United States Patent 7,314,750 (ADDRESSABLE OLIGONUCLEOTIDE ARRAY OF THE RAT GENOME) - sequence listing, part 12

SEQ ID NO: 415956 - DNA, 25 bp, Rattus norvegicus
ggaacagacccaagaccagcaccat

SEQ ID NO: 415957 - DNA, 25 bp, Rattus norvegicus
ggaacagacccatgaccagcaccat

SEQ ID NO: 415958 - DNA, 25 bp, Rattus norvegicus
ggaacagacctcaccagatgagtaa

SEQ ID NO: 415959 - DNA, 25 bp, Rattus norvegicus
ggaacagacctctccagatgagtaa

SEQ ID NO: 415960 - DNA, 25 bp, Rattus norvegicus
ggaacagacgttccctgctggttcg

SEQ ID NO: 415961 - DNA, 25 bp, Rattus norvegicus
ggaacagacgttgcctgctggttcg

SEQ ID NO: 415962 - DNA, 25 bp, Rattus norvegicus
ggaacagagaacaaactgccttttt

SEQ ID NO: 415963 - DNA, 25 bp, Rattus norvegicus
ggaacagagaactaactgccttttt

SEQ ID NO: 415964 - DNA, 25 bp, Rattus norvegicus
ggaacagaggtgacgccactcagct

SEQ ID NO: 415965 - DNA, 25 bp, Rattus norvegicus
ggaacagaggtgtcgccactcagct

SEQ ID NO: 415966 - DNA, 25 bp, Rattus norvegicus
ggaacagatcctcaagcagcgccgt

SEQ ID NO: 415967 - DNA, 25 bp, Rattus norvegicus
ggaacagatcctgaagcagcgccgt

SEQ ID NO: 415968 - DNA, 25 bp, Rattus norvegicus
ggaacagatcggacgcactgtcaga

SEQ ID NO: 415969 - DNA, 25 bp, Rattus norvegicus
ggaacagatcggtcgcactgtcaga

SEQ ID NO: 415970 - DNA, 25 bp, Rattus norvegicus
ggaacagatgacaccaccctggtca

SEQ ID NO: 415971 - DNA, 25 bp, Rattus norvegicus
ggaacagatgactccaccctggtca

SEQ ID NO: 415972 - DNA, 25 bp, Rattus norvegicus
ggaacagatgatccctgacctatgg

SEQ ID NO: 415973 - DNA, 25 bp, Rattus norvegicus
ggaacagatgatgcctgacctatgg

SEQ ID NO: 415974 - DNA, 25 bp, Rattus norvegicus
ggaacagatttcagtctgtctgaca

SEQ ID NO: 415975 - DNA, 25 bp, Rattus norvegicus
ggaacagatttctgtctgtctgaca

SEQ ID NO: 415976 - DNA, 25 bp, Rattus norvegicus
ggaacagcaagtcgaatggccttag

SEQ ID NO: 415977 - DNA, 25 bp, Rattus norvegicus
ggaacagcaagtggaatggccttag

SEQ ID NO: 415978 - DNA, 25 bp, Rattus norvegicus
ggaacagcagaaaggaaccccaccc

SEQ ID NO: 415979 - DNA, 25 bp, Rattus norvegicus
ggaacagcagaatggaaccccaccc

SEQ ID NO: 415980 - DNA, 25 bp, Rattus norvegicus
ggaacagcagccaatgtgaccacct

SEQ ID NO: 415981 - DNA, 25 bp, Rattus norvegicus
ggaacagcagcctatgtgaccacct

SEQ ID NO: 415982 - DNA, 25 bp, Rattus norvegicus
ggaacagcaggtccagcgcgcttcc

SEQ ID NO: 415983 - DNA, 25 bp, Rattus norvegicus
ggaacagcaggtgcagcgcgcttcc

SEQ ID NO: 415984 - DNA, 25 bp, Rattus norvegicus
ggaacagccactacgcagtgaccac

SEQ ID NO: 415985 - DNA, 25 bp, Rattus norvegicus
ggaacagccactcccaagaagagca

SEQ ID NO: 415986 - DNA, 25 bp, Rattus norvegicus
ggaacagccactgccaagaagagca

SEQ ID NO: 415987 - DNA, 25 bp, Rattus norvegicus
ggaacagccacttcgcagtgaccac

SEQ ID NO: 415988 - DNA, 25 bp, Rattus norvegicus
ggaacagccattagaagccagcctc

SEQ ID NO: 415989 - DNA, 25 bp, Rattus norvegicus
ggaacagccatttgaagccagcctc

SEQ ID NO: 415990 - DNA, 25 bp, Rattus norvegicus
ggaacagcccttagggccttgccaa

SEQ ID NO: 415991 - DNA, 25 bp, Rattus norvegicus
ggaacagccctttgggccttgccaa

SEQ ID NO: 415992 - DNA, 25 bp, Rattus norvegicus
ggaacagcctttccatctgaggcaa

SEQ ID NO: 415993 - DNA, 25 bp, Rattus norvegicus
ggaacagcctttgcatctgaggcaa

SEQ ID NO: 415994 - DNA, 25 bp, Rattus norvegicus
ggaacagcgagcacccaaatcaggg

SEQ ID NO: 415995 - DNA, 25 bp, Rattus norvegicus
ggaacagcgagctcccaaatcaggg

SEQ ID NO: 415996 - DNA, 25 bp, Rattus norvegicus
ggaacagcgtatcccatctatatgt

SEQ ID NO: 415997 - DNA, 25 bp, Rattus norvegicus
ggaacagcgtatgccatctatatgt

SEQ ID NO: 415998 - DNA, 25 bp, Rattus norvegicus
ggaacagctcatagtagccctgcag

SEQ ID NO: 415999 - DNA, 25 bp, Rattus norvegicus
ggaacagctcattgtagccctgcag

SEQ ID NO: 416000 - DNA, 25 bp, Rattus norvegicus
ggaacagctcgaaggcatagccaca

SEQ ID NO: 416001 - DNA, 25 bp, Rattus norvegicus
ggaacagctcgatggcatagccaca

SEQ ID NO: 416002 - DNA, 25 bp, Rattus norvegicus
ggaacagctcttcgaagacttcata

SEQ ID NO: 416003 - DNA, 25 bp, Rattus norvegicus
ggaacagctcttggaagacttcata

SEQ ID NO: 416004 - DNA, 25 bp, Rattus norvegicus
ggaacagctttaacccgtaatggag

SEQ ID NO: 416005 - DNA, 25 bp, Rattus norvegicus
ggaacagctttatcccgtaatggag

SEQ ID NO: 416006 - DNA, 25 bp, Rattus norvegicus
ggaacagctttgcacgcatcttaaa

SEQ ID NO: 416007 - DNA, 25 bp, Rattus norvegicus
ggaacagctttggacgcatcttaaa

SEQ ID NO: 416008 - DNA, 25 bp, Rattus norvegicus
ggaacaggcaacaattactacagaa

SEQ ID NO: 416009 - DNA, 25 bp, Rattus norvegicus
ggaacaggcaactattactacagaa

SEQ ID NO: 416010 - DNA, 25 bp, Rattus norvegicus
ggaacaggcactaggcaaattcatt

SEQ ID NO: 416011 - DNA, 25 bp, Rattus norvegicus
ggaacaggcacttggcaaattcatt

SEQ ID NO: 416012 - DNA, 25 bp, Rattus norvegicus
ggaacaggcaggcatttcccaccat

SEQ ID NO: 416013 - DNA, 25 bp, Rattus norvegicus
ggaacaggcagggatttcccaccat

SEQ ID NO: 416014 - DNA, 25 bp, Rattus norvegicus
ggaacaggccaacagctcgcaagaa

SEQ ID NO: 416015 - DNA, 25 bp, Rattus norvegicus
ggaacaggccaagagctcgcaagaa

SEQ ID NO: 416016 - DNA, 25 bp, Rattus norvegicus
ggaacaggccttactgattcggata

SEQ ID NO: 416017 - DNA, 25 bp, Rattus norvegicus
ggaacaggccttatgtgcacataca

SEQ ID NO: 416018 - DNA, 25 bp, Rattus norvegicus
ggaacaggcctttctgattcggata

SEQ ID NO: 416019 - DNA, 25 bp, Rattus norvegicus
ggaacaggccttttgtgcacataca

SEQ ID NO: 416020 - DNA, 25 bp, Rattus norvegicus
ggaacaggctcacatcagcactggg

SEQ ID NO: 416021 - DNA, 25 bp, Rattus norvegicus
ggaacaggctcagatcagcactggg

SEQ ID NO: 416022 - DNA, 25 bp, Rattus norvegicus
ggaacaggctttccaggcaccttta

SEQ ID NO: 416023 - DNA, 25 bp, Rattus norvegicus
ggaacaggctttccggttgctgaac

SEQ ID NO: 416024 - DNA, 25 bp, Rattus norvegicus
ggaacaggctttgcaggcaccttta

SEQ ID NO: 416025 - DNA, 25 bp, Rattus norvegicus
ggaacaggctttgcggttgctgaac

SEQ ID NO: 416026 - DNA, 25 bp, Rattus norvegicus
ggaacagggagcctgtgctcacctc

SEQ ID NO: 416027 - DNA, 25 bp, Rattus norvegicus
ggaacagggagcgtgtgctcacctc

SEQ ID NO: 416028 - DNA, 25 bp, Rattus norvegicus
ggaacagggccacattgtccattac

SEQ ID NO: 416029 - DNA, 25 bp, Rattus norvegicus
ggaacagggccagattgtccattac

SEQ ID NO: 416030 - DNA, 25 bp, Rattus norvegicus
ggaacagggcttcttttaccactga

SEQ ID NO: 416031 - DNA, 25 bp, Rattus norvegicus
ggaacagggcttgttttaccactga

SEQ ID NO: 416032 - DNA, 25 bp, Rattus norvegicus
ggaacagtatggcattagtcacttt

SEQ ID NO: 416033 - DNA, 25 bp, Rattus norvegicus
ggaacagtatgggattagtcacttt

SEQ ID NO: 416034 - DNA, 25 bp, Rattus norvegicus
ggaacagtcagacagtagacccaga

SEQ ID NO: 416035 - DNA, 25 bp, Rattus norvegicus
ggaacagtcagagagtagacccaga

SEQ ID NO: 416036 - DNA, 25 bp, Rattus norvegicus
ggaacagtccacagtatgtcggata

SEQ ID NO: 416037 - DNA, 25 bp, Rattus norvegicus
ggaacagtccactgtatgtcggata

SEQ ID NO: 416038 - DNA, 25 bp, Rattus norvegicus
ggaacagtccatcgtcgacttcctt

SEQ ID NO: 416039 - DNA, 25 bp, Rattus norvegicus
ggaacagtccatggtcgacttcctt

SEQ ID NO: 416040 - DNA, 25 bp, Rattus norvegicus
ggaacagtccctcatggtctggcac

SEQ ID NO: 416041 - DNA, 25 bp, Rattus norvegicus
ggaacagtccctgatggtctggcac

SEQ ID NO: 416042 - DNA, 25 bp, Rattus norvegicus
ggaacagtcgagagcccacaagggc

SEQ ID NO: 416043 - DNA, 25 bp, Rattus norvegicus
ggaacagtcgagtgcccacaagggc

SEQ ID NO: 416044 - DNA, 25 bp, Rattus norvegicus
ggaacagtcgatcctttctaacatt

SEQ ID NO: 416045 - DNA, 25 bp, Rattus norvegicus
ggaacagtcgatgctttctaacatt

SEQ ID NO: 416046 - DNA, 25 bp, Rattus norvegicus
ggaacagtcttacatttctcagtga

SEQ ID NO: 416047 - DNA, 25 bp, Rattus norvegicus
ggaacagtcttagatttctcagtga

SEQ ID NO: 416048 - DNA, 25 bp, Rattus norvegicus
ggaacagtctttcgcagtcttatca

SEQ ID NO: 416049 - DNA, 25 bp, Rattus norvegicus
ggaacagtctttggcagtcttatca

SEQ ID NO: 416050 - DNA, 25 bp, Rattus norvegicus
ggaacagtgacgcacgtctgtcagc

SEQ ID NO: 416051 - DNA, 25 bp, Rattus norvegicus
ggaacagtgacggacgtctgtcagc

SEQ ID NO: 416052 - DNA, 25 bp, Rattus norvegicus
ggaacagtgcccaccacattatcgt

SEQ ID NO: 416053 - DNA, 25 bp, Rattus norvegicus
ggaacagtgccctccacattatcgt

SEQ ID NO: 416054 - DNA, 25 bp, Rattus norvegicus
ggaacagtgctcaaccaatggcgcg

SEQ ID NO: 416055 - DNA, 25 bp, Rattus norvegicus
ggaacagtgctctaccaatggcgcg

SEQ ID NO: 416056 - DNA, 25 bp, Rattus norvegicus
ggaacagtggcaatgtctttctcgt

SEQ ID NO: 416057 - DNA, 25 bp, Rattus norvegicus
ggaacagtggcattgtctttctcgt

SEQ ID NO: 416058 - DNA, 25 bp, Rattus norvegicus
ggaacagtgtaaagctaaacgaata

SEQ ID NO: 416059 - DNA, 25 bp, Rattus norvegicus
ggaacagtgtaatgctaaacgaata

SEQ ID NO: 416060 - DNA, 25 bp, Rattus norvegicus
ggaacagtgtttctagatggcaaag

SEQ ID NO: 416061 - DNA, 25 bp, Rattus norvegicus
ggaacagtgtttgtagatggcaaag

SEQ ID NO: 416062 - DNA, 25 bp, Rattus norvegicus
ggaacagttagcactctcacttttg

SEQ ID NO: 416063 - DNA, 25 bp, Rattus norvegicus
ggaacagttagctctctcacttttg

SEQ ID NO: 416064 - DNA, 25 bp, Rattus norvegicus
ggaacagttcaaagtgtcccctggc

SEQ ID NO: 416065 - DNA, 25 bp, Rattus norvegicus
ggaacagttcaatgtgtcccctggc

SEQ ID NO: 416066 - DNA, 25 bp, Rattus norvegicus
ggaacagttccgaaagctctttatt

SEQ ID NO: 416067 - DNA, 25 bp, Rattus norvegicus
ggaacagttccgtaagctctttatt

SEQ ID NO: 416068 - DNA, 25 bp, Rattus norvegicus
ggaacagttgcaattcttagatctt

SEQ ID NO: 416069 - DNA, 25 bp, Rattus norvegicus
ggaacagttgcatttcttagatctt

SEQ ID NO: 416070 - DNA, 25 bp, Rattus norvegicus
ggaacagtttgaagatgaccagaaa

SEQ ID NO: 416071 - DNA, 25 bp, Rattus norvegicus
ggaacagtttgatgatgaccagaaa

SEQ ID NO: 416072 - DNA, 25 bp, Rattus norvegicus
ggaacagttttgaaggtgattacct

SEQ ID NO: 416073 - DNA, 25 bp, Rattus norvegicus
ggaacagttttgctcacctgccgga

SEQ ID NO: 416074 - DNA, 25 bp, Rattus norvegicus
ggaacagttttggtcacctgccgga

SEQ ID NO: 416075 - DNA, 25 bp, Rattus norvegicus
ggaacagttttgtaggtgattacct

SEQ ID NO: 416076 - DNA, 25 bp, Rattus norvegicus
ggaacatacgaaacagtctcttgca

SEQ ID NO: 416077 - DNA, 25 bp, Rattus norvegicus
ggaacatacgaatcagtctcttgca

SEQ ID NO: 416078 - DNA, 25 bp, Rattus norvegicus
ggaacatactgccattcgactctct

SEQ ID NO: 416079 - DNA, 25 bp, Rattus norvegicus
ggaacatactgcgattcgactctct

SEQ ID NO: 416080 - DNA, 25 bp, Rattus norvegicus
ggaacatagaccagctgtccttgaa

SEQ ID NO: 416081 - DNA, 25 bp, Rattus norvegicus
ggaacatagacctgctgtccttgaa

SEQ ID NO: 416082 - DNA, 25 bp, Rattus norvegicus
ggaacatagggcagcacaccgtttt

SEQ ID NO: 416083 - DNA, 25 bp, Rattus norvegicus
ggaacatagggctgcacaccgtttt

SEQ ID NO: 416084 - DNA, 25 bp, Rattus norvegicus
ggaacatatccacggccttttccag

SEQ ID NO: 416085 - DNA, 25 bp, Rattus norvegicus
ggaacatatccagggccttttccag

SEQ ID NO: 416086 - DNA, 25 bp, Rattus norvegicus
ggaacatatcctccaacctgactta

SEQ ID NO: 416087 - DNA, 25 bp, Rattus norvegicus
ggaacatatcctgcaacctgactta

SEQ ID NO: 416088 - DNA, 25 bp, Rattus norvegicus
ggaacatatgagcagatcctaactg

SEQ ID NO: 416089 - DNA, 25 bp, Rattus norvegicus
ggaacatatgaggagatcctaactg

SEQ ID NO: 416090 - DNA, 25 bp, Rattus norvegicus
ggaacatatttaccagtttctgata

SEQ ID NO: 416091 - DNA, 25 bp, Rattus norvegicus
ggaacatatttagcagtttctgata

SEQ ID NO: 416092 - DNA, 25 bp, Rattus norvegicus
ggaacatcaaacagtgccagcctat

SEQ ID NO: 416093 - DNA, 25 bp, Rattus norvegicus
ggaacatcaaactgtgccagcctat

SEQ ID NO: 416094 - DNA, 25 bp, Rattus norvegicus
ggaacatcagacctccagattcggt

SEQ ID NO: 416095 - DNA, 25 bp, Rattus norvegicus
ggaacatcagacgtccagattcggt

SEQ ID NO: 416096 - DNA, 25 bp, Rattus norvegicus
ggaacatcattcatctctggatctt

SEQ ID NO: 416097 - DNA, 25 bp, Rattus norvegicus
ggaacatcattcttctctggatctt

SEQ ID NO: 416098 - DNA, 25 bp, Rattus norvegicus
ggaacatccaagacataagcataca

SEQ ID NO: 416099 - DNA, 25 bp, Rattus norvegicus
ggaacatccaagtcataagcataca

SEQ ID NO: 416100 - DNA, 25 bp, Rattus norvegicus
ggaacatctccgaaactccctgtgg

SEQ ID NO: 416101 - DNA, 25 bp, Rattus norvegicus
ggaacatctccgtaactccctgtgg

SEQ ID NO: 416102 - DNA, 25 bp, Rattus norvegicus
ggaacatctgcacgaaccggagcct

SEQ ID NO: 416103 - DNA, 25 bp, Rattus norvegicus
ggaacatctgcaggaaccggagcct

SEQ ID NO: 416104 - DNA, 25 bp, Rattus norvegicus
ggaacatctggtagaaacatgtcat

SEQ ID NO: 416105 - DNA, 25 bp, Rattus norvegicus
ggaacatctggttgaaacatgtcat

SEQ ID NO: 416106 - DNA, 25 bp, Rattus norvegicus
ggaacatcttgccaaacgggccatg

SEQ ID NO: 416107 - DNA, 25 bp, Rattus norvegicus
ggaacatcttgcgaaacgggccatg

SEQ ID NO: 416108 - DNA, 25 bp, Rattus norvegicus
ggaacatctttgcttgaacttaagt

SEQ ID NO: 416109 - DNA, 25 bp, Rattus norvegicus
ggaacatctttggttgaacttaagt

SEQ ID NO: 416110 - DNA, 25 bp, Rattus norvegicus
ggaacatgaaatatgccttggccca

SEQ ID NO: 416111 - DNA, 25 bp, Rattus norvegicus
ggaacatgaaatttgccttggccca

SEQ ID NO: 416112 - DNA, 25 bp, Rattus norvegicus
ggaacatgaacaacctgctgcaaaa

SEQ ID NO: 416113 - DNA, 25 bp, Rattus norvegicus
ggaacatgaacatcctgctgcaaaa

SEQ ID NO: 416114 - DNA, 25 bp, Rattus norvegicus
ggaacatgcccgcttaaacaatcat

SEQ ID NO: 416115 - DNA, 25 bp, Rattus norvegicus
ggaacatgcccggttaaacaatcat

SEQ ID NO: 416116 - DNA, 25 bp, Rattus norvegicus
ggaacatgcctgatgtgcccagcca

SEQ ID NO: 416117 - DNA, 25 bp, Rattus norvegicus
ggaacatgcctgttgtgcccagcca

SEQ ID NO: 416118 - DNA, 25 bp, Rattus norvegicus
ggaacatgcgcaacttcatcctgtt

SEQ ID NO: 416119 - DNA, 25 bp, Rattus norvegicus
ggaacatgcgcatcttcatcctgtt

SEQ ID NO: 416120 - DNA, 25 bp, Rattus norvegicus
ggaacatggagacagtctccttcta

SEQ ID NO: 416121 - DNA, 25 bp, Rattus norvegicus
ggaacatggagagagtctccttcta

SEQ ID NO: 416122 - DNA, 25 bp, Rattus norvegicus
ggaacatggagccttccgatctgaa

SEQ ID NO: 416123 - DNA, 25 bp, Rattus norvegicus
ggaacatggagcgttccgatctgaa

SEQ ID NO: 416124 - DNA, 25 bp, Rattus norvegicus
ggaacatggccccaaggtctggcat

SEQ ID NO: 416125 - DNA, 25 bp, Rattus norvegicus
ggaacatggcccgaaggtctggcat

SEQ ID NO: 416126 - DNA, 25 bp, Rattus norvegicus
ggaacatgggcaagtactaccacac

SEQ ID NO: 416127 - DNA, 25 bp, Rattus norvegicus
ggaacatgggcatgtactaccacac

SEQ ID NO: 416128 - DNA, 25 bp, Rattus norvegicus
ggaacatggtatctttgaaaaacac

SEQ ID NO: 416129 - DNA, 25 bp, Rattus norvegicus
ggaacatggtatgtttgaaaaacac

SEQ ID NO: 416130 - DNA, 25 bp, Rattus norvegicus
ggaacatggtccagcaggtcggaaa

SEQ ID NO: 416131 - DNA, 25 bp, Rattus norvegicus
ggaacatggtcctgcaggtcggaaa

SEQ ID NO: 416132 - DNA, 25 bp, Rattus norvegicus
ggaacatgtccaagctgtctgacag

SEQ ID NO: 416133 - DNA, 25 bp, Rattus norvegicus
ggaacatgtccatgctgtctgacag

SEQ ID NO: 416134 - DNA, 25 bp, Rattus norvegicus
ggaacatgtgatagaggctctgcgc

SEQ ID NO: 416135 - DNA, 25 bp, Rattus norvegicus
ggaacatgtgattgaggctctgcgc

SEQ ID NO: 416136 - DNA, 25 bp, Rattus norvegicus
ggaacatgtgtgatagtgctctgta

SEQ ID NO: 416137 - DNA, 25 bp, Rattus norvegicus
ggaacatgtgtgttagtgctctgta

SEQ ID NO: 416138 - DNA, 25 bp, Rattus norvegicus
ggaacattaaacaatgctctggaac

SEQ ID NO: 416139 - DNA, 25 bp, Rattus norvegicus
ggaacattaaactatgctctggaac

SEQ ID NO: 416140 - DNA, 25 bp, Rattus norvegicus
ggaacattagtcctttaggtcacta

SEQ ID NO: 416141 - DNA, 25 bp, Rattus norvegicus
ggaacattagtcgtttaggtcacta

SEQ ID NO: 416142 - DNA, 25 bp, Rattus norvegicus
ggaacattatttccagtcggaggaa

SEQ ID NO: 416143 - DNA, 25 bp, Rattus norvegicus
ggaacattatttgcagtcggaggaa

SEQ ID NO: 416144 - DNA, 25 bp, Rattus norvegicus
ggaacattccagatctgaccttctc

SEQ ID NO: 416145 - DNA, 25 bp, Rattus norvegicus
ggaacattccagttctgaccttctc

SEQ ID NO: 416146 - DNA, 25 bp, Rattus norvegicus
ggaacattctaacccagttaccaga

SEQ ID NO: 416147 - DNA, 25 bp, Rattus norvegicus
ggaacattctaagccagttaccaga

SEQ ID NO: 416148 - DNA, 25 bp, Rattus norvegicus
ggaacattctggatgggctcactac

SEQ ID NO: 416149 - DNA, 25 bp, Rattus norvegicus
ggaacattctggttgggctcactac

SEQ ID NO: 416150 - DNA, 25 bp, Rattus norvegicus
ggaacattctgtataatttatgaca

SEQ ID NO: 416151 - DNA, 25 bp, Rattus norvegicus
ggaacattctgtttaatttatgaca

SEQ ID NO: 416152 - DNA, 25 bp, Rattus norvegicus
ggaacattgcatccttggctcagtg

SEQ ID NO: 416153 - DNA, 25 bp, Rattus norvegicus
ggaacattgcatgcttggctcagtg

SEQ ID NO: 416154 - DNA, 25 bp, Rattus norvegicus
ggaacattggtgaaccctgtgggac

SEQ ID NO: 416155 - DNA, 25 bp, Rattus norvegicus
ggaacattggtgtaccctgtgggac

SEQ ID NO: 416156 - DNA, 25 bp, Rattus norvegicus
ggaacattggttctaacacccacat

SEQ ID NO: 416157 - DNA, 25 bp, Rattus norvegicus
ggaacattggttgtaacacccacat

SEQ ID NO: 416158 - DNA, 25 bp, Rattus norvegicus
ggaacattgtagaagccgctgcagt

SEQ ID NO: 416159 - DNA, 25 bp, Rattus norvegicus
ggaacattgtagtagccgctgcagt

SEQ ID NO: 416160 - DNA, 25 bp, Rattus norvegicus
ggaacattgttcatagtgccagcat

SEQ ID NO: 416161 - DNA, 25 bp, Rattus norvegicus
ggaacattgttcttagtgccagcat

SEQ ID NO: 416162 - DNA, 25 bp, Rattus norvegicus
ggaacatttcctacccagggtatgt

SEQ ID NO: 416163 - DNA, 25 bp, Rattus norvegicus
ggaacatttccttcccagggtatgt

SEQ ID NO: 416164 - DNA, 25 bp, Rattus norvegicus
ggaacattttgcagagctgtccctt

SEQ ID NO: 416165 - DNA, 25 bp, Rattus norvegicus
ggaacattttgctgagctgtccctt

SEQ ID NO: 416166 - DNA, 25 bp, Rattus norvegicus
ggaacatttttactcattagctgga

SEQ ID NO: 416167 - DNA, 25 bp, Rattus norvegicus
ggaacatttttagtcattagctgga

SEQ ID NO: 416168 - DNA, 25 bp, Rattus norvegicus
ggaaccaaaatgctaagtactcagt

SEQ ID NO: 416169 - DNA, 25 bp, Rattus norvegicus
ggaaccaaaatggtaagtactcagt

SEQ ID NO: 416170 - DNA, 25 bp, Rattus norvegicus
ggaaccaaactaagtgtcaccttca

SEQ ID NO: 416171 - DNA, 25 bp, Rattus norvegicus
ggaaccaaactatgtgtcaccttca

SEQ ID NO: 416172 - DNA, 25 bp, Rattus norvegicus
ggaaccaaatggactgtcagttgaa

SEQ ID NO: 416173 - DNA, 25 bp, Rattus norvegicus
ggaaccaaatggtctgtcagttgaa

SEQ ID NO: 416174 - DNA, 25 bp, Rattus norvegicus
ggaaccaacaacagcagctccattt

SEQ ID NO: 416175 - DNA, 25 bp, Rattus norvegicus
ggaaccaacaactgcagctccattt

SEQ ID NO: 416176 - DNA, 25 bp, Rattus norvegicus
ggaaccaacatcctgaagtttgtgt

SEQ ID NO: 416177 - DNA, 25 bp, Rattus norvegicus
ggaaccaacatcgtgaagtttgtgt

SEQ ID NO: 416178 - DNA, 25 bp, Rattus norvegicus
ggaaccaactccaatcctgattaat

SEQ ID NO: 416179 - DNA, 25 bp, Rattus norvegicus
ggaaccaactcctatcctgattaat

SEQ ID NO: 416180 - DNA, 25 bp, Rattus norvegicus
ggaaccaactgacattctatctgtg

SEQ ID NO: 416181 - DNA, 25 bp, Rattus norvegicus
ggaaccaactgagattctatctgtg

SEQ ID NO: 416182 - DNA, 25 bp, Rattus norvegicus
ggaaccaagaaccatccatttcaaa

SEQ ID NO: 416183 - DNA, 25 bp, Rattus norvegicus
ggaaccaagaacgatccatttcaaa

SEQ ID NO: 416184 - DNA, 25 bp, Rattus norvegicus
ggaaccaagatgacccttcctgaag

SEQ ID NO: 416185 - DNA, 25 bp, Rattus norvegicus
ggaaccaagatgtcccttcctgaag

SEQ ID NO: 416186 - DNA, 25 bp, Rattus norvegicus
ggaaccaagcctccctagagagtta

SEQ ID NO: 416187 - DNA, 25 bp, Rattus norvegicus
ggaaccaagcctgcctagagagtta

SEQ ID NO: 416188 - DNA, 25 bp, Rattus norvegicus
ggaaccaaggaactggctacgactc

SEQ ID NO: 416189 - DNA, 25 bp, Rattus norvegicus
ggaaccaaggaagtggctacgactc

SEQ ID NO: 416190 - DNA, 25 bp, Rattus norvegicus
ggaaccaaggcccagcactgtaccg

SEQ ID NO: 416191 - DNA, 25 bp, Rattus norvegicus
ggaaccaaggccgagcactgtaccg

SEQ ID NO: 416192 - DNA, 25 bp, Rattus norvegicus
ggaaccaaggctcacatcggtgttg

SEQ ID NO: 416193 - DNA, 25 bp, Rattus norvegicus
ggaaccaaggctgacatcggtgttg

SEQ ID NO: 416194 - DNA, 25 bp, Rattus norvegicus
ggaaccaagtccctcatggatgagg

SEQ ID NO: 416195 - DNA, 25 bp, Rattus norvegicus
ggaaccaagtccctgtgttgtaatt

SEQ ID NO: 416196 - DNA, 25 bp, Rattus norvegicus
ggaaccaagtccgtcatggatgagg

SEQ ID NO: 416197 - DNA, 25 bp, Rattus norvegicus
ggaaccaagtccgtgtgttgtaatt

SEQ ID NO: 416198 - DNA, 25 bp, Rattus norvegicus
ggaaccaagtggagagacgccctcg

SEQ ID NO: 416199 - DNA, 25 bp, Rattus norvegicus
ggaaccaagtggtgagacgccctcg

SEQ ID NO: 416200 - DNA, 25 bp, Rattus norvegicus
ggaaccaagtgtagcccaagtgaac

SEQ ID NO: 416201 - DNA, 25 bp, Rattus norvegicus
ggaaccaagtgttgcccaagtgaac

SEQ ID NO: 416202 - DNA, 25 bp, Rattus norvegicus
ggaaccaagttaccctggactccgg

SEQ ID NO: 416203 - DNA, 25 bp, Rattus norvegicus
ggaaccaagttagcctggactccgg

SEQ ID NO: 416204 - DNA, 25 bp, Rattus norvegicus
ggaaccaataaaaccctcagagaag

SEQ ID NO: 416205 - DNA, 25 bp, Rattus norvegicus
ggaaccaataaatccctcagagaag

SEQ ID NO: 416206 - DNA, 25 bp, Rattus norvegicus
ggaaccaatagccacaatttcttgt

SEQ ID NO: 416207 - DNA, 25 bp, Rattus norvegicus
ggaaccaatagcgacaatttcttgt

SEQ ID NO: 416208 - DNA, 25 bp, Rattus norvegicus
ggaaccaatccacaattcttgcagc

SEQ ID NO: 416209 - DNA, 25 bp, Rattus norvegicus
ggaaccaatccagaattcttgcagc

SEQ ID NO: 416210 - DNA, 25 bp, Rattus norvegicus
ggaaccaatgcgcaacagccacttc

SEQ ID NO: 416211 - DNA, 25 bp, Rattus norvegicus
ggaaccaatgcggaacagccacttc

SEQ ID NO: 416212 - DNA, 25 bp, Rattus norvegicus
ggaaccaattaacctgtctgtgaaa

SEQ ID NO: 416213 - DNA, 25 bp, Rattus norvegicus
ggaaccaattaagctgtctgtgaaa

SEQ ID NO: 416214 - DNA, 25 bp, Rattus norvegicus
ggaaccaatttgaggagcattgtga

SEQ ID NO: 416215 - DNA, 25 bp, Rattus norvegicus
ggaaccaatttgtggagcattgtga

SEQ ID NO: 416216 - DNA, 25 bp, Rattus norvegicus
ggaaccacaatgacctgaatagctt

SEQ ID NO: 416217 - DNA, 25 bp, Rattus norvegicus
ggaaccacaatgtcctgaatagctt

SEQ ID NO: 416218 - DNA, 25 bp, Rattus norvegicus
ggaaccacacatacactgagaggat

SEQ ID NO: 416219 - DNA, 25 bp, Rattus norvegicus
ggaaccacacattcactgagaggat

SEQ ID NO: 416220 - DNA, 25 bp, Rattus norvegicus
ggaaccacaccaatgatatcttcat

SEQ ID NO: 416221 - DNA, 25 bp, Rattus norvegicus
ggaaccacaccattgatatcttcat

SEQ ID NO: 416222 - DNA, 25 bp, Rattus norvegicus
ggaaccacactgcaatgtgtcatgg

SEQ ID NO: 416223 - DNA, 25 bp, Rattus norvegicus
ggaaccacactggaatgtgtcatgg

SEQ ID NO: 416224 - DNA, 25 bp, Rattus norvegicus
ggaaccacagacagctgtgctgtat

SEQ ID NO: 416225 - DNA, 25 bp, Rattus norvegicus
ggaaccacagactgctgtgctgtat

SEQ ID NO: 416226 - DNA, 25 bp, Rattus norvegicus
ggaaccacagagacaaaggccccag

SEQ ID NO: 416227 - DNA, 25 bp, Rattus norvegicus
ggaaccacagagtcaaaggccccag

SEQ ID NO: 416228 - DNA, 25 bp, Rattus norvegicus
ggaaccacagtgacttcattctgtt

SEQ ID NO: 416229 - DNA, 25 bp, Rattus norvegicus
ggaaccacagtgtcttcattctgtt

SEQ ID NO: 416230 - DNA, 25 bp, Rattus norvegicus
ggaaccacatcaaggatctttgtat

SEQ ID NO: 416231 - DNA, 25 bp, Rattus norvegicus
ggaaccacatcatggatctttgtat

SEQ ID NO: 416232 - DNA, 25 bp, Rattus norvegicus
ggaaccacattcattgagctctctt

SEQ ID NO: 416233 - DNA, 25 bp, Rattus norvegicus
ggaaccacattctttgagctctctt

SEQ ID NO: 416234 - DNA, 25 bp, Rattus norvegicus
ggaaccaccatcaagtaatctcttt

SEQ ID NO: 416235 - DNA, 25 bp, Rattus norvegicus
ggaaccaccatctagtaatctcttt

SEQ ID NO: 416236 - DNA, 25 bp, Rattus norvegicus
ggaaccacgacaagcacaataaaac

SEQ ID NO: 416237 - DNA, 25 bp, Rattus norvegicus
ggaaccacgacatgcacaataaaac

SEQ ID NO: 416238 - DNA, 25 bp, Rattus norvegicus
ggaaccacgagtcactttgcacaaa

SEQ ID NO: 416239 - DNA, 25 bp, Rattus norvegicus
ggaaccacgagtgactttgcacaaa

SEQ ID NO: 416240 - DNA, 25 bp, Rattus norvegicus
ggaaccactattagcgttctcttcc

SEQ ID NO: 416241 - DNA, 25 bp, Rattus norvegicus
ggaaccactatttgcgttctcttcc

SEQ ID NO: 416242 - DNA, 25 bp, Rattus norvegicus
ggaaccactctcacagaactatagg

SEQ ID NO: 416243 - DNA, 25 bp, Rattus norvegicus
ggaaccactctctcagaactatagg

SEQ ID NO: 416244 - DNA, 25 bp, Rattus norvegicus
ggaaccactcttatatagtccccat

SEQ ID NO: 416245 - DNA, 25 bp, Rattus norvegicus
ggaaccactcttttatagtccccat

SEQ ID NO: 416246 - DNA, 25 bp, Rattus norvegicus
ggaaccactggacttcaagcatcat

SEQ ID NO: 416247 - DNA, 25 bp, Rattus norvegicus
ggaaccactggagttcaagcatcat

SEQ ID NO: 416248 - DNA, 25 bp, Rattus norvegicus
ggaaccactttaattgtcatgatca

SEQ ID NO: 416249 - DNA, 25 bp, Rattus norvegicus
ggaaccactttatttgtcatgatca

SEQ ID NO: 416250 - DNA, 25 bp, Rattus norvegicus
ggaaccactttgataaccagcatct

SEQ ID NO: 416251 - DNA, 25 bp, Rattus norvegicus
ggaaccactttgttaaccagcatct

SEQ ID NO: 416252 - DNA, 25 bp, Rattus norvegicus
ggaaccagaccccagaccaagtggt

SEQ ID NO: 416253 - DNA, 25 bp, Rattus norvegicus
ggaaccagacccgagaccaagtggt

SEQ ID NO: 416254 - DNA, 25 bp, Rattus norvegicus
ggaaccagaggtcatccctggacct

SEQ ID NO: 416255 - DNA, 25 bp, Rattus norvegicus
ggaaccagaggtgatccctggacct

SEQ ID NO: 416256 - DNA, 25 bp, Rattus norvegicus
ggaaccagattgagaattaccaact

SEQ ID NO: 416257 - DNA, 25 bp, Rattus norvegicus
ggaaccagattgtgaattaccaact

SEQ ID NO: 416258 - DNA, 25 bp, Rattus norvegicus
ggaaccagcagaaattcctccggga

SEQ ID NO: 416259 - DNA, 25 bp, Rattus norvegicus
ggaaccagcagatattcctccggga

SEQ ID NO: 416260 - DNA, 25 bp, Rattus norvegicus
ggaaccagcagcagcttgatgacct

SEQ ID NO: 416261 - DNA, 25 bp, Rattus norvegicus
ggaaccagcagctgcttgatgacct

SEQ ID NO: 416262 - DNA, 25 bp, Rattus norvegicus
ggaaccagccatcgctagaacagct

SEQ ID NO: 416263 - DNA, 25 bp, Rattus norvegicus
ggaaccagccatggctagaacagct

SEQ ID NO: 416264 - DNA, 25 bp, Rattus norvegicus
ggaaccagccccacttttctatata

SEQ ID NO: 416265 - DNA, 25 bp, Rattus norvegicus
ggaaccagcccctcttttctatata

SEQ ID NO: 416266 - DNA, 25 bp, Rattus norvegicus
ggaaccaggattagagctgcaaatt

SEQ ID NO: 416267 - DNA, 25 bp, Rattus norvegicus
ggaaccaggatttgagctgcaaatt

SEQ ID NO: 416268 - DNA, 25 bp, Rattus norvegicus
ggaaccaggcccaggcagtagtctg

SEQ ID NO: 416269 - DNA, 25 bp, Rattus norvegicus
ggaaccaggccctggcagtagtctg

SEQ ID NO: 416270 - DNA, 25 bp, Rattus norvegicus
ggaaccagtttcagcacgaactaga

SEQ ID NO: 416271 - DNA, 25 bp, Rattus norvegicus
ggaaccagtttctgcacgaactaga

SEQ ID NO: 416272 - DNA, 25 bp, Rattus norvegicus
ggaaccatagagacacggccaataa

SEQ ID NO: 416273 - DNA, 25 bp, Rattus norvegicus
ggaaccatagagtcacggccaataa

SEQ ID NO: 416274 - DNA, 25 bp, Rattus norvegicus
ggaaccatatggaccagattctctt

SEQ ID NO: 416275 - DNA, 25 bp, Rattus norvegicus
ggaaccatatggtccagattctctt

SEQ ID NO: 416276 - DNA, 25 bp, Rattus norvegicus
ggaaccatccccagggatcaggaat

SEQ ID NO: 416277 - DNA, 25 bp, Rattus norvegicus
ggaaccatcccctgggatcaggaat

SEQ ID NO: 416278 - DNA, 25 bp, Rattus norvegicus
ggaaccatcctgctctcaactacaa

SEQ ID NO: 416279 - DNA, 25 bp, Rattus norvegicus
ggaaccatcctggtctcaactacaa

SEQ ID NO: 416280 - DNA, 25 bp, Rattus norvegicus
ggaaccatgaaccttgctttgagcc

SEQ ID NO: 416281 - DNA, 25 bp, Rattus norvegicus
ggaaccatgaacgttgctttgagcc

SEQ ID NO: 416282 - DNA, 25 bp, Rattus norvegicus
ggaaccatgaatatgtacactgtgc

SEQ ID NO: 416283 - DNA, 25 bp, Rattus norvegicus
ggaaccatgaatttgtacactgtgc

SEQ ID NO: 416284 - DNA, 25 bp, Rattus norvegicus
ggaaccatgagacgtctgcttcaac

SEQ ID NO: 416285 - DNA, 25 bp, Rattus norvegicus
ggaaccatgagaggtctgcttcaac

SEQ ID NO: 416286 - DNA, 25 bp, Rattus norvegicus
ggaaccatggatatgatccccagag

SEQ ID NO: 416287 - DNA, 25 bp, Rattus norvegicus
ggaaccatggatttgatccccagag

SEQ ID NO: 416288 - DNA, 25 bp, Rattus norvegicus
ggaaccatggtgactgtcccattaa

SEQ ID NO: 416289 - DNA, 25 bp, Rattus norvegicus
ggaaccatggtgtctgtcccattaa

SEQ ID NO: 416290 - DNA, 25 bp, Rattus norvegicus
ggaaccatgtcaagccttactaggc

SEQ ID NO: 416291 - DNA, 25 bp, Rattus norvegicus
ggaaccatgtcatgccttactaggc

SEQ ID NO: 416292 - DNA, 25 bp, Rattus norvegicus
ggaaccatgtcgagtgagccaccat

SEQ ID NO: 416293 - DNA, 25 bp, Rattus norvegicus
ggaaccatgtcgtgtgagccaccat

SEQ ID NO: 416294 - DNA, 25 bp, Rattus norvegicus
ggaaccatgtgaaaccttccaccgt

SEQ ID NO: 416295 - DNA, 25 bp, Rattus norvegicus
ggaaccatgtgataccttccaccgt

SEQ ID NO: 416296 - DNA, 25 bp, Rattus norvegicus
ggaaccatgttgagaagcttcttaa

SEQ ID NO: 416297 - DNA, 25 bp, Rattus norvegicus
ggaaccatgttgtgaagcttcttaa

SEQ ID NO: 416298 - DNA, 25 bp, Rattus norvegicus
ggaaccattaacagactccctgtgc

SEQ ID NO: 416299 - DNA, 25 bp, Rattus norvegicus
ggaaccattaactgactccctgtgc

SEQ ID NO: 416300 - DNA, 25 bp, Rattus norvegicus
ggaaccattaggcaccagccatgca

SEQ ID NO: 416301 - DNA, 25 bp, Rattus norvegicus
ggaaccattagggaccagccatgca

SEQ ID NO: 416302 - DNA, 25 bp, Rattus norvegicus
ggaaccattggtactcacagaacct

SEQ ID NO: 416303 - DNA, 25 bp, Rattus norvegicus
ggaaccattggttctcacagaacct

SEQ ID NO: 416304 - DNA, 25 bp, Rattus norvegicus
ggaaccatttcccaacaacgtggat

SEQ ID NO: 416305 - DNA, 25 bp, Rattus norvegicus
ggaaccatttccgaacaacgtggat

SEQ ID NO: 416306 - DNA, 25 bp, Rattus norvegicus
ggaacccaaagacctctgcttgtct

SEQ ID NO: 416307 - DNA, 25 bp, Rattus norvegicus
ggaacccaaagagctctgcttgtct

SEQ ID NO: 416308 - DNA, 25 bp, Rattus norvegicus
ggaacccaaggcaagtcctcagtgg

SEQ ID NO: 416309 - DNA, 25 bp, Rattus norvegicus
ggaacccaaggcacagagtccctga

SEQ ID NO: 416310 - DNA, 25 bp, Rattus norvegicus
ggaacccaaggctagtcctcagtgg

SEQ ID NO: 416311 - DNA, 25 bp, Rattus norvegicus
ggaacccaaggctcagagtccctga

SEQ ID NO: 416312 - DNA, 25 bp, Rattus norvegicus
ggaacccaatatcttagaccctgtt

SEQ ID NO: 416313 - DNA, 25 bp, Rattus norvegicus
ggaacccaatatgttagaccctgtt

SEQ ID NO: 416314 - DNA, 25 bp, Rattus norvegicus
ggaacccaatctcttttgcgatgaa

SEQ ID NO: 416315 - DNA, 25 bp, Rattus norvegicus
ggaacccaatctgttttgcgatgaa

SEQ ID NO: 416316 - DNA, 25 bp, Rattus norvegicus
ggaacccaatgaagtccgactggaa

SEQ ID NO: 416317 - DNA, 25 bp, Rattus norvegicus
ggaacccaatgatgtccgactggaa

SEQ ID NO: 416318 - DNA, 25 bp, Rattus norvegicus
ggaacccaatttacttatggacaga

SEQ ID NO: 416319 - DNA, 25 bp, Rattus norvegicus
ggaacccaattttcttatggacaga

SEQ ID NO: 416320 - DNA, 25 bp, Rattus norvegicus
ggaacccacaaaatcttaggctatt

SEQ ID NO: 416321 - DNA, 25 bp, Rattus norvegicus
ggaacccacaaattcttaggctatt

SEQ ID NO: 416322 - DNA, 25 bp, Rattus norvegicus
ggaacccacattaagaaagccaaca

SEQ ID NO: 416323 - DNA, 25 bp, Rattus norvegicus
ggaacccacatttagaaagccaaca

SEQ ID NO: 416324 - DNA, 25 bp, Rattus norvegicus
ggaacccacctccacaagtagtaat

SEQ ID NO: 416325 - DNA, 25 bp, Rattus norvegicus
ggaacccacctcgacaagtagtaat

SEQ ID NO: 416326 - DNA, 25 bp, Rattus norvegicus
ggaacccactggagtgtctggctaa

SEQ ID NO: 416327 - DNA, 25 bp, Rattus norvegicus
ggaacccactggtgtgtctggctaa

SEQ ID NO: 416328 - DNA, 25 bp, Rattus norvegicus
ggaacccagactcgcgccctggatg

SEQ ID NO: 416329 - DNA, 25 bp, Rattus norvegicus
ggaacccagactggcgccctggatg

SEQ ID NO: 416330 - DNA, 25 bp, Rattus norvegicus
ggaacccagagccatctcatgatgt

SEQ ID NO: 416331 - DNA, 25 bp, Rattus norvegicus
ggaacccagagcgatctcatgatgt

SEQ ID NO: 416332 - DNA, 25 bp, Rattus norvegicus
ggaacccagcaaaatacttaaccta

SEQ ID NO: 416333 - DNA, 25 bp, Rattus norvegicus
ggaacccagcaatatacttaaccta

SEQ ID NO: 416334 - DNA, 25 bp, Rattus norvegicus
ggaacccaggctactttcataatga

SEQ ID NO: 416335 - DNA, 25 bp, Rattus norvegicus
ggaacccaggcttctttcataatga

SEQ ID NO: 416336 - DNA, 25 bp, Rattus norvegicus
ggaacccagggaatttgtccatcag

SEQ ID NO: 416337 - DNA, 25 bp, Rattus norvegicus
ggaacccagggattttgtccatcag

SEQ ID NO: 416338 - DNA, 25 bp, Rattus norvegicus
ggaacccagtggaatattcctcggt

SEQ ID NO: 416339 - DNA, 25 bp, Rattus norvegicus
ggaacccagtggtatattcctcggt

SEQ ID NO: 416340 - DNA, 25 bp, Rattus norvegicus
ggaacccataacaggattcactcta

SEQ ID NO: 416341 - DNA, 25 bp, Rattus norvegicus
ggaacccataactggattcactcta

SEQ ID NO: 416342 - DNA, 25 bp, Rattus norvegicus
ggaacccataccaatgtaatttcaa

SEQ ID NO: 416343 - DNA, 25 bp, Rattus norvegicus
ggaacccatacctatgtaatttcaa

SEQ ID NO: 416344 - DNA, 25 bp, Rattus norvegicus
ggaacccatataaccattataccat

SEQ ID NO: 416345 - DNA, 25 bp, Rattus norvegicus
ggaacccatatatccattataccat

SEQ ID NO: 416346 - DNA, 25 bp, Rattus norvegicus
ggaacccatcttccatgatgtgaga

SEQ ID NO: 416347 - DNA, 25 bp, Rattus norvegicus
ggaacccatcttgcatgatgtgaga

SEQ ID NO: 416348 - DNA, 25 bp, Rattus norvegicus
ggaacccatggcaactcatacattc

SEQ ID NO: 416349 - DNA, 25 bp, Rattus norvegicus
ggaacccatggctactcatacattc

SEQ ID NO: 416350 - DNA, 25 bp, Rattus norvegicus
ggaacccatgtaagctggcctttcc

SEQ ID NO: 416351 - DNA, 25 bp, Rattus norvegicus
ggaacccatgtatgctggcctttcc

SEQ ID NO: 416352 - DNA, 25 bp, Rattus norvegicus
ggaaccccaaaacagttgtgaacag

SEQ ID NO: 416353 - DNA, 25 bp, Rattus norvegicus
ggaaccccaaaagagttgtgaacag

SEQ ID NO: 416354 - DNA, 25 bp, Rattus norvegicus
ggaaccccagccattgagtttatat

SEQ ID NO: 416355 - DNA, 25 bp, Rattus norvegicus
ggaaccccagcctttgagtttatat

SEQ ID NO: 416356 - DNA, 25 bp, Rattus norvegicus
ggaaccccagttcaaatgtcaacag

SEQ ID NO: 416357 - DNA, 25 bp, Rattus norvegicus
ggaaccccagttgaaatgtcaacag

SEQ ID NO: 416358 - DNA, 25 bp, Rattus norvegicus
ggaacccctcagaggtatccagtga

SEQ ID NO: 416359 - DNA, 25 bp, Rattus norvegicus
ggaacccctcagtggtatccagtga

SEQ ID NO: 416360 - DNA, 25 bp, Rattus norvegicus
ggaacccgctctagttcacgtggaa

SEQ ID NO: 416361 - DNA, 25 bp, Rattus norvegicus
ggaacccgctcttgttcacgtggaa

SEQ ID NO: 416362 - DNA, 25 bp, Rattus norvegicus
ggaaccctaactacacaccaggaga

SEQ ID NO: 416363 - DNA, 25 bp, Rattus norvegicus
ggaaccctaacttcacaccaggaga

SEQ ID NO: 416364 - DNA, 25 bp, Rattus norvegicus
ggaaccctaagcagactttagcttt

SEQ ID NO: 416365 - DNA, 25 bp, Rattus norvegicus
ggaaccctaagctgactttagcttt

SEQ ID NO: 416366 - DNA, 25 bp, Rattus norvegicus
ggaaccctaggaattgtatgcaaag

SEQ ID NO: 416367 - DNA, 25 bp, Rattus norvegicus
ggaaccctaggatttgtatgcaaag

SEQ ID NO: 416368 - DNA, 25 bp, Rattus norvegicus
ggaaccctcacaccaaggagactta

SEQ ID NO: 416369 - DNA, 25 bp, Rattus norvegicus
ggaaccctcacagcaaggagactta

SEQ ID NO: 416370 - DNA, 25 bp, Rattus norvegicus
ggaaccctctcacagtgcagttcta

SEQ ID NO: 416371 - DNA, 25 bp, Rattus norvegicus
ggaaccctctcagagtgcagttcta

SEQ ID NO: 416372 - DNA, 25 bp, Rattus norvegicus
ggaaccctctgtattgcaccaaact

SEQ ID NO: 416373 - DNA, 25 bp, Rattus norvegicus
ggaaccctctgttttgcaccaaact

SEQ ID NO: 416374 - DNA, 25 bp, Rattus norvegicus
ggaaccctgatcctcagacagtagt

SEQ ID NO: 416375 - DNA, 25 bp, Rattus norvegicus
ggaaccctgatcgtcagacagtagt

SEQ ID NO: 416376 - DNA, 25 bp, Rattus norvegicus
ggaaccctggagatcattacactac

SEQ ID NO: 416377 - DNA, 25 bp, Rattus norvegicus
ggaaccctggagttcattacactac

SEQ ID NO: 416378 - DNA, 25 bp, Rattus norvegicus
ggaaccctggtgcacagaagtccca

SEQ ID NO: 416379 - DNA, 25 bp, Rattus norvegicus
ggaaccctggtggacagaagtccca

SEQ ID NO: 416380 - DNA, 25 bp, Rattus norvegicus
ggaaccctgtgaaccactgctgttt

SEQ ID NO: 416381 - DNA, 25 bp, Rattus norvegicus
ggaaccctgtgaacggagcctcaag

SEQ ID NO: 416382 - DNA, 25 bp, Rattus norvegicus
ggaaccctgtgatccactgctgttt

SEQ ID NO: 416383 - DNA, 25 bp, Rattus norvegicus
ggaaccctgtgatcggagcctcaag

SEQ ID NO: 416384 - DNA, 25 bp, Rattus norvegicus
ggaacccttactcttgttgggacag

SEQ ID NO: 416385 - DNA, 25 bp, Rattus norvegicus
ggaacccttactgttgttgggacag

SEQ ID NO: 416386 - DNA, 25 bp, Rattus norvegicus
ggaacccttcagctctcgtaggaag

SEQ ID NO: 416387 - DNA, 25 bp, Rattus norvegicus
ggaacccttcaggtctcgtaggaag

SEQ ID NO: 416388 - DNA, 25 bp, Rattus norvegicus
ggaacccttcgtccgatgagaaaca

SEQ ID NO: 416389 - DNA, 25 bp, Rattus norvegicus
ggaacccttcgtgcgatgagaaaca

SEQ ID NO: 416390 - DNA, 25 bp, Rattus norvegicus
ggaacccttctcacctctgagaaag

SEQ ID NO: 416391 - DNA, 25 bp, Rattus norvegicus
ggaacccttctctcctctgagaaag

SEQ ID NO: 416392 - DNA, 25 bp, Rattus norvegicus
ggaacccttctgaacacgatgaggc

SEQ ID NO: 416393 - DNA, 25 bp, Rattus norvegicus
ggaacccttctgtacacgatgaggc

SEQ ID NO: 416394 - DNA, 25 bp, Rattus norvegicus
ggaacccttgcacaagcacttcctg

SEQ ID NO: 416395 - DNA, 25 bp, Rattus norvegicus
ggaacccttgcagaagcacttcctg

SEQ ID NO: 416396 - DNA, 25 bp, Rattus norvegicus
ggaacccttgctcggttaattaatg

SEQ ID NO: 416397 - DNA, 25 bp, Rattus norvegicus
ggaacccttgctgggttaattaatg

SEQ ID NO: 416398 - DNA, 25 bp, Rattus norvegicus
ggaacccttgttcctattctatagg

SEQ ID NO: 416399 - DNA, 25 bp, Rattus norvegicus
ggaacccttgttgctattctatagg

SEQ ID NO: 416400 - DNA, 25 bp, Rattus norvegicus
ggaaccgaaggacttatgcgtgcta

SEQ ID NO: 416401 - DNA, 25 bp, Rattus norvegicus
ggaaccgaaggagttatgcgtgcta

SEQ ID NO: 416402 - DNA, 25 bp, Rattus norvegicus
ggaaccgacgttacagatatatatt

SEQ ID NO: 416403 - DNA, 25 bp, Rattus norvegicus
ggaaccgacgtttcagatatatatt

SEQ ID NO: 416404 - DNA, 25 bp, Rattus norvegicus
ggaaccgactcaccagagctcgagg

SEQ ID NO: 416405 - DNA, 25 bp, Rattus norvegicus
ggaaccgactcagcagagctcgagg

SEQ ID NO: 416406 - DNA, 25 bp, Rattus norvegicus
ggaaccgagactcactcttcacagg

SEQ ID NO: 416407 - DNA, 25 bp, Rattus norvegicus
ggaaccgagactgactcttcacagg

SEQ ID NO: 416408 - DNA, 25 bp, Rattus norvegicus
ggaaccgagtacatctgcaaaacct

SEQ ID NO: 416409 - DNA, 25 bp, Rattus norvegicus
ggaaccgagtacttctgcaaaacct

SEQ ID NO: 416410 - DNA, 25 bp, Rattus norvegicus
ggaaccgagtttagcgattcatatt

SEQ ID NO: 416411 - DNA, 25 bp, Rattus norvegicus
ggaaccgagtttcgccgaccatgaa

SEQ ID NO: 416412 - DNA, 25 bp, Rattus norvegicus
ggaaccgagtttggccgaccatgaa

SEQ ID NO: 416413 - DNA, 25 bp, Rattus norvegicus
ggaaccgagttttgcgattcatatt

SEQ ID NO: 416414 - DNA, 25 bp, Rattus norvegicus
ggaaccgcattccagggaaacctct

SEQ ID NO: 416415 - DNA, 25 bp, Rattus norvegicus
ggaaccgcattcgagggaaacctct

SEQ ID NO: 416416 - DNA, 25 bp, Rattus norvegicus
ggaaccgcccatcatgtgtagaact

SEQ ID NO: 416417 - DNA, 25 bp, Rattus norvegicus
ggaaccgcccatgatgtgtagaact

SEQ ID NO: 416418 - DNA, 25 bp, Rattus norvegicus
ggaaccgctgccacaggagcccgtg

SEQ ID NO: 416419 - DNA, 25 bp, Rattus norvegicus
ggaaccgctgcctcaggagcccgtg

SEQ ID NO: 416420 - DNA, 25 bp, Rattus norvegicus
ggaaccgctggccaccatcggagtt

SEQ ID NO: 416421 - DNA, 25 bp, Rattus norvegicus
ggaaccgctggcgaccatcggagtt

SEQ ID NO: 416422 - DNA, 25 bp, Rattus norvegicus
ggaaccggaatgctaattgctcact

SEQ ID NO: 416423 - DNA, 25 bp, Rattus norvegicus
ggaaccggaatggtaattgctcact

SEQ ID NO: 416424 - DNA, 25 bp, Rattus norvegicus
ggaaccggatatcacagtccttgat

SEQ ID NO: 416425 - DNA, 25 bp, Rattus norvegicus
ggaaccggatatgacagtccttgat

SEQ ID NO: 416426 - DNA, 25 bp, Rattus norvegicus
ggaaccggatcaaagggccctggct

SEQ ID NO: 416427 - DNA, 25 bp, Rattus norvegicus
ggaaccggatcatagggccctggct

SEQ ID NO: 416428 - DNA, 25 bp, Rattus norvegicus
ggaaccggctgcatccaagatcaag

SEQ ID NO: 416429 - DNA, 25 bp, Rattus norvegicus
ggaaccggctgcttccaagatcaag

SEQ ID NO: 416430 - DNA, 25 bp, Rattus norvegicus
ggaaccgtaactctccatagctgta

SEQ ID NO: 416431 - DNA, 25 bp, Rattus norvegicus
ggaaccgtaactgtccatagctgta

SEQ ID NO: 416432 - DNA, 25 bp, Rattus norvegicus
ggaaccgtcggcatgttgctgttga

SEQ ID NO: 416433 - DNA, 25 bp, Rattus norvegicus
ggaaccgtcggcttgttgctgttga

SEQ ID NO: 416434 - DNA, 25 bp, Rattus norvegicus
ggaaccgtgcgacccagaagaagcc

SEQ ID NO: 416435 - DNA, 25 bp, Rattus norvegicus
ggaaccgtgcgagccagaagaagcc

SEQ ID NO: 416436 - DNA, 25 bp, Rattus norvegicus
ggaaccgttcaaagccactggttat

SEQ ID NO: 416437 - DNA, 25 bp, Rattus norvegicus
ggaaccgttcaatgccactggttat

SEQ ID NO: 416438 - DNA, 25 bp, Rattus norvegicus
ggaacctaagcaaattcagccgttt

SEQ ID NO: 416439 - DNA, 25 bp, Rattus norvegicus
ggaacctaagcatattcagccgttt

SEQ ID NO: 416440 - DNA, 25 bp, Rattus norvegicus
ggaacctactgcaacatcatgaaga

SEQ ID NO: 416441 - DNA, 25 bp, Rattus norvegicus
ggaacctactgctacatcatgaaga

SEQ ID NO: 416442 - DNA, 25 bp, Rattus norvegicus
ggaacctacttcaaaagggcttgtg

SEQ ID NO: 416443 - DNA, 25 bp, Rattus norvegicus
ggaacctacttctaaagggcttgtg

SEQ ID NO: 416444 - DNA, 25 bp, Rattus norvegicus
ggaacctagttgactttctcataaa

SEQ ID NO: 416445 - DNA, 25 bp, Rattus norvegicus
ggaacctagttgtctttctcataaa

SEQ ID NO: 416446 - DNA, 25 bp, Rattus norvegicus
ggaacctatgcacaccatggcttct

SEQ ID NO: 416447 - DNA, 25 bp, Rattus norvegicus
ggaacctatgcagaccatggcttct

SEQ ID NO: 416448 - DNA, 25 bp, Rattus norvegicus
ggaacctatgcccatgactgcctgg

SEQ ID NO: 416449 - DNA, 25 bp, Rattus norvegicus
ggaacctatgccgatgactgcctgg

SEQ ID NO: 416450 - DNA, 25 bp, Rattus norvegicus
ggaacctcaagaatcataaaccaca

SEQ ID NO: 416451 - DNA, 25 bp, Rattus norvegicus
ggaacctcaagattcataaaccaca

SEQ ID NO: 416452 - DNA, 25 bp, Rattus norvegicus
ggaacctcacctacaatgactttgt

SEQ ID NO: 416453 - DNA, 25 bp, Rattus norvegicus
ggaacctcaccttcaatgactttgt

SEQ ID NO: 416454 - DNA, 25 bp, Rattus norvegicus
ggaacctcactgctgtaggctatta

SEQ ID NO: 416455 - DNA, 25 bp, Rattus norvegicus
ggaacctcactggtgtaggctatta

SEQ ID NO: 416456 - DNA, 25 bp, Rattus norvegicus
ggaacctcacttcctttacagagtt

SEQ ID NO: 416457 - DNA, 25 bp, Rattus norvegicus
ggaacctcacttgctttacagagtt

SEQ ID NO: 416458 - DNA, 25 bp, Rattus norvegicus
ggaacctcaggaaggccttacttat

SEQ ID NO: 416459 - DNA, 25 bp, Rattus norvegicus
ggaacctcaggaccggtcactgaat

SEQ ID NO: 416460 - DNA, 25 bp, Rattus norvegicus
ggaacctcaggagcggtcactgaat

SEQ ID NO: 416461 - DNA, 25 bp, Rattus norvegicus
ggaacctcaggatggccttacttat

SEQ ID NO: 416462 - DNA, 25 bp, Rattus norvegicus
ggaacctcagtgaaaccgctgcgtt

SEQ ID NO: 416463 - DNA, 25 bp, Rattus norvegicus
ggaacctcagtgtaaccgctgcgtt

SEQ ID NO: 416464 - DNA, 25 bp, Rattus norvegicus
ggaacctcatcacaacactatgaaa

SEQ ID NO: 416465 - DNA, 25 bp, Rattus norvegicus
ggaacctcatcagaacactatgaaa

SEQ ID NO: 416466 - DNA, 25 bp, Rattus norvegicus
ggaacctctagaacactaacctatg

SEQ ID NO: 416467 - DNA, 25 bp, Rattus norvegicus
ggaacctctagatcactaacctatg

SEQ ID NO: 416468 - DNA, 25 bp, Rattus norvegicus
ggaacctctcatatactacgtcttg

SEQ ID NO: 416469 - DNA, 25 bp, Rattus norvegicus
ggaacctctcatttactacgtcttg

SEQ ID NO: 416470 - DNA, 25 bp, Rattus norvegicus
ggaacctctggccactggaatagga

SEQ ID NO: 416471 - DNA, 25 bp, Rattus norvegicus
ggaacctctggcgactggaatagga

SEQ ID NO: 416472 - DNA, 25 bp, Rattus norvegicus
ggaacctctgggaccaagcttggaa

SEQ ID NO: 416473 - DNA, 25 bp, Rattus norvegicus
ggaacctctgggtccaagcttggaa

SEQ ID NO: 416474 - DNA, 25 bp, Rattus norvegicus
ggaacctcttgcacagcatatttaa

SEQ ID NO: 416475 - DNA, 25 bp, Rattus norvegicus
ggaacctcttgctcagcatatttaa

SEQ ID NO: 416476 - DNA, 25 bp, Rattus norvegicus
ggaacctgaaaactcctgcatcgga

SEQ ID NO: 416477 - DNA, 25 bp, Rattus norvegicus
ggaacctgaaaagtcctgcatcgga

SEQ ID NO: 416478 - DNA, 25 bp, Rattus norvegicus
ggaacctgagctagcaaatcaccag

SEQ ID NO: 416479 - DNA, 25 bp, Rattus norvegicus
ggaacctgagcttgcaaatcaccag

SEQ ID NO: 416480 - DNA, 25 bp, Rattus norvegicus
ggaacctgaggaaccatgttgtttt

SEQ ID NO: 416481 - DNA, 25 bp, Rattus norvegicus
ggaacctgaggatccatgttgtttt

SEQ ID NO: 416482 - DNA, 25 bp, Rattus norvegicus
ggaacctgattgaggtctcccagaa

SEQ ID NO: 416483 - DNA, 25 bp, Rattus norvegicus
ggaacctgattgtggtctcccagaa

SEQ ID NO: 416484 - DNA, 25 bp, Rattus norvegicus
ggaacctgcttaccccagtgcgcat

SEQ ID NO: 416485 - DNA, 25 bp, Rattus norvegicus
ggaacctgcttagcccagtgcgcat

SEQ ID NO: 416486 - DNA, 25 bp, Rattus norvegicus
ggaacctggaggactcacgcatgag

SEQ ID NO: 416487 - DNA, 25 bp, Rattus norvegicus
ggaacctggaggtctcacgcatgag

SEQ ID NO: 416488 - DNA, 25 bp, Rattus norvegicus
ggaacctggatacaagaactgatgc

SEQ ID NO: 416489 - DNA, 25 bp, Rattus norvegicus
ggaacctggatagaagaactgatgc

SEQ ID NO: 416490 - DNA, 25 bp, Rattus norvegicus
ggaacctggttcatgacattagctc

SEQ ID NO: 416491 - DNA, 25 bp, Rattus norvegicus
ggaacctggttcttgacattagctc

SEQ ID NO: 416492 - DNA, 25 bp, Rattus norvegicus
ggaacctgtacaagcttgccagtcg

SEQ ID NO: 416493 - DNA, 25 bp, Rattus norvegicus
ggaacctgtacatgcttgccagtcg

SEQ ID NO: 416494 - DNA, 25 bp, Rattus norvegicus
ggaacctgtacgagggagcccatgt

SEQ ID NO: 416495 - DNA, 25 bp, Rattus norvegicus
ggaacctgtacgtgggagcccatgt

SEQ ID NO: 416496 - DNA, 25 bp, Rattus norvegicus
ggaacctgtggtcatgatgcacatg

SEQ ID NO: 416497 - DNA, 25 bp, Rattus norvegicus
ggaacctgtggtgatgatgcacatg

SEQ ID NO: 416498 - DNA, 25 bp, Rattus norvegicus
ggaacctgtgtaaagtgtcctccag

SEQ ID NO: 416499 - DNA, 25 bp, Rattus norvegicus
ggaacctgtgtatagtgtcctccag

SEQ ID NO: 416500 - DNA, 25 bp, Rattus norvegicus
ggaacctgttataaattacatcacc

SEQ ID NO: 416501 - DNA, 25 bp, Rattus norvegicus
ggaacctgttattaattacatcacc

SEQ ID NO: 416502 - DNA, 25 bp, Rattus norvegicus
ggaaccttaactcagcagcccagga

SEQ ID NO: 416503 - DNA, 25 bp, Rattus norvegicus
ggaaccttaactgagcagcccagga

SEQ ID NO: 416504 - DNA, 25 bp, Rattus norvegicus
ggaaccttagttcaacccagtgtct

SEQ ID NO: 416505 - DNA, 25 bp, Rattus norvegicus
ggaaccttagttgaacccagtgtct

SEQ ID NO: 416506 - DNA, 25 bp, Rattus norvegicus
ggaaccttccagagctttgtgtatt

SEQ ID NO: 416507 - DNA, 25 bp, Rattus norvegicus
ggaaccttccagtgctttgtgtatt

SEQ ID NO: 416508 - DNA, 25 bp, Rattus norvegicus
ggaaccttcctaaattgcagttgat

SEQ ID NO: 416509 - DNA, 25 bp, Rattus norvegicus
ggaaccttcctatattgcagttgat

SEQ ID NO: 416510 - DNA, 25 bp, Rattus norvegicus
ggaaccttcctgcactttgaagact

SEQ ID NO: 416511 - DNA, 25 bp, Rattus norvegicus
ggaaccttcctgctgaatgcagcaa

SEQ ID NO: 416512 - DNA, 25 bp, Rattus norvegicus
ggaaccttcctggactttgaagact

SEQ ID NO: 416513 - DNA, 25 bp, Rattus norvegicus
ggaaccttcctggtgaatgcagcaa

SEQ ID NO: 416514 - DNA, 25 bp, Rattus norvegicus
ggaaccttccttacactaccaaatg

SEQ ID NO: 416515 - DNA, 25 bp, Rattus norvegicus
ggaaccttcctttcactaccaaatg

SEQ ID NO: 416516 - DNA, 25 bp, Rattus norvegicus
ggaaccttctacactggctcagagt

SEQ ID NO: 416517 - DNA, 25 bp, Rattus norvegicus
ggaaccttctactctggctcagagt

SEQ ID NO: 416518 - DNA, 25 bp, Rattus norvegicus
ggaaccttgacccttaaggccatgc

SEQ ID NO: 416519 - DNA, 25 bp, Rattus norvegicus
ggaaccttgaccgttaaggccatgc

SEQ ID NO: 416520 - DNA, 25 bp, Rattus norvegicus
ggaaccttgcataattttactagta

SEQ ID NO: 416521 - DNA, 25 bp, Rattus norvegicus
ggaaccttgcattattttactagta

SEQ ID NO: 416522 - DNA, 25 bp, Rattus norvegicus
ggaaccttggacacgatggcactaa

SEQ ID NO: 416523 - DNA, 25 bp, Rattus norvegicus
ggaaccttggactcgatggcactaa

SEQ ID NO: 416524 - DNA, 25 bp, Rattus norvegicus
ggaaccttgtccatgtatgactttt

SEQ ID NO: 416525 - DNA, 25 bp, Rattus norvegicus
ggaaccttgtccttgtatgactttt

SEQ ID NO: 416526 - DNA, 25 bp, Rattus norvegicus
ggaaccttgtctcactactgtgttt

SEQ ID NO: 416527 - DNA, 25 bp, Rattus norvegicus
ggaaccttgtctgactactgtgttt

SEQ ID NO: 416528 - DNA, 25 bp, Rattus norvegicus
ggaaccttgtgcctactgtacataa

SEQ ID NO: 416529 - DNA, 25 bp, Rattus norvegicus
ggaaccttgtgcgtactgtacataa

SEQ ID NO: 416530 - DNA, 25 bp, Rattus norvegicus
ggaaccttgttcagcctgtaactat

SEQ ID NO: 416531 - DNA, 25 bp, Rattus norvegicus
ggaaccttgttctgcctgtaactat

SEQ ID NO: 416532 - DNA, 25 bp, Rattus norvegicus
ggaacctttacaatctacatcacct

SEQ ID NO: 416533 - DNA, 25 bp, Rattus norvegicus
ggaacctttacattctacatcacct

SEQ ID NO: 416534 - DNA, 25 bp, Rattus norvegicus
ggaacctttaccagtatttgtgaag

SEQ ID NO: 416535 - DNA, 25 bp, Rattus norvegicus
ggaacctttacctgtatttgtgaag

SEQ ID NO: 416536 - DNA, 25 bp, Rattus norvegicus
ggaacctttagaccatctcttagga

SEQ ID NO: 416537 - DNA, 25 bp, Rattus norvegicus
ggaacctttagagcatctcttagga

SEQ ID NO: 416538 - DNA, 25 bp, Rattus norvegicus
ggaacctttcataggcaatgccatg

SEQ ID NO: 416539 - DNA, 25 bp, Rattus norvegicus
ggaacctttcattggcaatgccatg

SEQ ID NO: 416540 - DNA, 25 bp, Rattus norvegicus
ggaacctttgtaataaattgagcca

SEQ ID NO: 416541 - DNA, 25 bp, Rattus norvegicus
ggaacctttgtattaaattgagcca

SEQ ID NO: 416542 - DNA, 25 bp, Rattus norvegicus
ggaacctttgtgcagccggaactaa

SEQ ID NO: 416543 - DNA, 25 bp, Rattus norvegicus
ggaacctttgtggagccggaactaa

SEQ ID NO: 416544 - DNA, 25 bp, Rattus norvegicus
ggaaccttttctatggatccatttg

SEQ ID NO: 416545 - DNA, 25 bp, Rattus norvegicus
ggaaccttttctttggatccatttg

SEQ ID NO: 416546 - DNA, 25 bp, Rattus norvegicus
ggaacgaaggtcactgagatctaga

SEQ ID NO: 416547 - DNA, 25 bp, Rattus norvegicus
ggaacgaaggtctctgagatctaga

SEQ ID NO: 416548 - DNA, 25 bp, Rattus norvegicus
ggaacgaatcgcactggaggaagat

SEQ ID NO: 416549 - DNA, 25 bp, Rattus norvegicus
ggaacgaatcgctctggaggaagat

SEQ ID NO: 416550 - DNA, 25 bp, Rattus norvegicus
ggaacgaattccattcttgaggtct

SEQ ID NO: 416551 - DNA, 25 bp, Rattus norvegicus
ggaacgaattcctttcttgaggtct

SEQ ID NO: 416552 - DNA, 25 bp, Rattus norvegicus
ggaacgactgatacccggccagcaa

SEQ ID NO: 416553 - DNA, 25 bp, Rattus norvegicus
ggaacgactgattcccggccagcaa

SEQ ID NO: 416554 - DNA, 25 bp, Rattus norvegicus
ggaacgacttcacagggaactggaa

SEQ ID NO: 416555 - DNA, 25 bp, Rattus norvegicus
ggaacgacttcagagggaactggaa

SEQ ID NO: 416556 - DNA, 25 bp, Rattus norvegicus
ggaacgagccacagaggaaccaaag

SEQ ID NO: 416557 - DNA, 25 bp, Rattus norvegicus
ggaacgagccactgaggaaccaaag

SEQ ID NO: 416558 - DNA, 25 bp, Rattus norvegicus
ggaacgatcctaccagagacagaga

SEQ ID NO: 416559 - DNA, 25 bp, Rattus norvegicus
ggaacgatcctagcagagacagaga

SEQ ID NO: 416560 - DNA, 25 bp, Rattus norvegicus
ggaacgatgccaaaactgtcaatgt

SEQ ID NO: 416561 - DNA, 25 bp, Rattus norvegicus
ggaacgatgccataactgtcaatgt

SEQ ID NO: 416562 - DNA, 25 bp, Rattus norvegicus
ggaacgatgcgcaccagccgggcaa

SEQ ID NO: 416563 - DNA, 25 bp, Rattus norvegicus
ggaacgatgcgctccagccgggcaa

SEQ ID NO: 416564 - DNA, 25 bp, Rattus norvegicus
ggaacgattccaatcaaatatcccc

SEQ ID NO: 416565 - DNA, 25 bp, Rattus norvegicus
ggaacgattccattcaaatatcccc

SEQ ID NO: 416566 - DNA, 25 bp, Rattus norvegicus
ggaacgattggcaaaactgtgattt

SEQ ID NO: 416567 - DNA, 25 bp, Rattus norvegicus
ggaacgattggctaaactgtgattt

SEQ ID NO: 416568 - DNA, 25 bp, Rattus norvegicus
ggaacgcaaagcacaactcaatggt

SEQ ID NO: 416569 - DNA, 25 bp, Rattus norvegicus
ggaacgcaaagctcaactcaatggt

SEQ ID NO: 416570 - DNA, 25 bp, Rattus norvegicus
ggaacgcaagtcaatttctaactta

SEQ ID NO: 416571 - DNA, 25 bp, Rattus norvegicus
ggaacgcaagtctatttctaactta

SEQ ID NO: 416572 - DNA, 25 bp, Rattus norvegicus
ggaacgcaagttcagcccctggatt

SEQ ID NO: 416573 - DNA, 25 bp, Rattus norvegicus
ggaacgcaagttgagcccctggatt

SEQ ID NO: 416574 - DNA, 25 bp, Rattus norvegicus
ggaacgcacaccacacagtttgaga

SEQ ID NO: 416575 - DNA, 25 bp, Rattus norvegicus
ggaacgcacacctcacagtttgaga

SEQ ID NO: 416576 - DNA, 25 bp, Rattus norvegicus
ggaacgcacacgagcgcaggccgct

SEQ ID NO: 416577 - DNA, 25 bp, Rattus norvegicus
ggaacgcacacgtgcgcaggccgct

SEQ ID NO: 416578 - DNA, 25 bp, Rattus norvegicus
ggaacgcatctgaggactatcgatt

SEQ ID NO: 416579 - DNA, 25 bp, Rattus norvegicus
ggaacgcatctgtggactatcgatt

SEQ ID NO: 416580 - DNA, 25 bp, Rattus norvegicus
ggaacgcatgcacacttatcaggat

SEQ ID NO: 416581 - DNA, 25 bp, Rattus norvegicus
ggaacgcatgcagacttatcaggat

SEQ ID NO: 416582 - DNA, 25 bp, Rattus norvegicus
ggaacgccactgagcatttggacaa

SEQ ID NO: 416583 - DNA, 25 bp, Rattus norvegicus
ggaacgccactgtgcatttggacaa

SEQ ID NO: 416584 - DNA, 25 bp, Rattus norvegicus
ggaacgccagaacaacagcagccaa

SEQ ID NO: 416585 - DNA, 25 bp, Rattus norvegicus
ggaacgccagaagaacagcagccaa

SEQ ID NO: 416586 - DNA, 25 bp, Rattus norvegicus
ggaacgccagccctgaagaaatcca

SEQ ID NO: 416587 - DNA, 25 bp, Rattus norvegicus
ggaacgccagccgtgaagaaatcca

SEQ ID NO: 416588 - DNA, 25 bp, Rattus norvegicus
ggaacgccatccctaaagattttct

SEQ ID NO: 416589 - DNA, 25 bp, Rattus norvegicus
ggaacgccatccgtaaagattttct

SEQ ID NO: 416590 - DNA, 25 bp, Rattus norvegicus
ggaacgcctgctcctggacaaagtg

SEQ ID NO: 416591 - DNA, 25 bp, Rattus norvegicus
ggaacgcctgctgctggacaaagtg

SEQ ID NO: 416592 - DNA, 25 bp, Rattus norvegicus
ggaacgctcacaaaaatctcttggt

SEQ ID NO: 416593 - DNA, 25 bp, Rattus norvegicus
ggaacgctcacataaatctcttggt

SEQ ID NO: 416594 - DNA, 25 bp, Rattus norvegicus
ggaacgctcgctcgctaggtatcca

SEQ ID NO: 416595 - DNA, 25 bp, Rattus norvegicus
ggaacgctcgctggctaggtatcca

SEQ ID NO: 416596 - DNA, 25 bp, Rattus norvegicus
ggaacgctcgttcatgtaaccttaa

SEQ ID NO: 416597 - DNA, 25 bp, Rattus norvegicus
ggaacgctcgttgatgtaaccttaa

SEQ ID NO: 416598 - DNA, 25 bp, Rattus norvegicus
ggaacgctggctacgccgagattat

SEQ ID NO: 416599 - DNA, 25 bp, Rattus norvegicus
ggaacgctggcttcgccgagattat

SEQ ID NO: 416600 - DNA, 25 bp, Rattus norvegicus
ggaacgctttccctttgggcagaag

SEQ ID NO: 416601 - DNA, 25 bp, Rattus norvegicus
ggaacgctttccgtttgggcagaag

SEQ ID NO: 416602 - DNA, 25 bp, Rattus norvegicus
ggaacggaaaccatgcacgatatgt

SEQ ID NO: 416603 - DNA, 25 bp, Rattus norvegicus
ggaacggaaaccttgcacgatatgt

SEQ ID NO: 416604 - DNA, 25 bp, Rattus norvegicus
ggaacggaaggcatattcttagaca

SEQ ID NO: 416605 - DNA, 25 bp, Rattus norvegicus
ggaacggaaggcttattcttagaca

SEQ ID NO: 416606 - DNA, 25 bp, Rattus norvegicus
ggaacggacactctcccagagagaa

SEQ ID NO: 416607 - DNA, 25 bp, Rattus norvegicus
ggaacggacactgtcccagagagaa

SEQ ID NO: 416608 - DNA, 25 bp, Rattus norvegicus
ggaacggacattagcttgactcagc

SEQ ID NO: 416609 - DNA, 25 bp, Rattus norvegicus
ggaacggacattaggtttatcctat

SEQ ID NO: 416610 - DNA, 25 bp, Rattus norvegicus
ggaacggacatttgcttgactcagc

SEQ ID NO: 416611 - DNA, 25 bp, Rattus norvegicus
ggaacggacatttggtttatcctat

SEQ ID NO: 416612 - DNA, 25 bp, Rattus norvegicus
ggaacggacctgcattgtatttcat

SEQ ID NO: 416613 - DNA, 25 bp, Rattus norvegicus
ggaacggacctggattgtatttcat

SEQ ID NO: 416614 - DNA, 25 bp, Rattus norvegicus
ggaacggagtccagatcctcaaaat

SEQ ID NO: 416615 - DNA, 25 bp, Rattus norvegicus
ggaacggagtccaggcttcagaact

SEQ ID NO: 416616 - DNA, 25 bp, Rattus norvegicus
ggaacggagtcctgatcctcaaaat

SEQ ID NO: 416617 - DNA, 25 bp, Rattus norvegicus
ggaacggagtcctggcttcagaact

SEQ ID NO: 416618 - DNA, 25 bp, Rattus norvegicus
ggaacggcaattacattcatcaata

SEQ ID NO: 416619 - DNA, 25 bp, Rattus norvegicus
ggaacggcaatttcattcatcaata

SEQ ID NO: 416620 - DNA, 25 bp, Rattus norvegicus
ggaacggcacccagcagtatctgca

SEQ ID NO: 416621 - DNA, 25 bp, Rattus norvegicus
ggaacggcaccctgcagtatctgca

SEQ ID NO: 416622 - DNA, 25 bp, Rattus norvegicus
ggaacggcgctacttcaagcagcag

SEQ ID NO: 416623 - DNA, 25 bp, Rattus norvegicus
ggaacggcgctagttcaagcagcag

SEQ ID NO: 416624 - DNA, 25 bp, Rattus norvegicus
ggaacggctccaataattactgtag

SEQ ID NO: 416625 - DNA, 25 bp, Rattus norvegicus
ggaacggctccattaattactgtag

SEQ ID NO: 416626 - DNA, 25 bp, Rattus norvegicus
ggaacggctttaactagcatctaac

SEQ ID NO: 416627 - DNA, 25 bp, Rattus norvegicus
ggaacggctttatctagcatctaac

SEQ ID NO: 416628 - DNA, 25 bp, Rattus norvegicus
ggaacgggcacgagactttcgtcat

SEQ ID NO: 416629 - DNA, 25 bp, Rattus norvegicus
ggaacgggcacgtgactttcgtcat

SEQ ID NO: 416630 - DNA, 25 bp, Rattus norvegicus
ggaacggtctccaagtggcttcagc

SEQ ID NO: 416631 - DNA, 25 bp, Rattus norvegicus
ggaacggtctcctagtggcttcagc

SEQ ID NO: 416632 - DNA, 25 bp, Rattus norvegicus
ggaacggtggctattcaatgtgtcc

SEQ ID NO: 416633 - DNA, 25 bp, Rattus norvegicus
ggaacggtggcttttcaatgtgtcc

SEQ ID NO: 416634 - DNA, 25 bp, Rattus norvegicus
ggaacggttacacgctcacggaaag

SEQ ID NO: 416635 - DNA, 25 bp, Rattus norvegicus
ggaacggttacaggctcacggaaag

SEQ ID NO: 416636 - DNA, 25 bp, Rattus norvegicus
ggaacggtttggagtataccatcac

SEQ ID NO: 416637 - DNA, 25 bp, Rattus norvegicus
ggaacggtttggtgtataccatcac

SEQ ID NO: 416638 - DNA, 25 bp, Rattus norvegicus
ggaacgtacctgacacacgaagcga

SEQ ID NO: 416639 - DNA, 25 bp, Rattus norvegicus
ggaacgtacctgtcacacgaagcga

SEQ ID NO: 416640 - DNA, 25 bp, Rattus norvegicus
ggaacgtaggccatcaaaatacaag

SEQ ID NO: 416641 - DNA, 25 bp, Rattus norvegicus
ggaacgtaggccttcaaaatacaag

SEQ ID NO: 416642 - DNA, 25 bp, Rattus norvegicus
ggaacgtattgaatgcccttaaata

SEQ ID NO: 416643 - DNA, 25 bp, Rattus norvegicus
ggaacgtattgattgcccttaaata

SEQ ID NO: 416644 - DNA, 25 bp, Rattus norvegicus
ggaacgtattttctgatgcctctca

SEQ ID NO: 416645 - DNA, 25 bp, Rattus norvegicus
ggaacgtattttgtgatgcctctca

SEQ ID NO: 416646 - DNA, 25 bp, Rattus norvegicus
ggaacgtcgctgcatttcttgatta

SEQ ID NO: 416647 - DNA, 25 bp, Rattus norvegicus
ggaacgtcgctggatttcttgatta

SEQ ID NO: 416648 - DNA, 25 bp, Rattus norvegicus
ggaacgtctcaaaaccattttctgt

SEQ ID NO: 416649 - DNA, 25 bp, Rattus norvegicus
ggaacgtctcaataccattttctgt

SEQ ID NO: 416650 - DNA, 25 bp, Rattus norvegicus
ggaacgtctgtcaaggtgccatggc

SEQ ID NO: 416651 - DNA, 25 bp, Rattus norvegicus
ggaacgtctgtctaggtgccatggc

SEQ ID NO: 416652 - DNA, 25 bp, Rattus norvegicus
ggaacgtctttaaccgaatgccgat

SEQ ID NO: 416653 - DNA, 25 bp, Rattus norvegicus
ggaacgtctttatccgaatgccgat

SEQ ID NO: 416654 - DNA, 25 bp, Rattus norvegicus
ggaacgtgatggatggacgcacact

SEQ ID NO: 416655 - DNA, 25 bp, Rattus norvegicus
ggaacgtgatggttggacgcacact

SEQ ID NO: 416656 - DNA, 25 bp, Rattus norvegicus
ggaacgtgattgcagccatcgacct

SEQ ID NO: 416657 - DNA, 25 bp, Rattus norvegicus
ggaacgtgattggagccatcgacct

SEQ ID NO: 416658 - DNA, 25 bp, Rattus norvegicus
ggaacgtgctgtacacagtggaaaa

SEQ ID NO: 416659 - DNA, 25 bp, Rattus norvegicus
ggaacgtgctgttcacagtggaaaa

SEQ ID NO: 416660 - DNA, 25 bp, Rattus norvegicus
ggaacgtgctttagtatttctactt

SEQ ID NO: 416661 - DNA, 25 bp, Rattus norvegicus
ggaacgtgcttttgtatttctactt

SEQ ID NO: 416662 - DNA, 25 bp, Rattus norvegicus
ggaacgtggatcattttattttgca

SEQ ID NO: 416663 - DNA, 25 bp, Rattus norvegicus
ggaacgtggatctttttattttgca

SEQ ID NO: 416664 - DNA, 25 bp, Rattus norvegicus
ggaacgtggcccctaacaaggagat

SEQ ID NO: 416665 - DNA, 25 bp, Rattus norvegicus
ggaacgtggcccgtaacaaggagat

SEQ ID NO: 416666 - DNA, 25 bp, Rattus norvegicus
ggaacgtgtccaaaaaagccacaat

SEQ ID NO: 416667 - DNA, 25 bp, Rattus norvegicus
ggaacgtgtccataaaagccacaat

SEQ ID NO: 416668 - DNA, 25 bp, Rattus norvegicus
ggaacgtgtgatatttctggataca

SEQ ID NO: 416669 - DNA, 25 bp, Rattus norvegicus
ggaacgtgtgatttttctggataca

SEQ ID NO: 416670 - DNA, 25 bp, Rattus norvegicus
ggaacgtgttgccacagctgtaata

SEQ ID NO: 416671 - DNA, 25 bp, Rattus norvegicus
ggaacgtgttgcgacagctgtaata

SEQ ID NO: 416672 - DNA, 25 bp, Rattus norvegicus
ggaacgtgttgtactgcatgctggc

SEQ ID NO: 416673 - DNA, 25 bp, Rattus norvegicus
ggaacgtgttgttctgcatgctggc

SEQ ID NO: 416674 - DNA, 25 bp, Rattus norvegicus
ggaacgttcaatcagtcctttcttc

SEQ ID NO: 416675 - DNA, 25 bp, Rattus norvegicus
ggaacgttcaatgagtcctttcttc

SEQ ID NO: 416676 - DNA, 25 bp, Rattus norvegicus
ggaacgttctccagcagtttccttg

SEQ ID NO: 416677 - DNA, 25 bp, Rattus norvegicus
ggaacgttctcctgcagtttccttg

SEQ ID NO: 416678 - DNA, 25 bp, Rattus norvegicus
ggaacgttgcccaggaactccaaga

SEQ ID NO: 416679 - DNA, 25 bp, Rattus norvegicus
ggaacgttgccctggaactccaaga

SEQ ID NO: 416680 - DNA, 25 bp, Rattus norvegicus
ggaacgttgggcatcaccatcagag

SEQ ID NO: 416681 - DNA, 25 bp, Rattus norvegicus
ggaacgttgggcttcaccatcagag

SEQ ID NO: 416682 - DNA, 25 bp, Rattus norvegicus
ggaacgttgtcccacagagctgttt

SEQ ID NO: 416683 - DNA, 25 bp, Rattus norvegicus
ggaacgttgtccgacagagctgttt

SEQ ID NO: 416684 - DNA, 25 bp, Rattus norvegicus
ggaacgtttcaaaaactgtactgtt

SEQ ID NO: 416685 - DNA, 25 bp, Rattus norvegicus
ggaacgtttcaataactgtactgtt

SEQ ID NO: 416686 - DNA, 25 bp, Rattus norvegicus
ggaactaaactgataaccaggctgg

SEQ ID NO: 416687 - DNA, 25 bp, Rattus norvegicus
ggaactaaactgctactgctgctta

SEQ ID NO: 416688 - DNA, 25 bp, Rattus norvegicus
ggaactaaactggtactgctgctta

SEQ ID NO: 416689 - DNA, 25 bp, Rattus norvegicus
ggaactaaactgttaaccaggctgg

SEQ ID NO: 416690 - DNA, 25 bp, Rattus norvegicus
ggaactaactatctgttgcctgcat

SEQ ID NO: 416691 - DNA, 25 bp, Rattus norvegicus
ggaactaactatgtgttgcctgcat

SEQ ID NO: 416692 - DNA, 25 bp, Rattus norvegicus
ggaactaaggttcgcttgtcacaca

SEQ ID NO: 416693 - DNA, 25 bp, Rattus norvegicus
ggaactaaggttggcttgtcacaca

SEQ ID NO: 416694 - DNA, 25 bp, Rattus norvegicus
ggaactaagtgcatgtgaaagccaa

SEQ ID NO: 416695 - DNA, 25 bp, Rattus norvegicus
ggaactaagtgcttgtgaaagccaa

SEQ ID NO: 416696 - DNA, 25 bp, Rattus norvegicus
ggaactaatagactggcatcgccat

SEQ ID NO: 416697 - DNA, 25 bp, Rattus norvegicus
ggaactaatagagtggcatcgccat

SEQ ID NO: 416698 - DNA, 25 bp, Rattus norvegicus
ggaactaatcatactgtagctatct

SEQ ID NO: 416699 - DNA, 25 bp, Rattus norvegicus
ggaactaatcattctgtagctatct

SEQ ID NO: 416700 - DNA, 25 bp, Rattus norvegicus
ggaactaatcctctcacatctgtac

SEQ ID NO: 416701 - DNA, 25 bp, Rattus norvegicus
ggaactaatcctgtcacatctgtac

SEQ ID NO: 416702 - DNA, 25 bp, Rattus norvegicus
ggaactaatggaaggcgcccgctaa

SEQ ID NO: 416703 - DNA, 25 bp, Rattus norvegicus
ggaactaatggatggcgcccgctaa

SEQ ID NO: 416704 - DNA, 25 bp, Rattus norvegicus
ggaactacaattacttctgttggta

SEQ ID NO: 416705 - DNA, 25 bp, Rattus norvegicus
ggaactacaatttcttctgttggta

SEQ ID NO: 416706 - DNA, 25 bp, Rattus norvegicus
ggaactacaccgctagaaacaccat

SEQ ID NO: 416707 - DNA, 25 bp, Rattus norvegicus
ggaactacaccggtagaaacaccat

SEQ ID NO: 416708 - DNA, 25 bp, Rattus norvegicus
ggaactacagtacatcatggaccta

SEQ ID NO: 416709 - DNA, 25 bp, Rattus norvegicus
ggaactacagtagatcatggaccta

SEQ ID NO: 416710 - DNA, 25 bp, Rattus norvegicus
ggaactacatccatgagaaatatga

SEQ ID NO: 416711 - DNA, 25 bp, Rattus norvegicus
ggaactacatccttgagaaatatga

SEQ ID NO: 416712 - DNA, 25 bp, Rattus norvegicus
ggaactacattaacttgggctggaa

SEQ ID NO: 416713 - DNA, 25 bp, Rattus norvegicus
ggaactacattatcttgggctggaa

SEQ ID NO: 416714 - DNA, 25 bp, Rattus norvegicus
ggaactacccttatgccatgaggaa

SEQ ID NO: 416715 - DNA, 25 bp, Rattus norvegicus
ggaactacccttttgccatgaggaa

SEQ ID NO: 416716 - DNA, 25 bp, Rattus norvegicus
ggaactaccgtgcagcctaagggaa

SEQ ID NO: 416717 - DNA, 25 bp, Rattus norvegicus
ggaactaccgtggagcctaagggaa

SEQ ID NO: 416718 - DNA, 25 bp, Rattus norvegicus
ggaactacgtcacagcaaccaccgg

SEQ ID NO: 416719 - DNA, 25 bp, Rattus norvegicus
ggaactacgtcagagcaaccaccgg

SEQ ID NO: 416720 - DNA, 25 bp, Rattus norvegicus
ggaactacgtgtatgtatcgcccaa

SEQ ID NO: 416721 - DNA, 25 bp, Rattus norvegicus
ggaactacgtgtttgtatcgcccaa

SEQ ID NO: 416722 - DNA, 25 bp, Rattus norvegicus
ggaactactccaacaataggcaaag

SEQ ID NO: 416723 - DNA, 25 bp, Rattus norvegicus
ggaactactccatcaataggcaaag

SEQ ID NO: 416724 - DNA, 25 bp, Rattus norvegicus
ggaactactgcacagacccttgtaa

SEQ ID NO: 416725 - DNA, 25 bp, Rattus norvegicus
ggaactactgcacattccactgtct

SEQ ID NO: 416726 - DNA, 25 bp, Rattus norvegicus
ggaactactgcagagacccttgtaa

SEQ ID NO: 416727 - DNA, 25 bp, Rattus norvegicus
ggaactactgcagattccactgtct

SEQ ID NO: 416728 - DNA, 25 bp, Rattus norvegicus
ggaactagactcaccctaaagaact

SEQ ID NO: 416729 - DNA, 25 bp, Rattus norvegicus
ggaactagactctccctaaagaact

SEQ ID NO: 416730 - DNA, 25 bp, Rattus norvegicus
ggaactagagctcagcctcctctgg

SEQ ID NO: 416731 - DNA, 25 bp, Rattus norvegicus
ggaactagagctgagcctcctctgg

SEQ ID NO: 416732 - DNA, 25 bp, Rattus norvegicus
ggaactagatcacgcttggcccagt

SEQ ID NO: 416733 - DNA, 25 bp, Rattus norvegicus
ggaactagatcaggcttggcccagt

SEQ ID NO: 416734 - DNA, 25 bp, Rattus norvegicus
ggaactagcctaattgtgaatcgag

SEQ ID NO: 416735 - DNA, 25 bp, Rattus norvegicus
ggaactagcctatttgtgaatcgag

SEQ ID NO: 416736 - DNA, 25 bp, Rattus norvegicus
ggaactaggctcaggatgtatatta

SEQ ID NO: 416737 - DNA, 25 bp, Rattus norvegicus
ggaactaggctctggatgtatatta

SEQ ID NO: 416738 - DNA, 25 bp, Rattus norvegicus
ggaactataaagaccaatcactaag

SEQ ID NO: 416739 - DNA, 25 bp, Rattus norvegicus
ggaactataaagtccaatcactaag

SEQ ID NO: 416740 - DNA, 25 bp, Rattus norvegicus
ggaactatacctaccctcattgtgg

SEQ ID NO: 416741 - DNA, 25 bp, Rattus norvegicus
ggaactataccttccctcattgtgg

SEQ ID NO: 416742 - DNA, 25 bp, Rattus norvegicus
ggaactatccataacatgcatttaa

SEQ ID NO: 416743 - DNA, 25 bp, Rattus norvegicus
ggaactatccattacatgcatttaa

SEQ ID NO: 416744 - DNA, 25 bp, Rattus norvegicus
ggaactatccctagcggaggctaaa

SEQ ID NO: 416745 - DNA, 25 bp, Rattus norvegicus
ggaactatcccttgcggaggctaaa

SEQ ID NO: 416746 - DNA, 25 bp, Rattus norvegicus
ggaactatgaacaccatccatttgc

SEQ ID NO: 416747 - DNA, 25 bp, Rattus norvegicus
ggaactatgaactccatccatttgc

SEQ ID NO: 416748 - DNA, 25 bp, Rattus norvegicus
ggaactatgggcaacatccttccat

SEQ ID NO: 416749 - DNA, 25 bp, Rattus norvegicus
ggaactatgggctacatccttccat

SEQ ID NO: 416750 - DNA, 25 bp, Rattus norvegicus
ggaactattccaatcaacttaccag

SEQ ID NO: 416751 - DNA, 25 bp, Rattus norvegicus
ggaactattccattcaacttaccag

SEQ ID NO: 416752 - DNA, 25 bp, Rattus norvegicus
ggaactattcttaagctatgctgca

SEQ ID NO: 416753 - DNA, 25 bp, Rattus norvegicus
ggaactattctttagctatgctgca

SEQ ID NO: 416754 - DNA, 25 bp, Rattus norvegicus
ggaactattggacatttatttgaca

SEQ ID NO: 416755 - DNA, 25 bp, Rattus norvegicus
ggaactattggaccacgccactgaa

SEQ ID NO: 416756 - DNA, 25 bp, Rattus norvegicus
ggaactattggagatttatttgaca

SEQ ID NO: 416757 - DNA, 25 bp, Rattus norvegicus
ggaactattggagcacgccactgaa

SEQ ID NO: 416758 - DNA, 25 bp, Rattus norvegicus
ggaactcaaaccagatgtcaacatc

SEQ ID NO: 416759 - DNA, 25 bp, Rattus norvegicus
ggaactcaaacctgatgtcaacatc

SEQ ID NO: 416760 - DNA, 25 bp, Rattus norvegicus
ggaactcaacatcaccgcggcaaag

SEQ ID NO: 416761 - DNA, 25 bp, Rattus norvegicus
ggaactcaacatgaccgcggcaaag

SEQ ID NO: 416762 - DNA, 25 bp, Rattus norvegicus
ggaactcaaggtattctgcaagctg

SEQ ID NO: 416763 - DNA, 25 bp, Rattus norvegicus
ggaactcaaggttttctgcaagctg

SEQ ID NO: 416764 - DNA, 25 bp, Rattus norvegicus
ggaactcaagtgaagacaccctctg

SEQ ID NO: 416765 - DNA, 25 bp, Rattus norvegicus
ggaactcaagtgtagacaccctctg

SEQ ID NO: 416766 - DNA, 25 bp, Rattus norvegicus
ggaactcaccacactaactagttgt

SEQ ID NO: 416767 - DNA, 25 bp, Rattus norvegicus
ggaactcaccactctaactagttgt

SEQ ID NO: 416768 - DNA, 25 bp, Rattus norvegicus
ggaactcaccatacagaagagagga

SEQ ID NO: 416769 - DNA, 25 bp, Rattus norvegicus
ggaactcaccattcagaagagagga

SEQ ID NO: 416770 - DNA, 25 bp, Rattus norvegicus
ggaactcaccggagaagtcagctca

SEQ ID NO: 416771 - DNA, 25 bp, Rattus norvegicus
ggaactcaccggtgaagtcagctca

SEQ ID NO: 416772 - DNA, 25 bp, Rattus norvegicus
ggaactcactcacgccaagtgctga

SEQ ID NO: 416773 - DNA, 25 bp, Rattus norvegicus
ggaactcactcaggccaagtgctga

SEQ ID NO: 416774 - DNA, 25 bp, Rattus norvegicus
ggaactcactgccttataccagatg

SEQ ID NO: 416775 - DNA, 25 bp, Rattus norvegicus
ggaactcactgcgttataccagatg

SEQ ID NO: 416776 - DNA, 25 bp, Rattus norvegicus
ggaactcactgtcgctggccttaaa

SEQ ID NO: 416777 - DNA, 25 bp, Rattus norvegicus
ggaactcactgtggctggccttaaa

SEQ ID NO: 416778 - DNA, 25 bp, Rattus norvegicus
ggaactcagaacatagcctgccaag

SEQ ID NO: 416779 - DNA, 25 bp, Rattus norvegicus
ggaactcagaacttagcctgccaag

SEQ ID NO: 416780 - DNA, 25 bp, Rattus norvegicus
ggaactcagacccatccatgtcata

SEQ ID NO: 416781 - DNA, 25 bp, Rattus norvegicus
ggaactcagaccgatccatgtcata

SEQ ID NO: 416782 - DNA, 25 bp, Rattus norvegicus
ggaactcagagaattcactgtcccc

SEQ ID NO: 416783 - DNA, 25 bp, Rattus norvegicus
ggaactcagagatttcactgtcccc

SEQ ID NO: 416784 - DNA, 25 bp, Rattus norvegicus
ggaactcagatcatataagtcaagg

SEQ ID NO: 416785 - DNA, 25 bp, Rattus norvegicus
ggaactcagatcttataagtcaagg

SEQ ID NO: 416786 - DNA, 25 bp, Rattus norvegicus
ggaactcagcctatatctttttatt

SEQ ID NO: 416787 - DNA, 25 bp, Rattus norvegicus
ggaactcagcctttatctttttatt

SEQ ID NO: 416788 - DNA, 25 bp, Rattus norvegicus
ggaactcagctgacctaagggattt

SEQ ID NO: 416789 - DNA, 25 bp, Rattus norvegicus
ggaactcagctgtcctaagggattt

SEQ ID NO: 416790 - DNA, 25 bp, Rattus norvegicus
ggaactcaggagagcttgctaaaat

SEQ ID NO: 416791 - DNA, 25 bp, Rattus norvegicus
ggaactcaggagtgcttgctaaaat

SEQ ID NO: 416792 - DNA, 25 bp, Rattus norvegicus
ggaactcaggctaataacagtctag

SEQ ID NO: 416793 - DNA, 25 bp, Rattus norvegicus
ggaactcaggcttataacagtctag

SEQ ID NO: 416794 - DNA, 25 bp, Rattus norvegicus
ggaactcagggtcttgcacatggta

SEQ ID NO: 416795 - DNA, 25 bp, Rattus norvegicus
ggaactcagggtgttgcacatggta

SEQ ID NO: 416796 - DNA, 25 bp, Rattus norvegicus
ggaactcaggttaaatcatgaacaa

SEQ ID NO: 416797 - DNA, 25 bp, Rattus norvegicus
ggaactcaggtttaatcatgaacaa

SEQ ID NO: 416798 - DNA, 25 bp, Rattus norvegicus
ggaactcatgcacggcaggtacctg

SEQ ID NO: 416799 - DNA, 25 bp, Rattus norvegicus
ggaactcatgcagggcaggtacctg

SEQ ID NO: 416800 - DNA, 25 bp, Rattus norvegicus
ggaactcatgttaggtttccagccc

SEQ ID NO: 416801 - DNA, 25 bp, Rattus norvegicus
ggaactcatgtttggtttccagccc

SEQ ID NO: 416802 - DNA, 25 bp, Rattus norvegicus
ggaactccaaagcaagaccaacagg

SEQ ID NO: 416803 - DNA, 25 bp, Rattus norvegicus
ggaactccaaaggaagaccaacagg

SEQ ID NO: 416804 - DNA, 25 bp, Rattus norvegicus
ggaactccacatcaaagaacgcaga

SEQ ID NO: 416805 - DNA, 25 bp, Rattus norvegicus
ggaactccacatgaaagaacgcaga

SEQ ID NO: 416806 - DNA, 25 bp, Rattus norvegicus
ggaactccagcaatgacatcccgag

SEQ ID NO: 416807 - DNA, 25 bp, Rattus norvegicus
ggaactccagcattgacatcccgag

SEQ ID NO: 416808 - DNA, 25 bp, Rattus norvegicus
ggaactccaggcattcttgtcataa

SEQ ID NO: 416809 - DNA, 25 bp, Rattus norvegicus
ggaactccaggctttcttgtcataa

SEQ ID NO: 416810 - DNA, 25 bp, Rattus norvegicus
ggaactccagttccctacaactcta

SEQ ID NO: 416811 - DNA, 25 bp, Rattus norvegicus
ggaactccagttgcctacaactcta

SEQ ID NO: 416812 - DNA, 25 bp, Rattus norvegicus
ggaactccatctatttgattgcaat

SEQ ID NO: 416813 - DNA, 25 bp, Rattus norvegicus
ggaactccatctttttgattgcaat

SEQ ID NO: 416814 - DNA, 25 bp, Rattus norvegicus
ggaactccctcgaggctggaactgg

SEQ ID NO: 416815 - DNA, 25 bp, Rattus norvegicus
ggaactccctcgtggctggaactgg

SEQ ID NO: 416816 - DNA, 25 bp, Rattus norvegicus
ggaactccgaatacaagcccaggaa

SEQ ID NO: 416817 - DNA, 25 bp, Rattus norvegicus
ggaactccgaattcaagcccaggaa

SEQ ID NO: 416818 - DNA, 25 bp, Rattus norvegicus
ggaactcctcgaagccaccgtaaag

SEQ ID NO: 416819 - DNA, 25 bp, Rattus norvegicus
ggaactcctcgatgccaccgtaaag

SEQ ID NO: 416820 - DNA, 25 bp, Rattus norvegicus
ggaactccttcaacagagctgagct

SEQ ID NO: 416821 - DNA, 25 bp, Rattus norvegicus
ggaactccttcatcagagctgagct

SEQ ID NO: 416822 - DNA, 25 bp, Rattus norvegicus
ggaactcgaaacctgaagcccctgg

SEQ ID NO: 416823 - DNA, 25 bp, Rattus norvegicus
ggaactcgaaacgtgaagcccctgg

SEQ ID NO: 416824 - DNA, 25 bp, Rattus norvegicus
ggaactcgagagcttttactgtgat

SEQ ID NO: 416825 - DNA, 25 bp, Rattus norvegicus
ggaactcgagaggttttactgtgat

SEQ ID NO: 416826 - DNA, 25 bp, Rattus norvegicus
ggaactcgcaatcaagcccaggctg

SEQ ID NO: 416827 - DNA, 25 bp, Rattus norvegicus
ggaactcgcaatgaagcccaggctg

SEQ ID NO: 416828 - DNA, 25 bp, Rattus norvegicus
ggaactcgcataatactttactctt

SEQ ID NO: 416829 - DNA, 25 bp, Rattus norvegicus
ggaactcgcatattactttactctt

SEQ ID NO: 416830 - DNA, 25 bp, Rattus norvegicus
ggaactcgccataagacattgatca

SEQ ID NO: 416831 - DNA, 25 bp, Rattus norvegicus
ggaactcgccattagacattgatca

SEQ ID NO: 416832 - DNA, 25 bp, Rattus norvegicus
ggaactcgctctctacgaacaaatc

SEQ ID NO: 416833 - DNA, 25 bp, Rattus norvegicus
ggaactcgctctgtacgaacaaatc

SEQ ID NO: 416834 - DNA, 25 bp, Rattus norvegicus
ggaactcggccacctctggatactg

SEQ ID NO: 416835 - DNA, 25 bp, Rattus norvegicus
ggaactcggccagctctggatactg

SEQ ID NO: 416836 - DNA, 25 bp, Rattus norvegicus
ggaactcgtttgcttcttgcatgac

SEQ ID NO: 416837 - DNA, 25 bp, Rattus norvegicus
ggaactcgtttggttcttgcatgac

SEQ ID NO: 416838 - DNA, 25 bp, Rattus norvegicus
ggaactctaacacagatgacccctt

SEQ ID NO: 416839 - DNA, 25 bp, Rattus norvegicus
ggaactctaacagagatgacccctt

SEQ ID NO: 416840 - DNA, 25 bp, Rattus norvegicus
ggaactctacctaacttgcccatga

SEQ ID NO: 416841 - DNA, 25 bp, Rattus norvegicus
ggaactctaccttacttgcccatga

SEQ ID NO: 416842 - DNA, 25 bp, Rattus norvegicus
ggaactctactcactcaggaaagca

SEQ ID NO: 416843 - DNA, 25 bp, Rattus norvegicus
ggaactctactctctcaggaaagca

SEQ ID NO: 416844 - DNA, 25 bp, Rattus norvegicus
ggaactctagggaacacttggtgcc

SEQ ID NO: 416845 - DNA, 25 bp, Rattus norvegicus
ggaactctagggtacacttggtgcc

SEQ ID NO: 416846 - DNA, 25 bp, Rattus norvegicus
ggaactctatcaactgtgacttctg

SEQ ID NO: 416847 - DNA, 25 bp, Rattus norvegicus
ggaactctatcatctgtgacttctg

SEQ ID NO: 416848 - DNA, 25 bp, Rattus norvegicus
ggaactctattcattgctgcaggct

SEQ ID NO: 416849 - DNA, 25 bp, Rattus norvegicus
ggaactctattctttgctgcaggct

SEQ ID NO: 416850 - DNA, 25 bp, Rattus norvegicus
ggaactctcaacaggaagtcctgca

SEQ ID NO: 416851 - DNA, 25 bp, Rattus norvegicus
ggaactctcaactggaagtcctgca

SEQ ID NO: 416852 - DNA, 25 bp, Rattus norvegicus
ggaactctcaagataccagcagtga

SEQ ID NO: 416853 - DNA, 25 bp, Rattus norvegicus
ggaactctcaagttaccagcagtga

SEQ ID NO: 416854 - DNA, 25 bp, Rattus norvegicus
ggaactctcaatccttacacagctt

SEQ ID NO: 416855 - DNA, 25 bp, Rattus norvegicus
ggaactctcaatgcttacacagctt

SEQ ID NO: 416856 - DNA, 25 bp, Rattus norvegicus
ggaactctcagaccatggatccctc

SEQ ID NO: 416857 - DNA, 25 bp, Rattus norvegicus
ggaactctcagagcatggatccctc

SEQ ID NO: 416858 - DNA, 25 bp, Rattus norvegicus
ggaactctccaaacaacaccaagaa

SEQ ID NO: 416859 - DNA, 25 bp, Rattus norvegicus
ggaactctccaatcaacaccaagaa

SEQ ID NO: 416860 - DNA, 25 bp, Rattus norvegicus
ggaactctccgtcacatagacatca

SEQ ID NO: 416861 - DNA, 25 bp, Rattus norvegicus
ggaactctccgtgacatagacatca

SEQ ID NO: 416862 - DNA, 25 bp, Rattus norvegicus
ggaactctctatacaggccagtctg

SEQ ID NO: 416863 - DNA, 25 bp, Rattus norvegicus
ggaactctctatcgatcgcctcact

SEQ ID NO: 416864 - DNA, 25 bp, Rattus norvegicus
ggaactctctatggatcgcctcact

SEQ ID NO: 416865 - DNA, 25 bp, Rattus norvegicus
ggaactctctattcaggccagtctg

SEQ ID NO: 416866 - DNA, 25 bp, Rattus norvegicus
ggaactctctgacgttagatttcaa

SEQ ID NO: 416867 - DNA, 25 bp, Rattus norvegicus
ggaactctctgaggttagatttcaa

SEQ ID NO: 416868 - DNA, 25 bp, Rattus norvegicus
ggaactctgaatacccatctgcaac

SEQ ID NO: 416869 - DNA, 25 bp, Rattus norvegicus
ggaactctgaattcccatctgcaac

SEQ ID NO: 416870 - DNA, 25 bp, Rattus norvegicus
ggaactctgagcacagtggctgcca

SEQ ID NO: 416871 - DNA, 25 bp, Rattus norvegicus
ggaactctgagcagtttctactttg

SEQ ID NO: 416872 - DNA, 25 bp, Rattus norvegicus
ggaactctgagctcagtggctgcca

SEQ ID NO: 416873 - DNA, 25 bp, Rattus norvegicus
ggaactctgagctgtttctactttg

SEQ ID NO: 416874 - DNA, 25 bp, Rattus norvegicus
ggaactctgcaaacaactgcatgcg

SEQ ID NO: 416875 - DNA, 25 bp, Rattus norvegicus
ggaactctgcaatcaactgcatgcg

SEQ ID NO: 416876 - DNA, 25 bp, Rattus norvegicus
ggaactctgcttcacttgtgtactc

SEQ ID NO: 416877 - DNA, 25 bp, Rattus norvegicus
ggaactctgcttgacttgtgtactc

SEQ ID NO: 416878 - DNA, 25 bp, Rattus norvegicus
ggaactctggagacctcacggatat

SEQ ID NO: 416879 - DNA, 25 bp, Rattus norvegicus
ggaactctggagtcctcacggatat

SEQ ID NO: 416880 - DNA, 25 bp, Rattus norvegicus
ggaactctggatagactggtcagtt

SEQ ID NO: 416881 - DNA, 25 bp, Rattus norvegicus
ggaactctggattgactggtcagtt

SEQ ID NO: 416882 - DNA, 25 bp, Rattus norvegicus
ggaactctggctccacaagttcaag

SEQ ID NO: 416883 - DNA, 25 bp, Rattus norvegicus
ggaactctggctgcacaagttcaag

SEQ ID NO: 416884 - DNA, 25 bp, Rattus norvegicus
ggaactctgggaaaccttgtaccaa

SEQ ID NO: 416885 - DNA, 25 bp, Rattus norvegicus
ggaactctgggataccttgtaccaa

SEQ ID NO: 416886 - DNA, 25 bp, Rattus norvegicus
ggaactctggttcggcctgattacc

SEQ ID NO: 416887 - DNA, 25 bp, Rattus norvegicus
ggaactctggttgggcctgattacc

SEQ ID NO: 416888 - DNA, 25 bp, Rattus norvegicus
ggaactctgtaaaactgtgctctat

SEQ ID NO: 416889 - DNA, 25 bp, Rattus norvegicus
ggaactctgtaatactgtgctctat

SEQ ID NO: 416890 - DNA, 25 bp, Rattus norvegicus
ggaactctgtgcctggaaccctgcc

SEQ ID NO: 416891 - DNA, 25 bp, Rattus norvegicus
ggaactctgtgcgtggaaccctgcc

SEQ ID NO: 416892 - DNA, 25 bp, Rattus norvegicus
ggaactctgttaacttctcagaata

SEQ ID NO: 416893 - DNA, 25 bp, Rattus norvegicus
ggaactctgttatcttctcagaata

SEQ ID NO: 416894 - DNA, 25 bp, Rattus norvegicus
ggaactctgttcacaggtatcctac

SEQ ID NO: 416895 - DNA, 25 bp, Rattus norvegicus
ggaactctgttctcaggtatcctac

SEQ ID NO: 416896 - DNA, 25 bp, Rattus norvegicus
ggaactcttcggctgtgacatttat

SEQ ID NO: 416897 - DNA, 25 bp, Rattus norvegicus
ggaactcttcgggtgtgacatttat

SEQ ID NO: 416898 - DNA, 25 bp, Rattus norvegicus
ggaactctttatctagagccacagt

SEQ ID NO: 416899 - DNA, 25 bp, Rattus norvegicus
ggaactctttatgtagagccacagt

SEQ ID NO: 416900 - DNA, 25 bp, Rattus norvegicus
ggaactctttgtaagtacctgactg

SEQ ID NO: 416901 - DNA, 25 bp, Rattus norvegicus
ggaactctttgttagtacctgactg

SEQ ID NO: 416902 - DNA, 25 bp, Rattus norvegicus
ggaactgaagacacaggccctgtaa

SEQ ID NO: 416903 - DNA, 25 bp, Rattus norvegicus
ggaactgaagactcaggccctgtaa

SEQ ID NO: 416904 - DNA, 25 bp, Rattus norvegicus
ggaactgaaggaacctctgcttcca

SEQ ID NO: 416905 - DNA, 25 bp, Rattus norvegicus
ggaactgaaggatcctctgcttcca

SEQ ID NO: 416906 - DNA, 25 bp, Rattus norvegicus
ggaactgaatccaactctgtcctgt

SEQ ID NO: 416907 - DNA, 25 bp, Rattus norvegicus
ggaactgaatcctactctgtcctgt

SEQ ID NO: 416908 - DNA, 25 bp, Rattus norvegicus
ggaactgaatttcaggcccctgagg

SEQ ID NO: 416909 - DNA, 25 bp, Rattus norvegicus
ggaactgaatttgaggcccctgagg

SEQ ID NO: 416910 - DNA, 25 bp, Rattus norvegicus
ggaactgacagaccttgaacctctt

SEQ ID NO: 416911 - DNA, 25 bp, Rattus norvegicus
ggaactgacagagcttgaacctctt

SEQ ID NO: 416912 - DNA, 25 bp, Rattus norvegicus
ggaactgacctcataactgccaaga

SEQ ID NO: 416913 - DNA, 25 bp, Rattus norvegicus
ggaactgacctccaggacactcatg

SEQ ID NO: 416914 - DNA, 25 bp, Rattus norvegicus
ggaactgacctcgaggacactcatg

SEQ ID NO: 416915 - DNA, 25 bp, Rattus norvegicus
ggaactgacctcttaactgccaaga

SEQ ID NO: 416916 - DNA, 25 bp, Rattus norvegicus
ggaactgacggccagcagacagtcc

SEQ ID NO: 416917 - DNA, 25 bp, Rattus norvegicus
ggaactgacggcgagcagacagtcc

SEQ ID NO: 416918 - DNA, 25 bp, Rattus norvegicus
ggaactgactccaaacaagatcaga

SEQ ID NO: 416919 - DNA, 25 bp, Rattus norvegicus
ggaactgactcctaacaagatcaga

SEQ ID NO: 416920 - DNA, 25 bp, Rattus norvegicus
ggaactgacttcatatggcaccctt

SEQ ID NO: 416921 - DNA, 25 bp, Rattus norvegicus
ggaactgacttcttatggcaccctt

SEQ ID NO: 416922 - DNA, 25 bp, Rattus norvegicus
ggaactgacttgcaagactccacta

SEQ ID NO: 416923 - DNA, 25 bp, Rattus norvegicus
ggaactgacttggaagactccacta

SEQ ID NO: 416924 - DNA, 25 bp, Rattus norvegicus
ggaactgactttaggacccaactgt

SEQ ID NO: 416925 - DNA, 25 bp, Rattus norvegicus
ggaactgacttttggacccaactgt

SEQ ID NO: 416926 - DNA, 25 bp, Rattus norvegicus
ggaactgagacgcacaccccgagta

SEQ ID NO: 416927 - DNA, 25 bp, Rattus norvegicus
ggaactgagacggacaccccgagta

SEQ ID NO: 416928 - DNA, 25 bp, Rattus norvegicus
ggaactgagcaacttccttgggctc

SEQ ID NO: 416929 - DNA, 25 bp, Rattus norvegicus
ggaactgagcaagttccttgggctc

SEQ ID NO: 416930 - DNA, 25 bp, Rattus norvegicus
ggaactgagcagagactggtccttt

SEQ ID NO: 416931 - DNA, 25 bp, Rattus norvegicus
ggaactgagcagtgactggtccttt

SEQ ID NO: 416932 - DNA, 25 bp, Rattus norvegicus
ggaactgaggaacttgtctgcccac

SEQ ID NO: 416933 - DNA, 25 bp, Rattus norvegicus
ggaactgaggaagttgtctgcccac

SEQ ID NO: 416934 - DNA, 25 bp, Rattus norvegicus
ggaactgaggctcccagagccttgt

SEQ ID NO: 416935 - DNA, 25 bp, Rattus norvegicus
ggaactgaggctgccagagccttgt

SEQ ID NO: 416936 - DNA, 25 bp, Rattus norvegicus
ggaactgaggttcacagctgtctta

SEQ ID NO: 416937 - DNA, 25 bp, Rattus norvegicus
ggaactgaggttgacagctgtctta

SEQ ID NO: 416938 - DNA, 25 bp, Rattus norvegicus
ggaactgagtcaagccaggcaagct

SEQ ID NO: 416939 - DNA, 25 bp, Rattus norvegicus
ggaactgagtcatgccaggcaagct

SEQ ID NO: 416940 - DNA, 25 bp, Rattus norvegicus
ggaactgagttcctatagtgctttt

SEQ ID NO: 416941 - DNA, 25 bp, Rattus norvegicus
ggaactgagttcgtatagtgctttt

SEQ ID NO: 416942 - DNA, 25 bp, Rattus norvegicus
ggaactgatagtcattgcccaaata

SEQ ID NO: 416943 - DNA, 25 bp, Rattus norvegicus
ggaactgatagtgattgcccaaata

SEQ ID NO: 416944 - DNA, 25 bp, Rattus norvegicus
ggaactgatgaccttacgatgaaga

SEQ ID NO: 416945 - DNA, 25 bp, Rattus norvegicus
ggaactgatgacgttacgatgaaga

SEQ ID NO: 416946 - DNA, 25 bp, Rattus norvegicus
ggaactgcaaccacctattctcagt

SEQ ID NO: 416947 - DNA, 25 bp, Rattus norvegicus
ggaactgcaacctcctattctcagt

SEQ ID NO: 416948 - DNA, 25 bp, Rattus norvegicus
ggaactgcaccgagggcacccgcaa

SEQ ID NO: 416949 - DNA, 25 bp, Rattus norvegicus
ggaactgcaccgtgggcacccgcaa

SEQ ID NO: 416950 - DNA, 25 bp, Rattus norvegicus
ggaactgcagcacccgacctatgtc

SEQ ID NO: 416951 - DNA, 25 bp, Rattus norvegicus
ggaactgcagcagccgacctatgtc

SEQ ID NO: 416952 - DNA, 25 bp, Rattus norvegicus
ggaactgcagcccagtgccgaaaca

SEQ ID NO: 416953 - DNA, 25 bp, Rattus norvegicus
ggaactgcagccgagtgccgaaaca

SEQ ID NO: 416954 - DNA, 25 bp, Rattus norvegicus
ggaactgcaggtaggcttatcacac

SEQ ID NO: 416955 - DNA, 25 bp, Rattus norvegicus
ggaactgcaggttggcttatcacac

SEQ ID NO: 416956 - DNA, 25 bp, Rattus norvegicus
ggaactgcagtgaagccggccttag

SEQ ID NO: 416957 - DNA, 25 bp, Rattus norvegicus
ggaactgcagtgtagccggccttag

SEQ ID NO: 416958 - DNA, 25 bp, Rattus norvegicus
ggaactgcatggaatcttgttacta

SEQ ID NO: 416959 - DNA, 25 bp, Rattus norvegicus
ggaactgcatggtatcttgttacta

SEQ ID NO: 416960 - DNA, 25 bp, Rattus norvegicus
ggaactgccagaaaaccctgtctag

SEQ ID NO: 416961 - DNA, 25 bp, Rattus norvegicus
ggaactgccagataaccctgtctag

SEQ ID NO: 416962 - DNA, 25 bp, Rattus norvegicus
ggaactgccatccattcttgtactc

SEQ ID NO: 416963 - DNA, 25 bp, Rattus norvegicus
ggaactgccatcgattcttgtactc

SEQ ID NO: 416964 - DNA, 25 bp, Rattus norvegicus
ggaactgcccttaaaattctaagtg

SEQ ID NO: 416965 - DNA, 25 bp, Rattus norvegicus
ggaactgccctttaaattctaagtg

SEQ ID NO: 416966 - DNA, 25 bp, Rattus norvegicus
ggaactgcctggaatatcccacagg

SEQ ID NO: 416967 - DNA, 25 bp, Rattus norvegicus
ggaactgcctggtatatcccacagg

SEQ ID NO: 416968 - DNA, 25 bp, Rattus norvegicus
ggaactgctaacaaaatttactcaa

SEQ ID NO: 416969 - DNA, 25 bp, Rattus norvegicus
ggaactgctaactaaatttactcaa

SEQ ID NO: 416970 - DNA, 25 bp, Rattus norvegicus
ggaactgctaagactagtaggccat

SEQ ID NO: 416971 - DNA, 25 bp, Rattus norvegicus
ggaactgctaagtctagtaggccat

SEQ ID NO: 416972 - DNA, 25 bp, Rattus norvegicus
ggaactgctccacggtgacggactc

SEQ ID NO: 416973 - DNA, 25 bp, Rattus norvegicus
ggaactgctccagggtgacggactc

SEQ ID NO: 416974 - DNA, 25 bp, Rattus norvegicus
ggaactgctgatatcaactcgctgg

SEQ ID NO: 416975 - DNA, 25 bp, Rattus norvegicus
ggaactgctgatctttctgtactgc

SEQ ID NO: 416976 - DNA, 25 bp, Rattus norvegicus
ggaactgctgatgtttctgtactgc

SEQ ID NO: 416977 - DNA, 25 bp, Rattus norvegicus
ggaactgctgatttcaactcgctgg

SEQ ID NO: 416978 - DNA, 25 bp, Rattus norvegicus
ggaactgctgctacacattgactta

SEQ ID NO: 416979 - DNA, 25 bp, Rattus norvegicus
ggaactgctgcttcacattgactta

SEQ ID NO: 416980 - DNA, 25 bp, Rattus norvegicus
ggaactgctgtgacactcagccaaa

SEQ ID NO: 416981 - DNA, 25 bp, Rattus norvegicus
ggaactgctgtgtcactcagccaaa

SEQ ID NO: 416982 - DNA, 25 bp, Rattus norvegicus
ggaactgctgttcagtgcctgctgt

SEQ ID NO: 416983 - DNA, 25 bp, Rattus norvegicus
ggaactgctgttgagtgcctgctgt

SEQ ID NO: 416984 - DNA, 25 bp, Rattus norvegicus
ggaactgcttccctgaaagaagacg

SEQ ID NO: 416985 - DNA, 25 bp, Rattus norvegicus
ggaactgcttccgtgaaagaagacg

SEQ ID NO: 416986 - DNA, 25 bp, Rattus norvegicus
ggaactgcttctcggaaggctgctt

SEQ ID NO: 416987 - DNA, 25 bp, Rattus norvegicus
ggaactgcttctgggaaggctgctt

SEQ ID NO: 416988 - DNA, 25 bp, Rattus norvegicus
ggaactgcttttcacttacattggt

SEQ ID NO: 416989 - DNA, 25 bp, Rattus norvegicus
ggaactgcttttcattcacgttaag

SEQ ID NO: 416990 - DNA, 25 bp, Rattus norvegicus
ggaactgcttttgacttacattggt

SEQ ID NO: 416991 - DNA, 25 bp, Rattus norvegicus
ggaactgcttttgattcacgttaag

SEQ ID NO: 416992 - DNA, 25 bp, Rattus norvegicus
ggaactggaagaaaagactcgactc

SEQ ID NO: 416993 - DNA, 25 bp, Rattus norvegicus
ggaactggaagataagactcgactc

SEQ ID NO: 416994 - DNA, 25 bp, Rattus norvegicus
ggaactggaattataactgtgaacc

SEQ ID NO: 416995 - DNA, 25 bp, Rattus norvegicus
ggaactggaattttaactgtgaacc

SEQ ID NO: 416996 - DNA, 25 bp, Rattus norvegicus
ggaactggactaatcttgggctctc

SEQ ID NO: 416997 - DNA, 25 bp, Rattus norvegicus
ggaactggactattcttgggctctc

SEQ ID NO: 416998 - DNA, 25 bp, Rattus norvegicus
ggaactggagacagccactgcacgc

SEQ ID NO: 416999 - DNA, 25 bp, Rattus norvegicus
ggaactggagactgccactgcacgc

SEQ ID NO: 417000 - DNA, 25 bp, Rattus norvegicus
ggaactggagccacactcattgcac

SEQ ID NO: 417001 - DNA, 25 bp, Rattus norvegicus
ggaactggagcctcactcattgcac

SEQ ID NO: 417002 - DNA, 25 bp, Rattus norvegicus
ggaactggagctactgccgttgtgc

SEQ ID NO: 417003 - DNA, 25 bp, Rattus norvegicus
ggaactggagcttctgccgttgtgc

SEQ ID NO: 417004 - DNA, 25 bp, Rattus norvegicus
ggaactggatgtatttagttgctta

SEQ ID NO: 417005 - DNA, 25 bp, Rattus norvegicus
ggaactggatgtttttagttgctta

SEQ ID NO: 417006 - DNA, 25 bp, Rattus norvegicus
ggaactggcataattcttcaccact

SEQ ID NO: 417007 - DNA, 25 bp, Rattus norvegicus
ggaactggcatatttcttcaccact

SEQ ID NO: 417008 - DNA, 25 bp, Rattus norvegicus
ggaactggcatgaagcctcggaatt

SEQ ID NO: 417009 - DNA, 25 bp, Rattus norvegicus
ggaactggcatgtagcctcggaatt

SEQ ID NO: 417010 - DNA, 25 bp, Rattus norvegicus
ggaactggcctcacaacaagcgtga

SEQ ID NO: 417011 - DNA, 25 bp, Rattus norvegicus
ggaactggcctctcaacaagcgtga

SEQ ID NO: 417012 - DNA, 25 bp, Rattus norvegicus
ggaactggcctgctctgcgtgtctt

SEQ ID NO: 417013 - DNA, 25 bp, Rattus norvegicus
ggaactggcctggtctgcgtgtctt

SEQ ID NO: 417014 - DNA, 25 bp, Rattus norvegicus
ggaactggctcaaacctctggccac

SEQ ID NO: 417015 - DNA, 25 bp, Rattus norvegicus
ggaactggctcatacctctggccac

SEQ ID NO: 417016 - DNA, 25 bp, Rattus norvegicus
ggaactggctttagtgtccgagtgc

SEQ ID NO: 417017 - DNA, 25 bp, Rattus norvegicus
ggaactggcttttgtgtccgagtgc

SEQ ID NO: 417018 - DNA, 25 bp, Rattus norvegicus
ggaactgggcaccactttctgcaag

SEQ ID NO: 417019 - DNA, 25 bp, Rattus norvegicus
ggaactgggcacgactttctgcaag

SEQ ID NO: 417020 - DNA, 25 bp, Rattus norvegicus
ggaactggtcccacagtgataaact

SEQ ID NO: 417021 - DNA, 25 bp, Rattus norvegicus
ggaactggtccctcagtgataaact

SEQ ID NO: 417022 - DNA, 25 bp, Rattus norvegicus
ggaactggtgatctacattcccacc

SEQ ID NO: 417023 - DNA, 25 bp, Rattus norvegicus
ggaactggtgatgtacattcccacc

SEQ ID NO: 417024 - DNA, 25 bp, Rattus norvegicus
ggaactggtggcaccctgtcatagc

SEQ ID NO: 417025 - DNA, 25 bp, Rattus norvegicus
ggaactggtggctccctgtcatagc

SEQ ID NO: 417026 - DNA, 25 bp, Rattus norvegicus
ggaactggtgttcatcttttctgac

SEQ ID NO: 417027 - DNA, 25 bp, Rattus norvegicus
ggaactggtgttgatcttttctgac

SEQ ID NO: 417028 - DNA, 25 bp, Rattus norvegicus
ggaactggttccacaactatggata

SEQ ID NO: 417029 - DNA, 25 bp, Rattus norvegicus
ggaactggttcctcaactatggata

SEQ ID NO: 417030 - DNA, 25 bp, Rattus norvegicus
ggaactggttctccatacacttgag

SEQ ID NO: 417031 - DNA, 25 bp, Rattus norvegicus
ggaactggttctgcatacacttgag

SEQ ID NO: 417032 - DNA, 25 bp, Rattus norvegicus
ggaactgtaaaaatgaggcaaggca

SEQ ID NO: 417033 - DNA, 25 bp, Rattus norvegicus
ggaactgtaaaacaagagcctcatg

SEQ ID NO: 417034 - DNA, 25 bp, Rattus norvegicus
ggaactgtaaaagaagagcctcatg

SEQ ID NO: 417035 - DNA, 25 bp, Rattus norvegicus
ggaactgtaaaattgaggcaaggca

SEQ ID NO: 417036 - DNA, 25 bp, Rattus norvegicus
ggaactgtaagcaccaaggaaccct

SEQ ID NO: 417037 - DNA, 25 bp, Rattus norvegicus
ggaactgtaagctccaaggaaccct

SEQ ID NO: 417038 - DNA, 25 bp, Rattus norvegicus
ggaactgtaataaataccctatgct

SEQ ID NO: 417039 - DNA, 25 bp, Rattus norvegicus
ggaactgtaatatataccctatgct

SEQ ID NO: 417040 - DNA, 25 bp, Rattus norvegicus
ggaactgtacacagtcagggcttca

SEQ ID NO: 417041 - DNA, 25 bp, Rattus norvegicus
ggaactgtacactgtcagggcttca

SEQ ID NO: 417042 - DNA, 25 bp, Rattus norvegicus
ggaactgtacgaagcactgatggac

SEQ ID NO: 417043 - DNA, 25 bp, Rattus norvegicus
ggaactgtacgatgcactgatggac

SEQ ID NO: 417044 - DNA, 25 bp, Rattus norvegicus
ggaactgtactgatactattttgat

SEQ ID NO: 417045 - DNA, 25 bp, Rattus norvegicus
ggaactgtactgttactattttgat

SEQ ID NO: 417046 - DNA, 25 bp, Rattus norvegicus
ggaactgtagcaccagaacccattc

SEQ ID NO: 417047 - DNA, 25 bp, Rattus norvegicus
ggaactgtagcagcagaacccattc

SEQ ID NO: 417048 - DNA, 25 bp, Rattus norvegicus
ggaactgtatgtctgtaatgtactc

SEQ ID NO: 417049 - DNA, 25 bp, Rattus norvegicus
ggaactgtatgtgtgtaatgtactc

SEQ ID NO: 417050 - DNA, 25 bp, Rattus norvegicus
ggaactgtcaagcatcagctttgtg

SEQ ID NO: 417051 - DNA, 25 bp, Rattus norvegicus
ggaactgtcaaggatcagctttgtg

SEQ ID NO: 417052 - DNA, 25 bp, Rattus norvegicus
ggaactgtcaccctgtaaaatgctc

SEQ ID NO: 417053 - DNA, 25 bp, Rattus norvegicus
ggaactgtcaccgtgtaaaatgctc

SEQ ID NO: 417054 - DNA, 25 bp, Rattus norvegicus
ggaactgtcagtcttcagttgactg

SEQ ID NO: 417055 - DNA, 25 bp, Rattus norvegicus
ggaactgtcagtgttcagttgactg

SEQ ID NO: 417056 - DNA, 25 bp, Rattus norvegicus
ggaactgtccaacatcacaatgcca

SEQ ID NO: 417057 - DNA, 25 bp, Rattus norvegicus
ggaactgtccaagatcacaatgcca

SEQ ID NO: 417058 - DNA, 25 bp, Rattus norvegicus
ggaactgtccggacagcggcacgct

SEQ ID NO: 417059 - DNA, 25 bp, Rattus norvegicus
ggaactgtccggtcagcggcacgct

SEQ ID NO: 417060 - DNA, 25 bp, Rattus norvegicus
ggaactgtcctgaggaagactgcag

SEQ ID NO: 417061 - DNA, 25 bp, Rattus norvegicus
ggaactgtcctgtggaagactgcag

SEQ ID NO: 417062 - DNA, 25 bp, Rattus norvegicus
ggaactgtctacactaagtgccttt

SEQ ID NO: 417063 - DNA, 25 bp, Rattus norvegicus
ggaactgtctactctaagtgccttt

SEQ ID NO: 417064 - DNA, 25 bp, Rattus norvegicus
ggaactgtctctagtggccagcgaa

SEQ ID NO: 417065 - DNA, 25 bp, Rattus norvegicus
ggaactgtctcttgtggccagcgaa

SEQ ID NO: 417066 - DNA, 25 bp, Rattus norvegicus
ggaactgtcttaaagggccacagct

SEQ ID NO: 417067 - DNA, 25 bp, Rattus norvegicus
ggaactgtcttaaccttagaagcta

SEQ ID NO: 417068 - DNA, 25 bp, Rattus norvegicus
ggaactgtcttatagggccacagct

SEQ ID NO: 417069 - DNA, 25 bp, Rattus norvegicus
ggaactgtcttatccttagaagcta

SEQ ID NO: 417070 - DNA, 25 bp, Rattus norvegicus
ggaactgtgaatcagactaccccaa

SEQ ID NO: 417071 - DNA, 25 bp, Rattus norvegicus
ggaactgtgaatgagactaccccaa

SEQ ID NO: 417072 - DNA, 25 bp, Rattus norvegicus
ggaactgtgcagctctaactttcag

SEQ ID NO: 417073 - DNA, 25 bp, Rattus norvegicus
ggaactgtgcaggtctaactttcag

SEQ ID NO: 417074 - DNA, 25 bp, Rattus norvegicus
ggaactgtgcgtaacaactttggaa

SEQ ID NO: 417075 - DNA, 25 bp, Rattus norvegicus
ggaactgtgcgttacaactttggaa

SEQ ID NO: 417076 - DNA, 25 bp, Rattus norvegicus
ggaactgtgctcacaggtccataag

SEQ ID NO: 417077 - DNA, 25 bp, Rattus norvegicus
ggaactgtgctctcaggtccataag

SEQ ID NO: 417078 - DNA, 25 bp, Rattus norvegicus
ggaactgtggccatgcatctaagat

SEQ ID NO: 417079 - DNA, 25 bp, Rattus norvegicus
ggaactgtggccttgcatctaagat

SEQ ID NO: 417080 - DNA, 25 bp, Rattus norvegicus
ggaactgtggtcaagccactctggg

SEQ ID NO: 417081 - DNA, 25 bp, Rattus norvegicus
ggaactgtggtccagtatcttcctg

SEQ ID NO: 417082 - DNA, 25 bp, Rattus norvegicus
ggaactgtggtcgagtatcttcctg

SEQ ID NO: 417083 - DNA, 25 bp, Rattus norvegicus
ggaactgtggtctagccactctggg

SEQ ID NO: 417084 - DNA, 25 bp, Rattus norvegicus
ggaactgtgtggagggtactccttc

SEQ ID NO: 417085 - DNA, 25 bp, Rattus norvegicus
ggaactgtgtggtgggtactccttc

SEQ ID NO: 417086 - DNA, 25 bp, Rattus norvegicus
ggaactgtgtgtcactattacttga

SEQ ID NO: 417087 - DNA, 25 bp, Rattus norvegicus
ggaactgtgtgtgactattacttga

SEQ ID NO: 417088 - DNA, 25 bp, Rattus norvegicus
ggaactgttggcatttgacctgtga

SEQ ID NO: 417089 - DNA, 25 bp, Rattus norvegicus
ggaactgttggcttttgacctgtga

SEQ ID NO: 417090 - DNA, 25 bp, Rattus norvegicus
ggaactgtttacagctccttactgg

SEQ ID NO: 417091 - DNA, 25 bp, Rattus norvegicus
ggaactgtttactgctccttactgg

SEQ ID NO: 417092 - DNA, 25 bp, Rattus norvegicus
ggaactgtttccagacttgtgtgag

SEQ ID NO: 417093 - DNA, 25 bp, Rattus norvegicus
ggaactgtttcctgacttgtgtgag

SEQ ID NO: 417094 - DNA, 25 bp, Rattus norvegicus
ggaactgtttctagcctatgtctaa

SEQ ID NO: 417095 - DNA, 25 bp, Rattus norvegicus
ggaactgtttcttgcctatgtctaa

SEQ ID NO: 417096 - DNA, 25 bp, Rattus norvegicus
ggaacttaaaaccactgcctgccag

SEQ ID NO: 417097 - DNA, 25 bp, Rattus norvegicus
ggaacttaaaacgactgcctgccag

SEQ ID NO: 417098 - DNA, 25 bp, Rattus norvegicus
ggaacttaaaggactgtcactagga

SEQ ID NO: 417099 - DNA, 25 bp, Rattus norvegicus
ggaacttaaaggtctgtcactagga

SEQ ID NO: 417100 - DNA, 25 bp, Rattus norvegicus
ggaacttaacctatggtgattctca

SEQ ID NO: 417101 - DNA, 25 bp, Rattus norvegicus
ggaacttaacctttggtgattctca

SEQ ID NO: 417102 - DNA, 25 bp, Rattus norvegicus
ggaacttaatgtctgcttcacctgc

SEQ ID NO: 417103 - DNA, 25 bp, Rattus norvegicus
ggaacttaatgtgtgcttcacctgc

SEQ ID NO: 417104 - DNA, 25 bp, Rattus norvegicus
ggaacttactccatagaccatgctg

SEQ ID NO: 417105 - DNA, 25 bp, Rattus norvegicus
ggaacttactccttagaccatgctg

SEQ ID NO: 417106 - DNA, 25 bp, Rattus norvegicus
ggaacttagaggctggtctccttac

SEQ ID NO: 417107 - DNA, 25 bp, Rattus norvegicus
ggaacttagagggtggtctccttac

SEQ ID NO: 417108 - DNA, 25 bp, Rattus norvegicus
ggaacttagatcattctgttactgt

SEQ ID NO: 417109 - DNA, 25 bp, Rattus norvegicus
ggaacttagatctttctgttactgt

SEQ ID NO: 417110 - DNA, 25 bp, Rattus norvegicus
ggaacttagccaaaccatactttgt

SEQ ID NO: 417111 - DNA, 25 bp, Rattus norvegicus
ggaacttagccataccatactttgt

SEQ ID NO: 417112 - DNA, 25 bp, Rattus norvegicus
ggaacttataccaaaacctctgtgt

SEQ ID NO: 417113 - DNA, 25 bp, Rattus norvegicus
ggaacttatacctaaacctctgtgt

SEQ ID NO: 417114 - DNA, 25 bp, Rattus norvegicus
ggaacttatcaaactggccttaaag

SEQ ID NO: 417115 - DNA, 25 bp, Rattus norvegicus
ggaacttatcaatctggccttaaag

SEQ ID NO: 417116 - DNA, 25 bp, Rattus norvegicus
ggaacttatcccattagcagagctc

SEQ ID NO: 417117 - DNA, 25 bp, Rattus norvegicus
ggaacttatccctttagcagagctc

SEQ ID NO: 417118 - DNA, 25 bp, Rattus norvegicus
ggaacttatctgagtgtaccccaga

SEQ ID NO: 417119 - DNA, 25 bp, Rattus norvegicus
ggaacttatctgtgtgtaccccaga

SEQ ID NO: 417120 - DNA, 25 bp, Rattus norvegicus
ggaacttcagacaaccaagtgtgta

SEQ ID NO: 417121 - DNA, 25 bp, Rattus norvegicus
ggaacttcagactaccaagtgtgta

SEQ ID NO: 417122 - DNA, 25 bp, Rattus norvegicus
ggaacttcagcaaccactgggtgta

SEQ ID NO: 417123 - DNA, 25 bp, Rattus norvegicus
ggaacttcagcaccttgtatgtctt

SEQ ID NO: 417124 - DNA, 25 bp, Rattus norvegicus
ggaacttcagcagcttgtatgtctt

SEQ ID NO: 417125 - DNA, 25 bp, Rattus norvegicus
ggaacttcagcatccactgggtgta

SEQ ID NO: 417126 - DNA, 25 bp, Rattus norvegicus
ggaacttcatagatcagacccgtgt

SEQ ID NO: 417127 - DNA, 25 bp, Rattus norvegicus
ggaacttcatagttcagacccgtgt

SEQ ID NO: 417128 - DNA, 25 bp, Rattus norvegicus
ggaacttcatatacttttagaggcc

SEQ ID NO: 417129 - DNA, 25 bp, Rattus norvegicus
ggaacttcatattcttttagaggcc

SEQ ID NO: 417130 - DNA, 25 bp, Rattus norvegicus
ggaacttcatccatgttgctttctt

SEQ ID NO: 417131 - DNA, 25 bp, Rattus norvegicus
ggaacttcatccttgttgctttctt

SEQ ID NO: 417132 - DNA, 25 bp, Rattus norvegicus
ggaacttccaaaagcttgctcagtg

SEQ ID NO: 417133 - DNA, 25 bp, Rattus norvegicus
ggaacttccaaatgcttgctcagtg

SEQ ID NO: 417134 - DNA, 25 bp, Rattus norvegicus
ggaacttcccgactgctggtaattc

SEQ ID NO: 417135 - DNA, 25 bp, Rattus norvegicus
ggaacttcccgagtgctggtaattc

SEQ ID NO: 417136 - DNA, 25 bp, Rattus norvegicus
ggaacttcccttcctaacagagaga

SEQ ID NO: 417137 - DNA, 25 bp, Rattus norvegicus
ggaacttcccttgctaacagagaga

SEQ ID NO: 417138 - DNA, 25 bp, Rattus norvegicus
ggaacttcggtacctacgtgacaca

SEQ ID NO: 417139 - DNA, 25 bp, Rattus norvegicus
ggaacttcggtagctacgtgacaca

SEQ ID NO: 417140 - DNA, 25 bp, Rattus norvegicus
ggaacttctaaaccctgctgtcata

SEQ ID NO: 417141 - DNA, 25 bp, Rattus norvegicus
ggaacttctaaagcctgctgtcata

SEQ ID NO: 417142 - DNA, 25 bp, Rattus norvegicus
ggaacttctccgactgttgacaaga

SEQ ID NO: 417143 - DNA, 25 bp, Rattus norvegicus
ggaacttctccgtctgttgacaaga

SEQ ID NO: 417144 - DNA, 25 bp, Rattus norvegicus
ggaacttctgcaatcctaaaattgt

SEQ ID NO: 417145 - DNA, 25 bp, Rattus norvegicus
ggaacttctgcattcctaaaattgt

SEQ ID NO: 417146 - DNA, 25 bp, Rattus norvegicus
ggaacttctgcgcatcctttaaaac

SEQ ID NO: 417147 - DNA, 25 bp, Rattus norvegicus
ggaacttctgcggatcctttaaaac

SEQ ID NO: 417148 - DNA, 25 bp, Rattus norvegicus
ggaacttctggaacggctctacaag

SEQ ID NO: 417149 - DNA, 25 bp, Rattus norvegicus
ggaacttctggatcggctctacaag

SEQ ID NO: 417150 - DNA, 25 bp, Rattus norvegicus
ggaacttctgtgagtcagcctgggt

SEQ ID NO: 417151 - DNA, 25 bp, Rattus norvegicus
ggaacttctgtgtgtcagcctgggt

SEQ ID NO: 417152 - DNA, 25 bp, Rattus norvegicus
ggaacttcttacagtctctgaacga

SEQ ID NO: 417153 - DNA, 25 bp, Rattus norvegicus
ggaacttcttactgtctctgaacga

SEQ ID NO: 417154 - DNA, 25 bp, Rattus norvegicus
ggaacttgaaatctcctcagatccc

SEQ ID NO: 417155 - DNA, 25 bp, Rattus norvegicus
ggaacttgaaatgtcctcagatccc

SEQ ID NO: 417156 - DNA, 25 bp, Rattus norvegicus
ggaacttgacctagtactgaacctt

SEQ ID NO: 417157 - DNA, 25 bp, Rattus norvegicus
ggaacttgaccttgtactgaacctt

SEQ ID NO: 417158 - DNA, 25 bp, Rattus norvegicus
ggaacttgaggcagtgctgctccat

SEQ ID NO: 417159 - DNA, 25 bp, Rattus norvegicus
ggaacttgaggcctttttgtcagat

SEQ ID NO: 417160 - DNA, 25 bp, Rattus norvegicus
ggaacttgaggcgtttttgtcagat

SEQ ID NO: 417161 - DNA, 25 bp, Rattus norvegicus
ggaacttgaggctgtgctgctccat

SEQ ID NO: 417162 - DNA, 25 bp, Rattus norvegicus
ggaacttgatcacagatccaccggc

SEQ ID NO: 417163 - DNA, 25 bp, Rattus norvegicus
ggaacttgatcagagatccaccggc

SEQ ID NO: 417164 - DNA, 25 bp, Rattus norvegicus
ggaacttgcaatcctcctgcatctt

SEQ ID NO: 417165 - DNA, 25 bp, Rattus norvegicus
ggaacttgcaatgctcctgcatctt

SEQ ID NO: 417166 - DNA, 25 bp, Rattus norvegicus
ggaacttgcacacctagagacagag

SEQ ID NO: 417167 - DNA, 25 bp, Rattus norvegicus
ggaacttgcacagctagagacagag

SEQ ID NO: 417168 - DNA, 25 bp, Rattus norvegicus
ggaacttgccaaactagcgactttc

SEQ ID NO: 417169 - DNA, 25 bp, Rattus norvegicus
ggaacttgccaatctagcgactttc

SEQ ID NO: 417170 - DNA, 25 bp, Rattus norvegicus
ggaacttgcctaacttcagacactt

SEQ ID NO: 417171 - DNA, 25 bp, Rattus norvegicus
ggaacttgcctatcttcagacactt

SEQ ID NO: 417172 - DNA, 25 bp, Rattus norvegicus
ggaacttgcgttataacagtggctc

SEQ ID NO: 417173 - DNA, 25 bp, Rattus norvegicus
ggaacttgcgttttaacagtggctc

SEQ ID NO: 417174 - DNA, 25 bp, Rattus norvegicus
ggaacttgctagacacctctttcag

SEQ ID NO: 417175 - DNA, 25 bp, Rattus norvegicus
ggaacttgctagtcacctctttcag

SEQ ID NO: 417176 - DNA, 25 bp, Rattus norvegicus
ggaacttgctatcgccttacggtgc

SEQ ID NO: 417177 - DNA, 25 bp, Rattus norvegicus
ggaacttgctatggccttacggtgc

SEQ ID NO: 417178 - DNA, 25 bp, Rattus norvegicus
ggaacttgctggagcctcagaggac

SEQ ID NO: 417179 - DNA, 25 bp, Rattus norvegicus
ggaacttgctggtgcctcagaggac

SEQ ID NO: 417180 - DNA, 25 bp, Rattus norvegicus
ggaacttggctgagcggatcctaat

SEQ ID NO: 417181 - DNA, 25 bp, Rattus norvegicus
ggaacttggctgtgcggatcctaat

SEQ ID NO: 417182 - DNA, 25 bp, Rattus norvegicus
ggaacttggcttcgcagaacacata

SEQ ID NO: 417183 - DNA, 25 bp, Rattus norvegicus
ggaacttggcttggcagaacacata

SEQ ID NO: 417184 - DNA, 25 bp, Rattus norvegicus
ggaacttgggtgcagcgatcacatt

SEQ ID NO: 417185 - DNA, 25 bp, Rattus norvegicus
ggaacttgggtggagcgatcacatt

SEQ ID NO: 417186 - DNA, 25 bp, Rattus norvegicus
ggaacttggtgactgagaccctcag

SEQ ID NO: 417187 - DNA, 25 bp, Rattus norvegicus
ggaacttggtgagtgagaccctcag

SEQ ID NO: 417188 - DNA, 25 bp, Rattus norvegicus
ggaacttggtgcacaattgctctct

SEQ ID NO: 417189 - DNA, 25 bp, Rattus norvegicus
ggaacttggtgctcaattgctctct

SEQ ID NO: 417190 - DNA, 25 bp, Rattus norvegicus
ggaacttgtaacattttgcctttat

SEQ ID NO: 417191 - DNA, 25 bp, Rattus norvegicus
ggaacttgtaactttttgcctttat

SEQ ID NO: 417192 - DNA, 25 bp, Rattus norvegicus
ggaacttgtcacacagcagttacct

SEQ ID NO: 417193 - DNA, 25 bp, Rattus norvegicus
ggaacttgtcactcagcagttacct

SEQ ID NO: 417194 - DNA, 25 bp, Rattus norvegicus
ggaacttgtcagagtctcctgggtc

SEQ ID NO: 417195 - DNA, 25 bp, Rattus norvegicus
ggaacttgtcagtgtctcctgggtc

SEQ ID NO: 417196 - DNA, 25 bp, Rattus norvegicus
ggaacttgtgtgagcaatactgtct

SEQ ID NO: 417197 - DNA, 25 bp, Rattus norvegicus
ggaacttgtgtgtgcaatactgtct

SEQ ID NO: 417198 - DNA, 25 bp, Rattus norvegicus
ggaactttcaaaccttgcttcgtat

SEQ ID NO: 417199 - DNA, 25 bp, Rattus norvegicus
ggaactttcaaagcttgcttcgtat

SEQ ID NO: 417200 - DNA, 25 bp, Rattus norvegicus
ggaactttccacctgcattattatg

SEQ ID NO: 417201 - DNA, 25 bp, Rattus norvegicus
ggaactttccacgtgcattattatg

SEQ ID NO: 417202 - DNA, 25 bp, Rattus norvegicus
ggaactttccatcacccagtgggat

SEQ ID NO: 417203 - DNA, 25 bp, Rattus norvegicus
ggaactttccatgacccagtgggat

SEQ ID NO: 417204 - DNA, 25 bp, Rattus norvegicus
ggaactttctagacacccagctgtt

SEQ ID NO: 417205 - DNA, 25 bp, Rattus norvegicus
ggaactttctagtcacccagctgtt

SEQ ID NO: 417206 - DNA, 25 bp, Rattus norvegicus
ggaactttctataaatggcacctca

SEQ ID NO: 417207 - DNA, 25 bp, Rattus norvegicus
ggaactttctattaatggcacctca

SEQ ID NO: 417208 - DNA, 25 bp, Rattus norvegicus
ggaactttgaaaccctcatcctgtg

SEQ ID NO: 417209 - DNA, 25 bp, Rattus norvegicus
ggaactttgaaagcctcatcctgtg

SEQ ID NO: 417210 - DNA, 25 bp, Rattus norvegicus
ggaactttgaggacgcttaggtaca

SEQ ID NO: 417211 - DNA, 25 bp, Rattus norvegicus
ggaactttgaggtcgcttaggtaca

SEQ ID NO: 417212 - DNA, 25 bp, Rattus norvegicus
ggaactttgcacactttcgtgtctg

SEQ ID NO: 417213 - DNA, 25 bp, Rattus norvegicus
ggaactttgcactctttcgtgtctg

SEQ ID NO: 417214 - DNA, 25 bp, Rattus norvegicus
ggaactttggtgagcgcctgtgcta

SEQ ID NO: 417215 - DNA, 25 bp, Rattus norvegicus
ggaactttggtgtgcgcctgtgcta

SEQ ID NO: 417216 - DNA, 25 bp, Rattus norvegicus
ggaactttggttctgccatggacta

SEQ ID NO: 417217 - DNA, 25 bp, Rattus norvegicus
ggaactttggttgtgccatggacta

SEQ ID NO: 417218 - DNA, 25 bp, Rattus norvegicus
ggaactttgtacaatccgcatttcg

SEQ ID NO: 417219 - DNA, 25 bp, Rattus norvegicus
ggaactttgtactatccgcatttcg

SEQ ID NO: 417220 - DNA, 25 bp, Rattus norvegicus
ggaactttgtgcatagccacacagt

SEQ ID NO: 417221 - DNA, 25 bp, Rattus norvegicus
ggaactttgtgcttagccacacagt

SEQ ID NO: 417222 - DNA, 25 bp, Rattus norvegicus
ggaacttttaggaggcacatctttg

SEQ ID NO: 417223 - DNA, 25 bp, Rattus norvegicus
ggaacttttaggtggcacatctttg

SEQ ID NO: 417224 - DNA, 25 bp, Rattus norvegicus
ggaacttttcctcaagttgcaattt

SEQ ID NO: 417225 - DNA, 25 bp, Rattus norvegicus
ggaacttttcctgaagttgcaattt

SEQ ID NO: 417226 - DNA, 25 bp, Rattus norvegicus
ggaacttttggtacttaggtctgct

SEQ ID NO: 417227 - DNA, 25 bp, Rattus norvegicus
ggaacttttggttcttaggtctgct

SEQ ID NO: 417228 - DNA, 25 bp, Rattus norvegicus
ggaacttttgttacttaactctgtg

SEQ ID NO: 417229 - DNA, 25 bp, Rattus norvegicus
ggaacttttgtttcttaactctgtg

SEQ ID NO: 417230 - DNA, 25 bp, Rattus norvegicus
ggaactttttcaccgaggaacactg

SEQ ID NO: 417231 - DNA, 25 bp, Rattus norvegicus
ggaactttttcagcgaggaacactg

SEQ ID NO: 417232 - DNA, 25 bp, Rattus norvegicus
ggaagaaaacctactccacgtgtgc

SEQ ID NO: 417233 - DNA, 25 bp, Rattus norvegicus
ggaagaaaaccttctccacgtgtgc

SEQ ID NO: 417234 - DNA, 25 bp, Rattus norvegicus
ggaagaaaactgctctaacctaaag

SEQ ID NO: 417235 - DNA, 25 bp, Rattus norvegicus
ggaagaaaactggtctaacctaaag

SEQ ID NO: 417236 - DNA, 25 bp, Rattus norvegicus
ggaagaaaagataccctgccctgct

SEQ ID NO: 417237 - DNA, 25 bp, Rattus norvegicus
ggaagaaaagattccctgccctgct

SEQ ID NO: 417238 - DNA, 25 bp, Rattus norvegicus
ggaagaaacatgagccgtgatcccc

SEQ ID NO: 417239 - DNA, 25 bp, Rattus norvegicus
ggaagaaacatgtgccgtgatcccc

SEQ ID NO: 417240 - DNA, 25 bp, Rattus norvegicus
ggaagaaaccttcgctcccaggtat

SEQ ID NO: 417241 - DNA, 25 bp, Rattus norvegicus
ggaagaaaccttggctcccaggtat

SEQ ID NO: 417242 - DNA, 25 bp, Rattus norvegicus
ggaagaaactctcgtgacgcaaata

SEQ ID NO: 417243 - DNA, 25 bp, Rattus norvegicus
ggaagaaactctggtgacgcaaata

SEQ ID NO: 417244 - DNA, 25 bp, Rattus norvegicus
ggaagaaactggcattccatcccct

SEQ ID NO: 417245 - DNA, 25 bp, Rattus norvegicus
ggaagaaactgggattccatcccct

SEQ ID NO: 417246 - DNA, 25 bp, Rattus norvegicus
ggaagaaacttaccctacctcatca

SEQ ID NO: 417247 - DNA, 25 bp, Rattus norvegicus
ggaagaaacttagcctacctcatca

SEQ ID NO: 417248 - DNA, 25 bp, Rattus norvegicus
ggaagaaagtccacatgtctcgatc

SEQ ID NO: 417249 - DNA, 25 bp, Rattus norvegicus
ggaagaaagtcctcatgtctcgatc

SEQ ID NO: 417250 - DNA, 25 bp, Rattus norvegicus
ggaagaaatcccctcaagactgaaa

SEQ ID NO: 417251 - DNA, 25 bp, Rattus norvegicus
ggaagaaatcccgtcaagactgaaa

SEQ ID NO: 417252 - DNA, 25 bp, Rattus norvegicus
ggaagaaatcctccagccaccagag

SEQ ID NO: 417253 - DNA, 25 bp, Rattus norvegicus
ggaagaaatcctgcagccaccagag

SEQ ID NO: 417254 - DNA, 25 bp, Rattus norvegicus
ggaagaaatctaacaccctgtcatg

SEQ ID NO: 417255 - DNA, 25 bp, Rattus norvegicus
ggaagaaatctatcaccctgtcatg

SEQ ID NO: 417256 - DNA, 25 bp, Rattus norvegicus
ggaagaaatgcaccctaacacccct

SEQ ID NO: 417257 - DNA, 25 bp, Rattus norvegicus
ggaagaaatgcaccttctcttgctc

SEQ ID NO: 417258 - DNA, 25 bp, Rattus norvegicus
ggaagaaatgcagcctaacacccct

SEQ ID NO: 417259 - DNA, 25 bp, Rattus norvegicus
ggaagaaatgcagcttctcttgctc

SEQ ID NO: 417260 - DNA, 25 bp, Rattus norvegicus
ggaagaaatgttctctgctgcaatt

SEQ ID NO: 417261 - DNA, 25 bp, Rattus norvegicus
ggaagaaatgttgtctgctgcaatt

SEQ ID NO: 417262 - DNA, 25 bp, Rattus norvegicus
ggaagaacatacctgacatccactt

SEQ ID NO: 417263 - DNA, 25 bp, Rattus norvegicus
ggaagaacatacgtgacatccactt

SEQ ID NO: 417264 - DNA, 25 bp, Rattus norvegicus
ggaagaacatcgacctcacagccat

SEQ ID NO: 417265 - DNA, 25 bp, Rattus norvegicus
ggaagaacatcgtcctcacagccat

SEQ ID NO: 417266 - DNA, 25 bp, Rattus norvegicus
ggaagaacatgacactcctcctcac

SEQ ID NO: 417267 - DNA, 25 bp, Rattus norvegicus
ggaagaacatgagactcctcctcac

SEQ ID NO: 417268 - DNA, 25 bp, Rattus norvegicus
ggaagaacatttccccttagggatc

SEQ ID NO: 417269 - DNA, 25 bp, Rattus norvegicus
ggaagaacatttgcccttagggatc

SEQ ID NO: 417270 - DNA, 25 bp, Rattus norvegicus
ggaagaaccaaaatcacgcaaacat

SEQ ID NO: 417271 - DNA, 25 bp, Rattus norvegicus
ggaagaaccaaattcacgcaaacat

SEQ ID NO: 417272 - DNA, 25 bp, Rattus norvegicus
ggaagaaccagccagaagatccacg

SEQ ID NO: 417273 - DNA, 25 bp, Rattus norvegicus
ggaagaaccagcgagaagatccacg

SEQ ID NO: 417274 - DNA, 25 bp, Rattus norvegicus
ggaagaaccctcaccgaaagtggca

SEQ ID NO: 417275 - DNA, 25 bp, Rattus norvegicus
ggaagaaccctctccgaaagtggca

SEQ ID NO: 417276 - DNA, 25 bp, Rattus norvegicus
ggaagaaccctgagacaagcacatt

SEQ ID NO: 417277 - DNA, 25 bp, Rattus norvegicus
ggaagaaccctgtgacaagcacatt

SEQ ID NO: 417278 - DNA, 25 bp, Rattus norvegicus
ggaagaacgccactcgggacgccac

SEQ ID NO: 417279 - DNA, 25 bp, Rattus norvegicus
ggaagaacgccagtcgggacgccac

SEQ ID NO: 417280 - DNA, 25 bp, Rattus norvegicus
ggaagaacgtcgaagtgcccgtctc

SEQ ID NO: 417281 - DNA, 25 bp, Rattus norvegicus
ggaagaacgtcgtagtgcccgtctc

SEQ ID NO: 417282 - DNA, 25 bp, Rattus norvegicus
ggaagaactaccaactacacgcaga

SEQ ID NO: 417283 - DNA, 25 bp, Rattus norvegicus
ggaagaactacctactacacgcaga

SEQ ID NO: 417284 - DNA, 25 bp, Rattus norvegicus
ggaagaactagactcctctataaaa

SEQ ID NO: 417285 - DNA, 25 bp, Rattus norvegicus
ggaagaactagagtcctctataaaa

SEQ ID NO: 417286 - DNA, 25 bp, Rattus norvegicus
ggaagaactccaccacgatgttcat

SEQ ID NO: 417287 - DNA, 25 bp, Rattus norvegicus
ggaagaactccagcacgatgttcat

SEQ ID NO: 417288 - DNA, 25 bp, Rattus norvegicus
ggaagaactcttacccaaagctatg

SEQ ID NO: 417289 - DNA, 25 bp, Rattus norvegicus
ggaagaactctttcccaaagctatg

SEQ ID NO: 417290 - DNA, 25 bp, Rattus norvegicus
ggaagaactgcacagcctggaccca

SEQ ID NO: 417291 - DNA, 25 bp, Rattus norvegicus
ggaagaactgcagagcctggaccca

SEQ ID NO: 417292 - DNA, 25 bp, Rattus norvegicus
ggaagaactgccaccaaatgttagc

SEQ ID NO: 417293 - DNA, 25 bp, Rattus norvegicus
ggaagaactgcctccaaatgttagc

SEQ ID NO: 417294 - DNA, 25 bp, Rattus norvegicus
ggaagaactgggactcagggctccc

SEQ ID NO: 417295 - DNA, 25 bp, Rattus norvegicus
ggaagaactgggtctcagggctccc

SEQ ID NO: 417296 - DNA, 25 bp, Rattus norvegicus
ggaagaactggtccctcttctagtc

SEQ ID NO: 417297 - DNA, 25 bp, Rattus norvegicus
ggaagaactggtctctcccaagcag

SEQ ID NO: 417298 - DNA, 25 bp, Rattus norvegicus
ggaagaactggtgcctcttctagtc

SEQ ID NO: 417299 - DNA, 25 bp, Rattus norvegicus
ggaagaactggtgtctcccaagcag

SEQ ID NO: 417300 - DNA, 25 bp, Rattus norvegicus
ggaagaacttcacaatgcactacaa

SEQ ID NO: 417301 - DNA, 25 bp, Rattus norvegicus
ggaagaacttcagaatgcactacaa

SEQ ID NO: 417302 - DNA, 25 bp, Rattus norvegicus
ggaagaacttctcaggatcttacaa

SEQ ID NO: 417303 - DNA, 25 bp, Rattus norvegicus
ggaagaacttctgaggatcttacaa

SEQ ID NO: 417304 - DNA, 25 bp, Rattus norvegicus
ggaagaagaaatccctgccagccct

SEQ ID NO: 417305 - DNA, 25 bp, Rattus norvegicus
ggaagaagaaatgcctgccagccct

SEQ ID NO: 417306 - DNA, 25 bp, Rattus norvegicus
ggaagaagagacaccacaggcccca

SEQ ID NO: 417307 - DNA, 25 bp, Rattus norvegicus
ggaagaagagactccacaggcccca

SEQ ID NO: 417308 - DNA, 25 bp, Rattus norvegicus
ggaagaagaggcaagccctacccac

SEQ ID NO: 417309 - DNA, 25 bp, Rattus norvegicus
ggaagaagaggctagccctacccac

SEQ ID NO: 417310 - DNA, 25 bp, Rattus norvegicus
ggaagaagataaaagcctcgctgaa

SEQ ID NO: 417311 - DNA, 25 bp, Rattus norvegicus
ggaagaagataatagcctcgctgaa

SEQ ID NO: 417312 - DNA, 25 bp, Rattus norvegicus
ggaagaagatgacaccactgaggat

SEQ ID NO: 417313 - DNA, 25 bp, Rattus norvegicus
ggaagaagatgagaccactgaggat

SEQ ID NO: 417314 - DNA, 25 bp, Rattus norvegicus
ggaagaagcacaagtcatcctcgga

SEQ ID NO: 417315 - DNA, 25 bp, Rattus norvegicus
ggaagaagcacatgtcatcctcgga

SEQ ID NO: 417316 - DNA, 25 bp, Rattus norvegicus
ggaagaagcaccatggctggcccag

SEQ ID NO: 417317 - DNA, 25 bp, Rattus norvegicus
ggaagaagcaccttggctggcccag

SEQ ID NO: 417318 - DNA, 25 bp, Rattus norvegicus
ggaagaagcagaccctgtggttatc

SEQ ID NO: 417319 - DNA, 25 bp, Rattus norvegicus
ggaagaagcagagcctgtggttatc

SEQ ID NO: 417320 - DNA, 25 bp, Rattus norvegicus
ggaagaagcctaaacccacagcaaa

SEQ ID NO: 417321 - DNA, 25 bp, Rattus norvegicus
ggaagaagcctatacccacagcaaa

SEQ ID NO: 417322 - DNA, 25 bp, Rattus norvegicus
ggaagaagccttcggcgccaactct

SEQ ID NO: 417323 - DNA, 25 bp, Rattus norvegicus
ggaagaagccttgggcgccaactct

SEQ ID NO: 417324 - DNA, 25 bp, Rattus norvegicus
ggaagaagcgtcagcacctaatgca

SEQ ID NO: 417325 - DNA, 25 bp, Rattus norvegicus
ggaagaagcgtctgcacctaatgca

SEQ ID NO: 417326 - DNA, 25 bp, Rattus norvegicus
ggaagaagctacagtgtccccagac

SEQ ID NO: 417327 - DNA, 25 bp, Rattus norvegicus
ggaagaagctactgtgtccccagac

SEQ ID NO: 417328 - DNA, 25 bp, Rattus norvegicus
ggaagaagcttcagtcaccgcaggc

SEQ ID NO: 417329 - DNA, 25 bp, Rattus norvegicus
ggaagaagcttctgtcaccgcaggc

SEQ ID NO: 417330 - DNA, 25 bp, Rattus norvegicus
ggaagaagctttacgtcaccggcag

SEQ ID NO: 417331 - DNA, 25 bp, Rattus norvegicus
ggaagaagcttttcgtcaccggcag

SEQ ID NO: 417332 - DNA, 25 bp, Rattus norvegicus
ggaagaaggatcaggcactcctcca

SEQ ID NO: 417333 - DNA, 25 bp, Rattus norvegicus
ggaagaaggatctggcactcctcca

SEQ ID NO: 417334 - DNA, 25 bp, Rattus norvegicus
ggaagaaggcacagctgcggtccca

SEQ ID NO: 417335 - DNA, 25 bp, Rattus norvegicus
ggaagaaggcacaggtcccctggca

SEQ ID NO: 417336 - DNA, 25 bp, Rattus norvegicus
ggaagaaggcaccactcgtttctgg

SEQ ID NO: 417337 - DNA, 25 bp, Rattus norvegicus
ggaagaaggcacgactcgtttctgg

SEQ ID NO: 417338 - DNA, 25 bp, Rattus norvegicus
ggaagaaggcactgctgcggtccca

SEQ ID NO: 417339 - DNA, 25 bp, Rattus norvegicus
ggaagaaggcactggtcccctggca

SEQ ID NO: 417340 - DNA, 25 bp, Rattus norvegicus
ggaagaaggctgctttctctttgcc

SEQ ID NO: 417341 - DNA, 25 bp, Rattus norvegicus
ggaagaaggctggtttctctttgcc

SEQ ID NO: 417342 - DNA, 25 bp, Rattus norvegicus
ggaagaagggccatttccctgctgc

SEQ ID NO: 417343 - DNA, 25 bp, Rattus norvegicus
ggaagaagggccttttccctgctgc

SEQ ID NO: 417344 - DNA, 25 bp, Rattus norvegicus
ggaagaagtctgaccggcactgatg

SEQ ID NO: 417345 - DNA, 25 bp, Rattus norvegicus
ggaagaagtctgcaccagcagcctt

SEQ ID NO: 417346 - DNA, 25 bp, Rattus norvegicus
ggaagaagtctggaccagcagcctt

SEQ ID NO: 417347 - DNA, 25 bp, Rattus norvegicus
ggaagaagtctgtccggcactgatg

SEQ ID NO: 417348 - DNA, 25 bp, Rattus norvegicus
ggaagaagtggcaggctcccatgac

SEQ ID NO: 417349 - DNA, 25 bp, Rattus norvegicus
ggaagaagtggctggctcccatgac

SEQ ID NO: 417350 - DNA, 25 bp, Rattus norvegicus
ggaagaagtttactgccacgctggc

SEQ ID NO: 417351 - DNA, 25 bp, Rattus norvegicus
ggaagaagtttagtgccacgctggc

SEQ ID NO: 417352 - DNA, 25 bp, Rattus norvegicus
ggaagaatacccagagttgtcctct

SEQ ID NO: 417353 - DNA, 25 bp, Rattus norvegicus
ggaagaataccctgagttgtcctct

SEQ ID NO: 417354 - DNA, 25 bp, Rattus norvegicus
ggaagaatatccagatgtttatggg

SEQ ID NO: 417355 - DNA, 25 bp, Rattus norvegicus
ggaagaatatcctgatgtttatggg

SEQ ID NO: 417356 - DNA, 25 bp, Rattus norvegicus
ggaagaatcaccacctacttcagcc

SEQ ID NO: 417357 - DNA, 25 bp, Rattus norvegicus
ggaagaatcacctcctacttcagcc

SEQ ID NO: 417358 - DNA, 25 bp, Rattus norvegicus
ggaagaatggccatgcctcatctgc

SEQ ID NO: 417359 - DNA, 25 bp, Rattus norvegicus
ggaagaatggccatggcgtacaata

SEQ ID NO: 417360 - DNA, 25 bp, Rattus norvegicus
ggaagaatggccttgcctcatctgc

SEQ ID NO: 417361 - DNA, 25 bp, Rattus norvegicus
ggaagaatggccttggcgtacaata

SEQ ID NO: 417362 - DNA, 25 bp, Rattus norvegicus
ggaagaatgtcacctcttgtcccat

SEQ ID NO: 417363 - DNA, 25 bp, Rattus norvegicus
ggaagaatgtcagctcttgtcccat

SEQ ID NO: 417364 - DNA, 25 bp, Rattus norvegicus
ggaagaatgtctcctcggacggacc

SEQ ID NO: 417365 - DNA, 25 bp, Rattus norvegicus
ggaagaatgtctgctcggacggacc

SEQ ID NO: 417366 - DNA, 25 bp, Rattus norvegicus
ggaagaattcataccaccatcaatg

SEQ ID NO: 417367 - DNA, 25 bp, Rattus norvegicus
ggaagaattcattccaccatcaatg

SEQ ID NO: 417368 - DNA, 25 bp, Rattus norvegicus
ggaagaattccacccaacattaaat

SEQ ID NO: 417369 - DNA, 25 bp, Rattus norvegicus
ggaagaattccagccaacattaaat

SEQ ID NO: 417370 - DNA, 25 bp, Rattus norvegicus
ggaagaattcttcattttcaaagca

SEQ ID NO: 417371 - DNA, 25 bp, Rattus norvegicus
ggaagaattcttgattttcaaagca

SEQ ID NO: 417372 - DNA, 25 bp, Rattus norvegicus
ggaagaattgtccttgtacctcctg

SEQ ID NO: 417373 - DNA, 25 bp, Rattus norvegicus
ggaagaattgtcgttgtacctcctg

SEQ ID NO: 417374 - DNA, 25 bp, Rattus norvegicus
ggaagacaaaaacgcctctgtgagg

SEQ ID NO: 417375 - DNA, 25 bp, Rattus norvegicus
ggaagacaaaaaggcctctgtgagg

SEQ ID NO: 417376 - DNA, 25 bp, Rattus norvegicus
ggaagacaaacccagcatcatgaag

SEQ ID NO: 417377 - DNA, 25 bp, Rattus norvegicus
ggaagacaaaccgagcatcatgaag

SEQ ID NO: 417378 - DNA, 25 bp, Rattus norvegicus
ggaagacaaatccacctgcgagttg

SEQ ID NO: 417379 - DNA, 25 bp, Rattus norvegicus
ggaagacaaatcgacctgcgagttg

SEQ ID NO: 417380 - DNA, 25 bp, Rattus norvegicus
ggaagacaagccaaccctatcagag

SEQ ID NO: 417381 - DNA, 25 bp, Rattus norvegicus
ggaagacaagcctaccctatcagag

SEQ ID NO: 417382 - DNA, 25 bp, Rattus norvegicus
ggaagacaagtcactgacctgcgaa

SEQ ID NO: 417383 - DNA, 25 bp, Rattus norvegicus
ggaagacaagtctctgacctgcgaa

SEQ ID NO: 417384 - DNA, 25 bp, Rattus norvegicus
ggaagacacaagaccctttatgaag

SEQ ID NO: 417385 - DNA, 25 bp, Rattus norvegicus
ggaagacacaagtccctttatgaag

SEQ ID NO: 417386 - DNA, 25 bp, Rattus norvegicus
ggaagacacaccctactggaggtat

SEQ ID NO: 417387 - DNA, 25 bp, Rattus norvegicus
ggaagacacaccgtactggaggtat

SEQ ID NO: 417388 - DNA, 25 bp, Rattus norvegicus
ggaagacacagtatttgattttgta

SEQ ID NO: 417389 - DNA, 25 bp, Rattus norvegicus
ggaagacacagtttttgattttgta

SEQ ID NO: 417390 - DNA, 25 bp, Rattus norvegicus
ggaagacaccaacttctaactccct

SEQ ID NO: 417391 - DNA, 25 bp, Rattus norvegicus
ggaagacaccaagttctaactccct

SEQ ID NO: 417392 - DNA, 25 bp, Rattus norvegicus
ggaagacaccatacaggaacctgga

SEQ ID NO: 417393 - DNA, 25 bp, Rattus norvegicus
ggaagacaccattcaggaacctgga

SEQ ID NO: 417394 - DNA, 25 bp, Rattus norvegicus
ggaagacacctcatgccactctgca

SEQ ID NO: 417395 - DNA, 25 bp, Rattus norvegicus
ggaagacacctcttgccactctgca

SEQ ID NO: 417396 - DNA, 25 bp, Rattus norvegicus
ggaagacacggactctttcaggcgt

SEQ ID NO: 417397 - DNA, 25 bp, Rattus norvegicus
ggaagacacggagtctttcaggcgt

SEQ ID NO: 417398 - DNA, 25 bp, Rattus norvegicus
ggaagacactccctctgatagtgac

SEQ ID NO: 417399 - DNA, 25 bp, Rattus norvegicus
ggaagacactccgtctgatagtgac

SEQ ID NO: 417400 - DNA, 25 bp, Rattus norvegicus
ggaagacactggacccattttcttt

SEQ ID NO: 417401 - DNA, 25 bp, Rattus norvegicus
ggaagacactggtcccattttcttt

SEQ ID NO: 417402 - DNA, 25 bp, Rattus norvegicus
ggaagacacttcagaaccattcagt

SEQ ID NO: 417403 - DNA, 25 bp, Rattus norvegicus
ggaagacacttctgaaccattcagt

SEQ ID NO: 417404 - DNA, 25 bp, Rattus norvegicus
ggaagacagactcatccagtgccac

SEQ ID NO: 417405 - DNA, 25 bp, Rattus norvegicus
ggaagacagactgatccagtgccac

SEQ ID NO: 417406 - DNA, 25 bp, Rattus norvegicus
ggaagacagagcatactccagccta

SEQ ID NO: 417407 - DNA, 25 bp, Rattus norvegicus
ggaagacagagcttactccagccta

SEQ ID NO: 417408 - DNA, 25 bp, Rattus norvegicus
ggaagacagcagacctcagacgaca

SEQ ID NO: 417409 - DNA, 25 bp, Rattus norvegicus
ggaagacagcagtcctcagacgaca

SEQ ID NO: 417410 - DNA, 25 bp, Rattus norvegicus
ggaagacagccaatagcacccatta

SEQ ID NO: 417411 - DNA, 25 bp, Rattus norvegicus
ggaagacagccactgtgtgcagcat

SEQ ID NO: 417412 - DNA, 25 bp, Rattus norvegicus
ggaagacagccagtgtgtgcagcat

SEQ ID NO: 417413 - DNA, 25 bp, Rattus norvegicus
ggaagacagccattagcacccatta

SEQ ID NO: 417414 - DNA, 25 bp, Rattus norvegicus
ggaagacagcctcagcttgtttaga

SEQ ID NO: 417415 - DNA, 25 bp, Rattus norvegicus
ggaagacagcctgagcttgtttaga

SEQ ID NO: 417416 - DNA, 25 bp, Rattus norvegicus
ggaagacagctaaaggctccacctc

SEQ ID NO: 417417 - DNA, 25 bp, Rattus norvegicus
ggaagacagctataggctccacctc

SEQ ID NO: 417418 - DNA, 25 bp, Rattus norvegicus
ggaagacaggcaatgatgagcacat

SEQ ID NO: 417419 - DNA, 25 bp, Rattus norvegicus
ggaagacaggcattgatgagcacat

SEQ ID NO: 417420 - DNA, 25 bp, Rattus norvegicus
ggaagacagtggaccaacctaattg

SEQ ID NO: 417421 - DNA, 25 bp, Rattus norvegicus
ggaagacagtggtccaacctaattg

SEQ ID NO: 417422 - DNA, 25 bp, Rattus norvegicus
ggaagacagtttacaaccgcctcaa

SEQ ID NO: 417423 - DNA, 25 bp, Rattus norvegicus
ggaagacagttttcaaccgcctcaa

SEQ ID NO: 417424 - DNA, 25 bp, Rattus norvegicus
ggaagacataccaatcaccatggaa

SEQ ID NO: 417425 - DNA, 25 bp, Rattus norvegicus
ggaagacatacctatcaccatggaa

SEQ ID NO: 417426 - DNA, 25 bp, Rattus norvegicus
ggaagacatccaccttaaccttttc

SEQ ID NO: 417427 - DNA, 25 bp, Rattus norvegicus
ggaagacatccagcttaaccttttc

SEQ ID NO: 417428 - DNA, 25 bp, Rattus norvegicus
ggaagacatgcaccactgttgcctt

SEQ ID NO: 417429 - DNA, 25 bp, Rattus norvegicus
ggaagacatgcagcactgttgcctt

SEQ ID NO: 417430 - DNA, 25 bp, Rattus norvegicus
ggaagacatgggaccttgttgttca

SEQ ID NO: 417431 - DNA, 25 bp, Rattus norvegicus
ggaagacatgggtccttgttgttca

SEQ ID NO: 417432 - DNA, 25 bp, Rattus norvegicus
ggaagacatgttcccatggatcata

SEQ ID NO: 417433 - DNA, 25 bp, Rattus norvegicus
ggaagacatgttgccatggatcata

SEQ ID NO: 417434 - DNA, 25 bp, Rattus norvegicus
ggaagacatttcaagcccaaaggaa

SEQ ID NO: 417435 - DNA, 25 bp, Rattus norvegicus
ggaagacatttctagcccaaaggaa

SEQ ID NO: 417436 - DNA, 25 bp, Rattus norvegicus
ggaagacatttgaaactgccatttt

SEQ ID NO: 417437 - DNA, 25 bp, Rattus norvegicus
ggaagacatttgaacacagcagaat

SEQ ID NO: 417438 - DNA, 25 bp, Rattus norvegicus
ggaagacatttgtaactgccatttt

SEQ ID NO: 417439 - DNA, 25 bp, Rattus norvegicus
ggaagacatttgtacacagcagaat

SEQ ID NO: 417440 - DNA, 25 bp, Rattus norvegicus
ggaagaccaataccactgcctcggc

SEQ ID NO: 417441 - DNA, 25 bp, Rattus norvegicus
ggaagaccaatagcactgcctcggc

SEQ ID NO: 417442 - DNA, 25 bp, Rattus norvegicus
ggaagaccaatgatgtccctgcagg

SEQ ID NO: 417443 - DNA, 25 bp, Rattus norvegicus
ggaagaccaatgttgtccctgcagg

SEQ ID NO: 417444 - DNA, 25 bp, Rattus norvegicus
ggaagaccacagacgaggacctgtt

SEQ ID NO: 417445 - DNA, 25 bp, Rattus norvegicus
ggaagaccacagtcgaggacctgtt

SEQ ID NO: 417446 - DNA, 25 bp, Rattus norvegicus
ggaagaccagaaccgatacctagat

SEQ ID NO: 417447 - DNA, 25 bp, Rattus norvegicus
ggaagaccagaagcgatacctagat

SEQ ID NO: 417448 - DNA, 25 bp, Rattus norvegicus
ggaagaccagctctttggatccaaa

SEQ ID NO: 417449 - DNA, 25 bp, Rattus norvegicus
ggaagaccagctgtttggatccaaa

SEQ ID NO: 417450 - DNA, 25 bp, Rattus norvegicus
ggaagaccatagcacaccaggctct

SEQ ID NO: 417451 - DNA, 25 bp, Rattus norvegicus
ggaagaccataggacaccaggctct

SEQ ID NO: 417452 - DNA, 25 bp, Rattus norvegicus
ggaagacccagactttgaggccatc

SEQ ID NO: 417453 - DNA, 25 bp, Rattus norvegicus
ggaagacccagagtttgaggccatc

SEQ ID NO: 417454 - DNA, 25 bp, Rattus norvegicus
ggaagaccccaacgatgtctgtgtc

SEQ ID NO: 417455 - DNA, 25 bp, Rattus norvegicus
ggaagaccccaaggatgtctgtgtc

SEQ ID NO: 417456 - DNA, 25 bp, Rattus norvegicus
ggaagaccccagagcagccatgggc

SEQ ID NO: 417457 - DNA, 25 bp, Rattus norvegicus
ggaagaccccagtgcagccatgggc

SEQ ID NO: 417458 - DNA, 25 bp, Rattus norvegicus
ggaagaccccgacgctcggcgactt

SEQ ID NO: 417459 - DNA, 25 bp, Rattus norvegicus
ggaagaccccgaggctcggcgactt

SEQ ID NO: 417460 - DNA, 25 bp, Rattus norvegicus
ggaagacccgttagtcatccatgag

SEQ ID NO: 417461 - DNA, 25 bp, Rattus norvegicus
ggaagacccgtttgtcatccatgag

SEQ ID NO: 417462 - DNA, 25 bp, Rattus norvegicus
ggaagaccctccaaaaccagcagag

SEQ ID NO: 417463 - DNA, 25 bp, Rattus norvegicus
ggaagaccctcctaaaccagcagag

SEQ ID NO: 417464 - DNA, 25 bp, Rattus norvegicus
ggaagaccctgtcccgggactcgct

SEQ ID NO: 417465 - DNA, 25 bp, Rattus norvegicus
ggaagaccctgtgccgggactcgct

SEQ ID NO: 417466 - DNA, 25 bp, Rattus norvegicus
ggaagacccttacaatctgggagtt

SEQ ID NO: 417467 - DNA, 25 bp, Rattus norvegicus
ggaagacccttagaatctgggagtt

SEQ ID NO: 417468 - DNA, 25 bp, Rattus norvegicus
ggaagaccgtacaccaatggctgaa

SEQ ID NO: 417469 - DNA, 25 bp, Rattus norvegicus
ggaagaccgtactccaatggctgaa

SEQ ID NO: 417470 - DNA, 25 bp, Rattus norvegicus
ggaagacctcagacctaacctttca

SEQ ID NO: 417471 - DNA, 25 bp, Rattus norvegicus
ggaagacctcagtcctaacctttca

SEQ ID NO: 417472 - DNA, 25 bp, Rattus norvegicus
ggaagacctcccaaacgaatatctt

SEQ ID NO: 417473 - DNA, 25 bp, Rattus norvegicus
ggaagacctccctaacgaatatctt

SEQ ID NO: 417474 - DNA, 25 bp, Rattus norvegicus
ggaagacctctcaggtcagagctgc

SEQ ID NO: 417475 - DNA, 25 bp, Rattus norvegicus
ggaagacctctccttcaacttgtag

SEQ ID NO: 417476 - DNA, 25 bp, Rattus norvegicus
ggaagacctctcgttcaacttgtag

SEQ ID NO: 417477 - DNA, 25 bp, Rattus norvegicus
ggaagacctctctggtcagagctgc

SEQ ID NO: 417478 - DNA, 25 bp, Rattus norvegicus
ggaagacctgatctctgactcttta

SEQ ID NO: 417479 - DNA, 25 bp, Rattus norvegicus
ggaagacctgatgtctgactcttta

SEQ ID NO: 417480 - DNA, 25 bp, Rattus norvegicus
ggaagacctgctaggtgccctgtcc

SEQ ID NO: 417481 - DNA, 25 bp, Rattus norvegicus
ggaagacctgcttggtgccctgtcc

SEQ ID NO: 417482 - DNA, 25 bp, Rattus norvegicus
ggaagacctgtgacgtgagcccaag

SEQ ID NO: 417483 - DNA, 25 bp, Rattus norvegicus
ggaagacctgtgtcgtgagcccaag

SEQ ID NO: 417484 - DNA, 25 bp, Rattus norvegicus
ggaagaccttaaacctactcagctc

SEQ ID NO: 417485 - DNA, 25 bp, Rattus norvegicus
ggaagaccttaatcctactcagctc

SEQ ID NO: 417486 - DNA, 25 bp, Rattus norvegicus
ggaagaccttccagttaatgactat

SEQ ID NO: 417487 - DNA, 25 bp, Rattus norvegicus
ggaagaccttcctgttaatgactat

SEQ ID NO: 417488 - DNA, 25 bp, Rattus norvegicus
ggaagaccttgccagagcaactttg

SEQ ID NO: 417489 - DNA, 25 bp, Rattus norvegicus
ggaagaccttgcgagagcaactttg

SEQ ID NO: 417490 - DNA, 25 bp, Rattus norvegicus
ggaagacgacttagccagaggccta

SEQ ID NO: 417491 - DNA, 25 bp, Rattus norvegicus
ggaagacgactttgccagaggccta

SEQ ID NO: 417492 - DNA, 25 bp, Rattus norvegicus
ggaagacgcatcagctcagcgggct

SEQ ID NO: 417493 - DNA, 25 bp, Rattus norvegicus
ggaagacgcatctgctcagcgggct

SEQ ID NO: 417494 - DNA, 25 bp, Rattus norvegicus
ggaagacggattatcagggtgaatc

SEQ ID NO: 417495 - DNA, 25 bp, Rattus norvegicus
ggaagacggattttcagggtgaatc

SEQ ID NO: 417496 - DNA, 25 bp, Rattus norvegicus
ggaagacgtcccaattcatgtccga

SEQ ID NO: 417497 - DNA, 25 bp, Rattus norvegicus
ggaagacgtccctattcatgtccga

SEQ ID NO: 417498 - DNA, 25 bp, Rattus norvegicus
ggaagacgtggacctctgcacacag

SEQ ID NO: 417499 - DNA, 25 bp, Rattus norvegicus
ggaagacgtggagctctgcacacag

SEQ ID NO: 417500 - DNA, 25 bp, Rattus norvegicus
ggaagacgtgtacctgccatgcctt

SEQ ID NO: 417501 - DNA, 25 bp, Rattus norvegicus
ggaagacgtgtagctgccatgcctt

SEQ ID NO: 417502 - DNA, 25 bp, Rattus norvegicus
ggaagactagaaactgcccctctgg

SEQ ID NO: 417503 - DNA, 25 bp, Rattus norvegicus
ggaagactagaatctgcccctctgg

SEQ ID NO: 417504 - DNA, 25 bp, Rattus norvegicus
ggaagactagtgctttgtgcatttt

SEQ ID NO: 417505 - DNA, 25 bp, Rattus norvegicus
ggaagactagtggtttgtgcatttt

SEQ ID NO: 417506 - DNA, 25 bp, Rattus norvegicus
ggaagactatttcacctccacagaa

SEQ ID NO: 417507 - DNA, 25 bp, Rattus norvegicus
ggaagactatttgacctccacagaa

SEQ ID NO: 417508 - DNA, 25 bp, Rattus norvegicus
ggaagactccacaagctttcatggt

SEQ ID NO: 417509 - DNA, 25 bp, Rattus norvegicus
ggaagactccactagctttcatggt

SEQ ID NO: 417510 - DNA, 25 bp, Rattus norvegicus
ggaagactcccgaggagcccgaagt

SEQ ID NO: 417511 - DNA, 25 bp, Rattus norvegicus
ggaagactcccgtggagcccgaagt

SEQ ID NO: 417512 - DNA, 25 bp, Rattus norvegicus
ggaagactccggcaacataaaccct

SEQ ID NO: 417513 - DNA, 25 bp, Rattus norvegicus
ggaagactccgggaacataaaccct

SEQ ID NO: 417514 - DNA, 25 bp, Rattus norvegicus
ggaagactcctgattgatctttgag

SEQ ID NO: 417515 - DNA, 25 bp, Rattus norvegicus
ggaagactcctgtttgatctttgag

SEQ ID NO: 417516 - DNA, 25 bp, Rattus norvegicus
ggaagactctcaagagatgccccac

SEQ ID NO: 417517 - DNA, 25 bp, Rattus norvegicus
ggaagactctcatgagatgccccac

SEQ ID NO: 417518 - DNA, 25 bp, Rattus norvegicus
ggaagactgaagaccaaccctttca

SEQ ID NO: 417519 - DNA, 25 bp, Rattus norvegicus
ggaagactgaagtccaaccctttca

SEQ ID NO: 417520 - DNA, 25 bp, Rattus norvegicus
ggaagactgacgaccacttgtgcac

SEQ ID NO: 417521 - DNA, 25 bp, Rattus norvegicus
ggaagactgacgtccacttgtgcac

SEQ ID NO: 417522 - DNA, 25 bp, Rattus norvegicus
ggaagactgagacccatccaaattg

SEQ ID NO: 417523 - DNA, 25 bp, Rattus norvegicus
ggaagactgagagccatccaaattg

SEQ ID NO: 417524 - DNA, 25 bp, Rattus norvegicus
ggaagactgatgatcatgggtaaaa

SEQ ID NO: 417525 - DNA, 25 bp, Rattus norvegicus
ggaagactgatgttcatgggtaaaa

SEQ ID NO: 417526 - DNA, 25 bp, Rattus norvegicus
ggaagactggttagccaacatcccc

SEQ ID NO: 417527 - DNA, 25 bp, Rattus norvegicus
ggaagactggtttgccaacatcccc

SEQ ID NO: 417528 - DNA, 25 bp, Rattus norvegicus
ggaagactgtacacaacgcccagct

SEQ ID NO: 417529 - DNA, 25 bp, Rattus norvegicus
ggaagactgtactcaacgcccagct

SEQ ID NO: 417530 - DNA, 25 bp, Rattus norvegicus
ggaagactgtctacaaataatcaaa

SEQ ID NO: 417531 - DNA, 25 bp, Rattus norvegicus
ggaagactgtcttcaaataatcaaa

SEQ ID NO: 417532 - DNA, 25 bp, Rattus norvegicus
ggaagactgttcctgcatccacgac

SEQ ID NO: 417533 - DNA, 25 bp, Rattus norvegicus
ggaagactgttcgtgcatccacgac

SEQ ID NO: 417534 - DNA, 25 bp, Rattus norvegicus
ggaagacttaatcctcagagggcct

SEQ ID NO: 417535 - DNA, 25 bp, Rattus norvegicus
ggaagacttaatgctcagagggcct

SEQ ID NO: 417536 - DNA, 25 bp, Rattus norvegicus
ggaagacttcacattcaatgacttg

SEQ ID NO: 417537 - DNA, 25 bp, Rattus norvegicus
ggaagacttcactttcaatgacttg

SEQ ID NO: 417538 - DNA, 25 bp, Rattus norvegicus
ggaagacttcatcaaagcagtcaga

SEQ ID NO: 417539 - DNA, 25 bp, Rattus norvegicus
ggaagacttcatgaaagcagtcaga

SEQ ID NO: 417540 - DNA, 25 bp, Rattus norvegicus
ggaagacttctcatggacactggct

SEQ ID NO: 417541 - DNA, 25 bp, Rattus norvegicus
ggaagacttctcttggacactggct

SEQ ID NO: 417542 - DNA, 25 bp, Rattus norvegicus
ggaagacttcttcaaggcctcctgc

SEQ ID NO: 417543 - DNA, 25 bp, Rattus norvegicus
ggaagacttcttcagactgattata

SEQ ID NO: 417544 - DNA, 25 bp, Rattus norvegicus
ggaagacttcttgaaggcctcctgc

SEQ ID NO: 417545 - DNA, 25 bp, Rattus norvegicus
ggaagacttcttgagactgattata

SEQ ID NO: 417546 - DNA, 25 bp, Rattus norvegicus
ggaagacttgatatcagtcctcagt

SEQ ID NO: 417547 - DNA, 25 bp, Rattus norvegicus
ggaagacttgatttcagtcctcagt

SEQ ID NO: 417548 - DNA, 25 bp, Rattus norvegicus
ggaagacttgggactccactgtccg

SEQ ID NO: 417549 - DNA, 25 bp, Rattus norvegicus
ggaagacttgggtctccactgtccg

SEQ ID NO: 417550 - DNA, 25 bp, Rattus norvegicus
ggaagactttagactccgtctcaac

SEQ ID NO: 417551 - DNA, 25 bp, Rattus norvegicus
ggaagactttagtctccgtctcaac

SEQ ID NO: 417552 - DNA, 25 bp, Rattus norvegicus
ggaagactttccacaggttttgtgg

SEQ ID NO: 417553 - DNA, 25 bp, Rattus norvegicus
ggaagactttcctcaggttttgtgg

SEQ ID NO: 417554 - DNA, 25 bp, Rattus norvegicus
ggaagactttttcatcccgctaact

SEQ ID NO: 417555 - DNA, 25 bp, Rattus norvegicus
ggaagactttttgatcccgctaact

SEQ ID NO: 417556 - DNA, 25 bp, Rattus norvegicus
ggaagagaaacgacgcatccgccgt

SEQ ID NO: 417557 - DNA, 25 bp, Rattus norvegicus
ggaagagaaacgtcgcatccgccgt

SEQ ID NO: 417558 - DNA, 25 bp, Rattus norvegicus
ggaagagaacagaggccccatcctt

SEQ ID NO: 417559 - DNA, 25 bp, Rattus norvegicus
ggaagagaacagtggccccatcctt

SEQ ID NO: 417560 - DNA, 25 bp, Rattus norvegicus
ggaagagaactgagcctgtctttta

SEQ ID NO: 417561 - DNA, 25 bp, Rattus norvegicus
ggaagagaactgtgcctgtctttta

SEQ ID NO: 417562 - DNA, 25 bp, Rattus norvegicus
ggaagagaagccacagccaccaagt

SEQ ID NO: 417563 - DNA, 25 bp, Rattus norvegicus
ggaagagaagcctcagccaccaagt

SEQ ID NO: 417564 - DNA, 25 bp, Rattus norvegicus
ggaagagaagggacagcctccaccc

SEQ ID NO: 417565 - DNA, 25 bp, Rattus norvegicus
ggaagagaagggtcagcctccaccc

SEQ ID NO: 417566 - DNA, 25 bp, Rattus norvegicus
ggaagagacactcgacgccctggca

SEQ ID NO: 417567 - DNA, 25 bp, Rattus norvegicus
ggaagagacactggacgccctggca

SEQ ID NO: 417568 - DNA, 25 bp, Rattus norvegicus
ggaagagaccaaagagaaagccctg

SEQ ID NO: 417569 - DNA, 25 bp, Rattus norvegicus
ggaagagaccaatgagaaagccctg

SEQ ID NO: 417570 - DNA, 25 bp, Rattus norvegicus
ggaagagacgctatggctgcctgat

SEQ ID NO: 417571 - DNA, 25 bp, Rattus norvegicus
ggaagagacgctttggctgcctgat

SEQ ID NO: 417572 - DNA, 25 bp, Rattus norvegicus
ggaagagacgtccactcatgagcaa

SEQ ID NO: 417573 - DNA, 25 bp, Rattus norvegicus
ggaagagacgtcgactcatgagcaa

SEQ ID NO: 417574 - DNA, 25 bp, Rattus norvegicus
ggaagagacgttacctcattctttt

SEQ ID NO: 417575 - DNA, 25 bp, Rattus norvegicus
ggaagagacgtttcctcattctttt

SEQ ID NO: 417576 - DNA, 25 bp, Rattus norvegicus
ggaagagactccaacagctagaact

SEQ ID NO: 417577 - DNA, 25 bp, Rattus norvegicus
ggaagagactcctacagctagaact

SEQ ID NO: 417578 - DNA, 25 bp, Rattus norvegicus
ggaagagactggagctgtgactcca

SEQ ID NO: 417579 - DNA, 25 bp, Rattus norvegicus
ggaagagactggtgctgtgactcca

SEQ ID NO: 417580 - DNA, 25 bp, Rattus norvegicus
ggaagagaggctcatcttcgccatc

SEQ ID NO: 417581 - DNA, 25 bp, Rattus norvegicus
ggaagagaggctgatcttcgccatc

SEQ ID NO: 417582 - DNA, 25 bp, Rattus norvegicus
ggaagagatccaacagctgcactcg

SEQ ID NO: 417583 - DNA, 25 bp, Rattus norvegicus
ggaagagatccatcagctgcactcg

SEQ ID NO: 417584 - DNA, 25 bp, Rattus norvegicus
ggaagagatcccacgcgtgagccca

SEQ ID NO: 417585 - DNA, 25 bp, Rattus norvegicus
ggaagagatccctcgcgtgagccca

SEQ ID NO: 417586 - DNA, 25 bp, Rattus norvegicus
ggaagagatgaccaccacggtcctg

SEQ ID NO: 417587 - DNA, 25 bp, Rattus norvegicus
ggaagagatgacgaccacggtcctg

SEQ ID NO: 417588 - DNA, 25 bp, Rattus norvegicus
ggaagagatgatcgctgtcctttca

SEQ ID NO: 417589 - DNA, 25 bp, Rattus norvegicus
ggaagagatgatggctgtcctttca

SEQ ID NO: 417590 - DNA, 25 bp, Rattus norvegicus
ggaagagcaagtagccccgaggtct

SEQ ID NO: 417591 - DNA, 25 bp, Rattus norvegicus
ggaagagcaagttgccccgaggtct

SEQ ID NO: 417592 - DNA, 25 bp, Rattus norvegicus
ggaagagcacgcacggcctggctat

SEQ ID NO: 417593 - DNA, 25 bp, Rattus norvegicus
ggaagagcacgctcggcctggctat

SEQ ID NO: 417594 - DNA, 25 bp, Rattus norvegicus
ggaagagcagcacctgaccagcaaa

SEQ ID NO: 417595 - DNA, 25 bp, Rattus norvegicus
ggaagagcagcagctgaccagcaaa

SEQ ID NO: 417596 - DNA, 25 bp, Rattus norvegicus
ggaagagcagcgaccaaccgcccgg

SEQ ID NO: 417597 - DNA, 25 bp, Rattus norvegicus
ggaagagcagcgtccaaccgcccgg

SEQ ID NO: 417598 - DNA, 25 bp, Rattus norvegicus
ggaagagccactccaacagtgtatt

SEQ ID NO: 417599 - DNA, 25 bp, Rattus norvegicus
ggaagagccactgcaacagtgtatt

SEQ ID NO: 417600 - DNA, 25 bp, Rattus norvegicus
ggaagagccagcaccagcttgagaa

SEQ ID NO: 417601 - DNA, 25 bp, Rattus norvegicus
ggaagagccagctccagcttgagaa

SEQ ID NO: 417602 - DNA, 25 bp, Rattus norvegicus
ggaagagccaggaggctgtccccac

SEQ ID NO: 417603 - DNA, 25 bp, Rattus norvegicus
ggaagagccaggtggctgtccccac

SEQ ID NO: 417604 - DNA, 25 bp, Rattus norvegicus
ggaagagcccggattgtaccttcta

SEQ ID NO: 417605 - DNA, 25 bp, Rattus norvegicus
ggaagagcccggtttgtaccttcta

SEQ ID NO: 417606 - DNA, 25 bp, Rattus norvegicus
ggaagagccctcacatacttacttg

SEQ ID NO: 417607 - DNA, 25 bp, Rattus norvegicus
ggaagagccctctcatacttacttg

SEQ ID NO: 417608 - DNA, 25 bp, Rattus norvegicus
ggaagagcccttaggttcccagaag

SEQ ID NO: 417609 - DNA, 25 bp, Rattus norvegicus
ggaagagccctttggttcccagaag

SEQ ID NO: 417610 - DNA, 25 bp, Rattus norvegicus
ggaagagccgcacacttacagttgc

SEQ ID NO: 417611 - DNA, 25 bp, Rattus norvegicus
ggaagagccgcagacttacagttgc

SEQ ID NO: 417612 - DNA, 25 bp, Rattus norvegicus
ggaagagcgcacactcgacattctt

SEQ ID NO: 417613 - DNA, 25 bp, Rattus norvegicus
ggaagagcgcactctcgacattctt

SEQ ID NO: 417614 - DNA, 25 bp, Rattus norvegicus
ggaagagctaaactcctcagcacct

SEQ ID NO: 417615 - DNA, 25 bp, Rattus norvegicus
ggaagagctaaagtcctcagcacct

SEQ ID NO: 417616 - DNA, 25 bp, Rattus norvegicus
ggaagagctcaactccaagatgatg

SEQ ID NO: 417617 - DNA, 25 bp, Rattus norvegicus
ggaagagctcaagtccaagatgatg

SEQ ID NO: 417618 - DNA, 25 bp, Rattus norvegicus
ggaagagctctaatgctgctcccat

SEQ ID NO: 417619 - DNA, 25 bp, Rattus norvegicus
ggaagagctctattgctgctcccat

SEQ ID NO: 417620 - DNA, 25 bp, Rattus norvegicus
ggaagagctgagagccaccggcctt

SEQ ID NO: 417621 - DNA, 25 bp, Rattus norvegicus
ggaagagctgagtgccaccggcctt

SEQ ID NO: 417622 - DNA, 25 bp, Rattus norvegicus
ggaagagctgcacaggagcctcaac

SEQ ID NO: 417623 - DNA, 25 bp, Rattus norvegicus
ggaagagctgcagaggagcctcaac

SEQ ID NO: 417624 - DNA, 25 bp, Rattus norvegicus
ggaagagcttcccaatacattatga

SEQ ID NO: 417625 - DNA, 25 bp, Rattus norvegicus
ggaagagcttccctgtgcccagtgt

SEQ ID NO: 417626 - DNA, 25 bp, Rattus norvegicus
ggaagagcttccgaatacattatga

SEQ ID NO: 417627 - DNA, 25 bp, Rattus norvegicus
ggaagagcttccgtgtgcccagtgt

SEQ ID NO: 417628 - DNA, 25 bp, Rattus norvegicus
ggaagagcttcgacctgggctcacc

SEQ ID NO: 417629 - DNA, 25 bp, Rattus norvegicus
ggaagagcttcgtcctgggctcacc

SEQ ID NO: 417630 - DNA, 25 bp, Rattus norvegicus
ggaagaggaccccaaacttcacact

SEQ ID NO: 417631 - DNA, 25 bp, Rattus norvegicus
ggaagaggacccgaaacttcacact

SEQ ID NO: 417632 - DNA, 25 bp, Rattus norvegicus
ggaagaggacttcctaccctttcac

SEQ ID NO: 417633 - DNA, 25 bp, Rattus norvegicus
ggaagaggacttgctaccctttcac

SEQ ID NO: 417634 - DNA, 25 bp, Rattus norvegicus
ggaagaggagcaaccctcagcagcc

SEQ ID NO: 417635 - DNA, 25 bp, Rattus norvegicus
ggaagaggagcatccctcagcagcc

SEQ ID NO: 417636 - DNA, 25 bp, Rattus norvegicus
ggaagaggagccattctgttcactc

SEQ ID NO: 417637 - DNA, 25 bp, Rattus norvegicus
ggaagaggagcctttctgttcactc

SEQ ID NO: 417638 - DNA, 25 bp, Rattus norvegicus
ggaagaggaggaaccctctcgcact

SEQ ID NO: 417639 - DNA, 25 bp, Rattus norvegicus
ggaagaggaggatccctctcgcact

SEQ ID NO: 417640 - DNA, 25 bp, Rattus norvegicus
ggaagaggcaggctaccccaaagta

SEQ ID NO: 417641 - DNA, 25 bp, Rattus norvegicus
ggaagaggcagggtaccccaaagta

SEQ ID NO: 417642 - DNA, 25 bp, Rattus norvegicus
ggaagaggcatgactgatcctgcct

SEQ ID NO: 417643 - DNA, 25 bp, Rattus norvegicus
ggaagaggcatgtctgatcctgcct

SEQ ID NO: 417644 - DNA, 25 bp, Rattus norvegicus
ggaagaggccctatctgaggctgac

SEQ ID NO: 417645 - DNA, 25 bp, Rattus norvegicus
ggaagaggccctttctgaggctgac

SEQ ID NO: 417646 - DNA, 25 bp, Rattus norvegicus
ggaagaggccgcaactattccccca

SEQ ID NO: 417647 - DNA, 25 bp, Rattus norvegicus
ggaagaggccgctactattccccca

SEQ ID NO: 417648 - DNA, 25 bp, Rattus norvegicus
ggaagaggcctaatgtttcttagtt

SEQ ID NO: 417649 - DNA, 25 bp, Rattus norvegicus
ggaagaggcctattgtttcttagtt

SEQ ID NO: 417650 - DNA, 25 bp, Rattus norvegicus
ggaagaggcctcctagtacctgctt

SEQ ID NO: 417651 - DNA, 25 bp, Rattus norvegicus
ggaagaggcctcgtagtacctgctt

SEQ ID NO: 417652 - DNA, 25 bp, Rattus norvegicus
ggaagaggcctgagagccctcagaa

SEQ ID NO: 417653 - DNA, 25 bp, Rattus norvegicus
ggaagaggcctgtgagccctcagaa

SEQ ID NO: 417654 - DNA, 25 bp, Rattus norvegicus
ggaagaggccttcgcgcatcctttc

SEQ ID NO: 417655 - DNA, 25 bp, Rattus norvegicus
ggaagaggccttctataccacagac

SEQ ID NO: 417656 - DNA, 25 bp, Rattus norvegicus
ggaagaggccttggcgcatcctttc

SEQ ID NO: 417657 - DNA, 25 bp, Rattus norvegicus
ggaagaggccttgtataccacagac

SEQ ID NO: 417658 - DNA, 25 bp, Rattus norvegicus
ggaagaggctacaggccaggcctct

SEQ ID NO: 417659 - DNA, 25 bp, Rattus norvegicus
ggaagaggctactggccaggcctct

SEQ ID NO: 417660 - DNA, 25 bp, Rattus norvegicus
ggaagaggcttcagttaataccgaa

SEQ ID NO: 417661 - DNA, 25 bp, Rattus norvegicus
ggaagaggcttctgttaataccgaa

SEQ ID NO: 417662 - DNA, 25 bp, Rattus norvegicus
ggaagaggtcaccaaggccactaga

SEQ ID NO: 417663 - DNA, 25 bp, Rattus norvegicus
ggaagaggtcacgaaggccactaga

SEQ ID NO: 417664 - DNA, 25 bp, Rattus norvegicus
ggaagaggtcataatcagctggtca

SEQ ID NO: 417665 - DNA, 25 bp, Rattus norvegicus
ggaagaggtcattatcagctggtca

SEQ ID NO: 417666 - DNA, 25 bp, Rattus norvegicus
ggaagaggtctgagccatccctgtg

SEQ ID NO: 417667 - DNA, 25 bp, Rattus norvegicus
ggaagaggtctgtgccatccctgtg

SEQ ID NO: 417668 - DNA, 25 bp, Rattus norvegicus
ggaagagtaagacgtacaacccaag

SEQ ID NO: 417669 - DNA, 25 bp, Rattus norvegicus
ggaagagtaagaggtacaacccaag

SEQ ID NO: 417670 - DNA, 25 bp, Rattus norvegicus
ggaagagtagtcagtctgtctatta

SEQ ID NO: 417671 - DNA, 25 bp, Rattus norvegicus
ggaagagtagtctgtctgtctatta

SEQ ID NO: 417672 - DNA, 25 bp, Rattus norvegicus
ggaagagtcactccactcctcggaa

SEQ ID NO: 417673 - DNA, 25 bp, Rattus norvegicus
ggaagagtcactgcactcctcggaa

SEQ ID NO: 417674 - DNA, 25 bp, Rattus norvegicus
ggaagagtcagcatgtccccaggaa

SEQ ID NO: 417675 - DNA, 25 bp, Rattus norvegicus
ggaagagtcagcttgtccccaggaa

SEQ ID NO: 417676 - DNA, 25 bp, Rattus norvegicus
ggaagagtcagtccccagtggccac

SEQ ID NO: 417677 - DNA, 25 bp, Rattus norvegicus
ggaagagtcagtgcccagtggccac

SEQ ID NO: 417678 - DNA, 25 bp, Rattus norvegicus
ggaagagtcattatcagtattactg

SEQ ID NO: 417679 - DNA, 25 bp, Rattus norvegicus
ggaagagtcattttcagtattactg

SEQ ID NO: 417680 - DNA, 25 bp, Rattus norvegicus
ggaagagtccacaatcctttctcac

SEQ ID NO: 417681 - DNA, 25 bp, Rattus norvegicus
ggaagagtccactatcctttctcac

SEQ ID NO: 417682 - DNA, 25 bp, Rattus norvegicus
ggaagagtccagagcctttgcccag

SEQ ID NO: 417683 - DNA, 25 bp, Rattus norvegicus
ggaagagtccagtgcctttgcccag

SEQ ID NO: 417684 - DNA, 25 bp, Rattus norvegicus
ggaagagtccgtccagttcgacttc

SEQ ID NO: 417685 - DNA, 25 bp, Rattus norvegicus
ggaagagtccgtgcagttcgacttc

SEQ ID NO: 417686 - DNA, 25 bp, Rattus norvegicus
ggaagagtcggaatggtagcttaca

SEQ ID NO: 417687 - DNA, 25 bp, Rattus norvegicus
ggaagagtcggattggtagcttaca

SEQ ID NO: 417688 - DNA, 25 bp, Rattus norvegicus
ggaagagtctcaatttggttttaag

SEQ ID NO: 417689 - DNA, 25 bp, Rattus norvegicus
ggaagagtctcattttggttttaag

SEQ ID NO: 417690 - DNA, 25 bp, Rattus norvegicus
ggaagagtctctctttttcacctgc

SEQ ID NO: 417691 - DNA, 25 bp, Rattus norvegicus
ggaagagtctctgtttttcacctgc

SEQ ID NO: 417692 - DNA, 25 bp, Rattus norvegicus
ggaagagtctgcatagtccacagca

SEQ ID NO: 417693 - DNA, 25 bp, Rattus norvegicus
ggaagagtctgcttagtccacagca

SEQ ID NO: 417694 - DNA, 25 bp, Rattus norvegicus
ggaagagtgctgaacaaagtcaaac

SEQ ID NO: 417695 - DNA, 25 bp, Rattus norvegicus
ggaagagtgctgtacaaagtcaaac

SEQ ID NO: 417696 - DNA, 25 bp, Rattus norvegicus
ggaagagtgtgaccgcgcctaccct

SEQ ID NO: 417697 - DNA, 25 bp, Rattus norvegicus
ggaagagtgtgagcgcgcctaccct

SEQ ID NO: 417698 - DNA, 25 bp, Rattus norvegicus
ggaagagtgtgcatctccatcctgc

SEQ ID NO: 417699 - DNA, 25 bp, Rattus norvegicus
ggaagagtgtgcttctccatcctgc

SEQ ID NO: 417700 - DNA, 25 bp, Rattus norvegicus
ggaagagttctcagcaagcataaac

SEQ ID NO: 417701 - DNA, 25 bp, Rattus norvegicus
ggaagagttctctgcaagcataaac

SEQ ID NO: 417702 - DNA, 25 bp, Rattus norvegicus
ggaagagttgctagcccagataaaa

SEQ ID NO: 417703 - DNA, 25 bp, Rattus norvegicus
ggaagagttgcttgcccagataaaa

SEQ ID NO: 417704 - DNA, 25 bp, Rattus norvegicus
ggaagagtttccagcactgtgggat

SEQ ID NO: 417705 - DNA, 25 bp, Rattus norvegicus
ggaagagtttcctgcactgtgggat

SEQ ID NO: 417706 - DNA, 25 bp, Rattus norvegicus
ggaagatacaccaagagacggagaa

SEQ ID NO: 417707 - DNA, 25 bp, Rattus norvegicus
ggaagatacacctagagacggagaa

SEQ ID NO: 417708 - DNA, 25 bp, Rattus norvegicus
ggaagatacctcatttacctcatat

SEQ ID NO: 417709 - DNA, 25 bp, Rattus norvegicus
ggaagatacctcttttacctcatat

SEQ ID NO: 417710 - DNA, 25 bp, Rattus norvegicus
ggaagatacgtgcagctgtccacag

SEQ ID NO: 417711 - DNA, 25 bp, Rattus norvegicus
ggaagatacgtggagctgtccacag

SEQ ID NO: 417712 - DNA, 25 bp, Rattus norvegicus
ggaagatactaaccctgggcagcta

SEQ ID NO: 417713 - DNA, 25 bp, Rattus norvegicus
ggaagatactaagcctgggcagcta

SEQ ID NO: 417714 - DNA, 25 bp, Rattus norvegicus
ggaagatactcaaaccgtctctacg

SEQ ID NO: 417715 - DNA, 25 bp, Rattus norvegicus
ggaagatactcataccgtctctacg

SEQ ID NO: 417716 - DNA, 25 bp, Rattus norvegicus
ggaagatcaattaacccctccgttg

SEQ ID NO: 417717 - DNA, 25 bp, Rattus norvegicus
ggaagatcaatttacccctccgttg

SEQ ID NO: 417718 - DNA, 25 bp, Rattus norvegicus
ggaagatcaccaatgtcaccaagcg

SEQ ID NO: 417719 - DNA, 25 bp, Rattus norvegicus
ggaagatcaccattgtcaccaagcg

SEQ ID NO: 417720 - DNA, 25 bp, Rattus norvegicus
ggaagatcacgtatattttaccaca

SEQ ID NO: 417721 - DNA, 25 bp, Rattus norvegicus
ggaagatcacgtttattttaccaca

SEQ ID NO: 417722 - DNA, 25 bp, Rattus norvegicus
ggaagatcactcaactggtccttat

SEQ ID NO: 417723 - DNA, 25 bp, Rattus norvegicus
ggaagatcactctactggtccttat

SEQ ID NO: 417724 - DNA, 25 bp, Rattus norvegicus
ggaagatcaggtcgttactgccacc

SEQ ID NO: 417725 - DNA, 25 bp, Rattus norvegicus
ggaagatcaggtggttactgccacc

SEQ ID NO: 417726 - DNA, 25 bp, Rattus norvegicus
ggaagatcatctagctactgccaga

SEQ ID NO: 417727 - DNA, 25 bp, Rattus norvegicus
ggaagatcatcttgctactgccaga

SEQ ID NO: 417728 - DNA, 25 bp, Rattus norvegicus
ggaagatcattcctacaggttcagg

SEQ ID NO: 417729 - DNA, 25 bp, Rattus norvegicus
ggaagatcattcgtacaggttcagg

SEQ ID NO: 417730 - DNA, 25 bp, Rattus norvegicus
ggaagatccaggctcagacccacag

SEQ ID NO: 417731 - DNA, 25 bp, Rattus norvegicus
ggaagatccagggtcagacccacag

SEQ ID NO: 417732 - DNA, 25 bp, Rattus norvegicus
ggaagatcccaaagctcagagttat

SEQ ID NO: 417733 - DNA, 25 bp, Rattus norvegicus
ggaagatcccaatgctcagagttat

SEQ ID NO: 417734 - DNA, 25 bp, Rattus norvegicus
ggaagatcctgacagacctgtgctt

SEQ ID NO: 417735 - DNA, 25 bp, Rattus norvegicus
ggaagatcctgagagacctgtgctt

SEQ ID NO: 417736 - DNA, 25 bp, Rattus norvegicus
ggaagatcctgcatatcatggaaga

SEQ ID NO: 417737 - DNA, 25 bp, Rattus norvegicus
ggaagatcctgcttatcatggaaga

SEQ ID NO: 417738 - DNA, 25 bp, Rattus norvegicus
ggaagatcctttaacctagttggtg

SEQ ID NO: 417739 - DNA, 25 bp, Rattus norvegicus
ggaagatccttttacctagttggtg

SEQ ID NO: 417740 - DNA, 25 bp, Rattus norvegicus
ggaagatctccaagtcaggccagac

SEQ ID NO: 417741 - DNA, 25 bp, Rattus norvegicus
ggaagatctccatgtcaggccagac

SEQ ID NO: 417742 - DNA, 25 bp, Rattus norvegicus
ggaagatctggacccctctgtcact

SEQ ID NO: 417743 - DNA, 25 bp, Rattus norvegicus
ggaagatctggagccctctgtcact

SEQ ID NO: 417744 - DNA, 25 bp, Rattus norvegicus
ggaagatctgtcagagacccagaag

SEQ ID NO: 417745 - DNA, 25 bp, Rattus norvegicus
ggaagatctgtctgagacccagaag

SEQ ID NO: 417746 - DNA, 25 bp, Rattus norvegicus
ggaagatcttatctacaatgtagct

SEQ ID NO: 417747 - DNA, 25 bp, Rattus norvegicus
ggaagatcttatgtacaatgtagct

SEQ ID NO: 417748 - DNA, 25 bp, Rattus norvegicus
ggaagatgaatgaccctgcttctgt

SEQ ID NO: 417749 - DNA, 25 bp, Rattus norvegicus
ggaagatgaatgtccctgcttctgt

SEQ ID NO: 417750 - DNA, 25 bp, Rattus norvegicus
ggaagatgacaaagcctctggagaa

SEQ ID NO: 417751 - DNA, 25 bp, Rattus norvegicus
ggaagatgacaatgcctctggagaa

SEQ ID NO: 417752 - DNA, 25 bp, Rattus norvegicus
ggaagatgactcacctctgtaaacg

SEQ ID NO: 417753 - DNA, 25 bp, Rattus norvegicus
ggaagatgactctcctctgtaaacg

SEQ ID NO: 417754 - DNA, 25 bp, Rattus norvegicus
ggaagatgcaacaccgtcggattct

SEQ ID NO: 417755 - DNA, 25 bp, Rattus norvegicus
ggaagatgcaaccatcgggattgtt

SEQ ID NO: 417756 - DNA, 25 bp, Rattus norvegicus
ggaagatgcaacgatcgggattgtt

SEQ ID NO: 417757 - DNA, 25 bp, Rattus norvegicus
ggaagatgcaactccgtcggattct

SEQ ID NO: 417758 - DNA, 25 bp, Rattus norvegicus
ggaagatgcaccacactaagctcat

SEQ ID NO: 417759 - DNA, 25 bp, Rattus norvegicus
ggaagatgcacccacatctgaggta

SEQ ID NO: 417760 - DNA, 25 bp, Rattus norvegicus
ggaagatgcaccgacatctgaggta

SEQ ID NO: 417761 - DNA, 25 bp, Rattus norvegicus
ggaagatgcacctcactaagctcat

SEQ ID NO: 417762 - DNA, 25 bp, Rattus norvegicus
ggaagatgcagcctcatccagcaaa

SEQ ID NO: 417763 - DNA, 25 bp, Rattus norvegicus
ggaagatgcagcgtcatccagcaaa

SEQ ID NO: 417764 - DNA, 25 bp, Rattus norvegicus
ggaagatgcataacactccctggtg

SEQ ID NO: 417765 - DNA, 25 bp, Rattus norvegicus
ggaagatgcatatcactccctggtg

SEQ ID NO: 417766 - DNA, 25 bp, Rattus norvegicus
ggaagatgccacactgtatgtcaaa

SEQ ID NO: 417767 - DNA, 25 bp, Rattus norvegicus
ggaagatgccactctgtatgtcaaa

SEQ ID NO: 417768 - DNA, 25 bp, Rattus norvegicus
ggaagatgccctagacctctataaa

SEQ ID NO: 417769 - DNA, 25 bp, Rattus norvegicus
ggaagatgcccttgacctctataaa

SEQ ID NO: 417770 - DNA, 25 bp, Rattus norvegicus
ggaagatgctagacagtactcctta

SEQ ID NO: 417771 - DNA, 25 bp, Rattus norvegicus
ggaagatgctagtcagtactcctta

SEQ ID NO: 417772 - DNA, 25 bp, Rattus norvegicus
ggaagatgctggaacgccgtttgca

SEQ ID NO: 417773 - DNA, 25 bp, Rattus norvegicus
ggaagatgctggtacgccgtttgca

SEQ ID NO: 417774 - DNA, 25 bp, Rattus norvegicus
ggaagatggcccaggagaaccctaa

SEQ ID NO: 417775 - DNA, 25 bp, Rattus norvegicus
ggaagatggccctggagaaccctaa

SEQ ID NO: 417776 - DNA, 25 bp, Rattus norvegicus
ggaagatggccgaatgctgctcata

SEQ ID NO: 417777 - DNA, 25 bp, Rattus norvegicus
ggaagatggccgtatgctgctcata

SEQ ID NO: 417778 - DNA, 25 bp, Rattus norvegicus
ggaagatgggctccaccacacccaa

SEQ ID NO: 417779 - DNA, 25 bp, Rattus norvegicus
ggaagatgggctgcaccacacccaa

SEQ ID NO: 417780 - DNA, 25 bp, Rattus norvegicus
ggaagatggttcacattctccgctc

SEQ ID NO: 417781 - DNA, 25 bp, Rattus norvegicus
ggaagatggttctcattctccgctc

SEQ ID NO: 417782 - DNA, 25 bp, Rattus norvegicus
ggaagatgtagcaccctgtgtacta

SEQ ID NO: 417783 - DNA, 25 bp, Rattus norvegicus
ggaagatgtagctccctgtgtacta

SEQ ID NO: 417784 - DNA, 25 bp, Rattus norvegicus
ggaagatgtgccagttaccaagtgc

SEQ ID NO: 417785 - DNA, 25 bp, Rattus norvegicus
ggaagatgtgcctgttaccaagtgc

SEQ ID NO: 417786 - DNA, 25 bp, Rattus norvegicus
ggaagattcactacttcacgggcct

SEQ ID NO: 417787 - DNA, 25 bp, Rattus norvegicus
ggaagattcacttcttcacgggcct

SEQ ID NO: 417788 - DNA, 25 bp, Rattus norvegicus
ggaagattcagcagctccagaccat

SEQ ID NO: 417789 - DNA, 25 bp, Rattus norvegicus
ggaagattcagctgctccagaccat

SEQ ID NO: 417790 - DNA, 25 bp, Rattus norvegicus
ggaagattcatgctagacaatccat

SEQ ID NO: 417791 - DNA, 25 bp, Rattus norvegicus
ggaagattcatggtagacaatccat

SEQ ID NO: 417792 - DNA, 25 bp, Rattus norvegicus
ggaagattccacacaaggacaaaaa

SEQ ID NO: 417793 - DNA, 25 bp, Rattus norvegicus
ggaagattccactcaaggacaaaaa

SEQ ID NO: 417794 - DNA, 25 bp, Rattus norvegicus
ggaagattccataccacagctaatc

SEQ ID NO: 417795 - DNA, 25 bp, Rattus norvegicus
ggaagattccattccacagctaatc

SEQ ID NO: 417796 - DNA, 25 bp, Rattus norvegicus
ggaagattccggacgtctccagttt

SEQ ID NO: 417797 - DNA, 25 bp, Rattus norvegicus
ggaagattccggtcgtctccagttt

SEQ ID NO: 417798 - DNA, 25 bp, Rattus norvegicus
ggaagattccgtccagtgctgaaac

SEQ ID NO: 417799 - DNA, 25 bp, Rattus norvegicus
ggaagattccgtgcagtgctgaaac

SEQ ID NO: 417800 - DNA, 25 bp, Rattus norvegicus
ggaagattccttcagagccgcggct

SEQ ID NO: 417801 - DNA, 25 bp, Rattus norvegicus
ggaagattccttgagagccgcggct

SEQ ID NO: 417802 - DNA, 25 bp, Rattus norvegicus
ggaagattcttacgccatcctaata

SEQ ID NO: 417803 - DNA, 25 bp, Rattus norvegicus
ggaagattcttaggccatcctaata

SEQ ID NO: 417804 - DNA, 25 bp, Rattus norvegicus
ggaagattcttcagccgtggataga

SEQ ID NO: 417805 - DNA, 25 bp, Rattus norvegicus
ggaagattcttctgccgtggataga

SEQ ID NO: 417806 - DNA, 25 bp, Rattus norvegicus
ggaagattgccaccagccatggcct

SEQ ID NO: 417807 - DNA, 25 bp, Rattus norvegicus
ggaagattgccagcagccatggcct

SEQ ID NO: 417808 - DNA, 25 bp, Rattus norvegicus
ggaagattgctcaaaactacctaaa

SEQ ID NO: 417809 - DNA, 25 bp, Rattus norvegicus
ggaagattgctctaaactacctaaa

SEQ ID NO: 417810 - DNA, 25 bp, Rattus norvegicus
ggaagattgtcaaacccggtgttga

SEQ ID NO: 417811 - DNA, 25 bp, Rattus norvegicus
ggaagattgtcatacccggtgttga

SEQ ID NO: 417812 - DNA, 25 bp, Rattus norvegicus
ggaagatttgtcagctttgttcgaa

SEQ ID NO: 417813 - DNA, 25 bp, Rattus norvegicus
ggaagatttgtctgctttgttcgaa

SEQ ID NO: 417814 - DNA, 25 bp, Rattus norvegicus
ggaagattttgcagctccccaggtc

SEQ ID NO: 417815 - DNA, 25 bp, Rattus norvegicus
ggaagattttgctgctccccaggtc

SEQ ID NO: 417816 - DNA, 25 bp, Rattus norvegicus
ggaagcaaacatctccagttcttgt

SEQ ID NO: 417817 - DNA, 25 bp, Rattus norvegicus
ggaagcaaacatgtccagttcttgt

SEQ ID NO: 417818 - DNA, 25 bp, Rattus norvegicus
ggaagcaaaccacccagtcaatatt

SEQ ID NO: 417819 - DNA, 25 bp, Rattus norvegicus
ggaagcaaaccagccagtcaatatt

SEQ ID NO: 417820 - DNA, 25 bp, Rattus norvegicus
ggaagcaaacccatgtttacatctt

SEQ ID NO: 417821 - DNA, 25 bp, Rattus norvegicus
ggaagcaaacccttgtttacatctt

SEQ ID NO: 417822 - DNA, 25 bp, Rattus norvegicus
ggaagcaaacctacaacccatgagc

SEQ ID NO: 417823 - DNA, 25 bp, Rattus norvegicus
ggaagcaaaccttcaacccatgagc

SEQ ID NO: 417824 - DNA, 25 bp, Rattus norvegicus
ggaagcaaatctctccttttttaag

SEQ ID NO: 417825 - DNA, 25 bp, Rattus norvegicus
ggaagcaaatctgtccttttttaag

SEQ ID NO: 417826 - DNA, 25 bp, Rattus norvegicus
ggaagcaaattaagcctccgctgtg

SEQ ID NO: 417827 - DNA, 25 bp, Rattus norvegicus
ggaagcaaattacagattcaccaaa

SEQ ID NO: 417828 - DNA, 25 bp, Rattus norvegicus
ggaagcaaattagagattcaccaaa

SEQ ID NO: 417829 - DNA, 25 bp, Rattus norvegicus
ggaagcaaattatgcctccgctgtg

SEQ ID NO: 417830 - DNA, 25 bp, Rattus norvegicus
ggaagcaaatttctgaccccacagt

SEQ ID NO: 417831 - DNA, 25 bp, Rattus norvegicus
ggaagcaaatttgtgaccccacagt

SEQ ID NO: 417832 - DNA, 25 bp, Rattus norvegicus
ggaagcaacacgaggcacactctag

SEQ ID NO: 417833 - DNA, 25 bp, Rattus norvegicus
ggaagcaacacgtggcacactctag

SEQ ID NO: 417834 - DNA, 25 bp, Rattus norvegicus
ggaagcaacgaaactgccatccaca

SEQ ID NO: 417835 - DNA, 25 bp, Rattus norvegicus
ggaagcaacgaatctgccatccaca

SEQ ID NO: 417836 - DNA, 25 bp, Rattus norvegicus
ggaagcaagaggcactgtccccagc

SEQ ID NO: 417837 - DNA, 25 bp, Rattus norvegicus
ggaagcaagagggactgtccccagc

SEQ ID NO: 417838 - DNA, 25 bp, Rattus norvegicus
ggaagcaagattacctcacacggac

SEQ ID NO: 417839 - DNA, 25 bp, Rattus norvegicus
ggaagcaagatttcctcacacggac

SEQ ID NO: 417840 - DNA, 25 bp, Rattus norvegicus
ggaagcaagcacacaattggttgtc

SEQ ID NO: 417841 - DNA, 25 bp, Rattus norvegicus
ggaagcaagcactcaattggttgtc

SEQ ID NO: 417842 - DNA, 25 bp, Rattus norvegicus
ggaagcaagcatctgcctttcctgg

SEQ ID NO: 417843 - DNA, 25 bp, Rattus norvegicus
ggaagcaagcatgtgcctttcctgg

SEQ ID NO: 417844 - DNA, 25 bp, Rattus norvegicus
ggaagcaaggatactgacccaagga

SEQ ID NO: 417845 - DNA, 25 bp, Rattus norvegicus
ggaagcaaggattctgacccaagga

SEQ ID NO: 417846 - DNA, 25 bp, Rattus norvegicus
ggaagcaattccacttgggctaaaa

SEQ ID NO: 417847 - DNA, 25 bp, Rattus norvegicus
ggaagcaattcctcttgggctaaaa

SEQ ID NO: 417848 - DNA, 25 bp, Rattus norvegicus
ggaagcaatttcctgtggacattga

SEQ ID NO: 417849 - DNA, 25 bp, Rattus norvegicus
ggaagcaatttcgtgtggacattga

SEQ ID NO: 417850 - DNA, 25 bp, Rattus norvegicus
ggaagcacaaagaccagcgtgacag

SEQ ID NO: 417851 - DNA, 25 bp, Rattus norvegicus
ggaagcacaaagtccagcgtgacag

SEQ ID NO: 417852 - DNA, 25 bp, Rattus norvegicus
ggaagcacaactcctttgcctttat

SEQ ID NO: 417853 - DNA, 25 bp, Rattus norvegicus
ggaagcacaactgctttgcctttat

SEQ ID NO: 417854 - DNA, 25 bp, Rattus norvegicus
ggaagcacacaaaactcaccaaggt

SEQ ID NO: 417855 - DNA, 25 bp, Rattus norvegicus
ggaagcacacaatactcaccaaggt

SEQ ID NO: 417856 - DNA, 25 bp, Rattus norvegicus
ggaagcacacccactcatatgtgga

SEQ ID NO: 417857 - DNA, 25 bp, Rattus norvegicus
ggaagcacaccctctcatatgtgga

SEQ ID NO: 417858 - DNA, 25 bp, Rattus norvegicus
ggaagcacagaacctatgccttaga

SEQ ID NO: 417859 - DNA, 25 bp, Rattus norvegicus
ggaagcacagaagctatgccttaga

SEQ ID NO: 417860 - DNA, 25 bp, Rattus norvegicus
ggaagcacaggcaggccgcccgctt

SEQ ID NO: 417861 - DNA, 25 bp, Rattus norvegicus
ggaagcacaggctggccgcccgctt

SEQ ID NO: 417862 - DNA, 25 bp, Rattus norvegicus
ggaagcacagtcctatgcagatgac

SEQ ID NO: 417863 - DNA, 25 bp, Rattus norvegicus
ggaagcacagtcgtatgcagatgac

SEQ ID NO: 417864 - DNA, 25 bp, Rattus norvegicus
ggaagcacatgcagaggcccagttc

SEQ ID NO: 417865 - DNA, 25 bp, Rattus norvegicus
ggaagcacatgctgaggcccagttc

SEQ ID NO: 417866 - DNA, 25 bp, Rattus norvegicus
ggaagcaccagacttcaacccacaa

SEQ ID NO: 417867 - DNA, 25 bp, Rattus norvegicus
ggaagcaccagagttcaacccacaa

SEQ ID NO: 417868 - DNA, 25 bp, Rattus norvegicus
ggaagcacccctcaggtctgtacag

SEQ ID NO: 417869 - DNA, 25 bp, Rattus norvegicus
ggaagcacccctgaggtctgtacag

SEQ ID NO: 417870 - DNA, 25 bp, Rattus norvegicus
ggaagcacctttctttgtgacacat

SEQ ID NO: 417871 - DNA, 25 bp, Rattus norvegicus
ggaagcacctttgtttgtgacacat

SEQ ID NO: 417872 - DNA, 25 bp, Rattus norvegicus
ggaagcacgtctccgttgtgtttaa

SEQ ID NO: 417873 - DNA, 25 bp, Rattus norvegicus
ggaagcacgtctgcgttgtgtttaa

SEQ ID NO: 417874 - DNA, 25 bp, Rattus norvegicus
ggaagcactaagcaagctccagatg

SEQ ID NO: 417875 - DNA, 25 bp, Rattus norvegicus
ggaagcactaaggaagctccagatg

SEQ ID NO: 417876 - DNA, 25 bp, Rattus norvegicus
ggaagcactcttcattacactaaag

SEQ ID NO: 417877 - DNA, 25 bp, Rattus norvegicus
ggaagcactcttgattacactaaag

SEQ ID NO: 417878 - DNA, 25 bp, Rattus norvegicus
ggaagcagaaacaccagccacattt

SEQ ID NO: 417879 - DNA, 25 bp, Rattus norvegicus
ggaagcagaaactccagccacattt

SEQ ID NO: 417880 - DNA, 25 bp, Rattus norvegicus
ggaagcagaactcagacctgggaca

SEQ ID NO: 417881 - DNA, 25 bp, Rattus norvegicus
ggaagcagaactgagacctgggaca

SEQ ID NO: 417882 - DNA, 25 bp, Rattus norvegicus
ggaagcagacacaccggaaacaatt

SEQ ID NO: 417883 - DNA, 25 bp, Rattus norvegicus
ggaagcagacactccggaaacaatt

SEQ ID NO: 417884 - DNA, 25 bp, Rattus norvegicus
ggaagcagatccatgctggtgttaa

SEQ ID NO: 417885 - DNA, 25 bp, Rattus norvegicus
ggaagcagatccttgctggtgttaa

SEQ ID NO: 417886 - DNA, 25 bp, Rattus norvegicus
ggaagcagcaaaaccatgagaaact

SEQ ID NO: 417887 - DNA, 25 bp, Rattus norvegicus
ggaagcagcaaatccatgagaaact

SEQ ID NO: 417888 - DNA, 25 bp, Rattus norvegicus
ggaagcagcatcatggccgtggact

SEQ ID NO: 417889 - DNA, 25 bp, Rattus norvegicus
ggaagcagcatcttggccgtggact

SEQ ID NO: 417890 - DNA, 25 bp, Rattus norvegicus
ggaagcagccacatagcgatagcaa

SEQ ID NO: 417891 - DNA, 25 bp, Rattus norvegicus
ggaagcagccacttagcgatagcaa

SEQ ID NO: 417892 - DNA, 25 bp, Rattus norvegicus
ggaagcagcctcagctccttacctt

SEQ ID NO: 417893 - DNA, 25 bp, Rattus norvegicus
ggaagcagcctccatggaacagcct

SEQ ID NO: 417894 - DNA, 25 bp, Rattus norvegicus
ggaagcagcctcgatggaacagcct

SEQ ID NO: 417895 - DNA, 25 bp, Rattus norvegicus
ggaagcagcctctgctccttacctt

SEQ ID NO: 417896 - DNA, 25 bp, Rattus norvegicus
ggaagcagcgaaaccagactccagt

SEQ ID NO: 417897 - DNA, 25 bp, Rattus norvegicus
ggaagcagcgaatccagactccagt

SEQ ID NO: 417898 - DNA, 25 bp, Rattus norvegicus
ggaagcagctaccatcagtgccaag

SEQ ID NO: 417899 - DNA, 25 bp, Rattus norvegicus
ggaagcagctacgatcagtgccaag

SEQ ID NO: 417900 - DNA, 25 bp, Rattus norvegicus
ggaagcagctcactttgctacaact

SEQ ID NO: 417901 - DNA, 25 bp, Rattus norvegicus
ggaagcagctcagtttgctacaact

SEQ ID NO: 417902 - DNA, 25 bp, Rattus norvegicus
ggaagcagctggacttttaagcaga

SEQ ID NO: 417903 - DNA, 25 bp, Rattus norvegicus
ggaagcagctggtcttttaagcaga

SEQ ID NO: 417904 - DNA, 25 bp, Rattus norvegicus
ggaagcagctttctgcacagactga

SEQ ID NO: 417905 - DNA, 25 bp, Rattus norvegicus
ggaagcagctttgtgcacagactga

SEQ ID NO: 417906 - DNA, 25 bp, Rattus norvegicus
ggaagcaggatcaggctctcacatc

SEQ ID NO: 417907 - DNA, 25 bp, Rattus norvegicus
ggaagcaggatctggctctcacatc

SEQ ID NO: 417908 - DNA, 25 bp, Rattus norvegicus
ggaagcaggcatcctattgactgac

SEQ ID NO: 417909 - DNA, 25 bp, Rattus norvegicus
ggaagcaggcatgctattgactgac

SEQ ID NO: 417910 - DNA, 25 bp, Rattus norvegicus
ggaagcaggcggagactcagtcact

SEQ ID NO: 417911 - DNA, 25 bp, Rattus norvegicus
ggaagcaggcggtgactcagtcact

SEQ ID NO: 417912 - DNA, 25 bp, Rattus norvegicus
ggaagcagggtacactcggacattc

SEQ ID NO: 417913 - DNA, 25 bp, Rattus norvegicus
ggaagcagggtagactcggacattc

SEQ ID NO: 417914 - DNA, 25 bp, Rattus norvegicus
ggaagcagtaccagccgatgacaag

SEQ ID NO: 417915 - DNA, 25 bp, Rattus norvegicus
ggaagcagtacctgccgatgacaag

SEQ ID NO: 417916 - DNA, 25 bp, Rattus norvegicus
ggaagcagtcctctatgtattaaac

SEQ ID NO: 417917 - DNA, 25 bp, Rattus norvegicus
ggaagcagtcctgtatgtattaaac

SEQ ID NO: 417918 - DNA, 25 bp, Rattus norvegicus
ggaagcagtcggagacacactagaa

SEQ ID NO: 417919 - DNA, 25 bp, Rattus norvegicus
ggaagcagtcggtgacacactagaa

SEQ ID NO: 417920 - DNA, 25 bp, Rattus norvegicus
ggaagcagtctcacatgggaagttt

SEQ ID NO: 417921 - DNA, 25 bp, Rattus norvegicus
ggaagcagtctctcatgggaagttt

SEQ ID NO: 417922 - DNA, 25 bp, Rattus norvegicus
ggaagcagtggcagcgcacagctcc

SEQ ID NO: 417923 - DNA, 25 bp, Rattus norvegicus
ggaagcagtggctgcgcacagctcc

SEQ ID NO: 417924 - DNA, 25 bp, Rattus norvegicus
ggaagcagtgtcagctggcacactt

SEQ ID NO: 417925 - DNA, 25 bp, Rattus norvegicus
ggaagcagtgtctgctggcacactt

SEQ ID NO: 417926 - DNA, 25 bp, Rattus norvegicus
ggaagcataaatagctctgtgagct

SEQ ID NO: 417927 - DNA, 25 bp, Rattus norvegicus
ggaagcataaattgctctgtgagct

SEQ ID NO: 417928 - DNA, 25 bp, Rattus norvegicus
ggaagcatatctacctcaggcccag

SEQ ID NO: 417929 - DNA, 25 bp, Rattus norvegicus
ggaagcatatcttcctcaggcccag

SEQ ID NO: 417930 - DNA, 25 bp, Rattus norvegicus
ggaagcatcagaatccctgaaactg

SEQ ID NO: 417931 - DNA, 25 bp, Rattus norvegicus
ggaagcatcagattccctgaaactg

SEQ ID NO: 417932 - DNA, 25 bp, Rattus norvegicus
ggaagcatccagaagcacatgacca

SEQ ID NO: 417933 - DNA, 25 bp, Rattus norvegicus
ggaagcatccagtagcacatgacca

SEQ ID NO: 417934 - DNA, 25 bp, Rattus norvegicus
ggaagcatctatcaaacatcagagc

SEQ ID NO: 417935 - DNA, 25 bp, Rattus norvegicus
ggaagcatctatgaaacatcagagc

SEQ ID NO: 417936 - DNA, 25 bp, Rattus norvegicus
ggaagcatctcgaacccatgggcac

SEQ ID NO: 417937 - DNA, 25 bp, Rattus norvegicus
ggaagcatctcgtacccatgggcac

SEQ ID NO: 417938 - DNA, 25 bp, Rattus norvegicus
ggaagcatgacaacgtccagagttt

SEQ ID NO: 417939 - DNA, 25 bp, Rattus norvegicus
ggaagcatgacatcgtccagagttt

SEQ ID NO: 417940 - DNA, 25 bp, Rattus norvegicus
ggaagcatggcaccgcataagcaga

SEQ ID NO: 417941 - DNA, 25 bp, Rattus norvegicus
ggaagcatggcagcgcataagcaga

SEQ ID NO: 417942 - DNA, 25 bp, Rattus norvegicus
ggaagcattaatcttctcccggcac

SEQ ID NO: 417943 - DNA, 25 bp, Rattus norvegicus
ggaagcattaatgttctcccggcac

SEQ ID NO: 417944 - DNA, 25 bp, Rattus norvegicus
ggaagcattctcacagtctgtgtgt

SEQ ID NO: 417945 - DNA, 25 bp, Rattus norvegicus
ggaagcattctctcagtctgtgtgt

SEQ ID NO: 417946 - DNA, 25 bp, Rattus norvegicus
ggaagcattgcactcttgttcatta

SEQ ID NO: 417947 - DNA, 25 bp, Rattus norvegicus
ggaagcattgcagtcttgttcatta

SEQ ID NO: 417948 - DNA, 25 bp, Rattus norvegicus
ggaagcatttaccactctgagtact

SEQ ID NO: 417949 - DNA, 25 bp, Rattus norvegicus
ggaagcatttacgactctgagtact

SEQ ID NO: 417950 - DNA, 25 bp, Rattus norvegicus
ggaagcatttatatgctctcaaatg

SEQ ID NO: 417951 - DNA, 25 bp, Rattus norvegicus
ggaagcatttatttgctctcaaatg

SEQ ID NO: 417952 - DNA, 25 bp, Rattus norvegicus
ggaagcatttcaacagccagctctg

SEQ ID NO: 417953 - DNA, 25 bp, Rattus norvegicus
ggaagcatttcatcagccagctctg

SEQ ID NO: 417954 - DNA, 25 bp, Rattus norvegicus
ggaagcatttccctagagcactgga

SEQ ID NO: 417955 - DNA, 25 bp, Rattus norvegicus
ggaagcatttccgtagagcactgga

SEQ ID NO: 417956 - DNA, 25 bp, Rattus norvegicus
ggaagcatttgcaactcaggtttta

SEQ ID NO: 417957 - DNA, 25 bp, Rattus norvegicus
ggaagcatttgctactcaggtttta

SEQ ID NO: 417958 - DNA, 25 bp, Rattus norvegicus
ggaagcattttcctggctgatgaaa

SEQ ID NO: 417959 - DNA, 25 bp, Rattus norvegicus
ggaagcattttccttctataaaatt

SEQ ID NO: 417960 - DNA, 25 bp, Rattus norvegicus
ggaagcattttcgtggctgatgaaa

SEQ ID NO: 417961 - DNA, 25 bp, Rattus norvegicus
ggaagcattttcgttctataaaatt

SEQ ID NO: 417962 - DNA, 25 bp, Rattus norvegicus
ggaagccaaagaacagtgcccaccc

SEQ ID NO: 417963 - DNA, 25 bp, Rattus norvegicus
ggaagccaaagacctgccagcggaa

SEQ ID NO: 417964 - DNA, 25 bp, Rattus norvegicus
ggaagccaaagagctgccagcggaa

SEQ ID NO: 417965 - DNA, 25 bp, Rattus norvegicus
ggaagccaaagatcagtgcccaccc

SEQ ID NO: 417966 - DNA, 25 bp, Rattus norvegicus
ggaagccaaaggcagcctctgctga

SEQ ID NO: 417967 - DNA, 25 bp, Rattus norvegicus
ggaagccaaagggagcctctgctga

SEQ ID NO: 417968 - DNA, 25 bp, Rattus norvegicus
ggaagccaactgagactccctgcag

SEQ ID NO: 417969 - DNA, 25 bp, Rattus norvegicus
ggaagccaactgtgactccctgcag

SEQ ID NO: 417970 - DNA, 25 bp, Rattus norvegicus
ggaagccaaggcctcagtcagagaa

SEQ ID NO: 417971 - DNA, 25 bp, Rattus norvegicus
ggaagccaaggcgtcagtcagagaa

SEQ ID NO: 417972 - DNA, 25 bp, Rattus norvegicus
ggaagccaataccagcgcagagcat

SEQ ID NO: 417973 - DNA, 25 bp, Rattus norvegicus
ggaagccaatacgagcgcagagcat

SEQ ID NO: 417974 - DNA, 25 bp, Rattus norvegicus
ggaagccaatcacaatggtcactta

SEQ ID NO: 417975 - DNA, 25 bp, Rattus norvegicus
ggaagccaatcagaatggtcactta

SEQ ID NO: 417976 - DNA, 25 bp, Rattus norvegicus
ggaagccaattcagctgtcatcttg

SEQ ID NO: 417977 - DNA, 25 bp, Rattus norvegicus
ggaagccaattctgctgtcatcttg

SEQ ID NO: 417978 - DNA, 25 bp, Rattus norvegicus
ggaagccacaacattatatgttcaa

SEQ ID NO: 417979 - DNA, 25 bp, Rattus norvegicus
ggaagccacaactttatatgttcaa

SEQ ID NO: 417980 - DNA, 25 bp, Rattus norvegicus
ggaagccacaagcagtatctagata

SEQ ID NO: 417981 - DNA, 25 bp, Rattus norvegicus
ggaagccacaaggagtatctagata

SEQ ID NO: 417982 - DNA, 25 bp, Rattus norvegicus
ggaagccacagacctgtcaccaaaa

SEQ ID NO: 417983 - DNA, 25 bp, Rattus norvegicus
ggaagccacagagctgtcaccaaaa

SEQ ID NO: 417984 - DNA, 25 bp, Rattus norvegicus
ggaagccacagtacttcacaacatt

SEQ ID NO: 417985 - DNA, 25 bp, Rattus norvegicus
ggaagccacagttcttcacaacatt

SEQ ID NO: 417986 - DNA, 25 bp, Rattus norvegicus
ggaagccaccagcaatgctttctaa

SEQ ID NO: 417987 - DNA, 25 bp, Rattus norvegicus
ggaagccaccaggaatgctttctaa

SEQ ID NO: 417988 - DNA, 25 bp, Rattus norvegicus
ggaagccactatatttgtatcgtgt

SEQ ID NO: 417989 - DNA, 25 bp, Rattus norvegicus
ggaagccactatttttgtatcgtgt

SEQ ID NO: 417990 - DNA, 25 bp, Rattus norvegicus
ggaagccagacgctgcattcttaat

SEQ ID NO: 417991 - DNA, 25 bp, Rattus norvegicus
ggaagccagacggtgcattcttaat

SEQ ID NO: 417992 - DNA, 25 bp, Rattus norvegicus
ggaagccagactcactcgtgggaaa

SEQ ID NO: 417993 - DNA, 25 bp, Rattus norvegicus
ggaagccagactgactcgtgggaaa

SEQ ID NO: 417994 - DNA, 25 bp, Rattus norvegicus
ggaagccagctgagcttcagcactg

SEQ ID NO: 417995 - DNA, 25 bp, Rattus norvegicus
ggaagccagctgtgcttcagcactg

SEQ ID NO: 417996 - DNA, 25 bp, Rattus norvegicus
ggaagccaggacattgaactttatt

SEQ ID NO: 417997 - DNA, 25 bp, Rattus norvegicus
ggaagccaggactttgaactttatt

SEQ ID NO: 417998 - DNA, 25 bp, Rattus norvegicus
ggaagccaggcaagagacattgtgt

SEQ ID NO: 417999 - DNA, 25 bp, Rattus norvegicus
ggaagccaggcatgagacattgtgt

SEQ ID NO: 418000 - DNA, 25 bp, Rattus norvegicus
ggaagccagggcacgtatctcagtg

SEQ ID NO: 418001 - DNA, 25 bp, Rattus norvegicus
ggaagccagggctcgtatctcagtg

SEQ ID NO: 418002 - DNA, 25 bp, Rattus norvegicus
ggaagccagtcaagccggaaacacc

SEQ ID NO: 418003 - DNA, 25 bp, Rattus norvegicus
ggaagccagtcatgccggaaacacc

SEQ ID NO: 418004 - DNA, 25 bp, Rattus norvegicus
ggaagccagtggatttcaaaaagat

SEQ ID NO: 418005 - DNA, 25 bp, Rattus norvegicus
ggaagccagtggttttcaaaaagat

SEQ ID NO: 418006 - DNA, 25 bp, Rattus norvegicus
ggaagccatattcaatccaggccta

SEQ ID NO: 418007 - DNA, 25 bp, Rattus norvegicus
ggaagccatattgaatccaggccta

SEQ ID NO: 418008 - DNA, 25 bp, Rattus norvegicus
ggaagccatcaaccaaggaccccga

SEQ ID NO: 418009 - DNA, 25 bp, Rattus norvegicus
ggaagccatcaagcaaggaccccga

SEQ ID NO: 418010 - DNA, 25 bp, Rattus norvegicus
ggaagccatcacagcagggatcctg

SEQ ID NO: 418011 - DNA, 25 bp, Rattus norvegicus
ggaagccatcactgcagggatcctg

SEQ ID NO: 418012 - DNA, 25 bp, Rattus norvegicus
ggaagccatcagaggttttacaatt

SEQ ID NO: 418013 - DNA, 25 bp, Rattus norvegicus
ggaagccatcagagtcttctgtcat

SEQ ID NO: 418014 - DNA, 25 bp, Rattus norvegicus
ggaagccatcagtggttttacaatt

SEQ ID NO: 418015 - DNA, 25 bp, Rattus norvegicus
ggaagccatcagtgtcttctgtcat

SEQ ID NO: 418016 - DNA, 25 bp, Rattus norvegicus
ggaagccatctgaagtgtcaatcaa

SEQ ID NO: 418017 - DNA, 25 bp, Rattus norvegicus
ggaagccatctgtagtgtcaatcaa

SEQ ID NO: 418018 - DNA, 25 bp, Rattus norvegicus
ggaagccatgctcacttacactaga

SEQ ID NO: 418019 - DNA, 25 bp, Rattus norvegicus
ggaagccatgctgacttacactaga

SEQ ID NO: 418020 - DNA, 25 bp, Rattus norvegicus
ggaagccatggcaaccttatgacag

SEQ ID NO: 418021 - DNA, 25 bp, Rattus norvegicus
ggaagccatggctaccttatgacag

SEQ ID NO: 418022 - DNA, 25 bp, Rattus norvegicus
ggaagccatgttattattcttgaaa

SEQ ID NO: 418023 - DNA, 25 bp, Rattus norvegicus
ggaagccatgttattgtcacactct

SEQ ID NO: 418024 - DNA, 25 bp, Rattus norvegicus
ggaagccatgtttttattcttgaaa

SEQ ID NO: 418025 - DNA, 25 bp, Rattus norvegicus
ggaagccatgtttttgtcacactct

SEQ ID NO: 418026 - DNA, 25 bp, Rattus norvegicus
ggaagccattagagtcagccctgcc

SEQ ID NO: 418027 - DNA, 25 bp, Rattus norvegicus
ggaagccattagtgtcagccctgcc

SEQ ID NO: 418028 - DNA, 25 bp, Rattus norvegicus
ggaagccattgtccccatggaggtt

SEQ ID NO: 418029 - DNA, 25 bp, Rattus norvegicus
ggaagccattgtgcccatggaggtt

SEQ ID NO: 418030 - DNA, 25 bp, Rattus norvegicus
ggaagcccaaatcaactcgttctct

SEQ ID NO: 418031 - DNA, 25 bp, Rattus norvegicus
ggaagcccaaatgaactcgttctct

SEQ ID NO: 418032 - DNA, 25 bp, Rattus norvegicus
ggaagcccaccaccagcatctggag

SEQ ID NO: 418033 - DNA, 25 bp, Rattus norvegicus
ggaagcccaccagcagcatctggag

SEQ ID NO: 418034 - DNA, 25 bp, Rattus norvegicus
ggaagcccagtgacaaagtgctaac

SEQ ID NO: 418035 - DNA, 25 bp, Rattus norvegicus
ggaagcccagtgtcaaagtgctaac

SEQ ID NO: 418036 - DNA, 25 bp, Rattus norvegicus
ggaagcccagttcatatgttcacaa

SEQ ID NO: 418037 - DNA, 25 bp, Rattus norvegicus
ggaagcccagttgatatgttcacaa

SEQ ID NO: 418038 - DNA, 25 bp, Rattus norvegicus
ggaagcccatcccagaacatgttac

SEQ ID NO: 418039 - DNA, 25 bp, Rattus norvegicus
ggaagcccatccgagaacatgttac

SEQ ID NO: 418040 - DNA, 25 bp, Rattus norvegicus
ggaagcccatggatctgcaaacaga

SEQ ID NO: 418041 - DNA, 25 bp, Rattus norvegicus
ggaagcccatggttctgcaaacaga

SEQ ID NO: 418042 - DNA, 25 bp, Rattus norvegicus
ggaagcccatgtccgcaaggtagaa

SEQ ID NO: 418043 - DNA, 25 bp, Rattus norvegicus
ggaagcccatgtgcgcaaggtagaa

SEQ ID NO: 418044 - DNA, 25 bp, Rattus norvegicus
ggaagccccagcatggtggtagacc

SEQ ID NO: 418045 - DNA, 25 bp, Rattus norvegicus
ggaagccccagcttggtggtagacc

SEQ ID NO: 418046 - DNA, 25 bp, Rattus norvegicus
ggaagcccctgacaactggcagacc

SEQ ID NO: 418047 - DNA, 25 bp, Rattus norvegicus
ggaagcccctgagaactggcagacc

SEQ ID NO: 418048 - DNA, 25 bp, Rattus norvegicus
ggaagcccctgtaatggagcatttc

SEQ ID NO: 418049 - DNA, 25 bp, Rattus norvegicus
ggaagcccctgttatggagcatttc

SEQ ID NO: 418050 - DNA, 25 bp, Rattus norvegicus
ggaagcccgaagagcgccgtcctcg

SEQ ID NO: 418051 - DNA, 25 bp, Rattus norvegicus
ggaagcccgaagtgcgccgtcctcg

SEQ ID NO: 418052 - DNA, 25 bp, Rattus norvegicus
ggaagcccgggcagttacagacgac

SEQ ID NO: 418053 - DNA, 25 bp, Rattus norvegicus
ggaagcccgggctgttacagacgac

SEQ ID NO: 418054 - DNA, 25 bp, Rattus norvegicus
ggaagccctagaccacagagccaga

SEQ ID NO: 418055 - DNA, 25 bp, Rattus norvegicus
ggaagccctagagcacagagccaga

SEQ ID NO: 418056 - DNA, 25 bp, Rattus norvegicus
ggaagccctcacaggcgagtgtaaa

SEQ ID NO: 418057 - DNA, 25 bp, Rattus norvegicus
ggaagccctcactggcgagtgtaaa

SEQ ID NO: 418058 - DNA, 25 bp, Rattus norvegicus
ggaagccctcagcagtgtgaccaaa

SEQ ID NO: 418059 - DNA, 25 bp, Rattus norvegicus
ggaagccctcaggagtgtgaccaaa

SEQ ID NO: 418060 - DNA, 25 bp, Rattus norvegicus
ggaagccctctcatgaaaggaaata

SEQ ID NO: 418061 - DNA, 25 bp, Rattus norvegicus
ggaagccctctcttgaaaggaaata

SEQ ID NO: 418062 - DNA, 25 bp, Rattus norvegicus
ggaagccctggaacagctgaaactt

SEQ ID NO: 418063 - DNA, 25 bp, Rattus norvegicus
ggaagccctggatcagctgaaactt

SEQ ID NO: 418064 - DNA, 25 bp, Rattus norvegicus
ggaagccctggcaatgctgcactgt

SEQ ID NO: 418065 - DNA, 25 bp, Rattus norvegicus
ggaagccctggctatgctgcactgt

SEQ ID NO: 418066 - DNA, 25 bp, Rattus norvegicus
ggaagccctgggaaggaaccattct

SEQ ID NO: 418067 - DNA, 25 bp, Rattus norvegicus
ggaagccctgggtaggaaccattct

SEQ ID NO: 418068 - DNA, 25 bp, Rattus norvegicus
ggaagccctgtgacctcaaaattca

SEQ ID NO: 418069 - DNA, 25 bp, Rattus norvegicus
ggaagccctgtgatgaattttgaga

SEQ ID NO: 418070 - DNA, 25 bp, Rattus norvegicus
ggaagccctgtgtcctcaaaattca

SEQ ID NO: 418071 - DNA, 25 bp, Rattus norvegicus
ggaagccctgtgttgaattttgaga

SEQ ID NO: 418072 - DNA, 25 bp, Rattus norvegicus
ggaagccctttgctttctgtttctg

SEQ ID NO: 418073 - DNA, 25 bp, Rattus norvegicus
ggaagccctttggtttctgtttctg

SEQ ID NO: 418074 - DNA, 25 bp, Rattus norvegicus
ggaagccgagggactgccatttgct

SEQ ID NO: 418075 - DNA, 25 bp, Rattus norvegicus
ggaagccgagggtctgccatttgct

SEQ ID NO: 418076 - DNA, 25 bp, Rattus norvegicus
ggaagccgcaaaccactctcaaagt

SEQ ID NO: 418077 - DNA, 25 bp, Rattus norvegicus
ggaagccgcaaagcactctcaaagt

SEQ ID NO: 418078 - DNA, 25 bp, Rattus norvegicus
ggaagccgcacgacatggtgtatgt

SEQ ID NO: 418079 - DNA, 25 bp, Rattus norvegicus
ggaagccgcacgtcatggtgtatgt

SEQ ID NO: 418080 - DNA, 25 bp, Rattus norvegicus
ggaagccgcagaatgcaaacccagg

SEQ ID NO: 418081 - DNA, 25 bp, Rattus norvegicus
ggaagccgcagattgcaaacccagg

SEQ ID NO: 418082 - DNA, 25 bp, Rattus norvegicus
ggaagccgctaaccaaagcctgcaa

SEQ ID NO: 418083 - DNA, 25 bp, Rattus norvegicus
ggaagccgctaagcaaagcctgcaa

SEQ ID NO: 418084 - DNA, 25 bp, Rattus norvegicus
ggaagccgcttacccgagaactgtg

SEQ ID NO: 418085 - DNA, 25 bp, Rattus norvegicus
ggaagccgcttagccgagaactgtg

SEQ ID NO: 418086 - DNA, 25 bp, Rattus norvegicus
ggaagccggagaagactctgatcat

SEQ ID NO: 418087 - DNA, 25 bp, Rattus norvegicus
ggaagccggagatgactctgatcat

SEQ ID NO: 418088 - DNA, 25 bp, Rattus norvegicus
ggaagccggttcacatagcaccaga

SEQ ID NO: 418089 - DNA, 25 bp, Rattus norvegicus
ggaagccggttctcatagcaccaga

SEQ ID NO: 418090 - DNA, 25 bp, Rattus norvegicus
ggaagcctaaagctgctctgaaaaa

SEQ ID NO: 418091 - DNA, 25 bp, Rattus norvegicus
ggaagcctaaaggtgctctgaaaaa

SEQ ID NO: 418092 - DNA, 25 bp, Rattus norvegicus
ggaagcctacaaaccagggagcctt

SEQ ID NO: 418093 - DNA, 25 bp, Rattus norvegicus
ggaagcctacaatccagggagcctt

SEQ ID NO: 418094 - DNA, 25 bp, Rattus norvegicus
ggaagcctactaattgtcaagagca

SEQ ID NO: 418095 - DNA, 25 bp, Rattus norvegicus
ggaagcctactatttgtcaagagca

SEQ ID NO: 418096 - DNA, 25 bp, Rattus norvegicus
ggaagcctatcacattgcattgtaa

SEQ ID NO: 418097 - DNA, 25 bp, Rattus norvegicus
ggaagcctatcagattgcattgtaa

SEQ ID NO: 418098 - DNA, 25 bp, Rattus norvegicus
ggaagcctatgactgtgcactgtaa

SEQ ID NO: 418099 - DNA, 25 bp, Rattus norvegicus
ggaagcctatgagtgtgcactgtaa

SEQ ID NO: 418100 - DNA, 25 bp, Rattus norvegicus
ggaagcctatgcagagtcctgactc

SEQ ID NO: 418101 - DNA, 25 bp, Rattus norvegicus
ggaagcctatgctgagtcctgactc

SEQ ID NO: 418102 - DNA, 25 bp, Rattus norvegicus
ggaagcctcaaaccttaatcgccct

SEQ ID NO: 418103 - DNA, 25 bp, Rattus norvegicus
ggaagcctcaaagcttaatcgccct

SEQ ID NO: 418104 - DNA, 25 bp, Rattus norvegicus
ggaagcctcctgacaggcagtgtga

SEQ ID NO: 418105 - DNA, 25 bp, Rattus norvegicus
ggaagcctcctgtcaggcagtgtga

SEQ ID NO: 418106 - DNA, 25 bp, Rattus norvegicus
ggaagcctcgaaaggtgcctccaag

SEQ ID NO: 418107 - DNA, 25 bp, Rattus norvegicus
ggaagcctcgaatggtgcctccaag

SEQ ID NO: 418108 - DNA, 25 bp, Rattus norvegicus
ggaagcctcggcatatttcattaag

SEQ ID NO: 418109 - DNA, 25 bp, Rattus norvegicus
ggaagcctcggcctgtagacacaga

SEQ ID NO: 418110 - DNA, 25 bp, Rattus norvegicus
ggaagcctcggcgtgtagacacaga

SEQ ID NO: 418111 - DNA, 25 bp, Rattus norvegicus
ggaagcctcggcttatttcattaag

SEQ ID NO: 418112 - DNA, 25 bp, Rattus norvegicus
ggaagcctctatctcggtgatcatg

SEQ ID NO: 418113 - DNA, 25 bp, Rattus norvegicus
ggaagcctctatgtcggtgatcatg

SEQ ID NO: 418114 - DNA, 25 bp, Rattus norvegicus
ggaagcctctgaattggactttgtt

SEQ ID NO: 418115 - DNA, 25 bp, Rattus norvegicus
ggaagcctctgatttggactttgtt

SEQ ID NO: 418116 - DNA, 25 bp, Rattus norvegicus
ggaagcctcttactactgggtgtac

SEQ ID NO: 418117 - DNA, 25 bp, Rattus norvegicus
ggaagcctcttagtactgggtgtac

SEQ ID NO: 418118 - DNA, 25 bp, Rattus norvegicus
ggaagcctgaacacagcgtagactt

SEQ ID NO: 418119 - DNA, 25 bp, Rattus norvegicus
ggaagcctgaactcagcgtagactt

SEQ ID NO: 418120 - DNA, 25 bp, Rattus norvegicus
ggaagcctgaagattaggagtccaa

SEQ ID NO: 418121 - DNA, 25 bp, Rattus norvegicus
ggaagcctgaagtttaggagtccaa

SEQ ID NO: 418122 - DNA, 25 bp, Rattus norvegicus
ggaagcctgccccaggtaacatacg

SEQ ID NO: 418123 - DNA, 25 bp, Rattus norvegicus
ggaagcctgcccgaggtaacatacg

SEQ ID NO: 418124 - DNA, 25 bp, Rattus norvegicus
ggaagcctgcgcaggttcctcgtcg

SEQ ID NO: 418125 - DNA, 25 bp, Rattus norvegicus
ggaagcctgcgctggttcctcgtcg

SEQ ID NO: 418126 - DNA, 25 bp, Rattus norvegicus
ggaagcctggcaaggcaggtataca

SEQ ID NO: 418127 - DNA, 25 bp, Rattus norvegicus
ggaagcctggcatggcaggtataca

SEQ ID NO: 418128 - DNA, 25 bp, Rattus norvegicus
ggaagcctgggaactggtagccata

SEQ ID NO: 418129 - DNA, 25 bp, Rattus norvegicus
ggaagcctgggatctggtagccata

SEQ ID NO: 418130 - DNA, 25 bp, Rattus norvegicus
ggaagcctggtacccacactacagt

SEQ ID NO: 418131 - DNA, 25 bp, Rattus norvegicus
ggaagcctggtagccacactacagt

SEQ ID NO: 418132 - DNA, 25 bp, Rattus norvegicus
ggaagcctggttatttgtccttagt

SEQ ID NO: 418133 - DNA, 25 bp, Rattus norvegicus
ggaagcctggttttttgtccttagt

SEQ ID NO: 418134 - DNA, 25 bp, Rattus norvegicus
ggaagcctgtatctatttaatgcat

SEQ ID NO: 418135 - DNA, 25 bp, Rattus norvegicus
ggaagcctgtatgtatttaatgcat

SEQ ID NO: 418136 - DNA, 25 bp, Rattus norvegicus
ggaagccttcaaccgcaggaaaacc

SEQ ID NO: 418137 - DNA, 25 bp, Rattus norvegicus
ggaagccttcaagcgcaggaaaacc

SEQ ID NO: 418138 - DNA, 25 bp, Rattus norvegicus
ggaagccttcagacacagtgactct

SEQ ID NO: 418139 - DNA, 25 bp, Rattus norvegicus
ggaagccttcagtcacagtgactct

SEQ ID NO: 418140 - DNA, 25 bp, Rattus norvegicus
ggaagccttcatatagattttggtt

SEQ ID NO: 418141 - DNA, 25 bp, Rattus norvegicus
ggaagccttcatttagattttggtt

SEQ ID NO: 418142 - DNA, 25 bp, Rattus norvegicus
ggaagccttgaacctcttgccagag

SEQ ID NO: 418143 - DNA, 25 bp, Rattus norvegicus
ggaagccttgaagctcttgccagag

SEQ ID NO: 418144 - DNA, 25 bp, Rattus norvegicus
ggaagccttgccatcagatacttac

SEQ ID NO: 418145 - DNA, 25 bp, Rattus norvegicus
ggaagccttgccttcagatacttac

SEQ ID NO: 418146 - DNA, 25 bp, Rattus norvegicus
ggaagccttgctagtccacaagctt

SEQ ID NO: 418147 - DNA, 25 bp, Rattus norvegicus
ggaagccttgcttgtccacaagctt

SEQ ID NO: 418148 - DNA, 25 bp, Rattus norvegicus
ggaagcctttacatcagagcactgg

SEQ ID NO: 418149 - DNA, 25 bp, Rattus norvegicus
ggaagcctttacttcagagcactgg

SEQ ID NO: 418150 - DNA, 25 bp, Rattus norvegicus
ggaagcctttgcagacttcatctgt

SEQ ID NO: 418151 - DNA, 25 bp, Rattus norvegicus
ggaagcctttgctgacttcatctgt

SEQ ID NO: 418152 - DNA, 25 bp, Rattus norvegicus
ggaagcgaagctcactgactctagt

SEQ ID NO: 418153 - DNA, 25 bp, Rattus norvegicus
ggaagcgaagctgactgactctagt

SEQ ID NO: 418154 - DNA, 25 bp, Rattus norvegicus
ggaagcgactgtagtccagtcatga

SEQ ID NO: 418155 - DNA, 25 bp, Rattus norvegicus
ggaagcgactgttgtccagtcatga

SEQ ID NO: 418156 - DNA, 25 bp, Rattus norvegicus
ggaagcgagaaacggacctgcctac

SEQ ID NO: 418157 - DNA, 25 bp, Rattus norvegicus
ggaagcgagaaagggacctgcctac

SEQ ID NO: 418158 - DNA, 25 bp, Rattus norvegicus
ggaagcgagagaaaacccctcatga

SEQ ID NO: 418159 - DNA, 25 bp, Rattus norvegicus
ggaagcgagagataacccctcatga

SEQ ID NO: 418160 - DNA, 25 bp, Rattus norvegicus
ggaagcgattttacattagcgtaaa

SEQ ID NO: 418161 - DNA, 25 bp, Rattus norvegicus
ggaagcgatttttcattagcgtaaa

SEQ ID NO: 418162 - DNA, 25 bp, Rattus norvegicus
ggaagcgcaaagaaactgcagagga

SEQ ID NO: 418163 - DNA, 25 bp, Rattus norvegicus
ggaagcgcaaagtaactgcagagga

SEQ ID NO: 418164 - DNA, 25 bp, Rattus norvegicus
ggaagcgcagcgatcggtgttcaat

SEQ ID NO: 418165 - DNA, 25 bp, Rattus norvegicus
ggaagcgcagcgttcggtgttcaat

SEQ ID NO: 418166 - DNA, 25 bp, Rattus norvegicus
ggaagcgcagtcagctaccgctgag

SEQ ID NO: 418167 - DNA, 25 bp, Rattus norvegicus
ggaagcgcagtctgctaccgctgag

SEQ ID NO: 418168 - DNA, 25 bp, Rattus norvegicus
ggaagcgcatgcaggtggagcaccc

SEQ ID NO: 418169 - DNA, 25 bp, Rattus norvegicus
ggaagcgcatgctggtggagcaccc

SEQ ID NO: 418170 - DNA, 25 bp, Rattus norvegicus
ggaagcgccgctccatcaggtactt

SEQ ID NO: 418171 - DNA, 25 bp, Rattus norvegicus
ggaagcgccgctgcatcaggtactt

SEQ ID NO: 418172 - DNA, 25 bp, Rattus norvegicus
ggaagcgccggtagcattagcctag

SEQ ID NO: 418173 - DNA, 25 bp, Rattus norvegicus
ggaagcgccggttgcattagcctag

SEQ ID NO: 418174 - DNA, 25 bp, Rattus norvegicus
ggaagcgccttacagtccgtttgac

SEQ ID NO: 418175 - DNA, 25 bp, Rattus norvegicus
ggaagcgccttagagtccgtttgac

SEQ ID NO: 418176 - DNA, 25 bp, Rattus norvegicus
ggaagcgcgagcaccgacccaaggc

SEQ ID NO: 418177 - DNA, 25 bp, Rattus norvegicus
ggaagcgcgagctccgacccaaggc

SEQ ID NO: 418178 - DNA, 25 bp, Rattus norvegicus
ggaagcgcgcatcctgggtaactaa

SEQ ID NO: 418179 - DNA, 25 bp, Rattus norvegicus
ggaagcgcgcatgctgggtaactaa

SEQ ID NO: 418180 - DNA, 25 bp, Rattus norvegicus
ggaagcgctgctcaccgtattccaa

SEQ ID NO: 418181 - DNA, 25 bp, Rattus norvegicus
ggaagcgctgctgaccgtattccaa

SEQ ID NO: 418182 - DNA, 25 bp, Rattus norvegicus
ggaagcgcttcaagcgccaccagca

SEQ ID NO: 418183 - DNA, 25 bp, Rattus norvegicus
ggaagcgcttcatgcgccaccagca

SEQ ID NO: 418184 - DNA, 25 bp, Rattus norvegicus
ggaagcgcttccatcgctgatagcc

SEQ ID NO: 418185 - DNA, 25 bp, Rattus norvegicus
ggaagcgcttccttcgctgatagcc

SEQ ID NO: 418186 - DNA, 25 bp, Rattus norvegicus
ggaagcgcttttccagctcacagat

SEQ ID NO: 418187 - DNA, 25 bp, Rattus norvegicus
ggaagcgcttttgcagctcacagat

SEQ ID NO: 418188 - DNA, 25 bp, Rattus norvegicus
ggaagcggaaacacggagctctccc

SEQ ID NO: 418189 - DNA, 25 bp, Rattus norvegicus
ggaagcggaaactcggagctctccc

SEQ ID NO: 418190 - DNA, 25 bp, Rattus norvegicus
ggaagcggcgtcaacctttgaaaag

SEQ ID NO: 418191 - DNA, 25 bp, Rattus norvegicus
ggaagcggcgtctacctttgaaaag

SEQ ID NO: 418192 - DNA, 25 bp, Rattus norvegicus
ggaagcgggctcagggccgggcggc

SEQ ID NO: 418193 - DNA, 25 bp, Rattus norvegicus
ggaagcgggctctgggccgggcggc

SEQ ID NO: 418194 - DNA, 25 bp, Rattus norvegicus
ggaagcggtggcacaggcctctaat

SEQ ID NO: 418195 - DNA, 25 bp, Rattus norvegicus
ggaagcggtggctcaggcctctaat

SEQ ID NO: 418196 - DNA, 25 bp, Rattus norvegicus
ggaagcgtcataaagcctggaaccc

SEQ ID NO: 418197 - DNA, 25 bp, Rattus norvegicus
ggaagcgtcatatagcctggaaccc

SEQ ID NO: 418198 - DNA, 25 bp, Rattus norvegicus
ggaagcgtctatcgggctccagccg

SEQ ID NO: 418199 - DNA, 25 bp, Rattus norvegicus
ggaagcgtctatggggctccagccg

SEQ ID NO: 418200 - DNA, 25 bp, Rattus norvegicus
ggaagcgtctgtcaaactggccccg

SEQ ID NO: 418201 - DNA, 25 bp, Rattus norvegicus
ggaagcgtctgtgaaactggccccg

SEQ ID NO: 418202 - DNA, 25 bp, Rattus norvegicus
ggaagcgtcttaagtccagctgcaa

SEQ ID NO: 418203 - DNA, 25 bp, Rattus norvegicus
ggaagcgtcttaccatgtatccacc

SEQ ID NO: 418204 - DNA, 25 bp, Rattus norvegicus
ggaagcgtcttagcatgtatccacc

SEQ ID NO: 418205 - DNA, 25 bp, Rattus norvegicus
ggaagcgtcttatgtccagctgcaa

SEQ ID NO: 418206 - DNA, 25 bp, Rattus norvegicus
ggaagcgtgcagaggcgtgggctgt

SEQ ID NO: 418207 - DNA, 25 bp, Rattus norvegicus
ggaagcgtgcagtggcgtgggctgt

SEQ ID NO: 418208 - DNA, 25 bp, Rattus norvegicus
ggaagcgtttccatgctctaagaat

SEQ ID NO: 418209 - DNA, 25 bp, Rattus norvegicus
ggaagcgtttccttgctctaagaat

SEQ ID NO: 418210 - DNA, 25 bp, Rattus norvegicus
ggaagctaagccatctagccagcac

SEQ ID NO: 418211 - DNA, 25 bp, Rattus norvegicus
ggaagctaagccttctagccagcac

SEQ ID NO: 418212 - DNA, 25 bp, Rattus norvegicus
ggaagctaagtaacctcacagttag

SEQ ID NO: 418213 - DNA, 25 bp, Rattus norvegicus
ggaagctaagtatcctcacagttag

SEQ ID NO: 418214 - DNA, 25 bp, Rattus norvegicus
ggaagctacaggagccggaccaata

SEQ ID NO: 418215 - DNA, 25 bp, Rattus norvegicus
ggaagctacaggtgccggaccaata

SEQ ID NO: 418216 - DNA, 25 bp, Rattus norvegicus
ggaagctacagtaacagcatccaga

SEQ ID NO: 418217 - DNA, 25 bp, Rattus norvegicus
ggaagctacagttacagcatccaga

SEQ ID NO: 418218 - DNA, 25 bp, Rattus norvegicus
ggaagctacccaactgtttagttac

SEQ ID NO: 418219 - DNA, 25 bp, Rattus norvegicus
ggaagctacccatctgtttagttac

SEQ ID NO: 418220 - DNA, 25 bp, Rattus norvegicus
ggaagctaccggccgccgcgaactt

SEQ ID NO: 418221 - DNA, 25 bp, Rattus norvegicus
ggaagctaccgggcgccgcgaactt

SEQ ID NO: 418222 - DNA, 25 bp, Rattus norvegicus
ggaagctacgacaggtctatgacaa

SEQ ID NO: 418223 - DNA, 25 bp, Rattus norvegicus
ggaagctacgactggtctatgacaa

SEQ ID NO: 418224 - DNA, 25 bp, Rattus norvegicus
ggaagctactccaaaccaggagcag

SEQ ID NO: 418225 - DNA, 25 bp, Rattus norvegicus
ggaagctactcctaaccaggagcag

SEQ ID NO: 418226 - DNA, 25 bp, Rattus norvegicus
ggaagctactggatctgtgccacag

SEQ ID NO: 418227 - DNA, 25 bp, Rattus norvegicus
ggaagctactggttctgtgccacag

SEQ ID NO: 418228 - DNA, 25 bp, Rattus norvegicus
ggaagctactttctccccaggaggg

SEQ ID NO: 418229 - DNA, 25 bp, Rattus norvegicus
ggaagctactttgtccccaggaggg

SEQ ID NO: 418230 - DNA, 25 bp, Rattus norvegicus
ggaagctagcacaaggcctgaccag

SEQ ID NO: 418231 - DNA, 25 bp, Rattus norvegicus
ggaagctagcactaggcctgaccag

SEQ ID NO: 418232 - DNA, 25 bp, Rattus norvegicus
ggaagctatactccccagagaacaa

SEQ ID NO: 418233 - DNA, 25 bp, Rattus norvegicus
ggaagctatactgcccagagaacaa

SEQ ID NO: 418234 - DNA, 25 bp, Rattus norvegicus
ggaagctatccgaagagccagcaat

SEQ ID NO: 418235 - DNA, 25 bp, Rattus norvegicus
ggaagctatccgtagagccagcaat

SEQ ID NO: 418236 - DNA, 25 bp, Rattus norvegicus
ggaagctattatcttgccaagcctg

SEQ ID NO: 418237 - DNA, 25 bp, Rattus norvegicus
ggaagctattatgttgccaagcctg

SEQ ID NO: 418238 - DNA, 25 bp, Rattus norvegicus
ggaagctattgcaaagttcatacgt

SEQ ID NO: 418239 - DNA, 25 bp, Rattus norvegicus
ggaagctattgctaagttcatacgt

SEQ ID NO: 418240 - DNA, 25 bp, Rattus norvegicus
ggaagctattgtcacttgagaattt

SEQ ID NO: 418241 - DNA, 25 bp, Rattus norvegicus
ggaagctattgtgacttgagaattt

SEQ ID NO: 418242 - DNA, 25 bp, Rattus norvegicus
ggaagctatttcacactatctggtg

SEQ ID NO: 418243 - DNA, 25 bp, Rattus norvegicus
ggaagctatttccaatcacattggt

SEQ ID NO: 418244 - DNA, 25 bp, Rattus norvegicus
ggaagctatttcgaatcacattggt

SEQ ID NO: 418245 - DNA, 25 bp, Rattus norvegicus
ggaagctatttctcactatctggtg

SEQ ID NO: 418246 - DNA, 25 bp, Rattus norvegicus
ggaagctcaagcacacctgtggcag

SEQ ID NO: 418247 - DNA, 25 bp, Rattus norvegicus
ggaagctcaagctcacctgtggcag

SEQ ID NO: 418248 - DNA, 25 bp, Rattus norvegicus
ggaagctcaccgactccaaagagaa

SEQ ID NO: 418249 - DNA, 25 bp, Rattus norvegicus
ggaagctcaccgtctccaaagagaa

SEQ ID NO: 418250 - DNA, 25 bp, Rattus norvegicus
ggaagctcacgaacaacttctttaa

SEQ ID NO: 418251 - DNA, 25 bp, Rattus norvegicus
ggaagctcacgatcaacttctttaa

SEQ ID NO: 418252 - DNA, 25 bp, Rattus norvegicus
ggaagctcagacaatggtctgtgat

SEQ ID NO: 418253 - DNA, 25 bp, Rattus norvegicus
ggaagctcagacacacccattgaaa

SEQ ID NO: 418254 - DNA, 25 bp, Rattus norvegicus
ggaagctcagactatggtctgtgat

SEQ ID NO: 418255 - DNA, 25 bp, Rattus norvegicus
ggaagctcagactcacccattgaaa

SEQ ID NO: 418256 - DNA, 25 bp, Rattus norvegicus
ggaagctcagcaacagtttactgca

SEQ ID NO: 418257 - DNA, 25 bp, Rattus norvegicus
ggaagctcagcatcagtttactgca

SEQ ID NO: 418258 - DNA, 25 bp, Rattus norvegicus
ggaagctcaggcatgtgcacacagt

SEQ ID NO: 418259 - DNA, 25 bp, Rattus norvegicus
ggaagctcaggcttgtgcacacagt

SEQ ID NO: 418260 - DNA, 25 bp, Rattus norvegicus
ggaagctcatcccatatgtgacagc

SEQ ID NO: 418261 - DNA, 25 bp, Rattus norvegicus
ggaagctcatccgatatgtgacagc

SEQ ID NO: 418262 - DNA, 25 bp, Rattus norvegicus
ggaagctcatgcaaataccctgttc

SEQ ID NO: 418263 - DNA, 25 bp, Rattus norvegicus
ggaagctcatgcagatcttggcctt

SEQ ID NO: 418264 - DNA, 25 bp, Rattus norvegicus
ggaagctcatgctaataccctgttc

SEQ ID NO: 418265 - DNA, 25 bp, Rattus norvegicus
ggaagctcatgctgatcttggcctt

SEQ ID NO: 418266 - DNA, 25 bp, Rattus norvegicus
ggaagctccatgacagctgcatagt

SEQ ID NO: 418267 - DNA, 25 bp, Rattus norvegicus
ggaagctccatgtcagctgcatagt

SEQ ID NO: 418268 - DNA, 25 bp, Rattus norvegicus
ggaagctccctaagcaacctgtcat

SEQ ID NO: 418269 - DNA, 25 bp, Rattus norvegicus
ggaagctccctatgcaacctgtcat

SEQ ID NO: 418270 - DNA, 25 bp, Rattus norvegicus
ggaagctccgtcatcaatggtgctc

SEQ ID NO: 418271 - DNA, 25 bp, Rattus norvegicus
ggaagctccgtcttcaatggtgctc

SEQ ID NO: 418272 - DNA, 25 bp, Rattus norvegicus
ggaagctcctcgagttgctgtgttc

SEQ ID NO: 418273 - DNA, 25 bp, Rattus norvegicus
ggaagctcctcgtgttgctgtgttc

SEQ ID NO: 418274 - DNA, 25 bp, Rattus norvegicus
ggaagctcctgccatatttgatgtc

SEQ ID NO: 418275 - DNA, 25 bp, Rattus norvegicus
ggaagctcctgcgatatttgatgtc

SEQ ID NO: 418276 - DNA, 25 bp, Rattus norvegicus
ggaagctccttaagcaggactgaga

SEQ ID NO: 418277 - DNA, 25 bp, Rattus norvegicus
ggaagctccttatgcaggactgaga

SEQ ID NO: 418278 - DNA, 25 bp, Rattus norvegicus
ggaagctccttcaggtctaccttgc

SEQ ID NO: 418279 - DNA, 25 bp, Rattus norvegicus
ggaagctccttctggtctaccttgc

SEQ ID NO: 418280 - DNA, 25 bp, Rattus norvegicus
ggaagctcggcgctccaaacaactg

SEQ ID NO: 418281 - DNA, 25 bp, Rattus norvegicus
ggaagctcggcggtccaaacaactg

SEQ ID NO: 418282 - DNA, 25 bp, Rattus norvegicus
ggaagctctaaaagtcgccagcctt

SEQ ID NO: 418283 - DNA, 25 bp, Rattus norvegicus
ggaagctctaaatgtcgccagcctt

SEQ ID NO: 418284 - DNA, 25 bp, Rattus norvegicus
ggaagctctacacgcacacggtaaa

SEQ ID NO: 418285 - DNA, 25 bp, Rattus norvegicus
ggaagctctacaggcacacggtaaa

SEQ ID NO: 418286 - DNA, 25 bp, Rattus norvegicus
ggaagctctagaactgaccctctgt

SEQ ID NO: 418287 - DNA, 25 bp, Rattus norvegicus
ggaagctctagatctgaccctctgt

SEQ ID NO: 418288 - DNA, 25 bp, Rattus norvegicus
ggaagctctctgatgtggagccata

SEQ ID NO: 418289 - DNA, 25 bp, Rattus norvegicus
ggaagctctctgttgtggagccata

SEQ ID NO: 418290 - DNA, 25 bp, Rattus norvegicus
ggaagctctgaaagcaacctgtaaa

SEQ ID NO: 418291 - DNA, 25 bp, Rattus norvegicus
ggaagctctgaatgcaacctgtaaa

SEQ ID NO: 418292 - DNA, 25 bp, Rattus norvegicus
ggaagctctgggaaactcactggat

SEQ ID NO: 418293 - DNA, 25 bp, Rattus norvegicus
ggaagctctgggtaactcactggat

SEQ ID NO: 418294 - DNA, 25 bp, Rattus norvegicus
ggaagctctgtgactacttactgca

SEQ ID NO: 418295 - DNA, 25 bp, Rattus norvegicus
ggaagctctgtgtctacttactgca

SEQ ID NO: 418296 - DNA, 25 bp, Rattus norvegicus
ggaagctcttgtcgcattcagggca

SEQ ID NO: 418297 - DNA, 25 bp, Rattus norvegicus
ggaagctcttgtggcattcagggca

SEQ ID NO: 418298 - DNA, 25 bp, Rattus norvegicus
ggaagctcttttcccaggctgagaa

SEQ ID NO: 418299 - DNA, 25 bp, Rattus norvegicus
ggaagctcttttgccaggctgagaa

SEQ ID NO: 418300 - DNA, 25 bp, Rattus norvegicus
ggaagctgaaagaccccgaatgggt

SEQ ID NO: 418301 - DNA, 25 bp, Rattus norvegicus
ggaagctgaaagtccccgaatgggt

SEQ ID NO: 418302 - DNA, 25 bp, Rattus norvegicus
ggaagctgaagtcccacctattcat

SEQ ID NO: 418303 - DNA, 25 bp, Rattus norvegicus
ggaagctgaagtgccacctattcat

SEQ ID NO: 418304 - DNA, 25 bp, Rattus norvegicus
ggaagctgaatgaccctcagctgtt

SEQ ID NO: 418305 - DNA, 25 bp, Rattus norvegicus
ggaagctgaatgtccctcagctgtt

SEQ ID NO: 418306 - DNA, 25 bp, Rattus norvegicus
ggaagctgacacacctactgaacgc

SEQ ID NO: 418307 - DNA, 25 bp, Rattus norvegicus
ggaagctgacactcctactgaacgc

SEQ ID NO: 418308 - DNA, 25 bp, Rattus norvegicus
ggaagctgacatagtggaccacctg

SEQ ID NO: 418309 - DNA, 25 bp, Rattus norvegicus
ggaagctgacattgtggaccacctg

SEQ ID NO: 418310 - DNA, 25 bp, Rattus norvegicus
ggaagctgacccaggatccacgata

SEQ ID NO: 418311 - DNA, 25 bp, Rattus norvegicus
ggaagctgacccattcttgaagtat

SEQ ID NO: 418312 - DNA, 25 bp, Rattus norvegicus
ggaagctgaccctggatccacgata

SEQ ID NO: 418313 - DNA, 25 bp, Rattus norvegicus
ggaagctgaccctttcttgaagtat

SEQ ID NO: 418314 - DNA, 25 bp, Rattus norvegicus
ggaagctgaccgacttcctgagctt

SEQ ID NO: 418315 - DNA, 25 bp, Rattus norvegicus
ggaagctgaccgtcttcctgagctt

SEQ ID NO: 418316 - DNA, 25 bp, Rattus norvegicus
ggaagctgagacatctgccctaggg

SEQ ID NO: 418317 - DNA, 25 bp, Rattus norvegicus
ggaagctgagacttctgccctaggg

SEQ ID NO: 418318 - DNA, 25 bp, Rattus norvegicus
ggaagctgagcgaagcatccttcaa

SEQ ID NO: 418319 - DNA, 25 bp, Rattus norvegicus
ggaagctgagcgtagcatccttcaa

SEQ ID NO: 418320 - DNA, 25 bp, Rattus norvegicus
ggaagctgagctcaccatacactga

SEQ ID NO: 418321 - DNA, 25 bp, Rattus norvegicus
ggaagctgagctgaccatacactga

SEQ ID NO: 418322 - DNA, 25 bp, Rattus norvegicus
ggaagctgaggtcattcgccatgcc

SEQ ID NO: 418323 - DNA, 25 bp, Rattus norvegicus
ggaagctgaggtgattcgccatgcc

SEQ ID NO: 418324 - DNA, 25 bp, Rattus norvegicus
ggaagctgagttctccccactggac

SEQ ID NO: 418325 - DNA, 25 bp, Rattus norvegicus
ggaagctgagttgtccccactggac

SEQ ID NO: 418326 - DNA, 25 bp, Rattus norvegicus
ggaagctgcacgacacccagaagga

SEQ ID NO: 418327 - DNA, 25 bp, Rattus norvegicus
ggaagctgcacgcagctctgcccta

SEQ ID NO: 418328 - DNA, 25 bp, Rattus norvegicus
ggaagctgcacggagctctgcccta

SEQ ID NO: 418329 - DNA, 25 bp, Rattus norvegicus
ggaagctgcacgtcacccagaagga

SEQ ID NO: 418330 - DNA, 25 bp, Rattus norvegicus
ggaagctgcagacagccatcaccat

SEQ ID NO: 418331 - DNA, 25 bp, Rattus norvegicus
ggaagctgcagagagccatcaccat

SEQ ID NO: 418332 - DNA, 25 bp, Rattus norvegicus
ggaagctgcagcacactgatcgtca

SEQ ID NO: 418333 - DNA, 25 bp, Rattus norvegicus
ggaagctgcagctcactgatcgtca

SEQ ID NO: 418334 - DNA, 25 bp, Rattus norvegicus
ggaagctgcataactcctacacaga

SEQ ID NO: 418335 - DNA, 25 bp, Rattus norvegicus
ggaagctgcatatctcctacacaga

SEQ ID NO: 418336 - DNA, 25 bp, Rattus norvegicus
ggaagctgccgaaggatccgaatcc

SEQ ID NO: 418337 - DNA, 25 bp, Rattus norvegicus
ggaagctgccgatggatccgaatcc

SEQ ID NO: 418338 - DNA, 25 bp, Rattus norvegicus
ggaagctgcctcaattgtatacctc

SEQ ID NO: 418339 - DNA, 25 bp, Rattus norvegicus
ggaagctgcctctattgtatacctc

SEQ ID NO: 418340 - DNA, 25 bp, Rattus norvegicus
ggaagctgcctgatctcagaactca

SEQ ID NO: 418341 - DNA, 25 bp, Rattus norvegicus
ggaagctgcctgttctcagaactca

SEQ ID NO: 418342 - DNA, 25 bp, Rattus norvegicus
ggaagctgccttcaagagcgccacc

SEQ ID NO: 418343 - DNA, 25 bp, Rattus norvegicus
ggaagctgccttgaagagcgccacc

SEQ ID NO: 418344 - DNA, 25 bp, Rattus norvegicus
ggaagctgctttatgctagcaactt

SEQ ID NO: 418345 - DNA, 25 bp, Rattus norvegicus
ggaagctgctttttgctagcaactt

SEQ ID NO: 418346 - DNA, 25 bp, Rattus norvegicus
ggaagctggaacacatttctccact

SEQ ID NO: 418347 - DNA, 25 bp, Rattus norvegicus
ggaagctggaactcatttctccact

SEQ ID NO: 418348 - DNA, 25 bp, Rattus norvegicus
ggaagctggaccacggttgtctttg

SEQ ID NO: 418349 - DNA, 25 bp, Rattus norvegicus
ggaagctggacctcggttgtctttg

SEQ ID NO: 418350 - DNA, 25 bp, Rattus norvegicus
ggaagctggactaacccaagcacat

SEQ ID NO: 418351 - DNA, 25 bp, Rattus norvegicus
ggaagctggacttacccaagcacat

SEQ ID NO: 418352 - DNA, 25 bp, Rattus norvegicus
ggaagctggagcacataccgacatg

SEQ ID NO: 418353 - DNA, 25 bp, Rattus norvegicus
ggaagctggagcaccgctgcataag

SEQ ID NO: 418354 - DNA, 25 bp, Rattus norvegicus
ggaagctggagcagcccatcgactt

SEQ ID NO: 418355 - DNA, 25 bp, Rattus norvegicus
ggaagctggagctcataccgacatg

SEQ ID NO: 418356 - DNA, 25 bp, Rattus norvegicus
ggaagctggagctccgctgcataag

SEQ ID NO: 418357 - DNA, 25 bp, Rattus norvegicus
ggaagctggagctgcccatcgactt

SEQ ID NO: 418358 - DNA, 25 bp, Rattus norvegicus
ggaagctgggacaccccaaacctca

SEQ ID NO: 418359 - DNA, 25 bp, Rattus norvegicus
ggaagctgggactccccaaacctca

SEQ ID NO: 418360 - DNA, 25 bp, Rattus norvegicus
ggaagctgggccacttggtaacatc

SEQ ID NO: 418361 - DNA, 25 bp, Rattus norvegicus
ggaagctgggcctcttggtaacatc

SEQ ID NO: 418362 - DNA, 25 bp, Rattus norvegicus
ggaagctggtcaacctgttctcata

SEQ ID NO: 418363 - DNA, 25 bp, Rattus norvegicus
ggaagctggtcatcctgttctcata

SEQ ID NO: 418364 - DNA, 25 bp, Rattus norvegicus
ggaagctggtccaagaaactcgcag

SEQ ID NO: 418365 - DNA, 25 bp, Rattus norvegicus
ggaagctggtcctagaaactcgcag

SEQ ID NO: 418366 - DNA, 25 bp, Rattus norvegicus
ggaagctgtaacaccaaaggcctgg

SEQ ID NO: 418367 - DNA, 25 bp, Rattus norvegicus
ggaagctgtaactccaaaggcctgg

SEQ ID NO: 418368 - DNA, 25 bp, Rattus norvegicus
ggaagctgtagaacctaccgtgtat

SEQ ID NO: 418369 - DNA, 25 bp, Rattus norvegicus
ggaagctgtagatcctaccgtgtat

SEQ ID NO: 418370 - DNA, 25 bp, Rattus norvegicus
ggaagctgtcccacggaagctcgcg

SEQ ID NO: 418371 - DNA, 25 bp, Rattus norvegicus
ggaagctgtccctcggaagctcgcg

SEQ ID NO: 418372 - DNA, 25 bp, Rattus norvegicus
ggaagctgtcctagcaattgccgtg

SEQ ID NO: 418373 - DNA, 25 bp, Rattus norvegicus
ggaagctgtccttgcaattgccgtg

SEQ ID NO: 418374 - DNA, 25 bp, Rattus norvegicus
ggaagctgttagaacaggtcagaaa

SEQ ID NO: 418375 - DNA, 25 bp, Rattus norvegicus
ggaagctgttagtacaggtcagaaa

SEQ ID NO: 418376 - DNA, 25 bp, Rattus norvegicus
ggaagcttaagcactagaaagcaaa

SEQ ID NO: 418377 - DNA, 25 bp, Rattus norvegicus
ggaagcttaagctctagaaagcaaa

SEQ ID NO: 418378 - DNA, 25 bp, Rattus norvegicus
ggaagcttaccaatcttactttgta

SEQ ID NO: 418379 - DNA, 25 bp, Rattus norvegicus
ggaagcttaccattcttactttgta

SEQ ID NO: 418380 - DNA, 25 bp, Rattus norvegicus
ggaagcttacgccacacgcggtaca

SEQ ID NO: 418381 - DNA, 25 bp, Rattus norvegicus
ggaagcttacgcgacacgcggtaca

SEQ ID NO: 418382 - DNA, 25 bp, Rattus norvegicus
ggaagcttagcaactggcaagacta

SEQ ID NO: 418383 - DNA, 25 bp, Rattus norvegicus
ggaagcttagcatctggcaagacta

SEQ ID NO: 418384 - DNA, 25 bp, Rattus norvegicus
ggaagcttagccatttttacttatt

SEQ ID NO: 418385 - DNA, 25 bp, Rattus norvegicus
ggaagcttagccttttttacttatt

SEQ ID NO: 418386 - DNA, 25 bp, Rattus norvegicus
ggaagcttagtaccgctccatttaa

SEQ ID NO: 418387 - DNA, 25 bp, Rattus norvegicus
ggaagcttagtagcgctccatttaa

SEQ ID NO: 418388 - DNA, 25 bp, Rattus norvegicus
ggaagcttagtcacacatctctcga

SEQ ID NO: 418389 - DNA, 25 bp, Rattus norvegicus
ggaagcttagtctcacatctctcga

SEQ ID NO: 418390 - DNA, 25 bp, Rattus norvegicus
ggaagcttatcgcatgtatacccct

SEQ ID NO: 418391 - DNA, 25 bp, Rattus norvegicus
ggaagcttatcggatgtatacccct

SEQ ID NO: 418392 - DNA, 25 bp, Rattus norvegicus
ggaagcttattgaccagcccaacac

SEQ ID NO: 418393 - DNA, 25 bp, Rattus norvegicus
ggaagcttattgtccagcccaacac

SEQ ID NO: 418394 - DNA, 25 bp, Rattus norvegicus
ggaagcttcagacaggcggctttaa

SEQ ID NO: 418395 - DNA, 25 bp, Rattus norvegicus
ggaagcttcagagaggcggctttaa

SEQ ID NO: 418396 - DNA, 25 bp, Rattus norvegicus
ggaagcttcagcagtctgggccagt

SEQ ID NO: 418397 - DNA, 25 bp, Rattus norvegicus
ggaagcttcagctgtctgggccagt

SEQ ID NO: 418398 - DNA, 25 bp, Rattus norvegicus
ggaagcttcaggacctgcaatcgtt

SEQ ID NO: 418399 - DNA, 25 bp, Rattus norvegicus
ggaagcttcaggtcctgcaatcgtt

SEQ ID NO: 418400 - DNA, 25 bp, Rattus norvegicus
ggaagcttccacaatcacctcaagg

SEQ ID NO: 418401 - DNA, 25 bp, Rattus norvegicus
ggaagcttccactatcacctcaagg

SEQ ID NO: 418402 - DNA, 25 bp, Rattus norvegicus
ggaagcttcgtaatctgatctctga

SEQ ID NO: 418403 - DNA, 25 bp, Rattus norvegicus
ggaagcttcgtattctgatctctga

SEQ ID NO: 418404 - DNA, 25 bp, Rattus norvegicus
ggaagcttctctcatctcccaggtc

SEQ ID NO: 418405 - DNA, 25 bp, Rattus norvegicus
ggaagcttctctgatctcccaggtc

SEQ ID NO: 418406 - DNA, 25 bp, Rattus norvegicus
ggaagcttggttacactaagataca

SEQ ID NO: 418407 - DNA, 25 bp, Rattus norvegicus
ggaagcttggtttcactaagataca

SEQ ID NO: 418408 - DNA, 25 bp, Rattus norvegicus
ggaagcttgtgcacattcatttttt

SEQ ID NO: 418409 - DNA, 25 bp, Rattus norvegicus
ggaagcttgtgctcattcatttttt

SEQ ID NO: 418410 - DNA, 25 bp, Rattus norvegicus
ggaagctttagtctcgtttgcactc

SEQ ID NO: 418411 - DNA, 25 bp, Rattus norvegicus
ggaagctttagtgtcgtttgcactc

SEQ ID NO: 418412 - DNA, 25 bp, Rattus norvegicus
ggaagctttattaacaaccagggag

SEQ ID NO: 418413 - DNA, 25 bp, Rattus norvegicus
ggaagctttatttacaaccagggag

SEQ ID NO: 418414 - DNA, 25 bp, Rattus norvegicus
ggaagctttcccagtcaaatgaaca

SEQ ID NO: 418415 - DNA, 25 bp, Rattus norvegicus
ggaagctttccctgtcaaatgaaca

SEQ ID NO: 418416 - DNA, 25 bp, Rattus norvegicus
ggaagctttctgatccacattgctc

SEQ ID NO: 418417 - DNA, 25 bp, Rattus norvegicus
ggaagctttctgttccacattgctc

SEQ ID NO: 418418 - DNA, 25 bp, Rattus norvegicus
ggaagctttggacgaccaaccttat

SEQ ID NO: 418419 - DNA, 25 bp, Rattus norvegicus
ggaagctttggaggaccaaccttat

SEQ ID NO: 418420 - DNA, 25 bp, Rattus norvegicus
ggaagctttggtacaacccagtgcc

SEQ ID NO: 418421 - DNA, 25 bp, Rattus norvegicus
ggaagctttggttcaacccagtgcc

SEQ ID NO: 418422 - DNA, 25 bp, Rattus norvegicus
ggaagcttttaaaaaccgcatttag

SEQ ID NO: 418423 - DNA, 25 bp, Rattus norvegicus
ggaagcttttaataaccgcatttag

SEQ ID NO: 418424 - DNA, 25 bp, Rattus norvegicus
ggaaggaaacatactctggacctgt

SEQ ID NO: 418425 - DNA, 25 bp, Rattus norvegicus
ggaaggaaacattctctggacctgt

SEQ ID NO: 418426 - DNA, 25 bp, Rattus norvegicus
ggaaggaaatccctctgtgactaca

SEQ ID NO: 418427 - DNA, 25 bp, Rattus norvegicus
ggaaggaaatccgtctgtgactaca

SEQ ID NO: 418428 - DNA, 25 bp, Rattus norvegicus
ggaaggaaatggacgcttacaggct

SEQ ID NO: 418429 - DNA, 25 bp, Rattus norvegicus
ggaaggaaatggtcgcttacaggct

SEQ ID NO: 418430 - DNA, 25 bp, Rattus norvegicus
ggaaggaacactatgctcttgggtt

SEQ ID NO: 418431 - DNA, 25 bp, Rattus norvegicus
ggaaggaacactttgctcttgggtt

SEQ ID NO: 418432 - DNA, 25 bp, Rattus norvegicus
ggaaggaactcgctgacctacctaa

SEQ ID NO: 418433 - DNA, 25 bp, Rattus norvegicus
ggaaggaactcggtgacctacctaa

SEQ ID NO: 418434 - DNA, 25 bp, Rattus norvegicus
ggaaggaactctccggaggaccatt

SEQ ID NO: 418435 - DNA, 25 bp, Rattus norvegicus
ggaaggaactctgcggaggaccatt

SEQ ID NO: 418436 - DNA, 25 bp, Rattus norvegicus
ggaaggaactgaacgctccagaatg

SEQ ID NO: 418437 - DNA, 25 bp, Rattus norvegicus
ggaaggaactgatcgctccagaatg

SEQ ID NO: 418438 - DNA, 25 bp, Rattus norvegicus
ggaaggaagactcggcgcacatttc

SEQ ID NO: 418439 - DNA, 25 bp, Rattus norvegicus
ggaaggaagactgggcgcacatttc

SEQ ID NO: 418440 - DNA, 25 bp, Rattus norvegicus
ggaaggaagatcatggtccctgccc

SEQ ID NO: 418441 - DNA, 25 bp, Rattus norvegicus
ggaaggaagatcttggtccctgccc

SEQ ID NO: 418442 - DNA, 25 bp, Rattus norvegicus
ggaaggaaggcactttcccatgctt

SEQ ID NO: 418443 - DNA, 25 bp, Rattus norvegicus
ggaaggaaggcagtttcccatgctt

SEQ ID NO: 418444 - DNA, 25 bp, Rattus norvegicus
ggaaggaatcagaagtgctcactaa

SEQ ID NO: 418445 - DNA, 25 bp, Rattus norvegicus
ggaaggaatcagtagtgctcactaa

SEQ ID NO: 418446 - DNA, 25 bp, Rattus norvegicus
ggaaggaatcctcatactttggata

SEQ ID NO: 418447 - DNA, 25 bp, Rattus norvegicus
ggaaggaatcctgatactttggata

SEQ ID NO: 418448 - DNA, 25 bp, Rattus norvegicus
ggaaggaattaccatcagccaaacc

SEQ ID NO: 418449 - DNA, 25 bp, Rattus norvegicus
ggaaggaattacgatcagccaaacc

SEQ ID NO: 418450 - DNA, 25 bp, Rattus norvegicus
ggaaggaatttcaaacagctcacat

SEQ ID NO: 418451 - DNA, 25 bp, Rattus norvegicus
ggaaggaatttctaacagctcacat

SEQ ID NO: 418452 - DNA, 25 bp, Rattus norvegicus
ggaaggaattttctgtccacacctc

SEQ ID NO: 418453 - DNA, 25 bp, Rattus norvegicus
ggaaggaattttgtgtccacacctc

SEQ ID NO: 418454 - DNA, 25 bp, Rattus norvegicus
ggaaggacaccaaactgttcggctt

SEQ ID NO: 418455 - DNA, 25 bp, Rattus norvegicus
ggaaggacaccatactgttcggctt

SEQ ID NO: 418456 - DNA, 25 bp, Rattus norvegicus
ggaaggacatacagcccacttgaag

SEQ ID NO: 418457 - DNA, 25 bp, Rattus norvegicus
ggaaggacatactgcccacttgaag

SEQ ID NO: 418458 - DNA, 25 bp, Rattus norvegicus
ggaaggacatccagtacgctactag

SEQ ID NO: 418459 - DNA, 25 bp, Rattus norvegicus
ggaaggacatcctgtacgctactag

SEQ ID NO: 418460 - DNA, 25 bp, Rattus norvegicus
ggaaggacattgaccctgtggccat

SEQ ID NO: 418461 - DNA, 25 bp, Rattus norvegicus
ggaaggacattgtccctgtggccat

SEQ ID NO: 418462 - DNA, 25 bp, Rattus norvegicus
ggaaggaccaacaacgactcacaga

SEQ ID NO: 418463 - DNA, 25 bp, Rattus norvegicus
ggaaggaccaactacgactcacaga

SEQ ID NO: 418464 - DNA, 25 bp, Rattus norvegicus
ggaaggaccactaggccaagccaaa

SEQ ID NO: 418465 - DNA, 25 bp, Rattus norvegicus
ggaaggaccacttggccaagccaaa

SEQ ID NO: 418466 - DNA, 25 bp, Rattus norvegicus
ggaaggaccatgacactttcacgtg

SEQ ID NO: 418467 - DNA, 25 bp, Rattus norvegicus
ggaaggaccatgtcactttcacgtg

SEQ ID NO: 418468 - DNA, 25 bp, Rattus norvegicus
ggaaggacccctagccaggctcggt

SEQ ID NO: 418469 - DNA, 25 bp, Rattus norvegicus
ggaaggaccccttgccaggctcggt

SEQ ID NO: 418470 - DNA, 25 bp, Rattus norvegicus
ggaaggaccctaatcacaaagcaag

SEQ ID NO: 418471 - DNA, 25 bp, Rattus norvegicus
ggaaggaccctattcacaaagcaag

SEQ ID NO: 418472 - DNA, 25 bp, Rattus norvegicus
ggaaggacccttcagaaatcatgct

SEQ ID NO: 418473 - DNA, 25 bp, Rattus norvegicus
ggaaggacccttgagaaatcatgct

SEQ ID NO: 418474 - DNA, 25 bp, Rattus norvegicus
ggaaggaccgatcacagctagaact

SEQ ID NO: 418475 - DNA, 25 bp, Rattus norvegicus
ggaaggaccgatgacagctagaact

SEQ ID NO: 418476 - DNA, 25 bp, Rattus norvegicus
ggaaggacctctatgctaacaacgt

SEQ ID NO: 418477 - DNA, 25 bp, Rattus norvegicus
ggaaggacctctttgctaacaacgt

SEQ ID NO: 418478 - DNA, 25 bp, Rattus norvegicus
ggaaggactagcaccaggccagtct

SEQ ID NO: 418479 - DNA, 25 bp, Rattus norvegicus
ggaaggactagctccaggccagtct

SEQ ID NO: 418480 - DNA, 25 bp, Rattus norvegicus
ggaaggactctacaagtgccactaa

SEQ ID NO: 418481 - DNA, 25 bp, Rattus norvegicus
ggaaggactctagaagtgccactaa

SEQ ID NO: 418482 - DNA, 25 bp, Rattus norvegicus
ggaaggactgagaccactctggaaa

SEQ ID NO: 418483 - DNA, 25 bp, Rattus norvegicus
ggaaggactgagtccactctggaaa

SEQ ID NO: 418484 - DNA, 25 bp, Rattus norvegicus
ggaaggacttctaagactctaggct

SEQ ID NO: 418485 - DNA, 25 bp, Rattus norvegicus
ggaaggacttcttagactctaggct

SEQ ID NO: 418486 - DNA, 25 bp, Rattus norvegicus
ggaaggagacatctctctagtcctc

SEQ ID NO: 418487 - DNA, 25 bp, Rattus norvegicus
ggaaggagacatgtctctagtcctc

SEQ ID NO: 418488 - DNA, 25 bp, Rattus norvegicus
ggaaggagcagaatccgtttccgct

SEQ ID NO: 418489 - DNA, 25 bp, Rattus norvegicus
ggaaggagcagattccgtttccgct

SEQ ID NO: 418490 - DNA, 25 bp, Rattus norvegicus
ggaaggagcattagccctcagctta

SEQ ID NO: 418491 - DNA, 25 bp, Rattus norvegicus
ggaaggagcatttgccctcagctta

SEQ ID NO: 418492 - DNA, 25 bp, Rattus norvegicus
ggaaggagccacactggtgcaccgt

SEQ ID NO: 418493 - DNA, 25 bp, Rattus norvegicus
ggaaggagccactctggtgcaccgt

SEQ ID NO: 418494 - DNA, 25 bp, Rattus norvegicus
ggaaggagcccacactacaagttgt

SEQ ID NO: 418495 - DNA, 25 bp, Rattus norvegicus
ggaaggagcccagactacaagttgt

SEQ ID NO: 418496 - DNA, 25 bp, Rattus norvegicus
ggaaggagcctgatgaatctgttca

SEQ ID NO: 418497 - DNA, 25 bp, Rattus norvegicus
ggaaggagcctgatggtgatccatt

SEQ ID NO: 418498 - DNA, 25 bp, Rattus norvegicus
ggaaggagcctgttgaatctgttca

SEQ ID NO: 418499 - DNA, 25 bp, Rattus norvegicus
ggaaggagcctgttggtgatccatt

SEQ ID NO: 418500 - DNA, 25 bp, Rattus norvegicus
ggaaggagcttccaggacacctgaa

SEQ ID NO: 418501 - DNA, 25 bp, Rattus norvegicus
ggaaggagcttcgaggacacctgaa

SEQ ID NO: 418502 - DNA, 25 bp, Rattus norvegicus
ggaaggagcttgagtccctctgcac

SEQ ID NO: 418503 - DNA, 25 bp, Rattus norvegicus
ggaaggagcttgtgtccctctgcac

SEQ ID NO: 418504 - DNA, 25 bp, Rattus norvegicus
ggaaggaggtccatgctgcctacca

SEQ ID NO: 418505 - DNA, 25 bp, Rattus norvegicus
ggaaggaggtccttgctgcctacca

SEQ ID NO: 418506 - DNA, 25 bp, Rattus norvegicus
ggaaggaggtgtcttcctctcctgt

SEQ ID NO: 418507 - DNA, 25 bp, Rattus norvegicus
ggaaggaggtgtgttcctctcctgt

SEQ ID NO: 418508 - DNA, 25 bp, Rattus norvegicus
ggaaggagtatgaacctggccaact

SEQ ID NO: 418509 - DNA, 25 bp, Rattus norvegicus
ggaaggagtatgtacctggccaact

SEQ ID NO: 418510 - DNA, 25 bp, Rattus norvegicus
ggaaggataaggacgggcaggatca

SEQ ID NO: 418511 - DNA, 25 bp, Rattus norvegicus
ggaaggataaggtcgggcaggatca

SEQ ID NO: 418512 - DNA, 25 bp, Rattus norvegicus
ggaaggatactaaccaagctgttta

SEQ ID NO: 418513 - DNA, 25 bp, Rattus norvegicus
ggaaggatactatccaagctgttta

SEQ ID NO: 418514 - DNA, 25 bp, Rattus norvegicus
ggaaggatatccagtagctatttat

SEQ ID NO: 418515 - DNA, 25 bp, Rattus norvegicus
ggaaggatatcctgtagctatttat

SEQ ID NO: 418516 - DNA, 25 bp, Rattus norvegicus
ggaaggatccctacaggccaagcag

SEQ ID NO: 418517 - DNA, 25 bp, Rattus norvegicus
ggaaggatcccttcaggccaagcag

SEQ ID NO: 418518 - DNA, 25 bp, Rattus norvegicus
ggaaggatccgcatgaccttgaaat

SEQ ID NO: 418519 - DNA, 25 bp, Rattus norvegicus
ggaaggatccgcttgaccttgaaat

SEQ ID NO: 418520 - DNA, 25 bp, Rattus norvegicus
ggaaggatctgaagctccttggctc

SEQ ID NO: 418521 - DNA, 25 bp, Rattus norvegicus
ggaaggatctgatgctccttggctc

SEQ ID NO: 418522 - DNA, 25 bp, Rattus norvegicus
ggaaggatgacaatttcacacacgt

SEQ ID NO: 418523 - DNA, 25 bp, Rattus norvegicus
ggaaggatgacattttcacacacgt

SEQ ID NO: 418524 - DNA, 25 bp, Rattus norvegicus
ggaaggatgatcattaccctccagc

SEQ ID NO: 418525 - DNA, 25 bp, Rattus norvegicus
ggaaggatgatctttaccctccagc

SEQ ID NO: 418526 - DNA, 25 bp, Rattus norvegicus
ggaaggatgcacaacccgggagcca

SEQ ID NO: 418527 - DNA, 25 bp, Rattus norvegicus
ggaaggatgcactacccgggagcca

SEQ ID NO: 418528 - DNA, 25 bp, Rattus norvegicus
ggaaggatgctcactagaccaatgc

SEQ ID NO: 418529 - DNA, 25 bp, Rattus norvegicus
ggaaggatgctctctagaccaatgc

SEQ ID NO: 418530 - DNA, 25 bp, Rattus norvegicus
ggaaggattctgcactctgtagtgt

SEQ ID NO: 418531 - DNA, 25 bp, Rattus norvegicus
ggaaggattctggactctgtagtgt

SEQ ID NO: 418532 - DNA, 25 bp, Rattus norvegicus
ggaaggattgctagccaaccagcct

SEQ ID NO: 418533 - DNA, 25 bp, Rattus norvegicus
ggaaggattgcttgccaaccagcct

SEQ ID NO: 418534 - DNA, 25 bp, Rattus norvegicus
ggaaggatttaaagccctggagcct

SEQ ID NO: 418535 - DNA, 25 bp, Rattus norvegicus
ggaaggatttaatgccctggagcct

SEQ ID NO: 418536 - DNA, 25 bp, Rattus norvegicus
ggaaggatttcactgagcactgcaa

SEQ ID NO: 418537 - DNA, 25 bp, Rattus norvegicus
ggaaggatttcagtgagcactgcaa

SEQ ID NO: 418538 - DNA, 25 bp, Rattus norvegicus
ggaaggatttctactctttgaagtc

SEQ ID NO: 418539 - DNA, 25 bp, Rattus norvegicus
ggaaggatttcttctctttgaagtc

SEQ ID NO: 418540 - DNA, 25 bp, Rattus norvegicus
ggaaggcaaattactcttctcatat

SEQ ID NO: 418541 - DNA, 25 bp, Rattus norvegicus
ggaaggcaaatttctcttctcatat

SEQ ID NO: 418542 - DNA, 25 bp, Rattus norvegicus
ggaaggcaacccagcagagatcaat

SEQ ID NO: 418543 - DNA, 25 bp, Rattus norvegicus
ggaaggcaaccctgcagagatcaat

SEQ ID NO: 418544 - DNA, 25 bp, Rattus norvegicus
ggaaggcaagcaatccaatactctt

SEQ ID NO: 418545 - DNA, 25 bp, Rattus norvegicus
ggaaggcaagcattccaatactctt

SEQ ID NO: 418546 - DNA, 25 bp, Rattus norvegicus
ggaaggcaagttccacacttcttgt

SEQ ID NO: 418547 - DNA, 25 bp, Rattus norvegicus
ggaaggcaagttgcacacttcttgt

SEQ ID NO: 418548 - DNA, 25 bp, Rattus norvegicus
ggaaggcacaccacaccggaactgc

SEQ ID NO: 418549 - DNA, 25 bp, Rattus norvegicus
ggaaggcacacctcaccggaactgc

SEQ ID NO: 418550 - DNA, 25 bp, Rattus norvegicus
ggaaggcaccaacgcagtcaccaag

SEQ ID NO: 418551 - DNA, 25 bp, Rattus norvegicus
ggaaggcaccaaggcagtcaccaag

SEQ ID NO: 418552 - DNA, 25 bp, Rattus norvegicus
ggaaggcaccagctacagcaatgat

SEQ ID NO: 418553 - DNA, 25 bp, Rattus norvegicus
ggaaggcaccaggtacagcaatgat

SEQ ID NO: 418554 - DNA, 25 bp, Rattus norvegicus
ggaaggcacccaagaccacagactg

SEQ ID NO: 418555 - DNA, 25 bp, Rattus norvegicus
ggaaggcacccatgaccacagactg

SEQ ID NO: 418556 - DNA, 25 bp, Rattus norvegicus
ggaaggcaccttagcagcttagata

SEQ ID NO: 418557 - DNA, 25 bp, Rattus norvegicus
ggaaggcacctttgcagcttagata

SEQ ID NO: 418558 - DNA, 25 bp, Rattus norvegicus
ggaaggcactacctgtgatttgtca

SEQ ID NO: 418559 - DNA, 25 bp, Rattus norvegicus
ggaaggcactacgtgtgatttgtca

SEQ ID NO: 418560 - DNA, 25 bp, Rattus norvegicus
ggaaggcagaacacccgtatacata

SEQ ID NO: 418561 - DNA, 25 bp, Rattus norvegicus
ggaaggcagaactcccgtatacata

SEQ ID NO: 418562 - DNA, 25 bp, Rattus norvegicus
ggaaggcagatgctacccctatcac

SEQ ID NO: 418563 - DNA, 25 bp, Rattus norvegicus
ggaaggcagatggtacccctatcac

SEQ ID NO: 418564 - DNA, 25 bp, Rattus norvegicus
ggaaggcagcagaccagttctcagg

SEQ ID NO: 418565 - DNA, 25 bp, Rattus norvegicus
ggaaggcagcagtccagttctcagg

SEQ ID NO: 418566 - DNA, 25 bp, Rattus norvegicus
ggaaggcagccaccatcagagagca

SEQ ID NO: 418567 - DNA, 25 bp, Rattus norvegicus
ggaaggcagccagcatcagagagca

SEQ ID NO: 418568 - DNA, 25 bp, Rattus norvegicus
ggaaggcagggcaacaatatatgat

SEQ ID NO: 418569 - DNA, 25 bp, Rattus norvegicus
ggaaggcagggctacaatatatgat

SEQ ID NO: 418570 - DNA, 25 bp, Rattus norvegicus
ggaaggcatctaattctgccatcat

SEQ ID NO: 418571 - DNA, 25 bp, Rattus norvegicus
ggaaggcatctatttctgccatcat

SEQ ID NO: 418572 - DNA, 25 bp, Rattus norvegicus
ggaaggcatgacacagtcccagtct

SEQ ID NO: 418573 - DNA, 25 bp, Rattus norvegicus
ggaaggcatgactcagtcccagtct

SEQ ID NO: 418574 - DNA, 25 bp, Rattus norvegicus
ggaaggcatggcaccttgcctaaaa

SEQ ID NO: 418575 - DNA, 25 bp, Rattus norvegicus
ggaaggcatggctccttgcctaaaa

SEQ ID NO: 418576 - DNA, 25 bp, Rattus norvegicus
ggaaggccaaacatgcagtacccaa

SEQ ID NO: 418577 - DNA, 25 bp, Rattus norvegicus
ggaaggccaaacttgcagtacccaa

SEQ ID NO: 418578 - DNA, 25 bp, Rattus norvegicus
ggaaggccacagacctggctctcag

SEQ ID NO: 418579 - DNA, 25 bp, Rattus norvegicus
ggaaggccacagtcctggctctcag

SEQ ID NO: 418580 - DNA, 25 bp, Rattus norvegicus
ggaaggccaggtagatcccagctgt

SEQ ID NO: 418581 - DNA, 25 bp, Rattus norvegicus
ggaaggccaggttgatcccagctgt

SEQ ID NO: 418582 - DNA, 25 bp, Rattus norvegicus
ggaaggccatatcgtgccatcccag

SEQ ID NO: 418583 - DNA, 25 bp, Rattus norvegicus
ggaaggccatatggtgccatcccag

SEQ ID NO: 418584 - DNA, 25 bp, Rattus norvegicus
ggaaggccatcacaattggccgcat

SEQ ID NO: 418585 - DNA, 25 bp, Rattus norvegicus
ggaaggccatcagaattggccgcat

SEQ ID NO: 418586 - DNA, 25 bp, Rattus norvegicus
ggaaggccatttaacctgaggccct

SEQ ID NO: 418587 - DNA, 25 bp, Rattus norvegicus
ggaaggccattttacctgaggccct

SEQ ID NO: 418588 - DNA, 25 bp, Rattus norvegicus
ggaaggcccagcattctttaatgga

SEQ ID NO: 418589 - DNA, 25 bp, Rattus norvegicus
ggaaggcccagctttctttaatgga

SEQ ID NO: 418590 - DNA, 25 bp, Rattus norvegicus
ggaaggcctatgagggttaccattc

SEQ ID NO: 418591 - DNA, 25 bp, Rattus norvegicus
ggaaggcctatgtgggttaccattc

SEQ ID NO: 418592 - DNA, 25 bp, Rattus norvegicus
ggaaggcctgaaactgcccgtcaga

SEQ ID NO: 418593 - DNA, 25 bp, Rattus norvegicus
ggaaggcctgaatctgcccgtcaga

SEQ ID NO: 418594 - DNA, 25 bp, Rattus norvegicus
ggaaggcctgacatgtggtctccat

SEQ ID NO: 418595 - DNA, 25 bp, Rattus norvegicus
ggaaggcctgacttgtggtctccat

SEQ ID NO: 418596 - DNA, 25 bp, Rattus norvegicus
ggaaggcctggcaatgcccagcctc

SEQ ID NO: 418597 - DNA, 25 bp, Rattus norvegicus
ggaaggcctggctatgcccagcctc

SEQ ID NO: 418598 - DNA, 25 bp, Rattus norvegicus
ggaaggcctgttacccacgtgaggc

SEQ ID NO: 418599 - DNA, 25 bp, Rattus norvegicus
ggaaggcctgtttcccacgtgaggc

SEQ ID NO: 418600 - DNA, 25 bp, Rattus norvegicus
ggaaggccttcacttgtagctcata

SEQ ID NO: 418601 - DNA, 25 bp, Rattus norvegicus
ggaaggccttcagttgtagctcata

SEQ ID NO: 418602 - DNA, 25 bp, Rattus norvegicus
ggaaggccttccatttagggcagga

SEQ ID NO: 418603 - DNA, 25 bp, Rattus norvegicus
ggaaggccttccttttagggcagga

SEQ ID NO: 418604 - DNA, 25 bp, Rattus norvegicus
ggaaggcctttaatcaagtgtcaga

SEQ ID NO: 418605 - DNA, 25 bp, Rattus norvegicus
ggaaggcctttattcaagtgtcaga

SEQ ID NO: 418606 - DNA, 25 bp, Rattus norvegicus
ggaaggcctttcaggagagctttaa

SEQ ID NO: 418607 - DNA, 25 bp, Rattus norvegicus
ggaaggcctttctggagagctttaa

SEQ ID NO: 418608 - DNA, 25 bp, Rattus norvegicus
ggaaggcgccttagccactgaggaa

SEQ ID NO: 418609 - DNA, 25 bp, Rattus norvegicus
ggaaggcgcctttgccactgaggaa

SEQ ID NO: 418610 - DNA, 25 bp, Rattus norvegicus
ggaaggcggcttccaaattctttaa

SEQ ID NO: 418611 - DNA, 25 bp, Rattus norvegicus
ggaaggcggcttgcaaattctttaa

SEQ ID NO: 418612 - DNA, 25 bp, Rattus norvegicus
ggaaggcgttagactcggagcaaac

SEQ ID NO: 418613 - DNA, 25 bp, Rattus norvegicus
ggaaggcgttagtctcggagcaaac

SEQ ID NO: 418614 - DNA, 25 bp, Rattus norvegicus
ggaaggctaagaaccgcagcttaaa

SEQ ID NO: 418615 - DNA, 25 bp, Rattus norvegicus
ggaaggctaagatccgcagcttaaa

SEQ ID NO: 418616 - DNA, 25 bp, Rattus norvegicus
ggaaggctccaaatcctaccttaga

SEQ ID NO: 418617 - DNA, 25 bp, Rattus norvegicus
ggaaggctccaattcctaccttaga

SEQ ID NO: 418618 - DNA, 25 bp, Rattus norvegicus
ggaaggctccagacacaggctgcca

SEQ ID NO: 418619 - DNA, 25 bp, Rattus norvegicus
ggaaggctccagtcacaggctgcca

SEQ ID NO: 418620 - DNA, 25 bp, Rattus norvegicus
ggaaggctcctgattgtttacccat

SEQ ID NO: 418621 - DNA, 25 bp, Rattus norvegicus
ggaaggctcctgtttgtttacccat

SEQ ID NO: 418622 - DNA, 25 bp, Rattus norvegicus
ggaaggctccttaaaactggtcagt

SEQ ID NO: 418623 - DNA, 25 bp, Rattus norvegicus
ggaaggctcctttaaactggtcagt

SEQ ID NO: 418624 - DNA, 25 bp, Rattus norvegicus
ggaaggctctcacggattcaggata

SEQ ID NO: 418625 - DNA, 25 bp, Rattus norvegicus
ggaaggctctcagggattcaggata

SEQ ID NO: 418626 - DNA, 25 bp, Rattus norvegicus
ggaaggctctgtcatgctgcaaatt

SEQ ID NO: 418627 - DNA, 25 bp, Rattus norvegicus
ggaaggctctgtgatgctgcaaatt

SEQ ID NO: 418628 - DNA, 25 bp, Rattus norvegicus
ggaaggctctttaaactctcaaaag

SEQ ID NO: 418629 - DNA, 25 bp, Rattus norvegicus
ggaaggctcttttaactctcaaaag

SEQ ID NO: 418630 - DNA, 25 bp, Rattus norvegicus
ggaaggctgcagctttgctccagtc

SEQ ID NO: 418631 - DNA, 25 bp, Rattus norvegicus
ggaaggctgcaggtttgctccagtc

SEQ ID NO: 418632 - DNA, 25 bp, Rattus norvegicus
ggaaggctgcctctggcttaaagac

SEQ ID NO: 418633 - DNA, 25 bp, Rattus norvegicus
ggaaggctgcctgtggcttaaagac

SEQ ID NO: 418634 - DNA, 25 bp, Rattus norvegicus
ggaaggctgctaagctcagtgccca

SEQ ID NO: 418635 - DNA, 25 bp, Rattus norvegicus
ggaaggctgctatgctcagtgccca

SEQ ID NO: 418636 - DNA, 25 bp, Rattus norvegicus
ggaaggctgcttacggacggtcacc

SEQ ID NO: 418637 - DNA, 25 bp, Rattus norvegicus
ggaaggctgctttcggacggtcacc

SEQ ID NO: 418638 - DNA, 25 bp, Rattus norvegicus
ggaaggctgggtaccagtattccct

SEQ ID NO: 418639 - DNA, 25 bp, Rattus norvegicus
ggaaggctgggttccagtattccct

SEQ ID NO: 418640 - DNA, 25 bp, Rattus norvegicus
ggaaggctgtctatctgtgcttggc

SEQ ID NO: 418641 - DNA, 25 bp, Rattus norvegicus
ggaaggctgtctttctgtgcttggc

SEQ ID NO: 418642 - DNA, 25 bp, Rattus norvegicus
ggaaggcttatcagcacagacccca

SEQ ID NO: 418643 - DNA, 25 bp, Rattus norvegicus
ggaaggcttatctgcacagacccca

SEQ ID NO: 418644 - DNA, 25 bp, Rattus norvegicus
ggaaggcttcacactgaccttatgc

SEQ ID NO: 418645 - DNA, 25 bp, Rattus norvegicus
ggaaggcttcactctgaccttatgc

SEQ ID NO: 418646 - DNA, 25 bp, Rattus norvegicus
ggaaggcttccaaacgcagatctct

SEQ ID NO: 418647 - DNA, 25 bp, Rattus norvegicus
ggaaggcttccatacgcagatctct

SEQ ID NO: 418648 - DNA, 25 bp, Rattus norvegicus
ggaagggaaaaccaagcatgcattt

SEQ ID NO: 418649 - DNA, 25 bp, Rattus norvegicus
ggaagggaaaacgaagcatgcattt

SEQ ID NO: 418650 - DNA, 25 bp, Rattus norvegicus
ggaagggaaagtacacttgctccat

SEQ ID NO: 418651 - DNA, 25 bp, Rattus norvegicus
ggaagggaaagttcacttgctccat

SEQ ID NO: 418652 - DNA, 25 bp, Rattus norvegicus
ggaagggaagtcctggactccacca

SEQ ID NO: 418653 - DNA, 25 bp, Rattus norvegicus
ggaagggaagtcgtggactccacca

SEQ ID NO: 418654 - DNA, 25 bp, Rattus norvegicus
ggaagggacagacttaaccaagcaa

SEQ ID NO: 418655 - DNA, 25 bp, Rattus norvegicus
ggaagggacagagttaaccaagcaa

SEQ ID NO: 418656 - DNA, 25 bp, Rattus norvegicus
ggaagggactcgcttctcaagaatt

SEQ ID NO: 418657 - DNA, 25 bp, Rattus norvegicus
ggaagggactcggttctcaagaatt

SEQ ID NO: 418658 - DNA, 25 bp, Rattus norvegicus
ggaagggactctattgtactttgga

SEQ ID NO: 418659 - DNA, 25 bp, Rattus norvegicus
ggaagggactcttttgtactttgga

SEQ ID NO: 418660 - DNA, 25 bp, Rattus norvegicus
ggaagggactgtctcgacccatcat

SEQ ID NO: 418661 - DNA, 25 bp, Rattus norvegicus
ggaagggactgtgtcgacccatcat

SEQ ID NO: 418662 - DNA, 25 bp, Rattus norvegicus
ggaagggactttcacattgtggcct

SEQ ID NO: 418663 - DNA, 25 bp, Rattus norvegicus
ggaagggactttgacattgtggcct

SEQ ID NO: 418664 - DNA, 25 bp, Rattus norvegicus
ggaagggagtctatacttacataat

SEQ ID NO: 418665 - DNA, 25 bp, Rattus norvegicus
ggaagggagtctttacttacataat

SEQ ID NO: 418666 - DNA, 25 bp, Rattus norvegicus
ggaagggattgtcgttcagctcttt

SEQ ID NO: 418667 - DNA, 25 bp, Rattus norvegicus
ggaagggattgtggttcagctcttt

SEQ ID NO: 418668 - DNA, 25 bp, Rattus norvegicus
ggaagggcacgccaaactaccgctg

SEQ ID NO: 418669 - DNA, 25 bp, Rattus norvegicus
ggaagggcacgcgaaactaccgctg

SEQ ID NO: 418670 - DNA, 25 bp, Rattus norvegicus
ggaagggcactgaccatccatgcac

SEQ ID NO: 418671 - DNA, 25 bp, Rattus norvegicus
ggaagggcactgtccatccatgcac

SEQ ID NO: 418672 - DNA, 25 bp, Rattus norvegicus
ggaagggcaggaaagccctcaccct

SEQ ID NO: 418673 - DNA, 25 bp, Rattus norvegicus
ggaagggcaggatagccctcaccct

SEQ ID NO: 418674 - DNA, 25 bp, Rattus norvegicus
ggaagggcatatcaccacaagtata

SEQ ID NO: 418675 - DNA, 25 bp, Rattus norvegicus
ggaagggcatatgaccacaagtata

SEQ ID NO: 418676 - DNA, 25 bp, Rattus norvegicus
ggaagggcatgcaatgtcccacaga

SEQ ID NO: 418677 - DNA, 25 bp, Rattus norvegicus
ggaagggcatgctatgtcccacaga

SEQ ID NO: 418678 - DNA, 25 bp, Rattus norvegicus
ggaagggccattcattcaacaccat

SEQ ID NO: 418679 - DNA, 25 bp, Rattus norvegicus
ggaagggccattgattcaacaccat

SEQ ID NO: 418680 - DNA, 25 bp, Rattus norvegicus
ggaagggcccaacatgtagcatcct

SEQ ID NO: 418681 - DNA, 25 bp, Rattus norvegicus
ggaagggcccaagatgtagcatcct

SEQ ID NO: 418682 - DNA, 25 bp, Rattus norvegicus
ggaagggcctagaatttcccatgac

SEQ ID NO: 418683 - DNA, 25 bp, Rattus norvegicus
ggaagggcctagtatttcccatgac

SEQ ID NO: 418684 - DNA, 25 bp, Rattus norvegicus
ggaagggcctctaacaatgctaagt

SEQ ID NO: 418685 - DNA, 25 bp, Rattus norvegicus
ggaagggcctcttacaatgctaagt

SEQ ID NO: 418686 - DNA, 25 bp, Rattus norvegicus
ggaagggccttgcattttggcacta

SEQ ID NO: 418687 - DNA, 25 bp, Rattus norvegicus
ggaagggccttggattttggcacta

SEQ ID NO: 418688 - DNA, 25 bp, Rattus norvegicus
ggaagggcgatgagaacccgcccac

SEQ ID NO: 418689 - DNA, 25 bp, Rattus norvegicus
ggaagggcgatgtgaacccgcccac

SEQ ID NO: 418690 - DNA, 25 bp, Rattus norvegicus
ggaagggcgcgacctctgtaatatt

SEQ ID NO: 418691 - DNA, 25 bp, Rattus norvegicus
ggaagggcgcgagctctgtaatatt

SEQ ID NO: 418692 - DNA, 25 bp, Rattus norvegicus
ggaagggctcccatttattctgcag

SEQ ID NO: 418693 - DNA, 25 bp, Rattus norvegicus
ggaagggctcccttttattctgcag

SEQ ID NO: 418694 - DNA, 25 bp, Rattus norvegicus
ggaagggctcctctgctagttgcac

SEQ ID NO: 418695 - DNA, 25 bp, Rattus norvegicus
ggaagggctcctgtgctagttgcac

SEQ ID NO: 418696 - DNA, 25 bp, Rattus norvegicus
ggaagggcttagcttctgaatcaat

SEQ ID NO: 418697 - DNA, 25 bp, Rattus norvegicus
ggaagggcttaggttctgaatcaat

SEQ ID NO: 418698 - DNA, 25 bp, Rattus norvegicus
ggaagggcttcactcagacctcaca

SEQ ID NO: 418699 - DNA, 25 bp, Rattus norvegicus
ggaagggcttcagtcagacctcaca

SEQ ID NO: 418700 - DNA, 25 bp, Rattus norvegicus
ggaaggtaaacgactgctctgagaa

SEQ ID NO: 418701 - DNA, 25 bp, Rattus norvegicus
ggaaggtaaacgtctgctctgagaa

SEQ ID NO: 418702 - DNA, 25 bp, Rattus norvegicus
ggaaggtattcccatctgtcagcag

SEQ ID NO: 418703 - DNA, 25 bp, Rattus norvegicus
ggaaggtattccgatctgtcagcag

SEQ ID NO: 418704 - DNA, 25 bp, Rattus norvegicus
ggaaggtatttcagatcactctaag

SEQ ID NO: 418705 - DNA, 25 bp, Rattus norvegicus
ggaaggtatttctgatcactctaag

SEQ ID NO: 418706 - DNA, 25 bp, Rattus norvegicus
ggaaggtcacagcaggcccattgaa

SEQ ID NO: 418707 - DNA, 25 bp, Rattus norvegicus
ggaaggtcacaggaggcccattgaa

SEQ ID NO: 418708 - DNA, 25 bp, Rattus norvegicus
ggaaggtcattgctacaactgttac

SEQ ID NO: 418709 - DNA, 25 bp, Rattus norvegicus
ggaaggtcattggtacaactgttac

SEQ ID NO: 418710 - DNA, 25 bp, Rattus norvegicus
ggaaggtccctcaagcgtcggccat

SEQ ID NO: 418711 - DNA, 25 bp, Rattus norvegicus
ggaaggtccctctagcgtcggccat

SEQ ID NO: 418712 - DNA, 25 bp, Rattus norvegicus
ggaaggtccgttagtcacggcagac

SEQ ID NO: 418713 - DNA, 25 bp, Rattus norvegicus
ggaaggtccgtttgtcacggcagac

SEQ ID NO: 418714 - DNA, 25 bp, Rattus norvegicus
ggaaggtcctgcagacacgaccaga

SEQ ID NO: 418715 - DNA, 25 bp, Rattus norvegicus
ggaaggtcctgctgacacgaccaga

SEQ ID NO: 418716 - DNA, 25 bp, Rattus norvegicus
ggaaggtcgaagcactccacctcat

SEQ ID NO: 418717 - DNA, 25 bp, Rattus norvegicus
ggaaggtcgaaggactccacctcat

SEQ ID NO: 418718 - DNA, 25 bp, Rattus norvegicus
ggaaggtctccaaagcagacttgca

SEQ ID NO: 418719 - DNA, 25 bp, Rattus norvegicus
ggaaggtctccatagcagacttgca

SEQ ID NO: 418720 - DNA, 25 bp, Rattus norvegicus
ggaaggtcttacatatcacctagga

SEQ ID NO: 418721 - DNA, 25 bp, Rattus norvegicus
ggaaggtcttacttatcacctagga

SEQ ID NO: 418722 - DNA, 25 bp, Rattus norvegicus
ggaaggtcttccacaatgttgaggc

SEQ ID NO: 418723 - DNA, 25 bp, Rattus norvegicus
ggaaggtcttcctcaatgttgaggc

SEQ ID NO: 418724 - DNA, 25 bp, Rattus norvegicus
ggaaggtctttcctaaagtcacatc

SEQ ID NO: 418725 - DNA, 25 bp, Rattus norvegicus
ggaaggtctttcgtaaagtcacatc

SEQ ID NO: 418726 - DNA, 25 bp, Rattus norvegicus
ggaaggtgaaaaccgcctggccctt

SEQ ID NO: 418727 - DNA, 25 bp, Rattus norvegicus
ggaaggtgaaaagcgcctggccctt

SEQ ID NO: 418728 - DNA, 25 bp, Rattus norvegicus
ggaaggtgattccatcccctttgga

SEQ ID NO: 418729 - DNA, 25 bp, Rattus norvegicus
ggaaggtgattcgatcccctttgga

SEQ ID NO: 418730 - DNA, 25 bp, Rattus norvegicus
ggaaggtgcccactcaaaccatcaa

SEQ ID NO: 418731 - DNA, 25 bp, Rattus norvegicus
ggaaggtgcccagtcaaaccatcaa

SEQ ID NO: 418732 - DNA, 25 bp, Rattus norvegicus
ggaaggtgcctcaacagaccccggg

SEQ ID NO: 418733 - DNA, 25 bp, Rattus norvegicus
ggaaggtgcctctacagaccccggg

SEQ ID NO: 418734 - DNA, 25 bp, Rattus norvegicus
ggaaggtgcggcacttctggacaca

SEQ ID NO: 418735 - DNA, 25 bp, Rattus norvegicus
ggaaggtgcggctcttctggacaca

SEQ ID NO: 418736 - DNA, 25 bp, Rattus norvegicus
ggaaggtggaaaacctctcccgctg

SEQ ID NO: 418737 - DNA, 25 bp, Rattus norvegicus
ggaaggtggaaatcctctcccgctg

SEQ ID NO: 418738 - DNA, 25 bp, Rattus norvegicus
ggaaggtggattccgttcctcttca

SEQ ID NO: 418739 - DNA, 25 bp, Rattus norvegicus
ggaaggtggattgcgttcctcttca

SEQ ID NO: 418740 - DNA, 25 bp, Rattus norvegicus
ggaaggtggccaacggagacctcct

SEQ ID NO: 418741 - DNA, 25 bp, Rattus norvegicus
ggaaggtggccatcggagacctcct

SEQ ID NO: 418742 - DNA, 25 bp, Rattus norvegicus
ggaaggtggtttctcccattgcaac

SEQ ID NO: 418743 - DNA, 25 bp, Rattus norvegicus
ggaaggtggtttgtcccattgcaac

SEQ ID NO: 418744 - DNA, 25 bp, Rattus norvegicus
ggaaggtgtcaaaccattcatcaaa

SEQ ID NO: 418745 - DNA, 25 bp, Rattus norvegicus
ggaaggtgtcaatccattcatcaaa

SEQ ID NO: 418746 - DNA, 25 bp, Rattus norvegicus
ggaaggtgtgccctccgattccatc

SEQ ID NO: 418747 - DNA, 25 bp, Rattus norvegicus
ggaaggtgtgccgtccgattccatc

SEQ ID NO: 418748 - DNA, 25 bp, Rattus norvegicus
ggaaggttattgaccagctgcttcg

SEQ ID NO: 418749 - DNA, 25 bp, Rattus norvegicus
ggaaggttattgtccagctgcttcg

SEQ ID NO: 418750 - DNA, 25 bp, Rattus norvegicus
ggaaggttcagcacaggtgtttctt

SEQ ID NO: 418751 - DNA, 25 bp, Rattus norvegicus
ggaaggttcagctcaggtgtttctt

SEQ ID NO: 418752 - DNA, 25 bp, Rattus norvegicus
ggaaggttccagaatctctcatgaa

SEQ ID NO: 418753 - DNA, 25 bp, Rattus norvegicus
ggaaggttccagtatctctcatgaa

SEQ ID NO: 418754 - DNA, 25 bp, Rattus norvegicus
ggaaggttcctccatgtgatacagg

SEQ ID NO: 418755 - DNA, 25 bp, Rattus norvegicus
ggaaggttcctcgatgtgatacagg

SEQ ID NO: 418756 - DNA, 25 bp, Rattus norvegicus
ggaaggttctcaatttgcctagcaa

SEQ ID NO: 418757 - DNA, 25 bp, Rattus norvegicus
ggaaggttctcattttgcctagcaa

SEQ ID NO: 418758 - DNA, 25 bp, Rattus norvegicus
ggaaggttctcgaacacgtgcctct

SEQ ID NO: 418759 - DNA, 25 bp, Rattus norvegicus
ggaaggttctcgtacacgtgcctct

SEQ ID NO: 418760 - DNA, 25 bp, Rattus norvegicus
ggaaggttgcacagattccattctg

SEQ ID NO: 418761 - DNA, 25 bp, Rattus norvegicus
ggaaggttgcactgattccattctg

SEQ ID NO: 418762 - DNA, 25 bp, Rattus norvegicus
ggaaggtttagactccattcttaag

SEQ ID NO: 418763 - DNA, 25 bp, Rattus norvegicus
ggaaggtttagagtccattcttaag

SEQ ID NO: 418764 - DNA, 25 bp, Rattus norvegicus
ggaaggtttcacagcataattgcca

SEQ ID NO: 418765 - DNA, 25 bp, Rattus norvegicus
ggaaggtttcactgcataattgcca

SEQ ID NO: 418766 - DNA, 25 bp, Rattus norvegicus
ggaaggtttccaccaactgaatcat

SEQ ID NO: 418767 - DNA, 25 bp, Rattus norvegicus
ggaaggtttccagcaactgaatcat

SEQ ID NO: 418768 - DNA, 25 bp, Rattus norvegicus
ggaaggtttctcagtgcttgtgact

SEQ ID NO: 418769 - DNA, 25 bp, Rattus norvegicus
ggaaggtttctctgtgcttgtgact

SEQ ID NO: 418770 - DNA, 25 bp, Rattus norvegicus
ggaaggtttgtgaggcacttcatga

SEQ ID NO: 418771 - DNA, 25 bp, Rattus norvegicus
ggaaggtttgtgtggcacttcatga

SEQ ID NO: 418772 - DNA, 25 bp, Rattus norvegicus
ggaagtaaaagccacctgctgcaga

SEQ ID NO: 418773 - DNA, 25 bp, Rattus norvegicus
ggaagtaaaagcgacctgctgcaga

SEQ ID NO: 418774 - DNA, 25 bp, Rattus norvegicus
ggaagtaaaataccagctcgttaat

SEQ ID NO: 418775 - DNA, 25 bp, Rattus norvegicus
ggaagtaaaatagcagctcgttaat

SEQ ID NO: 418776 - DNA, 25 bp, Rattus norvegicus
ggaagtaacatcatgcgtgcagaga

SEQ ID NO: 418777 - DNA, 25 bp, Rattus norvegicus
ggaagtaacatcttgcgtgcagaga

SEQ ID NO: 418778 - DNA, 25 bp, Rattus norvegicus
ggaagtaactaacgatctccgttgc

SEQ ID NO: 418779 - DNA, 25 bp, Rattus norvegicus
ggaagtaactaaggatctccgttgc

SEQ ID NO: 418780 - DNA, 25 bp, Rattus norvegicus
ggaagtaagactattcccatctgca

SEQ ID NO: 418781 - DNA, 25 bp, Rattus norvegicus
ggaagtaagacttttcccatctgca

SEQ ID NO: 418782 - DNA, 25 bp, Rattus norvegicus
ggaagtaagtcactgcccctaggtc

SEQ ID NO: 418783 - DNA, 25 bp, Rattus norvegicus
ggaagtaagtcagtgcccctaggtc

SEQ ID NO: 418784 - DNA, 25 bp, Rattus norvegicus
ggaagtaatgatacagatatcctgt

SEQ ID NO: 418785 - DNA, 25 bp, Rattus norvegicus
ggaagtaatgattcagatatcctgt

SEQ ID NO: 418786 - DNA, 25 bp, Rattus norvegicus
ggaagtaatggtccctgcttgcata

SEQ ID NO: 418787 - DNA, 25 bp, Rattus norvegicus
ggaagtaatggtgcctgcttgcata

SEQ ID NO: 418788 - DNA, 25 bp, Rattus norvegicus
ggaagtaattcacaaccagctgtta

SEQ ID NO: 418789 - DNA, 25 bp, Rattus norvegicus
ggaagtaattcagaaccagctgtta

SEQ ID NO: 418790 - DNA, 25 bp, Rattus norvegicus
ggaagtacacgtatgcagcccacat

SEQ ID NO: 418791 - DNA, 25 bp, Rattus norvegicus
ggaagtacacgtttgcagcccacat

SEQ ID NO: 418792 - DNA, 25 bp, Rattus norvegicus
ggaagtacagatattgaccccaagg

SEQ ID NO: 418793 - DNA, 25 bp, Rattus norvegicus
ggaagtacagattttgaccccaagg

SEQ ID NO: 418794 - DNA, 25 bp, Rattus norvegicus
ggaagtacattcagcccagagctcc

SEQ ID NO: 418795 - DNA, 25 bp, Rattus norvegicus
ggaagtacattctgcccagagctcc

SEQ ID NO: 418796 - DNA, 25 bp, Rattus norvegicus
ggaagtaccagaacttgaacaatga

SEQ ID NO: 418797 - DNA, 25 bp, Rattus norvegicus
ggaagtaccagatcttgaacaatga

SEQ ID NO: 418798 - DNA, 25 bp, Rattus norvegicus
ggaagtaccagcacagctcaactga

SEQ ID NO: 418799 - DNA, 25 bp, Rattus norvegicus
ggaagtaccagctcagctcaactga

SEQ ID NO: 418800 - DNA, 25 bp, Rattus norvegicus
ggaagtaccttcacatccacagcag

SEQ ID NO: 418801 - DNA, 25 bp, Rattus norvegicus
ggaagtaccttctcatccacagcag

SEQ ID NO: 418802 - DNA, 25 bp, Rattus norvegicus
ggaagtactcaacgcagcaactgct

SEQ ID NO: 418803 - DNA, 25 bp, Rattus norvegicus
ggaagtactcaaggcagcaactgct

SEQ ID NO: 418804 - DNA, 25 bp, Rattus norvegicus
ggaagtactgacacactggcactga

SEQ ID NO: 418805 - DNA, 25 bp, Rattus norvegicus
ggaagtactgactcactggcactga

SEQ ID NO: 418806 - DNA, 25 bp, Rattus norvegicus
ggaagtagaacccatgtgtcacact

SEQ ID NO: 418807 - DNA, 25 bp, Rattus norvegicus
ggaagtagaaccgatgtgtcacact

SEQ ID NO: 418808 - DNA, 25 bp, Rattus norvegicus
ggaagtagaggaccctttacctaga

SEQ ID NO: 418809 - DNA, 25 bp, Rattus norvegicus
ggaagtagaggagcctttacctaga

SEQ ID NO: 418810 - DNA, 25 bp, Rattus norvegicus
ggaagtagcccgcagtcagcattca

SEQ ID NO: 418811 - DNA, 25 bp, Rattus norvegicus
ggaagtagcccggagtcagcattca

SEQ ID NO: 418812 - DNA, 25 bp, Rattus norvegicus
ggaagtagctgccttgtctttcctc

SEQ ID NO: 418813 - DNA, 25 bp, Rattus norvegicus
ggaagtagctgcgttgtctttcctc

SEQ ID NO: 418814 - DNA, 25 bp, Rattus norvegicus
ggaagtaggcagcaacctccctgtc

SEQ ID NO: 418815 - DNA, 25 bp, Rattus norvegicus
ggaagtaggcaggaacctccctgtc

SEQ ID NO: 418816 - DNA, 25 bp, Rattus norvegicus
ggaagtaggctcacacagaataagt

SEQ ID NO: 418817 - DNA, 25 bp, Rattus norvegicus
ggaagtaggctctcacagaataagt

SEQ ID NO: 418818 - DNA, 25 bp, Rattus norvegicus
ggaagtagggcccttacctcacagc

SEQ ID NO: 418819 - DNA, 25 bp, Rattus norvegicus
ggaagtagggccgttacctcacagc

SEQ ID NO: 418820 - DNA, 25 bp, Rattus norvegicus
ggaagtagttaaatacaggctgttc

SEQ ID NO: 418821 - DNA, 25 bp, Rattus norvegicus
ggaagtagttaattacaggctgttc

SEQ ID NO: 418822 - DNA, 25 bp, Rattus norvegicus
ggaagtatgacactggcatcccacc

SEQ ID NO: 418823 - DNA, 25 bp, Rattus norvegicus
ggaagtatgacagtggcatcccacc

SEQ ID NO: 418824 - DNA, 25 bp, Rattus norvegicus
ggaagtatgatccacatgccattac

SEQ ID NO: 418825 - DNA, 25 bp, Rattus norvegicus
ggaagtatgatcgacatgccattac

SEQ ID NO: 418826 - DNA, 25 bp, Rattus norvegicus
ggaagtatggatcgcctggatttca

SEQ ID NO: 418827 - DNA, 25 bp, Rattus norvegicus
ggaagtatggatggcctggatttca

SEQ ID NO: 418828 - DNA, 25 bp, Rattus norvegicus
ggaagtatttcacacaacatgtttt

SEQ ID NO: 418829 - DNA, 25 bp, Rattus norvegicus
ggaagtatttcagacaacatgtttt

SEQ ID NO: 418830 - DNA, 25 bp, Rattus norvegicus
ggaagtatttgtctctccaatctga

SEQ ID NO: 418831 - DNA, 25 bp, Rattus norvegicus
ggaagtatttgtgtctccaatctga

SEQ ID NO: 418832 - DNA, 25 bp, Rattus norvegicus
ggaagtcaacccctctcagagagat

SEQ ID NO: 418833 - DNA, 25 bp, Rattus norvegicus
ggaagtcaacccgtctcagagagat

SEQ ID NO: 418834 - DNA, 25 bp, Rattus norvegicus
ggaagtcaagccctctgaatcagtt

SEQ ID NO: 418835 - DNA, 25 bp, Rattus norvegicus
ggaagtcaagccgtctgaatcagtt

SEQ ID NO: 418836 - DNA, 25 bp, Rattus norvegicus
ggaagtcaatgcaatgctcttgaac

SEQ ID NO: 418837 - DNA, 25 bp, Rattus norvegicus
ggaagtcaatgctatgctcttgaac

SEQ ID NO: 418838 - DNA, 25 bp, Rattus norvegicus
ggaagtcaattgactccaccatatt

SEQ ID NO: 418839 - DNA, 25 bp, Rattus norvegicus
ggaagtcaattgtctccaccatatt

SEQ ID NO: 418840 - DNA, 25 bp, Rattus norvegicus
ggaagtcacagtactcccggctgtg

SEQ ID NO: 418841 - DNA, 25 bp, Rattus norvegicus
ggaagtcacagttctcccggctgtg

SEQ ID NO: 418842 - DNA, 25 bp, Rattus norvegicus
ggaagtcaccgtattgaacgataca

SEQ ID NO: 418843 - DNA, 25 bp, Rattus norvegicus
ggaagtcaccgttttgaacgataca

SEQ ID NO: 418844 - DNA, 25 bp, Rattus norvegicus
ggaagtcacctaattggctgcgaat

SEQ ID NO: 418845 - DNA, 25 bp, Rattus norvegicus
ggaagtcacctatttggctgcgaat

SEQ ID NO: 418846 - DNA, 25 bp, Rattus norvegicus
ggaagtcaccttcggaagcacctga

SEQ ID NO: 418847 - DNA, 25 bp, Rattus norvegicus
ggaagtcaccttgggaagcacctga

SEQ ID NO: 418848 - DNA, 25 bp, Rattus norvegicus
ggaagtcactacctgtaaggagaag

SEQ ID NO: 418849 - DNA, 25 bp, Rattus norvegicus
ggaagtcactacgtgtaaggagaag

SEQ ID NO: 418850 - DNA, 25 bp, Rattus norvegicus
ggaagtcactgtaggagacctgaca

SEQ ID NO: 418851 - DNA, 25 bp, Rattus norvegicus
ggaagtcactgttggagacctgaca

SEQ ID NO: 418852 - DNA, 25 bp, Rattus norvegicus
ggaagtcagaagaagcccaagaaac

SEQ ID NO: 418853 - DNA, 25 bp, Rattus norvegicus
ggaagtcagaagtagcccaagaaac

SEQ ID NO: 418854 - DNA, 25 bp, Rattus norvegicus
ggaagtcagagcactggctatggac

SEQ ID NO: 418855 - DNA, 25 bp, Rattus norvegicus
ggaagtcagagctctggctatggac

SEQ ID NO: 418856 - DNA, 25 bp, Rattus norvegicus
ggaagtcagcatacacccacaatga

SEQ ID NO: 418857 - DNA, 25 bp, Rattus norvegicus
ggaagtcagcattcacccacaatga

SEQ ID NO: 418858 - DNA, 25 bp, Rattus norvegicus
ggaagtcagctgaacacatgcaatt

SEQ ID NO: 418859 - DNA, 25 bp, Rattus norvegicus
ggaagtcagctgtacacatgcaatt

SEQ ID NO: 418860 - DNA, 25 bp, Rattus norvegicus
ggaagtcagggcagcttgtgtctct

SEQ ID NO: 418861 - DNA, 25 bp, Rattus norvegicus
ggaagtcagggctgcttgtgtctct

SEQ ID NO: 418862 - DNA, 25 bp, Rattus norvegicus
ggaagtcagtcaccacagacagaca

SEQ ID NO: 418863 - DNA, 25 bp, Rattus norvegicus
ggaagtcagtcagcacagacagaca

SEQ ID NO: 418864 - DNA, 25 bp, Rattus norvegicus
ggaagtcatactcaccaatccttgg

SEQ ID NO: 418865 - DNA, 25 bp, Rattus norvegicus
ggaagtcatactgaccaatccttgg

SEQ ID NO: 418866 - DNA, 25 bp, Rattus norvegicus
ggaagtcatcacatgctgttacctc

SEQ ID NO: 418867 - DNA, 25 bp, Rattus norvegicus
ggaagtcatcacttgctgttacctc

SEQ ID NO: 418868 - DNA, 25 bp, Rattus norvegicus
ggaagtcatctgctgtgacagccct

SEQ ID NO: 418869 - DNA, 25 bp, Rattus norvegicus
ggaagtcatctggtgtgacagccct

SEQ ID NO: 418870 - DNA, 25 bp, Rattus norvegicus
ggaagtcatcttcccttttcataat

SEQ ID NO: 418871 - DNA, 25 bp, Rattus norvegicus
ggaagtcatcttctcttggtctgaa

SEQ ID NO: 418872 - DNA, 25 bp, Rattus norvegicus
ggaagtcatcttgccttttcataat

SEQ ID NO: 418873 - DNA, 25 bp, Rattus norvegicus
ggaagtcatcttgtcttggtctgaa

SEQ ID NO: 418874 - DNA, 25 bp, Rattus norvegicus
ggaagtcatggaacacctgtcatct

SEQ ID NO: 418875 - DNA, 25 bp, Rattus norvegicus
ggaagtcatggacccgctggacact

SEQ ID NO: 418876 - DNA, 25 bp, Rattus norvegicus
ggaagtcatggagccgctggacact

SEQ ID NO: 418877 - DNA, 25 bp, Rattus norvegicus
ggaagtcatggatcacctgtcatct

SEQ ID NO: 418878 - DNA, 25 bp, Rattus norvegicus
ggaagtcattctcctaagatacttg

SEQ ID NO: 418879 - DNA, 25 bp, Rattus norvegicus
ggaagtcattctgctaagatacttg

SEQ ID NO: 418880 - DNA, 25 bp, Rattus norvegicus
ggaagtccaactatcaggaaccaag

SEQ ID NO: 418881 - DNA, 25 bp, Rattus norvegicus
ggaagtccaactttcaggaaccaag

SEQ ID NO: 418882 - DNA, 25 bp, Rattus norvegicus
ggaagtccaggactcctaactacat

SEQ ID NO: 418883 - DNA, 25 bp, Rattus norvegicus
ggaagtccaggagtcctaactacat

SEQ ID NO: 418884 - DNA, 25 bp, Rattus norvegicus
ggaagtccaggccaaaactgtcctt

SEQ ID NO: 418885 - DNA, 25 bp, Rattus norvegicus
ggaagtccaggcgaaaactgtcctt

SEQ ID NO: 418886 - DNA, 25 bp, Rattus norvegicus
ggaagtccatccagagatttcagct

SEQ ID NO: 418887 - DNA, 25 bp, Rattus norvegicus
ggaagtccatcctgagatttcagct

SEQ ID NO: 418888 - DNA, 25 bp, Rattus norvegicus
ggaagtcccacaaaagctacagctg

SEQ ID NO: 418889 - DNA, 25 bp, Rattus norvegicus
ggaagtcccacataagctacagctg

SEQ ID NO: 418890 - DNA, 25 bp, Rattus norvegicus
ggaagtcccatgaataccctgtaaa

SEQ ID NO: 418891 - DNA, 25 bp, Rattus norvegicus
ggaagtcccatgtataccctgtaaa

SEQ ID NO: 418892 - DNA, 25 bp, Rattus norvegicus
ggaagtcctacaagtgtcctcagtg

SEQ ID NO: 418893 - DNA, 25 bp, Rattus norvegicus
ggaagtcctacacaggctgcccctg

SEQ ID NO: 418894 - DNA, 25 bp, Rattus norvegicus
ggaagtcctacagaggctgcccctg

SEQ ID NO: 418895 - DNA, 25 bp, Rattus norvegicus
ggaagtcctacatgtgtcctcagtg

SEQ ID NO: 418896 - DNA, 25 bp, Rattus norvegicus
ggaagtcctatcatccaggctgctt

SEQ ID NO: 418897 - DNA, 25 bp, Rattus norvegicus
ggaagtcctatcttccaggctgctt

SEQ ID NO: 418898 - DNA, 25 bp, Rattus norvegicus
ggaagtcctgacaagtcaccatttg

SEQ ID NO: 418899 - DNA, 25 bp, Rattus norvegicus
ggaagtcctgacactgaatctccag

SEQ ID NO: 418900 - DNA, 25 bp, Rattus norvegicus
ggaagtcctgactagtcaccatttg

SEQ ID NO: 418901 - DNA, 25 bp, Rattus norvegicus
ggaagtcctgactctgaatctccag

SEQ ID NO: 418902 - DNA, 25 bp, Rattus norvegicus
ggaagtcctgccacttgttggtgac

SEQ ID NO: 418903 - DNA, 25 bp, Rattus norvegicus
ggaagtcctgcccactgagcttgtt

SEQ ID NO: 418904 - DNA, 25 bp, Rattus norvegicus
ggaagtcctgccgactgagcttgtt

SEQ ID NO: 418905 - DNA, 25 bp, Rattus norvegicus
ggaagtcctgcctcttgttggtgac

SEQ ID NO: 418906 - DNA, 25 bp, Rattus norvegicus
ggaagtcctgctcacatcgacctta

SEQ ID NO: 418907 - DNA, 25 bp, Rattus norvegicus
ggaagtcctgctgacatcgacctta

SEQ ID NO: 418908 - DNA, 25 bp, Rattus norvegicus
ggaagtccttatctggtctctagat

SEQ ID NO: 418909 - DNA, 25 bp, Rattus norvegicus
ggaagtccttatgtggtctctagat

SEQ ID NO: 418910 - DNA, 25 bp, Rattus norvegicus
ggaagtcctttacctatgaacgaaa

SEQ ID NO: 418911 - DNA, 25 bp, Rattus norvegicus
ggaagtcctttagctatgaacgaaa

SEQ ID NO: 418912 - DNA, 25 bp, Rattus norvegicus
ggaagtcctttcatcaccaggagct

SEQ ID NO: 418913 - DNA, 25 bp, Rattus norvegicus
ggaagtcctttcttcaccaggagct

SEQ ID NO: 418914 - DNA, 25 bp, Rattus norvegicus
ggaagtcgacccatcaggaactact

SEQ ID NO: 418915 - DNA, 25 bp, Rattus norvegicus
ggaagtcgacccttcaggaactact

SEQ ID NO: 418916 - DNA, 25 bp, Rattus norvegicus
ggaagtcgccatctttacagaccta

SEQ ID NO: 418917 - DNA, 25 bp, Rattus norvegicus
ggaagtcgccatgtttacagaccta

SEQ ID NO: 418918 - DNA, 25 bp, Rattus norvegicus
ggaagtcggtccagcccgtggcact

SEQ ID NO: 418919 - DNA, 25 bp, Rattus norvegicus
ggaagtcggtcctgcccgtggcact

SEQ ID NO: 418920 - DNA, 25 bp, Rattus norvegicus
ggaagtcgtgttactccatgggaaa

SEQ ID NO: 418921 - DNA, 25 bp, Rattus norvegicus
ggaagtcgtgtttctccatgggaaa

SEQ ID NO: 418922 - DNA, 25 bp, Rattus norvegicus
ggaagtctagctacgtgggcactgc

SEQ ID NO: 418923 - DNA, 25 bp, Rattus norvegicus
ggaagtctagcttcgtgggcactgc

SEQ ID NO: 418924 - DNA, 25 bp, Rattus norvegicus
ggaagtctatcgagccattttgagt

SEQ ID NO: 418925 - DNA, 25 bp, Rattus norvegicus
ggaagtctatcgtgccattttgagt

SEQ ID NO: 418926 - DNA, 25 bp, Rattus norvegicus
ggaagtctatgaccgccttgagtac

SEQ ID NO: 418927 - DNA, 25 bp, Rattus norvegicus
ggaagtctatgagcgccttgagtac

SEQ ID NO: 418928 - DNA, 25 bp, Rattus norvegicus
ggaagtctccaaagcctaaccaatt

SEQ ID NO: 418929 - DNA, 25 bp, Rattus norvegicus
ggaagtctccaatgcctaaccaatt

SEQ ID NO: 418930 - DNA, 25 bp, Rattus norvegicus
ggaagtctccctcactggtaaagtg

SEQ ID NO: 418931 - DNA, 25 bp, Rattus norvegicus
ggaagtctccctgactggtaaagtg

SEQ ID NO: 418932 - DNA, 25 bp, Rattus norvegicus
ggaagtctcctgctcagattttgat

SEQ ID NO: 418933 - DNA, 25 bp, Rattus norvegicus
ggaagtctcctggtcagattttgat

SEQ ID NO: 418934 - DNA, 25 bp, Rattus norvegicus
ggaagtctctccaatgaggtccctg

SEQ ID NO: 418935 - DNA, 25 bp, Rattus norvegicus
ggaagtctctcctatgaggtccctg

SEQ ID NO: 418936 - DNA, 25 bp, Rattus norvegicus
ggaagtctcttacctgatgtctgca

SEQ ID NO: 418937 - DNA, 25 bp, Rattus norvegicus
ggaagtctcttagctgatgtctgca

SEQ ID NO: 418938 - DNA, 25 bp, Rattus norvegicus
ggaagtctgagcatctctaagcctg

SEQ ID NO: 418939 - DNA, 25 bp, Rattus norvegicus
ggaagtctgagcttctctaagcctg

SEQ ID NO: 418940 - DNA, 25 bp, Rattus norvegicus
ggaagtctgcaactctgttcacctt

SEQ ID NO: 418941 - DNA, 25 bp, Rattus norvegicus
ggaagtctgcaagtctgttcacctt

SEQ ID NO: 418942 - DNA, 25 bp, Rattus norvegicus
ggaagtctgcccacaatgagcgata

SEQ ID NO: 418943 - DNA, 25 bp, Rattus norvegicus
ggaagtctgccctcaatgagcgata

SEQ ID NO: 418944 - DNA, 25 bp, Rattus norvegicus
ggaagtctgtagatggccggctcat

SEQ ID NO: 418945 - DNA, 25 bp, Rattus norvegicus
ggaagtctgtagttggccggctcat

SEQ ID NO: 418946 - DNA, 25 bp, Rattus norvegicus
ggaagtctgtatctgggttaatcac

SEQ ID NO: 418947 - DNA, 25 bp, Rattus norvegicus
ggaagtctgtatgtgggttaatcac

SEQ ID NO: 418948 - DNA, 25 bp, Rattus norvegicus
ggaagtctgtctaggaggccagctt

SEQ ID NO: 418949 - DNA, 25 bp, Rattus norvegicus
ggaagtctgtcttggaggccagctt

SEQ ID NO: 418950 - DNA, 25 bp, Rattus norvegicus
ggaagtctgtttagcatcaagtgga

SEQ ID NO: 418951 - DNA, 25 bp, Rattus norvegicus
ggaagtctgttttgcatcaagtgga

SEQ ID NO: 418952 - DNA, 25 bp, Rattus norvegicus
ggaagtcttacactgtcctgcagac

SEQ ID NO: 418953 - DNA, 25 bp, Rattus norvegicus
ggaagtcttacagtgtcctgcagac

SEQ ID NO: 418954 - DNA, 25 bp, Rattus norvegicus
ggaagtcttcagcatgttacgtgat

SEQ ID NO: 418955 - DNA, 25 bp, Rattus norvegicus
ggaagtcttcaggatgttacgtgat

SEQ ID NO: 418956 - DNA, 25 bp, Rattus norvegicus
ggaagtcttcataggcagcaaggaa

SEQ ID NO: 418957 - DNA, 25 bp, Rattus norvegicus
ggaagtcttcattggcagcaaggaa

SEQ ID NO: 418958 - DNA, 25 bp, Rattus norvegicus
ggaagtcttcggcaagcagatctca

SEQ ID NO: 418959 - DNA, 25 bp, Rattus norvegicus
ggaagtcttcgggaagcagatctca

SEQ ID NO: 418960 - DNA, 25 bp, Rattus norvegicus
ggaagtcttggaagatctaactcag

SEQ ID NO: 418961 - DNA, 25 bp, Rattus norvegicus
ggaagtcttggatgatctaactcag

SEQ ID NO: 418962 - DNA, 25 bp, Rattus norvegicus
ggaagtctttccaggatgactcttt

SEQ ID NO: 418963 - DNA, 25 bp, Rattus norvegicus
ggaagtctttcctggatgactcttt

SEQ ID NO: 418964 - DNA, 25 bp, Rattus norvegicus
ggaagtcttttgactcaccgaccaa

SEQ ID NO: 418965 - DNA, 25 bp, Rattus norvegicus
ggaagtcttttgtctcaccgaccaa

SEQ ID NO: 418966 - DNA, 25 bp, Rattus norvegicus
ggaagtgaacctatctagctctgtt

SEQ ID NO: 418967 - DNA, 25 bp, Rattus norvegicus
ggaagtgaacctttctagctctgtt

SEQ ID NO: 418968 - DNA, 25 bp, Rattus norvegicus
ggaagtgaagttccctttcctccag

SEQ ID NO: 418969 - DNA, 25 bp, Rattus norvegicus
ggaagtgaagttgcctttcctccag

SEQ ID NO: 418970 - DNA, 25 bp, Rattus norvegicus
ggaagtgaccacagacttgcctggc

SEQ ID NO: 418971 - DNA, 25 bp, Rattus norvegicus
ggaagtgaccactgacttgcctggc

SEQ ID NO: 418972 - DNA, 25 bp, Rattus norvegicus
ggaagtgaccatcgttggcccacac

SEQ ID NO: 418973 - DNA, 25 bp, Rattus norvegicus
ggaagtgaccatggttggcccacac

SEQ ID NO: 418974 - DNA, 25 bp, Rattus norvegicus
ggaagtgactaccattgccgttttt

SEQ ID NO: 418975 - DNA, 25 bp, Rattus norvegicus
ggaagtgactacgattgccgttttt

SEQ ID NO: 418976 - DNA, 25 bp, Rattus norvegicus
ggaagtgacttgagtcacctcgccc

SEQ ID NO: 418977 - DNA, 25 bp, Rattus norvegicus
ggaagtgacttgtgtcacctcgccc

SEQ ID NO: 418978 - DNA, 25 bp, Rattus norvegicus
ggaagtgagagcactgaccctggaa

SEQ ID NO: 418979 - DNA, 25 bp, Rattus norvegicus
ggaagtgagagcagtcctcttagta

SEQ ID NO: 418980 - DNA, 25 bp, Rattus norvegicus
ggaagtgagagctctgaccctggaa

SEQ ID NO: 418981 - DNA, 25 bp, Rattus norvegicus
ggaagtgagagctgtcctcttagta

SEQ ID NO: 418982 - DNA, 25 bp, Rattus norvegicus
ggaagtgagccaagtcacccttgct

SEQ ID NO: 418983 - DNA, 25 bp, Rattus norvegicus
ggaagtgagccatgtcacccttgct

SEQ ID NO: 418984 - DNA, 25 bp, Rattus norvegicus
ggaagtgatcgcaatctaccggaca

SEQ ID NO: 418985 - DNA, 25 bp, Rattus norvegicus
ggaagtgatcgctatctaccggaca

SEQ ID NO: 418986 - DNA, 25 bp, Rattus norvegicus
ggaagtgatcgtacaacctacctct

SEQ ID NO: 418987 - DNA, 25 bp, Rattus norvegicus
ggaagtgatcgttcaacctacctct

SEQ ID NO: 418988 - DNA, 25 bp, Rattus norvegicus
ggaagtgcagctagctcatctggca

SEQ ID NO: 418989 - DNA, 25 bp, Rattus norvegicus
ggaagtgcagcttgctcatctggca

SEQ ID NO: 418990 - DNA, 25 bp, Rattus norvegicus
ggaagtgcagtcatcagctcagaag

SEQ ID NO: 418991 - DNA, 25 bp, Rattus norvegicus
ggaagtgcagtcttcagctcagaag

SEQ ID NO: 418992 - DNA, 25 bp, Rattus norvegicus
ggaagtgcccataactgtcatgaat

SEQ ID NO: 418993 - DNA, 25 bp, Rattus norvegicus
ggaagtgcccattactgtcatgaat

SEQ ID NO: 418994 - DNA, 25 bp, Rattus norvegicus
ggaagtgcctggcaatccaggtaac

SEQ ID NO: 418995 - DNA, 25 bp, Rattus norvegicus
ggaagtgcctgggaatccaggtaac

SEQ ID NO: 418996 - DNA, 25 bp, Rattus norvegicus
ggaagtgcgtttacaacttgaacta

SEQ ID NO: 418997 - DNA, 25 bp, Rattus norvegicus
ggaagtgcgttttcaacttgaacta

SEQ ID NO: 418998 - DNA, 25 bp, Rattus norvegicus
ggaagtgctacacccctcttttaga

SEQ ID NO: 418999 - DNA, 25 bp, Rattus norvegicus
ggaagtgctacagccctcttttaga

SEQ ID NO: 419000 - DNA, 25 bp, Rattus norvegicus
ggaagtgctatgatgcccttcgcaa

SEQ ID NO: 419001 - DNA, 25 bp, Rattus norvegicus
ggaagtgctatgttgcccttcgcaa

SEQ ID NO: 419002 - DNA, 25 bp, Rattus norvegicus
ggaagtgctcacagacacatcctac

SEQ ID NO: 419003 - DNA, 25 bp, Rattus norvegicus
ggaagtgctcactgacacatcctac

SEQ ID NO: 419004 - DNA, 25 bp, Rattus norvegicus
ggaagtgctctccaaacttctgccc

SEQ ID NO: 419005 - DNA, 25 bp, Rattus norvegicus
ggaagtgctctcgaaacttctgccc

SEQ ID NO: 419006 - DNA, 25 bp, Rattus norvegicus
ggaagtgctgcccagtacgcctcag

SEQ ID NO: 419007 - DNA, 25 bp, Rattus norvegicus
ggaagtgctgccgagtacgcctcag

SEQ ID NO: 419008 - DNA, 25 bp, Rattus norvegicus
ggaagtgctgctcatgtgcaacaaa

SEQ ID NO: 419009 - DNA, 25 bp, Rattus norvegicus
ggaagtgctgctgatgtgcaacaaa

SEQ ID NO: 419010 - DNA, 25 bp, Rattus norvegicus
ggaagtgcttatctccttagtgata

SEQ ID NO: 419011 - DNA, 25 bp, Rattus norvegicus
ggaagtgcttatgtccttagtgata

SEQ ID NO: 419012 - DNA, 25 bp, Rattus norvegicus
ggaagtgcttcaagctgagtctgat

SEQ ID NO: 419013 - DNA, 25 bp, Rattus norvegicus
ggaagtgcttcatgctgagtctgat

SEQ ID NO: 419014 - DNA, 25 bp, Rattus norvegicus
ggaagtggacaccaacttgtctcaa

SEQ ID NO: 419015 - DNA, 25 bp, Rattus norvegicus
ggaagtggacacgaacttgtctcaa

SEQ ID NO: 419016 - DNA, 25 bp, Rattus norvegicus
ggaagtggaccacgcaccacagcta

SEQ ID NO: 419017 - DNA, 25 bp, Rattus norvegicus
ggaagtggaccaggcaccacagcta

SEQ ID NO: 419018 - DNA, 25 bp, Rattus norvegicus
ggaagtggacctcgccaacctggca

SEQ ID NO: 419019 - DNA, 25 bp, Rattus norvegicus
ggaagtggacctggccaacctggca

SEQ ID NO: 419020 - DNA, 25 bp, Rattus norvegicus
ggaagtggacttccgcgagttcatc

SEQ ID NO: 419021 - DNA, 25 bp, Rattus norvegicus
ggaagtggacttgcgcgagttcatc

SEQ ID NO: 419022 - DNA, 25 bp, Rattus norvegicus
ggaagtggagctcttctctgctgca

SEQ ID NO: 419023 - DNA, 25 bp, Rattus norvegicus
ggaagtggagctgttctctgctgca

SEQ ID NO: 419024 - DNA, 25 bp, Rattus norvegicus
ggaagtggcacaagccagcagcaat

SEQ ID NO: 419025 - DNA, 25 bp, Rattus norvegicus
ggaagtggcacacatacgaacagaa

SEQ ID NO: 419026 - DNA, 25 bp, Rattus norvegicus
ggaagtggcacagatacgaacagaa

SEQ ID NO: 419027 - DNA, 25 bp, Rattus norvegicus
ggaagtggcacatgccagcagcaat

SEQ ID NO: 419028 - DNA, 25 bp, Rattus norvegicus
ggaagtggccctctgatggaccaca

SEQ ID NO: 419029 - DNA, 25 bp, Rattus norvegicus
ggaagtggccctgtgatggaccaca

SEQ ID NO: 419030 - DNA, 25 bp, Rattus norvegicus
ggaagtggccttaagtagtgtacaa

SEQ ID NO: 419031 - DNA, 25 bp, Rattus norvegicus
ggaagtggcctttagtagtgtacaa

SEQ ID NO: 419032 - DNA, 25 bp, Rattus norvegicus
ggaagtgggcacatcatggcttatc

SEQ ID NO: 419033 - DNA, 25 bp, Rattus norvegicus
ggaagtgggcacttcatggcttatc

SEQ ID NO: 419034 - DNA, 25 bp, Rattus norvegicus
ggaagtgggtctctgttctctctaa

SEQ ID NO: 419035 - DNA, 25 bp, Rattus norvegicus
ggaagtgggtctgtgttctctctaa

SEQ ID NO: 419036 - DNA, 25 bp, Rattus norvegicus
ggaagtgggtttccatttctaaaat

SEQ ID NO: 419037 - DNA, 25 bp, Rattus norvegicus
ggaagtgggtttgcatttctaaaat

SEQ ID NO: 419038 - DNA, 25 bp, Rattus norvegicus
ggaagtggtcacaattagcaatgtt

SEQ ID NO: 419039 - DNA, 25 bp, Rattus norvegicus
ggaagtggtcactattagcaatgtt

SEQ ID NO: 419040 - DNA, 25 bp, Rattus norvegicus
ggaagtggtcctcggcaagcttaac

SEQ ID NO: 419041 - DNA, 25 bp, Rattus norvegicus
ggaagtggtcctgggcaagcttaac

SEQ ID NO: 419042 - DNA, 25 bp, Rattus norvegicus
ggaagtggtctaactgagcagagtc

SEQ ID NO: 419043 - DNA, 25 bp, Rattus norvegicus
ggaagtggtctatctgagcagagtc

SEQ ID NO: 419044 - DNA, 25 bp, Rattus norvegicus
ggaagtggtgagagctgtccatcct

SEQ ID NO: 419045 - DNA, 25 bp, Rattus norvegicus
ggaagtggtgagtgctgtccatcct

SEQ ID NO: 419046 - DNA, 25 bp, Rattus norvegicus
ggaagtggttctccccatttaaata

SEQ ID NO: 419047 - DNA, 25 bp, Rattus norvegicus
ggaagtggttctgcccatttaaata

SEQ ID NO: 419048 - DNA, 25 bp, Rattus norvegicus
ggaagtgtactgctttatggtaaac

SEQ ID NO: 419049 - DNA, 25 bp, Rattus norvegicus
ggaagtgtactggtttatggtaaac

SEQ ID NO: 419050 - DNA, 25 bp, Rattus norvegicus
ggaagtgtattaatttatgtatctg

SEQ ID NO: 419051 - DNA, 25 bp, Rattus norvegicus
ggaagtgtattattttatgtatctg

SEQ ID NO: 419052 - DNA, 25 bp, Rattus norvegicus
ggaagtgtcctaaactagccttatc

SEQ ID NO: 419053 - DNA, 25 bp, Rattus norvegicus
ggaagtgtcctatactagccttatc

SEQ ID NO: 419054 - DNA, 25 bp, Rattus norvegicus
ggaagtgtcctcagcactggctgag

SEQ ID NO: 419055 - DNA, 25 bp, Rattus norvegicus
ggaagtgtcctctgcactggctgag

SEQ ID NO: 419056 - DNA, 25 bp, Rattus norvegicus
ggaagtgtcctgataaaacatggtt

SEQ ID NO: 419057 - DNA, 25 bp, Rattus norvegicus
ggaagtgtcctgttaaaacatggtt

SEQ ID NO: 419058 - DNA, 25 bp, Rattus norvegicus
ggaagtgtccttaaattagcatctc

SEQ ID NO: 419059 - DNA, 25 bp, Rattus norvegicus
ggaagtgtcctttaattagcatctc

SEQ ID NO: 419060 - DNA, 25 bp, Rattus norvegicus
ggaagtgtctgacccacttatctat

SEQ ID NO: 419061 - DNA, 25 bp, Rattus norvegicus
ggaagtgtctgagccacttatctat

SEQ ID NO: 419062 - DNA, 25 bp, Rattus norvegicus
ggaagtgtgattcccaccaggcttt

SEQ ID NO: 419063 - DNA, 25 bp, Rattus norvegicus
ggaagtgtgattgccaccaggcttt

SEQ ID NO: 419064 - DNA, 25 bp, Rattus norvegicus
ggaagtgtgggtacatatcaacagt

SEQ ID NO: 419065 - DNA, 25 bp, Rattus norvegicus
ggaagtgtgggttcatatcaacagt

SEQ ID NO: 419066 - DNA, 25 bp, Rattus norvegicus
ggaagtgtgtccattcctactgcgt

SEQ ID NO: 419067 - DNA, 25 bp, Rattus norvegicus
ggaagtgtgtcctttcctactgcgt

SEQ ID NO: 419068 - DNA, 25 bp, Rattus norvegicus
ggaagtgttcctctctcaatagctc

SEQ ID NO: 419069 - DNA, 25 bp, Rattus norvegicus
ggaagtgttcctgtctcaatagctc

SEQ ID NO: 419070 - DNA, 25 bp, Rattus norvegicus
ggaagttaacacacagtcacttatc

SEQ ID NO: 419071 - DNA, 25 bp, Rattus norvegicus
ggaagttaacactcagtcacttatc

SEQ ID NO: 419072 - DNA, 25 bp, Rattus norvegicus
ggaagttaccttctagctctttgaa

SEQ ID NO: 419073 - DNA, 25 bp, Rattus norvegicus
ggaagttaccttgtagctctttgaa

SEQ ID NO: 419074 - DNA, 25 bp, Rattus norvegicus
ggaagttagtcgactttgaagccat

SEQ ID NO: 419075 - DNA, 25 bp, Rattus norvegicus
ggaagttagtcgtctttgaagccat

SEQ ID NO: 419076 - DNA, 25 bp, Rattus norvegicus
ggaagttatctcatctctggatctt

SEQ ID NO: 419077 - DNA, 25 bp, Rattus norvegicus
ggaagttatctcttctctggatctt

SEQ ID NO: 419078 - DNA, 25 bp, Rattus norvegicus
ggaagttcaacgcttcccctcgaga

SEQ ID NO: 419079 - DNA, 25 bp, Rattus norvegicus
ggaagttcaacggttcccctcgaga

SEQ ID NO: 419080 - DNA, 25 bp, Rattus norvegicus
ggaagttcaatcatccagtggtact

SEQ ID NO: 419081 - DNA, 25 bp, Rattus norvegicus
ggaagttcaatcttccagtggtact

SEQ ID NO: 419082 - DNA, 25 bp, Rattus norvegicus
ggaagttcacacctaagtactgtaa

SEQ ID NO: 419083 - DNA, 25 bp, Rattus norvegicus
ggaagttcacacgtaagtactgtaa

SEQ ID NO: 419084 - DNA, 25 bp, Rattus norvegicus
ggaagttcacccatcaaactctgag

SEQ ID NO: 419085 - DNA, 25 bp, Rattus norvegicus
ggaagttcacccttcaaactctgag

SEQ ID NO: 419086 - DNA, 25 bp, Rattus norvegicus
ggaagttcacctccaaagtgcccgg

SEQ ID NO: 419087 - DNA, 25 bp, Rattus norvegicus
ggaagttcacctgcaaagtgcccgg

SEQ ID NO: 419088 - DNA, 25 bp, Rattus norvegicus
ggaagttcagaacaagaagcttata

SEQ ID NO: 419089 - DNA, 25 bp, Rattus norvegicus
ggaagttcagaagaagaagcttata

SEQ ID NO: 419090 - DNA, 25 bp, Rattus norvegicus
ggaagttcataaactcagagtcatc

SEQ ID NO: 419091 - DNA, 25 bp, Rattus norvegicus
ggaagttcataatctcagagtcatc

SEQ ID NO: 419092 - DNA, 25 bp, Rattus norvegicus
ggaagttcatcccatttcactggag

SEQ ID NO: 419093 - DNA, 25 bp, Rattus norvegicus
ggaagttcatccgatttcactggag

SEQ ID NO: 419094 - DNA, 25 bp, Rattus norvegicus
ggaagttccagcaacagaagaaatc

SEQ ID NO: 419095 - DNA, 25 bp, Rattus norvegicus
ggaagttccagcactatgtcttcac

SEQ ID NO: 419096 - DNA, 25 bp, Rattus norvegicus
ggaagttccagctacagaagaaatc

SEQ ID NO: 419097 - DNA, 25 bp, Rattus norvegicus
ggaagttccagctctatgtcttcac

SEQ ID NO: 419098 - DNA, 25 bp, Rattus norvegicus
ggaagttcccaactataagcttatt

SEQ ID NO: 419099 - DNA, 25 bp, Rattus norvegicus
ggaagttcccaagtataagcttatt

SEQ ID NO: 419100 - DNA, 25 bp, Rattus norvegicus
ggaagttcgcagagaaagcacatca

SEQ ID NO: 419101 - DNA, 25 bp, Rattus norvegicus
ggaagttcgcagtgaaagcacatca

SEQ ID NO: 419102 - DNA, 25 bp, Rattus norvegicus
ggaagttcgtttcttgaatagcaca

SEQ ID NO: 419103 - DNA, 25 bp, Rattus norvegicus
ggaagttcgtttgttgaatagcaca

SEQ ID NO: 419104 - DNA, 25 bp, Rattus norvegicus
ggaagttctatcaacatggctgagg

SEQ ID NO: 419105 - DNA, 25 bp, Rattus norvegicus
ggaagttctatctacatggctgagg

SEQ ID NO: 419106 - DNA, 25 bp, Rattus norvegicus
ggaagttctccacccgcagtgatgt

SEQ ID NO: 419107 - DNA, 25 bp, Rattus norvegicus
ggaagttctccagccgcagtgatgt

SEQ ID NO: 419108 - DNA, 25 bp, Rattus norvegicus
ggaagttctctaattctagacctag

SEQ ID NO: 419109 - DNA, 25 bp, Rattus norvegicus
ggaagttctctatttctagacctag

SEQ ID NO: 419110 - DNA, 25 bp, Rattus norvegicus
ggaagttcttcactggcttcaccac

SEQ ID NO: 419111 - DNA, 25 bp, Rattus norvegicus
ggaagttcttcagtggcttcaccac

SEQ ID NO: 419112 - DNA, 25 bp, Rattus norvegicus
ggaagttcttcccaagacagacctc

SEQ ID NO: 419113 - DNA, 25 bp, Rattus norvegicus
ggaagttcttccgaagacagacctc

SEQ ID NO: 419114 - DNA, 25 bp, Rattus norvegicus
ggaagttcttgacaacctccttgat

SEQ ID NO: 419115 - DNA, 25 bp, Rattus norvegicus
ggaagttcttgagaacctccttgat

SEQ ID NO: 419116 - DNA, 25 bp, Rattus norvegicus
ggaagttgcaagacaccacagtcaa

SEQ ID NO: 419117 - DNA, 25 bp, Rattus norvegicus
ggaagttgcaagtcaccacagtcaa

SEQ ID NO: 419118 - DNA, 25 bp, Rattus norvegicus
ggaagttgcactactgctttgagtc

SEQ ID NO: 419119 - DNA, 25 bp, Rattus norvegicus
ggaagttgcacttctgctttgagtc

SEQ ID NO: 419120 - DNA, 25 bp, Rattus norvegicus
ggaagttgcaggacaagcccattac

SEQ ID NO: 419121 - DNA, 25 bp, Rattus norvegicus
ggaagttgcaggtcaagcccattac

SEQ ID NO: 419122 - DNA, 25 bp, Rattus norvegicus
ggaagttgccatacttctatgtagt

SEQ ID NO: 419123 - DNA, 25 bp, Rattus norvegicus
ggaagttgccattcttctatgtagt

SEQ ID NO: 419124 - DNA, 25 bp, Rattus norvegicus
ggaagttgcctgatagttctttatc

SEQ ID NO: 419125 - DNA, 25 bp, Rattus norvegicus
ggaagttgcctgttagttctttatc

SEQ ID NO: 419126 - DNA, 25 bp, Rattus norvegicus
ggaagttgctctctggacctaaaca

SEQ ID NO: 419127 - DNA, 25 bp, Rattus norvegicus
ggaagttgctctgtggacctaaaca

SEQ ID NO: 419128 - DNA, 25 bp, Rattus norvegicus
ggaagttggcgcattgttctctgtc

SEQ ID NO: 419129 - DNA, 25 bp, Rattus norvegicus
ggaagttggcgctttgttctctgtc

SEQ ID NO: 419130 - DNA, 25 bp, Rattus norvegicus
ggaagttggctgacagaacgttttt

SEQ ID NO: 419131 - DNA, 25 bp, Rattus norvegicus
ggaagttggctgtcagaacgttttt

SEQ ID NO: 419132 - DNA, 25 bp, Rattus norvegicus
ggaagttgtcacaagctggaacctg

SEQ ID NO: 419133 - DNA, 25 bp, Rattus norvegicus
ggaagttgtcacagatatactttat

SEQ ID NO: 419134 - DNA, 25 bp, Rattus norvegicus
ggaagttgtcactagctggaacctg

SEQ ID NO: 419135 - DNA, 25 bp, Rattus norvegicus
ggaagttgtcactgatatactttat

SEQ ID NO: 419136 - DNA, 25 bp, Rattus norvegicus
ggaagtttacatccggattttcaca

SEQ ID NO: 419137 - DNA, 25 bp, Rattus norvegicus
ggaagtttacatgcggattttcaca

SEQ ID NO: 419138 - DNA, 25 bp, Rattus norvegicus
ggaagtttaccacaggctgctctat

SEQ ID NO: 419139 - DNA, 25 bp, Rattus norvegicus
ggaagtttaccagaggctgctctat

SEQ ID NO: 419140 - DNA, 25 bp, Rattus norvegicus
ggaagtttacttctctgtgtttctg

SEQ ID NO: 419141 - DNA, 25 bp, Rattus norvegicus
ggaagtttacttgtctgtgtttctg

SEQ ID NO: 419142 - DNA, 25 bp, Rattus norvegicus
ggaagtttatccaagtacatgtcac

SEQ ID NO: 419143 - DNA, 25 bp, Rattus norvegicus
ggaagtttatcctagtacatgtcac

SEQ ID NO: 419144 - DNA, 25 bp, Rattus norvegicus
ggaagtttcacccatgagtatctga

SEQ ID NO: 419145 - DNA, 25 bp, Rattus norvegicus
ggaagtttcaccgatgagtatctga

SEQ ID NO: 419146 - DNA, 25 bp, Rattus norvegicus
ggaagtttcaggcaggtccagaaaa

SEQ ID NO: 419147 - DNA, 25 bp, Rattus norvegicus
ggaagtttcagggaggtccagaaaa

SEQ ID NO: 419148 - DNA, 25 bp, Rattus norvegicus
ggaagtttccacacacaagaactca

SEQ ID NO: 419149 - DNA, 25 bp, Rattus norvegicus
ggaagtttccactcacaagaactca

SEQ ID NO: 419150 - DNA, 25 bp, Rattus norvegicus
ggaagtttccatatgcagatctgtt

SEQ ID NO: 419151 - DNA, 25 bp, Rattus norvegicus
ggaagtttccatttgcagatctgtt

SEQ ID NO: 419152 - DNA, 25 bp, Rattus norvegicus
ggaagtttcccaacagcgaatgaac

SEQ ID NO: 419153 - DNA, 25 bp, Rattus norvegicus
ggaagtttcccatcagcgaatgaac

SEQ ID NO: 419154 - DNA, 25 bp, Rattus norvegicus
ggaagtttctctaaagcctttcata

SEQ ID NO: 419155 - DNA, 25 bp, Rattus norvegicus
ggaagtttctcttaagcctttcata

SEQ ID NO: 419156 - DNA, 25 bp, Rattus norvegicus
ggaagtttctggaccacaatgtcaa

SEQ ID NO: 419157 - DNA, 25 bp, Rattus norvegicus
ggaagtttctggtccacaatgtcaa

SEQ ID NO: 419158 - DNA, 25 bp, Rattus norvegicus
ggaagtttctttatagccatttggt

SEQ ID NO: 419159 - DNA, 25 bp, Rattus norvegicus
ggaagtttctttttagccatttggt

SEQ ID NO: 419160 - DNA, 25 bp, Rattus norvegicus
ggaagtttgattccttctacctgcg

SEQ ID NO: 419161 - DNA, 25 bp, Rattus norvegicus
ggaagtttgattgcttctacctgcg

SEQ ID NO: 419162 - DNA, 25 bp, Rattus norvegicus
ggaagtttgtccatgtaaatagctt

SEQ ID NO: 419163 - DNA, 25 bp, Rattus norvegicus
ggaagtttgtccttgtaaatagctt

SEQ ID NO: 419164 - DNA, 25 bp, Rattus norvegicus
ggaagtttgttgaaggcctccccat

SEQ ID NO: 419165 - DNA, 25 bp, Rattus norvegicus
ggaagtttgttgtaggcctccccat

SEQ ID NO: 419166 - DNA, 25 bp, Rattus norvegicus
ggaagttttgcccttggatgctaat

SEQ ID NO: 419167 - DNA, 25 bp, Rattus norvegicus
ggaagttttgccgttggatgctaat

SEQ ID NO: 419168 - DNA, 25 bp, Rattus norvegicus
ggaagttttttgatcatgcagcaca

SEQ ID NO: 419169 - DNA, 25 bp, Rattus norvegicus
ggaagttttttgttcatgcagcaca

SEQ ID NO: 419170 - DNA, 25 bp, Rattus norvegicus
ggaataaactgactcactagcattt

SEQ ID NO: 419171 - DNA, 25 bp, Rattus norvegicus
ggaataaactgagtcactagcattt

SEQ ID NO: 419172 - DNA, 25 bp, Rattus norvegicus
ggaataaagcttaaatcgagtatct

SEQ ID NO: 419173 - DNA, 25 bp, Rattus norvegicus
ggaataaagctttaatcgagtatct

SEQ ID NO: 419174 - DNA, 25 bp, Rattus norvegicus
ggaataaagtgtcccgctgtgatta

SEQ ID NO: 419175 - DNA, 25 bp, Rattus norvegicus
ggaataaagtgtgccgctgtgatta

SEQ ID NO: 419176 - DNA, 25 bp, Rattus norvegicus
ggaataaatcccaacttctggcctc

SEQ ID NO: 419177 - DNA, 25 bp, Rattus norvegicus
ggaataaatccctacttctggcctc

SEQ ID NO: 419178 - DNA, 25 bp, Rattus norvegicus
ggaataacaagtagtccctagcaaa

SEQ ID NO: 419179 - DNA, 25 bp, Rattus norvegicus
ggaataacaagttgtccctagcaaa

SEQ ID NO: 419180 - DNA, 25 bp, Rattus norvegicus
ggaataacagctcttacccagtgag

SEQ ID NO: 419181 - DNA, 25 bp, Rattus norvegicus
ggaataacagctgttacccagtgag

SEQ ID NO: 419182 - DNA, 25 bp, Rattus norvegicus
ggaataaccagcagctcctgtaata

SEQ ID NO: 419183 - DNA, 25 bp, Rattus norvegicus
ggaataaccagctgctcctgtaata

SEQ ID NO: 419184 - DNA, 25 bp, Rattus norvegicus
ggaataaccgtgaatacctgtattt

SEQ ID NO: 419185 - DNA, 25 bp, Rattus norvegicus
ggaataaccgtgtatacctgtattt

SEQ ID NO: 419186 - DNA, 25 bp, Rattus norvegicus
ggaataactcaacaacacaatgatt

SEQ ID NO: 419187 - DNA, 25 bp, Rattus norvegicus
ggaataactcaagaacacaatgatt

SEQ ID NO: 419188 - DNA, 25 bp, Rattus norvegicus
ggaataacttggaggctttgtagca

SEQ ID NO: 419189 - DNA, 25 bp, Rattus norvegicus
ggaataacttggtggctttgtagca

SEQ ID NO: 419190 - DNA, 25 bp, Rattus norvegicus
ggaataagggttagtgcgcagatct

SEQ ID NO: 419191 - DNA, 25 bp, Rattus norvegicus
ggaataagggtttgtgcgcagatct

SEQ ID NO: 419192 - DNA, 25 bp, Rattus norvegicus
ggaataagtgttagagcgtccaact

SEQ ID NO: 419193 - DNA, 25 bp, Rattus norvegicus
ggaataagtgtttgagcgtccaact

SEQ ID NO: 419194 - DNA, 25 bp, Rattus norvegicus
ggaataagttaaatcgacgccggtg

SEQ ID NO: 419195 - DNA, 25 bp, Rattus norvegicus
ggaataagttaattcgacgccggtg

SEQ ID NO: 419196 - DNA, 25 bp, Rattus norvegicus
ggaataatcacaatgcatagcctat

SEQ ID NO: 419197 - DNA, 25 bp, Rattus norvegicus
ggaataatcacattgcatagcctat

SEQ ID NO: 419198 - DNA, 25 bp, Rattus norvegicus
ggaataatggtacccctgccaacag

SEQ ID NO: 419199 - DNA, 25 bp, Rattus norvegicus
ggaataatggtagccctgccaacag

SEQ ID NO: 419200 - DNA, 25 bp, Rattus norvegicus
ggaataattgctacctttagagcaa

SEQ ID NO: 419201 - DNA, 25 bp, Rattus norvegicus
ggaataattgcttcctttagagcaa

SEQ ID NO: 419202 - DNA, 25 bp, Rattus norvegicus
ggaatacaacctagctatccttcaa

SEQ ID NO: 419203 - DNA, 25 bp, Rattus norvegicus
ggaatacaaccttgctatccttcaa

SEQ ID NO: 419204 - DNA, 25 bp, Rattus norvegicus
ggaatacaatgcacctgaggaccca

SEQ ID NO: 419205 - DNA, 25 bp, Rattus norvegicus
ggaatacaatgctcctgaggaccca

SEQ ID NO: 419206 - DNA, 25 bp, Rattus norvegicus
ggaatacaatgtcgctgcacccttc

SEQ ID NO: 419207 - DNA, 25 bp, Rattus norvegicus
ggaatacaatgtggctgcacccttc

SEQ ID NO: 419208 - DNA, 25 bp, Rattus norvegicus
ggaatacacattacagaagcagcag

SEQ ID NO: 419209 - DNA, 25 bp, Rattus norvegicus
ggaatacacatttcagaagcagcag

SEQ ID NO: 419210 - DNA, 25 bp, Rattus norvegicus
ggaatacaccctacttgtgaaattg

SEQ ID NO: 419211 - DNA, 25 bp, Rattus norvegicus
ggaatacacccttcttgtgaaattg

SEQ ID NO: 419212 - DNA, 25 bp, Rattus norvegicus
ggaatacagctcagagagccctcca

SEQ ID NO: 419213 - DNA, 25 bp, Rattus norvegicus
ggaatacagctctgagagccctcca

SEQ ID NO: 419214 - DNA, 25 bp, Rattus norvegicus
ggaatacagtttctcttgtcttctt

SEQ ID NO: 419215 - DNA, 25 bp, Rattus norvegicus
ggaatacagtttgtcttgtcttctt

SEQ ID NO: 419216 - DNA, 25 bp, Rattus norvegicus
ggaatacatccaatgagagccagtg

SEQ ID NO: 419217 - DNA, 25 bp, Rattus norvegicus
ggaatacatccattgagagccagtg

SEQ ID NO: 419218 - DNA, 25 bp, Rattus norvegicus
ggaatacatgaaccggctggacaca

SEQ ID NO: 419219 - DNA, 25 bp, Rattus norvegicus
ggaatacatgaagcggctggacaca

SEQ ID NO: 419220 - DNA, 25 bp, Rattus norvegicus
ggaatacattgcctacttcagacaa

SEQ ID NO: 419221 - DNA, 25 bp, Rattus norvegicus
ggaatacattgcgtacttcagacaa

SEQ ID NO: 419222 - DNA, 25 bp, Rattus norvegicus
ggaatacatttaaagccgggcccgt

SEQ ID NO: 419223 - DNA, 25 bp, Rattus norvegicus
ggaatacatttatagccgggcccgt

SEQ ID NO: 419224 - DNA, 25 bp, Rattus norvegicus
ggaataccaacactccctggtctgt

SEQ ID NO: 419225 - DNA, 25 bp, Rattus norvegicus
ggaataccaacagtccctggtctgt

SEQ ID NO: 419226 - DNA, 25 bp, Rattus norvegicus
ggaatacccagacgcctttatgtgc

SEQ ID NO: 419227 - DNA, 25 bp, Rattus norvegicus
ggaatacccagaggcctttatgtgc

SEQ ID NO: 419228 - DNA, 25 bp, Rattus norvegicus
ggaatacccgatagcaaaagcctac

SEQ ID NO: 419229 - DNA, 25 bp, Rattus norvegicus
ggaatacccgattgcaaaagcctac

SEQ ID NO: 419230 - DNA, 25 bp, Rattus norvegicus
ggaataccctgacccttagtgatga

SEQ ID NO: 419231 - DNA, 25 bp, Rattus norvegicus
ggaataccctgagccttagtgatga

SEQ ID NO: 419232 - DNA, 25 bp, Rattus norvegicus
ggaataccgtgtcttggtcatcgtc

SEQ ID NO: 419233 - DNA, 25 bp, Rattus norvegicus
ggaataccgtgtgttggtcatcgtc

SEQ ID NO: 419234 - DNA, 25 bp, Rattus norvegicus
ggaatacctcaaaacctcagacaag

SEQ ID NO: 419235 - DNA, 25 bp, Rattus norvegicus
ggaatacctcaatacctcagacaag

SEQ ID NO: 419236 - DNA, 25 bp, Rattus norvegicus
ggaatacctgtgatagtccctaagt

SEQ ID NO: 419237 - DNA, 25 bp, Rattus norvegicus
ggaatacctgtgttagtccctaagt

SEQ ID NO: 419238 - DNA, 25 bp, Rattus norvegicus
ggaatacctttacctatatggccca

SEQ ID NO: 419239 - DNA, 25 bp, Rattus norvegicus
ggaatacctttagctatatggccca

SEQ ID NO: 419240 - DNA, 25 bp, Rattus norvegicus
ggaatacgatgtagtggtcagcacc

SEQ ID NO: 419241 - DNA, 25 bp, Rattus norvegicus
ggaatacgatgttgtggtcagcacc

SEQ ID NO: 419242 - DNA, 25 bp, Rattus norvegicus
ggaatacgcctcaatccattttgac

SEQ ID NO: 419243 - DNA, 25 bp, Rattus norvegicus
ggaatacgcctctatccattttgac

SEQ ID NO: 419244 - DNA, 25 bp, Rattus norvegicus
ggaatacgtcacatgtcacacatgc

SEQ ID NO: 419245 - DNA, 25 bp, Rattus norvegicus
ggaatacgtcacttgtcacacatgc

SEQ ID NO: 419246 - DNA, 25 bp, Rattus norvegicus
ggaatacgtccaaactttcatgaac

SEQ ID NO: 419247 - DNA, 25 bp, Rattus norvegicus
ggaatacgtccatactttcatgaac

SEQ ID NO: 419248 - DNA, 25 bp, Rattus norvegicus
ggaatactaacaaagcccgtcgata

SEQ ID NO: 419249 - DNA, 25 bp, Rattus norvegicus
ggaatactaacatagcccgtcgata

SEQ ID NO: 419250 - DNA, 25 bp, Rattus norvegicus
ggaatactagggacacatctcttca

SEQ ID NO: 419251 - DNA, 25 bp, Rattus norvegicus
ggaatactagggtcacatctcttca

SEQ ID NO: 419252 - DNA, 25 bp, Rattus norvegicus
ggaatactgctcacaacggtaccaa

SEQ ID NO: 419253 - DNA, 25 bp, Rattus norvegicus
ggaatactgctctcaacggtaccaa

SEQ ID NO: 419254 - DNA, 25 bp, Rattus norvegicus
ggaatactggtaattttgaccctgc

SEQ ID NO: 419255 - DNA, 25 bp, Rattus norvegicus
ggaatactggtatttttgaccctgc

SEQ ID NO: 419256 - DNA, 25 bp, Rattus norvegicus
ggaatacttatacctgactacctag

SEQ ID NO: 419257 - DNA, 25 bp, Rattus norvegicus
ggaatacttatagctgactacctag

SEQ ID NO: 419258 - DNA, 25 bp, Rattus norvegicus
ggaatacttcacattactcagaggt

SEQ ID NO: 419259 - DNA, 25 bp, Rattus norvegicus
ggaatacttcactttactcagaggt

SEQ ID NO: 419260 - DNA, 25 bp, Rattus norvegicus
ggaatacttcttctaattgacactg

SEQ ID NO: 419261 - DNA, 25 bp, Rattus norvegicus
ggaatacttcttgtaattgacactg

SEQ ID NO: 419262 - DNA, 25 bp, Rattus norvegicus
ggaatactttcaccatagatatctt

SEQ ID NO: 419263 - DNA, 25 bp, Rattus norvegicus
ggaatactttcagcatagatatctt

SEQ ID NO: 419264 - DNA, 25 bp, Rattus norvegicus
ggaatacttttaagcaatgcagatg

SEQ ID NO: 419265 - DNA, 25 bp, Rattus norvegicus
ggaatacttttatgcaatgcagatg

SEQ ID NO: 419266 - DNA, 25 bp, Rattus norvegicus
ggaatagaaaccctgtgcttcaccc

SEQ ID NO: 419267 - DNA, 25 bp, Rattus norvegicus
ggaatagaaaccgtgtgcttcaccc

SEQ ID NO: 419268 - DNA, 25 bp, Rattus norvegicus
ggaatagaacctcttcacttgtgtt

SEQ ID NO: 419269 - DNA, 25 bp, Rattus norvegicus
ggaatagaacctgttcacttgtgtt

SEQ ID NO: 419270 - DNA, 25 bp, Rattus norvegicus
ggaatagaatttccgaccctttgag

SEQ ID NO: 419271 - DNA, 25 bp, Rattus norvegicus
ggaatagaatttgcgaccctttgag

SEQ ID NO: 419272 - DNA, 25 bp, Rattus norvegicus
ggaatagcaatacccacgcttgctt

SEQ ID NO: 419273 - DNA, 25 bp, Rattus norvegicus
ggaatagcaatagccacgcttgctt

SEQ ID NO: 419274 - DNA, 25 bp, Rattus norvegicus
ggaatagcagcgagtttccttcccg

SEQ ID NO: 419275 - DNA, 25 bp, Rattus norvegicus
ggaatagcagcgtgtttccttcccg

SEQ ID NO: 419276 - DNA, 25 bp, Rattus norvegicus
ggaatagccaatccacacctctaag

SEQ ID NO: 419277 - DNA, 25 bp, Rattus norvegicus
ggaatagccaatgcacacctctaag

SEQ ID NO: 419278 - DNA, 25 bp, Rattus norvegicus
ggaatagctaagactcatcacatcg

SEQ ID NO: 419279 - DNA, 25 bp, Rattus norvegicus
ggaatagctaagtctcatcacatcg

SEQ ID NO: 419280 - DNA, 25 bp, Rattus norvegicus
ggaatagctgctctcaaacgaacaa

SEQ ID NO: 419281 - DNA, 25 bp, Rattus norvegicus
ggaatagctgctgtcaaacgaacaa

SEQ ID NO: 419282 - DNA, 25 bp, Rattus norvegicus
ggaatagcttccaagcaaggcttgt

SEQ ID NO: 419283 - DNA, 25 bp, Rattus norvegicus
ggaatagcttcctagcaaggcttgt

SEQ ID NO: 419284 - DNA, 25 bp, Rattus norvegicus
ggaataggacctactgacaccaaag

SEQ ID NO: 419285 - DNA, 25 bp, Rattus norvegicus
ggaataggaccttctgacaccaaag

SEQ ID NO: 419286 - DNA, 25 bp, Rattus norvegicus
ggaataggcccactgtagacaccac

SEQ ID NO: 419287 - DNA, 25 bp, Rattus norvegicus
ggaataggcccagtgtagacaccac

SEQ ID NO: 419288 - DNA, 25 bp, Rattus norvegicus
ggaatagggttccagccactagcca

SEQ ID NO: 419289 - DNA, 25 bp, Rattus norvegicus
ggaatagggttcgagccactagcca

SEQ ID NO: 419290 - DNA, 25 bp, Rattus norvegicus
ggaataggtagcattggcaaacttt

SEQ ID NO: 419291 - DNA, 25 bp, Rattus norvegicus
ggaataggtagctttggcaaacttt

SEQ ID NO: 419292 - DNA, 25 bp, Rattus norvegicus
ggaataggtcgaagccaaggctcca

SEQ ID NO: 419293 - DNA, 25 bp, Rattus norvegicus
ggaataggtcgatgccaaggctcca

SEQ ID NO: 419294 - DNA, 25 bp, Rattus norvegicus
ggaatagtctttcctgcttctcttc

SEQ ID NO: 419295 - DNA, 25 bp, Rattus norvegicus
ggaatagtctttgctgcttctcttc

SEQ ID NO: 419296 - DNA, 25 bp, Rattus norvegicus
ggaatagtgcggactagccaagtag

SEQ ID NO: 419297 - DNA, 25 bp, Rattus norvegicus
ggaatagtgcggtctagccaagtag

SEQ ID NO: 419298 - DNA, 25 bp, Rattus norvegicus
ggaatagtgtatcgagctgctcttg

SEQ ID NO: 419299 - DNA, 25 bp, Rattus norvegicus
ggaatagtgtatggagctgctcttg

SEQ ID NO: 419300 - DNA, 25 bp, Rattus norvegicus
ggaatagttgggatctcttttcatc

SEQ ID NO: 419301 - DNA, 25 bp, Rattus norvegicus
ggaatagttgggttctcttttcatc

SEQ ID NO: 419302 - DNA, 25 bp, Rattus norvegicus
ggaatataagctccttaccgtgtta

SEQ ID NO: 419303 - DNA, 25 bp, Rattus norvegicus
ggaatataagctgcttaccgtgtta

SEQ ID NO: 419304 - DNA, 25 bp, Rattus norvegicus
ggaatatacccgaccatgtagatat

SEQ ID NO: 419305 - DNA, 25 bp, Rattus norvegicus
ggaatatacccgtccatgtagatat

SEQ ID NO: 419306 - DNA, 25 bp, Rattus norvegicus
ggaatatactagaccaacccaccta

SEQ ID NO: 419307 - DNA, 25 bp, Rattus norvegicus
ggaatatactagtccaacccaccta

SEQ ID NO: 419308 - DNA, 25 bp, Rattus norvegicus
ggaatatatccaaaaagtcacctag

SEQ ID NO: 419309 - DNA, 25 bp, Rattus norvegicus
ggaatatatccataaagtcacctag

SEQ ID NO: 419310 - DNA, 25 bp, Rattus norvegicus
ggaatatattccagctaccttggcc

SEQ ID NO: 419311 - DNA, 25 bp, Rattus norvegicus
ggaatatattcctgctaccttggcc

SEQ ID NO: 419312 - DNA, 25 bp, Rattus norvegicus
ggaatatcacacacattttattttg

SEQ ID NO: 419313 - DNA, 25 bp, Rattus norvegicus
ggaatatcacactcattttattttg

SEQ ID NO: 419314 - DNA, 25 bp, Rattus norvegicus
ggaatatcagctccatgtttctagg

SEQ ID NO: 419315 - DNA, 25 bp, Rattus norvegicus
ggaatatcagctgcatgtttctagg

SEQ ID NO: 419316 - DNA, 25 bp, Rattus norvegicus
ggaatatcagttcagattacttcat

SEQ ID NO: 419317 - DNA, 25 bp, Rattus norvegicus
ggaatatcagttgagattacttcat

SEQ ID NO: 419318 - DNA, 25 bp, Rattus norvegicus
ggaatatccccgagcacaagtggtg

SEQ ID NO: 419319 - DNA, 25 bp, Rattus norvegicus
ggaatatccccgtgcacaagtggtg

SEQ ID NO: 419320 - DNA, 25 bp, Rattus norvegicus
ggaatatcggtacccatttttggag

SEQ ID NO: 419321 - DNA, 25 bp, Rattus norvegicus
ggaatatcggtagccatttttggag

SEQ ID NO: 419322 - DNA, 25 bp, Rattus norvegicus
ggaatatgacaaccgctgagaccag

SEQ ID NO: 419323 - DNA, 25 bp, Rattus norvegicus
ggaatatgacaagcgctgagaccag

SEQ ID NO: 419324 - DNA, 25 bp, Rattus norvegicus
ggaatatgaggacattacgcccctg

SEQ ID NO: 419325 - DNA, 25 bp, Rattus norvegicus
ggaatatgaggagattacgcccctg

SEQ ID NO: 419326 - DNA, 25 bp, Rattus norvegicus
ggaatatgcatcaccacctttttct

SEQ ID NO: 419327 - DNA, 25 bp, Rattus norvegicus
ggaatatgcatctccacctttttct

SEQ ID NO: 419328 - DNA, 25 bp, Rattus norvegicus
ggaatatgtactccaacaggctgct

SEQ ID NO: 419329 - DNA, 25 bp, Rattus norvegicus
ggaatatgtactgcaacaggctgct

SEQ ID NO: 419330 - DNA, 25 bp, Rattus norvegicus
ggaatatgtctgacatcccaacaca

SEQ ID NO: 419331 - DNA, 25 bp, Rattus norvegicus
ggaatatgtctgtcatcccaacaca

SEQ ID NO: 419332 - DNA, 25 bp, Rattus norvegicus
ggaatatgtggcacctttcctgtca

SEQ ID NO: 419333 - DNA, 25 bp, Rattus norvegicus
ggaatatgtggctcctttcctgtca

SEQ ID NO: 419334 - DNA, 25 bp, Rattus norvegicus
ggaatatgtttaactgaccacagtt

SEQ ID NO: 419335 - DNA, 25 bp, Rattus norvegicus
ggaatatgtttatctgaccacagtt

SEQ ID NO: 419336 - DNA, 25 bp, Rattus norvegicus
ggaatattactcagccatcaaaaga

SEQ ID NO: 419337 - DNA, 25 bp, Rattus norvegicus
ggaatattactctgccatcaaaaga

SEQ ID NO: 419338 - DNA, 25 bp, Rattus norvegicus
ggaatattatttatactcacatgaa

SEQ ID NO: 419339 - DNA, 25 bp, Rattus norvegicus
ggaatattatttctagcttgctctg

SEQ ID NO: 419340 - DNA, 25 bp, Rattus norvegicus
ggaatattatttgtagcttgctctg

SEQ ID NO: 419341 - DNA, 25 bp, Rattus norvegicus
ggaatattatttttactcacatgaa

SEQ ID NO: 419342 - DNA, 25 bp, Rattus norvegicus
ggaatattcaaaacggcactgcatc

SEQ ID NO: 419343 - DNA, 25 bp, Rattus norvegicus
ggaatattcaaatcggcactgcatc

SEQ ID NO: 419344 - DNA, 25 bp, Rattus norvegicus
ggaatattcacacctaccctcagat

SEQ ID NO: 419345 - DNA, 25 bp, Rattus norvegicus
ggaatattcacagctaccctcagat

SEQ ID NO: 419346 - DNA, 25 bp, Rattus norvegicus
ggaatattcctaatgcctcacttat

SEQ ID NO: 419347 - DNA, 25 bp, Rattus norvegicus
ggaatattcctattgcctcacttat

SEQ ID NO: 419348 - DNA, 25 bp, Rattus norvegicus
ggaatattcgaaccctgcgtctgtt

SEQ ID NO: 419349 - DNA, 25 bp, Rattus norvegicus
ggaatattcgaagcctgcgtctgtt

SEQ ID NO: 419350 - DNA, 25 bp, Rattus norvegicus
ggaatattctagattctactaatga

SEQ ID NO: 419351 - DNA, 25 bp, Rattus norvegicus
ggaatattctagtttctactaatga

SEQ ID NO: 419352 - DNA, 25 bp, Rattus norvegicus
ggaatattgattatcttacctcata

SEQ ID NO: 419353 - DNA, 25 bp, Rattus norvegicus
ggaatattgattttcttacctcata

SEQ ID NO: 419354 - DNA, 25 bp, Rattus norvegicus
ggaatattggctagttcagacctaa

SEQ ID NO: 419355 - DNA, 25 bp, Rattus norvegicus
ggaatattggcttgttcagacctaa

SEQ ID NO: 419356 - DNA, 25 bp, Rattus norvegicus
ggaatattttatatgcaagcatctt

SEQ ID NO: 419357 - DNA, 25 bp, Rattus norvegicus
ggaatattttatttgcaagcatctt

SEQ ID NO: 419358 - DNA, 25 bp, Rattus norvegicus
ggaatattttccatggtccactccc

SEQ ID NO: 419359 - DNA, 25 bp, Rattus norvegicus
ggaatattttcccaggcatctcatt

SEQ ID NO: 419360 - DNA, 25 bp, Rattus norvegicus
ggaatattttccgaggcatctcatt

SEQ ID NO: 419361 - DNA, 25 bp, Rattus norvegicus
ggaatattttccttggtccactccc

SEQ ID NO: 419362 - DNA, 25 bp, Rattus norvegicus
ggaatattttctaaacctcagtgct

SEQ ID NO: 419363 - DNA, 25 bp, Rattus norvegicus
ggaatattttcttaacctcagtgct

SEQ ID NO: 419364 - DNA, 25 bp, Rattus norvegicus
ggaatcaaacatcgagagcaccatg

SEQ ID NO: 419365 - DNA, 25 bp, Rattus norvegicus
ggaatcaaacatggagagcaccatg

SEQ ID NO: 419366 - DNA, 25 bp, Rattus norvegicus
ggaatcaaacccagatcctccagat

SEQ ID NO: 419367 - DNA, 25 bp, Rattus norvegicus
ggaatcaaaccctgatcctccagat

SEQ ID NO: 419368 - DNA, 25 bp, Rattus norvegicus
ggaatcaaatatcggtcctctttaa

SEQ ID NO: 419369 - DNA, 25 bp, Rattus norvegicus
ggaatcaaatatgggtcctctttaa

SEQ ID NO: 419370 - DNA, 25 bp, Rattus norvegicus
ggaatcaacttcatggtctaccagc

SEQ ID NO: 419371 - DNA, 25 bp, Rattus norvegicus
ggaatcaacttcttggtctaccagc

SEQ ID NO: 419372 - DNA, 25 bp, Rattus norvegicus
ggaatcaagaccacatttaaccaga

SEQ ID NO: 419373 - DNA, 25 bp, Rattus norvegicus
ggaatcaagacctcatttaaccaga

SEQ ID NO: 419374 - DNA, 25 bp, Rattus norvegicus
ggaatcacaacacgcatcttaccag

SEQ ID NO: 419375 - DNA, 25 bp, Rattus norvegicus
ggaatcacaacaggcatcttaccag

SEQ ID NO: 419376 - DNA, 25 bp, Rattus norvegicus
ggaatcacaagtcccaaccatgcgt

SEQ ID NO: 419377 - DNA, 25 bp, Rattus norvegicus
ggaatcacaagtgccaaccatgcgt

SEQ ID NO: 419378 - DNA, 25 bp, Rattus norvegicus
ggaatcacaataatgaccaactctg

SEQ ID NO: 419379 - DNA, 25 bp, Rattus norvegicus
ggaatcacaatattgaccaactctg

SEQ ID NO: 419380 - DNA, 25 bp, Rattus norvegicus
ggaatcaccaccaagcttttgacgg

SEQ ID NO: 419381 - DNA, 25 bp, Rattus norvegicus
ggaatcaccacctagcttttgacgg

SEQ ID NO: 419382 - DNA, 25 bp, Rattus norvegicus
ggaatcaccatgctggagacccgat

SEQ ID NO: 419383 - DNA, 25 bp, Rattus norvegicus
ggaatcaccatggtggagacccgat

SEQ ID NO: 419384 - DNA, 25 bp, Rattus norvegicus
ggaatcaccctgagacctggaatca

SEQ ID NO: 419385 - DNA, 25 bp, Rattus norvegicus
ggaatcaccctgtgacctggaatca

SEQ ID NO: 419386 - DNA, 25 bp, Rattus norvegicus
ggaatcacgggaagaaaactggcaa

SEQ ID NO: 419387 - DNA, 25 bp, Rattus norvegicus
ggaatcacgggatgaaaactggcaa

SEQ ID NO: 419388 - DNA, 25 bp, Rattus norvegicus
ggaatcactgaaaacctgtgccaga

SEQ ID NO: 419389 - DNA, 25 bp, Rattus norvegicus
ggaatcactgaatacctgtgccaga

SEQ ID NO: 419390 - DNA, 25 bp, Rattus norvegicus
ggaatcactgagaaagcccctgaag

SEQ ID NO: 419391 - DNA, 25 bp, Rattus norvegicus
ggaatcactgagtaagcccctgaag

SEQ ID NO: 419392 - DNA, 25 bp, Rattus norvegicus
ggaatcactggaatgtccacgctaa

SEQ ID NO: 419393 - DNA, 25 bp, Rattus norvegicus
ggaatcactggattgtccacgctaa

SEQ ID NO: 419394 - DNA, 25 bp, Rattus norvegicus
ggaatcagaaagctttcagtctcta

SEQ ID NO: 419395 - DNA, 25 bp, Rattus norvegicus
ggaatcagaaaggtttcagtctcta

SEQ ID NO: 419396 - DNA, 25 bp, Rattus norvegicus
ggaatcagaatcaccctcgaaacat

SEQ ID NO: 419397 - DNA, 25 bp, Rattus norvegicus
ggaatcagaatctccctcgaaacat

SEQ ID NO: 419398 - DNA, 25 bp, Rattus norvegicus
ggaatcagacaacatcctcttgggc

SEQ ID NO: 419399 - DNA, 25 bp, Rattus norvegicus
ggaatcagacaagatcctcttgggc

SEQ ID NO: 419400 - DNA, 25 bp, Rattus norvegicus
ggaatcagagctcgatgccaccctc

SEQ ID NO: 419401 - DNA, 25 bp, Rattus norvegicus
ggaatcagagctggatgccaccctc

SEQ ID NO: 419402 - DNA, 25 bp, Rattus norvegicus
ggaatcagatgtaaagccccagaga

SEQ ID NO: 419403 - DNA, 25 bp, Rattus norvegicus
ggaatcagatgttaagccccagaga

SEQ ID NO: 419404 - DNA, 25 bp, Rattus norvegicus
ggaatcagcataatctgcccttaaa

SEQ ID NO: 419405 - DNA, 25 bp, Rattus norvegicus
ggaatcagcatattctgcccttaaa

SEQ ID NO: 419406 - DNA, 25 bp, Rattus norvegicus
ggaatcagccagctcatggcgctaa

SEQ ID NO: 419407 - DNA, 25 bp, Rattus norvegicus
ggaatcagccaggtcatggcgctaa

SEQ ID NO: 419408 - DNA, 25 bp, Rattus norvegicus
ggaatcagctataatctcttgctat

SEQ ID NO: 419409 - DNA, 25 bp, Rattus norvegicus
ggaatcagctattatctcttgctat

SEQ ID NO: 419410 - DNA, 25 bp, Rattus norvegicus
ggaatcagctctacatcaggtcaga

SEQ ID NO: 419411 - DNA, 25 bp, Rattus norvegicus
ggaatcagctcttcatcaggtcaga

SEQ ID NO: 419412 - DNA, 25 bp, Rattus norvegicus
ggaatcagctgcatcaacctgggtg

SEQ ID NO: 419413 - DNA, 25 bp, Rattus norvegicus
ggaatcagctgcttcaacctgggtg

SEQ ID NO: 419414 - DNA, 25 bp, Rattus norvegicus
ggaatcagctgtaacaccattcttg

SEQ ID NO: 419415 - DNA, 25 bp, Rattus norvegicus
ggaatcagctgttacaccattcttg

SEQ ID NO: 419416 - DNA, 25 bp, Rattus norvegicus
ggaatcaggttgaaccctccgtatt

SEQ ID NO: 419417 - DNA, 25 bp, Rattus norvegicus
ggaatcaggttgtaccctccgtatt

SEQ ID NO: 419418 - DNA, 25 bp, Rattus norvegicus
ggaatcagtaaaaatgctcaccact

SEQ ID NO: 419419 - DNA, 25 bp, Rattus norvegicus
ggaatcagtaaatatgctcaccact

SEQ ID NO: 419420 - DNA, 25 bp, Rattus norvegicus
ggaatcagtatgacacgctccatga

SEQ ID NO: 419421 - DNA, 25 bp, Rattus norvegicus
ggaatcagtatgtcacgctccatga

SEQ ID NO: 419422 - DNA, 25 bp, Rattus norvegicus
ggaatcagtctcatgcgggtgccga

SEQ ID NO: 419423 - DNA, 25 bp, Rattus norvegicus
ggaatcagtctcttgcgggtgccga

SEQ ID NO: 419424 - DNA, 25 bp, Rattus norvegicus
ggaatcagtgacatggagttggcaa

SEQ ID NO: 419425 - DNA, 25 bp, Rattus norvegicus
ggaatcagtgacatgttctcattga

SEQ ID NO: 419426 - DNA, 25 bp, Rattus norvegicus
ggaatcagtgacttggagttggcaa

SEQ ID NO: 419427 - DNA, 25 bp, Rattus norvegicus
ggaatcagtgacttgttctcattga

SEQ ID NO: 419428 - DNA, 25 bp, Rattus norvegicus
ggaatcatatgactacttagggcat

SEQ ID NO: 419429 - DNA, 25 bp, Rattus norvegicus
ggaatcatatgagtacttagggcat

SEQ ID NO: 419430 - DNA, 25 bp, Rattus norvegicus
ggaatcatcactcaatcacatcagg

SEQ ID NO: 419431 - DNA, 25 bp, Rattus norvegicus
ggaatcatcactcacttgtttaatt

SEQ ID NO: 419432 - DNA, 25 bp, Rattus norvegicus
ggaatcatcactgaatcacatcagg

SEQ ID NO: 419433 - DNA, 25 bp, Rattus norvegicus
ggaatcatcactgacttgtttaatt

SEQ ID NO: 419434 - DNA, 25 bp, Rattus norvegicus
ggaatcatcgatacatccataacta

SEQ ID NO: 419435 - DNA, 25 bp, Rattus norvegicus
ggaatcatcgattcatccataacta

SEQ ID NO: 419436 - DNA, 25 bp, Rattus norvegicus
ggaatcatggatcaacgccctgagt

SEQ ID NO: 419437 - DNA, 25 bp, Rattus norvegicus
ggaatcatggatgaacgccctgagt

SEQ ID NO: 419438 - DNA, 25 bp, Rattus norvegicus
ggaatcatggcgcacatgggcaaat

SEQ ID NO: 419439 - DNA, 25 bp, Rattus norvegicus
ggaatcatggcggacatgggcaaat

SEQ ID NO: 419440 - DNA, 25 bp, Rattus norvegicus
ggaatcatgtacagcctgctttctt

SEQ ID NO: 419441 - DNA, 25 bp, Rattus norvegicus
ggaatcatgtactgcctgctttctt

SEQ ID NO: 419442 - DNA, 25 bp, Rattus norvegicus
ggaatcatgttaaccagcttcatta

SEQ ID NO: 419443 - DNA, 25 bp, Rattus norvegicus
ggaatcatgttatccagcttcatta

SEQ ID NO: 419444 - DNA, 25 bp, Rattus norvegicus
ggaatcattctcagtgagcgaactt

SEQ ID NO: 419445 - DNA, 25 bp, Rattus norvegicus
ggaatcattctctgtgagcgaactt

SEQ ID NO: 419446 - DNA, 25 bp, Rattus norvegicus
ggaatcattgtcaatctgattgctg

SEQ ID NO: 419447 - DNA, 25 bp, Rattus norvegicus
ggaatcattgtctatctgattgctg

SEQ ID NO: 419448 - DNA, 25 bp, Rattus norvegicus
ggaatcatttatagcagccctgtac

SEQ ID NO: 419449 - DNA, 25 bp, Rattus norvegicus
ggaatcatttattgcagccctgtac

SEQ ID NO: 419450 - DNA, 25 bp, Rattus norvegicus
ggaatcatttctaagattatcatct

SEQ ID NO: 419451 - DNA, 25 bp, Rattus norvegicus
ggaatcatttcttagattatcatct

SEQ ID NO: 419452 - DNA, 25 bp, Rattus norvegicus
ggaatccaacatcctctggcaggtt

SEQ ID NO: 419453 - DNA, 25 bp, Rattus norvegicus
ggaatccaacatgctctggcaggtt

SEQ ID NO: 419454 - DNA, 25 bp, Rattus norvegicus
ggaatccaaccaaagtgctgaccct

SEQ ID NO: 419455 - DNA, 25 bp, Rattus norvegicus
ggaatccaaccatagtgctgaccct

SEQ ID NO: 419456 - DNA, 25 bp, Rattus norvegicus
ggaatccaagatcatcgccagctat

SEQ ID NO: 419457 - DNA, 25 bp, Rattus norvegicus
ggaatccaagatgatcgccagctat

SEQ ID NO: 419458 - DNA, 25 bp, Rattus norvegicus
ggaatccaccctcagacgccaggtg

SEQ ID NO: 419459 - DNA, 25 bp, Rattus norvegicus
ggaatccaccctgagacgccaggtg

SEQ ID NO: 419460 - DNA, 25 bp, Rattus norvegicus
ggaatccacctgacacttggttgaa

SEQ ID NO: 419461 - DNA, 25 bp, Rattus norvegicus
ggaatccacctgtcacttggttgaa

SEQ ID NO: 419462 - DNA, 25 bp, Rattus norvegicus
ggaatccactacacagtattcgcct

SEQ ID NO: 419463 - DNA, 25 bp, Rattus norvegicus
ggaatccactactcagtattcgcct

SEQ ID NO: 419464 - DNA, 25 bp, Rattus norvegicus
ggaatccactgcagtaggccatttt

SEQ ID NO: 419465 - DNA, 25 bp, Rattus norvegicus
ggaatccactgctgtaggccatttt

SEQ ID NO: 419466 - DNA, 25 bp, Rattus norvegicus
ggaatccactggactgccatacaga

SEQ ID NO: 419467 - DNA, 25 bp, Rattus norvegicus
ggaatccactggtctgccatacaga

SEQ ID NO: 419468 - DNA, 25 bp, Rattus norvegicus
ggaatccagcagacccatactgaag

SEQ ID NO: 419469 - DNA, 25 bp, Rattus norvegicus
ggaatccagcagtcccatactgaag

SEQ ID NO: 419470 - DNA, 25 bp, Rattus norvegicus
ggaatccatactaaacagttctggc

SEQ ID NO: 419471 - DNA, 25 bp, Rattus norvegicus
ggaatccatacttaacagttctggc

SEQ ID NO: 419472 - DNA, 25 bp, Rattus norvegicus
ggaatccatcacatttcatcttcac

SEQ ID NO: 419473 - DNA, 25 bp, Rattus norvegicus
ggaatccatcacttttcatcttcac

SEQ ID NO: 419474 - DNA, 25 bp, Rattus norvegicus
ggaatccatcttatgacatccagag

SEQ ID NO: 419475 - DNA, 25 bp, Rattus norvegicus
ggaatccatcttttgacatccagag

SEQ ID NO: 419476 - DNA, 25 bp, Rattus norvegicus
ggaatccatggtcaaactctcaagt

SEQ ID NO: 419477 - DNA, 25 bp, Rattus norvegicus
ggaatccatggtgaaactctcaagt

SEQ ID NO: 419478 - DNA, 25 bp, Rattus norvegicus
ggaatcccaaaacagtcaccagaca

SEQ ID NO: 419479 - DNA, 25 bp, Rattus norvegicus
ggaatcccaaaagagtcaccagaca

SEQ ID NO: 419480 - DNA, 25 bp, Rattus norvegicus
ggaatcccaatgagataactttcaa

SEQ ID NO: 419481 - DNA, 25 bp, Rattus norvegicus
ggaatcccaatgtgataactttcaa

SEQ ID NO: 419482 - DNA, 25 bp, Rattus norvegicus
ggaatcccacacagtggtttcattt

SEQ ID NO: 419483 - DNA, 25 bp, Rattus norvegicus
ggaatcccacactgtggtttcattt

SEQ ID NO: 419484 - DNA, 25 bp, Rattus norvegicus
ggaatcccacgaatgcctatgactc

SEQ ID NO: 419485 - DNA, 25 bp, Rattus norvegicus
ggaatcccacgattgcctatgactc

SEQ ID NO: 419486 - DNA, 25 bp, Rattus norvegicus
ggaatcccaggcctctgagaatgga

SEQ ID NO: 419487 - DNA, 25 bp, Rattus norvegicus
ggaatcccaggcgtctgagaatgga

SEQ ID NO: 419488 - DNA, 25 bp, Rattus norvegicus
ggaatcccatatctcaaagccagta

SEQ ID NO: 419489 - DNA, 25 bp, Rattus norvegicus
ggaatcccatatgtcaaagccagta

SEQ ID NO: 419490 - DNA, 25 bp, Rattus norvegicus
ggaatccccagaaatgacggcttta

SEQ ID NO: 419491 - DNA, 25 bp, Rattus norvegicus
ggaatccccagatatgacggcttta

SEQ ID NO: 419492 - DNA, 25 bp, Rattus norvegicus
ggaatccccattctgtatgagctga

SEQ ID NO: 419493 - DNA, 25 bp, Rattus norvegicus
ggaatccccattgtgtatgagctga

SEQ ID NO: 419494 - DNA, 25 bp, Rattus norvegicus
ggaatcccctatagtgagcacagca

SEQ ID NO: 419495 - DNA, 25 bp, Rattus norvegicus
ggaatcccctatattgaaaccagcg

SEQ ID NO: 419496 - DNA, 25 bp, Rattus norvegicus
ggaatcccctattgtgagcacagca

SEQ ID NO: 419497 - DNA, 25 bp, Rattus norvegicus
ggaatcccctattttgaaaccagcg

SEQ ID NO: 419498 - DNA, 25 bp, Rattus norvegicus
ggaatccctacactagcctctttga

SEQ ID NO: 419499 - DNA, 25 bp, Rattus norvegicus
ggaatccctacagtagcctctttga

SEQ ID NO: 419500 - DNA, 25 bp, Rattus norvegicus
ggaatccctcacctggttggaaatt

SEQ ID NO: 419501 - DNA, 25 bp, Rattus norvegicus
ggaatccctcacgtggttggaaatt

SEQ ID NO: 419502 - DNA, 25 bp, Rattus norvegicus
ggaatccgaatcactatgtctcatg

SEQ ID NO: 419503 - DNA, 25 bp, Rattus norvegicus
ggaatccgaatctctatgtctcatg

SEQ ID NO: 419504 - DNA, 25 bp, Rattus norvegicus
ggaatccgagtcactctctaagaat

SEQ ID NO: 419505 - DNA, 25 bp, Rattus norvegicus
ggaatccgagtctctctctaagaat

SEQ ID NO: 419506 - DNA, 25 bp, Rattus norvegicus
ggaatccgtgacacacgaggctgga

SEQ ID NO: 419507 - DNA, 25 bp, Rattus norvegicus
ggaatccgtgactcacgaggctgga

SEQ ID NO: 419508 - DNA, 25 bp, Rattus norvegicus
ggaatccgtgccaggaagtgcttct

SEQ ID NO: 419509 - DNA, 25 bp, Rattus norvegicus
ggaatccgtgcctggaagtgcttct

SEQ ID NO: 419510 - DNA, 25 bp, Rattus norvegicus
ggaatcctaataaacctccttggag

SEQ ID NO: 419511 - DNA, 25 bp, Rattus norvegicus
ggaatcctaatatacctccttggag

SEQ ID NO: 419512 - DNA, 25 bp, Rattus norvegicus
ggaatcctacttccagaaccacttc

SEQ ID NO: 419513 - DNA, 25 bp, Rattus norvegicus
ggaatcctacttgcagaaccacttc

SEQ ID NO: 419514 - DNA, 25 bp, Rattus norvegicus
ggaatcctagagagaccgcctgcca

SEQ ID NO: 419515 - DNA, 25 bp, Rattus norvegicus
ggaatcctagagtgaccgcctgcca

SEQ ID NO: 419516 - DNA, 25 bp, Rattus norvegicus
ggaatcctaggcaggaagcttgcaa

SEQ ID NO: 419517 - DNA, 25 bp, Rattus norvegicus
ggaatcctaggctggaagcttgcaa

SEQ ID NO: 419518 - DNA, 25 bp, Rattus norvegicus
ggaatcctatgcagtagcgtactca

SEQ ID NO: 419519 - DNA, 25 bp, Rattus norvegicus
ggaatcctatgctgtagcgtactca

SEQ ID NO: 419520 - DNA, 25 bp, Rattus norvegicus
ggaatcctctgaattaaaaacgtgc

SEQ ID NO: 419521 - DNA, 25 bp, Rattus norvegicus
ggaatcctctgatttaaaaacgtgc

SEQ ID NO: 419522 - DNA, 25 bp, Rattus norvegicus
ggaatcctcttcagggtccagaact

SEQ ID NO: 419523 - DNA, 25 bp, Rattus norvegicus
ggaatcctcttctgggtccagaact

SEQ ID NO: 419524 - DNA, 25 bp, Rattus norvegicus
ggaatcctgcttacatgtgcatcat

SEQ ID NO: 419525 - DNA, 25 bp, Rattus norvegicus
ggaatcctgctttcatgtgcatcat

SEQ ID NO: 419526 - DNA, 25 bp, Rattus norvegicus
ggaatcctgggtctcctcggagtca

SEQ ID NO: 419527 - DNA, 25 bp, Rattus norvegicus
ggaatcctgggtgtcctcggagtca

SEQ ID NO: 419528 - DNA, 25 bp, Rattus norvegicus
ggaatcctgtccaaacactgtatac

SEQ ID NO: 419529 - DNA, 25 bp, Rattus norvegicus
ggaatcctgtcctaacactgtatac

SEQ ID NO: 419530 - DNA, 25 bp, Rattus norvegicus
ggaatcctgtgcaaggagtccccat

SEQ ID NO: 419531 - DNA, 25 bp, Rattus norvegicus
ggaatcctgtgctaggagtccccat

SEQ ID NO: 419532 - DNA, 25 bp, Rattus norvegicus
ggaatcctgtggcatccatgaaact

SEQ ID NO: 419533 - DNA, 25 bp, Rattus norvegicus
ggaatcctgtgggatccatgaaact

SEQ ID NO: 419534 - DNA, 25 bp, Rattus norvegicus
ggaatccttacgaaattgcaatagt

SEQ ID NO: 419535 - DNA, 25 bp, Rattus norvegicus
ggaatccttacgtaattgcaatagt

SEQ ID NO: 419536 - DNA, 25 bp, Rattus norvegicus
ggaatccttttaaacagactagaat

SEQ ID NO: 419537 - DNA, 25 bp, Rattus norvegicus
ggaatccttttatacagactagaat

SEQ ID NO: 419538 - DNA, 25 bp, Rattus norvegicus
ggaatcgaacaaccctctgtgaata

SEQ ID NO: 419539 - DNA, 25 bp, Rattus norvegicus
ggaatcgaacaagcctctgtgaata

SEQ ID NO: 419540 - DNA, 25 bp, Rattus norvegicus
ggaatcgaattcatctcagccttta

SEQ ID NO: 419541 - DNA, 25 bp, Rattus norvegicus
ggaatcgaattcttctcagccttta

SEQ ID NO: 419542 - DNA, 25 bp, Rattus norvegicus
ggaatcgatcccagcattcagtctg

SEQ ID NO: 419543 - DNA, 25 bp, Rattus norvegicus
ggaatcgatccctgcattcagtctg

SEQ ID NO: 419544 - DNA, 25 bp, Rattus norvegicus
ggaatcgatctaacacttgccatga

SEQ ID NO: 419545 - DNA, 25 bp, Rattus norvegicus
ggaatcgatctatcacttgccatga

SEQ ID NO: 419546 - DNA, 25 bp, Rattus norvegicus
ggaatcgatgttacttctgttgttc

SEQ ID NO: 419547 - DNA, 25 bp, Rattus norvegicus
ggaatcgatgtttcttctgttgttc

SEQ ID NO: 419548 - DNA, 25 bp, Rattus norvegicus
ggaatcgccagtaagcttaaagcta

SEQ ID NO: 419549 - DNA, 25 bp, Rattus norvegicus
ggaatcgccagttagcttaaagcta

SEQ ID NO: 419550 - DNA, 25 bp, Rattus norvegicus
ggaatcgctcataaggacctggatc

SEQ ID NO: 419551 - DNA, 25 bp, Rattus norvegicus
ggaatcgctcattaggacctggatc

SEQ ID NO: 419552 - DNA, 25 bp, Rattus norvegicus
ggaatcgctgccacagcggagagca

SEQ ID NO: 419553 - DNA, 25 bp, Rattus norvegicus
ggaatcgctgcctcagcggagagca

SEQ ID NO: 419554 - DNA, 25 bp, Rattus norvegicus
ggaatcgcttttactgatatttggt

SEQ ID NO: 419555 - DNA, 25 bp, Rattus norvegicus
ggaatcgctttttctgatatttggt

SEQ ID NO: 419556 - DNA, 25 bp, Rattus norvegicus
ggaatcggaacacgctggctccata

SEQ ID NO: 419557 - DNA, 25 bp, Rattus norvegicus
ggaatcggaacaggctggctccata

SEQ ID NO: 419558 - DNA, 25 bp, Rattus norvegicus
ggaatcggagcaactagagagccat

SEQ ID NO: 419559 - DNA, 25 bp, Rattus norvegicus
ggaatcggagcatctagagagccat

SEQ ID NO: 419560 - DNA, 25 bp, Rattus norvegicus
ggaatcggctgtcaattcagaactc

SEQ ID NO: 419561 - DNA, 25 bp, Rattus norvegicus
ggaatcggctgtgaattcagaactc

SEQ ID NO: 419562 - DNA, 25 bp, Rattus norvegicus
ggaatcgtcccaaaatgtctcttgc

SEQ ID NO: 419563 - DNA, 25 bp, Rattus norvegicus
ggaatcgtcccataatgtctcttgc

SEQ ID NO: 419564 - DNA, 25 bp, Rattus norvegicus
ggaatctaaaatcaccaagtcttgt

SEQ ID NO: 419565 - DNA, 25 bp, Rattus norvegicus
ggaatctaaaatgaccaagtcttgt

SEQ ID NO: 419566 - DNA, 25 bp, Rattus norvegicus
ggaatctaaccccaggagtgtttct

SEQ ID NO: 419567 - DNA, 25 bp, Rattus norvegicus
ggaatctaacccgaggagtgtttct

SEQ ID NO: 419568 - DNA, 25 bp, Rattus norvegicus
ggaatctaaggccacatgtacaagt

SEQ ID NO: 419569 - DNA, 25 bp, Rattus norvegicus
ggaatctaaggcgacatgtacaagt

SEQ ID NO: 419570 - DNA, 25 bp, Rattus norvegicus
ggaatctacagtcagatgttttaat

SEQ ID NO: 419571 - DNA, 25 bp, Rattus norvegicus
ggaatctacagtgagatgttttaat

SEQ ID NO: 419572 - DNA, 25 bp, Rattus norvegicus
ggaatctacatgaccctgttattaa

SEQ ID NO: 419573 - DNA, 25 bp, Rattus norvegicus
ggaatctacatgtccctgttattaa

SEQ ID NO: 419574 - DNA, 25 bp, Rattus norvegicus
ggaatctacctgactgctagttttc

SEQ ID NO: 419575 - DNA, 25 bp, Rattus norvegicus
ggaatctacctgtctgctagttttc

SEQ ID NO: 419576 - DNA, 25 bp, Rattus norvegicus
ggaatctactcaaccgtgatagcca

SEQ ID NO: 419577 - DNA, 25 bp, Rattus norvegicus
ggaatctactcatccgtgatagcca

SEQ ID NO: 419578 - DNA, 25 bp, Rattus norvegicus
ggaatctagaagaccacccgaacac

SEQ ID NO: 419579 - DNA, 25 bp, Rattus norvegicus
ggaatctagaagtccacccgaacac

SEQ ID NO: 419580 - DNA, 25 bp, Rattus norvegicus
ggaatctagggaccactttcctggg

SEQ ID NO: 419581 - DNA, 25 bp, Rattus norvegicus
ggaatctagggagcactttcctggg

SEQ ID NO: 419582 - DNA, 25 bp, Rattus norvegicus
ggaatctagtagacctgcaaattga

SEQ ID NO: 419583 - DNA, 25 bp, Rattus norvegicus
ggaatctagtagtcctgcaaattga

SEQ ID NO: 419584 - DNA, 25 bp, Rattus norvegicus
ggaatctattctcccatttccaaaa

SEQ ID NO: 419585 - DNA, 25 bp, Rattus norvegicus
ggaatctattctgccatttccaaaa

SEQ ID NO: 419586 - DNA, 25 bp, Rattus norvegicus
ggaatctcaaatcgctaagaagcac

SEQ ID NO: 419587 - DNA, 25 bp, Rattus norvegicus
ggaatctcaaatggctaagaagcac

SEQ ID NO: 419588 - DNA, 25 bp, Rattus norvegicus
ggaatctcaaccatgactgggacag

SEQ ID NO: 419589 - DNA, 25 bp, Rattus norvegicus
ggaatctcaaccttgactgggacag

SEQ ID NO: 419590 - DNA, 25 bp, Rattus norvegicus
ggaatctcactcagaatccgaggca

SEQ ID NO: 419591 - DNA, 25 bp, Rattus norvegicus
ggaatctcactctgaatccgaggca

SEQ ID NO: 419592 - DNA, 25 bp, Rattus norvegicus
ggaatctcagcaatcgttaccttca

SEQ ID NO: 419593 - DNA, 25 bp, Rattus norvegicus
ggaatctcagcattcgttaccttca

SEQ ID NO: 419594 - DNA, 25 bp, Rattus norvegicus
ggaatctcagcgctccgggatcacc

SEQ ID NO: 419595 - DNA, 25 bp, Rattus norvegicus
ggaatctcagcggtccgggatcacc

SEQ ID NO: 419596 - DNA, 25 bp, Rattus norvegicus
ggaatctcagtaagcttggccactc

SEQ ID NO: 419597 - DNA, 25 bp, Rattus norvegicus
ggaatctcagtatgcttggccactc

SEQ ID NO: 419598 - DNA, 25 bp, Rattus norvegicus
ggaatctcattcaggaaaacgtctt

SEQ ID NO: 419599 - DNA, 25 bp, Rattus norvegicus
ggaatctcattctggaaaacgtctt

SEQ ID NO: 419600 - DNA, 25 bp, Rattus norvegicus
ggaatctccacgacagccggtggcg

SEQ ID NO: 419601 - DNA, 25 bp, Rattus norvegicus
ggaatctccacgtcagccggtggcg

SEQ ID NO: 419602 - DNA, 25 bp, Rattus norvegicus
ggaatctccattcactgattgaccc

SEQ ID NO: 419603 - DNA, 25 bp, Rattus norvegicus
ggaatctccattgactgattgaccc

SEQ ID NO: 419604 - DNA, 25 bp, Rattus norvegicus
ggaatctcccgccatttttcaataa

SEQ ID NO: 419605 - DNA, 25 bp, Rattus norvegicus
ggaatctcccgcgatttttcaataa

SEQ ID NO: 419606 - DNA, 25 bp, Rattus norvegicus
ggaatctccctcagtgactaaggaa

SEQ ID NO: 419607 - DNA, 25 bp, Rattus norvegicus
ggaatctccctccatttctagggca

SEQ ID NO: 419608 - DNA, 25 bp, Rattus norvegicus
ggaatctccctcgatttctagggca

SEQ ID NO: 419609 - DNA, 25 bp, Rattus norvegicus
ggaatctccctctgtgactaaggaa

SEQ ID NO: 419610 - DNA, 25 bp, Rattus norvegicus
ggaatctcgggtcactcagtatgaa

SEQ ID NO: 419611 - DNA, 25 bp, Rattus norvegicus
ggaatctcgggtgactcagtatgaa

SEQ ID NO: 419612 - DNA, 25 bp, Rattus norvegicus
ggaatctcgtcaatattttgcctgt

SEQ ID NO: 419613 - DNA, 25 bp, Rattus norvegicus
ggaatctcgtcattattttgcctgt

SEQ ID NO: 419614 - DNA, 25 bp, Rattus norvegicus
ggaatctctcctaaaggacctactt

SEQ ID NO: 419615 - DNA, 25 bp, Rattus norvegicus
ggaatctctccttaaggacctactt

SEQ ID NO: 419616 - DNA, 25 bp, Rattus norvegicus
ggaatctctgtcattggctgggatc

SEQ ID NO: 419617 - DNA, 25 bp, Rattus norvegicus
ggaatctctgtctttggctgggatc

SEQ ID NO: 419618 - DNA, 25 bp, Rattus norvegicus
ggaatctcttttcaccagttcggga

SEQ ID NO: 419619 - DNA, 25 bp, Rattus norvegicus
ggaatctcttttgaccagttcggga

SEQ ID NO: 419620 - DNA, 25 bp, Rattus norvegicus
ggaatctgaactcatccgggtccca

SEQ ID NO: 419621 - DNA, 25 bp, Rattus norvegicus
ggaatctgaactgatccgggtccca

SEQ ID NO: 419622 - DNA, 25 bp, Rattus norvegicus
ggaatctgaagacggtcacacacgt

SEQ ID NO: 419623 - DNA, 25 bp, Rattus norvegicus
ggaatctgaagagggtcacacacgt

SEQ ID NO: 419624 - DNA, 25 bp, Rattus norvegicus
ggaatctgataccttttctggcttc

SEQ ID NO: 419625 - DNA, 25 bp, Rattus norvegicus
ggaatctgatacgttttctggcttc

SEQ ID NO: 419626 - DNA, 25 bp, Rattus norvegicus
ggaatctgatgccttttaccacaag

SEQ ID NO: 419627 - DNA, 25 bp, Rattus norvegicus
ggaatctgatgcgttttaccacaag

SEQ ID NO: 419628 - DNA, 25 bp, Rattus norvegicus
ggaatctgcagaagccgccagtctc

SEQ ID NO: 419629 - DNA, 25 bp, Rattus norvegicus
ggaatctgcagatgccgccagtctc

SEQ ID NO: 419630 - DNA, 25 bp, Rattus norvegicus
ggaatctgcaggaaagctgccccat

SEQ ID NO: 419631 - DNA, 25 bp, Rattus norvegicus
ggaatctgcaggtaagctgccccat

SEQ ID NO: 419632 - DNA, 25 bp, Rattus norvegicus
ggaatctgcatgctttgcctgagct

SEQ ID NO: 419633 - DNA, 25 bp, Rattus norvegicus
ggaatctgcatggtttgcctgagct

SEQ ID NO: 419634 - DNA, 25 bp, Rattus norvegicus
ggaatctgccagaacactagttgat

SEQ ID NO: 419635 - DNA, 25 bp, Rattus norvegicus
ggaatctgccagtacactagttgat

SEQ ID NO: 419636 - DNA, 25 bp, Rattus norvegicus
ggaatctggaatctactcggtgctt

SEQ ID NO: 419637 - DNA, 25 bp, Rattus norvegicus
ggaatctggaatgtactcggtgctt

SEQ ID NO: 419638 - DNA, 25 bp, Rattus norvegicus
ggaatctggacaacttccatccatg

SEQ ID NO: 419639 - DNA, 25 bp, Rattus norvegicus
ggaatctggacatcttccatccatg

SEQ ID NO: 419640 - DNA, 25 bp, Rattus norvegicus
ggaatctgggtaaacctcagatcag

SEQ ID NO: 419641 - DNA, 25 bp, Rattus norvegicus
ggaatctgggtatacctcagatcag

SEQ ID NO: 419642 - DNA, 25 bp, Rattus norvegicus
ggaatctggttgagtcacccatcac

SEQ ID NO: 419643 - DNA, 25 bp, Rattus norvegicus
ggaatctggttgctattttaaggta

SEQ ID NO: 419644 - DNA, 25 bp, Rattus norvegicus
ggaatctggttggtattttaaggta

SEQ ID NO: 419645 - DNA, 25 bp, Rattus norvegicus
ggaatctggttgtgtcacccatcac

SEQ ID NO: 419646 - DNA, 25 bp, Rattus norvegicus
ggaatctgtagactgcatgtacccc

SEQ ID NO: 419647 - DNA, 25 bp, Rattus norvegicus
ggaatctgtagagtgcatgtacccc

SEQ ID NO: 419648 - DNA, 25 bp, Rattus norvegicus
ggaatctgtcatcctttggcttaca

SEQ ID NO: 419649 - DNA, 25 bp, Rattus norvegicus
ggaatctgtcatgctttggcttaca

SEQ ID NO: 419650 - DNA, 25 bp, Rattus norvegicus
ggaatctgtcctcggcctggtgcac

SEQ ID NO: 419651 - DNA, 25 bp, Rattus norvegicus
ggaatctgtcctgggcctggtgcac

SEQ ID NO: 419652 - DNA, 25 bp, Rattus norvegicus
ggaatctgtgccacaggactcctaa

SEQ ID NO: 419653 - DNA, 25 bp, Rattus norvegicus
ggaatctgtgcctcaggactcctaa

SEQ ID NO: 419654 - DNA, 25 bp, Rattus norvegicus
ggaatctgtgttcttcaaagccatt

SEQ ID NO: 419655 - DNA, 25 bp, Rattus norvegicus
ggaatctgtgttgttcaaagccatt

SEQ ID NO: 419656 - DNA, 25 bp, Rattus norvegicus
ggaatctgttccagaatcggccaag

SEQ ID NO: 419657 - DNA, 25 bp, Rattus norvegicus
ggaatctgttcctgaatcggccaag

SEQ ID NO: 419658 - DNA, 25 bp, Rattus norvegicus
ggaatcttacttacaaatggctgca

SEQ ID NO: 419659 - DNA, 25 bp, Rattus norvegicus
ggaatcttactttcaaatggctgca

SEQ ID NO: 419660 - DNA, 25 bp, Rattus norvegicus
ggaatcttagacatcccagaataat

SEQ ID NO: 419661 - DNA, 25 bp, Rattus norvegicus
ggaatcttagacttcccagaataat

SEQ ID NO: 419662 - DNA, 25 bp, Rattus norvegicus
ggaatcttcccaagacttagggcta

SEQ ID NO: 419663 - DNA, 25 bp, Rattus norvegicus
ggaatcttcccatgacttagggcta

SEQ ID NO: 419664 - DNA, 25 bp, Rattus norvegicus
ggaatcttcctgacacatttaatga

SEQ ID NO: 419665 - DNA, 25 bp, Rattus norvegicus
ggaatcttcctgtcacatttaatga

SEQ ID NO: 419666 - DNA, 25 bp, Rattus norvegicus
ggaatcttctctccgtattcaggaa

SEQ ID NO: 419667 - DNA, 25 bp, Rattus norvegicus
ggaatcttctctgcgtattcaggaa

SEQ ID NO: 419668 - DNA, 25 bp, Rattus norvegicus
ggaatcttctgcagtttcctcagat

SEQ ID NO: 419669 - DNA, 25 bp, Rattus norvegicus
ggaatcttctgctgtttcctcagat

SEQ ID NO: 419670 - DNA, 25 bp, Rattus norvegicus
ggaatcttcttgctgtatcctttct

SEQ ID NO: 419671 - DNA, 25 bp, Rattus norvegicus
ggaatcttcttggtgtatcctttct

SEQ ID NO: 419672 - DNA, 25 bp, Rattus norvegicus
ggaatcttgagacattctgcctgcc

SEQ ID NO: 419673 - DNA, 25 bp, Rattus norvegicus
ggaatcttgagagattctgcctgcc

SEQ ID NO: 419674 - DNA, 25 bp, Rattus norvegicus
ggaatcttggccacacgctggagaa

SEQ ID NO: 419675 - DNA, 25 bp, Rattus norvegicus
ggaatcttggcctcacgctggagaa

SEQ ID NO: 419676 - DNA, 25 bp, Rattus norvegicus
ggaatcttgtcccagtcaaaggcag

SEQ ID NO: 419677 - DNA, 25 bp, Rattus norvegicus
ggaatcttgtccgagtcaaaggcag

SEQ ID NO: 419678 - DNA, 25 bp, Rattus norvegicus
ggaatctttaccaattgaacctgaa

SEQ ID NO: 419679 - DNA, 25 bp, Rattus norvegicus
ggaatctttacctattgaacctgaa

SEQ ID NO: 419680 - DNA, 25 bp, Rattus norvegicus
ggaatctttcttacttgaagtggaa

SEQ ID NO: 419681 - DNA, 25 bp, Rattus norvegicus
ggaatctttctttcttgaagtggaa

SEQ ID NO: 419682 - DNA, 25 bp, Rattus norvegicus
ggaatctttgagagtgcagacccaa

SEQ ID NO: 419683 - DNA, 25 bp, Rattus norvegicus
ggaatctttgagtgtgcagacccaa

SEQ ID NO: 419684 - DNA, 25 bp, Rattus norvegicus
ggaatctttgtgaatttcggaacat

SEQ ID NO: 419685 - DNA, 25 bp, Rattus norvegicus
ggaatctttgtgtatttcggaacat

SEQ ID NO: 419686 - DNA, 25 bp, Rattus norvegicus
ggaatcttttagaccctgacaaatg

SEQ ID NO: 419687 - DNA, 25 bp, Rattus norvegicus
ggaatcttttagtccctgacaaatg

SEQ ID NO: 419688 - DNA, 25 bp, Rattus norvegicus
ggaatcttttccagttatgtctatc

SEQ ID NO: 419689 - DNA, 25 bp, Rattus norvegicus
ggaatcttttcctgttatgtctatc

SEQ ID NO: 419690 - DNA, 25 bp, Rattus norvegicus
ggaatcttttgtacaaccgtcaata

SEQ ID NO: 419691 - DNA, 25 bp, Rattus norvegicus
ggaatcttttgtactttgcacccag

SEQ ID NO: 419692 - DNA, 25 bp, Rattus norvegicus
ggaatcttttgttcaaccgtcaata

SEQ ID NO: 419693 - DNA, 25 bp, Rattus norvegicus
ggaatcttttgttctttgcacccag

SEQ ID NO: 419694 - DNA, 25 bp, Rattus norvegicus
ggaatgaacagcatcctgtacccac

SEQ ID NO: 419695 - DNA, 25 bp, Rattus norvegicus
ggaatgaacagcttcctgtacccac

SEQ ID NO: 419696 - DNA, 25 bp, Rattus norvegicus
ggaatgaaccatctatcaacttcta

SEQ ID NO: 419697 - DNA, 25 bp, Rattus norvegicus
ggaatgaaccatgtatcaacttcta

SEQ ID NO: 419698 - DNA, 25 bp, Rattus norvegicus
ggaatgaacccaatccacatactga

SEQ ID NO: 419699 - DNA, 25 bp, Rattus norvegicus
ggaatgaacccattccacatactga

SEQ ID NO: 419700 - DNA, 25 bp, Rattus norvegicus
ggaatgaactctactccatactcac

SEQ ID NO: 419701 - DNA, 25 bp, Rattus norvegicus
ggaatgaactcttctccatactcac

SEQ ID NO: 419702 - DNA, 25 bp, Rattus norvegicus
ggaatgaagaacacttgccccagat

SEQ ID NO: 419703 - DNA, 25 bp, Rattus norvegicus
ggaatgaagaactcttgccccagat

SEQ ID NO: 419704 - DNA, 25 bp, Rattus norvegicus
ggaatgaaggcacctcccatcacag

SEQ ID NO: 419705 - DNA, 25 bp, Rattus norvegicus
ggaatgaaggcagctcccatcacag

SEQ ID NO: 419706 - DNA, 25 bp, Rattus norvegicus
ggaatgaaggccacaccagccaggt

SEQ ID NO: 419707 - DNA, 25 bp, Rattus norvegicus
ggaatgaaggcctcaccagccaggt

SEQ ID NO: 419708 - DNA, 25 bp, Rattus norvegicus
ggaatgaatcctacaaatccagctg

SEQ ID NO: 419709 - DNA, 25 bp, Rattus norvegicus
ggaatgaatccttcaaatccagctg

SEQ ID NO: 419710 - DNA, 25 bp, Rattus norvegicus
ggaatgacagcacttgttctgcaaa

SEQ ID NO: 419711 - DNA, 25 bp, Rattus norvegicus
ggaatgacagcagttgttctgcaaa

SEQ ID NO: 419712 - DNA, 25 bp, Rattus norvegicus
ggaatgacatcgactccattaaaaa

SEQ ID NO: 419713 - DNA, 25 bp, Rattus norvegicus
ggaatgacatcgtctccattaaaaa

SEQ ID NO: 419714 - DNA, 25 bp, Rattus norvegicus
ggaatgaccctcagtttcaactaat

SEQ ID NO: 419715 - DNA, 25 bp, Rattus norvegicus
ggaatgaccctctgtttcaactaat

SEQ ID NO: 419716 - DNA, 25 bp, Rattus norvegicus
ggaatgacgcttaacctgagagagt

SEQ ID NO: 419717 - DNA, 25 bp, Rattus norvegicus
ggaatgacgctttacctgagagagt

SEQ ID NO: 419718 - DNA, 25 bp, Rattus norvegicus
ggaatgacgttccttgctctgattc

SEQ ID NO: 419719 - DNA, 25 bp, Rattus norvegicus
ggaatgacgttcgttgctctgattc

SEQ ID NO: 419720 - DNA, 25 bp, Rattus norvegicus
ggaatgactcagatctatttaaggg

SEQ ID NO: 419721 - DNA, 25 bp, Rattus norvegicus
ggaatgactcagttctatttaaggg

SEQ ID NO: 419722 - DNA, 25 bp, Rattus norvegicus
ggaatgactctccatgtggtaccac

SEQ ID NO: 419723 - DNA, 25 bp, Rattus norvegicus
ggaatgactctcgatgtggtaccac

SEQ ID NO: 419724 - DNA, 25 bp, Rattus norvegicus
ggaatgactgtaagacctgaacaaa

SEQ ID NO: 419725 - DNA, 25 bp, Rattus norvegicus
ggaatgactgtatgacctgaacaaa

SEQ ID NO: 419726 - DNA, 25 bp, Rattus norvegicus
ggaatgacttctaaacagcttaaca

SEQ ID NO: 419727 - DNA, 25 bp, Rattus norvegicus
ggaatgacttcttaacagcttaaca

SEQ ID NO: 419728 - DNA, 25 bp, Rattus norvegicus
ggaatgagaagcatctggccctgct

SEQ ID NO: 419729 - DNA, 25 bp, Rattus norvegicus
ggaatgagaagcttctggccctgct

SEQ ID NO: 419730 - DNA, 25 bp, Rattus norvegicus
ggaatgagacccagaacgagcccta

SEQ ID NO: 419731 - DNA, 25 bp, Rattus norvegicus
ggaatgagaccctgaacgagcccta

SEQ ID NO: 419732 - DNA, 25 bp, Rattus norvegicus
ggaatgagacctaccacaccaggtt

SEQ ID NO: 419733 - DNA, 25 bp, Rattus norvegicus
ggaatgagaccttccacaccaggtt

SEQ ID NO: 419734 - DNA, 25 bp, Rattus norvegicus
ggaatgagactcagttgtccttcag

SEQ ID NO: 419735 - DNA, 25 bp, Rattus norvegicus
ggaatgagactctgttgtccttcag

SEQ ID NO: 419736 - DNA, 25 bp, Rattus norvegicus
ggaatgagagttccttgcctagtcc

SEQ ID NO: 419737 - DNA, 25 bp, Rattus norvegicus
ggaatgagagttgcttgcctagtcc

SEQ ID NO: 419738 - DNA, 25 bp, Rattus norvegicus
ggaatgagcactctttccttctgtt

SEQ ID NO: 419739 - DNA, 25 bp, Rattus norvegicus
ggaatgagcactgtttccttctgtt

SEQ ID NO: 419740 - DNA, 25 bp, Rattus norvegicus
ggaatgagcagtctggagcccatct

SEQ ID NO: 419741 - DNA, 25 bp, Rattus norvegicus
ggaatgagcagtgtggagcccatct

SEQ ID NO: 419742 - DNA, 25 bp, Rattus norvegicus
ggaatgagctcacccttatgccaca

SEQ ID NO: 419743 - DNA, 25 bp, Rattus norvegicus
ggaatgagctcagccttatgccaca

SEQ ID NO: 419744 - DNA, 25 bp, Rattus norvegicus
ggaatgagtcataacaactggaaaa

SEQ ID NO: 419745 - DNA, 25 bp, Rattus norvegicus
ggaatgagtcattacaactggaaaa

SEQ ID NO: 419746 - DNA, 25 bp, Rattus norvegicus
ggaatgatcaggatctcctcttcag

SEQ ID NO: 419747 - DNA, 25 bp, Rattus norvegicus
ggaatgatcaggttctcctcttcag

SEQ ID NO: 419748 - DNA, 25 bp, Rattus norvegicus
ggaatgatgagcaatcccactcctt

SEQ ID NO: 419749 - DNA, 25 bp, Rattus norvegicus
ggaatgatgagctatcccactcctt

SEQ ID NO: 419750 - DNA, 25 bp, Rattus norvegicus
ggaatgatgggcctgctttttaaaa

SEQ ID NO: 419751 - DNA, 25 bp, Rattus norvegicus
ggaatgatgggcgtgctttttaaaa

SEQ ID NO: 419752 - DNA, 25 bp, Rattus norvegicus
ggaatgatgtcaccctctacagaac

SEQ ID NO: 419753 - DNA, 25 bp, Rattus norvegicus
ggaatgatgtcagcctctacagaac

SEQ ID NO: 419754 - DNA, 25 bp, Rattus norvegicus
ggaatgattcacatcctctcaagtt

SEQ ID NO: 419755 - DNA, 25 bp, Rattus norvegicus
ggaatgattcacttcctctcaagtt

SEQ ID NO: 419756 - DNA, 25 bp, Rattus norvegicus
ggaatgattccacaattactttttt

SEQ ID NO: 419757 - DNA, 25 bp, Rattus norvegicus
ggaatgattccagaattactttttt

SEQ ID NO: 419758 - DNA, 25 bp, Rattus norvegicus
ggaatgatttacatcccagctgtgt

SEQ ID NO: 419759 - DNA, 25 bp, Rattus norvegicus
ggaatgatttacttcccagctgtgt

SEQ ID NO: 419760 - DNA, 25 bp, Rattus norvegicus
ggaatgcaagaaccactgcccaggc

SEQ ID NO: 419761 - DNA, 25 bp, Rattus norvegicus
ggaatgcaagaagcactgcccaggc

SEQ ID NO: 419762 - DNA, 25 bp, Rattus norvegicus
ggaatgcaattcatgctcctgcgag

SEQ ID NO: 419763 - DNA, 25 bp, Rattus norvegicus
ggaatgcaattcttgctcctgcgag

SEQ ID NO: 419764 - DNA, 25 bp, Rattus norvegicus
ggaatgcaccaacactttggcatga

SEQ ID NO: 419765 - DNA, 25 bp, Rattus norvegicus
ggaatgcaccaagactttggcatga

SEQ ID NO: 419766 - DNA, 25 bp, Rattus norvegicus
ggaatgcacccacacaaaaggctca

SEQ ID NO: 419767 - DNA, 25 bp, Rattus norvegicus
ggaatgcacccagacaaaaggctca

SEQ ID NO: 419768 - DNA, 25 bp, Rattus norvegicus
ggaatgcacgttaatctgcttcccc

SEQ ID NO: 419769 - DNA, 25 bp, Rattus norvegicus
ggaatgcacgtttatctgcttcccc

SEQ ID NO: 419770 - DNA, 25 bp, Rattus norvegicus
ggaatgcacttgctagtttccaatg

SEQ ID NO: 419771 - DNA, 25 bp, Rattus norvegicus
ggaatgcacttggtagtttccaatg

SEQ ID NO: 419772 - DNA, 25 bp, Rattus norvegicus
ggaatgcagacacctttctttcttg

SEQ ID NO: 419773 - DNA, 25 bp, Rattus norvegicus
ggaatgcagacagctttctttcttg

SEQ ID NO: 419774 - DNA, 25 bp, Rattus norvegicus
ggaatgcagcccacatagtctttag

SEQ ID NO: 419775 - DNA, 25 bp, Rattus norvegicus
ggaatgcagccctcatagtctttag

SEQ ID NO: 419776 - DNA, 25 bp, Rattus norvegicus
ggaatgcagggaccctggccaacca

SEQ ID NO: 419777 - DNA, 25 bp, Rattus norvegicus
ggaatgcagggagcctggccaacca

SEQ ID NO: 419778 - DNA, 25 bp, Rattus norvegicus
ggaatgcatcacattttcgtcatac

SEQ ID NO: 419779 - DNA, 25 bp, Rattus norvegicus
ggaatgcatcactttttcgtcatac

SEQ ID NO: 419780 - DNA, 25 bp, Rattus norvegicus
ggaatgccacgtagcactgttataa

SEQ ID NO: 419781 - DNA, 25 bp, Rattus norvegicus
ggaatgccacgttgcactgttataa

SEQ ID NO: 419782 - DNA, 25 bp, Rattus norvegicus
ggaatgcccacaattcaaaggctct

SEQ ID NO: 419783 - DNA, 25 bp, Rattus norvegicus
ggaatgcccacatttcaaaggctct

SEQ ID NO: 419784 - DNA, 25 bp, Rattus norvegicus
ggaatgccccttaagacacataaat

SEQ ID NO: 419785 - DNA, 25 bp, Rattus norvegicus
ggaatgcccctttagacacataaat

SEQ ID NO: 419786 - DNA, 25 bp, Rattus norvegicus
ggaatgcccgtcatgaacttgatga

SEQ ID NO: 419787 - DNA, 25 bp, Rattus norvegicus
ggaatgcccgtcttgaacttgatga

SEQ ID NO: 419788 - DNA, 25 bp, Rattus norvegicus
ggaatgcctacacctagcatatcta

SEQ ID NO: 419789 - DNA, 25 bp, Rattus norvegicus
ggaatgcctacagctagcatatcta

SEQ ID NO: 419790 - DNA, 25 bp, Rattus norvegicus
ggaatgcctccacagtattcaaaag

SEQ ID NO: 419791 - DNA, 25 bp, Rattus norvegicus
ggaatgcctccagagtattcaaaag

SEQ ID NO: 419792 - DNA, 25 bp, Rattus norvegicus
ggaatgcctggactataatgtaagc

SEQ ID NO: 419793 - DNA, 25 bp, Rattus norvegicus
ggaatgcctggacttacgcttacaa

SEQ ID NO: 419794 - DNA, 25 bp, Rattus norvegicus
ggaatgcctggagtataatgtaagc

SEQ ID NO: 419795 - DNA, 25 bp, Rattus norvegicus
ggaatgcctggagttacgcttacaa

SEQ ID NO: 419796 - DNA, 25 bp, Rattus norvegicus
ggaatgcctgttccagaagccacag

SEQ ID NO: 419797 - DNA, 25 bp, Rattus norvegicus
ggaatgcctgttgcagaagccacag

SEQ ID NO: 419798 - DNA, 25 bp, Rattus norvegicus
ggaatgccttttcttgtggacctgc

SEQ ID NO: 419799 - DNA, 25 bp, Rattus norvegicus
ggaatgccttttgttgtggacctgc

SEQ ID NO: 419800 - DNA, 25 bp, Rattus norvegicus
ggaatgctaaaaccgaaatcagatg

SEQ ID NO: 419801 - DNA, 25 bp, Rattus norvegicus
ggaatgctaaaagcgaaatcagatg

SEQ ID NO: 419802 - DNA, 25 bp, Rattus norvegicus
ggaatgctattgagttggtttgtaa

SEQ ID NO: 419803 - DNA, 25 bp, Rattus norvegicus
ggaatgctattgtgttggtttgtaa

SEQ ID NO: 419804 - DNA, 25 bp, Rattus norvegicus
ggaatgctcaatatcatttgccaat

SEQ ID NO: 419805 - DNA, 25 bp, Rattus norvegicus
ggaatgctcaatttcatttgccaat

SEQ ID NO: 419806 - DNA, 25 bp, Rattus norvegicus
ggaatgctcagactggttctgttga

SEQ ID NO: 419807 - DNA, 25 bp, Rattus norvegicus
ggaatgctcagagtggttctgttga

SEQ ID NO: 419808 - DNA, 25 bp, Rattus norvegicus
ggaatgctcggtcttttatcgtgat

SEQ ID NO: 419809 - DNA, 25 bp, Rattus norvegicus
ggaatgctcggtgttttatcgtgat

SEQ ID NO: 419810 - DNA, 25 bp, Rattus norvegicus
ggaatgctctatatgcccaaagttt

SEQ ID NO: 419811 - DNA, 25 bp, Rattus norvegicus
ggaatgctctatttgcccaaagttt

SEQ ID NO: 419812 - DNA, 25 bp, Rattus norvegicus
ggaatgctggatattatgaccttca

SEQ ID NO: 419813 - DNA, 25 bp, Rattus norvegicus
ggaatgctggattttatgaccttca

SEQ ID NO: 419814 - DNA, 25 bp, Rattus norvegicus
ggaatgctggtcatagtttttatat

SEQ ID NO: 419815 - DNA, 25 bp, Rattus norvegicus
ggaatgctggtcttagtttttatat

SEQ ID NO: 419816 - DNA, 25 bp, Rattus norvegicus
ggaatgctgtcaccgtgaccttaga

SEQ ID NO: 419817 - DNA, 25 bp, Rattus norvegicus
ggaatgctgtcagcgtgaccttaga

SEQ ID NO: 419818 - DNA, 25 bp, Rattus norvegicus
ggaatgcttatgcaatcccatccac

SEQ ID NO: 419819 - DNA, 25 bp, Rattus norvegicus
ggaatgcttatggaatcccatccac

SEQ ID NO: 419820 - DNA, 25 bp, Rattus norvegicus
ggaatgcttcacaacttaaaccctg

SEQ ID NO: 419821 - DNA, 25 bp, Rattus norvegicus
ggaatgcttcactacttaaaccctg

SEQ ID NO: 419822 - DNA, 25 bp, Rattus norvegicus
ggaatgcttcttctgtactctcgtt

SEQ ID NO: 419823 - DNA, 25 bp, Rattus norvegicus
ggaatgcttcttgtgtactctcgtt

SEQ ID NO: 419824 - DNA, 25 bp, Rattus norvegicus
ggaatgcttgcgaaaccttgctaaa

SEQ ID NO: 419825 - DNA, 25 bp, Rattus norvegicus
ggaatgcttgcgtaaccttgctaaa

SEQ ID NO: 419826 - DNA, 25 bp, Rattus norvegicus
ggaatgctttcacaccgaaccttta

SEQ ID NO: 419827 - DNA, 25 bp, Rattus norvegicus
ggaatgctttcagaccgaaccttta

SEQ ID NO: 419828 - DNA, 25 bp, Rattus norvegicus
ggaatggaacccaagcagtggcctc

SEQ ID NO: 419829 - DNA, 25 bp, Rattus norvegicus
ggaatggaaccctagcagtggcctc

SEQ ID NO: 419830 - DNA, 25 bp, Rattus norvegicus
ggaatggaaccgatgctaaaagcta

SEQ ID NO: 419831 - DNA, 25 bp, Rattus norvegicus
ggaatggaaccgttgctaaaagcta

SEQ ID NO: 419832 - DNA, 25 bp, Rattus norvegicus
ggaatggaagctcctttgaggcaaa

SEQ ID NO: 419833 - DNA, 25 bp, Rattus norvegicus
ggaatggaagctgctttgaggcaaa

SEQ ID NO: 419834 - DNA, 25 bp, Rattus norvegicus
ggaatggaggccactttgcacgagc

SEQ ID NO: 419835 - DNA, 25 bp, Rattus norvegicus
ggaatggaggcctctttgcacgagc

SEQ ID NO: 419836 - DNA, 25 bp, Rattus norvegicus
ggaatggatccaataccacaaatga

SEQ ID NO: 419837 - DNA, 25 bp, Rattus norvegicus
ggaatggatccattaccacaaatga

SEQ ID NO: 419838 - DNA, 25 bp, Rattus norvegicus
ggaatggatgcgactgtgcacagct

SEQ ID NO: 419839 - DNA, 25 bp, Rattus norvegicus
ggaatggatgcgtctgtgcacagct

SEQ ID NO: 419840 - DNA, 25 bp, Rattus norvegicus
ggaatggcacacactgcttctttaa

SEQ ID NO: 419841 - DNA, 25 bp, Rattus norvegicus
ggaatggcacactctgcttctttaa

SEQ ID NO: 419842 - DNA, 25 bp, Rattus norvegicus
ggaatggcctctatgtgaacctgac

SEQ ID NO: 419843 - DNA, 25 bp, Rattus norvegicus
ggaatggcctctttgtgaacctgac

SEQ ID NO: 419844 - DNA, 25 bp, Rattus norvegicus
ggaatggcgtccaagatagcacttt

SEQ ID NO: 419845 - DNA, 25 bp, Rattus norvegicus
ggaatggcgtcctagatagcacttt

SEQ ID NO: 419846 - DNA, 25 bp, Rattus norvegicus
ggaatggctctgattatggcagcag

SEQ ID NO: 419847 - DNA, 25 bp, Rattus norvegicus
ggaatggctctgtttatggcagcag

SEQ ID NO: 419848 - DNA, 25 bp, Rattus norvegicus
ggaatggctgtcagggagctcacat

SEQ ID NO: 419849 - DNA, 25 bp, Rattus norvegicus
ggaatggctgtctgggagctcacat

SEQ ID NO: 419850 - DNA, 25 bp, Rattus norvegicus
ggaatggcttgtctgtgctgtacat

SEQ ID NO: 419851 - DNA, 25 bp, Rattus norvegicus
ggaatggcttgtgtgtgctgtacat

SEQ ID NO: 419852 - DNA, 25 bp, Rattus norvegicus
ggaatgggaactccacgcagcagat

SEQ ID NO: 419853 - DNA, 25 bp, Rattus norvegicus
ggaatgggaactgcacgcagcagat

SEQ ID NO: 419854 - DNA, 25 bp, Rattus norvegicus
ggaatgggccgacagaaaaccaact

SEQ ID NO: 419855 - DNA, 25 bp, Rattus norvegicus
ggaatgggccgagagaaaaccaact

SEQ ID NO: 419856 - DNA, 25 bp, Rattus norvegicus
ggaatggtaaccattcaaggattgt

SEQ ID NO: 419857 - DNA, 25 bp, Rattus norvegicus
ggaatggtaacctttcaaggattgt

SEQ ID NO: 419858 - DNA, 25 bp, Rattus norvegicus
ggaatggtacccatggacaccaaag

SEQ ID NO: 419859 - DNA, 25 bp, Rattus norvegicus
ggaatggtacccttggacaccaaag

SEQ ID NO: 419860 - DNA, 25 bp, Rattus norvegicus
ggaatggtacctccaggatccctac

SEQ ID NO: 419861 - DNA, 25 bp, Rattus norvegicus
ggaatggtacctgcaggatccctac

SEQ ID NO: 419862 - DNA, 25 bp, Rattus norvegicus
ggaatggtatgcacgttgtacgtct

SEQ ID NO: 419863 - DNA, 25 bp, Rattus norvegicus
ggaatggtatgctcgttgtacgtct

SEQ ID NO: 419864 - DNA, 25 bp, Rattus norvegicus
ggaatggtcctaacaagtctcttta

SEQ ID NO: 419865 - DNA, 25 bp, Rattus norvegicus
ggaatggtcctatcaagtctcttta

SEQ ID NO: 419866 - DNA, 25 bp, Rattus norvegicus
ggaatggtctgcagtgtgctactac

SEQ ID NO: 419867 - DNA, 25 bp, Rattus norvegicus
ggaatggtctgctgtgtgctactac

SEQ ID NO: 419868 - DNA, 25 bp, Rattus norvegicus
ggaatggtggtacacacacaacact

SEQ ID NO: 419869 - DNA, 25 bp, Rattus norvegicus
ggaatggtggtagacacacaacact

SEQ ID NO: 419870 - DNA, 25 bp, Rattus norvegicus
ggaatggttcaacgtgtacaacaag

SEQ ID NO: 419871 - DNA, 25 bp, Rattus norvegicus
ggaatggttcaaggtgtacaacaag

SEQ ID NO: 419872 - DNA, 25 bp, Rattus norvegicus
ggaatggttcctctgcttttattaa

SEQ ID NO: 419873 - DNA, 25 bp, Rattus norvegicus
ggaatggttcctgtgcttttattaa

SEQ ID NO: 419874 - DNA, 25 bp, Rattus norvegicus
ggaatggttctaccgcaagacccag

SEQ ID NO: 419875 - DNA, 25 bp, Rattus norvegicus
ggaatggttctagcgcaagacccag

SEQ ID NO: 419876 - DNA, 25 bp, Rattus norvegicus
ggaatgtaaattcgaccaccggctg

SEQ ID NO: 419877 - DNA, 25 bp, Rattus norvegicus
ggaatgtaaattggaccaccggctg

SEQ ID NO: 419878 - DNA, 25 bp, Rattus norvegicus
ggaatgtaacatccccagtgacacg

SEQ ID NO: 419879 - DNA, 25 bp, Rattus norvegicus
ggaatgtaacatgcccagtgacacg

SEQ ID NO: 419880 - DNA, 25 bp, Rattus norvegicus
ggaatgtaattccttctcctctaca

SEQ ID NO: 419881 - DNA, 25 bp, Rattus norvegicus
ggaatgtaattcgttctcctctaca

SEQ ID NO: 419882 - DNA, 25 bp, Rattus norvegicus
ggaatgtactcgaactgatcgcccc

SEQ ID NO: 419883 - DNA, 25 bp, Rattus norvegicus
ggaatgtactcgtactgatcgcccc

SEQ ID NO: 419884 - DNA, 25 bp, Rattus norvegicus
ggaatgtactggatcctgaccaatt

SEQ ID NO: 419885 - DNA, 25 bp, Rattus norvegicus
ggaatgtactggttcctgaccaatt

SEQ ID NO: 419886 - DNA, 25 bp, Rattus norvegicus
ggaatgtagctacaccgccatccgt

SEQ ID NO: 419887 - DNA, 25 bp, Rattus norvegicus
ggaatgtagctagaccgccatccgt

SEQ ID NO: 419888 - DNA, 25 bp, Rattus norvegicus
ggaatgtagtatatcccgtcctcct

SEQ ID NO: 419889 - DNA, 25 bp, Rattus norvegicus
ggaatgtagtatttcccgtcctcct

SEQ ID NO: 419890 - DNA, 25 bp, Rattus norvegicus
ggaatgtatttccaccttggctgaa

SEQ ID NO: 419891 - DNA, 25 bp, Rattus norvegicus
ggaatgtatttcgaccttggctgaa

SEQ ID NO: 419892 - DNA, 25 bp, Rattus norvegicus
ggaatgtcagaccatggctcagctc

SEQ ID NO: 419893 - DNA, 25 bp, Rattus norvegicus
ggaatgtcagacgatggctcagctc

SEQ ID NO: 419894 - DNA, 25 bp, Rattus norvegicus
ggaatgtcaggtaccctggcgcatg

SEQ ID NO: 419895 - DNA, 25 bp, Rattus norvegicus
ggaatgtcaggttccctggcgcatg

SEQ ID NO: 419896 - DNA, 25 bp, Rattus norvegicus
ggaatgtcccataaactcgggctcc

SEQ ID NO: 419897 - DNA, 25 bp, Rattus norvegicus
ggaatgtcccattaactcgggctcc

SEQ ID NO: 419898 - DNA, 25 bp, Rattus norvegicus
ggaatgtccgatacccttctcagga

SEQ ID NO: 419899 - DNA, 25 bp, Rattus norvegicus
ggaatgtccgattcccttctcagga

SEQ ID NO: 419900 - DNA, 25 bp, Rattus norvegicus
ggaatgtccgtgaagtaccgctact

SEQ ID NO: 419901 - DNA, 25 bp, Rattus norvegicus
ggaatgtccgtgtagtaccgctact

SEQ ID NO: 419902 - DNA, 25 bp, Rattus norvegicus
ggaatgtcctatcaaacgtgaccta

SEQ ID NO: 419903 - DNA, 25 bp, Rattus norvegicus
ggaatgtcctatgaaacgtgaccta

SEQ ID NO: 419904 - DNA, 25 bp, Rattus norvegicus
ggaatgtcctccaagagtgcactga

SEQ ID NO: 419905 - DNA, 25 bp, Rattus norvegicus
ggaatgtcctcctagagtgcactga

SEQ ID NO: 419906 - DNA, 25 bp, Rattus norvegicus
ggaatgtcctctagcacattgtcca

SEQ ID NO: 419907 - DNA, 25 bp, Rattus norvegicus
ggaatgtcctcttgcacattgtcca

SEQ ID NO: 419908 - DNA, 25 bp, Rattus norvegicus
ggaatgtccttcacagtcgagatat

SEQ ID NO: 419909 - DNA, 25 bp, Rattus norvegicus
ggaatgtccttctcagtcgagatat

SEQ ID NO: 419910 - DNA, 25 bp, Rattus norvegicus
ggaatgtcctttcaagtgaagacca

SEQ ID NO: 419911 - DNA, 25 bp, Rattus norvegicus
ggaatgtcctttgaagtgaagacca

SEQ ID NO: 419912 - DNA, 25 bp, Rattus norvegicus
ggaatgtcgaggaaacagcctttga

SEQ ID NO: 419913 - DNA, 25 bp, Rattus norvegicus
ggaatgtcgaggtaacagcctttga

SEQ ID NO: 419914 - DNA, 25 bp, Rattus norvegicus
ggaatgtctcagactgtctcgtcgc

SEQ ID NO: 419915 - DNA, 25 bp, Rattus norvegicus
ggaatgtctcagtctgtctcgtcgc

SEQ ID NO: 419916 - DNA, 25 bp, Rattus norvegicus
ggaatgtctcctacatcagatcaat

SEQ ID NO: 419917 - DNA, 25 bp, Rattus norvegicus
ggaatgtctccttcatcagatcaat

SEQ ID NO: 419918 - DNA, 25 bp, Rattus norvegicus
ggaatgtctgagctgactcactctc

SEQ ID NO: 419919 - DNA, 25 bp, Rattus norvegicus
ggaatgtctgaggtgactcactctc

SEQ ID NO: 419920 - DNA, 25 bp, Rattus norvegicus
ggaatgtcttcaaggcggccttttg

SEQ ID NO: 419921 - DNA, 25 bp, Rattus norvegicus
ggaatgtcttcatggcggccttttg

SEQ ID NO: 419922 - DNA, 25 bp, Rattus norvegicus
ggaatgtcttcccacatcgagagga

SEQ ID NO: 419923 - DNA, 25 bp, Rattus norvegicus
ggaatgtcttccgacatcgagagga

SEQ ID NO: 419924 - DNA, 25 bp, Rattus norvegicus
ggaatgtcttctcggagggctaaac

SEQ ID NO: 419925 - DNA, 25 bp, Rattus norvegicus
ggaatgtcttctgggagggctaaac

SEQ ID NO: 419926 - DNA, 25 bp, Rattus norvegicus
ggaatgtctttcctacggggtacat

SEQ ID NO: 419927 - DNA, 25 bp, Rattus norvegicus
ggaatgtctttcgtacggggtacat

SEQ ID NO: 419928 - DNA, 25 bp, Rattus norvegicus
ggaatgtgaacgcttggctacccct

SEQ ID NO: 419929 - DNA, 25 bp, Rattus norvegicus
ggaatgtgaacggttggctacccct

SEQ ID NO: 419930 - DNA, 25 bp, Rattus norvegicus
ggaatgtgaagcatacttttcgtgt

SEQ ID NO: 419931 - DNA, 25 bp, Rattus norvegicus
ggaatgtgaagcttacttttcgtgt

SEQ ID NO: 419932 - DNA, 25 bp, Rattus norvegicus
ggaatgtgccaccagttatataccc

SEQ ID NO: 419933 - DNA, 25 bp, Rattus norvegicus
ggaatgtgccacgagttatataccc

SEQ ID NO: 419934 - DNA, 25 bp, Rattus norvegicus
ggaatgtggatcaggtttactagca

SEQ ID NO: 419935 - DNA, 25 bp, Rattus norvegicus
ggaatgtggatctggtttactagca

SEQ ID NO: 419936 - DNA, 25 bp, Rattus norvegicus
ggaatgtggcgccaatgcagaatta

SEQ ID NO: 419937 - DNA, 25 bp, Rattus norvegicus
ggaatgtggcgcgaatgcagaatta

SEQ ID NO: 419938 - DNA, 25 bp, Rattus norvegicus
ggaatgtgggtcaccttgcaacctg

SEQ ID NO: 419939 - DNA, 25 bp, Rattus norvegicus
ggaatgtgggtctccttgcaacctg

SEQ ID NO: 419940 - DNA, 25 bp, Rattus norvegicus
ggaatgtgtctacatagccacagta

SEQ ID NO: 419941 - DNA, 25 bp, Rattus norvegicus
ggaatgtgtctactccacttgggac

SEQ ID NO: 419942 - DNA, 25 bp, Rattus norvegicus
ggaatgtgtctagatagccacagta

SEQ ID NO: 419943 - DNA, 25 bp, Rattus norvegicus
ggaatgtgtctagtccacttgggac

SEQ ID NO: 419944 - DNA, 25 bp, Rattus norvegicus
ggaatgtgttcaagatgctctgcat

SEQ ID NO: 419945 - DNA, 25 bp, Rattus norvegicus
ggaatgtgttcatgatgctctgcat

SEQ ID NO: 419946 - DNA, 25 bp, Rattus norvegicus
ggaatgtgttccactgtagactata

SEQ ID NO: 419947 - DNA, 25 bp, Rattus norvegicus
ggaatgtgttcctctgtagactata

SEQ ID NO: 419948 - DNA, 25 bp, Rattus norvegicus
ggaatgtgttgcctaattctaccaa

SEQ ID NO: 419949 - DNA, 25 bp, Rattus norvegicus
ggaatgtgttgcgtaattctaccaa

SEQ ID NO: 419950 - DNA, 25 bp, Rattus norvegicus
ggaatgttactgattccctccattt

SEQ ID NO: 419951 - DNA, 25 bp, Rattus norvegicus
ggaatgttactgtttccctccattt

SEQ ID NO: 419952 - DNA, 25 bp, Rattus norvegicus
ggaatgttcattccctgtacctgac

SEQ ID NO: 419953 - DNA, 25 bp, Rattus norvegicus
ggaatgttcattgcctgtacctgac

SEQ ID NO: 419954 - DNA, 25 bp, Rattus norvegicus
ggaatgttctacacaaccacagggt

SEQ ID NO: 419955 - DNA, 25 bp, Rattus norvegicus
ggaatgttctactcaaccacagggt

SEQ ID NO: 419956 - DNA, 25 bp, Rattus norvegicus
ggaatgttctggaacttggcataac

SEQ ID NO: 419957 - DNA, 25 bp, Rattus norvegicus
ggaatgttctggtacttggcataac

SEQ ID NO: 419958 - DNA, 25 bp, Rattus norvegicus
ggaatgttcttaccaactgttcata

SEQ ID NO: 419959 - DNA, 25 bp, Rattus norvegicus
ggaatgttcttagcaactgttcata

SEQ ID NO: 419960 - DNA, 25 bp, Rattus norvegicus
ggaatgttctttcccttattcagag

SEQ ID NO: 419961 - DNA, 25 bp, Rattus norvegicus
ggaatgttctttgccttattcagag

SEQ ID NO: 419962 - DNA, 25 bp, Rattus norvegicus
ggaatgttgatactgcacacccact

SEQ ID NO: 419963 - DNA, 25 bp, Rattus norvegicus
ggaatgttgatagtgcacacccact

SEQ ID NO: 419964 - DNA, 25 bp, Rattus norvegicus
ggaatgtttccaattgccaaatcct

SEQ ID NO: 419965 - DNA, 25 bp, Rattus norvegicus
ggaatgtttccatttgccaaatcct

SEQ ID NO: 419966 - DNA, 25 bp, Rattus norvegicus
ggaatgtttcccagttaacaagcta

SEQ ID NO: 419967 - DNA, 25 bp, Rattus norvegicus
ggaatgtttccctgttaacaagcta

SEQ ID NO: 419968 - DNA, 25 bp, Rattus norvegicus
ggaatgtttctacacgatcctatta

SEQ ID NO: 419969 - DNA, 25 bp, Rattus norvegicus
ggaatgtttctagacgatcctatta

SEQ ID NO: 419970 - DNA, 25 bp, Rattus norvegicus
ggaatgtttctcaaactccatgcac

SEQ ID NO: 419971 - DNA, 25 bp, Rattus norvegicus
ggaatgtttctcatttgccagttga

SEQ ID NO: 419972 - DNA, 25 bp, Rattus norvegicus
ggaatgtttctctaactccatgcac

SEQ ID NO: 419973 - DNA, 25 bp, Rattus norvegicus
ggaatgtttctcttttgccagttga

SEQ ID NO: 419974 - DNA, 25 bp, Rattus norvegicus
ggaatgtttgaccagaaactctgta

SEQ ID NO: 419975 - DNA, 25 bp, Rattus norvegicus
ggaatgtttgacgagaaactctgta

SEQ ID NO: 419976 - DNA, 25 bp, Rattus norvegicus
ggaatgtttgatatctgacccatga

SEQ ID NO: 419977 - DNA, 25 bp, Rattus norvegicus
ggaatgtttgatttctgacccatga

SEQ ID NO: 419978 - DNA, 25 bp, Rattus norvegicus
ggaatgtttgggaagctgttaatga

SEQ ID NO: 419979 - DNA, 25 bp, Rattus norvegicus
ggaatgtttgggtagctgttaatga

SEQ ID NO: 419980 - DNA, 25 bp, Rattus norvegicus
ggaatgttttgccatttctcaaact

SEQ ID NO: 419981 - DNA, 25 bp, Rattus norvegicus
ggaatgttttgcgatttctcaaact

SEQ ID NO: 419982 - DNA, 25 bp, Rattus norvegicus
ggaattaaaatcataggcctacaca

SEQ ID NO: 419983 - DNA, 25 bp, Rattus norvegicus
ggaattaaaatcttaggcctacaca

SEQ ID NO: 419984 - DNA, 25 bp, Rattus norvegicus
ggaattaaaggaagcccgtgctgcc

SEQ ID NO: 419985 - DNA, 25 bp, Rattus norvegicus
ggaattaaaggatgcccgtgctgcc

SEQ ID NO: 419986 - DNA, 25 bp, Rattus norvegicus
ggaattaaatggctctgtctgtact

SEQ ID NO: 419987 - DNA, 25 bp, Rattus norvegicus
ggaattaaatgggtctgtctgtact

SEQ ID NO: 419988 - DNA, 25 bp, Rattus norvegicus
ggaattaaggctccctctggactgt

SEQ ID NO: 419989 - DNA, 25 bp, Rattus norvegicus
ggaattaaggctgcctctggactgt

SEQ ID NO: 419990 - DNA, 25 bp, Rattus norvegicus
ggaattaagtaaatgctatttttgt

SEQ ID NO: 419991 - DNA, 25 bp, Rattus norvegicus
ggaattaagtaattgctatttttgt

SEQ ID NO: 419992 - DNA, 25 bp, Rattus norvegicus
ggaattaatctcacgttcagccttt

SEQ ID NO: 419993 - DNA, 25 bp, Rattus norvegicus
ggaattaatctctcgttcagccttt

SEQ ID NO: 419994 - DNA, 25 bp, Rattus norvegicus
ggaattaatgacctggacttgacca

SEQ ID NO: 419995 - DNA, 25 bp, Rattus norvegicus
ggaattaatgacgtggacttgacca

SEQ ID NO: 419996 - DNA, 25 bp, Rattus norvegicus
ggaattaattccatactgacttatt

SEQ ID NO: 419997 - DNA, 25 bp, Rattus norvegicus
ggaattaattccttactgacttatt

SEQ ID NO: 419998 - DNA, 25 bp, Rattus norvegicus
ggaattacaaaccatcgctacctac

SEQ ID NO: 419999 - DNA, 25 bp, Rattus norvegicus
ggaattacaaacgatcgctacctac

SEQ ID NO: 420000 - DNA, 25 bp, Rattus norvegicus
ggaattacatgaacataccacctta

SEQ ID NO: 420001 - DNA, 25 bp, Rattus norvegicus
ggaattacatgatcataccacctta

SEQ ID NO: 420002 - DNA, 25 bp, Rattus norvegicus
ggaattacccagcacacagtggcaa

SEQ ID NO: 420003 - DNA, 25 bp, Rattus norvegicus
ggaattacccaggacacagtggcaa

SEQ ID NO: 420004 - DNA, 25 bp, Rattus norvegicus
ggaattacctcccaagttgacattt

SEQ ID NO: 420005 - DNA, 25 bp, Rattus norvegicus
ggaattacctccgaagttgacattt

SEQ ID NO: 420006 - DNA, 25 bp, Rattus norvegicus
ggaattacgtttactgttcatacaa

SEQ ID NO: 420007 - DNA, 25 bp, Rattus norvegicus
ggaattacgttttctgttcatacaa

SEQ ID NO: 420008 - DNA, 25 bp, Rattus norvegicus
ggaattacttatctcgactagcctc

SEQ ID NO: 420009 - DNA, 25 bp, Rattus norvegicus
ggaattacttatgtcgactagcctc

SEQ ID NO: 420010 - DNA, 25 bp, Rattus norvegicus
ggaattagcacccaacatttctgtc

SEQ ID NO: 420011 - DNA, 25 bp, Rattus norvegicus
ggaattagcaccgaacatttctgtc

SEQ ID NO: 420012 - DNA, 25 bp, Rattus norvegicus
ggaattagcagtacttacacacata

SEQ ID NO: 420013 - DNA, 25 bp, Rattus norvegicus
ggaattagcagttcttacacacata

SEQ ID NO: 420014 - DNA, 25 bp, Rattus norvegicus
ggaattaggactatttaacatgcag

SEQ ID NO: 420015 - DNA, 25 bp, Rattus norvegicus
ggaattaggactttttaacatgcag

SEQ ID NO: 420016 - DNA, 25 bp, Rattus norvegicus
ggaattagtcacacagaagcctgtc

SEQ ID NO: 420017 - DNA, 25 bp, Rattus norvegicus
ggaattagtcactcagaagcctgtc

SEQ ID NO: 420018 - DNA, 25 bp, Rattus norvegicus
ggaattagtcttatgtgaacacgtt

SEQ ID NO: 420019 - DNA, 25 bp, Rattus norvegicus
ggaattagtcttttgtgaacacgtt

SEQ ID NO: 420020 - DNA, 25 bp, Rattus norvegicus
ggaattagtggactttcgtcattaa

SEQ ID NO: 420021 - DNA, 25 bp, Rattus norvegicus
ggaattagtggagtttcgtcattaa

SEQ ID NO: 420022 - DNA, 25 bp, Rattus norvegicus
ggaattagtgttctttttgcaatac

SEQ ID NO: 420023 - DNA, 25 bp, Rattus norvegicus
ggaattagtgttgtttttgcaatac

SEQ ID NO: 420024 - DNA, 25 bp, Rattus norvegicus
ggaattatattactagaactatgca

SEQ ID NO: 420025 - DNA, 25 bp, Rattus norvegicus
ggaattatattagtagaactatgca

SEQ ID NO: 420026 - DNA, 25 bp, Rattus norvegicus
ggaattatcaccatgtctttctata

SEQ ID NO: 420027 - DNA, 25 bp, Rattus norvegicus
ggaattatcaccttgtctttctata

SEQ ID NO: 420028 - DNA, 25 bp, Rattus norvegicus
ggaattatcatcacctaaacctgtt

SEQ ID NO: 420029 - DNA, 25 bp, Rattus norvegicus
ggaattatcatcctcactagtggga

SEQ ID NO: 420030 - DNA, 25 bp, Rattus norvegicus
ggaattatcatcgtcactagtggga

SEQ ID NO: 420031 - DNA, 25 bp, Rattus norvegicus
ggaattatcatctcctaaacctgtt

SEQ ID NO: 420032 - DNA, 25 bp, Rattus norvegicus
ggaattatgggaatgcctcctctgc

SEQ ID NO: 420033 - DNA, 25 bp, Rattus norvegicus
ggaattatgggattgcctcctctgc

SEQ ID NO: 420034 - DNA, 25 bp, Rattus norvegicus
ggaattatgtttaccaaaattgagc

SEQ ID NO: 420035 - DNA, 25 bp, Rattus norvegicus
ggaattatgttttccaaaattgagc

SEQ ID NO: 420036 - DNA, 25 bp, Rattus norvegicus
ggaattattacaagaggctcagtgc

SEQ ID NO: 420037 - DNA, 25 bp, Rattus norvegicus
ggaattattacatgaggctcagtgc

SEQ ID NO: 420038 - DNA, 25 bp, Rattus norvegicus
ggaattatttcgcacacggaccatt

SEQ ID NO: 420039 - DNA, 25 bp, Rattus norvegicus
ggaattatttcggacacggaccatt

SEQ ID NO: 420040 - DNA, 25 bp, Rattus norvegicus
ggaattcacagaccaacaagcgtgt

SEQ ID NO: 420041 - DNA, 25 bp, Rattus norvegicus
ggaattcacagagcaacaagcgtgt

SEQ ID NO: 420042 - DNA, 25 bp, Rattus norvegicus
ggaattcactaccaagcagagtcta

SEQ ID NO: 420043 - DNA, 25 bp, Rattus norvegicus
ggaattcactacgaagcagagtcta

SEQ ID NO: 420044 - DNA, 25 bp, Rattus norvegicus
ggaattcagcaccaaggcaacactt

SEQ ID NO: 420045 - DNA, 25 bp, Rattus norvegicus
ggaattcagcacgaaggcaacactt

SEQ ID NO: 420046 - DNA, 25 bp, Rattus norvegicus
ggaattcagggaacttgcctctgcc

SEQ ID NO: 420047 - DNA, 25 bp, Rattus norvegicus
ggaattcagggatcttgcctctgcc

SEQ ID NO: 420048 - DNA, 25 bp, Rattus norvegicus
ggaattcaggttccagaccactctg

SEQ ID NO: 420049 - DNA, 25 bp, Rattus norvegicus
ggaattcaggttgcagaccactctg

SEQ ID NO: 420050 - DNA, 25 bp, Rattus norvegicus
ggaattcagtttattgaccgtatca

SEQ ID NO: 420051 - DNA, 25 bp, Rattus norvegicus
ggaattcagttttttgaccgtatca

SEQ ID NO: 420052 - DNA, 25 bp, Rattus norvegicus
ggaattcattttctattaccagtgg

SEQ ID NO: 420053 - DNA, 25 bp, Rattus norvegicus
ggaattcattttgtattaccagtgg

SEQ ID NO: 420054 - DNA, 25 bp, Rattus norvegicus
ggaattccacaccaaggtatgcatg

SEQ ID NO: 420055 - DNA, 25 bp, Rattus norvegicus
ggaattccacacgaaggtatgcatg

SEQ ID NO: 420056 - DNA, 25 bp, Rattus norvegicus
ggaattccaccactctgaattgtta

SEQ ID NO: 420057 - DNA, 25 bp, Rattus norvegicus
ggaattccaccagtctgaattgtta

SEQ ID NO: 420058 - DNA, 25 bp, Rattus norvegicus
ggaattccagaaccacaccgcgatc

SEQ ID NO: 420059 - DNA, 25 bp, Rattus norvegicus
ggaattccagaagcacaccgcgatc

SEQ ID NO: 420060 - DNA, 25 bp, Rattus norvegicus
ggaattccatgcaatgcctgtgcca

SEQ ID NO: 420061 - DNA, 25 bp, Rattus norvegicus
ggaattccatgctatgcctgtgcca

SEQ ID NO: 420062 - DNA, 25 bp, Rattus norvegicus
ggaattcccaatagtagccaggcta

SEQ ID NO: 420063 - DNA, 25 bp, Rattus norvegicus
ggaattcccaattgtagccaggcta

SEQ ID NO: 420064 - DNA, 25 bp, Rattus norvegicus
ggaattccccagatgcctttaagcg

SEQ ID NO: 420065 - DNA, 25 bp, Rattus norvegicus
ggaattccccagttgcctttaagcg

SEQ ID NO: 420066 - DNA, 25 bp, Rattus norvegicus
ggaattcccgaaacttgtcttctgg

SEQ ID NO: 420067 - DNA, 25 bp, Rattus norvegicus
ggaattcccgaatcttgtcttctgg

SEQ ID NO: 420068 - DNA, 25 bp, Rattus norvegicus
ggaattccctgcactttgagtggag

SEQ ID NO: 420069 - DNA, 25 bp, Rattus norvegicus
ggaattccctgctctttgagtggag

SEQ ID NO: 420070 - DNA, 25 bp, Rattus norvegicus
ggaattccctttactcatgatcata

SEQ ID NO: 420071 - DNA, 25 bp, Rattus norvegicus
ggaattcccttttctcatgatcata

SEQ ID NO: 420072 - DNA, 25 bp, Rattus norvegicus
ggaattccgatacatgatcacccca

SEQ ID NO: 420073 - DNA, 25 bp, Rattus norvegicus
ggaattccgatagatgatcacccca

SEQ ID NO: 420074 - DNA, 25 bp, Rattus norvegicus
ggaattcctaggaggcctgaagcgt

SEQ ID NO: 420075 - DNA, 25 bp, Rattus norvegicus
ggaattcctaggtggcctgaagcgt

SEQ ID NO: 420076 - DNA, 25 bp, Rattus norvegicus
ggaattcctcagactgatggctgtt

SEQ ID NO: 420077 - DNA, 25 bp, Rattus norvegicus
ggaattcctcagtctgatggctgtt

SEQ ID NO: 420078 - DNA, 25 bp, Rattus norvegicus
ggaattccttttagcaccagatcag

SEQ ID NO: 420079 - DNA, 25 bp, Rattus norvegicus
ggaattcctttttgcaccagatcag

SEQ ID NO: 420080 - DNA, 25 bp, Rattus norvegicus
ggaattcgatgaaatcaccccagat

SEQ ID NO: 420081 - DNA, 25 bp, Rattus norvegicus
ggaattcgatgatatcaccccagat

SEQ ID NO: 420082 - DNA, 25 bp, Rattus norvegicus
ggaattcggcgcacaggagagctca

SEQ ID NO: 420083 - DNA, 25 bp, Rattus norvegicus
ggaattcggcgctcaggagagctca

SEQ ID NO: 420084 - DNA, 25 bp, Rattus norvegicus
ggaattctaacgctaacacaggact

SEQ ID NO: 420085 - DNA, 25 bp, Rattus norvegicus
ggaattctaacggtaacacaggact

SEQ ID NO: 420086 - DNA, 25 bp, Rattus norvegicus
ggaattctaactacacactgttggg

SEQ ID NO: 420087 - DNA, 25 bp, Rattus norvegicus
ggaattctaacttcacactgttggg

SEQ ID NO: 420088 - DNA, 25 bp, Rattus norvegicus
ggaattctacctcttcagaacaggg

SEQ ID NO: 420089 - DNA, 25 bp, Rattus norvegicus
ggaattctacctgttcagaacaggg

SEQ ID NO: 420090 - DNA, 25 bp, Rattus norvegicus
ggaattctagatctcacactttgga

SEQ ID NO: 420091 - DNA, 25 bp, Rattus norvegicus
ggaattctagatgtcacactttgga

SEQ ID NO: 420092 - DNA, 25 bp, Rattus norvegicus
ggaattctattaactgtcccatcct

SEQ ID NO: 420093 - DNA, 25 bp, Rattus norvegicus
ggaattctattatctgtcccatcct

SEQ ID NO: 420094 - DNA, 25 bp, Rattus norvegicus
ggaattctcaagagtgccaacatgg

SEQ ID NO: 420095 - DNA, 25 bp, Rattus norvegicus
ggaattctcaagtgtgccaacatgg

SEQ ID NO: 420096 - DNA, 25 bp, Rattus norvegicus
ggaattctcatccagacaacctatc

SEQ ID NO: 420097 - DNA, 25 bp, Rattus norvegicus
ggaattctcatcgagacaacctatc

SEQ ID NO: 420098 - DNA, 25 bp, Rattus norvegicus
ggaattctccaacacatcgatatgc

SEQ ID NO: 420099 - DNA, 25 bp, Rattus norvegicus
ggaattctccaagacatcgatatgc

SEQ ID NO: 420100 - DNA, 25 bp, Rattus norvegicus
ggaattctcctacttaatcacacag

SEQ ID NO: 420101 - DNA, 25 bp, Rattus norvegicus
ggaattctcctagttaatcacacag

SEQ ID NO: 420102 - DNA, 25 bp, Rattus norvegicus
ggaattctgagtccttggctctaga

SEQ ID NO: 420103 - DNA, 25 bp, Rattus norvegicus
ggaattctgagtgcttggctctaga

SEQ ID NO: 420104 - DNA, 25 bp, Rattus norvegicus
ggaattctgataacttcgtcaggga

SEQ ID NO: 420105 - DNA, 25 bp, Rattus norvegicus
ggaattctgatacctctgggcttct

SEQ ID NO: 420106 - DNA, 25 bp, Rattus norvegicus
ggaattctgatagctctgggcttct

SEQ ID NO: 420107 - DNA, 25 bp, Rattus norvegicus
ggaattctgatatcttcgtcaggga

SEQ ID NO: 420108 - DNA, 25 bp, Rattus norvegicus
ggaattctgcagatttggcgttatc

SEQ ID NO: 420109 - DNA, 25 bp, Rattus norvegicus
ggaattctgcagttttggcgttatc

SEQ ID NO: 420110 - DNA, 25 bp, Rattus norvegicus
ggaattctgtagcacaccttatagg

SEQ ID NO: 420111 - DNA, 25 bp, Rattus norvegicus
ggaattctgtaggacaccttatagg

SEQ ID NO: 420112 - DNA, 25 bp, Rattus norvegicus
ggaattctgtgaccttgggctagtt

SEQ ID NO: 420113 - DNA, 25 bp, Rattus norvegicus
ggaattctgtgagcttgggctagtt

SEQ ID NO: 420114 - DNA, 25 bp, Rattus norvegicus
ggaattctgtgcctatttactcaag

SEQ ID NO: 420115 - DNA, 25 bp, Rattus norvegicus
ggaattctgtgcgtatttactcaag

SEQ ID NO: 420116 - DNA, 25 bp, Rattus norvegicus
ggaattcttcaccaggttcaaaact

SEQ ID NO: 420117 - DNA, 25 bp, Rattus norvegicus
ggaattcttcacgaggttcaaaact

SEQ ID NO: 420118 - DNA, 25 bp, Rattus norvegicus
ggaattcttccgagcccctgggttg

SEQ ID NO: 420119 - DNA, 25 bp, Rattus norvegicus
ggaattcttccgtgcccctgggttg

SEQ ID NO: 420120 - DNA, 25 bp, Rattus norvegicus
ggaattcttgagacgtgtgatgagc

SEQ ID NO: 420121 - DNA, 25 bp, Rattus norvegicus
ggaattcttgagcttcactccttgt

SEQ ID NO: 420122 - DNA, 25 bp, Rattus norvegicus
ggaattcttgaggttcactccttgt

SEQ ID NO: 420123 - DNA, 25 bp, Rattus norvegicus
ggaattcttgagtcgtgtgatgagc

SEQ ID NO: 420124 - DNA, 25 bp, Rattus norvegicus
ggaattctttgacttcacttacgat

SEQ ID NO: 420125 - DNA, 25 bp, Rattus norvegicus
ggaattctttgagttcacttacgat

SEQ ID NO: 420126 - DNA, 25 bp, Rattus norvegicus
ggaattgaagccacagccaatcatg

SEQ ID NO: 420127 - DNA, 25 bp, Rattus norvegicus
ggaattgaagcctcagccaatcatg

SEQ ID NO: 420128 - DNA, 25 bp, Rattus norvegicus
ggaattgaagtcagttacctaatgg

SEQ ID NO: 420129 - DNA, 25 bp, Rattus norvegicus
ggaattgaagtctgttacctaatgg

SEQ ID NO: 420130 - DNA, 25 bp, Rattus norvegicus
ggaattgaatttccatctacttata

SEQ ID NO: 420131 - DNA, 25 bp, Rattus norvegicus
ggaattgaatttgcatctacttata

SEQ ID NO: 420132 - DNA, 25 bp, Rattus norvegicus
ggaattgactgcagcacaccggagg

SEQ ID NO: 420133 - DNA, 25 bp, Rattus norvegicus
ggaattgactgctgcacaccggagg

SEQ ID NO: 420134 - DNA, 25 bp, Rattus norvegicus
ggaattgagatcactgctcctagat

SEQ ID NO: 420135 - DNA, 25 bp, Rattus norvegicus
ggaattgagatctctgctcctagat

SEQ ID NO: 420136 - DNA, 25 bp, Rattus norvegicus
ggaattgataggactctagctttga

SEQ ID NO: 420137 - DNA, 25 bp, Rattus norvegicus
ggaattgataggtctctagctttga

SEQ ID NO: 420138 - DNA, 25 bp, Rattus norvegicus
ggaattgatcagagccctctagcct

SEQ ID NO: 420139 - DNA, 25 bp, Rattus norvegicus
ggaattgatcagtgccctctagcct

SEQ ID NO: 420140 - DNA, 25 bp, Rattus norvegicus
ggaattgcaagtccatgctacccag

SEQ ID NO: 420141 - DNA, 25 bp, Rattus norvegicus
ggaattgcaagtgcatgctacccag

SEQ ID NO: 420142 - DNA, 25 bp, Rattus norvegicus
ggaattgcactgcttcagatttttg

SEQ ID NO: 420143 - DNA, 25 bp, Rattus norvegicus
ggaattgcactggttcagatttttg

SEQ ID NO: 420144 - DNA, 25 bp, Rattus norvegicus
ggaattgcagcactggtcccaatgg

SEQ ID NO: 420145 - DNA, 25 bp, Rattus norvegicus
ggaattgcagcagtggtcccaatgg

SEQ ID NO: 420146 - DNA, 25 bp, Rattus norvegicus
ggaattgcagtcaggacctctggga

SEQ ID NO: 420147 - DNA, 25 bp, Rattus norvegicus
ggaattgcagtctggacctctggga

SEQ ID NO: 420148 - DNA, 25 bp, Rattus norvegicus
ggaattgccaccaagattactctaa

SEQ ID NO: 420149 - DNA, 25 bp, Rattus norvegicus
ggaattgccacctagattactctaa

SEQ ID NO: 420150 - DNA, 25 bp, Rattus norvegicus
ggaattgcctaacaaatcacaccct

SEQ ID NO: 420151 - DNA, 25 bp, Rattus norvegicus
ggaattgcctaagaaatcacaccct

SEQ ID NO: 420152 - DNA, 25 bp, Rattus norvegicus
ggaattgccttaatagagccctagt

SEQ ID NO: 420153 - DNA, 25 bp, Rattus norvegicus
ggaattgccttattagagccctagt

SEQ ID NO: 420154 - DNA, 25 bp, Rattus norvegicus
ggaattgctgaaacatctctcccac

SEQ ID NO: 420155 - DNA, 25 bp, Rattus norvegicus
ggaattgctgaatcatctctcccac

SEQ ID NO: 420156 - DNA, 25 bp, Rattus norvegicus
ggaattgcttccattaaactgtatt

SEQ ID NO: 420157 - DNA, 25 bp, Rattus norvegicus
ggaattgcttcccagtacacataca

SEQ ID NO: 420158 - DNA, 25 bp, Rattus norvegicus
ggaattgcttccgagtacacataca

SEQ ID NO: 420159 - DNA, 25 bp, Rattus norvegicus
ggaattgcttcctttaaactgtatt

SEQ ID NO: 420160 - DNA, 25 bp, Rattus norvegicus
ggaattgcttgtcagactctaaaga

SEQ ID NO: 420161 - DNA, 25 bp, Rattus norvegicus
ggaattgcttgtgagactctaaaga

SEQ ID NO: 420162 - DNA, 25 bp, Rattus norvegicus
ggaattgcttttctactgacaggag

SEQ ID NO: 420163 - DNA, 25 bp, Rattus norvegicus
ggaattgcttttgtactgacaggag

SEQ ID NO: 420164 - DNA, 25 bp, Rattus norvegicus
ggaattggcccacggtctccagtca

SEQ ID NO: 420165 - DNA, 25 bp, Rattus norvegicus
ggaattggcccagggtctccagtca

SEQ ID NO: 420166 - DNA, 25 bp, Rattus norvegicus
ggaattggctatccatacccgcgtg

SEQ ID NO: 420167 - DNA, 25 bp, Rattus norvegicus
ggaattggctatgcatacccgcgtg

SEQ ID NO: 420168 - DNA, 25 bp, Rattus norvegicus
ggaattgggaacaccttggcctcta

SEQ ID NO: 420169 - DNA, 25 bp, Rattus norvegicus
ggaattgggaactccttggcctcta

SEQ ID NO: 420170 - DNA, 25 bp, Rattus norvegicus
ggaattgggcatatgttgactctgg

SEQ ID NO: 420171 - DNA, 25 bp, Rattus norvegicus
ggaattgggcatttgttgactctgg

SEQ ID NO: 420172 - DNA, 25 bp, Rattus norvegicus
ggaattgggctcctgacagcagtct

SEQ ID NO: 420173 - DNA, 25 bp, Rattus norvegicus
ggaattgggctcgtgacagcagtct

SEQ ID NO: 420174 - DNA, 25 bp, Rattus norvegicus
ggaattgtactgagttcctggcccc

SEQ ID NO: 420175 - DNA, 25 bp, Rattus norvegicus
ggaattgtactgtgttcctggcccc

SEQ ID NO: 420176 - DNA, 25 bp, Rattus norvegicus
ggaattgtcattaccttggccatct

SEQ ID NO: 420177 - DNA, 25 bp, Rattus norvegicus
ggaattgtcatttccttggccatct

SEQ ID NO: 420178 - DNA, 25 bp, Rattus norvegicus
ggaattgtcctactgtgtgaagtta

SEQ ID NO: 420179 - DNA, 25 bp, Rattus norvegicus
ggaattgtcctagtgtgtgaagtta

SEQ ID NO: 420180 - DNA, 25 bp, Rattus norvegicus
ggaattgtcttccaataccttgtca

SEQ ID NO: 420181 - DNA, 25 bp, Rattus norvegicus
ggaattgtcttcgaataccttgtca

SEQ ID NO: 420182 - DNA, 25 bp, Rattus norvegicus
ggaattgtcttgactccattgtcct

SEQ ID NO: 420183 - DNA, 25 bp, Rattus norvegicus
ggaattgtcttgtctccattgtcct

SEQ ID NO: 420184 - DNA, 25 bp, Rattus norvegicus
ggaattgtgcatccctcagaggtag

SEQ ID NO: 420185 - DNA, 25 bp, Rattus norvegicus
ggaattgtgcatgcctcagaggtag

SEQ ID NO: 420186 - DNA, 25 bp, Rattus norvegicus
ggaattgttcagaggcctctgactc

SEQ ID NO: 420187 - DNA, 25 bp, Rattus norvegicus
ggaattgttcagtggcctctgactc

SEQ ID NO: 420188 - DNA, 25 bp, Rattus norvegicus
ggaattgttcctatagtatctgtag

SEQ ID NO: 420189 - DNA, 25 bp, Rattus norvegicus
ggaattgttcctccgtagttctgaa

SEQ ID NO: 420190 - DNA, 25 bp, Rattus norvegicus
ggaattgttcctgcgtagttctgaa

SEQ ID NO: 420191 - DNA, 25 bp, Rattus norvegicus
ggaattgttcctttagtatctgtag

SEQ ID NO: 420192 - DNA, 25 bp, Rattus norvegicus
ggaattgttggcacactccatcaga

SEQ ID NO: 420193 - DNA, 25 bp, Rattus norvegicus
ggaattgttggctcactccatcaga

SEQ ID NO: 420194 - DNA, 25 bp, Rattus norvegicus
ggaattgttttcctccttaaatgct

SEQ ID NO: 420195 - DNA, 25 bp, Rattus norvegicus
ggaattgttttcgtccttaaatgct

SEQ ID NO: 420196 - DNA, 25 bp, Rattus norvegicus
ggaatttaaatcacttgtcagcttg

SEQ ID NO: 420197 - DNA, 25 bp, Rattus norvegicus
ggaatttaaatctcttgtcagcttg

SEQ ID NO: 420198 - DNA, 25 bp, Rattus norvegicus
ggaatttaaatgagccgggccgagc

SEQ ID NO: 420199 - DNA, 25 bp, Rattus norvegicus
ggaatttaaatgtgccgggccgagc

SEQ ID NO: 420200 - DNA, 25 bp, Rattus norvegicus
ggaatttaaggtatgtcagctatga

SEQ ID NO: 420201 - DNA, 25 bp, Rattus norvegicus
ggaatttaaggtttgtcagctatga

SEQ ID NO: 420202 - DNA, 25 bp, Rattus norvegicus
ggaatttaccccagatggtttgtgt

SEQ ID NO: 420203 - DNA, 25 bp, Rattus norvegicus
ggaatttacccctgatggtttgtgt

SEQ ID NO: 420204 - DNA, 25 bp, Rattus norvegicus
ggaatttacgtcatttaatcacaat

SEQ ID NO: 420205 - DNA, 25 bp, Rattus norvegicus
ggaatttacgtcttttaatcacaat

SEQ ID NO: 420206 - DNA, 25 bp, Rattus norvegicus
ggaatttacttcctccatattttga

SEQ ID NO: 420207 - DNA, 25 bp, Rattus norvegicus
ggaatttacttcgtccatattttga

SEQ ID NO: 420208 - DNA, 25 bp, Rattus norvegicus
ggaatttagactctggtggcccagt

SEQ ID NO: 420209 - DNA, 25 bp, Rattus norvegicus
ggaatttagactgtggtggcccagt

SEQ ID NO: 420210 - DNA, 25 bp, Rattus norvegicus
ggaatttagtgaactgtatccataa

SEQ ID NO: 420211 - DNA, 25 bp, Rattus norvegicus
ggaatttagtgatctgtatccataa

SEQ ID NO: 420212 - DNA, 25 bp, Rattus norvegicus
ggaatttatctgactctgatcagga

SEQ ID NO: 420213 - DNA, 25 bp, Rattus norvegicus
ggaatttatctgtctctgatcagga

SEQ ID NO: 420214 - DNA, 25 bp, Rattus norvegicus
ggaatttattacagttctacctaga

SEQ ID NO: 420215 - DNA, 25 bp, Rattus norvegicus
ggaatttattactgttctacctaga

SEQ ID NO: 420216 - DNA, 25 bp, Rattus norvegicus
ggaatttcacatcacatgccctgat

SEQ ID NO: 420217 - DNA, 25 bp, Rattus norvegicus
ggaatttcacatgacatgccctgat

SEQ ID NO: 420218 - DNA, 25 bp, Rattus norvegicus
ggaatttcacctatctttcagatta

SEQ ID NO: 420219 - DNA, 25 bp, Rattus norvegicus
ggaatttcacctttctttcagatta

SEQ ID NO: 420220 - DNA, 25 bp, Rattus norvegicus
ggaatttcaggcacaaaagcctcta

SEQ ID NO: 420221 - DNA, 25 bp, Rattus norvegicus
ggaatttcaggctcaaaagcctcta

SEQ ID NO: 420222 - DNA, 25 bp, Rattus norvegicus
ggaatttcatgaaccaggacaccaa

SEQ ID NO: 420223 - DNA, 25 bp, Rattus norvegicus
ggaatttcatgatccaggacaccaa

SEQ ID NO: 420224 - DNA, 25 bp, Rattus norvegicus
ggaatttccaccatatccaaagcct

SEQ ID NO: 420225 - DNA, 25 bp, Rattus norvegicus
ggaatttccaccttatccaaagcct

SEQ ID NO: 420226 - DNA, 25 bp, Rattus norvegicus
ggaatttcctaaagtttctgactgt

SEQ ID NO: 420227 - DNA, 25 bp, Rattus norvegicus
ggaatttcctaatgtttctgactgt

SEQ ID NO: 420228 - DNA, 25 bp, Rattus norvegicus
ggaatttcctcaaagacacacgcaa

SEQ ID NO: 420229 - DNA, 25 bp, Rattus norvegicus
ggaatttcctcatagacacacgcaa

SEQ ID NO: 420230 - DNA, 25 bp, Rattus norvegicus
ggaatttccttacaggatgaatcat

SEQ ID NO: 420231 - DNA, 25 bp, Rattus norvegicus
ggaatttccttagaggatgaatcat

SEQ ID NO: 420232 - DNA, 25 bp, Rattus norvegicus
ggaatttccttcagtgacctctgta

SEQ ID NO: 420233 - DNA, 25 bp, Rattus norvegicus
ggaatttccttctgtgacctctgta

SEQ ID NO: 420234 - DNA, 25 bp, Rattus norvegicus
ggaatttctattatctgggtatctt

SEQ ID NO: 420235 - DNA, 25 bp, Rattus norvegicus
ggaatttctattttctgggtatctt

SEQ ID NO: 420236 - DNA, 25 bp, Rattus norvegicus
ggaatttctcctacaggctgtatga

SEQ ID NO: 420237 - DNA, 25 bp, Rattus norvegicus
ggaatttctccttcaggctgtatga

SEQ ID NO: 420238 - DNA, 25 bp, Rattus norvegicus
ggaatttctctcaatctagtataca

SEQ ID NO: 420239 - DNA, 25 bp, Rattus norvegicus
ggaatttctctctatctagtataca

SEQ ID NO: 420240 - DNA, 25 bp, Rattus norvegicus
ggaatttctgatattgattgtgtac

SEQ ID NO: 420241 - DNA, 25 bp, Rattus norvegicus
ggaatttctgattttgattgtgtac

SEQ ID NO: 420242 - DNA, 25 bp, Rattus norvegicus
ggaatttctttcattacggtcatat

SEQ ID NO: 420243 - DNA, 25 bp, Rattus norvegicus
ggaatttctttccaatggcactact

SEQ ID NO: 420244 - DNA, 25 bp, Rattus norvegicus
ggaatttctttcgaatggcactact

SEQ ID NO: 420245 - DNA, 25 bp, Rattus norvegicus
ggaatttctttctttacggtcatat

SEQ ID NO: 420246 - DNA, 25 bp, Rattus norvegicus
ggaatttgacctcctcagccaagta

SEQ ID NO: 420247 - DNA, 25 bp, Rattus norvegicus
ggaatttgacctgctcagccaagta

SEQ ID NO: 420248 - DNA, 25 bp, Rattus norvegicus
ggaatttgagtccttctccctggac

SEQ ID NO: 420249 - DNA, 25 bp, Rattus norvegicus
ggaatttgagtcgttctccctggac

SEQ ID NO: 420250 - DNA, 25 bp, Rattus norvegicus
ggaatttgatcccaaagcagcccac

SEQ ID NO: 420251 - DNA, 25 bp, Rattus norvegicus
ggaatttgatccgaaagcagcccac

SEQ ID NO: 420252 - DNA, 25 bp, Rattus norvegicus
ggaatttgatgcacctccagaggct

SEQ ID NO: 420253 - DNA, 25 bp, Rattus norvegicus
ggaatttgatgctcctccagaggct

SEQ ID NO: 420254 - DNA, 25 bp, Rattus norvegicus
ggaatttgatgtagagccagataaa

SEQ ID NO: 420255 - DNA, 25 bp, Rattus norvegicus
ggaatttgatgttgagccagataaa

SEQ ID NO: 420256 - DNA, 25 bp, Rattus norvegicus
ggaatttgcaggcactcaaaccctc

SEQ ID NO: 420257 - DNA, 25 bp, Rattus norvegicus
ggaatttgcagggactcaaaccctc

SEQ ID NO: 420258 - DNA, 25 bp, Rattus norvegicus
ggaatttgctctctagacagactga

SEQ ID NO: 420259 - DNA, 25 bp, Rattus norvegicus
ggaatttgctctgtagacagactga

SEQ ID NO: 420260 - DNA, 25 bp, Rattus norvegicus
ggaatttgcttccataatcattgag

SEQ ID NO: 420261 - DNA, 25 bp, Rattus norvegicus
ggaatttgcttcgataatcattgag

SEQ ID NO: 420262 - DNA, 25 bp, Rattus norvegicus
ggaatttggagccatcctgggctac

SEQ ID NO: 420263 - DNA, 25 bp, Rattus norvegicus
ggaatttggagcgatcctgggctac

SEQ ID NO: 420264 - DNA, 25 bp, Rattus norvegicus
ggaatttggcaccaccctgaaggaa

SEQ ID NO: 420265 - DNA, 25 bp, Rattus norvegicus
ggaatttggcacgaccctgaaggaa

SEQ ID NO: 420266 - DNA, 25 bp, Rattus norvegicus
ggaatttggcccctgcccttagcac

SEQ ID NO: 420267 - DNA, 25 bp, Rattus norvegicus
ggaatttggcccgtgcccttagcac

SEQ ID NO: 420268 - DNA, 25 bp, Rattus norvegicus
ggaatttgttccatgcagcaactta

SEQ ID NO: 420269 - DNA, 25 bp, Rattus norvegicus
ggaatttgttccttgcagcaactta

SEQ ID NO: 420270 - DNA, 25 bp, Rattus norvegicus
ggaattttacatcacttctggccag

SEQ ID NO: 420271 - DNA, 25 bp, Rattus norvegicus
ggaattttacatgacttctggccag

SEQ ID NO: 420272 - DNA, 25 bp, Rattus norvegicus
ggaattttagtaacacgtctgccat

SEQ ID NO: 420273 - DNA, 25 bp, Rattus norvegicus
ggaattttagtatcacgtctgccat

SEQ ID NO: 420274 - DNA, 25 bp, Rattus norvegicus
ggaattttatccagagagctcgtct

SEQ ID NO: 420275 - DNA, 25 bp, Rattus norvegicus
ggaattttatcctgagagctcgtct

SEQ ID NO: 420276 - DNA, 25 bp, Rattus norvegicus
ggaattttccagaaggcagggccat

SEQ ID NO: 420277 - DNA, 25 bp, Rattus norvegicus
ggaattttccagtaggcagggccat

SEQ ID NO: 420278 - DNA, 25 bp, Rattus norvegicus
ggaattttcccacccaactatgtaa

SEQ ID NO: 420279 - DNA, 25 bp, Rattus norvegicus
ggaattttcccagccaactatgtaa

SEQ ID NO: 420280 - DNA, 25 bp, Rattus norvegicus
ggaattttccttacaaattgggctg

SEQ ID NO: 420281 - DNA, 25 bp, Rattus norvegicus
ggaattttcctttcaaattgggctg

SEQ ID NO: 420282 - DNA, 25 bp, Rattus norvegicus
ggaattttctccatgttttaagcag

SEQ ID NO: 420283 - DNA, 25 bp, Rattus norvegicus
ggaattttctccttgttttaagcag

SEQ ID NO: 420284 - DNA, 25 bp, Rattus norvegicus
ggaattttctctcgatccatgtcag

SEQ ID NO: 420285 - DNA, 25 bp, Rattus norvegicus
ggaattttctctggatccatgtcag

SEQ ID NO: 420286 - DNA, 25 bp, Rattus norvegicus
ggaattttcttacccacagatctga

SEQ ID NO: 420287 - DNA, 25 bp, Rattus norvegicus
ggaattttcttagccacagatctga

SEQ ID NO: 420288 - DNA, 25 bp, Rattus norvegicus
ggaattttgaaccttgacttgatga

SEQ ID NO: 420289 - DNA, 25 bp, Rattus norvegicus
ggaattttgaacgttgacttgatga

SEQ ID NO: 420290 - DNA, 25 bp, Rattus norvegicus
ggaattttggtccttcagtgacctg

SEQ ID NO: 420291 - DNA, 25 bp, Rattus norvegicus
ggaattttggtcgttcagtgacctg

SEQ ID NO: 420292 - DNA, 25 bp, Rattus norvegicus
ggaattttttccagcaatgctacat

SEQ ID NO: 420293 - DNA, 25 bp, Rattus norvegicus
ggaattttttccagtcttataagat

SEQ ID NO: 420294 - DNA, 25 bp, Rattus norvegicus
ggaattttttcctgcaatgctacat

SEQ ID NO: 420295 - DNA, 25 bp, Rattus norvegicus
ggaattttttcctgtcttataagat

SEQ ID NO: 420296 - DNA, 25 bp, Rattus norvegicus
ggacaaaaatgtaaccatctcgtag

SEQ ID NO: 420297 - DNA, 25 bp, Rattus norvegicus
ggacaaaaatgttaccatctcgtag

SEQ ID NO: 420298 - DNA, 25 bp, Rattus norvegicus
ggacaaaacatgctgagctccctga

SEQ ID NO: 420299 - DNA, 25 bp, Rattus norvegicus
ggacaaaacatggtgagctccctga

SEQ ID NO: 420300 - DNA, 25 bp, Rattus norvegicus
ggacaaaagctaatgccagctccat

SEQ ID NO: 420301 - DNA, 25 bp, Rattus norvegicus
ggacaaaagctattgccagctccat

SEQ ID NO: 420302 - DNA, 25 bp, Rattus norvegicus
ggacaaaagcttccacttggtaatt

SEQ ID NO: 420303 - DNA, 25 bp, Rattus norvegicus
ggacaaaagcttgcacttggtaatt

SEQ ID NO: 420304 - DNA, 25 bp, Rattus norvegicus
ggacaaaagtgcagagttccctctc

SEQ ID NO: 420305 - DNA, 25 bp, Rattus norvegicus
ggacaaaagtgctgagttccctctc

SEQ ID NO: 420306 - DNA, 25 bp, Rattus norvegicus
ggacaaaatcaacggctcctgcatg

SEQ ID NO: 420307 - DNA, 25 bp, Rattus norvegicus
ggacaaaatcaagggctcctgcatg

SEQ ID NO: 420308 - DNA, 25 bp, Rattus norvegicus
ggacaaaatggcaatccacagattg

SEQ ID NO: 420309 - DNA, 25 bp, Rattus norvegicus
ggacaaaatggctatccacagattg

SEQ ID NO: 420310 - DNA, 25 bp, Rattus norvegicus
ggacaaacaagcacctgggattatt

SEQ ID NO: 420311 - DNA, 25 bp, Rattus norvegicus
ggacaaacaagctcctgggattatt

SEQ ID NO: 420312 - DNA, 25 bp, Rattus norvegicus
ggacaaacaccaagtagttcgtcag

SEQ ID NO: 420313 - DNA, 25 bp, Rattus norvegicus
ggacaaacaccatgtagttcgtcag

SEQ ID NO: 420314 - DNA, 25 bp, Rattus norvegicus
ggacaaacacgcataacttctatga

SEQ ID NO: 420315 - DNA, 25 bp, Rattus norvegicus
ggacaaacacgcttaacttctatga

SEQ ID NO: 420316 - DNA, 25 bp, Rattus norvegicus
ggacaaacagttctttttacaatgg

SEQ ID NO: 420317 - DNA, 25 bp, Rattus norvegicus
ggacaaacagttgtttttacaatgg

SEQ ID NO: 420318 - DNA, 25 bp, Rattus norvegicus
ggacaaaccaagctactttgcttat

SEQ ID NO: 420319 - DNA, 25 bp, Rattus norvegicus
ggacaaaccaaggtactttgcttat

SEQ ID NO: 420320 - DNA, 25 bp, Rattus norvegicus
ggacaaacccatcaccttgtgaact

SEQ ID NO: 420321 - DNA, 25 bp, Rattus norvegicus
ggacaaacccatgaccttgtgaact

SEQ ID NO: 420322 - DNA, 25 bp, Rattus norvegicus
ggacaaacggctaggacccagaggc

SEQ ID NO: 420323 - DNA, 25 bp, Rattus norvegicus
ggacaaacggcttggacccagaggc

SEQ ID NO: 420324 - DNA, 25 bp, Rattus norvegicus
ggacaaactagtcagttcttttcat

SEQ ID NO: 420325 - DNA, 25 bp, Rattus norvegicus
ggacaaactagtgagttcttttcat

SEQ ID NO: 420326 - DNA, 25 bp, Rattus norvegicus
ggacaaactggcctctctgaagagg

SEQ ID NO: 420327 - DNA, 25 bp, Rattus norvegicus
ggacaaactggcgtctctgaagagg

SEQ ID NO: 420328 - DNA, 25 bp, Rattus norvegicus
ggacaaagacacagagctcgggatt

SEQ ID NO: 420329 - DNA, 25 bp, Rattus norvegicus
ggacaaagacactgagctcgggatt

SEQ ID NO: 420330 - DNA, 25 bp, Rattus norvegicus
ggacaaagagccacctgtacctgag

SEQ ID NO: 420331 - DNA, 25 bp, Rattus norvegicus
ggacaaagagcctcctgtacctgag

SEQ ID NO: 420332 - DNA, 25 bp, Rattus norvegicus
ggacaaagccacactttgcttgtca

SEQ ID NO: 420333 - DNA, 25 bp, Rattus norvegicus
ggacaaagccactctttgcttgtca

SEQ ID NO: 420334 - DNA, 25 bp, Rattus norvegicus
ggacaaagccctcaggaattcccca

SEQ ID NO: 420335 - DNA, 25 bp, Rattus norvegicus
ggacaaagccctgaggaattcccca

SEQ ID NO: 420336 - DNA, 25 bp, Rattus norvegicus
ggacaaagcgctaaagctaccacca

SEQ ID NO: 420337 - DNA, 25 bp, Rattus norvegicus
ggacaaagcgcttaagctaccacca

SEQ ID NO: 420338 - DNA, 25 bp, Rattus norvegicus
ggacaaagcttcagcctctggagta

SEQ ID NO: 420339 - DNA, 25 bp, Rattus norvegicus
ggacaaagcttctgcctctggagta

SEQ ID NO: 420340 - DNA, 25 bp, Rattus norvegicus
ggacaaagggataccggtgcgacct

SEQ ID NO: 420341 - DNA, 25 bp, Rattus norvegicus
ggacaaagggattccggtgcgacct

SEQ ID NO: 420342 - DNA, 25 bp, Rattus norvegicus
ggacaaagtcacaactgggccatct

SEQ ID NO: 420343 - DNA, 25 bp, Rattus norvegicus
ggacaaagtcactactgggccatct

SEQ ID NO: 420344 - DNA, 25 bp, Rattus norvegicus
ggacaaagtcagactgttgcatctg

SEQ ID NO: 420345 - DNA, 25 bp, Rattus norvegicus
ggacaaagtcagtctgttgcatctg

SEQ ID NO: 420346 - DNA, 25 bp, Rattus norvegicus
ggacaaagtcatcttacctctgggc

SEQ ID NO: 420347 - DNA, 25 bp, Rattus norvegicus
ggacaaagtcatgttacctctgggc

SEQ ID NO: 420348 - DNA, 25 bp, Rattus norvegicus
ggacaaagtctcctgattctaactg

SEQ ID NO: 420349 - DNA, 25 bp, Rattus norvegicus
ggacaaagtctcgtgattctaactg

SEQ ID NO: 420350 - DNA, 25 bp, Rattus norvegicus
ggacaaataaccacacgataacctt

SEQ ID NO: 420351 - DNA, 25 bp, Rattus norvegicus
ggacaaataacctcacgataacctt

SEQ ID NO: 420352 - DNA, 25 bp, Rattus norvegicus
ggacaaatatgtactcacccagaca

SEQ ID NO: 420353 - DNA, 25 bp, Rattus norvegicus
ggacaaatatgttctcacccagaca

SEQ ID NO: 420354 - DNA, 25 bp, Rattus norvegicus
ggacaaatcccccactaaagctgtc

SEQ ID NO: 420355 - DNA, 25 bp, Rattus norvegicus
ggacaaatccccgactaaagctgtc

SEQ ID NO: 420356 - DNA, 25 bp, Rattus norvegicus
ggacaaatgacaacccatcgtatgg

SEQ ID NO: 420357 - DNA, 25 bp, Rattus norvegicus
ggacaaatgacatcccatcgtatgg

SEQ ID NO: 420358 - DNA, 25 bp, Rattus norvegicus
ggacaaatggaacagcaaagctcag

SEQ ID NO: 420359 - DNA, 25 bp, Rattus norvegicus
ggacaaatggaagagcaaagctcag

SEQ ID NO: 420360 - DNA, 25 bp, Rattus norvegicus
ggacaaatgtcccaatcagcccaac

SEQ ID NO: 420361 - DNA, 25 bp, Rattus norvegicus
ggacaaatgtccgaatcagcccaac

SEQ ID NO: 420362 - DNA, 25 bp, Rattus norvegicus
ggacaaatttagcattcccagcacc

SEQ ID NO: 420363 - DNA, 25 bp, Rattus norvegicus
ggacaaatttaggattcccagcacc

SEQ ID NO: 420364 - DNA, 25 bp, Rattus norvegicus
ggacaacaacctcgaactggcctct

SEQ ID NO: 420365 - DNA, 25 bp, Rattus norvegicus
ggacaacaacctggaactggcctct

SEQ ID NO: 420366 - DNA, 25 bp, Rattus norvegicus
ggacaacaacgtcccgggaacaaag

SEQ ID NO: 420367 - DNA, 25 bp, Rattus norvegicus
ggacaacaacgtgccgggaacaaag

SEQ ID NO: 420368 - DNA, 25 bp, Rattus norvegicus
ggacaacaatccactggaatttgat

SEQ ID NO: 420369 - DNA, 25 bp, Rattus norvegicus
ggacaacaatcctctggaatttgat

SEQ ID NO: 420370 - DNA, 25 bp, Rattus norvegicus
ggacaacaatgtaaagccgtttacg

SEQ ID NO: 420371 - DNA, 25 bp, Rattus norvegicus
ggacaacaatgttaagccgtttacg

SEQ ID NO: 420372 - DNA, 25 bp, Rattus norvegicus
ggacaacacgacagtttctctctct

SEQ ID NO: 420373 - DNA, 25 bp, Rattus norvegicus
ggacaacacgactgtttctctctct

SEQ ID NO: 420374 - DNA, 25 bp, Rattus norvegicus
ggacaacagtctcacttccttatga

SEQ ID NO: 420375 - DNA, 25 bp, Rattus norvegicus
ggacaacagtctgacttccttatga

SEQ ID NO: 420376 - DNA, 25 bp, Rattus norvegicus
ggacaacatacaaacatcccgttta

SEQ ID NO: 420377 - DNA, 25 bp, Rattus norvegicus
ggacaacatacatacatcccgttta

SEQ ID NO: 420378 - DNA, 25 bp, Rattus norvegicus
ggacaacatcgcactgtggatgact

SEQ ID NO: 420379 - DNA, 25 bp, Rattus norvegicus
ggacaacatcgctctgtggatgact

SEQ ID NO: 420380 - DNA, 25 bp, Rattus norvegicus
ggacaacatttcataccgcagggag

SEQ ID NO: 420381 - DNA, 25 bp, Rattus norvegicus
ggacaacatttcttaccgcagggag

SEQ ID NO: 420382 - DNA, 25 bp, Rattus norvegicus
ggacaaccaaacactagtcaacagg

SEQ ID NO: 420383 - DNA, 25 bp, Rattus norvegicus
ggacaaccaaactctagtcaacagg

SEQ ID NO: 420384 - DNA, 25 bp, Rattus norvegicus
ggacaaccatgaagaggccaccctg

SEQ ID NO: 420385 - DNA, 25 bp, Rattus norvegicus
ggacaaccatgatgaggccaccctg

SEQ ID NO: 420386 - DNA, 25 bp, Rattus norvegicus
ggacaaccctgcaagctggaactat

SEQ ID NO: 420387 - DNA, 25 bp, Rattus norvegicus
ggacaaccctgctagctggaactat

SEQ ID NO: 420388 - DNA, 25 bp, Rattus norvegicus
ggacaaccgggacatctttgagagc

SEQ ID NO: 420389 - DNA, 25 bp, Rattus norvegicus
ggacaaccgggagatctttgagagc

SEQ ID NO: 420390 - DNA, 25 bp, Rattus norvegicus
ggacaacctgctccatgagaagcgt

SEQ ID NO: 420391 - DNA, 25 bp, Rattus norvegicus
ggacaacctgctgcatgagaagcgt

SEQ ID NO: 420392 - DNA, 25 bp, Rattus norvegicus
ggacaacctgggatcaactttgtac

SEQ ID NO: 420393 - DNA, 25 bp, Rattus norvegicus
ggacaacctgggttcaactttgtac

SEQ ID NO: 420394 - DNA, 25 bp, Rattus norvegicus
ggacaacctggtcatagacatgatg

SEQ ID NO: 420395 - DNA, 25 bp, Rattus norvegicus
ggacaacctggtgatagacatgatg

SEQ ID NO: 420396 - DNA, 25 bp, Rattus norvegicus
ggacaaccttatcaactcactggat

SEQ ID NO: 420397 - DNA, 25 bp, Rattus norvegicus
ggacaaccttatgaactcactggat

SEQ ID NO: 420398 - DNA, 25 bp, Rattus norvegicus
ggacaacgatggctgggtaactaca

SEQ ID NO: 420399 - DNA, 25 bp, Rattus norvegicus
ggacaacgatgggtgggtaactaca

SEQ ID NO: 420400 - DNA, 25 bp, Rattus norvegicus
ggacaacgccctacgagatgagatg

SEQ ID NO: 420401 - DNA, 25 bp, Rattus norvegicus
ggacaacgcccttcgagatgagatg

SEQ ID NO: 420402 - DNA, 25 bp, Rattus norvegicus
ggacaacgctggacagtacagacct

SEQ ID NO: 420403 - DNA, 25 bp, Rattus norvegicus
ggacaacgctggtcagtacagacct

SEQ ID NO: 420404 - DNA, 25 bp, Rattus norvegicus
ggacaacgttatagccacctatgag

SEQ ID NO: 420405 - DNA, 25 bp, Rattus norvegicus
ggacaacgttattgccacctatgag

SEQ ID NO: 420406 - DNA, 25 bp, Rattus norvegicus
ggacaacgttgcagagaatgactaa

SEQ ID NO: 420407 - DNA, 25 bp, Rattus norvegicus
ggacaacgttgctgagaatgactaa

SEQ ID NO: 420408 - DNA, 25 bp, Rattus norvegicus
ggacaactacatagatggacctcat

SEQ ID NO: 420409 - DNA, 25 bp, Rattus norvegicus
ggacaactacattgatggacctcat

SEQ ID NO: 420410 - DNA, 25 bp, Rattus norvegicus
ggacaactaggacaggtcgcaagaa

SEQ ID NO: 420411 - DNA, 25 bp, Rattus norvegicus
ggacaactaggagaggtcgcaagaa

SEQ ID NO: 420412 - DNA, 25 bp, Rattus norvegicus
ggacaactaggtcagctccttgtta

SEQ ID NO: 420413 - DNA, 25 bp, Rattus norvegicus
ggacaactaggtgagctccttgtta

SEQ ID NO: 420414 - DNA, 25 bp, Rattus norvegicus
ggacaactcagcaagggcacgtaga

SEQ ID NO: 420415 - DNA, 25 bp, Rattus norvegicus
ggacaactcagctagggcacgtaga

SEQ ID NO: 420416 - DNA, 25 bp, Rattus norvegicus
ggacaactcccaagccgtgtggaaa

SEQ ID NO: 420417 - DNA, 25 bp, Rattus norvegicus
ggacaactcccatgccgtgtggaaa

SEQ ID NO: 420418 - DNA, 25 bp, Rattus norvegicus
ggacaactgaggagcctctgccagt

SEQ ID NO: 420419 - DNA, 25 bp, Rattus norvegicus
ggacaactgaggtgcctctgccagt

SEQ ID NO: 420420 - DNA, 25 bp, Rattus norvegicus
ggacaactgattccatctactaccc

SEQ ID NO: 420421 - DNA, 25 bp, Rattus norvegicus
ggacaactgattgcatctactaccc

SEQ ID NO: 420422 - DNA, 25 bp, Rattus norvegicus
ggacaactggctaagggagcatgct

SEQ ID NO: 420423 - DNA, 25 bp, Rattus norvegicus
ggacaactggcttagggagcatgct

SEQ ID NO: 420424 - DNA, 25 bp, Rattus norvegicus
ggacaactgttaacaacttactaag

SEQ ID NO: 420425 - DNA, 25 bp, Rattus norvegicus
ggacaactgttatcaacttactaag

SEQ ID NO: 420426 - DNA, 25 bp, Rattus norvegicus
ggacaacttcaaccctgaggagctg

SEQ ID NO: 420427 - DNA, 25 bp, Rattus norvegicus
ggacaacttcaagcctgaggagctg

SEQ ID NO: 420428 - DNA, 25 bp, Rattus norvegicus
ggacaacttcctactctggaataaa

SEQ ID NO: 420429 - DNA, 25 bp, Rattus norvegicus
ggacaacttcctcgacaaactgtag

SEQ ID NO: 420430 - DNA, 25 bp, Rattus norvegicus
ggacaacttcctggacaaactgtag

SEQ ID NO: 420431 - DNA, 25 bp, Rattus norvegicus
ggacaacttccttctctggaataaa

SEQ ID NO: 420432 - DNA, 25 bp, Rattus norvegicus
ggacaacttctcaaagtttggtctt

SEQ ID NO: 420433 - DNA, 25 bp, Rattus norvegicus
ggacaacttctctaagtttggtctt

SEQ ID NO: 420434 - DNA, 25 bp, Rattus norvegicus
ggacaacttgtgactttccagccag

SEQ ID NO: 420435 - DNA, 25 bp, Rattus norvegicus
ggacaacttgtgtctttccagccag

SEQ ID NO: 420436 - DNA, 25 bp, Rattus norvegicus
ggacaactttgcatgtcagtccctg

SEQ ID NO: 420437 - DNA, 25 bp, Rattus norvegicus
ggacaactttgcttgtcagtccctg

SEQ ID NO: 420438 - DNA, 25 bp, Rattus norvegicus
ggacaactttttctttgctagagta

SEQ ID NO: 420439 - DNA, 25 bp, Rattus norvegicus
ggacaactttttgtttgctagagta

SEQ ID NO: 420440 - DNA, 25 bp, Rattus norvegicus
ggacaagaactgagggccctcggct

SEQ ID NO: 420441 - DNA, 25 bp, Rattus norvegicus
ggacaagaactgtgggccctcggct

SEQ ID NO: 420442 - DNA, 25 bp, Rattus norvegicus
ggacaagaagacctcacaagctatt

SEQ ID NO: 420443 - DNA, 25 bp, Rattus norvegicus
ggacaagaagacgtcacaagctatt

SEQ ID NO: 420444 - DNA, 25 bp, Rattus norvegicus
ggacaagaaggtcgacctctcccag

SEQ ID NO: 420445 - DNA, 25 bp, Rattus norvegicus
ggacaagaaggtggacctctcccag

SEQ ID NO: 420446 - DNA, 25 bp, Rattus norvegicus
ggacaagacaaacactggccagctt

SEQ ID NO: 420447 - DNA, 25 bp, Rattus norvegicus
ggacaagacaaagactggccagctt

SEQ ID NO: 420448 - DNA, 25 bp, Rattus norvegicus
ggacaagacatgagccattggacag

SEQ ID NO: 420449 - DNA, 25 bp, Rattus norvegicus
ggacaagacatgtgccattggacag

SEQ ID NO: 420450 - DNA, 25 bp, Rattus norvegicus
ggacaagaccaccaacagcagcgag

SEQ ID NO: 420451 - DNA, 25 bp, Rattus norvegicus
ggacaagaccacgaacagcagcgag

SEQ ID NO: 420452 - DNA, 25 bp, Rattus norvegicus
ggacaagactccatctgtatctgat

SEQ ID NO: 420453 - DNA, 25 bp, Rattus norvegicus
ggacaagactccttctgtatctgat

SEQ ID NO: 420454 - DNA, 25 bp, Rattus norvegicus
ggacaagactgtaagcgcacctgag

SEQ ID NO: 420455 - DNA, 25 bp, Rattus norvegicus
ggacaagactgttagcgcacctgag

SEQ ID NO: 420456 - DNA, 25 bp, Rattus norvegicus
ggacaagagcatatcagagatcact

SEQ ID NO: 420457 - DNA, 25 bp, Rattus norvegicus
ggacaagagcatttcagagatcact

SEQ ID NO: 420458 - DNA, 25 bp, Rattus norvegicus
ggacaagatcctcctgaatgcctgc

SEQ ID NO: 420459 - DNA, 25 bp, Rattus norvegicus
ggacaagatcctgctgaatgcctgc

SEQ ID NO: 420460 - DNA, 25 bp, Rattus norvegicus
ggacaagatgatagcctggctcctc

SEQ ID NO: 420461 - DNA, 25 bp, Rattus norvegicus
ggacaagatgattgcctggctcctc

SEQ ID NO: 420462 - DNA, 25 bp, Rattus norvegicus
ggacaagattttcaccttcccacag

SEQ ID NO: 420463 - DNA, 25 bp, Rattus norvegicus
ggacaagattttgaccttcccacag

SEQ ID NO: 420464 - DNA, 25 bp, Rattus norvegicus
ggacaagcaaagatgactaaaacct

SEQ ID NO: 420465 - DNA, 25 bp, Rattus norvegicus
ggacaagcaaagttgactaaaacct

SEQ ID NO: 420466 - DNA, 25 bp, Rattus norvegicus
ggacaagcaccacgattttcttaca

SEQ ID NO: 420467 - DNA, 25 bp, Rattus norvegicus
ggacaagcaccaggattttcttaca

SEQ ID NO: 420468 - DNA, 25 bp, Rattus norvegicus
ggacaagcagaactggagttcacaa

SEQ ID NO: 420469 - DNA, 25 bp, Rattus norvegicus
ggacaagcagaagtggagttcacaa

SEQ ID NO: 420470 - DNA, 25 bp, Rattus norvegicus
ggacaagcagttataccctaatctc

SEQ ID NO: 420471 - DNA, 25 bp, Rattus norvegicus
ggacaagcagttccagatcctgacc

SEQ ID NO: 420472 - DNA, 25 bp, Rattus norvegicus
ggacaagcagttgcagatcctgacc

SEQ ID NO: 420473 - DNA, 25 bp, Rattus norvegicus
ggacaagcagttttaccctaatctc

SEQ ID NO: 420474 - DNA, 25 bp, Rattus norvegicus
ggacaagccactctctgacatggaa

SEQ ID NO: 420475 - DNA, 25 bp, Rattus norvegicus
ggacaagccactgtctgacatggaa

SEQ ID NO: 420476 - DNA, 25 bp, Rattus norvegicus
ggacaagccattcatcccaaagcct

SEQ ID NO: 420477 - DNA, 25 bp, Rattus norvegicus
ggacaagccattgatcccaaagcct

SEQ ID NO: 420478 - DNA, 25 bp, Rattus norvegicus
ggacaagcccagaaactgtaccaat

SEQ ID NO: 420479 - DNA, 25 bp, Rattus norvegicus
ggacaagcccagtaactgtaccaat

SEQ ID NO: 420480 - DNA, 25 bp, Rattus norvegicus
ggacaagcccttcaagacacaatga

SEQ ID NO: 420481 - DNA, 25 bp, Rattus norvegicus
ggacaagcccttgaagacacaatga

SEQ ID NO: 420482 - DNA, 25 bp, Rattus norvegicus
ggacaagcctttagtcaccaggata

SEQ ID NO: 420483 - DNA, 25 bp, Rattus norvegicus
ggacaagccttttgtcaccaggata

SEQ ID NO: 420484 - DNA, 25 bp, Rattus norvegicus
ggacaagcggttagttcatgcgcaa

SEQ ID NO: 420485 - DNA, 25 bp, Rattus norvegicus
ggacaagcggtttgttcatgcgcaa

SEQ ID NO: 420486 - DNA, 25 bp, Rattus norvegicus
ggacaagctaccacttacataagca

SEQ ID NO: 420487 - DNA, 25 bp, Rattus norvegicus
ggacaagctacctcttacataagca

SEQ ID NO: 420488 - DNA, 25 bp, Rattus norvegicus
ggacaagctctgaatacaggcacat

SEQ ID NO: 420489 - DNA, 25 bp, Rattus norvegicus
ggacaagctctgtatacaggcacat

SEQ ID NO: 420490 - DNA, 25 bp, Rattus norvegicus
ggacaagctgaccattcaaggcctg

SEQ ID NO: 420491 - DNA, 25 bp, Rattus norvegicus
ggacaagctgacgattcaaggcctg

SEQ ID NO: 420492 - DNA, 25 bp, Rattus norvegicus
ggacaagctgccatctctctctgca

SEQ ID NO: 420493 - DNA, 25 bp, Rattus norvegicus
ggacaagctgccttctctctctgca

SEQ ID NO: 420494 - DNA, 25 bp, Rattus norvegicus
ggacaagctgcgactggagatccgc

SEQ ID NO: 420495 - DNA, 25 bp, Rattus norvegicus
ggacaagctgcgtctggagatccgc

SEQ ID NO: 420496 - DNA, 25 bp, Rattus norvegicus
ggacaagctgctaagctaaaaccct

SEQ ID NO: 420497 - DNA, 25 bp, Rattus norvegicus
ggacaagctgctccgatacgaccac

SEQ ID NO: 420498 - DNA, 25 bp, Rattus norvegicus
ggacaagctgctctggcgcgacaac

SEQ ID NO: 420499 - DNA, 25 bp, Rattus norvegicus
ggacaagctgctgcgatacgaccac

SEQ ID NO: 420500 - DNA, 25 bp, Rattus norvegicus
ggacaagctgctgtggcgcgacaac

SEQ ID NO: 420501 - DNA, 25 bp, Rattus norvegicus
ggacaagctgcttagctaaaaccct

SEQ ID NO: 420502 - DNA, 25 bp, Rattus norvegicus
ggacaagctgttacgactgacgcat

SEQ ID NO: 420503 - DNA, 25 bp, Rattus norvegicus
ggacaagctgtttcgactgacgcat

SEQ ID NO: 420504 - DNA, 25 bp, Rattus norvegicus
ggacaagcttcgagtggcgtctgca

SEQ ID NO: 420505 - DNA, 25 bp, Rattus norvegicus
ggacaagcttcgcatagttccctgt

SEQ ID NO: 420506 - DNA, 25 bp, Rattus norvegicus
ggacaagcttcggatagttccctgt

SEQ ID NO: 420507 - DNA, 25 bp, Rattus norvegicus
ggacaagcttcgtgtggcgtctgca

SEQ ID NO: 420508 - DNA, 25 bp, Rattus norvegicus
ggacaagcttgccacggacatccct

SEQ ID NO: 420509 - DNA, 25 bp, Rattus norvegicus
ggacaagcttgcgacggacatccct

SEQ ID NO: 420510 - DNA, 25 bp, Rattus norvegicus
ggacaagcttttctgcctactcaat

SEQ ID NO: 420511 - DNA, 25 bp, Rattus norvegicus
ggacaagcttttgtgcctactcaat

SEQ ID NO: 420512 - DNA, 25 bp, Rattus norvegicus
ggacaaggacataggctcaagttct

SEQ ID NO: 420513 - DNA, 25 bp, Rattus norvegicus
ggacaaggacattggctcaagttct

SEQ ID NO: 420514 - DNA, 25 bp, Rattus norvegicus
ggacaaggagctcgcccggctatct

SEQ ID NO: 420515 - DNA, 25 bp, Rattus norvegicus
ggacaaggagctggcccggctatct

SEQ ID NO: 420516 - DNA, 25 bp, Rattus norvegicus
ggacaaggagtcatccacgcagcta

SEQ ID NO: 420517 - DNA, 25 bp, Rattus norvegicus
ggacaaggagtcttccacgcagcta

SEQ ID NO: 420518 - DNA, 25 bp, Rattus norvegicus
ggacaaggatgcagtgacacccacc

SEQ ID NO: 420519 - DNA, 25 bp, Rattus norvegicus
ggacaaggatgctgtgacacccacc

SEQ ID NO: 420520 - DNA, 25 bp, Rattus norvegicus
ggacaaggatgtctacccggagccc

SEQ ID NO: 420521 - DNA, 25 bp, Rattus norvegicus
ggacaaggatgtgtacccggagccc

SEQ ID NO: 420522 - DNA, 25 bp, Rattus norvegicus
ggacaaggcaacaagctgactgctt

SEQ ID NO: 420523 - DNA, 25 bp, Rattus norvegicus
ggacaaggcaactagctgactgctt

SEQ ID NO: 420524 - DNA, 25 bp, Rattus norvegicus
ggacaaggcattcctggaatcccca

SEQ ID NO: 420525 - DNA, 25 bp, Rattus norvegicus
ggacaaggcattgctggaatcccca

SEQ ID NO: 420526 - DNA, 25 bp, Rattus norvegicus
ggacaaggcccacagacaggagaat

SEQ ID NO: 420527 - DNA, 25 bp, Rattus norvegicus
ggacaaggcccagagacaggagaat

SEQ ID NO: 420528 - DNA, 25 bp, Rattus norvegicus
ggacaaggccccaggataccagatg

SEQ ID NO: 420529 - DNA, 25 bp, Rattus norvegicus
ggacaaggcccctggataccagatg

SEQ ID NO: 420530 - DNA, 25 bp, Rattus norvegicus
ggacaaggccgcaagctggagttct

SEQ ID NO: 420531 - DNA, 25 bp, Rattus norvegicus
ggacaaggccgctagctggagttct

SEQ ID NO: 420532 - DNA, 25 bp, Rattus norvegicus
ggacaaggccgtatccattattgaa

SEQ ID NO: 420533 - DNA, 25 bp, Rattus norvegicus
ggacaaggccgtttccattattgaa

SEQ ID NO: 420534 - DNA, 25 bp, Rattus norvegicus
ggacaaggctgcagctatcaggacc

SEQ ID NO: 420535 - DNA, 25 bp, Rattus norvegicus
ggacaaggctgctgctatcaggacc

SEQ ID NO: 420536 - DNA, 25 bp, Rattus norvegicus
ggacaaggtcctcttagtgaacaaa

SEQ ID NO: 420537 - DNA, 25 bp, Rattus norvegicus
ggacaaggtcctgttagtgaacaaa

SEQ ID NO: 420538 - DNA, 25 bp, Rattus norvegicus
ggacaaggtgtcctccacgtggttc

SEQ ID NO: 420539 - DNA, 25 bp, Rattus norvegicus
ggacaaggtgtcgtccacgtggttc

SEQ ID NO: 420540 - DNA, 25 bp, Rattus norvegicus
ggacaaggtgttctctgtggcctca

SEQ ID NO: 420541 - DNA, 25 bp, Rattus norvegicus
ggacaaggtgttgtctgtggcctca

SEQ ID NO: 420542 - DNA, 25 bp, Rattus norvegicus
ggacaagtactgctctcagcagatt

SEQ ID NO: 420543 - DNA, 25 bp, Rattus norvegicus
ggacaagtactggtctcagcagatt

SEQ ID NO: 420544 - DNA, 25 bp, Rattus norvegicus
ggacaagtatgaacgtctctagctt

SEQ ID NO: 420545 - DNA, 25 bp, Rattus norvegicus
ggacaagtatgatcgtctctagctt

SEQ ID NO: 420546 - DNA, 25 bp, Rattus norvegicus
ggacaagtcctgcagggcagattat

SEQ ID NO: 420547 - DNA, 25 bp, Rattus norvegicus
ggacaagtcctggagggcagattat

SEQ ID NO: 420548 - DNA, 25 bp, Rattus norvegicus
ggacaagtcttcaattcacagctac

SEQ ID NO: 420549 - DNA, 25 bp, Rattus norvegicus
ggacaagtcttctattcacagctac

SEQ ID NO: 420550 - DNA, 25 bp, Rattus norvegicus
ggacaagtgactagctctttgtggg

SEQ ID NO: 420551 - DNA, 25 bp, Rattus norvegicus
ggacaagtgacttgctctttgtggg

SEQ ID NO: 420552 - DNA, 25 bp, Rattus norvegicus
ggacaagtgtgtccgactccaagtt

SEQ ID NO: 420553 - DNA, 25 bp, Rattus norvegicus
ggacaagtgtgtcgacttcctgctc

SEQ ID NO: 420554 - DNA, 25 bp, Rattus norvegicus
ggacaagtgtgtgcgactccaagtt

SEQ ID NO: 420555 - DNA, 25 bp, Rattus norvegicus
ggacaagtgtgtggacttcctgctc

SEQ ID NO: 420556 - DNA, 25 bp, Rattus norvegicus
ggacaagtgtttccggaagtgcatc

SEQ ID NO: 420557 - DNA, 25 bp, Rattus norvegicus
ggacaagtgtttgcggaagtgcatc

SEQ ID NO: 420558 - DNA, 25 bp, Rattus norvegicus
ggacaagttagcaccctacatattg

SEQ ID NO: 420559 - DNA, 25 bp, Rattus norvegicus
ggacaagttagctccctacatattg

SEQ ID NO: 420560 - DNA, 25 bp, Rattus norvegicus
ggacaagttaggaaaagatctggat

SEQ ID NO: 420561 - DNA, 25 bp, Rattus norvegicus
ggacaagttaggtaaagatctggat

SEQ ID NO: 420562 - DNA, 25 bp, Rattus norvegicus
ggacaagttatcctcgctgggaaca

SEQ ID NO: 420563 - DNA, 25 bp, Rattus norvegicus
ggacaagttatcgtcgctgggaaca

SEQ ID NO: 420564 - DNA, 25 bp, Rattus norvegicus
ggacaagttctgaagtctggacgaa

SEQ ID NO: 420565 - DNA, 25 bp, Rattus norvegicus
ggacaagttctgtagtctggacgaa

SEQ ID NO: 420566 - DNA, 25 bp, Rattus norvegicus
ggacaagttggaaaatatcttaagc

SEQ ID NO: 420567 - DNA, 25 bp, Rattus norvegicus
ggacaagttggataatatcttaagc

SEQ ID NO: 420568 - DNA, 25 bp, Rattus norvegicus
ggacaagtttctacacctctcaaag

SEQ ID NO: 420569 - DNA, 25 bp, Rattus norvegicus
ggacaagtttctcggtcacgtgact

SEQ ID NO: 420570 - DNA, 25 bp, Rattus norvegicus
ggacaagtttctgggtcacgtgact

SEQ ID NO: 420571 - DNA, 25 bp, Rattus norvegicus
ggacaagtttcttcacctctcaaag

SEQ ID NO: 420572 - DNA, 25 bp, Rattus norvegicus
ggacaataacctcttgggcaagttc

SEQ ID NO: 420573 - DNA, 25 bp, Rattus norvegicus
ggacaataacctgttgggcaagttc

SEQ ID NO: 420574 - DNA, 25 bp, Rattus norvegicus
ggacaataatttaaacttatgctaa

SEQ ID NO: 420575 - DNA, 25 bp, Rattus norvegicus
ggacaataattttaacttatgctaa

SEQ ID NO: 420576 - DNA, 25 bp, Rattus norvegicus
ggacaatagaaaactgcaaacatgg

SEQ ID NO: 420577 - DNA, 25 bp, Rattus norvegicus
ggacaatagaaatctgcaaacatgg

SEQ ID NO: 420578 - DNA, 25 bp, Rattus norvegicus
ggacaatagctgctttatcctctgt

SEQ ID NO: 420579 - DNA, 25 bp, Rattus norvegicus
ggacaatagctggtttatcctctgt

SEQ ID NO: 420580 - DNA, 25 bp, Rattus norvegicus
ggacaatatatgcatcccacagaga

SEQ ID NO: 420581 - DNA, 25 bp, Rattus norvegicus
ggacaatatatggatcccacagaga

SEQ ID NO: 420582 - DNA, 25 bp, Rattus norvegicus
ggacaatatcaaccaaatctcaaag

SEQ ID NO: 420583 - DNA, 25 bp, Rattus norvegicus
ggacaatatcaagcaaatctcaaag

SEQ ID NO: 420584 - DNA, 25 bp, Rattus norvegicus
ggacaatatgtgcactttgctctta

SEQ ID NO: 420585 - DNA, 25 bp, Rattus norvegicus
ggacaatatgtggactttgctctta

SEQ ID NO: 420586 - DNA, 25 bp, Rattus norvegicus
ggacaatattccagacagcgctact

SEQ ID NO: 420587 - DNA, 25 bp, Rattus norvegicus
ggacaatattcctgacagcgctact

SEQ ID NO: 420588 - DNA, 25 bp, Rattus norvegicus
ggacaatcaaatatctacccacaga

SEQ ID NO: 420589 - DNA, 25 bp, Rattus norvegicus
ggacaatcaaatttctacccacaga

SEQ ID NO: 420590 - DNA, 25 bp, Rattus norvegicus
ggacaatcaaccctgactgagctct

SEQ ID NO: 420591 - DNA, 25 bp, Rattus norvegicus
ggacaatcaaccgtgactgagctct

SEQ ID NO: 420592 - DNA, 25 bp, Rattus norvegicus
ggacaatcactgcaagaggctcttt

SEQ ID NO: 420593 - DNA, 25 bp, Rattus norvegicus
ggacaatcactggaagaggctcttt

SEQ ID NO: 420594 - DNA, 25 bp, Rattus norvegicus
ggacaatcagggacaaccccgaaga

SEQ ID NO: 420595 - DNA, 25 bp, Rattus norvegicus
ggacaatcagggtcaaccccgaaga

SEQ ID NO: 420596 - DNA, 25 bp, Rattus norvegicus
ggacaatcagtgcttctgggctccc

SEQ ID NO: 420597 - DNA, 25 bp, Rattus norvegicus
ggacaatcagtggttctgggctccc

SEQ ID NO: 420598 - DNA, 25 bp, Rattus norvegicus
ggacaatcataactgcaattctgct

SEQ ID NO: 420599 - DNA, 25 bp, Rattus norvegicus
ggacaatcataagtgcaattctgct

SEQ ID NO: 420600 - DNA, 25 bp, Rattus norvegicus
ggacaatccaaacatcaaatacctt

SEQ ID NO: 420601 - DNA, 25 bp, Rattus norvegicus
ggacaatccaaagatcaaatacctt

SEQ ID NO: 420602 - DNA, 25 bp, Rattus norvegicus
ggacaatcgcttcaaatccctgaaa

SEQ ID NO: 420603 - DNA, 25 bp, Rattus norvegicus
ggacaatcgcttgaaatccctgaaa

SEQ ID NO: 420604 - DNA, 25 bp, Rattus norvegicus
ggacaatctgatacagttttccaga

SEQ ID NO: 420605 - DNA, 25 bp, Rattus norvegicus
ggacaatctgattcagttttccaga

SEQ ID NO: 420606 - DNA, 25 bp, Rattus norvegicus
ggacaatctgctactgttgagttca

SEQ ID NO: 420607 - DNA, 25 bp, Rattus norvegicus
ggacaatctgcttctgttgagttca

SEQ ID NO: 420608 - DNA, 25 bp, Rattus norvegicus
ggacaatctggtcaaggcaattctt

SEQ ID NO: 420609 - DNA, 25 bp, Rattus norvegicus
ggacaatctggtgaaggcaattctt

SEQ ID NO: 420610 - DNA, 25 bp, Rattus norvegicus
ggacaatcttcaatatctgtggtga

SEQ ID NO: 420611 - DNA, 25 bp, Rattus norvegicus
ggacaatcttcattatctgtggtga

SEQ ID NO: 420612 - DNA, 25 bp, Rattus norvegicus
ggacaatcttccaggttaccggaga

SEQ ID NO: 420613 - DNA, 25 bp, Rattus norvegicus
ggacaatcttcctggttaccggaga

SEQ ID NO: 420614 - DNA, 25 bp, Rattus norvegicus
ggacaatgaatccttcctgtttttc

SEQ ID NO: 420615 - DNA, 25 bp, Rattus norvegicus
ggacaatgaatcgttcctgtttttc

SEQ ID NO: 420616 - DNA, 25 bp, Rattus norvegicus
ggacaatgagaaccggcccatggct

SEQ ID NO: 420617 - DNA, 25 bp, Rattus norvegicus
ggacaatgagaagcggcccatggct

SEQ ID NO: 420618 - DNA, 25 bp, Rattus norvegicus
ggacaatgcgatcacggcgagccca

SEQ ID NO: 420619 - DNA, 25 bp, Rattus norvegicus
ggacaatgcgatgacggcgagccca

SEQ ID NO: 420620 - DNA, 25 bp, Rattus norvegicus
ggacaatgcggacggctctgacacc

SEQ ID NO: 420621 - DNA, 25 bp, Rattus norvegicus
ggacaatgcggagggctctgacacc

SEQ ID NO: 420622 - DNA, 25 bp, Rattus norvegicus
ggacaatggaacagctctacacaat

SEQ ID NO: 420623 - DNA, 25 bp, Rattus norvegicus
ggacaatggaactgctctacacaat

SEQ ID NO: 420624 - DNA, 25 bp, Rattus norvegicus
ggacaatggagtaatacacctatct

SEQ ID NO: 420625 - DNA, 25 bp, Rattus norvegicus
ggacaatggagttatacacctatct

SEQ ID NO: 420626 - DNA, 25 bp, Rattus norvegicus
ggacaatggattcaggccctactct

SEQ ID NO: 420627 - DNA, 25 bp, Rattus norvegicus
ggacaatggattgaggccctactct

SEQ ID NO: 420628 - DNA, 25 bp, Rattus norvegicus
ggacaatggcaaaccacgactgcta

SEQ ID NO: 420629 - DNA, 25 bp, Rattus norvegicus
ggacaatggcaatccacgactgcta

SEQ ID NO: 420630 - DNA, 25 bp, Rattus norvegicus
ggacaatgttctacatctggcccag

SEQ ID NO: 420631 - DNA, 25 bp, Rattus norvegicus
ggacaatgttcttcatctggcccag

SEQ ID NO: 420632 - DNA, 25 bp, Rattus norvegicus
ggacaattagctactttccccagat

SEQ ID NO: 420633 - DNA, 25 bp, Rattus norvegicus
ggacaattagcttctttccccagat

SEQ ID NO: 420634 - DNA, 25 bp, Rattus norvegicus
ggacaattatatatgtaacgctttc

SEQ ID NO: 420635 - DNA, 25 bp, Rattus norvegicus
ggacaattatatttgtaacgctttc

SEQ ID NO: 420636 - DNA, 25 bp, Rattus norvegicus
ggacaattcaaacagcggcatgcca

SEQ ID NO: 420637 - DNA, 25 bp, Rattus norvegicus
ggacaattcaaagagcggcatgcca

SEQ ID NO: 420638 - DNA, 25 bp, Rattus norvegicus
ggacaattcacgcaatgcccctttg

SEQ ID NO: 420639 - DNA, 25 bp, Rattus norvegicus
ggacaattcacggaatgcccctttg

SEQ ID NO: 420640 - DNA, 25 bp, Rattus norvegicus
ggacaattccataattttctgcagg

SEQ ID NO: 420641 - DNA, 25 bp, Rattus norvegicus
ggacaattccattattttctgcagg

SEQ ID NO: 420642 - DNA, 25 bp, Rattus norvegicus
ggacaattctcaccagtgtgacact

SEQ ID NO: 420643 - DNA, 25 bp, Rattus norvegicus
ggacaattctcagcagtgtgacact

SEQ ID NO: 420644 - DNA, 25 bp, Rattus norvegicus
ggacaattctcccatttttgagcca

SEQ ID NO: 420645 - DNA, 25 bp, Rattus norvegicus
ggacaattctccgatttttgagcca

SEQ ID NO: 420646 - DNA, 25 bp, Rattus norvegicus
ggacaattcttgatcttacatctgt

SEQ ID NO: 420647 - DNA, 25 bp, Rattus norvegicus
ggacaattcttgttcttacatctgt

SEQ ID NO: 420648 - DNA, 25 bp, Rattus norvegicus
ggacaattgcatacatggcgcctga

SEQ ID NO: 420649 - DNA, 25 bp, Rattus norvegicus
ggacaattgcattcatggcgcctga

SEQ ID NO: 420650 - DNA, 25 bp, Rattus norvegicus
ggacaattgcccactaatcacagat

SEQ ID NO: 420651 - DNA, 25 bp, Rattus norvegicus
ggacaattgccctctaatcacagat

SEQ ID NO: 420652 - DNA, 25 bp, Rattus norvegicus
ggacaatttccacgagtccttccac

SEQ ID NO: 420653 - DNA, 25 bp, Rattus norvegicus
ggacaatttccaggagtccttccac

SEQ ID NO: 420654 - DNA, 25 bp, Rattus norvegicus
ggacaatttctaacttctgtaaaag

SEQ ID NO: 420655 - DNA, 25 bp, Rattus norvegicus
ggacaatttctatcttctgtaaaag

SEQ ID NO: 420656 - DNA, 25 bp, Rattus norvegicus
ggacaattttatatcccttccctgt

SEQ ID NO: 420657 - DNA, 25 bp, Rattus norvegicus
ggacaattttatttcccttccctgt

SEQ ID NO: 420658 - DNA, 25 bp, Rattus norvegicus
ggacacaaagaaagaccccctactg

SEQ ID NO: 420659 - DNA, 25 bp, Rattus norvegicus
ggacacaaagaatgaccccctactg

SEQ ID NO: 420660 - DNA, 25 bp, Rattus norvegicus
ggacacaaagacctcaaaatagtaa

SEQ ID NO: 420661 - DNA, 25 bp, Rattus norvegicus
ggacacaaagacgtcaaaatagtaa

SEQ ID NO: 420662 - DNA, 25 bp, Rattus norvegicus
ggacacaacacgctcactccaagtg

SEQ ID NO: 420663 - DNA, 25 bp, Rattus norvegicus
ggacacaacacggtcactccaagtg

SEQ ID NO: 420664 - DNA, 25 bp, Rattus norvegicus
ggacacaacttgctcaaaggctggt

SEQ ID NO: 420665 - DNA, 25 bp, Rattus norvegicus
ggacacaacttggtcaaaggctggt

SEQ ID NO: 420666 - DNA, 25 bp, Rattus norvegicus
ggacacaagcctcatgaaaccactg

SEQ ID NO: 420667 - DNA, 25 bp, Rattus norvegicus
ggacacaagcctgatgaaaccactg

SEQ ID NO: 420668 - DNA, 25 bp, Rattus norvegicus
ggacacaaggaacggctagctgctc

SEQ ID NO: 420669 - DNA, 25 bp, Rattus norvegicus
ggacacaaggaagggctagctgctc

SEQ ID NO: 420670 - DNA, 25 bp, Rattus norvegicus
ggacacaagtgtcagattgcaggct

SEQ ID NO: 420671 - DNA, 25 bp, Rattus norvegicus
ggacacaagtgtgagattgcaggct

SEQ ID NO: 420672 - DNA, 25 bp, Rattus norvegicus
ggacacaattcaacaagagctacaa

SEQ ID NO: 420673 - DNA, 25 bp, Rattus norvegicus
ggacacaattcatcaagagctacaa

SEQ ID NO: 420674 - DNA, 25 bp, Rattus norvegicus
ggacacacacagactcagcgcaggt

SEQ ID NO: 420675 - DNA, 25 bp, Rattus norvegicus
ggacacacacagtctcagcgcaggt

SEQ ID NO: 420676 - DNA, 25 bp, Rattus norvegicus
ggacacacatacaacttctacttca

SEQ ID NO: 420677 - DNA, 25 bp, Rattus norvegicus
ggacacacatactacttctacttca

SEQ ID NO: 420678 - DNA, 25 bp, Rattus norvegicus
ggacacaccaagcacaagaggaaat

SEQ ID NO: 420679 - DNA, 25 bp, Rattus norvegicus
ggacacaccaaggacaagaggaaat

SEQ ID NO: 420680 - DNA, 25 bp, Rattus norvegicus
ggacacaccacaccacgagggcatg

SEQ ID NO: 420681 - DNA, 25 bp, Rattus norvegicus
ggacacaccacagcacgagggcatg

SEQ ID NO: 420682 - DNA, 25 bp, Rattus norvegicus
ggacacaccatgctgaccggcgtga

SEQ ID NO: 420683 - DNA, 25 bp, Rattus norvegicus
ggacacaccatggtgaccggcgtga

SEQ ID NO: 420684 - DNA, 25 bp, Rattus norvegicus
ggacacaccattcacttcatctgta

SEQ ID NO: 420685 - DNA, 25 bp, Rattus norvegicus
ggacacaccattgacttcatctgta

SEQ ID NO: 420686 - DNA, 25 bp, Rattus norvegicus
ggacacacccaaaaggttatctctt

SEQ ID NO: 420687 - DNA, 25 bp, Rattus norvegicus
ggacacacccaataggttatctctt

SEQ ID NO: 420688 - DNA, 25 bp, Rattus norvegicus
ggacacacccatactcgggttaata

SEQ ID NO: 420689 - DNA, 25 bp, Rattus norvegicus
ggacacacccattctcgggttaata

SEQ ID NO: 420690 - DNA, 25 bp, Rattus norvegicus
ggacacacgaaaactgggctcgccg

SEQ ID NO: 420691 - DNA, 25 bp, Rattus norvegicus
ggacacacgaaatctgggctcgccg

SEQ ID NO: 420692 - DNA, 25 bp, Rattus norvegicus
ggacacacggtcatgaccctggaga

SEQ ID NO: 420693 - DNA, 25 bp, Rattus norvegicus
ggacacacggtcttgaccctggaga

SEQ ID NO: 420694 - DNA, 25 bp, Rattus norvegicus
ggacacactccgatatagccaatgg

SEQ ID NO: 420695 - DNA, 25 bp, Rattus norvegicus
ggacacactccgttatagccaatgg

SEQ ID NO: 420696 - DNA, 25 bp, Rattus norvegicus
ggacacactcggctgatgcgttctg

SEQ ID NO: 420697 - DNA, 25 bp, Rattus norvegicus
ggacacactcgggtgatgcgttctg

SEQ ID NO: 420698 - DNA, 25 bp, Rattus norvegicus
ggacacactctaccctcgaggtata

SEQ ID NO: 420699 - DNA, 25 bp, Rattus norvegicus
ggacacactctagcctcgaggtata

SEQ ID NO: 420700 - DNA, 25 bp, Rattus norvegicus
ggacacactgccaagatttctgact

SEQ ID NO: 420701 - DNA, 25 bp, Rattus norvegicus
ggacacactgcctagatttctgact

SEQ ID NO: 420702 - DNA, 25 bp, Rattus norvegicus
ggacacactgtacttttaatggatt

SEQ ID NO: 420703 - DNA, 25 bp, Rattus norvegicus
ggacacactgtagttttaatggatt

SEQ ID NO: 420704 - DNA, 25 bp, Rattus norvegicus
ggacacactgttaatatcccaacaa

SEQ ID NO: 420705 - DNA, 25 bp, Rattus norvegicus
ggacacactgtttatatcccaacaa

SEQ ID NO: 420706 - DNA, 25 bp, Rattus norvegicus
ggacacacttctaaatacaacctgg

SEQ ID NO: 420707 - DNA, 25 bp, Rattus norvegicus
ggacacacttcttaatacaacctgg

SEQ ID NO: 420708 - DNA, 25 bp, Rattus norvegicus
ggacacagaacccattaagagctct

SEQ ID NO: 420709 - DNA, 25 bp, Rattus norvegicus
ggacacagaaccgattaagagctct

SEQ ID NO: 420710 - DNA, 25 bp, Rattus norvegicus
ggacacagaattctattcaatgctg

SEQ ID NO: 420711 - DNA, 25 bp, Rattus norvegicus
ggacacagaattgtattcaatgctg

SEQ ID NO: 420712 - DNA, 25 bp, Rattus norvegicus
ggacacagaccaaacgcaacagagc

SEQ ID NO: 420713 - DNA, 25 bp, Rattus norvegicus
ggacacagaccatacgcaacagagc

SEQ ID NO: 420714 - DNA, 25 bp, Rattus norvegicus
ggacacagacgcatctattggacct

SEQ ID NO: 420715 - DNA, 25 bp, Rattus norvegicus
ggacacagacgcttctattggacct

SEQ ID NO: 420716 - DNA, 25 bp, Rattus norvegicus
ggacacagataactagacacccatc

SEQ ID NO: 420717 - DNA, 25 bp, Rattus norvegicus
ggacacagataagtagacacccatc

SEQ ID NO: 420718 - DNA, 25 bp, Rattus norvegicus
ggacacagatatactctctctagag

SEQ ID NO: 420719 - DNA, 25 bp, Rattus norvegicus
ggacacagatattctctctctagag

SEQ ID NO: 420720 - DNA, 25 bp, Rattus norvegicus
ggacacagatctatctcaagagcag

SEQ ID NO: 420721 - DNA, 25 bp, Rattus norvegicus
ggacacagatctttctcaagagcag

SEQ ID NO: 420722 - DNA, 25 bp, Rattus norvegicus
ggacacagattcagccagccaaaga

SEQ ID NO: 420723 - DNA, 25 bp, Rattus norvegicus
ggacacagattctgccagccaaaga

SEQ ID NO: 420724 - DNA, 25 bp, Rattus norvegicus
ggacacagcaggatcttagctctga

SEQ ID NO: 420725 - DNA, 25 bp, Rattus norvegicus
ggacacagcaggttcttagctctga

SEQ ID NO: 420726 - DNA, 25 bp, Rattus norvegicus
ggacacagcagtaccgagggtcccg

SEQ ID NO: 420727 - DNA, 25 bp, Rattus norvegicus
ggacacagcagttccgagggtcccg

SEQ ID NO: 420728 - DNA, 25 bp, Rattus norvegicus
ggacacagcattcattcctgtctca

SEQ ID NO: 420729 - DNA, 25 bp, Rattus norvegicus
ggacacagcattgattcctgtctca

SEQ ID NO: 420730 - DNA, 25 bp, Rattus norvegicus
ggacacagcgagagttaacccgcat

SEQ ID NO: 420731 - DNA, 25 bp, Rattus norvegicus
ggacacagcgagtgttaacccgcat

SEQ ID NO: 420732 - DNA, 25 bp, Rattus norvegicus
ggacacagcgggaaaaccacctgaa

SEQ ID NO: 420733 - DNA, 25 bp, Rattus norvegicus
ggacacagcgggtaaaccacctgaa

SEQ ID NO: 420734 - DNA, 25 bp, Rattus norvegicus
ggacacagctgaatctccacagaaa

SEQ ID NO: 420735 - DNA, 25 bp, Rattus norvegicus
ggacacagctgattctccacagaaa

SEQ ID NO: 420736 - DNA, 25 bp, Rattus norvegicus
ggacacaggagcacctaagttcttg

SEQ ID NO: 420737 - DNA, 25 bp, Rattus norvegicus
ggacacaggagctcctaagttcttg

SEQ ID NO: 420738 - DNA, 25 bp, Rattus norvegicus
ggacacaggcttactcattcagcac

SEQ ID NO: 420739 - DNA, 25 bp, Rattus norvegicus
ggacacaggctttctcattcagcac

SEQ ID NO: 420740 - DNA, 25 bp, Rattus norvegicus
ggacacaggtgcaggcatggccatt

SEQ ID NO: 420741 - DNA, 25 bp, Rattus norvegicus
ggacacaggtgctggcatggccatt

SEQ ID NO: 420742 - DNA, 25 bp, Rattus norvegicus
ggacacagtcaacttggccaaacat

SEQ ID NO: 420743 - DNA, 25 bp, Rattus norvegicus
ggacacagtcaagttggccaaacat

SEQ ID NO: 420744 - DNA, 25 bp, Rattus norvegicus
ggacacagtgcaagttccagcagat

SEQ ID NO: 420745 - DNA, 25 bp, Rattus norvegicus
ggacacagtgcatgttccagcagat

SEQ ID NO: 420746 - DNA, 25 bp, Rattus norvegicus
ggacacagtgtgcatgaggacggga

SEQ ID NO: 420747 - DNA, 25 bp, Rattus norvegicus
ggacacagtgtggatgaggacggga

SEQ ID NO: 420748 - DNA, 25 bp, Rattus norvegicus
ggacacagtgttacccggatagctg

SEQ ID NO: 420749 - DNA, 25 bp, Rattus norvegicus
ggacacagtgtttcccggatagctg

SEQ ID NO: 420750 - DNA, 25 bp, Rattus norvegicus
ggacacagtttaacactctccatgt

SEQ ID NO: 420751 - DNA, 25 bp, Rattus norvegicus
ggacacagtttatcactctccatgt

SEQ ID NO: 420752 - DNA, 25 bp, Rattus norvegicus
ggacacataaccaagccttctggga

SEQ ID NO: 420753 - DNA, 25 bp, Rattus norvegicus
ggacacataacctagccttctggga

SEQ ID NO: 420754 - DNA, 25 bp, Rattus norvegicus
ggacacataataatcacctctcaga

SEQ ID NO: 420755 - DNA, 25 bp, Rattus norvegicus
ggacacataatattcacctctcaga

SEQ ID NO: 420756 - DNA, 25 bp, Rattus norvegicus
ggacacatatgccttggactctgag

SEQ ID NO: 420757 - DNA, 25 bp, Rattus norvegicus
ggacacatatgcgttggactctgag

SEQ ID NO: 420758 - DNA, 25 bp, Rattus norvegicus
ggacacatcaataacctcagaggat

SEQ ID NO: 420759 - DNA, 25 bp, Rattus norvegicus
ggacacatcaattacctcagaggat

SEQ ID NO: 420760 - DNA, 25 bp, Rattus norvegicus
ggacacatcctgcaaggaccagaca

SEQ ID NO: 420761 - DNA, 25 bp, Rattus norvegicus
ggacacatcctggaaggaccagaca

SEQ ID NO: 420762 - DNA, 25 bp, Rattus norvegicus
ggacacatgattctgcccgttactg

SEQ ID NO: 420763 - DNA, 25 bp, Rattus norvegicus
ggacacatgattgtgcccgttactg

SEQ ID NO: 420764 - DNA, 25 bp, Rattus norvegicus
ggacacatgcctacatttcacatga

SEQ ID NO: 420765 - DNA, 25 bp, Rattus norvegicus
ggacacatgccttcatttcacatga

SEQ ID NO: 420766 - DNA, 25 bp, Rattus norvegicus
ggacacatggcaatctcaaattctg

SEQ ID NO: 420767 - DNA, 25 bp, Rattus norvegicus
ggacacatggcattctcaaattctg

SEQ ID NO: 420768 - DNA, 25 bp, Rattus norvegicus
ggacacatggtcattatacagttaa

SEQ ID NO: 420769 - DNA, 25 bp, Rattus norvegicus
ggacacatggtctttatacagttaa

SEQ ID NO: 420770 - DNA, 25 bp, Rattus norvegicus
ggacacatggtgacttgctgtattt

SEQ ID NO: 420771 - DNA, 25 bp, Rattus norvegicus
ggacacatggtgtcttgctgtattt

SEQ ID NO: 420772 - DNA, 25 bp, Rattus norvegicus
ggacacatgtccatgtcctgaggcc

SEQ ID NO: 420773 - DNA, 25 bp, Rattus norvegicus
ggacacatgtcccagacaagccaag

SEQ ID NO: 420774 - DNA, 25 bp, Rattus norvegicus
ggacacatgtcccatcagttggaat

SEQ ID NO: 420775 - DNA, 25 bp, Rattus norvegicus
ggacacatgtccgagacaagccaag

SEQ ID NO: 420776 - DNA, 25 bp, Rattus norvegicus
ggacacatgtccgatcagttggaat

SEQ ID NO: 420777 - DNA, 25 bp, Rattus norvegicus
ggacacatgtccttgtcctgaggcc

SEQ ID NO: 420778 - DNA, 25 bp, Rattus norvegicus
ggacacatgttacagcctggtttta

SEQ ID NO: 420779 - DNA, 25 bp, Rattus norvegicus
ggacacatgttagagcctggtttta

SEQ ID NO: 420780 - DNA, 25 bp, Rattus norvegicus
ggacacatgttcatctgttaaacca

SEQ ID NO: 420781 - DNA, 25 bp, Rattus norvegicus
ggacacatgttcttctgttaaacca

SEQ ID NO: 420782 - DNA, 25 bp, Rattus norvegicus
ggacacattaagatatagatacaga

SEQ ID NO: 420783 - DNA, 25 bp, Rattus norvegicus
ggacacattaagttatagatacaga

SEQ ID NO: 420784 - DNA, 25 bp, Rattus norvegicus
ggacacattattcgccaggaggttt

SEQ ID NO: 420785 - DNA, 25 bp, Rattus norvegicus
ggacacattattggccaggaggttt

SEQ ID NO: 420786 - DNA, 25 bp, Rattus norvegicus
ggacacattctccatgatgacaatg

SEQ ID NO: 420787 - DNA, 25 bp, Rattus norvegicus
ggacacattctcgatgatgacaatg

SEQ ID NO: 420788 - DNA, 25 bp, Rattus norvegicus
ggacacattgctctacaaaagtact

SEQ ID NO: 420789 - DNA, 25 bp, Rattus norvegicus
ggacacattgctgtacaaaagtact

SEQ ID NO: 420790 - DNA, 25 bp, Rattus norvegicus
ggacacatttacaccacgcagatcg

SEQ ID NO: 420791 - DNA, 25 bp, Rattus norvegicus
ggacacatttactccacgcagatcg

SEQ ID NO: 420792 - DNA, 25 bp, Rattus norvegicus
ggacacatttcaatgcaaacgacag

SEQ ID NO: 420793 - DNA, 25 bp, Rattus norvegicus
ggacacatttcattgcaaacgacag

SEQ ID NO: 420794 - DNA, 25 bp, Rattus norvegicus
ggacacatttccaaagaacccctag

SEQ ID NO: 420795 - DNA, 25 bp, Rattus norvegicus
ggacacatttccaattgagactctt

SEQ ID NO: 420796 - DNA, 25 bp, Rattus norvegicus
ggacacatttcctaagaacccctag

SEQ ID NO: 420797 - DNA, 25 bp, Rattus norvegicus
ggacacatttcctattgagactctt

SEQ ID NO: 420798 - DNA, 25 bp, Rattus norvegicus
ggacaccaacatcagtgcaggctgt

SEQ ID NO: 420799 - DNA, 25 bp, Rattus norvegicus
ggacaccaacatgagtgcaggctgt

SEQ ID NO: 420800 - DNA, 25 bp, Rattus norvegicus
ggacaccacatcctttctattgaag

SEQ ID NO: 420801 - DNA, 25 bp, Rattus norvegicus
ggacaccacatcgtttctattgaag

SEQ ID NO: 420802 - DNA, 25 bp, Rattus norvegicus
ggacaccacccaccaggcagtgagt

SEQ ID NO: 420803 - DNA, 25 bp, Rattus norvegicus
ggacaccacccagcaggcagtgagt

SEQ ID NO: 420804 - DNA, 25 bp, Rattus norvegicus
ggacaccacggcaacatgaacacgg

SEQ ID NO: 420805 - DNA, 25 bp, Rattus norvegicus
ggacaccacggctacatgaacacgg

SEQ ID NO: 420806 - DNA, 25 bp, Rattus norvegicus
ggacaccagactctcatgaccatga

SEQ ID NO: 420807 - DNA, 25 bp, Rattus norvegicus
ggacaccagactgtcatgaccatga

SEQ ID NO: 420808 - DNA, 25 bp, Rattus norvegicus
ggacaccagcctaagttcattaagc

SEQ ID NO: 420809 - DNA, 25 bp, Rattus norvegicus
ggacaccagccttagttcattaagc

SEQ ID NO: 420810 - DNA, 25 bp, Rattus norvegicus
ggacaccaggatacaggcagtacat

SEQ ID NO: 420811 - DNA, 25 bp, Rattus norvegicus
ggacaccaggattcaggcagtacat

SEQ ID NO: 420812 - DNA, 25 bp, Rattus norvegicus
ggacaccagtcgataacaagtggaa

SEQ ID NO: 420813 - DNA, 25 bp, Rattus norvegicus
ggacaccagtcgttaacaagtggaa

SEQ ID NO: 420814 - DNA, 25 bp, Rattus norvegicus
ggacaccagtgccagagttctcagt

SEQ ID NO: 420815 - DNA, 25 bp, Rattus norvegicus
ggacaccagtgcgagagttctcagt

SEQ ID NO: 420816 - DNA, 25 bp, Rattus norvegicus
ggacaccatcacctctttggaactg

SEQ ID NO: 420817 - DNA, 25 bp, Rattus norvegicus
ggacaccatcacgtctttggaactg

SEQ ID NO: 420818 - DNA, 25 bp, Rattus norvegicus
ggacaccatccaactttcaaaacta

SEQ ID NO: 420819 - DNA, 25 bp, Rattus norvegicus
ggacaccatccatctttcaaaacta

SEQ ID NO: 420820 - DNA, 25 bp, Rattus norvegicus
ggacaccatgccactgtttcagaaa

SEQ ID NO: 420821 - DNA, 25 bp, Rattus norvegicus
ggacaccatgcctctgtttcagaaa

SEQ ID NO: 420822 - DNA, 25 bp, Rattus norvegicus
ggacacccaactaactactcaggaa

SEQ ID NO: 420823 - DNA, 25 bp, Rattus norvegicus
ggacacccaacttactactcaggaa

SEQ ID NO: 420824 - DNA, 25 bp, Rattus norvegicus
ggacacccatcgaggagaccctaag

SEQ ID NO: 420825 - DNA, 25 bp, Rattus norvegicus
ggacacccatcgtggagaccctaag

SEQ ID NO: 420826 - DNA, 25 bp, Rattus norvegicus
ggacaccccagtctggacccagtgg

SEQ ID NO: 420827 - DNA, 25 bp, Rattus norvegicus
ggacaccccagtgtggacccagtgg

SEQ ID NO: 420828 - DNA, 25 bp, Rattus norvegicus
ggacaccctggcctataaagttagt

SEQ ID NO: 420829 - DNA, 25 bp, Rattus norvegicus
ggacaccctggcgtataaagttagt

SEQ ID NO: 420830 - DNA, 25 bp, Rattus norvegicus
ggacaccgggacaggaatctggacc

SEQ ID NO: 420831 - DNA, 25 bp, Rattus norvegicus
ggacaccgggactggaatctggacc

SEQ ID NO: 420832 - DNA, 25 bp, Rattus norvegicus
ggacaccgtggcagctatcctgaaa

SEQ ID NO: 420833 - DNA, 25 bp, Rattus norvegicus
ggacaccgtggctgctatcctgaaa

SEQ ID NO: 420834 - DNA, 25 bp, Rattus norvegicus
ggacacctaccaacctatgagtgaa

SEQ ID NO: 420835 - DNA, 25 bp, Rattus norvegicus
ggacacctaccatcctatgagtgaa

SEQ ID NO: 420836 - DNA, 25 bp, Rattus norvegicus
ggacacctacttcatcttagtactc

SEQ ID NO: 420837 - DNA, 25 bp, Rattus norvegicus
ggacacctacttgatcttagtactc

SEQ ID NO: 420838 - DNA, 25 bp, Rattus norvegicus
ggacacctatctataccacatagac

SEQ ID NO: 420839 - DNA, 25 bp, Rattus norvegicus
ggacacctatctttaccacatagac

SEQ ID NO: 420840 - DNA, 25 bp, Rattus norvegicus
ggacacctccggaaatcagtgctaa

SEQ ID NO: 420841 - DNA, 25 bp, Rattus norvegicus
ggacacctccggtaatcagtgctaa

SEQ ID NO: 420842 - DNA, 25 bp, Rattus norvegicus
ggacacctcctccatgaactgagaa

SEQ ID NO: 420843 - DNA, 25 bp, Rattus norvegicus
ggacacctcctcgatgaactgagaa

SEQ ID NO: 420844 - DNA, 25 bp, Rattus norvegicus
ggacacctctttcacatttggaact

SEQ ID NO: 420845 - DNA, 25 bp, Rattus norvegicus
ggacacctctttgacatttggaact

SEQ ID NO: 420846 - DNA, 25 bp, Rattus norvegicus
ggacacctgagcacgcatgatggat

SEQ ID NO: 420847 - DNA, 25 bp, Rattus norvegicus
ggacacctgagctcgcatgatggat

SEQ ID NO: 420848 - DNA, 25 bp, Rattus norvegicus
ggacacctgaggctaagtttcctaa

SEQ ID NO: 420849 - DNA, 25 bp, Rattus norvegicus
ggacacctgaggctatcgaactttg

SEQ ID NO: 420850 - DNA, 25 bp, Rattus norvegicus
ggacacctgagggtaagtttcctaa

SEQ ID NO: 420851 - DNA, 25 bp, Rattus norvegicus
ggacacctgagggtatcgaactttg

SEQ ID NO: 420852 - DNA, 25 bp, Rattus norvegicus
ggacacctgctaaagatcactgaca

SEQ ID NO: 420853 - DNA, 25 bp, Rattus norvegicus
ggacacctgctatagatcactgaca

SEQ ID NO: 420854 - DNA, 25 bp, Rattus norvegicus
ggacacctgggaagagctcttgatt

SEQ ID NO: 420855 - DNA, 25 bp, Rattus norvegicus
ggacacctgggaagtagtgccacct

SEQ ID NO: 420856 - DNA, 25 bp, Rattus norvegicus
ggacacctgggatgagctcttgatt

SEQ ID NO: 420857 - DNA, 25 bp, Rattus norvegicus
ggacacctgggatgtagtgccacct

SEQ ID NO: 420858 - DNA, 25 bp, Rattus norvegicus
ggacacctgtctcacagcagtttaa

SEQ ID NO: 420859 - DNA, 25 bp, Rattus norvegicus
ggacacctgtctgacagcagtttaa

SEQ ID NO: 420860 - DNA, 25 bp, Rattus norvegicus
ggacacctgtgcagtcagtgattca

SEQ ID NO: 420861 - DNA, 25 bp, Rattus norvegicus
ggacacctgtgctgtcagtgattca

SEQ ID NO: 420862 - DNA, 25 bp, Rattus norvegicus
ggacaccttacacgaattggttcta

SEQ ID NO: 420863 - DNA, 25 bp, Rattus norvegicus
ggacaccttacaggaattggttcta

SEQ ID NO: 420864 - DNA, 25 bp, Rattus norvegicus
ggacaccttcgcaaatggcttttag

SEQ ID NO: 420865 - DNA, 25 bp, Rattus norvegicus
ggacaccttcgctaatggcttttag

SEQ ID NO: 420866 - DNA, 25 bp, Rattus norvegicus
ggacacctttacacatgtacacata

SEQ ID NO: 420867 - DNA, 25 bp, Rattus norvegicus
ggacacctttactcatgtacacata

SEQ ID NO: 420868 - DNA, 25 bp, Rattus norvegicus
ggacacctttgaattaagatgcttt

SEQ ID NO: 420869 - DNA, 25 bp, Rattus norvegicus
ggacacctttgatttaagatgcttt

SEQ ID NO: 420870 - DNA, 25 bp, Rattus norvegicus
ggacacctttgtcaagcagctaatc

SEQ ID NO: 420871 - DNA, 25 bp, Rattus norvegicus
ggacacctttgtgaagcagctaatc

SEQ ID NO: 420872 - DNA, 25 bp, Rattus norvegicus
ggacacgaactgagctgacgccgtt

SEQ ID NO: 420873 - DNA, 25 bp, Rattus norvegicus
ggacacgaactgtgctgacgccgtt

SEQ ID NO: 420874 - DNA, 25 bp, Rattus norvegicus
ggacacgaccagcacagagctgtca

SEQ ID NO: 420875 - DNA, 25 bp, Rattus norvegicus
ggacacgaccaggacagagctgtca

SEQ ID NO: 420876 - DNA, 25 bp, Rattus norvegicus
ggacacgatccccttgttagagcaa

SEQ ID NO: 420877 - DNA, 25 bp, Rattus norvegicus
ggacacgatcccgttgttagagcaa

SEQ ID NO: 420878 - DNA, 25 bp, Rattus norvegicus
ggacacgatgaaacccagccagctg

SEQ ID NO: 420879 - DNA, 25 bp, Rattus norvegicus
ggacacgatgaatcccagccagctg

SEQ ID NO: 420880 - DNA, 25 bp, Rattus norvegicus
ggacacgccgtgattaaatctctta

SEQ ID NO: 420881 - DNA, 25 bp, Rattus norvegicus
ggacacgccgtgtttaaatctctta

SEQ ID NO: 420882 - DNA, 25 bp, Rattus norvegicus
ggacacgcgcagcaggccaaccaga

SEQ ID NO: 420883 - DNA, 25 bp, Rattus norvegicus
ggacacgcgcaggaggccaaccaga

SEQ ID NO: 420884 - DNA, 25 bp, Rattus norvegicus
ggacacgcgtgcactcggattggca

SEQ ID NO: 420885 - DNA, 25 bp, Rattus norvegicus
ggacacgcgtgctctcggattggca

SEQ ID NO: 420886 - DNA, 25 bp, Rattus norvegicus
ggacacgctatgctggttctactta

SEQ ID NO: 420887 - DNA, 25 bp, Rattus norvegicus
ggacacgctatggtggttctactta

SEQ ID NO: 420888 - DNA, 25 bp, Rattus norvegicus
ggacacggacggactaggacttctc

SEQ ID NO: 420889 - DNA, 25 bp, Rattus norvegicus
ggacacggacggtctaggacttctc

SEQ ID NO: 420890 - DNA, 25 bp, Rattus norvegicus
ggacacggagccattggaaagccct

SEQ ID NO: 420891 - DNA, 25 bp, Rattus norvegicus
ggacacggagcctttggaaagccct

SEQ ID NO: 420892 - DNA, 25 bp, Rattus norvegicus
ggacacggagctctcgctgcattgc

SEQ ID NO: 420893 - DNA, 25 bp, Rattus norvegicus
ggacacggagctgtcgctgcattgc

SEQ ID NO: 420894 - DNA, 25 bp, Rattus norvegicus
ggacacggaggtacatgcctgtaat

SEQ ID NO: 420895 - DNA, 25 bp, Rattus norvegicus
ggacacggaggttcatgcctgtaat

SEQ ID NO: 420896 - DNA, 25 bp, Rattus norvegicus
ggacacggccggaagtctccagtgt

SEQ ID NO: 420897 - DNA, 25 bp, Rattus norvegicus
ggacacggccggtagtctccagtgt

SEQ ID NO: 420898 - DNA, 25 bp, Rattus norvegicus
ggacacggtctgcattgagtactat

SEQ ID NO: 420899 - DNA, 25 bp, Rattus norvegicus
ggacacggtctggattgagtactat

SEQ ID NO: 420900 - DNA, 25 bp, Rattus norvegicus
ggacacgtaagaagaaaagcgattc

SEQ ID NO: 420901 - DNA, 25 bp, Rattus norvegicus
ggacacgtaagatgaaaagcgattc

SEQ ID NO: 420902 - DNA, 25 bp, Rattus norvegicus
ggacacgtaatgcaatggactggca

SEQ ID NO: 420903 - DNA, 25 bp, Rattus norvegicus
ggacacgtaatggaatggactggca

SEQ ID NO: 420904 - DNA, 25 bp, Rattus norvegicus
ggacacgtacttaatagcaatcatc

SEQ ID NO: 420905 - DNA, 25 bp, Rattus norvegicus
ggacacgtacttccagaggctcgga

SEQ ID NO: 420906 - DNA, 25 bp, Rattus norvegicus
ggacacgtacttgcagaggctcgga

SEQ ID NO: 420907 - DNA, 25 bp, Rattus norvegicus
ggacacgtactttatagcaatcatc

SEQ ID NO: 420908 - DNA, 25 bp, Rattus norvegicus
ggacacgtgatacatactttttagc

SEQ ID NO: 420909 - DNA, 25 bp, Rattus norvegicus
ggacacgtgatagatactttttagc

SEQ ID NO: 420910 - DNA, 25 bp, Rattus norvegicus
ggacacgtgccacaatcagccagat

SEQ ID NO: 420911 - DNA, 25 bp, Rattus norvegicus
ggacacgtgccagaatcagccagat

SEQ ID NO: 420912 - DNA, 25 bp, Rattus norvegicus
ggacacgttccactatcatggttga

SEQ ID NO: 420913 - DNA, 25 bp, Rattus norvegicus
ggacacgttccagtatcatggttga

SEQ ID NO: 420914 - DNA, 25 bp, Rattus norvegicus
ggacacgtttgcagtcgaataaact

SEQ ID NO: 420915 - DNA, 25 bp, Rattus norvegicus
ggacacgtttgctgtcgaataaact

SEQ ID NO: 420916 - DNA, 25 bp, Rattus norvegicus
ggacactaaagtagccactgggaac

SEQ ID NO: 420917 - DNA, 25 bp, Rattus norvegicus
ggacactaaagttgccactgggaac

SEQ ID NO: 420918 - DNA, 25 bp, Rattus norvegicus
ggacactaaatacgaacttggactt

SEQ ID NO: 420919 - DNA, 25 bp, Rattus norvegicus
ggacactaaataggaacttggactt

SEQ ID NO: 420920 - DNA, 25 bp, Rattus norvegicus
ggacactacattaaggattgccctc

SEQ ID NO: 420921 - DNA, 25 bp, Rattus norvegicus
ggacactacatttaggattgccctc

SEQ ID NO: 420922 - DNA, 25 bp, Rattus norvegicus
ggacactacctgcaacactggttga

SEQ ID NO: 420923 - DNA, 25 bp, Rattus norvegicus
ggacactacctggaacactggttga

SEQ ID NO: 420924 - DNA, 25 bp, Rattus norvegicus
ggacactacttgaacactcctagat

SEQ ID NO: 420925 - DNA, 25 bp, Rattus norvegicus
ggacactacttgtacactcctagat

SEQ ID NO: 420926 - DNA, 25 bp, Rattus norvegicus
ggacactactttcttttcctgtgtt

SEQ ID NO: 420927 - DNA, 25 bp, Rattus norvegicus
ggacactactttgttttcctgtgtt

SEQ ID NO: 420928 - DNA, 25 bp, Rattus norvegicus
ggacactagcgacaaaagagcctga

SEQ ID NO: 420929 - DNA, 25 bp, Rattus norvegicus
ggacactagcgagaaaagagcctga

SEQ ID NO: 420930 - DNA, 25 bp, Rattus norvegicus
ggacactaggaaaccattcaaagta

SEQ ID NO: 420931 - DNA, 25 bp, Rattus norvegicus
ggacactaggaatccattcaaagta

SEQ ID NO: 420932 - DNA, 25 bp, Rattus norvegicus
ggacactaggtcattctctactata

SEQ ID NO: 420933 - DNA, 25 bp, Rattus norvegicus
ggacactaggtctttctctactata

SEQ ID NO: 420934 - DNA, 25 bp, Rattus norvegicus
ggacactatctcaagtggccagaaa

SEQ ID NO: 420935 - DNA, 25 bp, Rattus norvegicus
ggacactatctctagtggccagaaa

SEQ ID NO: 420936 - DNA, 25 bp, Rattus norvegicus
ggacactcactgattccagcaataa

SEQ ID NO: 420937 - DNA, 25 bp, Rattus norvegicus
ggacactcactgtttccagcaataa

SEQ ID NO: 420938 - DNA, 25 bp, Rattus norvegicus
ggacactcacttcactttataaact

SEQ ID NO: 420939 - DNA, 25 bp, Rattus norvegicus
ggacactcacttgactttataaact

SEQ ID NO: 420940 - DNA, 25 bp, Rattus norvegicus
ggacactcagccagccagatctaaa

SEQ ID NO: 420941 - DNA, 25 bp, Rattus norvegicus
ggacactcagcctgccagatctaaa

SEQ ID NO: 420942 - DNA, 25 bp, Rattus norvegicus
ggacactcagtccacccaaatggca

SEQ ID NO: 420943 - DNA, 25 bp, Rattus norvegicus
ggacactcagtcgacccaaatggca

SEQ ID NO: 420944 - DNA, 25 bp, Rattus norvegicus
ggacactccataccagacacttttg

SEQ ID NO: 420945 - DNA, 25 bp, Rattus norvegicus
ggacactccatagcagacacttttg

SEQ ID NO: 420946 - DNA, 25 bp, Rattus norvegicus
ggacactcctacaacagctggacga

SEQ ID NO: 420947 - DNA, 25 bp, Rattus norvegicus
ggacactcctactacagctggacga

SEQ ID NO: 420948 - DNA, 25 bp, Rattus norvegicus
ggacactcctgccaaatggtattcc

SEQ ID NO: 420949 - DNA, 25 bp, Rattus norvegicus
ggacactcctgcgaaatggtattcc

SEQ ID NO: 420950 - DNA, 25 bp, Rattus norvegicus
ggacactccttcatgcattttataa

SEQ ID NO: 420951 - DNA, 25 bp, Rattus norvegicus
ggacactccttcttgcattttataa

SEQ ID NO: 420952 - DNA, 25 bp, Rattus norvegicus
ggacactccttgctagtcgagcaga

SEQ ID NO: 420953 - DNA, 25 bp, Rattus norvegicus
ggacactccttggtagtcgagcaga

SEQ ID NO: 420954 - DNA, 25 bp, Rattus norvegicus
ggacactcgagacactattcacaca

SEQ ID NO: 420955 - DNA, 25 bp, Rattus norvegicus
ggacactcgagagactattcacaca

SEQ ID NO: 420956 - DNA, 25 bp, Rattus norvegicus
ggacactcggagcttagtcttccct

SEQ ID NO: 420957 - DNA, 25 bp, Rattus norvegicus
ggacactcggaggttagtcttccct

SEQ ID NO: 420958 - DNA, 25 bp, Rattus norvegicus
ggacactcgtgaccagaaccaacag

SEQ ID NO: 420959 - DNA, 25 bp, Rattus norvegicus
ggacactcgtgagcagaaccaacag

SEQ ID NO: 420960 - DNA, 25 bp, Rattus norvegicus
ggacactcgtgcatggtaaggaaac

SEQ ID NO: 420961 - DNA, 25 bp, Rattus norvegicus
ggacactcgtgcttggtaaggaaac

SEQ ID NO: 420962 - DNA, 25 bp, Rattus norvegicus
ggacactctatcagtagtgcatttt

SEQ ID NO: 420963 - DNA, 25 bp, Rattus norvegicus
ggacactctatctgtagtgcatttt

SEQ ID NO: 420964 - DNA, 25 bp, Rattus norvegicus
ggacactctggaatcctgttgggag

SEQ ID NO: 420965 - DNA, 25 bp, Rattus norvegicus
ggacactctggattcctgttgggag

SEQ ID NO: 420966 - DNA, 25 bp, Rattus norvegicus
ggacactctgtaatcctgttttcat

SEQ ID NO: 420967 - DNA, 25 bp, Rattus norvegicus
ggacactctgtattcctgttttcat

SEQ ID NO: 420968 - DNA, 25 bp, Rattus norvegicus
ggacactcttgactttttcttgttt

SEQ ID NO: 420969 - DNA, 25 bp, Rattus norvegicus
ggacactcttgagtttttcttgttt

SEQ ID NO: 420970 - DNA, 25 bp, Rattus norvegicus
ggacactcttggcacttgggacgct

SEQ ID NO: 420971 - DNA, 25 bp, Rattus norvegicus
ggacactcttgggacttgggacgct

SEQ ID NO: 420972 - DNA, 25 bp, Rattus norvegicus
ggacactgaatcatcggtatctcaa

SEQ ID NO: 420973 - DNA, 25 bp, Rattus norvegicus
ggacactgaatcttcggtatctcaa

SEQ ID NO: 420974 - DNA, 25 bp, Rattus norvegicus
ggacactgacagactcctggaagac

SEQ ID NO: 420975 - DNA, 25 bp, Rattus norvegicus
ggacactgacagtctcctggaagac

SEQ ID NO: 420976 - DNA, 25 bp, Rattus norvegicus
ggacactgaccacccattgcagcag

SEQ ID NO: 420977 - DNA, 25 bp, Rattus norvegicus
ggacactgaccagccattgcagcag

SEQ ID NO: 420978 - DNA, 25 bp, Rattus norvegicus
ggacactgacgaccacaatggactt

SEQ ID NO: 420979 - DNA, 25 bp, Rattus norvegicus
ggacactgacgactcgctggcaatt

SEQ ID NO: 420980 - DNA, 25 bp, Rattus norvegicus
ggacactgacgagcacaatggactt

SEQ ID NO: 420981 - DNA, 25 bp, Rattus norvegicus
ggacactgacgagtcgctggcaatt

SEQ ID NO: 420982 - DNA, 25 bp, Rattus norvegicus
ggacactgagaaccacaacccaggg

SEQ ID NO: 420983 - DNA, 25 bp, Rattus norvegicus
ggacactgagaagcacaacccaggg

SEQ ID NO: 420984 - DNA, 25 bp, Rattus norvegicus
ggacactgaggcagctgagaccata

SEQ ID NO: 420985 - DNA, 25 bp, Rattus norvegicus
ggacactgaggctgctgagaccata

SEQ ID NO: 420986 - DNA, 25 bp, Rattus norvegicus
ggacactgatgccatcaagcaacta

SEQ ID NO: 420987 - DNA, 25 bp, Rattus norvegicus
ggacactgatgcgatcaagcaacta

SEQ ID NO: 420988 - DNA, 25 bp, Rattus norvegicus
ggacactgcagaagctgggcactgt

SEQ ID NO: 420989 - DNA, 25 bp, Rattus norvegicus
ggacactgcagatgctgggcactgt

SEQ ID NO: 420990 - DNA, 25 bp, Rattus norvegicus
ggacactgcaggcaaactcatctta

SEQ ID NO: 420991 - DNA, 25 bp, Rattus norvegicus
ggacactgcagggaaactcatctta

SEQ ID NO: 420992 - DNA, 25 bp, Rattus norvegicus
ggacactgcagtacacaatgcggag

SEQ ID NO: 420993 - DNA, 25 bp, Rattus norvegicus
ggacactgcagttcacaatgcggag

SEQ ID NO: 420994 - DNA, 25 bp, Rattus norvegicus
ggacactgcctaaagcgatcacggt

SEQ ID NO: 420995 - DNA, 25 bp, Rattus norvegicus
ggacactgcctatagcgatcacggt

SEQ ID NO: 420996 - DNA, 25 bp, Rattus norvegicus
ggacactgctcaccacagagggaaa

SEQ ID NO: 420997 - DNA, 25 bp, Rattus norvegicus
ggacactgctcagcacagagggaaa

SEQ ID NO: 420998 - DNA, 25 bp, Rattus norvegicus
ggacactgctctatgtctagcaaat

SEQ ID NO: 420999 - DNA, 25 bp, Rattus norvegicus
ggacactgctctttgtctagcaaat

SEQ ID NO: 421000 - DNA, 25 bp, Rattus norvegicus
ggacactggacaaggccaacagctg

SEQ ID NO: 421001 - DNA, 25 bp, Rattus norvegicus
ggacactggacatggccaacagctg

SEQ ID NO: 421002 - DNA, 25 bp, Rattus norvegicus
ggacactggatgattcttaatctct

SEQ ID NO: 421003 - DNA, 25 bp, Rattus norvegicus
ggacactggatgtttcttaatctct

SEQ ID NO: 421004 - DNA, 25 bp, Rattus norvegicus
ggacactggccaatgctgcaccatg

SEQ ID NO: 421005 - DNA, 25 bp, Rattus norvegicus
ggacactggccattgctgcaccatg

SEQ ID NO: 421006 - DNA, 25 bp, Rattus norvegicus
ggacactggctaagtggacttttcc

SEQ ID NO: 421007 - DNA, 25 bp, Rattus norvegicus
ggacactggctatgtggacttttcc

SEQ ID NO: 421008 - DNA, 25 bp, Rattus norvegicus
ggacactggctgagagattctcacc

SEQ ID NO: 421009 - DNA, 25 bp, Rattus norvegicus
ggacactggctgtgagattctcacc

SEQ ID NO: 421010 - DNA, 25 bp, Rattus norvegicus
ggacactggcttactctaaatggga

SEQ ID NO: 421011 - DNA, 25 bp, Rattus norvegicus
ggacactggcttcaagaacattcac

SEQ ID NO: 421012 - DNA, 25 bp, Rattus norvegicus
ggacactggcttgaagaacattcac

SEQ ID NO: 421013 - DNA, 25 bp, Rattus norvegicus
ggacactggctttctctaaatggga

SEQ ID NO: 421014 - DNA, 25 bp, Rattus norvegicus
ggacactgggcaactttaaactgta

SEQ ID NO: 421015 - DNA, 25 bp, Rattus norvegicus
ggacactgggcatctttaaactgta

SEQ ID NO: 421016 - DNA, 25 bp, Rattus norvegicus
ggacactggttaacttggcacatgc

SEQ ID NO: 421017 - DNA, 25 bp, Rattus norvegicus
ggacactggttatcttggcacatgc

SEQ ID NO: 421018 - DNA, 25 bp, Rattus norvegicus
ggacactgtacaaccttaggagcga

SEQ ID NO: 421019 - DNA, 25 bp, Rattus norvegicus
ggacactgtacatccttaggagcga

SEQ ID NO: 421020 - DNA, 25 bp, Rattus norvegicus
ggacactgtatcaacctggtggaca

SEQ ID NO: 421021 - DNA, 25 bp, Rattus norvegicus
ggacactgtatctacctggtggaca

SEQ ID NO: 421022 - DNA, 25 bp, Rattus norvegicus
ggacactgtcaacaggctgtgcata

SEQ ID NO: 421023 - DNA, 25 bp, Rattus norvegicus
ggacactgtcaacgtcttttattta

SEQ ID NO: 421024 - DNA, 25 bp, Rattus norvegicus
ggacactgtcaagaggctgtgcata

SEQ ID NO: 421025 - DNA, 25 bp, Rattus norvegicus
ggacactgtcaaggtcttttattta

SEQ ID NO: 421026 - DNA, 25 bp, Rattus norvegicus
ggacactgtcccatgtgagtagtaa

SEQ ID NO: 421027 - DNA, 25 bp, Rattus norvegicus
ggacactgtcccttgtgagtagtaa

SEQ ID NO: 421028 - DNA, 25 bp, Rattus norvegicus
ggacactgtgatccgagactgcctt

SEQ ID NO: 421029 - DNA, 25 bp, Rattus norvegicus
ggacactgtgatgcgagactgcctt

SEQ ID NO: 421030 - DNA, 25 bp, Rattus norvegicus
ggacactgtggcctggtgatttcac

SEQ ID NO: 421031 - DNA, 25 bp, Rattus norvegicus
ggacactgtggcgtggtgatttcac

SEQ ID NO: 421032 - DNA, 25 bp, Rattus norvegicus
ggacactgtggtcctcaacgagact

SEQ ID NO: 421033 - DNA, 25 bp, Rattus norvegicus
ggacactgtggtgctcaacgagact

SEQ ID NO: 421034 - DNA, 25 bp, Rattus norvegicus
ggacactgtgttacatcaccggctg

SEQ ID NO: 421035 - DNA, 25 bp, Rattus norvegicus
ggacactgtgttcgtgacctgctca

SEQ ID NO: 421036 - DNA, 25 bp, Rattus norvegicus
ggacactgtgttggtgacctgctca

SEQ ID NO: 421037 - DNA, 25 bp, Rattus norvegicus
ggacactgtgtttcatcaccggctg

SEQ ID NO: 421038 - DNA, 25 bp, Rattus norvegicus
ggacactgtttaacatcatttcaca

SEQ ID NO: 421039 - DNA, 25 bp, Rattus norvegicus
ggacactgtttatcatcatttcaca

SEQ ID NO: 421040 - DNA, 25 bp, Rattus norvegicus
ggacacttaaaaatcatgagaccgt

SEQ ID NO: 421041 - DNA, 25 bp, Rattus norvegicus
ggacacttaaaattcatgagaccgt

SEQ ID NO: 421042 - DNA, 25 bp, Rattus norvegicus
ggacacttcaggacactttcacagg

SEQ ID NO: 421043 - DNA, 25 bp, Rattus norvegicus
ggacacttcaggtcactttcacagg

SEQ ID NO: 421044 - DNA, 25 bp, Rattus norvegicus
ggacacttcatgatcctgattgaat

SEQ ID NO: 421045 - DNA, 25 bp, Rattus norvegicus
ggacacttcatgttcctgattgaat

SEQ ID NO: 421046 - DNA, 25 bp, Rattus norvegicus
ggacacttctacaaaaacctgggct

SEQ ID NO: 421047 - DNA, 25 bp, Rattus norvegicus
ggacacttctactaaaacctgggct

SEQ ID NO: 421048 - DNA, 25 bp, Rattus norvegicus
ggacacttgcctccagagcccagaa

SEQ ID NO: 421049 - DNA, 25 bp, Rattus norvegicus
ggacacttgcctgcagagcccagaa

SEQ ID NO: 421050 - DNA, 25 bp, Rattus norvegicus
ggacacttgctcactgtctgagcat

SEQ ID NO: 421051 - DNA, 25 bp, Rattus norvegicus
ggacacttgctctctgtctgagcat

SEQ ID NO: 421052 - DNA, 25 bp, Rattus norvegicus
ggacacttggatatctcatccgcaa

SEQ ID NO: 421053 - DNA, 25 bp, Rattus norvegicus
ggacacttggatctttgttctcgtt

SEQ ID NO: 421054 - DNA, 25 bp, Rattus norvegicus
ggacacttggatgtttgttctcgtt

SEQ ID NO: 421055 - DNA, 25 bp, Rattus norvegicus
ggacacttggatttctcatccgcaa

SEQ ID NO: 421056 - DNA, 25 bp, Rattus norvegicus
ggacactttattatctatggctttc

SEQ ID NO: 421057 - DNA, 25 bp, Rattus norvegicus
ggacactttattttctatggctttc

SEQ ID NO: 421058 - DNA, 25 bp, Rattus norvegicus
ggacactttcctcacagatgtacgg

SEQ ID NO: 421059 - DNA, 25 bp, Rattus norvegicus
ggacactttcctgacagatgtacgg

SEQ ID NO: 421060 - DNA, 25 bp, Rattus norvegicus
ggacagaaaaccctcagctcagaaa

SEQ ID NO: 421061 - DNA, 25 bp, Rattus norvegicus
ggacagaaaaccgtcagctcagaaa

SEQ ID NO: 421062 - DNA, 25 bp, Rattus norvegicus
ggacagaaactacgctcagaaccct

SEQ ID NO: 421063 - DNA, 25 bp, Rattus norvegicus
ggacagaaactaggctcagaaccct

SEQ ID NO: 421064 - DNA, 25 bp, Rattus norvegicus
ggacagaacccaatctcataagctg

SEQ ID NO: 421065 - DNA, 25 bp, Rattus norvegicus
ggacagaacccattctcataagctg

SEQ ID NO: 421066 - DNA, 25 bp, Rattus norvegicus
ggacagaactctcagctgtgtagct

SEQ ID NO: 421067 - DNA, 25 bp, Rattus norvegicus
ggacagaactctgagctgtgtagct

SEQ ID NO: 421068 - DNA, 25 bp, Rattus norvegicus
ggacagaactgcaatcttccaatca

SEQ ID NO: 421069 - DNA, 25 bp, Rattus norvegicus
ggacagaactgctatcttccaatca

SEQ ID NO: 421070 - DNA, 25 bp, Rattus norvegicus
ggacagaagccccatcgtcagatga

SEQ ID NO: 421071 - DNA, 25 bp, Rattus norvegicus
ggacagaagcccgatcgtcagatga

SEQ ID NO: 421072 - DNA, 25 bp, Rattus norvegicus
ggacagaatggaatgggtacttaca

SEQ ID NO: 421073 - DNA, 25 bp, Rattus norvegicus
ggacagaatggattgggtacttaca

SEQ ID NO: 421074 - DNA, 25 bp, Rattus norvegicus
ggacagacaactcatcactgatcta

SEQ ID NO: 421075 - DNA, 25 bp, Rattus norvegicus
ggacagacaactgatcactgatcta

SEQ ID NO: 421076 - DNA, 25 bp, Rattus norvegicus
ggacagacaagcactttcgagcctt

SEQ ID NO: 421077 - DNA, 25 bp, Rattus norvegicus
ggacagacaagctctttcgagcctt

SEQ ID NO: 421078 - DNA, 25 bp, Rattus norvegicus
ggacagacactcaaggccacaagcg

SEQ ID NO: 421079 - DNA, 25 bp, Rattus norvegicus
ggacagacactctaggccacaagcg

SEQ ID NO: 421080 - DNA, 25 bp, Rattus norvegicus
ggacagacagcaacacttaggtgtt

SEQ ID NO: 421081 - DNA, 25 bp, Rattus norvegicus
ggacagacagcatcacttaggtgtt

SEQ ID NO: 421082 - DNA, 25 bp, Rattus norvegicus
ggacagacagtacctttacatgcca

SEQ ID NO: 421083 - DNA, 25 bp, Rattus norvegicus
ggacagacagtagctttacatgcca

SEQ ID NO: 421084 - DNA, 25 bp, Rattus norvegicus
ggacagacagtcaagctcaactagt

SEQ ID NO: 421085 - DNA, 25 bp, Rattus norvegicus
ggacagacagtctagctcaactagt

SEQ ID NO: 421086 - DNA, 25 bp, Rattus norvegicus
ggacagacataccatggccagcata

SEQ ID NO: 421087 - DNA, 25 bp, Rattus norvegicus
ggacagacatacgatggccagcata

SEQ ID NO: 421088 - DNA, 25 bp, Rattus norvegicus
ggacagaccaccagagaatggccaa

SEQ ID NO: 421089 - DNA, 25 bp, Rattus norvegicus
ggacagaccacctgagaatggccaa

SEQ ID NO: 421090 - DNA, 25 bp, Rattus norvegicus
ggacagaccaggcacatgggaccaa

SEQ ID NO: 421091 - DNA, 25 bp, Rattus norvegicus
ggacagaccagggacatgggaccaa

SEQ ID NO: 421092 - DNA, 25 bp, Rattus norvegicus
ggacagaccctgactctggagggaa

SEQ ID NO: 421093 - DNA, 25 bp, Rattus norvegicus
ggacagaccctgtctctggagggaa

SEQ ID NO: 421094 - DNA, 25 bp, Rattus norvegicus
ggacagacctgacatggtacccaga

SEQ ID NO: 421095 - DNA, 25 bp, Rattus norvegicus
ggacagacctgagatggtacccaga

SEQ ID NO: 421096 - DNA, 25 bp, Rattus norvegicus
ggacagacctgtcattatgagccca

SEQ ID NO: 421097 - DNA, 25 bp, Rattus norvegicus
ggacagacctgtgattatgagccca

SEQ ID NO: 421098 - DNA, 25 bp, Rattus norvegicus
ggacagacgtccattatatatataa

SEQ ID NO: 421099 - DNA, 25 bp, Rattus norvegicus
ggacagacgtcctttatatatataa

SEQ ID NO: 421100 - DNA, 25 bp, Rattus norvegicus
ggacagactcccatatagctaattc

SEQ ID NO: 421101 - DNA, 25 bp, Rattus norvegicus
ggacagactcccttatagctaattc

SEQ ID NO: 421102 - DNA, 25 bp, Rattus norvegicus
ggacagactctactgagcacctttt

SEQ ID NO: 421103 - DNA, 25 bp, Rattus norvegicus
ggacagactctagtgagcacctttt

SEQ ID NO: 421104 - DNA, 25 bp, Rattus norvegicus
ggacagactctgattggctgagcaa

SEQ ID NO: 421105 - DNA, 25 bp, Rattus norvegicus
ggacagactctgtttggctgagcaa

SEQ ID NO: 421106 - DNA, 25 bp, Rattus norvegicus
ggacagagaatccttgactgcccca

SEQ ID NO: 421107 - DNA, 25 bp, Rattus norvegicus
ggacagagaatcgttgactgcccca

SEQ ID NO: 421108 - DNA, 25 bp, Rattus norvegicus
ggacagagacaacggtcttctgcaa

SEQ ID NO: 421109 - DNA, 25 bp, Rattus norvegicus
ggacagagacaagggtcttctgcaa

SEQ ID NO: 421110 - DNA, 25 bp, Rattus norvegicus
ggacagagacctacccactgagatg

SEQ ID NO: 421111 - DNA, 25 bp, Rattus norvegicus
ggacagagaccttcccactgagatg

SEQ ID NO: 421112 - DNA, 25 bp, Rattus norvegicus
ggacagagcaacaacctggttctca

SEQ ID NO: 421113 - DNA, 25 bp, Rattus norvegicus
ggacagagcaactacctggttctca

SEQ ID NO: 421114 - DNA, 25 bp, Rattus norvegicus
ggacagagcgaaaggtcacccagct

SEQ ID NO: 421115 - DNA, 25 bp, Rattus norvegicus
ggacagagcgaatggtcacccagct

SEQ ID NO: 421116 - DNA, 25 bp, Rattus norvegicus
ggacagagctttctggatatcccca

SEQ ID NO: 421117 - DNA, 25 bp, Rattus norvegicus
ggacagagctttgtggatatcccca

SEQ ID NO: 421118 - DNA, 25 bp, Rattus norvegicus
ggacagaggatcacttccctggcag

SEQ ID NO: 421119 - DNA, 25 bp, Rattus norvegicus
ggacagaggatctcttccctggcag

SEQ ID NO: 421120 - DNA, 25 bp, Rattus norvegicus
ggacagaggcacactcctttatgga

SEQ ID NO: 421121 - DNA, 25 bp, Rattus norvegicus
ggacagaggcactctcctttatgga

SEQ ID NO: 421122 - DNA, 25 bp, Rattus norvegicus
ggacagaggccaaagtaaagtacat

SEQ ID NO: 421123 - DNA, 25 bp, Rattus norvegicus
ggacagaggccatagtaaagtacat

SEQ ID NO: 421124 - DNA, 25 bp, Rattus norvegicus
ggacagaggcgcagcaccatcctgg

SEQ ID NO: 421125 - DNA, 25 bp, Rattus norvegicus
ggacagaggcgctgcaccatcctgg

SEQ ID NO: 421126 - DNA, 25 bp, Rattus norvegicus
ggacagagtctcaagcccttaattt

SEQ ID NO: 421127 - DNA, 25 bp, Rattus norvegicus
ggacagagtctctagcccttaattt

SEQ ID NO: 421128 - DNA, 25 bp, Rattus norvegicus
ggacagagtgccaaggtatgagcct

SEQ ID NO: 421129 - DNA, 25 bp, Rattus norvegicus
ggacagagtgcctaggtatgagcct

SEQ ID NO: 421130 - DNA, 25 bp, Rattus norvegicus
ggacagataaaccatcatgctacta

SEQ ID NO: 421131 - DNA, 25 bp, Rattus norvegicus
ggacagataaacgatcatgctacta

SEQ ID NO: 421132 - DNA, 25 bp, Rattus norvegicus
ggacagatacacacctttatttgta

SEQ ID NO: 421133 - DNA, 25 bp, Rattus norvegicus
ggacagatacactcctttatttgta

SEQ ID NO: 421134 - DNA, 25 bp, Rattus norvegicus
ggacagatcagacctttgctcctcc

SEQ ID NO: 421135 - DNA, 25 bp, Rattus norvegicus
ggacagatcagagctttgctcctcc

SEQ ID NO: 421136 - DNA, 25 bp, Rattus norvegicus
ggacagatcatcacaacatggtctt

SEQ ID NO: 421137 - DNA, 25 bp, Rattus norvegicus
ggacagatcatctcaacatggtctt

SEQ ID NO: 421138 - DNA, 25 bp, Rattus norvegicus
ggacagatctacaggctacatcgca

SEQ ID NO: 421139 - DNA, 25 bp, Rattus norvegicus
ggacagatctactggctacatcgca

SEQ ID NO: 421140 - DNA, 25 bp, Rattus norvegicus
ggacagatctgaccatgaccaccca

SEQ ID NO: 421141 - DNA, 25 bp, Rattus norvegicus
ggacagatctgagcatgaccaccca

SEQ ID NO: 421142 - DNA, 25 bp, Rattus norvegicus
ggacagatctgcatcagcatctctc

SEQ ID NO: 421143 - DNA, 25 bp, Rattus norvegicus
ggacagatctgcttcagcatctctc

SEQ ID NO: 421144 - DNA, 25 bp, Rattus norvegicus
ggacagatctgtcacatcccagtgt

SEQ ID NO: 421145 - DNA, 25 bp, Rattus norvegicus
ggacagatctgtgacatcccagtgt

SEQ ID NO: 421146 - DNA, 25 bp, Rattus norvegicus
ggacagatcttcctgccaaaatcat

SEQ ID NO: 421147 - DNA, 25 bp, Rattus norvegicus
ggacagatcttcgtgccaaaatcat

SEQ ID NO: 421148 - DNA, 25 bp, Rattus norvegicus
ggacagatgactaggactcatacca

SEQ ID NO: 421149 - DNA, 25 bp, Rattus norvegicus
ggacagatgacttggactcatacca

SEQ ID NO: 421150 - DNA, 25 bp, Rattus norvegicus
ggacagatgatcaacaacagctaga

SEQ ID NO: 421151 - DNA, 25 bp, Rattus norvegicus
ggacagatgatctacaacagctaga

SEQ ID NO: 421152 - DNA, 25 bp, Rattus norvegicus
ggacagatgattctcccaagaactc

SEQ ID NO: 421153 - DNA, 25 bp, Rattus norvegicus
ggacagatgattgtcccaagaactc

SEQ ID NO: 421154 - DNA, 25 bp, Rattus norvegicus
ggacagatgctcactactcctggaa

SEQ ID NO: 421155 - DNA, 25 bp, Rattus norvegicus
ggacagatgctctctactcctggaa

SEQ ID NO: 421156 - DNA, 25 bp, Rattus norvegicus
ggacagatggaaactcatcccttca

SEQ ID NO: 421157 - DNA, 25 bp, Rattus norvegicus
ggacagatggaatctcatcccttca

SEQ ID NO: 421158 - DNA, 25 bp, Rattus norvegicus
ggacagatggctataactctacatt

SEQ ID NO: 421159 - DNA, 25 bp, Rattus norvegicus
ggacagatggctttaactctacatt

SEQ ID NO: 421160 - DNA, 25 bp, Rattus norvegicus
ggacagatgtacagatccctgggcc

SEQ ID NO: 421161 - DNA, 25 bp, Rattus norvegicus
ggacagatgtactgatccctgggcc

SEQ ID NO: 421162 - DNA, 25 bp, Rattus norvegicus
ggacagatgtcacttacctctgcaa

SEQ ID NO: 421163 - DNA, 25 bp, Rattus norvegicus
ggacagatgtcagttacctctgcaa

SEQ ID NO: 421164 - DNA, 25 bp, Rattus norvegicus
ggacagatgtctacgtgaacttaac

SEQ ID NO: 421165 - DNA, 25 bp, Rattus norvegicus
ggacagatgtcttcgtgaacttaac

SEQ ID NO: 421166 - DNA, 25 bp, Rattus norvegicus
ggacagatttctagtttcaaaacga

SEQ ID NO: 421167 - DNA, 25 bp, Rattus norvegicus
ggacagatttcttgtttcaaaacga

SEQ ID NO: 421168 - DNA, 25 bp, Rattus norvegicus
ggacagcaaactcgcagcactttaa

SEQ ID NO: 421169 - DNA, 25 bp, Rattus norvegicus
ggacagcaaactggcagcactttaa

SEQ ID NO: 421170 - DNA, 25 bp, Rattus norvegicus
ggacagcaacctacttgtatgttca

SEQ ID NO: 421171 - DNA, 25 bp, Rattus norvegicus
ggacagcaaccttcttgtatgttca

SEQ ID NO: 421172 - DNA, 25 bp, Rattus norvegicus
ggacagcaagccagccggttacagc

SEQ ID NO: 421173 - DNA, 25 bp, Rattus norvegicus
ggacagcaagcctgccggttacagc

SEQ ID NO: 421174 - DNA, 25 bp, Rattus norvegicus
ggacagcaatgcaggtgacatcagc

SEQ ID NO: 421175 - DNA, 25 bp, Rattus norvegicus
ggacagcaatgctggtgacatcagc

SEQ ID NO: 421176 - DNA, 25 bp, Rattus norvegicus
ggacagcaattcaagcgccagttca

SEQ ID NO: 421177 - DNA, 25 bp, Rattus norvegicus
ggacagcaattctagcgccagttca

SEQ ID NO: 421178 - DNA, 25 bp, Rattus norvegicus
ggacagcaattgacttggactgtta

SEQ ID NO: 421179 - DNA, 25 bp, Rattus norvegicus
ggacagcaattgtcttggactgtta

SEQ ID NO: 421180 - DNA, 25 bp, Rattus norvegicus
ggacagcacaagatgttcatactaa

SEQ ID NO: 421181 - DNA, 25 bp, Rattus norvegicus
ggacagcacaagttgttcatactaa

SEQ ID NO: 421182 - DNA, 25 bp, Rattus norvegicus
ggacagcacagaaacagccttgact

SEQ ID NO: 421183 - DNA, 25 bp, Rattus norvegicus
ggacagcacagatacagccttgact

SEQ ID NO: 421184 - DNA, 25 bp, Rattus norvegicus
ggacagcactgcaagaccaggttta

SEQ ID NO: 421185 - DNA, 25 bp, Rattus norvegicus
ggacagcactgctagaccaggttta

SEQ ID NO: 421186 - DNA, 25 bp, Rattus norvegicus
ggacagcactgtacctcacatcagg

SEQ ID NO: 421187 - DNA, 25 bp, Rattus norvegicus
ggacagcactgttcctcacatcagg

SEQ ID NO: 421188 - DNA, 25 bp, Rattus norvegicus
ggacagcagccaccgtgaacatgaa

SEQ ID NO: 421189 - DNA, 25 bp, Rattus norvegicus
ggacagcagccagcgtgaacatgaa

SEQ ID NO: 421190 - DNA, 25 bp, Rattus norvegicus
ggacagcagcgcactcggccagtgc

SEQ ID NO: 421191 - DNA, 25 bp, Rattus norvegicus
ggacagcagcgctctcggccagtgc

SEQ ID NO: 421192 - DNA, 25 bp, Rattus norvegicus
ggacagcagctacctcttaacttgt

SEQ ID NO: 421193 - DNA, 25 bp, Rattus norvegicus
ggacagcagctagctcttaacttgt

SEQ ID NO: 421194 - DNA, 25 bp, Rattus norvegicus
ggacagcagtcaaagtctccagaat

SEQ ID NO: 421195 - DNA, 25 bp, Rattus norvegicus
ggacagcagtcatagtctccagaat

SEQ ID NO: 421196 - DNA, 25 bp, Rattus norvegicus
ggacagcagtgcagctgccatcatt

SEQ ID NO: 421197 - DNA, 25 bp, Rattus norvegicus
ggacagcagtgctgctgccatcatt

SEQ ID NO: 421198 - DNA, 25 bp, Rattus norvegicus
ggacagcagtgtactgtgggccctc

SEQ ID NO: 421199 - DNA, 25 bp, Rattus norvegicus
ggacagcagtgtacttgcagaaacc

SEQ ID NO: 421200 - DNA, 25 bp, Rattus norvegicus
ggacagcagtgttctgtgggccctc

SEQ ID NO: 421201 - DNA, 25 bp, Rattus norvegicus
ggacagcagtgttcttgcagaaacc

SEQ ID NO: 421202 - DNA, 25 bp, Rattus norvegicus
ggacagcatccaccgagtcttacag

SEQ ID NO: 421203 - DNA, 25 bp, Rattus norvegicus
ggacagcatccagcgagtcttacag

SEQ ID NO: 421204 - DNA, 25 bp, Rattus norvegicus
ggacagcatcctcgtgttcagcaac

SEQ ID NO: 421205 - DNA, 25 bp, Rattus norvegicus
ggacagcatcctggtgttcagcaac

SEQ ID NO: 421206 - DNA, 25 bp, Rattus norvegicus
ggacagcatctaactccaggctggt

SEQ ID NO: 421207 - DNA, 25 bp, Rattus norvegicus
ggacagcatctatctccaggctggt

SEQ ID NO: 421208 - DNA, 25 bp, Rattus norvegicus
ggacagcatctcctcttagagagga

SEQ ID NO: 421209 - DNA, 25 bp, Rattus norvegicus
ggacagcatctcgtcttagagagga

SEQ ID NO: 421210 - DNA, 25 bp, Rattus norvegicus
ggacagcattccacagtgactcaac

SEQ ID NO: 421211 - DNA, 25 bp, Rattus norvegicus
ggacagcattcctcagtgactcaac

SEQ ID NO: 421212 - DNA, 25 bp, Rattus norvegicus
ggacagcattgtatctctttgagac

SEQ ID NO: 421213 - DNA, 25 bp, Rattus norvegicus
ggacagcattgtttctctttgagac

SEQ ID NO: 421214 - DNA, 25 bp, Rattus norvegicus
ggacagcatttcatacgtaaccatt

SEQ ID NO: 421215 - DNA, 25 bp, Rattus norvegicus
ggacagcatttcatagctctatagt

SEQ ID NO: 421216 - DNA, 25 bp, Rattus norvegicus
ggacagcatttcttacgtaaccatt

SEQ ID NO: 421217 - DNA, 25 bp, Rattus norvegicus
ggacagcatttcttagctctatagt

SEQ ID NO: 421218 - DNA, 25 bp, Rattus norvegicus
ggacagccaaatcggccctggacta

SEQ ID NO: 421219 - DNA, 25 bp, Rattus norvegicus
ggacagccaaatgggccctggacta

SEQ ID NO: 421220 - DNA, 25 bp, Rattus norvegicus
ggacagccacagagctttggcaaag

SEQ ID NO: 421221 - DNA, 25 bp, Rattus norvegicus
ggacagccacagtgctttggcaaag

SEQ ID NO: 421222 - DNA, 25 bp, Rattus norvegicus
ggacagccagacatcagcatcagtt

SEQ ID NO: 421223 - DNA, 25 bp, Rattus norvegicus
ggacagccagacttcagcatcagtt

SEQ ID NO: 421224 - DNA, 25 bp, Rattus norvegicus
ggacagccaggccaggccattccta

SEQ ID NO: 421225 - DNA, 25 bp, Rattus norvegicus
ggacagccaggcgaggccattccta

SEQ ID NO: 421226 - DNA, 25 bp, Rattus norvegicus
ggacagccatcgagtagaccccagt

SEQ ID NO: 421227 - DNA, 25 bp, Rattus norvegicus
ggacagccatcgtgtagaccccagt

SEQ ID NO: 421228 - DNA, 25 bp, Rattus norvegicus
ggacagcccaacagcctggcctgag

SEQ ID NO: 421229 - DNA, 25 bp, Rattus norvegicus
ggacagcccaactgcctggcctgag

SEQ ID NO: 421230 - DNA, 25 bp, Rattus norvegicus
ggacagcccactaggctttttacta

SEQ ID NO: 421231 - DNA, 25 bp, Rattus norvegicus
ggacagcccacttggctttttacta

SEQ ID NO: 421232 - DNA, 25 bp, Rattus norvegicus
ggacagcccgggagcgaaaagccca

SEQ ID NO: 421233 - DNA, 25 bp, Rattus norvegicus
ggacagcccgggtgcgaaaagccca

SEQ ID NO: 421234 - DNA, 25 bp, Rattus norvegicus
ggacagccctctatatcacatggag

SEQ ID NO: 421235 - DNA, 25 bp, Rattus norvegicus
ggacagccctctttatcacatggag

SEQ ID NO: 421236 - DNA, 25 bp, Rattus norvegicus
ggacagcctagaaggcactgccaat

SEQ ID NO: 421237 - DNA, 25 bp, Rattus norvegicus
ggacagcctagatggcactgccaat

SEQ ID NO: 421238 - DNA, 25 bp, Rattus norvegicus
ggacagcctcgtcagcttttaaagc

SEQ ID NO: 421239 - DNA, 25 bp, Rattus norvegicus
ggacagcctcgtgagcttttaaagc

SEQ ID NO: 421240 - DNA, 25 bp, Rattus norvegicus
ggacagcctctccagatggttatga

SEQ ID NO: 421241 - DNA, 25 bp, Rattus norvegicus
ggacagcctctcgagatggttatga

SEQ ID NO: 421242 - DNA, 25 bp, Rattus norvegicus
ggacagcctgagctaacatttcaag

SEQ ID NO: 421243 - DNA, 25 bp, Rattus norvegicus
ggacagcctgaggtaacatttcaag

SEQ ID NO: 421244 - DNA, 25 bp, Rattus norvegicus
ggacagcctgctctggaggaactca

SEQ ID NO: 421245 - DNA, 25 bp, Rattus norvegicus
ggacagcctgctgtggaggaactca

SEQ ID NO: 421246 - DNA, 25 bp, Rattus norvegicus
ggacagcctggtaatttcctaagac

SEQ ID NO: 421247 - DNA, 25 bp, Rattus norvegicus
ggacagcctggttatttcctaagac

SEQ ID NO: 421248 - DNA, 25 bp, Rattus norvegicus
ggacagccttatactttagcacaaa

SEQ ID NO: 421249 - DNA, 25 bp, Rattus norvegicus
ggacagccttatatcccagatttct

SEQ ID NO: 421250 - DNA, 25 bp, Rattus norvegicus
ggacagccttattctttagcacaaa

SEQ ID NO: 421251 - DNA, 25 bp, Rattus norvegicus
ggacagccttatttcccagatttct

SEQ ID NO: 421252 - DNA, 25 bp, Rattus norvegicus
ggacagcctttaaagtacagaccct

SEQ ID NO: 421253 - DNA, 25 bp, Rattus norvegicus
ggacagcctttatagtacagaccct

SEQ ID NO: 421254 - DNA, 25 bp, Rattus norvegicus
ggacagcgacggacagcccgcacgg

SEQ ID NO: 421255 - DNA, 25 bp, Rattus norvegicus
ggacagcgacggtcagcccgcacgg

SEQ ID NO: 421256 - DNA, 25 bp, Rattus norvegicus
ggacagcgatccagccaacattgtg

SEQ ID NO: 421257 - DNA, 25 bp, Rattus norvegicus
ggacagcgatcctgccaacattgtg

SEQ ID NO: 421258 - DNA, 25 bp, Rattus norvegicus
ggacagcgcacgacctgaccctggg

SEQ ID NO: 421259 - DNA, 25 bp, Rattus norvegicus
ggacagcgcacgtcctgaccctggg

SEQ ID NO: 421260 - DNA, 25 bp, Rattus norvegicus
ggacagcgcgggacactggctatat

SEQ ID NO: 421261 - DNA, 25 bp, Rattus norvegicus
ggacagcgcgggtcactggctatat

SEQ ID NO: 421262 - DNA, 25 bp, Rattus norvegicus
ggacagcgctcgagtctatgagaac

SEQ ID NO: 421263 - DNA, 25 bp, Rattus norvegicus
ggacagcgctcgtgtctatgagaac

SEQ ID NO: 421264 - DNA, 25 bp, Rattus norvegicus
ggacagcgcttcaatcaaagccgtt

SEQ ID NO: 421265 - DNA, 25 bp, Rattus norvegicus
ggacagcgcttctatcaaagccgtt

SEQ ID NO: 421266 - DNA, 25 bp, Rattus norvegicus
ggacagcgtgaaccttttgaagcag

SEQ ID NO: 421267 - DNA, 25 bp, Rattus norvegicus
ggacagcgtgaagcttttgaagcag

SEQ ID NO: 421268 - DNA, 25 bp, Rattus norvegicus
ggacagctagaaaagggcccacacg

SEQ ID NO: 421269 - DNA, 25 bp, Rattus norvegicus
ggacagctagaatagggcccacacg

SEQ ID NO: 421270 - DNA, 25 bp, Rattus norvegicus
ggacagctaggaccactctccaagt

SEQ ID NO: 421271 - DNA, 25 bp, Rattus norvegicus
ggacagctaggagcactctccaagt

SEQ ID NO: 421272 - DNA, 25 bp, Rattus norvegicus
ggacagctatggaaatatcctgttt

SEQ ID NO: 421273 - DNA, 25 bp, Rattus norvegicus
ggacagctatggtaatatcctgttt

SEQ ID NO: 421274 - DNA, 25 bp, Rattus norvegicus
ggacagctatttcaggcgtgagcta

SEQ ID NO: 421275 - DNA, 25 bp, Rattus norvegicus
ggacagctatttgaggcgtgagcta

SEQ ID NO: 421276 - DNA, 25 bp, Rattus norvegicus
ggacagctcagcagggtatggaccc

SEQ ID NO: 421277 - DNA, 25 bp, Rattus norvegicus
ggacagctcagctgggtatggaccc

SEQ ID NO: 421278 - DNA, 25 bp, Rattus norvegicus
ggacagctccaccaacactgtgaga

SEQ ID NO: 421279 - DNA, 25 bp, Rattus norvegicus
ggacagctccacgaacactgtgaga

SEQ ID NO: 421280 - DNA, 25 bp, Rattus norvegicus
ggacagctcccaatttctttgtctg

SEQ ID NO: 421281 - DNA, 25 bp, Rattus norvegicus
ggacagctcccattttctttgtctg

SEQ ID NO: 421282 - DNA, 25 bp, Rattus norvegicus
ggacagctcccgcagcaacctggtt

SEQ ID NO: 421283 - DNA, 25 bp, Rattus norvegicus
ggacagctcccggagcaacctggtt

SEQ ID NO: 421284 - DNA, 25 bp, Rattus norvegicus
ggacagctccttccacaaggttaag

SEQ ID NO: 421285 - DNA, 25 bp, Rattus norvegicus
ggacagctccttgcacaaggttaag

SEQ ID NO: 421286 - DNA, 25 bp, Rattus norvegicus
ggacagctgactacaagacaccatg

SEQ ID NO: 421287 - DNA, 25 bp, Rattus norvegicus
ggacagctgacttcaagacaccatg

SEQ ID NO: 421288 - DNA, 25 bp, Rattus norvegicus
ggacagctgctacatgaacatcatt

SEQ ID NO: 421289 - DNA, 25 bp, Rattus norvegicus
ggacagctgctagatgaacatcatt

SEQ ID NO: 421290 - DNA, 25 bp, Rattus norvegicus
ggacagctgttgaatagcagagtta

SEQ ID NO: 421291 - DNA, 25 bp, Rattus norvegicus
ggacagctgttgtatagcagagtta

SEQ ID NO: 421292 - DNA, 25 bp, Rattus norvegicus
ggacagcttctgatgcagcatagcc

SEQ ID NO: 421293 - DNA, 25 bp, Rattus norvegicus
ggacagcttctgttgcagcatagcc

SEQ ID NO: 421294 - DNA, 25 bp, Rattus norvegicus
ggacagcttgctcggaggcatcaca

SEQ ID NO: 421295 - DNA, 25 bp, Rattus norvegicus
ggacagcttgctgggaggcatcaca

SEQ ID NO: 421296 - DNA, 25 bp, Rattus norvegicus
ggacagcttgttccttatcttctag

SEQ ID NO: 421297 - DNA, 25 bp, Rattus norvegicus
ggacagcttgttgcttatcttctag

SEQ ID NO: 421298 - DNA, 25 bp, Rattus norvegicus
ggacagctttataaggctcccagca

SEQ ID NO: 421299 - DNA, 25 bp, Rattus norvegicus
ggacagctttattaggctcccagca

SEQ ID NO: 421300 - DNA, 25 bp, Rattus norvegicus
ggacagctttcaatgttctacactc

SEQ ID NO: 421301 - DNA, 25 bp, Rattus norvegicus
ggacagctttcattgttctacactc

SEQ ID NO: 421302 - DNA, 25 bp, Rattus norvegicus
ggacagctttctacaatgaggatga

SEQ ID NO: 421303 - DNA, 25 bp, Rattus norvegicus
ggacagctttcttcaatgaggatga

SEQ ID NO: 421304 - DNA, 25 bp, Rattus norvegicus
ggacagctttgaagacgcgctcggt

SEQ ID NO: 421305 - DNA, 25 bp, Rattus norvegicus
ggacagctttgatgacgcgctcggt

SEQ ID NO: 421306 - DNA, 25 bp, Rattus norvegicus
ggacaggacaagactgcctagtaga

SEQ ID NO: 421307 - DNA, 25 bp, Rattus norvegicus
ggacaggacaagtctgcctagtaga

SEQ ID NO: 421308 - DNA, 25 bp, Rattus norvegicus
ggacaggacacaaatcaagcagctt

SEQ ID NO: 421309 - DNA, 25 bp, Rattus norvegicus
ggacaggacacatatcaagcagctt

SEQ ID NO: 421310 - DNA, 25 bp, Rattus norvegicus
ggacaggacttgctccaaggtctga

SEQ ID NO: 421311 - DNA, 25 bp, Rattus norvegicus
ggacaggacttggtccaaggtctga

SEQ ID NO: 421312 - DNA, 25 bp, Rattus norvegicus
ggacaggatattcgaatccctccac

SEQ ID NO: 421313 - DNA, 25 bp, Rattus norvegicus
ggacaggatattggaatccctccac

SEQ ID NO: 421314 - DNA, 25 bp, Rattus norvegicus
ggacaggatcatattagcttcatta

SEQ ID NO: 421315 - DNA, 25 bp, Rattus norvegicus
ggacaggatcattttagcttcatta

SEQ ID NO: 421316 - DNA, 25 bp, Rattus norvegicus
ggacaggatcctctttcatttcaag

SEQ ID NO: 421317 - DNA, 25 bp, Rattus norvegicus
ggacaggatcctgtttcatttcaag

SEQ ID NO: 421318 - DNA, 25 bp, Rattus norvegicus
ggacaggcaaggacattcaccaagt

SEQ ID NO: 421319 - DNA, 25 bp, Rattus norvegicus
ggacaggcaaggtcattcaccaagt

SEQ ID NO: 421320 - DNA, 25 bp, Rattus norvegicus
ggacaggcacaaactcaaccaagag

SEQ ID NO: 421321 - DNA, 25 bp, Rattus norvegicus
ggacaggcacaatctcaaccaagag

SEQ ID NO: 421322 - DNA, 25 bp, Rattus norvegicus
ggacaggcacacaccagaatctgag

SEQ ID NO: 421323 - DNA, 25 bp, Rattus norvegicus
ggacaggcacactccagaatctgag

SEQ ID NO: 421324 - DNA, 25 bp, Rattus norvegicus
ggacaggcagggaagccttccccag

SEQ ID NO: 421325 - DNA, 25 bp, Rattus norvegicus
ggacaggcagggtagccttccccag

SEQ ID NO: 421326 - DNA, 25 bp, Rattus norvegicus
ggacaggcataaccagtggcacact

SEQ ID NO: 421327 - DNA, 25 bp, Rattus norvegicus
ggacaggcataagcagtggcacact

SEQ ID NO: 421328 - DNA, 25 bp, Rattus norvegicus
ggacaggcatttcttctaccaagta

SEQ ID NO: 421329 - DNA, 25 bp, Rattus norvegicus
ggacaggcatttgttctaccaagta

SEQ ID NO: 421330 - DNA, 25 bp, Rattus norvegicus
ggacaggccccaatctcacaagcag

SEQ ID NO: 421331 - DNA, 25 bp, Rattus norvegicus
ggacaggccccattctcacaagcag

SEQ ID NO: 421332 - DNA, 25 bp, Rattus norvegicus
ggacaggccggcacgtgcagcacat

SEQ ID NO: 421333 - DNA, 25 bp, Rattus norvegicus
ggacaggccggctcgtgcagcacat

SEQ ID NO: 421334 - DNA, 25 bp, Rattus norvegicus
ggacaggcctcacctgacagtgtag

SEQ ID NO: 421335 - DNA, 25 bp, Rattus norvegicus
ggacaggcctcagctgacagtgtag

SEQ ID NO: 421336 - DNA, 25 bp, Rattus norvegicus
ggacaggcctgtaccatttgggaat

SEQ ID NO: 421337 - DNA, 25 bp, Rattus norvegicus
ggacaggcctgttccatttgggaat

SEQ ID NO: 421338 - DNA, 25 bp, Rattus norvegicus
ggacaggcgacgacttttcattttc

SEQ ID NO: 421339 - DNA, 25 bp, Rattus norvegicus
ggacaggcgacgtcttttcattttc

SEQ ID NO: 421340 - DNA, 25 bp, Rattus norvegicus
ggacaggcgcacatgtgctctgcaa

SEQ ID NO: 421341 - DNA, 25 bp, Rattus norvegicus
ggacaggcgcacttgtgctctgcaa

SEQ ID NO: 421342 - DNA, 25 bp, Rattus norvegicus
ggacaggctgaacaaaatcccctta

SEQ ID NO: 421343 - DNA, 25 bp, Rattus norvegicus
ggacaggctgaagaaaatcccctta

SEQ ID NO: 421344 - DNA, 25 bp, Rattus norvegicus
ggacagggaccaagctcaacaaaat

SEQ ID NO: 421345 - DNA, 25 bp, Rattus norvegicus
ggacagggaccatgctcaacaaaat

SEQ ID NO: 421346 - DNA, 25 bp, Rattus norvegicus
ggacagggatttcaccaggcatttg

SEQ ID NO: 421347 - DNA, 25 bp, Rattus norvegicus
ggacagggatttgaccaggcatttg

SEQ ID NO: 421348 - DNA, 25 bp, Rattus norvegicus
ggacagggccaacggagctcataaa

SEQ ID NO: 421349 - DNA, 25 bp, Rattus norvegicus
ggacagggccaagggagctcataaa

SEQ ID NO: 421350 - DNA, 25 bp, Rattus norvegicus
ggacagggcttgcaatagccgctct

SEQ ID NO: 421351 - DNA, 25 bp, Rattus norvegicus
ggacagggcttggaatagccgctct

SEQ ID NO: 421352 - DNA, 25 bp, Rattus norvegicus
ggacagggtcaaaagaagccatgta

SEQ ID NO: 421353 - DNA, 25 bp, Rattus norvegicus
ggacagggtcaatagaagccatgta

SEQ ID NO: 421354 - DNA, 25 bp, Rattus norvegicus
ggacagggtcctaggctcagatagc

SEQ ID NO: 421355 - DNA, 25 bp, Rattus norvegicus
ggacagggtccttggctcagatagc

SEQ ID NO: 421356 - DNA, 25 bp, Rattus norvegicus
ggacagggtctcatgccaagactct

SEQ ID NO: 421357 - DNA, 25 bp, Rattus norvegicus
ggacagggtctcttgccaagactct

SEQ ID NO: 421358 - DNA, 25 bp, Rattus norvegicus
ggacagggtttcactttgcagacca

SEQ ID NO: 421359 - DNA, 25 bp, Rattus norvegicus
ggacagggtttctctttgcagacca

SEQ ID NO: 421360 - DNA, 25 bp, Rattus norvegicus
ggacaggtacatacatagcactcag

SEQ ID NO: 421361 - DNA, 25 bp, Rattus norvegicus
ggacaggtacattcatagcactcag

SEQ ID NO: 421362 - DNA, 25 bp, Rattus norvegicus
ggacaggtcaatacagactccagtg

SEQ ID NO: 421363 - DNA, 25 bp, Rattus norvegicus
ggacaggtcaattcagactccagtg

SEQ ID NO: 421364 - DNA, 25 bp, Rattus norvegicus
ggacaggtcagaccttaccttcact

SEQ ID NO: 421365 - DNA, 25 bp, Rattus norvegicus
ggacaggtcagagcttaccttcact

SEQ ID NO: 421366 - DNA, 25 bp, Rattus norvegicus
ggacaggtcctactaattaacactt

SEQ ID NO: 421367 - DNA, 25 bp, Rattus norvegicus
ggacaggtcctagtaattaacactt

SEQ ID NO: 421368 - DNA, 25 bp, Rattus norvegicus
ggacaggtcctcatgatataaacag

SEQ ID NO: 421369 - DNA, 25 bp, Rattus norvegicus
ggacaggtcctcttgatataaacag

SEQ ID NO: 421370 - DNA, 25 bp, Rattus norvegicus
ggacaggtctgtagggtaagaacaa

SEQ ID NO: 421371 - DNA, 25 bp, Rattus norvegicus
ggacaggtctgttgggtaagaacaa

SEQ ID NO: 421372 - DNA, 25 bp, Rattus norvegicus
ggacaggtgcctcattaggttacta

SEQ ID NO: 421373 - DNA, 25 bp, Rattus norvegicus
ggacaggtgcctgattaggttacta

SEQ ID NO: 421374 - DNA, 25 bp, Rattus norvegicus
ggacaggtggtcaccgttagctccc

SEQ ID NO: 421375 - DNA, 25 bp, Rattus norvegicus
ggacaggtggtctccgttagctccc

SEQ ID NO: 421376 - DNA, 25 bp, Rattus norvegicus
ggacaggtgttcatatcagtaccct

SEQ ID NO: 421377 - DNA, 25 bp, Rattus norvegicus
ggacaggtgttcttatcagtaccct

SEQ ID NO: 421378 - DNA, 25 bp, Rattus norvegicus
ggacaggttagcagtgccgtgccac

SEQ ID NO: 421379 - DNA, 25 bp, Rattus norvegicus
ggacaggttagctgtgccgtgccac

SEQ ID NO: 421380 - DNA, 25 bp, Rattus norvegicus
ggacaggttcaacccaggccttgga

SEQ ID NO: 421381 - DNA, 25 bp, Rattus norvegicus
ggacaggttcaagccaggccttgga

SEQ ID NO: 421382 - DNA, 25 bp, Rattus norvegicus
ggacaggttctcaagtaagatagtt

SEQ ID NO: 421383 - DNA, 25 bp, Rattus norvegicus
ggacaggttctctagtaagatagtt

SEQ ID NO: 421384 - DNA, 25 bp, Rattus norvegicus
ggacaggttgttcaaactcctttct

SEQ ID NO: 421385 - DNA, 25 bp, Rattus norvegicus
ggacaggttgttgaaactcctttct

SEQ ID NO: 421386 - DNA, 25 bp, Rattus norvegicus
ggacaggttttcactcaacatttgt

SEQ ID NO: 421387 - DNA, 25 bp, Rattus norvegicus
ggacaggttttctctcaacatttgt

SEQ ID NO: 421388 - DNA, 25 bp, Rattus norvegicus
ggacagtaactcacctgtagcttgt

SEQ ID NO: 421389 - DNA, 25 bp, Rattus norvegicus
ggacagtaactctcctgtagcttgt

SEQ ID NO: 421390 - DNA, 25 bp, Rattus norvegicus
ggacagtaagcacccgatgtaccgg

SEQ ID NO: 421391 - DNA, 25 bp, Rattus norvegicus
ggacagtaagcagccgatgtaccgg

SEQ ID NO: 421392 - DNA, 25 bp, Rattus norvegicus
ggacagtaatgaccttatctgcatt

SEQ ID NO: 421393 - DNA, 25 bp, Rattus norvegicus
ggacagtaatgagcttatctgcatt

SEQ ID NO: 421394 - DNA, 25 bp, Rattus norvegicus
ggacagtacacaatgggcaatcaat

SEQ ID NO: 421395 - DNA, 25 bp, Rattus norvegicus
ggacagtacacattgggcaatcaat

SEQ ID NO: 421396 - DNA, 25 bp, Rattus norvegicus
ggacagtacggaagttgacctacca

SEQ ID NO: 421397 - DNA, 25 bp, Rattus norvegicus
ggacagtacggatgttgacctacca

SEQ ID NO: 421398 - DNA, 25 bp, Rattus norvegicus
ggacagtactgtccagtccactaag

SEQ ID NO: 421399 - DNA, 25 bp, Rattus norvegicus
ggacagtactgtgcagtccactaag

SEQ ID NO: 421400 - DNA, 25 bp, Rattus norvegicus
ggacagtatcacagacgccgtaaga

SEQ ID NO: 421401 - DNA, 25 bp, Rattus norvegicus
ggacagtatcactgacgccgtaaga

SEQ ID NO: 421402 - DNA, 25 bp, Rattus norvegicus
ggacagtatctgatgctttcccaag

SEQ ID NO: 421403 - DNA, 25 bp, Rattus norvegicus
ggacagtatctgttgctttcccaag

SEQ ID NO: 421404 - DNA, 25 bp, Rattus norvegicus
ggacagtatgccaatcgctagctga

SEQ ID NO: 421405 - DNA, 25 bp, Rattus norvegicus
ggacagtatgcctatcgctagctga

SEQ ID NO: 421406 - DNA, 25 bp, Rattus norvegicus
ggacagtatgttcacacgggctcgt

SEQ ID NO: 421407 - DNA, 25 bp, Rattus norvegicus
ggacagtatgttgacacgggctcgt

SEQ ID NO: 421408 - DNA, 25 bp, Rattus norvegicus
ggacagtcatgaccccacctatgga

SEQ ID NO: 421409 - DNA, 25 bp, Rattus norvegicus
ggacagtcatgagcccacctatgga

SEQ ID NO: 421410 - DNA, 25 bp, Rattus norvegicus
ggacagtccaaaaaacaacccggag

SEQ ID NO: 421411 - DNA, 25 bp, Rattus norvegicus
ggacagtccaaataacaacccggag

SEQ ID NO: 421412 - DNA, 25 bp, Rattus norvegicus
ggacagtccctgcagtgacacaagg

SEQ ID NO: 421413 - DNA, 25 bp, Rattus norvegicus
ggacagtccctggagtgacacaagg

SEQ ID NO: 421414 - DNA, 25 bp, Rattus norvegicus
ggacagtccgccagcagctgacgcg

SEQ ID NO: 421415 - DNA, 25 bp, Rattus norvegicus
ggacagtccgcctgcagctgacgcg

SEQ ID NO: 421416 - DNA, 25 bp, Rattus norvegicus
ggacagtcgcctacaagtgtttatg

SEQ ID NO: 421417 - DNA, 25 bp, Rattus norvegicus
ggacagtcgccttcaagtgtttatg

SEQ ID NO: 421418 - DNA, 25 bp, Rattus norvegicus
ggacagtcgtcaaaccatcatattg

SEQ ID NO: 421419 - DNA, 25 bp, Rattus norvegicus
ggacagtcgtcataccatcatattg

SEQ ID NO: 421420 - DNA, 25 bp, Rattus norvegicus
ggacagtcgttcaccaatgtcagta

SEQ ID NO: 421421 - DNA, 25 bp, Rattus norvegicus
ggacagtcgttctccaatgtcagta

SEQ ID NO: 421422 - DNA, 25 bp, Rattus norvegicus
ggacagtctacaccgccagatggag

SEQ ID NO: 421423 - DNA, 25 bp, Rattus norvegicus
ggacagtctacagcgccagatggag

SEQ ID NO: 421424 - DNA, 25 bp, Rattus norvegicus
ggacagtctgtcataaatttcatat

SEQ ID NO: 421425 - DNA, 25 bp, Rattus norvegicus
ggacagtctgtcttaaatttcatat

SEQ ID NO: 421426 - DNA, 25 bp, Rattus norvegicus
ggacagtctgtgcacttccctgtat

SEQ ID NO: 421427 - DNA, 25 bp, Rattus norvegicus
ggacagtctgtggacttccctgtat

SEQ ID NO: 421428 - DNA, 25 bp, Rattus norvegicus
ggacagtgacgtctaatacttgtat

SEQ ID NO: 421429 - DNA, 25 bp, Rattus norvegicus
ggacagtgacgtgtaatacttgtat

SEQ ID NO: 421430 - DNA, 25 bp, Rattus norvegicus
ggacagtgactgacatagccttgag

SEQ ID NO: 421431 - DNA, 25 bp, Rattus norvegicus
ggacagtgactgtcatagccttgag

SEQ ID NO: 421432 - DNA, 25 bp, Rattus norvegicus
ggacagtgattaaacacgctatact

SEQ ID NO: 421433 - DNA, 25 bp, Rattus norvegicus
ggacagtgattatacacgctatact

SEQ ID NO: 421434 - DNA, 25 bp, Rattus norvegicus
ggacagtgattccatctcaggtgct

SEQ ID NO: 421435 - DNA, 25 bp, Rattus norvegicus
ggacagtgattcgatctcaggtgct

SEQ ID NO: 421436 - DNA, 25 bp, Rattus norvegicus
ggacagtgcagtaccgtcatccctt

SEQ ID NO: 421437 - DNA, 25 bp, Rattus norvegicus
ggacagtgcagttccgtcatccctt

SEQ ID NO: 421438 - DNA, 25 bp, Rattus norvegicus
ggacagtgcatgcatattgctgtaa

SEQ ID NO: 421439 - DNA, 25 bp, Rattus norvegicus
ggacagtgcatggatattgctgtaa

SEQ ID NO: 421440 - DNA, 25 bp, Rattus norvegicus
ggacagtgcattacaataagagcta

SEQ ID NO: 421441 - DNA, 25 bp, Rattus norvegicus
ggacagtgcatttcaataagagcta

SEQ ID NO: 421442 - DNA, 25 bp, Rattus norvegicus
ggacagtgcctccatggcacaaagt

SEQ ID NO: 421443 - DNA, 25 bp, Rattus norvegicus
ggacagtgcctcgatggcacaaagt

SEQ ID NO: 421444 - DNA, 25 bp, Rattus norvegicus
ggacagtgctacaggctggccagcc

SEQ ID NO: 421445 - DNA, 25 bp, Rattus norvegicus
ggacagtgctactggctggccagcc

SEQ ID NO: 421446 - DNA, 25 bp, Rattus norvegicus
ggacagtgcttgacactcagtctta

SEQ ID NO: 421447 - DNA, 25 bp, Rattus norvegicus
ggacagtgcttgtcactcagtctta

SEQ ID NO: 421448 - DNA, 25 bp, Rattus norvegicus
ggacagtggcatcaaagcctcttct

SEQ ID NO: 421449 - DNA, 25 bp, Rattus norvegicus
ggacagtggcatgaaagcctcttct

SEQ ID NO: 421450 - DNA, 25 bp, Rattus norvegicus
ggacagtgtataatatcttgtattt

SEQ ID NO: 421451 - DNA, 25 bp, Rattus norvegicus
ggacagtgtatattatcttgtattt

SEQ ID NO: 421452 - DNA, 25 bp, Rattus norvegicus
ggacagttcagccaaataaggataa

SEQ ID NO: 421453 - DNA, 25 bp, Rattus norvegicus
ggacagttcagcgaaataaggataa

SEQ ID NO: 421454 - DNA, 25 bp, Rattus norvegicus
ggacagttcccgcagtagcgccagt

SEQ ID NO: 421455 - DNA, 25 bp, Rattus norvegicus
ggacagttcccggagtagcgccagt

SEQ ID NO: 421456 - DNA, 25 bp, Rattus norvegicus
ggacagttctagagattccgaagat

SEQ ID NO: 421457 - DNA, 25 bp, Rattus norvegicus
ggacagttctagtgattccgaagat

SEQ ID NO: 421458 - DNA, 25 bp, Rattus norvegicus
ggacagttgactatgggcaatctta

SEQ ID NO: 421459 - DNA, 25 bp, Rattus norvegicus
ggacagttgactttgggcaatctta

SEQ ID NO: 421460 - DNA, 25 bp, Rattus norvegicus
ggacagttgcaacagtttctggaaa

SEQ ID NO: 421461 - DNA, 25 bp, Rattus norvegicus
ggacagttgcaagagtttctggaaa

SEQ ID NO: 421462 - DNA, 25 bp, Rattus norvegicus
ggacagttgtacctgcttttctgca

SEQ ID NO: 421463 - DNA, 25 bp, Rattus norvegicus
ggacagttgtacgtgcttttctgca

SEQ ID NO: 421464 - DNA, 25 bp, Rattus norvegicus
ggacagttgtttaccagcttgatac

SEQ ID NO: 421465 - DNA, 25 bp, Rattus norvegicus
ggacagttgttttccagcttgatac

SEQ ID NO: 421466 - DNA, 25 bp, Rattus norvegicus
ggacagtttcatcattttctccagc

SEQ ID NO: 421467 - DNA, 25 bp, Rattus norvegicus
ggacagtttcatgattttctccagc

SEQ ID NO: 421468 - DNA, 25 bp, Rattus norvegicus
ggacagttttcacacatatctacct

SEQ ID NO: 421469 - DNA, 25 bp, Rattus norvegicus
ggacagttttcagacatatctacct

SEQ ID NO: 421470 - DNA, 25 bp, Rattus norvegicus
ggacagttttgcattcccgagcatg

SEQ ID NO: 421471 - DNA, 25 bp, Rattus norvegicus
ggacagttttgctttcccgagcatg

SEQ ID NO: 421472 - DNA, 25 bp, Rattus norvegicus
ggacataaacagagactcaaggctt

SEQ ID NO: 421473 - DNA, 25 bp, Rattus norvegicus
ggacataaacagtgactcaaggctt

SEQ ID NO: 421474 - DNA, 25 bp, Rattus norvegicus
ggacataaacatcatgccaccaggt

SEQ ID NO: 421475 - DNA, 25 bp, Rattus norvegicus
ggacataaacatgatgccaccaggt

SEQ ID NO: 421476 - DNA, 25 bp, Rattus norvegicus
ggacataacaaaacagtctcaggaa

SEQ ID NO: 421477 - DNA, 25 bp, Rattus norvegicus
ggacataacaaatcagtctcaggaa

SEQ ID NO: 421478 - DNA, 25 bp, Rattus norvegicus
ggacataactgtcccgcctctggta

SEQ ID NO: 421479 - DNA, 25 bp, Rattus norvegicus
ggacataactgtgccgcctctggta

SEQ ID NO: 421480 - DNA, 25 bp, Rattus norvegicus
ggacataactttactcttcaagtct

SEQ ID NO: 421481 - DNA, 25 bp, Rattus norvegicus
ggacataacttttctcttcaagtct

SEQ ID NO: 421482 - DNA, 25 bp, Rattus norvegicus
ggacataagtgtaccccagcagtat

SEQ ID NO: 421483 - DNA, 25 bp, Rattus norvegicus
ggacataagtgttccccagcagtat

SEQ ID NO: 421484 - DNA, 25 bp, Rattus norvegicus
ggacataagttaatgttcacattaa

SEQ ID NO: 421485 - DNA, 25 bp, Rattus norvegicus
ggacataagttattgttcacattaa

SEQ ID NO: 421486 - DNA, 25 bp, Rattus norvegicus
ggacataatactaccattgttagga

SEQ ID NO: 421487 - DNA, 25 bp, Rattus norvegicus
ggacataatacttccattgttagga

SEQ ID NO: 421488 - DNA, 25 bp, Rattus norvegicus
ggacatacactcctagcagagctac

SEQ ID NO: 421489 - DNA, 25 bp, Rattus norvegicus
ggacatacactcgtagcagagctac

SEQ ID NO: 421490 - DNA, 25 bp, Rattus norvegicus
ggacatacatttaaactcaactata

SEQ ID NO: 421491 - DNA, 25 bp, Rattus norvegicus
ggacatacattttaactcaactata

SEQ ID NO: 421492 - DNA, 25 bp, Rattus norvegicus
ggacataccaatagttgaccaccaa

SEQ ID NO: 421493 - DNA, 25 bp, Rattus norvegicus
ggacataccaattgttgaccaccaa

SEQ ID NO: 421494 - DNA, 25 bp, Rattus norvegicus
ggacatacggaaactcattcccttc

SEQ ID NO: 421495 - DNA, 25 bp, Rattus norvegicus
ggacatacggaatctcattcccttc

SEQ ID NO: 421496 - DNA, 25 bp, Rattus norvegicus
ggacatactgacacatcttggtggt

SEQ ID NO: 421497 - DNA, 25 bp, Rattus norvegicus
ggacatactgactcatcttggtggt

SEQ ID NO: 421498 - DNA, 25 bp, Rattus norvegicus
ggacatacttgccttctgagtgatt

SEQ ID NO: 421499 - DNA, 25 bp, Rattus norvegicus
ggacatacttgcgttctgagtgatt

SEQ ID NO: 421500 - DNA, 25 bp, Rattus norvegicus
ggacatagatgtcacttttgagctt

SEQ ID NO: 421501 - DNA, 25 bp, Rattus norvegicus
ggacatagatgtgacttttgagctt

SEQ ID NO: 421502 - DNA, 25 bp, Rattus norvegicus
ggacatagcagcagtgtctgtctta

SEQ ID NO: 421503 - DNA, 25 bp, Rattus norvegicus
ggacatagcagctgtgtctgtctta

SEQ ID NO: 421504 - DNA, 25 bp, Rattus norvegicus
ggacatagctgccaatcagcctgga

SEQ ID NO: 421505 - DNA, 25 bp, Rattus norvegicus
ggacatagctgcgaatcagcctgga

SEQ ID NO: 421506 - DNA, 25 bp, Rattus norvegicus
ggacataggtcacagttccaaggac

SEQ ID NO: 421507 - DNA, 25 bp, Rattus norvegicus
ggacataggtcagagttccaaggac

SEQ ID NO: 421508 - DNA, 25 bp, Rattus norvegicus
ggacataggtctctactgctgtagt

SEQ ID NO: 421509 - DNA, 25 bp, Rattus norvegicus
ggacataggtctgtactgctgtagt

SEQ ID NO: 421510 - DNA, 25 bp, Rattus norvegicus
ggacatagtaagagcctgggctacc

SEQ ID NO: 421511 - DNA, 25 bp, Rattus norvegicus
ggacatagtaagtgcctgggctacc

SEQ ID NO: 421512 - DNA, 25 bp, Rattus norvegicus
ggacatagtctgctacgatgtgcaa

SEQ ID NO: 421513 - DNA, 25 bp, Rattus norvegicus
ggacatagtctggtacgatgtgcaa

SEQ ID NO: 421514 - DNA, 25 bp, Rattus norvegicus
ggacatagtgacacattcctttagt

SEQ ID NO: 421515 - DNA, 25 bp, Rattus norvegicus
ggacatagtgactcattcctttagt

SEQ ID NO: 421516 - DNA, 25 bp, Rattus norvegicus
ggacatatggaaacaatacctggaa

SEQ ID NO: 421517 - DNA, 25 bp, Rattus norvegicus
ggacatatggaatcaatacctggaa

SEQ ID NO: 421518 - DNA, 25 bp, Rattus norvegicus
ggacatattccaaaccctggtgtga

SEQ ID NO: 421519 - DNA, 25 bp, Rattus norvegicus
ggacatattccataccctggtgtga

SEQ ID NO: 421520 - DNA, 25 bp, Rattus norvegicus
ggacatatttatcgctccacttccc

SEQ ID NO: 421521 - DNA, 25 bp, Rattus norvegicus
ggacatatttatggctccacttccc

SEQ ID NO: 421522 - DNA, 25 bp, Rattus norvegicus
ggacatcaacacacagcagagcttt

SEQ ID NO: 421523 - DNA, 25 bp, Rattus norvegicus
ggacatcaacactcagcagagcttt

SEQ ID NO: 421524 - DNA, 25 bp, Rattus norvegicus
ggacatcaactcctttcattcatga

SEQ ID NO: 421525 - DNA, 25 bp, Rattus norvegicus
ggacatcaactcgtttcattcatga

SEQ ID NO: 421526 - DNA, 25 bp, Rattus norvegicus
ggacatcaccaactggagctccaat

SEQ ID NO: 421527 - DNA, 25 bp, Rattus norvegicus
ggacatcaccaagtggagctccaat

SEQ ID NO: 421528 - DNA, 25 bp, Rattus norvegicus
ggacatcacctgcaggagttacctg

SEQ ID NO: 421529 - DNA, 25 bp, Rattus norvegicus
ggacatcacctggaggagttacctg

SEQ ID NO: 421530 - DNA, 25 bp, Rattus norvegicus
ggacatcacgacctcgtgcggtatt

SEQ ID NO: 421531 - DNA, 25 bp, Rattus norvegicus
ggacatcacgacgtcgtgcggtatt

SEQ ID NO: 421532 - DNA, 25 bp, Rattus norvegicus
ggacatcactgcacgatgcatctgg

SEQ ID NO: 421533 - DNA, 25 bp, Rattus norvegicus
ggacatcactgctcgatgcatctgg

SEQ ID NO: 421534 - DNA, 25 bp, Rattus norvegicus
ggacatcacttgaaccttttgactg

SEQ ID NO: 421535 - DNA, 25 bp, Rattus norvegicus
ggacatcacttgtaccttttgactg

SEQ ID NO: 421536 - DNA, 25 bp, Rattus norvegicus
ggacatcagagaccaagagaccctc

SEQ ID NO: 421537 - DNA, 25 bp, Rattus norvegicus
ggacatcagagagcaagagaccctc

SEQ ID NO: 421538 - DNA, 25 bp, Rattus norvegicus
ggacatcaggacaatttggcaaact

SEQ ID NO: 421539 - DNA, 25 bp, Rattus norvegicus
ggacatcaggactatttggcaaact

SEQ ID NO: 421540 - DNA, 25 bp, Rattus norvegicus
ggacatcatcatctactgcctggaa

SEQ ID NO: 421541 - DNA, 25 bp, Rattus norvegicus
ggacatcatcatgtactgcctggaa

SEQ ID NO: 421542 - DNA, 25 bp, Rattus norvegicus
ggacatcatctcaaacgcattcaga

SEQ ID NO: 421543 - DNA, 25 bp, Rattus norvegicus
ggacatcatctctaacgcattcaga

SEQ ID NO: 421544 - DNA, 25 bp, Rattus norvegicus
ggacatcatctgagactggccacct

SEQ ID NO: 421545 - DNA, 25 bp, Rattus norvegicus
ggacatcatctgtgactggccacct

SEQ ID NO: 421546 - DNA, 25 bp, Rattus norvegicus
ggacatccaactcgtatgttctttt

SEQ ID NO: 421547 - DNA, 25 bp, Rattus norvegicus
ggacatccaactggtatgttctttt

SEQ ID NO: 421548 - DNA, 25 bp, Rattus norvegicus
ggacatccaagacaacctgctgcag

SEQ ID NO: 421549 - DNA, 25 bp, Rattus norvegicus
ggacatccaagagaacctgctgcag

SEQ ID NO: 421550 - DNA, 25 bp, Rattus norvegicus
ggacatccaagccatactgttcgag

SEQ ID NO: 421551 - DNA, 25 bp, Rattus norvegicus
ggacatccaagcgatactgttcgag

SEQ ID NO: 421552 - DNA, 25 bp, Rattus norvegicus
ggacatccaggcacacaagttcatt

SEQ ID NO: 421553 - DNA, 25 bp, Rattus norvegicus
ggacatccaggctcacaagttcatt

SEQ ID NO: 421554 - DNA, 25 bp, Rattus norvegicus
ggacatccatcgctttcaaaaacat

SEQ ID NO: 421555 - DNA, 25 bp, Rattus norvegicus
ggacatccatcggtttcaaaaacat

SEQ ID NO: 421556 - DNA, 25 bp, Rattus norvegicus
ggacatcccagtacaccatggtttt

SEQ ID NO: 421557 - DNA, 25 bp, Rattus norvegicus
ggacatcccagttcaccatggtttt

SEQ ID NO: 421558 - DNA, 25 bp, Rattus norvegicus
ggacatcccttaattagccttttca

SEQ ID NO: 421559 - DNA, 25 bp, Rattus norvegicus
ggacatcccttatttagccttttca

SEQ ID NO: 421560 - DNA, 25 bp, Rattus norvegicus
ggacatccctttatgaactgctcat

SEQ ID NO: 421561 - DNA, 25 bp, Rattus norvegicus
ggacatccctttccttggtgaaatg

SEQ ID NO: 421562 - DNA, 25 bp, Rattus norvegicus
ggacatccctttgcttggtgaaatg

SEQ ID NO: 421563 - DNA, 25 bp, Rattus norvegicus
ggacatccctttttgaactgctcat

SEQ ID NO: 421564 - DNA, 25 bp, Rattus norvegicus
ggacatcctgagatttacaggcaaa

SEQ ID NO: 421565 - DNA, 25 bp, Rattus norvegicus
ggacatcctgagttttacaggcaaa

SEQ ID NO: 421566 - DNA, 25 bp, Rattus norvegicus
ggacatcctggaacctactcaggat

SEQ ID NO: 421567 - DNA, 25 bp, Rattus norvegicus
ggacatcctggacgacagtggctat

SEQ ID NO: 421568 - DNA, 25 bp, Rattus norvegicus
ggacatcctggaggacagtggctat

SEQ ID NO: 421569 - DNA, 25 bp, Rattus norvegicus
ggacatcctggatcctactcaggat

SEQ ID NO: 421570 - DNA, 25 bp, Rattus norvegicus
ggacatcctggcctggacattaaga

SEQ ID NO: 421571 - DNA, 25 bp, Rattus norvegicus
ggacatcctggcgtggacattaaga

SEQ ID NO: 421572 - DNA, 25 bp, Rattus norvegicus
ggacatccttgacctggtggtcagc

SEQ ID NO: 421573 - DNA, 25 bp, Rattus norvegicus
ggacatccttgagctggtggtcagc

SEQ ID NO: 421574 - DNA, 25 bp, Rattus norvegicus
ggacatccttgcagcttgtaacata

SEQ ID NO: 421575 - DNA, 25 bp, Rattus norvegicus
ggacatccttgctgcttgtaacata

SEQ ID NO: 421576 - DNA, 25 bp, Rattus norvegicus
ggacatcgaattaatctacacggcc

SEQ ID NO: 421577 - DNA, 25 bp, Rattus norvegicus
ggacatcgaatttatctacacggcc

SEQ ID NO: 421578 - DNA, 25 bp, Rattus norvegicus
ggacatcgacttcgatcagcgcatc

SEQ ID NO: 421579 - DNA, 25 bp, Rattus norvegicus
ggacatcgacttggatcagcgcatc

SEQ ID NO: 421580 - DNA, 25 bp, Rattus norvegicus
ggacatcgagtcaccatttgtataa

SEQ ID NO: 421581 - DNA, 25 bp, Rattus norvegicus
ggacatcgagtctccatttgtataa

SEQ ID NO: 421582 - DNA, 25 bp, Rattus norvegicus
ggacatcgcctcattgtttaaggaa

SEQ ID NO: 421583 - DNA, 25 bp, Rattus norvegicus
ggacatcgcctctttgtttaaggaa

SEQ ID NO: 421584 - DNA, 25 bp, Rattus norvegicus
ggacatcggcaaagctgaccagtta

SEQ ID NO: 421585 - DNA, 25 bp, Rattus norvegicus
ggacatcggcaatgctgaccagtta

SEQ ID NO: 421586 - DNA, 25 bp, Rattus norvegicus
ggacatcggccacgtttataaggaa

SEQ ID NO: 421587 - DNA, 25 bp, Rattus norvegicus
ggacatcggccaggtttataaggaa

SEQ ID NO: 421588 - DNA, 25 bp, Rattus norvegicus
ggacatcggtacacctagtgagaaa

SEQ ID NO: 421589 - DNA, 25 bp, Rattus norvegicus
ggacatcggtactcctagtgagaaa

SEQ ID NO: 421590 - DNA, 25 bp, Rattus norvegicus
ggacatcgttcccaagacaggtatc

SEQ ID NO: 421591 - DNA, 25 bp, Rattus norvegicus
ggacatcgttccgaagacaggtatc

SEQ ID NO: 421592 - DNA, 25 bp, Rattus norvegicus
ggacatcgttgaagacctgcggctc

SEQ ID NO: 421593 - DNA, 25 bp, Rattus norvegicus
ggacatcgttgatgacctgcggctc

SEQ ID NO: 421594 - DNA, 25 bp, Rattus norvegicus
ggacatctaaacatgccgtcaaaca

SEQ ID NO: 421595 - DNA, 25 bp, Rattus norvegicus
ggacatctaaacttgccgtcaaaca

SEQ ID NO: 421596 - DNA, 25 bp, Rattus norvegicus
ggacatctaacacaaatgacctcag

SEQ ID NO: 421597 - DNA, 25 bp, Rattus norvegicus
ggacatctaacagaaatgacctcag

SEQ ID NO: 421598 - DNA, 25 bp, Rattus norvegicus
ggacatctacctactggtggagaca

SEQ ID NO: 421599 - DNA, 25 bp, Rattus norvegicus
ggacatctaccttctggtggagaca

SEQ ID NO: 421600 - DNA, 25 bp, Rattus norvegicus
ggacatctaggtctttgcatcctga

SEQ ID NO: 421601 - DNA, 25 bp, Rattus norvegicus
ggacatctaggtgtttgcatcctga

SEQ ID NO: 421602 - DNA, 25 bp, Rattus norvegicus
ggacatctcagtatctgtttgcttg

SEQ ID NO: 421603 - DNA, 25 bp, Rattus norvegicus
ggacatctcagtttctgtttgcttg

SEQ ID NO: 421604 - DNA, 25 bp, Rattus norvegicus
ggacatctctgaccctatctactaa

SEQ ID NO: 421605 - DNA, 25 bp, Rattus norvegicus
ggacatctctgagcctatctactaa

SEQ ID NO: 421606 - DNA, 25 bp, Rattus norvegicus
ggacatctgaggcacatatcaaaca

SEQ ID NO: 421607 - DNA, 25 bp, Rattus norvegicus
ggacatctgagggacatatcaaaca

SEQ ID NO: 421608 - DNA, 25 bp, Rattus norvegicus
ggacatctgagtccagacgtgtatc

SEQ ID NO: 421609 - DNA, 25 bp, Rattus norvegicus
ggacatctgagtgcagacgtgtatc

SEQ ID NO: 421610 - DNA, 25 bp, Rattus norvegicus
ggacatctgatacctaccattacct

SEQ ID NO: 421611 - DNA, 25 bp, Rattus norvegicus
ggacatctgatagctaccattacct

SEQ ID NO: 421612 - DNA, 25 bp, Rattus norvegicus
ggacatctgcccaggatttcttcaa

SEQ ID NO: 421613 - DNA, 25 bp, Rattus norvegicus
ggacatctgccctggatttcttcaa

SEQ ID NO: 421614 - DNA, 25 bp, Rattus norvegicus
ggacatctgcgcagagaggcctaca

SEQ ID NO: 421615 - DNA, 25 bp, Rattus norvegicus
ggacatctgcgctgagaggcctaca

SEQ ID NO: 421616 - DNA, 25 bp, Rattus norvegicus
ggacatctgctgagacggtctataa

SEQ ID NO: 421617 - DNA, 25 bp, Rattus norvegicus
ggacatctgctgtgacggtctataa

SEQ ID NO: 421618 - DNA, 25 bp, Rattus norvegicus
ggacatctggacacatagttgccct

SEQ ID NO: 421619 - DNA, 25 bp, Rattus norvegicus
ggacatctggactcatagttgccct

SEQ ID NO: 421620 - DNA, 25 bp, Rattus norvegicus
ggacatctggatcgagttcccactg

SEQ ID NO: 421621 - DNA, 25 bp, Rattus norvegicus
ggacatctggatggagttcccactg

SEQ ID NO: 421622 - DNA, 25 bp, Rattus norvegicus
ggacatctggttcaccttgggacat

SEQ ID NO: 421623 - DNA, 25 bp, Rattus norvegicus
ggacatctggttgaccttgggacat

SEQ ID NO: 421624 - DNA, 25 bp, Rattus norvegicus
ggacatcttcaaagccaagcggcat

SEQ ID NO: 421625 - DNA, 25 bp, Rattus norvegicus
ggacatcttcaatgccaagcggcat

SEQ ID NO: 421626 - DNA, 25 bp, Rattus norvegicus
ggacatcttgagactccacggagat

SEQ ID NO: 421627 - DNA, 25 bp, Rattus norvegicus
ggacatcttgagtctccacggagat

SEQ ID NO: 421628 - DNA, 25 bp, Rattus norvegicus
ggacatcttttgctgtggaacaagc

SEQ ID NO: 421629 - DNA, 25 bp, Rattus norvegicus
ggacatcttttggtgtggaacaagc

SEQ ID NO: 421630 - DNA, 25 bp, Rattus norvegicus
ggacatctttttcctgtgttcttaa

SEQ ID NO: 421631 - DNA, 25 bp, Rattus norvegicus
ggacatctttttgctgtgttcttaa

SEQ ID NO: 421632 - DNA, 25 bp, Rattus norvegicus
ggacatgaactcagggcatgcctgt

SEQ ID NO: 421633 - DNA, 25 bp, Rattus norvegicus
ggacatgaactctgggcatgcctgt

SEQ ID NO: 421634 - DNA, 25 bp, Rattus norvegicus
ggacatgaagatcttttttcccaag

SEQ ID NO: 421635 - DNA, 25 bp, Rattus norvegicus
ggacatgaagatgttttttcccaag

SEQ ID NO: 421636 - DNA, 25 bp, Rattus norvegicus
ggacatgaaggtcaaccccattcag

SEQ ID NO: 421637 - DNA, 25 bp, Rattus norvegicus
ggacatgaaggtctttgtaacccta

SEQ ID NO: 421638 - DNA, 25 bp, Rattus norvegicus
ggacatgaaggtgaaccccattcag

SEQ ID NO: 421639 - DNA, 25 bp, Rattus norvegicus
ggacatgaaggtgtttgtaacccta

SEQ ID NO: 421640 - DNA, 25 bp, Rattus norvegicus
ggacatgaatccatctgtgttgaag

SEQ ID NO: 421641 - DNA, 25 bp, Rattus norvegicus
ggacatgaatccttctgtgttgaag

SEQ ID NO: 421642 - DNA, 25 bp, Rattus norvegicus
ggacatgacaccaactatacggaaa

SEQ ID NO: 421643 - DNA, 25 bp, Rattus norvegicus
ggacatgacacctactatacggaaa

SEQ ID NO: 421644 - DNA, 25 bp, Rattus norvegicus
ggacatgacatccaccaagctaggg

SEQ ID NO: 421645 - DNA, 25 bp, Rattus norvegicus
ggacatgacatcgaccaagctaggg

SEQ ID NO: 421646 - DNA, 25 bp, Rattus norvegicus
ggacatgacattacatagcctcaat

SEQ ID NO: 421647 - DNA, 25 bp, Rattus norvegicus
ggacatgacatttcatagcctcaat

SEQ ID NO: 421648 - DNA, 25 bp, Rattus norvegicus
ggacatgacccaccagctgaagaga

SEQ ID NO: 421649 - DNA, 25 bp, Rattus norvegicus
ggacatgacccagcagctgaagaga

SEQ ID NO: 421650 - DNA, 25 bp, Rattus norvegicus
ggacatgactttcctttcctaattt

SEQ ID NO: 421651 - DNA, 25 bp, Rattus norvegicus
ggacatgactttctttcagcactgt

SEQ ID NO: 421652 - DNA, 25 bp, Rattus norvegicus
ggacatgactttgctttcctaattt

SEQ ID NO: 421653 - DNA, 25 bp, Rattus norvegicus
ggacatgactttgtttcagcactgt

SEQ ID NO: 421654 - DNA, 25 bp, Rattus norvegicus
ggacatgagagacagctgccacaaa

SEQ ID NO: 421655 - DNA, 25 bp, Rattus norvegicus
ggacatgagagagagctgccacaaa

SEQ ID NO: 421656 - DNA, 25 bp, Rattus norvegicus
ggacatgagcctacgagagcatttc

SEQ ID NO: 421657 - DNA, 25 bp, Rattus norvegicus
ggacatgagccttcgagagcatttc

SEQ ID NO: 421658 - DNA, 25 bp, Rattus norvegicus
ggacatgagtcccaaagcctgcttt

SEQ ID NO: 421659 - DNA, 25 bp, Rattus norvegicus
ggacatgagtccgaaagcctgcttt

SEQ ID NO: 421660 - DNA, 25 bp, Rattus norvegicus
ggacatgagtctctcgagtgacact

SEQ ID NO: 421661 - DNA, 25 bp, Rattus norvegicus
ggacatgagtctgtcgagtgacact

SEQ ID NO: 421662 - DNA, 25 bp, Rattus norvegicus
ggacatgatcaaatgcaccaaaaag

SEQ ID NO: 421663 - DNA, 25 bp, Rattus norvegicus
ggacatgatcaattgcaccaaaaag

SEQ ID NO: 421664 - DNA, 25 bp, Rattus norvegicus
ggacatgatcatactgcccgagatg

SEQ ID NO: 421665 - DNA, 25 bp, Rattus norvegicus
ggacatgatcattctgcccgagatg

SEQ ID NO: 421666 - DNA, 25 bp, Rattus norvegicus
ggacatgatcctagacgacgaccac

SEQ ID NO: 421667 - DNA, 25 bp, Rattus norvegicus
ggacatgatccttgacgacgaccac

SEQ ID NO: 421668 - DNA, 25 bp, Rattus norvegicus
ggacatgatgaacgccacccagctg

SEQ ID NO: 421669 - DNA, 25 bp, Rattus norvegicus
ggacatgatgaaggccacccagctg

SEQ ID NO: 421670 - DNA, 25 bp, Rattus norvegicus
ggacatgatgatacctagtgacaag

SEQ ID NO: 421671 - DNA, 25 bp, Rattus norvegicus
ggacatgatgattcctagtgacaag

SEQ ID NO: 421672 - DNA, 25 bp, Rattus norvegicus
ggacatgatgctactactgaattca

SEQ ID NO: 421673 - DNA, 25 bp, Rattus norvegicus
ggacatgatgcttctactgaattca

SEQ ID NO: 421674 - DNA, 25 bp, Rattus norvegicus
ggacatgattttaacctactaacac

SEQ ID NO: 421675 - DNA, 25 bp, Rattus norvegicus
ggacatgatttttacctactaacac

SEQ ID NO: 421676 - DNA, 25 bp, Rattus norvegicus
ggacatgcacatcgactcagctttg

SEQ ID NO: 421677 - DNA, 25 bp, Rattus norvegicus
ggacatgcacatggactcagctttg

SEQ ID NO: 421678 - DNA, 25 bp, Rattus norvegicus
ggacatgcacttaatgcttacccgc

SEQ ID NO: 421679 - DNA, 25 bp, Rattus norvegicus
ggacatgcactttatgcttacccgc

SEQ ID NO: 421680 - DNA, 25 bp, Rattus norvegicus
ggacatgcagacactcggcatgctt

SEQ ID NO: 421681 - DNA, 25 bp, Rattus norvegicus
ggacatgcagactctcggcatgctt

SEQ ID NO: 421682 - DNA, 25 bp, Rattus norvegicus
ggacatgcagagcaatcaatcagat

SEQ ID NO: 421683 - DNA, 25 bp, Rattus norvegicus
ggacatgcagaggaatcaatcagat

SEQ ID NO: 421684 - DNA, 25 bp, Rattus norvegicus
ggacatgcataaagctgtagccgga

SEQ ID NO: 421685 - DNA, 25 bp, Rattus norvegicus
ggacatgcataatgctgtagccgga

SEQ ID NO: 421686 - DNA, 25 bp, Rattus norvegicus
ggacatgcattgataatcttttgac

SEQ ID NO: 421687 - DNA, 25 bp, Rattus norvegicus
ggacatgcattgttaatcttttgac

SEQ ID NO: 421688 - DNA, 25 bp, Rattus norvegicus
ggacatgccagccaacaacaagtgc

SEQ ID NO: 421689 - DNA, 25 bp, Rattus norvegicus
ggacatgccagcgaacaacaagtgc

SEQ ID NO: 421690 - DNA, 25 bp, Rattus norvegicus
ggacatgcccagagatggtctccaa

SEQ ID NO: 421691 - DNA, 25 bp, Rattus norvegicus
ggacatgcccagtgatggtctccaa

SEQ ID NO: 421692 - DNA, 25 bp, Rattus norvegicus
ggacatgccgtgagtactacaactg

SEQ ID NO: 421693 - DNA, 25 bp, Rattus norvegicus
ggacatgccgtgtgtactacaactg

SEQ ID NO: 421694 - DNA, 25 bp, Rattus norvegicus
ggacatgcctatatttaatggcctc

SEQ ID NO: 421695 - DNA, 25 bp, Rattus norvegicus
ggacatgcctatttttaatggcctc

SEQ ID NO: 421696 - DNA, 25 bp, Rattus norvegicus
ggacatgctccaaaagatctgcctc

SEQ ID NO: 421697 - DNA, 25 bp, Rattus norvegicus
ggacatgctccacaatttcttgcaa

SEQ ID NO: 421698 - DNA, 25 bp, Rattus norvegicus
ggacatgctccagaatttcttgcaa

SEQ ID NO: 421699 - DNA, 25 bp, Rattus norvegicus
ggacatgctccataagatctgcctc

SEQ ID NO: 421700 - DNA, 25 bp, Rattus norvegicus
ggacatgctctacggccttgaagtg

SEQ ID NO: 421701 - DNA, 25 bp, Rattus norvegicus
ggacatgctctagggccttgaagtg

SEQ ID NO: 421702 - DNA, 25 bp, Rattus norvegicus
ggacatgctgttcgtagtgactgaa

SEQ ID NO: 421703 - DNA, 25 bp, Rattus norvegicus
ggacatgctgttggtagtgactgaa

SEQ ID NO: 421704 - DNA, 25 bp, Rattus norvegicus
ggacatgcttccctgctgtggatag

SEQ ID NO: 421705 - DNA, 25 bp, Rattus norvegicus
ggacatgcttccgtgctgtggatag

SEQ ID NO: 421706 - DNA, 25 bp, Rattus norvegicus
ggacatggaagacccatcttctggc

SEQ ID NO: 421707 - DNA, 25 bp, Rattus norvegicus
ggacatggaagagccatcttctggc

SEQ ID NO: 421708 - DNA, 25 bp, Rattus norvegicus
ggacatggacctctggccacacgga

SEQ ID NO: 421709 - DNA, 25 bp, Rattus norvegicus
ggacatggacctgtggccacacgga

SEQ ID NO: 421710 - DNA, 25 bp, Rattus norvegicus
ggacatggacttagaagcctacttg

SEQ ID NO: 421711 - DNA, 25 bp, Rattus norvegicus
ggacatggactttgaagcctacttg

SEQ ID NO: 421712 - DNA, 25 bp, Rattus norvegicus
ggacatggattcaccttcagcggga

SEQ ID NO: 421713 - DNA, 25 bp, Rattus norvegicus
ggacatggattctccttcagcggga

SEQ ID NO: 421714 - DNA, 25 bp, Rattus norvegicus
ggacatggcagccagtccaatagca

SEQ ID NO: 421715 - DNA, 25 bp, Rattus norvegicus
ggacatggcagcgagtccaatagca

SEQ ID NO: 421716 - DNA, 25 bp, Rattus norvegicus
ggacatggccagactgagctggact

SEQ ID NO: 421717 - DNA, 25 bp, Rattus norvegicus
ggacatggccagtctgagctggact

SEQ ID NO: 421718 - DNA, 25 bp, Rattus norvegicus
ggacatggccatcgcaggttccagc

SEQ ID NO: 421719 - DNA, 25 bp, Rattus norvegicus
ggacatggccatggcaggttccagc

SEQ ID NO: 421720 - DNA, 25 bp, Rattus norvegicus
ggacatggcctgacgagtcatcttg

SEQ ID NO: 421721 - DNA, 25 bp, Rattus norvegicus
ggacatggcctgtcgagtcatcttg

SEQ ID NO: 421722 - DNA, 25 bp, Rattus norvegicus
ggacatggctcaatttgttttatca

SEQ ID NO: 421723 - DNA, 25 bp, Rattus norvegicus
ggacatggctcattttgttttatca

SEQ ID NO: 421724 - DNA, 25 bp, Rattus norvegicus
ggacatggctggcttttatgtgcta

SEQ ID NO: 421725 - DNA, 25 bp, Rattus norvegicus
ggacatggctgggttttatgtgcta

SEQ ID NO: 421726 - DNA, 25 bp, Rattus norvegicus
ggacatgggagtattcaagcactga

SEQ ID NO: 421727 - DNA, 25 bp, Rattus norvegicus
ggacatgggagttttcaagcactga

SEQ ID NO: 421728 - DNA, 25 bp, Rattus norvegicus
ggacatgggtccagaaatggctgta

SEQ ID NO: 421729 - DNA, 25 bp, Rattus norvegicus
ggacatgggtccctcagaggacact

SEQ ID NO: 421730 - DNA, 25 bp, Rattus norvegicus
ggacatgggtccgtcagaggacact

SEQ ID NO: 421731 - DNA, 25 bp, Rattus norvegicus
ggacatgggtcctgaaatggctgta

SEQ ID NO: 421732 - DNA, 25 bp, Rattus norvegicus
ggacatggtagcagccttgctggaa

SEQ ID NO: 421733 - DNA, 25 bp, Rattus norvegicus
ggacatggtagctgccttgctggaa

SEQ ID NO: 421734 - DNA, 25 bp, Rattus norvegicus
ggacatggtcctcgaaattccttat

SEQ ID NO: 421735 - DNA, 25 bp, Rattus norvegicus
ggacatggtcctggaaattccttat

SEQ ID NO: 421736 - DNA, 25 bp, Rattus norvegicus
ggacatggtgctctggttaagaaca

SEQ ID NO: 421737 - DNA, 25 bp, Rattus norvegicus
ggacatggtgctgtggttaagaaca

SEQ ID NO: 421738 - DNA, 25 bp, Rattus norvegicus
ggacatggttcacgccagccctatg

SEQ ID NO: 421739 - DNA, 25 bp, Rattus norvegicus
ggacatggttcaggccagccctatg

SEQ ID NO: 421740 - DNA, 25 bp, Rattus norvegicus
ggacatggttttaacaagcttgaag

SEQ ID NO: 421741 - DNA, 25 bp, Rattus norvegicus
ggacatggttttccttggattgtgt

SEQ ID NO: 421742 - DNA, 25 bp, Rattus norvegicus
ggacatggttttgcttggattgtgt

SEQ ID NO: 421743 - DNA, 25 bp, Rattus norvegicus
ggacatggtttttacaagcttgaag

SEQ ID NO: 421744 - DNA, 25 bp, Rattus norvegicus
ggacatgtacatccatagggcaact

SEQ ID NO: 421745 - DNA, 25 bp, Rattus norvegicus
ggacatgtacatgcatagggcaact

SEQ ID NO: 421746 - DNA, 25 bp, Rattus norvegicus
ggacatgtacccaaatacggtactt

SEQ ID NO: 421747 - DNA, 25 bp, Rattus norvegicus
ggacatgtaccctaatacggtactt

SEQ ID NO: 421748 - DNA, 25 bp, Rattus norvegicus
ggacatgtactaaggctgcacgcag

SEQ ID NO: 421749 - DNA, 25 bp, Rattus norvegicus
ggacatgtactatggctgcacgcag

SEQ ID NO: 421750 - DNA, 25 bp, Rattus norvegicus
ggacatgtagccaaggagcctgaga

SEQ ID NO: 421751 - DNA, 25 bp, Rattus norvegicus
ggacatgtagcctaggagcctgaga

SEQ ID NO: 421752 - DNA, 25 bp, Rattus norvegicus
ggacatgtccaaccacggcacagat

SEQ ID NO: 421753 - DNA, 25 bp, Rattus norvegicus
ggacatgtccaagcacggcacagat

SEQ ID NO: 421754 - DNA, 25 bp, Rattus norvegicus
ggacatgtccatacagtgaacagtt

SEQ ID NO: 421755 - DNA, 25 bp, Rattus norvegicus
ggacatgtccattcagtgaacagtt

SEQ ID NO: 421756 - DNA, 25 bp, Rattus norvegicus
ggacatgtcctcctcagtccagatt

SEQ ID NO: 421757 - DNA, 25 bp, Rattus norvegicus
ggacatgtcctcgtcagtccagatt

SEQ ID NO: 421758 - DNA, 25 bp, Rattus norvegicus
ggacatgtccttacattcaatggaa

SEQ ID NO: 421759 - DNA, 25 bp, Rattus norvegicus
ggacatgtcctttcattcaatggaa

SEQ ID NO: 421760 - DNA, 25 bp, Rattus norvegicus
ggacatgtcgacattccagggatgt

SEQ ID NO: 421761 - DNA, 25 bp, Rattus norvegicus
ggacatgtcgactttccagggatgt

SEQ ID NO: 421762 - DNA, 25 bp, Rattus norvegicus
ggacatgtctttcgtgtcgctgaga

SEQ ID NO: 421763 - DNA, 25 bp, Rattus norvegicus
ggacatgtctttggtgtcgctgaga

SEQ ID NO: 421764 - DNA, 25 bp, Rattus norvegicus
ggacatgtgaccaatagcccagtgc

SEQ ID NO: 421765 - DNA, 25 bp, Rattus norvegicus
ggacatgtgacctatagcccagtgc

SEQ ID NO: 421766 - DNA, 25 bp, Rattus norvegicus
ggacatgtgcataatctcatacaag

SEQ ID NO: 421767 - DNA, 25 bp, Rattus norvegicus
ggacatgtgcattatctcatacaag

SEQ ID NO: 421768 - DNA, 25 bp, Rattus norvegicus
ggacatgtgcccatgcatactgttc

SEQ ID NO: 421769 - DNA, 25 bp, Rattus norvegicus
ggacatgtgcccttgcatactgttc

SEQ ID NO: 421770 - DNA, 25 bp, Rattus norvegicus
ggacatgtgtacactgctgcactta

SEQ ID NO: 421771 - DNA, 25 bp, Rattus norvegicus
ggacatgtgtactctgctgcactta

SEQ ID NO: 421772 - DNA, 25 bp, Rattus norvegicus
ggacatgttcatccttttgaggtat

SEQ ID NO: 421773 - DNA, 25 bp, Rattus norvegicus
ggacatgttcatgcttttgaggtat

SEQ ID NO: 421774 - DNA, 25 bp, Rattus norvegicus
ggacatgttctcacagttgactttt

SEQ ID NO: 421775 - DNA, 25 bp, Rattus norvegicus
ggacatgttctctcagttgactttt

SEQ ID NO: 421776 - DNA, 25 bp, Rattus norvegicus
ggacatgttcttcgagtgaccaagt

SEQ ID NO: 421777 - DNA, 25 bp, Rattus norvegicus
ggacatgttcttggagtgaccaagt

SEQ ID NO: 421778 - DNA, 25 bp, Rattus norvegicus
ggacatgttgccagaagccacagaa

SEQ ID NO: 421779 - DNA, 25 bp, Rattus norvegicus
ggacatgttgcctgaagccacagaa

SEQ ID NO: 421780 - DNA, 25 bp, Rattus norvegicus
ggacattaacccatttttactatca

SEQ ID NO: 421781 - DNA, 25 bp, Rattus norvegicus
ggacattaacccttttttactatca

SEQ ID NO: 421782 - DNA, 25 bp, Rattus norvegicus
ggacattaatcgcttcacttgaatt

SEQ ID NO: 421783 - DNA, 25 bp, Rattus norvegicus
ggacattaatcggttcacttgaatt

SEQ ID NO: 421784 - DNA, 25 bp, Rattus norvegicus
ggacattacctgaggtgtcttgtat

SEQ ID NO: 421785 - DNA, 25 bp, Rattus norvegicus
ggacattacctgtggtgtcttgtat

SEQ ID NO: 421786 - DNA, 25 bp, Rattus norvegicus
ggacattacgacctcagtgctgaca

SEQ ID NO: 421787 - DNA, 25 bp, Rattus norvegicus
ggacattacgacgtcagtgctgaca

SEQ ID NO: 421788 - DNA, 25 bp, Rattus norvegicus
ggacattagctgatacttcctgcag

SEQ ID NO: 421789 - DNA, 25 bp, Rattus norvegicus
ggacattagctgttacttcctgcag

SEQ ID NO: 421790 - DNA, 25 bp, Rattus norvegicus
ggacattaggtcataagcgcccaac

SEQ ID NO: 421791 - DNA, 25 bp, Rattus norvegicus
ggacattaggtcttaagcgcccaac

SEQ ID NO: 421792 - DNA, 25 bp, Rattus norvegicus
ggacattagttcacattcctcacca

SEQ ID NO: 421793 - DNA, 25 bp, Rattus norvegicus
ggacattagttctcattcctcacca

SEQ ID NO: 421794 - DNA, 25 bp, Rattus norvegicus
ggacattatcaccttgtttggcctc

SEQ ID NO: 421795 - DNA, 25 bp, Rattus norvegicus
ggacattatcacgttgtttggcctc

SEQ ID NO: 421796 - DNA, 25 bp, Rattus norvegicus
ggacattatgtccagacctgtcaga

SEQ ID NO: 421797 - DNA, 25 bp, Rattus norvegicus
ggacattatgtcgagacctgtcaga

SEQ ID NO: 421798 - DNA, 25 bp, Rattus norvegicus
ggacattattgtacccactgaacag

SEQ ID NO: 421799 - DNA, 25 bp, Rattus norvegicus
ggacattattgttcccactgaacag

SEQ ID NO: 421800 - DNA, 25 bp, Rattus norvegicus
ggacattcaactctaccacaacctg

SEQ ID NO: 421801 - DNA, 25 bp, Rattus norvegicus
ggacattcaactgtaccacaacctg

SEQ ID NO: 421802 - DNA, 25 bp, Rattus norvegicus
ggacattcattcataccaagagata

SEQ ID NO: 421803 - DNA, 25 bp, Rattus norvegicus
ggacattcattcttaccaagagata

SEQ ID NO: 421804 - DNA, 25 bp, Rattus norvegicus
ggacattccagtcattccatgacat

SEQ ID NO: 421805 - DNA, 25 bp, Rattus norvegicus
ggacattccagtgattccatgacat

SEQ ID NO: 421806 - DNA, 25 bp, Rattus norvegicus
ggacattcctttagggactccatac

SEQ ID NO: 421807 - DNA, 25 bp, Rattus norvegicus
ggacattcctttctacaagagccgg

SEQ ID NO: 421808 - DNA, 25 bp, Rattus norvegicus
ggacattcctttgtacaagagccgg

SEQ ID NO: 421809 - DNA, 25 bp, Rattus norvegicus
ggacattccttttgggactccatac

SEQ ID NO: 421810 - DNA, 25 bp, Rattus norvegicus
ggacattcgagacagcagcttaggt

SEQ ID NO: 421811 - DNA, 25 bp, Rattus norvegicus
ggacattcgagagagcagcttaggt

SEQ ID NO: 421812 - DNA, 25 bp, Rattus norvegicus
ggacattctacccattactcagaga

SEQ ID NO: 421813 - DNA, 25 bp, Rattus norvegicus
ggacattctaccgattactcagaga

SEQ ID NO: 421814 - DNA, 25 bp, Rattus norvegicus
ggacattctcaaagaccactggcag

SEQ ID NO: 421815 - DNA, 25 bp, Rattus norvegicus
ggacattctcaatgaccactggcag

SEQ ID NO: 421816 - DNA, 25 bp, Rattus norvegicus
ggacattctcacagcatccaatgtg

SEQ ID NO: 421817 - DNA, 25 bp, Rattus norvegicus
ggacattctcactgcatccaatgtg

SEQ ID NO: 421818 - DNA, 25 bp, Rattus norvegicus
ggacattctccacattgacacattt

SEQ ID NO: 421819 - DNA, 25 bp, Rattus norvegicus
ggacattctccagattgacacattt

SEQ ID NO: 421820 - DNA, 25 bp, Rattus norvegicus
ggacattctgatcgctgcatttctt

SEQ ID NO: 421821 - DNA, 25 bp, Rattus norvegicus
ggacattctgatggctgcatttctt

SEQ ID NO: 421822 - DNA, 25 bp, Rattus norvegicus
ggacattctgcaaactcttaaagat

SEQ ID NO: 421823 - DNA, 25 bp, Rattus norvegicus
ggacattctgcatactcttaaagat

SEQ ID NO: 421824 - DNA, 25 bp, Rattus norvegicus
ggacattctgggatgttttcgttaa

SEQ ID NO: 421825 - DNA, 25 bp, Rattus norvegicus
ggacattctgggttgttttcgttaa

SEQ ID NO: 421826 - DNA, 25 bp, Rattus norvegicus
ggacattcttttatattggcggctc

SEQ ID NO: 421827 - DNA, 25 bp, Rattus norvegicus
ggacattcttttttattggcggctc

SEQ ID NO: 421828 - DNA, 25 bp, Rattus norvegicus
ggacattgaaatctgttgctggcat

SEQ ID NO: 421829 - DNA, 25 bp, Rattus norvegicus
ggacattgaaatgtgttgctggcat

SEQ ID NO: 421830 - DNA, 25 bp, Rattus norvegicus
ggacattgaagcacgataagccaag

SEQ ID NO: 421831 - DNA, 25 bp, Rattus norvegicus
ggacattgaagctcgataagccaag

SEQ ID NO: 421832 - DNA, 25 bp, Rattus norvegicus
ggacattgaccccagtgtgtaattt

SEQ ID NO: 421833 - DNA, 25 bp, Rattus norvegicus
ggacattgacccctgtgagccgagc

SEQ ID NO: 421834 - DNA, 25 bp, Rattus norvegicus
ggacattgacccgagtgtgtaattt

SEQ ID NO: 421835 - DNA, 25 bp, Rattus norvegicus
ggacattgacccgtgtgagccgagc

SEQ ID NO: 421836 - DNA, 25 bp, Rattus norvegicus
ggacattgagacacagacccatcga

SEQ ID NO: 421837 - DNA, 25 bp, Rattus norvegicus
ggacattgagactcagacccatcga

SEQ ID NO: 421838 - DNA, 25 bp, Rattus norvegicus
ggacattgccatatgacgactcacc

SEQ ID NO: 421839 - DNA, 25 bp, Rattus norvegicus
ggacattgccatttgacgactcacc

SEQ ID NO: 421840 - DNA, 25 bp, Rattus norvegicus
ggacattgctgcctatatcaagaag

SEQ ID NO: 421841 - DNA, 25 bp, Rattus norvegicus
ggacattgctgcgtatatcaagaag

SEQ ID NO: 421842 - DNA, 25 bp, Rattus norvegicus
ggacattgctggctgccttcaggac

SEQ ID NO: 421843 - DNA, 25 bp, Rattus norvegicus
ggacattgctgggtgccttcaggac

SEQ ID NO: 421844 - DNA, 25 bp, Rattus norvegicus
ggacattggacaacagggcacccac

SEQ ID NO: 421845 - DNA, 25 bp, Rattus norvegicus
ggacattggacatcagggcacccac

SEQ ID NO: 421846 - DNA, 25 bp, Rattus norvegicus
ggacattggctaagaagactcgtaa

SEQ ID NO: 421847 - DNA, 25 bp, Rattus norvegicus
ggacattggctaccatgagttccgg

SEQ ID NO: 421848 - DNA, 25 bp, Rattus norvegicus
ggacattggctagcatgagttccgg

SEQ ID NO: 421849 - DNA, 25 bp, Rattus norvegicus
ggacattggctatgaagactcgtaa

SEQ ID NO: 421850 - DNA, 25 bp, Rattus norvegicus
ggacattggtcaagcctgtgcacga

SEQ ID NO: 421851 - DNA, 25 bp, Rattus norvegicus
ggacattggtcatgcctgtgcacga

SEQ ID NO: 421852 - DNA, 25 bp, Rattus norvegicus
ggacattggtctattgacaaaatac

SEQ ID NO: 421853 - DNA, 25 bp, Rattus norvegicus
ggacattggtcttttgacaaaatac

SEQ ID NO: 421854 - DNA, 25 bp, Rattus norvegicus
ggacattgtcaaagccatctacgac

SEQ ID NO: 421855 - DNA, 25 bp, Rattus norvegicus
ggacattgtcaatgccatctacgac

SEQ ID NO: 421856 - DNA, 25 bp, Rattus norvegicus
ggacattgtcatatcttgatgccag

SEQ ID NO: 421857 - DNA, 25 bp, Rattus norvegicus
ggacattgtcatttcttgatgccag

SEQ ID NO: 421858 - DNA, 25 bp, Rattus norvegicus
ggacattgtcttagacctaaatcat

SEQ ID NO: 421859 - DNA, 25 bp, Rattus norvegicus
ggacattgtctttgacctaaatcat

SEQ ID NO: 421860 - DNA, 25 bp, Rattus norvegicus
ggacattgtgatacaggagctgttt

SEQ ID NO: 421861 - DNA, 25 bp, Rattus norvegicus
ggacattgtgattcaggagctgttt

SEQ ID NO: 421862 - DNA, 25 bp, Rattus norvegicus
ggacattgtgtcagattgcagttat

SEQ ID NO: 421863 - DNA, 25 bp, Rattus norvegicus
ggacattgtgtctgattgcagttat

SEQ ID NO: 421864 - DNA, 25 bp, Rattus norvegicus
ggacattgttttacagtgagctaac

SEQ ID NO: 421865 - DNA, 25 bp, Rattus norvegicus
ggacattgtttttcagtgagctaac

SEQ ID NO: 421866 - DNA, 25 bp, Rattus norvegicus
ggacatttaacaattgcaggtcaaa

SEQ ID NO: 421867 - DNA, 25 bp, Rattus norvegicus
ggacatttaacatttgcaggtcaaa

SEQ ID NO: 421868 - DNA, 25 bp, Rattus norvegicus
ggacatttaactcctaggattctag

SEQ ID NO: 421869 - DNA, 25 bp, Rattus norvegicus
ggacatttaactgctaggattctag

SEQ ID NO: 421870 - DNA, 25 bp, Rattus norvegicus
ggacatttaaggaaagacccactag

SEQ ID NO: 421871 - DNA, 25 bp, Rattus norvegicus
ggacatttaaggtaagacccactag

SEQ ID NO: 421872 - DNA, 25 bp, Rattus norvegicus
ggacatttatttacctacttgtgaa

SEQ ID NO: 421873 - DNA, 25 bp, Rattus norvegicus
ggacatttattttcctacttgtgaa

SEQ ID NO: 421874 - DNA, 25 bp, Rattus norvegicus
ggacatttcacacaagtacccttta

SEQ ID NO: 421875 - DNA, 25 bp, Rattus norvegicus
ggacatttcacagaagtacccttta

SEQ ID NO: 421876 - DNA, 25 bp, Rattus norvegicus
ggacatttccttatttagcctcaat

SEQ ID NO: 421877 - DNA, 25 bp, Rattus norvegicus
ggacatttccttttttagcctcaat

SEQ ID NO: 421878 - DNA, 25 bp, Rattus norvegicus
ggacatttcgctagttgcagtgttt

SEQ ID NO: 421879 - DNA, 25 bp, Rattus norvegicus
ggacatttcgcttgttgcagtgttt

SEQ ID NO: 421880 - DNA, 25 bp, Rattus norvegicus
ggacatttctccacagcagcgggcg

SEQ ID NO: 421881 - DNA, 25 bp, Rattus norvegicus
ggacatttctcctcagcagcgggcg

SEQ ID NO: 421882 - DNA, 25 bp, Rattus norvegicus
ggacatttgagacccacttctggct

SEQ ID NO: 421883 - DNA, 25 bp, Rattus norvegicus
ggacatttgagagccacttctggct

SEQ ID NO: 421884 - DNA, 25 bp, Rattus norvegicus
ggacatttgcttatccccatcaaag

SEQ ID NO: 421885 - DNA, 25 bp, Rattus norvegicus
ggacatttgcttttccccatcaaag

SEQ ID NO: 421886 - DNA, 25 bp, Rattus norvegicus
ggacatttggctaacaaatttcatt

SEQ ID NO: 421887 - DNA, 25 bp, Rattus norvegicus
ggacatttggcttacaaatttcatt

SEQ ID NO: 421888 - DNA, 25 bp, Rattus norvegicus
ggacatttgtaacagccttcaggga

SEQ ID NO: 421889 - DNA, 25 bp, Rattus norvegicus
ggacatttgtaaccaactgtactgc

SEQ ID NO: 421890 - DNA, 25 bp, Rattus norvegicus
ggacatttgtaagagccttcaggga

SEQ ID NO: 421891 - DNA, 25 bp, Rattus norvegicus
ggacatttgtaagcaactgtactgc

SEQ ID NO: 421892 - DNA, 25 bp, Rattus norvegicus
ggacatttgtgcaattgctcgccct

SEQ ID NO: 421893 - DNA, 25 bp, Rattus norvegicus
ggacatttgtgctattgctcgccct

SEQ ID NO: 421894 - DNA, 25 bp, Rattus norvegicus
ggacattttataaacggcgcttgct

SEQ ID NO: 421895 - DNA, 25 bp, Rattus norvegicus
ggacattttatatacggcgcttgct

SEQ ID NO: 421896 - DNA, 25 bp, Rattus norvegicus
ggacattttatcctcctatggtgat

SEQ ID NO: 421897 - DNA, 25 bp, Rattus norvegicus
ggacattttatcgtcctatggtgat

SEQ ID NO: 421898 - DNA, 25 bp, Rattus norvegicus
ggacattttgacaggccacgtgcag

SEQ ID NO: 421899 - DNA, 25 bp, Rattus norvegicus
ggacattttgactggccacgtgcag

SEQ ID NO: 421900 - DNA, 25 bp, Rattus norvegicus
ggacatttttagataccacaaggtg

SEQ ID NO: 421901 - DNA, 25 bp, Rattus norvegicus
ggacatttttagttaccacaaggtg

SEQ ID NO: 421902 - DNA, 25 bp, Rattus norvegicus
ggacatttttgcactgaagcctaaa

SEQ ID NO: 421903 - DNA, 25 bp, Rattus norvegicus
ggacatttttgctctgaagcctaaa

SEQ ID NO: 421904 - DNA, 25 bp, Rattus norvegicus
ggacatttttgtacatacccttttg

SEQ ID NO: 421905 - DNA, 25 bp, Rattus norvegicus
ggacatttttgttcatacccttttg

SEQ ID NO: 421906 - DNA, 25 bp, Rattus norvegicus
ggaccaaacgtcctgaacgagaagt

SEQ ID NO: 421907 - DNA, 25 bp, Rattus norvegicus
ggaccaaacgtcgtgaacgagaagt

SEQ ID NO: 421908 - DNA, 25 bp, Rattus norvegicus
ggaccaaactctaattcgggatctg

SEQ ID NO: 421909 - DNA, 25 bp, Rattus norvegicus
ggaccaaactcttattcgggatctg

SEQ ID NO: 421910 - DNA, 25 bp, Rattus norvegicus
ggaccaaactggcattgttctattt

SEQ ID NO: 421911 - DNA, 25 bp, Rattus norvegicus
ggaccaaactgggattgttctattt

SEQ ID NO: 421912 - DNA, 25 bp, Rattus norvegicus
ggaccaaagacaagtggcgcgccta

SEQ ID NO: 421913 - DNA, 25 bp, Rattus norvegicus
ggaccaaagacatgtggcgcgccta

SEQ ID NO: 421914 - DNA, 25 bp, Rattus norvegicus
ggaccaaagccccaacagacaatat

SEQ ID NO: 421915 - DNA, 25 bp, Rattus norvegicus
ggaccaaagcccgaacagacaatat

SEQ ID NO: 421916 - DNA, 25 bp, Rattus norvegicus
ggaccaaagtttagttctctgcccg

SEQ ID NO: 421917 - DNA, 25 bp, Rattus norvegicus
ggaccaaagttttgttctctgcccg

SEQ ID NO: 421918 - DNA, 25 bp, Rattus norvegicus
ggaccaaatcccagccgcaagagga

SEQ ID NO: 421919 - DNA, 25 bp, Rattus norvegicus
ggaccaaatccctgccgcaagagga

SEQ ID NO: 421920 - DNA, 25 bp, Rattus norvegicus
ggaccaaatcgaccaggcgcacctg

SEQ ID NO: 421921 - DNA, 25 bp, Rattus norvegicus
ggaccaaatcgagcaggcgcacctg

SEQ ID NO: 421922 - DNA, 25 bp, Rattus norvegicus
ggaccaacagacaggcaacctcaag

SEQ ID NO: 421923 - DNA, 25 bp, Rattus norvegicus
ggaccaacagactggcaacctcaag

SEQ ID NO: 421924 - DNA, 25 bp, Rattus norvegicus
ggaccaacagttcttccaaacctga

SEQ ID NO: 421925 - DNA, 25 bp, Rattus norvegicus
ggaccaacagttgttccaaacctga

SEQ ID NO: 421926 - DNA, 25 bp, Rattus norvegicus
ggaccaacattaatcctgtaattga

SEQ ID NO: 421927 - DNA, 25 bp, Rattus norvegicus
ggaccaacattattcctgtaattga

SEQ ID NO: 421928 - DNA, 25 bp, Rattus norvegicus
ggaccaaccacaagtgtcacagggt

SEQ ID NO: 421929 - DNA, 25 bp, Rattus norvegicus
ggaccaaccacatgtgtcacagggt

SEQ ID NO: 421930 - DNA, 25 bp, Rattus norvegicus
ggaccaaccattcgtgcaccaggaa

SEQ ID NO: 421931 - DNA, 25 bp, Rattus norvegicus
ggaccaaccattggtgcaccaggaa

SEQ ID NO: 421932 - DNA, 25 bp, Rattus norvegicus
ggaccaacccatcataaactcacag

SEQ ID NO: 421933 - DNA, 25 bp, Rattus norvegicus
ggaccaacccatgataaactcacag

SEQ ID NO: 421934 - DNA, 25 bp, Rattus norvegicus
ggaccaaccttgagggatcaggaaa

SEQ ID NO: 421935 - DNA, 25 bp, Rattus norvegicus
ggaccaaccttgtgggatcaggaaa

SEQ ID NO: 421936 - DNA, 25 bp, Rattus norvegicus
ggaccaacggacagtatgaataatc

SEQ ID NO: 421937 - DNA, 25 bp, Rattus norvegicus
ggaccaacggactgtatgaataatc

SEQ ID NO: 421938 - DNA, 25 bp, Rattus norvegicus
ggaccaacttgaagatgacgccgat

SEQ ID NO: 421939 - DNA, 25 bp, Rattus norvegicus
ggaccaacttgaccgagactgggct

SEQ ID NO: 421940 - DNA, 25 bp, Rattus norvegicus
ggaccaacttgagcgagactgggct

SEQ ID NO: 421941 - DNA, 25 bp, Rattus norvegicus
ggaccaacttgatgatgacgccgat

SEQ ID NO: 421942 - DNA, 25 bp, Rattus norvegicus
ggaccaagatcaccccaaagcgtta

SEQ ID NO: 421943 - DNA, 25 bp, Rattus norvegicus
ggaccaagatcagcccaaagcgtta

SEQ ID NO: 421944 - DNA, 25 bp, Rattus norvegicus
ggaccaagattaaacaccagcagga

SEQ ID NO: 421945 - DNA, 25 bp, Rattus norvegicus
ggaccaagattatacaccagcagga

SEQ ID NO: 421946 - DNA, 25 bp, Rattus norvegicus
ggaccaagcactctatgcgcggatc

SEQ ID NO: 421947 - DNA, 25 bp, Rattus norvegicus
ggaccaagcactgtatgcgcggatc

SEQ ID NO: 421948 - DNA, 25 bp, Rattus norvegicus
ggaccaagcggcagcttctcaaaaa

SEQ ID NO: 421949 - DNA, 25 bp, Rattus norvegicus
ggaccaagcggctgcttctcaaaaa

SEQ ID NO: 421950 - DNA, 25 bp, Rattus norvegicus
ggaccaagctatacaggagttcatg

SEQ ID NO: 421951 - DNA, 25 bp, Rattus norvegicus
ggaccaagctattcaggagttcatg

SEQ ID NO: 421952 - DNA, 25 bp, Rattus norvegicus
ggaccaaggaagagcggcccacaca

SEQ ID NO: 421953 - DNA, 25 bp, Rattus norvegicus
ggaccaaggaagtgcggcccacaca

SEQ ID NO: 421954 - DNA, 25 bp, Rattus norvegicus
ggaccaaggcatactcataactaca

SEQ ID NO: 421955 - DNA, 25 bp, Rattus norvegicus
ggaccaaggcattctcataactaca

SEQ ID NO: 421956 - DNA, 25 bp, Rattus norvegicus
ggaccaaggtcaatctcacataagc

SEQ ID NO: 421957 - DNA, 25 bp, Rattus norvegicus
ggaccaaggtcattctcacataagc

SEQ ID NO: 421958 - DNA, 25 bp, Rattus norvegicus
ggaccaagtattcagcaggccgaaa

SEQ ID NO: 421959 - DNA, 25 bp, Rattus norvegicus
ggaccaagtattgagcaggccgaaa

SEQ ID NO: 421960 - DNA, 25 bp, Rattus norvegicus
ggaccaagtgttctcttgcatacat

SEQ ID NO: 421961 - DNA, 25 bp, Rattus norvegicus
ggaccaagtgttgtcttgcatacat

SEQ ID NO: 421962 - DNA, 25 bp, Rattus norvegicus
ggaccaagtttgaagcctgcatctg

SEQ ID NO: 421963 - DNA, 25 bp, Rattus norvegicus
ggaccaagtttgcaggcagcttttt

SEQ ID NO: 421964 - DNA, 25 bp, Rattus norvegicus
ggaccaagtttggaggcagcttttt

SEQ ID NO: 421965 - DNA, 25 bp, Rattus norvegicus
ggaccaagtttgtagcctgcatctg

SEQ ID NO: 421966 - DNA, 25 bp, Rattus norvegicus
ggaccaatagtgactctcctagtaa

SEQ ID NO: 421967 - DNA, 25 bp, Rattus norvegicus
ggaccaatagtgtctctcctagtaa

SEQ ID NO: 421968 - DNA, 25 bp, Rattus norvegicus
ggaccaatatgccactgtatcagta

SEQ ID NO: 421969 - DNA, 25 bp, Rattus norvegicus
ggaccaatatgcgactgtatcagta

SEQ ID NO: 421970 - DNA, 25 bp, Rattus norvegicus
ggaccaatcagacatgctgtagctc

SEQ ID NO: 421971 - DNA, 25 bp, Rattus norvegicus
ggaccaatcagagatgctgtagctc

SEQ ID NO: 421972 - DNA, 25 bp, Rattus norvegicus
ggaccaatccacagtctgtaaaatg

SEQ ID NO: 421973 - DNA, 25 bp, Rattus norvegicus
ggaccaatccactgtctgtaaaatg

SEQ ID NO: 421974 - DNA, 25 bp, Rattus norvegicus
ggaccaatcgtcaaaaggcccaaga

SEQ ID NO: 421975 - DNA, 25 bp, Rattus norvegicus
ggaccaatcgtctaaaggcccaaga

SEQ ID NO: 421976 - DNA, 25 bp, Rattus norvegicus
ggaccaatctgacaaagccattctg

SEQ ID NO: 421977 - DNA, 25 bp, Rattus norvegicus
ggaccaatctgagaaagccattctg

SEQ ID NO: 421978 - DNA, 25 bp, Rattus norvegicus
ggaccaattagaaccagcgtgagac

SEQ ID NO: 421979 - DNA, 25 bp, Rattus norvegicus
ggaccaattagatccagcgtgagac

SEQ ID NO: 421980 - DNA, 25 bp, Rattus norvegicus
ggaccaattcagcacccgggagaca

SEQ ID NO: 421981 - DNA, 25 bp, Rattus norvegicus
ggaccaattcaggacccgggagaca

SEQ ID NO: 421982 - DNA, 25 bp, Rattus norvegicus
ggaccaattcgcagcagcatataca

SEQ ID NO: 421983 - DNA, 25 bp, Rattus norvegicus
ggaccaattcgctgcagcatataca

SEQ ID NO: 421984 - DNA, 25 bp, Rattus norvegicus
ggaccaatttttccctgttgtttgt

SEQ ID NO: 421985 - DNA, 25 bp, Rattus norvegicus
ggaccaatttttgcctgttgtttgt

SEQ ID NO: 421986 - DNA, 25 bp, Rattus norvegicus
ggaccacaaagaaatataacagcga

SEQ ID NO: 421987 - DNA, 25 bp, Rattus norvegicus
ggaccacaaagatatataacagcga

SEQ ID NO: 421988 - DNA, 25 bp, Rattus norvegicus
ggaccacaaagtatgggttccacac

SEQ ID NO: 421989 - DNA, 25 bp, Rattus norvegicus
ggaccacaaagtttgggttccacac

SEQ ID NO: 421990 - DNA, 25 bp, Rattus norvegicus
ggaccacaatggaaaagttaggaga

SEQ ID NO: 421991 - DNA, 25 bp, Rattus norvegicus
ggaccacaatggtaaagttaggaga

SEQ ID NO: 421992 - DNA, 25 bp, Rattus norvegicus
ggaccacacaggagcagatgcccat

SEQ ID NO: 421993 - DNA, 25 bp, Rattus norvegicus
ggaccacacaggtgcagatgcccat

SEQ ID NO: 421994 - DNA, 25 bp, Rattus norvegicus
ggaccacaccttcgcttacgattat

SEQ ID NO: 421995 - DNA, 25 bp, Rattus norvegicus
ggaccacaccttggcttacgattat

SEQ ID NO: 421996 - DNA, 25 bp, Rattus norvegicus
ggaccacactaaaagcacagattca

SEQ ID NO: 421997 - DNA, 25 bp, Rattus norvegicus
ggaccacactaatagcacagattca

SEQ ID NO: 421998 - DNA, 25 bp, Rattus norvegicus
ggaccacagaacaagcagccagagt

SEQ ID NO: 421999 - DNA, 25 bp, Rattus norvegicus
ggaccacagaactagcagccagagt

SEQ ID NO: 422000 - DNA, 25 bp, Rattus norvegicus
ggaccacagatcagttgttcctctt

SEQ ID NO: 422001 - DNA, 25 bp, Rattus norvegicus
ggaccacagatctgttgttcctctt

SEQ ID NO: 422002 - DNA, 25 bp, Rattus norvegicus
ggaccacagcagatgtttgctccta

SEQ ID NO: 422003 - DNA, 25 bp, Rattus norvegicus
ggaccacagcagttgtttgctccta

SEQ ID NO: 422004 - DNA, 25 bp, Rattus norvegicus
ggaccacagcgcactgttgaaggtt

SEQ ID NO: 422005 - DNA, 25 bp, Rattus norvegicus
ggaccacagcgctctgttgaaggtt

SEQ ID NO: 422006 - DNA, 25 bp, Rattus norvegicus
ggaccacagcttacaccatgagaat

SEQ ID NO: 422007 - DNA, 25 bp, Rattus norvegicus
ggaccacagctttcaccatgagaat

SEQ ID NO: 422008 - DNA, 25 bp, Rattus norvegicus
ggaccacagggcatcatccttgatg

SEQ ID NO: 422009 - DNA, 25 bp, Rattus norvegicus
ggaccacagggcttcatccttgatg

SEQ ID NO: 422010 - DNA, 25 bp, Rattus norvegicus
ggaccacagtgaactgcagggcaga

SEQ ID NO: 422011 - DNA, 25 bp, Rattus norvegicus
ggaccacagtgatctgcagggcaga

SEQ ID NO: 422012 - DNA, 25 bp, Rattus norvegicus
ggaccacagtggctacgccttagag

SEQ ID NO: 422013 - DNA, 25 bp, Rattus norvegicus
ggaccacagtggctggaccaatcca

SEQ ID NO: 422014 - DNA, 25 bp, Rattus norvegicus
ggaccacagtgggtacgccttagag

SEQ ID NO: 422015 - DNA, 25 bp, Rattus norvegicus
ggaccacagtgggtggaccaatcca

SEQ ID NO: 422016 - DNA, 25 bp, Rattus norvegicus
ggaccacagtttccaagtaactcgc

SEQ ID NO: 422017 - DNA, 25 bp, Rattus norvegicus
ggaccacagtttgcaagtaactcgc

SEQ ID NO: 422018 - DNA, 25 bp, Rattus norvegicus
ggaccacatccacagtaccacaggg

SEQ ID NO: 422019 - DNA, 25 bp, Rattus norvegicus
ggaccacatccagagtaccacaggg

SEQ ID NO: 422020 - DNA, 25 bp, Rattus norvegicus
ggaccacattagacttctctactgt

SEQ ID NO: 422021 - DNA, 25 bp, Rattus norvegicus
ggaccacattagtcttctctactgt

SEQ ID NO: 422022 - DNA, 25 bp, Rattus norvegicus
ggaccacattcacccataagacaac

SEQ ID NO: 422023 - DNA, 25 bp, Rattus norvegicus
ggaccacattcagccataagacaac

SEQ ID NO: 422024 - DNA, 25 bp, Rattus norvegicus
ggaccaccaccaacctataaagatg

SEQ ID NO: 422025 - DNA, 25 bp, Rattus norvegicus
ggaccaccaccatcctataaagatg

SEQ ID NO: 422026 - DNA, 25 bp, Rattus norvegicus
ggaccacccatgagtatagttgtaa

SEQ ID NO: 422027 - DNA, 25 bp, Rattus norvegicus
ggaccacccatgtgtatagttgtaa

SEQ ID NO: 422028 - DNA, 25 bp, Rattus norvegicus
ggaccaccctgtactatctttgtaa

SEQ ID NO: 422029 - DNA, 25 bp, Rattus norvegicus
ggaccaccctgttctatctttgtaa

SEQ ID NO: 422030 - DNA, 25 bp, Rattus norvegicus
ggaccaccgcggacactcggaggaa

SEQ ID NO: 422031 - DNA, 25 bp, Rattus norvegicus
ggaccaccgcggtcactcggaggaa

SEQ ID NO: 422032 - DNA, 25 bp, Rattus norvegicus
ggaccacctgacaaatgcaatcgct

SEQ ID NO: 422033 - DNA, 25 bp, Rattus norvegicus
ggaccacctgactaatgcaatcgct

SEQ ID NO: 422034 - DNA, 25 bp, Rattus norvegicus
ggaccaccttctctacctatttata

SEQ ID NO: 422035 - DNA, 25 bp, Rattus norvegicus
ggaccaccttctgtacctatttata

SEQ ID NO: 422036 - DNA, 25 bp, Rattus norvegicus
ggaccacgaagccacagctggaact

SEQ ID NO: 422037 - DNA, 25 bp, Rattus norvegicus
ggaccacgaagcgacagctggaact

SEQ ID NO: 422038 - DNA, 25 bp, Rattus norvegicus
ggaccacgagggagaccagcagacc

SEQ ID NO: 422039 - DNA, 25 bp, Rattus norvegicus
ggaccacgagggtgaccagcagacc

SEQ ID NO: 422040 - DNA, 25 bp, Rattus norvegicus
ggaccacgaggtattgttcctggct

SEQ ID NO: 422041 - DNA, 25 bp, Rattus norvegicus
ggaccacgaggttttgttcctggct

SEQ ID NO: 422042 - DNA, 25 bp, Rattus norvegicus
ggaccacgccataaaatatttgctt

SEQ ID NO: 422043 - DNA, 25 bp, Rattus norvegicus
ggaccacgccattaaatatttgctt

SEQ ID NO: 422044 - DNA, 25 bp, Rattus norvegicus
ggaccacgcccgaatgaagaccgtg

SEQ ID NO: 422045 - DNA, 25 bp, Rattus norvegicus
ggaccacgcccgtatgaagaccgtg

SEQ ID NO: 422046 - DNA, 25 bp, Rattus norvegicus
ggaccacgcgtccatccagatgaat

SEQ ID NO: 422047 - DNA, 25 bp, Rattus norvegicus
ggaccacgcgtcgatccagatgaat

SEQ ID NO: 422048 - DNA, 25 bp, Rattus norvegicus
ggaccacgctctcaacgatatgact

SEQ ID NO: 422049 - DNA, 25 bp, Rattus norvegicus
ggaccacgctctgaacgatatgact

SEQ ID NO: 422050 - DNA, 25 bp, Rattus norvegicus
ggaccacgctgtacctgagacaagg

SEQ ID NO: 422051 - DNA, 25 bp, Rattus norvegicus
ggaccacgctgttcctgagacaagg

SEQ ID NO: 422052 - DNA, 25 bp, Rattus norvegicus
ggaccacggctgctactgcacttat

SEQ ID NO: 422053 - DNA, 25 bp, Rattus norvegicus
ggaccacggctggtactgcacttat

SEQ ID NO: 422054 - DNA, 25 bp, Rattus norvegicus
ggaccacgggacatccagagttctg

SEQ ID NO: 422055 - DNA, 25 bp, Rattus norvegicus
ggaccacgggacttccagagttctg

SEQ ID NO: 422056 - DNA, 25 bp, Rattus norvegicus
ggaccacgtctcctaaatggctaca

SEQ ID NO: 422057 - DNA, 25 bp, Rattus norvegicus
ggaccacgtctcgtaaatggctaca

SEQ ID NO: 422058 - DNA, 25 bp, Rattus norvegicus
ggaccacgtgcacttttggacacat

SEQ ID NO: 422059 - DNA, 25 bp, Rattus norvegicus
ggaccacgtgcagttttggacacat

SEQ ID NO: 422060 - DNA, 25 bp, Rattus norvegicus
ggaccactaaacaatctattgcaaa

SEQ ID NO: 422061 - DNA, 25 bp, Rattus norvegicus
ggaccactaaactatctattgcaaa

SEQ ID NO: 422062 - DNA, 25 bp, Rattus norvegicus
ggaccactcacactcatgatgcgag

SEQ ID NO: 422063 - DNA, 25 bp, Rattus norvegicus
ggaccactcacagtcatgatgcgag

SEQ ID NO: 422064 - DNA, 25 bp, Rattus norvegicus
ggaccactccacaatgtgagcattt

SEQ ID NO: 422065 - DNA, 25 bp, Rattus norvegicus
ggaccactccactatgtgagcattt

SEQ ID NO: 422066 - DNA, 25 bp, Rattus norvegicus
ggaccactctgaagctgttctctaa

SEQ ID NO: 422067 - DNA, 25 bp, Rattus norvegicus
ggaccactctgatgctgttctctaa

SEQ ID NO: 422068 - DNA, 25 bp, Rattus norvegicus
ggaccactgaatagccaggcatcta

SEQ ID NO: 422069 - DNA, 25 bp, Rattus norvegicus
ggaccactgaattgccaggcatcta

SEQ ID NO: 422070 - DNA, 25 bp, Rattus norvegicus
ggaccactgcagataactctcgttg

SEQ ID NO: 422071 - DNA, 25 bp, Rattus norvegicus
ggaccactgcagttaactctcgttg

SEQ ID NO: 422072 - DNA, 25 bp, Rattus norvegicus
ggaccacttcaccaagttcacactg

SEQ ID NO: 422073 - DNA, 25 bp, Rattus norvegicus
ggaccacttcacgaagttcacactg

SEQ ID NO: 422074 - DNA, 25 bp, Rattus norvegicus
ggaccacttcgccaagctgaagcaa

SEQ ID NO: 422075 - DNA, 25 bp, Rattus norvegicus
ggaccacttcgcgaagctgaagcaa

SEQ ID NO: 422076 - DNA, 25 bp, Rattus norvegicus
ggaccacttgtactatttgccttgg

SEQ ID NO: 422077 - DNA, 25 bp, Rattus norvegicus
ggaccacttgtagtatttgccttgg

SEQ ID NO: 422078 - DNA, 25 bp, Rattus norvegicus
ggaccacttttcaaactgtgctttc

SEQ ID NO: 422079 - DNA, 25 bp, Rattus norvegicus
ggaccacttttctaactgtgctttc

SEQ ID NO: 422080 - DNA, 25 bp, Rattus norvegicus
ggaccagaaacaaggtgctctccaa

SEQ ID NO: 422081 - DNA, 25 bp, Rattus norvegicus
ggaccagaaacatggtgctctccaa

SEQ ID NO: 422082 - DNA, 25 bp, Rattus norvegicus
ggaccagaaatcaagccagctcagc

SEQ ID NO: 422083 - DNA, 25 bp, Rattus norvegicus
ggaccagaaatctagccagctcagc

SEQ ID NO: 422084 - DNA, 25 bp, Rattus norvegicus
ggaccagaaatgcacctcatcgcag

SEQ ID NO: 422085 - DNA, 25 bp, Rattus norvegicus
ggaccagaaatggacctcatcgcag

SEQ ID NO: 422086 - DNA, 25 bp, Rattus norvegicus
ggaccagaacctcaagtgtctgagt

SEQ ID NO: 422087 - DNA, 25 bp, Rattus norvegicus
ggaccagaacctgaagtgtctgagt

SEQ ID NO: 422088 - DNA, 25 bp, Rattus norvegicus
ggaccagaacttatcttttccttgg

SEQ ID NO: 422089 - DNA, 25 bp, Rattus norvegicus
ggaccagaacttttcttttccttgg

SEQ ID NO: 422090 - DNA, 25 bp, Rattus norvegicus
ggaccagaagacacacagacctatg

SEQ ID NO: 422091 - DNA, 25 bp, Rattus norvegicus
ggaccagaagactcacagacctatg

SEQ ID NO: 422092 - DNA, 25 bp, Rattus norvegicus
ggaccagaagttcagctagcctcta

SEQ ID NO: 422093 - DNA, 25 bp, Rattus norvegicus
ggaccagaagttgagctagcctcta

SEQ ID NO: 422094 - DNA, 25 bp, Rattus norvegicus
ggaccagaatccacaagtttgtctc

SEQ ID NO: 422095 - DNA, 25 bp, Rattus norvegicus
ggaccagaatcctcaagtttgtctc

SEQ ID NO: 422096 - DNA, 25 bp, Rattus norvegicus
ggaccagacagtagtgcctatctta

SEQ ID NO: 422097 - DNA, 25 bp, Rattus norvegicus
ggaccagacagttgtgcctatctta

SEQ ID NO: 422098 - DNA, 25 bp, Rattus norvegicus
ggaccagaccagatttcaagcggag

SEQ ID NO: 422099 - DNA, 25 bp, Rattus norvegicus
ggaccagaccagttttcaagcggag

SEQ ID NO: 422100 - DNA, 25 bp, Rattus norvegicus
ggaccagacccactaagtcattagc

SEQ ID NO: 422101 - DNA, 25 bp, Rattus norvegicus
ggaccagacccagtaagtcattagc

SEQ ID NO: 422102 - DNA, 25 bp, Rattus norvegicus
ggaccagaccgaacaggatccttgt

SEQ ID NO: 422103 - DNA, 25 bp, Rattus norvegicus
ggaccagaccgatcaggatccttgt

SEQ ID NO: 422104 - DNA, 25 bp, Rattus norvegicus
ggaccagacgggacagtcattccta

SEQ ID NO: 422105 - DNA, 25 bp, Rattus norvegicus
ggaccagacgggtcagtcattccta

SEQ ID NO: 422106 - DNA, 25 bp, Rattus norvegicus
ggaccagactgccacgtgtcagcaa

SEQ ID NO: 422107 - DNA, 25 bp, Rattus norvegicus
ggaccagactgcgacgtgtcagcaa

SEQ ID NO: 422108 - DNA, 25 bp, Rattus norvegicus
ggaccagagcaacacctacaacaat

SEQ ID NO: 422109 - DNA, 25 bp, Rattus norvegicus
ggaccagagcaagacctacaacaat

SEQ ID NO: 422110 - DNA, 25 bp, Rattus norvegicus
ggaccagagcacagcagagccacag

SEQ ID NO: 422111 - DNA, 25 bp, Rattus norvegicus
ggaccagagcactgcagagccacag

SEQ ID NO: 422112 - DNA, 25 bp, Rattus norvegicus
ggaccagagctacgatgccacgctt

SEQ ID NO: 422113 - DNA, 25 bp, Rattus norvegicus
ggaccagagctaggatgccacgctt

SEQ ID NO: 422114 - DNA, 25 bp, Rattus norvegicus
ggaccagaggaaagtcatctttaca

SEQ ID NO: 422115 - DNA, 25 bp, Rattus norvegicus
ggaccagaggaatgtcatctttaca

SEQ ID NO: 422116 - DNA, 25 bp, Rattus norvegicus
ggaccagagtttctttcctacgttg

SEQ ID NO: 422117 - DNA, 25 bp, Rattus norvegicus
ggaccagagtttgtttcctacgttg

SEQ ID NO: 422118 - DNA, 25 bp, Rattus norvegicus
ggaccagatcctaatgttggaccca

SEQ ID NO: 422119 - DNA, 25 bp, Rattus norvegicus
ggaccagatccttatgttggaccca

SEQ ID NO: 422120 - DNA, 25 bp, Rattus norvegicus
ggaccagatgaaagtagcccacaca

SEQ ID NO: 422121 - DNA, 25 bp, Rattus norvegicus
ggaccagatgaatgtagcccacaca

SEQ ID NO: 422122 - DNA, 25 bp, Rattus norvegicus
ggaccagatgccagccatgtatgga

SEQ ID NO: 422123 - DNA, 25 bp, Rattus norvegicus
ggaccagatgcctgccatgtatgga

SEQ ID NO: 422124 - DNA, 25 bp, Rattus norvegicus
ggaccagatggaagacctctatgaa

SEQ ID NO: 422125 - DNA, 25 bp, Rattus norvegicus
ggaccagatggatgacctctatgaa

SEQ ID NO: 422126 - DNA, 25 bp, Rattus norvegicus
ggaccagattcacaaagctcatatt

SEQ ID NO: 422127 - DNA, 25 bp, Rattus norvegicus
ggaccagattcagaaagctcatatt

SEQ ID NO: 422128 - DNA, 25 bp, Rattus norvegicus
ggaccagcaactagactcctcaaag

SEQ ID NO: 422129 - DNA, 25 bp, Rattus norvegicus
ggaccagcaactatgcagtcatcat

SEQ ID NO: 422130 - DNA, 25 bp, Rattus norvegicus
ggaccagcaacttgactcctcaaag

SEQ ID NO: 422131 - DNA, 25 bp, Rattus norvegicus
ggaccagcaactttgcagtcatcat

SEQ ID NO: 422132 - DNA, 25 bp, Rattus norvegicus
ggaccagcaagacttctccatagct

SEQ ID NO: 422133 - DNA, 25 bp, Rattus norvegicus
ggaccagcaagagttctccatagct

SEQ ID NO: 422134 - DNA, 25 bp, Rattus norvegicus
ggaccagcacagcactaacagttct

SEQ ID NO: 422135 - DNA, 25 bp, Rattus norvegicus
ggaccagcacaggactaacagttct

SEQ ID NO: 422136 - DNA, 25 bp, Rattus norvegicus
ggaccagcaccaaaaggtagtctgt

SEQ ID NO: 422137 - DNA, 25 bp, Rattus norvegicus
ggaccagcaccataaggtagtctgt

SEQ ID NO: 422138 - DNA, 25 bp, Rattus norvegicus
ggaccagcagcacttattcaccgag

SEQ ID NO: 422139 - DNA, 25 bp, Rattus norvegicus
ggaccagcagcagttattcaccgag

SEQ ID NO: 422140 - DNA, 25 bp, Rattus norvegicus
ggaccagcagttaccgcagtgaccg

SEQ ID NO: 422141 - DNA, 25 bp, Rattus norvegicus
ggaccagcagttacttctgagccca

SEQ ID NO: 422142 - DNA, 25 bp, Rattus norvegicus
ggaccagcagtttccgcagtgaccg

SEQ ID NO: 422143 - DNA, 25 bp, Rattus norvegicus
ggaccagcagtttcttctgagccca

SEQ ID NO: 422144 - DNA, 25 bp, Rattus norvegicus
ggaccagcatgtaggaatccagcgt

SEQ ID NO: 422145 - DNA, 25 bp, Rattus norvegicus
ggaccagcatgtatgggagcacaac

SEQ ID NO: 422146 - DNA, 25 bp, Rattus norvegicus
ggaccagcatgttggaatccagcgt

SEQ ID NO: 422147 - DNA, 25 bp, Rattus norvegicus
ggaccagcatgtttgggagcacaac

SEQ ID NO: 422148 - DNA, 25 bp, Rattus norvegicus
ggaccagccatcaggaaagagcgat

SEQ ID NO: 422149 - DNA, 25 bp, Rattus norvegicus
ggaccagccatctggaaagagcgat

SEQ ID NO: 422150 - DNA, 25 bp, Rattus norvegicus
ggaccagcccatagaggagccgaga

SEQ ID NO: 422151 - DNA, 25 bp, Rattus norvegicus
ggaccagcccattgaggagccgaga

SEQ ID NO: 422152 - DNA, 25 bp, Rattus norvegicus
ggaccagccttgaaggccgttataa

SEQ ID NO: 422153 - DNA, 25 bp, Rattus norvegicus
ggaccagccttgtaggccgttataa

SEQ ID NO: 422154 - DNA, 25 bp, Rattus norvegicus
ggaccagctagaagcttgagcattt

SEQ ID NO: 422155 - DNA, 25 bp, Rattus norvegicus
ggaccagctagatgcttgagcattt

SEQ ID NO: 422156 - DNA, 25 bp, Rattus norvegicus
ggaccagctctacttcatctggaga

SEQ ID NO: 422157 - DNA, 25 bp, Rattus norvegicus
ggaccagctctagttcatctggaga

SEQ ID NO: 422158 - DNA, 25 bp, Rattus norvegicus
ggaccagctggcaactgaggacctt

SEQ ID NO: 422159 - DNA, 25 bp, Rattus norvegicus
ggaccagctggctactgaggacctt

SEQ ID NO: 422160 - DNA, 25 bp, Rattus norvegicus
ggaccagctgttctacgtgtagtat

SEQ ID NO: 422161 - DNA, 25 bp, Rattus norvegicus
ggaccagctgttgtacgtgtagtat

SEQ ID NO: 422162 - DNA, 25 bp, Rattus norvegicus
ggaccagcttgcatggctcagaaaa

SEQ ID NO: 422163 - DNA, 25 bp, Rattus norvegicus
ggaccagcttgcttggctcagaaaa

SEQ ID NO: 422164 - DNA, 25 bp, Rattus norvegicus
ggaccaggaaacaggaggctctcct

SEQ ID NO: 422165 - DNA, 25 bp, Rattus norvegicus
ggaccaggaaactggaggctctcct

SEQ ID NO: 422166 - DNA, 25 bp, Rattus norvegicus
ggaccaggaaggcttcttctacttc

SEQ ID NO: 422167 - DNA, 25 bp, Rattus norvegicus
ggaccaggaagggttcttctacttc

SEQ ID NO: 422168 - DNA, 25 bp, Rattus norvegicus
ggaccaggagaaaacaacacagagc

SEQ ID NO: 422169 - DNA, 25 bp, Rattus norvegicus
ggaccaggagaatacaacacagagc

SEQ ID NO: 422170 - DNA, 25 bp, Rattus norvegicus
ggaccaggaggtcttcttcagaagc

SEQ ID NO: 422171 - DNA, 25 bp, Rattus norvegicus
ggaccaggaggtgttcttcagaagc

SEQ ID NO: 422172 - DNA, 25 bp, Rattus norvegicus
ggaccaggcaacaggagcaactcct

SEQ ID NO: 422173 - DNA, 25 bp, Rattus norvegicus
ggaccaggcaacatctgcagacctt

SEQ ID NO: 422174 - DNA, 25 bp, Rattus norvegicus
ggaccaggcaactggagcaactcct

SEQ ID NO: 422175 - DNA, 25 bp, Rattus norvegicus
ggaccaggcaacttctgcagacctt

SEQ ID NO: 422176 - DNA, 25 bp, Rattus norvegicus
ggaccaggcactaagttcagaactt

SEQ ID NO: 422177 - DNA, 25 bp, Rattus norvegicus
ggaccaggcacttagttcagaactt

SEQ ID NO: 422178 - DNA, 25 bp, Rattus norvegicus
ggaccaggcccactaacatcttttg

SEQ ID NO: 422179 - DNA, 25 bp, Rattus norvegicus
ggaccaggcccagtaacatcttttg

SEQ ID NO: 422180 - DNA, 25 bp, Rattus norvegicus
ggaccaggccttaaagaccattcga

SEQ ID NO: 422181 - DNA, 25 bp, Rattus norvegicus
ggaccaggcctttaagaccattcga

SEQ ID NO: 422182 - DNA, 25 bp, Rattus norvegicus
ggaccaggctctatctgggtatcat

SEQ ID NO: 422183 - DNA, 25 bp, Rattus norvegicus
ggaccaggctctttctgggtatcat

SEQ ID NO: 422184 - DNA, 25 bp, Rattus norvegicus
ggaccagggcagctcttattttgga

SEQ ID NO: 422185 - DNA, 25 bp, Rattus norvegicus
ggaccagggcaggtcttattttgga

SEQ ID NO: 422186 - DNA, 25 bp, Rattus norvegicus
ggaccagggcgcaatgactgaccag

SEQ ID NO: 422187 - DNA, 25 bp, Rattus norvegicus
ggaccagggcgctatgactgaccag

SEQ ID NO: 422188 - DNA, 25 bp, Rattus norvegicus
ggaccaggtacaagcctctagatat

SEQ ID NO: 422189 - DNA, 25 bp, Rattus norvegicus
ggaccaggtacatgcctctagatat

SEQ ID NO: 422190 - DNA, 25 bp, Rattus norvegicus
ggaccaggtcacactaaccaggaga

SEQ ID NO: 422191 - DNA, 25 bp, Rattus norvegicus
ggaccaggtcactctaaccaggaga

SEQ ID NO: 422192 - DNA, 25 bp, Rattus norvegicus
ggaccaggtcagctacgtgagccaa

SEQ ID NO: 422193 - DNA, 25 bp, Rattus norvegicus
ggaccaggtcaggtacgtgagccaa

SEQ ID NO: 422194 - DNA, 25 bp, Rattus norvegicus
ggaccaggttgtatctgtctccatt

SEQ ID NO: 422195 - DNA, 25 bp, Rattus norvegicus
ggaccaggttgtttctgtctccatt

SEQ ID NO: 422196 - DNA, 25 bp, Rattus norvegicus
ggaccagtagcacacttcctgcgaa

SEQ ID NO: 422197 - DNA, 25 bp, Rattus norvegicus
ggaccagtagcagacttcctgcgaa

SEQ ID NO: 422198 - DNA, 25 bp, Rattus norvegicus
ggaccagtagttatgtctccacaaa

SEQ ID NO: 422199 - DNA, 25 bp, Rattus norvegicus
ggaccagtagttttgtctccacaaa

SEQ ID NO: 422200 - DNA, 25 bp, Rattus norvegicus
ggaccagtatgaagctccactttaa

SEQ ID NO: 422201 - DNA, 25 bp, Rattus norvegicus
ggaccagtatgatgctccactttaa

SEQ ID NO: 422202 - DNA, 25 bp, Rattus norvegicus
ggaccagtcacaacctgtcactgag

SEQ ID NO: 422203 - DNA, 25 bp, Rattus norvegicus
ggaccagtcacatcctgtcactgag

SEQ ID NO: 422204 - DNA, 25 bp, Rattus norvegicus
ggaccagtcacgatggctcataaat

SEQ ID NO: 422205 - DNA, 25 bp, Rattus norvegicus
ggaccagtcacgttggctcataaat

SEQ ID NO: 422206 - DNA, 25 bp, Rattus norvegicus
ggaccagtccatctctatgtgcata

SEQ ID NO: 422207 - DNA, 25 bp, Rattus norvegicus
ggaccagtccatgtctatgtgcata

SEQ ID NO: 422208 - DNA, 25 bp, Rattus norvegicus
ggaccagtgaacagttagcaacaat

SEQ ID NO: 422209 - DNA, 25 bp, Rattus norvegicus
ggaccagtgaactgttagcaacaat

SEQ ID NO: 422210 - DNA, 25 bp, Rattus norvegicus
ggaccagtgacaattccaacattgg

SEQ ID NO: 422211 - DNA, 25 bp, Rattus norvegicus
ggaccagtgacatttccaacattgg

SEQ ID NO: 422212 - DNA, 25 bp, Rattus norvegicus
ggaccagtgagacccgtgatttatg

SEQ ID NO: 422213 - DNA, 25 bp, Rattus norvegicus
ggaccagtgagagccgtgatttatg

SEQ ID NO: 422214 - DNA, 25 bp, Rattus norvegicus
ggaccagtgagtccctcgcaagcct

SEQ ID NO: 422215 - DNA, 25 bp, Rattus norvegicus
ggaccagtgagtgcctcgcaagcct

SEQ ID NO: 422216 - DNA, 25 bp, Rattus norvegicus
ggaccagtggacagctggctgaaca

SEQ ID NO: 422217 - DNA, 25 bp, Rattus norvegicus
ggaccagtggactgctggctgaaca

SEQ ID NO: 422218 - DNA, 25 bp, Rattus norvegicus
ggaccagtggatctgatcaaaatac

SEQ ID NO: 422219 - DNA, 25 bp, Rattus norvegicus
ggaccagtggatgtgatcaaaatac

SEQ ID NO: 422220 - DNA, 25 bp, Rattus norvegicus
ggaccagtgtgaatcttcccaagca

SEQ ID NO: 422221 - DNA, 25 bp, Rattus norvegicus
ggaccagtgtgattcttcccaagca

SEQ ID NO: 422222 - DNA, 25 bp, Rattus norvegicus
ggaccagtgtttcacttgaccacca

SEQ ID NO: 422223 - DNA, 25 bp, Rattus norvegicus
ggaccagtgtttgacttgaccacca

SEQ ID NO: 422224 - DNA, 25 bp, Rattus norvegicus
ggaccagttccacgccatggcaaag

SEQ ID NO: 422225 - DNA, 25 bp, Rattus norvegicus
ggaccagttccaggccatggcaaag

SEQ ID NO: 422226 - DNA, 25 bp, Rattus norvegicus
ggaccagttctaaggtactcggcct

SEQ ID NO: 422227 - DNA, 25 bp, Rattus norvegicus
ggaccagttctatggtactcggcct

SEQ ID NO: 422228 - DNA, 25 bp, Rattus norvegicus
ggaccagttctcaagccaggaggtt

SEQ ID NO: 422229 - DNA, 25 bp, Rattus norvegicus
ggaccagttctctagccaggaggtt

SEQ ID NO: 422230 - DNA, 25 bp, Rattus norvegicus
ggaccagtttcaaatttcttgtatc

SEQ ID NO: 422231 - DNA, 25 bp, Rattus norvegicus
ggaccagtttcatatttcttgtatc

SEQ ID NO: 422232 - DNA, 25 bp, Rattus norvegicus
ggaccagtttctagcaacacacaat

SEQ ID NO: 422233 - DNA, 25 bp, Rattus norvegicus
ggaccagtttcttgcaacacacaat

SEQ ID NO: 422234 - DNA, 25 bp, Rattus norvegicus
ggaccagttttaaaagtaccagatt

SEQ ID NO: 422235 - DNA, 25 bp, Rattus norvegicus
ggaccagttttataagtaccagatt

SEQ ID NO: 422236 - DNA, 25 bp, Rattus norvegicus
ggaccatagaacctgcttcttacct

SEQ ID NO: 422237 - DNA, 25 bp, Rattus norvegicus
ggaccatagaacgtgcttcttacct

SEQ ID NO: 422238 - DNA, 25 bp, Rattus norvegicus
ggaccatagattcttgcccactgaa

SEQ ID NO: 422239 - DNA, 25 bp, Rattus norvegicus
ggaccatagattgttgcccactgaa

SEQ ID NO: 422240 - DNA, 25 bp, Rattus norvegicus
ggaccatatgacaagggcactgtaa

SEQ ID NO: 422241 - DNA, 25 bp, Rattus norvegicus
ggaccatatgactagggcactgtaa

SEQ ID NO: 422242 - DNA, 25 bp, Rattus norvegicus
ggaccatatggtcactctgtatctc

SEQ ID NO: 422243 - DNA, 25 bp, Rattus norvegicus
ggaccatatggtgactctgtatctc

SEQ ID NO: 422244 - DNA, 25 bp, Rattus norvegicus
ggaccatcaagccaccgtcgctatt

SEQ ID NO: 422245 - DNA, 25 bp, Rattus norvegicus
ggaccatcaagcgaccgtcgctatt

SEQ ID NO: 422246 - DNA, 25 bp, Rattus norvegicus
ggaccatcagacatccttctgcaat

SEQ ID NO: 422247 - DNA, 25 bp, Rattus norvegicus
ggaccatcagacttccttctgcaat

SEQ ID NO: 422248 - DNA, 25 bp, Rattus norvegicus
ggaccatcagggaacacaatcactt

SEQ ID NO: 422249 - DNA, 25 bp, Rattus norvegicus
ggaccatcagggtacacaatcactt

SEQ ID NO: 422250 - DNA, 25 bp, Rattus norvegicus
ggaccatcaggtccaaactcatgga

SEQ ID NO: 422251 - DNA, 25 bp, Rattus norvegicus
ggaccatcaggtgcaaactcatgga

SEQ ID NO: 422252 - DNA, 25 bp, Rattus norvegicus
ggaccatcccagctgttgtaaatac

SEQ ID NO: 422253 - DNA, 25 bp, Rattus norvegicus
ggaccatcccaggtgttgtaaatac

SEQ ID NO: 422254 - DNA, 25 bp, Rattus norvegicus
ggaccatcccgtcttgtggtgaaat

SEQ ID NO: 422255 - DNA, 25 bp, Rattus norvegicus
ggaccatcccgtgttgtggtgaaat

SEQ ID NO: 422256 - DNA, 25 bp, Rattus norvegicus
ggaccatccgagacaagttcgcccg

SEQ ID NO: 422257 - DNA, 25 bp, Rattus norvegicus
ggaccatccgagtcaagttcgcccg

SEQ ID NO: 422258 - DNA, 25 bp, Rattus norvegicus
ggaccatcctagaacattctctgtc

SEQ ID NO: 422259 - DNA, 25 bp, Rattus norvegicus
ggaccatcctagtacattctctgtc

SEQ ID NO: 422260 - DNA, 25 bp, Rattus norvegicus
ggaccatcggatccattcagaccat

SEQ ID NO: 422261 - DNA, 25 bp, Rattus norvegicus
ggaccatcggatgcattcagaccat

SEQ ID NO: 422262 - DNA, 25 bp, Rattus norvegicus
ggaccatcggctaatgttctgactt

SEQ ID NO: 422263 - DNA, 25 bp, Rattus norvegicus
ggaccatcggcttatgttctgactt

SEQ ID NO: 422264 - DNA, 25 bp, Rattus norvegicus
ggaccatctctaccgggacgaggta

SEQ ID NO: 422265 - DNA, 25 bp, Rattus norvegicus
ggaccatctctagcgggacgaggta

SEQ ID NO: 422266 - DNA, 25 bp, Rattus norvegicus
ggaccatctctcacaataggcacaa

SEQ ID NO: 422267 - DNA, 25 bp, Rattus norvegicus
ggaccatctctctcaataggcacaa

SEQ ID NO: 422268 - DNA, 25 bp, Rattus norvegicus
ggaccatctggacctacactcaggt

SEQ ID NO: 422269 - DNA, 25 bp, Rattus norvegicus
ggaccatctggagctacactcaggt

SEQ ID NO: 422270 - DNA, 25 bp, Rattus norvegicus
ggaccatcttacaacctctaggaag

SEQ ID NO: 422271 - DNA, 25 bp, Rattus norvegicus
ggaccatcttactacctctaggaag

SEQ ID NO: 422272 - DNA, 25 bp, Rattus norvegicus
ggaccatcttcaaactgctggagcc

SEQ ID NO: 422273 - DNA, 25 bp, Rattus norvegicus
ggaccatcttcatactgctggagcc

SEQ ID NO: 422274 - DNA, 25 bp, Rattus norvegicus
ggaccatcttcgacagtgacctcat

SEQ ID NO: 422275 - DNA, 25 bp, Rattus norvegicus
ggaccatcttcgtcagtgacctcat

SEQ ID NO: 422276 - DNA, 25 bp, Rattus norvegicus
ggaccatctttaccgtattttcagt

SEQ ID NO: 422277 - DNA, 25 bp, Rattus norvegicus
ggaccatctttagcgtattttcagt

SEQ ID NO: 422278 - DNA, 25 bp, Rattus norvegicus
ggaccatgaccaatgactctgtgct

SEQ ID NO: 422279 - DNA, 25 bp, Rattus norvegicus
ggaccatgaccattgactctgtgct

SEQ ID NO: 422280 - DNA, 25 bp, Rattus norvegicus
ggaccatgaggcagtctgcagaaca

SEQ ID NO: 422281 - DNA, 25 bp, Rattus norvegicus
ggaccatgaggctgtctgcagaaca

SEQ ID NO: 422282 - DNA, 25 bp, Rattus norvegicus
ggaccatgaggtcaagaccctgcag

SEQ ID NO: 422283 - DNA, 25 bp, Rattus norvegicus
ggaccatgaggtgaagaccctgcag

SEQ ID NO: 422284 - DNA, 25 bp, Rattus norvegicus
ggaccatgatccctgctgttggcaa

SEQ ID NO: 422285 - DNA, 25 bp, Rattus norvegicus
ggaccatgatccgtgctgttggcaa

SEQ ID NO: 422286 - DNA, 25 bp, Rattus norvegicus
ggaccatgatggacttttctatcac

SEQ ID NO: 422287 - DNA, 25 bp, Rattus norvegicus
ggaccatgatggtcttttctatcac

SEQ ID NO: 422288 - DNA, 25 bp, Rattus norvegicus
ggaccatgcaaaagacctgattacc

SEQ ID NO: 422289 - DNA, 25 bp, Rattus norvegicus
ggaccatgcaaatgacctgattacc

SEQ ID NO: 422290 - DNA, 25 bp, Rattus norvegicus
ggaccatgcaggcattttatctcaa

SEQ ID NO: 422291 - DNA, 25 bp, Rattus norvegicus
ggaccatgcagggattttatctcaa

SEQ ID NO: 422292 - DNA, 25 bp, Rattus norvegicus
ggaccatgctacaggaatcgctgcg

SEQ ID NO: 422293 - DNA, 25 bp, Rattus norvegicus
ggaccatgctactggaatcgctgcg

SEQ ID NO: 422294 - DNA, 25 bp, Rattus norvegicus
ggaccatggaatatggagtaaccta

SEQ ID NO: 422295 - DNA, 25 bp, Rattus norvegicus
ggaccatggaatttggagtaaccta

SEQ ID NO: 422296 - DNA, 25 bp, Rattus norvegicus
ggaccatgtatcaggagaaaacacc

SEQ ID NO: 422297 - DNA, 25 bp, Rattus norvegicus
ggaccatgtatctggagaaaacacc

SEQ ID NO: 422298 - DNA, 25 bp, Rattus norvegicus
ggaccatgtcagaggagagcgcatc

SEQ ID NO: 422299 - DNA, 25 bp, Rattus norvegicus
ggaccatgtcagtggagagcgcatc

SEQ ID NO: 422300 - DNA, 25 bp, Rattus norvegicus
ggaccatgtgtcctgtacttaccga

SEQ ID NO: 422301 - DNA, 25 bp, Rattus norvegicus
ggaccatgtgtcgtgtacttaccga

SEQ ID NO: 422302 - DNA, 25 bp, Rattus norvegicus
ggaccatgtgtgactgtcagtgcct

SEQ ID NO: 422303 - DNA, 25 bp, Rattus norvegicus
ggaccatgtgtgtctgtcagtgcct

SEQ ID NO: 422304 - DNA, 25 bp, Rattus norvegicus
ggaccattaaccacctctatttatt

SEQ ID NO: 422305 - DNA, 25 bp, Rattus norvegicus
ggaccattaacctcctctatttatt

SEQ ID NO: 422306 - DNA, 25 bp, Rattus norvegicus
ggaccattaaggactctggatgtct

SEQ ID NO: 422307 - DNA, 25 bp, Rattus norvegicus
ggaccattaaggtctctggatgtct

SEQ ID NO: 422308 - DNA, 25 bp, Rattus norvegicus
ggaccattacagaagctcgtttaca

SEQ ID NO: 422309 - DNA, 25 bp, Rattus norvegicus
ggaccattacagtagctcgtttaca

SEQ ID NO: 422310 - DNA, 25 bp, Rattus norvegicus
ggaccattacatatgaccgcacagt

SEQ ID NO: 422311 - DNA, 25 bp, Rattus norvegicus
ggaccattacatttgaccgcacagt

SEQ ID NO: 422312 - DNA, 25 bp, Rattus norvegicus
ggaccattagggatcccagaaagtt

SEQ ID NO: 422313 - DNA, 25 bp, Rattus norvegicus
ggaccattagggttcccagaaagtt

SEQ ID NO: 422314 - DNA, 25 bp, Rattus norvegicus
ggaccattcattccttggcattaat

SEQ ID NO: 422315 - DNA, 25 bp, Rattus norvegicus
ggaccattcattgcttggcattaat

SEQ ID NO: 422316 - DNA, 25 bp, Rattus norvegicus
ggaccattccacaactgatccaaag

SEQ ID NO: 422317 - DNA, 25 bp, Rattus norvegicus
ggaccattccactactgatccaaag

SEQ ID NO: 422318 - DNA, 25 bp, Rattus norvegicus
ggaccattccatattgtgtattgct

SEQ ID NO: 422319 - DNA, 25 bp, Rattus norvegicus
ggaccattccattttgtgtattgct

SEQ ID NO: 422320 - DNA, 25 bp, Rattus norvegicus
ggaccattgagaaagacgcccactg

SEQ ID NO: 422321 - DNA, 25 bp, Rattus norvegicus
ggaccattgagatagacgcccactg

SEQ ID NO: 422322 - DNA, 25 bp, Rattus norvegicus
ggaccattgggaatttgttcttgtt

SEQ ID NO: 422323 - DNA, 25 bp, Rattus norvegicus
ggaccattgggattttgttcttgtt

SEQ ID NO: 422324 - DNA, 25 bp, Rattus norvegicus
ggaccatttctacttggatcaccac

SEQ ID NO: 422325 - DNA, 25 bp, Rattus norvegicus
ggaccatttctagttggatcaccac

SEQ ID NO: 422326 - DNA, 25 bp, Rattus norvegicus
ggaccatttgttacatcccaaagct

SEQ ID NO: 422327 - DNA, 25 bp, Rattus norvegicus
ggaccatttgtttcatcccaaagct

SEQ ID NO: 422328 - DNA, 25 bp, Rattus norvegicus
ggacccaaaatgatctgagaccctt

SEQ ID NO: 422329 - DNA, 25 bp, Rattus norvegicus
ggacccaaaatgttctgagaccctt

SEQ ID NO: 422330 - DNA, 25 bp, Rattus norvegicus
ggacccaaactccagtcttacagaa

SEQ ID NO: 422331 - DNA, 25 bp, Rattus norvegicus
ggacccaaactcgagtcttacagaa

SEQ ID NO: 422332 - DNA, 25 bp, Rattus norvegicus
ggacccaaatacattctaaccgcag

SEQ ID NO: 422333 - DNA, 25 bp, Rattus norvegicus
ggacccaaatactttctaaccgcag

SEQ ID NO: 422334 - DNA, 25 bp, Rattus norvegicus
ggacccaaatccctcctggagagat

SEQ ID NO: 422335 - DNA, 25 bp, Rattus norvegicus
ggacccaaatccgtcctggagagat

SEQ ID NO: 422336 - DNA, 25 bp, Rattus norvegicus
ggacccaaatgaacgatacacctgc

SEQ ID NO: 422337 - DNA, 25 bp, Rattus norvegicus
ggacccaaatgatcgatacacctgc

SEQ ID NO: 422338 - DNA, 25 bp, Rattus norvegicus
ggacccaaatgccactttctgaaag

SEQ ID NO: 422339 - DNA, 25 bp, Rattus norvegicus
ggacccaaatgcgactttctgaaag

SEQ ID NO: 422340 - DNA, 25 bp, Rattus norvegicus
ggacccaacagaccttatgctggat

SEQ ID NO: 422341 - DNA, 25 bp, Rattus norvegicus
ggacccaacagagcttatgctggat

SEQ ID NO: 422342 - DNA, 25 bp, Rattus norvegicus
ggacccaacatgattacaggacctg

SEQ ID NO: 422343 - DNA, 25 bp, Rattus norvegicus
ggacccaacatgtttacaggacctg

SEQ ID NO: 422344 - DNA, 25 bp, Rattus norvegicus
ggacccaaccccatgaacaaatcat

SEQ ID NO: 422345 - DNA, 25 bp, Rattus norvegicus
ggacccaaccccttgaacaaatcat

SEQ ID NO: 422346 - DNA, 25 bp, Rattus norvegicus
ggacccaactctagtctgggctgga

SEQ ID NO: 422347 - DNA, 25 bp, Rattus norvegicus
ggacccaactcttgtctgggctgga

SEQ ID NO: 422348 - DNA, 25 bp, Rattus norvegicus
ggacccaactgtcagcagtccagga

SEQ ID NO: 422349 - DNA, 25 bp, Rattus norvegicus
ggacccaactgtgagcagtccagga

SEQ ID NO: 422350 - DNA, 25 bp, Rattus norvegicus
ggacccaaggaacctggtgcatgtt

SEQ ID NO: 422351 - DNA, 25 bp, Rattus norvegicus
ggacccaaggaagctggtgcatgtt

SEQ ID NO: 422352 - DNA, 25 bp, Rattus norvegicus
ggacccaaggctactggtatttctt

SEQ ID NO: 422353 - DNA, 25 bp, Rattus norvegicus
ggacccaaggcttctggtatttctt

SEQ ID NO: 422354 - DNA, 25 bp, Rattus norvegicus
ggacccaaggttagcccatttaatg

SEQ ID NO: 422355 - DNA, 25 bp, Rattus norvegicus
ggacccaaggtttgcccatttaatg

SEQ ID NO: 422356 - DNA, 25 bp, Rattus norvegicus
ggacccaagtatattcattttctga

SEQ ID NO: 422357 - DNA, 25 bp, Rattus norvegicus
ggacccaagtattttcattttctga

SEQ ID NO: 422358 - DNA, 25 bp, Rattus norvegicus
ggacccaagttcagtacccgcaagg

SEQ ID NO: 422359 - DNA, 25 bp, Rattus norvegicus
ggacccaagttctgtacccgcaagg

SEQ ID NO: 422360 - DNA, 25 bp, Rattus norvegicus
ggacccaagtttaaggcaatgagta

SEQ ID NO: 422361 - DNA, 25 bp, Rattus norvegicus
ggacccaagttttaggcaatgagta

SEQ ID NO: 422362 - DNA, 25 bp, Rattus norvegicus
ggacccaatgtcagtacctagaact

SEQ ID NO: 422363 - DNA, 25 bp, Rattus norvegicus
ggacccaatgtctgtacctagaact

SEQ ID NO: 422364 - DNA, 25 bp, Rattus norvegicus
ggacccaatgttaatccttgcctat

SEQ ID NO: 422365 - DNA, 25 bp, Rattus norvegicus
ggacccaatgtttatccttgcctat

SEQ ID NO: 422366 - DNA, 25 bp, Rattus norvegicus
ggacccacaacactcctaagataga

SEQ ID NO: 422367 - DNA, 25 bp, Rattus norvegicus
ggacccacaacagtcctaagataga

SEQ ID NO: 422368 - DNA, 25 bp, Rattus norvegicus
ggacccacacttccgagtgctgaaa

SEQ ID NO: 422369 - DNA, 25 bp, Rattus norvegicus
ggacccacacttgcgagtgctgaaa

SEQ ID NO: 422370 - DNA, 25 bp, Rattus norvegicus
ggacccacagaacaatcaggctatg

SEQ ID NO: 422371 - DNA, 25 bp, Rattus norvegicus
ggacccacagaagaatcaggctatg

SEQ ID NO: 422372 - DNA, 25 bp, Rattus norvegicus
ggacccacagatcgagaaccactag

SEQ ID NO: 422373 - DNA, 25 bp, Rattus norvegicus
ggacccacagatggagaaccactag

SEQ ID NO: 422374 - DNA, 25 bp, Rattus norvegicus
ggacccacagccattagactgagat

SEQ ID NO: 422375 - DNA, 25 bp, Rattus norvegicus
ggacccacagcctttagactgagat

SEQ ID NO: 422376 - DNA, 25 bp, Rattus norvegicus
ggacccacaggaagttagcagctct

SEQ ID NO: 422377 - DNA, 25 bp, Rattus norvegicus
ggacccacaggatgttagcagctct

SEQ ID NO: 422378 - DNA, 25 bp, Rattus norvegicus
ggacccacatgtatgtgcactgtta

SEQ ID NO: 422379 - DNA, 25 bp, Rattus norvegicus
ggacccacatgtttgtgcactgtta

SEQ ID NO: 422380 - DNA, 25 bp, Rattus norvegicus
ggacccacattacagacgcctataa

SEQ ID NO: 422381 - DNA, 25 bp, Rattus norvegicus
ggacccacattagagacgcctataa

SEQ ID NO: 422382 - DNA, 25 bp, Rattus norvegicus
ggacccacatttcatttgcagcacc

SEQ ID NO: 422383 - DNA, 25 bp, Rattus norvegicus
ggacccacatttgatttgcagcacc

SEQ ID NO: 422384 - DNA, 25 bp, Rattus norvegicus
ggacccaccctgatgaaagacaaag

SEQ ID NO: 422385 - DNA, 25 bp, Rattus norvegicus
ggacccaccctgttgaaagacaaag

SEQ ID NO: 422386 - DNA, 25 bp, Rattus norvegicus
ggacccacctgccttgaatacattt

SEQ ID NO: 422387 - DNA, 25 bp, Rattus norvegicus
ggacccacctgcgttgaatacattt

SEQ ID NO: 422388 - DNA, 25 bp, Rattus norvegicus
ggacccacctttcgccaagtataag

SEQ ID NO: 422389 - DNA, 25 bp, Rattus norvegicus
ggacccacctttggccaagtataag

SEQ ID NO: 422390 - DNA, 25 bp, Rattus norvegicus
ggacccacgtgtaatctgctatgaa

SEQ ID NO: 422391 - DNA, 25 bp, Rattus norvegicus
ggacccacgtgttatctgctatgaa

SEQ ID NO: 422392 - DNA, 25 bp, Rattus norvegicus
ggacccactctgagttttgctagtt

SEQ ID NO: 422393 - DNA, 25 bp, Rattus norvegicus
ggacccactctgtgttttgctagtt

SEQ ID NO: 422394 - DNA, 25 bp, Rattus norvegicus
ggacccactggaagcgtgcattcaa

SEQ ID NO: 422395 - DNA, 25 bp, Rattus norvegicus
ggacccactggatgcgtgcattcaa

SEQ ID NO: 422396 - DNA, 25 bp, Rattus norvegicus
ggacccactgtgaaagctagcctgt

SEQ ID NO: 422397 - DNA, 25 bp, Rattus norvegicus
ggacccactgtgtaagctagcctgt

SEQ ID NO: 422398 - DNA, 25 bp, Rattus norvegicus
ggacccactttgcaccatgagtttg

SEQ ID NO: 422399 - DNA, 25 bp, Rattus norvegicus
ggacccactttggaccatgagtttg

SEQ ID NO: 422400 - DNA, 25 bp, Rattus norvegicus
ggacccagaacacgtaggagccttt

SEQ ID NO: 422401 - DNA, 25 bp, Rattus norvegicus
ggacccagaacaggtaggagccttt

SEQ ID NO: 422402 - DNA, 25 bp, Rattus norvegicus
ggacccagaagcagcccagggtgtc

SEQ ID NO: 422403 - DNA, 25 bp, Rattus norvegicus
ggacccagaagctgcccagggtgtc

SEQ ID NO: 422404 - DNA, 25 bp, Rattus norvegicus
ggacccagacgaaggctcacaactg

SEQ ID NO: 422405 - DNA, 25 bp, Rattus norvegicus
ggacccagacgatggctcacaactg

SEQ ID NO: 422406 - DNA, 25 bp, Rattus norvegicus
ggacccagagaactcctgtggcaga

SEQ ID NO: 422407 - DNA, 25 bp, Rattus norvegicus
ggacccagagaagtcctgtggcaga

SEQ ID NO: 422408 - DNA, 25 bp, Rattus norvegicus
ggacccagagccatgctcattgtaa

SEQ ID NO: 422409 - DNA, 25 bp, Rattus norvegicus
ggacccagagccttgctcattgtaa

SEQ ID NO: 422410 - DNA, 25 bp, Rattus norvegicus
ggacccagagtaatttccccactga

SEQ ID NO: 422411 - DNA, 25 bp, Rattus norvegicus
ggacccagagtattttccccactga

SEQ ID NO: 422412 - DNA, 25 bp, Rattus norvegicus
ggacccagatcacctgacctgtggg

SEQ ID NO: 422413 - DNA, 25 bp, Rattus norvegicus
ggacccagatcagctgacctgtggg

SEQ ID NO: 422414 - DNA, 25 bp, Rattus norvegicus
ggacccagcactaaggacgggctta

SEQ ID NO: 422415 - DNA, 25 bp, Rattus norvegicus
ggacccagcacttaggacgggctta

SEQ ID NO: 422416 - DNA, 25 bp, Rattus norvegicus
ggacccagcgttcggaagctgtctt

SEQ ID NO: 422417 - DNA, 25 bp, Rattus norvegicus
ggacccagcgttgggaagctgtctt

SEQ ID NO: 422418 - DNA, 25 bp, Rattus norvegicus
ggacccaggatgatttgtacttatt

SEQ ID NO: 422419 - DNA, 25 bp, Rattus norvegicus
ggacccaggatgttttgtacttatt

SEQ ID NO: 422420 - DNA, 25 bp, Rattus norvegicus
ggacccaggcagctgtgtacactaa

SEQ ID NO: 422421 - DNA, 25 bp, Rattus norvegicus
ggacccaggcaggtgtgtacactaa

SEQ ID NO: 422422 - DNA, 25 bp, Rattus norvegicus
ggacccagggatccgtgaagctgca

SEQ ID NO: 422423 - DNA, 25 bp, Rattus norvegicus
ggacccagggatgcgtgaagctgca

SEQ ID NO: 422424 - DNA, 25 bp, Rattus norvegicus
ggacccaggtaccttcacatgagaa

SEQ ID NO: 422425 - DNA, 25 bp, Rattus norvegicus
ggacccaggtacgttcacatgagaa

SEQ ID NO: 422426 - DNA, 25 bp, Rattus norvegicus
ggacccaggtcccattgtgtatgtg

SEQ ID NO: 422427 - DNA, 25 bp, Rattus norvegicus
ggacccaggtccgattgtgtatgtg

SEQ ID NO: 422428 - DNA, 25 bp, Rattus norvegicus
ggacccaggttgagttcccagtgaa

SEQ ID NO: 422429 - DNA, 25 bp, Rattus norvegicus
ggacccaggttgtgttcccagtgaa

SEQ ID NO: 422430 - DNA, 25 bp, Rattus norvegicus
ggacccagtaatccagcctaatcaa

SEQ ID NO: 422431 - DNA, 25 bp, Rattus norvegicus
ggacccagtaatgcagcctaatcaa

SEQ ID NO: 422432 - DNA, 25 bp, Rattus norvegicus
ggacccagtcataacctaggtacca

SEQ ID NO: 422433 - DNA, 25 bp, Rattus norvegicus
ggacccagtcattacctaggtacca

SEQ ID NO: 422434 - DNA, 25 bp, Rattus norvegicus
ggacccagtgcacaatcaggcagca

SEQ ID NO: 422435 - DNA, 25 bp, Rattus norvegicus
ggacccagtgcagaatcaggcagca

SEQ ID NO: 422436 - DNA, 25 bp, Rattus norvegicus
ggacccagtgccctattttggcttt

SEQ ID NO: 422437 - DNA, 25 bp, Rattus norvegicus
ggacccagtgccgtattttggcttt

SEQ ID NO: 422438 - DNA, 25 bp, Rattus norvegicus
ggacccagttccatctctagatatc

SEQ ID NO: 422439 - DNA, 25 bp, Rattus norvegicus
ggacccagttccttctctagatatc

SEQ ID NO: 422440 - DNA, 25 bp, Rattus norvegicus
ggacccagttctatttccaagactc

SEQ ID NO: 422441 - DNA, 25 bp, Rattus norvegicus
ggacccagttctttttccaagactc

SEQ ID NO: 422442 - DNA, 25 bp, Rattus norvegicus
ggacccataaacctctcagacacag

SEQ ID NO: 422443 - DNA, 25 bp, Rattus norvegicus
ggacccataaacgtctcagacacag

SEQ ID NO: 422444 - DNA, 25 bp, Rattus norvegicus
ggacccatacggaagcaaaccacca

SEQ ID NO: 422445 - DNA, 25 bp, Rattus norvegicus
ggacccatacggtagcaaaccacca

SEQ ID NO: 422446 - DNA, 25 bp, Rattus norvegicus
ggacccatcaaactaaacatcgacg

SEQ ID NO: 422447 - DNA, 25 bp, Rattus norvegicus
ggacccatcaaagtaaacatcgacg

SEQ ID NO: 422448 - DNA, 25 bp, Rattus norvegicus
ggacccatcagaagtacctcatcat

SEQ ID NO: 422449 - DNA, 25 bp, Rattus norvegicus
ggacccatcagatgtacctcatcat

SEQ ID NO: 422450 - DNA, 25 bp, Rattus norvegicus
ggacccatcatgctggctcagcaag

SEQ ID NO: 422451 - DNA, 25 bp, Rattus norvegicus
ggacccatcatggtggctcagcaag

SEQ ID NO: 422452 - DNA, 25 bp, Rattus norvegicus
ggacccatcttaaatatctacccat

SEQ ID NO: 422453 - DNA, 25 bp, Rattus norvegicus
ggacccatcttatatatctacccat

SEQ ID NO: 422454 - DNA, 25 bp, Rattus norvegicus
ggacccatgactaggtttttcttgt

SEQ ID NO: 422455 - DNA, 25 bp, Rattus norvegicus
ggacccatgacttggtttttcttgt

SEQ ID NO: 422456 - DNA, 25 bp, Rattus norvegicus
ggacccatgagtacagagtgggtat

SEQ ID NO: 422457 - DNA, 25 bp, Rattus norvegicus
ggacccatgagttcagagtgggtat

SEQ ID NO: 422458 - DNA, 25 bp, Rattus norvegicus
ggacccatgcagaagttgccctaga

SEQ ID NO: 422459 - DNA, 25 bp, Rattus norvegicus
ggacccatgcagtagttgccctaga

SEQ ID NO: 422460 - DNA, 25 bp, Rattus norvegicus
ggacccatggacaggagccgttatg

SEQ ID NO: 422461 - DNA, 25 bp, Rattus norvegicus
ggacccatggactggagccgttatg

SEQ ID NO: 422462 - DNA, 25 bp, Rattus norvegicus
ggacccatgtcacaaagccagtcat

SEQ ID NO: 422463 - DNA, 25 bp, Rattus norvegicus
ggacccatgtcagaaagccagtcat

SEQ ID NO: 422464 - DNA, 25 bp, Rattus norvegicus
ggacccattgccacaacaagactga

SEQ ID NO: 422465 - DNA, 25 bp, Rattus norvegicus
ggacccattgcctcaacaagactga

SEQ ID NO: 422466 - DNA, 25 bp, Rattus norvegicus
ggacccattgttaataatctccaaa

SEQ ID NO: 422467 - DNA, 25 bp, Rattus norvegicus
ggacccattgtttataatctccaaa

SEQ ID NO: 422468 - DNA, 25 bp, Rattus norvegicus
ggacccatttagactttagatgcaa

SEQ ID NO: 422469 - DNA, 25 bp, Rattus norvegicus
ggacccatttagtctttagatgcaa

SEQ ID NO: 422470 - DNA, 25 bp, Rattus norvegicus
ggaccccaaataccctgcagagaag

SEQ ID NO: 422471 - DNA, 25 bp, Rattus norvegicus
ggaccccaaatagcctgcagagaag

SEQ ID NO: 422472 - DNA, 25 bp, Rattus norvegicus
ggaccccaagctcgatcatgctgaa

SEQ ID NO: 422473 - DNA, 25 bp, Rattus norvegicus
ggaccccaagctggatcatgctgaa

SEQ ID NO: 422474 - DNA, 25 bp, Rattus norvegicus
ggaccccaaggaccttcttaggctg

SEQ ID NO: 422475 - DNA, 25 bp, Rattus norvegicus
ggaccccaaggagcttcttaggctg

SEQ ID NO: 422476 - DNA, 25 bp, Rattus norvegicus
ggaccccaagttcgacatcctggag

SEQ ID NO: 422477 - DNA, 25 bp, Rattus norvegicus
ggaccccaagttggacatcctggag

SEQ ID NO: 422478 - DNA, 25 bp, Rattus norvegicus
ggaccccactggaatgttcttgaat

SEQ ID NO: 422479 - DNA, 25 bp, Rattus norvegicus
ggaccccactggtatgttcttgaat

SEQ ID NO: 422480 - DNA, 25 bp, Rattus norvegicus
ggaccccagccaccaatgaatcata

SEQ ID NO: 422481 - DNA, 25 bp, Rattus norvegicus
ggaccccagccagcaatgaatcata

SEQ ID NO: 422482 - DNA, 25 bp, Rattus norvegicus
ggaccccagtgaatgtggctaccaa

SEQ ID NO: 422483 - DNA, 25 bp, Rattus norvegicus
ggaccccagtgattgtggctaccaa

SEQ ID NO: 422484 - DNA, 25 bp, Rattus norvegicus
ggaccccatacaacatgctggtaaa

SEQ ID NO: 422485 - DNA, 25 bp, Rattus norvegicus
ggaccccatacatcatgctggtaaa

SEQ ID NO: 422486 - DNA, 25 bp, Rattus norvegicus
ggaccccatcaaccgacacgtgaat

SEQ ID NO: 422487 - DNA, 25 bp, Rattus norvegicus
ggaccccatcaagcgacacgtgaat

SEQ ID NO: 422488 - DNA, 25 bp, Rattus norvegicus
ggaccccatcttcattgatgcagac

SEQ ID NO: 422489 - DNA, 25 bp, Rattus norvegicus
ggaccccatcttgattgatgcagac

SEQ ID NO: 422490 - DNA, 25 bp, Rattus norvegicus
ggaccccgcttaatttcggagcctg

SEQ ID NO: 422491 - DNA, 25 bp, Rattus norvegicus
ggaccccgcttattttcggagcctg

SEQ ID NO: 422492 - DNA, 25 bp, Rattus norvegicus
ggacccctattcattcatttattca

SEQ ID NO: 422493 - DNA, 25 bp, Rattus norvegicus
ggacccctattctttcatttattca

SEQ ID NO: 422494 - DNA, 25 bp, Rattus norvegicus
ggacccctcaagaaatcgtgcatat

SEQ ID NO: 422495 - DNA, 25 bp, Rattus norvegicus
ggacccctcaagtaatcgtgcatat

SEQ ID NO: 422496 - DNA, 25 bp, Rattus norvegicus
ggacccctcagaccttaaatgctta

SEQ ID NO: 422497 - DNA, 25 bp, Rattus norvegicus
ggacccctcagagcttaaatgctta

SEQ ID NO: 422498 - DNA, 25 bp, Rattus norvegicus
ggacccctcgtgcatccgttcggag

SEQ ID NO: 422499 - DNA, 25 bp, Rattus norvegicus
ggacccctcgtggatccgttcggag

SEQ ID NO: 422500 - DNA, 25 bp, Rattus norvegicus
ggacccctgctacctactgatatta

SEQ ID NO: 422501 - DNA, 25 bp, Rattus norvegicus
ggacccctgctagctactgatatta

SEQ ID NO: 422502 - DNA, 25 bp, Rattus norvegicus
ggacccctgcttagtgatgtacaag

SEQ ID NO: 422503 - DNA, 25 bp, Rattus norvegicus
ggacccctgctttgtgatgtacaag

SEQ ID NO: 422504 - DNA, 25 bp, Rattus norvegicus
ggacccctgggtcgtggaatcacat

SEQ ID NO: 422505 - DNA, 25 bp, Rattus norvegicus
ggacccctgggtggtggaatcacat

SEQ ID NO: 422506 - DNA, 25 bp, Rattus norvegicus
ggaccccttacacttgtgcgtgcag

SEQ ID NO: 422507 - DNA, 25 bp, Rattus norvegicus
ggaccccttacagttgtgcgtgcag

SEQ ID NO: 422508 - DNA, 25 bp, Rattus norvegicus
ggaccccttctacgagatgttggca

SEQ ID NO: 422509 - DNA, 25 bp, Rattus norvegicus
ggaccccttctaggagatgttggca

SEQ ID NO: 422510 - DNA, 25 bp, Rattus norvegicus
ggaccccttgggaaaggcatgccat

SEQ ID NO: 422511 - DNA, 25 bp, Rattus norvegicus
ggaccccttgggtaaggcatgccat

SEQ ID NO: 422512 - DNA, 25 bp, Rattus norvegicus
ggacccctttttctgtctgtagcgt

SEQ ID NO: 422513 - DNA, 25 bp, Rattus norvegicus
ggacccctttttgtgtctgtagcgt

SEQ ID NO: 422514 - DNA, 25 bp, Rattus norvegicus
ggacccgacggaaccaaagtcatga

SEQ ID NO: 422515 - DNA, 25 bp, Rattus norvegicus
ggacccgacggatccaaagtcatga

SEQ ID NO: 422516 - DNA, 25 bp, Rattus norvegicus
ggacccgagtcaagagcccaagtac

SEQ ID NO: 422517 - DNA, 25 bp, Rattus norvegicus
ggacccgagtcatgagcccaagtac

SEQ ID NO: 422518 - DNA, 25 bp, Rattus norvegicus
ggacccgcagtgacggccagtaaag

SEQ ID NO: 422519 - DNA, 25 bp, Rattus norvegicus
ggacccgcagtgtcggccagtaaag

SEQ ID NO: 422520 - DNA, 25 bp, Rattus norvegicus
ggacccgcccgtagagggtgctgaa

SEQ ID NO: 422521 - DNA, 25 bp, Rattus norvegicus
ggacccgcccgttgagggtgctgaa

SEQ ID NO: 422522 - DNA, 25 bp, Rattus norvegicus
ggacccggagcacagagagcgttgg

SEQ ID NO: 422523 - DNA, 25 bp, Rattus norvegicus
ggacccggagcagagagagcgttgg

SEQ ID NO: 422524 - DNA, 25 bp, Rattus norvegicus
ggacccggcatgaagatatttttga

SEQ ID NO: 422525 - DNA, 25 bp, Rattus norvegicus
ggacccggcatgtagatatttttga

SEQ ID NO: 422526 - DNA, 25 bp, Rattus norvegicus
ggacccggctctcagagtcatttga

SEQ ID NO: 422527 - DNA, 25 bp, Rattus norvegicus
ggacccggctctgagagtcatttga

SEQ ID NO: 422528 - DNA, 25 bp, Rattus norvegicus
ggacccggctgtccgggaggcgcgt

SEQ ID NO: 422529 - DNA, 25 bp, Rattus norvegicus
ggacccggctgtgcgggaggcgcgt

SEQ ID NO: 422530 - DNA, 25 bp, Rattus norvegicus
ggacccgggaccaggatccgctgca

SEQ ID NO: 422531 - DNA, 25 bp, Rattus norvegicus
ggacccgggacctggatccgctgca

SEQ ID NO: 422532 - DNA, 25 bp, Rattus norvegicus
ggacccggttctcttgtgtttcatc

SEQ ID NO: 422533 - DNA, 25 bp, Rattus norvegicus
ggacccggttctgttgtgtttcatc

SEQ ID NO: 422534 - DNA, 25 bp, Rattus norvegicus
ggacccgtacaaaaatgtcacgata

SEQ ID NO: 422535 - DNA, 25 bp, Rattus norvegicus
ggacccgtacaataatgtcacgata

SEQ ID NO: 422536 - DNA, 25 bp, Rattus norvegicus
ggacccgtactcctaatatttgaga

SEQ ID NO: 422537 - DNA, 25 bp, Rattus norvegicus
ggacccgtactcgtaatatttgaga

SEQ ID NO: 422538 - DNA, 25 bp, Rattus norvegicus
ggacccgtgcttacaaaacttacat

SEQ ID NO: 422539 - DNA, 25 bp, Rattus norvegicus
ggacccgtgctttcaaaacttacat

SEQ ID NO: 422540 - DNA, 25 bp, Rattus norvegicus
ggacccgtggttcaaaagtgcatta

SEQ ID NO: 422541 - DNA, 25 bp, Rattus norvegicus
ggacccgtggttgaaaagtgcatta

SEQ ID NO: 422542 - DNA, 25 bp, Rattus norvegicus
ggaccctaacaaatcttagctggga

SEQ ID NO: 422543 - DNA, 25 bp, Rattus norvegicus
ggaccctaacaattcttagctggga

SEQ ID NO: 422544 - DNA, 25 bp, Rattus norvegicus
ggaccctaactgaacggaccatctt

SEQ ID NO: 422545 - DNA, 25 bp, Rattus norvegicus
ggaccctaactgtacggaccatctt

SEQ ID NO: 422546 - DNA, 25 bp, Rattus norvegicus
ggaccctacacgctttcagtcagtg

SEQ ID NO: 422547 - DNA, 25 bp, Rattus norvegicus
ggaccctacacggtttcagtcagtg

SEQ ID NO: 422548 - DNA, 25 bp, Rattus norvegicus
ggaccctacctgcttcaagagtgag

SEQ ID NO: 422549 - DNA, 25 bp, Rattus norvegicus
ggaccctacctggttcaagagtgag

SEQ ID NO: 422550 - DNA, 25 bp, Rattus norvegicus
ggaccctagactagccctaataata

SEQ ID NO: 422551 - DNA, 25 bp, Rattus norvegicus
ggaccctagacttgccctaataata

SEQ ID NO: 422552 - DNA, 25 bp, Rattus norvegicus
ggaccctagagccagcagcaacagg

SEQ ID NO: 422553 - DNA, 25 bp, Rattus norvegicus
ggaccctagagcgagcagcaacagg

SEQ ID NO: 422554 - DNA, 25 bp, Rattus norvegicus
ggaccctagcaactggttctttgaa

SEQ ID NO: 422555 - DNA, 25 bp, Rattus norvegicus
ggaccctagcaagtggttctttgaa

SEQ ID NO: 422556 - DNA, 25 bp, Rattus norvegicus
ggaccctagggcagattgtagccta

SEQ ID NO: 422557 - DNA, 25 bp, Rattus norvegicus
ggaccctagggctgattgtagccta

SEQ ID NO: 422558 - DNA, 25 bp, Rattus norvegicus
ggaccctcagtaagatgggcgacta

SEQ ID NO: 422559 - DNA, 25 bp, Rattus norvegicus
ggaccctcagtatgatgggcgacta

SEQ ID NO: 422560 - DNA, 25 bp, Rattus norvegicus
ggaccctcattgactgatcattttc

SEQ ID NO: 422561 - DNA, 25 bp, Rattus norvegicus
ggaccctcattgtctgatcattttc

SEQ ID NO: 422562 - DNA, 25 bp, Rattus norvegicus
ggaccctcccagctagaagcattga

SEQ ID NO: 422563 - DNA, 25 bp, Rattus norvegicus
ggaccctcccaggtagaagcattga

SEQ ID NO: 422564 - DNA, 25 bp, Rattus norvegicus
ggaccctccttgagtctttatcaaa

SEQ ID NO: 422565 - DNA, 25 bp, Rattus norvegicus
ggaccctccttgtgtctttatcaaa

SEQ ID NO: 422566 - DNA, 25 bp, Rattus norvegicus
ggaccctcctttcgagaacttctga

SEQ ID NO: 422567 - DNA, 25 bp, Rattus norvegicus
ggaccctcctttggagaacttctga

SEQ ID NO: 422568 - DNA, 25 bp, Rattus norvegicus
ggaccctcgggcaccaaaatgcagc

SEQ ID NO: 422569 - DNA, 25 bp, Rattus norvegicus
ggaccctcgggctccaaaatgcagc

SEQ ID NO: 422570 - DNA, 25 bp, Rattus norvegicus
ggaccctctcagcttcaggagcaaa

SEQ ID NO: 422571 - DNA, 25 bp, Rattus norvegicus
ggaccctctcaggttcaggagcaaa

SEQ ID NO: 422572 - DNA, 25 bp, Rattus norvegicus
ggaccctctgaccttacaggcaaag

SEQ ID NO: 422573 - DNA, 25 bp, Rattus norvegicus
ggaccctctgacgttacaggcaaag

SEQ ID NO: 422574 - DNA, 25 bp, Rattus norvegicus
ggaccctgactgagaggccaaatca

SEQ ID NO: 422575 - DNA, 25 bp, Rattus norvegicus
ggaccctgactgtgaggccaaatca

SEQ ID NO: 422576 - DNA, 25 bp, Rattus norvegicus
ggaccctgagaactgcctgggcctc

SEQ ID NO: 422577 - DNA, 25 bp, Rattus norvegicus
ggaccctgagaagtgcctgggcctc

SEQ ID NO: 422578 - DNA, 25 bp, Rattus norvegicus
ggaccctgaggaatgcttgactcca

SEQ ID NO: 422579 - DNA, 25 bp, Rattus norvegicus
ggaccctgaggattgcttgactcca

SEQ ID NO: 422580 - DNA, 25 bp, Rattus norvegicus
ggaccctgatcaatcactgtgacac

SEQ ID NO: 422581 - DNA, 25 bp, Rattus norvegicus
ggaccctgatcattcactgtgacac

SEQ ID NO: 422582 - DNA, 25 bp, Rattus norvegicus
ggaccctgatggaaaccccaagtgt

SEQ ID NO: 422583 - DNA, 25 bp, Rattus norvegicus
ggaccctgatggtaaccccaagtgt

SEQ ID NO: 422584 - DNA, 25 bp, Rattus norvegicus
ggaccctgcaacagcacatggagtt

SEQ ID NO: 422585 - DNA, 25 bp, Rattus norvegicus
ggaccctgcaactgcacatggagtt

SEQ ID NO: 422586 - DNA, 25 bp, Rattus norvegicus
ggaccctgccagcattcaaggaagg

SEQ ID NO: 422587 - DNA, 25 bp, Rattus norvegicus
ggaccctgccaggattcaaggaagg

SEQ ID NO: 422588 - DNA, 25 bp, Rattus norvegicus
ggaccctgcctaatttaagataaat

SEQ ID NO: 422589 - DNA, 25 bp, Rattus norvegicus
ggaccctgcctattttaagataaat

SEQ ID NO: 422590 - DNA, 25 bp, Rattus norvegicus
ggaccctgcgaacagtagttttcat

SEQ ID NO: 422591 - DNA, 25 bp, Rattus norvegicus
ggaccctgcgaagagtagttttcat

SEQ ID NO: 422592 - DNA, 25 bp, Rattus norvegicus
ggaccctgctagatctcaggtttca

SEQ ID NO: 422593 - DNA, 25 bp, Rattus norvegicus
ggaccctgctagttctcaggtttca

SEQ ID NO: 422594 - DNA, 25 bp, Rattus norvegicus
ggaccctgcttcaatggcggcttgt

SEQ ID NO: 422595 - DNA, 25 bp, Rattus norvegicus
ggaccctgcttctatggcggcttgt

SEQ ID NO: 422596 - DNA, 25 bp, Rattus norvegicus
ggaccctgcttgataccaaaacttg

SEQ ID NO: 422597 - DNA, 25 bp, Rattus norvegicus
ggaccctgcttgttaccaaaacttg

SEQ ID NO: 422598 - DNA, 25 bp, Rattus norvegicus
ggaccctggaataactcccatcttg

SEQ ID NO: 422599 - DNA, 25 bp, Rattus norvegicus
ggaccctggaattactcccatcttg

SEQ ID NO: 422600 - DNA, 25 bp, Rattus norvegicus
ggaccctgggacagagcctgcatgt

SEQ ID NO: 422601 - DNA, 25 bp, Rattus norvegicus
ggaccctgggactgagcctgcatgt

SEQ ID NO: 422602 - DNA, 25 bp, Rattus norvegicus
ggaccctggtgacaactacaatctt

SEQ ID NO: 422603 - DNA, 25 bp, Rattus norvegicus
ggaccctggtgagaactacaatctt

SEQ ID NO: 422604 - DNA, 25 bp, Rattus norvegicus
ggaccctgtgacacggtgcctgaga

SEQ ID NO: 422605 - DNA, 25 bp, Rattus norvegicus
ggaccctgtgactcggtgcctgaga

SEQ ID NO: 422606 - DNA, 25 bp, Rattus norvegicus
ggaccctgtgtcacaaatccttgtg

SEQ ID NO: 422607 - DNA, 25 bp, Rattus norvegicus
ggaccctgtgtctcaaatccttgtg

SEQ ID NO: 422608 - DNA, 25 bp, Rattus norvegicus
ggaccctgtttgaggctgggaaact

SEQ ID NO: 422609 - DNA, 25 bp, Rattus norvegicus
ggaccctgtttgtggctgggaaact

SEQ ID NO: 422610 - DNA, 25 bp, Rattus norvegicus
ggaccctgttttcctacggacagta

SEQ ID NO: 422611 - DNA, 25 bp, Rattus norvegicus
ggaccctgttttgctacggacagta

SEQ ID NO: 422612 - DNA, 25 bp, Rattus norvegicus
ggacccttcaaacactaaagcacta

SEQ ID NO: 422613 - DNA, 25 bp, Rattus norvegicus
ggacccttcaaagactaaagcacta

SEQ ID NO: 422614 - DNA, 25 bp, Rattus norvegicus
ggacccttcatcagattgttctgaa

SEQ ID NO: 422615 - DNA, 25 bp, Rattus norvegicus
ggacccttcatctgattgttctgaa

SEQ ID NO: 422616 - DNA, 25 bp, Rattus norvegicus
ggacccttggaaacaagctcttact

SEQ ID NO: 422617 - DNA, 25 bp, Rattus norvegicus
ggacccttggaaatgtgaaactcga

SEQ ID NO: 422618 - DNA, 25 bp, Rattus norvegicus
ggacccttggaatcaagctcttact

SEQ ID NO: 422619 - DNA, 25 bp, Rattus norvegicus
ggacccttggaattgtgaaactcga

SEQ ID NO: 422620 - DNA, 25 bp, Rattus norvegicus
ggacccttgggaccctctgtctttg

SEQ ID NO: 422621 - DNA, 25 bp, Rattus norvegicus
ggacccttgggagcctctgtctttg

SEQ ID NO: 422622 - DNA, 25 bp, Rattus norvegicus
ggaccctttaggaatgttaccagat

SEQ ID NO: 422623 - DNA, 25 bp, Rattus norvegicus
ggaccctttaggtatgttaccagat

SEQ ID NO: 422624 - DNA, 25 bp, Rattus norvegicus
ggaccctttcctcttgtgatcatag

SEQ ID NO: 422625 - DNA, 25 bp, Rattus norvegicus
ggaccctttcctgttgtgatcatag

SEQ ID NO: 422626 - DNA, 25 bp, Rattus norvegicus
ggaccgaacctgatttcagcagttt

SEQ ID NO: 422627 - DNA, 25 bp, Rattus norvegicus
ggaccgaacctgttttcagcagttt

SEQ ID NO: 422628 - DNA, 25 bp, Rattus norvegicus
ggaccgaaggtcactttgtacatat

SEQ ID NO: 422629 - DNA, 25 bp, Rattus norvegicus
ggaccgaaggtctctttgtacatat

SEQ ID NO: 422630 - DNA, 25 bp, Rattus norvegicus
ggaccgaagtctcgacatcaatgtc

SEQ ID NO: 422631 - DNA, 25 bp, Rattus norvegicus
ggaccgaagtctggacatcaatgtc

SEQ ID NO: 422632 - DNA, 25 bp, Rattus norvegicus
ggaccgacacccctttgaataatat

SEQ ID NO: 422633 - DNA, 25 bp, Rattus norvegicus
ggaccgacacccgtttgaataatat

SEQ ID NO: 422634 - DNA, 25 bp, Rattus norvegicus
ggaccgacagaaacttggtgtacta

SEQ ID NO: 422635 - DNA, 25 bp, Rattus norvegicus
ggaccgacagaatcttggtgtacta

SEQ ID NO: 422636 - DNA, 25 bp, Rattus norvegicus
ggaccgacagagatatttttggcaa

SEQ ID NO: 422637 - DNA, 25 bp, Rattus norvegicus
ggaccgacagagttatttttggcaa

SEQ ID NO: 422638 - DNA, 25 bp, Rattus norvegicus
ggaccgacagttccaggagctcaac

SEQ ID NO: 422639 - DNA, 25 bp, Rattus norvegicus
ggaccgacagttgcaggagctcaac

SEQ ID NO: 422640 - DNA, 25 bp, Rattus norvegicus
ggaccgaccatccttcctggtaggg

SEQ ID NO: 422641 - DNA, 25 bp, Rattus norvegicus
ggaccgaccatcgttcctggtaggg

SEQ ID NO: 422642 - DNA, 25 bp, Rattus norvegicus
ggaccgaccctcatctgaaaggcat

SEQ ID NO: 422643 - DNA, 25 bp, Rattus norvegicus
ggaccgaccctcttctgaaaggcat

SEQ ID NO: 422644 - DNA, 25 bp, Rattus norvegicus
ggaccgactttcaacgccacagagg

SEQ ID NO: 422645 - DNA, 25 bp, Rattus norvegicus
ggaccgactttctacgccacagagg

SEQ ID NO: 422646 - DNA, 25 bp, Rattus norvegicus
ggaccgagtggcagtctctgtgaca

SEQ ID NO: 422647 - DNA, 25 bp, Rattus norvegicus
ggaccgagtggctgtctctgtgaca

SEQ ID NO: 422648 - DNA, 25 bp, Rattus norvegicus
ggaccgagttatcacaatctacgtt

SEQ ID NO: 422649 - DNA, 25 bp, Rattus norvegicus
ggaccgagttatgacaatctacgtt

SEQ ID NO: 422650 - DNA, 25 bp, Rattus norvegicus
ggaccgagttcacgttgtcagactt

SEQ ID NO: 422651 - DNA, 25 bp, Rattus norvegicus
ggaccgagttcaggttgtcagactt

SEQ ID NO: 422652 - DNA, 25 bp, Rattus norvegicus
ggaccgataagcaaagcccctcaag

SEQ ID NO: 422653 - DNA, 25 bp, Rattus norvegicus
ggaccgataagctaagcccctcaag

SEQ ID NO: 422654 - DNA, 25 bp, Rattus norvegicus
ggaccgatggtcatgatgaaaaatc

SEQ ID NO: 422655 - DNA, 25 bp, Rattus norvegicus
ggaccgatggtcttgatgaaaaatc

SEQ ID NO: 422656 - DNA, 25 bp, Rattus norvegicus
ggaccgattcagaaaacccttccat

SEQ ID NO: 422657 - DNA, 25 bp, Rattus norvegicus
ggaccgattcagtaaacccttccat

SEQ ID NO: 422658 - DNA, 25 bp, Rattus norvegicus
ggaccgatttccaacagtattcaat

SEQ ID NO: 422659 - DNA, 25 bp, Rattus norvegicus
ggaccgatttcctacagtattcaat

SEQ ID NO: 422660 - DNA, 25 bp, Rattus norvegicus
ggaccgcaaaagacagacagctgct

SEQ ID NO: 422661 - DNA, 25 bp, Rattus norvegicus
ggaccgcaaaagtcagacagctgct

SEQ ID NO: 422662 - DNA, 25 bp, Rattus norvegicus
ggaccgcaaagccaatgttgaacat

SEQ ID NO: 422663 - DNA, 25 bp, Rattus norvegicus
ggaccgcaaagcgaatgttgaacat

SEQ ID NO: 422664 - DNA, 25 bp, Rattus norvegicus
ggaccgcaagtacagcatctgcaag

SEQ ID NO: 422665 - DNA, 25 bp, Rattus norvegicus
ggaccgcaagtagagcatctgcaag

SEQ ID NO: 422666 - DNA, 25 bp, Rattus norvegicus
ggaccgcaatgcctttgatgtactg

SEQ ID NO: 422667 - DNA, 25 bp, Rattus norvegicus
ggaccgcaatgcgtttgatgtactg

SEQ ID NO: 422668 - DNA, 25 bp, Rattus norvegicus
ggaccgcagatgcaccaacccagat

SEQ ID NO: 422669 - DNA, 25 bp, Rattus norvegicus
ggaccgcagatggaccaacccagat

SEQ ID NO: 422670 - DNA, 25 bp, Rattus norvegicus
ggaccgcagcttctagacgattctt

SEQ ID NO: 422671 - DNA, 25 bp, Rattus norvegicus
ggaccgcagcttgtagacgattctt

SEQ ID NO: 422672 - DNA, 25 bp, Rattus norvegicus
ggaccgcattttatcagccctttgg

SEQ ID NO: 422673 - DNA, 25 bp, Rattus norvegicus
ggaccgcattttttcagccctttgg

SEQ ID NO: 422674 - DNA, 25 bp, Rattus norvegicus
ggaccgccagtccacttctgtaggg

SEQ ID NO: 422675 - DNA, 25 bp, Rattus norvegicus
ggaccgccagtcgacttctgtaggg

SEQ ID NO: 422676 - DNA, 25 bp, Rattus norvegicus
ggaccgccgcttaggaaccttggat

SEQ ID NO: 422677 - DNA, 25 bp, Rattus norvegicus
ggaccgccgctttggaaccttggat

SEQ ID NO: 422678 - DNA, 25 bp, Rattus norvegicus
ggaccgccgtgtataatgtaaacca

SEQ ID NO: 422679 - DNA, 25 bp, Rattus norvegicus
ggaccgccgtgtttaatgtaaacca

SEQ ID NO: 422680 - DNA, 25 bp, Rattus norvegicus
ggaccgcctacaactgggtgtgcaa

SEQ ID NO: 422681 - DNA, 25 bp, Rattus norvegicus
ggaccgcctacatctgggtgtgcaa

SEQ ID NO: 422682 - DNA, 25 bp, Rattus norvegicus
ggaccgcctcggacaggaggtcata

SEQ ID NO: 422683 - DNA, 25 bp, Rattus norvegicus
ggaccgcctcggtcaggaggtcata

SEQ ID NO: 422684 - DNA, 25 bp, Rattus norvegicus
ggaccgcgacgccaacagacagtca

SEQ ID NO: 422685 - DNA, 25 bp, Rattus norvegicus
ggaccgcgacgcgaacagacagtca

SEQ ID NO: 422686 - DNA, 25 bp, Rattus norvegicus
ggaccgcggcccaggaagctaccgg

SEQ ID NO: 422687 - DNA, 25 bp, Rattus norvegicus
ggaccgcggccctggaagctaccgg

SEQ ID NO: 422688 - DNA, 25 bp, Rattus norvegicus
ggaccgcgggtgactctatgagcta

SEQ ID NO: 422689 - DNA, 25 bp, Rattus norvegicus
ggaccgcgggtgtctctatgagcta

SEQ ID NO: 422690 - DNA, 25 bp, Rattus norvegicus
ggaccgctaggcatttaggctgaca

SEQ ID NO: 422691 - DNA, 25 bp, Rattus norvegicus
ggaccgctaggcttttaggctgaca

SEQ ID NO: 422692 - DNA, 25 bp, Rattus norvegicus
ggaccgctctgtctctgcctgcgtt

SEQ ID NO: 422693 - DNA, 25 bp, Rattus norvegicus
ggaccgctctgtgtctgcctgcgtt

SEQ ID NO: 422694 - DNA, 25 bp, Rattus norvegicus
ggaccgcttgcaaccggtgtcctgt

SEQ ID NO: 422695 - DNA, 25 bp, Rattus norvegicus
ggaccgcttgcatccggtgtcctgt

SEQ ID NO: 422696 - DNA, 25 bp, Rattus norvegicus
ggaccgcttgctactggataatcgt

SEQ ID NO: 422697 - DNA, 25 bp, Rattus norvegicus
ggaccgcttgcttctggataatcgt

SEQ ID NO: 422698 - DNA, 25 bp, Rattus norvegicus
ggaccggaccagcaaatacgacgct

SEQ ID NO: 422699 - DNA, 25 bp, Rattus norvegicus
ggaccggaccaggaaatacgacgct

SEQ ID NO: 422700 - DNA, 25 bp, Rattus norvegicus
ggaccggacgaaacatttatctgga

SEQ ID NO: 422701 - DNA, 25 bp, Rattus norvegicus
ggaccggacgaatcatttatctgga

SEQ ID NO: 422702 - DNA, 25 bp, Rattus norvegicus
ggaccggacttgctacaggactcca

SEQ ID NO: 422703 - DNA, 25 bp, Rattus norvegicus
ggaccggacttggtacaggactcca

SEQ ID NO: 422704 - DNA, 25 bp, Rattus norvegicus
ggaccggcaagtacctctgtataag

SEQ ID NO: 422705 - DNA, 25 bp, Rattus norvegicus
ggaccggcaagttcctctgtataag

SEQ ID NO: 422706 - DNA, 25 bp, Rattus norvegicus
ggaccggcctggcatattctcatag

SEQ ID NO: 422707 - DNA, 25 bp, Rattus norvegicus
ggaccggcctgggatattctcatag

SEQ ID NO: 422708 - DNA, 25 bp, Rattus norvegicus
ggaccggcgggcctaaactgctctt

SEQ ID NO: 422709 - DNA, 25 bp, Rattus norvegicus
ggaccggcgggcgtaaactgctctt

SEQ ID NO: 422710 - DNA, 25 bp, Rattus norvegicus
ggaccgggcaggattccagagtcac

SEQ ID NO: 422711 - DNA, 25 bp, Rattus norvegicus
ggaccgggcaggtttccagagtcac

SEQ ID NO: 422712 - DNA, 25 bp, Rattus norvegicus
ggaccgggcgaaacacactgcagag

SEQ ID NO: 422713 - DNA, 25 bp, Rattus norvegicus
ggaccgggcgaatcacactgcagag

SEQ ID NO: 422714 - DNA, 25 bp, Rattus norvegicus
ggaccggtcactacgagtgtgctga

SEQ ID NO: 422715 - DNA, 25 bp, Rattus norvegicus
ggaccggtcacttcgagtgtgctga

SEQ ID NO: 422716 - DNA, 25 bp, Rattus norvegicus
ggaccgtaagcaattctagcccaca

SEQ ID NO: 422717 - DNA, 25 bp, Rattus norvegicus
ggaccgtaagcatttctagcccaca

SEQ ID NO: 422718 - DNA, 25 bp, Rattus norvegicus
ggaccgtagacgactatgtagccta

SEQ ID NO: 422719 - DNA, 25 bp, Rattus norvegicus
ggaccgtagacgtctatgtagccta

SEQ ID NO: 422720 - DNA, 25 bp, Rattus norvegicus
ggaccgtagccaacctcagggacat

SEQ ID NO: 422721 - DNA, 25 bp, Rattus norvegicus
ggaccgtagccatcctcagggacat

SEQ ID NO: 422722 - DNA, 25 bp, Rattus norvegicus
ggaccgtcaggactgctaattgtaa

SEQ ID NO: 422723 - DNA, 25 bp, Rattus norvegicus
ggaccgtcaggagtgctaattgtaa

SEQ ID NO: 422724 - DNA, 25 bp, Rattus norvegicus
ggaccgtcagtcagggtttcagcta

SEQ ID NO: 422725 - DNA, 25 bp, Rattus norvegicus
ggaccgtcagtctgggtttcagcta

SEQ ID NO: 422726 - DNA, 25 bp, Rattus norvegicus
ggaccgtcatggcataacgctctat

SEQ ID NO: 422727 - DNA, 25 bp, Rattus norvegicus
ggaccgtcatgggataacgctctat

SEQ ID NO: 422728 - DNA, 25 bp, Rattus norvegicus
ggaccgtccaacctgacagtggttt

SEQ ID NO: 422729 - DNA, 25 bp, Rattus norvegicus
ggaccgtccaacgtgacagtggttt

SEQ ID NO: 422730 - DNA, 25 bp, Rattus norvegicus
ggaccgtccacgacatatttactgg

SEQ ID NO: 422731 - DNA, 25 bp, Rattus norvegicus
ggaccgtccacgtcatatttactgg

SEQ ID NO: 422732 - DNA, 25 bp, Rattus norvegicus
ggaccgtcggtgagaactcgtgtct

SEQ ID NO: 422733 - DNA, 25 bp, Rattus norvegicus
ggaccgtcggtgtgaactcgtgtct

SEQ ID NO: 422734 - DNA, 25 bp, Rattus norvegicus
ggaccgtctatgcttagccctgtga

SEQ ID NO: 422735 - DNA, 25 bp, Rattus norvegicus
ggaccgtctatggttagccctgtga

SEQ ID NO: 422736 - DNA, 25 bp, Rattus norvegicus
ggaccgtctggtatgggtggccctg

SEQ ID NO: 422737 - DNA, 25 bp, Rattus norvegicus
ggaccgtctggtttgggtggccctg

SEQ ID NO: 422738 - DNA, 25 bp, Rattus norvegicus
ggaccgtcttgcagtggaattcaga

SEQ ID NO: 422739 - DNA, 25 bp, Rattus norvegicus
ggaccgtcttgctgtggaattcaga

SEQ ID NO: 422740 - DNA, 25 bp, Rattus norvegicus
ggaccgtgatctagaattggattta

SEQ ID NO: 422741 - DNA, 25 bp, Rattus norvegicus
ggaccgtgatcttgaattggattta

SEQ ID NO: 422742 - DNA, 25 bp, Rattus norvegicus
ggaccgtgatttccatgtgcactgc

SEQ ID NO: 422743 - DNA, 25 bp, Rattus norvegicus
ggaccgtgatttgcatgtgcactgc

SEQ ID NO: 422744 - DNA, 25 bp, Rattus norvegicus
ggaccgtgctttcttatgtttgtat

SEQ ID NO: 422745 - DNA, 25 bp, Rattus norvegicus
ggaccgtgctttgttatgtttgtat

SEQ ID NO: 422746 - DNA, 25 bp, Rattus norvegicus
ggaccgtggaccacaataaccgaga

SEQ ID NO: 422747 - DNA, 25 bp, Rattus norvegicus
ggaccgtggacctcaataaccgaga

SEQ ID NO: 422748 - DNA, 25 bp, Rattus norvegicus
ggaccgttgattacctggttcttgc

SEQ ID NO: 422749 - DNA, 25 bp, Rattus norvegicus
ggaccgttgatttcctggttcttgc

SEQ ID NO: 422750 - DNA, 25 bp, Rattus norvegicus
ggaccgtttatccagacccaagagg

SEQ ID NO: 422751 - DNA, 25 bp, Rattus norvegicus
ggaccgtttatcgagacccaagagg

SEQ ID NO: 422752 - DNA, 25 bp, Rattus norvegicus
ggaccgtttgaaaacactgcctcag

SEQ ID NO: 422753 - DNA, 25 bp, Rattus norvegicus
ggaccgtttgaatacactgcctcag

SEQ ID NO: 422754 - DNA, 25 bp, Rattus norvegicus
ggacctaacattcgatctcattcag

SEQ ID NO: 422755 - DNA, 25 bp, Rattus norvegicus
ggacctaacattggatctcattcag

SEQ ID NO: 422756 - DNA, 25 bp, Rattus norvegicus
ggacctaagcaaccaggccgagcag

SEQ ID NO: 422757 - DNA, 25 bp, Rattus norvegicus
ggacctaagcaagcaggccgagcag

SEQ ID NO: 422758 - DNA, 25 bp, Rattus norvegicus
ggacctaagcatcttctgttgttta

SEQ ID NO: 422759 - DNA, 25 bp, Rattus norvegicus
ggacctaagcatgttctgttgttta

SEQ ID NO: 422760 - DNA, 25 bp, Rattus norvegicus
ggacctaaggagaaagattgagaca

SEQ ID NO: 422761 - DNA, 25 bp, Rattus norvegicus
ggacctaaggagtaagattgagaca

SEQ ID NO: 422762 - DNA, 25 bp, Rattus norvegicus
ggacctaatgggacttacctgttgc

SEQ ID NO: 422763 - DNA, 25 bp, Rattus norvegicus
ggacctaatgggtcttacctgttgc

SEQ ID NO: 422764 - DNA, 25 bp, Rattus norvegicus
ggacctacaccactatgttataatg

SEQ ID NO: 422765 - DNA, 25 bp, Rattus norvegicus
ggacctacaccagtatgttataatg

SEQ ID NO: 422766 - DNA, 25 bp, Rattus norvegicus
ggacctacactcacagcaacatgga

SEQ ID NO: 422767 - DNA, 25 bp, Rattus norvegicus
ggacctacactctcagcaacatgga

SEQ ID NO: 422768 - DNA, 25 bp, Rattus norvegicus
ggacctaccctaagtacggagaaag

SEQ ID NO: 422769 - DNA, 25 bp, Rattus norvegicus
ggacctaccctatgtacggagaaag

SEQ ID NO: 422770 - DNA, 25 bp, Rattus norvegicus
ggacctacctccagaatttattcac

SEQ ID NO: 422771 - DNA, 25 bp, Rattus norvegicus
ggacctacctcctgaatttattcac

SEQ ID NO: 422772 - DNA, 25 bp, Rattus norvegicus
ggacctacctgtctgtggctaccaa

SEQ ID NO: 422773 - DNA, 25 bp, Rattus norvegicus
ggacctacctgtgtgtggctaccaa

SEQ ID NO: 422774 - DNA, 25 bp, Rattus norvegicus
ggacctacctttatacctatagcag

SEQ ID NO: 422775 - DNA, 25 bp, Rattus norvegicus
ggacctacctttttacctatagcag

SEQ ID NO: 422776 - DNA, 25 bp, Rattus norvegicus
ggacctacgacaagatccagtacta

SEQ ID NO: 422777 - DNA, 25 bp, Rattus norvegicus
ggacctacgacatgatccagtacta

SEQ ID NO: 422778 - DNA, 25 bp, Rattus norvegicus
ggacctacgagaagacagtctgctt

SEQ ID NO: 422779 - DNA, 25 bp, Rattus norvegicus
ggacctacgagatgacagtctgctt

SEQ ID NO: 422780 - DNA, 25 bp, Rattus norvegicus
ggacctacgctccatggcaacagga

SEQ ID NO: 422781 - DNA, 25 bp, Rattus norvegicus
ggacctacgctcgatggcaacagga

SEQ ID NO: 422782 - DNA, 25 bp, Rattus norvegicus
ggacctactcctccaataactatga

SEQ ID NO: 422783 - DNA, 25 bp, Rattus norvegicus
ggacctactcctgcaataactatga

SEQ ID NO: 422784 - DNA, 25 bp, Rattus norvegicus
ggacctactctacgaaagccaccat

SEQ ID NO: 422785 - DNA, 25 bp, Rattus norvegicus
ggacctactctaggaaagccaccat

SEQ ID NO: 422786 - DNA, 25 bp, Rattus norvegicus
ggacctactgatcctattttataac

SEQ ID NO: 422787 - DNA, 25 bp, Rattus norvegicus
ggacctactgatgctattttataac

SEQ ID NO: 422788 - DNA, 25 bp, Rattus norvegicus
ggacctactgtgagccactttgtgt

SEQ ID NO: 422789 - DNA, 25 bp, Rattus norvegicus
ggacctactgtgtgccactttgtgt

SEQ ID NO: 422790 - DNA, 25 bp, Rattus norvegicus
ggacctacttagattgtctttatgt

SEQ ID NO: 422791 - DNA, 25 bp, Rattus norvegicus
ggacctacttagtttgtctttatgt

SEQ ID NO: 422792 - DNA, 25 bp, Rattus norvegicus
ggacctagaaatatgccctgtactt

SEQ ID NO: 422793 - DNA, 25 bp, Rattus norvegicus
ggacctagaaatttgccctgtactt

SEQ ID NO: 422794 - DNA, 25 bp, Rattus norvegicus
ggacctagaagtaccacctattcct

SEQ ID NO: 422795 - DNA, 25 bp, Rattus norvegicus
ggacctagaagttccacctattcct

SEQ ID NO: 422796 - DNA, 25 bp, Rattus norvegicus
ggacctagaatcatctcttttcagc

SEQ ID NO: 422797 - DNA, 25 bp, Rattus norvegicus
ggacctagaatcttctcttttcagc

SEQ ID NO: 422798 - DNA, 25 bp, Rattus norvegicus
ggacctagcatgaagatcctgttaa

SEQ ID NO: 422799 - DNA, 25 bp, Rattus norvegicus
ggacctagcatgtagatcctgttaa

SEQ ID NO: 422800 - DNA, 25 bp, Rattus norvegicus
ggacctagcctacgcacctgtgggt

SEQ ID NO: 422801 - DNA, 25 bp, Rattus norvegicus
ggacctagcctaggcacctgtgggt

SEQ ID NO: 422802 - DNA, 25 bp, Rattus norvegicus
ggacctagctctctagaagacatta

SEQ ID NO: 422803 - DNA, 25 bp, Rattus norvegicus
ggacctagctctgtagaagacatta

SEQ ID NO: 422804 - DNA, 25 bp, Rattus norvegicus
ggacctagctgcatccagagcagaa

SEQ ID NO: 422805 - DNA, 25 bp, Rattus norvegicus
ggacctagctgcttccagagcagaa

SEQ ID NO: 422806 - DNA, 25 bp, Rattus norvegicus
ggacctaggaaacacttcgctacaa

SEQ ID NO: 422807 - DNA, 25 bp, Rattus norvegicus
ggacctaggaaagacttcgctacaa

SEQ ID NO: 422808 - DNA, 25 bp, Rattus norvegicus
ggacctaggcatcccggtggatgcg

SEQ ID NO: 422809 - DNA, 25 bp, Rattus norvegicus
ggacctaggcatgccggtggatgcg

SEQ ID NO: 422810 - DNA, 25 bp, Rattus norvegicus
ggacctaggcctccttgattctttc

SEQ ID NO: 422811 - DNA, 25 bp, Rattus norvegicus
ggacctaggcctgcttgattctttc

SEQ ID NO: 422812 - DNA, 25 bp, Rattus norvegicus
ggacctaggctcaaaaatccagcaa

SEQ ID NO: 422813 - DNA, 25 bp, Rattus norvegicus
ggacctaggctctaaaatccagcaa

SEQ ID NO: 422814 - DNA, 25 bp, Rattus norvegicus
ggacctagtctccttctatggagca

SEQ ID NO: 422815 - DNA, 25 bp, Rattus norvegicus
ggacctagtctcgttctatggagca

SEQ ID NO: 422816 - DNA, 25 bp, Rattus norvegicus
ggacctagtggaaaaattacagact

SEQ ID NO: 422817 - DNA, 25 bp, Rattus norvegicus
ggacctagtggataaattacagact

SEQ ID NO: 422818 - DNA, 25 bp, Rattus norvegicus
ggacctatcacaattgcccttatat

SEQ ID NO: 422819 - DNA, 25 bp, Rattus norvegicus
ggacctatcacatttgcccttatat

SEQ ID NO: 422820 - DNA, 25 bp, Rattus norvegicus
ggacctatcctcatatgcttaacat

SEQ ID NO: 422821 - DNA, 25 bp, Rattus norvegicus
ggacctatcctcttatgcttaacat

SEQ ID NO: 422822 - DNA, 25 bp, Rattus norvegicus
ggacctatctacagctgctgttgtt

SEQ ID NO: 422823 - DNA, 25 bp, Rattus norvegicus
ggacctatctactgctgctgttgtt

SEQ ID NO: 422824 - DNA, 25 bp, Rattus norvegicus
ggacctatctcaatgtcagtgctag

SEQ ID NO: 422825 - DNA, 25 bp, Rattus norvegicus
ggacctatctcattgtcagtgctag

SEQ ID NO: 422826 - DNA, 25 bp, Rattus norvegicus
ggacctatctgaatatagtacttgg

SEQ ID NO: 422827 - DNA, 25 bp, Rattus norvegicus
ggacctatctgacctgcctcatgat

SEQ ID NO: 422828 - DNA, 25 bp, Rattus norvegicus
ggacctatctgagctgcctcatgat

SEQ ID NO: 422829 - DNA, 25 bp, Rattus norvegicus
ggacctatctgattatagtacttgg

SEQ ID NO: 422830 - DNA, 25 bp, Rattus norvegicus
ggacctatgcaacgcacagacactt

SEQ ID NO: 422831 - DNA, 25 bp, Rattus norvegicus
ggacctatgcaaggcacagacactt

SEQ ID NO: 422832 - DNA, 25 bp, Rattus norvegicus
ggacctatgcgtacctaggagctgt

SEQ ID NO: 422833 - DNA, 25 bp, Rattus norvegicus
ggacctatgcgttcctaggagctgt

SEQ ID NO: 422834 - DNA, 25 bp, Rattus norvegicus
ggacctatgggcatgtacttgccta

SEQ ID NO: 422835 - DNA, 25 bp, Rattus norvegicus
ggacctatgggcttgtacttgccta

SEQ ID NO: 422836 - DNA, 25 bp, Rattus norvegicus
ggacctatttggaatggcccacaga

SEQ ID NO: 422837 - DNA, 25 bp, Rattus norvegicus
ggacctatttggtatggcccacaga

SEQ ID NO: 422838 - DNA, 25 bp, Rattus norvegicus
ggacctcaaaaacagctctactagt

SEQ ID NO: 422839 - DNA, 25 bp, Rattus norvegicus
ggacctcaaaaagagctctactagt

SEQ ID NO: 422840 - DNA, 25 bp, Rattus norvegicus
ggacctcaaaggatgaagcccgcga

SEQ ID NO: 422841 - DNA, 25 bp, Rattus norvegicus
ggacctcaaaggttgaagcccgcga

SEQ ID NO: 422842 - DNA, 25 bp, Rattus norvegicus
ggacctcaagcaccatgtgctcatc

SEQ ID NO: 422843 - DNA, 25 bp, Rattus norvegicus
ggacctcaagcagcatgtgctcatc

SEQ ID NO: 422844 - DNA, 25 bp, Rattus norvegicus
ggacctcaagttataacatgcccct

SEQ ID NO: 422845 - DNA, 25 bp, Rattus norvegicus
ggacctcaagttttaacatgcccct

SEQ ID NO: 422846 - DNA, 25 bp, Rattus norvegicus
ggacctcaattcagcacttgggatt

SEQ ID NO: 422847 - DNA, 25 bp, Rattus norvegicus
ggacctcaattctgcacttgggatt

SEQ ID NO: 422848 - DNA, 25 bp, Rattus norvegicus
ggacctcacaggatgttctcgggat

SEQ ID NO: 422849 - DNA, 25 bp, Rattus norvegicus
ggacctcacaggttgttctcgggat

SEQ ID NO: 422850 - DNA, 25 bp, Rattus norvegicus
ggacctcaccctacggtgtgcctgg

SEQ ID NO: 422851 - DNA, 25 bp, Rattus norvegicus
ggacctcacccttcggtgtgcctgg

SEQ ID NO: 422852 - DNA, 25 bp, Rattus norvegicus
ggacctcaccgaattcgatcagtat

SEQ ID NO: 422853 - DNA, 25 bp, Rattus norvegicus
ggacctcaccgatttcgatcagtat

SEQ ID NO: 422854 - DNA, 25 bp, Rattus norvegicus
ggacctcacggcaagctaagtaact

SEQ ID NO: 422855 - DNA, 25 bp, Rattus norvegicus
ggacctcacggctagctaagtaact

SEQ ID NO: 422856 - DNA, 25 bp, Rattus norvegicus
ggacctcactataacagacaggctg

SEQ ID NO: 422857 - DNA, 25 bp, Rattus norvegicus
ggacctcactattacagacaggctg

SEQ ID NO: 422858 - DNA, 25 bp, Rattus norvegicus
ggacctcactttccatatttcagta

SEQ ID NO: 422859 - DNA, 25 bp, Rattus norvegicus
ggacctcactttgcatatttcagta

SEQ ID NO: 422860 - DNA, 25 bp, Rattus norvegicus
ggacctcagagtcctccaaagaatc

SEQ ID NO: 422861 - DNA, 25 bp, Rattus norvegicus
ggacctcagagtgctccaaagaatc

SEQ ID NO: 422862 - DNA, 25 bp, Rattus norvegicus
ggacctcagcctctatttatttgta

SEQ ID NO: 422863 - DNA, 25 bp, Rattus norvegicus
ggacctcagcctgtatttatttgta

SEQ ID NO: 422864 - DNA, 25 bp, Rattus norvegicus
ggacctcagcggcatagtctctaaa

SEQ ID NO: 422865 - DNA, 25 bp, Rattus norvegicus
ggacctcagcgggatagtctctaaa

SEQ ID NO: 422866 - DNA, 25 bp, Rattus norvegicus
ggacctcatagacttggtctgctca

SEQ ID NO: 422867 - DNA, 25 bp, Rattus norvegicus
ggacctcatagagttggtctgctca

SEQ ID NO: 422868 - DNA, 25 bp, Rattus norvegicus
ggacctcatcacacacatcaacggg

SEQ ID NO: 422869 - DNA, 25 bp, Rattus norvegicus
ggacctcatcactcacatcaacggg

SEQ ID NO: 422870 - DNA, 25 bp, Rattus norvegicus
ggacctcatcagagcacaatttctt

SEQ ID NO: 422871 - DNA, 25 bp, Rattus norvegicus
ggacctcatcagtgcacaatttctt

SEQ ID NO: 422872 - DNA, 25 bp, Rattus norvegicus
ggacctcatctcacgttagtcacaa

SEQ ID NO: 422873 - DNA, 25 bp, Rattus norvegicus
ggacctcatctctcgttagtcacaa

SEQ ID NO: 422874 - DNA, 25 bp, Rattus norvegicus
ggacctcatctgcattttaagctgt

SEQ ID NO: 422875 - DNA, 25 bp, Rattus norvegicus
ggacctcatctggattttaagctgt

SEQ ID NO: 422876 - DNA, 25 bp, Rattus norvegicus
ggacctcatggacgatggctccttg

SEQ ID NO: 422877 - DNA, 25 bp, Rattus norvegicus
ggacctcatggaggatggctccttg

SEQ ID NO: 422878 - DNA, 25 bp, Rattus norvegicus
ggacctcattgacaccaaggcggag

SEQ ID NO: 422879 - DNA, 25 bp, Rattus norvegicus
ggacctcattgagaccaaggcggag

SEQ ID NO: 422880 - DNA, 25 bp, Rattus norvegicus
ggacctccaaggctcttgaacaaca

SEQ ID NO: 422881 - DNA, 25 bp, Rattus norvegicus
ggacctccaagggtcttgaacaaca

SEQ ID NO: 422882 - DNA, 25 bp, Rattus norvegicus
ggacctccagatctatgacacagta

SEQ ID NO: 422883 - DNA, 25 bp, Rattus norvegicus
ggacctccagatgtatgacacagta

SEQ ID NO: 422884 - DNA, 25 bp, Rattus norvegicus
ggacctccaggtcttgatctgtaca

SEQ ID NO: 422885 - DNA, 25 bp, Rattus norvegicus
ggacctccaggtgttgatctgtaca

SEQ ID NO: 422886 - DNA, 25 bp, Rattus norvegicus
ggacctccatcccaatgggctctag

SEQ ID NO: 422887 - DNA, 25 bp, Rattus norvegicus
ggacctccatccgaatgggctctag

SEQ ID NO: 422888 - DNA, 25 bp, Rattus norvegicus
ggacctcccttcatgcctcagagga

SEQ ID NO: 422889 - DNA, 25 bp, Rattus norvegicus
ggacctcccttcttgcctcagagga

SEQ ID NO: 422890 - DNA, 25 bp, Rattus norvegicus
ggacctccgagcacttagattttta

SEQ ID NO: 422891 - DNA, 25 bp, Rattus norvegicus
ggacctccgagctcttagattttta

SEQ ID NO: 422892 - DNA, 25 bp, Rattus norvegicus
ggacctccgggaagacatatgcagt

SEQ ID NO: 422893 - DNA, 25 bp, Rattus norvegicus
ggacctccgggatgacatatgcagt

SEQ ID NO: 422894 - DNA, 25 bp, Rattus norvegicus
ggacctcctaaactcagtcagtgtt

SEQ ID NO: 422895 - DNA, 25 bp, Rattus norvegicus
ggacctcctaaagtcagtcagtgtt

SEQ ID NO: 422896 - DNA, 25 bp, Rattus norvegicus
ggacctcctataaattcctatggga

SEQ ID NO: 422897 - DNA, 25 bp, Rattus norvegicus
ggacctcctatatattcctatggga

SEQ ID NO: 422898 - DNA, 25 bp, Rattus norvegicus
ggacctcctcagagccgaaaacaat

SEQ ID NO: 422899 - DNA, 25 bp, Rattus norvegicus
ggacctcctcagtgccgaaaacaat

SEQ ID NO: 422900 - DNA, 25 bp, Rattus norvegicus
ggacctcctggaatagctcttctga

SEQ ID NO: 422901 - DNA, 25 bp, Rattus norvegicus
ggacctcctggattagctcttctga

SEQ ID NO: 422902 - DNA, 25 bp, Rattus norvegicus
ggacctcctgtacaagtcaccgatg

SEQ ID NO: 422903 - DNA, 25 bp, Rattus norvegicus
ggacctcctgtactttgtctatacc

SEQ ID NO: 422904 - DNA, 25 bp, Rattus norvegicus
ggacctcctgtagaagtcaccgatg

SEQ ID NO: 422905 - DNA, 25 bp, Rattus norvegicus
ggacctcctgtagtttgtctatacc

SEQ ID NO: 422906 - DNA, 25 bp, Rattus norvegicus
ggacctcgacatactttttgcattg

SEQ ID NO: 422907 - DNA, 25 bp, Rattus norvegicus
ggacctcgacattctttttgcattg

SEQ ID NO: 422908 - DNA, 25 bp, Rattus norvegicus
ggacctcgacctcaaaaccagtggg

SEQ ID NO: 422909 - DNA, 25 bp, Rattus norvegicus
ggacctcgacctgaaaaccagtggg

SEQ ID NO: 422910 - DNA, 25 bp, Rattus norvegicus
ggacctcgacgccagagtacaatgt

SEQ ID NO: 422911 - DNA, 25 bp, Rattus norvegicus
ggacctcgacgcgagagtacaatgt

SEQ ID NO: 422912 - DNA, 25 bp, Rattus norvegicus
ggacctcggaggctgagaacttact

SEQ ID NO: 422913 - DNA, 25 bp, Rattus norvegicus
ggacctcggagggtgagaacttact

SEQ ID NO: 422914 - DNA, 25 bp, Rattus norvegicus
ggacctcggcctaaaaatgccagtt

SEQ ID NO: 422915 - DNA, 25 bp, Rattus norvegicus
ggacctcggccttaaaatgccagtt

SEQ ID NO: 422916 - DNA, 25 bp, Rattus norvegicus
ggacctcggtagagagctccttgga

SEQ ID NO: 422917 - DNA, 25 bp, Rattus norvegicus
ggacctcggtagtgagctccttgga

SEQ ID NO: 422918 - DNA, 25 bp, Rattus norvegicus
ggacctcgtgctatctaactgtaga

SEQ ID NO: 422919 - DNA, 25 bp, Rattus norvegicus
ggacctcgtgctttctaactgtaga

SEQ ID NO: 422920 - DNA, 25 bp, Rattus norvegicus
ggacctcgtggaagccacagcagcc

SEQ ID NO: 422921 - DNA, 25 bp, Rattus norvegicus
ggacctcgtggatgccacagcagcc

SEQ ID NO: 422922 - DNA, 25 bp, Rattus norvegicus
ggacctcgtgtgagtcccttaaggg

SEQ ID NO: 422923 - DNA, 25 bp, Rattus norvegicus
ggacctcgtgtgtgtcccttaaggg

SEQ ID NO: 422924 - DNA, 25 bp, Rattus norvegicus
ggacctcgttttctcttaaatctca

SEQ ID NO: 422925 - DNA, 25 bp, Rattus norvegicus
ggacctcgttttgtcttaaatctca

SEQ ID NO: 422926 - DNA, 25 bp, Rattus norvegicus
ggacctctacaaccactgcggagga

SEQ ID NO: 422927 - DNA, 25 bp, Rattus norvegicus
ggacctctacaagcactgcggagga

SEQ ID NO: 422928 - DNA, 25 bp, Rattus norvegicus
ggacctctaggtcacaactgaacat

SEQ ID NO: 422929 - DNA, 25 bp, Rattus norvegicus
ggacctctaggtgacaactgaacat

SEQ ID NO: 422930 - DNA, 25 bp, Rattus norvegicus
ggacctctatgaagccattgacagt

SEQ ID NO: 422931 - DNA, 25 bp, Rattus norvegicus
ggacctctatgatgccattgacagt

SEQ ID NO: 422932 - DNA, 25 bp, Rattus norvegicus
ggacctctcagaagagtcggctgat

SEQ ID NO: 422933 - DNA, 25 bp, Rattus norvegicus
ggacctctcagatgagtcggctgat

SEQ ID NO: 422934 - DNA, 25 bp, Rattus norvegicus
ggacctctcggacttgagcatggaa

SEQ ID NO: 422935 - DNA, 25 bp, Rattus norvegicus
ggacctctcggagttgagcatggaa

SEQ ID NO: 422936 - DNA, 25 bp, Rattus norvegicus
ggacctctgactatcttgggttggt

SEQ ID NO: 422937 - DNA, 25 bp, Rattus norvegicus
ggacctctgactttcttgggttggt

SEQ ID NO: 422938 - DNA, 25 bp, Rattus norvegicus
ggacctctggagagaaccccatcca

SEQ ID NO: 422939 - DNA, 25 bp, Rattus norvegicus
ggacctctggagtgaaccccatcca

SEQ ID NO: 422940 - DNA, 25 bp, Rattus norvegicus
ggacctctgggtcaagagcctatct

SEQ ID NO: 422941 - DNA, 25 bp, Rattus norvegicus
ggacctctgggtgaagagcctatct

SEQ ID NO: 422942 - DNA, 25 bp, Rattus norvegicus
ggacctctggtaacaggatcccaag

SEQ ID NO: 422943 - DNA, 25 bp, Rattus norvegicus
ggacctctggtatcaggatcccaag

SEQ ID NO: 422944 - DNA, 25 bp, Rattus norvegicus
ggacctctgtatatgatcttttgta

SEQ ID NO: 422945 - DNA, 25 bp, Rattus norvegicus
ggacctctgtatttgatcttttgta

SEQ ID NO: 422946 - DNA, 25 bp, Rattus norvegicus
ggacctctgtggcatttgcacaata

SEQ ID NO: 422947 - DNA, 25 bp, Rattus norvegicus
ggacctctgtgggatttgcacaata

SEQ ID NO: 422948 - DNA, 25 bp, Rattus norvegicus
ggacctctgtttccctcgaagcgaa

SEQ ID NO: 422949 - DNA, 25 bp, Rattus norvegicus
ggacctctgtttgcctcgaagcgaa

SEQ ID NO: 422950 - DNA, 25 bp, Rattus norvegicus
ggacctcttgacagggaatttctgc

SEQ ID NO: 422951 - DNA, 25 bp, Rattus norvegicus
ggacctcttgactgggaatttctgc

SEQ ID NO: 422952 - DNA, 25 bp, Rattus norvegicus
ggacctgaaagacatgaagaagcta

SEQ ID NO: 422953 - DNA, 25 bp, Rattus norvegicus
ggacctgaaagagatgaagaagcta

SEQ ID NO: 422954 - DNA, 25 bp, Rattus norvegicus
ggacctgaaccgacagcttctggat

SEQ ID NO: 422955 - DNA, 25 bp, Rattus norvegicus
ggacctgaaccgtcagcttctggat

SEQ ID NO: 422956 - DNA, 25 bp, Rattus norvegicus
ggacctgaacctcacctaaagtctt

SEQ ID NO: 422957 - DNA, 25 bp, Rattus norvegicus
ggacctgaacctgacctaaagtctt

SEQ ID NO: 422958 - DNA, 25 bp, Rattus norvegicus
ggacctgaagcgaaattttgcccat

SEQ ID NO: 422959 - DNA, 25 bp, Rattus norvegicus
ggacctgaagcgtaattttgcccat

SEQ ID NO: 422960 - DNA, 25 bp, Rattus norvegicus
ggacctgaatttatgccttactgta

SEQ ID NO: 422961 - DNA, 25 bp, Rattus norvegicus
ggacctgaatttttgccttactgta

SEQ ID NO: 422962 - DNA, 25 bp, Rattus norvegicus
ggacctgacaggaaagggcctccta

SEQ ID NO: 422963 - DNA, 25 bp, Rattus norvegicus
ggacctgacaggcaacatcgactac

SEQ ID NO: 422964 - DNA, 25 bp, Rattus norvegicus
ggacctgacagggaacatcgactac

SEQ ID NO: 422965 - DNA, 25 bp, Rattus norvegicus
ggacctgacaggtaagggcctccta

SEQ ID NO: 422966 - DNA, 25 bp, Rattus norvegicus
ggacctgacattcaccacagtggcc

SEQ ID NO: 422967 - DNA, 25 bp, Rattus norvegicus
ggacctgacattgaccacagtggcc

SEQ ID NO: 422968 - DNA, 25 bp, Rattus norvegicus
ggacctgacccacactgaatgtagt

SEQ ID NO: 422969 - DNA, 25 bp, Rattus norvegicus
ggacctgacccagactgaatgtagt

SEQ ID NO: 422970 - DNA, 25 bp, Rattus norvegicus
ggacctgaccgaaagattatagaat

SEQ ID NO: 422971 - DNA, 25 bp, Rattus norvegicus
ggacctgaccgatagattatagaat

SEQ ID NO: 422972 - DNA, 25 bp, Rattus norvegicus
ggacctgactcacaatgactctgtt

SEQ ID NO: 422973 - DNA, 25 bp, Rattus norvegicus
ggacctgactcagaatgactctgtt

SEQ ID NO: 422974 - DNA, 25 bp, Rattus norvegicus
ggacctgactgtactctagacctga

SEQ ID NO: 422975 - DNA, 25 bp, Rattus norvegicus
ggacctgactgttctctagacctga

SEQ ID NO: 422976 - DNA, 25 bp, Rattus norvegicus
ggacctgagacaagctttccgaagc

SEQ ID NO: 422977 - DNA, 25 bp, Rattus norvegicus
ggacctgagacatgctttccgaagc

SEQ ID NO: 422978 - DNA, 25 bp, Rattus norvegicus
ggacctgagctcatagctgaaccca

SEQ ID NO: 422979 - DNA, 25 bp, Rattus norvegicus
ggacctgagctcttagctgaaccca

SEQ ID NO: 422980 - DNA, 25 bp, Rattus norvegicus
ggacctgagctgattgtagcctttt

SEQ ID NO: 422981 - DNA, 25 bp, Rattus norvegicus
ggacctgagctgtttgtagcctttt

SEQ ID NO: 422982 - DNA, 25 bp, Rattus norvegicus
ggacctgaggcaacagtagctatat

SEQ ID NO: 422983 - DNA, 25 bp, Rattus norvegicus
ggacctgaggcatcagtagctatat

SEQ ID NO: 422984 - DNA, 25 bp, Rattus norvegicus
ggacctgatcaccttttttgacgaa

SEQ ID NO: 422985 - DNA, 25 bp, Rattus norvegicus
ggacctgatcacgttttttgacgaa

SEQ ID NO: 422986 - DNA, 25 bp, Rattus norvegicus
ggacctgatggccatattccagcaa

SEQ ID NO: 422987 - DNA, 25 bp, Rattus norvegicus
ggacctgatggcgatattccagcaa

SEQ ID NO: 422988 - DNA, 25 bp, Rattus norvegicus
ggacctgatgtcagctttgataaca

SEQ ID NO: 422989 - DNA, 25 bp, Rattus norvegicus
ggacctgatgtctgctttgataaca

SEQ ID NO: 422990 - DNA, 25 bp, Rattus norvegicus
ggacctgcacaaccagagccagctg

SEQ ID NO: 422991 - DNA, 25 bp, Rattus norvegicus
ggacctgcacaacttacagggacaa

SEQ ID NO: 422992 - DNA, 25 bp, Rattus norvegicus
ggacctgcacaagcagagccagctg

SEQ ID NO: 422993 - DNA, 25 bp, Rattus norvegicus
ggacctgcacaagttacagggacaa

SEQ ID NO: 422994 - DNA, 25 bp, Rattus norvegicus
ggacctgcacgcaagggcaaaatga

SEQ ID NO: 422995 - DNA, 25 bp, Rattus norvegicus
ggacctgcacgctagggcaaaatga

SEQ ID NO: 422996 - DNA, 25 bp, Rattus norvegicus
ggacctgcaggtcatttagcctttt

SEQ ID NO: 422997 - DNA, 25 bp, Rattus norvegicus
ggacctgcaggtgatttagcctttt

SEQ ID NO: 422998 - DNA, 25 bp, Rattus norvegicus
ggacctgcatgtaaagacggactca

SEQ ID NO: 422999 - DNA, 25 bp, Rattus norvegicus
ggacctgcatgttaagacggactca

SEQ ID NO: 423000 - DNA, 25 bp, Rattus norvegicus
ggacctgcattgaatgggacctgaa

SEQ ID NO: 423001 - DNA, 25 bp, Rattus norvegicus
ggacctgcattgtatgggacctgaa

SEQ ID NO: 423002 - DNA, 25 bp, Rattus norvegicus
ggacctgccagaagctatacagtgt

SEQ ID NO: 423003 - DNA, 25 bp, Rattus norvegicus
ggacctgccagatgctatacagtgt

SEQ ID NO: 423004 - DNA, 25 bp, Rattus norvegicus
ggacctgccattagactctgacaga

SEQ ID NO: 423005 - DNA, 25 bp, Rattus norvegicus
ggacctgccatttgactctgacaga

SEQ ID NO: 423006 - DNA, 25 bp, Rattus norvegicus
ggacctgcccttcatgctgtaggag

SEQ ID NO: 423007 - DNA, 25 bp, Rattus norvegicus
ggacctgcccttgatgctgtaggag

SEQ ID NO: 423008 - DNA, 25 bp, Rattus norvegicus
ggacctgccgatcacattacagttt

SEQ ID NO: 423009 - DNA, 25 bp, Rattus norvegicus
ggacctgccgatgacattacagttt

SEQ ID NO: 423010 - DNA, 25 bp, Rattus norvegicus
ggacctgccgcacctattttagctg

SEQ ID NO: 423011 - DNA, 25 bp, Rattus norvegicus
ggacctgccgcagctattttagctg

SEQ ID NO: 423012 - DNA, 25 bp, Rattus norvegicus
ggacctgccgtcaattatgctgtga

SEQ ID NO: 423013 - DNA, 25 bp, Rattus norvegicus
ggacctgccgtctattatgctgtga

SEQ ID NO: 423014 - DNA, 25 bp, Rattus norvegicus
ggacctgcctctcaagcagagcagc

SEQ ID NO: 423015 - DNA, 25 bp, Rattus norvegicus
ggacctgcctctgaagcagagcagc

SEQ ID NO: 423016 - DNA, 25 bp, Rattus norvegicus
ggacctgcctgccagtgtaaatttg

SEQ ID NO: 423017 - DNA, 25 bp, Rattus norvegicus
ggacctgcctgcgagtgtaaatttg

SEQ ID NO: 423018 - DNA, 25 bp, Rattus norvegicus
ggacctgccttcattatttcttcaa

SEQ ID NO: 423019 - DNA, 25 bp, Rattus norvegicus
ggacctgccttctttatttcttcaa

SEQ ID NO: 423020 - DNA, 25 bp, Rattus norvegicus
ggacctgctgcacccattttaattc

SEQ ID NO: 423021 - DNA, 25 bp, Rattus norvegicus
ggacctgctgcagccattttaattc

SEQ ID NO: 423022 - DNA, 25 bp, Rattus norvegicus
ggacctgcttctcttactaggttgc

SEQ ID NO: 423023 - DNA, 25 bp, Rattus norvegicus
ggacctgcttctgttactaggttgc

SEQ ID NO: 423024 - DNA, 25 bp, Rattus norvegicus
ggacctgcttgccagaggccttacc

SEQ ID NO: 423025 - DNA, 25 bp, Rattus norvegicus
ggacctgcttgcgagaggccttacc

SEQ ID NO: 423026 - DNA, 25 bp, Rattus norvegicus
ggacctggactacgcgtaattccaa

SEQ ID NO: 423027 - DNA, 25 bp, Rattus norvegicus
ggacctggactaggcgtaattccaa

SEQ ID NO: 423028 - DNA, 25 bp, Rattus norvegicus
ggacctggagagcacatcatgtcaa

SEQ ID NO: 423029 - DNA, 25 bp, Rattus norvegicus
ggacctggagaggacatcatgtcaa

SEQ ID NO: 423030 - DNA, 25 bp, Rattus norvegicus
ggacctggagttacactgggattct

SEQ ID NO: 423031 - DNA, 25 bp, Rattus norvegicus
ggacctggagtttcactgggattct

SEQ ID NO: 423032 - DNA, 25 bp, Rattus norvegicus
ggacctggatgcatctgggatcaca

SEQ ID NO: 423033 - DNA, 25 bp, Rattus norvegicus
ggacctggatgcttctgggatcaca

SEQ ID NO: 423034 - DNA, 25 bp, Rattus norvegicus
ggacctggatgtagagtgcacccta

SEQ ID NO: 423035 - DNA, 25 bp, Rattus norvegicus
ggacctggatgttgagtgcacccta

SEQ ID NO: 423036 - DNA, 25 bp, Rattus norvegicus
ggacctggcaagagagtttctacct

SEQ ID NO: 423037 - DNA, 25 bp, Rattus norvegicus
ggacctggcaagtgagtttctacct

SEQ ID NO: 423038 - DNA, 25 bp, Rattus norvegicus
ggacctggccaccaaaatcaatgaa

SEQ ID NO: 423039 - DNA, 25 bp, Rattus norvegicus
ggacctggccacgaaaatcaatgaa

SEQ ID NO: 423040 - DNA, 25 bp, Rattus norvegicus
ggacctggcgccaccgttaggctag

SEQ ID NO: 423041 - DNA, 25 bp, Rattus norvegicus
ggacctggcgcctccgttaggctag

SEQ ID NO: 423042 - DNA, 25 bp, Rattus norvegicus
ggacctggctaacggacattcggcc

SEQ ID NO: 423043 - DNA, 25 bp, Rattus norvegicus
ggacctggctaagggacattcggcc

SEQ ID NO: 423044 - DNA, 25 bp, Rattus norvegicus
ggacctggctgcagacataatgcta

SEQ ID NO: 423045 - DNA, 25 bp, Rattus norvegicus
ggacctggctgctgacataatgcta

SEQ ID NO: 423046 - DNA, 25 bp, Rattus norvegicus
ggacctggctgtccgaataaagcta

SEQ ID NO: 423047 - DNA, 25 bp, Rattus norvegicus
ggacctggctgtgcgaataaagcta

SEQ ID NO: 423048 - DNA, 25 bp, Rattus norvegicus
ggacctgggactcgtggcaccaact

SEQ ID NO: 423049 - DNA, 25 bp, Rattus norvegicus
ggacctgggactggtggcaccaact

SEQ ID NO: 423050 - DNA, 25 bp, Rattus norvegicus
ggacctgggatcatagcaccacatg

SEQ ID NO: 423051 - DNA, 25 bp, Rattus norvegicus
ggacctgggatcttagcaccacatg

SEQ ID NO: 423052 - DNA, 25 bp, Rattus norvegicus
ggacctgggatgagagctcgccttt

SEQ ID NO: 423053 - DNA, 25 bp, Rattus norvegicus
ggacctgggatgtgagctcgccttt

SEQ ID NO: 423054 - DNA, 25 bp, Rattus norvegicus
ggacctgggctgatttgtgctatct

SEQ ID NO: 423055 - DNA, 25 bp, Rattus norvegicus
ggacctgggctgttttgtgctatct

SEQ ID NO: 423056 - DNA, 25 bp, Rattus norvegicus
ggacctgggtaacagattatcttcc

SEQ ID NO: 423057 - DNA, 25 bp, Rattus norvegicus
ggacctgggtaagagattatcttcc

SEQ ID NO: 423058 - DNA, 25 bp, Rattus norvegicus
ggacctgggtgaatagagctcatct

SEQ ID NO: 423059 - DNA, 25 bp, Rattus norvegicus
ggacctgggtgattagagctcatct

SEQ ID NO: 423060 - DNA, 25 bp, Rattus norvegicus
ggacctgggtttctgactttactgt

SEQ ID NO: 423061 - DNA, 25 bp, Rattus norvegicus
ggacctgggtttgtgactttactgt

SEQ ID NO: 423062 - DNA, 25 bp, Rattus norvegicus
ggacctggtctacatgctgactggc

SEQ ID NO: 423063 - DNA, 25 bp, Rattus norvegicus
ggacctggtctagatgctgactggc

SEQ ID NO: 423064 - DNA, 25 bp, Rattus norvegicus
ggacctggtgccctgctttgaaacc

SEQ ID NO: 423065 - DNA, 25 bp, Rattus norvegicus
ggacctggtgccgtgctttgaaacc

SEQ ID NO: 423066 - DNA, 25 bp, Rattus norvegicus
ggacctgtaccaaatggactcataa

SEQ ID NO: 423067 - DNA, 25 bp, Rattus norvegicus
ggacctgtaccatatggactcataa

SEQ ID NO: 423068 - DNA, 25 bp, Rattus norvegicus
ggacctgtaggcactgctgtgttac

SEQ ID NO: 423069 - DNA, 25 bp, Rattus norvegicus
ggacctgtaggctctgctgtgttac

SEQ ID NO: 423070 - DNA, 25 bp, Rattus norvegicus
ggacctgtatgtaccccagaaactg

SEQ ID NO: 423071 - DNA, 25 bp, Rattus norvegicus
ggacctgtatgttccccagaaactg

SEQ ID NO: 423072 - DNA, 25 bp, Rattus norvegicus
ggacctgtccaactgttggcacgaa

SEQ ID NO: 423073 - DNA, 25 bp, Rattus norvegicus
ggacctgtccaagtgttggcacgaa

SEQ ID NO: 423074 - DNA, 25 bp, Rattus norvegicus
ggacctgtccacctcaaaggactga

SEQ ID NO: 423075 - DNA, 25 bp, Rattus norvegicus
ggacctgtccacgtcaaaggactga

SEQ ID NO: 423076 - DNA, 25 bp, Rattus norvegicus
ggacctgtccctatggaagcaagtg

SEQ ID NO: 423077 - DNA, 25 bp, Rattus norvegicus
ggacctgtccctttggaagcaagtg

SEQ ID NO: 423078 - DNA, 25 bp, Rattus norvegicus
ggacctgtccgactgttggcaagca

SEQ ID NO: 423079 - DNA, 25 bp, Rattus norvegicus
ggacctgtccgagtgttggcaagca

SEQ ID NO: 423080 - DNA, 25 bp, Rattus norvegicus
ggacctgtccttacatattgtggcc

SEQ ID NO: 423081 - DNA, 25 bp, Rattus norvegicus
ggacctgtcctttcatattgtggcc

SEQ ID NO: 423082 - DNA, 25 bp, Rattus norvegicus
ggacctgtgagccatgcttgactag

SEQ ID NO: 423083 - DNA, 25 bp, Rattus norvegicus
ggacctgtgagcgatgcttgactag

SEQ ID NO: 423084 - DNA, 25 bp, Rattus norvegicus
ggacctgtgcaacagagcgcgacaa

SEQ ID NO: 423085 - DNA, 25 bp, Rattus norvegicus
ggacctgtgcaagagagcgcgacaa

SEQ ID NO: 423086 - DNA, 25 bp, Rattus norvegicus
ggacctgtgcatcgccgtgtgatca

SEQ ID NO: 423087 - DNA, 25 bp, Rattus norvegicus
ggacctgtgcatggccgtgtgatca

SEQ ID NO: 423088 - DNA, 25 bp, Rattus norvegicus
ggacctgtgggtactgcatgtgttc

SEQ ID NO: 423089 - DNA, 25 bp, Rattus norvegicus
ggacctgtgggttctgcatgtgttc

SEQ ID NO: 423090 - DNA, 25 bp, Rattus norvegicus
ggacctgtgtgcaagatgtgcattt

SEQ ID NO: 423091 - DNA, 25 bp, Rattus norvegicus
ggacctgtgtgctagatgtgcattt

SEQ ID NO: 423092 - DNA, 25 bp, Rattus norvegicus
ggacctgtgtttaattccacaccag

SEQ ID NO: 423093 - DNA, 25 bp, Rattus norvegicus
ggacctgtgttttattccacaccag

SEQ ID NO: 423094 - DNA, 25 bp, Rattus norvegicus
ggacctgttcagactgttggtgaca

SEQ ID NO: 423095 - DNA, 25 bp, Rattus norvegicus
ggacctgttcagtctgttggtgaca

SEQ ID NO: 423096 - DNA, 25 bp, Rattus norvegicus
ggacctgttccacgaggacctgtat

SEQ ID NO: 423097 - DNA, 25 bp, Rattus norvegicus
ggacctgttccaggaggacctgtat

SEQ ID NO: 423098 - DNA, 25 bp, Rattus norvegicus
ggacctgttggcaccgcctgacggt

SEQ ID NO: 423099 - DNA, 25 bp, Rattus norvegicus
ggacctgttggctccgcctgacggt

SEQ ID NO: 423100 - DNA, 25 bp, Rattus norvegicus
ggacctgtttgacgcgcgcagttat

SEQ ID NO: 423101 - DNA, 25 bp, Rattus norvegicus
ggacctgtttgaggcgcgcagttat

SEQ ID NO: 423102 - DNA, 25 bp, Rattus norvegicus
ggaccttaacataatttctcggaca

SEQ ID NO: 423103 - DNA, 25 bp, Rattus norvegicus
ggaccttaacattatttctcggaca

SEQ ID NO: 423104 - DNA, 25 bp, Rattus norvegicus
ggaccttaactcactgcataattgt

SEQ ID NO: 423105 - DNA, 25 bp, Rattus norvegicus
ggaccttaactctctgcataattgt

SEQ ID NO: 423106 - DNA, 25 bp, Rattus norvegicus
ggaccttaagccagaagcgcactag

SEQ ID NO: 423107 - DNA, 25 bp, Rattus norvegicus
ggaccttaagcctgaagcgcactag

SEQ ID NO: 423108 - DNA, 25 bp, Rattus norvegicus
ggaccttaaggtcagtggcattatc

SEQ ID NO: 423109 - DNA, 25 bp, Rattus norvegicus
ggaccttaaggtgagtggcattatc

SEQ ID NO: 423110 - DNA, 25 bp, Rattus norvegicus
ggaccttacaacctagcagtgcctt

SEQ ID NO: 423111 - DNA, 25 bp, Rattus norvegicus
ggaccttacaacgtagcagtgcctt

SEQ ID NO: 423112 - DNA, 25 bp, Rattus norvegicus
ggaccttacccaaaatacagtgctg

SEQ ID NO: 423113 - DNA, 25 bp, Rattus norvegicus
ggaccttacccataatacagtgctg

SEQ ID NO: 423114 - DNA, 25 bp, Rattus norvegicus
ggaccttaccttccaagaacatgaa

SEQ ID NO: 423115 - DNA, 25 bp, Rattus norvegicus
ggaccttaccttgcaagaacatgaa

SEQ ID NO: 423116 - DNA, 25 bp, Rattus norvegicus
ggaccttactcaaccagtagaagat

SEQ ID NO: 423117 - DNA, 25 bp, Rattus norvegicus
ggaccttactcatccagtagaagat

SEQ ID NO: 423118 - DNA, 25 bp, Rattus norvegicus
ggaccttactccagacttagaggac

SEQ ID NO: 423119 - DNA, 25 bp, Rattus norvegicus
ggaccttactcctgacttagaggac

SEQ ID NO: 423120 - DNA, 25 bp, Rattus norvegicus
ggaccttagcatatctacatggagt

SEQ ID NO: 423121 - DNA, 25 bp, Rattus norvegicus
ggaccttagcatttctacatggagt

SEQ ID NO: 423122 - DNA, 25 bp, Rattus norvegicus
ggaccttagcgcaagaagaactgtt

SEQ ID NO: 423123 - DNA, 25 bp, Rattus norvegicus
ggaccttagcgctagaagaactgtt

SEQ ID NO: 423124 - DNA, 25 bp, Rattus norvegicus
ggaccttatgaacaccaggaatatg

SEQ ID NO: 423125 - DNA, 25 bp, Rattus norvegicus
ggaccttatgaagaccaggaatatg

SEQ ID NO: 423126 - DNA, 25 bp, Rattus norvegicus
ggaccttcactgcatacagaccttc

SEQ ID NO: 423127 - DNA, 25 bp, Rattus norvegicus
ggaccttcactggatacagaccttc

SEQ ID NO: 423128 - DNA, 25 bp, Rattus norvegicus
ggaccttcagagatacgacagtgat

SEQ ID NO: 423129 - DNA, 25 bp, Rattus norvegicus
ggaccttcagagttacgacagtgat

SEQ ID NO: 423130 - DNA, 25 bp, Rattus norvegicus
ggaccttcaggcatgaacagataat

SEQ ID NO: 423131 - DNA, 25 bp, Rattus norvegicus
ggaccttcaggcttgaacagataat

SEQ ID NO: 423132 - DNA, 25 bp, Rattus norvegicus
ggaccttcatgtcgcttgaacctgt

SEQ ID NO: 423133 - DNA, 25 bp, Rattus norvegicus
ggaccttcatgtggcttgaacctgt

SEQ ID NO: 423134 - DNA, 25 bp, Rattus norvegicus
ggaccttcctcaaccgggagagcag

SEQ ID NO: 423135 - DNA, 25 bp, Rattus norvegicus
ggaccttcctcaagcagtgacaact

SEQ ID NO: 423136 - DNA, 25 bp, Rattus norvegicus
ggaccttcctcatccgggagagcag

SEQ ID NO: 423137 - DNA, 25 bp, Rattus norvegicus
ggaccttcctcatgcagtgacaact

SEQ ID NO: 423138 - DNA, 25 bp, Rattus norvegicus
ggaccttcctttagcattcagattg

SEQ ID NO: 423139 - DNA, 25 bp, Rattus norvegicus
ggaccttcctttattcaatatgcaa

SEQ ID NO: 423140 - DNA, 25 bp, Rattus norvegicus
ggaccttccttttgcattcagattg

SEQ ID NO: 423141 - DNA, 25 bp, Rattus norvegicus
ggaccttccttttttcaatatgcaa

SEQ ID NO: 423142 - DNA, 25 bp, Rattus norvegicus
ggaccttcgggaacaggcattcaga

SEQ ID NO: 423143 - DNA, 25 bp, Rattus norvegicus
ggaccttcgggatcaggcattcaga

SEQ ID NO: 423144 - DNA, 25 bp, Rattus norvegicus
ggaccttctccaaaacatactttgt

SEQ ID NO: 423145 - DNA, 25 bp, Rattus norvegicus
ggaccttctccataacatactttgt

SEQ ID NO: 423146 - DNA, 25 bp, Rattus norvegicus
ggaccttctcctctaacgtaattag

SEQ ID NO: 423147 - DNA, 25 bp, Rattus norvegicus
ggaccttctcctctgggtttcagta

SEQ ID NO: 423148 - DNA, 25 bp, Rattus norvegicus
ggaccttctcctgtaacgtaattag

SEQ ID NO: 423149 - DNA, 25 bp, Rattus norvegicus
ggaccttctcctgtgggtttcagta

SEQ ID NO: 423150 - DNA, 25 bp, Rattus norvegicus
ggaccttctgaactcttagtgggaa

SEQ ID NO: 423151 - DNA, 25 bp, Rattus norvegicus
ggaccttctgaagtcttagtgggaa

SEQ ID NO: 423152 - DNA, 25 bp, Rattus norvegicus
ggaccttctgcaaacctgtttagaa

SEQ ID NO: 423153 - DNA, 25 bp, Rattus norvegicus
ggaccttctgcatacctgtttagaa

SEQ ID NO: 423154 - DNA, 25 bp, Rattus norvegicus
ggaccttctggtcctgagcacatga

SEQ ID NO: 423155 - DNA, 25 bp, Rattus norvegicus
ggaccttctggtgctgagcacatga

SEQ ID NO: 423156 - DNA, 25 bp, Rattus norvegicus
ggaccttgactcaggacagtgactc

SEQ ID NO: 423157 - DNA, 25 bp, Rattus norvegicus
ggaccttgactctggacagtgactc

SEQ ID NO: 423158 - DNA, 25 bp, Rattus norvegicus
ggaccttgagataacctggctttgc

SEQ ID NO: 423159 - DNA, 25 bp, Rattus norvegicus
ggaccttgagattacctggctttgc

SEQ ID NO: 423160 - DNA, 25 bp, Rattus norvegicus
ggaccttgcaccctcatgggaggtt

SEQ ID NO: 423161 - DNA, 25 bp, Rattus norvegicus
ggaccttgcaccgtcatgggaggtt

SEQ ID NO: 423162 - DNA, 25 bp, Rattus norvegicus
ggaccttggagtcatcttgattttc

SEQ ID NO: 423163 - DNA, 25 bp, Rattus norvegicus
ggaccttggagtgatcttgattttc

SEQ ID NO: 423164 - DNA, 25 bp, Rattus norvegicus
ggaccttggcataccaattttgaat

SEQ ID NO: 423165 - DNA, 25 bp, Rattus norvegicus
ggaccttggcattccaattttgaat

SEQ ID NO: 423166 - DNA, 25 bp, Rattus norvegicus
ggaccttgggcaaagcactgggtat

SEQ ID NO: 423167 - DNA, 25 bp, Rattus norvegicus
ggaccttgggcatagcactgggtat

SEQ ID NO: 423168 - DNA, 25 bp, Rattus norvegicus
ggaccttgggtcaccgcatgctaat

SEQ ID NO: 423169 - DNA, 25 bp, Rattus norvegicus
ggaccttgggtctccgcatgctaat

SEQ ID NO: 423170 - DNA, 25 bp, Rattus norvegicus
ggaccttggtcaatactgccatagt

SEQ ID NO: 423171 - DNA, 25 bp, Rattus norvegicus
ggaccttggtcacagccgagtgctc

SEQ ID NO: 423172 - DNA, 25 bp, Rattus norvegicus
ggaccttggtcagagccgagtgctc

SEQ ID NO: 423173 - DNA, 25 bp, Rattus norvegicus
ggaccttggtcattactgccatagt

SEQ ID NO: 423174 - DNA, 25 bp, Rattus norvegicus
ggaccttggtgaacatgatgtctta

SEQ ID NO: 423175 - DNA, 25 bp, Rattus norvegicus
ggaccttggtgatcatgatgtctta

SEQ ID NO: 423176 - DNA, 25 bp, Rattus norvegicus
ggaccttgtcctagtggctgaggct

SEQ ID NO: 423177 - DNA, 25 bp, Rattus norvegicus
ggaccttgtccttgtggctgaggct

SEQ ID NO: 423178 - DNA, 25 bp, Rattus norvegicus
ggaccttgtgcccaaagagctctat

SEQ ID NO: 423179 - DNA, 25 bp, Rattus norvegicus
ggaccttgtgccgaaagagctctat

SEQ ID NO: 423180 - DNA, 25 bp, Rattus norvegicus
ggaccttgtggacaaactgcaatca

SEQ ID NO: 423181 - DNA, 25 bp, Rattus norvegicus
ggaccttgtggagaaactgcaatca

SEQ ID NO: 423182 - DNA, 25 bp, Rattus norvegicus
ggacctttataaacctggaggtgca

SEQ ID NO: 423183 - DNA, 25 bp, Rattus norvegicus
ggacctttataatcctggaggtgca

SEQ ID NO: 423184 - DNA, 25 bp, Rattus norvegicus
ggacctttatgtactgcgcttagca

SEQ ID NO: 423185 - DNA, 25 bp, Rattus norvegicus
ggacctttatgttctgcgcttagca

SEQ ID NO: 423186 - DNA, 25 bp, Rattus norvegicus
ggacctttcacaagtgggagccact

SEQ ID NO: 423187 - DNA, 25 bp, Rattus norvegicus
ggacctttcacatgtgggagccact

SEQ ID NO: 423188 - DNA, 25 bp, Rattus norvegicus
ggacctttccagcagttctagactt

SEQ ID NO: 423189 - DNA, 25 bp, Rattus norvegicus
ggacctttccaggagttctagactt

SEQ ID NO: 423190 - DNA, 25 bp, Rattus norvegicus
ggacctttctgacttcatgaaccct

SEQ ID NO: 423191 - DNA, 25 bp, Rattus norvegicus
ggacctttctgagttcatgaaccct

SEQ ID NO: 423192 - DNA, 25 bp, Rattus norvegicus
ggacctttctgtctgatttacttta

SEQ ID NO: 423193 - DNA, 25 bp, Rattus norvegicus
ggacctttctgtgtgatttacttta

SEQ ID NO: 423194 - DNA, 25 bp, Rattus norvegicus
ggacctttgaaacggcgcagacttg

SEQ ID NO: 423195 - DNA, 25 bp, Rattus norvegicus
ggacctttgaaagggcgcagacttg

SEQ ID NO: 423196 - DNA, 25 bp, Rattus norvegicus
ggacctttgaccaagcttgtcttaa

SEQ ID NO: 423197 - DNA, 25 bp, Rattus norvegicus
ggacctttgacctagcttgtcttaa

SEQ ID NO: 423198 - DNA, 25 bp, Rattus norvegicus
ggacctttgactagtacccattaat

SEQ ID NO: 423199 - DNA, 25 bp, Rattus norvegicus
ggacctttgacttgtacccattaat

SEQ ID NO: 423200 - DNA, 25 bp, Rattus norvegicus
ggacctttgagaccatctttgagga

SEQ ID NO: 423201 - DNA, 25 bp, Rattus norvegicus
ggacctttgagagcatctttgagga

SEQ ID NO: 423202 - DNA, 25 bp, Rattus norvegicus
ggacctttgatccactggctggata

SEQ ID NO: 423203 - DNA, 25 bp, Rattus norvegicus
ggacctttgatcgactggctggata

SEQ ID NO: 423204 - DNA, 25 bp, Rattus norvegicus
ggacctttgcacaccagttgataac

SEQ ID NO: 423205 - DNA, 25 bp, Rattus norvegicus
ggacctttgcactccagttgataac

SEQ ID NO: 423206 - DNA, 25 bp, Rattus norvegicus
ggacctttggtccagtaagcagaac

SEQ ID NO: 423207 - DNA, 25 bp, Rattus norvegicus
ggacctttggtcgagtaagcagaac

SEQ ID NO: 423208 - DNA, 25 bp, Rattus norvegicus
ggacctttgtgcatggcctgttaat

SEQ ID NO: 423209 - DNA, 25 bp, Rattus norvegicus
ggacctttgtgcttggcctgttaat

SEQ ID NO: 423210 - DNA, 25 bp, Rattus norvegicus
ggacctttgttcaaactagctgctt

SEQ ID NO: 423211 - DNA, 25 bp, Rattus norvegicus
ggacctttgttctaactagctgctt

SEQ ID NO: 423212 - DNA, 25 bp, Rattus norvegicus
ggaccttttgtcaaaatgcttgagc

SEQ ID NO: 423213 - DNA, 25 bp, Rattus norvegicus
ggaccttttgtcatgaagagcccct

SEQ ID NO: 423214 - DNA, 25 bp, Rattus norvegicus
ggaccttttgtccagatttctgagt

SEQ ID NO: 423215 - DNA, 25 bp, Rattus norvegicus
ggaccttttgtcgagatttctgagt

SEQ ID NO: 423216 - DNA, 25 bp, Rattus norvegicus
ggaccttttgtctaaatgcttgagc

SEQ ID NO: 423217 - DNA, 25 bp, Rattus norvegicus
ggaccttttgtcttgaagagcccct

SEQ ID NO: 423218 - DNA, 25 bp, Rattus norvegicus
ggacctttttagatgccctcagtca

SEQ ID NO: 423219 - DNA, 25 bp, Rattus norvegicus
ggacctttttagttgccctcagtca

SEQ ID NO: 423220 - DNA, 25 bp, Rattus norvegicus
ggacctttttgccaagggcacactg

SEQ ID NO: 423221 - DNA, 25 bp, Rattus norvegicus
ggacctttttgcgaagggcacactg

SEQ ID NO: 423222 - DNA, 25 bp, Rattus norvegicus
ggacgaaacatgctccgatggcatt

SEQ ID NO: 423223 - DNA, 25 bp, Rattus norvegicus
ggacgaaacatggtccgatggcatt

SEQ ID NO: 423224 - DNA, 25 bp, Rattus norvegicus
ggacgaaaccatccagactctgcag

SEQ ID NO: 423225 - DNA, 25 bp, Rattus norvegicus
ggacgaaaccatgcagactctgcag

SEQ ID NO: 423226 - DNA, 25 bp, Rattus norvegicus
ggacgaaaggctcgcatccccgtgc

SEQ ID NO: 423227 - DNA, 25 bp, Rattus norvegicus
ggacgaaaggctggcatccccgtgc

SEQ ID NO: 423228 - DNA, 25 bp, Rattus norvegicus
ggacgaaattagcaaaatgaccctt

SEQ ID NO: 423229 - DNA, 25 bp, Rattus norvegicus
ggacgaaattaggaaaatgaccctt

SEQ ID NO: 423230 - DNA, 25 bp, Rattus norvegicus
ggacgaacaacaaaggctggccgga

SEQ ID NO: 423231 - DNA, 25 bp, Rattus norvegicus
ggacgaacaacataggctggccgga

SEQ ID NO: 423232 - DNA, 25 bp, Rattus norvegicus
ggacgaaccaggctgtagcaaccgt

SEQ ID NO: 423233 - DNA, 25 bp, Rattus norvegicus
ggacgaaccagggtgtagcaaccgt

SEQ ID NO: 423234 - DNA, 25 bp, Rattus norvegicus
ggacgaagatgaagcccctggcacc

SEQ ID NO: 423235 - DNA, 25 bp, Rattus norvegicus
ggacgaagatgatgcccctggcacc

SEQ ID NO: 423236 - DNA, 25 bp, Rattus norvegicus
ggacgaagatgtctacactctgtac

SEQ ID NO: 423237 - DNA, 25 bp, Rattus norvegicus
ggacgaagatgtgtacactctgtac

SEQ ID NO: 423238 - DNA, 25 bp, Rattus norvegicus
ggacgaatctatacctgttcaggac

SEQ ID NO: 423239 - DNA, 25 bp, Rattus norvegicus
ggacgaatctattcctgttcaggac

SEQ ID NO: 423240 - DNA, 25 bp, Rattus norvegicus
ggacgaattccaccttcatactaat

SEQ ID NO: 423241 - DNA, 25 bp, Rattus norvegicus
ggacgaattccagcttcatactaat

SEQ ID NO: 423242 - DNA, 25 bp, Rattus norvegicus
ggacgaattgttcatctgttcagaa

SEQ ID NO: 423243 - DNA, 25 bp, Rattus norvegicus
ggacgaattgttgatctgttcagaa

SEQ ID NO: 423244 - DNA, 25 bp, Rattus norvegicus
ggacgacaaaccattgatgctgatg

SEQ ID NO: 423245 - DNA, 25 bp, Rattus norvegicus
ggacgacaaacctttgatgctgatg

SEQ ID NO: 423246 - DNA, 25 bp, Rattus norvegicus
ggacgacaaactaacagccggtatc

SEQ ID NO: 423247 - DNA, 25 bp, Rattus norvegicus
ggacgacaaacttacagccggtatc

SEQ ID NO: 423248 - DNA, 25 bp, Rattus norvegicus
ggacgacaaccaaatcatcaccagc

SEQ ID NO: 423249 - DNA, 25 bp, Rattus norvegicus
ggacgacaaccatatcatcaccagc

SEQ ID NO: 423250 - DNA, 25 bp, Rattus norvegicus
ggacgacaatcgaccatcgtgctat

SEQ ID NO: 423251 - DNA, 25 bp, Rattus norvegicus
ggacgacaatcgtccatcgtgctat

SEQ ID NO: 423252 - DNA, 25 bp, Rattus norvegicus
ggacgacagagcactctaggactgt

SEQ ID NO: 423253 - DNA, 25 bp, Rattus norvegicus
ggacgacagagctctctaggactgt

SEQ ID NO: 423254 - DNA, 25 bp, Rattus norvegicus
ggacgacagctgactctgggaacca

SEQ ID NO: 423255 - DNA, 25 bp, Rattus norvegicus
ggacgacagctgtctctgggaacca

SEQ ID NO: 423256 - DNA, 25 bp, Rattus norvegicus
ggacgacaggcaaatgctacacaca

SEQ ID NO: 423257 - DNA, 25 bp, Rattus norvegicus
ggacgacaggcatatgctacacaca

SEQ ID NO: 423258 - DNA, 25 bp, Rattus norvegicus
ggacgacatgaaccactgctactcg

SEQ ID NO: 423259 - DNA, 25 bp, Rattus norvegicus
ggacgacatgaagcactgctactcg

SEQ ID NO: 423260 - DNA, 25 bp, Rattus norvegicus
ggacgaccaggtcgctattgtcttc

SEQ ID NO: 423261 - DNA, 25 bp, Rattus norvegicus
ggacgaccaggtggctattgtcttc

SEQ ID NO: 423262 - DNA, 25 bp, Rattus norvegicus
ggacgaccccatcggctatgagagc

SEQ ID NO: 423263 - DNA, 25 bp, Rattus norvegicus
ggacgaccccatgggctatgagagc

SEQ ID NO: 423264 - DNA, 25 bp, Rattus norvegicus
ggacgacctggaaggcactttgcat

SEQ ID NO: 423265 - DNA, 25 bp, Rattus norvegicus
ggacgacctggatggcactttgcat

SEQ ID NO: 423266 - DNA, 25 bp, Rattus norvegicus
ggacgaccttcgcaatgatctggat

SEQ ID NO: 423267 - DNA, 25 bp, Rattus norvegicus
ggacgaccttcggaatgatctggat

SEQ ID NO: 423268 - DNA, 25 bp, Rattus norvegicus
ggacgacgaaaaagctcccatgatt

SEQ ID NO: 423269 - DNA, 25 bp, Rattus norvegicus
ggacgacgaaaatgctcccatgatt

SEQ ID NO: 423270 - DNA, 25 bp, Rattus norvegicus
ggacgacgctgtctttgttctcaga

SEQ ID NO: 423271 - DNA, 25 bp, Rattus norvegicus
ggacgacgctgtgtttgttctcaga

SEQ ID NO: 423272 - DNA, 25 bp, Rattus norvegicus
ggacgactcaatctgtggccaccag

SEQ ID NO: 423273 - DNA, 25 bp, Rattus norvegicus
ggacgactcaatgtgtggccaccag

SEQ ID NO: 423274 - DNA, 25 bp, Rattus norvegicus
ggacgactcaggaagcaggacccca

SEQ ID NO: 423275 - DNA, 25 bp, Rattus norvegicus
ggacgactcaggtagcaggacccca

SEQ ID NO: 423276 - DNA, 25 bp, Rattus norvegicus
ggacgactgttaattctgtctccgt

SEQ ID NO: 423277 - DNA, 25 bp, Rattus norvegicus
ggacgactgttatttctgtctccgt

SEQ ID NO: 423278 - DNA, 25 bp, Rattus norvegicus
ggacgacttaaaattggtctctaga

SEQ ID NO: 423279 - DNA, 25 bp, Rattus norvegicus
ggacgacttaaatttggtctctaga

SEQ ID NO: 423280 - DNA, 25 bp, Rattus norvegicus
ggacgacttggtaatgcatacctct

SEQ ID NO: 423281 - DNA, 25 bp, Rattus norvegicus
ggacgacttggttatgcatacctct

SEQ ID NO: 423282 - DNA, 25 bp, Rattus norvegicus
ggacgagaaaccatccatcttgatt

SEQ ID NO: 423283 - DNA, 25 bp, Rattus norvegicus
ggacgagaaaccttccatcttgatt

SEQ ID NO: 423284 - DNA, 25 bp, Rattus norvegicus
ggacgagaacttcaagcgctgcttc

SEQ ID NO: 423285 - DNA, 25 bp, Rattus norvegicus
ggacgagaacttgaagcgctgcttc

SEQ ID NO: 423286 - DNA, 25 bp, Rattus norvegicus
ggacgagaatggaactacatccctc

SEQ ID NO: 423287 - DNA, 25 bp, Rattus norvegicus
ggacgagaatggtactacatccctc

SEQ ID NO: 423288 - DNA, 25 bp, Rattus norvegicus
ggacgagaattcacccctataggtc

SEQ ID NO: 423289 - DNA, 25 bp, Rattus norvegicus
ggacgagaattctcccctataggtc

SEQ ID NO: 423290 - DNA, 25 bp, Rattus norvegicus
ggacgagacactcatgtgttccttc

SEQ ID NO: 423291 - DNA, 25 bp, Rattus norvegicus
ggacgagacactgatgtgttccttc

SEQ ID NO: 423292 - DNA, 25 bp, Rattus norvegicus
ggacgagaccgaccagacaacatca

SEQ ID NO: 423293 - DNA, 25 bp, Rattus norvegicus
ggacgagaccgagcagacaacatca

SEQ ID NO: 423294 - DNA, 25 bp, Rattus norvegicus
ggacgagatcgactctatcggttct

SEQ ID NO: 423295 - DNA, 25 bp, Rattus norvegicus
ggacgagatcgagtctatcggttct

SEQ ID NO: 423296 - DNA, 25 bp, Rattus norvegicus
ggacgagattaccattttgtgactt

SEQ ID NO: 423297 - DNA, 25 bp, Rattus norvegicus
ggacgagattacgattttgtgactt

SEQ ID NO: 423298 - DNA, 25 bp, Rattus norvegicus
ggacgagcagctccggtgactcact

SEQ ID NO: 423299 - DNA, 25 bp, Rattus norvegicus
ggacgagcagctgcggtgactcact

SEQ ID NO: 423300 - DNA, 25 bp, Rattus norvegicus
ggacgagccggtactaaaacactgg

SEQ ID NO: 423301 - DNA, 25 bp, Rattus norvegicus
ggacgagccggttctaaaacactgg

SEQ ID NO: 423302 - DNA, 25 bp, Rattus norvegicus
ggacgagctcgaagtgacgcctgca

SEQ ID NO: 423303 - DNA, 25 bp, Rattus norvegicus
ggacgagctcgatgtgacgcctgca

SEQ ID NO: 423304 - DNA, 25 bp, Rattus norvegicus
ggacgagctgacctgatgcgaccta

SEQ ID NO: 423305 - DNA, 25 bp, Rattus norvegicus
ggacgagctgacgtgatgcgaccta

SEQ ID NO: 423306 - DNA, 25 bp, Rattus norvegicus
ggacgagctggaaccacctctgaat

SEQ ID NO: 423307 - DNA, 25 bp, Rattus norvegicus
ggacgagctggatccacctctgaat

SEQ ID NO: 423308 - DNA, 25 bp, Rattus norvegicus
ggacgagcttcaagagacacctctt

SEQ ID NO: 423309 - DNA, 25 bp, Rattus norvegicus
ggacgagcttcatgagacacctctt

SEQ ID NO: 423310 - DNA, 25 bp, Rattus norvegicus
ggacgaggaccacgcctatgctctg

SEQ ID NO: 423311 - DNA, 25 bp, Rattus norvegicus
ggacgaggaccaggcctatgctctg

SEQ ID NO: 423312 - DNA, 25 bp, Rattus norvegicus
ggacgaggtgacagaaggccaattc

SEQ ID NO: 423313 - DNA, 25 bp, Rattus norvegicus
ggacgaggtgactgaaggccaattc

SEQ ID NO: 423314 - DNA, 25 bp, Rattus norvegicus
ggacgaggtggcatctgctcagcat

SEQ ID NO: 423315 - DNA, 25 bp, Rattus norvegicus
ggacgaggtggcttctgctcagcat

SEQ ID NO: 423316 - DNA, 25 bp, Rattus norvegicus
ggacgagtacaacgagatgcccatg

SEQ ID NO: 423317 - DNA, 25 bp, Rattus norvegicus
ggacgagtacaaggagatgcccatg

SEQ ID NO: 423318 - DNA, 25 bp, Rattus norvegicus
ggacgagtcatgcaccctgaaacaa

SEQ ID NO: 423319 - DNA, 25 bp, Rattus norvegicus
ggacgagtcatggaccctgaaacaa

SEQ ID NO: 423320 - DNA, 25 bp, Rattus norvegicus
ggacgagtccgaaagttgactgaaa

SEQ ID NO: 423321 - DNA, 25 bp, Rattus norvegicus
ggacgagtccgatagttgactgaaa

SEQ ID NO: 423322 - DNA, 25 bp, Rattus norvegicus
ggacgataactgaactctggagaga

SEQ ID NO: 423323 - DNA, 25 bp, Rattus norvegicus
ggacgataactgtactctggagaga

SEQ ID NO: 423324 - DNA, 25 bp, Rattus norvegicus
ggacgatacaggcttcaacccaggt

SEQ ID NO: 423325 - DNA, 25 bp, Rattus norvegicus
ggacgatacagggttcaacccaggt

SEQ ID NO: 423326 - DNA, 25 bp, Rattus norvegicus
ggacgatcgcggaggaacctacagt

SEQ ID NO: 423327 - DNA, 25 bp, Rattus norvegicus
ggacgatcgcggtggaacctacagt

SEQ ID NO: 423328 - DNA, 25 bp, Rattus norvegicus
ggacgatcgtacaatgtagaccaca

SEQ ID NO: 423329 - DNA, 25 bp, Rattus norvegicus
ggacgatcgtactatgtagaccaca

SEQ ID NO: 423330 - DNA, 25 bp, Rattus norvegicus
ggacgatgaactactgcctttatct

SEQ ID NO: 423331 - DNA, 25 bp, Rattus norvegicus
ggacgatgaacttctgcctttatct

SEQ ID NO: 423332 - DNA, 25 bp, Rattus norvegicus
ggacgatgaagcatttgtcaaggta

SEQ ID NO: 423333 - DNA, 25 bp, Rattus norvegicus
ggacgatgaagcttttgtcaaggta

SEQ ID NO: 423334 - DNA, 25 bp, Rattus norvegicus
ggacgatgacaactatgtgaaccca

SEQ ID NO: 423335 - DNA, 25 bp, Rattus norvegicus
ggacgatgacaagtatgtgaaccca

SEQ ID NO: 423336 - DNA, 25 bp, Rattus norvegicus
ggacgatgaggacctcttccgcctc

SEQ ID NO: 423337 - DNA, 25 bp, Rattus norvegicus
ggacgatgaggagctcttccgcctc

SEQ ID NO: 423338 - DNA, 25 bp, Rattus norvegicus
ggacgatggattatggctgccctta

SEQ ID NO: 423339 - DNA, 25 bp, Rattus norvegicus
ggacgatggattttggctgccctta

SEQ ID NO: 423340 - DNA, 25 bp, Rattus norvegicus
ggacgatggcttaggcatggacccc

SEQ ID NO: 423341 - DNA, 25 bp, Rattus norvegicus
ggacgatggctttggcatggacccc

SEQ ID NO: 423342 - DNA, 25 bp, Rattus norvegicus
ggacgatgggttccaggccacttac

SEQ ID NO: 423343 - DNA, 25 bp, Rattus norvegicus
ggacgatgggttgcaggccacttac

SEQ ID NO: 423344 - DNA, 25 bp, Rattus norvegicus
ggacgatgttccaaaccccaagaat

SEQ ID NO: 423345 - DNA, 25 bp, Rattus norvegicus
ggacgatgttcctaaccccaagaat

SEQ ID NO: 423346 - DNA, 25 bp, Rattus norvegicus
ggacgattgcaacacctgccggaga

SEQ ID NO: 423347 - DNA, 25 bp, Rattus norvegicus
ggacgattgcaagacctgccggaga

SEQ ID NO: 423348 - DNA, 25 bp, Rattus norvegicus
ggacgattgcagctctctaggattc

SEQ ID NO: 423349 - DNA, 25 bp, Rattus norvegicus
ggacgattgcaggtctctaggattc

SEQ ID NO: 423350 - DNA, 25 bp, Rattus norvegicus
ggacgatttcagactcaacgacgcc

SEQ ID NO: 423351 - DNA, 25 bp, Rattus norvegicus
ggacgatttcagtctcaacgacgcc

SEQ ID NO: 423352 - DNA, 25 bp, Rattus norvegicus
ggacgatttgcgagttagtgacaac

SEQ ID NO: 423353 - DNA, 25 bp, Rattus norvegicus
ggacgatttgcgtgttagtgacaac

SEQ ID NO: 423354 - DNA, 25 bp, Rattus norvegicus
ggacgcaacccaagaacagccaagt

SEQ ID NO: 423355 - DNA, 25 bp, Rattus norvegicus
ggacgcaacccatgaacagccaagt

SEQ ID NO: 423356 - DNA, 25 bp, Rattus norvegicus
ggacgcaagcccacatcaaattact

SEQ ID NO: 423357 - DNA, 25 bp, Rattus norvegicus
ggacgcaagccctcatcaaattact

SEQ ID NO: 423358 - DNA, 25 bp, Rattus norvegicus
ggacgcacacagctgggcgcctggc

SEQ ID NO: 423359 - DNA, 25 bp, Rattus norvegicus
ggacgcacacaggtgggcgcctggc

SEQ ID NO: 423360 - DNA, 25 bp, Rattus norvegicus
ggacgcacatgtaaagtgcctgtgt

SEQ ID NO: 423361 - DNA, 25 bp, Rattus norvegicus
ggacgcacatgttaagtgcctgtgt

SEQ ID NO: 423362 - DNA, 25 bp, Rattus norvegicus
ggacgcacgctaagtttcctatggg

SEQ ID NO: 423363 - DNA, 25 bp, Rattus norvegicus
ggacgcacgctatgtttcctatggg

SEQ ID NO: 423364 - DNA, 25 bp, Rattus norvegicus
ggacgcagagacacctcatgagatc

SEQ ID NO: 423365 - DNA, 25 bp, Rattus norvegicus
ggacgcagagactcctcatgagatc

SEQ ID NO: 423366 - DNA, 25 bp, Rattus norvegicus
ggacgcaggtaacgccaagctttaa

SEQ ID NO: 423367 - DNA, 25 bp, Rattus norvegicus
ggacgcaggtaaggccaagctttaa

SEQ ID NO: 423368 - DNA, 25 bp, Rattus norvegicus
ggacgcagtggtatttgttcttgac

SEQ ID NO: 423369 - DNA, 25 bp, Rattus norvegicus
ggacgcagtggtttttgttcttgac

SEQ ID NO: 423370 - DNA, 25 bp, Rattus norvegicus
ggacgcagttacattgctagcacct

SEQ ID NO: 423371 - DNA, 25 bp, Rattus norvegicus
ggacgcagttactttgctagcacct

SEQ ID NO: 423372 - DNA, 25 bp, Rattus norvegicus
ggacgcattcccatagaacacagtg

SEQ ID NO: 423373 - DNA, 25 bp, Rattus norvegicus
ggacgcattcccttagaacacagtg

SEQ ID NO: 423374 - DNA, 25 bp, Rattus norvegicus
ggacgccaaacaaatgttccactct

SEQ ID NO: 423375 - DNA, 25 bp, Rattus norvegicus
ggacgccaaacatatgttccactct

SEQ ID NO: 423376 - DNA, 25 bp, Rattus norvegicus
ggacgccaatcgctccagttacgac

SEQ ID NO: 423377 - DNA, 25 bp, Rattus norvegicus
ggacgccaatcggtccagttacgac

SEQ ID NO: 423378 - DNA, 25 bp, Rattus norvegicus
ggacgccacactacagatcactttg

SEQ ID NO: 423379 - DNA, 25 bp, Rattus norvegicus
ggacgccacacttcagatcactttg

SEQ ID NO: 423380 - DNA, 25 bp, Rattus norvegicus
ggacgccacgtccatgtctttaaat

SEQ ID NO: 423381 - DNA, 25 bp, Rattus norvegicus
ggacgccacgtcgatgtctttaaat

SEQ ID NO: 423382 - DNA, 25 bp, Rattus norvegicus
ggacgccagtctcgctgctgatgta

SEQ ID NO: 423383 - DNA, 25 bp, Rattus norvegicus
ggacgccagtctggctgctgatgta

SEQ ID NO: 423384 - DNA, 25 bp, Rattus norvegicus
ggacgccatccgaattctcggtatt

SEQ ID NO: 423385 - DNA, 25 bp, Rattus norvegicus
ggacgccatccgtattctcggtatt

SEQ ID NO: 423386 - DNA, 25 bp, Rattus norvegicus
ggacgccccggtagctgctatgaaa

SEQ ID NO: 423387 - DNA, 25 bp, Rattus norvegicus
ggacgccccggttgctgctatgaaa

SEQ ID NO: 423388 - DNA, 25 bp, Rattus norvegicus
ggacgccccttgcaggtctggacca

SEQ ID NO: 423389 - DNA, 25 bp, Rattus norvegicus
ggacgccccttggaggtctggacca

SEQ ID NO: 423390 - DNA, 25 bp, Rattus norvegicus
ggacgcccgaccctgataggagaaa

SEQ ID NO: 423391 - DNA, 25 bp, Rattus norvegicus
ggacgcccgaccgtgataggagaaa

SEQ ID NO: 423392 - DNA, 25 bp, Rattus norvegicus
ggacgccctggcagaattctttgaa

SEQ ID NO: 423393 - DNA, 25 bp, Rattus norvegicus
ggacgccctggctgaattctttgaa

SEQ ID NO: 423394 - DNA, 25 bp, Rattus norvegicus
ggacgccgcagcacgacactgaggc

SEQ ID NO: 423395 - DNA, 25 bp, Rattus norvegicus
ggacgccgcagctcgacactgaggc

SEQ ID NO: 423396 - DNA, 25 bp, Rattus norvegicus
ggacgcctacaaacatcatgaatga

SEQ ID NO: 423397 - DNA, 25 bp, Rattus norvegicus
ggacgcctacaatcatcatgaatga

SEQ ID NO: 423398 - DNA, 25 bp, Rattus norvegicus
ggacgcctcatcactgagctcaaac

SEQ ID NO: 423399 - DNA, 25 bp, Rattus norvegicus
ggacgcctcatctctgagctcaaac

SEQ ID NO: 423400 - DNA, 25 bp, Rattus norvegicus
ggacgcctgacaaactgactcaaag

SEQ ID NO: 423401 - DNA, 25 bp, Rattus norvegicus
ggacgcctgacatactgactcaaag

SEQ ID NO: 423402 - DNA, 25 bp, Rattus norvegicus
ggacgcctggatcgaagcgggcgca

SEQ ID NO: 423403 - DNA, 25 bp, Rattus norvegicus
ggacgcctggatggaagcgggcgca

SEQ ID NO: 423404 - DNA, 25 bp, Rattus norvegicus
ggacgcctgtcacagacgctgatga

SEQ ID NO: 423405 - DNA, 25 bp, Rattus norvegicus
ggacgcctgtcagagacgctgatga

SEQ ID NO: 423406 - DNA, 25 bp, Rattus norvegicus
ggacgcgaagacagcgccccgagtc

SEQ ID NO: 423407 - DNA, 25 bp, Rattus norvegicus
ggacgcgaagactgcgccccgagtc

SEQ ID NO: 423408 - DNA, 25 bp, Rattus norvegicus
ggacgcgacattcttcttgaagact

SEQ ID NO: 423409 - DNA, 25 bp, Rattus norvegicus
ggacgcgacattgttcttgaagact

SEQ ID NO: 423410 - DNA, 25 bp, Rattus norvegicus
ggacgcgagccaaggtagctcctaa

SEQ ID NO: 423411 - DNA, 25 bp, Rattus norvegicus
ggacgcgagccatggtagctcctaa

SEQ ID NO: 423412 - DNA, 25 bp, Rattus norvegicus
ggacgcgcatggagagaaagcaaac

SEQ ID NO: 423413 - DNA, 25 bp, Rattus norvegicus
ggacgcgcatggtgagaaagcaaac

SEQ ID NO: 423414 - DNA, 25 bp, Rattus norvegicus
ggacgcgcgggcacggccagacaaa

SEQ ID NO: 423415 - DNA, 25 bp, Rattus norvegicus
ggacgcgcgggctcggccagacaaa

SEQ ID NO: 423416 - DNA, 25 bp, Rattus norvegicus
ggacgcggacgcatcttagagctct

SEQ ID NO: 423417 - DNA, 25 bp, Rattus norvegicus
ggacgcggacgcttcttagagctct

SEQ ID NO: 423418 - DNA, 25 bp, Rattus norvegicus
ggacgcgggatcatacagtgtcaac

SEQ ID NO: 423419 - DNA, 25 bp, Rattus norvegicus
ggacgcgggatcttacagtgtcaac

SEQ ID NO: 423420 - DNA, 25 bp, Rattus norvegicus
ggacgctaagttcccaggctacaaa

SEQ ID NO: 423421 - DNA, 25 bp, Rattus norvegicus
ggacgctaagttgccaggctacaaa

SEQ ID NO: 423422 - DNA, 25 bp, Rattus norvegicus
ggacgctagacaaccagctgttctt

SEQ ID NO: 423423 - DNA, 25 bp, Rattus norvegicus
ggacgctagacatccagctgttctt

SEQ ID NO: 423424 - DNA, 25 bp, Rattus norvegicus
ggacgctatgaaaggtgggcacttc

SEQ ID NO: 423425 - DNA, 25 bp, Rattus norvegicus
ggacgctatgaatggtgggcacttc

SEQ ID NO: 423426 - DNA, 25 bp, Rattus norvegicus
ggacgctatgtcaaccaacaactgt

SEQ ID NO: 423427 - DNA, 25 bp, Rattus norvegicus
ggacgctatgtctaccaacaactgt

SEQ ID NO: 423428 - DNA, 25 bp, Rattus norvegicus
ggacgctatttactcagctatccag

SEQ ID NO: 423429 - DNA, 25 bp, Rattus norvegicus
ggacgctatttagtcagctatccag

SEQ ID NO: 423430 - DNA, 25 bp, Rattus norvegicus
ggacgctctaccaggacatttaact

SEQ ID NO: 423431 - DNA, 25 bp, Rattus norvegicus
ggacgctctacctggacatttaact

SEQ ID NO: 423432 - DNA, 25 bp, Rattus norvegicus
ggacgctctggaccaggattctcca

SEQ ID NO: 423433 - DNA, 25 bp, Rattus norvegicus
ggacgctctggagcaggattctcca

SEQ ID NO: 423434 - DNA, 25 bp, Rattus norvegicus
ggacgctgacgtccactgtaagatg

SEQ ID NO: 423435 - DNA, 25 bp, Rattus norvegicus
ggacgctgacgtgcactgtaagatg

SEQ ID NO: 423436 - DNA, 25 bp, Rattus norvegicus
ggacgctgaggcacgagtgctccct

SEQ ID NO: 423437 - DNA, 25 bp, Rattus norvegicus
ggacgctgaggctcgagtgctccct

SEQ ID NO: 423438 - DNA, 25 bp, Rattus norvegicus
ggacgctgccaacatcaaccaggac

SEQ ID NO: 423439 - DNA, 25 bp, Rattus norvegicus
ggacgctgccaagatcaaccaggac

SEQ ID NO: 423440 - DNA, 25 bp, Rattus norvegicus
ggacgctgctacaggcaaatctgtc

SEQ ID NO: 423441 - DNA, 25 bp, Rattus norvegicus
ggacgctgctactggcaaatctgtc

SEQ ID NO: 423442 - DNA, 25 bp, Rattus norvegicus
ggacgctgctttacctggccgaagt

SEQ ID NO: 423443 - DNA, 25 bp, Rattus norvegicus
ggacgctgcttttcctggccgaagt

SEQ ID NO: 423444 - DNA, 25 bp, Rattus norvegicus
ggacgctggacacgatgccccaact

SEQ ID NO: 423445 - DNA, 25 bp, Rattus norvegicus
ggacgctggacaggatgccccaact

SEQ ID NO: 423446 - DNA, 25 bp, Rattus norvegicus
ggacgctggctgaattccgtatttc

SEQ ID NO: 423447 - DNA, 25 bp, Rattus norvegicus
ggacgctggctgtattccgtatttc

SEQ ID NO: 423448 - DNA, 25 bp, Rattus norvegicus
ggacgctgggatactcttcactgag

SEQ ID NO: 423449 - DNA, 25 bp, Rattus norvegicus
ggacgctgggattctcttcactgag

SEQ ID NO: 423450 - DNA, 25 bp, Rattus norvegicus
ggacgctgtaacctcttcatttaag

SEQ ID NO: 423451 - DNA, 25 bp, Rattus norvegicus
ggacgctgtaacgtcttcatttaag

SEQ ID NO: 423452 - DNA, 25 bp, Rattus norvegicus
ggacgctgtcatagtgttccccgta

SEQ ID NO: 423453 - DNA, 25 bp, Rattus norvegicus
ggacgctgtcattgtgttccccgta

SEQ ID NO: 423454 - DNA, 25 bp, Rattus norvegicus
ggacgctgtccaaagaggccgccgc

SEQ ID NO: 423455 - DNA, 25 bp, Rattus norvegicus
ggacgctgtccatagaggccgccgc

SEQ ID NO: 423456 - DNA, 25 bp, Rattus norvegicus
ggacgctgtgatattggttccaaaa

SEQ ID NO: 423457 - DNA, 25 bp, Rattus norvegicus
ggacgctgtgattttggttccaaaa

SEQ ID NO: 423458 - DNA, 25 bp, Rattus norvegicus
ggacgctgtttgatgcatgactgac

SEQ ID NO: 423459 - DNA, 25 bp, Rattus norvegicus
ggacgctgtttgttgcatgactgac

SEQ ID NO: 423460 - DNA, 25 bp, Rattus norvegicus
ggacgcttcacgcagtggtactttg

SEQ ID NO: 423461 - DNA, 25 bp, Rattus norvegicus
ggacgcttcacggagtggtactttg

SEQ ID NO: 423462 - DNA, 25 bp, Rattus norvegicus
ggacgcttcctgaatgttgaactta

SEQ ID NO: 423463 - DNA, 25 bp, Rattus norvegicus
ggacgcttcctgtatgttgaactta

SEQ ID NO: 423464 - DNA, 25 bp, Rattus norvegicus
ggacgcttcgataggcaaagcccag

SEQ ID NO: 423465 - DNA, 25 bp, Rattus norvegicus
ggacgcttcgattggcaaagcccag

SEQ ID NO: 423466 - DNA, 25 bp, Rattus norvegicus
ggacgcttgcagaggtacgccaata

SEQ ID NO: 423467 - DNA, 25 bp, Rattus norvegicus
ggacgcttgcagtggtacgccaata

SEQ ID NO: 423468 - DNA, 25 bp, Rattus norvegicus
ggacggaaaccaacacagtccatat

SEQ ID NO: 423469 - DNA, 25 bp, Rattus norvegicus
ggacggaaaccatcacagtccatat

SEQ ID NO: 423470 - DNA, 25 bp, Rattus norvegicus
ggacggaaatcccagaaaactcatt

SEQ ID NO: 423471 - DNA, 25 bp, Rattus norvegicus
ggacggaaatccgagaaaactcatt

SEQ ID NO: 423472 - DNA, 25 bp, Rattus norvegicus
ggacggaacctcagtgctggctagt

SEQ ID NO: 423473 - DNA, 25 bp, Rattus norvegicus
ggacggaacctctgtgctggctagt

SEQ ID NO: 423474 - DNA, 25 bp, Rattus norvegicus
ggacggaactaacagatttctccca

SEQ ID NO: 423475 - DNA, 25 bp, Rattus norvegicus
ggacggaactaagagatttctccca

SEQ ID NO: 423476 - DNA, 25 bp, Rattus norvegicus
ggacggaactatacttgacagtgct

SEQ ID NO: 423477 - DNA, 25 bp, Rattus norvegicus
ggacggaactattcttgacagtgct

SEQ ID NO: 423478 - DNA, 25 bp, Rattus norvegicus
ggacggaactcaataatctgtggaa

SEQ ID NO: 423479 - DNA, 25 bp, Rattus norvegicus
ggacggaactcattaatctgtggaa

SEQ ID NO: 423480 - DNA, 25 bp, Rattus norvegicus
ggacggaagtgtcgcggcctcctca

SEQ ID NO: 423481 - DNA, 25 bp, Rattus norvegicus
ggacggaagtgtggcggcctcctca

SEQ ID NO: 423482 - DNA, 25 bp, Rattus norvegicus
ggacggaagttcaagcagctgtcat

SEQ ID NO: 423483 - DNA, 25 bp, Rattus norvegicus
ggacggaagttctagcagctgtcat

SEQ ID NO: 423484 - DNA, 25 bp, Rattus norvegicus
ggacggacttcaagatccctatgga

SEQ ID NO: 423485 - DNA, 25 bp, Rattus norvegicus
ggacggacttcatgatccctatgga

SEQ ID NO: 423486 - DNA, 25 bp, Rattus norvegicus
ggacggagagaaccgaacatccctg

SEQ ID NO: 423487 - DNA, 25 bp, Rattus norvegicus
ggacggagagaagcgaacatccctg

SEQ ID NO: 423488 - DNA, 25 bp, Rattus norvegicus
ggacggagctacagttttaagatca

SEQ ID NO: 423489 - DNA, 25 bp, Rattus norvegicus
ggacggagctactgttttaagatca

SEQ ID NO: 423490 - DNA, 25 bp, Rattus norvegicus
ggacggaggcttatgcagatgcaaa

SEQ ID NO: 423491 - DNA, 25 bp, Rattus norvegicus
ggacggaggcttttgcagatgcaaa

SEQ ID NO: 423492 - DNA, 25 bp, Rattus norvegicus
ggacggagggctactgtattccaag

SEQ ID NO: 423493 - DNA, 25 bp, Rattus norvegicus
ggacggagggcttctgtattccaag

SEQ ID NO: 423494 - DNA, 25 bp, Rattus norvegicus
ggacggagtttgacagcagcctacc

SEQ ID NO: 423495 - DNA, 25 bp, Rattus norvegicus
ggacggagtttgtcagcagcctacc

SEQ ID NO: 423496 - DNA, 25 bp, Rattus norvegicus
ggacggatatggacacacccagccg

SEQ ID NO: 423497 - DNA, 25 bp, Rattus norvegicus
ggacggatatggtcacacccagccg

SEQ ID NO: 423498 - DNA, 25 bp, Rattus norvegicus
ggacggatcctcctcgacgagtaga

SEQ ID NO: 423499 - DNA, 25 bp, Rattus norvegicus
ggacggatcctcgtcgacgagtaga

SEQ ID NO: 423500 - DNA, 25 bp, Rattus norvegicus
ggacggatcttgaatggagtattgt

SEQ ID NO: 423501 - DNA, 25 bp, Rattus norvegicus
ggacggatcttgtatggagtattgt

SEQ ID NO: 423502 - DNA, 25 bp, Rattus norvegicus
ggacggatggccacgccaagccgat

SEQ ID NO: 423503 - DNA, 25 bp, Rattus norvegicus
ggacggatggcctcgccaagccgat

SEQ ID NO: 423504 - DNA, 25 bp, Rattus norvegicus
ggacggatgtggatatattctgtac

SEQ ID NO: 423505 - DNA, 25 bp, Rattus norvegicus
ggacggatgtggttatattctgtac

SEQ ID NO: 423506 - DNA, 25 bp, Rattus norvegicus
ggacggatttccagagcacggccag

SEQ ID NO: 423507 - DNA, 25 bp, Rattus norvegicus
ggacggatttcctgagcacggccag

SEQ ID NO: 423508 - DNA, 25 bp, Rattus norvegicus
ggacggcaaactaggaacaccttct

SEQ ID NO: 423509 - DNA, 25 bp, Rattus norvegicus
ggacggcaaacttggaacaccttct

SEQ ID NO: 423510 - DNA, 25 bp, Rattus norvegicus
ggacggcacagcagctccaaaataa

SEQ ID NO: 423511 - DNA, 25 bp, Rattus norvegicus
ggacggcacagctgctccaaaataa

SEQ ID NO: 423512 - DNA, 25 bp, Rattus norvegicus
ggacggcactgaacgcttccagccg

SEQ ID NO: 423513 - DNA, 25 bp, Rattus norvegicus
ggacggcactgaagtgggctccttc

SEQ ID NO: 423514 - DNA, 25 bp, Rattus norvegicus
ggacggcactgatcgcttccagccg

SEQ ID NO: 423515 - DNA, 25 bp, Rattus norvegicus
ggacggcactgatgtgggctccttc

SEQ ID NO: 423516 - DNA, 25 bp, Rattus norvegicus
ggacggcagttgactcactgtaaat

SEQ ID NO: 423517 - DNA, 25 bp, Rattus norvegicus
ggacggcagttgtctcactgtaaat

SEQ ID NO: 423518 - DNA, 25 bp, Rattus norvegicus
ggacggcattttaccaaaagccaat

SEQ ID NO: 423519 - DNA, 25 bp, Rattus norvegicus
ggacggcatttttccaaaagccaat

SEQ ID NO: 423520 - DNA, 25 bp, Rattus norvegicus
ggacggccactgacttggacatctt

SEQ ID NO: 423521 - DNA, 25 bp, Rattus norvegicus
ggacggccactgtcttggacatctt

SEQ ID NO: 423522 - DNA, 25 bp, Rattus norvegicus
ggacggcctcggaatgcagaacgac

SEQ ID NO: 423523 - DNA, 25 bp, Rattus norvegicus
ggacggcctcggtatgcagaacgac

SEQ ID NO: 423524 - DNA, 25 bp, Rattus norvegicus
ggacggcgtctgagtgtgctctaca

SEQ ID NO: 423525 - DNA, 25 bp, Rattus norvegicus
ggacggcgtctgtgtgtgctctaca

SEQ ID NO: 423526 - DNA, 25 bp, Rattus norvegicus
ggacggctacaaaggctcacgaggt

SEQ ID NO: 423527 - DNA, 25 bp, Rattus norvegicus
ggacggctacaatggctcacgaggt

SEQ ID NO: 423528 - DNA, 25 bp, Rattus norvegicus
ggacggctgcttatgtcttatttta

SEQ ID NO: 423529 - DNA, 25 bp, Rattus norvegicus
ggacggctgcttttgtcttatttta

SEQ ID NO: 423530 - DNA, 25 bp, Rattus norvegicus
ggacgggaagaaactgaccttaatg

SEQ ID NO: 423531 - DNA, 25 bp, Rattus norvegicus
ggacgggaagaatctgaccttaatg

SEQ ID NO: 423532 - DNA, 25 bp, Rattus norvegicus
ggacgggagcatcgcctacatacac

SEQ ID NO: 423533 - DNA, 25 bp, Rattus norvegicus
ggacgggagcatggcctacatacac

SEQ ID NO: 423534 - DNA, 25 bp, Rattus norvegicus
ggacgggagccgaaaagatcaaaag

SEQ ID NO: 423535 - DNA, 25 bp, Rattus norvegicus
ggacgggagccgtaaagatcaaaag

SEQ ID NO: 423536 - DNA, 25 bp, Rattus norvegicus
ggacgggatgtcaccaagctcttgt

SEQ ID NO: 423537 - DNA, 25 bp, Rattus norvegicus
ggacgggatgtctccaagctcttgt

SEQ ID NO: 423538 - DNA, 25 bp, Rattus norvegicus
ggacgggcatttatgcttaacgcat

SEQ ID NO: 423539 - DNA, 25 bp, Rattus norvegicus
ggacgggcatttttgcttaacgcat

SEQ ID NO: 423540 - DNA, 25 bp, Rattus norvegicus
ggacgggtcatgcttcatccagtca

SEQ ID NO: 423541 - DNA, 25 bp, Rattus norvegicus
ggacgggtcatggttcatccagtca

SEQ ID NO: 423542 - DNA, 25 bp, Rattus norvegicus
ggacgggtgtccagaatctcattat

SEQ ID NO: 423543 - DNA, 25 bp, Rattus norvegicus
ggacgggtgtcctgaatctcattat

SEQ ID NO: 423544 - DNA, 25 bp, Rattus norvegicus
ggacggtcacacacactcattagac

SEQ ID NO: 423545 - DNA, 25 bp, Rattus norvegicus
ggacggtcacactcactcattagac

SEQ ID NO: 423546 - DNA, 25 bp, Rattus norvegicus
ggacggtcacttagcaattttgtac

SEQ ID NO: 423547 - DNA, 25 bp, Rattus norvegicus
ggacggtcactttgcaattttgtac

SEQ ID NO: 423548 - DNA, 25 bp, Rattus norvegicus
ggacggtcgacacatttacatttct

SEQ ID NO: 423549 - DNA, 25 bp, Rattus norvegicus
ggacggtcgacagatttacatttct

SEQ ID NO: 423550 - DNA, 25 bp, Rattus norvegicus
ggacggtctatcagagagcttttca

SEQ ID NO: 423551 - DNA, 25 bp, Rattus norvegicus
ggacggtctatctgagagcttttca

SEQ ID NO: 423552 - DNA, 25 bp, Rattus norvegicus
ggacggtgtaagactggcttcgacc

SEQ ID NO: 423553 - DNA, 25 bp, Rattus norvegicus
ggacggtgtaagtctggcttcgacc

SEQ ID NO: 423554 - DNA, 25 bp, Rattus norvegicus
ggacggttctctctacaagatgcac

SEQ ID NO: 423555 - DNA, 25 bp, Rattus norvegicus
ggacggttctctgtacaagatgcac

SEQ ID NO: 423556 - DNA, 25 bp, Rattus norvegicus
ggacgtaagggcactcaatgatttg

SEQ ID NO: 423557 - DNA, 25 bp, Rattus norvegicus
ggacgtaagggctctcaatgatttg

SEQ ID NO: 423558 - DNA, 25 bp, Rattus norvegicus
ggacgtacacggatctctggatctt

SEQ ID NO: 423559 - DNA, 25 bp, Rattus norvegicus
ggacgtacacggttctctggatctt

SEQ ID NO: 423560 - DNA, 25 bp, Rattus norvegicus
ggacgtagaattagtctgcaaggtt

SEQ ID NO: 423561 - DNA, 25 bp, Rattus norvegicus
ggacgtagaatttgtctgcaaggtt

SEQ ID NO: 423562 - DNA, 25 bp, Rattus norvegicus
ggacgtagcagaaatgccgcttcag

SEQ ID NO: 423563 - DNA, 25 bp, Rattus norvegicus
ggacgtagcagatatgccgcttcag

SEQ ID NO: 423564 - DNA, 25 bp, Rattus norvegicus
ggacgtagctgtattgtaaggatct

SEQ ID NO: 423565 - DNA, 25 bp, Rattus norvegicus
ggacgtagctgttttgtaaggatct

SEQ ID NO: 423566 - DNA, 25 bp, Rattus norvegicus
ggacgtaggaatcctgacaggccca

SEQ ID NO: 423567 - DNA, 25 bp, Rattus norvegicus
ggacgtaggaatgctgacaggccca

SEQ ID NO: 423568 - DNA, 25 bp, Rattus norvegicus
ggacgtagtgatacatgcctagcat

SEQ ID NO: 423569 - DNA, 25 bp, Rattus norvegicus
ggacgtagtgattcatgcctagcat

SEQ ID NO: 423570 - DNA, 25 bp, Rattus norvegicus
ggacgtatcgtaacgtccgatcctc

SEQ ID NO: 423571 - DNA, 25 bp, Rattus norvegicus
ggacgtatcgtatcgtccgatcctc

SEQ ID NO: 423572 - DNA, 25 bp, Rattus norvegicus
ggacgtatgggcaatacatccctca

SEQ ID NO: 423573 - DNA, 25 bp, Rattus norvegicus
ggacgtatgggctatacatccctca

SEQ ID NO: 423574 - DNA, 25 bp, Rattus norvegicus
ggacgtattgccatcttaatcttta

SEQ ID NO: 423575 - DNA, 25 bp, Rattus norvegicus
ggacgtattgccttcttaatcttta

SEQ ID NO: 423576 - DNA, 25 bp, Rattus norvegicus
ggacgtcagaagaacccaagagtta

SEQ ID NO: 423577 - DNA, 25 bp, Rattus norvegicus
ggacgtcagaagtacccaagagtta

SEQ ID NO: 423578 - DNA, 25 bp, Rattus norvegicus
ggacgtcagcctagttggttggttt

SEQ ID NO: 423579 - DNA, 25 bp, Rattus norvegicus
ggacgtcagccttgttggttggttt

SEQ ID NO: 423580 - DNA, 25 bp, Rattus norvegicus
ggacgtcaggagctaccttcagaat

SEQ ID NO: 423581 - DNA, 25 bp, Rattus norvegicus
ggacgtcaggaggtaccttcagaat

SEQ ID NO: 423582 - DNA, 25 bp, Rattus norvegicus
ggacgtcattatacatatagtaaac

SEQ ID NO: 423583 - DNA, 25 bp, Rattus norvegicus
ggacgtcattattcatatagtaaac

SEQ ID NO: 423584 - DNA, 25 bp, Rattus norvegicus
ggacgtccagataatcctgttgtgt

SEQ ID NO: 423585 - DNA, 25 bp, Rattus norvegicus
ggacgtccagattatcctgttgtgt

SEQ ID NO: 423586 - DNA, 25 bp, Rattus norvegicus
ggacgtccctaccatacaagagaag

SEQ ID NO: 423587 - DNA, 25 bp, Rattus norvegicus
ggacgtccctacgatacaagagaag

SEQ ID NO: 423588 - DNA, 25 bp, Rattus norvegicus
ggacgtctggtcagatgtctggcct

SEQ ID NO: 423589 - DNA, 25 bp, Rattus norvegicus
ggacgtctggtctgatgtctggcct

SEQ ID NO: 423590 - DNA, 25 bp, Rattus norvegicus
ggacgtcttgaaaggtgaggttttt

SEQ ID NO: 423591 - DNA, 25 bp, Rattus norvegicus
ggacgtcttgaatggtgaggttttt

SEQ ID NO: 423592 - DNA, 25 bp, Rattus norvegicus
ggacgtgaactgacaggacctcttc

SEQ ID NO: 423593 - DNA, 25 bp, Rattus norvegicus
ggacgtgaactgtcaggacctcttc

SEQ ID NO: 423594 - DNA, 25 bp, Rattus norvegicus
ggacgtgatggtcccgttgcatcct

SEQ ID NO: 423595 - DNA, 25 bp, Rattus norvegicus
ggacgtgatggtgccgttgcatcct

SEQ ID NO: 423596 - DNA, 25 bp, Rattus norvegicus
ggacgtgccactagagcagtgtcat

SEQ ID NO: 423597 - DNA, 25 bp, Rattus norvegicus
ggacgtgccacttgagcagtgtcat

SEQ ID NO: 423598 - DNA, 25 bp, Rattus norvegicus
ggacgtgccctcatcaggaaaggaa

SEQ ID NO: 423599 - DNA, 25 bp, Rattus norvegicus
ggacgtgccctcttcaggaaaggaa

SEQ ID NO: 423600 - DNA, 25 bp, Rattus norvegicus
ggacgtgctctcagtgttttataga

SEQ ID NO: 423601 - DNA, 25 bp, Rattus norvegicus
ggacgtgctctctgtgttttataga

SEQ ID NO: 423602 - DNA, 25 bp, Rattus norvegicus
ggacgtgctgagcaacacctacttc

SEQ ID NO: 423603 - DNA, 25 bp, Rattus norvegicus
ggacgtgctgaggaacacctacttc

SEQ ID NO: 423604 - DNA, 25 bp, Rattus norvegicus
ggacgtgctgccaagggagctctac

SEQ ID NO: 423605 - DNA, 25 bp, Rattus norvegicus
ggacgtgctgcccagactgtgactc

SEQ ID NO: 423606 - DNA, 25 bp, Rattus norvegicus
ggacgtgctgccgagactgtgactc

SEQ ID NO: 423607 - DNA, 25 bp, Rattus norvegicus
ggacgtgctgcctagggagctctac

SEQ ID NO: 423608 - DNA, 25 bp, Rattus norvegicus
ggacgtgctgttaattagctgtgct

SEQ ID NO: 423609 - DNA, 25 bp, Rattus norvegicus
ggacgtgctgtttattagctgtgct

SEQ ID NO: 423610 - DNA, 25 bp, Rattus norvegicus
ggacgtggctccaaaaagatctatt

SEQ ID NO: 423611 - DNA, 25 bp, Rattus norvegicus
ggacgtggctcctaaaagatctatt

SEQ ID NO: 423612 - DNA, 25 bp, Rattus norvegicus
ggacgtggtctacgcactcaaacgc

SEQ ID NO: 423613 - DNA, 25 bp, Rattus norvegicus
ggacgtggtctaggcactcaaacgc

SEQ ID NO: 423614 - DNA, 25 bp, Rattus norvegicus
ggacgtgtaaacaatgtgcaccagc

SEQ ID NO: 423615 - DNA, 25 bp, Rattus norvegicus
ggacgtgtaaactatgtgcaccagc

SEQ ID NO: 423616 - DNA, 25 bp, Rattus norvegicus
ggacgtgtacgtccagctctacctg

SEQ ID NO: 423617 - DNA, 25 bp, Rattus norvegicus
ggacgtgtacgtgcagctctacctg

SEQ ID NO: 423618 - DNA, 25 bp, Rattus norvegicus
ggacgtgtattgacttaacttgctg

SEQ ID NO: 423619 - DNA, 25 bp, Rattus norvegicus
ggacgtgtattgtcttaacttgctg

SEQ ID NO: 423620 - DNA, 25 bp, Rattus norvegicus
ggacgtgtcgctacacaacttcagt

SEQ ID NO: 423621 - DNA, 25 bp, Rattus norvegicus
ggacgtgtcgcttcacaacttcagt

SEQ ID NO: 423622 - DNA, 25 bp, Rattus norvegicus
ggacgtgtgtacattgtgtgctaaa

SEQ ID NO: 423623 - DNA, 25 bp, Rattus norvegicus
ggacgtgtgtactttgtgtgctaaa

SEQ ID NO: 423624 - DNA, 25 bp, Rattus norvegicus
ggacgtgttccgcaagctgccattc

SEQ ID NO: 423625 - DNA, 25 bp, Rattus norvegicus
ggacgtgttccggaagctgccattc

SEQ ID NO: 423626 - DNA, 25 bp, Rattus norvegicus
ggacgtgtttctacatcaggatctt

SEQ ID NO: 423627 - DNA, 25 bp, Rattus norvegicus
ggacgtgtttctcaagagcacatct

SEQ ID NO: 423628 - DNA, 25 bp, Rattus norvegicus
ggacgtgtttctcatgatccggcgc

SEQ ID NO: 423629 - DNA, 25 bp, Rattus norvegicus
ggacgtgtttctgaagagcacatct

SEQ ID NO: 423630 - DNA, 25 bp, Rattus norvegicus
ggacgtgtttctgatgatccggcgc

SEQ ID NO: 423631 - DNA, 25 bp, Rattus norvegicus
ggacgtgtttcttcatcaggatctt

SEQ ID NO: 423632 - DNA, 25 bp, Rattus norvegicus
ggacgttagactacatctttcacag

SEQ ID NO: 423633 - DNA, 25 bp, Rattus norvegicus
ggacgttagacttcatctttcacag

SEQ ID NO: 423634 - DNA, 25 bp, Rattus norvegicus
ggacgttcaaagaactgtggcctgt

SEQ ID NO: 423635 - DNA, 25 bp, Rattus norvegicus
ggacgttcaaagtactgtggcctgt

SEQ ID NO: 423636 - DNA, 25 bp, Rattus norvegicus
ggacgttcaatgacttgctcacacg

SEQ ID NO: 423637 - DNA, 25 bp, Rattus norvegicus
ggacgttcaatgtcttgctcacacg

SEQ ID NO: 423638 - DNA, 25 bp, Rattus norvegicus
ggacgttcctgcataggttcagtga

SEQ ID NO: 423639 - DNA, 25 bp, Rattus norvegicus
ggacgttcctgcttaggttcagtga

SEQ ID NO: 423640 - DNA, 25 bp, Rattus norvegicus
ggacgttcgccactgtgcagcagct

SEQ ID NO: 423641 - DNA, 25 bp, Rattus norvegicus
ggacgttcgccagtgtgcagcagct

SEQ ID NO: 423642 - DNA, 25 bp, Rattus norvegicus
ggacgttcgtgaatgccttttccat

SEQ ID NO: 423643 - DNA, 25 bp, Rattus norvegicus
ggacgttcgtgattgccttttccat

SEQ ID NO: 423644 - DNA, 25 bp, Rattus norvegicus
ggacgttctagcagatagccgccat

SEQ ID NO: 423645 - DNA, 25 bp, Rattus norvegicus
ggacgttctagctgatagccgccat

SEQ ID NO: 423646 - DNA, 25 bp, Rattus norvegicus
ggacgttgaggacttttcgaccaat

SEQ ID NO: 423647 - DNA, 25 bp, Rattus norvegicus
ggacgttgaggagttttcgaccaat

SEQ ID NO: 423648 - DNA, 25 bp, Rattus norvegicus
ggacgttgtaataacttgcacagga

SEQ ID NO: 423649 - DNA, 25 bp, Rattus norvegicus
ggacgttgtaattacttgcacagga

SEQ ID NO: 423650 - DNA, 25 bp, Rattus norvegicus
ggacgtttctctcactatttattct

SEQ ID NO: 423651 - DNA, 25 bp, Rattus norvegicus
ggacgtttctctgactatttattct

SEQ ID NO: 423652 - DNA, 25 bp, Rattus norvegicus
ggacgtttctgccatcttgcaggca

SEQ ID NO: 423653 - DNA, 25 bp, Rattus norvegicus
ggacgtttctgcgatcttgcaggca

SEQ ID NO: 423654 - DNA, 25 bp, Rattus norvegicus
ggacgttttcccactaacatgacag

SEQ ID NO: 423655 - DNA, 25 bp, Rattus norvegicus
ggacgttttccctctaacatgacag

SEQ ID NO: 423656 - DNA, 25 bp, Rattus norvegicus
ggactaaaatccacaagcagcaata

SEQ ID NO: 423657 - DNA, 25 bp, Rattus norvegicus
ggactaaaatcctcaagcagcaata

SEQ ID NO: 423658 - DNA, 25 bp, Rattus norvegicus
ggactaaacacaaaatacgccttct

SEQ ID NO: 423659 - DNA, 25 bp, Rattus norvegicus
ggactaaacacataatacgccttct

SEQ ID NO: 423660 - DNA, 25 bp, Rattus norvegicus
ggactaaagctgaagttcccctagt

SEQ ID NO: 423661 - DNA, 25 bp, Rattus norvegicus
ggactaaagctgtagttcccctagt

SEQ ID NO: 423662 - DNA, 25 bp, Rattus norvegicus
ggactaaaggccatccatcccattg

SEQ ID NO: 423663 - DNA, 25 bp, Rattus norvegicus
ggactaaaggccttccatcccattg

SEQ ID NO: 423664 - DNA, 25 bp, Rattus norvegicus
ggactaaataccattaagccctgtt

SEQ ID NO: 423665 - DNA, 25 bp, Rattus norvegicus
ggactaaatacctttaagccctgtt

SEQ ID NO: 423666 - DNA, 25 bp, Rattus norvegicus
ggactaaatgctcaaactccaggac

SEQ ID NO: 423667 - DNA, 25 bp, Rattus norvegicus
ggactaaatgctgaaactccaggac

SEQ ID NO: 423668 - DNA, 25 bp, Rattus norvegicus
ggactaacatgcagctgtgagccat

SEQ ID NO: 423669 - DNA, 25 bp, Rattus norvegicus
ggactaacatgctgctgtgagccat

SEQ ID NO: 423670 - DNA, 25 bp, Rattus norvegicus
ggactaaccacgcttgagacctaaa

SEQ ID NO: 423671 - DNA, 25 bp, Rattus norvegicus
ggactaaccacggttgagacctaaa

SEQ ID NO: 423672 - DNA, 25 bp, Rattus norvegicus
ggactaacttacagatccctgacta

SEQ ID NO: 423673 - DNA, 25 bp, Rattus norvegicus
ggactaacttactgatccctgacta

SEQ ID NO: 423674 - DNA, 25 bp, Rattus norvegicus
ggactaacttgcatggactgaggtg

SEQ ID NO: 423675 - DNA, 25 bp, Rattus norvegicus
ggactaacttgcttggactgaggtg

SEQ ID NO: 423676 - DNA, 25 bp, Rattus norvegicus
ggactaagacctacctggatgttct

SEQ ID NO: 423677 - DNA, 25 bp, Rattus norvegicus
ggactaagaccttcctggatgttct

SEQ ID NO: 423678 - DNA, 25 bp, Rattus norvegicus
ggactaagcattatcttctcacctt

SEQ ID NO: 423679 - DNA, 25 bp, Rattus norvegicus
ggactaagcattttcttctcacctt

SEQ ID NO: 423680 - DNA, 25 bp, Rattus norvegicus
ggactaagtttcatgacccaggaca

SEQ ID NO: 423681 - DNA, 25 bp, Rattus norvegicus
ggactaagtttcttgacccaggaca

SEQ ID NO: 423682 - DNA, 25 bp, Rattus norvegicus
ggactaataattctcccacactagc

SEQ ID NO: 423683 - DNA, 25 bp, Rattus norvegicus
ggactaataattgtcccacactagc

SEQ ID NO: 423684 - DNA, 25 bp, Rattus norvegicus
ggactaatccttatttgtcacagta

SEQ ID NO: 423685 - DNA, 25 bp, Rattus norvegicus
ggactaatccttttttgtcacagta

SEQ ID NO: 423686 - DNA, 25 bp, Rattus norvegicus
ggactaatggccactggtgctttgt

SEQ ID NO: 423687 - DNA, 25 bp, Rattus norvegicus
ggactaatggcctctggtgctttgt

SEQ ID NO: 423688 - DNA, 25 bp, Rattus norvegicus
ggactaattagcaatctgggcaaca

SEQ ID NO: 423689 - DNA, 25 bp, Rattus norvegicus
ggactaattagctatctgggcaaca

SEQ ID NO: 423690 - DNA, 25 bp, Rattus norvegicus
ggactaatttagctccagaataaca

SEQ ID NO: 423691 - DNA, 25 bp, Rattus norvegicus
ggactaatttaggtccagaataaca

SEQ ID NO: 423692 - DNA, 25 bp, Rattus norvegicus
ggactacaaggcctcttccagaagc

SEQ ID NO: 423693 - DNA, 25 bp, Rattus norvegicus
ggactacaaggcgtcttccagaagc

SEQ ID NO: 423694 - DNA, 25 bp, Rattus norvegicus
ggactacactccatgaagggaccat

SEQ ID NO: 423695 - DNA, 25 bp, Rattus norvegicus
ggactacactccttgaagggaccat

SEQ ID NO: 423696 - DNA, 25 bp, Rattus norvegicus
ggactacactgaaaagccgctttac

SEQ ID NO: 423697 - DNA, 25 bp, Rattus norvegicus
ggactacactgataagccgctttac

SEQ ID NO: 423698 - DNA, 25 bp, Rattus norvegicus
ggactacaggcaaatgccacacacc

SEQ ID NO: 423699 - DNA, 25 bp, Rattus norvegicus
ggactacaggcatatgccacacacc

SEQ ID NO: 423700 - DNA, 25 bp, Rattus norvegicus
ggactacagggaaggcctcggcatt

SEQ ID NO: 423701 - DNA, 25 bp, Rattus norvegicus
ggactacagggatggcctcggcatt

SEQ ID NO: 423702 - DNA, 25 bp, Rattus norvegicus
ggactacagtcgagccttcatgcat

SEQ ID NO: 423703 - DNA, 25 bp, Rattus norvegicus
ggactacagtcgtgccttcatgcat

SEQ ID NO: 423704 - DNA, 25 bp, Rattus norvegicus
ggactacatgtacatccctgactat

SEQ ID NO: 423705 - DNA, 25 bp, Rattus norvegicus
ggactacatgtagatccctgactat

SEQ ID NO: 423706 - DNA, 25 bp, Rattus norvegicus
ggactaccactaatcaactacttct

SEQ ID NO: 423707 - DNA, 25 bp, Rattus norvegicus
ggactaccactattcaactacttct

SEQ ID NO: 423708 - DNA, 25 bp, Rattus norvegicus
ggactaccatatatctgtacaggac

SEQ ID NO: 423709 - DNA, 25 bp, Rattus norvegicus
ggactaccatatttctgtacaggac

SEQ ID NO: 423710 - DNA, 25 bp, Rattus norvegicus
ggactacccagccttctaggctgtt

SEQ ID NO: 423711 - DNA, 25 bp, Rattus norvegicus
ggactacccagcgttctaggctgtt

SEQ ID NO: 423712 - DNA, 25 bp, Rattus norvegicus
ggactacccgaccttggttcagagg

SEQ ID NO: 423713 - DNA, 25 bp, Rattus norvegicus
ggactacccgacgttggttcagagg

SEQ ID NO: 423714 - DNA, 25 bp, Rattus norvegicus
ggactacggagtcagtacccagcat

SEQ ID NO: 423715 - DNA, 25 bp, Rattus norvegicus
ggactacggagtgagtacccagcat

SEQ ID NO: 423716 - DNA, 25 bp, Rattus norvegicus
ggactacgtgtgattcagcaagcaa

SEQ ID NO: 423717 - DNA, 25 bp, Rattus norvegicus
ggactacgtgtgtttcagcaagcaa

SEQ ID NO: 423718 - DNA, 25 bp, Rattus norvegicus
ggactactaagcatgtggtttctct

SEQ ID NO: 423719 - DNA, 25 bp, Rattus norvegicus
ggactactaagcttgtggtttctct

SEQ ID NO: 423720 - DNA, 25 bp, Rattus norvegicus
ggactactacaaatgctgggagcct

SEQ ID NO: 423721 - DNA, 25 bp, Rattus norvegicus
ggactactacaattgctgggagcct

SEQ ID NO: 423722 - DNA, 25 bp, Rattus norvegicus
ggactactagctaccatctgcttaa

SEQ ID NO: 423723 - DNA, 25 bp, Rattus norvegicus
ggactactagcttccatctgcttaa

SEQ ID NO: 423724 - DNA, 25 bp, Rattus norvegicus
ggactactccaaccccaaagagagc

SEQ ID NO: 423725 - DNA, 25 bp, Rattus norvegicus
ggactactccaagcccaaagagagc

SEQ ID NO: 423726 - DNA, 25 bp, Rattus norvegicus
ggactactgagaaccgccatgttca

SEQ ID NO: 423727 - DNA, 25 bp, Rattus norvegicus
ggactactgagatccgccatgttca

SEQ ID NO: 423728 - DNA, 25 bp, Rattus norvegicus
ggactactggatatgaagctcacat

SEQ ID NO: 423729 - DNA, 25 bp, Rattus norvegicus
ggactactggatttgaagctcacat

SEQ ID NO: 423730 - DNA, 25 bp, Rattus norvegicus
ggactactgtgactctggaatgtga

SEQ ID NO: 423731 - DNA, 25 bp, Rattus norvegicus
ggactactgtgagtctggaatgtga

SEQ ID NO: 423732 - DNA, 25 bp, Rattus norvegicus
ggactacttgtacatgaacatctgg

SEQ ID NO: 423733 - DNA, 25 bp, Rattus norvegicus
ggactacttgtagatgaacatctgg

SEQ ID NO: 423734 - DNA, 25 bp, Rattus norvegicus
ggactagaagcccagttctgcgatc

SEQ ID NO: 423735 - DNA, 25 bp, Rattus norvegicus
ggactagaagccgagttctgcgatc

SEQ ID NO: 423736 - DNA, 25 bp, Rattus norvegicus
ggactagactccatagcagcagatg

SEQ ID NO: 423737 - DNA, 25 bp, Rattus norvegicus
ggactagactccttagcagcagatg

SEQ ID NO: 423738 - DNA, 25 bp, Rattus norvegicus
ggactagacttgcaagcctgccata

SEQ ID NO: 423739 - DNA, 25 bp, Rattus norvegicus
ggactagacttggaagcctgccata

SEQ ID NO: 423740 - DNA, 25 bp, Rattus norvegicus
ggactagagtaacagggctaccctt

SEQ ID NO: 423741 - DNA, 25 bp, Rattus norvegicus
ggactagagtaagagggctaccctt

SEQ ID NO: 423742 - DNA, 25 bp, Rattus norvegicus
ggactagatagcaaccctgtctcaa

SEQ ID NO: 423743 - DNA, 25 bp, Rattus norvegicus
ggactagatagctaccctgtctcaa

SEQ ID NO: 423744 - DNA, 25 bp, Rattus norvegicus
ggactagatgagattccaccgaaat

SEQ ID NO: 423745 - DNA, 25 bp, Rattus norvegicus
ggactagatgagtttccaccgaaat

SEQ ID NO: 423746 - DNA, 25 bp, Rattus norvegicus
ggactagatgtcctcaggtcttttc

SEQ ID NO: 423747 - DNA, 25 bp, Rattus norvegicus
ggactagatgtcgtcaggtcttttc

SEQ ID NO: 423748 - DNA, 25 bp, Rattus norvegicus
ggactagattccaaggccctataca

SEQ ID NO: 423749 - DNA, 25 bp, Rattus norvegicus
ggactagattccacttcaaacagtt

SEQ ID NO: 423750 - DNA, 25 bp, Rattus norvegicus
ggactagattcctaggccctataca

SEQ ID NO: 423751 - DNA, 25 bp, Rattus norvegicus
ggactagattcctcttcaaacagtt

SEQ ID NO: 423752 - DNA, 25 bp, Rattus norvegicus
ggactagattgaccttagcccacaa

SEQ ID NO: 423753 - DNA, 25 bp, Rattus norvegicus
ggactagattgagcttagcccacaa

SEQ ID NO: 423754 - DNA, 25 bp, Rattus norvegicus
ggactaggactaacaatatctcatc

SEQ ID NO: 423755 - DNA, 25 bp, Rattus norvegicus
ggactaggactatcaatatctcatc

SEQ ID NO: 423756 - DNA, 25 bp, Rattus norvegicus
ggactaggagcaacccaagccttgt

SEQ ID NO: 423757 - DNA, 25 bp, Rattus norvegicus
ggactaggagcatcccaagccttgt

SEQ ID NO: 423758 - DNA, 25 bp, Rattus norvegicus
ggactaggaggaacctcttctagag

SEQ ID NO: 423759 - DNA, 25 bp, Rattus norvegicus
ggactaggaggatcctcttctagag

SEQ ID NO: 423760 - DNA, 25 bp, Rattus norvegicus
ggactaggataaagtttctaacaat

SEQ ID NO: 423761 - DNA, 25 bp, Rattus norvegicus
ggactaggataatgtttctaacaat

SEQ ID NO: 423762 - DNA, 25 bp, Rattus norvegicus
ggactaggatctatcccacatggaa

SEQ ID NO: 423763 - DNA, 25 bp, Rattus norvegicus
ggactaggatctttcccacatggaa

SEQ ID NO: 423764 - DNA, 25 bp, Rattus norvegicus
ggactaggctgtctactgctttcaa

SEQ ID NO: 423765 - DNA, 25 bp, Rattus norvegicus
ggactaggctgtgtactgctttcaa

SEQ ID NO: 423766 - DNA, 25 bp, Rattus norvegicus
ggactagggataaatacagctcggt

SEQ ID NO: 423767 - DNA, 25 bp, Rattus norvegicus
ggactagggatatatacagctcggt

SEQ ID NO: 423768 - DNA, 25 bp, Rattus norvegicus
ggactagggattaggcaatccttga

SEQ ID NO: 423769 - DNA, 25 bp, Rattus norvegicus
ggactagggatttggcaatccttga

SEQ ID NO: 423770 - DNA, 25 bp, Rattus norvegicus
ggactagggttcagattgcctctct

SEQ ID NO: 423771 - DNA, 25 bp, Rattus norvegicus
ggactagggttctgattgcctctct

SEQ ID NO: 423772 - DNA, 25 bp, Rattus norvegicus
ggactaggtgtcctcaaacacctct

SEQ ID NO: 423773 - DNA, 25 bp, Rattus norvegicus
ggactaggtgtcgtcaaacacctct

SEQ ID NO: 423774 - DNA, 25 bp, Rattus norvegicus
ggactagtttatcctgtcttggcaa

SEQ ID NO: 423775 - DNA, 25 bp, Rattus norvegicus
ggactagtttatgctgtcttggcaa

SEQ ID NO: 423776 - DNA, 25 bp, Rattus norvegicus
ggactataaactcctcatgccagag

SEQ ID NO: 423777 - DNA, 25 bp, Rattus norvegicus
ggactataaactgctcatgccagag

SEQ ID NO: 423778 - DNA, 25 bp, Rattus norvegicus
ggactataaattacagcttttgctt

SEQ ID NO: 423779 - DNA, 25 bp, Rattus norvegicus
ggactataaatttcagcttttgctt

SEQ ID NO: 423780 - DNA, 25 bp, Rattus norvegicus
ggactatacagcaaacaaccatgtg

SEQ ID NO: 423781 - DNA, 25 bp, Rattus norvegicus
ggactatacagctaacaaccatgtg

SEQ ID NO: 423782 - DNA, 25 bp, Rattus norvegicus
ggactatacatcctagccttcaagt

SEQ ID NO: 423783 - DNA, 25 bp, Rattus norvegicus
ggactatacatcgtagccttcaagt

SEQ ID NO: 423784 - DNA, 25 bp, Rattus norvegicus
ggactatatactcagccactttctc

SEQ ID NO: 423785 - DNA, 25 bp, Rattus norvegicus
ggactatatactgagccactttctc

SEQ ID NO: 423786 - DNA, 25 bp, Rattus norvegicus
ggactatcacagaccgacatggagt

SEQ ID NO: 423787 - DNA, 25 bp, Rattus norvegicus
ggactatcacagtccgacatggagt

SEQ ID NO: 423788 - DNA, 25 bp, Rattus norvegicus
ggactatcagtgaccacaatccctt

SEQ ID NO: 423789 - DNA, 25 bp, Rattus norvegicus
ggactatcagtgtccacaatccctt

SEQ ID NO: 423790 - DNA, 25 bp, Rattus norvegicus
ggactatctgcactaccacattaag

SEQ ID NO: 423791 - DNA, 25 bp, Rattus norvegicus
ggactatctgcagtaccacattaag

SEQ ID NO: 423792 - DNA, 25 bp, Rattus norvegicus
ggactatctgtgcattctgtggccc

SEQ ID NO: 423793 - DNA, 25 bp, Rattus norvegicus
ggactatctgtggattctgtggccc

SEQ ID NO: 423794 - DNA, 25 bp, Rattus norvegicus
ggactatcttagaatgatgctgttt

SEQ ID NO: 423795 - DNA, 25 bp, Rattus norvegicus
ggactatcttagtatgatgctgttt

SEQ ID NO: 423796 - DNA, 25 bp, Rattus norvegicus
ggactatgaaacaacggccccgatg

SEQ ID NO: 423797 - DNA, 25 bp, Rattus norvegicus
ggactatgaaactacggccccgatg

SEQ ID NO: 423798 - DNA, 25 bp, Rattus norvegicus
ggactatgagcccaaacactaccaa

SEQ ID NO: 423799 - DNA, 25 bp, Rattus norvegicus
ggactatgagccgaaacactaccaa

SEQ ID NO: 423800 - DNA, 25 bp, Rattus norvegicus
ggactatgaggacatgatgcagatt

SEQ ID NO: 423801 - DNA, 25 bp, Rattus norvegicus
ggactatgaggagatgatgcagatt

SEQ ID NO: 423802 - DNA, 25 bp, Rattus norvegicus
ggactatgcaccaaaatgacccttt

SEQ ID NO: 423803 - DNA, 25 bp, Rattus norvegicus
ggactatgcacctaaatgacccttt

SEQ ID NO: 423804 - DNA, 25 bp, Rattus norvegicus
ggactatgtactacaaaccctgttt

SEQ ID NO: 423805 - DNA, 25 bp, Rattus norvegicus
ggactatgtacttcaaaccctgttt

SEQ ID NO: 423806 - DNA, 25 bp, Rattus norvegicus
ggactatgtcacatgtcactcagtg

SEQ ID NO: 423807 - DNA, 25 bp, Rattus norvegicus
ggactatgtcacttgtcactcagtg

SEQ ID NO: 423808 - DNA, 25 bp, Rattus norvegicus
ggactatgtcagaacgttgcttttt

SEQ ID NO: 423809 - DNA, 25 bp, Rattus norvegicus
ggactatgtcagtacgttgcttttt

SEQ ID NO: 423810 - DNA, 25 bp, Rattus norvegicus
ggactatgtgttatccttgctcact

SEQ ID NO: 423811 - DNA, 25 bp, Rattus norvegicus
ggactatgtgttttccttgctcact

SEQ ID NO: 423812 - DNA, 25 bp, Rattus norvegicus
ggactatgtttcaagctgctcaaaa

SEQ ID NO: 423813 - DNA, 25 bp, Rattus norvegicus
ggactatgtttctagctgctcaaaa

SEQ ID NO: 423814 - DNA, 25 bp, Rattus norvegicus
ggactattaccaaagcactcggcca

SEQ ID NO: 423815 - DNA, 25 bp, Rattus norvegicus
ggactattaccatagcactcggcca

SEQ ID NO: 423816 - DNA, 25 bp, Rattus norvegicus
ggactattactcagatgctttggaa

SEQ ID NO: 423817 - DNA, 25 bp, Rattus norvegicus
ggactattactctgatgctttggaa

SEQ ID NO: 423818 - DNA, 25 bp, Rattus norvegicus
ggactattcagtcaggagcctcgac

SEQ ID NO: 423819 - DNA, 25 bp, Rattus norvegicus
ggactattcagtgaggagcctcgac

SEQ ID NO: 423820 - DNA, 25 bp, Rattus norvegicus
ggactattggctacagatggctgtt

SEQ ID NO: 423821 - DNA, 25 bp, Rattus norvegicus
ggactattggcttcagatggctgtt

SEQ ID NO: 423822 - DNA, 25 bp, Rattus norvegicus
ggactattggttagtgcatcttaca

SEQ ID NO: 423823 - DNA, 25 bp, Rattus norvegicus
ggactattggtttgtgcatcttaca

SEQ ID NO: 423824 - DNA, 25 bp, Rattus norvegicus
ggactatttacgctatacttacttt

SEQ ID NO: 423825 - DNA, 25 bp, Rattus norvegicus
ggactatttacggtatacttacttt

SEQ ID NO: 423826 - DNA, 25 bp, Rattus norvegicus
ggactatttccccataacatgtgat

SEQ ID NO: 423827 - DNA, 25 bp, Rattus norvegicus
ggactatttcccgataacatgtgat

SEQ ID NO: 423828 - DNA, 25 bp, Rattus norvegicus
ggactatttctgcttttctagctgt

SEQ ID NO: 423829 - DNA, 25 bp, Rattus norvegicus
ggactatttctggttttctagctgt

SEQ ID NO: 423830 - DNA, 25 bp, Rattus norvegicus
ggactatttgctattgcagggaatc

SEQ ID NO: 423831 - DNA, 25 bp, Rattus norvegicus
ggactatttgcttttgcagggaatc

SEQ ID NO: 423832 - DNA, 25 bp, Rattus norvegicus
ggactcaaacgtcagcggactccag

SEQ ID NO: 423833 - DNA, 25 bp, Rattus norvegicus
ggactcaaacgtgagcggactccag

SEQ ID NO: 423834 - DNA, 25 bp, Rattus norvegicus
ggactcaaagacatgcagtcatctg

SEQ ID NO: 423835 - DNA, 25 bp, Rattus norvegicus
ggactcaaagacttgcagtcatctg

SEQ ID NO: 423836 - DNA, 25 bp, Rattus norvegicus
ggactcaaaggactccgtggacatt

SEQ ID NO: 423837 - DNA, 25 bp, Rattus norvegicus
ggactcaaaggagtccgtggacatt

SEQ ID NO: 423838 - DNA, 25 bp, Rattus norvegicus
ggactcaaaggcacatgacctgcat

SEQ ID NO: 423839 - DNA, 25 bp, Rattus norvegicus
ggactcaaaggcatgtgtctaccct

SEQ ID NO: 423840 - DNA, 25 bp, Rattus norvegicus
ggactcaaaggctcatgacctgcat

SEQ ID NO: 423841 - DNA, 25 bp, Rattus norvegicus
ggactcaaaggcttgtgtctaccct

SEQ ID NO: 423842 - DNA, 25 bp, Rattus norvegicus
ggactcaaatcaacgtggccctcag

SEQ ID NO: 423843 - DNA, 25 bp, Rattus norvegicus
ggactcaaatcatcgtggccctcag

SEQ ID NO: 423844 - DNA, 25 bp, Rattus norvegicus
ggactcaacagtcgcaggctcttta

SEQ ID NO: 423845 - DNA, 25 bp, Rattus norvegicus
ggactcaacagtggcaggctcttta

SEQ ID NO: 423846 - DNA, 25 bp, Rattus norvegicus
ggactcaaccaaacagagcctttct

SEQ ID NO: 423847 - DNA, 25 bp, Rattus norvegicus
ggactcaaccaaagacctgtgacct

SEQ ID NO: 423848 - DNA, 25 bp, Rattus norvegicus
ggactcaaccaatcagagcctttct

SEQ ID NO: 423849 - DNA, 25 bp, Rattus norvegicus
ggactcaaccaatgacctgtgacct

SEQ ID NO: 423850 - DNA, 25 bp, Rattus norvegicus
ggactcaaccacaggatctgacaca

SEQ ID NO: 423851 - DNA, 25 bp, Rattus norvegicus
ggactcaaccactggatctgacaca

SEQ ID NO: 423852 - DNA, 25 bp, Rattus norvegicus
ggactcaactgaatcataacgtgtt

SEQ ID NO: 423853 - DNA, 25 bp, Rattus norvegicus
ggactcaactgattcataacgtgtt

SEQ ID NO: 423854 - DNA, 25 bp, Rattus norvegicus
ggactcaactggaactcacagccaa

SEQ ID NO: 423855 - DNA, 25 bp, Rattus norvegicus
ggactcaactggatcccggggacag

SEQ ID NO: 423856 - DNA, 25 bp, Rattus norvegicus
ggactcaactggtactcacagccaa

SEQ ID NO: 423857 - DNA, 25 bp, Rattus norvegicus
ggactcaactggttcccggggacag

SEQ ID NO: 423858 - DNA, 25 bp, Rattus norvegicus
ggactcaagacacgcgcctggccta

SEQ ID NO: 423859 - DNA, 25 bp, Rattus norvegicus
ggactcaagacaggcgcctggccta

SEQ ID NO: 423860 - DNA, 25 bp, Rattus norvegicus
ggactcacagagaatttcagatgaa

SEQ ID NO: 423861 - DNA, 25 bp, Rattus norvegicus
ggactcacagagtatttcagatgaa

SEQ ID NO: 423862 - DNA, 25 bp, Rattus norvegicus
ggactcacagatatcaagccaggct

SEQ ID NO: 423863 - DNA, 25 bp, Rattus norvegicus
ggactcacagatttcaagccaggct

SEQ ID NO: 423864 - DNA, 25 bp, Rattus norvegicus
ggactcacatataccggcaggttga

SEQ ID NO: 423865 - DNA, 25 bp, Rattus norvegicus
ggactcacatattccggcaggttga

SEQ ID NO: 423866 - DNA, 25 bp, Rattus norvegicus
ggactcacctccagaagatatgctt

SEQ ID NO: 423867 - DNA, 25 bp, Rattus norvegicus
ggactcacctcctgaagatatgctt

SEQ ID NO: 423868 - DNA, 25 bp, Rattus norvegicus
ggactcactcctaatacttgcaata

SEQ ID NO: 423869 - DNA, 25 bp, Rattus norvegicus
ggactcactccttatacttgcaata

SEQ ID NO: 423870 - DNA, 25 bp, Rattus norvegicus
ggactcactgagcacagctttgaac

SEQ ID NO: 423871 - DNA, 25 bp, Rattus norvegicus
ggactcactgaggacagctttgaac

SEQ ID NO: 423872 - DNA, 25 bp, Rattus norvegicus
ggactcactgctctatgacgatggg

SEQ ID NO: 423873 - DNA, 25 bp, Rattus norvegicus
ggactcactgctgtatgacgatggg

SEQ ID NO: 423874 - DNA, 25 bp, Rattus norvegicus
ggactcactgtccagttcataggga

SEQ ID NO: 423875 - DNA, 25 bp, Rattus norvegicus
ggactcactgtcgagttcataggga

SEQ ID NO: 423876 - DNA, 25 bp, Rattus norvegicus
ggactcactttcatgaagcgaaact

SEQ ID NO: 423877 - DNA, 25 bp, Rattus norvegicus
ggactcactttcttgaagcgaaact

SEQ ID NO: 423878 - DNA, 25 bp, Rattus norvegicus
ggactcagacatattctgaccttct

SEQ ID NO: 423879 - DNA, 25 bp, Rattus norvegicus
ggactcagacattttctgaccttct

SEQ ID NO: 423880 - DNA, 25 bp, Rattus norvegicus
ggactcagagatcacgaccacaggt

SEQ ID NO: 423881 - DNA, 25 bp, Rattus norvegicus
ggactcagagatgacgaccacaggt

SEQ ID NO: 423882 - DNA, 25 bp, Rattus norvegicus
ggactcagagcaacaacagcgcctt

SEQ ID NO: 423883 - DNA, 25 bp, Rattus norvegicus
ggactcagagcatcaacagcgcctt

SEQ ID NO: 423884 - DNA, 25 bp, Rattus norvegicus
ggactcagatccatgtgcttgtaga

SEQ ID NO: 423885 - DNA, 25 bp, Rattus norvegicus
ggactcagatccttgtgcttgtaga

SEQ ID NO: 423886 - DNA, 25 bp, Rattus norvegicus
ggactcagattaaggctcaggctat

SEQ ID NO: 423887 - DNA, 25 bp, Rattus norvegicus
ggactcagattatggctcaggctat

SEQ ID NO: 423888 - DNA, 25 bp, Rattus norvegicus
ggactcagcctcaactgcatatgga

SEQ ID NO: 423889 - DNA, 25 bp, Rattus norvegicus
ggactcagcctctactgcatatgga

SEQ ID NO: 423890 - DNA, 25 bp, Rattus norvegicus
ggactcagccttccaactgaacagg

SEQ ID NO: 423891 - DNA, 25 bp, Rattus norvegicus
ggactcagccttgcaactgaacagg

SEQ ID NO: 423892 - DNA, 25 bp, Rattus norvegicus
ggactcagcgctcatcggcaataaa

SEQ ID NO: 423893 - DNA, 25 bp, Rattus norvegicus
ggactcagcgctgatcggcaataaa

SEQ ID NO: 423894 - DNA, 25 bp, Rattus norvegicus
ggactcagctaccactatgctcaca

SEQ ID NO: 423895 - DNA, 25 bp, Rattus norvegicus
ggactcagctacgactatgctcaca

SEQ ID NO: 423896 - DNA, 25 bp, Rattus norvegicus
ggactcagctatctaggtcttcccc

SEQ ID NO: 423897 - DNA, 25 bp, Rattus norvegicus
ggactcagctatgtaggtcttcccc

SEQ ID NO: 423898 - DNA, 25 bp, Rattus norvegicus
ggactcaggactacacttccagagt

SEQ ID NO: 423899 - DNA, 25 bp, Rattus norvegicus
ggactcaggactacagggttccata

SEQ ID NO: 423900 - DNA, 25 bp, Rattus norvegicus
ggactcaggacttcacttccagagt

SEQ ID NO: 423901 - DNA, 25 bp, Rattus norvegicus
ggactcaggacttcagggttccata

SEQ ID NO: 423902 - DNA, 25 bp, Rattus norvegicus
ggactcaggattcaatgttcccaaa

SEQ ID NO: 423903 - DNA, 25 bp, Rattus norvegicus
ggactcaggattgaatgttcccaaa

SEQ ID NO: 423904 - DNA, 25 bp, Rattus norvegicus
ggactcaggcagatgatggacagtt

SEQ ID NO: 423905 - DNA, 25 bp, Rattus norvegicus
ggactcaggcagttgatggacagtt

SEQ ID NO: 423906 - DNA, 25 bp, Rattus norvegicus
ggactcagggaactactccaacgaa

SEQ ID NO: 423907 - DNA, 25 bp, Rattus norvegicus
ggactcagggaagtactccaacgaa

SEQ ID NO: 423908 - DNA, 25 bp, Rattus norvegicus
ggactcagggctcccacgaatgttc

SEQ ID NO: 423909 - DNA, 25 bp, Rattus norvegicus
ggactcagggctgccacgaatgttc

SEQ ID NO: 423910 - DNA, 25 bp, Rattus norvegicus
ggactcagtggaatgtggtgctaac

SEQ ID NO: 423911 - DNA, 25 bp, Rattus norvegicus
ggactcagtggattgtggtgctaac

SEQ ID NO: 423912 - DNA, 25 bp, Rattus norvegicus
ggactcagtgtcatcagtggtttgt

SEQ ID NO: 423913 - DNA, 25 bp, Rattus norvegicus
ggactcagtgtcttcagtggtttgt

SEQ ID NO: 423914 - DNA, 25 bp, Rattus norvegicus
ggactcagtttgcaccctttttgta

SEQ ID NO: 423915 - DNA, 25 bp, Rattus norvegicus
ggactcagtttggaccctttttgta

SEQ ID NO: 423916 - DNA, 25 bp, Rattus norvegicus
ggactcataaaaccccactctactg

SEQ ID NO: 423917 - DNA, 25 bp, Rattus norvegicus
ggactcataaaagcccactctactg

SEQ ID NO: 423918 - DNA, 25 bp, Rattus norvegicus
ggactcataaccagaggcgccgaat

SEQ ID NO: 423919 - DNA, 25 bp, Rattus norvegicus
ggactcataacctgaggcgccgaat

SEQ ID NO: 423920 - DNA, 25 bp, Rattus norvegicus
ggactcatactgactgggtcttagt

SEQ ID NO: 423921 - DNA, 25 bp, Rattus norvegicus
ggactcatactgtctgggtcttagt

SEQ ID NO: 423922 - DNA, 25 bp, Rattus norvegicus
ggactcatattcattaccatgtggg

SEQ ID NO: 423923 - DNA, 25 bp, Rattus norvegicus
ggactcatattctttaccatgtggg

SEQ ID NO: 423924 - DNA, 25 bp, Rattus norvegicus
ggactcatcaccattgaaagccttg

SEQ ID NO: 423925 - DNA, 25 bp, Rattus norvegicus
ggactcatcacctttgaaagccttg

SEQ ID NO: 423926 - DNA, 25 bp, Rattus norvegicus
ggactcatctgccatgaactgattt

SEQ ID NO: 423927 - DNA, 25 bp, Rattus norvegicus
ggactcatctgcgatgaactgattt

SEQ ID NO: 423928 - DNA, 25 bp, Rattus norvegicus
ggactcatgaggaagctggataact

SEQ ID NO: 423929 - DNA, 25 bp, Rattus norvegicus
ggactcatgaggtagctggataact

SEQ ID NO: 423930 - DNA, 25 bp, Rattus norvegicus
ggactcatggcaatgctgatctttg

SEQ ID NO: 423931 - DNA, 25 bp, Rattus norvegicus
ggactcatggcattgctgatctttg

SEQ ID NO: 423932 - DNA, 25 bp, Rattus norvegicus
ggactcatggtaatcctcatagagg

SEQ ID NO: 423933 - DNA, 25 bp, Rattus norvegicus
ggactcatggtattcctcatagagg

SEQ ID NO: 423934 - DNA, 25 bp, Rattus norvegicus
ggactcattcaaaaacctaggccgt

SEQ ID NO: 423935 - DNA, 25 bp, Rattus norvegicus
ggactcattcaataacctaggccgt

SEQ ID NO: 423936 - DNA, 25 bp, Rattus norvegicus
ggactcattcccagacaaagcaata

SEQ ID NO: 423937 - DNA, 25 bp, Rattus norvegicus
ggactcattccctgacaaagcaata

SEQ ID NO: 423938 - DNA, 25 bp, Rattus norvegicus
ggactcattgacatgggaactgcct

SEQ ID NO: 423939 - DNA, 25 bp, Rattus norvegicus
ggactcattgacttgggaactgcct

SEQ ID NO: 423940 - DNA, 25 bp, Rattus norvegicus
ggactcattggaaatcagagcattt

SEQ ID NO: 423941 - DNA, 25 bp, Rattus norvegicus
ggactcattggatatcagagcattt

SEQ ID NO: 423942 - DNA, 25 bp, Rattus norvegicus
ggactccaagtactagtgattcaga

SEQ ID NO: 423943 - DNA, 25 bp, Rattus norvegicus
ggactccaagtagtagtgattcaga

SEQ ID NO: 423944 - DNA, 25 bp, Rattus norvegicus
ggactccaagtgatctgtctcagag

SEQ ID NO: 423945 - DNA, 25 bp, Rattus norvegicus
ggactccaagtgttctgtctcagag

SEQ ID NO: 423946 - DNA, 25 bp, Rattus norvegicus
ggactccacaacactagactcataa

SEQ ID NO: 423947 - DNA, 25 bp, Rattus norvegicus
ggactccacaactctagactcataa

SEQ ID NO: 423948 - DNA, 25 bp, Rattus norvegicus
ggactccacctcacgaattatggat

SEQ ID NO: 423949 - DNA, 25 bp, Rattus norvegicus
ggactccacctctcgaattatggat

SEQ ID NO: 423950 - DNA, 25 bp, Rattus norvegicus
ggactccactttagagtctgaacag

SEQ ID NO: 423951 - DNA, 25 bp, Rattus norvegicus
ggactccacttttgagtctgaacag

SEQ ID NO: 423952 - DNA, 25 bp, Rattus norvegicus
ggactccagacactaactcattaac

SEQ ID NO: 423953 - DNA, 25 bp, Rattus norvegicus
ggactccagacagtaactcattaac

SEQ ID NO: 423954 - DNA, 25 bp, Rattus norvegicus
ggactccagagtaaaatcagcttaa

SEQ ID NO: 423955 - DNA, 25 bp, Rattus norvegicus
ggactccagagttaaatcagcttaa

SEQ ID NO: 423956 - DNA, 25 bp, Rattus norvegicus
ggactccagcatatacttatcaata

SEQ ID NO: 423957 - DNA, 25 bp, Rattus norvegicus
ggactccagcatttacttatcaata

SEQ ID NO: 423958 - DNA, 25 bp, Rattus norvegicus
ggactccagccaattcttttaaaca

SEQ ID NO: 423959 - DNA, 25 bp, Rattus norvegicus
ggactccagccatttcttttaaaca

SEQ ID NO: 423960 - DNA, 25 bp, Rattus norvegicus
ggactccagcccacgaggatggaat

SEQ ID NO: 423961 - DNA, 25 bp, Rattus norvegicus
ggactccagcccagagggaactgaa

SEQ ID NO: 423962 - DNA, 25 bp, Rattus norvegicus
ggactccagccctcgaggatggaat

SEQ ID NO: 423963 - DNA, 25 bp, Rattus norvegicus
ggactccagccctgagggaactgaa

SEQ ID NO: 423964 - DNA, 25 bp, Rattus norvegicus
ggactccaggagaaagggcagctat

SEQ ID NO: 423965 - DNA, 25 bp, Rattus norvegicus
ggactccaggagtaagggcagctat

SEQ ID NO: 423966 - DNA, 25 bp, Rattus norvegicus
ggactccagggaagccagaggctct

SEQ ID NO: 423967 - DNA, 25 bp, Rattus norvegicus
ggactccagggatgccagaggctct

SEQ ID NO: 423968 - DNA, 25 bp, Rattus norvegicus
ggactccaggtgaaactctttgcca

SEQ ID NO: 423969 - DNA, 25 bp, Rattus norvegicus
ggactccaggtgtaactctttgcca

SEQ ID NO: 423970 - DNA, 25 bp, Rattus norvegicus
ggactccagtgccacatgcgaaaag

SEQ ID NO: 423971 - DNA, 25 bp, Rattus norvegicus
ggactccagtgcgacatgcgaaaag

SEQ ID NO: 423972 - DNA, 25 bp, Rattus norvegicus
ggactccatcacaagcctgcataag

SEQ ID NO: 423973 - DNA, 25 bp, Rattus norvegicus
ggactccatcactagcctgcataag

SEQ ID NO: 423974 - DNA, 25 bp, Rattus norvegicus
ggactccatcctaagctgatagtta

SEQ ID NO: 423975 - DNA, 25 bp, Rattus norvegicus
ggactccatccttagctgatagtta

SEQ ID NO: 423976 - DNA, 25 bp, Rattus norvegicus
ggactccatgggaaccaggcacaag

SEQ ID NO: 423977 - DNA, 25 bp, Rattus norvegicus
ggactccatgggagtttgcacgtat

SEQ ID NO: 423978 - DNA, 25 bp, Rattus norvegicus
ggactccatgggtaccaggcacaag

SEQ ID NO: 423979 - DNA, 25 bp, Rattus norvegicus
ggactccatgggtgtttgcacgtat

SEQ ID NO: 423980 - DNA, 25 bp, Rattus norvegicus
ggactccattatcaaccacagagct

SEQ ID NO: 423981 - DNA, 25 bp, Rattus norvegicus
ggactccattatgaaccacagagct

SEQ ID NO: 423982 - DNA, 25 bp, Rattus norvegicus
ggactccattttcagcatgcttgtc

SEQ ID NO: 423983 - DNA, 25 bp, Rattus norvegicus
ggactccattttgagcatgcttgtc

SEQ ID NO: 423984 - DNA, 25 bp, Rattus norvegicus
ggactcccaaagactggcaggctga

SEQ ID NO: 423985 - DNA, 25 bp, Rattus norvegicus
ggactcccaaagtctggcaggctga

SEQ ID NO: 423986 - DNA, 25 bp, Rattus norvegicus
ggactcccaacaccaggagcaggct

SEQ ID NO: 423987 - DNA, 25 bp, Rattus norvegicus
ggactcccaacagcaggagcaggct

SEQ ID NO: 423988 - DNA, 25 bp, Rattus norvegicus
ggactcccacctccctggagtaaat

SEQ ID NO: 423989 - DNA, 25 bp, Rattus norvegicus
ggactcccacctgcctggagtaaat

SEQ ID NO: 423990 - DNA, 25 bp, Rattus norvegicus
ggactcccagatcaagagcatcatt

SEQ ID NO: 423991 - DNA, 25 bp, Rattus norvegicus
ggactcccagatgaagagcatcatt

SEQ ID NO: 423992 - DNA, 25 bp, Rattus norvegicus
ggactcccagttaataggtgtctaa

SEQ ID NO: 423993 - DNA, 25 bp, Rattus norvegicus
ggactcccagtttataggtgtctaa

SEQ ID NO: 423994 - DNA, 25 bp, Rattus norvegicus
ggactccctcatacagtgagctgag

SEQ ID NO: 423995 - DNA, 25 bp, Rattus norvegicus
ggactccctcattcagtgagctgag

SEQ ID NO: 423996 - DNA, 25 bp, Rattus norvegicus
ggactccctgacactttaacgataa

SEQ ID NO: 423997 - DNA, 25 bp, Rattus norvegicus
ggactccctgactctttaacgataa

SEQ ID NO: 423998 - DNA, 25 bp, Rattus norvegicus
ggactccctgtgacctaagaaatgc

SEQ ID NO: 423999 - DNA, 25 bp, Rattus norvegicus
ggactccctgtgtcctaagaaatgc

SEQ ID NO: 424000 - DNA, 25 bp, Rattus norvegicus
ggactcctaaacacatctacacaat

SEQ ID NO: 424001 - DNA, 25 bp, Rattus norvegicus
ggactcctaaactcatctacacaat

SEQ ID NO: 424002 - DNA, 25 bp, Rattus norvegicus
ggactcctaaataatcagctctctg

SEQ ID NO: 424003 - DNA, 25 bp, Rattus norvegicus
ggactcctaaattatcagctctctg

SEQ ID NO: 424004 - DNA, 25 bp, Rattus norvegicus
ggactcctagatcctcttcggaaga

SEQ ID NO: 424005 - DNA, 25 bp, Rattus norvegicus
ggactcctagatgctcttcggaaga

SEQ ID NO: 424006 - DNA, 25 bp, Rattus norvegicus
ggactcctagctccagtaaggctgt

SEQ ID NO: 424007 - DNA, 25 bp, Rattus norvegicus
ggactcctagctgcagtaaggctgt

SEQ ID NO: 424008 - DNA, 25 bp, Rattus norvegicus
ggactcctaggcagggcaggtcaca

SEQ ID NO: 424009 - DNA, 25 bp, Rattus norvegicus
ggactcctaggctgggcaggtcaca

SEQ ID NO: 424010 - DNA, 25 bp, Rattus norvegicus
ggactcctatccaatttatttgacg

SEQ ID NO: 424011 - DNA, 25 bp, Rattus norvegicus
ggactcctatcctatttatttgacg

SEQ ID NO: 424012 - DNA, 25 bp, Rattus norvegicus
ggactcctcagacccagggtgagaa

SEQ ID NO: 424013 - DNA, 25 bp, Rattus norvegicus
ggactcctcagagccagggtgagaa

SEQ ID NO: 424014 - DNA, 25 bp, Rattus norvegicus
ggactcctccacacaagctaatgag

SEQ ID NO: 424015 - DNA, 25 bp, Rattus norvegicus
ggactcctccactcaagctaatgag

SEQ ID NO: 424016 - DNA, 25 bp, Rattus norvegicus
ggactcctccgacgaagagtcacat

SEQ ID NO: 424017 - DNA, 25 bp, Rattus norvegicus
ggactcctccgaggaagagtcacat

SEQ ID NO: 424018 - DNA, 25 bp, Rattus norvegicus
ggactcctctcgctggcagtgtgaa

SEQ ID NO: 424019 - DNA, 25 bp, Rattus norvegicus
ggactcctctcggtggcagtgtgaa

SEQ ID NO: 424020 - DNA, 25 bp, Rattus norvegicus
ggactcctctttatgtagcttgtat

SEQ ID NO: 424021 - DNA, 25 bp, Rattus norvegicus
ggactcctctttccaggatagtctt

SEQ ID NO: 424022 - DNA, 25 bp, Rattus norvegicus
ggactcctctttgcaggatagtctt

SEQ ID NO: 424023 - DNA, 25 bp, Rattus norvegicus
ggactcctctttttgtagcttgtat

SEQ ID NO: 424024 - DNA, 25 bp, Rattus norvegicus
ggactcctgaccactatagttgtta

SEQ ID NO: 424025 - DNA, 25 bp, Rattus norvegicus
ggactcctgacctctatagttgtta

SEQ ID NO: 424026 - DNA, 25 bp, Rattus norvegicus
ggactcctgagtatgtactaagctt

SEQ ID NO: 424027 - DNA, 25 bp, Rattus norvegicus
ggactcctgagtttgtactaagctt

SEQ ID NO: 424028 - DNA, 25 bp, Rattus norvegicus
ggactcctgcacctgtgagccaggc

SEQ ID NO: 424029 - DNA, 25 bp, Rattus norvegicus
ggactcctgcacgtgtgagccaggc

SEQ ID NO: 424030 - DNA, 25 bp, Rattus norvegicus
ggactcctgcccagggaagaggcta

SEQ ID NO: 424031 - DNA, 25 bp, Rattus norvegicus
ggactcctgccctgggaagaggcta

SEQ ID NO: 424032 - DNA, 25 bp, Rattus norvegicus
ggactcctgcgcctgaaaggtcgtc

SEQ ID NO: 424033 - DNA, 25 bp, Rattus norvegicus
ggactcctgcgcgtgaaaggtcgtc

SEQ ID NO: 424034 - DNA, 25 bp, Rattus norvegicus
ggactccttacaccgtatgacacag

SEQ ID NO: 424035 - DNA, 25 bp, Rattus norvegicus
ggactccttacagcgtatgacacag

SEQ ID NO: 424036 - DNA, 25 bp, Rattus norvegicus
ggactccttagccaggatgcaccgg

SEQ ID NO: 424037 - DNA, 25 bp, Rattus norvegicus
ggactccttagcgaggatgcaccgg

SEQ ID NO: 424038 - DNA, 25 bp, Rattus norvegicus
ggactccttgcaagtttacatggct

SEQ ID NO: 424039 - DNA, 25 bp, Rattus norvegicus
ggactccttgcatgtttacatggct

SEQ ID NO: 424040 - DNA, 25 bp, Rattus norvegicus
ggactccttgctagtttatgtcagc

SEQ ID NO: 424041 - DNA, 25 bp, Rattus norvegicus
ggactccttgcttgtttatgtcagc

SEQ ID NO: 424042 - DNA, 25 bp, Rattus norvegicus
ggactccttggacgcactgtgaatt

SEQ ID NO: 424043 - DNA, 25 bp, Rattus norvegicus
ggactccttggaggcactgtgaatt

SEQ ID NO: 424044 - DNA, 25 bp, Rattus norvegicus
ggactcctttcaagtctagtaaaat

SEQ ID NO: 424045 - DNA, 25 bp, Rattus norvegicus
ggactcctttcatgtctagtaaaat

SEQ ID NO: 424046 - DNA, 25 bp, Rattus norvegicus
ggactcctttccagatgtgttcaat

SEQ ID NO: 424047 - DNA, 25 bp, Rattus norvegicus
ggactcctttcctgatgtgttcaat

SEQ ID NO: 424048 - DNA, 25 bp, Rattus norvegicus
ggactcctttggctttgttgaatga

SEQ ID NO: 424049 - DNA, 25 bp, Rattus norvegicus
ggactcctttgggtttgttgaatga

SEQ ID NO: 424050 - DNA, 25 bp, Rattus norvegicus
ggactcctttgtaaaattcagccag

SEQ ID NO: 424051 - DNA, 25 bp, Rattus norvegicus
ggactcctttgttaaattcagccag

SEQ ID NO: 424052 - DNA, 25 bp, Rattus norvegicus
ggactccttttcctttagtgctctt

SEQ ID NO: 424053 - DNA, 25 bp, Rattus norvegicus
ggactccttttcgtttagtgctctt

SEQ ID NO: 424054 - DNA, 25 bp, Rattus norvegicus
ggactcctttttcctagaggttcaa

SEQ ID NO: 424055 - DNA, 25 bp, Rattus norvegicus
ggactcctttttgctagaggttcaa

SEQ ID NO: 424056 - DNA, 25 bp, Rattus norvegicus
ggactcgaacacattactgctttac

SEQ ID NO: 424057 - DNA, 25 bp, Rattus norvegicus
ggactcgaacactttactgctttac

SEQ ID NO: 424058 - DNA, 25 bp, Rattus norvegicus
ggactcgcatatagaagtctgtctt

SEQ ID NO: 424059 - DNA, 25 bp, Rattus norvegicus
ggactcgcatattgaagtctgtctt

SEQ ID NO: 424060 - DNA, 25 bp, Rattus norvegicus
ggactcgcccggcataccaggtcag

SEQ ID NO: 424061 - DNA, 25 bp, Rattus norvegicus
ggactcgcccgggataccaggtcag

SEQ ID NO: 424062 - DNA, 25 bp, Rattus norvegicus
ggactcgccttacattcagttcaat

SEQ ID NO: 424063 - DNA, 25 bp, Rattus norvegicus
ggactcgccttagattcagttcaat

SEQ ID NO: 424064 - DNA, 25 bp, Rattus norvegicus
ggactcgctttcattgcttctggag

SEQ ID NO: 424065 - DNA, 25 bp, Rattus norvegicus
ggactcgctttctttgcttctggag

SEQ ID NO: 424066 - DNA, 25 bp, Rattus norvegicus
ggactcggaactcttcctcatgaag

SEQ ID NO: 424067 - DNA, 25 bp, Rattus norvegicus
ggactcggaactgttcctcatgaag

SEQ ID NO: 424068 - DNA, 25 bp, Rattus norvegicus
ggactcggaagacctaatccacaag

SEQ ID NO: 424069 - DNA, 25 bp, Rattus norvegicus
ggactcggaagacgacagcagctcc

SEQ ID NO: 424070 - DNA, 25 bp, Rattus norvegicus
ggactcggaagagctaatccacaag

SEQ ID NO: 424071 - DNA, 25 bp, Rattus norvegicus
ggactcggaagaggacagcagctcc

SEQ ID NO: 424072 - DNA, 25 bp, Rattus norvegicus
ggactcggacctacagaaagcctgc

SEQ ID NO: 424073 - DNA, 25 bp, Rattus norvegicus
ggactcggaccttcagaaagcctgc

SEQ ID NO: 424074 - DNA, 25 bp, Rattus norvegicus
ggactcggcctaagtgtacttgata

SEQ ID NO: 424075 - DNA, 25 bp, Rattus norvegicus
ggactcggcctatgtgtacttgata

SEQ ID NO: 424076 - DNA, 25 bp, Rattus norvegicus
ggactcggctacatagggttggcat

SEQ ID NO: 424077 - DNA, 25 bp, Rattus norvegicus
ggactcggctacttagggttggcat

SEQ ID NO: 424078 - DNA, 25 bp, Rattus norvegicus
ggactcgggatcatcaaccggcggc

SEQ ID NO: 424079 - DNA, 25 bp, Rattus norvegicus
ggactcgggatcttcaaccggcggc

SEQ ID NO: 424080 - DNA, 25 bp, Rattus norvegicus
ggactcgtatctaatgaaccacttc

SEQ ID NO: 424081 - DNA, 25 bp, Rattus norvegicus
ggactcgtatcttatgaaccacttc

SEQ ID NO: 424082 - DNA, 25 bp, Rattus norvegicus
ggactcgtggctcgtctttgacaga

SEQ ID NO: 424083 - DNA, 25 bp, Rattus norvegicus
ggactcgtggctggtctttgacaga

SEQ ID NO: 424084 - DNA, 25 bp, Rattus norvegicus
ggactcgtttccatgtatatgcaaa

SEQ ID NO: 424085 - DNA, 25 bp, Rattus norvegicus
ggactcgtttccttgtatatgcaaa

SEQ ID NO: 424086 - DNA, 25 bp, Rattus norvegicus
ggactctaaatacccttcctacagt

SEQ ID NO: 424087 - DNA, 25 bp, Rattus norvegicus
ggactctaaatagccttcctacagt

SEQ ID NO: 424088 - DNA, 25 bp, Rattus norvegicus
ggactctaaggacctggactctcac

SEQ ID NO: 424089 - DNA, 25 bp, Rattus norvegicus
ggactctaaggagctggactctcac

SEQ ID NO: 424090 - DNA, 25 bp, Rattus norvegicus
ggactctaccacattctcggacaga

SEQ ID NO: 424091 - DNA, 25 bp, Rattus norvegicus
ggactctaccactttctcggacaga

SEQ ID NO: 424092 - DNA, 25 bp, Rattus norvegicus
ggactctacgttcttttgatgacca

SEQ ID NO: 424093 - DNA, 25 bp, Rattus norvegicus
ggactctacgttgttttgatgacca

SEQ ID NO: 424094 - DNA, 25 bp, Rattus norvegicus
ggactctactgtcctgacgtacaag

SEQ ID NO: 424095 - DNA, 25 bp, Rattus norvegicus
ggactctactgtgctgacgtacaag

SEQ ID NO: 424096 - DNA, 25 bp, Rattus norvegicus
ggactctagaggacttttgttcaac

SEQ ID NO: 424097 - DNA, 25 bp, Rattus norvegicus
ggactctagaggtcttttgttcaac

SEQ ID NO: 424098 - DNA, 25 bp, Rattus norvegicus
ggactctatacccaagccgaattaa

SEQ ID NO: 424099 - DNA, 25 bp, Rattus norvegicus
ggactctataccgaagccgaattaa

SEQ ID NO: 424100 - DNA, 25 bp, Rattus norvegicus
ggactctatcaaacggtggcctggt

SEQ ID NO: 424101 - DNA, 25 bp, Rattus norvegicus
ggactctatcaatcggtggcctggt

SEQ ID NO: 424102 - DNA, 25 bp, Rattus norvegicus
ggactctcaactaccaatgactgtt

SEQ ID NO: 424103 - DNA, 25 bp, Rattus norvegicus
ggactctcaacttccaatgactgtt

SEQ ID NO: 424104 - DNA, 25 bp, Rattus norvegicus
ggactctcagttcatcagggctgta

SEQ ID NO: 424105 - DNA, 25 bp, Rattus norvegicus
ggactctcagttgatcagggctgta

SEQ ID NO: 424106 - DNA, 25 bp, Rattus norvegicus
ggactctccattctcactggattta

SEQ ID NO: 424107 - DNA, 25 bp, Rattus norvegicus
ggactctccattgtcactggattta

SEQ ID NO: 424108 - DNA, 25 bp, Rattus norvegicus
ggactctcccttaggaatgcatggg

SEQ ID NO: 424109 - DNA, 25 bp, Rattus norvegicus
ggactctccctttggaatgcatggg

SEQ ID NO: 424110 - DNA, 25 bp, Rattus norvegicus
ggactctcctttagaaaccatgaac

SEQ ID NO: 424111 - DNA, 25 bp, Rattus norvegicus
ggactctccttttgaaaccatgaac

SEQ ID NO: 424112 - DNA, 25 bp, Rattus norvegicus
ggactctctgttattgtgagaaaaa

SEQ ID NO: 424113 - DNA, 25 bp, Rattus norvegicus
ggactctctgtttttgtgagaaaaa

SEQ ID NO: 424114 - DNA, 25 bp, Rattus norvegicus
ggactctgacagcttgtgaatgttt

SEQ ID NO: 424115 - DNA, 25 bp, Rattus norvegicus
ggactctgacaggttgtgaatgttt

SEQ ID NO: 424116 - DNA, 25 bp, Rattus norvegicus
ggactctgacttagcaatctacgat

SEQ ID NO: 424117 - DNA, 25 bp, Rattus norvegicus
ggactctgactttgcaatctacgat

SEQ ID NO: 424118 - DNA, 25 bp, Rattus norvegicus
ggactctgagagctctacggagaaa

SEQ ID NO: 424119 - DNA, 25 bp, Rattus norvegicus
ggactctgagaggtctacggagaaa

SEQ ID NO: 424120 - DNA, 25 bp, Rattus norvegicus
ggactctgcagaagctaactgttat

SEQ ID NO: 424121 - DNA, 25 bp, Rattus norvegicus
ggactctgcagatgctaactgttat

SEQ ID NO: 424122 - DNA, 25 bp, Rattus norvegicus
ggactctgcagcaaagtcagcccaa

SEQ ID NO: 424123 - DNA, 25 bp, Rattus norvegicus
ggactctgcagctaagtcagcccaa

SEQ ID NO: 424124 - DNA, 25 bp, Rattus norvegicus
ggactctgcatccattgttccagct

SEQ ID NO: 424125 - DNA, 25 bp, Rattus norvegicus
ggactctgcatcgattgttccagct

SEQ ID NO: 424126 - DNA, 25 bp, Rattus norvegicus
ggactctgctcaacgggacttagac

SEQ ID NO: 424127 - DNA, 25 bp, Rattus norvegicus
ggactctgctcatcgggacttagac

SEQ ID NO: 424128 - DNA, 25 bp, Rattus norvegicus
ggactctgctctccaggacacagat

SEQ ID NO: 424129 - DNA, 25 bp, Rattus norvegicus
ggactctgctctgcaggacacagat

SEQ ID NO: 424130 - DNA, 25 bp, Rattus norvegicus
ggactctggagccttgttactgcag

SEQ ID NO: 424131 - DNA, 25 bp, Rattus norvegicus
ggactctggagcgttgttactgcag

SEQ ID NO: 424132 - DNA, 25 bp, Rattus norvegicus
ggactctggcatccacacacaagtg

SEQ ID NO: 424133 - DNA, 25 bp, Rattus norvegicus
ggactctggcatgcacacacaagtg

SEQ ID NO: 424134 - DNA, 25 bp, Rattus norvegicus
ggactctggcttatgagcacttgaa

SEQ ID NO: 424135 - DNA, 25 bp, Rattus norvegicus
ggactctggcttttgagcacttgaa

SEQ ID NO: 424136 - DNA, 25 bp, Rattus norvegicus
ggactctgggctacctcccatgatg

SEQ ID NO: 424137 - DNA, 25 bp, Rattus norvegicus
ggactctgggcttcctcccatgatg

SEQ ID NO: 424138 - DNA, 25 bp, Rattus norvegicus
ggactctgtatcactctctaacaac

SEQ ID NO: 424139 - DNA, 25 bp, Rattus norvegicus
ggactctgtatctctctctaacaac

SEQ ID NO: 424140 - DNA, 25 bp, Rattus norvegicus
ggactctgtcaactgtgggatcttc

SEQ ID NO: 424141 - DNA, 25 bp, Rattus norvegicus
ggactctgtcaagtgtgggatcttc

SEQ ID NO: 424142 - DNA, 25 bp, Rattus norvegicus
ggactctgtgtccaaccgttaagta

SEQ ID NO: 424143 - DNA, 25 bp, Rattus norvegicus
ggactctgtgtcgaaccgttaagta

SEQ ID NO: 424144 - DNA, 25 bp, Rattus norvegicus
ggactctgtgttagtgaacttccaa

SEQ ID NO: 424145 - DNA, 25 bp, Rattus norvegicus
ggactctgtgtttgtgaacttccaa

SEQ ID NO: 424146 - DNA, 25 bp, Rattus norvegicus
ggactctgtttaacggactgacatt

SEQ ID NO: 424147 - DNA, 25 bp, Rattus norvegicus
ggactctgtttatcggactgacatt

SEQ ID NO: 424148 - DNA, 25 bp, Rattus norvegicus
ggactcttaacaaacaacctgaagc

SEQ ID NO: 424149 - DNA, 25 bp, Rattus norvegicus
ggactcttaacatacaacctgaagc

SEQ ID NO: 424150 - DNA, 25 bp, Rattus norvegicus
ggactcttattgacgagccgtctgt

SEQ ID NO: 424151 - DNA, 25 bp, Rattus norvegicus
ggactcttattgtcgagccgtctgt

SEQ ID NO: 424152 - DNA, 25 bp, Rattus norvegicus
ggactcttcagtaagctcaccatgt

SEQ ID NO: 424153 - DNA, 25 bp, Rattus norvegicus
ggactcttcagttagctcaccatgt

SEQ ID NO: 424154 - DNA, 25 bp, Rattus norvegicus
ggactcttcatgctgatgttctcca

SEQ ID NO: 424155 - DNA, 25 bp, Rattus norvegicus
ggactcttcatggtgatgttctcca

SEQ ID NO: 424156 - DNA, 25 bp, Rattus norvegicus
ggactcttccaacggtgcctcgagc

SEQ ID NO: 424157 - DNA, 25 bp, Rattus norvegicus
ggactcttccaagggtgcctcgagc

SEQ ID NO: 424158 - DNA, 25 bp, Rattus norvegicus
ggactcttccacagattttgagcgt

SEQ ID NO: 424159 - DNA, 25 bp, Rattus norvegicus
ggactcttccactgattttgagcgt

SEQ ID NO: 424160 - DNA, 25 bp, Rattus norvegicus
ggactcttccatcaaagccatcctg

SEQ ID NO: 424161 - DNA, 25 bp, Rattus norvegicus
ggactcttccatgaaagccatcctg

SEQ ID NO: 424162 - DNA, 25 bp, Rattus norvegicus
ggactcttccttagcatgtgtgtga

SEQ ID NO: 424163 - DNA, 25 bp, Rattus norvegicus
ggactcttcctttgcatgtgtgtga

SEQ ID NO: 424164 - DNA, 25 bp, Rattus norvegicus
ggactcttcgcacttacatccagga

SEQ ID NO: 424165 - DNA, 25 bp, Rattus norvegicus
ggactcttcgcagttacatccagga

SEQ ID NO: 424166 - DNA, 25 bp, Rattus norvegicus
ggactcttctacagtctcagacatt

SEQ ID NO: 424167 - DNA, 25 bp, Rattus norvegicus
ggactcttctactgtctcagacatt

SEQ ID NO: 424168 - DNA, 25 bp, Rattus norvegicus
ggactcttctatcaggagacaacct

SEQ ID NO: 424169 - DNA, 25 bp, Rattus norvegicus
ggactcttctatgaggagacaacct

SEQ ID NO: 424170 - DNA, 25 bp, Rattus norvegicus
ggactcttctgccagtgtgaattca

SEQ ID NO: 424171 - DNA, 25 bp, Rattus norvegicus
ggactcttctgcgagtgtgaattca

SEQ ID NO: 424172 - DNA, 25 bp, Rattus norvegicus
ggactcttgtttccaatagacacag

SEQ ID NO: 424173 - DNA, 25 bp, Rattus norvegicus
ggactcttgtttgcaatagacacag

SEQ ID NO: 424174 - DNA, 25 bp, Rattus norvegicus
ggactctttactctttgcacagcaa

SEQ ID NO: 424175 - DNA, 25 bp, Rattus norvegicus
ggactctttactgtttgcacagcaa

SEQ ID NO: 424176 - DNA, 25 bp, Rattus norvegicus
ggactctttcctcggaccaatttag

SEQ ID NO: 424177 - DNA, 25 bp, Rattus norvegicus
ggactctttcctgggaccaatttag

SEQ ID NO: 424178 - DNA, 25 bp, Rattus norvegicus
ggactctttctgcttgacaatgtag

SEQ ID NO: 424179 - DNA, 25 bp, Rattus norvegicus
ggactctttctggttgacaatgtag

SEQ ID NO: 424180 - DNA, 25 bp, Rattus norvegicus
ggactctttgagcacaaatcagcaa

SEQ ID NO: 424181 - DNA, 25 bp, Rattus norvegicus
ggactctttgaggacaaatcagcaa

SEQ ID NO: 424182 - DNA, 25 bp, Rattus norvegicus
ggactgaaaacactgcgagccctgg

SEQ ID NO: 424183 - DNA, 25 bp, Rattus norvegicus
ggactgaaaacagtgcgagccctgg

SEQ ID NO: 424184 - DNA, 25 bp, Rattus norvegicus
ggactgaaactgactttatctgctt

SEQ ID NO: 424185 - DNA, 25 bp, Rattus norvegicus
ggactgaaactgtctttatctgctt

SEQ ID NO: 424186 - DNA, 25 bp, Rattus norvegicus
ggactgaaagagcaaccaagccatt

SEQ ID NO: 424187 - DNA, 25 bp, Rattus norvegicus
ggactgaaagaggaaccaagccatt

SEQ ID NO: 424188 - DNA, 25 bp, Rattus norvegicus
ggactgaaatgccactaccctgagt

SEQ ID NO: 424189 - DNA, 25 bp, Rattus norvegicus
ggactgaaatgcgactaccctgagt

SEQ ID NO: 424190 - DNA, 25 bp, Rattus norvegicus
ggactgaacacaactgacttcctct

SEQ ID NO: 424191 - DNA, 25 bp, Rattus norvegicus
ggactgaacacatctgacttcctct

SEQ ID NO: 424192 - DNA, 25 bp, Rattus norvegicus
ggactgaacacgctgacttcctggc

SEQ ID NO: 424193 - DNA, 25 bp, Rattus norvegicus
ggactgaacacggtgacttcctggc

SEQ ID NO: 424194 - DNA, 25 bp, Rattus norvegicus
ggactgaaccataccacatcaatta

SEQ ID NO: 424195 - DNA, 25 bp, Rattus norvegicus
ggactgaaccattccacatcaatta

SEQ ID NO: 424196 - DNA, 25 bp, Rattus norvegicus
ggactgaacccaagactcctgtagt

SEQ ID NO: 424197 - DNA, 25 bp, Rattus norvegicus
ggactgaacccatgactcctgtagt

SEQ ID NO: 424198 - DNA, 25 bp, Rattus norvegicus
ggactgaacctactgccttgagttt

SEQ ID NO: 424199 - DNA, 25 bp, Rattus norvegicus
ggactgaacctagtgccttgagttt

SEQ ID NO: 424200 - DNA, 25 bp, Rattus norvegicus
ggactgaactgcctgtgccactgaa

SEQ ID NO: 424201 - DNA, 25 bp, Rattus norvegicus
ggactgaactgcgtgtgccactgaa

SEQ ID NO: 424202 - DNA, 25 bp, Rattus norvegicus
ggactgaagcccatgctgggtctta

SEQ ID NO: 424203 - DNA, 25 bp, Rattus norvegicus
ggactgaagcccttgctgggtctta

SEQ ID NO: 424204 - DNA, 25 bp, Rattus norvegicus
ggactgaagcttcgccatggttcta

SEQ ID NO: 424205 - DNA, 25 bp, Rattus norvegicus
ggactgaagcttggccatggttcta

SEQ ID NO: 424206 - DNA, 25 bp, Rattus norvegicus
ggactgaaggtaagtgtgcaccacc

SEQ ID NO: 424207 - DNA, 25 bp, Rattus norvegicus
ggactgaaggtatgtgtgcaccacc

SEQ ID NO: 424208 - DNA, 25 bp, Rattus norvegicus
ggactgaagtcactggtcttccctt

SEQ ID NO: 424209 - DNA, 25 bp, Rattus norvegicus
ggactgaagtcagtggtcttccctt

SEQ ID NO: 424210 - DNA, 25 bp, Rattus norvegicus
ggactgaatcacagccactgtttca

SEQ ID NO: 424211 - DNA, 25 bp, Rattus norvegicus
ggactgaatcactgccactgtttca

SEQ ID NO: 424212 - DNA, 25 bp, Rattus norvegicus
ggactgaatttcatgcttccaaatg

SEQ ID NO: 424213 - DNA, 25 bp, Rattus norvegicus
ggactgaatttcttgcttccaaatg

SEQ ID NO: 424214 - DNA, 25 bp, Rattus norvegicus
ggactgaccatcatgctgttgtgca

SEQ ID NO: 424215 - DNA, 25 bp, Rattus norvegicus
ggactgaccatcttgctgttgtgca

SEQ ID NO: 424216 - DNA, 25 bp, Rattus norvegicus
ggactgaccctcacgtgggaactag

SEQ ID NO: 424217 - DNA, 25 bp, Rattus norvegicus
ggactgaccctctcgtgggaactag

SEQ ID NO: 424218 - DNA, 25 bp, Rattus norvegicus
ggactgacctccatttaagccagta

SEQ ID NO: 424219 - DNA, 25 bp, Rattus norvegicus
ggactgacctccttttaagccagta

SEQ ID NO: 424220 - DNA, 25 bp, Rattus norvegicus
ggactgaccttcaaagacaattcat

SEQ ID NO: 424221 - DNA, 25 bp, Rattus norvegicus
ggactgaccttctaagacaattcat

SEQ ID NO: 424222 - DNA, 25 bp, Rattus norvegicus
ggactgacgatacactgcctttgac

SEQ ID NO: 424223 - DNA, 25 bp, Rattus norvegicus
ggactgacgatagactgcctttgac

SEQ ID NO: 424224 - DNA, 25 bp, Rattus norvegicus
ggactgacgcctacctaagagccag

SEQ ID NO: 424225 - DNA, 25 bp, Rattus norvegicus
ggactgacgccttcctaagagccag

SEQ ID NO: 424226 - DNA, 25 bp, Rattus norvegicus
ggactgactctcctggaagaactca

SEQ ID NO: 424227 - DNA, 25 bp, Rattus norvegicus
ggactgactctcgtggaagaactca

SEQ ID NO: 424228 - DNA, 25 bp, Rattus norvegicus
ggactgactggaagctacatccctt

SEQ ID NO: 424229 - DNA, 25 bp, Rattus norvegicus
ggactgactggatgctacatccctt

SEQ ID NO: 424230 - DNA, 25 bp, Rattus norvegicus
ggactgactggcaccaaggacaact

SEQ ID NO: 424231 - DNA, 25 bp, Rattus norvegicus
ggactgactggctccaaggacaact

SEQ ID NO: 424232 - DNA, 25 bp, Rattus norvegicus
ggactgacttctctaattctcatag

SEQ ID NO: 424233 - DNA, 25 bp, Rattus norvegicus
ggactgacttctgtaattctcatag

SEQ ID NO: 424234 - DNA, 25 bp, Rattus norvegicus
ggactgagacagaggaccttcctat

SEQ ID NO: 424235 - DNA, 25 bp, Rattus norvegicus
ggactgagacagtggaccttcctat

SEQ ID NO: 424236 - DNA, 25 bp, Rattus norvegicus
ggactgagacccaggaagactttcc

SEQ ID NO: 424237 - DNA, 25 bp, Rattus norvegicus
ggactgagaccctggaagactttcc

SEQ ID NO: 424238 - DNA, 25 bp, Rattus norvegicus
ggactgagccacaagatggagccaa

SEQ ID NO: 424239 - DNA, 25 bp, Rattus norvegicus
ggactgagccactagatggagccaa

SEQ ID NO: 424240 - DNA, 25 bp, Rattus norvegicus
ggactgagctagctgccagatgctt

SEQ ID NO: 424241 - DNA, 25 bp, Rattus norvegicus
ggactgagctaggtgccagatgctt

SEQ ID NO: 424242 - DNA, 25 bp, Rattus norvegicus
ggactgagctgccactgcctgctga

SEQ ID NO: 424243 - DNA, 25 bp, Rattus norvegicus
ggactgagctgcgactgcctgctga

SEQ ID NO: 424244 - DNA, 25 bp, Rattus norvegicus
ggactgaggataaccattcccggtt

SEQ ID NO: 424245 - DNA, 25 bp, Rattus norvegicus
ggactgaggataatgcaacatcaca

SEQ ID NO: 424246 - DNA, 25 bp, Rattus norvegicus
ggactgaggatatccattcccggtt

SEQ ID NO: 424247 - DNA, 25 bp, Rattus norvegicus
ggactgaggatattgcaacatcaca

SEQ ID NO: 424248 - DNA, 25 bp, Rattus norvegicus
ggactgaggtatcccatgcaccaaa

SEQ ID NO: 424249 - DNA, 25 bp, Rattus norvegicus
ggactgaggtatgccatgcaccaaa

SEQ ID NO: 424250 - DNA, 25 bp, Rattus norvegicus
ggactgagtcctatatgcactttag

SEQ ID NO: 424251 - DNA, 25 bp, Rattus norvegicus
ggactgagtcctttatgcactttag

SEQ ID NO: 424252 - DNA, 25 bp, Rattus norvegicus
ggactgagtgaaagccagcttctcc

SEQ ID NO: 424253 - DNA, 25 bp, Rattus norvegicus
ggactgagtgaatgccagcttctcc

SEQ ID NO: 424254 - DNA, 25 bp, Rattus norvegicus
ggactgagtgtgacccgggcaacaa

SEQ ID NO: 424255 - DNA, 25 bp, Rattus norvegicus
ggactgagtgtgtcccgggcaacaa

SEQ ID NO: 424256 - DNA, 25 bp, Rattus norvegicus
ggactgatctgtagtctgcccagtt

SEQ ID NO: 424257 - DNA, 25 bp, Rattus norvegicus
ggactgatctgttgtctgcccagtt

SEQ ID NO: 424258 - DNA, 25 bp, Rattus norvegicus
ggactgatctttccatccatggctg

SEQ ID NO: 424259 - DNA, 25 bp, Rattus norvegicus
ggactgatctttgcatccatggctg

SEQ ID NO: 424260 - DNA, 25 bp, Rattus norvegicus
ggactgatggatctcatacctccaa

SEQ ID NO: 424261 - DNA, 25 bp, Rattus norvegicus
ggactgatggatgtcatacctccaa

SEQ ID NO: 424262 - DNA, 25 bp, Rattus norvegicus
ggactgatgttccaagtttgtatca

SEQ ID NO: 424263 - DNA, 25 bp, Rattus norvegicus
ggactgatgttcgaagtttgtatca

SEQ ID NO: 424264 - DNA, 25 bp, Rattus norvegicus
ggactgattcttcccaaggagggct

SEQ ID NO: 424265 - DNA, 25 bp, Rattus norvegicus
ggactgattcttgccaaggagggct

SEQ ID NO: 424266 - DNA, 25 bp, Rattus norvegicus
ggactgattggcacctggctttcac

SEQ ID NO: 424267 - DNA, 25 bp, Rattus norvegicus
ggactgattggctcctggctttcac

SEQ ID NO: 424268 - DNA, 25 bp, Rattus norvegicus
ggactgattgtaaagttcgccacta

SEQ ID NO: 424269 - DNA, 25 bp, Rattus norvegicus
ggactgattgtatagttcgccacta

SEQ ID NO: 424270 - DNA, 25 bp, Rattus norvegicus
ggactgcacagaaagccaggcacca

SEQ ID NO: 424271 - DNA, 25 bp, Rattus norvegicus
ggactgcacagatagccaggcacca

SEQ ID NO: 424272 - DNA, 25 bp, Rattus norvegicus
ggactgcacaggagtttccctacaa

SEQ ID NO: 424273 - DNA, 25 bp, Rattus norvegicus
ggactgcacaggtgtttccctacaa

SEQ ID NO: 424274 - DNA, 25 bp, Rattus norvegicus
ggactgcacagtacatggaagctgc

SEQ ID NO: 424275 - DNA, 25 bp, Rattus norvegicus
ggactgcacagttcatggaagctgc

SEQ ID NO: 424276 - DNA, 25 bp, Rattus norvegicus
ggactgcacatcatgtagactccag

SEQ ID NO: 424277 - DNA, 25 bp, Rattus norvegicus
ggactgcacatcttgtagactccag

SEQ ID NO: 424278 - DNA, 25 bp, Rattus norvegicus
ggactgcacccaaacctaattgatt

SEQ ID NO: 424279 - DNA, 25 bp, Rattus norvegicus
ggactgcacccatacctaattgatt

SEQ ID NO: 424280 - DNA, 25 bp, Rattus norvegicus
ggactgcacttgacagtgtggctct

SEQ ID NO: 424281 - DNA, 25 bp, Rattus norvegicus
ggactgcacttgtcagtgtggctct

SEQ ID NO: 424282 - DNA, 25 bp, Rattus norvegicus
ggactgcagaaaccttacctgattt

SEQ ID NO: 424283 - DNA, 25 bp, Rattus norvegicus
ggactgcagaaagcttacctgattt

SEQ ID NO: 424284 - DNA, 25 bp, Rattus norvegicus
ggactgcagaggaaccaagtcaatt

SEQ ID NO: 424285 - DNA, 25 bp, Rattus norvegicus
ggactgcagaggtaccaagtcaatt

SEQ ID NO: 424286 - DNA, 25 bp, Rattus norvegicus
ggactgcagagtcatttcctgaatt

SEQ ID NO: 424287 - DNA, 25 bp, Rattus norvegicus
ggactgcagagtgatttcctgaatt

SEQ ID NO: 424288 - DNA, 25 bp, Rattus norvegicus
ggactgcagctcactgacagttaaa

SEQ ID NO: 424289 - DNA, 25 bp, Rattus norvegicus
ggactgcagctctctgacagttaaa

SEQ ID NO: 424290 - DNA, 25 bp, Rattus norvegicus
ggactgcaggttccatgatagcctc

SEQ ID NO: 424291 - DNA, 25 bp, Rattus norvegicus
ggactgcaggttgcatgatagcctc

SEQ ID NO: 424292 - DNA, 25 bp, Rattus norvegicus
ggactgcatagaaaactagtgcatg

SEQ ID NO: 424293 - DNA, 25 bp, Rattus norvegicus
ggactgcatagataactagtgcatg

SEQ ID NO: 424294 - DNA, 25 bp, Rattus norvegicus
ggactgcatcaacttacgttttcta

SEQ ID NO: 424295 - DNA, 25 bp, Rattus norvegicus
ggactgcatcaagttacgttttcta

SEQ ID NO: 424296 - DNA, 25 bp, Rattus norvegicus
ggactgcatcagaaacactgcggat

SEQ ID NO: 424297 - DNA, 25 bp, Rattus norvegicus
ggactgcatcagtaacactgcggat

SEQ ID NO: 424298 - DNA, 25 bp, Rattus norvegicus
ggactgcatctaattttctgcctgc

SEQ ID NO: 424299 - DNA, 25 bp, Rattus norvegicus
ggactgcatctatttttctgcctgc

SEQ ID NO: 424300 - DNA, 25 bp, Rattus norvegicus
ggactgcatctgcaagagctctgta

SEQ ID NO: 424301 - DNA, 25 bp, Rattus norvegicus
ggactgcatctggaagagctctgta

SEQ ID NO: 424302 - DNA, 25 bp, Rattus norvegicus
ggactgccacacatttatggaactg

SEQ ID NO: 424303 - DNA, 25 bp, Rattus norvegicus
ggactgccacacttttatggaactg

SEQ ID NO: 424304 - DNA, 25 bp, Rattus norvegicus
ggactgccaccaagtgcaaatcgtt

SEQ ID NO: 424305 - DNA, 25 bp, Rattus norvegicus
ggactgccaccatgtgcaaatcgtt

SEQ ID NO: 424306 - DNA, 25 bp, Rattus norvegicus
ggactgccactaacctgaggacgag

SEQ ID NO: 424307 - DNA, 25 bp, Rattus norvegicus
ggactgccactatcctgaggacgag

SEQ ID NO: 424308 - DNA, 25 bp, Rattus norvegicus
ggactgccactgaagcacttgttac

SEQ ID NO: 424309 - DNA, 25 bp, Rattus norvegicus
ggactgccactgtagcacttgttac

SEQ ID NO: 424310 - DNA, 25 bp, Rattus norvegicus
ggactgccagaaaatatctgcctct

SEQ ID NO: 424311 - DNA, 25 bp, Rattus norvegicus
ggactgccagaatatatctgcctct

SEQ ID NO: 424312 - DNA, 25 bp, Rattus norvegicus
ggactgccatgacccactgttgagc

SEQ ID NO: 424313 - DNA, 25 bp, Rattus norvegicus
ggactgccatgagccactgttgagc

SEQ ID NO: 424314 - DNA, 25 bp, Rattus norvegicus
ggactgccattaacacagcacactg

SEQ ID NO: 424315 - DNA, 25 bp, Rattus norvegicus
ggactgccattatcacagcacactg

SEQ ID NO: 424316 - DNA, 25 bp, Rattus norvegicus
ggactgcccacactgtgaaatgcct

SEQ ID NO: 424317 - DNA, 25 bp, Rattus norvegicus
ggactgcccacagtgtgaaatgcct

SEQ ID NO: 424318 - DNA, 25 bp, Rattus norvegicus
ggactgcccactccacagaaatata

SEQ ID NO: 424319 - DNA, 25 bp, Rattus norvegicus
ggactgcccactgcacagaaatata

SEQ ID NO: 424320 - DNA, 25 bp, Rattus norvegicus
ggactgccccggaggaccctagagt

SEQ ID NO: 424321 - DNA, 25 bp, Rattus norvegicus
ggactgccccggtggaccctagagt

SEQ ID NO: 424322 - DNA, 25 bp, Rattus norvegicus
ggactgcccctgctattaaaaagat

SEQ ID NO: 424323 - DNA, 25 bp, Rattus norvegicus
ggactgcccctggtattaaaaagat

SEQ ID NO: 424324 - DNA, 25 bp, Rattus norvegicus
ggactgccctaacctgctacagaat

SEQ ID NO: 424325 - DNA, 25 bp, Rattus norvegicus
ggactgccctaagctgctacagaat

SEQ ID NO: 424326 - DNA, 25 bp, Rattus norvegicus
ggactgcctaggagccagggcctcc

SEQ ID NO: 424327 - DNA, 25 bp, Rattus norvegicus
ggactgcctaggtgccagggcctcc

SEQ ID NO: 424328 - DNA, 25 bp, Rattus norvegicus
ggactgccttatcgcatccatgtaa

SEQ ID NO: 424329 - DNA, 25 bp, Rattus norvegicus
ggactgccttatggcatccatgtaa

SEQ ID NO: 424330 - DNA, 25 bp, Rattus norvegicus
ggactgcgagctcgtgcctagcttc

SEQ ID NO: 424331 - DNA, 25 bp, Rattus norvegicus
ggactgcgagctggtgcctagcttc

SEQ ID NO: 424332 - DNA, 25 bp, Rattus norvegicus
ggactgcgtaccagtggcctgtgtt

SEQ ID NO: 424333 - DNA, 25 bp, Rattus norvegicus
ggactgcgtacctgtggcctgtgtt

SEQ ID NO: 424334 - DNA, 25 bp, Rattus norvegicus
ggactgcgtctcatcaaagtttcca

SEQ ID NO: 424335 - DNA, 25 bp, Rattus norvegicus
ggactgcgtctcttcaaagtttcca

SEQ ID NO: 424336 - DNA, 25 bp, Rattus norvegicus
ggactgctacaacagccagggcaat

SEQ ID NO: 424337 - DNA, 25 bp, Rattus norvegicus
ggactgctacaagagccagggcaat

SEQ ID NO: 424338 - DNA, 25 bp, Rattus norvegicus
ggactgctaggcagaacctggccat

SEQ ID NO: 424339 - DNA, 25 bp, Rattus norvegicus
ggactgctaggctgaacctggccat

SEQ ID NO: 424340 - DNA, 25 bp, Rattus norvegicus
ggactgctcagtacctttggatgac

SEQ ID NO: 424341 - DNA, 25 bp, Rattus norvegicus
ggactgctcagttcctttggatgac

SEQ ID NO: 424342 - DNA, 25 bp, Rattus norvegicus
ggactgctgaaaaccactgaatgta

SEQ ID NO: 424343 - DNA, 25 bp, Rattus norvegicus
ggactgctgaaatccactgaatgta

SEQ ID NO: 424344 - DNA, 25 bp, Rattus norvegicus
ggactgctgaacatacctggtattg

SEQ ID NO: 424345 - DNA, 25 bp, Rattus norvegicus
ggactgctgaacttacctggtattg

SEQ ID NO: 424346 - DNA, 25 bp, Rattus norvegicus
ggactgctgagtactaggcaaccct

SEQ ID NO: 424347 - DNA, 25 bp, Rattus norvegicus
ggactgctgagttctaggcaaccct

SEQ ID NO: 424348 - DNA, 25 bp, Rattus norvegicus
ggactgctggcacatacatccacta

SEQ ID NO: 424349 - DNA, 25 bp, Rattus norvegicus
ggactgctggcagatacatccacta

SEQ ID NO: 424350 - DNA, 25 bp, Rattus norvegicus
ggactgctgtatcccaagccaggat

SEQ ID NO: 424351 - DNA, 25 bp, Rattus norvegicus
ggactgctgtatgccaagccaggat

SEQ ID NO: 424352 - DNA, 25 bp, Rattus norvegicus
ggactgctgtcactttgatgacttt

SEQ ID NO: 424353 - DNA, 25 bp, Rattus norvegicus
ggactgctgtcagtttgatgacttt

SEQ ID NO: 424354 - DNA, 25 bp, Rattus norvegicus
ggactgctgtgtaccaggacagcca

SEQ ID NO: 424355 - DNA, 25 bp, Rattus norvegicus
ggactgctgtgttccaggacagcca

SEQ ID NO: 424356 - DNA, 25 bp, Rattus norvegicus
ggactgcttcttcgagtcattgact

SEQ ID NO: 424357 - DNA, 25 bp, Rattus norvegicus
ggactgcttcttggagtcattgact

SEQ ID NO: 424358 - DNA, 25 bp, Rattus norvegicus
ggactgcttttgattcacagaagaa

SEQ ID NO: 424359 - DNA, 25 bp, Rattus norvegicus
ggactgcttttgtttcacagaagaa

SEQ ID NO: 424360 - DNA, 25 bp, Rattus norvegicus
ggactgctttttctggatggccaca

SEQ ID NO: 424361 - DNA, 25 bp, Rattus norvegicus
ggactgctttttgtggatggccaca

SEQ ID NO: 424362 - DNA, 25 bp, Rattus norvegicus
ggactggaacctacagagtttcaga

SEQ ID NO: 424363 - DNA, 25 bp, Rattus norvegicus
ggactggaaccttcagagtttcaga

SEQ ID NO: 424364 - DNA, 25 bp, Rattus norvegicus
ggactggaagccaggtctccgaatc

SEQ ID NO: 424365 - DNA, 25 bp, Rattus norvegicus
ggactggaagcctggtctccgaatc

SEQ ID NO: 424366 - DNA, 25 bp, Rattus norvegicus
ggactggacccaacaggcagcttgg

SEQ ID NO: 424367 - DNA, 25 bp, Rattus norvegicus
ggactggacccatcaggcagcttgg

SEQ ID NO: 424368 - DNA, 25 bp, Rattus norvegicus
ggactggactccatttcccagaggg

SEQ ID NO: 424369 - DNA, 25 bp, Rattus norvegicus
ggactggactccttttcccagaggg

SEQ ID NO: 424370 - DNA, 25 bp, Rattus norvegicus
ggactggaggctacaggtggcctct

SEQ ID NO: 424371 - DNA, 25 bp, Rattus norvegicus
ggactggaggctatcactagatatt

SEQ ID NO: 424372 - DNA, 25 bp, Rattus norvegicus
ggactggaggcttcaggtggcctct

SEQ ID NO: 424373 - DNA, 25 bp, Rattus norvegicus
ggactggaggctttcactagatatt

SEQ ID NO: 424374 - DNA, 25 bp, Rattus norvegicus
ggactggagtcaatattcaaggatc

SEQ ID NO: 424375 - DNA, 25 bp, Rattus norvegicus
ggactggagtcattattcaaggatc

SEQ ID NO: 424376 - DNA, 25 bp, Rattus norvegicus
ggactggataatccttcgccaagct

SEQ ID NO: 424377 - DNA, 25 bp, Rattus norvegicus
ggactggataatgcttcgccaagct

SEQ ID NO: 424378 - DNA, 25 bp, Rattus norvegicus
ggactggatcaaagcggccttcaga

SEQ ID NO: 424379 - DNA, 25 bp, Rattus norvegicus
ggactggatcaatgcggccttcaga

SEQ ID NO: 424380 - DNA, 25 bp, Rattus norvegicus
ggactggatgttacactcacttctc

SEQ ID NO: 424381 - DNA, 25 bp, Rattus norvegicus
ggactggatgtttcactcacttctc

SEQ ID NO: 424382 - DNA, 25 bp, Rattus norvegicus
ggactggcacgtacggcactgcaaa

SEQ ID NO: 424383 - DNA, 25 bp, Rattus norvegicus
ggactggcacgttcggcactgcaaa

SEQ ID NO: 424384 - DNA, 25 bp, Rattus norvegicus
ggactggcaggtagatatcggctaa

SEQ ID NO: 424385 - DNA, 25 bp, Rattus norvegicus
ggactggcaggttgatatcggctaa

SEQ ID NO: 424386 - DNA, 25 bp, Rattus norvegicus
ggactggcatacaatatacctactc

SEQ ID NO: 424387 - DNA, 25 bp, Rattus norvegicus
ggactggcatactatatacctactc

SEQ ID NO: 424388 - DNA, 25 bp, Rattus norvegicus
ggactggccagacctaaaatgctaa

SEQ ID NO: 424389 - DNA, 25 bp, Rattus norvegicus
ggactggccagagctaaaatgctaa

SEQ ID NO: 424390 - DNA, 25 bp, Rattus norvegicus
ggactggccgccagcttactgacta

SEQ ID NO: 424391 - DNA, 25 bp, Rattus norvegicus
ggactggccgcctgcttactgacta

SEQ ID NO: 424392 - DNA, 25 bp, Rattus norvegicus
ggactggcctgtctaagcagatcta

SEQ ID NO: 424393 - DNA, 25 bp, Rattus norvegicus
ggactggcctgtgtaagcagatcta

SEQ ID NO: 424394 - DNA, 25 bp, Rattus norvegicus
ggactggcgcaaagatgccttgttc

SEQ ID NO: 424395 - DNA, 25 bp, Rattus norvegicus
ggactggcgcaatgatgccttgttc

SEQ ID NO: 424396 - DNA, 25 bp, Rattus norvegicus
ggactggctccccttagccaatgga

SEQ ID NO: 424397 - DNA, 25 bp, Rattus norvegicus
ggactggctcccgttagccaatgga

SEQ ID NO: 424398 - DNA, 25 bp, Rattus norvegicus
ggactggctctgctgacaactgcac

SEQ ID NO: 424399 - DNA, 25 bp, Rattus norvegicus
ggactggctctggtgacaactgcac

SEQ ID NO: 424400 - DNA, 25 bp, Rattus norvegicus
ggactgggaaccctgtggccacatt

SEQ ID NO: 424401 - DNA, 25 bp, Rattus norvegicus
ggactgggaaccgtgtggccacatt

SEQ ID NO: 424402 - DNA, 25 bp, Rattus norvegicus
ggactgggaattatgggattgcctc

SEQ ID NO: 424403 - DNA, 25 bp, Rattus norvegicus
ggactgggaattttgggattgcctc

SEQ ID NO: 424404 - DNA, 25 bp, Rattus norvegicus
ggactgggacagattgctcaagatc

SEQ ID NO: 424405 - DNA, 25 bp, Rattus norvegicus
ggactgggacagtttgctcaagatc

SEQ ID NO: 424406 - DNA, 25 bp, Rattus norvegicus
ggactgggaccaactatacactgag

SEQ ID NO: 424407 - DNA, 25 bp, Rattus norvegicus
ggactgggaccatctatacactgag

SEQ ID NO: 424408 - DNA, 25 bp, Rattus norvegicus
ggactgggactcagcaggacaagta

SEQ ID NO: 424409 - DNA, 25 bp, Rattus norvegicus
ggactgggactctgcaggacaagta

SEQ ID NO: 424410 - DNA, 25 bp, Rattus norvegicus
ggactgggcatcaccacagtgctca

SEQ ID NO: 424411 - DNA, 25 bp, Rattus norvegicus
ggactgggcatctccacagtgctca

SEQ ID NO: 424412 - DNA, 25 bp, Rattus norvegicus
ggactgggcccaagatccccacgga

SEQ ID NO: 424413 - DNA, 25 bp, Rattus norvegicus
ggactgggcccatgatccccacgga

SEQ ID NO: 424414 - DNA, 25 bp, Rattus norvegicus
ggactgggcctcacgagagaagcta

SEQ ID NO: 424415 - DNA, 25 bp, Rattus norvegicus
ggactgggcctctcgagagaagcta

SEQ ID NO: 424416 - DNA, 25 bp, Rattus norvegicus
ggactgggcgccatgcccgagacca

SEQ ID NO: 424417 - DNA, 25 bp, Rattus norvegicus
ggactgggcgccttgcccgagacca

SEQ ID NO: 424418 - DNA, 25 bp, Rattus norvegicus
ggactgggctgacctgtttgtcttc

SEQ ID NO: 424419 - DNA, 25 bp, Rattus norvegicus
ggactgggctgagctgtttgtcttc

SEQ ID NO: 424420 - DNA, 25 bp, Rattus norvegicus
ggactgggcttacagtttactattt

SEQ ID NO: 424421 - DNA, 25 bp, Rattus norvegicus
ggactgggcttagagtttactattt

SEQ ID NO: 424422 - DNA, 25 bp, Rattus norvegicus
ggactggggaacacatatgcacata

SEQ ID NO: 424423 - DNA, 25 bp, Rattus norvegicus
ggactggggaactcatatgcacata

SEQ ID NO: 424424 - DNA, 25 bp, Rattus norvegicus
ggactgggtgtaatttcttctgaat

SEQ ID NO: 424425 - DNA, 25 bp, Rattus norvegicus
ggactgggtgtattttcttctgaat

SEQ ID NO: 424426 - DNA, 25 bp, Rattus norvegicus
ggactgggtgttcctggaactaatt

SEQ ID NO: 424427 - DNA, 25 bp, Rattus norvegicus
ggactgggtgttgctggaactaatt

SEQ ID NO: 424428 - DNA, 25 bp, Rattus norvegicus
ggactggtcagtacatgcttgttat

SEQ ID NO: 424429 - DNA, 25 bp, Rattus norvegicus
ggactggtcagttcatgcttgttat

SEQ ID NO: 424430 - DNA, 25 bp, Rattus norvegicus
ggactggtccagctgcaacatgaac

SEQ ID NO: 424431 - DNA, 25 bp, Rattus norvegicus
ggactggtccaggtgcaacatgaac

SEQ ID NO: 424432 - DNA, 25 bp, Rattus norvegicus
ggactggtcgccaagaatatgaaac

SEQ ID NO: 424433 - DNA, 25 bp, Rattus norvegicus
ggactggtcgcctagaatatgaaac

SEQ ID NO: 424434 - DNA, 25 bp, Rattus norvegicus
ggactggtcggaagaggcacctaaa

SEQ ID NO: 424435 - DNA, 25 bp, Rattus norvegicus
ggactggtcggatgaggcacctaaa

SEQ ID NO: 424436 - DNA, 25 bp, Rattus norvegicus
ggactggtgactcgctatcttgaaa

SEQ ID NO: 424437 - DNA, 25 bp, Rattus norvegicus
ggactggtgactggctatcttgaaa

SEQ ID NO: 424438 - DNA, 25 bp, Rattus norvegicus
ggactggtgcaaacttgattctttt

SEQ ID NO: 424439 - DNA, 25 bp, Rattus norvegicus
ggactggtgcaactggactttgatt

SEQ ID NO: 424440 - DNA, 25 bp, Rattus norvegicus
ggactggtgcaagtggactttgatt

SEQ ID NO: 424441 - DNA, 25 bp, Rattus norvegicus
ggactggtgcaatcttgattctttt

SEQ ID NO: 424442 - DNA, 25 bp, Rattus norvegicus
ggactggtgggaccagcctggccaa

SEQ ID NO: 424443 - DNA, 25 bp, Rattus norvegicus
ggactggtgggagcagcctggccaa

SEQ ID NO: 424444 - DNA, 25 bp, Rattus norvegicus
ggactggttagaacccacatatata

SEQ ID NO: 424445 - DNA, 25 bp, Rattus norvegicus
ggactggttagatcccacatatata

SEQ ID NO: 424446 - DNA, 25 bp, Rattus norvegicus
ggactggtttttccaagacccctga

SEQ ID NO: 424447 - DNA, 25 bp, Rattus norvegicus
ggactggtttttgcaagacccctga

SEQ ID NO: 424448 - DNA, 25 bp, Rattus norvegicus
ggactgtaacaacacaatcgccata

SEQ ID NO: 424449 - DNA, 25 bp, Rattus norvegicus
ggactgtaacaagacaatcgccata

SEQ ID NO: 424450 - DNA, 25 bp, Rattus norvegicus
ggactgtaacttaacgcagctggaa

SEQ ID NO: 424451 - DNA, 25 bp, Rattus norvegicus
ggactgtaactttacgcagctggaa

SEQ ID NO: 424452 - DNA, 25 bp, Rattus norvegicus
ggactgtaagatctcctatagttat

SEQ ID NO: 424453 - DNA, 25 bp, Rattus norvegicus
ggactgtaagatgtcctatagttat

SEQ ID NO: 424454 - DNA, 25 bp, Rattus norvegicus
ggactgtacataccttgccatgaga

SEQ ID NO: 424455 - DNA, 25 bp, Rattus norvegicus
ggactgtacatagcttgccatgaga

SEQ ID NO: 424456 - DNA, 25 bp, Rattus norvegicus
ggactgtacccacttatactgtgag

SEQ ID NO: 424457 - DNA, 25 bp, Rattus norvegicus
ggactgtacccagttatactgtgag

SEQ ID NO: 424458 - DNA, 25 bp, Rattus norvegicus
ggactgtacgtgactgccagacgga

SEQ ID NO: 424459 - DNA, 25 bp, Rattus norvegicus
ggactgtacgtgtctgccagacgga

SEQ ID NO: 424460 - DNA, 25 bp, Rattus norvegicus
ggactgtactgtctgctgttggatc

SEQ ID NO: 424461 - DNA, 25 bp, Rattus norvegicus
ggactgtactgtgtgctgttggatc

SEQ ID NO: 424462 - DNA, 25 bp, Rattus norvegicus
ggactgtagcatcccactgattggg

SEQ ID NO: 424463 - DNA, 25 bp, Rattus norvegicus
ggactgtagcatgccactgattggg

SEQ ID NO: 424464 - DNA, 25 bp, Rattus norvegicus
ggactgtagccgattcttttctaac

SEQ ID NO: 424465 - DNA, 25 bp, Rattus norvegicus
ggactgtagccgtttcttttctaac

SEQ ID NO: 424466 - DNA, 25 bp, Rattus norvegicus
ggactgtatacaaaagcctgtttat

SEQ ID NO: 424467 - DNA, 25 bp, Rattus norvegicus
ggactgtatacataagcctgtttat

SEQ ID NO: 424468 - DNA, 25 bp, Rattus norvegicus
ggactgtatcttatgcatctctgta

SEQ ID NO: 424469 - DNA, 25 bp, Rattus norvegicus
ggactgtatcttttgcatctctgta

SEQ ID NO: 424470 - DNA, 25 bp, Rattus norvegicus
ggactgtcacatcgctagagttctt

SEQ ID NO: 424471 - DNA, 25 bp, Rattus norvegicus
ggactgtcacatggctagagttctt

SEQ ID NO: 424472 - DNA, 25 bp, Rattus norvegicus
ggactgtcacggaaacactttattt

SEQ ID NO: 424473 - DNA, 25 bp, Rattus norvegicus
ggactgtcacggtaacactttattt

SEQ ID NO: 424474 - DNA, 25 bp, Rattus norvegicus
ggactgtcactacccctggagatgg

SEQ ID NO: 424475 - DNA, 25 bp, Rattus norvegicus
ggactgtcactagccctggagatgg

SEQ ID NO: 424476 - DNA, 25 bp, Rattus norvegicus
ggactgtcaggaccccacggaacca

SEQ ID NO: 424477 - DNA, 25 bp, Rattus norvegicus
ggactgtcaggagcccacggaacca

SEQ ID NO: 424478 - DNA, 25 bp, Rattus norvegicus
ggactgtcagttattacctcggata

SEQ ID NO: 424479 - DNA, 25 bp, Rattus norvegicus
ggactgtcagtttttacctcggata

SEQ ID NO: 424480 - DNA, 25 bp, Rattus norvegicus
ggactgtcatatagtaacccctgtg

SEQ ID NO: 424481 - DNA, 25 bp, Rattus norvegicus
ggactgtcatattgtaacccctgtg

SEQ ID NO: 424482 - DNA, 25 bp, Rattus norvegicus
ggactgtccaacatcgcacaagtag

SEQ ID NO: 424483 - DNA, 25 bp, Rattus norvegicus
ggactgtccaacttcgcacaagtag

SEQ ID NO: 424484 - DNA, 25 bp, Rattus norvegicus
ggactgtccagtccctttaggaaag

SEQ ID NO: 424485 - DNA, 25 bp, Rattus norvegicus
ggactgtccagtgcctttaggaaag

SEQ ID NO: 424486 - DNA, 25 bp, Rattus norvegicus
ggactgtccatgaactttgaaccaa

SEQ ID NO: 424487 - DNA, 25 bp, Rattus norvegicus
ggactgtccatgtactttgaaccaa

SEQ ID NO: 424488 - DNA, 25 bp, Rattus norvegicus
ggactgtccattcgattgtgagatc

SEQ ID NO: 424489 - DNA, 25 bp, Rattus norvegicus
ggactgtccattggattgtgagatc

SEQ ID NO: 424490 - DNA, 25 bp, Rattus norvegicus
ggactgtcccttctttggaggtaca

SEQ ID NO: 424491 - DNA, 25 bp, Rattus norvegicus
ggactgtcccttgtttggaggtaca

SEQ ID NO: 424492 - DNA, 25 bp, Rattus norvegicus
ggactgtccgtaactactgtttagc

SEQ ID NO: 424493 - DNA, 25 bp, Rattus norvegicus
ggactgtccgtatctactgtttagc

SEQ ID NO: 424494 - DNA, 25 bp, Rattus norvegicus
ggactgtctaatctaactctacgtt

SEQ ID NO: 424495 - DNA, 25 bp, Rattus norvegicus
ggactgtctaatgtaactctacgtt

SEQ ID NO: 424496 - DNA, 25 bp, Rattus norvegicus
ggactgtctagtaaggagcacacaa

SEQ ID NO: 424497 - DNA, 25 bp, Rattus norvegicus
ggactgtctagttaggagcacacaa

SEQ ID NO: 424498 - DNA, 25 bp, Rattus norvegicus
ggactgtctgtaccactgtctagat

SEQ ID NO: 424499 - DNA, 25 bp, Rattus norvegicus
ggactgtctgtagcactgtctagat

SEQ ID NO: 424500 - DNA, 25 bp, Rattus norvegicus
ggactgtcttaactccagtgggtta

SEQ ID NO: 424501 - DNA, 25 bp, Rattus norvegicus
ggactgtcttaagtccagtgggtta

SEQ ID NO: 424502 - DNA, 25 bp, Rattus norvegicus
ggactgtcttacactctgagattag

SEQ ID NO: 424503 - DNA, 25 bp, Rattus norvegicus
ggactgtcttactctctgagattag

SEQ ID NO: 424504 - DNA, 25 bp, Rattus norvegicus
ggactgtcttctcctaacaggttgt

SEQ ID NO: 424505 - DNA, 25 bp, Rattus norvegicus
ggactgtcttctgctaacaggttgt

SEQ ID NO: 424506 - DNA, 25 bp, Rattus norvegicus
ggactgtgaatccaagctttccttc

SEQ ID NO: 424507 - DNA, 25 bp, Rattus norvegicus
ggactgtgaatcgaagctttccttc

SEQ ID NO: 424508 - DNA, 25 bp, Rattus norvegicus
ggactgtgacaaaatgaaccgcttt

SEQ ID NO: 424509 - DNA, 25 bp, Rattus norvegicus
ggactgtgacaatatgaaccgcttt

SEQ ID NO: 424510 - DNA, 25 bp, Rattus norvegicus
ggactgtgacagctggcattcccag

SEQ ID NO: 424511 - DNA, 25 bp, Rattus norvegicus
ggactgtgacaggtggcattcccag

SEQ ID NO: 424512 - DNA, 25 bp, Rattus norvegicus
ggactgtgaccccaagtgtgtagaa

SEQ ID NO: 424513 - DNA, 25 bp, Rattus norvegicus
ggactgtgacccgaagtgtgtagaa

SEQ ID NO: 424514 - DNA, 25 bp, Rattus norvegicus
ggactgtgacgtctattttctcatt

SEQ ID NO: 424515 - DNA, 25 bp, Rattus norvegicus
ggactgtgacgtgtattttctcatt

SEQ ID NO: 424516 - DNA, 25 bp, Rattus norvegicus
ggactgtgagccatctgacctgttc

SEQ ID NO: 424517 - DNA, 25 bp, Rattus norvegicus
ggactgtgagccttctgacctgttc

SEQ ID NO: 424518 - DNA, 25 bp, Rattus norvegicus
ggactgtgcaagctgcagtttgccc

SEQ ID NO: 424519 - DNA, 25 bp, Rattus norvegicus
ggactgtgcaaggtgcagtttgccc

SEQ ID NO: 424520 - DNA, 25 bp, Rattus norvegicus
ggactgtgcagtctttccaaagctc

SEQ ID NO: 424521 - DNA, 25 bp, Rattus norvegicus
ggactgtgcagtgtttccaaagctc

SEQ ID NO: 424522 - DNA, 25 bp, Rattus norvegicus
ggactgtgctcaataacctatttta

SEQ ID NO: 424523 - DNA, 25 bp, Rattus norvegicus
ggactgtgctcattaacctatttta

SEQ ID NO: 424524 - DNA, 25 bp, Rattus norvegicus
ggactgtgctttcctctatgaacta

SEQ ID NO: 424525 - DNA, 25 bp, Rattus norvegicus
ggactgtgctttgctctatgaacta

SEQ ID NO: 424526 - DNA, 25 bp, Rattus norvegicus
ggactgtggaccagcaacttggcac

SEQ ID NO: 424527 - DNA, 25 bp, Rattus norvegicus
ggactgtggacctgcaacttggcac

SEQ ID NO: 424528 - DNA, 25 bp, Rattus norvegicus
ggactgtggcaaacagaccatgaga

SEQ ID NO: 424529 - DNA, 25 bp, Rattus norvegicus
ggactgtggcaatcagaccatgaga

SEQ ID NO: 424530 - DNA, 25 bp, Rattus norvegicus
ggactgtggtctaagtttagatgaa

SEQ ID NO: 424531 - DNA, 25 bp, Rattus norvegicus
ggactgtggtcttagtttagatgaa

SEQ ID NO: 424532 - DNA, 25 bp, Rattus norvegicus
ggactgtggtggacttctatccgaa

SEQ ID NO: 424533 - DNA, 25 bp, Rattus norvegicus
ggactgtggtggtcttctatccgaa

SEQ ID NO: 424534 - DNA, 25 bp, Rattus norvegicus
ggactgtggttgcactgaggaagca

SEQ ID NO: 424535 - DNA, 25 bp, Rattus norvegicus
ggactgtggttggactgaggaagca

SEQ ID NO: 424536 - DNA, 25 bp, Rattus norvegicus
ggactgtgtcctcgtggtttagcaa

SEQ ID NO: 424537 - DNA, 25 bp, Rattus norvegicus
ggactgtgtcctggtggtttagcaa

SEQ ID NO: 424538 - DNA, 25 bp, Rattus norvegicus
ggactgttaacaatttcactgtgaa

SEQ ID NO: 424539 - DNA, 25 bp, Rattus norvegicus
ggactgttaacattttcactgtgaa

SEQ ID NO: 424540 - DNA, 25 bp, Rattus norvegicus
ggactgttaaccactatggcactta

SEQ ID NO: 424541 - DNA, 25 bp, Rattus norvegicus
ggactgttaacctctatggcactta

SEQ ID NO: 424542 - DNA, 25 bp, Rattus norvegicus
ggactgttacagactgagccccaga

SEQ ID NO: 424543 - DNA, 25 bp, Rattus norvegicus
ggactgttacagctcccatttataa

SEQ ID NO: 424544 - DNA, 25 bp, Rattus norvegicus
ggactgttacaggtcccatttataa

SEQ ID NO: 424545 - DNA, 25 bp, Rattus norvegicus
ggactgttacagtctgagccccaga

SEQ ID NO: 424546 - DNA, 25 bp, Rattus norvegicus
ggactgttacatccactttcttgga

SEQ ID NO: 424547 - DNA, 25 bp, Rattus norvegicus
ggactgttacatgcactttcttgga

SEQ ID NO: 424548 - DNA, 25 bp, Rattus norvegicus
ggactgttagctacttgtaccttaa

SEQ ID NO: 424549 - DNA, 25 bp, Rattus norvegicus
ggactgttagcttcttgtaccttaa

SEQ ID NO: 424550 - DNA, 25 bp, Rattus norvegicus
ggactgttcagtatgctgaggctga

SEQ ID NO: 424551 - DNA, 25 bp, Rattus norvegicus
ggactgttcagtttgctgaggctga

SEQ ID NO: 424552 - DNA, 25 bp, Rattus norvegicus
ggactgttccagagctgtttaccaa

SEQ ID NO: 424553 - DNA, 25 bp, Rattus norvegicus
ggactgttccagtgctgtttaccaa

SEQ ID NO: 424554 - DNA, 25 bp, Rattus norvegicus
ggactgttctctctctgattgtgaa

SEQ ID NO: 424555 - DNA, 25 bp, Rattus norvegicus
ggactgttctctgtctgattgtgaa

SEQ ID NO: 424556 - DNA, 25 bp, Rattus norvegicus
ggactgttctttaggactgaaactt

SEQ ID NO: 424557 - DNA, 25 bp, Rattus norvegicus
ggactgttcttttggactgaaactt

SEQ ID NO: 424558 - DNA, 25 bp, Rattus norvegicus
ggactgttgaaaacattaacgtgga

SEQ ID NO: 424559 - DNA, 25 bp, Rattus norvegicus
ggactgttgaaacccacgagctgaa

SEQ ID NO: 424560 - DNA, 25 bp, Rattus norvegicus
ggactgttgaaagccacgagctgaa

SEQ ID NO: 424561 - DNA, 25 bp, Rattus norvegicus
ggactgttgaaatcattaacgtgga

SEQ ID NO: 424562 - DNA, 25 bp, Rattus norvegicus
ggactgttgagtcaggccttatcaa

SEQ ID NO: 424563 - DNA, 25 bp, Rattus norvegicus
ggactgttgagtgaggccttatcaa

SEQ ID NO: 424564 - DNA, 25 bp, Rattus norvegicus
ggactgttgcctcccatttggtaat

SEQ ID NO: 424565 - DNA, 25 bp, Rattus norvegicus
ggactgttgcctgccatttggtaat

SEQ ID NO: 424566 - DNA, 25 bp, Rattus norvegicus
ggactgttggagaccacggtacaaa

SEQ ID NO: 424567 - DNA, 25 bp, Rattus norvegicus
ggactgttggagtccacggtacaaa

SEQ ID NO: 424568 - DNA, 25 bp, Rattus norvegicus
ggactgttgtccatcaattatctta

SEQ ID NO: 424569 - DNA, 25 bp, Rattus norvegicus
ggactgttgtccttcaattatctta

SEQ ID NO: 424570 - DNA, 25 bp, Rattus norvegicus
ggactgtttaacacctgacactcga

SEQ ID NO: 424571 - DNA, 25 bp, Rattus norvegicus
ggactgtttaactcctgacactcga

SEQ ID NO: 424572 - DNA, 25 bp, Rattus norvegicus
ggactgtttgctcccataggagaga

SEQ ID NO: 424573 - DNA, 25 bp, Rattus norvegicus
ggactgtttgctgccataggagaga

SEQ ID NO: 424574 - DNA, 25 bp, Rattus norvegicus
ggactgtttgttcttctagtgggca

SEQ ID NO: 424575 - DNA, 25 bp, Rattus norvegicus
ggactgtttgttgttctagtgggca

SEQ ID NO: 424576 - DNA, 25 bp, Rattus norvegicus
ggactgttttatattgtgctctggg

SEQ ID NO: 424577 - DNA, 25 bp, Rattus norvegicus
ggactgttttattttgtgctctggg

SEQ ID NO: 424578 - DNA, 25 bp, Rattus norvegicus
ggacttaaaagtcagttgccctaca

SEQ ID NO: 424579 - DNA, 25 bp, Rattus norvegicus
ggacttaaaagtgagttgccctaca

SEQ ID NO: 424580 - DNA, 25 bp, Rattus norvegicus
ggacttaaacctcacatagatgtcg

SEQ ID NO: 424581 - DNA, 25 bp, Rattus norvegicus
ggacttaaacctgacatagatgtcg

SEQ ID NO: 424582 - DNA, 25 bp, Rattus norvegicus
ggacttaacactctacccaagtact

SEQ ID NO: 424583 - DNA, 25 bp, Rattus norvegicus
ggacttaacactgtacccaagtact

SEQ ID NO: 424584 - DNA, 25 bp, Rattus norvegicus
ggacttaacccaaggccttatgcat

SEQ ID NO: 424585 - DNA, 25 bp, Rattus norvegicus
ggacttaacccatggccttatgcat

SEQ ID NO: 424586 - DNA, 25 bp, Rattus norvegicus
ggacttaactcccaggtgtgtcgag

SEQ ID NO: 424587 - DNA, 25 bp, Rattus norvegicus
ggacttaactccgaggtgtgtcgag

SEQ ID NO: 424588 - DNA, 25 bp, Rattus norvegicus
ggacttaagagccagttaggcctct

SEQ ID NO: 424589 - DNA, 25 bp, Rattus norvegicus
ggacttaagagcgagttaggcctct

SEQ ID NO: 424590 - DNA, 25 bp, Rattus norvegicus
ggacttaagagtacgagacctccct

SEQ ID NO: 424591 - DNA, 25 bp, Rattus norvegicus
ggacttaagagttcgagacctccct

SEQ ID NO: 424592 - DNA, 25 bp, Rattus norvegicus
ggacttaataacagaccaactcgga

SEQ ID NO: 424593 - DNA, 25 bp, Rattus norvegicus
ggacttaataactgaccaactcgga

SEQ ID NO: 424594 - DNA, 25 bp, Rattus norvegicus
ggacttaatatgacaaaggcacatt

SEQ ID NO: 424595 - DNA, 25 bp, Rattus norvegicus
ggacttaatatgtcaaaggcacatt

SEQ ID NO: 424596 - DNA, 25 bp, Rattus norvegicus
ggacttaatcacactgtggcccagg

SEQ ID NO: 424597 - DNA, 25 bp, Rattus norvegicus
ggacttaatcactctgtggcccagg

SEQ ID NO: 424598 - DNA, 25 bp, Rattus norvegicus
ggacttaatcctatgtttggccatg

SEQ ID NO: 424599 - DNA, 25 bp, Rattus norvegicus
ggacttaatcctttgtttggccatg

SEQ ID NO: 424600 - DNA, 25 bp, Rattus norvegicus
ggacttaattcccatcatcctgaag

SEQ ID NO: 424601 - DNA, 25 bp, Rattus norvegicus
ggacttaattccgatcatcctgaag

SEQ ID NO: 424602 - DNA, 25 bp, Rattus norvegicus
ggacttacacagaggagccgaatct

SEQ ID NO: 424603 - DNA, 25 bp, Rattus norvegicus
ggacttacacagtggagccgaatct

SEQ ID NO: 424604 - DNA, 25 bp, Rattus norvegicus
ggacttacaggaagacaaggaggct

SEQ ID NO: 424605 - DNA, 25 bp, Rattus norvegicus
ggacttacaggatgacaaggaggct

SEQ ID NO: 424606 - DNA, 25 bp, Rattus norvegicus
ggacttacagggagtgttcaccaaa

SEQ ID NO: 424607 - DNA, 25 bp, Rattus norvegicus
ggacttacagggtgtgttcaccaaa

SEQ ID NO: 424608 - DNA, 25 bp, Rattus norvegicus
ggacttacaggtcatcggctgtctg

SEQ ID NO: 424609 - DNA, 25 bp, Rattus norvegicus
ggacttacaggtgatcggctgtctg

SEQ ID NO: 424610 - DNA, 25 bp, Rattus norvegicus
ggacttacatgcacacagtggacct

SEQ ID NO: 424611 - DNA, 25 bp, Rattus norvegicus
ggacttacatgctcacagtggacct

SEQ ID NO: 424612 - DNA, 25 bp, Rattus norvegicus
ggacttaccatgataacaccccaaa

SEQ ID NO: 424613 - DNA, 25 bp, Rattus norvegicus
ggacttaccatgttaacaccccaaa

SEQ ID NO: 424614 - DNA, 25 bp, Rattus norvegicus
ggacttacccatagctgtacgtcga

SEQ ID NO: 424615 - DNA, 25 bp, Rattus norvegicus
ggacttacccattgctgtacgtcga

SEQ ID NO: 424616 - DNA, 25 bp, Rattus norvegicus
ggacttacgcatccacgtgtagaca

SEQ ID NO: 424617 - DNA, 25 bp, Rattus norvegicus
ggacttacgcatgcacgtgtagaca

SEQ ID NO: 424618 - DNA, 25 bp, Rattus norvegicus
ggacttactgacatgccaatttggc

SEQ ID NO: 424619 - DNA, 25 bp, Rattus norvegicus
ggacttactgacttgccaatttggc

SEQ ID NO: 424620 - DNA, 25 bp, Rattus norvegicus
ggacttactgctcgttctgtgaaaa

SEQ ID NO: 424621 - DNA, 25 bp, Rattus norvegicus
ggacttactgctggttctgtgaaaa

SEQ ID NO: 424622 - DNA, 25 bp, Rattus norvegicus
ggacttacttataggatttccgaag

SEQ ID NO: 424623 - DNA, 25 bp, Rattus norvegicus
ggacttacttattggatttccgaag

SEQ ID NO: 424624 - DNA, 25 bp, Rattus norvegicus
ggacttagacccagagatctgcttg

SEQ ID NO: 424625 - DNA, 25 bp, Rattus norvegicus
ggacttagaccctgagatctgcttg

SEQ ID NO: 424626 - DNA, 25 bp, Rattus norvegicus
ggacttagagctcagcaacaggcag

SEQ ID NO: 424627 - DNA, 25 bp, Rattus norvegicus
ggacttagagctgagcaacaggcag

SEQ ID NO: 424628 - DNA, 25 bp, Rattus norvegicus
ggacttaggtgcactgtgtacttaa

SEQ ID NO: 424629 - DNA, 25 bp, Rattus norvegicus
ggacttaggtgctctgtgtacttaa

SEQ ID NO: 424630 - DNA, 25 bp, Rattus norvegicus
ggacttataaacagactgcatgagc

SEQ ID NO: 424631 - DNA, 25 bp, Rattus norvegicus
ggacttataaactgactgcatgagc

SEQ ID NO: 424632 - DNA, 25 bp, Rattus norvegicus
ggacttataaataccttaagcagta

SEQ ID NO: 424633 - DNA, 25 bp, Rattus norvegicus
ggacttataaattccttaagcagta

SEQ ID NO: 424634 - DNA, 25 bp, Rattus norvegicus
ggacttataaggcaacgctaactca

SEQ ID NO: 424635 - DNA, 25 bp, Rattus norvegicus
ggacttataagggaacgctaactca

SEQ ID NO: 424636 - DNA, 25 bp, Rattus norvegicus
ggacttatccggatgctcctaaagg

SEQ ID NO: 424637 - DNA, 25 bp, Rattus norvegicus
ggacttatccggttgctcctaaagg

SEQ ID NO: 424638 - DNA, 25 bp, Rattus norvegicus
ggacttatctaccaatgactccggt

SEQ ID NO: 424639 - DNA, 25 bp, Rattus norvegicus
ggacttatctacgaatgactccggt

SEQ ID NO: 424640 - DNA, 25 bp, Rattus norvegicus
ggacttatctttactgagcctgtat

SEQ ID NO: 424641 - DNA, 25 bp, Rattus norvegicus
ggacttatcttttctgagcctgtat

SEQ ID NO: 424642 - DNA, 25 bp, Rattus norvegicus
ggacttatgagtacattcctagaag

SEQ ID NO: 424643 - DNA, 25 bp, Rattus norvegicus
ggacttatgagttcattcctagaag

SEQ ID NO: 424644 - DNA, 25 bp, Rattus norvegicus
ggacttatgcgcctgctgactgact

SEQ ID NO: 424645 - DNA, 25 bp, Rattus norvegicus
ggacttatgcgcgtgctgactgact

SEQ ID NO: 424646 - DNA, 25 bp, Rattus norvegicus
ggacttattcaaccgcggagcccta

SEQ ID NO: 424647 - DNA, 25 bp, Rattus norvegicus
ggacttattcaagcgcggagcccta

SEQ ID NO: 424648 - DNA, 25 bp, Rattus norvegicus
ggacttattgagaattttgtcattc

SEQ ID NO: 424649 - DNA, 25 bp, Rattus norvegicus
ggacttattgagtattttgtcattc

SEQ ID NO: 424650 - DNA, 25 bp, Rattus norvegicus
ggacttatttccatcaaatgtgagt

SEQ ID NO: 424651 - DNA, 25 bp, Rattus norvegicus
ggacttatttccttcaaatgtgagt

SEQ ID NO: 424652 - DNA, 25 bp, Rattus norvegicus
ggacttcaaaccacatctcatgatg

SEQ ID NO: 424653 - DNA, 25 bp, Rattus norvegicus
ggacttcaaacctcatctcatgatg

SEQ ID NO: 424654 - DNA, 25 bp, Rattus norvegicus
ggacttcaaatcacaaacacctcta

SEQ ID NO: 424655 - DNA, 25 bp, Rattus norvegicus
ggacttcaaatcacagccggaacca

SEQ ID NO: 424656 - DNA, 25 bp, Rattus norvegicus
ggacttcaaatctcaaacacctcta

SEQ ID NO: 424657 - DNA, 25 bp, Rattus norvegicus
ggacttcaaatctcagccggaacca

SEQ ID NO: 424658 - DNA, 25 bp, Rattus norvegicus
ggacttcaatgtctgttctgggtca

SEQ ID NO: 424659 - DNA, 25 bp, Rattus norvegicus
ggacttcaatgtgtgttctgggtca

SEQ ID NO: 424660 - DNA, 25 bp, Rattus norvegicus
ggacttcacagacgtatacacacac

SEQ ID NO: 424661 - DNA, 25 bp, Rattus norvegicus
ggacttcacagaggtatacacacac

SEQ ID NO: 424662 - DNA, 25 bp, Rattus norvegicus
ggacttcacatccttttcctttggt

SEQ ID NO: 424663 - DNA, 25 bp, Rattus norvegicus
ggacttcacatcgttttcctttggt

SEQ ID NO: 424664 - DNA, 25 bp, Rattus norvegicus
ggacttcacattatcttaccttctg

SEQ ID NO: 424665 - DNA, 25 bp, Rattus norvegicus
ggacttcacattttcttaccttctg

SEQ ID NO: 424666 - DNA, 25 bp, Rattus norvegicus
ggacttcacggcaagagatggcact

SEQ ID NO: 424667 - DNA, 25 bp, Rattus norvegicus
ggacttcacggctagagatggcact

SEQ ID NO: 424668 - DNA, 25 bp, Rattus norvegicus
ggacttcactctctagtttgggcta

SEQ ID NO: 424669 - DNA, 25 bp, Rattus norvegicus
ggacttcactctgtagtttgggcta

SEQ ID NO: 424670 - DNA, 25 bp, Rattus norvegicus
ggacttcagagactatcacacccaa

SEQ ID NO: 424671 - DNA, 25 bp, Rattus norvegicus
ggacttcagagagtatcacacccaa

SEQ ID NO: 424672 - DNA, 25 bp, Rattus norvegicus
ggacttcagatgctgacactacttg

SEQ ID NO: 424673 - DNA, 25 bp, Rattus norvegicus
ggacttcagatggtgacactacttg

SEQ ID NO: 424674 - DNA, 25 bp, Rattus norvegicus
ggacttcagattaccttgaactgta

SEQ ID NO: 424675 - DNA, 25 bp, Rattus norvegicus
ggacttcagattcataattcagtgc

SEQ ID NO: 424676 - DNA, 25 bp, Rattus norvegicus
ggacttcagattgataattcagtgc

SEQ ID NO: 424677 - DNA, 25 bp, Rattus norvegicus
ggacttcagatttccttgaactgta

SEQ ID NO: 424678 - DNA, 25 bp, Rattus norvegicus
ggacttcagcaaattccaaccactg

SEQ ID NO: 424679 - DNA, 25 bp, Rattus norvegicus
ggacttcagcaatttccaaccactg

SEQ ID NO: 424680 - DNA, 25 bp, Rattus norvegicus
ggacttcagccaacaggactcctga

SEQ ID NO: 424681 - DNA, 25 bp, Rattus norvegicus
ggacttcagccatcaggactcctga

SEQ ID NO: 424682 - DNA, 25 bp, Rattus norvegicus
ggacttcagcgcaagcttcaacgat

SEQ ID NO: 424683 - DNA, 25 bp, Rattus norvegicus
ggacttcagcgctagcttcaacgat

SEQ ID NO: 424684 - DNA, 25 bp, Rattus norvegicus
ggacttcagctcctggtagcagcag

SEQ ID NO: 424685 - DNA, 25 bp, Rattus norvegicus
ggacttcagctcgtggtagcagcag

SEQ ID NO: 424686 - DNA, 25 bp, Rattus norvegicus
ggacttcagggtcgcatccccaatg

SEQ ID NO: 424687 - DNA, 25 bp, Rattus norvegicus
ggacttcagggtggcatccccaatg

SEQ ID NO: 424688 - DNA, 25 bp, Rattus norvegicus
ggacttcaggttcagatcactactt

SEQ ID NO: 424689 - DNA, 25 bp, Rattus norvegicus
ggacttcaggttgagatcactactt

SEQ ID NO: 424690 - DNA, 25 bp, Rattus norvegicus
ggacttcagtgtacttcctagtatt

SEQ ID NO: 424691 - DNA, 25 bp, Rattus norvegicus
ggacttcagtgttcttcctagtatt

SEQ ID NO: 424692 - DNA, 25 bp, Rattus norvegicus
ggacttcatcgcactatagcttgga

SEQ ID NO: 424693 - DNA, 25 bp, Rattus norvegicus
ggacttcatcgctctatagcttgga

SEQ ID NO: 424694 - DNA, 25 bp, Rattus norvegicus
ggacttcatgcacagatgggaccat

SEQ ID NO: 424695 - DNA, 25 bp, Rattus norvegicus
ggacttcatgcagagatgggaccat

SEQ ID NO: 424696 - DNA, 25 bp, Rattus norvegicus
ggacttcattttagccatagatcat

SEQ ID NO: 424697 - DNA, 25 bp, Rattus norvegicus
ggacttcatttttgccatagatcat

SEQ ID NO: 424698 - DNA, 25 bp, Rattus norvegicus
ggacttccaagcacctacaacaagg

SEQ ID NO: 424699 - DNA, 25 bp, Rattus norvegicus
ggacttccaagctcctacaacaagg

SEQ ID NO: 424700 - DNA, 25 bp, Rattus norvegicus
ggacttccaaggacattccaatctt

SEQ ID NO: 424701 - DNA, 25 bp, Rattus norvegicus
ggacttccaaggtcattccaatctt

SEQ ID NO: 424702 - DNA, 25 bp, Rattus norvegicus
ggacttccactgatgtagcattacc

SEQ ID NO: 424703 - DNA, 25 bp, Rattus norvegicus
ggacttccactgttgtagcattacc

SEQ ID NO: 424704 - DNA, 25 bp, Rattus norvegicus
ggacttccacttaacagacgaacat

SEQ ID NO: 424705 - DNA, 25 bp, Rattus norvegicus
ggacttccactttacagacgaacat

SEQ ID NO: 424706 - DNA, 25 bp, Rattus norvegicus
ggacttccagacacctggcattggt

SEQ ID NO: 424707 - DNA, 25 bp, Rattus norvegicus
ggacttccagacattttccacagaa

SEQ ID NO: 424708 - DNA, 25 bp, Rattus norvegicus
ggacttccagactcctggcattggt

SEQ ID NO: 424709 - DNA, 25 bp, Rattus norvegicus
ggacttccagactttttccacagaa

SEQ ID NO: 424710 - DNA, 25 bp, Rattus norvegicus
ggacttccagtgaacttccaggctg

SEQ ID NO: 424711 - DNA, 25 bp, Rattus norvegicus
ggacttccagtgtacttccaggctg

SEQ ID NO: 424712 - DNA, 25 bp, Rattus norvegicus
ggacttcccctaaggtcaatatggt

SEQ ID NO: 424713 - DNA, 25 bp, Rattus norvegicus
ggacttcccctatggtcaatatggt

SEQ ID NO: 424714 - DNA, 25 bp, Rattus norvegicus
ggacttccctggcttaagtgacgat

SEQ ID NO: 424715 - DNA, 25 bp, Rattus norvegicus
ggacttccctgggttaagtgacgat

SEQ ID NO: 424716 - DNA, 25 bp, Rattus norvegicus
ggacttccggtcatgtccgtttcag

SEQ ID NO: 424717 - DNA, 25 bp, Rattus norvegicus
ggacttccggtcttgtccgtttcag

SEQ ID NO: 424718 - DNA, 25 bp, Rattus norvegicus
ggacttcctgcacaaactcactaag

SEQ ID NO: 424719 - DNA, 25 bp, Rattus norvegicus
ggacttcctgcagaaactcactaag

SEQ ID NO: 424720 - DNA, 25 bp, Rattus norvegicus
ggacttcctggacacatttgtgcta

SEQ ID NO: 424721 - DNA, 25 bp, Rattus norvegicus
ggacttcctggagacatttgtgcta

SEQ ID NO: 424722 - DNA, 25 bp, Rattus norvegicus
ggacttcctgtgacttaggtgactt

SEQ ID NO: 424723 - DNA, 25 bp, Rattus norvegicus
ggacttcctgtgtcttaggtgactt

SEQ ID NO: 424724 - DNA, 25 bp, Rattus norvegicus
ggacttcctgttatggctctgcctc

SEQ ID NO: 424725 - DNA, 25 bp, Rattus norvegicus
ggacttcctgttttggctctgcctc

SEQ ID NO: 424726 - DNA, 25 bp, Rattus norvegicus
ggacttcgagtacctctggcagaat

SEQ ID NO: 424727 - DNA, 25 bp, Rattus norvegicus
ggacttcgagtagctctggcagaat

SEQ ID NO: 424728 - DNA, 25 bp, Rattus norvegicus
ggacttcgatccaagttattttgca

SEQ ID NO: 424729 - DNA, 25 bp, Rattus norvegicus
ggacttcgatcctagttattttgca

SEQ ID NO: 424730 - DNA, 25 bp, Rattus norvegicus
ggacttcgcagcaaaggcacatcta

SEQ ID NO: 424731 - DNA, 25 bp, Rattus norvegicus
ggacttcgcagctaaggcacatcta

SEQ ID NO: 424732 - DNA, 25 bp, Rattus norvegicus
ggacttcgtagtacttgtgtcacaa

SEQ ID NO: 424733 - DNA, 25 bp, Rattus norvegicus
ggacttcgtagttcttgtgtcacaa

SEQ ID NO: 424734 - DNA, 25 bp, Rattus norvegicus
ggacttctaaaccagttattcagta

SEQ ID NO: 424735 - DNA, 25 bp, Rattus norvegicus
ggacttctaaacgagttattcagta

SEQ ID NO: 424736 - DNA, 25 bp, Rattus norvegicus
ggacttctacaaacaggcttctagg

SEQ ID NO: 424737 - DNA, 25 bp, Rattus norvegicus
ggacttctacaatcaggcttctagg

SEQ ID NO: 424738 - DNA, 25 bp, Rattus norvegicus
ggacttctacagagtgtgtctggcc

SEQ ID NO: 424739 - DNA, 25 bp, Rattus norvegicus
ggacttctacagtgtgtgtctggcc

SEQ ID NO: 424740 - DNA, 25 bp, Rattus norvegicus
ggacttctaccaccagtacgggcca

SEQ ID NO: 424741 - DNA, 25 bp, Rattus norvegicus
ggacttctaccagcagtacgggcca

SEQ ID NO: 424742 - DNA, 25 bp, Rattus norvegicus
ggacttctagaaagcacacgtgatg

SEQ ID NO: 424743 - DNA, 25 bp, Rattus norvegicus
ggacttctagaatgcacacgtgatg

SEQ ID NO: 424744 - DNA, 25 bp, Rattus norvegicus
ggacttctagggagagcctgagctc

SEQ ID NO: 424745 - DNA, 25 bp, Rattus norvegicus
ggacttctagggtgagcctgagctc

SEQ ID NO: 424746 - DNA, 25 bp, Rattus norvegicus
ggacttctcaagcatgacactgacc

SEQ ID NO: 424747 - DNA, 25 bp, Rattus norvegicus
ggacttctcaaggatgacactgacc

SEQ ID NO: 424748 - DNA, 25 bp, Rattus norvegicus
ggacttctcacgaaaacagttgctt

SEQ ID NO: 424749 - DNA, 25 bp, Rattus norvegicus
ggacttctcacgtaaacagttgctt

SEQ ID NO: 424750 - DNA, 25 bp, Rattus norvegicus
ggacttctcagaagcctcaggttca

SEQ ID NO: 424751 - DNA, 25 bp, Rattus norvegicus
ggacttctcagatgcctcaggttca

SEQ ID NO: 424752 - DNA, 25 bp, Rattus norvegicus
ggacttctccaacagctaagccaca

SEQ ID NO: 424753 - DNA, 25 bp, Rattus norvegicus
ggacttctccaaccaggtgtactgt

SEQ ID NO: 424754 - DNA, 25 bp, Rattus norvegicus
ggacttctccaagagctaagccaca

SEQ ID NO: 424755 - DNA, 25 bp, Rattus norvegicus
ggacttctccaagcaggtgtactgt

SEQ ID NO: 424756 - DNA, 25 bp, Rattus norvegicus
ggacttctctctctctggatgcaca

SEQ ID NO: 424757 - DNA, 25 bp, Rattus norvegicus
ggacttctctctgtctggatgcaca

SEQ ID NO: 424758 - DNA, 25 bp, Rattus norvegicus
ggacttctctggaattaaggcttta

SEQ ID NO: 424759 - DNA, 25 bp, Rattus norvegicus
ggacttctctggcttttgggctaga

SEQ ID NO: 424760 - DNA, 25 bp, Rattus norvegicus
ggacttctctgggttttgggctaga

SEQ ID NO: 424761 - DNA, 25 bp, Rattus norvegicus
ggacttctctggtattaaggcttta

SEQ ID NO: 424762 - DNA, 25 bp, Rattus norvegicus
ggacttctctttctgtattgctgtt

SEQ ID NO: 424763 - DNA, 25 bp, Rattus norvegicus
ggacttctctttgtgtattgctgtt

SEQ ID NO: 424764 - DNA, 25 bp, Rattus norvegicus
ggacttctgaatccatgttcatctt

SEQ ID NO: 424765 - DNA, 25 bp, Rattus norvegicus
ggacttctgaatgcatgttcatctt

SEQ ID NO: 424766 - DNA, 25 bp, Rattus norvegicus
ggacttctgagtaccacagatagta

SEQ ID NO: 424767 - DNA, 25 bp, Rattus norvegicus
ggacttctgagttccacagatagta

SEQ ID NO: 424768 - DNA, 25 bp, Rattus norvegicus
ggacttctgattacattcgtctggt

SEQ ID NO: 424769 - DNA, 25 bp, Rattus norvegicus
ggacttctgatttcattcgtctggt

SEQ ID NO: 424770 - DNA, 25 bp, Rattus norvegicus
ggacttctgtaaatttcccatttag

SEQ ID NO: 424771 - DNA, 25 bp, Rattus norvegicus
ggacttctgtaattttcccatttag

SEQ ID NO: 424772 - DNA, 25 bp, Rattus norvegicus
ggacttctgtatccttgtaaccaaa

SEQ ID NO: 424773 - DNA, 25 bp, Rattus norvegicus
ggacttctgtatgcttgtaaccaaa

SEQ ID NO: 424774 - DNA, 25 bp, Rattus norvegicus
ggacttctgtgtcccgtttgtcttt

SEQ ID NO: 424775 - DNA, 25 bp, Rattus norvegicus
ggacttctgtgtgccgtttgtcttt

SEQ ID NO: 424776 - DNA, 25 bp, Rattus norvegicus
ggacttcttgcaaataaggctacac

SEQ ID NO: 424777 - DNA, 25 bp, Rattus norvegicus
ggacttcttgcatataaggctacac

SEQ ID NO: 424778 - DNA, 25 bp, Rattus norvegicus
ggacttctttgtatacccatgttga

SEQ ID NO: 424779 - DNA, 25 bp, Rattus norvegicus
ggacttctttgtttacccatgttga

SEQ ID NO: 424780 - DNA, 25 bp, Rattus norvegicus
ggacttgaaaccaccagcattgagc

SEQ ID NO: 424781 - DNA, 25 bp, Rattus norvegicus
ggacttgaaacctccagcattgagc

SEQ ID NO: 424782 - DNA, 25 bp, Rattus norvegicus
ggacttgaaatcatattccccacaa

SEQ ID NO: 424783 - DNA, 25 bp, Rattus norvegicus
ggacttgaaatcttattccccacaa

SEQ ID NO: 424784 - DNA, 25 bp, Rattus norvegicus
ggacttgaacagatggccttatatt

SEQ ID NO: 424785 - DNA, 25 bp, Rattus norvegicus
ggacttgaacagttggccttatatt

SEQ ID NO: 424786 - DNA, 25 bp, Rattus norvegicus
ggacttgaacccaaatctgcctaat

SEQ ID NO: 424787 - DNA, 25 bp, Rattus norvegicus
ggacttgaacccaggtacctttgtg

SEQ ID NO: 424788 - DNA, 25 bp, Rattus norvegicus
ggacttgaaccctaatctgcctaat

SEQ ID NO: 424789 - DNA, 25 bp, Rattus norvegicus
ggacttgaaccctggtacctttgtg

SEQ ID NO: 424790 - DNA, 25 bp, Rattus norvegicus
ggacttgaactcaggaccgttgaga

SEQ ID NO: 424791 - DNA, 25 bp, Rattus norvegicus
ggacttgaactctggaccgttgaga

SEQ ID NO: 424792 - DNA, 25 bp, Rattus norvegicus
ggacttgaagcacacattacggagg

SEQ ID NO: 424793 - DNA, 25 bp, Rattus norvegicus
ggacttgaagcagacattacggagg

SEQ ID NO: 424794 - DNA, 25 bp, Rattus norvegicus
ggacttgaagcgattctatgacctt

SEQ ID NO: 424795 - DNA, 25 bp, Rattus norvegicus
ggacttgaagcgtttctatgacctt

SEQ ID NO: 424796 - DNA, 25 bp, Rattus norvegicus
ggacttgaattaccttggccatatt

SEQ ID NO: 424797 - DNA, 25 bp, Rattus norvegicus
ggacttgaattagcttggccatatt

SEQ ID NO: 424798 - DNA, 25 bp, Rattus norvegicus
ggacttgactagactttctgaactt

SEQ ID NO: 424799 - DNA, 25 bp, Rattus norvegicus
ggacttgactagtctttctgaactt

SEQ ID NO: 424800 - DNA, 25 bp, Rattus norvegicus
ggacttgactccacagaaaataata

SEQ ID NO: 424801 - DNA, 25 bp, Rattus norvegicus
ggacttgactcctcagaaaataata

SEQ ID NO: 424802 - DNA, 25 bp, Rattus norvegicus
ggacttgagaacatgccctttgagg

SEQ ID NO: 424803 - DNA, 25 bp, Rattus norvegicus
ggacttgagaacttgccctttgagg

SEQ ID NO: 424804 - DNA, 25 bp, Rattus norvegicus
ggacttgaggatcatcatgctccct

SEQ ID NO: 424805 - DNA, 25 bp, Rattus norvegicus
ggacttgaggatgatcatgctccct

SEQ ID NO: 424806 - DNA, 25 bp, Rattus norvegicus
ggacttgagtccataatgcgaacac

SEQ ID NO: 424807 - DNA, 25 bp, Rattus norvegicus
ggacttgagtccttaatgcgaacac

SEQ ID NO: 424808 - DNA, 25 bp, Rattus norvegicus
ggacttgagttcaactcgctcgcaa

SEQ ID NO: 424809 - DNA, 25 bp, Rattus norvegicus
ggacttgagttctactcgctcgcaa

SEQ ID NO: 424810 - DNA, 25 bp, Rattus norvegicus
ggacttgatcaccagaccagttcta

SEQ ID NO: 424811 - DNA, 25 bp, Rattus norvegicus
ggacttgatcacgagaccagttcta

SEQ ID NO: 424812 - DNA, 25 bp, Rattus norvegicus
ggacttgatgtaccctccaggtgag

SEQ ID NO: 424813 - DNA, 25 bp, Rattus norvegicus
ggacttgatgtagcctccaggtgag

SEQ ID NO: 424814 - DNA, 25 bp, Rattus norvegicus
ggacttgcacacagtactacgaaca

SEQ ID NO: 424815 - DNA, 25 bp, Rattus norvegicus
ggacttgcacactgtactacgaaca

SEQ ID NO: 424816 - DNA, 25 bp, Rattus norvegicus
ggacttgcaggacttcatccacgaa

SEQ ID NO: 424817 - DNA, 25 bp, Rattus norvegicus
ggacttgcaggagttcatccacgaa

SEQ ID NO: 424818 - DNA, 25 bp, Rattus norvegicus
ggacttgcaggcacccagaaatgaa

SEQ ID NO: 424819 - DNA, 25 bp, Rattus norvegicus
ggacttgcaggcaggattaccgcag

SEQ ID NO: 424820 - DNA, 25 bp, Rattus norvegicus
ggacttgcaggctcccagaaatgaa

SEQ ID NO: 424821 - DNA, 25 bp, Rattus norvegicus
ggacttgcaggctggattaccgcag

SEQ ID NO: 424822 - DNA, 25 bp, Rattus norvegicus
ggacttgcagtcataattttgggtg

SEQ ID NO: 424823 - DNA, 25 bp, Rattus norvegicus
ggacttgcagtcttaattttgggtg

SEQ ID NO: 424824 - DNA, 25 bp, Rattus norvegicus
ggacttgccacgctgtttgtaagag

SEQ ID NO: 424825 - DNA, 25 bp, Rattus norvegicus
ggacttgccacggtgtttgtaagag

SEQ ID NO: 424826 - DNA, 25 bp, Rattus norvegicus
ggacttgccagaaagttcatctgca

SEQ ID NO: 424827 - DNA, 25 bp, Rattus norvegicus
ggacttgccagatagttcatctgca

SEQ ID NO: 424828 - DNA, 25 bp, Rattus norvegicus
ggacttgccattatcacggtctgaa

SEQ ID NO: 424829 - DNA, 25 bp, Rattus norvegicus
ggacttgccattttcacggtctgaa

SEQ ID NO: 424830 - DNA, 25 bp, Rattus norvegicus
ggacttgcccagatcttaggcctag

SEQ ID NO: 424831 - DNA, 25 bp, Rattus norvegicus
ggacttgcccagttcttaggcctag

SEQ ID NO: 424832 - DNA, 25 bp, Rattus norvegicus
ggacttgcccatctatgtcatcagt

SEQ ID NO: 424833 - DNA, 25 bp, Rattus norvegicus
ggacttgcccatgtatgtcatcagt

SEQ ID NO: 424834 - DNA, 25 bp, Rattus norvegicus
ggacttgcccgccagctacaaactg

SEQ ID NO: 424835 - DNA, 25 bp, Rattus norvegicus
ggacttgcccgcgagctacaaactg

SEQ ID NO: 424836 - DNA, 25 bp, Rattus norvegicus
ggacttgcctaacacactcaaagcc

SEQ ID NO: 424837 - DNA, 25 bp, Rattus norvegicus
ggacttgcctaagacactcaaagcc

SEQ ID NO: 424838 - DNA, 25 bp, Rattus norvegicus
ggacttgcctagctgtgagcatgat

SEQ ID NO: 424839 - DNA, 25 bp, Rattus norvegicus
ggacttgcctaggtgtgagcatgat

SEQ ID NO: 424840 - DNA, 25 bp, Rattus norvegicus
ggacttgcctgactgaacacccaga

SEQ ID NO: 424841 - DNA, 25 bp, Rattus norvegicus
ggacttgcctgagtgaacacccaga

SEQ ID NO: 424842 - DNA, 25 bp, Rattus norvegicus
ggacttgctcagaatggtgttctaa

SEQ ID NO: 424843 - DNA, 25 bp, Rattus norvegicus
ggacttgctcagtatggtgttctaa

SEQ ID NO: 424844 - DNA, 25 bp, Rattus norvegicus
ggacttgcttatattttgcttcata

SEQ ID NO: 424845 - DNA, 25 bp, Rattus norvegicus
ggacttgcttattttttgcttcata

SEQ ID NO: 424846 - DNA, 25 bp, Rattus norvegicus
ggacttggaaacacactgacaccgt

SEQ ID NO: 424847 - DNA, 25 bp, Rattus norvegicus
ggacttggaaactcactgacaccgt

SEQ ID NO: 424848 - DNA, 25 bp, Rattus norvegicus
ggacttggaatactctgacctctga

SEQ ID NO: 424849 - DNA, 25 bp, Rattus norvegicus
ggacttggaatagtctgacctctga

SEQ ID NO: 424850 - DNA, 25 bp, Rattus norvegicus
ggacttggacatagtgtggcacccc

SEQ ID NO: 424851 - DNA, 25 bp, Rattus norvegicus
ggacttggacattgtgtggcacccc

SEQ ID NO: 424852 - DNA, 25 bp, Rattus norvegicus
ggacttggacccacatcaatggaca

SEQ ID NO: 424853 - DNA, 25 bp, Rattus norvegicus
ggacttggaccctcatcaatggaca

SEQ ID NO: 424854 - DNA, 25 bp, Rattus norvegicus
ggacttggagatcccgaattttctt

SEQ ID NO: 424855 - DNA, 25 bp, Rattus norvegicus
ggacttggagatgccgaattttctt

SEQ ID NO: 424856 - DNA, 25 bp, Rattus norvegicus
ggacttggcaggactgtgcaaccca

SEQ ID NO: 424857 - DNA, 25 bp, Rattus norvegicus
ggacttggcaggtctgtgcaaccca

SEQ ID NO: 424858 - DNA, 25 bp, Rattus norvegicus
ggacttggccatcgccgctcctgtt

SEQ ID NO: 424859 - DNA, 25 bp, Rattus norvegicus
ggacttggccatggccgctcctgtt

SEQ ID NO: 424860 - DNA, 25 bp, Rattus norvegicus
ggacttggcccacctcagataatct

SEQ ID NO: 424861 - DNA, 25 bp, Rattus norvegicus
ggacttggcccacttcagtgagaac

SEQ ID NO: 424862 - DNA, 25 bp, Rattus norvegicus
ggacttggcccagctcagataatct

SEQ ID NO: 424863 - DNA, 25 bp, Rattus norvegicus
ggacttggcccagttcagtgagaac

SEQ ID NO: 424864 - DNA, 25 bp, Rattus norvegicus
ggacttggctgtcatctttgactat

SEQ ID NO: 424865 - DNA, 25 bp, Rattus norvegicus
ggacttggctgtgatctttgactat

SEQ ID NO: 424866 - DNA, 25 bp, Rattus norvegicus
ggacttggcttcatcacagggagac

SEQ ID NO: 424867 - DNA, 25 bp, Rattus norvegicus
ggacttggcttcttcacagggagac

SEQ ID NO: 424868 - DNA, 25 bp, Rattus norvegicus
ggacttgggattctgtcagctacct

SEQ ID NO: 424869 - DNA, 25 bp, Rattus norvegicus
ggacttgggattgtgtcagctacct

SEQ ID NO: 424870 - DNA, 25 bp, Rattus norvegicus
ggacttgggtcacggaacattcttg

SEQ ID NO: 424871 - DNA, 25 bp, Rattus norvegicus
ggacttgggtcagggaacattcttg

SEQ ID NO: 424872 - DNA, 25 bp, Rattus norvegicus
ggacttggtaagacaacacgacttt

SEQ ID NO: 424873 - DNA, 25 bp, Rattus norvegicus
ggacttggtaagtcaacacgacttt

SEQ ID NO: 424874 - DNA, 25 bp, Rattus norvegicus
ggacttggtagtaatttttccatca

SEQ ID NO: 424875 - DNA, 25 bp, Rattus norvegicus
ggacttggtagttatttttccatca

SEQ ID NO: 424876 - DNA, 25 bp, Rattus norvegicus
ggacttggtcagcatccatgtcaaa

SEQ ID NO: 424877 - DNA, 25 bp, Rattus norvegicus
ggacttggtcaggatccatgtcaaa

SEQ ID NO: 424878 - DNA, 25 bp, Rattus norvegicus
ggacttggtctcacatcactgagca

SEQ ID NO: 424879 - DNA, 25 bp, Rattus norvegicus
ggacttggtctctcatcactgagca

SEQ ID NO: 424880 - DNA, 25 bp, Rattus norvegicus
ggacttggtgctccgctgaatgcaa

SEQ ID NO: 424881 - DNA, 25 bp, Rattus norvegicus
ggacttggtgctgcgctgaatgcaa

SEQ ID NO: 424882 - DNA, 25 bp, Rattus norvegicus
ggacttggtggcatttgagaccttt

SEQ ID NO: 424883 - DNA, 25 bp, Rattus norvegicus
ggacttggtggcttttgagaccttt

SEQ ID NO: 424884 - DNA, 25 bp, Rattus norvegicus
ggacttggtgtcattgaactcgttt

SEQ ID NO: 424885 - DNA, 25 bp, Rattus norvegicus
ggacttggtgtccagaccttgaaac

SEQ ID NO: 424886 - DNA, 25 bp, Rattus norvegicus
ggacttggtgtcgagaccttgaaac

SEQ ID NO: 424887 - DNA, 25 bp, Rattus norvegicus
ggacttggtgtctttgaactcgttt

SEQ ID NO: 424888 - DNA, 25 bp, Rattus norvegicus
ggacttgtaatcattcttcctcaga

SEQ ID NO: 424889 - DNA, 25 bp, Rattus norvegicus
ggacttgtaatctttcttcctcaga

SEQ ID NO: 424890 - DNA, 25 bp, Rattus norvegicus
ggacttgtacagagcgaccccaggg

SEQ ID NO: 424891 - DNA, 25 bp, Rattus norvegicus
ggacttgtacagtgcgaccccaggg

SEQ ID NO: 424892 - DNA, 25 bp, Rattus norvegicus
ggacttgtatccatggtactctact

SEQ ID NO: 424893 - DNA, 25 bp, Rattus norvegicus
ggacttgtatccttggtactctact

SEQ ID NO: 424894 - DNA, 25 bp, Rattus norvegicus
ggacttgtcatgctggtttgtgact

SEQ ID NO: 424895 - DNA, 25 bp, Rattus norvegicus
ggacttgtcatggtggtttgtgact

SEQ ID NO: 424896 - DNA, 25 bp, Rattus norvegicus
ggacttgtctccctaatcactacca

SEQ ID NO: 424897 - DNA, 25 bp, Rattus norvegicus
ggacttgtctccgtaatcactacca

SEQ ID NO: 424898 - DNA, 25 bp, Rattus norvegicus
ggacttgtctgtcaaaaagcttccc

SEQ ID NO: 424899 - DNA, 25 bp, Rattus norvegicus
ggacttgtctgtgaaaaagcttccc

SEQ ID NO: 424900 - DNA, 25 bp, Rattus norvegicus
ggacttgtcttaagtcactcggcaa

SEQ ID NO: 424901 - DNA, 25 bp, Rattus norvegicus
ggacttgtcttatgtcactcggcaa

SEQ ID NO: 424902 - DNA, 25 bp, Rattus norvegicus
ggacttgtgatgacgcctcaggcaa

SEQ ID NO: 424903 - DNA, 25 bp, Rattus norvegicus
ggacttgtgatgtcgcctcaggcaa

SEQ ID NO: 424904 - DNA, 25 bp, Rattus norvegicus
ggacttgtgcacagggtcttaccat

SEQ ID NO: 424905 - DNA, 25 bp, Rattus norvegicus
ggacttgtgcactgggtcttaccat

SEQ ID NO: 424906 - DNA, 25 bp, Rattus norvegicus
ggacttgtgggtcgcttaccagacc

SEQ ID NO: 424907 - DNA, 25 bp, Rattus norvegicus
ggacttgtgggtggcttaccagacc

SEQ ID NO: 424908 - DNA, 25 bp, Rattus norvegicus
ggacttgtggtcaaacaggcctgct

SEQ ID NO: 424909 - DNA, 25 bp, Rattus norvegicus
ggacttgtggtctaacaggcctgct

SEQ ID NO: 424910 - DNA, 25 bp, Rattus norvegicus
ggacttgtgtctagttcttactttt

SEQ ID NO: 424911 - DNA, 25 bp, Rattus norvegicus
ggacttgtgtcttgttcttactttt

SEQ ID NO: 424912 - DNA, 25 bp, Rattus norvegicus
ggacttgttctacttgctccgtaga

SEQ ID NO: 424913 - DNA, 25 bp, Rattus norvegicus
ggacttgttctagttgctccgtaga

SEQ ID NO: 424914 - DNA, 25 bp, Rattus norvegicus
ggacttgttgatatgacacacccct

SEQ ID NO: 424915 - DNA, 25 bp, Rattus norvegicus
ggacttgttgatttgacacacccct

SEQ ID NO: 424916 - DNA, 25 bp, Rattus norvegicus
ggacttgtttccacgtaacagtgca

SEQ ID NO: 424917 - DNA, 25 bp, Rattus norvegicus
ggacttgtttcctcgtaacagtgca

SEQ ID NO: 424918 - DNA, 25 bp, Rattus norvegicus
ggacttgttttcctgtatgctgaag

SEQ ID NO: 424919 - DNA, 25 bp, Rattus norvegicus
ggacttgttttcgtgtatgctgaag

SEQ ID NO: 424920 - DNA, 25 bp, Rattus norvegicus
ggacttgttttgacaatgcctgtgt

SEQ ID NO: 424921 - DNA, 25 bp, Rattus norvegicus
ggacttgttttgtcaatgcctgtgt

SEQ ID NO: 424922 - DNA, 25 bp, Rattus norvegicus
ggactttaaggcaagctgggtaact

SEQ ID NO: 424923 - DNA, 25 bp, Rattus norvegicus
ggactttaaggctagctgggtaact

SEQ ID NO: 424924 - DNA, 25 bp, Rattus norvegicus
ggactttacacacataggttgcgct

SEQ ID NO: 424925 - DNA, 25 bp, Rattus norvegicus
ggactttacacagataggttgcgct

SEQ ID NO: 424926 - DNA, 25 bp, Rattus norvegicus
ggactttacatgaccttcttacggc

SEQ ID NO: 424927 - DNA, 25 bp, Rattus norvegicus
ggactttacatgtccttcttacggc

SEQ ID NO: 424928 - DNA, 25 bp, Rattus norvegicus
ggactttaccagctgtgcagctcca

SEQ ID NO: 424929 - DNA, 25 bp, Rattus norvegicus
ggactttaccaggtgtgcagctcca

SEQ ID NO: 424930 - DNA, 25 bp, Rattus norvegicus
ggactttagacacgtagcctctgga

SEQ ID NO: 424931 - DNA, 25 bp, Rattus norvegicus
ggactttagacaggtagcctctgga

SEQ ID NO: 424932 - DNA, 25 bp, Rattus norvegicus
ggactttaggacatgagacattatt

SEQ ID NO: 424933 - DNA, 25 bp, Rattus norvegicus
ggactttaggacttgagacattatt

SEQ ID NO: 424934 - DNA, 25 bp, Rattus norvegicus
ggactttatccactgtccagtctgc

SEQ ID NO: 424935 - DNA, 25 bp, Rattus norvegicus
ggactttatccagtgtccagtctgc

SEQ ID NO: 424936 - DNA, 25 bp, Rattus norvegicus
ggactttcagctatacagctcactt

SEQ ID NO: 424937 - DNA, 25 bp, Rattus norvegicus
ggactttcagctttacagctcactt

SEQ ID NO: 424938 - DNA, 25 bp, Rattus norvegicus
ggactttcatttaaccattggcggt

SEQ ID NO: 424939 - DNA, 25 bp, Rattus norvegicus
ggactttcattttaccattggcggt

SEQ ID NO: 424940 - DNA, 25 bp, Rattus norvegicus
ggactttccaagagtcaacgtgctt

SEQ ID NO: 424941 - DNA, 25 bp, Rattus norvegicus
ggactttccaagtgtcaacgtgctt

SEQ ID NO: 424942 - DNA, 25 bp, Rattus norvegicus
ggactttcccttaagaaagccatag

SEQ ID NO: 424943 - DNA, 25 bp, Rattus norvegicus
ggactttccctttagaaagccatag

SEQ ID NO: 424944 - DNA, 25 bp, Rattus norvegicus
ggactttcgcagcaggaatctactt

SEQ ID NO: 424945 - DNA, 25 bp, Rattus norvegicus
ggactttcgcaggaggaatctactt

SEQ ID NO: 424946 - DNA, 25 bp, Rattus norvegicus
ggactttctctacgctttgtaggca

SEQ ID NO: 424947 - DNA, 25 bp, Rattus norvegicus
ggactttctctaggctttgtaggca

SEQ ID NO: 424948 - DNA, 25 bp, Rattus norvegicus
ggactttctgccctctcacagagag

SEQ ID NO: 424949 - DNA, 25 bp, Rattus norvegicus
ggactttctgccgtctcacagagag

SEQ ID NO: 424950 - DNA, 25 bp, Rattus norvegicus
ggactttcttccaggcctattacta

SEQ ID NO: 424951 - DNA, 25 bp, Rattus norvegicus
ggactttcttccatcaagttcatgg

SEQ ID NO: 424952 - DNA, 25 bp, Rattus norvegicus
ggactttcttcctggcctattacta

SEQ ID NO: 424953 - DNA, 25 bp, Rattus norvegicus
ggactttcttccttcaagttcatgg

SEQ ID NO: 424954 - DNA, 25 bp, Rattus norvegicus
ggactttcttctaacttctctaagg

SEQ ID NO: 424955 - DNA, 25 bp, Rattus norvegicus
ggactttcttcttacttctctaagg

SEQ ID NO: 424956 - DNA, 25 bp, Rattus norvegicus
ggactttctttacatgtcgtatccg

SEQ ID NO: 424957 - DNA, 25 bp, Rattus norvegicus
ggactttctttagatgtcgtatccg

SEQ ID NO: 424958 - DNA, 25 bp, Rattus norvegicus
ggactttctttgacagatcatagca

SEQ ID NO: 424959 - DNA, 25 bp, Rattus norvegicus
ggactttctttgtcagatcatagca

SEQ ID NO: 424960 - DNA, 25 bp, Rattus norvegicus
ggactttgaaaaactggctgtacat

SEQ ID NO: 424961 - DNA, 25 bp, Rattus norvegicus
ggactttgaaaatctggctgtacat

SEQ ID NO: 424962 - DNA, 25 bp, Rattus norvegicus
ggactttgacaaaagggtctctact

SEQ ID NO: 424963 - DNA, 25 bp, Rattus norvegicus
ggactttgacaatagggtctctact

SEQ ID NO: 424964 - DNA, 25 bp, Rattus norvegicus
ggactttgaccaagagaccaacatt

SEQ ID NO: 424965 - DNA, 25 bp, Rattus norvegicus
ggactttgaccatgagaccaacatt

SEQ ID NO: 424966 - DNA, 25 bp, Rattus norvegicus
ggactttgagatatcctgttacctc

SEQ ID NO: 424967 - DNA, 25 bp, Rattus norvegicus
ggactttgagatttcctgttacctc

SEQ ID NO: 424968 - DNA, 25 bp, Rattus norvegicus
ggactttgaggccacacttgtgaaa

SEQ ID NO: 424969 - DNA, 25 bp, Rattus norvegicus
ggactttgaggcgacacttgtgaaa

SEQ ID NO: 424970 - DNA, 25 bp, Rattus norvegicus
ggactttgcacgctcttgcagaact

SEQ ID NO: 424971 - DNA, 25 bp, Rattus norvegicus
ggactttgcacggtcttgcagaact

SEQ ID NO: 424972 - DNA, 25 bp, Rattus norvegicus
ggactttgcatacttcagcccaggg

SEQ ID NO: 424973 - DNA, 25 bp, Rattus norvegicus
ggactttgcatagttcagcccaggg

SEQ ID NO: 424974 - DNA, 25 bp, Rattus norvegicus
ggactttgccacatttctgatcaga

SEQ ID NO: 424975 - DNA, 25 bp, Rattus norvegicus
ggactttgccacttttctgatcaga

SEQ ID NO: 424976 - DNA, 25 bp, Rattus norvegicus
ggactttgccataaagcctttaaat

SEQ ID NO: 424977 - DNA, 25 bp, Rattus norvegicus
ggactttgccattaagcctttaaat

SEQ ID NO: 424978 - DNA, 25 bp, Rattus norvegicus
ggactttgctaaatcctgtggagaa

SEQ ID NO: 424979 - DNA, 25 bp, Rattus norvegicus
ggactttgctaattcctgtggagaa

SEQ ID NO: 424980 - DNA, 25 bp, Rattus norvegicus
ggactttgctccattcaattttctt

SEQ ID NO: 424981 - DNA, 25 bp, Rattus norvegicus
ggactttgctcctttcaattttctt

SEQ ID NO: 424982 - DNA, 25 bp, Rattus norvegicus
ggactttgctgacctgggcatgttc

SEQ ID NO: 424983 - DNA, 25 bp, Rattus norvegicus
ggactttgctgagctgggcatgttc

SEQ ID NO: 424984 - DNA, 25 bp, Rattus norvegicus
ggactttgctggatatagtacggag

SEQ ID NO: 424985 - DNA, 25 bp, Rattus norvegicus
ggactttgctggttatagtacggag

SEQ ID NO: 424986 - DNA, 25 bp, Rattus norvegicus
ggactttgctgtcagaaccacttat

SEQ ID NO: 424987 - DNA, 25 bp, Rattus norvegicus
ggactttgctgtgagaaccacttat

SEQ ID NO: 424988 - DNA, 25 bp, Rattus norvegicus
ggactttggaggctcgtcttctctc

SEQ ID NO: 424989 - DNA, 25 bp, Rattus norvegicus
ggactttggagggtcgtcttctctc

SEQ ID NO: 424990 - DNA, 25 bp, Rattus norvegicus
ggactttggattcaggttttttgca

SEQ ID NO: 424991 - DNA, 25 bp, Rattus norvegicus
ggactttggattgaggttttttgca

SEQ ID NO: 424992 - DNA, 25 bp, Rattus norvegicus
ggactttggccacttgacaacatat

SEQ ID NO: 424993 - DNA, 25 bp, Rattus norvegicus
ggactttggccagttgacaacatat

SEQ ID NO: 424994 - DNA, 25 bp, Rattus norvegicus
ggactttggtccaccttgtaacctg

SEQ ID NO: 424995 - DNA, 25 bp, Rattus norvegicus
ggactttggtcctccttgtaacctg

SEQ ID NO: 424996 - DNA, 25 bp, Rattus norvegicus
ggactttgtagtatcaaggcccagt

SEQ ID NO: 424997 - DNA, 25 bp, Rattus norvegicus
ggactttgtagtttcaaggcccagt

SEQ ID NO: 424998 - DNA, 25 bp, Rattus norvegicus
ggactttgtccaacattttgcttgt

SEQ ID NO: 424999 - DNA, 25 bp, Rattus norvegicus
ggactttgtccatcattttgcttgt

SEQ ID NO: 425000 - DNA, 25 bp, Rattus norvegicus
ggactttgtgaccagccatgggaac

SEQ ID NO: 425001 - DNA, 25 bp, Rattus norvegicus
ggactttgtgacgagccatgggaac

SEQ ID NO: 425002 - DNA, 25 bp, Rattus norvegicus
ggactttgtgctatctccagaacag

SEQ ID NO: 425003 - DNA, 25 bp, Rattus norvegicus
ggactttgtgctttctccagaacag

SEQ ID NO: 425004 - DNA, 25 bp, Rattus norvegicus
ggactttgtggcagcactaaccata

SEQ ID NO: 425005 - DNA, 25 bp, Rattus norvegicus
ggactttgtggctgcactaaccata

SEQ ID NO: 425006 - DNA, 25 bp, Rattus norvegicus
ggactttgttacattagccacaaag

SEQ ID NO: 425007 - DNA, 25 bp, Rattus norvegicus
ggactttgttactttagccacaaag

SEQ ID NO: 425008 - DNA, 25 bp, Rattus norvegicus
ggactttgtttcatcaattgacttt

SEQ ID NO: 425009 - DNA, 25 bp, Rattus norvegicus
ggactttgtttcttcaattgacttt

SEQ ID NO: 425010 - DNA, 25 bp, Rattus norvegicus
ggacttttccttatggtgatcagcg

SEQ ID NO: 425011 - DNA, 25 bp, Rattus norvegicus
ggacttttccttttggtgatcagcg

SEQ ID NO: 425012 - DNA, 25 bp, Rattus norvegicus
ggacttttcgttaacattgaccaag

SEQ ID NO: 425013 - DNA, 25 bp, Rattus norvegicus
ggacttttcgtttacattgaccaag

SEQ ID NO: 425014 - DNA, 25 bp, Rattus norvegicus
ggacttttgacactttagttcttag

SEQ ID NO: 425015 - DNA, 25 bp, Rattus norvegicus
ggacttttgacagtttagttcttag

SEQ ID NO: 425016 - DNA, 25 bp, Rattus norvegicus
ggacttttgccaagtttgcttgtat

SEQ ID NO: 425017 - DNA, 25 bp, Rattus norvegicus
ggacttttgccatgtttgcttgtat

SEQ ID NO: 425018 - DNA, 25 bp, Rattus norvegicus
ggacttttggagacagttccagtct

SEQ ID NO: 425019 - DNA, 25 bp, Rattus norvegicus
ggacttttggagtcagttccagtct

SEQ ID NO: 425020 - DNA, 25 bp, Rattus norvegicus
ggacttttgtcaagtttgccccaat

SEQ ID NO: 425021 - DNA, 25 bp, Rattus norvegicus
ggacttttgtcatgtttgccccaat

SEQ ID NO: 425022 - DNA, 25 bp, Rattus norvegicus
ggacttttgtttcggtctttctctg

SEQ ID NO: 425023 - DNA, 25 bp, Rattus norvegicus
ggacttttgtttgggtctttctctg

SEQ ID NO: 425024 - DNA, 25 bp, Rattus norvegicus
ggactttttactacgtgactacaca

SEQ ID NO: 425025 - DNA, 25 bp, Rattus norvegicus
ggactttttacttcgtgactacaca

SEQ ID NO: 425026 - DNA, 25 bp, Rattus norvegicus
ggacttttttccaaggtatactatg

SEQ ID NO: 425027 - DNA, 25 bp, Rattus norvegicus
ggacttttttcctaggtatactatg

SEQ ID NO: 425028 - DNA, 25 bp, Rattus norvegicus
ggacttttttctactcagacctcgt

SEQ ID NO: 425029 - DNA, 25 bp, Rattus norvegicus
ggacttttttcttctcagacctcgt

SEQ ID NO: 425030 - DNA, 25 bp, Rattus norvegicus
ggagaaaacctacagtatcagttaa

SEQ ID NO: 425031 - DNA, 25 bp, Rattus norvegicus
ggagaaaacctagagtatcagttaa

SEQ ID NO: 425032 - DNA, 25 bp, Rattus norvegicus
ggagaaaacggtcccactagacgga

SEQ ID NO: 425033 - DNA, 25 bp, Rattus norvegicus
ggagaaaacggtgccactagacgga

SEQ ID NO: 425034 - DNA, 25 bp, Rattus norvegicus
ggagaaaactccaagtcctcttcct

SEQ ID NO: 425035 - DNA, 25 bp, Rattus norvegicus
ggagaaaactcctagtcctcttcct

SEQ ID NO: 425036 - DNA, 25 bp, Rattus norvegicus
ggagaaaactctatgaagtcctgcc

SEQ ID NO: 425037 - DNA, 25 bp, Rattus norvegicus
ggagaaaactctttgaagtcctgcc

SEQ ID NO: 425038 - DNA, 25 bp, Rattus norvegicus
ggagaaaagcccatgagccctcagc

SEQ ID NO: 425039 - DNA, 25 bp, Rattus norvegicus
ggagaaaagcccttgagccctcagc

SEQ ID NO: 425040 - DNA, 25 bp, Rattus norvegicus
ggagaaaaggcacctcttcccacac

SEQ ID NO: 425041 - DNA, 25 bp, Rattus norvegicus
ggagaaaaggcagctcttcccacac

SEQ ID NO: 425042 - DNA, 25 bp, Rattus norvegicus
ggagaaaatatgaacttcctcaaga

SEQ ID NO: 425043 - DNA, 25 bp, Rattus norvegicus
ggagaaaatatgtacttcctcaaga

SEQ ID NO: 425044 - DNA, 25 bp, Rattus norvegicus
ggagaaaatccacgtccccagtgct

SEQ ID NO: 425045 - DNA, 25 bp, Rattus norvegicus
ggagaaaatccaggtccccagtgct

SEQ ID NO: 425046 - DNA, 25 bp, Rattus norvegicus
ggagaaaatctgcaagtcacggtta

SEQ ID NO: 425047 - DNA, 25 bp, Rattus norvegicus
ggagaaaatctggaagtcacggtta

SEQ ID NO: 425048 - DNA, 25 bp, Rattus norvegicus
ggagaaaattccatcccacgagcac

SEQ ID NO: 425049 - DNA, 25 bp, Rattus norvegicus
ggagaaaattccttcccacgagcac

SEQ ID NO: 425050 - DNA, 25 bp, Rattus norvegicus
ggagaaaattgccttcctgaataga

SEQ ID NO: 425051 - DNA, 25 bp, Rattus norvegicus
ggagaaaattgcgttcctgaataga

SEQ ID NO: 425052 - DNA, 25 bp, Rattus norvegicus
ggagaaacaactcacctgactggat

SEQ ID NO: 425053 - DNA, 25 bp, Rattus norvegicus
ggagaaacaactgacctgactggat

SEQ ID NO: 425054 - DNA, 25 bp, Rattus norvegicus
ggagaaacactgctgcgctgaactt

SEQ ID NO: 425055 - DNA, 25 bp, Rattus norvegicus
ggagaaacactggtgcgctgaactt

SEQ ID NO: 425056 - DNA, 25 bp, Rattus norvegicus
ggagaaacagacaagcccttccgac

SEQ ID NO: 425057 - DNA, 25 bp, Rattus norvegicus
ggagaaacagactagcccttccgac

SEQ ID NO: 425058 - DNA, 25 bp, Rattus norvegicus
ggagaaacagcacatacaggtatga

SEQ ID NO: 425059 - DNA, 25 bp, Rattus norvegicus
ggagaaacagcagatacaggtatga

SEQ ID NO: 425060 - DNA, 25 bp, Rattus norvegicus
ggagaaaccaatcagcagcccctat

SEQ ID NO: 425061 - DNA, 25 bp, Rattus norvegicus
ggagaaaccaatgagcagcccctat

SEQ ID NO: 425062 - DNA, 25 bp, Rattus norvegicus
ggagaaaccatgcagcctgcgctgc

SEQ ID NO: 425063 - DNA, 25 bp, Rattus norvegicus
ggagaaaccatggagcctgcgctgc

SEQ ID NO: 425064 - DNA, 25 bp, Rattus norvegicus
ggagaaacccagagacctttatcaa

SEQ ID NO: 425065 - DNA, 25 bp, Rattus norvegicus
ggagaaacccagtgacctttatcaa

SEQ ID NO: 425066 - DNA, 25 bp, Rattus norvegicus
ggagaaaccgttcaagtgtgatgcc

SEQ ID NO: 425067 - DNA, 25 bp, Rattus norvegicus
ggagaaaccgttgaagtgtgatgcc

SEQ ID NO: 425068 - DNA, 25 bp, Rattus norvegicus
ggagaaacctagagttcagagttcc

SEQ ID NO: 425069 - DNA, 25 bp, Rattus norvegicus
ggagaaacctagtgttcagagttcc

SEQ ID NO: 425070 - DNA, 25 bp, Rattus norvegicus
ggagaaacgcttcttaccctgtatt

SEQ ID NO: 425071 - DNA, 25 bp, Rattus norvegicus
ggagaaacgcttgttaccctgtatt

SEQ ID NO: 425072 - DNA, 25 bp, Rattus norvegicus
ggagaaacgtatcaattacatgcaa

SEQ ID NO: 425073 - DNA, 25 bp, Rattus norvegicus
ggagaaacgtatgaattacatgcaa

SEQ ID NO: 425074 - DNA, 25 bp, Rattus norvegicus
ggagaaactaccagaccaaactggc

SEQ ID NO: 425075 - DNA, 25 bp, Rattus norvegicus
ggagaaactacctgaccaaactggc

SEQ ID NO: 425076 - DNA, 25 bp, Rattus norvegicus
ggagaaactcaaagggaccgaccct

SEQ ID NO: 425077 - DNA, 25 bp, Rattus norvegicus
ggagaaactcaatgggaccgaccct

SEQ ID NO: 425078 - DNA, 25 bp, Rattus norvegicus
ggagaaactctgacttttgcacttt

SEQ ID NO: 425079 - DNA, 25 bp, Rattus norvegicus
ggagaaactctgtcttttgcacttt

SEQ ID NO: 425080 - DNA, 25 bp, Rattus norvegicus
ggagaaactgctcctttgactgagg

SEQ ID NO: 425081 - DNA, 25 bp, Rattus norvegicus
ggagaaactgctgctttgactgagg

SEQ ID NO: 425082 - DNA, 25 bp, Rattus norvegicus
ggagaaactgtgctactgtcatgaa

SEQ ID NO: 425083 - DNA, 25 bp, Rattus norvegicus
ggagaaactgtggtactgtcatgaa

SEQ ID NO: 425084 - DNA, 25 bp, Rattus norvegicus
ggagaaacttccctgccccatgctg

SEQ ID NO: 425085 - DNA, 25 bp, Rattus norvegicus
ggagaaacttccgtgccccatgctg

SEQ ID NO: 425086 - DNA, 25 bp, Rattus norvegicus
ggagaaacttcgactcttatcgccc

SEQ ID NO: 425087 - DNA, 25 bp, Rattus norvegicus
ggagaaacttcgtctcttatcgccc

SEQ ID NO: 425088 - DNA, 25 bp, Rattus norvegicus
ggagaaactttgcacaagacaatgt

SEQ ID NO: 425089 - DNA, 25 bp, Rattus norvegicus
ggagaaactttggacaagacaatgt

SEQ ID NO: 425090 - DNA, 25 bp, Rattus norvegicus
ggagaaacttttcaccttcagcaga

SEQ ID NO: 425091 - DNA, 25 bp, Rattus norvegicus
ggagaaacttttgaccttcagcaga

SEQ ID NO: 425092 - DNA, 25 bp, Rattus norvegicus
ggagaaagatccaaagttcaaggcc

SEQ ID NO: 425093 - DNA, 25 bp, Rattus norvegicus
ggagaaagatcctaagttcaaggcc

SEQ ID NO: 425094 - DNA, 25 bp, Rattus norvegicus
ggagaaagccacaagccaaacaata

SEQ ID NO: 425095 - DNA, 25 bp, Rattus norvegicus
ggagaaagccactagccaaacaata

SEQ ID NO: 425096 - DNA, 25 bp, Rattus norvegicus
ggagaaagccccaggcccatgtgct

SEQ ID NO: 425097 - DNA, 25 bp, Rattus norvegicus
ggagaaagcccctggcccatgtgct

SEQ ID NO: 425098 - DNA, 25 bp, Rattus norvegicus
ggagaaagcctgcaccacggcagtc

SEQ ID NO: 425099 - DNA, 25 bp, Rattus norvegicus
ggagaaagcctggaccacggcagtc

SEQ ID NO: 425100 - DNA, 25 bp, Rattus norvegicus
ggagaaagctctctagaccatcagc

SEQ ID NO: 425101 - DNA, 25 bp, Rattus norvegicus
ggagaaagctctgtagaccatcagc

SEQ ID NO: 425102 - DNA, 25 bp, Rattus norvegicus
ggagaaagtcccatgttcataacag

SEQ ID NO: 425103 - DNA, 25 bp, Rattus norvegicus
ggagaaagtcccttgttcataacag

SEQ ID NO: 425104 - DNA, 25 bp, Rattus norvegicus
ggagaaataagtacggccgcctctc

SEQ ID NO: 425105 - DNA, 25 bp, Rattus norvegicus
ggagaaataagttcggccgcctctc

SEQ ID NO: 425106 - DNA, 25 bp, Rattus norvegicus
ggagaaataccacagcctcacctct

SEQ ID NO: 425107 - DNA, 25 bp, Rattus norvegicus
ggagaaataccagagcctcacctct

SEQ ID NO: 425108 - DNA, 25 bp, Rattus norvegicus
ggagaaatatccatgttgcgtaaag

SEQ ID NO: 425109 - DNA, 25 bp, Rattus norvegicus
ggagaaatatccttgttgcgtaaag

SEQ ID NO: 425110 - DNA, 25 bp, Rattus norvegicus
ggagaaatatggaacacctctttac

SEQ ID NO: 425111 - DNA, 25 bp, Rattus norvegicus
ggagaaatatggtacacctctttac

SEQ ID NO: 425112 - DNA, 25 bp, Rattus norvegicus
ggagaaatcccacccctactgctag

SEQ ID NO: 425113 - DNA, 25 bp, Rattus norvegicus
ggagaaatcccagccctactgctag

SEQ ID NO: 425114 - DNA, 25 bp, Rattus norvegicus
ggagaaatgaatccctttgaaacca

SEQ ID NO: 425115 - DNA, 25 bp, Rattus norvegicus
ggagaaatgaatgcctttgaaacca

SEQ ID NO: 425116 - DNA, 25 bp, Rattus norvegicus
ggagaaatgcccacatctgtgggta

SEQ ID NO: 425117 - DNA, 25 bp, Rattus norvegicus
ggagaaatgccctcatctgtgggta

SEQ ID NO: 425118 - DNA, 25 bp, Rattus norvegicus
ggagaaatgctactgcccattgcag

SEQ ID NO: 425119 - DNA, 25 bp, Rattus norvegicus
ggagaaatgctagtgcccattgcag

SEQ ID NO: 425120 - DNA, 25 bp, Rattus norvegicus
ggagaacaaaacatcagcccaggaa

SEQ ID NO: 425121 - DNA, 25 bp, Rattus norvegicus
ggagaacaaaacttcagcccaggaa

SEQ ID NO: 425122 - DNA, 25 bp, Rattus norvegicus
ggagaacaaacactcctgggctcct

SEQ ID NO: 425123 - DNA, 25 bp, Rattus norvegicus
ggagaacaaacagtcctgggctcct

SEQ ID NO: 425124 - DNA, 25 bp, Rattus norvegicus
ggagaacaacagaaccagtagccca

SEQ ID NO: 425125 - DNA, 25 bp, Rattus norvegicus
ggagaacaacagtaccagtagccca

SEQ ID NO: 425126 - DNA, 25 bp, Rattus norvegicus
ggagaacaactacacagccttccag

SEQ ID NO: 425127 - DNA, 25 bp, Rattus norvegicus
ggagaacaactacacggcgctgcag

SEQ ID NO: 425128 - DNA, 25 bp, Rattus norvegicus
ggagaacaactagacagccttccag

SEQ ID NO: 425129 - DNA, 25 bp, Rattus norvegicus
ggagaacaactagacggcgctgcag

SEQ ID NO: 425130 - DNA, 25 bp, Rattus norvegicus
ggagaacaactcatatcctcgtttc

SEQ ID NO: 425131 - DNA, 25 bp, Rattus norvegicus
ggagaacaactcttatcctcgtttc

SEQ ID NO: 425132 - DNA, 25 bp, Rattus norvegicus
ggagaacaagatactggccagcttt

SEQ ID NO: 425133 - DNA, 25 bp, Rattus norvegicus
ggagaacaagattctggccagcttt

SEQ ID NO: 425134 - DNA, 25 bp, Rattus norvegicus
ggagaacacagcactggcggcttag

SEQ ID NO: 425135 - DNA, 25 bp, Rattus norvegicus
ggagaacacagctctggcggcttag

SEQ ID NO: 425136 - DNA, 25 bp, Rattus norvegicus
ggagaacaccttcaagtcagacgca

SEQ ID NO: 425137 - DNA, 25 bp, Rattus norvegicus
ggagaacaccttgaagtcagacgca

SEQ ID NO: 425138 - DNA, 25 bp, Rattus norvegicus
ggagaacactctagccatgaaggta

SEQ ID NO: 425139 - DNA, 25 bp, Rattus norvegicus
ggagaacactcttgccatgaaggta

SEQ ID NO: 425140 - DNA, 25 bp, Rattus norvegicus
ggagaacactgtccagaactgccct

SEQ ID NO: 425141 - DNA, 25 bp, Rattus norvegicus
ggagaacactgtgcagaactgccct

SEQ ID NO: 425142 - DNA, 25 bp, Rattus norvegicus
ggagaacacttcattgccttaacgt

SEQ ID NO: 425143 - DNA, 25 bp, Rattus norvegicus
ggagaacacttctttgccttaacgt

SEQ ID NO: 425144 - DNA, 25 bp, Rattus norvegicus
ggagaacagacgatcggctacctct

SEQ ID NO: 425145 - DNA, 25 bp, Rattus norvegicus
ggagaacagacgttcggctacctct

SEQ ID NO: 425146 - DNA, 25 bp, Rattus norvegicus
ggagaacagctcaccagtgtttagt

SEQ ID NO: 425147 - DNA, 25 bp, Rattus norvegicus
ggagaacagctctccagtgtttagt

SEQ ID NO: 425148 - DNA, 25 bp, Rattus norvegicus
ggagaacagcttccagcgtgaacct

SEQ ID NO: 425149 - DNA, 25 bp, Rattus norvegicus
ggagaacagcttgcagcgtgaacct

SEQ ID NO: 425150 - DNA, 25 bp, Rattus norvegicus
ggagaacatgatatccttcacaaat

SEQ ID NO: 425151 - DNA, 25 bp, Rattus norvegicus
ggagaacatgatttccttcacaaat

SEQ ID NO: 425152 - DNA, 25 bp, Rattus norvegicus
ggagaacattccatctacctagtga

SEQ ID NO: 425153 - DNA, 25 bp, Rattus norvegicus
ggagaacattccttctacctagtga

SEQ ID NO: 425154 - DNA, 25 bp, Rattus norvegicus
ggagaaccaagtcatcggcttcctg

SEQ ID NO: 425155 - DNA, 25 bp, Rattus norvegicus
ggagaaccaagtgatcggcttcctg

SEQ ID NO: 425156 - DNA, 25 bp, Rattus norvegicus
ggagaaccaatcctgttgtcttctg

SEQ ID NO: 425157 - DNA, 25 bp, Rattus norvegicus
ggagaaccaatcgtgttgtcttctg

SEQ ID NO: 425158 - DNA, 25 bp, Rattus norvegicus
ggagaaccacctatgtcagtactaa

SEQ ID NO: 425159 - DNA, 25 bp, Rattus norvegicus
ggagaaccacctttgtcagtactaa

SEQ ID NO: 425160 - DNA, 25 bp, Rattus norvegicus
ggagaaccagacacgggctcgcgat

SEQ ID NO: 425161 - DNA, 25 bp, Rattus norvegicus
ggagaaccagactcgggctcgcgat

SEQ ID NO: 425162 - DNA, 25 bp, Rattus norvegicus
ggagaacccagacccttcagaacat

SEQ ID NO: 425163 - DNA, 25 bp, Rattus norvegicus
ggagaacccagagccttcagaacat

SEQ ID NO: 425164 - DNA, 25 bp, Rattus norvegicus
ggagaacccattactgcagcatcca

SEQ ID NO: 425165 - DNA, 25 bp, Rattus norvegicus
ggagaacccatttctgcagcatcca

SEQ ID NO: 425166 - DNA, 25 bp, Rattus norvegicus
ggagaacccgatctggatctgtgtt

SEQ ID NO: 425167 - DNA, 25 bp, Rattus norvegicus
ggagaacccgatgtggatctgtgtt

SEQ ID NO: 425168 - DNA, 25 bp, Rattus norvegicus
ggagaacccgtgcaaatgtcttcat

SEQ ID NO: 425169 - DNA, 25 bp, Rattus norvegicus
ggagaacccgtggaaatgtcttcat

SEQ ID NO: 425170 - DNA, 25 bp, Rattus norvegicus
ggagaaccctctagaaactctacta

SEQ ID NO: 425171 - DNA, 25 bp, Rattus norvegicus
ggagaaccctcttgaaactctacta

SEQ ID NO: 425172 - DNA, 25 bp, Rattus norvegicus
ggagaacccttccttgaacaagcgc

SEQ ID NO: 425173 - DNA, 25 bp, Rattus norvegicus
ggagaacccttcgttgaacaagcgc

SEQ ID NO: 425174 - DNA, 25 bp, Rattus norvegicus
ggagaaccggagagccttcctcagg

SEQ ID NO: 425175 - DNA, 25 bp, Rattus norvegicus
ggagaaccggagtgccttcctcagg

SEQ ID NO: 425176 - DNA, 25 bp, Rattus norvegicus
ggagaacctagacgcattcccctaa

SEQ ID NO: 425177 - DNA, 25 bp, Rattus norvegicus
ggagaacctagaggcattcccctaa

SEQ ID NO: 425178 - DNA, 25 bp, Rattus norvegicus
ggagaacctatgacattaacctagt

SEQ ID NO: 425179 - DNA, 25 bp, Rattus norvegicus
ggagaacctatgtcattaacctagt

SEQ ID NO: 425180 - DNA, 25 bp, Rattus norvegicus
ggagaacctctgacttaagctaagt

SEQ ID NO: 425181 - DNA, 25 bp, Rattus norvegicus
ggagaacctctgtcttaagctaagt

SEQ ID NO: 425182 - DNA, 25 bp, Rattus norvegicus
ggagaaccttctccgcaagggtcgc

SEQ ID NO: 425183 - DNA, 25 bp, Rattus norvegicus
ggagaaccttctgcgcaagggtcgc

SEQ ID NO: 425184 - DNA, 25 bp, Rattus norvegicus
ggagaacgaagccttttccagccac

SEQ ID NO: 425185 - DNA, 25 bp, Rattus norvegicus
ggagaacgaagcgttttccagccac

SEQ ID NO: 425186 - DNA, 25 bp, Rattus norvegicus
ggagaacgccttacctaagacagga

SEQ ID NO: 425187 - DNA, 25 bp, Rattus norvegicus
ggagaacgcctttcctaagacagga

SEQ ID NO: 425188 - DNA, 25 bp, Rattus norvegicus
ggagaacgctctacacagagcacta

SEQ ID NO: 425189 - DNA, 25 bp, Rattus norvegicus
ggagaacgctcttcacagagcacta

SEQ ID NO: 425190 - DNA, 25 bp, Rattus norvegicus
ggagaacgcttgctatgcccttaaa

SEQ ID NO: 425191 - DNA, 25 bp, Rattus norvegicus
ggagaacgcttggtatgcccttaaa

SEQ ID NO: 425192 - DNA, 25 bp, Rattus norvegicus
ggagaacggctaaaccttccctcat

SEQ ID NO: 425193 - DNA, 25 bp, Rattus norvegicus
ggagaacggctataccttccctcat

SEQ ID NO: 425194 - DNA, 25 bp, Rattus norvegicus
ggagaacggtccacggcaagcttga

SEQ ID NO: 425195 - DNA, 25 bp, Rattus norvegicus
ggagaacggtcctcggcaagcttga

SEQ ID NO: 425196 - DNA, 25 bp, Rattus norvegicus
ggagaactacaacacccaccaagga

SEQ ID NO: 425197 - DNA, 25 bp, Rattus norvegicus
ggagaactacaagacccaccaagga

SEQ ID NO: 425198 - DNA, 25 bp, Rattus norvegicus
ggagaactactcctcccaggagacg

SEQ ID NO: 425199 - DNA, 25 bp, Rattus norvegicus
ggagaactactcgtcccaggagacg

SEQ ID NO: 425200 - DNA, 25 bp, Rattus norvegicus
ggagaactagagcaccaactctctg

SEQ ID NO: 425201 - DNA, 25 bp, Rattus norvegicus
ggagaactagaggaccaactctctg

SEQ ID NO: 425202 - DNA, 25 bp, Rattus norvegicus
ggagaactatcgactacacctaggg

SEQ ID NO: 425203 - DNA, 25 bp, Rattus norvegicus
ggagaactatcgtctacacctaggg

SEQ ID NO: 425204 - DNA, 25 bp, Rattus norvegicus
ggagaactatggctgcggacaatat

SEQ ID NO: 425205 - DNA, 25 bp, Rattus norvegicus
ggagaactatgggtgcggacaatat

SEQ ID NO: 425206 - DNA, 25 bp, Rattus norvegicus
ggagaactcaatatagatacagatt

SEQ ID NO: 425207 - DNA, 25 bp, Rattus norvegicus
ggagaactcaatttagatacagatt

SEQ ID NO: 425208 - DNA, 25 bp, Rattus norvegicus
ggagaactcagaagaccctgtagaa

SEQ ID NO: 425209 - DNA, 25 bp, Rattus norvegicus
ggagaactcagatgaccctgtagaa

SEQ ID NO: 425210 - DNA, 25 bp, Rattus norvegicus
ggagaactcgagcacatgcatgatc

SEQ ID NO: 425211 - DNA, 25 bp, Rattus norvegicus
ggagaactcgaggacatgcatgatc

SEQ ID NO: 425212 - DNA, 25 bp, Rattus norvegicus
ggagaactctctatggtcacttttg

SEQ ID NO: 425213 - DNA, 25 bp, Rattus norvegicus
ggagaactctctttggtcacttttg

SEQ ID NO: 425214 - DNA, 25 bp, Rattus norvegicus
ggagaactctgacctggccttgcca

SEQ ID NO: 425215 - DNA, 25 bp, Rattus norvegicus
ggagaactctgagctggccttgcca

SEQ ID NO: 425216 - DNA, 25 bp, Rattus norvegicus
ggagaactctggatacttttttatg

SEQ ID NO: 425217 - DNA, 25 bp, Rattus norvegicus
ggagaactctggttacttttttatg

SEQ ID NO: 425218 - DNA, 25 bp, Rattus norvegicus
ggagaactgcttccagactctaaag

SEQ ID NO: 425219 - DNA, 25 bp, Rattus norvegicus
ggagaactgcttgcagactctaaag

SEQ ID NO: 425220 - DNA, 25 bp, Rattus norvegicus
ggagaactggttccaagtcgtcctc

SEQ ID NO: 425221 - DNA, 25 bp, Rattus norvegicus
ggagaactggttgcaagtcgtcctc

SEQ ID NO: 425222 - DNA, 25 bp, Rattus norvegicus
ggagaactgtctctccaagtcaaag

SEQ ID NO: 425223 - DNA, 25 bp, Rattus norvegicus
ggagaactgtctgtccaagtcaaag

SEQ ID NO: 425224 - DNA, 25 bp, Rattus norvegicus
ggagaactgtgacactcgtccaata

SEQ ID NO: 425225 - DNA, 25 bp, Rattus norvegicus
ggagaactgtgagactcgtccaata

SEQ ID NO: 425226 - DNA, 25 bp, Rattus norvegicus
ggagaacttaatcctcttggtttat

SEQ ID NO: 425227 - DNA, 25 bp, Rattus norvegicus
ggagaacttaatgctcttggtttat

SEQ ID NO: 425228 - DNA, 25 bp, Rattus norvegicus
ggagaacttccacaacatgccaaaa

SEQ ID NO: 425229 - DNA, 25 bp, Rattus norvegicus
ggagaacttccagaacatgccaaaa

SEQ ID NO: 425230 - DNA, 25 bp, Rattus norvegicus
ggagaacttcttagagatctgcgat

SEQ ID NO: 425231 - DNA, 25 bp, Rattus norvegicus
ggagaacttctttgagatctgcgat

SEQ ID NO: 425232 - DNA, 25 bp, Rattus norvegicus
ggagaactttggctcatctccccag

SEQ ID NO: 425233 - DNA, 25 bp, Rattus norvegicus
ggagaactttgggtcatctccccag

SEQ ID NO: 425234 - DNA, 25 bp, Rattus norvegicus
ggagaactttttacacaccacacca

SEQ ID NO: 425235 - DNA, 25 bp, Rattus norvegicus
ggagaacttttttcacaccacacca

SEQ ID NO: 425236 - DNA, 25 bp, Rattus norvegicus
ggagaagaactcacgccagcgactt

SEQ ID NO: 425237 - DNA, 25 bp, Rattus norvegicus
ggagaagaactctcgccagcgactt

SEQ ID NO: 425238 - DNA, 25 bp, Rattus norvegicus
ggagaagaagctcccaatcgccatt

SEQ ID NO: 425239 - DNA, 25 bp, Rattus norvegicus
ggagaagaagctgccaatcgccatt

SEQ ID NO: 425240 - DNA, 25 bp, Rattus norvegicus
ggagaagaagtcatggcccagtact

SEQ ID NO: 425241 - DNA, 25 bp, Rattus norvegicus
ggagaagaagtcttggcccagtact

SEQ ID NO: 425242 - DNA, 25 bp, Rattus norvegicus
ggagaagaattcaagcccagcacta

SEQ ID NO: 425243 - DNA, 25 bp, Rattus norvegicus
ggagaagaattcaggcctggccagt

SEQ ID NO: 425244 - DNA, 25 bp, Rattus norvegicus
ggagaagaattctagcccagcacta

SEQ ID NO: 425245 - DNA, 25 bp, Rattus norvegicus
ggagaagaattctggcctggccagt

SEQ ID NO: 425246 - DNA, 25 bp, Rattus norvegicus
ggagaagacacacccttccaagatg

SEQ ID NO: 425247 - DNA, 25 bp, Rattus norvegicus
ggagaagacacagccttccaagatg

SEQ ID NO: 425248 - DNA, 25 bp, Rattus norvegicus
ggagaagacagaactcgtcacttta

SEQ ID NO: 425249 - DNA, 25 bp, Rattus norvegicus
ggagaagacagatctcgtcacttta

SEQ ID NO: 425250 - DNA, 25 bp, Rattus norvegicus
ggagaagaccatcgccaacacctga

SEQ ID NO: 425251 - DNA, 25 bp, Rattus norvegicus
ggagaagaccatggccaacacctga

SEQ ID NO: 425252 - DNA, 25 bp, Rattus norvegicus
ggagaagacgatcaccagaagtaat

SEQ ID NO: 425253 - DNA, 25 bp, Rattus norvegicus
ggagaagacgatgaccagaagtaat

SEQ ID NO: 425254 - DNA, 25 bp, Rattus norvegicus
ggagaagagaggaggacatcacccc

SEQ ID NO: 425255 - DNA, 25 bp, Rattus norvegicus
ggagaagagaggtggacatcacccc

SEQ ID NO: 425256 - DNA, 25 bp, Rattus norvegicus
ggagaagatcttctgcggccagatc

SEQ ID NO: 425257 - DNA, 25 bp, Rattus norvegicus
ggagaagatcttgtgcggccagatc

SEQ ID NO: 425258 - DNA, 25 bp, Rattus norvegicus
ggagaagatgtcctcgctcagcatc

SEQ ID NO: 425259 - DNA, 25 bp, Rattus norvegicus
ggagaagatgtcgtcgctcagcatc

SEQ ID NO: 425260 - DNA, 25 bp, Rattus norvegicus
ggagaagatgttattcacagtatga

SEQ ID NO: 425261 - DNA, 25 bp, Rattus norvegicus
ggagaagatgtttttcacagtatga

SEQ ID NO: 425262 - DNA, 25 bp, Rattus norvegicus
ggagaagattcaattcttcccgccg

SEQ ID NO: 425263 - DNA, 25 bp, Rattus norvegicus
ggagaagattcatttcttcccgccg

SEQ ID NO: 425264 - DNA, 25 bp, Rattus norvegicus
ggagaagattccatgacccagatat

SEQ ID NO: 425265 - DNA, 25 bp, Rattus norvegicus
ggagaagattccttgacccagatat

SEQ ID NO: 425266 - DNA, 25 bp, Rattus norvegicus
ggagaagattttccccgtggtttat

SEQ ID NO: 425267 - DNA, 25 bp, Rattus norvegicus
ggagaagattttgcccgtggtttat

SEQ ID NO: 425268 - DNA, 25 bp, Rattus norvegicus
ggagaagcaccacctcagactgact

SEQ ID NO: 425269 - DNA, 25 bp, Rattus norvegicus
ggagaagcaccagctcagactgact

SEQ ID NO: 425270 - DNA, 25 bp, Rattus norvegicus
ggagaagcactgactcggacactga

SEQ ID NO: 425271 - DNA, 25 bp, Rattus norvegicus
ggagaagcactgtctcggacactga

SEQ ID NO: 425272 - DNA, 25 bp, Rattus norvegicus
ggagaagcaggccacttgcagtacc

SEQ ID NO: 425273 - DNA, 25 bp, Rattus norvegicus
ggagaagcaggcgacttgcagtacc

SEQ ID NO: 425274 - DNA, 25 bp, Rattus norvegicus
ggagaagcaggtacctctggagaca

SEQ ID NO: 425275 - DNA, 25 bp, Rattus norvegicus
ggagaagcaggttcctctggagaca

SEQ ID NO: 425276 - DNA, 25 bp, Rattus norvegicus
ggagaagcagtccaacagcacttta

SEQ ID NO: 425277 - DNA, 25 bp, Rattus norvegicus
ggagaagcagtcgaacagcacttta

SEQ ID NO: 425278 - DNA, 25 bp, Rattus norvegicus
ggagaagcatgactcactttcctgt

SEQ ID NO: 425279 - DNA, 25 bp, Rattus norvegicus
ggagaagcatgagtcactttcctgt

SEQ ID NO: 425280 - DNA, 25 bp, Rattus norvegicus
ggagaagccagcatttgatgtcccc

SEQ ID NO: 425281 - DNA, 25 bp, Rattus norvegicus
ggagaagccagcttttgatgtcccc

SEQ ID NO: 425282 - DNA, 25 bp, Rattus norvegicus
ggagaagcccatacccttacttgag

SEQ ID NO: 425283 - DNA, 25 bp, Rattus norvegicus
ggagaagcccattcccttacttgag

SEQ ID NO: 425284 - DNA, 25 bp, Rattus norvegicus
ggagaagccccaatcctggatggtt

SEQ ID NO: 425285 - DNA, 25 bp, Rattus norvegicus
ggagaagccccaccgcctgtaggca

SEQ ID NO: 425286 - DNA, 25 bp, Rattus norvegicus
ggagaagccccagcgcctgtaggca

SEQ ID NO: 425287 - DNA, 25 bp, Rattus norvegicus
ggagaagccccattcctggatggtt

SEQ ID NO: 425288 - DNA, 25 bp, Rattus norvegicus
ggagaagccctgcagactactgtca

SEQ ID NO: 425289 - DNA, 25 bp, Rattus norvegicus
ggagaagccctggagactactgtca

SEQ ID NO: 425290 - DNA, 25 bp, Rattus norvegicus
ggagaagcctccagaaacaccaaac

SEQ ID NO: 425291 - DNA, 25 bp, Rattus norvegicus
ggagaagcctcctgaaacaccaaac

SEQ ID NO: 425292 - DNA, 25 bp, Rattus norvegicus
ggagaagccttcaggttgaccttaa

SEQ ID NO: 425293 - DNA, 25 bp, Rattus norvegicus
ggagaagccttcatcctttaatgct

SEQ ID NO: 425294 - DNA, 25 bp, Rattus norvegicus
ggagaagccttctggttgaccttaa

SEQ ID NO: 425295 - DNA, 25 bp, Rattus norvegicus
ggagaagccttcttcctttaatgct

SEQ ID NO: 425296 - DNA, 25 bp, Rattus norvegicus
ggagaagcgttcaacacgttggtgt

SEQ ID NO: 425297 - DNA, 25 bp, Rattus norvegicus
ggagaagcgttctacacgttggtgt

SEQ ID NO: 425298 - DNA, 25 bp, Rattus norvegicus
ggagaagctaatcacccacatgaat

SEQ ID NO: 425299 - DNA, 25 bp, Rattus norvegicus
ggagaagctaatgacccacatgaat

SEQ ID NO: 425300 - DNA, 25 bp, Rattus norvegicus
ggagaagctgccaatcttcctcgaa

SEQ ID NO: 425301 - DNA, 25 bp, Rattus norvegicus
ggagaagctgcctatcttcctcgaa

SEQ ID NO: 425302 - DNA, 25 bp, Rattus norvegicus
ggagaagctgcgcacactaggatac

SEQ ID NO: 425303 - DNA, 25 bp, Rattus norvegicus
ggagaagctgcggacactaggatac

SEQ ID NO: 425304 - DNA, 25 bp, Rattus norvegicus
ggagaagctgctaatgacagtgcct

SEQ ID NO: 425305 - DNA, 25 bp, Rattus norvegicus
ggagaagctgcttatgacagtgcct

SEQ ID NO: 425306 - DNA, 25 bp, Rattus norvegicus
ggagaagcttctaaccagcgagagt

SEQ ID NO: 425307 - DNA, 25 bp, Rattus norvegicus
ggagaagcttcttaccagcgagagt

SEQ ID NO: 425308 - DNA, 25 bp, Rattus norvegicus
ggagaaggactcagatggtacaaaa

SEQ ID NO: 425309 - DNA, 25 bp, Rattus norvegicus
ggagaaggactctgatggtacaaaa

SEQ ID NO: 425310 - DNA, 25 bp, Rattus norvegicus
ggagaaggacttcattgccctctac

SEQ ID NO: 425311 - DNA, 25 bp, Rattus norvegicus
ggagaaggacttgattgccctctac

SEQ ID NO: 425312 - DNA, 25 bp, Rattus norvegicus
ggagaaggagaccctgcttcgctca

SEQ ID NO: 425313 - DNA, 25 bp, Rattus norvegicus
ggagaaggagacgctgcttcgctca

SEQ ID NO: 425314 - DNA, 25 bp, Rattus norvegicus
ggagaaggatcaagggcaacacagt

SEQ ID NO: 425315 - DNA, 25 bp, Rattus norvegicus
ggagaaggatcacaacctcaatgga

SEQ ID NO: 425316 - DNA, 25 bp, Rattus norvegicus
ggagaaggatcagaacctcaatgga

SEQ ID NO: 425317 - DNA, 25 bp, Rattus norvegicus
ggagaaggatcatgggcaacacagt

SEQ ID NO: 425318 - DNA, 25 bp, Rattus norvegicus
ggagaaggatcgagatcgcccactc

SEQ ID NO: 425319 - DNA, 25 bp, Rattus norvegicus
ggagaaggatcgtgatcgcccactc

SEQ ID NO: 425320 - DNA, 25 bp, Rattus norvegicus
ggagaaggcaccatctattatcttt

SEQ ID NO: 425321 - DNA, 25 bp, Rattus norvegicus
ggagaaggcaccttctattatcttt

SEQ ID NO: 425322 - DNA, 25 bp, Rattus norvegicus
ggagaaggcgcaacactcttcagct

SEQ ID NO: 425323 - DNA, 25 bp, Rattus norvegicus
ggagaaggcgcatcactcttcagct

SEQ ID NO: 425324 - DNA, 25 bp, Rattus norvegicus
ggagaaggctgaccatccagcagtc

SEQ ID NO: 425325 - DNA, 25 bp, Rattus norvegicus
ggagaaggctgagcatccagcagtc

SEQ ID NO: 425326 - DNA, 25 bp, Rattus norvegicus
ggagaaggtatcatgtcagacaacg

SEQ ID NO: 425327 - DNA, 25 bp, Rattus norvegicus
ggagaaggtatcttgtcagacaacg

SEQ ID NO: 425328 - DNA, 25 bp, Rattus norvegicus
ggagaaggtctgcaaccctatcatc

SEQ ID NO: 425329 - DNA, 25 bp, Rattus norvegicus
ggagaaggtctggaaccctatcatc

SEQ ID NO: 425330 - DNA, 25 bp, Rattus norvegicus
ggagaagtatttctactctagctac

SEQ ID NO: 425331 - DNA, 25 bp, Rattus norvegicus
ggagaagtatttgtactctagctac

SEQ ID NO: 425332 - DNA, 25 bp, Rattus norvegicus
ggagaagtcacaatgagcccggctt

SEQ ID NO: 425333 - DNA, 25 bp, Rattus norvegicus
ggagaagtcacattgagcccggctt

SEQ ID NO: 425334 - DNA, 25 bp, Rattus norvegicus
ggagaagtccgaccacaccgagccg

SEQ ID NO: 425335 - DNA, 25 bp, Rattus norvegicus
ggagaagtccgagcacaccgagccg

SEQ ID NO: 425336 - DNA, 25 bp, Rattus norvegicus
ggagaagtccggactgcagaaagaa

SEQ ID NO: 425337 - DNA, 25 bp, Rattus norvegicus
ggagaagtccggtctgcagaaagaa

SEQ ID NO: 425338 - DNA, 25 bp, Rattus norvegicus
ggagaagtcctactgacgacaccta

SEQ ID NO: 425339 - DNA, 25 bp, Rattus norvegicus
ggagaagtcctagtgacgacaccta

SEQ ID NO: 425340 - DNA, 25 bp, Rattus norvegicus
ggagaagtctccaaaagcaaaggga

SEQ ID NO: 425341 - DNA, 25 bp, Rattus norvegicus
ggagaagtctcctaaagcaaaggga

SEQ ID NO: 425342 - DNA, 25 bp, Rattus norvegicus
ggagaagtggaactctgtcccacct

SEQ ID NO: 425343 - DNA, 25 bp, Rattus norvegicus
ggagaagtggaagtctgtcccacct

SEQ ID NO: 425344 - DNA, 25 bp, Rattus norvegicus
ggagaagtgtaacatgaccagagac

SEQ ID NO: 425345 - DNA, 25 bp, Rattus norvegicus
ggagaagtgtaagatgaccagagac

SEQ ID NO: 425346 - DNA, 25 bp, Rattus norvegicus
ggagaagttaaaccacctgcctagt

SEQ ID NO: 425347 - DNA, 25 bp, Rattus norvegicus
ggagaagttaaagcacctgcctagt

SEQ ID NO: 425348 - DNA, 25 bp, Rattus norvegicus
ggagaagttcctctggctggcctca

SEQ ID NO: 425349 - DNA, 25 bp, Rattus norvegicus
ggagaagttcctgtggctggcctca

SEQ ID NO: 425350 - DNA, 25 bp, Rattus norvegicus
ggagaagttctgagactatcatgaa

SEQ ID NO: 425351 - DNA, 25 bp, Rattus norvegicus
ggagaagttctgtgactatcatgaa

SEQ ID NO: 425352 - DNA, 25 bp, Rattus norvegicus
ggagaagtttacacgcccattgtcg

SEQ ID NO: 425353 - DNA, 25 bp, Rattus norvegicus
ggagaagtttactcgcccattgtcg

SEQ ID NO: 425354 - DNA, 25 bp, Rattus norvegicus
ggagaataccctccctatccctatg

SEQ ID NO: 425355 - DNA, 25 bp, Rattus norvegicus
ggagaataccctgcctatccctatg

SEQ ID NO: 425356 - DNA, 25 bp, Rattus norvegicus
ggagaatatacacctgctccaccac

SEQ ID NO: 425357 - DNA, 25 bp, Rattus norvegicus
ggagaatatacagctgctccaccac

SEQ ID NO: 425358 - DNA, 25 bp, Rattus norvegicus
ggagaatatccaacccaggacacca

SEQ ID NO: 425359 - DNA, 25 bp, Rattus norvegicus
ggagaatatccatcccaggacacca

SEQ ID NO: 425360 - DNA, 25 bp, Rattus norvegicus
ggagaatatgtcctcctcagtgcct

SEQ ID NO: 425361 - DNA, 25 bp, Rattus norvegicus
ggagaatatgtcgtcctcagtgcct

SEQ ID NO: 425362 - DNA, 25 bp, Rattus norvegicus
ggagaatcacgtactctgacttcca

SEQ ID NO: 425363 - DNA, 25 bp, Rattus norvegicus
ggagaatcacgttctctgacttcca

SEQ ID NO: 425364 - DNA, 25 bp, Rattus norvegicus
ggagaatccccaacttagaccaaag

SEQ ID NO: 425365 - DNA, 25 bp, Rattus norvegicus
ggagaatccccatcttagaccaaag

SEQ ID NO: 425366 - DNA, 25 bp, Rattus norvegicus
ggagaatcgatgcatacctagtata

SEQ ID NO: 425367 - DNA, 25 bp, Rattus norvegicus
ggagaatcgatggatacctagtata

SEQ ID NO: 425368 - DNA, 25 bp, Rattus norvegicus
ggagaatctcagatcccagtcaggg

SEQ ID NO: 425369 - DNA, 25 bp, Rattus norvegicus
ggagaatctcagttcccagtcaggg

SEQ ID NO: 425370 - DNA, 25 bp, Rattus norvegicus
ggagaatctctaaaagtcctggatg

SEQ ID NO: 425371 - DNA, 25 bp, Rattus norvegicus
ggagaatctctaccaagagcggagt

SEQ ID NO: 425372 - DNA, 25 bp, Rattus norvegicus
ggagaatctctagcaagagcggagt

SEQ ID NO: 425373 - DNA, 25 bp, Rattus norvegicus
ggagaatctctataagtcctggatg

SEQ ID NO: 425374 - DNA, 25 bp, Rattus norvegicus
ggagaatctgaacgtcacgtccttc

SEQ ID NO: 425375 - DNA, 25 bp, Rattus norvegicus
ggagaatctgaaggtcacgtccttc

SEQ ID NO: 425376 - DNA, 25 bp, Rattus norvegicus
ggagaatctgcaatgttgtctgtat

SEQ ID NO: 425377 - DNA, 25 bp, Rattus norvegicus
ggagaatctgcattgttgtctgtat

SEQ ID NO: 425378 - DNA, 25 bp, Rattus norvegicus
ggagaatcttacaagtcttcagcta

SEQ ID NO: 425379 - DNA, 25 bp, Rattus norvegicus
ggagaatcttactagtcttcagcta

SEQ ID NO: 425380 - DNA, 25 bp, Rattus norvegicus
ggagaatcttctagtacccaaaaag

SEQ ID NO: 425381 - DNA, 25 bp, Rattus norvegicus
ggagaatcttcttgtacccaaaaag

SEQ ID NO: 425382 - DNA, 25 bp, Rattus norvegicus
ggagaatgaatgctcctcacagcag

SEQ ID NO: 425383 - DNA, 25 bp, Rattus norvegicus
ggagaatgaatggtcctcacagcag

SEQ ID NO: 425384 - DNA, 25 bp, Rattus norvegicus
ggagaatgacaactaccgaagacac

SEQ ID NO: 425385 - DNA, 25 bp, Rattus norvegicus
ggagaatgacaagtaccgaagacac

SEQ ID NO: 425386 - DNA, 25 bp, Rattus norvegicus
ggagaatgacctcaaccctgcggca

SEQ ID NO: 425387 - DNA, 25 bp, Rattus norvegicus
ggagaatgacctgaaccctgcggca

SEQ ID NO: 425388 - DNA, 25 bp, Rattus norvegicus
ggagaatgatagaacggacgccaga

SEQ ID NO: 425389 - DNA, 25 bp, Rattus norvegicus
ggagaatgatagtacggacgccaga

SEQ ID NO: 425390 - DNA, 25 bp, Rattus norvegicus
ggagaatgctccaagaaaacctttc

SEQ ID NO: 425391 - DNA, 25 bp, Rattus norvegicus
ggagaatgctcctagaaaacctttc

SEQ ID NO: 425392 - DNA, 25 bp, Rattus norvegicus
ggagaatggctccttcttactgaac

SEQ ID NO: 425393 - DNA, 25 bp, Rattus norvegicus
ggagaatggctcgttcttactgaac

SEQ ID NO: 425394 - DNA, 25 bp, Rattus norvegicus
ggagaatggtttaccttgctaacaa

SEQ ID NO: 425395 - DNA, 25 bp, Rattus norvegicus
ggagaatggttttccttgctaacaa

SEQ ID NO: 425396 - DNA, 25 bp, Rattus norvegicus
ggagaatgtcaacacctacttcgta

SEQ ID NO: 425397 - DNA, 25 bp, Rattus norvegicus
ggagaatgtcaagacctacttcgta

SEQ ID NO: 425398 - DNA, 25 bp, Rattus norvegicus
ggagaatgtctcaaaccctatcttc

SEQ ID NO: 425399 - DNA, 25 bp, Rattus norvegicus
ggagaatgtctctaaccctatcttc

SEQ ID NO: 425400 - DNA, 25 bp, Rattus norvegicus
ggagaatgtgttctcgccctctaaa

SEQ ID NO: 425401 - DNA, 25 bp, Rattus norvegicus
ggagaatgtgttgtcgccctctaaa

SEQ ID NO: 425402 - DNA, 25 bp, Rattus norvegicus
ggagaattacaacctacaggtcatc

SEQ ID NO: 425403 - DNA, 25 bp, Rattus norvegicus
ggagaattacaagctacaggtcatc

SEQ ID NO: 425404 - DNA, 25 bp, Rattus norvegicus
ggagaattattactccctacctctg

SEQ ID NO: 425405 - DNA, 25 bp, Rattus norvegicus
ggagaattattagtccctacctctg

SEQ ID NO: 425406 - DNA, 25 bp, Rattus norvegicus
ggagaattcaaactgctcatattac

SEQ ID NO: 425407 - DNA, 25 bp, Rattus norvegicus
ggagaattcaaagtgctcatattac

SEQ ID NO: 425408 - DNA, 25 bp, Rattus norvegicus
ggagaattcctcatcactggacatg

SEQ ID NO: 425409 - DNA, 25 bp, Rattus norvegicus
ggagaattcctcttcactggacatg

SEQ ID NO: 425410 - DNA, 25 bp, Rattus norvegicus
ggagaattcgacagtcacactctct

SEQ ID NO: 425411 - DNA, 25 bp, Rattus norvegicus
ggagaattcgactgtcacactctct

SEQ ID NO: 425412 - DNA, 25 bp, Rattus norvegicus
ggagaattctgtcgctcagcatccg

SEQ ID NO: 425413 - DNA, 25 bp, Rattus norvegicus
ggagaattctgtggctcagcatccg

SEQ ID NO: 425414 - DNA, 25 bp, Rattus norvegicus
ggagaattcttacatcttgcatttg

SEQ ID NO: 425415 - DNA, 25 bp, Rattus norvegicus
ggagaattcttagatcttgcatttg

SEQ ID NO: 425416 - DNA, 25 bp, Rattus norvegicus
ggagaattgcccctatacctgagcc

SEQ ID NO: 425417 - DNA, 25 bp, Rattus norvegicus
ggagaattgcccgtatacctgagcc

SEQ ID NO: 425418 - DNA, 25 bp, Rattus norvegicus
ggagaattggctcactggctgtcta

SEQ ID NO: 425419 - DNA, 25 bp, Rattus norvegicus
ggagaattggctgactggctgtcta

SEQ ID NO: 425420 - DNA, 25 bp, Rattus norvegicus
ggagaatttgaaccagcccttcagc

SEQ ID NO: 425421 - DNA, 25 bp, Rattus norvegicus
ggagaatttgaagcagcccttcagc

SEQ ID NO: 425422 - DNA, 25 bp, Rattus norvegicus
ggagaatttgagattcacctacgaa

SEQ ID NO: 425423 - DNA, 25 bp, Rattus norvegicus
ggagaatttgagtttcacctacgaa

SEQ ID NO: 425424 - DNA, 25 bp, Rattus norvegicus
ggagacaaaagcaaatacaactgat

SEQ ID NO: 425425 - DNA, 25 bp, Rattus norvegicus
ggagacaaaagctaatacaactgat

SEQ ID NO: 425426 - DNA, 25 bp, Rattus norvegicus
ggagacaaaatgagaccaccgggac

SEQ ID NO: 425427 - DNA, 25 bp, Rattus norvegicus
ggagacaaaatgtgaccaccgggac

SEQ ID NO: 425428 - DNA, 25 bp, Rattus norvegicus
ggagacaaaggtcgtgaatctctga

SEQ ID NO: 425429 - DNA, 25 bp, Rattus norvegicus
ggagacaaaggtggtgaatctctga

SEQ ID NO: 425430 - DNA, 25 bp, Rattus norvegicus
ggagacaacccacgaggtggcttca

SEQ ID NO: 425431 - DNA, 25 bp, Rattus norvegicus
ggagacaacccaggaggtggcttca

SEQ ID NO: 425432 - DNA, 25 bp, Rattus norvegicus
ggagacaactcgaagggcccagctg

SEQ ID NO: 425433 - DNA, 25 bp, Rattus norvegicus
ggagacaactcgtagggcccagctg

SEQ ID NO: 425434 - DNA, 25 bp, Rattus norvegicus
ggagacaactgcatctgctaacagt

SEQ ID NO: 425435 - DNA, 25 bp, Rattus norvegicus
ggagacaactgcttctgctaacagt

SEQ ID NO: 425436 - DNA, 25 bp, Rattus norvegicus
ggagacaagctcattcatgtgcaga

SEQ ID NO: 425437 - DNA, 25 bp, Rattus norvegicus
ggagacaagctctttcatgtgcaga

SEQ ID NO: 425438 - DNA, 25 bp, Rattus norvegicus
ggagacaagcttcctgtcccagttc

SEQ ID NO: 425439 - DNA, 25 bp, Rattus norvegicus
ggagacaagcttgctgtcccagttc

SEQ ID NO: 425440 - DNA, 25 bp, Rattus norvegicus
ggagacaagggtatcacatttcaat

SEQ ID NO: 425441 - DNA, 25 bp, Rattus norvegicus
ggagacaagggtttcacatttcaat

SEQ ID NO: 425442 - DNA, 25 bp, Rattus norvegicus
ggagacaagtgtaaaacctcaaaca

SEQ ID NO: 425443 - DNA, 25 bp, Rattus norvegicus
ggagacaagtgttaaacctcaaaca

SEQ ID NO: 425444 - DNA, 25 bp, Rattus norvegicus
ggagacaatgcccaatcacttgccc

SEQ ID NO: 425445 - DNA, 25 bp, Rattus norvegicus
ggagacaatgccgaatcacttgccc

SEQ ID NO: 425446 - DNA, 25 bp, Rattus norvegicus
ggagacaatgggaccgctaacatct

SEQ ID NO: 425447 - DNA, 25 bp, Rattus norvegicus
ggagacaatgggtccgctaacatct

SEQ ID NO: 425448 - DNA, 25 bp, Rattus norvegicus
ggagacaattacctgttaacctcta

SEQ ID NO: 425449 - DNA, 25 bp, Rattus norvegicus
ggagacaattacgtgttaacctcta

SEQ ID NO: 425450 - DNA, 25 bp, Rattus norvegicus
ggagacaattagcattcaccaagat

SEQ ID NO: 425451 - DNA, 25 bp, Rattus norvegicus
ggagacaattaggattcaccaagat

SEQ ID NO: 425452 - DNA, 25 bp, Rattus norvegicus
ggagacacaatcaccaataccatga

SEQ ID NO: 425453 - DNA, 25 bp, Rattus norvegicus
ggagacacaatctccaataccatga

SEQ ID NO: 425454 - DNA, 25 bp, Rattus norvegicus
ggagacacagtcactaccattctaa

SEQ ID NO: 425455 - DNA, 25 bp, Rattus norvegicus
ggagacacagtctctaccattctaa

SEQ ID NO: 425456 - DNA, 25 bp, Rattus norvegicus
ggagacacagtgatgctgctgcagt

SEQ ID NO: 425457 - DNA, 25 bp, Rattus norvegicus
ggagacacagtgttgctgctgcagt

SEQ ID NO: 425458 - DNA, 25 bp, Rattus norvegicus
ggagacaccagaatggcaagtgact

SEQ ID NO: 425459 - DNA, 25 bp, Rattus norvegicus
ggagacaccagattggcaagtgact

SEQ ID NO: 425460 - DNA, 25 bp, Rattus norvegicus
ggagacaccataatggcctgcctag

SEQ ID NO: 425461 - DNA, 25 bp, Rattus norvegicus
ggagacaccatattggcctgcctag

SEQ ID NO: 425462 - DNA, 25 bp, Rattus norvegicus
ggagacacccaacaccaacactgga

SEQ ID NO: 425463 - DNA, 25 bp, Rattus norvegicus
ggagacacccaagaccaacactgga

SEQ ID NO: 425464 - DNA, 25 bp, Rattus norvegicus
ggagacaccgcgagaatttctactt

SEQ ID NO: 425465 - DNA, 25 bp, Rattus norvegicus
ggagacaccgcgtgaatttctactt

SEQ ID NO: 425466 - DNA, 25 bp, Rattus norvegicus
ggagacacctatctaccagagtaat

SEQ ID NO: 425467 - DNA, 25 bp, Rattus norvegicus
ggagacacctatgtaccagagtaat

SEQ ID NO: 425468 - DNA, 25 bp, Rattus norvegicus
ggagacacgctcagccaaggatgct

SEQ ID NO: 425469 - DNA, 25 bp, Rattus norvegicus
ggagacacgctctgccaaggatgct

SEQ ID NO: 425470 - DNA, 25 bp, Rattus norvegicus
ggagacacgtttcgattgccagctt

SEQ ID NO: 425471 - DNA, 25 bp, Rattus norvegicus
ggagacacgtttggattgccagctt

SEQ ID NO: 425472 - DNA, 25 bp, Rattus norvegicus
ggagacactccaatgctgtcagctg

SEQ ID NO: 425473 - DNA, 25 bp, Rattus norvegicus
ggagacactccattgctgtcagctg

SEQ ID NO: 425474 - DNA, 25 bp, Rattus norvegicus
ggagacactccgagtttctttttct

SEQ ID NO: 425475 - DNA, 25 bp, Rattus norvegicus
ggagacactccgtgtttctttttct

SEQ ID NO: 425476 - DNA, 25 bp, Rattus norvegicus
ggagacactcgaaccaccaagaggg

SEQ ID NO: 425477 - DNA, 25 bp, Rattus norvegicus
ggagacactcgatccaccaagaggg

SEQ ID NO: 425478 - DNA, 25 bp, Rattus norvegicus
ggagacactggtcccatgaggatcc

SEQ ID NO: 425479 - DNA, 25 bp, Rattus norvegicus
ggagacactggtgccatgaggatcc

SEQ ID NO: 425480 - DNA, 25 bp, Rattus norvegicus
ggagacacttaactaccaccagttt

SEQ ID NO: 425481 - DNA, 25 bp, Rattus norvegicus
ggagacacttaagtaccaccagttt

SEQ ID NO: 425482 - DNA, 25 bp, Rattus norvegicus
ggagacacttggatccttctgcgga

SEQ ID NO: 425483 - DNA, 25 bp, Rattus norvegicus
ggagacacttggttccttctgcgga

SEQ ID NO: 425484 - DNA, 25 bp, Rattus norvegicus
ggagacagaaaccactactcaccaa

SEQ ID NO: 425485 - DNA, 25 bp, Rattus norvegicus
ggagacagaaacgactactcaccaa

SEQ ID NO: 425486 - DNA, 25 bp, Rattus norvegicus
ggagacagacacattcggcagcaga

SEQ ID NO: 425487 - DNA, 25 bp, Rattus norvegicus
ggagacagacactttcggcagcaga

SEQ ID NO: 425488 - DNA, 25 bp, Rattus norvegicus
ggagacagacatattcatattgatc

SEQ ID NO: 425489 - DNA, 25 bp, Rattus norvegicus
ggagacagacattttcatattgatc

SEQ ID NO: 425490 - DNA, 25 bp, Rattus norvegicus
ggagacagacttacaatgggaactt

SEQ ID NO: 425491 - DNA, 25 bp, Rattus norvegicus
ggagacagactttcaatgggaactt

SEQ ID NO: 425492 - DNA, 25 bp, Rattus norvegicus
ggagacagagccatcattgacagtt

SEQ ID NO: 425493 - DNA, 25 bp, Rattus norvegicus
ggagacagagccttcattgacagtt

SEQ ID NO: 425494 - DNA, 25 bp, Rattus norvegicus
ggagacagatatcagccttcaccct

SEQ ID NO: 425495 - DNA, 25 bp, Rattus norvegicus
ggagacagatatgagccttcaccct

SEQ ID NO: 425496 - DNA, 25 bp, Rattus norvegicus
ggagacagcaccaggctttatgtaa

SEQ ID NO: 425497 - DNA, 25 bp, Rattus norvegicus
ggagacagcacctggctttatgtaa

SEQ ID NO: 425498 - DNA, 25 bp, Rattus norvegicus
ggagacagcctgagacagatccagt

SEQ ID NO: 425499 - DNA, 25 bp, Rattus norvegicus
ggagacagcctgtgacagatccagt

SEQ ID NO: 425500 - DNA, 25 bp, Rattus norvegicus
ggagacaggacaacgtttgcctaat

SEQ ID NO: 425501 - DNA, 25 bp, Rattus norvegicus
ggagacaggacatcgtttgcctaat

SEQ ID NO: 425502 - DNA, 25 bp, Rattus norvegicus
ggagacaggcaaaaccagtgcccgc

SEQ ID NO: 425503 - DNA, 25 bp, Rattus norvegicus
ggagacaggcaataccagtgcccgc

SEQ ID NO: 425504 - DNA, 25 bp, Rattus norvegicus
ggagacaggctaccatcgattttgt

SEQ ID NO: 425505 - DNA, 25 bp, Rattus norvegicus
ggagacaggctagcatcgattttgt

SEQ ID NO: 425506 - DNA, 25 bp, Rattus norvegicus
ggagacaggcttaccaggtgccttg

SEQ ID NO: 425507 - DNA, 25 bp, Rattus norvegicus
ggagacaggctttccaggtgccttg

SEQ ID NO: 425508 - DNA, 25 bp, Rattus norvegicus
ggagacatagcacctgggcttttct

SEQ ID NO: 425509 - DNA, 25 bp, Rattus norvegicus
ggagacatagcagctgggcttttct

SEQ ID NO: 425510 - DNA, 25 bp, Rattus norvegicus
ggagacatatgcactaggaccacaa

SEQ ID NO: 425511 - DNA, 25 bp, Rattus norvegicus
ggagacatatgctctaggaccacaa

SEQ ID NO: 425512 - DNA, 25 bp, Rattus norvegicus
ggagacatatgtccgccagatgtgc

SEQ ID NO: 425513 - DNA, 25 bp, Rattus norvegicus
ggagacatatgtgcgccagatgtgc

SEQ ID NO: 425514 - DNA, 25 bp, Rattus norvegicus
ggagacatcaagatctggcactaac

SEQ ID NO: 425515 - DNA, 25 bp, Rattus norvegicus
ggagacatcaagttctggcactaac

SEQ ID NO: 425516 - DNA, 25 bp, Rattus norvegicus
ggagacatcactaccacagaaacgt

SEQ ID NO: 425517 - DNA, 25 bp, Rattus norvegicus
ggagacatcacttccacagaaacgt

SEQ ID NO: 425518 - DNA, 25 bp, Rattus norvegicus
ggagacatcagaatccttccattcc

SEQ ID NO: 425519 - DNA, 25 bp, Rattus norvegicus
ggagacatcagattccttccattcc

SEQ ID NO: 425520 - DNA, 25 bp, Rattus norvegicus
ggagacatcccaatcccataaggaa

SEQ ID NO: 425521 - DNA, 25 bp, Rattus norvegicus
ggagacatcccattcccataaggaa

SEQ ID NO: 425522 - DNA, 25 bp, Rattus norvegicus
ggagacatcctgagtatgccccgga

SEQ ID NO: 425523 - DNA, 25 bp, Rattus norvegicus
ggagacatcctgtgtatgccccgga

SEQ ID NO: 425524 - DNA, 25 bp, Rattus norvegicus
ggagacatcgcaatcaaaccagtac

SEQ ID NO: 425525 - DNA, 25 bp, Rattus norvegicus
ggagacatcgcattcaaaccagtac

SEQ ID NO: 425526 - DNA, 25 bp, Rattus norvegicus
ggagacatctcgctggacaaaccca

SEQ ID NO: 425527 - DNA, 25 bp, Rattus norvegicus
ggagacatctcggtggacaaaccca

SEQ ID NO: 425528 - DNA, 25 bp, Rattus norvegicus
ggagacatgccgcaatccaaactaa

SEQ ID NO: 425529 - DNA, 25 bp, Rattus norvegicus
ggagacatgccggaatccaaactaa

SEQ ID NO: 425530 - DNA, 25 bp, Rattus norvegicus
ggagacatgcttattatactgttat

SEQ ID NO: 425531 - DNA, 25 bp, Rattus norvegicus
ggagacatgctttttatactgttat

SEQ ID NO: 425532 - DNA, 25 bp, Rattus norvegicus
ggagacatgggcagacctcgtacat

SEQ ID NO: 425533 - DNA, 25 bp, Rattus norvegicus
ggagacatgggctgacctcgtacat

SEQ ID NO: 425534 - DNA, 25 bp, Rattus norvegicus
ggagacatggtgcatccctttcaca

SEQ ID NO: 425535 - DNA, 25 bp, Rattus norvegicus
ggagacatggtggatccctttcaca

SEQ ID NO: 425536 - DNA, 25 bp, Rattus norvegicus
ggagacatggttccaactaccattg

SEQ ID NO: 425537 - DNA, 25 bp, Rattus norvegicus
ggagacatggttgcaactaccattg

SEQ ID NO: 425538 - DNA, 25 bp, Rattus norvegicus
ggagacattcgaacagacatgctga

SEQ ID NO: 425539 - DNA, 25 bp, Rattus norvegicus
ggagacattcgacgttatcactgat

SEQ ID NO: 425540 - DNA, 25 bp, Rattus norvegicus
ggagacattcgaggttatcactgat

SEQ ID NO: 425541 - DNA, 25 bp, Rattus norvegicus
ggagacattcgatcagacatgctga

SEQ ID NO: 425542 - DNA, 25 bp, Rattus norvegicus
ggagacattgctacccagaacatga

SEQ ID NO: 425543 - DNA, 25 bp, Rattus norvegicus
ggagacattgcttcccagaacatga

SEQ ID NO: 425544 - DNA, 25 bp, Rattus norvegicus
ggagacattggaagcccttgggccc

SEQ ID NO: 425545 - DNA, 25 bp, Rattus norvegicus
ggagacattggaatcctcagtgaga

SEQ ID NO: 425546 - DNA, 25 bp, Rattus norvegicus
ggagacattggatgcccttgggccc

SEQ ID NO: 425547 - DNA, 25 bp, Rattus norvegicus
ggagacattggattcctcagtgaga

SEQ ID NO: 425548 - DNA, 25 bp, Rattus norvegicus
ggagacattgtcaggcctctactgc

SEQ ID NO: 425549 - DNA, 25 bp, Rattus norvegicus
ggagacattgtctggcctctactgc

SEQ ID NO: 425550 - DNA, 25 bp, Rattus norvegicus
ggagacatttacattaggcttcaga

SEQ ID NO: 425551 - DNA, 25 bp, Rattus norvegicus
ggagacatttactttaggcttcaga

SEQ ID NO: 425552 - DNA, 25 bp, Rattus norvegicus
ggagacatttatacctgctctgtgg

SEQ ID NO: 425553 - DNA, 25 bp, Rattus norvegicus
ggagacatttattcctgctctgtgg

SEQ ID NO: 425554 - DNA, 25 bp, Rattus norvegicus
ggagacattttaatgcctagaagtt

SEQ ID NO: 425555 - DNA, 25 bp, Rattus norvegicus
ggagacattttattgcctagaagtt

SEQ ID NO: 425556 - DNA, 25 bp, Rattus norvegicus
ggagaccaactcattcccagaactg

SEQ ID NO: 425557 - DNA, 25 bp, Rattus norvegicus
ggagaccaactctttcccagaactg

SEQ ID NO: 425558 - DNA, 25 bp, Rattus norvegicus
ggagaccaaggcacgttatgccagc

SEQ ID NO: 425559 - DNA, 25 bp, Rattus norvegicus
ggagaccaaggctcgttatgccagc

SEQ ID NO: 425560 - DNA, 25 bp, Rattus norvegicus
ggagaccagaatattctcaccagaa

SEQ ID NO: 425561 - DNA, 25 bp, Rattus norvegicus
ggagaccagaattttctcaccagaa

SEQ ID NO: 425562 - DNA, 25 bp, Rattus norvegicus
ggagaccagcccaccggacctatct

SEQ ID NO: 425563 - DNA, 25 bp, Rattus norvegicus
ggagaccagccctccggacctatct

SEQ ID NO: 425564 - DNA, 25 bp, Rattus norvegicus
ggagaccagcgaaggcgttcatcga

SEQ ID NO: 425565 - DNA, 25 bp, Rattus norvegicus
ggagaccagcgatggcgttcatcga

SEQ ID NO: 425566 - DNA, 25 bp, Rattus norvegicus
ggagaccaggagaccagggcaaatt

SEQ ID NO: 425567 - DNA, 25 bp, Rattus norvegicus
ggagaccaggagtccagggcaaatt

SEQ ID NO: 425568 - DNA, 25 bp, Rattus norvegicus
ggagaccagggcagcttactgtcag

SEQ ID NO: 425569 - DNA, 25 bp, Rattus norvegicus
ggagaccagggctgcttactgtcag

SEQ ID NO: 425570 - DNA, 25 bp, Rattus norvegicus
ggagaccaggtcatgcaattttgtg

SEQ ID NO: 425571 - DNA, 25 bp, Rattus norvegicus
ggagaccaggtcttgcaattttgtg

SEQ ID NO: 425572 - DNA, 25 bp, Rattus norvegicus
ggagaccaggtgagttgcaccccta

SEQ ID NO: 425573 - DNA, 25 bp, Rattus norvegicus
ggagaccaggtgtgttgcaccccta

SEQ ID NO: 425574 - DNA, 25 bp, Rattus norvegicus
ggagaccagtgaatgctgctcgtat

SEQ ID NO: 425575 - DNA, 25 bp, Rattus norvegicus
ggagaccagtgattgctgctcgtat

SEQ ID NO: 425576 - DNA, 25 bp, Rattus norvegicus
ggagaccatcaacgccttcaaagac

SEQ ID NO: 425577 - DNA, 25 bp, Rattus norvegicus
ggagaccatcaaggccttcaaagac

SEQ ID NO: 425578 - DNA, 25 bp, Rattus norvegicus
ggagaccatcagcaacagcacatct

SEQ ID NO: 425579 - DNA, 25 bp, Rattus norvegicus
ggagaccatcaggaacagcacatct

SEQ ID NO: 425580 - DNA, 25 bp, Rattus norvegicus
ggagaccatcgcctatcctagggtc

SEQ ID NO: 425581 - DNA, 25 bp, Rattus norvegicus
ggagaccatcgcgtatcctagggtc

SEQ ID NO: 425582 - DNA, 25 bp, Rattus norvegicus
ggagaccatgagacctttttaggaa

SEQ ID NO: 425583 - DNA, 25 bp, Rattus norvegicus
ggagaccatgagtcctttttaggaa

SEQ ID NO: 425584 - DNA, 25 bp, Rattus norvegicus
ggagaccatgtgactctctctccca

SEQ ID NO: 425585 - DNA, 25 bp, Rattus norvegicus
ggagaccatgtgtctctctctccca

SEQ ID NO: 425586 - DNA, 25 bp, Rattus norvegicus
ggagaccattgccaagtgcatcgga

SEQ ID NO: 425587 - DNA, 25 bp, Rattus norvegicus
ggagaccattgcgaagtgcatcgga

SEQ ID NO: 425588 - DNA, 25 bp, Rattus norvegicus
ggagacccaaccaacctggtcaatg

SEQ ID NO: 425589 - DNA, 25 bp, Rattus norvegicus
ggagacccaacctacctggtcaatg

SEQ ID NO: 425590 - DNA, 25 bp, Rattus norvegicus
ggagacccacgaatgctctttaaat

SEQ ID NO: 425591 - DNA, 25 bp, Rattus norvegicus
ggagacccacgattgctctttaaat

SEQ ID NO: 425592 - DNA, 25 bp, Rattus norvegicus
ggagacccagaacttccacgtacct

SEQ ID NO: 425593 - DNA, 25 bp, Rattus norvegicus
ggagacccagaagttccacgtacct

SEQ ID NO: 425594 - DNA, 25 bp, Rattus norvegicus
ggagacccagagacttctacaaggt

SEQ ID NO: 425595 - DNA, 25 bp, Rattus norvegicus
ggagacccagagtcttctacaaggt

SEQ ID NO: 425596 - DNA, 25 bp, Rattus norvegicus
ggagacccagccatctatgctgaaa

SEQ ID NO: 425597 - DNA, 25 bp, Rattus norvegicus
ggagacccagccttctatgctgaaa

SEQ ID NO: 425598 - DNA, 25 bp, Rattus norvegicus
ggagacccagcgcactacattcagg

SEQ ID NO: 425599 - DNA, 25 bp, Rattus norvegicus
ggagacccagcggactacattcagg

SEQ ID NO: 425600 - DNA, 25 bp, Rattus norvegicus
ggagacccaggcaacagacaggaat

SEQ ID NO: 425601 - DNA, 25 bp, Rattus norvegicus
ggagacccaggctacagacaggaat

SEQ ID NO: 425602 - DNA, 25 bp, Rattus norvegicus
ggagacccaggtactaaatcaaaca

SEQ ID NO: 425603 - DNA, 25 bp, Rattus norvegicus
ggagacccaggttctaaatcaaaca

SEQ ID NO: 425604 - DNA, 25 bp, Rattus norvegicus
ggagaccccaaacttcctactgaag

SEQ ID NO: 425605 - DNA, 25 bp, Rattus norvegicus
ggagaccccaaagttcctactgaag

SEQ ID NO: 425606 - DNA, 25 bp, Rattus norvegicus
ggagaccccacaagtgtctagctaa

SEQ ID NO: 425607 - DNA, 25 bp, Rattus norvegicus
ggagaccccacatgtgtctagctaa

SEQ ID NO: 425608 - DNA, 25 bp, Rattus norvegicus
ggagacccctttaggctcagggttg

SEQ ID NO: 425609 - DNA, 25 bp, Rattus norvegicus
ggagaccccttttggctcagggttg

SEQ ID NO: 425610 - DNA, 25 bp, Rattus norvegicus
ggagacccgcgtcagacagtgaaca

SEQ ID NO: 425611 - DNA, 25 bp, Rattus norvegicus
ggagacccgcgtgagacagtgaaca

SEQ ID NO: 425612 - DNA, 25 bp, Rattus norvegicus
ggagacccggagagttgtcctgctt

SEQ ID NO: 425613 - DNA, 25 bp, Rattus norvegicus
ggagacccggagtgttgtcctgctt

SEQ ID NO: 425614 - DNA, 25 bp, Rattus norvegicus
ggagaccctagcatatggaaggtac

SEQ ID NO: 425615 - DNA, 25 bp, Rattus norvegicus
ggagaccctagcttatggaaggtac

SEQ ID NO: 425616 - DNA, 25 bp, Rattus norvegicus
ggagaccctcaacataccaagaagt

SEQ ID NO: 425617 - DNA, 25 bp, Rattus norvegicus
ggagaccctcaagataccaagaagt

SEQ ID NO: 425618 - DNA, 25 bp, Rattus norvegicus
ggagaccctgaacgttctagaggca

SEQ ID NO: 425619 - DNA, 25 bp, Rattus norvegicus
ggagaccctgaaggttctagaggca

SEQ ID NO: 425620 - DNA, 25 bp, Rattus norvegicus
ggagaccctgttcgtattacggtat

SEQ ID NO: 425621 - DNA, 25 bp, Rattus norvegicus
ggagaccctgttggtattacggtat

SEQ ID NO: 425622 - DNA, 25 bp, Rattus norvegicus
ggagacccttcgagaaatcgcgtct

SEQ ID NO: 425623 - DNA, 25 bp, Rattus norvegicus
ggagacccttcgtgaaatcgcgtct

SEQ ID NO: 425624 - DNA, 25 bp, Rattus norvegicus
ggagaccgaactcactgtatgcatt

SEQ ID NO: 425625 - DNA, 25 bp, Rattus norvegicus
ggagaccgaactgactgtatgcatt

SEQ ID NO: 425626 - DNA, 25 bp, Rattus norvegicus
ggagaccgagtgagaccctgacatt

SEQ ID NO: 425627 - DNA, 25 bp, Rattus norvegicus
ggagaccgagtgtgaccctgacatt

SEQ ID NO: 425628 - DNA, 25 bp, Rattus norvegicus
ggagaccgatgcaaaaccctgctag

SEQ ID NO: 425629 - DNA, 25 bp, Rattus norvegicus
ggagaccgatgctaaaccctgctag

SEQ ID NO: 425630 - DNA, 25 bp, Rattus norvegicus
ggagaccgctgcatctgaacctgcc

SEQ ID NO: 425631 - DNA, 25 bp, Rattus norvegicus
ggagaccgctgcttctgaacctgcc

SEQ ID NO: 425632 - DNA, 25 bp, Rattus norvegicus
ggagaccgctgtctttgcactttac

SEQ ID NO: 425633 - DNA, 25 bp, Rattus norvegicus
ggagaccgctgtgtttgcactttac

SEQ ID NO: 425634 - DNA, 25 bp, Rattus norvegicus
ggagaccggcttcttgatttagata

SEQ ID NO: 425635 - DNA, 25 bp, Rattus norvegicus
ggagaccggcttgttgatttagata

SEQ ID NO: 425636 - DNA, 25 bp, Rattus norvegicus
ggagaccgggctcaatctgtgcaat

SEQ ID NO: 425637 - DNA, 25 bp, Rattus norvegicus
ggagaccgggctgaatctgtgcaat

SEQ ID NO: 425638 - DNA, 25 bp, Rattus norvegicus
ggagaccgtataatgcctgagtaag

SEQ ID NO: 425639 - DNA, 25 bp, Rattus norvegicus
ggagaccgtatattgcctgagtaag

SEQ ID NO: 425640 - DNA, 25 bp, Rattus norvegicus
ggagacctagatacatctgcgcaca

SEQ ID NO: 425641 - DNA, 25 bp, Rattus norvegicus
ggagacctagattcatctgcgcaca

SEQ ID NO: 425642 - DNA, 25 bp, Rattus norvegicus
ggagacctatctcatcctgaaggat

SEQ ID NO: 425643 - DNA, 25 bp, Rattus norvegicus
ggagacctatctgatcctgaaggat

SEQ ID NO: 425644 - DNA, 25 bp, Rattus norvegicus
ggagacctcagcatctttcaccaca

SEQ ID NO: 425645 - DNA, 25 bp, Rattus norvegicus
ggagacctcagcttctttcaccaca

SEQ ID NO: 425646 - DNA, 25 bp, Rattus norvegicus
ggagacctcaggagatcagacacta

SEQ ID NO: 425647 - DNA, 25 bp, Rattus norvegicus
ggagacctcaggtgatcagacacta

SEQ ID NO: 425648 - DNA, 25 bp, Rattus norvegicus
ggagacctcataatgtgtagcccag

SEQ ID NO: 425649 - DNA, 25 bp, Rattus norvegicus
ggagacctcatattgtgtagcccag

SEQ ID NO: 425650 - DNA, 25 bp, Rattus norvegicus
ggagacctccaaacctaggtagcca

SEQ ID NO: 425651 - DNA, 25 bp, Rattus norvegicus
ggagacctccaatcctaggtagcca

SEQ ID NO: 425652 - DNA, 25 bp, Rattus norvegicus
ggagacctccacaaaacagttttat

SEQ ID NO: 425653 - DNA, 25 bp, Rattus norvegicus
ggagacctccactaaacagttttat

SEQ ID NO: 425654 - DNA, 25 bp, Rattus norvegicus
ggagacctccatatcatcgttgttc

SEQ ID NO: 425655 - DNA, 25 bp, Rattus norvegicus
ggagacctccatttcatcgttgttc

SEQ ID NO: 425656 - DNA, 25 bp, Rattus norvegicus
ggagacctcggccaagatgaactac

SEQ ID NO: 425657 - DNA, 25 bp, Rattus norvegicus
ggagacctcggcgaagatgaactac

SEQ ID NO: 425658 - DNA, 25 bp, Rattus norvegicus
ggagacctctgcactgaatttccta

SEQ ID NO: 425659 - DNA, 25 bp, Rattus norvegicus
ggagacctctgctctgaatttccta

SEQ ID NO: 425660 - DNA, 25 bp, Rattus norvegicus
ggagacctcttcaatggtcgctatc

SEQ ID NO: 425661 - DNA, 25 bp, Rattus norvegicus
ggagacctcttctatggtcgctatc

SEQ ID NO: 425662 - DNA, 25 bp, Rattus norvegicus
ggagacctgacacgttgtccagtca

SEQ ID NO: 425663 - DNA, 25 bp, Rattus norvegicus
ggagacctgacaggttgtccagtca

SEQ ID NO: 425664 - DNA, 25 bp, Rattus norvegicus
ggagacctgagccactcgccgcaga

SEQ ID NO: 425665 - DNA, 25 bp, Rattus norvegicus
ggagacctgagcgactcgccgcaga

SEQ ID NO: 425666 - DNA, 25 bp, Rattus norvegicus
ggagacctgctgaacagtagctttt

SEQ ID NO: 425667 - DNA, 25 bp, Rattus norvegicus
ggagacctgctgtacagtagctttt

SEQ ID NO: 425668 - DNA, 25 bp, Rattus norvegicus
ggagacctggagcttctagagaaca

SEQ ID NO: 425669 - DNA, 25 bp, Rattus norvegicus
ggagacctggaggttctagagaaca

SEQ ID NO: 425670 - DNA, 25 bp, Rattus norvegicus
ggagacctggcaacttaggcttgaa

SEQ ID NO: 425671 - DNA, 25 bp, Rattus norvegicus
ggagacctggcatcttaggcttgaa

SEQ ID NO: 425672 - DNA, 25 bp, Rattus norvegicus
ggagacctgtccaggaacccaggca

SEQ ID NO: 425673 - DNA, 25 bp, Rattus norvegicus
ggagacctgtcctggaacccaggca

SEQ ID NO: 425674 - DNA, 25 bp, Rattus norvegicus
ggagacctgtgcctgatttcattag

SEQ ID NO: 425675 - DNA, 25 bp, Rattus norvegicus
ggagacctgtgcgtgatttcattag

SEQ ID NO: 425676 - DNA, 25 bp, Rattus norvegicus
ggagaccttgaaccaggaataccca

SEQ ID NO: 425677 - DNA, 25 bp, Rattus norvegicus
ggagaccttgaagcaggaataccca

SEQ ID NO: 425678 - DNA, 25 bp, Rattus norvegicus
ggagaccttgatcgtcccgttcaga

SEQ ID NO: 425679 - DNA, 25 bp, Rattus norvegicus
ggagaccttgatggtcccgttcaga

SEQ ID NO: 425680 - DNA, 25 bp, Rattus norvegicus
ggagaccttgttacacactccacag

SEQ ID NO: 425681 - DNA, 25 bp, Rattus norvegicus
ggagaccttgtttcacactccacag

SEQ ID NO: 425682 - DNA, 25 bp, Rattus norvegicus
ggagacctttccatgcttccgagtg

SEQ ID NO: 425683 - DNA, 25 bp, Rattus norvegicus
ggagacctttccttgcttccgagtg

SEQ ID NO: 425684 - DNA, 25 bp, Rattus norvegicus
ggagacgaaatcaactctgtctttg

SEQ ID NO: 425685 - DNA, 25 bp, Rattus norvegicus
ggagacgaaatctactctgtctttg

SEQ ID NO: 425686 - DNA, 25 bp, Rattus norvegicus
ggagacgaaccgcattgataatcat

SEQ ID NO: 425687 - DNA, 25 bp, Rattus norvegicus
ggagacgaaccggattgataatcat

SEQ ID NO: 425688 - DNA, 25 bp, Rattus norvegicus
ggagacgaacctctggcaacgtttc

SEQ ID NO: 425689 - DNA, 25 bp, Rattus norvegicus
ggagacgaacctgtggcaacgtttc

SEQ ID NO: 425690 - DNA, 25 bp, Rattus norvegicus
ggagacgaactccagagctcgactt

SEQ ID NO: 425691 - DNA, 25 bp, Rattus norvegicus
ggagacgaactcgagagctcgactt

SEQ ID NO: 425692 - DNA, 25 bp, Rattus norvegicus
ggagacgacgacaacatcgagcaga

SEQ ID NO: 425693 - DNA, 25 bp, Rattus norvegicus
ggagacgacgactacatcgagcaga

SEQ ID NO: 425694 - DNA, 25 bp, Rattus norvegicus
ggagacgagttcaaggcctatctgg

SEQ ID NO: 425695 - DNA, 25 bp, Rattus norvegicus
ggagacgagttctaggcctatctgg

SEQ ID NO: 425696 - DNA, 25 bp, Rattus norvegicus
ggagacgatggcatctctgtcgcct

SEQ ID NO: 425697 - DNA, 25 bp, Rattus norvegicus
ggagacgatggcttctctgtcgcct

SEQ ID NO: 425698 - DNA, 25 bp, Rattus norvegicus
ggagacgcacaccaacaccaggtgt

SEQ ID NO: 425699 - DNA, 25 bp, Rattus norvegicus
ggagacgcacacgaacaccaggtgt

SEQ ID NO: 425700 - DNA, 25 bp, Rattus norvegicus
ggagacgcacagcaacgcatccgtt

SEQ ID NO: 425701 - DNA, 25 bp, Rattus norvegicus
ggagacgcacaggaacgcatccgtt

SEQ ID NO: 425702 - DNA, 25 bp, Rattus norvegicus
ggagacgcacccagctctgctgaga

SEQ ID NO: 425703 - DNA, 25 bp, Rattus norvegicus
ggagacgcaccctgctctgctgaga

SEQ ID NO: 425704 - DNA, 25 bp, Rattus norvegicus
ggagacgcagcaccaaatcagccat

SEQ ID NO: 425705 - DNA, 25 bp, Rattus norvegicus
ggagacgcagcagcaaatcagccat

SEQ ID NO: 425706 - DNA, 25 bp, Rattus norvegicus
ggagacgcatgaaatggccaataat

SEQ ID NO: 425707 - DNA, 25 bp, Rattus norvegicus
ggagacgcatgaccagcaccaggca

SEQ ID NO: 425708 - DNA, 25 bp, Rattus norvegicus
ggagacgcatgagcagcaccaggca

SEQ ID NO: 425709 - DNA, 25 bp, Rattus norvegicus
ggagacgcatgatatggccaataat

SEQ ID NO: 425710 - DNA, 25 bp, Rattus norvegicus
ggagacgcattaccatactgtgtaa

SEQ ID NO: 425711 - DNA, 25 bp, Rattus norvegicus
ggagacgcattagcatactgtgtaa

SEQ ID NO: 425712 - DNA, 25 bp, Rattus norvegicus
ggagacgctctcaatagatgccaga

SEQ ID NO: 425713 - DNA, 25 bp, Rattus norvegicus
ggagacgctctctatagatgccaga

SEQ ID NO: 425714 - DNA, 25 bp, Rattus norvegicus
ggagacgctgcaccttggcaaagcc

SEQ ID NO: 425715 - DNA, 25 bp, Rattus norvegicus
ggagacgctgcagcttggcaaagcc

SEQ ID NO: 425716 - DNA, 25 bp, Rattus norvegicus
ggagacggaaacatattccctacag

SEQ ID NO: 425717 - DNA, 25 bp, Rattus norvegicus
ggagacggaaacttattccctacag

SEQ ID NO: 425718 - DNA, 25 bp, Rattus norvegicus
ggagacggaggacccgcgatccccg

SEQ ID NO: 425719 - DNA, 25 bp, Rattus norvegicus
ggagacggaggagccgcgatccccg

SEQ ID NO: 425720 - DNA, 25 bp, Rattus norvegicus
ggagacggatgtccagaccctgttc

SEQ ID NO: 425721 - DNA, 25 bp, Rattus norvegicus
ggagacggatgtgcagaccctgttc

SEQ ID NO: 425722 - DNA, 25 bp, Rattus norvegicus
ggagacggtctgagcgcttgtatca

SEQ ID NO: 425723 - DNA, 25 bp, Rattus norvegicus
ggagacggtctgtgcgcttgtatca

SEQ ID NO: 425724 - DNA, 25 bp, Rattus norvegicus
ggagacggtgttctgaaattttcat

SEQ ID NO: 425725 - DNA, 25 bp, Rattus norvegicus
ggagacggtgttgtgaaattttcat

SEQ ID NO: 425726 - DNA, 25 bp, Rattus norvegicus
ggagacggttataccgcgtgcgtaa

SEQ ID NO: 425727 - DNA, 25 bp, Rattus norvegicus
ggagacggttattccgcgtgcgtaa

SEQ ID NO: 425728 - DNA, 25 bp, Rattus norvegicus
ggagacgtcaatcatctgcatagtt

SEQ ID NO: 425729 - DNA, 25 bp, Rattus norvegicus
ggagacgtcaatgatctgcatagtt

SEQ ID NO: 425730 - DNA, 25 bp, Rattus norvegicus
ggagacgtcagaaaatgtcacacca

SEQ ID NO: 425731 - DNA, 25 bp, Rattus norvegicus
ggagacgtcagataatgtcacacca

SEQ ID NO: 425732 - DNA, 25 bp, Rattus norvegicus
ggagacgtcattacaacacatctga

SEQ ID NO: 425733 - DNA, 25 bp, Rattus norvegicus
ggagacgtcatttcaacacatctga

SEQ ID NO: 425734 - DNA, 25 bp, Rattus norvegicus
ggagacgtgataacactgcctcttg

SEQ ID NO: 425735 - DNA, 25 bp, Rattus norvegicus
ggagacgtgatatcactgcctcttg

SEQ ID NO: 425736 - DNA, 25 bp, Rattus norvegicus
ggagactaatcaccccttacaagaa

SEQ ID NO: 425737 - DNA, 25 bp, Rattus norvegicus
ggagactaatcagcccttacaagaa

SEQ ID NO: 425738 - DNA, 25 bp, Rattus norvegicus
ggagactactctatgcgtgtggacc

SEQ ID NO: 425739 - DNA, 25 bp, Rattus norvegicus
ggagactactctttgcgtgtggacc

SEQ ID NO: 425740 - DNA, 25 bp, Rattus norvegicus
ggagactagtccacaggtgttactt

SEQ ID NO: 425741 - DNA, 25 bp, Rattus norvegicus
ggagactagtcctcaggtgttactt

SEQ ID NO: 425742 - DNA, 25 bp, Rattus norvegicus
ggagactagtctctatcacctgtac

SEQ ID NO: 425743 - DNA, 25 bp, Rattus norvegicus
ggagactagtctgtatcacctgtac

SEQ ID NO: 425744 - DNA, 25 bp, Rattus norvegicus
ggagactagtggagcgatcccagct

SEQ ID NO: 425745 - DNA, 25 bp, Rattus norvegicus
ggagactagtggtgcgatcccagct

SEQ ID NO: 425746 - DNA, 25 bp, Rattus norvegicus
ggagactatataaagcttgcctatg

SEQ ID NO: 425747 - DNA, 25 bp, Rattus norvegicus
ggagactatatatagcttgcctatg

SEQ ID NO: 425748 - DNA, 25 bp, Rattus norvegicus
ggagactatttacctccaggtctgg

SEQ ID NO: 425749 - DNA, 25 bp, Rattus norvegicus
ggagactatttagctccaggtctgg

SEQ ID NO: 425750 - DNA, 25 bp, Rattus norvegicus
ggagactcaacgatcccgaggcttc

SEQ ID NO: 425751 - DNA, 25 bp, Rattus norvegicus
ggagactcaacgttcccgaggcttc

SEQ ID NO: 425752 - DNA, 25 bp, Rattus norvegicus
ggagactcaagcatctgggtactta

SEQ ID NO: 425753 - DNA, 25 bp, Rattus norvegicus
ggagactcaagcctgcctagaagtt

SEQ ID NO: 425754 - DNA, 25 bp, Rattus norvegicus
ggagactcaagcgtgcctagaagtt

SEQ ID NO: 425755 - DNA, 25 bp, Rattus norvegicus
ggagactcaagcttctgggtactta

SEQ ID NO: 425756 - DNA, 25 bp, Rattus norvegicus
ggagactcactaactggcttttgga

SEQ ID NO: 425757 - DNA, 25 bp, Rattus norvegicus
ggagactcactatctggcttttgga

SEQ ID NO: 425758 - DNA, 25 bp, Rattus norvegicus
ggagactcatctacctgcacactaa

SEQ ID NO: 425759 - DNA, 25 bp, Rattus norvegicus
ggagactcatcttcctgcacactaa

SEQ ID NO: 425760 - DNA, 25 bp, Rattus norvegicus
ggagactccaaaccccaagtgtaca

SEQ ID NO: 425761 - DNA, 25 bp, Rattus norvegicus
ggagactccaaagcccaagtgtaca

SEQ ID NO: 425762 - DNA, 25 bp, Rattus norvegicus
ggagactccatcataacagtgtaat

SEQ ID NO: 425763 - DNA, 25 bp, Rattus norvegicus
ggagactccatcttaacagtgtaat

SEQ ID NO: 425764 - DNA, 25 bp, Rattus norvegicus
ggagactcccggcaatgtttcacct

SEQ ID NO: 425765 - DNA, 25 bp, Rattus norvegicus
ggagactcccgggaatgtttcacct

SEQ ID NO: 425766 - DNA, 25 bp, Rattus norvegicus
ggagactccctgacaaagcacaaca

SEQ ID NO: 425767 - DNA, 25 bp, Rattus norvegicus
ggagactccctgtcaaagcacaaca

SEQ ID NO: 425768 - DNA, 25 bp, Rattus norvegicus
ggagactcccttctcacggcaagat

SEQ ID NO: 425769 - DNA, 25 bp, Rattus norvegicus
ggagactcccttgtcacggcaagat

SEQ ID NO: 425770 - DNA, 25 bp, Rattus norvegicus
ggagactcctctatacagccctggt

SEQ ID NO: 425771 - DNA, 25 bp, Rattus norvegicus
ggagactcctctctcatgtgtaaac

SEQ ID NO: 425772 - DNA, 25 bp, Rattus norvegicus
ggagactcctctgtcatgtgtaaac

SEQ ID NO: 425773 - DNA, 25 bp, Rattus norvegicus
ggagactcctctttacagccctggt

SEQ ID NO: 425774 - DNA, 25 bp, Rattus norvegicus
ggagactcctgccattgactgtgag

SEQ ID NO: 425775 - DNA, 25 bp, Rattus norvegicus
ggagactcctgcgattgactgtgag

SEQ ID NO: 425776 - DNA, 25 bp, Rattus norvegicus
ggagactcggaacggacccctgaat

SEQ ID NO: 425777 - DNA, 25 bp, Rattus norvegicus
ggagactcggaagggacccctgaat

SEQ ID NO: 425778 - DNA, 25 bp, Rattus norvegicus
ggagactcggtaattgttccaaagt

SEQ ID NO: 425779 - DNA, 25 bp, Rattus norvegicus
ggagactcggtatttgttccaaagt

SEQ ID NO: 425780 - DNA, 25 bp, Rattus norvegicus
ggagactcgtccatagaccaactaa

SEQ ID NO: 425781 - DNA, 25 bp, Rattus norvegicus
ggagactcgtccttagaccaactaa

SEQ ID NO: 425782 - DNA, 25 bp, Rattus norvegicus
ggagactcgtctactacaagtgact

SEQ ID NO: 425783 - DNA, 25 bp, Rattus norvegicus
ggagactcgtcttctacaagtgact

SEQ ID NO: 425784 - DNA, 25 bp, Rattus norvegicus
ggagactctaccaatattcctgggc

SEQ ID NO: 425785 - DNA, 25 bp, Rattus norvegicus
ggagactctacctatattcctgggc

SEQ ID NO: 425786 - DNA, 25 bp, Rattus norvegicus
ggagactgaaacaggagatgacctt

SEQ ID NO: 425787 - DNA, 25 bp, Rattus norvegicus
ggagactgaaactggagatgacctt

SEQ ID NO: 425788 - DNA, 25 bp, Rattus norvegicus
ggagactgaagcagattcacctcaa

SEQ ID NO: 425789 - DNA, 25 bp, Rattus norvegicus
ggagactgaagcatccttcttcctt

SEQ ID NO: 425790 - DNA, 25 bp, Rattus norvegicus
ggagactgaagctgattcacctcaa

SEQ ID NO: 425791 - DNA, 25 bp, Rattus norvegicus
ggagactgaagcttccttcttcctt

SEQ ID NO: 425792 - DNA, 25 bp, Rattus norvegicus
ggagactgactcctacataccatac

SEQ ID NO: 425793 - DNA, 25 bp, Rattus norvegicus
ggagactgactcgtacataccatac

SEQ ID NO: 425794 - DNA, 25 bp, Rattus norvegicus
ggagactgactgaatagctactcta

SEQ ID NO: 425795 - DNA, 25 bp, Rattus norvegicus
ggagactgactgtatagctactcta

SEQ ID NO: 425796 - DNA, 25 bp, Rattus norvegicus
ggagactgacttcttcagatgctcg

SEQ ID NO: 425797 - DNA, 25 bp, Rattus norvegicus
ggagactgacttgttcagatgctcg

SEQ ID NO: 425798 - DNA, 25 bp, Rattus norvegicus
ggagactgattcctgcaacttgtca

SEQ ID NO: 425799 - DNA, 25 bp, Rattus norvegicus
ggagactgattcgtgcaacttgtca

SEQ ID NO: 425800 - DNA, 25 bp, Rattus norvegicus
ggagactgcagtcttatttcttcaa

SEQ ID NO: 425801 - DNA, 25 bp, Rattus norvegicus
ggagactgcagtgttatttcttcaa

SEQ ID NO: 425802 - DNA, 25 bp, Rattus norvegicus
ggagactgcgccagggatgctaacc

SEQ ID NO: 425803 - DNA, 25 bp, Rattus norvegicus
ggagactgcgcctgggatgctaacc

SEQ ID NO: 425804 - DNA, 25 bp, Rattus norvegicus
ggagactggaacacttcaccaagtt

SEQ ID NO: 425805 - DNA, 25 bp, Rattus norvegicus
ggagactggaactcttcaccaagtt

SEQ ID NO: 425806 - DNA, 25 bp, Rattus norvegicus
ggagactggaggacgtcagacactc

SEQ ID NO: 425807 - DNA, 25 bp, Rattus norvegicus
ggagactggaggtcgtcagacactc

SEQ ID NO: 425808 - DNA, 25 bp, Rattus norvegicus
ggagactggagtattgaacatcaag

SEQ ID NO: 425809 - DNA, 25 bp, Rattus norvegicus
ggagactggagttttgaacatcaag

SEQ ID NO: 425810 - DNA, 25 bp, Rattus norvegicus
ggagactggcccataatagacagaa

SEQ ID NO: 425811 - DNA, 25 bp, Rattus norvegicus
ggagactggcccttaatagacagaa

SEQ ID NO: 425812 - DNA, 25 bp, Rattus norvegicus
ggagactgggatccttacgtcacaa

SEQ ID NO: 425813 - DNA, 25 bp, Rattus norvegicus
ggagactgggatgcttacgtcacaa

SEQ ID NO: 425814 - DNA, 25 bp, Rattus norvegicus
ggagactggttcagcatggtgcttc

SEQ ID NO: 425815 - DNA, 25 bp, Rattus norvegicus
ggagactggttctgcatggtgcttc

SEQ ID NO: 425816 - DNA, 25 bp, Rattus norvegicus
ggagactgtaaaaccaccagcaatc

SEQ ID NO: 425817 - DNA, 25 bp, Rattus norvegicus
ggagactgtaaatccaccagcaatc

SEQ ID NO: 425818 - DNA, 25 bp, Rattus norvegicus
ggagactgtaccagaagccttgagt

SEQ ID NO: 425819 - DNA, 25 bp, Rattus norvegicus
ggagactgtacctgaagccttgagt

SEQ ID NO: 425820 - DNA, 25 bp, Rattus norvegicus
ggagactgtgaaactactggactac

SEQ ID NO: 425821 - DNA, 25 bp, Rattus norvegicus
ggagactgtgaatctactggactac

SEQ ID NO: 425822 - DNA, 25 bp, Rattus norvegicus
ggagactgtggcctttgcccagcta

SEQ ID NO: 425823 - DNA, 25 bp, Rattus norvegicus
ggagactgtggcgtttgcccagcta

SEQ ID NO: 425824 - DNA, 25 bp, Rattus norvegicus
ggagactgttaaaagctgggaagct

SEQ ID NO: 425825 - DNA, 25 bp, Rattus norvegicus
ggagactgttaatagctgggaagct

SEQ ID NO: 425826 - DNA, 25 bp, Rattus norvegicus
ggagactgttagcatgccaaccacg

SEQ ID NO: 425827 - DNA, 25 bp, Rattus norvegicus
ggagactgttaggatgccaaccacg

SEQ ID NO: 425828 - DNA, 25 bp, Rattus norvegicus
ggagacttaaaaagctcagccctct

SEQ ID NO: 425829 - DNA, 25 bp, Rattus norvegicus
ggagacttaaaatgctcagccctct

SEQ ID NO: 425830 - DNA, 25 bp, Rattus norvegicus
ggagacttacccactgacgatgaag

SEQ ID NO: 425831 - DNA, 25 bp, Rattus norvegicus
ggagacttaccctctgacgatgaag

SEQ ID NO: 425832 - DNA, 25 bp, Rattus norvegicus
ggagacttagctacttgtgtgccac

SEQ ID NO: 425833 - DNA, 25 bp, Rattus norvegicus
ggagacttagcttcttgtgtgccac

SEQ ID NO: 425834 - DNA, 25 bp, Rattus norvegicus
ggagacttcaggctcaattttcaaa

SEQ ID NO: 425835 - DNA, 25 bp, Rattus norvegicus
ggagacttcagggtcaattttcaaa

SEQ ID NO: 425836 - DNA, 25 bp, Rattus norvegicus
ggagacttcgtcctgaaccagtaac

SEQ ID NO: 425837 - DNA, 25 bp, Rattus norvegicus
ggagacttcgtcgtgaaccagtaac

SEQ ID NO: 425838 - DNA, 25 bp, Rattus norvegicus
ggagacttctctacatctctgaggg

SEQ ID NO: 425839 - DNA, 25 bp, Rattus norvegicus
ggagacttctctccacagaagcaat

SEQ ID NO: 425840 - DNA, 25 bp, Rattus norvegicus
ggagacttctctctggttgccatga

SEQ ID NO: 425841 - DNA, 25 bp, Rattus norvegicus
ggagacttctctgcacagaagcaat

SEQ ID NO: 425842 - DNA, 25 bp, Rattus norvegicus
ggagacttctctgtggttgccatga

SEQ ID NO: 425843 - DNA, 25 bp, Rattus norvegicus
ggagacttctcttcatctctgaggg

SEQ ID NO: 425844 - DNA, 25 bp, Rattus norvegicus
ggagacttctggattttccaaggca

SEQ ID NO: 425845 - DNA, 25 bp, Rattus norvegicus
ggagacttctggtttttccaaggca

SEQ ID NO: 425846 - DNA, 25 bp, Rattus norvegicus
ggagacttcttcaggtaacaccact

SEQ ID NO: 425847 - DNA, 25 bp, Rattus norvegicus
ggagacttcttctggtaacaccact

SEQ ID NO: 425848 - DNA, 25 bp, Rattus norvegicus
ggagacttgaacattcaggaccaga

SEQ ID NO: 425849 - DNA, 25 bp, Rattus norvegicus
ggagacttgaactttcaggaccaga

SEQ ID NO: 425850 - DNA, 25 bp, Rattus norvegicus
ggagacttgagacctcgctccccga

SEQ ID NO: 425851 - DNA, 25 bp, Rattus norvegicus
ggagacttgagagctcgctccccga

SEQ ID NO: 425852 - DNA, 25 bp, Rattus norvegicus
ggagacttgagcctgcccaggtaca

SEQ ID NO: 425853 - DNA, 25 bp, Rattus norvegicus
ggagacttgagcgtgcccaggtaca

SEQ ID NO: 425854 - DNA, 25 bp, Rattus norvegicus
ggagacttgagtctggatgccccat

SEQ ID NO: 425855 - DNA, 25 bp, Rattus norvegicus
ggagacttgagtgtggatgccccat

SEQ ID NO: 425856 - DNA, 25 bp, Rattus norvegicus
ggagactttaatccttcagattctt

SEQ ID NO: 425857 - DNA, 25 bp, Rattus norvegicus
ggagactttaatgcttcagattctt

SEQ ID NO: 425858 - DNA, 25 bp, Rattus norvegicus
ggagactttactactcaaccatgag

SEQ ID NO: 425859 - DNA, 25 bp, Rattus norvegicus
ggagactttactactgcgatatttt

SEQ ID NO: 425860 - DNA, 25 bp, Rattus norvegicus
ggagactttacttctcaaccatgag

SEQ ID NO: 425861 - DNA, 25 bp, Rattus norvegicus
ggagactttacttctgcgatatttt

SEQ ID NO: 425862 - DNA, 25 bp, Rattus norvegicus
ggagactttcaaagccatccacaaa

SEQ ID NO: 425863 - DNA, 25 bp, Rattus norvegicus
ggagactttcaatgccatccacaaa

SEQ ID NO: 425864 - DNA, 25 bp, Rattus norvegicus
ggagactttgccagatatcagctac

SEQ ID NO: 425865 - DNA, 25 bp, Rattus norvegicus
ggagactttgccaggtcattcctta

SEQ ID NO: 425866 - DNA, 25 bp, Rattus norvegicus
ggagactttgcctgatatcagctac

SEQ ID NO: 425867 - DNA, 25 bp, Rattus norvegicus
ggagactttgcctggtcattcctta

SEQ ID NO: 425868 - DNA, 25 bp, Rattus norvegicus
ggagactttgtcattaaggattgag

SEQ ID NO: 425869 - DNA, 25 bp, Rattus norvegicus
ggagactttgtctttaaggattgag

SEQ ID NO: 425870 - DNA, 25 bp, Rattus norvegicus
ggagacttttgacgccttggatgat

SEQ ID NO: 425871 - DNA, 25 bp, Rattus norvegicus
ggagacttttgaggccttggatgat

SEQ ID NO: 425872 - DNA, 25 bp, Rattus norvegicus
ggagagaaaatacccagtaccttgt

SEQ ID NO: 425873 - DNA, 25 bp, Rattus norvegicus
ggagagaaaatagccagtaccttgt

SEQ ID NO: 425874 - DNA, 25 bp, Rattus norvegicus
ggagagaaattaccatcgccttaaa

SEQ ID NO: 425875 - DNA, 25 bp, Rattus norvegicus
ggagagaaattagcatcgccttaaa

SEQ ID NO: 425876 - DNA, 25 bp, Rattus norvegicus
ggagagaaccccagactcgagatgg

SEQ ID NO: 425877 - DNA, 25 bp, Rattus norvegicus
ggagagaacccctgactcgagatgg

SEQ ID NO: 425878 - DNA, 25 bp, Rattus norvegicus
ggagagaaccttagccatcgtatac

SEQ ID NO: 425879 - DNA, 25 bp, Rattus norvegicus
ggagagaacctttgccatcgtatac

SEQ ID NO: 425880 - DNA, 25 bp, Rattus norvegicus
ggagagaactaaccactaccctttg

SEQ ID NO: 425881 - DNA, 25 bp, Rattus norvegicus
ggagagaactaagcactaccctttg

SEQ ID NO: 425882 - DNA, 25 bp, Rattus norvegicus
ggagagaagattcgcacatgtgcct

SEQ ID NO: 425883 - DNA, 25 bp, Rattus norvegicus
ggagagaagattggcacatgtgcct

SEQ ID NO: 425884 - DNA, 25 bp, Rattus norvegicus
ggagagaagcccatcttgtgccttt

SEQ ID NO: 425885 - DNA, 25 bp, Rattus norvegicus
ggagagaagcccttcttgtgccttt

SEQ ID NO: 425886 - DNA, 25 bp, Rattus norvegicus
ggagagaagcctctcccagtggacc

SEQ ID NO: 425887 - DNA, 25 bp, Rattus norvegicus
ggagagaagcctgtcccagtggacc

SEQ ID NO: 425888 - DNA, 25 bp, Rattus norvegicus
ggagagaatggcaccctccatcctg

SEQ ID NO: 425889 - DNA, 25 bp, Rattus norvegicus
ggagagaatggctccctccatcctg

SEQ ID NO: 425890 - DNA, 25 bp, Rattus norvegicus
ggagagaattccaacaccggcatcg

SEQ ID NO: 425891 - DNA, 25 bp, Rattus norvegicus
ggagagaattcctacaccggcatcg

SEQ ID NO: 425892 - DNA, 25 bp, Rattus norvegicus
ggagagaatttcaatatttgcaata

SEQ ID NO: 425893 - DNA, 25 bp, Rattus norvegicus
ggagagaatttctatatttgcaata

SEQ ID NO: 425894 - DNA, 25 bp, Rattus norvegicus
ggagagacaactcccatacccacat

SEQ ID NO: 425895 - DNA, 25 bp, Rattus norvegicus
ggagagacaactgccatacccacat

SEQ ID NO: 425896 - DNA, 25 bp, Rattus norvegicus
ggagagacacgtacaaccacttgac

SEQ ID NO: 425897 - DNA, 25 bp, Rattus norvegicus
ggagagacacgttcaaccacttgac

SEQ ID NO: 425898 - DNA, 25 bp, Rattus norvegicus
ggagagacagacagccgctttgcac

SEQ ID NO: 425899 - DNA, 25 bp, Rattus norvegicus
ggagagacagactgccgctttgcac

SEQ ID NO: 425900 - DNA, 25 bp, Rattus norvegicus
ggagagacatctaagaccaattttt

SEQ ID NO: 425901 - DNA, 25 bp, Rattus norvegicus
ggagagacatctatgactcctcaga

SEQ ID NO: 425902 - DNA, 25 bp, Rattus norvegicus
ggagagacatcttagaccaattttt

SEQ ID NO: 425903 - DNA, 25 bp, Rattus norvegicus
ggagagacatctttgactcctcaga

SEQ ID NO: 425904 - DNA, 25 bp, Rattus norvegicus
ggagagacccagacactccaggaga

SEQ ID NO: 425905 - DNA, 25 bp, Rattus norvegicus
ggagagacccagtcactccaggaga

SEQ ID NO: 425906 - DNA, 25 bp, Rattus norvegicus
ggagagacgcagctcatacctcact

SEQ ID NO: 425907 - DNA, 25 bp, Rattus norvegicus
ggagagacgcaggtcatacctcact

SEQ ID NO: 425908 - DNA, 25 bp, Rattus norvegicus
ggagagacggcccaggagttaagac

SEQ ID NO: 425909 - DNA, 25 bp, Rattus norvegicus
ggagagacggccgaggagttaagac

SEQ ID NO: 425910 - DNA, 25 bp, Rattus norvegicus
ggagagactaccatcttagacattg

SEQ ID NO: 425911 - DNA, 25 bp, Rattus norvegicus
ggagagactaccttcttagacattg

SEQ ID NO: 425912 - DNA, 25 bp, Rattus norvegicus
ggagagactctcctaattgtggaat

SEQ ID NO: 425913 - DNA, 25 bp, Rattus norvegicus
ggagagactctcgtaattgtggaat

SEQ ID NO: 425914 - DNA, 25 bp, Rattus norvegicus
ggagagactgcactggcattttata

SEQ ID NO: 425915 - DNA, 25 bp, Rattus norvegicus
ggagagactgcagtggcattttata

SEQ ID NO: 425916 - DNA, 25 bp, Rattus norvegicus
ggagagactggaatccgtgactcca

SEQ ID NO: 425917 - DNA, 25 bp, Rattus norvegicus
ggagagactggattccgtgactcca

SEQ ID NO: 425918 - DNA, 25 bp, Rattus norvegicus
ggagagactggcagtcacacagtca

SEQ ID NO: 425919 - DNA, 25 bp, Rattus norvegicus
ggagagactggctgtcacacagtca

SEQ ID NO: 425920 - DNA, 25 bp, Rattus norvegicus
ggagagacttctcaaacagctttgc

SEQ ID NO: 425921 - DNA, 25 bp, Rattus norvegicus
ggagagacttctgaaacagctttgc

SEQ ID NO: 425922 - DNA, 25 bp, Rattus norvegicus
ggagagactttaacatgccttaata

SEQ ID NO: 425923 - DNA, 25 bp, Rattus norvegicus
ggagagactttatcatgccttaata

SEQ ID NO: 425924 - DNA, 25 bp, Rattus norvegicus
ggagagagaactacctgtgcctaga

SEQ ID NO: 425925 - DNA, 25 bp, Rattus norvegicus
ggagagagaacttcctgtgcctaga

SEQ ID NO: 425926 - DNA, 25 bp, Rattus norvegicus
ggagagagaagccaccggcgacggt

SEQ ID NO: 425927 - DNA, 25 bp, Rattus norvegicus
ggagagagaagcgaccggcgacggt

SEQ ID NO: 425928 - DNA, 25 bp, Rattus norvegicus
ggagagagagtcattttcctttggg

SEQ ID NO: 425929 - DNA, 25 bp, Rattus norvegicus
ggagagagagtctttttcctttggg

SEQ ID NO: 425930 - DNA, 25 bp, Rattus norvegicus
ggagagagcaacagccactcttctt

SEQ ID NO: 425931 - DNA, 25 bp, Rattus norvegicus
ggagagagcaactgccactcttctt

SEQ ID NO: 425932 - DNA, 25 bp, Rattus norvegicus
ggagagagcatgacctttgacccta

SEQ ID NO: 425933 - DNA, 25 bp, Rattus norvegicus
ggagagagcatgtcctttgacccta

SEQ ID NO: 425934 - DNA, 25 bp, Rattus norvegicus
ggagagagccacacgctgctagtca

SEQ ID NO: 425935 - DNA, 25 bp, Rattus norvegicus
ggagagagccactcgctgctagtca

SEQ ID NO: 425936 - DNA, 25 bp, Rattus norvegicus
ggagagagcctaaataccccttaat

SEQ ID NO: 425937 - DNA, 25 bp, Rattus norvegicus
ggagagagcctatataccccttaat

SEQ ID NO: 425938 - DNA, 25 bp, Rattus norvegicus
ggagagagctaactcccattagtta

SEQ ID NO: 425939 - DNA, 25 bp, Rattus norvegicus
ggagagagctaagtcccattagtta

SEQ ID NO: 425940 - DNA, 25 bp, Rattus norvegicus
ggagagagctacaggatccccacag

SEQ ID NO: 425941 - DNA, 25 bp, Rattus norvegicus
ggagagagctactggatccccacag

SEQ ID NO: 425942 - DNA, 25 bp, Rattus norvegicus
ggagagaggctacacaatacccacc

SEQ ID NO: 425943 - DNA, 25 bp, Rattus norvegicus
ggagagaggctagacaatacccacc

SEQ ID NO: 425944 - DNA, 25 bp, Rattus norvegicus
ggagagaggtctctttctgtatctg

SEQ ID NO: 425945 - DNA, 25 bp, Rattus norvegicus
ggagagaggtctgtttctgtatctg

SEQ ID NO: 425946 - DNA, 25 bp, Rattus norvegicus
ggagagagtctcaactgggccacct

SEQ ID NO: 425947 - DNA, 25 bp, Rattus norvegicus
ggagagagtctctactgggccacct

SEQ ID NO: 425948 - DNA, 25 bp, Rattus norvegicus
ggagagatacacagtctgtggcagt

SEQ ID NO: 425949 - DNA, 25 bp, Rattus norvegicus
ggagagatacactgtctgtggcagt

SEQ ID NO: 425950 - DNA, 25 bp, Rattus norvegicus
ggagagatatgcattgctctctgcc

SEQ ID NO: 425951 - DNA, 25 bp, Rattus norvegicus
ggagagatatgctttgctctctgcc

SEQ ID NO: 425952 - DNA, 25 bp, Rattus norvegicus
ggagagatcagtagtcatgccagct

SEQ ID NO: 425953 - DNA, 25 bp, Rattus norvegicus
ggagagatcagttgtcatgccagct

SEQ ID NO: 425954 - DNA, 25 bp, Rattus norvegicus
ggagagatccccaggcttgcagaaa

SEQ ID NO: 425955 - DNA, 25 bp, Rattus norvegicus
ggagagatcccctggcttgcagaaa

SEQ ID NO: 425956 - DNA, 25 bp, Rattus norvegicus
ggagagatcccgaactagtaaccat

SEQ ID NO: 425957 - DNA, 25 bp, Rattus norvegicus
ggagagatcccgtactagtaaccat

SEQ ID NO: 425958 - DNA, 25 bp, Rattus norvegicus
ggagagatccctccttacctgacat

SEQ ID NO: 425959 - DNA, 25 bp, Rattus norvegicus
ggagagatccctgcttacctgacat

SEQ ID NO: 425960 - DNA, 25 bp, Rattus norvegicus
ggagagatccgaccccacagagtaa

SEQ ID NO: 425961 - DNA, 25 bp, Rattus norvegicus
ggagagatccgagcccacagagtaa

SEQ ID NO: 425962 - DNA, 25 bp, Rattus norvegicus
ggagagatcttaatctcacctaaga

SEQ ID NO: 425963 - DNA, 25 bp, Rattus norvegicus
ggagagatcttattctcacctaaga

SEQ ID NO: 425964 - DNA, 25 bp, Rattus norvegicus
ggagagatgcataaactttttcagt

SEQ ID NO: 425965 - DNA, 25 bp, Rattus norvegicus
ggagagatgcattaactttttcagt

SEQ ID NO: 425966 - DNA, 25 bp, Rattus norvegicus
ggagagatgtccatcttgttttcct

SEQ ID NO: 425967 - DNA, 25 bp, Rattus norvegicus
ggagagatgtccttcttgttttcct

SEQ ID NO: 425968 - DNA, 25 bp, Rattus norvegicus
ggagagattaccagttcagcacact

SEQ ID NO: 425969 - DNA, 25 bp, Rattus norvegicus
ggagagattacctgttcagcacact

SEQ ID NO: 425970 - DNA, 25 bp, Rattus norvegicus
ggagagattgctactaaataactca

SEQ ID NO: 425971 - DNA, 25 bp, Rattus norvegicus
ggagagattgcttctaaataactca

SEQ ID NO: 425972 - DNA, 25 bp, Rattus norvegicus
ggagagattttaccccaacagttat

SEQ ID NO: 425973 - DNA, 25 bp, Rattus norvegicus
ggagagattttagcccaacagttat

SEQ ID NO: 425974 - DNA, 25 bp, Rattus norvegicus
ggagagcaccaaactgcattactgc

SEQ ID NO: 425975 - DNA, 25 bp, Rattus norvegicus
ggagagcaccaatctgcattactgc

SEQ ID NO: 425976 - DNA, 25 bp, Rattus norvegicus
ggagagcaccttcatgaccactggg

SEQ ID NO: 425977 - DNA, 25 bp, Rattus norvegicus
ggagagcaccttgatgaccactggg

SEQ ID NO: 425978 - DNA, 25 bp, Rattus norvegicus
ggagagcacgtcacttggaatttca

SEQ ID NO: 425979 - DNA, 25 bp, Rattus norvegicus
ggagagcacgtctcttggaatttca

SEQ ID NO: 425980 - DNA, 25 bp, Rattus norvegicus
ggagagcactccaggctgcagtctg

SEQ ID NO: 425981 - DNA, 25 bp, Rattus norvegicus
ggagagcactcctggctgcagtctg

SEQ ID NO: 425982 - DNA, 25 bp, Rattus norvegicus
ggagagcactctcgctttgatttta

SEQ ID NO: 425983 - DNA, 25 bp, Rattus norvegicus
ggagagcactctggctttgatttta

SEQ ID NO: 425984 - DNA, 25 bp, Rattus norvegicus
ggagagcactgacgagcccacatgt

SEQ ID NO: 425985 - DNA, 25 bp, Rattus norvegicus
ggagagcactgaggagcccacatgt

SEQ ID NO: 425986 - DNA, 25 bp, Rattus norvegicus
ggagagcagcagacaccccaatgga

SEQ ID NO: 425987 - DNA, 25 bp, Rattus norvegicus
ggagagcagcagtcaccccaatgga

SEQ ID NO: 425988 - DNA, 25 bp, Rattus norvegicus
ggagagcagccaccaaccgtatcag

SEQ ID NO: 425989 - DNA, 25 bp, Rattus norvegicus
ggagagcagccagcaaccgtatcag

SEQ ID NO: 425990 - DNA, 25 bp, Rattus norvegicus
ggagagcagccccagacacgaactc

SEQ ID NO: 425991 - DNA, 25 bp, Rattus norvegicus
ggagagcagcccgagacacgaactc

SEQ ID NO: 425992 - DNA, 25 bp, Rattus norvegicus
ggagagcaggttacagatccttact

SEQ ID NO: 425993 - DNA, 25 bp, Rattus norvegicus
ggagagcaggtttcagatccttact

SEQ ID NO: 425994 - DNA, 25 bp, Rattus norvegicus
ggagagcatatcagcctgatggata

SEQ ID NO: 425995 - DNA, 25 bp, Rattus norvegicus
ggagagcatatctgcctgatggata

SEQ ID NO: 425996 - DNA, 25 bp, Rattus norvegicus
ggagagcatctcaattttgaaatgg

SEQ ID NO: 425997 - DNA, 25 bp, Rattus norvegicus
ggagagcatctccatggtcaaaatc

SEQ ID NO: 425998 - DNA, 25 bp, Rattus norvegicus
ggagagcatctcgatggtcaaaatc

SEQ ID NO: 425999 - DNA, 25 bp, Rattus norvegicus
ggagagcatctctattttgaaatgg

SEQ ID NO: 426000 - DNA, 25 bp, Rattus norvegicus
ggagagcatgatccgcgcccttgct

SEQ ID NO: 426001 - DNA, 25 bp, Rattus norvegicus
ggagagcatgatgcgcgcccttgct

SEQ ID NO: 426002 - DNA, 25 bp, Rattus norvegicus
ggagagcattccatcattggccgta

SEQ ID NO: 426003 - DNA, 25 bp, Rattus norvegicus
ggagagcattccttcattggccgta

SEQ ID NO: 426004 - DNA, 25 bp, Rattus norvegicus
ggagagccaatcagatcaaccatat

SEQ ID NO: 426005 - DNA, 25 bp, Rattus norvegicus
ggagagccaatctgatcaaccatat

SEQ ID NO: 426006 - DNA, 25 bp, Rattus norvegicus
ggagagccagatcttccactgtatt

SEQ ID NO: 426007 - DNA, 25 bp, Rattus norvegicus
ggagagccagatgttccactgtatt

SEQ ID NO: 426008 - DNA, 25 bp, Rattus norvegicus
ggagagccaggacaacagttacgac

SEQ ID NO: 426009 - DNA, 25 bp, Rattus norvegicus
ggagagccaggagaacagttacgac

SEQ ID NO: 426010 - DNA, 25 bp, Rattus norvegicus
ggagagccagtacgccaggattctc

SEQ ID NO: 426011 - DNA, 25 bp, Rattus norvegicus
ggagagccagtaggccaggattctc

SEQ ID NO: 426012 - DNA, 25 bp, Rattus norvegicus
ggagagccatttccagtctcagaag

SEQ ID NO: 426013 - DNA, 25 bp, Rattus norvegicus
ggagagccatttgcagtctcagaag

SEQ ID NO: 426014 - DNA, 25 bp, Rattus norvegicus
ggagagcccagccaacagtattgag

SEQ ID NO: 426015 - DNA, 25 bp, Rattus norvegicus
ggagagcccagcgaacagtattgag

SEQ ID NO: 426016 - DNA, 25 bp, Rattus norvegicus
ggagagccccagagcgcatcagatt

SEQ ID NO: 426017 - DNA, 25 bp, Rattus norvegicus
ggagagccccagtgcgcatcagatt

SEQ ID NO: 426018 - DNA, 25 bp, Rattus norvegicus
ggagagcccttgagacattactaat

SEQ ID NO: 426019 - DNA, 25 bp, Rattus norvegicus
ggagagcccttgctactctggataa

SEQ ID NO: 426020 - DNA, 25 bp, Rattus norvegicus
ggagagcccttggtactctggataa

SEQ ID NO: 426021 - DNA, 25 bp, Rattus norvegicus
ggagagcccttgtgacattactaat

SEQ ID NO: 426022 - DNA, 25 bp, Rattus norvegicus
ggagagcctacaaaatcccacttgt

SEQ ID NO: 426023 - DNA, 25 bp, Rattus norvegicus
ggagagcctacataatcccacttgt

SEQ ID NO: 426024 - DNA, 25 bp, Rattus norvegicus
ggagagcctagcacgaacctgaagt

SEQ ID NO: 426025 - DNA, 25 bp, Rattus norvegicus
ggagagcctagctcgaacctgaagt

SEQ ID NO: 426026 - DNA, 25 bp, Rattus norvegicus
ggagagcctattacacagtcatcat

SEQ ID NO: 426027 - DNA, 25 bp, Rattus norvegicus
ggagagcctatttcacagtcatcat

SEQ ID NO: 426028 - DNA, 25 bp, Rattus norvegicus
ggagagcctcccatggaaacggatg

SEQ ID NO: 426029 - DNA, 25 bp, Rattus norvegicus
ggagagcctcccttggaaacggatg

SEQ ID NO: 426030 - DNA, 25 bp, Rattus norvegicus
ggagagcctctcctcagaaaagtca

SEQ ID NO: 426031 - DNA, 25 bp, Rattus norvegicus
ggagagcctctcgtcagaaaagtca

SEQ ID NO: 426032 - DNA, 25 bp, Rattus norvegicus
ggagagcctgctcagtggttaaaca

SEQ ID NO: 426033 - DNA, 25 bp, Rattus norvegicus
ggagagcctgctgagtggttaaaca

SEQ ID NO: 426034 - DNA, 25 bp, Rattus norvegicus
ggagagcctggtcccttatgtctta

SEQ ID NO: 426035 - DNA, 25 bp, Rattus norvegicus
ggagagcctggtgccttatgtctta

SEQ ID NO: 426036 - DNA, 25 bp, Rattus norvegicus
ggagagcctgtccatcctccggaag

SEQ ID NO: 426037 - DNA, 25 bp, Rattus norvegicus
ggagagcctgtcgatcctccggaag

SEQ ID NO: 426038 - DNA, 25 bp, Rattus norvegicus
ggagagccttcaactatatcgtggg

SEQ ID NO: 426039 - DNA, 25 bp, Rattus norvegicus
ggagagccttcaagagaacctcagg

SEQ ID NO: 426040 - DNA, 25 bp, Rattus norvegicus
ggagagccttcatctatatcgtggg

SEQ ID NO: 426041 - DNA, 25 bp, Rattus norvegicus
ggagagccttcatgagaacctcagg

SEQ ID NO: 426042 - DNA, 25 bp, Rattus norvegicus
ggagagccttccacatgaccaagga

SEQ ID NO: 426043 - DNA, 25 bp, Rattus norvegicus
ggagagccttcctcatgaccaagga

SEQ ID NO: 426044 - DNA, 25 bp, Rattus norvegicus
ggagagcctttcacagtcaaccctg

SEQ ID NO: 426045 - DNA, 25 bp, Rattus norvegicus
ggagagcctttctcagtcaaccctg

SEQ ID NO: 426046 - DNA, 25 bp, Rattus norvegicus
ggagagctaacccaggcacccagaa

SEQ ID NO: 426047 - DNA, 25 bp, Rattus norvegicus
ggagagctaaccgaggcacccagaa

SEQ ID NO: 426048 - DNA, 25 bp, Rattus norvegicus
ggagagctaatcctgaccatgacag

SEQ ID NO: 426049 - DNA, 25 bp, Rattus norvegicus
ggagagctaatcgtgaccatgacag

SEQ ID NO: 426050 - DNA, 25 bp, Rattus norvegicus
ggagagctagataaaccactgcact

SEQ ID NO: 426051 - DNA, 25 bp, Rattus norvegicus
ggagagctagattaaccactgcact

SEQ ID NO: 426052 - DNA, 25 bp, Rattus norvegicus
ggagagctatatacggctgttgcag

SEQ ID NO: 426053 - DNA, 25 bp, Rattus norvegicus
ggagagctatattcggctgttgcag

SEQ ID NO: 426054 - DNA, 25 bp, Rattus norvegicus
ggagagctcacccaaatcctatgtc

SEQ ID NO: 426055 - DNA, 25 bp, Rattus norvegicus
ggagagctcaccgaaatcctatgtc

SEQ ID NO: 426056 - DNA, 25 bp, Rattus norvegicus
ggagagctcctacttctctgaggga

SEQ ID NO: 426057 - DNA, 25 bp, Rattus norvegicus
ggagagctcctagttctctgaggga

SEQ ID NO: 426058 - DNA, 25 bp, Rattus norvegicus
ggagagctcgcaacagattttcatt

SEQ ID NO: 426059 - DNA, 25 bp, Rattus norvegicus
ggagagctcgcatcagattttcatt

SEQ ID NO: 426060 - DNA, 25 bp, Rattus norvegicus
ggagagctcgctagggttatgaccc

SEQ ID NO: 426061 - DNA, 25 bp, Rattus norvegicus
ggagagctcgcttgggttatgaccc

SEQ ID NO: 426062 - DNA, 25 bp, Rattus norvegicus
ggagagctctacctggtacaccact

SEQ ID NO: 426063 - DNA, 25 bp, Rattus norvegicus
ggagagctctacgtggtacaccact

SEQ ID NO: 426064 - DNA, 25 bp, Rattus norvegicus
ggagagctgatcatctacgagcctg

SEQ ID NO: 426065 - DNA, 25 bp, Rattus norvegicus
ggagagctgatcttctacgagcctg

SEQ ID NO: 426066 - DNA, 25 bp, Rattus norvegicus
ggagagctggctatgtgacatttaa

SEQ ID NO: 426067 - DNA, 25 bp, Rattus norvegicus
ggagagctggctttgtgacatttaa

SEQ ID NO: 426068 - DNA, 25 bp, Rattus norvegicus
ggagagcttctcacgatatacgctg

SEQ ID NO: 426069 - DNA, 25 bp, Rattus norvegicus
ggagagcttctctcgatatacgctg

SEQ ID NO: 426070 - DNA, 25 bp, Rattus norvegicus
ggagagcttgacacccctgagttag

SEQ ID NO: 426071 - DNA, 25 bp, Rattus norvegicus
ggagagcttgactcccctgagttag

SEQ ID NO: 426072 - DNA, 25 bp, Rattus norvegicus
ggagagcttgggactgccttttgca

SEQ ID NO: 426073 - DNA, 25 bp, Rattus norvegicus
ggagagcttgggtctgccttttgca

SEQ ID NO: 426074 - DNA, 25 bp, Rattus norvegicus
ggagagctttcccagacagatgtta

SEQ ID NO: 426075 - DNA, 25 bp, Rattus norvegicus
ggagagctttccgagacagatgtta

SEQ ID NO: 426076 - DNA, 25 bp, Rattus norvegicus
ggagagctttttccagtgtctgctt

SEQ ID NO: 426077 - DNA, 25 bp, Rattus norvegicus
ggagagctttttgcagtgtctgctt

SEQ ID NO: 426078 - DNA, 25 bp, Rattus norvegicus
ggagaggaaaccctgagcttgccct

SEQ ID NO: 426079 - DNA, 25 bp, Rattus norvegicus
ggagaggaaaccgtgagcttgccct

SEQ ID NO: 426080 - DNA, 25 bp, Rattus norvegicus
ggagaggaaagcacctcccttgtga

SEQ ID NO: 426081 - DNA, 25 bp, Rattus norvegicus
ggagaggaaagctcctcccttgtga

SEQ ID NO: 426082 - DNA, 25 bp, Rattus norvegicus
ggagaggaacacatgctcctgggct

SEQ ID NO: 426083 - DNA, 25 bp, Rattus norvegicus
ggagaggaacacttgctcctgggct

SEQ ID NO: 426084 - DNA, 25 bp, Rattus norvegicus
ggagaggaactcagttatcttctca

SEQ ID NO: 426085 - DNA, 25 bp, Rattus norvegicus
ggagaggaactctgttatcttctca

SEQ ID NO: 426086 - DNA, 25 bp, Rattus norvegicus
ggagaggacaatctctcttttcatc

SEQ ID NO: 426087 - DNA, 25 bp, Rattus norvegicus
ggagaggacaatgtctcttttcatc

SEQ ID NO: 426088 - DNA, 25 bp, Rattus norvegicus
ggagaggacagacccaaagctaccg

SEQ ID NO: 426089 - DNA, 25 bp, Rattus norvegicus
ggagaggacagagccaaagctaccg

SEQ ID NO: 426090 - DNA, 25 bp, Rattus norvegicus
ggagaggacccaagtttcctagcgc

SEQ ID NO: 426091 - DNA, 25 bp, Rattus norvegicus
ggagaggacccatgtttcctagcgc

SEQ ID NO: 426092 - DNA, 25 bp, Rattus norvegicus
ggagaggacgccacacctgacgcca

SEQ ID NO: 426093 - DNA, 25 bp, Rattus norvegicus
ggagaggacgcctcacctgacgcca

SEQ ID NO: 426094 - DNA, 25 bp, Rattus norvegicus
ggagaggactctcttccaggacagc

SEQ ID NO: 426095 - DNA, 25 bp, Rattus norvegicus
ggagaggactctgttccaggacagc

SEQ ID NO: 426096 - DNA, 25 bp, Rattus norvegicus
ggagaggagcgcagtctgtatccca

SEQ ID NO: 426097 - DNA, 25 bp, Rattus norvegicus
ggagaggagcgctgtctgtatccca

SEQ ID NO: 426098 - DNA, 25 bp, Rattus norvegicus
ggagaggagctacctttccacttgc

SEQ ID NO: 426099 - DNA, 25 bp, Rattus norvegicus
ggagaggagctagctttccacttgc

SEQ ID NO: 426100 - DNA, 25 bp, Rattus norvegicus
ggagaggagcttcgccaagactcac

SEQ ID NO: 426101 - DNA, 25 bp, Rattus norvegicus
ggagaggagcttggccaagactcac

SEQ ID NO: 426102 - DNA, 25 bp, Rattus norvegicus
ggagaggaggctacacaccgttgaa

SEQ ID NO: 426103 - DNA, 25 bp, Rattus norvegicus
ggagaggaggcttcacaccgttgaa

SEQ ID NO: 426104 - DNA, 25 bp, Rattus norvegicus
ggagaggatgccaccacagtcccaa

SEQ ID NO: 426105 - DNA, 25 bp, Rattus norvegicus
ggagaggatgcctccacagtcccaa

SEQ ID NO: 426106 - DNA, 25 bp, Rattus norvegicus
ggagaggcaagaaccgagctcctca

SEQ ID NO: 426107 - DNA, 25 bp, Rattus norvegicus
ggagaggcaagatccgagctcctca

SEQ ID NO: 426108 - DNA, 25 bp, Rattus norvegicus
ggagaggcacaaatacccagctatg

SEQ ID NO: 426109 - DNA, 25 bp, Rattus norvegicus
ggagaggcacaattacccagctatg

SEQ ID NO: 426110 - DNA, 25 bp, Rattus norvegicus
ggagaggcatcaaggtctcgcttca

SEQ ID NO: 426111 - DNA, 25 bp, Rattus norvegicus
ggagaggcatcatggtctcgcttca

SEQ ID NO: 426112 - DNA, 25 bp, Rattus norvegicus
ggagaggccagcaaatactcctcgg

SEQ ID NO: 426113 - DNA, 25 bp, Rattus norvegicus
ggagaggccagctaatactcctcgg

SEQ ID NO: 426114 - DNA, 25 bp, Rattus norvegicus
ggagaggccatgatcttttcctcag

SEQ ID NO: 426115 - DNA, 25 bp, Rattus norvegicus
ggagaggccatgttcttttcctcag

SEQ ID NO: 426116 - DNA, 25 bp, Rattus norvegicus
ggagaggccgctaatgctagcctaa

SEQ ID NO: 426117 - DNA, 25 bp, Rattus norvegicus
ggagaggccgcttatgctagcctaa

SEQ ID NO: 426118 - DNA, 25 bp, Rattus norvegicus
ggagaggccttaaccctgtgaggaa

SEQ ID NO: 426119 - DNA, 25 bp, Rattus norvegicus
ggagaggccttatccctgtgaggaa

SEQ ID NO: 426120 - DNA, 25 bp, Rattus norvegicus
ggagaggccttgatgccaagtgctt

SEQ ID NO: 426121 - DNA, 25 bp, Rattus norvegicus
ggagaggccttgttgccaagtgctt

SEQ ID NO: 426122 - DNA, 25 bp, Rattus norvegicus
ggagaggcctttatcttgtacatga

SEQ ID NO: 426123 - DNA, 25 bp, Rattus norvegicus
ggagaggcctttttcttgtacatga

SEQ ID NO: 426124 - DNA, 25 bp, Rattus norvegicus
ggagaggcggccatatcccagaaca

SEQ ID NO: 426125 - DNA, 25 bp, Rattus norvegicus
ggagaggcggccttatcccagaaca

SEQ ID NO: 426126 - DNA, 25 bp, Rattus norvegicus
ggagaggcgtccatgactgtatccc

SEQ ID NO: 426127 - DNA, 25 bp, Rattus norvegicus
ggagaggcgtccttgactgtatccc

SEQ ID NO: 426128 - DNA, 25 bp, Rattus norvegicus
ggagaggctccgaactgaaaaccag

SEQ ID NO: 426129 - DNA, 25 bp, Rattus norvegicus
ggagaggctccgtactgaaaaccag

SEQ ID NO: 426130 - DNA, 25 bp, Rattus norvegicus
ggagaggctgccaagatgtccccat

SEQ ID NO: 426131 - DNA, 25 bp, Rattus norvegicus
ggagaggctgcctagatgtccccat

SEQ ID NO: 426132 - DNA, 25 bp, Rattus norvegicus
ggagaggctggcattgcagtttatt

SEQ ID NO: 426133 - DNA, 25 bp, Rattus norvegicus
ggagaggctggctttgcagtttatt

SEQ ID NO: 426134 - DNA, 25 bp, Rattus norvegicus
ggagaggcttttctcttcggaaata

SEQ ID NO: 426135 - DNA, 25 bp, Rattus norvegicus
ggagaggcttttgtcttcggaaata

SEQ ID NO: 426136 - DNA, 25 bp, Rattus norvegicus
ggagagggaaaccttgcctcactca

SEQ ID NO: 426137 - DNA, 25 bp, Rattus norvegicus
ggagagggaaacgttgcctcactca

SEQ ID NO: 426138 - DNA, 25 bp, Rattus norvegicus
ggagagggatgcacctgtctgctac

SEQ ID NO: 426139 - DNA, 25 bp, Rattus norvegicus
ggagagggatgctcctgtctgctac

SEQ ID NO: 426140 - DNA, 25 bp, Rattus norvegicus
ggagagggctatagtgtcaacacac

SEQ ID NO: 426141 - DNA, 25 bp, Rattus norvegicus
ggagagggctattgtgtcaacacac

SEQ ID NO: 426142 - DNA, 25 bp, Rattus norvegicus
ggagaggtaaccagcttcctcccat

SEQ ID NO: 426143 - DNA, 25 bp, Rattus norvegicus
ggagaggtaacctgcttcctcccat

SEQ ID NO: 426144 - DNA, 25 bp, Rattus norvegicus
ggagaggtattcacagcctcaccaa

SEQ ID NO: 426145 - DNA, 25 bp, Rattus norvegicus
ggagaggtattctcagcctcaccaa

SEQ ID NO: 426146 - DNA, 25 bp, Rattus norvegicus
ggagaggtctccaaatgacacccca

SEQ ID NO: 426147 - DNA, 25 bp, Rattus norvegicus
ggagaggtctcctaatgacacccca

SEQ ID NO: 426148 - DNA, 25 bp, Rattus norvegicus
ggagaggtctctactacaatgctaa

SEQ ID NO: 426149 - DNA, 25 bp, Rattus norvegicus
ggagaggtctcttctacaatgctaa

SEQ ID NO: 426150 - DNA, 25 bp, Rattus norvegicus
ggagaggtgatcagccaggctcccc

SEQ ID NO: 426151 - DNA, 25 bp, Rattus norvegicus
ggagaggtgatctgccaggctcccc

SEQ ID NO: 426152 - DNA, 25 bp, Rattus norvegicus
ggagaggtgccaatttcagaagaca

SEQ ID NO: 426153 - DNA, 25 bp, Rattus norvegicus
ggagaggtgccattttcagaagaca

SEQ ID NO: 426154 - DNA, 25 bp, Rattus norvegicus
ggagaggtggtaccctgatttccca

SEQ ID NO: 426155 - DNA, 25 bp, Rattus norvegicus
ggagaggtggtagcctgatttccca

SEQ ID NO: 426156 - DNA, 25 bp, Rattus norvegicus
ggagaggttcccatcaaccatgaga

SEQ ID NO: 426157 - DNA, 25 bp, Rattus norvegicus
ggagaggttcccttcaaccatgaga

SEQ ID NO: 426158 - DNA, 25 bp, Rattus norvegicus
ggagaggttgccattagccctactg

SEQ ID NO: 426159 - DNA, 25 bp, Rattus norvegicus
ggagaggttgcctttagccctactg

SEQ ID NO: 426160 - DNA, 25 bp, Rattus norvegicus
ggagaggttgtcacccattttaaca

SEQ ID NO: 426161 - DNA, 25 bp, Rattus norvegicus
ggagaggttgtctcccattttaaca

SEQ ID NO: 426162 - DNA, 25 bp, Rattus norvegicus
ggagagtaacataccattgtaaata

SEQ ID NO: 426163 - DNA, 25 bp, Rattus norvegicus
ggagagtaacattccattgtaaata

SEQ ID NO: 426164 - DNA, 25 bp, Rattus norvegicus
ggagagtaacgccacagtctgtcac

SEQ ID NO: 426165 - DNA, 25 bp, Rattus norvegicus
ggagagtaacgcgacagtctgtcac

SEQ ID NO: 426166 - DNA, 25 bp, Rattus norvegicus
ggagagtaccaactgctgcagcgac

SEQ ID NO: 426167 - DNA, 25 bp, Rattus norvegicus
ggagagtaccaagtgctgcagcgac

SEQ ID NO: 426168 - DNA, 25 bp, Rattus norvegicus
ggagagtagcttatccatctggaca

SEQ ID NO: 426169 - DNA, 25 bp, Rattus norvegicus
ggagagtagcttttccatctggaca

SEQ ID NO: 426170 - DNA, 25 bp, Rattus norvegicus
ggagagtagtcaacggaagcccatt

SEQ ID NO: 426171 - DNA, 25 bp, Rattus norvegicus
ggagagtagtcatcggaagcccatt

SEQ ID NO: 426172 - DNA, 25 bp, Rattus norvegicus
ggagagtatcaacaacagacccaat

SEQ ID NO: 426173 - DNA, 25 bp, Rattus norvegicus
ggagagtatcaagaacagacccaat

SEQ ID NO: 426174 - DNA, 25 bp, Rattus norvegicus
ggagagtatcaccttgttcctgatt

SEQ ID NO: 426175 - DNA, 25 bp, Rattus norvegicus
ggagagtatcacgttgttcctgatt

SEQ ID NO: 426176 - DNA, 25 bp, Rattus norvegicus
ggagagtattacctgcttctcttgc

SEQ ID NO: 426177 - DNA, 25 bp, Rattus norvegicus
ggagagtattacgtgcttctcttgc

SEQ ID NO: 426178 - DNA, 25 bp, Rattus norvegicus
ggagagtcacctccactgaaaatga

SEQ ID NO: 426179 - DNA, 25 bp, Rattus norvegicus
ggagagtcacctccttctagcttat

SEQ ID NO: 426180 - DNA, 25 bp, Rattus norvegicus
ggagagtcacctgcactgaaaatga

SEQ ID NO: 426181 - DNA, 25 bp, Rattus norvegicus
ggagagtcacctgcttctagcttat

SEQ ID NO: 426182 - DNA, 25 bp, Rattus norvegicus
ggagagtcagaaacctttcactgag

SEQ ID NO: 426183 - DNA, 25 bp, Rattus norvegicus
ggagagtcagaatcctttcactgag

SEQ ID NO: 426184 - DNA, 25 bp, Rattus norvegicus
ggagagtcagccagaaccctcagtg

SEQ ID NO: 426185 - DNA, 25 bp, Rattus norvegicus
ggagagtcagcctgaaccctcagtg

SEQ ID NO: 426186 - DNA, 25 bp, Rattus norvegicus
ggagagtccactcgactcagccagg

SEQ ID NO: 426187 - DNA, 25 bp, Rattus norvegicus
ggagagtccactggactcagccagg

SEQ ID NO: 426188 - DNA, 25 bp, Rattus norvegicus
ggagagtccatgacagcttcaatgt

SEQ ID NO: 426189 - DNA, 25 bp, Rattus norvegicus
ggagagtccatgtcagcttcaatgt

SEQ ID NO: 426190 - DNA, 25 bp, Rattus norvegicus
ggagagtcccagatttatgaatcat

SEQ ID NO: 426191 - DNA, 25 bp, Rattus norvegicus
ggagagtcccagttttatgaatcat

SEQ ID NO: 426192 - DNA, 25 bp, Rattus norvegicus
ggagagtccgtacacgccgtacaca

SEQ ID NO: 426193 - DNA, 25 bp, Rattus norvegicus
ggagagtccgtagacgccgtacaca

SEQ ID NO: 426194 - DNA, 25 bp, Rattus norvegicus
ggagagtccttcagttacctaaata

SEQ ID NO: 426195 - DNA, 25 bp, Rattus norvegicus
ggagagtccttctgttacctaaata

SEQ ID NO: 426196 - DNA, 25 bp, Rattus norvegicus
ggagagtctgtgatcgcgatgacac

SEQ ID NO: 426197 - DNA, 25 bp, Rattus norvegicus
ggagagtctgtgttcgcgatgacac

SEQ ID NO: 426198 - DNA, 25 bp, Rattus norvegicus
ggagagtcttgcagactgccatgct

SEQ ID NO: 426199 - DNA, 25 bp, Rattus norvegicus
ggagagtcttgctgactgccatgct

SEQ ID NO: 426200 - DNA, 25 bp, Rattus norvegicus
ggagagtgaaggcacacaaacataa

SEQ ID NO: 426201 - DNA, 25 bp, Rattus norvegicus
ggagagtgaagggacacaaacataa

SEQ ID NO: 426202 - DNA, 25 bp, Rattus norvegicus
ggagagtgaccccaaaactgaccgc

SEQ ID NO: 426203 - DNA, 25 bp, Rattus norvegicus
ggagagtgacccgaaaactgaccgc

SEQ ID NO: 426204 - DNA, 25 bp, Rattus norvegicus
ggagagtgacttctttacacagaca

SEQ ID NO: 426205 - DNA, 25 bp, Rattus norvegicus
ggagagtgacttgtttacacagaca

SEQ ID NO: 426206 - DNA, 25 bp, Rattus norvegicus
ggagagtgagaccttcccctctcgt

SEQ ID NO: 426207 - DNA, 25 bp, Rattus norvegicus
ggagagtgagaccttgctgcacccc

SEQ ID NO: 426208 - DNA, 25 bp, Rattus norvegicus
ggagagtgagacgttcccctctcgt

SEQ ID NO: 426209 - DNA, 25 bp, Rattus norvegicus
ggagagtgagacgttgctgcacccc

SEQ ID NO: 426210 - DNA, 25 bp, Rattus norvegicus
ggagagtgcctgagaaccctgccag

SEQ ID NO: 426211 - DNA, 25 bp, Rattus norvegicus
ggagagtgcctgtgaaccctgccag

SEQ ID NO: 426212 - DNA, 25 bp, Rattus norvegicus
ggagagtgctcacgagccgcaacca

SEQ ID NO: 426213 - DNA, 25 bp, Rattus norvegicus
ggagagtgctcaggagccgcaacca

SEQ ID NO: 426214 - DNA, 25 bp, Rattus norvegicus
ggagagtgctgtatagtcatttgtt

SEQ ID NO: 426215 - DNA, 25 bp, Rattus norvegicus
ggagagtgctgtttagtcatttgtt

SEQ ID NO: 426216 - DNA, 25 bp, Rattus norvegicus
ggagagtggataacttcgggcaaca

SEQ ID NO: 426217 - DNA, 25 bp, Rattus norvegicus
ggagagtggatatcttcgggcaaca

SEQ ID NO: 426218 - DNA, 25 bp, Rattus norvegicus
ggagagtggcacatcctgcaatgac

SEQ ID NO: 426219 - DNA, 25 bp, Rattus norvegicus
ggagagtggcacttcctgcaatgac

SEQ ID NO: 426220 - DNA, 25 bp, Rattus norvegicus
ggagagtgtcaacgctgctacccgc

SEQ ID NO: 426221 - DNA, 25 bp, Rattus norvegicus
ggagagtgtcaaggctgctacccgc

SEQ ID NO: 426222 - DNA, 25 bp, Rattus norvegicus
ggagagttaaagctgaccctccagc

SEQ ID NO: 426223 - DNA, 25 bp, Rattus norvegicus
ggagagttaaaggtgaccctccagc

SEQ ID NO: 426224 - DNA, 25 bp, Rattus norvegicus
ggagagttcacacactgcttcctgc

SEQ ID NO: 426225 - DNA, 25 bp, Rattus norvegicus
ggagagttcacagactgcttcctgc

SEQ ID NO: 426226 - DNA, 25 bp, Rattus norvegicus
ggagagttcaggactgtgtccaccg

SEQ ID NO: 426227 - DNA, 25 bp, Rattus norvegicus
ggagagttcaggtctgtgtccaccg

SEQ ID NO: 426228 - DNA, 25 bp, Rattus norvegicus
ggagagttctgcctgctgagccaaa

SEQ ID NO: 426229 - DNA, 25 bp, Rattus norvegicus
ggagagttctgcgtgctgagccaaa

SEQ ID NO: 426230 - DNA, 25 bp, Rattus norvegicus
ggagagtttttcatagcaactggaa

SEQ ID NO: 426231 - DNA, 25 bp, Rattus norvegicus
ggagagtttttcttagcaactggaa

SEQ ID NO: 426232 - DNA, 25 bp, Rattus norvegicus
ggagagtttttgcatacatttttac

SEQ ID NO: 426233 - DNA, 25 bp, Rattus norvegicus
ggagagtttttggatacatttttac

SEQ ID NO: 426234 - DNA, 25 bp, Rattus norvegicus
ggagataaagccactgtccacttcc

SEQ ID NO: 426235 - DNA, 25 bp, Rattus norvegicus
ggagataaagcctctgtccacttcc

SEQ ID NO: 426236 - DNA, 25 bp, Rattus norvegicus
ggagataacaacactttacacatgc

SEQ ID NO: 426237 - DNA, 25 bp, Rattus norvegicus
ggagataacaactctttacacatgc

SEQ ID NO: 426238 - DNA, 25 bp, Rattus norvegicus
ggagataaccaccatgccaggaagt

SEQ ID NO: 426239 - DNA, 25 bp, Rattus norvegicus
ggagataaccacgatgccaggaagt

SEQ ID NO: 426240 - DNA, 25 bp, Rattus norvegicus
ggagataaccctagatgagatttgg

SEQ ID NO: 426241 - DNA, 25 bp, Rattus norvegicus
ggagataacccttgatgagatttgg

SEQ ID NO: 426242 - DNA, 25 bp, Rattus norvegicus
ggagataacctcatccttcagagac

SEQ ID NO: 426243 - DNA, 25 bp, Rattus norvegicus
ggagataacctcttccttcagagac

SEQ ID NO: 426244 - DNA, 25 bp, Rattus norvegicus
ggagataagcagacattttttcagg

SEQ ID NO: 426245 - DNA, 25 bp, Rattus norvegicus
ggagataagcagtcattttttcagg

SEQ ID NO: 426246 - DNA, 25 bp, Rattus norvegicus
ggagataatgacacctaccttgcag

SEQ ID NO: 426247 - DNA, 25 bp, Rattus norvegicus
ggagataatgactcctaccttgcag

SEQ ID NO: 426248 - DNA, 25 bp, Rattus norvegicus
ggagatacaggaatctttctaatga

SEQ ID NO: 426249 - DNA, 25 bp, Rattus norvegicus
ggagatacaggattctttctaatga

SEQ ID NO: 426250 - DNA, 25 bp, Rattus norvegicus
ggagatacagttatgaggctatttt

SEQ ID NO: 426251 - DNA, 25 bp, Rattus norvegicus
ggagatacagttttgaggctatttt

SEQ ID NO: 426252 - DNA, 25 bp, Rattus norvegicus
ggagatacatctcacattcctcttc

SEQ ID NO: 426253 - DNA, 25 bp, Rattus norvegicus
ggagatacatctgacattcctcttc

SEQ ID NO: 426254 - DNA, 25 bp, Rattus norvegicus
ggagatacatgcatgcccagggctg

SEQ ID NO: 426255 - DNA, 25 bp, Rattus norvegicus
ggagatacatgcttgcccagggctg

SEQ ID NO: 426256 - DNA, 25 bp, Rattus norvegicus
ggagatacattcagcaaatccattc

SEQ ID NO: 426257 - DNA, 25 bp, Rattus norvegicus
ggagatacattccatacctcagtcc

SEQ ID NO: 426258 - DNA, 25 bp, Rattus norvegicus
ggagatacattcgatacctcagtcc

SEQ ID NO: 426259 - DNA, 25 bp, Rattus norvegicus
ggagatacattctgcaaatccattc

SEQ ID NO: 426260 - DNA, 25 bp, Rattus norvegicus
ggagatacatttagtcacctcgtgt

SEQ ID NO: 426261 - DNA, 25 bp, Rattus norvegicus
ggagatacattttgtcacctcgtgt

SEQ ID NO: 426262 - DNA, 25 bp, Rattus norvegicus
ggagatacccaccaattacttgaat

SEQ ID NO: 426263 - DNA, 25 bp, Rattus norvegicus
ggagatacccacgaattacttgaat

SEQ ID NO: 426264 - DNA, 25 bp, Rattus norvegicus
ggagataccctgaaagccatcacaa

SEQ ID NO: 426265 - DNA, 25 bp, Rattus norvegicus
ggagataccctgagatccctagtgg

SEQ ID NO: 426266 - DNA, 25 bp, Rattus norvegicus
ggagataccctgtaagccatcacaa

SEQ ID NO: 426267 - DNA, 25 bp, Rattus norvegicus
ggagataccctgtgatccctagtgg

SEQ ID NO: 426268 - DNA, 25 bp, Rattus norvegicus
ggagatacctgaagccagtcaagca

SEQ ID NO: 426269 - DNA, 25 bp, Rattus norvegicus
ggagatacctgatgccagtcaagca

SEQ ID NO: 426270 - DNA, 25 bp, Rattus norvegicus
ggagatactattccttctgcagagt

SEQ ID NO: 426271 - DNA, 25 bp, Rattus norvegicus
ggagatactattgcttctgcagagt

SEQ ID NO: 426272 - DNA, 25 bp, Rattus norvegicus
ggagatagaaaactcgccctgcccc

SEQ ID NO: 426273 - DNA, 25 bp, Rattus norvegicus
ggagatagaaaagtcgccctgcccc

SEQ ID NO: 426274 - DNA, 25 bp, Rattus norvegicus
ggagatagcgtccagccattgcagc

SEQ ID NO: 426275 - DNA, 25 bp, Rattus norvegicus
ggagatagcgtcgagccattgcagc

SEQ ID NO: 426276 - DNA, 25 bp, Rattus norvegicus
ggagataggagaacctgtctgtctt

SEQ ID NO: 426277 - DNA, 25 bp, Rattus norvegicus
ggagataggagatcctgtctgtctt

SEQ ID NO: 426278 - DNA, 25 bp, Rattus norvegicus
ggagatagggttagtttcctcaaca

SEQ ID NO: 426279 - DNA, 25 bp, Rattus norvegicus
ggagatagggtttgtttcctcaaca

SEQ ID NO: 426280 - DNA, 25 bp, Rattus norvegicus
ggagatagtccaatgcttgtcacaa

SEQ ID NO: 426281 - DNA, 25 bp, Rattus norvegicus
ggagatagtccattgcttgtcacaa

SEQ ID NO: 426282 - DNA, 25 bp, Rattus norvegicus
ggagatataaccagttccaccccag

SEQ ID NO: 426283 - DNA, 25 bp, Rattus norvegicus
ggagatataacctgttccaccccag

SEQ ID NO: 426284 - DNA, 25 bp, Rattus norvegicus
ggagatatagcgacggcctcaggcc

SEQ ID NO: 426285 - DNA, 25 bp, Rattus norvegicus
ggagatatagcgtcggcctcaggcc

SEQ ID NO: 426286 - DNA, 25 bp, Rattus norvegicus
ggagatatatctccaacacaacatt

SEQ ID NO: 426287 - DNA, 25 bp, Rattus norvegicus
ggagatatatctgcaacacaacatt

SEQ ID NO: 426288 - DNA, 25 bp, Rattus norvegicus
ggagatatgatgaatgaccccagtt

SEQ ID NO: 426289 - DNA, 25 bp, Rattus norvegicus
ggagatatgatgtatgaccccagtt

SEQ ID NO: 426290 - DNA, 25 bp, Rattus norvegicus
ggagatattcgtctccttcaataaa

SEQ ID NO: 426291 - DNA, 25 bp, Rattus norvegicus
ggagatattcgtgtccttcaataaa

SEQ ID NO: 426292 - DNA, 25 bp, Rattus norvegicus
ggagatatttgcacaggctgtagga

SEQ ID NO: 426293 - DNA, 25 bp, Rattus norvegicus
ggagatatttgctcaggctgtagga

SEQ ID NO: 426294 - DNA, 25 bp, Rattus norvegicus
ggagatatttgtcaatgctcaccat

SEQ ID NO: 426295 - DNA, 25 bp, Rattus norvegicus
ggagatatttgtgaatgctcaccat

SEQ ID NO: 426296 - DNA, 25 bp, Rattus norvegicus
ggagatcaacagacattttctgatt

SEQ ID NO: 426297 - DNA, 25 bp, Rattus norvegicus
ggagatcaacagtcattttctgatt

SEQ ID NO: 426298 - DNA, 25 bp, Rattus norvegicus
ggagatcaacccagacaggccaagg

SEQ ID NO: 426299 - DNA, 25 bp, Rattus norvegicus
ggagatcaaccctgacaggccaagg

SEQ ID NO: 426300 - DNA, 25 bp, Rattus norvegicus
ggagatcaacgacttctcatctaaa

SEQ ID NO: 426301 - DNA, 25 bp, Rattus norvegicus
ggagatcaacgagttctcatctaaa

SEQ ID NO: 426302 - DNA, 25 bp, Rattus norvegicus
ggagatcaatcaattcgtcgaccat

SEQ ID NO: 426303 - DNA, 25 bp, Rattus norvegicus
ggagatcaatcatttcgtcgaccat

SEQ ID NO: 426304 - DNA, 25 bp, Rattus norvegicus
ggagatcacaaacacctacaagcta

SEQ ID NO: 426305 - DNA, 25 bp, Rattus norvegicus
ggagatcacaaagacctacaagcta

SEQ ID NO: 426306 - DNA, 25 bp, Rattus norvegicus
ggagatcaccataccggtcactttc

SEQ ID NO: 426307 - DNA, 25 bp, Rattus norvegicus
ggagatcaccattccggtcactttc

SEQ ID NO: 426308 - DNA, 25 bp, Rattus norvegicus
ggagatcacgagaagattcctaact

SEQ ID NO: 426309 - DNA, 25 bp, Rattus norvegicus
ggagatcacgagtagattcctaact

SEQ ID NO: 426310 - DNA, 25 bp, Rattus norvegicus
ggagatcactagagcaagctgcagc

SEQ ID NO: 426311 - DNA, 25 bp, Rattus norvegicus
ggagatcactagtgcaagctgcagc

SEQ ID NO: 426312 - DNA, 25 bp, Rattus norvegicus
ggagatcactgtaagttcgaaacac

SEQ ID NO: 426313 - DNA, 25 bp, Rattus norvegicus
ggagatcactgttagttcgaaacac

SEQ ID NO: 426314 - DNA, 25 bp, Rattus norvegicus
ggagatcaggccagatccccgttta

SEQ ID NO: 426315 - DNA, 25 bp, Rattus norvegicus
ggagatcaggcctgatccccgttta

SEQ ID NO: 426316 - DNA, 25 bp, Rattus norvegicus
ggagatcagtttctggtttcagcct

SEQ ID NO: 426317 - DNA, 25 bp, Rattus norvegicus
ggagatcagtttgtggtttcagcct

SEQ ID NO: 426318 - DNA, 25 bp, Rattus norvegicus
ggagatcatgcaagctggtggctgg

SEQ ID NO: 426319 - DNA, 25 bp, Rattus norvegicus
ggagatcatgcatgctggtggctgg

SEQ ID NO: 426320 - DNA, 25 bp, Rattus norvegicus
ggagatcattgtagtagactttata

SEQ ID NO: 426321 - DNA, 25 bp, Rattus norvegicus
ggagatcattgttgtagactttata

SEQ ID NO: 426322 - DNA, 25 bp, Rattus norvegicus
ggagatccactcagaagacctgaca

SEQ ID NO: 426323 - DNA, 25 bp, Rattus norvegicus
ggagatccactcctgtaaggtacta

SEQ ID NO: 426324 - DNA, 25 bp, Rattus norvegicus
ggagatccactcgtgtaaggtacta

SEQ ID NO: 426325 - DNA, 25 bp, Rattus norvegicus
ggagatccactctgaagacctgaca

SEQ ID NO: 426326 - DNA, 25 bp, Rattus norvegicus
ggagatccagtactccctcaaaatt

SEQ ID NO: 426327 - DNA, 25 bp, Rattus norvegicus
ggagatccagtagtccctcaaaatt

SEQ ID NO: 426328 - DNA, 25 bp, Rattus norvegicus
ggagatccagtgactatgcttcaaa

SEQ ID NO: 426329 - DNA, 25 bp, Rattus norvegicus
ggagatccagtgtctatgcttcaaa

SEQ ID NO: 426330 - DNA, 25 bp, Rattus norvegicus
ggagatccattacaaggctgagctg

SEQ ID NO: 426331 - DNA, 25 bp, Rattus norvegicus
ggagatccattagaaggctgagctg

SEQ ID NO: 426332 - DNA, 25 bp, Rattus norvegicus
ggagatccattgacggattcgcctt

SEQ ID NO: 426333 - DNA, 25 bp, Rattus norvegicus
ggagatccattgtcggattcgcctt

SEQ ID NO: 426334 - DNA, 25 bp, Rattus norvegicus
ggagatcccaagacgtttactatgc

SEQ ID NO: 426335 - DNA, 25 bp, Rattus norvegicus
ggagatcccaagtcgtttactatgc

SEQ ID NO: 426336 - DNA, 25 bp, Rattus norvegicus
ggagatccccagctagtacctgtaa

SEQ ID NO: 426337 - DNA, 25 bp, Rattus norvegicus
ggagatccccaggtagtacctgtaa

SEQ ID NO: 426338 - DNA, 25 bp, Rattus norvegicus
ggagatccctgtattagtgtttagt

SEQ ID NO: 426339 - DNA, 25 bp, Rattus norvegicus
ggagatccctgtccctaaaggcttt

SEQ ID NO: 426340 - DNA, 25 bp, Rattus norvegicus
ggagatccctgtgcctaaaggcttt

SEQ ID NO: 426341 - DNA, 25 bp, Rattus norvegicus
ggagatccctgttttagtgtttagt

SEQ ID NO: 426342 - DNA, 25 bp, Rattus norvegicus
ggagatccgacaacttcagaccttc

SEQ ID NO: 426343 - DNA, 25 bp, Rattus norvegicus
ggagatccgacatcttcagaccttc

SEQ ID NO: 426344 - DNA, 25 bp, Rattus norvegicus
ggagatccgcacatacattagagtc

SEQ ID NO: 426345 - DNA, 25 bp, Rattus norvegicus
ggagatccgcacttacattagagtc

SEQ ID NO: 426346 - DNA, 25 bp, Rattus norvegicus
ggagatccgtgtctctgactgtatc

SEQ ID NO: 426347 - DNA, 25 bp, Rattus norvegicus
ggagatccgtgtgtctgactgtatc

SEQ ID NO: 426348 - DNA, 25 bp, Rattus norvegicus
ggagatcctcaaatacatgcagcgg

SEQ ID NO: 426349 - DNA, 25 bp, Rattus norvegicus
ggagatcctcaattacatgcagcgg

SEQ ID NO: 426350 - DNA, 25 bp, Rattus norvegicus
ggagatcctgatctacatcaatgac

SEQ ID NO: 426351 - DNA, 25 bp, Rattus norvegicus
ggagatcctgatgtacatcaatgac

SEQ ID NO: 426352 - DNA, 25 bp, Rattus norvegicus
ggagatcctggacatacaacacaag

SEQ ID NO: 426353 - DNA, 25 bp, Rattus norvegicus
ggagatcctggagatacaacacaag

SEQ ID NO: 426354 - DNA, 25 bp, Rattus norvegicus
ggagatcctggcatatctggcgtat

SEQ ID NO: 426355 - DNA, 25 bp, Rattus norvegicus
ggagatcctggcttatctggcgtat

SEQ ID NO: 426356 - DNA, 25 bp, Rattus norvegicus
ggagatcctgtgacaaagcatacta

SEQ ID NO: 426357 - DNA, 25 bp, Rattus norvegicus
ggagatcctgtgacttcagtgtttc

SEQ ID NO: 426358 - DNA, 25 bp, Rattus norvegicus
ggagatcctgtgtcaaagcatacta

SEQ ID NO: 426359 - DNA, 25 bp, Rattus norvegicus
ggagatcctgtgtcttcagtgtttc

SEQ ID NO: 426360 - DNA, 25 bp, Rattus norvegicus
ggagatccttaaccaccagtgacca

SEQ ID NO: 426361 - DNA, 25 bp, Rattus norvegicus
ggagatccttaagcaccagtgacca

SEQ ID NO: 426362 - DNA, 25 bp, Rattus norvegicus
ggagatcgattgaaaccctgctgct

SEQ ID NO: 426363 - DNA, 25 bp, Rattus norvegicus
ggagatcgattgtaaccctgctgct

SEQ ID NO: 426364 - DNA, 25 bp, Rattus norvegicus
ggagatcgtcatcgctattttcaaa

SEQ ID NO: 426365 - DNA, 25 bp, Rattus norvegicus
ggagatcgtcatggctattttcaaa

SEQ ID NO: 426366 - DNA, 25 bp, Rattus norvegicus
ggagatctaactaccaaactgttca

SEQ ID NO: 426367 - DNA, 25 bp, Rattus norvegicus
ggagatctaacttccaaactgttca

SEQ ID NO: 426368 - DNA, 25 bp, Rattus norvegicus
ggagatctacgtctaccatcaacta

SEQ ID NO: 426369 - DNA, 25 bp, Rattus norvegicus
ggagatctacgtgtaccatcaacta

SEQ ID NO: 426370 - DNA, 25 bp, Rattus norvegicus
ggagatctagctatactcgacaatc

SEQ ID NO: 426371 - DNA, 25 bp, Rattus norvegicus
ggagatctagctttactcgacaatc

SEQ ID NO: 426372 - DNA, 25 bp, Rattus norvegicus
ggagatctcgcaacagttttacctg

SEQ ID NO: 426373 - DNA, 25 bp, Rattus norvegicus
ggagatctcgcatcagttttacctg

SEQ ID NO: 426374 - DNA, 25 bp, Rattus norvegicus
ggagatctcggtaaccaccatgcag

SEQ ID NO: 426375 - DNA, 25 bp, Rattus norvegicus
ggagatctcggttaccaccatgcag

SEQ ID NO: 426376 - DNA, 25 bp, Rattus norvegicus
ggagatctctcgagcagcagccgaa

SEQ ID NO: 426377 - DNA, 25 bp, Rattus norvegicus
ggagatctctcgtgcagcagccgaa

SEQ ID NO: 426378 - DNA, 25 bp, Rattus norvegicus
ggagatctctggaaacatggctaca

SEQ ID NO: 426379 - DNA, 25 bp, Rattus norvegicus
ggagatctctggctatttccttgag

SEQ ID NO: 426380 - DNA, 25 bp, Rattus norvegicus
ggagatctctgggtatttccttgag

SEQ ID NO: 426381 - DNA, 25 bp, Rattus norvegicus
ggagatctctggtaacatggctaca

SEQ ID NO: 426382 - DNA, 25 bp, Rattus norvegicus
ggagatctctttatcgattccctcc

SEQ ID NO: 426383 - DNA, 25 bp, Rattus norvegicus
ggagatctctttttcgattccctcc

SEQ ID NO: 426384 - DNA, 25 bp, Rattus norvegicus
ggagatctgacacctcttatagtct

SEQ ID NO: 426385 - DNA, 25 bp, Rattus norvegicus
ggagatctgacagctcttatagtct

SEQ ID NO: 426386 - DNA, 25 bp, Rattus norvegicus
ggagatctgcaaagccaatgtcccc

SEQ ID NO: 426387 - DNA, 25 bp, Rattus norvegicus
ggagatctgcaatgccaatgtcccc

SEQ ID NO: 426388 - DNA, 25 bp, Rattus norvegicus
ggagatctgcagaaaccgccagcaa

SEQ ID NO: 426389 - DNA, 25 bp, Rattus norvegicus
ggagatctgcagtaaccgccagcaa

SEQ ID NO: 426390 - DNA, 25 bp, Rattus norvegicus
ggagatctgccccatgtcatagaga

SEQ ID NO: 426391 - DNA, 25 bp, Rattus norvegicus
ggagatctgcccgatgtcatagaga

SEQ ID NO: 426392 - DNA, 25 bp, Rattus norvegicus
ggagatctgctgctaggtctgaact

SEQ ID NO: 426393 - DNA, 25 bp, Rattus norvegicus
ggagatctgctggtaggtctgaact

SEQ ID NO: 426394 - DNA, 25 bp, Rattus norvegicus
ggagatctgtagagcgttttgttct

SEQ ID NO: 426395 - DNA, 25 bp, Rattus norvegicus
ggagatctgtagtgcgttttgttct

SEQ ID NO: 426396 - DNA, 25 bp, Rattus norvegicus
ggagatctgtccaaggagccctgaa

SEQ ID NO: 426397 - DNA, 25 bp, Rattus norvegicus
ggagatctgtcctaggagccctgaa

SEQ ID NO: 426398 - DNA, 25 bp, Rattus norvegicus
ggagatctgtgaccattgtctgtat

SEQ ID NO: 426399 - DNA, 25 bp, Rattus norvegicus
ggagatctgtgagcattgtctgtat

SEQ ID NO: 426400 - DNA, 25 bp, Rattus norvegicus
ggagatctgtgtcccactaatgctg

SEQ ID NO: 426401 - DNA, 25 bp, Rattus norvegicus
ggagatctgtgtgccactaatgctg

SEQ ID NO: 426402 - DNA, 25 bp, Rattus norvegicus
ggagatcttacactcctagaaagta

SEQ ID NO: 426403 - DNA, 25 bp, Rattus norvegicus
ggagatcttacagtcctagaaagta

SEQ ID NO: 426404 - DNA, 25 bp, Rattus norvegicus
ggagatcttcctatgatctgtcaag

SEQ ID NO: 426405 - DNA, 25 bp, Rattus norvegicus
ggagatcttcctttgatctgtcaag

SEQ ID NO: 426406 - DNA, 25 bp, Rattus norvegicus
ggagatcttctcctatggactgcag

SEQ ID NO: 426407 - DNA, 25 bp, Rattus norvegicus
ggagatcttctcgtatggactgcag

SEQ ID NO: 426408 - DNA, 25 bp, Rattus norvegicus
ggagatcttgtaagccactggtatt

SEQ ID NO: 426409 - DNA, 25 bp, Rattus norvegicus
ggagatcttgtatgccactggtatt

SEQ ID NO: 426410 - DNA, 25 bp, Rattus norvegicus
ggagatctttctcagacctttagac

SEQ ID NO: 426411 - DNA, 25 bp, Rattus norvegicus
ggagatctttctgagacctttagac

SEQ ID NO: 426412 - DNA, 25 bp, Rattus norvegicus
ggagatgaacacagctcgcttgcat

SEQ ID NO: 426413 - DNA, 25 bp, Rattus norvegicus
ggagatgaacactgctcgcttgcat

SEQ ID NO: 426414 - DNA, 25 bp, Rattus norvegicus
ggagatgaacatagcctctggctgt

SEQ ID NO: 426415 - DNA, 25 bp, Rattus norvegicus
ggagatgaacatctggtcgcccaaa

SEQ ID NO: 426416 - DNA, 25 bp, Rattus norvegicus
ggagatgaacatgtggtcgcccaaa

SEQ ID NO: 426417 - DNA, 25 bp, Rattus norvegicus
ggagatgaacattgcctctggctgt

SEQ ID NO: 426418 - DNA, 25 bp, Rattus norvegicus
ggagatgaagtccaggccaaccttg

SEQ ID NO: 426419 - DNA, 25 bp, Rattus norvegicus
ggagatgaagtcgaggccaaccttg

SEQ ID NO: 426420 - DNA, 25 bp, Rattus norvegicus
ggagatgacatcatgcgtattaaat

SEQ ID NO: 426421 - DNA, 25 bp, Rattus norvegicus
ggagatgacatcttgcgtattaaat

SEQ ID NO: 426422 - DNA, 25 bp, Rattus norvegicus
ggagatgaccaacacttctgaggca

SEQ ID NO: 426423 - DNA, 25 bp, Rattus norvegicus
ggagatgaccaagacttctgaggca

SEQ ID NO: 426424 - DNA, 25 bp, Rattus norvegicus
ggagatgaccagagtctactgtgtt

SEQ ID NO: 426425 - DNA, 25 bp, Rattus norvegicus
ggagatgaccagtgtctactgtgtt

SEQ ID NO: 426426 - DNA, 25 bp, Rattus norvegicus
ggagatgacccacatatttattttt

SEQ ID NO: 426427 - DNA, 25 bp, Rattus norvegicus
ggagatgacccagatatttattttt

SEQ ID NO: 426428 - DNA, 25 bp, Rattus norvegicus
ggagatgacggcatctgactaccag

SEQ ID NO: 426429 - DNA, 25 bp, Rattus norvegicus
ggagatgacggcttctgactaccag

SEQ ID NO: 426430 - DNA, 25 bp, Rattus norvegicus
ggagatgactatcttttgccttagt

SEQ ID NO: 426431 - DNA, 25 bp, Rattus norvegicus
ggagatgactatgttttgccttagt

SEQ ID NO: 426432 - DNA, 25 bp, Rattus norvegicus
ggagatgactcaaggctagggccca

SEQ ID NO: 426433 - DNA, 25 bp, Rattus norvegicus
ggagatgactcatggctagggccca

SEQ ID NO: 426434 - DNA, 25 bp, Rattus norvegicus
ggagatgactccagctcagggtaaa

SEQ ID NO: 426435 - DNA, 25 bp, Rattus norvegicus
ggagatgactcctgctcagggtaaa

SEQ ID NO: 426436 - DNA, 25 bp, Rattus norvegicus
ggagatgagctcagacacgcagcaa

SEQ ID NO: 426437 - DNA, 25 bp, Rattus norvegicus
ggagatgagctctgacacgcagcaa

SEQ ID NO: 426438 - DNA, 25 bp, Rattus norvegicus
ggagatgaggccagaccacggacac

SEQ ID NO: 426439 - DNA, 25 bp, Rattus norvegicus
ggagatgaggcctgaccacggacac

SEQ ID NO: 426440 - DNA, 25 bp, Rattus norvegicus
ggagatgatcctagttttaagattc

SEQ ID NO: 426441 - DNA, 25 bp, Rattus norvegicus
ggagatgatccttgttttaagattc

SEQ ID NO: 426442 - DNA, 25 bp, Rattus norvegicus
ggagatgatgacctaccttcgatat

SEQ ID NO: 426443 - DNA, 25 bp, Rattus norvegicus
ggagatgatgacctttcccagcccg

SEQ ID NO: 426444 - DNA, 25 bp, Rattus norvegicus
ggagatgatgacgtaccttcgatat

SEQ ID NO: 426445 - DNA, 25 bp, Rattus norvegicus
ggagatgatgacgtttcccagcccg

SEQ ID NO: 426446 - DNA, 25 bp, Rattus norvegicus
ggagatgcaacccatgctgcaagct

SEQ ID NO: 426447 - DNA, 25 bp, Rattus norvegicus
ggagatgcaaccgatgctgcaagct

SEQ ID NO: 426448 - DNA, 25 bp, Rattus norvegicus
ggagatgcacggacccatattggat

SEQ ID NO: 426449 - DNA, 25 bp, Rattus norvegicus
ggagatgcacggtcccatattggat

SEQ ID NO: 426450 - DNA, 25 bp, Rattus norvegicus
ggagatgcagacagaccgtctctgt

SEQ ID NO: 426451 - DNA, 25 bp, Rattus norvegicus
ggagatgcagactgaccgtctctgt

SEQ ID NO: 426452 - DNA, 25 bp, Rattus norvegicus
ggagatgcagcgactgacagaagct

SEQ ID NO: 426453 - DNA, 25 bp, Rattus norvegicus
ggagatgcagcgtctgacagaagct

SEQ ID NO: 426454 - DNA, 25 bp, Rattus norvegicus
ggagatgcagctacaagaccaaaga

SEQ ID NO: 426455 - DNA, 25 bp, Rattus norvegicus
ggagatgcagcttcaagaccaaaga

SEQ ID NO: 426456 - DNA, 25 bp, Rattus norvegicus
ggagatgcatccaggactatgtagt

SEQ ID NO: 426457 - DNA, 25 bp, Rattus norvegicus
ggagatgcatcctggactatgtagt

SEQ ID NO: 426458 - DNA, 25 bp, Rattus norvegicus
ggagatgccaaacacatgaggtaca

SEQ ID NO: 426459 - DNA, 25 bp, Rattus norvegicus
ggagatgccaaagacatgaggtaca

SEQ ID NO: 426460 - DNA, 25 bp, Rattus norvegicus
ggagatgcccagagaacgtgttgaa

SEQ ID NO: 426461 - DNA, 25 bp, Rattus norvegicus
ggagatgcccagtgaacgtgttgaa

SEQ ID NO: 426462 - DNA, 25 bp, Rattus norvegicus
ggagatgccctcaattactgatgtt

SEQ ID NO: 426463 - DNA, 25 bp, Rattus norvegicus
ggagatgccctctattactgatgtt

SEQ ID NO: 426464 - DNA, 25 bp, Rattus norvegicus
ggagatgcctatatcttctactatc

SEQ ID NO: 426465 - DNA, 25 bp, Rattus norvegicus
ggagatgcctatttcttctactatc

SEQ ID NO: 426466 - DNA, 25 bp, Rattus norvegicus
ggagatgcgaagcaactacagtttt

SEQ ID NO: 426467 - DNA, 25 bp, Rattus norvegicus
ggagatgcgaaggaactacagtttt

SEQ ID NO: 426468 - DNA, 25 bp, Rattus norvegicus
ggagatgctagcactcaccattatt

SEQ ID NO: 426469 - DNA, 25 bp, Rattus norvegicus
ggagatgctagctctcaccattatt

SEQ ID NO: 426470 - DNA, 25 bp, Rattus norvegicus
ggagatgctcagacccaaggagaaa

SEQ ID NO: 426471 - DNA, 25 bp, Rattus norvegicus
ggagatgctcagtcccaaggagaaa

SEQ ID NO: 426472 - DNA, 25 bp, Rattus norvegicus
ggagatgctctcaatggatttctga

SEQ ID NO: 426473 - DNA, 25 bp, Rattus norvegicus
ggagatgctctctatggatttctga

SEQ ID NO: 426474 - DNA, 25 bp, Rattus norvegicus
ggagatgctcttctgtgtttattaa

SEQ ID NO: 426475 - DNA, 25 bp, Rattus norvegicus
ggagatgctcttgtgtgtttattaa

SEQ ID NO: 426476 - DNA, 25 bp, Rattus norvegicus
ggagatgctgaaactggaggatact

SEQ ID NO: 426477 - DNA, 25 bp, Rattus norvegicus
ggagatgctgaatctggaggatact

SEQ ID NO: 426478 - DNA, 25 bp, Rattus norvegicus
ggagatgctgagagaagaccattct

SEQ ID NO: 426479 - DNA, 25 bp, Rattus norvegicus
ggagatgctgagtgaagaccattct

SEQ ID NO: 426480 - DNA, 25 bp, Rattus norvegicus
ggagatgctgctaagctgatcccac

SEQ ID NO: 426481 - DNA, 25 bp, Rattus norvegicus
ggagatgctgcttagctgatcccac

SEQ ID NO: 426482 - DNA, 25 bp, Rattus norvegicus
ggagatgctgtaaacttttggcaaa

SEQ ID NO: 426483 - DNA, 25 bp, Rattus norvegicus
ggagatgctgtatacttttggcaaa

SEQ ID NO: 426484 - DNA, 25 bp, Rattus norvegicus
ggagatgctgtcagtccctttgtgc

SEQ ID NO: 426485 - DNA, 25 bp, Rattus norvegicus
ggagatgctgtctgtccctttgtgc

SEQ ID NO: 426486 - DNA, 25 bp, Rattus norvegicus
ggagatgcttgcaggcctcctgtca

SEQ ID NO: 426487 - DNA, 25 bp, Rattus norvegicus
ggagatgcttgctggcctcctgtca

SEQ ID NO: 426488 - DNA, 25 bp, Rattus norvegicus
ggagatggacacaggcctcacgttt

SEQ ID NO: 426489 - DNA, 25 bp, Rattus norvegicus
ggagatggacactggcctcacgttt

SEQ ID NO: 426490 - DNA, 25 bp, Rattus norvegicus
ggagatggaggaacccttttggaat

SEQ ID NO: 426491 - DNA, 25 bp, Rattus norvegicus
ggagatggaggatcccttttggaat

SEQ ID NO: 426492 - DNA, 25 bp, Rattus norvegicus
ggagatggaggcactcccgtcctgc

SEQ ID NO: 426493 - DNA, 25 bp, Rattus norvegicus
ggagatggaggctctcccgtcctgc

SEQ ID NO: 426494 - DNA, 25 bp, Rattus norvegicus
ggagatggcccgagatccacagcgc

SEQ ID NO: 426495 - DNA, 25 bp, Rattus norvegicus
ggagatggcccgtgatccacagcgc

SEQ ID NO: 426496 - DNA, 25 bp, Rattus norvegicus
ggagatggcctcatcacccgagtga

SEQ ID NO: 426497 - DNA, 25 bp, Rattus norvegicus
ggagatggcctcttcacccgagtga

SEQ ID NO: 426498 - DNA, 25 bp, Rattus norvegicus
ggagatggcttcaataaccccatga

SEQ ID NO: 426499 - DNA, 25 bp, Rattus norvegicus
ggagatggcttctataaccccatga

SEQ ID NO: 426500 - DNA, 25 bp, Rattus norvegicus
ggagatgggccgaactacatgtacc

SEQ ID NO: 426501 - DNA, 25 bp, Rattus norvegicus
ggagatgggccgtactacatgtacc

SEQ ID NO: 426502 - DNA, 25 bp, Rattus norvegicus
ggagatgggcctcaaaaagtcttac

SEQ ID NO: 426503 - DNA, 25 bp, Rattus norvegicus
ggagatgggcctgaaaaagtcttac

SEQ ID NO: 426504 - DNA, 25 bp, Rattus norvegicus
ggagatgggctccacactgctcatt

SEQ ID NO: 426505 - DNA, 25 bp, Rattus norvegicus
ggagatgggctcgacactgctcatt

SEQ ID NO: 426506 - DNA, 25 bp, Rattus norvegicus
ggagatgtaaagattttcctgaaaa

SEQ ID NO: 426507 - DNA, 25 bp, Rattus norvegicus
ggagatgtaaagtttttcctgaaaa

SEQ ID NO: 426508 - DNA, 25 bp, Rattus norvegicus
ggagatgtaaatagtcaccagcccc

SEQ ID NO: 426509 - DNA, 25 bp, Rattus norvegicus
ggagatgtaaattgtcaccagcccc

SEQ ID NO: 426510 - DNA, 25 bp, Rattus norvegicus
ggagatgtacgtaaatgcccctttt

SEQ ID NO: 426511 - DNA, 25 bp, Rattus norvegicus
ggagatgtacgttaatgcccctttt

SEQ ID NO: 426512 - DNA, 25 bp, Rattus norvegicus
ggagatgtatgcctactaccctgta

SEQ ID NO: 426513 - DNA, 25 bp, Rattus norvegicus
ggagatgtatgcgtactaccctgta

SEQ ID NO: 426514 - DNA, 25 bp, Rattus norvegicus
ggagatgtcaccagggcaatcaaca

SEQ ID NO: 426515 - DNA, 25 bp, Rattus norvegicus
ggagatgtcacctgggcaatcaaca

SEQ ID NO: 426516 - DNA, 25 bp, Rattus norvegicus
ggagatgtcactcacttagtctgta

SEQ ID NO: 426517 - DNA, 25 bp, Rattus norvegicus
ggagatgtcactgacttagtctgta

SEQ ID NO: 426518 - DNA, 25 bp, Rattus norvegicus
ggagatgtcattacccaatggcaac

SEQ ID NO: 426519 - DNA, 25 bp, Rattus norvegicus
ggagatgtcatttcccaatggcaac

SEQ ID NO: 426520 - DNA, 25 bp, Rattus norvegicus
ggagatgtctctctgccatgtcact

SEQ ID NO: 426521 - DNA, 25 bp, Rattus norvegicus
ggagatgtctctgtgccatgtcact

SEQ ID NO: 426522 - DNA, 25 bp, Rattus norvegicus
ggagatgtcttaaagggtcacttaa

SEQ ID NO: 426523 - DNA, 25 bp, Rattus norvegicus
ggagatgtcttacttgtgtctgatc

SEQ ID NO: 426524 - DNA, 25 bp, Rattus norvegicus
ggagatgtcttagttgtgtctgatc

SEQ ID NO: 426525 - DNA, 25 bp, Rattus norvegicus
ggagatgtcttatagggtcacttaa

SEQ ID NO: 426526 - DNA, 25 bp, Rattus norvegicus
ggagatgtgctactgctggcaactt

SEQ ID NO: 426527 - DNA, 25 bp, Rattus norvegicus
ggagatgtgctagtgctggcaactt

SEQ ID NO: 426528 - DNA, 25 bp, Rattus norvegicus
ggagatgttctgattctagaccaac

SEQ ID NO: 426529 - DNA, 25 bp, Rattus norvegicus
ggagatgttctgtttctagaccaac

SEQ ID NO: 426530 - DNA, 25 bp, Rattus norvegicus
ggagatgttgcaagccctgcttgac

SEQ ID NO: 426531 - DNA, 25 bp, Rattus norvegicus
ggagatgttgcatgccctgcttgac

SEQ ID NO: 426532 - DNA, 25 bp, Rattus norvegicus
ggagatgtttctacttgtcatcctt

SEQ ID NO: 426533 - DNA, 25 bp, Rattus norvegicus
ggagatgtttcttcttgtcatcctt

SEQ ID NO: 426534 - DNA, 25 bp, Rattus norvegicus
ggagattaacagagccccatacctg

SEQ ID NO: 426535 - DNA, 25 bp, Rattus norvegicus
ggagattaacagtgccccatacctg

SEQ ID NO: 426536 - DNA, 25 bp, Rattus norvegicus
ggagattatagcagtgtgcctctat

SEQ ID NO: 426537 - DNA, 25 bp, Rattus norvegicus
ggagattatagctgtgtgcctctat

SEQ ID NO: 426538 - DNA, 25 bp, Rattus norvegicus
ggagattatcccctggcaaatgcaa

SEQ ID NO: 426539 - DNA, 25 bp, Rattus norvegicus
ggagattatcccgtggcaaatgcaa

SEQ ID NO: 426540 - DNA, 25 bp, Rattus norvegicus
ggagattatcctctgagttactaag

SEQ ID NO: 426541 - DNA, 25 bp, Rattus norvegicus
ggagattatcctgtgagttactaag

SEQ ID NO: 426542 - DNA, 25 bp, Rattus norvegicus
ggagattattccacgacagctgtgt

SEQ ID NO: 426543 - DNA, 25 bp, Rattus norvegicus
ggagattattcctcgacagctgtgt

SEQ ID NO: 426544 - DNA, 25 bp, Rattus norvegicus
ggagattcaccactgacacaactgt

SEQ ID NO: 426545 - DNA, 25 bp, Rattus norvegicus
ggagattcaccagtgacacaactgt

SEQ ID NO: 426546 - DNA, 25 bp, Rattus norvegicus
ggagattcagccaccttataaacca

SEQ ID NO: 426547 - DNA, 25 bp, Rattus norvegicus
ggagattcagcctccttataaacca

SEQ ID NO: 426548 - DNA, 25 bp, Rattus norvegicus
ggagattcaggacttctgcctcaaa

SEQ ID NO: 426549 - DNA, 25 bp, Rattus norvegicus
ggagattcaggagttctgcctcaaa

SEQ ID NO: 426550 - DNA, 25 bp, Rattus norvegicus
ggagattccaggattccacaggaca

SEQ ID NO: 426551 - DNA, 25 bp, Rattus norvegicus
ggagattccaggtttccacaggaca

SEQ ID NO: 426552 - DNA, 25 bp, Rattus norvegicus
ggagattccggcatggaactagttt

SEQ ID NO: 426553 - DNA, 25 bp, Rattus norvegicus
ggagattccggcttggaactagttt

SEQ ID NO: 426554 - DNA, 25 bp, Rattus norvegicus
ggagattcctgaccagaacattgat

SEQ ID NO: 426555 - DNA, 25 bp, Rattus norvegicus
ggagattcctgagcagaacattgat

SEQ ID NO: 426556 - DNA, 25 bp, Rattus norvegicus
ggagattcggatatagatcctgaaa

SEQ ID NO: 426557 - DNA, 25 bp, Rattus norvegicus
ggagattcggatttagatcctgaaa

SEQ ID NO: 426558 - DNA, 25 bp, Rattus norvegicus
ggagattctcctctactgtttatac

SEQ ID NO: 426559 - DNA, 25 bp, Rattus norvegicus
ggagattctcctgtactgtttatac

SEQ ID NO: 426560 - DNA, 25 bp, Rattus norvegicus
ggagattgaaccaggagccactcta

SEQ ID NO: 426561 - DNA, 25 bp, Rattus norvegicus
ggagattgaacctggagccactcta

SEQ ID NO: 426562 - DNA, 25 bp, Rattus norvegicus
ggagattggatcagcctggtgctct

SEQ ID NO: 426563 - DNA, 25 bp, Rattus norvegicus
ggagattggatctgcctggtgctct

SEQ ID NO: 426564 - DNA, 25 bp, Rattus norvegicus
ggagattgtgcacgccatctacaag

SEQ ID NO: 426565 - DNA, 25 bp, Rattus norvegicus
ggagattgtgcaggccatctacaag

SEQ ID NO: 426566 - DNA, 25 bp, Rattus norvegicus
ggagattgtgctacgtcaaccgagg

SEQ ID NO: 426567 - DNA, 25 bp, Rattus norvegicus
ggagattgtgcttcgtcaaccgagg

SEQ ID NO: 426568 - DNA, 25 bp, Rattus norvegicus
ggagattgtggtccccagtctgaac

SEQ ID NO: 426569 - DNA, 25 bp, Rattus norvegicus
ggagattgtggtgcccagtctgaac

SEQ ID NO: 426570 - DNA, 25 bp, Rattus norvegicus
ggagattgttttacactattcatta

SEQ ID NO: 426571 - DNA, 25 bp, Rattus norvegicus
ggagattgtttttcactattcatta

SEQ ID NO: 426572 - DNA, 25 bp, Rattus norvegicus
ggagatttagcgactgccatgtgaa

SEQ ID NO: 426573 - DNA, 25 bp, Rattus norvegicus
ggagatttagcgtctgccatgtgaa

SEQ ID NO: 426574 - DNA, 25 bp, Rattus norvegicus
ggagatttagtaaccaaaccttgtg

SEQ ID NO: 426575 - DNA, 25 bp, Rattus norvegicus
ggagatttagtatccaaaccttgtg

SEQ ID NO: 426576 - DNA, 25 bp, Rattus norvegicus
ggagatttcacgcaaatggtatggc

SEQ ID NO: 426577 - DNA, 25 bp, Rattus norvegicus
ggagatttcacggaaatggtatggc

SEQ ID NO: 426578 - DNA, 25 bp, Rattus norvegicus
ggagatttccagagcaagatcatgc

SEQ ID NO: 426579 - DNA, 25 bp, Rattus norvegicus
ggagatttccagtgcaagatcatgc

SEQ ID NO: 426580 - DNA, 25 bp, Rattus norvegicus
ggagatttcccaccagaagctgaag

SEQ ID NO: 426581 - DNA, 25 bp, Rattus norvegicus
ggagatttcccagcagaagctgaag

SEQ ID NO: 426582 - DNA, 25 bp, Rattus norvegicus
ggagatttccctactaagacagcta

SEQ ID NO: 426583 - DNA, 25 bp, Rattus norvegicus
ggagatttccctagtgcattcaaga

SEQ ID NO: 426584 - DNA, 25 bp, Rattus norvegicus
ggagatttcccttctaagacagcta

SEQ ID NO: 426585 - DNA, 25 bp, Rattus norvegicus
ggagatttcccttgtgcattcaaga

SEQ ID NO: 426586 - DNA, 25 bp, Rattus norvegicus
ggagatttccttccatatgatttaa

SEQ ID NO: 426587 - DNA, 25 bp, Rattus norvegicus
ggagatttccttgcatatgatttaa

SEQ ID NO: 426588 - DNA, 25 bp, Rattus norvegicus
ggagatttcgttcgccaacctggat

SEQ ID NO: 426589 - DNA, 25 bp, Rattus norvegicus
ggagatttcgttggccaacctggat

SEQ ID NO: 426590 - DNA, 25 bp, Rattus norvegicus
ggagatttctaaagatttgtggcaa

SEQ ID NO: 426591 - DNA, 25 bp, Rattus norvegicus
ggagatttctaatgatttgtggcaa

SEQ ID NO: 426592 - DNA, 25 bp, Rattus norvegicus
ggagatttctacctagccagtgata

SEQ ID NO: 426593 - DNA, 25 bp, Rattus norvegicus
ggagatttctacgtagccagtgata

SEQ ID NO: 426594 - DNA, 25 bp, Rattus norvegicus
ggagatttctctatggctgttggct

SEQ ID NO: 426595 - DNA, 25 bp, Rattus norvegicus
ggagatttctctttggctgttggct

SEQ ID NO: 426596 - DNA, 25 bp, Rattus norvegicus
ggagatttctgacgccattcttgat

SEQ ID NO: 426597 - DNA, 25 bp, Rattus norvegicus
ggagatttctgaggccattcttgat

SEQ ID NO: 426598 - DNA, 25 bp, Rattus norvegicus
ggagatttgcttcaaatgagaaacc

SEQ ID NO: 426599 - DNA, 25 bp, Rattus norvegicus
ggagatttgcttgaaatgagaaacc

SEQ ID NO: 426600 - DNA, 25 bp, Rattus norvegicus
ggagatttgtggaccactttctggt

SEQ ID NO: 426601 - DNA, 25 bp, Rattus norvegicus
ggagatttgtggtccactttctggt

SEQ ID NO: 426602 - DNA, 25 bp, Rattus norvegicus
ggagatttttctacagcactttcta

SEQ ID NO: 426603 - DNA, 25 bp, Rattus norvegicus
ggagatttttcttcagcactttcta

SEQ ID NO: 426604 - DNA, 25 bp, Rattus norvegicus
ggagatttttgtctctgggaaattc

SEQ ID NO: 426605 - DNA, 25 bp, Rattus norvegicus
ggagatttttgtgtctgggaaattc

SEQ ID NO: 426606 - DNA, 25 bp, Rattus norvegicus
ggagcaaaaccacctctgcaatatg

SEQ ID NO: 426607 - DNA, 25 bp, Rattus norvegicus
ggagcaaaaccagctctgcaatatg

SEQ ID NO: 426608 - DNA, 25 bp, Rattus norvegicus
ggagcaaaacttcaggaggcctcta

SEQ ID NO: 426609 - DNA, 25 bp, Rattus norvegicus
ggagcaaaacttgaggaggcctcta

SEQ ID NO: 426610 - DNA, 25 bp, Rattus norvegicus
ggagcaaaagagcagtggtccctaa

SEQ ID NO: 426611 - DNA, 25 bp, Rattus norvegicus
ggagcaaaagaggagtggtccctaa

SEQ ID NO: 426612 - DNA, 25 bp, Rattus norvegicus
ggagcaaacaggatccccatgaggc

SEQ ID NO: 426613 - DNA, 25 bp, Rattus norvegicus
ggagcaaacaggttccccatgaggc

SEQ ID NO: 426614 - DNA, 25 bp, Rattus norvegicus
ggagcaaacatccagctcagtgcct

SEQ ID NO: 426615 - DNA, 25 bp, Rattus norvegicus
ggagcaaacatcgagctcagtgcct

SEQ ID NO: 426616 - DNA, 25 bp, Rattus norvegicus
ggagcaaactgcatccacctgtgac

SEQ ID NO: 426617 - DNA, 25 bp, Rattus norvegicus
ggagcaaactgcttccacctgtgac

SEQ ID NO: 426618 - DNA, 25 bp, Rattus norvegicus
ggagcaaagcaaagaatcacagcaa

SEQ ID NO: 426619 - DNA, 25 bp, Rattus norvegicus
ggagcaaagcaatgaatcacagcaa

SEQ ID NO: 426620 - DNA, 25 bp, Rattus norvegicus
ggagcaaagcatccaaccccacgga

SEQ ID NO: 426621 - DNA, 25 bp, Rattus norvegicus
ggagcaaagcatgcaaccccacgga

SEQ ID NO: 426622 - DNA, 25 bp, Rattus norvegicus
ggagcaaagcgaacatcagggttga

SEQ ID NO: 426623 - DNA, 25 bp, Rattus norvegicus
ggagcaaagcgacctaatacgagag

SEQ ID NO: 426624 - DNA, 25 bp, Rattus norvegicus
ggagcaaagcgagctaatacgagag

SEQ ID NO: 426625 - DNA, 25 bp, Rattus norvegicus
ggagcaaagcgatcatcagggttga

SEQ ID NO: 426626 - DNA, 25 bp, Rattus norvegicus
ggagcaaaggctatccctggtaata

SEQ ID NO: 426627 - DNA, 25 bp, Rattus norvegicus
ggagcaaaggctttccctggtaata

SEQ ID NO: 426628 - DNA, 25 bp, Rattus norvegicus
ggagcaaaggtgactcctacagcct

SEQ ID NO: 426629 - DNA, 25 bp, Rattus norvegicus
ggagcaaaggtgtctcctacagcct

SEQ ID NO: 426630 - DNA, 25 bp, Rattus norvegicus
ggagcaaatcccagaaggaatcagt

SEQ ID NO: 426631 - DNA, 25 bp, Rattus norvegicus
ggagcaaatccctgaaggaatcagt

SEQ ID NO: 426632 - DNA, 25 bp, Rattus norvegicus
ggagcaaatgaacccgtgctgccca

SEQ ID NO: 426633 - DNA, 25 bp, Rattus norvegicus
ggagcaaatgaagccgtgctgccca

SEQ ID NO: 426634 - DNA, 25 bp, Rattus norvegicus
ggagcaaatgctccctggctttgta

SEQ ID NO: 426635 - DNA, 25 bp, Rattus norvegicus
ggagcaaatgctgcctggctttgta

SEQ ID NO: 426636 - DNA, 25 bp, Rattus norvegicus
ggagcaacagcaatgtcacaaacag

SEQ ID NO: 426637 - DNA, 25 bp, Rattus norvegicus
ggagcaacagcattgtcacaaacag

SEQ ID NO: 426638 - DNA, 25 bp, Rattus norvegicus
ggagcaacagtaccagaaattaaga

SEQ ID NO: 426639 - DNA, 25 bp, Rattus norvegicus
ggagcaacagtagcagaaattaaga

SEQ ID NO: 426640 - DNA, 25 bp, Rattus norvegicus
ggagcaacatccatgtgtgtggtat

SEQ ID NO: 426641 - DNA, 25 bp, Rattus norvegicus
ggagcaacatccttgtgtgtggtat

SEQ ID NO: 426642 - DNA, 25 bp, Rattus norvegicus
ggagcaaccacaagtcctacactga

SEQ ID NO: 426643 - DNA, 25 bp, Rattus norvegicus
ggagcaaccacatgtcctacactga

SEQ ID NO: 426644 - DNA, 25 bp, Rattus norvegicus
ggagcaaccgttatctgtatcgtgc

SEQ ID NO: 426645 - DNA, 25 bp, Rattus norvegicus
ggagcaaccgttttctgtatcgtgc

SEQ ID NO: 426646 - DNA, 25 bp, Rattus norvegicus
ggagcaacgacaactcctgcacgcg

SEQ ID NO: 426647 - DNA, 25 bp, Rattus norvegicus
ggagcaacgacatctcctgcacgcg

SEQ ID NO: 426648 - DNA, 25 bp, Rattus norvegicus
ggagcaactctaaagccagccctta

SEQ ID NO: 426649 - DNA, 25 bp, Rattus norvegicus
ggagcaactctatagccagccctta

SEQ ID NO: 426650 - DNA, 25 bp, Rattus norvegicus
ggagcaagacacaacatcactgagc

SEQ ID NO: 426651 - DNA, 25 bp, Rattus norvegicus
ggagcaagacactacatcactgagc

SEQ ID NO: 426652 - DNA, 25 bp, Rattus norvegicus
ggagcaagacttctgtacctacaaa

SEQ ID NO: 426653 - DNA, 25 bp, Rattus norvegicus
ggagcaagacttgtgtacctacaaa

SEQ ID NO: 426654 - DNA, 25 bp, Rattus norvegicus
ggagcaagagtgattggccttcccc

SEQ ID NO: 426655 - DNA, 25 bp, Rattus norvegicus
ggagcaagagtgtttggccttcccc

SEQ ID NO: 426656 - DNA, 25 bp, Rattus norvegicus
ggagcaagatatcttctccctcttt

SEQ ID NO: 426657 - DNA, 25 bp, Rattus norvegicus
ggagcaagatatgttctccctcttt

SEQ ID NO: 426658 - DNA, 25 bp, Rattus norvegicus
ggagcaagatgcaggcccatcagct

SEQ ID NO: 426659 - DNA, 25 bp, Rattus norvegicus
ggagcaagatgctggcccatcagct

SEQ ID NO: 426660 - DNA, 25 bp, Rattus norvegicus
ggagcaagccataaagttactgaga

SEQ ID NO: 426661 - DNA, 25 bp, Rattus norvegicus
ggagcaagccattaagttactgaga

SEQ ID NO: 426662 - DNA, 25 bp, Rattus norvegicus
ggagcaagctgtccttgtccccggc

SEQ ID NO: 426663 - DNA, 25 bp, Rattus norvegicus
ggagcaagctgtgcttgtccccggc

SEQ ID NO: 426664 - DNA, 25 bp, Rattus norvegicus
ggagcaagcttgcagttttcagaaa

SEQ ID NO: 426665 - DNA, 25 bp, Rattus norvegicus
ggagcaagcttggagttttcagaaa

SEQ ID NO: 426666 - DNA, 25 bp, Rattus norvegicus
ggagcaaggaacagctggccttcct

SEQ ID NO: 426667 - DNA, 25 bp, Rattus norvegicus
ggagcaaggaactgctggccttcct

SEQ ID NO: 426668 - DNA, 25 bp, Rattus norvegicus
ggagcaaggacaagatcatcatagt

SEQ ID NO: 426669 - DNA, 25 bp, Rattus norvegicus
ggagcaaggacatgatcatcatagt

SEQ ID NO: 426670 - DNA, 25 bp, Rattus norvegicus
ggagcaaggatgcaccacctttcct

SEQ ID NO: 426671 - DNA, 25 bp, Rattus norvegicus
ggagcaaggatggaccacctttcct

SEQ ID NO: 426672 - DNA, 25 bp, Rattus norvegicus
ggagcaaggctccagttctcaaagg

SEQ ID NO: 426673 - DNA, 25 bp, Rattus norvegicus
ggagcaaggctcgagttctcaaagg

SEQ ID NO: 426674 - DNA, 25 bp, Rattus norvegicus
ggagcaagtaaaattctggctttat

SEQ ID NO: 426675 - DNA, 25 bp, Rattus norvegicus
ggagcaagtaaatttctggctttat

SEQ ID NO: 426676 - DNA, 25 bp, Rattus norvegicus
ggagcaagtcaacatcctgcgcttc

SEQ ID NO: 426677 - DNA, 25 bp, Rattus norvegicus
ggagcaagtcaagatcctgcgcttc

SEQ ID NO: 426678 - DNA, 25 bp, Rattus norvegicus
ggagcaagtccccaagtaggctacc

SEQ ID NO: 426679 - DNA, 25 bp, Rattus norvegicus
ggagcaagtcccgaagtaggctacc

SEQ ID NO: 426680 - DNA, 25 bp, Rattus norvegicus
ggagcaagtctaaaaggcctgctta

SEQ ID NO: 426681 - DNA, 25 bp, Rattus norvegicus
ggagcaagtctataaggcctgctta

SEQ ID NO: 426682 - DNA, 25 bp, Rattus norvegicus
ggagcaagtcttatcagcaagcaat

SEQ ID NO: 426683 - DNA, 25 bp, Rattus norvegicus
ggagcaagtcttttcagcaagcaat

SEQ ID NO: 426684 - DNA, 25 bp, Rattus norvegicus
ggagcaatatttatctttcacactt

SEQ ID NO: 426685 - DNA, 25 bp, Rattus norvegicus
ggagcaatatttttctttcacactt

SEQ ID NO: 426686 - DNA, 25 bp, Rattus norvegicus
ggagcaatcaacacttgcaggcaga

SEQ ID NO: 426687 - DNA, 25 bp, Rattus norvegicus
ggagcaatcaactcttgcaggcaga

SEQ ID NO: 426688 - DNA, 25 bp, Rattus norvegicus
ggagcaatcagtctgcacagcacag

SEQ ID NO: 426689 - DNA, 25 bp, Rattus norvegicus
ggagcaatcagtgtgcacagcacag

SEQ ID NO: 426690 - DNA, 25 bp, Rattus norvegicus
ggagcaatccacattcactagaact

SEQ ID NO: 426691 - DNA, 25 bp, Rattus norvegicus
ggagcaatccactttcactagaact

SEQ ID NO: 426692 - DNA, 25 bp, Rattus norvegicus
ggagcaatgccaaattatccccaga

SEQ ID NO: 426693 - DNA, 25 bp, Rattus norvegicus
ggagcaatgccatattatccccaga

SEQ ID NO: 426694 - DNA, 25 bp, Rattus norvegicus
ggagcaatgctcatcatacacggca

SEQ ID NO: 426695 - DNA, 25 bp, Rattus norvegicus
ggagcaatgctcttcatacacggca

SEQ ID NO: 426696 - DNA, 25 bp, Rattus norvegicus
ggagcaatgtgtctttatctccttt

SEQ ID NO: 426697 - DNA, 25 bp, Rattus norvegicus
ggagcaatgtgtgtttatctccttt

SEQ ID NO: 426698 - DNA, 25 bp, Rattus norvegicus
ggagcaatgttcaacaccattctaa

SEQ ID NO: 426699 - DNA, 25 bp, Rattus norvegicus
ggagcaatgttctacaccattctaa

SEQ ID NO: 426700 - DNA, 25 bp, Rattus norvegicus
ggagcaattccaaaccagctgatgg

SEQ ID NO: 426701 - DNA, 25 bp, Rattus norvegicus
ggagcaattccataccagctgatgg

SEQ ID NO: 426702 - DNA, 25 bp, Rattus norvegicus
ggagcaattgtcaacatcacagaaa

SEQ ID NO: 426703 - DNA, 25 bp, Rattus norvegicus
ggagcaattgtctacatcacagaaa

SEQ ID NO: 426704 - DNA, 25 bp, Rattus norvegicus
ggagcaattttcctgccatcagcaa

SEQ ID NO: 426705 - DNA, 25 bp, Rattus norvegicus
ggagcaattttcgtgccatcagcaa

SEQ ID NO: 426706 - DNA, 25 bp, Rattus norvegicus
ggagcacaaaaccaatcacagcaat

SEQ ID NO: 426707 - DNA, 25 bp, Rattus norvegicus
ggagcacaaaacgaatcacagcaat

SEQ ID NO: 426708 - DNA, 25 bp, Rattus norvegicus
ggagcacaagctatgctgaactcct

SEQ ID NO: 426709 - DNA, 25 bp, Rattus norvegicus
ggagcacaagctttgctgaactcct

SEQ ID NO: 426710 - DNA, 25 bp, Rattus norvegicus
ggagcacaaggtcacctgtgtcctc

SEQ ID NO: 426711 - DNA, 25 bp, Rattus norvegicus
ggagcacaaggtgacctgtgtcctc

SEQ ID NO: 426712 - DNA, 25 bp, Rattus norvegicus
ggagcacaagtcaaacacctactga

SEQ ID NO: 426713 - DNA, 25 bp, Rattus norvegicus
ggagcacaagtctaacacctactga

SEQ ID NO: 426714 - DNA, 25 bp, Rattus norvegicus
ggagcacaatacaaaccctttcagt

SEQ ID NO: 426715 - DNA, 25 bp, Rattus norvegicus
ggagcacaatactaaccctttcagt

SEQ ID NO: 426716 - DNA, 25 bp, Rattus norvegicus
ggagcacaatgtatctatgtaaaga

SEQ ID NO: 426717 - DNA, 25 bp, Rattus norvegicus
ggagcacaatgtttctatgtaaaga

SEQ ID NO: 426718 - DNA, 25 bp, Rattus norvegicus
ggagcacacacaataagagacattt

SEQ ID NO: 426719 - DNA, 25 bp, Rattus norvegicus
ggagcacacacattaagagacattt

SEQ ID NO: 426720 - DNA, 25 bp, Rattus norvegicus
ggagcacacagacgccttgctgttg

SEQ ID NO: 426721 - DNA, 25 bp, Rattus norvegicus
ggagcacacagaggccttgctgttg

SEQ ID NO: 426722 - DNA, 25 bp, Rattus norvegicus
ggagcacacatcatggcctttctga

SEQ ID NO: 426723 - DNA, 25 bp, Rattus norvegicus
ggagcacacatcttggcctttctga

SEQ ID NO: 426724 - DNA, 25 bp, Rattus norvegicus
ggagcacaccataaaagccccaaag

SEQ ID NO: 426725 - DNA, 25 bp, Rattus norvegicus
ggagcacaccattaaagccccaaag

SEQ ID NO: 426726 - DNA, 25 bp, Rattus norvegicus
ggagcacacctccagttactgtaga

SEQ ID NO: 426727 - DNA, 25 bp, Rattus norvegicus
ggagcacacctcgagttactgtaga

SEQ ID NO: 426728 - DNA, 25 bp, Rattus norvegicus
ggagcacacgctccttcagtcaaag

SEQ ID NO: 426729 - DNA, 25 bp, Rattus norvegicus
ggagcacacgctgcttcagtcaaag

SEQ ID NO: 426730 - DNA, 25 bp, Rattus norvegicus
ggagcacagacaataatgccgacct

SEQ ID NO: 426731 - DNA, 25 bp, Rattus norvegicus
ggagcacagacattaatgccgacct

SEQ ID NO: 426732 - DNA, 25 bp, Rattus norvegicus
ggagcacagatactcctcgggctgc

SEQ ID NO: 426733 - DNA, 25 bp, Rattus norvegicus
ggagcacagatagtcctcgggctgc

SEQ ID NO: 426734 - DNA, 25 bp, Rattus norvegicus
ggagcacagccacgacacagatgca

SEQ ID NO: 426735 - DNA, 25 bp, Rattus norvegicus
ggagcacagccaggacacagatgca

SEQ ID NO: 426736 - DNA, 25 bp, Rattus norvegicus
ggagcacagcccatgaagactgaat

SEQ ID NO: 426737 - DNA, 25 bp, Rattus norvegicus
ggagcacagcccttgaagactgaat

SEQ ID NO: 426738 - DNA, 25 bp, Rattus norvegicus
ggagcacagctcatcttggtaagtt

SEQ ID NO: 426739 - DNA, 25 bp, Rattus norvegicus
ggagcacagctcttcttggtaagtt

SEQ ID NO: 426740 - DNA, 25 bp, Rattus norvegicus
ggagcacagggcaggcgtagaaggg

SEQ ID NO: 426741 - DNA, 25 bp, Rattus norvegicus
ggagcacagggctggcgtagaaggg

SEQ ID NO: 426742 - DNA, 25 bp, Rattus norvegicus
ggagcacaggtcatttttatttgaa

SEQ ID NO: 426743 - DNA, 25 bp, Rattus norvegicus
ggagcacaggtcttttttatttgaa

SEQ ID NO: 426744 - DNA, 25 bp, Rattus norvegicus
ggagcacaggtgcacttctctggta

SEQ ID NO: 426745 - DNA, 25 bp, Rattus norvegicus
ggagcacaggtggacttctctggta

SEQ ID NO: 426746 - DNA, 25 bp, Rattus norvegicus
ggagcacagtgacccttttcattct

SEQ ID NO: 426747 - DNA, 25 bp, Rattus norvegicus
ggagcacagtgagccttttcattct

SEQ ID NO: 426748 - DNA, 25 bp, Rattus norvegicus
ggagcacagtgcactcgtctatagt

SEQ ID NO: 426749 - DNA, 25 bp, Rattus norvegicus
ggagcacagtgctctcgtctatagt

SEQ ID NO: 426750 - DNA, 25 bp, Rattus norvegicus
ggagcacatccaaagccagagacaa

SEQ ID NO: 426751 - DNA, 25 bp, Rattus norvegicus
ggagcacatccatagccagagacaa

SEQ ID NO: 426752 - DNA, 25 bp, Rattus norvegicus
ggagcacattccactcattttagtt

SEQ ID NO: 426753 - DNA, 25 bp, Rattus norvegicus
ggagcacattcctctcattttagtt

SEQ ID NO: 426754 - DNA, 25 bp, Rattus norvegicus
ggagcaccacccatgctgggtagag

SEQ ID NO: 426755 - DNA, 25 bp, Rattus norvegicus
ggagcaccacccttgctgggtagag

SEQ ID NO: 426756 - DNA, 25 bp, Rattus norvegicus
ggagcaccagacagagcgcctgcgc

SEQ ID NO: 426757 - DNA, 25 bp, Rattus norvegicus
ggagcaccagactgagcgcctgcgc

SEQ ID NO: 426758 - DNA, 25 bp, Rattus norvegicus
ggagcaccagcgagtcgcacaggat

SEQ ID NO: 426759 - DNA, 25 bp, Rattus norvegicus
ggagcaccagcgtgtcgcacaggat

SEQ ID NO: 426760 - DNA, 25 bp, Rattus norvegicus
ggagcaccaggtatgacccagagta

SEQ ID NO: 426761 - DNA, 25 bp, Rattus norvegicus
ggagcaccaggtttgacccagagta

SEQ ID NO: 426762 - DNA, 25 bp, Rattus norvegicus
ggagcaccagtgactagtccagaat

SEQ ID NO: 426763 - DNA, 25 bp, Rattus norvegicus
ggagcaccagtgtctagtccagaat

SEQ ID NO: 426764 - DNA, 25 bp, Rattus norvegicus
ggagcaccattcatgcctagtggaa

SEQ ID NO: 426765 - DNA, 25 bp, Rattus norvegicus
ggagcaccattcttgcctagtggaa

SEQ ID NO: 426766 - DNA, 25 bp, Rattus norvegicus
ggagcaccctgaaaaagccgtgcca

SEQ ID NO: 426767 - DNA, 25 bp, Rattus norvegicus
ggagcaccctgataaagccgtgcca

SEQ ID NO: 426768 - DNA, 25 bp, Rattus norvegicus
ggagcacctaggattgatacctttc

SEQ ID NO: 426769 - DNA, 25 bp, Rattus norvegicus
ggagcacctaggtttgatacctttc

SEQ ID NO: 426770 - DNA, 25 bp, Rattus norvegicus
ggagcacctcagacaaggcggaagt

SEQ ID NO: 426771 - DNA, 25 bp, Rattus norvegicus
ggagcacctcagtcaaggcggaagt

SEQ ID NO: 426772 - DNA, 25 bp, Rattus norvegicus
ggagcacctccaagctcaccaggag

SEQ ID NO: 426773 - DNA, 25 bp, Rattus norvegicus
ggagcacctccatgctcaccaggag

SEQ ID NO: 426774 - DNA, 25 bp, Rattus norvegicus
ggagcacctggactccggccggcgg

SEQ ID NO: 426775 - DNA, 25 bp, Rattus norvegicus
ggagcacctggagtccggccggcgg

SEQ ID NO: 426776 - DNA, 25 bp, Rattus norvegicus
ggagcacctgtaacatattcactct

SEQ ID NO: 426777 - DNA, 25 bp, Rattus norvegicus
ggagcacctgtatcatattcactct

SEQ ID NO: 426778 - DNA, 25 bp, Rattus norvegicus
ggagcacctgttaggcttgctttca

SEQ ID NO: 426779 - DNA, 25 bp, Rattus norvegicus
ggagcacctgtttggcttgctttca

SEQ ID NO: 426780 - DNA, 25 bp, Rattus norvegicus
ggagcacctttaactggccctatgg

SEQ ID NO: 426781 - DNA, 25 bp, Rattus norvegicus
ggagcacctttatctggccctatgg

SEQ ID NO: 426782 - DNA, 25 bp, Rattus norvegicus
ggagcacgaactcacagctacggga

SEQ ID NO: 426783 - DNA, 25 bp, Rattus norvegicus
ggagcacgaactgacagctacggga

SEQ ID NO: 426784 - DNA, 25 bp, Rattus norvegicus
ggagcacgaggaacgcggccgaagc

SEQ ID NO: 426785 - DNA, 25 bp, Rattus norvegicus
ggagcacgaggatcgcggccgaagc

SEQ ID NO: 426786 - DNA, 25 bp, Rattus norvegicus
ggagcacgctggacgcgccgggaga

SEQ ID NO: 426787 - DNA, 25 bp, Rattus norvegicus
ggagcacgctggtcgcgccgggaga

SEQ ID NO: 426788 - DNA, 25 bp, Rattus norvegicus
ggagcacgcttactatcttcagtat

SEQ ID NO: 426789 - DNA, 25 bp, Rattus norvegicus
ggagcacgcttagtatcttcagtat

SEQ ID NO: 426790 - DNA, 25 bp, Rattus norvegicus
ggagcacgggatatgcacagcatta

SEQ ID NO: 426791 - DNA, 25 bp, Rattus norvegicus
ggagcacgggatttgcacagcatta

SEQ ID NO: 426792 - DNA, 25 bp, Rattus norvegicus
ggagcacggtttcatgcaaactctt

SEQ ID NO: 426793 - DNA, 25 bp, Rattus norvegicus
ggagcacggtttgatgcaaactctt

SEQ ID NO: 426794 - DNA, 25 bp, Rattus norvegicus
ggagcactaaaacctgaagtctctt

SEQ ID NO: 426795 - DNA, 25 bp, Rattus norvegicus
ggagcactaaaagctgaagtctctt

SEQ ID NO: 426796 - DNA, 25 bp, Rattus norvegicus
ggagcactaagccagcctaagccag

SEQ ID NO: 426797 - DNA, 25 bp, Rattus norvegicus
ggagcactaagcgagcctaagccag

SEQ ID NO: 426798 - DNA, 25 bp, Rattus norvegicus
ggagcactacaaccacgccgtcaga

SEQ ID NO: 426799 - DNA, 25 bp, Rattus norvegicus
ggagcactacaagcacgccgtcaga

SEQ ID NO: 426800 - DNA, 25 bp, Rattus norvegicus
ggagcactacatagacctgaaggac

SEQ ID NO: 426801 - DNA, 25 bp, Rattus norvegicus
ggagcactacattgacctgaaggac

SEQ ID NO: 426802 - DNA, 25 bp, Rattus norvegicus
ggagcactaccgctttgtcagcatg

SEQ ID NO: 426803 - DNA, 25 bp, Rattus norvegicus
ggagcactaccggtttgtcagcatg

SEQ ID NO: 426804 - DNA, 25 bp, Rattus norvegicus
ggagcactagctaggagcctgcagc

SEQ ID NO: 426805 - DNA, 25 bp, Rattus norvegicus
ggagcactagcttggagcctgcagc

SEQ ID NO: 426806 - DNA, 25 bp, Rattus norvegicus
ggagcactcctaatacattgttcag

SEQ ID NO: 426807 - DNA, 25 bp, Rattus norvegicus
ggagcactcctattacattgttcag

SEQ ID NO: 426808 - DNA, 25 bp, Rattus norvegicus
ggagcactctaaaatccacgggatt

SEQ ID NO: 426809 - DNA, 25 bp, Rattus norvegicus
ggagcactctaatatccacgggatt

SEQ ID NO: 426810 - DNA, 25 bp, Rattus norvegicus
ggagcactctctctcttgagggaac

SEQ ID NO: 426811 - DNA, 25 bp, Rattus norvegicus
ggagcactctctgtcttgagggaac

SEQ ID NO: 426812 - DNA, 25 bp, Rattus norvegicus
ggagcactctgcaggcactgaagat

SEQ ID NO: 426813 - DNA, 25 bp, Rattus norvegicus
ggagcactctgctggcactgaagat

SEQ ID NO: 426814 - DNA, 25 bp, Rattus norvegicus
ggagcactgactcggagcactgaca

SEQ ID NO: 426815 - DNA, 25 bp, Rattus norvegicus
ggagcactgactgggagcactgaca

SEQ ID NO: 426816 - DNA, 25 bp, Rattus norvegicus
ggagcactgctaccctttactaaga

SEQ ID NO: 426817 - DNA, 25 bp, Rattus norvegicus
ggagcactgctagcctttactaaga

SEQ ID NO: 426818 - DNA, 25 bp, Rattus norvegicus
ggagcactggacagagaaccctgga

SEQ ID NO: 426819 - DNA, 25 bp, Rattus norvegicus
ggagcactggactgagaaccctgga

SEQ ID NO: 426820 - DNA, 25 bp, Rattus norvegicus
ggagcactggcaactgacaatggaa

SEQ ID NO: 426821 - DNA, 25 bp, Rattus norvegicus
ggagcactggcatctgacaatggaa

SEQ ID NO: 426822 - DNA, 25 bp, Rattus norvegicus
ggagcactgttgcaaccctaaaaag

SEQ ID NO: 426823 - DNA, 25 bp, Rattus norvegicus
ggagcactgttggaaccctaaaaag

SEQ ID NO: 426824 - DNA, 25 bp, Rattus norvegicus
ggagcacttcacagaagcactcaag

SEQ ID NO: 426825 - DNA, 25 bp, Rattus norvegicus
ggagcacttcactgaagcactcaag

SEQ ID NO: 426826 - DNA, 25 bp, Rattus norvegicus
ggagcacttctcaggccagttctag

SEQ ID NO: 426827 - DNA, 25 bp, Rattus norvegicus
ggagcacttctcagggacacatggt

SEQ ID NO: 426828 - DNA, 25 bp, Rattus norvegicus
ggagcacttctctggccagttctag

SEQ ID NO: 426829 - DNA, 25 bp, Rattus norvegicus
ggagcacttctctgggacacatggt

SEQ ID NO: 426830 - DNA, 25 bp, Rattus norvegicus
ggagcactttcaaatctatgacact

SEQ ID NO: 426831 - DNA, 25 bp, Rattus norvegicus
ggagcactttcatatctatgacact

SEQ ID NO: 426832 - DNA, 25 bp, Rattus norvegicus
ggagcactttctctctgtagcatag

SEQ ID NO: 426833 - DNA, 25 bp, Rattus norvegicus
ggagcactttctgtctgtagcatag

SEQ ID NO: 426834 - DNA, 25 bp, Rattus norvegicus
ggagcacttttaaatctttgtactt

SEQ ID NO: 426835 - DNA, 25 bp, Rattus norvegicus
ggagcacttttatatctttgtactt

SEQ ID NO: 426836 - DNA, 25 bp, Rattus norvegicus
ggagcagaaacccttatatgaccta

SEQ ID NO: 426837 - DNA, 25 bp, Rattus norvegicus
ggagcagaaaccgttatatgaccta

SEQ ID NO: 426838 - DNA, 25 bp, Rattus norvegicus
ggagcagaacagacgctatttcaag

SEQ ID NO: 426839 - DNA, 25 bp, Rattus norvegicus
ggagcagaacagtcgctatttcaag

SEQ ID NO: 426840 - DNA, 25 bp, Rattus norvegicus
ggagcagaacccaaggtacgctctg

SEQ ID NO: 426841 - DNA, 25 bp, Rattus norvegicus
ggagcagaaccctaggtacgctctg

SEQ ID NO: 426842 - DNA, 25 bp, Rattus norvegicus
ggagcagaatggactcttttgttga

SEQ ID NO: 426843 - DNA, 25 bp, Rattus norvegicus
ggagcagaatggtctcttttgttga

SEQ ID NO: 426844 - DNA, 25 bp, Rattus norvegicus
ggagcagacactacactcatctggg

SEQ ID NO: 426845 - DNA, 25 bp, Rattus norvegicus
ggagcagacacttcactcatctggg

SEQ ID NO: 426846 - DNA, 25 bp, Rattus norvegicus
ggagcagacatcagtggcctccatg

SEQ ID NO: 426847 - DNA, 25 bp, Rattus norvegicus
ggagcagacatctgtggcctccatg

SEQ ID NO: 426848 - DNA, 25 bp, Rattus norvegicus
ggagcagacccgcactcatgaggaa

SEQ ID NO: 426849 - DNA, 25 bp, Rattus norvegicus
ggagcagacccggactcatgaggaa

SEQ ID NO: 426850 - DNA, 25 bp, Rattus norvegicus
ggagcagacgctacggcagcagaaa

SEQ ID NO: 426851 - DNA, 25 bp, Rattus norvegicus
ggagcagacgcttcggcagcagaaa

SEQ ID NO: 426852 - DNA, 25 bp, Rattus norvegicus
ggagcagacgtgctgttacatgact

SEQ ID NO: 426853 - DNA, 25 bp, Rattus norvegicus
ggagcagacgtggtgttacatgact

SEQ ID NO: 426854 - DNA, 25 bp, Rattus norvegicus
ggagcagagaaacaaggaacatttt

SEQ ID NO: 426855 - DNA, 25 bp, Rattus norvegicus
ggagcagagaaagaaggaacatttt

SEQ ID NO: 426856 - DNA, 25 bp, Rattus norvegicus
ggagcagagaccatagaatgaatta

SEQ ID NO: 426857 - DNA, 25 bp, Rattus norvegicus
ggagcagagaccttagaatgaatta

SEQ ID NO: 426858 - DNA, 25 bp, Rattus norvegicus
ggagcagaggacatattttttcatt

SEQ ID NO: 426859 - DNA, 25 bp, Rattus norvegicus
ggagcagaggacattatttccacct

SEQ ID NO: 426860 - DNA, 25 bp, Rattus norvegicus
ggagcagaggacttattttttcatt

SEQ ID NO: 426861 - DNA, 25 bp, Rattus norvegicus
ggagcagaggactttatttccacct

SEQ ID NO: 426862 - DNA, 25 bp, Rattus norvegicus
ggagcagagtagctcactgccctct

SEQ ID NO: 426863 - DNA, 25 bp, Rattus norvegicus
ggagcagagtaggtcactgccctct

SEQ ID NO: 426864 - DNA, 25 bp, Rattus norvegicus
ggagcagagttcaacaatcccgctg

SEQ ID NO: 426865 - DNA, 25 bp, Rattus norvegicus
ggagcagagttctacaatcccgctg

SEQ ID NO: 426866 - DNA, 25 bp, Rattus norvegicus
ggagcagagtttccagagcctaaac

SEQ ID NO: 426867 - DNA, 25 bp, Rattus norvegicus
ggagcagagtttcgccaagcagaat

SEQ ID NO: 426868 - DNA, 25 bp, Rattus norvegicus
ggagcagagtttgcagagcctaaac

SEQ ID NO: 426869 - DNA, 25 bp, Rattus norvegicus
ggagcagagtttggccaagcagaat

SEQ ID NO: 426870 - DNA, 25 bp, Rattus norvegicus
ggagcagatactcttgtcctcagat

SEQ ID NO: 426871 - DNA, 25 bp, Rattus norvegicus
ggagcagatactgttgtcctcagat

SEQ ID NO: 426872 - DNA, 25 bp, Rattus norvegicus
ggagcagatccgcagttacatcaac

SEQ ID NO: 426873 - DNA, 25 bp, Rattus norvegicus
ggagcagatccggagttacatcaac

SEQ ID NO: 426874 - DNA, 25 bp, Rattus norvegicus
ggagcagatgatcattcacaagaca

SEQ ID NO: 426875 - DNA, 25 bp, Rattus norvegicus
ggagcagatgatgattcacaagaca

SEQ ID NO: 426876 - DNA, 25 bp, Rattus norvegicus
ggagcagatgctcatctgtcccatg

SEQ ID NO: 426877 - DNA, 25 bp, Rattus norvegicus
ggagcagatgctgatctgtcccatg

SEQ ID NO: 426878 - DNA, 25 bp, Rattus norvegicus
ggagcagcactcaaagattgacatg

SEQ ID NO: 426879 - DNA, 25 bp, Rattus norvegicus
ggagcagcactctaagattgacatg

SEQ ID NO: 426880 - DNA, 25 bp, Rattus norvegicus
ggagcagcagatcttcatcgaagcc

SEQ ID NO: 426881 - DNA, 25 bp, Rattus norvegicus
ggagcagcagatgttcatcgaagcc

SEQ ID NO: 426882 - DNA, 25 bp, Rattus norvegicus
ggagcagcagcaacacacaagatct

SEQ ID NO: 426883 - DNA, 25 bp, Rattus norvegicus
ggagcagcagcatcacacaagatct

SEQ ID NO: 426884 - DNA, 25 bp, Rattus norvegicus
ggagcagcagccatcaggtgtttat

SEQ ID NO: 426885 - DNA, 25 bp, Rattus norvegicus
ggagcagcagccttcaggtgtttat

SEQ ID NO: 426886 - DNA, 25 bp, Rattus norvegicus
ggagcagcagctctagatctttctg

SEQ ID NO: 426887 - DNA, 25 bp, Rattus norvegicus
ggagcagcagctgtagatctttctg

SEQ ID NO: 426888 - DNA, 25 bp, Rattus norvegicus
ggagcagcagtgatggttccagcac

SEQ ID NO: 426889 - DNA, 25 bp, Rattus norvegicus
ggagcagcagtgttggttccagcac

SEQ ID NO: 426890 - DNA, 25 bp, Rattus norvegicus
ggagcagcatccatggcagcgtcat

SEQ ID NO: 426891 - DNA, 25 bp, Rattus norvegicus
ggagcagcatccttggcagcgtcat

SEQ ID NO: 426892 - DNA, 25 bp, Rattus norvegicus
ggagcagccacaaactaagccattt

SEQ ID NO: 426893 - DNA, 25 bp, Rattus norvegicus
ggagcagccacaatgtctctgttca

SEQ ID NO: 426894 - DNA, 25 bp, Rattus norvegicus
ggagcagccacatactaagccattt

SEQ ID NO: 426895 - DNA, 25 bp, Rattus norvegicus
ggagcagccacattgtctctgttca

SEQ ID NO: 426896 - DNA, 25 bp, Rattus norvegicus
ggagcagccagtcaacgtgccacca

SEQ ID NO: 426897 - DNA, 25 bp, Rattus norvegicus
ggagcagccagtgaacgtgccacca

SEQ ID NO: 426898 - DNA, 25 bp, Rattus norvegicus
ggagcagccatccagcctctgagaa

SEQ ID NO: 426899 - DNA, 25 bp, Rattus norvegicus
ggagcagccatcgagcctctgagaa

SEQ ID NO: 426900 - DNA, 25 bp, Rattus norvegicus
ggagcagccatgaaacgatcatttc

SEQ ID NO: 426901 - DNA, 25 bp, Rattus norvegicus
ggagcagccatgtaacgatcatttc

SEQ ID NO: 426902 - DNA, 25 bp, Rattus norvegicus
ggagcagccattcagcagcgcttca

SEQ ID NO: 426903 - DNA, 25 bp, Rattus norvegicus
ggagcagccattgagcagcgcttca

SEQ ID NO: 426904 - DNA, 25 bp, Rattus norvegicus
ggagcagccccgaacgattcctctg

SEQ ID NO: 426905 - DNA, 25 bp, Rattus norvegicus
ggagcagccccgtacgattcctctg

SEQ ID NO: 426906 - DNA, 25 bp, Rattus norvegicus
ggagcagcccttaggaaccgactca

SEQ ID NO: 426907 - DNA, 25 bp, Rattus norvegicus
ggagcagcccttatggtgttgcaaa

SEQ ID NO: 426908 - DNA, 25 bp, Rattus norvegicus
ggagcagccctttggaaccgactca

SEQ ID NO: 426909 - DNA, 25 bp, Rattus norvegicus
ggagcagcccttttggtgttgcaaa

SEQ ID NO: 426910 - DNA, 25 bp, Rattus norvegicus
ggagcagcctctaaactggaaaact

SEQ ID NO: 426911 - DNA, 25 bp, Rattus norvegicus
ggagcagcctcttaactggaaaact

SEQ ID NO: 426912 - DNA, 25 bp, Rattus norvegicus
ggagcagcctgacagggacttcttt

SEQ ID NO: 426913 - DNA, 25 bp, Rattus norvegicus
ggagcagcctgagagggacttcttt

SEQ ID NO: 426914 - DNA, 25 bp, Rattus norvegicus
ggagcagcctgtctcataaaagttc

SEQ ID NO: 426915 - DNA, 25 bp, Rattus norvegicus
ggagcagcctgtgtcataaaagttc

SEQ ID NO: 426916 - DNA, 25 bp, Rattus norvegicus
ggagcagccttcaagcattccatta

SEQ ID NO: 426917 - DNA, 25 bp, Rattus norvegicus
ggagcagccttctagcattccatta

SEQ ID NO: 426918 - DNA, 25 bp, Rattus norvegicus
ggagcagcgcagacacggcatccat

SEQ ID NO: 426919 - DNA, 25 bp, Rattus norvegicus
ggagcagcgcagtcacggcatccat

SEQ ID NO: 426920 - DNA, 25 bp, Rattus norvegicus
ggagcagcgcgtccacctggaaaac

SEQ ID NO: 426921 - DNA, 25 bp, Rattus norvegicus
ggagcagcgcgtgcacctggaaaac

SEQ ID NO: 426922 - DNA, 25 bp, Rattus norvegicus
ggagcagcggctcacactgacagaa

SEQ ID NO: 426923 - DNA, 25 bp, Rattus norvegicus
ggagcagcggctgacactgacagaa

SEQ ID NO: 426924 - DNA, 25 bp, Rattus norvegicus
ggagcagctaccagtgccggatgca

SEQ ID NO: 426925 - DNA, 25 bp, Rattus norvegicus
ggagcagctacctgtgccggatgca

SEQ ID NO: 426926 - DNA, 25 bp, Rattus norvegicus
ggagcagctcagaacaacggatcta

SEQ ID NO: 426927 - DNA, 25 bp, Rattus norvegicus
ggagcagctcagtacaacggatcta

SEQ ID NO: 426928 - DNA, 25 bp, Rattus norvegicus
ggagcagctcatcttgcacgaagac

SEQ ID NO: 426929 - DNA, 25 bp, Rattus norvegicus
ggagcagctcatgttgcacgaagac

SEQ ID NO: 426930 - DNA, 25 bp, Rattus norvegicus
ggagcagctgaacaccatcgagaaa

SEQ ID NO: 426931 - DNA, 25 bp, Rattus norvegicus
ggagcagctgaagaccatcgagaaa

SEQ ID NO: 426932 - DNA, 25 bp, Rattus norvegicus
ggagcagctgcaccagcttcacggt

SEQ ID NO: 426933 - DNA, 25 bp, Rattus norvegicus
ggagcagctgcagcagcttcacggt

SEQ ID NO: 426934 - DNA, 25 bp, Rattus norvegicus
ggagcagctgctcactatggagacc

SEQ ID NO: 426935 - DNA, 25 bp, Rattus norvegicus
ggagcagctgctgactatggagacc

SEQ ID NO: 426936 - DNA, 25 bp, Rattus norvegicus
ggagcagctggacattacctgttta

SEQ ID NO: 426937 - DNA, 25 bp, Rattus norvegicus
ggagcagctggagattacctgttta

SEQ ID NO: 426938 - DNA, 25 bp, Rattus norvegicus
ggagcagctgtcatacttctgtgac

SEQ ID NO: 426939 - DNA, 25 bp, Rattus norvegicus
ggagcagctgtccatgtcattgact

SEQ ID NO: 426940 - DNA, 25 bp, Rattus norvegicus
ggagcagctgtcgatgtcattgact

SEQ ID NO: 426941 - DNA, 25 bp, Rattus norvegicus
ggagcagctgtcttacttctgtgac

SEQ ID NO: 426942 - DNA, 25 bp, Rattus norvegicus
ggagcagcttccatcggagtccgaa

SEQ ID NO: 426943 - DNA, 25 bp, Rattus norvegicus
ggagcagcttccttcggagtccgaa

SEQ ID NO: 426944 - DNA, 25 bp, Rattus norvegicus
ggagcagcttgacgcacagacgaac

SEQ ID NO: 426945 - DNA, 25 bp, Rattus norvegicus
ggagcagcttgaggcacagacgaac

SEQ ID NO: 426946 - DNA, 25 bp, Rattus norvegicus
ggagcaggaaagctcctcttttcgt

SEQ ID NO: 426947 - DNA, 25 bp, Rattus norvegicus
ggagcaggaaagcttccacacatta

SEQ ID NO: 426948 - DNA, 25 bp, Rattus norvegicus
ggagcaggaaaggtcctcttttcgt

SEQ ID NO: 426949 - DNA, 25 bp, Rattus norvegicus
ggagcaggaaaggttccacacatta

SEQ ID NO: 426950 - DNA, 25 bp, Rattus norvegicus
ggagcaggaactacaaaggctgaaa

SEQ ID NO: 426951 - DNA, 25 bp, Rattus norvegicus
ggagcaggaactccataacctgtcg

SEQ ID NO: 426952 - DNA, 25 bp, Rattus norvegicus
ggagcaggaactgcataacctgtcg

SEQ ID NO: 426953 - DNA, 25 bp, Rattus norvegicus
ggagcaggaacttcaaaggctgaaa

SEQ ID NO: 426954 - DNA, 25 bp, Rattus norvegicus
ggagcaggaagcacagaccccatga

SEQ ID NO: 426955 - DNA, 25 bp, Rattus norvegicus
ggagcaggaagctcagaccccatga

SEQ ID NO: 426956 - DNA, 25 bp, Rattus norvegicus
ggagcaggaaggagcgtcccacctc

SEQ ID NO: 426957 - DNA, 25 bp, Rattus norvegicus
ggagcaggaaggtgcgtcccacctc

SEQ ID NO: 426958 - DNA, 25 bp, Rattus norvegicus
ggagcaggacttaaggaagcaatga

SEQ ID NO: 426959 - DNA, 25 bp, Rattus norvegicus
ggagcaggactttaggaagcaatga

SEQ ID NO: 426960 - DNA, 25 bp, Rattus norvegicus
ggagcaggagccagtttcacatttc

SEQ ID NO: 426961 - DNA, 25 bp, Rattus norvegicus
ggagcaggagcctgtttcacatttc

SEQ ID NO: 426962 - DNA, 25 bp, Rattus norvegicus
ggagcaggcactactctcagagaaa

SEQ ID NO: 426963 - DNA, 25 bp, Rattus norvegicus
ggagcaggcactccagaaacctgga

SEQ ID NO: 426964 - DNA, 25 bp, Rattus norvegicus
ggagcaggcactgcagaaacctgga

SEQ ID NO: 426965 - DNA, 25 bp, Rattus norvegicus
ggagcaggcacttctctcagagaaa

SEQ ID NO: 426966 - DNA, 25 bp, Rattus norvegicus
ggagcaggccaacagcacttagctt

SEQ ID NO: 426967 - DNA, 25 bp, Rattus norvegicus
ggagcaggccaagagcacttagctt

SEQ ID NO: 426968 - DNA, 25 bp, Rattus norvegicus
ggagcaggccctccaggaaagccta

SEQ ID NO: 426969 - DNA, 25 bp, Rattus norvegicus
ggagcaggccctgcaggaaagccta

SEQ ID NO: 426970 - DNA, 25 bp, Rattus norvegicus
ggagcaggccttaagcagcggttaa

SEQ ID NO: 426971 - DNA, 25 bp, Rattus norvegicus
ggagcaggcctttagcagcggttaa

SEQ ID NO: 426972 - DNA, 25 bp, Rattus norvegicus
ggagcaggctgtatgaccagttccg

SEQ ID NO: 426973 - DNA, 25 bp, Rattus norvegicus
ggagcaggctgtttgaccagttccg

SEQ ID NO: 426974 - DNA, 25 bp, Rattus norvegicus
ggagcaggcttgactctggccaaac

SEQ ID NO: 426975 - DNA, 25 bp, Rattus norvegicus
ggagcaggcttgtctctggccaaac

SEQ ID NO: 426976 - DNA, 25 bp, Rattus norvegicus
ggagcaggtccaagggcaagtagtt

SEQ ID NO: 426977 - DNA, 25 bp, Rattus norvegicus
ggagcaggtccatgggcaagtagtt

SEQ ID NO: 426978 - DNA, 25 bp, Rattus norvegicus
ggagcagtacaacagcaccttcaga

SEQ ID NO: 426979 - DNA, 25 bp, Rattus norvegicus
ggagcagtacaagagcaccttcaga

SEQ ID NO: 426980 - DNA, 25 bp, Rattus norvegicus
ggagcagtacagatcgccattatag

SEQ ID NO: 426981 - DNA, 25 bp, Rattus norvegicus
ggagcagtacagttcgccattatag

SEQ ID NO: 426982 - DNA, 25 bp, Rattus norvegicus
ggagcagtacctactgtgttcaaca

SEQ ID NO: 426983 - DNA, 25 bp, Rattus norvegicus
ggagcagtaccttctgtgttcaaca

SEQ ID NO: 426984 - DNA, 25 bp, Rattus norvegicus
ggagcagtaggccagaacttccatc

SEQ ID NO: 426985 - DNA, 25 bp, Rattus norvegicus
ggagcagtaggcgagaacttccatc

SEQ ID NO: 426986 - DNA, 25 bp, Rattus norvegicus
ggagcagtatttaaccattgaccat

SEQ ID NO: 426987 - DNA, 25 bp, Rattus norvegicus
ggagcagtattttaccattgaccat

SEQ ID NO: 426988 - DNA, 25 bp, Rattus norvegicus
ggagcagtcatacatctcggcagaa

SEQ ID NO: 426989 - DNA, 25 bp, Rattus norvegicus
ggagcagtcatagatctcggcagaa

SEQ ID NO: 426990 - DNA, 25 bp, Rattus norvegicus
ggagcagtcatcatgttagttttat

SEQ ID NO: 426991 - DNA, 25 bp, Rattus norvegicus
ggagcagtcatcttgttagttttat

SEQ ID NO: 426992 - DNA, 25 bp, Rattus norvegicus
ggagcagtccaaagatgcccttcac

SEQ ID NO: 426993 - DNA, 25 bp, Rattus norvegicus
ggagcagtccaacaagtcctcgctt

SEQ ID NO: 426994 - DNA, 25 bp, Rattus norvegicus
ggagcagtccaagaagtcctcgctt

SEQ ID NO: 426995 - DNA, 25 bp, Rattus norvegicus
ggagcagtccaatgatgcccttcac

SEQ ID NO: 426996 - DNA, 25 bp, Rattus norvegicus
ggagcagtccatacgttacaactaa

SEQ ID NO: 426997 - DNA, 25 bp, Rattus norvegicus
ggagcagtccatcgaagaactacgt

SEQ ID NO: 426998 - DNA, 25 bp, Rattus norvegicus
ggagcagtccatggaagaactacgt

SEQ ID NO: 426999 - DNA, 25 bp, Rattus norvegicus
ggagcagtccattcgttacaactaa

SEQ ID NO: 427000 - DNA, 25 bp, Rattus norvegicus
ggagcagtcgttcctcttaactact

SEQ ID NO: 427001 - DNA, 25 bp, Rattus norvegicus
ggagcagtcgttgctcttaactact

SEQ ID NO: 427002 - DNA, 25 bp, Rattus norvegicus
ggagcagtctgtatgaggttcttat

SEQ ID NO: 427003 - DNA, 25 bp, Rattus norvegicus
ggagcagtctgtttgaggttcttat

SEQ ID NO: 427004 - DNA, 25 bp, Rattus norvegicus
ggagcagtgcttacttcgaaggtac

SEQ ID NO: 427005 - DNA, 25 bp, Rattus norvegicus
ggagcagtgctttcttcgaaggtac

SEQ ID NO: 427006 - DNA, 25 bp, Rattus norvegicus
ggagcagtggctaacagacttacat

SEQ ID NO: 427007 - DNA, 25 bp, Rattus norvegicus
ggagcagtggcttacagacttacat

SEQ ID NO: 427008 - DNA, 25 bp, Rattus norvegicus
ggagcagtgtgaactctttattcat

SEQ ID NO: 427009 - DNA, 25 bp, Rattus norvegicus
ggagcagtgtgatctctttattcat

SEQ ID NO: 427010 - DNA, 25 bp, Rattus norvegicus
ggagcagttccaccagggcaagctt

SEQ ID NO: 427011 - DNA, 25 bp, Rattus norvegicus
ggagcagttccagcagggcaagctt

SEQ ID NO: 427012 - DNA, 25 bp, Rattus norvegicus
ggagcagttgacactagagccttat

SEQ ID NO: 427013 - DNA, 25 bp, Rattus norvegicus
ggagcagttgactctagagccttat

SEQ ID NO: 427014 - DNA, 25 bp, Rattus norvegicus
ggagcagtttataccgctacaataa

SEQ ID NO: 427015 - DNA, 25 bp, Rattus norvegicus
ggagcagtttattccgctacaataa

SEQ ID NO: 427016 - DNA, 25 bp, Rattus norvegicus
ggagcagtttccacactagcatgtt

SEQ ID NO: 427017 - DNA, 25 bp, Rattus norvegicus
ggagcagtttcctcactagcatgtt

SEQ ID NO: 427018 - DNA, 25 bp, Rattus norvegicus
ggagcagtttgacagcatgaccgat

SEQ ID NO: 427019 - DNA, 25 bp, Rattus norvegicus
ggagcagtttgagagcatgaccgat

SEQ ID NO: 427020 - DNA, 25 bp, Rattus norvegicus
ggagcagtttgcagtcatagactct

SEQ ID NO: 427021 - DNA, 25 bp, Rattus norvegicus
ggagcagtttgctgtcatagactct

SEQ ID NO: 427022 - DNA, 25 bp, Rattus norvegicus
ggagcagtttttactataagccact

SEQ ID NO: 427023 - DNA, 25 bp, Rattus norvegicus
ggagcagttttttctataagccact

SEQ ID NO: 427024 - DNA, 25 bp, Rattus norvegicus
ggagcatacctcagtgatctaggcc

SEQ ID NO: 427025 - DNA, 25 bp, Rattus norvegicus
ggagcatacctctgtgatctaggcc

SEQ ID NO: 427026 - DNA, 25 bp, Rattus norvegicus
ggagcatagacacacaccacagtgt

SEQ ID NO: 427027 - DNA, 25 bp, Rattus norvegicus
ggagcatagacagacaccacagtgt

SEQ ID NO: 427028 - DNA, 25 bp, Rattus norvegicus
ggagcatatcatactctgagagaac

SEQ ID NO: 427029 - DNA, 25 bp, Rattus norvegicus
ggagcatatcattctctgagagaac

SEQ ID NO: 427030 - DNA, 25 bp, Rattus norvegicus
ggagcatatcccaccaggtgtgtta

SEQ ID NO: 427031 - DNA, 25 bp, Rattus norvegicus
ggagcatatccctccaggtgtgtta

SEQ ID NO: 427032 - DNA, 25 bp, Rattus norvegicus
ggagcatatgaacgctggccagtta

SEQ ID NO: 427033 - DNA, 25 bp, Rattus norvegicus
ggagcatatgaaggctggccagtta

SEQ ID NO: 427034 - DNA, 25 bp, Rattus norvegicus
ggagcatcaccaatgaagtcaccag

SEQ ID NO: 427035 - DNA, 25 bp, Rattus norvegicus
ggagcatcaccattgaagtcaccag

SEQ ID NO: 427036 - DNA, 25 bp, Rattus norvegicus
ggagcatcacctaagagattacttt

SEQ ID NO: 427037 - DNA, 25 bp, Rattus norvegicus
ggagcatcaccttagagattacttt

SEQ ID NO: 427038 - DNA, 25 bp, Rattus norvegicus
ggagcatcacttcttcattactttt

SEQ ID NO: 427039 - DNA, 25 bp, Rattus norvegicus
ggagcatcacttgttcattactttt

SEQ ID NO: 427040 - DNA, 25 bp, Rattus norvegicus
ggagcatcagccagggaatctgttt

SEQ ID NO: 427041 - DNA, 25 bp, Rattus norvegicus
ggagcatcagcctgggaatctgttt

SEQ ID NO: 427042 - DNA, 25 bp, Rattus norvegicus
ggagcatcaggcatcttgcagatac

SEQ ID NO: 427043 - DNA, 25 bp, Rattus norvegicus
ggagcatcaggcttcttgcagatac

SEQ ID NO: 427044 - DNA, 25 bp, Rattus norvegicus
ggagcatcatccctgtgtacagcaa

SEQ ID NO: 427045 - DNA, 25 bp, Rattus norvegicus
ggagcatcatccgtgtgtacagcaa

SEQ ID NO: 427046 - DNA, 25 bp, Rattus norvegicus
ggagcatccagaccagtgtccccaa

SEQ ID NO: 427047 - DNA, 25 bp, Rattus norvegicus
ggagcatccagagcagtgtccccaa

SEQ ID NO: 427048 - DNA, 25 bp, Rattus norvegicus
ggagcatcccttatccgaggagcat

SEQ ID NO: 427049 - DNA, 25 bp, Rattus norvegicus
ggagcatcccttttccgaggagcat

SEQ ID NO: 427050 - DNA, 25 bp, Rattus norvegicus
ggagcatccgtgacagacaagagaa

SEQ ID NO: 427051 - DNA, 25 bp, Rattus norvegicus
ggagcatccgtgtcagacaagagaa

SEQ ID NO: 427052 - DNA, 25 bp, Rattus norvegicus
ggagcatcctcactaactactctac

SEQ ID NO: 427053 - DNA, 25 bp, Rattus norvegicus
ggagcatcctcagtaactactctac

SEQ ID NO: 427054 - DNA, 25 bp, Rattus norvegicus
ggagcatcgctgagaaatccctgat

SEQ ID NO: 427055 - DNA, 25 bp, Rattus norvegicus
ggagcatcgctgtgaaatccctgat

SEQ ID NO: 427056 - DNA, 25 bp, Rattus norvegicus
ggagcatcgttcagggagctgacct

SEQ ID NO: 427057 - DNA, 25 bp, Rattus norvegicus
ggagcatcgttctgggagctgacct

SEQ ID NO: 427058 - DNA, 25 bp, Rattus norvegicus
ggagcatctccaaagagttttacag

SEQ ID NO: 427059 - DNA, 25 bp, Rattus norvegicus
ggagcatctccatagagttttacag

SEQ ID NO: 427060 - DNA, 25 bp, Rattus norvegicus
ggagcatctcctactgtaagtgcga

SEQ ID NO: 427061 - DNA, 25 bp, Rattus norvegicus
ggagcatctccttctgtaagtgcga

SEQ ID NO: 427062 - DNA, 25 bp, Rattus norvegicus
ggagcatctgtaccacctagaatct

SEQ ID NO: 427063 - DNA, 25 bp, Rattus norvegicus
ggagcatctgtagcacctagaatct

SEQ ID NO: 427064 - DNA, 25 bp, Rattus norvegicus
ggagcatcttcaacccagtgttgat

SEQ ID NO: 427065 - DNA, 25 bp, Rattus norvegicus
ggagcatcttcatcccagtgttgat

SEQ ID NO: 427066 - DNA, 25 bp, Rattus norvegicus
ggagcatcttttcattatatgtgca

SEQ ID NO: 427067 - DNA, 25 bp, Rattus norvegicus
ggagcatcttttgattatatgtgca

SEQ ID NO: 427068 - DNA, 25 bp, Rattus norvegicus
ggagcatggaatatgacccaggtct

SEQ ID NO: 427069 - DNA, 25 bp, Rattus norvegicus
ggagcatggaatttgacccaggtct

SEQ ID NO: 427070 - DNA, 25 bp, Rattus norvegicus
ggagcatggctgacaccaagcgcta

SEQ ID NO: 427071 - DNA, 25 bp, Rattus norvegicus
ggagcatggctgtcaccaagcgcta

SEQ ID NO: 427072 - DNA, 25 bp, Rattus norvegicus
ggagcatggcttatggtaccacacg

SEQ ID NO: 427073 - DNA, 25 bp, Rattus norvegicus
ggagcatggcttttggtaccacacg

SEQ ID NO: 427074 - DNA, 25 bp, Rattus norvegicus
ggagcatgtgttccttagggccaca

SEQ ID NO: 427075 - DNA, 25 bp, Rattus norvegicus
ggagcatgtgttgcttagggccaca

SEQ ID NO: 427076 - DNA, 25 bp, Rattus norvegicus
ggagcatgttcaagcatctcatttt

SEQ ID NO: 427077 - DNA, 25 bp, Rattus norvegicus
ggagcatgttcatgcatctcatttt

SEQ ID NO: 427078 - DNA, 25 bp, Rattus norvegicus
ggagcattaaaacttccttttggca

SEQ ID NO: 427079 - DNA, 25 bp, Rattus norvegicus
ggagcattaaaagttccttttggca

SEQ ID NO: 427080 - DNA, 25 bp, Rattus norvegicus
ggagcattaacacctcaaggccagc

SEQ ID NO: 427081 - DNA, 25 bp, Rattus norvegicus
ggagcattaacagctcaaggccagc

SEQ ID NO: 427082 - DNA, 25 bp, Rattus norvegicus
ggagcattcactaagcactgggttt

SEQ ID NO: 427083 - DNA, 25 bp, Rattus norvegicus
ggagcattcacttagcactgggttt

SEQ ID NO: 427084 - DNA, 25 bp, Rattus norvegicus
ggagcattcagtatgctgacaccat

SEQ ID NO: 427085 - DNA, 25 bp, Rattus norvegicus
ggagcattcagtttgctgacaccat

SEQ ID NO: 427086 - DNA, 25 bp, Rattus norvegicus
ggagcattctcaatcgagaggcaca

SEQ ID NO: 427087 - DNA, 25 bp, Rattus norvegicus
ggagcattctcacggatctggccta

SEQ ID NO: 427088 - DNA, 25 bp, Rattus norvegicus
ggagcattctcagggatctggccta

SEQ ID NO: 427089 - DNA, 25 bp, Rattus norvegicus
ggagcattctcattcgagaggcaca

SEQ ID NO: 427090 - DNA, 25 bp, Rattus norvegicus
ggagcattctgtagacatcgtcttc

SEQ ID NO: 427091 - DNA, 25 bp, Rattus norvegicus
ggagcattctgttgacatcgtcttc

SEQ ID NO: 427092 - DNA, 25 bp, Rattus norvegicus
ggagcattcttcagactctgaatac

SEQ ID NO: 427093 - DNA, 25 bp, Rattus norvegicus
ggagcattcttctgactctgaatac

SEQ ID NO: 427094 - DNA, 25 bp, Rattus norvegicus
ggagcattgcccactccggagggaa

SEQ ID NO: 427095 - DNA, 25 bp, Rattus norvegicus
ggagcattgccctctccggagggaa

SEQ ID NO: 427096 - DNA, 25 bp, Rattus norvegicus
ggagcattgcgccaaactgtacagc

SEQ ID NO: 427097 - DNA, 25 bp, Rattus norvegicus
ggagcattgcgcgaaactgtacagc

SEQ ID NO: 427098 - DNA, 25 bp, Rattus norvegicus
ggagcattgcttccaaacagtggtt

SEQ ID NO: 427099 - DNA, 25 bp, Rattus norvegicus
ggagcattgcttgcaaacagtggtt

SEQ ID NO: 427100 - DNA, 25 bp, Rattus norvegicus
ggagcattggccacgacacaagcga

SEQ ID NO: 427101 - DNA, 25 bp, Rattus norvegicus
ggagcattggcctcgacacaagcga

SEQ ID NO: 427102 - DNA, 25 bp, Rattus norvegicus
ggagcattggctacggcagctacag

SEQ ID NO: 427103 - DNA, 25 bp, Rattus norvegicus
ggagcattggctctaatatcccata

SEQ ID NO: 427104 - DNA, 25 bp, Rattus norvegicus
ggagcattggctgtaatatcccata

SEQ ID NO: 427105 - DNA, 25 bp, Rattus norvegicus
ggagcattggcttcggcagctacag

SEQ ID NO: 427106 - DNA, 25 bp, Rattus norvegicus
ggagcattgtctcctcttccataga

SEQ ID NO: 427107 - DNA, 25 bp, Rattus norvegicus
ggagcattgtctgctcttccataga

SEQ ID NO: 427108 - DNA, 25 bp, Rattus norvegicus
ggagcattgtgcatccaacacgtac

SEQ ID NO: 427109 - DNA, 25 bp, Rattus norvegicus
ggagcattgtgcttccaacacgtac

SEQ ID NO: 427110 - DNA, 25 bp, Rattus norvegicus
ggagcattgtgtatgagtgccccac

SEQ ID NO: 427111 - DNA, 25 bp, Rattus norvegicus
ggagcattgtgtttgagtgccccac

SEQ ID NO: 427112 - DNA, 25 bp, Rattus norvegicus
ggagcattgttgacttcccaaggga

SEQ ID NO: 427113 - DNA, 25 bp, Rattus norvegicus
ggagcattgttgtcttcccaaggga

SEQ ID NO: 427114 - DNA, 25 bp, Rattus norvegicus
ggagcatttatcaatagcactgaca

SEQ ID NO: 427115 - DNA, 25 bp, Rattus norvegicus
ggagcatttatctatagcactgaca

SEQ ID NO: 427116 - DNA, 25 bp, Rattus norvegicus
ggagcatttattcccttaccagaaa

SEQ ID NO: 427117 - DNA, 25 bp, Rattus norvegicus
ggagcatttattgccttaccagaaa

SEQ ID NO: 427118 - DNA, 25 bp, Rattus norvegicus
ggagcatttcaaactgctttcctgc

SEQ ID NO: 427119 - DNA, 25 bp, Rattus norvegicus
ggagcatttcaatctgctttcctgc

SEQ ID NO: 427120 - DNA, 25 bp, Rattus norvegicus
ggagcatttcaccttttagatatta

SEQ ID NO: 427121 - DNA, 25 bp, Rattus norvegicus
ggagcatttcacgttttagatatta

SEQ ID NO: 427122 - DNA, 25 bp, Rattus norvegicus
ggagccaaaattagtgtttgcccaa

SEQ ID NO: 427123 - DNA, 25 bp, Rattus norvegicus
ggagccaaaatttgtgtttgcccaa

SEQ ID NO: 427124 - DNA, 25 bp, Rattus norvegicus
ggagccaaagccaatggagtgccca

SEQ ID NO: 427125 - DNA, 25 bp, Rattus norvegicus
ggagccaaagcctatggagtgccca

SEQ ID NO: 427126 - DNA, 25 bp, Rattus norvegicus
ggagccaaataacaccccaaaatga

SEQ ID NO: 427127 - DNA, 25 bp, Rattus norvegicus
ggagccaaataagaccccaaaatga

SEQ ID NO: 427128 - DNA, 25 bp, Rattus norvegicus
ggagccaacaccacagtagtgctgt

SEQ ID NO: 427129 - DNA, 25 bp, Rattus norvegicus
ggagccaacacctcagtagtgctgt

SEQ ID NO: 427130 - DNA, 25 bp, Rattus norvegicus
ggagccaagagcaataagccctaca

SEQ ID NO: 427131 - DNA, 25 bp, Rattus norvegicus
ggagccaagagctataagccctaca

SEQ ID NO: 427132 - DNA, 25 bp, Rattus norvegicus
ggagccaagagtactccggtggcca

SEQ ID NO: 427133 - DNA, 25 bp, Rattus norvegicus
ggagccaagagttctccggtggcca

SEQ ID NO: 427134 - DNA, 25 bp, Rattus norvegicus
ggagccaagcagacctgatgcagat

SEQ ID NO: 427135 - DNA, 25 bp, Rattus norvegicus
ggagccaagcagtcctgatgcagat

SEQ ID NO: 427136 - DNA, 25 bp, Rattus norvegicus
ggagccaaggacaggtctacgacca

SEQ ID NO: 427137 - DNA, 25 bp, Rattus norvegicus
ggagccaaggactggtctacgacca

SEQ ID NO: 427138 - DNA, 25 bp, Rattus norvegicus
ggagccaaggatcccagccaccgtg

SEQ ID NO: 427139 - DNA, 25 bp, Rattus norvegicus
ggagccaaggatgccagccaccgtg

SEQ ID NO: 427140 - DNA, 25 bp, Rattus norvegicus
ggagccaaggtaatctagagacaca

SEQ ID NO: 427141 - DNA, 25 bp, Rattus norvegicus
ggagccaaggtattctagagacaca

SEQ ID NO: 427142 - DNA, 25 bp, Rattus norvegicus
ggagccaaggtcaatggttttttga

SEQ ID NO: 427143 - DNA, 25 bp, Rattus norvegicus
ggagccaaggtctatggttttttga

SEQ ID NO: 427144 - DNA, 25 bp, Rattus norvegicus
ggagccaagtagacagttaccacca

SEQ ID NO: 427145 - DNA, 25 bp, Rattus norvegicus
ggagccaagtagtcagttaccacca

SEQ ID NO: 427146 - DNA, 25 bp, Rattus norvegicus
ggagccaagttccttacagcagagg

SEQ ID NO: 427147 - DNA, 25 bp, Rattus norvegicus
ggagccaagttcgttacagcagagg

SEQ ID NO: 427148 - DNA, 25 bp, Rattus norvegicus
ggagccaatccaattggcatactct

SEQ ID NO: 427149 - DNA, 25 bp, Rattus norvegicus
ggagccaatccatttggcatactct

SEQ ID NO: 427150 - DNA, 25 bp, Rattus norvegicus
ggagccaattgcaattatcataaca

SEQ ID NO: 427151 - DNA, 25 bp, Rattus norvegicus
ggagccaattgctattatcataaca

SEQ ID NO: 427152 - DNA, 25 bp, Rattus norvegicus
ggagccacaactatttgttttgcat

SEQ ID NO: 427153 - DNA, 25 bp, Rattus norvegicus
ggagccacaactttttgttttgcat

SEQ ID NO: 427154 - DNA, 25 bp, Rattus norvegicus
ggagccacaaggacttggacagcca

SEQ ID NO: 427155 - DNA, 25 bp, Rattus norvegicus
ggagccacaaggtcttggacagcca

SEQ ID NO: 427156 - DNA, 25 bp, Rattus norvegicus
ggagccacacgcagcaatggttagt

SEQ ID NO: 427157 - DNA, 25 bp, Rattus norvegicus
ggagccacacgctgcaatggttagt

SEQ ID NO: 427158 - DNA, 25 bp, Rattus norvegicus
ggagccacactaatggtccatgtcc

SEQ ID NO: 427159 - DNA, 25 bp, Rattus norvegicus
ggagccacactattggtccatgtcc

SEQ ID NO: 427160 - DNA, 25 bp, Rattus norvegicus
ggagccacagatccttgtacagtac

SEQ ID NO: 427161 - DNA, 25 bp, Rattus norvegicus
ggagccacagatgcttgtacagtac

SEQ ID NO: 427162 - DNA, 25 bp, Rattus norvegicus
ggagccacagcaactttgattgtct

SEQ ID NO: 427163 - DNA, 25 bp, Rattus norvegicus
ggagccacagcatctttgattgtct

SEQ ID NO: 427164 - DNA, 25 bp, Rattus norvegicus
ggagccacagccagcacacatgaat

SEQ ID NO: 427165 - DNA, 25 bp, Rattus norvegicus
ggagccacagcctgcacacatgaat

SEQ ID NO: 427166 - DNA, 25 bp, Rattus norvegicus
ggagccacagtcattggaagggaca

SEQ ID NO: 427167 - DNA, 25 bp, Rattus norvegicus
ggagccacagtctttggaagggaca

SEQ ID NO: 427168 - DNA, 25 bp, Rattus norvegicus
ggagccacatggacaatggtgccta

SEQ ID NO: 427169 - DNA, 25 bp, Rattus norvegicus
ggagccacatggtcaatggtgccta

SEQ ID NO: 427170 - DNA, 25 bp, Rattus norvegicus
ggagccaccctgagtgttggcagta

SEQ ID NO: 427171 - DNA, 25 bp, Rattus norvegicus
ggagccaccctgtgtgttggcagta

SEQ ID NO: 427172 - DNA, 25 bp, Rattus norvegicus
ggagccacctacatccatgggagga

SEQ ID NO: 427173 - DNA, 25 bp, Rattus norvegicus
ggagccacctacttccatgggagga

SEQ ID NO: 427174 - DNA, 25 bp, Rattus norvegicus
ggagccacctgtaggagtttccgcg

SEQ ID NO: 427175 - DNA, 25 bp, Rattus norvegicus
ggagccacctgttggagtttccgcg

SEQ ID NO: 427176 - DNA, 25 bp, Rattus norvegicus
ggagccacggttctgtaattctgtt

SEQ ID NO: 427177 - DNA, 25 bp, Rattus norvegicus
ggagccacggttgtgtaattctgtt

SEQ ID NO: 427178 - DNA, 25 bp, Rattus norvegicus
ggagccacgtgtatttatcgctgac

SEQ ID NO: 427179 - DNA, 25 bp, Rattus norvegicus
ggagccacgtgtttttatcgctgac

SEQ ID NO: 427180 - DNA, 25 bp, Rattus norvegicus
ggagccactccaatcccttgggtcc

SEQ ID NO: 427181 - DNA, 25 bp, Rattus norvegicus
ggagccactccattcccttgggtcc

SEQ ID NO: 427182 - DNA, 25 bp, Rattus norvegicus
ggagccactgctaagctgtgtacca

SEQ ID NO: 427183 - DNA, 25 bp, Rattus norvegicus
ggagccactgcttagctgtgtacca

SEQ ID NO: 427184 - DNA, 25 bp, Rattus norvegicus
ggagccagaactctgactccaggat

SEQ ID NO: 427185 - DNA, 25 bp, Rattus norvegicus
ggagccagaactgtgactccaggat

SEQ ID NO: 427186 - DNA, 25 bp, Rattus norvegicus
ggagccagaatcctctttagcaata

SEQ ID NO: 427187 - DNA, 25 bp, Rattus norvegicus
ggagccagaatcgtctttagcaata

SEQ ID NO: 427188 - DNA, 25 bp, Rattus norvegicus
ggagccagaccccacgtggtagacc

SEQ ID NO: 427189 - DNA, 25 bp, Rattus norvegicus
ggagccagacccgacgtggtagacc

SEQ ID NO: 427190 - DNA, 25 bp, Rattus norvegicus
ggagccagagatcgtgccctgccca

SEQ ID NO: 427191 - DNA, 25 bp, Rattus norvegicus
ggagccagagatggtgccctgccca

SEQ ID NO: 427192 - DNA, 25 bp, Rattus norvegicus
ggagccagagctaagtatcaccctc

SEQ ID NO: 427193 - DNA, 25 bp, Rattus norvegicus
ggagccagagcttagtatcaccctc

SEQ ID NO: 427194 - DNA, 25 bp, Rattus norvegicus
ggagccagcaatccctagtggtgta

SEQ ID NO: 427195 - DNA, 25 bp, Rattus norvegicus
ggagccagcaatgcctagtggtgta

SEQ ID NO: 427196 - DNA, 25 bp, Rattus norvegicus
ggagccagcagaaacagtttaaaca

SEQ ID NO: 427197 - DNA, 25 bp, Rattus norvegicus
ggagccagcagatacagtttaaaca

SEQ ID NO: 427198 - DNA, 25 bp, Rattus norvegicus
ggagccagcaggagttctaaccatc

SEQ ID NO: 427199 - DNA, 25 bp, Rattus norvegicus
ggagccagcaggtgttctaaccatc

SEQ ID NO: 427200 - DNA, 25 bp, Rattus norvegicus
ggagccagcccacgcaacttgttag

SEQ ID NO: 427201 - DNA, 25 bp, Rattus norvegicus
ggagccagcccaggcaacttgttag

SEQ ID NO: 427202 - DNA, 25 bp, Rattus norvegicus
ggagccagcctcagagcacaaaggg

SEQ ID NO: 427203 - DNA, 25 bp, Rattus norvegicus
ggagccagcctctgagcacaaaggg

SEQ ID NO: 427204 - DNA, 25 bp, Rattus norvegicus
ggagccagctgccttagatgccaac

SEQ ID NO: 427205 - DNA, 25 bp, Rattus norvegicus
ggagccagctgcgttagatgccaac

SEQ ID NO: 427206 - DNA, 25 bp, Rattus norvegicus
ggagccagctggaagtttctagatc

SEQ ID NO: 427207 - DNA, 25 bp, Rattus norvegicus
ggagccagctggtagtttctagatc

SEQ ID NO: 427208 - DNA, 25 bp, Rattus norvegicus
ggagccagcttgcaaaatcttgaat

SEQ ID NO: 427209 - DNA, 25 bp, Rattus norvegicus
ggagccagcttggaaaatcttgaat

SEQ ID NO: 427210 - DNA, 25 bp, Rattus norvegicus
ggagccaggaacagaagtccccaaa

SEQ ID NO: 427211 - DNA, 25 bp, Rattus norvegicus
ggagccaggaacaggcgggccttga

SEQ ID NO: 427212 - DNA, 25 bp, Rattus norvegicus
ggagccaggaactgaagtccccaaa

SEQ ID NO: 427213 - DNA, 25 bp, Rattus norvegicus
ggagccaggaactggcgggccttga

SEQ ID NO: 427214 - DNA, 25 bp, Rattus norvegicus
ggagccaggagactttctgccctct

SEQ ID NO: 427215 - DNA, 25 bp, Rattus norvegicus
ggagccaggagagtttctgccctct

SEQ ID NO: 427216 - DNA, 25 bp, Rattus norvegicus
ggagccagggccactaagactgctg

SEQ ID NO: 427217 - DNA, 25 bp, Rattus norvegicus
ggagccagggcctctaagactgctg

SEQ ID NO: 427218 - DNA, 25 bp, Rattus norvegicus
ggagccagtactatcagaaccagag

SEQ ID NO: 427219 - DNA, 25 bp, Rattus norvegicus
ggagccagtactttcagaaccagag

SEQ ID NO: 427220 - DNA, 25 bp, Rattus norvegicus
ggagccagtatacacgtgtcctgtg

SEQ ID NO: 427221 - DNA, 25 bp, Rattus norvegicus
ggagccagtatagacgtgtcctgtg

SEQ ID NO: 427222 - DNA, 25 bp, Rattus norvegicus
ggagccagtattctttatcctgact

SEQ ID NO: 427223 - DNA, 25 bp, Rattus norvegicus
ggagccagtattgtttatcctgact

SEQ ID NO: 427224 - DNA, 25 bp, Rattus norvegicus
ggagccagtcagaccttgaaattcc

SEQ ID NO: 427225 - DNA, 25 bp, Rattus norvegicus
ggagccagtcagtccttgaaattcc

SEQ ID NO: 427226 - DNA, 25 bp, Rattus norvegicus
ggagccagtccaaagaagtgtgtct

SEQ ID NO: 427227 - DNA, 25 bp, Rattus norvegicus
ggagccagtccatagaagtgtgtct

SEQ ID NO: 427228 - DNA, 25 bp, Rattus norvegicus
ggagccagtctaaagtgcacagcca

SEQ ID NO: 427229 - DNA, 25 bp, Rattus norvegicus
ggagccagtctatagtgcacagcca

SEQ ID NO: 427230 - DNA, 25 bp, Rattus norvegicus
ggagccagtgctattagaggagctg

SEQ ID NO: 427231 - DNA, 25 bp, Rattus norvegicus
ggagccagtgcttttagaggagctg

SEQ ID NO: 427232 - DNA, 25 bp, Rattus norvegicus
ggagccatacaacttctacctgacc

SEQ ID NO: 427233 - DNA, 25 bp, Rattus norvegicus
ggagccatacaagttctacctgacc

SEQ ID NO: 427234 - DNA, 25 bp, Rattus norvegicus
ggagccataggacccacttagacca

SEQ ID NO: 427235 - DNA, 25 bp, Rattus norvegicus
ggagccataggagccacttagacca

SEQ ID NO: 427236 - DNA, 25 bp, Rattus norvegicus
ggagccatatctagacggcacagat

SEQ ID NO: 427237 - DNA, 25 bp, Rattus norvegicus
ggagccatatcttgacggcacagat

SEQ ID NO: 427238 - DNA, 25 bp, Rattus norvegicus
ggagccatcaagacctggtgactaa

SEQ ID NO: 427239 - DNA, 25 bp, Rattus norvegicus
ggagccatcaagtcctggtgactaa

SEQ ID NO: 427240 - DNA, 25 bp, Rattus norvegicus
ggagccatcattcgaactctggcca

SEQ ID NO: 427241 - DNA, 25 bp, Rattus norvegicus
ggagccatcattggaactctggcca

SEQ ID NO: 427242 - DNA, 25 bp, Rattus norvegicus
ggagccatcctacatcaaaggagat

SEQ ID NO: 427243 - DNA, 25 bp, Rattus norvegicus
ggagccatcctagatcaaaggagat

SEQ ID NO: 427244 - DNA, 25 bp, Rattus norvegicus
ggagccatgctgctgacatattctg

SEQ ID NO: 427245 - DNA, 25 bp, Rattus norvegicus
ggagccatgctggtgacatattctg

SEQ ID NO: 427246 - DNA, 25 bp, Rattus norvegicus
ggagccatggccatggtgaagctac

SEQ ID NO: 427247 - DNA, 25 bp, Rattus norvegicus
ggagccatggccttggtgaagctac

SEQ ID NO: 427248 - DNA, 25 bp, Rattus norvegicus
ggagccatgggcattgtgcaactaa

SEQ ID NO: 427249 - DNA, 25 bp, Rattus norvegicus
ggagccatgggctttgtgcaactaa

SEQ ID NO: 427250 - DNA, 25 bp, Rattus norvegicus
ggagccatggtacacttcggtagtt

SEQ ID NO: 427251 - DNA, 25 bp, Rattus norvegicus
ggagccatggtagacttcggtagtt

SEQ ID NO: 427252 - DNA, 25 bp, Rattus norvegicus
ggagccatggtcatctgagtcagga

SEQ ID NO: 427253 - DNA, 25 bp, Rattus norvegicus
ggagccatggtcttctgagtcagga

SEQ ID NO: 427254 - DNA, 25 bp, Rattus norvegicus
ggagccatgtagctgatttgtttac

SEQ ID NO: 427255 - DNA, 25 bp, Rattus norvegicus
ggagccatgtaggtgatttgtttac

SEQ ID NO: 427256 - DNA, 25 bp, Rattus norvegicus
ggagccatgtatccacacttcagat

SEQ ID NO: 427257 - DNA, 25 bp, Rattus norvegicus
ggagccatgtatgcacacttcagat

SEQ ID NO: 427258 - DNA, 25 bp, Rattus norvegicus
ggagccatgtgacaagtccgtcttc

SEQ ID NO: 427259 - DNA, 25 bp, Rattus norvegicus
ggagccatgtgagaagtccgtcttc

SEQ ID NO: 427260 - DNA, 25 bp, Rattus norvegicus
ggagccattaaaatcacctgttagc

SEQ ID NO: 427261 - DNA, 25 bp, Rattus norvegicus
ggagccattaaattcacctgttagc

SEQ ID NO: 427262 - DNA, 25 bp, Rattus norvegicus
ggagccattaggaccaacagggaca

SEQ ID NO: 427263 - DNA, 25 bp, Rattus norvegicus
ggagccattaggtccaacagggaca

SEQ ID NO: 427264 - DNA, 25 bp, Rattus norvegicus
ggagccattgatcaacctggacgta

SEQ ID NO: 427265 - DNA, 25 bp, Rattus norvegicus
ggagccattgatgaacctggacgta

SEQ ID NO: 427266 - DNA, 25 bp, Rattus norvegicus
ggagccattggcaccgtcggagcac

SEQ ID NO: 427267 - DNA, 25 bp, Rattus norvegicus
ggagccattggcatggtgcctaaag

SEQ ID NO: 427268 - DNA, 25 bp, Rattus norvegicus
ggagccattggctccgtcggagcac

SEQ ID NO: 427269 - DNA, 25 bp, Rattus norvegicus
ggagccattggcttggtgcctaaag

SEQ ID NO: 427270 - DNA, 25 bp, Rattus norvegicus
ggagccatttatctcagttgaggtt

SEQ ID NO: 427271 - DNA, 25 bp, Rattus norvegicus
ggagccatttatgtcagttgaggtt

SEQ ID NO: 427272 - DNA, 25 bp, Rattus norvegicus
ggagccattttccatttgcgacaat

SEQ ID NO: 427273 - DNA, 25 bp, Rattus norvegicus
ggagccattttcgatttgcgacaat

SEQ ID NO: 427274 - DNA, 25 bp, Rattus norvegicus
ggagcccaagccagcccaggctttt

SEQ ID NO: 427275 - DNA, 25 bp, Rattus norvegicus
ggagcccaagcctgcccaggctttt

SEQ ID NO: 427276 - DNA, 25 bp, Rattus norvegicus
ggagcccacatcaaatcactgactg

SEQ ID NO: 427277 - DNA, 25 bp, Rattus norvegicus
ggagcccacatcacagtatttctga

SEQ ID NO: 427278 - DNA, 25 bp, Rattus norvegicus
ggagcccacatctaatcactgactg

SEQ ID NO: 427279 - DNA, 25 bp, Rattus norvegicus
ggagcccacatctcagtatttctga

SEQ ID NO: 427280 - DNA, 25 bp, Rattus norvegicus
ggagcccacgtccttttctaaatgc

SEQ ID NO: 427281 - DNA, 25 bp, Rattus norvegicus
ggagcccacgtcgttttctaaatgc

SEQ ID NO: 427282 - DNA, 25 bp, Rattus norvegicus
ggagcccagacaacttggagttcaa

SEQ ID NO: 427283 - DNA, 25 bp, Rattus norvegicus
ggagcccagacatcttggagttcaa

SEQ ID NO: 427284 - DNA, 25 bp, Rattus norvegicus
ggagcccagagcatacctacctgga

SEQ ID NO: 427285 - DNA, 25 bp, Rattus norvegicus
ggagcccagagcttacctacctgga

SEQ ID NO: 427286 - DNA, 25 bp, Rattus norvegicus
ggagcccagcaaagtagccaatgac

SEQ ID NO: 427287 - DNA, 25 bp, Rattus norvegicus
ggagcccagcaacacaatagaacat

SEQ ID NO: 427288 - DNA, 25 bp, Rattus norvegicus
ggagcccagcaagacaatagaacat

SEQ ID NO: 427289 - DNA, 25 bp, Rattus norvegicus
ggagcccagcaatgtagccaatgac

SEQ ID NO: 427290 - DNA, 25 bp, Rattus norvegicus
ggagcccagctgctaagaccaagat

SEQ ID NO: 427291 - DNA, 25 bp, Rattus norvegicus
ggagcccagctggtaagaccaagat

SEQ ID NO: 427292 - DNA, 25 bp, Rattus norvegicus
ggagcccagggaaagtaatcttgcc

SEQ ID NO: 427293 - DNA, 25 bp, Rattus norvegicus
ggagcccagggaacggccccgggag

SEQ ID NO: 427294 - DNA, 25 bp, Rattus norvegicus
ggagcccagggatagtaatcttgcc

SEQ ID NO: 427295 - DNA, 25 bp, Rattus norvegicus
ggagcccagggatcggccccgggag

SEQ ID NO: 427296 - DNA, 25 bp, Rattus norvegicus
ggagcccagggtcgcgccgggagac

SEQ ID NO: 427297 - DNA, 25 bp, Rattus norvegicus
ggagcccagggtggcgccgggagac

SEQ ID NO: 427298 - DNA, 25 bp, Rattus norvegicus
ggagcccagttccacgtacagtgaa

SEQ ID NO: 427299 - DNA, 25 bp, Rattus norvegicus
ggagcccagttcgacgtacagtgaa

SEQ ID NO: 427300 - DNA, 25 bp, Rattus norvegicus
ggagcccatttcacccgatgtggac

SEQ ID NO: 427301 - DNA, 25 bp, Rattus norvegicus
ggagcccatttctcccgatgtggac

SEQ ID NO: 427302 - DNA, 25 bp, Rattus norvegicus
ggagcccatttgactcagccatggg

SEQ ID NO: 427303 - DNA, 25 bp, Rattus norvegicus
ggagcccatttgtctcagccatggg

SEQ ID NO: 427304 - DNA, 25 bp, Rattus norvegicus
ggagccccaaataagtagcccagga

SEQ ID NO: 427305 - DNA, 25 bp, Rattus norvegicus
ggagccccaaattagtagcccagga

SEQ ID NO: 427306 - DNA, 25 bp, Rattus norvegicus
ggagccccagatcctttgaaagtct

SEQ ID NO: 427307 - DNA, 25 bp, Rattus norvegicus
ggagccccagatgctttgaaagtct

SEQ ID NO: 427308 - DNA, 25 bp, Rattus norvegicus
ggagccccaggcaatcatggcattt

SEQ ID NO: 427309 - DNA, 25 bp, Rattus norvegicus
ggagccccaggctatcatggcattt

SEQ ID NO: 427310 - DNA, 25 bp, Rattus norvegicus
ggagccccatgcaacatgagacagg

SEQ ID NO: 427311 - DNA, 25 bp, Rattus norvegicus
ggagccccatgctacatgagacagg

SEQ ID NO: 427312 - DNA, 25 bp, Rattus norvegicus
ggagccccgcctcaggtgtcctaaa

SEQ ID NO: 427313 - DNA, 25 bp, Rattus norvegicus
ggagccccgcctgaggtgtcctaaa

SEQ ID NO: 427314 - DNA, 25 bp, Rattus norvegicus
ggagcccctggaagtcaaggaccaa

SEQ ID NO: 427315 - DNA, 25 bp, Rattus norvegicus
ggagcccctggatgtcaaggaccaa

SEQ ID NO: 427316 - DNA, 25 bp, Rattus norvegicus
ggagcccgagcgcagcgcagctcag

SEQ ID NO: 427317 - DNA, 25 bp, Rattus norvegicus
ggagcccgagcggagcgcagctcag

SEQ ID NO: 427318 - DNA, 25 bp, Rattus norvegicus
ggagcccgcggcaggagaaacctgg

SEQ ID NO: 427319 - DNA, 25 bp, Rattus norvegicus
ggagcccgcggctggagaaacctgg

SEQ ID NO: 427320 - DNA, 25 bp, Rattus norvegicus
ggagcccggttcaccttcaaggaat

SEQ ID NO: 427321 - DNA, 25 bp, Rattus norvegicus
ggagcccggttctccttcaaggaat

SEQ ID NO: 427322 - DNA, 25 bp, Rattus norvegicus
ggagcccgtcttagtgggatagtta

SEQ ID NO: 427323 - DNA, 25 bp, Rattus norvegicus
ggagcccgtctttgtgggatagtta

SEQ ID NO: 427324 - DNA, 25 bp, Rattus norvegicus
ggagcccgttaccaaagcagcacag

SEQ ID NO: 427325 - DNA, 25 bp, Rattus norvegicus
ggagcccgttacgaaagcagcacag

SEQ ID NO: 427326 - DNA, 25 bp, Rattus norvegicus
ggagccctaaacctttatctccatt

SEQ ID NO: 427327 - DNA, 25 bp, Rattus norvegicus
ggagccctaaacgtttatctccatt

SEQ ID NO: 427328 - DNA, 25 bp, Rattus norvegicus
ggagccctacatcgttttgatacgt

SEQ ID NO: 427329 - DNA, 25 bp, Rattus norvegicus
ggagccctacatggttttgatacgt

SEQ ID NO: 427330 - DNA, 25 bp, Rattus norvegicus
ggagccctacgaccccgagaagaag

SEQ ID NO: 427331 - DNA, 25 bp, Rattus norvegicus
ggagccctacgagcccgagaagaag

SEQ ID NO: 427332 - DNA, 25 bp, Rattus norvegicus
ggagccctagaaatatcaccaacct

SEQ ID NO: 427333 - DNA, 25 bp, Rattus norvegicus
ggagccctagaattatcaccaacct

SEQ ID NO: 427334 - DNA, 25 bp, Rattus norvegicus
ggagccctatccagtgtaaatgttc

SEQ ID NO: 427335 - DNA, 25 bp, Rattus norvegicus
ggagccctatcctgtgtaaatgttc

SEQ ID NO: 427336 - DNA, 25 bp, Rattus norvegicus
ggagccctatgacccagagaagaaa

SEQ ID NO: 427337 - DNA, 25 bp, Rattus norvegicus
ggagccctatgagccagagaagaaa

SEQ ID NO: 427338 - DNA, 25 bp, Rattus norvegicus
ggagccctcttgattatcttatcag

SEQ ID NO: 427339 - DNA, 25 bp, Rattus norvegicus
ggagccctcttgtttatcttatcag

SEQ ID NO: 427340 - DNA, 25 bp, Rattus norvegicus
ggagccctgagtaccgagagaccga

SEQ ID NO: 427341 - DNA, 25 bp, Rattus norvegicus
ggagccctgagttccgagagaccga

SEQ ID NO: 427342 - DNA, 25 bp, Rattus norvegicus
ggagccctgcagactcagagaacta

SEQ ID NO: 427343 - DNA, 25 bp, Rattus norvegicus
ggagccctgcagtctcagagaacta

SEQ ID NO: 427344 - DNA, 25 bp, Rattus norvegicus
ggagccctgccaatgctggagtctg

SEQ ID NO: 427345 - DNA, 25 bp, Rattus norvegicus
ggagccctgccattgctggagtctg

SEQ ID NO: 427346 - DNA, 25 bp, Rattus norvegicus
ggagccctgctcaatgtgtttgtct

SEQ ID NO: 427347 - DNA, 25 bp, Rattus norvegicus
ggagccctgctctatgtgtttgtct

SEQ ID NO: 427348 - DNA, 25 bp, Rattus norvegicus
ggagccctgctgagtcatagacatt

SEQ ID NO: 427349 - DNA, 25 bp, Rattus norvegicus
ggagccctgctgtgtcatagacatt

SEQ ID NO: 427350 - DNA, 25 bp, Rattus norvegicus
ggagccctgcttaggcgcgctttga

SEQ ID NO: 427351 - DNA, 25 bp, Rattus norvegicus
ggagccctgctttggcgcgctttga

SEQ ID NO: 427352 - DNA, 25 bp, Rattus norvegicus
ggagccctggaaacaaacagactgt

SEQ ID NO: 427353 - DNA, 25 bp, Rattus norvegicus
ggagccctggaatcaaacagactgt

SEQ ID NO: 427354 - DNA, 25 bp, Rattus norvegicus
ggagccctggacattgaggacactt

SEQ ID NO: 427355 - DNA, 25 bp, Rattus norvegicus
ggagccctggactttgaggacactt

SEQ ID NO: 427356 - DNA, 25 bp, Rattus norvegicus
ggagccctggcgctatctgcagtct

SEQ ID NO: 427357 - DNA, 25 bp, Rattus norvegicus
ggagccctggcggtatctgcagtct

SEQ ID NO: 427358 - DNA, 25 bp, Rattus norvegicus
ggagccctgggaagccttaacagac

SEQ ID NO: 427359 - DNA, 25 bp, Rattus norvegicus
ggagccctgggatgccttaacagac

SEQ ID NO: 427360 - DNA, 25 bp, Rattus norvegicus
ggagccctgggcattctggaccctt

SEQ ID NO: 427361 - DNA, 25 bp, Rattus norvegicus
ggagccctgggctttctggaccctt

SEQ ID NO: 427362 - DNA, 25 bp, Rattus norvegicus
ggagccctgtccagagaaccaaatt

SEQ ID NO: 427363 - DNA, 25 bp, Rattus norvegicus
ggagccctgtcctgagaaccaaatt

SEQ ID NO: 427364 - DNA, 25 bp, Rattus norvegicus
ggagcccttaagatgcacgatggaa

SEQ ID NO: 427365 - DNA, 25 bp, Rattus norvegicus
ggagcccttaagttgcacgatggaa

SEQ ID NO: 427366 - DNA, 25 bp, Rattus norvegicus
ggagcccttcctcacaaacgtggag

SEQ ID NO: 427367 - DNA, 25 bp, Rattus norvegicus
ggagcccttcctgacaaacgtggag

SEQ ID NO: 427368 - DNA, 25 bp, Rattus norvegicus
ggagcccttctacataatgtctgtt

SEQ ID NO: 427369 - DNA, 25 bp, Rattus norvegicus
ggagcccttctagataatgtctgtt

SEQ ID NO: 427370 - DNA, 25 bp, Rattus norvegicus
ggagcccttcttaggcaggcagtta

SEQ ID NO: 427371 - DNA, 25 bp, Rattus norvegicus
ggagcccttctttggcaggcagtta

SEQ ID NO: 427372 - DNA, 25 bp, Rattus norvegicus
ggagcccttgtgctggtacatagcc

SEQ ID NO: 427373 - DNA, 25 bp, Rattus norvegicus
ggagcccttgtggtggtacatagcc

SEQ ID NO: 427374 - DNA, 25 bp, Rattus norvegicus
ggagccgaatcacatgacctagcca

SEQ ID NO: 427375 - DNA, 25 bp, Rattus norvegicus
ggagccgaatcagatgacctagcca

SEQ ID NO: 427376 - DNA, 25 bp, Rattus norvegicus
ggagccgacaaactcaacaccttct

SEQ ID NO: 427377 - DNA, 25 bp, Rattus norvegicus
ggagccgacaaagtcaacaccttct

SEQ ID NO: 427378 - DNA, 25 bp, Rattus norvegicus
ggagccgaccttcaatacaacttaa

SEQ ID NO: 427379 - DNA, 25 bp, Rattus norvegicus
ggagccgaccttgaatacaacttaa

SEQ ID NO: 427380 - DNA, 25 bp, Rattus norvegicus
ggagccgagaacaatccctctagat

SEQ ID NO: 427381 - DNA, 25 bp, Rattus norvegicus
ggagccgagaactatccctctagat

SEQ ID NO: 427382 - DNA, 25 bp, Rattus norvegicus
ggagccgagcggagtacatctcagt

SEQ ID NO: 427383 - DNA, 25 bp, Rattus norvegicus
ggagccgagcggtgtacatctcagt

SEQ ID NO: 427384 - DNA, 25 bp, Rattus norvegicus
ggagccgagtgaacctttagaccct

SEQ ID NO: 427385 - DNA, 25 bp, Rattus norvegicus
ggagccgagtgatcctttagaccct

SEQ ID NO: 427386 - DNA, 25 bp, Rattus norvegicus
ggagccgatattcagcttcttccta

SEQ ID NO: 427387 - DNA, 25 bp, Rattus norvegicus
ggagccgatattgagcttcttccta

SEQ ID NO: 427388 - DNA, 25 bp, Rattus norvegicus
ggagccgatctaacagtggtcacag

SEQ ID NO: 427389 - DNA, 25 bp, Rattus norvegicus
ggagccgatctatcagtggtcacag

SEQ ID NO: 427390 - DNA, 25 bp, Rattus norvegicus
ggagccgatggaaactgatgataac

SEQ ID NO: 427391 - DNA, 25 bp, Rattus norvegicus
ggagccgatggatactgatgataac

SEQ ID NO: 427392 - DNA, 25 bp, Rattus norvegicus
ggagccgcaaacaccacagagaagt

SEQ ID NO: 427393 - DNA, 25 bp, Rattus norvegicus
ggagccgcaaactccacagagaagt

SEQ ID NO: 427394 - DNA, 25 bp, Rattus norvegicus
ggagccgccttcaggatcaccatcg

SEQ ID NO: 427395 - DNA, 25 bp, Rattus norvegicus
ggagccgccttctggatcaccatcg

SEQ ID NO: 427396 - DNA, 25 bp, Rattus norvegicus
ggagccggaactaggacgtgcaact

SEQ ID NO: 427397 - DNA, 25 bp, Rattus norvegicus
ggagccggaacttggacgtgcaact

SEQ ID NO: 427398 - DNA, 25 bp, Rattus norvegicus
ggagccggagcccaagttttcttct

SEQ ID NO: 427399 - DNA, 25 bp, Rattus norvegicus
ggagccggagccgaagttttcttct

SEQ ID NO: 427400 - DNA, 25 bp, Rattus norvegicus
ggagccggcagaccaaaacaaagga

SEQ ID NO: 427401 - DNA, 25 bp, Rattus norvegicus
ggagccggcagagcaaaacaaagga

SEQ ID NO: 427402 - DNA, 25 bp, Rattus norvegicus
ggagccggtgacactaccctgcggc

SEQ ID NO: 427403 - DNA, 25 bp, Rattus norvegicus
ggagccggtgactctaccctgcggc

SEQ ID NO: 427404 - DNA, 25 bp, Rattus norvegicus
ggagccgtacctacagtgacaagat

SEQ ID NO: 427405 - DNA, 25 bp, Rattus norvegicus
ggagccgtaccttcagtgacaagat

SEQ ID NO: 427406 - DNA, 25 bp, Rattus norvegicus
ggagccgtggaacccaaatctttat

SEQ ID NO: 427407 - DNA, 25 bp, Rattus norvegicus
ggagccgtggaagccaaatctttat

SEQ ID NO: 427408 - DNA, 25 bp, Rattus norvegicus
ggagccgtggacacatcatgtgtca

SEQ ID NO: 427409 - DNA, 25 bp, Rattus norvegicus
ggagccgtggactcatcatgtgtca

SEQ ID NO: 427410 - DNA, 25 bp, Rattus norvegicus
ggagccgtttcaaccacaggacatg

SEQ ID NO: 427411 - DNA, 25 bp, Rattus norvegicus
ggagccgtttcatccacaggacatg

SEQ ID NO: 427412 - DNA, 25 bp, Rattus norvegicus
ggagccgtttgtacatttcatcact

SEQ ID NO: 427413 - DNA, 25 bp, Rattus norvegicus
ggagccgtttgttcatttcatcact

SEQ ID NO: 427414 - DNA, 25 bp, Rattus norvegicus
ggagccgttttgcacacgttactgt

SEQ ID NO: 427415 - DNA, 25 bp, Rattus norvegicus
ggagccgttttggacacgttactgt

SEQ ID NO: 427416 - DNA, 25 bp, Rattus norvegicus
ggagcctaaacaacagtcactgtga

SEQ ID NO: 427417 - DNA, 25 bp, Rattus norvegicus
ggagcctaaacatcagtcactgtga

SEQ ID NO: 427418 - DNA, 25 bp, Rattus norvegicus
ggagcctaaatgaaatgtctatatg

SEQ ID NO: 427419 - DNA, 25 bp, Rattus norvegicus
ggagcctaaatgtaatgtctatatg

SEQ ID NO: 427420 - DNA, 25 bp, Rattus norvegicus
ggagcctaaccactgggacgcgact

SEQ ID NO: 427421 - DNA, 25 bp, Rattus norvegicus
ggagcctaaccagtgggacgcgact

SEQ ID NO: 427422 - DNA, 25 bp, Rattus norvegicus
ggagcctaagagcactcgagctttt

SEQ ID NO: 427423 - DNA, 25 bp, Rattus norvegicus
ggagcctaagaggactcgagctttt

SEQ ID NO: 427424 - DNA, 25 bp, Rattus norvegicus
ggagcctaattgatttcgtccttat

SEQ ID NO: 427425 - DNA, 25 bp, Rattus norvegicus
ggagcctaattgttttcgtccttat

SEQ ID NO: 427426 - DNA, 25 bp, Rattus norvegicus
ggagcctacatgcttcaaatacaag

SEQ ID NO: 427427 - DNA, 25 bp, Rattus norvegicus
ggagcctacatggttcaaatacaag

SEQ ID NO: 427428 - DNA, 25 bp, Rattus norvegicus
ggagcctaccagcaacctgactggg

SEQ ID NO: 427429 - DNA, 25 bp, Rattus norvegicus
ggagcctaccaggaacctgactggg

SEQ ID NO: 427430 - DNA, 25 bp, Rattus norvegicus
ggagcctactatactgccaggaagt

SEQ ID NO: 427431 - DNA, 25 bp, Rattus norvegicus
ggagcctactattctgccaggaagt

SEQ ID NO: 427432 - DNA, 25 bp, Rattus norvegicus
ggagcctactgacctgactgagaat

SEQ ID NO: 427433 - DNA, 25 bp, Rattus norvegicus
ggagcctactgagctgactgagaat

SEQ ID NO: 427434 - DNA, 25 bp, Rattus norvegicus
ggagcctacttacatagatctgaac

SEQ ID NO: 427435 - DNA, 25 bp, Rattus norvegicus
ggagcctacttagatagatctgaac

SEQ ID NO: 427436 - DNA, 25 bp, Rattus norvegicus
ggagcctagacacggttctacttcc

SEQ ID NO: 427437 - DNA, 25 bp, Rattus norvegicus
ggagcctagacagggttctacttcc

SEQ ID NO: 427438 - DNA, 25 bp, Rattus norvegicus
ggagcctagatcaatcactttgcca

SEQ ID NO: 427439 - DNA, 25 bp, Rattus norvegicus
ggagcctagatctatcactttgcca

SEQ ID NO: 427440 - DNA, 25 bp, Rattus norvegicus
ggagcctagctccatggaggcctct

SEQ ID NO: 427441 - DNA, 25 bp, Rattus norvegicus
ggagcctagctcgatggaggcctct

SEQ ID NO: 427442 - DNA, 25 bp, Rattus norvegicus
ggagcctaggacaatgtttctctaa

SEQ ID NO: 427443 - DNA, 25 bp, Rattus norvegicus
ggagcctaggactatgtttctctaa

SEQ ID NO: 427444 - DNA, 25 bp, Rattus norvegicus
ggagcctaggagacattcttttcat

SEQ ID NO: 427445 - DNA, 25 bp, Rattus norvegicus
ggagcctaggagtcattcttttcat

SEQ ID NO: 427446 - DNA, 25 bp, Rattus norvegicus
ggagcctagtttactcagcatcaat

SEQ ID NO: 427447 - DNA, 25 bp, Rattus norvegicus
ggagcctagttttctcagcatcaat

SEQ ID NO: 427448 - DNA, 25 bp, Rattus norvegicus
ggagcctatcggacagcttgtctat

SEQ ID NO: 427449 - DNA, 25 bp, Rattus norvegicus
ggagcctatcggtcagcttgtctat

SEQ ID NO: 427450 - DNA, 25 bp, Rattus norvegicus
ggagcctatgggaacccttacatgc

SEQ ID NO: 427451 - DNA, 25 bp, Rattus norvegicus
ggagcctatgggtacccttacatgc

SEQ ID NO: 427452 - DNA, 25 bp, Rattus norvegicus
ggagcctattgaagtctgagctata

SEQ ID NO: 427453 - DNA, 25 bp, Rattus norvegicus
ggagcctattgatgtctgagctata

SEQ ID NO: 427454 - DNA, 25 bp, Rattus norvegicus
ggagcctcacagcagcgctgtttaa

SEQ ID NO: 427455 - DNA, 25 bp, Rattus norvegicus
ggagcctcacaggagcgctgtttaa

SEQ ID NO: 427456 - DNA, 25 bp, Rattus norvegicus
ggagcctcagccagtgtaggtcccc

SEQ ID NO: 427457 - DNA, 25 bp, Rattus norvegicus
ggagcctcagcctgtgtaggtcccc

SEQ ID NO: 427458 - DNA, 25 bp, Rattus norvegicus
ggagcctcagtcctttgaggttaac

SEQ ID NO: 427459 - DNA, 25 bp, Rattus norvegicus
ggagcctcagtcgtttgaggttaac

SEQ ID NO: 427460 - DNA, 25 bp, Rattus norvegicus
ggagcctcataaactgttgcacctg

SEQ ID NO: 427461 - DNA, 25 bp, Rattus norvegicus
ggagcctcataatctgttgcacctg

SEQ ID NO: 427462 - DNA, 25 bp, Rattus norvegicus
ggagcctcatctctgtcaagacagt

SEQ ID NO: 427463 - DNA, 25 bp, Rattus norvegicus
ggagcctcatctgtgtcaagacagt

SEQ ID NO: 427464 - DNA, 25 bp, Rattus norvegicus
ggagcctcatgtccatagggcaaga

SEQ ID NO: 427465 - DNA, 25 bp, Rattus norvegicus
ggagcctcatgtgcatagggcaaga

SEQ ID NO: 427466 - DNA, 25 bp, Rattus norvegicus
ggagcctccaatccaagatttgatc

SEQ ID NO: 427467 - DNA, 25 bp, Rattus norvegicus
ggagcctccaatgcaagatttgatc

SEQ ID NO: 427468 - DNA, 25 bp, Rattus norvegicus
ggagcctccagtattagaattgtct

SEQ ID NO: 427469 - DNA, 25 bp, Rattus norvegicus
ggagcctccagtcccttgtataaag

SEQ ID NO: 427470 - DNA, 25 bp, Rattus norvegicus
ggagcctccagtgccttgtataaag

SEQ ID NO: 427471 - DNA, 25 bp, Rattus norvegicus
ggagcctccagttttagaattgtct

SEQ ID NO: 427472 - DNA, 25 bp, Rattus norvegicus
ggagcctcccacagggtgaagagac

SEQ ID NO: 427473 - DNA, 25 bp, Rattus norvegicus
ggagcctcccactgggtgaagagac

SEQ ID NO: 427474 - DNA, 25 bp, Rattus norvegicus
ggagcctccgccaatgaaatcttct

SEQ ID NO: 427475 - DNA, 25 bp, Rattus norvegicus
ggagcctccgcctatgaaatcttct

SEQ ID NO: 427476 - DNA, 25 bp, Rattus norvegicus
ggagcctcctgtcagactatctggt

SEQ ID NO: 427477 - DNA, 25 bp, Rattus norvegicus
ggagcctcctgtgagactatctggt

SEQ ID NO: 427478 - DNA, 25 bp, Rattus norvegicus
ggagcctcctttagttgccattttg

SEQ ID NO: 427479 - DNA, 25 bp, Rattus norvegicus
ggagcctcctttcaaactgtgaatc

SEQ ID NO: 427480 - DNA, 25 bp, Rattus norvegicus
ggagcctcctttgaaactgtgaatc

SEQ ID NO: 427481 - DNA, 25 bp, Rattus norvegicus
ggagcctccttttgttgccattttg

SEQ ID NO: 427482 - DNA, 25 bp, Rattus norvegicus
ggagcctcggctatagattagaact

SEQ ID NO: 427483 - DNA, 25 bp, Rattus norvegicus
ggagcctcggctctcaagactggat

SEQ ID NO: 427484 - DNA, 25 bp, Rattus norvegicus
ggagcctcggctgtcaagactggat

SEQ ID NO: 427485 - DNA, 25 bp, Rattus norvegicus
ggagcctcggctttagattagaact

SEQ ID NO: 427486 - DNA, 25 bp, Rattus norvegicus
ggagcctcgtagatcccgacggtga

SEQ ID NO: 427487 - DNA, 25 bp, Rattus norvegicus
ggagcctcgtagttcccgacggtga

SEQ ID NO: 427488 - DNA, 25 bp, Rattus norvegicus
ggagcctcgtgaaggatcctagaat

SEQ ID NO: 427489 - DNA, 25 bp, Rattus norvegicus
ggagcctcgtgatggatcctagaat

SEQ ID NO: 427490 - DNA, 25 bp, Rattus norvegicus
ggagcctctagtcaaaatctggcac

SEQ ID NO: 427491 - DNA, 25 bp, Rattus norvegicus
ggagcctctagtgaaaatctggcac

SEQ ID NO: 427492 - DNA, 25 bp, Rattus norvegicus
ggagcctctgaaattacacactgaa

SEQ ID NO: 427493 - DNA, 25 bp, Rattus norvegicus
ggagcctctgaatttacacactgaa

SEQ ID NO: 427494 - DNA, 25 bp, Rattus norvegicus
ggagcctctgagacactgaacttgg

SEQ ID NO: 427495 - DNA, 25 bp, Rattus norvegicus
ggagcctctgagtcactgaacttgg

SEQ ID NO: 427496 - DNA, 25 bp, Rattus norvegicus
ggagcctctggtatgtaggagacac

SEQ ID NO: 427497 - DNA, 25 bp, Rattus norvegicus
ggagcctctggtttgtaggagacac

SEQ ID NO: 427498 - DNA, 25 bp, Rattus norvegicus
ggagcctgacaacaggacctacctc

SEQ ID NO: 427499 - DNA, 25 bp, Rattus norvegicus
ggagcctgacaagaggacctacctc

SEQ ID NO: 427500 - DNA, 25 bp, Rattus norvegicus
ggagcctgagatctccagaatgctt

SEQ ID NO: 427501 - DNA, 25 bp, Rattus norvegicus
ggagcctgagatgtccagaatgctt

SEQ ID NO: 427502 - DNA, 25 bp, Rattus norvegicus
ggagcctgatgcagcattgggagct

SEQ ID NO: 427503 - DNA, 25 bp, Rattus norvegicus
ggagcctgatgctgcattgggagct

SEQ ID NO: 427504 - DNA, 25 bp, Rattus norvegicus
ggagcctgcagaatacaactctcaa

SEQ ID NO: 427505 - DNA, 25 bp, Rattus norvegicus
ggagcctgcagattacaactctcaa

SEQ ID NO: 427506 - DNA, 25 bp, Rattus norvegicus
ggagcctgcaggattcttcataagc

SEQ ID NO: 427507 - DNA, 25 bp, Rattus norvegicus
ggagcctgcaggtttcttcataagc

SEQ ID NO: 427508 - DNA, 25 bp, Rattus norvegicus
ggagcctgcgaacgtcaagctgctt

SEQ ID NO: 427509 - DNA, 25 bp, Rattus norvegicus
ggagcctgcgaaggtcaagctgctt

SEQ ID NO: 427510 - DNA, 25 bp, Rattus norvegicus
ggagcctgctatagcatttacagat

SEQ ID NO: 427511 - DNA, 25 bp, Rattus norvegicus
ggagcctgctattgcatttacagat

SEQ ID NO: 427512 - DNA, 25 bp, Rattus norvegicus
ggagcctgctcgagcaaacggtaca

SEQ ID NO: 427513 - DNA, 25 bp, Rattus norvegicus
ggagcctgctcgtgcaaacggtaca

SEQ ID NO: 427514 - DNA, 25 bp, Rattus norvegicus
ggagcctgctctagggaatgatact

SEQ ID NO: 427515 - DNA, 25 bp, Rattus norvegicus
ggagcctgctcttgggaatgatact

SEQ ID NO: 427516 - DNA, 25 bp, Rattus norvegicus
ggagcctgctggaagcggaacggta

SEQ ID NO: 427517 - DNA, 25 bp, Rattus norvegicus
ggagcctgctggtagcggaacggta

SEQ ID NO: 427518 - DNA, 25 bp, Rattus norvegicus
ggagcctggagaaatcccagcccta

SEQ ID NO: 427519 - DNA, 25 bp, Rattus norvegicus
ggagcctggagatatcccagcccta

SEQ ID NO: 427520 - DNA, 25 bp, Rattus norvegicus
ggagcctggctcctgtattataagg

SEQ ID NO: 427521 - DNA, 25 bp, Rattus norvegicus
ggagcctggctcgtgtattataagg

SEQ ID NO: 427522 - DNA, 25 bp, Rattus norvegicus
ggagcctggctgagagcttaccctt

SEQ ID NO: 427523 - DNA, 25 bp, Rattus norvegicus
ggagcctggctgagcaccaacgaag

SEQ ID NO: 427524 - DNA, 25 bp, Rattus norvegicus
ggagcctggctgtgagcttaccctt

SEQ ID NO: 427525 - DNA, 25 bp, Rattus norvegicus
ggagcctggctgtgcaccaacgaag

SEQ ID NO: 427526 - DNA, 25 bp, Rattus norvegicus
ggagcctgggtgacattctgtacat

SEQ ID NO: 427527 - DNA, 25 bp, Rattus norvegicus
ggagcctgggtgtcattctgtacat

SEQ ID NO: 427528 - DNA, 25 bp, Rattus norvegicus
ggagcctgtaaaaatgacacctgct

SEQ ID NO: 427529 - DNA, 25 bp, Rattus norvegicus
ggagcctgtaaatatgacacctgct

SEQ ID NO: 427530 - DNA, 25 bp, Rattus norvegicus
ggagcctgtcaacatctcttactgg

SEQ ID NO: 427531 - DNA, 25 bp, Rattus norvegicus
ggagcctgtcaagatctcttactgg

SEQ ID NO: 427532 - DNA, 25 bp, Rattus norvegicus
ggagcctgtcatagtttccttggag

SEQ ID NO: 427533 - DNA, 25 bp, Rattus norvegicus
ggagcctgtcattgtttccttggag

SEQ ID NO: 427534 - DNA, 25 bp, Rattus norvegicus
ggagcctgtcggatatgtatatttt

SEQ ID NO: 427535 - DNA, 25 bp, Rattus norvegicus
ggagcctgtcggttatgtatatttt

SEQ ID NO: 427536 - DNA, 25 bp, Rattus norvegicus
ggagcctgtgaacccaatctgaacc

SEQ ID NO: 427537 - DNA, 25 bp, Rattus norvegicus
ggagcctgtgaagccaatctgaacc

SEQ ID NO: 427538 - DNA, 25 bp, Rattus norvegicus
ggagcctgtgccacgaaaggtccgt

SEQ ID NO: 427539 - DNA, 25 bp, Rattus norvegicus
ggagcctgtgcctcgaaaggtccgt

SEQ ID NO: 427540 - DNA, 25 bp, Rattus norvegicus
ggagcctgtggcatcaagaaccatc

SEQ ID NO: 427541 - DNA, 25 bp, Rattus norvegicus
ggagcctgtggcttcaagaaccatc

SEQ ID NO: 427542 - DNA, 25 bp, Rattus norvegicus
ggagcctgtggtcccagaactgccc

SEQ ID NO: 427543 - DNA, 25 bp, Rattus norvegicus
ggagcctgtggtgccagaactgccc

SEQ ID NO: 427544 - DNA, 25 bp, Rattus norvegicus
ggagcctgttagcaagcttcggatt

SEQ ID NO: 427545 - DNA, 25 bp, Rattus norvegicus
ggagcctgttaggaagcttcggatt

SEQ ID NO: 427546 - DNA, 25 bp, Rattus norvegicus
ggagcctgttccagaattgctagaa

SEQ ID NO: 427547 - DNA, 25 bp, Rattus norvegicus
ggagcctgttcccagactgatagga

SEQ ID NO: 427548 - DNA, 25 bp, Rattus norvegicus
ggagcctgttccgagactgatagga

SEQ ID NO: 427549 - DNA, 25 bp, Rattus norvegicus
ggagcctgttcctgaattgctagaa

SEQ ID NO: 427550 - DNA, 25 bp, Rattus norvegicus
ggagccttaaatctatgtggttttc

SEQ ID NO: 427551 - DNA, 25 bp, Rattus norvegicus
ggagccttaaatgtatgtggttttc

SEQ ID NO: 427552 - DNA, 25 bp, Rattus norvegicus
ggagccttagcacagacctttgtaa

SEQ ID NO: 427553 - DNA, 25 bp, Rattus norvegicus
ggagccttagcagagacctttgtaa

SEQ ID NO: 427554 - DNA, 25 bp, Rattus norvegicus
ggagccttcgacaggagtgtgtata

SEQ ID NO: 427555 - DNA, 25 bp, Rattus norvegicus
ggagccttcgactggagtgtgtata

SEQ ID NO: 427556 - DNA, 25 bp, Rattus norvegicus
ggagccttctcactgtgataccaaa

SEQ ID NO: 427557 - DNA, 25 bp, Rattus norvegicus
ggagccttctcagtgtgataccaaa

SEQ ID NO: 427558 - DNA, 25 bp, Rattus norvegicus
ggagccttgagtcggcaaaacctct

SEQ ID NO: 427559 - DNA, 25 bp, Rattus norvegicus
ggagccttgagtgggcaaaacctct

SEQ ID NO: 427560 - DNA, 25 bp, Rattus norvegicus
ggagccttgctcactgggcacagag

SEQ ID NO: 427561 - DNA, 25 bp, Rattus norvegicus
ggagccttgctctctgggcacagag

SEQ ID NO: 427562 - DNA, 25 bp, Rattus norvegicus
ggagccttgtaaaggacactgtcaa

SEQ ID NO: 427563 - DNA, 25 bp, Rattus norvegicus
ggagccttgtaatggacactgtcaa

SEQ ID NO: 427564 - DNA, 25 bp, Rattus norvegicus
ggagccttgtggaggaatccccttt

SEQ ID NO: 427565 - DNA, 25 bp, Rattus norvegicus
ggagccttgtggtggaatccccttt

SEQ ID NO: 427566 - DNA, 25 bp, Rattus norvegicus
ggagcctttaagaactgatcccaaa

SEQ ID NO: 427567 - DNA, 25 bp, Rattus norvegicus
ggagcctttaagtactgatcccaaa

SEQ ID NO: 427568 - DNA, 25 bp, Rattus norvegicus
ggagcctttaccagtggcctaacca

SEQ ID NO: 427569 - DNA, 25 bp, Rattus norvegicus
ggagcctttacctgtggcctaacca

SEQ ID NO: 427570 - DNA, 25 bp, Rattus norvegicus
ggagcctttccaaccaagccataaa

SEQ ID NO: 427571 - DNA, 25 bp, Rattus norvegicus
ggagcctttccatccaagccataaa

SEQ ID NO: 427572 - DNA, 25 bp, Rattus norvegicus
ggagcctttgaaatgtcctctcaag

SEQ ID NO: 427573 - DNA, 25 bp, Rattus norvegicus
ggagcctttgaattgtcctctcaag

SEQ ID NO: 427574 - DNA, 25 bp, Rattus norvegicus
ggagcctttgagctgatgtgcacat

SEQ ID NO: 427575 - DNA, 25 bp, Rattus norvegicus
ggagcctttgaggtgatgtgcacat

SEQ ID NO: 427576 - DNA, 25 bp, Rattus norvegicus
ggagcctttgatatggccttgaaca

SEQ ID NO: 427577 - DNA, 25 bp, Rattus norvegicus
ggagcctttgatttggccttgaaca

SEQ ID NO: 427578 - DNA, 25 bp, Rattus norvegicus
ggagccttttccaactctagttttg

SEQ ID NO: 427579 - DNA, 25 bp, Rattus norvegicus
ggagccttttcctactctagttttg

SEQ ID NO: 427580 - DNA, 25 bp, Rattus norvegicus
ggagcgaacatcaatcacccttaac

SEQ ID NO: 427581 - DNA, 25 bp, Rattus norvegicus
ggagcgaacatctatcacccttaac

SEQ ID NO: 427582 - DNA, 25 bp, Rattus norvegicus
ggagcgaagactccctttcttcctc

SEQ ID NO: 427583 - DNA, 25 bp, Rattus norvegicus
ggagcgaagactgcctttcttcctc

SEQ ID NO: 427584 - DNA, 25 bp, Rattus norvegicus
ggagcgaagcataaaggccttgaca

SEQ ID NO: 427585 - DNA, 25 bp, Rattus norvegicus
ggagcgaagcattaaggccttgaca

SEQ ID NO: 427586 - DNA, 25 bp, Rattus norvegicus
ggagcgaatcctctcagtaaatttc

SEQ ID NO: 427587 - DNA, 25 bp, Rattus norvegicus
ggagcgaatcctgtcagtaaatttc

SEQ ID NO: 427588 - DNA, 25 bp, Rattus norvegicus
ggagcgacaggaatttcggccccag

SEQ ID NO: 427589 - DNA, 25 bp, Rattus norvegicus
ggagcgacaggattttcggccccag

SEQ ID NO: 427590 - DNA, 25 bp, Rattus norvegicus
ggagcgagatcccgtcaagatcaaa

SEQ ID NO: 427591 - DNA, 25 bp, Rattus norvegicus
ggagcgagatccggtcaagatcaaa

SEQ ID NO: 427592 - DNA, 25 bp, Rattus norvegicus
ggagcgagcaatccccaggctgaca

SEQ ID NO: 427593 - DNA, 25 bp, Rattus norvegicus
ggagcgagcaatgcccaggctgaca

SEQ ID NO: 427594 - DNA, 25 bp, Rattus norvegicus
ggagcgaggaaaatctcagccataa

SEQ ID NO: 427595 - DNA, 25 bp, Rattus norvegicus
ggagcgaggaaattctcagccataa

SEQ ID NO: 427596 - DNA, 25 bp, Rattus norvegicus
ggagcgatcagaactaaccgtgccc

SEQ ID NO: 427597 - DNA, 25 bp, Rattus norvegicus
ggagcgatcagatctaaccgtgccc

SEQ ID NO: 427598 - DNA, 25 bp, Rattus norvegicus
ggagcgatcatcagtcaaagcatat

SEQ ID NO: 427599 - DNA, 25 bp, Rattus norvegicus
ggagcgatcatctgtcaaagcatat

SEQ ID NO: 427600 - DNA, 25 bp, Rattus norvegicus
ggagcgcaaggacccacagtaccta

SEQ ID NO: 427601 - DNA, 25 bp, Rattus norvegicus
ggagcgcaaggagccacagtaccta

SEQ ID NO: 427602 - DNA, 25 bp, Rattus norvegicus
ggagcgcaatccatactttgataag

SEQ ID NO: 427603 - DNA, 25 bp, Rattus norvegicus
ggagcgcaatccttactttgataag

SEQ ID NO: 427604 - DNA, 25 bp, Rattus norvegicus
ggagcgcacagtagggaccagcatt

SEQ ID NO: 427605 - DNA, 25 bp, Rattus norvegicus
ggagcgcacagttgggaccagcatt

SEQ ID NO: 427606 - DNA, 25 bp, Rattus norvegicus
ggagcgcacgccacctcttggagga

SEQ ID NO: 427607 - DNA, 25 bp, Rattus norvegicus
ggagcgcacgcctcctcttggagga

SEQ ID NO: 427608 - DNA, 25 bp, Rattus norvegicus
ggagcgcactgacccatgtacgcaa

SEQ ID NO: 427609 - DNA, 25 bp, Rattus norvegicus
ggagcgcactgagccatgtacgcaa

SEQ ID NO: 427610 - DNA, 25 bp, Rattus norvegicus
ggagcgcagcataagcaccatcatc

SEQ ID NO: 427611 - DNA, 25 bp, Rattus norvegicus
ggagcgcagcattagcaccatcatc

SEQ ID NO: 427612 - DNA, 25 bp, Rattus norvegicus
ggagcgcattcaaatagactggatt

SEQ ID NO: 427613 - DNA, 25 bp, Rattus norvegicus
ggagcgcattcatatagactggatt

SEQ ID NO: 427614 - DNA, 25 bp, Rattus norvegicus
ggagcgcctcacagcctgtgggatc

SEQ ID NO: 427615 - DNA, 25 bp, Rattus norvegicus
ggagcgcctcactgcctgtgggatc

SEQ ID NO: 427616 - DNA, 25 bp, Rattus norvegicus
ggagcgcgcgccattttgtgagatt

SEQ ID NO: 427617 - DNA, 25 bp, Rattus norvegicus
ggagcgcgcgcctttttgtgagatt

SEQ ID NO: 427618 - DNA, 25 bp, Rattus norvegicus
ggagcgcgcttgagctctctatctt

SEQ ID NO: 427619 - DNA, 25 bp, Rattus norvegicus
ggagcgcgcttgtgctctctatctt

SEQ ID NO: 427620 - DNA, 25 bp, Rattus norvegicus
ggagcgcgttccacatgaattcata

SEQ ID NO: 427621 - DNA, 25 bp, Rattus norvegicus
ggagcgcgttcctcatgaattcata

SEQ ID NO: 427622 - DNA, 25 bp, Rattus norvegicus
ggagcgctctttagggaagtccatt

SEQ ID NO: 427623 - DNA, 25 bp, Rattus norvegicus
ggagcgctcttttgggaagtccatt

SEQ ID NO: 427624 - DNA, 25 bp, Rattus norvegicus
ggagcgctgtgcagtgtgtaaatct

SEQ ID NO: 427625 - DNA, 25 bp, Rattus norvegicus
ggagcgctgtgctgtgtgtaaatct

SEQ ID NO: 427626 - DNA, 25 bp, Rattus norvegicus
ggagcggaagacatgtgccacttaa

SEQ ID NO: 427627 - DNA, 25 bp, Rattus norvegicus
ggagcggaagacttgtgccacttaa

SEQ ID NO: 427628 - DNA, 25 bp, Rattus norvegicus
ggagcggaagcgcatgtccacctat

SEQ ID NO: 427629 - DNA, 25 bp, Rattus norvegicus
ggagcggaagcggatgtccacctat

SEQ ID NO: 427630 - DNA, 25 bp, Rattus norvegicus
ggagcggattaccaaactcattatt

SEQ ID NO: 427631 - DNA, 25 bp, Rattus norvegicus
ggagcggattacgaaactcattatt

SEQ ID NO: 427632 - DNA, 25 bp, Rattus norvegicus
ggagcggcagctccctttctgattt

SEQ ID NO: 427633 - DNA, 25 bp, Rattus norvegicus
ggagcggcagctgcctttctgattt

SEQ ID NO: 427634 - DNA, 25 bp, Rattus norvegicus
ggagcggcaggaacgcatctctcgt

SEQ ID NO: 427635 - DNA, 25 bp, Rattus norvegicus
ggagcggcaggatcgcatctctcgt

SEQ ID NO: 427636 - DNA, 25 bp, Rattus norvegicus
ggagcggcagtcactctgagccaat

SEQ ID NO: 427637 - DNA, 25 bp, Rattus norvegicus
ggagcggcagtctctctgagccaat

SEQ ID NO: 427638 - DNA, 25 bp, Rattus norvegicus
ggagcggccaccaagatgcacccag

SEQ ID NO: 427639 - DNA, 25 bp, Rattus norvegicus
ggagcggccacctagatgcacccag

SEQ ID NO: 427640 - DNA, 25 bp, Rattus norvegicus
ggagcgggcaggaccacatccattt

SEQ ID NO: 427641 - DNA, 25 bp, Rattus norvegicus
ggagcgggcaggtccacatccattt

SEQ ID NO: 427642 - DNA, 25 bp, Rattus norvegicus
ggagcgggccggaccgtgagacgga

SEQ ID NO: 427643 - DNA, 25 bp, Rattus norvegicus
ggagcgggccggtccgtgagacgga

SEQ ID NO: 427644 - DNA, 25 bp, Rattus norvegicus
ggagcgggctatagaccttaataaa

SEQ ID NO: 427645 - DNA, 25 bp, Rattus norvegicus
ggagcgggctattgaccttaataaa

SEQ ID NO: 427646 - DNA, 25 bp, Rattus norvegicus
ggagcgggtcaacatctgcaattta

SEQ ID NO: 427647 - DNA, 25 bp, Rattus norvegicus
ggagcgggtcaactgatagatcaac

SEQ ID NO: 427648 - DNA, 25 bp, Rattus norvegicus
ggagcgggtcaagatctgcaattta

SEQ ID NO: 427649 - DNA, 25 bp, Rattus norvegicus
ggagcgggtcaagtgatagatcaac

SEQ ID NO: 427650 - DNA, 25 bp, Rattus norvegicus
ggagcggtagccattttagttactg

SEQ ID NO: 427651 - DNA, 25 bp, Rattus norvegicus
ggagcggtagcctttttagttactg

SEQ ID NO: 427652 - DNA, 25 bp, Rattus norvegicus
ggagcggtctacacccgcagagcgc

SEQ ID NO: 427653 - DNA, 25 bp, Rattus norvegicus
ggagcggtctactcccgcagagcgc

SEQ ID NO: 427654 - DNA, 25 bp, Rattus norvegicus
ggagcgtactacagccaagggaaac

SEQ ID NO: 427655 - DNA, 25 bp, Rattus norvegicus
ggagcgtactactgccaagggaaac

SEQ ID NO: 427656 - DNA, 25 bp, Rattus norvegicus
ggagcgtatcctaaacatgttaatt

SEQ ID NO: 427657 - DNA, 25 bp, Rattus norvegicus
ggagcgtatccttaacatgttaatt

SEQ ID NO: 427658 - DNA, 25 bp, Rattus norvegicus
ggagcgtctcacagtagctgatgca

SEQ ID NO: 427659 - DNA, 25 bp, Rattus norvegicus
ggagcgtctcactgtagctgatgca

SEQ ID NO: 427660 - DNA, 25 bp, Rattus norvegicus
ggagcgtctctcatctcaggtgtga

SEQ ID NO: 427661 - DNA, 25 bp, Rattus norvegicus
ggagcgtctctcttctcaggtgtga

SEQ ID NO: 427662 - DNA, 25 bp, Rattus norvegicus
ggagcgtcttcaaatatggtttaat

SEQ ID NO: 427663 - DNA, 25 bp, Rattus norvegicus
ggagcgtcttcatatatggtttaat

SEQ ID NO: 427664 - DNA, 25 bp, Rattus norvegicus
ggagcgtcttgtactccggagccgc

SEQ ID NO: 427665 - DNA, 25 bp, Rattus norvegicus
ggagcgtcttgttctccggagccgc

SEQ ID NO: 427666 - DNA, 25 bp, Rattus norvegicus
ggagcgttctgcctaagattgtcat

SEQ ID NO: 427667 - DNA, 25 bp, Rattus norvegicus
ggagcgttctgcgtaagattgtcat

SEQ ID NO: 427668 - DNA, 25 bp, Rattus norvegicus
ggagcgttcttcactatgacacaga

SEQ ID NO: 427669 - DNA, 25 bp, Rattus norvegicus
ggagcgttcttctctatgacacaga

SEQ ID NO: 427670 - DNA, 25 bp, Rattus norvegicus
ggagcgttgcttcatttgacaccat

SEQ ID NO: 427671 - DNA, 25 bp, Rattus norvegicus
ggagcgttgcttgatttgacaccat

SEQ ID NO: 427672 - DNA, 25 bp, Rattus norvegicus
ggagcgtttgttcccacttatccaa

SEQ ID NO: 427673 - DNA, 25 bp, Rattus norvegicus
ggagcgtttgttgccacttatccaa

SEQ ID NO: 427674 - DNA, 25 bp, Rattus norvegicus
ggagctaaactaccagctatcccca

SEQ ID NO: 427675 - DNA, 25 bp, Rattus norvegicus
ggagctaaactagcagctatcccca

SEQ ID NO: 427676 - DNA, 25 bp, Rattus norvegicus
ggagctaaagtcagtgctgggattt

SEQ ID NO: 427677 - DNA, 25 bp, Rattus norvegicus
ggagctaaagtctgtgctgggattt

SEQ ID NO: 427678 - DNA, 25 bp, Rattus norvegicus
ggagctaacgtcctgcttacgggca

SEQ ID NO: 427679 - DNA, 25 bp, Rattus norvegicus
ggagctaacgtcgtgcttacgggca

SEQ ID NO: 427680 - DNA, 25 bp, Rattus norvegicus
ggagctaactcgcatccattagcca

SEQ ID NO: 427681 - DNA, 25 bp, Rattus norvegicus
ggagctaactcggatccattagcca

SEQ ID NO: 427682 - DNA, 25 bp, Rattus norvegicus
ggagctaagatgaggctgccacgct

SEQ ID NO: 427683 - DNA, 25 bp, Rattus norvegicus
ggagctaagatgtggctgccacgct

SEQ ID NO: 427684 - DNA, 25 bp, Rattus norvegicus
ggagctaagcttaatcctgctgcag

SEQ ID NO: 427685 - DNA, 25 bp, Rattus norvegicus
ggagctaagctttatcctgctgcag

SEQ ID NO: 427686 - DNA, 25 bp, Rattus norvegicus
ggagctaaggaaactcttcaatgaa

SEQ ID NO: 427687 - DNA, 25 bp, Rattus norvegicus
ggagctaaggaactcacctgcctca

SEQ ID NO: 427688 - DNA, 25 bp, Rattus norvegicus
ggagctaaggaagtcacctgcctca

SEQ ID NO: 427689 - DNA, 25 bp, Rattus norvegicus
ggagctaaggaatctcttcaatgaa

SEQ ID NO: 427690 - DNA, 25 bp, Rattus norvegicus
ggagctaaggctcgacttcgtttta

SEQ ID NO: 427691 - DNA, 25 bp, Rattus norvegicus
ggagctaaggctggacttcgtttta

SEQ ID NO: 427692 - DNA, 25 bp, Rattus norvegicus
ggagctaatgacaccatccacaggt

SEQ ID NO: 427693 - DNA, 25 bp, Rattus norvegicus
ggagctaatgaccaatcactgagtt

SEQ ID NO: 427694 - DNA, 25 bp, Rattus norvegicus
ggagctaatgacgaatcactgagtt

SEQ ID NO: 427695 - DNA, 25 bp, Rattus norvegicus
ggagctaatgactccatccacaggt

SEQ ID NO: 427696 - DNA, 25 bp, Rattus norvegicus
ggagctacaactctggtttccatgt

SEQ ID NO: 427697 - DNA, 25 bp, Rattus norvegicus
ggagctacaactgtggtttccatgt

SEQ ID NO: 427698 - DNA, 25 bp, Rattus norvegicus
ggagctacaagcacatcagaggcct

SEQ ID NO: 427699 - DNA, 25 bp, Rattus norvegicus
ggagctacaagctcatcagaggcct

SEQ ID NO: 427700 - DNA, 25 bp, Rattus norvegicus
ggagctacaagtactacgccagcag

SEQ ID NO: 427701 - DNA, 25 bp, Rattus norvegicus
ggagctacaagttctacgccagcag

SEQ ID NO: 427702 - DNA, 25 bp, Rattus norvegicus
ggagctaccagactttatgccattt

SEQ ID NO: 427703 - DNA, 25 bp, Rattus norvegicus
ggagctaccagagtttatgccattt

SEQ ID NO: 427704 - DNA, 25 bp, Rattus norvegicus
ggagctaccctcagagcggtggaac

SEQ ID NO: 427705 - DNA, 25 bp, Rattus norvegicus
ggagctaccctctgagcggtggaac

SEQ ID NO: 427706 - DNA, 25 bp, Rattus norvegicus
ggagctaccgctaggtatctttggt

SEQ ID NO: 427707 - DNA, 25 bp, Rattus norvegicus
ggagctaccgcttggtatctttggt

SEQ ID NO: 427708 - DNA, 25 bp, Rattus norvegicus
ggagctacctagctgtagtctagta

SEQ ID NO: 427709 - DNA, 25 bp, Rattus norvegicus
ggagctacctaggtgtagtctagta

SEQ ID NO: 427710 - DNA, 25 bp, Rattus norvegicus
ggagctactaccaatgatctgatta

SEQ ID NO: 427711 - DNA, 25 bp, Rattus norvegicus
ggagctactacctatgatctgatta

SEQ ID NO: 427712 - DNA, 25 bp, Rattus norvegicus
ggagctactattactctgacgtgat

SEQ ID NO: 427713 - DNA, 25 bp, Rattus norvegicus
ggagctactatttctctgacgtgat

SEQ ID NO: 427714 - DNA, 25 bp, Rattus norvegicus
ggagctactgttataagatcaatga

SEQ ID NO: 427715 - DNA, 25 bp, Rattus norvegicus
ggagctactgttttaagatcaatga

SEQ ID NO: 427716 - DNA, 25 bp, Rattus norvegicus
ggagctagagaactgagtccttcag

SEQ ID NO: 427717 - DNA, 25 bp, Rattus norvegicus
ggagctagagaagtgagtccttcag

SEQ ID NO: 427718 - DNA, 25 bp, Rattus norvegicus
ggagctagagtgcagcaagatcaat

SEQ ID NO: 427719 - DNA, 25 bp, Rattus norvegicus
ggagctagagtggagcaagatcaat

SEQ ID NO: 427720 - DNA, 25 bp, Rattus norvegicus
ggagctagctagcactgttcacaat

SEQ ID NO: 427721 - DNA, 25 bp, Rattus norvegicus
ggagctagctaggactgttcacaat

SEQ ID NO: 427722 - DNA, 25 bp, Rattus norvegicus
ggagctaggagacctcttcatgcac

SEQ ID NO: 427723 - DNA, 25 bp, Rattus norvegicus
ggagctaggagagctcttcatgcac

SEQ ID NO: 427724 - DNA, 25 bp, Rattus norvegicus
ggagctataccgaagccttgtacag

SEQ ID NO: 427725 - DNA, 25 bp, Rattus norvegicus
ggagctataccgtagccttgtacag

SEQ ID NO: 427726 - DNA, 25 bp, Rattus norvegicus
ggagctatccctattgggtcccatt

SEQ ID NO: 427727 - DNA, 25 bp, Rattus norvegicus
ggagctatcccttttgggtcccatt

SEQ ID NO: 427728 - DNA, 25 bp, Rattus norvegicus
ggagctatctcaatgctatatgcat

SEQ ID NO: 427729 - DNA, 25 bp, Rattus norvegicus
ggagctatctcacctgtcgtatcaa

SEQ ID NO: 427730 - DNA, 25 bp, Rattus norvegicus
ggagctatctcagctgtcgtatcaa

SEQ ID NO: 427731 - DNA, 25 bp, Rattus norvegicus
ggagctatctcattgctatatgcat

SEQ ID NO: 427732 - DNA, 25 bp, Rattus norvegicus
ggagctatctctaagaccatcaagg

SEQ ID NO: 427733 - DNA, 25 bp, Rattus norvegicus
ggagctatctcttagaccatcaagg

SEQ ID NO: 427734 - DNA, 25 bp, Rattus norvegicus
ggagctatgagaaccccttgggttt

SEQ ID NO: 427735 - DNA, 25 bp, Rattus norvegicus
ggagctatgagatccccttgggttt

SEQ ID NO: 427736 - DNA, 25 bp, Rattus norvegicus
ggagctatggcacagtatccacaac

SEQ ID NO: 427737 - DNA, 25 bp, Rattus norvegicus
ggagctatggcagagtatccacaac

SEQ ID NO: 427738 - DNA, 25 bp, Rattus norvegicus
ggagctatgtcacggcctatctgaa

SEQ ID NO: 427739 - DNA, 25 bp, Rattus norvegicus
ggagctatgtcagggcctatctgaa

SEQ ID NO: 427740 - DNA, 25 bp, Rattus norvegicus
ggagctatttctaacattaactttg

SEQ ID NO: 427741 - DNA, 25 bp, Rattus norvegicus
ggagctatttcttacattaactttg

SEQ ID NO: 427742 - DNA, 25 bp, Rattus norvegicus
ggagctcaactaacaatcatcctga

SEQ ID NO: 427743 - DNA, 25 bp, Rattus norvegicus
ggagctcaactatcaatcatcctga

SEQ ID NO: 427744 - DNA, 25 bp, Rattus norvegicus
ggagctcaagacactccaagtctag

SEQ ID NO: 427745 - DNA, 25 bp, Rattus norvegicus
ggagctcaagactctccaagtctag

SEQ ID NO: 427746 - DNA, 25 bp, Rattus norvegicus
ggagctcaagagcaaccctaagtga

SEQ ID NO: 427747 - DNA, 25 bp, Rattus norvegicus
ggagctcaagaggaaccctaagtga

SEQ ID NO: 427748 - DNA, 25 bp, Rattus norvegicus
ggagctcaagctatcatgtgcttac

SEQ ID NO: 427749 - DNA, 25 bp, Rattus norvegicus
ggagctcaagctttcatgtgcttac

SEQ ID NO: 427750 - DNA, 25 bp, Rattus norvegicus
ggagctcaatgtactagcccaagtc

SEQ ID NO: 427751 - DNA, 25 bp, Rattus norvegicus
ggagctcaatgttctagcccaagtc

SEQ ID NO: 427752 - DNA, 25 bp, Rattus norvegicus
ggagctcacctaagactacaagttt

SEQ ID NO: 427753 - DNA, 25 bp, Rattus norvegicus
ggagctcacctatgactacaagttt

SEQ ID NO: 427754 - DNA, 25 bp, Rattus norvegicus
ggagctcaccttcgcctcagtgtca

SEQ ID NO: 427755 - DNA, 25 bp, Rattus norvegicus
ggagctcaccttggcctcagtgtca

SEQ ID NO: 427756 - DNA, 25 bp, Rattus norvegicus
ggagctcacgctaagggcaggtcac

SEQ ID NO: 427757 - DNA, 25 bp, Rattus norvegicus
ggagctcacgcttagggcaggtcac

SEQ ID NO: 427758 - DNA, 25 bp, Rattus norvegicus
ggagctcactgacgatggcctttat

SEQ ID NO: 427759 - DNA, 25 bp, Rattus norvegicus
ggagctcactgaggatggcctttat

SEQ ID NO: 427760 - DNA, 25 bp, Rattus norvegicus
ggagctcactgtactatcgggttga

SEQ ID NO: 427761 - DNA, 25 bp, Rattus norvegicus
ggagctcactgttctatcgggttga

SEQ ID NO: 427762 - DNA, 25 bp, Rattus norvegicus
ggagctcagaacctacctggagaaa

SEQ ID NO: 427763 - DNA, 25 bp, Rattus norvegicus
ggagctcagaacgtacctggagaaa

SEQ ID NO: 427764 - DNA, 25 bp, Rattus norvegicus
ggagctcagacacgttcttaccact

SEQ ID NO: 427765 - DNA, 25 bp, Rattus norvegicus
ggagctcagacaggttcttaccact

SEQ ID NO: 427766 - DNA, 25 bp, Rattus norvegicus
ggagctcagcgaataccgggaccaa

SEQ ID NO: 427767 - DNA, 25 bp, Rattus norvegicus
ggagctcagcgattaccgggaccaa

SEQ ID NO: 427768 - DNA, 25 bp, Rattus norvegicus
ggagctcaggctagactctggaata

SEQ ID NO: 427769 - DNA, 25 bp, Rattus norvegicus
ggagctcaggcttgactctggaata

SEQ ID NO: 427770 - DNA, 25 bp, Rattus norvegicus
ggagctcagtgaccacgctgactgc

SEQ ID NO: 427771 - DNA, 25 bp, Rattus norvegicus
ggagctcagtgagcacgctgactgc

SEQ ID NO: 427772 - DNA, 25 bp, Rattus norvegicus
ggagctcagtggatagcgactaccc

SEQ ID NO: 427773 - DNA, 25 bp, Rattus norvegicus
ggagctcagtggttagcgactaccc

SEQ ID NO: 427774 - DNA, 25 bp, Rattus norvegicus
ggagctcagttcaatgcagttgtgc

SEQ ID NO: 427775 - DNA, 25 bp, Rattus norvegicus
ggagctcagttctatgcagttgtgc

SEQ ID NO: 427776 - DNA, 25 bp, Rattus norvegicus
ggagctcatatcatagaatatatca

SEQ ID NO: 427777 - DNA, 25 bp, Rattus norvegicus
ggagctcatatcttagaatatatca

SEQ ID NO: 427778 - DNA, 25 bp, Rattus norvegicus
ggagctcatcccaatacaagcagca

SEQ ID NO: 427779 - DNA, 25 bp, Rattus norvegicus
ggagctcatccctatacaagcagca

SEQ ID NO: 427780 - DNA, 25 bp, Rattus norvegicus
ggagctcatgacaacttgaaactga

SEQ ID NO: 427781 - DNA, 25 bp, Rattus norvegicus
ggagctcatgactacttgaaactga

SEQ ID NO: 427782 - DNA, 25 bp, Rattus norvegicus
ggagctcatgcgcaccattgtgcat

SEQ ID NO: 427783 - DNA, 25 bp, Rattus norvegicus
ggagctcatgcggaccattgtgcat

SEQ ID NO: 427784 - DNA, 25 bp, Rattus norvegicus
ggagctcatgtcagtgaacctataa

SEQ ID NO: 427785 - DNA, 25 bp, Rattus norvegicus
ggagctcatgtctgtgaacctataa

SEQ ID NO: 427786 - DNA, 25 bp, Rattus norvegicus
ggagctcattgaagcaatcaggcag

SEQ ID NO: 427787 - DNA, 25 bp, Rattus norvegicus
ggagctcattgatgcaatcaggcag

SEQ ID NO: 427788 - DNA, 25 bp, Rattus norvegicus
ggagctccaatgacctcatggacaa

SEQ ID NO: 427789 - DNA, 25 bp, Rattus norvegicus
ggagctccaatgtcctcatggacaa

SEQ ID NO: 427790 - DNA, 25 bp, Rattus norvegicus
ggagctccagccagtaagacccaag

SEQ ID NO: 427791 - DNA, 25 bp, Rattus norvegicus
ggagctccagcccactgagagaaga

SEQ ID NO: 427792 - DNA, 25 bp, Rattus norvegicus
ggagctccagccgactgagagaaga

SEQ ID NO: 427793 - DNA, 25 bp, Rattus norvegicus
ggagctccagcctgtaagacccaag

SEQ ID NO: 427794 - DNA, 25 bp, Rattus norvegicus
ggagctccaggcaatttttgtgctt

SEQ ID NO: 427795 - DNA, 25 bp, Rattus norvegicus
ggagctccaggctatttttgtgctt

SEQ ID NO: 427796 - DNA, 25 bp, Rattus norvegicus
ggagctcccgctcaggtcgcttaag

SEQ ID NO: 427797 - DNA, 25 bp, Rattus norvegicus
ggagctcccgctgaggtcgcttaag

SEQ ID NO: 427798 - DNA, 25 bp, Rattus norvegicus
ggagctccctaactagaccagacta

SEQ ID NO: 427799 - DNA, 25 bp, Rattus norvegicus
ggagctccctaagtagaccagacta

SEQ ID NO: 427800 - DNA, 25 bp, Rattus norvegicus
ggagctccctcaacattttgtgcac

SEQ ID NO: 427801 - DNA, 25 bp, Rattus norvegicus
ggagctccctcatcattttgtgcac

SEQ ID NO: 427802 - DNA, 25 bp, Rattus norvegicus
ggagctccctgtacagttggttcaa

SEQ ID NO: 427803 - DNA, 25 bp, Rattus norvegicus
ggagctccctgttcagttggttcaa

SEQ ID NO: 427804 - DNA, 25 bp, Rattus norvegicus
ggagctccgggacaatcctttcaag

SEQ ID NO: 427805 - DNA, 25 bp, Rattus norvegicus
ggagctccgggagaatcctttcaag

SEQ ID NO: 427806 - DNA, 25 bp, Rattus norvegicus
ggagctcctgtgaagaccattggtt

SEQ ID NO: 427807 - DNA, 25 bp, Rattus norvegicus
ggagctcctgtgtagaccattggtt

SEQ ID NO: 427808 - DNA, 25 bp, Rattus norvegicus
ggagctcctgttcccgagctaacat

SEQ ID NO: 427809 - DNA, 25 bp, Rattus norvegicus
ggagctcctgttcccggaatccttt

SEQ ID NO: 427810 - DNA, 25 bp, Rattus norvegicus
ggagctcctgttgccgagctaacat

SEQ ID NO: 427811 - DNA, 25 bp, Rattus norvegicus
ggagctcctgttgccggaatccttt

SEQ ID NO: 427812 - DNA, 25 bp, Rattus norvegicus
ggagctcggagtacgtttccaccgg

SEQ ID NO: 427813 - DNA, 25 bp, Rattus norvegicus
ggagctcggagttcgtttccaccgg

SEQ ID NO: 427814 - DNA, 25 bp, Rattus norvegicus
ggagctcgtatgattccagtggact

SEQ ID NO: 427815 - DNA, 25 bp, Rattus norvegicus
ggagctcgtatgtttccagtggact

SEQ ID NO: 427816 - DNA, 25 bp, Rattus norvegicus
ggagctctaagcatctagatccttc

SEQ ID NO: 427817 - DNA, 25 bp, Rattus norvegicus
ggagctctaagcttctagatccttc

SEQ ID NO: 427818 - DNA, 25 bp, Rattus norvegicus
ggagctctaatcattctttagccaa

SEQ ID NO: 427819 - DNA, 25 bp, Rattus norvegicus
ggagctctaatctttctttagccaa

SEQ ID NO: 427820 - DNA, 25 bp, Rattus norvegicus
ggagctctaccaactgtccaggtgt

SEQ ID NO: 427821 - DNA, 25 bp, Rattus norvegicus
ggagctctaccatctgtccaggtgt

SEQ ID NO: 427822 - DNA, 25 bp, Rattus norvegicus
ggagctctacttacagaacaactgt

SEQ ID NO: 427823 - DNA, 25 bp, Rattus norvegicus
ggagctctactttcagaacaactgt

SEQ ID NO: 427824 - DNA, 25 bp, Rattus norvegicus
ggagctctagttctcccaaaggagt

SEQ ID NO: 427825 - DNA, 25 bp, Rattus norvegicus
ggagctctagttgtcccaaaggagt

SEQ ID NO: 427826 - DNA, 25 bp, Rattus norvegicus
ggagctctcaacagaacacagcact

SEQ ID NO: 427827 - DNA, 25 bp, Rattus norvegicus
ggagctctcaactgaacacagcact

SEQ ID NO: 427828 - DNA, 25 bp, Rattus norvegicus
ggagctctcagaaatagggcccctg

SEQ ID NO: 427829 - DNA, 25 bp, Rattus norvegicus
ggagctctcagatatagggcccctg

SEQ ID NO: 427830 - DNA, 25 bp, Rattus norvegicus
ggagctctccaaagaggtcatgtct

SEQ ID NO: 427831 - DNA, 25 bp, Rattus norvegicus
ggagctctccaatgaggtcatgtct

SEQ ID NO: 427832 - DNA, 25 bp, Rattus norvegicus
ggagctctcctgctctatatagcaa

SEQ ID NO: 427833 - DNA, 25 bp, Rattus norvegicus
ggagctctcctggtctatatagcaa

SEQ ID NO: 427834 - DNA, 25 bp, Rattus norvegicus
ggagctctccttacttatttttatt

SEQ ID NO: 427835 - DNA, 25 bp, Rattus norvegicus
ggagctctcctttcttatttttatt

SEQ ID NO: 427836 - DNA, 25 bp, Rattus norvegicus
ggagctctcgaacctatcgcttaac

SEQ ID NO: 427837 - DNA, 25 bp, Rattus norvegicus
ggagctctcgaagctatcgcttaac

SEQ ID NO: 427838 - DNA, 25 bp, Rattus norvegicus
ggagctctctgcctgagattttgca

SEQ ID NO: 427839 - DNA, 25 bp, Rattus norvegicus
ggagctctctgcgtgagattttgca

SEQ ID NO: 427840 - DNA, 25 bp, Rattus norvegicus
ggagctctgaacctggcattatcta

SEQ ID NO: 427841 - DNA, 25 bp, Rattus norvegicus
ggagctctgaacgtggcattatcta

SEQ ID NO: 427842 - DNA, 25 bp, Rattus norvegicus
ggagctctgaatcatctggaccagt

SEQ ID NO: 427843 - DNA, 25 bp, Rattus norvegicus
ggagctctgaatgatctggaccagt

SEQ ID NO: 427844 - DNA, 25 bp, Rattus norvegicus
ggagctctgagcatgttggagacat

SEQ ID NO: 427845 - DNA, 25 bp, Rattus norvegicus
ggagctctgagcttgttggagacat

SEQ ID NO: 427846 - DNA, 25 bp, Rattus norvegicus
ggagctctgcagacttgtcagccag

SEQ ID NO: 427847 - DNA, 25 bp, Rattus norvegicus
ggagctctgcagtcttgtcagccag

SEQ ID NO: 427848 - DNA, 25 bp, Rattus norvegicus
ggagctctgcccaaggctcagacca

SEQ ID NO: 427849 - DNA, 25 bp, Rattus norvegicus
ggagctctgccctaggctcagacca

SEQ ID NO: 427850 - DNA, 25 bp, Rattus norvegicus
ggagctctgccgaggtttgctgccc

SEQ ID NO: 427851 - DNA, 25 bp, Rattus norvegicus
ggagctctgccgtggtttgctgccc

SEQ ID NO: 427852 - DNA, 25 bp, Rattus norvegicus
ggagctctggccatgctgtttcaag

SEQ ID NO: 427853 - DNA, 25 bp, Rattus norvegicus
ggagctctggccttgctgtttcaag

SEQ ID NO: 427854 - DNA, 25 bp, Rattus norvegicus
ggagctctggctcggtctcaacgac

SEQ ID NO: 427855 - DNA, 25 bp, Rattus norvegicus
ggagctctggctgggtctcaacgac

SEQ ID NO: 427856 - DNA, 25 bp, Rattus norvegicus
ggagctctggtcatgactttgctac

SEQ ID NO: 427857 - DNA, 25 bp, Rattus norvegicus
ggagctctggtcttgactttgctac

SEQ ID NO: 427858 - DNA, 25 bp, Rattus norvegicus
ggagctctgttacagatccctgcag

SEQ ID NO: 427859 - DNA, 25 bp, Rattus norvegicus
ggagctctgttagagatccctgcag

SEQ ID NO: 427860 - DNA, 25 bp, Rattus norvegicus
ggagctcttaaacgcaattcttcac

SEQ ID NO: 427861 - DNA, 25 bp, Rattus norvegicus
ggagctcttaaaggcaattcttcac

SEQ ID NO: 427862 - DNA, 25 bp, Rattus norvegicus
ggagctcttacccaccactttggtg

SEQ ID NO: 427863 - DNA, 25 bp, Rattus norvegicus
ggagctcttaccgaccactttggtg

SEQ ID NO: 427864 - DNA, 25 bp, Rattus norvegicus
ggagctcttgaaactaccggtgcct

SEQ ID NO: 427865 - DNA, 25 bp, Rattus norvegicus
ggagctcttgaatctaccggtgcct

SEQ ID NO: 427866 - DNA, 25 bp, Rattus norvegicus
ggagctcttgacagttctccagaga

SEQ ID NO: 427867 - DNA, 25 bp, Rattus norvegicus
ggagctcttgactgttctccagaga

SEQ ID NO: 427868 - DNA, 25 bp, Rattus norvegicus
ggagctcttggtatccagggcaaag

SEQ ID NO: 427869 - DNA, 25 bp, Rattus norvegicus
ggagctcttggtttccagggcaaag

SEQ ID NO: 427870 - DNA, 25 bp, Rattus norvegicus
ggagctgaaacacgaagccccatga

SEQ ID NO: 427871 - DNA, 25 bp, Rattus norvegicus
ggagctgaaacaggaagccccatga

SEQ ID NO: 427872 - DNA, 25 bp, Rattus norvegicus
ggagctgaacagaaagtaccctagg

SEQ ID NO: 427873 - DNA, 25 bp, Rattus norvegicus
ggagctgaacagtaagtaccctagg

SEQ ID NO: 427874 - DNA, 25 bp, Rattus norvegicus
ggagctgaagagctagcctcccctg

SEQ ID NO: 427875 - DNA, 25 bp, Rattus norvegicus
ggagctgaagaggtagcctcccctg

SEQ ID NO: 427876 - DNA, 25 bp, Rattus norvegicus
ggagctgaagatcaatttaccatag

SEQ ID NO: 427877 - DNA, 25 bp, Rattus norvegicus
ggagctgaagatccccaaggactat

SEQ ID NO: 427878 - DNA, 25 bp, Rattus norvegicus
ggagctgaagatgaatttaccatag

SEQ ID NO: 427879 - DNA, 25 bp, Rattus norvegicus
ggagctgaagatgcccaaggactat

SEQ ID NO: 427880 - DNA, 25 bp, Rattus norvegicus
ggagctgaagctcctgattcagtca

SEQ ID NO: 427881 - DNA, 25 bp, Rattus norvegicus
ggagctgaagctgctgattcagtca

SEQ ID NO: 427882 - DNA, 25 bp, Rattus norvegicus
ggagctgaatccaatctttcatgta

SEQ ID NO: 427883 - DNA, 25 bp, Rattus norvegicus
ggagctgaatcctatctttcatgta

SEQ ID NO: 427884 - DNA, 25 bp, Rattus norvegicus
ggagctgaatctcaggcttcgagat

SEQ ID NO: 427885 - DNA, 25 bp, Rattus norvegicus
ggagctgaatctgaggcttcgagat

SEQ ID NO: 427886 - DNA, 25 bp, Rattus norvegicus
ggagctgacactcacaatggccttt

SEQ ID NO: 427887 - DNA, 25 bp, Rattus norvegicus
ggagctgacactgacaatggccttt

SEQ ID NO: 427888 - DNA, 25 bp, Rattus norvegicus
ggagctgacagtaccacaggagcac

SEQ ID NO: 427889 - DNA, 25 bp, Rattus norvegicus
ggagctgacagttccacaggagcac

SEQ ID NO: 427890 - DNA, 25 bp, Rattus norvegicus
ggagctgaccggacacatgagacca

SEQ ID NO: 427891 - DNA, 25 bp, Rattus norvegicus
ggagctgaccggtcacatgagacca

SEQ ID NO: 427892 - DNA, 25 bp, Rattus norvegicus
ggagctgaccttactttgtgtatat

SEQ ID NO: 427893 - DNA, 25 bp, Rattus norvegicus
ggagctgacctttctttgtgtatat

SEQ ID NO: 427894 - DNA, 25 bp, Rattus norvegicus
ggagctgacgtcagtggcccatgtc

SEQ ID NO: 427895 - DNA, 25 bp, Rattus norvegicus
ggagctgacgtctgtggcccatgtc

SEQ ID NO: 427896 - DNA, 25 bp, Rattus norvegicus
ggagctgacgtgaagatgccgcccc

SEQ ID NO: 427897 - DNA, 25 bp, Rattus norvegicus
ggagctgacgtgtagatgccgcccc

SEQ ID NO: 427898 - DNA, 25 bp, Rattus norvegicus
ggagctgactggaagcccaacagaa

SEQ ID NO: 427899 - DNA, 25 bp, Rattus norvegicus
ggagctgactggtagcccaacagaa

SEQ ID NO: 427900 - DNA, 25 bp, Rattus norvegicus
ggagctgacttaagaagggcctcaa

SEQ ID NO: 427901 - DNA, 25 bp, Rattus norvegicus
ggagctgacttatgaagggcctcaa

SEQ ID NO: 427902 - DNA, 25 bp, Rattus norvegicus
ggagctgactttagaacgcccgtca

SEQ ID NO: 427903 - DNA, 25 bp, Rattus norvegicus
ggagctgacttttgaacgcccgtca

SEQ ID NO: 427904 - DNA, 25 bp, Rattus norvegicus
ggagctgagacactgtctcccctgc

SEQ ID NO: 427905 - DNA, 25 bp, Rattus norvegicus
ggagctgagacagtgtctcccctgc

SEQ ID NO: 427906 - DNA, 25 bp, Rattus norvegicus
ggagctgagagaacatcgaatggaa

SEQ ID NO: 427907 - DNA, 25 bp, Rattus norvegicus
ggagctgagagatcatcgaatggaa

SEQ ID NO: 427908 - DNA, 25 bp, Rattus norvegicus
ggagctgagatgagcctcctgatga

SEQ ID NO: 427909 - DNA, 25 bp, Rattus norvegicus
ggagctgagatgtgcctcctgatga

SEQ ID NO: 427910 - DNA, 25 bp, Rattus norvegicus
ggagctgagattagtgcgagaatta

SEQ ID NO: 427911 - DNA, 25 bp, Rattus norvegicus
ggagctgagatttgtgcgagaatta

SEQ ID NO: 427912 - DNA, 25 bp, Rattus norvegicus
ggagctgagcatactgcaaatggct

SEQ ID NO: 427913 - DNA, 25 bp, Rattus norvegicus
ggagctgagcattctgcaaatggct

SEQ ID NO: 427914 - DNA, 25 bp, Rattus norvegicus
ggagctgaggacattggacccatct

SEQ ID NO: 427915 - DNA, 25 bp, Rattus norvegicus
ggagctgaggactttggacccatct

SEQ ID NO: 427916 - DNA, 25 bp, Rattus norvegicus
ggagctgaggcccaagcagtttatt

SEQ ID NO: 427917 - DNA, 25 bp, Rattus norvegicus
ggagctgaggccgaagcagtttatt

SEQ ID NO: 427918 - DNA, 25 bp, Rattus norvegicus
ggagctgatcacataaccctgggta

SEQ ID NO: 427919 - DNA, 25 bp, Rattus norvegicus
ggagctgatcacttaaccctgggta

SEQ ID NO: 427920 - DNA, 25 bp, Rattus norvegicus
ggagctgatcagacattgtgggcaa

SEQ ID NO: 427921 - DNA, 25 bp, Rattus norvegicus
ggagctgatcagtcattgtgggcaa

SEQ ID NO: 427922 - DNA, 25 bp, Rattus norvegicus
ggagctgatccaccgatacgtagag

SEQ ID NO: 427923 - DNA, 25 bp, Rattus norvegicus
ggagctgatccagcgatacgtagag

SEQ ID NO: 427924 - DNA, 25 bp, Rattus norvegicus
ggagctgatcgacccaacgttggat

SEQ ID NO: 427925 - DNA, 25 bp, Rattus norvegicus
ggagctgatcgagccaacgttggat

SEQ ID NO: 427926 - DNA, 25 bp, Rattus norvegicus
ggagctgatctgctcaggtcaacct

SEQ ID NO: 427927 - DNA, 25 bp, Rattus norvegicus
ggagctgatctggtcaggtcaacct

SEQ ID NO: 427928 - DNA, 25 bp, Rattus norvegicus
ggagctgattatctcctcacagagg

SEQ ID NO: 427929 - DNA, 25 bp, Rattus norvegicus
ggagctgattatgtcctcacagagg

SEQ ID NO: 427930 - DNA, 25 bp, Rattus norvegicus
ggagctgcaagcactttatgcacta

SEQ ID NO: 427931 - DNA, 25 bp, Rattus norvegicus
ggagctgcaagctctttatgcacta

SEQ ID NO: 427932 - DNA, 25 bp, Rattus norvegicus
ggagctgcaaggcagaccaactctt

SEQ ID NO: 427933 - DNA, 25 bp, Rattus norvegicus
ggagctgcaagggagaccaactctt

SEQ ID NO: 427934 - DNA, 25 bp, Rattus norvegicus
ggagctgcaagtcaccattaccatc

SEQ ID NO: 427935 - DNA, 25 bp, Rattus norvegicus
ggagctgcaagtgaccattaccatc

SEQ ID NO: 427936 - DNA, 25 bp, Rattus norvegicus
ggagctgcacacataagttgcccag

SEQ ID NO: 427937 - DNA, 25 bp, Rattus norvegicus
ggagctgcacaccaaaattctagca

SEQ ID NO: 427938 - DNA, 25 bp, Rattus norvegicus
ggagctgcacacgaaaattctagca

SEQ ID NO: 427939 - DNA, 25 bp, Rattus norvegicus
ggagctgcacacttaagttgcccag

SEQ ID NO: 427940 - DNA, 25 bp, Rattus norvegicus
ggagctgcagccatagaccgagcgc

SEQ ID NO: 427941 - DNA, 25 bp, Rattus norvegicus
ggagctgcagccttagaccgagcgc

SEQ ID NO: 427942 - DNA, 25 bp, Rattus norvegicus
ggagctgccaaaaaagggtcaccct

SEQ ID NO: 427943 - DNA, 25 bp, Rattus norvegicus
ggagctgccaaataagggtcaccct

SEQ ID NO: 427944 - DNA, 25 bp, Rattus norvegicus
ggagctgccaagagccacactgcag

SEQ ID NO: 427945 - DNA, 25 bp, Rattus norvegicus
ggagctgccaagtgccacactgcag

SEQ ID NO: 427946 - DNA, 25 bp, Rattus norvegicus
ggagctgccaatatcatttctctta

SEQ ID NO: 427947 - DNA, 25 bp, Rattus norvegicus
ggagctgccaatttcatttctctta

SEQ ID NO: 427948 - DNA, 25 bp, Rattus norvegicus
ggagctgccaccatgagactgtgca

SEQ ID NO: 427949 - DNA, 25 bp, Rattus norvegicus
ggagctgccaccttgagactgtgca

SEQ ID NO: 427950 - DNA, 25 bp, Rattus norvegicus
ggagctgccatgatttaggtcaatc

SEQ ID NO: 427951 - DNA, 25 bp, Rattus norvegicus
ggagctgccatgttttaggtcaatc

SEQ ID NO: 427952 - DNA, 25 bp, Rattus norvegicus
ggagctgccctaccttaggtctgct

SEQ ID NO: 427953 - DNA, 25 bp, Rattus norvegicus
ggagctgccctagcttaggtctgct

SEQ ID NO: 427954 - DNA, 25 bp, Rattus norvegicus
ggagctgcccttaatgccaggaaat

SEQ ID NO: 427955 - DNA, 25 bp, Rattus norvegicus
ggagctgccctttatgccaggaaat

SEQ ID NO: 427956 - DNA, 25 bp, Rattus norvegicus
ggagctgcctaaagtgttcctcagg

SEQ ID NO: 427957 - DNA, 25 bp, Rattus norvegicus
ggagctgcctaatgtgttcctcagg

SEQ ID NO: 427958 - DNA, 25 bp, Rattus norvegicus
ggagctgcctacaagttttgtgtta

SEQ ID NO: 427959 - DNA, 25 bp, Rattus norvegicus
ggagctgcctactagttttgtgtta

SEQ ID NO: 427960 - DNA, 25 bp, Rattus norvegicus
ggagctgccttcaagttgtgcatat

SEQ ID NO: 427961 - DNA, 25 bp, Rattus norvegicus
ggagctgccttcaatctgtagttta

SEQ ID NO: 427962 - DNA, 25 bp, Rattus norvegicus
ggagctgccttctagttgtgcatat

SEQ ID NO: 427963 - DNA, 25 bp, Rattus norvegicus
ggagctgccttctatctgtagttta

SEQ ID NO: 427964 - DNA, 25 bp, Rattus norvegicus
ggagctgcgcatcgagaccatcgct

SEQ ID NO: 427965 - DNA, 25 bp, Rattus norvegicus
ggagctgcgcatggagaccatcgct

SEQ ID NO: 427966 - DNA, 25 bp, Rattus norvegicus
ggagctgcgcgacctcaacgaccgt

SEQ ID NO: 427967 - DNA, 25 bp, Rattus norvegicus
ggagctgcgcgagctcaacgaccgt

SEQ ID NO: 427968 - DNA, 25 bp, Rattus norvegicus
ggagctgctagtagactgttacaaa

SEQ ID NO: 427969 - DNA, 25 bp, Rattus norvegicus
ggagctgctagttgactgttacaaa

SEQ ID NO: 427970 - DNA, 25 bp, Rattus norvegicus
ggagctgctctaattactactgtgt

SEQ ID NO: 427971 - DNA, 25 bp, Rattus norvegicus
ggagctgctctatttactactgtgt

SEQ ID NO: 427972 - DNA, 25 bp, Rattus norvegicus
ggagctgctctcactgattgctggg

SEQ ID NO: 427973 - DNA, 25 bp, Rattus norvegicus
ggagctgctctctctgattgctggg

SEQ ID NO: 427974 - DNA, 25 bp, Rattus norvegicus
ggagctgctctgatgggcaagccta

SEQ ID NO: 427975 - DNA, 25 bp, Rattus norvegicus
ggagctgctctgttgggcaagccta

SEQ ID NO: 427976 - DNA, 25 bp, Rattus norvegicus
ggagctgctgcaacttaacatcgag

SEQ ID NO: 427977 - DNA, 25 bp, Rattus norvegicus
ggagctgctgcatcttaacatcgag

SEQ ID NO: 427978 - DNA, 25 bp, Rattus norvegicus
ggagctgctgcgatacaagcgtatc

SEQ ID NO: 427979 - DNA, 25 bp, Rattus norvegicus
ggagctgctgcgttacaagcgtatc

SEQ ID NO: 427980 - DNA, 25 bp, Rattus norvegicus
ggagctgctgttatatatcatgact

SEQ ID NO: 427981 - DNA, 25 bp, Rattus norvegicus
ggagctgctgttttatatcatgact

SEQ ID NO: 427982 - DNA, 25 bp, Rattus norvegicus
ggagctgcttggatctttcgaagac

SEQ ID NO: 427983 - DNA, 25 bp, Rattus norvegicus
ggagctgcttggttctttcgaagac

SEQ ID NO: 427984 - DNA, 25 bp, Rattus norvegicus
ggagctgctttgatgcctaaacttc

SEQ ID NO: 427985 - DNA, 25 bp, Rattus norvegicus
ggagctgctttgttgcctaaacttc

SEQ ID NO: 427986 - DNA, 25 bp, Rattus norvegicus
ggagctggatccatccaagcatggg

SEQ ID NO: 427987 - DNA, 25 bp, Rattus norvegicus
ggagctggatccttccaagcatggg

SEQ ID NO: 427988 - DNA, 25 bp, Rattus norvegicus
ggagctggatgactcacatctagaa

SEQ ID NO: 427989 - DNA, 25 bp, Rattus norvegicus
ggagctggatgagtcacatctagaa

SEQ ID NO: 427990 - DNA, 25 bp, Rattus norvegicus
ggagctggcaaaatcgtcaccacca

SEQ ID NO: 427991 - DNA, 25 bp, Rattus norvegicus
ggagctggcaaactcaccaagtctg

SEQ ID NO: 427992 - DNA, 25 bp, Rattus norvegicus
ggagctggcaaagtcaccaagtctg

SEQ ID NO: 427993 - DNA, 25 bp, Rattus norvegicus
ggagctggcaaattcgtcaccacca

SEQ ID NO: 427994 - DNA, 25 bp, Rattus norvegicus
ggagctggcagtctgtcctagatat

SEQ ID NO: 427995 - DNA, 25 bp, Rattus norvegicus
ggagctggcagtgtgtcctagatat

SEQ ID NO: 427996 - DNA, 25 bp, Rattus norvegicus
ggagctggcatgatgtctctagcaa

SEQ ID NO: 427997 - DNA, 25 bp, Rattus norvegicus
ggagctggcatgttgtctctagcaa

SEQ ID NO: 427998 - DNA, 25 bp, Rattus norvegicus
ggagctggccagacaccttagaaaa

SEQ ID NO: 427999 - DNA, 25 bp, Rattus norvegicus
ggagctggccagtcaccttagaaaa

SEQ ID NO: 428000 - DNA, 25 bp, Rattus norvegicus
ggagctggcgctcatcacacaggcc

SEQ ID NO: 428001 - DNA, 25 bp, Rattus norvegicus
ggagctggcgctgatcacacaggcc

SEQ ID NO: 428002 - DNA, 25 bp, Rattus norvegicus
ggagctggctaacagatttcctcag

SEQ ID NO: 428003 - DNA, 25 bp, Rattus norvegicus
ggagctggctaagagatttcctcag

SEQ ID NO: 428004 - DNA, 25 bp, Rattus norvegicus
ggagctggctacatttctgcttgac

SEQ ID NO: 428005 - DNA, 25 bp, Rattus norvegicus
ggagctggctacttttctgcttgac

SEQ ID NO: 428006 - DNA, 25 bp, Rattus norvegicus
ggagctggcttacaatgtgtcttta

SEQ ID NO: 428007 - DNA, 25 bp, Rattus norvegicus
ggagctggcttagaatgtgtcttta

SEQ ID NO: 428008 - DNA, 25 bp, Rattus norvegicus
ggagctgggaagaccacactcatga

SEQ ID NO: 428009 - DNA, 25 bp, Rattus norvegicus
ggagctgggaagtccacactcatga

SEQ ID NO: 428010 - DNA, 25 bp, Rattus norvegicus
ggagctgggaatatctactgcaggt

SEQ ID NO: 428011 - DNA, 25 bp, Rattus norvegicus
ggagctgggaatttctactgcaggt

SEQ ID NO: 428012 - DNA, 25 bp, Rattus norvegicus
ggagctgggagcacctctccgcgac

SEQ ID NO: 428013 - DNA, 25 bp, Rattus norvegicus
ggagctgggagctcctctccgcgac

SEQ ID NO: 428014 - DNA, 25 bp, Rattus norvegicus
ggagctgggctcatttgaatttgtt

SEQ ID NO: 428015 - DNA, 25 bp, Rattus norvegicus
ggagctgggctcttttgaatttgtt

SEQ ID NO: 428016 - DNA, 25 bp, Rattus norvegicus
ggagctgggttaactgcttcatagc

SEQ ID NO: 428017 - DNA, 25 bp, Rattus norvegicus
ggagctgggttatctgcttcatagc

SEQ ID NO: 428018 - DNA, 25 bp, Rattus norvegicus
ggagctggtaaaaattttaacccat

SEQ ID NO: 428019 - DNA, 25 bp, Rattus norvegicus
ggagctggtaaatattttaacccat

SEQ ID NO: 428020 - DNA, 25 bp, Rattus norvegicus
ggagctggtagaacagacctggtct

SEQ ID NO: 428021 - DNA, 25 bp, Rattus norvegicus
ggagctggtagatcagacctggtct

SEQ ID NO: 428022 - DNA, 25 bp, Rattus norvegicus
ggagctggtcttacagccaccattg

SEQ ID NO: 428023 - DNA, 25 bp, Rattus norvegicus
ggagctggtctttcagccaccattg

SEQ ID NO: 428024 - DNA, 25 bp, Rattus norvegicus
ggagctggtgagaccttgaggcagg

SEQ ID NO: 428025 - DNA, 25 bp, Rattus norvegicus
ggagctggtgagtccttgaggcagg

SEQ ID NO: 428026 - DNA, 25 bp, Rattus norvegicus
ggagctggtgcaatttgtgcacaaa

SEQ ID NO: 428027 - DNA, 25 bp, Rattus norvegicus
ggagctggtgcattttgtgcacaaa

SEQ ID NO: 428028 - DNA, 25 bp, Rattus norvegicus
ggagctgtacgaatgcctggactac

SEQ ID NO: 428029 - DNA, 25 bp, Rattus norvegicus
ggagctgtacgattgcctggactac

SEQ ID NO: 428030 - DNA, 25 bp, Rattus norvegicus
ggagctgtactaaatctgtccttag

SEQ ID NO: 428031 - DNA, 25 bp, Rattus norvegicus
ggagctgtactatatctgtccttag

SEQ ID NO: 428032 - DNA, 25 bp, Rattus norvegicus
ggagctgtacttcaatgacaacccc

SEQ ID NO: 428033 - DNA, 25 bp, Rattus norvegicus
ggagctgtacttcatgtccaccggt

SEQ ID NO: 428034 - DNA, 25 bp, Rattus norvegicus
ggagctgtacttgaatgacaacccc

SEQ ID NO: 428035 - DNA, 25 bp, Rattus norvegicus
ggagctgtacttgatgtccaccggt

SEQ ID NO: 428036 - DNA, 25 bp, Rattus norvegicus
ggagctgtccagagctagaggcctt

SEQ ID NO: 428037 - DNA, 25 bp, Rattus norvegicus
ggagctgtccagtgctagaggcctt

SEQ ID NO: 428038 - DNA, 25 bp, Rattus norvegicus
ggagctgtccatagcctcgtcatct

SEQ ID NO: 428039 - DNA, 25 bp, Rattus norvegicus
ggagctgtccattgcctcgtcatct

SEQ ID NO: 428040 - DNA, 25 bp, Rattus norvegicus
ggagctgtccccataggatgcatag

SEQ ID NO: 428041 - DNA, 25 bp, Rattus norvegicus
ggagctgtccccttaggatgcatag

SEQ ID NO: 428042 - DNA, 25 bp, Rattus norvegicus
ggagctgtcctgctgtaaataccct

SEQ ID NO: 428043 - DNA, 25 bp, Rattus norvegicus
ggagctgtcctggtgtaaataccct

SEQ ID NO: 428044 - DNA, 25 bp, Rattus norvegicus
ggagctgtcgtactccctgcattac

SEQ ID NO: 428045 - DNA, 25 bp, Rattus norvegicus
ggagctgtcgtagtccctgcattac

SEQ ID NO: 428046 - DNA, 25 bp, Rattus norvegicus
ggagctgtgatcaactgtgctgaca

SEQ ID NO: 428047 - DNA, 25 bp, Rattus norvegicus
ggagctgtgatctactgtgctgaca

SEQ ID NO: 428048 - DNA, 25 bp, Rattus norvegicus
ggagctgtgcacaagccaagtcttg

SEQ ID NO: 428049 - DNA, 25 bp, Rattus norvegicus
ggagctgtgcactagccaagtcttg

SEQ ID NO: 428050 - DNA, 25 bp, Rattus norvegicus
ggagctgtggacctgtacaacgtct

SEQ ID NO: 428051 - DNA, 25 bp, Rattus norvegicus
ggagctgtggacgtgtacaacgtct

SEQ ID NO: 428052 - DNA, 25 bp, Rattus norvegicus
ggagctgtggagacatgctgcactc

SEQ ID NO: 428053 - DNA, 25 bp, Rattus norvegicus
ggagctgtggagtcatgctgcactc

SEQ ID NO: 428054 - DNA, 25 bp, Rattus norvegicus
ggagctgtggcaccaaatacccaac

SEQ ID NO: 428055 - DNA, 25 bp, Rattus norvegicus
ggagctgtggcacgtttgttttatt

SEQ ID NO: 428056 - DNA, 25 bp, Rattus norvegicus
ggagctgtggcagcaaatacccaac

SEQ ID NO: 428057 - DNA, 25 bp, Rattus norvegicus
ggagctgtggcaggtttgttttatt

SEQ ID NO: 428058 - DNA, 25 bp, Rattus norvegicus
ggagctgtggctcttgactgacctt

SEQ ID NO: 428059 - DNA, 25 bp, Rattus norvegicus
ggagctgtggctgttgactgacctt

SEQ ID NO: 428060 - DNA, 25 bp, Rattus norvegicus
ggagctgtgggtaacagtcacttaa

SEQ ID NO: 428061 - DNA, 25 bp, Rattus norvegicus
ggagctgtgggttacagtcacttaa

SEQ ID NO: 428062 - DNA, 25 bp, Rattus norvegicus
ggagctgtggtcatggtcaccccat

SEQ ID NO: 428063 - DNA, 25 bp, Rattus norvegicus
ggagctgtggtcttggtcaccccat

SEQ ID NO: 428064 - DNA, 25 bp, Rattus norvegicus
ggagctgtgtaaattccttacctct

SEQ ID NO: 428065 - DNA, 25 bp, Rattus norvegicus
ggagctgtgtaatttccttacctct

SEQ ID NO: 428066 - DNA, 25 bp, Rattus norvegicus
ggagctgtgtataaacatgttaaca

SEQ ID NO: 428067 - DNA, 25 bp, Rattus norvegicus
ggagctgtgtattaacatgttaaca

SEQ ID NO: 428068 - DNA, 25 bp, Rattus norvegicus
ggagctgtgtgcatctcgtcgtcag

SEQ ID NO: 428069 - DNA, 25 bp, Rattus norvegicus
ggagctgtgtgcttctcgtcgtcag

SEQ ID NO: 428070 - DNA, 25 bp, Rattus norvegicus
ggagctgtgttcattttgccaaata

SEQ ID NO: 428071 - DNA, 25 bp, Rattus norvegicus
ggagctgtgttctttttgccaaata

SEQ ID NO: 428072 - DNA, 25 bp, Rattus norvegicus
ggagctgttagacatatcccagaaa

SEQ ID NO: 428073 - DNA, 25 bp, Rattus norvegicus
ggagctgttagagatatcccagaaa

SEQ ID NO: 428074 - DNA, 25 bp, Rattus norvegicus
ggagctgttatgacatatgcccaaa

SEQ ID NO: 428075 - DNA, 25 bp, Rattus norvegicus
ggagctgttatgtcatatgcccaaa

SEQ ID NO: 428076 - DNA, 25 bp, Rattus norvegicus
ggagctgttctaacatgttcattga

SEQ ID NO: 428077 - DNA, 25 bp, Rattus norvegicus
ggagctgttctatcatgttcattga

SEQ ID NO: 428078 - DNA, 25 bp, Rattus norvegicus
ggagctgttctccattcaacagtgt

SEQ ID NO: 428079 - DNA, 25 bp, Rattus norvegicus
ggagctgttctcgattcaacagtgt

SEQ ID NO: 428080 - DNA, 25 bp, Rattus norvegicus
ggagctgttgctcacaagaacccgt

SEQ ID NO: 428081 - DNA, 25 bp, Rattus norvegicus
ggagctgttgctgacaagaacccgt

SEQ ID NO: 428082 - DNA, 25 bp, Rattus norvegicus
ggagctgtttccagtttgccaataa

SEQ ID NO: 428083 - DNA, 25 bp, Rattus norvegicus
ggagctgtttcctgtttgccaataa

SEQ ID NO: 428084 - DNA, 25 bp, Rattus norvegicus
ggagctgtttctaccactgtggaga

SEQ ID NO: 428085 - DNA, 25 bp, Rattus norvegicus
ggagctgtttctacccaagcatgga

SEQ ID NO: 428086 - DNA, 25 bp, Rattus norvegicus
ggagctgtttcttccactgtggaga

SEQ ID NO: 428087 - DNA, 25 bp, Rattus norvegicus
ggagctgtttcttcccaagcatgga

SEQ ID NO: 428088 - DNA, 25 bp, Rattus norvegicus
ggagctgttttactgtctacttttc

SEQ ID NO: 428089 - DNA, 25 bp, Rattus norvegicus
ggagctgttttagtgtctacttttc

SEQ ID NO: 428090 - DNA, 25 bp, Rattus norvegicus
ggagctgtttttcttgtttcaatga

SEQ ID NO: 428091 - DNA, 25 bp, Rattus norvegicus
ggagctgtttttgttgtttcaatga

SEQ ID NO: 428092 - DNA, 25 bp, Rattus norvegicus
ggagcttaaagcatagcccataaat

SEQ ID NO: 428093 - DNA, 25 bp, Rattus norvegicus
ggagcttaaagcttagcccataaat

SEQ ID NO: 428094 - DNA, 25 bp, Rattus norvegicus
ggagcttaagcacttcgaggccaaa

SEQ ID NO: 428095 - DNA, 25 bp, Rattus norvegicus
ggagcttaagcagttcgaggccaaa

SEQ ID NO: 428096 - DNA, 25 bp, Rattus norvegicus
ggagcttacactaaacctatgaata

SEQ ID NO: 428097 - DNA, 25 bp, Rattus norvegicus
ggagcttacacttaacctatgaata

SEQ ID NO: 428098 - DNA, 25 bp, Rattus norvegicus
ggagcttacatgatccctaaactca

SEQ ID NO: 428099 - DNA, 25 bp, Rattus norvegicus
ggagcttacatgttccctaaactca

SEQ ID NO: 428100 - DNA, 25 bp, Rattus norvegicus
ggagcttaccttagttctggattac

SEQ ID NO: 428101 - DNA, 25 bp, Rattus norvegicus
ggagcttacctttgttctggattac

SEQ ID NO: 428102 - DNA, 25 bp, Rattus norvegicus
ggagcttactagaccagtgacatca

SEQ ID NO: 428103 - DNA, 25 bp, Rattus norvegicus
ggagcttactagtccagtgacatca

SEQ ID NO: 428104 - DNA, 25 bp, Rattus norvegicus
ggagcttagaacagacatctatttc

SEQ ID NO: 428105 - DNA, 25 bp, Rattus norvegicus
ggagcttagaactgacatctatttc

SEQ ID NO: 428106 - DNA, 25 bp, Rattus norvegicus
ggagcttagctcacaactttcaaag

SEQ ID NO: 428107 - DNA, 25 bp, Rattus norvegicus
ggagcttagctctcaactttcaaag

SEQ ID NO: 428108 - DNA, 25 bp, Rattus norvegicus
ggagcttcaactcgagttgccgcca

SEQ ID NO: 428109 - DNA, 25 bp, Rattus norvegicus
ggagcttcaactggagttgccgcca

SEQ ID NO: 428110 - DNA, 25 bp, Rattus norvegicus
ggagcttcaagtatgggccaggcca

SEQ ID NO: 428111 - DNA, 25 bp, Rattus norvegicus
ggagcttcaagtttgggccaggcca

SEQ ID NO: 428112 - DNA, 25 bp, Rattus norvegicus
ggagcttcaattcctcagaatgtcg

SEQ ID NO: 428113 - DNA, 25 bp, Rattus norvegicus
ggagcttcaattgctcagaatgtcg

SEQ ID NO: 428114 - DNA, 25 bp, Rattus norvegicus
ggagcttcacgcctacatcagtggt

SEQ ID NO: 428115 - DNA, 25 bp, Rattus norvegicus
ggagcttcacgcgtacatcagtggt

SEQ ID NO: 428116 - DNA, 25 bp, Rattus norvegicus
ggagcttcactgcagtgagctgttt

SEQ ID NO: 428117 - DNA, 25 bp, Rattus norvegicus
ggagcttcactggagtgagctgttt

SEQ ID NO: 428118 - DNA, 25 bp, Rattus norvegicus
ggagcttcagtcaggtggccacaaa

SEQ ID NO: 428119 - DNA, 25 bp, Rattus norvegicus
ggagcttcagtctggtggccacaaa

SEQ ID NO: 428120 - DNA, 25 bp, Rattus norvegicus
ggagcttcataccacatgacacgtg

SEQ ID NO: 428121 - DNA, 25 bp, Rattus norvegicus
ggagcttcatacgacatgacacgtg

SEQ ID NO: 428122 - DNA, 25 bp, Rattus norvegicus
ggagcttccaagctgtctgggacca

SEQ ID NO: 428123 - DNA, 25 bp, Rattus norvegicus
ggagcttccaaggtgtctgggacca

SEQ ID NO: 428124 - DNA, 25 bp, Rattus norvegicus
ggagcttccagtcgctggcatcaga

SEQ ID NO: 428125 - DNA, 25 bp, Rattus norvegicus
ggagcttccagtggctggcatcaga

SEQ ID NO: 428126 - DNA, 25 bp, Rattus norvegicus
ggagcttctatactgttgcctgact

SEQ ID NO: 428127 - DNA, 25 bp, Rattus norvegicus
ggagcttctatagtgttgcctgact

SEQ ID NO: 428128 - DNA, 25 bp, Rattus norvegicus
ggagcttctcaaaggctggtgtgcc

SEQ ID NO: 428129 - DNA, 25 bp, Rattus norvegicus
ggagcttctcaatggctggtgtgcc

SEQ ID NO: 428130 - DNA, 25 bp, Rattus norvegicus
ggagcttctcagacgcatcttgaat

SEQ ID NO: 428131 - DNA, 25 bp, Rattus norvegicus
ggagcttctcagtcgcatcttgaat

SEQ ID NO: 428132 - DNA, 25 bp, Rattus norvegicus
ggagcttctgcacttggatctgcat

SEQ ID NO: 428133 - DNA, 25 bp, Rattus norvegicus
ggagcttctgcagttggatctgcat

SEQ ID NO: 428134 - DNA, 25 bp, Rattus norvegicus
ggagcttctggcatcctgaaagcaa

SEQ ID NO: 428135 - DNA, 25 bp, Rattus norvegicus
ggagcttctggcttcctgaaagcaa

SEQ ID NO: 428136 - DNA, 25 bp, Rattus norvegicus
ggagcttcttctagtgacttttcac

SEQ ID NO: 428137 - DNA, 25 bp, Rattus norvegicus
ggagcttcttcttgtgacttttcac

SEQ ID NO: 428138 - DNA, 25 bp, Rattus norvegicus
ggagcttcttgccaacatgccagac

SEQ ID NO: 428139 - DNA, 25 bp, Rattus norvegicus
ggagcttcttgcgaacatgccagac

SEQ ID NO: 428140 - DNA, 25 bp, Rattus norvegicus
ggagcttgaaagacaacggcgttta

SEQ ID NO: 428141 - DNA, 25 bp, Rattus norvegicus
ggagcttgaaagtcaacggcgttta

SEQ ID NO: 428142 - DNA, 25 bp, Rattus norvegicus
ggagcttgagctaggagacttgact

SEQ ID NO: 428143 - DNA, 25 bp, Rattus norvegicus
ggagcttgagcttggagacttgact

SEQ ID NO: 428144 - DNA, 25 bp, Rattus norvegicus
ggagcttgcacactctagtacttat

SEQ ID NO: 428145 - DNA, 25 bp, Rattus norvegicus
ggagcttgcacagtctagtacttat

SEQ ID NO: 428146 - DNA, 25 bp, Rattus norvegicus
ggagcttgcaccatcttgttttaag

SEQ ID NO: 428147 - DNA, 25 bp, Rattus norvegicus
ggagcttgcaccttcttgttttaag

SEQ ID NO: 428148 - DNA, 25 bp, Rattus norvegicus
ggagcttgccacacagcttgagggc

SEQ ID NO: 428149 - DNA, 25 bp, Rattus norvegicus
ggagcttgccactcagcttgagggc

SEQ ID NO: 428150 - DNA, 25 bp, Rattus norvegicus
ggagcttgcctcagccatccaaggg

SEQ ID NO: 428151 - DNA, 25 bp, Rattus norvegicus
ggagcttgcctctgccatccaaggg

SEQ ID NO: 428152 - DNA, 25 bp, Rattus norvegicus
ggagcttgctacacaaaccaaattt

SEQ ID NO: 428153 - DNA, 25 bp, Rattus norvegicus
ggagcttgctactcaaaccaaattt

SEQ ID NO: 428154 - DNA, 25 bp, Rattus norvegicus
ggagcttgctcgactgagagatgca

SEQ ID NO: 428155 - DNA, 25 bp, Rattus norvegicus
ggagcttgctcgtctgagagatgca

SEQ ID NO: 428156 - DNA, 25 bp, Rattus norvegicus
ggagcttgctttacacagcagcaga

SEQ ID NO: 428157 - DNA, 25 bp, Rattus norvegicus
ggagcttgctttcatggcctggtaa

SEQ ID NO: 428158 - DNA, 25 bp, Rattus norvegicus
ggagcttgctttgatggcctggtaa

SEQ ID NO: 428159 - DNA, 25 bp, Rattus norvegicus
ggagcttgcttttcacagcagcaga

SEQ ID NO: 428160 - DNA, 25 bp, Rattus norvegicus
ggagcttggattatggtttttgcaa

SEQ ID NO: 428161 - DNA, 25 bp, Rattus norvegicus
ggagcttggattttggtttttgcaa

SEQ ID NO: 428162 - DNA, 25 bp, Rattus norvegicus
ggagcttggcacacactttttgtct

SEQ ID NO: 428163 - DNA, 25 bp, Rattus norvegicus
ggagcttggcactcactttttgtct

SEQ ID NO: 428164 - DNA, 25 bp, Rattus norvegicus
ggagcttggctgatattgatcttat

SEQ ID NO: 428165 - DNA, 25 bp, Rattus norvegicus
ggagcttggctgttattgatcttat

SEQ ID NO: 428166 - DNA, 25 bp, Rattus norvegicus
ggagcttgtacgatcaagaatgatt

SEQ ID NO: 428167 - DNA, 25 bp, Rattus norvegicus
ggagcttgtacgttcaagaatgatt

SEQ ID NO: 428168 - DNA, 25 bp, Rattus norvegicus
ggagcttgtcccctgagcctgttgc

SEQ ID NO: 428169 - DNA, 25 bp, Rattus norvegicus
ggagcttgtcccgtgagcctgttgc

SEQ ID NO: 428170 - DNA, 25 bp, Rattus norvegicus
ggagcttgtctcatgggaaccaggt

SEQ ID NO: 428171 - DNA, 25 bp, Rattus norvegicus
ggagcttgtctcttgggaaccaggt

SEQ ID NO: 428172 - DNA, 25 bp, Rattus norvegicus
ggagcttgtgcccaattgttacacc

SEQ ID NO: 428173 - DNA, 25 bp, Rattus norvegicus
ggagcttgtgccgaattgttacacc

SEQ ID NO: 428174 - DNA, 25 bp, Rattus norvegicus
ggagcttgttgtcgactaagtttca

SEQ ID NO: 428175 - DNA, 25 bp, Rattus norvegicus
ggagcttgttgtggactaagtttca

SEQ ID NO: 428176 - DNA, 25 bp, Rattus norvegicus
ggagcttgttttaacttgtgtctag

SEQ ID NO: 428177 - DNA, 25 bp, Rattus norvegicus
ggagcttgtttttacttgtgtctag

SEQ ID NO: 428178 - DNA, 25 bp, Rattus norvegicus
ggagctttaagccagcagttctctg

SEQ ID NO: 428179 - DNA, 25 bp, Rattus norvegicus
ggagctttaagcgagcagttctctg

SEQ ID NO: 428180 - DNA, 25 bp, Rattus norvegicus
ggagctttccaaatacctgcgggac

SEQ ID NO: 428181 - DNA, 25 bp, Rattus norvegicus
ggagctttccaattacctgcgggac

SEQ ID NO: 428182 - DNA, 25 bp, Rattus norvegicus
ggagctttccagcaatagccatgaa

SEQ ID NO: 428183 - DNA, 25 bp, Rattus norvegicus
ggagctttccaggaatagccatgaa

SEQ ID NO: 428184 - DNA, 25 bp, Rattus norvegicus
ggagctttcctactgcttaggatga

SEQ ID NO: 428185 - DNA, 25 bp, Rattus norvegicus
ggagctttcctagtgcttaggatga

SEQ ID NO: 428186 - DNA, 25 bp, Rattus norvegicus
ggagctttcctgcagcatgtggtac

SEQ ID NO: 428187 - DNA, 25 bp, Rattus norvegicus
ggagctttcctggagcatgtggtac

SEQ ID NO: 428188 - DNA, 25 bp, Rattus norvegicus
ggagctttcgtcatagagccatatt

SEQ ID NO: 428189 - DNA, 25 bp, Rattus norvegicus
ggagctttcgtcttagagccatatt

SEQ ID NO: 428190 - DNA, 25 bp, Rattus norvegicus
ggagctttctccaacgatgtacaca

SEQ ID NO: 428191 - DNA, 25 bp, Rattus norvegicus
ggagctttctcctacgatgtacaca

SEQ ID NO: 428192 - DNA, 25 bp, Rattus norvegicus
ggagctttctggatgctttctattt

SEQ ID NO: 428193 - DNA, 25 bp, Rattus norvegicus
ggagctttctggttgctttctattt

SEQ ID NO: 428194 - DNA, 25 bp, Rattus norvegicus
ggagctttgcaactatgcgtccaac

SEQ ID NO: 428195 - DNA, 25 bp, Rattus norvegicus
ggagctttgcaagtatgcgtccaac

SEQ ID NO: 428196 - DNA, 25 bp, Rattus norvegicus
ggagctttggctcctgtcctatgag

SEQ ID NO: 428197 - DNA, 25 bp, Rattus norvegicus
ggagctttggctgctgtcctatgag

SEQ ID NO: 428198 - DNA, 25 bp, Rattus norvegicus
ggagctttgggaacagtctgtcctt

SEQ ID NO: 428199 - DNA, 25 bp, Rattus norvegicus
ggagctttgggatcagtctgtcctt

SEQ ID NO: 428200 - DNA, 25 bp, Rattus norvegicus
ggagcttttacaacgcttaaggatg

SEQ ID NO: 428201 - DNA, 25 bp, Rattus norvegicus
ggagcttttacatcgcttaaggatg

SEQ ID NO: 428202 - DNA, 25 bp, Rattus norvegicus
ggagcttttcgaaccgtaaatggca

SEQ ID NO: 428203 - DNA, 25 bp, Rattus norvegicus
ggagcttttcgatccgtaaatggca

SEQ ID NO: 428204 - DNA, 25 bp, Rattus norvegicus
ggagcttttgcaccatccattttta

SEQ ID NO: 428205 - DNA, 25 bp, Rattus norvegicus
ggagcttttgcagcatccattttta

SEQ ID NO: 428206 - DNA, 25 bp, Rattus norvegicus
ggaggaaaagaacatcactaccact

SEQ ID NO: 428207 - DNA, 25 bp, Rattus norvegicus
ggaggaaaagaagatcactaccact

SEQ ID NO: 428208 - DNA, 25 bp, Rattus norvegicus
ggaggaaaccacctgagttagaaat

SEQ ID NO: 428209 - DNA, 25 bp, Rattus norvegicus
ggaggaaaccacgtgagttagaaat

SEQ ID NO: 428210 - DNA, 25 bp, Rattus norvegicus
ggaggaaacctcagtcttgaaatgt

SEQ ID NO: 428211 - DNA, 25 bp, Rattus norvegicus
ggaggaaacctctgtcttgaaatgt

SEQ ID NO: 428212 - DNA, 25 bp, Rattus norvegicus
ggaggaaactccatgacctctacct

SEQ ID NO: 428213 - DNA, 25 bp, Rattus norvegicus
ggaggaaactccttgacctctacct

SEQ ID NO: 428214 - DNA, 25 bp, Rattus norvegicus
ggaggaaagcaccttttacccactg

SEQ ID NO: 428215 - DNA, 25 bp, Rattus norvegicus
ggaggaaagcacgttttacccactg

SEQ ID NO: 428216 - DNA, 25 bp, Rattus norvegicus
ggaggaaagcccacaccgagacagc

SEQ ID NO: 428217 - DNA, 25 bp, Rattus norvegicus
ggaggaaagccccatcatcttgggt

SEQ ID NO: 428218 - DNA, 25 bp, Rattus norvegicus
ggaggaaagcccgatcatcttgggt

SEQ ID NO: 428219 - DNA, 25 bp, Rattus norvegicus
ggaggaaagccctcaccgagacagc

SEQ ID NO: 428220 - DNA, 25 bp, Rattus norvegicus
ggaggaaagtcactaggtactgcat

SEQ ID NO: 428221 - DNA, 25 bp, Rattus norvegicus
ggaggaaagtcagtaggtactgcat

SEQ ID NO: 428222 - DNA, 25 bp, Rattus norvegicus
ggaggaaatcagacttcctgaatct

SEQ ID NO: 428223 - DNA, 25 bp, Rattus norvegicus
ggaggaaatcagtcttcctgaatct

SEQ ID NO: 428224 - DNA, 25 bp, Rattus norvegicus
ggaggaaatcccatcatacttgaac

SEQ ID NO: 428225 - DNA, 25 bp, Rattus norvegicus
ggaggaaatcccttcatacttgaac

SEQ ID NO: 428226 - DNA, 25 bp, Rattus norvegicus
ggaggaaatctcatgcctatctaag

SEQ ID NO: 428227 - DNA, 25 bp, Rattus norvegicus
ggaggaaatctcttgcctatctaag

SEQ ID NO: 428228 - DNA, 25 bp, Rattus norvegicus
ggaggaacaccacccgtaatgcctg

SEQ ID NO: 428229 - DNA, 25 bp, Rattus norvegicus
ggaggaacaccagccgtaatgcctg

SEQ ID NO: 428230 - DNA, 25 bp, Rattus norvegicus
ggaggaaccaggaccaaccaatgtt

SEQ ID NO: 428231 - DNA, 25 bp, Rattus norvegicus
ggaggaaccaggtccaaccaatgtt

SEQ ID NO: 428232 - DNA, 25 bp, Rattus norvegicus
ggaggaacccgtccctgttacagga

SEQ ID NO: 428233 - DNA, 25 bp, Rattus norvegicus
ggaggaacccgtgcctgttacagga

SEQ ID NO: 428234 - DNA, 25 bp, Rattus norvegicus
ggaggaaccttgactgattcccaga

SEQ ID NO: 428235 - DNA, 25 bp, Rattus norvegicus
ggaggaaccttgtctgattcccaga

SEQ ID NO: 428236 - DNA, 25 bp, Rattus norvegicus
ggaggaacgacgacgcctctttttg

SEQ ID NO: 428237 - DNA, 25 bp, Rattus norvegicus
ggaggaacgacgtcgcctctttttg

SEQ ID NO: 428238 - DNA, 25 bp, Rattus norvegicus
ggaggaacggacactgaacccacgg

SEQ ID NO: 428239 - DNA, 25 bp, Rattus norvegicus
ggaggaacggactctgaacccacgg

SEQ ID NO: 428240 - DNA, 25 bp, Rattus norvegicus
ggaggaacggtgaagccatttcagt

SEQ ID NO: 428241 - DNA, 25 bp, Rattus norvegicus
ggaggaacggtgtagccatttcagt

SEQ ID NO: 428242 - DNA, 25 bp, Rattus norvegicus
ggaggaactcacagcggaagacccc

SEQ ID NO: 428243 - DNA, 25 bp, Rattus norvegicus
ggaggaactcactgcggaagacccc

SEQ ID NO: 428244 - DNA, 25 bp, Rattus norvegicus
ggaggaactcagacatcttagggat

SEQ ID NO: 428245 - DNA, 25 bp, Rattus norvegicus
ggaggaactcagtcatcttagggat

SEQ ID NO: 428246 - DNA, 25 bp, Rattus norvegicus
ggaggaactcccagcagtatacaca

SEQ ID NO: 428247 - DNA, 25 bp, Rattus norvegicus
ggaggaactccctgcagtatacaca

SEQ ID NO: 428248 - DNA, 25 bp, Rattus norvegicus
ggaggaactctaagccaagctcata

SEQ ID NO: 428249 - DNA, 25 bp, Rattus norvegicus
ggaggaactctatgccaagctcata

SEQ ID NO: 428250 - DNA, 25 bp, Rattus norvegicus
ggaggaactttgaaggcactggatt

SEQ ID NO: 428251 - DNA, 25 bp, Rattus norvegicus
ggaggaactttgtaggcactggatt

SEQ ID NO: 428252 - DNA, 25 bp, Rattus norvegicus
ggaggaagaggaattaccaggtcaa

SEQ ID NO: 428253 - DNA, 25 bp, Rattus norvegicus
ggaggaagaggatttaccaggtcaa

SEQ ID NO: 428254 - DNA, 25 bp, Rattus norvegicus
ggaggaagccagctttagcagtaat

SEQ ID NO: 428255 - DNA, 25 bp, Rattus norvegicus
ggaggaagccaggtttagcagtaat

SEQ ID NO: 428256 - DNA, 25 bp, Rattus norvegicus
ggaggaagccctagccacatggttt

SEQ ID NO: 428257 - DNA, 25 bp, Rattus norvegicus
ggaggaagccctccatgactctgaa

SEQ ID NO: 428258 - DNA, 25 bp, Rattus norvegicus
ggaggaagccctgcatgactctgaa

SEQ ID NO: 428259 - DNA, 25 bp, Rattus norvegicus
ggaggaagcccttgccacatggttt

SEQ ID NO: 428260 - DNA, 25 bp, Rattus norvegicus
ggaggaagccgaaccacgagctact

SEQ ID NO: 428261 - DNA, 25 bp, Rattus norvegicus
ggaggaagccgatccacgagctact

SEQ ID NO: 428262 - DNA, 25 bp, Rattus norvegicus
ggaggaagcctgatcgaaagcgacc

SEQ ID NO: 428263 - DNA, 25 bp, Rattus norvegicus
ggaggaagcctgttcgaaagcgacc

SEQ ID NO: 428264 - DNA, 25 bp, Rattus norvegicus
ggaggaagctgtcctctaccacaac

SEQ ID NO: 428265 - DNA, 25 bp, Rattus norvegicus
ggaggaagctgtgctctaccacaac

SEQ ID NO: 428266 - DNA, 25 bp, Rattus norvegicus
ggaggaagggaaactcccgccattt

SEQ ID NO: 428267 - DNA, 25 bp, Rattus norvegicus
ggaggaagggaatctcccgccattt

SEQ ID NO: 428268 - DNA, 25 bp, Rattus norvegicus
ggaggaagggacctttctgctccta

SEQ ID NO: 428269 - DNA, 25 bp, Rattus norvegicus
ggaggaagggacgtttctgctccta

SEQ ID NO: 428270 - DNA, 25 bp, Rattus norvegicus
ggaggaaggtgtccgtgcccgccgc

SEQ ID NO: 428271 - DNA, 25 bp, Rattus norvegicus
ggaggaaggtgtgcgtgcccgccgc

SEQ ID NO: 428272 - DNA, 25 bp, Rattus norvegicus
ggaggaaggttccattcgctcgttt

SEQ ID NO: 428273 - DNA, 25 bp, Rattus norvegicus
ggaggaaggttcgattcgctcgttt

SEQ ID NO: 428274 - DNA, 25 bp, Rattus norvegicus
ggaggaagtccaacctcttgcacaa

SEQ ID NO: 428275 - DNA, 25 bp, Rattus norvegicus
ggaggaagtccatcctcttgcacaa

SEQ ID NO: 428276 - DNA, 25 bp, Rattus norvegicus
ggaggaagtcgcatctaccccgtgg

SEQ ID NO: 428277 - DNA, 25 bp, Rattus norvegicus
ggaggaagtcgcttctaccccgtgg

SEQ ID NO: 428278 - DNA, 25 bp, Rattus norvegicus
ggaggaagtctcagcgctggcttac

SEQ ID NO: 428279 - DNA, 25 bp, Rattus norvegicus
ggaggaagtctctgcgctggcttac

SEQ ID NO: 428280 - DNA, 25 bp, Rattus norvegicus
ggaggaagtcttatgatgacatctt

SEQ ID NO: 428281 - DNA, 25 bp, Rattus norvegicus
ggaggaagtcttttgatgacatctt

SEQ ID NO: 428282 - DNA, 25 bp, Rattus norvegicus
ggaggaagttttagccagggcactc

SEQ ID NO: 428283 - DNA, 25 bp, Rattus norvegicus
ggaggaagtttttgccagggcactc

SEQ ID NO: 428284 - DNA, 25 bp, Rattus norvegicus
ggaggaataattacaggtgcaattc

SEQ ID NO: 428285 - DNA, 25 bp, Rattus norvegicus
ggaggaataatttcaggtgcaattc

SEQ ID NO: 428286 - DNA, 25 bp, Rattus norvegicus
ggaggaatacctcctttgtacatgt

SEQ ID NO: 428287 - DNA, 25 bp, Rattus norvegicus
ggaggaatacctgctttgtacatgt

SEQ ID NO: 428288 - DNA, 25 bp, Rattus norvegicus
ggaggaatcaccacaattccccatt

SEQ ID NO: 428289 - DNA, 25 bp, Rattus norvegicus
ggaggaatcacctcaattccccatt

SEQ ID NO: 428290 - DNA, 25 bp, Rattus norvegicus
ggaggaatcagcctctctctaggga

SEQ ID NO: 428291 - DNA, 25 bp, Rattus norvegicus
ggaggaatcagcgtctctctaggga

SEQ ID NO: 428292 - DNA, 25 bp, Rattus norvegicus
ggaggaatcaggacaaggcttctaa

SEQ ID NO: 428293 - DNA, 25 bp, Rattus norvegicus
ggaggaatcaggtcaaggcttctaa

SEQ ID NO: 428294 - DNA, 25 bp, Rattus norvegicus
ggaggaatcctgagtttaccagaat

SEQ ID NO: 428295 - DNA, 25 bp, Rattus norvegicus
ggaggaatcctgtgtttaccagaat

SEQ ID NO: 428296 - DNA, 25 bp, Rattus norvegicus
ggaggaatctcgcacagcgtgaccc

SEQ ID NO: 428297 - DNA, 25 bp, Rattus norvegicus
ggaggaatctcggacagcgtgaccc

SEQ ID NO: 428298 - DNA, 25 bp, Rattus norvegicus
ggaggaatcttcatgtacccagcca

SEQ ID NO: 428299 - DNA, 25 bp, Rattus norvegicus
ggaggaatcttcttgtacccagcca

SEQ ID NO: 428300 - DNA, 25 bp, Rattus norvegicus
ggaggaatgactcactgctctgaca

SEQ ID NO: 428301 - DNA, 25 bp, Rattus norvegicus
ggaggaatgactgactgctctgaca

SEQ ID NO: 428302 - DNA, 25 bp, Rattus norvegicus
ggaggaatgtatacggccacagtgt

SEQ ID NO: 428303 - DNA, 25 bp, Rattus norvegicus
ggaggaatgtatatttatcaaccaa

SEQ ID NO: 428304 - DNA, 25 bp, Rattus norvegicus
ggaggaatgtattcggccacagtgt

SEQ ID NO: 428305 - DNA, 25 bp, Rattus norvegicus
ggaggaatgtatttttatcaaccaa

SEQ ID NO: 428306 - DNA, 25 bp, Rattus norvegicus
ggaggaattcctcatttcagctctt

SEQ ID NO: 428307 - DNA, 25 bp, Rattus norvegicus
ggaggaattcctgatttcagctctt

SEQ ID NO: 428308 - DNA, 25 bp, Rattus norvegicus
ggaggaattctacaccaaggctgag

SEQ ID NO: 428309 - DNA, 25 bp, Rattus norvegicus
ggaggaattctagaccaaggctgag

SEQ ID NO: 428310 - DNA, 25 bp, Rattus norvegicus
ggaggaattctgagcacagcccgct

SEQ ID NO: 428311 - DNA, 25 bp, Rattus norvegicus
ggaggaattctgtgcacagcccgct

SEQ ID NO: 428312 - DNA, 25 bp, Rattus norvegicus
ggaggaatttctcggacagtgcaat

SEQ ID NO: 428313 - DNA, 25 bp, Rattus norvegicus
ggaggaatttctgggacagtgcaat

SEQ ID NO: 428314 - DNA, 25 bp, Rattus norvegicus
ggaggacaacacactcaccattgag

SEQ ID NO: 428315 - DNA, 25 bp, Rattus norvegicus
ggaggacaacacagttccagccagc

SEQ ID NO: 428316 - DNA, 25 bp, Rattus norvegicus
ggaggacaacactctcaccattgag

SEQ ID NO: 428317 - DNA, 25 bp, Rattus norvegicus
ggaggacaacactgttccagccagc

SEQ ID NO: 428318 - DNA, 25 bp, Rattus norvegicus
ggaggacaacccagatgacacaagt

SEQ ID NO: 428319 - DNA, 25 bp, Rattus norvegicus
ggaggacaaccctgatgacacaagt

SEQ ID NO: 428320 - DNA, 25 bp, Rattus norvegicus
ggaggacaagacagggaaatccctt

SEQ ID NO: 428321 - DNA, 25 bp, Rattus norvegicus
ggaggacaagacatttgcttcaggg

SEQ ID NO: 428322 - DNA, 25 bp, Rattus norvegicus
ggaggacaagactgggaaatccctt

SEQ ID NO: 428323 - DNA, 25 bp, Rattus norvegicus
ggaggacaagacttttgcttcaggg

SEQ ID NO: 428324 - DNA, 25 bp, Rattus norvegicus
ggaggacaagctcccatatgaggat

SEQ ID NO: 428325 - DNA, 25 bp, Rattus norvegicus
ggaggacaagctgccatatgaggat

SEQ ID NO: 428326 - DNA, 25 bp, Rattus norvegicus
ggaggacaaggcacacatgttggaa

SEQ ID NO: 428327 - DNA, 25 bp, Rattus norvegicus
ggaggacaaggcatctccttctgtc

SEQ ID NO: 428328 - DNA, 25 bp, Rattus norvegicus
ggaggacaaggctcacatgttggaa

SEQ ID NO: 428329 - DNA, 25 bp, Rattus norvegicus
ggaggacaaggcttctccttctgtc

SEQ ID NO: 428330 - DNA, 25 bp, Rattus norvegicus
ggaggacaattaagccactggctgt

SEQ ID NO: 428331 - DNA, 25 bp, Rattus norvegicus
ggaggacaattacacagccctgcaa

SEQ ID NO: 428332 - DNA, 25 bp, Rattus norvegicus
ggaggacaattagacagccctgcaa

SEQ ID NO: 428333 - DNA, 25 bp, Rattus norvegicus
ggaggacaattatgccactggctgt

SEQ ID NO: 428334 - DNA, 25 bp, Rattus norvegicus
ggaggacacaaactgcttttcatct

SEQ ID NO: 428335 - DNA, 25 bp, Rattus norvegicus
ggaggacacaaagtgcttttcatct

SEQ ID NO: 428336 - DNA, 25 bp, Rattus norvegicus
ggaggacacataaggcggcacttct

SEQ ID NO: 428337 - DNA, 25 bp, Rattus norvegicus
ggaggacacatatggcggcacttct

SEQ ID NO: 428338 - DNA, 25 bp, Rattus norvegicus
ggaggacaccatatctaacagcaat

SEQ ID NO: 428339 - DNA, 25 bp, Rattus norvegicus
ggaggacaccatttctaacagcaat

SEQ ID NO: 428340 - DNA, 25 bp, Rattus norvegicus
ggaggacactgtatttaccctgctg

SEQ ID NO: 428341 - DNA, 25 bp, Rattus norvegicus
ggaggacactgtttttaccctgctg

SEQ ID NO: 428342 - DNA, 25 bp, Rattus norvegicus
ggaggacactttctgatttccatta

SEQ ID NO: 428343 - DNA, 25 bp, Rattus norvegicus
ggaggacactttgtgatttccatta

SEQ ID NO: 428344 - DNA, 25 bp, Rattus norvegicus
ggaggacagaagaaagccagccgtt

SEQ ID NO: 428345 - DNA, 25 bp, Rattus norvegicus
ggaggacagaagtaagccagccgtt

SEQ ID NO: 428346 - DNA, 25 bp, Rattus norvegicus
ggaggacagcacacgcgacgacagc

SEQ ID NO: 428347 - DNA, 25 bp, Rattus norvegicus
ggaggacagcaccaggttcagcatt

SEQ ID NO: 428348 - DNA, 25 bp, Rattus norvegicus
ggaggacagcacgaggttcagcatt

SEQ ID NO: 428349 - DNA, 25 bp, Rattus norvegicus
ggaggacagcactcgcgacgacagc

SEQ ID NO: 428350 - DNA, 25 bp, Rattus norvegicus
ggaggacagccgagttcgactagct

SEQ ID NO: 428351 - DNA, 25 bp, Rattus norvegicus
ggaggacagccgtgttcgactagct

SEQ ID NO: 428352 - DNA, 25 bp, Rattus norvegicus
ggaggacagtcaatcagcttgaagt

SEQ ID NO: 428353 - DNA, 25 bp, Rattus norvegicus
ggaggacagtcattcagcttgaagt

SEQ ID NO: 428354 - DNA, 25 bp, Rattus norvegicus
ggaggacagtgaagtcacccaccgt

SEQ ID NO: 428355 - DNA, 25 bp, Rattus norvegicus
ggaggacagtgatgtcacccaccgt

SEQ ID NO: 428356 - DNA, 25 bp, Rattus norvegicus
ggaggacagtgcaatttcctgccag

SEQ ID NO: 428357 - DNA, 25 bp, Rattus norvegicus
ggaggacagtgctatttcctgccag

SEQ ID NO: 428358 - DNA, 25 bp, Rattus norvegicus
ggaggacagtgtactgctcctacgc

SEQ ID NO: 428359 - DNA, 25 bp, Rattus norvegicus
ggaggacagtgttctgctcctacgc

SEQ ID NO: 428360 - DNA, 25 bp, Rattus norvegicus
ggaggacagttcaaatgtgacacat

SEQ ID NO: 428361 - DNA, 25 bp, Rattus norvegicus
ggaggacagttctaatgtgacacat

SEQ ID NO: 428362 - DNA, 25 bp, Rattus norvegicus
ggaggacatcaacagaggcagccct

SEQ ID NO: 428363 - DNA, 25 bp, Rattus norvegicus
ggaggacatcaagagaggcagccct

SEQ ID NO: 428364 - DNA, 25 bp, Rattus norvegicus
ggaggacatctacattccatcatgg

SEQ ID NO: 428365 - DNA, 25 bp, Rattus norvegicus
ggaggacatctagattccatcatgg

SEQ ID NO: 428366 - DNA, 25 bp, Rattus norvegicus
ggaggacatctcattggctacaatc

SEQ ID NO: 428367 - DNA, 25 bp, Rattus norvegicus
ggaggacatctctttggctacaatc

SEQ ID NO: 428368 - DNA, 25 bp, Rattus norvegicus
ggaggacattatactgcttttgcaa

SEQ ID NO: 428369 - DNA, 25 bp, Rattus norvegicus
ggaggacattattctgcttttgcaa

SEQ ID NO: 428370 - DNA, 25 bp, Rattus norvegicus
ggaggacattctacgatgcttcatc

SEQ ID NO: 428371 - DNA, 25 bp, Rattus norvegicus
ggaggacattcttcgatgcttcatc

SEQ ID NO: 428372 - DNA, 25 bp, Rattus norvegicus
ggaggacatttcaagcacaagtact

SEQ ID NO: 428373 - DNA, 25 bp, Rattus norvegicus
ggaggacatttctagcacaagtact

SEQ ID NO: 428374 - DNA, 25 bp, Rattus norvegicus
ggaggacattttccgtagatttcca

SEQ ID NO: 428375 - DNA, 25 bp, Rattus norvegicus
ggaggacattttgcgtagatttcca

SEQ ID NO: 428376 - DNA, 25 bp, Rattus norvegicus
ggaggaccacacagagatacacaat

SEQ ID NO: 428377 - DNA, 25 bp, Rattus norvegicus
ggaggaccacactgagatacacaat

SEQ ID NO: 428378 - DNA, 25 bp, Rattus norvegicus
ggaggaccacctctatcaggaagaa

SEQ ID NO: 428379 - DNA, 25 bp, Rattus norvegicus
ggaggaccacctgtatcaggaagaa

SEQ ID NO: 428380 - DNA, 25 bp, Rattus norvegicus
ggaggaccagcacttcctgatcatc

SEQ ID NO: 428381 - DNA, 25 bp, Rattus norvegicus
ggaggaccagcagttcctgatcatc

SEQ ID NO: 428382 - DNA, 25 bp, Rattus norvegicus
ggaggacccatgaagattcgcagat

SEQ ID NO: 428383 - DNA, 25 bp, Rattus norvegicus
ggaggacccatgtagattcgcagat

SEQ ID NO: 428384 - DNA, 25 bp, Rattus norvegicus
ggaggacccgaacgaccagaagctt

SEQ ID NO: 428385 - DNA, 25 bp, Rattus norvegicus
ggaggacccgaaggaccagaagctt

SEQ ID NO: 428386 - DNA, 25 bp, Rattus norvegicus
ggaggaccctaaagtgtttgccagg

SEQ ID NO: 428387 - DNA, 25 bp, Rattus norvegicus
ggaggaccctaatgtgtttgccagg

SEQ ID NO: 428388 - DNA, 25 bp, Rattus norvegicus
ggaggaccctcgaagagaacccaga

SEQ ID NO: 428389 - DNA, 25 bp, Rattus norvegicus
ggaggaccctcgtagagaacccaga

SEQ ID NO: 428390 - DNA, 25 bp, Rattus norvegicus
ggaggaccctctagatgaccaagat

SEQ ID NO: 428391 - DNA, 25 bp, Rattus norvegicus
ggaggaccctcttgatgaccaagat

SEQ ID NO: 428392 - DNA, 25 bp, Rattus norvegicus
ggaggaccctttatccctctgtaag

SEQ ID NO: 428393 - DNA, 25 bp, Rattus norvegicus
ggaggaccctttttccctctgtaag

SEQ ID NO: 428394 - DNA, 25 bp, Rattus norvegicus
ggaggaccgcataccttcagctgta

SEQ ID NO: 428395 - DNA, 25 bp, Rattus norvegicus
ggaggaccgcattccttcagctgta

SEQ ID NO: 428396 - DNA, 25 bp, Rattus norvegicus
ggaggaccgcgacctgtcacatcag

SEQ ID NO: 428397 - DNA, 25 bp, Rattus norvegicus
ggaggaccgcgagctgtcacatcag

SEQ ID NO: 428398 - DNA, 25 bp, Rattus norvegicus
ggaggaccggttccagccaaacatg

SEQ ID NO: 428399 - DNA, 25 bp, Rattus norvegicus
ggaggaccggttgcagccaaacatg

SEQ ID NO: 428400 - DNA, 25 bp, Rattus norvegicus
ggaggaccgtttacaatgtctaata

SEQ ID NO: 428401 - DNA, 25 bp, Rattus norvegicus
ggaggaccgttttcaatgtctaata

SEQ ID NO: 428402 - DNA, 25 bp, Rattus norvegicus
ggaggacctaatactgtgtatgcag

SEQ ID NO: 428403 - DNA, 25 bp, Rattus norvegicus
ggaggacctaattctgtgtatgcag

SEQ ID NO: 428404 - DNA, 25 bp, Rattus norvegicus
ggaggacctcacctaaccagagtca

SEQ ID NO: 428405 - DNA, 25 bp, Rattus norvegicus
ggaggacctcacgtaaccagagtca

SEQ ID NO: 428406 - DNA, 25 bp, Rattus norvegicus
ggaggacctctaatcttaagatctt

SEQ ID NO: 428407 - DNA, 25 bp, Rattus norvegicus
ggaggacctctattcttaagatctt

SEQ ID NO: 428408 - DNA, 25 bp, Rattus norvegicus
ggaggacctctccaaactcttcaag

SEQ ID NO: 428409 - DNA, 25 bp, Rattus norvegicus
ggaggacctctcgaaactcttcaag

SEQ ID NO: 428410 - DNA, 25 bp, Rattus norvegicus
ggaggacctcttatctgtaacatcg

SEQ ID NO: 428411 - DNA, 25 bp, Rattus norvegicus
ggaggacctcttttctgtaacatcg

SEQ ID NO: 428412 - DNA, 25 bp, Rattus norvegicus
ggaggacctgaactggagctctctt

SEQ ID NO: 428413 - DNA, 25 bp, Rattus norvegicus
ggaggacctgaagtggagctctctt

SEQ ID NO: 428414 - DNA, 25 bp, Rattus norvegicus
ggaggacctggcagctctggagaag

SEQ ID NO: 428415 - DNA, 25 bp, Rattus norvegicus
ggaggacctggctgctctggagaag

SEQ ID NO: 428416 - DNA, 25 bp, Rattus norvegicus
ggaggacctggtcgcagccaaatta

SEQ ID NO: 428417 - DNA, 25 bp, Rattus norvegicus
ggaggacctggtggcagccaaatta

SEQ ID NO: 428418 - DNA, 25 bp, Rattus norvegicus
ggaggacctgtcattggaatccata

SEQ ID NO: 428419 - DNA, 25 bp, Rattus norvegicus
ggaggacctgtctttggaatccata

SEQ ID NO: 428420 - DNA, 25 bp, Rattus norvegicus
ggaggaccttccctattgcaaatta

SEQ ID NO: 428421 - DNA, 25 bp, Rattus norvegicus
ggaggaccttccgtattgcaaatta

SEQ ID NO: 428422 - DNA, 25 bp, Rattus norvegicus
ggaggacgacttatcaactacgaga

SEQ ID NO: 428423 - DNA, 25 bp, Rattus norvegicus
ggaggacgacttttcaactacgaga

SEQ ID NO: 428424 - DNA, 25 bp, Rattus norvegicus
ggaggacggcgcaaggttcccacac

SEQ ID NO: 428425 - DNA, 25 bp, Rattus norvegicus
ggaggacggcgctaggttcccacac

SEQ ID NO: 428426 - DNA, 25 bp, Rattus norvegicus
ggaggacggcggctctgcgctggcc

SEQ ID NO: 428427 - DNA, 25 bp, Rattus norvegicus
ggaggacggcgggtctgcgctggcc

SEQ ID NO: 428428 - DNA, 25 bp, Rattus norvegicus
ggaggacgggaccactgcatacatc

SEQ ID NO: 428429 - DNA, 25 bp, Rattus norvegicus
ggaggacgggacgactgcatacatc

SEQ ID NO: 428430 - DNA, 25 bp, Rattus norvegicus
ggaggacgtctccatatcgtaatac

SEQ ID NO: 428431 - DNA, 25 bp, Rattus norvegicus
ggaggacgtctcgatatcgtaatac

SEQ ID NO: 428432 - DNA, 25 bp, Rattus norvegicus
ggaggactaaccattcaccttcagt

SEQ ID NO: 428433 - DNA, 25 bp, Rattus norvegicus
ggaggactaacctttcaccttcagt

SEQ ID NO: 428434 - DNA, 25 bp, Rattus norvegicus
ggaggactacagcatttgtacaaca

SEQ ID NO: 428435 - DNA, 25 bp, Rattus norvegicus
ggaggactacaggatttgtacaaca

SEQ ID NO: 428436 - DNA, 25 bp, Rattus norvegicus
ggaggactacttaaccgccacagag

SEQ ID NO: 428437 - DNA, 25 bp, Rattus norvegicus
ggaggactactttaccgccacagag

SEQ ID NO: 428438 - DNA, 25 bp, Rattus norvegicus
ggaggactccacagacggcgtccaa

SEQ ID NO: 428439 - DNA, 25 bp, Rattus norvegicus
ggaggactccactgacggcgtccaa

SEQ ID NO: 428440 - DNA, 25 bp, Rattus norvegicus
ggaggactcctgacaaagactgcag

SEQ ID NO: 428441 - DNA, 25 bp, Rattus norvegicus
ggaggactcctgtcaaagactgcag

SEQ ID NO: 428442 - DNA, 25 bp, Rattus norvegicus
ggaggactctgcacagggactcatt

SEQ ID NO: 428443 - DNA, 25 bp, Rattus norvegicus
ggaggactctgctcagggactcatt

SEQ ID NO: 428444 - DNA, 25 bp, Rattus norvegicus
ggaggactgaacactgcgtaaacaa

SEQ ID NO: 428445 - DNA, 25 bp, Rattus norvegicus
ggaggactgaactctgcgtaaacaa

SEQ ID NO: 428446 - DNA, 25 bp, Rattus norvegicus
ggaggactgctacagcaagctcaat

SEQ ID NO: 428447 - DNA, 25 bp, Rattus norvegicus
ggaggactgctacgctgactccatt

SEQ ID NO: 428448 - DNA, 25 bp, Rattus norvegicus
ggaggactgctagagcaagctcaat

SEQ ID NO: 428449 - DNA, 25 bp, Rattus norvegicus
ggaggactgctaggctgactccatt

SEQ ID NO: 428450 - DNA, 25 bp, Rattus norvegicus
ggaggactgctgaaaattcaaattc

SEQ ID NO: 428451 - DNA, 25 bp, Rattus norvegicus
ggaggactgctgtaaattcaaattc

SEQ ID NO: 428452 - DNA, 25 bp, Rattus norvegicus
ggaggactggagaagtgtccactaa

SEQ ID NO: 428453 - DNA, 25 bp, Rattus norvegicus
ggaggactggagtagtgtccactaa

SEQ ID NO: 428454 - DNA, 25 bp, Rattus norvegicus
ggaggactgtgacccacatcagaca

SEQ ID NO: 428455 - DNA, 25 bp, Rattus norvegicus
ggaggactgtgagccacatcagaca

SEQ ID NO: 428456 - DNA, 25 bp, Rattus norvegicus
ggaggactgtgcagagtaccttcta

SEQ ID NO: 428457 - DNA, 25 bp, Rattus norvegicus
ggaggactgtgctgagtaccttcta

SEQ ID NO: 428458 - DNA, 25 bp, Rattus norvegicus
ggaggactgtttctgacctgattat

SEQ ID NO: 428459 - DNA, 25 bp, Rattus norvegicus
ggaggactgtttgtgacctgattat

SEQ ID NO: 428460 - DNA, 25 bp, Rattus norvegicus
ggaggacttccaccctgagaatctg

SEQ ID NO: 428461 - DNA, 25 bp, Rattus norvegicus
ggaggacttccaccgggttatcaat

SEQ ID NO: 428462 - DNA, 25 bp, Rattus norvegicus
ggaggacttccagcctgagaatctg

SEQ ID NO: 428463 - DNA, 25 bp, Rattus norvegicus
ggaggacttccagcgggttatcaat

SEQ ID NO: 428464 - DNA, 25 bp, Rattus norvegicus
ggaggactttcaatgaccgctcagc

SEQ ID NO: 428465 - DNA, 25 bp, Rattus norvegicus
ggaggactttcattgaccgctcagc

SEQ ID NO: 428466 - DNA, 25 bp, Rattus norvegicus
ggaggactttgacgatcacacaccc

SEQ ID NO: 428467 - DNA, 25 bp, Rattus norvegicus
ggaggactttgaggatcacacaccc

SEQ ID NO: 428468 - DNA, 25 bp, Rattus norvegicus
ggaggagaacccagtacccttgctg

SEQ ID NO: 428469 - DNA, 25 bp, Rattus norvegicus
ggaggagaaccctgtacccttgctg

SEQ ID NO: 428470 - DNA, 25 bp, Rattus norvegicus
ggaggagaagcaccccacccagact

SEQ ID NO: 428471 - DNA, 25 bp, Rattus norvegicus
ggaggagaagcacgtgtttatcact

SEQ ID NO: 428472 - DNA, 25 bp, Rattus norvegicus
ggaggagaagcagcccacccagact

SEQ ID NO: 428473 - DNA, 25 bp, Rattus norvegicus
ggaggagaagcaggtgtttatcact

SEQ ID NO: 428474 - DNA, 25 bp, Rattus norvegicus
ggaggagacaccattgtttgcaaat

SEQ ID NO: 428475 - DNA, 25 bp, Rattus norvegicus
ggaggagacacctttgtttgcaaat

SEQ ID NO: 428476 - DNA, 25 bp, Rattus norvegicus
ggaggagacagacgcacaagcatct

SEQ ID NO: 428477 - DNA, 25 bp, Rattus norvegicus
ggaggagacagaggcacaagcatct

SEQ ID NO: 428478 - DNA, 25 bp, Rattus norvegicus
ggaggagacctaattgctctttatt

SEQ ID NO: 428479 - DNA, 25 bp, Rattus norvegicus
ggaggagacctacgttccgatccca

SEQ ID NO: 428480 - DNA, 25 bp, Rattus norvegicus
ggaggagacctaggttccgatccca

SEQ ID NO: 428481 - DNA, 25 bp, Rattus norvegicus
ggaggagacctatttgctctttatt

SEQ ID NO: 428482 - DNA, 25 bp, Rattus norvegicus
ggaggagactgaacttcatgtctta

SEQ ID NO: 428483 - DNA, 25 bp, Rattus norvegicus
ggaggagactgatcttcatgtctta

SEQ ID NO: 428484 - DNA, 25 bp, Rattus norvegicus
ggaggagagcctactgttacatcac

SEQ ID NO: 428485 - DNA, 25 bp, Rattus norvegicus
ggaggagagccttctgttacatcac

SEQ ID NO: 428486 - DNA, 25 bp, Rattus norvegicus
ggaggagaggttatcccacacgcag

SEQ ID NO: 428487 - DNA, 25 bp, Rattus norvegicus
ggaggagaggttttcccacacgcag

SEQ ID NO: 428488 - DNA, 25 bp, Rattus norvegicus
ggaggagagtcacctttcgtcagat

SEQ ID NO: 428489 - DNA, 25 bp, Rattus norvegicus
ggaggagagtcagctttcgtcagat

SEQ ID NO: 428490 - DNA, 25 bp, Rattus norvegicus
ggaggagatccactcactgaaggaa

SEQ ID NO: 428491 - DNA, 25 bp, Rattus norvegicus
ggaggagatccagtcactgaaggaa

SEQ ID NO: 428492 - DNA, 25 bp, Rattus norvegicus
ggaggagatcctaacgccactggtg

SEQ ID NO: 428493 - DNA, 25 bp, Rattus norvegicus
ggaggagatcctatcccagagggac

SEQ ID NO: 428494 - DNA, 25 bp, Rattus norvegicus
ggaggagatccttacgccactggtg

SEQ ID NO: 428495 - DNA, 25 bp, Rattus norvegicus
ggaggagatcctttcccagagggac

SEQ ID NO: 428496 - DNA, 25 bp, Rattus norvegicus
ggaggagatcgcaacctggtctttc

SEQ ID NO: 428497 - DNA, 25 bp, Rattus norvegicus
ggaggagatcgctacctggtctttc

SEQ ID NO: 428498 - DNA, 25 bp, Rattus norvegicus
ggaggagcaagcaagccccaagtcc

SEQ ID NO: 428499 - DNA, 25 bp, Rattus norvegicus
ggaggagcaagctagccccaagtcc

SEQ ID NO: 428500 - DNA, 25 bp, Rattus norvegicus
ggaggagcaattacttctgcctctt

SEQ ID NO: 428501 - DNA, 25 bp, Rattus norvegicus
ggaggagcaatttcttctgcctctt

SEQ ID NO: 428502 - DNA, 25 bp, Rattus norvegicus
ggaggagcacacacttctggagaag

SEQ ID NO: 428503 - DNA, 25 bp, Rattus norvegicus
ggaggagcacactcttctggagaag

SEQ ID NO: 428504 - DNA, 25 bp, Rattus norvegicus
ggaggagcactactctcatttcatt

SEQ ID NO: 428505 - DNA, 25 bp, Rattus norvegicus
ggaggagcactagtctcatttcatt

SEQ ID NO: 428506 - DNA, 25 bp, Rattus norvegicus
ggaggagcatctacagactccgttg

SEQ ID NO: 428507 - DNA, 25 bp, Rattus norvegicus
ggaggagcatctccccaatttgttc

SEQ ID NO: 428508 - DNA, 25 bp, Rattus norvegicus
ggaggagcatctgcccaatttgttc

SEQ ID NO: 428509 - DNA, 25 bp, Rattus norvegicus
ggaggagcatcttcagactccgttg

SEQ ID NO: 428510 - DNA, 25 bp, Rattus norvegicus
ggaggagccaagcttgccgtatcac

SEQ ID NO: 428511 - DNA, 25 bp, Rattus norvegicus
ggaggagccaaggttgccgtatcac

SEQ ID NO: 428512 - DNA, 25 bp, Rattus norvegicus
ggaggagccacacagttaatgtttt

SEQ ID NO: 428513 - DNA, 25 bp, Rattus norvegicus
ggaggagccacagagttaatgtttt

SEQ ID NO: 428514 - DNA, 25 bp, Rattus norvegicus
ggaggagccaccactgtagccgaag

SEQ ID NO: 428515 - DNA, 25 bp, Rattus norvegicus
ggaggagccacctctgtagccgaag

SEQ ID NO: 428516 - DNA, 25 bp, Rattus norvegicus
ggaggagccagtagctgtccccata

SEQ ID NO: 428517 - DNA, 25 bp, Rattus norvegicus
ggaggagccagttgctgtccccata

SEQ ID NO: 428518 - DNA, 25 bp, Rattus norvegicus
ggaggagccatgaatagcacatttt

SEQ ID NO: 428519 - DNA, 25 bp, Rattus norvegicus
ggaggagccatgcaccagcacagca

SEQ ID NO: 428520 - DNA, 25 bp, Rattus norvegicus
ggaggagccatggaccagcacagca

SEQ ID NO: 428521 - DNA, 25 bp, Rattus norvegicus
ggaggagccatgtatagcacatttt

SEQ ID NO: 428522 - DNA, 25 bp, Rattus norvegicus
ggaggagcccatcgtacacctgcag

SEQ ID NO: 428523 - DNA, 25 bp, Rattus norvegicus
ggaggagcccatggtacacctgcag

SEQ ID NO: 428524 - DNA, 25 bp, Rattus norvegicus
ggaggagcccctctatgagaatgtt

SEQ ID NO: 428525 - DNA, 25 bp, Rattus norvegicus
ggaggagcccctgtatgagaatgtt

SEQ ID NO: 428526 - DNA, 25 bp, Rattus norvegicus
ggaggagcccgaaccagggctgttg

SEQ ID NO: 428527 - DNA, 25 bp, Rattus norvegicus
ggaggagcccgatccagggctgttg

SEQ ID NO: 428528 - DNA, 25 bp, Rattus norvegicus
ggaggagcctccaaaaatacctgta

SEQ ID NO: 428529 - DNA, 25 bp, Rattus norvegicus
ggaggagcctcctaaaatacctgta

SEQ ID NO: 428530 - DNA, 25 bp, Rattus norvegicus
ggaggagcctgtagactactacgcc

SEQ ID NO: 428531 - DNA, 25 bp, Rattus norvegicus
ggaggagcctgttgactactacgcc

SEQ ID NO: 428532 - DNA, 25 bp, Rattus norvegicus
ggaggagcgagacccgccaggactc

SEQ ID NO: 428533 - DNA, 25 bp, Rattus norvegicus
ggaggagcgagagccgccaggactc

SEQ ID NO: 428534 - DNA, 25 bp, Rattus norvegicus
ggaggagctaacacggatccattag

SEQ ID NO: 428535 - DNA, 25 bp, Rattus norvegicus
ggaggagctaactcggatccattag

SEQ ID NO: 428536 - DNA, 25 bp, Rattus norvegicus
ggaggagctacacggttgtctacta

SEQ ID NO: 428537 - DNA, 25 bp, Rattus norvegicus
ggaggagctacagggttgtctacta

SEQ ID NO: 428538 - DNA, 25 bp, Rattus norvegicus
ggaggagctagtatgccggatacaa

SEQ ID NO: 428539 - DNA, 25 bp, Rattus norvegicus
ggaggagctagtttgccggatacaa

SEQ ID NO: 428540 - DNA, 25 bp, Rattus norvegicus
ggaggagctatacagtttccaagac

SEQ ID NO: 428541 - DNA, 25 bp, Rattus norvegicus
ggaggagctatagagtttccaagac

SEQ ID NO: 428542 - DNA, 25 bp, Rattus norvegicus
ggaggagctcaccttctttttaaag

SEQ ID NO: 428543 - DNA, 25 bp, Rattus norvegicus
ggaggagctcacgttctttttaaag

SEQ ID NO: 428544 - DNA, 25 bp, Rattus norvegicus
ggaggagctcccacaacattttgtg

SEQ ID NO: 428545 - DNA, 25 bp, Rattus norvegicus
ggaggagctccctcaacattttgtg

SEQ ID NO: 428546 - DNA, 25 bp, Rattus norvegicus
ggaggagctctgagcagactaccac

SEQ ID NO: 428547 - DNA, 25 bp, Rattus norvegicus
ggaggagctctgtgcagactaccac

SEQ ID NO: 428548 - DNA, 25 bp, Rattus norvegicus
ggaggagctgacacgcctggccttt

SEQ ID NO: 428549 - DNA, 25 bp, Rattus norvegicus
ggaggagctgactcgcctggccttt

SEQ ID NO: 428550 - DNA, 25 bp, Rattus norvegicus
ggaggagctgttactctgggccatc

SEQ ID NO: 428551 - DNA, 25 bp, Rattus norvegicus
ggaggagctgtttctctgggccatc

SEQ ID NO: 428552 - DNA, 25 bp, Rattus norvegicus
ggaggagcttagaccccaaagactc

SEQ ID NO: 428553 - DNA, 25 bp, Rattus norvegicus
ggaggagcttagtccccaaagactc

SEQ ID NO: 428554 - DNA, 25 bp, Rattus norvegicus
ggaggaggaaggaccgtttctctct

SEQ ID NO: 428555 - DNA, 25 bp, Rattus norvegicus
ggaggaggaaggtccgtttctctct

SEQ ID NO: 428556 - DNA, 25 bp, Rattus norvegicus
ggaggaggaccgatccctccttgct

SEQ ID NO: 428557 - DNA, 25 bp, Rattus norvegicus
ggaggaggaccgttccctccttgct

SEQ ID NO: 428558 - DNA, 25 bp, Rattus norvegicus
ggaggaggagccatagccactgtcc

SEQ ID NO: 428559 - DNA, 25 bp, Rattus norvegicus
ggaggaggagccttagccactgtcc

SEQ ID NO: 428560 - DNA, 25 bp, Rattus norvegicus
ggaggaggagttagtctttctgctt

SEQ ID NO: 428561 - DNA, 25 bp, Rattus norvegicus
ggaggaggagtttgtctttctgctt

SEQ ID NO: 428562 - DNA, 25 bp, Rattus norvegicus
ggaggaggatctcattccacactgg

SEQ ID NO: 428563 - DNA, 25 bp, Rattus norvegicus
ggaggaggatctgattccacactgg

SEQ ID NO: 428564 - DNA, 25 bp, Rattus norvegicus
ggaggaggccatacaatttatcaac

SEQ ID NO: 428565 - DNA, 25 bp, Rattus norvegicus
ggaggaggccatagctatttttaat

SEQ ID NO: 428566 - DNA, 25 bp, Rattus norvegicus
ggaggaggccattcaatttatcaac

SEQ ID NO: 428567 - DNA, 25 bp, Rattus norvegicus
ggaggaggccattgctatttttaat

SEQ ID NO: 428568 - DNA, 25 bp, Rattus norvegicus
ggaggaggctcaattgttcagaaca

SEQ ID NO: 428569 - DNA, 25 bp, Rattus norvegicus
ggaggaggctcatttgttcagaaca

SEQ ID NO: 428570 - DNA, 25 bp, Rattus norvegicus
ggaggagggcagaaccgctcttata

SEQ ID NO: 428571 - DNA, 25 bp, Rattus norvegicus
ggaggagggcagtaccgctcttata

SEQ ID NO: 428572 - DNA, 25 bp, Rattus norvegicus
ggaggagggctcatttctatattta

SEQ ID NO: 428573 - DNA, 25 bp, Rattus norvegicus
ggaggagggctcttttctatattta

SEQ ID NO: 428574 - DNA, 25 bp, Rattus norvegicus
ggaggaggtatcctttgtttaattg

SEQ ID NO: 428575 - DNA, 25 bp, Rattus norvegicus
ggaggaggtatcgtttgtttaattg

SEQ ID NO: 428576 - DNA, 25 bp, Rattus norvegicus
ggaggaggtttcatggcattcccag

SEQ ID NO: 428577 - DNA, 25 bp, Rattus norvegicus
ggaggaggtttcttggcattcccag

SEQ ID NO: 428578 - DNA, 25 bp, Rattus norvegicus
ggaggagtaacccacagccagttac

SEQ ID NO: 428579 - DNA, 25 bp, Rattus norvegicus
ggaggagtaaccgacagccagttac

SEQ ID NO: 428580 - DNA, 25 bp, Rattus norvegicus
ggaggagtacttcagctccactcca

SEQ ID NO: 428581 - DNA, 25 bp, Rattus norvegicus
ggaggagtacttgagctccactcca

SEQ ID NO: 428582 - DNA, 25 bp, Rattus norvegicus
ggaggagtccaaaccaggccaccag

SEQ ID NO: 428583 - DNA, 25 bp, Rattus norvegicus
ggaggagtccaatccaggccaccag

SEQ ID NO: 428584 - DNA, 25 bp, Rattus norvegicus
ggaggagtccagaaccctatccccg

SEQ ID NO: 428585 - DNA, 25 bp, Rattus norvegicus
ggaggagtccagtaccctatccccg

SEQ ID NO: 428586 - DNA, 25 bp, Rattus norvegicus
ggaggagtctccaatggttttcctg

SEQ ID NO: 428587 - DNA, 25 bp, Rattus norvegicus
ggaggagtctcctatggttttcctg

SEQ ID NO: 428588 - DNA, 25 bp, Rattus norvegicus
ggaggagtgcccagaaactgttgca

SEQ ID NO: 428589 - DNA, 25 bp, Rattus norvegicus
ggaggagtgccctgaaactgttgca

SEQ ID NO: 428590 - DNA, 25 bp, Rattus norvegicus
ggaggagtgctcagtctcactacag

SEQ ID NO: 428591 - DNA, 25 bp, Rattus norvegicus
ggaggagtgctctgtctcactacag

SEQ ID NO: 428592 - DNA, 25 bp, Rattus norvegicus
ggaggagttcctaccatatactgac

SEQ ID NO: 428593 - DNA, 25 bp, Rattus norvegicus
ggaggagttccttccatatactgac

SEQ ID NO: 428594 - DNA, 25 bp, Rattus norvegicus
ggaggagttgctccagcatttctca

SEQ ID NO: 428595 - DNA, 25 bp, Rattus norvegicus
ggaggagttgctgcagcatttctca

SEQ ID NO: 428596 - DNA, 25 bp, Rattus norvegicus
ggaggagttgtcactggaagcccaa

SEQ ID NO: 428597 - DNA, 25 bp, Rattus norvegicus
ggaggagttgtctctggaagcccaa

SEQ ID NO: 428598 - DNA, 25 bp, Rattus norvegicus
ggaggagtttctaagcatttattag

SEQ ID NO: 428599 - DNA, 25 bp, Rattus norvegicus
ggaggagtttcttagcatttattag

SEQ ID NO: 428600 - DNA, 25 bp, Rattus norvegicus
ggaggagttttccatacccagccta

SEQ ID NO: 428601 - DNA, 25 bp, Rattus norvegicus
ggaggagttttcgatacccagccta

SEQ ID NO: 428602 - DNA, 25 bp, Rattus norvegicus
ggaggatacatgattttctgtcacc

SEQ ID NO: 428603 - DNA, 25 bp, Rattus norvegicus
ggaggatacatgtttttctgtcacc

SEQ ID NO: 428604 - DNA, 25 bp, Rattus norvegicus
ggaggataggtcaggtgcgttatct

SEQ ID NO: 428605 - DNA, 25 bp, Rattus norvegicus
ggaggataggtctggtgcgttatct

SEQ ID NO: 428606 - DNA, 25 bp, Rattus norvegicus
ggaggatatcctcgatcatggcaat

SEQ ID NO: 428607 - DNA, 25 bp, Rattus norvegicus
ggaggatatcctggatcatggcaat

SEQ ID NO: 428608 - DNA, 25 bp, Rattus norvegicus
ggaggatatctaactctaagagaac

SEQ ID NO: 428609 - DNA, 25 bp, Rattus norvegicus
ggaggatatctatctctaagagaac

SEQ ID NO: 428610 - DNA, 25 bp, Rattus norvegicus
ggaggatatgacaacactggttaca

SEQ ID NO: 428611 - DNA, 25 bp, Rattus norvegicus
ggaggatatgactacactggttaca

SEQ ID NO: 428612 - DNA, 25 bp, Rattus norvegicus
ggaggatatggaagcacttctgaac

SEQ ID NO: 428613 - DNA, 25 bp, Rattus norvegicus
ggaggatatggatgcacttctgaac

SEQ ID NO: 428614 - DNA, 25 bp, Rattus norvegicus
ggaggatcaccaagaatttgaagcc

SEQ ID NO: 428615 - DNA, 25 bp, Rattus norvegicus
ggaggatcaccatgaatttgaagcc

SEQ ID NO: 428616 - DNA, 25 bp, Rattus norvegicus
ggaggatcacgaagccaacctgggc

SEQ ID NO: 428617 - DNA, 25 bp, Rattus norvegicus
ggaggatcacgatgccaacctgggc

SEQ ID NO: 428618 - DNA, 25 bp, Rattus norvegicus
ggaggatcacgtacaaagcctgttt

SEQ ID NO: 428619 - DNA, 25 bp, Rattus norvegicus
ggaggatcacgttcaaagcctgttt

SEQ ID NO: 428620 - DNA, 25 bp, Rattus norvegicus
ggaggatcacttatattctgtattt

SEQ ID NO: 428621 - DNA, 25 bp, Rattus norvegicus
ggaggatcacttcaactctgtagtt

SEQ ID NO: 428622 - DNA, 25 bp, Rattus norvegicus
ggaggatcacttgaactctgtagtt

SEQ ID NO: 428623 - DNA, 25 bp, Rattus norvegicus
ggaggatcacttttattctgtattt

SEQ ID NO: 428624 - DNA, 25 bp, Rattus norvegicus
ggaggatcagtaaggaccgcttgca

SEQ ID NO: 428625 - DNA, 25 bp, Rattus norvegicus
ggaggatcagtatggaccgcttgca

SEQ ID NO: 428626 - DNA, 25 bp, Rattus norvegicus
ggaggatcatctccagaagctgcat

SEQ ID NO: 428627 - DNA, 25 bp, Rattus norvegicus
ggaggatcatctcgtgtttacctga

SEQ ID NO: 428628 - DNA, 25 bp, Rattus norvegicus
ggaggatcatctgcagaagctgcat

SEQ ID NO: 428629 - DNA, 25 bp, Rattus norvegicus
ggaggatcatctggtgtttacctga

SEQ ID NO: 428630 - DNA, 25 bp, Rattus norvegicus
ggaggatcatggcttcacaggaaat

SEQ ID NO: 428631 - DNA, 25 bp, Rattus norvegicus
ggaggatcatgggttcacaggaaat

SEQ ID NO: 428632 - DNA, 25 bp, Rattus norvegicus
ggaggatccaaacacttccccaaag

SEQ ID NO: 428633 - DNA, 25 bp, Rattus norvegicus
ggaggatccaaagacttccccaaag

SEQ ID NO: 428634 - DNA, 25 bp, Rattus norvegicus
ggaggatccaccacgaccagaatgg

SEQ ID NO: 428635 - DNA, 25 bp, Rattus norvegicus
ggaggatccacctcgaccagaatgg

SEQ ID NO: 428636 - DNA, 25 bp, Rattus norvegicus
ggaggatcccttatggaatactgag

SEQ ID NO: 428637 - DNA, 25 bp, Rattus norvegicus
ggaggatcccttcaacagcaagtga

SEQ ID NO: 428638 - DNA, 25 bp, Rattus norvegicus
ggaggatcccttgaacagcaagtga

SEQ ID NO: 428639 - DNA, 25 bp, Rattus norvegicus
ggaggatcccttttggaatactgag

SEQ ID NO: 428640 - DNA, 25 bp, Rattus norvegicus
ggaggatccttcagttgtaacctgt

SEQ ID NO: 428641 - DNA, 25 bp, Rattus norvegicus
ggaggatccttctgttgtaacctgt

SEQ ID NO: 428642 - DNA, 25 bp, Rattus norvegicus
ggaggatctactcctgtacagctaa

SEQ ID NO: 428643 - DNA, 25 bp, Rattus norvegicus
ggaggatctactgctgtacagctaa

SEQ ID NO: 428644 - DNA, 25 bp, Rattus norvegicus
ggaggatctctgagcatcccagtac

SEQ ID NO: 428645 - DNA, 25 bp, Rattus norvegicus
ggaggatctctgtgcatcccagtac

SEQ ID NO: 428646 - DNA, 25 bp, Rattus norvegicus
ggaggatctgaaattctctttcctt

SEQ ID NO: 428647 - DNA, 25 bp, Rattus norvegicus
ggaggatctgaatttctctttcctt

SEQ ID NO: 428648 - DNA, 25 bp, Rattus norvegicus
ggaggatctgggatcccaaaccaga

SEQ ID NO: 428649 - DNA, 25 bp, Rattus norvegicus
ggaggatctgggttcccaaaccaga

SEQ ID NO: 428650 - DNA, 25 bp, Rattus norvegicus
ggaggatctttaccggacctttgat

SEQ ID NO: 428651 - DNA, 25 bp, Rattus norvegicus
ggaggatctttagcggacctttgat

SEQ ID NO: 428652 - DNA, 25 bp, Rattus norvegicus
ggaggatctttgaccaatttgacat

SEQ ID NO: 428653 - DNA, 25 bp, Rattus norvegicus
ggaggatctttgtccaatttgacat

SEQ ID NO: 428654 - DNA, 25 bp, Rattus norvegicus
ggaggatgaaccaacaaccaccaga

SEQ ID NO: 428655 - DNA, 25 bp, Rattus norvegicus
ggaggatgaaccactgtcagacgag

SEQ ID NO: 428656 - DNA, 25 bp, Rattus norvegicus
ggaggatgaacctacaaccaccaga

SEQ ID NO: 428657 - DNA, 25 bp, Rattus norvegicus
ggaggatgaacctctgtcagacgag

SEQ ID NO: 428658 - DNA, 25 bp, Rattus norvegicus
ggaggatgactcataagcacatagt

SEQ ID NO: 428659 - DNA, 25 bp, Rattus norvegicus
ggaggatgactcttaagcacatagt

SEQ ID NO: 428660 - DNA, 25 bp, Rattus norvegicus
ggaggatgacttctacccagtgcaa

SEQ ID NO: 428661 - DNA, 25 bp, Rattus norvegicus
ggaggatgacttgtacccagtgcaa

SEQ ID NO: 428662 - DNA, 25 bp, Rattus norvegicus
ggaggatgattcagacctaggacag

SEQ ID NO: 428663 - DNA, 25 bp, Rattus norvegicus
ggaggatgattctgacctaggacag

SEQ ID NO: 428664 - DNA, 25 bp, Rattus norvegicus
ggaggatgcatgagccccatctggt

SEQ ID NO: 428665 - DNA, 25 bp, Rattus norvegicus
ggaggatgcatgtgccccatctggt

SEQ ID NO: 428666 - DNA, 25 bp, Rattus norvegicus
ggaggatgcccaatatgaccgacag

SEQ ID NO: 428667 - DNA, 25 bp, Rattus norvegicus
ggaggatgcccattatgaccgacag

SEQ ID NO: 428668 - DNA, 25 bp, Rattus norvegicus
ggaggatgccctaagagacagaact

SEQ ID NO: 428669 - DNA, 25 bp, Rattus norvegicus
ggaggatgcccttagagacagaact

SEQ ID NO: 428670 - DNA, 25 bp, Rattus norvegicus
ggaggatgctttacccaggacagat

SEQ ID NO: 428671 - DNA, 25 bp, Rattus norvegicus
ggaggatgcttttcccaggacagat

SEQ ID NO: 428672 - DNA, 25 bp, Rattus norvegicus
ggaggatggacacgctctccctctc

SEQ ID NO: 428673 - DNA, 25 bp, Rattus norvegicus
ggaggatggacaggctctccctctc

SEQ ID NO: 428674 - DNA, 25 bp, Rattus norvegicus
ggaggattacagctcactgcctaat

SEQ ID NO: 428675 - DNA, 25 bp, Rattus norvegicus
ggaggattacaggtcactgcctaat

SEQ ID NO: 428676 - DNA, 25 bp, Rattus norvegicus
ggaggattaccacttggctgccaac

SEQ ID NO: 428677 - DNA, 25 bp, Rattus norvegicus
ggaggattaccagttggctgccaac

SEQ ID NO: 428678 - DNA, 25 bp, Rattus norvegicus
ggaggattcagcaacccaaggacag

SEQ ID NO: 428679 - DNA, 25 bp, Rattus norvegicus
ggaggattcagctacccaaggacag

SEQ ID NO: 428680 - DNA, 25 bp, Rattus norvegicus
ggaggattcatcatttctgccctga

SEQ ID NO: 428681 - DNA, 25 bp, Rattus norvegicus
ggaggattcatcttttctgccctga

SEQ ID NO: 428682 - DNA, 25 bp, Rattus norvegicus
ggaggattcatgacagagcttccct

SEQ ID NO: 428683 - DNA, 25 bp, Rattus norvegicus
ggaggattcatgtcagagcttccct

SEQ ID NO: 428684 - DNA, 25 bp, Rattus norvegicus
ggaggattccctatatattactaca

SEQ ID NO: 428685 - DNA, 25 bp, Rattus norvegicus
ggaggattccctttatattactaca

SEQ ID NO: 428686 - DNA, 25 bp, Rattus norvegicus
ggaggattcctaaagctgtctgcac

SEQ ID NO: 428687 - DNA, 25 bp, Rattus norvegicus
ggaggattcctaagcaggccacctt

SEQ ID NO: 428688 - DNA, 25 bp, Rattus norvegicus
ggaggattcctatagctgtctgcac

SEQ ID NO: 428689 - DNA, 25 bp, Rattus norvegicus
ggaggattcctatgcaggccacctt

SEQ ID NO: 428690 - DNA, 25 bp, Rattus norvegicus
ggaggattcctcaaagttctgggcc

SEQ ID NO: 428691 - DNA, 25 bp, Rattus norvegicus
ggaggattcctctaagttctgggcc

SEQ ID NO: 428692 - DNA, 25 bp, Rattus norvegicus
ggaggattcgtgatcagttgcccgt

SEQ ID NO: 428693 - DNA, 25 bp, Rattus norvegicus
ggaggattcgtgttcagttgcccgt

SEQ ID NO: 428694 - DNA, 25 bp, Rattus norvegicus
ggaggattgcctcagacttgtaaca

SEQ ID NO: 428695 - DNA, 25 bp, Rattus norvegicus
ggaggattgcctgagacttgtaaca

SEQ ID NO: 428696 - DNA, 25 bp, Rattus norvegicus
ggaggattgggaaagtctcacttat

SEQ ID NO: 428697 - DNA, 25 bp, Rattus norvegicus
ggaggattgggatagtctcacttat

SEQ ID NO: 428698 - DNA, 25 bp, Rattus norvegicus
ggaggattgtccaggacaccggcct

SEQ ID NO: 428699 - DNA, 25 bp, Rattus norvegicus
ggaggattgtcctggacaccggcct

SEQ ID NO: 428700 - DNA, 25 bp, Rattus norvegicus
ggaggattgtgcctactgacccaga

SEQ ID NO: 428701 - DNA, 25 bp, Rattus norvegicus
ggaggattgtgcgtactgacccaga

SEQ ID NO: 428702 - DNA, 25 bp, Rattus norvegicus
ggaggatttctcaggctatgccatg

SEQ ID NO: 428703 - DNA, 25 bp, Rattus norvegicus
ggaggatttctctggctatgccatg

SEQ ID NO: 428704 - DNA, 25 bp, Rattus norvegicus
ggaggatttcttactctggtggagt

SEQ ID NO: 428705 - DNA, 25 bp, Rattus norvegicus
ggaggatttctttctctggtggagt

SEQ ID NO: 428706 - DNA, 25 bp, Rattus norvegicus
ggaggatttgaccagtaccgagccc

SEQ ID NO: 428707 - DNA, 25 bp, Rattus norvegicus
ggaggatttgacgagtaccgagccc

SEQ ID NO: 428708 - DNA, 25 bp, Rattus norvegicus
ggaggatttggccaccgcatataac

SEQ ID NO: 428709 - DNA, 25 bp, Rattus norvegicus
ggaggatttggcgaccgcatataac

SEQ ID NO: 428710 - DNA, 25 bp, Rattus norvegicus
ggaggatttttcaggctacgacttt

SEQ ID NO: 428711 - DNA, 25 bp, Rattus norvegicus
ggaggatttttctggctacgacttt

SEQ ID NO: 428712 - DNA, 25 bp, Rattus norvegicus
ggaggcaaaaatagacctgcagttt

SEQ ID NO: 428713 - DNA, 25 bp, Rattus norvegicus
ggaggcaaaaattgacctgcagttt

SEQ ID NO: 428714 - DNA, 25 bp, Rattus norvegicus
ggaggcaaaatgacatccttcccta

SEQ ID NO: 428715 - DNA, 25 bp, Rattus norvegicus
ggaggcaaaatgtcatccttcccta

SEQ ID NO: 428716 - DNA, 25 bp, Rattus norvegicus
ggaggcaacagacgccttgccagac

SEQ ID NO: 428717 - DNA, 25 bp, Rattus norvegicus
ggaggcaacagaggccttgccagac

SEQ ID NO: 428718 - DNA, 25 bp, Rattus norvegicus
ggaggcaagaccattctgggttaca

SEQ ID NO: 428719 - DNA, 25 bp, Rattus norvegicus
ggaggcaagacctttctgggttaca

SEQ ID NO: 428720 - DNA, 25 bp, Rattus norvegicus
ggaggcaagacgatcaatagttcaa

SEQ ID NO: 428721 - DNA, 25 bp, Rattus norvegicus
ggaggcaagacgttcaatagttcaa

SEQ ID NO: 428722 - DNA, 25 bp, Rattus norvegicus
ggaggcaaggatatctcattgacaa

SEQ ID NO: 428723 - DNA, 25 bp, Rattus norvegicus
ggaggcaaggatttctcattgacaa

SEQ ID NO: 428724 - DNA, 25 bp, Rattus norvegicus
ggaggcaagtccagaggcaagctct

SEQ ID NO: 428725 - DNA, 25 bp, Rattus norvegicus
ggaggcaagtcctgaggcaagctct

SEQ ID NO: 428726 - DNA, 25 bp, Rattus norvegicus
ggaggcaagtgcactaccacaatgc

SEQ ID NO: 428727 - DNA, 25 bp, Rattus norvegicus
ggaggcaagtgctctaccacaatgc

SEQ ID NO: 428728 - DNA, 25 bp, Rattus norvegicus
ggaggcaatcctcggttcagtaaga

SEQ ID NO: 428729 - DNA, 25 bp, Rattus norvegicus
ggaggcaatcctgggttcagtaaga

SEQ ID NO: 428730 - DNA, 25 bp, Rattus norvegicus
ggaggcaatggcaatgaccaggaat

SEQ ID NO: 428731 - DNA, 25 bp, Rattus norvegicus
ggaggcaatggctatgaccaggaat

SEQ ID NO: 428732 - DNA, 25 bp, Rattus norvegicus
ggaggcaatggtaattccccggcaa

SEQ ID NO: 428733 - DNA, 25 bp, Rattus norvegicus
ggaggcaatggttattccccggcaa

SEQ ID NO: 428734 - DNA, 25 bp, Rattus norvegicus
ggaggcacaatcacatgcagcctat

SEQ ID NO: 428735 - DNA, 25 bp, Rattus norvegicus
ggaggcacaatctcatgcagcctat

SEQ ID NO: 428736 - DNA, 25 bp, Rattus norvegicus
ggaggcacacctagacagaactgtt

SEQ ID NO: 428737 - DNA, 25 bp, Rattus norvegicus
ggaggcacaccttgacagaactgtt

SEQ ID NO: 428738 - DNA, 25 bp, Rattus norvegicus
ggaggcacagcaaacaccagtagag

SEQ ID NO: 428739 - DNA, 25 bp, Rattus norvegicus
ggaggcacagcatacaccagtagag

SEQ ID NO: 428740 - DNA, 25 bp, Rattus norvegicus
ggaggcacaggaatcccagccagca

SEQ ID NO: 428741 - DNA, 25 bp, Rattus norvegicus
ggaggcacaggattcccagccagca

SEQ ID NO: 428742 - DNA, 25 bp, Rattus norvegicus
ggaggcacatctcattttgtattaa

SEQ ID NO: 428743 - DNA, 25 bp, Rattus norvegicus
ggaggcacatctgattttgtattaa

SEQ ID NO: 428744 - DNA, 25 bp, Rattus norvegicus
ggaggcacattcctatacttctgaa

SEQ ID NO: 428745 - DNA, 25 bp, Rattus norvegicus
ggaggcacattcgtatacttctgaa

SEQ ID NO: 428746 - DNA, 25 bp, Rattus norvegicus
ggaggcacatttaattgctctgtac

SEQ ID NO: 428747 - DNA, 25 bp, Rattus norvegicus
ggaggcacattttattgctctgtac

SEQ ID NO: 428748 - DNA, 25 bp, Rattus norvegicus
ggaggcaccacaccttcaagatcaa

SEQ ID NO: 428749 - DNA, 25 bp, Rattus norvegicus
ggaggcaccacagcttcaagatcaa

SEQ ID NO: 428750 - DNA, 25 bp, Rattus norvegicus
ggaggcaccatacatctttaagcag

SEQ ID NO: 428751 - DNA, 25 bp, Rattus norvegicus
ggaggcaccatagatctttaagcag

SEQ ID NO: 428752 - DNA, 25 bp, Rattus norvegicus
ggaggcacctcacggtcatgaacta

SEQ ID NO: 428753 - DNA, 25 bp, Rattus norvegicus
ggaggcacctcagggtcatgaacta

SEQ ID NO: 428754 - DNA, 25 bp, Rattus norvegicus
ggaggcacctccagtacctgggccg

SEQ ID NO: 428755 - DNA, 25 bp, Rattus norvegicus
ggaggcacctcctgtacctgggccg

SEQ ID NO: 428756 - DNA, 25 bp, Rattus norvegicus
ggaggcacctcgcagaagttgcaat

SEQ ID NO: 428757 - DNA, 25 bp, Rattus norvegicus
ggaggcacctcggagaagttgcaat

SEQ ID NO: 428758 - DNA, 25 bp, Rattus norvegicus
ggaggcacctgactagtggtacctt

SEQ ID NO: 428759 - DNA, 25 bp, Rattus norvegicus
ggaggcacctgagtagtggtacctt

SEQ ID NO: 428760 - DNA, 25 bp, Rattus norvegicus
ggaggcacgctgagacttagtgact

SEQ ID NO: 428761 - DNA, 25 bp, Rattus norvegicus
ggaggcacgctgtgacttagtgact

SEQ ID NO: 428762 - DNA, 25 bp, Rattus norvegicus
ggaggcacggccacggcggcgccga

SEQ ID NO: 428763 - DNA, 25 bp, Rattus norvegicus
ggaggcacggcctcggcggcgccga

SEQ ID NO: 428764 - DNA, 25 bp, Rattus norvegicus
ggaggcacggttagcttattttcca

SEQ ID NO: 428765 - DNA, 25 bp, Rattus norvegicus
ggaggcacggtttgcttattttcca

SEQ ID NO: 428766 - DNA, 25 bp, Rattus norvegicus
ggaggcactcacagcagaaactgct

SEQ ID NO: 428767 - DNA, 25 bp, Rattus norvegicus
ggaggcactcactgcagaaactgct

SEQ ID NO: 428768 - DNA, 25 bp, Rattus norvegicus
ggaggcactgaaactgtacttccca

SEQ ID NO: 428769 - DNA, 25 bp, Rattus norvegicus
ggaggcactgaaccacagcggctat

SEQ ID NO: 428770 - DNA, 25 bp, Rattus norvegicus
ggaggcactgaagcacagcggctat

SEQ ID NO: 428771 - DNA, 25 bp, Rattus norvegicus
ggaggcactgaatctgtacttccca

SEQ ID NO: 428772 - DNA, 25 bp, Rattus norvegicus
ggaggcactgccacaaccatggtgt

SEQ ID NO: 428773 - DNA, 25 bp, Rattus norvegicus
ggaggcactgcctcaaccatggtgt

SEQ ID NO: 428774 - DNA, 25 bp, Rattus norvegicus
ggaggcactgtacaacacatgagtt

SEQ ID NO: 428775 - DNA, 25 bp, Rattus norvegicus
ggaggcactgtagaacacatgagtt

SEQ ID NO: 428776 - DNA, 25 bp, Rattus norvegicus
ggaggcagaacaaagctttcaagct

SEQ ID NO: 428777 - DNA, 25 bp, Rattus norvegicus
ggaggcagaacatagctttcaagct

SEQ ID NO: 428778 - DNA, 25 bp, Rattus norvegicus
ggaggcagaattcttgaacatcttt

SEQ ID NO: 428779 - DNA, 25 bp, Rattus norvegicus
ggaggcagaattgttgaacatcttt

SEQ ID NO: 428780 - DNA, 25 bp, Rattus norvegicus
ggaggcagacacagttccccgtgga

SEQ ID NO: 428781 - DNA, 25 bp, Rattus norvegicus
ggaggcagacactgttccccgtgga

SEQ ID NO: 428782 - DNA, 25 bp, Rattus norvegicus
ggaggcagagccctaattcagagct

SEQ ID NO: 428783 - DNA, 25 bp, Rattus norvegicus
ggaggcagagccgtaattcagagct

SEQ ID NO: 428784 - DNA, 25 bp, Rattus norvegicus
ggaggcagccaaacttctagagatt

SEQ ID NO: 428785 - DNA, 25 bp, Rattus norvegicus
ggaggcagccaatcttctagagatt

SEQ ID NO: 428786 - DNA, 25 bp, Rattus norvegicus
ggaggcagccaccttaggtgtcaat

SEQ ID NO: 428787 - DNA, 25 bp, Rattus norvegicus
ggaggcagccacgttaggtgtcaat

SEQ ID NO: 428788 - DNA, 25 bp, Rattus norvegicus
ggaggcagctccagtacccgcaggc

SEQ ID NO: 428789 - DNA, 25 bp, Rattus norvegicus
ggaggcagctcctgtacccgcaggc

SEQ ID NO: 428790 - DNA, 25 bp, Rattus norvegicus
ggaggcagctctctctaccaggaag

SEQ ID NO: 428791 - DNA, 25 bp, Rattus norvegicus
ggaggcagctctgtctaccaggaag

SEQ ID NO: 428792 - DNA, 25 bp, Rattus norvegicus
ggaggcagctgtagacacgatgtct

SEQ ID NO: 428793 - DNA, 25 bp, Rattus norvegicus
ggaggcagctgtatgggataccata

SEQ ID NO: 428794 - DNA, 25 bp, Rattus norvegicus
ggaggcagctgttgacacgatgtct

SEQ ID NO: 428795 - DNA, 25 bp, Rattus norvegicus
ggaggcagctgtttgggataccata

SEQ ID NO: 428796 - DNA, 25 bp, Rattus norvegicus
ggaggcaggcacacctctgggttcc

SEQ ID NO: 428797 - DNA, 25 bp, Rattus norvegicus
ggaggcaggcactcctctgggttcc

SEQ ID NO: 428798 - DNA, 25 bp, Rattus norvegicus
ggaggcaggcgcactgctgctcttc

SEQ ID NO: 428799 - DNA, 25 bp, Rattus norvegicus
ggaggcaggcgctctgctgctcttc

SEQ ID NO: 428800 - DNA, 25 bp, Rattus norvegicus
ggaggcagggagacattcatttaac

SEQ ID NO: 428801 - DNA, 25 bp, Rattus norvegicus
ggaggcagggagtcattcatttaac

SEQ ID NO: 428802 - DNA, 25 bp, Rattus norvegicus
ggaggcaggtacagacaccgtcttc

SEQ ID NO: 428803 - DNA, 25 bp, Rattus norvegicus
ggaggcaggtactgacaccgtcttc

SEQ ID NO: 428804 - DNA, 25 bp, Rattus norvegicus
ggaggcagtgacaggctcgccctaa

SEQ ID NO: 428805 - DNA, 25 bp, Rattus norvegicus
ggaggcagtgactggctcgccctaa

SEQ ID NO: 428806 - DNA, 25 bp, Rattus norvegicus
ggaggcagtgatcttctctacatat

SEQ ID NO: 428807 - DNA, 25 bp, Rattus norvegicus
ggaggcagtgatgttctctacatat

SEQ ID NO: 428808 - DNA, 25 bp, Rattus norvegicus
ggaggcagttacatcctgtggaagt

SEQ ID NO: 428809 - DNA, 25 bp, Rattus norvegicus
ggaggcagttacttcctgtggaagt

SEQ ID NO: 428810 - DNA, 25 bp, Rattus norvegicus
ggaggcatccgtaggttttctgctt

SEQ ID NO: 428811 - DNA, 25 bp, Rattus norvegicus
ggaggcatccgttggttttctgctt

SEQ ID NO: 428812 - DNA, 25 bp, Rattus norvegicus
ggaggcatctgcatgggtgaccacc

SEQ ID NO: 428813 - DNA, 25 bp, Rattus norvegicus
ggaggcatctgcttgggtgaccacc

SEQ ID NO: 428814 - DNA, 25 bp, Rattus norvegicus
ggaggcatgagcagtctttggtttt

SEQ ID NO: 428815 - DNA, 25 bp, Rattus norvegicus
ggaggcatgagctgtctttggtttt

SEQ ID NO: 428816 - DNA, 25 bp, Rattus norvegicus
ggaggcatggtaaccgtaacatccc

SEQ ID NO: 428817 - DNA, 25 bp, Rattus norvegicus
ggaggcatggtatccgtaacatccc

SEQ ID NO: 428818 - DNA, 25 bp, Rattus norvegicus
ggaggcatgtcacttgttgaacctt

SEQ ID NO: 428819 - DNA, 25 bp, Rattus norvegicus
ggaggcatgtcagttgttgaacctt

SEQ ID NO: 428820 - DNA, 25 bp, Rattus norvegicus
ggaggcattagccaccacatgtcgg

SEQ ID NO: 428821 - DNA, 25 bp, Rattus norvegicus
ggaggcattagcgaccacatgtcgg

SEQ ID NO: 428822 - DNA, 25 bp, Rattus norvegicus
ggaggcatttcaaacaaacacattt

SEQ ID NO: 428823 - DNA, 25 bp, Rattus norvegicus
ggaggcatttcatacaaacacattt

SEQ ID NO: 428824 - DNA, 25 bp, Rattus norvegicus
ggaggcatttccctcttctctgatg

SEQ ID NO: 428825 - DNA, 25 bp, Rattus norvegicus
ggaggcatttccgtcttctctgatg

SEQ ID NO: 428826 - DNA, 25 bp, Rattus norvegicus
ggaggcatttgaaggattacacatt

SEQ ID NO: 428827 - DNA, 25 bp, Rattus norvegicus
ggaggcatttgatggattacacatt

SEQ ID NO: 428828 - DNA, 25 bp, Rattus norvegicus
ggaggccaaatgaaccatacataga

SEQ ID NO: 428829 - DNA, 25 bp, Rattus norvegicus
ggaggccaaatgtaccatacataga

SEQ ID NO: 428830 - DNA, 25 bp, Rattus norvegicus
ggaggccaaggcagttgctttccat

SEQ ID NO: 428831 - DNA, 25 bp, Rattus norvegicus
ggaggccaaggctgttgctttccat

SEQ ID NO: 428832 - DNA, 25 bp, Rattus norvegicus
ggaggccaagtaaccgtggtagcaa

SEQ ID NO: 428833 - DNA, 25 bp, Rattus norvegicus
ggaggccaagtatccgtggtagcaa

SEQ ID NO: 428834 - DNA, 25 bp, Rattus norvegicus
ggaggccacagtctgtgtgccacat

SEQ ID NO: 428835 - DNA, 25 bp, Rattus norvegicus
ggaggccacagtgtgtgtgccacat

SEQ ID NO: 428836 - DNA, 25 bp, Rattus norvegicus
ggaggccacatgaaatcagcatagt

SEQ ID NO: 428837 - DNA, 25 bp, Rattus norvegicus
ggaggccacatgtaatcagcatagt

SEQ ID NO: 428838 - DNA, 25 bp, Rattus norvegicus
ggaggccacattattgttcagtagc

SEQ ID NO: 428839 - DNA, 25 bp, Rattus norvegicus
ggaggccacatttttgttcagtagc

SEQ ID NO: 428840 - DNA, 25 bp, Rattus norvegicus
ggaggccagacactagaacagctta

SEQ ID NO: 428841 - DNA, 25 bp, Rattus norvegicus
ggaggccagacagtagaacagctta

SEQ ID NO: 428842 - DNA, 25 bp, Rattus norvegicus
ggaggccagagcactaaaagcccag

SEQ ID NO: 428843 - DNA, 25 bp, Rattus norvegicus
ggaggccagagctctaaaagcccag

SEQ ID NO: 428844 - DNA, 25 bp, Rattus norvegicus
ggaggccagcctaaaaggttcccag

SEQ ID NO: 428845 - DNA, 25 bp, Rattus norvegicus
ggaggccagccttaaaggttcccag

SEQ ID NO: 428846 - DNA, 25 bp, Rattus norvegicus
ggaggccagcgtagctcattttaaa

SEQ ID NO: 428847 - DNA, 25 bp, Rattus norvegicus
ggaggccagcgttgctcattttaaa

SEQ ID NO: 428848 - DNA, 25 bp, Rattus norvegicus
ggaggccaggcaacacacaggtact

SEQ ID NO: 428849 - DNA, 25 bp, Rattus norvegicus
ggaggccaggcatcacacaggtact

SEQ ID NO: 428850 - DNA, 25 bp, Rattus norvegicus
ggaggccagtacattgctaaaccac

SEQ ID NO: 428851 - DNA, 25 bp, Rattus norvegicus
ggaggccagtactttgctaaaccac

SEQ ID NO: 428852 - DNA, 25 bp, Rattus norvegicus
ggaggccagtgcctgacatcacagc

SEQ ID NO: 428853 - DNA, 25 bp, Rattus norvegicus
ggaggccagtgcgtgacatcacagc

SEQ ID NO: 428854 - DNA, 25 bp, Rattus norvegicus
ggaggccataatactgacgatactg

SEQ ID NO: 428855 - DNA, 25 bp, Rattus norvegicus
ggaggccataattctgacgatactg

SEQ ID NO: 428856 - DNA, 25 bp, Rattus norvegicus
ggaggccatagcaggactgtcagtt

SEQ ID NO: 428857 - DNA, 25 bp, Rattus norvegicus
ggaggccatagctggactgtcagtt

SEQ ID NO: 428858 - DNA, 25 bp, Rattus norvegicus
ggaggccatctgaccagagggtatt

SEQ ID NO: 428859 - DNA, 25 bp, Rattus norvegicus
ggaggccatctgtccagagggtatt

SEQ ID NO: 428860 - DNA, 25 bp, Rattus norvegicus
ggaggccatgcaagttgcccctgaa

SEQ ID NO: 428861 - DNA, 25 bp, Rattus norvegicus
ggaggccatgcatgttgcccctgaa

SEQ ID NO: 428862 - DNA, 25 bp, Rattus norvegicus
ggaggccatgttcagcgacaccgca

SEQ ID NO: 428863 - DNA, 25 bp, Rattus norvegicus
ggaggccatgttgagcgacaccgca

SEQ ID NO: 428864 - DNA, 25 bp, Rattus norvegicus
ggaggccattgcaccatatttactg

SEQ ID NO: 428865 - DNA, 25 bp, Rattus norvegicus
ggaggccattgcatctgctggcaaa

SEQ ID NO: 428866 - DNA, 25 bp, Rattus norvegicus
ggaggccattgctccatatttactg

SEQ ID NO: 428867 - DNA, 25 bp, Rattus norvegicus
ggaggccattgcttctgctggcaaa

SEQ ID NO: 428868 - DNA, 25 bp, Rattus norvegicus
ggaggcccaaatctacactcatgaa

SEQ ID NO: 428869 - DNA, 25 bp, Rattus norvegicus
ggaggcccaaatgtacactcatgaa

SEQ ID NO: 428870 - DNA, 25 bp, Rattus norvegicus
ggaggcccaaggagagctcccagca

SEQ ID NO: 428871 - DNA, 25 bp, Rattus norvegicus
ggaggcccaaggtgagctcccagca

SEQ ID NO: 428872 - DNA, 25 bp, Rattus norvegicus
ggaggcccaggtaagaatctcgaca

SEQ ID NO: 428873 - DNA, 25 bp, Rattus norvegicus
ggaggcccaggtacgcaaagagaac

SEQ ID NO: 428874 - DNA, 25 bp, Rattus norvegicus
ggaggcccaggttagaatctcgaca

SEQ ID NO: 428875 - DNA, 25 bp, Rattus norvegicus
ggaggcccaggttcgcaaagagaac

SEQ ID NO: 428876 - DNA, 25 bp, Rattus norvegicus
ggaggcccagttacaggagagcctt

SEQ ID NO: 428877 - DNA, 25 bp, Rattus norvegicus
ggaggcccagtttcaggagagcctt

SEQ ID NO: 428878 - DNA, 25 bp, Rattus norvegicus
ggaggcccatgtccagaacagtgtc

SEQ ID NO: 428879 - DNA, 25 bp, Rattus norvegicus
ggaggcccatgtgcagaacagtgtc

SEQ ID NO: 428880 - DNA, 25 bp, Rattus norvegicus
ggaggcccattcaggctcctatgga

SEQ ID NO: 428881 - DNA, 25 bp, Rattus norvegicus
ggaggcccattctggctcctatgga

SEQ ID NO: 428882 - DNA, 25 bp, Rattus norvegicus
ggaggcccgaatcaccttagaaact

SEQ ID NO: 428883 - DNA, 25 bp, Rattus norvegicus
ggaggcccgaatgaccttagaaact

SEQ ID NO: 428884 - DNA, 25 bp, Rattus norvegicus
ggaggcccgactccatcacgttatg

SEQ ID NO: 428885 - DNA, 25 bp, Rattus norvegicus
ggaggcccgactgcatcacgttatg

SEQ ID NO: 428886 - DNA, 25 bp, Rattus norvegicus
ggaggcccgtgcatggcagatactc

SEQ ID NO: 428887 - DNA, 25 bp, Rattus norvegicus
ggaggcccgtgcttggcagatactc

SEQ ID NO: 428888 - DNA, 25 bp, Rattus norvegicus
ggaggccctaagaaggaccacagtt

SEQ ID NO: 428889 - DNA, 25 bp, Rattus norvegicus
ggaggccctaagagaacacccagat

SEQ ID NO: 428890 - DNA, 25 bp, Rattus norvegicus
ggaggccctaagtaggaccacagtt

SEQ ID NO: 428891 - DNA, 25 bp, Rattus norvegicus
ggaggccctaagtgaacacccagat

SEQ ID NO: 428892 - DNA, 25 bp, Rattus norvegicus
ggaggccctacacaggatgttcgct

SEQ ID NO: 428893 - DNA, 25 bp, Rattus norvegicus
ggaggccctacagaggatgttcgct

SEQ ID NO: 428894 - DNA, 25 bp, Rattus norvegicus
ggaggccctagcattggacatgatg

SEQ ID NO: 428895 - DNA, 25 bp, Rattus norvegicus
ggaggccctagctttggacatgatg

SEQ ID NO: 428896 - DNA, 25 bp, Rattus norvegicus
ggaggccctggaagtcagtgaccac

SEQ ID NO: 428897 - DNA, 25 bp, Rattus norvegicus
ggaggccctggatgtcagtgaccac

SEQ ID NO: 428898 - DNA, 25 bp, Rattus norvegicus
ggaggccctggcagaatgcaaactg

SEQ ID NO: 428899 - DNA, 25 bp, Rattus norvegicus
ggaggccctggctgaatgcaaactg

SEQ ID NO: 428900 - DNA, 25 bp, Rattus norvegicus
ggaggccctggtataaggatcactt

SEQ ID NO: 428901 - DNA, 25 bp, Rattus norvegicus
ggaggccctggtttaaggatcactt

SEQ ID NO: 428902 - DNA, 25 bp, Rattus norvegicus
ggaggccgacatcatcaaactcaga

SEQ ID NO: 428903 - DNA, 25 bp, Rattus norvegicus
ggaggccgacatgatcaaactcaga

SEQ ID NO: 428904 - DNA, 25 bp, Rattus norvegicus
ggaggccgacgacagctaaagcttt

SEQ ID NO: 428905 - DNA, 25 bp, Rattus norvegicus
ggaggccgacgagagctaaagcttt

SEQ ID NO: 428906 - DNA, 25 bp, Rattus norvegicus
ggaggccgcatgacgattcttttga

SEQ ID NO: 428907 - DNA, 25 bp, Rattus norvegicus
ggaggccgcatgtcgattcttttga

SEQ ID NO: 428908 - DNA, 25 bp, Rattus norvegicus
ggaggccgctaaagccttctggtga

SEQ ID NO: 428909 - DNA, 25 bp, Rattus norvegicus
ggaggccgctaatgccttctggtga

SEQ ID NO: 428910 - DNA, 25 bp, Rattus norvegicus
ggaggccgtcttatagacacatggt

SEQ ID NO: 428911 - DNA, 25 bp, Rattus norvegicus
ggaggccgtcttttagacacatggt

SEQ ID NO: 428912 - DNA, 25 bp, Rattus norvegicus
ggaggcctagaacagctttcactgg

SEQ ID NO: 428913 - DNA, 25 bp, Rattus norvegicus
ggaggcctagaagagctttcactgg

SEQ ID NO: 428914 - DNA, 25 bp, Rattus norvegicus
ggaggcctatgccttacaggttctt

SEQ ID NO: 428915 - DNA, 25 bp, Rattus norvegicus
ggaggcctatgcgttacaggttctt

SEQ ID NO: 428916 - DNA, 25 bp, Rattus norvegicus
ggaggcctctagagaactgtattct

SEQ ID NO: 428917 - DNA, 25 bp, Rattus norvegicus
ggaggcctctagtgaactgtattct

SEQ ID NO: 428918 - DNA, 25 bp, Rattus norvegicus
ggaggcctctccagactcgagatga

SEQ ID NO: 428919 - DNA, 25 bp, Rattus norvegicus
ggaggcctctcctgactcgagatga

SEQ ID NO: 428920 - DNA, 25 bp, Rattus norvegicus
ggaggcctctgtcagcctgatgaat

SEQ ID NO: 428921 - DNA, 25 bp, Rattus norvegicus
ggaggcctctgtgagcctgatgaat

SEQ ID NO: 428922 - DNA, 25 bp, Rattus norvegicus
ggaggcctgaggagccacagttact

SEQ ID NO: 428923 - DNA, 25 bp, Rattus norvegicus
ggaggcctgaggtgccacagttact

SEQ ID NO: 428924 - DNA, 25 bp, Rattus norvegicus
ggaggcctgggacactctattgaaa

SEQ ID NO: 428925 - DNA, 25 bp, Rattus norvegicus
ggaggcctgggagactctattgaaa

SEQ ID NO: 428926 - DNA, 25 bp, Rattus norvegicus
ggaggcctgtgtattacctgacaac

SEQ ID NO: 428927 - DNA, 25 bp, Rattus norvegicus
ggaggcctgtgttttacctgacaac

SEQ ID NO: 428928 - DNA, 25 bp, Rattus norvegicus
ggaggcctgttgatgaacacagcag

SEQ ID NO: 428929 - DNA, 25 bp, Rattus norvegicus
ggaggcctgttgttgaacacagcag

SEQ ID NO: 428930 - DNA, 25 bp, Rattus norvegicus
ggaggccttactactttgactgaac

SEQ ID NO: 428931 - DNA, 25 bp, Rattus norvegicus
ggaggccttactccttggagtcaga

SEQ ID NO: 428932 - DNA, 25 bp, Rattus norvegicus
ggaggccttactgcttggagtcaga

SEQ ID NO: 428933 - DNA, 25 bp, Rattus norvegicus
ggaggccttacttctttgactgaac

SEQ ID NO: 428934 - DNA, 25 bp, Rattus norvegicus
ggaggccttcatatagagagcgaaa

SEQ ID NO: 428935 - DNA, 25 bp, Rattus norvegicus
ggaggccttcatttagagagcgaaa

SEQ ID NO: 428936 - DNA, 25 bp, Rattus norvegicus
ggaggccttctcctatggccagaag

SEQ ID NO: 428937 - DNA, 25 bp, Rattus norvegicus
ggaggccttctcgtatggccagaag

SEQ ID NO: 428938 - DNA, 25 bp, Rattus norvegicus
ggaggccttgaaccacgcactgcac

SEQ ID NO: 428939 - DNA, 25 bp, Rattus norvegicus
ggaggccttgaagcacgcactgcac

SEQ ID NO: 428940 - DNA, 25 bp, Rattus norvegicus
ggaggccttgtcacaagtcgaaaag

SEQ ID NO: 428941 - DNA, 25 bp, Rattus norvegicus
ggaggccttgtctcaagtcgaaaag

SEQ ID NO: 428942 - DNA, 25 bp, Rattus norvegicus
ggaggcgacaagcatcaccacatta

SEQ ID NO: 428943 - DNA, 25 bp, Rattus norvegicus
ggaggcgacaaggatcaccacatta

SEQ ID NO: 428944 - DNA, 25 bp, Rattus norvegicus
ggaggcgacacccagagtcacctgt

SEQ ID NO: 428945 - DNA, 25 bp, Rattus norvegicus
ggaggcgacaccgagagtcacctgt

SEQ ID NO: 428946 - DNA, 25 bp, Rattus norvegicus
ggaggcgaggacagtgcacacttca

SEQ ID NO: 428947 - DNA, 25 bp, Rattus norvegicus
ggaggcgaggactgtgcacacttca

SEQ ID NO: 428948 - DNA, 25 bp, Rattus norvegicus
ggaggcgaggtcataattgctctaa

SEQ ID NO: 428949 - DNA, 25 bp, Rattus norvegicus
ggaggcgaggtcttaattgctctaa

SEQ ID NO: 428950 - DNA, 25 bp, Rattus norvegicus
ggaggcgattccctgactagtcaaa

SEQ ID NO: 428951 - DNA, 25 bp, Rattus norvegicus
ggaggcgattccgtgactagtcaaa

SEQ ID NO: 428952 - DNA, 25 bp, Rattus norvegicus
ggaggcgcacacagagtgactctta

SEQ ID NO: 428953 - DNA, 25 bp, Rattus norvegicus
ggaggcgcacactgagtgactctta

SEQ ID NO: 428954 - DNA, 25 bp, Rattus norvegicus
ggaggcgcagcgataggctctggga

SEQ ID NO: 428955 - DNA, 25 bp, Rattus norvegicus
ggaggcgcagcgttaggctctggga

SEQ ID NO: 428956 - DNA, 25 bp, Rattus norvegicus
ggaggcgcagggactctgttactct

SEQ ID NO: 428957 - DNA, 25 bp, Rattus norvegicus
ggaggcgcagggtctctgttactct

SEQ ID NO: 428958 - DNA, 25 bp, Rattus norvegicus
ggaggcgccactactgtggactcaa

SEQ ID NO: 428959 - DNA, 25 bp, Rattus norvegicus
ggaggcgccacttctgtggactcaa

SEQ ID NO: 428960 - DNA, 25 bp, Rattus norvegicus
ggaggcgcggccagggcaggcagct

SEQ ID NO: 428961 - DNA, 25 bp, Rattus norvegicus
ggaggcgcggcctgggcaggcagct

SEQ ID NO: 428962 - DNA, 25 bp, Rattus norvegicus
ggaggcgctaaacttccttataccg

SEQ ID NO: 428963 - DNA, 25 bp, Rattus norvegicus
ggaggcgctaaagttccttataccg

SEQ ID NO: 428964 - DNA, 25 bp, Rattus norvegicus
ggaggcgctgctccgtctagatccc

SEQ ID NO: 428965 - DNA, 25 bp, Rattus norvegicus
ggaggcgctgctgcgtctagatccc

SEQ ID NO: 428966 - DNA, 25 bp, Rattus norvegicus
ggaggcggagcactctgatcactca

SEQ ID NO: 428967 - DNA, 25 bp, Rattus norvegicus
ggaggcggagcagtctgatcactca

SEQ ID NO: 428968 - DNA, 25 bp, Rattus norvegicus
ggaggcggctcccatttcagagctt

SEQ ID NO: 428969 - DNA, 25 bp, Rattus norvegicus
ggaggcggctccgatttcagagctt

SEQ ID NO: 428970 - DNA, 25 bp, Rattus norvegicus
ggaggcgtcaacactgagctgctgt

SEQ ID NO: 428971 - DNA, 25 bp, Rattus norvegicus
ggaggcgtcaactctgagctgctgt

SEQ ID NO: 428972 - DNA, 25 bp, Rattus norvegicus
ggaggcgtcctcagactcgataaaa

SEQ ID NO: 428973 - DNA, 25 bp, Rattus norvegicus
ggaggcgtcctctgactcgataaaa

SEQ ID NO: 428974 - DNA, 25 bp, Rattus norvegicus
ggaggcgtctcaagtgagtgtcaat

SEQ ID NO: 428975 - DNA, 25 bp, Rattus norvegicus
ggaggcgtctcatgtgagtgtcaat

SEQ ID NO: 428976 - DNA, 25 bp, Rattus norvegicus
ggaggcgttctcacaaggactttaa

SEQ ID NO: 428977 - DNA, 25 bp, Rattus norvegicus
ggaggcgttctctcaaggactttaa

SEQ ID NO: 428978 - DNA, 25 bp, Rattus norvegicus
ggaggcgtttggaacactctgccct

SEQ ID NO: 428979 - DNA, 25 bp, Rattus norvegicus
ggaggcgtttggtacactctgccct

SEQ ID NO: 428980 - DNA, 25 bp, Rattus norvegicus
ggaggctacacaaagccctgtttaa

SEQ ID NO: 428981 - DNA, 25 bp, Rattus norvegicus
ggaggctacacacttttggcctcct

SEQ ID NO: 428982 - DNA, 25 bp, Rattus norvegicus
ggaggctacacagttttggcctcct

SEQ ID NO: 428983 - DNA, 25 bp, Rattus norvegicus
ggaggctacacatagccctgtttaa

SEQ ID NO: 428984 - DNA, 25 bp, Rattus norvegicus
ggaggctacatcaagtccacaggta

SEQ ID NO: 428985 - DNA, 25 bp, Rattus norvegicus
ggaggctacatctagtccacaggta

SEQ ID NO: 428986 - DNA, 25 bp, Rattus norvegicus
ggaggctacgaccagctagagctca

SEQ ID NO: 428987 - DNA, 25 bp, Rattus norvegicus
ggaggctacgacgagctagagctca

SEQ ID NO: 428988 - DNA, 25 bp, Rattus norvegicus
ggaggctactcaacacagtcaaact

SEQ ID NO: 428989 - DNA, 25 bp, Rattus norvegicus
ggaggctactcatcacagtcaaact

SEQ ID NO: 428990 - DNA, 25 bp, Rattus norvegicus
ggaggctaggctcagtaccttctaa

SEQ ID NO: 428991 - DNA, 25 bp, Rattus norvegicus
ggaggctaggctgagtaccttctaa

SEQ ID NO: 428992 - DNA, 25 bp, Rattus norvegicus
ggaggctatgcaccttacagatatg

SEQ ID NO: 428993 - DNA, 25 bp, Rattus norvegicus
ggaggctatgcagcttacagatatg

SEQ ID NO: 428994 - DNA, 25 bp, Rattus norvegicus
ggaggctcacaactatcatcctaag

SEQ ID NO: 428995 - DNA, 25 bp, Rattus norvegicus
ggaggctcacaagtatcatcctaag

SEQ ID NO: 428996 - DNA, 25 bp, Rattus norvegicus
ggaggctcacataatgtgacttgat

SEQ ID NO: 428997 - DNA, 25 bp, Rattus norvegicus
ggaggctcacattatgtgacttgat

SEQ ID NO: 428998 - DNA, 25 bp, Rattus norvegicus
ggaggctcaggcacgaaactcaatt

SEQ ID NO: 428999 - DNA, 25 bp, Rattus norvegicus
ggaggctcaggctcgaaactcaatt

SEQ ID NO: 429000 - DNA, 25 bp, Rattus norvegicus
ggaggctcagtgaccagtcctgctg

SEQ ID NO: 429001 - DNA, 25 bp, Rattus norvegicus
ggaggctcagtgtccagtcctgctg

SEQ ID NO: 429002 - DNA, 25 bp, Rattus norvegicus
ggaggctcatcaagggctgttttca

SEQ ID NO: 429003 - DNA, 25 bp, Rattus norvegicus
ggaggctcatcatgggctgttttca

SEQ ID NO: 429004 - DNA, 25 bp, Rattus norvegicus
ggaggctcatgcagaagaacgagta

SEQ ID NO: 429005 - DNA, 25 bp, Rattus norvegicus
ggaggctcatgctgaagaacgagta

SEQ ID NO: 429006 - DNA, 25 bp, Rattus norvegicus
ggaggctccaacacctcaatgtatt

SEQ ID NO: 429007 - DNA, 25 bp, Rattus norvegicus
ggaggctccaactcctcaatgtatt

SEQ ID NO: 429008 - DNA, 25 bp, Rattus norvegicus
ggaggctccatccagaaccgcaagt

SEQ ID NO: 429009 - DNA, 25 bp, Rattus norvegicus
ggaggctccatcgagaaccgcaagt

SEQ ID NO: 429010 - DNA, 25 bp, Rattus norvegicus
ggaggctccggcaaaagaagctgct

SEQ ID NO: 429011 - DNA, 25 bp, Rattus norvegicus
ggaggctccggctaaagaagctgct

SEQ ID NO: 429012 - DNA, 25 bp, Rattus norvegicus
ggaggctcctgacacctgctcgaga

SEQ ID NO: 429013 - DNA, 25 bp, Rattus norvegicus
ggaggctcctgagacctgctcgaga

SEQ ID NO: 429014 - DNA, 25 bp, Rattus norvegicus
ggaggctcctgcaaaaccttcttaa

SEQ ID NO: 429015 - DNA, 25 bp, Rattus norvegicus
ggaggctcctgcaatgacagtcctg

SEQ ID NO: 429016 - DNA, 25 bp, Rattus norvegicus
ggaggctcctgctaaaccttcttaa

SEQ ID NO: 429017 - DNA, 25 bp, Rattus norvegicus
ggaggctcctgctatgacagtcctg

SEQ ID NO: 429018 - DNA, 25 bp, Rattus norvegicus
ggaggctccttcattttgtaaatgc

SEQ ID NO: 429019 - DNA, 25 bp, Rattus norvegicus
ggaggctccttctttttgtaaatgc

SEQ ID NO: 429020 - DNA, 25 bp, Rattus norvegicus
ggaggctctcaactgcttagttaaa

SEQ ID NO: 429021 - DNA, 25 bp, Rattus norvegicus
ggaggctctcaagtgcttagttaaa

SEQ ID NO: 429022 - DNA, 25 bp, Rattus norvegicus
ggaggctctctgatttcttgagcat

SEQ ID NO: 429023 - DNA, 25 bp, Rattus norvegicus
ggaggctctctgttttcttgagcat

SEQ ID NO: 429024 - DNA, 25 bp, Rattus norvegicus
ggaggctctgccattgcgaatctca

SEQ ID NO: 429025 - DNA, 25 bp, Rattus norvegicus
ggaggctctgcctttgcgaatctca

SEQ ID NO: 429026 - DNA, 25 bp, Rattus norvegicus
ggaggctcttcacagaccttaacat

SEQ ID NO: 429027 - DNA, 25 bp, Rattus norvegicus
ggaggctcttcagagaccttaacat

SEQ ID NO: 429028 - DNA, 25 bp, Rattus norvegicus
ggaggctcttgaaatggacccttca

SEQ ID NO: 429029 - DNA, 25 bp, Rattus norvegicus
ggaggctcttgatatggacccttca

SEQ ID NO: 429030 - DNA, 25 bp, Rattus norvegicus
ggaggctgacccaacgtacagaact

SEQ ID NO: 429031 - DNA, 25 bp, Rattus norvegicus
ggaggctgaccctacgtacagaact

SEQ ID NO: 429032 - DNA, 25 bp, Rattus norvegicus
ggaggctgacgcaggacaatcctaa

SEQ ID NO: 429033 - DNA, 25 bp, Rattus norvegicus
ggaggctgacgctggacaatcctaa

SEQ ID NO: 429034 - DNA, 25 bp, Rattus norvegicus
ggaggctgactgaccactaggcaca

SEQ ID NO: 429035 - DNA, 25 bp, Rattus norvegicus
ggaggctgactgacttaggattctt

SEQ ID NO: 429036 - DNA, 25 bp, Rattus norvegicus
ggaggctgactgtccactaggcaca

SEQ ID NO: 429037 - DNA, 25 bp, Rattus norvegicus
ggaggctgactgtcttaggattctt

SEQ ID NO: 429038 - DNA, 25 bp, Rattus norvegicus
ggaggctgatacaggcaaatcccag

SEQ ID NO: 429039 - DNA, 25 bp, Rattus norvegicus
ggaggctgatactggcaaatcccag

SEQ ID NO: 429040 - DNA, 25 bp, Rattus norvegicus
ggaggctgattcatccacaggaagc

SEQ ID NO: 429041 - DNA, 25 bp, Rattus norvegicus
ggaggctgattcttccacaggaagc

SEQ ID NO: 429042 - DNA, 25 bp, Rattus norvegicus
ggaggctgcaaacatcctagctgaa

SEQ ID NO: 429043 - DNA, 25 bp, Rattus norvegicus
ggaggctgcaaagatcctagctgaa

SEQ ID NO: 429044 - DNA, 25 bp, Rattus norvegicus
ggaggctgcagccatttgatttttt

SEQ ID NO: 429045 - DNA, 25 bp, Rattus norvegicus
ggaggctgcagcgatttgatttttt

SEQ ID NO: 429046 - DNA, 25 bp, Rattus norvegicus
ggaggctgcatgcatccttaacata

SEQ ID NO: 429047 - DNA, 25 bp, Rattus norvegicus
ggaggctgcatggatccttaacata

SEQ ID NO: 429048 - DNA, 25 bp, Rattus norvegicus
ggaggctgccacatttgctagagag

SEQ ID NO: 429049 - DNA, 25 bp, Rattus norvegicus
ggaggctgccacttttgctagagag

SEQ ID NO: 429050 - DNA, 25 bp, Rattus norvegicus
ggaggctgcgatcaactgttaacat

SEQ ID NO: 429051 - DNA, 25 bp, Rattus norvegicus
ggaggctgcgatgaactgttaacat

SEQ ID NO: 429052 - DNA, 25 bp, Rattus norvegicus
ggaggctgctatagtccagagtgaa

SEQ ID NO: 429053 - DNA, 25 bp, Rattus norvegicus
ggaggctgctattgtccagagtgaa

SEQ ID NO: 429054 - DNA, 25 bp, Rattus norvegicus
ggaggctgctccctagattctagga

SEQ ID NO: 429055 - DNA, 25 bp, Rattus norvegicus
ggaggctgctccgtagattctagga

SEQ ID NO: 429056 - DNA, 25 bp, Rattus norvegicus
ggaggctggacaacacatagagact

SEQ ID NO: 429057 - DNA, 25 bp, Rattus norvegicus
ggaggctggacatcacatagagact

SEQ ID NO: 429058 - DNA, 25 bp, Rattus norvegicus
ggaggctggactatctggtcttcaa

SEQ ID NO: 429059 - DNA, 25 bp, Rattus norvegicus
ggaggctggactttctggtcttcaa

SEQ ID NO: 429060 - DNA, 25 bp, Rattus norvegicus
ggaggctggcaccaaatctcatagt

SEQ ID NO: 429061 - DNA, 25 bp, Rattus norvegicus
ggaggctggcacgaaatctcatagt

SEQ ID NO: 429062 - DNA, 25 bp, Rattus norvegicus
ggaggctggcagcacacacgtccca

SEQ ID NO: 429063 - DNA, 25 bp, Rattus norvegicus
ggaggctggcaggacacacgtccca

SEQ ID NO: 429064 - DNA, 25 bp, Rattus norvegicus
ggaggctggcatatgatcttttatc

SEQ ID NO: 429065 - DNA, 25 bp, Rattus norvegicus
ggaggctggcatttgatcttttatc

SEQ ID NO: 429066 - DNA, 25 bp, Rattus norvegicus
ggaggctggccaaggtgacaactca

SEQ ID NO: 429067 - DNA, 25 bp, Rattus norvegicus
ggaggctggccatggtgacaactca

SEQ ID NO: 429068 - DNA, 25 bp, Rattus norvegicus
ggaggctggtgaagtccctgcccaa

SEQ ID NO: 429069 - DNA, 25 bp, Rattus norvegicus
ggaggctggtgatgtccctgcccaa

SEQ ID NO: 429070 - DNA, 25 bp, Rattus norvegicus
ggaggctggttacctacctgtctta

SEQ ID NO: 429071 - DNA, 25 bp, Rattus norvegicus
ggaggctggttagctacctgtctta

SEQ ID NO: 429072 - DNA, 25 bp, Rattus norvegicus
ggaggctgttttactgcttagattt

SEQ ID NO: 429073 - DNA, 25 bp, Rattus norvegicus
ggaggctgtttttctgcttagattt

SEQ ID NO: 429074 - DNA, 25 bp, Rattus norvegicus
ggaggcttaaccagctagttactag

SEQ ID NO: 429075 - DNA, 25 bp, Rattus norvegicus
ggaggcttaacctgctagttactag

SEQ ID NO: 429076 - DNA, 25 bp, Rattus norvegicus
ggaggcttagacatgcacaattctt

SEQ ID NO: 429077 - DNA, 25 bp, Rattus norvegicus
ggaggcttagacttgcacaattctt

SEQ ID NO: 429078 - DNA, 25 bp, Rattus norvegicus
ggaggcttcacgaaggactcgccat

SEQ ID NO: 429079 - DNA, 25 bp, Rattus norvegicus
ggaggcttcacgtaggactcgccat

SEQ ID NO: 429080 - DNA, 25 bp, Rattus norvegicus
ggaggcttccaaacaaacatcgtag

SEQ ID NO: 429081 - DNA, 25 bp, Rattus norvegicus
ggaggcttccaatcaaacatcgtag

SEQ ID NO: 429082 - DNA, 25 bp, Rattus norvegicus
ggaggcttcccaccacctgaaggtg

SEQ ID NO: 429083 - DNA, 25 bp, Rattus norvegicus
ggaggcttcccagcacctgaaggtg

SEQ ID NO: 429084 - DNA, 25 bp, Rattus norvegicus
ggaggcttcgccatctaaagaagtt

SEQ ID NO: 429085 - DNA, 25 bp, Rattus norvegicus
ggaggcttcgccttctaaagaagtt

SEQ ID NO: 429086 - DNA, 25 bp, Rattus norvegicus
ggaggcttctgtccaagttttggca

SEQ ID NO: 429087 - DNA, 25 bp, Rattus norvegicus
ggaggcttctgtgcaagttttggca

SEQ ID NO: 429088 - DNA, 25 bp, Rattus norvegicus
ggaggcttgaccaggaattcccaag

SEQ ID NO: 429089 - DNA, 25 bp, Rattus norvegicus
ggaggcttgaccatagtccgctgca

SEQ ID NO: 429090 - DNA, 25 bp, Rattus norvegicus
ggaggcttgacctggaattcccaag

SEQ ID NO: 429091 - DNA, 25 bp, Rattus norvegicus
ggaggcttgaccttagtccgctgca

SEQ ID NO: 429092 - DNA, 25 bp, Rattus norvegicus
ggaggcttgactcatttccatgatg

SEQ ID NO: 429093 - DNA, 25 bp, Rattus norvegicus
ggaggcttgactgatttccatgatg

SEQ ID NO: 429094 - DNA, 25 bp, Rattus norvegicus
ggaggcttgcccagtgccagcagac

SEQ ID NO: 429095 - DNA, 25 bp, Rattus norvegicus
ggaggcttgccctgtgccagcagac

SEQ ID NO: 429096 - DNA, 25 bp, Rattus norvegicus
ggaggcttggaaccgacaaccacct

SEQ ID NO: 429097 - DNA, 25 bp, Rattus norvegicus
ggaggcttggaagcgacaaccacct

SEQ ID NO: 429098 - DNA, 25 bp, Rattus norvegicus
ggaggcttgtcacgagaccaaacct

SEQ ID NO: 429099 - DNA, 25 bp, Rattus norvegicus
ggaggcttgtcaggagaccaaacct

SEQ ID NO: 429100 - DNA, 25 bp, Rattus norvegicus
ggaggcttgtttctgcaaaacctga

SEQ ID NO: 429101 - DNA, 25 bp, Rattus norvegicus
ggaggcttgtttgtgcaaaacctga

SEQ ID NO: 429102 - DNA, 25 bp, Rattus norvegicus
ggaggctttccaaaaacacattcag

SEQ ID NO: 429103 - DNA, 25 bp, Rattus norvegicus
ggaggctttccataaacacattcag

SEQ ID NO: 429104 - DNA, 25 bp, Rattus norvegicus
ggaggctttctgatgaactacttat

SEQ ID NO: 429105 - DNA, 25 bp, Rattus norvegicus
ggaggctttctgttgaactacttat

SEQ ID NO: 429106 - DNA, 25 bp, Rattus norvegicus
ggaggctttgccagggttcagttct

SEQ ID NO: 429107 - DNA, 25 bp, Rattus norvegicus
ggaggctttgcctgggttcagttct

SEQ ID NO: 429108 - DNA, 25 bp, Rattus norvegicus
ggaggctttgtgacctgtggtacca

SEQ ID NO: 429109 - DNA, 25 bp, Rattus norvegicus
ggaggctttgtgtcctgtggtacca

SEQ ID NO: 429110 - DNA, 25 bp, Rattus norvegicus
ggaggcttttacattggagaggcaa

SEQ ID NO: 429111 - DNA, 25 bp, Rattus norvegicus
ggaggcttttactttggagaggcaa

SEQ ID NO: 429112 - DNA, 25 bp, Rattus norvegicus
ggagggaaactcagcgcctgcgcaa

SEQ ID NO: 429113 - DNA, 25 bp, Rattus norvegicus
ggagggaaactctgcgcctgcgcaa

SEQ ID NO: 429114 - DNA, 25 bp, Rattus norvegicus
ggagggaaagcacccttcagttaaa

SEQ ID NO: 429115 - DNA, 25 bp, Rattus norvegicus
ggagggaaagcagccttcagttaaa

SEQ ID NO: 429116 - DNA, 25 bp, Rattus norvegicus
ggagggaagcttctctttcgtgccc

SEQ ID NO: 429117 - DNA, 25 bp, Rattus norvegicus
ggagggaagcttgtctttcgtgccc

SEQ ID NO: 429118 - DNA, 25 bp, Rattus norvegicus
ggagggaaggtcactcggtctccct

SEQ ID NO: 429119 - DNA, 25 bp, Rattus norvegicus
ggagggaaggtctctcggtctccct

SEQ ID NO: 429120 - DNA, 25 bp, Rattus norvegicus
ggagggacaaacacactgacaggcc

SEQ ID NO: 429121 - DNA, 25 bp, Rattus norvegicus
ggagggacaaactcactgacaggcc

SEQ ID NO: 429122 - DNA, 25 bp, Rattus norvegicus
ggagggacactaactctagtggcca

SEQ ID NO: 429123 - DNA, 25 bp, Rattus norvegicus
ggagggacactatctctagtggcca

SEQ ID NO: 429124 - DNA, 25 bp, Rattus norvegicus
ggagggacactgctctagaacagtt

SEQ ID NO: 429125 - DNA, 25 bp, Rattus norvegicus
ggagggacactggtctagaacagtt

SEQ ID NO: 429126 - DNA, 25 bp, Rattus norvegicus
ggagggacagccactattggccaca

SEQ ID NO: 429127 - DNA, 25 bp, Rattus norvegicus
ggagggacagcctctattggccaca

SEQ ID NO: 429128 - DNA, 25 bp, Rattus norvegicus
ggagggacatcgacagctacgtgct

SEQ ID NO: 429129 - DNA, 25 bp, Rattus norvegicus
ggagggacatcgtcagctacgtgct

SEQ ID NO: 429130 - DNA, 25 bp, Rattus norvegicus
ggagggaccaaccaaagatcacatg

SEQ ID NO: 429131 - DNA, 25 bp, Rattus norvegicus
ggagggaccaacgaaagatcacatg

SEQ ID NO: 429132 - DNA, 25 bp, Rattus norvegicus
ggagggaccccaagtacaacgagta

SEQ ID NO: 429133 - DNA, 25 bp, Rattus norvegicus
ggagggaccccatgtacaacgagta

SEQ ID NO: 429134 - DNA, 25 bp, Rattus norvegicus
ggagggacgactctctcatgcaact

SEQ ID NO: 429135 - DNA, 25 bp, Rattus norvegicus
ggagggacgactgtctcatgcaact

SEQ ID NO: 429136 - DNA, 25 bp, Rattus norvegicus
ggagggactcctcccagagacatgt

SEQ ID NO: 429137 - DNA, 25 bp, Rattus norvegicus
ggagggactcctgccagagacatgt

SEQ ID NO: 429138 - DNA, 25 bp, Rattus norvegicus
ggagggactggaaccacaagcaact

SEQ ID NO: 429139 - DNA, 25 bp, Rattus norvegicus
ggagggactggatccacaagcaact

SEQ ID NO: 429140 - DNA, 25 bp, Rattus norvegicus
ggagggactttcaagccaacactaa

SEQ ID NO: 429141 - DNA, 25 bp, Rattus norvegicus
ggagggactttctagccaacactaa

SEQ ID NO: 429142 - DNA, 25 bp, Rattus norvegicus
ggagggagcacaagccccaatgaca

SEQ ID NO: 429143 - DNA, 25 bp, Rattus norvegicus
ggagggagcacatgccccaatgaca

SEQ ID NO: 429144 - DNA, 25 bp, Rattus norvegicus
ggagggagcattcatccagcctgat

SEQ ID NO: 429145 - DNA, 25 bp, Rattus norvegicus
ggagggagcattgatccagcctgat

SEQ ID NO: 429146 - DNA, 25 bp, Rattus norvegicus
ggagggagccagacttacctggcat

SEQ ID NO: 429147 - DNA, 25 bp, Rattus norvegicus
ggagggagccagtcttacctggcat

SEQ ID NO: 429148 - DNA, 25 bp, Rattus norvegicus
ggagggagccttcgcgtatacccca

SEQ ID NO: 429149 - DNA, 25 bp, Rattus norvegicus
ggagggagccttggcgtatacccca

SEQ ID NO: 429150 - DNA, 25 bp, Rattus norvegicus
ggagggagctctccattgtgaacac

SEQ ID NO: 429151 - DNA, 25 bp, Rattus norvegicus
ggagggagctctgcattgtgaacac

SEQ ID NO: 429152 - DNA, 25 bp, Rattus norvegicus
ggagggagcttgactctttcataga

SEQ ID NO: 429153 - DNA, 25 bp, Rattus norvegicus
ggagggagcttgtctctttcataga

SEQ ID NO: 429154 - DNA, 25 bp, Rattus norvegicus
ggagggaggaccagtaatcccgctc

SEQ ID NO: 429155 - DNA, 25 bp, Rattus norvegicus
ggagggaggacctgtaatcccgctc

SEQ ID NO: 429156 - DNA, 25 bp, Rattus norvegicus
ggagggaggatcatgctgacctcct

SEQ ID NO: 429157 - DNA, 25 bp, Rattus norvegicus
ggagggaggatcttgctgacctcct

SEQ ID NO: 429158 - DNA, 25 bp, Rattus norvegicus
ggagggagtctcacaaacttctctc

SEQ ID NO: 429159 - DNA, 25 bp, Rattus norvegicus
ggagggagtctctcaaacttctctc

SEQ ID NO: 429160 - DNA, 25 bp, Rattus norvegicus
ggagggagtgcccaattccaccgtt

SEQ ID NO: 429161 - DNA, 25 bp, Rattus norvegicus
ggagggagtgccgaattccaccgtt

SEQ ID NO: 429162 - DNA, 25 bp, Rattus norvegicus
ggagggataacaccactatttccag

SEQ ID NO: 429163 - DNA, 25 bp, Rattus norvegicus
ggagggataacagcactatttccag

SEQ ID NO: 429164 - DNA, 25 bp, Rattus norvegicus
ggagggatcactcccctttgatctg

SEQ ID NO: 429165 - DNA, 25 bp, Rattus norvegicus
ggagggatcactgccctttgatctg

SEQ ID NO: 429166 - DNA, 25 bp, Rattus norvegicus
ggagggatcttccagtgacacgcac

SEQ ID NO: 429167 - DNA, 25 bp, Rattus norvegicus
ggagggatcttcgagtgacacgcac

SEQ ID NO: 429168 - DNA, 25 bp, Rattus norvegicus
ggagggatgcaaccagaagctcata

SEQ ID NO: 429169 - DNA, 25 bp, Rattus norvegicus
ggagggatgcaagcagaagctcata

SEQ ID NO: 429170 - DNA, 25 bp, Rattus norvegicus
ggagggatggccatgtaaattccac

SEQ ID NO: 429171 - DNA, 25 bp, Rattus norvegicus
ggagggatggccttgtaaattccac

SEQ ID NO: 429172 - DNA, 25 bp, Rattus norvegicus
ggagggatgttcatggcactcacct

SEQ ID NO: 429173 - DNA, 25 bp, Rattus norvegicus
ggagggatgttcttggcactcacct

SEQ ID NO: 429174 - DNA, 25 bp, Rattus norvegicus
ggagggattctacctccaatctatt

SEQ ID NO: 429175 - DNA, 25 bp, Rattus norvegicus
ggagggattctagctccaatctatt

SEQ ID NO: 429176 - DNA, 25 bp, Rattus norvegicus
ggagggcaaccccatcctgcgtgac

SEQ ID NO: 429177 - DNA, 25 bp, Rattus norvegicus
ggagggcaacccgatcctgcgtgac

SEQ ID NO: 429178 - DNA, 25 bp, Rattus norvegicus
ggagggcaattcagggcccttctga

SEQ ID NO: 429179 - DNA, 25 bp, Rattus norvegicus
ggagggcaattctgggcccttctga

SEQ ID NO: 429180 - DNA, 25 bp, Rattus norvegicus
ggagggcagagacccagactactca

SEQ ID NO: 429181 - DNA, 25 bp, Rattus norvegicus
ggagggcagagagccagactactca

SEQ ID NO: 429182 - DNA, 25 bp, Rattus norvegicus
ggagggcagatccaactcatctgac

SEQ ID NO: 429183 - DNA, 25 bp, Rattus norvegicus
ggagggcagatcgaactcatctgac

SEQ ID NO: 429184 - DNA, 25 bp, Rattus norvegicus
ggagggcagttaactagacctgaaa

SEQ ID NO: 429185 - DNA, 25 bp, Rattus norvegicus
ggagggcagttatctagacctgaaa

SEQ ID NO: 429186 - DNA, 25 bp, Rattus norvegicus
ggagggccaaagacattcactaaag

SEQ ID NO: 429187 - DNA, 25 bp, Rattus norvegicus
ggagggccaaagtcattcactaaag

SEQ ID NO: 429188 - DNA, 25 bp, Rattus norvegicus
ggagggccatctatccaagcgatca

SEQ ID NO: 429189 - DNA, 25 bp, Rattus norvegicus
ggagggccatctttccaagcgatca

SEQ ID NO: 429190 - DNA, 25 bp, Rattus norvegicus
ggagggccatggaactcccagagtt

SEQ ID NO: 429191 - DNA, 25 bp, Rattus norvegicus
ggagggccatggtactcccagagtt

SEQ ID NO: 429192 - DNA, 25 bp, Rattus norvegicus
ggagggcccaatcgcctcaatgagc

SEQ ID NO: 429193 - DNA, 25 bp, Rattus norvegicus
ggagggcccaatggcctcaatgagc

SEQ ID NO: 429194 - DNA, 25 bp, Rattus norvegicus
ggagggccgaatcgcaaattctcga

SEQ ID NO: 429195 - DNA, 25 bp, Rattus norvegicus
ggagggccgaatggcaaattctcga

SEQ ID NO: 429196 - DNA, 25 bp, Rattus norvegicus
ggagggcctgacacagttctctgta

SEQ ID NO: 429197 - DNA, 25 bp, Rattus norvegicus
ggagggcctgactcagttctctgta

SEQ ID NO: 429198 - DNA, 25 bp, Rattus norvegicus
ggagggcctgagacccgtgcctttc

SEQ ID NO: 429199 - DNA, 25 bp, Rattus norvegicus
ggagggcctgagtcccgtgcctttc

SEQ ID NO: 429200 - DNA, 25 bp, Rattus norvegicus
ggagggcgacgtaccatgtatttca

SEQ ID NO: 429201 - DNA, 25 bp, Rattus norvegicus
ggagggcgacgttccatgtatttca

SEQ ID NO: 429202 - DNA, 25 bp, Rattus norvegicus
ggagggcgcgcgcacgccggcgggt

SEQ ID NO: 429203 - DNA, 25 bp, Rattus norvegicus
ggagggcgcgcggacgccggcgggt

SEQ ID NO: 429204 - DNA, 25 bp, Rattus norvegicus
ggagggctaccgcaagctcattgac

SEQ ID NO: 429205 - DNA, 25 bp, Rattus norvegicus
ggagggctaccggaagctcattgac

SEQ ID NO: 429206 - DNA, 25 bp, Rattus norvegicus
ggagggctcaaacagctaccactaa

SEQ ID NO: 429207 - DNA, 25 bp, Rattus norvegicus
ggagggctcaaagagctaccactaa

SEQ ID NO: 429208 - DNA, 25 bp, Rattus norvegicus
ggagggctcatcatttctgccttta

SEQ ID NO: 429209 - DNA, 25 bp, Rattus norvegicus
ggagggctcatcttttctgccttta

SEQ ID NO: 429210 - DNA, 25 bp, Rattus norvegicus
ggagggctctggagccacagaccaa

SEQ ID NO: 429211 - DNA, 25 bp, Rattus norvegicus
ggagggctctggtgccacagaccaa

SEQ ID NO: 429212 - DNA, 25 bp, Rattus norvegicus
ggagggctgcctagaattgataatt

SEQ ID NO: 429213 - DNA, 25 bp, Rattus norvegicus
ggagggctgccttgaattgataatt

SEQ ID NO: 429214 - DNA, 25 bp, Rattus norvegicus
ggagggcttgttatactgacataca

SEQ ID NO: 429215 - DNA, 25 bp, Rattus norvegicus
ggagggcttgttttactgacataca

SEQ ID NO: 429216 - DNA, 25 bp, Rattus norvegicus
ggaggggaacacatgtctcttccta

SEQ ID NO: 429217 - DNA, 25 bp, Rattus norvegicus
ggaggggaacacttgtctcttccta

SEQ ID NO: 429218 - DNA, 25 bp, Rattus norvegicus
ggagggtaccacagtgcagtctctg

SEQ ID NO: 429219 - DNA, 25 bp, Rattus norvegicus
ggagggtaccactgtgcagtctctg

SEQ ID NO: 429220 - DNA, 25 bp, Rattus norvegicus
ggagggtaccttctgtcaggcttca

SEQ ID NO: 429221 - DNA, 25 bp, Rattus norvegicus
ggagggtaccttgtgtcaggcttca

SEQ ID NO: 429222 - DNA, 25 bp, Rattus norvegicus
ggagggtactgtctctaatgtatat

SEQ ID NO: 429223 - DNA, 25 bp, Rattus norvegicus
ggagggtactgtgtctaatgtatat

SEQ ID NO: 429224 - DNA, 25 bp, Rattus norvegicus
ggagggtatctgaagctctccacca

SEQ ID NO: 429225 - DNA, 25 bp, Rattus norvegicus
ggagggtatctgtagctctccacca

SEQ ID NO: 429226 - DNA, 25 bp, Rattus norvegicus
ggagggtatgatccttactgtgcaa

SEQ ID NO: 429227 - DNA, 25 bp, Rattus norvegicus
ggagggtatgatgcttactgtgcaa

SEQ ID NO: 429228 - DNA, 25 bp, Rattus norvegicus
ggagggtcacaacctcaagttcaaa

SEQ ID NO: 429229 - DNA, 25 bp, Rattus norvegicus
ggagggtcacaagctcaagttcaaa

SEQ ID NO: 429230 - DNA, 25 bp, Rattus norvegicus
ggagggtcactgcactgttgtaatt

SEQ ID NO: 429231 - DNA, 25 bp, Rattus norvegicus
ggagggtcactggactgttgtaatt

SEQ ID NO: 429232 - DNA, 25 bp, Rattus norvegicus
ggagggtcaggaattcacaactaca

SEQ ID NO: 429233 - DNA, 25 bp, Rattus norvegicus
ggagggtcaggatttcacaactaca

SEQ ID NO: 429234 - DNA, 25 bp, Rattus norvegicus
ggagggtccactcggtctttactgc

SEQ ID NO: 429235 - DNA, 25 bp, Rattus norvegicus
ggagggtccactgggtctttactgc

SEQ ID NO: 429236 - DNA, 25 bp, Rattus norvegicus
ggagggtcctaacgttacctcagca

SEQ ID NO: 429237 - DNA, 25 bp, Rattus norvegicus
ggagggtcctaaggttacctcagca

SEQ ID NO: 429238 - DNA, 25 bp, Rattus norvegicus
ggagggtctcccaccaaggaaatag

SEQ ID NO: 429239 - DNA, 25 bp, Rattus norvegicus
ggagggtctccctccaaggaaatag

SEQ ID NO: 429240 - DNA, 25 bp, Rattus norvegicus
ggagggtctcctaatttttcatgat

SEQ ID NO: 429241 - DNA, 25 bp, Rattus norvegicus
ggagggtctccttatttttcatgat

SEQ ID NO: 429242 - DNA, 25 bp, Rattus norvegicus
ggagggtctgcacggaattgaggga

SEQ ID NO: 429243 - DNA, 25 bp, Rattus norvegicus
ggagggtctgcagggaattgaggga

SEQ ID NO: 429244 - DNA, 25 bp, Rattus norvegicus
ggagggtcttatatcacatttgtat

SEQ ID NO: 429245 - DNA, 25 bp, Rattus norvegicus
ggagggtcttatttcacatttgtat

SEQ ID NO: 429246 - DNA, 25 bp, Rattus norvegicus
ggagggtcttgcactgaactctcta

SEQ ID NO: 429247 - DNA, 25 bp, Rattus norvegicus
ggagggtcttgctctgaactctcta

SEQ ID NO: 429248 - DNA, 25 bp, Rattus norvegicus
ggagggtgacctcattccgccacct

SEQ ID NO: 429249 - DNA, 25 bp, Rattus norvegicus
ggagggtgacctgattccgccacct

SEQ ID NO: 429250 - DNA, 25 bp, Rattus norvegicus
ggagggtgccagcaactccaagcta

SEQ ID NO: 429251 - DNA, 25 bp, Rattus norvegicus
ggagggtgccaggaactccaagcta

SEQ ID NO: 429252 - DNA, 25 bp, Rattus norvegicus
ggagggtgccatcaatccagtcatt

SEQ ID NO: 429253 - DNA, 25 bp, Rattus norvegicus
ggagggtgccatgaatccagtcatt

SEQ ID NO: 429254 - DNA, 25 bp, Rattus norvegicus
ggagggtgctacatgacccactgga

SEQ ID NO: 429255 - DNA, 25 bp, Rattus norvegicus
ggagggtgctacttgacccactgga

SEQ ID NO: 429256 - DNA, 25 bp, Rattus norvegicus
ggagggtgctccagctgcattttca

SEQ ID NO: 429257 - DNA, 25 bp, Rattus norvegicus
ggagggtgctcctgctgcattttca

SEQ ID NO: 429258 - DNA, 25 bp, Rattus norvegicus
ggagggtggactaggccttattcct

SEQ ID NO: 429259 - DNA, 25 bp, Rattus norvegicus
ggagggtggacttggccttattcct

SEQ ID NO: 429260 - DNA, 25 bp, Rattus norvegicus
ggagggtgtaatcacttctcagtgt

SEQ ID NO: 429261 - DNA, 25 bp, Rattus norvegicus
ggagggtgtaatgacttctcagtgt

SEQ ID NO: 429262 - DNA, 25 bp, Rattus norvegicus
ggagggtgtgttctctatcctagac

SEQ ID NO: 429263 - DNA, 25 bp, Rattus norvegicus
ggagggtgtgttgtctatcctagac

SEQ ID NO: 429264 - DNA, 25 bp, Rattus norvegicus
ggagggtttcttatctatctatgca

SEQ ID NO: 429265 - DNA, 25 bp, Rattus norvegicus
ggagggtttcttttctatctatgca

SEQ ID NO: 429266 - DNA, 25 bp, Rattus norvegicus
ggaggtaaaggcctctacctgccac

SEQ ID NO: 429267 - DNA, 25 bp, Rattus norvegicus
ggaggtaaaggcgtctacctgccac

SEQ ID NO: 429268 - DNA, 25 bp, Rattus norvegicus
ggaggtaacccaaagtagcacacac

SEQ ID NO: 429269 - DNA, 25 bp, Rattus norvegicus
ggaggtaacccatagtagcacacac

SEQ ID NO: 429270 - DNA, 25 bp, Rattus norvegicus
ggaggtaacctcattcgtttgttct

SEQ ID NO: 429271 - DNA, 25 bp, Rattus norvegicus
ggaggtaacctctttcgtttgttct

SEQ ID NO: 429272 - DNA, 25 bp, Rattus norvegicus
ggaggtaactcacaggacagacaca

SEQ ID NO: 429273 - DNA, 25 bp, Rattus norvegicus
ggaggtaactcagaggacagacaca

SEQ ID NO: 429274 - DNA, 25 bp, Rattus norvegicus
ggaggtaagctgaccgatattaaat

SEQ ID NO: 429275 - DNA, 25 bp, Rattus norvegicus
ggaggtaagctgtccgatattaaat

SEQ ID NO: 429276 - DNA, 25 bp, Rattus norvegicus
ggaggtaattatacttgcctacact

SEQ ID NO: 429277 - DNA, 25 bp, Rattus norvegicus
ggaggtaattattcttgcctacact

SEQ ID NO: 429278 - DNA, 25 bp, Rattus norvegicus
ggaggtacactccttgcatttttgt

SEQ ID NO: 429279 - DNA, 25 bp, Rattus norvegicus
ggaggtacactcgttgcatttttgt

SEQ ID NO: 429280 - DNA, 25 bp, Rattus norvegicus
ggaggtacatgccattcacattgaa

SEQ ID NO: 429281 - DNA, 25 bp, Rattus norvegicus
ggaggtacatgcgattcacattgaa

SEQ ID NO: 429282 - DNA, 25 bp, Rattus norvegicus
ggaggtaccaacagtcactctgccg

SEQ ID NO: 429283 - DNA, 25 bp, Rattus norvegicus
ggaggtaccaactgtcactctgccg

SEQ ID NO: 429284 - DNA, 25 bp, Rattus norvegicus
ggaggtacccacagccatggttgag

SEQ ID NO: 429285 - DNA, 25 bp, Rattus norvegicus
ggaggtacccactgccatggttgag

SEQ ID NO: 429286 - DNA, 25 bp, Rattus norvegicus
ggaggtacgcataccttgacctaaa

SEQ ID NO: 429287 - DNA, 25 bp, Rattus norvegicus
ggaggtacgcattccttgacctaaa

SEQ ID NO: 429288 - DNA, 25 bp, Rattus norvegicus
ggaggtactgcaagtatcttccaca

SEQ ID NO: 429289 - DNA, 25 bp, Rattus norvegicus
ggaggtactgcatgtatcttccaca

SEQ ID NO: 429290 - DNA, 25 bp, Rattus norvegicus
ggaggtactggaacactgccgcatg

SEQ ID NO: 429291 - DNA, 25 bp, Rattus norvegicus
ggaggtactggatcactgccgcatg

SEQ ID NO: 429292 - DNA, 25 bp, Rattus norvegicus
ggaggtagaatcagtctctgcttct

SEQ ID NO: 429293 - DNA, 25 bp, Rattus norvegicus
ggaggtagaatctgtctctgcttct

SEQ ID NO: 429294 - DNA, 25 bp, Rattus norvegicus
ggaggtagcaatacctgtggttatt

SEQ ID NO: 429295 - DNA, 25 bp, Rattus norvegicus
ggaggtagcaattcctgtggttatt

SEQ ID NO: 429296 - DNA, 25 bp, Rattus norvegicus
ggaggtagtataacagccgtactgt

SEQ ID NO: 429297 - DNA, 25 bp, Rattus norvegicus
ggaggtagtatatcagccgtactgt

SEQ ID NO: 429298 - DNA, 25 bp, Rattus norvegicus
ggaggtatactcatctacacgtgtg

SEQ ID NO: 429299 - DNA, 25 bp, Rattus norvegicus
ggaggtatactcttctacacgtgtg

SEQ ID NO: 429300 - DNA, 25 bp, Rattus norvegicus
ggaggtatatccagggttgccgtcc

SEQ ID NO: 429301 - DNA, 25 bp, Rattus norvegicus
ggaggtatatcctgggttgccgtcc

SEQ ID NO: 429302 - DNA, 25 bp, Rattus norvegicus
ggaggtatcactatctatcatttgt

SEQ ID NO: 429303 - DNA, 25 bp, Rattus norvegicus
ggaggtatcactttctatcatttgt

SEQ ID NO: 429304 - DNA, 25 bp, Rattus norvegicus
ggaggtatctgccttcccatactgc

SEQ ID NO: 429305 - DNA, 25 bp, Rattus norvegicus
ggaggtatctgcgttcccatactgc

SEQ ID NO: 429306 - DNA, 25 bp, Rattus norvegicus
ggaggtatcttgcatctgattgcaa

SEQ ID NO: 429307 - DNA, 25 bp, Rattus norvegicus
ggaggtatcttggatctgattgcaa

SEQ ID NO: 429308 - DNA, 25 bp, Rattus norvegicus
ggaggtatggttacatttcaccaaa

SEQ ID NO: 429309 - DNA, 25 bp, Rattus norvegicus
ggaggtatggtttcatttcaccaaa

SEQ ID NO: 429310 - DNA, 25 bp, Rattus norvegicus
ggaggtattcaaccattcatcttta

SEQ ID NO: 429311 - DNA, 25 bp, Rattus norvegicus
ggaggtattcaagcattcatcttta

SEQ ID NO: 429312 - DNA, 25 bp, Rattus norvegicus
ggaggtatttgcagctcatgccggc

SEQ ID NO: 429313 - DNA, 25 bp, Rattus norvegicus
ggaggtatttgctgctcatgccggc

SEQ ID NO: 429314 - DNA, 25 bp, Rattus norvegicus
ggaggtcaagccagggacagcccaa

SEQ ID NO: 429315 - DNA, 25 bp, Rattus norvegicus
ggaggtcaagcctgggacagcccaa

SEQ ID NO: 429316 - DNA, 25 bp, Rattus norvegicus
ggaggtcaatctaggtgaacaaaca

SEQ ID NO: 429317 - DNA, 25 bp, Rattus norvegicus
ggaggtcaatcttggtgaacaaaca

SEQ ID NO: 429318 - DNA, 25 bp, Rattus norvegicus
ggaggtcaattcctgtgggtacatc

SEQ ID NO: 429319 - DNA, 25 bp, Rattus norvegicus
ggaggtcaattcgtgtgggtacatc

SEQ ID NO: 429320 - DNA, 25 bp, Rattus norvegicus
ggaggtcacaaacgccatttccagg

SEQ ID NO: 429321 - DNA, 25 bp, Rattus norvegicus
ggaggtcacaaaggccatttccagg

SEQ ID NO: 429322 - DNA, 25 bp, Rattus norvegicus
ggaggtcacatcagtggcagacgct

SEQ ID NO: 429323 - DNA, 25 bp, Rattus norvegicus
ggaggtcacatctgtggcagacgct

SEQ ID NO: 429324 - DNA, 25 bp, Rattus norvegicus
ggaggtcaccaaagttacttgtaca

SEQ ID NO: 429325 - DNA, 25 bp, Rattus norvegicus
ggaggtcaccaatgttacttgtaca

SEQ ID NO: 429326 - DNA, 25 bp, Rattus norvegicus
ggaggtcaccctcaatccaaaggag

SEQ ID NO: 429327 - DNA, 25 bp, Rattus norvegicus
ggaggtcaccctgaatccaaaggag

SEQ ID NO: 429328 - DNA, 25 bp, Rattus norvegicus
ggaggtcactggctcattctgaagt

SEQ ID NO: 429329 - DNA, 25 bp, Rattus norvegicus
ggaggtcactgggtcattctgaagt

SEQ ID NO: 429330 - DNA, 25 bp, Rattus norvegicus
ggaggtcagagtagacccgaccctg

SEQ ID NO: 429331 - DNA, 25 bp, Rattus norvegicus
ggaggtcagagttgacccgaccctg

SEQ ID NO: 429332 - DNA, 25 bp, Rattus norvegicus
ggaggtcagcacctaaataccacag

SEQ ID NO: 429333 - DNA, 25 bp, Rattus norvegicus
ggaggtcagcacgtaaataccacag

SEQ ID NO: 429334 - DNA, 25 bp, Rattus norvegicus
ggaggtcagggcacactcaaaagcc

SEQ ID NO: 429335 - DNA, 25 bp, Rattus norvegicus
ggaggtcagggctcactcaaaagcc

SEQ ID NO: 429336 - DNA, 25 bp, Rattus norvegicus
ggaggtcagtgcatacacactcgtg

SEQ ID NO: 429337 - DNA, 25 bp, Rattus norvegicus
ggaggtcagtgcttacacactcgtg

SEQ ID NO: 429338 - DNA, 25 bp, Rattus norvegicus
ggaggtcatgcaaagccaggtatga

SEQ ID NO: 429339 - DNA, 25 bp, Rattus norvegicus
ggaggtcatgcatagccaggtatga

SEQ ID NO: 429340 - DNA, 25 bp, Rattus norvegicus
ggaggtcatggaccatcggttcttc

SEQ ID NO: 429341 - DNA, 25 bp, Rattus norvegicus
ggaggtcatggagcatcggttcttc

SEQ ID NO: 429342 - DNA, 25 bp, Rattus norvegicus
ggaggtcatttcattcatcccaatc

SEQ ID NO: 429343 - DNA, 25 bp, Rattus norvegicus
ggaggtcatttctttcatcccaatc

SEQ ID NO: 429344 - DNA, 25 bp, Rattus norvegicus
ggaggtccaccactgactgaactgg

SEQ ID NO: 429345 - DNA, 25 bp, Rattus norvegicus
ggaggtccaccagtgactgaactgg

SEQ ID NO: 429346 - DNA, 25 bp, Rattus norvegicus
ggaggtccagatcgagccttaccac

SEQ ID NO: 429347 - DNA, 25 bp, Rattus norvegicus
ggaggtccagatggagccttaccac

SEQ ID NO: 429348 - DNA, 25 bp, Rattus norvegicus
ggaggtccagccatcttgcgaaagc

SEQ ID NO: 429349 - DNA, 25 bp, Rattus norvegicus
ggaggtccagccttcttgcgaaagc

SEQ ID NO: 429350 - DNA, 25 bp, Rattus norvegicus
ggaggtccaggccaagcatatatca

SEQ ID NO: 429351 - DNA, 25 bp, Rattus norvegicus
ggaggtccaggcgaagcatatatca

SEQ ID NO: 429352 - DNA, 25 bp, Rattus norvegicus
ggaggtccagtaattcttcaagatc

SEQ ID NO: 429353 - DNA, 25 bp, Rattus norvegicus
ggaggtccagtatttcttcaagatc

SEQ ID NO: 429354 - DNA, 25 bp, Rattus norvegicus
ggaggtccatctacaataaacttca

SEQ ID NO: 429355 - DNA, 25 bp, Rattus norvegicus
ggaggtccatcttcaataaacttca

SEQ ID NO: 429356 - DNA, 25 bp, Rattus norvegicus
ggaggtcccaaacgatttccatcaa

SEQ ID NO: 429357 - DNA, 25 bp, Rattus norvegicus
ggaggtcccaaaggatttccatcaa

SEQ ID NO: 429358 - DNA, 25 bp, Rattus norvegicus
ggaggtcccaacagtgtcatactgt

SEQ ID NO: 429359 - DNA, 25 bp, Rattus norvegicus
ggaggtcccaactgtgtcatactgt

SEQ ID NO: 429360 - DNA, 25 bp, Rattus norvegicus
ggaggtcccagccttcaagatactt

SEQ ID NO: 429361 - DNA, 25 bp, Rattus norvegicus
ggaggtcccagcgttcaagatactt

SEQ ID NO: 429362 - DNA, 25 bp, Rattus norvegicus
ggaggtcccctcattcccagtagtg

SEQ ID NO: 429363 - DNA, 25 bp, Rattus norvegicus
ggaggtcccctctttcccagtagtg

SEQ ID NO: 429364 - DNA, 25 bp, Rattus norvegicus
ggaggtccctcaagccaagggatgt

SEQ ID NO: 429365 - DNA, 25 bp, Rattus norvegicus
ggaggtccctcatgccaagggatgt

SEQ ID NO: 429366 - DNA, 25 bp, Rattus norvegicus
ggaggtccggctcgctgcccacttt

SEQ ID NO: 429367 - DNA, 25 bp, Rattus norvegicus
ggaggtccggctggctgcccacttt

SEQ ID NO: 429368 - DNA, 25 bp, Rattus norvegicus
ggaggtcctcagatgatccagctca

SEQ ID NO: 429369 - DNA, 25 bp, Rattus norvegicus
ggaggtcctcagttgatccagctca

SEQ ID NO: 429370 - DNA, 25 bp, Rattus norvegicus
ggaggtcctctcagtacgggttatc

SEQ ID NO: 429371 - DNA, 25 bp, Rattus norvegicus
ggaggtcctctctgtacgggttatc

SEQ ID NO: 429372 - DNA, 25 bp, Rattus norvegicus
ggaggtccttcaaggaagcccatta

SEQ ID NO: 429373 - DNA, 25 bp, Rattus norvegicus
ggaggtccttcatggaagcccatta

SEQ ID NO: 429374 - DNA, 25 bp, Rattus norvegicus
ggaggtcgaagtaacacacaaatgt

SEQ ID NO: 429375 - DNA, 25 bp, Rattus norvegicus
ggaggtcgaagttacacacaaatgt

SEQ ID NO: 429376 - DNA, 25 bp, Rattus norvegicus
ggaggtcgacgaccgactttgaccc

SEQ ID NO: 429377 - DNA, 25 bp, Rattus norvegicus
ggaggtcgacgagcgactttgaccc

SEQ ID NO: 429378 - DNA, 25 bp, Rattus norvegicus
ggaggtcgcgtacctgaaaatgtac

SEQ ID NO: 429379 - DNA, 25 bp, Rattus norvegicus
ggaggtcgcgtagctgaaaatgtac

SEQ ID NO: 429380 - DNA, 25 bp, Rattus norvegicus
ggaggtcgctttcttatgatacaaa

SEQ ID NO: 429381 - DNA, 25 bp, Rattus norvegicus
ggaggtcgctttgttatgatacaaa

SEQ ID NO: 429382 - DNA, 25 bp, Rattus norvegicus
ggaggtcggcatagactaccactca

SEQ ID NO: 429383 - DNA, 25 bp, Rattus norvegicus
ggaggtcggcattgactaccactca

SEQ ID NO: 429384 - DNA, 25 bp, Rattus norvegicus
ggaggtcgtctcaatgtatcaaagc

SEQ ID NO: 429385 - DNA, 25 bp, Rattus norvegicus
ggaggtcgtctctatgtatcaaagc

SEQ ID NO: 429386 - DNA, 25 bp, Rattus norvegicus
ggaggtctatcacatgccgctgtgc

SEQ ID NO: 429387 - DNA, 25 bp, Rattus norvegicus
ggaggtctatcagatgccgctgtgc

SEQ ID NO: 429388 - DNA, 25 bp, Rattus norvegicus
ggaggtctccaaactttaccaagct

SEQ ID NO: 429389 - DNA, 25 bp, Rattus norvegicus
ggaggtctccaatctttaccaagct

SEQ ID NO: 429390 - DNA, 25 bp, Rattus norvegicus
ggaggtctccgacagtttgtcgaca

SEQ ID NO: 429391 - DNA, 25 bp, Rattus norvegicus
ggaggtctccgagagtttgtcgaca

SEQ ID NO: 429392 - DNA, 25 bp, Rattus norvegicus
ggaggtctcctaccaaattcagtca

SEQ ID NO: 429393 - DNA, 25 bp, Rattus norvegicus
ggaggtctcctagcaaattcagtca

SEQ ID NO: 429394 - DNA, 25 bp, Rattus norvegicus
ggaggtctcctcataccctgattat

SEQ ID NO: 429395 - DNA, 25 bp, Rattus norvegicus
ggaggtctcctcttaccctgattat

SEQ ID NO: 429396 - DNA, 25 bp, Rattus norvegicus
ggaggtctcctgaatcaaagtggat

SEQ ID NO: 429397 - DNA, 25 bp, Rattus norvegicus
ggaggtctcctgtatcaaagtggat

SEQ ID NO: 429398 - DNA, 25 bp, Rattus norvegicus
ggaggtctctaaagttcagtgttca

SEQ ID NO: 429399 - DNA, 25 bp, Rattus norvegicus
ggaggtctctaatgttcagtgttca

SEQ ID NO: 429400 - DNA, 25 bp, Rattus norvegicus
ggaggtctctccacagggtcagatc

SEQ ID NO: 429401 - DNA, 25 bp, Rattus norvegicus
ggaggtctctcctcagggtcagatc

SEQ ID NO: 429402 - DNA, 25 bp, Rattus norvegicus
ggaggtctgaggctctatcccacag

SEQ ID NO: 429403 - DNA, 25 bp, Rattus norvegicus
ggaggtctgagggtctatcccacag

SEQ ID NO: 429404 - DNA, 25 bp, Rattus norvegicus
ggaggtctgctgatactggctctca

SEQ ID NO: 429405 - DNA, 25 bp, Rattus norvegicus
ggaggtctgctgttactggctctca

SEQ ID NO: 429406 - DNA, 25 bp, Rattus norvegicus
ggaggtctgggtcggccctagagga

SEQ ID NO: 429407 - DNA, 25 bp, Rattus norvegicus
ggaggtctgggtgggccctagagga

SEQ ID NO: 429408 - DNA, 25 bp, Rattus norvegicus
ggaggtcttccccagcgagcagatt

SEQ ID NO: 429409 - DNA, 25 bp, Rattus norvegicus
ggaggtcttcccgagcgagcagatt

SEQ ID NO: 429410 - DNA, 25 bp, Rattus norvegicus
ggaggtcttttcatgtaaccgcctg

SEQ ID NO: 429411 - DNA, 25 bp, Rattus norvegicus
ggaggtcttttcttgtaaccgcctg

SEQ ID NO: 429412 - DNA, 25 bp, Rattus norvegicus
ggaggtgaacaaccgcatcatcgag

SEQ ID NO: 429413 - DNA, 25 bp, Rattus norvegicus
ggaggtgaacaagcgcatcatcgag

SEQ ID NO: 429414 - DNA, 25 bp, Rattus norvegicus
ggaggtgaagccctgtgtcatctac

SEQ ID NO: 429415 - DNA, 25 bp, Rattus norvegicus
ggaggtgaagccgtgtgtcatctac

SEQ ID NO: 429416 - DNA, 25 bp, Rattus norvegicus
ggaggtgacagcatacagccccttg

SEQ ID NO: 429417 - DNA, 25 bp, Rattus norvegicus
ggaggtgacagcttacagccccttg

SEQ ID NO: 429418 - DNA, 25 bp, Rattus norvegicus
ggaggtgacatcaccaccagtttaa

SEQ ID NO: 429419 - DNA, 25 bp, Rattus norvegicus
ggaggtgacatctccaccagtttaa

SEQ ID NO: 429420 - DNA, 25 bp, Rattus norvegicus
ggaggtgaccctcagagcctctaca

SEQ ID NO: 429421 - DNA, 25 bp, Rattus norvegicus
ggaggtgaccctgagagcctctaca

SEQ ID NO: 429422 - DNA, 25 bp, Rattus norvegicus
ggaggtgacctacaatcccaagact

SEQ ID NO: 429423 - DNA, 25 bp, Rattus norvegicus
ggaggtgacctagaatcccaagact

SEQ ID NO: 429424 - DNA, 25 bp, Rattus norvegicus
ggaggtgacgcacaaataccaggaa

SEQ ID NO: 429425 - DNA, 25 bp, Rattus norvegicus
ggaggtgacgcagaaataccaggaa

SEQ ID NO: 429426 - DNA, 25 bp, Rattus norvegicus
ggaggtgactcgcactttcacacac

SEQ ID NO: 429427 - DNA, 25 bp, Rattus norvegicus
ggaggtgactcggactttcacacac

SEQ ID NO: 429428 - DNA, 25 bp, Rattus norvegicus
ggaggtgagctaataacttgttttt

SEQ ID NO: 429429 - DNA, 25 bp, Rattus norvegicus
ggaggtgagctattaacttgttttt

SEQ ID NO: 429430 - DNA, 25 bp, Rattus norvegicus
ggaggtgaggccaaagtcgaacttc

SEQ ID NO: 429431 - DNA, 25 bp, Rattus norvegicus
ggaggtgaggcctaagtcgaacttc

SEQ ID NO: 429432 - DNA, 25 bp, Rattus norvegicus
ggaggtgatccaagcgttctcggcc

SEQ ID NO: 429433 - DNA, 25 bp, Rattus norvegicus
ggaggtgatccatgcgttctcggcc

SEQ ID NO: 429434 - DNA, 25 bp, Rattus norvegicus
ggaggtgatcttatccctatgtcag

SEQ ID NO: 429435 - DNA, 25 bp, Rattus norvegicus
ggaggtgatcttttccctatgtcag

SEQ ID NO: 429436 - DNA, 25 bp, Rattus norvegicus
ggaggtgatggacactaatcaagtt

SEQ ID NO: 429437 - DNA, 25 bp, Rattus norvegicus
ggaggtgatggagactaatcaagtt

SEQ ID NO: 429438 - DNA, 25 bp, Rattus norvegicus
ggaggtgcagacagcgttttcccac

SEQ ID NO: 429439 - DNA, 25 bp, Rattus norvegicus
ggaggtgcagactgcgttttcccac

SEQ ID NO: 429440 - DNA, 25 bp, Rattus norvegicus
ggaggtgccatcaaatgtcttgcat

SEQ ID NO: 429441 - DNA, 25 bp, Rattus norvegicus
ggaggtgccatctaatgtcttgcat

SEQ ID NO: 429442 - DNA, 25 bp, Rattus norvegicus
ggaggtgccatgaatgtccccatta

SEQ ID NO: 429443 - DNA, 25 bp, Rattus norvegicus
ggaggtgccatgtatgtccccatta

SEQ ID NO: 429444 - DNA, 25 bp, Rattus norvegicus
ggaggtgcccaccatgctgagattc

SEQ ID NO: 429445 - DNA, 25 bp, Rattus norvegicus
ggaggtgcccacgatgctgagattc

SEQ ID NO: 429446 - DNA, 25 bp, Rattus norvegicus
ggaggtgcccgtcacagtgctgaat

SEQ ID NO: 429447 - DNA, 25 bp, Rattus norvegicus
ggaggtgcccgtgacagtgctgaat

SEQ ID NO: 429448 - DNA, 25 bp, Rattus norvegicus
ggaggtgccctgcaagtcattgcct

SEQ ID NO: 429449 - DNA, 25 bp, Rattus norvegicus
ggaggtgccctggaagtcattgcct

SEQ ID NO: 429450 - DNA, 25 bp, Rattus norvegicus
ggaggtgcctgacgattcccactgc

SEQ ID NO: 429451 - DNA, 25 bp, Rattus norvegicus
ggaggtgcctgaggattcccactgc

SEQ ID NO: 429452 - DNA, 25 bp, Rattus norvegicus
ggaggtgcgagtacctcagtgacca

SEQ ID NO: 429453 - DNA, 25 bp, Rattus norvegicus
ggaggtgcgagttcctcagtgacca

SEQ ID NO: 429454 - DNA, 25 bp, Rattus norvegicus
ggaggtgcgcaaaccactgtttgac

SEQ ID NO: 429455 - DNA, 25 bp, Rattus norvegicus
ggaggtgcgcaatccactgtttgac

SEQ ID NO: 429456 - DNA, 25 bp, Rattus norvegicus
ggaggtgcgctgactcctgcaaaga

SEQ ID NO: 429457 - DNA, 25 bp, Rattus norvegicus
ggaggtgcgctgtctcctgcaaaga

SEQ ID NO: 429458 - DNA, 25 bp, Rattus norvegicus
ggaggtgctgcacataccactcgca

SEQ ID NO: 429459 - DNA, 25 bp, Rattus norvegicus
ggaggtgctgcacgtctaaccatgc

SEQ ID NO: 429460 - DNA, 25 bp, Rattus norvegicus
ggaggtgctgcagataccactcgca

SEQ ID NO: 429461 - DNA, 25 bp, Rattus norvegicus
ggaggtgctgcaggtctaaccatgc

SEQ ID NO: 429462 - DNA, 25 bp, Rattus norvegicus
ggaggtgctgtgactgctaaaccag

SEQ ID NO: 429463 - DNA, 25 bp, Rattus norvegicus
ggaggtgctgtgtctgctaaaccag

SEQ ID NO: 429464 - DNA, 25 bp, Rattus norvegicus
ggaggtggaccaacgcagcaagatt

SEQ ID NO: 429465 - DNA, 25 bp, Rattus norvegicus
ggaggtggaccatcgcagcaagatt

SEQ ID NO: 429466 - DNA, 25 bp, Rattus norvegicus
ggaggtggtcgcatgaacacttctg

SEQ ID NO: 429467 - DNA, 25 bp, Rattus norvegicus
ggaggtggtcgcttgaacacttctg

SEQ ID NO: 429468 - DNA, 25 bp, Rattus norvegicus
ggaggtggtctaagacctttccatc

SEQ ID NO: 429469 - DNA, 25 bp, Rattus norvegicus
ggaggtggtctatgacctttccatc

SEQ ID NO: 429470 - DNA, 25 bp, Rattus norvegicus
ggaggtggtgacagatctgcttaaa

SEQ ID NO: 429471 - DNA, 25 bp, Rattus norvegicus
ggaggtggtgactgatctgcttaaa

SEQ ID NO: 429472 - DNA, 25 bp, Rattus norvegicus
ggaggtgtacaacgctttcctgaac

SEQ ID NO: 429473 - DNA, 25 bp, Rattus norvegicus
ggaggtgtacaaggctttcctgaac

SEQ ID NO: 429474 - DNA, 25 bp, Rattus norvegicus
ggaggtgtcaatcatcatggccaac

SEQ ID NO: 429475 - DNA, 25 bp, Rattus norvegicus
ggaggtgtcaatgatcatggccaac

SEQ ID NO: 429476 - DNA, 25 bp, Rattus norvegicus
ggaggtgtcagtcttcgcccatagc

SEQ ID NO: 429477 - DNA, 25 bp, Rattus norvegicus
ggaggtgtcagtgttcgcccatagc

SEQ ID NO: 429478 - DNA, 25 bp, Rattus norvegicus
ggaggtgtcattcactatgataact

SEQ ID NO: 429479 - DNA, 25 bp, Rattus norvegicus
ggaggtgtcattgactatgataact

SEQ ID NO: 429480 - DNA, 25 bp, Rattus norvegicus
ggaggtgtccctaatggttcagctc

SEQ ID NO: 429481 - DNA, 25 bp, Rattus norvegicus
ggaggtgtcccttatggttcagctc

SEQ ID NO: 429482 - DNA, 25 bp, Rattus norvegicus
ggaggtgtcctactttaaatcagaa

SEQ ID NO: 429483 - DNA, 25 bp, Rattus norvegicus
ggaggtgtcctagtttaaatcagaa

SEQ ID NO: 429484 - DNA, 25 bp, Rattus norvegicus
ggaggtgtggatatctccctggact

SEQ ID NO: 429485 - DNA, 25 bp, Rattus norvegicus
ggaggtgtggatttctccctggact

SEQ ID NO: 429486 - DNA, 25 bp, Rattus norvegicus
ggaggtgtgtgacctcaaccccaat

SEQ ID NO: 429487 - DNA, 25 bp, Rattus norvegicus
ggaggtgtgtgagctcaaccccaat

SEQ ID NO: 429488 - DNA, 25 bp, Rattus norvegicus
ggaggtgtgtgtccagtcttaaccc

SEQ ID NO: 429489 - DNA, 25 bp, Rattus norvegicus
ggaggtgtgtgtgcagtcttaaccc

SEQ ID NO: 429490 - DNA, 25 bp, Rattus norvegicus
ggaggtgttaacaaatgtccaggtt

SEQ ID NO: 429491 - DNA, 25 bp, Rattus norvegicus
ggaggtgttaactaatgtccaggtt

SEQ ID NO: 429492 - DNA, 25 bp, Rattus norvegicus
ggaggtgttcccaggtcctgttgac

SEQ ID NO: 429493 - DNA, 25 bp, Rattus norvegicus
ggaggtgttccctggtcctgttgac

SEQ ID NO: 429494 - DNA, 25 bp, Rattus norvegicus
ggaggtgttcctactgttcttgctg

SEQ ID NO: 429495 - DNA, 25 bp, Rattus norvegicus
ggaggtgttccttctgttcttgctg

SEQ ID NO: 429496 - DNA, 25 bp, Rattus norvegicus
ggaggttacatcagtctgtgacaac

SEQ ID NO: 429497 - DNA, 25 bp, Rattus norvegicus
ggaggttacatctgtctgtgacaac

SEQ ID NO: 429498 - DNA, 25 bp, Rattus norvegicus
ggaggttaccaacccaagatgccca

SEQ ID NO: 429499 - DNA, 25 bp, Rattus norvegicus
ggaggttaccaagccaagatgccca

SEQ ID NO: 429500 - DNA, 25 bp, Rattus norvegicus
ggaggttagaccacaagccagccta

SEQ ID NO: 429501 - DNA, 25 bp, Rattus norvegicus
ggaggttagacctcaagccagccta

SEQ ID NO: 429502 - DNA, 25 bp, Rattus norvegicus
ggaggttatgttacatccctagccc

SEQ ID NO: 429503 - DNA, 25 bp, Rattus norvegicus
ggaggttatgtttcatccctagccc

SEQ ID NO: 429504 - DNA, 25 bp, Rattus norvegicus
ggaggttatttaaaattcatctgat

SEQ ID NO: 429505 - DNA, 25 bp, Rattus norvegicus
ggaggttatttataattcatctgat

SEQ ID NO: 429506 - DNA, 25 bp, Rattus norvegicus
ggaggttcacatattctacagacga

SEQ ID NO: 429507 - DNA, 25 bp, Rattus norvegicus
ggaggttcacattttctacagacga

SEQ ID NO: 429508 - DNA, 25 bp, Rattus norvegicus
ggaggttcagctctttttgcatagt

SEQ ID NO: 429509 - DNA, 25 bp, Rattus norvegicus
ggaggttcagctgtttttgcatagt

SEQ ID NO: 429510 - DNA, 25 bp, Rattus norvegicus
ggaggttccacgagcagatgactat

SEQ ID NO: 429511 - DNA, 25 bp, Rattus norvegicus
ggaggttccacgtgcagatgactat

SEQ ID NO: 429512 - DNA, 25 bp, Rattus norvegicus
ggaggttccagcacactagcaataa

SEQ ID NO: 429513 - DNA, 25 bp, Rattus norvegicus
ggaggttccagctcactagcaataa

SEQ ID NO: 429514 - DNA, 25 bp, Rattus norvegicus
ggaggttcccttcaagcagtgctaa

SEQ ID NO: 429515 - DNA, 25 bp, Rattus norvegicus
ggaggttcccttgaagcagtgctaa

SEQ ID NO: 429516 - DNA, 25 bp, Rattus norvegicus
ggaggttccttactatcaggagtta

SEQ ID NO: 429517 - DNA, 25 bp, Rattus norvegicus
ggaggttccttagtatcaggagtta

SEQ ID NO: 429518 - DNA, 25 bp, Rattus norvegicus
ggaggttctaaaaacttctgcttat

SEQ ID NO: 429519 - DNA, 25 bp, Rattus norvegicus
ggaggttctaaatacttctgcttat

SEQ ID NO: 429520 - DNA, 25 bp, Rattus norvegicus
ggaggttctaccatgtatcctggcc

SEQ ID NO: 429521 - DNA, 25 bp, Rattus norvegicus
ggaggttctaccttgtatcctggcc

SEQ ID NO: 429522 - DNA, 25 bp, Rattus norvegicus
ggaggttctagaacctgctgaaact

SEQ ID NO: 429523 - DNA, 25 bp, Rattus norvegicus
ggaggttctagatcctgctgaaact

SEQ ID NO: 429524 - DNA, 25 bp, Rattus norvegicus
ggaggttctcaaactcaggtctagt

SEQ ID NO: 429525 - DNA, 25 bp, Rattus norvegicus
ggaggttctcaacgcactgaaatct

SEQ ID NO: 429526 - DNA, 25 bp, Rattus norvegicus
ggaggttctcaaggcactgaaatct

SEQ ID NO: 429527 - DNA, 25 bp, Rattus norvegicus
ggaggttctcaatctcaggtctagt

SEQ ID NO: 429528 - DNA, 25 bp, Rattus norvegicus
ggaggttctgtcatttattgtctat

SEQ ID NO: 429529 - DNA, 25 bp, Rattus norvegicus
ggaggttctgtcttttattgtctat

SEQ ID NO: 429530 - DNA, 25 bp, Rattus norvegicus
ggaggttcttctaattttgtgagcc

SEQ ID NO: 429531 - DNA, 25 bp, Rattus norvegicus
ggaggttcttcttattttgtgagcc

SEQ ID NO: 429532 - DNA, 25 bp, Rattus norvegicus
ggaggttcttgtcaggattccttct

SEQ ID NO: 429533 - DNA, 25 bp, Rattus norvegicus
ggaggttcttgtgaggattccttct

SEQ ID NO: 429534 - DNA, 25 bp, Rattus norvegicus
ggaggttgactcagtaaacacggtt

SEQ ID NO: 429535 - DNA, 25 bp, Rattus norvegicus
ggaggttgactctgtaaacacggtt

SEQ ID NO: 429536 - DNA, 25 bp, Rattus norvegicus
ggaggttgagatactgagcctgcaa

SEQ ID NO: 429537 - DNA, 25 bp, Rattus norvegicus
ggaggttgagattctgagcctgcaa

SEQ ID NO: 429538 - DNA, 25 bp, Rattus norvegicus
ggaggttgccagaaggtcctcaact

SEQ ID NO: 429539 - DNA, 25 bp, Rattus norvegicus
ggaggttgccagtaggtcctcaact

SEQ ID NO: 429540 - DNA, 25 bp, Rattus norvegicus
ggaggttgcgccaagaccatgctga

SEQ ID NO: 429541 - DNA, 25 bp, Rattus norvegicus
ggaggttgcgcctagaccatgctga

SEQ ID NO: 429542 - DNA, 25 bp, Rattus norvegicus
ggaggttgtagacgctttgcacacc

SEQ ID NO: 429543 - DNA, 25 bp, Rattus norvegicus
ggaggttgtagaggctttgcacacc

SEQ ID NO: 429544 - DNA, 25 bp, Rattus norvegicus
ggaggttgtcaactctattttacag

SEQ ID NO: 429545 - DNA, 25 bp, Rattus norvegicus
ggaggttgtcaagtctattttacag

SEQ ID NO: 429546 - DNA, 25 bp, Rattus norvegicus
ggaggttgtcccactggagacccag

SEQ ID NO: 429547 - DNA, 25 bp, Rattus norvegicus
ggaggttgtccctctggagacccag

SEQ ID NO: 429548 - DNA, 25 bp, Rattus norvegicus
ggaggttgtcctctgacatctatat

SEQ ID NO: 429549 - DNA, 25 bp, Rattus norvegicus
ggaggttgtcctgtgacatctatat

SEQ ID NO: 429550 - DNA, 25 bp, Rattus norvegicus
ggaggtttacccaacagtcagagtt

SEQ ID NO: 429551 - DNA, 25 bp, Rattus norvegicus
ggaggtttaccctacagtcagagtt

SEQ ID NO: 429552 - DNA, 25 bp, Rattus norvegicus
ggaggtttccaaaccaagactgatt

SEQ ID NO: 429553 - DNA, 25 bp, Rattus norvegicus
ggaggtttccaatccaagactgatt

SEQ ID NO: 429554 - DNA, 25 bp, Rattus norvegicus
ggaggtttcctcagtgcttagagcc

SEQ ID NO: 429555 - DNA, 25 bp, Rattus norvegicus
ggaggtttcctctgtgcttagagcc

SEQ ID NO: 429556 - DNA, 25 bp, Rattus norvegicus
ggaggtttcgaaccagtcccttggc

SEQ ID NO: 429557 - DNA, 25 bp, Rattus norvegicus
ggaggtttcgaagcagtcccttggc

SEQ ID NO: 429558 - DNA, 25 bp, Rattus norvegicus
ggaggtttcggtccactgtgcacat

SEQ ID NO: 429559 - DNA, 25 bp, Rattus norvegicus
ggaggtttcggtgcactgtgcacat

SEQ ID NO: 429560 - DNA, 25 bp, Rattus norvegicus
ggaggtttcttcagatttggtccta

SEQ ID NO: 429561 - DNA, 25 bp, Rattus norvegicus
ggaggtttcttctgatttggtccta

SEQ ID NO: 429562 - DNA, 25 bp, Rattus norvegicus
ggaggtttgattaaatctgcccaat

SEQ ID NO: 429563 - DNA, 25 bp, Rattus norvegicus
ggaggtttgatttaatctgcccaat

SEQ ID NO: 429564 - DNA, 25 bp, Rattus norvegicus
ggaggtttgcttcttgtgcttgcaa

SEQ ID NO: 429565 - DNA, 25 bp, Rattus norvegicus
ggaggtttgcttgttgtgcttgcaa

SEQ ID NO: 429566 - DNA, 25 bp, Rattus norvegicus
ggaggtttgttgatttgaggcttat

SEQ ID NO: 429567 - DNA, 25 bp, Rattus norvegicus
ggaggtttgttgttttgaggcttat

SEQ ID NO: 429568 - DNA, 25 bp, Rattus norvegicus
ggaggttttaatagccctcatagat

SEQ ID NO: 429569 - DNA, 25 bp, Rattus norvegicus
ggaggttttaattgccctcatagat

SEQ ID NO: 429570 - DNA, 25 bp, Rattus norvegicus
ggaggttttagactttccctgctca

SEQ ID NO: 429571 - DNA, 25 bp, Rattus norvegicus
ggaggttttagagtttccctgctca

SEQ ID NO: 429572 - DNA, 25 bp, Rattus norvegicus
ggaggtttttgacaggcttcctgaa

SEQ ID NO: 429573 - DNA, 25 bp, Rattus norvegicus
ggaggtttttgagaggcttcctgaa

SEQ ID NO: 429574 - DNA, 25 bp, Rattus norvegicus
ggagtaaaaagcctcttccttctca

SEQ ID NO: 429575 - DNA, 25 bp, Rattus norvegicus
ggagtaaaaagcgtcttccttctca

SEQ ID NO: 429576 - DNA, 25 bp, Rattus norvegicus
ggagtaaatgctcttacaccattaa

SEQ ID NO: 429577 - DNA, 25 bp, Rattus norvegicus
ggagtaaatgctgttacaccattaa

SEQ ID NO: 429578 - DNA, 25 bp, Rattus norvegicus
ggagtaacaatcactatacccttaa

SEQ ID NO: 429579 - DNA, 25 bp, Rattus norvegicus
ggagtaacaatctctatacccttaa

SEQ ID NO: 429580 - DNA, 25 bp, Rattus norvegicus
ggagtaacactgaaacccacggaca

SEQ ID NO: 429581 - DNA, 25 bp, Rattus norvegicus
ggagtaacactgtaacccacggaca

SEQ ID NO: 429582 - DNA, 25 bp, Rattus norvegicus
ggagtaacctctcggacttcctgtc

SEQ ID NO: 429583 - DNA, 25 bp, Rattus norvegicus
ggagtaacctctgggacttcctgtc

SEQ ID NO: 429584 - DNA, 25 bp, Rattus norvegicus
ggagtaactgcaagagagcccacca

SEQ ID NO: 429585 - DNA, 25 bp, Rattus norvegicus
ggagtaactgcatgagagcccacca

SEQ ID NO: 429586 - DNA, 25 bp, Rattus norvegicus
ggagtaacttctcacacctgtacct

SEQ ID NO: 429587 - DNA, 25 bp, Rattus norvegicus
ggagtaacttctgacacctgtacct

SEQ ID NO: 429588 - DNA, 25 bp, Rattus norvegicus
ggagtaagaaatccggctccccgtt

SEQ ID NO: 429589 - DNA, 25 bp, Rattus norvegicus
ggagtaagaaatgcggctccccgtt

SEQ ID NO: 429590 - DNA, 25 bp, Rattus norvegicus
ggagtaagcaccattttcttcctat

SEQ ID NO: 429591 - DNA, 25 bp, Rattus norvegicus
ggagtaagcacctttttcttcctat

SEQ ID NO: 429592 - DNA, 25 bp, Rattus norvegicus
ggagtaaggctcagcctgccgctcg

SEQ ID NO: 429593 - DNA, 25 bp, Rattus norvegicus
ggagtaaggctctgcctgccgctcg

SEQ ID NO: 429594 - DNA, 25 bp, Rattus norvegicus
ggagtaagggatcatcacgtttttt

SEQ ID NO: 429595 - DNA, 25 bp, Rattus norvegicus
ggagtaagggatgatcacgtttttt

SEQ ID NO: 429596 - DNA, 25 bp, Rattus norvegicus
ggagtaagtttgacattgtggacta

SEQ ID NO: 429597 - DNA, 25 bp, Rattus norvegicus
ggagtaagtttgtcattgtggacta

SEQ ID NO: 429598 - DNA, 25 bp, Rattus norvegicus
ggagtaatacatacctacaaggtga

SEQ ID NO: 429599 - DNA, 25 bp, Rattus norvegicus
ggagtaatacattcctacaaggtga

SEQ ID NO: 429600 - DNA, 25 bp, Rattus norvegicus
ggagtaatatgcatcacgtcagtgt

SEQ ID NO: 429601 - DNA, 25 bp, Rattus norvegicus
ggagtaatatgcttcacgtcagtgt

SEQ ID NO: 429602 - DNA, 25 bp, Rattus norvegicus
ggagtaatgtttctgctgcactttc

SEQ ID NO: 429603 - DNA, 25 bp, Rattus norvegicus
ggagtaatgtttgtgctgcactttc

SEQ ID NO: 429604 - DNA, 25 bp, Rattus norvegicus
ggagtaattctcaggcttaactttt

SEQ ID NO: 429605 - DNA, 25 bp, Rattus norvegicus
ggagtaattctctggcttaactttt

SEQ ID NO: 429606 - DNA, 25 bp, Rattus norvegicus
ggagtaattgccacttgttctttct

SEQ ID NO: 429607 - DNA, 25 bp, Rattus norvegicus
ggagtaattgcctcttgttctttct

SEQ ID NO: 429608 - DNA, 25 bp, Rattus norvegicus
ggagtacaacagataccaaccatgt

SEQ ID NO: 429609 - DNA, 25 bp, Rattus norvegicus
ggagtacaacagttaccaaccatgt

SEQ ID NO: 429610 - DNA, 25 bp, Rattus norvegicus
ggagtacaagccaatgagatttcat

SEQ ID NO: 429611 - DNA, 25 bp, Rattus norvegicus
ggagtacaagcctatgagatttcat

SEQ ID NO: 429612 - DNA, 25 bp, Rattus norvegicus
ggagtacaatatccttgttaacttc

SEQ ID NO: 429613 - DNA, 25 bp, Rattus norvegicus
ggagtacaatatgcttgttaacttc

SEQ ID NO: 429614 - DNA, 25 bp, Rattus norvegicus
ggagtacactcactcactgcaaagt

SEQ ID NO: 429615 - DNA, 25 bp, Rattus norvegicus
ggagtacactcagtcactgcaaagt

SEQ ID NO: 429616 - DNA, 25 bp, Rattus norvegicus
ggagtacacttcatcactagtgcag

SEQ ID NO: 429617 - DNA, 25 bp, Rattus norvegicus
ggagtacacttcttcactagtgcag

SEQ ID NO: 429618 - DNA, 25 bp, Rattus norvegicus
ggagtacaggacatacttctagttt

SEQ ID NO: 429619 - DNA, 25 bp, Rattus norvegicus
ggagtacaggacttacttctagttt

SEQ ID NO: 429620 - DNA, 25 bp, Rattus norvegicus
ggagtacatcaaccgagccctggcc

SEQ ID NO: 429621 - DNA, 25 bp, Rattus norvegicus
ggagtacatcaagcgagccctggcc

SEQ ID NO: 429622 - DNA, 25 bp, Rattus norvegicus
ggagtaccaccaccgctaagaatga

SEQ ID NO: 429623 - DNA, 25 bp, Rattus norvegicus
ggagtaccaccagcgctaagaatga

SEQ ID NO: 429624 - DNA, 25 bp, Rattus norvegicus
ggagtaccagagagctttatattta

SEQ ID NO: 429625 - DNA, 25 bp, Rattus norvegicus
ggagtaccagagtgctttatattta

SEQ ID NO: 429626 - DNA, 25 bp, Rattus norvegicus
ggagtaccaggtcatttatcaaaag

SEQ ID NO: 429627 - DNA, 25 bp, Rattus norvegicus
ggagtaccaggtgatttatcaaaag

SEQ ID NO: 429628 - DNA, 25 bp, Rattus norvegicus
ggagtaccatgtactaatgcttgca

SEQ ID NO: 429629 - DNA, 25 bp, Rattus norvegicus
ggagtaccatgttctaatgcttgca

SEQ ID NO: 429630 - DNA, 25 bp, Rattus norvegicus
ggagtacccttcagggaagtgcttt

SEQ ID NO: 429631 - DNA, 25 bp, Rattus norvegicus
ggagtacccttcagttattcaacca

SEQ ID NO: 429632 - DNA, 25 bp, Rattus norvegicus
ggagtacccttctgggaagtgcttt

SEQ ID NO: 429633 - DNA, 25 bp, Rattus norvegicus
ggagtacccttctgttattcaacca

SEQ ID NO: 429634 - DNA, 25 bp, Rattus norvegicus
ggagtaccgttcagatgcatacaca

SEQ ID NO: 429635 - DNA, 25 bp, Rattus norvegicus
ggagtaccgttctgatgcatacaca

SEQ ID NO: 429636 - DNA, 25 bp, Rattus norvegicus
ggagtacctacaactatctttacca

SEQ ID NO: 429637 - DNA, 25 bp, Rattus norvegicus
ggagtacctacatctatctttacca

SEQ ID NO: 429638 - DNA, 25 bp, Rattus norvegicus
ggagtacctagtatcgagtgcggcc

SEQ ID NO: 429639 - DNA, 25 bp, Rattus norvegicus
ggagtacctagtttcgagtgcggcc

SEQ ID NO: 429640 - DNA, 25 bp, Rattus norvegicus
ggagtacctgcccagttactcgagg

SEQ ID NO: 429641 - DNA, 25 bp, Rattus norvegicus
ggagtacctgccgagttactcgagg

SEQ ID NO: 429642 - DNA, 25 bp, Rattus norvegicus
ggagtacgagaccacccaggagtat

SEQ ID NO: 429643 - DNA, 25 bp, Rattus norvegicus
ggagtacgagacgacccaggagtat

SEQ ID NO: 429644 - DNA, 25 bp, Rattus norvegicus
ggagtacgctggacccaaggtgtaa

SEQ ID NO: 429645 - DNA, 25 bp, Rattus norvegicus
ggagtacgctggtcccaaggtgtaa

SEQ ID NO: 429646 - DNA, 25 bp, Rattus norvegicus
ggagtacggtcaacagtctttacag

SEQ ID NO: 429647 - DNA, 25 bp, Rattus norvegicus
ggagtacggtcatcagtctttacag

SEQ ID NO: 429648 - DNA, 25 bp, Rattus norvegicus
ggagtactccaactttctgcagcag

SEQ ID NO: 429649 - DNA, 25 bp, Rattus norvegicus
ggagtactccaagtttctgcagcag

SEQ ID NO: 429650 - DNA, 25 bp, Rattus norvegicus
ggagtactcggacctggtttcgcac

SEQ ID NO: 429651 - DNA, 25 bp, Rattus norvegicus
ggagtactcggagctggtttcgcac

SEQ ID NO: 429652 - DNA, 25 bp, Rattus norvegicus
ggagtactgaccacaacatccagga

SEQ ID NO: 429653 - DNA, 25 bp, Rattus norvegicus
ggagtactgacctcaacatccagga

SEQ ID NO: 429654 - DNA, 25 bp, Rattus norvegicus
ggagtactgcacaaaacccactaaa

SEQ ID NO: 429655 - DNA, 25 bp, Rattus norvegicus
ggagtactgcactaaacccactaaa

SEQ ID NO: 429656 - DNA, 25 bp, Rattus norvegicus
ggagtactgcatagccatccaaagt

SEQ ID NO: 429657 - DNA, 25 bp, Rattus norvegicus
ggagtactgcattgccatccaaagt

SEQ ID NO: 429658 - DNA, 25 bp, Rattus norvegicus
ggagtactgcttctctagtctttga

SEQ ID NO: 429659 - DNA, 25 bp, Rattus norvegicus
ggagtactgcttgtctagtctttga

SEQ ID NO: 429660 - DNA, 25 bp, Rattus norvegicus
ggagtacttactcgtattcaacaga

SEQ ID NO: 429661 - DNA, 25 bp, Rattus norvegicus
ggagtacttactctatgctggaaac

SEQ ID NO: 429662 - DNA, 25 bp, Rattus norvegicus
ggagtacttactggtattcaacaga

SEQ ID NO: 429663 - DNA, 25 bp, Rattus norvegicus
ggagtacttactgtatgctggaaac

SEQ ID NO: 429664 - DNA, 25 bp, Rattus norvegicus
ggagtacttattagacctgctgtta

SEQ ID NO: 429665 - DNA, 25 bp, Rattus norvegicus
ggagtacttatttgacctgctgtta

SEQ ID NO: 429666 - DNA, 25 bp, Rattus norvegicus
ggagtacttgctccccagagctgtt

SEQ ID NO: 429667 - DNA, 25 bp, Rattus norvegicus
ggagtacttgctgcccagagctgtt

SEQ ID NO: 429668 - DNA, 25 bp, Rattus norvegicus
ggagtactttctcaacaaccgctac

SEQ ID NO: 429669 - DNA, 25 bp, Rattus norvegicus
ggagtactttctgaacaaccgctac

SEQ ID NO: 429670 - DNA, 25 bp, Rattus norvegicus
ggagtagacgttaggctttcactat

SEQ ID NO: 429671 - DNA, 25 bp, Rattus norvegicus
ggagtagacgtttggctttcactat

SEQ ID NO: 429672 - DNA, 25 bp, Rattus norvegicus
ggagtagatccccaagaattgcata

SEQ ID NO: 429673 - DNA, 25 bp, Rattus norvegicus
ggagtagatcccgaagaattgcata

SEQ ID NO: 429674 - DNA, 25 bp, Rattus norvegicus
ggagtagatcgtactgtacttccat

SEQ ID NO: 429675 - DNA, 25 bp, Rattus norvegicus
ggagtagatcgttctgtacttccat

SEQ ID NO: 429676 - DNA, 25 bp, Rattus norvegicus
ggagtagcacatcccagggctgact

SEQ ID NO: 429677 - DNA, 25 bp, Rattus norvegicus
ggagtagcacatgccagggctgact

SEQ ID NO: 429678 - DNA, 25 bp, Rattus norvegicus
ggagtagcagccatagaacagttgt

SEQ ID NO: 429679 - DNA, 25 bp, Rattus norvegicus
ggagtagcagccttagaacagttgt

SEQ ID NO: 429680 - DNA, 25 bp, Rattus norvegicus
ggagtagccacaaccttgagtctat

SEQ ID NO: 429681 - DNA, 25 bp, Rattus norvegicus
ggagtagccacatccttgagtctat

SEQ ID NO: 429682 - DNA, 25 bp, Rattus norvegicus
ggagtagccaccactaacttatatg

SEQ ID NO: 429683 - DNA, 25 bp, Rattus norvegicus
ggagtagccacctctaacttatatg

SEQ ID NO: 429684 - DNA, 25 bp, Rattus norvegicus
ggagtagccactcaggactttaatt

SEQ ID NO: 429685 - DNA, 25 bp, Rattus norvegicus
ggagtagccactgaggactttaatt

SEQ ID NO: 429686 - DNA, 25 bp, Rattus norvegicus
ggagtagccagtacactctcagaaa

SEQ ID NO: 429687 - DNA, 25 bp, Rattus norvegicus
ggagtagccagttcactctcagaaa

SEQ ID NO: 429688 - DNA, 25 bp, Rattus norvegicus
ggagtagctggccagtcttcagcaa

SEQ ID NO: 429689 - DNA, 25 bp, Rattus norvegicus
ggagtagctggcgagtcttcagcaa

SEQ ID NO: 429690 - DNA, 25 bp, Rattus norvegicus
ggagtagctgttactttcctagaga

SEQ ID NO: 429691 - DNA, 25 bp, Rattus norvegicus
ggagtagctgtttctttcctagaga

SEQ ID NO: 429692 - DNA, 25 bp, Rattus norvegicus
ggagtaggaagcattctggtcataa

SEQ ID NO: 429693 - DNA, 25 bp, Rattus norvegicus
ggagtaggaagctttctggtcataa

SEQ ID NO: 429694 - DNA, 25 bp, Rattus norvegicus
ggagtaggactcagcttcccattcc

SEQ ID NO: 429695 - DNA, 25 bp, Rattus norvegicus
ggagtaggactctgcttcccattcc

SEQ ID NO: 429696 - DNA, 25 bp, Rattus norvegicus
ggagtaggcataccacacatacaca

SEQ ID NO: 429697 - DNA, 25 bp, Rattus norvegicus
ggagtaggcatagcacacatacaca

SEQ ID NO: 429698 - DNA, 25 bp, Rattus norvegicus
ggagtaggtgccatgacctggtccc

SEQ ID NO: 429699 - DNA, 25 bp, Rattus norvegicus
ggagtaggtgccttgacctggtccc

SEQ ID NO: 429700 - DNA, 25 bp, Rattus norvegicus
ggagtagtacagcacatggcctttc

SEQ ID NO: 429701 - DNA, 25 bp, Rattus norvegicus
ggagtagtacaggacatggcctttc

SEQ ID NO: 429702 - DNA, 25 bp, Rattus norvegicus
ggagtagtatccagcgcagttcagt

SEQ ID NO: 429703 - DNA, 25 bp, Rattus norvegicus
ggagtagtatcctgcgcagttcagt

SEQ ID NO: 429704 - DNA, 25 bp, Rattus norvegicus
ggagtagtctcccttgtataaatga

SEQ ID NO: 429705 - DNA, 25 bp, Rattus norvegicus
ggagtagtctccgttgtataaatga

SEQ ID NO: 429706 - DNA, 25 bp, Rattus norvegicus
ggagtagtctggaatgtccccggaa

SEQ ID NO: 429707 - DNA, 25 bp, Rattus norvegicus
ggagtagtctggtatgtccccggaa

SEQ ID NO: 429708 - DNA, 25 bp, Rattus norvegicus
ggagtagttgccatgtctttttgat

SEQ ID NO: 429709 - DNA, 25 bp, Rattus norvegicus
ggagtagttgccttgtctttttgat

SEQ ID NO: 429710 - DNA, 25 bp, Rattus norvegicus
ggagtagttttcattttccttatga

SEQ ID NO: 429711 - DNA, 25 bp, Rattus norvegicus
ggagtagttttctttttccttatga

SEQ ID NO: 429712 - DNA, 25 bp, Rattus norvegicus
ggagtataccctcatacctttatga

SEQ ID NO: 429713 - DNA, 25 bp, Rattus norvegicus
ggagtataccctgatacctttatga

SEQ ID NO: 429714 - DNA, 25 bp, Rattus norvegicus
ggagtatactgcaggcactagccat

SEQ ID NO: 429715 - DNA, 25 bp, Rattus norvegicus
ggagtatactgctggcactagccat

SEQ ID NO: 429716 - DNA, 25 bp, Rattus norvegicus
ggagtatactggcatattcctgtaa

SEQ ID NO: 429717 - DNA, 25 bp, Rattus norvegicus
ggagtatactgggatattcctgtaa

SEQ ID NO: 429718 - DNA, 25 bp, Rattus norvegicus
ggagtatactgtccgacaaattacc

SEQ ID NO: 429719 - DNA, 25 bp, Rattus norvegicus
ggagtatactgtgcgacaaattacc

SEQ ID NO: 429720 - DNA, 25 bp, Rattus norvegicus
ggagtatcaacaataccctggtgta

SEQ ID NO: 429721 - DNA, 25 bp, Rattus norvegicus
ggagtatcaacattaccctggtgta

SEQ ID NO: 429722 - DNA, 25 bp, Rattus norvegicus
ggagtatcataacaggccacctggg

SEQ ID NO: 429723 - DNA, 25 bp, Rattus norvegicus
ggagtatcataagaggccacctggg

SEQ ID NO: 429724 - DNA, 25 bp, Rattus norvegicus
ggagtatcattccattcatttcatt

SEQ ID NO: 429725 - DNA, 25 bp, Rattus norvegicus
ggagtatcattcgattcatttcatt

SEQ ID NO: 429726 - DNA, 25 bp, Rattus norvegicus
ggagtatccccaacttcaagctgga

SEQ ID NO: 429727 - DNA, 25 bp, Rattus norvegicus
ggagtatccccatcttcaagctgga

SEQ ID NO: 429728 - DNA, 25 bp, Rattus norvegicus
ggagtatctaatactctacagcaac

SEQ ID NO: 429729 - DNA, 25 bp, Rattus norvegicus
ggagtatctaattctctacagcaac

SEQ ID NO: 429730 - DNA, 25 bp, Rattus norvegicus
ggagtatctggacctgtccatgcca

SEQ ID NO: 429731 - DNA, 25 bp, Rattus norvegicus
ggagtatctggagctgtccatgcca

SEQ ID NO: 429732 - DNA, 25 bp, Rattus norvegicus
ggagtatgagcacgtcacccagtag

SEQ ID NO: 429733 - DNA, 25 bp, Rattus norvegicus
ggagtatgagcaggtcacccagtag

SEQ ID NO: 429734 - DNA, 25 bp, Rattus norvegicus
ggagtatgatctcctgtggctccag

SEQ ID NO: 429735 - DNA, 25 bp, Rattus norvegicus
ggagtatgatctgctgtggctccag

SEQ ID NO: 429736 - DNA, 25 bp, Rattus norvegicus
ggagtatgcaaaacccactgaactt

SEQ ID NO: 429737 - DNA, 25 bp, Rattus norvegicus
ggagtatgcaaatcccactgaactt

SEQ ID NO: 429738 - DNA, 25 bp, Rattus norvegicus
ggagtatgcatgacttcggtaaaaa

SEQ ID NO: 429739 - DNA, 25 bp, Rattus norvegicus
ggagtatgcatgtcttcggtaaaaa

SEQ ID NO: 429740 - DNA, 25 bp, Rattus norvegicus
ggagtatgctacactcaactactat

SEQ ID NO: 429741 - DNA, 25 bp, Rattus norvegicus
ggagtatgctactctcaactactat

SEQ ID NO: 429742 - DNA, 25 bp, Rattus norvegicus
ggagtattcagtcaacttgcccaga

SEQ ID NO: 429743 - DNA, 25 bp, Rattus norvegicus
ggagtattcagtgaacttgcccaga

SEQ ID NO: 429744 - DNA, 25 bp, Rattus norvegicus
ggagtattccaccaaagaggacaaa

SEQ ID NO: 429745 - DNA, 25 bp, Rattus norvegicus
ggagtattccacgaaagaggacaaa

SEQ ID NO: 429746 - DNA, 25 bp, Rattus norvegicus
ggagtattgactaagctgtgcagaa

SEQ ID NO: 429747 - DNA, 25 bp, Rattus norvegicus
ggagtattgacttagctgtgcagaa

SEQ ID NO: 429748 - DNA, 25 bp, Rattus norvegicus
ggagtattgcacattgcatttcttt

SEQ ID NO: 429749 - DNA, 25 bp, Rattus norvegicus
ggagtattgcactttgcatttcttt

SEQ ID NO: 429750 - DNA, 25 bp, Rattus norvegicus
ggagtattgttcactcagaagccag

SEQ ID NO: 429751 - DNA, 25 bp, Rattus norvegicus
ggagtattgttctctcagaagccag

SEQ ID NO: 429752 - DNA, 25 bp, Rattus norvegicus
ggagtatttcccaagtctgtgcaaa

SEQ ID NO: 429753 - DNA, 25 bp, Rattus norvegicus
ggagtatttccctagtctgtgcaaa

SEQ ID NO: 429754 - DNA, 25 bp, Rattus norvegicus
ggagtatttgtcacagtcctgggct

SEQ ID NO: 429755 - DNA, 25 bp, Rattus norvegicus
ggagtatttgtctcagtcctgggct

SEQ ID NO: 429756 - DNA, 25 bp, Rattus norvegicus
ggagtcaaaccacattagccacctt

SEQ ID NO: 429757 - DNA, 25 bp, Rattus norvegicus
ggagtcaaaccagattagccacctt

SEQ ID NO: 429758 - DNA, 25 bp, Rattus norvegicus
ggagtcaaaggtacatgtttcatcc

SEQ ID NO: 429759 - DNA, 25 bp, Rattus norvegicus
ggagtcaaaggttcatgtttcatcc

SEQ ID NO: 429760 - DNA, 25 bp, Rattus norvegicus
ggagtcaaatggcttgttcctcatc

SEQ ID NO: 429761 - DNA, 25 bp, Rattus norvegicus
ggagtcaaatgggttgttcctcatc

SEQ ID NO: 429762 - DNA, 25 bp, Rattus norvegicus
ggagtcaacattcagaccacggttt

SEQ ID NO: 429763 - DNA, 25 bp, Rattus norvegicus
ggagtcaacattgagaccacggttt

SEQ ID NO: 429764 - DNA, 25 bp, Rattus norvegicus
ggagtcaaccctcaaggcagtgttt

SEQ ID NO: 429765 - DNA, 25 bp, Rattus norvegicus
ggagtcaaccctgaaggcagtgttt

SEQ ID NO: 429766 - DNA, 25 bp, Rattus norvegicus
ggagtcaagcgcagagaccattctt

SEQ ID NO: 429767 - DNA, 25 bp, Rattus norvegicus
ggagtcaagcgctgagaccattctt

SEQ ID NO: 429768 - DNA, 25 bp, Rattus norvegicus
ggagtcaagttcacagcttcagctc

SEQ ID NO: 429769 - DNA, 25 bp, Rattus norvegicus
ggagtcaagttctcagcttcagctc

SEQ ID NO: 429770 - DNA, 25 bp, Rattus norvegicus
ggagtcaatagcctacttggatttt

SEQ ID NO: 429771 - DNA, 25 bp, Rattus norvegicus
ggagtcaatagcgtacttggatttt

SEQ ID NO: 429772 - DNA, 25 bp, Rattus norvegicus
ggagtcaatcaactgcaagaccatt

SEQ ID NO: 429773 - DNA, 25 bp, Rattus norvegicus
ggagtcaatcaagtgcaagaccatt

SEQ ID NO: 429774 - DNA, 25 bp, Rattus norvegicus
ggagtcaatcctattctatctggag

SEQ ID NO: 429775 - DNA, 25 bp, Rattus norvegicus
ggagtcaatccttttctatctggag

SEQ ID NO: 429776 - DNA, 25 bp, Rattus norvegicus
ggagtcacaaccattgtcagtgcct

SEQ ID NO: 429777 - DNA, 25 bp, Rattus norvegicus
ggagtcacaacctttgtcagtgcct

SEQ ID NO: 429778 - DNA, 25 bp, Rattus norvegicus
ggagtcacataacccattgggtctt

SEQ ID NO: 429779 - DNA, 25 bp, Rattus norvegicus
ggagtcacataagccattgggtctt

SEQ ID NO: 429780 - DNA, 25 bp, Rattus norvegicus
ggagtcacattgatataccattcaa

SEQ ID NO: 429781 - DNA, 25 bp, Rattus norvegicus
ggagtcacattgttataccattcaa

SEQ ID NO: 429782 - DNA, 25 bp, Rattus norvegicus
ggagtcaccactatttctagcaaca

SEQ ID NO: 429783 - DNA, 25 bp, Rattus norvegicus
ggagtcaccactttttctagcaaca

SEQ ID NO: 429784 - DNA, 25 bp, Rattus norvegicus
ggagtcaccttacagccaagcgaag

SEQ ID NO: 429785 - DNA, 25 bp, Rattus norvegicus
ggagtcaccttagagccaagcgaag

SEQ ID NO: 429786 - DNA, 25 bp, Rattus norvegicus
ggagtcacggcaacagccttgcggt

SEQ ID NO: 429787 - DNA, 25 bp, Rattus norvegicus
ggagtcacggcatcagccttgcggt

SEQ ID NO: 429788 - DNA, 25 bp, Rattus norvegicus
ggagtcacggtcaggttaccagctc

SEQ ID NO: 429789 - DNA, 25 bp, Rattus norvegicus
ggagtcacggtctggttaccagctc

SEQ ID NO: 429790 - DNA, 25 bp, Rattus norvegicus
ggagtcacgtgcctttcaaatactt

SEQ ID NO: 429791 - DNA, 25 bp, Rattus norvegicus
ggagtcacgtgcgtttcaaatactt

SEQ ID NO: 429792 - DNA, 25 bp, Rattus norvegicus
ggagtcactattcctggttatctca

SEQ ID NO: 429793 - DNA, 25 bp, Rattus norvegicus
ggagtcactattgctggttatctca

SEQ ID NO: 429794 - DNA, 25 bp, Rattus norvegicus
ggagtcactctgagatgaccttttt

SEQ ID NO: 429795 - DNA, 25 bp, Rattus norvegicus
ggagtcactctgtgatgaccttttt

SEQ ID NO: 429796 - DNA, 25 bp, Rattus norvegicus
ggagtcactgagaaccatccgtggt

SEQ ID NO: 429797 - DNA, 25 bp, Rattus norvegicus
ggagtcactgagtaccatccgtggt

SEQ ID NO: 429798 - DNA, 25 bp, Rattus norvegicus
ggagtcactgatatacctgtggata

SEQ ID NO: 429799 - DNA, 25 bp, Rattus norvegicus
ggagtcactgatttacctgtggata

SEQ ID NO: 429800 - DNA, 25 bp, Rattus norvegicus
ggagtcactgggagtgagtctctaa

SEQ ID NO: 429801 - DNA, 25 bp, Rattus norvegicus
ggagtcactgggtgtgagtctctaa

SEQ ID NO: 429802 - DNA, 25 bp, Rattus norvegicus
ggagtcagaaacaacccagtcctgc

SEQ ID NO: 429803 - DNA, 25 bp, Rattus norvegicus
ggagtcagaaactacccagtcctgc

SEQ ID NO: 429804 - DNA, 25 bp, Rattus norvegicus
ggagtcagaaccatgctctactgga

SEQ ID NO: 429805 - DNA, 25 bp, Rattus norvegicus
ggagtcagaaccttgctctactgga

SEQ ID NO: 429806 - DNA, 25 bp, Rattus norvegicus
ggagtcagagtcacagatacctgaa

SEQ ID NO: 429807 - DNA, 25 bp, Rattus norvegicus
ggagtcagagtctcagatacctgaa

SEQ ID NO: 429808 - DNA, 25 bp, Rattus norvegicus
ggagtcagcatcctgtgtgagatac

SEQ ID NO: 429809 - DNA, 25 bp, Rattus norvegicus
ggagtcagcatcgtgtgtgagatac

SEQ ID NO: 429810 - DNA, 25 bp, Rattus norvegicus
ggagtcagccataagacttctctga

SEQ ID NO: 429811 - DNA, 25 bp, Rattus norvegicus
ggagtcagccattagacttctctga

SEQ ID NO: 429812 - DNA, 25 bp, Rattus norvegicus
ggagtcaggcagagtgatacacctt

SEQ ID NO: 429813 - DNA, 25 bp, Rattus norvegicus
ggagtcaggcagtgtgatacacctt

SEQ ID NO: 429814 - DNA, 25 bp, Rattus norvegicus
ggagtcagtaatacagccatgatca

SEQ ID NO: 429815 - DNA, 25 bp, Rattus norvegicus
ggagtcagtaattcagccatgatca

SEQ ID NO: 429816 - DNA, 25 bp, Rattus norvegicus
ggagtcagtagtcccttgcccagaa

SEQ ID NO: 429817 - DNA, 25 bp, Rattus norvegicus
ggagtcagtagtgccttgcccagaa

SEQ ID NO: 429818 - DNA, 25 bp, Rattus norvegicus
ggagtcagtcttcattccagaggct

SEQ ID NO: 429819 - DNA, 25 bp, Rattus norvegicus
ggagtcagtcttgattccagaggct

SEQ ID NO: 429820 - DNA, 25 bp, Rattus norvegicus
ggagtcagtgccaatatcctcagca

SEQ ID NO: 429821 - DNA, 25 bp, Rattus norvegicus
ggagtcagtgcctatatcctcagca

SEQ ID NO: 429822 - DNA, 25 bp, Rattus norvegicus
ggagtcagttctctcagttctctcc

SEQ ID NO: 429823 - DNA, 25 bp, Rattus norvegicus
ggagtcagttctgtcagttctctcc

SEQ ID NO: 429824 - DNA, 25 bp, Rattus norvegicus
ggagtcataacccttaggtaggaat

SEQ ID NO: 429825 - DNA, 25 bp, Rattus norvegicus
ggagtcataaccgttaggtaggaat

SEQ ID NO: 429826 - DNA, 25 bp, Rattus norvegicus
ggagtcatagtcctgtacccagttt

SEQ ID NO: 429827 - DNA, 25 bp, Rattus norvegicus
ggagtcatagtcgtgtacccagttt

SEQ ID NO: 429828 - DNA, 25 bp, Rattus norvegicus
ggagtcatatgcatcttttctttaa

SEQ ID NO: 429829 - DNA, 25 bp, Rattus norvegicus
ggagtcatatgcttcttttctttaa

SEQ ID NO: 429830 - DNA, 25 bp, Rattus norvegicus
ggagtcatcaaaatcatccccaaga

SEQ ID NO: 429831 - DNA, 25 bp, Rattus norvegicus
ggagtcatcaaattcatccccaaga

SEQ ID NO: 429832 - DNA, 25 bp, Rattus norvegicus
ggagtcatcagcaagacccttacgt

SEQ ID NO: 429833 - DNA, 25 bp, Rattus norvegicus
ggagtcatcagctagacccttacgt

SEQ ID NO: 429834 - DNA, 25 bp, Rattus norvegicus
ggagtcatcctcagtgcatttagcg

SEQ ID NO: 429835 - DNA, 25 bp, Rattus norvegicus
ggagtcatcctctgtgcatttagcg

SEQ ID NO: 429836 - DNA, 25 bp, Rattus norvegicus
ggagtcatctcaaaggtcaggttct

SEQ ID NO: 429837 - DNA, 25 bp, Rattus norvegicus
ggagtcatctcataggtcaggttct

SEQ ID NO: 429838 - DNA, 25 bp, Rattus norvegicus
ggagtcatctcgcaatgtcttattg

SEQ ID NO: 429839 - DNA, 25 bp, Rattus norvegicus
ggagtcatctcggaatgtcttattg

SEQ ID NO: 429840 - DNA, 25 bp, Rattus norvegicus
ggagtcatcttaacagccatcatct

SEQ ID NO: 429841 - DNA, 25 bp, Rattus norvegicus
ggagtcatcttatcagccatcatct

SEQ ID NO: 429842 - DNA, 25 bp, Rattus norvegicus
ggagtcatcttccagattccagatt

SEQ ID NO: 429843 - DNA, 25 bp, Rattus norvegicus
ggagtcatcttcgagattccagatt

SEQ ID NO: 429844 - DNA, 25 bp, Rattus norvegicus
ggagtcatggctaccttctcagcat

SEQ ID NO: 429845 - DNA, 25 bp, Rattus norvegicus
ggagtcatggcttccttctcagcat

SEQ ID NO: 429846 - DNA, 25 bp, Rattus norvegicus
ggagtcattagcacttgtggatcta

SEQ ID NO: 429847 - DNA, 25 bp, Rattus norvegicus
ggagtcattagctcttgtggatcta

SEQ ID NO: 429848 - DNA, 25 bp, Rattus norvegicus
ggagtcattcctagtgcattgtgtc

SEQ ID NO: 429849 - DNA, 25 bp, Rattus norvegicus
ggagtcattccttgtgcattgtgtc

SEQ ID NO: 429850 - DNA, 25 bp, Rattus norvegicus
ggagtcattgaaactcacagtctca

SEQ ID NO: 429851 - DNA, 25 bp, Rattus norvegicus
ggagtcattgaatctcacagtctca

SEQ ID NO: 429852 - DNA, 25 bp, Rattus norvegicus
ggagtccaacctattagccaatttg

SEQ ID NO: 429853 - DNA, 25 bp, Rattus norvegicus
ggagtccaaccttttagccaatttg

SEQ ID NO: 429854 - DNA, 25 bp, Rattus norvegicus
ggagtccaatataacatacccacag

SEQ ID NO: 429855 - DNA, 25 bp, Rattus norvegicus
ggagtccaatattacatacccacag

SEQ ID NO: 429856 - DNA, 25 bp, Rattus norvegicus
ggagtccaatttcaacccacagtac

SEQ ID NO: 429857 - DNA, 25 bp, Rattus norvegicus
ggagtccaatttgaacccacagtac

SEQ ID NO: 429858 - DNA, 25 bp, Rattus norvegicus
ggagtccacaagctgcccctgataa

SEQ ID NO: 429859 - DNA, 25 bp, Rattus norvegicus
ggagtccacaaggtgcccctgataa

SEQ ID NO: 429860 - DNA, 25 bp, Rattus norvegicus
ggagtccacagtacttcaaggcctt

SEQ ID NO: 429861 - DNA, 25 bp, Rattus norvegicus
ggagtccacagttcttcaaggcctt

SEQ ID NO: 429862 - DNA, 25 bp, Rattus norvegicus
ggagtccacctgaagcttttgcttg

SEQ ID NO: 429863 - DNA, 25 bp, Rattus norvegicus
ggagtccacctgtagcttttgcttg

SEQ ID NO: 429864 - DNA, 25 bp, Rattus norvegicus
ggagtccactaacctaggccatttt

SEQ ID NO: 429865 - DNA, 25 bp, Rattus norvegicus
ggagtccactaagctaggccatttt

SEQ ID NO: 429866 - DNA, 25 bp, Rattus norvegicus
ggagtccagaccatccttggaagag

SEQ ID NO: 429867 - DNA, 25 bp, Rattus norvegicus
ggagtccagaccttccttggaagag

SEQ ID NO: 429868 - DNA, 25 bp, Rattus norvegicus
ggagtccagactacacttcagaatt

SEQ ID NO: 429869 - DNA, 25 bp, Rattus norvegicus
ggagtccagacttcacttcagaatt

SEQ ID NO: 429870 - DNA, 25 bp, Rattus norvegicus
ggagtccagatacagcaaaaccgtt

SEQ ID NO: 429871 - DNA, 25 bp, Rattus norvegicus
ggagtccagatacctcagattgtca

SEQ ID NO: 429872 - DNA, 25 bp, Rattus norvegicus
ggagtccagatagagcaaaaccgtt

SEQ ID NO: 429873 - DNA, 25 bp, Rattus norvegicus
ggagtccagatagctcagattgtca

SEQ ID NO: 429874 - DNA, 25 bp, Rattus norvegicus
ggagtccagcttctgatggaacatt

SEQ ID NO: 429875 - DNA, 25 bp, Rattus norvegicus
ggagtccagcttgtgatggaacatt

SEQ ID NO: 429876 - DNA, 25 bp, Rattus norvegicus
ggagtccagtgaaattccgaatttg

SEQ ID NO: 429877 - DNA, 25 bp, Rattus norvegicus
ggagtccagtgatattccgaatttg

SEQ ID NO: 429878 - DNA, 25 bp, Rattus norvegicus
ggagtccagtgcagctcgaccatct

SEQ ID NO: 429879 - DNA, 25 bp, Rattus norvegicus
ggagtccagtgctgctcgaccatct

SEQ ID NO: 429880 - DNA, 25 bp, Rattus norvegicus
ggagtccataacattgaccttccta

SEQ ID NO: 429881 - DNA, 25 bp, Rattus norvegicus
ggagtccataactttgaccttccta

SEQ ID NO: 429882 - DNA, 25 bp, Rattus norvegicus
ggagtccatgaccagattaatttct

SEQ ID NO: 429883 - DNA, 25 bp, Rattus norvegicus
ggagtccatgacgagattaatttct

SEQ ID NO: 429884 - DNA, 25 bp, Rattus norvegicus
ggagtccatgcacacactgcagaaa

SEQ ID NO: 429885 - DNA, 25 bp, Rattus norvegicus
ggagtccatgcagacactgcagaaa

SEQ ID NO: 429886 - DNA, 25 bp, Rattus norvegicus
ggagtccattgcaaccttagaaact

SEQ ID NO: 429887 - DNA, 25 bp, Rattus norvegicus
ggagtccattgctaccttagaaact

SEQ ID NO: 429888 - DNA, 25 bp, Rattus norvegicus
ggagtcccaacaagtgccaggcatg

SEQ ID NO: 429889 - DNA, 25 bp, Rattus norvegicus
ggagtcccaacatgtgccaggcatg

SEQ ID NO: 429890 - DNA, 25 bp, Rattus norvegicus
ggagtcccaagcatcccttaggaag

SEQ ID NO: 429891 - DNA, 25 bp, Rattus norvegicus
ggagtcccaagcttcccttaggaag

SEQ ID NO: 429892 - DNA, 25 bp, Rattus norvegicus
ggagtcccaagtagtctacattcgt

SEQ ID NO: 429893 - DNA, 25 bp, Rattus norvegicus
ggagtcccaagttgtctacattcgt

SEQ ID NO: 429894 - DNA, 25 bp, Rattus norvegicus
ggagtcccagagagatcccttagtg

SEQ ID NO: 429895 - DNA, 25 bp, Rattus norvegicus
ggagtcccagagtgatcccttagtg

SEQ ID NO: 429896 - DNA, 25 bp, Rattus norvegicus
ggagtcccaggacgtcttacttctt

SEQ ID NO: 429897 - DNA, 25 bp, Rattus norvegicus
ggagtcccaggaggtcttacttctt

SEQ ID NO: 429898 - DNA, 25 bp, Rattus norvegicus
ggagtccccataaacatgtactgta

SEQ ID NO: 429899 - DNA, 25 bp, Rattus norvegicus
ggagtccccatatacatgtactgta

SEQ ID NO: 429900 - DNA, 25 bp, Rattus norvegicus
ggagtccccatcaaagaccaagtat

SEQ ID NO: 429901 - DNA, 25 bp, Rattus norvegicus
ggagtccccatctaagaccaagtat

SEQ ID NO: 429902 - DNA, 25 bp, Rattus norvegicus
ggagtcccctgacacagcagagaaa

SEQ ID NO: 429903 - DNA, 25 bp, Rattus norvegicus
ggagtcccctgagacagcagagaaa

SEQ ID NO: 429904 - DNA, 25 bp, Rattus norvegicus
ggagtcccgactacttgatattaaa

SEQ ID NO: 429905 - DNA, 25 bp, Rattus norvegicus
ggagtcccgacttcttgatattaaa

SEQ ID NO: 429906 - DNA, 25 bp, Rattus norvegicus
ggagtcccgctgacacatgaaagaa

SEQ ID NO: 429907 - DNA, 25 bp, Rattus norvegicus
ggagtcccgctgtcacatgaaagaa

SEQ ID NO: 429908 - DNA, 25 bp, Rattus norvegicus
ggagtcccggagatagcctgagtct

SEQ ID NO: 429909 - DNA, 25 bp, Rattus norvegicus
ggagtcccggagttagcctgagtct

SEQ ID NO: 429910 - DNA, 25 bp, Rattus norvegicus
ggagtccctttcaggtgacgatggc

SEQ ID NO: 429911 - DNA, 25 bp, Rattus norvegicus
ggagtccctttctggtgacgatggc

SEQ ID NO: 429912 - DNA, 25 bp, Rattus norvegicus
ggagtccgtgctctgtttcggcaca

SEQ ID NO: 429913 - DNA, 25 bp, Rattus norvegicus
ggagtccgtgctgtgtttcggcaca

SEQ ID NO: 429914 - DNA, 25 bp, Rattus norvegicus
ggagtcctaaagaaatgcaaagtgc

SEQ ID NO: 429915 - DNA, 25 bp, Rattus norvegicus
ggagtcctaaagtaatgcaaagtgc

SEQ ID NO: 429916 - DNA, 25 bp, Rattus norvegicus
ggagtcctatatatatccacactgg

SEQ ID NO: 429917 - DNA, 25 bp, Rattus norvegicus
ggagtcctatatttatccacactgg

SEQ ID NO: 429918 - DNA, 25 bp, Rattus norvegicus
ggagtcctcctacaagctcatgtga

SEQ ID NO: 429919 - DNA, 25 bp, Rattus norvegicus
ggagtcctcctagaagctcatgtga

SEQ ID NO: 429920 - DNA, 25 bp, Rattus norvegicus
ggagtcctctgacccctgatcacaa

SEQ ID NO: 429921 - DNA, 25 bp, Rattus norvegicus
ggagtcctctgagccctgatcacaa

SEQ ID NO: 429922 - DNA, 25 bp, Rattus norvegicus
ggagtcctctgtccccaggaagaga

SEQ ID NO: 429923 - DNA, 25 bp, Rattus norvegicus
ggagtcctctgtgcccaggaagaga

SEQ ID NO: 429924 - DNA, 25 bp, Rattus norvegicus
ggagtcctggcaccggagccaggcc

SEQ ID NO: 429925 - DNA, 25 bp, Rattus norvegicus
ggagtcctggcagcggagccaggcc

SEQ ID NO: 429926 - DNA, 25 bp, Rattus norvegicus
ggagtcctggctaatctatccatga

SEQ ID NO: 429927 - DNA, 25 bp, Rattus norvegicus
ggagtcctggcttatctatccatga

SEQ ID NO: 429928 - DNA, 25 bp, Rattus norvegicus
ggagtcctgggcatctctgtttgca

SEQ ID NO: 429929 - DNA, 25 bp, Rattus norvegicus
ggagtcctgggcttctctgtttgca

SEQ ID NO: 429930 - DNA, 25 bp, Rattus norvegicus
ggagtcctgggtattcattatggtt

SEQ ID NO: 429931 - DNA, 25 bp, Rattus norvegicus
ggagtcctgggttttcattatggtt

SEQ ID NO: 429932 - DNA, 25 bp, Rattus norvegicus
ggagtcctgtgcagcctgtgatttc

SEQ ID NO: 429933 - DNA, 25 bp, Rattus norvegicus
ggagtcctgtgctgcctgtgatttc

SEQ ID NO: 429934 - DNA, 25 bp, Rattus norvegicus
ggagtcctgtggaccaactacaagg

SEQ ID NO: 429935 - DNA, 25 bp, Rattus norvegicus
ggagtcctgtggtccaactacaagg

SEQ ID NO: 429936 - DNA, 25 bp, Rattus norvegicus
ggagtccttcagaaatcagcgttca

SEQ ID NO: 429937 - DNA, 25 bp, Rattus norvegicus
ggagtccttcagtaatcagcgttca

SEQ ID NO: 429938 - DNA, 25 bp, Rattus norvegicus
ggagtccttgcgctcagaagcacag

SEQ ID NO: 429939 - DNA, 25 bp, Rattus norvegicus
ggagtccttgcggtcagaagcacag

SEQ ID NO: 429940 - DNA, 25 bp, Rattus norvegicus
ggagtcgaaaaacttcttcatcttt

SEQ ID NO: 429941 - DNA, 25 bp, Rattus norvegicus
ggagtcgaaaaagttcttcatcttt

SEQ ID NO: 429942 - DNA, 25 bp, Rattus norvegicus
ggagtcgacaatacagccttccctt

SEQ ID NO: 429943 - DNA, 25 bp, Rattus norvegicus
ggagtcgacaattcagccttccctt

SEQ ID NO: 429944 - DNA, 25 bp, Rattus norvegicus
ggagtcgacataccagcggaaagca

SEQ ID NO: 429945 - DNA, 25 bp, Rattus norvegicus
ggagtcgacatagcagcggaaagca

SEQ ID NO: 429946 - DNA, 25 bp, Rattus norvegicus
ggagtcgcacaaatcaagaacggaa

SEQ ID NO: 429947 - DNA, 25 bp, Rattus norvegicus
ggagtcgcacaattcaagaacggaa

SEQ ID NO: 429948 - DNA, 25 bp, Rattus norvegicus
ggagtcgccagcctcaaagatatat

SEQ ID NO: 429949 - DNA, 25 bp, Rattus norvegicus
ggagtcgccagcgtcaaagatatat

SEQ ID NO: 429950 - DNA, 25 bp, Rattus norvegicus
ggagtcggactcataatcaggcctt

SEQ ID NO: 429951 - DNA, 25 bp, Rattus norvegicus
ggagtcggactcttaatcaggcctt

SEQ ID NO: 429952 - DNA, 25 bp, Rattus norvegicus
ggagtcggagagagctcccatctgt

SEQ ID NO: 429953 - DNA, 25 bp, Rattus norvegicus
ggagtcggagagtgctcccatctgt

SEQ ID NO: 429954 - DNA, 25 bp, Rattus norvegicus
ggagtcggcaagaccccaagaactt

SEQ ID NO: 429955 - DNA, 25 bp, Rattus norvegicus
ggagtcggcaagtccccaagaactt

SEQ ID NO: 429956 - DNA, 25 bp, Rattus norvegicus
ggagtcggcgcgcaaagcgaaagcg

SEQ ID NO: 429957 - DNA, 25 bp, Rattus norvegicus
ggagtcggcgcggaaagcgaaagcg

SEQ ID NO: 429958 - DNA, 25 bp, Rattus norvegicus
ggagtcggcttcactgcagtaaaca

SEQ ID NO: 429959 - DNA, 25 bp, Rattus norvegicus
ggagtcggcttctctgcagtaaaca

SEQ ID NO: 429960 - DNA, 25 bp, Rattus norvegicus
ggagtcgggtcactgtgtccagggt

SEQ ID NO: 429961 - DNA, 25 bp, Rattus norvegicus
ggagtcgggtcagtgtgtccagggt

SEQ ID NO: 429962 - DNA, 25 bp, Rattus norvegicus
ggagtcggtcctatgattataacta

SEQ ID NO: 429963 - DNA, 25 bp, Rattus norvegicus
ggagtcggtcctttgattataacta

SEQ ID NO: 429964 - DNA, 25 bp, Rattus norvegicus
ggagtcgtgcgaagtcttctggaaa

SEQ ID NO: 429965 - DNA, 25 bp, Rattus norvegicus
ggagtcgtgcgatgtcttctggaaa

SEQ ID NO: 429966 - DNA, 25 bp, Rattus norvegicus
ggagtcgtggttaaacgtcattcac

SEQ ID NO: 429967 - DNA, 25 bp, Rattus norvegicus
ggagtcgtggtttaacgtcattcac

SEQ ID NO: 429968 - DNA, 25 bp, Rattus norvegicus
ggagtcgtttttagctgaactgtga

SEQ ID NO: 429969 - DNA, 25 bp, Rattus norvegicus
ggagtcgttttttgctgaactgtga

SEQ ID NO: 429970 - DNA, 25 bp, Rattus norvegicus
ggagtctaaagtccacagaggtgca

SEQ ID NO: 429971 - DNA, 25 bp, Rattus norvegicus
ggagtctaaagtgcacagaggtgca

SEQ ID NO: 429972 - DNA, 25 bp, Rattus norvegicus
ggagtctaaggcactaaagcacccc

SEQ ID NO: 429973 - DNA, 25 bp, Rattus norvegicus
ggagtctaaggctctaaagcacccc

SEQ ID NO: 429974 - DNA, 25 bp, Rattus norvegicus
ggagtctacaccctgttgactaaga

SEQ ID NO: 429975 - DNA, 25 bp, Rattus norvegicus
ggagtctacaccgtgttgactaaga

SEQ ID NO: 429976 - DNA, 25 bp, Rattus norvegicus
ggagtctacactcactgggtacatt

SEQ ID NO: 429977 - DNA, 25 bp, Rattus norvegicus
ggagtctacactgactgggtacatt

SEQ ID NO: 429978 - DNA, 25 bp, Rattus norvegicus
ggagtctacctaccgtgcctgcaga

SEQ ID NO: 429979 - DNA, 25 bp, Rattus norvegicus
ggagtctacctagcgtgcctgcaga

SEQ ID NO: 429980 - DNA, 25 bp, Rattus norvegicus
ggagtctagcagagagtcggacaat

SEQ ID NO: 429981 - DNA, 25 bp, Rattus norvegicus
ggagtctagcagtgagtcggacaat

SEQ ID NO: 429982 - DNA, 25 bp, Rattus norvegicus
ggagtctagcccagtgattctctgt

SEQ ID NO: 429983 - DNA, 25 bp, Rattus norvegicus
ggagtctagccctgtgattctctgt

SEQ ID NO: 429984 - DNA, 25 bp, Rattus norvegicus
ggagtctagtggcaagtcctgtcaa

SEQ ID NO: 429985 - DNA, 25 bp, Rattus norvegicus
ggagtctagtgggaagtcctgtcaa

SEQ ID NO: 429986 - DNA, 25 bp, Rattus norvegicus
ggagtctcaaaacggccatcctggt

SEQ ID NO: 429987 - DNA, 25 bp, Rattus norvegicus
ggagtctcaaaagggccatcctggt

SEQ ID NO: 429988 - DNA, 25 bp, Rattus norvegicus
ggagtctcaaggcatggcctctgct

SEQ ID NO: 429989 - DNA, 25 bp, Rattus norvegicus
ggagtctcaagggatggcctctgct

SEQ ID NO: 429990 - DNA, 25 bp, Rattus norvegicus
ggagtctcaagtccaggaccactta

SEQ ID NO: 429991 - DNA, 25 bp, Rattus norvegicus
ggagtctcaagtgcaggaccactta

SEQ ID NO: 429992 - DNA, 25 bp, Rattus norvegicus
ggagtctcaccaagtagtccaggct

SEQ ID NO: 429993 - DNA, 25 bp, Rattus norvegicus
ggagtctcaccatgtagtccaggct

SEQ ID NO: 429994 - DNA, 25 bp, Rattus norvegicus
ggagtctcatagaggctgcagctca

SEQ ID NO: 429995 - DNA, 25 bp, Rattus norvegicus
ggagtctcatagtggctgcagctca

SEQ ID NO: 429996 - DNA, 25 bp, Rattus norvegicus
ggagtctcatcaagactgtgctgta

SEQ ID NO: 429997 - DNA, 25 bp, Rattus norvegicus
ggagtctcatcatgactgtgctgta

SEQ ID NO: 429998 - DNA, 25 bp, Rattus norvegicus
ggagtctcattcactgatgggacaa

SEQ ID NO: 429999 - DNA, 25 bp, Rattus norvegicus
ggagtctcattctctgatgggacaa

SEQ ID NO: 430000 - DNA, 25 bp, Rattus norvegicus
ggagtctccaatatagcatgtcgaa

SEQ ID NO: 430001 - DNA, 25 bp, Rattus norvegicus
ggagtctccaatttagcatgtcgaa

SEQ ID NO: 430002 - DNA, 25 bp, Rattus norvegicus
ggagtctccacacctactgcaatta

SEQ ID NO: 430003 - DNA, 25 bp, Rattus norvegicus
ggagtctccacagctactgcaatta

SEQ ID NO: 430004 - DNA, 25 bp, Rattus norvegicus
ggagtctccaggactttctgttctg

SEQ ID NO: 430005 - DNA, 25 bp, Rattus norvegicus
ggagtctccaggtctttctgttctg

SEQ ID NO: 430006 - DNA, 25 bp, Rattus norvegicus
ggagtctcctatcctgagtccatta

SEQ ID NO: 430007 - DNA, 25 bp, Rattus norvegicus
ggagtctcctatgctgagtccatta

SEQ ID NO: 430008 - DNA, 25 bp, Rattus norvegicus
ggagtctcctctcctctcagagtta

SEQ ID NO: 430009 - DNA, 25 bp, Rattus norvegicus
ggagtctcctctgctctcagagtta

SEQ ID NO: 430010 - DNA, 25 bp, Rattus norvegicus
ggagtctcctgaccactcggcagaa

SEQ ID NO: 430011 - DNA, 25 bp, Rattus norvegicus
ggagtctcctgagcactcggcagaa

SEQ ID NO: 430012 - DNA, 25 bp, Rattus norvegicus
ggagtctctattaaaccctgaccca

SEQ ID NO: 430013 - DNA, 25 bp, Rattus norvegicus
ggagtctctatttaaccctgaccca

SEQ ID NO: 430014 - DNA, 25 bp, Rattus norvegicus
ggagtctctcaaacttctctcaaca

SEQ ID NO: 430015 - DNA, 25 bp, Rattus norvegicus
ggagtctctcaatcttctctcaaca

SEQ ID NO: 430016 - DNA, 25 bp, Rattus norvegicus
ggagtctctgtacctccaagaggcc

SEQ ID NO: 430017 - DNA, 25 bp, Rattus norvegicus
ggagtctctgtagctccaagaggcc

SEQ ID NO: 430018 - DNA, 25 bp, Rattus norvegicus
ggagtctcttaaagctcctcatact

SEQ ID NO: 430019 - DNA, 25 bp, Rattus norvegicus
ggagtctcttaatgctcctcatact

SEQ ID NO: 430020 - DNA, 25 bp, Rattus norvegicus
ggagtctctttaacccagagccata

SEQ ID NO: 430021 - DNA, 25 bp, Rattus norvegicus
ggagtctctttatcccagagccata

SEQ ID NO: 430022 - DNA, 25 bp, Rattus norvegicus
ggagtctcttttacactcgtagatt

SEQ ID NO: 430023 - DNA, 25 bp, Rattus norvegicus
ggagtctctttttcactcgtagatt

SEQ ID NO: 430024 - DNA, 25 bp, Rattus norvegicus
ggagtctgacaccagatgcttctta

SEQ ID NO: 430025 - DNA, 25 bp, Rattus norvegicus
ggagtctgacacgagatgcttctta

SEQ ID NO: 430026 - DNA, 25 bp, Rattus norvegicus
ggagtctgacagagcagccagcgct

SEQ ID NO: 430027 - DNA, 25 bp, Rattus norvegicus
ggagtctgacagtgcagccagcgct

SEQ ID NO: 430028 - DNA, 25 bp, Rattus norvegicus
ggagtctgagtcagccgggttacaa

SEQ ID NO: 430029 - DNA, 25 bp, Rattus norvegicus
ggagtctgagtctgccgggttacaa

SEQ ID NO: 430030 - DNA, 25 bp, Rattus norvegicus
ggagtctgatctatactgtctgaac

SEQ ID NO: 430031 - DNA, 25 bp, Rattus norvegicus
ggagtctgatctttactgtctgaac

SEQ ID NO: 430032 - DNA, 25 bp, Rattus norvegicus
ggagtctgcacaatttagccatagg

SEQ ID NO: 430033 - DNA, 25 bp, Rattus norvegicus
ggagtctgcacattttagccatagg

SEQ ID NO: 430034 - DNA, 25 bp, Rattus norvegicus
ggagtctgctgacgaccacctgaac

SEQ ID NO: 430035 - DNA, 25 bp, Rattus norvegicus
ggagtctgctgaggaccacctgaac

SEQ ID NO: 430036 - DNA, 25 bp, Rattus norvegicus
ggagtctgctgtcgacggctacaaa

SEQ ID NO: 430037 - DNA, 25 bp, Rattus norvegicus
ggagtctgctgtggacggctacaaa

SEQ ID NO: 430038 - DNA, 25 bp, Rattus norvegicus
ggagtctggacacctacttccaaat

SEQ ID NO: 430039 - DNA, 25 bp, Rattus norvegicus
ggagtctggacagctacttccaaat

SEQ ID NO: 430040 - DNA, 25 bp, Rattus norvegicus
ggagtctggactaagctccatccac

SEQ ID NO: 430041 - DNA, 25 bp, Rattus norvegicus
ggagtctggacttagctccatccac

SEQ ID NO: 430042 - DNA, 25 bp, Rattus norvegicus
ggagtctggtcacttgcaatgctaa

SEQ ID NO: 430043 - DNA, 25 bp, Rattus norvegicus
ggagtctggtcagttgcaatgctaa

SEQ ID NO: 430044 - DNA, 25 bp, Rattus norvegicus
ggagtctgtactcacttacgataga

SEQ ID NO: 430045 - DNA, 25 bp, Rattus norvegicus
ggagtctgtactgacttacgataga

SEQ ID NO: 430046 - DNA, 25 bp, Rattus norvegicus
ggagtctgtagcaatgagccctgaa

SEQ ID NO: 430047 - DNA, 25 bp, Rattus norvegicus
ggagtctgtagctatgagccctgaa

SEQ ID NO: 430048 - DNA, 25 bp, Rattus norvegicus
ggagtctgtcctagtctatatttta

SEQ ID NO: 430049 - DNA, 25 bp, Rattus norvegicus
ggagtctgtccttgtctatatttta

SEQ ID NO: 430050 - DNA, 25 bp, Rattus norvegicus
ggagtctgtgctcaaacaatattaa

SEQ ID NO: 430051 - DNA, 25 bp, Rattus norvegicus
ggagtctgtgctgaaacaatattaa

SEQ ID NO: 430052 - DNA, 25 bp, Rattus norvegicus
ggagtctgttatatttacatctcat

SEQ ID NO: 430053 - DNA, 25 bp, Rattus norvegicus
ggagtctgttatttttacatctcat

SEQ ID NO: 430054 - DNA, 25 bp, Rattus norvegicus
ggagtctgtttgcagtacacaccaa

SEQ ID NO: 430055 - DNA, 25 bp, Rattus norvegicus
ggagtctgtttggagtacacaccaa

SEQ ID NO: 430056 - DNA, 25 bp, Rattus norvegicus
ggagtcttaactctggcaacgccaa

SEQ ID NO: 430057 - DNA, 25 bp, Rattus norvegicus
ggagtcttaactgtggcaacgccaa

SEQ ID NO: 430058 - DNA, 25 bp, Rattus norvegicus
ggagtcttacacaagcgaatgataa

SEQ ID NO: 430059 - DNA, 25 bp, Rattus norvegicus
ggagtcttacactagcgaatgataa

SEQ ID NO: 430060 - DNA, 25 bp, Rattus norvegicus
ggagtcttccttagaattgccttgt

SEQ ID NO: 430061 - DNA, 25 bp, Rattus norvegicus
ggagtcttcctttgaattgccttgt

SEQ ID NO: 430062 - DNA, 25 bp, Rattus norvegicus
ggagtcttcgcaaaagctttcctca

SEQ ID NO: 430063 - DNA, 25 bp, Rattus norvegicus
ggagtcttcgcataagctttcctca

SEQ ID NO: 430064 - DNA, 25 bp, Rattus norvegicus
ggagtcttctgcacaatgcaagtca

SEQ ID NO: 430065 - DNA, 25 bp, Rattus norvegicus
ggagtcttctgctcaatgcaagtca

SEQ ID NO: 430066 - DNA, 25 bp, Rattus norvegicus
ggagtcttgaggacacacccactgt

SEQ ID NO: 430067 - DNA, 25 bp, Rattus norvegicus
ggagtcttgaggtcacacccactgt

SEQ ID NO: 430068 - DNA, 25 bp, Rattus norvegicus
ggagtcttgcctaattctgcctatc

SEQ ID NO: 430069 - DNA, 25 bp, Rattus norvegicus
ggagtcttgccttattctgcctatc

SEQ ID NO: 430070 - DNA, 25 bp, Rattus norvegicus
ggagtcttggtgcaaacatgcattt

SEQ ID NO: 430071 - DNA, 25 bp, Rattus norvegicus
ggagtcttggtggaaacatgcattt

SEQ ID NO: 430072 - DNA, 25 bp, Rattus norvegicus
ggagtcttgtataagtcttcagtgc

SEQ ID NO: 430073 - DNA, 25 bp, Rattus norvegicus
ggagtcttgtattagtcttcagtgc

SEQ ID NO: 430074 - DNA, 25 bp, Rattus norvegicus
ggagtcttgtctatgtcatttcttt

SEQ ID NO: 430075 - DNA, 25 bp, Rattus norvegicus
ggagtcttgtctttgtcatttcttt

SEQ ID NO: 430076 - DNA, 25 bp, Rattus norvegicus
ggagtctttgggagacacataccta

SEQ ID NO: 430077 - DNA, 25 bp, Rattus norvegicus
ggagtctttgggtgacacataccta

SEQ ID NO: 430078 - DNA, 25 bp, Rattus norvegicus
ggagtctttgttactgtcacttaaa

SEQ ID NO: 430079 - DNA, 25 bp, Rattus norvegicus
ggagtctttgtttctgtcacttaaa

SEQ ID NO: 430080 - DNA, 25 bp, Rattus norvegicus
ggagtcttttccattttagagcata

SEQ ID NO: 430081 - DNA, 25 bp, Rattus norvegicus
ggagtcttttcctttttagagcata

SEQ ID NO: 430082 - DNA, 25 bp, Rattus norvegicus
ggagtcttttggacattgatggaaa

SEQ ID NO: 430083 - DNA, 25 bp, Rattus norvegicus
ggagtcttttggcatccggctcatc

SEQ ID NO: 430084 - DNA, 25 bp, Rattus norvegicus
ggagtcttttgggatccggctcatc

SEQ ID NO: 430085 - DNA, 25 bp, Rattus norvegicus
ggagtcttttggtcattgatggaaa

SEQ ID NO: 430086 - DNA, 25 bp, Rattus norvegicus
ggagtgaaacatctgcatctgataa

SEQ ID NO: 430087 - DNA, 25 bp, Rattus norvegicus
ggagtgaaacatgtgcatctgataa

SEQ ID NO: 430088 - DNA, 25 bp, Rattus norvegicus
ggagtgaaagatcctacctcagata

SEQ ID NO: 430089 - DNA, 25 bp, Rattus norvegicus
ggagtgaaagatgctacctcagata

SEQ ID NO: 430090 - DNA, 25 bp, Rattus norvegicus
ggagtgaaatgcctttcctctttat

SEQ ID NO: 430091 - DNA, 25 bp, Rattus norvegicus
ggagtgaaatgcgtttcctctttat

SEQ ID NO: 430092 - DNA, 25 bp, Rattus norvegicus
ggagtgaaccctcatgcctcggaga

SEQ ID NO: 430093 - DNA, 25 bp, Rattus norvegicus
ggagtgaaccctgatgcctcggaga

SEQ ID NO: 430094 - DNA, 25 bp, Rattus norvegicus
ggagtgaagcctccacatgcctatg

SEQ ID NO: 430095 - DNA, 25 bp, Rattus norvegicus
ggagtgaagcctgcacatgcctatg

SEQ ID NO: 430096 - DNA, 25 bp, Rattus norvegicus
ggagtgaagggaccgtcttccctca

SEQ ID NO: 430097 - DNA, 25 bp, Rattus norvegicus
ggagtgaagggagcgtcttccctca

SEQ ID NO: 430098 - DNA, 25 bp, Rattus norvegicus
ggagtgaattatcccaaacaacttg

SEQ ID NO: 430099 - DNA, 25 bp, Rattus norvegicus
ggagtgaattatgccaaacaacttg

SEQ ID NO: 430100 - DNA, 25 bp, Rattus norvegicus
ggagtgacaaaccttctctgtctgt

SEQ ID NO: 430101 - DNA, 25 bp, Rattus norvegicus
ggagtgacaaacgttctctgtctgt

SEQ ID NO: 430102 - DNA, 25 bp, Rattus norvegicus
ggagtgacaactatggtccgagttt

SEQ ID NO: 430103 - DNA, 25 bp, Rattus norvegicus
ggagtgacaactcagccatgctgcc

SEQ ID NO: 430104 - DNA, 25 bp, Rattus norvegicus
ggagtgacaactgagccatgctgcc

SEQ ID NO: 430105 - DNA, 25 bp, Rattus norvegicus
ggagtgacaactttggtccgagttt

SEQ ID NO: 430106 - DNA, 25 bp, Rattus norvegicus
ggagtgacactgcacgagttgctca

SEQ ID NO: 430107 - DNA, 25 bp, Rattus norvegicus
ggagtgacactggacgagttgctca

SEQ ID NO: 430108 - DNA, 25 bp, Rattus norvegicus
ggagtgaccaagaattcccagtcaa

SEQ ID NO: 430109 - DNA, 25 bp, Rattus norvegicus
ggagtgaccaagtattcccagtcaa

SEQ ID NO: 430110 - DNA, 25 bp, Rattus norvegicus
ggagtgaccaccactccaaacacat

SEQ ID NO: 430111 - DNA, 25 bp, Rattus norvegicus
ggagtgaccacctctccaaacacat

SEQ ID NO: 430112 - DNA, 25 bp, Rattus norvegicus
ggagtgaccagcatcgcagcaaaac

SEQ ID NO: 430113 - DNA, 25 bp, Rattus norvegicus
ggagtgaccagcttcgcagcaaaac

SEQ ID NO: 430114 - DNA, 25 bp, Rattus norvegicus
ggagtgacccgcacaaagctaaggt

SEQ ID NO: 430115 - DNA, 25 bp, Rattus norvegicus
ggagtgacccgctcaaagctaaggt

SEQ ID NO: 430116 - DNA, 25 bp, Rattus norvegicus
ggagtgacctaaagcatttcttaaa

SEQ ID NO: 430117 - DNA, 25 bp, Rattus norvegicus
ggagtgacctaatgcatttcttaaa

SEQ ID NO: 430118 - DNA, 25 bp, Rattus norvegicus
ggagtgacctgaaggaccccgtgca

SEQ ID NO: 430119 - DNA, 25 bp, Rattus norvegicus
ggagtgacctgatggaccccgtgca

SEQ ID NO: 430120 - DNA, 25 bp, Rattus norvegicus
ggagtgacctgcatcattttgcctg

SEQ ID NO: 430121 - DNA, 25 bp, Rattus norvegicus
ggagtgacctgcttcattttgcctg

SEQ ID NO: 430122 - DNA, 25 bp, Rattus norvegicus
ggagtgactagcaactggcttcctc

SEQ ID NO: 430123 - DNA, 25 bp, Rattus norvegicus
ggagtgactagctactggcttcctc

SEQ ID NO: 430124 - DNA, 25 bp, Rattus norvegicus
ggagtgacttatattcatcatcgtt

SEQ ID NO: 430125 - DNA, 25 bp, Rattus norvegicus
ggagtgacttattttcatcatcgtt

SEQ ID NO: 430126 - DNA, 25 bp, Rattus norvegicus
ggagtgagatgcagtcatatccccg

SEQ ID NO: 430127 - DNA, 25 bp, Rattus norvegicus
ggagtgagatgctgtcatatccccg

SEQ ID NO: 430128 - DNA, 25 bp, Rattus norvegicus
ggagtgagccaacccaagctctgga

SEQ ID NO: 430129 - DNA, 25 bp, Rattus norvegicus
ggagtgagccaagccaagctctgga

SEQ ID NO: 430130 - DNA, 25 bp, Rattus norvegicus
ggagtgagcctaccatattgcttga

SEQ ID NO: 430131 - DNA, 25 bp, Rattus norvegicus
ggagtgagcctagcatattgcttga

SEQ ID NO: 430132 - DNA, 25 bp, Rattus norvegicus
ggagtgagctcacttgccctctctg

SEQ ID NO: 430133 - DNA, 25 bp, Rattus norvegicus
ggagtgagctcagttgccctctctg

SEQ ID NO: 430134 - DNA, 25 bp, Rattus norvegicus
ggagtgaggccgcttaccttcatag

SEQ ID NO: 430135 - DNA, 25 bp, Rattus norvegicus
ggagtgaggccggttaccttcatag

SEQ ID NO: 430136 - DNA, 25 bp, Rattus norvegicus
ggagtgaggcgcacacttgactcta

SEQ ID NO: 430137 - DNA, 25 bp, Rattus norvegicus
ggagtgaggcgctcacttgactcta

SEQ ID NO: 430138 - DNA, 25 bp, Rattus norvegicus
ggagtgagtcagatctctacttcta

SEQ ID NO: 430139 - DNA, 25 bp, Rattus norvegicus
ggagtgagtcagttctctacttcta

SEQ ID NO: 430140 - DNA, 25 bp, Rattus norvegicus
ggagtgatactgagccatgctggtc

SEQ ID NO: 430141 - DNA, 25 bp, Rattus norvegicus
ggagtgatactgtgccatgctggtc

SEQ ID NO: 430142 - DNA, 25 bp, Rattus norvegicus
ggagtgatcccaccaagaagtctta

SEQ ID NO: 430143 - DNA, 25 bp, Rattus norvegicus
ggagtgatcccagcaagaagtctta

SEQ ID NO: 430144 - DNA, 25 bp, Rattus norvegicus
ggagtgatccccactttgcacctgg

SEQ ID NO: 430145 - DNA, 25 bp, Rattus norvegicus
ggagtgatcccctctttgcacctgg

SEQ ID NO: 430146 - DNA, 25 bp, Rattus norvegicus
ggagtgatcctcaattatttcaagt

SEQ ID NO: 430147 - DNA, 25 bp, Rattus norvegicus
ggagtgatcctctattatttcaagt

SEQ ID NO: 430148 - DNA, 25 bp, Rattus norvegicus
ggagtgatccttcataaaaccagaa

SEQ ID NO: 430149 - DNA, 25 bp, Rattus norvegicus
ggagtgatccttcttgtctgcctta

SEQ ID NO: 430150 - DNA, 25 bp, Rattus norvegicus
ggagtgatccttgataaaaccagaa

SEQ ID NO: 430151 - DNA, 25 bp, Rattus norvegicus
ggagtgatccttgttgtctgcctta

SEQ ID NO: 430152 - DNA, 25 bp, Rattus norvegicus
ggagtgatctccatttccctgcagg

SEQ ID NO: 430153 - DNA, 25 bp, Rattus norvegicus
ggagtgatctccttttccctgcagg

SEQ ID NO: 430154 - DNA, 25 bp, Rattus norvegicus
ggagtgatggttaggctaccttctc

SEQ ID NO: 430155 - DNA, 25 bp, Rattus norvegicus
ggagtgatggtttggctaccttctc

SEQ ID NO: 430156 - DNA, 25 bp, Rattus norvegicus
ggagtgatgtagcttgccctgattc

SEQ ID NO: 430157 - DNA, 25 bp, Rattus norvegicus
ggagtgatgtaggttgccctgattc

SEQ ID NO: 430158 - DNA, 25 bp, Rattus norvegicus
ggagtgattcataagcctaccagct

SEQ ID NO: 430159 - DNA, 25 bp, Rattus norvegicus
ggagtgattcattagcctaccagct

SEQ ID NO: 430160 - DNA, 25 bp, Rattus norvegicus
ggagtgattgtgacaccttcagaaa

SEQ ID NO: 430161 - DNA, 25 bp, Rattus norvegicus
ggagtgattgtgtcaccttcagaaa

SEQ ID NO: 430162 - DNA, 25 bp, Rattus norvegicus
ggagtgcaacggctcttaattcctg

SEQ ID NO: 430163 - DNA, 25 bp, Rattus norvegicus
ggagtgcaacgggtcttaattcctg

SEQ ID NO: 430164 - DNA, 25 bp, Rattus norvegicus
ggagtgcagactacactgattttat

SEQ ID NO: 430165 - DNA, 25 bp, Rattus norvegicus
ggagtgcagacttcactgattttat

SEQ ID NO: 430166 - DNA, 25 bp, Rattus norvegicus
ggagtgccattccaaccaggaggat

SEQ ID NO: 430167 - DNA, 25 bp, Rattus norvegicus
ggagtgccattcgaaccaggaggat

SEQ ID NO: 430168 - DNA, 25 bp, Rattus norvegicus
ggagtgccatttcttctgttatgaa

SEQ ID NO: 430169 - DNA, 25 bp, Rattus norvegicus
ggagtgccatttgttctgttatgaa

SEQ ID NO: 430170 - DNA, 25 bp, Rattus norvegicus
ggagtgcccaggacggatctgctca

SEQ ID NO: 430171 - DNA, 25 bp, Rattus norvegicus
ggagtgcccaggtcggatctgctca

SEQ ID NO: 430172 - DNA, 25 bp, Rattus norvegicus
ggagtgcccctgaatttaaattttg

SEQ ID NO: 430173 - DNA, 25 bp, Rattus norvegicus
ggagtgcccctgtatttaaattttg

SEQ ID NO: 430174 - DNA, 25 bp, Rattus norvegicus
ggagtgccgctgaaactgtgaccaa

SEQ ID NO: 430175 - DNA, 25 bp, Rattus norvegicus
ggagtgccgctgtaactgtgaccaa

SEQ ID NO: 430176 - DNA, 25 bp, Rattus norvegicus
ggagtgccgtagacactgcagccgt

SEQ ID NO: 430177 - DNA, 25 bp, Rattus norvegicus
ggagtgccgtagtcactgcagccgt

SEQ ID NO: 430178 - DNA, 25 bp, Rattus norvegicus
ggagtgccgtatcaatgctcagtga

SEQ ID NO: 430179 - DNA, 25 bp, Rattus norvegicus
ggagtgccgtatgaatgctcagtga

SEQ ID NO: 430180 - DNA, 25 bp, Rattus norvegicus
ggagtgcctcttctaaaagtctgaa

SEQ ID NO: 430181 - DNA, 25 bp, Rattus norvegicus
ggagtgcctcttgtaaaagtctgaa

SEQ ID NO: 430182 - DNA, 25 bp, Rattus norvegicus
ggagtgcgtatcatgacagagtgat

SEQ ID NO: 430183 - DNA, 25 bp, Rattus norvegicus
ggagtgcgtatcttgacagagtgat

SEQ ID NO: 430184 - DNA, 25 bp, Rattus norvegicus
ggagtgctcactaaacattcctcaa

SEQ ID NO: 430185 - DNA, 25 bp, Rattus norvegicus
ggagtgctcacttaacattcctcaa

SEQ ID NO: 430186 - DNA, 25 bp, Rattus norvegicus
ggagtgctcgaaaacctaaacaaag

SEQ ID NO: 430187 - DNA, 25 bp, Rattus norvegicus
ggagtgctcgaatacctaaacaaag

SEQ ID NO: 430188 - DNA, 25 bp, Rattus norvegicus
ggagtgctctgactagtgtactaat

SEQ ID NO: 430189 - DNA, 25 bp, Rattus norvegicus
ggagtgctctgagtagtgtactaat

SEQ ID NO: 430190 - DNA, 25 bp, Rattus norvegicus
ggagtgctctggaccaaaactggcc

SEQ ID NO: 430191 - DNA, 25 bp, Rattus norvegicus
ggagtgctctggtccaaaactggcc

SEQ ID NO: 430192 - DNA, 25 bp, Rattus norvegicus
ggagtgctggccatggtcagttcta

SEQ ID NO: 430193 - DNA, 25 bp, Rattus norvegicus
ggagtgctggccttggtcagttcta

SEQ ID NO: 430194 - DNA, 25 bp, Rattus norvegicus
ggagtgctgtataaccattttactg

SEQ ID NO: 430195 - DNA, 25 bp, Rattus norvegicus
ggagtgctgtattaccattttactg

SEQ ID NO: 430196 - DNA, 25 bp, Rattus norvegicus
ggagtgctgtttcatagtttcctgg

SEQ ID NO: 430197 - DNA, 25 bp, Rattus norvegicus
ggagtgctgtttgatagtttcctgg

SEQ ID NO: 430198 - DNA, 25 bp, Rattus norvegicus
ggagtgcttagccaactgtgcgcca

SEQ ID NO: 430199 - DNA, 25 bp, Rattus norvegicus
ggagtgcttagcgaactgtgcgcca

SEQ ID NO: 430200 - DNA, 25 bp, Rattus norvegicus
ggagtgctttctcggcatgctcaaa

SEQ ID NO: 430201 - DNA, 25 bp, Rattus norvegicus
ggagtgctttctgggcatgctcaaa

SEQ ID NO: 430202 - DNA, 25 bp, Rattus norvegicus
ggagtgcttttgatcttgttgatag

SEQ ID NO: 430203 - DNA, 25 bp, Rattus norvegicus
ggagtgcttttgttcttgttgatag

SEQ ID NO: 430204 - DNA, 25 bp, Rattus norvegicus
ggagtggaaccaacaggacctgtgt

SEQ ID NO: 430205 - DNA, 25 bp, Rattus norvegicus
ggagtggaaccatcaggacctgtgt

SEQ ID NO: 430206 - DNA, 25 bp, Rattus norvegicus
ggagtggacacacgaggatcagcaa

SEQ ID NO: 430207 - DNA, 25 bp, Rattus norvegicus
ggagtggacacaggaggatcagcaa

SEQ ID NO: 430208 - DNA, 25 bp, Rattus norvegicus
ggagtggaccaaagctcttacttaa

SEQ ID NO: 430209 - DNA, 25 bp, Rattus norvegicus
ggagtggaccaatgctcttacttaa

SEQ ID NO: 430210 - DNA, 25 bp, Rattus norvegicus
ggagtggagcttactggaacccctt

SEQ ID NO: 430211 - DNA, 25 bp, Rattus norvegicus
ggagtggagctttctggaacccctt

SEQ ID NO: 430212 - DNA, 25 bp, Rattus norvegicus
ggagtggatgccatcattcagaact

SEQ ID NO: 430213 - DNA, 25 bp, Rattus norvegicus
ggagtggatgccttcattcagaact

SEQ ID NO: 430214 - DNA, 25 bp, Rattus norvegicus
ggagtggcaattattcttcttcttg

SEQ ID NO: 430215 - DNA, 25 bp, Rattus norvegicus
ggagtggcaatttttcttcttcttg

SEQ ID NO: 430216 - DNA, 25 bp, Rattus norvegicus
ggagtggcacttctgccttgagtcc

SEQ ID NO: 430217 - DNA, 25 bp, Rattus norvegicus
ggagtggcacttgtgccttgagtcc

SEQ ID NO: 430218 - DNA, 25 bp, Rattus norvegicus
ggagtggccatcacagagatcacca

SEQ ID NO: 430219 - DNA, 25 bp, Rattus norvegicus
ggagtggccatccaatggatatctt

SEQ ID NO: 430220 - DNA, 25 bp, Rattus norvegicus
ggagtggccatcgaatggatatctt

SEQ ID NO: 430221 - DNA, 25 bp, Rattus norvegicus
ggagtggccatctcagagatcacca

SEQ ID NO: 430222 - DNA, 25 bp, Rattus norvegicus
ggagtggccggcaaagtccacatat

SEQ ID NO: 430223 - DNA, 25 bp, Rattus norvegicus
ggagtggccggctaagtccacatat

SEQ ID NO: 430224 - DNA, 25 bp, Rattus norvegicus
ggagtggcctacagcgaaccccagg

SEQ ID NO: 430225 - DNA, 25 bp, Rattus norvegicus
ggagtggcctactgcgaaccccagg

SEQ ID NO: 430226 - DNA, 25 bp, Rattus norvegicus
ggagtggccttgaagatcgacctaa

SEQ ID NO: 430227 - DNA, 25 bp, Rattus norvegicus
ggagtggccttgtagatcgacctaa

SEQ ID NO: 430228 - DNA, 25 bp, Rattus norvegicus
ggagtggctaaacatggcactgaca

SEQ ID NO: 430229 - DNA, 25 bp, Rattus norvegicus
ggagtggctaaagatggcactgaca

SEQ ID NO: 430230 - DNA, 25 bp, Rattus norvegicus
ggagtggctgtcatggcactgtcac

SEQ ID NO: 430231 - DNA, 25 bp, Rattus norvegicus
ggagtggctgtcttggcactgtcac

SEQ ID NO: 430232 - DNA, 25 bp, Rattus norvegicus
ggagtggcttctactcagctaacct

SEQ ID NO: 430233 - DNA, 25 bp, Rattus norvegicus
ggagtggcttctatttcaagtgcat

SEQ ID NO: 430234 - DNA, 25 bp, Rattus norvegicus
ggagtggcttcttctcagctaacct

SEQ ID NO: 430235 - DNA, 25 bp, Rattus norvegicus
ggagtggcttctttttcaagtgcat

SEQ ID NO: 430236 - DNA, 25 bp, Rattus norvegicus
ggagtgggacccacaggctcctgca

SEQ ID NO: 430237 - DNA, 25 bp, Rattus norvegicus
ggagtgggaccctcaggctcctgca

SEQ ID NO: 430238 - DNA, 25 bp, Rattus norvegicus
ggagtgggcttgataccacctccct

SEQ ID NO: 430239 - DNA, 25 bp, Rattus norvegicus
ggagtgggcttgttaccacctccct

SEQ ID NO: 430240 - DNA, 25 bp, Rattus norvegicus
ggagtgggtcatatctagagttctt

SEQ ID NO: 430241 - DNA, 25 bp, Rattus norvegicus
ggagtgggtcatttctagagttctt

SEQ ID NO: 430242 - DNA, 25 bp, Rattus norvegicus
ggagtgggtctcaagttaatcattt

SEQ ID NO: 430243 - DNA, 25 bp, Rattus norvegicus
ggagtgggtctctagttaatcattt

SEQ ID NO: 430244 - DNA, 25 bp, Rattus norvegicus
ggagtggtctcactctctactgcat

SEQ ID NO: 430245 - DNA, 25 bp, Rattus norvegicus
ggagtggtctcagtctctactgcat

SEQ ID NO: 430246 - DNA, 25 bp, Rattus norvegicus
ggagtggtgcacaaccacaggcatt

SEQ ID NO: 430247 - DNA, 25 bp, Rattus norvegicus
ggagtggtgcactaccacaggcatt

SEQ ID NO: 430248 - DNA, 25 bp, Rattus norvegicus
ggagtggtggtcatcagatgctact

SEQ ID NO: 430249 - DNA, 25 bp, Rattus norvegicus
ggagtggtggtcttcagatgctact

SEQ ID NO: 430250 - DNA, 25 bp, Rattus norvegicus
ggagtgtaagaccatccatgtttat

SEQ ID NO: 430251 - DNA, 25 bp, Rattus norvegicus
ggagtgtaagacgatccatgtttat

SEQ ID NO: 430252 - DNA, 25 bp, Rattus norvegicus
ggagtgtacctcctaatgttcactg

SEQ ID NO: 430253 - DNA, 25 bp, Rattus norvegicus
ggagtgtacctcgtaatgttcactg

SEQ ID NO: 430254 - DNA, 25 bp, Rattus norvegicus
ggagtgtaggagactcttccctctg

SEQ ID NO: 430255 - DNA, 25 bp, Rattus norvegicus
ggagtgtaggagtctcttccctctg

SEQ ID NO: 430256 - DNA, 25 bp, Rattus norvegicus
ggagtgtatagaagcagccgttgca

SEQ ID NO: 430257 - DNA, 25 bp, Rattus norvegicus
ggagtgtatagatgcagccgttgca

SEQ ID NO: 430258 - DNA, 25 bp, Rattus norvegicus
ggagtgtatctgacttaccaagatc

SEQ ID NO: 430259 - DNA, 25 bp, Rattus norvegicus
ggagtgtatctgtcttaccaagatc

SEQ ID NO: 430260 - DNA, 25 bp, Rattus norvegicus
ggagtgtcagccctaggtagacaca

SEQ ID NO: 430261 - DNA, 25 bp, Rattus norvegicus
ggagtgtcagccgtaggtagacaca

SEQ ID NO: 430262 - DNA, 25 bp, Rattus norvegicus
ggagtgtcatgaacagccatcttct

SEQ ID NO: 430263 - DNA, 25 bp, Rattus norvegicus
ggagtgtcatgatcagccatcttct

SEQ ID NO: 430264 - DNA, 25 bp, Rattus norvegicus
ggagtgtccaggctgagttacacaa

SEQ ID NO: 430265 - DNA, 25 bp, Rattus norvegicus
ggagtgtccagggtgagttacacaa

SEQ ID NO: 430266 - DNA, 25 bp, Rattus norvegicus
ggagtgtccccacctggatctgaag

SEQ ID NO: 430267 - DNA, 25 bp, Rattus norvegicus
ggagtgtccccagctggatctgaag

SEQ ID NO: 430268 - DNA, 25 bp, Rattus norvegicus
ggagtgtccggcaaacatgcagcat

SEQ ID NO: 430269 - DNA, 25 bp, Rattus norvegicus
ggagtgtccggctaacatgcagcat

SEQ ID NO: 430270 - DNA, 25 bp, Rattus norvegicus
ggagtgtcggacatattgcttgaat

SEQ ID NO: 430271 - DNA, 25 bp, Rattus norvegicus
ggagtgtcggacttattgcttgaat

SEQ ID NO: 430272 - DNA, 25 bp, Rattus norvegicus
ggagtgtcgttgatacttgtctgcc

SEQ ID NO: 430273 - DNA, 25 bp, Rattus norvegicus
ggagtgtcgttgttacttgtctgcc

SEQ ID NO: 430274 - DNA, 25 bp, Rattus norvegicus
ggagtgtctctaataatggccccga

SEQ ID NO: 430275 - DNA, 25 bp, Rattus norvegicus
ggagtgtctctattaatggccccga

SEQ ID NO: 430276 - DNA, 25 bp, Rattus norvegicus
ggagtgtctgtcctcgtttgataaa

SEQ ID NO: 430277 - DNA, 25 bp, Rattus norvegicus
ggagtgtctgtcgtcgtttgataaa

SEQ ID NO: 430278 - DNA, 25 bp, Rattus norvegicus
ggagtgtcttgacatcacccataaa

SEQ ID NO: 430279 - DNA, 25 bp, Rattus norvegicus
ggagtgtcttgagatcacccataaa

SEQ ID NO: 430280 - DNA, 25 bp, Rattus norvegicus
ggagtgtgacaaagcccttcgtgag

SEQ ID NO: 430281 - DNA, 25 bp, Rattus norvegicus
ggagtgtgacaatgcccttcgtgag

SEQ ID NO: 430282 - DNA, 25 bp, Rattus norvegicus
ggagtgtgagaactcagcccacttg

SEQ ID NO: 430283 - DNA, 25 bp, Rattus norvegicus
ggagtgtgagaagtcagcccacttg

SEQ ID NO: 430284 - DNA, 25 bp, Rattus norvegicus
ggagtgtgagccagtatccttggcc

SEQ ID NO: 430285 - DNA, 25 bp, Rattus norvegicus
ggagtgtgagcctgtatccttggcc

SEQ ID NO: 430286 - DNA, 25 bp, Rattus norvegicus
ggagtgtgagcgagcagtcttcctc

SEQ ID NO: 430287 - DNA, 25 bp, Rattus norvegicus
ggagtgtgagcgtgcagtcttcctc

SEQ ID NO: 430288 - DNA, 25 bp, Rattus norvegicus
ggagtgtgctatcaacttgcctttc

SEQ ID NO: 430289 - DNA, 25 bp, Rattus norvegicus
ggagtgtgctatgaacttgcctttc

SEQ ID NO: 430290 - DNA, 25 bp, Rattus norvegicus
ggagtgtgtgtactcccttggacta

SEQ ID NO: 430291 - DNA, 25 bp, Rattus norvegicus
ggagtgtgtgtagtcccttggacta

SEQ ID NO: 430292 - DNA, 25 bp, Rattus norvegicus
ggagtgtgttgaatcctctggaact

SEQ ID NO: 430293 - DNA, 25 bp, Rattus norvegicus
ggagtgtgttgattcctctggaact

SEQ ID NO: 430294 - DNA, 25 bp, Rattus norvegicus
ggagtgttactaattgcctctactt

SEQ ID NO: 430295 - DNA, 25 bp, Rattus norvegicus
ggagtgttactatttgcctctactt

SEQ ID NO: 430296 - DNA, 25 bp, Rattus norvegicus
ggagtgttcaacagaatgagcttca

SEQ ID NO: 430297 - DNA, 25 bp, Rattus norvegicus
ggagtgttcaactgaatgagcttca

SEQ ID NO: 430298 - DNA, 25 bp, Rattus norvegicus
ggagtgttcctcaatcctaaacttt

SEQ ID NO: 430299 - DNA, 25 bp, Rattus norvegicus
ggagtgttcctctatcctaaacttt

SEQ ID NO: 430300 - DNA, 25 bp, Rattus norvegicus
ggagtgttcttaatatgaaaccatg

SEQ ID NO: 430301 - DNA, 25 bp, Rattus norvegicus
ggagtgttcttattatgaaaccatg

SEQ ID NO: 430302 - DNA, 25 bp, Rattus norvegicus
ggagtgttcttcatttccacagaga

SEQ ID NO: 430303 - DNA, 25 bp, Rattus norvegicus
ggagtgttcttcttttccacagaga

SEQ ID NO: 430304 - DNA, 25 bp, Rattus norvegicus
ggagtgttgcagacgtttcagatga

SEQ ID NO: 430305 - DNA, 25 bp, Rattus norvegicus
ggagtgttgcagtcgtttcagatga

SEQ ID NO: 430306 - DNA, 25 bp, Rattus norvegicus
ggagtgttgtggcttctaatgaatc

SEQ ID NO: 430307 - DNA, 25 bp, Rattus norvegicus
ggagtgttgtgggttctaatgaatc

SEQ ID NO: 430308 - DNA, 25 bp, Rattus norvegicus
ggagtgtttaccatacctatacata

SEQ ID NO: 430309 - DNA, 25 bp, Rattus norvegicus
ggagtgtttaccttacctatacata

SEQ ID NO: 430310 - DNA, 25 bp, Rattus norvegicus
ggagtgtttctcaatgagtctccac

SEQ ID NO: 430311 - DNA, 25 bp, Rattus norvegicus
ggagtgtttctctatgagtctccac

SEQ ID NO: 430312 - DNA, 25 bp, Rattus norvegicus
ggagtgttttggacttgacattttt

SEQ ID NO: 430313 - DNA, 25 bp, Rattus norvegicus
ggagtgttttggtcttgacattttt

SEQ ID NO: 430314 - DNA, 25 bp, Rattus norvegicus
ggagttaaaacaacagctgcacctg

SEQ ID NO: 430315 - DNA, 25 bp, Rattus norvegicus
ggagttaaaacatcagctgcacctg

SEQ ID NO: 430316 - DNA, 25 bp, Rattus norvegicus
ggagttaaactcaataccttcttat

SEQ ID NO: 430317 - DNA, 25 bp, Rattus norvegicus
ggagttaaactctataccttcttat

SEQ ID NO: 430318 - DNA, 25 bp, Rattus norvegicus
ggagttaacctgactctgtgttaga

SEQ ID NO: 430319 - DNA, 25 bp, Rattus norvegicus
ggagttaacctgtctctgtgttaga

SEQ ID NO: 430320 - DNA, 25 bp, Rattus norvegicus
ggagttaaggacctaccatcctcac

SEQ ID NO: 430321 - DNA, 25 bp, Rattus norvegicus
ggagttaaggacgtaccatcctcac

SEQ ID NO: 430322 - DNA, 25 bp, Rattus norvegicus
ggagttacagcaccacaggcccagg

SEQ ID NO: 430323 - DNA, 25 bp, Rattus norvegicus
ggagttacagcagcacaggcccagg

SEQ ID NO: 430324 - DNA, 25 bp, Rattus norvegicus
ggagttacatgaccctgatatgaca

SEQ ID NO: 430325 - DNA, 25 bp, Rattus norvegicus
ggagttacatgagcctgatatgaca

SEQ ID NO: 430326 - DNA, 25 bp, Rattus norvegicus
ggagttacatgtccatgccctgtgc

SEQ ID NO: 430327 - DNA, 25 bp, Rattus norvegicus
ggagttacatgtgcatgccctgtgc

SEQ ID NO: 430328 - DNA, 25 bp, Rattus norvegicus
ggagttaccaatcagactggactta

SEQ ID NO: 430329 - DNA, 25 bp, Rattus norvegicus
ggagttaccaatgagactggactta

SEQ ID NO: 430330 - DNA, 25 bp, Rattus norvegicus
ggagttaccagacacattcccatga

SEQ ID NO: 430331 - DNA, 25 bp, Rattus norvegicus
ggagttaccagagacattcccatga

SEQ ID NO: 430332 - DNA, 25 bp, Rattus norvegicus
ggagttacccataggttggatgtaa

SEQ ID NO: 430333 - DNA, 25 bp, Rattus norvegicus
ggagttacccattggttggatgtaa

SEQ ID NO: 430334 - DNA, 25 bp, Rattus norvegicus
ggagttacctgaagacgaattatga

SEQ ID NO: 430335 - DNA, 25 bp, Rattus norvegicus
ggagttacctgatgacgaattatga

SEQ ID NO: 430336 - DNA, 25 bp, Rattus norvegicus
ggagttacgatccaagacacgctca

SEQ ID NO: 430337 - DNA, 25 bp, Rattus norvegicus
ggagttacgatcgaagacacgctca

SEQ ID NO: 430338 - DNA, 25 bp, Rattus norvegicus
ggagttactcatagctgcctttaaa

SEQ ID NO: 430339 - DNA, 25 bp, Rattus norvegicus
ggagttactcattgctgcctttaaa

SEQ ID NO: 430340 - DNA, 25 bp, Rattus norvegicus
ggagttactggcaaaagcatcatta

SEQ ID NO: 430341 - DNA, 25 bp, Rattus norvegicus
ggagttactggctaaagcatcatta

SEQ ID NO: 430342 - DNA, 25 bp, Rattus norvegicus
ggagttactttgactttctatcaga

SEQ ID NO: 430343 - DNA, 25 bp, Rattus norvegicus
ggagttactttgtctttctatcaga

SEQ ID NO: 430344 - DNA, 25 bp, Rattus norvegicus
ggagttagaactactgtgttcccat

SEQ ID NO: 430345 - DNA, 25 bp, Rattus norvegicus
ggagttagaacttctgtgttcccat

SEQ ID NO: 430346 - DNA, 25 bp, Rattus norvegicus
ggagttagagatcctacctcgtata

SEQ ID NO: 430347 - DNA, 25 bp, Rattus norvegicus
ggagttagagatgctacctcgtata

SEQ ID NO: 430348 - DNA, 25 bp, Rattus norvegicus
ggagttagatagatggaccgtaatt

SEQ ID NO: 430349 - DNA, 25 bp, Rattus norvegicus
ggagttagatagttggaccgtaatt

SEQ ID NO: 430350 - DNA, 25 bp, Rattus norvegicus
ggagttagcaaaaccagggccttgt

SEQ ID NO: 430351 - DNA, 25 bp, Rattus norvegicus
ggagttagcaaatccagggccttgt

SEQ ID NO: 430352 - DNA, 25 bp, Rattus norvegicus
ggagttagcagtatcagtgtggact

SEQ ID NO: 430353 - DNA, 25 bp, Rattus norvegicus
ggagttagcagtttcagtgtggact

SEQ ID NO: 430354 - DNA, 25 bp, Rattus norvegicus
ggagttagccagctttgattttcta

SEQ ID NO: 430355 - DNA, 25 bp, Rattus norvegicus
ggagttagccaggtttgattttcta

SEQ ID NO: 430356 - DNA, 25 bp, Rattus norvegicus
ggagttagcctcagagttcagtgta

SEQ ID NO: 430357 - DNA, 25 bp, Rattus norvegicus
ggagttagcctctgagttcagtgta

SEQ ID NO: 430358 - DNA, 25 bp, Rattus norvegicus
ggagttagcgccattggacaggtaa

SEQ ID NO: 430359 - DNA, 25 bp, Rattus norvegicus
ggagttagcgcctttggacaggtaa

SEQ ID NO: 430360 - DNA, 25 bp, Rattus norvegicus
ggagttatccatcattccataagta

SEQ ID NO: 430361 - DNA, 25 bp, Rattus norvegicus
ggagttatccatgattccataagta

SEQ ID NO: 430362 - DNA, 25 bp, Rattus norvegicus
ggagttattaacacacaattttctt

SEQ ID NO: 430363 - DNA, 25 bp, Rattus norvegicus
ggagttattaacatcaaacagagtc

SEQ ID NO: 430364 - DNA, 25 bp, Rattus norvegicus
ggagttattaactcacaattttctt

SEQ ID NO: 430365 - DNA, 25 bp, Rattus norvegicus
ggagttattaacttcaaacagagtc

SEQ ID NO: 430366 - DNA, 25 bp, Rattus norvegicus
ggagttattccacgcattgcgattc

SEQ ID NO: 430367 - DNA, 25 bp, Rattus norvegicus
ggagttattccaggcattgcgattc

SEQ ID NO: 430368 - DNA, 25 bp, Rattus norvegicus
ggagttattcttacccacctcctgc

SEQ ID NO: 430369 - DNA, 25 bp, Rattus norvegicus
ggagttattctttcccacctcctgc

SEQ ID NO: 430370 - DNA, 25 bp, Rattus norvegicus
ggagttcaaataaatacagacgacc

SEQ ID NO: 430371 - DNA, 25 bp, Rattus norvegicus
ggagttcaaatatatacagacgacc

SEQ ID NO: 430372 - DNA, 25 bp, Rattus norvegicus
ggagttcaacaacacagatcagatt

SEQ ID NO: 430373 - DNA, 25 bp, Rattus norvegicus
ggagttcaacaagacagatcagatt

SEQ ID NO: 430374 - DNA, 25 bp, Rattus norvegicus
ggagttcaagttcataggactaaag

SEQ ID NO: 430375 - DNA, 25 bp, Rattus norvegicus
ggagttcaagttgataggactaaag

SEQ ID NO: 430376 - DNA, 25 bp, Rattus norvegicus
ggagttcacaaaccatttgaccttt

SEQ ID NO: 430377 - DNA, 25 bp, Rattus norvegicus
ggagttcacaaagcatttgaccttt

SEQ ID NO: 430378 - DNA, 25 bp, Rattus norvegicus
ggagttcaccatcttcttttggaaa

SEQ ID NO: 430379 - DNA, 25 bp, Rattus norvegicus
ggagttcaccatgttcttttggaaa

SEQ ID NO: 430380 - DNA, 25 bp, Rattus norvegicus
ggagttcacctcaagatgctgctag

SEQ ID NO: 430381 - DNA, 25 bp, Rattus norvegicus
ggagttcacctccatacagagccag

SEQ ID NO: 430382 - DNA, 25 bp, Rattus norvegicus
ggagttcacctcgatacagagccag

SEQ ID NO: 430383 - DNA, 25 bp, Rattus norvegicus
ggagttcacctctagatgctgctag

SEQ ID NO: 430384 - DNA, 25 bp, Rattus norvegicus
ggagttcacggtctagtttccagaa

SEQ ID NO: 430385 - DNA, 25 bp, Rattus norvegicus
ggagttcacggtgtagtttccagaa

SEQ ID NO: 430386 - DNA, 25 bp, Rattus norvegicus
ggagttcagacacacaacacaccaa

SEQ ID NO: 430387 - DNA, 25 bp, Rattus norvegicus
ggagttcagacagacaacacaccaa

SEQ ID NO: 430388 - DNA, 25 bp, Rattus norvegicus
ggagttcagactacttcatacatgt

SEQ ID NO: 430389 - DNA, 25 bp, Rattus norvegicus
ggagttcagacttcttcatacatgt

SEQ ID NO: 430390 - DNA, 25 bp, Rattus norvegicus
ggagttcagataacggacggcttat

SEQ ID NO: 430391 - DNA, 25 bp, Rattus norvegicus
ggagttcagatatcggacggcttat

SEQ ID NO: 430392 - DNA, 25 bp, Rattus norvegicus
ggagttcagctcagagtcctcgaga

SEQ ID NO: 430393 - DNA, 25 bp, Rattus norvegicus
ggagttcagctctgagtcctcgaga

SEQ ID NO: 430394 - DNA, 25 bp, Rattus norvegicus
ggagttcagtccatcagagtctgat

SEQ ID NO: 430395 - DNA, 25 bp, Rattus norvegicus
ggagttcagtccttcagagtctgat

SEQ ID NO: 430396 - DNA, 25 bp, Rattus norvegicus
ggagttcagtttccgcctctttcta

SEQ ID NO: 430397 - DNA, 25 bp, Rattus norvegicus
ggagttcagtttgcgcctctttcta

SEQ ID NO: 430398 - DNA, 25 bp, Rattus norvegicus
ggagttcatctgatcagttcagggt

SEQ ID NO: 430399 - DNA, 25 bp, Rattus norvegicus
ggagttcatctgttcagttcagggt

SEQ ID NO: 430400 - DNA, 25 bp, Rattus norvegicus
ggagttcattcgaagagcacggaga

SEQ ID NO: 430401 - DNA, 25 bp, Rattus norvegicus
ggagttcattcgtagagcacggaga

SEQ ID NO: 430402 - DNA, 25 bp, Rattus norvegicus
ggagttcatttcactgtagactgta

SEQ ID NO: 430403 - DNA, 25 bp, Rattus norvegicus
ggagttcatttctctgtagactgta

SEQ ID NO: 430404 - DNA, 25 bp, Rattus norvegicus
ggagttccaagcaaaccagagctgc

SEQ ID NO: 430405 - DNA, 25 bp, Rattus norvegicus
ggagttccaagctaaccagagctgc

SEQ ID NO: 430406 - DNA, 25 bp, Rattus norvegicus
ggagttccacttagcagttatcctg

SEQ ID NO: 430407 - DNA, 25 bp, Rattus norvegicus
ggagttccactttgcagttatcctg

SEQ ID NO: 430408 - DNA, 25 bp, Rattus norvegicus
ggagttccccaacatagccttatga

SEQ ID NO: 430409 - DNA, 25 bp, Rattus norvegicus
ggagttccccaagatagccttatga

SEQ ID NO: 430410 - DNA, 25 bp, Rattus norvegicus
ggagttccctgaagagatcgacttt

SEQ ID NO: 430411 - DNA, 25 bp, Rattus norvegicus
ggagttccctgatgagatcgacttt

SEQ ID NO: 430412 - DNA, 25 bp, Rattus norvegicus
ggagttccctgcagtaatgccaaag

SEQ ID NO: 430413 - DNA, 25 bp, Rattus norvegicus
ggagttccctgctgtaatgccaaag

SEQ ID NO: 430414 - DNA, 25 bp, Rattus norvegicus
ggagttcctaatacccatttaccat

SEQ ID NO: 430415 - DNA, 25 bp, Rattus norvegicus
ggagttcctaattcccatttaccat

SEQ ID NO: 430416 - DNA, 25 bp, Rattus norvegicus
ggagttcctgtccaaggtcaagcaa

SEQ ID NO: 430417 - DNA, 25 bp, Rattus norvegicus
ggagttcctgtcgaaggtcaagcaa

SEQ ID NO: 430418 - DNA, 25 bp, Rattus norvegicus
ggagttccttagaggcaaaacgcct

SEQ ID NO: 430419 - DNA, 25 bp, Rattus norvegicus
ggagttccttagtggcaaaacgcct

SEQ ID NO: 430420 - DNA, 25 bp, Rattus norvegicus
ggagttccttttactcagatgatct

SEQ ID NO: 430421 - DNA, 25 bp, Rattus norvegicus
ggagttcctttttctcagatgatct

SEQ ID NO: 430422 - DNA, 25 bp, Rattus norvegicus
ggagttcgccagacaagagcttcag

SEQ ID NO: 430423 - DNA, 25 bp, Rattus norvegicus
ggagttcgccagtcaagagcttcag

SEQ ID NO: 430424 - DNA, 25 bp, Rattus norvegicus
ggagttcggctcagtgaacacccaa

SEQ ID NO: 430425 - DNA, 25 bp, Rattus norvegicus
ggagttcggctctgtgaacacccaa

SEQ ID NO: 430426 - DNA, 25 bp, Rattus norvegicus
ggagttcgtcgtcccggatctgacc

SEQ ID NO: 430427 - DNA, 25 bp, Rattus norvegicus
ggagttcgtcgtgccggatctgacc

SEQ ID NO: 430428 - DNA, 25 bp, Rattus norvegicus
ggagttctatacagtttagtcatca

SEQ ID NO: 430429 - DNA, 25 bp, Rattus norvegicus
ggagttctatactgtttagtcatca

SEQ ID NO: 430430 - DNA, 25 bp, Rattus norvegicus
ggagttctcagtagtgctaggttac

SEQ ID NO: 430431 - DNA, 25 bp, Rattus norvegicus
ggagttctcagttgtgctaggttac

SEQ ID NO: 430432 - DNA, 25 bp, Rattus norvegicus
ggagttctcatcatctacttgttta

SEQ ID NO: 430433 - DNA, 25 bp, Rattus norvegicus
ggagttctcatcttctacttgttta

SEQ ID NO: 430434 - DNA, 25 bp, Rattus norvegicus
ggagttctccacctgggtgacctac

SEQ ID NO: 430435 - DNA, 25 bp, Rattus norvegicus
ggagttctccacgtgggtgacctac

SEQ ID NO: 430436 - DNA, 25 bp, Rattus norvegicus
ggagttctcctaccctggctatctg

SEQ ID NO: 430437 - DNA, 25 bp, Rattus norvegicus
ggagttctcctagcctggctatctg

SEQ ID NO: 430438 - DNA, 25 bp, Rattus norvegicus
ggagttctctaacacactgtggtga

SEQ ID NO: 430439 - DNA, 25 bp, Rattus norvegicus
ggagttctctaagacactgtggtga

SEQ ID NO: 430440 - DNA, 25 bp, Rattus norvegicus
ggagttctcttgctaatgacatctt

SEQ ID NO: 430441 - DNA, 25 bp, Rattus norvegicus
ggagttctcttggtaatgacatctt

SEQ ID NO: 430442 - DNA, 25 bp, Rattus norvegicus
ggagttctgagccaactagttagca

SEQ ID NO: 430443 - DNA, 25 bp, Rattus norvegicus
ggagttctgagcgaactagttagca

SEQ ID NO: 430444 - DNA, 25 bp, Rattus norvegicus
ggagttctgagtaaagtaccaccct

SEQ ID NO: 430445 - DNA, 25 bp, Rattus norvegicus
ggagttctgagttaagtaccaccct

SEQ ID NO: 430446 - DNA, 25 bp, Rattus norvegicus
ggagttctgggacgccccagccaca

SEQ ID NO: 430447 - DNA, 25 bp, Rattus norvegicus
ggagttctgggaggccccagccaca

SEQ ID NO: 430448 - DNA, 25 bp, Rattus norvegicus
ggagttcttcaaaaccactgtcttg

SEQ ID NO: 430449 - DNA, 25 bp, Rattus norvegicus
ggagttcttcaataccactgtcttg

SEQ ID NO: 430450 - DNA, 25 bp, Rattus norvegicus
ggagttcttcccactaaactaatct

SEQ ID NO: 430451 - DNA, 25 bp, Rattus norvegicus
ggagttcttccctctaaactaatct

SEQ ID NO: 430452 - DNA, 25 bp, Rattus norvegicus
ggagttcttcctaatgctgtcagag

SEQ ID NO: 430453 - DNA, 25 bp, Rattus norvegicus
ggagttcttccttatgctgtcagag

SEQ ID NO: 430454 - DNA, 25 bp, Rattus norvegicus
ggagttctttgtcattacctttatg

SEQ ID NO: 430455 - DNA, 25 bp, Rattus norvegicus
ggagttctttgtgattacctttatg

SEQ ID NO: 430456 - DNA, 25 bp, Rattus norvegicus
ggagttgaactgatcaccctggagg

SEQ ID NO: 430457 - DNA, 25 bp, Rattus norvegicus
ggagttgaactgttcaccctggagg

SEQ ID NO: 430458 - DNA, 25 bp, Rattus norvegicus
ggagttgaatcccagtttaccactg

SEQ ID NO: 430459 - DNA, 25 bp, Rattus norvegicus
ggagttgaatccgagtttaccactg

SEQ ID NO: 430460 - DNA, 25 bp, Rattus norvegicus
ggagttgactagatcatactgactg

SEQ ID NO: 430461 - DNA, 25 bp, Rattus norvegicus
ggagttgactagttcatactgactg

SEQ ID NO: 430462 - DNA, 25 bp, Rattus norvegicus
ggagttgagactagactctctctcc

SEQ ID NO: 430463 - DNA, 25 bp, Rattus norvegicus
ggagttgagacttgactctctctcc

SEQ ID NO: 430464 - DNA, 25 bp, Rattus norvegicus
ggagttgatcatccacttccacaaa

SEQ ID NO: 430465 - DNA, 25 bp, Rattus norvegicus
ggagttgatcatgcacttccacaaa

SEQ ID NO: 430466 - DNA, 25 bp, Rattus norvegicus
ggagttgatcttcggctggaccaca

SEQ ID NO: 430467 - DNA, 25 bp, Rattus norvegicus
ggagttgatcttgggctggaccaca

SEQ ID NO: 430468 - DNA, 25 bp, Rattus norvegicus
ggagttgcagacataccgttatcat

SEQ ID NO: 430469 - DNA, 25 bp, Rattus norvegicus
ggagttgcagacttaccgttatcat

SEQ ID NO: 430470 - DNA, 25 bp, Rattus norvegicus
ggagttgccagcaggcgagtcctca

SEQ ID NO: 430471 - DNA, 25 bp, Rattus norvegicus
ggagttgccagctggcgagtcctca

SEQ ID NO: 430472 - DNA, 25 bp, Rattus norvegicus
ggagttgcccgaagcgaccagtgaa

SEQ ID NO: 430473 - DNA, 25 bp, Rattus norvegicus
ggagttgcccgatgcgaccagtgaa

SEQ ID NO: 430474 - DNA, 25 bp, Rattus norvegicus
ggagttgcctaaaccatgtgtgtga

SEQ ID NO: 430475 - DNA, 25 bp, Rattus norvegicus
ggagttgcctaatccatgtgtgtga

SEQ ID NO: 430476 - DNA, 25 bp, Rattus norvegicus
ggagttgctgatctggctgcaccaa

SEQ ID NO: 430477 - DNA, 25 bp, Rattus norvegicus
ggagttgctgatgtggctgcaccaa

SEQ ID NO: 430478 - DNA, 25 bp, Rattus norvegicus
ggagttgctgtcacttcgggacatt

SEQ ID NO: 430479 - DNA, 25 bp, Rattus norvegicus
ggagttgctgtctcttcgggacatt

SEQ ID NO: 430480 - DNA, 25 bp, Rattus norvegicus
ggagttgctgtgacaatttgtttca

SEQ ID NO: 430481 - DNA, 25 bp, Rattus norvegicus
ggagttgctgtgtcaatttgtttca

SEQ ID NO: 430482 - DNA, 25 bp, Rattus norvegicus
ggagttgcttgcaatcccgcgtgtc

SEQ ID NO: 430483 - DNA, 25 bp, Rattus norvegicus
ggagttgcttgctatcccgcgtgtc

SEQ ID NO: 430484 - DNA, 25 bp, Rattus norvegicus
ggagttggaccaagttgaacctgta

SEQ ID NO: 430485 - DNA, 25 bp, Rattus norvegicus
ggagttggaccatgttgaacctgta

SEQ ID NO: 430486 - DNA, 25 bp, Rattus norvegicus
ggagttggacttcgtttccccatag

SEQ ID NO: 430487 - DNA, 25 bp, Rattus norvegicus
ggagttggacttggtttccccatag

SEQ ID NO: 430488 - DNA, 25 bp, Rattus norvegicus
ggagttggagttcattcatattaca

SEQ ID NO: 430489 - DNA, 25 bp, Rattus norvegicus
ggagttggagttgattcatattaca

SEQ ID NO: 430490 - DNA, 25 bp, Rattus norvegicus
ggagttggcaaactggccacatcta

SEQ ID NO: 430491 - DNA, 25 bp, Rattus norvegicus
ggagttggcaaagtggccacatcta

SEQ ID NO: 430492 - DNA, 25 bp, Rattus norvegicus
ggagttggccgtaaaaatccaccat

SEQ ID NO: 430493 - DNA, 25 bp, Rattus norvegicus
ggagttggccgttaaaatccaccat

SEQ ID NO: 430494 - DNA, 25 bp, Rattus norvegicus
ggagttgtaccccaagagcatgcta

SEQ ID NO: 430495 - DNA, 25 bp, Rattus norvegicus
ggagttgtacccgaagagcatgcta

SEQ ID NO: 430496 - DNA, 25 bp, Rattus norvegicus
ggagttgtactgatacacacacaaa

SEQ ID NO: 430497 - DNA, 25 bp, Rattus norvegicus
ggagttgtactgttacacacacaaa

SEQ ID NO: 430498 - DNA, 25 bp, Rattus norvegicus
ggagttgtagccaaggctttcccag

SEQ ID NO: 430499 - DNA, 25 bp, Rattus norvegicus
ggagttgtagcctaggctttcccag

SEQ ID NO: 430500 - DNA, 25 bp, Rattus norvegicus
ggagttgtcgatagcccagtgaagt

SEQ ID NO: 430501 - DNA, 25 bp, Rattus norvegicus
ggagttgtcgattgcccagtgaagt

SEQ ID NO: 430502 - DNA, 25 bp, Rattus norvegicus
ggagttgtctctccccaccactgtg

SEQ ID NO: 430503 - DNA, 25 bp, Rattus norvegicus
ggagttgtctctgcccaccactgtg

SEQ ID NO: 430504 - DNA, 25 bp, Rattus norvegicus
ggagttgtcttccaaaacctttgcg

SEQ ID NO: 430505 - DNA, 25 bp, Rattus norvegicus
ggagttgtcttcgaaaacctttgcg

SEQ ID NO: 430506 - DNA, 25 bp, Rattus norvegicus
ggagttgtgaagaccctggagacaa

SEQ ID NO: 430507 - DNA, 25 bp, Rattus norvegicus
ggagttgtgaagtccctggagacaa

SEQ ID NO: 430508 - DNA, 25 bp, Rattus norvegicus
ggagttgttccactaagagatctaa

SEQ ID NO: 430509 - DNA, 25 bp, Rattus norvegicus
ggagttgttccagtaagagatctaa

SEQ ID NO: 430510 - DNA, 25 bp, Rattus norvegicus
ggagttgttgccctcaaagccatta

SEQ ID NO: 430511 - DNA, 25 bp, Rattus norvegicus
ggagttgttgccgtcaaagccatta

SEQ ID NO: 430512 - DNA, 25 bp, Rattus norvegicus
ggagttgtttttcagatcttcaata

SEQ ID NO: 430513 - DNA, 25 bp, Rattus norvegicus
ggagttgtttttgagatcttcaata

SEQ ID NO: 430514 - DNA, 25 bp, Rattus norvegicus
ggagtttaaaatcatatcctactaa

SEQ ID NO: 430515 - DNA, 25 bp, Rattus norvegicus
ggagtttaaaatgatatcctactaa

SEQ ID NO: 430516 - DNA, 25 bp, Rattus norvegicus
ggagtttaaccaccttcattctagc

SEQ ID NO: 430517 - DNA, 25 bp, Rattus norvegicus
ggagtttaaccagcttcattctagc

SEQ ID NO: 430518 - DNA, 25 bp, Rattus norvegicus
ggagtttaacttctgatggcttcta

SEQ ID NO: 430519 - DNA, 25 bp, Rattus norvegicus
ggagtttaacttgtgatggcttcta

SEQ ID NO: 430520 - DNA, 25 bp, Rattus norvegicus
ggagtttaaggccttccatagccca

SEQ ID NO: 430521 - DNA, 25 bp, Rattus norvegicus
ggagtttaaggcgttccatagccca

SEQ ID NO: 430522 - DNA, 25 bp, Rattus norvegicus
ggagtttacactcaatgtctgggta

SEQ ID NO: 430523 - DNA, 25 bp, Rattus norvegicus
ggagtttacactgaatgtctgggta

SEQ ID NO: 430524 - DNA, 25 bp, Rattus norvegicus
ggagtttacagcatttcacgccatg

SEQ ID NO: 430525 - DNA, 25 bp, Rattus norvegicus
ggagtttacagcttttcacgccatg

SEQ ID NO: 430526 - DNA, 25 bp, Rattus norvegicus
ggagtttaccaactcacctatactg

SEQ ID NO: 430527 - DNA, 25 bp, Rattus norvegicus
ggagtttaccaagtcacctatactg

SEQ ID NO: 430528 - DNA, 25 bp, Rattus norvegicus
ggagtttaccatacccaaattctgt

SEQ ID NO: 430529 - DNA, 25 bp, Rattus norvegicus
ggagtttaccattcccaaattctgt

SEQ ID NO: 430530 - DNA, 25 bp, Rattus norvegicus
ggagtttaccttactactcagaatt

SEQ ID NO: 430531 - DNA, 25 bp, Rattus norvegicus
ggagtttacctttctactcagaatt

SEQ ID NO: 430532 - DNA, 25 bp, Rattus norvegicus
ggagtttactagatcatctttcaga

SEQ ID NO: 430533 - DNA, 25 bp, Rattus norvegicus
ggagtttactagttcatctttcaga

SEQ ID NO: 430534 - DNA, 25 bp, Rattus norvegicus
ggagtttactttccccatggcatga

SEQ ID NO: 430535 - DNA, 25 bp, Rattus norvegicus
ggagtttactttgcccatggcatga

SEQ ID NO: 430536 - DNA, 25 bp, Rattus norvegicus
ggagtttagcagatcttgtgtgtaa

SEQ ID NO: 430537 - DNA, 25 bp, Rattus norvegicus
ggagtttagcagttcttgtgtgtaa

SEQ ID NO: 430538 - DNA, 25 bp, Rattus norvegicus
ggagtttagcccacccagaagacat

SEQ ID NO: 430539 - DNA, 25 bp, Rattus norvegicus
ggagtttagccctcccagaagacat

SEQ ID NO: 430540 - DNA, 25 bp, Rattus norvegicus
ggagtttataatcaccttgtaacac

SEQ ID NO: 430541 - DNA, 25 bp, Rattus norvegicus
ggagtttataatgaccttgtaacac

SEQ ID NO: 430542 - DNA, 25 bp, Rattus norvegicus
ggagtttcaataccggagatcatgc

SEQ ID NO: 430543 - DNA, 25 bp, Rattus norvegicus
ggagtttcaatagcggagatcatgc

SEQ ID NO: 430544 - DNA, 25 bp, Rattus norvegicus
ggagtttcactcctatatattaaca

SEQ ID NO: 430545 - DNA, 25 bp, Rattus norvegicus
ggagtttcactcgtatatattaaca

SEQ ID NO: 430546 - DNA, 25 bp, Rattus norvegicus
ggagtttcagagactggcctctcag

SEQ ID NO: 430547 - DNA, 25 bp, Rattus norvegicus
ggagtttcagagtctggcctctcag

SEQ ID NO: 430548 - DNA, 25 bp, Rattus norvegicus
ggagtttcagtgattgccagggcaa

SEQ ID NO: 430549 - DNA, 25 bp, Rattus norvegicus
ggagtttcagtgtttgccagggcaa

SEQ ID NO: 430550 - DNA, 25 bp, Rattus norvegicus
ggagtttcatcacagttgccagtgt

SEQ ID NO: 430551 - DNA, 25 bp, Rattus norvegicus
ggagtttcatcagagttgccagtgt

SEQ ID NO: 430552 - DNA, 25 bp, Rattus norvegicus
ggagtttccagacaaattcttctga

SEQ ID NO: 430553 - DNA, 25 bp, Rattus norvegicus
ggagtttccagagaaattcttctga

SEQ ID NO: 430554 - DNA, 25 bp, Rattus norvegicus
ggagtttcccagagcgtcctgtaaa

SEQ ID NO: 430555 - DNA, 25 bp, Rattus norvegicus
ggagtttcccagtgcgtcctgtaaa

SEQ ID NO: 430556 - DNA, 25 bp, Rattus norvegicus
ggagtttccctgcaggcacaaggac

SEQ ID NO: 430557 - DNA, 25 bp, Rattus norvegicus
ggagtttccctggaggcacaaggac

SEQ ID NO: 430558 - DNA, 25 bp, Rattus norvegicus
ggagtttcctgtattttatgcttag

SEQ ID NO: 430559 - DNA, 25 bp, Rattus norvegicus
ggagtttcctgttttttatgcttag

SEQ ID NO: 430560 - DNA, 25 bp, Rattus norvegicus
ggagtttccttaaagccgcagtttg

SEQ ID NO: 430561 - DNA, 25 bp, Rattus norvegicus
ggagtttccttatagccgcagtttg

SEQ ID NO: 430562 - DNA, 25 bp, Rattus norvegicus
ggagtttcgaccaagtgctccttac

SEQ ID NO: 430563 - DNA, 25 bp, Rattus norvegicus
ggagtttcgacctagtgctccttac

SEQ ID NO: 430564 - DNA, 25 bp, Rattus norvegicus
ggagtttcggacacagtcttaccat

SEQ ID NO: 430565 - DNA, 25 bp, Rattus norvegicus
ggagtttcggactcagtcttaccat

SEQ ID NO: 430566 - DNA, 25 bp, Rattus norvegicus
ggagtttctaatatcacccagacat

SEQ ID NO: 430567 - DNA, 25 bp, Rattus norvegicus
ggagtttctaatccatggtacagtt

SEQ ID NO: 430568 - DNA, 25 bp, Rattus norvegicus
ggagtttctaatgcatggtacagtt

SEQ ID NO: 430569 - DNA, 25 bp, Rattus norvegicus
ggagtttctaatttcacccagacat

SEQ ID NO: 430570 - DNA, 25 bp, Rattus norvegicus
ggagtttctcatccattgtcgatct

SEQ ID NO: 430571 - DNA, 25 bp, Rattus norvegicus
ggagtttctcatgcattgtcgatct

SEQ ID NO: 430572 - DNA, 25 bp, Rattus norvegicus
ggagtttctcttcaatatgtattta

SEQ ID NO: 430573 - DNA, 25 bp, Rattus norvegicus
ggagtttctcttgaatatgtattta

SEQ ID NO: 430574 - DNA, 25 bp, Rattus norvegicus
ggagtttctgaacctgtgacgcccc

SEQ ID NO: 430575 - DNA, 25 bp, Rattus norvegicus
ggagtttctgaagctgtgacgcccc

SEQ ID NO: 430576 - DNA, 25 bp, Rattus norvegicus
ggagtttgagatacttatgccacaa

SEQ ID NO: 430577 - DNA, 25 bp, Rattus norvegicus
ggagtttgagattcttatgccacaa

SEQ ID NO: 430578 - DNA, 25 bp, Rattus norvegicus
ggagtttgatccaaccataaccgat

SEQ ID NO: 430579 - DNA, 25 bp, Rattus norvegicus
ggagtttgatcctaccataaccgat

SEQ ID NO: 430580 - DNA, 25 bp, Rattus norvegicus
ggagtttgatctctagtttcttcat

SEQ ID NO: 430581 - DNA, 25 bp, Rattus norvegicus
ggagtttgatctgtagtttcttcat

SEQ ID NO: 430582 - DNA, 25 bp, Rattus norvegicus
ggagtttgcattactcaacatcatt

SEQ ID NO: 430583 - DNA, 25 bp, Rattus norvegicus
ggagtttgcatttctcaacatcatt

SEQ ID NO: 430584 - DNA, 25 bp, Rattus norvegicus
ggagtttgccaccagcagcttataa

SEQ ID NO: 430585 - DNA, 25 bp, Rattus norvegicus
ggagtttgccacgagcagcttataa

SEQ ID NO: 430586 - DNA, 25 bp, Rattus norvegicus
ggagtttgctcgcatcatgaccatg

SEQ ID NO: 430587 - DNA, 25 bp, Rattus norvegicus
ggagtttgctcggatcatgaccatg

SEQ ID NO: 430588 - DNA, 25 bp, Rattus norvegicus
ggagtttgctttcggacttgagcca

SEQ ID NO: 430589 - DNA, 25 bp, Rattus norvegicus
ggagtttgctttgggacttgagcca

SEQ ID NO: 430590 - DNA, 25 bp, Rattus norvegicus
ggagtttgggacctgttgaccaact

SEQ ID NO: 430591 - DNA, 25 bp, Rattus norvegicus
ggagtttgggacgtgttgaccaact

SEQ ID NO: 430592 - DNA, 25 bp, Rattus norvegicus
ggagtttggtccatgggatctgcaa

SEQ ID NO: 430593 - DNA, 25 bp, Rattus norvegicus
ggagtttggtccttgggatctgcaa

SEQ ID NO: 430594 - DNA, 25 bp, Rattus norvegicus
ggagtttgtaaaaaatcgctcacta

SEQ ID NO: 430595 - DNA, 25 bp, Rattus norvegicus
ggagtttgtaaataatcgctcacta

SEQ ID NO: 430596 - DNA, 25 bp, Rattus norvegicus
ggagtttgtcccaaagcctaacctg

SEQ ID NO: 430597 - DNA, 25 bp, Rattus norvegicus
ggagtttgtccctaagcctaacctg

SEQ ID NO: 430598 - DNA, 25 bp, Rattus norvegicus
ggagtttgtgtcagctgtacagtat

SEQ ID NO: 430599 - DNA, 25 bp, Rattus norvegicus
ggagtttgtgtctgctgtacagtat

SEQ ID NO: 430600 - DNA, 25 bp, Rattus norvegicus
ggagtttgtgttactctaaattgac

SEQ ID NO: 430601 - DNA, 25 bp, Rattus norvegicus
ggagtttgtgtttctctaaattgac

SEQ ID NO: 430602 - DNA, 25 bp, Rattus norvegicus
ggagtttgttcgctgttaatttctt

SEQ ID NO: 430603 - DNA, 25 bp, Rattus norvegicus
ggagtttgttcggtgttaatttctt

SEQ ID NO: 430604 - DNA, 25 bp, Rattus norvegicus
ggagttttcattaattgtgttctaa

SEQ ID NO: 430605 - DNA, 25 bp, Rattus norvegicus
ggagttttcatttattgtgttctaa

SEQ ID NO: 430606 - DNA, 25 bp, Rattus norvegicus
ggagttttccaaatctcttctggtt

SEQ ID NO: 430607 - DNA, 25 bp, Rattus norvegicus
ggagttttccaattctcttctggtt

SEQ ID NO: 430608 - DNA, 25 bp, Rattus norvegicus
ggagttttcctcaagaccaagatgg

SEQ ID NO: 430609 - DNA, 25 bp, Rattus norvegicus
ggagttttcctctagaccaagatgg

SEQ ID NO: 430610 - DNA, 25 bp, Rattus norvegicus
ggagttttctgaacattcgctgctt

SEQ ID NO: 430611 - DNA, 25 bp, Rattus norvegicus
ggagttttctgatcattcgctgctt

SEQ ID NO: 430612 - DNA, 25 bp, Rattus norvegicus
ggagttttgattcttgacctacctt

SEQ ID NO: 430613 - DNA, 25 bp, Rattus norvegicus
ggagttttgattgttgacctacctt

SEQ ID NO: 430614 - DNA, 25 bp, Rattus norvegicus
ggagttttgcatctcatgtccaagt

SEQ ID NO: 430615 - DNA, 25 bp, Rattus norvegicus
ggagttttgcatgtcatgtccaagt

SEQ ID NO: 430616 - DNA, 25 bp, Rattus norvegicus
ggagttttgcccactgctctggagc

SEQ ID NO: 430617 - DNA, 25 bp, Rattus norvegicus
ggagttttgccctctgctctggagc

SEQ ID NO: 430618 - DNA, 25 bp, Rattus norvegicus
ggagttttgctcaatggcagatcct

SEQ ID NO: 430619 - DNA, 25 bp, Rattus norvegicus
ggagttttgctctatggcagatcct

SEQ ID NO: 430620 - DNA, 25 bp, Rattus norvegicus
ggagttttggaccacttgctagcag

SEQ ID NO: 430621 - DNA, 25 bp, Rattus norvegicus
ggagttttggacgacttgctagcag

SEQ ID NO: 430622 - DNA, 25 bp, Rattus norvegicus
ggagttttgtcccaataccaagatg

SEQ ID NO: 430623 - DNA, 25 bp, Rattus norvegicus
ggagttttgtccgaataccaagatg

SEQ ID NO: 430624 - DNA, 25 bp, Rattus norvegicus
ggagtttttggtcttcttcctcctg

SEQ ID NO: 430625 - DNA, 25 bp, Rattus norvegicus
ggagtttttggtgttcttcctcctg

SEQ ID NO: 430626 - DNA, 25 bp, Rattus norvegicus
ggataaaacatccatcttcaggaaa

SEQ ID NO: 430627 - DNA, 25 bp, Rattus norvegicus
ggataaaacatcgatcttcaggaaa

SEQ ID NO: 430628 - DNA, 25 bp, Rattus norvegicus
ggataaaactccaggacacactgcc

SEQ ID NO: 430629 - DNA, 25 bp, Rattus norvegicus
ggataaaactcctggacacactgcc

SEQ ID NO: 430630 - DNA, 25 bp, Rattus norvegicus
ggataaaagcccagtccgggactgg

SEQ ID NO: 430631 - DNA, 25 bp, Rattus norvegicus
ggataaaagccctgtccgggactgg

SEQ ID NO: 430632 - DNA, 25 bp, Rattus norvegicus
ggataaaatgaaaacccagctctgg

SEQ ID NO: 430633 - DNA, 25 bp, Rattus norvegicus
ggataaaatgaatacccagctctgg

SEQ ID NO: 430634 - DNA, 25 bp, Rattus norvegicus
ggataaaatgtgatttcaactctta

SEQ ID NO: 430635 - DNA, 25 bp, Rattus norvegicus
ggataaaatgtgttttcaactctta

SEQ ID NO: 430636 - DNA, 25 bp, Rattus norvegicus
ggataaacacttctgcatctattga

SEQ ID NO: 430637 - DNA, 25 bp, Rattus norvegicus
ggataaacacttgtgcatctattga

SEQ ID NO: 430638 - DNA, 25 bp, Rattus norvegicus
ggataaaccgtcctgacttcaagtt

SEQ ID NO: 430639 - DNA, 25 bp, Rattus norvegicus
ggataaaccgtcgtgacttcaagtt

SEQ ID NO: 430640 - DNA, 25 bp, Rattus norvegicus
ggataaacctgcatttcacaaacca

SEQ ID NO: 430641 - DNA, 25 bp, Rattus norvegicus
ggataaacctgcttttcacaaacca

SEQ ID NO: 430642 - DNA, 25 bp, Rattus norvegicus
ggataaactactatgctactactgt

SEQ ID NO: 430643 - DNA, 25 bp, Rattus norvegicus
ggataaactactttgctactactgt

SEQ ID NO: 430644 - DNA, 25 bp, Rattus norvegicus
ggataaactcttagaaactcatctt

SEQ ID NO: 430645 - DNA, 25 bp, Rattus norvegicus
ggataaactcttcactatctcagta

SEQ ID NO: 430646 - DNA, 25 bp, Rattus norvegicus
ggataaactcttgactatctcagta

SEQ ID NO: 430647 - DNA, 25 bp, Rattus norvegicus
ggataaactctttgaaactcatctt

SEQ ID NO: 430648 - DNA, 25 bp, Rattus norvegicus
ggataaactgtcaacttctaagaga

SEQ ID NO: 430649 - DNA, 25 bp, Rattus norvegicus
ggataaactgtctacttctaagaga

SEQ ID NO: 430650 - DNA, 25 bp, Rattus norvegicus
ggataaagactgactgcgcacagga

SEQ ID NO: 430651 - DNA, 25 bp, Rattus norvegicus
ggataaagactgtctgcgcacagga

SEQ ID NO: 430652 - DNA, 25 bp, Rattus norvegicus
ggataaagagcaccgagcccagcac

SEQ ID NO: 430653 - DNA, 25 bp, Rattus norvegicus
ggataaagagcagcgagcccagcac

SEQ ID NO: 430654 - DNA, 25 bp, Rattus norvegicus
ggataaagctagaagtgaccctcag

SEQ ID NO: 430655 - DNA, 25 bp, Rattus norvegicus
ggataaagctagtagtgaccctcag

SEQ ID NO: 430656 - DNA, 25 bp, Rattus norvegicus
ggataaagtccccagatgccagacc

SEQ ID NO: 430657 - DNA, 25 bp, Rattus norvegicus
ggataaagtcccgagatgccagacc

SEQ ID NO: 430658 - DNA, 25 bp, Rattus norvegicus
ggataaatcaccactgtcagcagac

SEQ ID NO: 430659 - DNA, 25 bp, Rattus norvegicus
ggataaatcacctctgtcagcagac

SEQ ID NO: 430660 - DNA, 25 bp, Rattus norvegicus
ggataaatccgtcaccatgtctgag

SEQ ID NO: 430661 - DNA, 25 bp, Rattus norvegicus
ggataaatccgtgaccatgtctgag

SEQ ID NO: 430662 - DNA, 25 bp, Rattus norvegicus
ggataaatcctcaaattgcttctct

SEQ ID NO: 430663 - DNA, 25 bp, Rattus norvegicus
ggataaatcctctaattgcttctct

SEQ ID NO: 430664 - DNA, 25 bp, Rattus norvegicus
ggataaattgccatgaactcgtgaa

SEQ ID NO: 430665 - DNA, 25 bp, Rattus norvegicus
ggataaattgccttgaactcgtgaa

SEQ ID NO: 430666 - DNA, 25 bp, Rattus norvegicus
ggataacaaactacgaggcctcttt

SEQ ID NO: 430667 - DNA, 25 bp, Rattus norvegicus
ggataacaaacttcgaggcctcttt

SEQ ID NO: 430668 - DNA, 25 bp, Rattus norvegicus
ggataacacattacctcttctggtt

SEQ ID NO: 430669 - DNA, 25 bp, Rattus norvegicus
ggataacacatttcctcttctggtt

SEQ ID NO: 430670 - DNA, 25 bp, Rattus norvegicus
ggataacatctacttcagttcctag

SEQ ID NO: 430671 - DNA, 25 bp, Rattus norvegicus
ggataacatctagttcagttcctag

SEQ ID NO: 430672 - DNA, 25 bp, Rattus norvegicus
ggataacatgacatcctgttcccta

SEQ ID NO: 430673 - DNA, 25 bp, Rattus norvegicus
ggataacatgacttcctgttcccta

SEQ ID NO: 430674 - DNA, 25 bp, Rattus norvegicus
ggataacattgcctggtctgtccca

SEQ ID NO: 430675 - DNA, 25 bp, Rattus norvegicus
ggataacattgcgtggtctgtccca

SEQ ID NO: 430676 - DNA, 25 bp, Rattus norvegicus
ggataaccaagtatcttcctcggac

SEQ ID NO: 430677 - DNA, 25 bp, Rattus norvegicus
ggataaccaagtttcttcctcggac

SEQ ID NO: 430678 - DNA, 25 bp, Rattus norvegicus
ggataacccatgatcatctctaaat

SEQ ID NO: 430679 - DNA, 25 bp, Rattus norvegicus
ggataacccatgttcatctctaaat

SEQ ID NO: 430680 - DNA, 25 bp, Rattus norvegicus
ggataaccctgtactttggaagaca

SEQ ID NO: 430681 - DNA, 25 bp, Rattus norvegicus
ggataaccctgtagtggcatgccca

SEQ ID NO: 430682 - DNA, 25 bp, Rattus norvegicus
ggataaccctgttctttggaagaca

SEQ ID NO: 430683 - DNA, 25 bp, Rattus norvegicus
ggataaccctgttgtggcatgccca

SEQ ID NO: 430684 - DNA, 25 bp, Rattus norvegicus
ggataacctgacactggacgggaat

SEQ ID NO: 430685 - DNA, 25 bp, Rattus norvegicus
ggataacctgactctggacgggaat

SEQ ID NO: 430686 - DNA, 25 bp, Rattus norvegicus
ggataaccttggagctctggtccga

SEQ ID NO: 430687 - DNA, 25 bp, Rattus norvegicus
ggataaccttggtgctctggtccga

SEQ ID NO: 430688 - DNA, 25 bp, Rattus norvegicus
ggataacgagttctctggcgtgccc

SEQ ID NO: 430689 - DNA, 25 bp, Rattus norvegicus
ggataacgagttgtctggcgtgccc

SEQ ID NO: 430690 - DNA, 25 bp, Rattus norvegicus
ggataacgctaaccgcagcagtact

SEQ ID NO: 430691 - DNA, 25 bp, Rattus norvegicus
ggataacgctaagcgcagcagtact

SEQ ID NO: 430692 - DNA, 25 bp, Rattus norvegicus
ggataacgctcactgcttttgatag

SEQ ID NO: 430693 - DNA, 25 bp, Rattus norvegicus
ggataacgctcagtgcttttgatag

SEQ ID NO: 430694 - DNA, 25 bp, Rattus norvegicus
ggataactcaagacccaaaagacat

SEQ ID NO: 430695 - DNA, 25 bp, Rattus norvegicus
ggataactcaagctcatgttctgga

SEQ ID NO: 430696 - DNA, 25 bp, Rattus norvegicus
ggataactcaaggtcatgttctgga

SEQ ID NO: 430697 - DNA, 25 bp, Rattus norvegicus
ggataactcaagtcccaaaagacat

SEQ ID NO: 430698 - DNA, 25 bp, Rattus norvegicus
ggataactcggacactccagcagga

SEQ ID NO: 430699 - DNA, 25 bp, Rattus norvegicus
ggataactcggagactccagcagga

SEQ ID NO: 430700 - DNA, 25 bp, Rattus norvegicus
ggataactgaaaagccagctcctcc

SEQ ID NO: 430701 - DNA, 25 bp, Rattus norvegicus
ggataactgaaatgccagctcctcc

SEQ ID NO: 430702 - DNA, 25 bp, Rattus norvegicus
ggataactgaacaaagccatgtaca

SEQ ID NO: 430703 - DNA, 25 bp, Rattus norvegicus
ggataactgaactaagccatgtaca

SEQ ID NO: 430704 - DNA, 25 bp, Rattus norvegicus
ggataactgcagagcttccaggaac

SEQ ID NO: 430705 - DNA, 25 bp, Rattus norvegicus
ggataactgcagtgcttccaggaac

SEQ ID NO: 430706 - DNA, 25 bp, Rattus norvegicus
ggataactggtgaataagcttcaac

SEQ ID NO: 430707 - DNA, 25 bp, Rattus norvegicus
ggataactggtgtataagcttcaac

SEQ ID NO: 430708 - DNA, 25 bp, Rattus norvegicus
ggataacttatgacaccggttgaga

SEQ ID NO: 430709 - DNA, 25 bp, Rattus norvegicus
ggataacttatgtcaccggttgaga

SEQ ID NO: 430710 - DNA, 25 bp, Rattus norvegicus
ggataacttccccttcctgagatat

SEQ ID NO: 430711 - DNA, 25 bp, Rattus norvegicus
ggataacttcccgttcctgagatat

SEQ ID NO: 430712 - DNA, 25 bp, Rattus norvegicus
ggataacttctcctgaggacactcc

SEQ ID NO: 430713 - DNA, 25 bp, Rattus norvegicus
ggataacttctcgtgaggacactcc

SEQ ID NO: 430714 - DNA, 25 bp, Rattus norvegicus
ggataacttgtaagccttcttttgt

SEQ ID NO: 430715 - DNA, 25 bp, Rattus norvegicus
ggataacttgtatgccttcttttgt

SEQ ID NO: 430716 - DNA, 25 bp, Rattus norvegicus
ggataagaagagataacccaagtct

SEQ ID NO: 430717 - DNA, 25 bp, Rattus norvegicus
ggataagaagagttaacccaagtct

SEQ ID NO: 430718 - DNA, 25 bp, Rattus norvegicus
ggataagacacaaacctggttaact

SEQ ID NO: 430719 - DNA, 25 bp, Rattus norvegicus
ggataagacacatacctggttaact

SEQ ID NO: 430720 - DNA, 25 bp, Rattus norvegicus
ggataagacagcacaaactcctgcc

SEQ ID NO: 430721 - DNA, 25 bp, Rattus norvegicus
ggataagacagctcaaactcctgcc

SEQ ID NO: 430722 - DNA, 25 bp, Rattus norvegicus
ggataagacatcctaccgctggttc

SEQ ID NO: 430723 - DNA, 25 bp, Rattus norvegicus
ggataagacatcgtaccgctggttc

SEQ ID NO: 430724 - DNA, 25 bp, Rattus norvegicus
ggataagactccagcatccttgtca

SEQ ID NO: 430725 - DNA, 25 bp, Rattus norvegicus
ggataagactcctgcatccttgtca

SEQ ID NO: 430726 - DNA, 25 bp, Rattus norvegicus
ggataagactctactaccggaccca

SEQ ID NO: 430727 - DNA, 25 bp, Rattus norvegicus
ggataagactcttctaccggaccca

SEQ ID NO: 430728 - DNA, 25 bp, Rattus norvegicus
ggataagagcttccacctttgtata

SEQ ID NO: 430729 - DNA, 25 bp, Rattus norvegicus
ggataagagcttgcacctttgtata

SEQ ID NO: 430730 - DNA, 25 bp, Rattus norvegicus
ggataagatcctctcaaacacaatt

SEQ ID NO: 430731 - DNA, 25 bp, Rattus norvegicus
ggataagatcctgtcaaacacaatt

SEQ ID NO: 430732 - DNA, 25 bp, Rattus norvegicus
ggataagatgttaccaaactccttt

SEQ ID NO: 430733 - DNA, 25 bp, Rattus norvegicus
ggataagatgtttccaaactccttt

SEQ ID NO: 430734 - DNA, 25 bp, Rattus norvegicus
ggataagcaagcctcactacacagc

SEQ ID NO: 430735 - DNA, 25 bp, Rattus norvegicus
ggataagcaagcgtcactacacagc

SEQ ID NO: 430736 - DNA, 25 bp, Rattus norvegicus
ggataagcaagtactggcccaaact

SEQ ID NO: 430737 - DNA, 25 bp, Rattus norvegicus
ggataagcaagttctggcccaaact

SEQ ID NO: 430738 - DNA, 25 bp, Rattus norvegicus
ggataagcccaacctcaatcgctat

SEQ ID NO: 430739 - DNA, 25 bp, Rattus norvegicus
ggataagcccaagctcaatcgctat

SEQ ID NO: 430740 - DNA, 25 bp, Rattus norvegicus
ggataagccctaagcctgtgacatt

SEQ ID NO: 430741 - DNA, 25 bp, Rattus norvegicus
ggataagccctatgcctgtgacatt

SEQ ID NO: 430742 - DNA, 25 bp, Rattus norvegicus
ggataagccctcaggattcacagat

SEQ ID NO: 430743 - DNA, 25 bp, Rattus norvegicus
ggataagccctctggattcacagat

SEQ ID NO: 430744 - DNA, 25 bp, Rattus norvegicus
ggataagcctccaaatggttgttaa

SEQ ID NO: 430745 - DNA, 25 bp, Rattus norvegicus
ggataagcctcctaatggttgttaa

SEQ ID NO: 430746 - DNA, 25 bp, Rattus norvegicus
ggataagcttcccaatctgtgtgct

SEQ ID NO: 430747 - DNA, 25 bp, Rattus norvegicus
ggataagcttccgaatctgtgtgct

SEQ ID NO: 430748 - DNA, 25 bp, Rattus norvegicus
ggataaggaagtattgccaaacaca

SEQ ID NO: 430749 - DNA, 25 bp, Rattus norvegicus
ggataaggaagttttgccaaacaca

SEQ ID NO: 430750 - DNA, 25 bp, Rattus norvegicus
ggataaggacacacctgtgctgagt

SEQ ID NO: 430751 - DNA, 25 bp, Rattus norvegicus
ggataaggacactcctgtgctgagt

SEQ ID NO: 430752 - DNA, 25 bp, Rattus norvegicus
ggataaggctcacttaacatggtgc

SEQ ID NO: 430753 - DNA, 25 bp, Rattus norvegicus
ggataaggctcagttaacatggtgc

SEQ ID NO: 430754 - DNA, 25 bp, Rattus norvegicus
ggataaggcttcaatcaactccgaa

SEQ ID NO: 430755 - DNA, 25 bp, Rattus norvegicus
ggataaggcttctatcaactccgaa

SEQ ID NO: 430756 - DNA, 25 bp, Rattus norvegicus
ggataaggcttgacactaagcttca

SEQ ID NO: 430757 - DNA, 25 bp, Rattus norvegicus
ggataaggcttgtcactaagcttca

SEQ ID NO: 430758 - DNA, 25 bp, Rattus norvegicus
ggataagggcgacagcaacagctct

SEQ ID NO: 430759 - DNA, 25 bp, Rattus norvegicus
ggataagggcgagagcaacagctct

SEQ ID NO: 430760 - DNA, 25 bp, Rattus norvegicus
ggataaggtcagaagcatactgctt

SEQ ID NO: 430761 - DNA, 25 bp, Rattus norvegicus
ggataaggtcagtagcatactgctt

SEQ ID NO: 430762 - DNA, 25 bp, Rattus norvegicus
ggataagtagtacctttctctcttt

SEQ ID NO: 430763 - DNA, 25 bp, Rattus norvegicus
ggataagtagtagctttctctcttt

SEQ ID NO: 430764 - DNA, 25 bp, Rattus norvegicus
ggataagtctatctctcatttctag

SEQ ID NO: 430765 - DNA, 25 bp, Rattus norvegicus
ggataagtctatgtctcatttctag

SEQ ID NO: 430766 - DNA, 25 bp, Rattus norvegicus
ggataagtgatacagaattcatcta

SEQ ID NO: 430767 - DNA, 25 bp, Rattus norvegicus
ggataagtgatagagaattcatcta

SEQ ID NO: 430768 - DNA, 25 bp, Rattus norvegicus
ggataagttccgactggacctgtca

SEQ ID NO: 430769 - DNA, 25 bp, Rattus norvegicus
ggataagttccgtctggacctgtca

SEQ ID NO: 430770 - DNA, 25 bp, Rattus norvegicus
ggataagttcggagttcctctgact

SEQ ID NO: 430771 - DNA, 25 bp, Rattus norvegicus
ggataagttcggtgttcctctgact

SEQ ID NO: 430772 - DNA, 25 bp, Rattus norvegicus
ggataagtttacctaggctctcctc

SEQ ID NO: 430773 - DNA, 25 bp, Rattus norvegicus
ggataagtttacgtaggctctcctc

SEQ ID NO: 430774 - DNA, 25 bp, Rattus norvegicus
ggataataagatccctctgttaagt

SEQ ID NO: 430775 - DNA, 25 bp, Rattus norvegicus
ggataataagatgcctctgttaagt

SEQ ID NO: 430776 - DNA, 25 bp, Rattus norvegicus
ggataatagaccatcttggaccccg

SEQ ID NO: 430777 - DNA, 25 bp, Rattus norvegicus
ggataatagaccttcttggaccccg

SEQ ID NO: 430778 - DNA, 25 bp, Rattus norvegicus
ggataatcagacacgttttctctaa

SEQ ID NO: 430779 - DNA, 25 bp, Rattus norvegicus
ggataatcagactcgttttctctaa

SEQ ID NO: 430780 - DNA, 25 bp, Rattus norvegicus
ggataatcagccaacagacccagca

SEQ ID NO: 430781 - DNA, 25 bp, Rattus norvegicus
ggataatcagcctacagacccagca

SEQ ID NO: 430782 - DNA, 25 bp, Rattus norvegicus
ggataatccaccatttgccaagagc

SEQ ID NO: 430783 - DNA, 25 bp, Rattus norvegicus
ggataatccaccttttgccaagagc

SEQ ID NO: 430784 - DNA, 25 bp, Rattus norvegicus
ggataatccagcacgggtcatgcct

SEQ ID NO: 430785 - DNA, 25 bp, Rattus norvegicus
ggataatccagctcgggtcatgcct

SEQ ID NO: 430786 - DNA, 25 bp, Rattus norvegicus
ggataatccatccttctaacatata

SEQ ID NO: 430787 - DNA, 25 bp, Rattus norvegicus
ggataatccatcgttctaacatata

SEQ ID NO: 430788 - DNA, 25 bp, Rattus norvegicus
ggataatcctcactggttccattaa

SEQ ID NO: 430789 - DNA, 25 bp, Rattus norvegicus
ggataatcctcagtggttccattaa

SEQ ID NO: 430790 - DNA, 25 bp, Rattus norvegicus
ggataatcctccactgtcagaggct

SEQ ID NO: 430791 - DNA, 25 bp, Rattus norvegicus
ggataatcctcctctgtcagaggct

SEQ ID NO: 430792 - DNA, 25 bp, Rattus norvegicus
ggataatcctctcgcctcaatatac

SEQ ID NO: 430793 - DNA, 25 bp, Rattus norvegicus
ggataatcctctggcctcaatatac

SEQ ID NO: 430794 - DNA, 25 bp, Rattus norvegicus
ggataatcctgaaggtctctcccta

SEQ ID NO: 430795 - DNA, 25 bp, Rattus norvegicus
ggataatcctgatggtctctcccta

SEQ ID NO: 430796 - DNA, 25 bp, Rattus norvegicus
ggataatcgtctctcctgcctcact

SEQ ID NO: 430797 - DNA, 25 bp, Rattus norvegicus
ggataatcgtctgtcctgcctcact

SEQ ID NO: 430798 - DNA, 25 bp, Rattus norvegicus
ggataatgaaacatgctcgcccttg

SEQ ID NO: 430799 - DNA, 25 bp, Rattus norvegicus
ggataatgaaacttgctcgcccttg

SEQ ID NO: 430800 - DNA, 25 bp, Rattus norvegicus
ggataatgatacacaacctgtaaat

SEQ ID NO: 430801 - DNA, 25 bp, Rattus norvegicus
ggataatgatactcaacctgtaaat

SEQ ID NO: 430802 - DNA, 25 bp, Rattus norvegicus
ggataatgatgaagccgaccccaca

SEQ ID NO: 430803 - DNA, 25 bp, Rattus norvegicus
ggataatgatgatgccgaccccaca

SEQ ID NO: 430804 - DNA, 25 bp, Rattus norvegicus
ggataatgcactacttgctcctggg

SEQ ID NO: 430805 - DNA, 25 bp, Rattus norvegicus
ggataatgcacttcttgctcctggg

SEQ ID NO: 430806 - DNA, 25 bp, Rattus norvegicus
ggataatgtcaccagctccaaagct

SEQ ID NO: 430807 - DNA, 25 bp, Rattus norvegicus
ggataatgtcacgagctccaaagct

SEQ ID NO: 430808 - DNA, 25 bp, Rattus norvegicus
ggataatgtcggagaacccactgct

SEQ ID NO: 430809 - DNA, 25 bp, Rattus norvegicus
ggataatgtcggtgaacccactgct

SEQ ID NO: 430810 - DNA, 25 bp, Rattus norvegicus
ggataatgtgatctctccccagtca

SEQ ID NO: 430811 - DNA, 25 bp, Rattus norvegicus
ggataatgtgatgtctccccagtca

SEQ ID NO: 430812 - DNA, 25 bp, Rattus norvegicus
ggataatgtttgacttgacccacaa

SEQ ID NO: 430813 - DNA, 25 bp, Rattus norvegicus
ggataatgtttgtcttgacccacaa

SEQ ID NO: 430814 - DNA, 25 bp, Rattus norvegicus
ggataattcactagacctctccaga

SEQ ID NO: 430815 - DNA, 25 bp, Rattus norvegicus
ggataattcactagtctataataaa

SEQ ID NO: 430816 - DNA, 25 bp, Rattus norvegicus
ggataattcacttgacctctccaga

SEQ ID NO: 430817 - DNA, 25 bp, Rattus norvegicus
ggataattcacttgtctataataaa

SEQ ID NO: 430818 - DNA, 25 bp, Rattus norvegicus
ggataattcagcaccctatggtgcc

SEQ ID NO: 430819 - DNA, 25 bp, Rattus norvegicus
ggataattcagctccctatggtgcc

SEQ ID NO: 430820 - DNA, 25 bp, Rattus norvegicus
ggataattcaggaccctccagtatc

SEQ ID NO: 430821 - DNA, 25 bp, Rattus norvegicus
ggataattcaggtccctccagtatc

SEQ ID NO: 430822 - DNA, 25 bp, Rattus norvegicus
ggataattcctgctatcagagcgga

SEQ ID NO: 430823 - DNA, 25 bp, Rattus norvegicus
ggataattcctggtatcagagcgga

SEQ ID NO: 430824 - DNA, 25 bp, Rattus norvegicus
ggataatttctaagaaatcgcgctt

SEQ ID NO: 430825 - DNA, 25 bp, Rattus norvegicus
ggataatttctatgaaatcgcgctt

SEQ ID NO: 430826 - DNA, 25 bp, Rattus norvegicus
ggatacaaccgtattgctccatatt

SEQ ID NO: 430827 - DNA, 25 bp, Rattus norvegicus
ggatacaaccgttttgctccatatt

SEQ ID NO: 430828 - DNA, 25 bp, Rattus norvegicus
ggatacaagttccttagtccactct

SEQ ID NO: 430829 - DNA, 25 bp, Rattus norvegicus
ggatacaagttcgttagtccactct

SEQ ID NO: 430830 - DNA, 25 bp, Rattus norvegicus
ggatacaatgccatgcaggacttct

SEQ ID NO: 430831 - DNA, 25 bp, Rattus norvegicus
ggatacaatgccttgcaggacttct

SEQ ID NO: 430832 - DNA, 25 bp, Rattus norvegicus
ggatacacagccagtgcccaaatta

SEQ ID NO: 430833 - DNA, 25 bp, Rattus norvegicus
ggatacacagcctgtgcccaaatta

SEQ ID NO: 430834 - DNA, 25 bp, Rattus norvegicus
ggatacacatctaactccgggctaa

SEQ ID NO: 430835 - DNA, 25 bp, Rattus norvegicus
ggatacacatcttactccgggctaa

SEQ ID NO: 430836 - DNA, 25 bp, Rattus norvegicus
ggatacaccggaagtgcattccatc

SEQ ID NO: 430837 - DNA, 25 bp, Rattus norvegicus
ggatacaccggatgtgcattccatc

SEQ ID NO: 430838 - DNA, 25 bp, Rattus norvegicus
ggatacactcgactctgtttattga

SEQ ID NO: 430839 - DNA, 25 bp, Rattus norvegicus
ggatacactcgagtctgtttattga

SEQ ID NO: 430840 - DNA, 25 bp, Rattus norvegicus
ggatacactgaaccctggagcttct

SEQ ID NO: 430841 - DNA, 25 bp, Rattus norvegicus
ggatacactgaagcctggagcttct

SEQ ID NO: 430842 - DNA, 25 bp, Rattus norvegicus
ggatacagaattctcagcctgctct

SEQ ID NO: 430843 - DNA, 25 bp, Rattus norvegicus
ggatacagaattgtcagcctgctct

SEQ ID NO: 430844 - DNA, 25 bp, Rattus norvegicus
ggatacagatttaaaaggccccagt

SEQ ID NO: 430845 - DNA, 25 bp, Rattus norvegicus
ggatacagattttaaaggccccagt

SEQ ID NO: 430846 - DNA, 25 bp, Rattus norvegicus
ggatacagcaatctttttgtcaact

SEQ ID NO: 430847 - DNA, 25 bp, Rattus norvegicus
ggatacagcaatgtttttgtcaact

SEQ ID NO: 430848 - DNA, 25 bp, Rattus norvegicus
ggatacagcatcactacacacagga

SEQ ID NO: 430849 - DNA, 25 bp, Rattus norvegicus
ggatacagcatctctacacacagga

SEQ ID NO: 430850 - DNA, 25 bp, Rattus norvegicus
ggatacagcccaaccctatgatgga

SEQ ID NO: 430851 - DNA, 25 bp, Rattus norvegicus
ggatacagcccatccctatgatgga

SEQ ID NO: 430852 - DNA, 25 bp, Rattus norvegicus
ggatacagctaaatgctatctctaa

SEQ ID NO: 430853 - DNA, 25 bp, Rattus norvegicus
ggatacagctaattgctatctctaa

SEQ ID NO: 430854 - DNA, 25 bp, Rattus norvegicus
ggatacagctcccttgaaggccgag

SEQ ID NO: 430855 - DNA, 25 bp, Rattus norvegicus
ggatacagctccgttgaaggccgag

SEQ ID NO: 430856 - DNA, 25 bp, Rattus norvegicus
ggatacagggcaccctaggcatcca

SEQ ID NO: 430857 - DNA, 25 bp, Rattus norvegicus
ggatacagggcagcctaggcatcca

SEQ ID NO: 430858 - DNA, 25 bp, Rattus norvegicus
ggatacagttcactaaattcctgat

SEQ ID NO: 430859 - DNA, 25 bp, Rattus norvegicus
ggatacagttcagtaaattcctgat

SEQ ID NO: 430860 - DNA, 25 bp, Rattus norvegicus
ggatacatagtgagagtcagttttt

SEQ ID NO: 430861 - DNA, 25 bp, Rattus norvegicus
ggatacatagtgtgagtcagttttt

SEQ ID NO: 430862 - DNA, 25 bp, Rattus norvegicus
ggatacatctccactggtgcatgga

SEQ ID NO: 430863 - DNA, 25 bp, Rattus norvegicus
ggatacatctcctctggtgcatgga

SEQ ID NO: 430864 - DNA, 25 bp, Rattus norvegicus
ggatacatgcttatcactagtgcac

SEQ ID NO: 430865 - DNA, 25 bp, Rattus norvegicus
ggatacatgcttttcactagtgcac

SEQ ID NO: 430866 - DNA, 25 bp, Rattus norvegicus
ggatacatgtagattcacctctaat

SEQ ID NO: 430867 - DNA, 25 bp, Rattus norvegicus
ggatacatgtagtttcacctctaat

SEQ ID NO: 430868 - DNA, 25 bp, Rattus norvegicus
ggatacatgttacctaaaccttaag

SEQ ID NO: 430869 - DNA, 25 bp, Rattus norvegicus
ggatacatgttagctaaaccttaag

SEQ ID NO: 430870 - DNA, 25 bp, Rattus norvegicus
ggatacattcagaaacactctggga

SEQ ID NO: 430871 - DNA, 25 bp, Rattus norvegicus
ggatacattcagtaacactctggga

SEQ ID NO: 430872 - DNA, 25 bp, Rattus norvegicus
ggatacattccactaacctcatttc

SEQ ID NO: 430873 - DNA, 25 bp, Rattus norvegicus
ggatacattccagtaacctcatttc

SEQ ID NO: 430874 - DNA, 25 bp, Rattus norvegicus
ggatacattggcctgcaggtcctaa

SEQ ID NO: 430875 - DNA, 25 bp, Rattus norvegicus
ggatacattggcgtgcaggtcctaa

SEQ ID NO: 430876 - DNA, 25 bp, Rattus norvegicus
ggatacatttctattgtcaggctac

SEQ ID NO: 430877 - DNA, 25 bp, Rattus norvegicus
ggatacatttcttttgtcaggctac

SEQ ID NO: 430878 - DNA, 25 bp, Rattus norvegicus
ggatacatttgcagtcttctcaagg

SEQ ID NO: 430879 - DNA, 25 bp, Rattus norvegicus
ggatacatttgctgtcttctcaagg

SEQ ID NO: 430880 - DNA, 25 bp, Rattus norvegicus
ggataccaacctccaaaagacctgt

SEQ ID NO: 430881 - DNA, 25 bp, Rattus norvegicus
ggataccaacctgcaaaagacctgt

SEQ ID NO: 430882 - DNA, 25 bp, Rattus norvegicus
ggataccaagctaaacctcacaaga

SEQ ID NO: 430883 - DNA, 25 bp, Rattus norvegicus
ggataccaagcttaacctcacaaga

SEQ ID NO: 430884 - DNA, 25 bp, Rattus norvegicus
ggataccacatactaattctttacg

SEQ ID NO: 430885 - DNA, 25 bp, Rattus norvegicus
ggataccacatagtaattctttacg

SEQ ID NO: 430886 - DNA, 25 bp, Rattus norvegicus
ggataccacattcctcatttgagtg

SEQ ID NO: 430887 - DNA, 25 bp, Rattus norvegicus
ggataccacattgctcatttgagtg

SEQ ID NO: 430888 - DNA, 25 bp, Rattus norvegicus
ggataccactgaagagaccttaaaa

SEQ ID NO: 430889 - DNA, 25 bp, Rattus norvegicus
ggataccactgatgagaccttaaaa

SEQ ID NO: 430890 - DNA, 25 bp, Rattus norvegicus
ggataccagggcattgccagtcagg

SEQ ID NO: 430891 - DNA, 25 bp, Rattus norvegicus
ggataccagggctttgccagtcagg

SEQ ID NO: 430892 - DNA, 25 bp, Rattus norvegicus
ggataccaggtcagcttcggagtca

SEQ ID NO: 430893 - DNA, 25 bp, Rattus norvegicus
ggataccaggtctgcttcggagtca

SEQ ID NO: 430894 - DNA, 25 bp, Rattus norvegicus
ggataccatagtcacttttctctag

SEQ ID NO: 430895 - DNA, 25 bp, Rattus norvegicus
ggataccatagtgacttttctctag

SEQ ID NO: 430896 - DNA, 25 bp, Rattus norvegicus
ggataccatcatctaacagctgttt

SEQ ID NO: 430897 - DNA, 25 bp, Rattus norvegicus
ggataccatcatgtaacagctgttt

SEQ ID NO: 430898 - DNA, 25 bp, Rattus norvegicus
ggataccatggtcgaaattcccgtt

SEQ ID NO: 430899 - DNA, 25 bp, Rattus norvegicus
ggataccatggtggaaattcccgtt

SEQ ID NO: 430900 - DNA, 25 bp, Rattus norvegicus
ggataccatgttaatttgctcttca

SEQ ID NO: 430901 - DNA, 25 bp, Rattus norvegicus
ggataccatgtttatttgctcttca

SEQ ID NO: 430902 - DNA, 25 bp, Rattus norvegicus
ggatacccaaagaccacagtaggca

SEQ ID NO: 430903 - DNA, 25 bp, Rattus norvegicus
ggatacccaaagtccacagtaggca

SEQ ID NO: 430904 - DNA, 25 bp, Rattus norvegicus
ggataccccatgatagtaaggagat

SEQ ID NO: 430905 - DNA, 25 bp, Rattus norvegicus
ggataccccatgttagtaaggagat

SEQ ID NO: 430906 - DNA, 25 bp, Rattus norvegicus
ggataccctgagaagttatgcaact

SEQ ID NO: 430907 - DNA, 25 bp, Rattus norvegicus
ggataccctgagtagttatgcaact

SEQ ID NO: 430908 - DNA, 25 bp, Rattus norvegicus
ggataccctggaaatttcttttagt

SEQ ID NO: 430909 - DNA, 25 bp, Rattus norvegicus
ggataccctggatatttcttttagt

SEQ ID NO: 430910 - DNA, 25 bp, Rattus norvegicus
ggataccgattacctcaaatctcag

SEQ ID NO: 430911 - DNA, 25 bp, Rattus norvegicus
ggataccgattagctcaaatctcag

SEQ ID NO: 430912 - DNA, 25 bp, Rattus norvegicus
ggatacctacacaatccaggaaaaa

SEQ ID NO: 430913 - DNA, 25 bp, Rattus norvegicus
ggatacctacactatccaggaaaaa

SEQ ID NO: 430914 - DNA, 25 bp, Rattus norvegicus
ggatacctctagcactgtgctcagt

SEQ ID NO: 430915 - DNA, 25 bp, Rattus norvegicus
ggatacctctaggactgtgctcagt

SEQ ID NO: 430916 - DNA, 25 bp, Rattus norvegicus
ggatacctgccaccaaaacattcat

SEQ ID NO: 430917 - DNA, 25 bp, Rattus norvegicus
ggatacctgccagcaaaacattcat

SEQ ID NO: 430918 - DNA, 25 bp, Rattus norvegicus
ggatacctgcgaattctgtgcattg

SEQ ID NO: 430919 - DNA, 25 bp, Rattus norvegicus
ggatacctgcgatttctgtgcattg

SEQ ID NO: 430920 - DNA, 25 bp, Rattus norvegicus
ggatacctggagcagtttttactgt

SEQ ID NO: 430921 - DNA, 25 bp, Rattus norvegicus
ggatacctggaggagtttttactgt

SEQ ID NO: 430922 - DNA, 25 bp, Rattus norvegicus
ggatacctgtcgagggtcctatgat

SEQ ID NO: 430923 - DNA, 25 bp, Rattus norvegicus
ggatacctgtcgtgggtcctatgat

SEQ ID NO: 430924 - DNA, 25 bp, Rattus norvegicus
ggataccttgcaaaactgcatgaca

SEQ ID NO: 430925 - DNA, 25 bp, Rattus norvegicus
ggataccttgcataactgcatgaca

SEQ ID NO: 430926 - DNA, 25 bp, Rattus norvegicus
ggataccttgccaccttatggagga

SEQ ID NO: 430927 - DNA, 25 bp, Rattus norvegicus
ggataccttgcctccttatggagga

SEQ ID NO: 430928 - DNA, 25 bp, Rattus norvegicus
ggatacctttgtacacatctggaag

SEQ ID NO: 430929 - DNA, 25 bp, Rattus norvegicus
ggatacctttgttcacatctggaag

SEQ ID NO: 430930 - DNA, 25 bp, Rattus norvegicus
ggatacgaaggacccagcactcagt

SEQ ID NO: 430931 - DNA, 25 bp, Rattus norvegicus
ggatacgaaggagccagcactcagt

SEQ ID NO: 430932 - DNA, 25 bp, Rattus norvegicus
ggatacgaggaacgcacttctgagt

SEQ ID NO: 430933 - DNA, 25 bp, Rattus norvegicus
ggatacgaggaaggcacttctgagt

SEQ ID NO: 430934 - DNA, 25 bp, Rattus norvegicus
ggatacgcatcccagcacaggaagc

SEQ ID NO: 430935 - DNA, 25 bp, Rattus norvegicus
ggatacgcatccgagcacaggaagc

SEQ ID NO: 430936 - DNA, 25 bp, Rattus norvegicus
ggatacgccaggctcctgagcctat

SEQ ID NO: 430937 - DNA, 25 bp, Rattus norvegicus
ggatacgccagggtcctgagcctat

SEQ ID NO: 430938 - DNA, 25 bp, Rattus norvegicus
ggatacgccgaaccaatcaaagaca

SEQ ID NO: 430939 - DNA, 25 bp, Rattus norvegicus
ggatacgccgaagcaatcaaagaca

SEQ ID NO: 430940 - DNA, 25 bp, Rattus norvegicus
ggatacgctataaacacgattctgt

SEQ ID NO: 430941 - DNA, 25 bp, Rattus norvegicus
ggatacgctatatacacgattctgt

SEQ ID NO: 430942 - DNA, 25 bp, Rattus norvegicus
ggatacggcatgagatctcctacag

SEQ ID NO: 430943 - DNA, 25 bp, Rattus norvegicus
ggatacggcatgtgatctcctacag

SEQ ID NO: 430944 - DNA, 25 bp, Rattus norvegicus
ggatacgggttcattcggtgctcat

SEQ ID NO: 430945 - DNA, 25 bp, Rattus norvegicus
ggatacgggttctttcggtgctcat

SEQ ID NO: 430946 - DNA, 25 bp, Rattus norvegicus
ggatacggtctcatgaagcatacca

SEQ ID NO: 430947 - DNA, 25 bp, Rattus norvegicus
ggatacggtctcttgaagcatacca

SEQ ID NO: 430948 - DNA, 25 bp, Rattus norvegicus
ggatacgttcatctgtccaagtcaa

SEQ ID NO: 430949 - DNA, 25 bp, Rattus norvegicus
ggatacgttcatgtgtccaagtcaa

SEQ ID NO: 430950 - DNA, 25 bp, Rattus norvegicus
ggatacgtttggcagttcaccccat

SEQ ID NO: 430951 - DNA, 25 bp, Rattus norvegicus
ggatacgtttgggagttcaccccat

SEQ ID NO: 430952 - DNA, 25 bp, Rattus norvegicus
ggatactaacacacatgggtaatgg

SEQ ID NO: 430953 - DNA, 25 bp, Rattus norvegicus
ggatactaacactcatgggtaatgg

SEQ ID NO: 430954 - DNA, 25 bp, Rattus norvegicus
ggatactaaccaagctgtttacagt

SEQ ID NO: 430955 - DNA, 25 bp, Rattus norvegicus
ggatactaaccatgctgtttacagt

SEQ ID NO: 430956 - DNA, 25 bp, Rattus norvegicus
ggatactagtcaaccataagaatgc

SEQ ID NO: 430957 - DNA, 25 bp, Rattus norvegicus
ggatactagtcatccataagaatgc

SEQ ID NO: 430958 - DNA, 25 bp, Rattus norvegicus
ggatactattgaattctcatcttga

SEQ ID NO: 430959 - DNA, 25 bp, Rattus norvegicus
ggatactattgatttctcatcttga

SEQ ID NO: 430960 - DNA, 25 bp, Rattus norvegicus
ggatactcaagccatgcgctcacag

SEQ ID NO: 430961 - DNA, 25 bp, Rattus norvegicus
ggatactcaagcgatgcgctcacag

SEQ ID NO: 430962 - DNA, 25 bp, Rattus norvegicus
ggatactcacctatgtcttttgcaa

SEQ ID NO: 430963 - DNA, 25 bp, Rattus norvegicus
ggatactcacctttgtcttttgcaa

SEQ ID NO: 430964 - DNA, 25 bp, Rattus norvegicus
ggatactcagatccattgctgttct

SEQ ID NO: 430965 - DNA, 25 bp, Rattus norvegicus
ggatactcagatgcattgctgttct

SEQ ID NO: 430966 - DNA, 25 bp, Rattus norvegicus
ggatactcagttacccacagagact

SEQ ID NO: 430967 - DNA, 25 bp, Rattus norvegicus
ggatactcagtttcccacagagact

SEQ ID NO: 430968 - DNA, 25 bp, Rattus norvegicus
ggatactccatgacacagcgcctta

SEQ ID NO: 430969 - DNA, 25 bp, Rattus norvegicus
ggatactccatgtcacagcgcctta

SEQ ID NO: 430970 - DNA, 25 bp, Rattus norvegicus
ggatactctcgtacaaagtgatcaa

SEQ ID NO: 430971 - DNA, 25 bp, Rattus norvegicus
ggatactctcgttcaaagtgatcaa

SEQ ID NO: 430972 - DNA, 25 bp, Rattus norvegicus
ggatactctgccatatagaaaattc

SEQ ID NO: 430973 - DNA, 25 bp, Rattus norvegicus
ggatactctgccttatagaaaattc

SEQ ID NO: 430974 - DNA, 25 bp, Rattus norvegicus
ggatactgacatcttactgctctag

SEQ ID NO: 430975 - DNA, 25 bp, Rattus norvegicus
ggatactgacatgttactgctctag

SEQ ID NO: 430976 - DNA, 25 bp, Rattus norvegicus
ggatactgactgatttctgcttaaa

SEQ ID NO: 430977 - DNA, 25 bp, Rattus norvegicus
ggatactgactgttttctgcttaaa

SEQ ID NO: 430978 - DNA, 25 bp, Rattus norvegicus
ggatactggaaacgttccctcctct

SEQ ID NO: 430979 - DNA, 25 bp, Rattus norvegicus
ggatactggaaaggttccctcctct

SEQ ID NO: 430980 - DNA, 25 bp, Rattus norvegicus
ggatactgggctccgcacagactgt

SEQ ID NO: 430981 - DNA, 25 bp, Rattus norvegicus
ggatactgggctgcgcacagactgt

SEQ ID NO: 430982 - DNA, 25 bp, Rattus norvegicus
ggatacttacctacttcaagctcag

SEQ ID NO: 430983 - DNA, 25 bp, Rattus norvegicus
ggatacttaccttcttcaagctcag

SEQ ID NO: 430984 - DNA, 25 bp, Rattus norvegicus
ggatacttactgctacccactgtgc

SEQ ID NO: 430985 - DNA, 25 bp, Rattus norvegicus
ggatacttactggtacccactgtgc

SEQ ID NO: 430986 - DNA, 25 bp, Rattus norvegicus
ggatacttagccctgatgttatcac

SEQ ID NO: 430987 - DNA, 25 bp, Rattus norvegicus
ggatacttagccgtgatgttatcac

SEQ ID NO: 430988 - DNA, 25 bp, Rattus norvegicus
ggatacttatccaagcgcaatctct

SEQ ID NO: 430989 - DNA, 25 bp, Rattus norvegicus
ggatacttatcctagcgcaatctct

SEQ ID NO: 430990 - DNA, 25 bp, Rattus norvegicus
ggatacttattcagttgggaaatac

SEQ ID NO: 430991 - DNA, 25 bp, Rattus norvegicus
ggatacttattctgttgggaaatac

SEQ ID NO: 430992 - DNA, 25 bp, Rattus norvegicus
ggatacttcgttatattcatgtcaa

SEQ ID NO: 430993 - DNA, 25 bp, Rattus norvegicus
ggatacttcgttttattcatgtcaa

SEQ ID NO: 430994 - DNA, 25 bp, Rattus norvegicus
ggatacttgcccaaatcggttgttt

SEQ ID NO: 430995 - DNA, 25 bp, Rattus norvegicus
ggatacttgccctaatcggttgttt

SEQ ID NO: 430996 - DNA, 25 bp, Rattus norvegicus
ggatacttgtggctaccaacctgtt

SEQ ID NO: 430997 - DNA, 25 bp, Rattus norvegicus
ggatacttgtgggtaccaacctgtt

SEQ ID NO: 430998 - DNA, 25 bp, Rattus norvegicus
ggatactttatcataaccccaggga

SEQ ID NO: 430999 - DNA, 25 bp, Rattus norvegicus
ggatactttatcttaaccccaggga

SEQ ID NO: 431000 - DNA, 25 bp, Rattus norvegicus
ggatactttgttagtttcctcagtg

SEQ ID NO: 431001 - DNA, 25 bp, Rattus norvegicus
ggatactttgtttgtttcctcagtg

SEQ ID NO: 431002 - DNA, 25 bp, Rattus norvegicus
ggatacttttaaattcagtctttgt

SEQ ID NO: 431003 - DNA, 25 bp, Rattus norvegicus
ggatacttttaatttcagtctttgt

SEQ ID NO: 431004 - DNA, 25 bp, Rattus norvegicus
ggatagacaggaaaccagccttcat

SEQ ID NO: 431005 - DNA, 25 bp, Rattus norvegicus
ggatagacaggataccagccttcat

SEQ ID NO: 431006 - DNA, 25 bp, Rattus norvegicus
ggatagaccactcggcagcggtttc

SEQ ID NO: 431007 - DNA, 25 bp, Rattus norvegicus
ggatagaccactgggcagcggtttc

SEQ ID NO: 431008 - DNA, 25 bp, Rattus norvegicus
ggatagaccgtgacagatctggaca

SEQ ID NO: 431009 - DNA, 25 bp, Rattus norvegicus
ggatagaccgtgtcagatctggaca

SEQ ID NO: 431010 - DNA, 25 bp, Rattus norvegicus
ggatagactagcatctttaaaacgt

SEQ ID NO: 431011 - DNA, 25 bp, Rattus norvegicus
ggatagactagcttctttaaaacgt

SEQ ID NO: 431012 - DNA, 25 bp, Rattus norvegicus
ggatagactccaaccagatgccact

SEQ ID NO: 431013 - DNA, 25 bp, Rattus norvegicus
ggatagactccatccagatgccact

SEQ ID NO: 431014 - DNA, 25 bp, Rattus norvegicus
ggatagactctcctctctagacaac

SEQ ID NO: 431015 - DNA, 25 bp, Rattus norvegicus
ggatagactctcgtctctagacaac

SEQ ID NO: 431016 - DNA, 25 bp, Rattus norvegicus
ggatagagatgaccacaagccctgt

SEQ ID NO: 431017 - DNA, 25 bp, Rattus norvegicus
ggatagagatgagcacaagccctgt

SEQ ID NO: 431018 - DNA, 25 bp, Rattus norvegicus
ggatagagtctgacctcttgtctca

SEQ ID NO: 431019 - DNA, 25 bp, Rattus norvegicus
ggatagagtctgtcctcttgtctca

SEQ ID NO: 431020 - DNA, 25 bp, Rattus norvegicus
ggatagatcccgatttaatgactgg

SEQ ID NO: 431021 - DNA, 25 bp, Rattus norvegicus
ggatagatcccgttttaatgactgg

SEQ ID NO: 431022 - DNA, 25 bp, Rattus norvegicus
ggatagattcccaaaaccaagtgag

SEQ ID NO: 431023 - DNA, 25 bp, Rattus norvegicus
ggatagattccctaaaccaagtgag

SEQ ID NO: 431024 - DNA, 25 bp, Rattus norvegicus
ggatagattgaaaccattgccctgg

SEQ ID NO: 431025 - DNA, 25 bp, Rattus norvegicus
ggatagattgaatccattgccctgg

SEQ ID NO: 431026 - DNA, 25 bp, Rattus norvegicus
ggatagatttagagacctgcttgtt

SEQ ID NO: 431027 - DNA, 25 bp, Rattus norvegicus
ggatagatttagtgacctgcttgtt

SEQ ID NO: 431028 - DNA, 25 bp, Rattus norvegicus
ggatagcaatacctgaacttttcac

SEQ ID NO: 431029 - DNA, 25 bp, Rattus norvegicus
ggatagcaatacgtgaacttttcac

SEQ ID NO: 431030 - DNA, 25 bp, Rattus norvegicus
ggatagcaatgacgtgccttccccg

SEQ ID NO: 431031 - DNA, 25 bp, Rattus norvegicus
ggatagcaatgaggtgccttccccg

SEQ ID NO: 431032 - DNA, 25 bp, Rattus norvegicus
ggatagcaatggacattacttcatt

SEQ ID NO: 431033 - DNA, 25 bp, Rattus norvegicus
ggatagcaatggtcattacttcatt

SEQ ID NO: 431034 - DNA, 25 bp, Rattus norvegicus
ggatagcagatcatgcaccttctaa

SEQ ID NO: 431035 - DNA, 25 bp, Rattus norvegicus
ggatagcagatcttgcaccttctaa

SEQ ID NO: 431036 - DNA, 25 bp, Rattus norvegicus
ggatagcatgagcactagggcccat

SEQ ID NO: 431037 - DNA, 25 bp, Rattus norvegicus
ggatagcatgaggactagggcccat

SEQ ID NO: 431038 - DNA, 25 bp, Rattus norvegicus
ggatagcattccattatgtagactt

SEQ ID NO: 431039 - DNA, 25 bp, Rattus norvegicus
ggatagcattcctttatgtagactt

SEQ ID NO: 431040 - DNA, 25 bp, Rattus norvegicus
ggatagccattcattagtgtcaggg

SEQ ID NO: 431041 - DNA, 25 bp, Rattus norvegicus
ggatagccattctttagtgtcaggg

SEQ ID NO: 431042 - DNA, 25 bp, Rattus norvegicus
ggatagcctagccagattctcaagt

SEQ ID NO: 431043 - DNA, 25 bp, Rattus norvegicus
ggatagcctagcgagattctcaagt

SEQ ID NO: 431044 - DNA, 25 bp, Rattus norvegicus
ggatagccttccctacattgtatat

SEQ ID NO: 431045 - DNA, 25 bp, Rattus norvegicus
ggatagccttccgtacattgtatat

SEQ ID NO: 431046 - DNA, 25 bp, Rattus norvegicus
ggatagctacctattcttcattgtt

SEQ ID NO: 431047 - DNA, 25 bp, Rattus norvegicus
ggatagctaccttttcttcattgtt

SEQ ID NO: 431048 - DNA, 25 bp, Rattus norvegicus
ggataggagttaagtatggtcacat

SEQ ID NO: 431049 - DNA, 25 bp, Rattus norvegicus
ggataggagttatgtatggtcacat

SEQ ID NO: 431050 - DNA, 25 bp, Rattus norvegicus
ggataggcactcatgtgggaactgt

SEQ ID NO: 431051 - DNA, 25 bp, Rattus norvegicus
ggataggcactcttgtgggaactgt

SEQ ID NO: 431052 - DNA, 25 bp, Rattus norvegicus
ggataggcattcattcaggctctgt

SEQ ID NO: 431053 - DNA, 25 bp, Rattus norvegicus
ggataggcattctttcaggctctgt

SEQ ID NO: 431054 - DNA, 25 bp, Rattus norvegicus
ggataggcctggaacctattgggaa

SEQ ID NO: 431055 - DNA, 25 bp, Rattus norvegicus
ggataggcctggtacctattgggaa

SEQ ID NO: 431056 - DNA, 25 bp, Rattus norvegicus
ggataggctgctacaagactttcgc

SEQ ID NO: 431057 - DNA, 25 bp, Rattus norvegicus
ggataggctgcttcaagactttcgc

SEQ ID NO: 431058 - DNA, 25 bp, Rattus norvegicus
ggatagggacagagactcatattct

SEQ ID NO: 431059 - DNA, 25 bp, Rattus norvegicus
ggatagggacagtgactcatattct

SEQ ID NO: 431060 - DNA, 25 bp, Rattus norvegicus
ggatagggatgcatacaggtacaca

SEQ ID NO: 431061 - DNA, 25 bp, Rattus norvegicus
ggatagggatgcttacaggtacaca

SEQ ID NO: 431062 - DNA, 25 bp, Rattus norvegicus
ggatagggccctacaggacaaacag

SEQ ID NO: 431063 - DNA, 25 bp, Rattus norvegicus
ggatagggccctatcatgttaattc

SEQ ID NO: 431064 - DNA, 25 bp, Rattus norvegicus
ggatagggcccttcaggacaaacag

SEQ ID NO: 431065 - DNA, 25 bp, Rattus norvegicus
ggatagggccctttcatgttaattc

SEQ ID NO: 431066 - DNA, 25 bp, Rattus norvegicus
ggatagggtcatccctggctcctca

SEQ ID NO: 431067 - DNA, 25 bp, Rattus norvegicus
ggatagggtcatgcctggctcctca

SEQ ID NO: 431068 - DNA, 25 bp, Rattus norvegicus
ggatagggtctcagtgttcaacaca

SEQ ID NO: 431069 - DNA, 25 bp, Rattus norvegicus
ggatagggtctctgtgttcaacaca

SEQ ID NO: 431070 - DNA, 25 bp, Rattus norvegicus
ggatagggtcttagccaggctgttc

SEQ ID NO: 431071 - DNA, 25 bp, Rattus norvegicus
ggatagggtctttgccaggctgttc

SEQ ID NO: 431072 - DNA, 25 bp, Rattus norvegicus
ggataggtcacaagacattttacct

SEQ ID NO: 431073 - DNA, 25 bp, Rattus norvegicus
ggataggtcacatgacattttacct

SEQ ID NO: 431074 - DNA, 25 bp, Rattus norvegicus
ggataggtgttaacatgtgcttaag

SEQ ID NO: 431075 - DNA, 25 bp, Rattus norvegicus
ggataggtgttatcatgtgcttaag

SEQ ID NO: 431076 - DNA, 25 bp, Rattus norvegicus
ggataggttttcagttagccaatat

SEQ ID NO: 431077 - DNA, 25 bp, Rattus norvegicus
ggataggttttctgttagccaatat

SEQ ID NO: 431078 - DNA, 25 bp, Rattus norvegicus
ggatagtctcctaaacattttgcaa

SEQ ID NO: 431079 - DNA, 25 bp, Rattus norvegicus
ggatagtctccttaacattttgcaa

SEQ ID NO: 431080 - DNA, 25 bp, Rattus norvegicus
ggatagtgaatgacacctacaggac

SEQ ID NO: 431081 - DNA, 25 bp, Rattus norvegicus
ggatagtgaatgtcacctacaggac

SEQ ID NO: 431082 - DNA, 25 bp, Rattus norvegicus
ggatagtggcccagcacgagactgt

SEQ ID NO: 431083 - DNA, 25 bp, Rattus norvegicus
ggatagtggccctgcacgagactgt

SEQ ID NO: 431084 - DNA, 25 bp, Rattus norvegicus
ggatagtggtatacttgctctggat

SEQ ID NO: 431085 - DNA, 25 bp, Rattus norvegicus
ggatagtggtattcttgctctggat

SEQ ID NO: 431086 - DNA, 25 bp, Rattus norvegicus
ggatagtgtagcatgtctttcttta

SEQ ID NO: 431087 - DNA, 25 bp, Rattus norvegicus
ggatagtgtagcttgtctttcttta

SEQ ID NO: 431088 - DNA, 25 bp, Rattus norvegicus
ggatagttaaaccacatgcagatgt

SEQ ID NO: 431089 - DNA, 25 bp, Rattus norvegicus
ggatagttaaacgacatgcagatgt

SEQ ID NO: 431090 - DNA, 25 bp, Rattus norvegicus
ggatagttcttaaacgcctttcaat

SEQ ID NO: 431091 - DNA, 25 bp, Rattus norvegicus
ggatagttcttaatctaccgatgaa

SEQ ID NO: 431092 - DNA, 25 bp, Rattus norvegicus
ggatagttcttatacgcctttcaat

SEQ ID NO: 431093 - DNA, 25 bp, Rattus norvegicus
ggatagttcttattctaccgatgaa

SEQ ID NO: 431094 - DNA, 25 bp, Rattus norvegicus
ggatagttgcttatgatcccagcag

SEQ ID NO: 431095 - DNA, 25 bp, Rattus norvegicus
ggatagttgcttttgatcccagcag

SEQ ID NO: 431096 - DNA, 25 bp, Rattus norvegicus
ggatagtttcacatttctcatcatt

SEQ ID NO: 431097 - DNA, 25 bp, Rattus norvegicus
ggatagtttcacttttctcatcatt

SEQ ID NO: 431098 - DNA, 25 bp, Rattus norvegicus
ggatataaagctaacgctctctggg

SEQ ID NO: 431099 - DNA, 25 bp, Rattus norvegicus
ggatataaagcttacgctctctggg

SEQ ID NO: 431100 - DNA, 25 bp, Rattus norvegicus
ggatataaattcaacctctgagcta

SEQ ID NO: 431101 - DNA, 25 bp, Rattus norvegicus
ggatataaattctacctctgagcta

SEQ ID NO: 431102 - DNA, 25 bp, Rattus norvegicus
ggatataacagcacttcacagaaat

SEQ ID NO: 431103 - DNA, 25 bp, Rattus norvegicus
ggatataacagctcttcacagaaat

SEQ ID NO: 431104 - DNA, 25 bp, Rattus norvegicus
ggatataacccacgctcttacaaag

SEQ ID NO: 431105 - DNA, 25 bp, Rattus norvegicus
ggatataacccaggctcttacaaag

SEQ ID NO: 431106 - DNA, 25 bp, Rattus norvegicus
ggatatacacacagcttctctaata

SEQ ID NO: 431107 - DNA, 25 bp, Rattus norvegicus
ggatatacacactgcttctctaata

SEQ ID NO: 431108 - DNA, 25 bp, Rattus norvegicus
ggatatacgtctcatgatgacactt

SEQ ID NO: 431109 - DNA, 25 bp, Rattus norvegicus
ggatatacgtctgatgatgacactt

SEQ ID NO: 431110 - DNA, 25 bp, Rattus norvegicus
ggatatacttcacaatctgaccaca

SEQ ID NO: 431111 - DNA, 25 bp, Rattus norvegicus
ggatatacttcagaatctgaccaca

SEQ ID NO: 431112 - DNA, 25 bp, Rattus norvegicus
ggatatagacctcgcacatgtcctg

SEQ ID NO: 431113 - DNA, 25 bp, Rattus norvegicus
ggatatagacctggcacatgtcctg

SEQ ID NO: 431114 - DNA, 25 bp, Rattus norvegicus
ggatatagcctgagggattcgcttt

SEQ ID NO: 431115 - DNA, 25 bp, Rattus norvegicus
ggatatagcctgtgggattcgcttt

SEQ ID NO: 431116 - DNA, 25 bp, Rattus norvegicus
ggatatagctggacgggacctcact

SEQ ID NO: 431117 - DNA, 25 bp, Rattus norvegicus
ggatatagctggtcgggacctcact

SEQ ID NO: 431118 - DNA, 25 bp, Rattus norvegicus
ggatatatcctacgtactgcactgt

SEQ ID NO: 431119 - DNA, 25 bp, Rattus norvegicus
ggatatatcctaggtactgcactgt

SEQ ID NO: 431120 - DNA, 25 bp, Rattus norvegicus
ggatatatctttaattcagcacctg

SEQ ID NO: 431121 - DNA, 25 bp, Rattus norvegicus
ggatatatcttttattcagcacctg

SEQ ID NO: 431122 - DNA, 25 bp, Rattus norvegicus
ggatatatgggcacaccgatgcaga

SEQ ID NO: 431123 - DNA, 25 bp, Rattus norvegicus
ggatatatgggctcaccgatgcaga

SEQ ID NO: 431124 - DNA, 25 bp, Rattus norvegicus
ggatatattcctagcagtgcttgcc

SEQ ID NO: 431125 - DNA, 25 bp, Rattus norvegicus
ggatatattccttgcagtgcttgcc

SEQ ID NO: 431126 - DNA, 25 bp, Rattus norvegicus
ggatatatttatctgtaaagctcct

SEQ ID NO: 431127 - DNA, 25 bp, Rattus norvegicus
ggatatatttatgtgtaaagctcct

SEQ ID NO: 431128 - DNA, 25 bp, Rattus norvegicus
ggatatattttcatgcacagctgtt

SEQ ID NO: 431129 - DNA, 25 bp, Rattus norvegicus
ggatatattttcttgcacagctgtt

SEQ ID NO: 431130 - DNA, 25 bp, Rattus norvegicus
ggatatcaacagactcttgcttacc

SEQ ID NO: 431131 - DNA, 25 bp, Rattus norvegicus
ggatatcaacagtctcttgcttacc

SEQ ID NO: 431132 - DNA, 25 bp, Rattus norvegicus
ggatatcaatgtactctgtcaggta

SEQ ID NO: 431133 - DNA, 25 bp, Rattus norvegicus
ggatatcaatgttctctgtcaggta

SEQ ID NO: 431134 - DNA, 25 bp, Rattus norvegicus
ggatatcatcaaactcttcctgcac

SEQ ID NO: 431135 - DNA, 25 bp, Rattus norvegicus
ggatatcatcaatctcttcctgcac

SEQ ID NO: 431136 - DNA, 25 bp, Rattus norvegicus
ggatatcatgggagctgtcatcagt

SEQ ID NO: 431137 - DNA, 25 bp, Rattus norvegicus
ggatatcatgggtgctgtcatcagt

SEQ ID NO: 431138 - DNA, 25 bp, Rattus norvegicus
ggatatccaaggcttggtgcctccc

SEQ ID NO: 431139 - DNA, 25 bp, Rattus norvegicus
ggatatccaagggttggtgcctccc

SEQ ID NO: 431140 - DNA, 25 bp, Rattus norvegicus
ggatatcccattacaggccttggag

SEQ ID NO: 431141 - DNA, 25 bp, Rattus norvegicus
ggatatcccatttcaggccttggag

SEQ ID NO: 431142 - DNA, 25 bp, Rattus norvegicus
ggatatccgaatcacctcgtttgaa

SEQ ID NO: 431143 - DNA, 25 bp, Rattus norvegicus
ggatatccgaatgacctcgtttgaa

SEQ ID NO: 431144 - DNA, 25 bp, Rattus norvegicus
ggatatcctgccataggcttgttaa

SEQ ID NO: 431145 - DNA, 25 bp, Rattus norvegicus
ggatatcctgccttaggcttgttaa

SEQ ID NO: 431146 - DNA, 25 bp, Rattus norvegicus
ggatatcctttcactctgcatggtt

SEQ ID NO: 431147 - DNA, 25 bp, Rattus norvegicus
ggatatcctttctctctgcatggtt

SEQ ID NO: 431148 - DNA, 25 bp, Rattus norvegicus
ggatatcgatacaactccagttttc

SEQ ID NO: 431149 - DNA, 25 bp, Rattus norvegicus
ggatatcgatactactccagttttc

SEQ ID NO: 431150 - DNA, 25 bp, Rattus norvegicus
ggatatcgatctatggcagacttat

SEQ ID NO: 431151 - DNA, 25 bp, Rattus norvegicus
ggatatcgatctttggcagacttat

SEQ ID NO: 431152 - DNA, 25 bp, Rattus norvegicus
ggatatctaatcaaaacccgtgtta

SEQ ID NO: 431153 - DNA, 25 bp, Rattus norvegicus
ggatatctaatctaaacccgtgtta

SEQ ID NO: 431154 - DNA, 25 bp, Rattus norvegicus
ggatatctattccaagactaagtct

SEQ ID NO: 431155 - DNA, 25 bp, Rattus norvegicus
ggatatctattcgaagactaagtct

SEQ ID NO: 431156 - DNA, 25 bp, Rattus norvegicus
ggatatctcagaacaccggaggcaa

SEQ ID NO: 431157 - DNA, 25 bp, Rattus norvegicus
ggatatctcagactacgtacatgtt

SEQ ID NO: 431158 - DNA, 25 bp, Rattus norvegicus
ggatatctcagagtacgtacatgtt

SEQ ID NO: 431159 - DNA, 25 bp, Rattus norvegicus
ggatatctcagatcaccggaggcaa

SEQ ID NO: 431160 - DNA, 25 bp, Rattus norvegicus
ggatatctgcttaacagggtcctct

SEQ ID NO: 431161 - DNA, 25 bp, Rattus norvegicus
ggatatctgctttacagggtcctct

SEQ ID NO: 431162 - DNA, 25 bp, Rattus norvegicus
ggatatctggaaaagcctctcttca

SEQ ID NO: 431163 - DNA, 25 bp, Rattus norvegicus
ggatatctggaatagcctctcttca

SEQ ID NO: 431164 - DNA, 25 bp, Rattus norvegicus
ggatatcttaaaccaaccaacatct

SEQ ID NO: 431165 - DNA, 25 bp, Rattus norvegicus
ggatatcttaaagcaaccaacatct

SEQ ID NO: 431166 - DNA, 25 bp, Rattus norvegicus
ggatatcttaacagccactttgtta

SEQ ID NO: 431167 - DNA, 25 bp, Rattus norvegicus
ggatatcttaactgccactttgtta

SEQ ID NO: 431168 - DNA, 25 bp, Rattus norvegicus
ggatatcttccgcaagctgggactg

SEQ ID NO: 431169 - DNA, 25 bp, Rattus norvegicus
ggatatcttccgcttcatagacaac

SEQ ID NO: 431170 - DNA, 25 bp, Rattus norvegicus
ggatatcttccggaagctgggactg

SEQ ID NO: 431171 - DNA, 25 bp, Rattus norvegicus
ggatatcttccggttcatagacaac

SEQ ID NO: 431172 - DNA, 25 bp, Rattus norvegicus
ggatatcttctaagatctacctcag

SEQ ID NO: 431173 - DNA, 25 bp, Rattus norvegicus
ggatatcttctatgatctacctcag

SEQ ID NO: 431174 - DNA, 25 bp, Rattus norvegicus
ggatatgacagcatgcacggatttt

SEQ ID NO: 431175 - DNA, 25 bp, Rattus norvegicus
ggatatgacagcttgcacggatttt

SEQ ID NO: 431176 - DNA, 25 bp, Rattus norvegicus
ggatatgacataatcttgtacccag

SEQ ID NO: 431177 - DNA, 25 bp, Rattus norvegicus
ggatatgacatattcttgtacccag

SEQ ID NO: 431178 - DNA, 25 bp, Rattus norvegicus
ggatatgaccttactggctagggca

SEQ ID NO: 431179 - DNA, 25 bp, Rattus norvegicus
ggatatgacctttctggctagggca

SEQ ID NO: 431180 - DNA, 25 bp, Rattus norvegicus
ggatatgacgtcatcttgcagacta

SEQ ID NO: 431181 - DNA, 25 bp, Rattus norvegicus
ggatatgacgtcttcttgcagacta

SEQ ID NO: 431182 - DNA, 25 bp, Rattus norvegicus
ggatatgactccaacttctgaccct

SEQ ID NO: 431183 - DNA, 25 bp, Rattus norvegicus
ggatatgactcctacttctgaccct

SEQ ID NO: 431184 - DNA, 25 bp, Rattus norvegicus
ggatatgactgtacctgtctggcct

SEQ ID NO: 431185 - DNA, 25 bp, Rattus norvegicus
ggatatgactgttcctgtctggcct

SEQ ID NO: 431186 - DNA, 25 bp, Rattus norvegicus
ggatatgacttgcacactactggaa

SEQ ID NO: 431187 - DNA, 25 bp, Rattus norvegicus
ggatatgacttggacactactggaa

SEQ ID NO: 431188 - DNA, 25 bp, Rattus norvegicus
ggatatgagccaatacgttgcatct

SEQ ID NO: 431189 - DNA, 25 bp, Rattus norvegicus
ggatatgagccattacgttgcatct

SEQ ID NO: 431190 - DNA, 25 bp, Rattus norvegicus
ggatatgaggctactgcaggcagac

SEQ ID NO: 431191 - DNA, 25 bp, Rattus norvegicus
ggatatgaggcttctgcaggcagac

SEQ ID NO: 431192 - DNA, 25 bp, Rattus norvegicus
ggatatgatggtaaccgctcttcat

SEQ ID NO: 431193 - DNA, 25 bp, Rattus norvegicus
ggatatgatggttaccgctcttcat

SEQ ID NO: 431194 - DNA, 25 bp, Rattus norvegicus
ggatatgcagcgaggaccctgcatt

SEQ ID NO: 431195 - DNA, 25 bp, Rattus norvegicus
ggatatgcagcgtggaccctgcatt

SEQ ID NO: 431196 - DNA, 25 bp, Rattus norvegicus
ggatatgcaggtctgtggacaacat

SEQ ID NO: 431197 - DNA, 25 bp, Rattus norvegicus
ggatatgcaggtgtgtggacaacat

SEQ ID NO: 431198 - DNA, 25 bp, Rattus norvegicus
ggatatgcatttcctcactttgcct

SEQ ID NO: 431199 - DNA, 25 bp, Rattus norvegicus
ggatatgcatttgctcactttgcct

SEQ ID NO: 431200 - DNA, 25 bp, Rattus norvegicus
ggatatgccaatccccaactcaatt

SEQ ID NO: 431201 - DNA, 25 bp, Rattus norvegicus
ggatatgccaatgcccaactcaatt

SEQ ID NO: 431202 - DNA, 25 bp, Rattus norvegicus
ggatatgccgaaatgtttaacatgc

SEQ ID NO: 431203 - DNA, 25 bp, Rattus norvegicus
ggatatgccgaattgtttaacatgc

SEQ ID NO: 431204 - DNA, 25 bp, Rattus norvegicus
ggatatgcctgcagccatcagagca

SEQ ID NO: 431205 - DNA, 25 bp, Rattus norvegicus
ggatatgcctgctgccatcagagca

SEQ ID NO: 431206 - DNA, 25 bp, Rattus norvegicus
ggatatgctatacgacaggaactca

SEQ ID NO: 431207 - DNA, 25 bp, Rattus norvegicus
ggatatgctataggacaggaactca

SEQ ID NO: 431208 - DNA, 25 bp, Rattus norvegicus
ggatatgctcctataatttctatag

SEQ ID NO: 431209 - DNA, 25 bp, Rattus norvegicus
ggatatgctcctttaatttctatag

SEQ ID NO: 431210 - DNA, 25 bp, Rattus norvegicus
ggatatgctggccaacacccagggc

SEQ ID NO: 431211 - DNA, 25 bp, Rattus norvegicus
ggatatgctggcgaacacccagggc

SEQ ID NO: 431212 - DNA, 25 bp, Rattus norvegicus
ggatatggaaccaccatcttctgat

SEQ ID NO: 431213 - DNA, 25 bp, Rattus norvegicus
ggatatggaacctccatcttctgat

SEQ ID NO: 431214 - DNA, 25 bp, Rattus norvegicus
ggatatggcaaactaagccaccaag

SEQ ID NO: 431215 - DNA, 25 bp, Rattus norvegicus
ggatatggcaaagtaagccaccaag

SEQ ID NO: 431216 - DNA, 25 bp, Rattus norvegicus
ggatatggcctaccattcagtggga

SEQ ID NO: 431217 - DNA, 25 bp, Rattus norvegicus
ggatatggcctagcattcagtggga

SEQ ID NO: 431218 - DNA, 25 bp, Rattus norvegicus
ggatatggctttccagaaccctaca

SEQ ID NO: 431219 - DNA, 25 bp, Rattus norvegicus
ggatatggctttgcagaaccctaca

SEQ ID NO: 431220 - DNA, 25 bp, Rattus norvegicus
ggatatgggacgaaaccttatgatt

SEQ ID NO: 431221 - DNA, 25 bp, Rattus norvegicus
ggatatgggacgtaaccttatgatt

SEQ ID NO: 431222 - DNA, 25 bp, Rattus norvegicus
ggatatggtctcctgcagactgaaa

SEQ ID NO: 431223 - DNA, 25 bp, Rattus norvegicus
ggatatggtctcgtgcagactgaaa

SEQ ID NO: 431224 - DNA, 25 bp, Rattus norvegicus
ggatatggtttgagtgtctctagct

SEQ ID NO: 431225 - DNA, 25 bp, Rattus norvegicus
ggatatggtttgtgtgtctctagct

SEQ ID NO: 431226 - DNA, 25 bp, Rattus norvegicus
ggatatgtaaccatcattgtataac

SEQ ID NO: 431227 - DNA, 25 bp, Rattus norvegicus
ggatatgtaaccttcattgtataac

SEQ ID NO: 431228 - DNA, 25 bp, Rattus norvegicus
ggatatgtacaacactatgaagact

SEQ ID NO: 431229 - DNA, 25 bp, Rattus norvegicus
ggatatgtacaagactatgaagact

SEQ ID NO: 431230 - DNA, 25 bp, Rattus norvegicus
ggatatgtatccacaaagttgcagg

SEQ ID NO: 431231 - DNA, 25 bp, Rattus norvegicus
ggatatgtatcctcaaagttgcagg

SEQ ID NO: 431232 - DNA, 25 bp, Rattus norvegicus
ggatatgtctgcagacttgtgtcgt

SEQ ID NO: 431233 - DNA, 25 bp, Rattus norvegicus
ggatatgtctgctgacttgtgtcgt

SEQ ID NO: 431234 - DNA, 25 bp, Rattus norvegicus
ggatatgtcttgagacctgtttttt

SEQ ID NO: 431235 - DNA, 25 bp, Rattus norvegicus
ggatatgtcttgtgacctgtttttt

SEQ ID NO: 431236 - DNA, 25 bp, Rattus norvegicus
ggatatgtgagcaccatgttacccc

SEQ ID NO: 431237 - DNA, 25 bp, Rattus norvegicus
ggatatgtgagctccatgttacccc

SEQ ID NO: 431238 - DNA, 25 bp, Rattus norvegicus
ggatatgttcctattgttgctgtaa

SEQ ID NO: 431239 - DNA, 25 bp, Rattus norvegicus
ggatatgttccttttgttgctgtaa

SEQ ID NO: 431240 - DNA, 25 bp, Rattus norvegicus
ggatattcaaaacttcccgaggaag

SEQ ID NO: 431241 - DNA, 25 bp, Rattus norvegicus
ggatattcaaaagttcccgaggaag

SEQ ID NO: 431242 - DNA, 25 bp, Rattus norvegicus
ggatattcactcatcaacagagata

SEQ ID NO: 431243 - DNA, 25 bp, Rattus norvegicus
ggatattcactcttcaacagagata

SEQ ID NO: 431244 - DNA, 25 bp, Rattus norvegicus
ggatattccacaaggcttaaactga

SEQ ID NO: 431245 - DNA, 25 bp, Rattus norvegicus
ggatattccacatggcttaaactga

SEQ ID NO: 431246 - DNA, 25 bp, Rattus norvegicus
ggatattccccacagacattttgat

SEQ ID NO: 431247 - DNA, 25 bp, Rattus norvegicus
ggatattccccagagacattttgat

SEQ ID NO: 431248 - DNA, 25 bp, Rattus norvegicus
ggatattcctctcgctgttcattat

SEQ ID NO: 431249 - DNA, 25 bp, Rattus norvegicus
ggatattcctctggctgttcattat

SEQ ID NO: 431250 - DNA, 25 bp, Rattus norvegicus
ggatattcgggcactgtgatacagg

SEQ ID NO: 431251 - DNA, 25 bp, Rattus norvegicus
ggatattcgggctctgtgatacagg

SEQ ID NO: 431252 - DNA, 25 bp, Rattus norvegicus
ggatattctacgattctcatcaaat

SEQ ID NO: 431253 - DNA, 25 bp, Rattus norvegicus
ggatattctacgtttctcatcaaat

SEQ ID NO: 431254 - DNA, 25 bp, Rattus norvegicus
ggatattctcataggtttcctccgc

SEQ ID NO: 431255 - DNA, 25 bp, Rattus norvegicus
ggatattctcattggtttcctccgc

SEQ ID NO: 431256 - DNA, 25 bp, Rattus norvegicus
ggatattctccaacagttggttcgt

SEQ ID NO: 431257 - DNA, 25 bp, Rattus norvegicus
ggatattctccatcagttggttcgt

SEQ ID NO: 431258 - DNA, 25 bp, Rattus norvegicus
ggatattctcctccactttagaaag

SEQ ID NO: 431259 - DNA, 25 bp, Rattus norvegicus
ggatattctcctgcactttagaaag

SEQ ID NO: 431260 - DNA, 25 bp, Rattus norvegicus
ggatattgccttatttgtctgtaaa

SEQ ID NO: 431261 - DNA, 25 bp, Rattus norvegicus
ggatattgccttttttgtctgtaaa

SEQ ID NO: 431262 - DNA, 25 bp, Rattus norvegicus
ggatattgctgcataccgtgccaag

SEQ ID NO: 431263 - DNA, 25 bp, Rattus norvegicus
ggatattgctgcttaccgtgccaag

SEQ ID NO: 431264 - DNA, 25 bp, Rattus norvegicus
ggatattggtctctacagcagccat

SEQ ID NO: 431265 - DNA, 25 bp, Rattus norvegicus
ggatattggtctgtacagcagccat

SEQ ID NO: 431266 - DNA, 25 bp, Rattus norvegicus
ggatattgtctcagcattttttcat

SEQ ID NO: 431267 - DNA, 25 bp, Rattus norvegicus
ggatattgtctctgcattttttcat

SEQ ID NO: 431268 - DNA, 25 bp, Rattus norvegicus
ggatattgtttcattcagcttttac

SEQ ID NO: 431269 - DNA, 25 bp, Rattus norvegicus
ggatattgtttctttcagcttttac

SEQ ID NO: 431270 - DNA, 25 bp, Rattus norvegicus
ggatatttaattcatcccattaaca

SEQ ID NO: 431271 - DNA, 25 bp, Rattus norvegicus
ggatatttaattgatcccattaaca

SEQ ID NO: 431272 - DNA, 25 bp, Rattus norvegicus
ggatatttacctcagtccccaagtg

SEQ ID NO: 431273 - DNA, 25 bp, Rattus norvegicus
ggatatttacctgagtccccaagtg

SEQ ID NO: 431274 - DNA, 25 bp, Rattus norvegicus
ggatatttacttcaaagtttctggt

SEQ ID NO: 431275 - DNA, 25 bp, Rattus norvegicus
ggatatttacttgaaagtttctggt

SEQ ID NO: 431276 - DNA, 25 bp, Rattus norvegicus
ggatatttagctctgttcctgaaaa

SEQ ID NO: 431277 - DNA, 25 bp, Rattus norvegicus
ggatatttagctgtgttcctgaaaa

SEQ ID NO: 431278 - DNA, 25 bp, Rattus norvegicus
ggatatttatcaccagagctggcgt

SEQ ID NO: 431279 - DNA, 25 bp, Rattus norvegicus
ggatatttatcagcagagctggcgt

SEQ ID NO: 431280 - DNA, 25 bp, Rattus norvegicus
ggatatttcacactccatatagaga

SEQ ID NO: 431281 - DNA, 25 bp, Rattus norvegicus
ggatatttcacagtccatatagaga

SEQ ID NO: 431282 - DNA, 25 bp, Rattus norvegicus
ggatatttcactaaactcctccacc

SEQ ID NO: 431283 - DNA, 25 bp, Rattus norvegicus
ggatatttcacttaactcctccacc

SEQ ID NO: 431284 - DNA, 25 bp, Rattus norvegicus
ggatatttccccagctctaagcaaa

SEQ ID NO: 431285 - DNA, 25 bp, Rattus norvegicus
ggatatttcccctgctctaagcaaa

SEQ ID NO: 431286 - DNA, 25 bp, Rattus norvegicus
ggatatttctccagtgttcagcaaa

SEQ ID NO: 431287 - DNA, 25 bp, Rattus norvegicus
ggatatttctcctgtgttcagcaaa

SEQ ID NO: 431288 - DNA, 25 bp, Rattus norvegicus
ggatatttcttgaacttggcctgct

SEQ ID NO: 431289 - DNA, 25 bp, Rattus norvegicus
ggatatttcttgtacttggcctgct

SEQ ID NO: 431290 - DNA, 25 bp, Rattus norvegicus
ggatatttgataccattcacctatg

SEQ ID NO: 431291 - DNA, 25 bp, Rattus norvegicus
ggatatttgatagcattcacctatg

SEQ ID NO: 431292 - DNA, 25 bp, Rattus norvegicus
ggatatttggctctctttataccta

SEQ ID NO: 431293 - DNA, 25 bp, Rattus norvegicus
ggatatttggctgtctttataccta

SEQ ID NO: 431294 - DNA, 25 bp, Rattus norvegicus
ggatatttggttatctcagatgagc

SEQ ID NO: 431295 - DNA, 25 bp, Rattus norvegicus
ggatatttggttttctcagatgagc

SEQ ID NO: 431296 - DNA, 25 bp, Rattus norvegicus
ggatattttcatacctttgctggag

SEQ ID NO: 431297 - DNA, 25 bp, Rattus norvegicus
ggatattttcattcctttgctggag

SEQ ID NO: 431298 - DNA, 25 bp, Rattus norvegicus
ggatattttcctccataatcttcaa

SEQ ID NO: 431299 - DNA, 25 bp, Rattus norvegicus
ggatattttcctgcataatcttcaa

SEQ ID NO: 431300 - DNA, 25 bp, Rattus norvegicus
ggatattttcttccaatcaggtgga

SEQ ID NO: 431301 - DNA, 25 bp, Rattus norvegicus
ggatattttcttgcaatcaggtgga

SEQ ID NO: 431302 - DNA, 25 bp, Rattus norvegicus
ggatattttgccataaaccttgagt

SEQ ID NO: 431303 - DNA, 25 bp, Rattus norvegicus
ggatattttgccttaaaccttgagt

SEQ ID NO: 431304 - DNA, 25 bp, Rattus norvegicus
ggatattttgtccacagcttgacca

SEQ ID NO: 431305 - DNA, 25 bp, Rattus norvegicus
ggatattttgtcgacagcttgacca

SEQ ID NO: 431306 - DNA, 25 bp, Rattus norvegicus
ggatcaaaattacgttctcctcttt

SEQ ID NO: 431307 - DNA, 25 bp, Rattus norvegicus
ggatcaaaattaggttctcctcttt

SEQ ID NO: 431308 - DNA, 25 bp, Rattus norvegicus
ggatcaaacccacagtgtctgctct

SEQ ID NO: 431309 - DNA, 25 bp, Rattus norvegicus
ggatcaaacccagagtgtctgctct

SEQ ID NO: 431310 - DNA, 25 bp, Rattus norvegicus
ggatcaaacctaaacttcggctgta

SEQ ID NO: 431311 - DNA, 25 bp, Rattus norvegicus
ggatcaaacctatacttcggctgta

SEQ ID NO: 431312 - DNA, 25 bp, Rattus norvegicus
ggatcaaagaggaccgacccatcac

SEQ ID NO: 431313 - DNA, 25 bp, Rattus norvegicus
ggatcaaagaggtccgacccatcac

SEQ ID NO: 431314 - DNA, 25 bp, Rattus norvegicus
ggatcaaaggatctacgaagctcta

SEQ ID NO: 431315 - DNA, 25 bp, Rattus norvegicus
ggatcaaaggatgtacgaagctcta

SEQ ID NO: 431316 - DNA, 25 bp, Rattus norvegicus
ggatcaaatctaccatggccagcat

SEQ ID NO: 431317 - DNA, 25 bp, Rattus norvegicus
ggatcaaatctagcatggccagcat

SEQ ID NO: 431318 - DNA, 25 bp, Rattus norvegicus
ggatcaaatgctctggacatcatct

SEQ ID NO: 431319 - DNA, 25 bp, Rattus norvegicus
ggatcaaatgctgtggacatcatct

SEQ ID NO: 431320 - DNA, 25 bp, Rattus norvegicus
ggatcaaatggcactttttcccttt

SEQ ID NO: 431321 - DNA, 25 bp, Rattus norvegicus
ggatcaaatggctctttttcccttt

SEQ ID NO: 431322 - DNA, 25 bp, Rattus norvegicus
ggatcaaatttcagtctgctgctat

SEQ ID NO: 431323 - DNA, 25 bp, Rattus norvegicus
ggatcaaatttctgtctgctgctat

SEQ ID NO: 431324 - DNA, 25 bp, Rattus norvegicus
ggatcaacaagcacttcctcgatga

SEQ ID NO: 431325 - DNA, 25 bp, Rattus norvegicus
ggatcaacaagctcttcctcgatga

SEQ ID NO: 431326 - DNA, 25 bp, Rattus norvegicus
ggatcaacacctctgctctcaagag

SEQ ID NO: 431327 - DNA, 25 bp, Rattus norvegicus
ggatcaacacctgtgctctcaagag

SEQ ID NO: 431328 - DNA, 25 bp, Rattus norvegicus
ggatcaacacggaccgcatctaatc

SEQ ID NO: 431329 - DNA, 25 bp, Rattus norvegicus
ggatcaacacggtccgcatctaatc

SEQ ID NO: 431330 - DNA, 25 bp, Rattus norvegicus
ggatcaacatgtccggcttgaccac

SEQ ID NO: 431331 - DNA, 25 bp, Rattus norvegicus
ggatcaacatgtgcggcttgaccac

SEQ ID NO: 431332 - DNA, 25 bp, Rattus norvegicus
ggatcaaccattcacctaggtaggt

SEQ ID NO: 431333 - DNA, 25 bp, Rattus norvegicus
ggatcaaccattgacctaggtaggt

SEQ ID NO: 431334 - DNA, 25 bp, Rattus norvegicus
ggatcaacctgacgaccgacacgag

SEQ ID NO: 431335 - DNA, 25 bp, Rattus norvegicus
ggatcaacctgaggaccgacacgag

SEQ ID NO: 431336 - DNA, 25 bp, Rattus norvegicus
ggatcaacggtgacatgggttcaaa

SEQ ID NO: 431337 - DNA, 25 bp, Rattus norvegicus
ggatcaacggtgtcatgggttcaaa

SEQ ID NO: 431338 - DNA, 25 bp, Rattus norvegicus
ggatcaactaacactggctgactgt

SEQ ID NO: 431339 - DNA, 25 bp, Rattus norvegicus
ggatcaactaactctggctgactgt

SEQ ID NO: 431340 - DNA, 25 bp, Rattus norvegicus
ggatcaactcatcaaaacactgtga

SEQ ID NO: 431341 - DNA, 25 bp, Rattus norvegicus
ggatcaactcatgaaaacactgtga

SEQ ID NO: 431342 - DNA, 25 bp, Rattus norvegicus
ggatcaacttcacctgcattaacag

SEQ ID NO: 431343 - DNA, 25 bp, Rattus norvegicus
ggatcaacttcagctgcattaacag

SEQ ID NO: 431344 - DNA, 25 bp, Rattus norvegicus
ggatcaacttcccaaggtatatttt

SEQ ID NO: 431345 - DNA, 25 bp, Rattus norvegicus
ggatcaacttccgaaggtatatttt

SEQ ID NO: 431346 - DNA, 25 bp, Rattus norvegicus
ggatcaacttgaatttcctttaatg

SEQ ID NO: 431347 - DNA, 25 bp, Rattus norvegicus
ggatcaacttgattttcctttaatg

SEQ ID NO: 431348 - DNA, 25 bp, Rattus norvegicus
ggatcaacttggcaatcccaatacc

SEQ ID NO: 431349 - DNA, 25 bp, Rattus norvegicus
ggatcaacttgggaatcccaatacc

SEQ ID NO: 431350 - DNA, 25 bp, Rattus norvegicus
ggatcaagaacgctgccgccaatgt

SEQ ID NO: 431351 - DNA, 25 bp, Rattus norvegicus
ggatcaagaacggtgccgccaatgt

SEQ ID NO: 431352 - DNA, 25 bp, Rattus norvegicus
ggatcaagacatcgcctggtccact

SEQ ID NO: 431353 - DNA, 25 bp, Rattus norvegicus
ggatcaagacatggcctggtccact

SEQ ID NO: 431354 - DNA, 25 bp, Rattus norvegicus
ggatcaagactcacctggaaagaca

SEQ ID NO: 431355 - DNA, 25 bp, Rattus norvegicus
ggatcaagactctcctggaaagaca

SEQ ID NO: 431356 - DNA, 25 bp, Rattus norvegicus
ggatcaagaggtcaaggctgtcctt

SEQ ID NO: 431357 - DNA, 25 bp, Rattus norvegicus
ggatcaagaggtgaaggctgtcctt

SEQ ID NO: 431358 - DNA, 25 bp, Rattus norvegicus
ggatcaagataaactacctccccgt

SEQ ID NO: 431359 - DNA, 25 bp, Rattus norvegicus
ggatcaagataatctacctccccgt

SEQ ID NO: 431360 - DNA, 25 bp, Rattus norvegicus
ggatcaagcccgcaagttcgagaac

SEQ ID NO: 431361 - DNA, 25 bp, Rattus norvegicus
ggatcaagcccggaagttcgagaac

SEQ ID NO: 431362 - DNA, 25 bp, Rattus norvegicus
ggatcaagggctcttttctgcacat

SEQ ID NO: 431363 - DNA, 25 bp, Rattus norvegicus
ggatcaagggctgttttctgcacat

SEQ ID NO: 431364 - DNA, 25 bp, Rattus norvegicus
ggatcaagtcacagcactgtgcttt

SEQ ID NO: 431365 - DNA, 25 bp, Rattus norvegicus
ggatcaagtcactgcactgtgcttt

SEQ ID NO: 431366 - DNA, 25 bp, Rattus norvegicus
ggatcaagtctgaccgccgaacgag

SEQ ID NO: 431367 - DNA, 25 bp, Rattus norvegicus
ggatcaagtctgtccgccgaacgag

SEQ ID NO: 431368 - DNA, 25 bp, Rattus norvegicus
ggatcaagtgcaacaaagccgccat

SEQ ID NO: 431369 - DNA, 25 bp, Rattus norvegicus
ggatcaagtgcatcaaagccgccat

SEQ ID NO: 431370 - DNA, 25 bp, Rattus norvegicus
ggatcaatcccactctaatagcagt

SEQ ID NO: 431371 - DNA, 25 bp, Rattus norvegicus
ggatcaatcccagtctaatagcagt

SEQ ID NO: 431372 - DNA, 25 bp, Rattus norvegicus
ggatcaatccgaccagcacacatga

SEQ ID NO: 431373 - DNA, 25 bp, Rattus norvegicus
ggatcaatccgagcagcacacatga

SEQ ID NO: 431374 - DNA, 25 bp, Rattus norvegicus
ggatcaatgacccagcagtcaccag

SEQ ID NO: 431375 - DNA, 25 bp, Rattus norvegicus
ggatcaatgaccgagcagtcaccag

SEQ ID NO: 431376 - DNA, 25 bp, Rattus norvegicus
ggatcaatgactattacctgtggtt

SEQ ID NO: 431377 - DNA, 25 bp, Rattus norvegicus
ggatcaatgacttttacctgtggtt

SEQ ID NO: 431378 - DNA, 25 bp, Rattus norvegicus
ggatcaattatcctccagcagtggg

SEQ ID NO: 431379 - DNA, 25 bp, Rattus norvegicus
ggatcaattatcgtccagcagtggg

SEQ ID NO: 431380 - DNA, 25 bp, Rattus norvegicus
ggatcaattgtgcactcattcttag

SEQ ID NO: 431381 - DNA, 25 bp, Rattus norvegicus
ggatcaattgtggactcattcttag

SEQ ID NO: 431382 - DNA, 25 bp, Rattus norvegicus
ggatcaatttctaaagtcatggcag

SEQ ID NO: 431383 - DNA, 25 bp, Rattus norvegicus
ggatcaatttcttaagtcatggcag

SEQ ID NO: 431384 - DNA, 25 bp, Rattus norvegicus
ggatcacaaatcaacgtacctccat

SEQ ID NO: 431385 - DNA, 25 bp, Rattus norvegicus
ggatcacaaatctacgtacctccat

SEQ ID NO: 431386 - DNA, 25 bp, Rattus norvegicus
ggatcacaaatgaagccggctgctc

SEQ ID NO: 431387 - DNA, 25 bp, Rattus norvegicus
ggatcacaaatgtagccggctgctc

SEQ ID NO: 431388 - DNA, 25 bp, Rattus norvegicus
ggatcacaagctcaagacccatctg

SEQ ID NO: 431389 - DNA, 25 bp, Rattus norvegicus
ggatcacaagctgaagacccatctg

SEQ ID NO: 431390 - DNA, 25 bp, Rattus norvegicus
ggatcacaccatcaggtcctggcta

SEQ ID NO: 431391 - DNA, 25 bp, Rattus norvegicus
ggatcacaccatgaggtcctggcta

SEQ ID NO: 431392 - DNA, 25 bp, Rattus norvegicus
ggatcacacctaagctcagagaact

SEQ ID NO: 431393 - DNA, 25 bp, Rattus norvegicus
ggatcacacctatgctcagagaact

SEQ ID NO: 431394 - DNA, 25 bp, Rattus norvegicus
ggatcacacctgaaactagatttct

SEQ ID NO: 431395 - DNA, 25 bp, Rattus norvegicus
ggatcacacctgtaactagatttct

SEQ ID NO: 431396 - DNA, 25 bp, Rattus norvegicus
ggatcacacgttagagacctgcctg

SEQ ID NO: 431397 - DNA, 25 bp, Rattus norvegicus
ggatcacacgtttgagacctgcctg

SEQ ID NO: 431398 - DNA, 25 bp, Rattus norvegicus
ggatcacactagaattttcttcaag

SEQ ID NO: 431399 - DNA, 25 bp, Rattus norvegicus
ggatcacactagtattttcttcaag

SEQ ID NO: 431400 - DNA, 25 bp, Rattus norvegicus
ggatcacagatgagattctttgctt

SEQ ID NO: 431401 - DNA, 25 bp, Rattus norvegicus
ggatcacagatgtgattctttgctt

SEQ ID NO: 431402 - DNA, 25 bp, Rattus norvegicus
ggatcacagcacaaccacagtaata

SEQ ID NO: 431403 - DNA, 25 bp, Rattus norvegicus
ggatcacagcactaccacagtaata

SEQ ID NO: 431404 - DNA, 25 bp, Rattus norvegicus
ggatcacagctaccgcagagccgtg

SEQ ID NO: 431405 - DNA, 25 bp, Rattus norvegicus
ggatcacagctagcgcagagccgtg

SEQ ID NO: 431406 - DNA, 25 bp, Rattus norvegicus
ggatcacaggtgcacactgccgtgc

SEQ ID NO: 431407 - DNA, 25 bp, Rattus norvegicus
ggatcacaggtggacactgccgtgc

SEQ ID NO: 431408 - DNA, 25 bp, Rattus norvegicus
ggatcacaggttatgtgccacacac

SEQ ID NO: 431409 - DNA, 25 bp, Rattus norvegicus
ggatcacaggttttgtgccacacac

SEQ ID NO: 431410 - DNA, 25 bp, Rattus norvegicus
ggatcacagtctcccaagggtccag

SEQ ID NO: 431411 - DNA, 25 bp, Rattus norvegicus
ggatcacagtctgccaagggtccag

SEQ ID NO: 431412 - DNA, 25 bp, Rattus norvegicus
ggatcacagttgaagggaccaccct

SEQ ID NO: 431413 - DNA, 25 bp, Rattus norvegicus
ggatcacagttgtagggaccaccct

SEQ ID NO: 431414 - DNA, 25 bp, Rattus norvegicus
ggatcacattcacaactcgtgtagg

SEQ ID NO: 431415 - DNA, 25 bp, Rattus norvegicus
ggatcacattcagaactcgtgtagg

SEQ ID NO: 431416 - DNA, 25 bp, Rattus norvegicus
ggatcaccacgcagaactgaccgta

SEQ ID NO: 431417 - DNA, 25 bp, Rattus norvegicus
ggatcaccacgctgaactgaccgta

SEQ ID NO: 431418 - DNA, 25 bp, Rattus norvegicus
ggatcaccagaccatgctgttcgtg

SEQ ID NO: 431419 - DNA, 25 bp, Rattus norvegicus
ggatcaccagacgatgctgttcgtg

SEQ ID NO: 431420 - DNA, 25 bp, Rattus norvegicus
ggatcaccagttctgagaagctctt

SEQ ID NO: 431421 - DNA, 25 bp, Rattus norvegicus
ggatcaccagttgtgagaagctctt

SEQ ID NO: 431422 - DNA, 25 bp, Rattus norvegicus
ggatcacccagccttgtttgtgtgc

SEQ ID NO: 431423 - DNA, 25 bp, Rattus norvegicus
ggatcacccagcgttgtttgtgtgc

SEQ ID NO: 431424 - DNA, 25 bp, Rattus norvegicus
ggatcaccgatcattgccgagaaag

SEQ ID NO: 431425 - DNA, 25 bp, Rattus norvegicus
ggatcaccgatctttgccgagaaag

SEQ ID NO: 431426 - DNA, 25 bp, Rattus norvegicus
ggatcaccggacatccaatgttaga

SEQ ID NO: 431427 - DNA, 25 bp, Rattus norvegicus
ggatcaccggacttccaatgttaga

SEQ ID NO: 431428 - DNA, 25 bp, Rattus norvegicus
ggatcacctagtactactacagtct

SEQ ID NO: 431429 - DNA, 25 bp, Rattus norvegicus
ggatcacctagttctactacagtct

SEQ ID NO: 431430 - DNA, 25 bp, Rattus norvegicus
ggatcacctccaattcgttcaaaat

SEQ ID NO: 431431 - DNA, 25 bp, Rattus norvegicus
ggatcacctccatttcgttcaaaat

SEQ ID NO: 431432 - DNA, 25 bp, Rattus norvegicus
ggatcacctgatcgtagacacgtgt

SEQ ID NO: 431433 - DNA, 25 bp, Rattus norvegicus
ggatcacctgatggtagacacgtgt

SEQ ID NO: 431434 - DNA, 25 bp, Rattus norvegicus
ggatcacctgcaacatctactgaag

SEQ ID NO: 431435 - DNA, 25 bp, Rattus norvegicus
ggatcacctgcatcatctactgaag

SEQ ID NO: 431436 - DNA, 25 bp, Rattus norvegicus
ggatcacctggtacttctcaaaaat

SEQ ID NO: 431437 - DNA, 25 bp, Rattus norvegicus
ggatcacctggttcttctcaaaaat

SEQ ID NO: 431438 - DNA, 25 bp, Rattus norvegicus
ggatcaccttgaagttttaagcttt

SEQ ID NO: 431439 - DNA, 25 bp, Rattus norvegicus
ggatcaccttgatgttttaagcttt

SEQ ID NO: 431440 - DNA, 25 bp, Rattus norvegicus
ggatcacctttaattctcatgtaga

SEQ ID NO: 431441 - DNA, 25 bp, Rattus norvegicus
ggatcacctttatttctcatgtaga

SEQ ID NO: 431442 - DNA, 25 bp, Rattus norvegicus
ggatcacgagtccataggtggccat

SEQ ID NO: 431443 - DNA, 25 bp, Rattus norvegicus
ggatcacgagtcgataggtggccat

SEQ ID NO: 431444 - DNA, 25 bp, Rattus norvegicus
ggatcacgcaacagaggactacctc

SEQ ID NO: 431445 - DNA, 25 bp, Rattus norvegicus
ggatcacgcaactgaggactacctc

SEQ ID NO: 431446 - DNA, 25 bp, Rattus norvegicus
ggatcacgccgaacactactaggct

SEQ ID NO: 431447 - DNA, 25 bp, Rattus norvegicus
ggatcacgccgatcactactaggct

SEQ ID NO: 431448 - DNA, 25 bp, Rattus norvegicus
ggatcacgttctcaaatccctgaga

SEQ ID NO: 431449 - DNA, 25 bp, Rattus norvegicus
ggatcacgttctgaaatccctgaga

SEQ ID NO: 431450 - DNA, 25 bp, Rattus norvegicus
ggatcactaaaaagtgcccgccatg

SEQ ID NO: 431451 - DNA, 25 bp, Rattus norvegicus
ggatcactaaaatgtgcccgccatg

SEQ ID NO: 431452 - DNA, 25 bp, Rattus norvegicus
ggatcactccttcgtgactttgagc

SEQ ID NO: 431453 - DNA, 25 bp, Rattus norvegicus
ggatcactccttggtgactttgagc

SEQ ID NO: 431454 - DNA, 25 bp, Rattus norvegicus
ggatcactcgccaagcataaacaac

SEQ ID NO: 431455 - DNA, 25 bp, Rattus norvegicus
ggatcactcgcctagcataaacaac

SEQ ID NO: 431456 - DNA, 25 bp, Rattus norvegicus
ggatcactgaagacctttaagtact

SEQ ID NO: 431457 - DNA, 25 bp, Rattus norvegicus
ggatcactgaagtcctttaagtact

SEQ ID NO: 431458 - DNA, 25 bp, Rattus norvegicus
ggatcactgaccactggagtcggca

SEQ ID NO: 431459 - DNA, 25 bp, Rattus norvegicus
ggatcactgacctctggagtcggca

SEQ ID NO: 431460 - DNA, 25 bp, Rattus norvegicus
ggatcactgccaagtggcctgtagg

SEQ ID NO: 431461 - DNA, 25 bp, Rattus norvegicus
ggatcactgccatgtggcctgtagg

SEQ ID NO: 431462 - DNA, 25 bp, Rattus norvegicus
ggatcactgcgacagctgaaaacag

SEQ ID NO: 431463 - DNA, 25 bp, Rattus norvegicus
ggatcactgcgagagctgaaaacag

SEQ ID NO: 431464 - DNA, 25 bp, Rattus norvegicus
ggatcactgggtaaaaacactcggt

SEQ ID NO: 431465 - DNA, 25 bp, Rattus norvegicus
ggatcactgggttaaaacactcggt

SEQ ID NO: 431466 - DNA, 25 bp, Rattus norvegicus
ggatcactggtaatatttcagactt

SEQ ID NO: 431467 - DNA, 25 bp, Rattus norvegicus
ggatcactggtattatttcagactt

SEQ ID NO: 431468 - DNA, 25 bp, Rattus norvegicus
ggatcactgtgtacacgttggccaa

SEQ ID NO: 431469 - DNA, 25 bp, Rattus norvegicus
ggatcactgtgttcacgttggccaa

SEQ ID NO: 431470 - DNA, 25 bp, Rattus norvegicus
ggatcacttcctatagacccattga

SEQ ID NO: 431471 - DNA, 25 bp, Rattus norvegicus
ggatcacttcctttagacccattga

SEQ ID NO: 431472 - DNA, 25 bp, Rattus norvegicus
ggatcacttctgaatgtaacttttt

SEQ ID NO: 431473 - DNA, 25 bp, Rattus norvegicus
ggatcacttctgtatgtaacttttt

SEQ ID NO: 431474 - DNA, 25 bp, Rattus norvegicus
ggatcacttgtccttcagtaggctc

SEQ ID NO: 431475 - DNA, 25 bp, Rattus norvegicus
ggatcacttgtcgttcagtaggctc

SEQ ID NO: 431476 - DNA, 25 bp, Rattus norvegicus
ggatcactttatactgacttgcaag

SEQ ID NO: 431477 - DNA, 25 bp, Rattus norvegicus
ggatcactttattctgacttgcaag

SEQ ID NO: 431478 - DNA, 25 bp, Rattus norvegicus
ggatcagaaacacttgccaaaagtc

SEQ ID NO: 431479 - DNA, 25 bp, Rattus norvegicus
ggatcagaaacagttgccaaaagtc

SEQ ID NO: 431480 - DNA, 25 bp, Rattus norvegicus
ggatcagaaattcaaggccctcttt

SEQ ID NO: 431481 - DNA, 25 bp, Rattus norvegicus
ggatcagaaattgaaggccctcttt

SEQ ID NO: 431482 - DNA, 25 bp, Rattus norvegicus
ggatcagaacttatctgtgaaagtc

SEQ ID NO: 431483 - DNA, 25 bp, Rattus norvegicus
ggatcagaacttcccagcatttgtg

SEQ ID NO: 431484 - DNA, 25 bp, Rattus norvegicus
ggatcagaacttgccagcatttgtg

SEQ ID NO: 431485 - DNA, 25 bp, Rattus norvegicus
ggatcagaacttttctgtgaaagtc

SEQ ID NO: 431486 - DNA, 25 bp, Rattus norvegicus
ggatcagaagtgagagtcctactta

SEQ ID NO: 431487 - DNA, 25 bp, Rattus norvegicus
ggatcagaagtgtgagtcctactta

SEQ ID NO: 431488 - DNA, 25 bp, Rattus norvegicus
ggatcagaatcacaaccccgtcaag

SEQ ID NO: 431489 - DNA, 25 bp, Rattus norvegicus
ggatcagaatcagaaccccgtcaag

SEQ ID NO: 431490 - DNA, 25 bp, Rattus norvegicus
ggatcagaccgtcgtgggccttcaa

SEQ ID NO: 431491 - DNA, 25 bp, Rattus norvegicus
ggatcagaccgtggtgggccttcaa

SEQ ID NO: 431492 - DNA, 25 bp, Rattus norvegicus
ggatcagactggagccgaagctgta

SEQ ID NO: 431493 - DNA, 25 bp, Rattus norvegicus
ggatcagactggagttaccggctct

SEQ ID NO: 431494 - DNA, 25 bp, Rattus norvegicus
ggatcagactggtgccgaagctgta

SEQ ID NO: 431495 - DNA, 25 bp, Rattus norvegicus
ggatcagactggtgttaccggctct

SEQ ID NO: 431496 - DNA, 25 bp, Rattus norvegicus
ggatcagagaggaacacgcgcccca

SEQ ID NO: 431497 - DNA, 25 bp, Rattus norvegicus
ggatcagagaggtacacgcgcccca

SEQ ID NO: 431498 - DNA, 25 bp, Rattus norvegicus
ggatcagagcttctcttgactggaa

SEQ ID NO: 431499 - DNA, 25 bp, Rattus norvegicus
ggatcagagcttgtcttgactggaa

SEQ ID NO: 431500 - DNA, 25 bp, Rattus norvegicus
ggatcagaggaacccagaggcttaa

SEQ ID NO: 431501 - DNA, 25 bp, Rattus norvegicus
ggatcagaggaagccagaggcttaa

SEQ ID NO: 431502 - DNA, 25 bp, Rattus norvegicus
ggatcagaggccatagaaaccatct

SEQ ID NO: 431503 - DNA, 25 bp, Rattus norvegicus
ggatcagaggccttagaaaccatct

SEQ ID NO: 431504 - DNA, 25 bp, Rattus norvegicus
ggatcagatgaccacaggcctttca

SEQ ID NO: 431505 - DNA, 25 bp, Rattus norvegicus
ggatcagatgacgacaggcctttca

SEQ ID NO: 431506 - DNA, 25 bp, Rattus norvegicus
ggatcagatgccaactctggactct

SEQ ID NO: 431507 - DNA, 25 bp, Rattus norvegicus
ggatcagatgcctactctggactct

SEQ ID NO: 431508 - DNA, 25 bp, Rattus norvegicus
ggatcagcaattagagggtagtcta

SEQ ID NO: 431509 - DNA, 25 bp, Rattus norvegicus
ggatcagcaatttgagggtagtcta

SEQ ID NO: 431510 - DNA, 25 bp, Rattus norvegicus
ggatcagcacaaacagaactgcctg

SEQ ID NO: 431511 - DNA, 25 bp, Rattus norvegicus
ggatcagcacaatcagaactgcctg

SEQ ID NO: 431512 - DNA, 25 bp, Rattus norvegicus
ggatcagcacagcatcaactatgaa

SEQ ID NO: 431513 - DNA, 25 bp, Rattus norvegicus
ggatcagcacaggatcaactatgaa

SEQ ID NO: 431514 - DNA, 25 bp, Rattus norvegicus
ggatcagcaccaagaccttttacta

SEQ ID NO: 431515 - DNA, 25 bp, Rattus norvegicus
ggatcagcaccatgaccttttacta

SEQ ID NO: 431516 - DNA, 25 bp, Rattus norvegicus
ggatcagcacgcattgaggccggac

SEQ ID NO: 431517 - DNA, 25 bp, Rattus norvegicus
ggatcagcacgctttgaggccggac

SEQ ID NO: 431518 - DNA, 25 bp, Rattus norvegicus
ggatcagcacttctttggaagagat

SEQ ID NO: 431519 - DNA, 25 bp, Rattus norvegicus
ggatcagcacttgtttggaagagat

SEQ ID NO: 431520 - DNA, 25 bp, Rattus norvegicus
ggatcagcagccacacgaggtttat

SEQ ID NO: 431521 - DNA, 25 bp, Rattus norvegicus
ggatcagcagcctcacgaggtttat

SEQ ID NO: 431522 - DNA, 25 bp, Rattus norvegicus
ggatcagcagttaccaaacttgagg

SEQ ID NO: 431523 - DNA, 25 bp, Rattus norvegicus
ggatcagcagtttccaaacttgagg

SEQ ID NO: 431524 - DNA, 25 bp, Rattus norvegicus
ggatcagccacaaacttaaccatcg

SEQ ID NO: 431525 - DNA, 25 bp, Rattus norvegicus
ggatcagccacatacttaaccatcg

SEQ ID NO: 431526 - DNA, 25 bp, Rattus norvegicus
ggatcagcccaacaagctttcagtg

SEQ ID NO: 431527 - DNA, 25 bp, Rattus norvegicus
ggatcagcccaagaagctttcagtg

SEQ ID NO: 431528 - DNA, 25 bp, Rattus norvegicus
ggatcagcccctcaagattctaagt

SEQ ID NO: 431529 - DNA, 25 bp, Rattus norvegicus
ggatcagcccctgaagattctaagt

SEQ ID NO: 431530 - DNA, 25 bp, Rattus norvegicus
ggatcagcctcacgtaaatacccaa

SEQ ID NO: 431531 - DNA, 25 bp, Rattus norvegicus
ggatcagcctcaggtaaatacccaa

SEQ ID NO: 431532 - DNA, 25 bp, Rattus norvegicus
ggatcagcgcctccagattgagctc

SEQ ID NO: 431533 - DNA, 25 bp, Rattus norvegicus
ggatcagcgcctgcagattgagctc

SEQ ID NO: 431534 - DNA, 25 bp, Rattus norvegicus
ggatcagctatcactacaaacactt

SEQ ID NO: 431535 - DNA, 25 bp, Rattus norvegicus
ggatcagctatctctacaaacactt

SEQ ID NO: 431536 - DNA, 25 bp, Rattus norvegicus
ggatcagctctgatcaagcattcag

SEQ ID NO: 431537 - DNA, 25 bp, Rattus norvegicus
ggatcagctctgttcaagcattcag

SEQ ID NO: 431538 - DNA, 25 bp, Rattus norvegicus
ggatcaggaagaccctggccacagt

SEQ ID NO: 431539 - DNA, 25 bp, Rattus norvegicus
ggatcaggaagagcctggccacagt

SEQ ID NO: 431540 - DNA, 25 bp, Rattus norvegicus
ggatcaggaagtcccatccctagtt

SEQ ID NO: 431541 - DNA, 25 bp, Rattus norvegicus
ggatcaggaagtgccatccctagtt

SEQ ID NO: 431542 - DNA, 25 bp, Rattus norvegicus
ggatcaggatgtagctcccagacat

SEQ ID NO: 431543 - DNA, 25 bp, Rattus norvegicus
ggatcaggatgttgctcccagacat

SEQ ID NO: 431544 - DNA, 25 bp, Rattus norvegicus
ggatcaggcccactagacagtttta

SEQ ID NO: 431545 - DNA, 25 bp, Rattus norvegicus
ggatcaggcccagtagacagtttta

SEQ ID NO: 431546 - DNA, 25 bp, Rattus norvegicus
ggatcaggtacacagcaaggctcgc

SEQ ID NO: 431547 - DNA, 25 bp, Rattus norvegicus
ggatcaggtacagagcaaggctcgc

SEQ ID NO: 431548 - DNA, 25 bp, Rattus norvegicus
ggatcaggtgtcacatgccttagaa

SEQ ID NO: 431549 - DNA, 25 bp, Rattus norvegicus
ggatcaggtgtctcatgccttagaa

SEQ ID NO: 431550 - DNA, 25 bp, Rattus norvegicus
ggatcagtattaacagtggcaactt

SEQ ID NO: 431551 - DNA, 25 bp, Rattus norvegicus
ggatcagtattatcagtggcaactt

SEQ ID NO: 431552 - DNA, 25 bp, Rattus norvegicus
ggatcagtcaccagaattactatta

SEQ ID NO: 431553 - DNA, 25 bp, Rattus norvegicus
ggatcagtcacctgaattactatta

SEQ ID NO: 431554 - DNA, 25 bp, Rattus norvegicus
ggatcagtccaaacctgagatttac

SEQ ID NO: 431555 - DNA, 25 bp, Rattus norvegicus
ggatcagtccaatcctgagatttac

SEQ ID NO: 431556 - DNA, 25 bp, Rattus norvegicus
ggatcagtcccaaacgtcgaggtga

SEQ ID NO: 431557 - DNA, 25 bp, Rattus norvegicus
ggatcagtcccatacgtcgaggtga

SEQ ID NO: 431558 - DNA, 25 bp, Rattus norvegicus
ggatcagtctccaacaaaagtctct

SEQ ID NO: 431559 - DNA, 25 bp, Rattus norvegicus
ggatcagtctcctacaaaagtctct

SEQ ID NO: 431560 - DNA, 25 bp, Rattus norvegicus
ggatcagtgaaaagctacaattaat

SEQ ID NO: 431561 - DNA, 25 bp, Rattus norvegicus
ggatcagtgaaatgctacaattaat

SEQ ID NO: 431562 - DNA, 25 bp, Rattus norvegicus
ggatcagtgctcagctaatgccctt

SEQ ID NO: 431563 - DNA, 25 bp, Rattus norvegicus
ggatcagtgctctgctaatgccctt

SEQ ID NO: 431564 - DNA, 25 bp, Rattus norvegicus
ggatcagtgctgagagccaggcctc

SEQ ID NO: 431565 - DNA, 25 bp, Rattus norvegicus
ggatcagtgctgtgagccaggcctc

SEQ ID NO: 431566 - DNA, 25 bp, Rattus norvegicus
ggatcagtgtgtccccacaagcctg

SEQ ID NO: 431567 - DNA, 25 bp, Rattus norvegicus
ggatcagtgtgtgcccacaagcctg

SEQ ID NO: 431568 - DNA, 25 bp, Rattus norvegicus
ggatcagtgttgcaggtacatcatc

SEQ ID NO: 431569 - DNA, 25 bp, Rattus norvegicus
ggatcagtgttggaggtacatcatc

SEQ ID NO: 431570 - DNA, 25 bp, Rattus norvegicus
ggatcagttaaacgccagcactccc

SEQ ID NO: 431571 - DNA, 25 bp, Rattus norvegicus
ggatcagttaaaggccagcactccc

SEQ ID NO: 431572 - DNA, 25 bp, Rattus norvegicus
ggatcagttatccttctgcaataca

SEQ ID NO: 431573 - DNA, 25 bp, Rattus norvegicus
ggatcagttatcgttctgcaataca

SEQ ID NO: 431574 - DNA, 25 bp, Rattus norvegicus
ggatcagttcataaccattgttcta

SEQ ID NO: 431575 - DNA, 25 bp, Rattus norvegicus
ggatcagttcattaccattgttcta

SEQ ID NO: 431576 - DNA, 25 bp, Rattus norvegicus
ggatcagttttgctcagtttgaatt

SEQ ID NO: 431577 - DNA, 25 bp, Rattus norvegicus
ggatcagttttggtcagtttgaatt

SEQ ID NO: 431578 - DNA, 25 bp, Rattus norvegicus
ggatcataaatccaccacctgagaa

SEQ ID NO: 431579 - DNA, 25 bp, Rattus norvegicus
ggatcataaatcgaccacctgagaa

SEQ ID NO: 431580 - DNA, 25 bp, Rattus norvegicus
ggatcatagaaaagcaaccctcccc

SEQ ID NO: 431581 - DNA, 25 bp, Rattus norvegicus
ggatcatagaaatgcaaccctcccc

SEQ ID NO: 431582 - DNA, 25 bp, Rattus norvegicus
ggatcatagtccctcacaaagtagg

SEQ ID NO: 431583 - DNA, 25 bp, Rattus norvegicus
ggatcatagtccgtcacaaagtagg

SEQ ID NO: 431584 - DNA, 25 bp, Rattus norvegicus
ggatcatatcctctattcttaaggt

SEQ ID NO: 431585 - DNA, 25 bp, Rattus norvegicus
ggatcatatcctgtattcttaaggt

SEQ ID NO: 431586 - DNA, 25 bp, Rattus norvegicus
ggatcatcaaccatctaatcacaat

SEQ ID NO: 431587 - DNA, 25 bp, Rattus norvegicus
ggatcatcaaccttctaatcacaat

SEQ ID NO: 431588 - DNA, 25 bp, Rattus norvegicus
ggatcatcaatgaggcgctaccgga

SEQ ID NO: 431589 - DNA, 25 bp, Rattus norvegicus
ggatcatcaatgtggcgctaccgga

SEQ ID NO: 431590 - DNA, 25 bp, Rattus norvegicus
ggatcatcactgcacttaaaacaca

SEQ ID NO: 431591 - DNA, 25 bp, Rattus norvegicus
ggatcatcactggacttaaaacaca

SEQ ID NO: 431592 - DNA, 25 bp, Rattus norvegicus
ggatcatcagatccgctaggaattc

SEQ ID NO: 431593 - DNA, 25 bp, Rattus norvegicus
ggatcatcagatgcgctaggaattc

SEQ ID NO: 431594 - DNA, 25 bp, Rattus norvegicus
ggatcatcccatcagttggaaccac

SEQ ID NO: 431595 - DNA, 25 bp, Rattus norvegicus
ggatcatcccatgagttggaaccac

SEQ ID NO: 431596 - DNA, 25 bp, Rattus norvegicus
ggatcatccgcactgcaggcctcag

SEQ ID NO: 431597 - DNA, 25 bp, Rattus norvegicus
ggatcatccgcagtgcaggcctcag

SEQ ID NO: 431598 - DNA, 25 bp, Rattus norvegicus
ggatcatcgaggacgcaccacaagt

SEQ ID NO: 431599 - DNA, 25 bp, Rattus norvegicus
ggatcatcgaggtcgcaccacaagt

SEQ ID NO: 431600 - DNA, 25 bp, Rattus norvegicus
ggatcatcgctgaaaccatctgtaa

SEQ ID NO: 431601 - DNA, 25 bp, Rattus norvegicus
ggatcatcgctgtaaccatctgtaa

SEQ ID NO: 431602 - DNA, 25 bp, Rattus norvegicus
ggatcatcgggcaggttgccacaga

SEQ ID NO: 431603 - DNA, 25 bp, Rattus norvegicus
ggatcatcgggctggttgccacaga

SEQ ID NO: 431604 - DNA, 25 bp, Rattus norvegicus
ggatcatcggttatcttcctattac

SEQ ID NO: 431605 - DNA, 25 bp, Rattus norvegicus
ggatcatcggttttcttcctattac

SEQ ID NO: 431606 - DNA, 25 bp, Rattus norvegicus
ggatcatctcccctggagctgaata

SEQ ID NO: 431607 - DNA, 25 bp, Rattus norvegicus
ggatcatctcccgtggagctgaata

SEQ ID NO: 431608 - DNA, 25 bp, Rattus norvegicus
ggatcatctgaacacctggctaaca

SEQ ID NO: 431609 - DNA, 25 bp, Rattus norvegicus
ggatcatctgaagacctggctaaca

SEQ ID NO: 431610 - DNA, 25 bp, Rattus norvegicus
ggatcatctgagattcgtgctagca

SEQ ID NO: 431611 - DNA, 25 bp, Rattus norvegicus
ggatcatctgagtttcgtgctagca

SEQ ID NO: 431612 - DNA, 25 bp, Rattus norvegicus
ggatcatgaccaaactgctcagctg

SEQ ID NO: 431613 - DNA, 25 bp, Rattus norvegicus
ggatcatgaccatactgctcagctg

SEQ ID NO: 431614 - DNA, 25 bp, Rattus norvegicus
ggatcatgactgaatctccaagtga

SEQ ID NO: 431615 - DNA, 25 bp, Rattus norvegicus
ggatcatgactgtatctccaagtga

SEQ ID NO: 431616 - DNA, 25 bp, Rattus norvegicus
ggatcatgagagaatttttgctgca

SEQ ID NO: 431617 - DNA, 25 bp, Rattus norvegicus
ggatcatgagagtatttttgctgca

SEQ ID NO: 431618 - DNA, 25 bp, Rattus norvegicus
ggatcatgataaaccgttgaaagta

SEQ ID NO: 431619 - DNA, 25 bp, Rattus norvegicus
ggatcatgataatccgttgaaagta

SEQ ID NO: 431620 - DNA, 25 bp, Rattus norvegicus
ggatcatgatgccaacctcttacgt

SEQ ID NO: 431621 - DNA, 25 bp, Rattus norvegicus
ggatcatgatgcgaacctcttacgt

SEQ ID NO: 431622 - DNA, 25 bp, Rattus norvegicus
ggatcatgatttccgagctacttta

SEQ ID NO: 431623 - DNA, 25 bp, Rattus norvegicus
ggatcatgatttgcgagctacttta

SEQ ID NO: 431624 - DNA, 25 bp, Rattus norvegicus
ggatcatgctagctaagttctcaca

SEQ ID NO: 431625 - DNA, 25 bp, Rattus norvegicus
ggatcatgctaggtaagttctcaca

SEQ ID NO: 431626 - DNA, 25 bp, Rattus norvegicus
ggatcatggactcaaacctctaaaa

SEQ ID NO: 431627 - DNA, 25 bp, Rattus norvegicus
ggatcatggactcggacgagttaac

SEQ ID NO: 431628 - DNA, 25 bp, Rattus norvegicus
ggatcatggactgaaacctctaaaa

SEQ ID NO: 431629 - DNA, 25 bp, Rattus norvegicus
ggatcatggactgggacgagttaac

SEQ ID NO: 431630 - DNA, 25 bp, Rattus norvegicus
ggatcatggatgctgtacatagaga

SEQ ID NO: 431631 - DNA, 25 bp, Rattus norvegicus
ggatcatggatggtgtacatagaga

SEQ ID NO: 431632 - DNA, 25 bp, Rattus norvegicus
ggatcatggcttctaacttcctgaa

SEQ ID NO: 431633 - DNA, 25 bp, Rattus norvegicus
ggatcatggcttgtaacttcctgaa

SEQ ID NO: 431634 - DNA, 25 bp, Rattus norvegicus
ggatcatgggacatcagtggccttc

SEQ ID NO: 431635 - DNA, 25 bp, Rattus norvegicus
ggatcatgggacttcagtggccttc

SEQ ID NO: 431636 - DNA, 25 bp, Rattus norvegicus
ggatcatgtgccatattcagttagc

SEQ ID NO: 431637 - DNA, 25 bp, Rattus norvegicus
ggatcatgtgccttattcagttagc

SEQ ID NO: 431638 - DNA, 25 bp, Rattus norvegicus
ggatcattagttcccgggcgctgaa

SEQ ID NO: 431639 - DNA, 25 bp, Rattus norvegicus
ggatcattagttgccgggcgctgaa

SEQ ID NO: 431640 - DNA, 25 bp, Rattus norvegicus
ggatcattatagacaccctagcaga

SEQ ID NO: 431641 - DNA, 25 bp, Rattus norvegicus
ggatcattatagtcaccctagcaga

SEQ ID NO: 431642 - DNA, 25 bp, Rattus norvegicus
ggatcattatctccttgtactttaa

SEQ ID NO: 431643 - DNA, 25 bp, Rattus norvegicus
ggatcattatctgcttgtactttaa

SEQ ID NO: 431644 - DNA, 25 bp, Rattus norvegicus
ggatcattgactcccagatttccaa

SEQ ID NO: 431645 - DNA, 25 bp, Rattus norvegicus
ggatcattgactgccagatttccaa

SEQ ID NO: 431646 - DNA, 25 bp, Rattus norvegicus
ggatcattgcaaccttgtgctagac

SEQ ID NO: 431647 - DNA, 25 bp, Rattus norvegicus
ggatcattgcaagcttgtgctagac

SEQ ID NO: 431648 - DNA, 25 bp, Rattus norvegicus
ggatcatttattcgcgcctacacag

SEQ ID NO: 431649 - DNA, 25 bp, Rattus norvegicus
ggatcatttattggcgcctacacag

SEQ ID NO: 431650 - DNA, 25 bp, Rattus norvegicus
ggatcatttcgccaagtacttcact

SEQ ID NO: 431651 - DNA, 25 bp, Rattus norvegicus
ggatcatttcgcgaagtacttcact

SEQ ID NO: 431652 - DNA, 25 bp, Rattus norvegicus
ggatcatttgaaatgctgtctagcc

SEQ ID NO: 431653 - DNA, 25 bp, Rattus norvegicus
ggatcatttgaattgctgtctagcc

SEQ ID NO: 431654 - DNA, 25 bp, Rattus norvegicus
ggatcatttttgaccatctcaagaa

SEQ ID NO: 431655 - DNA, 25 bp, Rattus norvegicus
ggatcatttttgtccatctcaagaa

SEQ ID NO: 431656 - DNA, 25 bp, Rattus norvegicus
ggatccaaagccaaagccgaatgag

SEQ ID NO: 431657 - DNA, 25 bp, Rattus norvegicus
ggatccaaagccacattatcttaga

SEQ ID NO: 431658 - DNA, 25 bp, Rattus norvegicus
ggatccaaagccacgaagtcacggt

SEQ ID NO: 431659 - DNA, 25 bp, Rattus norvegicus
ggatccaaagcctaagccgaatgag

SEQ ID NO: 431660 - DNA, 25 bp, Rattus norvegicus
ggatccaaagcctcattatcttaga

SEQ ID NO: 431661 - DNA, 25 bp, Rattus norvegicus
ggatccaaagcctcgaagtcacggt

SEQ ID NO: 431662 - DNA, 25 bp, Rattus norvegicus
ggatccaacacactcatacagacat

SEQ ID NO: 431663 - DNA, 25 bp, Rattus norvegicus
ggatccaacacagtcatacagacat

SEQ ID NO: 431664 - DNA, 25 bp, Rattus norvegicus
ggatccaagcttctccagatgactt

SEQ ID NO: 431665 - DNA, 25 bp, Rattus norvegicus
ggatccaagcttgtccagatgactt

SEQ ID NO: 431666 - DNA, 25 bp, Rattus norvegicus
ggatccaagggccagatttccactt

SEQ ID NO: 431667 - DNA, 25 bp, Rattus norvegicus
ggatccaagggcgagatttccactt

SEQ ID NO: 431668 - DNA, 25 bp, Rattus norvegicus
ggatccaagtcacatagccaggctt

SEQ ID NO: 431669 - DNA, 25 bp, Rattus norvegicus
ggatccaagtcagatagccaggctt

SEQ ID NO: 431670 - DNA, 25 bp, Rattus norvegicus
ggatccaatccaacagttcggcagt

SEQ ID NO: 431671 - DNA, 25 bp, Rattus norvegicus
ggatccaatccatcagttcggcagt

SEQ ID NO: 431672 - DNA, 25 bp, Rattus norvegicus
ggatccaatgtacatgcggccatca

SEQ ID NO: 431673 - DNA, 25 bp, Rattus norvegicus
ggatccaatgtagatgcggccatca

SEQ ID NO: 431674 - DNA, 25 bp, Rattus norvegicus
ggatccacaagacgcgccggtcatg

SEQ ID NO: 431675 - DNA, 25 bp, Rattus norvegicus
ggatccacaagaggcgccggtcatg

SEQ ID NO: 431676 - DNA, 25 bp, Rattus norvegicus
ggatccacaatgaaggagaaggact

SEQ ID NO: 431677 - DNA, 25 bp, Rattus norvegicus
ggatccacaatgtaggagaaggact

SEQ ID NO: 431678 - DNA, 25 bp, Rattus norvegicus
ggatccacatacctaccatgatcta

SEQ ID NO: 431679 - DNA, 25 bp, Rattus norvegicus
ggatccacatacgtaccatgatcta

SEQ ID NO: 431680 - DNA, 25 bp, Rattus norvegicus
ggatccaccaccagctggaagccag

SEQ ID NO: 431681 - DNA, 25 bp, Rattus norvegicus
ggatccaccacctgctggaagccag

SEQ ID NO: 431682 - DNA, 25 bp, Rattus norvegicus
ggatccacccatcttgagttacaga

SEQ ID NO: 431683 - DNA, 25 bp, Rattus norvegicus
ggatccacccatgttgagttacaga

SEQ ID NO: 431684 - DNA, 25 bp, Rattus norvegicus
ggatccacctgcctactggatgaga

SEQ ID NO: 431685 - DNA, 25 bp, Rattus norvegicus
ggatccacctgcgtactggatgaga

SEQ ID NO: 431686 - DNA, 25 bp, Rattus norvegicus
ggatccaccttgaacttcgctacta

SEQ ID NO: 431687 - DNA, 25 bp, Rattus norvegicus
ggatccaccttgtacttcgctacta

SEQ ID NO: 431688 - DNA, 25 bp, Rattus norvegicus
ggatccacggcaagcaaggcgccgt

SEQ ID NO: 431689 - DNA, 25 bp, Rattus norvegicus
ggatccacggcatgcaaggcgccgt

SEQ ID NO: 431690 - DNA, 25 bp, Rattus norvegicus
ggatccacgggacagtcaagcaatg

SEQ ID NO: 431691 - DNA, 25 bp, Rattus norvegicus
ggatccacgggagagtcaagcaatg

SEQ ID NO: 431692 - DNA, 25 bp, Rattus norvegicus
ggatccacggtgaagccctggctta

SEQ ID NO: 431693 - DNA, 25 bp, Rattus norvegicus
ggatccacggtgtagccctggctta

SEQ ID NO: 431694 - DNA, 25 bp, Rattus norvegicus
ggatccactctgcacacttaacaag

SEQ ID NO: 431695 - DNA, 25 bp, Rattus norvegicus
ggatccactctggacacttaacaag

SEQ ID NO: 431696 - DNA, 25 bp, Rattus norvegicus
ggatccactgtgatgaagactcttg

SEQ ID NO: 431697 - DNA, 25 bp, Rattus norvegicus
ggatccactgtgttgaagactcttg

SEQ ID NO: 431698 - DNA, 25 bp, Rattus norvegicus
ggatccagaagcagcctctttctaa

SEQ ID NO: 431699 - DNA, 25 bp, Rattus norvegicus
ggatccagaagctgcctctttctaa

SEQ ID NO: 431700 - DNA, 25 bp, Rattus norvegicus
ggatccagacatccctcgggacctg

SEQ ID NO: 431701 - DNA, 25 bp, Rattus norvegicus
ggatccagacatgcctcgggacctg

SEQ ID NO: 431702 - DNA, 25 bp, Rattus norvegicus
ggatccagcaaacctactgcttctt

SEQ ID NO: 431703 - DNA, 25 bp, Rattus norvegicus
ggatccagcaaagctactgcttctt

SEQ ID NO: 431704 - DNA, 25 bp, Rattus norvegicus
ggatccagcactaatcagaccaggc

SEQ ID NO: 431705 - DNA, 25 bp, Rattus norvegicus
ggatccagcacttatcagaccaggc

SEQ ID NO: 431706 - DNA, 25 bp, Rattus norvegicus
ggatccagcataaccaggaggtggt

SEQ ID NO: 431707 - DNA, 25 bp, Rattus norvegicus
ggatccagcatatccaggaggtggt

SEQ ID NO: 431708 - DNA, 25 bp, Rattus norvegicus
ggatccagccccagaccaaagattt

SEQ ID NO: 431709 - DNA, 25 bp, Rattus norvegicus
ggatccagcccctgaccaaagattt

SEQ ID NO: 431710 - DNA, 25 bp, Rattus norvegicus
ggatccagcctaagtgatttgcttt

SEQ ID NO: 431711 - DNA, 25 bp, Rattus norvegicus
ggatccagcctatgtgatttgcttt

SEQ ID NO: 431712 - DNA, 25 bp, Rattus norvegicus
ggatccagcgcacagcggtgtcggg

SEQ ID NO: 431713 - DNA, 25 bp, Rattus norvegicus
ggatccagcgcagagcggtgtcggg

SEQ ID NO: 431714 - DNA, 25 bp, Rattus norvegicus
ggatccagctacagaaggcatcgta

SEQ ID NO: 431715 - DNA, 25 bp, Rattus norvegicus
ggatccagctactgaaggcatcgta

SEQ ID NO: 431716 - DNA, 25 bp, Rattus norvegicus
ggatccaggagtctcccttatcact

SEQ ID NO: 431717 - DNA, 25 bp, Rattus norvegicus
ggatccaggagtgtcccttatcact

SEQ ID NO: 431718 - DNA, 25 bp, Rattus norvegicus
ggatccaggatgctctaagcactgt

SEQ ID NO: 431719 - DNA, 25 bp, Rattus norvegicus
ggatccaggatggtctaagcactgt

SEQ ID NO: 431720 - DNA, 25 bp, Rattus norvegicus
ggatccaggcccaggatacaggatt

SEQ ID NO: 431721 - DNA, 25 bp, Rattus norvegicus
ggatccaggccctggatacaggatt

SEQ ID NO: 431722 - DNA, 25 bp, Rattus norvegicus
ggatccaggctacgaaagccagaca

SEQ ID NO: 431723 - DNA, 25 bp, Rattus norvegicus
ggatccaggctaggaaagccagaca

SEQ ID NO: 431724 - DNA, 25 bp, Rattus norvegicus
ggatccagggtgaacagccagctct

SEQ ID NO: 431725 - DNA, 25 bp, Rattus norvegicus
ggatccagggtgactgtaaccttgc

SEQ ID NO: 431726 - DNA, 25 bp, Rattus norvegicus
ggatccagggtgtacagccagctct

SEQ ID NO: 431727 - DNA, 25 bp, Rattus norvegicus
ggatccagggtgtctgtaaccttgc

SEQ ID NO: 431728 - DNA, 25 bp, Rattus norvegicus
ggatccagtcacagacagcaagaac

SEQ ID NO: 431729 - DNA, 25 bp, Rattus norvegicus
ggatccagtcactgacagcaagaac

SEQ ID NO: 431730 - DNA, 25 bp, Rattus norvegicus
ggatccagtcctaaaggagctcctt

SEQ ID NO: 431731 - DNA, 25 bp, Rattus norvegicus
ggatccagtccttaaggagctcctt

SEQ ID NO: 431732 - DNA, 25 bp, Rattus norvegicus
ggatccagttcactatcttcaccca

SEQ ID NO: 431733 - DNA, 25 bp, Rattus norvegicus
ggatccagttcagtatcttcaccca

SEQ ID NO: 431734 - DNA, 25 bp, Rattus norvegicus
ggatccagttctaccagtatcccag

SEQ ID NO: 431735 - DNA, 25 bp, Rattus norvegicus
ggatccagttcttccagtatcccag

SEQ ID NO: 431736 - DNA, 25 bp, Rattus norvegicus
ggatccagttgtccagtagagttca

SEQ ID NO: 431737 - DNA, 25 bp, Rattus norvegicus
ggatccagttgtgcagtagagttca

SEQ ID NO: 431738 - DNA, 25 bp, Rattus norvegicus
ggatccataggtactcactttttct

SEQ ID NO: 431739 - DNA, 25 bp, Rattus norvegicus
ggatccataggttctcactttttct

SEQ ID NO: 431740 - DNA, 25 bp, Rattus norvegicus
ggatccatatgactcaaactgttgt

SEQ ID NO: 431741 - DNA, 25 bp, Rattus norvegicus
ggatccatatgagtcaaactgttgt

SEQ ID NO: 431742 - DNA, 25 bp, Rattus norvegicus
ggatccatcctaagcccaaagacat

SEQ ID NO: 431743 - DNA, 25 bp, Rattus norvegicus
ggatccatcctatgcccaaagacat

SEQ ID NO: 431744 - DNA, 25 bp, Rattus norvegicus
ggatccatcttcaataccacagaga

SEQ ID NO: 431745 - DNA, 25 bp, Rattus norvegicus
ggatccatcttctataccacagaga

SEQ ID NO: 431746 - DNA, 25 bp, Rattus norvegicus
ggatccatgatgatcttgaatgtca

SEQ ID NO: 431747 - DNA, 25 bp, Rattus norvegicus
ggatccatgatgttcttgaatgtca

SEQ ID NO: 431748 - DNA, 25 bp, Rattus norvegicus
ggatccatgctgaaaatgccctcac

SEQ ID NO: 431749 - DNA, 25 bp, Rattus norvegicus
ggatccatgctgtaaatgccctcac

SEQ ID NO: 431750 - DNA, 25 bp, Rattus norvegicus
ggatccatggttattctaccttagg

SEQ ID NO: 431751 - DNA, 25 bp, Rattus norvegicus
ggatccatggtttttctaccttagg

SEQ ID NO: 431752 - DNA, 25 bp, Rattus norvegicus
ggatccattcccacgaaggcattaa

SEQ ID NO: 431753 - DNA, 25 bp, Rattus norvegicus
ggatccattccctcgaaggcattaa

SEQ ID NO: 431754 - DNA, 25 bp, Rattus norvegicus
ggatccattcctcaacagagctaca

SEQ ID NO: 431755 - DNA, 25 bp, Rattus norvegicus
ggatccattcctgaacagagctaca

SEQ ID NO: 431756 - DNA, 25 bp, Rattus norvegicus
ggatccattctcattaaagcgcctt

SEQ ID NO: 431757 - DNA, 25 bp, Rattus norvegicus
ggatccattctctttaaagcgcctt

SEQ ID NO: 431758 - DNA, 25 bp, Rattus norvegicus
ggatccatttcacatcttccaatat

SEQ ID NO: 431759 - DNA, 25 bp, Rattus norvegicus
ggatccatttcagatcttccaatat

SEQ ID NO: 431760 - DNA, 25 bp, Rattus norvegicus
ggatccattttgattttcagatgtg

SEQ ID NO: 431761 - DNA, 25 bp, Rattus norvegicus
ggatccattttgtttttcagatgtg

SEQ ID NO: 431762 - DNA, 25 bp, Rattus norvegicus
ggatcccaaagccattctggaaagg

SEQ ID NO: 431763 - DNA, 25 bp, Rattus norvegicus
ggatcccaaagcgattctggaaagg

SEQ ID NO: 431764 - DNA, 25 bp, Rattus norvegicus
ggatcccaaataacacttgtctggt

SEQ ID NO: 431765 - DNA, 25 bp, Rattus norvegicus
ggatcccaaatatcacttgtctggt

SEQ ID NO: 431766 - DNA, 25 bp, Rattus norvegicus
ggatcccaacttaaatcagcctgtc

SEQ ID NO: 431767 - DNA, 25 bp, Rattus norvegicus
ggatcccaactttaatcagcctgtc

SEQ ID NO: 431768 - DNA, 25 bp, Rattus norvegicus
ggatcccaagctaccttgttaattt

SEQ ID NO: 431769 - DNA, 25 bp, Rattus norvegicus
ggatcccaagcttccttgttaattt

SEQ ID NO: 431770 - DNA, 25 bp, Rattus norvegicus
ggatcccacaagataaatacagaat

SEQ ID NO: 431771 - DNA, 25 bp, Rattus norvegicus
ggatcccacaagttaaatacagaat

SEQ ID NO: 431772 - DNA, 25 bp, Rattus norvegicus
ggatcccacacaccttaacacaaag

SEQ ID NO: 431773 - DNA, 25 bp, Rattus norvegicus
ggatcccacacagcttaacacaaag

SEQ ID NO: 431774 - DNA, 25 bp, Rattus norvegicus
ggatcccacagacactcaagctggg

SEQ ID NO: 431775 - DNA, 25 bp, Rattus norvegicus
ggatcccacagagactcaagctggg

SEQ ID NO: 431776 - DNA, 25 bp, Rattus norvegicus
ggatcccacgaacccagtgtgttaa

SEQ ID NO: 431777 - DNA, 25 bp, Rattus norvegicus
ggatcccacgaagccagtgtgttaa

SEQ ID NO: 431778 - DNA, 25 bp, Rattus norvegicus
ggatcccagaaactttaagagacat

SEQ ID NO: 431779 - DNA, 25 bp, Rattus norvegicus
ggatcccagaaagtttaagagacat

SEQ ID NO: 431780 - DNA, 25 bp, Rattus norvegicus
ggatcccagaataacagttgcccag

SEQ ID NO: 431781 - DNA, 25 bp, Rattus norvegicus
ggatcccagaattacagttgcccag

SEQ ID NO: 431782 - DNA, 25 bp, Rattus norvegicus
ggatcccagagaacaggccccaaag

SEQ ID NO: 431783 - DNA, 25 bp, Rattus norvegicus
ggatcccagagatcaggccccaaag

SEQ ID NO: 431784 - DNA, 25 bp, Rattus norvegicus
ggatcccagcatccggaggtttttg

SEQ ID NO: 431785 - DNA, 25 bp, Rattus norvegicus
ggatcccagcatgcggaggtttttg

SEQ ID NO: 431786 - DNA, 25 bp, Rattus norvegicus
ggatcccagccactaaggagcttct

SEQ ID NO: 431787 - DNA, 25 bp, Rattus norvegicus
ggatcccagccactgaaattgaagc

SEQ ID NO: 431788 - DNA, 25 bp, Rattus norvegicus
ggatcccagccagtaaggagcttct

SEQ ID NO: 431789 - DNA, 25 bp, Rattus norvegicus
ggatcccagccagtgaaattgaagc

SEQ ID NO: 431790 - DNA, 25 bp, Rattus norvegicus
ggatcccagctgctctccagtgatt

SEQ ID NO: 431791 - DNA, 25 bp, Rattus norvegicus
ggatcccagctggtctccagtgatt

SEQ ID NO: 431792 - DNA, 25 bp, Rattus norvegicus
ggatcccaggacaagttggcaatct

SEQ ID NO: 431793 - DNA, 25 bp, Rattus norvegicus
ggatcccaggactagttggcaatct

SEQ ID NO: 431794 - DNA, 25 bp, Rattus norvegicus
ggatcccaggcaaagttggccccaa

SEQ ID NO: 431795 - DNA, 25 bp, Rattus norvegicus
ggatcccaggcatagttggccccaa

SEQ ID NO: 431796 - DNA, 25 bp, Rattus norvegicus
ggatcccagggaccttttcagagaa

SEQ ID NO: 431797 - DNA, 25 bp, Rattus norvegicus
ggatcccagggagcttttcagagaa

SEQ ID NO: 431798 - DNA, 25 bp, Rattus norvegicus
ggatcccagggtcttcctagaatgc

SEQ ID NO: 431799 - DNA, 25 bp, Rattus norvegicus
ggatcccagggtgttcctagaatgc

SEQ ID NO: 431800 - DNA, 25 bp, Rattus norvegicus
ggatcccagtgcctcgagtgaaact

SEQ ID NO: 431801 - DNA, 25 bp, Rattus norvegicus
ggatcccagtgcgtcgagtgaaact

SEQ ID NO: 431802 - DNA, 25 bp, Rattus norvegicus
ggatcccatgacacactaacaacag

SEQ ID NO: 431803 - DNA, 25 bp, Rattus norvegicus
ggatcccatgactcactaacaacag

SEQ ID NO: 431804 - DNA, 25 bp, Rattus norvegicus
ggatcccatttgagccccagggttt

SEQ ID NO: 431805 - DNA, 25 bp, Rattus norvegicus
ggatcccatttgtgccccagggttt

SEQ ID NO: 431806 - DNA, 25 bp, Rattus norvegicus
ggatccccaaaacggcaggtcctgg

SEQ ID NO: 431807 - DNA, 25 bp, Rattus norvegicus
ggatccccaaaagggcaggtcctgg

SEQ ID NO: 431808 - DNA, 25 bp, Rattus norvegicus
ggatccccaggacccaatagagaga

SEQ ID NO: 431809 - DNA, 25 bp, Rattus norvegicus
ggatccccaggagccaatagagaga

SEQ ID NO: 431810 - DNA, 25 bp, Rattus norvegicus
ggatccccatgaactgttccgtgaa

SEQ ID NO: 431811 - DNA, 25 bp, Rattus norvegicus
ggatccccatgatctgttccgtgaa

SEQ ID NO: 431812 - DNA, 25 bp, Rattus norvegicus
ggatccccatttatggcagctgctc

SEQ ID NO: 431813 - DNA, 25 bp, Rattus norvegicus
ggatccccatttttggcagctgctc

SEQ ID NO: 431814 - DNA, 25 bp, Rattus norvegicus
ggatcccctagacttggagtcacag

SEQ ID NO: 431815 - DNA, 25 bp, Rattus norvegicus
ggatcccctagagttggagtcacag

SEQ ID NO: 431816 - DNA, 25 bp, Rattus norvegicus
ggatcccctgacaggagttaaagac

SEQ ID NO: 431817 - DNA, 25 bp, Rattus norvegicus
ggatcccctgactggagttaaagac

SEQ ID NO: 431818 - DNA, 25 bp, Rattus norvegicus
ggatcccctggacttggcatcaaag

SEQ ID NO: 431819 - DNA, 25 bp, Rattus norvegicus
ggatcccctggagttggcatcaaag

SEQ ID NO: 431820 - DNA, 25 bp, Rattus norvegicus
ggatcccctgtacgcacatacacat

SEQ ID NO: 431821 - DNA, 25 bp, Rattus norvegicus
ggatcccctgtaggcacatacacat

SEQ ID NO: 431822 - DNA, 25 bp, Rattus norvegicus
ggatccccttagagctctgaagtat

SEQ ID NO: 431823 - DNA, 25 bp, Rattus norvegicus
ggatccccttagtgctctgaagtat

SEQ ID NO: 431824 - DNA, 25 bp, Rattus norvegicus
ggatcccgacgccatgatgaataac

SEQ ID NO: 431825 - DNA, 25 bp, Rattus norvegicus
ggatcccgacgcgatgatgaataac

SEQ ID NO: 431826 - DNA, 25 bp, Rattus norvegicus
ggatcccgatgcagaagatagtgtt

SEQ ID NO: 431827 - DNA, 25 bp, Rattus norvegicus
ggatcccgatgctgaagatagtgtt

SEQ ID NO: 431828 - DNA, 25 bp, Rattus norvegicus
ggatcccgcgagatggcgtttgcaa

SEQ ID NO: 431829 - DNA, 25 bp, Rattus norvegicus
ggatcccgcgagttggcgtttgcaa

SEQ ID NO: 431830 - DNA, 25 bp, Rattus norvegicus
ggatcccggtgaatatgcaagcgct

SEQ ID NO: 431831 - DNA, 25 bp, Rattus norvegicus
ggatcccggtgattatgcaagcgct

SEQ ID NO: 431832 - DNA, 25 bp, Rattus norvegicus
ggatcccggtgtctgtcaagagtat

SEQ ID NO: 431833 - DNA, 25 bp, Rattus norvegicus
ggatcccggtgtgtgtcaagagtat

SEQ ID NO: 431834 - DNA, 25 bp, Rattus norvegicus
ggatccctagttctgatcagtccat

SEQ ID NO: 431835 - DNA, 25 bp, Rattus norvegicus
ggatccctagttgtgatcagtccat

SEQ ID NO: 431836 - DNA, 25 bp, Rattus norvegicus
ggatccctatccagacagacctcta

SEQ ID NO: 431837 - DNA, 25 bp, Rattus norvegicus
ggatccctatcctgacagacctcta

SEQ ID NO: 431838 - DNA, 25 bp, Rattus norvegicus
ggatccctcaaacatgcccattaag

SEQ ID NO: 431839 - DNA, 25 bp, Rattus norvegicus
ggatccctcaaagatgcccattaag

SEQ ID NO: 431840 - DNA, 25 bp, Rattus norvegicus
ggatccctgagaactaagactgtgg

SEQ ID NO: 431841 - DNA, 25 bp, Rattus norvegicus
ggatccctgagatctaagactgtgg

SEQ ID NO: 431842 - DNA, 25 bp, Rattus norvegicus
ggatccctgggaaggacaacccttg

SEQ ID NO: 431843 - DNA, 25 bp, Rattus norvegicus
ggatccctgggatggacaacccttg

SEQ ID NO: 431844 - DNA, 25 bp, Rattus norvegicus
ggatccctggtgattactggtcaac

SEQ ID NO: 431845 - DNA, 25 bp, Rattus norvegicus
ggatccctggtgtttactggtcaac

SEQ ID NO: 431846 - DNA, 25 bp, Rattus norvegicus
ggatccctgtccagatcaacaaggt

SEQ ID NO: 431847 - DNA, 25 bp, Rattus norvegicus
ggatccctgtcctgatcaacaaggt

SEQ ID NO: 431848 - DNA, 25 bp, Rattus norvegicus
ggatccctgtgaactacgaaagctg

SEQ ID NO: 431849 - DNA, 25 bp, Rattus norvegicus
ggatccctgtgatctacgaaagctg

SEQ ID NO: 431850 - DNA, 25 bp, Rattus norvegicus
ggatcccttacccaggtatgtcaaa

SEQ ID NO: 431851 - DNA, 25 bp, Rattus norvegicus
ggatcccttaccgaggtatgtcaaa

SEQ ID NO: 431852 - DNA, 25 bp, Rattus norvegicus
ggatcccttccacggtgatatggat

SEQ ID NO: 431853 - DNA, 25 bp, Rattus norvegicus
ggatcccttccagggtgatatggat

SEQ ID NO: 431854 - DNA, 25 bp, Rattus norvegicus
ggatccctttgaaactttggcaaca

SEQ ID NO: 431855 - DNA, 25 bp, Rattus norvegicus
ggatccctttgatactttggcaaca

SEQ ID NO: 431856 - DNA, 25 bp, Rattus norvegicus
ggatccgaacacatgctttttattt

SEQ ID NO: 431857 - DNA, 25 bp, Rattus norvegicus
ggatccgaacacttgctttttattt

SEQ ID NO: 431858 - DNA, 25 bp, Rattus norvegicus
ggatccgaagttatgaagaagcccg

SEQ ID NO: 431859 - DNA, 25 bp, Rattus norvegicus
ggatccgaagttttgaagaagcccg

SEQ ID NO: 431860 - DNA, 25 bp, Rattus norvegicus
ggatccgactcacccaagttgtaga

SEQ ID NO: 431861 - DNA, 25 bp, Rattus norvegicus
ggatccgactcagccaagttgtaga

SEQ ID NO: 431862 - DNA, 25 bp, Rattus norvegicus
ggatccgagctaccacgaaaagaga

SEQ ID NO: 431863 - DNA, 25 bp, Rattus norvegicus
ggatccgagctagcacgaaaagaga

SEQ ID NO: 431864 - DNA, 25 bp, Rattus norvegicus
ggatccgagtcacggcagatacctt

SEQ ID NO: 431865 - DNA, 25 bp, Rattus norvegicus
ggatccgagtcagggcagatacctt

SEQ ID NO: 431866 - DNA, 25 bp, Rattus norvegicus
ggatccgccctaatgtggcagagaa

SEQ ID NO: 431867 - DNA, 25 bp, Rattus norvegicus
ggatccgccctattgtggcagagaa

SEQ ID NO: 431868 - DNA, 25 bp, Rattus norvegicus
ggatccgcgtagaccccagtgtaga

SEQ ID NO: 431869 - DNA, 25 bp, Rattus norvegicus
ggatccgcgtagtccccagtgtaga

SEQ ID NO: 431870 - DNA, 25 bp, Rattus norvegicus
ggatccggaaacactctttattcag

SEQ ID NO: 431871 - DNA, 25 bp, Rattus norvegicus
ggatccggaaactctctttattcag

SEQ ID NO: 431872 - DNA, 25 bp, Rattus norvegicus
ggatccggaaagacctacactatga

SEQ ID NO: 431873 - DNA, 25 bp, Rattus norvegicus
ggatccggaaagtcctacactatga

SEQ ID NO: 431874 - DNA, 25 bp, Rattus norvegicus
ggatccggaagcacctctggaaaga

SEQ ID NO: 431875 - DNA, 25 bp, Rattus norvegicus
ggatccggaagctcctctggaaaga

SEQ ID NO: 431876 - DNA, 25 bp, Rattus norvegicus
ggatccggaataagtttcccaactc

SEQ ID NO: 431877 - DNA, 25 bp, Rattus norvegicus
ggatccggaatatgtttcccaactc

SEQ ID NO: 431878 - DNA, 25 bp, Rattus norvegicus
ggatccggcagcatgtccgaataga

SEQ ID NO: 431879 - DNA, 25 bp, Rattus norvegicus
ggatccggcagcttgtccgaataga

SEQ ID NO: 431880 - DNA, 25 bp, Rattus norvegicus
ggatccggccaaaagtccctgagat

SEQ ID NO: 431881 - DNA, 25 bp, Rattus norvegicus
ggatccggccaatagtccctgagat

SEQ ID NO: 431882 - DNA, 25 bp, Rattus norvegicus
ggatccgggtaacaaagcagttctt

SEQ ID NO: 431883 - DNA, 25 bp, Rattus norvegicus
ggatccgggtaagaaagcagttctt

SEQ ID NO: 431884 - DNA, 25 bp, Rattus norvegicus
ggatccggtatgacaacacttgcag

SEQ ID NO: 431885 - DNA, 25 bp, Rattus norvegicus
ggatccggtatgtcaacacttgcag

SEQ ID NO: 431886 - DNA, 25 bp, Rattus norvegicus
ggatccggtgcacagttaccaacct

SEQ ID NO: 431887 - DNA, 25 bp, Rattus norvegicus
ggatccggtgcagagttaccaacct

SEQ ID NO: 431888 - DNA, 25 bp, Rattus norvegicus
ggatccgtaaacacagaactttttg

SEQ ID NO: 431889 - DNA, 25 bp, Rattus norvegicus
ggatccgtaaactcagaactttttg

SEQ ID NO: 431890 - DNA, 25 bp, Rattus norvegicus
ggatccgtacatccagtttgaccca

SEQ ID NO: 431891 - DNA, 25 bp, Rattus norvegicus
ggatccgtacatgcagtttgaccca

SEQ ID NO: 431892 - DNA, 25 bp, Rattus norvegicus
ggatccgtcctgcagcttgactgag

SEQ ID NO: 431893 - DNA, 25 bp, Rattus norvegicus
ggatccgtcctggagcttgactgag

SEQ ID NO: 431894 - DNA, 25 bp, Rattus norvegicus
ggatccgtggagaagtgccctctgt

SEQ ID NO: 431895 - DNA, 25 bp, Rattus norvegicus
ggatccgtggagtagtgccctctgt

SEQ ID NO: 431896 - DNA, 25 bp, Rattus norvegicus
ggatcctaatctcacttgttttctt

SEQ ID NO: 431897 - DNA, 25 bp, Rattus norvegicus
ggatcctaatctgacttgttttctt

SEQ ID NO: 431898 - DNA, 25 bp, Rattus norvegicus
ggatcctacagcaataccagttttc

SEQ ID NO: 431899 - DNA, 25 bp, Rattus norvegicus
ggatcctacagctataccagttttc

SEQ ID NO: 431900 - DNA, 25 bp, Rattus norvegicus
ggatcctaccagaatctcagtgtat

SEQ ID NO: 431901 - DNA, 25 bp, Rattus norvegicus
ggatcctaccagtatctcagtgtat

SEQ ID NO: 431902 - DNA, 25 bp, Rattus norvegicus
ggatcctacggtcctgaatctaata

SEQ ID NO: 431903 - DNA, 25 bp, Rattus norvegicus
ggatcctacggtgctgaatctaata

SEQ ID NO: 431904 - DNA, 25 bp, Rattus norvegicus
ggatcctaggagacgaggctcccca

SEQ ID NO: 431905 - DNA, 25 bp, Rattus norvegicus
ggatcctaggagtcgaggctcccca

SEQ ID NO: 431906 - DNA, 25 bp, Rattus norvegicus
ggatcctaggttctgctcaggtctc

SEQ ID NO: 431907 - DNA, 25 bp, Rattus norvegicus
ggatcctaggttgtgctcaggtctc

SEQ ID NO: 431908 - DNA, 25 bp, Rattus norvegicus
ggatcctatatcctcatcgggactc

SEQ ID NO: 431909 - DNA, 25 bp, Rattus norvegicus
ggatcctatatcgtcatcgggactc

SEQ ID NO: 431910 - DNA, 25 bp, Rattus norvegicus
ggatcctatgttccatggccaatcg

SEQ ID NO: 431911 - DNA, 25 bp, Rattus norvegicus
ggatcctatgttgcatggccaatcg

SEQ ID NO: 431912 - DNA, 25 bp, Rattus norvegicus
ggatcctcaaatcctcctgaattct

SEQ ID NO: 431913 - DNA, 25 bp, Rattus norvegicus
ggatcctcaaatgctcctgaattct

SEQ ID NO: 431914 - DNA, 25 bp, Rattus norvegicus
ggatcctcaagtatgggtaccagtt

SEQ ID NO: 431915 - DNA, 25 bp, Rattus norvegicus
ggatcctcaagtttgggtaccagtt

SEQ ID NO: 431916 - DNA, 25 bp, Rattus norvegicus
ggatcctcagccctaaataaaccag

SEQ ID NO: 431917 - DNA, 25 bp, Rattus norvegicus
ggatcctcagccgtaaataaaccag

SEQ ID NO: 431918 - DNA, 25 bp, Rattus norvegicus
ggatcctcatcgacagggctctcaa

SEQ ID NO: 431919 - DNA, 25 bp, Rattus norvegicus
ggatcctcatcgtcagggctctcaa

SEQ ID NO: 431920 - DNA, 25 bp, Rattus norvegicus
ggatcctcatgcctttcagtaactg

SEQ ID NO: 431921 - DNA, 25 bp, Rattus norvegicus
ggatcctcatgcgtttcagtaactg

SEQ ID NO: 431922 - DNA, 25 bp, Rattus norvegicus
ggatcctcattaacatgttcagcct

SEQ ID NO: 431923 - DNA, 25 bp, Rattus norvegicus
ggatcctcattatcatgttcagcct

SEQ ID NO: 431924 - DNA, 25 bp, Rattus norvegicus
ggatcctccagcagttggactcaaa

SEQ ID NO: 431925 - DNA, 25 bp, Rattus norvegicus
ggatcctccagctgttggactcaaa

SEQ ID NO: 431926 - DNA, 25 bp, Rattus norvegicus
ggatcctccgctagaaatgttttct

SEQ ID NO: 431927 - DNA, 25 bp, Rattus norvegicus
ggatcctccgcttgaaatgttttct

SEQ ID NO: 431928 - DNA, 25 bp, Rattus norvegicus
ggatcctcctccaaggaatgctgtt

SEQ ID NO: 431929 - DNA, 25 bp, Rattus norvegicus
ggatcctcctcctaggaatgctgtt

SEQ ID NO: 431930 - DNA, 25 bp, Rattus norvegicus
ggatcctctctgcagcgacagctaa

SEQ ID NO: 431931 - DNA, 25 bp, Rattus norvegicus
ggatcctctctggagcgacagctaa

SEQ ID NO: 431932 - DNA, 25 bp, Rattus norvegicus
ggatcctctgagaccgtattgatgg

SEQ ID NO: 431933 - DNA, 25 bp, Rattus norvegicus
ggatcctctgagtccgtattgatgg

SEQ ID NO: 431934 - DNA, 25 bp, Rattus norvegicus
ggatcctctgcgcagggacaattac

SEQ ID NO: 431935 - DNA, 25 bp, Rattus norvegicus
ggatcctctgcggagggacaattac

SEQ ID NO: 431936 - DNA, 25 bp, Rattus norvegicus
ggatcctctggtaaagggaattcca

SEQ ID NO: 431937 - DNA, 25 bp, Rattus norvegicus
ggatcctctggttaagggaattcca

SEQ ID NO: 431938 - DNA, 25 bp, Rattus norvegicus
ggatcctgaacaccagccagtggaa

SEQ ID NO: 431939 - DNA, 25 bp, Rattus norvegicus
ggatcctgaacagcagccagtggaa

SEQ ID NO: 431940 - DNA, 25 bp, Rattus norvegicus
ggatcctgaatcagagctgtacacc

SEQ ID NO: 431941 - DNA, 25 bp, Rattus norvegicus
ggatcctgaatctgagctgtacacc

SEQ ID NO: 431942 - DNA, 25 bp, Rattus norvegicus
ggatcctgacaccatacacagcaag

SEQ ID NO: 431943 - DNA, 25 bp, Rattus norvegicus
ggatcctgacacgatacacagcaag

SEQ ID NO: 431944 - DNA, 25 bp, Rattus norvegicus
ggatcctgactccacccgggcgagc

SEQ ID NO: 431945 - DNA, 25 bp, Rattus norvegicus
ggatcctgactcgacccgggcgagc

SEQ ID NO: 431946 - DNA, 25 bp, Rattus norvegicus
ggatcctgagatagccagcctgtca

SEQ ID NO: 431947 - DNA, 25 bp, Rattus norvegicus
ggatcctgagattgccagcctgtca

SEQ ID NO: 431948 - DNA, 25 bp, Rattus norvegicus
ggatcctgagccatatatagcccag

SEQ ID NO: 431949 - DNA, 25 bp, Rattus norvegicus
ggatcctgagccttatatagcccag

SEQ ID NO: 431950 - DNA, 25 bp, Rattus norvegicus
ggatcctgaggtaagcgttataatt

SEQ ID NO: 431951 - DNA, 25 bp, Rattus norvegicus
ggatcctgaggttagcgttataatt

SEQ ID NO: 431952 - DNA, 25 bp, Rattus norvegicus
ggatcctgatccaggaccaggactg

SEQ ID NO: 431953 - DNA, 25 bp, Rattus norvegicus
ggatcctgatcctggaccaggactg

SEQ ID NO: 431954 - DNA, 25 bp, Rattus norvegicus
ggatcctgcaagaccacagttaagg

SEQ ID NO: 431955 - DNA, 25 bp, Rattus norvegicus
ggatcctgcaagtccacagttaagg

SEQ ID NO: 431956 - DNA, 25 bp, Rattus norvegicus
ggatcctgcatcacttgttttaact

SEQ ID NO: 431957 - DNA, 25 bp, Rattus norvegicus
ggatcctgcatctcttgttttaact

SEQ ID NO: 431958 - DNA, 25 bp, Rattus norvegicus
ggatcctgccagatgttttctttcc

SEQ ID NO: 431959 - DNA, 25 bp, Rattus norvegicus
ggatcctgccagttgttttctttcc

SEQ ID NO: 431960 - DNA, 25 bp, Rattus norvegicus
ggatcctgctctcaatctctggact

SEQ ID NO: 431961 - DNA, 25 bp, Rattus norvegicus
ggatcctgctctgaatctctggact

SEQ ID NO: 431962 - DNA, 25 bp, Rattus norvegicus
ggatcctgctgaagtgctccgcttg

SEQ ID NO: 431963 - DNA, 25 bp, Rattus norvegicus
ggatcctgctgatgtgctccgcttg

SEQ ID NO: 431964 - DNA, 25 bp, Rattus norvegicus
ggatcctggaagcttagaccagcga

SEQ ID NO: 431965 - DNA, 25 bp, Rattus norvegicus
ggatcctggaaggttagaccagcga

SEQ ID NO: 431966 - DNA, 25 bp, Rattus norvegicus
ggatcctggtcaattttagctgttc

SEQ ID NO: 431967 - DNA, 25 bp, Rattus norvegicus
ggatcctggtcatttttagctgttc

SEQ ID NO: 431968 - DNA, 25 bp, Rattus norvegicus
ggatcctggtgcaaacaatgctgcc

SEQ ID NO: 431969 - DNA, 25 bp, Rattus norvegicus
ggatcctggtgctaacaatgctgcc

SEQ ID NO: 431970 - DNA, 25 bp, Rattus norvegicus
ggatcctgtatccatagcctctgta

SEQ ID NO: 431971 - DNA, 25 bp, Rattus norvegicus
ggatcctgtatcgatagcctctgta

SEQ ID NO: 431972 - DNA, 25 bp, Rattus norvegicus
ggatcctgtatgcaggacacctcct

SEQ ID NO: 431973 - DNA, 25 bp, Rattus norvegicus
ggatcctgtatggaggacacctcct

SEQ ID NO: 431974 - DNA, 25 bp, Rattus norvegicus
ggatcctgtctcatttgactaatat

SEQ ID NO: 431975 - DNA, 25 bp, Rattus norvegicus
ggatcctgtctcttttgactaatat

SEQ ID NO: 431976 - DNA, 25 bp, Rattus norvegicus
ggatcctgtctgctgttgtgacgaa

SEQ ID NO: 431977 - DNA, 25 bp, Rattus norvegicus
ggatcctgtctggtgttgtgacgaa

SEQ ID NO: 431978 - DNA, 25 bp, Rattus norvegicus
ggatcctgtcttacagctccaaaaa

SEQ ID NO: 431979 - DNA, 25 bp, Rattus norvegicus
ggatcctgtcttatagaggtgtgga

SEQ ID NO: 431980 - DNA, 25 bp, Rattus norvegicus
ggatcctgtctttcagctccaaaaa

SEQ ID NO: 431981 - DNA, 25 bp, Rattus norvegicus
ggatcctgtcttttagaggtgtgga

SEQ ID NO: 431982 - DNA, 25 bp, Rattus norvegicus
ggatcctgttccatcacatcgcggt

SEQ ID NO: 431983 - DNA, 25 bp, Rattus norvegicus
ggatcctgttccttcacatcgcggt

SEQ ID NO: 431984 - DNA, 25 bp, Rattus norvegicus
ggatcctgttttagcagagtacatt

SEQ ID NO: 431985 - DNA, 25 bp, Rattus norvegicus
ggatcctgtttttgcagagtacatt

SEQ ID NO: 431986 - DNA, 25 bp, Rattus norvegicus
ggatccttaggccaagcatgaactc

SEQ ID NO: 431987 - DNA, 25 bp, Rattus norvegicus
ggatccttaggcgaagcatgaactc

SEQ ID NO: 431988 - DNA, 25 bp, Rattus norvegicus
ggatccttcaggctttcagagacga

SEQ ID NO: 431989 - DNA, 25 bp, Rattus norvegicus
ggatccttcagggtttcagagacga

SEQ ID NO: 431990 - DNA, 25 bp, Rattus norvegicus
ggatccttcattatgggactgcttt

SEQ ID NO: 431991 - DNA, 25 bp, Rattus norvegicus
ggatccttcattttgggactgcttt

SEQ ID NO: 431992 - DNA, 25 bp, Rattus norvegicus
ggatccttccccaggatgttatcct

SEQ ID NO: 431993 - DNA, 25 bp, Rattus norvegicus
ggatccttcccctggatgttatcct

SEQ ID NO: 431994 - DNA, 25 bp, Rattus norvegicus
ggatccttgatgcttgctgactctc

SEQ ID NO: 431995 - DNA, 25 bp, Rattus norvegicus
ggatccttgatggttgctgactctc

SEQ ID NO: 431996 - DNA, 25 bp, Rattus norvegicus
ggatccttgctcagggcagtcttaa

SEQ ID NO: 431997 - DNA, 25 bp, Rattus norvegicus
ggatccttgctctgggcagtcttaa

SEQ ID NO: 431998 - DNA, 25 bp, Rattus norvegicus
ggatccttgtgtattgcatggttat

SEQ ID NO: 431999 - DNA, 25 bp, Rattus norvegicus
ggatccttgtgttttgcatggttat

SEQ ID NO: 432000 - DNA, 25 bp, Rattus norvegicus
ggatccttgttgatgctctccaaaa

SEQ ID NO: 432001 - DNA, 25 bp, Rattus norvegicus
ggatccttgttgttgctctccaaaa

SEQ ID NO: 432002 - DNA, 25 bp, Rattus norvegicus
ggatcctttcctagtaaaccgccag

SEQ ID NO: 432003 - DNA, 25 bp, Rattus norvegicus
ggatcctttccttgtaaaccgccag

SEQ ID NO: 432004 - DNA, 25 bp, Rattus norvegicus
ggatcctttgaaaatctcacttcag

SEQ ID NO: 432005 - DNA, 25 bp, Rattus norvegicus
ggatcctttgaatatctcacttcag

SEQ ID NO: 432006 - DNA, 25 bp, Rattus norvegicus
ggatcctttgttattggcctctgga

SEQ ID NO: 432007 - DNA, 25 bp, Rattus norvegicus
ggatcctttgtttttggcctctgga

SEQ ID NO: 432008 - DNA, 25 bp, Rattus norvegicus
ggatccttttggctgggatttccac

SEQ ID NO: 432009 - DNA, 25 bp, Rattus norvegicus
ggatccttttgggtgggatttccac

SEQ ID NO: 432010 - DNA, 25 bp, Rattus norvegicus
ggatcgaaacacatagcctcatttc

SEQ ID NO: 432011 - DNA, 25 bp, Rattus norvegicus
ggatcgaaacacttagcctcatttc

SEQ ID NO: 432012 - DNA, 25 bp, Rattus norvegicus
ggatcgaaatctacctgaagccctc

SEQ ID NO: 432013 - DNA, 25 bp, Rattus norvegicus
ggatcgaaatcttcctgaagccctc

SEQ ID NO: 432014 - DNA, 25 bp, Rattus norvegicus
ggatcgaactaaccaccagctagaa

SEQ ID NO: 432015 - DNA, 25 bp, Rattus norvegicus
ggatcgaactaagcaccagctagaa

SEQ ID NO: 432016 - DNA, 25 bp, Rattus norvegicus
ggatcgaatgcgatgggaacccctt

SEQ ID NO: 432017 - DNA, 25 bp, Rattus norvegicus
ggatcgaatgcgttgggaacccctt

SEQ ID NO: 432018 - DNA, 25 bp, Rattus norvegicus
ggatcgacaatcactatgacagcac

SEQ ID NO: 432019 - DNA, 25 bp, Rattus norvegicus
ggatcgacaatctctatgacagcac

SEQ ID NO: 432020 - DNA, 25 bp, Rattus norvegicus
ggatcgacacagaccttggcaaagt

SEQ ID NO: 432021 - DNA, 25 bp, Rattus norvegicus
ggatcgacacagtccttggcaaagt

SEQ ID NO: 432022 - DNA, 25 bp, Rattus norvegicus
ggatcgacactgctggtctgcgaat

SEQ ID NO: 432023 - DNA, 25 bp, Rattus norvegicus
ggatcgacactggtggtctgcgaat

SEQ ID NO: 432024 - DNA, 25 bp, Rattus norvegicus
ggatcgacgcggctccagatgtcta

SEQ ID NO: 432025 - DNA, 25 bp, Rattus norvegicus
ggatcgacgcgggtccagatgtcta

SEQ ID NO: 432026 - DNA, 25 bp, Rattus norvegicus
ggatcgagccatcagccctccagat

SEQ ID NO: 432027 - DNA, 25 bp, Rattus norvegicus
ggatcgagccatgagccctccagat

SEQ ID NO: 432028 - DNA, 25 bp, Rattus norvegicus
ggatcgagcccacgaccatgtgtgt

SEQ ID NO: 432029 - DNA, 25 bp, Rattus norvegicus
ggatcgagcccaggaccatgtgtgt

SEQ ID NO: 432030 - DNA, 25 bp, Rattus norvegicus
ggatcgaggagtacaccacgggcat

SEQ ID NO: 432031 - DNA, 25 bp, Rattus norvegicus
ggatcgaggagttcaccacgggcat

SEQ ID NO: 432032 - DNA, 25 bp, Rattus norvegicus
ggatcgagtggcattcaagcagcat

SEQ ID NO: 432033 - DNA, 25 bp, Rattus norvegicus
ggatcgagtggctttcaagcagcat

SEQ ID NO: 432034 - DNA, 25 bp, Rattus norvegicus
ggatcgagtgtcacagctcagctaa

SEQ ID NO: 432035 - DNA, 25 bp, Rattus norvegicus
ggatcgagtgtctcagctcagctaa

SEQ ID NO: 432036 - DNA, 25 bp, Rattus norvegicus
ggatcgatcctgcacgctgactgca

SEQ ID NO: 432037 - DNA, 25 bp, Rattus norvegicus
ggatcgatcctggacgctgactgca

SEQ ID NO: 432038 - DNA, 25 bp, Rattus norvegicus
ggatcgcaagtacaccctaaccatg

SEQ ID NO: 432039 - DNA, 25 bp, Rattus norvegicus
ggatcgcaagtagaccctaaccatg

SEQ ID NO: 432040 - DNA, 25 bp, Rattus norvegicus
ggatcgcactgtccccatcaaaatg

SEQ ID NO: 432041 - DNA, 25 bp, Rattus norvegicus
ggatcgcactgtgcccatcaaaatg

SEQ ID NO: 432042 - DNA, 25 bp, Rattus norvegicus
ggatcgcatcatcccgagacttgag

SEQ ID NO: 432043 - DNA, 25 bp, Rattus norvegicus
ggatcgcatcatgccgagacttgag

SEQ ID NO: 432044 - DNA, 25 bp, Rattus norvegicus
ggatcgcattgtaatattctgggtt

SEQ ID NO: 432045 - DNA, 25 bp, Rattus norvegicus
ggatcgcattgttatattctgggtt

SEQ ID NO: 432046 - DNA, 25 bp, Rattus norvegicus
ggatcgcccctgacgactgaaagaa

SEQ ID NO: 432047 - DNA, 25 bp, Rattus norvegicus
ggatcgcccctgtcgactgaaagaa

SEQ ID NO: 432048 - DNA, 25 bp, Rattus norvegicus
ggatcgctgcacatttatctcaatt

SEQ ID NO: 432049 - DNA, 25 bp, Rattus norvegicus
ggatcgctgcacttttatctcaatt

SEQ ID NO: 432050 - DNA, 25 bp, Rattus norvegicus
ggatcgctgtcaaacctggggctca

SEQ ID NO: 432051 - DNA, 25 bp, Rattus norvegicus
ggatcgctgtcatacctggggctca

SEQ ID NO: 432052 - DNA, 25 bp, Rattus norvegicus
ggatcgcttgctcggtatcgttgcc

SEQ ID NO: 432053 - DNA, 25 bp, Rattus norvegicus
ggatcgcttgctgggtatcgttgcc

SEQ ID NO: 432054 - DNA, 25 bp, Rattus norvegicus
ggatcgcttggaaacttagcctaga

SEQ ID NO: 432055 - DNA, 25 bp, Rattus norvegicus
ggatcgcttggatacttagcctaga

SEQ ID NO: 432056 - DNA, 25 bp, Rattus norvegicus
ggatcgctttcgctgagcctggccc

SEQ ID NO: 432057 - DNA, 25 bp, Rattus norvegicus
ggatcgctttcggtgagcctggccc

SEQ ID NO: 432058 - DNA, 25 bp, Rattus norvegicus
ggatcggaaaccatgctgcctgcaa

SEQ ID NO: 432059 - DNA, 25 bp, Rattus norvegicus
ggatcggaaaccttgctgcctgcaa

SEQ ID NO: 432060 - DNA, 25 bp, Rattus norvegicus
ggatcggaagctcacgtcgaactca

SEQ ID NO: 432061 - DNA, 25 bp, Rattus norvegicus
ggatcggaagctgacgtcgaactca

SEQ ID NO: 432062 - DNA, 25 bp, Rattus norvegicus
ggatcggagcttcactactgacctg

SEQ ID NO: 432063 - DNA, 25 bp, Rattus norvegicus
ggatcggagcttgactactgacctg

SEQ ID NO: 432064 - DNA, 25 bp, Rattus norvegicus
ggatcggatccaatcctgggagagt

SEQ ID NO: 432065 - DNA, 25 bp, Rattus norvegicus
ggatcggatccattcctgggagagt

SEQ ID NO: 432066 - DNA, 25 bp, Rattus norvegicus
ggatcggatctcctttcagatggtt

SEQ ID NO: 432067 - DNA, 25 bp, Rattus norvegicus
ggatcggatctcgtttcagatggtt

SEQ ID NO: 432068 - DNA, 25 bp, Rattus norvegicus
ggatcggcgagcagccagacaactc

SEQ ID NO: 432069 - DNA, 25 bp, Rattus norvegicus
ggatcggcgagctgccagacaactc

SEQ ID NO: 432070 - DNA, 25 bp, Rattus norvegicus
ggatcggcgcgcacacagaagagat

SEQ ID NO: 432071 - DNA, 25 bp, Rattus norvegicus
ggatcggcgcgctcacagaagagat

SEQ ID NO: 432072 - DNA, 25 bp, Rattus norvegicus
ggatcggctacccatgagtcaatat

SEQ ID NO: 432073 - DNA, 25 bp, Rattus norvegicus
ggatcggctaccgatgagtcaatat

SEQ ID NO: 432074 - DNA, 25 bp, Rattus norvegicus
ggatcggctgtgaaatgtgcactct

SEQ ID NO: 432075 - DNA, 25 bp, Rattus norvegicus
ggatcggctgtgtaatgtgcactct

SEQ ID NO: 432076 - DNA, 25 bp, Rattus norvegicus
ggatcgggaagacagcccgccgaga

SEQ ID NO: 432077 - DNA, 25 bp, Rattus norvegicus
ggatcgggaagagagcccgccgaga

SEQ ID NO: 432078 - DNA, 25 bp, Rattus norvegicus
ggatcgggagataatcacaactgtt

SEQ ID NO: 432079 - DNA, 25 bp, Rattus norvegicus
ggatcgggagattatcacaactgtt

SEQ ID NO: 432080 - DNA, 25 bp, Rattus norvegicus
ggatcgggcctgaactcagcaggct

SEQ ID NO: 432081 - DNA, 25 bp, Rattus norvegicus
ggatcgggcctgtactcagcaggct

SEQ ID NO: 432082 - DNA, 25 bp, Rattus norvegicus
ggatcgggccttaggcattcctgac

SEQ ID NO: 432083 - DNA, 25 bp, Rattus norvegicus
ggatcgggcctttggcattcctgac

SEQ ID NO: 432084 - DNA, 25 bp, Rattus norvegicus
ggatcggtcgcgataccgcactgga

SEQ ID NO: 432085 - DNA, 25 bp, Rattus norvegicus
ggatcggtcgcgttaccgcactgga

SEQ ID NO: 432086 - DNA, 25 bp, Rattus norvegicus
ggatcggttatcacgtgtagctgga

SEQ ID NO: 432087 - DNA, 25 bp, Rattus norvegicus
ggatcggttatctcgtgtagctgga

SEQ ID NO: 432088 - DNA, 25 bp, Rattus norvegicus
ggatcgtaaactccaagccaaagtt

SEQ ID NO: 432089 - DNA, 25 bp, Rattus norvegicus
ggatcgtaaactgcaagccaaagtt

SEQ ID NO: 432090 - DNA, 25 bp, Rattus norvegicus
ggatcgtacaagctgacgacgactt

SEQ ID NO: 432091 - DNA, 25 bp, Rattus norvegicus
ggatcgtacaaggtgacgacgactt

SEQ ID NO: 432092 - DNA, 25 bp, Rattus norvegicus
ggatcgtatcttagaaactgtgcag

SEQ ID NO: 432093 - DNA, 25 bp, Rattus norvegicus
ggatcgtatctttgaaactgtgcag

SEQ ID NO: 432094 - DNA, 25 bp, Rattus norvegicus
ggatcgtcacccaggaaacaaaatt

SEQ ID NO: 432095 - DNA, 25 bp, Rattus norvegicus
ggatcgtcaccctggaaacaaaatt

SEQ ID NO: 432096 - DNA, 25 bp, Rattus norvegicus
ggatcgtcacggagaagccatgtct

SEQ ID NO: 432097 - DNA, 25 bp, Rattus norvegicus
ggatcgtcacggtgaagccatgtct

SEQ ID NO: 432098 - DNA, 25 bp, Rattus norvegicus
ggatcgtcagacctggcaagccagt

SEQ ID NO: 432099 - DNA, 25 bp, Rattus norvegicus
ggatcgtcagacgtggcaagccagt

SEQ ID NO: 432100 - DNA, 25 bp, Rattus norvegicus
ggatcgtccctgagtggcaagacta

SEQ ID NO: 432101 - DNA, 25 bp, Rattus norvegicus
ggatcgtccctgtgtggcaagacta

SEQ ID NO: 432102 - DNA, 25 bp, Rattus norvegicus
ggatcgtctaccatagtcttgagca

SEQ ID NO: 432103 - DNA, 25 bp, Rattus norvegicus
ggatcgtctaccttagtcttgagca

SEQ ID NO: 432104 - DNA, 25 bp, Rattus norvegicus
ggatcgtgctttccgttgtctccga

SEQ ID NO: 432105 - DNA, 25 bp, Rattus norvegicus
ggatcgtgctttgcgttgtctccga

SEQ ID NO: 432106 - DNA, 25 bp, Rattus norvegicus
ggatcgtggaagctgcatccaactt

SEQ ID NO: 432107 - DNA, 25 bp, Rattus norvegicus
ggatcgtggaaggtgcatccaactt

SEQ ID NO: 432108 - DNA, 25 bp, Rattus norvegicus
ggatcgtgtcttcatgctgagctgc

SEQ ID NO: 432109 - DNA, 25 bp, Rattus norvegicus
ggatcgtgtcttgatgctgagctgc

SEQ ID NO: 432110 - DNA, 25 bp, Rattus norvegicus
ggatcgtgtttccattcaccttttc

SEQ ID NO: 432111 - DNA, 25 bp, Rattus norvegicus
ggatcgtgtttcgattcaccttttc

SEQ ID NO: 432112 - DNA, 25 bp, Rattus norvegicus
ggatctaagaagacatggtgttcga

SEQ ID NO: 432113 - DNA, 25 bp, Rattus norvegicus
ggatctaagaagtcatggtgttcga

SEQ ID NO: 432114 - DNA, 25 bp, Rattus norvegicus
ggatctaagcccaccaagaacgagt

SEQ ID NO: 432115 - DNA, 25 bp, Rattus norvegicus
ggatctaagccctccaagaacgagt

SEQ ID NO: 432116 - DNA, 25 bp, Rattus norvegicus
ggatctaagcctccagtctgagcaa

SEQ ID NO: 432117 - DNA, 25 bp, Rattus norvegicus
ggatctaagcctgcagtctgagcaa

SEQ ID NO: 432118 - DNA, 25 bp, Rattus norvegicus
ggatctaagctgcacctttgagaaa

SEQ ID NO: 432119 - DNA, 25 bp, Rattus norvegicus
ggatctaagctggacctttgagaaa

SEQ ID NO: 432120 - DNA, 25 bp, Rattus norvegicus
ggatctaaggaaacaattttatcaa

SEQ ID NO: 432121 - DNA, 25 bp, Rattus norvegicus
ggatctaaggaatcaattttatcaa

SEQ ID NO: 432122 - DNA, 25 bp, Rattus norvegicus
ggatctaagggcacctgacctggat

SEQ ID NO: 432123 - DNA, 25 bp, Rattus norvegicus
ggatctaagggctcctgacctggat

SEQ ID NO: 432124 - DNA, 25 bp, Rattus norvegicus
ggatctaatctcctgcagttcagtt

SEQ ID NO: 432125 - DNA, 25 bp, Rattus norvegicus
ggatctaatctcgtgcagttcagtt

SEQ ID NO: 432126 - DNA, 25 bp, Rattus norvegicus
ggatctaattccctgtttgctatta

SEQ ID NO: 432127 - DNA, 25 bp, Rattus norvegicus
ggatctaattccgtgtttgctatta

SEQ ID NO: 432128 - DNA, 25 bp, Rattus norvegicus
ggatctacaaccagggcacgggcac

SEQ ID NO: 432129 - DNA, 25 bp, Rattus norvegicus
ggatctacaacctgggcacgggcac

SEQ ID NO: 432130 - DNA, 25 bp, Rattus norvegicus
ggatctacaagtccaaccttggcgt

SEQ ID NO: 432131 - DNA, 25 bp, Rattus norvegicus
ggatctacaagtgcaaccttggcgt

SEQ ID NO: 432132 - DNA, 25 bp, Rattus norvegicus
ggatctacacccaccagagtgatgt

SEQ ID NO: 432133 - DNA, 25 bp, Rattus norvegicus
ggatctacacccatatcattactga

SEQ ID NO: 432134 - DNA, 25 bp, Rattus norvegicus
ggatctacaccctccagagtgatgt

SEQ ID NO: 432135 - DNA, 25 bp, Rattus norvegicus
ggatctacacccttatcattactga

SEQ ID NO: 432136 - DNA, 25 bp, Rattus norvegicus
ggatctacatgcacttcacaggtca

SEQ ID NO: 432137 - DNA, 25 bp, Rattus norvegicus
ggatctacatgctcttcacaggtca

SEQ ID NO: 432138 - DNA, 25 bp, Rattus norvegicus
ggatctactcaccaaatgggctctt

SEQ ID NO: 432139 - DNA, 25 bp, Rattus norvegicus
ggatctactcacgaaatgggctctt

SEQ ID NO: 432140 - DNA, 25 bp, Rattus norvegicus
ggatctactgatcggcaggttacca

SEQ ID NO: 432141 - DNA, 25 bp, Rattus norvegicus
ggatctactgatgggcaggttacca

SEQ ID NO: 432142 - DNA, 25 bp, Rattus norvegicus
ggatctactggaagcccctggttca

SEQ ID NO: 432143 - DNA, 25 bp, Rattus norvegicus
ggatctactggatgcccctggttca

SEQ ID NO: 432144 - DNA, 25 bp, Rattus norvegicus
ggatctagacaaaggctctgagtac

SEQ ID NO: 432145 - DNA, 25 bp, Rattus norvegicus
ggatctagacaatggctctgagtac

SEQ ID NO: 432146 - DNA, 25 bp, Rattus norvegicus
ggatctagtcggatgaggcctccaa

SEQ ID NO: 432147 - DNA, 25 bp, Rattus norvegicus
ggatctagtcggttgaggcctccaa

SEQ ID NO: 432148 - DNA, 25 bp, Rattus norvegicus
ggatctataagcatgcccacttgag

SEQ ID NO: 432149 - DNA, 25 bp, Rattus norvegicus
ggatctataagcttgcccacttgag

SEQ ID NO: 432150 - DNA, 25 bp, Rattus norvegicus
ggatctatctggaggacgcaggcct

SEQ ID NO: 432151 - DNA, 25 bp, Rattus norvegicus
ggatctatctggtggacgcaggcct

SEQ ID NO: 432152 - DNA, 25 bp, Rattus norvegicus
ggatctatctgtacaggtgcctgtt

SEQ ID NO: 432153 - DNA, 25 bp, Rattus norvegicus
ggatctatctgttcaggtgcctgtt

SEQ ID NO: 432154 - DNA, 25 bp, Rattus norvegicus
ggatctattagcctggcttctgcct

SEQ ID NO: 432155 - DNA, 25 bp, Rattus norvegicus
ggatctattagcgtggcttctgcct

SEQ ID NO: 432156 - DNA, 25 bp, Rattus norvegicus
ggatctatttttcttgttgccattc

SEQ ID NO: 432157 - DNA, 25 bp, Rattus norvegicus
ggatctatttttgttgttgccattc

SEQ ID NO: 432158 - DNA, 25 bp, Rattus norvegicus
ggatctcaaagcaaggtctccacct

SEQ ID NO: 432159 - DNA, 25 bp, Rattus norvegicus
ggatctcaaagctaggtctccacct

SEQ ID NO: 432160 - DNA, 25 bp, Rattus norvegicus
ggatctcaacgacctaaacgatggg

SEQ ID NO: 432161 - DNA, 25 bp, Rattus norvegicus
ggatctcaacgagctaaacgatggg

SEQ ID NO: 432162 - DNA, 25 bp, Rattus norvegicus
ggatctcaacttatccttctggaag

SEQ ID NO: 432163 - DNA, 25 bp, Rattus norvegicus
ggatctcaacttttccttctggaag

SEQ ID NO: 432164 - DNA, 25 bp, Rattus norvegicus
ggatctcaagcaaagtcaaccactg

SEQ ID NO: 432165 - DNA, 25 bp, Rattus norvegicus
ggatctcaagcatagtcaaccactg

SEQ ID NO: 432166 - DNA, 25 bp, Rattus norvegicus
ggatctcaagtaagtccagagctca

SEQ ID NO: 432167 - DNA, 25 bp, Rattus norvegicus
ggatctcaagtatgtccagagctca

SEQ ID NO: 432168 - DNA, 25 bp, Rattus norvegicus
ggatctcaccatctatccctaaatg

SEQ ID NO: 432169 - DNA, 25 bp, Rattus norvegicus
ggatctcaccatgtatccctaaatg

SEQ ID NO: 432170 - DNA, 25 bp, Rattus norvegicus
ggatctcacgacactgaggctaagt

SEQ ID NO: 432171 - DNA, 25 bp, Rattus norvegicus
ggatctcacgactctgaggctaagt

SEQ ID NO: 432172 - DNA, 25 bp, Rattus norvegicus
ggatctcactatccatcctaggtct

SEQ ID NO: 432173 - DNA, 25 bp, Rattus norvegicus
ggatctcactatgcatcctaggtct

SEQ ID NO: 432174 - DNA, 25 bp, Rattus norvegicus
ggatctcagtacacgactggacatt

SEQ ID NO: 432175 - DNA, 25 bp, Rattus norvegicus
ggatctcagtacaggcagaggagtc

SEQ ID NO: 432176 - DNA, 25 bp, Rattus norvegicus
ggatctcagtactcgactggacatt

SEQ ID NO: 432177 - DNA, 25 bp, Rattus norvegicus
ggatctcagtactggcagaggagtc

SEQ ID NO: 432178 - DNA, 25 bp, Rattus norvegicus
ggatctcatgagatcagactggcct

SEQ ID NO: 432179 - DNA, 25 bp, Rattus norvegicus
ggatctcatgagttcagactggcct

SEQ ID NO: 432180 - DNA, 25 bp, Rattus norvegicus
ggatctcattcaatctttgtgtttt

SEQ ID NO: 432181 - DNA, 25 bp, Rattus norvegicus
ggatctcattcattctttgtgtttt

SEQ ID NO: 432182 - DNA, 25 bp, Rattus norvegicus
ggatctccacatcctaatcattgtg

SEQ ID NO: 432183 - DNA, 25 bp, Rattus norvegicus
ggatctccacatgctaatcattgtg

SEQ ID NO: 432184 - DNA, 25 bp, Rattus norvegicus
ggatctccactaccacagattatga

SEQ ID NO: 432185 - DNA, 25 bp, Rattus norvegicus
ggatctccactagcacagattatga

SEQ ID NO: 432186 - DNA, 25 bp, Rattus norvegicus
ggatctcccatcctcttgactggca

SEQ ID NO: 432187 - DNA, 25 bp, Rattus norvegicus
ggatctcccatcgtcttgactggca

SEQ ID NO: 432188 - DNA, 25 bp, Rattus norvegicus
ggatctcccttgctgaatacgcaca

SEQ ID NO: 432189 - DNA, 25 bp, Rattus norvegicus
ggatctcccttggtgaatacgcaca

SEQ ID NO: 432190 - DNA, 25 bp, Rattus norvegicus
ggatctccggttacgtctgtgatgt

SEQ ID NO: 432191 - DNA, 25 bp, Rattus norvegicus
ggatctccggtttcgtctgtgatgt

SEQ ID NO: 432192 - DNA, 25 bp, Rattus norvegicus
ggatctcctgatcctgacttttgac

SEQ ID NO: 432193 - DNA, 25 bp, Rattus norvegicus
ggatctcctgatgctgacttttgac

SEQ ID NO: 432194 - DNA, 25 bp, Rattus norvegicus
ggatctcctggactttcaatggaat

SEQ ID NO: 432195 - DNA, 25 bp, Rattus norvegicus
ggatctcctggagtttcaatggaat

SEQ ID NO: 432196 - DNA, 25 bp, Rattus norvegicus
ggatctcgagtcagtggcaaccgga

SEQ ID NO: 432197 - DNA, 25 bp, Rattus norvegicus
ggatctcgagtctgtggcaaccgga

SEQ ID NO: 432198 - DNA, 25 bp, Rattus norvegicus
ggatctcgatgcatggattcttttg

SEQ ID NO: 432199 - DNA, 25 bp, Rattus norvegicus
ggatctcgatgcttggattcttttg

SEQ ID NO: 432200 - DNA, 25 bp, Rattus norvegicus
ggatctcgtgataaactctagggaa

SEQ ID NO: 432201 - DNA, 25 bp, Rattus norvegicus
ggatctcgtgattaactctagggaa

SEQ ID NO: 432202 - DNA, 25 bp, Rattus norvegicus
ggatctctaaatatcaggtcagcct

SEQ ID NO: 432203 - DNA, 25 bp, Rattus norvegicus
ggatctctaaatttcaggtcagcct

SEQ ID NO: 432204 - DNA, 25 bp, Rattus norvegicus
ggatctctacagattgaggttagcc

SEQ ID NO: 432205 - DNA, 25 bp, Rattus norvegicus
ggatctctacagtttgaggttagcc

SEQ ID NO: 432206 - DNA, 25 bp, Rattus norvegicus
ggatctctagacctgtgccttggat

SEQ ID NO: 432207 - DNA, 25 bp, Rattus norvegicus
ggatctctagacgtgtgccttggat

SEQ ID NO: 432208 - DNA, 25 bp, Rattus norvegicus
ggatctctagtgacgatatcatgct

SEQ ID NO: 432209 - DNA, 25 bp, Rattus norvegicus
ggatctctagtgtcgatatcatgct

SEQ ID NO: 432210 - DNA, 25 bp, Rattus norvegicus
ggatctctatctaggcttttgtaaa

SEQ ID NO: 432211 - DNA, 25 bp, Rattus norvegicus
ggatctctatcttggcttttgtaaa

SEQ ID NO: 432212 - DNA, 25 bp, Rattus norvegicus
ggatctctcagaccaatagcagttt

SEQ ID NO: 432213 - DNA, 25 bp, Rattus norvegicus
ggatctctcagagcaatagcagttt

SEQ ID NO: 432214 - DNA, 25 bp, Rattus norvegicus
ggatctctcatcaggtgagtttaca

SEQ ID NO: 432215 - DNA, 25 bp, Rattus norvegicus
ggatctctcatctggtgagtttaca

SEQ ID NO: 432216 - DNA, 25 bp, Rattus norvegicus
ggatctctcttcagtgcactaatag

SEQ ID NO: 432217 - DNA, 25 bp, Rattus norvegicus
ggatctctcttctgtgcactaatag

SEQ ID NO: 432218 - DNA, 25 bp, Rattus norvegicus
ggatctctgagaacttgtttcctct

SEQ ID NO: 432219 - DNA, 25 bp, Rattus norvegicus
ggatctctgagatcttgtttcctct

SEQ ID NO: 432220 - DNA, 25 bp, Rattus norvegicus
ggatctctgaggaagcggcccgcgc

SEQ ID NO: 432221 - DNA, 25 bp, Rattus norvegicus
ggatctctgaggtagcggcccgcgc

SEQ ID NO: 432222 - DNA, 25 bp, Rattus norvegicus
ggatctctgatcctaactggaacct

SEQ ID NO: 432223 - DNA, 25 bp, Rattus norvegicus
ggatctctgatcgtaactggaacct

SEQ ID NO: 432224 - DNA, 25 bp, Rattus norvegicus
ggatctctgatgaaactctgctact

SEQ ID NO: 432225 - DNA, 25 bp, Rattus norvegicus
ggatctctgatgtaactctgctact

SEQ ID NO: 432226 - DNA, 25 bp, Rattus norvegicus
ggatctctgcgaccaaaggcctcat

SEQ ID NO: 432227 - DNA, 25 bp, Rattus norvegicus
ggatctctgcgagcaaaggcctcat

SEQ ID NO: 432228 - DNA, 25 bp, Rattus norvegicus
ggatctctgtgtataacccaacctt

SEQ ID NO: 432229 - DNA, 25 bp, Rattus norvegicus
ggatctctgtgtttaacccaacctt

SEQ ID NO: 432230 - DNA, 25 bp, Rattus norvegicus
ggatctcttcttcaatcatggacaa

SEQ ID NO: 432231 - DNA, 25 bp, Rattus norvegicus
ggatctcttcttgaatcatggacaa

SEQ ID NO: 432232 - DNA, 25 bp, Rattus norvegicus
ggatctcttgagaacctagcaactg

SEQ ID NO: 432233 - DNA, 25 bp, Rattus norvegicus
ggatctcttgagtacctagcaactg

SEQ ID NO: 432234 - DNA, 25 bp, Rattus norvegicus
ggatctcttgatacatcaatccgag

SEQ ID NO: 432235 - DNA, 25 bp, Rattus norvegicus
ggatctcttgattcatcaatccgag

SEQ ID NO: 432236 - DNA, 25 bp, Rattus norvegicus
ggatctctttccaattaattttcta

SEQ ID NO: 432237 - DNA, 25 bp, Rattus norvegicus
ggatctctttcctattaattttcta

SEQ ID NO: 432238 - DNA, 25 bp, Rattus norvegicus
ggatctctttctaatcaaagggtgg

SEQ ID NO: 432239 - DNA, 25 bp, Rattus norvegicus
ggatctctttcttatcaaagggtgg

SEQ ID NO: 432240 - DNA, 25 bp, Rattus norvegicus
ggatctgaaacaatccctagatttt

SEQ ID NO: 432241 - DNA, 25 bp, Rattus norvegicus
ggatctgaaacattccctagatttt

SEQ ID NO: 432242 - DNA, 25 bp, Rattus norvegicus
ggatctgaaactagaacccctggaa

SEQ ID NO: 432243 - DNA, 25 bp, Rattus norvegicus
ggatctgaaacttgaacccctggaa

SEQ ID NO: 432244 - DNA, 25 bp, Rattus norvegicus
ggatctgaacttcctgaagctgctt

SEQ ID NO: 432245 - DNA, 25 bp, Rattus norvegicus
ggatctgaacttcttccttagcctt

SEQ ID NO: 432246 - DNA, 25 bp, Rattus norvegicus
ggatctgaacttgctgaagctgctt

SEQ ID NO: 432247 - DNA, 25 bp, Rattus norvegicus
ggatctgaacttgttccttagcctt

SEQ ID NO: 432248 - DNA, 25 bp, Rattus norvegicus
ggatctgaaggcagctgtcgtctga

SEQ ID NO: 432249 - DNA, 25 bp, Rattus norvegicus
ggatctgaaggcctgtccctgaccg

SEQ ID NO: 432250 - DNA, 25 bp, Rattus norvegicus
ggatctgaaggcgtgtccctgaccg

SEQ ID NO: 432251 - DNA, 25 bp, Rattus norvegicus
ggatctgaaggctgctgtcgtctga

SEQ ID NO: 432252 - DNA, 25 bp, Rattus norvegicus
ggatctgaccaacaaggccacagga

SEQ ID NO: 432253 - DNA, 25 bp, Rattus norvegicus
ggatctgaccaagaaggccacagga

SEQ ID NO: 432254 - DNA, 25 bp, Rattus norvegicus
ggatctgacccgagaaccttctgat

SEQ ID NO: 432255 - DNA, 25 bp, Rattus norvegicus
ggatctgacccgtgaaccttctgat

SEQ ID NO: 432256 - DNA, 25 bp, Rattus norvegicus
ggatctgacctcataccatcagtgg

SEQ ID NO: 432257 - DNA, 25 bp, Rattus norvegicus
ggatctgacctccaagaagcctgaa

SEQ ID NO: 432258 - DNA, 25 bp, Rattus norvegicus
ggatctgacctcgaagaagcctgaa

SEQ ID NO: 432259 - DNA, 25 bp, Rattus norvegicus
ggatctgacctcttaccatcagtgg

SEQ ID NO: 432260 - DNA, 25 bp, Rattus norvegicus
ggatctgacttaattcctagggaaa

SEQ ID NO: 432261 - DNA, 25 bp, Rattus norvegicus
ggatctgacttatttcctagggaaa

SEQ ID NO: 432262 - DNA, 25 bp, Rattus norvegicus
ggatctgagcccaggacttcgtgga

SEQ ID NO: 432263 - DNA, 25 bp, Rattus norvegicus
ggatctgagccctggacttcgtgga

SEQ ID NO: 432264 - DNA, 25 bp, Rattus norvegicus
ggatctgagtataccccaagggcac

SEQ ID NO: 432265 - DNA, 25 bp, Rattus norvegicus
ggatctgagtattccccaagggcac

SEQ ID NO: 432266 - DNA, 25 bp, Rattus norvegicus
ggatctgatgacacccgggtgagcc

SEQ ID NO: 432267 - DNA, 25 bp, Rattus norvegicus
ggatctgatgactcccgggtgagcc

SEQ ID NO: 432268 - DNA, 25 bp, Rattus norvegicus
ggatctgatgccactgaactctggg

SEQ ID NO: 432269 - DNA, 25 bp, Rattus norvegicus
ggatctgatgcctctgaactctggg

SEQ ID NO: 432270 - DNA, 25 bp, Rattus norvegicus
ggatctgatgctacctcaaagtgtg

SEQ ID NO: 432271 - DNA, 25 bp, Rattus norvegicus
ggatctgatgcttcctcaaagtgtg

SEQ ID NO: 432272 - DNA, 25 bp, Rattus norvegicus
ggatctgattatctatggattctgt

SEQ ID NO: 432273 - DNA, 25 bp, Rattus norvegicus
ggatctgattatgtatggattctgt

SEQ ID NO: 432274 - DNA, 25 bp, Rattus norvegicus
ggatctgattccatgggctataccc

SEQ ID NO: 432275 - DNA, 25 bp, Rattus norvegicus
ggatctgattccttgggctataccc

SEQ ID NO: 432276 - DNA, 25 bp, Rattus norvegicus
ggatctgcaagcacccctaaggttg

SEQ ID NO: 432277 - DNA, 25 bp, Rattus norvegicus
ggatctgcaagctcccctaaggttg

SEQ ID NO: 432278 - DNA, 25 bp, Rattus norvegicus
ggatctgcaggaacactctaggctt

SEQ ID NO: 432279 - DNA, 25 bp, Rattus norvegicus
ggatctgcaggaatttccgtagaca

SEQ ID NO: 432280 - DNA, 25 bp, Rattus norvegicus
ggatctgcaggatcactctaggctt

SEQ ID NO: 432281 - DNA, 25 bp, Rattus norvegicus
ggatctgcaggattttccgtagaca

SEQ ID NO: 432282 - DNA, 25 bp, Rattus norvegicus
ggatctgcagtcacattttggaagt

SEQ ID NO: 432283 - DNA, 25 bp, Rattus norvegicus
ggatctgcagtctcattttggaagt

SEQ ID NO: 432284 - DNA, 25 bp, Rattus norvegicus
ggatctgcatgcagctgtaccagac

SEQ ID NO: 432285 - DNA, 25 bp, Rattus norvegicus
ggatctgcatgcattggttcttcaa

SEQ ID NO: 432286 - DNA, 25 bp, Rattus norvegicus
ggatctgcatgctgctgtaccagac

SEQ ID NO: 432287 - DNA, 25 bp, Rattus norvegicus
ggatctgcatgctttggttcttcaa

SEQ ID NO: 432288 - DNA, 25 bp, Rattus norvegicus
ggatctgcatgtatcccatatccaa

SEQ ID NO: 432289 - DNA, 25 bp, Rattus norvegicus
ggatctgcatgtctttgggaactgt

SEQ ID NO: 432290 - DNA, 25 bp, Rattus norvegicus
ggatctgcatgtgtttgggaactgt

SEQ ID NO: 432291 - DNA, 25 bp, Rattus norvegicus
ggatctgcatgtttcccatatccaa

SEQ ID NO: 432292 - DNA, 25 bp, Rattus norvegicus
ggatctgcattaccatgtttgcttg

SEQ ID NO: 432293 - DNA, 25 bp, Rattus norvegicus
ggatctgcattagcatgtttgcttg

SEQ ID NO: 432294 - DNA, 25 bp, Rattus norvegicus
ggatctgcccctcataatggtgtta

SEQ ID NO: 432295 - DNA, 25 bp, Rattus norvegicus
ggatctgcccctgataatggtgtta

SEQ ID NO: 432296 - DNA, 25 bp, Rattus norvegicus
ggatctgcctccaaaattcagttcc

SEQ ID NO: 432297 - DNA, 25 bp, Rattus norvegicus
ggatctgcctccactaatggttgta

SEQ ID NO: 432298 - DNA, 25 bp, Rattus norvegicus
ggatctgcctcctaaattcagttcc

SEQ ID NO: 432299 - DNA, 25 bp, Rattus norvegicus
ggatctgcctcctctaatggttgta

SEQ ID NO: 432300 - DNA, 25 bp, Rattus norvegicus
ggatctgcctgacacctgactgaag

SEQ ID NO: 432301 - DNA, 25 bp, Rattus norvegicus
ggatctgcctgagacctgactgaag

SEQ ID NO: 432302 - DNA, 25 bp, Rattus norvegicus
ggatctgcgcgtagacacatttcga

SEQ ID NO: 432303 - DNA, 25 bp, Rattus norvegicus
ggatctgcgcgttgacacatttcga

SEQ ID NO: 432304 - DNA, 25 bp, Rattus norvegicus
ggatctgcggagagtgttcttcaag

SEQ ID NO: 432305 - DNA, 25 bp, Rattus norvegicus
ggatctgcggagtgtgttcttcaag

SEQ ID NO: 432306 - DNA, 25 bp, Rattus norvegicus
ggatctgctctgagagactgtcacc

SEQ ID NO: 432307 - DNA, 25 bp, Rattus norvegicus
ggatctgctctgtgagactgtcacc

SEQ ID NO: 432308 - DNA, 25 bp, Rattus norvegicus
ggatctgctgatctacagtgccttt

SEQ ID NO: 432309 - DNA, 25 bp, Rattus norvegicus
ggatctgctgatgtacagtgccttt

SEQ ID NO: 432310 - DNA, 25 bp, Rattus norvegicus
ggatctgctggcacaactgctggaa

SEQ ID NO: 432311 - DNA, 25 bp, Rattus norvegicus
ggatctgctggctcaactgctggaa

SEQ ID NO: 432312 - DNA, 25 bp, Rattus norvegicus
ggatctgctgtaatttatcggctat

SEQ ID NO: 432313 - DNA, 25 bp, Rattus norvegicus
ggatctgctgtattttatcggctat

SEQ ID NO: 432314 - DNA, 25 bp, Rattus norvegicus
ggatctgctgttagaagcgcagcag

SEQ ID NO: 432315 - DNA, 25 bp, Rattus norvegicus
ggatctgctgtttgaagcgcagcag

SEQ ID NO: 432316 - DNA, 25 bp, Rattus norvegicus
ggatctggaactatgggcatcgtca

SEQ ID NO: 432317 - DNA, 25 bp, Rattus norvegicus
ggatctggaactttgggcatcgtca

SEQ ID NO: 432318 - DNA, 25 bp, Rattus norvegicus
ggatctggacccctatgttaagaag

SEQ ID NO: 432319 - DNA, 25 bp, Rattus norvegicus
ggatctggacccgtatgttaagaag

SEQ ID NO: 432320 - DNA, 25 bp, Rattus norvegicus
ggatctggacctatgtcatgtagtc

SEQ ID NO: 432321 - DNA, 25 bp, Rattus norvegicus
ggatctggacctttgtcatgtagtc

SEQ ID NO: 432322 - DNA, 25 bp, Rattus norvegicus
ggatctggactcaggccatcagact

SEQ ID NO: 432323 - DNA, 25 bp, Rattus norvegicus
ggatctggactctggccatcagact

SEQ ID NO: 432324 - DNA, 25 bp, Rattus norvegicus
ggatctggagcccacagaccaagac

SEQ ID NO: 432325 - DNA, 25 bp, Rattus norvegicus
ggatctggagccgacagaccaagac

SEQ ID NO: 432326 - DNA, 25 bp, Rattus norvegicus
ggatctggagctccttcagtcgtca

SEQ ID NO: 432327 - DNA, 25 bp, Rattus norvegicus
ggatctggagctgcttcagtcgtca

SEQ ID NO: 432328 - DNA, 25 bp, Rattus norvegicus
ggatctggcaccagagtcaacaagt

SEQ ID NO: 432329 - DNA, 25 bp, Rattus norvegicus
ggatctggcacctgagtcaacaagt

SEQ ID NO: 432330 - DNA, 25 bp, Rattus norvegicus
ggatctggccaaaatattacctctt

SEQ ID NO: 432331 - DNA, 25 bp, Rattus norvegicus
ggatctggccaatatattacctctt

SEQ ID NO: 432332 - DNA, 25 bp, Rattus norvegicus
ggatctggcgagagtgctgacacca

SEQ ID NO: 432333 - DNA, 25 bp, Rattus norvegicus
ggatctggcgagtgtgctgacacca

SEQ ID NO: 432334 - DNA, 25 bp, Rattus norvegicus
ggatctggctgcagctgaaaaagct

SEQ ID NO: 432335 - DNA, 25 bp, Rattus norvegicus
ggatctggctgctgctgaaaaagct

SEQ ID NO: 432336 - DNA, 25 bp, Rattus norvegicus
ggatctgggatcctggccacatcag

SEQ ID NO: 432337 - DNA, 25 bp, Rattus norvegicus
ggatctgggatcgtggccacatcag

SEQ ID NO: 432338 - DNA, 25 bp, Rattus norvegicus
ggatctgggcagaatcttccgctgg

SEQ ID NO: 432339 - DNA, 25 bp, Rattus norvegicus
ggatctgggcagtatcttccgctgg

SEQ ID NO: 432340 - DNA, 25 bp, Rattus norvegicus
ggatctgggcatccttctaacctgt

SEQ ID NO: 432341 - DNA, 25 bp, Rattus norvegicus
ggatctgggcatgcttctaacctgt

SEQ ID NO: 432342 - DNA, 25 bp, Rattus norvegicus
ggatctgggttgactggcctttgtc

SEQ ID NO: 432343 - DNA, 25 bp, Rattus norvegicus
ggatctgggttgtctggcctttgtc

SEQ ID NO: 432344 - DNA, 25 bp, Rattus norvegicus
ggatctggtaccataggcccctgtg

SEQ ID NO: 432345 - DNA, 25 bp, Rattus norvegicus
ggatctggtaccttaggcccctgtg

SEQ ID NO: 432346 - DNA, 25 bp, Rattus norvegicus
ggatctggtcttacctggcacagaa

SEQ ID NO: 432347 - DNA, 25 bp, Rattus norvegicus
ggatctggtctttcctggcacagaa

SEQ ID NO: 432348 - DNA, 25 bp, Rattus norvegicus
ggatctggtgagctacacacacccc

SEQ ID NO: 432349 - DNA, 25 bp, Rattus norvegicus
ggatctggtgaggtacacacacccc

SEQ ID NO: 432350 - DNA, 25 bp, Rattus norvegicus
ggatctggtgctagacagccttggc

SEQ ID NO: 432351 - DNA, 25 bp, Rattus norvegicus
ggatctggtgcttgacagccttggc

SEQ ID NO: 432352 - DNA, 25 bp, Rattus norvegicus
ggatctgtaatcacagctgcctgga

SEQ ID NO: 432353 - DNA, 25 bp, Rattus norvegicus
ggatctgtaatctcagctgcctgga

SEQ ID NO: 432354 - DNA, 25 bp, Rattus norvegicus
ggatctgtacttaatttccttataa

SEQ ID NO: 432355 - DNA, 25 bp, Rattus norvegicus
ggatctgtactttatttccttataa

SEQ ID NO: 432356 - DNA, 25 bp, Rattus norvegicus
ggatctgtcacaccgtgggacccag

SEQ ID NO: 432357 - DNA, 25 bp, Rattus norvegicus
ggatctgtcacagcgtgggacccag

SEQ ID NO: 432358 - DNA, 25 bp, Rattus norvegicus
ggatctgtcgttacttattactgtg

SEQ ID NO: 432359 - DNA, 25 bp, Rattus norvegicus
ggatctgtcgtttcttattactgtg

SEQ ID NO: 432360 - DNA, 25 bp, Rattus norvegicus
ggatctgtctgtagcggtcaagcca

SEQ ID NO: 432361 - DNA, 25 bp, Rattus norvegicus
ggatctgtctgttgcggtcaagcca

SEQ ID NO: 432362 - DNA, 25 bp, Rattus norvegicus
ggatctgtgagaatcttcttcagta

SEQ ID NO: 432363 - DNA, 25 bp, Rattus norvegicus
ggatctgtgagattcttcttcagta

SEQ ID NO: 432364 - DNA, 25 bp, Rattus norvegicus
ggatctgtgatgacttgcacttccc

SEQ ID NO: 432365 - DNA, 25 bp, Rattus norvegicus
ggatctgtgatgtcttgcacttccc

SEQ ID NO: 432366 - DNA, 25 bp, Rattus norvegicus
ggatctgtgcagaaggtgccctgtt

SEQ ID NO: 432367 - DNA, 25 bp, Rattus norvegicus
ggatctgtgcagtaggtgccctgtt

SEQ ID NO: 432368 - DNA, 25 bp, Rattus norvegicus
ggatctgtgccacttgtgtcagaga

SEQ ID NO: 432369 - DNA, 25 bp, Rattus norvegicus
ggatctgtgccagttgtgtcagaga

SEQ ID NO: 432370 - DNA, 25 bp, Rattus norvegicus
ggatctgtggccagtcactaatgga

SEQ ID NO: 432371 - DNA, 25 bp, Rattus norvegicus
ggatctgtggcccaagaaaccttac

SEQ ID NO: 432372 - DNA, 25 bp, Rattus norvegicus
ggatctgtggccgaagaaaccttac

SEQ ID NO: 432373 - DNA, 25 bp, Rattus norvegicus
ggatctgtggcctgtcactaatgga

SEQ ID NO: 432374 - DNA, 25 bp, Rattus norvegicus
ggatctgtgggcatgtaaatatgtc

SEQ ID NO: 432375 - DNA, 25 bp, Rattus norvegicus
ggatctgtgggcttgtaaatatgtc

SEQ ID NO: 432376 - DNA, 25 bp, Rattus norvegicus
ggatctgtgggtaccaagtttctcc

SEQ ID NO: 432377 - DNA, 25 bp, Rattus norvegicus
ggatctgtgggttccaagtttctcc

SEQ ID NO: 432378 - DNA, 25 bp, Rattus norvegicus
ggatctgtgttcatgtttcctgtca

SEQ ID NO: 432379 - DNA, 25 bp, Rattus norvegicus
ggatctgtgttcttgtttcctgtca

SEQ ID NO: 432380 - DNA, 25 bp, Rattus norvegicus
ggatctgtgttgagtccaagcactt

SEQ ID NO: 432381 - DNA, 25 bp, Rattus norvegicus
ggatctgtgttgtgtccaagcactt

SEQ ID NO: 432382 - DNA, 25 bp, Rattus norvegicus
ggatctgttcatccctcttaagtag

SEQ ID NO: 432383 - DNA, 25 bp, Rattus norvegicus
ggatctgttcatgcctcttaagtag

SEQ ID NO: 432384 - DNA, 25 bp, Rattus norvegicus
ggatctgttcccactgcggtttggt

SEQ ID NO: 432385 - DNA, 25 bp, Rattus norvegicus
ggatctgttccctctgcggtttggt

SEQ ID NO: 432386 - DNA, 25 bp, Rattus norvegicus
ggatctgtttccaggtgcatggcat

SEQ ID NO: 432387 - DNA, 25 bp, Rattus norvegicus
ggatctgtttcctggtgcatggcat

SEQ ID NO: 432388 - DNA, 25 bp, Rattus norvegicus
ggatcttaaaaccactatgctgaat

SEQ ID NO: 432389 - DNA, 25 bp, Rattus norvegicus
ggatcttaaaacgactatgctgaat

SEQ ID NO: 432390 - DNA, 25 bp, Rattus norvegicus
ggatcttaaccgacactgtctgtct

SEQ ID NO: 432391 - DNA, 25 bp, Rattus norvegicus
ggatcttaaccgtcactgtctgtct

SEQ ID NO: 432392 - DNA, 25 bp, Rattus norvegicus
ggatcttaagagaccctcttctctt

SEQ ID NO: 432393 - DNA, 25 bp, Rattus norvegicus
ggatcttaagagtccctcttctctt

SEQ ID NO: 432394 - DNA, 25 bp, Rattus norvegicus
ggatcttaccaaacctgggatggtc

SEQ ID NO: 432395 - DNA, 25 bp, Rattus norvegicus
ggatcttaccaatcctgggatggtc

SEQ ID NO: 432396 - DNA, 25 bp, Rattus norvegicus
ggatcttactgtctatatctgtctg

SEQ ID NO: 432397 - DNA, 25 bp, Rattus norvegicus
ggatcttactgtgtatatctgtctg

SEQ ID NO: 432398 - DNA, 25 bp, Rattus norvegicus
ggatcttagcctagtcactggagct

SEQ ID NO: 432399 - DNA, 25 bp, Rattus norvegicus
ggatcttagccttgtcactggagct

SEQ ID NO: 432400 - DNA, 25 bp, Rattus norvegicus
ggatcttaggatcttcccgctgagg

SEQ ID NO: 432401 - DNA, 25 bp, Rattus norvegicus
ggatcttaggatgttcccgctgagg

SEQ ID NO: 432402 - DNA, 25 bp, Rattus norvegicus
ggatcttaggccagtggccctagga

SEQ ID NO: 432403 - DNA, 25 bp, Rattus norvegicus
ggatcttaggcctgtggccctagga

SEQ ID NO: 432404 - DNA, 25 bp, Rattus norvegicus
ggatcttaggctagattctttcctt

SEQ ID NO: 432405 - DNA, 25 bp, Rattus norvegicus
ggatcttaggcttgattctttcctt

SEQ ID NO: 432406 - DNA, 25 bp, Rattus norvegicus
ggatcttatcagcaccatagaccca

SEQ ID NO: 432407 - DNA, 25 bp, Rattus norvegicus
ggatcttatcaggaccatagaccca

SEQ ID NO: 432408 - DNA, 25 bp, Rattus norvegicus
ggatcttatcctattggttctcttt

SEQ ID NO: 432409 - DNA, 25 bp, Rattus norvegicus
ggatcttatccttttggttctcttt

SEQ ID NO: 432410 - DNA, 25 bp, Rattus norvegicus
ggatcttcaaagaaccaaagccttg

SEQ ID NO: 432411 - DNA, 25 bp, Rattus norvegicus
ggatcttcaaagtaccaaagccttg

SEQ ID NO: 432412 - DNA, 25 bp, Rattus norvegicus
ggatcttcacaaaagctccctgaca

SEQ ID NO: 432413 - DNA, 25 bp, Rattus norvegicus
ggatcttcacaatagctccctgaca

SEQ ID NO: 432414 - DNA, 25 bp, Rattus norvegicus
ggatcttcagtcctaagttggcaat

SEQ ID NO: 432415 - DNA, 25 bp, Rattus norvegicus
ggatcttcagtcgtaagttggcaat

SEQ ID NO: 432416 - DNA, 25 bp, Rattus norvegicus
ggatcttccatgatacaatcacaaa

SEQ ID NO: 432417 - DNA, 25 bp, Rattus norvegicus
ggatcttccatgttacaatcacaaa

SEQ ID NO: 432418 - DNA, 25 bp, Rattus norvegicus
ggatcttccattcgctcagcaattg

SEQ ID NO: 432419 - DNA, 25 bp, Rattus norvegicus
ggatcttccattggctcagcaattg

SEQ ID NO: 432420 - DNA, 25 bp, Rattus norvegicus
ggatcttccctcagtagatgtgacc

SEQ ID NO: 432421 - DNA, 25 bp, Rattus norvegicus
ggatcttccctctgtagatgtgacc

SEQ ID NO: 432422 - DNA, 25 bp, Rattus norvegicus
ggatcttccgttcgtttcaggagca

SEQ ID NO: 432423 - DNA, 25 bp, Rattus norvegicus
ggatcttccgttggtttcaggagca

SEQ ID NO: 432424 - DNA, 25 bp, Rattus norvegicus
ggatcttcctctaattgacagccta

SEQ ID NO: 432425 - DNA, 25 bp, Rattus norvegicus
ggatcttcctcttattgacagccta

SEQ ID NO: 432426 - DNA, 25 bp, Rattus norvegicus
ggatcttcgagacagcacccagctt

SEQ ID NO: 432427 - DNA, 25 bp, Rattus norvegicus
ggatcttcgagagagcacccagctt

SEQ ID NO: 432428 - DNA, 25 bp, Rattus norvegicus
ggatcttcggaaagatgagcacaca

SEQ ID NO: 432429 - DNA, 25 bp, Rattus norvegicus
ggatcttcggaatgatgagcacaca

SEQ ID NO: 432430 - DNA, 25 bp, Rattus norvegicus
ggatcttctattaagctcagactgg

SEQ ID NO: 432431 - DNA, 25 bp, Rattus norvegicus
ggatcttctatttagctcagactgg

SEQ ID NO: 432432 - DNA, 25 bp, Rattus norvegicus
ggatcttctcatctattcacttgta

SEQ ID NO: 432433 - DNA, 25 bp, Rattus norvegicus
ggatcttctcatgtattcacttgta

SEQ ID NO: 432434 - DNA, 25 bp, Rattus norvegicus
ggatcttctctgagtcaggcaccgg

SEQ ID NO: 432435 - DNA, 25 bp, Rattus norvegicus
ggatcttctctgtgtcaggcaccgg

SEQ ID NO: 432436 - DNA, 25 bp, Rattus norvegicus
ggatcttcttgtcgaggtcatggac

SEQ ID NO: 432437 - DNA, 25 bp, Rattus norvegicus
ggatcttcttgtggaggtcatggac

SEQ ID NO: 432438 - DNA, 25 bp, Rattus norvegicus
ggatcttgaggcctagtttctctct

SEQ ID NO: 432439 - DNA, 25 bp, Rattus norvegicus
ggatcttgaggcgtagtttctctct

SEQ ID NO: 432440 - DNA, 25 bp, Rattus norvegicus
ggatcttgatttataatccagcaag

SEQ ID NO: 432441 - DNA, 25 bp, Rattus norvegicus
ggatcttgatttttaatccagcaag

SEQ ID NO: 432442 - DNA, 25 bp, Rattus norvegicus
ggatcttgcaaaccagctctatgct

SEQ ID NO: 432443 - DNA, 25 bp, Rattus norvegicus
ggatcttgcaaagcagctctatgct

SEQ ID NO: 432444 - DNA, 25 bp, Rattus norvegicus
ggatcttgctacagttccattcaga

SEQ ID NO: 432445 - DNA, 25 bp, Rattus norvegicus
ggatcttgctactgttccattcaga

SEQ ID NO: 432446 - DNA, 25 bp, Rattus norvegicus
ggatcttggagaatttttgcacagt

SEQ ID NO: 432447 - DNA, 25 bp, Rattus norvegicus
ggatcttggagattttttgcacagt

SEQ ID NO: 432448 - DNA, 25 bp, Rattus norvegicus
ggatcttggatcagtgttggctcat

SEQ ID NO: 432449 - DNA, 25 bp, Rattus norvegicus
ggatcttggatctgtgttggctcat

SEQ ID NO: 432450 - DNA, 25 bp, Rattus norvegicus
ggatcttggcccaggaaatgcctca

SEQ ID NO: 432451 - DNA, 25 bp, Rattus norvegicus
ggatcttggccctggaaatgcctca

SEQ ID NO: 432452 - DNA, 25 bp, Rattus norvegicus
ggatcttgggcccataactcagaag

SEQ ID NO: 432453 - DNA, 25 bp, Rattus norvegicus
ggatcttgggccgataactcagaag

SEQ ID NO: 432454 - DNA, 25 bp, Rattus norvegicus
ggatcttgtacactaggagcccagt

SEQ ID NO: 432455 - DNA, 25 bp, Rattus norvegicus
ggatcttgtacagtaggagcccagt

SEQ ID NO: 432456 - DNA, 25 bp, Rattus norvegicus
ggatcttgtgtccaaagtctctaaa

SEQ ID NO: 432457 - DNA, 25 bp, Rattus norvegicus
ggatcttgtgtcgaaagtctctaaa

SEQ ID NO: 432458 - DNA, 25 bp, Rattus norvegicus
ggatctttacttacttgtttgccat

SEQ ID NO: 432459 - DNA, 25 bp, Rattus norvegicus
ggatctttactttcttgtttgccat

SEQ ID NO: 432460 - DNA, 25 bp, Rattus norvegicus
ggatctttagatacctggagcctca

SEQ ID NO: 432461 - DNA, 25 bp, Rattus norvegicus
ggatctttagattcctggagcctca

SEQ ID NO: 432462 - DNA, 25 bp, Rattus norvegicus
ggatctttccataagttctttgtga

SEQ ID NO: 432463 - DNA, 25 bp, Rattus norvegicus
ggatctttccattagttctttgtga

SEQ ID NO: 432464 - DNA, 25 bp, Rattus norvegicus
ggatctttctaactgtctatacgaa

SEQ ID NO: 432465 - DNA, 25 bp, Rattus norvegicus
ggatctttctaagtgtctatacgaa

SEQ ID NO: 432466 - DNA, 25 bp, Rattus norvegicus
ggatctttctgcactgtgggataag

SEQ ID NO: 432467 - DNA, 25 bp, Rattus norvegicus
ggatctttctgctctgtgggataag

SEQ ID NO: 432468 - DNA, 25 bp, Rattus norvegicus
ggatctttgaaacccatcagaggca

SEQ ID NO: 432469 - DNA, 25 bp, Rattus norvegicus
ggatctttgaaagccatcagaggca

SEQ ID NO: 432470 - DNA, 25 bp, Rattus norvegicus
ggatctttgatgcatccctccaaag

SEQ ID NO: 432471 - DNA, 25 bp, Rattus norvegicus
ggatctttgatggatccctccaaag

SEQ ID NO: 432472 - DNA, 25 bp, Rattus norvegicus
ggatctttgtgacctagtgaccacc

SEQ ID NO: 432473 - DNA, 25 bp, Rattus norvegicus
ggatctttgtgagctagtgaccacc

SEQ ID NO: 432474 - DNA, 25 bp, Rattus norvegicus
ggatcttttatcaccgagcactgct

SEQ ID NO: 432475 - DNA, 25 bp, Rattus norvegicus
ggatcttttatctccgagcactgct

SEQ ID NO: 432476 - DNA, 25 bp, Rattus norvegicus
ggatcttttcagctgaactcaagct

SEQ ID NO: 432477 - DNA, 25 bp, Rattus norvegicus
ggatcttttcaggtgaactcaagct

SEQ ID NO: 432478 - DNA, 25 bp, Rattus norvegicus
ggatcttttctgaagaatgcacata

SEQ ID NO: 432479 - DNA, 25 bp, Rattus norvegicus
ggatcttttctgtagaatgcacata

SEQ ID NO: 432480 - DNA, 25 bp, Rattus norvegicus
ggatcttttgcgcttcggttccctt

SEQ ID NO: 432481 - DNA, 25 bp, Rattus norvegicus
ggatcttttgcggttcggttccctt

SEQ ID NO: 432482 - DNA, 25 bp, Rattus norvegicus
ggatcttttgtgagacaaggccagc

SEQ ID NO: 432483 - DNA, 25 bp, Rattus norvegicus
ggatcttttgtgtgacaaggccagc

SEQ ID NO: 432484 - DNA, 25 bp, Rattus norvegicus
ggatctttttacctcagcatgcagt

SEQ ID NO: 432485 - DNA, 25 bp, Rattus norvegicus
ggatctttttacgtcagcatgcagt

SEQ ID NO: 432486 - DNA, 25 bp, Rattus norvegicus
ggatctttttcccaacagcttttgc

SEQ ID NO: 432487 - DNA, 25 bp, Rattus norvegicus
ggatctttttccgaacagcttttgc

SEQ ID NO: 432488 - DNA, 25 bp, Rattus norvegicus
ggatgaaaacccatccgggcctgat

SEQ ID NO: 432489 - DNA, 25 bp, Rattus norvegicus
ggatgaaaacccttccgggcctgat

SEQ ID NO: 432490 - DNA, 25 bp, Rattus norvegicus
ggatgaaaagatccccttagctgca

SEQ ID NO: 432491 - DNA, 25 bp, Rattus norvegicus
ggatgaaaagatgcccttagctgca

SEQ ID NO: 432492 - DNA, 25 bp, Rattus norvegicus
ggatgaaaagctctcttgggtctaa

SEQ ID NO: 432493 - DNA, 25 bp, Rattus norvegicus
ggatgaaaagctgtcttgggtctaa

SEQ ID NO: 432494 - DNA, 25 bp, Rattus norvegicus
ggatgaaaatgacctcttccccaga

SEQ ID NO: 432495 - DNA, 25 bp, Rattus norvegicus
ggatgaaaatgagctcttccccaga

SEQ ID NO: 432496 - DNA, 25 bp, Rattus norvegicus
ggatgaaaccacatggacacctgct

SEQ ID NO: 432497 - DNA, 25 bp, Rattus norvegicus
ggatgaaaccacttggacacctgct

SEQ ID NO: 432498 - DNA, 25 bp, Rattus norvegicus
ggatgaaaccagctttttaggcaaa

SEQ ID NO: 432499 - DNA, 25 bp, Rattus norvegicus
ggatgaaaccaggtttttaggcaaa

SEQ ID NO: 432500 - DNA, 25 bp, Rattus norvegicus
ggatgaaaccgaatggccttcttat

SEQ ID NO: 432501 - DNA, 25 bp, Rattus norvegicus
ggatgaaaccgattggccttcttat

SEQ ID NO: 432502 - DNA, 25 bp, Rattus norvegicus
ggatgaaagcaaaggccgttcctct

SEQ ID NO: 432503 - DNA, 25 bp, Rattus norvegicus
ggatgaaagcaatggccgttcctct

SEQ ID NO: 432504 - DNA, 25 bp, Rattus norvegicus
ggatgaaagctcatctttctccctg

SEQ ID NO: 432505 - DNA, 25 bp, Rattus norvegicus
ggatgaaagctcttctttctccctg

SEQ ID NO: 432506 - DNA, 25 bp, Rattus norvegicus
ggatgaaagtccagcccaagggcag

SEQ ID NO: 432507 - DNA, 25 bp, Rattus norvegicus
ggatgaaagtcctgcccaagggcag

SEQ ID NO: 432508 - DNA, 25 bp, Rattus norvegicus
ggatgaaataacatctttagatttt

SEQ ID NO: 432509 - DNA, 25 bp, Rattus norvegicus
ggatgaaataacttctttagatttt

SEQ ID NO: 432510 - DNA, 25 bp, Rattus norvegicus
ggatgaaatccaatctgccttagcc

SEQ ID NO: 432511 - DNA, 25 bp, Rattus norvegicus
ggatgaaatccattctgccttagcc

SEQ ID NO: 432512 - DNA, 25 bp, Rattus norvegicus
ggatgaaattcacacgttccaggaa

SEQ ID NO: 432513 - DNA, 25 bp, Rattus norvegicus
ggatgaaattcacgcgcctcatgcc

SEQ ID NO: 432514 - DNA, 25 bp, Rattus norvegicus
ggatgaaattcagacgttccaggaa

SEQ ID NO: 432515 - DNA, 25 bp, Rattus norvegicus
ggatgaaattcaggcgcctcatgcc

SEQ ID NO: 432516 - DNA, 25 bp, Rattus norvegicus
ggatgaacaagcctaccaagaggat

SEQ ID NO: 432517 - DNA, 25 bp, Rattus norvegicus
ggatgaacaagcgtaccaagaggat

SEQ ID NO: 432518 - DNA, 25 bp, Rattus norvegicus
ggatgaacatctcacgctggtagca

SEQ ID NO: 432519 - DNA, 25 bp, Rattus norvegicus
ggatgaacatctgacgctggtagca

SEQ ID NO: 432520 - DNA, 25 bp, Rattus norvegicus
ggatgaacctatatggctggcttta

SEQ ID NO: 432521 - DNA, 25 bp, Rattus norvegicus
ggatgaacctatttggctggcttta

SEQ ID NO: 432522 - DNA, 25 bp, Rattus norvegicus
ggatgaacctggcaaagtcttcaaa

SEQ ID NO: 432523 - DNA, 25 bp, Rattus norvegicus
ggatgaacctgggaaagtcttcaaa

SEQ ID NO: 432524 - DNA, 25 bp, Rattus norvegicus
ggatgaacgaccctctggagctctg

SEQ ID NO: 432525 - DNA, 25 bp, Rattus norvegicus
ggatgaacgaccgtctggagctctg

SEQ ID NO: 432526 - DNA, 25 bp, Rattus norvegicus
ggatgaacgcccacgtagctaagag

SEQ ID NO: 432527 - DNA, 25 bp, Rattus norvegicus
ggatgaacgccctcgtagctaagag

SEQ ID NO: 432528 - DNA, 25 bp, Rattus norvegicus
ggatgaactctcctgccggaagaaa

SEQ ID NO: 432529 - DNA, 25 bp, Rattus norvegicus
ggatgaactctcgtgccggaagaaa

SEQ ID NO: 432530 - DNA, 25 bp, Rattus norvegicus
ggatgaactggtagggaactgccca

SEQ ID NO: 432531 - DNA, 25 bp, Rattus norvegicus
ggatgaactggttgggaactgccca

SEQ ID NO: 432532 - DNA, 25 bp, Rattus norvegicus
ggatgaagaccgagtgccccagcat

SEQ ID NO: 432533 - DNA, 25 bp, Rattus norvegicus
ggatgaagaccgtgtgccccagcat

SEQ ID NO: 432534 - DNA, 25 bp, Rattus norvegicus
ggatgaagagctctctgcccagcgc

SEQ ID NO: 432535 - DNA, 25 bp, Rattus norvegicus
ggatgaagagctgtctgcccagcgc

SEQ ID NO: 432536 - DNA, 25 bp, Rattus norvegicus
ggatgaagccctccttagatacctc

SEQ ID NO: 432537 - DNA, 25 bp, Rattus norvegicus
ggatgaagccctctacaacaggcta

SEQ ID NO: 432538 - DNA, 25 bp, Rattus norvegicus
ggatgaagccctgcttagatacctc

SEQ ID NO: 432539 - DNA, 25 bp, Rattus norvegicus
ggatgaagccctgtacaacaggcta

SEQ ID NO: 432540 - DNA, 25 bp, Rattus norvegicus
ggatgaagcgcacgccagaaaacat

SEQ ID NO: 432541 - DNA, 25 bp, Rattus norvegicus
ggatgaagcgcaggccagaaaacat

SEQ ID NO: 432542 - DNA, 25 bp, Rattus norvegicus
ggatgaagctaaacgcacccttcct

SEQ ID NO: 432543 - DNA, 25 bp, Rattus norvegicus
ggatgaagctaatcgcacccttcct

SEQ ID NO: 432544 - DNA, 25 bp, Rattus norvegicus
ggatgaaggagcagactggctcaat

SEQ ID NO: 432545 - DNA, 25 bp, Rattus norvegicus
ggatgaaggagctgactggctcaat

SEQ ID NO: 432546 - DNA, 25 bp, Rattus norvegicus
ggatgaagggccaagcacccagatt

SEQ ID NO: 432547 - DNA, 25 bp, Rattus norvegicus
ggatgaagggcctagcacccagatt

SEQ ID NO: 432548 - DNA, 25 bp, Rattus norvegicus
ggatgaaggtgtccatgcccaccga

SEQ ID NO: 432549 - DNA, 25 bp, Rattus norvegicus
ggatgaaggtgtgcatgcccaccga

SEQ ID NO: 432550 - DNA, 25 bp, Rattus norvegicus
ggatgaagtcagcatgttcgccatg

SEQ ID NO: 432551 - DNA, 25 bp, Rattus norvegicus
ggatgaagtcaggatgttcgccatg

SEQ ID NO: 432552 - DNA, 25 bp, Rattus norvegicus
ggatgaatattaacgcggaagcctt

SEQ ID NO: 432553 - DNA, 25 bp, Rattus norvegicus
ggatgaatattatcgcggaagcctt

SEQ ID NO: 432554 - DNA, 25 bp, Rattus norvegicus
ggatgaatcattatcctcagggtct

SEQ ID NO: 432555 - DNA, 25 bp, Rattus norvegicus
ggatgaatcattttcctcagggtct

SEQ ID NO: 432556 - DNA, 25 bp, Rattus norvegicus
ggatgaatcccactgttaaaacaaa

SEQ ID NO: 432557 - DNA, 25 bp, Rattus norvegicus
ggatgaatcccagtgttaaaacaaa

SEQ ID NO: 432558 - DNA, 25 bp, Rattus norvegicus
ggatgaatcgtccagccaaatttat

SEQ ID NO: 432559 - DNA, 25 bp, Rattus norvegicus
ggatgaatcgtcgagccaaatttat

SEQ ID NO: 432560 - DNA, 25 bp, Rattus norvegicus
ggatgaatctatctgcagggaacgc

SEQ ID NO: 432561 - DNA, 25 bp, Rattus norvegicus
ggatgaatctatgtgcagggaacgc

SEQ ID NO: 432562 - DNA, 25 bp, Rattus norvegicus
ggatgaatggaaaacctttcttctt

SEQ ID NO: 432563 - DNA, 25 bp, Rattus norvegicus
ggatgaatggaatacctttcttctt

SEQ ID NO: 432564 - DNA, 25 bp, Rattus norvegicus
ggatgaattagtccaccccaatgaa

SEQ ID NO: 432565 - DNA, 25 bp, Rattus norvegicus
ggatgaattagtgcaccccaatgaa

SEQ ID NO: 432566 - DNA, 25 bp, Rattus norvegicus
ggatgaattcaacaaccacggactg

SEQ ID NO: 432567 - DNA, 25 bp, Rattus norvegicus
ggatgaattcaagaaccacggactg

SEQ ID NO: 432568 - DNA, 25 bp, Rattus norvegicus
ggatgaattcatcagccttctgcac

SEQ ID NO: 432569 - DNA, 25 bp, Rattus norvegicus
ggatgaattcatgagccttctgcac

SEQ ID NO: 432570 - DNA, 25 bp, Rattus norvegicus
ggatgaattccacagagcaacagct

SEQ ID NO: 432571 - DNA, 25 bp, Rattus norvegicus
ggatgaattccagagagcaacagct

SEQ ID NO: 432572 - DNA, 25 bp, Rattus norvegicus
ggatgacaaaatatgccttatggaa

SEQ ID NO: 432573 - DNA, 25 bp, Rattus norvegicus
ggatgacaaaatttgccttatggaa

SEQ ID NO: 432574 - DNA, 25 bp, Rattus norvegicus
ggatgacaaagaccccaatgacccc

SEQ ID NO: 432575 - DNA, 25 bp, Rattus norvegicus
ggatgacaaagagcccaatgacccc

SEQ ID NO: 432576 - DNA, 25 bp, Rattus norvegicus
ggatgacacacaacaacttcattag

SEQ ID NO: 432577 - DNA, 25 bp, Rattus norvegicus
ggatgacacacatcaacttcattag

SEQ ID NO: 432578 - DNA, 25 bp, Rattus norvegicus
ggatgacacatacaaacctacgaag

SEQ ID NO: 432579 - DNA, 25 bp, Rattus norvegicus
ggatgacacatagaaacctacgaag

SEQ ID NO: 432580 - DNA, 25 bp, Rattus norvegicus
ggatgacacatgcacaggacactgg

SEQ ID NO: 432581 - DNA, 25 bp, Rattus norvegicus
ggatgacacatggacaggacactgg

SEQ ID NO: 432582 - DNA, 25 bp, Rattus norvegicus
ggatgacaccagcacagcgaggcaa

SEQ ID NO: 432583 - DNA, 25 bp, Rattus norvegicus
ggatgacaccaggacagcgaggcaa

SEQ ID NO: 432584 - DNA, 25 bp, Rattus norvegicus
ggatgacaccatagtccccatagga

SEQ ID NO: 432585 - DNA, 25 bp, Rattus norvegicus
ggatgacaccatcctgacgtgacaa

SEQ ID NO: 432586 - DNA, 25 bp, Rattus norvegicus
ggatgacaccatgctgacgtgacaa

SEQ ID NO: 432587 - DNA, 25 bp, Rattus norvegicus
ggatgacaccattgtccccatagga

SEQ ID NO: 432588 - DNA, 25 bp, Rattus norvegicus
ggatgacactaccatccctgatttt

SEQ ID NO: 432589 - DNA, 25 bp, Rattus norvegicus
ggatgacactacgatccctgatttt

SEQ ID NO: 432590 - DNA, 25 bp, Rattus norvegicus
ggatgacactgtcactgcttttcag

SEQ ID NO: 432591 - DNA, 25 bp, Rattus norvegicus
ggatgacactgtgactgcttttcag

SEQ ID NO: 432592 - DNA, 25 bp, Rattus norvegicus
ggatgacacttaagactctctcctc

SEQ ID NO: 432593 - DNA, 25 bp, Rattus norvegicus
ggatgacacttatgactctctcctc

SEQ ID NO: 432594 - DNA, 25 bp, Rattus norvegicus
ggatgacagatactggtcccatctc

SEQ ID NO: 432595 - DNA, 25 bp, Rattus norvegicus
ggatgacagatagtggtcccatctc

SEQ ID NO: 432596 - DNA, 25 bp, Rattus norvegicus
ggatgacagccccatatccccgcgg

SEQ ID NO: 432597 - DNA, 25 bp, Rattus norvegicus
ggatgacagcccgatatccccgcgg

SEQ ID NO: 432598 - DNA, 25 bp, Rattus norvegicus
ggatgacatcagattttcacttcca

SEQ ID NO: 432599 - DNA, 25 bp, Rattus norvegicus
ggatgacatcagtttttcacttcca

SEQ ID NO: 432600 - DNA, 25 bp, Rattus norvegicus
ggatgacatcatcagtctcccacag

SEQ ID NO: 432601 - DNA, 25 bp, Rattus norvegicus
ggatgacatcatgagtctcccacag

SEQ ID NO: 432602 - DNA, 25 bp, Rattus norvegicus
ggatgacatgctactctctgataag

SEQ ID NO: 432603 - DNA, 25 bp, Rattus norvegicus
ggatgacatgcttctctctgataag

SEQ ID NO: 432604 - DNA, 25 bp, Rattus norvegicus
ggatgacatggcagtagatagtgat

SEQ ID NO: 432605 - DNA, 25 bp, Rattus norvegicus
ggatgacatggctgtagatagtgat

SEQ ID NO: 432606 - DNA, 25 bp, Rattus norvegicus
ggatgaccaaatcgcccaggttgtt

SEQ ID NO: 432607 - DNA, 25 bp, Rattus norvegicus
ggatgaccaaatggcccaggttgtt

SEQ ID NO: 432608 - DNA, 25 bp, Rattus norvegicus
ggatgaccacagctacatcttcacg

SEQ ID NO: 432609 - DNA, 25 bp, Rattus norvegicus
ggatgaccacaggtacatcttcacg

SEQ ID NO: 432610 - DNA, 25 bp, Rattus norvegicus
ggatgaccagctcagggcactgctt

SEQ ID NO: 432611 - DNA, 25 bp, Rattus norvegicus
ggatgaccagctgagggcactgctt

SEQ ID NO: 432612 - DNA, 25 bp, Rattus norvegicus
ggatgaccaggcatttgtggcctat

SEQ ID NO: 432613 - DNA, 25 bp, Rattus norvegicus
ggatgaccaggcttttgtggcctat

SEQ ID NO: 432614 - DNA, 25 bp, Rattus norvegicus
ggatgacccatacaaccacaaattt

SEQ ID NO: 432615 - DNA, 25 bp, Rattus norvegicus
ggatgacccatagaaccacaaattt

SEQ ID NO: 432616 - DNA, 25 bp, Rattus norvegicus
ggatgaccccacaggaaacttccga

SEQ ID NO: 432617 - DNA, 25 bp, Rattus norvegicus
ggatgaccccactggaaacttccga

SEQ ID NO: 432618 - DNA, 25 bp, Rattus norvegicus
ggatgaccgctcctttcattctgga

SEQ ID NO: 432619 - DNA, 25 bp, Rattus norvegicus
ggatgaccgctcgtttcattctgga

SEQ ID NO: 432620 - DNA, 25 bp, Rattus norvegicus
ggatgacctctaagacccggacgat

SEQ ID NO: 432621 - DNA, 25 bp, Rattus norvegicus
ggatgacctctatgacccggacgat

SEQ ID NO: 432622 - DNA, 25 bp, Rattus norvegicus
ggatgacctcttcccgaatgatgag

SEQ ID NO: 432623 - DNA, 25 bp, Rattus norvegicus
ggatgacctcttccgtaagaccaag

SEQ ID NO: 432624 - DNA, 25 bp, Rattus norvegicus
ggatgacctcttgccgaatgatgag

SEQ ID NO: 432625 - DNA, 25 bp, Rattus norvegicus
ggatgacctcttgcgtaagaccaag

SEQ ID NO: 432626 - DNA, 25 bp, Rattus norvegicus
ggatgacctggaacatactctatac

SEQ ID NO: 432627 - DNA, 25 bp, Rattus norvegicus
ggatgacctggatcatactctatac

SEQ ID NO: 432628 - DNA, 25 bp, Rattus norvegicus
ggatgacctgtacgcgacaaagaca

SEQ ID NO: 432629 - DNA, 25 bp, Rattus norvegicus
ggatgacctgtaggcgacaaagaca

SEQ ID NO: 432630 - DNA, 25 bp, Rattus norvegicus
ggatgaccttagaaagctggtccag

SEQ ID NO: 432631 - DNA, 25 bp, Rattus norvegicus
ggatgaccttagtaagctggtccag

SEQ ID NO: 432632 - DNA, 25 bp, Rattus norvegicus
ggatgacgaagaacctttcaaccct

SEQ ID NO: 432633 - DNA, 25 bp, Rattus norvegicus
ggatgacgaagatcctttcaaccct

SEQ ID NO: 432634 - DNA, 25 bp, Rattus norvegicus
ggatgacgatgtccttctgtgccaa

SEQ ID NO: 432635 - DNA, 25 bp, Rattus norvegicus
ggatgacgatgtgcttctgtgccaa

SEQ ID NO: 432636 - DNA, 25 bp, Rattus norvegicus
ggatgacgctctcgcgcgcgggcgt

SEQ ID NO: 432637 - DNA, 25 bp, Rattus norvegicus
ggatgacgctctggcgcgcgggcgt

SEQ ID NO: 432638 - DNA, 25 bp, Rattus norvegicus
ggatgactaaaccacggcacctctg

SEQ ID NO: 432639 - DNA, 25 bp, Rattus norvegicus
ggatgactaaacgacggcacctctg

SEQ ID NO: 432640 - DNA, 25 bp, Rattus norvegicus
ggatgactaacgaggcactgcacaa

SEQ ID NO: 432641 - DNA, 25 bp, Rattus norvegicus
ggatgactaacgtggcactgcacaa

SEQ ID NO: 432642 - DNA, 25 bp, Rattus norvegicus
ggatgactactgagtacctgccgct

SEQ ID NO: 432643 - DNA, 25 bp, Rattus norvegicus
ggatgactactgtgtacctgccgct

SEQ ID NO: 432644 - DNA, 25 bp, Rattus norvegicus
ggatgactagttctctctctacttc

SEQ ID NO: 432645 - DNA, 25 bp, Rattus norvegicus
ggatgactagttgtctctctacttc

SEQ ID NO: 432646 - DNA, 25 bp, Rattus norvegicus
ggatgactatgacccctacgcggtg

SEQ ID NO: 432647 - DNA, 25 bp, Rattus norvegicus
ggatgactatgagccctacgcggtg

SEQ ID NO: 432648 - DNA, 25 bp, Rattus norvegicus
ggatgactcaaactctggcttgggc

SEQ ID NO: 432649 - DNA, 25 bp, Rattus norvegicus
ggatgactcaaagtctggcttgggc

SEQ ID NO: 432650 - DNA, 25 bp, Rattus norvegicus
ggatgactcagaatggtaccaggtg

SEQ ID NO: 432651 - DNA, 25 bp, Rattus norvegicus
ggatgactcagattggtaccaggtg

SEQ ID NO: 432652 - DNA, 25 bp, Rattus norvegicus
ggatgactccacagttactaactct

SEQ ID NO: 432653 - DNA, 25 bp, Rattus norvegicus
ggatgactccactgttactaactct

SEQ ID NO: 432654 - DNA, 25 bp, Rattus norvegicus
ggatgactcctgatttcttggacat

SEQ ID NO: 432655 - DNA, 25 bp, Rattus norvegicus
ggatgactcctgttttcttggacat

SEQ ID NO: 432656 - DNA, 25 bp, Rattus norvegicus
ggatgactctggctcagtcttctgt

SEQ ID NO: 432657 - DNA, 25 bp, Rattus norvegicus
ggatgactctgggtcagtcttctgt

SEQ ID NO: 432658 - DNA, 25 bp, Rattus norvegicus
ggatgactctgtccgcttctgcaga

SEQ ID NO: 432659 - DNA, 25 bp, Rattus norvegicus
ggatgactctgtgcgcttctgcaga

SEQ ID NO: 432660 - DNA, 25 bp, Rattus norvegicus
ggatgactcttgagcttctagtaga

SEQ ID NO: 432661 - DNA, 25 bp, Rattus norvegicus
ggatgactcttgtgcttctagtaga

SEQ ID NO: 432662 - DNA, 25 bp, Rattus norvegicus
ggatgactgaagcacagactgtgaa

SEQ ID NO: 432663 - DNA, 25 bp, Rattus norvegicus
ggatgactgaaggacagactgtgaa

SEQ ID NO: 432664 - DNA, 25 bp, Rattus norvegicus
ggatgactgagcctcaaaggcccaa

SEQ ID NO: 432665 - DNA, 25 bp, Rattus norvegicus
ggatgactgagcgtcaaaggcccaa

SEQ ID NO: 432666 - DNA, 25 bp, Rattus norvegicus
ggatgactgcctcgaaagctgtctt

SEQ ID NO: 432667 - DNA, 25 bp, Rattus norvegicus
ggatgactgcctggaaagctgtctt

SEQ ID NO: 432668 - DNA, 25 bp, Rattus norvegicus
ggatgactggctatatattcaccaa

SEQ ID NO: 432669 - DNA, 25 bp, Rattus norvegicus
ggatgactggctttatattcaccaa

SEQ ID NO: 432670 - DNA, 25 bp, Rattus norvegicus
ggatgactgtggaacattccataga

SEQ ID NO: 432671 - DNA, 25 bp, Rattus norvegicus
ggatgactgtggtacattccataga

SEQ ID NO: 432672 - DNA, 25 bp, Rattus norvegicus
ggatgactgtgtcttacagcctgta

SEQ ID NO: 432673 - DNA, 25 bp, Rattus norvegicus
ggatgactgtgtgttacagcctgta

SEQ ID NO: 432674 - DNA, 25 bp, Rattus norvegicus
ggatgacttaacacagcaacacttg

SEQ ID NO: 432675 - DNA, 25 bp, Rattus norvegicus
ggatgacttaactcagcaacacttg

SEQ ID NO: 432676 - DNA, 25 bp, Rattus norvegicus
ggatgacttcctcaactggcacgtc

SEQ ID NO: 432677 - DNA, 25 bp, Rattus norvegicus
ggatgacttcctgaactggcacgtc

SEQ ID NO: 432678 - DNA, 25 bp, Rattus norvegicus
ggatgacttctaacatctgacacaa

SEQ ID NO: 432679 - DNA, 25 bp, Rattus norvegicus
ggatgacttctacactgccacggaa

SEQ ID NO: 432680 - DNA, 25 bp, Rattus norvegicus
ggatgacttctagactgccacggaa

SEQ ID NO: 432681 - DNA, 25 bp, Rattus norvegicus
ggatgacttctatcatctgacacaa

SEQ ID NO: 432682 - DNA, 25 bp, Rattus norvegicus
ggatgactttgtccctctgtaacca

SEQ ID NO: 432683 - DNA, 25 bp, Rattus norvegicus
ggatgactttgtgcctctgtaacca

SEQ ID NO: 432684 - DNA, 25 bp, Rattus norvegicus
ggatgagaaagtcaggcccgcatat

SEQ ID NO: 432685 - DNA, 25 bp, Rattus norvegicus
ggatgagaaagtgaggcccgcatat

SEQ ID NO: 432686 - DNA, 25 bp, Rattus norvegicus
ggatgagaaatcactagctagcctc

SEQ ID NO: 432687 - DNA, 25 bp, Rattus norvegicus
ggatgagaaatctctagctagcctc

SEQ ID NO: 432688 - DNA, 25 bp, Rattus norvegicus
ggatgagacagactctttcagctaa

SEQ ID NO: 432689 - DNA, 25 bp, Rattus norvegicus
ggatgagacagagtctttcagctaa

SEQ ID NO: 432690 - DNA, 25 bp, Rattus norvegicus
ggatgagaccctatcaaatctggaa

SEQ ID NO: 432691 - DNA, 25 bp, Rattus norvegicus
ggatgagaccctttcaaatctggaa

SEQ ID NO: 432692 - DNA, 25 bp, Rattus norvegicus
ggatgagaccttacctaggttgcct

SEQ ID NO: 432693 - DNA, 25 bp, Rattus norvegicus
ggatgagaccttcgcatgtagtaca

SEQ ID NO: 432694 - DNA, 25 bp, Rattus norvegicus
ggatgagaccttggcatgtagtaca

SEQ ID NO: 432695 - DNA, 25 bp, Rattus norvegicus
ggatgagacctttcctaggttgcct

SEQ ID NO: 432696 - DNA, 25 bp, Rattus norvegicus
ggatgagactggcaccgtatcgttc

SEQ ID NO: 432697 - DNA, 25 bp, Rattus norvegicus
ggatgagactgggaccgtatcgttc

SEQ ID NO: 432698 - DNA, 25 bp, Rattus norvegicus
ggatgagagaaaacaccccggattt

SEQ ID NO: 432699 - DNA, 25 bp, Rattus norvegicus
ggatgagagaaatcaccccggattt

SEQ ID NO: 432700 - DNA, 25 bp, Rattus norvegicus
ggatgagagctgcactgatgtatca

SEQ ID NO: 432701 - DNA, 25 bp, Rattus norvegicus
ggatgagagctggactgatgtatca

SEQ ID NO: 432702 - DNA, 25 bp, Rattus norvegicus
ggatgagataaccacatgccctggg

SEQ ID NO: 432703 - DNA, 25 bp, Rattus norvegicus
ggatgagataacgacatgccctggg

SEQ ID NO: 432704 - DNA, 25 bp, Rattus norvegicus
ggatgagattctacaactctgggaa

SEQ ID NO: 432705 - DNA, 25 bp, Rattus norvegicus
ggatgagattcttcaactctgggaa

SEQ ID NO: 432706 - DNA, 25 bp, Rattus norvegicus
ggatgagcaccaatttcgtctgcat

SEQ ID NO: 432707 - DNA, 25 bp, Rattus norvegicus
ggatgagcaccattttcgtctgcat

SEQ ID NO: 432708 - DNA, 25 bp, Rattus norvegicus
ggatgagcagaaagacaccagtttt

SEQ ID NO: 432709 - DNA, 25 bp, Rattus norvegicus
ggatgagcagaatgacaccagtttt

SEQ ID NO: 432710 - DNA, 25 bp, Rattus norvegicus
ggatgagcagccctttgcaaagcag

SEQ ID NO: 432711 - DNA, 25 bp, Rattus norvegicus
ggatgagcagccgtttgcaaagcag

SEQ ID NO: 432712 - DNA, 25 bp, Rattus norvegicus
ggatgagcaggaagaccaaacacgt

SEQ ID NO: 432713 - DNA, 25 bp, Rattus norvegicus
ggatgagcaggatgaccaaacacgt

SEQ ID NO: 432714 - DNA, 25 bp, Rattus norvegicus
ggatgagccaagcagacctggtctt

SEQ ID NO: 432715 - DNA, 25 bp, Rattus norvegicus
ggatgagccaaggagacctggtctt

SEQ ID NO: 432716 - DNA, 25 bp, Rattus norvegicus
ggatgagcccaactggattttagaa

SEQ ID NO: 432717 - DNA, 25 bp, Rattus norvegicus
ggatgagcccaagtggattttagaa

SEQ ID NO: 432718 - DNA, 25 bp, Rattus norvegicus
ggatgagccccaagaacctcaagag

SEQ ID NO: 432719 - DNA, 25 bp, Rattus norvegicus
ggatgagccccatgaacctcaagag

SEQ ID NO: 432720 - DNA, 25 bp, Rattus norvegicus
ggatgagccccgaaggacacactac

SEQ ID NO: 432721 - DNA, 25 bp, Rattus norvegicus
ggatgagccccgtaggacacactac

SEQ ID NO: 432722 - DNA, 25 bp, Rattus norvegicus
ggatgagccttcattgtgagcatgc

SEQ ID NO: 432723 - DNA, 25 bp, Rattus norvegicus
ggatgagccttctttgtgagcatgc

SEQ ID NO: 432724 - DNA, 25 bp, Rattus norvegicus
ggatgagcggaaactcctgggccaa

SEQ ID NO: 432725 - DNA, 25 bp, Rattus norvegicus
ggatgagcggaatctcctgggccaa

SEQ ID NO: 432726 - DNA, 25 bp, Rattus norvegicus
ggatgagctgaaaacctatcaccaa

SEQ ID NO: 432727 - DNA, 25 bp, Rattus norvegicus
ggatgagctgaatacctatcaccaa

SEQ ID NO: 432728 - DNA, 25 bp, Rattus norvegicus
ggatgagctgccatgctcactgaag

SEQ ID NO: 432729 - DNA, 25 bp, Rattus norvegicus
ggatgagctgccttgctcactgaag

SEQ ID NO: 432730 - DNA, 25 bp, Rattus norvegicus
ggatgagctgtacaggccacaccac

SEQ ID NO: 432731 - DNA, 25 bp, Rattus norvegicus
ggatgagctgtagaggccacaccac

SEQ ID NO: 432732 - DNA, 25 bp, Rattus norvegicus
ggatgagcttccataagcccatacc

SEQ ID NO: 432733 - DNA, 25 bp, Rattus norvegicus
ggatgagcttccttaagcccatacc

SEQ ID NO: 432734 - DNA, 25 bp, Rattus norvegicus
ggatgagctttaatcccctcagctg

SEQ ID NO: 432735 - DNA, 25 bp, Rattus norvegicus
ggatgagctttattcccctcagctg

SEQ ID NO: 432736 - DNA, 25 bp, Rattus norvegicus
ggatgaggaacaagcctactcaccc

SEQ ID NO: 432737 - DNA, 25 bp, Rattus norvegicus
ggatgaggaacatgcctactcaccc

SEQ ID NO: 432738 - DNA, 25 bp, Rattus norvegicus
ggatgaggacttcccgatttgctct

SEQ ID NO: 432739 - DNA, 25 bp, Rattus norvegicus
ggatgaggacttgccgatttgctct

SEQ ID NO: 432740 - DNA, 25 bp, Rattus norvegicus
ggatgaggataaaccggctgcactt

SEQ ID NO: 432741 - DNA, 25 bp, Rattus norvegicus
ggatgaggataatccggctgcactt

SEQ ID NO: 432742 - DNA, 25 bp, Rattus norvegicus
ggatgaggattccagccttgctgtc

SEQ ID NO: 432743 - DNA, 25 bp, Rattus norvegicus
ggatgaggattcgagccttgctgtc

SEQ ID NO: 432744 - DNA, 25 bp, Rattus norvegicus
ggatgaggcacacacagcatttcct

SEQ ID NO: 432745 - DNA, 25 bp, Rattus norvegicus
ggatgaggcacagacagcatttcct

SEQ ID NO: 432746 - DNA, 25 bp, Rattus norvegicus
ggatgaggcgtgaacaccaacctct

SEQ ID NO: 432747 - DNA, 25 bp, Rattus norvegicus
ggatgaggcgtgtacaccaacctct

SEQ ID NO: 432748 - DNA, 25 bp, Rattus norvegicus
ggatgaggctatcctgacgtcctct

SEQ ID NO: 432749 - DNA, 25 bp, Rattus norvegicus
ggatgaggctatgctgacgtcctct

SEQ ID NO: 432750 - DNA, 25 bp, Rattus norvegicus
ggatgaggtggcagcattgctccat

SEQ ID NO: 432751 - DNA, 25 bp, Rattus norvegicus
ggatgaggtggctgcattgctccat

SEQ ID NO: 432752 - DNA, 25 bp, Rattus norvegicus
ggatgagtaccacttctgcttccag

SEQ ID NO: 432753 - DNA, 25 bp, Rattus norvegicus
ggatgagtaccagttctgcttccag

SEQ ID NO: 432754 - DNA, 25 bp, Rattus norvegicus
ggatgagtcaagctcctcacactgt

SEQ ID NO: 432755 - DNA, 25 bp, Rattus norvegicus
ggatgagtcaaggtcctcacactgt

SEQ ID NO: 432756 - DNA, 25 bp, Rattus norvegicus
ggatgagtcctgagttcgtttcccc

SEQ ID NO: 432757 - DNA, 25 bp, Rattus norvegicus
ggatgagtcctgtgttcgtttcccc

SEQ ID NO: 432758 - DNA, 25 bp, Rattus norvegicus
ggatgagtctccaaggcacctgtca

SEQ ID NO: 432759 - DNA, 25 bp, Rattus norvegicus
ggatgagtctcctaggcacctgtca

SEQ ID NO: 432760 - DNA, 25 bp, Rattus norvegicus
ggatgagttcttacccacgtgacat

SEQ ID NO: 432761 - DNA, 25 bp, Rattus norvegicus
ggatgagttctttcccacgtgacat

SEQ ID NO: 432762 - DNA, 25 bp, Rattus norvegicus
ggatgagttgcaccctataaaccag

SEQ ID NO: 432763 - DNA, 25 bp, Rattus norvegicus
ggatgagttgcagcctataaaccag

SEQ ID NO: 432764 - DNA, 25 bp, Rattus norvegicus
ggatgataaactctccaccgaggaa

SEQ ID NO: 432765 - DNA, 25 bp, Rattus norvegicus
ggatgataaactgtccaccgaggaa

SEQ ID NO: 432766 - DNA, 25 bp, Rattus norvegicus
ggatgataccagagctgctgtaact

SEQ ID NO: 432767 - DNA, 25 bp, Rattus norvegicus
ggatgataccagtgctgctgtaact

SEQ ID NO: 432768 - DNA, 25 bp, Rattus norvegicus
ggatgatatcccattcagtctggaa

SEQ ID NO: 432769 - DNA, 25 bp, Rattus norvegicus
ggatgatatccctttcagtctggaa

SEQ ID NO: 432770 - DNA, 25 bp, Rattus norvegicus
ggatgatcacagaaagagctcggga

SEQ ID NO: 432771 - DNA, 25 bp, Rattus norvegicus
ggatgatcacagtaagagctcggga

SEQ ID NO: 432772 - DNA, 25 bp, Rattus norvegicus
ggatgatcacggacgtgcagctcgc

SEQ ID NO: 432773 - DNA, 25 bp, Rattus norvegicus
ggatgatcacggtcgtgcagctcgc

SEQ ID NO: 432774 - DNA, 25 bp, Rattus norvegicus
ggatgatcagtccggggcgctgcat

SEQ ID NO: 432775 - DNA, 25 bp, Rattus norvegicus
ggatgatcagtcgggggcgctgcat

SEQ ID NO: 432776 - DNA, 25 bp, Rattus norvegicus
ggatgatcccatactttgtaccatg

SEQ ID NO: 432777 - DNA, 25 bp, Rattus norvegicus
ggatgatcccattctttgtaccatg

SEQ ID NO: 432778 - DNA, 25 bp, Rattus norvegicus
ggatgatccgttagtatgccgccat

SEQ ID NO: 432779 - DNA, 25 bp, Rattus norvegicus
ggatgatccgtttgtatgccgccat

SEQ ID NO: 432780 - DNA, 25 bp, Rattus norvegicus
ggatgatcctggagccaaggcaatt

SEQ ID NO: 432781 - DNA, 25 bp, Rattus norvegicus
ggatgatcctggtgccaaggcaatt

SEQ ID NO: 432782 - DNA, 25 bp, Rattus norvegicus
ggatgatcggctcgtgatgcacaac

SEQ ID NO: 432783 - DNA, 25 bp, Rattus norvegicus
ggatgatcggctggtgatgcacaac

SEQ ID NO: 432784 - DNA, 25 bp, Rattus norvegicus
ggatgatctaacacaggaggacctg

SEQ ID NO: 432785 - DNA, 25 bp, Rattus norvegicus
ggatgatctaactcaggaggacctg

SEQ ID NO: 432786 - DNA, 25 bp, Rattus norvegicus
ggatgatctggaccgtaacaaggat

SEQ ID NO: 432787 - DNA, 25 bp, Rattus norvegicus
ggatgatctggagcgtaacaaggat

SEQ ID NO: 432788 - DNA, 25 bp, Rattus norvegicus
ggatgatcttccaggagctgaactt

SEQ ID NO: 432789 - DNA, 25 bp, Rattus norvegicus
ggatgatcttcctggagctgaactt

SEQ ID NO: 432790 - DNA, 25 bp, Rattus norvegicus
ggatgatgacagcataggcccctca

SEQ ID NO: 432791 - DNA, 25 bp, Rattus norvegicus
ggatgatgacaggataggcccctca

SEQ ID NO: 432792 - DNA, 25 bp, Rattus norvegicus
ggatgatgacgccaagtacacctgc

SEQ ID NO: 432793 - DNA, 25 bp, Rattus norvegicus
ggatgatgacgcgaagtacacctgc

SEQ ID NO: 432794 - DNA, 25 bp, Rattus norvegicus
ggatgatgacgtaccagatcttgta

SEQ ID NO: 432795 - DNA, 25 bp, Rattus norvegicus
ggatgatgacgttccagatcttgta

SEQ ID NO: 432796 - DNA, 25 bp, Rattus norvegicus
ggatgatgacttcctttatttacct

SEQ ID NO: 432797 - DNA, 25 bp, Rattus norvegicus
ggatgatgacttgctttatttacct

SEQ ID NO: 432798 - DNA, 25 bp, Rattus norvegicus
ggatgatgagtgacccagcacctcc

SEQ ID NO: 432799 - DNA, 25 bp, Rattus norvegicus
ggatgatgagtgtcccagcacctcc

SEQ ID NO: 432800 - DNA, 25 bp, Rattus norvegicus
ggatgatgatcccagactgccagcg

SEQ ID NO: 432801 - DNA, 25 bp, Rattus norvegicus
ggatgatgatccgagactgccagcg

SEQ ID NO: 432802 - DNA, 25 bp, Rattus norvegicus
ggatgatgatgacaccttctccttg

SEQ ID NO: 432803 - DNA, 25 bp, Rattus norvegicus
ggatgatgatgagaccttctccttg

SEQ ID NO: 432804 - DNA, 25 bp, Rattus norvegicus
ggatgatgcagaacagacccctttg

SEQ ID NO: 432805 - DNA, 25 bp, Rattus norvegicus
ggatgatgcagatcagacccctttg

SEQ ID NO: 432806 - DNA, 25 bp, Rattus norvegicus
ggatgatgcctgagggaccagctcc

SEQ ID NO: 432807 - DNA, 25 bp, Rattus norvegicus
ggatgatgcctgtgggaccagctcc

SEQ ID NO: 432808 - DNA, 25 bp, Rattus norvegicus
ggatgatgccttagttgctgctatt

SEQ ID NO: 432809 - DNA, 25 bp, Rattus norvegicus
ggatgatgcctttgttgctgctatt

SEQ ID NO: 432810 - DNA, 25 bp, Rattus norvegicus
ggatgatggctcattcccataatct

SEQ ID NO: 432811 - DNA, 25 bp, Rattus norvegicus
ggatgatggctctttcccataatct

SEQ ID NO: 432812 - DNA, 25 bp, Rattus norvegicus
ggatgatgggtcagctttcttaata

SEQ ID NO: 432813 - DNA, 25 bp, Rattus norvegicus
ggatgatgggtctgctttcttaata

SEQ ID NO: 432814 - DNA, 25 bp, Rattus norvegicus
ggatgatggtatcctctgccctgtg

SEQ ID NO: 432815 - DNA, 25 bp, Rattus norvegicus
ggatgatggtatgctctgccctgtg

SEQ ID NO: 432816 - DNA, 25 bp, Rattus norvegicus
ggatgatgtaccagtattcgctgct

SEQ ID NO: 432817 - DNA, 25 bp, Rattus norvegicus
ggatgatgtacctgtattcgctgct

SEQ ID NO: 432818 - DNA, 25 bp, Rattus norvegicus
ggatgatgtcgcctttatctgtata

SEQ ID NO: 432819 - DNA, 25 bp, Rattus norvegicus
ggatgatgtcgcgtttatctgtata

SEQ ID NO: 432820 - DNA, 25 bp, Rattus norvegicus
ggatgatgttgacctcttccttcac

SEQ ID NO: 432821 - DNA, 25 bp, Rattus norvegicus
ggatgatgttgagctcttccttcac

SEQ ID NO: 432822 - DNA, 25 bp, Rattus norvegicus
ggatgattcatcaagcccacacgtg

SEQ ID NO: 432823 - DNA, 25 bp, Rattus norvegicus
ggatgattcatctagcccacacgtg

SEQ ID NO: 432824 - DNA, 25 bp, Rattus norvegicus
ggatgattcccaatttgtagtccat

SEQ ID NO: 432825 - DNA, 25 bp, Rattus norvegicus
ggatgattcccattttgtagtccat

SEQ ID NO: 432826 - DNA, 25 bp, Rattus norvegicus
ggatgattcctaatggatccccgtc

SEQ ID NO: 432827 - DNA, 25 bp, Rattus norvegicus
ggatgattcctattggatccccgtc

SEQ ID NO: 432828 - DNA, 25 bp, Rattus norvegicus
ggatgattgggcaaagtacaaatta

SEQ ID NO: 432829 - DNA, 25 bp, Rattus norvegicus
ggatgattgggctaagtacaaatta

SEQ ID NO: 432830 - DNA, 25 bp, Rattus norvegicus
ggatgatttcttcccgggctctgat

SEQ ID NO: 432831 - DNA, 25 bp, Rattus norvegicus
ggatgatttcttgccgggctctgat

SEQ ID NO: 432832 - DNA, 25 bp, Rattus norvegicus
ggatgatttgccagcttattaataa

SEQ ID NO: 432833 - DNA, 25 bp, Rattus norvegicus
ggatgatttgcctgcttattaataa

SEQ ID NO: 432834 - DNA, 25 bp, Rattus norvegicus
ggatgatttggccacaagagttttt

SEQ ID NO: 432835 - DNA, 25 bp, Rattus norvegicus
ggatgatttggcgacaagagttttt

SEQ ID NO: 432836 - DNA, 25 bp, Rattus norvegicus
ggatgcaaacgcctacgggagtcaa

SEQ ID NO: 432837 - DNA, 25 bp, Rattus norvegicus
ggatgcaaacgcgtacgggagtcaa

SEQ ID NO: 432838 - DNA, 25 bp, Rattus norvegicus
ggatgcaaagacaggaccagcaaca

SEQ ID NO: 432839 - DNA, 25 bp, Rattus norvegicus
ggatgcaaagactggaccagcaaca

SEQ ID NO: 432840 - DNA, 25 bp, Rattus norvegicus
ggatgcaacccgcaagggcaacaaa

SEQ ID NO: 432841 - DNA, 25 bp, Rattus norvegicus
ggatgcaacccggaagggcaacaaa

SEQ ID NO: 432842 - DNA, 25 bp, Rattus norvegicus
ggatgcaaccttagacctagcagca

SEQ ID NO: 432843 - DNA, 25 bp, Rattus norvegicus
ggatgcaacctttgacctagcagca

SEQ ID NO: 432844 - DNA, 25 bp, Rattus norvegicus
ggatgcaacgatatgcccagcagca

SEQ ID NO: 432845 - DNA, 25 bp, Rattus norvegicus
ggatgcaacgatttgcccagcagca

SEQ ID NO: 432846 - DNA, 25 bp, Rattus norvegicus
ggatgcaactgtccctcaattatta

SEQ ID NO: 432847 - DNA, 25 bp, Rattus norvegicus
ggatgcaactgtgcctcaattatta

SEQ ID NO: 432848 - DNA, 25 bp, Rattus norvegicus
ggatgcaagcacagagctagcctct

SEQ ID NO: 432849 - DNA, 25 bp, Rattus norvegicus
ggatgcaagcactgagctagcctct

SEQ ID NO: 432850 - DNA, 25 bp, Rattus norvegicus
ggatgcaagcctccggtcttgtaaa

SEQ ID NO: 432851 - DNA, 25 bp, Rattus norvegicus
ggatgcaagcctgcggtcttgtaaa

SEQ ID NO: 432852 - DNA, 25 bp, Rattus norvegicus
ggatgcaagctaactgacatttttc

SEQ ID NO: 432853 - DNA, 25 bp, Rattus norvegicus
ggatgcaagctatctgacatttttc

SEQ ID NO: 432854 - DNA, 25 bp, Rattus norvegicus
ggatgcaagtacagtatgtctcttt

SEQ ID NO: 432855 - DNA, 25 bp, Rattus norvegicus
ggatgcaagtactgtatgtctcttt

SEQ ID NO: 432856 - DNA, 25 bp, Rattus norvegicus
ggatgcaagtctaagcgtttcatgt

SEQ ID NO: 432857 - DNA, 25 bp, Rattus norvegicus
ggatgcaagtcttagcgtttcatgt

SEQ ID NO: 432858 - DNA, 25 bp, Rattus norvegicus
ggatgcaataacaatgcccctccaa

SEQ ID NO: 432859 - DNA, 25 bp, Rattus norvegicus
ggatgcaataactatgcccctccaa

SEQ ID NO: 432860 - DNA, 25 bp, Rattus norvegicus
ggatgcaatgctcgagaagactcca

SEQ ID NO: 432861 - DNA, 25 bp, Rattus norvegicus
ggatgcaatgctggagaagactcca

SEQ ID NO: 432862 - DNA, 25 bp, Rattus norvegicus
ggatgcaattctcctgggtcattat

SEQ ID NO: 432863 - DNA, 25 bp, Rattus norvegicus
ggatgcaattctgctgggtcattat

SEQ ID NO: 432864 - DNA, 25 bp, Rattus norvegicus
ggatgcaattgaactccccataggc

SEQ ID NO: 432865 - DNA, 25 bp, Rattus norvegicus
ggatgcaattgatctccccataggc

SEQ ID NO: 432866 - DNA, 25 bp, Rattus norvegicus
ggatgcacaactagccacagttttc

SEQ ID NO: 432867 - DNA, 25 bp, Rattus norvegicus
ggatgcacaacttgccacagttttc

SEQ ID NO: 432868 - DNA, 25 bp, Rattus norvegicus
ggatgcacagccaggaagccccaag

SEQ ID NO: 432869 - DNA, 25 bp, Rattus norvegicus
ggatgcacagcctggaagccccaag

SEQ ID NO: 432870 - DNA, 25 bp, Rattus norvegicus
ggatgcacaggcagatccccaaggg

SEQ ID NO: 432871 - DNA, 25 bp, Rattus norvegicus
ggatgcacaggcatgaggccatatt

SEQ ID NO: 432872 - DNA, 25 bp, Rattus norvegicus
ggatgcacaggctgatccccaaggg

SEQ ID NO: 432873 - DNA, 25 bp, Rattus norvegicus
ggatgcacaggcttgaggccatatt

SEQ ID NO: 432874 - DNA, 25 bp, Rattus norvegicus
ggatgcacatgcagagctggtgact

SEQ ID NO: 432875 - DNA, 25 bp, Rattus norvegicus
ggatgcacatgctgagctggtgact

SEQ ID NO: 432876 - DNA, 25 bp, Rattus norvegicus
ggatgcactatgatggcctcagaaa

SEQ ID NO: 432877 - DNA, 25 bp, Rattus norvegicus
ggatgcactatgttggcctcagaaa

SEQ ID NO: 432878 - DNA, 25 bp, Rattus norvegicus
ggatgcactccgaagtctgttaagt

SEQ ID NO: 432879 - DNA, 25 bp, Rattus norvegicus
ggatgcactccgtagtctgttaagt

SEQ ID NO: 432880 - DNA, 25 bp, Rattus norvegicus
ggatgcactctactaactatgtata

SEQ ID NO: 432881 - DNA, 25 bp, Rattus norvegicus
ggatgcactctagtaactatgtata

SEQ ID NO: 432882 - DNA, 25 bp, Rattus norvegicus
ggatgcagacacagacaactacact

SEQ ID NO: 432883 - DNA, 25 bp, Rattus norvegicus
ggatgcagacactgacaactacact

SEQ ID NO: 432884 - DNA, 25 bp, Rattus norvegicus
ggatgcagaccgaagtcccctgtgc

SEQ ID NO: 432885 - DNA, 25 bp, Rattus norvegicus
ggatgcagaccgtagtcccctgtgc

SEQ ID NO: 432886 - DNA, 25 bp, Rattus norvegicus
ggatgcagagggacctcagccttta

SEQ ID NO: 432887 - DNA, 25 bp, Rattus norvegicus
ggatgcagagggtcctcagccttta

SEQ ID NO: 432888 - DNA, 25 bp, Rattus norvegicus
ggatgcagccaacatactttttaca

SEQ ID NO: 432889 - DNA, 25 bp, Rattus norvegicus
ggatgcagccaagatactttttaca

SEQ ID NO: 432890 - DNA, 25 bp, Rattus norvegicus
ggatgcagccatcattctgattatc

SEQ ID NO: 432891 - DNA, 25 bp, Rattus norvegicus
ggatgcagccatgattctgattatc

SEQ ID NO: 432892 - DNA, 25 bp, Rattus norvegicus
ggatgcaggaatagtcgctcttctc

SEQ ID NO: 432893 - DNA, 25 bp, Rattus norvegicus
ggatgcaggaattgtcgctcttctc

SEQ ID NO: 432894 - DNA, 25 bp, Rattus norvegicus
ggatgcaggcagagtacacattgtt

SEQ ID NO: 432895 - DNA, 25 bp, Rattus norvegicus
ggatgcaggcagtgtacacattgtt

SEQ ID NO: 432896 - DNA, 25 bp, Rattus norvegicus
ggatgcagtattcagcagccagctg

SEQ ID NO: 432897 - DNA, 25 bp, Rattus norvegicus
ggatgcagtattgagcagccagctg

SEQ ID NO: 432898 - DNA, 25 bp, Rattus norvegicus
ggatgcagtcatactttgtggctgg

SEQ ID NO: 432899 - DNA, 25 bp, Rattus norvegicus
ggatgcagtcattctttgtggctgg

SEQ ID NO: 432900 - DNA, 25 bp, Rattus norvegicus
ggatgcagtcgacgcaccacagctg

SEQ ID NO: 432901 - DNA, 25 bp, Rattus norvegicus
ggatgcagtcgaggcaccacagctg

SEQ ID NO: 432902 - DNA, 25 bp, Rattus norvegicus
ggatgcagtgcacccatatacttat

SEQ ID NO: 432903 - DNA, 25 bp, Rattus norvegicus
ggatgcagtgcagccatatacttat

SEQ ID NO: 432904 - DNA, 25 bp, Rattus norvegicus
ggatgcataaacaatcttgtctcat

SEQ ID NO: 432905 - DNA, 25 bp, Rattus norvegicus
ggatgcataaactatcttgtctcat

SEQ ID NO: 432906 - DNA, 25 bp, Rattus norvegicus
ggatgcatcaccaagagtccctgga

SEQ ID NO: 432907 - DNA, 25 bp, Rattus norvegicus
ggatgcatcacctagagtccctgga

SEQ ID NO: 432908 - DNA, 25 bp, Rattus norvegicus
ggatgcatcccacttctaatgtaca

SEQ ID NO: 432909 - DNA, 25 bp, Rattus norvegicus
ggatgcatcccagttctaatgtaca

SEQ ID NO: 432910 - DNA, 25 bp, Rattus norvegicus
ggatgcatccgaatcaagtgagctc

SEQ ID NO: 432911 - DNA, 25 bp, Rattus norvegicus
ggatgcatccgattcaagtgagctc

SEQ ID NO: 432912 - DNA, 25 bp, Rattus norvegicus
ggatgcatccgtcgagatccctggc

SEQ ID NO: 432913 - DNA, 25 bp, Rattus norvegicus
ggatgcatccgtggagatccctggc

SEQ ID NO: 432914 - DNA, 25 bp, Rattus norvegicus
ggatgcatctaaccttccatgaata

SEQ ID NO: 432915 - DNA, 25 bp, Rattus norvegicus
ggatgcatctaagcttccatgaata

SEQ ID NO: 432916 - DNA, 25 bp, Rattus norvegicus
ggatgcatctacatgtatgctggga

SEQ ID NO: 432917 - DNA, 25 bp, Rattus norvegicus
ggatgcatctacttgtatgctggga

SEQ ID NO: 432918 - DNA, 25 bp, Rattus norvegicus
ggatgcatgagtcccggcgcctatc

SEQ ID NO: 432919 - DNA, 25 bp, Rattus norvegicus
ggatgcatgagtgccggcgcctatc

SEQ ID NO: 432920 - DNA, 25 bp, Rattus norvegicus
ggatgcatgtggatccccagtagca

SEQ ID NO: 432921 - DNA, 25 bp, Rattus norvegicus
ggatgcatgtggttccccagtagca

SEQ ID NO: 432922 - DNA, 25 bp, Rattus norvegicus
ggatgcattatgacctatctcaaaa

SEQ ID NO: 432923 - DNA, 25 bp, Rattus norvegicus
ggatgcattatgtcctatctcaaaa

SEQ ID NO: 432924 - DNA, 25 bp, Rattus norvegicus
ggatgcattcatagccagttttcta

SEQ ID NO: 432925 - DNA, 25 bp, Rattus norvegicus
ggatgcattcattgccagttttcta

SEQ ID NO: 432926 - DNA, 25 bp, Rattus norvegicus
ggatgcattctccataagattccag

SEQ ID NO: 432927 - DNA, 25 bp, Rattus norvegicus
ggatgcattctcgataagattccag

SEQ ID NO: 432928 - DNA, 25 bp, Rattus norvegicus
ggatgccaaagtcaccagttgtcta

SEQ ID NO: 432929 - DNA, 25 bp, Rattus norvegicus
ggatgccaaagtgaccagttgtcta

SEQ ID NO: 432930 - DNA, 25 bp, Rattus norvegicus
ggatgccaacatcagacctgtaata

SEQ ID NO: 432931 - DNA, 25 bp, Rattus norvegicus
ggatgccaacatgagacctgtaata

SEQ ID NO: 432932 - DNA, 25 bp, Rattus norvegicus
ggatgccaacgaagagtaggacaga

SEQ ID NO: 432933 - DNA, 25 bp, Rattus norvegicus
ggatgccaacgatgagtaggacaga

SEQ ID NO: 432934 - DNA, 25 bp, Rattus norvegicus
ggatgccaagagaaaccagccttct

SEQ ID NO: 432935 - DNA, 25 bp, Rattus norvegicus
ggatgccaagagtaaccagccttct

SEQ ID NO: 432936 - DNA, 25 bp, Rattus norvegicus
ggatgccacaccctgctgttgtata

SEQ ID NO: 432937 - DNA, 25 bp, Rattus norvegicus
ggatgccacaccgtgctgttgtata

SEQ ID NO: 432938 - DNA, 25 bp, Rattus norvegicus
ggatgccacactcatcttctggaac

SEQ ID NO: 432939 - DNA, 25 bp, Rattus norvegicus
ggatgccacactgatcttctggaac

SEQ ID NO: 432940 - DNA, 25 bp, Rattus norvegicus
ggatgccacgtgacacagatgttta

SEQ ID NO: 432941 - DNA, 25 bp, Rattus norvegicus
ggatgccacgtgtcacagatgttta

SEQ ID NO: 432942 - DNA, 25 bp, Rattus norvegicus
ggatgccactggaacagctgcctca

SEQ ID NO: 432943 - DNA, 25 bp, Rattus norvegicus
ggatgccactggtacagctgcctca

SEQ ID NO: 432944 - DNA, 25 bp, Rattus norvegicus
ggatgccagagcctccagcttggta

SEQ ID NO: 432945 - DNA, 25 bp, Rattus norvegicus
ggatgccagagcgtccagcttggta

SEQ ID NO: 432946 - DNA, 25 bp, Rattus norvegicus
ggatgccagcatcccacctagtgcg

SEQ ID NO: 432947 - DNA, 25 bp, Rattus norvegicus
ggatgccagcatgccacctagtgcg

SEQ ID NO: 432948 - DNA, 25 bp, Rattus norvegicus
ggatgccagccactgtaccagaagc

SEQ ID NO: 432949 - DNA, 25 bp, Rattus norvegicus
ggatgccagccagtgtaccagaagc

SEQ ID NO: 432950 - DNA, 25 bp, Rattus norvegicus
ggatgccaggcccagtcattaaaac

SEQ ID NO: 432951 - DNA, 25 bp, Rattus norvegicus
ggatgccaggccgagtcattaaaac

SEQ ID NO: 432952 - DNA, 25 bp, Rattus norvegicus
ggatgccagtggcaatggctccaaa

SEQ ID NO: 432953 - DNA, 25 bp, Rattus norvegicus
ggatgccagtgggaatggctccaaa

SEQ ID NO: 432954 - DNA, 25 bp, Rattus norvegicus
ggatgccagtttattattgcccaac

SEQ ID NO: 432955 - DNA, 25 bp, Rattus norvegicus
ggatgccagttttttattgcccaac

SEQ ID NO: 432956 - DNA, 25 bp, Rattus norvegicus
ggatgccatatacctctatagtcag

SEQ ID NO: 432957 - DNA, 25 bp, Rattus norvegicus
ggatgccatatagctctatagtcag

SEQ ID NO: 432958 - DNA, 25 bp, Rattus norvegicus
ggatgccatatcataatcttgttaa

SEQ ID NO: 432959 - DNA, 25 bp, Rattus norvegicus
ggatgccatatcttaatcttgttaa

SEQ ID NO: 432960 - DNA, 25 bp, Rattus norvegicus
ggatgccatcctaacagggtccaac

SEQ ID NO: 432961 - DNA, 25 bp, Rattus norvegicus
ggatgccatccttacagggtccaac

SEQ ID NO: 432962 - DNA, 25 bp, Rattus norvegicus
ggatgccatgacactgtctggataa

SEQ ID NO: 432963 - DNA, 25 bp, Rattus norvegicus
ggatgccatgactctgtctggataa

SEQ ID NO: 432964 - DNA, 25 bp, Rattus norvegicus
ggatgccatgctcgtccatgggcaa

SEQ ID NO: 432965 - DNA, 25 bp, Rattus norvegicus
ggatgccatgctggtccatgggcaa

SEQ ID NO: 432966 - DNA, 25 bp, Rattus norvegicus
ggatgccatgtcattgtgtgtgaaa

SEQ ID NO: 432967 - DNA, 25 bp, Rattus norvegicus
ggatgccatgtctttgtgtgtgaaa

SEQ ID NO: 432968 - DNA, 25 bp, Rattus norvegicus
ggatgccattgaactgagaaccaac

SEQ ID NO: 432969 - DNA, 25 bp, Rattus norvegicus
ggatgccattgatctgagaaccaac

SEQ ID NO: 432970 - DNA, 25 bp, Rattus norvegicus
ggatgccattttatgcctagggaac

SEQ ID NO: 432971 - DNA, 25 bp, Rattus norvegicus
ggatgccattttccaacatgcagtg

SEQ ID NO: 432972 - DNA, 25 bp, Rattus norvegicus
ggatgccattttgcaacatgcagtg

SEQ ID NO: 432973 - DNA, 25 bp, Rattus norvegicus
ggatgccattttttgcctagggaac

SEQ ID NO: 432974 - DNA, 25 bp, Rattus norvegicus
ggatgcccacagctcctcagataag

SEQ ID NO: 432975 - DNA, 25 bp, Rattus norvegicus
ggatgcccacaggtcctcagataag

SEQ ID NO: 432976 - DNA, 25 bp, Rattus norvegicus
ggatgcccagaaagtcaccagacaa

SEQ ID NO: 432977 - DNA, 25 bp, Rattus norvegicus
ggatgcccagaatgtcaccagacaa

SEQ ID NO: 432978 - DNA, 25 bp, Rattus norvegicus
ggatgcccatgaactggccgcagtt

SEQ ID NO: 432979 - DNA, 25 bp, Rattus norvegicus
ggatgcccatgatctggccgcagtt

SEQ ID NO: 432980 - DNA, 25 bp, Rattus norvegicus
ggatgccccattagtcagtgggatt

SEQ ID NO: 432981 - DNA, 25 bp, Rattus norvegicus
ggatgccccatttgtcagtgggatt

SEQ ID NO: 432982 - DNA, 25 bp, Rattus norvegicus
ggatgcccgccgaacaaatctgttg

SEQ ID NO: 432983 - DNA, 25 bp, Rattus norvegicus
ggatgcccgccgtacaaatctgttg

SEQ ID NO: 432984 - DNA, 25 bp, Rattus norvegicus
ggatgccctaaccatttccaggatg

SEQ ID NO: 432985 - DNA, 25 bp, Rattus norvegicus
ggatgccctaacgatttccaggatg

SEQ ID NO: 432986 - DNA, 25 bp, Rattus norvegicus
ggatgccctatcaccagaagagcgc

SEQ ID NO: 432987 - DNA, 25 bp, Rattus norvegicus
ggatgccctatctccagaagagcgc

SEQ ID NO: 432988 - DNA, 25 bp, Rattus norvegicus
ggatgccctatgcatgtacttgtta

SEQ ID NO: 432989 - DNA, 25 bp, Rattus norvegicus
ggatgccctatggatgtacttgtta

SEQ ID NO: 432990 - DNA, 25 bp, Rattus norvegicus
ggatgccctcgaaactgggacacta

SEQ ID NO: 432991 - DNA, 25 bp, Rattus norvegicus
ggatgccctcgatactgggacacta

SEQ ID NO: 432992 - DNA, 25 bp, Rattus norvegicus
ggatgccctctgaaaaaccaagctg

SEQ ID NO: 432993 - DNA, 25 bp, Rattus norvegicus
ggatgccctctgtaaaaccaagctg

SEQ ID NO: 432994 - DNA, 25 bp, Rattus norvegicus
ggatgccctcttaatgcacaagcta

SEQ ID NO: 432995 - DNA, 25 bp, Rattus norvegicus
ggatgccctctttatgcacaagcta

SEQ ID NO: 432996 - DNA, 25 bp, Rattus norvegicus
ggatgccctgacagaactgctcagt

SEQ ID NO: 432997 - DNA, 25 bp, Rattus norvegicus
ggatgccctgactgaactgctcagt

SEQ ID NO: 432998 - DNA, 25 bp, Rattus norvegicus
ggatgccctgagctgcaaggcccat

SEQ ID NO: 432999 - DNA, 25 bp, Rattus norvegicus
ggatgccctgaggtgcaaggcccat

SEQ ID NO: 433000 - DNA, 25 bp, Rattus norvegicus
ggatgccctgcaagagatgtacaag

SEQ ID NO: 433001 - DNA, 25 bp, Rattus norvegicus
ggatgccctgcatgagatgtacaag

SEQ ID NO: 433002 - DNA, 25 bp, Rattus norvegicus
ggatgccctggtactgagcttgaag

SEQ ID NO: 433003 - DNA, 25 bp, Rattus norvegicus
ggatgccctggttctgagcttgaag

SEQ ID NO: 433004 - DNA, 25 bp, Rattus norvegicus
ggatgccctgttaaaacactatggt

SEQ ID NO: 433005 - DNA, 25 bp, Rattus norvegicus
ggatgccctgtttaaacactatggt

SEQ ID NO: 433006 - DNA, 25 bp, Rattus norvegicus
ggatgcccttatagtatcctatcaa

SEQ ID NO: 433007 - DNA, 25 bp, Rattus norvegicus
ggatgcccttattgtatcctatcaa

SEQ ID NO: 433008 - DNA, 25 bp, Rattus norvegicus
ggatgcccttcaagttttattgcta

SEQ ID NO: 433009 - DNA, 25 bp, Rattus norvegicus
ggatgcccttcatgttttattgcta

SEQ ID NO: 433010 - DNA, 25 bp, Rattus norvegicus
ggatgccctttgaaatcccaagcat

SEQ ID NO: 433011 - DNA, 25 bp, Rattus norvegicus
ggatgccctttgtaatcccaagcat

SEQ ID NO: 433012 - DNA, 25 bp, Rattus norvegicus
ggatgccgccaacgtctgcagagaa

SEQ ID NO: 433013 - DNA, 25 bp, Rattus norvegicus
ggatgccgccaaggtctgcagagaa

SEQ ID NO: 433014 - DNA, 25 bp, Rattus norvegicus
ggatgccgcctaatgctttaggaat

SEQ ID NO: 433015 - DNA, 25 bp, Rattus norvegicus
ggatgccgcctattgctttaggaat

SEQ ID NO: 433016 - DNA, 25 bp, Rattus norvegicus
ggatgccgctgacgagactcctgat

SEQ ID NO: 433017 - DNA, 25 bp, Rattus norvegicus
ggatgccgctgaggagactcctgat

SEQ ID NO: 433018 - DNA, 25 bp, Rattus norvegicus
ggatgccgtcaaactgtaacgaata

SEQ ID NO: 433019 - DNA, 25 bp, Rattus norvegicus
ggatgccgtcaatctgtaacgaata

SEQ ID NO: 433020 - DNA, 25 bp, Rattus norvegicus
ggatgccgtgcactatcttctagaa

SEQ ID NO: 433021 - DNA, 25 bp, Rattus norvegicus
ggatgccgtgcagtatcttctagaa

SEQ ID NO: 433022 - DNA, 25 bp, Rattus norvegicus
ggatgccgttaaatcgtggttttat

SEQ ID NO: 433023 - DNA, 25 bp, Rattus norvegicus
ggatgccgttaattcgtggttttat

SEQ ID NO: 433024 - DNA, 25 bp, Rattus norvegicus
ggatgcctaaccaagaacacacgtt

SEQ ID NO: 433025 - DNA, 25 bp, Rattus norvegicus
ggatgcctaacctagaacacacgtt

SEQ ID NO: 433026 - DNA, 25 bp, Rattus norvegicus
ggatgcctaccaaatgtttcttcaa

SEQ ID NO: 433027 - DNA, 25 bp, Rattus norvegicus
ggatgcctaccatatgtttcttcaa

SEQ ID NO: 433028 - DNA, 25 bp, Rattus norvegicus
ggatgcctacttcatcacattcatg

SEQ ID NO: 433029 - DNA, 25 bp, Rattus norvegicus
ggatgcctacttgatcacattcatg

SEQ ID NO: 433030 - DNA, 25 bp, Rattus norvegicus
ggatgcctagaacaccctgaccagg

SEQ ID NO: 433031 - DNA, 25 bp, Rattus norvegicus
ggatgcctagaagaccctgaccagg

SEQ ID NO: 433032 - DNA, 25 bp, Rattus norvegicus
ggatgcctcaggatgatcagagatt

SEQ ID NO: 433033 - DNA, 25 bp, Rattus norvegicus
ggatgcctcaggttgatcagagatt

SEQ ID NO: 433034 - DNA, 25 bp, Rattus norvegicus
ggatgcctctctatgggagcatatt

SEQ ID NO: 433035 - DNA, 25 bp, Rattus norvegicus
ggatgcctctctttgggagcatatt

SEQ ID NO: 433036 - DNA, 25 bp, Rattus norvegicus
ggatgcctggagatcttcacagtgc

SEQ ID NO: 433037 - DNA, 25 bp, Rattus norvegicus
ggatgcctggagttcttcacagtgc

SEQ ID NO: 433038 - DNA, 25 bp, Rattus norvegicus
ggatgccttctacaaatgggagagc

SEQ ID NO: 433039 - DNA, 25 bp, Rattus norvegicus
ggatgccttctagaaatgggagagc

SEQ ID NO: 433040 - DNA, 25 bp, Rattus norvegicus
ggatgccttgtaattttcaatgacc

SEQ ID NO: 433041 - DNA, 25 bp, Rattus norvegicus
ggatgccttgtatttttcaatgacc

SEQ ID NO: 433042 - DNA, 25 bp, Rattus norvegicus
ggatgcctttgtcttgtgaccggac

SEQ ID NO: 433043 - DNA, 25 bp, Rattus norvegicus
ggatgcctttgtgttgtgaccggac

SEQ ID NO: 433044 - DNA, 25 bp, Rattus norvegicus
ggatgccttttcatgacgggacgta

SEQ ID NO: 433045 - DNA, 25 bp, Rattus norvegicus
ggatgccttttcttgacgggacgta

SEQ ID NO: 433046 - DNA, 25 bp, Rattus norvegicus
ggatgcgaaccccggccagcctaag

SEQ ID NO: 433047 - DNA, 25 bp, Rattus norvegicus
ggatgcgaacccgggccagcctaag

SEQ ID NO: 433048 - DNA, 25 bp, Rattus norvegicus
ggatgcgaataaatgactcttgaat

SEQ ID NO: 433049 - DNA, 25 bp, Rattus norvegicus
ggatgcgaataattgactcttgaat

SEQ ID NO: 433050 - DNA, 25 bp, Rattus norvegicus
ggatgcgaatgtacctctgtgagcc

SEQ ID NO: 433051 - DNA, 25 bp, Rattus norvegicus
ggatgcgaatgttcctctgtgagcc

SEQ ID NO: 433052 - DNA, 25 bp, Rattus norvegicus
ggatgcgatgtgagcacacttctag

SEQ ID NO: 433053 - DNA, 25 bp, Rattus norvegicus
ggatgcgatgtgtgcacacttctag

SEQ ID NO: 433054 - DNA, 25 bp, Rattus norvegicus
ggatgcgcagtgagcttcaggcaat

SEQ ID NO: 433055 - DNA, 25 bp, Rattus norvegicus
ggatgcgcagtgtgcttcaggcaat

SEQ ID NO: 433056 - DNA, 25 bp, Rattus norvegicus
ggatgcgcccggagtacatgtactc

SEQ ID NO: 433057 - DNA, 25 bp, Rattus norvegicus
ggatgcgcccggtgtacatgtactc

SEQ ID NO: 433058 - DNA, 25 bp, Rattus norvegicus
ggatgcgctctccactgacatggtc

SEQ ID NO: 433059 - DNA, 25 bp, Rattus norvegicus
ggatgcgctctcgactgacatggtc

SEQ ID NO: 433060 - DNA, 25 bp, Rattus norvegicus
ggatgcggcatcattcgttcagcta

SEQ ID NO: 433061 - DNA, 25 bp, Rattus norvegicus
ggatgcggcatctttcgttcagcta

SEQ ID NO: 433062 - DNA, 25 bp, Rattus norvegicus
ggatgcggcgcaattttaaatttta

SEQ ID NO: 433063 - DNA, 25 bp, Rattus norvegicus
ggatgcggcgcatttttaaatttta

SEQ ID NO: 433064 - DNA, 25 bp, Rattus norvegicus
ggatgcggtctacttggctcttagc

SEQ ID NO: 433065 - DNA, 25 bp, Rattus norvegicus
ggatgcggtctagttggctcttagc

SEQ ID NO: 433066 - DNA, 25 bp, Rattus norvegicus
ggatgcggtttgaaccacagagccc

SEQ ID NO: 433067 - DNA, 25 bp, Rattus norvegicus
ggatgcggtttgtaccacagagccc

SEQ ID NO: 433068 - DNA, 25 bp, Rattus norvegicus
ggatgcgtccttcatggccatgaga

SEQ ID NO: 433069 - DNA, 25 bp, Rattus norvegicus
ggatgcgtccttgatggccatgaga

SEQ ID NO: 433070 - DNA, 25 bp, Rattus norvegicus
ggatgcgtcgtgaccatttagaggc

SEQ ID NO: 433071 - DNA, 25 bp, Rattus norvegicus
ggatgcgtcgtgtccatttagaggc

SEQ ID NO: 433072 - DNA, 25 bp, Rattus norvegicus
ggatgctaaaataacctttccaggt

SEQ ID NO: 433073 - DNA, 25 bp, Rattus norvegicus
ggatgctaaaattacctttccaggt

SEQ ID NO: 433074 - DNA, 25 bp, Rattus norvegicus
ggatgctaaaggactcaccagctgt

SEQ ID NO: 433075 - DNA, 25 bp, Rattus norvegicus
ggatgctaaaggtctcaccagctgt

SEQ ID NO: 433076 - DNA, 25 bp, Rattus norvegicus
ggatgctaaattccgcctgattcta

SEQ ID NO: 433077 - DNA, 25 bp, Rattus norvegicus
ggatgctaaattgcgcctgattcta

SEQ ID NO: 433078 - DNA, 25 bp, Rattus norvegicus
ggatgctaactgcacacatgctgaa

SEQ ID NO: 433079 - DNA, 25 bp, Rattus norvegicus
ggatgctaactggacacatgctgaa

SEQ ID NO: 433080 - DNA, 25 bp, Rattus norvegicus
ggatgctaatcccagactgactcag

SEQ ID NO: 433081 - DNA, 25 bp, Rattus norvegicus
ggatgctaatccgagactgactcag

SEQ ID NO: 433082 - DNA, 25 bp, Rattus norvegicus
ggatgctacaagatgcctaaccctc

SEQ ID NO: 433083 - DNA, 25 bp, Rattus norvegicus
ggatgctacaagttgcctaaccctc

SEQ ID NO: 433084 - DNA, 25 bp, Rattus norvegicus
ggatgctacagcagatgtcctcatg

SEQ ID NO: 433085 - DNA, 25 bp, Rattus norvegicus
ggatgctacagctgatgtcctcatg

SEQ ID NO: 433086 - DNA, 25 bp, Rattus norvegicus
ggatgctaccgacagacattttgct

SEQ ID NO: 433087 - DNA, 25 bp, Rattus norvegicus
ggatgctaccgagagacattttgct

SEQ ID NO: 433088 - DNA, 25 bp, Rattus norvegicus
ggatgctacttcattgcaacaacaa

SEQ ID NO: 433089 - DNA, 25 bp, Rattus norvegicus
ggatgctacttctttgcaacaacaa

SEQ ID NO: 433090 - DNA, 25 bp, Rattus norvegicus
ggatgctagtccaagggctgcagct

SEQ ID NO: 433091 - DNA, 25 bp, Rattus norvegicus
ggatgctagtcctagggctgcagct

SEQ ID NO: 433092 - DNA, 25 bp, Rattus norvegicus
ggatgctcaagcagtctttcaagta

SEQ ID NO: 433093 - DNA, 25 bp, Rattus norvegicus
ggatgctcaagctgtctttcaagta

SEQ ID NO: 433094 - DNA, 25 bp, Rattus norvegicus
ggatgctcagagatcatctctcgta

SEQ ID NO: 433095 - DNA, 25 bp, Rattus norvegicus
ggatgctcagagttcatctctcgta

SEQ ID NO: 433096 - DNA, 25 bp, Rattus norvegicus
ggatgctcaggcagtccaactgtgg

SEQ ID NO: 433097 - DNA, 25 bp, Rattus norvegicus
ggatgctcaggctgtccaactgtgg

SEQ ID NO: 433098 - DNA, 25 bp, Rattus norvegicus
ggatgctcaggtaagaggctcccag

SEQ ID NO: 433099 - DNA, 25 bp, Rattus norvegicus
ggatgctcaggttagaggctcccag

SEQ ID NO: 433100 - DNA, 25 bp, Rattus norvegicus
ggatgctcagtacacgcgcaggctt

SEQ ID NO: 433101 - DNA, 25 bp, Rattus norvegicus
ggatgctcagtagacgcgcaggctt

SEQ ID NO: 433102 - DNA, 25 bp, Rattus norvegicus
ggatgctccagcagtgtatcttcgc

SEQ ID NO: 433103 - DNA, 25 bp, Rattus norvegicus
ggatgctccagctgtgtatcttcgc

SEQ ID NO: 433104 - DNA, 25 bp, Rattus norvegicus
ggatgctccagtatgctgaaacatt

SEQ ID NO: 433105 - DNA, 25 bp, Rattus norvegicus
ggatgctccagtttgctgaaacatt

SEQ ID NO: 433106 - DNA, 25 bp, Rattus norvegicus
ggatgctcctatatcttggcagggt

SEQ ID NO: 433107 - DNA, 25 bp, Rattus norvegicus
ggatgctcctatttcttggcagggt

SEQ ID NO: 433108 - DNA, 25 bp, Rattus norvegicus
ggatgctcggccatttctgaacagg

SEQ ID NO: 433109 - DNA, 25 bp, Rattus norvegicus
ggatgctcggccttttctgaacagg

SEQ ID NO: 433110 - DNA, 25 bp, Rattus norvegicus
ggatgctcgggactcagacttcaat

SEQ ID NO: 433111 - DNA, 25 bp, Rattus norvegicus
ggatgctcgggagtcagacttcaat

SEQ ID NO: 433112 - DNA, 25 bp, Rattus norvegicus
ggatgctctacaagcccaaagtcta

SEQ ID NO: 433113 - DNA, 25 bp, Rattus norvegicus
ggatgctctacatgcccaaagtcta

SEQ ID NO: 433114 - DNA, 25 bp, Rattus norvegicus
ggatgctctctaattagcggagaaa

SEQ ID NO: 433115 - DNA, 25 bp, Rattus norvegicus
ggatgctctctatttagcggagaaa

SEQ ID NO: 433116 - DNA, 25 bp, Rattus norvegicus
ggatgctctgcacggaaggcttcat

SEQ ID NO: 433117 - DNA, 25 bp, Rattus norvegicus
ggatgctctgcagggaaggcttcat

SEQ ID NO: 433118 - DNA, 25 bp, Rattus norvegicus
ggatgctctgccaactgagctccgt

SEQ ID NO: 433119 - DNA, 25 bp, Rattus norvegicus
ggatgctctgcctactgagctccgt

SEQ ID NO: 433120 - DNA, 25 bp, Rattus norvegicus
ggatgctctggcactgtgtgcagaa

SEQ ID NO: 433121 - DNA, 25 bp, Rattus norvegicus
ggatgctctggctctgtgtgcagaa

SEQ ID NO: 433122 - DNA, 25 bp, Rattus norvegicus
ggatgctctgtgaccatcgagagaa

SEQ ID NO: 433123 - DNA, 25 bp, Rattus norvegicus
ggatgctctgtgtccatcgagagaa

SEQ ID NO: 433124 - DNA, 25 bp, Rattus norvegicus
ggatgctctgttcgcgcacggcaca

SEQ ID NO: 433125 - DNA, 25 bp, Rattus norvegicus
ggatgctctgttggcgcacggcaca

SEQ ID NO: 433126 - DNA, 25 bp, Rattus norvegicus
ggatgctctttaacctatatagata

SEQ ID NO: 433127 - DNA, 25 bp, Rattus norvegicus
ggatgctctttatcctatatagata

SEQ ID NO: 433128 - DNA, 25 bp, Rattus norvegicus
ggatgctgaagcctggtaccttact

SEQ ID NO: 433129 - DNA, 25 bp, Rattus norvegicus
ggatgctgaagcgtggtaccttact

SEQ ID NO: 433130 - DNA, 25 bp, Rattus norvegicus
ggatgctgaagtcgccttagcaact

SEQ ID NO: 433131 - DNA, 25 bp, Rattus norvegicus
ggatgctgaagtggccttagcaact

SEQ ID NO: 433132 - DNA, 25 bp, Rattus norvegicus
ggatgctgacagaatctttgtttta

SEQ ID NO: 433133 - DNA, 25 bp, Rattus norvegicus
ggatgctgacagtatctttgtttta

SEQ ID NO: 433134 - DNA, 25 bp, Rattus norvegicus
ggatgctgacatcgaacgtgcctcc

SEQ ID NO: 433135 - DNA, 25 bp, Rattus norvegicus
ggatgctgacatggaacgtgcctcc

SEQ ID NO: 433136 - DNA, 25 bp, Rattus norvegicus
ggatgctgcaccatgaagtgggcca

SEQ ID NO: 433137 - DNA, 25 bp, Rattus norvegicus
ggatgctgcaccttgaagtgggcca

SEQ ID NO: 433138 - DNA, 25 bp, Rattus norvegicus
ggatgctgcagacaaggcctcagta

SEQ ID NO: 433139 - DNA, 25 bp, Rattus norvegicus
ggatgctgcagagaaggcctcagta

SEQ ID NO: 433140 - DNA, 25 bp, Rattus norvegicus
ggatgctgcatcaccaggcaactat

SEQ ID NO: 433141 - DNA, 25 bp, Rattus norvegicus
ggatgctgcatctccaggcaactat

SEQ ID NO: 433142 - DNA, 25 bp, Rattus norvegicus
ggatgctgcctccaaggtgaccgaa

SEQ ID NO: 433143 - DNA, 25 bp, Rattus norvegicus
ggatgctgcctcgaaggtgaccgaa

SEQ ID NO: 433144 - DNA, 25 bp, Rattus norvegicus
ggatgctgcgtaatccattttcaaa

SEQ ID NO: 433145 - DNA, 25 bp, Rattus norvegicus
ggatgctgcgtattccattttcaaa

SEQ ID NO: 433146 - DNA, 25 bp, Rattus norvegicus
ggatgctgctgcacttcgcaagctg

SEQ ID NO: 433147 - DNA, 25 bp, Rattus norvegicus
ggatgctgctgcagagcttctccag

SEQ ID NO: 433148 - DNA, 25 bp, Rattus norvegicus
ggatgctgctgctcttcgcaagctg

SEQ ID NO: 433149 - DNA, 25 bp, Rattus norvegicus
ggatgctgctgctgagcttctccag

SEQ ID NO: 433150 - DNA, 25 bp, Rattus norvegicus
ggatgctgctgtccttcgcgctgct

SEQ ID NO: 433151 - DNA, 25 bp, Rattus norvegicus
ggatgctgctgtgcttcgcgctgct

SEQ ID NO: 433152 - DNA, 25 bp, Rattus norvegicus
ggatgctgcttaagctgggaacaca

SEQ ID NO: 433153 - DNA, 25 bp, Rattus norvegicus
ggatgctgcttatgctgggaacaca

SEQ ID NO: 433154 - DNA, 25 bp, Rattus norvegicus
ggatgctgcttccaaagggataaat

SEQ ID NO: 433155 - DNA, 25 bp, Rattus norvegicus
ggatgctgcttcgaaagggataaat

SEQ ID NO: 433156 - DNA, 25 bp, Rattus norvegicus
ggatgctggaccagaccctgctgga

SEQ ID NO: 433157 - DNA, 25 bp, Rattus norvegicus
ggatgctggacctgaccctgctgga

SEQ ID NO: 433158 - DNA, 25 bp, Rattus norvegicus
ggatgctggctaccctttttaagga

SEQ ID NO: 433159 - DNA, 25 bp, Rattus norvegicus
ggatgctggctagcctttttaagga

SEQ ID NO: 433160 - DNA, 25 bp, Rattus norvegicus
ggatgctgggctactcttcgcccta

SEQ ID NO: 433161 - DNA, 25 bp, Rattus norvegicus
ggatgctgggcttctcttcgcccta

SEQ ID NO: 433162 - DNA, 25 bp, Rattus norvegicus
ggatgctggtggactgtgtaccctt

SEQ ID NO: 433163 - DNA, 25 bp, Rattus norvegicus
ggatgctggtggtctgtgtaccctt

SEQ ID NO: 433164 - DNA, 25 bp, Rattus norvegicus
ggatgctgtaatcactccagtgaat

SEQ ID NO: 433165 - DNA, 25 bp, Rattus norvegicus
ggatgctgtaatgactccagtgaat

SEQ ID NO: 433166 - DNA, 25 bp, Rattus norvegicus
ggatgctgtagccaaggcctccaag

SEQ ID NO: 433167 - DNA, 25 bp, Rattus norvegicus
ggatgctgtagcgaaggcctccaag

SEQ ID NO: 433168 - DNA, 25 bp, Rattus norvegicus
ggatgctgtccaccttagttctgag

SEQ ID NO: 433169 - DNA, 25 bp, Rattus norvegicus
ggatgctgtccagcttagttctgag

SEQ ID NO: 433170 - DNA, 25 bp, Rattus norvegicus
ggatgctgtgaaacttttgtcttaa

SEQ ID NO: 433171 - DNA, 25 bp, Rattus norvegicus
ggatgctgtgaatcttttgtcttaa

SEQ ID NO: 433172 - DNA, 25 bp, Rattus norvegicus
ggatgctgttgccagtctttcctga

SEQ ID NO: 433173 - DNA, 25 bp, Rattus norvegicus
ggatgctgttgcgagtctttcctga

SEQ ID NO: 433174 - DNA, 25 bp, Rattus norvegicus
ggatgcttacttacctcgtggttac

SEQ ID NO: 433175 - DNA, 25 bp, Rattus norvegicus
ggatgcttactttcctcgtggttac

SEQ ID NO: 433176 - DNA, 25 bp, Rattus norvegicus
ggatgcttcagacatctgcttcaga

SEQ ID NO: 433177 - DNA, 25 bp, Rattus norvegicus
ggatgcttcagagatctgcttcaga

SEQ ID NO: 433178 - DNA, 25 bp, Rattus norvegicus
ggatgcttccagctagaactccgtg

SEQ ID NO: 433179 - DNA, 25 bp, Rattus norvegicus
ggatgcttccaggtagaactccgtg

SEQ ID NO: 433180 - DNA, 25 bp, Rattus norvegicus
ggatgcttctaccaaaggacgtggt

SEQ ID NO: 433181 - DNA, 25 bp, Rattus norvegicus
ggatgcttctacgaaaggacgtggt

SEQ ID NO: 433182 - DNA, 25 bp, Rattus norvegicus
ggatgcttctagaagccgggcttct

SEQ ID NO: 433183 - DNA, 25 bp, Rattus norvegicus
ggatgcttctagtagccgggcttct

SEQ ID NO: 433184 - DNA, 25 bp, Rattus norvegicus
ggatgcttctatacaaaagagcctt

SEQ ID NO: 433185 - DNA, 25 bp, Rattus norvegicus
ggatgcttctattcaaaagagcctt

SEQ ID NO: 433186 - DNA, 25 bp, Rattus norvegicus
ggatgcttctgaagacctcgatgac

SEQ ID NO: 433187 - DNA, 25 bp, Rattus norvegicus
ggatgcttctgatgacctcgatgac

SEQ ID NO: 433188 - DNA, 25 bp, Rattus norvegicus
ggatgcttctttaagccagtctaca

SEQ ID NO: 433189 - DNA, 25 bp, Rattus norvegicus
ggatgcttctttccgtatgaccaat

SEQ ID NO: 433190 - DNA, 25 bp, Rattus norvegicus
ggatgcttctttgcgtatgaccaat

SEQ ID NO: 433191 - DNA, 25 bp, Rattus norvegicus
ggatgcttcttttagccagtctaca

SEQ ID NO: 433192 - DNA, 25 bp, Rattus norvegicus
ggatgcttgccgcactgagtattca

SEQ ID NO: 433193 - DNA, 25 bp, Rattus norvegicus
ggatgcttgccggactgagtattca

SEQ ID NO: 433194 - DNA, 25 bp, Rattus norvegicus
ggatgcttgctacgtattcttaaaa

SEQ ID NO: 433195 - DNA, 25 bp, Rattus norvegicus
ggatgcttgctaggtattcttaaaa

SEQ ID NO: 433196 - DNA, 25 bp, Rattus norvegicus
ggatgcttgctgagtgtcctcagga

SEQ ID NO: 433197 - DNA, 25 bp, Rattus norvegicus
ggatgcttgctgtgtgtcctcagga

SEQ ID NO: 433198 - DNA, 25 bp, Rattus norvegicus
ggatgcttggcaactgactcagact

SEQ ID NO: 433199 - DNA, 25 bp, Rattus norvegicus
ggatgcttggcatctgactcagact

SEQ ID NO: 433200 - DNA, 25 bp, Rattus norvegicus
ggatgcttggccaattgtagtttgt

SEQ ID NO: 433201 - DNA, 25 bp, Rattus norvegicus
ggatgcttggcctattgtagtttgt

SEQ ID NO: 433202 - DNA, 25 bp, Rattus norvegicus
ggatgcttggttcatcagctctcct

SEQ ID NO: 433203 - DNA, 25 bp, Rattus norvegicus
ggatgcttggttgatcagctctcct

SEQ ID NO: 433204 - DNA, 25 bp, Rattus norvegicus
ggatgcttgtctctatcttaacccc

SEQ ID NO: 433205 - DNA, 25 bp, Rattus norvegicus
ggatgcttgtctgtatcttaacccc

SEQ ID NO: 433206 - DNA, 25 bp, Rattus norvegicus
ggatgctttaagacagttcattgta

SEQ ID NO: 433207 - DNA, 25 bp, Rattus norvegicus
ggatgctttaagctcctccaggatt

SEQ ID NO: 433208 - DNA, 25 bp, Rattus norvegicus
ggatgctttaaggtcctccaggatt

SEQ ID NO: 433209 - DNA, 25 bp, Rattus norvegicus
ggatgctttaagtcagttcattgta

SEQ ID NO: 433210 - DNA, 25 bp, Rattus norvegicus
ggatgctttctgattttactgtttg

SEQ ID NO: 433211 - DNA, 25 bp, Rattus norvegicus
ggatgctttctgtttttactgtttg

SEQ ID NO: 433212 - DNA, 25 bp, Rattus norvegicus
ggatgctttgcacaaacttcataaa

SEQ ID NO: 433213 - DNA, 25 bp, Rattus norvegicus
ggatgctttgcagaaacttcataaa

SEQ ID NO: 433214 - DNA, 25 bp, Rattus norvegicus
ggatgctttgtgaccttagaccagt

SEQ ID NO: 433215 - DNA, 25 bp, Rattus norvegicus
ggatgctttgtgtccttagaccagt

SEQ ID NO: 433216 - DNA, 25 bp, Rattus norvegicus
ggatggaaactaatgccctcctgtc

SEQ ID NO: 433217 - DNA, 25 bp, Rattus norvegicus
ggatggaaactattgccctcctgtc

SEQ ID NO: 433218 - DNA, 25 bp, Rattus norvegicus
ggatggaaatgacgctccctttgag

SEQ ID NO: 433219 - DNA, 25 bp, Rattus norvegicus
ggatggaaatgaggctccctttgag

SEQ ID NO: 433220 - DNA, 25 bp, Rattus norvegicus
ggatggaaccaacagccttacacat

SEQ ID NO: 433221 - DNA, 25 bp, Rattus norvegicus
ggatggaaccaagagccttacacat

SEQ ID NO: 433222 - DNA, 25 bp, Rattus norvegicus
ggatggaaggatctctaccctctcc

SEQ ID NO: 433223 - DNA, 25 bp, Rattus norvegicus
ggatggaaggatgtctaccctctcc

SEQ ID NO: 433224 - DNA, 25 bp, Rattus norvegicus
ggatggaatactaacctcagggaca

SEQ ID NO: 433225 - DNA, 25 bp, Rattus norvegicus
ggatggaatacttacctcagggaca

SEQ ID NO: 433226 - DNA, 25 bp, Rattus norvegicus
ggatggaatcctacacttgtcctga

SEQ ID NO: 433227 - DNA, 25 bp, Rattus norvegicus
ggatggaatcctagtcacagcaaca

SEQ ID NO: 433228 - DNA, 25 bp, Rattus norvegicus
ggatggaatccttcacttgtcctga

SEQ ID NO: 433229 - DNA, 25 bp, Rattus norvegicus
ggatggaatccttgtcacagcaaca

SEQ ID NO: 433230 - DNA, 25 bp, Rattus norvegicus
ggatggaatgtcattactaatcgag

SEQ ID NO: 433231 - DNA, 25 bp, Rattus norvegicus
ggatggaatgtctttactaatcgag

SEQ ID NO: 433232 - DNA, 25 bp, Rattus norvegicus
ggatggaatgttcctgagcccacct

SEQ ID NO: 433233 - DNA, 25 bp, Rattus norvegicus
ggatggaatgttgctgagcccacct

SEQ ID NO: 433234 - DNA, 25 bp, Rattus norvegicus
ggatggacaagacccagcgctctgt

SEQ ID NO: 433235 - DNA, 25 bp, Rattus norvegicus
ggatggacaagagccagcgctctgt

SEQ ID NO: 433236 - DNA, 25 bp, Rattus norvegicus
ggatggacatttaccagttttcttt

SEQ ID NO: 433237 - DNA, 25 bp, Rattus norvegicus
ggatggacatttagccctggaagag

SEQ ID NO: 433238 - DNA, 25 bp, Rattus norvegicus
ggatggacattttccagttttcttt

SEQ ID NO: 433239 - DNA, 25 bp, Rattus norvegicus
ggatggacattttgccctggaagag

SEQ ID NO: 433240 - DNA, 25 bp, Rattus norvegicus
ggatggaccaataccctgttataca

SEQ ID NO: 433241 - DNA, 25 bp, Rattus norvegicus
ggatggaccaattccctgttataca

SEQ ID NO: 433242 - DNA, 25 bp, Rattus norvegicus
ggatggaccatcatttctaaaacaa

SEQ ID NO: 433243 - DNA, 25 bp, Rattus norvegicus
ggatggaccatcttttctaaaacaa

SEQ ID NO: 433244 - DNA, 25 bp, Rattus norvegicus
ggatggaccctgagaagctagcaat

SEQ ID NO: 433245 - DNA, 25 bp, Rattus norvegicus
ggatggaccctgtgaagctagcaat

SEQ ID NO: 433246 - DNA, 25 bp, Rattus norvegicus
ggatggaccgtgacacatgttcaga

SEQ ID NO: 433247 - DNA, 25 bp, Rattus norvegicus
ggatggaccgtgtcacatgttcaga

SEQ ID NO: 433248 - DNA, 25 bp, Rattus norvegicus
ggatggacctgtcatgtcattatca

SEQ ID NO: 433249 - DNA, 25 bp, Rattus norvegicus
ggatggacctgtgatgtcattatca

SEQ ID NO: 433250 - DNA, 25 bp, Rattus norvegicus
ggatggacctttactataactgttt

SEQ ID NO: 433251 - DNA, 25 bp, Rattus norvegicus
ggatggaccttttctataactgttt

SEQ ID NO: 433252 - DNA, 25 bp, Rattus norvegicus
ggatggacgctcattgtgttttttg

SEQ ID NO: 433253 - DNA, 25 bp, Rattus norvegicus
ggatggacgctctttgtgttttttg

SEQ ID NO: 433254 - DNA, 25 bp, Rattus norvegicus
ggatggactaatcagctctatgatt

SEQ ID NO: 433255 - DNA, 25 bp, Rattus norvegicus
ggatggactaatgagctctatgatt

SEQ ID NO: 433256 - DNA, 25 bp, Rattus norvegicus
ggatggactcaaaccagagctgcaa

SEQ ID NO: 433257 - DNA, 25 bp, Rattus norvegicus
ggatggactcaatccagagctgcaa

SEQ ID NO: 433258 - DNA, 25 bp, Rattus norvegicus
ggatggactcatactccagcaggct

SEQ ID NO: 433259 - DNA, 25 bp, Rattus norvegicus
ggatggactcattctccagcaggct

SEQ ID NO: 433260 - DNA, 25 bp, Rattus norvegicus
ggatggactcctaagtggacttgac

SEQ ID NO: 433261 - DNA, 25 bp, Rattus norvegicus
ggatggactccttagtggacttgac

SEQ ID NO: 433262 - DNA, 25 bp, Rattus norvegicus
ggatggacttctctaggcaagtttt

SEQ ID NO: 433263 - DNA, 25 bp, Rattus norvegicus
ggatggacttctgtaggcaagtttt

SEQ ID NO: 433264 - DNA, 25 bp, Rattus norvegicus
ggatggacttggcactctgtgtaat

SEQ ID NO: 433265 - DNA, 25 bp, Rattus norvegicus
ggatggacttgggactctgtgtaat

SEQ ID NO: 433266 - DNA, 25 bp, Rattus norvegicus
ggatggagaaatacttggaccttta

SEQ ID NO: 433267 - DNA, 25 bp, Rattus norvegicus
ggatggagaaattcttggaccttta

SEQ ID NO: 433268 - DNA, 25 bp, Rattus norvegicus
ggatggagacaacatcagaactcaa

SEQ ID NO: 433269 - DNA, 25 bp, Rattus norvegicus
ggatggagacaagatcagaactcaa

SEQ ID NO: 433270 - DNA, 25 bp, Rattus norvegicus
ggatggagaccacactttcaaagag

SEQ ID NO: 433271 - DNA, 25 bp, Rattus norvegicus
ggatggagaccacagtctcccagtg

SEQ ID NO: 433272 - DNA, 25 bp, Rattus norvegicus
ggatggagaccacccactctggata

SEQ ID NO: 433273 - DNA, 25 bp, Rattus norvegicus
ggatggagaccagactttcaaagag

SEQ ID NO: 433274 - DNA, 25 bp, Rattus norvegicus
ggatggagaccagagtctcccagtg

SEQ ID NO: 433275 - DNA, 25 bp, Rattus norvegicus
ggatggagaccagccactctggata

SEQ ID NO: 433276 - DNA, 25 bp, Rattus norvegicus
ggatggagctcaccccgatgaatac

SEQ ID NO: 433277 - DNA, 25 bp, Rattus norvegicus
ggatggagctcagcccgatgaatac

SEQ ID NO: 433278 - DNA, 25 bp, Rattus norvegicus
ggatggagctccatgatctagaaac

SEQ ID NO: 433279 - DNA, 25 bp, Rattus norvegicus
ggatggagctccttgatctagaaac

SEQ ID NO: 433280 - DNA, 25 bp, Rattus norvegicus
ggatggaggcttaattcctctaaac

SEQ ID NO: 433281 - DNA, 25 bp, Rattus norvegicus
ggatggaggctttattcctctaaac

SEQ ID NO: 433282 - DNA, 25 bp, Rattus norvegicus
ggatggaggtgactgcgttcgcggc

SEQ ID NO: 433283 - DNA, 25 bp, Rattus norvegicus
ggatggaggtgagtgcgttcgcggc

SEQ ID NO: 433284 - DNA, 25 bp, Rattus norvegicus
ggatggagtcccattcttccggaat

SEQ ID NO: 433285 - DNA, 25 bp, Rattus norvegicus
ggatggagtccctttcttccggaat

SEQ ID NO: 433286 - DNA, 25 bp, Rattus norvegicus
ggatggagtctcaccacttccactg

SEQ ID NO: 433287 - DNA, 25 bp, Rattus norvegicus
ggatggagtctctccacttccactg

SEQ ID NO: 433288 - DNA, 25 bp, Rattus norvegicus
ggatggatacctactgacttccctt

SEQ ID NO: 433289 - DNA, 25 bp, Rattus norvegicus
ggatggataccttctgacttccctt

SEQ ID NO: 433290 - DNA, 25 bp, Rattus norvegicus
ggatggatatacacgtctggcttaa

SEQ ID NO: 433291 - DNA, 25 bp, Rattus norvegicus
ggatggatatactcgtctggcttaa

SEQ ID NO: 433292 - DNA, 25 bp, Rattus norvegicus
ggatggatgaagagtacaacctctt

SEQ ID NO: 433293 - DNA, 25 bp, Rattus norvegicus
ggatggatgaagtgtacaacctctt

SEQ ID NO: 433294 - DNA, 25 bp, Rattus norvegicus
ggatggattagcatggtcttaaaat

SEQ ID NO: 433295 - DNA, 25 bp, Rattus norvegicus
ggatggattagcttggtcttaaaat

SEQ ID NO: 433296 - DNA, 25 bp, Rattus norvegicus
ggatggattccacaattgtgctgaa

SEQ ID NO: 433297 - DNA, 25 bp, Rattus norvegicus
ggatggattccagaattgtgctgaa

SEQ ID NO: 433298 - DNA, 25 bp, Rattus norvegicus
ggatggattcttaccttagtctaac

SEQ ID NO: 433299 - DNA, 25 bp, Rattus norvegicus
ggatggattcttcctaagaccgcta

SEQ ID NO: 433300 - DNA, 25 bp, Rattus norvegicus
ggatggattcttgctaagaccgcta

SEQ ID NO: 433301 - DNA, 25 bp, Rattus norvegicus
ggatggattctttccttagtctaac

SEQ ID NO: 433302 - DNA, 25 bp, Rattus norvegicus
ggatggattgtcatgtcctgctgcc

SEQ ID NO: 433303 - DNA, 25 bp, Rattus norvegicus
ggatggattgtcttgtcctgctgcc

SEQ ID NO: 433304 - DNA, 25 bp, Rattus norvegicus
ggatggatttccatggccgttggac

SEQ ID NO: 433305 - DNA, 25 bp, Rattus norvegicus
ggatggatttccttggccgttggac

SEQ ID NO: 433306 - DNA, 25 bp, Rattus norvegicus
ggatggcaaactccttcagctccaa

SEQ ID NO: 433307 - DNA, 25 bp, Rattus norvegicus
ggatggcaaactgcttcagctccaa

SEQ ID NO: 433308 - DNA, 25 bp, Rattus norvegicus
ggatggcaagatagacctgtgtcag

SEQ ID NO: 433309 - DNA, 25 bp, Rattus norvegicus
ggatggcaagattgacctgtgtcag

SEQ ID NO: 433310 - DNA, 25 bp, Rattus norvegicus
ggatggcaccatactgtagactgga

SEQ ID NO: 433311 - DNA, 25 bp, Rattus norvegicus
ggatggcaccatagctccttacaag

SEQ ID NO: 433312 - DNA, 25 bp, Rattus norvegicus
ggatggcaccattctgtagactgga

SEQ ID NO: 433313 - DNA, 25 bp, Rattus norvegicus
ggatggcaccattgctccttacaag

SEQ ID NO: 433314 - DNA, 25 bp, Rattus norvegicus
ggatggcactacatacagtggtctg

SEQ ID NO: 433315 - DNA, 25 bp, Rattus norvegicus
ggatggcactacttacagtggtctg

SEQ ID NO: 433316 - DNA, 25 bp, Rattus norvegicus
ggatggcagtagacagtcatggcaa

SEQ ID NO: 433317 - DNA, 25 bp, Rattus norvegicus
ggatggcagtagtcagtcatggcaa

SEQ ID NO: 433318 - DNA, 25 bp, Rattus norvegicus
ggatggcagtgtaacaagccggtaa

SEQ ID NO: 433319 - DNA, 25 bp, Rattus norvegicus
ggatggcagtgttacaagccggtaa

SEQ ID NO: 433320 - DNA, 25 bp, Rattus norvegicus
ggatggcataacctgcattactatg

SEQ ID NO: 433321 - DNA, 25 bp, Rattus norvegicus
ggatggcataacgtgcattactatg

SEQ ID NO: 433322 - DNA, 25 bp, Rattus norvegicus
ggatggcatcaaatgcaaacccgaa

SEQ ID NO: 433323 - DNA, 25 bp, Rattus norvegicus
ggatggcatcaattgcaaacccgaa

SEQ ID NO: 433324 - DNA, 25 bp, Rattus norvegicus
ggatggcatgaccagctagcaccaa

SEQ ID NO: 433325 - DNA, 25 bp, Rattus norvegicus
ggatggcatgacgagctagcaccaa

SEQ ID NO: 433326 - DNA, 25 bp, Rattus norvegicus
ggatggccacaactacagtctacat

SEQ ID NO: 433327 - DNA, 25 bp, Rattus norvegicus
ggatggccacaagtacagtctacat

SEQ ID NO: 433328 - DNA, 25 bp, Rattus norvegicus
ggatggcccaatcgtcaggagccct

SEQ ID NO: 433329 - DNA, 25 bp, Rattus norvegicus
ggatggcccaatggtcaggagccct

SEQ ID NO: 433330 - DNA, 25 bp, Rattus norvegicus
ggatggcccacaagcagatctacta

SEQ ID NO: 433331 - DNA, 25 bp, Rattus norvegicus
ggatggcccacatgcagatctacta

SEQ ID NO: 433332 - DNA, 25 bp, Rattus norvegicus
ggatggcccaggatctcagtgagaa

SEQ ID NO: 433333 - DNA, 25 bp, Rattus norvegicus
ggatggcccaggttctcagtgagaa

SEQ ID NO: 433334 - DNA, 25 bp, Rattus norvegicus
ggatggccccttagatgaggatttc

SEQ ID NO: 433335 - DNA, 25 bp, Rattus norvegicus
ggatggcccctttgatgaggatttc

SEQ ID NO: 433336 - DNA, 25 bp, Rattus norvegicus
ggatggccctggcaacatgcctccg

SEQ ID NO: 433337 - DNA, 25 bp, Rattus norvegicus
ggatggccctgggaacatgcctccg

SEQ ID NO: 433338 - DNA, 25 bp, Rattus norvegicus
ggatggccgccactaacaaagacaa

SEQ ID NO: 433339 - DNA, 25 bp, Rattus norvegicus
ggatggccgccagtaacaaagacaa

SEQ ID NO: 433340 - DNA, 25 bp, Rattus norvegicus
ggatggccgcccaatgaacatccag

SEQ ID NO: 433341 - DNA, 25 bp, Rattus norvegicus
ggatggccgccctatgaacatccag

SEQ ID NO: 433342 - DNA, 25 bp, Rattus norvegicus
ggatggccgctaatctgtggactac

SEQ ID NO: 433343 - DNA, 25 bp, Rattus norvegicus
ggatggccgctattctgtggactac

SEQ ID NO: 433344 - DNA, 25 bp, Rattus norvegicus
ggatggcctcatcggtgtgatctac

SEQ ID NO: 433345 - DNA, 25 bp, Rattus norvegicus
ggatggcctcatgggtgtgatctac

SEQ ID NO: 433346 - DNA, 25 bp, Rattus norvegicus
ggatggcgataacgcgcccgtcttt

SEQ ID NO: 433347 - DNA, 25 bp, Rattus norvegicus
ggatggcgataaggcgcccgtcttt

SEQ ID NO: 433348 - DNA, 25 bp, Rattus norvegicus
ggatggcggcgaaccttgtagccca

SEQ ID NO: 433349 - DNA, 25 bp, Rattus norvegicus
ggatggcggcgatccttgtagccca

SEQ ID NO: 433350 - DNA, 25 bp, Rattus norvegicus
ggatggcgtcctactgaaacaaaac

SEQ ID NO: 433351 - DNA, 25 bp, Rattus norvegicus
ggatggcgtccttctgaaacaaaac

SEQ ID NO: 433352 - DNA, 25 bp, Rattus norvegicus
ggatggctatgacctcccaaacagc

SEQ ID NO: 433353 - DNA, 25 bp, Rattus norvegicus
ggatggctatgagctcccaaacagc

SEQ ID NO: 433354 - DNA, 25 bp, Rattus norvegicus
ggatggctccaacaaacgtgatgtt

SEQ ID NO: 433355 - DNA, 25 bp, Rattus norvegicus
ggatggctccaagaaacgtgatgtt

SEQ ID NO: 433356 - DNA, 25 bp, Rattus norvegicus
ggatggctcggtcaaagtcagaact

SEQ ID NO: 433357 - DNA, 25 bp, Rattus norvegicus
ggatggctcggtgaaagtcagaact

SEQ ID NO: 433358 - DNA, 25 bp, Rattus norvegicus
ggatggctcgtgagcagcgtaaatc

SEQ ID NO: 433359 - DNA, 25 bp, Rattus norvegicus
ggatggctcgtgtgcagcgtaaatc

SEQ ID NO: 433360 - DNA, 25 bp, Rattus norvegicus
ggatggctctccaaggcgcaaaggc

SEQ ID NO: 433361 - DNA, 25 bp, Rattus norvegicus
ggatggctctcctaggcgcaaaggc

SEQ ID NO: 433362 - DNA, 25 bp, Rattus norvegicus
ggatggctctgtcgtactcaacgga

SEQ ID NO: 433363 - DNA, 25 bp, Rattus norvegicus
ggatggctctgtggtactcaacgga

SEQ ID NO: 433364 - DNA, 25 bp, Rattus norvegicus
ggatggctgcctatcatatgaatac

SEQ ID NO: 433365 - DNA, 25 bp, Rattus norvegicus
ggatggctgcctttcatatgaatac

SEQ ID NO: 433366 - DNA, 25 bp, Rattus norvegicus
ggatggcttcatcttcagtaacaca

SEQ ID NO: 433367 - DNA, 25 bp, Rattus norvegicus
ggatggcttcatgttcagtaacaca

SEQ ID NO: 433368 - DNA, 25 bp, Rattus norvegicus
ggatggcttcgtatcagatggctct

SEQ ID NO: 433369 - DNA, 25 bp, Rattus norvegicus
ggatggcttcgtttcagatggctct

SEQ ID NO: 433370 - DNA, 25 bp, Rattus norvegicus
ggatggcttcttattacctagtaag

SEQ ID NO: 433371 - DNA, 25 bp, Rattus norvegicus
ggatggcttctttttacctagtaag

SEQ ID NO: 433372 - DNA, 25 bp, Rattus norvegicus
ggatggctttctacaaaaattgaga

SEQ ID NO: 433373 - DNA, 25 bp, Rattus norvegicus
ggatggctttcttcaaaaattgaga

SEQ ID NO: 433374 - DNA, 25 bp, Rattus norvegicus
ggatgggaagtcattggccacttta

SEQ ID NO: 433375 - DNA, 25 bp, Rattus norvegicus
ggatgggaagtctttggccacttta

SEQ ID NO: 433376 - DNA, 25 bp, Rattus norvegicus
ggatgggaatgccacctttttcttg

SEQ ID NO: 433377 - DNA, 25 bp, Rattus norvegicus
ggatgggaatgcgacctttttcttg

SEQ ID NO: 433378 - DNA, 25 bp, Rattus norvegicus
ggatgggacatacaagttctgcttt

SEQ ID NO: 433379 - DNA, 25 bp, Rattus norvegicus
ggatgggacatagaagttctgcttt

SEQ ID NO: 433380 - DNA, 25 bp, Rattus norvegicus
ggatgggaccatcaatctctccgag

SEQ ID NO: 433381 - DNA, 25 bp, Rattus norvegicus
ggatgggaccatgaatctctccgag

SEQ ID NO: 433382 - DNA, 25 bp, Rattus norvegicus
ggatgggaccttcgcaagcctgctt

SEQ ID NO: 433383 - DNA, 25 bp, Rattus norvegicus
ggatgggaccttggcaagcctgctt

SEQ ID NO: 433384 - DNA, 25 bp, Rattus norvegicus
ggatgggatgaaccactcttaacta

SEQ ID NO: 433385 - DNA, 25 bp, Rattus norvegicus
ggatgggatgaagcactcttaacta

SEQ ID NO: 433386 - DNA, 25 bp, Rattus norvegicus
ggatgggcatggcaccaagacctcc

SEQ ID NO: 433387 - DNA, 25 bp, Rattus norvegicus
ggatgggcatgggaccaagacctcc

SEQ ID NO: 433388 - DNA, 25 bp, Rattus norvegicus
ggatgggctcttaaagcaccattta

SEQ ID NO: 433389 - DNA, 25 bp, Rattus norvegicus
ggatgggctctttaagcaccattta

SEQ ID NO: 433390 - DNA, 25 bp, Rattus norvegicus
ggatgggctgccaggccgatccatt

SEQ ID NO: 433391 - DNA, 25 bp, Rattus norvegicus
ggatgggctgcctggccgatccatt

SEQ ID NO: 433392 - DNA, 25 bp, Rattus norvegicus
ggatgggcttgtatttcaccgtctt

SEQ ID NO: 433393 - DNA, 25 bp, Rattus norvegicus
ggatgggcttgtttttcaccgtctt

SEQ ID NO: 433394 - DNA, 25 bp, Rattus norvegicus
ggatgggcttttctgttctaagttt

SEQ ID NO: 433395 - DNA, 25 bp, Rattus norvegicus
ggatgggcttttgtgttctaagttt

SEQ ID NO: 433396 - DNA, 25 bp, Rattus norvegicus
ggatgggggaacacccttacagaag

SEQ ID NO: 433397 - DNA, 25 bp, Rattus norvegicus
ggatgggggaactcccttacagaag

SEQ ID NO: 433398 - DNA, 25 bp, Rattus norvegicus
ggatgggtaactaccttctacattt

SEQ ID NO: 433399 - DNA, 25 bp, Rattus norvegicus
ggatgggtaacttccttctacattt

SEQ ID NO: 433400 - DNA, 25 bp, Rattus norvegicus
ggatgggtactcagtcctgtgcttc

SEQ ID NO: 433401 - DNA, 25 bp, Rattus norvegicus
ggatgggtactctgtcctgtgcttc

SEQ ID NO: 433402 - DNA, 25 bp, Rattus norvegicus
ggatgggtagctcactgcacaacca

SEQ ID NO: 433403 - DNA, 25 bp, Rattus norvegicus
ggatgggtagctgactgcacaacca

SEQ ID NO: 433404 - DNA, 25 bp, Rattus norvegicus
ggatgggtccaacgttccctctgat

SEQ ID NO: 433405 - DNA, 25 bp, Rattus norvegicus
ggatgggtccaaggttccctctgat

SEQ ID NO: 433406 - DNA, 25 bp, Rattus norvegicus
ggatgggtggacattcctcctcagg

SEQ ID NO: 433407 - DNA, 25 bp, Rattus norvegicus
ggatgggtggactttcctcctcagg

SEQ ID NO: 433408 - DNA, 25 bp, Rattus norvegicus
ggatgggtgtccaccaccaggagaa

SEQ ID NO: 433409 - DNA, 25 bp, Rattus norvegicus
ggatgggtgtcctccaccaggagaa

SEQ ID NO: 433410 - DNA, 25 bp, Rattus norvegicus
ggatgggttactcacttagcccctc

SEQ ID NO: 433411 - DNA, 25 bp, Rattus norvegicus
ggatgggttactgacttagcccctc

SEQ ID NO: 433412 - DNA, 25 bp, Rattus norvegicus
ggatggtagaaaccccaggacagct

SEQ ID NO: 433413 - DNA, 25 bp, Rattus norvegicus
ggatggtagaaagcccaggacagct

SEQ ID NO: 433414 - DNA, 25 bp, Rattus norvegicus
ggatggtagattactctggctgctc

SEQ ID NO: 433415 - DNA, 25 bp, Rattus norvegicus
ggatggtagatttctctggctgctc

SEQ ID NO: 433416 - DNA, 25 bp, Rattus norvegicus
ggatggtattgtcgtacaggccttt

SEQ ID NO: 433417 - DNA, 25 bp, Rattus norvegicus
ggatggtattgtggtacaggccttt

SEQ ID NO: 433418 - DNA, 25 bp, Rattus norvegicus
ggatggtcaatgacccagaattctg

SEQ ID NO: 433419 - DNA, 25 bp, Rattus norvegicus
ggatggtcaatgtcccagaattctg

SEQ ID NO: 433420 - DNA, 25 bp, Rattus norvegicus
ggatggtcacctcgagtctaagcta

SEQ ID NO: 433421 - DNA, 25 bp, Rattus norvegicus
ggatggtcacctggagtctaagcta

SEQ ID NO: 433422 - DNA, 25 bp, Rattus norvegicus
ggatggtcagcaactgctcctggaa

SEQ ID NO: 433423 - DNA, 25 bp, Rattus norvegicus
ggatggtcagcatctgctcctggaa

SEQ ID NO: 433424 - DNA, 25 bp, Rattus norvegicus
ggatggtcatccaattagtctacta

SEQ ID NO: 433425 - DNA, 25 bp, Rattus norvegicus
ggatggtcatcctattagtctacta

SEQ ID NO: 433426 - DNA, 25 bp, Rattus norvegicus
ggatggtcatttacaaaagtgcggg

SEQ ID NO: 433427 - DNA, 25 bp, Rattus norvegicus
ggatggtcattttcaaaagtgcggg

SEQ ID NO: 433428 - DNA, 25 bp, Rattus norvegicus
ggatggtcctgacgcaccacggcca

SEQ ID NO: 433429 - DNA, 25 bp, Rattus norvegicus
ggatggtcctgaggcaccacggcca

SEQ ID NO: 433430 - DNA, 25 bp, Rattus norvegicus
ggatggtcgtttaaatctctcattg

SEQ ID NO: 433431 - DNA, 25 bp, Rattus norvegicus
ggatggtcgttttaatctctcattg

SEQ ID NO: 433432 - DNA, 25 bp, Rattus norvegicus
ggatggtctatgagcactactcgtc

SEQ ID NO: 433433 - DNA, 25 bp, Rattus norvegicus
ggatggtctatgtgcactactcgtc

SEQ ID NO: 433434 - DNA, 25 bp, Rattus norvegicus
ggatggtctcaaacttggaatcttt

SEQ ID NO: 433435 - DNA, 25 bp, Rattus norvegicus
ggatggtctcaatcttggaatcttt

SEQ ID NO: 433436 - DNA, 25 bp, Rattus norvegicus
ggatggtctccaaactgtcagaaca

SEQ ID NO: 433437 - DNA, 25 bp, Rattus norvegicus
ggatggtctccatactgtcagaaca

SEQ ID NO: 433438 - DNA, 25 bp, Rattus norvegicus
ggatggtcttaacttttcctgccag

SEQ ID NO: 433439 - DNA, 25 bp, Rattus norvegicus
ggatggtcttaagttttcctgccag

SEQ ID NO: 433440 - DNA, 25 bp, Rattus norvegicus
ggatggtcttcaagaatgcttcaag

SEQ ID NO: 433441 - DNA, 25 bp, Rattus norvegicus
ggatggtcttcatgaatgcttcaag

SEQ ID NO: 433442 - DNA, 25 bp, Rattus norvegicus
ggatggtgccatacaagcctttgac

SEQ ID NO: 433443 - DNA, 25 bp, Rattus norvegicus
ggatggtgccattcaagcctttgac

SEQ ID NO: 433444 - DNA, 25 bp, Rattus norvegicus
ggatggtgcctcagggccaacttga

SEQ ID NO: 433445 - DNA, 25 bp, Rattus norvegicus
ggatggtgcctctgggccaacttga

SEQ ID NO: 433446 - DNA, 25 bp, Rattus norvegicus
ggatggtggatcacccacctcagtt

SEQ ID NO: 433447 - DNA, 25 bp, Rattus norvegicus
ggatggtggatctcccacctcagtt

SEQ ID NO: 433448 - DNA, 25 bp, Rattus norvegicus
ggatggtggcacacaacactttgtt

SEQ ID NO: 433449 - DNA, 25 bp, Rattus norvegicus
ggatggtggcactcaacactttgtt

SEQ ID NO: 433450 - DNA, 25 bp, Rattus norvegicus
ggatggtgtcagagccttcctggca

SEQ ID NO: 433451 - DNA, 25 bp, Rattus norvegicus
ggatggtgtcagtgccttcctggca

SEQ ID NO: 433452 - DNA, 25 bp, Rattus norvegicus
ggatggttaccaacatcggctacac

SEQ ID NO: 433453 - DNA, 25 bp, Rattus norvegicus
ggatggttaccatcatcggctacac

SEQ ID NO: 433454 - DNA, 25 bp, Rattus norvegicus
ggatggttatttctctctcagtaaa

SEQ ID NO: 433455 - DNA, 25 bp, Rattus norvegicus
ggatggttatttgtctctcagtaaa

SEQ ID NO: 433456 - DNA, 25 bp, Rattus norvegicus
ggatggttcattcgtaattgcactt

SEQ ID NO: 433457 - DNA, 25 bp, Rattus norvegicus
ggatggttcattctgttccacagtg

SEQ ID NO: 433458 - DNA, 25 bp, Rattus norvegicus
ggatggttcattggtaattgcactt

SEQ ID NO: 433459 - DNA, 25 bp, Rattus norvegicus
ggatggttcattgtgttccacagtg

SEQ ID NO: 433460 - DNA, 25 bp, Rattus norvegicus
ggatggttcctgactgagccagtac

SEQ ID NO: 433461 - DNA, 25 bp, Rattus norvegicus
ggatggttcctgtctgagccagtac

SEQ ID NO: 433462 - DNA, 25 bp, Rattus norvegicus
ggatggttccttaccttatgattcg

SEQ ID NO: 433463 - DNA, 25 bp, Rattus norvegicus
ggatggttcctttccttatgattcg

SEQ ID NO: 433464 - DNA, 25 bp, Rattus norvegicus
ggatggttctacaaatgcacagtca

SEQ ID NO: 433465 - DNA, 25 bp, Rattus norvegicus
ggatggttctactaatgcacagtca

SEQ ID NO: 433466 - DNA, 25 bp, Rattus norvegicus
ggatggtttcagaaagtccccaagt

SEQ ID NO: 433467 - DNA, 25 bp, Rattus norvegicus
ggatggtttcagtaagtccccaagt

SEQ ID NO: 433468 - DNA, 25 bp, Rattus norvegicus
ggatggttttctatcctctaatgga

SEQ ID NO: 433469 - DNA, 25 bp, Rattus norvegicus
ggatggttttctttcctctaatgga

SEQ ID NO: 433470 - DNA, 25 bp, Rattus norvegicus
ggatgtaaacatactcctgcacttt

SEQ ID NO: 433471 - DNA, 25 bp, Rattus norvegicus
ggatgtaaacattctcctgcacttt

SEQ ID NO: 433472 - DNA, 25 bp, Rattus norvegicus
ggatgtaaacccagcagtgagccct

SEQ ID NO: 433473 - DNA, 25 bp, Rattus norvegicus
ggatgtaaaccctgcagtgagccct

SEQ ID NO: 433474 - DNA, 25 bp, Rattus norvegicus
ggatgtaaccacaactgaacagttt

SEQ ID NO: 433475 - DNA, 25 bp, Rattus norvegicus
ggatgtaaccactactgaacagttt

SEQ ID NO: 433476 - DNA, 25 bp, Rattus norvegicus
ggatgtaactataaccttcttacta

SEQ ID NO: 433477 - DNA, 25 bp, Rattus norvegicus
ggatgtaactattaccttcttacta

SEQ ID NO: 433478 - DNA, 25 bp, Rattus norvegicus
ggatgtaactgacaaaagctttaac

SEQ ID NO: 433479 - DNA, 25 bp, Rattus norvegicus
ggatgtaactgagaaaagctttaac

SEQ ID NO: 433480 - DNA, 25 bp, Rattus norvegicus
ggatgtaatgtaaggtcaactcttt

SEQ ID NO: 433481 - DNA, 25 bp, Rattus norvegicus
ggatgtaatgtatggtcaactcttt

SEQ ID NO: 433482 - DNA, 25 bp, Rattus norvegicus
ggatgtacacagacttccattggta

SEQ ID NO: 433483 - DNA, 25 bp, Rattus norvegicus
ggatgtacacagtcttccattggta

SEQ ID NO: 433484 - DNA, 25 bp, Rattus norvegicus
ggatgtacagtgcattctcagtcag

SEQ ID NO: 433485 - DNA, 25 bp, Rattus norvegicus
ggatgtacagtggattctcagtcag

SEQ ID NO: 433486 - DNA, 25 bp, Rattus norvegicus
ggatgtacccagacctgtcagaatt

SEQ ID NO: 433487 - DNA, 25 bp, Rattus norvegicus
ggatgtacccagtcctgtcagaatt

SEQ ID NO: 433488 - DNA, 25 bp, Rattus norvegicus
ggatgtaccctgcataacctgaaac

SEQ ID NO: 433489 - DNA, 25 bp, Rattus norvegicus
ggatgtaccctggataacctgaaac

SEQ ID NO: 433490 - DNA, 25 bp, Rattus norvegicus
ggatgtaccttaagtcctgctcata

SEQ ID NO: 433491 - DNA, 25 bp, Rattus norvegicus
ggatgtaccttatgtcctgctcata

SEQ ID NO: 433492 - DNA, 25 bp, Rattus norvegicus
ggatgtacctttattctcccatgtg

SEQ ID NO: 433493 - DNA, 25 bp, Rattus norvegicus
ggatgtaccttttttctcccatgtg

SEQ ID NO: 433494 - DNA, 25 bp, Rattus norvegicus
ggatgtacgattacaccgcgcagaa

SEQ ID NO: 433495 - DNA, 25 bp, Rattus norvegicus
ggatgtacgatttcaccgcgcagaa

SEQ ID NO: 433496 - DNA, 25 bp, Rattus norvegicus
ggatgtactaacaggcagccgggtc

SEQ ID NO: 433497 - DNA, 25 bp, Rattus norvegicus
ggatgtactaactggcagccgggtc

SEQ ID NO: 433498 - DNA, 25 bp, Rattus norvegicus
ggatgtactacacttttgtcattca

SEQ ID NO: 433499 - DNA, 25 bp, Rattus norvegicus
ggatgtactacagttttgtcattca

SEQ ID NO: 433500 - DNA, 25 bp, Rattus norvegicus
ggatgtactcttactttacacagct

SEQ ID NO: 433501 - DNA, 25 bp, Rattus norvegicus
ggatgtactctttctttacacagct

SEQ ID NO: 433502 - DNA, 25 bp, Rattus norvegicus
ggatgtactgacaacaccaccccaa

SEQ ID NO: 433503 - DNA, 25 bp, Rattus norvegicus
ggatgtactgaccaatcgcagcaga

SEQ ID NO: 433504 - DNA, 25 bp, Rattus norvegicus
ggatgtactgacgaatcgcagcaga

SEQ ID NO: 433505 - DNA, 25 bp, Rattus norvegicus
ggatgtactgactacaccaccccaa

SEQ ID NO: 433506 - DNA, 25 bp, Rattus norvegicus
ggatgtactgccctaaggacttcgg

SEQ ID NO: 433507 - DNA, 25 bp, Rattus norvegicus
ggatgtactgccgtaaggacttcgg

SEQ ID NO: 433508 - DNA, 25 bp, Rattus norvegicus
ggatgtacttcaagcctgacacgat

SEQ ID NO: 433509 - DNA, 25 bp, Rattus norvegicus
ggatgtacttcatgcctgacacgat

SEQ ID NO: 433510 - DNA, 25 bp, Rattus norvegicus
ggatgtagactcactggtcattgaa

SEQ ID NO: 433511 - DNA, 25 bp, Rattus norvegicus
ggatgtagactctctggtcattgaa

SEQ ID NO: 433512 - DNA, 25 bp, Rattus norvegicus
ggatgtagcactcgaggctgaccta

SEQ ID NO: 433513 - DNA, 25 bp, Rattus norvegicus
ggatgtagcactggaggctgaccta

SEQ ID NO: 433514 - DNA, 25 bp, Rattus norvegicus
ggatgtagcagcatactgggccaaa

SEQ ID NO: 433515 - DNA, 25 bp, Rattus norvegicus
ggatgtagcagcttactgggccaaa

SEQ ID NO: 433516 - DNA, 25 bp, Rattus norvegicus
ggatgtagctagagttggccctgcc

SEQ ID NO: 433517 - DNA, 25 bp, Rattus norvegicus
ggatgtagctagtgttggccctgcc

SEQ ID NO: 433518 - DNA, 25 bp, Rattus norvegicus
ggatgtagctcacggcctcatctgc

SEQ ID NO: 433519 - DNA, 25 bp, Rattus norvegicus
ggatgtagctcagggcctcatctgc

SEQ ID NO: 433520 - DNA, 25 bp, Rattus norvegicus
ggatgtaggctaccatttggccatg

SEQ ID NO: 433521 - DNA, 25 bp, Rattus norvegicus
ggatgtaggctagcatttggccatg

SEQ ID NO: 433522 - DNA, 25 bp, Rattus norvegicus
ggatgtagtcacacgagtctgcctc

SEQ ID NO: 433523 - DNA, 25 bp, Rattus norvegicus
ggatgtagtcactcgagtctgcctc

SEQ ID NO: 433524 - DNA, 25 bp, Rattus norvegicus
ggatgtagtgtcctgttttatgcta

SEQ ID NO: 433525 - DNA, 25 bp, Rattus norvegicus
ggatgtagtgtcgtgttttatgcta

SEQ ID NO: 433526 - DNA, 25 bp, Rattus norvegicus
ggatgtatcaaaccatgcactgtga

SEQ ID NO: 433527 - DNA, 25 bp, Rattus norvegicus
ggatgtatcaaagcatgcactgtga

SEQ ID NO: 433528 - DNA, 25 bp, Rattus norvegicus
ggatgtatcatgctttctgcggctc

SEQ ID NO: 433529 - DNA, 25 bp, Rattus norvegicus
ggatgtatcatggtttctgcggctc

SEQ ID NO: 433530 - DNA, 25 bp, Rattus norvegicus
ggatgtatctgtcagacttcaccat

SEQ ID NO: 433531 - DNA, 25 bp, Rattus norvegicus
ggatgtatctgtgagacttcaccat

SEQ ID NO: 433532 - DNA, 25 bp, Rattus norvegicus
ggatgtatcttaaatattgggaact

SEQ ID NO: 433533 - DNA, 25 bp, Rattus norvegicus
ggatgtatcttatatattgggaact

SEQ ID NO: 433534 - DNA, 25 bp, Rattus norvegicus
ggatgtatcttgcttcatcccagct

SEQ ID NO: 433535 - DNA, 25 bp, Rattus norvegicus
ggatgtatcttggttcatcccagct

SEQ ID NO: 433536 - DNA, 25 bp, Rattus norvegicus
ggatgtatgaaacaacactggagaa

SEQ ID NO: 433537 - DNA, 25 bp, Rattus norvegicus
ggatgtatgaaagaacactggagaa

SEQ ID NO: 433538 - DNA, 25 bp, Rattus norvegicus
ggatgtattcgaccgccgaacgcag

SEQ ID NO: 433539 - DNA, 25 bp, Rattus norvegicus
ggatgtattcgagcgccgaacgcag

SEQ ID NO: 433540 - DNA, 25 bp, Rattus norvegicus
ggatgtattctgatgtctatagttc

SEQ ID NO: 433541 - DNA, 25 bp, Rattus norvegicus
ggatgtattctgttgtctatagttc

SEQ ID NO: 433542 - DNA, 25 bp, Rattus norvegicus
ggatgtatttatcgtctcacgctgc

SEQ ID NO: 433543 - DNA, 25 bp, Rattus norvegicus
ggatgtatttatggtctcacgctgc

SEQ ID NO: 433544 - DNA, 25 bp, Rattus norvegicus
ggatgtatttccattcacacactca

SEQ ID NO: 433545 - DNA, 25 bp, Rattus norvegicus
ggatgtatttcctttcacacactca

SEQ ID NO: 433546 - DNA, 25 bp, Rattus norvegicus
ggatgtattttcactcctgatactt

SEQ ID NO: 433547 - DNA, 25 bp, Rattus norvegicus
ggatgtattttctctcctgatactt

SEQ ID NO: 433548 - DNA, 25 bp, Rattus norvegicus
ggatgtcaacatacctttgggtatg

SEQ ID NO: 433549 - DNA, 25 bp, Rattus norvegicus
ggatgtcaacattcctttgggtatg

SEQ ID NO: 433550 - DNA, 25 bp, Rattus norvegicus
ggatgtcaaccaccattgtcaccag

SEQ ID NO: 433551 - DNA, 25 bp, Rattus norvegicus
ggatgtcaaccagcattgtcaccag

SEQ ID NO: 433552 - DNA, 25 bp, Rattus norvegicus
ggatgtcaacctaacagtgtatcaa

SEQ ID NO: 433553 - DNA, 25 bp, Rattus norvegicus
ggatgtcaaccttacagtgtatcaa

SEQ ID NO: 433554 - DNA, 25 bp, Rattus norvegicus
ggatgtcacaaaatgccagagcctc

SEQ ID NO: 433555 - DNA, 25 bp, Rattus norvegicus
ggatgtcacaaattgccagagcctc

SEQ ID NO: 433556 - DNA, 25 bp, Rattus norvegicus
ggatgtcacactacttctgtactta

SEQ ID NO: 433557 - DNA, 25 bp, Rattus norvegicus
ggatgtcacacttcttctgtactta

SEQ ID NO: 433558 - DNA, 25 bp, Rattus norvegicus
ggatgtcaccccaaggttttctgga

SEQ ID NO: 433559 - DNA, 25 bp, Rattus norvegicus
ggatgtcacccctaggttttctgga

SEQ ID NO: 433560 - DNA, 25 bp, Rattus norvegicus
ggatgtcactttatgtaactggtga

SEQ ID NO: 433561 - DNA, 25 bp, Rattus norvegicus
ggatgtcactttttgtaactggtga

SEQ ID NO: 433562 - DNA, 25 bp, Rattus norvegicus
ggatgtcaggaaactgtaaccagat

SEQ ID NO: 433563 - DNA, 25 bp, Rattus norvegicus
ggatgtcaggaatctgtaaccagat

SEQ ID NO: 433564 - DNA, 25 bp, Rattus norvegicus
ggatgtcagtccacattgtcaagaa

SEQ ID NO: 433565 - DNA, 25 bp, Rattus norvegicus
ggatgtcagtcctcattgtcaagaa

SEQ ID NO: 433566 - DNA, 25 bp, Rattus norvegicus
ggatgtcatcttagccgatgtggcc

SEQ ID NO: 433567 - DNA, 25 bp, Rattus norvegicus
ggatgtcatctttgccgatgtggcc

SEQ ID NO: 433568 - DNA, 25 bp, Rattus norvegicus
ggatgtcatttaacctccttactgc

SEQ ID NO: 433569 - DNA, 25 bp, Rattus norvegicus
ggatgtcatttatcctccttactgc

SEQ ID NO: 433570 - DNA, 25 bp, Rattus norvegicus
ggatgtcatttcagcagatcttgta

SEQ ID NO: 433571 - DNA, 25 bp, Rattus norvegicus
ggatgtcatttctgcagatcttgta

SEQ ID NO: 433572 - DNA, 25 bp, Rattus norvegicus
ggatgtccaaagaagaacaggcgag

SEQ ID NO: 433573 - DNA, 25 bp, Rattus norvegicus
ggatgtccaaagtagaacaggcgag

SEQ ID NO: 433574 - DNA, 25 bp, Rattus norvegicus
ggatgtccactaagactccaaagat

SEQ ID NO: 433575 - DNA, 25 bp, Rattus norvegicus
ggatgtccactatgactccaaagat

SEQ ID NO: 433576 - DNA, 25 bp, Rattus norvegicus
ggatgtccaggaacttatctataaa

SEQ ID NO: 433577 - DNA, 25 bp, Rattus norvegicus
ggatgtccaggacacaagcactgac

SEQ ID NO: 433578 - DNA, 25 bp, Rattus norvegicus
ggatgtccaggagacaagcactgac

SEQ ID NO: 433579 - DNA, 25 bp, Rattus norvegicus
ggatgtccaggatcttatctataaa

SEQ ID NO: 433580 - DNA, 25 bp, Rattus norvegicus
ggatgtccaggcatgcctctaaccc

SEQ ID NO: 433581 - DNA, 25 bp, Rattus norvegicus
ggatgtccaggcttgcctctaaccc

SEQ ID NO: 433582 - DNA, 25 bp, Rattus norvegicus
ggatgtccagttcaagacccaagga

SEQ ID NO: 433583 - DNA, 25 bp, Rattus norvegicus
ggatgtccagttgaagacccaagga

SEQ ID NO: 433584 - DNA, 25 bp, Rattus norvegicus
ggatgtccatggacctcatgggtct

SEQ ID NO: 433585 - DNA, 25 bp, Rattus norvegicus
ggatgtccatggtcctcatgggtct

SEQ ID NO: 433586 - DNA, 25 bp, Rattus norvegicus
ggatgtccatgtcccagctactgta

SEQ ID NO: 433587 - DNA, 25 bp, Rattus norvegicus
ggatgtccatgtgccagctactgta

SEQ ID NO: 433588 - DNA, 25 bp, Rattus norvegicus
ggatgtcccaatattaccatgattt

SEQ ID NO: 433589 - DNA, 25 bp, Rattus norvegicus
ggatgtcccaattttaccatgattt

SEQ ID NO: 433590 - DNA, 25 bp, Rattus norvegicus
ggatgtcccaggagctgtcaacagc

SEQ ID NO: 433591 - DNA, 25 bp, Rattus norvegicus
ggatgtcccaggtgctgtcaacagc

SEQ ID NO: 433592 - DNA, 25 bp, Rattus norvegicus
ggatgtcccataatatgagtggctg

SEQ ID NO: 433593 - DNA, 25 bp, Rattus norvegicus
ggatgtcccatattatgagtggctg

SEQ ID NO: 433594 - DNA, 25 bp, Rattus norvegicus
ggatgtccccttcacagagaaagat

SEQ ID NO: 433595 - DNA, 25 bp, Rattus norvegicus
ggatgtccccttgacagagaaagat

SEQ ID NO: 433596 - DNA, 25 bp, Rattus norvegicus
ggatgtccctggaactgtcaaggaa

SEQ ID NO: 433597 - DNA, 25 bp, Rattus norvegicus
ggatgtccctggtactgtcaaggaa

SEQ ID NO: 433598 - DNA, 25 bp, Rattus norvegicus
ggatgtccctttcaggttgttggct

SEQ ID NO: 433599 - DNA, 25 bp, Rattus norvegicus
ggatgtccctttgaggttgttggct

SEQ ID NO: 433600 - DNA, 25 bp, Rattus norvegicus
ggatgtccgcaaatcagcaagaatg

SEQ ID NO: 433601 - DNA, 25 bp, Rattus norvegicus
ggatgtccgcaattcagcaagaatg

SEQ ID NO: 433602 - DNA, 25 bp, Rattus norvegicus
ggatgtccggctatctgggaatcac

SEQ ID NO: 433603 - DNA, 25 bp, Rattus norvegicus
ggatgtccggctttctgggaatcac

SEQ ID NO: 433604 - DNA, 25 bp, Rattus norvegicus
ggatgtcctaagaggcagttcaata

SEQ ID NO: 433605 - DNA, 25 bp, Rattus norvegicus
ggatgtcctaagtggcagttcaata

SEQ ID NO: 433606 - DNA, 25 bp, Rattus norvegicus
ggatgtcctccacgctttgctggcc

SEQ ID NO: 433607 - DNA, 25 bp, Rattus norvegicus
ggatgtcctccaggctttgctggcc

SEQ ID NO: 433608 - DNA, 25 bp, Rattus norvegicus
ggatgtcctcccagcacaagttact

SEQ ID NO: 433609 - DNA, 25 bp, Rattus norvegicus
ggatgtcctccctgcacaagttact

SEQ ID NO: 433610 - DNA, 25 bp, Rattus norvegicus
ggatgtcctctgaactcaacaggga

SEQ ID NO: 433611 - DNA, 25 bp, Rattus norvegicus
ggatgtcctctgtactcaacaggga

SEQ ID NO: 433612 - DNA, 25 bp, Rattus norvegicus
ggatgtcctggaactaaactgttaa

SEQ ID NO: 433613 - DNA, 25 bp, Rattus norvegicus
ggatgtcctggatctaaactgttaa

SEQ ID NO: 433614 - DNA, 25 bp, Rattus norvegicus
ggatgtcctgtgctggcccagaaaa

SEQ ID NO: 433615 - DNA, 25 bp, Rattus norvegicus
ggatgtcctgtggtggcccagaaaa

SEQ ID NO: 433616 - DNA, 25 bp, Rattus norvegicus
ggatgtcctttacccgccagcaaga

SEQ ID NO: 433617 - DNA, 25 bp, Rattus norvegicus
ggatgtcctttagccgccagcaaga

SEQ ID NO: 433618 - DNA, 25 bp, Rattus norvegicus
ggatgtcgagccacactgtgaattc

SEQ ID NO: 433619 - DNA, 25 bp, Rattus norvegicus
ggatgtcgagcctcactgtgaattc

SEQ ID NO: 433620 - DNA, 25 bp, Rattus norvegicus
ggatgtcgggccatactattggtaa

SEQ ID NO: 433621 - DNA, 25 bp, Rattus norvegicus
ggatgtcgggccttactattggtaa

SEQ ID NO: 433622 - DNA, 25 bp, Rattus norvegicus
ggatgtcgtaagagcctttttcttt

SEQ ID NO: 433623 - DNA, 25 bp, Rattus norvegicus
ggatgtcgtaagtgcctttttcttt

SEQ ID NO: 433624 - DNA, 25 bp, Rattus norvegicus
ggatgtcgttttatcagtgttttca

SEQ ID NO: 433625 - DNA, 25 bp, Rattus norvegicus
ggatgtcgttttttcagtgttttca

SEQ ID NO: 433626 - DNA, 25 bp, Rattus norvegicus
ggatgtctacaacagcccagcttca

SEQ ID NO: 433627 - DNA, 25 bp, Rattus norvegicus
ggatgtctacaagagcccagcttca

SEQ ID NO: 433628 - DNA, 25 bp, Rattus norvegicus
ggatgtctacttccggcttaatctg

SEQ ID NO: 433629 - DNA, 25 bp, Rattus norvegicus
ggatgtctacttgcggcttaatctg

SEQ ID NO: 433630 - DNA, 25 bp, Rattus norvegicus
ggatgtctatatactgggctctcaa

SEQ ID NO: 433631 - DNA, 25 bp, Rattus norvegicus
ggatgtctatattctgggctctcaa

SEQ ID NO: 433632 - DNA, 25 bp, Rattus norvegicus
ggatgtctatgtactcacctatgaa

SEQ ID NO: 433633 - DNA, 25 bp, Rattus norvegicus
ggatgtctatgttctcacctatgaa

SEQ ID NO: 433634 - DNA, 25 bp, Rattus norvegicus
ggatgtctcataattctttgccgtg

SEQ ID NO: 433635 - DNA, 25 bp, Rattus norvegicus
ggatgtctcatatttctttgccgtg

SEQ ID NO: 433636 - DNA, 25 bp, Rattus norvegicus
ggatgtctccagaacatgccatcag

SEQ ID NO: 433637 - DNA, 25 bp, Rattus norvegicus
ggatgtctccagtacatgccatcag

SEQ ID NO: 433638 - DNA, 25 bp, Rattus norvegicus
ggatgtctccgtcccttgcattaag

SEQ ID NO: 433639 - DNA, 25 bp, Rattus norvegicus
ggatgtctccgtgccttgcattaag

SEQ ID NO: 433640 - DNA, 25 bp, Rattus norvegicus
ggatgtctgcaaatatctgggcttt

SEQ ID NO: 433641 - DNA, 25 bp, Rattus norvegicus
ggatgtctgcaattatctgggcttt

SEQ ID NO: 433642 - DNA, 25 bp, Rattus norvegicus
ggatgtctgcccagcattcctgaag

SEQ ID NO: 433643 - DNA, 25 bp, Rattus norvegicus
ggatgtctgccctgcattcctgaag

SEQ ID NO: 433644 - DNA, 25 bp, Rattus norvegicus
ggatgtctgctaagccagagcactc

SEQ ID NO: 433645 - DNA, 25 bp, Rattus norvegicus
ggatgtctgctatgccagagcactc

SEQ ID NO: 433646 - DNA, 25 bp, Rattus norvegicus
ggatgtctgtatatttctcgtccca

SEQ ID NO: 433647 - DNA, 25 bp, Rattus norvegicus
ggatgtctgtatttttctcgtccca

SEQ ID NO: 433648 - DNA, 25 bp, Rattus norvegicus
ggatgtctgtgacccgaaattctgt

SEQ ID NO: 433649 - DNA, 25 bp, Rattus norvegicus
ggatgtctgtgagccgaaattctgt

SEQ ID NO: 433650 - DNA, 25 bp, Rattus norvegicus
ggatgtcttatactctagggtctgc

SEQ ID NO: 433651 - DNA, 25 bp, Rattus norvegicus
ggatgtcttatagtctagggtctgc

SEQ ID NO: 433652 - DNA, 25 bp, Rattus norvegicus
ggatgtcttgagaatccaagtcctt

SEQ ID NO: 433653 - DNA, 25 bp, Rattus norvegicus
ggatgtcttgagattcaatgcctag

SEQ ID NO: 433654 - DNA, 25 bp, Rattus norvegicus
ggatgtcttgagtatccaagtcctt

SEQ ID NO: 433655 - DNA, 25 bp, Rattus norvegicus
ggatgtcttgagtttcaatgcctag

SEQ ID NO: 433656 - DNA, 25 bp, Rattus norvegicus
ggatgtcttgttaaaacggtgacca

SEQ ID NO: 433657 - DNA, 25 bp, Rattus norvegicus
ggatgtcttgtttaaacggtgacca

SEQ ID NO: 433658 - DNA, 25 bp, Rattus norvegicus
ggatgtgaagctatgtggaccttgt

SEQ ID NO: 433659 - DNA, 25 bp, Rattus norvegicus
ggatgtgaagctttgtggaccttgt

SEQ ID NO: 433660 - DNA, 25 bp, Rattus norvegicus
ggatgtgacaacatgaggaacactt

SEQ ID NO: 433661 - DNA, 25 bp, Rattus norvegicus
ggatgtgacaacttgaggaacactt

SEQ ID NO: 433662 - DNA, 25 bp, Rattus norvegicus
ggatgtgacaagacccaagactaca

SEQ ID NO: 433663 - DNA, 25 bp, Rattus norvegicus
ggatgtgacaagtcccaagactaca

SEQ ID NO: 433664 - DNA, 25 bp, Rattus norvegicus
ggatgtgacacaagctcctgtgaac

SEQ ID NO: 433665 - DNA, 25 bp, Rattus norvegicus
ggatgtgacacatgctcctgtgaac

SEQ ID NO: 433666 - DNA, 25 bp, Rattus norvegicus
ggatgtgacgccattttacaaaaca

SEQ ID NO: 433667 - DNA, 25 bp, Rattus norvegicus
ggatgtgacgcctttttacaaaaca

SEQ ID NO: 433668 - DNA, 25 bp, Rattus norvegicus
ggatgtgagataactctgtctatct

SEQ ID NO: 433669 - DNA, 25 bp, Rattus norvegicus
ggatgtgagatatctctgtctatct

SEQ ID NO: 433670 - DNA, 25 bp, Rattus norvegicus
ggatgtgatcacaggagccttcaag

SEQ ID NO: 433671 - DNA, 25 bp, Rattus norvegicus
ggatgtgatcactggagccttcaag

SEQ ID NO: 433672 - DNA, 25 bp, Rattus norvegicus
ggatgtgatcctactgacagccatt

SEQ ID NO: 433673 - DNA, 25 bp, Rattus norvegicus
ggatgtgatccttctgacagccatt

SEQ ID NO: 433674 - DNA, 25 bp, Rattus norvegicus
ggatgtgatttcacagctgctctat

SEQ ID NO: 433675 - DNA, 25 bp, Rattus norvegicus
ggatgtgatttctcagctgctctat

SEQ ID NO: 433676 - DNA, 25 bp, Rattus norvegicus
ggatgtgcactcagtagatggccct

SEQ ID NO: 433677 - DNA, 25 bp, Rattus norvegicus
ggatgtgcactctgtagatggccct

SEQ ID NO: 433678 - DNA, 25 bp, Rattus norvegicus
ggatgtgcagacacctcccctctag

SEQ ID NO: 433679 - DNA, 25 bp, Rattus norvegicus
ggatgtgcagactcctcccctctag

SEQ ID NO: 433680 - DNA, 25 bp, Rattus norvegicus
ggatgtgcagccaggtctttatgtg

SEQ ID NO: 433681 - DNA, 25 bp, Rattus norvegicus
ggatgtgcagcctggtctttatgtg

SEQ ID NO: 433682 - DNA, 25 bp, Rattus norvegicus
ggatgtgcccaaaaatcaactgcgg

SEQ ID NO: 433683 - DNA, 25 bp, Rattus norvegicus
ggatgtgcccaataatcaactgcgg

SEQ ID NO: 433684 - DNA, 25 bp, Rattus norvegicus
ggatgtgcccggctcctgctttgct

SEQ ID NO: 433685 - DNA, 25 bp, Rattus norvegicus
ggatgtgcccgggtcctgctttgct

SEQ ID NO: 433686 - DNA, 25 bp, Rattus norvegicus
ggatgtgctcatcgttcacactcat

SEQ ID NO: 433687 - DNA, 25 bp, Rattus norvegicus
ggatgtgctcatggttcacactcat

SEQ ID NO: 433688 - DNA, 25 bp, Rattus norvegicus
ggatgtgctctgagacacttgtaat

SEQ ID NO: 433689 - DNA, 25 bp, Rattus norvegicus
ggatgtgctctgtgacacttgtaat

SEQ ID NO: 433690 - DNA, 25 bp, Rattus norvegicus
ggatgtgctcttcgcatgagagaaa

SEQ ID NO: 433691 - DNA, 25 bp, Rattus norvegicus
ggatgtgctcttggcatgagagaaa

SEQ ID NO: 433692 - DNA, 25 bp, Rattus norvegicus
ggatgtgctgtacttcctgaccgag

SEQ ID NO: 433693 - DNA, 25 bp, Rattus norvegicus
ggatgtgctgtagttcctgaccgag

SEQ ID NO: 433694 - DNA, 25 bp, Rattus norvegicus
ggatgtgcttcaaggcaacctggca

SEQ ID NO: 433695 - DNA, 25 bp, Rattus norvegicus
ggatgtgcttcatggcaacctggca

SEQ ID NO: 433696 - DNA, 25 bp, Rattus norvegicus
ggatgtggaagcctatggtattctt

SEQ ID NO: 433697 - DNA, 25 bp, Rattus norvegicus
ggatgtggaagcgtatggtattctt

SEQ ID NO: 433698 - DNA, 25 bp, Rattus norvegicus
ggatgtggacagctcaccaaaccaa

SEQ ID NO: 433699 - DNA, 25 bp, Rattus norvegicus
ggatgtggacaggtcaccaaaccaa

SEQ ID NO: 433700 - DNA, 25 bp, Rattus norvegicus
ggatgtggactacagcgatgccctc

SEQ ID NO: 433701 - DNA, 25 bp, Rattus norvegicus
ggatgtggactagagcgatgccctc

SEQ ID NO: 433702 - DNA, 25 bp, Rattus norvegicus
ggatgtggcacaaagtttctgacct

SEQ ID NO: 433703 - DNA, 25 bp, Rattus norvegicus
ggatgtggcacatagtttctgacct

SEQ ID NO: 433704 - DNA, 25 bp, Rattus norvegicus
ggatgtggcatcatcttccactaga

SEQ ID NO: 433705 - DNA, 25 bp, Rattus norvegicus
ggatgtggcatcttcttccactaga

SEQ ID NO: 433706 - DNA, 25 bp, Rattus norvegicus
ggatgtggcttcaggtttgaacttc

SEQ ID NO: 433707 - DNA, 25 bp, Rattus norvegicus
ggatgtggcttctggtttgaacttc

SEQ ID NO: 433708 - DNA, 25 bp, Rattus norvegicus
ggatgtggcttgcaagaactttaat

SEQ ID NO: 433709 - DNA, 25 bp, Rattus norvegicus
ggatgtggcttggaagaactttaat

SEQ ID NO: 433710 - DNA, 25 bp, Rattus norvegicus
ggatgtggctttatacatttgagga

SEQ ID NO: 433711 - DNA, 25 bp, Rattus norvegicus
ggatgtggctttttacatttgagga

SEQ ID NO: 433712 - DNA, 25 bp, Rattus norvegicus
ggatgtgggatcactactgcaagaa

SEQ ID NO: 433713 - DNA, 25 bp, Rattus norvegicus
ggatgtgggatctctactgcaagaa

SEQ ID NO: 433714 - DNA, 25 bp, Rattus norvegicus
ggatgtgggcacagcagcttttatt

SEQ ID NO: 433715 - DNA, 25 bp, Rattus norvegicus
ggatgtgggcactgcagcttttatt

SEQ ID NO: 433716 - DNA, 25 bp, Rattus norvegicus
ggatgtgggtcactgctagaccaca

SEQ ID NO: 433717 - DNA, 25 bp, Rattus norvegicus
ggatgtgggtcagtgctagaccaca

SEQ ID NO: 433718 - DNA, 25 bp, Rattus norvegicus
ggatgtggtatcatgtctgggtaac

SEQ ID NO: 433719 - DNA, 25 bp, Rattus norvegicus
ggatgtggtatcttgtctgggtaac

SEQ ID NO: 433720 - DNA, 25 bp, Rattus norvegicus
ggatgtggttacatgaccttgtcat

SEQ ID NO: 433721 - DNA, 25 bp, Rattus norvegicus
ggatgtggttacttgaccttgtcat

SEQ ID NO: 433722 - DNA, 25 bp, Rattus norvegicus
ggatgtggttcactcttccaaagga

SEQ ID NO: 433723 - DNA, 25 bp, Rattus norvegicus
ggatgtggttcagtcttccaaagga

SEQ ID NO: 433724 - DNA, 25 bp, Rattus norvegicus
ggatgtgtaacaacagccgcttctg

SEQ ID NO: 433725 - DNA, 25 bp, Rattus norvegicus
ggatgtgtaacatcagccgcttctg

SEQ ID NO: 433726 - DNA, 25 bp, Rattus norvegicus
ggatgtgtacacaggagacgccctc

SEQ ID NO: 433727 - DNA, 25 bp, Rattus norvegicus
ggatgtgtacactggagacgccctc

SEQ ID NO: 433728 - DNA, 25 bp, Rattus norvegicus
ggatgtgtagacagttcaatgcaac

SEQ ID NO: 433729 - DNA, 25 bp, Rattus norvegicus
ggatgtgtagactgttcaatgcaac

SEQ ID NO: 433730 - DNA, 25 bp, Rattus norvegicus
ggatgtgtcataattcaatttttac

SEQ ID NO: 433731 - DNA, 25 bp, Rattus norvegicus
ggatgtgtcatatttcaatttttac

SEQ ID NO: 433732 - DNA, 25 bp, Rattus norvegicus
ggatgtgtccagcaattaaactttt

SEQ ID NO: 433733 - DNA, 25 bp, Rattus norvegicus
ggatgtgtccaggaattaaactttt

SEQ ID NO: 433734 - DNA, 25 bp, Rattus norvegicus
ggatgtgtcctaactatgcgtagag

SEQ ID NO: 433735 - DNA, 25 bp, Rattus norvegicus
ggatgtgtcctatctatgcgtagag

SEQ ID NO: 433736 - DNA, 25 bp, Rattus norvegicus
ggatgtgtctccacatcagcatgag

SEQ ID NO: 433737 - DNA, 25 bp, Rattus norvegicus
ggatgtgtctcctcatcagcatgag

SEQ ID NO: 433738 - DNA, 25 bp, Rattus norvegicus
ggatgtgtgaacagacgcttttatc

SEQ ID NO: 433739 - DNA, 25 bp, Rattus norvegicus
ggatgtgtgaactgacgcttttatc

SEQ ID NO: 433740 - DNA, 25 bp, Rattus norvegicus
ggatgtgtgactacactgatcccta

SEQ ID NO: 433741 - DNA, 25 bp, Rattus norvegicus
ggatgtgtgacttcactgatcccta

SEQ ID NO: 433742 - DNA, 25 bp, Rattus norvegicus
ggatgtgtgcagagcttcaccctaa

SEQ ID NO: 433743 - DNA, 25 bp, Rattus norvegicus
ggatgtgtgcagtgcttcaccctaa

SEQ ID NO: 433744 - DNA, 25 bp, Rattus norvegicus
ggatgtgttaacagtgctttcccat

SEQ ID NO: 433745 - DNA, 25 bp, Rattus norvegicus
ggatgtgttaactgtgctttcccat

SEQ ID NO: 433746 - DNA, 25 bp, Rattus norvegicus
ggatgtgttatgaatcagtgccagg

SEQ ID NO: 433747 - DNA, 25 bp, Rattus norvegicus
ggatgtgttatgtatcagtgccagg

SEQ ID NO: 433748 - DNA, 25 bp, Rattus norvegicus
ggatgtgttcagagacccagcactg

SEQ ID NO: 433749 - DNA, 25 bp, Rattus norvegicus
ggatgtgttcagtgacccagcactg

SEQ ID NO: 433750 - DNA, 25 bp, Rattus norvegicus
ggatgtgttcctcaagcacgtccgc

SEQ ID NO: 433751 - DNA, 25 bp, Rattus norvegicus
ggatgtgttcctgaagcacgtccgc

SEQ ID NO: 433752 - DNA, 25 bp, Rattus norvegicus
ggatgtgttgaacaccacctttatt

SEQ ID NO: 433753 - DNA, 25 bp, Rattus norvegicus
ggatgtgttgaagaccacctttatt

SEQ ID NO: 433754 - DNA, 25 bp, Rattus norvegicus
ggatgtgttggacgacagtcacata

SEQ ID NO: 433755 - DNA, 25 bp, Rattus norvegicus
ggatgtgttggaggacagtcacata

SEQ ID NO: 433756 - DNA, 25 bp, Rattus norvegicus
ggatgtgttgttatgataccgtaat

SEQ ID NO: 433757 - DNA, 25 bp, Rattus norvegicus
ggatgtgttgttctaacagagtaac

SEQ ID NO: 433758 - DNA, 25 bp, Rattus norvegicus
ggatgtgttgttgtaacagagtaac

SEQ ID NO: 433759 - DNA, 25 bp, Rattus norvegicus
ggatgtgttgttttgataccgtaat

SEQ ID NO: 433760 - DNA, 25 bp, Rattus norvegicus
ggatgttaacctacagttttcttga

SEQ ID NO: 433761 - DNA, 25 bp, Rattus norvegicus
ggatgttaaccttcagttttcttga

SEQ ID NO: 433762 - DNA, 25 bp, Rattus norvegicus
ggatgttaatccaaccaagccgtat

SEQ ID NO: 433763 - DNA, 25 bp, Rattus norvegicus
ggatgttaatccacaagcactgaag

SEQ ID NO: 433764 - DNA, 25 bp, Rattus norvegicus
ggatgttaatcctaccaagccgtat

SEQ ID NO: 433765 - DNA, 25 bp, Rattus norvegicus
ggatgttaatcctcaagcactgaag

SEQ ID NO: 433766 - DNA, 25 bp, Rattus norvegicus
ggatgttaatttctcttccaactga

SEQ ID NO: 433767 - DNA, 25 bp, Rattus norvegicus
ggatgttaatttgtcttccaactga

SEQ ID NO: 433768 - DNA, 25 bp, Rattus norvegicus
ggatgttaccatacctgacacagga

SEQ ID NO: 433769 - DNA, 25 bp, Rattus norvegicus
ggatgttaccattcctgacacagga

SEQ ID NO: 433770 - DNA, 25 bp, Rattus norvegicus
ggatgttaccccagtcaatttcctg

SEQ ID NO: 433771 - DNA, 25 bp, Rattus norvegicus
ggatgttacccctgtcaatttcctg

SEQ ID NO: 433772 - DNA, 25 bp, Rattus norvegicus
ggatgttacttaagccaccaaaact

SEQ ID NO: 433773 - DNA, 25 bp, Rattus norvegicus
ggatgttacttatgccaccaaaact

SEQ ID NO: 433774 - DNA, 25 bp, Rattus norvegicus
ggatgttagaatagccaatatgtac

SEQ ID NO: 433775 - DNA, 25 bp, Rattus norvegicus
ggatgttagaattgccaatatgtac

SEQ ID NO: 433776 - DNA, 25 bp, Rattus norvegicus
ggatgttagagtacgaccctgctca

SEQ ID NO: 433777 - DNA, 25 bp, Rattus norvegicus
ggatgttagagttcgaccctgctca

SEQ ID NO: 433778 - DNA, 25 bp, Rattus norvegicus
ggatgttagcatcccatgttcactg

SEQ ID NO: 433779 - DNA, 25 bp, Rattus norvegicus
ggatgttagcatgccatgttcactg

SEQ ID NO: 433780 - DNA, 25 bp, Rattus norvegicus
ggatgttagccaccattccacagtg

SEQ ID NO: 433781 - DNA, 25 bp, Rattus norvegicus
ggatgttagccagcattccacagtg

SEQ ID NO: 433782 - DNA, 25 bp, Rattus norvegicus
ggatgttagggaccatataccttgt

SEQ ID NO: 433783 - DNA, 25 bp, Rattus norvegicus
ggatgttagggagcatataccttgt

SEQ ID NO: 433784 - DNA, 25 bp, Rattus norvegicus
ggatgttagtacagccctgaagaaa

SEQ ID NO: 433785 - DNA, 25 bp, Rattus norvegicus
ggatgttagtactgccctgaagaaa

SEQ ID NO: 433786 - DNA, 25 bp, Rattus norvegicus
ggatgttagtgcagcgacccctggc

SEQ ID NO: 433787 - DNA, 25 bp, Rattus norvegicus
ggatgttagtgctgcgacccctggc

SEQ ID NO: 433788 - DNA, 25 bp, Rattus norvegicus
ggatgttatagtcccgatcgtcctc

SEQ ID NO: 433789 - DNA, 25 bp, Rattus norvegicus
ggatgttatagtgccgatcgtcctc

SEQ ID NO: 433790 - DNA, 25 bp, Rattus norvegicus
ggatgttatcctcaaattccgggac

SEQ ID NO: 433791 - DNA, 25 bp, Rattus norvegicus
ggatgttatcctgaaattccgggac

SEQ ID NO: 433792 - DNA, 25 bp, Rattus norvegicus
ggatgttcatccaggtcatgagctt

SEQ ID NO: 433793 - DNA, 25 bp, Rattus norvegicus
ggatgttcatcctggtcatgagctt

SEQ ID NO: 433794 - DNA, 25 bp, Rattus norvegicus
ggatgttcatgcacctacacagatt

SEQ ID NO: 433795 - DNA, 25 bp, Rattus norvegicus
ggatgttcatgctcctacacagatt

SEQ ID NO: 433796 - DNA, 25 bp, Rattus norvegicus
ggatgttccactattattttcattc

SEQ ID NO: 433797 - DNA, 25 bp, Rattus norvegicus
ggatgttccacttttattttcattc

SEQ ID NO: 433798 - DNA, 25 bp, Rattus norvegicus
ggatgttcccaaatgtttctgtatt

SEQ ID NO: 433799 - DNA, 25 bp, Rattus norvegicus
ggatgttcccaattgtttctgtatt

SEQ ID NO: 433800 - DNA, 25 bp, Rattus norvegicus
ggatgttccgcaccacagtctgtga

SEQ ID NO: 433801 - DNA, 25 bp, Rattus norvegicus
ggatgttccgcagcacagtctgtga

SEQ ID NO: 433802 - DNA, 25 bp, Rattus norvegicus
ggatgttcgcgtacacgaggctgca

SEQ ID NO: 433803 - DNA, 25 bp, Rattus norvegicus
ggatgttcgcgttcacgaggctgca

SEQ ID NO: 433804 - DNA, 25 bp, Rattus norvegicus
ggatgttcggaaaaggcacatgcta

SEQ ID NO: 433805 - DNA, 25 bp, Rattus norvegicus
ggatgttcggaataggcacatgcta

SEQ ID NO: 433806 - DNA, 25 bp, Rattus norvegicus
ggatgttcggtcacatgacagctga

SEQ ID NO: 433807 - DNA, 25 bp, Rattus norvegicus
ggatgttcggtctcatgacagctga

SEQ ID NO: 433808 - DNA, 25 bp, Rattus norvegicus
ggatgttctaaaacagtgcagtagc

SEQ ID NO: 433809 - DNA, 25 bp, Rattus norvegicus
ggatgttctaaatcagtgcagtagc

SEQ ID NO: 433810 - DNA, 25 bp, Rattus norvegicus
ggatgttctgtaaggtctccagcca

SEQ ID NO: 433811 - DNA, 25 bp, Rattus norvegicus
ggatgttctgtatggtctccagcca

SEQ ID NO: 433812 - DNA, 25 bp, Rattus norvegicus
ggatgttcttcacaattcagcccca

SEQ ID NO: 433813 - DNA, 25 bp, Rattus norvegicus
ggatgttcttcagaattcagcccca

SEQ ID NO: 433814 - DNA, 25 bp, Rattus norvegicus
ggatgttcttccaacaccccatgtc

SEQ ID NO: 433815 - DNA, 25 bp, Rattus norvegicus
ggatgttcttcctacaccccatgtc

SEQ ID NO: 433816 - DNA, 25 bp, Rattus norvegicus
ggatgttgacaccagcacttggaaa

SEQ ID NO: 433817 - DNA, 25 bp, Rattus norvegicus
ggatgttgacacgagcacttggaaa

SEQ ID NO: 433818 - DNA, 25 bp, Rattus norvegicus
ggatgttgacctccacattctgtat

SEQ ID NO: 433819 - DNA, 25 bp, Rattus norvegicus
ggatgttgacctgcacattctgtat

SEQ ID NO: 433820 - DNA, 25 bp, Rattus norvegicus
ggatgttgcaggataatacccacct

SEQ ID NO: 433821 - DNA, 25 bp, Rattus norvegicus
ggatgttgcaggttaatacccacct

SEQ ID NO: 433822 - DNA, 25 bp, Rattus norvegicus
ggatgttgccctcagtaggtaccca

SEQ ID NO: 433823 - DNA, 25 bp, Rattus norvegicus
ggatgttgccctgagtaggtaccca

SEQ ID NO: 433824 - DNA, 25 bp, Rattus norvegicus
ggatgttgccttagccttaaaaatt

SEQ ID NO: 433825 - DNA, 25 bp, Rattus norvegicus
ggatgttgcctttgccttaaaaatt

SEQ ID NO: 433826 - DNA, 25 bp, Rattus norvegicus
ggatgttgcttgattctattgcagc

SEQ ID NO: 433827 - DNA, 25 bp, Rattus norvegicus
ggatgttgcttgtttctattgcagc

SEQ ID NO: 433828 - DNA, 25 bp, Rattus norvegicus
ggatgttggacacatgcagccgctt

SEQ ID NO: 433829 - DNA, 25 bp, Rattus norvegicus
ggatgttggacagatgcagccgctt

SEQ ID NO: 433830 - DNA, 25 bp, Rattus norvegicus
ggatgttggattccttggacttaga

SEQ ID NO: 433831 - DNA, 25 bp, Rattus norvegicus
ggatgttggattgcttggacttaga

SEQ ID NO: 433832 - DNA, 25 bp, Rattus norvegicus
ggatgttggtacagctagccttgtg

SEQ ID NO: 433833 - DNA, 25 bp, Rattus norvegicus
ggatgttggtactgctagccttgtg

SEQ ID NO: 433834 - DNA, 25 bp, Rattus norvegicus
ggatgttgtatccacgccgtgtgaa

SEQ ID NO: 433835 - DNA, 25 bp, Rattus norvegicus
ggatgttgtatcgacgccgtgtgaa

SEQ ID NO: 433836 - DNA, 25 bp, Rattus norvegicus
ggatgttgtgcccagatctgcatta

SEQ ID NO: 433837 - DNA, 25 bp, Rattus norvegicus
ggatgttgtgccgagatctgcatta

SEQ ID NO: 433838 - DNA, 25 bp, Rattus norvegicus
ggatgtttacaaccctgccttttac

SEQ ID NO: 433839 - DNA, 25 bp, Rattus norvegicus
ggatgtttacaagcctgccttttac

SEQ ID NO: 433840 - DNA, 25 bp, Rattus norvegicus
ggatgtttactccttgtcatttgct

SEQ ID NO: 433841 - DNA, 25 bp, Rattus norvegicus
ggatgtttactcgttgtcatttgct

SEQ ID NO: 433842 - DNA, 25 bp, Rattus norvegicus
ggatgtttagggagtaagtcaacct

SEQ ID NO: 433843 - DNA, 25 bp, Rattus norvegicus
ggatgtttagggtgtaagtcaacct

SEQ ID NO: 433844 - DNA, 25 bp, Rattus norvegicus
ggatgtttatctcaagcccctcatc

SEQ ID NO: 433845 - DNA, 25 bp, Rattus norvegicus
ggatgtttatctgaagcccctcatc

SEQ ID NO: 433846 - DNA, 25 bp, Rattus norvegicus
ggatgtttcaaaccctttccatcag

SEQ ID NO: 433847 - DNA, 25 bp, Rattus norvegicus
ggatgtttcaaactcaagtctgtaa

SEQ ID NO: 433848 - DNA, 25 bp, Rattus norvegicus
ggatgtttcaaagcctttccatcag

SEQ ID NO: 433849 - DNA, 25 bp, Rattus norvegicus
ggatgtttcaaagtcaagtctgtaa

SEQ ID NO: 433850 - DNA, 25 bp, Rattus norvegicus
ggatgtttcactcctgacactggag

SEQ ID NO: 433851 - DNA, 25 bp, Rattus norvegicus
ggatgtttcactgctgacactggag

SEQ ID NO: 433852 - DNA, 25 bp, Rattus norvegicus
ggatgtttcctcatgatgtatagta

SEQ ID NO: 433853 - DNA, 25 bp, Rattus norvegicus
ggatgtttcctcttgatgtatagta

SEQ ID NO: 433854 - DNA, 25 bp, Rattus norvegicus
ggatgtttctgcaaatgttcacaag

SEQ ID NO: 433855 - DNA, 25 bp, Rattus norvegicus
ggatgtttctgctaatgttcacaag

SEQ ID NO: 433856 - DNA, 25 bp, Rattus norvegicus
ggatgtttcttccagggccaaccca

SEQ ID NO: 433857 - DNA, 25 bp, Rattus norvegicus
ggatgtttcttcgagggccaaccca

SEQ ID NO: 433858 - DNA, 25 bp, Rattus norvegicus
ggatgtttgaccaccggataagcga

SEQ ID NO: 433859 - DNA, 25 bp, Rattus norvegicus
ggatgtttgacctccggataagcga

SEQ ID NO: 433860 - DNA, 25 bp, Rattus norvegicus
ggatgtttgcagcaaccggaccgtt

SEQ ID NO: 433861 - DNA, 25 bp, Rattus norvegicus
ggatgtttgcaggaaccggaccgtt

SEQ ID NO: 433862 - DNA, 25 bp, Rattus norvegicus
ggatgtttgctacacgtcgacttgt

SEQ ID NO: 433863 - DNA, 25 bp, Rattus norvegicus
ggatgtttgctagacgtcgacttgt

SEQ ID NO: 433864 - DNA, 25 bp, Rattus norvegicus
ggatgtttgtaaattgccagatgac

SEQ ID NO: 433865 - DNA, 25 bp, Rattus norvegicus
ggatgtttgtaatttgccagatgac

SEQ ID NO: 433866 - DNA, 25 bp, Rattus norvegicus
ggatgtttgtcaattccttacgctc

SEQ ID NO: 433867 - DNA, 25 bp, Rattus norvegicus
ggatgtttgtcactttggttttctc

SEQ ID NO: 433868 - DNA, 25 bp, Rattus norvegicus
ggatgtttgtcagtttggttttctc

SEQ ID NO: 433869 - DNA, 25 bp, Rattus norvegicus
ggatgtttgtcatttccttacgctc

SEQ ID NO: 433870 - DNA, 25 bp, Rattus norvegicus
ggatgtttgttaacctaatccaaat

SEQ ID NO: 433871 - DNA, 25 bp, Rattus norvegicus
ggatgtttgttaccccatctgtaaa

SEQ ID NO: 433872 - DNA, 25 bp, Rattus norvegicus
ggatgtttgttagcccatctgtaaa

SEQ ID NO: 433873 - DNA, 25 bp, Rattus norvegicus
ggatgtttgttatcctaatccaaat

SEQ ID NO: 433874 - DNA, 25 bp, Rattus norvegicus
ggatgttttaatcgactgtgctaca

SEQ ID NO: 433875 - DNA, 25 bp, Rattus norvegicus
ggatgttttaatggactgtgctaca

SEQ ID NO: 433876 - DNA, 25 bp, Rattus norvegicus
ggatgttttcagatttgtcggcaga

SEQ ID NO: 433877 - DNA, 25 bp, Rattus norvegicus
ggatgttttcagttttgtcggcaga

SEQ ID NO: 433878 - DNA, 25 bp, Rattus norvegicus
ggatgttttcctaagcatagacgtg

SEQ ID NO: 433879 - DNA, 25 bp, Rattus norvegicus
ggatgttttccttagcatagacgtg

SEQ ID NO: 433880 - DNA, 25 bp, Rattus norvegicus
ggatgttttcgtcagcagtgtgctt

SEQ ID NO: 433881 - DNA, 25 bp, Rattus norvegicus
ggatgttttcgtgagcagtgtgctt

SEQ ID NO: 433882 - DNA, 25 bp, Rattus norvegicus
ggatgtttttaaactctgacccacc

SEQ ID NO: 433883 - DNA, 25 bp, Rattus norvegicus
ggatgtttttaatctctgacccacc

SEQ ID NO: 433884 - DNA, 25 bp, Rattus norvegicus
ggatgtttttatactggccatttca

SEQ ID NO: 433885 - DNA, 25 bp, Rattus norvegicus
ggatgtttttattctggccatttca

SEQ ID NO: 433886 - DNA, 25 bp, Rattus norvegicus
ggattaaagccaagagcccaccaag

SEQ ID NO: 433887 - DNA, 25 bp, Rattus norvegicus
ggattaaagccatgagcccaccaag

SEQ ID NO: 433888 - DNA, 25 bp, Rattus norvegicus
ggattaaagctgagctccactacgc

SEQ ID NO: 433889 - DNA, 25 bp, Rattus norvegicus
ggattaaagctgtgctccactacgc

SEQ ID NO: 433890 - DNA, 25 bp, Rattus norvegicus
ggattaaagtacaacccaccacatg

SEQ ID NO: 433891 - DNA, 25 bp, Rattus norvegicus
ggattaaagtactacccaccacatg

SEQ ID NO: 433892 - DNA, 25 bp, Rattus norvegicus
ggattaaccaaactcttgccacagg

SEQ ID NO: 433893 - DNA, 25 bp, Rattus norvegicus
ggattaaccaaagtcttgccacagg

SEQ ID NO: 433894 - DNA, 25 bp, Rattus norvegicus
ggattaaccctcaaagttctcttca

SEQ ID NO: 433895 - DNA, 25 bp, Rattus norvegicus
ggattaaccctcaatgacactgttc

SEQ ID NO: 433896 - DNA, 25 bp, Rattus norvegicus
ggattaaccctctaagttctcttca

SEQ ID NO: 433897 - DNA, 25 bp, Rattus norvegicus
ggattaaccctctatgacactgttc

SEQ ID NO: 433898 - DNA, 25 bp, Rattus norvegicus
ggattaagatgtccagcactgcatt

SEQ ID NO: 433899 - DNA, 25 bp, Rattus norvegicus
ggattaagatgtgcagcactgcatt

SEQ ID NO: 433900 - DNA, 25 bp, Rattus norvegicus
ggattaaggatgaccacctcgcctg

SEQ ID NO: 433901 - DNA, 25 bp, Rattus norvegicus
ggattaaggatgtccacctcgcctg

SEQ ID NO: 433902 - DNA, 25 bp, Rattus norvegicus
ggattaaggcagactctctctgtga

SEQ ID NO: 433903 - DNA, 25 bp, Rattus norvegicus
ggattaaggcagtctctctctgtga

SEQ ID NO: 433904 - DNA, 25 bp, Rattus norvegicus
ggattaagggtgagctccaccacct

SEQ ID NO: 433905 - DNA, 25 bp, Rattus norvegicus
ggattaagggtgtgctccaccacct

SEQ ID NO: 433906 - DNA, 25 bp, Rattus norvegicus
ggattaaggtccacatcacgttgcc

SEQ ID NO: 433907 - DNA, 25 bp, Rattus norvegicus
ggattaaggtcctcatcacgttgcc

SEQ ID NO: 433908 - DNA, 25 bp, Rattus norvegicus
ggattaatagacatgaacacccttg

SEQ ID NO: 433909 - DNA, 25 bp, Rattus norvegicus
ggattaatagacttgaacacccttg

SEQ ID NO: 433910 - DNA, 25 bp, Rattus norvegicus
ggattaatctctccttctacaaggc

SEQ ID NO: 433911 - DNA, 25 bp, Rattus norvegicus
ggattaatctctgcttctacaaggc

SEQ ID NO: 433912 - DNA, 25 bp, Rattus norvegicus
ggattaattttgactgttctgttat

SEQ ID NO: 433913 - DNA, 25 bp, Rattus norvegicus
ggattaattttgtctgttctgttat

SEQ ID NO: 433914 - DNA, 25 bp, Rattus norvegicus
ggattacaaacacaccctcagggta

SEQ ID NO: 433915 - DNA, 25 bp, Rattus norvegicus
ggattacaaacagaccctcagggta

SEQ ID NO: 433916 - DNA, 25 bp, Rattus norvegicus
ggattacaagccatattgaacacca

SEQ ID NO: 433917 - DNA, 25 bp, Rattus norvegicus
ggattacaagccttattgaacacca

SEQ ID NO: 433918 - DNA, 25 bp, Rattus norvegicus
ggattacaatcccacagctgacatg

SEQ ID NO: 433919 - DNA, 25 bp, Rattus norvegicus
ggattacaatccgacagctgacatg

SEQ ID NO: 433920 - DNA, 25 bp, Rattus norvegicus
ggattacacacaagagaattccact

SEQ ID NO: 433921 - DNA, 25 bp, Rattus norvegicus
ggattacacacatgagaattccact

SEQ ID NO: 433922 - DNA, 25 bp, Rattus norvegicus
ggattacacgttctgctttagctca

SEQ ID NO: 433923 - DNA, 25 bp, Rattus norvegicus
ggattacacgttgtgctttagctca

SEQ ID NO: 433924 - DNA, 25 bp, Rattus norvegicus
ggattacaggaaagcagccccacca

SEQ ID NO: 433925 - DNA, 25 bp, Rattus norvegicus
ggattacaggaatgcagccccacca

SEQ ID NO: 433926 - DNA, 25 bp, Rattus norvegicus
ggattacagtccaacctactaataa

SEQ ID NO: 433927 - DNA, 25 bp, Rattus norvegicus
ggattacagtcctacctactaataa

SEQ ID NO: 433928 - DNA, 25 bp, Rattus norvegicus
ggattacatctgacctaaggcggtg

SEQ ID NO: 433929 - DNA, 25 bp, Rattus norvegicus
ggattacatctgtcctaaggcggtg

SEQ ID NO: 433930 - DNA, 25 bp, Rattus norvegicus
ggattacatttacgtctctggaaaa

SEQ ID NO: 433931 - DNA, 25 bp, Rattus norvegicus
ggattacatttaggtctctggaaaa

SEQ ID NO: 433932 - DNA, 25 bp, Rattus norvegicus
ggattaccaaaaacactcttcagcc

SEQ ID NO: 433933 - DNA, 25 bp, Rattus norvegicus
ggattaccaaaatcactcttcagcc

SEQ ID NO: 433934 - DNA, 25 bp, Rattus norvegicus
ggattaccaataacttatatggcac

SEQ ID NO: 433935 - DNA, 25 bp, Rattus norvegicus
ggattaccaatatcttatatggcac

SEQ ID NO: 433936 - DNA, 25 bp, Rattus norvegicus
ggattaccacagaccgtgcagggca

SEQ ID NO: 433937 - DNA, 25 bp, Rattus norvegicus
ggattaccacagtccgtgcagggca

SEQ ID NO: 433938 - DNA, 25 bp, Rattus norvegicus
ggattaccaggaaggcctttctaca

SEQ ID NO: 433939 - DNA, 25 bp, Rattus norvegicus
ggattaccaggatggcctttctaca

SEQ ID NO: 433940 - DNA, 25 bp, Rattus norvegicus
ggattaccgcagactgatggctggc

SEQ ID NO: 433941 - DNA, 25 bp, Rattus norvegicus
ggattaccgcagtctgatggctggc

SEQ ID NO: 433942 - DNA, 25 bp, Rattus norvegicus
ggattacctagaactggatttacta

SEQ ID NO: 433943 - DNA, 25 bp, Rattus norvegicus
ggattacctagatctggatttacta

SEQ ID NO: 433944 - DNA, 25 bp, Rattus norvegicus
ggattacctcagagcaccaatgcaa

SEQ ID NO: 433945 - DNA, 25 bp, Rattus norvegicus
ggattacctcagtgcaccaatgcaa

SEQ ID NO: 433946 - DNA, 25 bp, Rattus norvegicus
ggattacctgatcttcaactactcg

SEQ ID NO: 433947 - DNA, 25 bp, Rattus norvegicus
ggattacctgatgttcaactactcg

SEQ ID NO: 433948 - DNA, 25 bp, Rattus norvegicus
ggattacgacagaggcctgctgctc

SEQ ID NO: 433949 - DNA, 25 bp, Rattus norvegicus
ggattacgacagtggcctgctgctc

SEQ ID NO: 433950 - DNA, 25 bp, Rattus norvegicus
ggattacgctgcagtgtgagtctca

SEQ ID NO: 433951 - DNA, 25 bp, Rattus norvegicus
ggattacgctgctgtgtgagtctca

SEQ ID NO: 433952 - DNA, 25 bp, Rattus norvegicus
ggattacggaggaggcgcccgagga

SEQ ID NO: 433953 - DNA, 25 bp, Rattus norvegicus
ggattacggaggtggcgcccgagga

SEQ ID NO: 433954 - DNA, 25 bp, Rattus norvegicus
ggattactacacacttctgatgcat

SEQ ID NO: 433955 - DNA, 25 bp, Rattus norvegicus
ggattactacactcttctgatgcat

SEQ ID NO: 433956 - DNA, 25 bp, Rattus norvegicus
ggattactcattctacatctagaaa

SEQ ID NO: 433957 - DNA, 25 bp, Rattus norvegicus
ggattactcattgtacatctagaaa

SEQ ID NO: 433958 - DNA, 25 bp, Rattus norvegicus
ggattactccagagaagctcaccat

SEQ ID NO: 433959 - DNA, 25 bp, Rattus norvegicus
ggattactccagtgaagctcaccat

SEQ ID NO: 433960 - DNA, 25 bp, Rattus norvegicus
ggattactcgttctggaaccgactt

SEQ ID NO: 433961 - DNA, 25 bp, Rattus norvegicus
ggattactcgttgtggaaccgactt

SEQ ID NO: 433962 - DNA, 25 bp, Rattus norvegicus
ggattactgccacatgttaccacat

SEQ ID NO: 433963 - DNA, 25 bp, Rattus norvegicus
ggattactgccagatgttaccacat

SEQ ID NO: 433964 - DNA, 25 bp, Rattus norvegicus
ggattactgtatcactgctgttgac

SEQ ID NO: 433965 - DNA, 25 bp, Rattus norvegicus
ggattactgtatgactgctgttgac

SEQ ID NO: 433966 - DNA, 25 bp, Rattus norvegicus
ggattactgtgaaagctattttctg

SEQ ID NO: 433967 - DNA, 25 bp, Rattus norvegicus
ggattactgtgatagctattttctg

SEQ ID NO: 433968 - DNA, 25 bp, Rattus norvegicus
ggattacttcatacttccaaagttt

SEQ ID NO: 433969 - DNA, 25 bp, Rattus norvegicus
ggattacttcatatctagactggtg

SEQ ID NO: 433970 - DNA, 25 bp, Rattus norvegicus
ggattacttcattcttccaaagttt

SEQ ID NO: 433971 - DNA, 25 bp, Rattus norvegicus
ggattacttcatttctagactggtg

SEQ ID NO: 433972 - DNA, 25 bp, Rattus norvegicus
ggattagaccttatctatagataat

SEQ ID NO: 433973 - DNA, 25 bp, Rattus norvegicus
ggattagaccttttctatagataat

SEQ ID NO: 433974 - DNA, 25 bp, Rattus norvegicus
ggattagaggccacagcaccaggaa

SEQ ID NO: 433975 - DNA, 25 bp, Rattus norvegicus
ggattagaggcctcagcaccaggaa

SEQ ID NO: 433976 - DNA, 25 bp, Rattus norvegicus
ggattagaggcgaggctgctacccc

SEQ ID NO: 433977 - DNA, 25 bp, Rattus norvegicus
ggattagaggcgtggctgctacccc

SEQ ID NO: 433978 - DNA, 25 bp, Rattus norvegicus
ggattagcaacccaggaacccatca

SEQ ID NO: 433979 - DNA, 25 bp, Rattus norvegicus
ggattagcaaccgaggaacccatca

SEQ ID NO: 433980 - DNA, 25 bp, Rattus norvegicus
ggattagcaccacttgttcactttt

SEQ ID NO: 433981 - DNA, 25 bp, Rattus norvegicus
ggattagcaccagttgttcactttt

SEQ ID NO: 433982 - DNA, 25 bp, Rattus norvegicus
ggattagcagtgcaagctcttcctg

SEQ ID NO: 433983 - DNA, 25 bp, Rattus norvegicus
ggattagcagtggaagctcttcctg

SEQ ID NO: 433984 - DNA, 25 bp, Rattus norvegicus
ggattagcatttactgtgttcacag

SEQ ID NO: 433985 - DNA, 25 bp, Rattus norvegicus
ggattagcattttctgtgttcacag

SEQ ID NO: 433986 - DNA, 25 bp, Rattus norvegicus
ggattagccagcaagcatcttctca

SEQ ID NO: 433987 - DNA, 25 bp, Rattus norvegicus
ggattagccagctagcatcttctca

SEQ ID NO: 433988 - DNA, 25 bp, Rattus norvegicus
ggattagcgtctaagttacttctct

SEQ ID NO: 433989 - DNA, 25 bp, Rattus norvegicus
ggattagcgtcttagttacttctct

SEQ ID NO: 433990 - DNA, 25 bp, Rattus norvegicus
ggattagcttcccactgcactgaga

SEQ ID NO: 433991 - DNA, 25 bp, Rattus norvegicus
ggattagcttccgactgcactgaga

SEQ ID NO: 433992 - DNA, 25 bp, Rattus norvegicus
ggattaggcagacatgtgacacccc

SEQ ID NO: 433993 - DNA, 25 bp, Rattus norvegicus
ggattaggcagagatgtgacacccc

SEQ ID NO: 433994 - DNA, 25 bp, Rattus norvegicus
ggattaggcattcagtccccttaag

SEQ ID NO: 433995 - DNA, 25 bp, Rattus norvegicus
ggattaggcattgagtccccttaag

SEQ ID NO: 433996 - DNA, 25 bp, Rattus norvegicus
ggattagggttcatagccttgctag

SEQ ID NO: 433997 - DNA, 25 bp, Rattus norvegicus
ggattagggttcttagccttgctag

SEQ ID NO: 433998 - DNA, 25 bp, Rattus norvegicus
ggattagtgtgacaaggcccagcct

SEQ ID NO: 433999 - DNA, 25 bp, Rattus norvegicus
ggattagtgtgagaaggcccagcct

SEQ ID NO: 434000 - DNA, 25 bp, Rattus norvegicus
ggattagtgtttcagggccattgca

SEQ ID NO: 434001 - DNA, 25 bp, Rattus norvegicus
ggattagtgtttgagggccattgca

SEQ ID NO: 434002 - DNA, 25 bp, Rattus norvegicus
ggattagttcggctctcaagggctc

SEQ ID NO: 434003 - DNA, 25 bp, Rattus norvegicus
ggattagttcgggtctcaagggctc

SEQ ID NO: 434004 - DNA, 25 bp, Rattus norvegicus
ggattagtttccctgagccgatgaa

SEQ ID NO: 434005 - DNA, 25 bp, Rattus norvegicus
ggattagtttccgtgagccgatgaa

SEQ ID NO: 434006 - DNA, 25 bp, Rattus norvegicus
ggattataaagaaggcccacccaga

SEQ ID NO: 434007 - DNA, 25 bp, Rattus norvegicus
ggattataaagatggcccacccaga

SEQ ID NO: 434008 - DNA, 25 bp, Rattus norvegicus
ggattatacaccaacgatcccggat

SEQ ID NO: 434009 - DNA, 25 bp, Rattus norvegicus
ggattatacacctacgatcccggat

SEQ ID NO: 434010 - DNA, 25 bp, Rattus norvegicus
ggattatagatcaagcccaaaggct

SEQ ID NO: 434011 - DNA, 25 bp, Rattus norvegicus
ggattatagatctagcccaaaggct

SEQ ID NO: 434012 - DNA, 25 bp, Rattus norvegicus
ggattataggacaggctcctcccag

SEQ ID NO: 434013 - DNA, 25 bp, Rattus norvegicus
ggattataggactggctcctcccag

SEQ ID NO: 434014 - DNA, 25 bp, Rattus norvegicus
ggattataggcaagcgccacacagc

SEQ ID NO: 434015 - DNA, 25 bp, Rattus norvegicus
ggattataggcactttgtgagctct

SEQ ID NO: 434016 - DNA, 25 bp, Rattus norvegicus
ggattataggcagtttgtgagctct

SEQ ID NO: 434017 - DNA, 25 bp, Rattus norvegicus
ggattataggcatgcgccacacagc

SEQ ID NO: 434018 - DNA, 25 bp, Rattus norvegicus
ggattatatatacccactgaccaat

SEQ ID NO: 434019 - DNA, 25 bp, Rattus norvegicus
ggattatatatagccactgaccaat

SEQ ID NO: 434020 - DNA, 25 bp, Rattus norvegicus
ggattatcaacaaaacgtcccttgt

SEQ ID NO: 434021 - DNA, 25 bp, Rattus norvegicus
ggattatcaacataacgtcccttgt

SEQ ID NO: 434022 - DNA, 25 bp, Rattus norvegicus
ggattatcaactcagcatcattgga

SEQ ID NO: 434023 - DNA, 25 bp, Rattus norvegicus
ggattatcaactgagcatcattgga

SEQ ID NO: 434024 - DNA, 25 bp, Rattus norvegicus
ggattatcaatgaccccaatcctgg

SEQ ID NO: 434025 - DNA, 25 bp, Rattus norvegicus
ggattatcaatgtccccaatcctgg

SEQ ID NO: 434026 - DNA, 25 bp, Rattus norvegicus
ggattatcaattagccgccacctta

SEQ ID NO: 434027 - DNA, 25 bp, Rattus norvegicus
ggattatcaatttgccgccacctta

SEQ ID NO: 434028 - DNA, 25 bp, Rattus norvegicus
ggattatcacacaacttcaatagct

SEQ ID NO: 434029 - DNA, 25 bp, Rattus norvegicus
ggattatcacactacttcaatagct

SEQ ID NO: 434030 - DNA, 25 bp, Rattus norvegicus
ggattatcacatcgccctgtttata

SEQ ID NO: 434031 - DNA, 25 bp, Rattus norvegicus
ggattatcacatggccctgtttata

SEQ ID NO: 434032 - DNA, 25 bp, Rattus norvegicus
ggattatcagccatgcatgaacgat

SEQ ID NO: 434033 - DNA, 25 bp, Rattus norvegicus
ggattatcagccttgcatgaacgat

SEQ ID NO: 434034 - DNA, 25 bp, Rattus norvegicus
ggattatcgctcagttagcttttgt

SEQ ID NO: 434035 - DNA, 25 bp, Rattus norvegicus
ggattatcgctctgttagcttttgt

SEQ ID NO: 434036 - DNA, 25 bp, Rattus norvegicus
ggattatgaattctgggcctgtctg

SEQ ID NO: 434037 - DNA, 25 bp, Rattus norvegicus
ggattatgaattcttcttttgtaca

SEQ ID NO: 434038 - DNA, 25 bp, Rattus norvegicus
ggattatgaattgtgggcctgtctg

SEQ ID NO: 434039 - DNA, 25 bp, Rattus norvegicus
ggattatgaattgttcttttgtaca

SEQ ID NO: 434040 - DNA, 25 bp, Rattus norvegicus
ggattatgccatagcagcccgagac

SEQ ID NO: 434041 - DNA, 25 bp, Rattus norvegicus
ggattatgccattgcagcccgagac

SEQ ID NO: 434042 - DNA, 25 bp, Rattus norvegicus
ggattatgctctaaaaccacccaga

SEQ ID NO: 434043 - DNA, 25 bp, Rattus norvegicus
ggattatgctcttaaaccacccaga

SEQ ID NO: 434044 - DNA, 25 bp, Rattus norvegicus
ggattatggatcacaggtctctgat

SEQ ID NO: 434045 - DNA, 25 bp, Rattus norvegicus
ggattatggatctcaggtctctgat

SEQ ID NO: 434046 - DNA, 25 bp, Rattus norvegicus
ggattatggcatagacgttactagc

SEQ ID NO: 434047 - DNA, 25 bp, Rattus norvegicus
ggattatggcattgacgttactagc

SEQ ID NO: 434048 - DNA, 25 bp, Rattus norvegicus
ggattatgggatctgccaccatgcc

SEQ ID NO: 434049 - DNA, 25 bp, Rattus norvegicus
ggattatgggatgtgccaccatgcc

SEQ ID NO: 434050 - DNA, 25 bp, Rattus norvegicus
ggattatggtttatcatggccttaa

SEQ ID NO: 434051 - DNA, 25 bp, Rattus norvegicus
ggattatggtttttcatggccttaa

SEQ ID NO: 434052 - DNA, 25 bp, Rattus norvegicus
ggattatgtgcaatgcctccacaag

SEQ ID NO: 434053 - DNA, 25 bp, Rattus norvegicus
ggattatgtgcattgcctccacaag

SEQ ID NO: 434054 - DNA, 25 bp, Rattus norvegicus
ggattattacatcactcaactctta

SEQ ID NO: 434055 - DNA, 25 bp, Rattus norvegicus
ggattattacatgactcaactctta

SEQ ID NO: 434056 - DNA, 25 bp, Rattus norvegicus
ggattattacggaaccccaggctgg

SEQ ID NO: 434057 - DNA, 25 bp, Rattus norvegicus
ggattattacggtaccccaggctgg

SEQ ID NO: 434058 - DNA, 25 bp, Rattus norvegicus
ggattattccatatcctgctctgga

SEQ ID NO: 434059 - DNA, 25 bp, Rattus norvegicus
ggattattccatttcctgctctgga

SEQ ID NO: 434060 - DNA, 25 bp, Rattus norvegicus
ggattattggacattcagctctgac

SEQ ID NO: 434061 - DNA, 25 bp, Rattus norvegicus
ggattattggactttcagctctgac

SEQ ID NO: 434062 - DNA, 25 bp, Rattus norvegicus
ggattatttaataccttactgtgga

SEQ ID NO: 434063 - DNA, 25 bp, Rattus norvegicus
ggattatttaattccttactgtgga

SEQ ID NO: 434064 - DNA, 25 bp, Rattus norvegicus
ggattatttataagccacctactaa

SEQ ID NO: 434065 - DNA, 25 bp, Rattus norvegicus
ggattatttatatgccacctactaa

SEQ ID NO: 434066 - DNA, 25 bp, Rattus norvegicus
ggattatttccaacactatttttag

SEQ ID NO: 434067 - DNA, 25 bp, Rattus norvegicus
ggattatttccatcactatttttag

SEQ ID NO: 434068 - DNA, 25 bp, Rattus norvegicus
ggattatttctgaggccaacatatg

SEQ ID NO: 434069 - DNA, 25 bp, Rattus norvegicus
ggattatttctgtggccaacatatg

SEQ ID NO: 434070 - DNA, 25 bp, Rattus norvegicus
ggattatttgcacagactctacagt

SEQ ID NO: 434071 - DNA, 25 bp, Rattus norvegicus
ggattatttgcagagactctacagt

SEQ ID NO: 434072 - DNA, 25 bp, Rattus norvegicus
ggattattttctactaaccaatgct

SEQ ID NO: 434073 - DNA, 25 bp, Rattus norvegicus
ggattattttcttctaaccaatgct

SEQ ID NO: 434074 - DNA, 25 bp, Rattus norvegicus
ggattcaaaaaccagtgccccagtg

SEQ ID NO: 434075 - DNA, 25 bp, Rattus norvegicus
ggattcaaaaacgagtgccccagtg

SEQ ID NO: 434076 - DNA, 25 bp, Rattus norvegicus
ggattcaaaggaagcaccaccacca

SEQ ID NO: 434077 - DNA, 25 bp, Rattus norvegicus
ggattcaaaggatgcaccaccacca

SEQ ID NO: 434078 - DNA, 25 bp, Rattus norvegicus
ggattcaaatgaacgcagctcattg

SEQ ID NO: 434079 - DNA, 25 bp, Rattus norvegicus
ggattcaaatgatcgcagctcattg

SEQ ID NO: 434080 - DNA, 25 bp, Rattus norvegicus
ggattcaaccatacagttacaatac

SEQ ID NO: 434081 - DNA, 25 bp, Rattus norvegicus
ggattcaaccattcagttacaatac

SEQ ID NO: 434082 - DNA, 25 bp, Rattus norvegicus
ggattcaacctaaccatagccatct

SEQ ID NO: 434083 - DNA, 25 bp, Rattus norvegicus
ggattcaacctatccatagccatct

SEQ ID NO: 434084 - DNA, 25 bp, Rattus norvegicus
ggattcaacctgaagtacacgtaca

SEQ ID NO: 434085 - DNA, 25 bp, Rattus norvegicus
ggattcaacctgtagtacacgtaca

SEQ ID NO: 434086 - DNA, 25 bp, Rattus norvegicus
ggattcaatgcgctttcctggtgaa

SEQ ID NO: 434087 - DNA, 25 bp, Rattus norvegicus
ggattcaatgcggtttcctggtgaa

SEQ ID NO: 434088 - DNA, 25 bp, Rattus norvegicus
ggattcacaactatccagtgttagg

SEQ ID NO: 434089 - DNA, 25 bp, Rattus norvegicus
ggattcacaactttccagtgttagg

SEQ ID NO: 434090 - DNA, 25 bp, Rattus norvegicus
ggattcacatcaagacctccacggt

SEQ ID NO: 434091 - DNA, 25 bp, Rattus norvegicus
ggattcacatcatgacctccacggt

SEQ ID NO: 434092 - DNA, 25 bp, Rattus norvegicus
ggattcaccaaacaagctctacaca

SEQ ID NO: 434093 - DNA, 25 bp, Rattus norvegicus
ggattcaccaaagaagctctacaca

SEQ ID NO: 434094 - DNA, 25 bp, Rattus norvegicus
ggattcaccagactaatgtcaagtt

SEQ ID NO: 434095 - DNA, 25 bp, Rattus norvegicus
ggattcaccagagtaatgtcaagtt

SEQ ID NO: 434096 - DNA, 25 bp, Rattus norvegicus
ggattcaccccgagtctacaatggt

SEQ ID NO: 434097 - DNA, 25 bp, Rattus norvegicus
ggattcaccccgtgtctacaatggt

SEQ ID NO: 434098 - DNA, 25 bp, Rattus norvegicus
ggattcacctgcctaaacaaaactg

SEQ ID NO: 434099 - DNA, 25 bp, Rattus norvegicus
ggattcacctgcgtaaacaaaactg

SEQ ID NO: 434100 - DNA, 25 bp, Rattus norvegicus
ggattcacctttaagatggcccatc

SEQ ID NO: 434101 - DNA, 25 bp, Rattus norvegicus
ggattcaccttttagatggcccatc

SEQ ID NO: 434102 - DNA, 25 bp, Rattus norvegicus
ggattcactaatacctgttttcaga

SEQ ID NO: 434103 - DNA, 25 bp, Rattus norvegicus
ggattcactaattcctgttttcaga

SEQ ID NO: 434104 - DNA, 25 bp, Rattus norvegicus
ggattcactccaatttatgcggtag

SEQ ID NO: 434105 - DNA, 25 bp, Rattus norvegicus
ggattcactccattttatgcggtag

SEQ ID NO: 434106 - DNA, 25 bp, Rattus norvegicus
ggattcagactcagcaatggtgcca

SEQ ID NO: 434107 - DNA, 25 bp, Rattus norvegicus
ggattcagactctgcaatggtgcca

SEQ ID NO: 434108 - DNA, 25 bp, Rattus norvegicus
ggattcagataaatacagagttttt

SEQ ID NO: 434109 - DNA, 25 bp, Rattus norvegicus
ggattcagataattacagagttttt

SEQ ID NO: 434110 - DNA, 25 bp, Rattus norvegicus
ggattcagatgtctgccaagcacag

SEQ ID NO: 434111 - DNA, 25 bp, Rattus norvegicus
ggattcagatgtgtgccaagcacag

SEQ ID NO: 434112 - DNA, 25 bp, Rattus norvegicus
ggattcagccgtacaagaacttctt

SEQ ID NO: 434113 - DNA, 25 bp, Rattus norvegicus
ggattcagccgttcaagaacttctt

SEQ ID NO: 434114 - DNA, 25 bp, Rattus norvegicus
ggattcagcctccataaagaactgg

SEQ ID NO: 434115 - DNA, 25 bp, Rattus norvegicus
ggattcagcctcgataaagaactgg

SEQ ID NO: 434116 - DNA, 25 bp, Rattus norvegicus
ggattcagctataggcgcagtttat

SEQ ID NO: 434117 - DNA, 25 bp, Rattus norvegicus
ggattcagctattggcgcagtttat

SEQ ID NO: 434118 - DNA, 25 bp, Rattus norvegicus
ggattcagcttacttccagggcatc

SEQ ID NO: 434119 - DNA, 25 bp, Rattus norvegicus
ggattcagcttagttccagggcatc

SEQ ID NO: 434120 - DNA, 25 bp, Rattus norvegicus
ggattcaggagtctgtccccagtgc

SEQ ID NO: 434121 - DNA, 25 bp, Rattus norvegicus
ggattcaggagtgtgtccccagtgc

SEQ ID NO: 434122 - DNA, 25 bp, Rattus norvegicus
ggattcaggcacatgtttacagact

SEQ ID NO: 434123 - DNA, 25 bp, Rattus norvegicus
ggattcaggcacttgtttacagact

SEQ ID NO: 434124 - DNA, 25 bp, Rattus norvegicus
ggattcagggttcaaggcaaagggc

SEQ ID NO: 434125 - DNA, 25 bp, Rattus norvegicus
ggattcagggttgaaggcaaagggc

SEQ ID NO: 434126 - DNA, 25 bp, Rattus norvegicus
ggattcagtaaaactagccatcaat

SEQ ID NO: 434127 - DNA, 25 bp, Rattus norvegicus
ggattcagtaaatctagccatcaat

SEQ ID NO: 434128 - DNA, 25 bp, Rattus norvegicus
ggattcagtcagcttatgcagggct

SEQ ID NO: 434129 - DNA, 25 bp, Rattus norvegicus
ggattcagtcaggttatgcagggct

SEQ ID NO: 434130 - DNA, 25 bp, Rattus norvegicus
ggattcagtcctctttttcagcaaa

SEQ ID NO: 434131 - DNA, 25 bp, Rattus norvegicus
ggattcagtcctgtttttcagcaaa

SEQ ID NO: 434132 - DNA, 25 bp, Rattus norvegicus
ggattcagtctccagtactctaaaa

SEQ ID NO: 434133 - DNA, 25 bp, Rattus norvegicus
ggattcagtctcgagtactctaaaa

SEQ ID NO: 434134 - DNA, 25 bp, Rattus norvegicus
ggattcagtgttccccagtaatctt

SEQ ID NO: 434135 - DNA, 25 bp, Rattus norvegicus
ggattcagtgttgcccagtaatctt

SEQ ID NO: 434136 - DNA, 25 bp, Rattus norvegicus
ggattcagttttcaagagccgttca

SEQ ID NO: 434137 - DNA, 25 bp, Rattus norvegicus
ggattcagttttgaagagccgttca

SEQ ID NO: 434138 - DNA, 25 bp, Rattus norvegicus
ggattcataggcattggtttgtctt

SEQ ID NO: 434139 - DNA, 25 bp, Rattus norvegicus
ggattcataggctttggtttgtctt

SEQ ID NO: 434140 - DNA, 25 bp, Rattus norvegicus
ggattcatctacaacgttcaagatc

SEQ ID NO: 434141 - DNA, 25 bp, Rattus norvegicus
ggattcatctactacgttcaagatc

SEQ ID NO: 434142 - DNA, 25 bp, Rattus norvegicus
ggattcatctggcattttaccctga

SEQ ID NO: 434143 - DNA, 25 bp, Rattus norvegicus
ggattcatctgggattttaccctga

SEQ ID NO: 434144 - DNA, 25 bp, Rattus norvegicus
ggattcatctttagccaaccttgtg

SEQ ID NO: 434145 - DNA, 25 bp, Rattus norvegicus
ggattcatcttttgccaaccttgtg

SEQ ID NO: 434146 - DNA, 25 bp, Rattus norvegicus
ggattcatggctaggtttgctctaa

SEQ ID NO: 434147 - DNA, 25 bp, Rattus norvegicus
ggattcatggcttggtttgctctaa

SEQ ID NO: 434148 - DNA, 25 bp, Rattus norvegicus
ggattcatgtggctgaactcgctaa

SEQ ID NO: 434149 - DNA, 25 bp, Rattus norvegicus
ggattcatgtgggtgaactcgctaa

SEQ ID NO: 434150 - DNA, 25 bp, Rattus norvegicus
ggattcatgtttcttttgctatgca

SEQ ID NO: 434151 - DNA, 25 bp, Rattus norvegicus
ggattcatgtttgttttgctatgca

SEQ ID NO: 434152 - DNA, 25 bp, Rattus norvegicus
ggattcattcctcagaagccaccca

SEQ ID NO: 434153 - DNA, 25 bp, Rattus norvegicus
ggattcattcctgagaagccaccca

SEQ ID NO: 434154 - DNA, 25 bp, Rattus norvegicus
ggattcattcgcatggtctttgtaa

SEQ ID NO: 434155 - DNA, 25 bp, Rattus norvegicus
ggattcattcgcttggtctttgtaa

SEQ ID NO: 434156 - DNA, 25 bp, Rattus norvegicus
ggattcattctaagtgtcctcctag

SEQ ID NO: 434157 - DNA, 25 bp, Rattus norvegicus
ggattcattctatgtgtcctcctag

SEQ ID NO: 434158 - DNA, 25 bp, Rattus norvegicus
ggattcattctcatgatcatggtct

SEQ ID NO: 434159 - DNA, 25 bp, Rattus norvegicus
ggattcattctcttgatcatggtct

SEQ ID NO: 434160 - DNA, 25 bp, Rattus norvegicus
ggattccaaagcacctaaatgtgat

SEQ ID NO: 434161 - DNA, 25 bp, Rattus norvegicus
ggattccaaagctcctaaatgtgat

SEQ ID NO: 434162 - DNA, 25 bp, Rattus norvegicus
ggattccaacacagacggacgattg

SEQ ID NO: 434163 - DNA, 25 bp, Rattus norvegicus
ggattccaacactgacggacgattg

SEQ ID NO: 434164 - DNA, 25 bp, Rattus norvegicus
ggattccaactcagtttacactcaa

SEQ ID NO: 434165 - DNA, 25 bp, Rattus norvegicus
ggattccaactctgtttacactcaa

SEQ ID NO: 434166 - DNA, 25 bp, Rattus norvegicus
ggattccacaaactgtcctgcatgt

SEQ ID NO: 434167 - DNA, 25 bp, Rattus norvegicus
ggattccacaaagtgtcctgcatgt

SEQ ID NO: 434168 - DNA, 25 bp, Rattus norvegicus
ggattccacactccatcgatccagt

SEQ ID NO: 434169 - DNA, 25 bp, Rattus norvegicus
ggattccacactgcatcgatccagt

SEQ ID NO: 434170 - DNA, 25 bp, Rattus norvegicus
ggattccacattatgacttcccatc

SEQ ID NO: 434171 - DNA, 25 bp, Rattus norvegicus
ggattccacattttgacttcccatc

SEQ ID NO: 434172 - DNA, 25 bp, Rattus norvegicus
ggattccagatgcactgttgcccca

SEQ ID NO: 434173 - DNA, 25 bp, Rattus norvegicus
ggattccagatggactgttgcccca

SEQ ID NO: 434174 - DNA, 25 bp, Rattus norvegicus
ggattccaggaacgctcattgatgt

SEQ ID NO: 434175 - DNA, 25 bp, Rattus norvegicus
ggattccaggaaggctcattgatgt

SEQ ID NO: 434176 - DNA, 25 bp, Rattus norvegicus
ggattccaggtcagtgccaccaagc

SEQ ID NO: 434177 - DNA, 25 bp, Rattus norvegicus
ggattccaggtctgtgccaccaagc

SEQ ID NO: 434178 - DNA, 25 bp, Rattus norvegicus
ggattccagttcaaatgttcaacat

SEQ ID NO: 434179 - DNA, 25 bp, Rattus norvegicus
ggattccagttctaatgttcaacat

SEQ ID NO: 434180 - DNA, 25 bp, Rattus norvegicus
ggattccagttgactgtctagctca

SEQ ID NO: 434181 - DNA, 25 bp, Rattus norvegicus
ggattccagttgtctgtctagctca

SEQ ID NO: 434182 - DNA, 25 bp, Rattus norvegicus
ggattccatcagctaccacagcaat

SEQ ID NO: 434183 - DNA, 25 bp, Rattus norvegicus
ggattccatcaggtaccacagcaat

SEQ ID NO: 434184 - DNA, 25 bp, Rattus norvegicus
ggattccatcccaaaccacataaat

SEQ ID NO: 434185 - DNA, 25 bp, Rattus norvegicus
ggattccatccctaaccacataaat

SEQ ID NO: 434186 - DNA, 25 bp, Rattus norvegicus
ggattcccgtcaatgatgttttcag

SEQ ID NO: 434187 - DNA, 25 bp, Rattus norvegicus
ggattcccgtcattgatgttttcag

SEQ ID NO: 434188 - DNA, 25 bp, Rattus norvegicus
ggattccctctgaggaacgtcagtt

SEQ ID NO: 434189 - DNA, 25 bp, Rattus norvegicus
ggattccctctgtggaacgtcagtt

SEQ ID NO: 434190 - DNA, 25 bp, Rattus norvegicus
ggattccctgaacttttatcaacct

SEQ ID NO: 434191 - DNA, 25 bp, Rattus norvegicus
ggattccctgaagttttatcaacct

SEQ ID NO: 434192 - DNA, 25 bp, Rattus norvegicus
ggattccgcctgcttggtttgaaat

SEQ ID NO: 434193 - DNA, 25 bp, Rattus norvegicus
ggattccgcctggttggtttgaaat

SEQ ID NO: 434194 - DNA, 25 bp, Rattus norvegicus
ggattccggactctgtgatttctga

SEQ ID NO: 434195 - DNA, 25 bp, Rattus norvegicus
ggattccggactgtgtgatttctga

SEQ ID NO: 434196 - DNA, 25 bp, Rattus norvegicus
ggattccgtgacagaagcctgatgg

SEQ ID NO: 434197 - DNA, 25 bp, Rattus norvegicus
ggattccgtgactgaagcctgatgg

SEQ ID NO: 434198 - DNA, 25 bp, Rattus norvegicus
ggattcctaacactgagaacatctt

SEQ ID NO: 434199 - DNA, 25 bp, Rattus norvegicus
ggattcctaacagtgagaacatctt

SEQ ID NO: 434200 - DNA, 25 bp, Rattus norvegicus
ggattcctaagaagatgcagacccc

SEQ ID NO: 434201 - DNA, 25 bp, Rattus norvegicus
ggattcctaagatgatgcagacccc

SEQ ID NO: 434202 - DNA, 25 bp, Rattus norvegicus
ggattcctaagtcctctctgggagc

SEQ ID NO: 434203 - DNA, 25 bp, Rattus norvegicus
ggattcctaagtgctctctgggagc

SEQ ID NO: 434204 - DNA, 25 bp, Rattus norvegicus
ggattcctacagcaagccccagaaa

SEQ ID NO: 434205 - DNA, 25 bp, Rattus norvegicus
ggattcctacaggaagccccagaaa

SEQ ID NO: 434206 - DNA, 25 bp, Rattus norvegicus
ggattcctactgctcctacatgggt

SEQ ID NO: 434207 - DNA, 25 bp, Rattus norvegicus
ggattcctactggtcctacatgggt

SEQ ID NO: 434208 - DNA, 25 bp, Rattus norvegicus
ggattcctaggaagcagtgaatgga

SEQ ID NO: 434209 - DNA, 25 bp, Rattus norvegicus
ggattcctaggatgcagtgaatgga

SEQ ID NO: 434210 - DNA, 25 bp, Rattus norvegicus
ggattcctagggactcaggcaggca

SEQ ID NO: 434211 - DNA, 25 bp, Rattus norvegicus
ggattcctagggtctcaggcaggca

SEQ ID NO: 434212 - DNA, 25 bp, Rattus norvegicus
ggattcctatgcatttcctggtagc

SEQ ID NO: 434213 - DNA, 25 bp, Rattus norvegicus
ggattcctatgcttttcctggtagc

SEQ ID NO: 434214 - DNA, 25 bp, Rattus norvegicus
ggattcctcatcagatgtgctctgt

SEQ ID NO: 434215 - DNA, 25 bp, Rattus norvegicus
ggattcctcatctgatgtgctctgt

SEQ ID NO: 434216 - DNA, 25 bp, Rattus norvegicus
ggattcctccctcaaaggacgttct

SEQ ID NO: 434217 - DNA, 25 bp, Rattus norvegicus
ggattcctccctgaaaggacgttct

SEQ ID NO: 434218 - DNA, 25 bp, Rattus norvegicus
ggattcctcttgagtcagagccttg

SEQ ID NO: 434219 - DNA, 25 bp, Rattus norvegicus
ggattcctcttgtgtcagagccttg

SEQ ID NO: 434220 - DNA, 25 bp, Rattus norvegicus
ggattcctgactcacagcatggctg

SEQ ID NO: 434221 - DNA, 25 bp, Rattus norvegicus
ggattcctgactgacagcatggctg

SEQ ID NO: 434222 - DNA, 25 bp, Rattus norvegicus
ggattcctgagcacgcatattgtcg

SEQ ID NO: 434223 - DNA, 25 bp, Rattus norvegicus
ggattcctgagctcgcatattgtcg

SEQ ID NO: 434224 - DNA, 25 bp, Rattus norvegicus
ggattcctggatcataggcctcagc

SEQ ID NO: 434225 - DNA, 25 bp, Rattus norvegicus
ggattcctggatgataggcctcagc

SEQ ID NO: 434226 - DNA, 25 bp, Rattus norvegicus
ggattcctggcaagcacggaggatt

SEQ ID NO: 434227 - DNA, 25 bp, Rattus norvegicus
ggattcctggcatgcacggaggatt

SEQ ID NO: 434228 - DNA, 25 bp, Rattus norvegicus
ggattcctggtgaccaatgttttct

SEQ ID NO: 434229 - DNA, 25 bp, Rattus norvegicus
ggattcctggtgtccaatgttttct

SEQ ID NO: 434230 - DNA, 25 bp, Rattus norvegicus
ggattcctgtgcatgcaaaccagca

SEQ ID NO: 434231 - DNA, 25 bp, Rattus norvegicus
ggattcctgtgcttgcaaaccagca

SEQ ID NO: 434232 - DNA, 25 bp, Rattus norvegicus
ggattcctttgtagtgactttgtct

SEQ ID NO: 434233 - DNA, 25 bp, Rattus norvegicus
ggattcctttgttgtgactttgtct

SEQ ID NO: 434234 - DNA, 25 bp, Rattus norvegicus
ggattcgaagtcaaagccgacccaa

SEQ ID NO: 434235 - DNA, 25 bp, Rattus norvegicus
ggattcgaagtctaagccgacccaa

SEQ ID NO: 434236 - DNA, 25 bp, Rattus norvegicus
ggattcgagatgacccattacttaa

SEQ ID NO: 434237 - DNA, 25 bp, Rattus norvegicus
ggattcgagatgtcccattacttaa

SEQ ID NO: 434238 - DNA, 25 bp, Rattus norvegicus
ggattcgaggccaacttcaccacaa

SEQ ID NO: 434239 - DNA, 25 bp, Rattus norvegicus
ggattcgaggcctacttcaccacaa

SEQ ID NO: 434240 - DNA, 25 bp, Rattus norvegicus
ggattcgagggcatctttcagtcct

SEQ ID NO: 434241 - DNA, 25 bp, Rattus norvegicus
ggattcgagggcttctttcagtcct

SEQ ID NO: 434242 - DNA, 25 bp, Rattus norvegicus
ggattcggatcgacaccgcttgcgt

SEQ ID NO: 434243 - DNA, 25 bp, Rattus norvegicus
ggattcggatcgtcaccgcttgcgt

SEQ ID NO: 434244 - DNA, 25 bp, Rattus norvegicus
ggattcggctggagaaggtcctatt

SEQ ID NO: 434245 - DNA, 25 bp, Rattus norvegicus
ggattcggctggtgaaggtcctatt

SEQ ID NO: 434246 - DNA, 25 bp, Rattus norvegicus
ggattcgtattactctcgttacttt

SEQ ID NO: 434247 - DNA, 25 bp, Rattus norvegicus
ggattcgtattagtctcgttacttt

SEQ ID NO: 434248 - DNA, 25 bp, Rattus norvegicus
ggattcgtcaaacagccctggtgga

SEQ ID NO: 434249 - DNA, 25 bp, Rattus norvegicus
ggattcgtcaaagagccctggtgga

SEQ ID NO: 434250 - DNA, 25 bp, Rattus norvegicus
ggattcgtcagaacttcatcttgct

SEQ ID NO: 434251 - DNA, 25 bp, Rattus norvegicus
ggattcgtcagatcttcatcttgct

SEQ ID NO: 434252 - DNA, 25 bp, Rattus norvegicus
ggattcgtcatcaatgcatcaactg

SEQ ID NO: 434253 - DNA, 25 bp, Rattus norvegicus
ggattcgtcatctatgcatcaactg

SEQ ID NO: 434254 - DNA, 25 bp, Rattus norvegicus
ggattctaacaacactctctcctct

SEQ ID NO: 434255 - DNA, 25 bp, Rattus norvegicus
ggattctaacaagactctctcctct

SEQ ID NO: 434256 - DNA, 25 bp, Rattus norvegicus
ggattctaagtgcttccagcctata

SEQ ID NO: 434257 - DNA, 25 bp, Rattus norvegicus
ggattctaagtggttccagcctata

SEQ ID NO: 434258 - DNA, 25 bp, Rattus norvegicus
ggattctacaatctttggtttctga

SEQ ID NO: 434259 - DNA, 25 bp, Rattus norvegicus
ggattctacaatgtttggtttctga

SEQ ID NO: 434260 - DNA, 25 bp, Rattus norvegicus
ggattctacagaattgaccagtgct

SEQ ID NO: 434261 - DNA, 25 bp, Rattus norvegicus
ggattctacagatttgaccagtgct

SEQ ID NO: 434262 - DNA, 25 bp, Rattus norvegicus
ggattctacgtcagagcggcttata

SEQ ID NO: 434263 - DNA, 25 bp, Rattus norvegicus
ggattctacgtctgagcggcttata

SEQ ID NO: 434264 - DNA, 25 bp, Rattus norvegicus
ggattctagcctactgattgctgta

SEQ ID NO: 434265 - DNA, 25 bp, Rattus norvegicus
ggattctagcctagtgtcagctata

SEQ ID NO: 434266 - DNA, 25 bp, Rattus norvegicus
ggattctagccttctgattgctgta

SEQ ID NO: 434267 - DNA, 25 bp, Rattus norvegicus
ggattctagccttgtgtcagctata

SEQ ID NO: 434268 - DNA, 25 bp, Rattus norvegicus
ggattctatgttattcggcatcatt

SEQ ID NO: 434269 - DNA, 25 bp, Rattus norvegicus
ggattctatgttctcattttctatg

SEQ ID NO: 434270 - DNA, 25 bp, Rattus norvegicus
ggattctatgttgtcattttctatg

SEQ ID NO: 434271 - DNA, 25 bp, Rattus norvegicus
ggattctatgtttttcggcatcatt

SEQ ID NO: 434272 - DNA, 25 bp, Rattus norvegicus
ggattctatttccaggacccacgag

SEQ ID NO: 434273 - DNA, 25 bp, Rattus norvegicus
ggattctatttcgaggacccacgag

SEQ ID NO: 434274 - DNA, 25 bp, Rattus norvegicus
ggattctcaagtacttctcctttta

SEQ ID NO: 434275 - DNA, 25 bp, Rattus norvegicus
ggattctcaagttcttctcctttta

SEQ ID NO: 434276 - DNA, 25 bp, Rattus norvegicus
ggattctcagttacaaagctgactt

SEQ ID NO: 434277 - DNA, 25 bp, Rattus norvegicus
ggattctcagtttcaaagctgactt

SEQ ID NO: 434278 - DNA, 25 bp, Rattus norvegicus
ggattctccatcctcaatgggttta

SEQ ID NO: 434279 - DNA, 25 bp, Rattus norvegicus
ggattctccatcgtcaatgggttta

SEQ ID NO: 434280 - DNA, 25 bp, Rattus norvegicus
ggattctcccacctcaaaagtattg

SEQ ID NO: 434281 - DNA, 25 bp, Rattus norvegicus
ggattctcccacgtcaaaagtattg

SEQ ID NO: 434282 - DNA, 25 bp, Rattus norvegicus
ggattctcctacatgggtttgaact

SEQ ID NO: 434283 - DNA, 25 bp, Rattus norvegicus
ggattctcctacttgggtttgaact

SEQ ID NO: 434284 - DNA, 25 bp, Rattus norvegicus
ggattctcctggatttcagtgttta

SEQ ID NO: 434285 - DNA, 25 bp, Rattus norvegicus
ggattctcctggttttcagtgttta

SEQ ID NO: 434286 - DNA, 25 bp, Rattus norvegicus
ggattctcttacacaactgctatag

SEQ ID NO: 434287 - DNA, 25 bp, Rattus norvegicus
ggattctcttacacagatgccaaca

SEQ ID NO: 434288 - DNA, 25 bp, Rattus norvegicus
ggattctcttactcaactgctatag

SEQ ID NO: 434289 - DNA, 25 bp, Rattus norvegicus
ggattctcttactcagatgccaaca

SEQ ID NO: 434290 - DNA, 25 bp, Rattus norvegicus
ggattctctttgctgttactggatc

SEQ ID NO: 434291 - DNA, 25 bp, Rattus norvegicus
ggattctctttggtgttactggatc

SEQ ID NO: 434292 - DNA, 25 bp, Rattus norvegicus
ggattctgaactaactcatgaaaca

SEQ ID NO: 434293 - DNA, 25 bp, Rattus norvegicus
ggattctgaacttactcatgaaaca

SEQ ID NO: 434294 - DNA, 25 bp, Rattus norvegicus
ggattctgaatcctcgaaaggcttc

SEQ ID NO: 434295 - DNA, 25 bp, Rattus norvegicus
ggattctgaatcgtcgaaaggcttc

SEQ ID NO: 434296 - DNA, 25 bp, Rattus norvegicus
ggattctgaattacctgctattaaa

SEQ ID NO: 434297 - DNA, 25 bp, Rattus norvegicus
ggattctgaatttcctgctattaaa

SEQ ID NO: 434298 - DNA, 25 bp, Rattus norvegicus
ggattctgacctaacttgtctgcag

SEQ ID NO: 434299 - DNA, 25 bp, Rattus norvegicus
ggattctgacctccattttgggttt

SEQ ID NO: 434300 - DNA, 25 bp, Rattus norvegicus
ggattctgacctgcattttgggttt

SEQ ID NO: 434301 - DNA, 25 bp, Rattus norvegicus
ggattctgaccttacttgtctgcag

SEQ ID NO: 434302 - DNA, 25 bp, Rattus norvegicus
ggattctgagagcatgcgcccatct

SEQ ID NO: 434303 - DNA, 25 bp, Rattus norvegicus
ggattctgagaggatgcgcccatct

SEQ ID NO: 434304 - DNA, 25 bp, Rattus norvegicus
ggattctgatgtcttcaggctacat

SEQ ID NO: 434305 - DNA, 25 bp, Rattus norvegicus
ggattctgatgtgttcaggctacat

SEQ ID NO: 434306 - DNA, 25 bp, Rattus norvegicus
ggattctgcctaaggaagctcctac

SEQ ID NO: 434307 - DNA, 25 bp, Rattus norvegicus
ggattctgcctatggaagctcctac

SEQ ID NO: 434308 - DNA, 25 bp, Rattus norvegicus
ggattctggatcaactcttaccctt

SEQ ID NO: 434309 - DNA, 25 bp, Rattus norvegicus
ggattctggatctactcttaccctt

SEQ ID NO: 434310 - DNA, 25 bp, Rattus norvegicus
ggattctggctgcatcaccatgaag

SEQ ID NO: 434311 - DNA, 25 bp, Rattus norvegicus
ggattctggctggatcaccatgaag

SEQ ID NO: 434312 - DNA, 25 bp, Rattus norvegicus
ggattctgtacaatccgtgggaact

SEQ ID NO: 434313 - DNA, 25 bp, Rattus norvegicus
ggattctgtacattccgtgggaact

SEQ ID NO: 434314 - DNA, 25 bp, Rattus norvegicus
ggattctgtagactccgcagcgttc

SEQ ID NO: 434315 - DNA, 25 bp, Rattus norvegicus
ggattctgtagagtccgcagcgttc

SEQ ID NO: 434316 - DNA, 25 bp, Rattus norvegicus
ggattctgtcatatatctttcgaaa

SEQ ID NO: 434317 - DNA, 25 bp, Rattus norvegicus
ggattctgtcatttatctttcgaaa

SEQ ID NO: 434318 - DNA, 25 bp, Rattus norvegicus
ggattctgtttacctgtacctggta

SEQ ID NO: 434319 - DNA, 25 bp, Rattus norvegicus
ggattctgtttagctgtacctggta

SEQ ID NO: 434320 - DNA, 25 bp, Rattus norvegicus
ggattcttatgtctaattagtctcc

SEQ ID NO: 434321 - DNA, 25 bp, Rattus norvegicus
ggattcttatgtgtaattagtctcc

SEQ ID NO: 434322 - DNA, 25 bp, Rattus norvegicus
ggattcttcagccaccgctgacaga

SEQ ID NO: 434323 - DNA, 25 bp, Rattus norvegicus
ggattcttcagcgaccgctgacaga

SEQ ID NO: 434324 - DNA, 25 bp, Rattus norvegicus
ggattcttccatatagcaatatgta

SEQ ID NO: 434325 - DNA, 25 bp, Rattus norvegicus
ggattcttccatttagcaatatgta

SEQ ID NO: 434326 - DNA, 25 bp, Rattus norvegicus
ggattcttcctgaaccctccagtag

SEQ ID NO: 434327 - DNA, 25 bp, Rattus norvegicus
ggattcttcctgacagtctattcat

SEQ ID NO: 434328 - DNA, 25 bp, Rattus norvegicus
ggattcttcctgtaccctccagtag

SEQ ID NO: 434329 - DNA, 25 bp, Rattus norvegicus
ggattcttcctgtcagtctattcat

SEQ ID NO: 434330 - DNA, 25 bp, Rattus norvegicus
ggattcttctataggtcttgtctat

SEQ ID NO: 434331 - DNA, 25 bp, Rattus norvegicus
ggattcttctattggtcttgtctat

SEQ ID NO: 434332 - DNA, 25 bp, Rattus norvegicus
ggattcttgaacaagcctctctgac

SEQ ID NO: 434333 - DNA, 25 bp, Rattus norvegicus
ggattcttgaactagcctctctgac

SEQ ID NO: 434334 - DNA, 25 bp, Rattus norvegicus
ggattctttcatcgataactctgag

SEQ ID NO: 434335 - DNA, 25 bp, Rattus norvegicus
ggattctttcatggataactctgag

SEQ ID NO: 434336 - DNA, 25 bp, Rattus norvegicus
ggattctttctcagacaagttgtag

SEQ ID NO: 434337 - DNA, 25 bp, Rattus norvegicus
ggattctttctctgacaagttgtag

SEQ ID NO: 434338 - DNA, 25 bp, Rattus norvegicus
ggattctttcttcttacggtgtcat

SEQ ID NO: 434339 - DNA, 25 bp, Rattus norvegicus
ggattctttcttgttacggtgtcat

SEQ ID NO: 434340 - DNA, 25 bp, Rattus norvegicus
ggattctttggtaattttctacatt

SEQ ID NO: 434341 - DNA, 25 bp, Rattus norvegicus
ggattctttggttattttctacatt

SEQ ID NO: 434342 - DNA, 25 bp, Rattus norvegicus
ggattcttttccatgagggctcata

SEQ ID NO: 434343 - DNA, 25 bp, Rattus norvegicus
ggattcttttccttgagggctcata

SEQ ID NO: 434344 - DNA, 25 bp, Rattus norvegicus
ggattgaaacttcgtgcccttagtt

SEQ ID NO: 434345 - DNA, 25 bp, Rattus norvegicus
ggattgaaacttggtgcccttagtt

SEQ ID NO: 434346 - DNA, 25 bp, Rattus norvegicus
ggattgaaataactcacacccttta

SEQ ID NO: 434347 - DNA, 25 bp, Rattus norvegicus
ggattgaaataagtcacacccttta

SEQ ID NO: 434348 - DNA, 25 bp, Rattus norvegicus
ggattgaaggcaccctccttaggag

SEQ ID NO: 434349 - DNA, 25 bp, Rattus norvegicus
ggattgaaggcagcctccttaggag

SEQ ID NO: 434350 - DNA, 25 bp, Rattus norvegicus
ggattgacacatctaaggtcctgaa

SEQ ID NO: 434351 - DNA, 25 bp, Rattus norvegicus
ggattgacacatgtaaggtcctgaa

SEQ ID NO: 434352 - DNA, 25 bp, Rattus norvegicus
ggattgacccccaccggaagaagag

SEQ ID NO: 434353 - DNA, 25 bp, Rattus norvegicus
ggattgaccccctccggaagaagag

SEQ ID NO: 434354 - DNA, 25 bp, Rattus norvegicus
ggattgacgccccagatgatgtatt

SEQ ID NO: 434355 - DNA, 25 bp, Rattus norvegicus
ggattgacgcccgagatgatgtatt

SEQ ID NO: 434356 - DNA, 25 bp, Rattus norvegicus
ggattgagaaccaagtcaccccaca

SEQ ID NO: 434357 - DNA, 25 bp, Rattus norvegicus
ggattgagaacctagtcaccccaca

SEQ ID NO: 434358 - DNA, 25 bp, Rattus norvegicus
ggattgagcagtacaccaccttaac

SEQ ID NO: 434359 - DNA, 25 bp, Rattus norvegicus
ggattgagcagttcaccaccttaac

SEQ ID NO: 434360 - DNA, 25 bp, Rattus norvegicus
ggattgagctggactctgactcgga

SEQ ID NO: 434361 - DNA, 25 bp, Rattus norvegicus
ggattgagctggtctctgactcgga

SEQ ID NO: 434362 - DNA, 25 bp, Rattus norvegicus
ggattgaggaacactccttcactgt

SEQ ID NO: 434363 - DNA, 25 bp, Rattus norvegicus
ggattgaggaactctccttcactgt

SEQ ID NO: 434364 - DNA, 25 bp, Rattus norvegicus
ggattgaggccacttgatcagagta

SEQ ID NO: 434365 - DNA, 25 bp, Rattus norvegicus
ggattgaggccagttgatcagagta

SEQ ID NO: 434366 - DNA, 25 bp, Rattus norvegicus
ggattgatattcacacgtgttcagt

SEQ ID NO: 434367 - DNA, 25 bp, Rattus norvegicus
ggattgatattctcacgtgttcagt

SEQ ID NO: 434368 - DNA, 25 bp, Rattus norvegicus
ggattgatgaaaccccgccagtgga

SEQ ID NO: 434369 - DNA, 25 bp, Rattus norvegicus
ggattgatgaaagcccgccagtgga

SEQ ID NO: 434370 - DNA, 25 bp, Rattus norvegicus
ggattgatggtgagcaccacccctg

SEQ ID NO: 434371 - DNA, 25 bp, Rattus norvegicus
ggattgatggtgtgcaccacccctg

SEQ ID NO: 434372 - DNA, 25 bp, Rattus norvegicus
ggattgattgtacggaacctccagt

SEQ ID NO: 434373 - DNA, 25 bp, Rattus norvegicus
ggattgattgtagggaacctccagt

SEQ ID NO: 434374 - DNA, 25 bp, Rattus norvegicus
ggattgatttctaagctgctgtgta

SEQ ID NO: 434375 - DNA, 25 bp, Rattus norvegicus
ggattgatttcttagctgctgtgta

SEQ ID NO: 434376 - DNA, 25 bp, Rattus norvegicus
ggattgcaaaccatgttgagccaaa

SEQ ID NO: 434377 - DNA, 25 bp, Rattus norvegicus
ggattgcaaaccttgttgagccaaa

SEQ ID NO: 434378 - DNA, 25 bp, Rattus norvegicus
ggattgcacagcaagcaccttacca

SEQ ID NO: 434379 - DNA, 25 bp, Rattus norvegicus
ggattgcacagctagcaccttacca

SEQ ID NO: 434380 - DNA, 25 bp, Rattus norvegicus
ggattgcaccacaacttcagacttg

SEQ ID NO: 434381 - DNA, 25 bp, Rattus norvegicus
ggattgcaccactacttcagacttg

SEQ ID NO: 434382 - DNA, 25 bp, Rattus norvegicus
ggattgcaccttagttactgcacac

SEQ ID NO: 434383 - DNA, 25 bp, Rattus norvegicus
ggattgcacctttgttactgcacac

SEQ ID NO: 434384 - DNA, 25 bp, Rattus norvegicus
ggattgcactgaccagtcgttgtca

SEQ ID NO: 434385 - DNA, 25 bp, Rattus norvegicus
ggattgcactgagcagtcgttgtca

SEQ ID NO: 434386 - DNA, 25 bp, Rattus norvegicus
ggattgcagaagcactctgccttct

SEQ ID NO: 434387 - DNA, 25 bp, Rattus norvegicus
ggattgcagaaggactctgccttct

SEQ ID NO: 434388 - DNA, 25 bp, Rattus norvegicus
ggattgcagataacactttcattta

SEQ ID NO: 434389 - DNA, 25 bp, Rattus norvegicus
ggattgcagatatcactttcattta

SEQ ID NO: 434390 - DNA, 25 bp, Rattus norvegicus
ggattgcaggtcagaggtcactcta

SEQ ID NO: 434391 - DNA, 25 bp, Rattus norvegicus
ggattgcaggtctgaggtcactcta

SEQ ID NO: 434392 - DNA, 25 bp, Rattus norvegicus
ggattgcatttcactcttgcatgaa

SEQ ID NO: 434393 - DNA, 25 bp, Rattus norvegicus
ggattgcatttctctcttgcatgaa

SEQ ID NO: 434394 - DNA, 25 bp, Rattus norvegicus
ggattgccaagtccagcagtctgct

SEQ ID NO: 434395 - DNA, 25 bp, Rattus norvegicus
ggattgccaagtgcagcagtctgct

SEQ ID NO: 434396 - DNA, 25 bp, Rattus norvegicus
ggattgccacacacaaaattacctg

SEQ ID NO: 434397 - DNA, 25 bp, Rattus norvegicus
ggattgccacactcaaaattacctg

SEQ ID NO: 434398 - DNA, 25 bp, Rattus norvegicus
ggattgccacatatgaggccaacat

SEQ ID NO: 434399 - DNA, 25 bp, Rattus norvegicus
ggattgccacatttgaggccaacat

SEQ ID NO: 434400 - DNA, 25 bp, Rattus norvegicus
ggattgcccagaacagagccagcct

SEQ ID NO: 434401 - DNA, 25 bp, Rattus norvegicus
ggattgcccagatcagagccagcct

SEQ ID NO: 434402 - DNA, 25 bp, Rattus norvegicus
ggattgcccgacaacactgtgatat

SEQ ID NO: 434403 - DNA, 25 bp, Rattus norvegicus
ggattgcccgactacactgtgatat

SEQ ID NO: 434404 - DNA, 25 bp, Rattus norvegicus
ggattgcctgttctctacattttat

SEQ ID NO: 434405 - DNA, 25 bp, Rattus norvegicus
ggattgcctgttgtctacattttat

SEQ ID NO: 434406 - DNA, 25 bp, Rattus norvegicus
ggattgccttgtctggccttagtga

SEQ ID NO: 434407 - DNA, 25 bp, Rattus norvegicus
ggattgccttgtgtggccttagtga

SEQ ID NO: 434408 - DNA, 25 bp, Rattus norvegicus
ggattgcgtgtcagtgcccagagct

SEQ ID NO: 434409 - DNA, 25 bp, Rattus norvegicus
ggattgcgtgtctgtgcccagagct

SEQ ID NO: 434410 - DNA, 25 bp, Rattus norvegicus
ggattgctaaacactgtgcttgtaa

SEQ ID NO: 434411 - DNA, 25 bp, Rattus norvegicus
ggattgctaaactctgtgcttgtaa

SEQ ID NO: 434412 - DNA, 25 bp, Rattus norvegicus
ggattgctactaaattttttcctgg

SEQ ID NO: 434413 - DNA, 25 bp, Rattus norvegicus
ggattgctactatattttttcctgg

SEQ ID NO: 434414 - DNA, 25 bp, Rattus norvegicus
ggattgctagatctggctacatttt

SEQ ID NO: 434415 - DNA, 25 bp, Rattus norvegicus
ggattgctagatgtggctacatttt

SEQ ID NO: 434416 - DNA, 25 bp, Rattus norvegicus
ggattgctcctaaggtaggctagct

SEQ ID NO: 434417 - DNA, 25 bp, Rattus norvegicus
ggattgctcctatggtaggctagct

SEQ ID NO: 434418 - DNA, 25 bp, Rattus norvegicus
ggattgctctatcatggaccgcagc

SEQ ID NO: 434419 - DNA, 25 bp, Rattus norvegicus
ggattgctctatgatggaccgcagc

SEQ ID NO: 434420 - DNA, 25 bp, Rattus norvegicus
ggattgctctgtaatcgtggtcaac

SEQ ID NO: 434421 - DNA, 25 bp, Rattus norvegicus
ggattgctctgttatcgtggtcaac

SEQ ID NO: 434422 - DNA, 25 bp, Rattus norvegicus
ggattgctgcttattagtcacacaa

SEQ ID NO: 434423 - DNA, 25 bp, Rattus norvegicus
ggattgctgctttttagtcacacaa

SEQ ID NO: 434424 - DNA, 25 bp, Rattus norvegicus
ggattgctgttcatttatcatcttt

SEQ ID NO: 434425 - DNA, 25 bp, Rattus norvegicus
ggattgctgttcttttatcatcttt

SEQ ID NO: 434426 - DNA, 25 bp, Rattus norvegicus
ggattgcttagcatgtcattttaaa

SEQ ID NO: 434427 - DNA, 25 bp, Rattus norvegicus
ggattgcttagcttgtcattttaaa

SEQ ID NO: 434428 - DNA, 25 bp, Rattus norvegicus
ggattgcttcagatggtttgccgta

SEQ ID NO: 434429 - DNA, 25 bp, Rattus norvegicus
ggattgcttcagttggtttgccgta

SEQ ID NO: 434430 - DNA, 25 bp, Rattus norvegicus
ggattgcttccaccggtgtgtttga

SEQ ID NO: 434431 - DNA, 25 bp, Rattus norvegicus
ggattgcttccagcggtgtgtttga

SEQ ID NO: 434432 - DNA, 25 bp, Rattus norvegicus
ggattggaaccgacttcgaggcctg

SEQ ID NO: 434433 - DNA, 25 bp, Rattus norvegicus
ggattggaaccgtcttcgaggcctg

SEQ ID NO: 434434 - DNA, 25 bp, Rattus norvegicus
ggattggaagctacatgtctgcatg

SEQ ID NO: 434435 - DNA, 25 bp, Rattus norvegicus
ggattggaagcttcatgtctgcatg

SEQ ID NO: 434436 - DNA, 25 bp, Rattus norvegicus
ggattggacccaacacactgtgaag

SEQ ID NO: 434437 - DNA, 25 bp, Rattus norvegicus
ggattggacccatcacactgtgaag

SEQ ID NO: 434438 - DNA, 25 bp, Rattus norvegicus
ggattggagctgaactcgtccacct

SEQ ID NO: 434439 - DNA, 25 bp, Rattus norvegicus
ggattggagctgtactcgtccacct

SEQ ID NO: 434440 - DNA, 25 bp, Rattus norvegicus
ggattggatcagaactacctagtga

SEQ ID NO: 434441 - DNA, 25 bp, Rattus norvegicus
ggattggatcagtactacctagtga

SEQ ID NO: 434442 - DNA, 25 bp, Rattus norvegicus
ggattggatccgatcatcttttgat

SEQ ID NO: 434443 - DNA, 25 bp, Rattus norvegicus
ggattggatccgttcatcttttgat

SEQ ID NO: 434444 - DNA, 25 bp, Rattus norvegicus
ggattggcaaacagtggcggtcaat

SEQ ID NO: 434445 - DNA, 25 bp, Rattus norvegicus
ggattggcaaactgtggcggtcaat

SEQ ID NO: 434446 - DNA, 25 bp, Rattus norvegicus
ggattggcacataatattactgcaa

SEQ ID NO: 434447 - DNA, 25 bp, Rattus norvegicus
ggattggcacatcggtacactcaaa

SEQ ID NO: 434448 - DNA, 25 bp, Rattus norvegicus
ggattggcacatgggtacactcaaa

SEQ ID NO: 434449 - DNA, 25 bp, Rattus norvegicus
ggattggcacattatattactgcaa

SEQ ID NO: 434450 - DNA, 25 bp, Rattus norvegicus
ggattggcacttctgtcttctttat

SEQ ID NO: 434451 - DNA, 25 bp, Rattus norvegicus
ggattggcacttgtgtcttctttat

SEQ ID NO: 434452 - DNA, 25 bp, Rattus norvegicus
ggattggcatcaacgtcacaacgtc

SEQ ID NO: 434453 - DNA, 25 bp, Rattus norvegicus
ggattggcatcatcgtcacaacgtc

SEQ ID NO: 434454 - DNA, 25 bp, Rattus norvegicus
ggattggccgctagtcgggaaaatc

SEQ ID NO: 434455 - DNA, 25 bp, Rattus norvegicus
ggattggccgcttgtcgggaaaatc

SEQ ID NO: 434456 - DNA, 25 bp, Rattus norvegicus
ggattggctcctaaatattcccaga

SEQ ID NO: 434457 - DNA, 25 bp, Rattus norvegicus
ggattggctccttaatattcccaga

SEQ ID NO: 434458 - DNA, 25 bp, Rattus norvegicus
ggattggctgcgatgagatgcttca

SEQ ID NO: 434459 - DNA, 25 bp, Rattus norvegicus
ggattggctgcgttgagatgcttca

SEQ ID NO: 434460 - DNA, 25 bp, Rattus norvegicus
ggattggctgctcacatacttgggc

SEQ ID NO: 434461 - DNA, 25 bp, Rattus norvegicus
ggattggctgctgacatacttgggc

SEQ ID NO: 434462 - DNA, 25 bp, Rattus norvegicus
ggattgggaatcaaacctcacgcct

SEQ ID NO: 434463 - DNA, 25 bp, Rattus norvegicus
ggattgggaatctaacctcacgcct

SEQ ID NO: 434464 - DNA, 25 bp, Rattus norvegicus
ggattgggccagagcttaccacatt

SEQ ID NO: 434465 - DNA, 25 bp, Rattus norvegicus
ggattgggccagtgcttaccacatt

SEQ ID NO: 434466 - DNA, 25 bp, Rattus norvegicus
ggattgggccctaagagagcccggg

SEQ ID NO: 434467 - DNA, 25 bp, Rattus norvegicus
ggattgggcccttagagagcccggg

SEQ ID NO: 434468 - DNA, 25 bp, Rattus norvegicus
ggattgggctggcttttctatccca

SEQ ID NO: 434469 - DNA, 25 bp, Rattus norvegicus
ggattgggctgggttttctatccca

SEQ ID NO: 434470 - DNA, 25 bp, Rattus norvegicus
ggattgggtctaagcatggtcactt

SEQ ID NO: 434471 - DNA, 25 bp, Rattus norvegicus
ggattgggtctatgcatggtcactt

SEQ ID NO: 434472 - DNA, 25 bp, Rattus norvegicus
ggattggtaactctggtccacctga

SEQ ID NO: 434473 - DNA, 25 bp, Rattus norvegicus
ggattggtaactgtggtccacctga

SEQ ID NO: 434474 - DNA, 25 bp, Rattus norvegicus
ggattggtacctcgtgctgtctgca

SEQ ID NO: 434475 - DNA, 25 bp, Rattus norvegicus
ggattggtacctggtgctgtctgca

SEQ ID NO: 434476 - DNA, 25 bp, Rattus norvegicus
ggattggtatggcactttattcttt

SEQ ID NO: 434477 - DNA, 25 bp, Rattus norvegicus
ggattggtatgggactttattcttt

SEQ ID NO: 434478 - DNA, 25 bp, Rattus norvegicus
ggattggtccagatttagtgccaga

SEQ ID NO: 434479 - DNA, 25 bp, Rattus norvegicus
ggattggtccagttttagtgccaga

SEQ ID NO: 434480 - DNA, 25 bp, Rattus norvegicus
ggattggtctccaggatctcaacat

SEQ ID NO: 434481 - DNA, 25 bp, Rattus norvegicus
ggattggtctcctggatctcaacat

SEQ ID NO: 434482 - DNA, 25 bp, Rattus norvegicus
ggattggttacacgccatgctgtca

SEQ ID NO: 434483 - DNA, 25 bp, Rattus norvegicus
ggattggttacaggccatgctgtca

SEQ ID NO: 434484 - DNA, 25 bp, Rattus norvegicus
ggattggttggcaagaacttcttta

SEQ ID NO: 434485 - DNA, 25 bp, Rattus norvegicus
ggattggttggctagaacttcttta

SEQ ID NO: 434486 - DNA, 25 bp, Rattus norvegicus
ggattggttgtcctgttcctcgaat

SEQ ID NO: 434487 - DNA, 25 bp, Rattus norvegicus
ggattggttgtcgtgttcctcgaat

SEQ ID NO: 434488 - DNA, 25 bp, Rattus norvegicus
ggattgtaaaacacattcgagctac

SEQ ID NO: 434489 - DNA, 25 bp, Rattus norvegicus
ggattgtaaaactcattcgagctac

SEQ ID NO: 434490 - DNA, 25 bp, Rattus norvegicus
ggattgtaaaccacccacgtgtggg

SEQ ID NO: 434491 - DNA, 25 bp, Rattus norvegicus
ggattgtaaacctcccacgtgtggg

SEQ ID NO: 434492 - DNA, 25 bp, Rattus norvegicus
ggattgtaaccacttgttaatatca

SEQ ID NO: 434493 - DNA, 25 bp, Rattus norvegicus
ggattgtaaccagttgttaatatca

SEQ ID NO: 434494 - DNA, 25 bp, Rattus norvegicus
ggattgtaatagcaccgctccgttc

SEQ ID NO: 434495 - DNA, 25 bp, Rattus norvegicus
ggattgtaataggaccgctccgttc

SEQ ID NO: 434496 - DNA, 25 bp, Rattus norvegicus
ggattgtaatccatcaatccgtaga

SEQ ID NO: 434497 - DNA, 25 bp, Rattus norvegicus
ggattgtaatccttcaatccgtaga

SEQ ID NO: 434498 - DNA, 25 bp, Rattus norvegicus
ggattgtaattgctaggcctttaaa

SEQ ID NO: 434499 - DNA, 25 bp, Rattus norvegicus
ggattgtaattggtaggcctttaaa

SEQ ID NO: 434500 - DNA, 25 bp, Rattus norvegicus
ggattgtacagaaccctgagcctgt

SEQ ID NO: 434501 - DNA, 25 bp, Rattus norvegicus
ggattgtacagatccctgagcctgt

SEQ ID NO: 434502 - DNA, 25 bp, Rattus norvegicus
ggattgtactgcacacagtgtgctg

SEQ ID NO: 434503 - DNA, 25 bp, Rattus norvegicus
ggattgtactgctcacagtgtgctg

SEQ ID NO: 434504 - DNA, 25 bp, Rattus norvegicus
ggattgtatccaagtactgttgaca

SEQ ID NO: 434505 - DNA, 25 bp, Rattus norvegicus
ggattgtatccatgtactgttgaca

SEQ ID NO: 434506 - DNA, 25 bp, Rattus norvegicus
ggattgtcacctaacagatgcctaa

SEQ ID NO: 434507 - DNA, 25 bp, Rattus norvegicus
ggattgtcaccttacagatgcctaa

SEQ ID NO: 434508 - DNA, 25 bp, Rattus norvegicus
ggattgtcagacactagcattgtta

SEQ ID NO: 434509 - DNA, 25 bp, Rattus norvegicus
ggattgtcagactctagcattgtta

SEQ ID NO: 434510 - DNA, 25 bp, Rattus norvegicus
ggattgtccagtcattgaagtgtaa

SEQ ID NO: 434511 - DNA, 25 bp, Rattus norvegicus
ggattgtccagtgattgaagtgtaa

SEQ ID NO: 434512 - DNA, 25 bp, Rattus norvegicus
ggattgtccggcaaaaactactgta

SEQ ID NO: 434513 - DNA, 25 bp, Rattus norvegicus
ggattgtccggctaaaactactgta

SEQ ID NO: 434514 - DNA, 25 bp, Rattus norvegicus
ggattgtctgccattcctaggaaac

SEQ ID NO: 434515 - DNA, 25 bp, Rattus norvegicus
ggattgtctgcctttcctaggaaac

SEQ ID NO: 434516 - DNA, 25 bp, Rattus norvegicus
ggattgtctgtcattttccgaagat

SEQ ID NO: 434517 - DNA, 25 bp, Rattus norvegicus
ggattgtctgtctttttccgaagat

SEQ ID NO: 434518 - DNA, 25 bp, Rattus norvegicus
ggattgtctgtgaacagctctcgtc

SEQ ID NO: 434519 - DNA, 25 bp, Rattus norvegicus
ggattgtctgtgtacagctctcgtc

SEQ ID NO: 434520 - DNA, 25 bp, Rattus norvegicus
ggattgtcttttaaacaccctgaat

SEQ ID NO: 434521 - DNA, 25 bp, Rattus norvegicus
ggattgtctttttaacaccctgaat

SEQ ID NO: 434522 - DNA, 25 bp, Rattus norvegicus
ggattgtgacctcgaagtgtaagca

SEQ ID NO: 434523 - DNA, 25 bp, Rattus norvegicus
ggattgtgacctggaagtgtaagca

SEQ ID NO: 434524 - DNA, 25 bp, Rattus norvegicus
ggattgtgacttcacaccagccccg

SEQ ID NO: 434525 - DNA, 25 bp, Rattus norvegicus
ggattgtgacttgacaccagccccg

SEQ ID NO: 434526 - DNA, 25 bp, Rattus norvegicus
ggattgtgatccacagtccccatct

SEQ ID NO: 434527 - DNA, 25 bp, Rattus norvegicus
ggattgtgatcctcagtccccatct

SEQ ID NO: 434528 - DNA, 25 bp, Rattus norvegicus
ggattgtgattcctaggacccggct

SEQ ID NO: 434529 - DNA, 25 bp, Rattus norvegicus
ggattgtgattcgtaggacccggct

SEQ ID NO: 434530 - DNA, 25 bp, Rattus norvegicus
ggattgtgtctgctttttccttaag

SEQ ID NO: 434531 - DNA, 25 bp, Rattus norvegicus
ggattgtgtctggtttttccttaag

SEQ ID NO: 434532 - DNA, 25 bp, Rattus norvegicus
ggattgtgtttcatcgtcccagatc

SEQ ID NO: 434533 - DNA, 25 bp, Rattus norvegicus
ggattgtgtttcttcgtcccagatc

SEQ ID NO: 434534 - DNA, 25 bp, Rattus norvegicus
ggattgttatgtacttaagctcaca

SEQ ID NO: 434535 - DNA, 25 bp, Rattus norvegicus
ggattgttatgttcttaagctcaca

SEQ ID NO: 434536 - DNA, 25 bp, Rattus norvegicus
ggattgttctctccaaagttttgtt

SEQ ID NO: 434537 - DNA, 25 bp, Rattus norvegicus
ggattgttctctgcaaagttttgtt

SEQ ID NO: 434538 - DNA, 25 bp, Rattus norvegicus
ggattgttggcaaggagctcaccac

SEQ ID NO: 434539 - DNA, 25 bp, Rattus norvegicus
ggattgttggcatggagctcaccac

SEQ ID NO: 434540 - DNA, 25 bp, Rattus norvegicus
ggattgttgtccaggttatatctac

SEQ ID NO: 434541 - DNA, 25 bp, Rattus norvegicus
ggattgttgtcctggttatatctac

SEQ ID NO: 434542 - DNA, 25 bp, Rattus norvegicus
ggatttaacagtctcctctgtttgt

SEQ ID NO: 434543 - DNA, 25 bp, Rattus norvegicus
ggatttaacagtgtcctctgtttgt

SEQ ID NO: 434544 - DNA, 25 bp, Rattus norvegicus
ggatttaaccctagcaggttcttga

SEQ ID NO: 434545 - DNA, 25 bp, Rattus norvegicus
ggatttaacccttgcaggttcttga

SEQ ID NO: 434546 - DNA, 25 bp, Rattus norvegicus
ggatttaacctgacattcactgtgt

SEQ ID NO: 434547 - DNA, 25 bp, Rattus norvegicus
ggatttaacctgtcattcactgtgt

SEQ ID NO: 434548 - DNA, 25 bp, Rattus norvegicus
ggatttaacgtcaggtgctgcccaa

SEQ ID NO: 434549 - DNA, 25 bp, Rattus norvegicus
ggatttaacgtctggtgctgcccaa

SEQ ID NO: 434550 - DNA, 25 bp, Rattus norvegicus
ggatttaactctacccaagacatgc

SEQ ID NO: 434551 - DNA, 25 bp, Rattus norvegicus
ggatttaactcttcccaagacatgc

SEQ ID NO: 434552 - DNA, 25 bp, Rattus norvegicus
ggatttaagaacacacattgctagg

SEQ ID NO: 434553 - DNA, 25 bp, Rattus norvegicus
ggatttaagaactcacattgctagg

SEQ ID NO: 434554 - DNA, 25 bp, Rattus norvegicus
ggatttaaggaaactgccatttgcc

SEQ ID NO: 434555 - DNA, 25 bp, Rattus norvegicus
ggatttaaggaatctgccatttgcc

SEQ ID NO: 434556 - DNA, 25 bp, Rattus norvegicus
ggatttacaagcataactgccactt

SEQ ID NO: 434557 - DNA, 25 bp, Rattus norvegicus
ggatttacaagcttaactgccactt

SEQ ID NO: 434558 - DNA, 25 bp, Rattus norvegicus
ggatttacaggcctgggtaacctca

SEQ ID NO: 434559 - DNA, 25 bp, Rattus norvegicus
ggatttacaggcgtgggtaacctca

SEQ ID NO: 434560 - DNA, 25 bp, Rattus norvegicus
ggatttacagttattccgactcatg

SEQ ID NO: 434561 - DNA, 25 bp, Rattus norvegicus
ggatttacagtttttccgactcatg

SEQ ID NO: 434562 - DNA, 25 bp, Rattus norvegicus
ggatttacatagatcacagtggcca

SEQ ID NO: 434563 - DNA, 25 bp, Rattus norvegicus
ggatttacatagttcacagtggcca

SEQ ID NO: 434564 - DNA, 25 bp, Rattus norvegicus
ggatttaccatcagaagcatttttg

SEQ ID NO: 434565 - DNA, 25 bp, Rattus norvegicus
ggatttaccatctgaagcatttttg

SEQ ID NO: 434566 - DNA, 25 bp, Rattus norvegicus
ggatttaccttaagagtctccgcat

SEQ ID NO: 434567 - DNA, 25 bp, Rattus norvegicus
ggatttaccttatgagtctccgcat

SEQ ID NO: 434568 - DNA, 25 bp, Rattus norvegicus
ggatttaccttcatcattccactac

SEQ ID NO: 434569 - DNA, 25 bp, Rattus norvegicus
ggatttaccttcttcattccactac

SEQ ID NO: 434570 - DNA, 25 bp, Rattus norvegicus
ggatttacctttcgcattagcatag

SEQ ID NO: 434571 - DNA, 25 bp, Rattus norvegicus
ggatttacctttggcattagcatag

SEQ ID NO: 434572 - DNA, 25 bp, Rattus norvegicus
ggatttactcagaccatctatgcat

SEQ ID NO: 434573 - DNA, 25 bp, Rattus norvegicus
ggatttactcagtccatctatgcat

SEQ ID NO: 434574 - DNA, 25 bp, Rattus norvegicus
ggatttacttgacgcactacgactt

SEQ ID NO: 434575 - DNA, 25 bp, Rattus norvegicus
ggatttacttgaggcactacgactt

SEQ ID NO: 434576 - DNA, 25 bp, Rattus norvegicus
ggatttagaactccattaattccaa

SEQ ID NO: 434577 - DNA, 25 bp, Rattus norvegicus
ggatttagaactgcattaattccaa

SEQ ID NO: 434578 - DNA, 25 bp, Rattus norvegicus
ggatttagattcactgttctctgtc

SEQ ID NO: 434579 - DNA, 25 bp, Rattus norvegicus
ggatttagattctctgttctctgtc

SEQ ID NO: 434580 - DNA, 25 bp, Rattus norvegicus
ggatttagccgcagaggacacacat

SEQ ID NO: 434581 - DNA, 25 bp, Rattus norvegicus
ggatttagccgctgaggacacacat

SEQ ID NO: 434582 - DNA, 25 bp, Rattus norvegicus
ggatttagtcccagatcttacttct

SEQ ID NO: 434583 - DNA, 25 bp, Rattus norvegicus
ggatttagtccctgatcttacttct

SEQ ID NO: 434584 - DNA, 25 bp, Rattus norvegicus
ggatttataactactgccagccttg

SEQ ID NO: 434585 - DNA, 25 bp, Rattus norvegicus
ggatttataacttctgccagccttg

SEQ ID NO: 434586 - DNA, 25 bp, Rattus norvegicus
ggatttataatcaggttttcaactt

SEQ ID NO: 434587 - DNA, 25 bp, Rattus norvegicus
ggatttataatctggttttcaactt

SEQ ID NO: 434588 - DNA, 25 bp, Rattus norvegicus
ggatttatacttctgtgatggccac

SEQ ID NO: 434589 - DNA, 25 bp, Rattus norvegicus
ggatttatacttgtgtgatggccac

SEQ ID NO: 434590 - DNA, 25 bp, Rattus norvegicus
ggatttatctcaaccaccaacacaa

SEQ ID NO: 434591 - DNA, 25 bp, Rattus norvegicus
ggatttatctcatccaccaacacaa

SEQ ID NO: 434592 - DNA, 25 bp, Rattus norvegicus
ggatttatctgccttgtggaataca

SEQ ID NO: 434593 - DNA, 25 bp, Rattus norvegicus
ggatttatctgcgttgtggaataca

SEQ ID NO: 434594 - DNA, 25 bp, Rattus norvegicus
ggatttatgccaaccaggaggagga

SEQ ID NO: 434595 - DNA, 25 bp, Rattus norvegicus
ggatttatgccatccaggaggagga

SEQ ID NO: 434596 - DNA, 25 bp, Rattus norvegicus
ggatttatgtacagcattcttgtgc

SEQ ID NO: 434597 - DNA, 25 bp, Rattus norvegicus
ggatttatgtactgcattcttgtgc

SEQ ID NO: 434598 - DNA, 25 bp, Rattus norvegicus
ggatttattcagagtgctccctgca

SEQ ID NO: 434599 - DNA, 25 bp, Rattus norvegicus
ggatttattcagtgtgctccctgca

SEQ ID NO: 434600 - DNA, 25 bp, Rattus norvegicus
ggatttattccacaagactggtcaa

SEQ ID NO: 434601 - DNA, 25 bp, Rattus norvegicus
ggatttattccagaagactggtcaa

SEQ ID NO: 434602 - DNA, 25 bp, Rattus norvegicus
ggatttattctccttgtaaagctaa

SEQ ID NO: 434603 - DNA, 25 bp, Rattus norvegicus
ggatttattctcgttgtaaagctaa

SEQ ID NO: 434604 - DNA, 25 bp, Rattus norvegicus
ggatttattgaaacaagcagagata

SEQ ID NO: 434605 - DNA, 25 bp, Rattus norvegicus
ggatttattgaatcaagcagagata

SEQ ID NO: 434606 - DNA, 25 bp, Rattus norvegicus
ggatttattgatctcccagaattcc

SEQ ID NO: 434607 - DNA, 25 bp, Rattus norvegicus
ggatttattgatgtcccagaattcc

SEQ ID NO: 434608 - DNA, 25 bp, Rattus norvegicus
ggatttattgtcacaaccaagtctt

SEQ ID NO: 434609 - DNA, 25 bp, Rattus norvegicus
ggatttattgtctcaaccaagtctt

SEQ ID NO: 434610 - DNA, 25 bp, Rattus norvegicus
ggatttattttcactcttgcccgaa

SEQ ID NO: 434611 - DNA, 25 bp, Rattus norvegicus
ggatttattttctctcttgcccgaa

SEQ ID NO: 434612 - DNA, 25 bp, Rattus norvegicus
ggatttcaaaccctcagagcccctg

SEQ ID NO: 434613 - DNA, 25 bp, Rattus norvegicus
ggatttcaaaccgtcagagcccctg

SEQ ID NO: 434614 - DNA, 25 bp, Rattus norvegicus
ggatttcaaagcagggcacccagct

SEQ ID NO: 434615 - DNA, 25 bp, Rattus norvegicus
ggatttcaaagctgggcacccagct

SEQ ID NO: 434616 - DNA, 25 bp, Rattus norvegicus
ggatttcaacatattttaaactgat

SEQ ID NO: 434617 - DNA, 25 bp, Rattus norvegicus
ggatttcaacattttttaaactgat

SEQ ID NO: 434618 - DNA, 25 bp, Rattus norvegicus
ggatttcaaccaccacattgtatac

SEQ ID NO: 434619 - DNA, 25 bp, Rattus norvegicus
ggatttcaaccagcacattgtatac

SEQ ID NO: 434620 - DNA, 25 bp, Rattus norvegicus
ggatttcaagagactggcagccgcc

SEQ ID NO: 434621 - DNA, 25 bp, Rattus norvegicus
ggatttcaagagtctggcagccgcc

SEQ ID NO: 434622 - DNA, 25 bp, Rattus norvegicus
ggatttcaaggtagcccaggttggc

SEQ ID NO: 434623 - DNA, 25 bp, Rattus norvegicus
ggatttcaaggttgcccaggttggc

SEQ ID NO: 434624 - DNA, 25 bp, Rattus norvegicus
ggatttcacacacgtcccagcagaa

SEQ ID NO: 434625 - DNA, 25 bp, Rattus norvegicus
ggatttcacacaggtcccagcagaa

SEQ ID NO: 434626 - DNA, 25 bp, Rattus norvegicus
ggatttcacactagagatcacccca

SEQ ID NO: 434627 - DNA, 25 bp, Rattus norvegicus
ggatttcacacttgagatcacccca

SEQ ID NO: 434628 - DNA, 25 bp, Rattus norvegicus
ggatttcacagtatctgccatgcat

SEQ ID NO: 434629 - DNA, 25 bp, Rattus norvegicus
ggatttcacagtttctgccatgcat

SEQ ID NO: 434630 - DNA, 25 bp, Rattus norvegicus
ggatttcacatccaactggtacgga

SEQ ID NO: 434631 - DNA, 25 bp, Rattus norvegicus
ggatttcacatcgaactggtacgga

SEQ ID NO: 434632 - DNA, 25 bp, Rattus norvegicus
ggatttcaccttagtgtgtccaact

SEQ ID NO: 434633 - DNA, 25 bp, Rattus norvegicus
ggatttcacctttgtgtgtccaact

SEQ ID NO: 434634 - DNA, 25 bp, Rattus norvegicus
ggatttcagatcatttgtgtttttc

SEQ ID NO: 434635 - DNA, 25 bp, Rattus norvegicus
ggatttcagatcttttgtgtttttc

SEQ ID NO: 434636 - DNA, 25 bp, Rattus norvegicus
ggatttcaggcactgtgcagacaca

SEQ ID NO: 434637 - DNA, 25 bp, Rattus norvegicus
ggatttcaggcagtgtgcagacaca

SEQ ID NO: 434638 - DNA, 25 bp, Rattus norvegicus
ggatttcaggcccagcaactagcaa

SEQ ID NO: 434639 - DNA, 25 bp, Rattus norvegicus
ggatttcaggccgagcaactagcaa

SEQ ID NO: 434640 - DNA, 25 bp, Rattus norvegicus
ggatttcagtatcttcagttaagta

SEQ ID NO: 434641 - DNA, 25 bp, Rattus norvegicus
ggatttcagtatgttcagttaagta

SEQ ID NO: 434642 - DNA, 25 bp, Rattus norvegicus
ggatttcatagtatctccggacaaa

SEQ ID NO: 434643 - DNA, 25 bp, Rattus norvegicus
ggatttcatagtttctccggacaaa

SEQ ID NO: 434644 - DNA, 25 bp, Rattus norvegicus
ggatttcatcacatgtgggctacca

SEQ ID NO: 434645 - DNA, 25 bp, Rattus norvegicus
ggatttcatcacttgtgggctacca

SEQ ID NO: 434646 - DNA, 25 bp, Rattus norvegicus
ggatttcatcccacatatgctttat

SEQ ID NO: 434647 - DNA, 25 bp, Rattus norvegicus
ggatttcatccctcatatgctttat

SEQ ID NO: 434648 - DNA, 25 bp, Rattus norvegicus
ggatttcattctcttgtctcaactt

SEQ ID NO: 434649 - DNA, 25 bp, Rattus norvegicus
ggatttcattctgttgtctcaactt

SEQ ID NO: 434650 - DNA, 25 bp, Rattus norvegicus
ggatttccactccaccttgcaaatg

SEQ ID NO: 434651 - DNA, 25 bp, Rattus norvegicus
ggatttccactcgaccttgcaaatg

SEQ ID NO: 434652 - DNA, 25 bp, Rattus norvegicus
ggatttccagtgaactttttcttga

SEQ ID NO: 434653 - DNA, 25 bp, Rattus norvegicus
ggatttccagtgtactttttcttga

SEQ ID NO: 434654 - DNA, 25 bp, Rattus norvegicus
ggatttccataacacggcaccctat

SEQ ID NO: 434655 - DNA, 25 bp, Rattus norvegicus
ggatttccataagacggcaccctat

SEQ ID NO: 434656 - DNA, 25 bp, Rattus norvegicus
ggatttccatctaagccaggattga

SEQ ID NO: 434657 - DNA, 25 bp, Rattus norvegicus
ggatttccatcttagccaggattga

SEQ ID NO: 434658 - DNA, 25 bp, Rattus norvegicus
ggatttccatggattcccttggcca

SEQ ID NO: 434659 - DNA, 25 bp, Rattus norvegicus
ggatttccatggtttcccttggcca

SEQ ID NO: 434660 - DNA, 25 bp, Rattus norvegicus
ggatttcccatgcacatagcccagg

SEQ ID NO: 434661 - DNA, 25 bp, Rattus norvegicus
ggatttcccatggacatagcccagg

SEQ ID NO: 434662 - DNA, 25 bp, Rattus norvegicus
ggatttccccaaccaaggaccaatt

SEQ ID NO: 434663 - DNA, 25 bp, Rattus norvegicus
ggatttccccaagcaaggaccaatt

SEQ ID NO: 434664 - DNA, 25 bp, Rattus norvegicus
ggatttcccgaaagcctggttgcct

SEQ ID NO: 434665 - DNA, 25 bp, Rattus norvegicus
ggatttcccgaatgcctggttgcct

SEQ ID NO: 434666 - DNA, 25 bp, Rattus norvegicus
ggatttcccttcaaagtcccaagat

SEQ ID NO: 434667 - DNA, 25 bp, Rattus norvegicus
ggatttcccttcatagtatgcttca

SEQ ID NO: 434668 - DNA, 25 bp, Rattus norvegicus
ggatttcccttctaagtcccaagat

SEQ ID NO: 434669 - DNA, 25 bp, Rattus norvegicus
ggatttcccttcttagtatgcttca

SEQ ID NO: 434670 - DNA, 25 bp, Rattus norvegicus
ggatttcctaagatttgcatgctac

SEQ ID NO: 434671 - DNA, 25 bp, Rattus norvegicus
ggatttcctaagttttgcatgctac

SEQ ID NO: 434672 - DNA, 25 bp, Rattus norvegicus
ggatttccttacagtagcattctgc

SEQ ID NO: 434673 - DNA, 25 bp, Rattus norvegicus
ggatttccttactgtagcattctgc

SEQ ID NO: 434674 - DNA, 25 bp, Rattus norvegicus
ggatttcgaggactggactatttca

SEQ ID NO: 434675 - DNA, 25 bp, Rattus norvegicus
ggatttcgaggagtggactatttca

SEQ ID NO: 434676 - DNA, 25 bp, Rattus norvegicus
ggatttcgtgaaccagtgtctggta

SEQ ID NO: 434677 - DNA, 25 bp, Rattus norvegicus
ggatttcgtgaagcagtgtctggta

SEQ ID NO: 434678 - DNA, 25 bp, Rattus norvegicus
ggatttcgtgatagtctttaacagc

SEQ ID NO: 434679 - DNA, 25 bp, Rattus norvegicus
ggatttcgtgattgtctttaacagc

SEQ ID NO: 434680 - DNA, 25 bp, Rattus norvegicus
ggatttctaacaacaggactttgct

SEQ ID NO: 434681 - DNA, 25 bp, Rattus norvegicus
ggatttctaacatcaggactttgct

SEQ ID NO: 434682 - DNA, 25 bp, Rattus norvegicus
ggatttctaagcatgtcaccctaaa

SEQ ID NO: 434683 - DNA, 25 bp, Rattus norvegicus
ggatttctaagcttgtcaccctaaa

SEQ ID NO: 434684 - DNA, 25 bp, Rattus norvegicus
ggatttctaagtccgtgtgtgaccc

SEQ ID NO: 434685 - DNA, 25 bp, Rattus norvegicus
ggatttctaagtgcgtgtgtgaccc

SEQ ID NO: 434686 - DNA, 25 bp, Rattus norvegicus
ggatttctacacagactcttcgttg

SEQ ID NO: 434687 - DNA, 25 bp, Rattus norvegicus
ggatttctacactgactcttcgttg

SEQ ID NO: 434688 - DNA, 25 bp, Rattus norvegicus
ggatttctacggatttggctgtcat

SEQ ID NO: 434689 - DNA, 25 bp, Rattus norvegicus
ggatttctacggttttggctgtcat

SEQ ID NO: 434690 - DNA, 25 bp, Rattus norvegicus
ggatttctagccctcatcatcataa

SEQ ID NO: 434691 - DNA, 25 bp, Rattus norvegicus
ggatttctagccgtcatcatcataa

SEQ ID NO: 434692 - DNA, 25 bp, Rattus norvegicus
ggatttctagtcactttttgggtgt

SEQ ID NO: 434693 - DNA, 25 bp, Rattus norvegicus
ggatttctagtctctttttgggtgt

SEQ ID NO: 434694 - DNA, 25 bp, Rattus norvegicus
ggatttctatccatgttaccagcca

SEQ ID NO: 434695 - DNA, 25 bp, Rattus norvegicus
ggatttctatccttgttaccagcca

SEQ ID NO: 434696 - DNA, 25 bp, Rattus norvegicus
ggatttctccctaattaattcaggt

SEQ ID NO: 434697 - DNA, 25 bp, Rattus norvegicus
ggatttctcccttattaattcaggt

SEQ ID NO: 434698 - DNA, 25 bp, Rattus norvegicus
ggatttctcgatactcggtaagaag

SEQ ID NO: 434699 - DNA, 25 bp, Rattus norvegicus
ggatttctcgattctcggtaagaag

SEQ ID NO: 434700 - DNA, 25 bp, Rattus norvegicus
ggatttctcggaagtcaaggacagt

SEQ ID NO: 434701 - DNA, 25 bp, Rattus norvegicus
ggatttctcggatgtcaaggacagt

SEQ ID NO: 434702 - DNA, 25 bp, Rattus norvegicus
ggatttctcttcaaacctaagctga

SEQ ID NO: 434703 - DNA, 25 bp, Rattus norvegicus
ggatttctcttctaacctaagctga

SEQ ID NO: 434704 - DNA, 25 bp, Rattus norvegicus
ggatttctcttgaagctaccacatt

SEQ ID NO: 434705 - DNA, 25 bp, Rattus norvegicus
ggatttctcttgtagctaccacatt

SEQ ID NO: 434706 - DNA, 25 bp, Rattus norvegicus
ggatttctgaagctcatgttcaatg

SEQ ID NO: 434707 - DNA, 25 bp, Rattus norvegicus
ggatttctgaaggtcatgttcaatg

SEQ ID NO: 434708 - DNA, 25 bp, Rattus norvegicus
ggatttctgataccttgtcatttgg

SEQ ID NO: 434709 - DNA, 25 bp, Rattus norvegicus
ggatttctgatagcttgtcatttgg

SEQ ID NO: 434710 - DNA, 25 bp, Rattus norvegicus
ggatttctgcatcctgtcagagggt

SEQ ID NO: 434711 - DNA, 25 bp, Rattus norvegicus
ggatttctgcatgctgtcagagggt

SEQ ID NO: 434712 - DNA, 25 bp, Rattus norvegicus
ggatttctgcccaacttagattttt

SEQ ID NO: 434713 - DNA, 25 bp, Rattus norvegicus
ggatttctgccctacttagattttt

SEQ ID NO: 434714 - DNA, 25 bp, Rattus norvegicus
ggatttctgcctagagggttaccat

SEQ ID NO: 434715 - DNA, 25 bp, Rattus norvegicus
ggatttctgccttgagggttaccat

SEQ ID NO: 434716 - DNA, 25 bp, Rattus norvegicus
ggatttctgctgcttgctgttaaac

SEQ ID NO: 434717 - DNA, 25 bp, Rattus norvegicus
ggatttctgctggttgctgttaaac

SEQ ID NO: 434718 - DNA, 25 bp, Rattus norvegicus
ggatttctgggtatagcctggttat

SEQ ID NO: 434719 - DNA, 25 bp, Rattus norvegicus
ggatttctgggtttagcctggttat

SEQ ID NO: 434720 - DNA, 25 bp, Rattus norvegicus
ggatttctgtaacagcctgccgttc

SEQ ID NO: 434721 - DNA, 25 bp, Rattus norvegicus
ggatttctgtaagagcctgccgttc

SEQ ID NO: 434722 - DNA, 25 bp, Rattus norvegicus
ggatttcttagcattgtgttgttat

SEQ ID NO: 434723 - DNA, 25 bp, Rattus norvegicus
ggatttcttagctttgtgttgttat

SEQ ID NO: 434724 - DNA, 25 bp, Rattus norvegicus
ggatttcttcggaccttctcaggaa

SEQ ID NO: 434725 - DNA, 25 bp, Rattus norvegicus
ggatttcttcggtccttctcaggaa

SEQ ID NO: 434726 - DNA, 25 bp, Rattus norvegicus
ggatttcttgttctatttttgccac

SEQ ID NO: 434727 - DNA, 25 bp, Rattus norvegicus
ggatttcttgttgtatttttgccac

SEQ ID NO: 434728 - DNA, 25 bp, Rattus norvegicus
ggatttctttccaattcgcatttat

SEQ ID NO: 434729 - DNA, 25 bp, Rattus norvegicus
ggatttctttcctattcgcatttat

SEQ ID NO: 434730 - DNA, 25 bp, Rattus norvegicus
ggatttctttctccatgttctgttt

SEQ ID NO: 434731 - DNA, 25 bp, Rattus norvegicus
ggatttctttctgcatgttctgttt

SEQ ID NO: 434732 - DNA, 25 bp, Rattus norvegicus
ggatttcttttgaatgtcacccagc

SEQ ID NO: 434733 - DNA, 25 bp, Rattus norvegicus
ggatttcttttgtatgtcacccagc

SEQ ID NO: 434734 - DNA, 25 bp, Rattus norvegicus
ggatttgaaagaacctctccgatct

SEQ ID NO: 434735 - DNA, 25 bp, Rattus norvegicus
ggatttgaaagatcctctccgatct

SEQ ID NO: 434736 - DNA, 25 bp, Rattus norvegicus
ggatttgaagatatgggaccatcat

SEQ ID NO: 434737 - DNA, 25 bp, Rattus norvegicus
ggatttgaagatttgggaccatcat

SEQ ID NO: 434738 - DNA, 25 bp, Rattus norvegicus
ggatttgaagctacgcactcagcct

SEQ ID NO: 434739 - DNA, 25 bp, Rattus norvegicus
ggatttgaagcttcgcactcagcct

SEQ ID NO: 434740 - DNA, 25 bp, Rattus norvegicus
ggatttgaatccatctcccagagaa

SEQ ID NO: 434741 - DNA, 25 bp, Rattus norvegicus
ggatttgaatccttctcccagagaa

SEQ ID NO: 434742 - DNA, 25 bp, Rattus norvegicus
ggatttgaatctcatccttctaaat

SEQ ID NO: 434743 - DNA, 25 bp, Rattus norvegicus
ggatttgaatctcctttgtgttaaa

SEQ ID NO: 434744 - DNA, 25 bp, Rattus norvegicus
ggatttgaatctgatccttctaaat

SEQ ID NO: 434745 - DNA, 25 bp, Rattus norvegicus
ggatttgaatctgctttgtgttaaa

SEQ ID NO: 434746 - DNA, 25 bp, Rattus norvegicus
ggatttgaattactacccagggtca

SEQ ID NO: 434747 - DNA, 25 bp, Rattus norvegicus
ggatttgaattagtacccagggtca

SEQ ID NO: 434748 - DNA, 25 bp, Rattus norvegicus
ggatttgacaccctgttttgacctc

SEQ ID NO: 434749 - DNA, 25 bp, Rattus norvegicus
ggatttgacaccgtgttttgacctc

SEQ ID NO: 434750 - DNA, 25 bp, Rattus norvegicus
ggatttgacatcactgacaagcctc

SEQ ID NO: 434751 - DNA, 25 bp, Rattus norvegicus
ggatttgacatctctgacaagcctc

SEQ ID NO: 434752 - DNA, 25 bp, Rattus norvegicus
ggatttgaccttactgtactgtcag

SEQ ID NO: 434753 - DNA, 25 bp, Rattus norvegicus
ggatttgacctttctgtactgtcag

SEQ ID NO: 434754 - DNA, 25 bp, Rattus norvegicus
ggatttgactttagcaccacacgtg

SEQ ID NO: 434755 - DNA, 25 bp, Rattus norvegicus
ggatttgacttttgcaccacacgtg

SEQ ID NO: 434756 - DNA, 25 bp, Rattus norvegicus
ggatttgagaagatgcccgcagcgt

SEQ ID NO: 434757 - DNA, 25 bp, Rattus norvegicus
ggatttgagaagttgcccgcagcgt

SEQ ID NO: 434758 - DNA, 25 bp, Rattus norvegicus
ggatttgagtctcgcttgtccgaaa

SEQ ID NO: 434759 - DNA, 25 bp, Rattus norvegicus
ggatttgagtctggcttgtccgaaa

SEQ ID NO: 434760 - DNA, 25 bp, Rattus norvegicus
ggatttgatgacagcttggcctaca

SEQ ID NO: 434761 - DNA, 25 bp, Rattus norvegicus
ggatttgatgactgcttggcctaca

SEQ ID NO: 434762 - DNA, 25 bp, Rattus norvegicus
ggatttgatgttattgccttccaat

SEQ ID NO: 434763 - DNA, 25 bp, Rattus norvegicus
ggatttgatgtttttgccttccaat

SEQ ID NO: 434764 - DNA, 25 bp, Rattus norvegicus
ggatttgattttcttccctaacctg

SEQ ID NO: 434765 - DNA, 25 bp, Rattus norvegicus
ggatttgattttgttccctaacctg

SEQ ID NO: 434766 - DNA, 25 bp, Rattus norvegicus
ggatttgcagatatggccaccacag

SEQ ID NO: 434767 - DNA, 25 bp, Rattus norvegicus
ggatttgcagatttggccaccacag

SEQ ID NO: 434768 - DNA, 25 bp, Rattus norvegicus
ggatttgcagctagagtcacgtttt

SEQ ID NO: 434769 - DNA, 25 bp, Rattus norvegicus
ggatttgcagcttgagtcacgtttt

SEQ ID NO: 434770 - DNA, 25 bp, Rattus norvegicus
ggatttgccatgcatttcaacattc

SEQ ID NO: 434771 - DNA, 25 bp, Rattus norvegicus
ggatttgccatggatttcaacattc

SEQ ID NO: 434772 - DNA, 25 bp, Rattus norvegicus
ggatttgccccaccatgatgagaag

SEQ ID NO: 434773 - DNA, 25 bp, Rattus norvegicus
ggatttgccccagcatgatgagaag

SEQ ID NO: 434774 - DNA, 25 bp, Rattus norvegicus
ggatttgcgtaactaacacaccccg

SEQ ID NO: 434775 - DNA, 25 bp, Rattus norvegicus
ggatttgcgtaagtaacacaccccg

SEQ ID NO: 434776 - DNA, 25 bp, Rattus norvegicus
ggatttgctgctcgttctaacattt

SEQ ID NO: 434777 - DNA, 25 bp, Rattus norvegicus
ggatttgctgctggttctaacattt

SEQ ID NO: 434778 - DNA, 25 bp, Rattus norvegicus
ggatttgcttccataatctctgttg

SEQ ID NO: 434779 - DNA, 25 bp, Rattus norvegicus
ggatttgcttccttaatctctgttg

SEQ ID NO: 434780 - DNA, 25 bp, Rattus norvegicus
ggatttgctttccaaaacactctct

SEQ ID NO: 434781 - DNA, 25 bp, Rattus norvegicus
ggatttgctttcgaaaacactctct

SEQ ID NO: 434782 - DNA, 25 bp, Rattus norvegicus
ggatttggacatctgcccaagagaa

SEQ ID NO: 434783 - DNA, 25 bp, Rattus norvegicus
ggatttggacatgtgcccaagagaa

SEQ ID NO: 434784 - DNA, 25 bp, Rattus norvegicus
ggatttggagtcctgaagccacaac

SEQ ID NO: 434785 - DNA, 25 bp, Rattus norvegicus
ggatttggagtcgtgaagccacaac

SEQ ID NO: 434786 - DNA, 25 bp, Rattus norvegicus
ggatttggcgtcatctcagacacag

SEQ ID NO: 434787 - DNA, 25 bp, Rattus norvegicus
ggatttggcgtcttctcagacacag

SEQ ID NO: 434788 - DNA, 25 bp, Rattus norvegicus
ggatttggggaccagctttgctctc

SEQ ID NO: 434789 - DNA, 25 bp, Rattus norvegicus
ggatttggggacgagctttgctctc

SEQ ID NO: 434790 - DNA, 25 bp, Rattus norvegicus
ggatttgggtatcctcatcttaaat

SEQ ID NO: 434791 - DNA, 25 bp, Rattus norvegicus
ggatttgggtatgctcatcttaaat

SEQ ID NO: 434792 - DNA, 25 bp, Rattus norvegicus
ggatttgtacatcttatggcgagtg

SEQ ID NO: 434793 - DNA, 25 bp, Rattus norvegicus
ggatttgtacatgttatggcgagtg

SEQ ID NO: 434794 - DNA, 25 bp, Rattus norvegicus
ggatttgtacgtaggcattccacaa

SEQ ID NO: 434795 - DNA, 25 bp, Rattus norvegicus
ggatttgtacgttggcattccacaa

SEQ ID NO: 434796 - DNA, 25 bp, Rattus norvegicus
ggatttgtactaagccccattttgc

SEQ ID NO: 434797 - DNA, 25 bp, Rattus norvegicus
ggatttgtactatgccccattttgc

SEQ ID NO: 434798 - DNA, 25 bp, Rattus norvegicus
ggatttgtatttatacctgctcctt

SEQ ID NO: 434799 - DNA, 25 bp, Rattus norvegicus
ggatttgtatttttacctgctcctt

SEQ ID NO: 434800 - DNA, 25 bp, Rattus norvegicus
ggatttgtcaaacattgcacttaca

SEQ ID NO: 434801 - DNA, 25 bp, Rattus norvegicus
ggatttgtcaaagattgcacttaca

SEQ ID NO: 434802 - DNA, 25 bp, Rattus norvegicus
ggatttgtccacatgttattaacat

SEQ ID NO: 434803 - DNA, 25 bp, Rattus norvegicus
ggatttgtccacttgttattaacat

SEQ ID NO: 434804 - DNA, 25 bp, Rattus norvegicus
ggatttgtcgctagacatctttgat

SEQ ID NO: 434805 - DNA, 25 bp, Rattus norvegicus
ggatttgtcgcttgacatctttgat

SEQ ID NO: 434806 - DNA, 25 bp, Rattus norvegicus
ggatttgtcttgagtgcagggcctt

SEQ ID NO: 434807 - DNA, 25 bp, Rattus norvegicus
ggatttgtcttgtgtgcagggcctt

SEQ ID NO: 434808 - DNA, 25 bp, Rattus norvegicus
ggatttgtctttaactgcctattgt

SEQ ID NO: 434809 - DNA, 25 bp, Rattus norvegicus
ggatttgtcttttactgcctattgt

SEQ ID NO: 434810 - DNA, 25 bp, Rattus norvegicus
ggatttgtgactcagcccatgactt

SEQ ID NO: 434811 - DNA, 25 bp, Rattus norvegicus
ggatttgtgactgagcccatgactt

SEQ ID NO: 434812 - DNA, 25 bp, Rattus norvegicus
ggatttgtggccatgacctgtacat

SEQ ID NO: 434813 - DNA, 25 bp, Rattus norvegicus
ggatttgtggccttgacctgtacat

SEQ ID NO: 434814 - DNA, 25 bp, Rattus norvegicus
ggatttgtgtaacctctactcttcg

SEQ ID NO: 434815 - DNA, 25 bp, Rattus norvegicus
ggatttgtgtaagctctactcttcg

SEQ ID NO: 434816 - DNA, 25 bp, Rattus norvegicus
ggatttgtgttcatgagactccatc

SEQ ID NO: 434817 - DNA, 25 bp, Rattus norvegicus
ggatttgtgttcttgagactccatc

SEQ ID NO: 434818 - DNA, 25 bp, Rattus norvegicus
ggatttgttaccatgtgcactttgg

SEQ ID NO: 434819 - DNA, 25 bp, Rattus norvegicus
ggatttgttaccttgtgcactttgg

SEQ ID NO: 434820 - DNA, 25 bp, Rattus norvegicus
ggatttgtttacattttgtgttctg

SEQ ID NO: 434821 - DNA, 25 bp, Rattus norvegicus
ggatttgtttactttttgtgttctg

SEQ ID NO: 434822 - DNA, 25 bp, Rattus norvegicus
ggatttgtttttcaagtgtgtctca

SEQ ID NO: 434823 - DNA, 25 bp, Rattus norvegicus
ggatttgtttttgaagtgtgtctca

SEQ ID NO: 434824 - DNA, 25 bp, Rattus norvegicus
ggattttaacttcttgctaactctt

SEQ ID NO: 434825 - DNA, 25 bp, Rattus norvegicus
ggattttaacttgttgctaactctt

SEQ ID NO: 434826 - DNA, 25 bp, Rattus norvegicus
ggattttaatgacatcccaagaaaa

SEQ ID NO: 434827 - DNA, 25 bp, Rattus norvegicus
ggattttaatgagatcccaagaaaa

SEQ ID NO: 434828 - DNA, 25 bp, Rattus norvegicus
ggattttacatcaactcaggaacct

SEQ ID NO: 434829 - DNA, 25 bp, Rattus norvegicus
ggattttacatctactcaggaacct

SEQ ID NO: 434830 - DNA, 25 bp, Rattus norvegicus
ggattttacatgatgccacgaccaa

SEQ ID NO: 434831 - DNA, 25 bp, Rattus norvegicus
ggattttacatgttgccacgaccaa

SEQ ID NO: 434832 - DNA, 25 bp, Rattus norvegicus
ggattttacttcaacctttgctgta

SEQ ID NO: 434833 - DNA, 25 bp, Rattus norvegicus
ggattttacttctacctttgctgta

SEQ ID NO: 434834 - DNA, 25 bp, Rattus norvegicus
ggattttagaacagctcacgcgact

SEQ ID NO: 434835 - DNA, 25 bp, Rattus norvegicus
ggattttagaactgctcacgcgact

SEQ ID NO: 434836 - DNA, 25 bp, Rattus norvegicus
ggattttagagtaaggccagtcaca

SEQ ID NO: 434837 - DNA, 25 bp, Rattus norvegicus
ggattttagagttaggccagtcaca

SEQ ID NO: 434838 - DNA, 25 bp, Rattus norvegicus
ggattttaggtaactgacttctgga

SEQ ID NO: 434839 - DNA, 25 bp, Rattus norvegicus
ggattttaggtatctgacttctgga

SEQ ID NO: 434840 - DNA, 25 bp, Rattus norvegicus
ggattttatatgacaaccactgaca

SEQ ID NO: 434841 - DNA, 25 bp, Rattus norvegicus
ggattttatatgtcaaccactgaca

SEQ ID NO: 434842 - DNA, 25 bp, Rattus norvegicus
ggattttatctcagtgtcctgtaaa

SEQ ID NO: 434843 - DNA, 25 bp, Rattus norvegicus
ggattttatctctgtgtcctgtaaa

SEQ ID NO: 434844 - DNA, 25 bp, Rattus norvegicus
ggattttatcttactttgctttaca

SEQ ID NO: 434845 - DNA, 25 bp, Rattus norvegicus
ggattttatctttctttgctttaca

SEQ ID NO: 434846 - DNA, 25 bp, Rattus norvegicus
ggattttatgctcctgtcaattgga

SEQ ID NO: 434847 - DNA, 25 bp, Rattus norvegicus
ggattttatgctgctgtcaattgga

SEQ ID NO: 434848 - DNA, 25 bp, Rattus norvegicus
ggattttatgtaccgcttggctctg

SEQ ID NO: 434849 - DNA, 25 bp, Rattus norvegicus
ggattttatgtagcgcttggctctg

SEQ ID NO: 434850 - DNA, 25 bp, Rattus norvegicus
ggattttattcaagccaccatcaaa

SEQ ID NO: 434851 - DNA, 25 bp, Rattus norvegicus
ggattttattcatgccaccatcaaa

SEQ ID NO: 434852 - DNA, 25 bp, Rattus norvegicus
ggattttattctactttgtcagctc

SEQ ID NO: 434853 - DNA, 25 bp, Rattus norvegicus
ggattttattctctcaaaacagcaa

SEQ ID NO: 434854 - DNA, 25 bp, Rattus norvegicus
ggattttattctgtcaaaacagcaa

SEQ ID NO: 434855 - DNA, 25 bp, Rattus norvegicus
ggattttattcttctttgtcagctc

SEQ ID NO: 434856 - DNA, 25 bp, Rattus norvegicus
ggattttatttcactcacattcaga

SEQ ID NO: 434857 - DNA, 25 bp, Rattus norvegicus
ggattttatttctctcacattcaga

SEQ ID NO: 434858 - DNA, 25 bp, Rattus norvegicus
ggattttcacacctgcttctaacaa

SEQ ID NO: 434859 - DNA, 25 bp, Rattus norvegicus
ggattttcacacgtgcttctaacaa

SEQ ID NO: 434860 - DNA, 25 bp, Rattus norvegicus
ggattttcagcaagcctctgaggat

SEQ ID NO: 434861 - DNA, 25 bp, Rattus norvegicus
ggattttcagcatgcctctgaggat

SEQ ID NO: 434862 - DNA, 25 bp, Rattus norvegicus
ggattttccactattgtcagtaaca

SEQ ID NO: 434863 - DNA, 25 bp, Rattus norvegicus
ggattttccacttttgtcagtaaca

SEQ ID NO: 434864 - DNA, 25 bp, Rattus norvegicus
ggattttccagtcagggccatttag

SEQ ID NO: 434865 - DNA, 25 bp, Rattus norvegicus
ggattttccagtgagggccatttag

SEQ ID NO: 434866 - DNA, 25 bp, Rattus norvegicus
ggattttccatgactttttcttctt

SEQ ID NO: 434867 - DNA, 25 bp, Rattus norvegicus
ggattttccatgtctttttcttctt

SEQ ID NO: 434868 - DNA, 25 bp, Rattus norvegicus
ggattttcccaaatgcagatgtgcc

SEQ ID NO: 434869 - DNA, 25 bp, Rattus norvegicus
ggattttcccaattgcagatgtgcc

SEQ ID NO: 434870 - DNA, 25 bp, Rattus norvegicus
ggattttcgggactttcgtgatcta

SEQ ID NO: 434871 - DNA, 25 bp, Rattus norvegicus
ggattttcgggagtttcgtgatcta

SEQ ID NO: 434872 - DNA, 25 bp, Rattus norvegicus
ggattttctagaatgagttcactga

SEQ ID NO: 434873 - DNA, 25 bp, Rattus norvegicus
ggattttctagattgagttcactga

SEQ ID NO: 434874 - DNA, 25 bp, Rattus norvegicus
ggattttctatgcaacgagggccac

SEQ ID NO: 434875 - DNA, 25 bp, Rattus norvegicus
ggattttctatggaacgagggccac

SEQ ID NO: 434876 - DNA, 25 bp, Rattus norvegicus
ggattttctgtactgcgctatcaaa

SEQ ID NO: 434877 - DNA, 25 bp, Rattus norvegicus
ggattttctgtagtgcgctatcaaa

SEQ ID NO: 434878 - DNA, 25 bp, Rattus norvegicus
ggattttcttacacggatgcaaaca

SEQ ID NO: 434879 - DNA, 25 bp, Rattus norvegicus
ggattttcttaccatttgtgcttat

SEQ ID NO: 434880 - DNA, 25 bp, Rattus norvegicus
ggattttcttacgatttgtgcttat

SEQ ID NO: 434881 - DNA, 25 bp, Rattus norvegicus
ggattttcttactcggatgcaaaca

SEQ ID NO: 434882 - DNA, 25 bp, Rattus norvegicus
ggattttcttccactggctaacagt

SEQ ID NO: 434883 - DNA, 25 bp, Rattus norvegicus
ggattttcttcctctggctaacagt

SEQ ID NO: 434884 - DNA, 25 bp, Rattus norvegicus
ggattttcttctaggtaggaacagc

SEQ ID NO: 434885 - DNA, 25 bp, Rattus norvegicus
ggattttcttcttggtaggaacagc

SEQ ID NO: 434886 - DNA, 25 bp, Rattus norvegicus
ggattttcttggctccactgatgcc

SEQ ID NO: 434887 - DNA, 25 bp, Rattus norvegicus
ggattttcttgggtccactgatgcc

SEQ ID NO: 434888 - DNA, 25 bp, Rattus norvegicus
ggattttcttgtagtctgcatcaca

SEQ ID NO: 434889 - DNA, 25 bp, Rattus norvegicus
ggattttcttgtatgtcaccccgct

SEQ ID NO: 434890 - DNA, 25 bp, Rattus norvegicus
ggattttcttgttgtctgcatcaca

SEQ ID NO: 434891 - DNA, 25 bp, Rattus norvegicus
ggattttcttgtttgtcaccccgct

SEQ ID NO: 434892 - DNA, 25 bp, Rattus norvegicus
ggattttgaaaccttcctgcccatg

SEQ ID NO: 434893 - DNA, 25 bp, Rattus norvegicus
ggattttgaaacgttcctgcccatg

SEQ ID NO: 434894 - DNA, 25 bp, Rattus norvegicus
ggattttgaatcacatcgaagcctt

SEQ ID NO: 434895 - DNA, 25 bp, Rattus norvegicus
ggattttgaatctcatcgaagcctt

SEQ ID NO: 434896 - DNA, 25 bp, Rattus norvegicus
ggattttgaccaactttgctgcttc

SEQ ID NO: 434897 - DNA, 25 bp, Rattus norvegicus
ggattttgaccatctttgctgcttc

SEQ ID NO: 434898 - DNA, 25 bp, Rattus norvegicus
ggattttgatgtcacttcttagcat

SEQ ID NO: 434899 - DNA, 25 bp, Rattus norvegicus
ggattttgatgtgacttcttagcat

SEQ ID NO: 434900 - DNA, 25 bp, Rattus norvegicus
ggattttgattcaccttgccttaaa

SEQ ID NO: 434901 - DNA, 25 bp, Rattus norvegicus
ggattttgattctccttgccttaaa

SEQ ID NO: 434902 - DNA, 25 bp, Rattus norvegicus
ggattttgcggaattgggagcctaa

SEQ ID NO: 434903 - DNA, 25 bp, Rattus norvegicus
ggattttgcggatttgggagcctaa

SEQ ID NO: 434904 - DNA, 25 bp, Rattus norvegicus
ggattttggaccagcctggcttgcc

SEQ ID NO: 434905 - DNA, 25 bp, Rattus norvegicus
ggattttggacctgcctggcttgcc

SEQ ID NO: 434906 - DNA, 25 bp, Rattus norvegicus
ggattttggcccacaaactaattga

SEQ ID NO: 434907 - DNA, 25 bp, Rattus norvegicus
ggattttggccctcaaactaattga

SEQ ID NO: 434908 - DNA, 25 bp, Rattus norvegicus
ggattttgggacagccgtctggtca

SEQ ID NO: 434909 - DNA, 25 bp, Rattus norvegicus
ggattttgggactgccgtctggtca

SEQ ID NO: 434910 - DNA, 25 bp, Rattus norvegicus
ggattttgggtcacttagaactggg

SEQ ID NO: 434911 - DNA, 25 bp, Rattus norvegicus
ggattttgggtctcttagaactggg

SEQ ID NO: 434912 - DNA, 25 bp, Rattus norvegicus
ggattttgtaacagtagacctcaac

SEQ ID NO: 434913 - DNA, 25 bp, Rattus norvegicus
ggattttgtaactgtagacctcaac

SEQ ID NO: 434914 - DNA, 25 bp, Rattus norvegicus
ggattttgtctaaagtcctgtcaga

SEQ ID NO: 434915 - DNA, 25 bp, Rattus norvegicus
ggattttgtctatagtcctgtcaga

SEQ ID NO: 434916 - DNA, 25 bp, Rattus norvegicus
ggattttgttgtaatctgcatttca

SEQ ID NO: 434917 - DNA, 25 bp, Rattus norvegicus
ggattttgttgttatctgcatttca

SEQ ID NO: 434918 - DNA, 25 bp, Rattus norvegicus
ggattttgtttcagcttcaaggtca

SEQ ID NO: 434919 - DNA, 25 bp, Rattus norvegicus
ggattttgtttctgcttcaaggtca

SEQ ID NO: 434920 - DNA, 25 bp, Rattus norvegicus
ggatttttaagtcatagctcttggc

SEQ ID NO: 434921 - DNA, 25 bp, Rattus norvegicus
ggatttttaagtgatagctcttggc

SEQ ID NO: 434922 - DNA, 25 bp, Rattus norvegicus
ggatttttacagagcccacagtaga

SEQ ID NO: 434923 - DNA, 25 bp, Rattus norvegicus
ggatttttacagtgcccacagtaga

SEQ ID NO: 434924 - DNA, 25 bp, Rattus norvegicus
ggatttttaggacatgttgccacag

SEQ ID NO: 434925 - DNA, 25 bp, Rattus norvegicus
ggatttttaggagatgttgccacag

SEQ ID NO: 434926 - DNA, 25 bp, Rattus norvegicus
ggatttttatagcacctggacttaa

SEQ ID NO: 434927 - DNA, 25 bp, Rattus norvegicus
ggatttttataggacctggacttaa

SEQ ID NO: 434928 - DNA, 25 bp, Rattus norvegicus
ggatttttcaaccttagcccactca

SEQ ID NO: 434929 - DNA, 25 bp, Rattus norvegicus
ggatttttcaacgttagcccactca

SEQ ID NO: 434930 - DNA, 25 bp, Rattus norvegicus
ggatttttccacaaatgtgaacttc

SEQ ID NO: 434931 - DNA, 25 bp, Rattus norvegicus
ggatttttccactaatgtgaacttc

SEQ ID NO: 434932 - DNA, 25 bp, Rattus norvegicus
ggatttttccctccgtaggaaccat

SEQ ID NO: 434933 - DNA, 25 bp, Rattus norvegicus
ggatttttccctgcgtaggaaccat

SEQ ID NO: 434934 - DNA, 25 bp, Rattus norvegicus
ggatttttcctgacttatattcgtg

SEQ ID NO: 434935 - DNA, 25 bp, Rattus norvegicus
ggatttttcctgtcttatattcgtg

SEQ ID NO: 434936 - DNA, 25 bp, Rattus norvegicus
ggatttttctgaaggccttttagga

SEQ ID NO: 434937 - DNA, 25 bp, Rattus norvegicus
ggatttttctgatggccttttagga

SEQ ID NO: 434938 - DNA, 25 bp, Rattus norvegicus
ggatttttgacaactgaccaatgtg

SEQ ID NO: 434939 - DNA, 25 bp, Rattus norvegicus
ggatttttgacatctgaccaatgtg

SEQ ID NO: 434940 - DNA, 25 bp, Rattus norvegicus
ggatttttgctaagctgtaactgtt

SEQ ID NO: 434941 - DNA, 25 bp, Rattus norvegicus
ggatttttgctatgctgtaactgtt

SEQ ID NO: 434942 - DNA, 25 bp, Rattus norvegicus
ggatttttggtcatgaaactgtctt

SEQ ID NO: 434943 - DNA, 25 bp, Rattus norvegicus
ggatttttggtcttgaaactgtctt

SEQ ID NO: 434944 - DNA, 25 bp, Rattus norvegicus
ggatttttgtcaaggatgtgcccaa

SEQ ID NO: 434945 - DNA, 25 bp, Rattus norvegicus
ggatttttgtcatggatgtgcccaa

SEQ ID NO: 434946 - DNA, 25 bp, Rattus norvegicus
ggcaaaaaccctcacatacacaaaa

SEQ ID NO: 434947 - DNA, 25 bp, Rattus norvegicus
ggcaaaaaccctgacatacacaaaa

SEQ ID NO: 434948 - DNA, 25 bp, Rattus norvegicus
ggcaaaaaccttcagtccattccta

SEQ ID NO: 434949 - DNA, 25 bp, Rattus norvegicus
ggcaaaaaccttgagtccattccta

SEQ ID NO: 434950 - DNA, 25 bp, Rattus norvegicus
ggcaaaaactgcacatctttaagat

SEQ ID NO: 434951 - DNA, 25 bp, Rattus norvegicus
ggcaaaaactgctcatctttaagat

SEQ ID NO: 434952 - DNA, 25 bp, Rattus norvegicus
ggcaaaaagccccattcctattaag

SEQ ID NO: 434953 - DNA, 25 bp, Rattus norvegicus
ggcaaaaagcccgattcctattaag

SEQ ID NO: 434954 - DNA, 25 bp, Rattus norvegicus
ggcaaaacaccactatgtaataata

SEQ ID NO: 434955 - DNA, 25 bp, Rattus norvegicus
ggcaaaacaccagtatgtaataata

SEQ ID NO: 434956 - DNA, 25 bp, Rattus norvegicus
ggcaaaaccagtaactactaatctt

SEQ ID NO: 434957 - DNA, 25 bp, Rattus norvegicus
ggcaaaaccagttactactaatctt

SEQ ID NO: 434958 - DNA, 25 bp, Rattus norvegicus
ggcaaaaccccactgaggcggaact

SEQ ID NO: 434959 - DNA, 25 bp, Rattus norvegicus
ggcaaaaccccagtgaggcggaact

SEQ ID NO: 434960 - DNA, 25 bp, Rattus norvegicus
ggcaaaaccggaagaccttatggat

SEQ ID NO: 434961 - DNA, 25 bp, Rattus norvegicus
ggcaaaaccggatgaccttatggat

SEQ ID NO: 434962 - DNA, 25 bp, Rattus norvegicus
ggcaaaacgcagatcctgtgtctga

SEQ ID NO: 434963 - DNA, 25 bp, Rattus norvegicus
ggcaaaacgcagttcctgtgtctga

SEQ ID NO: 434964 - DNA, 25 bp, Rattus norvegicus
ggcaaaacgctcatatgtatcatat

SEQ ID NO: 434965 - DNA, 25 bp, Rattus norvegicus
ggcaaaacgctcttatgtatcatat

SEQ ID NO: 434966 - DNA, 25 bp, Rattus norvegicus
ggcaaaacggtgaatgaactccaga

SEQ ID NO: 434967 - DNA, 25 bp, Rattus norvegicus
ggcaaaacggtgtatgaactccaga

SEQ ID NO: 434968 - DNA, 25 bp, Rattus norvegicus
ggcaaaactgcacgaaatggctttc

SEQ ID NO: 434969 - DNA, 25 bp, Rattus norvegicus
ggcaaaactgcaggaaatggctttc

SEQ ID NO: 434970 - DNA, 25 bp, Rattus norvegicus
ggcaaaactgccaattctgctattt

SEQ ID NO: 434971 - DNA, 25 bp, Rattus norvegicus
ggcaaaactgccatctcaagaataa

SEQ ID NO: 434972 - DNA, 25 bp, Rattus norvegicus
ggcaaaactgcctattctgctattt

SEQ ID NO: 434973 - DNA, 25 bp, Rattus norvegicus
ggcaaaactgccttctcaagaataa

SEQ ID NO: 434974 - DNA, 25 bp, Rattus norvegicus
ggcaaaagacctcgtgcgtacccgg

SEQ ID NO: 434975 - DNA, 25 bp, Rattus norvegicus
ggcaaaagacctggtgcgtacccgg

SEQ ID NO: 434976 - DNA, 25 bp, Rattus norvegicus
ggcaaaagatcaacgccagtctgga

SEQ ID NO: 434977 - DNA, 25 bp, Rattus norvegicus
ggcaaaagatcatcgccagtctgga

SEQ ID NO: 434978 - DNA, 25 bp, Rattus norvegicus
ggcaaaagcaagaccctactggaga

SEQ ID NO: 434979 - DNA, 25 bp, Rattus norvegicus
ggcaaaagcaagtccctactggaga

SEQ ID NO: 434980 - DNA, 25 bp, Rattus norvegicus
ggcaaaagccggaggcctcgaacta

SEQ ID NO: 434981 - DNA, 25 bp, Rattus norvegicus
ggcaaaagccggtggcctcgaacta

SEQ ID NO: 434982 - DNA, 25 bp, Rattus norvegicus
ggcaaaagtcctctaatcttagaga

SEQ ID NO: 434983 - DNA, 25 bp, Rattus norvegicus
ggcaaaagtcctgtaatcttagaga

SEQ ID NO: 434984 - DNA, 25 bp, Rattus norvegicus
ggcaaaagttaacctgatggccttt

SEQ ID NO: 434985 - DNA, 25 bp, Rattus norvegicus
ggcaaaagttaagctgatggccttt

SEQ ID NO: 434986 - DNA, 25 bp, Rattus norvegicus
ggcaaaatatcgaccccaaaaatat

SEQ ID NO: 434987 - DNA, 25 bp, Rattus norvegicus
ggcaaaatatcgtccccaaaaatat

SEQ ID NO: 434988 - DNA, 25 bp, Rattus norvegicus
ggcaaaatctatagtcttccaccga

SEQ ID NO: 434989 - DNA, 25 bp, Rattus norvegicus
ggcaaaatctattgtcttccaccga

SEQ ID NO: 434990 - DNA, 25 bp, Rattus norvegicus
ggcaaaatgaaactcgaaccagaca

SEQ ID NO: 434991 - DNA, 25 bp, Rattus norvegicus
ggcaaaatgaaagtcgaaccagaca

SEQ ID NO: 434992 - DNA, 25 bp, Rattus norvegicus
ggcaaaatgaaccaccgagacccac

SEQ ID NO: 434993 - DNA, 25 bp, Rattus norvegicus
ggcaaaatgaacgaccgagacccac

SEQ ID NO: 434994 - DNA, 25 bp, Rattus norvegicus
ggcaaaatgccaagccctgggtcat

SEQ ID NO: 434995 - DNA, 25 bp, Rattus norvegicus
ggcaaaatgccatgccctgggtcat

SEQ ID NO: 434996 - DNA, 25 bp, Rattus norvegicus
ggcaaaatgtgcaactgatccagaa

SEQ ID NO: 434997 - DNA, 25 bp, Rattus norvegicus
ggcaaaatgtgctactgatccagaa

SEQ ID NO: 434998 - DNA, 25 bp, Rattus norvegicus
ggcaaaattctaactgaagttctgg

SEQ ID NO: 434999 - DNA, 25 bp, Rattus norvegicus
ggcaaaattctatctgaagttctgg

SEQ ID NO: 435000 - DNA, 25 bp, Rattus norvegicus
ggcaaaattctcaaggagcccagat

SEQ ID NO: 435001 - DNA, 25 bp, Rattus norvegicus
ggcaaaattctctaggagcccagat

SEQ ID NO: 435002 - DNA, 25 bp, Rattus norvegicus
ggcaaacaaactacctttgggctga

SEQ ID NO: 435003 - DNA, 25 bp, Rattus norvegicus
ggcaaacaaactcacacaggatcaa

SEQ ID NO: 435004 - DNA, 25 bp, Rattus norvegicus
ggcaaacaaactgacacaggatcaa

SEQ ID NO: 435005 - DNA, 25 bp, Rattus norvegicus
ggcaaacaaacttcctttgggctga

SEQ ID NO: 435006 - DNA, 25 bp, Rattus norvegicus
ggcaaacaacctcttttcgagctgc

SEQ ID NO: 435007 - DNA, 25 bp, Rattus norvegicus
ggcaaacaacctgttttcgagctgc

SEQ ID NO: 435008 - DNA, 25 bp, Rattus norvegicus
ggcaaacacatgaagctactgagct

SEQ ID NO: 435009 - DNA, 25 bp, Rattus norvegicus
ggcaaacacatgtagctactgagct

SEQ ID NO: 435010 - DNA, 25 bp, Rattus norvegicus
ggcaaacaccccagactcagatgta

SEQ ID NO: 435011 - DNA, 25 bp, Rattus norvegicus
ggcaaacacccctgactcagatgta

SEQ ID NO: 435012 - DNA, 25 bp, Rattus norvegicus
ggcaaacacctcatggatacacagc

SEQ ID NO: 435013 - DNA, 25 bp, Rattus norvegicus
ggcaaacacctcttggatacacagc

SEQ ID NO: 435014 - DNA, 25 bp, Rattus norvegicus
ggcaaacactgacatacctggctga

SEQ ID NO: 435015 - DNA, 25 bp, Rattus norvegicus
ggcaaacactgagatacctggctga

SEQ ID NO: 435016 - DNA, 25 bp, Rattus norvegicus
ggcaaacagaagatcgtcctcaaaa

SEQ ID NO: 435017 - DNA, 25 bp, Rattus norvegicus
ggcaaacagaagttcgtcctcaaaa

SEQ ID NO: 435018 - DNA, 25 bp, Rattus norvegicus
ggcaaacagccgcaccagtagcaaa

SEQ ID NO: 435019 - DNA, 25 bp, Rattus norvegicus
ggcaaacagccggaccagtagcaaa

SEQ ID NO: 435020 - DNA, 25 bp, Rattus norvegicus
ggcaaacatcctcagggacctttaa

SEQ ID NO: 435021 - DNA, 25 bp, Rattus norvegicus
ggcaaacatcctgagggacctttaa

SEQ ID NO: 435022 - DNA, 25 bp, Rattus norvegicus
ggcaaacatcttagtaatcacaggg

SEQ ID NO: 435023 - DNA, 25 bp, Rattus norvegicus
ggcaaacatctttgtaatcacaggg

SEQ ID NO: 435024 - DNA, 25 bp, Rattus norvegicus
ggcaaacatggactcgccctgtttt

SEQ ID NO: 435025 - DNA, 25 bp, Rattus norvegicus
ggcaaacatggagtcgccctgtttt

SEQ ID NO: 435026 - DNA, 25 bp, Rattus norvegicus
ggcaaacattgcctttatgaccaag

SEQ ID NO: 435027 - DNA, 25 bp, Rattus norvegicus
ggcaaacattgcgtttatgaccaag

SEQ ID NO: 435028 - DNA, 25 bp, Rattus norvegicus
ggcaaacatttaatcactgcacgga

SEQ ID NO: 435029 - DNA, 25 bp, Rattus norvegicus
ggcaaacatttattcactgcacgga

SEQ ID NO: 435030 - DNA, 25 bp, Rattus norvegicus
ggcaaaccactgcagaggatatttt

SEQ ID NO: 435031 - DNA, 25 bp, Rattus norvegicus
ggcaaaccactggagaggatatttt

SEQ ID NO: 435032 - DNA, 25 bp, Rattus norvegicus
ggcaaaccagccagtgattatgtga

SEQ ID NO: 435033 - DNA, 25 bp, Rattus norvegicus
ggcaaaccagcctgtgattatgtga

SEQ ID NO: 435034 - DNA, 25 bp, Rattus norvegicus
ggcaaaccaggcactccagggataa

SEQ ID NO: 435035 - DNA, 25 bp, Rattus norvegicus
ggcaaaccaggctctccagggataa

SEQ ID NO: 435036 - DNA, 25 bp, Rattus norvegicus
ggcaaaccagtaccagcttcctagg

SEQ ID NO: 435037 - DNA, 25 bp, Rattus norvegicus
ggcaaaccagtagcagcttcctagg

SEQ ID NO: 435038 - DNA, 25 bp, Rattus norvegicus
ggcaaacccatgcagatccacctgt

SEQ ID NO: 435039 - DNA, 25 bp, Rattus norvegicus
ggcaaacccatggagatccacctgt

SEQ ID NO: 435040 - DNA, 25 bp, Rattus norvegicus
ggcaaaccccgtctctagaacatag

SEQ ID NO: 435041 - DNA, 25 bp, Rattus norvegicus
ggcaaaccccgtgtctagaacatag

SEQ ID NO: 435042 - DNA, 25 bp, Rattus norvegicus
ggcaaaccgtatacatgaactgcat

SEQ ID NO: 435043 - DNA, 25 bp, Rattus norvegicus
ggcaaaccgtattcatgaactgcat

SEQ ID NO: 435044 - DNA, 25 bp, Rattus norvegicus
ggcaaacgccagagcagggaccaga

SEQ ID NO: 435045 - DNA, 25 bp, Rattus norvegicus
ggcaaacgccagtgcagggaccaga

SEQ ID NO: 435046 - DNA, 25 bp, Rattus norvegicus
ggcaaacgctttaaccatagtcatc

SEQ ID NO: 435047 - DNA, 25 bp, Rattus norvegicus
ggcaaacgcttttaccatagtcatc

SEQ ID NO: 435048 - DNA, 25 bp, Rattus norvegicus
ggcaaacggagccttcttgaaccag

SEQ ID NO: 435049 - DNA, 25 bp, Rattus norvegicus
ggcaaacggagcgttcttgaaccag

SEQ ID NO: 435050 - DNA, 25 bp, Rattus norvegicus
ggcaaacggcttaaagtgcactttc

SEQ ID NO: 435051 - DNA, 25 bp, Rattus norvegicus
ggcaaacggctttaagtgcactttc

SEQ ID NO: 435052 - DNA, 25 bp, Rattus norvegicus
ggcaaacgggaaccaatccgctgta

SEQ ID NO: 435053 - DNA, 25 bp, Rattus norvegicus
ggcaaacgggaagcaatccgctgta

SEQ ID NO: 435054 - DNA, 25 bp, Rattus norvegicus
ggcaaacgtagcaggtgcacacact

SEQ ID NO: 435055 - DNA, 25 bp, Rattus norvegicus
ggcaaacgtagctggtgcacacact

SEQ ID NO: 435056 - DNA, 25 bp, Rattus norvegicus
ggcaaacgttccatacaaccatgta

SEQ ID NO: 435057 - DNA, 25 bp, Rattus norvegicus
ggcaaacgttccttacaaccatgta

SEQ ID NO: 435058 - DNA, 25 bp, Rattus norvegicus
ggcaaacgtttcagtttagcgtgaa

SEQ ID NO: 435059 - DNA, 25 bp, Rattus norvegicus
ggcaaacgtttctgtttagcgtgaa

SEQ ID NO: 435060 - DNA, 25 bp, Rattus norvegicus
ggcaaactactaatcagtttagctt

SEQ ID NO: 435061 - DNA, 25 bp, Rattus norvegicus
ggcaaactactattcagtttagctt

SEQ ID NO: 435062 - DNA, 25 bp, Rattus norvegicus
ggcaaactcaggagcttcctttttt

SEQ ID NO: 435063 - DNA, 25 bp, Rattus norvegicus
ggcaaactcaggtgcttcctttttt

SEQ ID NO: 435064 - DNA, 25 bp, Rattus norvegicus
ggcaaactctccaccacattaagga

SEQ ID NO: 435065 - DNA, 25 bp, Rattus norvegicus
ggcaaactctcctccacattaagga

SEQ ID NO: 435066 - DNA, 25 bp, Rattus norvegicus
ggcaaactgctactctttaatggaa

SEQ ID NO: 435067 - DNA, 25 bp, Rattus norvegicus
ggcaaactgctagtctttaatggaa

SEQ ID NO: 435068 - DNA, 25 bp, Rattus norvegicus
ggcaaactgcttaatcttgtggatt

SEQ ID NO: 435069 - DNA, 25 bp, Rattus norvegicus
ggcaaactgctttatcttgtggatt

SEQ ID NO: 435070 - DNA, 25 bp, Rattus norvegicus
ggcaaactggccacatctaagaaag

SEQ ID NO: 435071 - DNA, 25 bp, Rattus norvegicus
ggcaaactggcctcatctaagaaag

SEQ ID NO: 435072 - DNA, 25 bp, Rattus norvegicus
ggcaaactgtagctggatttctccc

SEQ ID NO: 435073 - DNA, 25 bp, Rattus norvegicus
ggcaaactgtaggtggatttctccc

SEQ ID NO: 435074 - DNA, 25 bp, Rattus norvegicus
ggcaaactgttccaattgtatccca

SEQ ID NO: 435075 - DNA, 25 bp, Rattus norvegicus
ggcaaactgttcgaattgtatccca

SEQ ID NO: 435076 - DNA, 25 bp, Rattus norvegicus
ggcaaactgtttacaaatctgcttt

SEQ ID NO: 435077 - DNA, 25 bp, Rattus norvegicus
ggcaaactgttttcaaatctgcttt

SEQ ID NO: 435078 - DNA, 25 bp, Rattus norvegicus
ggcaaacttttaaggcctgtcccat

SEQ ID NO: 435079 - DNA, 25 bp, Rattus norvegicus
ggcaaacttttatggcctgtcccat

SEQ ID NO: 435080 - DNA, 25 bp, Rattus norvegicus
ggcaaagaacacatttcaccagctc

SEQ ID NO: 435081 - DNA, 25 bp, Rattus norvegicus
ggcaaagaacacttttcaccagctc

SEQ ID NO: 435082 - DNA, 25 bp, Rattus norvegicus
ggcaaagaatgcacactagtggaca

SEQ ID NO: 435083 - DNA, 25 bp, Rattus norvegicus
ggcaaagaatgctcactagtggaca

SEQ ID NO: 435084 - DNA, 25 bp, Rattus norvegicus
ggcaaagactgcaggccccttggat

SEQ ID NO: 435085 - DNA, 25 bp, Rattus norvegicus
ggcaaagactgctggccccttggat

SEQ ID NO: 435086 - DNA, 25 bp, Rattus norvegicus
ggcaaagagcagcaactactcagca

SEQ ID NO: 435087 - DNA, 25 bp, Rattus norvegicus
ggcaaagagcaggaactactcagca

SEQ ID NO: 435088 - DNA, 25 bp, Rattus norvegicus
ggcaaagaggctctctgcttcatcc

SEQ ID NO: 435089 - DNA, 25 bp, Rattus norvegicus
ggcaaagaggctgtctgcttcatcc

SEQ ID NO: 435090 - DNA, 25 bp, Rattus norvegicus
ggcaaagcaagacacaatccctggt

SEQ ID NO: 435091 - DNA, 25 bp, Rattus norvegicus
ggcaaagcaagagacaatccctggt

SEQ ID NO: 435092 - DNA, 25 bp, Rattus norvegicus
ggcaaagcacagaatgatccagcaa

SEQ ID NO: 435093 - DNA, 25 bp, Rattus norvegicus
ggcaaagcacagtatgatccagcaa

SEQ ID NO: 435094 - DNA, 25 bp, Rattus norvegicus
ggcaaagcaccacctggaatttctt

SEQ ID NO: 435095 - DNA, 25 bp, Rattus norvegicus
ggcaaagcaccagctggaatttctt

SEQ ID NO: 435096 - DNA, 25 bp, Rattus norvegicus
ggcaaagcacgtagaccgggagtta

SEQ ID NO: 435097 - DNA, 25 bp, Rattus norvegicus
ggcaaagcacgttgaccgggagtta

SEQ ID NO: 435098 - DNA, 25 bp, Rattus norvegicus
ggcaaagcagccaacatattcagag

SEQ ID NO: 435099 - DNA, 25 bp, Rattus norvegicus
ggcaaagcagcctacatattcagag

SEQ ID NO: 435100 - DNA, 25 bp, Rattus norvegicus
ggcaaagccactccggcgagaagcc

SEQ ID NO: 435101 - DNA, 25 bp, Rattus norvegicus
ggcaaagccactgcggcgagaagcc

SEQ ID NO: 435102 - DNA, 25 bp, Rattus norvegicus
ggcaaagccatgaaggttccaggtg

SEQ ID NO: 435103 - DNA, 25 bp, Rattus norvegicus
ggcaaagccatgtaggttccaggtg

SEQ ID NO: 435104 - DNA, 25 bp, Rattus norvegicus
ggcaaagcccggatcaggatcgaca

SEQ ID NO: 435105 - DNA, 25 bp, Rattus norvegicus
ggcaaagcccggttcaggatcgaca

SEQ ID NO: 435106 - DNA, 25 bp, Rattus norvegicus
ggcaaagccgaacggtgggccaaag

SEQ ID NO: 435107 - DNA, 25 bp, Rattus norvegicus
ggcaaagccgaagggtgggccaaag

SEQ ID NO: 435108 - DNA, 25 bp, Rattus norvegicus
ggcaaagctcaacctctgggatagt

SEQ ID NO: 435109 - DNA, 25 bp, Rattus norvegicus
ggcaaagctcaagctctgggatagt

SEQ ID NO: 435110 - DNA, 25 bp, Rattus norvegicus
ggcaaagctgctactctgtagcatt

SEQ ID NO: 435111 - DNA, 25 bp, Rattus norvegicus
ggcaaagctgctctctgtggattga

SEQ ID NO: 435112 - DNA, 25 bp, Rattus norvegicus
ggcaaagctgctgtctgtggattga

SEQ ID NO: 435113 - DNA, 25 bp, Rattus norvegicus
ggcaaagctgcttctctgtagcatt

SEQ ID NO: 435114 - DNA, 25 bp, Rattus norvegicus
ggcaaaggacgcatgcgcactttga

SEQ ID NO: 435115 - DNA, 25 bp, Rattus norvegicus
ggcaaaggacgcttgcgcactttga

SEQ ID NO: 435116 - DNA, 25 bp, Rattus norvegicus
ggcaaaggactgctttagcactttt

SEQ ID NO: 435117 - DNA, 25 bp, Rattus norvegicus
ggcaaaggactggtttagcactttt

SEQ ID NO: 435118 - DNA, 25 bp, Rattus norvegicus
ggcaaaggccaccagttgactctgt

SEQ ID NO: 435119 - DNA, 25 bp, Rattus norvegicus
ggcaaaggccacgagttgactctgt

SEQ ID NO: 435120 - DNA, 25 bp, Rattus norvegicus
ggcaaaggcctcctccttatgacaa

SEQ ID NO: 435121 - DNA, 25 bp, Rattus norvegicus
ggcaaaggcctcgtccttatgacaa

SEQ ID NO: 435122 - DNA, 25 bp, Rattus norvegicus
ggcaaaggccttcgacacagatgtc

SEQ ID NO: 435123 - DNA, 25 bp, Rattus norvegicus
ggcaaaggccttggacacagatgtc

SEQ ID NO: 435124 - DNA, 25 bp, Rattus norvegicus
ggcaaaggcgagagccggctcaaac

SEQ ID NO: 435125 - DNA, 25 bp, Rattus norvegicus
ggcaaaggcgagtgccggctcaaac

SEQ ID NO: 435126 - DNA, 25 bp, Rattus norvegicus
ggcaaagggacccatgttctctgtg

SEQ ID NO: 435127 - DNA, 25 bp, Rattus norvegicus
ggcaaagggaccgatgttctctgtg

SEQ ID NO: 435128 - DNA, 25 bp, Rattus norvegicus
ggcaaagggcaaactcaagacctgt

SEQ ID NO: 435129 - DNA, 25 bp, Rattus norvegicus
ggcaaagggcaactctgtacctact

SEQ ID NO: 435130 - DNA, 25 bp, Rattus norvegicus
ggcaaagggcaagtctgtacctact

SEQ ID NO: 435131 - DNA, 25 bp, Rattus norvegicus
ggcaaagggcaatctcaagacctgt

SEQ ID NO: 435132 - DNA, 25 bp, Rattus norvegicus
ggcaaagggcacatggaactgcagt

SEQ ID NO: 435133 - DNA, 25 bp, Rattus norvegicus
ggcaaagggcacttggaactgcagt

SEQ ID NO: 435134 - DNA, 25 bp, Rattus norvegicus
ggcaaagggtcaagggctcaccagc

SEQ ID NO: 435135 - DNA, 25 bp, Rattus norvegicus
ggcaaagggtcatgggctcaccagc

SEQ ID NO: 435136 - DNA, 25 bp, Rattus norvegicus
ggcaaagggtttcgctcccaatcaa

SEQ ID NO: 435137 - DNA, 25 bp, Rattus norvegicus
ggcaaagggtttggctcccaatcaa

SEQ ID NO: 435138 - DNA, 25 bp, Rattus norvegicus
ggcaaaggtaatactcttgacttgt

SEQ ID NO: 435139 - DNA, 25 bp, Rattus norvegicus
ggcaaaggtaattctcttgacttgt

SEQ ID NO: 435140 - DNA, 25 bp, Rattus norvegicus
ggcaaaggtactaattcagttcatg

SEQ ID NO: 435141 - DNA, 25 bp, Rattus norvegicus
ggcaaaggtacttattcagttcatg

SEQ ID NO: 435142 - DNA, 25 bp, Rattus norvegicus
ggcaaaggtgcacgcccatgtgcat

SEQ ID NO: 435143 - DNA, 25 bp, Rattus norvegicus
ggcaaaggtgcaggcccatgtgcat

SEQ ID NO: 435144 - DNA, 25 bp, Rattus norvegicus
ggcaaagtagttacctgcttcagta

SEQ ID NO: 435145 - DNA, 25 bp, Rattus norvegicus
ggcaaagtagtttcctgcttcagta

SEQ ID NO: 435146 - DNA, 25 bp, Rattus norvegicus
ggcaaagtccaaatgccctttatct

SEQ ID NO: 435147 - DNA, 25 bp, Rattus norvegicus
ggcaaagtccaattgccctttatct

SEQ ID NO: 435148 - DNA, 25 bp, Rattus norvegicus
ggcaaagtctgcatctgcctggcta

SEQ ID NO: 435149 - DNA, 25 bp, Rattus norvegicus
ggcaaagtctgcttctgcctggcta

SEQ ID NO: 435150 - DNA, 25 bp, Rattus norvegicus
ggcaaagtgggcagaggatcctact

SEQ ID NO: 435151 - DNA, 25 bp, Rattus norvegicus
ggcaaagtgggctgaggatcctact

SEQ ID NO: 435152 - DNA, 25 bp, Rattus norvegicus
ggcaaagttattcgccttcgggatc

SEQ ID NO: 435153 - DNA, 25 bp, Rattus norvegicus
ggcaaagttattggccttcgggatc

SEQ ID NO: 435154 - DNA, 25 bp, Rattus norvegicus
ggcaaataaggccttgacctctacc

SEQ ID NO: 435155 - DNA, 25 bp, Rattus norvegicus
ggcaaataaggcgttgacctctacc

SEQ ID NO: 435156 - DNA, 25 bp, Rattus norvegicus
ggcaaataaggtagtgtctccagat

SEQ ID NO: 435157 - DNA, 25 bp, Rattus norvegicus
ggcaaataaggttgtgtctccagat

SEQ ID NO: 435158 - DNA, 25 bp, Rattus norvegicus
ggcaaataccgtaagtcttagcaag

SEQ ID NO: 435159 - DNA, 25 bp, Rattus norvegicus
ggcaaataccgttagtcttagcaag

SEQ ID NO: 435160 - DNA, 25 bp, Rattus norvegicus
ggcaaatattctccctctgagctaa

SEQ ID NO: 435161 - DNA, 25 bp, Rattus norvegicus
ggcaaatattctgcctctgagctaa

SEQ ID NO: 435162 - DNA, 25 bp, Rattus norvegicus
ggcaaatcaaacatatgtgtcagtt

SEQ ID NO: 435163 - DNA, 25 bp, Rattus norvegicus
ggcaaatcaaacttatgtgtcagtt

SEQ ID NO: 435164 - DNA, 25 bp, Rattus norvegicus
ggcaaatcatgcattctcagtttcc

SEQ ID NO: 435165 - DNA, 25 bp, Rattus norvegicus
ggcaaatcatgctttctcagtttcc

SEQ ID NO: 435166 - DNA, 25 bp, Rattus norvegicus
ggcaaatcatgtactgttcttctgt

SEQ ID NO: 435167 - DNA, 25 bp, Rattus norvegicus
ggcaaatcatgttctgttcttctgt

SEQ ID NO: 435168 - DNA, 25 bp, Rattus norvegicus
ggcaaatcattaccatcattgttgt

SEQ ID NO: 435169 - DNA, 25 bp, Rattus norvegicus
ggcaaatcattagcatcattgttgt

SEQ ID NO: 435170 - DNA, 25 bp, Rattus norvegicus
ggcaaatccgtgagtaccagctcta

SEQ ID NO: 435171 - DNA, 25 bp, Rattus norvegicus
ggcaaatccgtgtgtaccagctcta

SEQ ID NO: 435172 - DNA, 25 bp, Rattus norvegicus
ggcaaatcctagcagctgtgcactc

SEQ ID NO: 435173 - DNA, 25 bp, Rattus norvegicus
ggcaaatcctaggagctgtgcactc

SEQ ID NO: 435174 - DNA, 25 bp, Rattus norvegicus
ggcaaatcctgtagctttagttctt

SEQ ID NO: 435175 - DNA, 25 bp, Rattus norvegicus
ggcaaatcctgttgctttagttctt

SEQ ID NO: 435176 - DNA, 25 bp, Rattus norvegicus
ggcaaatcgcctcataccttttaga

SEQ ID NO: 435177 - DNA, 25 bp, Rattus norvegicus
ggcaaatcgcctgataccttttaga

SEQ ID NO: 435178 - DNA, 25 bp, Rattus norvegicus
ggcaaatcgctaccccaaaattgtg

SEQ ID NO: 435179 - DNA, 25 bp, Rattus norvegicus
ggcaaatcgctagcccaaaattgtg

SEQ ID NO: 435180 - DNA, 25 bp, Rattus norvegicus
ggcaaatctgagctattccatactt

SEQ ID NO: 435181 - DNA, 25 bp, Rattus norvegicus
ggcaaatctgaggtattccatactt

SEQ ID NO: 435182 - DNA, 25 bp, Rattus norvegicus
ggcaaatctgtcatgtcatgttgta

SEQ ID NO: 435183 - DNA, 25 bp, Rattus norvegicus
ggcaaatctgtcttgtcatgttgta

SEQ ID NO: 435184 - DNA, 25 bp, Rattus norvegicus
ggcaaatgaactcgccccccggata

SEQ ID NO: 435185 - DNA, 25 bp, Rattus norvegicus
ggcaaatgaactggccccccggata

SEQ ID NO: 435186 - DNA, 25 bp, Rattus norvegicus
ggcaaatgagccatctctaggtcca

SEQ ID NO: 435187 - DNA, 25 bp, Rattus norvegicus
ggcaaatgagccttctctaggtcca

SEQ ID NO: 435188 - DNA, 25 bp, Rattus norvegicus
ggcaaatgtacacacctcatgctag

SEQ ID NO: 435189 - DNA, 25 bp, Rattus norvegicus
ggcaaatgtacagacctcatgctag

SEQ ID NO: 435190 - DNA, 25 bp, Rattus norvegicus
ggcaaatgtctcagtcacgtgggaa

SEQ ID NO: 435191 - DNA, 25 bp, Rattus norvegicus
ggcaaatgtctctgtcacgtgggaa

SEQ ID NO: 435192 - DNA, 25 bp, Rattus norvegicus
ggcaaatgttagcatgttctgagac

SEQ ID NO: 435193 - DNA, 25 bp, Rattus norvegicus
ggcaaatgttaggatgttctgagac

SEQ ID NO: 435194 - DNA, 25 bp, Rattus norvegicus
ggcaaatgtttcaccagttgtcaaa

SEQ ID NO: 435195 - DNA, 25 bp, Rattus norvegicus
ggcaaatgtttctccagttgtcaaa

SEQ ID NO: 435196 - DNA, 25 bp, Rattus norvegicus
ggcaaattcccacacaaactgcaag

SEQ ID NO: 435197 - DNA, 25 bp, Rattus norvegicus
ggcaaattcccagacaaactgcaag

SEQ ID NO: 435198 - DNA, 25 bp, Rattus norvegicus
ggcaaattcctcaggactcattttt

SEQ ID NO: 435199 - DNA, 25 bp, Rattus norvegicus
ggcaaattcctctggactcattttt

SEQ ID NO: 435200 - DNA, 25 bp, Rattus norvegicus
ggcaaattctgtctgatcttttttc

SEQ ID NO: 435201 - DNA, 25 bp, Rattus norvegicus
ggcaaattctgtgtgatcttttttc

SEQ ID NO: 435202 - DNA, 25 bp, Rattus norvegicus
ggcaaattgctcagcattcgactta

SEQ ID NO: 435203 - DNA, 25 bp, Rattus norvegicus
ggcaaattgctcagcggctcgagat

SEQ ID NO: 435204 - DNA, 25 bp, Rattus norvegicus
ggcaaattgctctgcattcgactta

SEQ ID NO: 435205 - DNA, 25 bp, Rattus norvegicus
ggcaaattgctctgcggctcgagat

SEQ ID NO: 435206 - DNA, 25 bp, Rattus norvegicus
ggcaaatttctacccacacaaaggt

SEQ ID NO: 435207 - DNA, 25 bp, Rattus norvegicus
ggcaaatttctagccacacaaaggt

SEQ ID NO: 435208 - DNA, 25 bp, Rattus norvegicus
ggcaacaaacacataacatctggaa

SEQ ID NO: 435209 - DNA, 25 bp, Rattus norvegicus
ggcaacaaacacttaacatctggaa

SEQ ID NO: 435210 - DNA, 25 bp, Rattus norvegicus
ggcaacaaaggtccttgtgcttctt

SEQ ID NO: 435211 - DNA, 25 bp, Rattus norvegicus
ggcaacaaaggtgcttgtgcttctt

SEQ ID NO: 435212 - DNA, 25 bp, Rattus norvegicus
ggcaacaaattgcagtttctataga

SEQ ID NO: 435213 - DNA, 25 bp, Rattus norvegicus
ggcaacaaattggagtttctataga

SEQ ID NO: 435214 - DNA, 25 bp, Rattus norvegicus
ggcaacaaggatacgatctctctta

SEQ ID NO: 435215 - DNA, 25 bp, Rattus norvegicus
ggcaacaaggattcgatctctctta

SEQ ID NO: 435216 - DNA, 25 bp, Rattus norvegicus
ggcaacaagtgtcggtccttaggtc

SEQ ID NO: 435217 - DNA, 25 bp, Rattus norvegicus
ggcaacaagtgtgggtccttaggtc

SEQ ID NO: 435218 - DNA, 25 bp, Rattus norvegicus
ggcaacaatgacagaccaacagcgt

SEQ ID NO: 435219 - DNA, 25 bp, Rattus norvegicus
ggcaacaatgactgaccaacagcgt

SEQ ID NO: 435220 - DNA, 25 bp, Rattus norvegicus
ggcaacaccagcaaagcctttagtt

SEQ ID NO: 435221 - DNA, 25 bp, Rattus norvegicus
ggcaacaccagctaagcctttagtt

SEQ ID NO: 435222 - DNA, 25 bp, Rattus norvegicus
ggcaacactaccattttataaaaca

SEQ ID NO: 435223 - DNA, 25 bp, Rattus norvegicus
ggcaacactacctttttataaaaca

SEQ ID NO: 435224 - DNA, 25 bp, Rattus norvegicus
ggcaacactcaacacaacaggacga

SEQ ID NO: 435225 - DNA, 25 bp, Rattus norvegicus
ggcaacactcaagacaacaggacga

SEQ ID NO: 435226 - DNA, 25 bp, Rattus norvegicus
ggcaacactgcccattcaattgaat

SEQ ID NO: 435227 - DNA, 25 bp, Rattus norvegicus
ggcaacactgccgattcaattgaat

SEQ ID NO: 435228 - DNA, 25 bp, Rattus norvegicus
ggcaacactgtaaccattgagactg

SEQ ID NO: 435229 - DNA, 25 bp, Rattus norvegicus
ggcaacactgtatccattgagactg

SEQ ID NO: 435230 - DNA, 25 bp, Rattus norvegicus
ggcaacactgttacatgaaccgcgt

SEQ ID NO: 435231 - DNA, 25 bp, Rattus norvegicus
ggcaacactgtttcatgaaccgcgt

SEQ ID NO: 435232 - DNA, 25 bp, Rattus norvegicus
ggcaacagcattattcttcagttta

SEQ ID NO: 435233 - DNA, 25 bp, Rattus norvegicus
ggcaacagcatttttcttcagttta

SEQ ID NO: 435234 - DNA, 25 bp, Rattus norvegicus
ggcaacagcctgatgcctgtgacag

SEQ ID NO: 435235 - DNA, 25 bp, Rattus norvegicus
ggcaacagcctgttgcctgtgacag

SEQ ID NO: 435236 - DNA, 25 bp, Rattus norvegicus
ggcaacagggatcccctaacctgac

SEQ ID NO: 435237 - DNA, 25 bp, Rattus norvegicus
ggcaacagggatgccctaacctgac

SEQ ID NO: 435238 - DNA, 25 bp, Rattus norvegicus
ggcaacagtaagagacggtcaccct

SEQ ID NO: 435239 - DNA, 25 bp, Rattus norvegicus
ggcaacagtaagtgacggtcaccct

SEQ ID NO: 435240 - DNA, 25 bp, Rattus norvegicus
ggcaacagtctgcttcaattacact

SEQ ID NO: 435241 - DNA, 25 bp, Rattus norvegicus
ggcaacagtctggttcaattacact

SEQ ID NO: 435242 - DNA, 25 bp, Rattus norvegicus
ggcaacagtgcaagatgaggttccc

SEQ ID NO: 435243 - DNA, 25 bp, Rattus norvegicus
ggcaacagtgcatgatgaggttccc

SEQ ID NO: 435244 - DNA, 25 bp, Rattus norvegicus
ggcaacagttatacaccagaggaat

SEQ ID NO: 435245 - DNA, 25 bp, Rattus norvegicus
ggcaacagttattcaccagaggaat

SEQ ID NO: 435246 - DNA, 25 bp, Rattus norvegicus
ggcaacatatcaaccagctgacaaa

SEQ ID NO: 435247 - DNA, 25 bp, Rattus norvegicus
ggcaacatatcatccagctgacaaa

SEQ ID NO: 435248 - DNA, 25 bp, Rattus norvegicus
ggcaacatggccacggctggtaacg

SEQ ID NO: 435249 - DNA, 25 bp, Rattus norvegicus
ggcaacatggccactaagcatatct

SEQ ID NO: 435250 - DNA, 25 bp, Rattus norvegicus
ggcaacatggcctcggctggtaacg

SEQ ID NO: 435251 - DNA, 25 bp, Rattus norvegicus
ggcaacatggcctctaagcatatct

SEQ ID NO: 435252 - DNA, 25 bp, Rattus norvegicus
ggcaacatgtcccaaaccacaaagg

SEQ ID NO: 435253 - DNA, 25 bp, Rattus norvegicus
ggcaacatgtccgaaaccacaaagg

SEQ ID NO: 435254 - DNA, 25 bp, Rattus norvegicus
ggcaacatgttgctgattgtccttt

SEQ ID NO: 435255 - DNA, 25 bp, Rattus norvegicus
ggcaacatgttggtgattgtccttt

SEQ ID NO: 435256 - DNA, 25 bp, Rattus norvegicus
ggcaacatttgcctattcgaatgct

SEQ ID NO: 435257 - DNA, 25 bp, Rattus norvegicus
ggcaacatttgcgtattcgaatgct

SEQ ID NO: 435258 - DNA, 25 bp, Rattus norvegicus
ggcaacatttgtaaaacctctgtgg

SEQ ID NO: 435259 - DNA, 25 bp, Rattus norvegicus
ggcaacatttgttaaacctctgtgg

SEQ ID NO: 435260 - DNA, 25 bp, Rattus norvegicus
ggcaaccaagttctatcgcacgact

SEQ ID NO: 435261 - DNA, 25 bp, Rattus norvegicus
ggcaaccaagttgtatcgcacgact

SEQ ID NO: 435262 - DNA, 25 bp, Rattus norvegicus
ggcaaccactggcatagagtattga

SEQ ID NO: 435263 - DNA, 25 bp, Rattus norvegicus
ggcaaccactgggatagagtattga

SEQ ID NO: 435264 - DNA, 25 bp, Rattus norvegicus
ggcaaccagaatcagcatcctcatt

SEQ ID NO: 435265 - DNA, 25 bp, Rattus norvegicus
ggcaaccagaatgagcatcctcatt

SEQ ID NO: 435266 - DNA, 25 bp, Rattus norvegicus
ggcaaccagcgtcaacaagccctgg

SEQ ID NO: 435267 - DNA, 25 bp, Rattus norvegicus
ggcaaccagcgtgaacaagccctgg

SEQ ID NO: 435268 - DNA, 25 bp, Rattus norvegicus
ggcaaccatccactctttaaaaatc

SEQ ID NO: 435269 - DNA, 25 bp, Rattus norvegicus
ggcaaccatccagtctttaaaaatc

SEQ ID NO: 435270 - DNA, 25 bp, Rattus norvegicus
ggcaaccatgttacctgatttaatg

SEQ ID NO: 435271 - DNA, 25 bp, Rattus norvegicus
ggcaaccatgtttcctgatttaatg

SEQ ID NO: 435272 - DNA, 25 bp, Rattus norvegicus
ggcaacccaagaatctggcttctat

SEQ ID NO: 435273 - DNA, 25 bp, Rattus norvegicus
ggcaacccaagattctggcttctat

SEQ ID NO: 435274 - DNA, 25 bp, Rattus norvegicus
ggcaacccacttaggtcatcttcct

SEQ ID NO: 435275 - DNA, 25 bp, Rattus norvegicus
ggcaacccactttggtcatcttcct

SEQ ID NO: 435276 - DNA, 25 bp, Rattus norvegicus
ggcaacccatctctctaaaattttt

SEQ ID NO: 435277 - DNA, 25 bp, Rattus norvegicus
ggcaacccatctgtctaaaattttt

SEQ ID NO: 435278 - DNA, 25 bp, Rattus norvegicus
ggcaaccgacttagctctcttttga

SEQ ID NO: 435279 - DNA, 25 bp, Rattus norvegicus
ggcaaccgactttgctctcttttga

SEQ ID NO: 435280 - DNA, 25 bp, Rattus norvegicus
ggcaaccgaggcaagaacaaccgaa

SEQ ID NO: 435281 - DNA, 25 bp, Rattus norvegicus
ggcaaccgaggctagaacaaccgaa

SEQ ID NO: 435282 - DNA, 25 bp, Rattus norvegicus
ggcaaccgggccacttagagtagaa

SEQ ID NO: 435283 - DNA, 25 bp, Rattus norvegicus
ggcaaccgggcctcttagagtagaa

SEQ ID NO: 435284 - DNA, 25 bp, Rattus norvegicus
ggcaacctacatccagaggacgttc

SEQ ID NO: 435285 - DNA, 25 bp, Rattus norvegicus
ggcaacctacatgcagaggacgttc

SEQ ID NO: 435286 - DNA, 25 bp, Rattus norvegicus
ggcaacctacgtcccgtggattgaa

SEQ ID NO: 435287 - DNA, 25 bp, Rattus norvegicus
ggcaacctacgtgccgtggattgaa

SEQ ID NO: 435288 - DNA, 25 bp, Rattus norvegicus
ggcaacctatgccaggtcgcatgat

SEQ ID NO: 435289 - DNA, 25 bp, Rattus norvegicus
ggcaacctatgcgaggtcgcatgat

SEQ ID NO: 435290 - DNA, 25 bp, Rattus norvegicus
ggcaacctcaatcttctttgggaag

SEQ ID NO: 435291 - DNA, 25 bp, Rattus norvegicus
ggcaacctcaatgttctttgggaag

SEQ ID NO: 435292 - DNA, 25 bp, Rattus norvegicus
ggcaacctcactcttatcaagggct

SEQ ID NO: 435293 - DNA, 25 bp, Rattus norvegicus
ggcaacctcactgttatcaagggct

SEQ ID NO: 435294 - DNA, 25 bp, Rattus norvegicus
ggcaacctcaggctcagaaccagtg

SEQ ID NO: 435295 - DNA, 25 bp, Rattus norvegicus
ggcaacctcagggtcagaaccagtg

SEQ ID NO: 435296 - DNA, 25 bp, Rattus norvegicus
ggcaacctcgagatgctgatctgaa

SEQ ID NO: 435297 - DNA, 25 bp, Rattus norvegicus
ggcaacctcgagttgctgatctgaa

SEQ ID NO: 435298 - DNA, 25 bp, Rattus norvegicus
ggcaacctcgctacattgtgtatag

SEQ ID NO: 435299 - DNA, 25 bp, Rattus norvegicus
ggcaacctcgcttcattgtgtatag

SEQ ID NO: 435300 - DNA, 25 bp, Rattus norvegicus
ggcaacctcgtcagtttgactattg

SEQ ID NO: 435301 - DNA, 25 bp, Rattus norvegicus
ggcaacctcgtctgtttgactattg

SEQ ID NO: 435302 - DNA, 25 bp, Rattus norvegicus
ggcaacctctgcattttaactgaca

SEQ ID NO: 435303 - DNA, 25 bp, Rattus norvegicus
ggcaacctctgctttttaactgaca

SEQ ID NO: 435304 - DNA, 25 bp, Rattus norvegicus
ggcaacctggaaagtcggcctcctt

SEQ ID NO: 435305 - DNA, 25 bp, Rattus norvegicus
ggcaacctggaatgtcggcctcctt

SEQ ID NO: 435306 - DNA, 25 bp, Rattus norvegicus
ggcaacctggatctgcacatgcgga

SEQ ID NO: 435307 - DNA, 25 bp, Rattus norvegicus
ggcaacctggatgtgcacatgcgga

SEQ ID NO: 435308 - DNA, 25 bp, Rattus norvegicus
ggcaacctgtcgctttcctaaggca

SEQ ID NO: 435309 - DNA, 25 bp, Rattus norvegicus
ggcaacctgtcggtttcctaaggca

SEQ ID NO: 435310 - DNA, 25 bp, Rattus norvegicus
ggcaacctgttcattgggagaccag

SEQ ID NO: 435311 - DNA, 25 bp, Rattus norvegicus
ggcaacctgttctttgggagaccag

SEQ ID NO: 435312 - DNA, 25 bp, Rattus norvegicus
ggcaaccttcacatctataacagag

SEQ ID NO: 435313 - DNA, 25 bp, Rattus norvegicus
ggcaaccttcacttctataacagag

SEQ ID NO: 435314 - DNA, 25 bp, Rattus norvegicus
ggcaaccttcggcagacgtggacaa

SEQ ID NO: 435315 - DNA, 25 bp, Rattus norvegicus
ggcaaccttcgggagacgtggacaa

SEQ ID NO: 435316 - DNA, 25 bp, Rattus norvegicus
ggcaacgacgaccatccccaaagag

SEQ ID NO: 435317 - DNA, 25 bp, Rattus norvegicus
ggcaacgacgacgatccccaaagag

SEQ ID NO: 435318 - DNA, 25 bp, Rattus norvegicus
ggcaacgcctggaacccacgtcaag

SEQ ID NO: 435319 - DNA, 25 bp, Rattus norvegicus
ggcaacgcctggtacccacgtcaag

SEQ ID NO: 435320 - DNA, 25 bp, Rattus norvegicus
ggcaacgcctttctctttgtaacac

SEQ ID NO: 435321 - DNA, 25 bp, Rattus norvegicus
ggcaacgcctttgtctttgtaacac

SEQ ID NO: 435322 - DNA, 25 bp, Rattus norvegicus
ggcaacgcttacaactgtgttatcc

SEQ ID NO: 435323 - DNA, 25 bp, Rattus norvegicus
ggcaacgcttactactgtgttatcc

SEQ ID NO: 435324 - DNA, 25 bp, Rattus norvegicus
ggcaacggagcccattttgtttggt

SEQ ID NO: 435325 - DNA, 25 bp, Rattus norvegicus
ggcaacggagccgattttgtttggt

SEQ ID NO: 435326 - DNA, 25 bp, Rattus norvegicus
ggcaacggcaacaagttctactctg

SEQ ID NO: 435327 - DNA, 25 bp, Rattus norvegicus
ggcaacggcaactagttctactctg

SEQ ID NO: 435328 - DNA, 25 bp, Rattus norvegicus
ggcaacggccagaggactcaaccta

SEQ ID NO: 435329 - DNA, 25 bp, Rattus norvegicus
ggcaacggccagtggactcaaccta

SEQ ID NO: 435330 - DNA, 25 bp, Rattus norvegicus
ggcaacggtcctaaaaatcaagtca

SEQ ID NO: 435331 - DNA, 25 bp, Rattus norvegicus
ggcaacggtccttaaaatcaagtca

SEQ ID NO: 435332 - DNA, 25 bp, Rattus norvegicus
ggcaacggtcgcaaaatgaacagga

SEQ ID NO: 435333 - DNA, 25 bp, Rattus norvegicus
ggcaacggtcgctaaatgaacagga

SEQ ID NO: 435334 - DNA, 25 bp, Rattus norvegicus
ggcaacgtcgctaagacctcgagaa

SEQ ID NO: 435335 - DNA, 25 bp, Rattus norvegicus
ggcaacgtcgcttagacctcgagaa

SEQ ID NO: 435336 - DNA, 25 bp, Rattus norvegicus
ggcaacgtctgaaggctggcaagca

SEQ ID NO: 435337 - DNA, 25 bp, Rattus norvegicus
ggcaacgtctgatggctggcaagca

SEQ ID NO: 435338 - DNA, 25 bp, Rattus norvegicus
ggcaacgtgcaaagctcctgtagat

SEQ ID NO: 435339 - DNA, 25 bp, Rattus norvegicus
ggcaacgtgcaatgctcctgtagat

SEQ ID NO: 435340 - DNA, 25 bp, Rattus norvegicus
ggcaactaagacagattggacatct

SEQ ID NO: 435341 - DNA, 25 bp, Rattus norvegicus
ggcaactaagactgattggacatct

SEQ ID NO: 435342 - DNA, 25 bp, Rattus norvegicus
ggcaactactggacgctcgatcccg

SEQ ID NO: 435343 - DNA, 25 bp, Rattus norvegicus
ggcaactactggtcgctcgatcccg

SEQ ID NO: 435344 - DNA, 25 bp, Rattus norvegicus
ggcaactagaggaaatctgctatct

SEQ ID NO: 435345 - DNA, 25 bp, Rattus norvegicus
ggcaactagaggtaatctgctatct

SEQ ID NO: 435346 - DNA, 25 bp, Rattus norvegicus
ggcaactagcagaaactccaggctg

SEQ ID NO: 435347 - DNA, 25 bp, Rattus norvegicus
ggcaactagcagtaactccaggctg

SEQ ID NO: 435348 - DNA, 25 bp, Rattus norvegicus
ggcaactagtatcaggagtctccaa

SEQ ID NO: 435349 - DNA, 25 bp, Rattus norvegicus
ggcaactagtatgaggagtctccaa

SEQ ID NO: 435350 - DNA, 25 bp, Rattus norvegicus
ggcaactagttcatttatggaattt

SEQ ID NO: 435351 - DNA, 25 bp, Rattus norvegicus
ggcaactagttcttttatggaattt

SEQ ID NO: 435352 - DNA, 25 bp, Rattus norvegicus
ggcaactcagcaccggtgtctcaga

SEQ ID NO: 435353 - DNA, 25 bp, Rattus norvegicus
ggcaactcagcagcggtgtctcaga

SEQ ID NO: 435354 - DNA, 25 bp, Rattus norvegicus
ggcaactcgagcagaaatgcacaga

SEQ ID NO: 435355 - DNA, 25 bp, Rattus norvegicus
ggcaactcgagctgaaatgcacaga

SEQ ID NO: 435356 - DNA, 25 bp, Rattus norvegicus
ggcaactcgcctcattattcgatgt

SEQ ID NO: 435357 - DNA, 25 bp, Rattus norvegicus
ggcaactcgcctgattattcgatgt

SEQ ID NO: 435358 - DNA, 25 bp, Rattus norvegicus
ggcaactctggaatacaatcgcttt

SEQ ID NO: 435359 - DNA, 25 bp, Rattus norvegicus
ggcaactctggattacaatcgcttt

SEQ ID NO: 435360 - DNA, 25 bp, Rattus norvegicus
ggcaactctttgaagcctcatgcat

SEQ ID NO: 435361 - DNA, 25 bp, Rattus norvegicus
ggcaactctttgtagcctcatgcat

SEQ ID NO: 435362 - DNA, 25 bp, Rattus norvegicus
ggcaactgattgagaccctgttttt

SEQ ID NO: 435363 - DNA, 25 bp, Rattus norvegicus
ggcaactgattgtgaccctgttttt

SEQ ID NO: 435364 - DNA, 25 bp, Rattus norvegicus
ggcaactgcctaacatccatgtgga

SEQ ID NO: 435365 - DNA, 25 bp, Rattus norvegicus
ggcaactgcctatcatccatgtgga

SEQ ID NO: 435366 - DNA, 25 bp, Rattus norvegicus
ggcaactgctttattaaacccaagt

SEQ ID NO: 435367 - DNA, 25 bp, Rattus norvegicus
ggcaactgcttttttaaacccaagt

SEQ ID NO: 435368 - DNA, 25 bp, Rattus norvegicus
ggcaactgtgccaacgtgtaaaagc

SEQ ID NO: 435369 - DNA, 25 bp, Rattus norvegicus
ggcaactgtgcctacgtgtaaaagc

SEQ ID NO: 435370 - DNA, 25 bp, Rattus norvegicus
ggcaactgttcaagaattccttcaa

SEQ ID NO: 435371 - DNA, 25 bp, Rattus norvegicus
ggcaactgttcatgaattccttcaa

SEQ ID NO: 435372 - DNA, 25 bp, Rattus norvegicus
ggcaacttacaaaaactccgacttc

SEQ ID NO: 435373 - DNA, 25 bp, Rattus norvegicus
ggcaacttacaataactccgacttc

SEQ ID NO: 435374 - DNA, 25 bp, Rattus norvegicus
ggcaacttacatccttaaaactttt

SEQ ID NO: 435375 - DNA, 25 bp, Rattus norvegicus
ggcaacttacatgcttaaaactttt

SEQ ID NO: 435376 - DNA, 25 bp, Rattus norvegicus
ggcaacttagccattagattcttca

SEQ ID NO: 435377 - DNA, 25 bp, Rattus norvegicus
ggcaacttagcctttagattcttca

SEQ ID NO: 435378 - DNA, 25 bp, Rattus norvegicus
ggcaacttcgataacctacacattc

SEQ ID NO: 435379 - DNA, 25 bp, Rattus norvegicus
ggcaacttcgattacctacacattc

SEQ ID NO: 435380 - DNA, 25 bp, Rattus norvegicus
ggcaacttcgcgaaactggtccagc

SEQ ID NO: 435381 - DNA, 25 bp, Rattus norvegicus
ggcaacttcgcgtaactggtccagc

SEQ ID NO: 435382 - DNA, 25 bp, Rattus norvegicus
ggcaacttcgggaataaatggcaat

SEQ ID NO: 435383 - DNA, 25 bp, Rattus norvegicus
ggcaacttcgggtataaatggcaat

SEQ ID NO: 435384 - DNA, 25 bp, Rattus norvegicus
ggcaacttctggctctcactttaca

SEQ ID NO: 435385 - DNA, 25 bp, Rattus norvegicus
ggcaacttctgggtctcactttaca

SEQ ID NO: 435386 - DNA, 25 bp, Rattus norvegicus
ggcaacttcttcatcacaagggcag

SEQ ID NO: 435387 - DNA, 25 bp, Rattus norvegicus
ggcaacttcttcttcacaagggcag

SEQ ID NO: 435388 - DNA, 25 bp, Rattus norvegicus
ggcaacttgatgctgttctgtctcc

SEQ ID NO: 435389 - DNA, 25 bp, Rattus norvegicus
ggcaacttgatggtgttctgtctcc

SEQ ID NO: 435390 - DNA, 25 bp, Rattus norvegicus
ggcaacttgcatcccctctgaaaga

SEQ ID NO: 435391 - DNA, 25 bp, Rattus norvegicus
ggcaacttgcatgccctctgaaaga

SEQ ID NO: 435392 - DNA, 25 bp, Rattus norvegicus
ggcaacttgtatcggagcctgttca

SEQ ID NO: 435393 - DNA, 25 bp, Rattus norvegicus
ggcaacttgtatgggagcctgttca

SEQ ID NO: 435394 - DNA, 25 bp, Rattus norvegicus
ggcaactttctaatctcttcaggaa

SEQ ID NO: 435395 - DNA, 25 bp, Rattus norvegicus
ggcaactttctattctcttcaggaa

SEQ ID NO: 435396 - DNA, 25 bp, Rattus norvegicus
ggcaagaaaacaatcactcctccat

SEQ ID NO: 435397 - DNA, 25 bp, Rattus norvegicus
ggcaagaaaacattcactcctccat

SEQ ID NO: 435398 - DNA, 25 bp, Rattus norvegicus
ggcaagaaaacgctccaggaagtct

SEQ ID NO: 435399 - DNA, 25 bp, Rattus norvegicus
ggcaagaaaacggtccaggaagtct

SEQ ID NO: 435400 - DNA, 25 bp, Rattus norvegicus
ggcaagaaacctagtcaagactcat

SEQ ID NO: 435401 - DNA, 25 bp, Rattus norvegicus
ggcaagaaaccttgtcaagactcat

SEQ ID NO: 435402 - DNA, 25 bp, Rattus norvegicus
ggcaagaaagcccagacttcccagt

SEQ ID NO: 435403 - DNA, 25 bp, Rattus norvegicus
ggcaagaaagccgagacttcccagt

SEQ ID NO: 435404 - DNA, 25 bp, Rattus norvegicus
ggcaagaacaggaccccaaagcgaa

SEQ ID NO: 435405 - DNA, 25 bp, Rattus norvegicus
ggcaagaacaggtccccaaagcgaa

SEQ ID NO: 435406 - DNA, 25 bp, Rattus norvegicus
ggcaagaacctcaccaacattgtgg

SEQ ID NO: 435407 - DNA, 25 bp, Rattus norvegicus
ggcaagaacctctccaacattgtgg

SEQ ID NO: 435408 - DNA, 25 bp, Rattus norvegicus
ggcaagaaccttcggctacaatatg

SEQ ID NO: 435409 - DNA, 25 bp, Rattus norvegicus
ggcaagaaccttgggctacaatatg

SEQ ID NO: 435410 - DNA, 25 bp, Rattus norvegicus
ggcaagaagatccatgactctccca

SEQ ID NO: 435411 - DNA, 25 bp, Rattus norvegicus
ggcaagaagatcgatgactctccca

SEQ ID NO: 435412 - DNA, 25 bp, Rattus norvegicus
ggcaagaatatgacctactgactga

SEQ ID NO: 435413 - DNA, 25 bp, Rattus norvegicus
ggcaagaatatgtcctactgactga

SEQ ID NO: 435414 - DNA, 25 bp, Rattus norvegicus
ggcaagaatcctcccaagttctaca

SEQ ID NO: 435415 - DNA, 25 bp, Rattus norvegicus
ggcaagaatcctgccaagttctaca

SEQ ID NO: 435416 - DNA, 25 bp, Rattus norvegicus
ggcaagaatcttctaccatatgtaa

SEQ ID NO: 435417 - DNA, 25 bp, Rattus norvegicus
ggcaagaatcttgtaccatatgtaa

SEQ ID NO: 435418 - DNA, 25 bp, Rattus norvegicus
ggcaagaatgcactgatactctgaa

SEQ ID NO: 435419 - DNA, 25 bp, Rattus norvegicus
ggcaagaatgcagtgatactctgaa

SEQ ID NO: 435420 - DNA, 25 bp, Rattus norvegicus
ggcaagaatgtcaagccactgctca

SEQ ID NO: 435421 - DNA, 25 bp, Rattus norvegicus
ggcaagaatgtctagccactgctca

SEQ ID NO: 435422 - DNA, 25 bp, Rattus norvegicus
ggcaagaatttacgcgacctggccc

SEQ ID NO: 435423 - DNA, 25 bp, Rattus norvegicus
ggcaagaatttaggcgacctggccc

SEQ ID NO: 435424 - DNA, 25 bp, Rattus norvegicus
ggcaagacaccaacctgaaggcact

SEQ ID NO: 435425 - DNA, 25 bp, Rattus norvegicus
ggcaagacaccatcctgaaggcact

SEQ ID NO: 435426 - DNA, 25 bp, Rattus norvegicus
ggcaagaccatcaaaaaactgttac

SEQ ID NO: 435427 - DNA, 25 bp, Rattus norvegicus
ggcaagaccatccatatgtccgaat

SEQ ID NO: 435428 - DNA, 25 bp, Rattus norvegicus
ggcaagaccatcgatatgtccgaat

SEQ ID NO: 435429 - DNA, 25 bp, Rattus norvegicus
ggcaagaccatctaaaaactgttac

SEQ ID NO: 435430 - DNA, 25 bp, Rattus norvegicus
ggcaagacctaccaacagtgagatt

SEQ ID NO: 435431 - DNA, 25 bp, Rattus norvegicus
ggcaagacctacgaacagtgagatt

SEQ ID NO: 435432 - DNA, 25 bp, Rattus norvegicus
ggcaagacgtggagtggtttctcct

SEQ ID NO: 435433 - DNA, 25 bp, Rattus norvegicus
ggcaagacgtggtgtggtttctcct

SEQ ID NO: 435434 - DNA, 25 bp, Rattus norvegicus
ggcaagactgcactctgtacagatt

SEQ ID NO: 435435 - DNA, 25 bp, Rattus norvegicus
ggcaagactgcagtctgtacagatt

SEQ ID NO: 435436 - DNA, 25 bp, Rattus norvegicus
ggcaagactgccaggaccaagacaa

SEQ ID NO: 435437 - DNA, 25 bp, Rattus norvegicus
ggcaagactgcctggaccaagacaa

SEQ ID NO: 435438 - DNA, 25 bp, Rattus norvegicus
ggcaagacttggataacacctattt

SEQ ID NO: 435439 - DNA, 25 bp, Rattus norvegicus
ggcaagacttggttaacacctattt

SEQ ID NO: 435440 - DNA, 25 bp, Rattus norvegicus
ggcaagagaacacgccgtcatcagt

SEQ ID NO: 435441 - DNA, 25 bp, Rattus norvegicus
ggcaagagaacaggccgtcatcagt

SEQ ID NO: 435442 - DNA, 25 bp, Rattus norvegicus
ggcaagagagacaaagctaccccac

SEQ ID NO: 435443 - DNA, 25 bp, Rattus norvegicus
ggcaagagagactaagctaccccac

SEQ ID NO: 435444 - DNA, 25 bp, Rattus norvegicus
ggcaagagccccatggaacccgagt

SEQ ID NO: 435445 - DNA, 25 bp, Rattus norvegicus
ggcaagagccccttggaacccgagt

SEQ ID NO: 435446 - DNA, 25 bp, Rattus norvegicus
ggcaagaggactatgtatccctttt

SEQ ID NO: 435447 - DNA, 25 bp, Rattus norvegicus
ggcaagaggactttgtatccctttt

SEQ ID NO: 435448 - DNA, 25 bp, Rattus norvegicus
ggcaagaggcctacaaccgaggaat

SEQ ID NO: 435449 - DNA, 25 bp, Rattus norvegicus
ggcaagaggccttcaaccgaggaat

SEQ ID NO: 435450 - DNA, 25 bp, Rattus norvegicus
ggcaagagtgggatttcttcagtcc

SEQ ID NO: 435451 - DNA, 25 bp, Rattus norvegicus
ggcaagagtgggttttcttcagtcc

SEQ ID NO: 435452 - DNA, 25 bp, Rattus norvegicus
ggcaagagttcaccaaatttgtgtt

SEQ ID NO: 435453 - DNA, 25 bp, Rattus norvegicus
ggcaagagttcagcaaatttgtgtt

SEQ ID NO: 435454 - DNA, 25 bp, Rattus norvegicus
ggcaagataggaaggctgaactcaa

SEQ ID NO: 435455 - DNA, 25 bp, Rattus norvegicus
ggcaagataggatggctgaactcaa

SEQ ID NO: 435456 - DNA, 25 bp, Rattus norvegicus
ggcaagatcatcaagcccataggat

SEQ ID NO: 435457 - DNA, 25 bp, Rattus norvegicus
ggcaagatcatctagcccataggat

SEQ ID NO: 435458 - DNA, 25 bp, Rattus norvegicus
ggcaagatcccaccgacgaagaaat

SEQ ID NO: 435459 - DNA, 25 bp, Rattus norvegicus
ggcaagatcccagcgacgaagaaat

SEQ ID NO: 435460 - DNA, 25 bp, Rattus norvegicus
ggcaagatccttcttacgttgtcaa

SEQ ID NO: 435461 - DNA, 25 bp, Rattus norvegicus
ggcaagatccttgttacgttgtcaa

SEQ ID NO: 435462 - DNA, 25 bp, Rattus norvegicus
ggcaagatggaaagaccatgatcgt

SEQ ID NO: 435463 - DNA, 25 bp, Rattus norvegicus
ggcaagatggaatgaccatgatcgt

SEQ ID NO: 435464 - DNA, 25 bp, Rattus norvegicus
ggcaagattcagctttccgtgggct

SEQ ID NO: 435465 - DNA, 25 bp, Rattus norvegicus
ggcaagattcaggtttccgtgggct

SEQ ID NO: 435466 - DNA, 25 bp, Rattus norvegicus
ggcaagattcccaagctgaaacttt

SEQ ID NO: 435467 - DNA, 25 bp, Rattus norvegicus
ggcaagattccctagctgaaacttt

SEQ ID NO: 435468 - DNA, 25 bp, Rattus norvegicus
ggcaagatttgtatcagtatggctc

SEQ ID NO: 435469 - DNA, 25 bp, Rattus norvegicus
ggcaagatttgtttcagtatggctc

SEQ ID NO: 435470 - DNA, 25 bp, Rattus norvegicus
ggcaagcaatcgcaactgttctcta

SEQ ID NO: 435471 - DNA, 25 bp, Rattus norvegicus
ggcaagcaatcggaactgttctcta

SEQ ID NO: 435472 - DNA, 25 bp, Rattus norvegicus
ggcaagcacacccaagatcgcatca

SEQ ID NO: 435473 - DNA, 25 bp, Rattus norvegicus
ggcaagcacaccgaagatcgcatca

SEQ ID NO: 435474 - DNA, 25 bp, Rattus norvegicus
ggcaagcactgcatcttagacgtgt

SEQ ID NO: 435475 - DNA, 25 bp, Rattus norvegicus
ggcaagcactgcttcttagacgtgt

SEQ ID NO: 435476 - DNA, 25 bp, Rattus norvegicus
ggcaagcagtagacctgggatcaca

SEQ ID NO: 435477 - DNA, 25 bp, Rattus norvegicus
ggcaagcagtagtcctgggatcaca

SEQ ID NO: 435478 - DNA, 25 bp, Rattus norvegicus
ggcaagcattctaccaactgagctg

SEQ ID NO: 435479 - DNA, 25 bp, Rattus norvegicus
ggcaagcattcttccaactgagctg

SEQ ID NO: 435480 - DNA, 25 bp, Rattus norvegicus
ggcaagcattgaattcatatgaacg

SEQ ID NO: 435481 - DNA, 25 bp, Rattus norvegicus
ggcaagcattgatttcatatgaacg

SEQ ID NO: 435482 - DNA, 25 bp, Rattus norvegicus
ggcaagccaacacatttcaaaacga

SEQ ID NO: 435483 - DNA, 25 bp, Rattus norvegicus
ggcaagccaacagatttcaaaacga

SEQ ID NO: 435484 - DNA, 25 bp, Rattus norvegicus
ggcaagcccagaatgagacactcta

SEQ ID NO: 435485 - DNA, 25 bp, Rattus norvegicus
ggcaagcccagattgagacactcta

SEQ ID NO: 435486 - DNA, 25 bp, Rattus norvegicus
ggcaagccgcttaacagaggacttt

SEQ ID NO: 435487 - DNA, 25 bp, Rattus norvegicus
ggcaagccgctttacagaggacttt

SEQ ID NO: 435488 - DNA, 25 bp, Rattus norvegicus
ggcaagcctcatatcaaacagttta

SEQ ID NO: 435489 - DNA, 25 bp, Rattus norvegicus
ggcaagcctcatttcaaacagttta

SEQ ID NO: 435490 - DNA, 25 bp, Rattus norvegicus
ggcaagcctctaaatttgattcaaa

SEQ ID NO: 435491 - DNA, 25 bp, Rattus norvegicus
ggcaagcctctatatttgattcaaa

SEQ ID NO: 435492 - DNA, 25 bp, Rattus norvegicus
ggcaagccttgtaccagcaggagat

SEQ ID NO: 435493 - DNA, 25 bp, Rattus norvegicus
ggcaagccttgttccagcaggagat

SEQ ID NO: 435494 - DNA, 25 bp, Rattus norvegicus
ggcaagcgagagagggctcctacct

SEQ ID NO: 435495 - DNA, 25 bp, Rattus norvegicus
ggcaagcgagagtgggctcctacct

SEQ ID NO: 435496 - DNA, 25 bp, Rattus norvegicus
ggcaagcggagtcccaagttcctgt

SEQ ID NO: 435497 - DNA, 25 bp, Rattus norvegicus
ggcaagcggagtgccaagttcctgt

SEQ ID NO: 435498 - DNA, 25 bp, Rattus norvegicus
ggcaagcgttggatctacatctaga

SEQ ID NO: 435499 - DNA, 25 bp, Rattus norvegicus
ggcaagcgttggttctacatctaga

SEQ ID NO: 435500 - DNA, 25 bp, Rattus norvegicus
ggcaagctaacaaaccctgagaccc

SEQ ID NO: 435501 - DNA, 25 bp, Rattus norvegicus
ggcaagctaacataccctgagaccc

SEQ ID NO: 435502 - DNA, 25 bp, Rattus norvegicus
ggcaagctctcactgtacaggcaac

SEQ ID NO: 435503 - DNA, 25 bp, Rattus norvegicus
ggcaagctctcagtgtacaggcaac

SEQ ID NO: 435504 - DNA, 25 bp, Rattus norvegicus
ggcaagctgaccctaattctcgttt

SEQ ID NO: 435505 - DNA, 25 bp, Rattus norvegicus
ggcaagctgaccgtaattctcgttt

SEQ ID NO: 435506 - DNA, 25 bp, Rattus norvegicus
ggcaagctgccaaggtgaaggtcaa

SEQ ID NO: 435507 - DNA, 25 bp, Rattus norvegicus
ggcaagctgccatggtgaaggtcaa

SEQ ID NO: 435508 - DNA, 25 bp, Rattus norvegicus
ggcaagcttattactgagtggcagt

SEQ ID NO: 435509 - DNA, 25 bp, Rattus norvegicus
ggcaagcttatttctgagtggcagt

SEQ ID NO: 435510 - DNA, 25 bp, Rattus norvegicus
ggcaagcttgcactgggtccagtat

SEQ ID NO: 435511 - DNA, 25 bp, Rattus norvegicus
ggcaagcttgcagtgggtccagtat

SEQ ID NO: 435512 - DNA, 25 bp, Rattus norvegicus
ggcaagcttgctcggaaatgcgatc

SEQ ID NO: 435513 - DNA, 25 bp, Rattus norvegicus
ggcaagcttgctgggaaatgcgatc

SEQ ID NO: 435514 - DNA, 25 bp, Rattus norvegicus
ggcaagcttttcctgggaggtctca

SEQ ID NO: 435515 - DNA, 25 bp, Rattus norvegicus
ggcaagcttttcgtgggaggtctca

SEQ ID NO: 435516 - DNA, 25 bp, Rattus norvegicus
ggcaaggaacgtacatacatttgtt

SEQ ID NO: 435517 - DNA, 25 bp, Rattus norvegicus
ggcaaggaacgttcatacatttgtt

SEQ ID NO: 435518 - DNA, 25 bp, Rattus norvegicus
ggcaaggaagccaacgtcacaccaa

SEQ ID NO: 435519 - DNA, 25 bp, Rattus norvegicus
ggcaaggaagcctacgtcacaccaa

SEQ ID NO: 435520 - DNA, 25 bp, Rattus norvegicus
ggcaaggaccgcagcttacatgagt

SEQ ID NO: 435521 - DNA, 25 bp, Rattus norvegicus
ggcaaggaccgctgcttacatgagt

SEQ ID NO: 435522 - DNA, 25 bp, Rattus norvegicus
ggcaaggactaaccaaacatctggt

SEQ ID NO: 435523 - DNA, 25 bp, Rattus norvegicus
ggcaaggactaagcaaacatctggt

SEQ ID NO: 435524 - DNA, 25 bp, Rattus norvegicus
ggcaaggatggaactctttctcttc

SEQ ID NO: 435525 - DNA, 25 bp, Rattus norvegicus
ggcaaggatggatctctttctcttc

SEQ ID NO: 435526 - DNA, 25 bp, Rattus norvegicus
ggcaaggcaagtcagctgttttatt

SEQ ID NO: 435527 - DNA, 25 bp, Rattus norvegicus
ggcaaggcaagtgagctgttttatt

SEQ ID NO: 435528 - DNA, 25 bp, Rattus norvegicus
ggcaaggcagccagtgttaaaaatt

SEQ ID NO: 435529 - DNA, 25 bp, Rattus norvegicus
ggcaaggcagcctgtgttaaaaatt

SEQ ID NO: 435530 - DNA, 25 bp, Rattus norvegicus
ggcaaggcattaaacccatcaggca

SEQ ID NO: 435531 - DNA, 25 bp, Rattus norvegicus
ggcaaggcattatacccatcaggca

SEQ ID NO: 435532 - DNA, 25 bp, Rattus norvegicus
ggcaaggccaagacaatcatcctca

SEQ ID NO: 435533 - DNA, 25 bp, Rattus norvegicus
ggcaaggccaagagtttacatcaga

SEQ ID NO: 435534 - DNA, 25 bp, Rattus norvegicus
ggcaaggccaagtcaatcatcctca

SEQ ID NO: 435535 - DNA, 25 bp, Rattus norvegicus
ggcaaggccaagtgtttacatcaga

SEQ ID NO: 435536 - DNA, 25 bp, Rattus norvegicus
ggcaaggccgttagcttattgcaga

SEQ ID NO: 435537 - DNA, 25 bp, Rattus norvegicus
ggcaaggccgtttgcttattgcaga

SEQ ID NO: 435538 - DNA, 25 bp, Rattus norvegicus
ggcaaggcctcaaagcagccaccaa

SEQ ID NO: 435539 - DNA, 25 bp, Rattus norvegicus
ggcaaggcctcatagcagccaccaa

SEQ ID NO: 435540 - DNA, 25 bp, Rattus norvegicus
ggcaaggcctcgaacagtttattaa

SEQ ID NO: 435541 - DNA, 25 bp, Rattus norvegicus
ggcaaggcctcgtacagtttattaa

SEQ ID NO: 435542 - DNA, 25 bp, Rattus norvegicus
ggcaaggccttcagtcagacatctc

SEQ ID NO: 435543 - DNA, 25 bp, Rattus norvegicus
ggcaaggccttctgtcagacatctc

SEQ ID NO: 435544 - DNA, 25 bp, Rattus norvegicus
ggcaaggctagcattcccagaacag

SEQ ID NO: 435545 - DNA, 25 bp, Rattus norvegicus
ggcaaggctagctttcccagaacag

SEQ ID NO: 435546 - DNA, 25 bp, Rattus norvegicus
ggcaaggctaggacaccctgatctc

SEQ ID NO: 435547 - DNA, 25 bp, Rattus norvegicus
ggcaaggctaggtcaccctgatctc

SEQ ID NO: 435548 - DNA, 25 bp, Rattus norvegicus
ggcaaggctctgaatcgttgttcat

SEQ ID NO: 435549 - DNA, 25 bp, Rattus norvegicus
ggcaaggctctgtatcgttgttcat

SEQ ID NO: 435550 - DNA, 25 bp, Rattus norvegicus
ggcaaggctgtgcttaaatccccat

SEQ ID NO: 435551 - DNA, 25 bp, Rattus norvegicus
ggcaaggctgtggttaaatccccat

SEQ ID NO: 435552 - DNA, 25 bp, Rattus norvegicus
ggcaagggacccagtcatgactgac

SEQ ID NO: 435553 - DNA, 25 bp, Rattus norvegicus
ggcaagggaccctgtcatgactgac

SEQ ID NO: 435554 - DNA, 25 bp, Rattus norvegicus
ggcaagggcttaatgttcctgacaa

SEQ ID NO: 435555 - DNA, 25 bp, Rattus norvegicus
ggcaagggcttattgttcctgacaa

SEQ ID NO: 435556 - DNA, 25 bp, Rattus norvegicus
ggcaagggcttcatggacctgaacc

SEQ ID NO: 435557 - DNA, 25 bp, Rattus norvegicus
ggcaagggcttcttggacctgaacc

SEQ ID NO: 435558 - DNA, 25 bp, Rattus norvegicus
ggcaagggtagacatgccccctttc

SEQ ID NO: 435559 - DNA, 25 bp, Rattus norvegicus
ggcaagggtagagatgccccctttc

SEQ ID NO: 435560 - DNA, 25 bp, Rattus norvegicus
ggcaaggtagtgaccctgtactcgg

SEQ ID NO: 435561 - DNA, 25 bp, Rattus norvegicus
ggcaaggtagtgtccctgtactcgg

SEQ ID NO: 435562 - DNA, 25 bp, Rattus norvegicus
ggcaaggtctgactctctgatcacc

SEQ ID NO: 435563 - DNA, 25 bp, Rattus norvegicus
ggcaaggtctgagtctctgatcacc

SEQ ID NO: 435564 - DNA, 25 bp, Rattus norvegicus
ggcaaggtgccaacaagtgggtttt

SEQ ID NO: 435565 - DNA, 25 bp, Rattus norvegicus
ggcaaggtgccatcaagtgggtttt

SEQ ID NO: 435566 - DNA, 25 bp, Rattus norvegicus
ggcaaggtggaactctagcccttct

SEQ ID NO: 435567 - DNA, 25 bp, Rattus norvegicus
ggcaaggtggaagtctagcccttct

SEQ ID NO: 435568 - DNA, 25 bp, Rattus norvegicus
ggcaaggttcagatgctggtcccaa

SEQ ID NO: 435569 - DNA, 25 bp, Rattus norvegicus
ggcaaggttcagttgctggtcccaa

SEQ ID NO: 435570 - DNA, 25 bp, Rattus norvegicus
ggcaagtaacccagctacctttaag

SEQ ID NO: 435571 - DNA, 25 bp, Rattus norvegicus
ggcaagtaaccctgctacctttaag

SEQ ID NO: 435572 - DNA, 25 bp, Rattus norvegicus
ggcaagtaacttataccctgctaag

SEQ ID NO: 435573 - DNA, 25 bp, Rattus norvegicus
ggcaagtaacttttaccctgctaag

SEQ ID NO: 435574 - DNA, 25 bp, Rattus norvegicus
ggcaagtactgcagattctctcaat

SEQ ID NO: 435575 - DNA, 25 bp, Rattus norvegicus
ggcaagtactgctgattctctcaat

SEQ ID NO: 435576 - DNA, 25 bp, Rattus norvegicus
ggcaagtataaactccaacaccaac

SEQ ID NO: 435577 - DNA, 25 bp, Rattus norvegicus
ggcaagtataaagtccaacaccaac

SEQ ID NO: 435578 - DNA, 25 bp, Rattus norvegicus
ggcaagtatacaacaaagtaggtgt

SEQ ID NO: 435579 - DNA, 25 bp, Rattus norvegicus
ggcaagtatacatcaaagtaggtgt

SEQ ID NO: 435580 - DNA, 25 bp, Rattus norvegicus
ggcaagtatatcagtgcattctttt

SEQ ID NO: 435581 - DNA, 25 bp, Rattus norvegicus
ggcaagtatatctgtgcattctttt

SEQ ID NO: 435582 - DNA, 25 bp, Rattus norvegicus
ggcaagtccacaccagggcaccatt

SEQ ID NO: 435583 - DNA, 25 bp, Rattus norvegicus
ggcaagtccacagcagggcaccatt

SEQ ID NO: 435584 - DNA, 25 bp, Rattus norvegicus
ggcaagtcctttacttccttagaag

SEQ ID NO: 435585 - DNA, 25 bp, Rattus norvegicus
ggcaagtccttttcttccttagaag

SEQ ID NO: 435586 - DNA, 25 bp, Rattus norvegicus
ggcaagtctatgagtctttagccta

SEQ ID NO: 435587 - DNA, 25 bp, Rattus norvegicus
ggcaagtctatgtgtctttagccta

SEQ ID NO: 435588 - DNA, 25 bp, Rattus norvegicus
ggcaagtctcctccagtaaccacag

SEQ ID NO: 435589 - DNA, 25 bp, Rattus norvegicus
ggcaagtctcctgcagtaaccacag

SEQ ID NO: 435590 - DNA, 25 bp, Rattus norvegicus
ggcaagtctgtgcaaccattttgtt

SEQ ID NO: 435591 - DNA, 25 bp, Rattus norvegicus
ggcaagtctgtggaaccattttgtt

SEQ ID NO: 435592 - DNA, 25 bp, Rattus norvegicus
ggcaagtcttgcaacttttgctaag

SEQ ID NO: 435593 - DNA, 25 bp, Rattus norvegicus
ggcaagtcttgctacttttgctaag

SEQ ID NO: 435594 - DNA, 25 bp, Rattus norvegicus
ggcaagtgccctcattatccctaga

SEQ ID NO: 435595 - DNA, 25 bp, Rattus norvegicus
ggcaagtgccctgattatccctaga

SEQ ID NO: 435596 - DNA, 25 bp, Rattus norvegicus
ggcaagtgctggaacacctgctgaa

SEQ ID NO: 435597 - DNA, 25 bp, Rattus norvegicus
ggcaagtgctggtacacctgctgaa

SEQ ID NO: 435598 - DNA, 25 bp, Rattus norvegicus
ggcaagtgtcatcgaacctggcatg

SEQ ID NO: 435599 - DNA, 25 bp, Rattus norvegicus
ggcaagtgtcatggaacctggcatg

SEQ ID NO: 435600 - DNA, 25 bp, Rattus norvegicus
ggcaagtgttgcaaatagatctcag

SEQ ID NO: 435601 - DNA, 25 bp, Rattus norvegicus
ggcaagtgttgctaatagatctcag

SEQ ID NO: 435602 - DNA, 25 bp, Rattus norvegicus
ggcaagttacttaactgtgggcctt

SEQ ID NO: 435603 - DNA, 25 bp, Rattus norvegicus
ggcaagttactttactgtgggcctt

SEQ ID NO: 435604 - DNA, 25 bp, Rattus norvegicus
ggcaagttcaacacacaggaggtat

SEQ ID NO: 435605 - DNA, 25 bp, Rattus norvegicus
ggcaagttcaactcacaggaggtat

SEQ ID NO: 435606 - DNA, 25 bp, Rattus norvegicus
ggcaagttcagcctatttatgtgaa

SEQ ID NO: 435607 - DNA, 25 bp, Rattus norvegicus
ggcaagttcagcgtatttatgtgaa

SEQ ID NO: 435608 - DNA, 25 bp, Rattus norvegicus
ggcaagttctcacttggacaccatc

SEQ ID NO: 435609 - DNA, 25 bp, Rattus norvegicus
ggcaagttctcagttggacaccatc

SEQ ID NO: 435610 - DNA, 25 bp, Rattus norvegicus
ggcaagttgagcatctgtagtttta

SEQ ID NO: 435611 - DNA, 25 bp, Rattus norvegicus
ggcaagttgagcttctgtagtttta

SEQ ID NO: 435612 - DNA, 25 bp, Rattus norvegicus
ggcaagttgaggaactttctcccaa

SEQ ID NO: 435613 - DNA, 25 bp, Rattus norvegicus
ggcaagttgaggtactttctcccaa

SEQ ID NO: 435614 - DNA, 25 bp, Rattus norvegicus
ggcaagtttactctcctggtgttga

SEQ ID NO: 435615 - DNA, 25 bp, Rattus norvegicus
ggcaagtttactgtcctggtgttga

SEQ ID NO: 435616 - DNA, 25 bp, Rattus norvegicus
ggcaagtttgtgaccgccaagaaaa

SEQ ID NO: 435617 - DNA, 25 bp, Rattus norvegicus
ggcaagtttgtgtccgccaagaaaa

SEQ ID NO: 435618 - DNA, 25 bp, Rattus norvegicus
ggcaataaccgccagttccagctgt

SEQ ID NO: 435619 - DNA, 25 bp, Rattus norvegicus
ggcaataaccgcgagttccagctgt

SEQ ID NO: 435620 - DNA, 25 bp, Rattus norvegicus
ggcaatacaagcatccatgttggtt

SEQ ID NO: 435621 - DNA, 25 bp, Rattus norvegicus
ggcaatacaagcttccatgttggtt

SEQ ID NO: 435622 - DNA, 25 bp, Rattus norvegicus
ggcaatacacaacaccagctgtttt

SEQ ID NO: 435623 - DNA, 25 bp, Rattus norvegicus
ggcaatacacaagaccagctgtttt

SEQ ID NO: 435624 - DNA, 25 bp, Rattus norvegicus
ggcaatacttctatgtcaacaggca

SEQ ID NO: 435625 - DNA, 25 bp, Rattus norvegicus
ggcaatacttctttgtcaacaggca

SEQ ID NO: 435626 - DNA, 25 bp, Rattus norvegicus
ggcaatagaaacatcccctgtggaa

SEQ ID NO: 435627 - DNA, 25 bp, Rattus norvegicus
ggcaatagaaacttcccctgtggaa

SEQ ID NO: 435628 - DNA, 25 bp, Rattus norvegicus
ggcaatagagcactcatcctgtatt

SEQ ID NO: 435629 - DNA, 25 bp, Rattus norvegicus
ggcaatagagcagtcatcctgtatt

SEQ ID NO: 435630 - DNA, 25 bp, Rattus norvegicus
ggcaatagcatgctttatagatcat

SEQ ID NO: 435631 - DNA, 25 bp, Rattus norvegicus
ggcaatagcatggtttatagatcat

SEQ ID NO: 435632 - DNA, 25 bp, Rattus norvegicus
ggcaatagccccagagtcccagaat

SEQ ID NO: 435633 - DNA, 25 bp, Rattus norvegicus
ggcaatagcccctgagtcccagaat

SEQ ID NO: 435634 - DNA, 25 bp, Rattus norvegicus
ggcaatataatgagccttgtttcaa

SEQ ID NO: 435635 - DNA, 25 bp, Rattus norvegicus
ggcaatataatgtgccttgtttcaa

SEQ ID NO: 435636 - DNA, 25 bp, Rattus norvegicus
ggcaatatgagacttcacatctttg

SEQ ID NO: 435637 - DNA, 25 bp, Rattus norvegicus
ggcaatatgagagttcacatctttg

SEQ ID NO: 435638 - DNA, 25 bp, Rattus norvegicus
ggcaatatggaacaaatgtctagtg

SEQ ID NO: 435639 - DNA, 25 bp, Rattus norvegicus
ggcaatatggaagaaatgtctagtg

SEQ ID NO: 435640 - DNA, 25 bp, Rattus norvegicus
ggcaatattcaaattgtcttgtcaa

SEQ ID NO: 435641 - DNA, 25 bp, Rattus norvegicus
ggcaatattcaatttgtcttgtcaa

SEQ ID NO: 435642 - DNA, 25 bp, Rattus norvegicus
ggcaatcaatggaactgtggccttc

SEQ ID NO: 435643 - DNA, 25 bp, Rattus norvegicus
ggcaatcaatggtactgtggccttc

SEQ ID NO: 435644 - DNA, 25 bp, Rattus norvegicus
ggcaatcaattgcaccttaatgtaa

SEQ ID NO: 435645 - DNA, 25 bp, Rattus norvegicus
ggcaatcaattggaccttaatgtaa

SEQ ID NO: 435646 - DNA, 25 bp, Rattus norvegicus
ggcaatcaccgaatcaccagtattt

SEQ ID NO: 435647 - DNA, 25 bp, Rattus norvegicus
ggcaatcaccgattcaccagtattt

SEQ ID NO: 435648 - DNA, 25 bp, Rattus norvegicus
ggcaatcactaaactcttttcactg

SEQ ID NO: 435649 - DNA, 25 bp, Rattus norvegicus
ggcaatcactaatctcttttcactg

SEQ ID NO: 435650 - DNA, 25 bp, Rattus norvegicus
ggcaatcactatcacgcaactacag

SEQ ID NO: 435651 - DNA, 25 bp, Rattus norvegicus
ggcaatcactatgacgcaactacag

SEQ ID NO: 435652 - DNA, 25 bp, Rattus norvegicus
ggcaatcagtaccttccatagctac

SEQ ID NO: 435653 - DNA, 25 bp, Rattus norvegicus
ggcaatcagtacgttccatagctac

SEQ ID NO: 435654 - DNA, 25 bp, Rattus norvegicus
ggcaatccaggaacacactagacac

SEQ ID NO: 435655 - DNA, 25 bp, Rattus norvegicus
ggcaatccaggatcacactagacac

SEQ ID NO: 435656 - DNA, 25 bp, Rattus norvegicus
ggcaatccagtaaggcttccttaat

SEQ ID NO: 435657 - DNA, 25 bp, Rattus norvegicus
ggcaatccagtatggcttccttaat

SEQ ID NO: 435658 - DNA, 25 bp, Rattus norvegicus
ggcaatcccaccaaaagtagtcctg

SEQ ID NO: 435659 - DNA, 25 bp, Rattus norvegicus
ggcaatcccacctaaagtagtcctg

SEQ ID NO: 435660 - DNA, 25 bp, Rattus norvegicus
ggcaatccccagaaggctcaatctg

SEQ ID NO: 435661 - DNA, 25 bp, Rattus norvegicus
ggcaatccccagtaggctcaatctg

SEQ ID NO: 435662 - DNA, 25 bp, Rattus norvegicus
ggcaatccgattcctctgggaaagc

SEQ ID NO: 435663 - DNA, 25 bp, Rattus norvegicus
ggcaatccgattgctctgggaaagc

SEQ ID NO: 435664 - DNA, 25 bp, Rattus norvegicus
ggcaatccgtctcactttattttct

SEQ ID NO: 435665 - DNA, 25 bp, Rattus norvegicus
ggcaatccgtctgactttattttct

SEQ ID NO: 435666 - DNA, 25 bp, Rattus norvegicus
ggcaatcctgcgacggcctaggaag

SEQ ID NO: 435667 - DNA, 25 bp, Rattus norvegicus
ggcaatcctgcgtcggcctaggaag

SEQ ID NO: 435668 - DNA, 25 bp, Rattus norvegicus
ggcaatcctgtaaatgtggaatcct

SEQ ID NO: 435669 - DNA, 25 bp, Rattus norvegicus
ggcaatcctgtatatgtggaatcct

SEQ ID NO: 435670 - DNA, 25 bp, Rattus norvegicus
ggcaatcgcttccaagagttcccgc

SEQ ID NO: 435671 - DNA, 25 bp, Rattus norvegicus
ggcaatcgcttcgaagagttcccgc

SEQ ID NO: 435672 - DNA, 25 bp, Rattus norvegicus
ggcaatcggtgcacttctactagat

SEQ ID NO: 435673 - DNA, 25 bp, Rattus norvegicus
ggcaatcggtgctcttctactagat

SEQ ID NO: 435674 - DNA, 25 bp, Rattus norvegicus
ggcaatctagctccattaagggcaa

SEQ ID NO: 435675 - DNA, 25 bp, Rattus norvegicus
ggcaatctagctgcattaagggcaa

SEQ ID NO: 435676 - DNA, 25 bp, Rattus norvegicus
ggcaatctgtacaagtcttctgtct

SEQ ID NO: 435677 - DNA, 25 bp, Rattus norvegicus
ggcaatctgtactagtcttctgtct

SEQ ID NO: 435678 - DNA, 25 bp, Rattus norvegicus
ggcaatcttactctgtagggctata

SEQ ID NO: 435679 - DNA, 25 bp, Rattus norvegicus
ggcaatcttactgtgtagggctata

SEQ ID NO: 435680 - DNA, 25 bp, Rattus norvegicus
ggcaatcttgcgcaagtgatcattt

SEQ ID NO: 435681 - DNA, 25 bp, Rattus norvegicus
ggcaatcttgcggaagtgatcattt

SEQ ID NO: 435682 - DNA, 25 bp, Rattus norvegicus
ggcaatcttttcaattggtttccca

SEQ ID NO: 435683 - DNA, 25 bp, Rattus norvegicus
ggcaatcttttctattggtttccca

SEQ ID NO: 435684 - DNA, 25 bp, Rattus norvegicus
ggcaatctttttccattgtgacaga

SEQ ID NO: 435685 - DNA, 25 bp, Rattus norvegicus
ggcaatctttttgcattgtgacaga

SEQ ID NO: 435686 - DNA, 25 bp, Rattus norvegicus
ggcaatgaaagccatcactgatgtt

SEQ ID NO: 435687 - DNA, 25 bp, Rattus norvegicus
ggcaatgaaagcgatcactgatgtt

SEQ ID NO: 435688 - DNA, 25 bp, Rattus norvegicus
ggcaatgaacctcgtctttctgaaa

SEQ ID NO: 435689 - DNA, 25 bp, Rattus norvegicus
ggcaatgaacctggtctttctgaaa

SEQ ID NO: 435690 - DNA, 25 bp, Rattus norvegicus
ggcaatgacatcatccacaagttct

SEQ ID NO: 435691 - DNA, 25 bp, Rattus norvegicus
ggcaatgacatcttccacaagttct

SEQ ID NO: 435692 - DNA, 25 bp, Rattus norvegicus
ggcaatgacctgatcgatgtctgaa

SEQ ID NO: 435693 - DNA, 25 bp, Rattus norvegicus
ggcaatgacctgttcgatgtctgaa

SEQ ID NO: 435694 - DNA, 25 bp, Rattus norvegicus
ggcaatgactaaccaaccaaaccag

SEQ ID NO: 435695 - DNA, 25 bp, Rattus norvegicus
ggcaatgactaagcaaccaaaccag

SEQ ID NO: 435696 - DNA, 25 bp, Rattus norvegicus
ggcaatgagactatcagaggcatct

SEQ ID NO: 435697 - DNA, 25 bp, Rattus norvegicus
ggcaatgagactttcagaggcatct

SEQ ID NO: 435698 - DNA, 25 bp, Rattus norvegicus
ggcaatgattttctggaatcactca

SEQ ID NO: 435699 - DNA, 25 bp, Rattus norvegicus
ggcaatgattttgtggaatcactca

SEQ ID NO: 435700 - DNA, 25 bp, Rattus norvegicus
ggcaatgcagtgagctctgtctgta

SEQ ID NO: 435701 - DNA, 25 bp, Rattus norvegicus
ggcaatgcagtgtgctctgtctgta

SEQ ID NO: 435702 - DNA, 25 bp, Rattus norvegicus
ggcaatgccatcaaacaggttacta

SEQ ID NO: 435703 - DNA, 25 bp, Rattus norvegicus
ggcaatgccatctaacaggttacta

SEQ ID NO: 435704 - DNA, 25 bp, Rattus norvegicus
ggcaatgcggctccactggtggaag

SEQ ID NO: 435705 - DNA, 25 bp, Rattus norvegicus
ggcaatgcggctgcactggtggaag

SEQ ID NO: 435706 - DNA, 25 bp, Rattus norvegicus
ggcaatgctaaacaccaggacggaa

SEQ ID NO: 435707 - DNA, 25 bp, Rattus norvegicus
ggcaatgctaaagaccaggacggaa

SEQ ID NO: 435708 - DNA, 25 bp, Rattus norvegicus
ggcaatgctactcactaggacttct

SEQ ID NO: 435709 - DNA, 25 bp, Rattus norvegicus
ggcaatgctactgactaggacttct

SEQ ID NO: 435710 - DNA, 25 bp, Rattus norvegicus
ggcaatgctctacaactaagtccag

SEQ ID NO: 435711 - DNA, 25 bp, Rattus norvegicus
ggcaatgctctagaactaagtccag

SEQ ID NO: 435712 - DNA, 25 bp, Rattus norvegicus
ggcaatgctctcagtttttggtggc

SEQ ID NO: 435713 - DNA, 25 bp, Rattus norvegicus
ggcaatgctctctgtttttggtggc

SEQ ID NO: 435714 - DNA, 25 bp, Rattus norvegicus
ggcaatggactcactggccaacctg

SEQ ID NO: 435715 - DNA, 25 bp, Rattus norvegicus
ggcaatggactctctggccaacctg

SEQ ID NO: 435716 - DNA, 25 bp, Rattus norvegicus
ggcaatggagcccagcataccaaca

SEQ ID NO: 435717 - DNA, 25 bp, Rattus norvegicus
ggcaatggagccgagcataccaaca

SEQ ID NO: 435718 - DNA, 25 bp, Rattus norvegicus
ggcaatggatttacagcacaaacct

SEQ ID NO: 435719 - DNA, 25 bp, Rattus norvegicus
ggcaatggattttcagcacaaacct

SEQ ID NO: 435720 - DNA, 25 bp, Rattus norvegicus
ggcaatggcaaaactcgagactgga

SEQ ID NO: 435721 - DNA, 25 bp, Rattus norvegicus
ggcaatggcaaacctccaggctagc

SEQ ID NO: 435722 - DNA, 25 bp, Rattus norvegicus
ggcaatggcaaagctccaggctagc

SEQ ID NO: 435723 - DNA, 25 bp, Rattus norvegicus
ggcaatggcaaatctcgagactgga

SEQ ID NO: 435724 - DNA, 25 bp, Rattus norvegicus
ggcaatggccaaagctttatgcagc

SEQ ID NO: 435725 - DNA, 25 bp, Rattus norvegicus
ggcaatggccaatgctttatgcagc

SEQ ID NO: 435726 - DNA, 25 bp, Rattus norvegicus
ggcaatggtaacaaagtctactcta

SEQ ID NO: 435727 - DNA, 25 bp, Rattus norvegicus
ggcaatggtaactaagtctactcta

SEQ ID NO: 435728 - DNA, 25 bp, Rattus norvegicus
ggcaatgtctggaaattactatggt

SEQ ID NO: 435729 - DNA, 25 bp, Rattus norvegicus
ggcaatgtctggtaattactatggt

SEQ ID NO: 435730 - DNA, 25 bp, Rattus norvegicus
ggcaatgtgcctctcatggttagtt

SEQ ID NO: 435731 - DNA, 25 bp, Rattus norvegicus
ggcaatgtgcctgtcatggttagtt

SEQ ID NO: 435732 - DNA, 25 bp, Rattus norvegicus
ggcaatgttagcagccacgttcgct

SEQ ID NO: 435733 - DNA, 25 bp, Rattus norvegicus
ggcaatgttagctgccacgttcgct

SEQ ID NO: 435734 - DNA, 25 bp, Rattus norvegicus
ggcaatgttgcaaaatgacagcttt

SEQ ID NO: 435735 - DNA, 25 bp, Rattus norvegicus
ggcaatgttgcataatgacagcttt

SEQ ID NO: 435736 - DNA, 25 bp, Rattus norvegicus
ggcaatgttgtgcagtgcctcacat

SEQ ID NO: 435737 - DNA, 25 bp, Rattus norvegicus
ggcaatgttgtggagtgcctcacat

SEQ ID NO: 435738 - DNA, 25 bp, Rattus norvegicus
ggcaattaaactccacagcaccttt

SEQ ID NO: 435739 - DNA, 25 bp, Rattus norvegicus
ggcaattaaactgcacagcaccttt

SEQ ID NO: 435740 - DNA, 25 bp, Rattus norvegicus
ggcaattacattatccatacaggtt

SEQ ID NO: 435741 - DNA, 25 bp, Rattus norvegicus
ggcaattacattttccatacaggtt

SEQ ID NO: 435742 - DNA, 25 bp, Rattus norvegicus
ggcaattactcactgagagacctgt

SEQ ID NO: 435743 - DNA, 25 bp, Rattus norvegicus
ggcaattactcagtgagagacctgt

SEQ ID NO: 435744 - DNA, 25 bp, Rattus norvegicus
ggcaattagcacactttctgactca

SEQ ID NO: 435745 - DNA, 25 bp, Rattus norvegicus
ggcaattagcactctttctgactca

SEQ ID NO: 435746 - DNA, 25 bp, Rattus norvegicus
ggcaattagggcctggcattctgtc

SEQ ID NO: 435747 - DNA, 25 bp, Rattus norvegicus
ggcaattagggcgtggcattctgtc

SEQ ID NO: 435748 - DNA, 25 bp, Rattus norvegicus
ggcaattatgcacttaggttccttc

SEQ ID NO: 435749 - DNA, 25 bp, Rattus norvegicus
ggcaattatgcagttaggttccttc

SEQ ID NO: 435750 - DNA, 25 bp, Rattus norvegicus
ggcaattcaacaaatgtctcctgga

SEQ ID NO: 435751 - DNA, 25 bp, Rattus norvegicus
ggcaattcaacatatgtctcctgga

SEQ ID NO: 435752 - DNA, 25 bp, Rattus norvegicus
ggcaattccagccttctgtggaaag

SEQ ID NO: 435753 - DNA, 25 bp, Rattus norvegicus
ggcaattccagcgttctgtggaaag

SEQ ID NO: 435754 - DNA, 25 bp, Rattus norvegicus
ggcaattccatgctgtttgacatca

SEQ ID NO: 435755 - DNA, 25 bp, Rattus norvegicus
ggcaattccatggtgtttgacatca

SEQ ID NO: 435756 - DNA, 25 bp, Rattus norvegicus
ggcaattcccctcccaagaaggaag

SEQ ID NO: 435757 - DNA, 25 bp, Rattus norvegicus
ggcaattcccctgccaagaaggaag

SEQ ID NO: 435758 - DNA, 25 bp, Rattus norvegicus
ggcaattctgataattttcattcat

SEQ ID NO: 435759 - DNA, 25 bp, Rattus norvegicus
ggcaattctgatatccaaggcacct

SEQ ID NO: 435760 - DNA, 25 bp, Rattus norvegicus
ggcaattctgattattttcattcat

SEQ ID NO: 435761 - DNA, 25 bp, Rattus norvegicus
ggcaattctgatttccaaggcacct

SEQ ID NO: 435762 - DNA, 25 bp, Rattus norvegicus
ggcaattgatttccactttacttgt

SEQ ID NO: 435763 - DNA, 25 bp, Rattus norvegicus
ggcaattgatttgcactttacttgt

SEQ ID NO: 435764 - DNA, 25 bp, Rattus norvegicus
ggcaattgcactaatgagactcatc

SEQ ID NO: 435765 - DNA, 25 bp, Rattus norvegicus
ggcaattgcactcgacttaaagtaa

SEQ ID NO: 435766 - DNA, 25 bp, Rattus norvegicus
ggcaattgcactggacttaaagtaa

SEQ ID NO: 435767 - DNA, 25 bp, Rattus norvegicus
ggcaattgcacttatgagactcatc

SEQ ID NO: 435768 - DNA, 25 bp, Rattus norvegicus
ggcaattgctaacaccaggactcac

SEQ ID NO: 435769 - DNA, 25 bp, Rattus norvegicus
ggcaattgctaagaccaggactcac

SEQ ID NO: 435770 - DNA, 25 bp, Rattus norvegicus
ggcaattgctgtatgctttctgtca

SEQ ID NO: 435771 - DNA, 25 bp, Rattus norvegicus
ggcaattgctgtttgctttctgtca

SEQ ID NO: 435772 - DNA, 25 bp, Rattus norvegicus
ggcaattggtctactgtggaacttt

SEQ ID NO: 435773 - DNA, 25 bp, Rattus norvegicus
ggcaattggtcttctgtggaacttt

SEQ ID NO: 435774 - DNA, 25 bp, Rattus norvegicus
ggcaattgttgtacttcactatctg

SEQ ID NO: 435775 - DNA, 25 bp, Rattus norvegicus
ggcaattgttgttcttcactatctg

SEQ ID NO: 435776 - DNA, 25 bp, Rattus norvegicus
ggcaattgtttgctggtgcttttgt

SEQ ID NO: 435777 - DNA, 25 bp, Rattus norvegicus
ggcaattgtttggtggtgcttttgt

SEQ ID NO: 435778 - DNA, 25 bp, Rattus norvegicus
ggcaatttacagaactctcactcct

SEQ ID NO: 435779 - DNA, 25 bp, Rattus norvegicus
ggcaatttacagtactctcactcct

SEQ ID NO: 435780 - DNA, 25 bp, Rattus norvegicus
ggcaatttatctaagtcagcttctg

SEQ ID NO: 435781 - DNA, 25 bp, Rattus norvegicus
ggcaatttatcttagtcagcttctg

SEQ ID NO: 435782 - DNA, 25 bp, Rattus norvegicus
ggcaatttcacacctctatcataca

SEQ ID NO: 435783 - DNA, 25 bp, Rattus norvegicus
ggcaatttcacagctctatcataca

SEQ ID NO: 435784 - DNA, 25 bp, Rattus norvegicus
ggcaatttcctgcattaagctgaga

SEQ ID NO: 435785 - DNA, 25 bp, Rattus norvegicus
ggcaatttcctggattaagctgaga

SEQ ID NO: 435786 - DNA, 25 bp, Rattus norvegicus
ggcaatttccttaacagtgagtctc

SEQ ID NO: 435787 - DNA, 25 bp, Rattus norvegicus
ggcaatttcctttacagtgagtctc

SEQ ID NO: 435788 - DNA, 25 bp, Rattus norvegicus
ggcaatttcttcattactactcata

SEQ ID NO: 435789 - DNA, 25 bp, Rattus norvegicus
ggcaatttcttctttactactcata

SEQ ID NO: 435790 - DNA, 25 bp, Rattus norvegicus
ggcaatttgcacctggaaatcagta

SEQ ID NO: 435791 - DNA, 25 bp, Rattus norvegicus
ggcaatttgcacgtggaaatcagta

SEQ ID NO: 435792 - DNA, 25 bp, Rattus norvegicus
ggcaattttatgcatgctagtcatc

SEQ ID NO: 435793 - DNA, 25 bp, Rattus norvegicus
ggcaattttatggatgctagtcatc

SEQ ID NO: 435794 - DNA, 25 bp, Rattus norvegicus
ggcaattttattcatctagggtcag

SEQ ID NO: 435795 - DNA, 25 bp, Rattus norvegicus
ggcaattttattgatctagggtcag

SEQ ID NO: 435796 - DNA, 25 bp, Rattus norvegicus
ggcaattttggactgaccaactcta

SEQ ID NO: 435797 - DNA, 25 bp, Rattus norvegicus
ggcaattttggagtgaccaactcta

SEQ ID NO: 435798 - DNA, 25 bp, Rattus norvegicus
ggcaatttttgaatcctcctaagga

SEQ ID NO: 435799 - DNA, 25 bp, Rattus norvegicus
ggcaatttttgattcctcctaagga

SEQ ID NO: 435800 - DNA, 25 bp, Rattus norvegicus
ggcacaaaactacctctgatacaga

SEQ ID NO: 435801 - DNA, 25 bp, Rattus norvegicus
ggcacaaaactagctctgatacaga

SEQ ID NO: 435802 - DNA, 25 bp, Rattus norvegicus
ggcacaaaactgctggtcccttgga

SEQ ID NO: 435803 - DNA, 25 bp, Rattus norvegicus
ggcacaaaactggtggtcccttgga

SEQ ID NO: 435804 - DNA, 25 bp, Rattus norvegicus
ggcacaaacattacatccacagtgt

SEQ ID NO: 435805 - DNA, 25 bp, Rattus norvegicus
ggcacaaacatttcatccacagtgt

SEQ ID NO: 435806 - DNA, 25 bp, Rattus norvegicus
ggcacaaactgactacatttcttga

SEQ ID NO: 435807 - DNA, 25 bp, Rattus norvegicus
ggcacaaactgagtacatttcttga

SEQ ID NO: 435808 - DNA, 25 bp, Rattus norvegicus
ggcacaaacttgattatctcagtag

SEQ ID NO: 435809 - DNA, 25 bp, Rattus norvegicus
ggcacaaacttgtttatctcagtag

SEQ ID NO: 435810 - DNA, 25 bp, Rattus norvegicus
ggcacaaagccgaagtttatcctcc

SEQ ID NO: 435811 - DNA, 25 bp, Rattus norvegicus
ggcacaaagccgtagtttatcctcc

SEQ ID NO: 435812 - DNA, 25 bp, Rattus norvegicus
ggcacaaagcttacgataaccctga

SEQ ID NO: 435813 - DNA, 25 bp, Rattus norvegicus
ggcacaaagctttcgataaccctga

SEQ ID NO: 435814 - DNA, 25 bp, Rattus norvegicus
ggcacaacacatccacttgttcagg

SEQ ID NO: 435815 - DNA, 25 bp, Rattus norvegicus
ggcacaacacatgcacttgttcagg

SEQ ID NO: 435816 - DNA, 25 bp, Rattus norvegicus
ggcacaacatttattattccacatg

SEQ ID NO: 435817 - DNA, 25 bp, Rattus norvegicus
ggcacaacattttttattccacatg

SEQ ID NO: 435818 - DNA, 25 bp, Rattus norvegicus
ggcacaacgtaaccaataccattct

SEQ ID NO: 435819 - DNA, 25 bp, Rattus norvegicus
ggcacaacgtaagcaataccattct

SEQ ID NO: 435820 - DNA, 25 bp, Rattus norvegicus
ggcacaactaatcactggaagaatc

SEQ ID NO: 435821 - DNA, 25 bp, Rattus norvegicus
ggcacaactaatgactggaagaatc

SEQ ID NO: 435822 - DNA, 25 bp, Rattus norvegicus
ggcacaactctaactaaggtgttta

SEQ ID NO: 435823 - DNA, 25 bp, Rattus norvegicus
ggcacaactctatctaaggtgttta

SEQ ID NO: 435824 - DNA, 25 bp, Rattus norvegicus
ggcacaacttaccttcaggtgcaca

SEQ ID NO: 435825 - DNA, 25 bp, Rattus norvegicus
ggcacaacttacgttcaggtgcaca

SEQ ID NO: 435826 - DNA, 25 bp, Rattus norvegicus
ggcacaagatgaccgtctggcacca

SEQ ID NO: 435827 - DNA, 25 bp, Rattus norvegicus
ggcacaagatgagcgtctggcacca

SEQ ID NO: 435828 - DNA, 25 bp, Rattus norvegicus
ggcacaagcctgagacacacgtcat

SEQ ID NO: 435829 - DNA, 25 bp, Rattus norvegicus
ggcacaagcctgtgacacacgtcat

SEQ ID NO: 435830 - DNA, 25 bp, Rattus norvegicus
ggcacaagctacctctcttagtaag

SEQ ID NO: 435831 - DNA, 25 bp, Rattus norvegicus
ggcacaagctacgtctcttagtaag

SEQ ID NO: 435832 - DNA, 25 bp, Rattus norvegicus
ggcacaagggtccacaatgcctttt

SEQ ID NO: 435833 - DNA, 25 bp, Rattus norvegicus
ggcacaagggtcgacaatgcctttt

SEQ ID NO: 435834 - DNA, 25 bp, Rattus norvegicus
ggcacaaggtagctcaaattcatca

SEQ ID NO: 435835 - DNA, 25 bp, Rattus norvegicus
ggcacaaggtaggtcaaattcatca

SEQ ID NO: 435836 - DNA, 25 bp, Rattus norvegicus
ggcacaagtcatactctacatagca

SEQ ID NO: 435837 - DNA, 25 bp, Rattus norvegicus
ggcacaagtcattctctacatagca

SEQ ID NO: 435838 - DNA, 25 bp, Rattus norvegicus
ggcacaatattaattaaggacccca

SEQ ID NO: 435839 - DNA, 25 bp, Rattus norvegicus
ggcacaatattatttaaggacccca

SEQ ID NO: 435840 - DNA, 25 bp, Rattus norvegicus
ggcacaatggcaccctggaagtcca

SEQ ID NO: 435841 - DNA, 25 bp, Rattus norvegicus
ggcacaatggcagcctggaagtcca

SEQ ID NO: 435842 - DNA, 25 bp, Rattus norvegicus
ggcacaatggccacttggtattttg

SEQ ID NO: 435843 - DNA, 25 bp, Rattus norvegicus
ggcacaatggcctcttggtattttg

SEQ ID NO: 435844 - DNA, 25 bp, Rattus norvegicus
ggcacaatggtgctgtcctctgcat

SEQ ID NO: 435845 - DNA, 25 bp, Rattus norvegicus
ggcacaatggtggtgtcctctgcat

SEQ ID NO: 435846 - DNA, 25 bp, Rattus norvegicus
ggcacaatgttaatctccatggaag

SEQ ID NO: 435847 - DNA, 25 bp, Rattus norvegicus
ggcacaatgttattctccatggaag

SEQ ID NO: 435848 - DNA, 25 bp, Rattus norvegicus
ggcacaattacccagagatatattt

SEQ ID NO: 435849 - DNA, 25 bp, Rattus norvegicus
ggcacaattaccgagagatatattt

SEQ ID NO: 435850 - DNA, 25 bp, Rattus norvegicus
ggcacaattgcaatccatagctatc

SEQ ID NO: 435851 - DNA, 25 bp, Rattus norvegicus
ggcacaattgcattccatagctatc

SEQ ID NO: 435852 - DNA, 25 bp, Rattus norvegicus
ggcacaatttttactcacttggagt

SEQ ID NO: 435853 - DNA, 25 bp, Rattus norvegicus
ggcacaattttttctcacttggagt

SEQ ID NO: 435854 - DNA, 25 bp, Rattus norvegicus
ggcacacaatctaccactgaatgac

SEQ ID NO: 435855 - DNA, 25 bp, Rattus norvegicus
ggcacacaatcttccactgaatgac

SEQ ID NO: 435856 - DNA, 25 bp, Rattus norvegicus
ggcacacacagtactagcaggcagt

SEQ ID NO: 435857 - DNA, 25 bp, Rattus norvegicus
ggcacacacagttctagcaggcagt

SEQ ID NO: 435858 - DNA, 25 bp, Rattus norvegicus
ggcacacacattaattcccagcatt

SEQ ID NO: 435859 - DNA, 25 bp, Rattus norvegicus
ggcacacacatttattcccagcatt

SEQ ID NO: 435860 - DNA, 25 bp, Rattus norvegicus
ggcacacaccacagtgtgtagctaa

SEQ ID NO: 435861 - DNA, 25 bp, Rattus norvegicus
ggcacacaccactgtgtgtagctaa

SEQ ID NO: 435862 - DNA, 25 bp, Rattus norvegicus
ggcacacaccttaaaggcagaggtg

SEQ ID NO: 435863 - DNA, 25 bp, Rattus norvegicus
ggcacacacctttaaggcagaggtg

SEQ ID NO: 435864 - DNA, 25 bp, Rattus norvegicus
ggcacacacgtgatgttccagcagt

SEQ ID NO: 435865 - DNA, 25 bp, Rattus norvegicus
ggcacacacgtgttgttccagcagt

SEQ ID NO: 435866 - DNA, 25 bp, Rattus norvegicus
ggcacacactgaactctttacttag

SEQ ID NO: 435867 - DNA, 25 bp, Rattus norvegicus
ggcacacactgatctctttacttag

SEQ ID NO: 435868 - DNA, 25 bp, Rattus norvegicus
ggcacacactttaattcctagcaga

SEQ ID NO: 435869 - DNA, 25 bp, Rattus norvegicus
ggcacacacttttattcctagcaga

SEQ ID NO: 435870 - DNA, 25 bp, Rattus norvegicus
ggcacacagccaattgagacacctt

SEQ ID NO: 435871 - DNA, 25 bp, Rattus norvegicus
ggcacacagccatttgagacacctt

SEQ ID NO: 435872 - DNA, 25 bp, Rattus norvegicus
ggcacacagctactttcaaactttt

SEQ ID NO: 435873 - DNA, 25 bp, Rattus norvegicus
ggcacacagctagtttcaaactttt

SEQ ID NO: 435874 - DNA, 25 bp, Rattus norvegicus
ggcacacagggcataactcctttct

SEQ ID NO: 435875 - DNA, 25 bp, Rattus norvegicus
ggcacacagggcttaactcctttct

SEQ ID NO: 435876 - DNA, 25 bp, Rattus norvegicus
ggcacacaggtacaagtctagctct

SEQ ID NO: 435877 - DNA, 25 bp, Rattus norvegicus
ggcacacaggtagaagtctagctct

SEQ ID NO: 435878 - DNA, 25 bp, Rattus norvegicus
ggcacacagtaaaggcagatcccaa

SEQ ID NO: 435879 - DNA, 25 bp, Rattus norvegicus
ggcacacagtaatggcagatcccaa

SEQ ID NO: 435880 - DNA, 25 bp, Rattus norvegicus
ggcacacattataatcccaggaggc

SEQ ID NO: 435881 - DNA, 25 bp, Rattus norvegicus
ggcacacattattatcccaggaggc

SEQ ID NO: 435882 - DNA, 25 bp, Rattus norvegicus
ggcacacatttcattatgtcagcca

SEQ ID NO: 435883 - DNA, 25 bp, Rattus norvegicus
ggcacacatttctttatgtcagcca

SEQ ID NO: 435884 - DNA, 25 bp, Rattus norvegicus
ggcacacattttctagctcagacaa

SEQ ID NO: 435885 - DNA, 25 bp, Rattus norvegicus
ggcacacattttgtagctcagacaa

SEQ ID NO: 435886 - DNA, 25 bp, Rattus norvegicus
ggcacaccaaagagtccacatcgta

SEQ ID NO: 435887 - DNA, 25 bp, Rattus norvegicus
ggcacaccaaagtgtccacatcgta

SEQ ID NO: 435888 - DNA, 25 bp, Rattus norvegicus
ggcacaccagagagaatcctatcat

SEQ ID NO: 435889 - DNA, 25 bp, Rattus norvegicus
ggcacaccagagtgaatcctatcat

SEQ ID NO: 435890 - DNA, 25 bp, Rattus norvegicus
ggcacacccagcatttgtcaagaag

SEQ ID NO: 435891 - DNA, 25 bp, Rattus norvegicus
ggcacacccagcttttgtcaagaag

SEQ ID NO: 435892 - DNA, 25 bp, Rattus norvegicus
ggcacacccatgagccacagtgaat

SEQ ID NO: 435893 - DNA, 25 bp, Rattus norvegicus
ggcacacccatgtgccacagtgaat

SEQ ID NO: 435894 - DNA, 25 bp, Rattus norvegicus
ggcacaccccacaggaaattattct

SEQ ID NO: 435895 - DNA, 25 bp, Rattus norvegicus
ggcacaccccactggaaattattct

SEQ ID NO: 435896 - DNA, 25 bp, Rattus norvegicus
ggcacaccgcaaaatcctaaattat

SEQ ID NO: 435897 - DNA, 25 bp, Rattus norvegicus
ggcacaccgcaatatcctaaattat

SEQ ID NO: 435898 - DNA, 25 bp, Rattus norvegicus
ggcacaccgggtactggaactttat

SEQ ID NO: 435899 - DNA, 25 bp, Rattus norvegicus
ggcacaccgggttctggaactttat

SEQ ID NO: 435900 - DNA, 25 bp, Rattus norvegicus
ggcacacctctacttcgaaatggga

SEQ ID NO: 435901 - DNA, 25 bp, Rattus norvegicus
ggcacacctctagttcgaaatggga

SEQ ID NO: 435902 - DNA, 25 bp, Rattus norvegicus
ggcacacctgtgcacgactgtaggt

SEQ ID NO: 435903 - DNA, 25 bp, Rattus norvegicus
ggcacacctgtggacgactgtaggt

SEQ ID NO: 435904 - DNA, 25 bp, Rattus norvegicus
ggcacaccttatctcttttgattca

SEQ ID NO: 435905 - DNA, 25 bp, Rattus norvegicus
ggcacaccttatgtcttttgattca

SEQ ID NO: 435906 - DNA, 25 bp, Rattus norvegicus
ggcacacgaactacccttaatatga

SEQ ID NO: 435907 - DNA, 25 bp, Rattus norvegicus
ggcacacgaacttcccttaatatga

SEQ ID NO: 435908 - DNA, 25 bp, Rattus norvegicus
ggcacacgagtgattgctctgaggt

SEQ ID NO: 435909 - DNA, 25 bp, Rattus norvegicus
ggcacacgagtgtttgctctgaggt

SEQ ID NO: 435910 - DNA, 25 bp, Rattus norvegicus
ggcacacgatgcatctctttaagtt

SEQ ID NO: 435911 - DNA, 25 bp, Rattus norvegicus
ggcacacgatgcttctctttaagtt

SEQ ID NO: 435912 - DNA, 25 bp, Rattus norvegicus
ggcacacgctgaaagatgtagatat

SEQ ID NO: 435913 - DNA, 25 bp, Rattus norvegicus
ggcacacgctgatagatgtagatat

SEQ ID NO: 435914 - DNA, 25 bp, Rattus norvegicus
ggcacacggcatcagtccttaatag

SEQ ID NO: 435915 - DNA, 25 bp, Rattus norvegicus
ggcacacggcatgagtccttaatag

SEQ ID NO: 435916 - DNA, 25 bp, Rattus norvegicus
ggcacacggctgactcaatggcttc

SEQ ID NO: 435917 - DNA, 25 bp, Rattus norvegicus
ggcacacggctgtctcaatggcttc

SEQ ID NO: 435918 - DNA, 25 bp, Rattus norvegicus
ggcacacggtagacactcaataaat

SEQ ID NO: 435919 - DNA, 25 bp, Rattus norvegicus
ggcacacggtagtcactcaataaat

SEQ ID NO: 435920 - DNA, 25 bp, Rattus norvegicus
ggcacacggtataacgtcagtttct

SEQ ID NO: 435921 - DNA, 25 bp, Rattus norvegicus
ggcacacggtattacgtcagtttct

SEQ ID NO: 435922 - DNA, 25 bp, Rattus norvegicus
ggcacacgtatgagtggaagcccct

SEQ ID NO: 435923 - DNA, 25 bp, Rattus norvegicus
ggcacacgtatgtgtggaagcccct

SEQ ID NO: 435924 - DNA, 25 bp, Rattus norvegicus
ggcacacgtgtaagctggagcacca

SEQ ID NO: 435925 - DNA, 25 bp, Rattus norvegicus
ggcacacgtgtatgctggagcacca

SEQ ID NO: 435926 - DNA, 25 bp, Rattus norvegicus
ggcacactagacatcccaaaactgt

SEQ ID NO: 435927 - DNA, 25 bp, Rattus norvegicus
ggcacactagacttcccaaaactgt

SEQ ID NO: 435928 - DNA, 25 bp, Rattus norvegicus
ggcacactagccattcgcagtgata

SEQ ID NO: 435929 - DNA, 25 bp, Rattus norvegicus
ggcacactagcctttcgcagtgata

SEQ ID NO: 435930 - DNA, 25 bp, Rattus norvegicus
ggcacactagctctgcagaggacaa

SEQ ID NO: 435931 - DNA, 25 bp, Rattus norvegicus
ggcacactagctgtgcagaggacaa

SEQ ID NO: 435932 - DNA, 25 bp, Rattus norvegicus
ggcacactagggaatcacagtcaaa

SEQ ID NO: 435933 - DNA, 25 bp, Rattus norvegicus
ggcacactagggtatcacagtcaaa

SEQ ID NO: 435934 - DNA, 25 bp, Rattus norvegicus
ggcacactcaccagttcaactttat

SEQ ID NO: 435935 - DNA, 25 bp, Rattus norvegicus
ggcacactcacctgttcaactttat

SEQ ID NO: 435936 - DNA, 25 bp, Rattus norvegicus
ggcacactcagccaggacatgcgag

SEQ ID NO: 435937 - DNA, 25 bp, Rattus norvegicus
ggcacactcagcgaggacatgcgag

SEQ ID NO: 435938 - DNA, 25 bp, Rattus norvegicus
ggcacactccagcacaacagctgat

SEQ ID NO: 435939 - DNA, 25 bp, Rattus norvegicus
ggcacactccaggacaacagctgat

SEQ ID NO: 435940 - DNA, 25 bp, Rattus norvegicus
ggcacactcctgagcgtatgatata

SEQ ID NO: 435941 - DNA, 25 bp, Rattus norvegicus
ggcacactcctgtgcgtatgatata

SEQ ID NO: 435942 - DNA, 25 bp, Rattus norvegicus
ggcacactctacaggaaacgtcttt

SEQ ID NO: 435943 - DNA, 25 bp, Rattus norvegicus
ggcacactctactggaaacgtcttt

SEQ ID NO: 435944 - DNA, 25 bp, Rattus norvegicus
ggcacactctccagaacagcatgta

SEQ ID NO: 435945 - DNA, 25 bp, Rattus norvegicus
ggcacactctcctgaacagcatgta

SEQ ID NO: 435946 - DNA, 25 bp, Rattus norvegicus
ggcacactctggcttgctcggcacg

SEQ ID NO: 435947 - DNA, 25 bp, Rattus norvegicus
ggcacactctgggttgctcggcacg

SEQ ID NO: 435948 - DNA, 25 bp, Rattus norvegicus
ggcacactgagtcgctttgtttcct

SEQ ID NO: 435949 - DNA, 25 bp, Rattus norvegicus
ggcacactgagtggctttgtttcct

SEQ ID NO: 435950 - DNA, 25 bp, Rattus norvegicus
ggcacactgggcagttcttaaatgt

SEQ ID NO: 435951 - DNA, 25 bp, Rattus norvegicus
ggcacactgggctgttcttaaatgt

SEQ ID NO: 435952 - DNA, 25 bp, Rattus norvegicus
ggcacactggtcacttagtttgagg

SEQ ID NO: 435953 - DNA, 25 bp, Rattus norvegicus
ggcacactggtctcttagtttgagg

SEQ ID NO: 435954 - DNA, 25 bp, Rattus norvegicus
ggcacactggttcatctcatgtgag

SEQ ID NO: 435955 - DNA, 25 bp, Rattus norvegicus
ggcacactggttgatctcatgtgag

SEQ ID NO: 435956 - DNA, 25 bp, Rattus norvegicus
ggcacactgtgaattcctatatggt

SEQ ID NO: 435957 - DNA, 25 bp, Rattus norvegicus
ggcacactgtgatttcctatatggt

SEQ ID NO: 435958 - DNA, 25 bp, Rattus norvegicus
ggcacactgtgcagtcttacatatt

SEQ ID NO: 435959 - DNA, 25 bp, Rattus norvegicus
ggcacactgtgctgtcttacatatt

SEQ ID NO: 435960 - DNA, 25 bp, Rattus norvegicus
ggcacactttgcaaatatatatgac

SEQ ID NO: 435961 - DNA, 25 bp, Rattus norvegicus
ggcacactttgctaatatatatgac

SEQ ID NO: 435962 - DNA, 25 bp, Rattus norvegicus
ggcacactttgtccaatgagggcag

SEQ ID NO: 435963 - DNA, 25 bp, Rattus norvegicus
ggcacactttgtgcaatgagggcag

SEQ ID NO: 435964 - DNA, 25 bp, Rattus norvegicus
ggcacagaagcacaaggaacatttt

SEQ ID NO: 435965 - DNA, 25 bp, Rattus norvegicus
ggcacagaagcagaaggaacatttt

SEQ ID NO: 435966 - DNA, 25 bp, Rattus norvegicus
ggcacagaccatctgactgttaaat

SEQ ID NO: 435967 - DNA, 25 bp, Rattus norvegicus
ggcacagaccatgtgactgttaaat

SEQ ID NO: 435968 - DNA, 25 bp, Rattus norvegicus
ggcacagacccactggccaagtggt

SEQ ID NO: 435969 - DNA, 25 bp, Rattus norvegicus
ggcacagacccagtggccaagtggt

SEQ ID NO: 435970 - DNA, 25 bp, Rattus norvegicus
ggcacagacgaacttcaccaagaga

SEQ ID NO: 435971 - DNA, 25 bp, Rattus norvegicus
ggcacagacgaagttcaccaagaga

SEQ ID NO: 435972 - DNA, 25 bp, Rattus norvegicus
ggcacagagccaccttgggaaatgt

SEQ ID NO: 435973 - DNA, 25 bp, Rattus norvegicus
ggcacagagccagcttgggaaatgt

SEQ ID NO: 435974 - DNA, 25 bp, Rattus norvegicus
ggcacagagcctattagttgttggg

SEQ ID NO: 435975 - DNA, 25 bp, Rattus norvegicus
ggcacagagccttttagttgttggg

SEQ ID NO: 435976 - DNA, 25 bp, Rattus norvegicus
ggcacagaggtcatggcaccagtac

SEQ ID NO: 435977 - DNA, 25 bp, Rattus norvegicus
ggcacagaggtcttggcaccagtac

SEQ ID NO: 435978 - DNA, 25 bp, Rattus norvegicus
ggcacagatgccatgcgtgatcgtg

SEQ ID NO: 435979 - DNA, 25 bp, Rattus norvegicus
ggcacagatgccttgcgtgatcgtg

SEQ ID NO: 435980 - DNA, 25 bp, Rattus norvegicus
ggcacagcacacagtcctgttgtta

SEQ ID NO: 435981 - DNA, 25 bp, Rattus norvegicus
ggcacagcacactgtcctgttgtta

SEQ ID NO: 435982 - DNA, 25 bp, Rattus norvegicus
ggcacagcacagaccagtgttgagt

SEQ ID NO: 435983 - DNA, 25 bp, Rattus norvegicus
ggcacagcacagtccagtgttgagt

SEQ ID NO: 435984 - DNA, 25 bp, Rattus norvegicus
ggcacagcaccaccgctgtttcctt

SEQ ID NO: 435985 - DNA, 25 bp, Rattus norvegicus
ggcacagcaccagcgctgtttcctt

SEQ ID NO: 435986 - DNA, 25 bp, Rattus norvegicus
ggcacagccaggactagaacacgct

SEQ ID NO: 435987 - DNA, 25 bp, Rattus norvegicus
ggcacagccaggtctagaacacgct

SEQ ID NO: 435988 - DNA, 25 bp, Rattus norvegicus
ggcacagccctcaggaagttgatta

SEQ ID NO: 435989 - DNA, 25 bp, Rattus norvegicus
ggcacagccctctggaagttgatta

SEQ ID NO: 435990 - DNA, 25 bp, Rattus norvegicus
ggcacagccctgaatgttgaggttt

SEQ ID NO: 435991 - DNA, 25 bp, Rattus norvegicus
ggcacagccctgtatgttgaggttt

SEQ ID NO: 435992 - DNA, 25 bp, Rattus norvegicus
ggcacagcctgaagaccggttttgt

SEQ ID NO: 435993 - DNA, 25 bp, Rattus norvegicus
ggcacagcctgatgaccggttttgt

SEQ ID NO: 435994 - DNA, 25 bp, Rattus norvegicus
ggcacagcctgcatcttgggaatgt

SEQ ID NO: 435995 - DNA, 25 bp, Rattus norvegicus
ggcacagcctgcttcttgggaatgt

SEQ ID NO: 435996 - DNA, 25 bp, Rattus norvegicus
ggcacagcgaatcagctcactgcta

SEQ ID NO: 435997 - DNA, 25 bp, Rattus norvegicus
ggcacagcgaatgagctcactgcta

SEQ ID NO: 435998 - DNA, 25 bp, Rattus norvegicus
ggcacagctagacttgtggcctgaa

SEQ ID NO: 435999 - DNA, 25 bp, Rattus norvegicus
ggcacagctagagttgtggcctgaa

SEQ ID NO: 436000 - DNA, 25 bp, Rattus norvegicus
ggcacagctgaaaaacaacctccat

SEQ ID NO: 436001 - DNA, 25 bp, Rattus norvegicus
ggcacagctgaataacaacctccat

SEQ ID NO: 436002 - DNA, 25 bp, Rattus norvegicus
ggcacagctgtcctccgctgggaca

SEQ ID NO: 436003 - DNA, 25 bp, Rattus norvegicus
ggcacagctgtcgtccgctgggaca

SEQ ID NO: 436004 - DNA, 25 bp, Rattus norvegicus
ggcacagctgttaagactgggcttt

SEQ ID NO: 436005 - DNA, 25 bp, Rattus norvegicus
ggcacagctgtttagactgggcttt

SEQ ID NO: 436006 - DNA, 25 bp, Rattus norvegicus
ggcacagcttaccatgactttggca

SEQ ID NO: 436007 - DNA, 25 bp, Rattus norvegicus
ggcacagcttacgatgactttggca

SEQ ID NO: 436008 - DNA, 25 bp, Rattus norvegicus
ggcacagcttccactaacaggttag

SEQ ID NO: 436009 - DNA, 25 bp, Rattus norvegicus
ggcacagcttcctctaacaggttag

SEQ ID NO: 436010 - DNA, 25 bp, Rattus norvegicus
ggcacaggacctaggtctcacacat

SEQ ID NO: 436011 - DNA, 25 bp, Rattus norvegicus
ggcacaggaccttggtctcacacat

SEQ ID NO: 436012 - DNA, 25 bp, Rattus norvegicus
ggcacaggagaaccccttagcaaat

SEQ ID NO: 436013 - DNA, 25 bp, Rattus norvegicus
ggcacaggagaagcccttagcaaat

SEQ ID NO: 436014 - DNA, 25 bp, Rattus norvegicus
ggcacaggagacatgttctcaccct

SEQ ID NO: 436015 - DNA, 25 bp, Rattus norvegicus
ggcacaggagacttgttctcaccct

SEQ ID NO: 436016 - DNA, 25 bp, Rattus norvegicus
ggcacaggagatatctagacattgt

SEQ ID NO: 436017 - DNA, 25 bp, Rattus norvegicus
ggcacaggagatttctagacattgt

SEQ ID NO: 436018 - DNA, 25 bp, Rattus norvegicus
ggcacaggatctcggtttgctctcc

SEQ ID NO: 436019 - DNA, 25 bp, Rattus norvegicus
ggcacaggatctgggtttgctctcc

SEQ ID NO: 436020 - DNA, 25 bp, Rattus norvegicus
ggcacaggcaagaagagagtcacat

SEQ ID NO: 436021 - DNA, 25 bp, Rattus norvegicus
ggcacaggcaagcactttttattaa

SEQ ID NO: 436022 - DNA, 25 bp, Rattus norvegicus
ggcacaggcaaggactttttattaa

SEQ ID NO: 436023 - DNA, 25 bp, Rattus norvegicus
ggcacaggcaagtagagagtcacat

SEQ ID NO: 436024 - DNA, 25 bp, Rattus norvegicus
ggcacaggcaggactatctctaaga

SEQ ID NO: 436025 - DNA, 25 bp, Rattus norvegicus
ggcacaggcaggtctatctctaaga

SEQ ID NO: 436026 - DNA, 25 bp, Rattus norvegicus
ggcacaggcagtcttctagcatttt

SEQ ID NO: 436027 - DNA, 25 bp, Rattus norvegicus
ggcacaggcagtgttctagcatttt

SEQ ID NO: 436028 - DNA, 25 bp, Rattus norvegicus
ggcacaggcctaagatgccttcaca

SEQ ID NO: 436029 - DNA, 25 bp, Rattus norvegicus
ggcacaggcctatgatgccttcaca

SEQ ID NO: 436030 - DNA, 25 bp, Rattus norvegicus
ggcacaggcctcagggcacctggaa

SEQ ID NO: 436031 - DNA, 25 bp, Rattus norvegicus
ggcacaggcctctgggcacctggaa

SEQ ID NO: 436032 - DNA, 25 bp, Rattus norvegicus
ggcacagggcatatctgtcagtgtt

SEQ ID NO: 436033 - DNA, 25 bp, Rattus norvegicus
ggcacagggcatttctgtcagtgtt

SEQ ID NO: 436034 - DNA, 25 bp, Rattus norvegicus
ggcacagggcctcgacaaactgata

SEQ ID NO: 436035 - DNA, 25 bp, Rattus norvegicus
ggcacagggcctggacaaactgata

SEQ ID NO: 436036 - DNA, 25 bp, Rattus norvegicus
ggcacagggcttactgaggtcctta

SEQ ID NO: 436037 - DNA, 25 bp, Rattus norvegicus
ggcacagggctttctgaggtcctta

SEQ ID NO: 436038 - DNA, 25 bp, Rattus norvegicus
ggcacaggtacacccagaggtctaa

SEQ ID NO: 436039 - DNA, 25 bp, Rattus norvegicus
ggcacaggtacagccagaggtctaa

SEQ ID NO: 436040 - DNA, 25 bp, Rattus norvegicus
ggcacaggtgaacttcttgtagact

SEQ ID NO: 436041 - DNA, 25 bp, Rattus norvegicus
ggcacaggtgaagttcttgtagact

SEQ ID NO: 436042 - DNA, 25 bp, Rattus norvegicus
ggcacaggtgcacaagcctcaagta

SEQ ID NO: 436043 - DNA, 25 bp, Rattus norvegicus
ggcacaggtgcagaagcctcaagta

SEQ ID NO: 436044 - DNA, 25 bp, Rattus norvegicus
ggcacagtaactcatcagatagcta

SEQ ID NO: 436045 - DNA, 25 bp, Rattus norvegicus
ggcacagtaactgatcagatagcta

SEQ ID NO: 436046 - DNA, 25 bp, Rattus norvegicus
ggcacagtactgaccagtctgtcat

SEQ ID NO: 436047 - DNA, 25 bp, Rattus norvegicus
ggcacagtactgtccagtctgtcat

SEQ ID NO: 436048 - DNA, 25 bp, Rattus norvegicus
ggcacagtagtgaacccctttagtc

SEQ ID NO: 436049 - DNA, 25 bp, Rattus norvegicus
ggcacagtagtgtacccctttagtc

SEQ ID NO: 436050 - DNA, 25 bp, Rattus norvegicus
ggcacagtcaggaacaacatcagga

SEQ ID NO: 436051 - DNA, 25 bp, Rattus norvegicus
ggcacagtcaggtacaacatcagga

SEQ ID NO: 436052 - DNA, 25 bp, Rattus norvegicus
ggcacagtcctaccattcaagagtt

SEQ ID NO: 436053 - DNA, 25 bp, Rattus norvegicus
ggcacagtcctagcattcaagagtt

SEQ ID NO: 436054 - DNA, 25 bp, Rattus norvegicus
ggcacagtcggtaagagcacttgat

SEQ ID NO: 436055 - DNA, 25 bp, Rattus norvegicus
ggcacagtcggttagagcacttgat

SEQ ID NO: 436056 - DNA, 25 bp, Rattus norvegicus
ggcacagtgagcactgccacaggcc

SEQ ID NO: 436057 - DNA, 25 bp, Rattus norvegicus
ggcacagtgagctctgccacaggcc

SEQ ID NO: 436058 - DNA, 25 bp, Rattus norvegicus
ggcacagtgatacacctcgggctat

SEQ ID NO: 436059 - DNA, 25 bp, Rattus norvegicus
ggcacagtgatagacctcgggctat

SEQ ID NO: 436060 - DNA, 25 bp, Rattus norvegicus
ggcacagtgcctcggatcagctgca

SEQ ID NO: 436061 - DNA, 25 bp, Rattus norvegicus
ggcacagtgcctgggatcagctgca

SEQ ID NO: 436062 - DNA, 25 bp, Rattus norvegicus
ggcacagtgctgcaggctgttattt

SEQ ID NO: 436063 - DNA, 25 bp, Rattus norvegicus
ggcacagtgctggaggctgttattt

SEQ ID NO: 436064 - DNA, 25 bp, Rattus norvegicus
ggcacagtggataggagactctctg

SEQ ID NO: 436065 - DNA, 25 bp, Rattus norvegicus
ggcacagtggattggagactctctg

SEQ ID NO: 436066 - DNA, 25 bp, Rattus norvegicus
ggcacagtggccatattgactttac

SEQ ID NO: 436067 - DNA, 25 bp, Rattus norvegicus
ggcacagtggccttattgactttac

SEQ ID NO: 436068 - DNA, 25 bp, Rattus norvegicus
ggcacagtgggaatcttaaacctcc

SEQ ID NO: 436069 - DNA, 25 bp, Rattus norvegicus
ggcacagtgggattcttaaacctcc

SEQ ID NO: 436070 - DNA, 25 bp, Rattus norvegicus
ggcacagtgggcaaggtccctccca

SEQ ID NO: 436071 - DNA, 25 bp, Rattus norvegicus
ggcacagtgggctaggtccctccca

SEQ ID NO: 436072 - DNA, 25 bp, Rattus norvegicus
ggcacagtgtctcataaacgtcagt

SEQ ID NO: 436073 - DNA, 25 bp, Rattus norvegicus
ggcacagtgtctgataaacgtcagt

SEQ ID NO: 436074 - DNA, 25 bp, Rattus norvegicus
ggcacagttcccaagtaaatcattt

SEQ ID NO: 436075 - DNA, 25 bp, Rattus norvegicus
ggcacagttccctagtaaatcattt

SEQ ID NO: 436076 - DNA, 25 bp, Rattus norvegicus
ggcacagttctacgcgctcggccag

SEQ ID NO: 436077 - DNA, 25 bp, Rattus norvegicus
ggcacagttctaggcgctcggccag

SEQ ID NO: 436078 - DNA, 25 bp, Rattus norvegicus
ggcacagttgtgacttcttcctaaa

SEQ ID NO: 436079 - DNA, 25 bp, Rattus norvegicus
ggcacagttgtgtcttcttcctaaa

SEQ ID NO: 436080 - DNA, 25 bp, Rattus norvegicus
ggcacagtttgccaacaggtttact

SEQ ID NO: 436081 - DNA, 25 bp, Rattus norvegicus
ggcacagtttgcgaacaggtttact

SEQ ID NO: 436082 - DNA, 25 bp, Rattus norvegicus
ggcacataagagaccccgtcttaaa

SEQ ID NO: 436083 - DNA, 25 bp, Rattus norvegicus
ggcacataagagtccccgtcttaaa

SEQ ID NO: 436084 - DNA, 25 bp, Rattus norvegicus
ggcacatacttaaaatcccaacatt

SEQ ID NO: 436085 - DNA, 25 bp, Rattus norvegicus
ggcacatacttataatcccaacatt

SEQ ID NO: 436086 - DNA, 25 bp, Rattus norvegicus
ggcacatcaaaacactgtttgttta

SEQ ID NO: 436087 - DNA, 25 bp, Rattus norvegicus
ggcacatcaaaagactgtttgttta

SEQ ID NO: 436088 - DNA, 25 bp, Rattus norvegicus
ggcacatcagcaaatctacctagaa

SEQ ID NO: 436089 - DNA, 25 bp, Rattus norvegicus
ggcacatcagcatatctacctagaa

SEQ ID NO: 436090 - DNA, 25 bp, Rattus norvegicus
ggcacatcctacaattccataagct

SEQ ID NO: 436091 - DNA, 25 bp, Rattus norvegicus
ggcacatcctactattccataagct

SEQ ID NO: 436092 - DNA, 25 bp, Rattus norvegicus
ggcacatccttaacacacaacacag

SEQ ID NO: 436093 - DNA, 25 bp, Rattus norvegicus
ggcacatccttatcacacaacacag

SEQ ID NO: 436094 - DNA, 25 bp, Rattus norvegicus
ggcacatccttcaaaaactactgag

SEQ ID NO: 436095 - DNA, 25 bp, Rattus norvegicus
ggcacatccttctaaaactactgag

SEQ ID NO: 436096 - DNA, 25 bp, Rattus norvegicus
ggcacatccttgcacgaaggtcttt

SEQ ID NO: 436097 - DNA, 25 bp, Rattus norvegicus
ggcacatccttggacgaaggtcttt

SEQ ID NO: 436098 - DNA, 25 bp, Rattus norvegicus
ggcacatctgtcctcttggaagagg

SEQ ID NO: 436099 - DNA, 25 bp, Rattus norvegicus
ggcacatctgtcgtcttggaagagg

SEQ ID NO: 436100 - DNA, 25 bp, Rattus norvegicus
ggcacatcttacacacctttgggaa

SEQ ID NO: 436101 - DNA, 25 bp, Rattus norvegicus
ggcacatcttactcacctttgggaa

SEQ ID NO: 436102 - DNA, 25 bp, Rattus norvegicus
ggcacatcttttaacttctctgagc

SEQ ID NO: 436103 - DNA, 25 bp, Rattus norvegicus
ggcacatctttttacttctctgagc

SEQ ID NO: 436104 - DNA, 25 bp, Rattus norvegicus
ggcacatggcgtcctgattttaacc

SEQ ID NO: 436105 - DNA, 25 bp, Rattus norvegicus
ggcacatggcgtgctgattttaacc

SEQ ID NO: 436106 - DNA, 25 bp, Rattus norvegicus
ggcacatgtggcaacgttcaaccga

SEQ ID NO: 436107 - DNA, 25 bp, Rattus norvegicus
ggcacatgtggctacgttcaaccga

SEQ ID NO: 436108 - DNA, 25 bp, Rattus norvegicus
ggcacattactcaggctgctggatc

SEQ ID NO: 436109 - DNA, 25 bp, Rattus norvegicus
ggcacattactctggctgctggatc

SEQ ID NO: 436110 - DNA, 25 bp, Rattus norvegicus
ggcacattatgaatgtaaacgtctc

SEQ ID NO: 436111 - DNA, 25 bp, Rattus norvegicus
ggcacattatgattgtaaacgtctc

SEQ ID NO: 436112 - DNA, 25 bp, Rattus norvegicus
ggcacattcataactgtgtccagtg

SEQ ID NO: 436113 - DNA, 25 bp, Rattus norvegicus
ggcacattcatatctgtgtccagtg

SEQ ID NO: 436114 - DNA, 25 bp, Rattus norvegicus
ggcacattcccacttatgcgtgaag

SEQ ID NO: 436115 - DNA, 25 bp, Rattus norvegicus
ggcacattcccagttatgcgtgaag

SEQ ID NO: 436116 - DNA, 25 bp, Rattus norvegicus
ggcacattccgcatgagatcctaca

SEQ ID NO: 436117 - DNA, 25 bp, Rattus norvegicus
ggcacattccgcttgagatcctaca

SEQ ID NO: 436118 - DNA, 25 bp, Rattus norvegicus
ggcacatttcccacaaaagatttat

SEQ ID NO: 436119 - DNA, 25 bp, Rattus norvegicus
ggcacatttccctcaaaagatttat

SEQ ID NO: 436120 - DNA, 25 bp, Rattus norvegicus
ggcacatttgctatcatttctagga

SEQ ID NO: 436121 - DNA, 25 bp, Rattus norvegicus
ggcacatttgctttcatttctagga

SEQ ID NO: 436122 - DNA, 25 bp, Rattus norvegicus
ggcacatttgttctcttctttgtaa

SEQ ID NO: 436123 - DNA, 25 bp, Rattus norvegicus
ggcacatttgttgtcttctttgtaa

SEQ ID NO: 436124 - DNA, 25 bp, Rattus norvegicus
ggcacattttgaatccgctgcgtgt

SEQ ID NO: 436125 - DNA, 25 bp, Rattus norvegicus
ggcacattttgattccgctgcgtgt

SEQ ID NO: 436126 - DNA, 25 bp, Rattus norvegicus
ggcacattttgccagttgggtcact

SEQ ID NO: 436127 - DNA, 25 bp, Rattus norvegicus
ggcacattttgcgagttgggtcact

SEQ ID NO: 436128 - DNA, 25 bp, Rattus norvegicus
ggcaccaacagccaattcattgcag

SEQ ID NO: 436129 - DNA, 25 bp, Rattus norvegicus
ggcaccaacagcgaattcattgcag

SEQ ID NO: 436130 - DNA, 25 bp, Rattus norvegicus
ggcaccaactagagagaacccctaa

SEQ ID NO: 436131 - DNA, 25 bp, Rattus norvegicus
ggcaccaactagtgagaacccctaa

SEQ ID NO: 436132 - DNA, 25 bp, Rattus norvegicus
ggcaccaagatcaacaatggtttgt

SEQ ID NO: 436133 - DNA, 25 bp, Rattus norvegicus
ggcaccaagatctacaatggtttgt

SEQ ID NO: 436134 - DNA, 25 bp, Rattus norvegicus
ggcaccaagcgaagcgacagggctc

SEQ ID NO: 436135 - DNA, 25 bp, Rattus norvegicus
ggcaccaagcgatgcgacagggctc

SEQ ID NO: 436136 - DNA, 25 bp, Rattus norvegicus
ggcaccaagcgcatcgacagtgaaa

SEQ ID NO: 436137 - DNA, 25 bp, Rattus norvegicus
ggcaccaagcgcttcgacagtgaaa

SEQ ID NO: 436138 - DNA, 25 bp, Rattus norvegicus
ggcaccaaggttcatggacttacat

SEQ ID NO: 436139 - DNA, 25 bp, Rattus norvegicus
ggcaccaaggttgatggacttacat

SEQ ID NO: 436140 - DNA, 25 bp, Rattus norvegicus
ggcaccaatgccagctacatggagg

SEQ ID NO: 436141 - DNA, 25 bp, Rattus norvegicus
ggcaccaatgcctgctacatggagg

SEQ ID NO: 436142 - DNA, 25 bp, Rattus norvegicus
ggcaccaatgtaacaaaatgcaaat

SEQ ID NO: 436143 - DNA, 25 bp, Rattus norvegicus
ggcaccaatgtatcaaaatgcaaat

SEQ ID NO: 436144 - DNA, 25 bp, Rattus norvegicus
ggcaccacagcacgcctgcaggaaa

SEQ ID NO: 436145 - DNA, 25 bp, Rattus norvegicus
ggcaccacagcaggcctgcaggaaa

SEQ ID NO: 436146 - DNA, 25 bp, Rattus norvegicus
ggcaccacagccaaagctggagaga

SEQ ID NO: 436147 - DNA, 25 bp, Rattus norvegicus
ggcaccacagcctaagctggagaga

SEQ ID NO: 436148 - DNA, 25 bp, Rattus norvegicus
ggcaccacatagactcctctggaag

SEQ ID NO: 436149 - DNA, 25 bp, Rattus norvegicus
ggcaccacatagtctcctctggaag

SEQ ID NO: 436150 - DNA, 25 bp, Rattus norvegicus
ggcaccaccgctcagtgcattttat

SEQ ID NO: 436151 - DNA, 25 bp, Rattus norvegicus
ggcaccaccgctgagtgcattttat

SEQ ID NO: 436152 - DNA, 25 bp, Rattus norvegicus
ggcaccacgatgaagatcagagctt

SEQ ID NO: 436153 - DNA, 25 bp, Rattus norvegicus
ggcaccacgatgtagatcagagctt

SEQ ID NO: 436154 - DNA, 25 bp, Rattus norvegicus
ggcaccactaaaagccttttaattg

SEQ ID NO: 436155 - DNA, 25 bp, Rattus norvegicus
ggcaccactaaatgccttttaattg

SEQ ID NO: 436156 - DNA, 25 bp, Rattus norvegicus
ggcaccactccaacaaacaaacttg

SEQ ID NO: 436157 - DNA, 25 bp, Rattus norvegicus
ggcaccactccatcaaacaaacttg

SEQ ID NO: 436158 - DNA, 25 bp, Rattus norvegicus
ggcaccacttgtatgtaatttccag

SEQ ID NO: 436159 - DNA, 25 bp, Rattus norvegicus
ggcaccacttgtttgtaatttccag

SEQ ID NO: 436160 - DNA, 25 bp, Rattus norvegicus
ggcaccagatatacttatgttcagc

SEQ ID NO: 436161 - DNA, 25 bp, Rattus norvegicus
ggcaccagatattcttatgttcagc

SEQ ID NO: 436162 - DNA, 25 bp, Rattus norvegicus
ggcaccagcaggatctgtttttaaa

SEQ ID NO: 436163 - DNA, 25 bp, Rattus norvegicus
ggcaccagcaggcacctgagcttag

SEQ ID NO: 436164 - DNA, 25 bp, Rattus norvegicus
ggcaccagcagggacctgagcttag

SEQ ID NO: 436165 - DNA, 25 bp, Rattus norvegicus
ggcaccagcaggttctgtttttaaa

SEQ ID NO: 436166 - DNA, 25 bp, Rattus norvegicus
ggcaccagcgggagtttcaagtttc

SEQ ID NO: 436167 - DNA, 25 bp, Rattus norvegicus
ggcaccagcgggtgtttcaagtttc

SEQ ID NO: 436168 - DNA, 25 bp, Rattus norvegicus
ggcaccagctggcaagtaaattgtt

SEQ ID NO: 436169 - DNA, 25 bp, Rattus norvegicus
ggcaccagctgggaagtaaattgtt

SEQ ID NO: 436170 - DNA, 25 bp, Rattus norvegicus
ggcaccaggaagagcgcctgttgct

SEQ ID NO: 436171 - DNA, 25 bp, Rattus norvegicus
ggcaccaggaagtgcgcctgttgct

SEQ ID NO: 436172 - DNA, 25 bp, Rattus norvegicus
ggcaccaggagaccccaaacagaaa

SEQ ID NO: 436173 - DNA, 25 bp, Rattus norvegicus
ggcaccaggagagcccaaacagaaa

SEQ ID NO: 436174 - DNA, 25 bp, Rattus norvegicus
ggcaccaggcagagacatcacaaag

SEQ ID NO: 436175 - DNA, 25 bp, Rattus norvegicus
ggcaccaggcagtgacatcacaaag

SEQ ID NO: 436176 - DNA, 25 bp, Rattus norvegicus
ggcaccaggctcacatgatgcatta

SEQ ID NO: 436177 - DNA, 25 bp, Rattus norvegicus
ggcaccaggctctcatgatgcatta

SEQ ID NO: 436178 - DNA, 25 bp, Rattus norvegicus
ggcaccaggtctcagcacagagttt

SEQ ID NO: 436179 - DNA, 25 bp, Rattus norvegicus
ggcaccaggtctgagcacagagttt

SEQ ID NO: 436180 - DNA, 25 bp, Rattus norvegicus
ggcaccagtactagtcctgtttgat

SEQ ID NO: 436181 - DNA, 25 bp, Rattus norvegicus
ggcaccagtacttgtcctgtttgat

SEQ ID NO: 436182 - DNA, 25 bp, Rattus norvegicus
ggcaccagtcatacctatggctatg

SEQ ID NO: 436183 - DNA, 25 bp, Rattus norvegicus
ggcaccagtcattcctatggctatg

SEQ ID NO: 436184 - DNA, 25 bp, Rattus norvegicus
ggcaccagtggcacaagttcaggga

SEQ ID NO: 436185 - DNA, 25 bp, Rattus norvegicus
ggcaccagtggctcaagttcaggga

SEQ ID NO: 436186 - DNA, 25 bp, Rattus norvegicus
ggcaccagtgtcagctagtgtcagc

SEQ ID NO: 436187 - DNA, 25 bp, Rattus norvegicus
ggcaccagtgtctgctagtgtcagc

SEQ ID NO: 436188 - DNA, 25 bp, Rattus norvegicus
ggcaccatagatccttaggtttatt

SEQ ID NO: 436189 - DNA, 25 bp, Rattus norvegicus
ggcaccatagatgcttaggtttatt

SEQ ID NO: 436190 - DNA, 25 bp, Rattus norvegicus
ggcaccataggccaaatatattaat

SEQ ID NO: 436191 - DNA, 25 bp, Rattus norvegicus
ggcaccataggcgaaatatattaat

SEQ ID NO: 436192 - DNA, 25 bp, Rattus norvegicus
ggcaccatagtgaataccttttatt

SEQ ID NO: 436193 - DNA, 25 bp, Rattus norvegicus
ggcaccatagtgtataccttttatt

SEQ ID NO: 436194 - DNA, 25 bp, Rattus norvegicus
ggcaccatatcaaagctggcactca

SEQ ID NO: 436195 - DNA, 25 bp, Rattus norvegicus
ggcaccatatcatagctggcactca

SEQ ID NO: 436196 - DNA, 25 bp, Rattus norvegicus
ggcaccatattcaagcacagcagat

SEQ ID NO: 436197 - DNA, 25 bp, Rattus norvegicus
ggcaccatattctagcacagcagat

SEQ ID NO: 436198 - DNA, 25 bp, Rattus norvegicus
ggcaccatcaatactcaagtcattc

SEQ ID NO: 436199 - DNA, 25 bp, Rattus norvegicus
ggcaccatcaattctcaagtcattc

SEQ ID NO: 436200 - DNA, 25 bp, Rattus norvegicus
ggcaccatcaccctaaagccttgtg

SEQ ID NO: 436201 - DNA, 25 bp, Rattus norvegicus
ggcaccatcaccgtaaagccttgtg

SEQ ID NO: 436202 - DNA, 25 bp, Rattus norvegicus
ggcaccatcatgagctttacagagg

SEQ ID NO: 436203 - DNA, 25 bp, Rattus norvegicus
ggcaccatcatgtgctttacagagg

SEQ ID NO: 436204 - DNA, 25 bp, Rattus norvegicus
ggcaccatcctgaaaagctcttgta

SEQ ID NO: 436205 - DNA, 25 bp, Rattus norvegicus
ggcaccatcctgtaaagctcttgta

SEQ ID NO: 436206 - DNA, 25 bp, Rattus norvegicus
ggcaccatgacaacacaaatgtgat

SEQ ID NO: 436207 - DNA, 25 bp, Rattus norvegicus
ggcaccatgacatcacaaatgtgat

SEQ ID NO: 436208 - DNA, 25 bp, Rattus norvegicus
ggcaccatgcaaagtgttgccatgt

SEQ ID NO: 436209 - DNA, 25 bp, Rattus norvegicus
ggcaccatgcaatgtgttgccatgt

SEQ ID NO: 436210 - DNA, 25 bp, Rattus norvegicus
ggcaccatgcatccaatgtgtggac

SEQ ID NO: 436211 - DNA, 25 bp, Rattus norvegicus
ggcaccatgcatgcaatgtgtggac

SEQ ID NO: 436212 - DNA, 25 bp, Rattus norvegicus
ggcaccatgcttagcatcgggagct

SEQ ID NO: 436213 - DNA, 25 bp, Rattus norvegicus
ggcaccatgctttgcatcgggagct

SEQ ID NO: 436214 - DNA, 25 bp, Rattus norvegicus
ggcaccatggagacgccaatgaacc

SEQ ID NO: 436215 - DNA, 25 bp, Rattus norvegicus
ggcaccatggagtcgccaatgaacc

SEQ ID NO: 436216 - DNA, 25 bp, Rattus norvegicus
ggcaccatgttgcttagctaccaaa

SEQ ID NO: 436217 - DNA, 25 bp, Rattus norvegicus
ggcaccatgttggttagctaccaaa

SEQ ID NO: 436218 - DNA, 25 bp, Rattus norvegicus
ggcaccattctcagaagcgtcagat

SEQ ID NO: 436219 - DNA, 25 bp, Rattus norvegicus
ggcaccattctctgaagcgtcagat

SEQ ID NO: 436220 - DNA, 25 bp, Rattus norvegicus
ggcaccattggccaattgtcccttt

SEQ ID NO: 436221 - DNA, 25 bp, Rattus norvegicus
ggcaccattggcgaattgtcccttt

SEQ ID NO: 436222 - DNA, 25 bp, Rattus norvegicus
ggcaccatttcactcaagggcaagg

SEQ ID NO: 436223 - DNA, 25 bp, Rattus norvegicus
ggcaccatttcagtcaagggcaagg

SEQ ID NO: 436224 - DNA, 25 bp, Rattus norvegicus
ggcacccaatgccattattctatga

SEQ ID NO: 436225 - DNA, 25 bp, Rattus norvegicus
ggcacccaatgcgattattctatga

SEQ ID NO: 436226 - DNA, 25 bp, Rattus norvegicus
ggcacccacaagctgcacatgcata

SEQ ID NO: 436227 - DNA, 25 bp, Rattus norvegicus
ggcacccacaaggtgcacatgcata

SEQ ID NO: 436228 - DNA, 25 bp, Rattus norvegicus
ggcacccacaatacggcacaaaagt

SEQ ID NO: 436229 - DNA, 25 bp, Rattus norvegicus
ggcacccacaattcggcacaaaagt

SEQ ID NO: 436230 - DNA, 25 bp, Rattus norvegicus
ggcacccaccatagagcacatgcga

SEQ ID NO: 436231 - DNA, 25 bp, Rattus norvegicus
ggcacccaccattgagcacatgcga

SEQ ID NO: 436232 - DNA, 25 bp, Rattus norvegicus
ggcacccagaaccagcaagacacta

SEQ ID NO: 436233 - DNA, 25 bp, Rattus norvegicus
ggcacccagaacgagcaagacacta

SEQ ID NO: 436234 - DNA, 25 bp, Rattus norvegicus
ggcacccatctcacctgtaggcggt

SEQ ID NO: 436235 - DNA, 25 bp, Rattus norvegicus
ggcacccatctctcctgtaggcggt

SEQ ID NO: 436236 - DNA, 25 bp, Rattus norvegicus
ggcacccatgtgaatgttagattta

SEQ ID NO: 436237 - DNA, 25 bp, Rattus norvegicus
ggcacccatgtgtatgttagattta

SEQ ID NO: 436238 - DNA, 25 bp, Rattus norvegicus
ggcacccattagaatctttgcccgg

SEQ ID NO: 436239 - DNA, 25 bp, Rattus norvegicus
ggcacccattagtatctttgcccgg

SEQ ID NO: 436240 - DNA, 25 bp, Rattus norvegicus
ggcaccccagagaaatgagtccctt

SEQ ID NO: 436241 - DNA, 25 bp, Rattus norvegicus
ggcaccccagagtaatgagtccctt

SEQ ID NO: 436242 - DNA, 25 bp, Rattus norvegicus
ggcaccccagtaccaaggactaaag

SEQ ID NO: 436243 - DNA, 25 bp, Rattus norvegicus
ggcaccccagtagcaaggactaaag

SEQ ID NO: 436244 - DNA, 25 bp, Rattus norvegicus
ggcacccctaaaccagaggcacaat

SEQ ID NO: 436245 - DNA, 25 bp, Rattus norvegicus
ggcacccctaaagcagaggcacaat

SEQ ID NO: 436246 - DNA, 25 bp, Rattus norvegicus
ggcacccctcatcaaggaagccatt

SEQ ID NO: 436247 - DNA, 25 bp, Rattus norvegicus
ggcacccctcatgaaggaagccatt

SEQ ID NO: 436248 - DNA, 25 bp, Rattus norvegicus
ggcacccctgagatggccttggtaa

SEQ ID NO: 436249 - DNA, 25 bp, Rattus norvegicus
ggcacccctgagttggccttggtaa

SEQ ID NO: 436250 - DNA, 25 bp, Rattus norvegicus
ggcacccctggtcaatccttggtga

SEQ ID NO: 436251 - DNA, 25 bp, Rattus norvegicus
ggcacccctggtgaatccttggtga

SEQ ID NO: 436252 - DNA, 25 bp, Rattus norvegicus
ggcacccctgtgaatgatgctagtg

SEQ ID NO: 436253 - DNA, 25 bp, Rattus norvegicus
ggcacccctgtgtatgatgctagtg

SEQ ID NO: 436254 - DNA, 25 bp, Rattus norvegicus
ggcacccctgttcactttcaaaggt

SEQ ID NO: 436255 - DNA, 25 bp, Rattus norvegicus
ggcacccctgttgactttcaaaggt

SEQ ID NO: 436256 - DNA, 25 bp, Rattus norvegicus
ggcacccgttaaactgacagcgatg

SEQ ID NO: 436257 - DNA, 25 bp, Rattus norvegicus
ggcacccgttaatctgacagcgatg

SEQ ID NO: 436258 - DNA, 25 bp, Rattus norvegicus
ggcaccctaataatagttccgtcac

SEQ ID NO: 436259 - DNA, 25 bp, Rattus norvegicus
ggcaccctaatattagttccgtcac

SEQ ID NO: 436260 - DNA, 25 bp, Rattus norvegicus
ggcaccctagttcattgctttcaaa

SEQ ID NO: 436261 - DNA, 25 bp, Rattus norvegicus
ggcaccctagttgattgctttcaaa

SEQ ID NO: 436262 - DNA, 25 bp, Rattus norvegicus
ggcaccctatgtcgttactggcagt

SEQ ID NO: 436263 - DNA, 25 bp, Rattus norvegicus
ggcaccctatgtggttactggcagt

SEQ ID NO: 436264 - DNA, 25 bp, Rattus norvegicus
ggcaccctcgagaccatcaatgaaa

SEQ ID NO: 436265 - DNA, 25 bp, Rattus norvegicus
ggcaccctcgagtccatcaatgaaa

SEQ ID NO: 436266 - DNA, 25 bp, Rattus norvegicus
ggcaccctgcagagacagtgtttaa

SEQ ID NO: 436267 - DNA, 25 bp, Rattus norvegicus
ggcaccctgcagtgacagtgtttaa

SEQ ID NO: 436268 - DNA, 25 bp, Rattus norvegicus
ggcaccctggtaccgtgacatgtta

SEQ ID NO: 436269 - DNA, 25 bp, Rattus norvegicus
ggcaccctggtagcgtgacatgtta

SEQ ID NO: 436270 - DNA, 25 bp, Rattus norvegicus
ggcacccttcctcaaaagtatgcat

SEQ ID NO: 436271 - DNA, 25 bp, Rattus norvegicus
ggcacccttcctgaaaagtatgcat

SEQ ID NO: 436272 - DNA, 25 bp, Rattus norvegicus
ggcacccttggtctgaagtgtgaca

SEQ ID NO: 436273 - DNA, 25 bp, Rattus norvegicus
ggcacccttggtgtgaagtgtgaca

SEQ ID NO: 436274 - DNA, 25 bp, Rattus norvegicus
ggcaccgaaaccctgaggacccttg

SEQ ID NO: 436275 - DNA, 25 bp, Rattus norvegicus
ggcaccgaaaccgtgaggacccttg

SEQ ID NO: 436276 - DNA, 25 bp, Rattus norvegicus
ggcaccgaattgaattggaagacac

SEQ ID NO: 436277 - DNA, 25 bp, Rattus norvegicus
ggcaccgaattgtattggaagacac

SEQ ID NO: 436278 - DNA, 25 bp, Rattus norvegicus
ggcaccgaggtgcacagctgtaatc

SEQ ID NO: 436279 - DNA, 25 bp, Rattus norvegicus
ggcaccgaggtggacagctgtaatc

SEQ ID NO: 436280 - DNA, 25 bp, Rattus norvegicus
ggcaccgcccaccaaagctggagag

SEQ ID NO: 436281 - DNA, 25 bp, Rattus norvegicus
ggcaccgcccacgaaagctggagag

SEQ ID NO: 436282 - DNA, 25 bp, Rattus norvegicus
ggcaccgctggaacactaacgagag

SEQ ID NO: 436283 - DNA, 25 bp, Rattus norvegicus
ggcaccgctggatcactaacgagag

SEQ ID NO: 436284 - DNA, 25 bp, Rattus norvegicus
ggcaccgcttctctgagagctgcat

SEQ ID NO: 436285 - DNA, 25 bp, Rattus norvegicus
ggcaccgcttctgtgagagctgcat

SEQ ID NO: 436286 - DNA, 25 bp, Rattus norvegicus
ggcaccggaaaaatgctatgaacat

SEQ ID NO: 436287 - DNA, 25 bp, Rattus norvegicus
ggcaccggaaaattgctatgaacat

SEQ ID NO: 436288 - DNA, 25 bp, Rattus norvegicus
ggcaccggcaaaacttttattgtct

SEQ ID NO: 436289 - DNA, 25 bp, Rattus norvegicus
ggcaccggcaaatcttttattgtct

SEQ ID NO: 436290 - DNA, 25 bp, Rattus norvegicus
ggcaccggcgcactgttaagatgaa

SEQ ID NO: 436291 - DNA, 25 bp, Rattus norvegicus
ggcaccggcgcagtgttaagatgaa

SEQ ID NO: 436292 - DNA, 25 bp, Rattus norvegicus
ggcaccggctggctgaacaatgtat

SEQ ID NO: 436293 - DNA, 25 bp, Rattus norvegicus
ggcaccggctgggtgaacaatgtat

SEQ ID NO: 436294 - DNA, 25 bp, Rattus norvegicus
ggcaccggcttaaattcttactaga

SEQ ID NO: 436295 - DNA, 25 bp, Rattus norvegicus
ggcaccggcttatattcttactaga

SEQ ID NO: 436296 - DNA, 25 bp, Rattus norvegicus
ggcaccgggcgcagagcttagaata

SEQ ID NO: 436297 - DNA, 25 bp, Rattus norvegicus
ggcaccgggcgctgagcttagaata

SEQ ID NO: 436298 - DNA, 25 bp, Rattus norvegicus
ggcaccggtataaattattgcttat

SEQ ID NO: 436299 - DNA, 25 bp, Rattus norvegicus
ggcaccggtatatattattgcttat

SEQ ID NO: 436300 - DNA, 25 bp, Rattus norvegicus
ggcaccgtagccatcatgaatgaca

SEQ ID NO: 436301 - DNA, 25 bp, Rattus norvegicus
ggcaccgtagccttcatgaatgaca

SEQ ID NO: 436302 - DNA, 25 bp, Rattus norvegicus
ggcaccgtcataagcagtggctggc

SEQ ID NO: 436303 - DNA, 25 bp, Rattus norvegicus
ggcaccgtcatatgcagtggctggc

SEQ ID NO: 436304 - DNA, 25 bp, Rattus norvegicus
ggcaccgtctctaaggacataactg

SEQ ID NO: 436305 - DNA, 25 bp, Rattus norvegicus
ggcaccgtctcttaggacataactg

SEQ ID NO: 436306 - DNA, 25 bp, Rattus norvegicus
ggcaccgttacactgaactctcagg

SEQ ID NO: 436307 - DNA, 25 bp, Rattus norvegicus
ggcaccgttacagtgaactctcagg

SEQ ID NO: 436308 - DNA, 25 bp, Rattus norvegicus
ggcaccgttgtcatgtcgagagcaa

SEQ ID NO: 436309 - DNA, 25 bp, Rattus norvegicus
ggcaccgttgtcttgtcgagagcaa

SEQ ID NO: 436310 - DNA, 25 bp, Rattus norvegicus
ggcacctaagtgaggtcctgcatca

SEQ ID NO: 436311 - DNA, 25 bp, Rattus norvegicus
ggcacctaagtgtggtcctgcatca

SEQ ID NO: 436312 - DNA, 25 bp, Rattus norvegicus
ggcacctaccacatcagaatgacaa

SEQ ID NO: 436313 - DNA, 25 bp, Rattus norvegicus
ggcacctaccacttcagaatgacaa

SEQ ID NO: 436314 - DNA, 25 bp, Rattus norvegicus
ggcacctaccgtacaagagttggct

SEQ ID NO: 436315 - DNA, 25 bp, Rattus norvegicus
ggcacctaccgttcaagagttggct

SEQ ID NO: 436316 - DNA, 25 bp, Rattus norvegicus
ggcacctacctacgccttgtacggg

SEQ ID NO: 436317 - DNA, 25 bp, Rattus norvegicus
ggcacctacctaggccttgtacggg

SEQ ID NO: 436318 - DNA, 25 bp, Rattus norvegicus
ggcacctatataatggctcacagtt

SEQ ID NO: 436319 - DNA, 25 bp, Rattus norvegicus
ggcacctatatattggctcacagtt

SEQ ID NO: 436320 - DNA, 25 bp, Rattus norvegicus
ggcacctcaccaagctgtggaaaag

SEQ ID NO: 436321 - DNA, 25 bp, Rattus norvegicus
ggcacctcaccatgctgtggaaaag

SEQ ID NO: 436322 - DNA, 25 bp, Rattus norvegicus
ggcacctcattaccagtctccagaa

SEQ ID NO: 436323 - DNA, 25 bp, Rattus norvegicus
ggcacctcattagcagtctccagaa

SEQ ID NO: 436324 - DNA, 25 bp, Rattus norvegicus
ggcacctcccagaaggttgccacat

SEQ ID NO: 436325 - DNA, 25 bp, Rattus norvegicus
ggcacctcccagtaggttgccacat

SEQ ID NO: 436326 - DNA, 25 bp, Rattus norvegicus
ggcacctccccgctccaggaacttg

SEQ ID NO: 436327 - DNA, 25 bp, Rattus norvegicus
ggcacctccccggtccaggaacttg

SEQ ID NO: 436328 - DNA, 25 bp, Rattus norvegicus
ggcacctcgattactcgaatctgtg

SEQ ID NO: 436329 - DNA, 25 bp, Rattus norvegicus
ggcacctcgatttctcgaatctgtg

SEQ ID NO: 436330 - DNA, 25 bp, Rattus norvegicus
ggcacctctactacagtttttactg

SEQ ID NO: 436331 - DNA, 25 bp, Rattus norvegicus
ggcacctctacttcagtttttactg

SEQ ID NO: 436332 - DNA, 25 bp, Rattus norvegicus
ggcacctctaggcaaaaccgcaaaa

SEQ ID NO: 436333 - DNA, 25 bp, Rattus norvegicus
ggcacctctagggaaaaccgcaaaa

SEQ ID NO: 436334 - DNA, 25 bp, Rattus norvegicus
ggcacctctgtgactagaagactta

SEQ ID NO: 436335 - DNA, 25 bp, Rattus norvegicus
ggcacctctgtgtctagaagactta

SEQ ID NO: 436336 - DNA, 25 bp, Rattus norvegicus
ggcacctgaagtaaacctgaagata

SEQ ID NO: 436337 - DNA, 25 bp, Rattus norvegicus
ggcacctgaagttaacctgaagata

SEQ ID NO: 436338 - DNA, 25 bp, Rattus norvegicus
ggcacctgcaagcacagcactggac

SEQ ID NO: 436339 - DNA, 25 bp, Rattus norvegicus
ggcacctgcaaggacagcactggac

SEQ ID NO: 436340 - DNA, 25 bp, Rattus norvegicus
ggcacctgcactaccaattgttaga

SEQ ID NO: 436341 - DNA, 25 bp, Rattus norvegicus
ggcacctgcacttccaattgttaga

SEQ ID NO: 436342 - DNA, 25 bp, Rattus norvegicus
ggcacctgcaggacatcggaacaca

SEQ ID NO: 436343 - DNA, 25 bp, Rattus norvegicus
ggcacctgcaggtcatcggaacaca

SEQ ID NO: 436344 - DNA, 25 bp, Rattus norvegicus
ggcacctgctacaaatcttgacaac

SEQ ID NO: 436345 - DNA, 25 bp, Rattus norvegicus
ggcacctgctactaatcttgacaac

SEQ ID NO: 436346 - DNA, 25 bp, Rattus norvegicus
ggcacctgctgcacattcagaagtg

SEQ ID NO: 436347 - DNA, 25 bp, Rattus norvegicus
ggcacctgctgctcattcagaagtg

SEQ ID NO: 436348 - DNA, 25 bp, Rattus norvegicus
ggcacctggataaccttctgttaac

SEQ ID NO: 436349 - DNA, 25 bp, Rattus norvegicus
ggcacctggatatccttctgttaac

SEQ ID NO: 436350 - DNA, 25 bp, Rattus norvegicus
ggcacctgggatcaactaaatttta

SEQ ID NO: 436351 - DNA, 25 bp, Rattus norvegicus
ggcacctgggatccttctaaaacaa

SEQ ID NO: 436352 - DNA, 25 bp, Rattus norvegicus
ggcacctgggatgaactaaatttta

SEQ ID NO: 436353 - DNA, 25 bp, Rattus norvegicus
ggcacctgggatgcttctaaaacaa

SEQ ID NO: 436354 - DNA, 25 bp, Rattus norvegicus
ggcacctgggcaactttatgctgtt

SEQ ID NO: 436355 - DNA, 25 bp, Rattus norvegicus
ggcacctgggcatctttatgctgtt

SEQ ID NO: 436356 - DNA, 25 bp, Rattus norvegicus
ggcacctggtggaatgaaactttca

SEQ ID NO: 436357 - DNA, 25 bp, Rattus norvegicus
ggcacctggtggtatgaaactttca

SEQ ID NO: 436358 - DNA, 25 bp, Rattus norvegicus
ggcacctgtaacaggccatagtgtc

SEQ ID NO: 436359 - DNA, 25 bp, Rattus norvegicus
ggcacctgtaactggccatagtgtc

SEQ ID NO: 436360 - DNA, 25 bp, Rattus norvegicus
ggcacctgtagtctacacttggcaa

SEQ ID NO: 436361 - DNA, 25 bp, Rattus norvegicus
ggcacctgtagtgtacacttggcaa

SEQ ID NO: 436362 - DNA, 25 bp, Rattus norvegicus
ggcacctgtcaaatactgaagcttt

SEQ ID NO: 436363 - DNA, 25 bp, Rattus norvegicus
ggcacctgtcaattactgaagcttt

SEQ ID NO: 436364 - DNA, 25 bp, Rattus norvegicus
ggcacctgtgagcaccttgcgagac

SEQ ID NO: 436365 - DNA, 25 bp, Rattus norvegicus
ggcacctgtgaggaccttgcgagac

SEQ ID NO: 436366 - DNA, 25 bp, Rattus norvegicus
ggcaccttaagaaccagactagact

SEQ ID NO: 436367 - DNA, 25 bp, Rattus norvegicus
ggcaccttaagatccagactagact

SEQ ID NO: 436368 - DNA, 25 bp, Rattus norvegicus
ggcaccttacgcacattcatagaaa

SEQ ID NO: 436369 - DNA, 25 bp, Rattus norvegicus
ggcaccttacgctcattcatagaaa

SEQ ID NO: 436370 - DNA, 25 bp, Rattus norvegicus
ggcaccttagttccatgaccacata

SEQ ID NO: 436371 - DNA, 25 bp, Rattus norvegicus
ggcaccttagttgcatgaccacata

SEQ ID NO: 436372 - DNA, 25 bp, Rattus norvegicus
ggcaccttccagacaactgcagtgg

SEQ ID NO: 436373 - DNA, 25 bp, Rattus norvegicus
ggcaccttccagtcaactgcagtgg

SEQ ID NO: 436374 - DNA, 25 bp, Rattus norvegicus
ggcaccttggtgacaaacgaccagt

SEQ ID NO: 436375 - DNA, 25 bp, Rattus norvegicus
ggcaccttggtgtcaaacgaccagt

SEQ ID NO: 436376 - DNA, 25 bp, Rattus norvegicus
ggcaccttgtcacctgaatcttcac

SEQ ID NO: 436377 - DNA, 25 bp, Rattus norvegicus
ggcaccttgtcagctgaatcttcac

SEQ ID NO: 436378 - DNA, 25 bp, Rattus norvegicus
ggcacctttcgcatgacatcaaata

SEQ ID NO: 436379 - DNA, 25 bp, Rattus norvegicus
ggcacctttcgcttgacatcaaata

SEQ ID NO: 436380 - DNA, 25 bp, Rattus norvegicus
ggcacctttcttaattagctacaat

SEQ ID NO: 436381 - DNA, 25 bp, Rattus norvegicus
ggcacctttctttattagctacaat

SEQ ID NO: 436382 - DNA, 25 bp, Rattus norvegicus
ggcacctttgacataatgctacttt

SEQ ID NO: 436383 - DNA, 25 bp, Rattus norvegicus
ggcacctttgacttaatgctacttt

SEQ ID NO: 436384 - DNA, 25 bp, Rattus norvegicus
ggcacgaaagtgaacgtattccgga

SEQ ID NO: 436385 - DNA, 25 bp, Rattus norvegicus
ggcacgaaagtgtacgtattccgga

SEQ ID NO: 436386 - DNA, 25 bp, Rattus norvegicus
ggcacgaagcccagctatcccgagg

SEQ ID NO: 436387 - DNA, 25 bp, Rattus norvegicus
ggcacgaagccctgctatcccgagg

SEQ ID NO: 436388 - DNA, 25 bp, Rattus norvegicus
ggcacgacagccatttccataaggt

SEQ ID NO: 436389 - DNA, 25 bp, Rattus norvegicus
ggcacgacagccttttccataaggt

SEQ ID NO: 436390 - DNA, 25 bp, Rattus norvegicus
ggcacgagagctagaggcttcagtt

SEQ ID NO: 436391 - DNA, 25 bp, Rattus norvegicus
ggcacgagagcttgaggcttcagtt

SEQ ID NO: 436392 - DNA, 25 bp, Rattus norvegicus
ggcacgagcgatccgggcagctgag

SEQ ID NO: 436393 - DNA, 25 bp, Rattus norvegicus
ggcacgagcgatgcgggcagctgag

SEQ ID NO: 436394 - DNA, 25 bp, Rattus norvegicus
ggcacgagtgctccctgttcgtctt

SEQ ID NO: 436395 - DNA, 25 bp, Rattus norvegicus
ggcacgagtgctgcctgttcgtctt

SEQ ID NO: 436396 - DNA, 25 bp, Rattus norvegicus
ggcacgatagccattcagacaccca

SEQ ID NO: 436397 - DNA, 25 bp, Rattus norvegicus
ggcacgatagcctttcagacaccca

SEQ ID NO: 436398 - DNA, 25 bp, Rattus norvegicus
ggcacgatcaagctcctatgcggat

SEQ ID NO: 436399 - DNA, 25 bp, Rattus norvegicus
ggcacgatcaaggtcctatgcggat

SEQ ID NO: 436400 - DNA, 25 bp, Rattus norvegicus
ggcacgatcactagaacgacgggct

SEQ ID NO: 436401 - DNA, 25 bp, Rattus norvegicus
ggcacgatcacttgaacgacgggct

SEQ ID NO: 436402 - DNA, 25 bp, Rattus norvegicus
ggcacgattgtacggcatttaaaat

SEQ ID NO: 436403 - DNA, 25 bp, Rattus norvegicus
ggcacgattgtagggcatttaaaat

SEQ ID NO: 436404 - DNA, 25 bp, Rattus norvegicus
ggcacgcacccaagacattgatgta

SEQ ID NO: 436405 - DNA, 25 bp, Rattus norvegicus
ggcacgcacccatgacattgatgta

SEQ ID NO: 436406 - DNA, 25 bp, Rattus norvegicus
ggcacgcacgcgcatgctcagagta

SEQ ID NO: 436407 - DNA, 25 bp, Rattus norvegicus
ggcacgcacgcggatgctcagagta

SEQ ID NO: 436408 - DNA, 25 bp, Rattus norvegicus
ggcacgcactataccaatgcagcag

SEQ ID NO: 436409 - DNA, 25 bp, Rattus norvegicus
ggcacgcactattccaatgcagcag

SEQ ID NO: 436410 - DNA, 25 bp, Rattus norvegicus
ggcacgcagacgaacccagtggcaa

SEQ ID NO: 436411 - DNA, 25 bp, Rattus norvegicus
ggcacgcagacgtacccagtggcaa

SEQ ID NO: 436412 - DNA, 25 bp, Rattus norvegicus
ggcacgcatgtgctacgcatgtata

SEQ ID NO: 436413 - DNA, 25 bp, Rattus norvegicus
ggcacgcatgtggtacgcatgtata

SEQ ID NO: 436414 - DNA, 25 bp, Rattus norvegicus
ggcacgcctgttaatgagcagcaat

SEQ ID NO: 436415 - DNA, 25 bp, Rattus norvegicus
ggcacgcctgtttatgagcagcaat

SEQ ID NO: 436416 - DNA, 25 bp, Rattus norvegicus
ggcacgctgagcatgagcagctcat

SEQ ID NO: 436417 - DNA, 25 bp, Rattus norvegicus
ggcacgctgagcttgagcagctcat

SEQ ID NO: 436418 - DNA, 25 bp, Rattus norvegicus
ggcacgctgtctcaggaccagtcta

SEQ ID NO: 436419 - DNA, 25 bp, Rattus norvegicus
ggcacgctgtctgaggaccagtcta

SEQ ID NO: 436420 - DNA, 25 bp, Rattus norvegicus
ggcacggagggcaagttcacttacc

SEQ ID NO: 436421 - DNA, 25 bp, Rattus norvegicus
ggcacggagggctagttcacttacc

SEQ ID NO: 436422 - DNA, 25 bp, Rattus norvegicus
ggcacggcaaagcacatattcaagt

SEQ ID NO: 436423 - DNA, 25 bp, Rattus norvegicus
ggcacggcaaaggacatattcaagt

SEQ ID NO: 436424 - DNA, 25 bp, Rattus norvegicus
ggcacggcaacgaggacaccatcag

SEQ ID NO: 436425 - DNA, 25 bp, Rattus norvegicus
ggcacggcaacgtggacaccatcag

SEQ ID NO: 436426 - DNA, 25 bp, Rattus norvegicus
ggcacggccatcctaatgctgaaga

SEQ ID NO: 436427 - DNA, 25 bp, Rattus norvegicus
ggcacggccatcgtaatgctgaaga

SEQ ID NO: 436428 - DNA, 25 bp, Rattus norvegicus
ggcacggccattaacggcacactgc

SEQ ID NO: 436429 - DNA, 25 bp, Rattus norvegicus
ggcacggccatttacggcacactgc

SEQ ID NO: 436430 - DNA, 25 bp, Rattus norvegicus
ggcacggcccacaaatatcagagac

SEQ ID NO: 436431 - DNA, 25 bp, Rattus norvegicus
ggcacggcccactaatatcagagac

SEQ ID NO: 436432 - DNA, 25 bp, Rattus norvegicus
ggcacggctgtgcacatccttaaat

SEQ ID NO: 436433 - DNA, 25 bp, Rattus norvegicus
ggcacggctgtggacatccttaaat

SEQ ID NO: 436434 - DNA, 25 bp, Rattus norvegicus
ggcacgggacagaacatgaagacat

SEQ ID NO: 436435 - DNA, 25 bp, Rattus norvegicus
ggcacgggacagtacatgaagacat

SEQ ID NO: 436436 - DNA, 25 bp, Rattus norvegicus
ggcacgggacgtatcagacattttc

SEQ ID NO: 436437 - DNA, 25 bp, Rattus norvegicus
ggcacgggacgtttcagacattttc

SEQ ID NO: 436438 - DNA, 25 bp, Rattus norvegicus
ggcacgggcgcgaagctctcgcact

SEQ ID NO: 436439 - DNA, 25 bp, Rattus norvegicus
ggcacgggcgcgtagctctcgcact

SEQ ID NO: 436440 - DNA, 25 bp, Rattus norvegicus
ggcacgggctgcaggataaacagta

SEQ ID NO: 436441 - DNA, 25 bp, Rattus norvegicus
ggcacgggctgctggataaacagta

SEQ ID NO: 436442 - DNA, 25 bp, Rattus norvegicus
ggcacgggtaataactctgctccaa

SEQ ID NO: 436443 - DNA, 25 bp, Rattus norvegicus
ggcacgggtaattactctgctccaa

SEQ ID NO: 436444 - DNA, 25 bp, Rattus norvegicus
ggcacggtctgtatactccttaaaa

SEQ ID NO: 436445 - DNA, 25 bp, Rattus norvegicus
ggcacggtctgtttactccttaaaa

SEQ ID NO: 436446 - DNA, 25 bp, Rattus norvegicus
ggcacggtgacacatgccgttgatt

SEQ ID NO: 436447 - DNA, 25 bp, Rattus norvegicus
ggcacggtgacagatgccgttgatt

SEQ ID NO: 436448 - DNA, 25 bp, Rattus norvegicus
ggcacgtacaagatccatgctctgg

SEQ ID NO: 436449 - DNA, 25 bp, Rattus norvegicus
ggcacgtacaagttccatgctctgg

SEQ ID NO: 436450 - DNA, 25 bp, Rattus norvegicus
ggcacgtactacatttgctctaagt

SEQ ID NO: 436451 - DNA, 25 bp, Rattus norvegicus
ggcacgtactacttttgctctaagt

SEQ ID NO: 436452 - DNA, 25 bp, Rattus norvegicus
ggcacgtcacagagcagcaccggga

SEQ ID NO: 436453 - DNA, 25 bp, Rattus norvegicus
ggcacgtcacagtgcagcaccggga

SEQ ID NO: 436454 - DNA, 25 bp, Rattus norvegicus
ggcacgtctatcaatgtgggtctta

SEQ ID NO: 436455 - DNA, 25 bp, Rattus norvegicus
ggcacgtctatctatgtgggtctta

SEQ ID NO: 436456 - DNA, 25 bp, Rattus norvegicus
ggcacgtcttatatgtactcatgag

SEQ ID NO: 436457 - DNA, 25 bp, Rattus norvegicus
ggcacgtcttatttgtactcatgag

SEQ ID NO: 436458 - DNA, 25 bp, Rattus norvegicus
ggcacgtgacacatacaaagctaat

SEQ ID NO: 436459 - DNA, 25 bp, Rattus norvegicus
ggcacgtgacacttacaaagctaat

SEQ ID NO: 436460 - DNA, 25 bp, Rattus norvegicus
ggcacgtgagttaaaagctcttttc

SEQ ID NO: 436461 - DNA, 25 bp, Rattus norvegicus
ggcacgtgagtttaaagctcttttc

SEQ ID NO: 436462 - DNA, 25 bp, Rattus norvegicus
ggcacgtgggccatttagaactccg

SEQ ID NO: 436463 - DNA, 25 bp, Rattus norvegicus
ggcacgtgggccttttagaactccg

SEQ ID NO: 436464 - DNA, 25 bp, Rattus norvegicus
ggcacgtgtagcaatgtttctttca

SEQ ID NO: 436465 - DNA, 25 bp, Rattus norvegicus
ggcacgtgtagctatgtttctttca

SEQ ID NO: 436466 - DNA, 25 bp, Rattus norvegicus
ggcacgtgtcctcggcagccaagtc

SEQ ID NO: 436467 - DNA, 25 bp, Rattus norvegicus
ggcacgtgtcctgggcagccaagtc

SEQ ID NO: 436468 - DNA, 25 bp, Rattus norvegicus
ggcacgtgtggcaattgctgctctc

SEQ ID NO: 436469 - DNA, 25 bp, Rattus norvegicus
ggcacgtgtggctattgctgctctc

SEQ ID NO: 436470 - DNA, 25 bp, Rattus norvegicus
ggcacgtgtgtaaatttctatcctt

SEQ ID NO: 436471 - DNA, 25 bp, Rattus norvegicus
ggcacgtgtgtatatttctatcctt

SEQ ID NO: 436472 - DNA, 25 bp, Rattus norvegicus
ggcacgttaactcttgcacttttga

SEQ ID NO: 436473 - DNA, 25 bp, Rattus norvegicus
ggcacgttaactgttgcacttttga

SEQ ID NO: 436474 - DNA, 25 bp, Rattus norvegicus
ggcacgttaagcaccattgttttct

SEQ ID NO: 436475 - DNA, 25 bp, Rattus norvegicus
ggcacgttaagctccattgttttct

SEQ ID NO: 436476 - DNA, 25 bp, Rattus norvegicus
ggcacgttctgaccatctgacggat

SEQ ID NO: 436477 - DNA, 25 bp, Rattus norvegicus
ggcacgttctgagcatctgacggat

SEQ ID NO: 436478 - DNA, 25 bp, Rattus norvegicus
ggcacgtttccaaaacatcatgtcc

SEQ ID NO: 436479 - DNA, 25 bp, Rattus norvegicus
ggcacgtttccataacatcatgtcc

SEQ ID NO: 436480 - DNA, 25 bp, Rattus norvegicus
ggcactaaatctaaaatcctgcaga

SEQ ID NO: 436481 - DNA, 25 bp, Rattus norvegicus
ggcactaaatcttaaatcctgcaga

SEQ ID NO: 436482 - DNA, 25 bp, Rattus norvegicus
ggcactaacccgctgtggtgtgtac

SEQ ID NO: 436483 - DNA, 25 bp, Rattus norvegicus
ggcactaacccggtgtggtgtgtac

SEQ ID NO: 436484 - DNA, 25 bp, Rattus norvegicus
ggcactaagtccctaggtcctgaag

SEQ ID NO: 436485 - DNA, 25 bp, Rattus norvegicus
ggcactaagtccgtaggtcctgaag

SEQ ID NO: 436486 - DNA, 25 bp, Rattus norvegicus
ggcactaagtgcagcatgtcgggaa

SEQ ID NO: 436487 - DNA, 25 bp, Rattus norvegicus
ggcactaagtgctgcatgtcgggaa

SEQ ID NO: 436488 - DNA, 25 bp, Rattus norvegicus
ggcactaatctgaagtcagtagctc

SEQ ID NO: 436489 - DNA, 25 bp, Rattus norvegicus
ggcactaatctgtagtcagtagctc

SEQ ID NO: 436490 - DNA, 25 bp, Rattus norvegicus
ggcactacccagattacttttatat

SEQ ID NO: 436491 - DNA, 25 bp, Rattus norvegicus
ggcactacccagtttacttttatat

SEQ ID NO: 436492 - DNA, 25 bp, Rattus norvegicus
ggcactactgaaaagcgtttgactc

SEQ ID NO: 436493 - DNA, 25 bp, Rattus norvegicus
ggcactactgaatagcgtttgactc

SEQ ID NO: 436494 - DNA, 25 bp, Rattus norvegicus
ggcactagaaaacatgtctttgcaa

SEQ ID NO: 436495 - DNA, 25 bp, Rattus norvegicus
ggcactagaaaagatgtctttgcaa

SEQ ID NO: 436496 - DNA, 25 bp, Rattus norvegicus
ggcactagaatcatttcctttcact

SEQ ID NO: 436497 - DNA, 25 bp, Rattus norvegicus
ggcactagaatcttttcctttcact

SEQ ID NO: 436498 - DNA, 25 bp, Rattus norvegicus
ggcactaggcagactccttttagga

SEQ ID NO: 436499 - DNA, 25 bp, Rattus norvegicus
ggcactaggcagtctccttttagga

SEQ ID NO: 436500 - DNA, 25 bp, Rattus norvegicus
ggcactaggttgaggctaaccccta

SEQ ID NO: 436501 - DNA, 25 bp, Rattus norvegicus
ggcactaggttgtggctaaccccta

SEQ ID NO: 436502 - DNA, 25 bp, Rattus norvegicus
ggcactatatcgagcctccttactt

SEQ ID NO: 436503 - DNA, 25 bp, Rattus norvegicus
ggcactatatcgtgcctccttactt

SEQ ID NO: 436504 - DNA, 25 bp, Rattus norvegicus
ggcactatctggagccacttttgat

SEQ ID NO: 436505 - DNA, 25 bp, Rattus norvegicus
ggcactatctggtgccacttttgat

SEQ ID NO: 436506 - DNA, 25 bp, Rattus norvegicus
ggcactatgatgcttggacggaact

SEQ ID NO: 436507 - DNA, 25 bp, Rattus norvegicus
ggcactatgatggttggacggaact

SEQ ID NO: 436508 - DNA, 25 bp, Rattus norvegicus
ggcactatggtaaagcagctcctca

SEQ ID NO: 436509 - DNA, 25 bp, Rattus norvegicus
ggcactatggtatagcagctcctca

SEQ ID NO: 436510 - DNA, 25 bp, Rattus norvegicus
ggcactattctgcatctgtcattaa

SEQ ID NO: 436511 - DNA, 25 bp, Rattus norvegicus
ggcactattctggatctgtcattaa

SEQ ID NO: 436512 - DNA, 25 bp, Rattus norvegicus
ggcactattgatacattacccaggt

SEQ ID NO: 436513 - DNA, 25 bp, Rattus norvegicus
ggcactattgattcattacccaggt

SEQ ID NO: 436514 - DNA, 25 bp, Rattus norvegicus
ggcactcaaacaacaacgcactgac

SEQ ID NO: 436515 - DNA, 25 bp, Rattus norvegicus
ggcactcaaacatcaacgcactgac

SEQ ID NO: 436516 - DNA, 25 bp, Rattus norvegicus
ggcactcaagtaaatgtcttcctga

SEQ ID NO: 436517 - DNA, 25 bp, Rattus norvegicus
ggcactcaagtatatgtcttcctga

SEQ ID NO: 436518 - DNA, 25 bp, Rattus norvegicus
ggcactcacatgcacatgttcttaa

SEQ ID NO: 436519 - DNA, 25 bp, Rattus norvegicus
ggcactcacatggacatgttcttaa

SEQ ID NO: 436520 - DNA, 25 bp, Rattus norvegicus
ggcactcacttgaggccaagccaga

SEQ ID NO: 436521 - DNA, 25 bp, Rattus norvegicus
ggcactcacttgtggccaagccaga

SEQ ID NO: 436522 - DNA, 25 bp, Rattus norvegicus
ggcactcagcaaacaactcaacctt

SEQ ID NO: 436523 - DNA, 25 bp, Rattus norvegicus
ggcactcagcaatcaactcaacctt

SEQ ID NO: 436524 - DNA, 25 bp, Rattus norvegicus
ggcactcagttgcaagagtccagca

SEQ ID NO: 436525 - DNA, 25 bp, Rattus norvegicus
ggcactcagttggaagagtccagca

SEQ ID NO: 436526 - DNA, 25 bp, Rattus norvegicus
ggcactcattagctacatctggtat

SEQ ID NO: 436527 - DNA, 25 bp, Rattus norvegicus
ggcactcattaggtacatctggtat

SEQ ID NO: 436528 - DNA, 25 bp, Rattus norvegicus
ggcactccgaggacctgaaagacat

SEQ ID NO: 436529 - DNA, 25 bp, Rattus norvegicus
ggcactccgaggtcctgaaagacat

SEQ ID NO: 436530 - DNA, 25 bp, Rattus norvegicus
ggcactccttacacacgaaaagctg

SEQ ID NO: 436531 - DNA, 25 bp, Rattus norvegicus
ggcactccttactcacgaaaagctg

SEQ ID NO: 436532 - DNA, 25 bp, Rattus norvegicus
ggcactcgcttcctgggagattaga

SEQ ID NO: 436533 - DNA, 25 bp, Rattus norvegicus
ggcactcgcttcgtgggagattaga

SEQ ID NO: 436534 - DNA, 25 bp, Rattus norvegicus
ggcactcggtatctatttgactgta

SEQ ID NO: 436535 - DNA, 25 bp, Rattus norvegicus
ggcactcggtatgtatttgactgta

SEQ ID NO: 436536 - DNA, 25 bp, Rattus norvegicus
ggcactcggtttagtcactatgtac

SEQ ID NO: 436537 - DNA, 25 bp, Rattus norvegicus
ggcactcggttttgtcactatgtac

SEQ ID NO: 436538 - DNA, 25 bp, Rattus norvegicus
ggcactcgtgtaaacagacactcat

SEQ ID NO: 436539 - DNA, 25 bp, Rattus norvegicus
ggcactcgtgtatacagacactcat

SEQ ID NO: 436540 - DNA, 25 bp, Rattus norvegicus
ggcactctacggatgcacgagaact

SEQ ID NO: 436541 - DNA, 25 bp, Rattus norvegicus
ggcactctacggttgcacgagaact

SEQ ID NO: 436542 - DNA, 25 bp, Rattus norvegicus
ggcactctacttcctgttacaggat

SEQ ID NO: 436543 - DNA, 25 bp, Rattus norvegicus
ggcactctacttgctgttacaggat

SEQ ID NO: 436544 - DNA, 25 bp, Rattus norvegicus
ggcactctcagaccctttcagaagt

SEQ ID NO: 436545 - DNA, 25 bp, Rattus norvegicus
ggcactctcagagcctttcagaagt

SEQ ID NO: 436546 - DNA, 25 bp, Rattus norvegicus
ggcactctcagcaaggatccaggct

SEQ ID NO: 436547 - DNA, 25 bp, Rattus norvegicus
ggcactctcagctaggatccaggct

SEQ ID NO: 436548 - DNA, 25 bp, Rattus norvegicus
ggcactctctatccagaggacttga

SEQ ID NO: 436549 - DNA, 25 bp, Rattus norvegicus
ggcactctctatgcagaggacttga

SEQ ID NO: 436550 - DNA, 25 bp, Rattus norvegicus
ggcactctctgtactggcacaggat

SEQ ID NO: 436551 - DNA, 25 bp, Rattus norvegicus
ggcactctctgttctggcacaggat

SEQ ID NO: 436552 - DNA, 25 bp, Rattus norvegicus
ggcactctgtctccttgatactaaa

SEQ ID NO: 436553 - DNA, 25 bp, Rattus norvegicus
ggcactctgtctgcttgatactaaa

SEQ ID NO: 436554 - DNA, 25 bp, Rattus norvegicus
ggcactctgtttactttaccaggac

SEQ ID NO: 436555 - DNA, 25 bp, Rattus norvegicus
ggcactctgttttctttaccaggac

SEQ ID NO: 436556 - DNA, 25 bp, Rattus norvegicus
ggcactcttaccctgagagactagt

SEQ ID NO: 436557 - DNA, 25 bp, Rattus norvegicus
ggcactcttaccgtgagagactagt

SEQ ID NO: 436558 - DNA, 25 bp, Rattus norvegicus
ggcactcttagtcgaacaagcgttt

SEQ ID NO: 436559 - DNA, 25 bp, Rattus norvegicus
ggcactcttagtggaacaagcgttt

SEQ ID NO: 436560 - DNA, 25 bp, Rattus norvegicus
ggcactcttattaccctggatgata

SEQ ID NO: 436561 - DNA, 25 bp, Rattus norvegicus
ggcactcttatttccctggatgata

SEQ ID NO: 436562 - DNA, 25 bp, Rattus norvegicus
ggcactgaaatcattgtttgagcac

SEQ ID NO: 436563 - DNA, 25 bp, Rattus norvegicus
ggcactgaaatctttgtttgagcac

SEQ ID NO: 436564 - DNA, 25 bp, Rattus norvegicus
ggcactgaacagaagctccagacct

SEQ ID NO: 436565 - DNA, 25 bp, Rattus norvegicus
ggcactgaacagtagctccagacct

SEQ ID NO: 436566 - DNA, 25 bp, Rattus norvegicus
ggcactgaacttagcacactgagct

SEQ ID NO: 436567 - DNA, 25 bp, Rattus norvegicus
ggcactgaactttgcacactgagct

SEQ ID NO: 436568 - DNA, 25 bp, Rattus norvegicus
ggcactgaagttatccaagccaaaa

SEQ ID NO: 436569 - DNA, 25 bp, Rattus norvegicus
ggcactgaagttttccaagccaaaa

SEQ ID NO: 436570 - DNA, 25 bp, Rattus norvegicus
ggcactgaatcacacgcaacactgt

SEQ ID NO: 436571 - DNA, 25 bp, Rattus norvegicus
ggcactgaatcagacgcaacactgt

SEQ ID NO: 436572 - DNA, 25 bp, Rattus norvegicus
ggcactgacaaaccccgcagagggt

SEQ ID NO: 436573 - DNA, 25 bp, Rattus norvegicus
ggcactgacaaagcccgcagagggt

SEQ ID NO: 436574 - DNA, 25 bp, Rattus norvegicus
ggcactgacctgagctcaaattttc

SEQ ID NO: 436575 - DNA, 25 bp, Rattus norvegicus
ggcactgacctgtgctcaaattttc

SEQ ID NO: 436576 - DNA, 25 bp, Rattus norvegicus
ggcactgactgtacaagctgatcaa

SEQ ID NO: 436577 - DNA, 25 bp, Rattus norvegicus
ggcactgactgttcaagctgatcaa

SEQ ID NO: 436578 - DNA, 25 bp, Rattus norvegicus
ggcactgagaacaacgctaaaaact

SEQ ID NO: 436579 - DNA, 25 bp, Rattus norvegicus
ggcactgagaactacgctaaaaact

SEQ ID NO: 436580 - DNA, 25 bp, Rattus norvegicus
ggcactgagcctctgaaacgctgtg

SEQ ID NO: 436581 - DNA, 25 bp, Rattus norvegicus
ggcactgagcctgtgaaacgctgtg

SEQ ID NO: 436582 - DNA, 25 bp, Rattus norvegicus
ggcactgagggcacattgtcaactc

SEQ ID NO: 436583 - DNA, 25 bp, Rattus norvegicus
ggcactgagggcactgacagcgtct

SEQ ID NO: 436584 - DNA, 25 bp, Rattus norvegicus
ggcactgagggctcattgtcaactc

SEQ ID NO: 436585 - DNA, 25 bp, Rattus norvegicus
ggcactgagggctctgacagcgtct

SEQ ID NO: 436586 - DNA, 25 bp, Rattus norvegicus
ggcactgatattcagcaccttcggg

SEQ ID NO: 436587 - DNA, 25 bp, Rattus norvegicus
ggcactgatattgagcaccttcggg

SEQ ID NO: 436588 - DNA, 25 bp, Rattus norvegicus
ggcactgatgacacctgagagctga

SEQ ID NO: 436589 - DNA, 25 bp, Rattus norvegicus
ggcactgatgactcctgagagctga

SEQ ID NO: 436590 - DNA, 25 bp, Rattus norvegicus
ggcactgatgatacacctatgagca

SEQ ID NO: 436591 - DNA, 25 bp, Rattus norvegicus
ggcactgatgattcacctatgagca

SEQ ID NO: 436592 - DNA, 25 bp, Rattus norvegicus
ggcactgcaaaaatgttcatgggtc

SEQ ID NO: 436593 - DNA, 25 bp, Rattus norvegicus
ggcactgcaaaattgttcatgggtc

SEQ ID NO: 436594 - DNA, 25 bp, Rattus norvegicus
ggcactgcaattatttcagcataac

SEQ ID NO: 436595 - DNA, 25 bp, Rattus norvegicus
ggcactgcaattttttcagcataac

SEQ ID NO: 436596 - DNA, 25 bp, Rattus norvegicus
ggcactgcacccacacttgaaaaga

SEQ ID NO: 436597 - DNA, 25 bp, Rattus norvegicus
ggcactgcaccctcacttgaaaaga

SEQ ID NO: 436598 - DNA, 25 bp, Rattus norvegicus
ggcactgcagagaacttctgtcatt

SEQ ID NO: 436599 - DNA, 25 bp, Rattus norvegicus
ggcactgcagagtacttctgtcatt

SEQ ID NO: 436600 - DNA, 25 bp, Rattus norvegicus
ggcactgcagcaagccctgggccaa

SEQ ID NO: 436601 - DNA, 25 bp, Rattus norvegicus
ggcactgcagcatgccctgggccaa

SEQ ID NO: 436602 - DNA, 25 bp, Rattus norvegicus
ggcactgcaggcagaagccgcagca

SEQ ID NO: 436603 - DNA, 25 bp, Rattus norvegicus
ggcactgcaggctgaagccgcagca

SEQ ID NO: 436604 - DNA, 25 bp, Rattus norvegicus
ggcactgcagggaactgcctgaaca

SEQ ID NO: 436605 - DNA, 25 bp, Rattus norvegicus
ggcactgcagggtactgcctgaaca

SEQ ID NO: 436606 - DNA, 25 bp, Rattus norvegicus
ggcactgcagtcaagtgtcagccaa

SEQ ID NO: 436607 - DNA, 25 bp, Rattus norvegicus
ggcactgcagtctagtgtcagccaa

SEQ ID NO: 436608 - DNA, 25 bp, Rattus norvegicus
ggcactgcagtgcttcatctatgac

SEQ ID NO: 436609 - DNA, 25 bp, Rattus norvegicus
ggcactgcagtggttcatctatgac

SEQ ID NO: 436610 - DNA, 25 bp, Rattus norvegicus
ggcactgccagaagggtcatttcga

SEQ ID NO: 436611 - DNA, 25 bp, Rattus norvegicus
ggcactgccagatgggtcatttcga

SEQ ID NO: 436612 - DNA, 25 bp, Rattus norvegicus
ggcactgcccaaacatggtacacag

SEQ ID NO: 436613 - DNA, 25 bp, Rattus norvegicus
ggcactgcccaatcatggtacacag

SEQ ID NO: 436614 - DNA, 25 bp, Rattus norvegicus
ggcactgccgtgatcttctgcacag

SEQ ID NO: 436615 - DNA, 25 bp, Rattus norvegicus
ggcactgccgtgttcttctgcacag

SEQ ID NO: 436616 - DNA, 25 bp, Rattus norvegicus
ggcactgcctcacaagtaataagag

SEQ ID NO: 436617 - DNA, 25 bp, Rattus norvegicus
ggcactgcctcagaagtaataagag

SEQ ID NO: 436618 - DNA, 25 bp, Rattus norvegicus
ggcactgcctggacagtccaaggaa

SEQ ID NO: 436619 - DNA, 25 bp, Rattus norvegicus
ggcactgcctggtcagtccaaggaa

SEQ ID NO: 436620 - DNA, 25 bp, Rattus norvegicus
ggcactgcggccaataaggacacag

SEQ ID NO: 436621 - DNA, 25 bp, Rattus norvegicus
ggcactgcggcctataaggacacag

SEQ ID NO: 436622 - DNA, 25 bp, Rattus norvegicus
ggcactgcgggtcctaagcacatat

SEQ ID NO: 436623 - DNA, 25 bp, Rattus norvegicus
ggcactgcgggtgctaagcacatat

SEQ ID NO: 436624 - DNA, 25 bp, Rattus norvegicus
ggcactgcgtgcatactactaaaat

SEQ ID NO: 436625 - DNA, 25 bp, Rattus norvegicus
ggcactgcgtgcttactactaaaat

SEQ ID NO: 436626 - DNA, 25 bp, Rattus norvegicus
ggcactgctcacagttgagtcatct

SEQ ID NO: 436627 - DNA, 25 bp, Rattus norvegicus
ggcactgctcactgttgagtcatct

SEQ ID NO: 436628 - DNA, 25 bp, Rattus norvegicus
ggcactgctgatcactcgaggccag

SEQ ID NO: 436629 - DNA, 25 bp, Rattus norvegicus
ggcactgctgatgactcgaggccag

SEQ ID NO: 436630 - DNA, 25 bp, Rattus norvegicus
ggcactgctggaatcttctgtccaa

SEQ ID NO: 436631 - DNA, 25 bp, Rattus norvegicus
ggcactgctggacaaatgtggactt

SEQ ID NO: 436632 - DNA, 25 bp, Rattus norvegicus
ggcactgctggagaaatgtggactt

SEQ ID NO: 436633 - DNA, 25 bp, Rattus norvegicus
ggcactgctggattcttctgtccaa

SEQ ID NO: 436634 - DNA, 25 bp, Rattus norvegicus
ggcactgctgtgcacatgatatgca

SEQ ID NO: 436635 - DNA, 25 bp, Rattus norvegicus
ggcactgctgtggacatgatatgca

SEQ ID NO: 436636 - DNA, 25 bp, Rattus norvegicus
ggcactgcttttctcaagttttcta

SEQ ID NO: 436637 - DNA, 25 bp, Rattus norvegicus
ggcactgcttttgtcaagttttcta

SEQ ID NO: 436638 - DNA, 25 bp, Rattus norvegicus
ggcactggacaactgctgtcgattt

SEQ ID NO: 436639 - DNA, 25 bp, Rattus norvegicus
ggcactggacaagtgctgtcgattt

SEQ ID NO: 436640 - DNA, 25 bp, Rattus norvegicus
ggcactggagaacgagacacactaa

SEQ ID NO: 436641 - DNA, 25 bp, Rattus norvegicus
ggcactggagaaggagacacactaa

SEQ ID NO: 436642 - DNA, 25 bp, Rattus norvegicus
ggcactggatgacccaataaacgaa

SEQ ID NO: 436643 - DNA, 25 bp, Rattus norvegicus
ggcactggatgagccaataaacgaa

SEQ ID NO: 436644 - DNA, 25 bp, Rattus norvegicus
ggcactggcacacctagatcttttt

SEQ ID NO: 436645 - DNA, 25 bp, Rattus norvegicus
ggcactggcacagctagatcttttt

SEQ ID NO: 436646 - DNA, 25 bp, Rattus norvegicus
ggcactggcattctctctgctcctg

SEQ ID NO: 436647 - DNA, 25 bp, Rattus norvegicus
ggcactggcattgtctctgctcctg

SEQ ID NO: 436648 - DNA, 25 bp, Rattus norvegicus
ggcactggccaaactaggtccgcgt

SEQ ID NO: 436649 - DNA, 25 bp, Rattus norvegicus
ggcactggccaatctaggtccgcgt

SEQ ID NO: 436650 - DNA, 25 bp, Rattus norvegicus
ggcactggccagctcatcaagggct

SEQ ID NO: 436651 - DNA, 25 bp, Rattus norvegicus
ggcactggccaggtcatcaagggct

SEQ ID NO: 436652 - DNA, 25 bp, Rattus norvegicus
ggcactggccatatttgtgatctgt

SEQ ID NO: 436653 - DNA, 25 bp, Rattus norvegicus
ggcactggccatttttgtgatctgt

SEQ ID NO: 436654 - DNA, 25 bp, Rattus norvegicus
ggcactggctgtcgaatttccggaa

SEQ ID NO: 436655 - DNA, 25 bp, Rattus norvegicus
ggcactggctgtggaatttccggaa

SEQ ID NO: 436656 - DNA, 25 bp, Rattus norvegicus
ggcactggcttcagtaatatttcct

SEQ ID NO: 436657 - DNA, 25 bp, Rattus norvegicus
ggcactggcttctgtaatatttcct

SEQ ID NO: 436658 - DNA, 25 bp, Rattus norvegicus
ggcactgggcatcacaaccggagtt

SEQ ID NO: 436659 - DNA, 25 bp, Rattus norvegicus
ggcactgggcatgacaaccggagtt

SEQ ID NO: 436660 - DNA, 25 bp, Rattus norvegicus
ggcactgggcctaaactagaatttt

SEQ ID NO: 436661 - DNA, 25 bp, Rattus norvegicus
ggcactgggcctctatttatttacc

SEQ ID NO: 436662 - DNA, 25 bp, Rattus norvegicus
ggcactgggcctgtatttatttacc

SEQ ID NO: 436663 - DNA, 25 bp, Rattus norvegicus
ggcactgggccttaactagaatttt

SEQ ID NO: 436664 - DNA, 25 bp, Rattus norvegicus
ggcactgggtgccttagccaaactt

SEQ ID NO: 436665 - DNA, 25 bp, Rattus norvegicus
ggcactgggtgcgttagccaaactt

SEQ ID NO: 436666 - DNA, 25 bp, Rattus norvegicus
ggcactggtaaacggctgcgcccca

SEQ ID NO: 436667 - DNA, 25 bp, Rattus norvegicus
ggcactggtaaagggctgcgcccca

SEQ ID NO: 436668 - DNA, 25 bp, Rattus norvegicus
ggcactggtacactaatcaacggat

SEQ ID NO: 436669 - DNA, 25 bp, Rattus norvegicus
ggcactggtacagtaatcaacggat

SEQ ID NO: 436670 - DNA, 25 bp, Rattus norvegicus
ggcactggtgttcaataaagatcta

SEQ ID NO: 436671 - DNA, 25 bp, Rattus norvegicus
ggcactggtgttgaataaagatcta

SEQ ID NO: 436672 - DNA, 25 bp, Rattus norvegicus
ggcactgtacacatgtgatgcacat

SEQ ID NO: 436673 - DNA, 25 bp, Rattus norvegicus
ggcactgtacacttgtgatgcacat

SEQ ID NO: 436674 - DNA, 25 bp, Rattus norvegicus
ggcactgtccttctgcagttcagag

SEQ ID NO: 436675 - DNA, 25 bp, Rattus norvegicus
ggcactgtccttgtgcagttcagag

SEQ ID NO: 436676 - DNA, 25 bp, Rattus norvegicus
ggcactgtctttatgttcataggct

SEQ ID NO: 436677 - DNA, 25 bp, Rattus norvegicus
ggcactgtctttttgttcataggct

SEQ ID NO: 436678 - DNA, 25 bp, Rattus norvegicus
ggcactgtgcaaaggagactatgac

SEQ ID NO: 436679 - DNA, 25 bp, Rattus norvegicus
ggcactgtgcaatggagactatgac

SEQ ID NO: 436680 - DNA, 25 bp, Rattus norvegicus
ggcactgtggagatcttgactctga

SEQ ID NO: 436681 - DNA, 25 bp, Rattus norvegicus
ggcactgtggagttcttgactctga

SEQ ID NO: 436682 - DNA, 25 bp, Rattus norvegicus
ggcactgtggcaccataccggttgc

SEQ ID NO: 436683 - DNA, 25 bp, Rattus norvegicus
ggcactgtggcagcataccggttgc

SEQ ID NO: 436684 - DNA, 25 bp, Rattus norvegicus
ggcactgtggtgagaccctctatta

SEQ ID NO: 436685 - DNA, 25 bp, Rattus norvegicus
ggcactgtggtgatgttgttgttcc

SEQ ID NO: 436686 - DNA, 25 bp, Rattus norvegicus
ggcactgtggtgtgaccctctatta

SEQ ID NO: 436687 - DNA, 25 bp, Rattus norvegicus
ggcactgtggtgttgttgttgttcc

SEQ ID NO: 436688 - DNA, 25 bp, Rattus norvegicus
ggcactgtgtgcaaaaaagcgcccc

SEQ ID NO: 436689 - DNA, 25 bp, Rattus norvegicus
ggcactgtgtgctaaaaagcgcccc

SEQ ID NO: 436690 - DNA, 25 bp, Rattus norvegicus
ggcactgtgtttctcttcaccggga

SEQ ID NO: 436691 - DNA, 25 bp, Rattus norvegicus
ggcactgtgtttgtcttcaccggga

SEQ ID NO: 436692 - DNA, 25 bp, Rattus norvegicus
ggcactgttctgcattgtttgtttc

SEQ ID NO: 436693 - DNA, 25 bp, Rattus norvegicus
ggcactgttctggattgtttgtttc

SEQ ID NO: 436694 - DNA, 25 bp, Rattus norvegicus
ggcactgtttagacatgcacattaa

SEQ ID NO: 436695 - DNA, 25 bp, Rattus norvegicus
ggcactgtttagtcatgcacattaa

SEQ ID NO: 436696 - DNA, 25 bp, Rattus norvegicus
ggcactgtttccatttcacatggga

SEQ ID NO: 436697 - DNA, 25 bp, Rattus norvegicus
ggcactgtttccttttcacatggga

SEQ ID NO: 436698 - DNA, 25 bp, Rattus norvegicus
ggcactgttttaatcatctgtatcc

SEQ ID NO: 436699 - DNA, 25 bp, Rattus norvegicus
ggcactgttttattcatctgtatcc

SEQ ID NO: 436700 - DNA, 25 bp, Rattus norvegicus
ggcacttaaaagctcatcctgggaa

SEQ ID NO: 436701 - DNA, 25 bp, Rattus norvegicus
ggcacttaaaaggtcatcctgggaa

SEQ ID NO: 436702 - DNA, 25 bp, Rattus norvegicus
ggcacttaaaggatgatcacgttat

SEQ ID NO: 436703 - DNA, 25 bp, Rattus norvegicus
ggcacttaaaggttgatcacgttat

SEQ ID NO: 436704 - DNA, 25 bp, Rattus norvegicus
ggcacttaactgacataccattttt

SEQ ID NO: 436705 - DNA, 25 bp, Rattus norvegicus
ggcacttaactgtcataccattttt

SEQ ID NO: 436706 - DNA, 25 bp, Rattus norvegicus
ggcacttacctaaaaatcccctgag

SEQ ID NO: 436707 - DNA, 25 bp, Rattus norvegicus
ggcacttacctataaatcccctgag

SEQ ID NO: 436708 - DNA, 25 bp, Rattus norvegicus
ggcacttagcgcagtctggttttaa

SEQ ID NO: 436709 - DNA, 25 bp, Rattus norvegicus
ggcacttagcgctgtctggttttaa

SEQ ID NO: 436710 - DNA, 25 bp, Rattus norvegicus
ggcacttagtgcatcagttagggct

SEQ ID NO: 436711 - DNA, 25 bp, Rattus norvegicus
ggcacttagtgcatccggaggagct

SEQ ID NO: 436712 - DNA, 25 bp, Rattus norvegicus
ggcacttagtgccaagccatgtgat

SEQ ID NO: 436713 - DNA, 25 bp, Rattus norvegicus
ggcacttagtgcgaagccatgtgat

SEQ ID NO: 436714 - DNA, 25 bp, Rattus norvegicus
ggcacttagtgcttcagttagggct

SEQ ID NO: 436715 - DNA, 25 bp, Rattus norvegicus
ggcacttagtgcttccggaggagct

SEQ ID NO: 436716 - DNA, 25 bp, Rattus norvegicus
ggcacttatgagacccagggtgagt

SEQ ID NO: 436717 - DNA, 25 bp, Rattus norvegicus
ggcacttatgagtcccagggtgagt

SEQ ID NO: 436718 - DNA, 25 bp, Rattus norvegicus
ggcacttccagaactcagacaaacc

SEQ ID NO: 436719 - DNA, 25 bp, Rattus norvegicus
ggcacttccagatctcagacaaacc

SEQ ID NO: 436720 - DNA, 25 bp, Rattus norvegicus
ggcacttcctatatataattctggt

SEQ ID NO: 436721 - DNA, 25 bp, Rattus norvegicus
ggcacttcctatttataattctggt

SEQ ID NO: 436722 - DNA, 25 bp, Rattus norvegicus
ggcacttcctggctaacagtagcaa

SEQ ID NO: 436723 - DNA, 25 bp, Rattus norvegicus
ggcacttcctgggtaacagtagcaa

SEQ ID NO: 436724 - DNA, 25 bp, Rattus norvegicus
ggcacttcctttcactcaaggttta

SEQ ID NO: 436725 - DNA, 25 bp, Rattus norvegicus
ggcacttcctttgactcaaggttta

SEQ ID NO: 436726 - DNA, 25 bp, Rattus norvegicus
ggcacttcgtttctgttgttagaaa

SEQ ID NO: 436727 - DNA, 25 bp, Rattus norvegicus
ggcacttcgtttgtgttgttagaaa

SEQ ID NO: 436728 - DNA, 25 bp, Rattus norvegicus
ggcacttctcatctgtttagttccg

SEQ ID NO: 436729 - DNA, 25 bp, Rattus norvegicus
ggcacttctcatgtgtttagttccg

SEQ ID NO: 436730 - DNA, 25 bp, Rattus norvegicus
ggcacttcttaaactccatagacac

SEQ ID NO: 436731 - DNA, 25 bp, Rattus norvegicus
ggcacttcttaatctccatagacac

SEQ ID NO: 436732 - DNA, 25 bp, Rattus norvegicus
ggcacttcttctagatatccaactc

SEQ ID NO: 436733 - DNA, 25 bp, Rattus norvegicus
ggcacttcttcttgatatccaactc

SEQ ID NO: 436734 - DNA, 25 bp, Rattus norvegicus
ggcacttgaattcgaaggacctctt

SEQ ID NO: 436735 - DNA, 25 bp, Rattus norvegicus
ggcacttgaattggaaggacctctt

SEQ ID NO: 436736 - DNA, 25 bp, Rattus norvegicus
ggcacttgacaccaacgattaggaa

SEQ ID NO: 436737 - DNA, 25 bp, Rattus norvegicus
ggcacttgacacgaacgattaggaa

SEQ ID NO: 436738 - DNA, 25 bp, Rattus norvegicus
ggcacttgcaatctaccttttgctc

SEQ ID NO: 436739 - DNA, 25 bp, Rattus norvegicus
ggcacttgcaatgtaccttttgctc

SEQ ID NO: 436740 - DNA, 25 bp, Rattus norvegicus
ggcacttgccttacttgaaactcat

SEQ ID NO: 436741 - DNA, 25 bp, Rattus norvegicus
ggcacttgcctttcttgaaactcat

SEQ ID NO: 436742 - DNA, 25 bp, Rattus norvegicus
ggcacttggaggattttgttgttat

SEQ ID NO: 436743 - DNA, 25 bp, Rattus norvegicus
ggcacttggaggtttttgttgttat

SEQ ID NO: 436744 - DNA, 25 bp, Rattus norvegicus
ggcacttggcttagtgaggacacaa

SEQ ID NO: 436745 - DNA, 25 bp, Rattus norvegicus
ggcacttggctttgtgaggacacaa

SEQ ID NO: 436746 - DNA, 25 bp, Rattus norvegicus
ggcacttgtattaaattccccacct

SEQ ID NO: 436747 - DNA, 25 bp, Rattus norvegicus
ggcacttgtatttaattccccacct

SEQ ID NO: 436748 - DNA, 25 bp, Rattus norvegicus
ggcacttgtcttaaagatagcttca

SEQ ID NO: 436749 - DNA, 25 bp, Rattus norvegicus
ggcacttgtctttaagatagcttca

SEQ ID NO: 436750 - DNA, 25 bp, Rattus norvegicus
ggcacttgtgtcatctttattacct

SEQ ID NO: 436751 - DNA, 25 bp, Rattus norvegicus
ggcacttgtgtcttctttattacct

SEQ ID NO: 436752 - DNA, 25 bp, Rattus norvegicus
ggcacttgtgttataaggtacatac

SEQ ID NO: 436753 - DNA, 25 bp, Rattus norvegicus
ggcacttgtgttttaaggtacatac

SEQ ID NO: 436754 - DNA, 25 bp, Rattus norvegicus
ggcacttgttccatgtgtttgctaa

SEQ ID NO: 436755 - DNA, 25 bp, Rattus norvegicus
ggcacttgttccttgtgtttgctaa

SEQ ID NO: 436756 - DNA, 25 bp, Rattus norvegicus
ggcacttgttgcaaaactggactac

SEQ ID NO: 436757 - DNA, 25 bp, Rattus norvegicus
ggcacttgttgcaaagttgcaggaa

SEQ ID NO: 436758 - DNA, 25 bp, Rattus norvegicus
ggcacttgttgctaaactggactac

SEQ ID NO: 436759 - DNA, 25 bp, Rattus norvegicus
ggcacttgttgctaagttgcaggaa

SEQ ID NO: 436760 - DNA, 25 bp, Rattus norvegicus
ggcactttaataatgcttgacacct

SEQ ID NO: 436761 - DNA, 25 bp, Rattus norvegicus
ggcactttaataatttcttttgaga

SEQ ID NO: 436762 - DNA, 25 bp, Rattus norvegicus
ggcactttaatattgcttgacacct

SEQ ID NO: 436763 - DNA, 25 bp, Rattus norvegicus
ggcactttaatattttcttttgaga

SEQ ID NO: 436764 - DNA, 25 bp, Rattus norvegicus
ggcactttatgtacccagttttaga

SEQ ID NO: 436765 - DNA, 25 bp, Rattus norvegicus
ggcactttatgttcccagttttaga

SEQ ID NO: 436766 - DNA, 25 bp, Rattus norvegicus
ggcactttattactgcatcccttta

SEQ ID NO: 436767 - DNA, 25 bp, Rattus norvegicus
ggcactttattagtgcatcccttta

SEQ ID NO: 436768 - DNA, 25 bp, Rattus norvegicus
ggcactttccacacctagaagtgta

SEQ ID NO: 436769 - DNA, 25 bp, Rattus norvegicus
ggcactttccactcctagaagtgta

SEQ ID NO: 436770 - DNA, 25 bp, Rattus norvegicus
ggcactttctatacatccccagtgg

SEQ ID NO: 436771 - DNA, 25 bp, Rattus norvegicus
ggcactttctattcatccccagtgg

SEQ ID NO: 436772 - DNA, 25 bp, Rattus norvegicus
ggcactttgaccactccaaggagtt

SEQ ID NO: 436773 - DNA, 25 bp, Rattus norvegicus
ggcactttgacctctccaaggagtt

SEQ ID NO: 436774 - DNA, 25 bp, Rattus norvegicus
ggcacttttctaacgtgcagtggga

SEQ ID NO: 436775 - DNA, 25 bp, Rattus norvegicus
ggcacttttctatcgtgcagtggga

SEQ ID NO: 436776 - DNA, 25 bp, Rattus norvegicus
ggcacttttgcaagagcaccggagc

SEQ ID NO: 436777 - DNA, 25 bp, Rattus norvegicus
ggcacttttgcatgagcaccggagc

SEQ ID NO: 436778 - DNA, 25 bp, Rattus norvegicus
ggcacttttgccacaatatcggcca

SEQ ID NO: 436779 - DNA, 25 bp, Rattus norvegicus
ggcacttttgcctcaatatcggcca

SEQ ID NO: 436780 - DNA, 25 bp, Rattus norvegicus
ggcacttttgggattttatactgac

SEQ ID NO: 436781 - DNA, 25 bp, Rattus norvegicus
ggcacttttgggtttttatactgac

SEQ ID NO: 436782 - DNA, 25 bp, Rattus norvegicus
ggcactttttccaccatttgtgttt

SEQ ID NO: 436783 - DNA, 25 bp, Rattus norvegicus
ggcactttttcctccatttgtgttt

SEQ ID NO: 436784 - DNA, 25 bp, Rattus norvegicus
ggcagaaaacatcgtggtcaccacc

SEQ ID NO: 436785 - DNA, 25 bp, Rattus norvegicus
ggcagaaaacatggtggtcaccacc

SEQ ID NO: 436786 - DNA, 25 bp, Rattus norvegicus
ggcagaaaactgatcaaccaaacta

SEQ ID NO: 436787 - DNA, 25 bp, Rattus norvegicus
ggcagaaaactgttcaaccaaacta

SEQ ID NO: 436788 - DNA, 25 bp, Rattus norvegicus
ggcagaaacacccacaaacgtaatt

SEQ ID NO: 436789 - DNA, 25 bp, Rattus norvegicus
ggcagaaacaccgacaaacgtaatt

SEQ ID NO: 436790 - DNA, 25 bp, Rattus norvegicus
ggcagaaaccatcccagctctctga

SEQ ID NO: 436791 - DNA, 25 bp, Rattus norvegicus
ggcagaaaccatgccagctctctga

SEQ ID NO: 436792 - DNA, 25 bp, Rattus norvegicus
ggcagaaactgcattcttcagctct

SEQ ID NO: 436793 - DNA, 25 bp, Rattus norvegicus
ggcagaaactgctttcttcagctct

SEQ ID NO: 436794 - DNA, 25 bp, Rattus norvegicus
ggcagaaagagactactgactccat

SEQ ID NO: 436795 - DNA, 25 bp, Rattus norvegicus
ggcagaaagagagtactgactccat

SEQ ID NO: 436796 - DNA, 25 bp, Rattus norvegicus
ggcagaaagcaacaggaccctagag

SEQ ID NO: 436797 - DNA, 25 bp, Rattus norvegicus
ggcagaaagcaagaggaccctagag

SEQ ID NO: 436798 - DNA, 25 bp, Rattus norvegicus
ggcagaaagcttacagacagccctg

SEQ ID NO: 436799 - DNA, 25 bp, Rattus norvegicus
ggcagaaagctttcagacagccctg

SEQ ID NO: 436800 - DNA, 25 bp, Rattus norvegicus
ggcagaacacatcttttctccttta

SEQ ID NO: 436801 - DNA, 25 bp, Rattus norvegicus
ggcagaacacatgttttctccttta

SEQ ID NO: 436802 - DNA, 25 bp, Rattus norvegicus
ggcagaacccagcaagctaccatac

SEQ ID NO: 436803 - DNA, 25 bp, Rattus norvegicus
ggcagaacccaggaagctaccatac

SEQ ID NO: 436804 - DNA, 25 bp, Rattus norvegicus
ggcagaacgcatagcagccatggac

SEQ ID NO: 436805 - DNA, 25 bp, Rattus norvegicus
ggcagaacgcattgcagccatggac

SEQ ID NO: 436806 - DNA, 25 bp, Rattus norvegicus
ggcagaacgccaaacttcgtgtcga

SEQ ID NO: 436807 - DNA, 25 bp, Rattus norvegicus
ggcagaacgccatacttcgtgtcga

SEQ ID NO: 436808 - DNA, 25 bp, Rattus norvegicus
ggcagaactaagactcgacactcct

SEQ ID NO: 436809 - DNA, 25 bp, Rattus norvegicus
ggcagaactaagtctcgacactcct

SEQ ID NO: 436810 - DNA, 25 bp, Rattus norvegicus
ggcagaactaccctctacataaaac

SEQ ID NO: 436811 - DNA, 25 bp, Rattus norvegicus
ggcagaactaccgtctacataaaac

SEQ ID NO: 436812 - DNA, 25 bp, Rattus norvegicus
ggcagaactcatctgtttttctctc

SEQ ID NO: 436813 - DNA, 25 bp, Rattus norvegicus
ggcagaactcatgtgtttttctctc

SEQ ID NO: 436814 - DNA, 25 bp, Rattus norvegicus
ggcagaactgctaggttgtcttttc

SEQ ID NO: 436815 - DNA, 25 bp, Rattus norvegicus
ggcagaactgcttggttgtcttttc

SEQ ID NO: 436816 - DNA, 25 bp, Rattus norvegicus
ggcagaactggtaaccttttgctct

SEQ ID NO: 436817 - DNA, 25 bp, Rattus norvegicus
ggcagaactggttaccttttgctct

SEQ ID NO: 436818 - DNA, 25 bp, Rattus norvegicus
ggcagaacttcgacagtacttccgg

SEQ ID NO: 436819 - DNA, 25 bp, Rattus norvegicus
ggcagaacttcgtcagtacttccgg

SEQ ID NO: 436820 - DNA, 25 bp, Rattus norvegicus
ggcagaagagccaaagcaacctttg

SEQ ID NO: 436821 - DNA, 25 bp, Rattus norvegicus
ggcagaagagcctaagcaacctttg

SEQ ID NO: 436822 - DNA, 25 bp, Rattus norvegicus
ggcagaagatcacccttgaggccgt

SEQ ID NO: 436823 - DNA, 25 bp, Rattus norvegicus
ggcagaagatcagccttgaggccgt

SEQ ID NO: 436824 - DNA, 25 bp, Rattus norvegicus
ggcagaagccttccagatgtaccag

SEQ ID NO: 436825 - DNA, 25 bp, Rattus norvegicus
ggcagaagccttgcagatgtaccag

SEQ ID NO: 436826 - DNA, 25 bp, Rattus norvegicus
ggcagaaggcagacctcgagtgctt

SEQ ID NO: 436827 - DNA, 25 bp, Rattus norvegicus
ggcagaaggcagtcctcgagtgctt

SEQ ID NO: 436828 - DNA, 25 bp, Rattus norvegicus
ggcagaagggacacaggctcacaaa

SEQ ID NO: 436829 - DNA, 25 bp, Rattus norvegicus
ggcagaagggactcaggctcacaaa

SEQ ID NO: 436830 - DNA, 25 bp, Rattus norvegicus
ggcagaatagtccacctttttcagc

SEQ ID NO: 436831 - DNA, 25 bp, Rattus norvegicus
ggcagaatagtcgacctttttcagc

SEQ ID NO: 436832 - DNA, 25 bp, Rattus norvegicus
ggcagaatcagcattgagtaactgt

SEQ ID NO: 436833 - DNA, 25 bp, Rattus norvegicus
ggcagaatcagctttgagtaactgt

SEQ ID NO: 436834 - DNA, 25 bp, Rattus norvegicus
ggcagaatctgcataggctttactt

SEQ ID NO: 436835 - DNA, 25 bp, Rattus norvegicus
ggcagaatctgccatttccaataaa

SEQ ID NO: 436836 - DNA, 25 bp, Rattus norvegicus
ggcagaatctgcgatttccaataaa

SEQ ID NO: 436837 - DNA, 25 bp, Rattus norvegicus
ggcagaatctgcttaggctttactt

SEQ ID NO: 436838 - DNA, 25 bp, Rattus norvegicus
ggcagaatgcagcacctcagctcag

SEQ ID NO: 436839 - DNA, 25 bp, Rattus norvegicus
ggcagaatgcaggacctcagctcag

SEQ ID NO: 436840 - DNA, 25 bp, Rattus norvegicus
ggcagaatgtctcccctagtatgtt

SEQ ID NO: 436841 - DNA, 25 bp, Rattus norvegicus
ggcagaatgtctgccctagtatgtt

SEQ ID NO: 436842 - DNA, 25 bp, Rattus norvegicus
ggcagaattctcatttccaagtgtt

SEQ ID NO: 436843 - DNA, 25 bp, Rattus norvegicus
ggcagaattctcttttccaagtgtt

SEQ ID NO: 436844 - DNA, 25 bp, Rattus norvegicus
ggcagaatttcaaataagtactttt

SEQ ID NO: 436845 - DNA, 25 bp, Rattus norvegicus
ggcagaatttcatataagtactttt

SEQ ID NO: 436846 - DNA, 25 bp, Rattus norvegicus
ggcagacaagaacgagggcttcccc

SEQ ID NO: 436847 - DNA, 25 bp, Rattus norvegicus
ggcagacaagaacgttcccaacctt

SEQ ID NO: 436848 - DNA, 25 bp, Rattus norvegicus
ggcagacaagaaggagggcttcccc

SEQ ID NO: 436849 - DNA, 25 bp, Rattus norvegicus
ggcagacaagaaggttcccaacctt

SEQ ID NO: 436850 - DNA, 25 bp, Rattus norvegicus
ggcagacaagttaggcctgggcttc

SEQ ID NO: 436851 - DNA, 25 bp, Rattus norvegicus
ggcagacaagtttggcctgggcttc

SEQ ID NO: 436852 - DNA, 25 bp, Rattus norvegicus
ggcagacactcaactttgtttacag

SEQ ID NO: 436853 - DNA, 25 bp, Rattus norvegicus
ggcagacactcatctttgtttacag

SEQ ID NO: 436854 - DNA, 25 bp, Rattus norvegicus
ggcagacagcaccatgatcgacaca

SEQ ID NO: 436855 - DNA, 25 bp, Rattus norvegicus
ggcagacagcacgatgatcgacaca

SEQ ID NO: 436856 - DNA, 25 bp, Rattus norvegicus
ggcagacaggcgacatccgcagtgt

SEQ ID NO: 436857 - DNA, 25 bp, Rattus norvegicus
ggcagacaggcgtcatccgcagtgt

SEQ ID NO: 436858 - DNA, 25 bp, Rattus norvegicus
ggcagacagtgaactccctcgtaaa

SEQ ID NO: 436859 - DNA, 25 bp, Rattus norvegicus
ggcagacagtgatctccctcgtaaa

SEQ ID NO: 436860 - DNA, 25 bp, Rattus norvegicus
ggcagacagttccagcaatgaccac

SEQ ID NO: 436861 - DNA, 25 bp, Rattus norvegicus
ggcagacagttcgagcaatgaccac

SEQ ID NO: 436862 - DNA, 25 bp, Rattus norvegicus
ggcagacatcaacggaacaccgctt

SEQ ID NO: 436863 - DNA, 25 bp, Rattus norvegicus
ggcagacatcaagggaacaccgctt

SEQ ID NO: 436864 - DNA, 25 bp, Rattus norvegicus
ggcagacatcagacaatgaggtcac

SEQ ID NO: 436865 - DNA, 25 bp, Rattus norvegicus
ggcagacatcagtcaatgaggtcac

SEQ ID NO: 436866 - DNA, 25 bp, Rattus norvegicus
ggcagacattctcagtcctgagttt

SEQ ID NO: 436867 - DNA, 25 bp, Rattus norvegicus
ggcagacattctgagtcctgagttt

SEQ ID NO: 436868 - DNA, 25 bp, Rattus norvegicus
ggcagacatttcatgcagaaccagg

SEQ ID NO: 436869 - DNA, 25 bp, Rattus norvegicus
ggcagacatttcttgcagaaccagg

SEQ ID NO: 436870 - DNA, 25 bp, Rattus norvegicus
ggcagaccaaccacatttcttttta

SEQ ID NO: 436871 - DNA, 25 bp, Rattus norvegicus
ggcagaccaacctcatttcttttta

SEQ ID NO: 436872 - DNA, 25 bp, Rattus norvegicus
ggcagaccacggagctacacaatgg

SEQ ID NO: 436873 - DNA, 25 bp, Rattus norvegicus
ggcagaccacggtgctacacaatgg

SEQ ID NO: 436874 - DNA, 25 bp, Rattus norvegicus
ggcagaccagccaaacagatttcta

SEQ ID NO: 436875 - DNA, 25 bp, Rattus norvegicus
ggcagaccagcctaacagatttcta

SEQ ID NO: 436876 - DNA, 25 bp, Rattus norvegicus
ggcagaccccagcttgtcacatggt

SEQ ID NO: 436877 - DNA, 25 bp, Rattus norvegicus
ggcagaccccaggttgtcacatggt

SEQ ID NO: 436878 - DNA, 25 bp, Rattus norvegicus
ggcagaccctctatttcaatggcac

SEQ ID NO: 436879 - DNA, 25 bp, Rattus norvegicus
ggcagaccctctttttcaatggcac

SEQ ID NO: 436880 - DNA, 25 bp, Rattus norvegicus
ggcagaccgtacaatccttcgatgt

SEQ ID NO: 436881 - DNA, 25 bp, Rattus norvegicus
ggcagaccgtactatccttcgatgt

SEQ ID NO: 436882 - DNA, 25 bp, Rattus norvegicus
ggcagacctaagagacctggcctca

SEQ ID NO: 436883 - DNA, 25 bp, Rattus norvegicus
ggcagacctaagtgacctggcctca

SEQ ID NO: 436884 - DNA, 25 bp, Rattus norvegicus
ggcagacctactaacattccccttg

SEQ ID NO: 436885 - DNA, 25 bp, Rattus norvegicus
ggcagacctacttacattccccttg

SEQ ID NO: 436886 - DNA, 25 bp, Rattus norvegicus
ggcagacctcggaaagaaaacaaat

SEQ ID NO: 436887 - DNA, 25 bp, Rattus norvegicus
ggcagacctcggtaagaaaacaaat

SEQ ID NO: 436888 - DNA, 25 bp, Rattus norvegicus
ggcagacgaaatccctagaatccca

SEQ ID NO: 436889 - DNA, 25 bp, Rattus norvegicus
ggcagacgaaatgcctagaatccca

SEQ ID NO: 436890 - DNA, 25 bp, Rattus norvegicus
ggcagacgctacagatggacagcaa

SEQ ID NO: 436891 - DNA, 25 bp, Rattus norvegicus
ggcagacgctactgatggacagcaa

SEQ ID NO: 436892 - DNA, 25 bp, Rattus norvegicus
ggcagacgtgagattccctgggcaa

SEQ ID NO: 436893 - DNA, 25 bp, Rattus norvegicus
ggcagacgtgagtttccctgggcaa

SEQ ID NO: 436894 - DNA, 25 bp, Rattus norvegicus
ggcagacgtggcactcatttaagaa

SEQ ID NO: 436895 - DNA, 25 bp, Rattus norvegicus
ggcagacgtggctctcatttaagaa

SEQ ID NO: 436896 - DNA, 25 bp, Rattus norvegicus
ggcagacgtgtcaatcaggaacagt

SEQ ID NO: 436897 - DNA, 25 bp, Rattus norvegicus
ggcagacgtgtctatcaggaacagt

SEQ ID NO: 436898 - DNA, 25 bp, Rattus norvegicus
ggcagactacagctatcttcacatg

SEQ ID NO: 436899 - DNA, 25 bp, Rattus norvegicus
ggcagactacaggtatcttcacatg

SEQ ID NO: 436900 - DNA, 25 bp, Rattus norvegicus
ggcagactagtcagaccccgtggaa

SEQ ID NO: 436901 - DNA, 25 bp, Rattus norvegicus
ggcagactagtctgaccccgtggaa

SEQ ID NO: 436902 - DNA, 25 bp, Rattus norvegicus
ggcagactcagtcaccagtacagta

SEQ ID NO: 436903 - DNA, 25 bp, Rattus norvegicus
ggcagactcagtgaccagtacagta

SEQ ID NO: 436904 - DNA, 25 bp, Rattus norvegicus
ggcagactcctgagtcatatgatca

SEQ ID NO: 436905 - DNA, 25 bp, Rattus norvegicus
ggcagactcctgtgtcatatgatca

SEQ ID NO: 436906 - DNA, 25 bp, Rattus norvegicus
ggcagactccttcctgttttacagg

SEQ ID NO: 436907 - DNA, 25 bp, Rattus norvegicus
ggcagactccttgctgttttacagg

SEQ ID NO: 436908 - DNA, 25 bp, Rattus norvegicus
ggcagactcgaaaagattctcattg

SEQ ID NO: 436909 - DNA, 25 bp, Rattus norvegicus
ggcagactcgaatagattctcattg

SEQ ID NO: 436910 - DNA, 25 bp, Rattus norvegicus
ggcagactgcaaagggcacagttat

SEQ ID NO: 436911 - DNA, 25 bp, Rattus norvegicus
ggcagactgcaatgggcacagttat

SEQ ID NO: 436912 - DNA, 25 bp, Rattus norvegicus
ggcagactgcctaagagacctgtgt

SEQ ID NO: 436913 - DNA, 25 bp, Rattus norvegicus
ggcagactgccttagagacctgtgt

SEQ ID NO: 436914 - DNA, 25 bp, Rattus norvegicus
ggcagactgtaaccccagattcagg

SEQ ID NO: 436915 - DNA, 25 bp, Rattus norvegicus
ggcagactgtaagcccagattcagg

SEQ ID NO: 436916 - DNA, 25 bp, Rattus norvegicus
ggcagactgtctactaacagccatt

SEQ ID NO: 436917 - DNA, 25 bp, Rattus norvegicus
ggcagactgtcttctaacagccatt

SEQ ID NO: 436918 - DNA, 25 bp, Rattus norvegicus
ggcagacttcaccaagctgaacgac

SEQ ID NO: 436919 - DNA, 25 bp, Rattus norvegicus
ggcagacttcacgaagctgaacgac

SEQ ID NO: 436920 - DNA, 25 bp, Rattus norvegicus
ggcagacttcagatcattacctagt

SEQ ID NO: 436921 - DNA, 25 bp, Rattus norvegicus
ggcagacttcagttcattacctagt

SEQ ID NO: 436922 - DNA, 25 bp, Rattus norvegicus
ggcagacttctaagattcaaggcca

SEQ ID NO: 436923 - DNA, 25 bp, Rattus norvegicus
ggcagacttctatgattcaaggcca

SEQ ID NO: 436924 - DNA, 25 bp, Rattus norvegicus
ggcagacttgcccatgacagcatca

SEQ ID NO: 436925 - DNA, 25 bp, Rattus norvegicus
ggcagacttgccgatgacagcatca

SEQ ID NO: 436926 - DNA, 25 bp, Rattus norvegicus
ggcagacttggtactggatttccag

SEQ ID NO: 436927 - DNA, 25 bp, Rattus norvegicus
ggcagacttggttctggatttccag

SEQ ID NO: 436928 - DNA, 25 bp, Rattus norvegicus
ggcagacttgtgaggccacccgtaa

SEQ ID NO: 436929 - DNA, 25 bp, Rattus norvegicus
ggcagacttgtgtggccacccgtaa

SEQ ID NO: 436930 - DNA, 25 bp, Rattus norvegicus
ggcagactttcaactgtcctaatgt

SEQ ID NO: 436931 - DNA, 25 bp, Rattus norvegicus
ggcagactttcatctgtcctaatgt

SEQ ID NO: 436932 - DNA, 25 bp, Rattus norvegicus
ggcagactttgcacttactgcagtg

SEQ ID NO: 436933 - DNA, 25 bp, Rattus norvegicus
ggcagactttgctcttactgcagtg

SEQ ID NO: 436934 - DNA, 25 bp, Rattus norvegicus
ggcagagaacggaccaagaccttca

SEQ ID NO: 436935 - DNA, 25 bp, Rattus norvegicus
ggcagagaacggtccaagaccttca

SEQ ID NO: 436936 - DNA, 25 bp, Rattus norvegicus
ggcagagaaggaaacccaaaggaag

SEQ ID NO: 436937 - DNA, 25 bp, Rattus norvegicus
ggcagagaaggatacccaaaggaag

SEQ ID NO: 436938 - DNA, 25 bp, Rattus norvegicus
ggcagagaaggcaccggtttaccat

SEQ ID NO: 436939 - DNA, 25 bp, Rattus norvegicus
ggcagagaaggctccggtttaccat

SEQ ID NO: 436940 - DNA, 25 bp, Rattus norvegicus
ggcagagaattacatcatgccttct

SEQ ID NO: 436941 - DNA, 25 bp, Rattus norvegicus
ggcagagaattagatcatgccttct

SEQ ID NO: 436942 - DNA, 25 bp, Rattus norvegicus
ggcagagaattccaggccctgagaa

SEQ ID NO: 436943 - DNA, 25 bp, Rattus norvegicus
ggcagagaattcgaggccctgagaa

SEQ ID NO: 436944 - DNA, 25 bp, Rattus norvegicus
ggcagagacagtagcatggatttct

SEQ ID NO: 436945 - DNA, 25 bp, Rattus norvegicus
ggcagagacagttgcatggatttct

SEQ ID NO: 436946 - DNA, 25 bp, Rattus norvegicus
ggcagagacattaaaatcctccatg

SEQ ID NO: 436947 - DNA, 25 bp, Rattus norvegicus
ggcagagacatttaaatcctccatg

SEQ ID NO: 436948 - DNA, 25 bp, Rattus norvegicus
ggcagagacggtacagcacagcact

SEQ ID NO: 436949 - DNA, 25 bp, Rattus norvegicus
ggcagagacggttcagcacagcact

SEQ ID NO: 436950 - DNA, 25 bp, Rattus norvegicus
ggcagagactcaacatcagaccgta

SEQ ID NO: 436951 - DNA, 25 bp, Rattus norvegicus
ggcagagactcatcatcagaccgta

SEQ ID NO: 436952 - DNA, 25 bp, Rattus norvegicus
ggcagagagcagataaccccatctt

SEQ ID NO: 436953 - DNA, 25 bp, Rattus norvegicus
ggcagagagcagttaaccccatctt

SEQ ID NO: 436954 - DNA, 25 bp, Rattus norvegicus
ggcagagagctcagagtccgagtct

SEQ ID NO: 436955 - DNA, 25 bp, Rattus norvegicus
ggcagagagctctgagtccgagtct

SEQ ID NO: 436956 - DNA, 25 bp, Rattus norvegicus
ggcagagagctgacgtgtccatttc

SEQ ID NO: 436957 - DNA, 25 bp, Rattus norvegicus
ggcagagagctgtcgtgtccatttc

SEQ ID NO: 436958 - DNA, 25 bp, Rattus norvegicus
ggcagagaggcccttgctgtctaac

SEQ ID NO: 436959 - DNA, 25 bp, Rattus norvegicus
ggcagagaggccgttgctgtctaac

SEQ ID NO: 436960 - DNA, 25 bp, Rattus norvegicus
ggcagagatcctaactttgatacta

SEQ ID NO: 436961 - DNA, 25 bp, Rattus norvegicus
ggcagagatccttactttgatacta

SEQ ID NO: 436962 - DNA, 25 bp, Rattus norvegicus
ggcagagatgagcactcctgacccc

SEQ ID NO: 436963 - DNA, 25 bp, Rattus norvegicus
ggcagagatgaggactcctgacccc

SEQ ID NO: 436964 - DNA, 25 bp, Rattus norvegicus
ggcagagatgatctttcgcccaccg

SEQ ID NO: 436965 - DNA, 25 bp, Rattus norvegicus
ggcagagatgatgtttcgcccaccg

SEQ ID NO: 436966 - DNA, 25 bp, Rattus norvegicus
ggcagagatgccacattttcatagc

SEQ ID NO: 436967 - DNA, 25 bp, Rattus norvegicus
ggcagagatgcctcattttcatagc

SEQ ID NO: 436968 - DNA, 25 bp, Rattus norvegicus
ggcagagcaagcagcattcacgaga

SEQ ID NO: 436969 - DNA, 25 bp, Rattus norvegicus
ggcagagcaagctgcattcacgaga

SEQ ID NO: 436970 - DNA, 25 bp, Rattus norvegicus
ggcagagcaagtccaagtccaagag

SEQ ID NO: 436971 - DNA, 25 bp, Rattus norvegicus
ggcagagcaagtgcaagtccaagag

SEQ ID NO: 436972 - DNA, 25 bp, Rattus norvegicus
ggcagagcagccattgtgttttcca

SEQ ID NO: 436973 - DNA, 25 bp, Rattus norvegicus
ggcagagcagcctttgtgttttcca

SEQ ID NO: 436974 - DNA, 25 bp, Rattus norvegicus
ggcagagcagtgctcatgtccagat

SEQ ID NO: 436975 - DNA, 25 bp, Rattus norvegicus
ggcagagcagtggtcatgtccagat

SEQ ID NO: 436976 - DNA, 25 bp, Rattus norvegicus
ggcagagcatccatgaaggcgtcaa

SEQ ID NO: 436977 - DNA, 25 bp, Rattus norvegicus
ggcagagcatccttgaaggcgtcaa

SEQ ID NO: 436978 - DNA, 25 bp, Rattus norvegicus
ggcagagcatcgacttcaagcaagt

SEQ ID NO: 436979 - DNA, 25 bp, Rattus norvegicus
ggcagagcatcgtcttcaagcaagt

SEQ ID NO: 436980 - DNA, 25 bp, Rattus norvegicus
ggcagagcattactgcagactttct

SEQ ID NO: 436981 - DNA, 25 bp, Rattus norvegicus
ggcagagcattagtgcagactttct

SEQ ID NO: 436982 - DNA, 25 bp, Rattus norvegicus
ggcagagcccagctatgaggtccca

SEQ ID NO: 436983 - DNA, 25 bp, Rattus norvegicus
ggcagagcccaggtatgaggtccca

SEQ ID NO: 436984 - DNA, 25 bp, Rattus norvegicus
ggcagagccttgagcaacagcagaa

SEQ ID NO: 436985 - DNA, 25 bp, Rattus norvegicus
ggcagagccttgtgcaacagcagaa

SEQ ID NO: 436986 - DNA, 25 bp, Rattus norvegicus
ggcagagctctaaatggcttttaaa

SEQ ID NO: 436987 - DNA, 25 bp, Rattus norvegicus
ggcagagctctaccctgaagatata

SEQ ID NO: 436988 - DNA, 25 bp, Rattus norvegicus
ggcagagctctacgccagtcagtat

SEQ ID NO: 436989 - DNA, 25 bp, Rattus norvegicus
ggcagagctctagcctgaagatata

SEQ ID NO: 436990 - DNA, 25 bp, Rattus norvegicus
ggcagagctctaggccagtcagtat

SEQ ID NO: 436991 - DNA, 25 bp, Rattus norvegicus
ggcagagctctatatggcttttaaa

SEQ ID NO: 436992 - DNA, 25 bp, Rattus norvegicus
ggcagagctgaaatgctctctcggg

SEQ ID NO: 436993 - DNA, 25 bp, Rattus norvegicus
ggcagagctgaattgctctctcggg

SEQ ID NO: 436994 - DNA, 25 bp, Rattus norvegicus
ggcagagctgctaatgctttacgta

SEQ ID NO: 436995 - DNA, 25 bp, Rattus norvegicus
ggcagagctgcttatgctttacgta

SEQ ID NO: 436996 - DNA, 25 bp, Rattus norvegicus
ggcagagctggaacctatgcacaga

SEQ ID NO: 436997 - DNA, 25 bp, Rattus norvegicus
ggcagagctggatcctatgcacaga

SEQ ID NO: 436998 - DNA, 25 bp, Rattus norvegicus
ggcagagctgtcaaatgtttggaat

SEQ ID NO: 436999 - DNA, 25 bp, Rattus norvegicus
ggcagagctgtctaatgtttggaat

SEQ ID NO: 437000 - DNA, 25 bp, Rattus norvegicus
ggcagagcttccaagatttaaaaca

SEQ ID NO: 437001 - DNA, 25 bp, Rattus norvegicus
ggcagagcttcctagatttaaaaca

SEQ ID NO: 437002 - DNA, 25 bp, Rattus norvegicus
ggcagaggaaccaccacagtgcata

SEQ ID NO: 437003 - DNA, 25 bp, Rattus norvegicus
ggcagaggaacctccacagtgcata

SEQ ID NO: 437004 - DNA, 25 bp, Rattus norvegicus
ggcagaggaatgacactttctcaaa

SEQ ID NO: 437005 - DNA, 25 bp, Rattus norvegicus
ggcagaggaatgtcactttctcaaa

SEQ ID NO: 437006 - DNA, 25 bp, Rattus norvegicus
ggcagaggacccatcagccgagcat

SEQ ID NO: 437007 - DNA, 25 bp, Rattus norvegicus
ggcagaggacccttcagccgagcat

SEQ ID NO: 437008 - DNA, 25 bp, Rattus norvegicus
ggcagaggagcaagtggtattcacc

SEQ ID NO: 437009 - DNA, 25 bp, Rattus norvegicus
ggcagaggagcatgtggtattcacc

SEQ ID NO: 437010 - DNA, 25 bp, Rattus norvegicus
ggcagaggaggtccggccccgtctg

SEQ ID NO: 437011 - DNA, 25 bp, Rattus norvegicus
ggcagaggaggtgcggccccgtctg

SEQ ID NO: 437012 - DNA, 25 bp, Rattus norvegicus
ggcagaggcaggcttatttctataa

SEQ ID NO: 437013 - DNA, 25 bp, Rattus norvegicus
ggcagaggcagggttatttctataa

SEQ ID NO: 437014 - DNA, 25 bp, Rattus norvegicus
ggcagaggcttcagccagcctaaga

SEQ ID NO: 437015 - DNA, 25 bp, Rattus norvegicus
ggcagaggcttctgccagcctaaga

SEQ ID NO: 437016 - DNA, 25 bp, Rattus norvegicus
ggcagaggcttgaaaattttatcca

SEQ ID NO: 437017 - DNA, 25 bp, Rattus norvegicus
ggcagaggcttgtaaattttatcca

SEQ ID NO: 437018 - DNA, 25 bp, Rattus norvegicus
ggcagagggaggactctcttttgcc

SEQ ID NO: 437019 - DNA, 25 bp, Rattus norvegicus
ggcagagggaggtctctcttttgcc

SEQ ID NO: 437020 - DNA, 25 bp, Rattus norvegicus
ggcagagggcagaactgataactta

SEQ ID NO: 437021 - DNA, 25 bp, Rattus norvegicus
ggcagagggcagagacatcatagtt

SEQ ID NO: 437022 - DNA, 25 bp, Rattus norvegicus
ggcagagggcagtactgataactta

SEQ ID NO: 437023 - DNA, 25 bp, Rattus norvegicus
ggcagagggcagtgacatcatagtt

SEQ ID NO: 437024 - DNA, 25 bp, Rattus norvegicus
ggcagagggcgtaaatctaattgtt

SEQ ID NO: 437025 - DNA, 25 bp, Rattus norvegicus
ggcagagggcgttaatctaattgtt

SEQ ID NO: 437026 - DNA, 25 bp, Rattus norvegicus
ggcagagggtgcagaaccccttgac

SEQ ID NO: 437027 - DNA, 25 bp, Rattus norvegicus
ggcagagggtgctgaaccccttgac

SEQ ID NO: 437028 - DNA, 25 bp, Rattus norvegicus
ggcagaggtccaagtaaaccatctt

SEQ ID NO: 437029 - DNA, 25 bp, Rattus norvegicus
ggcagaggtccatgtaaaccatctt

SEQ ID NO: 437030 - DNA, 25 bp, Rattus norvegicus
ggcagaggtcgcactagttctgaga

SEQ ID NO: 437031 - DNA, 25 bp, Rattus norvegicus
ggcagaggtcgctctagttctgaga

SEQ ID NO: 437032 - DNA, 25 bp, Rattus norvegicus
ggcagaggtgccaatgtcaagctga

SEQ ID NO: 437033 - DNA, 25 bp, Rattus norvegicus
ggcagaggtgcctatgtcaagctga

SEQ ID NO: 437034 - DNA, 25 bp, Rattus norvegicus
ggcagagtacatctgggttcccttc

SEQ ID NO: 437035 - DNA, 25 bp, Rattus norvegicus
ggcagagtacatgtgggttcccttc

SEQ ID NO: 437036 - DNA, 25 bp, Rattus norvegicus
ggcagagtatccaggtggaactttt

SEQ ID NO: 437037 - DNA, 25 bp, Rattus norvegicus
ggcagagtatcctggtggaactttt

SEQ ID NO: 437038 - DNA, 25 bp, Rattus norvegicus
ggcagagtcataattcagattcagt

SEQ ID NO: 437039 - DNA, 25 bp, Rattus norvegicus
ggcagagtcatatttcagattcagt

SEQ ID NO: 437040 - DNA, 25 bp, Rattus norvegicus
ggcagagtccccaaaacaagtgttt

SEQ ID NO: 437041 - DNA, 25 bp, Rattus norvegicus
ggcagagtcccctaaacaagtgttt

SEQ ID NO: 437042 - DNA, 25 bp, Rattus norvegicus
ggcagagtctgccatggctacatct

SEQ ID NO: 437043 - DNA, 25 bp, Rattus norvegicus
ggcagagtctgcgatggctacatct

SEQ ID NO: 437044 - DNA, 25 bp, Rattus norvegicus
ggcagagtcttcagctcacagccta

SEQ ID NO: 437045 - DNA, 25 bp, Rattus norvegicus
ggcagagtcttctgctcacagccta

SEQ ID NO: 437046 - DNA, 25 bp, Rattus norvegicus
ggcagagtgtctctccaacatcaca

SEQ ID NO: 437047 - DNA, 25 bp, Rattus norvegicus
ggcagagtgtctgtccaacatcaca

SEQ ID NO: 437048 - DNA, 25 bp, Rattus norvegicus
ggcagagttagaacctcacatcctg

SEQ ID NO: 437049 - DNA, 25 bp, Rattus norvegicus
ggcagagttagatcctcacatcctg

SEQ ID NO: 437050 - DNA, 25 bp, Rattus norvegicus
ggcagagttattatcctgtttacat

SEQ ID NO: 437051 - DNA, 25 bp, Rattus norvegicus
ggcagagttattttcctgtttacat

SEQ ID NO: 437052 - DNA, 25 bp, Rattus norvegicus
ggcagagttcggctacagctcaaac

SEQ ID NO: 437053 - DNA, 25 bp, Rattus norvegicus
ggcagagttcgggtacagctcaaac

SEQ ID NO: 437054 - DNA, 25 bp, Rattus norvegicus
ggcagagttctgactagcttaggaa

SEQ ID NO: 437055 - DNA, 25 bp, Rattus norvegicus
ggcagagttctgtctagcttaggaa

SEQ ID NO: 437056 - DNA, 25 bp, Rattus norvegicus
ggcagagttgccatgtttactgact

SEQ ID NO: 437057 - DNA, 25 bp, Rattus norvegicus
ggcagagttgccttgtttactgact

SEQ ID NO: 437058 - DNA, 25 bp, Rattus norvegicus
ggcagataaggccacacatcatatg

SEQ ID NO: 437059 - DNA, 25 bp, Rattus norvegicus
ggcagataaggcgacacatcatatg

SEQ ID NO: 437060 - DNA, 25 bp, Rattus norvegicus
ggcagatacagtaacttcaggtttt

SEQ ID NO: 437061 - DNA, 25 bp, Rattus norvegicus
ggcagatacagttacttcaggtttt

SEQ ID NO: 437062 - DNA, 25 bp, Rattus norvegicus
ggcagatagactcaactctctcatg

SEQ ID NO: 437063 - DNA, 25 bp, Rattus norvegicus
ggcagatagactgaactctctcatg

SEQ ID NO: 437064 - DNA, 25 bp, Rattus norvegicus
ggcagatagcagcacttaactccct

SEQ ID NO: 437065 - DNA, 25 bp, Rattus norvegicus
ggcagatagcaggacttaactccct

SEQ ID NO: 437066 - DNA, 25 bp, Rattus norvegicus
ggcagatcaaggaatagctcatgga

SEQ ID NO: 437067 - DNA, 25 bp, Rattus norvegicus
ggcagatcaaggtatagctcatgga

SEQ ID NO: 437068 - DNA, 25 bp, Rattus norvegicus
ggcagatcagccaaatacccaacta

SEQ ID NO: 437069 - DNA, 25 bp, Rattus norvegicus
ggcagatcagcctaatacccaacta

SEQ ID NO: 437070 - DNA, 25 bp, Rattus norvegicus
ggcagatcatctatgtaagaagaca

SEQ ID NO: 437071 - DNA, 25 bp, Rattus norvegicus
ggcagatcatctttgtaagaagaca

SEQ ID NO: 437072 - DNA, 25 bp, Rattus norvegicus
ggcagatcatgcattttcttcagtg

SEQ ID NO: 437073 - DNA, 25 bp, Rattus norvegicus
ggcagatcatgctttttcttcagtg

SEQ ID NO: 437074 - DNA, 25 bp, Rattus norvegicus
ggcagatccaaccagcaaccagaga

SEQ ID NO: 437075 - DNA, 25 bp, Rattus norvegicus
ggcagatccaacgagcaaccagaga

SEQ ID NO: 437076 - DNA, 25 bp, Rattus norvegicus
ggcagatccagcagagactccacat

SEQ ID NO: 437077 - DNA, 25 bp, Rattus norvegicus
ggcagatccagctgagactccacat

SEQ ID NO: 437078 - DNA, 25 bp, Rattus norvegicus
ggcagatccctgagattcagtggcc

SEQ ID NO: 437079 - DNA, 25 bp, Rattus norvegicus
ggcagatccctgtgattcagtggcc

SEQ ID NO: 437080 - DNA, 25 bp, Rattus norvegicus
ggcagatcctgcatttatgctatgc

SEQ ID NO: 437081 - DNA, 25 bp, Rattus norvegicus
ggcagatcctgcttttatgctatgc

SEQ ID NO: 437082 - DNA, 25 bp, Rattus norvegicus
ggcagatccttcagtcagtagcatg

SEQ ID NO: 437083 - DNA, 25 bp, Rattus norvegicus
ggcagatccttctgtcagtagcatg

SEQ ID NO: 437084 - DNA, 25 bp, Rattus norvegicus
ggcagatccttgcaaagtaccatga

SEQ ID NO: 437085 - DNA, 25 bp, Rattus norvegicus
ggcagatccttggaaagtaccatga

SEQ ID NO: 437086 - DNA, 25 bp, Rattus norvegicus
ggcagatcgccaagtggcaccaatt

SEQ ID NO: 437087 - DNA, 25 bp, Rattus norvegicus
ggcagatcgccatgtggcaccaatt

SEQ ID NO: 437088 - DNA, 25 bp, Rattus norvegicus
ggcagatcgcgtacgatgacttcat

SEQ ID NO: 437089 - DNA, 25 bp, Rattus norvegicus
ggcagatcgcgttcgatgacttcat

SEQ ID NO: 437090 - DNA, 25 bp, Rattus norvegicus
ggcagatctcagctgtcttgtttac

SEQ ID NO: 437091 - DNA, 25 bp, Rattus norvegicus
ggcagatctcaggtgtcttgtttac

SEQ ID NO: 437092 - DNA, 25 bp, Rattus norvegicus
ggcagatctccaccaaggcactgta

SEQ ID NO: 437093 - DNA, 25 bp, Rattus norvegicus
ggcagatctccagcaaggcactgta

SEQ ID NO: 437094 - DNA, 25 bp, Rattus norvegicus
ggcagatctcccagttcaagtccat

SEQ ID NO: 437095 - DNA, 25 bp, Rattus norvegicus
ggcagatctccctgttcaagtccat

SEQ ID NO: 437096 - DNA, 25 bp, Rattus norvegicus
ggcagatcttacaggccagcaggaa

SEQ ID NO: 437097 - DNA, 25 bp, Rattus norvegicus
ggcagatcttactggccagcaggaa

SEQ ID NO: 437098 - DNA, 25 bp, Rattus norvegicus
ggcagatcttctctttgatgtgcaa

SEQ ID NO: 437099 - DNA, 25 bp, Rattus norvegicus
ggcagatcttctgtttgatgtgcaa

SEQ ID NO: 437100 - DNA, 25 bp, Rattus norvegicus
ggcagatctttgcaccgaaactcat

SEQ ID NO: 437101 - DNA, 25 bp, Rattus norvegicus
ggcagatctttggaccgaaactcat

SEQ ID NO: 437102 - DNA, 25 bp, Rattus norvegicus
ggcagatgaactcgcctcctggtta

SEQ ID NO: 437103 - DNA, 25 bp, Rattus norvegicus
ggcagatgaactggcctcctggtta

SEQ ID NO: 437104 - DNA, 25 bp, Rattus norvegicus
ggcagatgactgctgtgtactattc

SEQ ID NO: 437105 - DNA, 25 bp, Rattus norvegicus
ggcagatgactggtgtgtactattc

SEQ ID NO: 437106 - DNA, 25 bp, Rattus norvegicus
ggcagatgagccaatcgcagactac

SEQ ID NO: 437107 - DNA, 25 bp, Rattus norvegicus
ggcagatgagcctatcgcagactac

SEQ ID NO: 437108 - DNA, 25 bp, Rattus norvegicus
ggcagatgatgaccgccaccgcgca

SEQ ID NO: 437109 - DNA, 25 bp, Rattus norvegicus
ggcagatgatgagcgccaccgcgca

SEQ ID NO: 437110 - DNA, 25 bp, Rattus norvegicus
ggcagatgcaagctgccatcttggt

SEQ ID NO: 437111 - DNA, 25 bp, Rattus norvegicus
ggcagatgcaaggtgccatcttggt

SEQ ID NO: 437112 - DNA, 25 bp, Rattus norvegicus
ggcagatgcaggctacttcacacac

SEQ ID NO: 437113 - DNA, 25 bp, Rattus norvegicus
ggcagatgcagggtacttcacacac

SEQ ID NO: 437114 - DNA, 25 bp, Rattus norvegicus
ggcagatgctaactggcttccaggt

SEQ ID NO: 437115 - DNA, 25 bp, Rattus norvegicus
ggcagatgctaagtggcttccaggt

SEQ ID NO: 437116 - DNA, 25 bp, Rattus norvegicus
ggcagatgctacatcagttgttttc

SEQ ID NO: 437117 - DNA, 25 bp, Rattus norvegicus
ggcagatgctacttcagttgttttc

SEQ ID NO: 437118 - DNA, 25 bp, Rattus norvegicus
ggcagatgctggcatcacgtactat

SEQ ID NO: 437119 - DNA, 25 bp, Rattus norvegicus
ggcagatgctgggatcacgtactat

SEQ ID NO: 437120 - DNA, 25 bp, Rattus norvegicus
ggcagatgctgtcccagaagttcct

SEQ ID NO: 437121 - DNA, 25 bp, Rattus norvegicus
ggcagatgctgtgccagaagttcct

SEQ ID NO: 437122 - DNA, 25 bp, Rattus norvegicus
ggcagatgtatgcttgaccttcctg

SEQ ID NO: 437123 - DNA, 25 bp, Rattus norvegicus
ggcagatgtatggttgaccttcctg

SEQ ID NO: 437124 - DNA, 25 bp, Rattus norvegicus
ggcagatgttcactccatcatcggc

SEQ ID NO: 437125 - DNA, 25 bp, Rattus norvegicus
ggcagatgttcagtccatcatcggc

SEQ ID NO: 437126 - DNA, 25 bp, Rattus norvegicus
ggcagattaagaccatgaaccaagt

SEQ ID NO: 437127 - DNA, 25 bp, Rattus norvegicus
ggcagattaagagcatgaaccaagt

SEQ ID NO: 437128 - DNA, 25 bp, Rattus norvegicus
ggcagattaccaatgacgacttcct

SEQ ID NO: 437129 - DNA, 25 bp, Rattus norvegicus
ggcagattaccattgacgacttcct

SEQ ID NO: 437130 - DNA, 25 bp, Rattus norvegicus
ggcagattatctatgtccagacgga

SEQ ID NO: 437131 - DNA, 25 bp, Rattus norvegicus
ggcagattatctttgtccagacgga

SEQ ID NO: 437132 - DNA, 25 bp, Rattus norvegicus
ggcagattcagcacagacgactagt

SEQ ID NO: 437133 - DNA, 25 bp, Rattus norvegicus
ggcagattcagctcagacgactagt

SEQ ID NO: 437134 - DNA, 25 bp, Rattus norvegicus
ggcagattcatcaccgggtttccaa

SEQ ID NO: 437135 - DNA, 25 bp, Rattus norvegicus
ggcagattcatctccgggtttccaa

SEQ ID NO: 437136 - DNA, 25 bp, Rattus norvegicus
ggcagattcgccagattcattcctt

SEQ ID NO: 437137 - DNA, 25 bp, Rattus norvegicus
ggcagattcgcctgattcattcctt

SEQ ID NO: 437138 - DNA, 25 bp, Rattus norvegicus
ggcagattctcacagccactgaaaa

SEQ ID NO: 437139 - DNA, 25 bp, Rattus norvegicus
ggcagattctcagagccactgaaaa

SEQ ID NO: 437140 - DNA, 25 bp, Rattus norvegicus
ggcagattctctcactatttgtcta

SEQ ID NO: 437141 - DNA, 25 bp, Rattus norvegicus
ggcagattctctgactatttgtcta

SEQ ID NO: 437142 - DNA, 25 bp, Rattus norvegicus
ggcagattgcccatcgtgactacgg

SEQ ID NO: 437143 - DNA, 25 bp, Rattus norvegicus
ggcagattgcccttcgtgactacgg

SEQ ID NO: 437144 - DNA, 25 bp, Rattus norvegicus
ggcagattgtcactgttcaggcttt

SEQ ID NO: 437145 - DNA, 25 bp, Rattus norvegicus
ggcagattgtcagtgttcaggcttt

SEQ ID NO: 437146 - DNA, 25 bp, Rattus norvegicus
ggcagatttaagacctgggcttggt

SEQ ID NO: 437147 - DNA, 25 bp, Rattus norvegicus
ggcagatttaagtcctgggcttggt

SEQ ID NO: 437148 - DNA, 25 bp, Rattus norvegicus
ggcagatttactctaggcattcaaa

SEQ ID NO: 437149 - DNA, 25 bp, Rattus norvegicus
ggcagatttactgtaggcattcaaa

SEQ ID NO: 437150 - DNA, 25 bp, Rattus norvegicus
ggcagatttatgcaccccttgtagc

SEQ ID NO: 437151 - DNA, 25 bp, Rattus norvegicus
ggcagatttatggaccccttgtagc

SEQ ID NO: 437152 - DNA, 25 bp, Rattus norvegicus
ggcagatttgagatcctgtaattta

SEQ ID NO: 437153 - DNA, 25 bp, Rattus norvegicus
ggcagatttgagttcctgtaattta

SEQ ID NO: 437154 - DNA, 25 bp, Rattus norvegicus
ggcagcaaacacacttcagtagggt

SEQ ID NO: 437155 - DNA, 25 bp, Rattus norvegicus
ggcagcaaacactcttcagtagggt

SEQ ID NO: 437156 - DNA, 25 bp, Rattus norvegicus
ggcagcaacagccaaactcgtgcat

SEQ ID NO: 437157 - DNA, 25 bp, Rattus norvegicus
ggcagcaacagcgaaactcgtgcat

SEQ ID NO: 437158 - DNA, 25 bp, Rattus norvegicus
ggcagcaactataacttcctaaatt

SEQ ID NO: 437159 - DNA, 25 bp, Rattus norvegicus
ggcagcaactattacttcctaaatt

SEQ ID NO: 437160 - DNA, 25 bp, Rattus norvegicus
ggcagcaagctaagtccaggttaca

SEQ ID NO: 437161 - DNA, 25 bp, Rattus norvegicus
ggcagcaagctatgtccaggttaca

SEQ ID NO: 437162 - DNA, 25 bp, Rattus norvegicus
ggcagcaagtctattccttgatctt

SEQ ID NO: 437163 - DNA, 25 bp, Rattus norvegicus
ggcagcaagtcttttccttgatctt

SEQ ID NO: 437164 - DNA, 25 bp, Rattus norvegicus
ggcagcaagtgcagggtctatctga

SEQ ID NO: 437165 - DNA, 25 bp, Rattus norvegicus
ggcagcaagtgctgggtctatctga

SEQ ID NO: 437166 - DNA, 25 bp, Rattus norvegicus
ggcagcaagtggactgctttccttc

SEQ ID NO: 437167 - DNA, 25 bp, Rattus norvegicus
ggcagcaagtggtctgctttccttc

SEQ ID NO: 437168 - DNA, 25 bp, Rattus norvegicus
ggcagcaagtgtctctgtagtgata

SEQ ID NO: 437169 - DNA, 25 bp, Rattus norvegicus
ggcagcaagtgtgtctgtagtgata

SEQ ID NO: 437170 - DNA, 25 bp, Rattus norvegicus
ggcagcaatcttcgaccttatcttg

SEQ ID NO: 437171 - DNA, 25 bp, Rattus norvegicus
ggcagcaatcttggaccttatcttg

SEQ ID NO: 437172 - DNA, 25 bp, Rattus norvegicus
ggcagcaatgccacactgaccaacg

SEQ ID NO: 437173 - DNA, 25 bp, Rattus norvegicus
ggcagcaatgcctcactgaccaacg

SEQ ID NO: 437174 - DNA, 25 bp, Rattus norvegicus
ggcagcaatgttccagtagcagtgt

SEQ ID NO: 437175 - DNA, 25 bp, Rattus norvegicus
ggcagcaatgttgcagtagcagtgt

SEQ ID NO: 437176 - DNA, 25 bp, Rattus norvegicus
ggcagcaattctcactatacgattt

SEQ ID NO: 437177 - DNA, 25 bp, Rattus norvegicus
ggcagcaattctgactatacgattt

SEQ ID NO: 437178 - DNA, 25 bp, Rattus norvegicus
ggcagcacaaaaccccttatatcag

SEQ ID NO: 437179 - DNA, 25 bp, Rattus norvegicus
ggcagcacaaaagcccttatatcag

SEQ ID NO: 437180 - DNA, 25 bp, Rattus norvegicus
ggcagcacacagacgcattgttgtt

SEQ ID NO: 437181 - DNA, 25 bp, Rattus norvegicus
ggcagcacacagtcgcattgttgtt

SEQ ID NO: 437182 - DNA, 25 bp, Rattus norvegicus
ggcagcacacggaggttagcatttt

SEQ ID NO: 437183 - DNA, 25 bp, Rattus norvegicus
ggcagcacacggtggttagcatttt

SEQ ID NO: 437184 - DNA, 25 bp, Rattus norvegicus
ggcagcacagataacctcttgttgg

SEQ ID NO: 437185 - DNA, 25 bp, Rattus norvegicus
ggcagcacagattacctcttgttgg

SEQ ID NO: 437186 - DNA, 25 bp, Rattus norvegicus
ggcagcacagcgctaaggaaccttc

SEQ ID NO: 437187 - DNA, 25 bp, Rattus norvegicus
ggcagcacagcggtaaggaaccttc

SEQ ID NO: 437188 - DNA, 25 bp, Rattus norvegicus
ggcagcacaggccagtctcactgta

SEQ ID NO: 437189 - DNA, 25 bp, Rattus norvegicus
ggcagcacaggcgagtctcactgta

SEQ ID NO: 437190 - DNA, 25 bp, Rattus norvegicus
ggcagcacattcagcagcctgtggt

SEQ ID NO: 437191 - DNA, 25 bp, Rattus norvegicus
ggcagcacattctgcagcctgtggt

SEQ ID NO: 437192 - DNA, 25 bp, Rattus norvegicus
ggcagcaccatcctatgaggacttt

SEQ ID NO: 437193 - DNA, 25 bp, Rattus norvegicus
ggcagcaccatcgtatgaggacttt

SEQ ID NO: 437194 - DNA, 25 bp, Rattus norvegicus
ggcagcacctaaagtacgtttcatg

SEQ ID NO: 437195 - DNA, 25 bp, Rattus norvegicus
ggcagcacctaatgtacgtttcatg

SEQ ID NO: 437196 - DNA, 25 bp, Rattus norvegicus
ggcagcacctggcactatataaggc

SEQ ID NO: 437197 - DNA, 25 bp, Rattus norvegicus
ggcagcacctgggactatataaggc

SEQ ID NO: 437198 - DNA, 25 bp, Rattus norvegicus
ggcagcaccttcagctttaatacta

SEQ ID NO: 437199 - DNA, 25 bp, Rattus norvegicus
ggcagcaccttctgctttaatacta

SEQ ID NO: 437200 - DNA, 25 bp, Rattus norvegicus
ggcagcacggtcagtgtcacacgag

SEQ ID NO: 437201 - DNA, 25 bp, Rattus norvegicus
ggcagcacggtctgtgtcacacgag

SEQ ID NO: 437202 - DNA, 25 bp, Rattus norvegicus
ggcagcacgttcactcaaatctgag

SEQ ID NO: 437203 - DNA, 25 bp, Rattus norvegicus
ggcagcacgttctctcaaatctgag

SEQ ID NO: 437204 - DNA, 25 bp, Rattus norvegicus
ggcagcacgttgcagcatgcttatt

SEQ ID NO: 437205 - DNA, 25 bp, Rattus norvegicus
ggcagcacgttggagcatgcttatt

SEQ ID NO: 437206 - DNA, 25 bp, Rattus norvegicus
ggcagcactagcattgtcctacatc

SEQ ID NO: 437207 - DNA, 25 bp, Rattus norvegicus
ggcagcactagctttgtcctacatc

SEQ ID NO: 437208 - DNA, 25 bp, Rattus norvegicus
ggcagcactcagacagccagacctg

SEQ ID NO: 437209 - DNA, 25 bp, Rattus norvegicus
ggcagcactcagtcagccagacctg

SEQ ID NO: 437210 - DNA, 25 bp, Rattus norvegicus
ggcagcactgtaatctcttggttaa

SEQ ID NO: 437211 - DNA, 25 bp, Rattus norvegicus
ggcagcactgtattctcttggttaa

SEQ ID NO: 437212 - DNA, 25 bp, Rattus norvegicus
ggcagcactgttaagcactttgata

SEQ ID NO: 437213 - DNA, 25 bp, Rattus norvegicus
ggcagcactgtttagcactttgata

SEQ ID NO: 437214 - DNA, 25 bp, Rattus norvegicus
ggcagcacttggcagagcacagaca

SEQ ID NO: 437215 - DNA, 25 bp, Rattus norvegicus
ggcagcacttgggagagcacagaca

SEQ ID NO: 437216 - DNA, 25 bp, Rattus norvegicus
ggcagcagacacaggcccaggtgca

SEQ ID NO: 437217 - DNA, 25 bp, Rattus norvegicus
ggcagcagacactggcccaggtgca

SEQ ID NO: 437218 - DNA, 25 bp, Rattus norvegicus
ggcagcagacagacatcatttgagt

SEQ ID NO: 437219 - DNA, 25 bp, Rattus norvegicus
ggcagcagacagctggaagctcctt

SEQ ID NO: 437220 - DNA, 25 bp, Rattus norvegicus
ggcagcagacaggtggaagctcctt

SEQ ID NO: 437221 - DNA, 25 bp, Rattus norvegicus
ggcagcagacagtcatcatttgagt

SEQ ID NO: 437222 - DNA, 25 bp, Rattus norvegicus
ggcagcagagtgacctgcgtctgac

SEQ ID NO: 437223 - DNA, 25 bp, Rattus norvegicus
ggcagcagagtgtcctgcgtctgac

SEQ ID NO: 437224 - DNA, 25 bp, Rattus norvegicus
ggcagcagcacacatacatcactgt

SEQ ID NO: 437225 - DNA, 25 bp, Rattus norvegicus
ggcagcagcacagatacatcactgt

SEQ ID NO: 437226 - DNA, 25 bp, Rattus norvegicus
ggcagcagcaggctaccttgtatat

SEQ ID NO: 437227 - DNA, 25 bp, Rattus norvegicus
ggcagcagcagggtaccttgtatat

SEQ ID NO: 437228 - DNA, 25 bp, Rattus norvegicus
ggcagcagcatgacggatggcactc

SEQ ID NO: 437229 - DNA, 25 bp, Rattus norvegicus
ggcagcagcatgtcggatggcactc

SEQ ID NO: 437230 - DNA, 25 bp, Rattus norvegicus
ggcagcagccaaaaattgtcctgac

SEQ ID NO: 437231 - DNA, 25 bp, Rattus norvegicus
ggcagcagccaataattgtcctgac

SEQ ID NO: 437232 - DNA, 25 bp, Rattus norvegicus
ggcagcagccggactacacagtgag

SEQ ID NO: 437233 - DNA, 25 bp, Rattus norvegicus
ggcagcagccggtctacacagtgag

SEQ ID NO: 437234 - DNA, 25 bp, Rattus norvegicus
ggcagcagccgtacagcgccgactt

SEQ ID NO: 437235 - DNA, 25 bp, Rattus norvegicus
ggcagcagccgttcagcgccgactt

SEQ ID NO: 437236 - DNA, 25 bp, Rattus norvegicus
ggcagcagcctcacatgagctcaaa

SEQ ID NO: 437237 - DNA, 25 bp, Rattus norvegicus
ggcagcagcctctcatgagctcaaa

SEQ ID NO: 437238 - DNA, 25 bp, Rattus norvegicus
ggcagcagccttagtgagtgaccct

SEQ ID NO: 437239 - DNA, 25 bp, Rattus norvegicus
ggcagcagcctttgtgagtgaccct

SEQ ID NO: 437240 - DNA, 25 bp, Rattus norvegicus
ggcagcagcggccacgaggacggcc

SEQ ID NO: 437241 - DNA, 25 bp, Rattus norvegicus
ggcagcagcggcgacgaggacggcc

SEQ ID NO: 437242 - DNA, 25 bp, Rattus norvegicus
ggcagcagctaacctacagcaacaa

SEQ ID NO: 437243 - DNA, 25 bp, Rattus norvegicus
ggcagcagctaagctacagcaacaa

SEQ ID NO: 437244 - DNA, 25 bp, Rattus norvegicus
ggcagcagctgaacctgatgctcaa

SEQ ID NO: 437245 - DNA, 25 bp, Rattus norvegicus
ggcagcagctgatcctgatgctcaa

SEQ ID NO: 437246 - DNA, 25 bp, Rattus norvegicus
ggcagcagctgccttggtcttcagt

SEQ ID NO: 437247 - DNA, 25 bp, Rattus norvegicus
ggcagcagctgcgttggtcttcagt

SEQ ID NO: 437248 - DNA, 25 bp, Rattus norvegicus
ggcagcagctggatctggaaaatat

SEQ ID NO: 437249 - DNA, 25 bp, Rattus norvegicus
ggcagcagctggttctggaaaatat

SEQ ID NO: 437250 - DNA, 25 bp, Rattus norvegicus
ggcagcagctgtctaacctcgagtg

SEQ ID NO: 437251 - DNA, 25 bp, Rattus norvegicus
ggcagcagctgtgtaacctcgagtg

SEQ ID NO: 437252 - DNA, 25 bp, Rattus norvegicus
ggcagcaggaacagcgaatgaacac

SEQ ID NO: 437253 - DNA, 25 bp, Rattus norvegicus
ggcagcaggaactgcgaatgaacac

SEQ ID NO: 437254 - DNA, 25 bp, Rattus norvegicus
ggcagcaggctgaccaaactgtaga

SEQ ID NO: 437255 - DNA, 25 bp, Rattus norvegicus
ggcagcaggctgtccaaactgtaga

SEQ ID NO: 437256 - DNA, 25 bp, Rattus norvegicus
ggcagcagggctacaatggcctcaa

SEQ ID NO: 437257 - DNA, 25 bp, Rattus norvegicus
ggcagcagggcttcaatggcctcaa

SEQ ID NO: 437258 - DNA, 25 bp, Rattus norvegicus
ggcagcaggtctcggtcgcggtcca

SEQ ID NO: 437259 - DNA, 25 bp, Rattus norvegicus
ggcagcaggtctgggtcgcggtcca

SEQ ID NO: 437260 - DNA, 25 bp, Rattus norvegicus
ggcagcagtcagcattccaaaccag

SEQ ID NO: 437261 - DNA, 25 bp, Rattus norvegicus
ggcagcagtcaggattccaaaccag

SEQ ID NO: 437262 - DNA, 25 bp, Rattus norvegicus
ggcagcagtcccataactactaaat

SEQ ID NO: 437263 - DNA, 25 bp, Rattus norvegicus
ggcagcagtcccttaactactaaat

SEQ ID NO: 437264 - DNA, 25 bp, Rattus norvegicus
ggcagcagtggtactcctagggtca

SEQ ID NO: 437265 - DNA, 25 bp, Rattus norvegicus
ggcagcagtggttctcctagggtca

SEQ ID NO: 437266 - DNA, 25 bp, Rattus norvegicus
ggcagcagtgtcctctctggatttg

SEQ ID NO: 437267 - DNA, 25 bp, Rattus norvegicus
ggcagcagtgtcgtctctggatttg

SEQ ID NO: 437268 - DNA, 25 bp, Rattus norvegicus
ggcagcatagggatgggatttttaa

SEQ ID NO: 437269 - DNA, 25 bp, Rattus norvegicus
ggcagcatagggttgggatttttaa

SEQ ID NO: 437270 - DNA, 25 bp, Rattus norvegicus
ggcagcatcaaacccaggactggat

SEQ ID NO: 437271 - DNA, 25 bp, Rattus norvegicus
ggcagcatcaaagccaggactggat

SEQ ID NO: 437272 - DNA, 25 bp, Rattus norvegicus
ggcagcatccccaggttctggccag

SEQ ID NO: 437273 - DNA, 25 bp, Rattus norvegicus
ggcagcatcccctggttctggccag

SEQ ID NO: 437274 - DNA, 25 bp, Rattus norvegicus
ggcagcatcgacatggtggactctc

SEQ ID NO: 437275 - DNA, 25 bp, Rattus norvegicus
ggcagcatcgacttggtggactctc

SEQ ID NO: 437276 - DNA, 25 bp, Rattus norvegicus
ggcagcatctacagcccagaggtgc

SEQ ID NO: 437277 - DNA, 25 bp, Rattus norvegicus
ggcagcatctactgcccagaggtgc

SEQ ID NO: 437278 - DNA, 25 bp, Rattus norvegicus
ggcagcatctggacaggcatggtac

SEQ ID NO: 437279 - DNA, 25 bp, Rattus norvegicus
ggcagcatctggtcaggcatggtac

SEQ ID NO: 437280 - DNA, 25 bp, Rattus norvegicus
ggcagcatctttcacaatttccttc

SEQ ID NO: 437281 - DNA, 25 bp, Rattus norvegicus
ggcagcatctttgacaatttccttc

SEQ ID NO: 437282 - DNA, 25 bp, Rattus norvegicus
ggcagcatgcagatctagtccagag

SEQ ID NO: 437283 - DNA, 25 bp, Rattus norvegicus
ggcagcatgcagttctagtccagag

SEQ ID NO: 437284 - DNA, 25 bp, Rattus norvegicus
ggcagcattacacttgggtcccact

SEQ ID NO: 437285 - DNA, 25 bp, Rattus norvegicus
ggcagcattacagttgggtcccact

SEQ ID NO: 437286 - DNA, 25 bp, Rattus norvegicus
ggcagcattggaaggattgctacaa

SEQ ID NO: 437287 - DNA, 25 bp, Rattus norvegicus
ggcagcattggatggattgctacaa

SEQ ID NO: 437288 - DNA, 25 bp, Rattus norvegicus
ggcagcatttaaacctagtccagca

SEQ ID NO: 437289 - DNA, 25 bp, Rattus norvegicus
ggcagcatttaatcctagtccagca

SEQ ID NO: 437290 - DNA, 25 bp, Rattus norvegicus
ggcagcatttcacatctattgtcct

SEQ ID NO: 437291 - DNA, 25 bp, Rattus norvegicus
ggcagcatttcagatctattgtcct

SEQ ID NO: 437292 - DNA, 25 bp, Rattus norvegicus
ggcagcatttgtagactccacgtag

SEQ ID NO: 437293 - DNA, 25 bp, Rattus norvegicus
ggcagcatttgttgactccacgtag

SEQ ID NO: 437294 - DNA, 25 bp, Rattus norvegicus
ggcagccaacctctttgggaaaatt

SEQ ID NO: 437295 - DNA, 25 bp, Rattus norvegicus
ggcagccaacctgtttgggaaaatt

SEQ ID NO: 437296 - DNA, 25 bp, Rattus norvegicus
ggcagccacactcagggacgcagca

SEQ ID NO: 437297 - DNA, 25 bp, Rattus norvegicus
ggcagccacactgagggacgcagca

SEQ ID NO: 437298 - DNA, 25 bp, Rattus norvegicus
ggcagccactccacgtatatagaat

SEQ ID NO: 437299 - DNA, 25 bp, Rattus norvegicus
ggcagccactcctcgtatatagaat

SEQ ID NO: 437300 - DNA, 25 bp, Rattus norvegicus
ggcagccactggacacattggacta

SEQ ID NO: 437301 - DNA, 25 bp, Rattus norvegicus
ggcagccactggtcacattggacta

SEQ ID NO: 437302 - DNA, 25 bp, Rattus norvegicus
ggcagccagaataataggacacctc

SEQ ID NO: 437303 - DNA, 25 bp, Rattus norvegicus
ggcagccagaattataggacacctc

SEQ ID NO: 437304 - DNA, 25 bp, Rattus norvegicus
ggcagccagcaaccaccactttgag

SEQ ID NO: 437305 - DNA, 25 bp, Rattus norvegicus
ggcagccagcaagcaccactttgag

SEQ ID NO: 437306 - DNA, 25 bp, Rattus norvegicus
ggcagccagcccagagatttgatct

SEQ ID NO: 437307 - DNA, 25 bp, Rattus norvegicus
ggcagccagccctgagatttgatct

SEQ ID NO: 437308 - DNA, 25 bp, Rattus norvegicus
ggcagccatacacggtgacacattt

SEQ ID NO: 437309 - DNA, 25 bp, Rattus norvegicus
ggcagccatacagggtgacacattt

SEQ ID NO: 437310 - DNA, 25 bp, Rattus norvegicus
ggcagccatcttaattgctcaagtc

SEQ ID NO: 437311 - DNA, 25 bp, Rattus norvegicus
ggcagccatctttattgctcaagtc

SEQ ID NO: 437312 - DNA, 25 bp, Rattus norvegicus
ggcagccatgatcatttatttctta

SEQ ID NO: 437313 - DNA, 25 bp, Rattus norvegicus
ggcagccatgatgatttatttctta

SEQ ID NO: 437314 - DNA, 25 bp, Rattus norvegicus
ggcagccatggcatcataataagac

SEQ ID NO: 437315 - DNA, 25 bp, Rattus norvegicus
ggcagccatggcttcataataagac

SEQ ID NO: 437316 - DNA, 25 bp, Rattus norvegicus
ggcagccatgttagtaaagagcact

SEQ ID NO: 437317 - DNA, 25 bp, Rattus norvegicus
ggcagccatgtttgtaaagagcact

SEQ ID NO: 437318 - DNA, 25 bp, Rattus norvegicus
ggcagccattctctaacgaactcca

SEQ ID NO: 437319 - DNA, 25 bp, Rattus norvegicus
ggcagccattctgtaacgaactcca

SEQ ID NO: 437320 - DNA, 25 bp, Rattus norvegicus
ggcagccatttcaactgtgttccaa

SEQ ID NO: 437321 - DNA, 25 bp, Rattus norvegicus
ggcagccatttctactgtgttccaa

SEQ ID NO: 437322 - DNA, 25 bp, Rattus norvegicus
ggcagcccacaaaaaagacgtcctt

SEQ ID NO: 437323 - DNA, 25 bp, Rattus norvegicus
ggcagcccacaataaagacgtcctt

SEQ ID NO: 437324 - DNA, 25 bp, Rattus norvegicus
ggcagcccagttagtacctttgtag

SEQ ID NO: 437325 - DNA, 25 bp, Rattus norvegicus
ggcagcccagtttgtacctttgtag

SEQ ID NO: 437326 - DNA, 25 bp, Rattus norvegicus
ggcagcccatgtccaatggtgccca

SEQ ID NO: 437327 - DNA, 25 bp, Rattus norvegicus
ggcagcccatgtgcaatggtgccca

SEQ ID NO: 437328 - DNA, 25 bp, Rattus norvegicus
ggcagcccattcatagatttccact

SEQ ID NO: 437329 - DNA, 25 bp, Rattus norvegicus
ggcagcccattcttagatttccact

SEQ ID NO: 437330 - DNA, 25 bp, Rattus norvegicus
ggcagccccaggactgtgtctttgt

SEQ ID NO: 437331 - DNA, 25 bp, Rattus norvegicus
ggcagccccaggtctgtgtctttgt

SEQ ID NO: 437332 - DNA, 25 bp, Rattus norvegicus
ggcagccccatcattgattatcttt

SEQ ID NO: 437333 - DNA, 25 bp, Rattus norvegicus
ggcagccccatctttgattatcttt

SEQ ID NO: 437334 - DNA, 25 bp, Rattus norvegicus
ggcagccccgtgcacaggataagca

SEQ ID NO: 437335 - DNA, 25 bp, Rattus norvegicus
ggcagccccgtggacaggataagca

SEQ ID NO: 437336 - DNA, 25 bp, Rattus norvegicus
ggcagcccggctacaagagcaacat

SEQ ID NO: 437337 - DNA, 25 bp, Rattus norvegicus
ggcagcccggcttcaagagcaacat

SEQ ID NO: 437338 - DNA, 25 bp, Rattus norvegicus
ggcagccctactctggccgtagtaa

SEQ ID NO: 437339 - DNA, 25 bp, Rattus norvegicus
ggcagccctactgtggccgtagtaa

SEQ ID NO: 437340 - DNA, 25 bp, Rattus norvegicus
ggcagccctgataggagtctaactt

SEQ ID NO: 437341 - DNA, 25 bp, Rattus norvegicus
ggcagccctgattggagtctaactt

SEQ ID NO: 437342 - DNA, 25 bp, Rattus norvegicus
ggcagccctgggaatatgtatattc

SEQ ID NO: 437343 - DNA, 25 bp, Rattus norvegicus
ggcagccctgggtatatgtatattc

SEQ ID NO: 437344 - DNA, 25 bp, Rattus norvegicus
ggcagccgacatagataccagatct

SEQ ID NO: 437345 - DNA, 25 bp, Rattus norvegicus
ggcagccgacattgataccagatct

SEQ ID NO: 437346 - DNA, 25 bp, Rattus norvegicus
ggcagccgacttcccgattcgagca

SEQ ID NO: 437347 - DNA, 25 bp, Rattus norvegicus
ggcagccgacttgccgattcgagca

SEQ ID NO: 437348 - DNA, 25 bp, Rattus norvegicus
ggcagccggctcataaaagttcatt

SEQ ID NO: 437349 - DNA, 25 bp, Rattus norvegicus
ggcagccggctcttaaaagttcatt

SEQ ID NO: 437350 - DNA, 25 bp, Rattus norvegicus
ggcagccgggaaaccagcagccact

SEQ ID NO: 437351 - DNA, 25 bp, Rattus norvegicus
ggcagccgggaatccagcagccact

SEQ ID NO: 437352 - DNA, 25 bp, Rattus norvegicus
ggcagcctaagacatcgcagactaa

SEQ ID NO: 437353 - DNA, 25 bp, Rattus norvegicus
ggcagcctaagagatcgcagactaa

SEQ ID NO: 437354 - DNA, 25 bp, Rattus norvegicus
ggcagcctagctacagatgccagaa

SEQ ID NO: 437355 - DNA, 25 bp, Rattus norvegicus
ggcagcctagcttcagatgccagaa

SEQ ID NO: 437356 - DNA, 25 bp, Rattus norvegicus
ggcagcctcagaaatgagtcagcca

SEQ ID NO: 437357 - DNA, 25 bp, Rattus norvegicus
ggcagcctcagatatgagtcagcca

SEQ ID NO: 437358 - DNA, 25 bp, Rattus norvegicus
ggcagcctccagattgagctgggaa

SEQ ID NO: 437359 - DNA, 25 bp, Rattus norvegicus
ggcagcctccagtttgagctgggaa

SEQ ID NO: 437360 - DNA, 25 bp, Rattus norvegicus
ggcagcctccttaaaagataagttt

SEQ ID NO: 437361 - DNA, 25 bp, Rattus norvegicus
ggcagcctcctttaaagataagttt

SEQ ID NO: 437362 - DNA, 25 bp, Rattus norvegicus
ggcagcctctctagggtggcaagta

SEQ ID NO: 437363 - DNA, 25 bp, Rattus norvegicus
ggcagcctctcttgggtggcaagta

SEQ ID NO: 437364 - DNA, 25 bp, Rattus norvegicus
ggcagcctgaagcactttaagttct

SEQ ID NO: 437365 - DNA, 25 bp, Rattus norvegicus
ggcagcctgaaggactttaagttct

SEQ ID NO: 437366 - DNA, 25 bp, Rattus norvegicus
ggcagcctgagacgacactggaatc

SEQ ID NO: 437367 - DNA, 25 bp, Rattus norvegicus
ggcagcctgagaggacactggaatc

SEQ ID NO: 437368 - DNA, 25 bp, Rattus norvegicus
ggcagcctgcgcaacacagagaacc

SEQ ID NO: 437369 - DNA, 25 bp, Rattus norvegicus
ggcagcctgcgctacacagagaacc

SEQ ID NO: 437370 - DNA, 25 bp, Rattus norvegicus
ggcagcctggacagacttttgaaca

SEQ ID NO: 437371 - DNA, 25 bp, Rattus norvegicus
ggcagcctggactgacttttgaaca

SEQ ID NO: 437372 - DNA, 25 bp, Rattus norvegicus
ggcagcctggctagcaagacaagga

SEQ ID NO: 437373 - DNA, 25 bp, Rattus norvegicus
ggcagcctggctatgttgtaatacc

SEQ ID NO: 437374 - DNA, 25 bp, Rattus norvegicus
ggcagcctggcttgcaagacaagga

SEQ ID NO: 437375 - DNA, 25 bp, Rattus norvegicus
ggcagcctggctttgttgtaatacc

SEQ ID NO: 437376 - DNA, 25 bp, Rattus norvegicus
ggcagcctgtatcagctcactgtga

SEQ ID NO: 437377 - DNA, 25 bp, Rattus norvegicus
ggcagcctgtatgagctcactgtga

SEQ ID NO: 437378 - DNA, 25 bp, Rattus norvegicus
ggcagccttcaaacacaaatacaga

SEQ ID NO: 437379 - DNA, 25 bp, Rattus norvegicus
ggcagccttcaatcacaaatacaga

SEQ ID NO: 437380 - DNA, 25 bp, Rattus norvegicus
ggcagccttcatcttttcctaaagc

SEQ ID NO: 437381 - DNA, 25 bp, Rattus norvegicus
ggcagccttcatgttttcctaaagc

SEQ ID NO: 437382 - DNA, 25 bp, Rattus norvegicus
ggcagccttccaattaacactggga

SEQ ID NO: 437383 - DNA, 25 bp, Rattus norvegicus
ggcagccttccatttaacactggga

SEQ ID NO: 437384 - DNA, 25 bp, Rattus norvegicus
ggcagccttcctcaaaaagtctggg

SEQ ID NO: 437385 - DNA, 25 bp, Rattus norvegicus
ggcagccttcctgaaaaagtctggg

SEQ ID NO: 437386 - DNA, 25 bp, Rattus norvegicus
ggcagccttgctcatctatttttaa

SEQ ID NO: 437387 - DNA, 25 bp, Rattus norvegicus
ggcagccttgctgatctatttttaa

SEQ ID NO: 437388 - DNA, 25 bp, Rattus norvegicus
ggcagccttgtgaaatggtttgtac

SEQ ID NO: 437389 - DNA, 25 bp, Rattus norvegicus
ggcagccttgtgtaatggtttgtac

SEQ ID NO: 437390 - DNA, 25 bp, Rattus norvegicus
ggcagcgaaacacaaaatactccac

SEQ ID NO: 437391 - DNA, 25 bp, Rattus norvegicus
ggcagcgaaacagaaaatactccac

SEQ ID NO: 437392 - DNA, 25 bp, Rattus norvegicus
ggcagcgaaaccaaaggaacgtcca

SEQ ID NO: 437393 - DNA, 25 bp, Rattus norvegicus
ggcagcgaaacctaaggaacgtcca

SEQ ID NO: 437394 - DNA, 25 bp, Rattus norvegicus
ggcagcgacaccatagacctgtgaa

SEQ ID NO: 437395 - DNA, 25 bp, Rattus norvegicus
ggcagcgacaccttagacctgtgaa

SEQ ID NO: 437396 - DNA, 25 bp, Rattus norvegicus
ggcagcgacaggacatcttgaagaa

SEQ ID NO: 437397 - DNA, 25 bp, Rattus norvegicus
ggcagcgacaggtcatcttgaagaa

SEQ ID NO: 437398 - DNA, 25 bp, Rattus norvegicus
ggcagcgaggctcgatttctgaaca

SEQ ID NO: 437399 - DNA, 25 bp, Rattus norvegicus
ggcagcgaggctggatttctgaaca

SEQ ID NO: 437400 - DNA, 25 bp, Rattus norvegicus
ggcagcgataggattcatcctcatt

SEQ ID NO: 437401 - DNA, 25 bp, Rattus norvegicus
ggcagcgataggtttcatcctcatt

SEQ ID NO: 437402 - DNA, 25 bp, Rattus norvegicus
ggcagcgcacacatgccagtgatgt

SEQ ID NO: 437403 - DNA, 25 bp, Rattus norvegicus
ggcagcgcacacttgccagtgatgt

SEQ ID NO: 437404 - DNA, 25 bp, Rattus norvegicus
ggcagcgcaccacaataggctttgg

SEQ ID NO: 437405 - DNA, 25 bp, Rattus norvegicus
ggcagcgcaccagaataggctttgg

SEQ ID NO: 437406 - DNA, 25 bp, Rattus norvegicus
ggcagcgcagcactcaggcagaaaa

SEQ ID NO: 437407 - DNA, 25 bp, Rattus norvegicus
ggcagcgcagcagtcaggcagaaaa

SEQ ID NO: 437408 - DNA, 25 bp, Rattus norvegicus
ggcagcgctgccatagtggactaga

SEQ ID NO: 437409 - DNA, 25 bp, Rattus norvegicus
ggcagcgctgccttagtggactaga

SEQ ID NO: 437410 - DNA, 25 bp, Rattus norvegicus
ggcagcggctacatgctcagcaagt

SEQ ID NO: 437411 - DNA, 25 bp, Rattus norvegicus
ggcagcggctacttgctcagcaagt

SEQ ID NO: 437412 - DNA, 25 bp, Rattus norvegicus
ggcagcggtggtcgagggagctact

SEQ ID NO: 437413 - DNA, 25 bp, Rattus norvegicus
ggcagcggtggtggagggagctact

SEQ ID NO: 437414 - DNA, 25 bp, Rattus norvegicus
ggcagcgtaacgccgtcccggaggg

SEQ ID NO: 437415 - DNA, 25 bp, Rattus norvegicus
ggcagcgtaacggcgtcccggaggg

SEQ ID NO: 437416 - DNA, 25 bp, Rattus norvegicus
ggcagcgtccctagtagctaaggag

SEQ ID NO: 437417 - DNA, 25 bp, Rattus norvegicus
ggcagcgtcccttgtagctaaggag

SEQ ID NO: 437418 - DNA, 25 bp, Rattus norvegicus
ggcagcgtgcaacaactcagtacaa

SEQ ID NO: 437419 - DNA, 25 bp, Rattus norvegicus
ggcagcgtgcaagaactcagtacaa

SEQ ID NO: 437420 - DNA, 25 bp, Rattus norvegicus
ggcagcgtgtccactcagtggccag

SEQ ID NO: 437421 - DNA, 25 bp, Rattus norvegicus
ggcagcgtgtcctctcagtggccag

SEQ ID NO: 437422 - DNA, 25 bp, Rattus norvegicus
ggcagcgttattaaagtgtgtcagt

SEQ ID NO: 437423 - DNA, 25 bp, Rattus norvegicus
ggcagcgttatttaagtgtgtcagt

SEQ ID NO: 437424 - DNA, 25 bp, Rattus norvegicus
ggcagcgttttcagcatttctgtaa

SEQ ID NO: 437425 - DNA, 25 bp, Rattus norvegicus
ggcagcgttttctgcatttctgtaa

SEQ ID NO: 437426 - DNA, 25 bp, Rattus norvegicus
ggcagctaaagcatctcttcgtgtt

SEQ ID NO: 437427 - DNA, 25 bp, Rattus norvegicus
ggcagctaaagcttctcttcgtgtt

SEQ ID NO: 437428 - DNA, 25 bp, Rattus norvegicus
ggcagctaagtcctttttaccataa

SEQ ID NO: 437429 - DNA, 25 bp, Rattus norvegicus
ggcagctaagtcgtttttaccataa

SEQ ID NO: 437430 - DNA, 25 bp, Rattus norvegicus
ggcagctacctgcactctaaaactg

SEQ ID NO: 437431 - DNA, 25 bp, Rattus norvegicus
ggcagctacctggactctaaaactg

SEQ ID NO: 437432 - DNA, 25 bp, Rattus norvegicus
ggcagctagagcaacccatctggat

SEQ ID NO: 437433 - DNA, 25 bp, Rattus norvegicus
ggcagctagagctacccatctggat

SEQ ID NO: 437434 - DNA, 25 bp, Rattus norvegicus
ggcagctagcatcacctcaaggaag

SEQ ID NO: 437435 - DNA, 25 bp, Rattus norvegicus
ggcagctagcatgacctcaaggaag

SEQ ID NO: 437436 - DNA, 25 bp, Rattus norvegicus
ggcagctagtccagattgaaacatt

SEQ ID NO: 437437 - DNA, 25 bp, Rattus norvegicus
ggcagctagtcctgattgaaacatt

SEQ ID NO: 437438 - DNA, 25 bp, Rattus norvegicus
ggcagctatccccagagtgtgtgac

SEQ ID NO: 437439 - DNA, 25 bp, Rattus norvegicus
ggcagctatcccgagagtgtgtgac

SEQ ID NO: 437440 - DNA, 25 bp, Rattus norvegicus
ggcagctatttcagtggtcagccac

SEQ ID NO: 437441 - DNA, 25 bp, Rattus norvegicus
ggcagctatttctgtggtcagccac

SEQ ID NO: 437442 - DNA, 25 bp, Rattus norvegicus
ggcagctcacaaaggtctggaattt

SEQ ID NO: 437443 - DNA, 25 bp, Rattus norvegicus
ggcagctcacaatggtctggaattt

SEQ ID NO: 437444 - DNA, 25 bp, Rattus norvegicus
ggcagctcacatcctataatcgcaa

SEQ ID NO: 437445 - DNA, 25 bp, Rattus norvegicus
ggcagctcacatgctataatcgcaa

SEQ ID NO: 437446 - DNA, 25 bp, Rattus norvegicus
ggcagctcacggatgttcttgcagc

SEQ ID NO: 437447 - DNA, 25 bp, Rattus norvegicus
ggcagctcacggttgttcttgcagc

SEQ ID NO: 437448 - DNA, 25 bp, Rattus norvegicus
ggcagctcatatctgtttgtgacta

SEQ ID NO: 437449 - DNA, 25 bp, Rattus norvegicus
ggcagctcatatgtgtttgtgacta

SEQ ID NO: 437450 - DNA, 25 bp, Rattus norvegicus
ggcagctcatgtaggtgtgattctt

SEQ ID NO: 437451 - DNA, 25 bp, Rattus norvegicus
ggcagctcatgttggtgtgattctt

SEQ ID NO: 437452 - DNA, 25 bp, Rattus norvegicus
ggcagctccaatccagaaacactgt

SEQ ID NO: 437453 - DNA, 25 bp, Rattus norvegicus
ggcagctccaatgcagaaacactgt

SEQ ID NO: 437454 - DNA, 25 bp, Rattus norvegicus
ggcagctccagtattcaattatgct

SEQ ID NO: 437455 - DNA, 25 bp, Rattus norvegicus
ggcagctccagttttcaattatgct

SEQ ID NO: 437456 - DNA, 25 bp, Rattus norvegicus
ggcagctccgctagggcatgatagc

SEQ ID NO: 437457 - DNA, 25 bp, Rattus norvegicus
ggcagctccgcttgggcatgatagc

SEQ ID NO: 437458 - DNA, 25 bp, Rattus norvegicus
ggcagctcgaaaccgtgcatctgaa

SEQ ID NO: 437459 - DNA, 25 bp, Rattus norvegicus
ggcagctcgaaagcgtgcatctgaa

SEQ ID NO: 437460 - DNA, 25 bp, Rattus norvegicus
ggcagctcgcctaggagagtactta

SEQ ID NO: 437461 - DNA, 25 bp, Rattus norvegicus
ggcagctcgccttggagagtactta

SEQ ID NO: 437462 - DNA, 25 bp, Rattus norvegicus
ggcagctcgctcatttacaatttga

SEQ ID NO: 437463 - DNA, 25 bp, Rattus norvegicus
ggcagctcgctcttttacaatttga

SEQ ID NO: 437464 - DNA, 25 bp, Rattus norvegicus
ggcagctcgtgcagtagtcctggat

SEQ ID NO: 437465 - DNA, 25 bp, Rattus norvegicus
ggcagctcgtgctgtagtcctggat

SEQ ID NO: 437466 - DNA, 25 bp, Rattus norvegicus
ggcagctctaagactgtttcaggtt

SEQ ID NO: 437467 - DNA, 25 bp, Rattus norvegicus
ggcagctctaagtctgtttcaggtt

SEQ ID NO: 437468 - DNA, 25 bp, Rattus norvegicus
ggcagctctataaagtgaccccgtg

SEQ ID NO: 437469 - DNA, 25 bp, Rattus norvegicus
ggcagctctatatagtgaccccgtg

SEQ ID NO: 437470 - DNA, 25 bp, Rattus norvegicus
ggcagctctatgcactttctctgga

SEQ ID NO: 437471 - DNA, 25 bp, Rattus norvegicus
ggcagctctatggactttctctgga

SEQ ID NO: 437472 - DNA, 25 bp, Rattus norvegicus
ggcagctctcccataaaactctgaa

SEQ ID NO: 437473 - DNA, 25 bp, Rattus norvegicus
ggcagctctcccttaaaactctgaa

SEQ ID NO: 437474 - DNA, 25 bp, Rattus norvegicus
ggcagctctgggaaatagctccaca

SEQ ID NO: 437475 - DNA, 25 bp, Rattus norvegicus
ggcagctctgggtaatagctccaca

SEQ ID NO: 437476 - DNA, 25 bp, Rattus norvegicus
ggcagctctggtaccaagatcactt

SEQ ID NO: 437477 - DNA, 25 bp, Rattus norvegicus
ggcagctctggttccaagatcactt

SEQ ID NO: 437478 - DNA, 25 bp, Rattus norvegicus
ggcagctcttgcagttcagccggga

SEQ ID NO: 437479 - DNA, 25 bp, Rattus norvegicus
ggcagctcttgctgttcagccggga

SEQ ID NO: 437480 - DNA, 25 bp, Rattus norvegicus
ggcagctgaaacattggttcttctt

SEQ ID NO: 437481 - DNA, 25 bp, Rattus norvegicus
ggcagctgaaactttggttcttctt

SEQ ID NO: 437482 - DNA, 25 bp, Rattus norvegicus
ggcagctgaaataagccacaggaac

SEQ ID NO: 437483 - DNA, 25 bp, Rattus norvegicus
ggcagctgaaattagccacaggaac

SEQ ID NO: 437484 - DNA, 25 bp, Rattus norvegicus
ggcagctgaagaccgtccatggctt

SEQ ID NO: 437485 - DNA, 25 bp, Rattus norvegicus
ggcagctgaagagcgtccatggctt

SEQ ID NO: 437486 - DNA, 25 bp, Rattus norvegicus
ggcagctgacacagtagttatcaca

SEQ ID NO: 437487 - DNA, 25 bp, Rattus norvegicus
ggcagctgacactgtagttatcaca

SEQ ID NO: 437488 - DNA, 25 bp, Rattus norvegicus
ggcagctgatacagaaggaagagat

SEQ ID NO: 437489 - DNA, 25 bp, Rattus norvegicus
ggcagctgatactgaaggaagagat

SEQ ID NO: 437490 - DNA, 25 bp, Rattus norvegicus
ggcagctgcaggagtctcagctgac

SEQ ID NO: 437491 - DNA, 25 bp, Rattus norvegicus
ggcagctgcaggtgtctcagctgac

SEQ ID NO: 437492 - DNA, 25 bp, Rattus norvegicus
ggcagctgcagtctgttcaggccaa

SEQ ID NO: 437493 - DNA, 25 bp, Rattus norvegicus
ggcagctgcagtgtgttcaggccaa

SEQ ID NO: 437494 - DNA, 25 bp, Rattus norvegicus
ggcagctgccccaagaacaggaaga

SEQ ID NO: 437495 - DNA, 25 bp, Rattus norvegicus
ggcagctgcccctagaacaggaaga

SEQ ID NO: 437496 - DNA, 25 bp, Rattus norvegicus
ggcagctgcctcagattccagaaaa

SEQ ID NO: 437497 - DNA, 25 bp, Rattus norvegicus
ggcagctgcctctgattccagaaaa

SEQ ID NO: 437498 - DNA, 25 bp, Rattus norvegicus
ggcagctgctccagttttggtaaat

SEQ ID NO: 437499 - DNA, 25 bp, Rattus norvegicus
ggcagctgctcctgttttggtaaat

SEQ ID NO: 437500 - DNA, 25 bp, Rattus norvegicus
ggcagctgctctagggctgtagctt

SEQ ID NO: 437501 - DNA, 25 bp, Rattus norvegicus
ggcagctgctcttgggctgtagctt

SEQ ID NO: 437502 - DNA, 25 bp, Rattus norvegicus
ggcagctgcttcatattcaccagaa

SEQ ID NO: 437503 - DNA, 25 bp, Rattus norvegicus
ggcagctgcttcttattcaccagaa

SEQ ID NO: 437504 - DNA, 25 bp, Rattus norvegicus
ggcagctggaaaagctggccctgaa

SEQ ID NO: 437505 - DNA, 25 bp, Rattus norvegicus
ggcagctggaaatgctggccctgaa

SEQ ID NO: 437506 - DNA, 25 bp, Rattus norvegicus
ggcagctggagccatttgtaccatg

SEQ ID NO: 437507 - DNA, 25 bp, Rattus norvegicus
ggcagctggagcgatttgtaccatg

SEQ ID NO: 437508 - DNA, 25 bp, Rattus norvegicus
ggcagctggatcaccatgagtctga

SEQ ID NO: 437509 - DNA, 25 bp, Rattus norvegicus
ggcagctggatccttgtgtgttcaa

SEQ ID NO: 437510 - DNA, 25 bp, Rattus norvegicus
ggcagctggatcgttgtgtgttcaa

SEQ ID NO: 437511 - DNA, 25 bp, Rattus norvegicus
ggcagctggatctccatgagtctga

SEQ ID NO: 437512 - DNA, 25 bp, Rattus norvegicus
ggcagctggcacaagcaactcggtt

SEQ ID NO: 437513 - DNA, 25 bp, Rattus norvegicus
ggcagctggcacactcagaggagcc

SEQ ID NO: 437514 - DNA, 25 bp, Rattus norvegicus
ggcagctggcactagcaactcggtt

SEQ ID NO: 437515 - DNA, 25 bp, Rattus norvegicus
ggcagctggcactctcagaggagcc

SEQ ID NO: 437516 - DNA, 25 bp, Rattus norvegicus
ggcagctggccgctgtagccgcaca

SEQ ID NO: 437517 - DNA, 25 bp, Rattus norvegicus
ggcagctggccggtgtagccgcaca

SEQ ID NO: 437518 - DNA, 25 bp, Rattus norvegicus
ggcagctgggccatggtgataccaa

SEQ ID NO: 437519 - DNA, 25 bp, Rattus norvegicus
ggcagctgggccttggtgataccaa

SEQ ID NO: 437520 - DNA, 25 bp, Rattus norvegicus
ggcagctgtcaaaatagactcaaat

SEQ ID NO: 437521 - DNA, 25 bp, Rattus norvegicus
ggcagctgtcaatatagactcaaat

SEQ ID NO: 437522 - DNA, 25 bp, Rattus norvegicus
ggcagctgtgtcatttcctaaggaa

SEQ ID NO: 437523 - DNA, 25 bp, Rattus norvegicus
ggcagctgtgtcttttcctaaggaa

SEQ ID NO: 437524 - DNA, 25 bp, Rattus norvegicus
ggcagcttacaaaacagaccgagat

SEQ ID NO: 437525 - DNA, 25 bp, Rattus norvegicus
ggcagcttacaatacagaccgagat

SEQ ID NO: 437526 - DNA, 25 bp, Rattus norvegicus
ggcagcttaccccatagaattacaa

SEQ ID NO: 437527 - DNA, 25 bp, Rattus norvegicus
ggcagcttacccgatagaattacaa

SEQ ID NO: 437528 - DNA, 25 bp, Rattus norvegicus
ggcagcttcaacacagatgcgtctg

SEQ ID NO: 437529 - DNA, 25 bp, Rattus norvegicus
ggcagcttcaactcagatgcgtctg

SEQ ID NO: 437530 - DNA, 25 bp, Rattus norvegicus
ggcagcttccccattgataatcagg

SEQ ID NO: 437531 - DNA, 25 bp, Rattus norvegicus
ggcagcttcccctttgataatcagg

SEQ ID NO: 437532 - DNA, 25 bp, Rattus norvegicus
ggcagcttctggactagagagtcct

SEQ ID NO: 437533 - DNA, 25 bp, Rattus norvegicus
ggcagcttctggtctagagagtcct

SEQ ID NO: 437534 - DNA, 25 bp, Rattus norvegicus
ggcagcttgaatagaaactccacag

SEQ ID NO: 437535 - DNA, 25 bp, Rattus norvegicus
ggcagcttgaattgaaactccacag

SEQ ID NO: 437536 - DNA, 25 bp, Rattus norvegicus
ggcagcttgaccagcgactacactg

SEQ ID NO: 437537 - DNA, 25 bp, Rattus norvegicus
ggcagcttgacctgcgactacactg

SEQ ID NO: 437538 - DNA, 25 bp, Rattus norvegicus
ggcagcttgagacggccatttgcaa

SEQ ID NO: 437539 - DNA, 25 bp, Rattus norvegicus
ggcagcttgagagggccatttgcaa

SEQ ID NO: 437540 - DNA, 25 bp, Rattus norvegicus
ggcagcttgatcctctctgtgacat

SEQ ID NO: 437541 - DNA, 25 bp, Rattus norvegicus
ggcagcttgatcgtctctgtgacat

SEQ ID NO: 437542 - DNA, 25 bp, Rattus norvegicus
ggcagcttgcagactcttgtgaaca

SEQ ID NO: 437543 - DNA, 25 bp, Rattus norvegicus
ggcagcttgcagtctcttgtgaaca

SEQ ID NO: 437544 - DNA, 25 bp, Rattus norvegicus
ggcagcttgcctacttattttgctt

SEQ ID NO: 437545 - DNA, 25 bp, Rattus norvegicus
ggcagcttgccttcttattttgctt

SEQ ID NO: 437546 - DNA, 25 bp, Rattus norvegicus
ggcagcttggcacgtgctcagatca

SEQ ID NO: 437547 - DNA, 25 bp, Rattus norvegicus
ggcagcttggcaggtgctcagatca

SEQ ID NO: 437548 - DNA, 25 bp, Rattus norvegicus
ggcagcttgggcagctggtaccact

SEQ ID NO: 437549 - DNA, 25 bp, Rattus norvegicus
ggcagcttgggctgctggtaccact

SEQ ID NO: 437550 - DNA, 25 bp, Rattus norvegicus
ggcagcttgtgtagctgtcactgaa

SEQ ID NO: 437551 - DNA, 25 bp, Rattus norvegicus
ggcagcttgtgttgctgtcactgaa

SEQ ID NO: 437552 - DNA, 25 bp, Rattus norvegicus
ggcagcttgttacattcttagaaaa

SEQ ID NO: 437553 - DNA, 25 bp, Rattus norvegicus
ggcagcttgttagattcttagaaaa

SEQ ID NO: 437554 - DNA, 25 bp, Rattus norvegicus
ggcagcttgtttacttgagccacta

SEQ ID NO: 437555 - DNA, 25 bp, Rattus norvegicus
ggcagcttgttttcttgagccacta

SEQ ID NO: 437556 - DNA, 25 bp, Rattus norvegicus
ggcagctttaatcccaattcatagt

SEQ ID NO: 437557 - DNA, 25 bp, Rattus norvegicus
ggcagctttaatgccaattcatagt

SEQ ID NO: 437558 - DNA, 25 bp, Rattus norvegicus
ggcagctttcaccttacgctgatct

SEQ ID NO: 437559 - DNA, 25 bp, Rattus norvegicus
ggcagctttcacgttacgctgatct

SEQ ID NO: 437560 - DNA, 25 bp, Rattus norvegicus
ggcagctttcagacttagcttgttt

SEQ ID NO: 437561 - DNA, 25 bp, Rattus norvegicus
ggcagctttcagtcttagcttgttt

SEQ ID NO: 437562 - DNA, 25 bp, Rattus norvegicus
ggcagctttcataacacagaggcag

SEQ ID NO: 437563 - DNA, 25 bp, Rattus norvegicus
ggcagctttcattacacagaggcag

SEQ ID NO: 437564 - DNA, 25 bp, Rattus norvegicus
ggcagctttgccaaggtcagcatag

SEQ ID NO: 437565 - DNA, 25 bp, Rattus norvegicus
ggcagctttgccaatttgagaattt

SEQ ID NO: 437566 - DNA, 25 bp, Rattus norvegicus
ggcagctttgcctaggtcagcatag

SEQ ID NO: 437567 - DNA, 25 bp, Rattus norvegicus
ggcagctttgcctatttgagaattt

SEQ ID NO: 437568 - DNA, 25 bp, Rattus norvegicus
ggcagctttggactagggatcttat

SEQ ID NO: 437569 - DNA, 25 bp, Rattus norvegicus
ggcagctttggagtagggatcttat

SEQ ID NO: 437570 - DNA, 25 bp, Rattus norvegicus
ggcagcttttctataccttctggaa

SEQ ID NO: 437571 - DNA, 25 bp, Rattus norvegicus
ggcagcttttctttaccttctggaa

SEQ ID NO: 437572 - DNA, 25 bp, Rattus norvegicus
ggcagcttttgaagtctgacatgtc

SEQ ID NO: 437573 - DNA, 25 bp, Rattus norvegicus
ggcagcttttgatgtctgacatgtc

SEQ ID NO: 437574 - DNA, 25 bp, Rattus norvegicus
ggcagcttttggagttattgagtaa

SEQ ID NO: 437575 - DNA, 25 bp, Rattus norvegicus
ggcagcttttggtgttattgagtaa

SEQ ID NO: 437576 - DNA, 25 bp, Rattus norvegicus
ggcagctttttaatgcgctgacatt

SEQ ID NO: 437577 - DNA, 25 bp, Rattus norvegicus
ggcagctttttattgcgctgacatt

SEQ ID NO: 437578 - DNA, 25 bp, Rattus norvegicus
ggcagctttttgaaggtctgtcaca

SEQ ID NO: 437579 - DNA, 25 bp, Rattus norvegicus
ggcagctttttgtaggtctgtcaca

SEQ ID NO: 437580 - DNA, 25 bp, Rattus norvegicus
ggcaggaaaggtcacaacctctgtg

SEQ ID NO: 437581 - DNA, 25 bp, Rattus norvegicus
ggcaggaaaggtgacaacctctgtg

SEQ ID NO: 437582 - DNA, 25 bp, Rattus norvegicus
ggcaggaacacaagaccccagtcgg

SEQ ID NO: 437583 - DNA, 25 bp, Rattus norvegicus
ggcaggaacacatgaccccagtcgg

SEQ ID NO: 437584 - DNA, 25 bp, Rattus norvegicus
ggcaggaacccgctttatatttatt

SEQ ID NO: 437585 - DNA, 25 bp, Rattus norvegicus
ggcaggaacccggtttatatttatt

SEQ ID NO: 437586 - DNA, 25 bp, Rattus norvegicus
ggcaggaacctaatgctgttttaat

SEQ ID NO: 437587 - DNA, 25 bp, Rattus norvegicus
ggcaggaacctattgctgttttaat

SEQ ID NO: 437588 - DNA, 25 bp, Rattus norvegicus
ggcaggaagatcaaacattcatggt

SEQ ID NO: 437589 - DNA, 25 bp, Rattus norvegicus
ggcaggaagatctaacattcatggt

SEQ ID NO: 437590 - DNA, 25 bp, Rattus norvegicus
ggcaggaagcacaggttcgaagaaa

SEQ ID NO: 437591 - DNA, 25 bp, Rattus norvegicus
ggcaggaagcactggttcgaagaaa

SEQ ID NO: 437592 - DNA, 25 bp, Rattus norvegicus
ggcaggaagcgccagcggccggagc

SEQ ID NO: 437593 - DNA, 25 bp, Rattus norvegicus
ggcaggaagcgcgagcggccggagc

SEQ ID NO: 437594 - DNA, 25 bp, Rattus norvegicus
ggcaggaagctcatacagcccgaaa

SEQ ID NO: 437595 - DNA, 25 bp, Rattus norvegicus
ggcaggaagctcttacagcccgaaa

SEQ ID NO: 437596 - DNA, 25 bp, Rattus norvegicus
ggcaggaatacccagtcacgtcacc

SEQ ID NO: 437597 - DNA, 25 bp, Rattus norvegicus
ggcaggaataccgagtcacgtcacc

SEQ ID NO: 437598 - DNA, 25 bp, Rattus norvegicus
ggcaggaatttcagggccaggttct

SEQ ID NO: 437599 - DNA, 25 bp, Rattus norvegicus
ggcaggaatttctgggccaggttct

SEQ ID NO: 437600 - DNA, 25 bp, Rattus norvegicus
ggcaggacaagcagccccacctggg

SEQ ID NO: 437601 - DNA, 25 bp, Rattus norvegicus
ggcaggacaagctgccccacctggg

SEQ ID NO: 437602 - DNA, 25 bp, Rattus norvegicus
ggcaggacaccaagctcaaggccat

SEQ ID NO: 437603 - DNA, 25 bp, Rattus norvegicus
ggcaggacaccatgctcaaggccat

SEQ ID NO: 437604 - DNA, 25 bp, Rattus norvegicus
ggcaggacacgaactctgaatttga

SEQ ID NO: 437605 - DNA, 25 bp, Rattus norvegicus
ggcaggacacgatctctgaatttga

SEQ ID NO: 437606 - DNA, 25 bp, Rattus norvegicus
ggcaggacagacaagagcaaaccat

SEQ ID NO: 437607 - DNA, 25 bp, Rattus norvegicus
ggcaggacagactagagcaaaccat

SEQ ID NO: 437608 - DNA, 25 bp, Rattus norvegicus
ggcaggacagcaatctgagcagctt

SEQ ID NO: 437609 - DNA, 25 bp, Rattus norvegicus
ggcaggacagcattctgagcagctt

SEQ ID NO: 437610 - DNA, 25 bp, Rattus norvegicus
ggcaggacagtgcttaggtcattca

SEQ ID NO: 437611 - DNA, 25 bp, Rattus norvegicus
ggcaggacagtggttaggtcattca

SEQ ID NO: 437612 - DNA, 25 bp, Rattus norvegicus
ggcaggacttccagtgccacagtaa

SEQ ID NO: 437613 - DNA, 25 bp, Rattus norvegicus
ggcaggacttcctgtgccacagtaa

SEQ ID NO: 437614 - DNA, 25 bp, Rattus norvegicus
ggcaggactttacagacccaggttt

SEQ ID NO: 437615 - DNA, 25 bp, Rattus norvegicus
ggcaggactttagagacccaggttt

SEQ ID NO: 437616 - DNA, 25 bp, Rattus norvegicus
ggcaggagacctctggttctactga

SEQ ID NO: 437617 - DNA, 25 bp, Rattus norvegicus
ggcaggagacctgtggttctactga

SEQ ID NO: 437618 - DNA, 25 bp, Rattus norvegicus
ggcaggagcacgagattctgttaat

SEQ ID NO: 437619 - DNA, 25 bp, Rattus norvegicus
ggcaggagcacgtgattctgttaat

SEQ ID NO: 437620 - DNA, 25 bp, Rattus norvegicus
ggcaggagcagcagactcaaagcct

SEQ ID NO: 437621 - DNA, 25 bp, Rattus norvegicus
ggcaggagcagctgactcaaagcct

SEQ ID NO: 437622 - DNA, 25 bp, Rattus norvegicus
ggcaggagccaaatgtatgtcttga

SEQ ID NO: 437623 - DNA, 25 bp, Rattus norvegicus
ggcaggagccaattgtatgtcttga

SEQ ID NO: 437624 - DNA, 25 bp, Rattus norvegicus
ggcaggagccgaccctttttgttgc

SEQ ID NO: 437625 - DNA, 25 bp, Rattus norvegicus
ggcaggagccgagcctttttgttgc

SEQ ID NO: 437626 - DNA, 25 bp, Rattus norvegicus
ggcaggagctgaaactcactcattt

SEQ ID NO: 437627 - DNA, 25 bp, Rattus norvegicus
ggcaggagctgatactcactcattt

SEQ ID NO: 437628 - DNA, 25 bp, Rattus norvegicus
ggcaggaggacaacagactccagaa

SEQ ID NO: 437629 - DNA, 25 bp, Rattus norvegicus
ggcaggaggacatcagactccagaa

SEQ ID NO: 437630 - DNA, 25 bp, Rattus norvegicus
ggcaggaggccacgccctacctagt

SEQ ID NO: 437631 - DNA, 25 bp, Rattus norvegicus
ggcaggaggccaggccctacctagt

SEQ ID NO: 437632 - DNA, 25 bp, Rattus norvegicus
ggcaggaggctcatcaggactttaa

SEQ ID NO: 437633 - DNA, 25 bp, Rattus norvegicus
ggcaggaggctcttcaggactttaa

SEQ ID NO: 437634 - DNA, 25 bp, Rattus norvegicus
ggcaggaggtttatgttctttttct

SEQ ID NO: 437635 - DNA, 25 bp, Rattus norvegicus
ggcaggaggtttttgttctttttct

SEQ ID NO: 437636 - DNA, 25 bp, Rattus norvegicus
ggcaggagtccgagttaaaccttca

SEQ ID NO: 437637 - DNA, 25 bp, Rattus norvegicus
ggcaggagtccgtgttaaaccttca

SEQ ID NO: 437638 - DNA, 25 bp, Rattus norvegicus
ggcaggagtctcagtgtcaagctgt

SEQ ID NO: 437639 - DNA, 25 bp, Rattus norvegicus
ggcaggagtctctgtgtcaagctgt

SEQ ID NO: 437640 - DNA, 25 bp, Rattus norvegicus
ggcaggataaccaacaattctcccc

SEQ ID NO: 437641 - DNA, 25 bp, Rattus norvegicus
ggcaggataacctacaattctcccc

SEQ ID NO: 437642 - DNA, 25 bp, Rattus norvegicus
ggcaggatagatagacccaggtctc

SEQ ID NO: 437643 - DNA, 25 bp, Rattus norvegicus
ggcaggatagattgacccaggtctc

SEQ ID NO: 437644 - DNA, 25 bp, Rattus norvegicus
ggcaggatcgacccgcttctgtatg

SEQ ID NO: 437645 - DNA, 25 bp, Rattus norvegicus
ggcaggatcgacgcgcttctgtatg

SEQ ID NO: 437646 - DNA, 25 bp, Rattus norvegicus
ggcaggatggccactggaattttct

SEQ ID NO: 437647 - DNA, 25 bp, Rattus norvegicus
ggcaggatggcctctggaattttct

SEQ ID NO: 437648 - DNA, 25 bp, Rattus norvegicus
ggcaggattaatctgtttggtagta

SEQ ID NO: 437649 - DNA, 25 bp, Rattus norvegicus
ggcaggattaatgtgtttggtagta

SEQ ID NO: 437650 - DNA, 25 bp, Rattus norvegicus
ggcaggattaggatgctccacacac

SEQ ID NO: 437651 - DNA, 25 bp, Rattus norvegicus
ggcaggattaggttgctccacacac

SEQ ID NO: 437652 - DNA, 25 bp, Rattus norvegicus
ggcaggattccaacgctggagcaat

SEQ ID NO: 437653 - DNA, 25 bp, Rattus norvegicus
ggcaggattccatcgctggagcaat

SEQ ID NO: 437654 - DNA, 25 bp, Rattus norvegicus
ggcaggattctgacatcagtcatca

SEQ ID NO: 437655 - DNA, 25 bp, Rattus norvegicus
ggcaggattctgtcatcagtcatca

SEQ ID NO: 437656 - DNA, 25 bp, Rattus norvegicus
ggcaggcaataaatatggaggcata

SEQ ID NO: 437657 - DNA, 25 bp, Rattus norvegicus
ggcaggcaataattatggaggcata

SEQ ID NO: 437658 - DNA, 25 bp, Rattus norvegicus
ggcaggcaatggagcttcaaattca

SEQ ID NO: 437659 - DNA, 25 bp, Rattus norvegicus
ggcaggcaatggtgcttcaaattca

SEQ ID NO: 437660 - DNA, 25 bp, Rattus norvegicus
ggcaggcacaagctagtacatgcta

SEQ ID NO: 437661 - DNA, 25 bp, Rattus norvegicus
ggcaggcacaaggtagtacatgcta

SEQ ID NO: 437662 - DNA, 25 bp, Rattus norvegicus
ggcaggcacattacagagctaagta

SEQ ID NO: 437663 - DNA, 25 bp, Rattus norvegicus
ggcaggcacatttcagagctaagta

SEQ ID NO: 437664 - DNA, 25 bp, Rattus norvegicus
ggcaggcagaatacacctacgccta

SEQ ID NO: 437665 - DNA, 25 bp, Rattus norvegicus
ggcaggcagaattcacctacgccta

SEQ ID NO: 437666 - DNA, 25 bp, Rattus norvegicus
ggcaggcagctgaagagattcttag

SEQ ID NO: 437667 - DNA, 25 bp, Rattus norvegicus
ggcaggcagctgtagagattcttag

SEQ ID NO: 437668 - DNA, 25 bp, Rattus norvegicus
ggcaggcaggagactcaaccaaaaa

SEQ ID NO: 437669 - DNA, 25 bp, Rattus norvegicus
ggcaggcaggagtctcaaccaaaaa

SEQ ID NO: 437670 - DNA, 25 bp, Rattus norvegicus
ggcaggcaggctatttagacccaaa

SEQ ID NO: 437671 - DNA, 25 bp, Rattus norvegicus
ggcaggcaggctttttagacccaaa

SEQ ID NO: 437672 - DNA, 25 bp, Rattus norvegicus
ggcaggcaggtcatacagaatgagt

SEQ ID NO: 437673 - DNA, 25 bp, Rattus norvegicus
ggcaggcaggtcttacagaatgagt

SEQ ID NO: 437674 - DNA, 25 bp, Rattus norvegicus
ggcaggcagtataggcagccacaaa

SEQ ID NO: 437675 - DNA, 25 bp, Rattus norvegicus
ggcaggcagtattggcagccacaaa

SEQ ID NO: 437676 - DNA, 25 bp, Rattus norvegicus
ggcaggcagtctcgctagtccttgc

SEQ ID NO: 437677 - DNA, 25 bp, Rattus norvegicus
ggcaggcagtctggctagtccttgc

SEQ ID NO: 437678 - DNA, 25 bp, Rattus norvegicus
ggcaggcataagcaacaataaggta

SEQ ID NO: 437679 - DNA, 25 bp, Rattus norvegicus
ggcaggcataaggaacaataaggta

SEQ ID NO: 437680 - DNA, 25 bp, Rattus norvegicus
ggcaggcatcccaattactaagtac

SEQ ID NO: 437681 - DNA, 25 bp, Rattus norvegicus
ggcaggcatccctattactaagtac

SEQ ID NO: 437682 - DNA, 25 bp, Rattus norvegicus
ggcaggccaaggacagtctcctgga

SEQ ID NO: 437683 - DNA, 25 bp, Rattus norvegicus
ggcaggccaaggtcagtctcctgga

SEQ ID NO: 437684 - DNA, 25 bp, Rattus norvegicus
ggcaggccactgagagtttgaccat

SEQ ID NO: 437685 - DNA, 25 bp, Rattus norvegicus
ggcaggccactgtgagtttgaccat

SEQ ID NO: 437686 - DNA, 25 bp, Rattus norvegicus
ggcaggccagagcacatttttgttt

SEQ ID NO: 437687 - DNA, 25 bp, Rattus norvegicus
ggcaggccagaggacatttttgttt

SEQ ID NO: 437688 - DNA, 25 bp, Rattus norvegicus
ggcaggcccagaaaagccctgaact

SEQ ID NO: 437689 - DNA, 25 bp, Rattus norvegicus
ggcaggcccagaaatcactatgtat

SEQ ID NO: 437690 - DNA, 25 bp, Rattus norvegicus
ggcaggcccagataagccctgaact

SEQ ID NO: 437691 - DNA, 25 bp, Rattus norvegicus
ggcaggcccagatatcactatgtat

SEQ ID NO: 437692 - DNA, 25 bp, Rattus norvegicus
ggcaggcccaggaagcccatgactt

SEQ ID NO: 437693 - DNA, 25 bp, Rattus norvegicus
ggcaggcccaggtagcccatgactt

SEQ ID NO: 437694 - DNA, 25 bp, Rattus norvegicus
ggcaggccgcctccttttggagaac

SEQ ID NO: 437695 - DNA, 25 bp, Rattus norvegicus
ggcaggccgcctgcttttggagaac

SEQ ID NO: 437696 - DNA, 25 bp, Rattus norvegicus
ggcaggccggatactccaccgaggc

SEQ ID NO: 437697 - DNA, 25 bp, Rattus norvegicus
ggcaggccggattctccaccgaggc

SEQ ID NO: 437698 - DNA, 25 bp, Rattus norvegicus
ggcaggcctaataactacagtcagc

SEQ ID NO: 437699 - DNA, 25 bp, Rattus norvegicus
ggcaggcctaattactacagtcagc

SEQ ID NO: 437700 - DNA, 25 bp, Rattus norvegicus
ggcaggcctctcactgataagatga

SEQ ID NO: 437701 - DNA, 25 bp, Rattus norvegicus
ggcaggcctctctctgataagatga

SEQ ID NO: 437702 - DNA, 25 bp, Rattus norvegicus
ggcaggcctgggatatagccatcct

SEQ ID NO: 437703 - DNA, 25 bp, Rattus norvegicus
ggcaggcctgggttatagccatcct

SEQ ID NO: 437704 - DNA, 25 bp, Rattus norvegicus
ggcaggcctggtctattggtctata

SEQ ID NO: 437705 - DNA, 25 bp, Rattus norvegicus
ggcaggcctggtgtattggtctata

SEQ ID NO: 437706 - DNA, 25 bp, Rattus norvegicus
ggcaggcgatttcccaagattcatt

SEQ ID NO: 437707 - DNA, 25 bp, Rattus norvegicus
ggcaggcgatttgccaagattcatt

SEQ ID NO: 437708 - DNA, 25 bp, Rattus norvegicus
ggcaggcgcatacccatcagatgct

SEQ ID NO: 437709 - DNA, 25 bp, Rattus norvegicus
ggcaggcgcatagccatcagatgct

SEQ ID NO: 437710 - DNA, 25 bp, Rattus norvegicus
ggcaggcgccaaaccaaagacagat

SEQ ID NO: 437711 - DNA, 25 bp, Rattus norvegicus
ggcaggcgccaatccaaagacagat

SEQ ID NO: 437712 - DNA, 25 bp, Rattus norvegicus
ggcaggcgtgttctatatacttgtc

SEQ ID NO: 437713 - DNA, 25 bp, Rattus norvegicus
ggcaggcgtgttgtatatacttgtc

SEQ ID NO: 437714 - DNA, 25 bp, Rattus norvegicus
ggcaggctaaccatacagcagtcaa

SEQ ID NO: 437715 - DNA, 25 bp, Rattus norvegicus
ggcaggctaaccttacagcagtcaa

SEQ ID NO: 437716 - DNA, 25 bp, Rattus norvegicus
ggcaggctactgactaaaatccaaa

SEQ ID NO: 437717 - DNA, 25 bp, Rattus norvegicus
ggcaggctactgtctaaaatccaaa

SEQ ID NO: 437718 - DNA, 25 bp, Rattus norvegicus
ggcaggctatttaactatgtctttg

SEQ ID NO: 437719 - DNA, 25 bp, Rattus norvegicus
ggcaggctattttactatgtctttg

SEQ ID NO: 437720 - DNA, 25 bp, Rattus norvegicus
ggcaggctgaaaactgttcataggt

SEQ ID NO: 437721 - DNA, 25 bp, Rattus norvegicus
ggcaggctgaaatctgttcataggt

SEQ ID NO: 437722 - DNA, 25 bp, Rattus norvegicus
ggcaggctgactcctttcctttggt

SEQ ID NO: 437723 - DNA, 25 bp, Rattus norvegicus
ggcaggctgactgctttcctttggt

SEQ ID NO: 437724 - DNA, 25 bp, Rattus norvegicus
ggcaggctgattctggccagttctc

SEQ ID NO: 437725 - DNA, 25 bp, Rattus norvegicus
ggcaggctgattgtggccagttctc

SEQ ID NO: 437726 - DNA, 25 bp, Rattus norvegicus
ggcaggctgcaaacctgacacagga

SEQ ID NO: 437727 - DNA, 25 bp, Rattus norvegicus
ggcaggctgcaatcctgacacagga

SEQ ID NO: 437728 - DNA, 25 bp, Rattus norvegicus
ggcaggctgctgcttgtctaccctt

SEQ ID NO: 437729 - DNA, 25 bp, Rattus norvegicus
ggcaggctgctggttgtctaccctt

SEQ ID NO: 437730 - DNA, 25 bp, Rattus norvegicus
ggcaggctgtaacattcattctctc

SEQ ID NO: 437731 - DNA, 25 bp, Rattus norvegicus
ggcaggctgtaagattcattctctc

SEQ ID NO: 437732 - DNA, 25 bp, Rattus norvegicus
ggcaggcttggacaacagttagctt

SEQ ID NO: 437733 - DNA, 25 bp, Rattus norvegicus
ggcaggcttggagaacagttagctt

SEQ ID NO: 437734 - DNA, 25 bp, Rattus norvegicus
ggcaggctttttcctgaaaggtgat

SEQ ID NO: 437735 - DNA, 25 bp, Rattus norvegicus
ggcaggctttttgctgaaaggtgat

SEQ ID NO: 437736 - DNA, 25 bp, Rattus norvegicus
ggcagggaaactatggcacctagcc

SEQ ID NO: 437737 - DNA, 25 bp, Rattus norvegicus
ggcagggaaactttggcacctagcc

SEQ ID NO: 437738 - DNA, 25 bp, Rattus norvegicus
ggcagggaaccaaccagatcagtct

SEQ ID NO: 437739 - DNA, 25 bp, Rattus norvegicus
ggcagggaaccatccagatcagtct

SEQ ID NO: 437740 - DNA, 25 bp, Rattus norvegicus
ggcagggaataaccctcaactcctt

SEQ ID NO: 437741 - DNA, 25 bp, Rattus norvegicus
ggcagggaataagcctcaactcctt

SEQ ID NO: 437742 - DNA, 25 bp, Rattus norvegicus
ggcagggacaccagatgggccttcc

SEQ ID NO: 437743 - DNA, 25 bp, Rattus norvegicus
ggcagggacacctgatgggccttcc

SEQ ID NO: 437744 - DNA, 25 bp, Rattus norvegicus
ggcagggactcacagatttctctag

SEQ ID NO: 437745 - DNA, 25 bp, Rattus norvegicus
ggcagggactcagagatttctctag

SEQ ID NO: 437746 - DNA, 25 bp, Rattus norvegicus
ggcagggactgaagcagtgaccata

SEQ ID NO: 437747 - DNA, 25 bp, Rattus norvegicus
ggcagggactgatgcagtgaccata

SEQ ID NO: 437748 - DNA, 25 bp, Rattus norvegicus
ggcagggactgtatcaaaagcactt

SEQ ID NO: 437749 - DNA, 25 bp, Rattus norvegicus
ggcagggactgtttcaaaagcactt

SEQ ID NO: 437750 - DNA, 25 bp, Rattus norvegicus
ggcagggagattctccaatcatcct

SEQ ID NO: 437751 - DNA, 25 bp, Rattus norvegicus
ggcagggagattgtccaatcatcct

SEQ ID NO: 437752 - DNA, 25 bp, Rattus norvegicus
ggcagggagccacaaatcttaccca

SEQ ID NO: 437753 - DNA, 25 bp, Rattus norvegicus
ggcagggagccagaaatcttaccca

SEQ ID NO: 437754 - DNA, 25 bp, Rattus norvegicus
ggcagggatcgtccctttccccaag

SEQ ID NO: 437755 - DNA, 25 bp, Rattus norvegicus
ggcagggatcgtgcctttccccaag

SEQ ID NO: 437756 - DNA, 25 bp, Rattus norvegicus
ggcagggatttacccttccagtgga

SEQ ID NO: 437757 - DNA, 25 bp, Rattus norvegicus
ggcagggatttagccttccagtgga

SEQ ID NO: 437758 - DNA, 25 bp, Rattus norvegicus
ggcagggcaaggactctttactata

SEQ ID NO: 437759 - DNA, 25 bp, Rattus norvegicus
ggcagggcaaggtctctttactata

SEQ ID NO: 437760 - DNA, 25 bp, Rattus norvegicus
ggcagggcacctaacgaaaaataat

SEQ ID NO: 437761 - DNA, 25 bp, Rattus norvegicus
ggcagggcacctagcgcagcacact

SEQ ID NO: 437762 - DNA, 25 bp, Rattus norvegicus
ggcagggcaccttacgaaaaataat

SEQ ID NO: 437763 - DNA, 25 bp, Rattus norvegicus
ggcagggcaccttgcgcagcacact

SEQ ID NO: 437764 - DNA, 25 bp, Rattus norvegicus
ggcagggccaggactggacctcacc

SEQ ID NO: 437765 - DNA, 25 bp, Rattus norvegicus
ggcagggccaggtctggacctcacc

SEQ ID NO: 437766 - DNA, 25 bp, Rattus norvegicus
ggcagggccatgcactcaacatgta

SEQ ID NO: 437767 - DNA, 25 bp, Rattus norvegicus
ggcagggccatggactcaacatgta

SEQ ID NO: 437768 - DNA, 25 bp, Rattus norvegicus
ggcagggcccataagtgtgagtttt

SEQ ID NO: 437769 - DNA, 25 bp, Rattus norvegicus
ggcagggcccattagtgtgagtttt

SEQ ID NO: 437770 - DNA, 25 bp, Rattus norvegicus
ggcagggccgcaactatatcctggg

SEQ ID NO: 437771 - DNA, 25 bp, Rattus norvegicus
ggcagggccgcatctatatcctggg

SEQ ID NO: 437772 - DNA, 25 bp, Rattus norvegicus
ggcagggccttacatttcaatagaa

SEQ ID NO: 437773 - DNA, 25 bp, Rattus norvegicus
ggcagggccttagatttcaatagaa

SEQ ID NO: 437774 - DNA, 25 bp, Rattus norvegicus
ggcagggcgcggctctccggaggct

SEQ ID NO: 437775 - DNA, 25 bp, Rattus norvegicus
ggcagggcgcgggtctccggaggct

SEQ ID NO: 437776 - DNA, 25 bp, Rattus norvegicus
ggcagggctgggaaaactttgtaca

SEQ ID NO: 437777 - DNA, 25 bp, Rattus norvegicus
ggcagggctgggtaaactttgtaca

SEQ ID NO: 437778 - DNA, 25 bp, Rattus norvegicus
ggcagggtctgtctgcaccttgcct

SEQ ID NO: 437779 - DNA, 25 bp, Rattus norvegicus
ggcagggtctgtgtgcaccttgcct

SEQ ID NO: 437780 - DNA, 25 bp, Rattus norvegicus
ggcagggtgatcacatcccaagcag

SEQ ID NO: 437781 - DNA, 25 bp, Rattus norvegicus
ggcagggtgatctcatcccaagcag

SEQ ID NO: 437782 - DNA, 25 bp, Rattus norvegicus
ggcagggtgcttatactttagtctt

SEQ ID NO: 437783 - DNA, 25 bp, Rattus norvegicus
ggcagggtgcttttactttagtctt

SEQ ID NO: 437784 - DNA, 25 bp, Rattus norvegicus
ggcagggttagcatgccagcagctt

SEQ ID NO: 437785 - DNA, 25 bp, Rattus norvegicus
ggcagggttagcttgccagcagctt

SEQ ID NO: 437786 - DNA, 25 bp, Rattus norvegicus
ggcagggttctcagtaaaccccttg

SEQ ID NO: 437787 - DNA, 25 bp, Rattus norvegicus
ggcagggttctctgtaaaccccttg

SEQ ID NO: 437788 - DNA, 25 bp, Rattus norvegicus
ggcagggtttctcctatgactacgt

SEQ ID NO: 437789 - DNA, 25 bp, Rattus norvegicus
ggcagggtttctgctatgactacgt

SEQ ID NO: 437790 - DNA, 25 bp, Rattus norvegicus
ggcaggtacatgatactcaaagcat

SEQ ID NO: 437791 - DNA, 25 bp, Rattus norvegicus
ggcaggtacatgttactcaaagcat

SEQ ID NO: 437792 - DNA, 25 bp, Rattus norvegicus
ggcaggtaccatcggtgtagaccat

SEQ ID NO: 437793 - DNA, 25 bp, Rattus norvegicus
ggcaggtaccatgggtgtagaccat

SEQ ID NO: 437794 - DNA, 25 bp, Rattus norvegicus
ggcaggtcaatgagacacatgcctt

SEQ ID NO: 437795 - DNA, 25 bp, Rattus norvegicus
ggcaggtcaatgtgacacatgcctt

SEQ ID NO: 437796 - DNA, 25 bp, Rattus norvegicus
ggcaggtcccctatgatttacacat

SEQ ID NO: 437797 - DNA, 25 bp, Rattus norvegicus
ggcaggtcccctttgatttacacat

SEQ ID NO: 437798 - DNA, 25 bp, Rattus norvegicus
ggcaggtccgtcatgagctatctta

SEQ ID NO: 437799 - DNA, 25 bp, Rattus norvegicus
ggcaggtccgtcttgagctatctta

SEQ ID NO: 437800 - DNA, 25 bp, Rattus norvegicus
ggcaggtcctgtaagtgaacgtcca

SEQ ID NO: 437801 - DNA, 25 bp, Rattus norvegicus
ggcaggtcctgttagtgaacgtcca

SEQ ID NO: 437802 - DNA, 25 bp, Rattus norvegicus
ggcaggtctagtctgcacacttttt

SEQ ID NO: 437803 - DNA, 25 bp, Rattus norvegicus
ggcaggtctagtgtgcacacttttt

SEQ ID NO: 437804 - DNA, 25 bp, Rattus norvegicus
ggcaggtctcccaacaggaactgga

SEQ ID NO: 437805 - DNA, 25 bp, Rattus norvegicus
ggcaggtctccctacaggaactgga

SEQ ID NO: 437806 - DNA, 25 bp, Rattus norvegicus
ggcaggtctctacagctcgctgact

SEQ ID NO: 437807 - DNA, 25 bp, Rattus norvegicus
ggcaggtctctagagctcgctgact

SEQ ID NO: 437808 - DNA, 25 bp, Rattus norvegicus
ggcaggtctgtcacaagggtttcaa

SEQ ID NO: 437809 - DNA, 25 bp, Rattus norvegicus
ggcaggtctgtctcaagggtttcaa

SEQ ID NO: 437810 - DNA, 25 bp, Rattus norvegicus
ggcaggtgaaatcaggcagcatctt

SEQ ID NO: 437811 - DNA, 25 bp, Rattus norvegicus
ggcaggtgaaatgaggcagcatctt

SEQ ID NO: 437812 - DNA, 25 bp, Rattus norvegicus
ggcaggtgcctgattactagtgagt

SEQ ID NO: 437813 - DNA, 25 bp, Rattus norvegicus
ggcaggtgcctgtttactagtgagt

SEQ ID NO: 437814 - DNA, 25 bp, Rattus norvegicus
ggcaggtgctaaaatctccatttga

SEQ ID NO: 437815 - DNA, 25 bp, Rattus norvegicus
ggcaggtgctaatatctccatttga

SEQ ID NO: 437816 - DNA, 25 bp, Rattus norvegicus
ggcaggtgctccagtccgttggaaa

SEQ ID NO: 437817 - DNA, 25 bp, Rattus norvegicus
ggcaggtgctcctgtccgttggaaa

SEQ ID NO: 437818 - DNA, 25 bp, Rattus norvegicus
ggcaggtgctggctttggagcggca

SEQ ID NO: 437819 - DNA, 25 bp, Rattus norvegicus
ggcaggtgctgggtttggagcggca

SEQ ID NO: 437820 - DNA, 25 bp, Rattus norvegicus
ggcaggtggccacatgcacaatgca

SEQ ID NO: 437821 - DNA, 25 bp, Rattus norvegicus
ggcaggtggccagatgcacaatgca

SEQ ID NO: 437822 - DNA, 25 bp, Rattus norvegicus
ggcaggtgtactacatgaggctctt

SEQ ID NO: 437823 - DNA, 25 bp, Rattus norvegicus
ggcaggtgtacttcatgaggctctt

SEQ ID NO: 437824 - DNA, 25 bp, Rattus norvegicus
ggcaggtgtccaacaagctcaagaa

SEQ ID NO: 437825 - DNA, 25 bp, Rattus norvegicus
ggcaggtgtccatcaagctcaagaa

SEQ ID NO: 437826 - DNA, 25 bp, Rattus norvegicus
ggcaggtgtgaaacccagtctgtga

SEQ ID NO: 437827 - DNA, 25 bp, Rattus norvegicus
ggcaggtgtgaatcccagtctgtga

SEQ ID NO: 437828 - DNA, 25 bp, Rattus norvegicus
ggcaggttctgtagacatgtgacaa

SEQ ID NO: 437829 - DNA, 25 bp, Rattus norvegicus
ggcaggttctgttgacatgtgacaa

SEQ ID NO: 437830 - DNA, 25 bp, Rattus norvegicus
ggcaggttgagcatggtctaactta

SEQ ID NO: 437831 - DNA, 25 bp, Rattus norvegicus
ggcaggttgagcttggtctaactta

SEQ ID NO: 437832 - DNA, 25 bp, Rattus norvegicus
ggcaggtttacaacactacacgttt

SEQ ID NO: 437833 - DNA, 25 bp, Rattus norvegicus
ggcaggtttacaactgactccagtg

SEQ ID NO: 437834 - DNA, 25 bp, Rattus norvegicus
ggcaggtttacatcactacacgttt

SEQ ID NO: 437835 - DNA, 25 bp, Rattus norvegicus
ggcaggtttacatctgactccagtg

SEQ ID NO: 437836 - DNA, 25 bp, Rattus norvegicus
ggcaggtttcccatggaccaatcaa

SEQ ID NO: 437837 - DNA, 25 bp, Rattus norvegicus
ggcaggtttcccttggaccaatcaa

SEQ ID NO: 437838 - DNA, 25 bp, Rattus norvegicus
ggcagtaaagacaggtctccccaca

SEQ ID NO: 437839 - DNA, 25 bp, Rattus norvegicus
ggcagtaaagactggtctccccaca

SEQ ID NO: 437840 - DNA, 25 bp, Rattus norvegicus
ggcagtaaataaccccaagaagcag

SEQ ID NO: 437841 - DNA, 25 bp, Rattus norvegicus
ggcagtaaataagcccaagaagcag

SEQ ID NO: 437842 - DNA, 25 bp, Rattus norvegicus
ggcagtaactgactccaacagcatt

SEQ ID NO: 437843 - DNA, 25 bp, Rattus norvegicus
ggcagtaactgagtccaacagcatt

SEQ ID NO: 437844 - DNA, 25 bp, Rattus norvegicus
ggcagtaactggataccttttattt

SEQ ID NO: 437845 - DNA, 25 bp, Rattus norvegicus
ggcagtaactggttaccttttattt

SEQ ID NO: 437846 - DNA, 25 bp, Rattus norvegicus
ggcagtaagcccaagtttgctgtta

SEQ ID NO: 437847 - DNA, 25 bp, Rattus norvegicus
ggcagtaagccctagtttgctgtta

SEQ ID NO: 437848 - DNA, 25 bp, Rattus norvegicus
ggcagtaaggccaatgggctcctct

SEQ ID NO: 437849 - DNA, 25 bp, Rattus norvegicus
ggcagtaaggcctatgggctcctct

SEQ ID NO: 437850 - DNA, 25 bp, Rattus norvegicus
ggcagtaagtgccagctcaatgtta

SEQ ID NO: 437851 - DNA, 25 bp, Rattus norvegicus
ggcagtaagtgcgagctcaatgtta

SEQ ID NO: 437852 - DNA, 25 bp, Rattus norvegicus
ggcagtaataggcacacaagagtat

SEQ ID NO: 437853 - DNA, 25 bp, Rattus norvegicus
ggcagtaatagggacacaagagtat

SEQ ID NO: 437854 - DNA, 25 bp, Rattus norvegicus
ggcagtaatcccctcgacatcgaca

SEQ ID NO: 437855 - DNA, 25 bp, Rattus norvegicus
ggcagtaatcccgtcgacatcgaca

SEQ ID NO: 437856 - DNA, 25 bp, Rattus norvegicus
ggcagtaattttactaccacagtca

SEQ ID NO: 437857 - DNA, 25 bp, Rattus norvegicus
ggcagtaatttttctaccacagtca

SEQ ID NO: 437858 - DNA, 25 bp, Rattus norvegicus
ggcagtacaacaacagcagccctca

SEQ ID NO: 437859 - DNA, 25 bp, Rattus norvegicus
ggcagtacaacatcagcagccctca

SEQ ID NO: 437860 - DNA, 25 bp, Rattus norvegicus
ggcagtacagctcggatttgtttta

SEQ ID NO: 437861 - DNA, 25 bp, Rattus norvegicus
ggcagtacagctgggatttgtttta

SEQ ID NO: 437862 - DNA, 25 bp, Rattus norvegicus
ggcagtacagtaaagctttcttctc

SEQ ID NO: 437863 - DNA, 25 bp, Rattus norvegicus
ggcagtacagtatagctttcttctc

SEQ ID NO: 437864 - DNA, 25 bp, Rattus norvegicus
ggcagtacattccagagcagtctag

SEQ ID NO: 437865 - DNA, 25 bp, Rattus norvegicus
ggcagtacattcgagagcagtctag

SEQ ID NO: 437866 - DNA, 25 bp, Rattus norvegicus
ggcagtaccaaaccccttatatggg

SEQ ID NO: 437867 - DNA, 25 bp, Rattus norvegicus
ggcagtaccaaagcccttatatggg

SEQ ID NO: 437868 - DNA, 25 bp, Rattus norvegicus
ggcagtaccagtagccaaggtgttt

SEQ ID NO: 437869 - DNA, 25 bp, Rattus norvegicus
ggcagtaccagttgccaaggtgttt

SEQ ID NO: 437870 - DNA, 25 bp, Rattus norvegicus
ggcagtagaccccaaaatgtagcga

SEQ ID NO: 437871 - DNA, 25 bp, Rattus norvegicus
ggcagtagacccgaaaatgtagcga

SEQ ID NO: 437872 - DNA, 25 bp, Rattus norvegicus
ggcagtagacgaatctttttgcttt

SEQ ID NO: 437873 - DNA, 25 bp, Rattus norvegicus
ggcagtagacgattctttttgcttt

SEQ ID NO: 437874 - DNA, 25 bp, Rattus norvegicus
ggcagtagagcccatttaattgtga

SEQ ID NO: 437875 - DNA, 25 bp, Rattus norvegicus
ggcagtagagccgatttaattgtga

SEQ ID NO: 437876 - DNA, 25 bp, Rattus norvegicus
ggcagtagcaccagcggccaatttc

SEQ ID NO: 437877 - DNA, 25 bp, Rattus norvegicus
ggcagtagcacctgcggccaatttc

SEQ ID NO: 437878 - DNA, 25 bp, Rattus norvegicus
ggcagtagcgccaacggccacgaat

SEQ ID NO: 437879 - DNA, 25 bp, Rattus norvegicus
ggcagtagcgcctacggccacgaat

SEQ ID NO: 437880 - DNA, 25 bp, Rattus norvegicus
ggcagtaggttgaccttttgttctt

SEQ ID NO: 437881 - DNA, 25 bp, Rattus norvegicus
ggcagtaggttgtccttttgttctt

SEQ ID NO: 437882 - DNA, 25 bp, Rattus norvegicus
ggcagtataccacagacatgctctt

SEQ ID NO: 437883 - DNA, 25 bp, Rattus norvegicus
ggcagtataccagagacatgctctt

SEQ ID NO: 437884 - DNA, 25 bp, Rattus norvegicus
ggcagtatatgccatcatctatatt

SEQ ID NO: 437885 - DNA, 25 bp, Rattus norvegicus
ggcagtatatgcgatcatctatatt

SEQ ID NO: 437886 - DNA, 25 bp, Rattus norvegicus
ggcagtatattaccattctctcaaa

SEQ ID NO: 437887 - DNA, 25 bp, Rattus norvegicus
ggcagtatattagcattctctcaaa

SEQ ID NO: 437888 - DNA, 25 bp, Rattus norvegicus
ggcagtatcatacctagccatattt

SEQ ID NO: 437889 - DNA, 25 bp, Rattus norvegicus
ggcagtatcatagctagccatattt

SEQ ID NO: 437890 - DNA, 25 bp, Rattus norvegicus
ggcagtatctgcagaggcctcaaga

SEQ ID NO: 437891 - DNA, 25 bp, Rattus norvegicus
ggcagtatctgctgaggcctcaaga

SEQ ID NO: 437892 - DNA, 25 bp, Rattus norvegicus
ggcagtatctgtaatacactgtata

SEQ ID NO: 437893 - DNA, 25 bp, Rattus norvegicus
ggcagtatctgttatacactgtata

SEQ ID NO: 437894 - DNA, 25 bp, Rattus norvegicus
ggcagtattgaacccctttgtattt

SEQ ID NO: 437895 - DNA, 25 bp, Rattus norvegicus
ggcagtattgaagccctttgtattt

SEQ ID NO: 437896 - DNA, 25 bp, Rattus norvegicus
ggcagtatttatatatccgagtgta

SEQ ID NO: 437897 - DNA, 25 bp, Rattus norvegicus
ggcagtatttatttatccgagtgta

SEQ ID NO: 437898 - DNA, 25 bp, Rattus norvegicus
ggcagtattttgcttcgtgtaatgg

SEQ ID NO: 437899 - DNA, 25 bp, Rattus norvegicus
ggcagtattttggttcgtgtaatgg

SEQ ID NO: 437900 - DNA, 25 bp, Rattus norvegicus
ggcagtcaaaccagggttccttctt

SEQ ID NO: 437901 - DNA, 25 bp, Rattus norvegicus
ggcagtcaaacctgggttccttctt

SEQ ID NO: 437902 - DNA, 25 bp, Rattus norvegicus
ggcagtcaagagacagtcacttcct

SEQ ID NO: 437903 - DNA, 25 bp, Rattus norvegicus
ggcagtcaagagtcagtcacttcct

SEQ ID NO: 437904 - DNA, 25 bp, Rattus norvegicus
ggcagtcaatcaaccagctggccag

SEQ ID NO: 437905 - DNA, 25 bp, Rattus norvegicus
ggcagtcaatcatccagctggccag

SEQ ID NO: 437906 - DNA, 25 bp, Rattus norvegicus
ggcagtcacaggcaccacttgaatc

SEQ ID NO: 437907 - DNA, 25 bp, Rattus norvegicus
ggcagtcacagggaccacttgaatc

SEQ ID NO: 437908 - DNA, 25 bp, Rattus norvegicus
ggcagtcacgtcattagttccaagg

SEQ ID NO: 437909 - DNA, 25 bp, Rattus norvegicus
ggcagtcacgtctttagttccaagg

SEQ ID NO: 437910 - DNA, 25 bp, Rattus norvegicus
ggcagtcactacagctactcagaga

SEQ ID NO: 437911 - DNA, 25 bp, Rattus norvegicus
ggcagtcactactgctactcagaga

SEQ ID NO: 437912 - DNA, 25 bp, Rattus norvegicus
ggcagtcactgacatgtctaaatga

SEQ ID NO: 437913 - DNA, 25 bp, Rattus norvegicus
ggcagtcactgagatgtctaaatga

SEQ ID NO: 437914 - DNA, 25 bp, Rattus norvegicus
ggcagtcactgcaagtttatcacca

SEQ ID NO: 437915 - DNA, 25 bp, Rattus norvegicus
ggcagtcactgcaataaatgtaaat

SEQ ID NO: 437916 - DNA, 25 bp, Rattus norvegicus
ggcagtcactgcacaacttgcagga

SEQ ID NO: 437917 - DNA, 25 bp, Rattus norvegicus
ggcagtcactgctagtttatcacca

SEQ ID NO: 437918 - DNA, 25 bp, Rattus norvegicus
ggcagtcactgctataaatgtaaat

SEQ ID NO: 437919 - DNA, 25 bp, Rattus norvegicus
ggcagtcactgctcaacttgcagga

SEQ ID NO: 437920 - DNA, 25 bp, Rattus norvegicus
ggcagtcagaccacctccgaagaag

SEQ ID NO: 437921 - DNA, 25 bp, Rattus norvegicus
ggcagtcagacctcctccgaagaag

SEQ ID NO: 437922 - DNA, 25 bp, Rattus norvegicus
ggcagtcagagtatggcacttatga

SEQ ID NO: 437923 - DNA, 25 bp, Rattus norvegicus
ggcagtcagagtttggcacttatga

SEQ ID NO: 437924 - DNA, 25 bp, Rattus norvegicus
ggcagtcagcccacggtggatgaca

SEQ ID NO: 437925 - DNA, 25 bp, Rattus norvegicus
ggcagtcagccctcggtggatgaca

SEQ ID NO: 437926 - DNA, 25 bp, Rattus norvegicus
ggcagtcaggcaacggtacggctct

SEQ ID NO: 437927 - DNA, 25 bp, Rattus norvegicus
ggcagtcaggcatcggtacggctct

SEQ ID NO: 437928 - DNA, 25 bp, Rattus norvegicus
ggcagtcagtagctttgtccgtatc

SEQ ID NO: 437929 - DNA, 25 bp, Rattus norvegicus
ggcagtcagtaggtttgtccgtatc

SEQ ID NO: 437930 - DNA, 25 bp, Rattus norvegicus
ggcagtcagtcaagggtagctctta

SEQ ID NO: 437931 - DNA, 25 bp, Rattus norvegicus
ggcagtcagtcatgggtagctctta

SEQ ID NO: 437932 - DNA, 25 bp, Rattus norvegicus
ggcagtcagtttccgcagatgtttg

SEQ ID NO: 437933 - DNA, 25 bp, Rattus norvegicus
ggcagtcagtttgcgcagatgtttg

SEQ ID NO: 437934 - DNA, 25 bp, Rattus norvegicus
ggcagtcatcaaagcctagcattgg

SEQ ID NO: 437935 - DNA, 25 bp, Rattus norvegicus
ggcagtcatcaatgcctagcattgg

SEQ ID NO: 437936 - DNA, 25 bp, Rattus norvegicus
ggcagtccaaagacattacaatgtc

SEQ ID NO: 437937 - DNA, 25 bp, Rattus norvegicus
ggcagtccaaagtcattacaatgtc

SEQ ID NO: 437938 - DNA, 25 bp, Rattus norvegicus
ggcagtccaataacctggcaacagg

SEQ ID NO: 437939 - DNA, 25 bp, Rattus norvegicus
ggcagtccaatatcctggcaacagg

SEQ ID NO: 437940 - DNA, 25 bp, Rattus norvegicus
ggcagtccactgcaatatgttggat

SEQ ID NO: 437941 - DNA, 25 bp, Rattus norvegicus
ggcagtccactggaatatgttggat

SEQ ID NO: 437942 - DNA, 25 bp, Rattus norvegicus
ggcagtccatcgatgcactcaaaga

SEQ ID NO: 437943 - DNA, 25 bp, Rattus norvegicus
ggcagtccatcgttgcactcaaaga

SEQ ID NO: 437944 - DNA, 25 bp, Rattus norvegicus
ggcagtcccagcacagatgccagtg

SEQ ID NO: 437945 - DNA, 25 bp, Rattus norvegicus
ggcagtcccagctcagatgccagtg

SEQ ID NO: 437946 - DNA, 25 bp, Rattus norvegicus
ggcagtcctacaatcccattgaggg

SEQ ID NO: 437947 - DNA, 25 bp, Rattus norvegicus
ggcagtcctacattcccattgaggg

SEQ ID NO: 437948 - DNA, 25 bp, Rattus norvegicus
ggcagtcctagcacatgggaggtaa

SEQ ID NO: 437949 - DNA, 25 bp, Rattus norvegicus
ggcagtcctagctcatgggaggtaa

SEQ ID NO: 437950 - DNA, 25 bp, Rattus norvegicus
ggcagtcctatgaagtttctgtctt

SEQ ID NO: 437951 - DNA, 25 bp, Rattus norvegicus
ggcagtcctatgtagtttctgtctt

SEQ ID NO: 437952 - DNA, 25 bp, Rattus norvegicus
ggcagtcctgacacactgtagacgt

SEQ ID NO: 437953 - DNA, 25 bp, Rattus norvegicus
ggcagtcctgactcactgtagacgt

SEQ ID NO: 437954 - DNA, 25 bp, Rattus norvegicus
ggcagtcctgtgacacaaatactcc

SEQ ID NO: 437955 - DNA, 25 bp, Rattus norvegicus
ggcagtcctgtgtcacaaatactcc

SEQ ID NO: 437956 - DNA, 25 bp, Rattus norvegicus
ggcagtcggcacacataagggcttc

SEQ ID NO: 437957 - DNA, 25 bp, Rattus norvegicus
ggcagtcggcactcataagggcttc

SEQ ID NO: 437958 - DNA, 25 bp, Rattus norvegicus
ggcagtctgaaacgcaggacaccat

SEQ ID NO: 437959 - DNA, 25 bp, Rattus norvegicus
ggcagtctgaaaggcaggacaccat

SEQ ID NO: 437960 - DNA, 25 bp, Rattus norvegicus
ggcagtctgactacactttagggta

SEQ ID NO: 437961 - DNA, 25 bp, Rattus norvegicus
ggcagtctgacttcactttagggta

SEQ ID NO: 437962 - DNA, 25 bp, Rattus norvegicus
ggcagtctgctcattctagtagcaa

SEQ ID NO: 437963 - DNA, 25 bp, Rattus norvegicus
ggcagtctgctctttctagtagcaa

SEQ ID NO: 437964 - DNA, 25 bp, Rattus norvegicus
ggcagtctgctgagagacactccag

SEQ ID NO: 437965 - DNA, 25 bp, Rattus norvegicus
ggcagtctgctgtgagacactccag

SEQ ID NO: 437966 - DNA, 25 bp, Rattus norvegicus
ggcagtctggacaacgtcacaacaa

SEQ ID NO: 437967 - DNA, 25 bp, Rattus norvegicus
ggcagtctggactacgtcacaacaa

SEQ ID NO: 437968 - DNA, 25 bp, Rattus norvegicus
ggcagtcttcagatttgtgtgttaa

SEQ ID NO: 437969 - DNA, 25 bp, Rattus norvegicus
ggcagtcttcagttttgtgtgttaa

SEQ ID NO: 437970 - DNA, 25 bp, Rattus norvegicus
ggcagtcttgcaccacagtagcagg

SEQ ID NO: 437971 - DNA, 25 bp, Rattus norvegicus
ggcagtcttgcagcacagtagcagg

SEQ ID NO: 437972 - DNA, 25 bp, Rattus norvegicus
ggcagtgaaaccaggcttcagtttt

SEQ ID NO: 437973 - DNA, 25 bp, Rattus norvegicus
ggcagtgaaacctggcttcagtttt

SEQ ID NO: 437974 - DNA, 25 bp, Rattus norvegicus
ggcagtgaaactcagaactccatga

SEQ ID NO: 437975 - DNA, 25 bp, Rattus norvegicus
ggcagtgaaactgagaactccatga

SEQ ID NO: 437976 - DNA, 25 bp, Rattus norvegicus
ggcagtgaactacagctttcctttt

SEQ ID NO: 437977 - DNA, 25 bp, Rattus norvegicus
ggcagtgaactagagctttcctttt

SEQ ID NO: 437978 - DNA, 25 bp, Rattus norvegicus
ggcagtgaatgtctactcgacgtca

SEQ ID NO: 437979 - DNA, 25 bp, Rattus norvegicus
ggcagtgaatgtgtactcgacgtca

SEQ ID NO: 437980 - DNA, 25 bp, Rattus norvegicus
ggcagtgacagcagaaacaacctat

SEQ ID NO: 437981 - DNA, 25 bp, Rattus norvegicus
ggcagtgacagctgaaacaacctat

SEQ ID NO: 437982 - DNA, 25 bp, Rattus norvegicus
ggcagtgacataagcctgtaatccc

SEQ ID NO: 437983 - DNA, 25 bp, Rattus norvegicus
ggcagtgacatacttcttatctgga

SEQ ID NO: 437984 - DNA, 25 bp, Rattus norvegicus
ggcagtgacatagttcttatctgga

SEQ ID NO: 437985 - DNA, 25 bp, Rattus norvegicus
ggcagtgacatatgcctgtaatccc

SEQ ID NO: 437986 - DNA, 25 bp, Rattus norvegicus
ggcagtgactctacgagcgtcagca

SEQ ID NO: 437987 - DNA, 25 bp, Rattus norvegicus
ggcagtgactcttcgagcgtcagca

SEQ ID NO: 437988 - DNA, 25 bp, Rattus norvegicus
ggcagtgactgcacagcgtaattga

SEQ ID NO: 437989 - DNA, 25 bp, Rattus norvegicus
ggcagtgactgccacagaagcttac

SEQ ID NO: 437990 - DNA, 25 bp, Rattus norvegicus
ggcagtgactgcgacagaagcttac

SEQ ID NO: 437991 - DNA, 25 bp, Rattus norvegicus
ggcagtgactgctcagcgtaattga

SEQ ID NO: 437992 - DNA, 25 bp, Rattus norvegicus
ggcagtgagccccagacaggataat

SEQ ID NO: 437993 - DNA, 25 bp, Rattus norvegicus
ggcagtgagcccgagacaggataat

SEQ ID NO: 437994 - DNA, 25 bp, Rattus norvegicus
ggcagtgagtcccagcaattatgta

SEQ ID NO: 437995 - DNA, 25 bp, Rattus norvegicus
ggcagtgagtccgagcaattatgta

SEQ ID NO: 437996 - DNA, 25 bp, Rattus norvegicus
ggcagtgatcaacagtctagtcctt

SEQ ID NO: 437997 - DNA, 25 bp, Rattus norvegicus
ggcagtgatcaagagtctagtcctt

SEQ ID NO: 437998 - DNA, 25 bp, Rattus norvegicus
ggcagtgatcaccttgtggtcctaa

SEQ ID NO: 437999 - DNA, 25 bp, Rattus norvegicus
ggcagtgatcacgttgtggtcctaa

SEQ ID NO: 438000 - DNA, 25 bp, Rattus norvegicus
ggcagtgatggtaaactggtcctac

SEQ ID NO: 438001 - DNA, 25 bp, Rattus norvegicus
ggcagtgatggttaactggtcctac

SEQ ID NO: 438002 - DNA, 25 bp, Rattus norvegicus
ggcagtgcaccacttacttttcagt

SEQ ID NO: 438003 - DNA, 25 bp, Rattus norvegicus
ggcagtgcaccagttacttttcagt

SEQ ID NO: 438004 - DNA, 25 bp, Rattus norvegicus
ggcagtgcacggaacttcatgtatt

SEQ ID NO: 438005 - DNA, 25 bp, Rattus norvegicus
ggcagtgcacggtacttcatgtatt

SEQ ID NO: 438006 - DNA, 25 bp, Rattus norvegicus
ggcagtgcactgagctttgggacaa

SEQ ID NO: 438007 - DNA, 25 bp, Rattus norvegicus
ggcagtgcactgtgctttgggacaa

SEQ ID NO: 438008 - DNA, 25 bp, Rattus norvegicus
ggcagtgcagccatgtaagaagtat

SEQ ID NO: 438009 - DNA, 25 bp, Rattus norvegicus
ggcagtgcagccttgtaagaagtat

SEQ ID NO: 438010 - DNA, 25 bp, Rattus norvegicus
ggcagtgccaaaattcctgggccat

SEQ ID NO: 438011 - DNA, 25 bp, Rattus norvegicus
ggcagtgccaaatttcctgggccat

SEQ ID NO: 438012 - DNA, 25 bp, Rattus norvegicus
ggcagtgcccaacctggacaggatc

SEQ ID NO: 438013 - DNA, 25 bp, Rattus norvegicus
ggcagtgcccaagctggacaggatc

SEQ ID NO: 438014 - DNA, 25 bp, Rattus norvegicus
ggcagtgccgacctggagatcatta

SEQ ID NO: 438015 - DNA, 25 bp, Rattus norvegicus
ggcagtgccgacgtggagatcatta

SEQ ID NO: 438016 - DNA, 25 bp, Rattus norvegicus
ggcagtgcctctatatagacctttg

SEQ ID NO: 438017 - DNA, 25 bp, Rattus norvegicus
ggcagtgcctctttatagacctttg

SEQ ID NO: 438018 - DNA, 25 bp, Rattus norvegicus
ggcagtgcggccacagtgcctaaaa

SEQ ID NO: 438019 - DNA, 25 bp, Rattus norvegicus
ggcagtgcggcctcagtgcctaaaa

SEQ ID NO: 438020 - DNA, 25 bp, Rattus norvegicus
ggcagtgctgtaaacctcagatgtc

SEQ ID NO: 438021 - DNA, 25 bp, Rattus norvegicus
ggcagtgctgtacatgttgcttcaa

SEQ ID NO: 438022 - DNA, 25 bp, Rattus norvegicus
ggcagtgctgtagatgttgcttcaa

SEQ ID NO: 438023 - DNA, 25 bp, Rattus norvegicus
ggcagtgctgtatacctcagatgtc

SEQ ID NO: 438024 - DNA, 25 bp, Rattus norvegicus
ggcagtgcttccagcaaactggagt

SEQ ID NO: 438025 - DNA, 25 bp, Rattus norvegicus
ggcagtgcttcctgcaaactggagt

SEQ ID NO: 438026 - DNA, 25 bp, Rattus norvegicus
ggcagtgcttgtctcaggtgatccc

SEQ ID NO: 438027 - DNA, 25 bp, Rattus norvegicus
ggcagtgcttgtgtcaggtgatccc

SEQ ID NO: 438028 - DNA, 25 bp, Rattus norvegicus
ggcagtggacagatcaaggcacttc

SEQ ID NO: 438029 - DNA, 25 bp, Rattus norvegicus
ggcagtggacagttcaaggcacttc

SEQ ID NO: 438030 - DNA, 25 bp, Rattus norvegicus
ggcagtggagatcacaattacaaca

SEQ ID NO: 438031 - DNA, 25 bp, Rattus norvegicus
ggcagtggagatgacaattacaaca

SEQ ID NO: 438032 - DNA, 25 bp, Rattus norvegicus
ggcagtggaggaacccatctcaaat

SEQ ID NO: 438033 - DNA, 25 bp, Rattus norvegicus
ggcagtggaggatcccatctcaaat

SEQ ID NO: 438034 - DNA, 25 bp, Rattus norvegicus
ggcagtggcaatacctgagtagtta

SEQ ID NO: 438035 - DNA, 25 bp, Rattus norvegicus
ggcagtggcaattcctgagtagtta

SEQ ID NO: 438036 - DNA, 25 bp, Rattus norvegicus
ggcagtggccacatttttatattct

SEQ ID NO: 438037 - DNA, 25 bp, Rattus norvegicus
ggcagtggccacttttttatattct

SEQ ID NO: 438038 - DNA, 25 bp, Rattus norvegicus
ggcagtggcccaataaacagaaaat

SEQ ID NO: 438039 - DNA, 25 bp, Rattus norvegicus
ggcagtggcccacaggatgcaacct

SEQ ID NO: 438040 - DNA, 25 bp, Rattus norvegicus
ggcagtggcccagaggatgcaacct

SEQ ID NO: 438041 - DNA, 25 bp, Rattus norvegicus
ggcagtggcccattaaacagaaaat

SEQ ID NO: 438042 - DNA, 25 bp, Rattus norvegicus
ggcagtggtcacagacgttttactt

SEQ ID NO: 438043 - DNA, 25 bp, Rattus norvegicus
ggcagtggtcactgacgttttactt

SEQ ID NO: 438044 - DNA, 25 bp, Rattus norvegicus
ggcagtggtcttaggatgctgatac

SEQ ID NO: 438045 - DNA, 25 bp, Rattus norvegicus
ggcagtggtctttggatgctgatac

SEQ ID NO: 438046 - DNA, 25 bp, Rattus norvegicus
ggcagtgtacgaacaaccttagaca

SEQ ID NO: 438047 - DNA, 25 bp, Rattus norvegicus
ggcagtgtacgatcaaccttagaca

SEQ ID NO: 438048 - DNA, 25 bp, Rattus norvegicus
ggcagtgtacttccacagtgtgact

SEQ ID NO: 438049 - DNA, 25 bp, Rattus norvegicus
ggcagtgtacttgcacagtgtgact

SEQ ID NO: 438050 - DNA, 25 bp, Rattus norvegicus
ggcagtgtcactcatggccatcatg

SEQ ID NO: 438051 - DNA, 25 bp, Rattus norvegicus
ggcagtgtcactgatggccatcatg

SEQ ID NO: 438052 - DNA, 25 bp, Rattus norvegicus
ggcagtgtcagcatgagctttacca

SEQ ID NO: 438053 - DNA, 25 bp, Rattus norvegicus
ggcagtgtcagcttgagctttacca

SEQ ID NO: 438054 - DNA, 25 bp, Rattus norvegicus
ggcagtgtcctcaactaccaaaata

SEQ ID NO: 438055 - DNA, 25 bp, Rattus norvegicus
ggcagtgtcctctactaccaaaata

SEQ ID NO: 438056 - DNA, 25 bp, Rattus norvegicus
ggcagtgtgattcctacccaggtaa

SEQ ID NO: 438057 - DNA, 25 bp, Rattus norvegicus
ggcagtgtgattgctacccaggtaa

SEQ ID NO: 438058 - DNA, 25 bp, Rattus norvegicus
ggcagtgtgcacaatctcatgtgtg

SEQ ID NO: 438059 - DNA, 25 bp, Rattus norvegicus
ggcagtgtgcactatctcatgtgtg

SEQ ID NO: 438060 - DNA, 25 bp, Rattus norvegicus
ggcagtgtgccacgacaagtttaat

SEQ ID NO: 438061 - DNA, 25 bp, Rattus norvegicus
ggcagtgtgccaggacaagtttaat

SEQ ID NO: 438062 - DNA, 25 bp, Rattus norvegicus
ggcagtgtgggcataggcaccttct

SEQ ID NO: 438063 - DNA, 25 bp, Rattus norvegicus
ggcagtgtgggcatcttgctctaca

SEQ ID NO: 438064 - DNA, 25 bp, Rattus norvegicus
ggcagtgtgggcttaggcaccttct

SEQ ID NO: 438065 - DNA, 25 bp, Rattus norvegicus
ggcagtgtgggcttcttgctctaca

SEQ ID NO: 438066 - DNA, 25 bp, Rattus norvegicus
ggcagtgtgttaactcttgaggttt

SEQ ID NO: 438067 - DNA, 25 bp, Rattus norvegicus
ggcagtgtgttatctcttgaggttt

SEQ ID NO: 438068 - DNA, 25 bp, Rattus norvegicus
ggcagtgttcatatgtttgggacct

SEQ ID NO: 438069 - DNA, 25 bp, Rattus norvegicus
ggcagtgttcatccgccagctgaaa

SEQ ID NO: 438070 - DNA, 25 bp, Rattus norvegicus
ggcagtgttcatgcgccagctgaaa

SEQ ID NO: 438071 - DNA, 25 bp, Rattus norvegicus
ggcagtgttcatttgtttgggacct

SEQ ID NO: 438072 - DNA, 25 bp, Rattus norvegicus
ggcagtgttcggctgtcctcttttc

SEQ ID NO: 438073 - DNA, 25 bp, Rattus norvegicus
ggcagtgttcgggtgtcctcttttc

SEQ ID NO: 438074 - DNA, 25 bp, Rattus norvegicus
ggcagtgtttgacattcatcctaaa

SEQ ID NO: 438075 - DNA, 25 bp, Rattus norvegicus
ggcagtgtttgagattcatcctaaa

SEQ ID NO: 438076 - DNA, 25 bp, Rattus norvegicus
ggcagtgtttgtccagcagctctga

SEQ ID NO: 438077 - DNA, 25 bp, Rattus norvegicus
ggcagtgtttgtgcagcagctctga

SEQ ID NO: 438078 - DNA, 25 bp, Rattus norvegicus
ggcagtgttttaatttcctttacag

SEQ ID NO: 438079 - DNA, 25 bp, Rattus norvegicus
ggcagtgttttattttcctttacag

SEQ ID NO: 438080 - DNA, 25 bp, Rattus norvegicus
ggcagttaagagactctctcctgag

SEQ ID NO: 438081 - DNA, 25 bp, Rattus norvegicus
ggcagttaagagtctctctcctgag

SEQ ID NO: 438082 - DNA, 25 bp, Rattus norvegicus
ggcagttacagccacatttttgagt

SEQ ID NO: 438083 - DNA, 25 bp, Rattus norvegicus
ggcagttacagcgacatttttgagt

SEQ ID NO: 438084 - DNA, 25 bp, Rattus norvegicus
ggcagttacctcaagagtatttcag

SEQ ID NO: 438085 - DNA, 25 bp, Rattus norvegicus
ggcagttacctctagagtatttcag

SEQ ID NO: 438086 - DNA, 25 bp, Rattus norvegicus
ggcagttactcaagctgttaaacac

SEQ ID NO: 438087 - DNA, 25 bp, Rattus norvegicus
ggcagttactcatgctgttaaacac

SEQ ID NO: 438088 - DNA, 25 bp, Rattus norvegicus
ggcagttactgcctatattaaaaat

SEQ ID NO: 438089 - DNA, 25 bp, Rattus norvegicus
ggcagttactgcgtatattaaaaat

SEQ ID NO: 438090 - DNA, 25 bp, Rattus norvegicus
ggcagttagatgacccttagggcag

SEQ ID NO: 438091 - DNA, 25 bp, Rattus norvegicus
ggcagttagatgtcccttagggcag

SEQ ID NO: 438092 - DNA, 25 bp, Rattus norvegicus
ggcagttaggaaatcagtacactca

SEQ ID NO: 438093 - DNA, 25 bp, Rattus norvegicus
ggcagttaggaattcagtacactca

SEQ ID NO: 438094 - DNA, 25 bp, Rattus norvegicus
ggcagttaggcaccagcagcttcat

SEQ ID NO: 438095 - DNA, 25 bp, Rattus norvegicus
ggcagttaggcagcagcagcttcat

SEQ ID NO: 438096 - DNA, 25 bp, Rattus norvegicus
ggcagttatgagctccgtccttagt

SEQ ID NO: 438097 - DNA, 25 bp, Rattus norvegicus
ggcagttatgaggtccgtccttagt

SEQ ID NO: 438098 - DNA, 25 bp, Rattus norvegicus
ggcagttattaccttgttgttggac

SEQ ID NO: 438099 - DNA, 25 bp, Rattus norvegicus
ggcagttattacgttgttgttggac

SEQ ID NO: 438100 - DNA, 25 bp, Rattus norvegicus
ggcagttattgccacacacttaaat

SEQ ID NO: 438101 - DNA, 25 bp, Rattus norvegicus
ggcagttattgcgacacacttaaat

SEQ ID NO: 438102 - DNA, 25 bp, Rattus norvegicus
ggcagttcaagaccaaccggagcta

SEQ ID NO: 438103 - DNA, 25 bp, Rattus norvegicus
ggcagttcaagagcaaccggagcta

SEQ ID NO: 438104 - DNA, 25 bp, Rattus norvegicus
ggcagttcagccaagacagatttag

SEQ ID NO: 438105 - DNA, 25 bp, Rattus norvegicus
ggcagttcagcctagacagatttag

SEQ ID NO: 438106 - DNA, 25 bp, Rattus norvegicus
ggcagttcagtaacaccgagtctac

SEQ ID NO: 438107 - DNA, 25 bp, Rattus norvegicus
ggcagttcagtatcaccgagtctac

SEQ ID NO: 438108 - DNA, 25 bp, Rattus norvegicus
ggcagttcataaagccaggagcagc

SEQ ID NO: 438109 - DNA, 25 bp, Rattus norvegicus
ggcagttcataatgccaggagcagc

SEQ ID NO: 438110 - DNA, 25 bp, Rattus norvegicus
ggcagttccagtcacagctggctga

SEQ ID NO: 438111 - DNA, 25 bp, Rattus norvegicus
ggcagttccagtgacagctggctga

SEQ ID NO: 438112 - DNA, 25 bp, Rattus norvegicus
ggcagttccgtgaagacatctttgt

SEQ ID NO: 438113 - DNA, 25 bp, Rattus norvegicus
ggcagttccgtgtagacatctttgt

SEQ ID NO: 438114 - DNA, 25 bp, Rattus norvegicus
ggcagttcctgcacgagatgtgtgc

SEQ ID NO: 438115 - DNA, 25 bp, Rattus norvegicus
ggcagttcctgctcgagatgtgtgc

SEQ ID NO: 438116 - DNA, 25 bp, Rattus norvegicus
ggcagttcgaagaattctggctaca

SEQ ID NO: 438117 - DNA, 25 bp, Rattus norvegicus
ggcagttcgaagtattctggctaca

SEQ ID NO: 438118 - DNA, 25 bp, Rattus norvegicus
ggcagttctgcaagaggagttactc

SEQ ID NO: 438119 - DNA, 25 bp, Rattus norvegicus
ggcagttctgcatgaggagttactc

SEQ ID NO: 438120 - DNA, 25 bp, Rattus norvegicus
ggcagttctggtaacgaaggagaca

SEQ ID NO: 438121 - DNA, 25 bp, Rattus norvegicus
ggcagttctggttacgaaggagaca

SEQ ID NO: 438122 - DNA, 25 bp, Rattus norvegicus
ggcagttctgtgagtggagcccaca

SEQ ID NO: 438123 - DNA, 25 bp, Rattus norvegicus
ggcagttctgtgtgtggagcccaca

SEQ ID NO: 438124 - DNA, 25 bp, Rattus norvegicus
ggcagttctgttagcaaaagtctct

SEQ ID NO: 438125 - DNA, 25 bp, Rattus norvegicus
ggcagttctgtttgcaaaagtctct

SEQ ID NO: 438126 - DNA, 25 bp, Rattus norvegicus
ggcagttcttagctgggcatactta

SEQ ID NO: 438127 - DNA, 25 bp, Rattus norvegicus
ggcagttcttaggtgggcatactta

SEQ ID NO: 438128 - DNA, 25 bp, Rattus norvegicus
ggcagttgaccgctgaattcagatt

SEQ ID NO: 438129 - DNA, 25 bp, Rattus norvegicus
ggcagttgaccggtgaattcagatt

SEQ ID NO: 438130 - DNA, 25 bp, Rattus norvegicus
ggcagttgactaatccaggaaccac

SEQ ID NO: 438131 - DNA, 25 bp, Rattus norvegicus
ggcagttgactattccaggaaccac

SEQ ID NO: 438132 - DNA, 25 bp, Rattus norvegicus
ggcagttgacttatgctcagtatta

SEQ ID NO: 438133 - DNA, 25 bp, Rattus norvegicus
ggcagttgacttttgctcagtatta

SEQ ID NO: 438134 - DNA, 25 bp, Rattus norvegicus
ggcagttgcaacaggcaagttcata

SEQ ID NO: 438135 - DNA, 25 bp, Rattus norvegicus
ggcagttgcaactggcaagttcata

SEQ ID NO: 438136 - DNA, 25 bp, Rattus norvegicus
ggcagttggtgaattgtggcatttc

SEQ ID NO: 438137 - DNA, 25 bp, Rattus norvegicus
ggcagttggtgatttgtggcatttc

SEQ ID NO: 438138 - DNA, 25 bp, Rattus norvegicus
ggcagttgtaccaacggttacagta

SEQ ID NO: 438139 - DNA, 25 bp, Rattus norvegicus
ggcagttgtacctacggttacagta

SEQ ID NO: 438140 - DNA, 25 bp, Rattus norvegicus
ggcagttgtgacaaaattcccctag

SEQ ID NO: 438141 - DNA, 25 bp, Rattus norvegicus
ggcagttgtgactaaattcccctag

SEQ ID NO: 438142 - DNA, 25 bp, Rattus norvegicus
ggcagttgttacaagttggtcaccc

SEQ ID NO: 438143 - DNA, 25 bp, Rattus norvegicus
ggcagttgttactagttggtcaccc

SEQ ID NO: 438144 - DNA, 25 bp, Rattus norvegicus
ggcagtttaaacatctgaacctctt

SEQ ID NO: 438145 - DNA, 25 bp, Rattus norvegicus
ggcagtttaaacttctgaacctctt

SEQ ID NO: 438146 - DNA, 25 bp, Rattus norvegicus
ggcagtttacaaatgcccataactc

SEQ ID NO: 438147 - DNA, 25 bp, Rattus norvegicus
ggcagtttacaattgcccataactc

SEQ ID NO: 438148 - DNA, 25 bp, Rattus norvegicus
ggcagtttacttctttcttttgtgt

SEQ ID NO: 438149 - DNA, 25 bp, Rattus norvegicus
ggcagtttacttgtttcttttgtgt

SEQ ID NO: 438150 - DNA, 25 bp, Rattus norvegicus
ggcagtttagcaacaccaaggtttt

SEQ ID NO: 438151 - DNA, 25 bp, Rattus norvegicus
ggcagtttagcatcaccaaggtttt

SEQ ID NO: 438152 - DNA, 25 bp, Rattus norvegicus
ggcagtttagccataaaaacctgta

SEQ ID NO: 438153 - DNA, 25 bp, Rattus norvegicus
ggcagtttagccttaaaaacctgta

SEQ ID NO: 438154 - DNA, 25 bp, Rattus norvegicus
ggcagtttatttatctctcagcatt

SEQ ID NO: 438155 - DNA, 25 bp, Rattus norvegicus
ggcagtttatttttctctcagcatt

SEQ ID NO: 438156 - DNA, 25 bp, Rattus norvegicus
ggcagtttcaagaagaacagctgat

SEQ ID NO: 438157 - DNA, 25 bp, Rattus norvegicus
ggcagtttcaagtagaacagctgat

SEQ ID NO: 438158 - DNA, 25 bp, Rattus norvegicus
ggcagtttcctccatgcaaaattag

SEQ ID NO: 438159 - DNA, 25 bp, Rattus norvegicus
ggcagtttcctcgatgcaaaattag

SEQ ID NO: 438160 - DNA, 25 bp, Rattus norvegicus
ggcagtttcctgaggcctttgggcc

SEQ ID NO: 438161 - DNA, 25 bp, Rattus norvegicus
ggcagtttcctgagtcaggacctaa

SEQ ID NO: 438162 - DNA, 25 bp, Rattus norvegicus
ggcagtttcctgtggcctttgggcc

SEQ ID NO: 438163 - DNA, 25 bp, Rattus norvegicus
ggcagtttcctgtgtcaggacctaa

SEQ ID NO: 438164 - DNA, 25 bp, Rattus norvegicus
ggcagtttctggaactcctatgcaa

SEQ ID NO: 438165 - DNA, 25 bp, Rattus norvegicus
ggcagtttctggtactcctatgcaa

SEQ ID NO: 438166 - DNA, 25 bp, Rattus norvegicus
ggcagtttgaacctctgaaatcttt

SEQ ID NO: 438167 - DNA, 25 bp, Rattus norvegicus
ggcagtttgaacgtctgaaatcttt

SEQ ID NO: 438168 - DNA, 25 bp, Rattus norvegicus
ggcagtttgacccttgctgcaagta

SEQ ID NO: 438169 - DNA, 25 bp, Rattus norvegicus
ggcagtttgaccgttgctgcaagta

SEQ ID NO: 438170 - DNA, 25 bp, Rattus norvegicus
ggcagtttgactaaagctgacccaa

SEQ ID NO: 438171 - DNA, 25 bp, Rattus norvegicus
ggcagtttgacttaagctgacccaa

SEQ ID NO: 438172 - DNA, 25 bp, Rattus norvegicus
ggcagtttgctactagtgtccaata

SEQ ID NO: 438173 - DNA, 25 bp, Rattus norvegicus
ggcagtttgctagtagtgtccaata

SEQ ID NO: 438174 - DNA, 25 bp, Rattus norvegicus
ggcagtttgcttcagtattttccaa

SEQ ID NO: 438175 - DNA, 25 bp, Rattus norvegicus
ggcagtttgcttgagtattttccaa

SEQ ID NO: 438176 - DNA, 25 bp, Rattus norvegicus
ggcagtttgggcagcctgcccgcca

SEQ ID NO: 438177 - DNA, 25 bp, Rattus norvegicus
ggcagtttgggctgcctgcccgcca

SEQ ID NO: 438178 - DNA, 25 bp, Rattus norvegicus
ggcagtttgtagcttcccttgtcgt

SEQ ID NO: 438179 - DNA, 25 bp, Rattus norvegicus
ggcagtttgtaggttcccttgtcgt

SEQ ID NO: 438180 - DNA, 25 bp, Rattus norvegicus
ggcagttttcaaagacttggcttat

SEQ ID NO: 438181 - DNA, 25 bp, Rattus norvegicus
ggcagttttcaacccagtttctctg

SEQ ID NO: 438182 - DNA, 25 bp, Rattus norvegicus
ggcagttttcaagccagtttctctg

SEQ ID NO: 438183 - DNA, 25 bp, Rattus norvegicus
ggcagttttcaatgacttggcttat

SEQ ID NO: 438184 - DNA, 25 bp, Rattus norvegicus
ggcagttttctaacaaaggtctatc

SEQ ID NO: 438185 - DNA, 25 bp, Rattus norvegicus
ggcagttttctatcaaaggtctatc

SEQ ID NO: 438186 - DNA, 25 bp, Rattus norvegicus
ggcagttttcttatggatgttccct

SEQ ID NO: 438187 - DNA, 25 bp, Rattus norvegicus
ggcagttttcttttggatgttccct

SEQ ID NO: 438188 - DNA, 25 bp, Rattus norvegicus
ggcagttttgcccactctaagaaac

SEQ ID NO: 438189 - DNA, 25 bp, Rattus norvegicus
ggcagttttgccgactctaagaaac

SEQ ID NO: 438190 - DNA, 25 bp, Rattus norvegicus
ggcagttttgtgcacataccctatg

SEQ ID NO: 438191 - DNA, 25 bp, Rattus norvegicus
ggcagttttgtggacataccctatg

SEQ ID NO: 438192 - DNA, 25 bp, Rattus norvegicus
ggcagtttttcaccatagtccacaa

SEQ ID NO: 438193 - DNA, 25 bp, Rattus norvegicus
ggcagtttttcagcatagtccacaa

SEQ ID NO: 438194 - DNA, 25 bp, Rattus norvegicus
ggcataaaaatcagtgcttgtgtta

SEQ ID NO: 438195 - DNA, 25 bp, Rattus norvegicus
ggcataaaaatctgtgcttgtgtta

SEQ ID NO: 438196 - DNA, 25 bp, Rattus norvegicus
ggcataaaacctacccacaaaattg

SEQ ID NO: 438197 - DNA, 25 bp, Rattus norvegicus
ggcataaaaccttcccacaaaattg

SEQ ID NO: 438198 - DNA, 25 bp, Rattus norvegicus
ggcataaaacggctggcaccggcct

SEQ ID NO: 438199 - DNA, 25 bp, Rattus norvegicus
ggcataaaacgggtggcaccggcct

SEQ ID NO: 438200 - DNA, 25 bp, Rattus norvegicus
ggcataaaactactcctgcgcatta

SEQ ID NO: 438201 - DNA, 25 bp, Rattus norvegicus
ggcataaaactagtcctgcgcatta

SEQ ID NO: 438202 - DNA, 25 bp, Rattus norvegicus
ggcataaactcacaagcctcatgta

SEQ ID NO: 438203 - DNA, 25 bp, Rattus norvegicus
ggcataaactcagaagcctcatgta

SEQ ID NO: 438204 - DNA, 25 bp, Rattus norvegicus
ggcataacactgaattataccatta

SEQ ID NO: 438205 - DNA, 25 bp, Rattus norvegicus
ggcataacactgtattataccatta

SEQ ID NO: 438206 - DNA, 25 bp, Rattus norvegicus
ggcataactagaccctttctcaaac

SEQ ID NO: 438207 - DNA, 25 bp, Rattus norvegicus
ggcataactagagcctttctcaaac

SEQ ID NO: 438208 - DNA, 25 bp, Rattus norvegicus
ggcataactgttcgccctttactct

SEQ ID NO: 438209 - DNA, 25 bp, Rattus norvegicus
ggcataactgttggccctttactct

SEQ ID NO: 438210 - DNA, 25 bp, Rattus norvegicus
ggcataagcacacatactctcgcaa

SEQ ID NO: 438211 - DNA, 25 bp, Rattus norvegicus
ggcataagcacagatactctcgcaa

SEQ ID NO: 438212 - DNA, 25 bp, Rattus norvegicus
ggcataagcctgaaatctcaccttt

SEQ ID NO: 438213 - DNA, 25 bp, Rattus norvegicus
ggcataagcctgtaatctcaccttt

SEQ ID NO: 438214 - DNA, 25 bp, Rattus norvegicus
ggcataaggcagagctcaccgagtt

SEQ ID NO: 438215 - DNA, 25 bp, Rattus norvegicus
ggcataaggcagtgctcaccgagtt

SEQ ID NO: 438216 - DNA, 25 bp, Rattus norvegicus
ggcataaggtctcggagtccagcac

SEQ ID NO: 438217 - DNA, 25 bp, Rattus norvegicus
ggcataaggtctgggagtccagcac

SEQ ID NO: 438218 - DNA, 25 bp, Rattus norvegicus
ggcataatgctgaacttccttggat

SEQ ID NO: 438219 - DNA, 25 bp, Rattus norvegicus
ggcataatgctgtacttccttggat

SEQ ID NO: 438220 - DNA, 25 bp, Rattus norvegicus
ggcataatgtccctaactctcaaat

SEQ ID NO: 438221 - DNA, 25 bp, Rattus norvegicus
ggcataatgtccgtaactctcaaat

SEQ ID NO: 438222 - DNA, 25 bp, Rattus norvegicus
ggcataatgtctccccactgtgtaa

SEQ ID NO: 438223 - DNA, 25 bp, Rattus norvegicus
ggcataatgtctgcccactgtgtaa

SEQ ID NO: 438224 - DNA, 25 bp, Rattus norvegicus
ggcataattgaacatcgctctccct

SEQ ID NO: 438225 - DNA, 25 bp, Rattus norvegicus
ggcataattgaagatcgctctccct

SEQ ID NO: 438226 - DNA, 25 bp, Rattus norvegicus
ggcataatttagacatcttacccaa

SEQ ID NO: 438227 - DNA, 25 bp, Rattus norvegicus
ggcataatttagtcatcttacccaa

SEQ ID NO: 438228 - DNA, 25 bp, Rattus norvegicus
ggcatacaatctataccaacagttt

SEQ ID NO: 438229 - DNA, 25 bp, Rattus norvegicus
ggcatacaatctttaccaacagttt

SEQ ID NO: 438230 - DNA, 25 bp, Rattus norvegicus
ggcatacacaatacctttgaagtag

SEQ ID NO: 438231 - DNA, 25 bp, Rattus norvegicus
ggcatacacaattcctttgaagtag

SEQ ID NO: 438232 - DNA, 25 bp, Rattus norvegicus
ggcatacacagaacagcttctacct

SEQ ID NO: 438233 - DNA, 25 bp, Rattus norvegicus
ggcatacacagatcagcttctacct

SEQ ID NO: 438234 - DNA, 25 bp, Rattus norvegicus
ggcatacacagcagataaccattcg

SEQ ID NO: 438235 - DNA, 25 bp, Rattus norvegicus
ggcatacacagctgataaccattcg

SEQ ID NO: 438236 - DNA, 25 bp, Rattus norvegicus
ggcatacagtgtatcccaagcctga

SEQ ID NO: 438237 - DNA, 25 bp, Rattus norvegicus
ggcatacagtgtttcccaagcctga

SEQ ID NO: 438238 - DNA, 25 bp, Rattus norvegicus
ggcatacatgataccgccttgtgaa

SEQ ID NO: 438239 - DNA, 25 bp, Rattus norvegicus
ggcatacatgattccgccttgtgaa

SEQ ID NO: 438240 - DNA, 25 bp, Rattus norvegicus
ggcatacattccaccgcataattaa

SEQ ID NO: 438241 - DNA, 25 bp, Rattus norvegicus
ggcatacattcctccgcataattaa

SEQ ID NO: 438242 - DNA, 25 bp, Rattus norvegicus
ggcataccaagacacttccgggaat

SEQ ID NO: 438243 - DNA, 25 bp, Rattus norvegicus
ggcataccaagagacttccgggaat

SEQ ID NO: 438244 - DNA, 25 bp, Rattus norvegicus
ggcataccaccacagggttcttaga

SEQ ID NO: 438245 - DNA, 25 bp, Rattus norvegicus
ggcataccaccagagggttcttaga

SEQ ID NO: 438246 - DNA, 25 bp, Rattus norvegicus
ggcataccatagagggttgggccct

SEQ ID NO: 438247 - DNA, 25 bp, Rattus norvegicus
ggcataccatagtgggttgggccct

SEQ ID NO: 438248 - DNA, 25 bp, Rattus norvegicus
ggcatacgagtacaatcttccttct

SEQ ID NO: 438249 - DNA, 25 bp, Rattus norvegicus
ggcatacgagtagaatcttccttct

SEQ ID NO: 438250 - DNA, 25 bp, Rattus norvegicus
ggcatacgccaacacgctgctgcag

SEQ ID NO: 438251 - DNA, 25 bp, Rattus norvegicus
ggcatacgccaagacgctgctgcag

SEQ ID NO: 438252 - DNA, 25 bp, Rattus norvegicus
ggcatacggatgaaggactccacct

SEQ ID NO: 438253 - DNA, 25 bp, Rattus norvegicus
ggcatacggatgtaggactccacct

SEQ ID NO: 438254 - DNA, 25 bp, Rattus norvegicus
ggcatactcgccacagccagaaagg

SEQ ID NO: 438255 - DNA, 25 bp, Rattus norvegicus
ggcatactcgcctcagccagaaagg

SEQ ID NO: 438256 - DNA, 25 bp, Rattus norvegicus
ggcatactcggaagcttgtccaatt

SEQ ID NO: 438257 - DNA, 25 bp, Rattus norvegicus
ggcatactcggatgcttgtccaatt

SEQ ID NO: 438258 - DNA, 25 bp, Rattus norvegicus
ggcatactgcttacaattcaggcaa

SEQ ID NO: 438259 - DNA, 25 bp, Rattus norvegicus
ggcatactgctttcaattcaggcaa

SEQ ID NO: 438260 - DNA, 25 bp, Rattus norvegicus
ggcatactgtaacaggtccctggtc

SEQ ID NO: 438261 - DNA, 25 bp, Rattus norvegicus
ggcatactgtaagaggtccctggtc

SEQ ID NO: 438262 - DNA, 25 bp, Rattus norvegicus
ggcatactgtagcaacctcacggaa

SEQ ID NO: 438263 - DNA, 25 bp, Rattus norvegicus
ggcatactgtaggaacctcacggaa

SEQ ID NO: 438264 - DNA, 25 bp, Rattus norvegicus
ggcatacttagcagctgtcacctaa

SEQ ID NO: 438265 - DNA, 25 bp, Rattus norvegicus
ggcatacttagctgctgtcacctaa

SEQ ID NO: 438266 - DNA, 25 bp, Rattus norvegicus
ggcatagatctccacaaccaggcga

SEQ ID NO: 438267 - DNA, 25 bp, Rattus norvegicus
ggcatagatctcgacaaccaggcga

SEQ ID NO: 438268 - DNA, 25 bp, Rattus norvegicus
ggcatagatcttaattgcagactta

SEQ ID NO: 438269 - DNA, 25 bp, Rattus norvegicus
ggcatagatctttattgcagactta

SEQ ID NO: 438270 - DNA, 25 bp, Rattus norvegicus
ggcatagcacataaatgagacagcc

SEQ ID NO: 438271 - DNA, 25 bp, Rattus norvegicus
ggcatagcacattaatgagacagcc

SEQ ID NO: 438272 - DNA, 25 bp, Rattus norvegicus
ggcatagcatcaccaagccgtattt

SEQ ID NO: 438273 - DNA, 25 bp, Rattus norvegicus
ggcatagcatcagcaagccgtattt

SEQ ID NO: 438274 - DNA, 25 bp, Rattus norvegicus
ggcatagccactctggtttatcata

SEQ ID NO: 438275 - DNA, 25 bp, Rattus norvegicus
ggcatagccactgtggtttatcata

SEQ ID NO: 438276 - DNA, 25 bp, Rattus norvegicus
ggcatagccatgcaagagcggcctc

SEQ ID NO: 438277 - DNA, 25 bp, Rattus norvegicus
ggcatagccatggaagagcggcctc

SEQ ID NO: 438278 - DNA, 25 bp, Rattus norvegicus
ggcatagccggacctgtcggcataa

SEQ ID NO: 438279 - DNA, 25 bp, Rattus norvegicus
ggcatagccggagctgtcggcataa

SEQ ID NO: 438280 - DNA, 25 bp, Rattus norvegicus
ggcatagcgcagaaggcctgcagtt

SEQ ID NO: 438281 - DNA, 25 bp, Rattus norvegicus
ggcatagcgcagtaggcctgcagtt

SEQ ID NO: 438282 - DNA, 25 bp, Rattus norvegicus
ggcatagctctgaattcagggccaa

SEQ ID NO: 438283 - DNA, 25 bp, Rattus norvegicus
ggcatagctctgtattcagggccaa

SEQ ID NO: 438284 - DNA, 25 bp, Rattus norvegicus
ggcataggcagaatccaggagtcaa

SEQ ID NO: 438285 - DNA, 25 bp, Rattus norvegicus
ggcataggcagattccaggagtcaa

SEQ ID NO: 438286 - DNA, 25 bp, Rattus norvegicus
ggcataggccatcaacttggttata

SEQ ID NO: 438287 - DNA, 25 bp, Rattus norvegicus
ggcataggccatgaacttggttata

SEQ ID NO: 438288 - DNA, 25 bp, Rattus norvegicus
ggcataggtcgtctctaacagtaga

SEQ ID NO: 438289 - DNA, 25 bp, Rattus norvegicus
ggcataggtcgtgtctaacagtaga

SEQ ID NO: 438290 - DNA, 25 bp, Rattus norvegicus
ggcatagtaatcatgttttgacaat

SEQ ID NO: 438291 - DNA, 25 bp, Rattus norvegicus
ggcatagtaatcttgttttgacaat

SEQ ID NO: 438292 - DNA, 25 bp, Rattus norvegicus
ggcatagtcactcttccgatttctg

SEQ ID NO: 438293 - DNA, 25 bp, Rattus norvegicus
ggcatagtcactgttccgatttctg

SEQ ID NO: 438294 - DNA, 25 bp, Rattus norvegicus
ggcatagtcctcagtgcacatgaag

SEQ ID NO: 438295 - DNA, 25 bp, Rattus norvegicus
ggcatagtcctctgtgcacatgaag

SEQ ID NO: 438296 - DNA, 25 bp, Rattus norvegicus
ggcatagtccttcccagtcagaagt

SEQ ID NO: 438297 - DNA, 25 bp, Rattus norvegicus
ggcatagtccttgccagtcagaagt

SEQ ID NO: 438298 - DNA, 25 bp, Rattus norvegicus
ggcatagtctttcccgtgatttttc

SEQ ID NO: 438299 - DNA, 25 bp, Rattus norvegicus
ggcatagtctttgccgtgatttttc

SEQ ID NO: 438300 - DNA, 25 bp, Rattus norvegicus
ggcatagttctgactatactgaggt

SEQ ID NO: 438301 - DNA, 25 bp, Rattus norvegicus
ggcatagttctgtctatactgaggt

SEQ ID NO: 438302 - DNA, 25 bp, Rattus norvegicus
ggcatataaaacatcaccctgagat

SEQ ID NO: 438303 - DNA, 25 bp, Rattus norvegicus
ggcatataaaacttcaccctgagat

SEQ ID NO: 438304 - DNA, 25 bp, Rattus norvegicus
ggcatataaaccattcggcactgtc

SEQ ID NO: 438305 - DNA, 25 bp, Rattus norvegicus
ggcatataaacctttcggcactgtc

SEQ ID NO: 438306 - DNA, 25 bp, Rattus norvegicus
ggcatataagccagagtccacgtgt

SEQ ID NO: 438307 - DNA, 25 bp, Rattus norvegicus
ggcatataagcctgagtccacgtgt

SEQ ID NO: 438308 - DNA, 25 bp, Rattus norvegicus
ggcatatacctgaaagtccacccag

SEQ ID NO: 438309 - DNA, 25 bp, Rattus norvegicus
ggcatatacctgtaagtccacccag

SEQ ID NO: 438310 - DNA, 25 bp, Rattus norvegicus
ggcatatatatcatcaacatcctga

SEQ ID NO: 438311 - DNA, 25 bp, Rattus norvegicus
ggcatatatatcttcaacatcctga

SEQ ID NO: 438312 - DNA, 25 bp, Rattus norvegicus
ggcatatatcagaaccactcgcttc

SEQ ID NO: 438313 - DNA, 25 bp, Rattus norvegicus
ggcatatatcagtaccactcgcttc

SEQ ID NO: 438314 - DNA, 25 bp, Rattus norvegicus
ggcatatctaatccgggcatcctaa

SEQ ID NO: 438315 - DNA, 25 bp, Rattus norvegicus
ggcatatctaatgcgggcatcctaa

SEQ ID NO: 438316 - DNA, 25 bp, Rattus norvegicus
ggcatatctgaacccatctgctgtt

SEQ ID NO: 438317 - DNA, 25 bp, Rattus norvegicus
ggcatatctgaagccatctgctgtt

SEQ ID NO: 438318 - DNA, 25 bp, Rattus norvegicus
ggcatatctgtgagcacgggtccat

SEQ ID NO: 438319 - DNA, 25 bp, Rattus norvegicus
ggcatatctgtgtgcacgggtccat

SEQ ID NO: 438320 - DNA, 25 bp, Rattus norvegicus
ggcatatgagccctatacgtaccaa

SEQ ID NO: 438321 - DNA, 25 bp, Rattus norvegicus
ggcatatgagccgtatacgtaccaa

SEQ ID NO: 438322 - DNA, 25 bp, Rattus norvegicus
ggcatatgatcgacaggctccagtt

SEQ ID NO: 438323 - DNA, 25 bp, Rattus norvegicus
ggcatatgatcgtcaggctccagtt

SEQ ID NO: 438324 - DNA, 25 bp, Rattus norvegicus
ggcatatgatctaaccatttttcta

SEQ ID NO: 438325 - DNA, 25 bp, Rattus norvegicus
ggcatatgatcttaccatttttcta

SEQ ID NO: 438326 - DNA, 25 bp, Rattus norvegicus
ggcatatgcattcattcctgttgga

SEQ ID NO: 438327 - DNA, 25 bp, Rattus norvegicus
ggcatatgcattgattcctgttgga

SEQ ID NO: 438328 - DNA, 25 bp, Rattus norvegicus
ggcatatgcccacgacaggagccat

SEQ ID NO: 438329 - DNA, 25 bp, Rattus norvegicus
ggcatatgcccaggacaggagccat

SEQ ID NO: 438330 - DNA, 25 bp, Rattus norvegicus
ggcatatgcgagcaaagcattctca

SEQ ID NO: 438331 - DNA, 25 bp, Rattus norvegicus
ggcatatgcgaggaaagcattctca

SEQ ID NO: 438332 - DNA, 25 bp, Rattus norvegicus
ggcatatggctcatctgggttggca

SEQ ID NO: 438333 - DNA, 25 bp, Rattus norvegicus
ggcatatggctcttctgggttggca

SEQ ID NO: 438334 - DNA, 25 bp, Rattus norvegicus
ggcatatgtcgacggcttttcatga

SEQ ID NO: 438335 - DNA, 25 bp, Rattus norvegicus
ggcatatgtcgagggcttttcatga

SEQ ID NO: 438336 - DNA, 25 bp, Rattus norvegicus
ggcatattctcacagccacacacat

SEQ ID NO: 438337 - DNA, 25 bp, Rattus norvegicus
ggcatattctcagagccacacacat

SEQ ID NO: 438338 - DNA, 25 bp, Rattus norvegicus
ggcatattctggatctttccagtaa

SEQ ID NO: 438339 - DNA, 25 bp, Rattus norvegicus
ggcatattctggttctttccagtaa

SEQ ID NO: 438340 - DNA, 25 bp, Rattus norvegicus
ggcatattggatagtccccatcgtg

SEQ ID NO: 438341 - DNA, 25 bp, Rattus norvegicus
ggcatattggattgtccccatcgtg

SEQ ID NO: 438342 - DNA, 25 bp, Rattus norvegicus
ggcatattgtgaccagacctcggga

SEQ ID NO: 438343 - DNA, 25 bp, Rattus norvegicus
ggcatattgtgagcagacctcggga

SEQ ID NO: 438344 - DNA, 25 bp, Rattus norvegicus
ggcatattttgcatgggagatcatg

SEQ ID NO: 438345 - DNA, 25 bp, Rattus norvegicus
ggcatattttgcttgggagatcatg

SEQ ID NO: 438346 - DNA, 25 bp, Rattus norvegicus
ggcatcaaaattcgccctcagcatg

SEQ ID NO: 438347 - DNA, 25 bp, Rattus norvegicus
ggcatcaaaattggccctcagcatg

SEQ ID NO: 438348 - DNA, 25 bp, Rattus norvegicus
ggcatcaaactgagagtgctctgca

SEQ ID NO: 438349 - DNA, 25 bp, Rattus norvegicus
ggcatcaaactgtgagtgctctgca

SEQ ID NO: 438350 - DNA, 25 bp, Rattus norvegicus
ggcatcaaccggcaagaaactctga

SEQ ID NO: 438351 - DNA, 25 bp, Rattus norvegicus
ggcatcaaccgggaagaaactctga

SEQ ID NO: 438352 - DNA, 25 bp, Rattus norvegicus
ggcatcaacttcagtcccataaatt

SEQ ID NO: 438353 - DNA, 25 bp, Rattus norvegicus
ggcatcaacttctgtcccataaatt

SEQ ID NO: 438354 - DNA, 25 bp, Rattus norvegicus
ggcatcaaggaacttaaccggccta

SEQ ID NO: 438355 - DNA, 25 bp, Rattus norvegicus
ggcatcaaggaagttaaccggccta

SEQ ID NO: 438356 - DNA, 25 bp, Rattus norvegicus
ggcatcaaggtcagaggctctcaac

SEQ ID NO: 438357 - DNA, 25 bp, Rattus norvegicus
ggcatcaaggtctgaggctctcaac

SEQ ID NO: 438358 - DNA, 25 bp, Rattus norvegicus
ggcatcaatgtaactatttccatgt

SEQ ID NO: 438359 - DNA, 25 bp, Rattus norvegicus
ggcatcaatgtatctatttccatgt

SEQ ID NO: 438360 - DNA, 25 bp, Rattus norvegicus
ggcatcacagccacatggacgtata

SEQ ID NO: 438361 - DNA, 25 bp, Rattus norvegicus
ggcatcacagcctcatggacgtata

SEQ ID NO: 438362 - DNA, 25 bp, Rattus norvegicus
ggcatcacagctcttaccttgtata

SEQ ID NO: 438363 - DNA, 25 bp, Rattus norvegicus
ggcatcacagctgttaccttgtata

SEQ ID NO: 438364 - DNA, 25 bp, Rattus norvegicus
ggcatcacagttcttgtcttggtac

SEQ ID NO: 438365 - DNA, 25 bp, Rattus norvegicus
ggcatcacagttgttgtcttggtac

SEQ ID NO: 438366 - DNA, 25 bp, Rattus norvegicus
ggcatcaccagacggcagtttgtct

SEQ ID NO: 438367 - DNA, 25 bp, Rattus norvegicus
ggcatcaccagagggcagtttgtct

SEQ ID NO: 438368 - DNA, 25 bp, Rattus norvegicus
ggcatcacgtttcccttattgttga

SEQ ID NO: 438369 - DNA, 25 bp, Rattus norvegicus
ggcatcacgtttgccttattgttga

SEQ ID NO: 438370 - DNA, 25 bp, Rattus norvegicus
ggcatcactggaaagggagcccctt

SEQ ID NO: 438371 - DNA, 25 bp, Rattus norvegicus
ggcatcactggatagggagcccctt

SEQ ID NO: 438372 - DNA, 25 bp, Rattus norvegicus
ggcatcactggcctgtgctgagcaa

SEQ ID NO: 438373 - DNA, 25 bp, Rattus norvegicus
ggcatcactggcgtgtgctgagcaa

SEQ ID NO: 438374 - DNA, 25 bp, Rattus norvegicus
ggcatcagatctcttggaactcaaa

SEQ ID NO: 438375 - DNA, 25 bp, Rattus norvegicus
ggcatcagatctgttggaactcaaa

SEQ ID NO: 438376 - DNA, 25 bp, Rattus norvegicus
ggcatcagatgcctttggatatctt

SEQ ID NO: 438377 - DNA, 25 bp, Rattus norvegicus
ggcatcagatgcgtttggatatctt

SEQ ID NO: 438378 - DNA, 25 bp, Rattus norvegicus
ggcatcagcaggaaagacactctca

SEQ ID NO: 438379 - DNA, 25 bp, Rattus norvegicus
ggcatcagcaggacatcatgtgact

SEQ ID NO: 438380 - DNA, 25 bp, Rattus norvegicus
ggcatcagcaggtaagacactctca

SEQ ID NO: 438381 - DNA, 25 bp, Rattus norvegicus
ggcatcagcaggtcatcatgtgact

SEQ ID NO: 438382 - DNA, 25 bp, Rattus norvegicus
ggcatcagtggacctcatcttgaca

SEQ ID NO: 438383 - DNA, 25 bp, Rattus norvegicus
ggcatcagtggagctcatcttgaca

SEQ ID NO: 438384 - DNA, 25 bp, Rattus norvegicus
ggcatcatagttctccttcagatta

SEQ ID NO: 438385 - DNA, 25 bp, Rattus norvegicus
ggcatcatagttcttttggtatata

SEQ ID NO: 438386 - DNA, 25 bp, Rattus norvegicus
ggcatcatagttgtccttcagatta

SEQ ID NO: 438387 - DNA, 25 bp, Rattus norvegicus
ggcatcatagttgttttggtatata

SEQ ID NO: 438388 - DNA, 25 bp, Rattus norvegicus
ggcatcatatgtcaagttctatcag

SEQ ID NO: 438389 - DNA, 25 bp, Rattus norvegicus
ggcatcatatgtgaagttctatcag

SEQ ID NO: 438390 - DNA, 25 bp, Rattus norvegicus
ggcatcatcataaaccatcacagca

SEQ ID NO: 438391 - DNA, 25 bp, Rattus norvegicus
ggcatcatcatataccatcacagca

SEQ ID NO: 438392 - DNA, 25 bp, Rattus norvegicus
ggcatcatcatcatccttgtacaga

SEQ ID NO: 438393 - DNA, 25 bp, Rattus norvegicus
ggcatcatcatcttccttgtacaga

SEQ ID NO: 438394 - DNA, 25 bp, Rattus norvegicus
ggcatcatcgaaaggcgtggcacat

SEQ ID NO: 438395 - DNA, 25 bp, Rattus norvegicus
ggcatcatcgaatggcgtggcacat

SEQ ID NO: 438396 - DNA, 25 bp, Rattus norvegicus
ggcatcatctggaggcagcctgaga

SEQ ID NO: 438397 - DNA, 25 bp, Rattus norvegicus
ggcatcatctggtggcagcctgaga

SEQ ID NO: 438398 - DNA, 25 bp, Rattus norvegicus
ggcatcatgggtacaaggtcagtca

SEQ ID NO: 438399 - DNA, 25 bp, Rattus norvegicus
ggcatcatgggttcaaggtcagtca

SEQ ID NO: 438400 - DNA, 25 bp, Rattus norvegicus
ggcatcatgtgacaccactttcagg

SEQ ID NO: 438401 - DNA, 25 bp, Rattus norvegicus
ggcatcatgtgagaccactttcagg

SEQ ID NO: 438402 - DNA, 25 bp, Rattus norvegicus
ggcatcattgctcgtgggatccgac

SEQ ID NO: 438403 - DNA, 25 bp, Rattus norvegicus
ggcatcattgctggtgggatccgac

SEQ ID NO: 438404 - DNA, 25 bp, Rattus norvegicus
ggcatcattgtcaccatcagttggc

SEQ ID NO: 438405 - DNA, 25 bp, Rattus norvegicus
ggcatcattgtctccatcagttggc

SEQ ID NO: 438406 - DNA, 25 bp, Rattus norvegicus
ggcatccaagacaatgacccggaca

SEQ ID NO: 438407 - DNA, 25 bp, Rattus norvegicus
ggcatccaagactatgacccggaca

SEQ ID NO: 438408 - DNA, 25 bp, Rattus norvegicus
ggcatccaagcccatgcccatgtgt

SEQ ID NO: 438409 - DNA, 25 bp, Rattus norvegicus
ggcatccaagccgatgcccatgtgt

SEQ ID NO: 438410 - DNA, 25 bp, Rattus norvegicus
ggcatccaatatcgcggacgcggtc

SEQ ID NO: 438411 - DNA, 25 bp, Rattus norvegicus
ggcatccaatatggcggacgcggtc

SEQ ID NO: 438412 - DNA, 25 bp, Rattus norvegicus
ggcatccacacaaatgtgtacttac

SEQ ID NO: 438413 - DNA, 25 bp, Rattus norvegicus
ggcatccacacatatgtgtacttac

SEQ ID NO: 438414 - DNA, 25 bp, Rattus norvegicus
ggcatccactaaagcgtccagtttg

SEQ ID NO: 438415 - DNA, 25 bp, Rattus norvegicus
ggcatccactaatgcgtccagtttg

SEQ ID NO: 438416 - DNA, 25 bp, Rattus norvegicus
ggcatccactacatctgagaccatt

SEQ ID NO: 438417 - DNA, 25 bp, Rattus norvegicus
ggcatccactacttctgagaccatt

SEQ ID NO: 438418 - DNA, 25 bp, Rattus norvegicus
ggcatccaggcccactcaaatgttg

SEQ ID NO: 438419 - DNA, 25 bp, Rattus norvegicus
ggcatccaggccgactcaaatgttg

SEQ ID NO: 438420 - DNA, 25 bp, Rattus norvegicus
ggcatccagtccaattcggtagcaa

SEQ ID NO: 438421 - DNA, 25 bp, Rattus norvegicus
ggcatccagtcctattcggtagcaa

SEQ ID NO: 438422 - DNA, 25 bp, Rattus norvegicus
ggcatccatgatcccatcttgtctt

SEQ ID NO: 438423 - DNA, 25 bp, Rattus norvegicus
ggcatccatgatgccatcttgtctt

SEQ ID NO: 438424 - DNA, 25 bp, Rattus norvegicus
ggcatccatgcgcattttagattta

SEQ ID NO: 438425 - DNA, 25 bp, Rattus norvegicus
ggcatccatgcggattttagattta

SEQ ID NO: 438426 - DNA, 25 bp, Rattus norvegicus
ggcatccatgtcatcattttgggct

SEQ ID NO: 438427 - DNA, 25 bp, Rattus norvegicus
ggcatccatgtcttcattttgggct

SEQ ID NO: 438428 - DNA, 25 bp, Rattus norvegicus
ggcatccattataaggtatgctttt

SEQ ID NO: 438429 - DNA, 25 bp, Rattus norvegicus
ggcatccattattaggtatgctttt

SEQ ID NO: 438430 - DNA, 25 bp, Rattus norvegicus
ggcatcccaactaccggtatttcta

SEQ ID NO: 438431 - DNA, 25 bp, Rattus norvegicus
ggcatcccaacttccggtatttcta

SEQ ID NO: 438432 - DNA, 25 bp, Rattus norvegicus
ggcatcccaggaaaccttccagtga

SEQ ID NO: 438433 - DNA, 25 bp, Rattus norvegicus
ggcatcccaggataccttccagtga

SEQ ID NO: 438434 - DNA, 25 bp, Rattus norvegicus
ggcatcccagggaatgagcttccag

SEQ ID NO: 438435 - DNA, 25 bp, Rattus norvegicus
ggcatcccagggtatgagcttccag

SEQ ID NO: 438436 - DNA, 25 bp, Rattus norvegicus
ggcatcccatacatttcttatacta

SEQ ID NO: 438437 - DNA, 25 bp, Rattus norvegicus
ggcatcccatacttttcttatacta

SEQ ID NO: 438438 - DNA, 25 bp, Rattus norvegicus
ggcatcccatgactataaataatct

SEQ ID NO: 438439 - DNA, 25 bp, Rattus norvegicus
ggcatcccatgagtataaataatct

SEQ ID NO: 438440 - DNA, 25 bp, Rattus norvegicus
ggcatccccagcagagaacagttga

SEQ ID NO: 438441 - DNA, 25 bp, Rattus norvegicus
ggcatccccagctgagaacagttga

SEQ ID NO: 438442 - DNA, 25 bp, Rattus norvegicus
ggcatcccctacattgaaacatcag

SEQ ID NO: 438443 - DNA, 25 bp, Rattus norvegicus
ggcatcccctactttgaaacatcag

SEQ ID NO: 438444 - DNA, 25 bp, Rattus norvegicus
ggcatcccctgcaaagactgtaatt

SEQ ID NO: 438445 - DNA, 25 bp, Rattus norvegicus
ggcatcccctgcaaatatttattgg

SEQ ID NO: 438446 - DNA, 25 bp, Rattus norvegicus
ggcatcccctgctaagactgtaatt

SEQ ID NO: 438447 - DNA, 25 bp, Rattus norvegicus
ggcatcccctgctaatatttattgg

SEQ ID NO: 438448 - DNA, 25 bp, Rattus norvegicus
ggcatccctgaacacccaagtgtga

SEQ ID NO: 438449 - DNA, 25 bp, Rattus norvegicus
ggcatccctgaagacccaagtgtga

SEQ ID NO: 438450 - DNA, 25 bp, Rattus norvegicus
ggcatccctgatacttaatagctga

SEQ ID NO: 438451 - DNA, 25 bp, Rattus norvegicus
ggcatccctgattcttaatagctga

SEQ ID NO: 438452 - DNA, 25 bp, Rattus norvegicus
ggcatccgagaaacagagctaccgc

SEQ ID NO: 438453 - DNA, 25 bp, Rattus norvegicus
ggcatccgagaatcagagctaccgc

SEQ ID NO: 438454 - DNA, 25 bp, Rattus norvegicus
ggcatccgcaatcccagtataatta

SEQ ID NO: 438455 - DNA, 25 bp, Rattus norvegicus
ggcatccgcaatgccagtataatta

SEQ ID NO: 438456 - DNA, 25 bp, Rattus norvegicus
ggcatccgcttaacatggaaaccac

SEQ ID NO: 438457 - DNA, 25 bp, Rattus norvegicus
ggcatccgcttatcatggaaaccac

SEQ ID NO: 438458 - DNA, 25 bp, Rattus norvegicus
ggcatcctacaaccctttaacagaa

SEQ ID NO: 438459 - DNA, 25 bp, Rattus norvegicus
ggcatcctacaagcctttaacagaa

SEQ ID NO: 438460 - DNA, 25 bp, Rattus norvegicus
ggcatcctaggaagcccatgtatat

SEQ ID NO: 438461 - DNA, 25 bp, Rattus norvegicus
ggcatcctaggatgcccatgtatat

SEQ ID NO: 438462 - DNA, 25 bp, Rattus norvegicus
ggcatcctcatgaatgctttccagg

SEQ ID NO: 438463 - DNA, 25 bp, Rattus norvegicus
ggcatcctcatgtatgctttccagg

SEQ ID NO: 438464 - DNA, 25 bp, Rattus norvegicus
ggcatcctgagcaggcaaggtttga

SEQ ID NO: 438465 - DNA, 25 bp, Rattus norvegicus
ggcatcctgagctggcaaggtttga

SEQ ID NO: 438466 - DNA, 25 bp, Rattus norvegicus
ggcatcctgccaaagttagcacaac

SEQ ID NO: 438467 - DNA, 25 bp, Rattus norvegicus
ggcatcctgccatagttagcacaac

SEQ ID NO: 438468 - DNA, 25 bp, Rattus norvegicus
ggcatcctggaaaacacacgtattt

SEQ ID NO: 438469 - DNA, 25 bp, Rattus norvegicus
ggcatcctggaatacacacgtattt

SEQ ID NO: 438470 - DNA, 25 bp, Rattus norvegicus
ggcatcctggacaggtgaccgagaa

SEQ ID NO: 438471 - DNA, 25 bp, Rattus norvegicus
ggcatcctggactggtgaccgagaa

SEQ ID NO: 438472 - DNA, 25 bp, Rattus norvegicus
ggcatcctgtgcattttcttgggac

SEQ ID NO: 438473 - DNA, 25 bp, Rattus norvegicus
ggcatcctgtgctttttcttgggac

SEQ ID NO: 438474 - DNA, 25 bp, Rattus norvegicus
ggcatccttaagatacacaggttat

SEQ ID NO: 438475 - DNA, 25 bp, Rattus norvegicus
ggcatccttaagttacacaggttat

SEQ ID NO: 438476 - DNA, 25 bp, Rattus norvegicus
ggcatccttaggaatcgggcacata

SEQ ID NO: 438477 - DNA, 25 bp, Rattus norvegicus
ggcatccttaggtatcgggcacata

SEQ ID NO: 438478 - DNA, 25 bp, Rattus norvegicus
ggcatccttctcaagtggctttagt

SEQ ID NO: 438479 - DNA, 25 bp, Rattus norvegicus
ggcatccttctctagtggctttagt

SEQ ID NO: 438480 - DNA, 25 bp, Rattus norvegicus
ggcatccttgttaagccctttgaag

SEQ ID NO: 438481 - DNA, 25 bp, Rattus norvegicus
ggcatccttgtttagccctttgaag

SEQ ID NO: 438482 - DNA, 25 bp, Rattus norvegicus
ggcatcgaagtaacgggtgcttact

SEQ ID NO: 438483 - DNA, 25 bp, Rattus norvegicus
ggcatcgaagtatcgggtgcttact

SEQ ID NO: 438484 - DNA, 25 bp, Rattus norvegicus
ggcatcgacagcatggtagcaccat

SEQ ID NO: 438485 - DNA, 25 bp, Rattus norvegicus
ggcatcgacagcttggtagcaccat

SEQ ID NO: 438486 - DNA, 25 bp, Rattus norvegicus
ggcatcgacatgctggaacagtctg

SEQ ID NO: 438487 - DNA, 25 bp, Rattus norvegicus
ggcatcgacatggtggaacagtctg

SEQ ID NO: 438488 - DNA, 25 bp, Rattus norvegicus
ggcatcgactggcagcatttgtaac

SEQ ID NO: 438489 - DNA, 25 bp, Rattus norvegicus
ggcatcgactgggagcatttgtaac

SEQ ID NO: 438490 - DNA, 25 bp, Rattus norvegicus
ggcatcgagattctcactaccttaa

SEQ ID NO: 438491 - DNA, 25 bp, Rattus norvegicus
ggcatcgagattgtcactaccttaa

SEQ ID NO: 438492 - DNA, 25 bp, Rattus norvegicus
ggcatcgagtataggattgtccgca

SEQ ID NO: 438493 - DNA, 25 bp, Rattus norvegicus
ggcatcgagtattggattgtccgca

SEQ ID NO: 438494 - DNA, 25 bp, Rattus norvegicus
ggcatcgctgatattccagggctct

SEQ ID NO: 438495 - DNA, 25 bp, Rattus norvegicus
ggcatcgctgattttccagggctct

SEQ ID NO: 438496 - DNA, 25 bp, Rattus norvegicus
ggcatcggcaataacgtggtacata

SEQ ID NO: 438497 - DNA, 25 bp, Rattus norvegicus
ggcatcggcaattacgtggtacata

SEQ ID NO: 438498 - DNA, 25 bp, Rattus norvegicus
ggcatcggtcccctactgatgggta

SEQ ID NO: 438499 - DNA, 25 bp, Rattus norvegicus
ggcatcggtcccgtactgatgggta

SEQ ID NO: 438500 - DNA, 25 bp, Rattus norvegicus
ggcatcggtgccacgcatcttcatg

SEQ ID NO: 438501 - DNA, 25 bp, Rattus norvegicus
ggcatcggtgcctcgcatcttcatg

SEQ ID NO: 438502 - DNA, 25 bp, Rattus norvegicus
ggcatcggtggcataatacccagtt

SEQ ID NO: 438503 - DNA, 25 bp, Rattus norvegicus
ggcatcggtggcttaatacccagtt

SEQ ID NO: 438504 - DNA, 25 bp, Rattus norvegicus
ggcatcgtgttaacatctgcttatt

SEQ ID NO: 438505 - DNA, 25 bp, Rattus norvegicus
ggcatcgtgttatcatctgcttatt

SEQ ID NO: 438506 - DNA, 25 bp, Rattus norvegicus
ggcatctaaatgatcttggtttggc

SEQ ID NO: 438507 - DNA, 25 bp, Rattus norvegicus
ggcatctaaatgttcttggtttggc

SEQ ID NO: 438508 - DNA, 25 bp, Rattus norvegicus
ggcatctaacccattttccattgag

SEQ ID NO: 438509 - DNA, 25 bp, Rattus norvegicus
ggcatctaaccctttttccattgag

SEQ ID NO: 438510 - DNA, 25 bp, Rattus norvegicus
ggcatctacacaagggattcgcata

SEQ ID NO: 438511 - DNA, 25 bp, Rattus norvegicus
ggcatctacacatgggattcgcata

SEQ ID NO: 438512 - DNA, 25 bp, Rattus norvegicus
ggcatctaccttaataaacgcttct

SEQ ID NO: 438513 - DNA, 25 bp, Rattus norvegicus
ggcatctacctttataaacgcttct

SEQ ID NO: 438514 - DNA, 25 bp, Rattus norvegicus
ggcatctatatcatcaaatggtctt

SEQ ID NO: 438515 - DNA, 25 bp, Rattus norvegicus
ggcatctatatcttcaaatggtctt

SEQ ID NO: 438516 - DNA, 25 bp, Rattus norvegicus
ggcatctatgtgagtgtgaacccct

SEQ ID NO: 438517 - DNA, 25 bp, Rattus norvegicus
ggcatctatgtgtgtgtgaacccct

SEQ ID NO: 438518 - DNA, 25 bp, Rattus norvegicus
ggcatctcaaatatgtccacttaca

SEQ ID NO: 438519 - DNA, 25 bp, Rattus norvegicus
ggcatctcaaatttgtccacttaca

SEQ ID NO: 438520 - DNA, 25 bp, Rattus norvegicus
ggcatctcagacctggatatcacca

SEQ ID NO: 438521 - DNA, 25 bp, Rattus norvegicus
ggcatctcagacgtggatatcacca

SEQ ID NO: 438522 - DNA, 25 bp, Rattus norvegicus
ggcatctcagctcaatctaatgaaa

SEQ ID NO: 438523 - DNA, 25 bp, Rattus norvegicus
ggcatctcagctgaatctaatgaaa

SEQ ID NO: 438524 - DNA, 25 bp, Rattus norvegicus
ggcatctcatcgcaggttggtgact

SEQ ID NO: 438525 - DNA, 25 bp, Rattus norvegicus
ggcatctcatcggaggttggtgact

SEQ ID NO: 438526 - DNA, 25 bp, Rattus norvegicus
ggcatctccaagaaagctgtcacgt

SEQ ID NO: 438527 - DNA, 25 bp, Rattus norvegicus
ggcatctccaagaattacccctgga

SEQ ID NO: 438528 - DNA, 25 bp, Rattus norvegicus
ggcatctccaagtaagctgtcacgt

SEQ ID NO: 438529 - DNA, 25 bp, Rattus norvegicus
ggcatctccaagtattacccctgga

SEQ ID NO: 438530 - DNA, 25 bp, Rattus norvegicus
ggcatctccagcattggctgagaca

SEQ ID NO: 438531 - DNA, 25 bp, Rattus norvegicus
ggcatctccagctttggctgagaca

SEQ ID NO: 438532 - DNA, 25 bp, Rattus norvegicus
ggcatctccttaatttaagtctcac

SEQ ID NO: 438533 - DNA, 25 bp, Rattus norvegicus
ggcatctccttattttaagtctcac

SEQ ID NO: 438534 - DNA, 25 bp, Rattus norvegicus
ggcatctcgctgaaattggtgctga

SEQ ID NO: 438535 - DNA, 25 bp, Rattus norvegicus
ggcatctcgctgtaattggtgctga

SEQ ID NO: 438536 - DNA, 25 bp, Rattus norvegicus
ggcatctctgccaaaggtctcatat

SEQ ID NO: 438537 - DNA, 25 bp, Rattus norvegicus
ggcatctctgcctaaggtctcatat

SEQ ID NO: 438538 - DNA, 25 bp, Rattus norvegicus
ggcatctcttccaagttgggagaca

SEQ ID NO: 438539 - DNA, 25 bp, Rattus norvegicus
ggcatctcttcctagttgggagaca

SEQ ID NO: 438540 - DNA, 25 bp, Rattus norvegicus
ggcatctgacagatacctaagggta

SEQ ID NO: 438541 - DNA, 25 bp, Rattus norvegicus
ggcatctgacagttacctaagggta

SEQ ID NO: 438542 - DNA, 25 bp, Rattus norvegicus
ggcatctgcagtatcgagtttctca

SEQ ID NO: 438543 - DNA, 25 bp, Rattus norvegicus
ggcatctgcagtttcgagtttctca

SEQ ID NO: 438544 - DNA, 25 bp, Rattus norvegicus
ggcatctgccatcggccaggacgtc

SEQ ID NO: 438545 - DNA, 25 bp, Rattus norvegicus
ggcatctgccatgggccaggacgtc

SEQ ID NO: 438546 - DNA, 25 bp, Rattus norvegicus
ggcatctgctgtagcccggatggct

SEQ ID NO: 438547 - DNA, 25 bp, Rattus norvegicus
ggcatctgctgttgcccggatggct

SEQ ID NO: 438548 - DNA, 25 bp, Rattus norvegicus
ggcatctgctttccgttcaaagtgt

SEQ ID NO: 438549 - DNA, 25 bp, Rattus norvegicus
ggcatctgctttctttgtggtgaac

SEQ ID NO: 438550 - DNA, 25 bp, Rattus norvegicus
ggcatctgctttgcgttcaaagtgt

SEQ ID NO: 438551 - DNA, 25 bp, Rattus norvegicus
ggcatctgctttgtttgtggtgaac

SEQ ID NO: 438552 - DNA, 25 bp, Rattus norvegicus
ggcatctggctaccaaggaacttcg

SEQ ID NO: 438553 - DNA, 25 bp, Rattus norvegicus
ggcatctggctagcaaggaacttcg

SEQ ID NO: 438554 - DNA, 25 bp, Rattus norvegicus
ggcatctggctcaaagaatggtcta

SEQ ID NO: 438555 - DNA, 25 bp, Rattus norvegicus
ggcatctggctctaagaatggtcta

SEQ ID NO: 438556 - DNA, 25 bp, Rattus norvegicus
ggcatctgggtaacctctatcagaa

SEQ ID NO: 438557 - DNA, 25 bp, Rattus norvegicus
ggcatctgggtatcctctatcagaa

SEQ ID NO: 438558 - DNA, 25 bp, Rattus norvegicus
ggcatcttaatgagggacttccctg

SEQ ID NO: 438559 - DNA, 25 bp, Rattus norvegicus
ggcatcttaatgtgggacttccctg

SEQ ID NO: 438560 - DNA, 25 bp, Rattus norvegicus
ggcatcttatttacatggtcttcct

SEQ ID NO: 438561 - DNA, 25 bp, Rattus norvegicus
ggcatcttattttcatggtcttcct

SEQ ID NO: 438562 - DNA, 25 bp, Rattus norvegicus
ggcatcttcagtcagccaggaagca

SEQ ID NO: 438563 - DNA, 25 bp, Rattus norvegicus
ggcatcttcagtgagccaggaagca

SEQ ID NO: 438564 - DNA, 25 bp, Rattus norvegicus
ggcatcttcatcatcaatgttgtgt

SEQ ID NO: 438565 - DNA, 25 bp, Rattus norvegicus
ggcatcttcatcttcaatgttgtgt

SEQ ID NO: 438566 - DNA, 25 bp, Rattus norvegicus
ggcatcttctgtacgttaggagttt

SEQ ID NO: 438567 - DNA, 25 bp, Rattus norvegicus
ggcatcttctgtattacatgacttc

SEQ ID NO: 438568 - DNA, 25 bp, Rattus norvegicus
ggcatcttctgttcgttaggagttt

SEQ ID NO: 438569 - DNA, 25 bp, Rattus norvegicus
ggcatcttctgttttacatgacttc

SEQ ID NO: 438570 - DNA, 25 bp, Rattus norvegicus
ggcatcttgcaccttttctaaatct

SEQ ID NO: 438571 - DNA, 25 bp, Rattus norvegicus
ggcatcttgcacgttttctaaatct

SEQ ID NO: 438572 - DNA, 25 bp, Rattus norvegicus
ggcatcttggatcttctgagtactt

SEQ ID NO: 438573 - DNA, 25 bp, Rattus norvegicus
ggcatcttggatgttctgagtactt

SEQ ID NO: 438574 - DNA, 25 bp, Rattus norvegicus
ggcatctttagacatggagccatct

SEQ ID NO: 438575 - DNA, 25 bp, Rattus norvegicus
ggcatctttagagatggagccatct

SEQ ID NO: 438576 - DNA, 25 bp, Rattus norvegicus
ggcatctttcctatggttactggga

SEQ ID NO: 438577 - DNA, 25 bp, Rattus norvegicus
ggcatctttcctttggttactggga

SEQ ID NO: 438578 - DNA, 25 bp, Rattus norvegicus
ggcatctttgggacttatactgtgt

SEQ ID NO: 438579 - DNA, 25 bp, Rattus norvegicus
ggcatctttgggtcttatactgtgt

SEQ ID NO: 438580 - DNA, 25 bp, Rattus norvegicus
ggcatgaaaaggctctctcagattt

SEQ ID NO: 438581 - DNA, 25 bp, Rattus norvegicus
ggcatgaaaagggtctctcagattt

SEQ ID NO: 438582 - DNA, 25 bp, Rattus norvegicus
ggcatgaaaattctcctattccagt

SEQ ID NO: 438583 - DNA, 25 bp, Rattus norvegicus
ggcatgaaaattgtcctattccagt

SEQ ID NO: 438584 - DNA, 25 bp, Rattus norvegicus
ggcatgaacacaccagtttctgatt

SEQ ID NO: 438585 - DNA, 25 bp, Rattus norvegicus
ggcatgaacacagcagtttctgatt

SEQ ID NO: 438586 - DNA, 25 bp, Rattus norvegicus
ggcatgaacataacctgcaggtttt

SEQ ID NO: 438587 - DNA, 25 bp, Rattus norvegicus
ggcatgaacatatcctgcaggtttt

SEQ ID NO: 438588 - DNA, 25 bp, Rattus norvegicus
ggcatgaaggatctggagtccggcc

SEQ ID NO: 438589 - DNA, 25 bp, Rattus norvegicus
ggcatgaaggatgtggagtccggcc

SEQ ID NO: 438590 - DNA, 25 bp, Rattus norvegicus
ggcatgaataccctaatctttgaag

SEQ ID NO: 438591 - DNA, 25 bp, Rattus norvegicus
ggcatgaataccgtaatctttgaag

SEQ ID NO: 438592 - DNA, 25 bp, Rattus norvegicus
ggcatgaatcccaataagtcacaat

SEQ ID NO: 438593 - DNA, 25 bp, Rattus norvegicus
ggcatgaatccctataagtcacaat

SEQ ID NO: 438594 - DNA, 25 bp, Rattus norvegicus
ggcatgacaccacgtttggtttcgt

SEQ ID NO: 438595 - DNA, 25 bp, Rattus norvegicus
ggcatgacaccaggtttggtttcgt

SEQ ID NO: 438596 - DNA, 25 bp, Rattus norvegicus
ggcatgacacttcatatatagacca

SEQ ID NO: 438597 - DNA, 25 bp, Rattus norvegicus
ggcatgacacttcctttgtgtgctc

SEQ ID NO: 438598 - DNA, 25 bp, Rattus norvegicus
ggcatgacacttgatatatagacca

SEQ ID NO: 438599 - DNA, 25 bp, Rattus norvegicus
ggcatgacacttgctttgtgtgctc

SEQ ID NO: 438600 - DNA, 25 bp, Rattus norvegicus
ggcatgacatgcaaaaactacttct

SEQ ID NO: 438601 - DNA, 25 bp, Rattus norvegicus
ggcatgacatgctaaaactacttct

SEQ ID NO: 438602 - DNA, 25 bp, Rattus norvegicus
ggcatgacattccatagctgacatt

SEQ ID NO: 438603 - DNA, 25 bp, Rattus norvegicus
ggcatgacattcgatagctgacatt

SEQ ID NO: 438604 - DNA, 25 bp, Rattus norvegicus
ggcatgacctgtccaagacgtactg

SEQ ID NO: 438605 - DNA, 25 bp, Rattus norvegicus
ggcatgacctgtgcaagacgtactg

SEQ ID NO: 438606 - DNA, 25 bp, Rattus norvegicus
ggcatgacctttacacacagtcagc

SEQ ID NO: 438607 - DNA, 25 bp, Rattus norvegicus
ggcatgaccttttcacacagtcagc

SEQ ID NO: 438608 - DNA, 25 bp, Rattus norvegicus
ggcatgacgagacccatttgaacaa

SEQ ID NO: 438609 - DNA, 25 bp, Rattus norvegicus
ggcatgacgagagccatttgaacaa

SEQ ID NO: 438610 - DNA, 25 bp, Rattus norvegicus
ggcatgacgggcatctggagatacc

SEQ ID NO: 438611 - DNA, 25 bp, Rattus norvegicus
ggcatgacgggcttctggagatacc

SEQ ID NO: 438612 - DNA, 25 bp, Rattus norvegicus
ggcatgactataagaccacgcacga

SEQ ID NO: 438613 - DNA, 25 bp, Rattus norvegicus
ggcatgactatatgaccacgcacga

SEQ ID NO: 438614 - DNA, 25 bp, Rattus norvegicus
ggcatgagacagaaccctagacgct

SEQ ID NO: 438615 - DNA, 25 bp, Rattus norvegicus
ggcatgagacagtaccctagacgct

SEQ ID NO: 438616 - DNA, 25 bp, Rattus norvegicus
ggcatgagcacgaggacaaaccgaa

SEQ ID NO: 438617 - DNA, 25 bp, Rattus norvegicus
ggcatgagcacgtggacaaaccgaa

SEQ ID NO: 438618 - DNA, 25 bp, Rattus norvegicus
ggcatgaggcgcctttattataaaa

SEQ ID NO: 438619 - DNA, 25 bp, Rattus norvegicus
ggcatgaggcgcgtttattataaaa

SEQ ID NO: 438620 - DNA, 25 bp, Rattus norvegicus
ggcatgaggtgtatgggcatcccaa

SEQ ID NO: 438621 - DNA, 25 bp, Rattus norvegicus
ggcatgaggtgtttgggcatcccaa

SEQ ID NO: 438622 - DNA, 25 bp, Rattus norvegicus
ggcatgagttttataatccccaaaa

SEQ ID NO: 438623 - DNA, 25 bp, Rattus norvegicus
ggcatgagttttttaatccccaaaa

SEQ ID NO: 438624 - DNA, 25 bp, Rattus norvegicus
ggcatgatcgctctcatcaaggtca

SEQ ID NO: 438625 - DNA, 25 bp, Rattus norvegicus
ggcatgatcgctgtcatcaaggtca

SEQ ID NO: 438626 - DNA, 25 bp, Rattus norvegicus
ggcatgatgggtatgctgcatctca

SEQ ID NO: 438627 - DNA, 25 bp, Rattus norvegicus
ggcatgatgggtttgctgcatctca

SEQ ID NO: 438628 - DNA, 25 bp, Rattus norvegicus
ggcatgatggttaccttttgactag

SEQ ID NO: 438629 - DNA, 25 bp, Rattus norvegicus
ggcatgatggtttccttttgactag

SEQ ID NO: 438630 - DNA, 25 bp, Rattus norvegicus
ggcatgattgaacaccagactcctg

SEQ ID NO: 438631 - DNA, 25 bp, Rattus norvegicus
ggcatgattgaagaccagactcctg

SEQ ID NO: 438632 - DNA, 25 bp, Rattus norvegicus
ggcatgattgggactttgctagatg

SEQ ID NO: 438633 - DNA, 25 bp, Rattus norvegicus
ggcatgattgggtctttgctagatg

SEQ ID NO: 438634 - DNA, 25 bp, Rattus norvegicus
ggcatgcaacaaaaggacgcctttt

SEQ ID NO: 438635 - DNA, 25 bp, Rattus norvegicus
ggcatgcaacaataggacgcctttt

SEQ ID NO: 438636 - DNA, 25 bp, Rattus norvegicus
ggcatgcaacttaagtgacccaatg

SEQ ID NO: 438637 - DNA, 25 bp, Rattus norvegicus
ggcatgcaactttagtgacccaatg

SEQ ID NO: 438638 - DNA, 25 bp, Rattus norvegicus
ggcatgcaatatccagacttacagc

SEQ ID NO: 438639 - DNA, 25 bp, Rattus norvegicus
ggcatgcaatatgcagacttacagc

SEQ ID NO: 438640 - DNA, 25 bp, Rattus norvegicus
ggcatgcaatttaggcctgcgacat

SEQ ID NO: 438641 - DNA, 25 bp, Rattus norvegicus
ggcatgcaattttggcctgcgacat

SEQ ID NO: 438642 - DNA, 25 bp, Rattus norvegicus
ggcatgcacactacaagggcacaca

SEQ ID NO: 438643 - DNA, 25 bp, Rattus norvegicus
ggcatgcacacttcaagggcacaca

SEQ ID NO: 438644 - DNA, 25 bp, Rattus norvegicus
ggcatgcacggcctccggatattta

SEQ ID NO: 438645 - DNA, 25 bp, Rattus norvegicus
ggcatgcacggcgtccggatattta

SEQ ID NO: 438646 - DNA, 25 bp, Rattus norvegicus
ggcatgcacttgatgtggacccagg

SEQ ID NO: 438647 - DNA, 25 bp, Rattus norvegicus
ggcatgcacttgttgtggacccagg

SEQ ID NO: 438648 - DNA, 25 bp, Rattus norvegicus
ggcatgcagacacggacactcttgt

SEQ ID NO: 438649 - DNA, 25 bp, Rattus norvegicus
ggcatgcagacagggacactcttgt

SEQ ID NO: 438650 - DNA, 25 bp, Rattus norvegicus
ggcatgcaggaactcacacacataa

SEQ ID NO: 438651 - DNA, 25 bp, Rattus norvegicus
ggcatgcaggaagtcacacacataa

SEQ ID NO: 438652 - DNA, 25 bp, Rattus norvegicus
ggcatgcagtccatttaatgtgctc

SEQ ID NO: 438653 - DNA, 25 bp, Rattus norvegicus
ggcatgcagtccttttaatgtgctc

SEQ ID NO: 438654 - DNA, 25 bp, Rattus norvegicus
ggcatgcagtggcactcagacttca

SEQ ID NO: 438655 - DNA, 25 bp, Rattus norvegicus
ggcatgcagtgggactcagacttca

SEQ ID NO: 438656 - DNA, 25 bp, Rattus norvegicus
ggcatgcatagaaaggctacagctt

SEQ ID NO: 438657 - DNA, 25 bp, Rattus norvegicus
ggcatgcatagataggctacagctt

SEQ ID NO: 438658 - DNA, 25 bp, Rattus norvegicus
ggcatgccagtacccgtaattgaat

SEQ ID NO: 438659 - DNA, 25 bp, Rattus norvegicus
ggcatgccagtagccgtaattgaat

SEQ ID NO: 438660 - DNA, 25 bp, Rattus norvegicus
ggcatgcccttaactgtggagttca

SEQ ID NO: 438661 - DNA, 25 bp, Rattus norvegicus
ggcatgcccttatctgtggagttca

SEQ ID NO: 438662 - DNA, 25 bp, Rattus norvegicus
ggcatgcctgtaagtatctctcaga

SEQ ID NO: 438663 - DNA, 25 bp, Rattus norvegicus
ggcatgcctgtatgtatctctcaga

SEQ ID NO: 438664 - DNA, 25 bp, Rattus norvegicus
ggcatgccttcaatatctgagggta

SEQ ID NO: 438665 - DNA, 25 bp, Rattus norvegicus
ggcatgccttcattatctgagggta

SEQ ID NO: 438666 - DNA, 25 bp, Rattus norvegicus
ggcatgcgaattagtggctctaccc

SEQ ID NO: 438667 - DNA, 25 bp, Rattus norvegicus
ggcatgcgaatttgtggctctaccc

SEQ ID NO: 438668 - DNA, 25 bp, Rattus norvegicus
ggcatgcgctgcagagcacctttag

SEQ ID NO: 438669 - DNA, 25 bp, Rattus norvegicus
ggcatgcgctgctgagcacctttag

SEQ ID NO: 438670 - DNA, 25 bp, Rattus norvegicus
ggcatgctagcaatctcaaggtcac

SEQ ID NO: 438671 - DNA, 25 bp, Rattus norvegicus
ggcatgctagcattctcaaggtcac

SEQ ID NO: 438672 - DNA, 25 bp, Rattus norvegicus
ggcatgctatttcagtttgcattat

SEQ ID NO: 438673 - DNA, 25 bp, Rattus norvegicus
ggcatgctatttgagtttgcattat

SEQ ID NO: 438674 - DNA, 25 bp, Rattus norvegicus
ggcatgctggataccatggttacca

SEQ ID NO: 438675 - DNA, 25 bp, Rattus norvegicus
ggcatgctggattccatggttacca

SEQ ID NO: 438676 - DNA, 25 bp, Rattus norvegicus
ggcatgcttaacagtgtcctctgga

SEQ ID NO: 438677 - DNA, 25 bp, Rattus norvegicus
ggcatgcttaactgtgtcctctgga

SEQ ID NO: 438678 - DNA, 25 bp, Rattus norvegicus
ggcatgcttagcatatttgaccaaa

SEQ ID NO: 438679 - DNA, 25 bp, Rattus norvegicus
ggcatgcttagcttatttgaccaaa

SEQ ID NO: 438680 - DNA, 25 bp, Rattus norvegicus
ggcatgcttaggcagtgtttttcat

SEQ ID NO: 438681 - DNA, 25 bp, Rattus norvegicus
ggcatgcttagggagtgtttttcat

SEQ ID NO: 438682 - DNA, 25 bp, Rattus norvegicus
ggcatgcttgggacttcactgacag

SEQ ID NO: 438683 - DNA, 25 bp, Rattus norvegicus
ggcatgcttgggtcttcactgacag

SEQ ID NO: 438684 - DNA, 25 bp, Rattus norvegicus
ggcatggaaacgcacagcacgcaca

SEQ ID NO: 438685 - DNA, 25 bp, Rattus norvegicus
ggcatggaaacggacagcacgcaca

SEQ ID NO: 438686 - DNA, 25 bp, Rattus norvegicus
ggcatggaataacctggcctgacca

SEQ ID NO: 438687 - DNA, 25 bp, Rattus norvegicus
ggcatggaataagctggcctgacca

SEQ ID NO: 438688 - DNA, 25 bp, Rattus norvegicus
ggcatggaatggacacctctgctgt

SEQ ID NO: 438689 - DNA, 25 bp, Rattus norvegicus
ggcatggaatggtcacctctgctgt

SEQ ID NO: 438690 - DNA, 25 bp, Rattus norvegicus
ggcatggacatgagaccctattcaa

SEQ ID NO: 438691 - DNA, 25 bp, Rattus norvegicus
ggcatggacatgtgaccctattcaa

SEQ ID NO: 438692 - DNA, 25 bp, Rattus norvegicus
ggcatggacattctgcacatacata

SEQ ID NO: 438693 - DNA, 25 bp, Rattus norvegicus
ggcatggacattgtgcacatacata

SEQ ID NO: 438694 - DNA, 25 bp, Rattus norvegicus
ggcatggaccttagaaaccccaggg

SEQ ID NO: 438695 - DNA, 25 bp, Rattus norvegicus
ggcatggacctttgaaaccccaggg

SEQ ID NO: 438696 - DNA, 25 bp, Rattus norvegicus
ggcatggagattcactaccttgatt

SEQ ID NO: 438697 - DNA, 25 bp, Rattus norvegicus
ggcatggagattgactaccttgatt

SEQ ID NO: 438698 - DNA, 25 bp, Rattus norvegicus
ggcatggagctcagtgatatttcaa

SEQ ID NO: 438699 - DNA, 25 bp, Rattus norvegicus
ggcatggagctctgtgatatttcaa

SEQ ID NO: 438700 - DNA, 25 bp, Rattus norvegicus
ggcatggatcacctgttttatacaa

SEQ ID NO: 438701 - DNA, 25 bp, Rattus norvegicus
ggcatggatcacgtgttttatacaa

SEQ ID NO: 438702 - DNA, 25 bp, Rattus norvegicus
ggcatggatggacgaaattctttca

SEQ ID NO: 438703 - DNA, 25 bp, Rattus norvegicus
ggcatggatggaggaaattctttca

SEQ ID NO: 438704 - DNA, 25 bp, Rattus norvegicus
ggcatggcaaataggtgctggacaa

SEQ ID NO: 438705 - DNA, 25 bp, Rattus norvegicus
ggcatggcaaattggtgctggacaa

SEQ ID NO: 438706 - DNA, 25 bp, Rattus norvegicus
ggcatggcatcacggcagccagaat

SEQ ID NO: 438707 - DNA, 25 bp, Rattus norvegicus
ggcatggcatcagggcagccagaat

SEQ ID NO: 438708 - DNA, 25 bp, Rattus norvegicus
ggcatggccatgctggaatgataaa

SEQ ID NO: 438709 - DNA, 25 bp, Rattus norvegicus
ggcatggccatggtggaatgataaa

SEQ ID NO: 438710 - DNA, 25 bp, Rattus norvegicus
ggcatggcgatcagtgatggctcct

SEQ ID NO: 438711 - DNA, 25 bp, Rattus norvegicus
ggcatggcgatctgtgatggctcct

SEQ ID NO: 438712 - DNA, 25 bp, Rattus norvegicus
ggcatggcggctaccaaacattctt

SEQ ID NO: 438713 - DNA, 25 bp, Rattus norvegicus
ggcatggcggcttccaaacattctt

SEQ ID NO: 438714 - DNA, 25 bp, Rattus norvegicus
ggcatggctgcaaaggaaccgttat

SEQ ID NO: 438715 - DNA, 25 bp, Rattus norvegicus
ggcatggctgcataggaaccgttat

SEQ ID NO: 438716 - DNA, 25 bp, Rattus norvegicus
ggcatggctgctacctgacagagat

SEQ ID NO: 438717 - DNA, 25 bp, Rattus norvegicus
ggcatggctgcttcctgacagagat

SEQ ID NO: 438718 - DNA, 25 bp, Rattus norvegicus
ggcatggctgttacttagacctgaa

SEQ ID NO: 438719 - DNA, 25 bp, Rattus norvegicus
ggcatggctgtttcttagacctgaa

SEQ ID NO: 438720 - DNA, 25 bp, Rattus norvegicus
ggcatgggagcaaaagcttccagct

SEQ ID NO: 438721 - DNA, 25 bp, Rattus norvegicus
ggcatgggagcataagcttccagct

SEQ ID NO: 438722 - DNA, 25 bp, Rattus norvegicus
ggcatgggcagcagtgcttacacac

SEQ ID NO: 438723 - DNA, 25 bp, Rattus norvegicus
ggcatgggcagctgtgcttacacac

SEQ ID NO: 438724 - DNA, 25 bp, Rattus norvegicus
ggcatgggcagtcaagtctctgaaa

SEQ ID NO: 438725 - DNA, 25 bp, Rattus norvegicus
ggcatgggcagtgaagtctctgaaa

SEQ ID NO: 438726 - DNA, 25 bp, Rattus norvegicus
ggcatgggcattcccacttagctat

SEQ ID NO: 438727 - DNA, 25 bp, Rattus norvegicus
ggcatgggcattgccacttagctat

SEQ ID NO: 438728 - DNA, 25 bp, Rattus norvegicus
ggcatgggcgtcagtggccatcata

SEQ ID NO: 438729 - DNA, 25 bp, Rattus norvegicus
ggcatgggcgtctgtggccatcata

SEQ ID NO: 438730 - DNA, 25 bp, Rattus norvegicus
ggcatgggtcgtcctagttatcaac

SEQ ID NO: 438731 - DNA, 25 bp, Rattus norvegicus
ggcatgggtcgtgctagttatcaac

SEQ ID NO: 438732 - DNA, 25 bp, Rattus norvegicus
ggcatgggtcttacatcatatcaat

SEQ ID NO: 438733 - DNA, 25 bp, Rattus norvegicus
ggcatgggtctttcatcatatcaat

SEQ ID NO: 438734 - DNA, 25 bp, Rattus norvegicus
ggcatggtgacccacacttgtaatc

SEQ ID NO: 438735 - DNA, 25 bp, Rattus norvegicus
ggcatggtgaccgacacttgtaatc

SEQ ID NO: 438736 - DNA, 25 bp, Rattus norvegicus
ggcatggtgccaagctgctctacgc

SEQ ID NO: 438737 - DNA, 25 bp, Rattus norvegicus
ggcatggtgccatgctgctctacgc

SEQ ID NO: 438738 - DNA, 25 bp, Rattus norvegicus
ggcatggtgctcaatatcttggcca

SEQ ID NO: 438739 - DNA, 25 bp, Rattus norvegicus
ggcatggtgctctatatcttggcca

SEQ ID NO: 438740 - DNA, 25 bp, Rattus norvegicus
ggcatggtggctcatacttgtcatc

SEQ ID NO: 438741 - DNA, 25 bp, Rattus norvegicus
ggcatggtggctgatacttgtcatc

SEQ ID NO: 438742 - DNA, 25 bp, Rattus norvegicus
ggcatggtgggcagtcctagcacat

SEQ ID NO: 438743 - DNA, 25 bp, Rattus norvegicus
ggcatggtgggctgtcctagcacat

SEQ ID NO: 438744 - DNA, 25 bp, Rattus norvegicus
ggcatggtgtcgatttacttttttc

SEQ ID NO: 438745 - DNA, 25 bp, Rattus norvegicus
ggcatggtgtcgttttacttttttc

SEQ ID NO: 438746 - DNA, 25 bp, Rattus norvegicus
ggcatggttcgtcccaaattccgaa

SEQ ID NO: 438747 - DNA, 25 bp, Rattus norvegicus
ggcatggttcgtgccaaattccgaa

SEQ ID NO: 438748 - DNA, 25 bp, Rattus norvegicus
ggcatggttctccttaggcagagca

SEQ ID NO: 438749 - DNA, 25 bp, Rattus norvegicus
ggcatggttctcgttaggcagagca

SEQ ID NO: 438750 - DNA, 25 bp, Rattus norvegicus
ggcatgtaaacaccacagacaccgt

SEQ ID NO: 438751 - DNA, 25 bp, Rattus norvegicus
ggcatgtaaacagcacagacaccgt

SEQ ID NO: 438752 - DNA, 25 bp, Rattus norvegicus
ggcatgtaccatagcaggcttcaat

SEQ ID NO: 438753 - DNA, 25 bp, Rattus norvegicus
ggcatgtaccatccctgtgaagaga

SEQ ID NO: 438754 - DNA, 25 bp, Rattus norvegicus
ggcatgtaccatctatcctaaagaa

SEQ ID NO: 438755 - DNA, 25 bp, Rattus norvegicus
ggcatgtaccatgcctgtgaagaga

SEQ ID NO: 438756 - DNA, 25 bp, Rattus norvegicus
ggcatgtaccatgtatcctaaagaa

SEQ ID NO: 438757 - DNA, 25 bp, Rattus norvegicus
ggcatgtaccattgcaggcttcaat

SEQ ID NO: 438758 - DNA, 25 bp, Rattus norvegicus
ggcatgtacgcccactcagagatgt

SEQ ID NO: 438759 - DNA, 25 bp, Rattus norvegicus
ggcatgtacgccgactcagagatgt

SEQ ID NO: 438760 - DNA, 25 bp, Rattus norvegicus
ggcatgtacgctaaggtcttgtgtt

SEQ ID NO: 438761 - DNA, 25 bp, Rattus norvegicus
ggcatgtacgcttaggtcttgtgtt

SEQ ID NO: 438762 - DNA, 25 bp, Rattus norvegicus
ggcatgtacttcagagtgtaactct

SEQ ID NO: 438763 - DNA, 25 bp, Rattus norvegicus
ggcatgtacttctgagtgtaactct

SEQ ID NO: 438764 - DNA, 25 bp, Rattus norvegicus
ggcatgtaggagatccgggtctcaa

SEQ ID NO: 438765 - DNA, 25 bp, Rattus norvegicus
ggcatgtaggagttccgggtctcaa

SEQ ID NO: 438766 - DNA, 25 bp, Rattus norvegicus
ggcatgtataacattagtccctaag

SEQ ID NO: 438767 - DNA, 25 bp, Rattus norvegicus
ggcatgtataactttagtccctaag

SEQ ID NO: 438768 - DNA, 25 bp, Rattus norvegicus
ggcatgtatcccatgcttggccacc

SEQ ID NO: 438769 - DNA, 25 bp, Rattus norvegicus
ggcatgtatcccttgcttggccacc

SEQ ID NO: 438770 - DNA, 25 bp, Rattus norvegicus
ggcatgtcaacaattctatggtgat

SEQ ID NO: 438771 - DNA, 25 bp, Rattus norvegicus
ggcatgtcaacatttctatggtgat

SEQ ID NO: 438772 - DNA, 25 bp, Rattus norvegicus
ggcatgtcaatgcttttctcggcat

SEQ ID NO: 438773 - DNA, 25 bp, Rattus norvegicus
ggcatgtcaatggttttctcggcat

SEQ ID NO: 438774 - DNA, 25 bp, Rattus norvegicus
ggcatgtcaggcaatctcgggtctc

SEQ ID NO: 438775 - DNA, 25 bp, Rattus norvegicus
ggcatgtcaggcaatgggacctact

SEQ ID NO: 438776 - DNA, 25 bp, Rattus norvegicus
ggcatgtcaggctatctcgggtctc

SEQ ID NO: 438777 - DNA, 25 bp, Rattus norvegicus
ggcatgtcaggctatgggacctact

SEQ ID NO: 438778 - DNA, 25 bp, Rattus norvegicus
ggcatgtcagttaattacatctgca

SEQ ID NO: 438779 - DNA, 25 bp, Rattus norvegicus
ggcatgtcagtttattacatctgca

SEQ ID NO: 438780 - DNA, 25 bp, Rattus norvegicus
ggcatgtctgctcgttgtctataaa

SEQ ID NO: 438781 - DNA, 25 bp, Rattus norvegicus
ggcatgtctgctggttgtctataaa

SEQ ID NO: 438782 - DNA, 25 bp, Rattus norvegicus
ggcatgtctggcagggctcgctatc

SEQ ID NO: 438783 - DNA, 25 bp, Rattus norvegicus
ggcatgtctggctgggctcgctatc

SEQ ID NO: 438784 - DNA, 25 bp, Rattus norvegicus
ggcatgtctgtgaccctagagaatt

SEQ ID NO: 438785 - DNA, 25 bp, Rattus norvegicus
ggcatgtctgtgtccctagagaatt

SEQ ID NO: 438786 - DNA, 25 bp, Rattus norvegicus
ggcatgtcttcacgcctgtcagagg

SEQ ID NO: 438787 - DNA, 25 bp, Rattus norvegicus
ggcatgtcttcaggcctgtcagagg

SEQ ID NO: 438788 - DNA, 25 bp, Rattus norvegicus
ggcatgtgacatatccctggtggga

SEQ ID NO: 438789 - DNA, 25 bp, Rattus norvegicus
ggcatgtgacatttccctggtggga

SEQ ID NO: 438790 - DNA, 25 bp, Rattus norvegicus
ggcatgtgaggcaccagcagctcac

SEQ ID NO: 438791 - DNA, 25 bp, Rattus norvegicus
ggcatgtgaggctccagcagctcac

SEQ ID NO: 438792 - DNA, 25 bp, Rattus norvegicus
ggcatgtgcagcagccttcaaggca

SEQ ID NO: 438793 - DNA, 25 bp, Rattus norvegicus
ggcatgtgcagctgccttcaaggca

SEQ ID NO: 438794 - DNA, 25 bp, Rattus norvegicus
ggcatgtgccacattctatggaagt

SEQ ID NO: 438795 - DNA, 25 bp, Rattus norvegicus
ggcatgtgccactttctatggaagt

SEQ ID NO: 438796 - DNA, 25 bp, Rattus norvegicus
ggcatgtgcctaacatctatgtggg

SEQ ID NO: 438797 - DNA, 25 bp, Rattus norvegicus
ggcatgtgcctacccatacaaacag

SEQ ID NO: 438798 - DNA, 25 bp, Rattus norvegicus
ggcatgtgcctagccatacaaacag

SEQ ID NO: 438799 - DNA, 25 bp, Rattus norvegicus
ggcatgtgcctatcatctatgtggg

SEQ ID NO: 438800 - DNA, 25 bp, Rattus norvegicus
ggcatgtggtagaccctttgagcag

SEQ ID NO: 438801 - DNA, 25 bp, Rattus norvegicus
ggcatgtggtagtccctttgagcag

SEQ ID NO: 438802 - DNA, 25 bp, Rattus norvegicus
ggcatgtgtcagatttgtggcttta

SEQ ID NO: 438803 - DNA, 25 bp, Rattus norvegicus
ggcatgtgtcagttttgtggcttta

SEQ ID NO: 438804 - DNA, 25 bp, Rattus norvegicus
ggcatgtgtctgacagtgtgataca

SEQ ID NO: 438805 - DNA, 25 bp, Rattus norvegicus
ggcatgtgtctgtcagtgtgataca

SEQ ID NO: 438806 - DNA, 25 bp, Rattus norvegicus
ggcatgtgtgaacgcgatcttgaat

SEQ ID NO: 438807 - DNA, 25 bp, Rattus norvegicus
ggcatgtgtgaaggcgatcttgaat

SEQ ID NO: 438808 - DNA, 25 bp, Rattus norvegicus
ggcatgtgtttacttaaatcggagt

SEQ ID NO: 438809 - DNA, 25 bp, Rattus norvegicus
ggcatgtgtttagttaaatcggagt

SEQ ID NO: 438810 - DNA, 25 bp, Rattus norvegicus
ggcatgttacaaagcctgcactaaa

SEQ ID NO: 438811 - DNA, 25 bp, Rattus norvegicus
ggcatgttacaatgcctgcactaaa

SEQ ID NO: 438812 - DNA, 25 bp, Rattus norvegicus
ggcatgttagctaaactcgtctgaa

SEQ ID NO: 438813 - DNA, 25 bp, Rattus norvegicus
ggcatgttagcttaactcgtctgaa

SEQ ID NO: 438814 - DNA, 25 bp, Rattus norvegicus
ggcatgttcaggcaagctccgaagt

SEQ ID NO: 438815 - DNA, 25 bp, Rattus norvegicus
ggcatgttcagggaagctccgaagt

SEQ ID NO: 438816 - DNA, 25 bp, Rattus norvegicus
ggcatgttgggcaggttctacttcc

SEQ ID NO: 438817 - DNA, 25 bp, Rattus norvegicus
ggcatgttgggctggttctacttcc

SEQ ID NO: 438818 - DNA, 25 bp, Rattus norvegicus
ggcatgtttccaacatttggttcta

SEQ ID NO: 438819 - DNA, 25 bp, Rattus norvegicus
ggcatgtttccatcatttggttcta

SEQ ID NO: 438820 - DNA, 25 bp, Rattus norvegicus
ggcatgtttcccattttatcacaga

SEQ ID NO: 438821 - DNA, 25 bp, Rattus norvegicus
ggcatgtttccccaagccatgaaga

SEQ ID NO: 438822 - DNA, 25 bp, Rattus norvegicus
ggcatgtttccccaggagttcatta

SEQ ID NO: 438823 - DNA, 25 bp, Rattus norvegicus
ggcatgtttcccgaagccatgaaga

SEQ ID NO: 438824 - DNA, 25 bp, Rattus norvegicus
ggcatgtttcccgaggagttcatta

SEQ ID NO: 438825 - DNA, 25 bp, Rattus norvegicus
ggcatgtttccctttttatcacaga

SEQ ID NO: 438826 - DNA, 25 bp, Rattus norvegicus
ggcatgttttacacaactttccctc

SEQ ID NO: 438827 - DNA, 25 bp, Rattus norvegicus
ggcatgttttactcaactttccctc

SEQ ID NO: 438828 - DNA, 25 bp, Rattus norvegicus
ggcattaatattcctcatgtagatt

SEQ ID NO: 438829 - DNA, 25 bp, Rattus norvegicus
ggcattaatattgctcatgtagatt

SEQ ID NO: 438830 - DNA, 25 bp, Rattus norvegicus
ggcattacaaacactaggttctcat

SEQ ID NO: 438831 - DNA, 25 bp, Rattus norvegicus
ggcattacaaactctaggttctcat

SEQ ID NO: 438832 - DNA, 25 bp, Rattus norvegicus
ggcattaccgtcattattgcgtact

SEQ ID NO: 438833 - DNA, 25 bp, Rattus norvegicus
ggcattaccgtctttattgcgtact

SEQ ID NO: 438834 - DNA, 25 bp, Rattus norvegicus
ggcattacctttcgccaagcatgga

SEQ ID NO: 438835 - DNA, 25 bp, Rattus norvegicus
ggcattacctttggccaagcatgga

SEQ ID NO: 438836 - DNA, 25 bp, Rattus norvegicus
ggcattacttttcctttgctgttga

SEQ ID NO: 438837 - DNA, 25 bp, Rattus norvegicus
ggcattacttttgctttgctgttga

SEQ ID NO: 438838 - DNA, 25 bp, Rattus norvegicus
ggcattagacaacgccgtcctgtgg

SEQ ID NO: 438839 - DNA, 25 bp, Rattus norvegicus
ggcattagacaaggccgtcctgtgg

SEQ ID NO: 438840 - DNA, 25 bp, Rattus norvegicus
ggcattagatccctacagttggagt

SEQ ID NO: 438841 - DNA, 25 bp, Rattus norvegicus
ggcattagatccgtacagttggagt

SEQ ID NO: 438842 - DNA, 25 bp, Rattus norvegicus
ggcattagcctacatcgacacttta

SEQ ID NO: 438843 - DNA, 25 bp, Rattus norvegicus
ggcattagcctagatcgacacttta

SEQ ID NO: 438844 - DNA, 25 bp, Rattus norvegicus
ggcattaggcgaccacagtacacat

SEQ ID NO: 438845 - DNA, 25 bp, Rattus norvegicus
ggcattaggcgagcacagtacacat

SEQ ID NO: 438846 - DNA, 25 bp, Rattus norvegicus
ggcattagtcacattatatctggtt

SEQ ID NO: 438847 - DNA, 25 bp, Rattus norvegicus
ggcattagtcactttatatctggtt

SEQ ID NO: 438848 - DNA, 25 bp, Rattus norvegicus
ggcattagtgatatcccttaccttc

SEQ ID NO: 438849 - DNA, 25 bp, Rattus norvegicus
ggcattagtgatttcccttaccttc

SEQ ID NO: 438850 - DNA, 25 bp, Rattus norvegicus
ggcattataccaagtgtatgcataa

SEQ ID NO: 438851 - DNA, 25 bp, Rattus norvegicus
ggcattataccatgtgtatgcataa

SEQ ID NO: 438852 - DNA, 25 bp, Rattus norvegicus
ggcattataggtatgttgtgttaga

SEQ ID NO: 438853 - DNA, 25 bp, Rattus norvegicus
ggcattataggtttgttgtgttaga

SEQ ID NO: 438854 - DNA, 25 bp, Rattus norvegicus
ggcattatgaacacacctctttttg

SEQ ID NO: 438855 - DNA, 25 bp, Rattus norvegicus
ggcattatgaactcacctctttttg

SEQ ID NO: 438856 - DNA, 25 bp, Rattus norvegicus
ggcattatgaccctgtctcctaaag

SEQ ID NO: 438857 - DNA, 25 bp, Rattus norvegicus
ggcattatgaccgtgtctcctaaag

SEQ ID NO: 438858 - DNA, 25 bp, Rattus norvegicus
ggcattatggccacaggttcatcta

SEQ ID NO: 438859 - DNA, 25 bp, Rattus norvegicus
ggcattatggcctcaggttcatcta

SEQ ID NO: 438860 - DNA, 25 bp, Rattus norvegicus
ggcattattagaatcctcagcgaaa

SEQ ID NO: 438861 - DNA, 25 bp, Rattus norvegicus
ggcattattagattcctcagcgaaa

SEQ ID NO: 438862 - DNA, 25 bp, Rattus norvegicus
ggcattattctaacatcacacgtaa

SEQ ID NO: 438863 - DNA, 25 bp, Rattus norvegicus
ggcattattctatcatcacacgtaa

SEQ ID NO: 438864 - DNA, 25 bp, Rattus norvegicus
ggcattattttcatcgtggcaggtc

SEQ ID NO: 438865 - DNA, 25 bp, Rattus norvegicus
ggcattattttcttcgtggcaggtc

SEQ ID NO: 438866 - DNA, 25 bp, Rattus norvegicus
ggcattcaatatacagtgctcaggt

SEQ ID NO: 438867 - DNA, 25 bp, Rattus norvegicus
ggcattcaatattcagtgctcaggt

SEQ ID NO: 438868 - DNA, 25 bp, Rattus norvegicus
ggcattcaatgcatctcttcaagac

SEQ ID NO: 438869 - DNA, 25 bp, Rattus norvegicus
ggcattcaatgcttctcttcaagac

SEQ ID NO: 438870 - DNA, 25 bp, Rattus norvegicus
ggcattcacattacgttcctaggtg

SEQ ID NO: 438871 - DNA, 25 bp, Rattus norvegicus
ggcattcacatttcgttcctaggtg

SEQ ID NO: 438872 - DNA, 25 bp, Rattus norvegicus
ggcattcagaatcgccttcgagaaa

SEQ ID NO: 438873 - DNA, 25 bp, Rattus norvegicus
ggcattcagaatggccttcgagaaa

SEQ ID NO: 438874 - DNA, 25 bp, Rattus norvegicus
ggcattcagactaatacaccttcat

SEQ ID NO: 438875 - DNA, 25 bp, Rattus norvegicus
ggcattcagacttatacaccttcat

SEQ ID NO: 438876 - DNA, 25 bp, Rattus norvegicus
ggcattcagagcacaacttcttgct

SEQ ID NO: 438877 - DNA, 25 bp, Rattus norvegicus
ggcattcagagctcaacttcttgct

SEQ ID NO: 438878 - DNA, 25 bp, Rattus norvegicus
ggcattcagatgatcttcctttact

SEQ ID NO: 438879 - DNA, 25 bp, Rattus norvegicus
ggcattcagatgttcttcctttact

SEQ ID NO: 438880 - DNA, 25 bp, Rattus norvegicus
ggcattcatataagtatccattctg

SEQ ID NO: 438881 - DNA, 25 bp, Rattus norvegicus
ggcattcatatatgtatccattctg

SEQ ID NO: 438882 - DNA, 25 bp, Rattus norvegicus
ggcattcatcccctgtcaaggaaat

SEQ ID NO: 438883 - DNA, 25 bp, Rattus norvegicus
ggcattcatcccgtgtcaaggaaat

SEQ ID NO: 438884 - DNA, 25 bp, Rattus norvegicus
ggcattcatcctcggcactggatac

SEQ ID NO: 438885 - DNA, 25 bp, Rattus norvegicus
ggcattcatcctgggcactggatac

SEQ ID NO: 438886 - DNA, 25 bp, Rattus norvegicus
ggcattcatcttatttcctaatcct

SEQ ID NO: 438887 - DNA, 25 bp, Rattus norvegicus
ggcattcatcttttttcctaatcct

SEQ ID NO: 438888 - DNA, 25 bp, Rattus norvegicus
ggcattccaagcactgcaggaacga

SEQ ID NO: 438889 - DNA, 25 bp, Rattus norvegicus
ggcattccaagctctgcaggaacga

SEQ ID NO: 438890 - DNA, 25 bp, Rattus norvegicus
ggcattccagtgctgccatcagcag

SEQ ID NO: 438891 - DNA, 25 bp, Rattus norvegicus
ggcattccagtggtgccatcagcag

SEQ ID NO: 438892 - DNA, 25 bp, Rattus norvegicus
ggcattccatagcaccgctggtaga

SEQ ID NO: 438893 - DNA, 25 bp, Rattus norvegicus
ggcattccataggaccgctggtaga

SEQ ID NO: 438894 - DNA, 25 bp, Rattus norvegicus
ggcattccattccatttctgttgat

SEQ ID NO: 438895 - DNA, 25 bp, Rattus norvegicus
ggcattccattcctcatgtgcagcg

SEQ ID NO: 438896 - DNA, 25 bp, Rattus norvegicus
ggcattccattcgatttctgttgat

SEQ ID NO: 438897 - DNA, 25 bp, Rattus norvegicus
ggcattccattcgtcatgtgcagcg

SEQ ID NO: 438898 - DNA, 25 bp, Rattus norvegicus
ggcattcccagacggcattagccat

SEQ ID NO: 438899 - DNA, 25 bp, Rattus norvegicus
ggcattcccagagggcattagccat

SEQ ID NO: 438900 - DNA, 25 bp, Rattus norvegicus
ggcattccctgaacactactatgtg

SEQ ID NO: 438901 - DNA, 25 bp, Rattus norvegicus
ggcattccctgatcactactatgtg

SEQ ID NO: 438902 - DNA, 25 bp, Rattus norvegicus
ggcattccctttctaacttaggttg

SEQ ID NO: 438903 - DNA, 25 bp, Rattus norvegicus
ggcattccctttgtaacttaggttg

SEQ ID NO: 438904 - DNA, 25 bp, Rattus norvegicus
ggcattcctaaccatcgtctgtatg

SEQ ID NO: 438905 - DNA, 25 bp, Rattus norvegicus
ggcattcctaacgatcgtctgtatg

SEQ ID NO: 438906 - DNA, 25 bp, Rattus norvegicus
ggcattcctatacgctctcgtagga

SEQ ID NO: 438907 - DNA, 25 bp, Rattus norvegicus
ggcattcctataggctctcgtagga

SEQ ID NO: 438908 - DNA, 25 bp, Rattus norvegicus
ggcattcctattatgcagttcagaa

SEQ ID NO: 438909 - DNA, 25 bp, Rattus norvegicus
ggcattcctattttgcagttcagaa

SEQ ID NO: 438910 - DNA, 25 bp, Rattus norvegicus
ggcattcctctgcttggtaacttaa

SEQ ID NO: 438911 - DNA, 25 bp, Rattus norvegicus
ggcattcctctggttggtaacttaa

SEQ ID NO: 438912 - DNA, 25 bp, Rattus norvegicus
ggcattcctgtcatcatgctctagc

SEQ ID NO: 438913 - DNA, 25 bp, Rattus norvegicus
ggcattcctgtcttcatgctctagc

SEQ ID NO: 438914 - DNA, 25 bp, Rattus norvegicus
ggcattcgccaaacctgacagataa

SEQ ID NO: 438915 - DNA, 25 bp, Rattus norvegicus
ggcattcgccaatcctgacagataa

SEQ ID NO: 438916 - DNA, 25 bp, Rattus norvegicus
ggcattctacacaggcccagggctg

SEQ ID NO: 438917 - DNA, 25 bp, Rattus norvegicus
ggcattctacactggcccagggctg

SEQ ID NO: 438918 - DNA, 25 bp, Rattus norvegicus
ggcattctacagaacaaatgaacat

SEQ ID NO: 438919 - DNA, 25 bp, Rattus norvegicus
ggcattctacagtacaaatgaacat

SEQ ID NO: 438920 - DNA, 25 bp, Rattus norvegicus
ggcattctacccaaacagcttatgt

SEQ ID NO: 438921 - DNA, 25 bp, Rattus norvegicus
ggcattctaccctaacagcttatgt

SEQ ID NO: 438922 - DNA, 25 bp, Rattus norvegicus
ggcattctagaactcctggacacca

SEQ ID NO: 438923 - DNA, 25 bp, Rattus norvegicus
ggcattctagaagtcctggacacca

SEQ ID NO: 438924 - DNA, 25 bp, Rattus norvegicus
ggcattctcagaactcagggcagct

SEQ ID NO: 438925 - DNA, 25 bp, Rattus norvegicus
ggcattctcagatctcagggcagct

SEQ ID NO: 438926 - DNA, 25 bp, Rattus norvegicus
ggcattctccacctaataaacatct

SEQ ID NO: 438927 - DNA, 25 bp, Rattus norvegicus
ggcattctccacgtaataaacatct

SEQ ID NO: 438928 - DNA, 25 bp, Rattus norvegicus
ggcattctcctgaagcccagactgg

SEQ ID NO: 438929 - DNA, 25 bp, Rattus norvegicus
ggcattctcctgtagcccagactgg

SEQ ID NO: 438930 - DNA, 25 bp, Rattus norvegicus
ggcattctgaaacatcttggttaca

SEQ ID NO: 438931 - DNA, 25 bp, Rattus norvegicus
ggcattctgaaagatcttggttaca

SEQ ID NO: 438932 - DNA, 25 bp, Rattus norvegicus
ggcattctgagaaactgtagttgtt

SEQ ID NO: 438933 - DNA, 25 bp, Rattus norvegicus
ggcattctgagatactgtagttgtt

SEQ ID NO: 438934 - DNA, 25 bp, Rattus norvegicus
ggcattctgaggaaacctcttttcc

SEQ ID NO: 438935 - DNA, 25 bp, Rattus norvegicus
ggcattctgaggacctgtgatcaca

SEQ ID NO: 438936 - DNA, 25 bp, Rattus norvegicus
ggcattctgaggtaacctcttttcc

SEQ ID NO: 438937 - DNA, 25 bp, Rattus norvegicus
ggcattctgaggtcctgtgatcaca

SEQ ID NO: 438938 - DNA, 25 bp, Rattus norvegicus
ggcattctgcaaatgtcactgctac

SEQ ID NO: 438939 - DNA, 25 bp, Rattus norvegicus
ggcattctgcaattgtcactgctac

SEQ ID NO: 438940 - DNA, 25 bp, Rattus norvegicus
ggcattctgcacatttcactagggt

SEQ ID NO: 438941 - DNA, 25 bp, Rattus norvegicus
ggcattctgcacttttcactagggt

SEQ ID NO: 438942 - DNA, 25 bp, Rattus norvegicus
ggcattctggacaagttctgttctc

SEQ ID NO: 438943 - DNA, 25 bp, Rattus norvegicus
ggcattctggactagttctgttctc

SEQ ID NO: 438944 - DNA, 25 bp, Rattus norvegicus
ggcattctgtatactgcttgttgaa

SEQ ID NO: 438945 - DNA, 25 bp, Rattus norvegicus
ggcattctgtattctgcttgttgaa

SEQ ID NO: 438946 - DNA, 25 bp, Rattus norvegicus
ggcattctgtcaccaatgcagaaac

SEQ ID NO: 438947 - DNA, 25 bp, Rattus norvegicus
ggcattctgtcagcaatgcagaaac

SEQ ID NO: 438948 - DNA, 25 bp, Rattus norvegicus
ggcattctgtccagatagctagcat

SEQ ID NO: 438949 - DNA, 25 bp, Rattus norvegicus
ggcattctgtcctgatagctagcat

SEQ ID NO: 438950 - DNA, 25 bp, Rattus norvegicus
ggcattctgttcatactctttacta

SEQ ID NO: 438951 - DNA, 25 bp, Rattus norvegicus
ggcattctgttcttactctttacta

SEQ ID NO: 438952 - DNA, 25 bp, Rattus norvegicus
ggcattcttcagcattgcgacagct

SEQ ID NO: 438953 - DNA, 25 bp, Rattus norvegicus
ggcattcttcaggattgcgacagct

SEQ ID NO: 438954 - DNA, 25 bp, Rattus norvegicus
ggcattctttaaaacctggtttttg

SEQ ID NO: 438955 - DNA, 25 bp, Rattus norvegicus
ggcattctttaatacctggtttttg

SEQ ID NO: 438956 - DNA, 25 bp, Rattus norvegicus
ggcattctttcaaggagcatttacc

SEQ ID NO: 438957 - DNA, 25 bp, Rattus norvegicus
ggcattctttcatggagcatttacc

SEQ ID NO: 438958 - DNA, 25 bp, Rattus norvegicus
ggcattgaactgcttctctttctga

SEQ ID NO: 438959 - DNA, 25 bp, Rattus norvegicus
ggcattgaactggttctctttctga

SEQ ID NO: 438960 - DNA, 25 bp, Rattus norvegicus
ggcattgaatctatgtacccgacag

SEQ ID NO: 438961 - DNA, 25 bp, Rattus norvegicus
ggcattgaatctttgtacccgacag

SEQ ID NO: 438962 - DNA, 25 bp, Rattus norvegicus
ggcattgacatcactgtttgtccct

SEQ ID NO: 438963 - DNA, 25 bp, Rattus norvegicus
ggcattgacatctctgtttgtccct

SEQ ID NO: 438964 - DNA, 25 bp, Rattus norvegicus
ggcattgacctacccaagatcctga

SEQ ID NO: 438965 - DNA, 25 bp, Rattus norvegicus
ggcattgacctagccaagatcctga

SEQ ID NO: 438966 - DNA, 25 bp, Rattus norvegicus
ggcattgaccttagcgaaaccaaga

SEQ ID NO: 438967 - DNA, 25 bp, Rattus norvegicus
ggcattgacctttgcgaaaccaaga

SEQ ID NO: 438968 - DNA, 25 bp, Rattus norvegicus
ggcattgatgtgcagcaggtctccc

SEQ ID NO: 438969 - DNA, 25 bp, Rattus norvegicus
ggcattgatgtggagcaggtctccc

SEQ ID NO: 438970 - DNA, 25 bp, Rattus norvegicus
ggcattgcaagtacctcatcaggaa

SEQ ID NO: 438971 - DNA, 25 bp, Rattus norvegicus
ggcattgcaagttcctcatcaggaa

SEQ ID NO: 438972 - DNA, 25 bp, Rattus norvegicus
ggcattgcacttcgagtcttgtaca

SEQ ID NO: 438973 - DNA, 25 bp, Rattus norvegicus
ggcattgcacttggagtcttgtaca

SEQ ID NO: 438974 - DNA, 25 bp, Rattus norvegicus
ggcattgccaccagtgtaagagcac

SEQ ID NO: 438975 - DNA, 25 bp, Rattus norvegicus
ggcattgccacctgtgtaagagcac

SEQ ID NO: 438976 - DNA, 25 bp, Rattus norvegicus
ggcattgccagtatgatgtccactc

SEQ ID NO: 438977 - DNA, 25 bp, Rattus norvegicus
ggcattgccagtttgatgtccactc

SEQ ID NO: 438978 - DNA, 25 bp, Rattus norvegicus
ggcattgccatgaagcgaggcagct

SEQ ID NO: 438979 - DNA, 25 bp, Rattus norvegicus
ggcattgccatgtagcgaggcagct

SEQ ID NO: 438980 - DNA, 25 bp, Rattus norvegicus
ggcattgccctgaacaggtgacact

SEQ ID NO: 438981 - DNA, 25 bp, Rattus norvegicus
ggcattgccctgtacaggtgacact

SEQ ID NO: 438982 - DNA, 25 bp, Rattus norvegicus
ggcattgcctcaagtgttggtttat

SEQ ID NO: 438983 - DNA, 25 bp, Rattus norvegicus
ggcattgcctcatgtgttggtttat

SEQ ID NO: 438984 - DNA, 25 bp, Rattus norvegicus
ggcattgcctgacttggctgtgttc

SEQ ID NO: 438985 - DNA, 25 bp, Rattus norvegicus
ggcattgcctgagttggctgtgttc

SEQ ID NO: 438986 - DNA, 25 bp, Rattus norvegicus
ggcattgcctgtacagtgctgaaaa

SEQ ID NO: 438987 - DNA, 25 bp, Rattus norvegicus
ggcattgcctgtatgtggcctctgt

SEQ ID NO: 438988 - DNA, 25 bp, Rattus norvegicus
ggcattgcctgttcagtgctgaaaa

SEQ ID NO: 438989 - DNA, 25 bp, Rattus norvegicus
ggcattgcctgtttgtggcctctgt

SEQ ID NO: 438990 - DNA, 25 bp, Rattus norvegicus
ggcattgcggtcatggtagttccaa

SEQ ID NO: 438991 - DNA, 25 bp, Rattus norvegicus
ggcattgcggtcttggtagttccaa

SEQ ID NO: 438992 - DNA, 25 bp, Rattus norvegicus
ggcattgctatactcagtcatcttg

SEQ ID NO: 438993 - DNA, 25 bp, Rattus norvegicus
ggcattgctatagtcagtcatcttg

SEQ ID NO: 438994 - DNA, 25 bp, Rattus norvegicus
ggcattgctgacaacaaacccaaga

SEQ ID NO: 438995 - DNA, 25 bp, Rattus norvegicus
ggcattgctgactacaaacccaaga

SEQ ID NO: 438996 - DNA, 25 bp, Rattus norvegicus
ggcattgctggaatgtcacttctgg

SEQ ID NO: 438997 - DNA, 25 bp, Rattus norvegicus
ggcattgctggattgtcacttctgg

SEQ ID NO: 438998 - DNA, 25 bp, Rattus norvegicus
ggcattgctttgatggtcctatact

SEQ ID NO: 438999 - DNA, 25 bp, Rattus norvegicus
ggcattgctttgttggtcctatact

SEQ ID NO: 439000 - DNA, 25 bp, Rattus norvegicus
ggcattggacaacttttcctgaaga

SEQ ID NO: 439001 - DNA, 25 bp, Rattus norvegicus
ggcattggacaagttttcctgaaga

SEQ ID NO: 439002 - DNA, 25 bp, Rattus norvegicus
ggcattggatctactgctgagccag

SEQ ID NO: 439003 - DNA, 25 bp, Rattus norvegicus
ggcattggatcttctgctgagccag

SEQ ID NO: 439004 - DNA, 25 bp, Rattus norvegicus
ggcattggcctgaggagaacacctt

SEQ ID NO: 439005 - DNA, 25 bp, Rattus norvegicus
ggcattggcctgtggagaacacctt

SEQ ID NO: 439006 - DNA, 25 bp, Rattus norvegicus
ggcattggccttatccaaaatggaa

SEQ ID NO: 439007 - DNA, 25 bp, Rattus norvegicus
ggcattggccttttccaaaatggaa

SEQ ID NO: 439008 - DNA, 25 bp, Rattus norvegicus
ggcattgggcacactgtatggcaac

SEQ ID NO: 439009 - DNA, 25 bp, Rattus norvegicus
ggcattgggcactctgtatggcaac

SEQ ID NO: 439010 - DNA, 25 bp, Rattus norvegicus
ggcattggtactacctagactgggt

SEQ ID NO: 439011 - DNA, 25 bp, Rattus norvegicus
ggcattggtacttcctagactgggt

SEQ ID NO: 439012 - DNA, 25 bp, Rattus norvegicus
ggcattggtcccagtctctgaggta

SEQ ID NO: 439013 - DNA, 25 bp, Rattus norvegicus
ggcattggtccctgtctctgaggta

SEQ ID NO: 439014 - DNA, 25 bp, Rattus norvegicus
ggcattggtttcaaccgttgcataa

SEQ ID NO: 439015 - DNA, 25 bp, Rattus norvegicus
ggcattggtttctaccgttgcataa

SEQ ID NO: 439016 - DNA, 25 bp, Rattus norvegicus
ggcattgtacttatgtttcctcgaa

SEQ ID NO: 439017 - DNA, 25 bp, Rattus norvegicus
ggcattgtacttttgtttcctcgaa

SEQ ID NO: 439018 - DNA, 25 bp, Rattus norvegicus
ggcattgtcattagttggcacttct

SEQ ID NO: 439019 - DNA, 25 bp, Rattus norvegicus
ggcattgtcatttgttggcacttct

SEQ ID NO: 439020 - DNA, 25 bp, Rattus norvegicus
ggcattgtccggcagctcaaaagtg

SEQ ID NO: 439021 - DNA, 25 bp, Rattus norvegicus
ggcattgtccgggagctcaaaagtg

SEQ ID NO: 439022 - DNA, 25 bp, Rattus norvegicus
ggcattgtcgctccagccaactttg

SEQ ID NO: 439023 - DNA, 25 bp, Rattus norvegicus
ggcattgtcgctgcagccaactttg

SEQ ID NO: 439024 - DNA, 25 bp, Rattus norvegicus
ggcattgtctccaaacttactgtgt

SEQ ID NO: 439025 - DNA, 25 bp, Rattus norvegicus
ggcattgtctcctaacttactgtgt

SEQ ID NO: 439026 - DNA, 25 bp, Rattus norvegicus
ggcattgtcttgatttatgtttcct

SEQ ID NO: 439027 - DNA, 25 bp, Rattus norvegicus
ggcattgtcttgttttatgtttcct

SEQ ID NO: 439028 - DNA, 25 bp, Rattus norvegicus
ggcattgtggacaatttggcattat

SEQ ID NO: 439029 - DNA, 25 bp, Rattus norvegicus
ggcattgtggactatttggcattat

SEQ ID NO: 439030 - DNA, 25 bp, Rattus norvegicus
ggcattgtggttatttcttactcag

SEQ ID NO: 439031 - DNA, 25 bp, Rattus norvegicus
ggcattgtggttttttcttactcag

SEQ ID NO: 439032 - DNA, 25 bp, Rattus norvegicus
ggcattgtgtccatgttaggtgcat

SEQ ID NO: 439033 - DNA, 25 bp, Rattus norvegicus
ggcattgtgtccttgttaggtgcat

SEQ ID NO: 439034 - DNA, 25 bp, Rattus norvegicus
ggcattgtgttgaataaagcccaag

SEQ ID NO: 439035 - DNA, 25 bp, Rattus norvegicus
ggcattgtgttgtataaagcccaag

SEQ ID NO: 439036 - DNA, 25 bp, Rattus norvegicus
ggcattgttattcatctattaggaa

SEQ ID NO: 439037 - DNA, 25 bp, Rattus norvegicus
ggcattgttattgatctattaggaa

SEQ ID NO: 439038 - DNA, 25 bp, Rattus norvegicus
ggcattgttttcagatacccattca

SEQ ID NO: 439039 - DNA, 25 bp, Rattus norvegicus
ggcattgttttctgatacccattca

SEQ ID NO: 439040 - DNA, 25 bp, Rattus norvegicus
ggcatttaaaacagaatcctcccaa

SEQ ID NO: 439041 - DNA, 25 bp, Rattus norvegicus
ggcatttaaaactgaatcctcccaa

SEQ ID NO: 439042 - DNA, 25 bp, Rattus norvegicus
ggcatttaagagatggtcccggctg

SEQ ID NO: 439043 - DNA, 25 bp, Rattus norvegicus
ggcatttaagagttggtcccggctg

SEQ ID NO: 439044 - DNA, 25 bp, Rattus norvegicus
ggcatttaattgatataccagtctg

SEQ ID NO: 439045 - DNA, 25 bp, Rattus norvegicus
ggcatttaattgttataccagtctg

SEQ ID NO: 439046 - DNA, 25 bp, Rattus norvegicus
ggcatttacaccaatatttactcat

SEQ ID NO: 439047 - DNA, 25 bp, Rattus norvegicus
ggcatttacacctatatttactcat

SEQ ID NO: 439048 - DNA, 25 bp, Rattus norvegicus
ggcatttacagtacatttcctttct

SEQ ID NO: 439049 - DNA, 25 bp, Rattus norvegicus
ggcatttacagttcatttcctttct

SEQ ID NO: 439050 - DNA, 25 bp, Rattus norvegicus
ggcatttacatgagcatactcatac

SEQ ID NO: 439051 - DNA, 25 bp, Rattus norvegicus
ggcatttacatgtgcatactcatac

SEQ ID NO: 439052 - DNA, 25 bp, Rattus norvegicus
ggcatttcaagaagcacttgccctg

SEQ ID NO: 439053 - DNA, 25 bp, Rattus norvegicus
ggcatttcaagatgcacttgccctg

SEQ ID NO: 439054 - DNA, 25 bp, Rattus norvegicus
ggcatttcaccaagaagcaatcaga

SEQ ID NO: 439055 - DNA, 25 bp, Rattus norvegicus
ggcatttcaccatgaagcaatcaga

SEQ ID NO: 439056 - DNA, 25 bp, Rattus norvegicus
ggcatttcacctatggcatagtaat

SEQ ID NO: 439057 - DNA, 25 bp, Rattus norvegicus
ggcatttcacctttggcatagtaat

SEQ ID NO: 439058 - DNA, 25 bp, Rattus norvegicus
ggcatttcagaaatcacttatcagc

SEQ ID NO: 439059 - DNA, 25 bp, Rattus norvegicus
ggcatttcagaacacttggcccaat

SEQ ID NO: 439060 - DNA, 25 bp, Rattus norvegicus
ggcatttcagaagacttggcccaat

SEQ ID NO: 439061 - DNA, 25 bp, Rattus norvegicus
ggcatttcagaattcacttatcagc

SEQ ID NO: 439062 - DNA, 25 bp, Rattus norvegicus
ggcatttcagcgacaagtgcactta

SEQ ID NO: 439063 - DNA, 25 bp, Rattus norvegicus
ggcatttcagcgtcaagtgcactta

SEQ ID NO: 439064 - DNA, 25 bp, Rattus norvegicus
ggcatttcaggaattaaagcggcaa

SEQ ID NO: 439065 - DNA, 25 bp, Rattus norvegicus
ggcatttcaggatttaaagcggcaa

SEQ ID NO: 439066 - DNA, 25 bp, Rattus norvegicus
ggcatttcatcccatttctgtgaac

SEQ ID NO: 439067 - DNA, 25 bp, Rattus norvegicus
ggcatttcatccgatttctgtgaac

SEQ ID NO: 439068 - DNA, 25 bp, Rattus norvegicus
ggcatttccaacctgcacagtatat

SEQ ID NO: 439069 - DNA, 25 bp, Rattus norvegicus
ggcatttccaacgtgcacagtatat

SEQ ID NO: 439070 - DNA, 25 bp, Rattus norvegicus
ggcatttcccaacttttcaatttca

SEQ ID NO: 439071 - DNA, 25 bp, Rattus norvegicus
ggcatttcccaagttttcaatttca

SEQ ID NO: 439072 - DNA, 25 bp, Rattus norvegicus
ggcatttccgccaagcagaattaaa

SEQ ID NO: 439073 - DNA, 25 bp, Rattus norvegicus
ggcatttccgccatgaaggacgctt

SEQ ID NO: 439074 - DNA, 25 bp, Rattus norvegicus
ggcatttccgcctagcagaattaaa

SEQ ID NO: 439075 - DNA, 25 bp, Rattus norvegicus
ggcatttccgccttgaaggacgctt

SEQ ID NO: 439076 - DNA, 25 bp, Rattus norvegicus
ggcatttccttcaggctgggcggaa

SEQ ID NO: 439077 - DNA, 25 bp, Rattus norvegicus
ggcatttccttctggctgggcggaa

SEQ ID NO: 439078 - DNA, 25 bp, Rattus norvegicus
ggcatttcggttctaatcctggttt

SEQ ID NO: 439079 - DNA, 25 bp, Rattus norvegicus
ggcatttcggttgtaatcctggttt

SEQ ID NO: 439080 - DNA, 25 bp, Rattus norvegicus
ggcatttctaagattcagtgctagt

SEQ ID NO: 439081 - DNA, 25 bp, Rattus norvegicus
ggcatttctaagtttcagtgctagt

SEQ ID NO: 439082 - DNA, 25 bp, Rattus norvegicus
ggcatttctacacctgtgcttgaac

SEQ ID NO: 439083 - DNA, 25 bp, Rattus norvegicus
ggcatttctacagctgtgcttgaac

SEQ ID NO: 439084 - DNA, 25 bp, Rattus norvegicus
ggcatttctcctcctatataaacaa

SEQ ID NO: 439085 - DNA, 25 bp, Rattus norvegicus
ggcatttctcctgctatataaacaa

SEQ ID NO: 439086 - DNA, 25 bp, Rattus norvegicus
ggcatttctctaatgttttcagtgg

SEQ ID NO: 439087 - DNA, 25 bp, Rattus norvegicus
ggcatttctctattgttttcagtgg

SEQ ID NO: 439088 - DNA, 25 bp, Rattus norvegicus
ggcatttctctgacaggctcactgt

SEQ ID NO: 439089 - DNA, 25 bp, Rattus norvegicus
ggcatttctctgtcaggctcactgt

SEQ ID NO: 439090 - DNA, 25 bp, Rattus norvegicus
ggcatttctgccctagatggcgaat

SEQ ID NO: 439091 - DNA, 25 bp, Rattus norvegicus
ggcatttctgccctgttactaccag

SEQ ID NO: 439092 - DNA, 25 bp, Rattus norvegicus
ggcatttctgccgtagatggcgaat

SEQ ID NO: 439093 - DNA, 25 bp, Rattus norvegicus
ggcatttctgccgtgttactaccag

SEQ ID NO: 439094 - DNA, 25 bp, Rattus norvegicus
ggcatttctggtagaagcaccccaa

SEQ ID NO: 439095 - DNA, 25 bp, Rattus norvegicus
ggcatttctggttgaagcaccccaa

SEQ ID NO: 439096 - DNA, 25 bp, Rattus norvegicus
ggcatttcttcactttgtgctatga

SEQ ID NO: 439097 - DNA, 25 bp, Rattus norvegicus
ggcatttcttcagtttgtgctatga

SEQ ID NO: 439098 - DNA, 25 bp, Rattus norvegicus
ggcatttcttgtcttacgtctgtaa

SEQ ID NO: 439099 - DNA, 25 bp, Rattus norvegicus
ggcatttcttgtgttacgtctgtaa

SEQ ID NO: 439100 - DNA, 25 bp, Rattus norvegicus
ggcatttcttttcctcatcataaac

SEQ ID NO: 439101 - DNA, 25 bp, Rattus norvegicus
ggcatttcttttgctcatcataaac

SEQ ID NO: 439102 - DNA, 25 bp, Rattus norvegicus
ggcatttgcaccctgatccgtgcgc

SEQ ID NO: 439103 - DNA, 25 bp, Rattus norvegicus
ggcatttgcaccgtgatccgtgcgc

SEQ ID NO: 439104 - DNA, 25 bp, Rattus norvegicus
ggcatttgcacgcacagctcatgtc

SEQ ID NO: 439105 - DNA, 25 bp, Rattus norvegicus
ggcatttgcacggacagctcatgtc

SEQ ID NO: 439106 - DNA, 25 bp, Rattus norvegicus
ggcatttgccagattatccagctgt

SEQ ID NO: 439107 - DNA, 25 bp, Rattus norvegicus
ggcatttgccagcttacttgagtaa

SEQ ID NO: 439108 - DNA, 25 bp, Rattus norvegicus
ggcatttgccaggttacttgagtaa

SEQ ID NO: 439109 - DNA, 25 bp, Rattus norvegicus
ggcatttgccagtttatccagctgt

SEQ ID NO: 439110 - DNA, 25 bp, Rattus norvegicus
ggcatttgctggcaatggccttcaa

SEQ ID NO: 439111 - DNA, 25 bp, Rattus norvegicus
ggcatttgctgggaatggccttcaa

SEQ ID NO: 439112 - DNA, 25 bp, Rattus norvegicus
ggcatttgtaccacagtttggaaga

SEQ ID NO: 439113 - DNA, 25 bp, Rattus norvegicus
ggcatttgtacctcagtttggaaga

SEQ ID NO: 439114 - DNA, 25 bp, Rattus norvegicus
ggcatttgtagcagtcacaggcctt

SEQ ID NO: 439115 - DNA, 25 bp, Rattus norvegicus
ggcatttgtagctgtcacaggcctt

SEQ ID NO: 439116 - DNA, 25 bp, Rattus norvegicus
ggcattttaaacagtttcccagcta

SEQ ID NO: 439117 - DNA, 25 bp, Rattus norvegicus
ggcattttaaactgtttcccagcta

SEQ ID NO: 439118 - DNA, 25 bp, Rattus norvegicus
ggcattttaggaattcatcttcacc

SEQ ID NO: 439119 - DNA, 25 bp, Rattus norvegicus
ggcattttaggatttcatcttcacc

SEQ ID NO: 439120 - DNA, 25 bp, Rattus norvegicus
ggcattttccataaatttcattttt

SEQ ID NO: 439121 - DNA, 25 bp, Rattus norvegicus
ggcattttccattaatttcattttt

SEQ ID NO: 439122 - DNA, 25 bp, Rattus norvegicus
ggcattttccttcagtctacagcag

SEQ ID NO: 439123 - DNA, 25 bp, Rattus norvegicus
ggcattttccttgagtctacagcag

SEQ ID NO: 439124 - DNA, 25 bp, Rattus norvegicus
ggcattttctccaatgaagtggtac

SEQ ID NO: 439125 - DNA, 25 bp, Rattus norvegicus
ggcattttctcctatgaagtggtac

SEQ ID NO: 439126 - DNA, 25 bp, Rattus norvegicus
ggcattttctcgagagttataacta

SEQ ID NO: 439127 - DNA, 25 bp, Rattus norvegicus
ggcattttctcgtgagttataacta

SEQ ID NO: 439128 - DNA, 25 bp, Rattus norvegicus
ggcattttctggcagaccccattat

SEQ ID NO: 439129 - DNA, 25 bp, Rattus norvegicus
ggcattttctgggagaccccattat

SEQ ID NO: 439130 - DNA, 25 bp, Rattus norvegicus
ggcattttcttaagtcagcaacaca

SEQ ID NO: 439131 - DNA, 25 bp, Rattus norvegicus
ggcattttcttatgtcagcaacaca

SEQ ID NO: 439132 - DNA, 25 bp, Rattus norvegicus
ggcattttgcagctatgtctttcta

SEQ ID NO: 439133 - DNA, 25 bp, Rattus norvegicus
ggcattttgcaggtatgtctttcta

SEQ ID NO: 439134 - DNA, 25 bp, Rattus norvegicus
ggcattttgcatattgcctccaaaa

SEQ ID NO: 439135 - DNA, 25 bp, Rattus norvegicus
ggcattttgcattttgcctccaaaa

SEQ ID NO: 439136 - DNA, 25 bp, Rattus norvegicus
ggcattttgcccaaatcagacttta

SEQ ID NO: 439137 - DNA, 25 bp, Rattus norvegicus
ggcattttgccctaatcagacttta

SEQ ID NO: 439138 - DNA, 25 bp, Rattus norvegicus
ggcattttgctcaattaacacctaa

SEQ ID NO: 439139 - DNA, 25 bp, Rattus norvegicus
ggcattttgctcctcttatatacat

SEQ ID NO: 439140 - DNA, 25 bp, Rattus norvegicus
ggcattttgctcgtcttatatacat

SEQ ID NO: 439141 - DNA, 25 bp, Rattus norvegicus
ggcattttgctctattaacacctaa

SEQ ID NO: 439142 - DNA, 25 bp, Rattus norvegicus
ggcattttgctgagggagaccttca

SEQ ID NO: 439143 - DNA, 25 bp, Rattus norvegicus
ggcattttgctgtgggagaccttca

SEQ ID NO: 439144 - DNA, 25 bp, Rattus norvegicus
ggcattttggtgacagtgctctctt

SEQ ID NO: 439145 - DNA, 25 bp, Rattus norvegicus
ggcattttggtgtcagtgctctctt

SEQ ID NO: 439146 - DNA, 25 bp, Rattus norvegicus
ggcattttgtaacctgctctgacta

SEQ ID NO: 439147 - DNA, 25 bp, Rattus norvegicus
ggcattttgtaagctgctctgacta

SEQ ID NO: 439148 - DNA, 25 bp, Rattus norvegicus
ggcattttgtccacttcagttggaa

SEQ ID NO: 439149 - DNA, 25 bp, Rattus norvegicus
ggcattttgtcctcttcagttggaa

SEQ ID NO: 439150 - DNA, 25 bp, Rattus norvegicus
ggcattttgttcaacttagactgta

SEQ ID NO: 439151 - DNA, 25 bp, Rattus norvegicus
ggcattttgttctacttagactgta

SEQ ID NO: 439152 - DNA, 25 bp, Rattus norvegicus
ggcatttttacacaccagctcctta

SEQ ID NO: 439153 - DNA, 25 bp, Rattus norvegicus
ggcatttttacagaccagctcctta

SEQ ID NO: 439154 - DNA, 25 bp, Rattus norvegicus
ggcatttttcccagttataccctga

SEQ ID NO: 439155 - DNA, 25 bp, Rattus norvegicus
ggcatttttccctgttataccctga

SEQ ID NO: 439156 - DNA, 25 bp, Rattus norvegicus
ggcattttttacacttgcacgggat

SEQ ID NO: 439157 - DNA, 25 bp, Rattus norvegicus
ggcattttttactcttgcacgggat

SEQ ID NO: 439158 - DNA, 25 bp, Rattus norvegicus
ggccaaaagactcttagccccattg

SEQ ID NO: 439159 - DNA, 25 bp, Rattus norvegicus
ggccaaaagactgttagccccattg

SEQ ID NO: 439160 - DNA, 25 bp, Rattus norvegicus
ggccaaaaggatcagttctcacagc

SEQ ID NO: 439161 - DNA, 25 bp, Rattus norvegicus
ggccaaaaggatgagttctcacagc

SEQ ID NO: 439162 - DNA, 25 bp, Rattus norvegicus
ggccaaaatccccaagcagctgttg

SEQ ID NO: 439163 - DNA, 25 bp, Rattus norvegicus
ggccaaaatcccgaagcagctgttg

SEQ ID NO: 439164 - DNA, 25 bp, Rattus norvegicus
ggccaaaatttcaaggtcacccttg

SEQ ID NO: 439165 - DNA, 25 bp, Rattus norvegicus
ggccaaaatttctaggtcacccttg

SEQ ID NO: 439166 - DNA, 25 bp, Rattus norvegicus
ggccaaacaagaacccattcataga

SEQ ID NO: 439167 - DNA, 25 bp, Rattus norvegicus
ggccaaacaagatcccattcataga

SEQ ID NO: 439168 - DNA, 25 bp, Rattus norvegicus
ggccaaacatatcccaacccttgta

SEQ ID NO: 439169 - DNA, 25 bp, Rattus norvegicus
ggccaaacatatgccaacccttgta

SEQ ID NO: 439170 - DNA, 25 bp, Rattus norvegicus
ggccaaaccagtcagatgtccgtgt

SEQ ID NO: 439171 - DNA, 25 bp, Rattus norvegicus
ggccaaaccagtgagatgtccgtgt

SEQ ID NO: 439172 - DNA, 25 bp, Rattus norvegicus
ggccaaacgctaaggcggctttttg

SEQ ID NO: 439173 - DNA, 25 bp, Rattus norvegicus
ggccaaacgctatggcggctttttg

SEQ ID NO: 439174 - DNA, 25 bp, Rattus norvegicus
ggccaaactcagactcctaagatgg

SEQ ID NO: 439175 - DNA, 25 bp, Rattus norvegicus
ggccaaactcagtctcctaagatgg

SEQ ID NO: 439176 - DNA, 25 bp, Rattus norvegicus
ggccaaactctgcagtcactgactg

SEQ ID NO: 439177 - DNA, 25 bp, Rattus norvegicus
ggccaaactctggagtcactgactg

SEQ ID NO: 439178 - DNA, 25 bp, Rattus norvegicus
ggccaaactgtgattccagcacaag

SEQ ID NO: 439179 - DNA, 25 bp, Rattus norvegicus
ggccaaactgtgtttccagcacaag

SEQ ID NO: 439180 - DNA, 25 bp, Rattus norvegicus
ggccaaagaatcattcaagcgcttc

SEQ ID NO: 439181 - DNA, 25 bp, Rattus norvegicus
ggccaaagaatctttcaagcgcttc

SEQ ID NO: 439182 - DNA, 25 bp, Rattus norvegicus
ggccaaagatcaaacactccagggt

SEQ ID NO: 439183 - DNA, 25 bp, Rattus norvegicus
ggccaaagatcatacactccagggt

SEQ ID NO: 439184 - DNA, 25 bp, Rattus norvegicus
ggccaaagcccgagcgttttataag

SEQ ID NO: 439185 - DNA, 25 bp, Rattus norvegicus
ggccaaagcccgtgcgttttataag

SEQ ID NO: 439186 - DNA, 25 bp, Rattus norvegicus
ggccaaagcttcattgcttcagtat

SEQ ID NO: 439187 - DNA, 25 bp, Rattus norvegicus
ggccaaagcttctttgcttcagtat

SEQ ID NO: 439188 - DNA, 25 bp, Rattus norvegicus
ggccaaaggaagaggagatcatact

SEQ ID NO: 439189 - DNA, 25 bp, Rattus norvegicus
ggccaaaggaagtggagatcatact

SEQ ID NO: 439190 - DNA, 25 bp, Rattus norvegicus
ggccaaaggccaatagagcagcaat

SEQ ID NO: 439191 - DNA, 25 bp, Rattus norvegicus
ggccaaaggccattagagcagcaat

SEQ ID NO: 439192 - DNA, 25 bp, Rattus norvegicus
ggccaaaggctgctggatccacaca

SEQ ID NO: 439193 - DNA, 25 bp, Rattus norvegicus
ggccaaaggctggtggatccacaca

SEQ ID NO: 439194 - DNA, 25 bp, Rattus norvegicus
ggccaaaggtttaacttgtatgaca

SEQ ID NO: 439195 - DNA, 25 bp, Rattus norvegicus
ggccaaaggttttacttgtatgaca

SEQ ID NO: 439196 - DNA, 25 bp, Rattus norvegicus
ggccaaagtgttacccatcagatag

SEQ ID NO: 439197 - DNA, 25 bp, Rattus norvegicus
ggccaaagtgtttcccatcagatag

SEQ ID NO: 439198 - DNA, 25 bp, Rattus norvegicus
ggccaaagttccaccagttagctag

SEQ ID NO: 439199 - DNA, 25 bp, Rattus norvegicus
ggccaaagttcctccagttagctag

SEQ ID NO: 439200 - DNA, 25 bp, Rattus norvegicus
ggccaaagttgtcgtcatcatcccc

SEQ ID NO: 439201 - DNA, 25 bp, Rattus norvegicus
ggccaaagttgtggtcatcatcccc

SEQ ID NO: 439202 - DNA, 25 bp, Rattus norvegicus
ggccaaatatccaagcctaggacaa

SEQ ID NO: 439203 - DNA, 25 bp, Rattus norvegicus
ggccaaatatcctagcctaggacaa

SEQ ID NO: 439204 - DNA, 25 bp, Rattus norvegicus
ggccaaatatggagcctggtatgta

SEQ ID NO: 439205 - DNA, 25 bp, Rattus norvegicus
ggccaaatatggtgcctggtatgta

SEQ ID NO: 439206 - DNA, 25 bp, Rattus norvegicus
ggccaaatctgacaaccattacatt

SEQ ID NO: 439207 - DNA, 25 bp, Rattus norvegicus
ggccaaatctgagaaccattacatt

SEQ ID NO: 439208 - DNA, 25 bp, Rattus norvegicus
ggccaaatctgtctttctagttata

SEQ ID NO: 439209 - DNA, 25 bp, Rattus norvegicus
ggccaaatctgtgtttctagttata

SEQ ID NO: 439210 - DNA, 25 bp, Rattus norvegicus
ggccaaatggtcatctccacagtga

SEQ ID NO: 439211 - DNA, 25 bp, Rattus norvegicus
ggccaaatggtcttctccacagtga

SEQ ID NO: 439212 - DNA, 25 bp, Rattus norvegicus
ggccaaattcaactagctcctgttc

SEQ ID NO: 439213 - DNA, 25 bp, Rattus norvegicus
ggccaaattcaagtagctcctgttc

SEQ ID NO: 439214 - DNA, 25 bp, Rattus norvegicus
ggccaaattcagatgcctggctttg

SEQ ID NO: 439215 - DNA, 25 bp, Rattus norvegicus
ggccaaattcagttgcctggctttg

SEQ ID NO: 439216 - DNA, 25 bp, Rattus norvegicus
ggccaacaaatccaggtccctaatg

SEQ ID NO: 439217 - DNA, 25 bp, Rattus norvegicus
ggccaacaaatcgaggtccctaatg

SEQ ID NO: 439218 - DNA, 25 bp, Rattus norvegicus
ggccaacacgttatctaatgcttct

SEQ ID NO: 439219 - DNA, 25 bp, Rattus norvegicus
ggccaacacgttttctaatgcttct

SEQ ID NO: 439220 - DNA, 25 bp, Rattus norvegicus
ggccaacagtatccagtgcaacacc

SEQ ID NO: 439221 - DNA, 25 bp, Rattus norvegicus
ggccaacagtatgcagtgcaacacc

SEQ ID NO: 439222 - DNA, 25 bp, Rattus norvegicus
ggccaacatgttacttcagtatctg

SEQ ID NO: 439223 - DNA, 25 bp, Rattus norvegicus
ggccaacatgtttcttcagtatctg

SEQ ID NO: 439224 - DNA, 25 bp, Rattus norvegicus
ggccaacattccattacacatttac

SEQ ID NO: 439225 - DNA, 25 bp, Rattus norvegicus
ggccaacattcctttacacatttac

SEQ ID NO: 439226 - DNA, 25 bp, Rattus norvegicus
ggccaacccagcaggtgttttttca

SEQ ID NO: 439227 - DNA, 25 bp, Rattus norvegicus
ggccaacccagctggtgttttttca

SEQ ID NO: 439228 - DNA, 25 bp, Rattus norvegicus
ggccaaccctgacgaaatccagctg

SEQ ID NO: 439229 - DNA, 25 bp, Rattus norvegicus
ggccaaccctgaggaaatccagctg

SEQ ID NO: 439230 - DNA, 25 bp, Rattus norvegicus
ggccaaccgtgaaaagatgacccag

SEQ ID NO: 439231 - DNA, 25 bp, Rattus norvegicus
ggccaaccgtgataagatgacccag

SEQ ID NO: 439232 - DNA, 25 bp, Rattus norvegicus
ggccaacctcctctatgacgtggag

SEQ ID NO: 439233 - DNA, 25 bp, Rattus norvegicus
ggccaacctcctgtatgacgtggag

SEQ ID NO: 439234 - DNA, 25 bp, Rattus norvegicus
ggccaacctgggacatatgacaaca

SEQ ID NO: 439235 - DNA, 25 bp, Rattus norvegicus
ggccaacctgggtcatatgacaaca

SEQ ID NO: 439236 - DNA, 25 bp, Rattus norvegicus
ggccaaccttggagaccttttgtag

SEQ ID NO: 439237 - DNA, 25 bp, Rattus norvegicus
ggccaaccttggtgaccttttgtag

SEQ ID NO: 439238 - DNA, 25 bp, Rattus norvegicus
ggccaacctttgactacttacagag

SEQ ID NO: 439239 - DNA, 25 bp, Rattus norvegicus
ggccaacctttgtctacttacagag

SEQ ID NO: 439240 - DNA, 25 bp, Rattus norvegicus
ggccaacgactcacagtaaggaaag

SEQ ID NO: 439241 - DNA, 25 bp, Rattus norvegicus
ggccaacgactctcagtaaggaaag

SEQ ID NO: 439242 - DNA, 25 bp, Rattus norvegicus
ggccaacgagtcctgaacacgcgac

SEQ ID NO: 439243 - DNA, 25 bp, Rattus norvegicus
ggccaacgagtcgtgaacacgcgac

SEQ ID NO: 439244 - DNA, 25 bp, Rattus norvegicus
ggccaacggagacaactaacccata

SEQ ID NO: 439245 - DNA, 25 bp, Rattus norvegicus
ggccaacggagagaactaacccata

SEQ ID NO: 439246 - DNA, 25 bp, Rattus norvegicus
ggccaactagagagcagccctctga

SEQ ID NO: 439247 - DNA, 25 bp, Rattus norvegicus
ggccaactagagtgcagccctctga

SEQ ID NO: 439248 - DNA, 25 bp, Rattus norvegicus
ggccaactccgaaggtaaactggag

SEQ ID NO: 439249 - DNA, 25 bp, Rattus norvegicus
ggccaactccgatggtaaactggag

SEQ ID NO: 439250 - DNA, 25 bp, Rattus norvegicus
ggccaactctaaccatctactctat

SEQ ID NO: 439251 - DNA, 25 bp, Rattus norvegicus
ggccaactctaagcatctactctat

SEQ ID NO: 439252 - DNA, 25 bp, Rattus norvegicus
ggccaactctcccagggcaaggcta

SEQ ID NO: 439253 - DNA, 25 bp, Rattus norvegicus
ggccaactctccgagggcaaggcta

SEQ ID NO: 439254 - DNA, 25 bp, Rattus norvegicus
ggccaactctggcaaactagctgaa

SEQ ID NO: 439255 - DNA, 25 bp, Rattus norvegicus
ggccaactctgggaaactagctgaa

SEQ ID NO: 439256 - DNA, 25 bp, Rattus norvegicus
ggccaactgcctctccacaatggga

SEQ ID NO: 439257 - DNA, 25 bp, Rattus norvegicus
ggccaactgcctgtccacaatggga

SEQ ID NO: 439258 - DNA, 25 bp, Rattus norvegicus
ggccaactgggcaaccaagctgaag

SEQ ID NO: 439259 - DNA, 25 bp, Rattus norvegicus
ggccaactgggctaccaagctgaag

SEQ ID NO: 439260 - DNA, 25 bp, Rattus norvegicus
ggccaagaaaatccgcttccgcaaa

SEQ ID NO: 439261 - DNA, 25 bp, Rattus norvegicus
ggccaagaaaatgcgcttccgcaaa

SEQ ID NO: 439262 - DNA, 25 bp, Rattus norvegicus
ggccaagaacctaactcagtcacag

SEQ ID NO: 439263 - DNA, 25 bp, Rattus norvegicus
ggccaagaaccttactcagtcacag

SEQ ID NO: 439264 - DNA, 25 bp, Rattus norvegicus
ggccaagaagacatacgtacgcgac

SEQ ID NO: 439265 - DNA, 25 bp, Rattus norvegicus
ggccaagaagacttacgtacgcgac

SEQ ID NO: 439266 - DNA, 25 bp, Rattus norvegicus
ggccaagacaagcagcatctgtccc

SEQ ID NO: 439267 - DNA, 25 bp, Rattus norvegicus
ggccaagacaaggagcatctgtccc

SEQ ID NO: 439268 - DNA, 25 bp, Rattus norvegicus
ggccaagacacactctgaatctgaa

SEQ ID NO: 439269 - DNA, 25 bp, Rattus norvegicus
ggccaagacacagtctgaatctgaa

SEQ ID NO: 439270 - DNA, 25 bp, Rattus norvegicus
ggccaagaccataaaagcattcaag

SEQ ID NO: 439271 - DNA, 25 bp, Rattus norvegicus
ggccaagaccattaaagcattcaag

SEQ ID NO: 439272 - DNA, 25 bp, Rattus norvegicus
ggccaagacttacacctagaccagc

SEQ ID NO: 439273 - DNA, 25 bp, Rattus norvegicus
ggccaagacttagacctagaccagc

SEQ ID NO: 439274 - DNA, 25 bp, Rattus norvegicus
ggccaagagcatattagccattgaa

SEQ ID NO: 439275 - DNA, 25 bp, Rattus norvegicus
ggccaagagcattttagccattgaa

SEQ ID NO: 439276 - DNA, 25 bp, Rattus norvegicus
ggccaagagctgcatttaaccctta

SEQ ID NO: 439277 - DNA, 25 bp, Rattus norvegicus
ggccaagagctggatttaaccctta

SEQ ID NO: 439278 - DNA, 25 bp, Rattus norvegicus
ggccaagatccgcaaggtcatgtat

SEQ ID NO: 439279 - DNA, 25 bp, Rattus norvegicus
ggccaagatccggaaggtcatgtat

SEQ ID NO: 439280 - DNA, 25 bp, Rattus norvegicus
ggccaagatgatctctgctgcagca

SEQ ID NO: 439281 - DNA, 25 bp, Rattus norvegicus
ggccaagatgatgtctgctgcagca

SEQ ID NO: 439282 - DNA, 25 bp, Rattus norvegicus
ggccaagattgacaacctgctgcag

SEQ ID NO: 439283 - DNA, 25 bp, Rattus norvegicus
ggccaagattgacagacacctaaat

SEQ ID NO: 439284 - DNA, 25 bp, Rattus norvegicus
ggccaagattgagaacctgctgcag

SEQ ID NO: 439285 - DNA, 25 bp, Rattus norvegicus
ggccaagattgagagacacctaaat

SEQ ID NO: 439286 - DNA, 25 bp, Rattus norvegicus
ggccaagcaattaattttccctcag

SEQ ID NO: 439287 - DNA, 25 bp, Rattus norvegicus
ggccaagcaatttattttccctcag

SEQ ID NO: 439288 - DNA, 25 bp, Rattus norvegicus
ggccaagcacctcatcaagatcaag

SEQ ID NO: 439289 - DNA, 25 bp, Rattus norvegicus
ggccaagcacctgatcaagatcaag

SEQ ID NO: 439290 - DNA, 25 bp, Rattus norvegicus
ggccaagcagagaaagccacagttg

SEQ ID NO: 439291 - DNA, 25 bp, Rattus norvegicus
ggccaagcagagtaagccacagttg

SEQ ID NO: 439292 - DNA, 25 bp, Rattus norvegicus
ggccaagcagctagaaatctcccat

SEQ ID NO: 439293 - DNA, 25 bp, Rattus norvegicus
ggccaagcagcttgaaatctcccat

SEQ ID NO: 439294 - DNA, 25 bp, Rattus norvegicus
ggccaagccaagaccatagcatttg

SEQ ID NO: 439295 - DNA, 25 bp, Rattus norvegicus
ggccaagccaagtccatagcatttg

SEQ ID NO: 439296 - DNA, 25 bp, Rattus norvegicus
ggccaagctgccaaaaccatgaaca

SEQ ID NO: 439297 - DNA, 25 bp, Rattus norvegicus
ggccaagctgcctaaaccatgaaca

SEQ ID NO: 439298 - DNA, 25 bp, Rattus norvegicus
ggccaagctgtactagagaccctgt

SEQ ID NO: 439299 - DNA, 25 bp, Rattus norvegicus
ggccaagctgtagtagagaccctgt

SEQ ID NO: 439300 - DNA, 25 bp, Rattus norvegicus
ggccaagcttacaatccatgtacta

SEQ ID NO: 439301 - DNA, 25 bp, Rattus norvegicus
ggccaagcttactatccatgtacta

SEQ ID NO: 439302 - DNA, 25 bp, Rattus norvegicus
ggccaagcttcacagttctttaaat

SEQ ID NO: 439303 - DNA, 25 bp, Rattus norvegicus
ggccaagcttcagagttctttaaat

SEQ ID NO: 439304 - DNA, 25 bp, Rattus norvegicus
ggccaaggaaagagtgcgaccccga

SEQ ID NO: 439305 - DNA, 25 bp, Rattus norvegicus
ggccaaggaaagtgtgcgaccccga

SEQ ID NO: 439306 - DNA, 25 bp, Rattus norvegicus
ggccaaggaataaaggcttcgtcat

SEQ ID NO: 439307 - DNA, 25 bp, Rattus norvegicus
ggccaaggaatataggcttcgtcat

SEQ ID NO: 439308 - DNA, 25 bp, Rattus norvegicus
ggccaaggaccaatcgtatttcaag

SEQ ID NO: 439309 - DNA, 25 bp, Rattus norvegicus
ggccaaggaccattcgtatttcaag

SEQ ID NO: 439310 - DNA, 25 bp, Rattus norvegicus
ggccaaggacttcggctccattacc

SEQ ID NO: 439311 - DNA, 25 bp, Rattus norvegicus
ggccaaggacttgggctccattacc

SEQ ID NO: 439312 - DNA, 25 bp, Rattus norvegicus
ggccaaggagaactcacttgaccat

SEQ ID NO: 439313 - DNA, 25 bp, Rattus norvegicus
ggccaaggagaagtcacttgaccat

SEQ ID NO: 439314 - DNA, 25 bp, Rattus norvegicus
ggccaaggagctcgaacgcctgatt

SEQ ID NO: 439315 - DNA, 25 bp, Rattus norvegicus
ggccaaggagctggaacgcctgatt

SEQ ID NO: 439316 - DNA, 25 bp, Rattus norvegicus
ggccaaggcacaatctgttttttac

SEQ ID NO: 439317 - DNA, 25 bp, Rattus norvegicus
ggccaaggcacattctgttttttac

SEQ ID NO: 439318 - DNA, 25 bp, Rattus norvegicus
ggccaaggccccagggaggctcaaa

SEQ ID NO: 439319 - DNA, 25 bp, Rattus norvegicus
ggccaaggcccctgggaggctcaaa

SEQ ID NO: 439320 - DNA, 25 bp, Rattus norvegicus
ggccaaggcctacccagtacaaaag

SEQ ID NO: 439321 - DNA, 25 bp, Rattus norvegicus
ggccaaggcctagccagtacaaaag

SEQ ID NO: 439322 - DNA, 25 bp, Rattus norvegicus
ggccaaggcgccacatgaacgtcaa

SEQ ID NO: 439323 - DNA, 25 bp, Rattus norvegicus
ggccaaggcgcctcatgaacgtcaa

SEQ ID NO: 439324 - DNA, 25 bp, Rattus norvegicus
ggccaaggcttcagcgagaaagact

SEQ ID NO: 439325 - DNA, 25 bp, Rattus norvegicus
ggccaaggcttcatgaatcacacaa

SEQ ID NO: 439326 - DNA, 25 bp, Rattus norvegicus
ggccaaggcttctgcgagaaagact

SEQ ID NO: 439327 - DNA, 25 bp, Rattus norvegicus
ggccaaggcttcttgaatcacacaa

SEQ ID NO: 439328 - DNA, 25 bp, Rattus norvegicus
ggccaaggctttcagtgaggtccca

SEQ ID NO: 439329 - DNA, 25 bp, Rattus norvegicus
ggccaaggctttgagtgaggtccca

SEQ ID NO: 439330 - DNA, 25 bp, Rattus norvegicus
ggccaagggcatcttcactgctgaa

SEQ ID NO: 439331 - DNA, 25 bp, Rattus norvegicus
ggccaagggcatgttcactgctgaa

SEQ ID NO: 439332 - DNA, 25 bp, Rattus norvegicus
ggccaagggcttccaacagcgcaaa

SEQ ID NO: 439333 - DNA, 25 bp, Rattus norvegicus
ggccaagggcttgcaacagcgcaaa

SEQ ID NO: 439334 - DNA, 25 bp, Rattus norvegicus
ggccaaggtaacatctttctttgtg

SEQ ID NO: 439335 - DNA, 25 bp, Rattus norvegicus
ggccaaggtaacttctttctttgtg

SEQ ID NO: 439336 - DNA, 25 bp, Rattus norvegicus
ggccaaggtcccattctgtaaatag

SEQ ID NO: 439337 - DNA, 25 bp, Rattus norvegicus
ggccaaggtccctttctgtaaatag

SEQ ID NO: 439338 - DNA, 25 bp, Rattus norvegicus
ggccaaggttatccctgcggtgtca

SEQ ID NO: 439339 - DNA, 25 bp, Rattus norvegicus
ggccaaggttatgcctgcggtgtca

SEQ ID NO: 439340 - DNA, 25 bp, Rattus norvegicus
ggccaagtaacaattgattccctga

SEQ ID NO: 439341 - DNA, 25 bp, Rattus norvegicus
ggccaagtaacatttgattccctga

SEQ ID NO: 439342 - DNA, 25 bp, Rattus norvegicus
ggccaagtacaaacagatccttaga

SEQ ID NO: 439343 - DNA, 25 bp, Rattus norvegicus
ggccaagtacaatcagatccttaga

SEQ ID NO: 439344 - DNA, 25 bp, Rattus norvegicus
ggccaagtagccatgggatcccaga

SEQ ID NO: 439345 - DNA, 25 bp, Rattus norvegicus
ggccaagtagccttgggatcccaga

SEQ ID NO: 439346 - DNA, 25 bp, Rattus norvegicus
ggccaagtccagctgactgccttct

SEQ ID NO: 439347 - DNA, 25 bp, Rattus norvegicus
ggccaagtccaggtgactgccttct

SEQ ID NO: 439348 - DNA, 25 bp, Rattus norvegicus
ggccaagtgcaaagatccccagctg

SEQ ID NO: 439349 - DNA, 25 bp, Rattus norvegicus
ggccaagtgcaatgatccccagctg

SEQ ID NO: 439350 - DNA, 25 bp, Rattus norvegicus
ggccaagtgtaccatgcagaagtct

SEQ ID NO: 439351 - DNA, 25 bp, Rattus norvegicus
ggccaagtgtacgatgcagaagtct

SEQ ID NO: 439352 - DNA, 25 bp, Rattus norvegicus
ggccaagtgtgtcaaagccgtcaca

SEQ ID NO: 439353 - DNA, 25 bp, Rattus norvegicus
ggccaagtgtgtgaaagccgtcaca

SEQ ID NO: 439354 - DNA, 25 bp, Rattus norvegicus
ggccaagtgttgactcagtctgtag

SEQ ID NO: 439355 - DNA, 25 bp, Rattus norvegicus
ggccaagtgttgtctcagtctgtag

SEQ ID NO: 439356 - DNA, 25 bp, Rattus norvegicus
ggccaagtgtttagacctcagctgt

SEQ ID NO: 439357 - DNA, 25 bp, Rattus norvegicus
ggccaagtgttttgacctcagctgt

SEQ ID NO: 439358 - DNA, 25 bp, Rattus norvegicus
ggccaagttattaggaagggctcat

SEQ ID NO: 439359 - DNA, 25 bp, Rattus norvegicus
ggccaagttatttggaagggctcat

SEQ ID NO: 439360 - DNA, 25 bp, Rattus norvegicus
ggccaagtttggcttcacattatct

SEQ ID NO: 439361 - DNA, 25 bp, Rattus norvegicus
ggccaagtttgggttcacattatct

SEQ ID NO: 439362 - DNA, 25 bp, Rattus norvegicus
ggccaataaattactccacccatat

SEQ ID NO: 439363 - DNA, 25 bp, Rattus norvegicus
ggccaataaatttctccacccatat

SEQ ID NO: 439364 - DNA, 25 bp, Rattus norvegicus
ggccaataattgacactgaaattct

SEQ ID NO: 439365 - DNA, 25 bp, Rattus norvegicus
ggccaataattgtcactgaaattct

SEQ ID NO: 439366 - DNA, 25 bp, Rattus norvegicus
ggccaataccctattctagatactt

SEQ ID NO: 439367 - DNA, 25 bp, Rattus norvegicus
ggccaatacccttttctagatactt

SEQ ID NO: 439368 - DNA, 25 bp, Rattus norvegicus
ggccaatcaccacaacggaagggat

SEQ ID NO: 439369 - DNA, 25 bp, Rattus norvegicus
ggccaatcaccagaacggaagggat

SEQ ID NO: 439370 - DNA, 25 bp, Rattus norvegicus
ggccaatcagagattgccgcacacc

SEQ ID NO: 439371 - DNA, 25 bp, Rattus norvegicus
ggccaatcagagtttgccgcacacc

SEQ ID NO: 439372 - DNA, 25 bp, Rattus norvegicus
ggccaatccagtagagtgtgacctt

SEQ ID NO: 439373 - DNA, 25 bp, Rattus norvegicus
ggccaatccagttgagtgtgacctt

SEQ ID NO: 439374 - DNA, 25 bp, Rattus norvegicus
ggccaatccgccatggtatagttga

SEQ ID NO: 439375 - DNA, 25 bp, Rattus norvegicus
ggccaatccgccttggtatagttga

SEQ ID NO: 439376 - DNA, 25 bp, Rattus norvegicus
ggccaatctggcctacttacagagt

SEQ ID NO: 439377 - DNA, 25 bp, Rattus norvegicus
ggccaatctggcgtacttacagagt

SEQ ID NO: 439378 - DNA, 25 bp, Rattus norvegicus
ggccaatcttcaatgtcaactcgac

SEQ ID NO: 439379 - DNA, 25 bp, Rattus norvegicus
ggccaatcttcattgtcaactcgac

SEQ ID NO: 439380 - DNA, 25 bp, Rattus norvegicus
ggccaatgaccaagagagcctgcat

SEQ ID NO: 439381 - DNA, 25 bp, Rattus norvegicus
ggccaatgaccatgagagcctgcat

SEQ ID NO: 439382 - DNA, 25 bp, Rattus norvegicus
ggccaatgaggcagagactgccaag

SEQ ID NO: 439383 - DNA, 25 bp, Rattus norvegicus
ggccaatgaggctgagactgccaag

SEQ ID NO: 439384 - DNA, 25 bp, Rattus norvegicus
ggccaatgcagtctccagaatcttc

SEQ ID NO: 439385 - DNA, 25 bp, Rattus norvegicus
ggccaatgcagtgtccagaatcttc

SEQ ID NO: 439386 - DNA, 25 bp, Rattus norvegicus
ggccaatgcccaattcaatggaatt

SEQ ID NO: 439387 - DNA, 25 bp, Rattus norvegicus
ggccaatgcccatttcaatggaatt

SEQ ID NO: 439388 - DNA, 25 bp, Rattus norvegicus
ggccaatgcccgagatgagtccaag

SEQ ID NO: 439389 - DNA, 25 bp, Rattus norvegicus
ggccaatgcccgtgatgagtccaag

SEQ ID NO: 439390 - DNA, 25 bp, Rattus norvegicus
ggccaatggcaaaaacggtgaaatt

SEQ ID NO: 439391 - DNA, 25 bp, Rattus norvegicus
ggccaatggcaataacggtgaaatt

SEQ ID NO: 439392 - DNA, 25 bp, Rattus norvegicus
ggccaatgtccccatatgtacagaa

SEQ ID NO: 439393 - DNA, 25 bp, Rattus norvegicus
ggccaatgtcccgatatgtacagaa

SEQ ID NO: 439394 - DNA, 25 bp, Rattus norvegicus
ggccaatgtggcacaccttcccttt

SEQ ID NO: 439395 - DNA, 25 bp, Rattus norvegicus
ggccaatgtggctcaccttcccttt

SEQ ID NO: 439396 - DNA, 25 bp, Rattus norvegicus
ggccaatgtggtactacccttgtca

SEQ ID NO: 439397 - DNA, 25 bp, Rattus norvegicus
ggccaatgtggttctacccttgtca

SEQ ID NO: 439398 - DNA, 25 bp, Rattus norvegicus
ggccaattatgcaatacactctcag

SEQ ID NO: 439399 - DNA, 25 bp, Rattus norvegicus
ggccaattatgctatacactctcag

SEQ ID NO: 439400 - DNA, 25 bp, Rattus norvegicus
ggccaattgttactttttgccctag

SEQ ID NO: 439401 - DNA, 25 bp, Rattus norvegicus
ggccaattgttagtttttgccctag

SEQ ID NO: 439402 - DNA, 25 bp, Rattus norvegicus
ggccaatttggtccttaacttgcag

SEQ ID NO: 439403 - DNA, 25 bp, Rattus norvegicus
ggccaatttggtgcttaacttgcag

SEQ ID NO: 439404 - DNA, 25 bp, Rattus norvegicus
ggccacaaagcacacacagtcatgt

SEQ ID NO: 439405 - DNA, 25 bp, Rattus norvegicus
ggccacaaagcagacacagtcatgt

SEQ ID NO: 439406 - DNA, 25 bp, Rattus norvegicus
ggccacaacccactatagaaaagaa

SEQ ID NO: 439407 - DNA, 25 bp, Rattus norvegicus
ggccacaacccagtatagaaaagaa

SEQ ID NO: 439408 - DNA, 25 bp, Rattus norvegicus
ggccacaaccttccacagtaaaatg

SEQ ID NO: 439409 - DNA, 25 bp, Rattus norvegicus
ggccacaaccttgcacagtaaaatg

SEQ ID NO: 439410 - DNA, 25 bp, Rattus norvegicus
ggccacaagcatcgtttctgatctt

SEQ ID NO: 439411 - DNA, 25 bp, Rattus norvegicus
ggccacaagcatggtttctgatctt

SEQ ID NO: 439412 - DNA, 25 bp, Rattus norvegicus
ggccacaaggccatggttaattctt

SEQ ID NO: 439413 - DNA, 25 bp, Rattus norvegicus
ggccacaaggccttggttaattctt

SEQ ID NO: 439414 - DNA, 25 bp, Rattus norvegicus
ggccacaagtccaagtctgagacat

SEQ ID NO: 439415 - DNA, 25 bp, Rattus norvegicus
ggccacaagtcctagtctgagacat

SEQ ID NO: 439416 - DNA, 25 bp, Rattus norvegicus
ggccacaatgccagggagaaagttt

SEQ ID NO: 439417 - DNA, 25 bp, Rattus norvegicus
ggccacaatgcctgggagaaagttt

SEQ ID NO: 439418 - DNA, 25 bp, Rattus norvegicus
ggccacaatgtacttaattctggaa

SEQ ID NO: 439419 - DNA, 25 bp, Rattus norvegicus
ggccacaatgtagttaattctggaa

SEQ ID NO: 439420 - DNA, 25 bp, Rattus norvegicus
ggccacacaaacattcgaacttctt

SEQ ID NO: 439421 - DNA, 25 bp, Rattus norvegicus
ggccacacaaactttcgaacttctt

SEQ ID NO: 439422 - DNA, 25 bp, Rattus norvegicus
ggccacacaggaccagcaacggagt

SEQ ID NO: 439423 - DNA, 25 bp, Rattus norvegicus
ggccacacaggagcagcaacggagt

SEQ ID NO: 439424 - DNA, 25 bp, Rattus norvegicus
ggccacaccctgatagtgttttaca

SEQ ID NO: 439425 - DNA, 25 bp, Rattus norvegicus
ggccacaccctgttagtgttttaca

SEQ ID NO: 439426 - DNA, 25 bp, Rattus norvegicus
ggccacaccttacaacctgaaaagt

SEQ ID NO: 439427 - DNA, 25 bp, Rattus norvegicus
ggccacaccttagaacctgaaaagt

SEQ ID NO: 439428 - DNA, 25 bp, Rattus norvegicus
ggccacacgctgacagaattttctg

SEQ ID NO: 439429 - DNA, 25 bp, Rattus norvegicus
ggccacacgctgtcagaattttctg

SEQ ID NO: 439430 - DNA, 25 bp, Rattus norvegicus
ggccacactagcaacatatagttta

SEQ ID NO: 439431 - DNA, 25 bp, Rattus norvegicus
ggccacactagctacatatagttta

SEQ ID NO: 439432 - DNA, 25 bp, Rattus norvegicus
ggccacactcatcagggagacatct

SEQ ID NO: 439433 - DNA, 25 bp, Rattus norvegicus
ggccacactcatgagggagacatct

SEQ ID NO: 439434 - DNA, 25 bp, Rattus norvegicus
ggccacactgatctgtcattctaaa

SEQ ID NO: 439435 - DNA, 25 bp, Rattus norvegicus
ggccacactgatgtgtcattctaaa

SEQ ID NO: 439436 - DNA, 25 bp, Rattus norvegicus
ggccacactgggatcattttaagct

SEQ ID NO: 439437 - DNA, 25 bp, Rattus norvegicus
ggccacactgggttcattttaagct

SEQ ID NO: 439438 - DNA, 25 bp, Rattus norvegicus
ggccacacttgaaacactgtaccaa

SEQ ID NO: 439439 - DNA, 25 bp, Rattus norvegicus
ggccacacttgatacactgtaccaa

SEQ ID NO: 439440 - DNA, 25 bp, Rattus norvegicus
ggccacagaaaacgtgtgccctgct

SEQ ID NO: 439441 - DNA, 25 bp, Rattus norvegicus
ggccacagaaaaggtgtgccctgct

SEQ ID NO: 439442 - DNA, 25 bp, Rattus norvegicus
ggccacagaaacctcttccagaaga

SEQ ID NO: 439443 - DNA, 25 bp, Rattus norvegicus
ggccacagaaacgtcttccagaaga

SEQ ID NO: 439444 - DNA, 25 bp, Rattus norvegicus
ggccacagaggcacgtaccagagat

SEQ ID NO: 439445 - DNA, 25 bp, Rattus norvegicus
ggccacagaggctcgtaccagagat

SEQ ID NO: 439446 - DNA, 25 bp, Rattus norvegicus
ggccacagatcacgtcagcatgaat

SEQ ID NO: 439447 - DNA, 25 bp, Rattus norvegicus
ggccacagatcaggtcagcatgaat

SEQ ID NO: 439448 - DNA, 25 bp, Rattus norvegicus
ggccacagcagcacatttttacaga

SEQ ID NO: 439449 - DNA, 25 bp, Rattus norvegicus
ggccacagcagctcatttttacaga

SEQ ID NO: 439450 - DNA, 25 bp, Rattus norvegicus
ggccacagccatcacatgcatgata

SEQ ID NO: 439451 - DNA, 25 bp, Rattus norvegicus
ggccacagccatgacatgcatgata

SEQ ID NO: 439452 - DNA, 25 bp, Rattus norvegicus
ggccacagccttagtgcttttggga

SEQ ID NO: 439453 - DNA, 25 bp, Rattus norvegicus
ggccacagcctttgtgcttttggga

SEQ ID NO: 439454 - DNA, 25 bp, Rattus norvegicus
ggccacagctacagtcagcaggtgc

SEQ ID NO: 439455 - DNA, 25 bp, Rattus norvegicus
ggccacagctactgtcagcaggtgc

SEQ ID NO: 439456 - DNA, 25 bp, Rattus norvegicus
ggccacaggaatctcgttctctcag

SEQ ID NO: 439457 - DNA, 25 bp, Rattus norvegicus
ggccacaggaatgtcgttctctcag

SEQ ID NO: 439458 - DNA, 25 bp, Rattus norvegicus
ggccacaggcagctgtcttatcaga

SEQ ID NO: 439459 - DNA, 25 bp, Rattus norvegicus
ggccacaggcaggtgtcttatcaga

SEQ ID NO: 439460 - DNA, 25 bp, Rattus norvegicus
ggccacagggctactttatggttgt

SEQ ID NO: 439461 - DNA, 25 bp, Rattus norvegicus
ggccacagggcttctttatggttgt

SEQ ID NO: 439462 - DNA, 25 bp, Rattus norvegicus
ggccacagtatgaccagaaagaaga

SEQ ID NO: 439463 - DNA, 25 bp, Rattus norvegicus
ggccacagtatgtccagaaagaaga

SEQ ID NO: 439464 - DNA, 25 bp, Rattus norvegicus
ggccacagtattcgtcccatcaggg

SEQ ID NO: 439465 - DNA, 25 bp, Rattus norvegicus
ggccacagtattggtcccatcaggg

SEQ ID NO: 439466 - DNA, 25 bp, Rattus norvegicus
ggccacagtgacaggtgaccacggt

SEQ ID NO: 439467 - DNA, 25 bp, Rattus norvegicus
ggccacagtgactggtgaccacggt

SEQ ID NO: 439468 - DNA, 25 bp, Rattus norvegicus
ggccacagtgccaaaaatcgagagt

SEQ ID NO: 439469 - DNA, 25 bp, Rattus norvegicus
ggccacagtgcctaaaatcgagagt

SEQ ID NO: 439470 - DNA, 25 bp, Rattus norvegicus
ggccacagtgtacagtttcctcttt

SEQ ID NO: 439471 - DNA, 25 bp, Rattus norvegicus
ggccacagtgtagagtttcctcttt

SEQ ID NO: 439472 - DNA, 25 bp, Rattus norvegicus
ggccacagttcaaatatttcaccat

SEQ ID NO: 439473 - DNA, 25 bp, Rattus norvegicus
ggccacagttcatatatttcaccat

SEQ ID NO: 439474 - DNA, 25 bp, Rattus norvegicus
ggccacagtttccatgtctacagaa

SEQ ID NO: 439475 - DNA, 25 bp, Rattus norvegicus
ggccacagtttcgatgtctacagaa

SEQ ID NO: 439476 - DNA, 25 bp, Rattus norvegicus
ggccacagttttaatgcaaggtcta

SEQ ID NO: 439477 - DNA, 25 bp, Rattus norvegicus
ggccacagtttttatgcaaggtcta

SEQ ID NO: 439478 - DNA, 25 bp, Rattus norvegicus
ggccacataggcagacacttaaagg

SEQ ID NO: 439479 - DNA, 25 bp, Rattus norvegicus
ggccacataggctgacacttaaagg

SEQ ID NO: 439480 - DNA, 25 bp, Rattus norvegicus
ggccacatagtgaggtctcgactga

SEQ ID NO: 439481 - DNA, 25 bp, Rattus norvegicus
ggccacatagtgtggtctcgactga

SEQ ID NO: 439482 - DNA, 25 bp, Rattus norvegicus
ggccacatccgacatggagctgaga

SEQ ID NO: 439483 - DNA, 25 bp, Rattus norvegicus
ggccacatccgagatggagctgaga

SEQ ID NO: 439484 - DNA, 25 bp, Rattus norvegicus
ggccacatctggcaacacagggatg

SEQ ID NO: 439485 - DNA, 25 bp, Rattus norvegicus
ggccacatctgggaacacagggatg

SEQ ID NO: 439486 - DNA, 25 bp, Rattus norvegicus
ggccacatcttacgagcgtctcgta

SEQ ID NO: 439487 - DNA, 25 bp, Rattus norvegicus
ggccacatcttaggagcgtctcgta

SEQ ID NO: 439488 - DNA, 25 bp, Rattus norvegicus
ggccacatgctaagccagactgtac

SEQ ID NO: 439489 - DNA, 25 bp, Rattus norvegicus
ggccacatgctatgccagactgtac

SEQ ID NO: 439490 - DNA, 25 bp, Rattus norvegicus
ggccacatgggacagaaatcctaat

SEQ ID NO: 439491 - DNA, 25 bp, Rattus norvegicus
ggccacatgggagagaaatcctaat

SEQ ID NO: 439492 - DNA, 25 bp, Rattus norvegicus
ggccacatgtggcaagatcatcatt

SEQ ID NO: 439493 - DNA, 25 bp, Rattus norvegicus
ggccacatgtgggaagatcatcatt

SEQ ID NO: 439494 - DNA, 25 bp, Rattus norvegicus
ggccacattcatacaggactttgca

SEQ ID NO: 439495 - DNA, 25 bp, Rattus norvegicus
ggccacattcattcaggactttgca

SEQ ID NO: 439496 - DNA, 25 bp, Rattus norvegicus
ggccacattcgtcccatatgggtta

SEQ ID NO: 439497 - DNA, 25 bp, Rattus norvegicus
ggccacattcgtgccatatgggtta

SEQ ID NO: 439498 - DNA, 25 bp, Rattus norvegicus
ggccacattctcaactacctaaata

SEQ ID NO: 439499 - DNA, 25 bp, Rattus norvegicus
ggccacattctctactacctaaata

SEQ ID NO: 439500 - DNA, 25 bp, Rattus norvegicus
ggccaccaactgcaacgacgatgag

SEQ ID NO: 439501 - DNA, 25 bp, Rattus norvegicus
ggccaccaactggaacgacgatgag

SEQ ID NO: 439502 - DNA, 25 bp, Rattus norvegicus
ggccaccaagaccaatgcactgaaa

SEQ ID NO: 439503 - DNA, 25 bp, Rattus norvegicus
ggccaccaagacgaatgcactgaaa

SEQ ID NO: 439504 - DNA, 25 bp, Rattus norvegicus
ggccaccaaggcactccaatgaaat

SEQ ID NO: 439505 - DNA, 25 bp, Rattus norvegicus
ggccaccaaggctctccaatgaaat

SEQ ID NO: 439506 - DNA, 25 bp, Rattus norvegicus
ggccaccacagcaatttcctgtagt

SEQ ID NO: 439507 - DNA, 25 bp, Rattus norvegicus
ggccaccacagctatttcctgtagt

SEQ ID NO: 439508 - DNA, 25 bp, Rattus norvegicus
ggccaccagggccatgtttggacct

SEQ ID NO: 439509 - DNA, 25 bp, Rattus norvegicus
ggccaccagggcgatgtttggacct

SEQ ID NO: 439510 - DNA, 25 bp, Rattus norvegicus
ggccaccatggcagaacagcagctt

SEQ ID NO: 439511 - DNA, 25 bp, Rattus norvegicus
ggccaccatggctgaacagcagctt

SEQ ID NO: 439512 - DNA, 25 bp, Rattus norvegicus
ggccaccctggaaataacattctac

SEQ ID NO: 439513 - DNA, 25 bp, Rattus norvegicus
ggccaccctggatataacattctac

SEQ ID NO: 439514 - DNA, 25 bp, Rattus norvegicus
ggccaccctgtcactagtaaaatga

SEQ ID NO: 439515 - DNA, 25 bp, Rattus norvegicus
ggccaccctgtctctagtaaaatga

SEQ ID NO: 439516 - DNA, 25 bp, Rattus norvegicus
ggccaccgctgtaatgtttattttc

SEQ ID NO: 439517 - DNA, 25 bp, Rattus norvegicus
ggccaccgctgttatgtttattttc

SEQ ID NO: 439518 - DNA, 25 bp, Rattus norvegicus
ggccaccgctttctattggaacggg

SEQ ID NO: 439519 - DNA, 25 bp, Rattus norvegicus
ggccaccgctttgtattggaacggg

SEQ ID NO: 439520 - DNA, 25 bp, Rattus norvegicus
ggccaccggccaagctgatttgagt

SEQ ID NO: 439521 - DNA, 25 bp, Rattus norvegicus
ggccaccggccatgctgatttgagt

SEQ ID NO: 439522 - DNA, 25 bp, Rattus norvegicus
ggccacctagaaccaacttttccta

SEQ ID NO: 439523 - DNA, 25 bp, Rattus norvegicus
ggccacctagaagcaacttttccta

SEQ ID NO: 439524 - DNA, 25 bp, Rattus norvegicus
ggccacctaggcagacaacagaggg

SEQ ID NO: 439525 - DNA, 25 bp, Rattus norvegicus
ggccacctaggctgacaacagaggg

SEQ ID NO: 439526 - DNA, 25 bp, Rattus norvegicus
ggccacctcgagattacagtgctga

SEQ ID NO: 439527 - DNA, 25 bp, Rattus norvegicus
ggccacctcgagtttacagtgctga

SEQ ID NO: 439528 - DNA, 25 bp, Rattus norvegicus
ggccacctgctgactatttgtggtt

SEQ ID NO: 439529 - DNA, 25 bp, Rattus norvegicus
ggccacctgctgtctatttgtggtt

SEQ ID NO: 439530 - DNA, 25 bp, Rattus norvegicus
ggccacctggtcagtcattgtgtaa

SEQ ID NO: 439531 - DNA, 25 bp, Rattus norvegicus
ggccacctggtctgtcattgtgtaa

SEQ ID NO: 439532 - DNA, 25 bp, Rattus norvegicus
ggccacctgtacatatcccagagaa

SEQ ID NO: 439533 - DNA, 25 bp, Rattus norvegicus
ggccacctgtacttatcccagagaa

SEQ ID NO: 439534 - DNA, 25 bp, Rattus norvegicus
ggccacctgtgtcagcaagtcaatg

SEQ ID NO: 439535 - DNA, 25 bp, Rattus norvegicus
ggccacctgtgtgagcaagtcaatg

SEQ ID NO: 439536 - DNA, 25 bp, Rattus norvegicus
ggccaccttaacagccggaaagccg

SEQ ID NO: 439537 - DNA, 25 bp, Rattus norvegicus
ggccaccttaactgccggaaagccg

SEQ ID NO: 439538 - DNA, 25 bp, Rattus norvegicus
ggccacgacgtgacttttgtaggtt

SEQ ID NO: 439539 - DNA, 25 bp, Rattus norvegicus
ggccacgacgtgtcttttgtaggtt

SEQ ID NO: 439540 - DNA, 25 bp, Rattus norvegicus
ggccacgatctccacacagatgtca

SEQ ID NO: 439541 - DNA, 25 bp, Rattus norvegicus
ggccacgatctcgacacagatgtca

SEQ ID NO: 439542 - DNA, 25 bp, Rattus norvegicus
ggccacgccctaatacatgttgaga

SEQ ID NO: 439543 - DNA, 25 bp, Rattus norvegicus
ggccacgccctattacatgttgaga

SEQ ID NO: 439544 - DNA, 25 bp, Rattus norvegicus
ggccacgccgagacaaagcagctga

SEQ ID NO: 439545 - DNA, 25 bp, Rattus norvegicus
ggccacgccgagtcaaagcagctga

SEQ ID NO: 439546 - DNA, 25 bp, Rattus norvegicus
ggccacgcgtcccagtgaggttcac

SEQ ID NO: 439547 - DNA, 25 bp, Rattus norvegicus
ggccacgcgtccgagtgaggttcac

SEQ ID NO: 439548 - DNA, 25 bp, Rattus norvegicus
ggccacgctccacatttaaaggaca

SEQ ID NO: 439549 - DNA, 25 bp, Rattus norvegicus
ggccacgctccagatttaaaggaca

SEQ ID NO: 439550 - DNA, 25 bp, Rattus norvegicus
ggccacggatcgagtgcggaactta

SEQ ID NO: 439551 - DNA, 25 bp, Rattus norvegicus
ggccacggatcgtgtgcggaactta

SEQ ID NO: 439552 - DNA, 25 bp, Rattus norvegicus
ggccacggcatcaggaagtttgagc

SEQ ID NO: 439553 - DNA, 25 bp, Rattus norvegicus
ggccacggcatctggaagtttgagc

SEQ ID NO: 439554 - DNA, 25 bp, Rattus norvegicus
ggccacggccataaaaattcctgtt

SEQ ID NO: 439555 - DNA, 25 bp, Rattus norvegicus
ggccacggccattaaaattcctgtt

SEQ ID NO: 439556 - DNA, 25 bp, Rattus norvegicus
ggccacggcgtcattctgaattgag

SEQ ID NO: 439557 - DNA, 25 bp, Rattus norvegicus
ggccacggcgtctttctgaattgag

SEQ ID NO: 439558 - DNA, 25 bp, Rattus norvegicus
ggccacgtcttccaccaagaaagat

SEQ ID NO: 439559 - DNA, 25 bp, Rattus norvegicus
ggccacgtcttcgaccaagaaagat

SEQ ID NO: 439560 - DNA, 25 bp, Rattus norvegicus
ggccacgttgttcacgaacttcttg

SEQ ID NO: 439561 - DNA, 25 bp, Rattus norvegicus
ggccacgttgttgacgaacttcttg

SEQ ID NO: 439562 - DNA, 25 bp, Rattus norvegicus
ggccactaacagaaacagcaccctt

SEQ ID NO: 439563 - DNA, 25 bp, Rattus norvegicus
ggccactaacagtaacagcaccctt

SEQ ID NO: 439564 - DNA, 25 bp, Rattus norvegicus
ggccactaagtgatgctatacatca

SEQ ID NO: 439565 - DNA, 25 bp, Rattus norvegicus
ggccactaagtgttgctatacatca

SEQ ID NO: 439566 - DNA, 25 bp, Rattus norvegicus
ggccactaatgcagcagtcactgta

SEQ ID NO: 439567 - DNA, 25 bp, Rattus norvegicus
ggccactaatgctgcagtcactgta

SEQ ID NO: 439568 - DNA, 25 bp, Rattus norvegicus
ggccactacattatcttgtttcttg

SEQ ID NO: 439569 - DNA, 25 bp, Rattus norvegicus
ggccactacattttcttgtttcttg

SEQ ID NO: 439570 - DNA, 25 bp, Rattus norvegicus
ggccactagatgaccctggggtgat

SEQ ID NO: 439571 - DNA, 25 bp, Rattus norvegicus
ggccactagatgtccctggggtgat

SEQ ID NO: 439572 - DNA, 25 bp, Rattus norvegicus
ggccactaggacacggaccaagcag

SEQ ID NO: 439573 - DNA, 25 bp, Rattus norvegicus
ggccactaggactcggaccaagcag

SEQ ID NO: 439574 - DNA, 25 bp, Rattus norvegicus
ggccactagggacgagtgccaccaa

SEQ ID NO: 439575 - DNA, 25 bp, Rattus norvegicus
ggccactagggaggagtgccaccaa

SEQ ID NO: 439576 - DNA, 25 bp, Rattus norvegicus
ggccactagggcacggattttattc

SEQ ID NO: 439577 - DNA, 25 bp, Rattus norvegicus
ggccactagggctcggattttattc

SEQ ID NO: 439578 - DNA, 25 bp, Rattus norvegicus
ggccactatattcagcctccttatt

SEQ ID NO: 439579 - DNA, 25 bp, Rattus norvegicus
ggccactatattgagcctccttatt

SEQ ID NO: 439580 - DNA, 25 bp, Rattus norvegicus
ggccactcccagcaatgctgaggaa

SEQ ID NO: 439581 - DNA, 25 bp, Rattus norvegicus
ggccactcccaggaatgctgaggaa

SEQ ID NO: 439582 - DNA, 25 bp, Rattus norvegicus
ggccactcgaatatctttggtgttg

SEQ ID NO: 439583 - DNA, 25 bp, Rattus norvegicus
ggccactcgaatttctttggtgttg

SEQ ID NO: 439584 - DNA, 25 bp, Rattus norvegicus
ggccactcgggtactggtagagatt

SEQ ID NO: 439585 - DNA, 25 bp, Rattus norvegicus
ggccactcgggttctggtagagatt

SEQ ID NO: 439586 - DNA, 25 bp, Rattus norvegicus
ggccactctcccaaaggaccagaaa

SEQ ID NO: 439587 - DNA, 25 bp, Rattus norvegicus
ggccactctccctaaggaccagaaa

SEQ ID NO: 439588 - DNA, 25 bp, Rattus norvegicus
ggccactctctcacaattttagatt

SEQ ID NO: 439589 - DNA, 25 bp, Rattus norvegicus
ggccactctctctcaattttagatt

SEQ ID NO: 439590 - DNA, 25 bp, Rattus norvegicus
ggccactctgaccttgagccaacag

SEQ ID NO: 439591 - DNA, 25 bp, Rattus norvegicus
ggccactctgacgttgagccaacag

SEQ ID NO: 439592 - DNA, 25 bp, Rattus norvegicus
ggccactcttgaatctttgattcac

SEQ ID NO: 439593 - DNA, 25 bp, Rattus norvegicus
ggccactcttgattctttgattcac

SEQ ID NO: 439594 - DNA, 25 bp, Rattus norvegicus
ggccactgaggacttctatcagtat

SEQ ID NO: 439595 - DNA, 25 bp, Rattus norvegicus
ggccactgaggagttctatcagtat

SEQ ID NO: 439596 - DNA, 25 bp, Rattus norvegicus
ggccactgagtaagaaagtccctgt

SEQ ID NO: 439597 - DNA, 25 bp, Rattus norvegicus
ggccactgagtatgaaagtccctgt

SEQ ID NO: 439598 - DNA, 25 bp, Rattus norvegicus
ggccactgagtgacgtgaggctctt

SEQ ID NO: 439599 - DNA, 25 bp, Rattus norvegicus
ggccactgagtgtcgtgaggctctt

SEQ ID NO: 439600 - DNA, 25 bp, Rattus norvegicus
ggccactgagttacagcttctatgt

SEQ ID NO: 439601 - DNA, 25 bp, Rattus norvegicus
ggccactgagtttcagcttctatgt

SEQ ID NO: 439602 - DNA, 25 bp, Rattus norvegicus
ggccactgcagacctgtagttcata

SEQ ID NO: 439603 - DNA, 25 bp, Rattus norvegicus
ggccactgcagagctgtagttcata

SEQ ID NO: 439604 - DNA, 25 bp, Rattus norvegicus
ggccactgccccaaaatagcgaagc

SEQ ID NO: 439605 - DNA, 25 bp, Rattus norvegicus
ggccactgcccctaaatagcgaagc

SEQ ID NO: 439606 - DNA, 25 bp, Rattus norvegicus
ggccactgcgtcaacatctagaaat

SEQ ID NO: 439607 - DNA, 25 bp, Rattus norvegicus
ggccactgcgtctacatctagaaat

SEQ ID NO: 439608 - DNA, 25 bp, Rattus norvegicus
ggccactgtaagaacctggaaccca

SEQ ID NO: 439609 - DNA, 25 bp, Rattus norvegicus
ggccactgtaagtacctggaaccca

SEQ ID NO: 439610 - DNA, 25 bp, Rattus norvegicus
ggccactgtgcaaaggctgtgtcca

SEQ ID NO: 439611 - DNA, 25 bp, Rattus norvegicus
ggccactgtgcataggctgtgtcca

SEQ ID NO: 439612 - DNA, 25 bp, Rattus norvegicus
ggccacttacagctatgtataagta

SEQ ID NO: 439613 - DNA, 25 bp, Rattus norvegicus
ggccacttacaggtatgtataagta

SEQ ID NO: 439614 - DNA, 25 bp, Rattus norvegicus
ggccacttagtgaccctttgttctt

SEQ ID NO: 439615 - DNA, 25 bp, Rattus norvegicus
ggccacttagtgtccctttgttctt

SEQ ID NO: 439616 - DNA, 25 bp, Rattus norvegicus
ggccacttcatgctgcatgcccggg

SEQ ID NO: 439617 - DNA, 25 bp, Rattus norvegicus
ggccacttcatggtgcatgcccggg

SEQ ID NO: 439618 - DNA, 25 bp, Rattus norvegicus
ggccacttgaatctgaagggtccaa

SEQ ID NO: 439619 - DNA, 25 bp, Rattus norvegicus
ggccacttgaatgtgaagggtccaa

SEQ ID NO: 439620 - DNA, 25 bp, Rattus norvegicus
ggccacttgcacacttttgatgtag

SEQ ID NO: 439621 - DNA, 25 bp, Rattus norvegicus
ggccacttgcactcttttgatgtag

SEQ ID NO: 439622 - DNA, 25 bp, Rattus norvegicus
ggccacttggccatgagatgcacag

SEQ ID NO: 439623 - DNA, 25 bp, Rattus norvegicus
ggccacttggccttgagatgcacag

SEQ ID NO: 439624 - DNA, 25 bp, Rattus norvegicus
ggccactttactagctgtgtagact

SEQ ID NO: 439625 - DNA, 25 bp, Rattus norvegicus
ggccactttacttgctgtgtagact

SEQ ID NO: 439626 - DNA, 25 bp, Rattus norvegicus
ggccactttctcagagttccaagag

SEQ ID NO: 439627 - DNA, 25 bp, Rattus norvegicus
ggccactttctctgagttccaagag

SEQ ID NO: 439628 - DNA, 25 bp, Rattus norvegicus
ggccactttggactatatgcatttg

SEQ ID NO: 439629 - DNA, 25 bp, Rattus norvegicus
ggccactttggagtatatgcatttg

SEQ ID NO: 439630 - DNA, 25 bp, Rattus norvegicus
ggccactttggcagaggacgtcact

SEQ ID NO: 439631 - DNA, 25 bp, Rattus norvegicus
ggccactttggctgaggacgtcact

SEQ ID NO: 439632 - DNA, 25 bp, Rattus norvegicus
ggccagaaaactactttaaacatgt

SEQ ID NO: 439633 - DNA, 25 bp, Rattus norvegicus
ggccagaaaacttctttaaacatgt

SEQ ID NO: 439634 - DNA, 25 bp, Rattus norvegicus
ggccagaaaaggacactggagcccc

SEQ ID NO: 439635 - DNA, 25 bp, Rattus norvegicus
ggccagaaaaggtcactggagcccc

SEQ ID NO: 439636 - DNA, 25 bp, Rattus norvegicus
ggccagaacatcactcaactgcaat

SEQ ID NO: 439637 - DNA, 25 bp, Rattus norvegicus
ggccagaacatctctcaactgcaat

SEQ ID NO: 439638 - DNA, 25 bp, Rattus norvegicus
ggccagaacttgaatgaaactacct

SEQ ID NO: 439639 - DNA, 25 bp, Rattus norvegicus
ggccagaacttgtatgaaactacct

SEQ ID NO: 439640 - DNA, 25 bp, Rattus norvegicus
ggccagaagtgtcaagacatgtcca

SEQ ID NO: 439641 - DNA, 25 bp, Rattus norvegicus
ggccagaagtgtgaagacatgtcca

SEQ ID NO: 439642 - DNA, 25 bp, Rattus norvegicus
ggccagaatcaaagtctttttcata

SEQ ID NO: 439643 - DNA, 25 bp, Rattus norvegicus
ggccagaatcaatgtctttttcata

SEQ ID NO: 439644 - DNA, 25 bp, Rattus norvegicus
ggccagacaagcaatcgacaaaact

SEQ ID NO: 439645 - DNA, 25 bp, Rattus norvegicus
ggccagacaagctatcgacaaaact

SEQ ID NO: 439646 - DNA, 25 bp, Rattus norvegicus
ggccagacaccaactcattggaagt

SEQ ID NO: 439647 - DNA, 25 bp, Rattus norvegicus
ggccagacaccatctcattggaagt

SEQ ID NO: 439648 - DNA, 25 bp, Rattus norvegicus
ggccagacactgcttgccaagatgg

SEQ ID NO: 439649 - DNA, 25 bp, Rattus norvegicus
ggccagacactggttgccaagatgg

SEQ ID NO: 439650 - DNA, 25 bp, Rattus norvegicus
ggccagacaggccagcattgtttgt

SEQ ID NO: 439651 - DNA, 25 bp, Rattus norvegicus
ggccagacaggcgagcattgtttgt

SEQ ID NO: 439652 - DNA, 25 bp, Rattus norvegicus
ggccagaccagaccccaggagagta

SEQ ID NO: 439653 - DNA, 25 bp, Rattus norvegicus
ggccagaccagagcccaggagagta

SEQ ID NO: 439654 - DNA, 25 bp, Rattus norvegicus
ggccagacctgtatctactgagaag

SEQ ID NO: 439655 - DNA, 25 bp, Rattus norvegicus
ggccagacctgtttctactgagaag

SEQ ID NO: 439656 - DNA, 25 bp, Rattus norvegicus
ggccagactctgctggttgttcaac

SEQ ID NO: 439657 - DNA, 25 bp, Rattus norvegicus
ggccagactctggtggttgttcaac

SEQ ID NO: 439658 - DNA, 25 bp, Rattus norvegicus
ggccagagaaccatccagagattgt

SEQ ID NO: 439659 - DNA, 25 bp, Rattus norvegicus
ggccagagaaccttccagagattgt

SEQ ID NO: 439660 - DNA, 25 bp, Rattus norvegicus
ggccagagacacaggattgctcata

SEQ ID NO: 439661 - DNA, 25 bp, Rattus norvegicus
ggccagagacactggattgctcata

SEQ ID NO: 439662 - DNA, 25 bp, Rattus norvegicus
ggccagagacgtatccttcaaaata

SEQ ID NO: 439663 - DNA, 25 bp, Rattus norvegicus
ggccagagacgtttccttcaaaata

SEQ ID NO: 439664 - DNA, 25 bp, Rattus norvegicus
ggccagagagcaaacattcgaactt

SEQ ID NO: 439665 - DNA, 25 bp, Rattus norvegicus
ggccagagagcatacattcgaactt

SEQ ID NO: 439666 - DNA, 25 bp, Rattus norvegicus
ggccagagaggacattacagcttgc

SEQ ID NO: 439667 - DNA, 25 bp, Rattus norvegicus
ggccagagaggagattacagcttgc

SEQ ID NO: 439668 - DNA, 25 bp, Rattus norvegicus
ggccagagcacgacagctttgagga

SEQ ID NO: 439669 - DNA, 25 bp, Rattus norvegicus
ggccagagcacgtcagctttgagga

SEQ ID NO: 439670 - DNA, 25 bp, Rattus norvegicus
ggccagagcggcattgttttcacga

SEQ ID NO: 439671 - DNA, 25 bp, Rattus norvegicus
ggccagagcggctttgttttcacga

SEQ ID NO: 439672 - DNA, 25 bp, Rattus norvegicus
ggccagagcgtcacggaactcgatg

SEQ ID NO: 439673 - DNA, 25 bp, Rattus norvegicus
ggccagagcgtctcggaactcgatg

SEQ ID NO: 439674 - DNA, 25 bp, Rattus norvegicus
ggccagagcttaagaaccacatcga

SEQ ID NO: 439675 - DNA, 25 bp, Rattus norvegicus
ggccagagcttatgaaccacatcga

SEQ ID NO: 439676 - DNA, 25 bp, Rattus norvegicus
ggccagaggcatcttcccagaagaa

SEQ ID NO: 439677 - DNA, 25 bp, Rattus norvegicus
ggccagaggcatgttcccagaagaa

SEQ ID NO: 439678 - DNA, 25 bp, Rattus norvegicus
ggccagaggcttatttgtggaccaa

SEQ ID NO: 439679 - DNA, 25 bp, Rattus norvegicus
ggccagaggcttttttgtggaccaa

SEQ ID NO: 439680 - DNA, 25 bp, Rattus norvegicus
ggccagagtagtctcctctgcctgg

SEQ ID NO: 439681 - DNA, 25 bp, Rattus norvegicus
ggccagagtagtgtcctctgcctgg

SEQ ID NO: 439682 - DNA, 25 bp, Rattus norvegicus
ggccagagtcccagatatttctcat

SEQ ID NO: 439683 - DNA, 25 bp, Rattus norvegicus
ggccagagtccctgatatttctcat

SEQ ID NO: 439684 - DNA, 25 bp, Rattus norvegicus
ggccagagtgctctccagaagcaat

SEQ ID NO: 439685 - DNA, 25 bp, Rattus norvegicus
ggccagagtgctgtccagaagcaat

SEQ ID NO: 439686 - DNA, 25 bp, Rattus norvegicus
ggccagagtggcagtttctcctgca

SEQ ID NO: 439687 - DNA, 25 bp, Rattus norvegicus
ggccagagtggctgtttctcctgca

SEQ ID NO: 439688 - DNA, 25 bp, Rattus norvegicus
ggccagagtttaacttgagctaaca

SEQ ID NO: 439689 - DNA, 25 bp, Rattus norvegicus
ggccagagtttatcttgagctaaca

SEQ ID NO: 439690 - DNA, 25 bp, Rattus norvegicus
ggccagagtttgattctcagtactg

SEQ ID NO: 439691 - DNA, 25 bp, Rattus norvegicus
ggccagagtttgtttctcagtactg

SEQ ID NO: 439692 - DNA, 25 bp, Rattus norvegicus
ggccagatctctaacttaatgactt

SEQ ID NO: 439693 - DNA, 25 bp, Rattus norvegicus
ggccagatctcttacttaatgactt

SEQ ID NO: 439694 - DNA, 25 bp, Rattus norvegicus
ggccagatctggaaacgcattagaa

SEQ ID NO: 439695 - DNA, 25 bp, Rattus norvegicus
ggccagatctggtaacgcattagaa

SEQ ID NO: 439696 - DNA, 25 bp, Rattus norvegicus
ggccagatgagcagattcaaccaga

SEQ ID NO: 439697 - DNA, 25 bp, Rattus norvegicus
ggccagatgagctgattcaaccaga

SEQ ID NO: 439698 - DNA, 25 bp, Rattus norvegicus
ggccagatgcagagcctgatcacaa

SEQ ID NO: 439699 - DNA, 25 bp, Rattus norvegicus
ggccagatgcagtgcctgatcacaa

SEQ ID NO: 439700 - DNA, 25 bp, Rattus norvegicus
ggccagattgccagttaccctctgg

SEQ ID NO: 439701 - DNA, 25 bp, Rattus norvegicus
ggccagattgcctgttaccctctgg

SEQ ID NO: 439702 - DNA, 25 bp, Rattus norvegicus
ggccagcaaagcctggaggacatcc

SEQ ID NO: 439703 - DNA, 25 bp, Rattus norvegicus
ggccagcaaagcgtggaggacatcc

SEQ ID NO: 439704 - DNA, 25 bp, Rattus norvegicus
ggccagcaacagacaagtttcctgt

SEQ ID NO: 439705 - DNA, 25 bp, Rattus norvegicus
ggccagcaacagtcaagtttcctgt

SEQ ID NO: 439706 - DNA, 25 bp, Rattus norvegicus
ggccagcaagtaattattctgactt

SEQ ID NO: 439707 - DNA, 25 bp, Rattus norvegicus
ggccagcaagtatttattctgactt

SEQ ID NO: 439708 - DNA, 25 bp, Rattus norvegicus
ggccagcaatgtcatgtcccagtac

SEQ ID NO: 439709 - DNA, 25 bp, Rattus norvegicus
ggccagcaatgtgatgtcccagtac

SEQ ID NO: 439710 - DNA, 25 bp, Rattus norvegicus
ggccagcacaaacacctctacagaa

SEQ ID NO: 439711 - DNA, 25 bp, Rattus norvegicus
ggccagcacaaagacctctacagaa

SEQ ID NO: 439712 - DNA, 25 bp, Rattus norvegicus
ggccagcacgagagcgttgaaacct

SEQ ID NO: 439713 - DNA, 25 bp, Rattus norvegicus
ggccagcacgagtgcgttgaaacct

SEQ ID NO: 439714 - DNA, 25 bp, Rattus norvegicus
ggccagcatacaaacataacaccct

SEQ ID NO: 439715 - DNA, 25 bp, Rattus norvegicus
ggccagcatacatacataacaccct

SEQ ID NO: 439716 - DNA, 25 bp, Rattus norvegicus
ggccagcatagaccacaccaagaag

SEQ ID NO: 439717 - DNA, 25 bp, Rattus norvegicus
ggccagcatagagcacaccaagaag

SEQ ID NO: 439718 - DNA, 25 bp, Rattus norvegicus
ggccagcatagtcagatcctaactc

SEQ ID NO: 439719 - DNA, 25 bp, Rattus norvegicus
ggccagcatagtgagatcctaactc

SEQ ID NO: 439720 - DNA, 25 bp, Rattus norvegicus
ggccagcatccaacataatagcaat

SEQ ID NO: 439721 - DNA, 25 bp, Rattus norvegicus
ggccagcatccatcataatagcaat

SEQ ID NO: 439722 - DNA, 25 bp, Rattus norvegicus
ggccagcatcttccacagatgtctt

SEQ ID NO: 439723 - DNA, 25 bp, Rattus norvegicus
ggccagcatcttgcacagatgtctt

SEQ ID NO: 439724 - DNA, 25 bp, Rattus norvegicus
ggccagccaactctttacctggaaa

SEQ ID NO: 439725 - DNA, 25 bp, Rattus norvegicus
ggccagccaactgtttacctggaaa

SEQ ID NO: 439726 - DNA, 25 bp, Rattus norvegicus
ggccagccaagtactaatccatgtt

SEQ ID NO: 439727 - DNA, 25 bp, Rattus norvegicus
ggccagccaagttctaatccatgtt

SEQ ID NO: 439728 - DNA, 25 bp, Rattus norvegicus
ggccagccacgcactgtattaggga

SEQ ID NO: 439729 - DNA, 25 bp, Rattus norvegicus
ggccagccacgctctgtattaggga

SEQ ID NO: 439730 - DNA, 25 bp, Rattus norvegicus
ggccagccagagcactgtctcggac

SEQ ID NO: 439731 - DNA, 25 bp, Rattus norvegicus
ggccagccagaggactgtctcggac

SEQ ID NO: 439732 - DNA, 25 bp, Rattus norvegicus
ggccagccagatcttgtttaattcc

SEQ ID NO: 439733 - DNA, 25 bp, Rattus norvegicus
ggccagccagatgttgtttaattcc

SEQ ID NO: 439734 - DNA, 25 bp, Rattus norvegicus
ggccagccagcgctttgtaagaact

SEQ ID NO: 439735 - DNA, 25 bp, Rattus norvegicus
ggccagccagcggtttgtaagaact

SEQ ID NO: 439736 - DNA, 25 bp, Rattus norvegicus
ggccagccaggactacttaggaaaa

SEQ ID NO: 439737 - DNA, 25 bp, Rattus norvegicus
ggccagccaggagtacttaggaaaa

SEQ ID NO: 439738 - DNA, 25 bp, Rattus norvegicus
ggccagcccatactccagaggagaa

SEQ ID NO: 439739 - DNA, 25 bp, Rattus norvegicus
ggccagcccatagtccagaggagaa

SEQ ID NO: 439740 - DNA, 25 bp, Rattus norvegicus
ggccagcccatcctaatttgtataa

SEQ ID NO: 439741 - DNA, 25 bp, Rattus norvegicus
ggccagcccatccttcagattcatg

SEQ ID NO: 439742 - DNA, 25 bp, Rattus norvegicus
ggccagcccatcgtaatttgtataa

SEQ ID NO: 439743 - DNA, 25 bp, Rattus norvegicus
ggccagcccatcgttcagattcatg

SEQ ID NO: 439744 - DNA, 25 bp, Rattus norvegicus
ggccagccggagatccatggtaaga

SEQ ID NO: 439745 - DNA, 25 bp, Rattus norvegicus
ggccagccggagttccatggtaaga

SEQ ID NO: 439746 - DNA, 25 bp, Rattus norvegicus
ggccagcctaggatatatattgaat

SEQ ID NO: 439747 - DNA, 25 bp, Rattus norvegicus
ggccagcctaggttatatattgaat

SEQ ID NO: 439748 - DNA, 25 bp, Rattus norvegicus
ggccagcctcagcattgagcatgta

SEQ ID NO: 439749 - DNA, 25 bp, Rattus norvegicus
ggccagcctcaggattgagcatgta

SEQ ID NO: 439750 - DNA, 25 bp, Rattus norvegicus
ggccagcctcatatacattgtttta

SEQ ID NO: 439751 - DNA, 25 bp, Rattus norvegicus
ggccagcctcatttacattgtttta

SEQ ID NO: 439752 - DNA, 25 bp, Rattus norvegicus
ggccagcctcttcgatgtgatccca

SEQ ID NO: 439753 - DNA, 25 bp, Rattus norvegicus
ggccagcctcttggatgtgatccca

SEQ ID NO: 439754 - DNA, 25 bp, Rattus norvegicus
ggccagcctgaactagtcttctgga

SEQ ID NO: 439755 - DNA, 25 bp, Rattus norvegicus
ggccagcctgaagtagtcttctgga

SEQ ID NO: 439756 - DNA, 25 bp, Rattus norvegicus
ggccagcctgacagcatgtccagaa

SEQ ID NO: 439757 - DNA, 25 bp, Rattus norvegicus
ggccagcctgactgcatgtccagaa

SEQ ID NO: 439758 - DNA, 25 bp, Rattus norvegicus
ggccagcctgagctcagactcccag

SEQ ID NO: 439759 - DNA, 25 bp, Rattus norvegicus
ggccagcctgaggtcagactcccag

SEQ ID NO: 439760 - DNA, 25 bp, Rattus norvegicus
ggccagcctgatatgctgactcaga

SEQ ID NO: 439761 - DNA, 25 bp, Rattus norvegicus
ggccagcctgatttgctgactcaga

SEQ ID NO: 439762 - DNA, 25 bp, Rattus norvegicus
ggccagcctggaatcaataagagtt

SEQ ID NO: 439763 - DNA, 25 bp, Rattus norvegicus
ggccagcctggattcaataagagtt

SEQ ID NO: 439764 - DNA, 25 bp, Rattus norvegicus
ggccagcctggcattaggactgagc

SEQ ID NO: 439765 - DNA, 25 bp, Rattus norvegicus
ggccagcctggctttaggactgagc

SEQ ID NO: 439766 - DNA, 25 bp, Rattus norvegicus
ggccagccttggctaatgacttgta

SEQ ID NO: 439767 - DNA, 25 bp, Rattus norvegicus
ggccagccttgggtaatgacttgta

SEQ ID NO: 439768 - DNA, 25 bp, Rattus norvegicus
ggccagcctttgatgtgcccaaaga

SEQ ID NO: 439769 - DNA, 25 bp, Rattus norvegicus
ggccagcctttgttgtgcccaaaga

SEQ ID NO: 439770 - DNA, 25 bp, Rattus norvegicus
ggccagcgccaacgacaacattaat

SEQ ID NO: 439771 - DNA, 25 bp, Rattus norvegicus
ggccagcgccaaggacaacattaat

SEQ ID NO: 439772 - DNA, 25 bp, Rattus norvegicus
ggccagcgctagacctacagaaggt

SEQ ID NO: 439773 - DNA, 25 bp, Rattus norvegicus
ggccagcgctagtcctacagaaggt

SEQ ID NO: 439774 - DNA, 25 bp, Rattus norvegicus
ggccagcgctgaattgtgtaaggaa

SEQ ID NO: 439775 - DNA, 25 bp, Rattus norvegicus
ggccagcgctgatttgtgtaaggaa

SEQ ID NO: 439776 - DNA, 25 bp, Rattus norvegicus
ggccagcggaaccaacccatttagc

SEQ ID NO: 439777 - DNA, 25 bp, Rattus norvegicus
ggccagcggaacgaacccatttagc

SEQ ID NO: 439778 - DNA, 25 bp, Rattus norvegicus
ggccagctaagtataagcctttgct

SEQ ID NO: 439779 - DNA, 25 bp, Rattus norvegicus
ggccagctaagtttaagcctttgct

SEQ ID NO: 439780 - DNA, 25 bp, Rattus norvegicus
ggccagctacccaggtgagttccag

SEQ ID NO: 439781 - DNA, 25 bp, Rattus norvegicus
ggccagctaccctggtgagttccag

SEQ ID NO: 439782 - DNA, 25 bp, Rattus norvegicus
ggccagctacgccaatgtggtgcta

SEQ ID NO: 439783 - DNA, 25 bp, Rattus norvegicus
ggccagctacgcgaatgtggtgcta

SEQ ID NO: 439784 - DNA, 25 bp, Rattus norvegicus
ggccagctacttcgaattaggtgaa

SEQ ID NO: 439785 - DNA, 25 bp, Rattus norvegicus
ggccagctacttggaattaggtgaa

SEQ ID NO: 439786 - DNA, 25 bp, Rattus norvegicus
ggccagctattcacattaatttcca

SEQ ID NO: 439787 - DNA, 25 bp, Rattus norvegicus
ggccagctattctcattaatttcca

SEQ ID NO: 439788 - DNA, 25 bp, Rattus norvegicus
ggccagctctttcatataccaggat

SEQ ID NO: 439789 - DNA, 25 bp, Rattus norvegicus
ggccagctctttgatataccaggat

SEQ ID NO: 439790 - DNA, 25 bp, Rattus norvegicus
ggccagctgcaaaaggcgccctgct

SEQ ID NO: 439791 - DNA, 25 bp, Rattus norvegicus
ggccagctgcaataggcgccctgct

SEQ ID NO: 439792 - DNA, 25 bp, Rattus norvegicus
ggccagctgcataccaagatagaga

SEQ ID NO: 439793 - DNA, 25 bp, Rattus norvegicus
ggccagctgcattccaagatagaga

SEQ ID NO: 439794 - DNA, 25 bp, Rattus norvegicus
ggccagctgtgccacttaaccagag

SEQ ID NO: 439795 - DNA, 25 bp, Rattus norvegicus
ggccagctgtgcgacttaaccagag

SEQ ID NO: 439796 - DNA, 25 bp, Rattus norvegicus
ggccagcttaacacggcaagattgc

SEQ ID NO: 439797 - DNA, 25 bp, Rattus norvegicus
ggccagcttaactcggcaagattgc

SEQ ID NO: 439798 - DNA, 25 bp, Rattus norvegicus
ggccagcttacaactgtgtcgtttg

SEQ ID NO: 439799 - DNA, 25 bp, Rattus norvegicus
ggccagcttacatctgtgtcgtttg

SEQ ID NO: 439800 - DNA, 25 bp, Rattus norvegicus
ggccagcttctacaccaagtatgat

SEQ ID NO: 439801 - DNA, 25 bp, Rattus norvegicus
ggccagcttctagaccaagtatgat

SEQ ID NO: 439802 - DNA, 25 bp, Rattus norvegicus
ggccagctttttaatgtgggttgtg

SEQ ID NO: 439803 - DNA, 25 bp, Rattus norvegicus
ggccagcttttttatgtgggttgtg

SEQ ID NO: 439804 - DNA, 25 bp, Rattus norvegicus
ggccaggaaccaccgtatacaatta

SEQ ID NO: 439805 - DNA, 25 bp, Rattus norvegicus
ggccaggaaccagcgtatacaatta

SEQ ID NO: 439806 - DNA, 25 bp, Rattus norvegicus
ggccaggaaggcattgcggtctctt

SEQ ID NO: 439807 - DNA, 25 bp, Rattus norvegicus
ggccaggaaggctttgcggtctctt

SEQ ID NO: 439808 - DNA, 25 bp, Rattus norvegicus
ggccaggaatacatagctaggacat

SEQ ID NO: 439809 - DNA, 25 bp, Rattus norvegicus
ggccaggaatacttagctaggacat

SEQ ID NO: 439810 - DNA, 25 bp, Rattus norvegicus
ggccaggacacacaaacgcagctat

SEQ ID NO: 439811 - DNA, 25 bp, Rattus norvegicus
ggccaggacacagaaacgcagctat

SEQ ID NO: 439812 - DNA, 25 bp, Rattus norvegicus
ggccaggaccttcaagaatctaaga

SEQ ID NO: 439813 - DNA, 25 bp, Rattus norvegicus
ggccaggaccttgaagaatctaaga

SEQ ID NO: 439814 - DNA, 25 bp, Rattus norvegicus
ggccaggagcgcactgtgacaatgt

SEQ ID NO: 439815 - DNA, 25 bp, Rattus norvegicus
ggccaggagcgctctgtgacaatgt

SEQ ID NO: 439816 - DNA, 25 bp, Rattus norvegicus
ggccaggaggtaccaactgtcactc

SEQ ID NO: 439817 - DNA, 25 bp, Rattus norvegicus
ggccaggaggtagcaactgtcactc

SEQ ID NO: 439818 - DNA, 25 bp, Rattus norvegicus
ggccaggagtcaaaaaatgctacat

SEQ ID NO: 439819 - DNA, 25 bp, Rattus norvegicus
ggccaggagtcataaaatgctacat

SEQ ID NO: 439820 - DNA, 25 bp, Rattus norvegicus
ggccaggatgacagacttgcaacaa

SEQ ID NO: 439821 - DNA, 25 bp, Rattus norvegicus
ggccaggatgactgacttgcaacaa

SEQ ID NO: 439822 - DNA, 25 bp, Rattus norvegicus
ggccaggcaaccactttccagatga

SEQ ID NO: 439823 - DNA, 25 bp, Rattus norvegicus
ggccaggcaacctctttccagatga

SEQ ID NO: 439824 - DNA, 25 bp, Rattus norvegicus
ggccaggcactgactttgcatcaag

SEQ ID NO: 439825 - DNA, 25 bp, Rattus norvegicus
ggccaggcactgtctttgcatcaag

SEQ ID NO: 439826 - DNA, 25 bp, Rattus norvegicus
ggccaggcagaacaccaacgtgttt

SEQ ID NO: 439827 - DNA, 25 bp, Rattus norvegicus
ggccaggcagaagaccaacgtgttt

SEQ ID NO: 439828 - DNA, 25 bp, Rattus norvegicus
ggccaggcataaaaaacacattcct

SEQ ID NO: 439829 - DNA, 25 bp, Rattus norvegicus
ggccaggcataataaacacattcct

SEQ ID NO: 439830 - DNA, 25 bp, Rattus norvegicus
ggccaggcatcacttgaggttgttc

SEQ ID NO: 439831 - DNA, 25 bp, Rattus norvegicus
ggccaggcatcagttgaggttgttc

SEQ ID NO: 439832 - DNA, 25 bp, Rattus norvegicus
ggccaggcatggatcttagtgaaga

SEQ ID NO: 439833 - DNA, 25 bp, Rattus norvegicus
ggccaggcatggttcttagtgaaga

SEQ ID NO: 439834 - DNA, 25 bp, Rattus norvegicus
ggccaggcatttaatctgttagaca

SEQ ID NO: 439835 - DNA, 25 bp, Rattus norvegicus
ggccaggcattttatctgttagaca

SEQ ID NO: 439836 - DNA, 25 bp, Rattus norvegicus
ggccaggccggcaagacaagctcat

SEQ ID NO: 439837 - DNA, 25 bp, Rattus norvegicus
ggccaggccggctagacaagctcat

SEQ ID NO: 439838 - DNA, 25 bp, Rattus norvegicus
ggccaggcctttatacattcatttg

SEQ ID NO: 439839 - DNA, 25 bp, Rattus norvegicus
ggccaggcctttatgttttatcaca

SEQ ID NO: 439840 - DNA, 25 bp, Rattus norvegicus
ggccaggcctttttacattcatttg

SEQ ID NO: 439841 - DNA, 25 bp, Rattus norvegicus
ggccaggcctttttgttttatcaca

SEQ ID NO: 439842 - DNA, 25 bp, Rattus norvegicus
ggccaggcgtgcaggcacatgcctt

SEQ ID NO: 439843 - DNA, 25 bp, Rattus norvegicus
ggccaggcgtgctggcacatgcctt

SEQ ID NO: 439844 - DNA, 25 bp, Rattus norvegicus
ggccaggctggcctttattgtaaga

SEQ ID NO: 439845 - DNA, 25 bp, Rattus norvegicus
ggccaggctggcgtttattgtaaga

SEQ ID NO: 439846 - DNA, 25 bp, Rattus norvegicus
ggccaggctggtctagagagagata

SEQ ID NO: 439847 - DNA, 25 bp, Rattus norvegicus
ggccaggctggtgtagagagagata

SEQ ID NO: 439848 - DNA, 25 bp, Rattus norvegicus
ggccaggctgtcacgtgtgcacact

SEQ ID NO: 439849 - DNA, 25 bp, Rattus norvegicus
ggccaggctgtctcgtgtgcacact

SEQ ID NO: 439850 - DNA, 25 bp, Rattus norvegicus
ggccaggctgttctccttaactgag

SEQ ID NO: 439851 - DNA, 25 bp, Rattus norvegicus
ggccaggctgttgtccttaactgag

SEQ ID NO: 439852 - DNA, 25 bp, Rattus norvegicus
ggccagggaaacaggcatctgccct

SEQ ID NO: 439853 - DNA, 25 bp, Rattus norvegicus
ggccagggaaactggcatctgccct

SEQ ID NO: 439854 - DNA, 25 bp, Rattus norvegicus
ggccagggacgcagggttcttcaca

SEQ ID NO: 439855 - DNA, 25 bp, Rattus norvegicus
ggccagggacgctgggttcttcaca

SEQ ID NO: 439856 - DNA, 25 bp, Rattus norvegicus
ggccagggagttatatgtttccgat

SEQ ID NO: 439857 - DNA, 25 bp, Rattus norvegicus
ggccagggagttttatgtttccgat

SEQ ID NO: 439858 - DNA, 25 bp, Rattus norvegicus
ggccagggccagcagcaccaaatga

SEQ ID NO: 439859 - DNA, 25 bp, Rattus norvegicus
ggccagggccaggagcaccaaatga

SEQ ID NO: 439860 - DNA, 25 bp, Rattus norvegicus
ggccagggccggcattcagttaata

SEQ ID NO: 439861 - DNA, 25 bp, Rattus norvegicus
ggccagggccgggattcagttaata

SEQ ID NO: 439862 - DNA, 25 bp, Rattus norvegicus
ggccagggctatcctgagaaatcct

SEQ ID NO: 439863 - DNA, 25 bp, Rattus norvegicus
ggccagggctatgctgagaaatcct

SEQ ID NO: 439864 - DNA, 25 bp, Rattus norvegicus
ggccagggctctacaggttgatgct

SEQ ID NO: 439865 - DNA, 25 bp, Rattus norvegicus
ggccagggctcttcaggttgatgct

SEQ ID NO: 439866 - DNA, 25 bp, Rattus norvegicus
ggccagggtcggcatgaacccaaca

SEQ ID NO: 439867 - DNA, 25 bp, Rattus norvegicus
ggccagggtcgggatgaacccaaca

SEQ ID NO: 439868 - DNA, 25 bp, Rattus norvegicus
ggccaggtacccaatcagctgagga

SEQ ID NO: 439869 - DNA, 25 bp, Rattus norvegicus
ggccaggtaccctatcagctgagga

SEQ ID NO: 439870 - DNA, 25 bp, Rattus norvegicus
ggccaggtatttactctgatttttt

SEQ ID NO: 439871 - DNA, 25 bp, Rattus norvegicus
ggccaggtattttctctgatttttt

SEQ ID NO: 439872 - DNA, 25 bp, Rattus norvegicus
ggccaggtctgtagtcaagagtctt

SEQ ID NO: 439873 - DNA, 25 bp, Rattus norvegicus
ggccaggtctgttgtcaagagtctt

SEQ ID NO: 439874 - DNA, 25 bp, Rattus norvegicus
ggccaggtgccaacagaacagtaat

SEQ ID NO: 439875 - DNA, 25 bp, Rattus norvegicus
ggccaggtgccatcagaacagtaat

SEQ ID NO: 439876 - DNA, 25 bp, Rattus norvegicus
ggccaggtgttcagaagcggataaa

SEQ ID NO: 439877 - DNA, 25 bp, Rattus norvegicus
ggccaggtgttctgaagcggataaa

SEQ ID NO: 439878 - DNA, 25 bp, Rattus norvegicus
ggccaggttagtcggcaaaactcaa

SEQ ID NO: 439879 - DNA, 25 bp, Rattus norvegicus
ggccaggttagtgggcaaaactcaa

SEQ ID NO: 439880 - DNA, 25 bp, Rattus norvegicus
ggccaggtttcaccatcgcagacaa

SEQ ID NO: 439881 - DNA, 25 bp, Rattus norvegicus
ggccaggtttcagcatcgcagacaa

SEQ ID NO: 439882 - DNA, 25 bp, Rattus norvegicus
ggccagtacaatacatttccaagca

SEQ ID NO: 439883 - DNA, 25 bp, Rattus norvegicus
ggccagtacaattcatttccaagca

SEQ ID NO: 439884 - DNA, 25 bp, Rattus norvegicus
ggccagtcagcaagcttgtcacgaa

SEQ ID NO: 439885 - DNA, 25 bp, Rattus norvegicus
ggccagtcagcatgcttgtcacgaa

SEQ ID NO: 439886 - DNA, 25 bp, Rattus norvegicus
ggccagtcagtaaaatccattttca

SEQ ID NO: 439887 - DNA, 25 bp, Rattus norvegicus
ggccagtcagtataatccattttca

SEQ ID NO: 439888 - DNA, 25 bp, Rattus norvegicus
ggccagtctacaatgattacccata

SEQ ID NO: 439889 - DNA, 25 bp, Rattus norvegicus
ggccagtctacattgattacccata

SEQ ID NO: 439890 - DNA, 25 bp, Rattus norvegicus
ggccagtctctcaggactttgtgaa

SEQ ID NO: 439891 - DNA, 25 bp, Rattus norvegicus
ggccagtctctctggactttgtgaa

SEQ ID NO: 439892 - DNA, 25 bp, Rattus norvegicus
ggccagtctcttactcagattggga

SEQ ID NO: 439893 - DNA, 25 bp, Rattus norvegicus
ggccagtctctttctcagattggga

SEQ ID NO: 439894 - DNA, 25 bp, Rattus norvegicus
ggccagtctggaaaagtctgagctt

SEQ ID NO: 439895 - DNA, 25 bp, Rattus norvegicus
ggccagtctggataagtctgagctt

SEQ ID NO: 439896 - DNA, 25 bp, Rattus norvegicus
ggccagtcttccatttttgttgttg

SEQ ID NO: 439897 - DNA, 25 bp, Rattus norvegicus
ggccagtcttccttttttgttgttg

SEQ ID NO: 439898 - DNA, 25 bp, Rattus norvegicus
ggccagtgaacccaaccaagagcag

SEQ ID NO: 439899 - DNA, 25 bp, Rattus norvegicus
ggccagtgaaccgaaccaagagcag

SEQ ID NO: 439900 - DNA, 25 bp, Rattus norvegicus
ggccagtgaagaccccaaaatagga

SEQ ID NO: 439901 - DNA, 25 bp, Rattus norvegicus
ggccagtgaagagcccaaaatagga

SEQ ID NO: 439902 - DNA, 25 bp, Rattus norvegicus
ggccagtgataaccacatgtacagt

SEQ ID NO: 439903 - DNA, 25 bp, Rattus norvegicus
ggccagtgataagcacatgtacagt

SEQ ID NO: 439904 - DNA, 25 bp, Rattus norvegicus
ggccagtgccacaagagttctggat

SEQ ID NO: 439905 - DNA, 25 bp, Rattus norvegicus
ggccagtgccactagagttctggat

SEQ ID NO: 439906 - DNA, 25 bp, Rattus norvegicus
ggccagtgccagcatgatttctgca

SEQ ID NO: 439907 - DNA, 25 bp, Rattus norvegicus
ggccagtgccaggatgatttctgca

SEQ ID NO: 439908 - DNA, 25 bp, Rattus norvegicus
ggccagtggcctagagaaagcttca

SEQ ID NO: 439909 - DNA, 25 bp, Rattus norvegicus
ggccagtggccttgagaaagcttca

SEQ ID NO: 439910 - DNA, 25 bp, Rattus norvegicus
ggccagtgggttagacctgatttca

SEQ ID NO: 439911 - DNA, 25 bp, Rattus norvegicus
ggccagtgggtttgacctgatttca

SEQ ID NO: 439912 - DNA, 25 bp, Rattus norvegicus
ggccagtgtagcagtcttgactcag

SEQ ID NO: 439913 - DNA, 25 bp, Rattus norvegicus
ggccagtgtagctgtcttgactcag

SEQ ID NO: 439914 - DNA, 25 bp, Rattus norvegicus
ggccagtgtgcactcacagcactga

SEQ ID NO: 439915 - DNA, 25 bp, Rattus norvegicus
ggccagtgtgcagtcacagcactga

SEQ ID NO: 439916 - DNA, 25 bp, Rattus norvegicus
ggccagtgtgtacacatttgctttt

SEQ ID NO: 439917 - DNA, 25 bp, Rattus norvegicus
ggccagtgtgtagacatttgctttt

SEQ ID NO: 439918 - DNA, 25 bp, Rattus norvegicus
ggccagttaaggaggctctagccat

SEQ ID NO: 439919 - DNA, 25 bp, Rattus norvegicus
ggccagttaaggtggctctagccat

SEQ ID NO: 439920 - DNA, 25 bp, Rattus norvegicus
ggccagttcaatctgtaagtatcga

SEQ ID NO: 439921 - DNA, 25 bp, Rattus norvegicus
ggccagttcaatgtgtaagtatcga

SEQ ID NO: 439922 - DNA, 25 bp, Rattus norvegicus
ggccagttcctgacttagtttataa

SEQ ID NO: 439923 - DNA, 25 bp, Rattus norvegicus
ggccagttcctgtcttagtttataa

SEQ ID NO: 439924 - DNA, 25 bp, Rattus norvegicus
ggccagttctggctctcagcctact

SEQ ID NO: 439925 - DNA, 25 bp, Rattus norvegicus
ggccagttctgggtctcagcctact

SEQ ID NO: 439926 - DNA, 25 bp, Rattus norvegicus
ggccagttctgtatctaaggtgtac

SEQ ID NO: 439927 - DNA, 25 bp, Rattus norvegicus
ggccagttctgtttctaaggtgtac

SEQ ID NO: 439928 - DNA, 25 bp, Rattus norvegicus
ggccagttcttcaaagtggacactt

SEQ ID NO: 439929 - DNA, 25 bp, Rattus norvegicus
ggccagttcttctaagtggacactt

SEQ ID NO: 439930 - DNA, 25 bp, Rattus norvegicus
ggccagttgctgactgttgctttaa

SEQ ID NO: 439931 - DNA, 25 bp, Rattus norvegicus
ggccagttgctgtctgttgctttaa

SEQ ID NO: 439932 - DNA, 25 bp, Rattus norvegicus
ggccagtttaagcatgttatcccag

SEQ ID NO: 439933 - DNA, 25 bp, Rattus norvegicus
ggccagtttaaggatgttatcccag

SEQ ID NO: 439934 - DNA, 25 bp, Rattus norvegicus
ggccagtttgttacctctctgtcta

SEQ ID NO: 439935 - DNA, 25 bp, Rattus norvegicus
ggccagtttgttactttagcattta

SEQ ID NO: 439936 - DNA, 25 bp, Rattus norvegicus
ggccagtttgtttcctctctgtcta

SEQ ID NO: 439937 - DNA, 25 bp, Rattus norvegicus
ggccagtttgtttctttagcattta

SEQ ID NO: 439938 - DNA, 25 bp, Rattus norvegicus
ggccagttttccagatgccatctag

SEQ ID NO: 439939 - DNA, 25 bp, Rattus norvegicus
ggccagttttcctgatgccatctag

SEQ ID NO: 439940 - DNA, 25 bp, Rattus norvegicus
ggccagttttgcattaagatcttat

SEQ ID NO: 439941 - DNA, 25 bp, Rattus norvegicus
ggccagttttgctttaagatcttat

SEQ ID NO: 439942 - DNA, 25 bp, Rattus norvegicus
ggccataacataccatacatgctgt

SEQ ID NO: 439943 - DNA, 25 bp, Rattus norvegicus
ggccataacatagcatacatgctgt

SEQ ID NO: 439944 - DNA, 25 bp, Rattus norvegicus
ggccataattagctgtgtgtccctg

SEQ ID NO: 439945 - DNA, 25 bp, Rattus norvegicus
ggccataattaggtgtgtgtccctg

SEQ ID NO: 439946 - DNA, 25 bp, Rattus norvegicus
ggccataccattctgcatcaggaat

SEQ ID NO: 439947 - DNA, 25 bp, Rattus norvegicus
ggccataccattgtgcatcaggaat

SEQ ID NO: 439948 - DNA, 25 bp, Rattus norvegicus
ggccatagaccaaacatacgatcag

SEQ ID NO: 439949 - DNA, 25 bp, Rattus norvegicus
ggccatagaccatacatacgatcag

SEQ ID NO: 439950 - DNA, 25 bp, Rattus norvegicus
ggccatagatcactctggaaagatt

SEQ ID NO: 439951 - DNA, 25 bp, Rattus norvegicus
ggccatagatcagtctggaaagatt

SEQ ID NO: 439952 - DNA, 25 bp, Rattus norvegicus
ggccataggtagataagaatatttc

SEQ ID NO: 439953 - DNA, 25 bp, Rattus norvegicus
ggccataggtagttaagaatatttc

SEQ ID NO: 439954 - DNA, 25 bp, Rattus norvegicus
ggccatagtcaaaccttgtctctag

SEQ ID NO: 439955 - DNA, 25 bp, Rattus norvegicus
ggccatagtcaatccttgtctctag

SEQ ID NO: 439956 - DNA, 25 bp, Rattus norvegicus
ggccatatatccaaggtttctaaga

SEQ ID NO: 439957 - DNA, 25 bp, Rattus norvegicus
ggccatatatcctaggtttctaaga

SEQ ID NO: 439958 - DNA, 25 bp, Rattus norvegicus
ggccatatggttcctgtgttgagac

SEQ ID NO: 439959 - DNA, 25 bp, Rattus norvegicus
ggccatatggttgctgtgttgagac

SEQ ID NO: 439960 - DNA, 25 bp, Rattus norvegicus
ggccatatgttgactgccttattga

SEQ ID NO: 439961 - DNA, 25 bp, Rattus norvegicus
ggccatatgttgtctgccttattga

SEQ ID NO: 439962 - DNA, 25 bp, Rattus norvegicus
ggccatattctaatgcttgtgcagc

SEQ ID NO: 439963 - DNA, 25 bp, Rattus norvegicus
ggccatattctattgcttgtgcagc

SEQ ID NO: 439964 - DNA, 25 bp, Rattus norvegicus
ggccatcaagggaatgcatatccgc

SEQ ID NO: 439965 - DNA, 25 bp, Rattus norvegicus
ggccatcaagggtatgcatatccgc

SEQ ID NO: 439966 - DNA, 25 bp, Rattus norvegicus
ggccatcacataagccaaaggattt

SEQ ID NO: 439967 - DNA, 25 bp, Rattus norvegicus
ggccatcacatatgccaaaggattt

SEQ ID NO: 439968 - DNA, 25 bp, Rattus norvegicus
ggccatcagcttcggctatgctaac

SEQ ID NO: 439969 - DNA, 25 bp, Rattus norvegicus
ggccatcagcttgggctatgctaac

SEQ ID NO: 439970 - DNA, 25 bp, Rattus norvegicus
ggccatcaggcacttttcaagttat

SEQ ID NO: 439971 - DNA, 25 bp, Rattus norvegicus
ggccatcaggcagttttcaagttat

SEQ ID NO: 439972 - DNA, 25 bp, Rattus norvegicus
ggccatcatcaaaagtcctttctgc

SEQ ID NO: 439973 - DNA, 25 bp, Rattus norvegicus
ggccatcatcaatagtcctttctgc

SEQ ID NO: 439974 - DNA, 25 bp, Rattus norvegicus
ggccatcatctgagagagaatccat

SEQ ID NO: 439975 - DNA, 25 bp, Rattus norvegicus
ggccatcatctgtgagagaatccat

SEQ ID NO: 439976 - DNA, 25 bp, Rattus norvegicus
ggccatccaattacctgttttacag

SEQ ID NO: 439977 - DNA, 25 bp, Rattus norvegicus
ggccatccaatttcctgttttacag

SEQ ID NO: 439978 - DNA, 25 bp, Rattus norvegicus
ggccatccagatccagtgagaccag

SEQ ID NO: 439979 - DNA, 25 bp, Rattus norvegicus
ggccatccagatgcagtgagaccag

SEQ ID NO: 439980 - DNA, 25 bp, Rattus norvegicus
ggccatccaggactatatataagtg

SEQ ID NO: 439981 - DNA, 25 bp, Rattus norvegicus
ggccatccaggagtatatataagtg

SEQ ID NO: 439982 - DNA, 25 bp, Rattus norvegicus
ggccatcccaaacggtttgcatata

SEQ ID NO: 439983 - DNA, 25 bp, Rattus norvegicus
ggccatcccaaagggtttgcatata

SEQ ID NO: 439984 - DNA, 25 bp, Rattus norvegicus
ggccatccctagcaggaataccttt

SEQ ID NO: 439985 - DNA, 25 bp, Rattus norvegicus
ggccatccctaggaggaataccttt

SEQ ID NO: 439986 - DNA, 25 bp, Rattus norvegicus
ggccatcccttgaagtcacttgagc

SEQ ID NO: 439987 - DNA, 25 bp, Rattus norvegicus
ggccatcccttgtagtcacttgagc

SEQ ID NO: 439988 - DNA, 25 bp, Rattus norvegicus
ggccatcctccacatttaataaggg

SEQ ID NO: 439989 - DNA, 25 bp, Rattus norvegicus
ggccatcctccagatttaataaggg

SEQ ID NO: 439990 - DNA, 25 bp, Rattus norvegicus
ggccatcctctgctaagcaagtttg

SEQ ID NO: 439991 - DNA, 25 bp, Rattus norvegicus
ggccatcctctggtaagcaagtttg

SEQ ID NO: 439992 - DNA, 25 bp, Rattus norvegicus
ggccatccttccagggcccggtaat

SEQ ID NO: 439993 - DNA, 25 bp, Rattus norvegicus
ggccatccttcctgggcccggtaat

SEQ ID NO: 439994 - DNA, 25 bp, Rattus norvegicus
ggccatcgacaacaccctgagtgag

SEQ ID NO: 439995 - DNA, 25 bp, Rattus norvegicus
ggccatcgacaagaccctgagtgag

SEQ ID NO: 439996 - DNA, 25 bp, Rattus norvegicus
ggccatcgcacccttattttgaaaa

SEQ ID NO: 439997 - DNA, 25 bp, Rattus norvegicus
ggccatcgcaccgttattttgaaaa

SEQ ID NO: 439998 - DNA, 25 bp, Rattus norvegicus
ggccatcggtttaaaagtgttgtca

SEQ ID NO: 439999 - DNA, 25 bp, Rattus norvegicus
ggccatcggttttaaagtgttgtca

SEQ ID NO: 440000 - DNA, 25 bp, Rattus norvegicus
ggccatcgtcacaggagctggagat

SEQ ID NO: 440001 - DNA, 25 bp, Rattus norvegicus
ggccatcgtcactggagctggagat

SEQ ID NO: 440002 - DNA, 25 bp, Rattus norvegicus
ggccatctctccagtgtcaatggat

SEQ ID NO: 440003 - DNA, 25 bp, Rattus norvegicus
ggccatctctcctgtgtcaatggat

SEQ ID NO: 440004 - DNA, 25 bp, Rattus norvegicus
ggccatctgctaagtgccaggacct

SEQ ID NO: 440005 - DNA, 25 bp, Rattus norvegicus
ggccatctgctatgtgccaggacct

SEQ ID NO: 440006 - DNA, 25 bp, Rattus norvegicus
ggccatctgggaccgaatactgcaa

SEQ ID NO: 440007 - DNA, 25 bp, Rattus norvegicus
ggccatctgggagcgaatactgcaa

SEQ ID NO: 440008 - DNA, 25 bp, Rattus norvegicus
ggccatctgtggatcaagggacaaa

SEQ ID NO: 440009 - DNA, 25 bp, Rattus norvegicus
ggccatctgtggttcaagggacaaa

SEQ ID NO: 440010 - DNA, 25 bp, Rattus norvegicus
ggccatcttcttaatttctaactcc

SEQ ID NO: 440011 - DNA, 25 bp, Rattus norvegicus
ggccatcttctttatttctaactcc

SEQ ID NO: 440012 - DNA, 25 bp, Rattus norvegicus
ggccatcttgtcaccacagagagca

SEQ ID NO: 440013 - DNA, 25 bp, Rattus norvegicus
ggccatcttgtctccacagagagca

SEQ ID NO: 440014 - DNA, 25 bp, Rattus norvegicus
ggccatctttacacaatttcgtcaa

SEQ ID NO: 440015 - DNA, 25 bp, Rattus norvegicus
ggccatctttactcaatttcgtcaa

SEQ ID NO: 440016 - DNA, 25 bp, Rattus norvegicus
ggccatgaacctataactctttgct

SEQ ID NO: 440017 - DNA, 25 bp, Rattus norvegicus
ggccatgaacctttaactctttgct

SEQ ID NO: 440018 - DNA, 25 bp, Rattus norvegicus
ggccatgaagagaattccttttttc

SEQ ID NO: 440019 - DNA, 25 bp, Rattus norvegicus
ggccatgaagagtattccttttttc

SEQ ID NO: 440020 - DNA, 25 bp, Rattus norvegicus
ggccatgaagcaaagccaccctctg

SEQ ID NO: 440021 - DNA, 25 bp, Rattus norvegicus
ggccatgaagcatagccaccctctg

SEQ ID NO: 440022 - DNA, 25 bp, Rattus norvegicus
ggccatgaagccatctttcaatgcc

SEQ ID NO: 440023 - DNA, 25 bp, Rattus norvegicus
ggccatgaagccttctttcaatgcc

SEQ ID NO: 440024 - DNA, 25 bp, Rattus norvegicus
ggccatgaagcgcagcgaccctcat

SEQ ID NO: 440025 - DNA, 25 bp, Rattus norvegicus
ggccatgaagcggagcgaccctcat

SEQ ID NO: 440026 - DNA, 25 bp, Rattus norvegicus
ggccatgaattgactccagagctat

SEQ ID NO: 440027 - DNA, 25 bp, Rattus norvegicus
ggccatgaattgtctccagagctat

SEQ ID NO: 440028 - DNA, 25 bp, Rattus norvegicus
ggccatgacgtgcaagtctaagcat

SEQ ID NO: 440029 - DNA, 25 bp, Rattus norvegicus
ggccatgacgtggaagtctaagcat

SEQ ID NO: 440030 - DNA, 25 bp, Rattus norvegicus
ggccatgagatgacttggtccccaa

SEQ ID NO: 440031 - DNA, 25 bp, Rattus norvegicus
ggccatgagatgtcttggtccccaa

SEQ ID NO: 440032 - DNA, 25 bp, Rattus norvegicus
ggccatgagcccataagattcttgc

SEQ ID NO: 440033 - DNA, 25 bp, Rattus norvegicus
ggccatgagcccttaagattcttgc

SEQ ID NO: 440034 - DNA, 25 bp, Rattus norvegicus
ggccatgagtacaaggtctccttga

SEQ ID NO: 440035 - DNA, 25 bp, Rattus norvegicus
ggccatgagtactaggtctccttga

SEQ ID NO: 440036 - DNA, 25 bp, Rattus norvegicus
ggccatgattcaaatatctcacatt

SEQ ID NO: 440037 - DNA, 25 bp, Rattus norvegicus
ggccatgattcatatatctcacatt

SEQ ID NO: 440038 - DNA, 25 bp, Rattus norvegicus
ggccatgcagggaatgaagcgctct

SEQ ID NO: 440039 - DNA, 25 bp, Rattus norvegicus
ggccatgcagggtatgaagcgctct

SEQ ID NO: 440040 - DNA, 25 bp, Rattus norvegicus
ggccatgccgtcaggaactgtgcag

SEQ ID NO: 440041 - DNA, 25 bp, Rattus norvegicus
ggccatgccgtctggaactgtgcag

SEQ ID NO: 440042 - DNA, 25 bp, Rattus norvegicus
ggccatgcgcatactttgctctcag

SEQ ID NO: 440043 - DNA, 25 bp, Rattus norvegicus
ggccatgcgcattctttgctctcag

SEQ ID NO: 440044 - DNA, 25 bp, Rattus norvegicus
ggccatgcgtccctacaagcaggag

SEQ ID NO: 440045 - DNA, 25 bp, Rattus norvegicus
ggccatgcgtccgtacaagcaggag

SEQ ID NO: 440046 - DNA, 25 bp, Rattus norvegicus
ggccatgctgagaccttagagcaat

SEQ ID NO: 440047 - DNA, 25 bp, Rattus norvegicus
ggccatgctgagtccttagagcaat

SEQ ID NO: 440048 - DNA, 25 bp, Rattus norvegicus
ggccatgctggcaaaatgtgcttga

SEQ ID NO: 440049 - DNA, 25 bp, Rattus norvegicus
ggccatgctggctaaatgtgcttga

SEQ ID NO: 440050 - DNA, 25 bp, Rattus norvegicus
ggccatgctggtctactgtgttgta

SEQ ID NO: 440051 - DNA, 25 bp, Rattus norvegicus
ggccatgctggtgtactgtgttgta

SEQ ID NO: 440052 - DNA, 25 bp, Rattus norvegicus
ggccatggaaagcagctaaggtata

SEQ ID NO: 440053 - DNA, 25 bp, Rattus norvegicus
ggccatggaaaggagctaaggtata

SEQ ID NO: 440054 - DNA, 25 bp, Rattus norvegicus
ggccatggaaatacaacctgcctgg

SEQ ID NO: 440055 - DNA, 25 bp, Rattus norvegicus
ggccatggaaattcaacctgcctgg

SEQ ID NO: 440056 - DNA, 25 bp, Rattus norvegicus
ggccatggaagacctcagagagatc

SEQ ID NO: 440057 - DNA, 25 bp, Rattus norvegicus
ggccatggaagagctcagagagatc

SEQ ID NO: 440058 - DNA, 25 bp, Rattus norvegicus
ggccatggactcatttgtgatgtta

SEQ ID NO: 440059 - DNA, 25 bp, Rattus norvegicus
ggccatggactcttttgtgatgtta

SEQ ID NO: 440060 - DNA, 25 bp, Rattus norvegicus
ggccatggagagagtcccttcttaa

SEQ ID NO: 440061 - DNA, 25 bp, Rattus norvegicus
ggccatggagagtgtcccttcttaa

SEQ ID NO: 440062 - DNA, 25 bp, Rattus norvegicus
ggccatggcaaaagcatgcttcgac

SEQ ID NO: 440063 - DNA, 25 bp, Rattus norvegicus
ggccatggcaaatgcatgcttcgac

SEQ ID NO: 440064 - DNA, 25 bp, Rattus norvegicus
ggccatggccttagtgacattggaa

SEQ ID NO: 440065 - DNA, 25 bp, Rattus norvegicus
ggccatggcctttgtgacattggaa

SEQ ID NO: 440066 - DNA, 25 bp, Rattus norvegicus
ggccatggcgcccacattcttcatt

SEQ ID NO: 440067 - DNA, 25 bp, Rattus norvegicus
ggccatggcgccgacattcttcatt

SEQ ID NO: 440068 - DNA, 25 bp, Rattus norvegicus
ggccatggcgtacaataagaagaac

SEQ ID NO: 440069 - DNA, 25 bp, Rattus norvegicus
ggccatggcgtagaataagaagaac

SEQ ID NO: 440070 - DNA, 25 bp, Rattus norvegicus
ggccatggctctacacagatgtatt

SEQ ID NO: 440071 - DNA, 25 bp, Rattus norvegicus
ggccatggctcttcacagatgtatt

SEQ ID NO: 440072 - DNA, 25 bp, Rattus norvegicus
ggccatgggatcacagggtacgcat

SEQ ID NO: 440073 - DNA, 25 bp, Rattus norvegicus
ggccatgggatctcagggtacgcat

SEQ ID NO: 440074 - DNA, 25 bp, Rattus norvegicus
ggccatgggctcaggttttataatg

SEQ ID NO: 440075 - DNA, 25 bp, Rattus norvegicus
ggccatgggctctggttttataatg

SEQ ID NO: 440076 - DNA, 25 bp, Rattus norvegicus
ggccatgtacacacgggtcagcaag

SEQ ID NO: 440077 - DNA, 25 bp, Rattus norvegicus
ggccatgtacactcgggtcagcaag

SEQ ID NO: 440078 - DNA, 25 bp, Rattus norvegicus
ggccatgtattgattaccttcaaag

SEQ ID NO: 440079 - DNA, 25 bp, Rattus norvegicus
ggccatgtattgtttaccttcaaag

SEQ ID NO: 440080 - DNA, 25 bp, Rattus norvegicus
ggccatgtcaagatgcctgatgaag

SEQ ID NO: 440081 - DNA, 25 bp, Rattus norvegicus
ggccatgtcaagttgcctgatgaag

SEQ ID NO: 440082 - DNA, 25 bp, Rattus norvegicus
ggccatgtctcccttaactggatct

SEQ ID NO: 440083 - DNA, 25 bp, Rattus norvegicus
ggccatgtctccgttaactggatct

SEQ ID NO: 440084 - DNA, 25 bp, Rattus norvegicus
ggccatgtctttcaggagtcccagg

SEQ ID NO: 440085 - DNA, 25 bp, Rattus norvegicus
ggccatgtctttgaggagtcccagg

SEQ ID NO: 440086 - DNA, 25 bp, Rattus norvegicus
ggccatgtgggtctccaacccactt

SEQ ID NO: 440087 - DNA, 25 bp, Rattus norvegicus
ggccatgtgggtgtccaacccactt

SEQ ID NO: 440088 - DNA, 25 bp, Rattus norvegicus
ggccatgtggtgagcatacttcgaa

SEQ ID NO: 440089 - DNA, 25 bp, Rattus norvegicus
ggccatgtggtgtgcatacttcgaa

SEQ ID NO: 440090 - DNA, 25 bp, Rattus norvegicus
ggccatgtttagatctgttcagctc

SEQ ID NO: 440091 - DNA, 25 bp, Rattus norvegicus
ggccatgtttagttctgttcagctc

SEQ ID NO: 440092 - DNA, 25 bp, Rattus norvegicus
ggccatgtttccagacgtcgacgaa

SEQ ID NO: 440093 - DNA, 25 bp, Rattus norvegicus
ggccatgtttcctgacgtcgacgaa

SEQ ID NO: 440094 - DNA, 25 bp, Rattus norvegicus
ggccattaagcaccgtctgcggcaa

SEQ ID NO: 440095 - DNA, 25 bp, Rattus norvegicus
ggccattaagcagcgtctgcggcaa

SEQ ID NO: 440096 - DNA, 25 bp, Rattus norvegicus
ggccattactggctttgctaaatct

SEQ ID NO: 440097 - DNA, 25 bp, Rattus norvegicus
ggccattactgggtttgctaaatct

SEQ ID NO: 440098 - DNA, 25 bp, Rattus norvegicus
ggccattagtgcagaatgccctttt

SEQ ID NO: 440099 - DNA, 25 bp, Rattus norvegicus
ggccattagtgctgaatgccctttt

SEQ ID NO: 440100 - DNA, 25 bp, Rattus norvegicus
ggccattataatctgcaagcaattg

SEQ ID NO: 440101 - DNA, 25 bp, Rattus norvegicus
ggccattataatgtgcaagcaattg

SEQ ID NO: 440102 - DNA, 25 bp, Rattus norvegicus
ggccattatgttagccatatcaaga

SEQ ID NO: 440103 - DNA, 25 bp, Rattus norvegicus
ggccattatgtttgccatatcaaga

SEQ ID NO: 440104 - DNA, 25 bp, Rattus norvegicus
ggccattcaagcattttccctaaaa

SEQ ID NO: 440105 - DNA, 25 bp, Rattus norvegicus
ggccattcaagctttttccctaaaa

SEQ ID NO: 440106 - DNA, 25 bp, Rattus norvegicus
ggccattcactacacctcaaattgg

SEQ ID NO: 440107 - DNA, 25 bp, Rattus norvegicus
ggccattcactagacctcaaattgg

SEQ ID NO: 440108 - DNA, 25 bp, Rattus norvegicus
ggccattcagatccgccaaaataga

SEQ ID NO: 440109 - DNA, 25 bp, Rattus norvegicus
ggccattcagatgcgccaaaataga

SEQ ID NO: 440110 - DNA, 25 bp, Rattus norvegicus
ggccattccacaacgtttttaacta

SEQ ID NO: 440111 - DNA, 25 bp, Rattus norvegicus
ggccattccacatcgtttttaacta

SEQ ID NO: 440112 - DNA, 25 bp, Rattus norvegicus
ggccattccgaaaaaccaggttttg

SEQ ID NO: 440113 - DNA, 25 bp, Rattus norvegicus
ggccattccgaataaccaggttttg

SEQ ID NO: 440114 - DNA, 25 bp, Rattus norvegicus
ggccattccgatattgtaacactga

SEQ ID NO: 440115 - DNA, 25 bp, Rattus norvegicus
ggccattccgattttgtaacactga

SEQ ID NO: 440116 - DNA, 25 bp, Rattus norvegicus
ggccattcctgacgctggattgtga

SEQ ID NO: 440117 - DNA, 25 bp, Rattus norvegicus
ggccattcctgaggctggattgtga

SEQ ID NO: 440118 - DNA, 25 bp, Rattus norvegicus
ggccattctctcagtacctaaagga

SEQ ID NO: 440119 - DNA, 25 bp, Rattus norvegicus
ggccattctctctgtacctaaagga

SEQ ID NO: 440120 - DNA, 25 bp, Rattus norvegicus
ggccattctgagcaatttaccaagg

SEQ ID NO: 440121 - DNA, 25 bp, Rattus norvegicus
ggccattctgaggaatttaccaagg

SEQ ID NO: 440122 - DNA, 25 bp, Rattus norvegicus
ggccattctgctaaatctgcatttt

SEQ ID NO: 440123 - DNA, 25 bp, Rattus norvegicus
ggccattctgcttaatctgcatttt

SEQ ID NO: 440124 - DNA, 25 bp, Rattus norvegicus
ggccattgagcaactttcagactgt

SEQ ID NO: 440125 - DNA, 25 bp, Rattus norvegicus
ggccattgagcatctttcagactgt

SEQ ID NO: 440126 - DNA, 25 bp, Rattus norvegicus
ggccattgagccacggacacaagga

SEQ ID NO: 440127 - DNA, 25 bp, Rattus norvegicus
ggccattgagcctcggacacaagga

SEQ ID NO: 440128 - DNA, 25 bp, Rattus norvegicus
ggccattgctggctatgtgtttaga

SEQ ID NO: 440129 - DNA, 25 bp, Rattus norvegicus
ggccattgctgggtatgtgtttaga

SEQ ID NO: 440130 - DNA, 25 bp, Rattus norvegicus
ggccattggaatatactcatatagc

SEQ ID NO: 440131 - DNA, 25 bp, Rattus norvegicus
ggccattggaatttactcatatagc

SEQ ID NO: 440132 - DNA, 25 bp, Rattus norvegicus
ggccattgggtactctggtccccag

SEQ ID NO: 440133 - DNA, 25 bp, Rattus norvegicus
ggccattgggtagtctggtccccag

SEQ ID NO: 440134 - DNA, 25 bp, Rattus norvegicus
ggccatttaatgactccttaaccta

SEQ ID NO: 440135 - DNA, 25 bp, Rattus norvegicus
ggccatttaatgtctccttaaccta

SEQ ID NO: 440136 - DNA, 25 bp, Rattus norvegicus
ggccatttatgtaaattcacacttg

SEQ ID NO: 440137 - DNA, 25 bp, Rattus norvegicus
ggccatttatgttaattcacacttg

SEQ ID NO: 440138 - DNA, 25 bp, Rattus norvegicus
ggccatttcaagaagcagcctttgc

SEQ ID NO: 440139 - DNA, 25 bp, Rattus norvegicus
ggccatttcaagtagcagcctttgc

SEQ ID NO: 440140 - DNA, 25 bp, Rattus norvegicus
ggccatttcagccactttcaagatg

SEQ ID NO: 440141 - DNA, 25 bp, Rattus norvegicus
ggccatttcagcgactttcaagatg

SEQ ID NO: 440142 - DNA, 25 bp, Rattus norvegicus
ggccatttccagctctgtgggacag

SEQ ID NO: 440143 - DNA, 25 bp, Rattus norvegicus
ggccatttccaggtctgtgggacag

SEQ ID NO: 440144 - DNA, 25 bp, Rattus norvegicus
ggccatttctgaccaaagacttcat

SEQ ID NO: 440145 - DNA, 25 bp, Rattus norvegicus
ggccatttctgagcaaagacttcat

SEQ ID NO: 440146 - DNA, 25 bp, Rattus norvegicus
ggccatttgaaaagcaggctcagca

SEQ ID NO: 440147 - DNA, 25 bp, Rattus norvegicus
ggccatttgaaatgcaggctcagca

SEQ ID NO: 440148 - DNA, 25 bp, Rattus norvegicus
ggccatttgacacagggatgcccac

SEQ ID NO: 440149 - DNA, 25 bp, Rattus norvegicus
ggccatttgacagagggatgcccac

SEQ ID NO: 440150 - DNA, 25 bp, Rattus norvegicus
ggccatttgcttacagggctgcatt

SEQ ID NO: 440151 - DNA, 25 bp, Rattus norvegicus
ggccatttgctttcagggctgcatt

SEQ ID NO: 440152 - DNA, 25 bp, Rattus norvegicus
ggccatttggtacataatcctgcac

SEQ ID NO: 440153 - DNA, 25 bp, Rattus norvegicus
ggccatttggtagataatcctgcac

SEQ ID NO: 440154 - DNA, 25 bp, Rattus norvegicus
ggccattttcatagatctcaccaga

SEQ ID NO: 440155 - DNA, 25 bp, Rattus norvegicus
ggccattttcattgatctcaccaga

SEQ ID NO: 440156 - DNA, 25 bp, Rattus norvegicus
ggccattttctacatgtccagtttt

SEQ ID NO: 440157 - DNA, 25 bp, Rattus norvegicus
ggccattttctagatgtccagtttt

SEQ ID NO: 440158 - DNA, 25 bp, Rattus norvegicus
ggccattttgatccaaattttccag

SEQ ID NO: 440159 - DNA, 25 bp, Rattus norvegicus
ggccattttgatgcaaattttccag

SEQ ID NO: 440160 - DNA, 25 bp, Rattus norvegicus
ggccattttgcacagtgttagacat

SEQ ID NO: 440161 - DNA, 25 bp, Rattus norvegicus
ggccattttgcagagtgttagacat

SEQ ID NO: 440162 - DNA, 25 bp, Rattus norvegicus
ggccattttgtgctgttggtaccca

SEQ ID NO: 440163 - DNA, 25 bp, Rattus norvegicus
ggccattttgtggtgttggtaccca

SEQ ID NO: 440164 - DNA, 25 bp, Rattus norvegicus
ggccatttttagagccactgcctaa

SEQ ID NO: 440165 - DNA, 25 bp, Rattus norvegicus
ggccatttttagtgccactgcctaa

SEQ ID NO: 440166 - DNA, 25 bp, Rattus norvegicus
ggcccaaaatggagtgcagctctgc

SEQ ID NO: 440167 - DNA, 25 bp, Rattus norvegicus
ggcccaaaatggtgtgcagctctgc

SEQ ID NO: 440168 - DNA, 25 bp, Rattus norvegicus
ggcccaaaccaacttcaccaagaag

SEQ ID NO: 440169 - DNA, 25 bp, Rattus norvegicus
ggcccaaaccaagttcaccaagaag

SEQ ID NO: 440170 - DNA, 25 bp, Rattus norvegicus
ggcccaaacttaatagctgttctga

SEQ ID NO: 440171 - DNA, 25 bp, Rattus norvegicus
ggcccaaacttattagctgttctga

SEQ ID NO: 440172 - DNA, 25 bp, Rattus norvegicus
ggcccaaagtagacccaaatgcctt

SEQ ID NO: 440173 - DNA, 25 bp, Rattus norvegicus
ggcccaaagtagtcccaaatgcctt

SEQ ID NO: 440174 - DNA, 25 bp, Rattus norvegicus
ggcccaaattgcataaaagataaag

SEQ ID NO: 440175 - DNA, 25 bp, Rattus norvegicus
ggcccaaattgcttaaaagataaag

SEQ ID NO: 440176 - DNA, 25 bp, Rattus norvegicus
ggcccaacacatagaatttacttct

SEQ ID NO: 440177 - DNA, 25 bp, Rattus norvegicus
ggcccaacacattgaatttacttct

SEQ ID NO: 440178 - DNA, 25 bp, Rattus norvegicus
ggcccaacaggccagatggtattta

SEQ ID NO: 440179 - DNA, 25 bp, Rattus norvegicus
ggcccaacaggcgagatggtattta

SEQ ID NO: 440180 - DNA, 25 bp, Rattus norvegicus
ggcccaacatatccctgtcattcag

SEQ ID NO: 440181 - DNA, 25 bp, Rattus norvegicus
ggcccaacatatgcctgtcattcag

SEQ ID NO: 440182 - DNA, 25 bp, Rattus norvegicus
ggcccaacatctctttaccttgtta

SEQ ID NO: 440183 - DNA, 25 bp, Rattus norvegicus
ggcccaacatctgtttaccttgtta

SEQ ID NO: 440184 - DNA, 25 bp, Rattus norvegicus
ggcccaagaaaccatcagtccagag

SEQ ID NO: 440185 - DNA, 25 bp, Rattus norvegicus
ggcccaagaaacgatcagtccagag

SEQ ID NO: 440186 - DNA, 25 bp, Rattus norvegicus
ggcccaagagctcctttttggtatt

SEQ ID NO: 440187 - DNA, 25 bp, Rattus norvegicus
ggcccaagagctgctttttggtatt

SEQ ID NO: 440188 - DNA, 25 bp, Rattus norvegicus
ggcccaagctcaattcaggatctaa

SEQ ID NO: 440189 - DNA, 25 bp, Rattus norvegicus
ggcccaagctcatttcaggatctaa

SEQ ID NO: 440190 - DNA, 25 bp, Rattus norvegicus
ggcccaaggacaccctgtgaagaga

SEQ ID NO: 440191 - DNA, 25 bp, Rattus norvegicus
ggcccaaggacagcctgtgaagaga

SEQ ID NO: 440192 - DNA, 25 bp, Rattus norvegicus
ggcccaaggccaatatcagtagagt

SEQ ID NO: 440193 - DNA, 25 bp, Rattus norvegicus
ggcccaaggccattatcagtagagt

SEQ ID NO: 440194 - DNA, 25 bp, Rattus norvegicus
ggcccaagggctacaaagacgtctt

SEQ ID NO: 440195 - DNA, 25 bp, Rattus norvegicus
ggcccaagggcttcaaagacgtctt

SEQ ID NO: 440196 - DNA, 25 bp, Rattus norvegicus
ggcccaagtaatattctgcagtctc

SEQ ID NO: 440197 - DNA, 25 bp, Rattus norvegicus
ggcccaagtaattttctgcagtctc

SEQ ID NO: 440198 - DNA, 25 bp, Rattus norvegicus
ggcccaagtgtaccttatttattaa

SEQ ID NO: 440199 - DNA, 25 bp, Rattus norvegicus
ggcccaagtgtagcttatttattaa

SEQ ID NO: 440200 - DNA, 25 bp, Rattus norvegicus
ggcccaataactacagcacctttta

SEQ ID NO: 440201 - DNA, 25 bp, Rattus norvegicus
ggcccaataacttcagcacctttta

SEQ ID NO: 440202 - DNA, 25 bp, Rattus norvegicus
ggcccaatagcaaccacaatttaca

SEQ ID NO: 440203 - DNA, 25 bp, Rattus norvegicus
ggcccaatagcatccacaatttaca

SEQ ID NO: 440204 - DNA, 25 bp, Rattus norvegicus
ggcccaatagccctagagtgagctg

SEQ ID NO: 440205 - DNA, 25 bp, Rattus norvegicus
ggcccaatagccgtagagtgagctg

SEQ ID NO: 440206 - DNA, 25 bp, Rattus norvegicus
ggcccaatccttaattttgtctttg

SEQ ID NO: 440207 - DNA, 25 bp, Rattus norvegicus
ggcccaatcctttattttgtctttg

SEQ ID NO: 440208 - DNA, 25 bp, Rattus norvegicus
ggcccaatcttaagtcgtcggtgga

SEQ ID NO: 440209 - DNA, 25 bp, Rattus norvegicus
ggcccaatcttatgtcgtcggtgga

SEQ ID NO: 440210 - DNA, 25 bp, Rattus norvegicus
ggcccaatcttcatgtcagatcttt

SEQ ID NO: 440211 - DNA, 25 bp, Rattus norvegicus
ggcccaatcttcttgtcagatcttt

SEQ ID NO: 440212 - DNA, 25 bp, Rattus norvegicus
ggcccaatgccacgttcttgtgtag

SEQ ID NO: 440213 - DNA, 25 bp, Rattus norvegicus
ggcccaatgccaggttcttgtgtag

SEQ ID NO: 440214 - DNA, 25 bp, Rattus norvegicus
ggcccaatgtatataaactccagtt

SEQ ID NO: 440215 - DNA, 25 bp, Rattus norvegicus
ggcccaatgtatttaaactccagtt

SEQ ID NO: 440216 - DNA, 25 bp, Rattus norvegicus
ggcccaattggcacttttacttgta

SEQ ID NO: 440217 - DNA, 25 bp, Rattus norvegicus
ggcccaattggctcttttacttgta

SEQ ID NO: 440218 - DNA, 25 bp, Rattus norvegicus
ggcccacaaactcttcaaaagcttg

SEQ ID NO: 440219 - DNA, 25 bp, Rattus norvegicus
ggcccacaaactgttcaaaagcttg

SEQ ID NO: 440220 - DNA, 25 bp, Rattus norvegicus
ggcccacacagaaatctgagtttga

SEQ ID NO: 440221 - DNA, 25 bp, Rattus norvegicus
ggcccacacagatatctgagtttga

SEQ ID NO: 440222 - DNA, 25 bp, Rattus norvegicus
ggcccacactggagtagaccagcag

SEQ ID NO: 440223 - DNA, 25 bp, Rattus norvegicus
ggcccacactggtgtagaccagcag

SEQ ID NO: 440224 - DNA, 25 bp, Rattus norvegicus
ggcccacagattactcaaagcagca

SEQ ID NO: 440225 - DNA, 25 bp, Rattus norvegicus
ggcccacagatttctcaaagcagca

SEQ ID NO: 440226 - DNA, 25 bp, Rattus norvegicus
ggcccacatcccaaagttgtgttat

SEQ ID NO: 440227 - DNA, 25 bp, Rattus norvegicus
ggcccacatccctaagttgtgttat

SEQ ID NO: 440228 - DNA, 25 bp, Rattus norvegicus
ggcccaccagagcataatgacgttt

SEQ ID NO: 440229 - DNA, 25 bp, Rattus norvegicus
ggcccaccagaggataatgacgttt

SEQ ID NO: 440230 - DNA, 25 bp, Rattus norvegicus
ggcccaccaggtcctaatggcgaac

SEQ ID NO: 440231 - DNA, 25 bp, Rattus norvegicus
ggcccaccaggtgctaatggcgaac

SEQ ID NO: 440232 - DNA, 25 bp, Rattus norvegicus
ggcccaccatcgaatatcttaaaat

SEQ ID NO: 440233 - DNA, 25 bp, Rattus norvegicus
ggcccaccatcgtatatcttaaaat

SEQ ID NO: 440234 - DNA, 25 bp, Rattus norvegicus
ggcccacccttcagaatactggaaa

SEQ ID NO: 440235 - DNA, 25 bp, Rattus norvegicus
ggcccacccttctgaatactggaaa

SEQ ID NO: 440236 - DNA, 25 bp, Rattus norvegicus
ggcccacctaaaacccaaagatgaa

SEQ ID NO: 440237 - DNA, 25 bp, Rattus norvegicus
ggcccacctaaatcccaaagatgaa

SEQ ID NO: 440238 - DNA, 25 bp, Rattus norvegicus
ggcccacctgaacctggagtacgaa

SEQ ID NO: 440239 - DNA, 25 bp, Rattus norvegicus
ggcccacctgaagctggagtacgaa

SEQ ID NO: 440240 - DNA, 25 bp, Rattus norvegicus
ggcccacctggcaatccggagagga

SEQ ID NO: 440241 - DNA, 25 bp, Rattus norvegicus
ggcccacctggctatccggagagga

SEQ ID NO: 440242 - DNA, 25 bp, Rattus norvegicus
ggcccaccttaacggtcgcgagata

SEQ ID NO: 440243 - DNA, 25 bp, Rattus norvegicus
ggcccaccttaagggtcgcgagata

SEQ ID NO: 440244 - DNA, 25 bp, Rattus norvegicus
ggcccaccttcccatgtgagagaag

SEQ ID NO: 440245 - DNA, 25 bp, Rattus norvegicus
ggcccaccttccgatgtgagagaag

SEQ ID NO: 440246 - DNA, 25 bp, Rattus norvegicus
ggcccacgtgtgagtttgcagttta

SEQ ID NO: 440247 - DNA, 25 bp, Rattus norvegicus
ggcccacgtgtgtgtttgcagttta

SEQ ID NO: 440248 - DNA, 25 bp, Rattus norvegicus
ggcccactcactatgatcatttgga

SEQ ID NO: 440249 - DNA, 25 bp, Rattus norvegicus
ggcccactcactttgatcatttgga

SEQ ID NO: 440250 - DNA, 25 bp, Rattus norvegicus
ggcccactggctattaaaggttttg

SEQ ID NO: 440251 - DNA, 25 bp, Rattus norvegicus
ggcccactggcttttaaaggttttg

SEQ ID NO: 440252 - DNA, 25 bp, Rattus norvegicus
ggcccactggtaagcttcctaggaa

SEQ ID NO: 440253 - DNA, 25 bp, Rattus norvegicus
ggcccactggtatgcttcctaggaa

SEQ ID NO: 440254 - DNA, 25 bp, Rattus norvegicus
ggcccactggttcctttacattatt

SEQ ID NO: 440255 - DNA, 25 bp, Rattus norvegicus
ggcccactggttgctttacattatt

SEQ ID NO: 440256 - DNA, 25 bp, Rattus norvegicus
ggcccacttcgaccctaagatagaa

SEQ ID NO: 440257 - DNA, 25 bp, Rattus norvegicus
ggcccacttcgagcctaagatagaa

SEQ ID NO: 440258 - DNA, 25 bp, Rattus norvegicus
ggcccagaagccatctagaggtatt

SEQ ID NO: 440259 - DNA, 25 bp, Rattus norvegicus
ggcccagaagccttctagaggtatt

SEQ ID NO: 440260 - DNA, 25 bp, Rattus norvegicus
ggcccagaagctccttcagaagtat

SEQ ID NO: 440261 - DNA, 25 bp, Rattus norvegicus
ggcccagaagctgcttcagaagtat

SEQ ID NO: 440262 - DNA, 25 bp, Rattus norvegicus
ggcccagaatccaccagaaaattag

SEQ ID NO: 440263 - DNA, 25 bp, Rattus norvegicus
ggcccagaatcctccagaaaattag

SEQ ID NO: 440264 - DNA, 25 bp, Rattus norvegicus
ggcccagagattcgcttttccgata

SEQ ID NO: 440265 - DNA, 25 bp, Rattus norvegicus
ggcccagagattggcttttccgata

SEQ ID NO: 440266 - DNA, 25 bp, Rattus norvegicus
ggcccagagcttcatggtttatctt

SEQ ID NO: 440267 - DNA, 25 bp, Rattus norvegicus
ggcccagagcttgatggtttatctt

SEQ ID NO: 440268 - DNA, 25 bp, Rattus norvegicus
ggcccagaggccatttgtaggctca

SEQ ID NO: 440269 - DNA, 25 bp, Rattus norvegicus
ggcccagaggccttttgtaggctca

SEQ ID NO: 440270 - DNA, 25 bp, Rattus norvegicus
ggcccagaggttcattttagtttct

SEQ ID NO: 440271 - DNA, 25 bp, Rattus norvegicus
ggcccagaggttgattttagtttct

SEQ ID NO: 440272 - DNA, 25 bp, Rattus norvegicus
ggcccagagtaaaggtgatttccca

SEQ ID NO: 440273 - DNA, 25 bp, Rattus norvegicus
ggcccagagtaatggtgatttccca

SEQ ID NO: 440274 - DNA, 25 bp, Rattus norvegicus
ggcccagattggatgcgtagttttg

SEQ ID NO: 440275 - DNA, 25 bp, Rattus norvegicus
ggcccagattggttgcgtagttttg

SEQ ID NO: 440276 - DNA, 25 bp, Rattus norvegicus
ggcccagcacaacccatgttcataa

SEQ ID NO: 440277 - DNA, 25 bp, Rattus norvegicus
ggcccagcacaagccatgttcataa

SEQ ID NO: 440278 - DNA, 25 bp, Rattus norvegicus
ggcccagcacacacagtgaagctta

SEQ ID NO: 440279 - DNA, 25 bp, Rattus norvegicus
ggcccagcacactcagtgaagctta

SEQ ID NO: 440280 - DNA, 25 bp, Rattus norvegicus
ggcccagcagccatttgatgatgcc

SEQ ID NO: 440281 - DNA, 25 bp, Rattus norvegicus
ggcccagcagccttttgatgatgcc

SEQ ID NO: 440282 - DNA, 25 bp, Rattus norvegicus
ggcccagcagggagtgtctacttta

SEQ ID NO: 440283 - DNA, 25 bp, Rattus norvegicus
ggcccagcagggtgtgtctacttta

SEQ ID NO: 440284 - DNA, 25 bp, Rattus norvegicus
ggcccagcaggtccacaggttgaca

SEQ ID NO: 440285 - DNA, 25 bp, Rattus norvegicus
ggcccagcaggtgcacaggttgaca

SEQ ID NO: 440286 - DNA, 25 bp, Rattus norvegicus
ggcccagcatgaacagaaccctgaa

SEQ ID NO: 440287 - DNA, 25 bp, Rattus norvegicus
ggcccagcatgatcagaaccctgaa

SEQ ID NO: 440288 - DNA, 25 bp, Rattus norvegicus
ggcccagcattgcatcttggttgaa

SEQ ID NO: 440289 - DNA, 25 bp, Rattus norvegicus
ggcccagcattggatcttggttgaa

SEQ ID NO: 440290 - DNA, 25 bp, Rattus norvegicus
ggcccagcccatatgaagttgatta

SEQ ID NO: 440291 - DNA, 25 bp, Rattus norvegicus
ggcccagcccatttgaagttgatta

SEQ ID NO: 440292 - DNA, 25 bp, Rattus norvegicus
ggcccagccgtaacctaggaggaag

SEQ ID NO: 440293 - DNA, 25 bp, Rattus norvegicus
ggcccagccgtatcctaggaggaag

SEQ ID NO: 440294 - DNA, 25 bp, Rattus norvegicus
ggcccagcctatatgtctatactat

SEQ ID NO: 440295 - DNA, 25 bp, Rattus norvegicus
ggcccagcctatttgtctatactat

SEQ ID NO: 440296 - DNA, 25 bp, Rattus norvegicus
ggcccagccttacaaatcccatttg

SEQ ID NO: 440297 - DNA, 25 bp, Rattus norvegicus
ggcccagccttagaaatcccatttg

SEQ ID NO: 440298 - DNA, 25 bp, Rattus norvegicus
ggcccagcgactatggtgtctttgc

SEQ ID NO: 440299 - DNA, 25 bp, Rattus norvegicus
ggcccagcgactttggtgtctttgc

SEQ ID NO: 440300 - DNA, 25 bp, Rattus norvegicus
ggcccagcgataacttcccggaagg

SEQ ID NO: 440301 - DNA, 25 bp, Rattus norvegicus
ggcccagcgatatcttcccggaagg

SEQ ID NO: 440302 - DNA, 25 bp, Rattus norvegicus
ggcccagcggcgaacagtcagcatt

SEQ ID NO: 440303 - DNA, 25 bp, Rattus norvegicus
ggcccagcggcgtacagtcagcatt

SEQ ID NO: 440304 - DNA, 25 bp, Rattus norvegicus
ggcccagcgtgtcgaaaaaactcca

SEQ ID NO: 440305 - DNA, 25 bp, Rattus norvegicus
ggcccagcgtgtggaaaaaactcca

SEQ ID NO: 440306 - DNA, 25 bp, Rattus norvegicus
ggcccagctcttcctgaacagagag

SEQ ID NO: 440307 - DNA, 25 bp, Rattus norvegicus
ggcccagctcttgctgaacagagag

SEQ ID NO: 440308 - DNA, 25 bp, Rattus norvegicus
ggcccagctgcaccgactgaaagtg

SEQ ID NO: 440309 - DNA, 25 bp, Rattus norvegicus
ggcccagctgcagcgactgaaagtg

SEQ ID NO: 440310 - DNA, 25 bp, Rattus norvegicus
ggcccagctgggaatctgaatctat

SEQ ID NO: 440311 - DNA, 25 bp, Rattus norvegicus
ggcccagctgggactaaactcttat

SEQ ID NO: 440312 - DNA, 25 bp, Rattus norvegicus
ggcccagctgggtatctgaatctat

SEQ ID NO: 440313 - DNA, 25 bp, Rattus norvegicus
ggcccagctgggtctaaactcttat

SEQ ID NO: 440314 - DNA, 25 bp, Rattus norvegicus
ggcccagctgttcggtctatatgga

SEQ ID NO: 440315 - DNA, 25 bp, Rattus norvegicus
ggcccagctgttgggtctatatgga

SEQ ID NO: 440316 - DNA, 25 bp, Rattus norvegicus
ggcccaggaaatatctactttcagt

SEQ ID NO: 440317 - DNA, 25 bp, Rattus norvegicus
ggcccaggaaatttctactttcagt

SEQ ID NO: 440318 - DNA, 25 bp, Rattus norvegicus
ggcccaggacacaggcatttgagtt

SEQ ID NO: 440319 - DNA, 25 bp, Rattus norvegicus
ggcccaggacactggcatttgagtt

SEQ ID NO: 440320 - DNA, 25 bp, Rattus norvegicus
ggcccaggacagactgagcacagct

SEQ ID NO: 440321 - DNA, 25 bp, Rattus norvegicus
ggcccaggacagtctgagcacagct

SEQ ID NO: 440322 - DNA, 25 bp, Rattus norvegicus
ggcccaggaggcaaggtttctcaag

SEQ ID NO: 440323 - DNA, 25 bp, Rattus norvegicus
ggcccaggaggcagaatgagcccaa

SEQ ID NO: 440324 - DNA, 25 bp, Rattus norvegicus
ggcccaggaggctaggtttctcaag

SEQ ID NO: 440325 - DNA, 25 bp, Rattus norvegicus
ggcccaggaggctgaatgagcccaa

SEQ ID NO: 440326 - DNA, 25 bp, Rattus norvegicus
ggcccaggatgcacctctaagatga

SEQ ID NO: 440327 - DNA, 25 bp, Rattus norvegicus
ggcccaggatgctcctctaagatga

SEQ ID NO: 440328 - DNA, 25 bp, Rattus norvegicus
ggcccaggcccaagaagacatcatt

SEQ ID NO: 440329 - DNA, 25 bp, Rattus norvegicus
ggcccaggcccatgaagacatcatt

SEQ ID NO: 440330 - DNA, 25 bp, Rattus norvegicus
ggcccaggcctacatgaaccagaga

SEQ ID NO: 440331 - DNA, 25 bp, Rattus norvegicus
ggcccaggcctagatgaaccagaga

SEQ ID NO: 440332 - DNA, 25 bp, Rattus norvegicus
ggcccaggcctccatggatgacaag

SEQ ID NO: 440333 - DNA, 25 bp, Rattus norvegicus
ggcccaggcctcgatggatgacaag

SEQ ID NO: 440334 - DNA, 25 bp, Rattus norvegicus
ggcccaggcgggagtatcattctga

SEQ ID NO: 440335 - DNA, 25 bp, Rattus norvegicus
ggcccaggcgggtgtatcattctga

SEQ ID NO: 440336 - DNA, 25 bp, Rattus norvegicus
ggcccaggcttacagctacacagag

SEQ ID NO: 440337 - DNA, 25 bp, Rattus norvegicus
ggcccaggcttagagctacacagag

SEQ ID NO: 440338 - DNA, 25 bp, Rattus norvegicus
ggcccagggcatcaactccatgtta

SEQ ID NO: 440339 - DNA, 25 bp, Rattus norvegicus
ggcccagggcatgaactccatgtta

SEQ ID NO: 440340 - DNA, 25 bp, Rattus norvegicus
ggcccagggcctaccaagtaggttg

SEQ ID NO: 440341 - DNA, 25 bp, Rattus norvegicus
ggcccagggccttccaagtaggttg

SEQ ID NO: 440342 - DNA, 25 bp, Rattus norvegicus
ggcccagggtcaattctcatgagaa

SEQ ID NO: 440343 - DNA, 25 bp, Rattus norvegicus
ggcccagggtcatttctcatgagaa

SEQ ID NO: 440344 - DNA, 25 bp, Rattus norvegicus
ggcccagggttccattcctacgtgt

SEQ ID NO: 440345 - DNA, 25 bp, Rattus norvegicus
ggcccagggttcgattcctacgtgt

SEQ ID NO: 440346 - DNA, 25 bp, Rattus norvegicus
ggcccaggtaaaacacggtcacaga

SEQ ID NO: 440347 - DNA, 25 bp, Rattus norvegicus
ggcccaggtaaatcacggtcacaga

SEQ ID NO: 440348 - DNA, 25 bp, Rattus norvegicus
ggcccaggtttcattctgcgttgga

SEQ ID NO: 440349 - DNA, 25 bp, Rattus norvegicus
ggcccaggtttcctcatcgaaaggg

SEQ ID NO: 440350 - DNA, 25 bp, Rattus norvegicus
ggcccaggtttcgtcatcgaaaggg

SEQ ID NO: 440351 - DNA, 25 bp, Rattus norvegicus
ggcccaggtttctttctgcgttgga

SEQ ID NO: 440352 - DNA, 25 bp, Rattus norvegicus
ggcccagtaaaaattacctcatgtg

SEQ ID NO: 440353 - DNA, 25 bp, Rattus norvegicus
ggcccagtaaaatttacctcatgtg

SEQ ID NO: 440354 - DNA, 25 bp, Rattus norvegicus
ggcccagtaaatctctgatccattc

SEQ ID NO: 440355 - DNA, 25 bp, Rattus norvegicus
ggcccagtaaatgtctgatccattc

SEQ ID NO: 440356 - DNA, 25 bp, Rattus norvegicus
ggcccagtatagaacaagcctacgt

SEQ ID NO: 440357 - DNA, 25 bp, Rattus norvegicus
ggcccagtatagtacaagcctacgt

SEQ ID NO: 440358 - DNA, 25 bp, Rattus norvegicus
ggcccagtcaaccttttgtatcaag

SEQ ID NO: 440359 - DNA, 25 bp, Rattus norvegicus
ggcccagtcaacgttttgtatcaag

SEQ ID NO: 440360 - DNA, 25 bp, Rattus norvegicus
ggcccagtccttaattttgctgaag

SEQ ID NO: 440361 - DNA, 25 bp, Rattus norvegicus
ggcccagtcctttattttgctgaag

SEQ ID NO: 440362 - DNA, 25 bp, Rattus norvegicus
ggcccagtctgacatcgggacgtaa

SEQ ID NO: 440363 - DNA, 25 bp, Rattus norvegicus
ggcccagtctgagatcgggacgtaa

SEQ ID NO: 440364 - DNA, 25 bp, Rattus norvegicus
ggcccagtgataccccagaggagat

SEQ ID NO: 440365 - DNA, 25 bp, Rattus norvegicus
ggcccagtgatagcccagaggagat

SEQ ID NO: 440366 - DNA, 25 bp, Rattus norvegicus
ggcccagtgattagcacataataca

SEQ ID NO: 440367 - DNA, 25 bp, Rattus norvegicus
ggcccagtgatttgcacataataca

SEQ ID NO: 440368 - DNA, 25 bp, Rattus norvegicus
ggcccagtgcctcgttatttatgtg

SEQ ID NO: 440369 - DNA, 25 bp, Rattus norvegicus
ggcccagtgcctggttatttatgtg

SEQ ID NO: 440370 - DNA, 25 bp, Rattus norvegicus
ggcccagtgctgagacaaatcttgc

SEQ ID NO: 440371 - DNA, 25 bp, Rattus norvegicus
ggcccagtgctgtgacaaatcttgc

SEQ ID NO: 440372 - DNA, 25 bp, Rattus norvegicus
ggcccagtgtgtagactttttctta

SEQ ID NO: 440373 - DNA, 25 bp, Rattus norvegicus
ggcccagtgtgttgactttttctta

SEQ ID NO: 440374 - DNA, 25 bp, Rattus norvegicus
ggcccagttcatagaaaaagctgct

SEQ ID NO: 440375 - DNA, 25 bp, Rattus norvegicus
ggcccagttcattgaaaaagctgct

SEQ ID NO: 440376 - DNA, 25 bp, Rattus norvegicus
ggcccataagaaccacatacctgtg

SEQ ID NO: 440377 - DNA, 25 bp, Rattus norvegicus
ggcccataagaagcacatacctgtg

SEQ ID NO: 440378 - DNA, 25 bp, Rattus norvegicus
ggcccataattccaggttacaatcg

SEQ ID NO: 440379 - DNA, 25 bp, Rattus norvegicus
ggcccataattcgaggttacaatcg

SEQ ID NO: 440380 - DNA, 25 bp, Rattus norvegicus
ggcccatacttcatttctaaatact

SEQ ID NO: 440381 - DNA, 25 bp, Rattus norvegicus
ggcccatacttcttttctaaatact

SEQ ID NO: 440382 - DNA, 25 bp, Rattus norvegicus
ggcccataggtgaagcctcctggag

SEQ ID NO: 440383 - DNA, 25 bp, Rattus norvegicus
ggcccataggtgaggaacatttcct

SEQ ID NO: 440384 - DNA, 25 bp, Rattus norvegicus
ggcccataggtgtagcctcctggag

SEQ ID NO: 440385 - DNA, 25 bp, Rattus norvegicus
ggcccataggtgtggaacatttcct

SEQ ID NO: 440386 - DNA, 25 bp, Rattus norvegicus
ggcccatatccacattattaagaaa

SEQ ID NO: 440387 - DNA, 25 bp, Rattus norvegicus
ggcccatatccagattattaagaaa

SEQ ID NO: 440388 - DNA, 25 bp, Rattus norvegicus
ggcccatcctagctatgaaatccag

SEQ ID NO: 440389 - DNA, 25 bp, Rattus norvegicus
ggcccatcctaggtatgaaatccag

SEQ ID NO: 440390 - DNA, 25 bp, Rattus norvegicus
ggcccatcctatccagtcaagagtt

SEQ ID NO: 440391 - DNA, 25 bp, Rattus norvegicus
ggcccatcctatgcagtcaagagtt

SEQ ID NO: 440392 - DNA, 25 bp, Rattus norvegicus
ggcccatcctttctgacttgaatgt

SEQ ID NO: 440393 - DNA, 25 bp, Rattus norvegicus
ggcccatcctttgtgacttgaatgt

SEQ ID NO: 440394 - DNA, 25 bp, Rattus norvegicus
ggcccatctgaccatgtttcaaggt

SEQ ID NO: 440395 - DNA, 25 bp, Rattus norvegicus
ggcccatctgacgatgtttcaaggt

SEQ ID NO: 440396 - DNA, 25 bp, Rattus norvegicus
ggcccatctgctctgagtactagga

SEQ ID NO: 440397 - DNA, 25 bp, Rattus norvegicus
ggcccatctgctgtgagtactagga

SEQ ID NO: 440398 - DNA, 25 bp, Rattus norvegicus
ggcccatgtggcaagtgtgttctga

SEQ ID NO: 440399 - DNA, 25 bp, Rattus norvegicus
ggcccatgtggctagtgtgttctga

SEQ ID NO: 440400 - DNA, 25 bp, Rattus norvegicus
ggcccattacttagaaacactttga

SEQ ID NO: 440401 - DNA, 25 bp, Rattus norvegicus
ggcccattactttgaaacactttga

SEQ ID NO: 440402 - DNA, 25 bp, Rattus norvegicus
ggcccattcctgaatctgtcagaga

SEQ ID NO: 440403 - DNA, 25 bp, Rattus norvegicus
ggcccattcctgtatctgtcagaga

SEQ ID NO: 440404 - DNA, 25 bp, Rattus norvegicus
ggcccattccttctatctggctgga

SEQ ID NO: 440405 - DNA, 25 bp, Rattus norvegicus
ggcccattccttgtatctggctgga

SEQ ID NO: 440406 - DNA, 25 bp, Rattus norvegicus
ggcccattgatgagtcctacagcaa

SEQ ID NO: 440407 - DNA, 25 bp, Rattus norvegicus
ggcccattgatgattccagcagttt

SEQ ID NO: 440408 - DNA, 25 bp, Rattus norvegicus
ggcccattgatgtgtcctacagcaa

SEQ ID NO: 440409 - DNA, 25 bp, Rattus norvegicus
ggcccattgatgtttccagcagttt

SEQ ID NO: 440410 - DNA, 25 bp, Rattus norvegicus
ggcccattggaactctccagggtgt

SEQ ID NO: 440411 - DNA, 25 bp, Rattus norvegicus
ggcccattggaagtctccagggtgt

SEQ ID NO: 440412 - DNA, 25 bp, Rattus norvegicus
ggcccattggttcaaagcagtgatt

SEQ ID NO: 440413 - DNA, 25 bp, Rattus norvegicus
ggcccattggttgaaagcagtgatt

SEQ ID NO: 440414 - DNA, 25 bp, Rattus norvegicus
ggcccattttctatgcctgatgact

SEQ ID NO: 440415 - DNA, 25 bp, Rattus norvegicus
ggcccattttctttgcctgatgact

SEQ ID NO: 440416 - DNA, 25 bp, Rattus norvegicus
ggccccaaagtcctgtttcagattt

SEQ ID NO: 440417 - DNA, 25 bp, Rattus norvegicus
ggccccaaagtcgtgtttcagattt

SEQ ID NO: 440418 - DNA, 25 bp, Rattus norvegicus
ggccccaaatccaggagtttcctat

SEQ ID NO: 440419 - DNA, 25 bp, Rattus norvegicus
ggccccaaatcctggagtttcctat

SEQ ID NO: 440420 - DNA, 25 bp, Rattus norvegicus
ggccccaagagcactgtcaggagga

SEQ ID NO: 440421 - DNA, 25 bp, Rattus norvegicus
ggccccaagagctctgtcaggagga

SEQ ID NO: 440422 - DNA, 25 bp, Rattus norvegicus
ggccccaatggtcgccagagctgtt

SEQ ID NO: 440423 - DNA, 25 bp, Rattus norvegicus
ggccccaatggtggccagagctgtt

SEQ ID NO: 440424 - DNA, 25 bp, Rattus norvegicus
ggccccaatgtgagtcgctgtataa

SEQ ID NO: 440425 - DNA, 25 bp, Rattus norvegicus
ggccccaatgtgtgtcgctgtataa

SEQ ID NO: 440426 - DNA, 25 bp, Rattus norvegicus
ggccccacaccactgatttgcaaaa

SEQ ID NO: 440427 - DNA, 25 bp, Rattus norvegicus
ggccccacaccagtgatttgcaaaa

SEQ ID NO: 440428 - DNA, 25 bp, Rattus norvegicus
ggccccacaggccatcagtgaacag

SEQ ID NO: 440429 - DNA, 25 bp, Rattus norvegicus
ggccccacaggcgatcagtgaacag

SEQ ID NO: 440430 - DNA, 25 bp, Rattus norvegicus
ggccccacagtgcatgttcacaagt

SEQ ID NO: 440431 - DNA, 25 bp, Rattus norvegicus
ggccccacagtggatgttcacaagt

SEQ ID NO: 440432 - DNA, 25 bp, Rattus norvegicus
ggccccacattgatttcattccaga

SEQ ID NO: 440433 - DNA, 25 bp, Rattus norvegicus
ggccccacattgttttcattccaga

SEQ ID NO: 440434 - DNA, 25 bp, Rattus norvegicus
ggccccagacaaccgtcggtgtgaa

SEQ ID NO: 440435 - DNA, 25 bp, Rattus norvegicus
ggccccagacaagcgtcggtgtgaa

SEQ ID NO: 440436 - DNA, 25 bp, Rattus norvegicus
ggccccagacacagtgtttatgtgt

SEQ ID NO: 440437 - DNA, 25 bp, Rattus norvegicus
ggccccagacactgtgtttatgtgt

SEQ ID NO: 440438 - DNA, 25 bp, Rattus norvegicus
ggccccagagggaagggtgctcctg

SEQ ID NO: 440439 - DNA, 25 bp, Rattus norvegicus
ggccccagagggtagggtgctcctg

SEQ ID NO: 440440 - DNA, 25 bp, Rattus norvegicus
ggccccagcaaactgctataacttg

SEQ ID NO: 440441 - DNA, 25 bp, Rattus norvegicus
ggccccagcaaagtgctataacttg

SEQ ID NO: 440442 - DNA, 25 bp, Rattus norvegicus
ggccccagccgcagagatcgcagaa

SEQ ID NO: 440443 - DNA, 25 bp, Rattus norvegicus
ggccccagccgctgagatcgcagaa

SEQ ID NO: 440444 - DNA, 25 bp, Rattus norvegicus
ggccccagcggtaagggatgtccaa

SEQ ID NO: 440445 - DNA, 25 bp, Rattus norvegicus
ggccccagcggttagggatgtccaa

SEQ ID NO: 440446 - DNA, 25 bp, Rattus norvegicus
ggccccagtccaagagttgaatgtt

SEQ ID NO: 440447 - DNA, 25 bp, Rattus norvegicus
ggccccagtccatgagttgaatgtt

SEQ ID NO: 440448 - DNA, 25 bp, Rattus norvegicus
ggccccagtgccacttagtagtgta

SEQ ID NO: 440449 - DNA, 25 bp, Rattus norvegicus
ggccccagtgcctcttagtagtgta

SEQ ID NO: 440450 - DNA, 25 bp, Rattus norvegicus
ggccccagtgtacccagtttgggta

SEQ ID NO: 440451 - DNA, 25 bp, Rattus norvegicus
ggccccagtgtagccagtttgggta

SEQ ID NO: 440452 - DNA, 25 bp, Rattus norvegicus
ggccccagtgttattgcaggttagc

SEQ ID NO: 440453 - DNA, 25 bp, Rattus norvegicus
ggccccagtgtttttgcaggttagc

SEQ ID NO: 440454 - DNA, 25 bp, Rattus norvegicus
ggccccatagacatatgtgaacaag

SEQ ID NO: 440455 - DNA, 25 bp, Rattus norvegicus
ggccccatagacttatgtgaacaag

SEQ ID NO: 440456 - DNA, 25 bp, Rattus norvegicus
ggccccatcactctgtatgtaattt

SEQ ID NO: 440457 - DNA, 25 bp, Rattus norvegicus
ggccccatcactgtgtatgtaattt

SEQ ID NO: 440458 - DNA, 25 bp, Rattus norvegicus
ggccccatctggactcattgtaaga

SEQ ID NO: 440459 - DNA, 25 bp, Rattus norvegicus
ggccccatctggtctcattgtaaga

SEQ ID NO: 440460 - DNA, 25 bp, Rattus norvegicus
ggccccatgatgagtggtgcatttt

SEQ ID NO: 440461 - DNA, 25 bp, Rattus norvegicus
ggccccatgatgcactcttcagtgc

SEQ ID NO: 440462 - DNA, 25 bp, Rattus norvegicus
ggccccatgatggactcttcagtgc

SEQ ID NO: 440463 - DNA, 25 bp, Rattus norvegicus
ggccccatgatgtgtggtgcatttt

SEQ ID NO: 440464 - DNA, 25 bp, Rattus norvegicus
ggccccatgcaaccccaaagaaatg

SEQ ID NO: 440465 - DNA, 25 bp, Rattus norvegicus
ggccccatgcaagcccaaagaaatg

SEQ ID NO: 440466 - DNA, 25 bp, Rattus norvegicus
ggccccatgtagaaagcgacaagga

SEQ ID NO: 440467 - DNA, 25 bp, Rattus norvegicus
ggccccatgtagtaagcgacaagga

SEQ ID NO: 440468 - DNA, 25 bp, Rattus norvegicus
ggccccattcttattgtgtcttttg

SEQ ID NO: 440469 - DNA, 25 bp, Rattus norvegicus
ggccccattctttttgtgtcttttg

SEQ ID NO: 440470 - DNA, 25 bp, Rattus norvegicus
ggccccattgttagtgttttcttca

SEQ ID NO: 440471 - DNA, 25 bp, Rattus norvegicus
ggccccattgtttgtgttttcttca

SEQ ID NO: 440472 - DNA, 25 bp, Rattus norvegicus
ggccccattttactgtgcgtgttca

SEQ ID NO: 440473 - DNA, 25 bp, Rattus norvegicus
ggccccattttagtgtgcgtgttca

SEQ ID NO: 440474 - DNA, 25 bp, Rattus norvegicus
ggccccgagactacgtaagcgtacg

SEQ ID NO: 440475 - DNA, 25 bp, Rattus norvegicus
ggccccgagacttcgtaagcgtacg

SEQ ID NO: 440476 - DNA, 25 bp, Rattus norvegicus
ggccccgattggactggaacttatt

SEQ ID NO: 440477 - DNA, 25 bp, Rattus norvegicus
ggccccgattggtctggaacttatt

SEQ ID NO: 440478 - DNA, 25 bp, Rattus norvegicus
ggccccgcgctcagaggtaaaatgg

SEQ ID NO: 440479 - DNA, 25 bp, Rattus norvegicus
ggccccgcgctctgaggtaaaatgg

SEQ ID NO: 440480 - DNA, 25 bp, Rattus norvegicus
ggccccgctggaactacagttgtaa

SEQ ID NO: 440481 - DNA, 25 bp, Rattus norvegicus
ggccccgctggatctacagttgtaa

SEQ ID NO: 440482 - DNA, 25 bp, Rattus norvegicus
ggccccgggacgcactcaggacagg

SEQ ID NO: 440483 - DNA, 25 bp, Rattus norvegicus
ggccccgggacggactcaggacagg

SEQ ID NO: 440484 - DNA, 25 bp, Rattus norvegicus
ggccccgggttaacgtaggagctat

SEQ ID NO: 440485 - DNA, 25 bp, Rattus norvegicus
ggccccgggttatcgtaggagctat

SEQ ID NO: 440486 - DNA, 25 bp, Rattus norvegicus
ggccccggtcggaagcgaatcgcca

SEQ ID NO: 440487 - DNA, 25 bp, Rattus norvegicus
ggccccggtcggtagcgaatcgcca

SEQ ID NO: 440488 - DNA, 25 bp, Rattus norvegicus
ggcccctatgccagggaaggtcata

SEQ ID NO: 440489 - DNA, 25 bp, Rattus norvegicus
ggcccctatgcctgggaaggtcata

SEQ ID NO: 440490 - DNA, 25 bp, Rattus norvegicus
ggcccctcaagtaggttctgagtat

SEQ ID NO: 440491 - DNA, 25 bp, Rattus norvegicus
ggcccctcaagttggttctgagtat

SEQ ID NO: 440492 - DNA, 25 bp, Rattus norvegicus
ggcccctcaatcactacaggaaatg

SEQ ID NO: 440493 - DNA, 25 bp, Rattus norvegicus
ggcccctcaatctctacaggaaatg

SEQ ID NO: 440494 - DNA, 25 bp, Rattus norvegicus
ggcccctcagaaaaggagctgtctc

SEQ ID NO: 440495 - DNA, 25 bp, Rattus norvegicus
ggcccctcagaataggagctgtctc

SEQ ID NO: 440496 - DNA, 25 bp, Rattus norvegicus
ggcccctcaggcagacagtgcggca

SEQ ID NO: 440497 - DNA, 25 bp, Rattus norvegicus
ggcccctcaggctgacagtgcggca

SEQ ID NO: 440498 - DNA, 25 bp, Rattus norvegicus
ggcccctcatgaaccattggtagta

SEQ ID NO: 440499 - DNA, 25 bp, Rattus norvegicus
ggcccctcatgatccattggtagta

SEQ ID NO: 440500 - DNA, 25 bp, Rattus norvegicus
ggcccctccataaggatggtactga

SEQ ID NO: 440501 - DNA, 25 bp, Rattus norvegicus
ggcccctccatatggatggtactga

SEQ ID NO: 440502 - DNA, 25 bp, Rattus norvegicus
ggcccctcgtgaaggtgatgaccga

SEQ ID NO: 440503 - DNA, 25 bp, Rattus norvegicus
ggcccctcgtgatggtgatgaccga

SEQ ID NO: 440504 - DNA, 25 bp, Rattus norvegicus
ggcccctgaattaaaggctgcagct

SEQ ID NO: 440505 - DNA, 25 bp, Rattus norvegicus
ggcccctgaatttaaggctgcagct

SEQ ID NO: 440506 - DNA, 25 bp, Rattus norvegicus
ggcccctgacacatatcaagcatag

SEQ ID NO: 440507 - DNA, 25 bp, Rattus norvegicus
ggcccctgacacttatcaagcatag

SEQ ID NO: 440508 - DNA, 25 bp, Rattus norvegicus
ggcccctgaggaccaccctgtgctg

SEQ ID NO: 440509 - DNA, 25 bp, Rattus norvegicus
ggcccctgaggagcaccctgtgctg

SEQ ID NO: 440510 - DNA, 25 bp, Rattus norvegicus
ggcccctggagcaactggagcaaat

SEQ ID NO: 440511 - DNA, 25 bp, Rattus norvegicus
ggcccctggagccattctggaataa

SEQ ID NO: 440512 - DNA, 25 bp, Rattus norvegicus
ggcccctggagcgattctggaataa

SEQ ID NO: 440513 - DNA, 25 bp, Rattus norvegicus
ggcccctggagctactggagcaaat

SEQ ID NO: 440514 - DNA, 25 bp, Rattus norvegicus
ggcccctgggatattgttttcacat

SEQ ID NO: 440515 - DNA, 25 bp, Rattus norvegicus
ggcccctgggattttgttttcacat

SEQ ID NO: 440516 - DNA, 25 bp, Rattus norvegicus
ggcccctgggcaagtacaatgtcaa

SEQ ID NO: 440517 - DNA, 25 bp, Rattus norvegicus
ggcccctgggcatgtacaatgtcaa

SEQ ID NO: 440518 - DNA, 25 bp, Rattus norvegicus
ggcccctgggtacacaaaccaagct

SEQ ID NO: 440519 - DNA, 25 bp, Rattus norvegicus
ggcccctgggtagacaaaccaagct

SEQ ID NO: 440520 - DNA, 25 bp, Rattus norvegicus
ggcccctgtgctactacggaagaaa

SEQ ID NO: 440521 - DNA, 25 bp, Rattus norvegicus
ggcccctgtgcttctacggaagaaa

SEQ ID NO: 440522 - DNA, 25 bp, Rattus norvegicus
ggcccctgttctcacttataaaagt

SEQ ID NO: 440523 - DNA, 25 bp, Rattus norvegicus
ggcccctgttctgacttataaaagt

SEQ ID NO: 440524 - DNA, 25 bp, Rattus norvegicus
ggcccctgtttgctgaaggaacaag

SEQ ID NO: 440525 - DNA, 25 bp, Rattus norvegicus
ggcccctgtttggtgaaggaacaag

SEQ ID NO: 440526 - DNA, 25 bp, Rattus norvegicus
ggccccttacaccttctggaatgag

SEQ ID NO: 440527 - DNA, 25 bp, Rattus norvegicus
ggccccttacacgttctggaatgag

SEQ ID NO: 440528 - DNA, 25 bp, Rattus norvegicus
ggccccttattgaatttgtccgaag

SEQ ID NO: 440529 - DNA, 25 bp, Rattus norvegicus
ggccccttattgtatttgtccgaag

SEQ ID NO: 440530 - DNA, 25 bp, Rattus norvegicus
ggccccttgtaccagaacatcagga

SEQ ID NO: 440531 - DNA, 25 bp, Rattus norvegicus
ggccccttgtacgagaacatcagga

SEQ ID NO: 440532 - DNA, 25 bp, Rattus norvegicus
ggccccttgttacactttgtaatca

SEQ ID NO: 440533 - DNA, 25 bp, Rattus norvegicus
ggccccttgttagactttgtaatca

SEQ ID NO: 440534 - DNA, 25 bp, Rattus norvegicus
ggccccttgtttcctgagtagtaga

SEQ ID NO: 440535 - DNA, 25 bp, Rattus norvegicus
ggccccttgtttgctgagtagtaga

SEQ ID NO: 440536 - DNA, 25 bp, Rattus norvegicus
ggcccctttggtaatgttcaaggag

SEQ ID NO: 440537 - DNA, 25 bp, Rattus norvegicus
ggcccctttggttatgttcaaggag

SEQ ID NO: 440538 - DNA, 25 bp, Rattus norvegicus
ggcccgaaacttactcatctttgag

SEQ ID NO: 440539 - DNA, 25 bp, Rattus norvegicus
ggcccgaaactttctcatctttgag

SEQ ID NO: 440540 - DNA, 25 bp, Rattus norvegicus
ggcccgacagcaccagttctgtgaa

SEQ ID NO: 440541 - DNA, 25 bp, Rattus norvegicus
ggcccgacagcagcagttctgtgaa

SEQ ID NO: 440542 - DNA, 25 bp, Rattus norvegicus
ggcccgagaaatcctttcacaacaa

SEQ ID NO: 440543 - DNA, 25 bp, Rattus norvegicus
ggcccgagaaatgctttcacaacaa

SEQ ID NO: 440544 - DNA, 25 bp, Rattus norvegicus
ggcccgagcgtgagggtatcatcac

SEQ ID NO: 440545 - DNA, 25 bp, Rattus norvegicus
ggcccgagcgtgtgggtatcatcac

SEQ ID NO: 440546 - DNA, 25 bp, Rattus norvegicus
ggcccgagctcaaaatgttccagta

SEQ ID NO: 440547 - DNA, 25 bp, Rattus norvegicus
ggcccgagctcataatgttccagta

SEQ ID NO: 440548 - DNA, 25 bp, Rattus norvegicus
ggcccgagggtcaggaacaactgca

SEQ ID NO: 440549 - DNA, 25 bp, Rattus norvegicus
ggcccgagggtctggaacaactgca

SEQ ID NO: 440550 - DNA, 25 bp, Rattus norvegicus
ggcccgatccctctatcccggcgct

SEQ ID NO: 440551 - DNA, 25 bp, Rattus norvegicus
ggcccgatccctgtatcccggcgct

SEQ ID NO: 440552 - DNA, 25 bp, Rattus norvegicus
ggcccgatccgtatgttgagagaga

SEQ ID NO: 440553 - DNA, 25 bp, Rattus norvegicus
ggcccgatccgtttgttgagagaga

SEQ ID NO: 440554 - DNA, 25 bp, Rattus norvegicus
ggcccgatggcccaaagtgtacaga

SEQ ID NO: 440555 - DNA, 25 bp, Rattus norvegicus
ggcccgatggccgaaagtgtacaga

SEQ ID NO: 440556 - DNA, 25 bp, Rattus norvegicus
ggcccgcatattcctgtagcattca

SEQ ID NO: 440557 - DNA, 25 bp, Rattus norvegicus
ggcccgcatattgctgtagcattca

SEQ ID NO: 440558 - DNA, 25 bp, Rattus norvegicus
ggcccgccgcagcattcgaatcgaa

SEQ ID NO: 440559 - DNA, 25 bp, Rattus norvegicus
ggcccgccgcaggattcgaatcgaa

SEQ ID NO: 440560 - DNA, 25 bp, Rattus norvegicus
ggcccgcgttcaaacatttctaaga

SEQ ID NO: 440561 - DNA, 25 bp, Rattus norvegicus
ggcccgcgttcatacatttctaaga

SEQ ID NO: 440562 - DNA, 25 bp, Rattus norvegicus
ggcccggaacttcccatataagcaa

SEQ ID NO: 440563 - DNA, 25 bp, Rattus norvegicus
ggcccggaacttgccatataagcaa

SEQ ID NO: 440564 - DNA, 25 bp, Rattus norvegicus
ggcccggacaacaccagcgtggact

SEQ ID NO: 440565 - DNA, 25 bp, Rattus norvegicus
ggcccggacaactccagcgtggact

SEQ ID NO: 440566 - DNA, 25 bp, Rattus norvegicus
ggcccggattggactatacctatct

SEQ ID NO: 440567 - DNA, 25 bp, Rattus norvegicus
ggcccggattggtctatacctatct

SEQ ID NO: 440568 - DNA, 25 bp, Rattus norvegicus
ggcccggcagccagaatatccaagg

SEQ ID NO: 440569 - DNA, 25 bp, Rattus norvegicus
ggcccggcagcctgaatatccaagg

SEQ ID NO: 440570 - DNA, 25 bp, Rattus norvegicus
ggcccggccgccaggttgaaattct

SEQ ID NO: 440571 - DNA, 25 bp, Rattus norvegicus
ggcccggccgcctggttgaaattct

SEQ ID NO: 440572 - DNA, 25 bp, Rattus norvegicus
ggcccggcgctcagaagtgatgaat

SEQ ID NO: 440573 - DNA, 25 bp, Rattus norvegicus
ggcccggcgctctgaagtgatgaat

SEQ ID NO: 440574 - DNA, 25 bp, Rattus norvegicus
ggcccggcttgactcagagattgct

SEQ ID NO: 440575 - DNA, 25 bp, Rattus norvegicus
ggcccggcttgagtcagagattgct

SEQ ID NO: 440576 - DNA, 25 bp, Rattus norvegicus
ggcccgggcaacatcgcgaaactgg

SEQ ID NO: 440577 - DNA, 25 bp, Rattus norvegicus
ggcccgggcaacttcgcgaaactgg

SEQ ID NO: 440578 - DNA, 25 bp, Rattus norvegicus
ggcccgtcaggcaactgcagctgag

SEQ ID NO: 440579 - DNA, 25 bp, Rattus norvegicus
ggcccgtcaggctactgcagctgag

SEQ ID NO: 440580 - DNA, 25 bp, Rattus norvegicus
ggcccgtcgacaagtgctggctgca

SEQ ID NO: 440581 - DNA, 25 bp, Rattus norvegicus
ggcccgtcgacatgtgctggctgca

SEQ ID NO: 440582 - DNA, 25 bp, Rattus norvegicus
ggcccgtgagccagtgtcgtcccaa

SEQ ID NO: 440583 - DNA, 25 bp, Rattus norvegicus
ggcccgtgagcctgtgtcgtcccaa

SEQ ID NO: 440584 - DNA, 25 bp, Rattus norvegicus
ggcccgtgcccaaaggaacaggcag

SEQ ID NO: 440585 - DNA, 25 bp, Rattus norvegicus
ggcccgtgcccataggaacaggcag

SEQ ID NO: 440586 - DNA, 25 bp, Rattus norvegicus
ggcccgtggttgagacatagctgac

SEQ ID NO: 440587 - DNA, 25 bp, Rattus norvegicus
ggcccgtggttgtgacatagctgac

SEQ ID NO: 440588 - DNA, 25 bp, Rattus norvegicus
ggcccgttaggcaatttgtacacaa

SEQ ID NO: 440589 - DNA, 25 bp, Rattus norvegicus
ggcccgttaggctatttgtacacaa

SEQ ID NO: 440590 - DNA, 25 bp, Rattus norvegicus
ggcccgttccagaatgatgctgact

SEQ ID NO: 440591 - DNA, 25 bp, Rattus norvegicus
ggcccgttccagtatgatgctgact

SEQ ID NO: 440592 - DNA, 25 bp, Rattus norvegicus
ggcccgttggatatctggccagaaa

SEQ ID NO: 440593 - DNA, 25 bp, Rattus norvegicus
ggcccgttggatttctggccagaaa

SEQ ID NO: 440594 - DNA, 25 bp, Rattus norvegicus
ggcccgttgtccagtgaatttgata

SEQ ID NO: 440595 - DNA, 25 bp, Rattus norvegicus
ggcccgttgtcctgtgaatttgata

SEQ ID NO: 440596 - DNA, 25 bp, Rattus norvegicus
ggcccgtttggaagttttatgtaga

SEQ ID NO: 440597 - DNA, 25 bp, Rattus norvegicus
ggcccgtttggatgttttatgtaga

SEQ ID NO: 440598 - DNA, 25 bp, Rattus norvegicus
ggccctaaacttagagtcggtccat

SEQ ID NO: 440599 - DNA, 25 bp, Rattus norvegicus
ggccctaaactttgagtcggtccat

SEQ ID NO: 440600 - DNA, 25 bp, Rattus norvegicus
ggccctaagctcacctaacagaaag

SEQ ID NO: 440601 - DNA, 25 bp, Rattus norvegicus
ggccctaagctctcctaacagaaag

SEQ ID NO: 440602 - DNA, 25 bp, Rattus norvegicus
ggccctacacctagacatgtgaaga

SEQ ID NO: 440603 - DNA, 25 bp, Rattus norvegicus
ggccctacaccttgacatgtgaaga

SEQ ID NO: 440604 - DNA, 25 bp, Rattus norvegicus
ggccctacccctagatgaagagcga

SEQ ID NO: 440605 - DNA, 25 bp, Rattus norvegicus
ggccctaccccttgatgaagagcga

SEQ ID NO: 440606 - DNA, 25 bp, Rattus norvegicus
ggccctactataatcccaacttata

SEQ ID NO: 440607 - DNA, 25 bp, Rattus norvegicus
ggccctactatattcccaacttata

SEQ ID NO: 440608 - DNA, 25 bp, Rattus norvegicus
ggccctactctaatcactgaggcag

SEQ ID NO: 440609 - DNA, 25 bp, Rattus norvegicus
ggccctactctattcactgaggcag

SEQ ID NO: 440610 - DNA, 25 bp, Rattus norvegicus
ggccctactgccacgaatagatggg

SEQ ID NO: 440611 - DNA, 25 bp, Rattus norvegicus
ggccctactgcctcgaatagatggg

SEQ ID NO: 440612 - DNA, 25 bp, Rattus norvegicus
ggccctagaagtagtcaccagtgtt

SEQ ID NO: 440613 - DNA, 25 bp, Rattus norvegicus
ggccctagaagttgtcaccagtgtt

SEQ ID NO: 440614 - DNA, 25 bp, Rattus norvegicus
ggccctagatccagatgtgcctaaa

SEQ ID NO: 440615 - DNA, 25 bp, Rattus norvegicus
ggccctagatcctgatgtgcctaaa

SEQ ID NO: 440616 - DNA, 25 bp, Rattus norvegicus
ggccctagctatatcctgtgtcagt

SEQ ID NO: 440617 - DNA, 25 bp, Rattus norvegicus
ggccctagctatttcctgtgtcagt

SEQ ID NO: 440618 - DNA, 25 bp, Rattus norvegicus
ggccctaggacactgtttaacatca

SEQ ID NO: 440619 - DNA, 25 bp, Rattus norvegicus
ggccctaggacagtgtttaacatca

SEQ ID NO: 440620 - DNA, 25 bp, Rattus norvegicus
ggccctagggctcttagatttttat

SEQ ID NO: 440621 - DNA, 25 bp, Rattus norvegicus
ggccctagggctgttagatttttat

SEQ ID NO: 440622 - DNA, 25 bp, Rattus norvegicus
ggccctagtggcctaagaagtactc

SEQ ID NO: 440623 - DNA, 25 bp, Rattus norvegicus
ggccctagtggcgtaagaagtactc

SEQ ID NO: 440624 - DNA, 25 bp, Rattus norvegicus
ggccctatacatcactacctattgg

SEQ ID NO: 440625 - DNA, 25 bp, Rattus norvegicus
ggccctatacatgactacctattgg

SEQ ID NO: 440626 - DNA, 25 bp, Rattus norvegicus
ggccctatcacaatcaaggatgctg

SEQ ID NO: 440627 - DNA, 25 bp, Rattus norvegicus
ggccctatcacattcaaggatgctg

SEQ ID NO: 440628 - DNA, 25 bp, Rattus norvegicus
ggccctatcaggactattcctacag

SEQ ID NO: 440629 - DNA, 25 bp, Rattus norvegicus
ggccctatcaggtctattcctacag

SEQ ID NO: 440630 - DNA, 25 bp, Rattus norvegicus
ggccctatgtcaacggaagtcctaa

SEQ ID NO: 440631 - DNA, 25 bp, Rattus norvegicus
ggccctatgtcatcggaagtcctaa

SEQ ID NO: 440632 - DNA, 25 bp, Rattus norvegicus
ggccctcaaagacctttattgccat

SEQ ID NO: 440633 - DNA, 25 bp, Rattus norvegicus
ggccctcaaagagctttattgccat

SEQ ID NO: 440634 - DNA, 25 bp, Rattus norvegicus
ggccctcaacagagaattgacttca

SEQ ID NO: 440635 - DNA, 25 bp, Rattus norvegicus
ggccctcaacagtgaattgacttca

SEQ ID NO: 440636 - DNA, 25 bp, Rattus norvegicus
ggccctcaatatatagatgcattca

SEQ ID NO: 440637 - DNA, 25 bp, Rattus norvegicus
ggccctcaatatttagatgcattca

SEQ ID NO: 440638 - DNA, 25 bp, Rattus norvegicus
ggccctcactctcattagaaggctg

SEQ ID NO: 440639 - DNA, 25 bp, Rattus norvegicus
ggccctcactctgattagaaggctg

SEQ ID NO: 440640 - DNA, 25 bp, Rattus norvegicus
ggccctcactgactacagacagtaa

SEQ ID NO: 440641 - DNA, 25 bp, Rattus norvegicus
ggccctcactgagtacagacagtaa

SEQ ID NO: 440642 - DNA, 25 bp, Rattus norvegicus
ggccctcagaggatcgaagcttgga

SEQ ID NO: 440643 - DNA, 25 bp, Rattus norvegicus
ggccctcagaggttcgaagcttgga

SEQ ID NO: 440644 - DNA, 25 bp, Rattus norvegicus
ggccctcagatcatcctgcagaaga

SEQ ID NO: 440645 - DNA, 25 bp, Rattus norvegicus
ggccctcagatcttcctgcagaaga

SEQ ID NO: 440646 - DNA, 25 bp, Rattus norvegicus
ggccctcagggcaagacaggaccaa

SEQ ID NO: 440647 - DNA, 25 bp, Rattus norvegicus
ggccctcagggctagacaggaccaa

SEQ ID NO: 440648 - DNA, 25 bp, Rattus norvegicus
ggccctcaggtcacagtcggagaac

SEQ ID NO: 440649 - DNA, 25 bp, Rattus norvegicus
ggccctcaggtctcagtcggagaac

SEQ ID NO: 440650 - DNA, 25 bp, Rattus norvegicus
ggccctcatttacttcgtggtgctg

SEQ ID NO: 440651 - DNA, 25 bp, Rattus norvegicus
ggccctcatttagttcgtggtgctg

SEQ ID NO: 440652 - DNA, 25 bp, Rattus norvegicus
ggccctccaaacatgtattctgtga

SEQ ID NO: 440653 - DNA, 25 bp, Rattus norvegicus
ggccctccaaacttgtattctgtga

SEQ ID NO: 440654 - DNA, 25 bp, Rattus norvegicus
ggccctccactaacggaaccgagag

SEQ ID NO: 440655 - DNA, 25 bp, Rattus norvegicus
ggccctccactatcggaaccgagag

SEQ ID NO: 440656 - DNA, 25 bp, Rattus norvegicus
ggccctccaggcacaagtgatgtca

SEQ ID NO: 440657 - DNA, 25 bp, Rattus norvegicus
ggccctccaggctcaagtgatgtca

SEQ ID NO: 440658 - DNA, 25 bp, Rattus norvegicus
ggccctcgaaccagaagagctgtaa

SEQ ID NO: 440659 - DNA, 25 bp, Rattus norvegicus
ggccctcgaacctgaagagctgtaa

SEQ ID NO: 440660 - DNA, 25 bp, Rattus norvegicus
ggccctcgagctccgggtgaggtgg

SEQ ID NO: 440661 - DNA, 25 bp, Rattus norvegicus
ggccctcgagctgcgggtgaggtgg

SEQ ID NO: 440662 - DNA, 25 bp, Rattus norvegicus
ggccctcgggacagctgtcacatgc

SEQ ID NO: 440663 - DNA, 25 bp, Rattus norvegicus
ggccctcgggactgctgtcacatgc

SEQ ID NO: 440664 - DNA, 25 bp, Rattus norvegicus
ggccctctaaaaagtgtaggtctct

SEQ ID NO: 440665 - DNA, 25 bp, Rattus norvegicus
ggccctctaaaatgtgtaggtctct

SEQ ID NO: 440666 - DNA, 25 bp, Rattus norvegicus
ggccctctcatcattaatgcaagca

SEQ ID NO: 440667 - DNA, 25 bp, Rattus norvegicus
ggccctctcatctttaatgcaagca

SEQ ID NO: 440668 - DNA, 25 bp, Rattus norvegicus
ggccctctcatgatgcatgttttca

SEQ ID NO: 440669 - DNA, 25 bp, Rattus norvegicus
ggccctctcatgttgcatgttttca

SEQ ID NO: 440670 - DNA, 25 bp, Rattus norvegicus
ggccctctcgttatgacagaagttc

SEQ ID NO: 440671 - DNA, 25 bp, Rattus norvegicus
ggccctctcgttttgacagaagttc

SEQ ID NO: 440672 - DNA, 25 bp, Rattus norvegicus
ggccctctgaataatccatttgcta

SEQ ID NO: 440673 - DNA, 25 bp, Rattus norvegicus
ggccctctgaattatccatttgcta

SEQ ID NO: 440674 - DNA, 25 bp, Rattus norvegicus
ggccctctgcgtcttcagcttatga

SEQ ID NO: 440675 - DNA, 25 bp, Rattus norvegicus
ggccctctgcgtgttcagcttatga

SEQ ID NO: 440676 - DNA, 25 bp, Rattus norvegicus
ggccctctgctgattattctgtttc

SEQ ID NO: 440677 - DNA, 25 bp, Rattus norvegicus
ggccctctgctgtttattctgtttc

SEQ ID NO: 440678 - DNA, 25 bp, Rattus norvegicus
ggccctctggaactagagactggtc

SEQ ID NO: 440679 - DNA, 25 bp, Rattus norvegicus
ggccctctggaagtagagactggtc

SEQ ID NO: 440680 - DNA, 25 bp, Rattus norvegicus
ggccctctgttcactttaagattca

SEQ ID NO: 440681 - DNA, 25 bp, Rattus norvegicus
ggccctctgttctctttaagattca

SEQ ID NO: 440682 - DNA, 25 bp, Rattus norvegicus
ggccctcttactctggaaggacaat

SEQ ID NO: 440683 - DNA, 25 bp, Rattus norvegicus
ggccctcttactgtggaaggacaat

SEQ ID NO: 440684 - DNA, 25 bp, Rattus norvegicus
ggccctcttcaaaattcggtcaaat

SEQ ID NO: 440685 - DNA, 25 bp, Rattus norvegicus
ggccctcttcaatattcggtcaaat

SEQ ID NO: 440686 - DNA, 25 bp, Rattus norvegicus
ggccctcttctccaatttgagattg

SEQ ID NO: 440687 - DNA, 25 bp, Rattus norvegicus
ggccctcttctcgaatttgagattg

SEQ ID NO: 440688 - DNA, 25 bp, Rattus norvegicus
ggccctcttgtgcttttttaggaga

SEQ ID NO: 440689 - DNA, 25 bp, Rattus norvegicus
ggccctcttgtggttttttaggaga

SEQ ID NO: 440690 - DNA, 25 bp, Rattus norvegicus
ggccctctttggatacatggcaagt

SEQ ID NO: 440691 - DNA, 25 bp, Rattus norvegicus
ggccctctttggttacatggcaagt

SEQ ID NO: 440692 - DNA, 25 bp, Rattus norvegicus
ggccctgaactactccatttaaatg

SEQ ID NO: 440693 - DNA, 25 bp, Rattus norvegicus
ggccctgaactagtccatttaaatg

SEQ ID NO: 440694 - DNA, 25 bp, Rattus norvegicus
ggccctgaagatcagaacttaccct

SEQ ID NO: 440695 - DNA, 25 bp, Rattus norvegicus
ggccctgaagatgagaacttaccct

SEQ ID NO: 440696 - DNA, 25 bp, Rattus norvegicus
ggccctgaagccatgttatctgcag

SEQ ID NO: 440697 - DNA, 25 bp, Rattus norvegicus
ggccctgaagccttgttatctgcag

SEQ ID NO: 440698 - DNA, 25 bp, Rattus norvegicus
ggccctgacaaccttcggttgaggt

SEQ ID NO: 440699 - DNA, 25 bp, Rattus norvegicus
ggccctgacaacgttcggttgaggt

SEQ ID NO: 440700 - DNA, 25 bp, Rattus norvegicus
ggccctgacaggattgaattcttga

SEQ ID NO: 440701 - DNA, 25 bp, Rattus norvegicus
ggccctgacaggtttgaattcttga

SEQ ID NO: 440702 - DNA, 25 bp, Rattus norvegicus
ggccctgaccagaacaatcagctct

SEQ ID NO: 440703 - DNA, 25 bp, Rattus norvegicus
ggccctgaccagtacaatcagctct

SEQ ID NO: 440704 - DNA, 25 bp, Rattus norvegicus
ggccctgacctcacattagtttagt

SEQ ID NO: 440705 - DNA, 25 bp, Rattus norvegicus
ggccctgacctctcattagtttagt

SEQ ID NO: 440706 - DNA, 25 bp, Rattus norvegicus
ggccctgactggacttcagttacat

SEQ ID NO: 440707 - DNA, 25 bp, Rattus norvegicus
ggccctgactggtcttcagttacat

SEQ ID NO: 440708 - DNA, 25 bp, Rattus norvegicus
ggccctgagatgcatgcagactgct

SEQ ID NO: 440709 - DNA, 25 bp, Rattus norvegicus
ggccctgagatggatgcagactgct

SEQ ID NO: 440710 - DNA, 25 bp, Rattus norvegicus
ggccctgagcagacattgcggagat

SEQ ID NO: 440711 - DNA, 25 bp, Rattus norvegicus
ggccctgagcagtcattgcggagat

SEQ ID NO: 440712 - DNA, 25 bp, Rattus norvegicus
ggccctgagccaccagatcaaacaa

SEQ ID NO: 440713 - DNA, 25 bp, Rattus norvegicus
ggccctgagccagcagatcaaacaa

SEQ ID NO: 440714 - DNA, 25 bp, Rattus norvegicus
ggccctgagcccagtaagcagatgc

SEQ ID NO: 440715 - DNA, 25 bp, Rattus norvegicus
ggccctgagccctgtaagcagatgc

SEQ ID NO: 440716 - DNA, 25 bp, Rattus norvegicus
ggccctgagccgacagtacttggcg

SEQ ID NO: 440717 - DNA, 25 bp, Rattus norvegicus
ggccctgagccgtcagtacttggcg

SEQ ID NO: 440718 - DNA, 25 bp, Rattus norvegicus
ggccctgagcgaccagaccgatgaa

SEQ ID NO: 440719 - DNA, 25 bp, Rattus norvegicus
ggccctgagcgagcagaccgatgaa

SEQ ID NO: 440720 - DNA, 25 bp, Rattus norvegicus
ggccctgatgcccattggactccag

SEQ ID NO: 440721 - DNA, 25 bp, Rattus norvegicus
ggccctgatgccgattggactccag

SEQ ID NO: 440722 - DNA, 25 bp, Rattus norvegicus
ggccctgatgctaccagttactgtt

SEQ ID NO: 440723 - DNA, 25 bp, Rattus norvegicus
ggccctgatgcttccagttactgtt

SEQ ID NO: 440724 - DNA, 25 bp, Rattus norvegicus
ggccctgatttgctcatcccaggag

SEQ ID NO: 440725 - DNA, 25 bp, Rattus norvegicus
ggccctgatttggtcatcccaggag

SEQ ID NO: 440726 - DNA, 25 bp, Rattus norvegicus
ggccctgcaaagactatgtgtgact

SEQ ID NO: 440727 - DNA, 25 bp, Rattus norvegicus
ggccctgcaaagtctatgtgtgact

SEQ ID NO: 440728 - DNA, 25 bp, Rattus norvegicus
ggccctgcaacaatgtcctaagaat

SEQ ID NO: 440729 - DNA, 25 bp, Rattus norvegicus
ggccctgcaacattgtcctaagaat

SEQ ID NO: 440730 - DNA, 25 bp, Rattus norvegicus
ggccctgcagcaaagtccagcagaa

SEQ ID NO: 440731 - DNA, 25 bp, Rattus norvegicus
ggccctgcagcactataagagttct

SEQ ID NO: 440732 - DNA, 25 bp, Rattus norvegicus
ggccctgcagcagtataagagttct

SEQ ID NO: 440733 - DNA, 25 bp, Rattus norvegicus
ggccctgcagcatagtccagcagaa

SEQ ID NO: 440734 - DNA, 25 bp, Rattus norvegicus
ggccctgcaggtcttgttacaaggt

SEQ ID NO: 440735 - DNA, 25 bp, Rattus norvegicus
ggccctgcaggtgttgttacaaggt

SEQ ID NO: 440736 - DNA, 25 bp, Rattus norvegicus
ggccctgccaacaggaccaggctaa

SEQ ID NO: 440737 - DNA, 25 bp, Rattus norvegicus
ggccctgccaactggaccaggctaa

SEQ ID NO: 440738 - DNA, 25 bp, Rattus norvegicus
ggccctgcctacatgaggactggat

SEQ ID NO: 440739 - DNA, 25 bp, Rattus norvegicus
ggccctgcctacttgaggactggat

SEQ ID NO: 440740 - DNA, 25 bp, Rattus norvegicus
ggccctgcggtcattaatgacatta

SEQ ID NO: 440741 - DNA, 25 bp, Rattus norvegicus
ggccctgcggtctttaatgacatta

SEQ ID NO: 440742 - DNA, 25 bp, Rattus norvegicus
ggccctgcgtttcagcgtcttacaa

SEQ ID NO: 440743 - DNA, 25 bp, Rattus norvegicus
ggccctgcgtttgagcgtcttacaa

SEQ ID NO: 440744 - DNA, 25 bp, Rattus norvegicus
ggccctgctctcagttgtaagtgta

SEQ ID NO: 440745 - DNA, 25 bp, Rattus norvegicus
ggccctgctctctgttgtaagtgta

SEQ ID NO: 440746 - DNA, 25 bp, Rattus norvegicus
ggccctggaacaacaagaccttcaa

SEQ ID NO: 440747 - DNA, 25 bp, Rattus norvegicus
ggccctggaacatcaagaccttcaa

SEQ ID NO: 440748 - DNA, 25 bp, Rattus norvegicus
ggccctggaagcatgtagatgccat

SEQ ID NO: 440749 - DNA, 25 bp, Rattus norvegicus
ggccctggaagcttgtagatgccat

SEQ ID NO: 440750 - DNA, 25 bp, Rattus norvegicus
ggccctggactaccagagccatata

SEQ ID NO: 440751 - DNA, 25 bp, Rattus norvegicus
ggccctggactagcagagccatata

SEQ ID NO: 440752 - DNA, 25 bp, Rattus norvegicus
ggccctggactgagtttttgcgatc

SEQ ID NO: 440753 - DNA, 25 bp, Rattus norvegicus
ggccctggactgtgtttttgcgatc

SEQ ID NO: 440754 - DNA, 25 bp, Rattus norvegicus
ggccctggagtgactctgttctaga

SEQ ID NO: 440755 - DNA, 25 bp, Rattus norvegicus
ggccctggagtgtctctgttctaga

SEQ ID NO: 440756 - DNA, 25 bp, Rattus norvegicus
ggccctggcatcattcaatggtaac

SEQ ID NO: 440757 - DNA, 25 bp, Rattus norvegicus
ggccctggcatctttcaatggtaac

SEQ ID NO: 440758 - DNA, 25 bp, Rattus norvegicus
ggccctggcccacagattcaaggta

SEQ ID NO: 440759 - DNA, 25 bp, Rattus norvegicus
ggccctggcccagagattcaaggta

SEQ ID NO: 440760 - DNA, 25 bp, Rattus norvegicus
ggccctggccctactcaggaagaga

SEQ ID NO: 440761 - DNA, 25 bp, Rattus norvegicus
ggccctggcccttctcaggaagaga

SEQ ID NO: 440762 - DNA, 25 bp, Rattus norvegicus
ggccctggctgcattgaagacatgt

SEQ ID NO: 440763 - DNA, 25 bp, Rattus norvegicus
ggccctggctgctttgaagacatgt

SEQ ID NO: 440764 - DNA, 25 bp, Rattus norvegicus
ggccctggcttgcatgatcattatc

SEQ ID NO: 440765 - DNA, 25 bp, Rattus norvegicus
ggccctggcttggatgatcattatc

SEQ ID NO: 440766 - DNA, 25 bp, Rattus norvegicus
ggccctggctttccaataaccaata

SEQ ID NO: 440767 - DNA, 25 bp, Rattus norvegicus
ggccctggctttgcaataaccaata

SEQ ID NO: 440768 - DNA, 25 bp, Rattus norvegicus
ggccctgggctcagtagacagcact

SEQ ID NO: 440769 - DNA, 25 bp, Rattus norvegicus
ggccctgggctctgtagacagcact

SEQ ID NO: 440770 - DNA, 25 bp, Rattus norvegicus
ggccctggtgaaacttctagagctt

SEQ ID NO: 440771 - DNA, 25 bp, Rattus norvegicus
ggccctggtgaatcttctagagctt

SEQ ID NO: 440772 - DNA, 25 bp, Rattus norvegicus
ggccctggtggaacagtagcagcct

SEQ ID NO: 440773 - DNA, 25 bp, Rattus norvegicus
ggccctggtggatcagtagcagcct

SEQ ID NO: 440774 - DNA, 25 bp, Rattus norvegicus
ggccctggttttcgcttggagtcaa

SEQ ID NO: 440775 - DNA, 25 bp, Rattus norvegicus
ggccctggttttggcttggagtcaa

SEQ ID NO: 440776 - DNA, 25 bp, Rattus norvegicus
ggccctgtagaccttgctatttttg

SEQ ID NO: 440777 - DNA, 25 bp, Rattus norvegicus
ggccctgtagacgttgctatttttg

SEQ ID NO: 440778 - DNA, 25 bp, Rattus norvegicus
ggccctgtagcaacacacctgggag

SEQ ID NO: 440779 - DNA, 25 bp, Rattus norvegicus
ggccctgtagcatcacacctgggag

SEQ ID NO: 440780 - DNA, 25 bp, Rattus norvegicus
ggccctgtaggtctggattttcaaa

SEQ ID NO: 440781 - DNA, 25 bp, Rattus norvegicus
ggccctgtaggtgtggattttcaaa

SEQ ID NO: 440782 - DNA, 25 bp, Rattus norvegicus
ggccctgtagtccatttcttacgat

SEQ ID NO: 440783 - DNA, 25 bp, Rattus norvegicus
ggccctgtagtcgatttcttacgat

SEQ ID NO: 440784 - DNA, 25 bp, Rattus norvegicus
ggccctgtcacaccagtggaaattc

SEQ ID NO: 440785 - DNA, 25 bp, Rattus norvegicus
ggccctgtcacagcagtggaaattc

SEQ ID NO: 440786 - DNA, 25 bp, Rattus norvegicus
ggccctgtcagtctggcagatacca

SEQ ID NO: 440787 - DNA, 25 bp, Rattus norvegicus
ggccctgtcagtgtggcagatacca

SEQ ID NO: 440788 - DNA, 25 bp, Rattus norvegicus
ggccctgtgcagattatcagacatt

SEQ ID NO: 440789 - DNA, 25 bp, Rattus norvegicus
ggccctgtgcagtttatcagacatt

SEQ ID NO: 440790 - DNA, 25 bp, Rattus norvegicus
ggccctgtgctgataattcagatca

SEQ ID NO: 440791 - DNA, 25 bp, Rattus norvegicus
ggccctgtgctgttaattcagatca

SEQ ID NO: 440792 - DNA, 25 bp, Rattus norvegicus
ggccctgtgggtatcagtgagttaa

SEQ ID NO: 440793 - DNA, 25 bp, Rattus norvegicus
ggccctgtgggtttcagtgagttaa

SEQ ID NO: 440794 - DNA, 25 bp, Rattus norvegicus
ggccctgtggttcttgctaatgtat

SEQ ID NO: 440795 - DNA, 25 bp, Rattus norvegicus
ggccctgtggttgttgctaatgtat

SEQ ID NO: 440796 - DNA, 25 bp, Rattus norvegicus
ggccctgtgtctagagtgaagagat

SEQ ID NO: 440797 - DNA, 25 bp, Rattus norvegicus
ggccctgtgtcttgagtgaagagat

SEQ ID NO: 440798 - DNA, 25 bp, Rattus norvegicus
ggccctgttacaccataacctggca

SEQ ID NO: 440799 - DNA, 25 bp, Rattus norvegicus
ggccctgttacagcataacctggca

SEQ ID NO: 440800 - DNA, 25 bp, Rattus norvegicus
ggccctgttagtacttaggttccat

SEQ ID NO: 440801 - DNA, 25 bp, Rattus norvegicus
ggccctgttagttcttaggttccat

SEQ ID NO: 440802 - DNA, 25 bp, Rattus norvegicus
ggccctgttggaatataattcttca

SEQ ID NO: 440803 - DNA, 25 bp, Rattus norvegicus
ggccctgttggattataattcttca

SEQ ID NO: 440804 - DNA, 25 bp, Rattus norvegicus
ggccctgttttacagccatgcaaca

SEQ ID NO: 440805 - DNA, 25 bp, Rattus norvegicus
ggccctgttttagagccatgcaaca

SEQ ID NO: 440806 - DNA, 25 bp, Rattus norvegicus
ggcccttaccccaaggtgtgtggat

SEQ ID NO: 440807 - DNA, 25 bp, Rattus norvegicus
ggcccttacccctaggtgtgtggat

SEQ ID NO: 440808 - DNA, 25 bp, Rattus norvegicus
ggcccttaccggagactatcgagga

SEQ ID NO: 440809 - DNA, 25 bp, Rattus norvegicus
ggcccttaccggtgactatcgagga

SEQ ID NO: 440810 - DNA, 25 bp, Rattus norvegicus
ggcccttagtgtaggaaacagccct

SEQ ID NO: 440811 - DNA, 25 bp, Rattus norvegicus
ggcccttagtgttggaaacagccct

SEQ ID NO: 440812 - DNA, 25 bp, Rattus norvegicus
ggcccttcaaagactggctttcatt

SEQ ID NO: 440813 - DNA, 25 bp, Rattus norvegicus
ggcccttcaaagtctggctttcatt

SEQ ID NO: 440814 - DNA, 25 bp, Rattus norvegicus
ggcccttcacatagtacatgctgga

SEQ ID NO: 440815 - DNA, 25 bp, Rattus norvegicus
ggcccttcacattgtacatgctgga

SEQ ID NO: 440816 - DNA, 25 bp, Rattus norvegicus
ggcccttcagatcgcattgtctgaa

SEQ ID NO: 440817 - DNA, 25 bp, Rattus norvegicus
ggcccttcagatggcattgtctgaa

SEQ ID NO: 440818 - DNA, 25 bp, Rattus norvegicus
ggcccttcatggagtcttgaaccag

SEQ ID NO: 440819 - DNA, 25 bp, Rattus norvegicus
ggcccttcatggtgtcttgaaccag

SEQ ID NO: 440820 - DNA, 25 bp, Rattus norvegicus
ggcccttcctcgagaattggatgca

SEQ ID NO: 440821 - DNA, 25 bp, Rattus norvegicus
ggcccttcctcgtgaattggatgca

SEQ ID NO: 440822 - DNA, 25 bp, Rattus norvegicus
ggcccttctagtatctatctgtgga

SEQ ID NO: 440823 - DNA, 25 bp, Rattus norvegicus
ggcccttctagtttctatctgtgga

SEQ ID NO: 440824 - DNA, 25 bp, Rattus norvegicus
ggcccttctgagagaataaagtatt

SEQ ID NO: 440825 - DNA, 25 bp, Rattus norvegicus
ggcccttctgagtgaataaagtatt

SEQ ID NO: 440826 - DNA, 25 bp, Rattus norvegicus
ggcccttctgctattgagtttctga

SEQ ID NO: 440827 - DNA, 25 bp, Rattus norvegicus
ggcccttctgcttttgagtttctga

SEQ ID NO: 440828 - DNA, 25 bp, Rattus norvegicus
ggcccttctgggaacaactagttat

SEQ ID NO: 440829 - DNA, 25 bp, Rattus norvegicus
ggcccttctgggtacaactagttat

SEQ ID NO: 440830 - DNA, 25 bp, Rattus norvegicus
ggcccttctgtgaatgctgccagca

SEQ ID NO: 440831 - DNA, 25 bp, Rattus norvegicus
ggcccttctgtgtatgctgccagca

SEQ ID NO: 440832 - DNA, 25 bp, Rattus norvegicus
ggcccttcttctctggaatggacaa

SEQ ID NO: 440833 - DNA, 25 bp, Rattus norvegicus
ggcccttcttctgtggaatggacaa

SEQ ID NO: 440834 - DNA, 25 bp, Rattus norvegicus
ggcccttgaaatctgtgagcccaaa

SEQ ID NO: 440835 - DNA, 25 bp, Rattus norvegicus
ggcccttgaaatgtgtgagcccaaa

SEQ ID NO: 440836 - DNA, 25 bp, Rattus norvegicus
ggcccttgagaaaatatcccaaaaa

SEQ ID NO: 440837 - DNA, 25 bp, Rattus norvegicus
ggcccttgagaatatatcccaaaaa

SEQ ID NO: 440838 - DNA, 25 bp, Rattus norvegicus
ggcccttgagagacatgaacacatc

SEQ ID NO: 440839 - DNA, 25 bp, Rattus norvegicus
ggcccttgagagtcatgaacacatc

SEQ ID NO: 440840 - DNA, 25 bp, Rattus norvegicus
ggcccttgaggtaaaaccgtcagct

SEQ ID NO: 440841 - DNA, 25 bp, Rattus norvegicus
ggcccttgaggttaaaccgtcagct

SEQ ID NO: 440842 - DNA, 25 bp, Rattus norvegicus
ggcccttgcacccaggtgaattctg

SEQ ID NO: 440843 - DNA, 25 bp, Rattus norvegicus
ggcccttgcaccgaggtgaattctg

SEQ ID NO: 440844 - DNA, 25 bp, Rattus norvegicus
ggcccttgcacgcaaatttgaagaa

SEQ ID NO: 440845 - DNA, 25 bp, Rattus norvegicus
ggcccttgcacggaaatttgaagaa

SEQ ID NO: 440846 - DNA, 25 bp, Rattus norvegicus
ggcccttgcaggaggtaaggtaaat

SEQ ID NO: 440847 - DNA, 25 bp, Rattus norvegicus
ggcccttgcaggtggtaaggtaaat

SEQ ID NO: 440848 - DNA, 25 bp, Rattus norvegicus
ggcccttgctgcagtaggctgcctg

SEQ ID NO: 440849 - DNA, 25 bp, Rattus norvegicus
ggcccttgctgctgtaggctgcctg

SEQ ID NO: 440850 - DNA, 25 bp, Rattus norvegicus
ggcccttggctcaggaatactgtac

SEQ ID NO: 440851 - DNA, 25 bp, Rattus norvegicus
ggcccttggctcatctgataattgg

SEQ ID NO: 440852 - DNA, 25 bp, Rattus norvegicus
ggcccttggctctggaatactgtac

SEQ ID NO: 440853 - DNA, 25 bp, Rattus norvegicus
ggcccttggctcttctgataattgg

SEQ ID NO: 440854 - DNA, 25 bp, Rattus norvegicus
ggcccttgtgagacccaccctggga

SEQ ID NO: 440855 - DNA, 25 bp, Rattus norvegicus
ggcccttgtgagtcccaccctggga

SEQ ID NO: 440856 - DNA, 25 bp, Rattus norvegicus
ggcccttgtggcagcaatacaggca

SEQ ID NO: 440857 - DNA, 25 bp, Rattus norvegicus
ggcccttgtggctgcaatacaggca

SEQ ID NO: 440858 - DNA, 25 bp, Rattus norvegicus
ggcccttgtgtacagtgttgtttca

SEQ ID NO: 440859 - DNA, 25 bp, Rattus norvegicus
ggcccttgtgtagagtgttgtttca

SEQ ID NO: 440860 - DNA, 25 bp, Rattus norvegicus
ggcccttgttcaagctcagtagtgg

SEQ ID NO: 440861 - DNA, 25 bp, Rattus norvegicus
ggcccttgttcatgctcagtagtgg

SEQ ID NO: 440862 - DNA, 25 bp, Rattus norvegicus
ggccctttcatcattttaaatatct

SEQ ID NO: 440863 - DNA, 25 bp, Rattus norvegicus
ggccctttcatctttttaaatatct

SEQ ID NO: 440864 - DNA, 25 bp, Rattus norvegicus
ggccctttccgtaggtcagactcat

SEQ ID NO: 440865 - DNA, 25 bp, Rattus norvegicus
ggccctttccgttggtcagactcat

SEQ ID NO: 440866 - DNA, 25 bp, Rattus norvegicus
ggccctttgaagcagatacactgtc

SEQ ID NO: 440867 - DNA, 25 bp, Rattus norvegicus
ggccctttgaaggagatacactgtc

SEQ ID NO: 440868 - DNA, 25 bp, Rattus norvegicus
ggccctttgcagagaagtccaccta

SEQ ID NO: 440869 - DNA, 25 bp, Rattus norvegicus
ggccctttgcagtgaagtccaccta

SEQ ID NO: 440870 - DNA, 25 bp, Rattus norvegicus
ggccctttggctagtgtagtgagtt

SEQ ID NO: 440871 - DNA, 25 bp, Rattus norvegicus
ggccctttggcttgtgtagtgagtt

SEQ ID NO: 440872 - DNA, 25 bp, Rattus norvegicus
ggccctttgtgcagcagtggtctgt

SEQ ID NO: 440873 - DNA, 25 bp, Rattus norvegicus
ggccctttgtgctgcagtggtctgt

SEQ ID NO: 440874 - DNA, 25 bp, Rattus norvegicus
ggcccttttgaccatatccatgtgt

SEQ ID NO: 440875 - DNA, 25 bp, Rattus norvegicus
ggcccttttgacgatatccatgtgt

SEQ ID NO: 440876 - DNA, 25 bp, Rattus norvegicus
ggcccttttgccaccaggtgcagag

SEQ ID NO: 440877 - DNA, 25 bp, Rattus norvegicus
ggcccttttgcctccaggtgcagag

SEQ ID NO: 440878 - DNA, 25 bp, Rattus norvegicus
ggcccttttgtacaattgtgctctc

SEQ ID NO: 440879 - DNA, 25 bp, Rattus norvegicus
ggcccttttgtagaattgtgctctc

SEQ ID NO: 440880 - DNA, 25 bp, Rattus norvegicus
ggcccttttgtcctcagaacagatg

SEQ ID NO: 440881 - DNA, 25 bp, Rattus norvegicus
ggcccttttgtcgtcagaacagatg

SEQ ID NO: 440882 - DNA, 25 bp, Rattus norvegicus
ggcccttttttcacatctcaaagaa

SEQ ID NO: 440883 - DNA, 25 bp, Rattus norvegicus
ggcccttttttctcatctcaaagaa

SEQ ID NO: 440884 - DNA, 25 bp, Rattus norvegicus
ggccgaaagctgacgctgttcatta

SEQ ID NO: 440885 - DNA, 25 bp, Rattus norvegicus
ggccgaaagctgtcgctgttcatta

SEQ ID NO: 440886 - DNA, 25 bp, Rattus norvegicus
ggccgaaatgacaccttttacctga

SEQ ID NO: 440887 - DNA, 25 bp, Rattus norvegicus
ggccgaaatgactccttttacctga

SEQ ID NO: 440888 - DNA, 25 bp, Rattus norvegicus
ggccgaaatgttcaaaagcctcttt

SEQ ID NO: 440889 - DNA, 25 bp, Rattus norvegicus
ggccgaaatgttgaaaagcctcttt

SEQ ID NO: 440890 - DNA, 25 bp, Rattus norvegicus
ggccgaaccatgaagtggacctgca

SEQ ID NO: 440891 - DNA, 25 bp, Rattus norvegicus
ggccgaaccatgtagtggacctgca

SEQ ID NO: 440892 - DNA, 25 bp, Rattus norvegicus
ggccgaacgtccagcaacacgtggg

SEQ ID NO: 440893 - DNA, 25 bp, Rattus norvegicus
ggccgaacgtcctgcaacacgtggg

SEQ ID NO: 440894 - DNA, 25 bp, Rattus norvegicus
ggccgaactgctctttgttaggtgc

SEQ ID NO: 440895 - DNA, 25 bp, Rattus norvegicus
ggccgaactgctgtttgttaggtgc

SEQ ID NO: 440896 - DNA, 25 bp, Rattus norvegicus
ggccgaatcattcttgctgtgtgac

SEQ ID NO: 440897 - DNA, 25 bp, Rattus norvegicus
ggccgaatcattgttgctgtgtgac

SEQ ID NO: 440898 - DNA, 25 bp, Rattus norvegicus
ggccgacaagatacctctcgcatgt

SEQ ID NO: 440899 - DNA, 25 bp, Rattus norvegicus
ggccgacaagattcctctcgcatgt

SEQ ID NO: 440900 - DNA, 25 bp, Rattus norvegicus
ggccgacagaaaaccaactgctctt

SEQ ID NO: 440901 - DNA, 25 bp, Rattus norvegicus
ggccgacagaaatccaactgctctt

SEQ ID NO: 440902 - DNA, 25 bp, Rattus norvegicus
ggccgacagtgaccaatgaccgatc

SEQ ID NO: 440903 - DNA, 25 bp, Rattus norvegicus
ggccgacagtgagcaatgaccgatc

SEQ ID NO: 440904 - DNA, 25 bp, Rattus norvegicus
ggccgacatgctacatgaacagcgc

SEQ ID NO: 440905 - DNA, 25 bp, Rattus norvegicus
ggccgacatgcttcatgaacagcgc

SEQ ID NO: 440906 - DNA, 25 bp, Rattus norvegicus
ggccgaccagcacgacaagtacatg

SEQ ID NO: 440907 - DNA, 25 bp, Rattus norvegicus
ggccgaccagcaggacaagtacatg

SEQ ID NO: 440908 - DNA, 25 bp, Rattus norvegicus
ggccgaccagtgaactatgaagcaa

SEQ ID NO: 440909 - DNA, 25 bp, Rattus norvegicus
ggccgaccagtgtactatgaagcaa

SEQ ID NO: 440910 - DNA, 25 bp, Rattus norvegicus
ggccgaccatgcaactacgagagga

SEQ ID NO: 440911 - DNA, 25 bp, Rattus norvegicus
ggccgaccatgctactacgagagga

SEQ ID NO: 440912 - DNA, 25 bp, Rattus norvegicus
ggccgacccggaccagcttgagcaa

SEQ ID NO: 440913 - DNA, 25 bp, Rattus norvegicus
ggccgacccggagcagcttgagcaa

SEQ ID NO: 440914 - DNA, 25 bp, Rattus norvegicus
ggccgacctggtccaggaagacatt

SEQ ID NO: 440915 - DNA, 25 bp, Rattus norvegicus
ggccgacctggtgcaggaagacatt

SEQ ID NO: 440916 - DNA, 25 bp, Rattus norvegicus
ggccgacgaagaaacactgttcagt

SEQ ID NO: 440917 - DNA, 25 bp, Rattus norvegicus
ggccgacgaagatacactgttcagt

SEQ ID NO: 440918 - DNA, 25 bp, Rattus norvegicus
ggccgactaaccagcggattgagta

SEQ ID NO: 440919 - DNA, 25 bp, Rattus norvegicus
ggccgactaacctgcggattgagta

SEQ ID NO: 440920 - DNA, 25 bp, Rattus norvegicus
ggccgactgtgaaagcttcattctt

SEQ ID NO: 440921 - DNA, 25 bp, Rattus norvegicus
ggccgactgtgatagcttcattctt

SEQ ID NO: 440922 - DNA, 25 bp, Rattus norvegicus
ggccgactgtttaatcttcaggaga

SEQ ID NO: 440923 - DNA, 25 bp, Rattus norvegicus
ggccgactgttttatcttcaggaga

SEQ ID NO: 440924 - DNA, 25 bp, Rattus norvegicus
ggccgacttacgcttaaaggagctg

SEQ ID NO: 440925 - DNA, 25 bp, Rattus norvegicus
ggccgacttacggttaaaggagctg

SEQ ID NO: 440926 - DNA, 25 bp, Rattus norvegicus
ggccgacttttcaggaatagcttcc

SEQ ID NO: 440927 - DNA, 25 bp, Rattus norvegicus
ggccgacttttctggaatagcttcc

SEQ ID NO: 440928 - DNA, 25 bp, Rattus norvegicus
ggccgagaaaaaagcgctggactga

SEQ ID NO: 440929 - DNA, 25 bp, Rattus norvegicus
ggccgagaaaaatgcgctggactga

SEQ ID NO: 440930 - DNA, 25 bp, Rattus norvegicus
ggccgagacaccacctatgggttgg

SEQ ID NO: 440931 - DNA, 25 bp, Rattus norvegicus
ggccgagacacctcctatgggttgg

SEQ ID NO: 440932 - DNA, 25 bp, Rattus norvegicus
ggccgagagtcccacgaagacactg

SEQ ID NO: 440933 - DNA, 25 bp, Rattus norvegicus
ggccgagagtccgacgaagacactg

SEQ ID NO: 440934 - DNA, 25 bp, Rattus norvegicus
ggccgagcaaccagttttgacagtc

SEQ ID NO: 440935 - DNA, 25 bp, Rattus norvegicus
ggccgagcaacctgttttgacagtc

SEQ ID NO: 440936 - DNA, 25 bp, Rattus norvegicus
ggccgagccattacccagtgggaag

SEQ ID NO: 440937 - DNA, 25 bp, Rattus norvegicus
ggccgagccatttcccagtgggaag

SEQ ID NO: 440938 - DNA, 25 bp, Rattus norvegicus
ggccgagctgtcagcggcggcgaga

SEQ ID NO: 440939 - DNA, 25 bp, Rattus norvegicus
ggccgagctgtctgcggcggcgaga

SEQ ID NO: 440940 - DNA, 25 bp, Rattus norvegicus
ggccgagcttttatctttgtttgca

SEQ ID NO: 440941 - DNA, 25 bp, Rattus norvegicus
ggccgagcttttttctttgtttgca

SEQ ID NO: 440942 - DNA, 25 bp, Rattus norvegicus
ggccgaggactacatactgggatct

SEQ ID NO: 440943 - DNA, 25 bp, Rattus norvegicus
ggccgaggactagatactgggatct

SEQ ID NO: 440944 - DNA, 25 bp, Rattus norvegicus
ggccgaggagaacatccgctactat

SEQ ID NO: 440945 - DNA, 25 bp, Rattus norvegicus
ggccgaggagaagatccgctactat

SEQ ID NO: 440946 - DNA, 25 bp, Rattus norvegicus
ggccgaggccagatttcaggacgaa

SEQ ID NO: 440947 - DNA, 25 bp, Rattus norvegicus
ggccgaggccagttttcaggacgaa

SEQ ID NO: 440948 - DNA, 25 bp, Rattus norvegicus
ggccgaggctgcacagttgagtcct

SEQ ID NO: 440949 - DNA, 25 bp, Rattus norvegicus
ggccgaggctgctcagttgagtcct

SEQ ID NO: 440950 - DNA, 25 bp, Rattus norvegicus
ggccgaggctggacaggacttgggt

SEQ ID NO: 440951 - DNA, 25 bp, Rattus norvegicus
ggccgaggctggtcaggacttgggt

SEQ ID NO: 440952 - DNA, 25 bp, Rattus norvegicus
ggccgaggtacgctatctcagtcgc

SEQ ID NO: 440953 - DNA, 25 bp, Rattus norvegicus
ggccgaggtacggtatctcagtcgc

SEQ ID NO: 440954 - DNA, 25 bp, Rattus norvegicus
ggccgaggtgccaacagataacaaa

SEQ ID NO: 440955 - DNA, 25 bp, Rattus norvegicus
ggccgaggtgccctagctaacagaa

SEQ ID NO: 440956 - DNA, 25 bp, Rattus norvegicus
ggccgaggtgccgtagctaacagaa

SEQ ID NO: 440957 - DNA, 25 bp, Rattus norvegicus
ggccgaggtgcctacagataacaaa

SEQ ID NO: 440958 - DNA, 25 bp, Rattus norvegicus
ggccgagttaccacagtgccacatg

SEQ ID NO: 440959 - DNA, 25 bp, Rattus norvegicus
ggccgagttacctcagtgccacatg

SEQ ID NO: 440960 - DNA, 25 bp, Rattus norvegicus
ggccgatccatccgattacacacga

SEQ ID NO: 440961 - DNA, 25 bp, Rattus norvegicus
ggccgatccatcggattacacacga

SEQ ID NO: 440962 - DNA, 25 bp, Rattus norvegicus
ggccgatctgtgagtcccatgtaaa

SEQ ID NO: 440963 - DNA, 25 bp, Rattus norvegicus
ggccgatctgtgtgtcccatgtaaa

SEQ ID NO: 440964 - DNA, 25 bp, Rattus norvegicus
ggccgatgtagcagaacttgtcctt

SEQ ID NO: 440965 - DNA, 25 bp, Rattus norvegicus
ggccgatgtagctgaacttgtcctt

SEQ ID NO: 440966 - DNA, 25 bp, Rattus norvegicus
ggccgatgtcttagggcatgacact

SEQ ID NO: 440967 - DNA, 25 bp, Rattus norvegicus
ggccgatgtctttgggcatgacact

SEQ ID NO: 440968 - DNA, 25 bp, Rattus norvegicus
ggccgatgtggtatgcaaatgtagt

SEQ ID NO: 440969 - DNA, 25 bp, Rattus norvegicus
ggccgatgtggtttgcaaatgtagt

SEQ ID NO: 440970 - DNA, 25 bp, Rattus norvegicus
ggccgcaagggcagggacctacaat

SEQ ID NO: 440971 - DNA, 25 bp, Rattus norvegicus
ggccgcaagggctgggacctacaat

SEQ ID NO: 440972 - DNA, 25 bp, Rattus norvegicus
ggccgcactccgagcacgcaaaggg

SEQ ID NO: 440973 - DNA, 25 bp, Rattus norvegicus
ggccgcactccgtgcacgcaaaggg

SEQ ID NO: 440974 - DNA, 25 bp, Rattus norvegicus
ggccgcacttgcaacaagacgtcta

SEQ ID NO: 440975 - DNA, 25 bp, Rattus norvegicus
ggccgcacttgctacaagacgtcta

SEQ ID NO: 440976 - DNA, 25 bp, Rattus norvegicus
ggccgcagctgcatattttgcacaa

SEQ ID NO: 440977 - DNA, 25 bp, Rattus norvegicus
ggccgcagctgcttattttgcacaa

SEQ ID NO: 440978 - DNA, 25 bp, Rattus norvegicus
ggccgcaggaagatgccgcaaaact

SEQ ID NO: 440979 - DNA, 25 bp, Rattus norvegicus
ggccgcaggaagttgccgcaaaact

SEQ ID NO: 440980 - DNA, 25 bp, Rattus norvegicus
ggccgcagggctattccgtaagagt

SEQ ID NO: 440981 - DNA, 25 bp, Rattus norvegicus
ggccgcagggcttttccgtaagagt

SEQ ID NO: 440982 - DNA, 25 bp, Rattus norvegicus
ggccgcatcggcagcaaatataaga

SEQ ID NO: 440983 - DNA, 25 bp, Rattus norvegicus
ggccgcatcggctgcaaatataaga

SEQ ID NO: 440984 - DNA, 25 bp, Rattus norvegicus
ggccgccaaagtaacttggagcaaa

SEQ ID NO: 440985 - DNA, 25 bp, Rattus norvegicus
ggccgccaaagttacttggagcaaa

SEQ ID NO: 440986 - DNA, 25 bp, Rattus norvegicus
ggccgccagttcaaacttgtcttaa

SEQ ID NO: 440987 - DNA, 25 bp, Rattus norvegicus
ggccgccagttctaacttgtcttaa

SEQ ID NO: 440988 - DNA, 25 bp, Rattus norvegicus
ggccgccatcggaaagctgcaggta

SEQ ID NO: 440989 - DNA, 25 bp, Rattus norvegicus
ggccgccatcggtaagctgcaggta

SEQ ID NO: 440990 - DNA, 25 bp, Rattus norvegicus
ggccgcccatttcagacagaataca

SEQ ID NO: 440991 - DNA, 25 bp, Rattus norvegicus
ggccgcccatttgagacagaataca

SEQ ID NO: 440992 - DNA, 25 bp, Rattus norvegicus
ggccgccctgaacatgtttccagaa

SEQ ID NO: 440993 - DNA, 25 bp, Rattus norvegicus
ggccgccctgaagatgtttccagaa

SEQ ID NO: 440994 - DNA, 25 bp, Rattus norvegicus
ggccgccgagtgcatcataagctgt

SEQ ID NO: 440995 - DNA, 25 bp, Rattus norvegicus
ggccgccgagtggatcataagctgt

SEQ ID NO: 440996 - DNA, 25 bp, Rattus norvegicus
ggccgccgctttaactagaatcaag

SEQ ID NO: 440997 - DNA, 25 bp, Rattus norvegicus
ggccgccgcttttactagaatcaag

SEQ ID NO: 440998 - DNA, 25 bp, Rattus norvegicus
ggccgcctacgtcttgttttaccag

SEQ ID NO: 440999 - DNA, 25 bp, Rattus norvegicus
ggccgcctacgtgttgttttaccag

SEQ ID NO: 441000 - DNA, 25 bp, Rattus norvegicus
ggccgcctacttcagttatgtttca

SEQ ID NO: 441001 - DNA, 25 bp, Rattus norvegicus
ggccgcctacttgagttatgtttca

SEQ ID NO: 441002 - DNA, 25 bp, Rattus norvegicus
ggccgcctcggaacccaggaaaagc

SEQ ID NO: 441003 - DNA, 25 bp, Rattus norvegicus
ggccgcctcggatcccaggaaaagc

SEQ ID NO: 441004 - DNA, 25 bp, Rattus norvegicus
ggccgcctctagaaagacccaggag

SEQ ID NO: 441005 - DNA, 25 bp, Rattus norvegicus
ggccgcctctagtaagacccaggag

SEQ ID NO: 441006 - DNA, 25 bp, Rattus norvegicus
ggccgcctgcacaacaaactgggtc

SEQ ID NO: 441007 - DNA, 25 bp, Rattus norvegicus
ggccgcctgcactacaaactgggtc

SEQ ID NO: 441008 - DNA, 25 bp, Rattus norvegicus
ggccgcctgcatatcagctttgtgt

SEQ ID NO: 441009 - DNA, 25 bp, Rattus norvegicus
ggccgcctgcatttcagctttgtgt

SEQ ID NO: 441010 - DNA, 25 bp, Rattus norvegicus
ggccgcctggaaatgcttgcaacaa

SEQ ID NO: 441011 - DNA, 25 bp, Rattus norvegicus
ggccgcctggaattgcttgcaacaa

SEQ ID NO: 441012 - DNA, 25 bp, Rattus norvegicus
ggccgcctggttcaaattctggcat

SEQ ID NO: 441013 - DNA, 25 bp, Rattus norvegicus
ggccgcctggttgaaattctggcat

SEQ ID NO: 441014 - DNA, 25 bp, Rattus norvegicus
ggccgccttgacacagagcttaggt

SEQ ID NO: 441015 - DNA, 25 bp, Rattus norvegicus
ggccgccttgactcagagcttaggt

SEQ ID NO: 441016 - DNA, 25 bp, Rattus norvegicus
ggccgccttggtctcttacaggaga

SEQ ID NO: 441017 - DNA, 25 bp, Rattus norvegicus
ggccgccttggtgtcttacaggaga

SEQ ID NO: 441018 - DNA, 25 bp, Rattus norvegicus
ggccgcgaacttcctagattgttaa

SEQ ID NO: 441019 - DNA, 25 bp, Rattus norvegicus
ggccgcgaacttgctagattgttaa

SEQ ID NO: 441020 - DNA, 25 bp, Rattus norvegicus
ggccgcgccgcgcgcttaagagcga

SEQ ID NO: 441021 - DNA, 25 bp, Rattus norvegicus
ggccgcgccgcgggcttaagagcga

SEQ ID NO: 441022 - DNA, 25 bp, Rattus norvegicus
ggccgcgccggcaaatatggccgtc

SEQ ID NO: 441023 - DNA, 25 bp, Rattus norvegicus
ggccgcgccggctaatatggccgtc

SEQ ID NO: 441024 - DNA, 25 bp, Rattus norvegicus
ggccgcgctagtaatgtcagttccg

SEQ ID NO: 441025 - DNA, 25 bp, Rattus norvegicus
ggccgcgctagttatgtcagttccg

SEQ ID NO: 441026 - DNA, 25 bp, Rattus norvegicus
ggccgcggcaatctacagcagcatg

SEQ ID NO: 441027 - DNA, 25 bp, Rattus norvegicus
ggccgcggcaatgtacagcagcatg

SEQ ID NO: 441028 - DNA, 25 bp, Rattus norvegicus
ggccgcgtctggactgaggttttaa

SEQ ID NO: 441029 - DNA, 25 bp, Rattus norvegicus
ggccgcgtctggtctgaggttttaa

SEQ ID NO: 441030 - DNA, 25 bp, Rattus norvegicus
ggccgctaggtcatggtcgccactt

SEQ ID NO: 441031 - DNA, 25 bp, Rattus norvegicus
ggccgctaggtcttggtcgccactt

SEQ ID NO: 441032 - DNA, 25 bp, Rattus norvegicus
ggccgctcgagcatgcatctagagg

SEQ ID NO: 441033 - DNA, 25 bp, Rattus norvegicus
ggccgctcgagcttgcatctagagg

SEQ ID NO: 441034 - DNA, 25 bp, Rattus norvegicus
ggccgctctgggagatttgactgac

SEQ ID NO: 441035 - DNA, 25 bp, Rattus norvegicus
ggccgctctgggtgatttgactgac

SEQ ID NO: 441036 - DNA, 25 bp, Rattus norvegicus
ggccgctgacccacatggcagagaa

SEQ ID NO: 441037 - DNA, 25 bp, Rattus norvegicus
ggccgctgaccctcatggcagagaa

SEQ ID NO: 441038 - DNA, 25 bp, Rattus norvegicus
ggccgctgcctacaggaaaatctta

SEQ ID NO: 441039 - DNA, 25 bp, Rattus norvegicus
ggccgctgcctagaggaaaatctta

SEQ ID NO: 441040 - DNA, 25 bp, Rattus norvegicus
ggccgctgtgccatcaaagccaaag

SEQ ID NO: 441041 - DNA, 25 bp, Rattus norvegicus
ggccgctgtgccttcaaagccaaag

SEQ ID NO: 441042 - DNA, 25 bp, Rattus norvegicus
ggccgctgttcacttgtaagataac

SEQ ID NO: 441043 - DNA, 25 bp, Rattus norvegicus
ggccgctgttcagttgtaagataac

SEQ ID NO: 441044 - DNA, 25 bp, Rattus norvegicus
ggccgcttaggcaagaagtgccaac

SEQ ID NO: 441045 - DNA, 25 bp, Rattus norvegicus
ggccgcttaggctagaagtgccaac

SEQ ID NO: 441046 - DNA, 25 bp, Rattus norvegicus
ggccgcttatttccgatgtctttgg

SEQ ID NO: 441047 - DNA, 25 bp, Rattus norvegicus
ggccgcttatttgcgatgtctttgg

SEQ ID NO: 441048 - DNA, 25 bp, Rattus norvegicus
ggccgcttcatcagtggttagggac

SEQ ID NO: 441049 - DNA, 25 bp, Rattus norvegicus
ggccgcttcatctgtggttagggac

SEQ ID NO: 441050 - DNA, 25 bp, Rattus norvegicus
ggccgcttcctcaagatcgccgagg

SEQ ID NO: 441051 - DNA, 25 bp, Rattus norvegicus
ggccgcttcctctagatcgccgagg

SEQ ID NO: 441052 - DNA, 25 bp, Rattus norvegicus
ggccgcttggccctggcgttggcgt

SEQ ID NO: 441053 - DNA, 25 bp, Rattus norvegicus
ggccgcttggccgtggcgttggcgt

SEQ ID NO: 441054 - DNA, 25 bp, Rattus norvegicus
ggccgcttgggaatgcaggatctct

SEQ ID NO: 441055 - DNA, 25 bp, Rattus norvegicus
ggccgcttgggattgcaggatctct

SEQ ID NO: 441056 - DNA, 25 bp, Rattus norvegicus
ggccgctttggtcaggagatctttc

SEQ ID NO: 441057 - DNA, 25 bp, Rattus norvegicus
ggccgctttggtgaggagatctttc

SEQ ID NO: 441058 - DNA, 25 bp, Rattus norvegicus
ggccggaagtcgacctttctctgag

SEQ ID NO: 441059 - DNA, 25 bp, Rattus norvegicus
ggccggaagtcgtcctttctctgag

SEQ ID NO: 441060 - DNA, 25 bp, Rattus norvegicus
ggccggacccgtcacagaagtctct

SEQ ID NO: 441061 - DNA, 25 bp, Rattus norvegicus
ggccggacccgtgacagaagtctct

SEQ ID NO: 441062 - DNA, 25 bp, Rattus norvegicus
ggccggaccttacagctaaatctta

SEQ ID NO: 441063 - DNA, 25 bp, Rattus norvegicus
ggccggaccttagagctaaatctta

SEQ ID NO: 441064 - DNA, 25 bp, Rattus norvegicus
ggccggactctgagtgacctaatag

SEQ ID NO: 441065 - DNA, 25 bp, Rattus norvegicus
ggccggactctgtgtgacctaatag

SEQ ID NO: 441066 - DNA, 25 bp, Rattus norvegicus
ggccggagaactcagctctgcttag

SEQ ID NO: 441067 - DNA, 25 bp, Rattus norvegicus
ggccggagaactgagctctgcttag

SEQ ID NO: 441068 - DNA, 25 bp, Rattus norvegicus
ggccggagatacagctcagctggta

SEQ ID NO: 441069 - DNA, 25 bp, Rattus norvegicus
ggccggagatactgctcagctggta

SEQ ID NO: 441070 - DNA, 25 bp, Rattus norvegicus
ggccggagccgaaggatgtattaac

SEQ ID NO: 441071 - DNA, 25 bp, Rattus norvegicus
ggccggagccgatggatgtattaac

SEQ ID NO: 441072 - DNA, 25 bp, Rattus norvegicus
ggccggagcgctccagcagtagcag

SEQ ID NO: 441073 - DNA, 25 bp, Rattus norvegicus
ggccggagcgctgcagcagtagcag

SEQ ID NO: 441074 - DNA, 25 bp, Rattus norvegicus
ggccggagggccagttctcaatgca

SEQ ID NO: 441075 - DNA, 25 bp, Rattus norvegicus
ggccggagggcctgttctcaatgca

SEQ ID NO: 441076 - DNA, 25 bp, Rattus norvegicus
ggccggagtacacctggacaccaaa

SEQ ID NO: 441077 - DNA, 25 bp, Rattus norvegicus
ggccggagtacagctggacaccaaa

SEQ ID NO: 441078 - DNA, 25 bp, Rattus norvegicus
ggccggagtcttacagaagtaacca

SEQ ID NO: 441079 - DNA, 25 bp, Rattus norvegicus
ggccggagtctttcagaagtaacca

SEQ ID NO: 441080 - DNA, 25 bp, Rattus norvegicus
ggccggatctgccatacaaaagagc

SEQ ID NO: 441081 - DNA, 25 bp, Rattus norvegicus
ggccggatctgcgatacaaaagagc

SEQ ID NO: 441082 - DNA, 25 bp, Rattus norvegicus
ggccggcaaaccagagagtgaccta

SEQ ID NO: 441083 - DNA, 25 bp, Rattus norvegicus
ggccggcaaacctgagagtgaccta

SEQ ID NO: 441084 - DNA, 25 bp, Rattus norvegicus
ggccggcaggtacatgctgatcatc

SEQ ID NO: 441085 - DNA, 25 bp, Rattus norvegicus
ggccggcaggtagatgctgatcatc

SEQ ID NO: 441086 - DNA, 25 bp, Rattus norvegicus
ggccggccatagcacgttgtcataa

SEQ ID NO: 441087 - DNA, 25 bp, Rattus norvegicus
ggccggccataggacgttgtcataa

SEQ ID NO: 441088 - DNA, 25 bp, Rattus norvegicus
ggccggccgaagacggtcagcatca

SEQ ID NO: 441089 - DNA, 25 bp, Rattus norvegicus
ggccggccgaagtcggtcagcatca

SEQ ID NO: 441090 - DNA, 25 bp, Rattus norvegicus
ggccggcgtctgatggaaatgcact

SEQ ID NO: 441091 - DNA, 25 bp, Rattus norvegicus
ggccggcgtctgttggaaatgcact

SEQ ID NO: 441092 - DNA, 25 bp, Rattus norvegicus
ggccggcttagacacctcgtttttg

SEQ ID NO: 441093 - DNA, 25 bp, Rattus norvegicus
ggccggcttagagacctcgtttttg

SEQ ID NO: 441094 - DNA, 25 bp, Rattus norvegicus
ggccggcttatcaagtcctatgttg

SEQ ID NO: 441095 - DNA, 25 bp, Rattus norvegicus
ggccggcttatctagtcctatgttg

SEQ ID NO: 441096 - DNA, 25 bp, Rattus norvegicus
ggccggcttggtctatagaactaat

SEQ ID NO: 441097 - DNA, 25 bp, Rattus norvegicus
ggccggcttggtgtatagaactaat

SEQ ID NO: 441098 - DNA, 25 bp, Rattus norvegicus
ggccgggaagttaacagcccagact

SEQ ID NO: 441099 - DNA, 25 bp, Rattus norvegicus
ggccgggaagtttacagcccagact

SEQ ID NO: 441100 - DNA, 25 bp, Rattus norvegicus
ggccgggaatggatcttttctaaat

SEQ ID NO: 441101 - DNA, 25 bp, Rattus norvegicus
ggccgggaatggttcttttctaaat

SEQ ID NO: 441102 - DNA, 25 bp, Rattus norvegicus
ggccgggacaccagggcccatgaac

SEQ ID NO: 441103 - DNA, 25 bp, Rattus norvegicus
ggccgggacacctgggcccatgaac

SEQ ID NO: 441104 - DNA, 25 bp, Rattus norvegicus
ggccgggatcagagcggcacacact

SEQ ID NO: 441105 - DNA, 25 bp, Rattus norvegicus
ggccgggatcagtgcggcacacact

SEQ ID NO: 441106 - DNA, 25 bp, Rattus norvegicus
ggccgggattaccactttgtctcct

SEQ ID NO: 441107 - DNA, 25 bp, Rattus norvegicus
ggccgggattacgactttgtctcct

SEQ ID NO: 441108 - DNA, 25 bp, Rattus norvegicus
ggccgggattagatgaccttcctaa

SEQ ID NO: 441109 - DNA, 25 bp, Rattus norvegicus
ggccgggattagttgaccttcctaa

SEQ ID NO: 441110 - DNA, 25 bp, Rattus norvegicus
ggccgggcaaagaaatctttgttca

SEQ ID NO: 441111 - DNA, 25 bp, Rattus norvegicus
ggccgggcaaagtaatctttgttca

SEQ ID NO: 441112 - DNA, 25 bp, Rattus norvegicus
ggccgggcttgcaaccctgagaata

SEQ ID NO: 441113 - DNA, 25 bp, Rattus norvegicus
ggccgggcttgctaccctgagaata

SEQ ID NO: 441114 - DNA, 25 bp, Rattus norvegicus
ggccgggtcttaaagcttatggaat

SEQ ID NO: 441115 - DNA, 25 bp, Rattus norvegicus
ggccgggtcttatagcttatggaat

SEQ ID NO: 441116 - DNA, 25 bp, Rattus norvegicus
ggccggtagcaaatagcacccacta

SEQ ID NO: 441117 - DNA, 25 bp, Rattus norvegicus
ggccggtagcaattagcacccacta

SEQ ID NO: 441118 - DNA, 25 bp, Rattus norvegicus
ggccggtctgaaaccactgttggga

SEQ ID NO: 441119 - DNA, 25 bp, Rattus norvegicus
ggccggtctgaatccactgttggga

SEQ ID NO: 441120 - DNA, 25 bp, Rattus norvegicus
ggccggtgctctaacctgggaagat

SEQ ID NO: 441121 - DNA, 25 bp, Rattus norvegicus
ggccggtgctcttacctgggaagat

SEQ ID NO: 441122 - DNA, 25 bp, Rattus norvegicus
ggccggtgctgcagtatactggaca

SEQ ID NO: 441123 - DNA, 25 bp, Rattus norvegicus
ggccggtgctgctgtatactggaca

SEQ ID NO: 441124 - DNA, 25 bp, Rattus norvegicus
ggccggtggtgaacgccgagctgga

SEQ ID NO: 441125 - DNA, 25 bp, Rattus norvegicus
ggccggtggtgatcgccgagctgga

SEQ ID NO: 441126 - DNA, 25 bp, Rattus norvegicus
ggccggtgtggtcatcgctcaacaa

SEQ ID NO: 441127 - DNA, 25 bp, Rattus norvegicus
ggccggtgtggtgatcgctcaacaa

SEQ ID NO: 441128 - DNA, 25 bp, Rattus norvegicus
ggccggttctcaagtaatcagcact

SEQ ID NO: 441129 - DNA, 25 bp, Rattus norvegicus
ggccggttctcatgtaatcagcact

SEQ ID NO: 441130 - DNA, 25 bp, Rattus norvegicus
ggccggttttgtcttagcagcggaa

SEQ ID NO: 441131 - DNA, 25 bp, Rattus norvegicus
ggccggttttgtgttagcagcggaa

SEQ ID NO: 441132 - DNA, 25 bp, Rattus norvegicus
ggccgtaaagccatatatccagtgt

SEQ ID NO: 441133 - DNA, 25 bp, Rattus norvegicus
ggccgtaaagccttatatccagtgt

SEQ ID NO: 441134 - DNA, 25 bp, Rattus norvegicus
ggccgtaagaagaatctagctcctt

SEQ ID NO: 441135 - DNA, 25 bp, Rattus norvegicus
ggccgtaagaagtatctagctcctt

SEQ ID NO: 441136 - DNA, 25 bp, Rattus norvegicus
ggccgtaatgacaactcctacatgt

SEQ ID NO: 441137 - DNA, 25 bp, Rattus norvegicus
ggccgtaatgactactcctacatgt

SEQ ID NO: 441138 - DNA, 25 bp, Rattus norvegicus
ggccgtacgcagattcaaggacctt

SEQ ID NO: 441139 - DNA, 25 bp, Rattus norvegicus
ggccgtacgcagtttcaaggacctt

SEQ ID NO: 441140 - DNA, 25 bp, Rattus norvegicus
ggccgtacgtggaatgttaagtcat

SEQ ID NO: 441141 - DNA, 25 bp, Rattus norvegicus
ggccgtacgtggtatgttaagtcat

SEQ ID NO: 441142 - DNA, 25 bp, Rattus norvegicus
ggccgtactatgctggtccacgaga

SEQ ID NO: 441143 - DNA, 25 bp, Rattus norvegicus
ggccgtactatggtggtccacgaga

SEQ ID NO: 441144 - DNA, 25 bp, Rattus norvegicus
ggccgtactttgactgactacaaca

SEQ ID NO: 441145 - DNA, 25 bp, Rattus norvegicus
ggccgtactttgtctgactacaaca

SEQ ID NO: 441146 - DNA, 25 bp, Rattus norvegicus
ggccgtcacctcaatagttttactg

SEQ ID NO: 441147 - DNA, 25 bp, Rattus norvegicus
ggccgtcacctctatagttttactg

SEQ ID NO: 441148 - DNA, 25 bp, Rattus norvegicus
ggccgtcatccacaccaaagccatg

SEQ ID NO: 441149 - DNA, 25 bp, Rattus norvegicus
ggccgtcatccagaccaaagccatg

SEQ ID NO: 441150 - DNA, 25 bp, Rattus norvegicus
ggccgtccagtaaaaagttcaagtt

SEQ ID NO: 441151 - DNA, 25 bp, Rattus norvegicus
ggccgtccagtataaagttcaagtt

SEQ ID NO: 441152 - DNA, 25 bp, Rattus norvegicus
ggccgtcctcttatagatccttaaa

SEQ ID NO: 441153 - DNA, 25 bp, Rattus norvegicus
ggccgtcctcttttagatccttaaa

SEQ ID NO: 441154 - DNA, 25 bp, Rattus norvegicus
ggccgtcgttccaatatttgtggga

SEQ ID NO: 441155 - DNA, 25 bp, Rattus norvegicus
ggccgtcgttcctatatttgtggga

SEQ ID NO: 441156 - DNA, 25 bp, Rattus norvegicus
ggccgtctcagacccaaaagtggtg

SEQ ID NO: 441157 - DNA, 25 bp, Rattus norvegicus
ggccgtctcagagccaaaagtggtg

SEQ ID NO: 441158 - DNA, 25 bp, Rattus norvegicus
ggccgtctggacaatggaactgtgc

SEQ ID NO: 441159 - DNA, 25 bp, Rattus norvegicus
ggccgtctggactatggaactgtgc

SEQ ID NO: 441160 - DNA, 25 bp, Rattus norvegicus
ggccgtctgtcaagggatagtcgct

SEQ ID NO: 441161 - DNA, 25 bp, Rattus norvegicus
ggccgtctgtcatgggatagtcgct

SEQ ID NO: 441162 - DNA, 25 bp, Rattus norvegicus
ggccgtcttttaaggctccatgtat

SEQ ID NO: 441163 - DNA, 25 bp, Rattus norvegicus
ggccgtcttttatggctccatgtat

SEQ ID NO: 441164 - DNA, 25 bp, Rattus norvegicus
ggccgtgaagcaagcactgagccaa

SEQ ID NO: 441165 - DNA, 25 bp, Rattus norvegicus
ggccgtgaagcatgcactgagccaa

SEQ ID NO: 441166 - DNA, 25 bp, Rattus norvegicus
ggccgtgactttactgtgctgactt

SEQ ID NO: 441167 - DNA, 25 bp, Rattus norvegicus
ggccgtgacttttctgtgctgactt

SEQ ID NO: 441168 - DNA, 25 bp, Rattus norvegicus
ggccgtgaggatatgtctccaaccc

SEQ ID NO: 441169 - DNA, 25 bp, Rattus norvegicus
ggccgtgaggatttgtctccaaccc

SEQ ID NO: 441170 - DNA, 25 bp, Rattus norvegicus
ggccgtgaggctctgatgtcacaaa

SEQ ID NO: 441171 - DNA, 25 bp, Rattus norvegicus
ggccgtgaggctgtgatgtcacaaa

SEQ ID NO: 441172 - DNA, 25 bp, Rattus norvegicus
ggccgtgatggacataatgacgaaa

SEQ ID NO: 441173 - DNA, 25 bp, Rattus norvegicus
ggccgtgatggagataatgacgaaa

SEQ ID NO: 441174 - DNA, 25 bp, Rattus norvegicus
ggccgtgcatatctggaatccccag

SEQ ID NO: 441175 - DNA, 25 bp, Rattus norvegicus
ggccgtgcatatgtggaatccccag

SEQ ID NO: 441176 - DNA, 25 bp, Rattus norvegicus
ggccgtgcgcgtagcgcccacaaag

SEQ ID NO: 441177 - DNA, 25 bp, Rattus norvegicus
ggccgtgcgcgttgcgcccacaaag

SEQ ID NO: 441178 - DNA, 25 bp, Rattus norvegicus
ggccgtgcgttacattgactttaca

SEQ ID NO: 441179 - DNA, 25 bp, Rattus norvegicus
ggccgtgcgttagattgactttaca

SEQ ID NO: 441180 - DNA, 25 bp, Rattus norvegicus
ggccgtgctcaccagttcgcctgta

SEQ ID NO: 441181 - DNA, 25 bp, Rattus norvegicus
ggccgtgctcacgagttcgcctgta

SEQ ID NO: 441182 - DNA, 25 bp, Rattus norvegicus
ggccgtgcttttaattgtgagtagt

SEQ ID NO: 441183 - DNA, 25 bp, Rattus norvegicus
ggccgtgctttttattgtgagtagt

SEQ ID NO: 441184 - DNA, 25 bp, Rattus norvegicus
ggccgtggaggcctctgggcatggg

SEQ ID NO: 441185 - DNA, 25 bp, Rattus norvegicus
ggccgtggaggcgtctgggcatggg

SEQ ID NO: 441186 - DNA, 25 bp, Rattus norvegicus
ggccgtggcgtcactcctcttcaag

SEQ ID NO: 441187 - DNA, 25 bp, Rattus norvegicus
ggccgtggcgtctctcctcttcaag

SEQ ID NO: 441188 - DNA, 25 bp, Rattus norvegicus
ggccgtgggcatcgctatctacaat

SEQ ID NO: 441189 - DNA, 25 bp, Rattus norvegicus
ggccgtgggcatggctatctacaat

SEQ ID NO: 441190 - DNA, 25 bp, Rattus norvegicus
ggccgtgtacataacgtgctttctc

SEQ ID NO: 441191 - DNA, 25 bp, Rattus norvegicus
ggccgtgtacattacgtgctttctc

SEQ ID NO: 441192 - DNA, 25 bp, Rattus norvegicus
ggccgtgtcacacaagtggtctcta

SEQ ID NO: 441193 - DNA, 25 bp, Rattus norvegicus
ggccgtgtcacagaagtggtctcta

SEQ ID NO: 441194 - DNA, 25 bp, Rattus norvegicus
ggccgtgtctgaacttgtttttccc

SEQ ID NO: 441195 - DNA, 25 bp, Rattus norvegicus
ggccgtgtctgatcttgtttttccc

SEQ ID NO: 441196 - DNA, 25 bp, Rattus norvegicus
ggccgtgtgctcaataaaggtcctt

SEQ ID NO: 441197 - DNA, 25 bp, Rattus norvegicus
ggccgtgtgctctataaaggtcctt

SEQ ID NO: 441198 - DNA, 25 bp, Rattus norvegicus
ggccgtgtgggcagcactcagttat

SEQ ID NO: 441199 - DNA, 25 bp, Rattus norvegicus
ggccgtgtgggctgcactcagttat

SEQ ID NO: 441200 - DNA, 25 bp, Rattus norvegicus
ggccgtgtgtttagaagcctaactg

SEQ ID NO: 441201 - DNA, 25 bp, Rattus norvegicus
ggccgtgtgttttgaagcctaactg

SEQ ID NO: 441202 - DNA, 25 bp, Rattus norvegicus
ggccgttatgcaccttgtaatccta

SEQ ID NO: 441203 - DNA, 25 bp, Rattus norvegicus
ggccgttatgcagcttgtaatccta

SEQ ID NO: 441204 - DNA, 25 bp, Rattus norvegicus
ggccgttcagccaggtcagtccatg

SEQ ID NO: 441205 - DNA, 25 bp, Rattus norvegicus
ggccgttcagcctggtcagtccatg

SEQ ID NO: 441206 - DNA, 25 bp, Rattus norvegicus
ggccgttcgagtcacccgcaaatgt

SEQ ID NO: 441207 - DNA, 25 bp, Rattus norvegicus
ggccgttcgagtgacccgcaaatgt

SEQ ID NO: 441208 - DNA, 25 bp, Rattus norvegicus
ggccgttgccaacgccgagagccaa

SEQ ID NO: 441209 - DNA, 25 bp, Rattus norvegicus
ggccgttgccaaggccgagagccaa

SEQ ID NO: 441210 - DNA, 25 bp, Rattus norvegicus
ggccgtttagagcatctttacctag

SEQ ID NO: 441211 - DNA, 25 bp, Rattus norvegicus
ggccgtttagaggatctttacctag

SEQ ID NO: 441212 - DNA, 25 bp, Rattus norvegicus
ggccgtttcacaccctttgacagaa

SEQ ID NO: 441213 - DNA, 25 bp, Rattus norvegicus
ggccgtttcacagcctttgacagaa

SEQ ID NO: 441214 - DNA, 25 bp, Rattus norvegicus
ggccgtttcctcactgtaagttaag

SEQ ID NO: 441215 - DNA, 25 bp, Rattus norvegicus
ggccgtttcctctctgtaagttaag

SEQ ID NO: 441216 - DNA, 25 bp, Rattus norvegicus
ggccgtttcttaaatacatttccat

SEQ ID NO: 441217 - DNA, 25 bp, Rattus norvegicus
ggccgtttcttatatacatttccat

SEQ ID NO: 441218 - DNA, 25 bp, Rattus norvegicus
ggccgtttgtggagttttaagtgct

SEQ ID NO: 441219 - DNA, 25 bp, Rattus norvegicus
ggccgtttgtggtgttttaagtgct

SEQ ID NO: 441220 - DNA, 25 bp, Rattus norvegicus
ggccgtttttacagtgctgatttaa

SEQ ID NO: 441221 - DNA, 25 bp, Rattus norvegicus
ggccgtttttactgtgctgatttaa

SEQ ID NO: 441222 - DNA, 25 bp, Rattus norvegicus
ggcctaaaccttctatttgtgtcat

SEQ ID NO: 441223 - DNA, 25 bp, Rattus norvegicus
ggcctaaaccttgtatttgtgtcat

SEQ ID NO: 441224 - DNA, 25 bp, Rattus norvegicus
ggcctaaactccaaagactgccttt

SEQ ID NO: 441225 - DNA, 25 bp, Rattus norvegicus
ggcctaaactcctaagactgccttt

SEQ ID NO: 441226 - DNA, 25 bp, Rattus norvegicus
ggcctaaatccgctgttgttcatga

SEQ ID NO: 441227 - DNA, 25 bp, Rattus norvegicus
ggcctaaatccggtgttgttcatga

SEQ ID NO: 441228 - DNA, 25 bp, Rattus norvegicus
ggcctaactgtactcctggaagttt

SEQ ID NO: 441229 - DNA, 25 bp, Rattus norvegicus
ggcctaactgtagtcctggaagttt

SEQ ID NO: 441230 - DNA, 25 bp, Rattus norvegicus
ggcctaagacagcagggccaccatt

SEQ ID NO: 441231 - DNA, 25 bp, Rattus norvegicus
ggcctaagacaggagggccaccatt

SEQ ID NO: 441232 - DNA, 25 bp, Rattus norvegicus
ggcctaagagccagacacactaatg

SEQ ID NO: 441233 - DNA, 25 bp, Rattus norvegicus
ggcctaagagccatgacgtttacag

SEQ ID NO: 441234 - DNA, 25 bp, Rattus norvegicus
ggcctaagagcctgacacactaatg

SEQ ID NO: 441235 - DNA, 25 bp, Rattus norvegicus
ggcctaagagccttgacgtttacag

SEQ ID NO: 441236 - DNA, 25 bp, Rattus norvegicus
ggcctaagagtaacctgtccccaag

SEQ ID NO: 441237 - DNA, 25 bp, Rattus norvegicus
ggcctaagagtatcctgtccccaag

SEQ ID NO: 441238 - DNA, 25 bp, Rattus norvegicus
ggcctaagctggcacaaaatcaggt

SEQ ID NO: 441239 - DNA, 25 bp, Rattus norvegicus
ggcctaagctgggacaaaatcaggt

SEQ ID NO: 441240 - DNA, 25 bp, Rattus norvegicus
ggcctaaggcctctatacactggta

SEQ ID NO: 441241 - DNA, 25 bp, Rattus norvegicus
ggcctaaggcctgtatacactggta

SEQ ID NO: 441242 - DNA, 25 bp, Rattus norvegicus
ggcctaatttgtagcaatccttcca

SEQ ID NO: 441243 - DNA, 25 bp, Rattus norvegicus
ggcctaatttgttgcaatccttcca

SEQ ID NO: 441244 - DNA, 25 bp, Rattus norvegicus
ggcctacaacaaatccaaacacttc

SEQ ID NO: 441245 - DNA, 25 bp, Rattus norvegicus
ggcctacaacaattccaaacacttc

SEQ ID NO: 441246 - DNA, 25 bp, Rattus norvegicus
ggcctacagcacacgcagtctgaaa

SEQ ID NO: 441247 - DNA, 25 bp, Rattus norvegicus
ggcctacagcactcgcagtctgaaa

SEQ ID NO: 441248 - DNA, 25 bp, Rattus norvegicus
ggcctacattcacgtcataagctta

SEQ ID NO: 441249 - DNA, 25 bp, Rattus norvegicus
ggcctacattcaggtcataagctta

SEQ ID NO: 441250 - DNA, 25 bp, Rattus norvegicus
ggcctaccacatcagacgagggctg

SEQ ID NO: 441251 - DNA, 25 bp, Rattus norvegicus
ggcctaccacatctaatccattgag

SEQ ID NO: 441252 - DNA, 25 bp, Rattus norvegicus
ggcctaccacatgagacgagggctg

SEQ ID NO: 441253 - DNA, 25 bp, Rattus norvegicus
ggcctaccacatgtaatccattgag

SEQ ID NO: 441254 - DNA, 25 bp, Rattus norvegicus
ggcctacctccactagttacaagca

SEQ ID NO: 441255 - DNA, 25 bp, Rattus norvegicus
ggcctacctccagtagttacaagca

SEQ ID NO: 441256 - DNA, 25 bp, Rattus norvegicus
ggcctacctgcaccctatttagggt

SEQ ID NO: 441257 - DNA, 25 bp, Rattus norvegicus
ggcctacctgcagcctatttagggt

SEQ ID NO: 441258 - DNA, 25 bp, Rattus norvegicus
ggcctacggcacagggctgacatgt

SEQ ID NO: 441259 - DNA, 25 bp, Rattus norvegicus
ggcctacggcactgggctgacatgt

SEQ ID NO: 441260 - DNA, 25 bp, Rattus norvegicus
ggcctactaggaccctttcagaatg

SEQ ID NO: 441261 - DNA, 25 bp, Rattus norvegicus
ggcctactaggagcctttcagaatg

SEQ ID NO: 441262 - DNA, 25 bp, Rattus norvegicus
ggcctactctttcagcgttttctga

SEQ ID NO: 441263 - DNA, 25 bp, Rattus norvegicus
ggcctactctttgagcgttttctga

SEQ ID NO: 441264 - DNA, 25 bp, Rattus norvegicus
ggcctacttactatttggtctctgt

SEQ ID NO: 441265 - DNA, 25 bp, Rattus norvegicus
ggcctacttactttttggtctctgt

SEQ ID NO: 441266 - DNA, 25 bp, Rattus norvegicus
ggcctactttatatcagacactcaa

SEQ ID NO: 441267 - DNA, 25 bp, Rattus norvegicus
ggcctactttatttcagacactcaa

SEQ ID NO: 441268 - DNA, 25 bp, Rattus norvegicus
ggcctagaaataccatgtgtccaca

SEQ ID NO: 441269 - DNA, 25 bp, Rattus norvegicus
ggcctagaaatagcatgtgtccaca

SEQ ID NO: 441270 - DNA, 25 bp, Rattus norvegicus
ggcctagacaaaccaggtcctgact

SEQ ID NO: 441271 - DNA, 25 bp, Rattus norvegicus
ggcctagacaaagcaggtcctgact

SEQ ID NO: 441272 - DNA, 25 bp, Rattus norvegicus
ggcctagaccaaaacaaccagtgtt

SEQ ID NO: 441273 - DNA, 25 bp, Rattus norvegicus
ggcctagaccaatacaaccagtgtt

SEQ ID NO: 441274 - DNA, 25 bp, Rattus norvegicus
ggcctagaccgcctgataaaactgg

SEQ ID NO: 441275 - DNA, 25 bp, Rattus norvegicus
ggcctagaccgcgtgataaaactgg

SEQ ID NO: 441276 - DNA, 25 bp, Rattus norvegicus
ggcctagaggttcccagtggtctca

SEQ ID NO: 441277 - DNA, 25 bp, Rattus norvegicus
ggcctagaggttgccagtggtctca

SEQ ID NO: 441278 - DNA, 25 bp, Rattus norvegicus
ggcctagagttgcaattcggtttct

SEQ ID NO: 441279 - DNA, 25 bp, Rattus norvegicus
ggcctagagttggaattcggtttct

SEQ ID NO: 441280 - DNA, 25 bp, Rattus norvegicus
ggcctagataggactcagctgtgtt

SEQ ID NO: 441281 - DNA, 25 bp, Rattus norvegicus
ggcctagataggtctcagctgtgtt

SEQ ID NO: 441282 - DNA, 25 bp, Rattus norvegicus
ggcctagcaattaagagacttccag

SEQ ID NO: 441283 - DNA, 25 bp, Rattus norvegicus
ggcctagcaatttagagacttccag

SEQ ID NO: 441284 - DNA, 25 bp, Rattus norvegicus
ggcctagcatgcaggcttgtttata

SEQ ID NO: 441285 - DNA, 25 bp, Rattus norvegicus
ggcctagcatgctggcttgtttata

SEQ ID NO: 441286 - DNA, 25 bp, Rattus norvegicus
ggcctaggaggcactctgtgatccg

SEQ ID NO: 441287 - DNA, 25 bp, Rattus norvegicus
ggcctaggaggctctctgtgatccg

SEQ ID NO: 441288 - DNA, 25 bp, Rattus norvegicus
ggcctaggcatgacagtgggcacct

SEQ ID NO: 441289 - DNA, 25 bp, Rattus norvegicus
ggcctaggcatgtcagtgggcacct

SEQ ID NO: 441290 - DNA, 25 bp, Rattus norvegicus
ggcctaggccagcaaagtggacttt

SEQ ID NO: 441291 - DNA, 25 bp, Rattus norvegicus
ggcctaggccaggaaagtggacttt

SEQ ID NO: 441292 - DNA, 25 bp, Rattus norvegicus
ggcctaggccttagacattttggta

SEQ ID NO: 441293 - DNA, 25 bp, Rattus norvegicus
ggcctaggcctttgacattttggta

SEQ ID NO: 441294 - DNA, 25 bp, Rattus norvegicus
ggcctaggctccagtacctgactaa

SEQ ID NO: 441295 - DNA, 25 bp, Rattus norvegicus
ggcctaggctcctgtacctgactaa

SEQ ID NO: 441296 - DNA, 25 bp, Rattus norvegicus
ggcctaggtttcatagcaattgcta

SEQ ID NO: 441297 - DNA, 25 bp, Rattus norvegicus
ggcctaggtttcttagcaattgcta

SEQ ID NO: 441298 - DNA, 25 bp, Rattus norvegicus
ggcctagtaccgaatagcagctgta

SEQ ID NO: 441299 - DNA, 25 bp, Rattus norvegicus
ggcctagtaccgtatagcagctgta

SEQ ID NO: 441300 - DNA, 25 bp, Rattus norvegicus
ggcctagtttgactgacaagccttc

SEQ ID NO: 441301 - DNA, 25 bp, Rattus norvegicus
ggcctagtttgagtgacaagccttc

SEQ ID NO: 441302 - DNA, 25 bp, Rattus norvegicus
ggcctatatcctagtgtttgtgtaa

SEQ ID NO: 441303 - DNA, 25 bp, Rattus norvegicus
ggcctatatccttgtgtttgtgtaa

SEQ ID NO: 441304 - DNA, 25 bp, Rattus norvegicus
ggcctatctccaagccaatgtatgg

SEQ ID NO: 441305 - DNA, 25 bp, Rattus norvegicus
ggcctatctccatgccaatgtatgg

SEQ ID NO: 441306 - DNA, 25 bp, Rattus norvegicus
ggcctatcttaaacagctacatggg

SEQ ID NO: 441307 - DNA, 25 bp, Rattus norvegicus
ggcctatcttaatcagctacatggg

SEQ ID NO: 441308 - DNA, 25 bp, Rattus norvegicus
ggcctatgaccccacagagagaaag

SEQ ID NO: 441309 - DNA, 25 bp, Rattus norvegicus
ggcctatgacccgacagagagaaag

SEQ ID NO: 441310 - DNA, 25 bp, Rattus norvegicus
ggcctatgcattcccacgtgtgaga

SEQ ID NO: 441311 - DNA, 25 bp, Rattus norvegicus
ggcctatgcattgccacgtgtgaga

SEQ ID NO: 441312 - DNA, 25 bp, Rattus norvegicus
ggcctatgcgaaaatctgtgaccca

SEQ ID NO: 441313 - DNA, 25 bp, Rattus norvegicus
ggcctatgcgaatatctgtgaccca

SEQ ID NO: 441314 - DNA, 25 bp, Rattus norvegicus
ggcctatgctaccacaaagtcactg

SEQ ID NO: 441315 - DNA, 25 bp, Rattus norvegicus
ggcctatgctacgacaaagtcactg

SEQ ID NO: 441316 - DNA, 25 bp, Rattus norvegicus
ggcctatggaaaccctcagaggtgt

SEQ ID NO: 441317 - DNA, 25 bp, Rattus norvegicus
ggcctatggaaagcctcagaggtgt

SEQ ID NO: 441318 - DNA, 25 bp, Rattus norvegicus
ggcctatggaggagaccgtggtggt

SEQ ID NO: 441319 - DNA, 25 bp, Rattus norvegicus
ggcctatggaggtgaccgtggtggt

SEQ ID NO: 441320 - DNA, 25 bp, Rattus norvegicus
ggcctatgggtcactgtccagtaaa

SEQ ID NO: 441321 - DNA, 25 bp, Rattus norvegicus
ggcctatgggtctctgtccagtaaa

SEQ ID NO: 441322 - DNA, 25 bp, Rattus norvegicus
ggcctattaccgagggtctgataca

SEQ ID NO: 441323 - DNA, 25 bp, Rattus norvegicus
ggcctattaccgtgggtctgataca

SEQ ID NO: 441324 - DNA, 25 bp, Rattus norvegicus
ggcctatttttaagagttcttcttg

SEQ ID NO: 441325 - DNA, 25 bp, Rattus norvegicus
ggcctatttttatgagttcttcttg

SEQ ID NO: 441326 - DNA, 25 bp, Rattus norvegicus
ggcctcaaaaggctgcggagactct

SEQ ID NO: 441327 - DNA, 25 bp, Rattus norvegicus
ggcctcaaaagggtgcggagactct

SEQ ID NO: 441328 - DNA, 25 bp, Rattus norvegicus
ggcctcaaactcaagctaaacctgt

SEQ ID NO: 441329 - DNA, 25 bp, Rattus norvegicus
ggcctcaaactcctcgtgtagctga

SEQ ID NO: 441330 - DNA, 25 bp, Rattus norvegicus
ggcctcaaactcgtcgtgtagctga

SEQ ID NO: 441331 - DNA, 25 bp, Rattus norvegicus
ggcctcaaactctagctaaacctgt

SEQ ID NO: 441332 - DNA, 25 bp, Rattus norvegicus
ggcctcaaagcaaggcgtgttctga

SEQ ID NO: 441333 - DNA, 25 bp, Rattus norvegicus
ggcctcaaagcatggcgtgttctga

SEQ ID NO: 441334 - DNA, 25 bp, Rattus norvegicus
ggcctcaacaatcattcagacctga

SEQ ID NO: 441335 - DNA, 25 bp, Rattus norvegicus
ggcctcaacaatgattcagacctga

SEQ ID NO: 441336 - DNA, 25 bp, Rattus norvegicus
ggcctcaagaggattttctgtccca

SEQ ID NO: 441337 - DNA, 25 bp, Rattus norvegicus
ggcctcaagaggtttttctgtccca

SEQ ID NO: 441338 - DNA, 25 bp, Rattus norvegicus
ggcctcaagctcctttccgcaaagg

SEQ ID NO: 441339 - DNA, 25 bp, Rattus norvegicus
ggcctcaagctcgtttccgcaaagg

SEQ ID NO: 441340 - DNA, 25 bp, Rattus norvegicus
ggcctcaagtgccttacatcagggt

SEQ ID NO: 441341 - DNA, 25 bp, Rattus norvegicus
ggcctcaagtgcgttacatcagggt

SEQ ID NO: 441342 - DNA, 25 bp, Rattus norvegicus
ggcctcaatcaacccacagtggtga

SEQ ID NO: 441343 - DNA, 25 bp, Rattus norvegicus
ggcctcaatcaagccacagtggtga

SEQ ID NO: 441344 - DNA, 25 bp, Rattus norvegicus
ggcctcacactcacgatgtgtagaa

SEQ ID NO: 441345 - DNA, 25 bp, Rattus norvegicus
ggcctcacactctcgatgtgtagaa

SEQ ID NO: 441346 - DNA, 25 bp, Rattus norvegicus
ggcctcacactgaccaagggcagag

SEQ ID NO: 441347 - DNA, 25 bp, Rattus norvegicus
ggcctcacactgtccaagggcagag

SEQ ID NO: 441348 - DNA, 25 bp, Rattus norvegicus
ggcctcacccaaacaattaaaacat

SEQ ID NO: 441349 - DNA, 25 bp, Rattus norvegicus
ggcctcacccaatcaattaaaacat

SEQ ID NO: 441350 - DNA, 25 bp, Rattus norvegicus
ggcctcacccctctggagggccaga

SEQ ID NO: 441351 - DNA, 25 bp, Rattus norvegicus
ggcctcacccctgtggagggccaga

SEQ ID NO: 441352 - DNA, 25 bp, Rattus norvegicus
ggcctcactgacagctgcctgagga

SEQ ID NO: 441353 - DNA, 25 bp, Rattus norvegicus
ggcctcactgactgctgcctgagga

SEQ ID NO: 441354 - DNA, 25 bp, Rattus norvegicus
ggcctcactgcccaatgtatgagat

SEQ ID NO: 441355 - DNA, 25 bp, Rattus norvegicus
ggcctcactgccgaatgtatgagat

SEQ ID NO: 441356 - DNA, 25 bp, Rattus norvegicus
ggcctcagaaaaaccctttcgggag

SEQ ID NO: 441357 - DNA, 25 bp, Rattus norvegicus
ggcctcagaaaatccctttcgggag

SEQ ID NO: 441358 - DNA, 25 bp, Rattus norvegicus
ggcctcagactgcaggaccagatct

SEQ ID NO: 441359 - DNA, 25 bp, Rattus norvegicus
ggcctcagactggaggaccagatct

SEQ ID NO: 441360 - DNA, 25 bp, Rattus norvegicus
ggcctcagcacaatccagagggact

SEQ ID NO: 441361 - DNA, 25 bp, Rattus norvegicus
ggcctcagcacattccagagggact

SEQ ID NO: 441362 - DNA, 25 bp, Rattus norvegicus
ggcctcagcctcacatgagttagga

SEQ ID NO: 441363 - DNA, 25 bp, Rattus norvegicus
ggcctcagcctctcatgagttagga

SEQ ID NO: 441364 - DNA, 25 bp, Rattus norvegicus
ggcctcagcctgatacagtattact

SEQ ID NO: 441365 - DNA, 25 bp, Rattus norvegicus
ggcctcagcctgttacagtattact

SEQ ID NO: 441366 - DNA, 25 bp, Rattus norvegicus
ggcctcagcggtccggttttctcct

SEQ ID NO: 441367 - DNA, 25 bp, Rattus norvegicus
ggcctcagcggtgcggttttctcct

SEQ ID NO: 441368 - DNA, 25 bp, Rattus norvegicus
ggcctcagcttccaatctagattgt

SEQ ID NO: 441369 - DNA, 25 bp, Rattus norvegicus
ggcctcagcttcgaatctagattgt

SEQ ID NO: 441370 - DNA, 25 bp, Rattus norvegicus
ggcctcagtctgatcgaagcagagt

SEQ ID NO: 441371 - DNA, 25 bp, Rattus norvegicus
ggcctcagtctgttcgaagcagagt

SEQ ID NO: 441372 - DNA, 25 bp, Rattus norvegicus
ggcctcagttgcagcaggcgcgcct

SEQ ID NO: 441373 - DNA, 25 bp, Rattus norvegicus
ggcctcagttgctgcaggcgcgcct

SEQ ID NO: 441374 - DNA, 25 bp, Rattus norvegicus
ggcctcataatcctattacctcaaa

SEQ ID NO: 441375 - DNA, 25 bp, Rattus norvegicus
ggcctcataatcgtattacctcaaa

SEQ ID NO: 441376 - DNA, 25 bp, Rattus norvegicus
ggcctcatagatactcattctctga

SEQ ID NO: 441377 - DNA, 25 bp, Rattus norvegicus
ggcctcatagattctcattctctga

SEQ ID NO: 441378 - DNA, 25 bp, Rattus norvegicus
ggcctcatattgcttaaaaacctgt

SEQ ID NO: 441379 - DNA, 25 bp, Rattus norvegicus
ggcctcatattggttaaaaacctgt

SEQ ID NO: 441380 - DNA, 25 bp, Rattus norvegicus
ggcctcatccttcctagaggttgga

SEQ ID NO: 441381 - DNA, 25 bp, Rattus norvegicus
ggcctcatccttgctagaggttgga

SEQ ID NO: 441382 - DNA, 25 bp, Rattus norvegicus
ggcctcatctctaggccaacaaatt

SEQ ID NO: 441383 - DNA, 25 bp, Rattus norvegicus
ggcctcatctcttggccaacaaatt

SEQ ID NO: 441384 - DNA, 25 bp, Rattus norvegicus
ggcctcatcttaccatttcaggtga

SEQ ID NO: 441385 - DNA, 25 bp, Rattus norvegicus
ggcctcatcttagcatttcaggtga

SEQ ID NO: 441386 - DNA, 25 bp, Rattus norvegicus
ggcctcatgcatagaccgtctgttt

SEQ ID NO: 441387 - DNA, 25 bp, Rattus norvegicus
ggcctcatgcattgaccgtctgttt

SEQ ID NO: 441388 - DNA, 25 bp, Rattus norvegicus
ggcctcatgctgactgccaccagaa

SEQ ID NO: 441389 - DNA, 25 bp, Rattus norvegicus
ggcctcatgctgtctgccaccagaa

SEQ ID NO: 441390 - DNA, 25 bp, Rattus norvegicus
ggcctcatgggaaggttctcatgtt

SEQ ID NO: 441391 - DNA, 25 bp, Rattus norvegicus
ggcctcatgggatggttctcatgtt

SEQ ID NO: 441392 - DNA, 25 bp, Rattus norvegicus
ggcctcatggtcaacagcttaggac

SEQ ID NO: 441393 - DNA, 25 bp, Rattus norvegicus
ggcctcatggtctacagcttaggac

SEQ ID NO: 441394 - DNA, 25 bp, Rattus norvegicus
ggcctcatgttcctttatccatttt

SEQ ID NO: 441395 - DNA, 25 bp, Rattus norvegicus
ggcctcatgttcgtttatccatttt

SEQ ID NO: 441396 - DNA, 25 bp, Rattus norvegicus
ggcctcattccaatgatggcagggt

SEQ ID NO: 441397 - DNA, 25 bp, Rattus norvegicus
ggcctcattccattgatggcagggt

SEQ ID NO: 441398 - DNA, 25 bp, Rattus norvegicus
ggcctcattggactcatgctctcaa

SEQ ID NO: 441399 - DNA, 25 bp, Rattus norvegicus
ggcctcattggagtcatgctctcaa

SEQ ID NO: 441400 - DNA, 25 bp, Rattus norvegicus
ggcctcattgtaatctccacaggaa

SEQ ID NO: 441401 - DNA, 25 bp, Rattus norvegicus
ggcctcattgtattctccacaggaa

SEQ ID NO: 441402 - DNA, 25 bp, Rattus norvegicus
ggcctcatttccagtgttaaacctc

SEQ ID NO: 441403 - DNA, 25 bp, Rattus norvegicus
ggcctcatttcctgtgttaaacctc

SEQ ID NO: 441404 - DNA, 25 bp, Rattus norvegicus
ggcctcatttctacagtcagtgggt

SEQ ID NO: 441405 - DNA, 25 bp, Rattus norvegicus
ggcctcatttcttcagtcagtgggt

SEQ ID NO: 441406 - DNA, 25 bp, Rattus norvegicus
ggcctccaaaagctgcactaaggac

SEQ ID NO: 441407 - DNA, 25 bp, Rattus norvegicus
ggcctccaaaaggtgcactaaggac

SEQ ID NO: 441408 - DNA, 25 bp, Rattus norvegicus
ggcctccaaactctactctgaatta

SEQ ID NO: 441409 - DNA, 25 bp, Rattus norvegicus
ggcctccaaactgtactctgaatta

SEQ ID NO: 441410 - DNA, 25 bp, Rattus norvegicus
ggcctccaaaggcttgggtctgatt

SEQ ID NO: 441411 - DNA, 25 bp, Rattus norvegicus
ggcctccaaagggttgggtctgatt

SEQ ID NO: 441412 - DNA, 25 bp, Rattus norvegicus
ggcctccacatactagtctgcagtg

SEQ ID NO: 441413 - DNA, 25 bp, Rattus norvegicus
ggcctccacatagtagtctgcagtg

SEQ ID NO: 441414 - DNA, 25 bp, Rattus norvegicus
ggcctccagaaccattagctgttaa

SEQ ID NO: 441415 - DNA, 25 bp, Rattus norvegicus
ggcctccagaacgattagctgttaa

SEQ ID NO: 441416 - DNA, 25 bp, Rattus norvegicus
ggcctccagattctttaaactctca

SEQ ID NO: 441417 - DNA, 25 bp, Rattus norvegicus
ggcctccagattgtttaaactctca

SEQ ID NO: 441418 - DNA, 25 bp, Rattus norvegicus
ggcctccagtatctgtgcagtccaa

SEQ ID NO: 441419 - DNA, 25 bp, Rattus norvegicus
ggcctccagtatgtgtgcagtccaa

SEQ ID NO: 441420 - DNA, 25 bp, Rattus norvegicus
ggcctccatcttcgtctgagaattg

SEQ ID NO: 441421 - DNA, 25 bp, Rattus norvegicus
ggcctccatcttggtctgagaattg

SEQ ID NO: 441422 - DNA, 25 bp, Rattus norvegicus
ggcctccatggaaattgcatgcata

SEQ ID NO: 441423 - DNA, 25 bp, Rattus norvegicus
ggcctccatggatattgcatgcata

SEQ ID NO: 441424 - DNA, 25 bp, Rattus norvegicus
ggcctcccagggattggccatgtcg

SEQ ID NO: 441425 - DNA, 25 bp, Rattus norvegicus
ggcctcccagggtttggccatgtcg

SEQ ID NO: 441426 - DNA, 25 bp, Rattus norvegicus
ggcctcccagttatgcatttggtga

SEQ ID NO: 441427 - DNA, 25 bp, Rattus norvegicus
ggcctcccagttttgcatttggtga

SEQ ID NO: 441428 - DNA, 25 bp, Rattus norvegicus
ggcctccccagtatcagagttttga

SEQ ID NO: 441429 - DNA, 25 bp, Rattus norvegicus
ggcctccccagtttcagagttttga

SEQ ID NO: 441430 - DNA, 25 bp, Rattus norvegicus
ggcctcccgaaaagtttgattccat

SEQ ID NO: 441431 - DNA, 25 bp, Rattus norvegicus
ggcctcccgaaatgtttgattccat

SEQ ID NO: 441432 - DNA, 25 bp, Rattus norvegicus
ggcctcccgtccaggaaatgacaaa

SEQ ID NO: 441433 - DNA, 25 bp, Rattus norvegicus
ggcctcccgtcctggaaatgacaaa

SEQ ID NO: 441434 - DNA, 25 bp, Rattus norvegicus
ggcctccctcccatgacagggaaat

SEQ ID NO: 441435 - DNA, 25 bp, Rattus norvegicus
ggcctccctcccttgacagggaaat

SEQ ID NO: 441436 - DNA, 25 bp, Rattus norvegicus
ggcctccctgtaagcaacaggcata

SEQ ID NO: 441437 - DNA, 25 bp, Rattus norvegicus
ggcctccctgtatgcaacaggcata

SEQ ID NO: 441438 - DNA, 25 bp, Rattus norvegicus
ggcctccctgtgaggttagcaggac

SEQ ID NO: 441439 - DNA, 25 bp, Rattus norvegicus
ggcctccctgtgtggttagcaggac

SEQ ID NO: 441440 - DNA, 25 bp, Rattus norvegicus
ggcctcccttagcagtaaacaacag

SEQ ID NO: 441441 - DNA, 25 bp, Rattus norvegicus
ggcctcccttaggagtaaacaacag

SEQ ID NO: 441442 - DNA, 25 bp, Rattus norvegicus
ggcctccgaggaacgaaggctcagt

SEQ ID NO: 441443 - DNA, 25 bp, Rattus norvegicus
ggcctccgaggatcgaaggctcagt

SEQ ID NO: 441444 - DNA, 25 bp, Rattus norvegicus
ggcctccgagtcactgatcaagcaa

SEQ ID NO: 441445 - DNA, 25 bp, Rattus norvegicus
ggcctccgagtctctgatcaagcaa

SEQ ID NO: 441446 - DNA, 25 bp, Rattus norvegicus
ggcctccgagtgagagtcagtcagc

SEQ ID NO: 441447 - DNA, 25 bp, Rattus norvegicus
ggcctccgagtgtgagtcagtcagc

SEQ ID NO: 441448 - DNA, 25 bp, Rattus norvegicus
ggcctccgggaacaagctttacgtg

SEQ ID NO: 441449 - DNA, 25 bp, Rattus norvegicus
ggcctccgggaagaagctttacgtg

SEQ ID NO: 441450 - DNA, 25 bp, Rattus norvegicus
ggcctcctaaaaagtctagtggtat

SEQ ID NO: 441451 - DNA, 25 bp, Rattus norvegicus
ggcctcctaaaatgtctagtggtat

SEQ ID NO: 441452 - DNA, 25 bp, Rattus norvegicus
ggcctcctaaagacgcgtacactct

SEQ ID NO: 441453 - DNA, 25 bp, Rattus norvegicus
ggcctcctaaagtcgcgtacactct

SEQ ID NO: 441454 - DNA, 25 bp, Rattus norvegicus
ggcctcctaagtattgtaccttcag

SEQ ID NO: 441455 - DNA, 25 bp, Rattus norvegicus
ggcctcctaagttttgtaccttcag

SEQ ID NO: 441456 - DNA, 25 bp, Rattus norvegicus
ggcctcctaattaattatttgagta

SEQ ID NO: 441457 - DNA, 25 bp, Rattus norvegicus
ggcctcctaatttattatttgagta

SEQ ID NO: 441458 - DNA, 25 bp, Rattus norvegicus
ggcctcctatctatgatcactaatt

SEQ ID NO: 441459 - DNA, 25 bp, Rattus norvegicus
ggcctcctatctttgatcactaatt

SEQ ID NO: 441460 - DNA, 25 bp, Rattus norvegicus
ggcctcctctggatgtgaaacctaa

SEQ ID NO: 441461 - DNA, 25 bp, Rattus norvegicus
ggcctcctctggttgtgaaacctaa

SEQ ID NO: 441462 - DNA, 25 bp, Rattus norvegicus
ggcctcctcttaacctgatgtgaag

SEQ ID NO: 441463 - DNA, 25 bp, Rattus norvegicus
ggcctcctcttatcctgatgtgaag

SEQ ID NO: 441464 - DNA, 25 bp, Rattus norvegicus
ggcctcctgctgatgaggacgctaa

SEQ ID NO: 441465 - DNA, 25 bp, Rattus norvegicus
ggcctcctgctgttgaggacgctaa

SEQ ID NO: 441466 - DNA, 25 bp, Rattus norvegicus
ggcctcctggacctttaatggaaca

SEQ ID NO: 441467 - DNA, 25 bp, Rattus norvegicus
ggcctcctggacgtttaatggaaca

SEQ ID NO: 441468 - DNA, 25 bp, Rattus norvegicus
ggcctcctggtgatttagcaatttc

SEQ ID NO: 441469 - DNA, 25 bp, Rattus norvegicus
ggcctcctggtgttttagcaatttc

SEQ ID NO: 441470 - DNA, 25 bp, Rattus norvegicus
ggcctcctgtacactgtgctaggga

SEQ ID NO: 441471 - DNA, 25 bp, Rattus norvegicus
ggcctcctgtactctgtgctaggga

SEQ ID NO: 441472 - DNA, 25 bp, Rattus norvegicus
ggcctccttaaactagctgttatgt

SEQ ID NO: 441473 - DNA, 25 bp, Rattus norvegicus
ggcctccttaaagtagctgttatgt

SEQ ID NO: 441474 - DNA, 25 bp, Rattus norvegicus
ggcctccttactcgcatgaggtgaa

SEQ ID NO: 441475 - DNA, 25 bp, Rattus norvegicus
ggcctccttactggcatgaggtgaa

SEQ ID NO: 441476 - DNA, 25 bp, Rattus norvegicus
ggcctccttaggcagacaggtgacc

SEQ ID NO: 441477 - DNA, 25 bp, Rattus norvegicus
ggcctccttagggagacaggtgacc

SEQ ID NO: 441478 - DNA, 25 bp, Rattus norvegicus
ggcctccttgagaaaactcctggaa

SEQ ID NO: 441479 - DNA, 25 bp, Rattus norvegicus
ggcctccttgagtaaactcctggaa

SEQ ID NO: 441480 - DNA, 25 bp, Rattus norvegicus
ggcctccttttacgttgaatctgat

SEQ ID NO: 441481 - DNA, 25 bp, Rattus norvegicus
ggcctccttttaggttgaatctgat

SEQ ID NO: 441482 - DNA, 25 bp, Rattus norvegicus
ggcctcctttttaactgtagcttca

SEQ ID NO: 441483 - DNA, 25 bp, Rattus norvegicus
ggcctccttttttactgtagcttca

SEQ ID NO: 441484 - DNA, 25 bp, Rattus norvegicus
ggcctcgaagacctaggaatccatt

SEQ ID NO: 441485 - DNA, 25 bp, Rattus norvegicus
ggcctcgaagacgtaggaatccatt

SEQ ID NO: 441486 - DNA, 25 bp, Rattus norvegicus
ggcctcgacgcaccctacgtgaagg

SEQ ID NO: 441487 - DNA, 25 bp, Rattus norvegicus
ggcctcgacgcagcctacgtgaagg

SEQ ID NO: 441488 - DNA, 25 bp, Rattus norvegicus
ggcctcgcacaacctcaagaagaag

SEQ ID NO: 441489 - DNA, 25 bp, Rattus norvegicus
ggcctcgcacaagctcaagaagaag

SEQ ID NO: 441490 - DNA, 25 bp, Rattus norvegicus
ggcctcggaggcagatgtatacaca

SEQ ID NO: 441491 - DNA, 25 bp, Rattus norvegicus
ggcctcggaggctgatgtatacaca

SEQ ID NO: 441492 - DNA, 25 bp, Rattus norvegicus
ggcctcggaggtcgacttctacatt

SEQ ID NO: 441493 - DNA, 25 bp, Rattus norvegicus
ggcctcggaggtggacttctacatt

SEQ ID NO: 441494 - DNA, 25 bp, Rattus norvegicus
ggcctcggtcatctgagaagtcagc

SEQ ID NO: 441495 - DNA, 25 bp, Rattus norvegicus
ggcctcggtcatgtgagaagtcagc

SEQ ID NO: 441496 - DNA, 25 bp, Rattus norvegicus
ggcctcggtgttccgtcactaggaa

SEQ ID NO: 441497 - DNA, 25 bp, Rattus norvegicus
ggcctcggtgttgcgtcactaggaa

SEQ ID NO: 441498 - DNA, 25 bp, Rattus norvegicus
ggcctcgtaaggacttgtgaaacct

SEQ ID NO: 441499 - DNA, 25 bp, Rattus norvegicus
ggcctcgtaaggtcttgtgaaacct

SEQ ID NO: 441500 - DNA, 25 bp, Rattus norvegicus
ggcctcgtatcgaatggtttgattt

SEQ ID NO: 441501 - DNA, 25 bp, Rattus norvegicus
ggcctcgtatcgtatggtttgattt

SEQ ID NO: 441502 - DNA, 25 bp, Rattus norvegicus
ggcctcgtcacccaagtactgggat

SEQ ID NO: 441503 - DNA, 25 bp, Rattus norvegicus
ggcctcgtcaccgaagtactgggat

SEQ ID NO: 441504 - DNA, 25 bp, Rattus norvegicus
ggcctcgttcctcatgggagacagc

SEQ ID NO: 441505 - DNA, 25 bp, Rattus norvegicus
ggcctcgttcctgatgggagacagc

SEQ ID NO: 441506 - DNA, 25 bp, Rattus norvegicus
ggcctctaaccaaaccgattcgtag

SEQ ID NO: 441507 - DNA, 25 bp, Rattus norvegicus
ggcctctaaccataccgattcgtag

SEQ ID NO: 441508 - DNA, 25 bp, Rattus norvegicus
ggcctctacacaatatctctattta

SEQ ID NO: 441509 - DNA, 25 bp, Rattus norvegicus
ggcctctacacattatctctattta

SEQ ID NO: 441510 - DNA, 25 bp, Rattus norvegicus
ggcctctagaatatcttccaatctg

SEQ ID NO: 441511 - DNA, 25 bp, Rattus norvegicus
ggcctctagaatttcttccaatctg

SEQ ID NO: 441512 - DNA, 25 bp, Rattus norvegicus
ggcctctatggccagttccaggtga

SEQ ID NO: 441513 - DNA, 25 bp, Rattus norvegicus
ggcctctatggcgagttccaggtga

SEQ ID NO: 441514 - DNA, 25 bp, Rattus norvegicus
ggcctctcacccatgtatttaatta

SEQ ID NO: 441515 - DNA, 25 bp, Rattus norvegicus
ggcctctcacccttgtatttaatta

SEQ ID NO: 441516 - DNA, 25 bp, Rattus norvegicus
ggcctctcactgatttctttattac

SEQ ID NO: 441517 - DNA, 25 bp, Rattus norvegicus
ggcctctcactgttttctttattac

SEQ ID NO: 441518 - DNA, 25 bp, Rattus norvegicus
ggcctctcagctcggtatatgaaaa

SEQ ID NO: 441519 - DNA, 25 bp, Rattus norvegicus
ggcctctcagctgggtatatgaaaa

SEQ ID NO: 441520 - DNA, 25 bp, Rattus norvegicus
ggcctctcagtactaccaggagcag

SEQ ID NO: 441521 - DNA, 25 bp, Rattus norvegicus
ggcctctcagtagtaccaggagcag

SEQ ID NO: 441522 - DNA, 25 bp, Rattus norvegicus
ggcctctccaggactgctatggacg

SEQ ID NO: 441523 - DNA, 25 bp, Rattus norvegicus
ggcctctccaggtctgctatggacg

SEQ ID NO: 441524 - DNA, 25 bp, Rattus norvegicus
ggcctctccggtcgatgtggtaaaa

SEQ ID NO: 441525 - DNA, 25 bp, Rattus norvegicus
ggcctctccggtggatgtggtaaaa

SEQ ID NO: 441526 - DNA, 25 bp, Rattus norvegicus
ggcctctcgaaaaacccatatctga

SEQ ID NO: 441527 - DNA, 25 bp, Rattus norvegicus
ggcctctcgaaatacccatatctga

SEQ ID NO: 441528 - DNA, 25 bp, Rattus norvegicus
ggcctctctgagcagcacaagttgc

SEQ ID NO: 441529 - DNA, 25 bp, Rattus norvegicus
ggcctctctgaggagcacaagttgc

SEQ ID NO: 441530 - DNA, 25 bp, Rattus norvegicus
ggcctctcttacagcctggagtata

SEQ ID NO: 441531 - DNA, 25 bp, Rattus norvegicus
ggcctctcttactgcctggagtata

SEQ ID NO: 441532 - DNA, 25 bp, Rattus norvegicus
ggcctctgaaatcctgttgtacata

SEQ ID NO: 441533 - DNA, 25 bp, Rattus norvegicus
ggcctctgaaatgctgttgtacata

SEQ ID NO: 441534 - DNA, 25 bp, Rattus norvegicus
ggcctctgaaggcaatgctcctaaa

SEQ ID NO: 441535 - DNA, 25 bp, Rattus norvegicus
ggcctctgaagggaatgctcctaaa

SEQ ID NO: 441536 - DNA, 25 bp, Rattus norvegicus
ggcctctgacctcttgaggtttggt

SEQ ID NO: 441537 - DNA, 25 bp, Rattus norvegicus
ggcctctgacctgttgaggtttggt

SEQ ID NO: 441538 - DNA, 25 bp, Rattus norvegicus
ggcctctgacttcaggttcctaagt

SEQ ID NO: 441539 - DNA, 25 bp, Rattus norvegicus
ggcctctgacttgaggttcctaagt

SEQ ID NO: 441540 - DNA, 25 bp, Rattus norvegicus
ggcctctgagagacatgttttcttc

SEQ ID NO: 441541 - DNA, 25 bp, Rattus norvegicus
ggcctctgagagtcatgttttcttc

SEQ ID NO: 441542 - DNA, 25 bp, Rattus norvegicus
ggcctctgcactcaggaaacagctg

SEQ ID NO: 441543 - DNA, 25 bp, Rattus norvegicus
ggcctctgcactgaggaaacagctg

SEQ ID NO: 441544 - DNA, 25 bp, Rattus norvegicus
ggcctctgcagcctgccaaaatatt

SEQ ID NO: 441545 - DNA, 25 bp, Rattus norvegicus
ggcctctgcagcgtgccaaaatatt

SEQ ID NO: 441546 - DNA, 25 bp, Rattus norvegicus
ggcctctgccaactgattttctgtg

SEQ ID NO: 441547 - DNA, 25 bp, Rattus norvegicus
ggcctctgccaagtgattttctgtg

SEQ ID NO: 441548 - DNA, 25 bp, Rattus norvegicus
ggcctctgccataatttgttgttca

SEQ ID NO: 441549 - DNA, 25 bp, Rattus norvegicus
ggcctctgccattatttgttgttca

SEQ ID NO: 441550 - DNA, 25 bp, Rattus norvegicus
ggcctctgctgaccatgatggagct

SEQ ID NO: 441551 - DNA, 25 bp, Rattus norvegicus
ggcctctgctgagcatgatggagct

SEQ ID NO: 441552 - DNA, 25 bp, Rattus norvegicus
ggcctctgcttgatgatggaatcct

SEQ ID NO: 441553 - DNA, 25 bp, Rattus norvegicus
ggcctctgcttgttgatggaatcct

SEQ ID NO: 441554 - DNA, 25 bp, Rattus norvegicus
ggcctctgggtcatggaattgagcc

SEQ ID NO: 441555 - DNA, 25 bp, Rattus norvegicus
ggcctctgggtcttggaattgagcc

SEQ ID NO: 441556 - DNA, 25 bp, Rattus norvegicus
ggcctctggtagcacacactgaagt

SEQ ID NO: 441557 - DNA, 25 bp, Rattus norvegicus
ggcctctggtaggacacactgaagt

SEQ ID NO: 441558 - DNA, 25 bp, Rattus norvegicus
ggcctctgtaggcacaggcacaaat

SEQ ID NO: 441559 - DNA, 25 bp, Rattus norvegicus
ggcctctgtagggacaggcacaaat

SEQ ID NO: 441560 - DNA, 25 bp, Rattus norvegicus
ggcctctgtcatattaaagacttgt

SEQ ID NO: 441561 - DNA, 25 bp, Rattus norvegicus
ggcctctgtcattttaaagacttgt

SEQ ID NO: 441562 - DNA, 25 bp, Rattus norvegicus
ggcctctgtcttcccatggaagatc

SEQ ID NO: 441563 - DNA, 25 bp, Rattus norvegicus
ggcctctgtcttgccatggaagatc

SEQ ID NO: 441564 - DNA, 25 bp, Rattus norvegicus
ggcctctgtgcaaaccgggaatgca

SEQ ID NO: 441565 - DNA, 25 bp, Rattus norvegicus
ggcctctgtgcataccgggaatgca

SEQ ID NO: 441566 - DNA, 25 bp, Rattus norvegicus
ggcctctgttctaggacaattgtaa

SEQ ID NO: 441567 - DNA, 25 bp, Rattus norvegicus
ggcctctgttcttggacaattgtaa

SEQ ID NO: 441568 - DNA, 25 bp, Rattus norvegicus
ggcctctgtttccaagtgatgattc

SEQ ID NO: 441569 - DNA, 25 bp, Rattus norvegicus
ggcctctgtttcgaagtgatgattc

SEQ ID NO: 441570 - DNA, 25 bp, Rattus norvegicus
ggcctcttaaccatccaagactgaa

SEQ ID NO: 441571 - DNA, 25 bp, Rattus norvegicus
ggcctcttaaccttccaagactgaa

SEQ ID NO: 441572 - DNA, 25 bp, Rattus norvegicus
ggcctcttactgctaggatcgggaa

SEQ ID NO: 441573 - DNA, 25 bp, Rattus norvegicus
ggcctcttactggtaggatcgggaa

SEQ ID NO: 441574 - DNA, 25 bp, Rattus norvegicus
ggcctcttagcaccacggaacggac

SEQ ID NO: 441575 - DNA, 25 bp, Rattus norvegicus
ggcctcttagcagcacggaacggac

SEQ ID NO: 441576 - DNA, 25 bp, Rattus norvegicus
ggcctcttagccagtgttctattac

SEQ ID NO: 441577 - DNA, 25 bp, Rattus norvegicus
ggcctcttagcctgtgttctattac

SEQ ID NO: 441578 - DNA, 25 bp, Rattus norvegicus
ggcctcttaggccaaccacggtaga

SEQ ID NO: 441579 - DNA, 25 bp, Rattus norvegicus
ggcctcttaggcgaaccacggtaga

SEQ ID NO: 441580 - DNA, 25 bp, Rattus norvegicus
ggcctcttcacaagtcctgaagtag

SEQ ID NO: 441581 - DNA, 25 bp, Rattus norvegicus
ggcctcttcacatgtcctgaagtag

SEQ ID NO: 441582 - DNA, 25 bp, Rattus norvegicus
ggcctcttccatatttgctgttcat

SEQ ID NO: 441583 - DNA, 25 bp, Rattus norvegicus
ggcctcttccatttttgctgttcat

SEQ ID NO: 441584 - DNA, 25 bp, Rattus norvegicus
ggcctcttccccagaatgtgtgatg

SEQ ID NO: 441585 - DNA, 25 bp, Rattus norvegicus
ggcctcttcccctgaatgtgtgatg

SEQ ID NO: 441586 - DNA, 25 bp, Rattus norvegicus
ggcctcttccctcagattgagttga

SEQ ID NO: 441587 - DNA, 25 bp, Rattus norvegicus
ggcctcttccctgagattgagttga

SEQ ID NO: 441588 - DNA, 25 bp, Rattus norvegicus
ggcctcttggagatggcagctctga

SEQ ID NO: 441589 - DNA, 25 bp, Rattus norvegicus
ggcctcttggagttggcagctctga

SEQ ID NO: 441590 - DNA, 25 bp, Rattus norvegicus
ggcctcttggtaatttgatccctac

SEQ ID NO: 441591 - DNA, 25 bp, Rattus norvegicus
ggcctcttggtattttgatccctac

SEQ ID NO: 441592 - DNA, 25 bp, Rattus norvegicus
ggcctcttgtccaagcaggcatatt

SEQ ID NO: 441593 - DNA, 25 bp, Rattus norvegicus
ggcctcttgtcctagcaggcatatt

SEQ ID NO: 441594 - DNA, 25 bp, Rattus norvegicus
ggcctctttaatccctgcaaagctt

SEQ ID NO: 441595 - DNA, 25 bp, Rattus norvegicus
ggcctctttaatgcctgcaaagctt

SEQ ID NO: 441596 - DNA, 25 bp, Rattus norvegicus
ggcctctttatacctgattttgctc

SEQ ID NO: 441597 - DNA, 25 bp, Rattus norvegicus
ggcctctttatagctgattttgctc

SEQ ID NO: 441598 - DNA, 25 bp, Rattus norvegicus
ggcctctttcacaatatgattcctg

SEQ ID NO: 441599 - DNA, 25 bp, Rattus norvegicus
ggcctctttcactatatgattcctg

SEQ ID NO: 441600 - DNA, 25 bp, Rattus norvegicus
ggcctctttccaactctgaaggaga

SEQ ID NO: 441601 - DNA, 25 bp, Rattus norvegicus
ggcctctttccatctctgaaggaga

SEQ ID NO: 441602 - DNA, 25 bp, Rattus norvegicus
ggcctctttcctcttattatggaca

SEQ ID NO: 441603 - DNA, 25 bp, Rattus norvegicus
ggcctctttcctgttattatggaca

SEQ ID NO: 441604 - DNA, 25 bp, Rattus norvegicus
ggcctctttgatatttctctcagaa

SEQ ID NO: 441605 - DNA, 25 bp, Rattus norvegicus
ggcctctttgatttttctctcagaa

SEQ ID NO: 441606 - DNA, 25 bp, Rattus norvegicus
ggcctctttgccagatatcaataat

SEQ ID NO: 441607 - DNA, 25 bp, Rattus norvegicus
ggcctctttgcctgatatcaataat

SEQ ID NO: 441608 - DNA, 25 bp, Rattus norvegicus
ggcctctttgtgcttacgtattctt

SEQ ID NO: 441609 - DNA, 25 bp, Rattus norvegicus
ggcctctttgtggttacgtattctt

SEQ ID NO: 441610 - DNA, 25 bp, Rattus norvegicus
ggcctcttttcaaaatggactacac

SEQ ID NO: 441611 - DNA, 25 bp, Rattus norvegicus
ggcctcttttcataatggactacac

SEQ ID NO: 441612 - DNA, 25 bp, Rattus norvegicus
ggcctgaaatgaagagacccgtgtt

SEQ ID NO: 441613 - DNA, 25 bp, Rattus norvegicus
ggcctgaaatgatgagacccgtgtt

SEQ ID NO: 441614 - DNA, 25 bp, Rattus norvegicus
ggcctgaacgctagacgctggtgca

SEQ ID NO: 441615 - DNA, 25 bp, Rattus norvegicus
ggcctgaacgcttgacgctggtgca

SEQ ID NO: 441616 - DNA, 25 bp, Rattus norvegicus
ggcctgaactctcggcagtctcgaa

SEQ ID NO: 441617 - DNA, 25 bp, Rattus norvegicus
ggcctgaactctgggcagtctcgaa

SEQ ID NO: 441618 - DNA, 25 bp, Rattus norvegicus
ggcctgaacttacagtatttgttta

SEQ ID NO: 441619 - DNA, 25 bp, Rattus norvegicus
ggcctgaacttagagtatttgttta

SEQ ID NO: 441620 - DNA, 25 bp, Rattus norvegicus
ggcctgaagacaagccttgtgggtt

SEQ ID NO: 441621 - DNA, 25 bp, Rattus norvegicus
ggcctgaagacatgccttgtgggtt

SEQ ID NO: 441622 - DNA, 25 bp, Rattus norvegicus
ggcctgacactgatactgatgctat

SEQ ID NO: 441623 - DNA, 25 bp, Rattus norvegicus
ggcctgacactgttactgatgctat

SEQ ID NO: 441624 - DNA, 25 bp, Rattus norvegicus
ggcctgacagcgatgaggacgacct

SEQ ID NO: 441625 - DNA, 25 bp, Rattus norvegicus
ggcctgacagcgttgaggacgacct

SEQ ID NO: 441626 - DNA, 25 bp, Rattus norvegicus
ggcctgacccagcactgatggagta

SEQ ID NO: 441627 - DNA, 25 bp, Rattus norvegicus
ggcctgacccaggactgatggagta

SEQ ID NO: 441628 - DNA, 25 bp, Rattus norvegicus
ggcctgaccgcgattccgaaaactg

SEQ ID NO: 441629 - DNA, 25 bp, Rattus norvegicus
ggcctgaccgcgtttccgaaaactg

SEQ ID NO: 441630 - DNA, 25 bp, Rattus norvegicus
ggcctgacctctcggtactggaacg

SEQ ID NO: 441631 - DNA, 25 bp, Rattus norvegicus
ggcctgacctctgggtactggaacg

SEQ ID NO: 441632 - DNA, 25 bp, Rattus norvegicus
ggcctgacctgacaatacctgaaat

SEQ ID NO: 441633 - DNA, 25 bp, Rattus norvegicus
ggcctgacctgagaatacctgaaat

SEQ ID NO: 441634 - DNA, 25 bp, Rattus norvegicus
ggcctgacgccacaatgggtactgt

SEQ ID NO: 441635 - DNA, 25 bp, Rattus norvegicus
ggcctgacgccagaatgggtactgt

SEQ ID NO: 441636 - DNA, 25 bp, Rattus norvegicus
ggcctgactattcctgtccaaatat

SEQ ID NO: 441637 - DNA, 25 bp, Rattus norvegicus
ggcctgactattgctgtccaaatat

SEQ ID NO: 441638 - DNA, 25 bp, Rattus norvegicus
ggcctgactgctccaaagcgcagta

SEQ ID NO: 441639 - DNA, 25 bp, Rattus norvegicus
ggcctgactgctgcaaagcgcagta

SEQ ID NO: 441640 - DNA, 25 bp, Rattus norvegicus
ggcctgagacttagggaacttatac

SEQ ID NO: 441641 - DNA, 25 bp, Rattus norvegicus
ggcctgagactttgggaacttatac

SEQ ID NO: 441642 - DNA, 25 bp, Rattus norvegicus
ggcctgagcctacgtgctggacttc

SEQ ID NO: 441643 - DNA, 25 bp, Rattus norvegicus
ggcctgagcctaggtgctggacttc

SEQ ID NO: 441644 - DNA, 25 bp, Rattus norvegicus
ggcctgagctggaagtgacactgta

SEQ ID NO: 441645 - DNA, 25 bp, Rattus norvegicus
ggcctgagctggtagtgacactgta

SEQ ID NO: 441646 - DNA, 25 bp, Rattus norvegicus
ggcctgagctttactgtattctatt

SEQ ID NO: 441647 - DNA, 25 bp, Rattus norvegicus
ggcctgagctttagactaatgtaca

SEQ ID NO: 441648 - DNA, 25 bp, Rattus norvegicus
ggcctgagcttttctgtattctatt

SEQ ID NO: 441649 - DNA, 25 bp, Rattus norvegicus
ggcctgagcttttgactaatgtaca

SEQ ID NO: 441650 - DNA, 25 bp, Rattus norvegicus
ggcctgaggaaaagtgacctgtctt

SEQ ID NO: 441651 - DNA, 25 bp, Rattus norvegicus
ggcctgaggaaatgtgacctgtctt

SEQ ID NO: 441652 - DNA, 25 bp, Rattus norvegicus
ggcctgaggaagaggtctgtcttaa

SEQ ID NO: 441653 - DNA, 25 bp, Rattus norvegicus
ggcctgaggaagtggtctgtcttaa

SEQ ID NO: 441654 - DNA, 25 bp, Rattus norvegicus
ggcctgaggcctattctgaggtagc

SEQ ID NO: 441655 - DNA, 25 bp, Rattus norvegicus
ggcctgaggccttttctgaggtagc

SEQ ID NO: 441656 - DNA, 25 bp, Rattus norvegicus
ggcctgagtaggcagtcatatatgt

SEQ ID NO: 441657 - DNA, 25 bp, Rattus norvegicus
ggcctgagtagggagtcatatatgt

SEQ ID NO: 441658 - DNA, 25 bp, Rattus norvegicus
ggcctgagtctcactacctgatgca

SEQ ID NO: 441659 - DNA, 25 bp, Rattus norvegicus
ggcctgagtctctctacctgatgca

SEQ ID NO: 441660 - DNA, 25 bp, Rattus norvegicus
ggcctgatacagaaggtcctcacta

SEQ ID NO: 441661 - DNA, 25 bp, Rattus norvegicus
ggcctgatacagtaggtcctcacta

SEQ ID NO: 441662 - DNA, 25 bp, Rattus norvegicus
ggcctgatgaacattgtgctgggtt

SEQ ID NO: 441663 - DNA, 25 bp, Rattus norvegicus
ggcctgatgaactttgtgctgggtt

SEQ ID NO: 441664 - DNA, 25 bp, Rattus norvegicus
ggcctgatgcccagattgagaactt

SEQ ID NO: 441665 - DNA, 25 bp, Rattus norvegicus
ggcctgatgccctgattgagaactt

SEQ ID NO: 441666 - DNA, 25 bp, Rattus norvegicus
ggcctgattgcaatcttttactgga

SEQ ID NO: 441667 - DNA, 25 bp, Rattus norvegicus
ggcctgattgcattcttttactgga

SEQ ID NO: 441668 - DNA, 25 bp, Rattus norvegicus
ggcctgcaagcaatcaactgcacaa

SEQ ID NO: 441669 - DNA, 25 bp, Rattus norvegicus
ggcctgcaagcattcaactgcacaa

SEQ ID NO: 441670 - DNA, 25 bp, Rattus norvegicus
ggcctgcaattgaacacctcagttg

SEQ ID NO: 441671 - DNA, 25 bp, Rattus norvegicus
ggcctgcaattgtacacctcagttg

SEQ ID NO: 441672 - DNA, 25 bp, Rattus norvegicus
ggcctgcactgtccctagaaaggag

SEQ ID NO: 441673 - DNA, 25 bp, Rattus norvegicus
ggcctgcactgtgcctagaaaggag

SEQ ID NO: 441674 - DNA, 25 bp, Rattus norvegicus
ggcctgcaggcacaatactgtcaca

SEQ ID NO: 441675 - DNA, 25 bp, Rattus norvegicus
ggcctgcaggcagaatactgtcaca

SEQ ID NO: 441676 - DNA, 25 bp, Rattus norvegicus
ggcctgcagggcacatctcgggaaa

SEQ ID NO: 441677 - DNA, 25 bp, Rattus norvegicus
ggcctgcagggctcatctcgggaaa

SEQ ID NO: 441678 - DNA, 25 bp, Rattus norvegicus
ggcctgcatcataccagactttaca

SEQ ID NO: 441679 - DNA, 25 bp, Rattus norvegicus
ggcctgcatcattccagactttaca

SEQ ID NO: 441680 - DNA, 25 bp, Rattus norvegicus
ggcctgcattttcccaaagctagaa

SEQ ID NO: 441681 - DNA, 25 bp, Rattus norvegicus
ggcctgcattttgccaaagctagaa

SEQ ID NO: 441682 - DNA, 25 bp, Rattus norvegicus
ggcctgccacctagttgtgtgagga

SEQ ID NO: 441683 - DNA, 25 bp, Rattus norvegicus
ggcctgccaccttgttgtgtgagga

SEQ ID NO: 441684 - DNA, 25 bp, Rattus norvegicus
ggcctgccaggtatgggttgcacaa

SEQ ID NO: 441685 - DNA, 25 bp, Rattus norvegicus
ggcctgccaggtttgggttgcacaa

SEQ ID NO: 441686 - DNA, 25 bp, Rattus norvegicus
ggcctgcccggaagaacgtggccaa

SEQ ID NO: 441687 - DNA, 25 bp, Rattus norvegicus
ggcctgcccggatgaacgtggccaa

SEQ ID NO: 441688 - DNA, 25 bp, Rattus norvegicus
ggcctgccctgcacttgaaggaata

SEQ ID NO: 441689 - DNA, 25 bp, Rattus norvegicus
ggcctgccctgctcttgaaggaata

SEQ ID NO: 441690 - DNA, 25 bp, Rattus norvegicus
ggcctgcccttacaagtagagccag

SEQ ID NO: 441691 - DNA, 25 bp, Rattus norvegicus
ggcctgcccttagaagtagagccag

SEQ ID NO: 441692 - DNA, 25 bp, Rattus norvegicus
ggcctgccgaggatttcatttaact

SEQ ID NO: 441693 - DNA, 25 bp, Rattus norvegicus
ggcctgccgaggttttcatttaact

SEQ ID NO: 441694 - DNA, 25 bp, Rattus norvegicus
ggcctgcctggcaagtgttcttgta

SEQ ID NO: 441695 - DNA, 25 bp, Rattus norvegicus
ggcctgcctggctagtgttcttgta

SEQ ID NO: 441696 - DNA, 25 bp, Rattus norvegicus
ggcctgcgacatataaccattttga

SEQ ID NO: 441697 - DNA, 25 bp, Rattus norvegicus
ggcctgcgacatttaaccattttga

SEQ ID NO: 441698 - DNA, 25 bp, Rattus norvegicus
ggcctgcgtagaataaaccctaagt

SEQ ID NO: 441699 - DNA, 25 bp, Rattus norvegicus
ggcctgcgtagattaaaccctaagt

SEQ ID NO: 441700 - DNA, 25 bp, Rattus norvegicus
ggcctgctaaacctccacagtgaaa

SEQ ID NO: 441701 - DNA, 25 bp, Rattus norvegicus
ggcctgctaaacgtccacagtgaaa

SEQ ID NO: 441702 - DNA, 25 bp, Rattus norvegicus
ggcctgctaccaaatgctaggatct

SEQ ID NO: 441703 - DNA, 25 bp, Rattus norvegicus
ggcctgctaccatatgctaggatct

SEQ ID NO: 441704 - DNA, 25 bp, Rattus norvegicus
ggcctgctacctagtgtgtctgaaa

SEQ ID NO: 441705 - DNA, 25 bp, Rattus norvegicus
ggcctgctaccttgtgtgtctgaaa

SEQ ID NO: 441706 - DNA, 25 bp, Rattus norvegicus
ggcctgctgtgcactgaatatgagg

SEQ ID NO: 441707 - DNA, 25 bp, Rattus norvegicus
ggcctgctgtgctctgaatatgagg

SEQ ID NO: 441708 - DNA, 25 bp, Rattus norvegicus
ggcctgcttagtaatttacagctaa

SEQ ID NO: 441709 - DNA, 25 bp, Rattus norvegicus
ggcctgcttagttatttacagctaa

SEQ ID NO: 441710 - DNA, 25 bp, Rattus norvegicus
ggcctggaaaacacagcttcaagaa

SEQ ID NO: 441711 - DNA, 25 bp, Rattus norvegicus
ggcctggaaaacaccttgcacgatg

SEQ ID NO: 441712 - DNA, 25 bp, Rattus norvegicus
ggcctggaaaactcagcttcaagaa

SEQ ID NO: 441713 - DNA, 25 bp, Rattus norvegicus
ggcctggaaaactccttgcacgatg

SEQ ID NO: 441714 - DNA, 25 bp, Rattus norvegicus
ggcctggaaatcaaaggttcacctg

SEQ ID NO: 441715 - DNA, 25 bp, Rattus norvegicus
ggcctggaaatctaaggttcacctg

SEQ ID NO: 441716 - DNA, 25 bp, Rattus norvegicus
ggcctggaacaacctcactgctaga

SEQ ID NO: 441717 - DNA, 25 bp, Rattus norvegicus
ggcctggaacaagctcactgctaga

SEQ ID NO: 441718 - DNA, 25 bp, Rattus norvegicus
ggcctggaagacaatgttccccgga

SEQ ID NO: 441719 - DNA, 25 bp, Rattus norvegicus
ggcctggaagacagctgaccattag

SEQ ID NO: 441720 - DNA, 25 bp, Rattus norvegicus
ggcctggaagactatgttccccgga

SEQ ID NO: 441721 - DNA, 25 bp, Rattus norvegicus
ggcctggaagactgctgaccattag

SEQ ID NO: 441722 - DNA, 25 bp, Rattus norvegicus
ggcctggaatcccacatcataaatt

SEQ ID NO: 441723 - DNA, 25 bp, Rattus norvegicus
ggcctggaatccgacatcataaatt

SEQ ID NO: 441724 - DNA, 25 bp, Rattus norvegicus
ggcctggaattcaatatataaccta

SEQ ID NO: 441725 - DNA, 25 bp, Rattus norvegicus
ggcctggaattctatatataaccta

SEQ ID NO: 441726 - DNA, 25 bp, Rattus norvegicus
ggcctggacagcagacctggaagaa

SEQ ID NO: 441727 - DNA, 25 bp, Rattus norvegicus
ggcctggacagctgacctggaagaa

SEQ ID NO: 441728 - DNA, 25 bp, Rattus norvegicus
ggcctggactctactattttgtaaa

SEQ ID NO: 441729 - DNA, 25 bp, Rattus norvegicus
ggcctggactcttctattttgtaaa

SEQ ID NO: 441730 - DNA, 25 bp, Rattus norvegicus
ggcctggactgtcataaccgttatt

SEQ ID NO: 441731 - DNA, 25 bp, Rattus norvegicus
ggcctggactgtgataaccgttatt

SEQ ID NO: 441732 - DNA, 25 bp, Rattus norvegicus
ggcctggagactacaggcgctacca

SEQ ID NO: 441733 - DNA, 25 bp, Rattus norvegicus
ggcctggagacttcaggcgctacca

SEQ ID NO: 441734 - DNA, 25 bp, Rattus norvegicus
ggcctggaggctcagccatcagaac

SEQ ID NO: 441735 - DNA, 25 bp, Rattus norvegicus
ggcctggaggctgagccatcagaac

SEQ ID NO: 441736 - DNA, 25 bp, Rattus norvegicus
ggcctggaggtgctctcagattctt

SEQ ID NO: 441737 - DNA, 25 bp, Rattus norvegicus
ggcctggaggtggtctcagattctt

SEQ ID NO: 441738 - DNA, 25 bp, Rattus norvegicus
ggcctggagttaatacacttgtcat

SEQ ID NO: 441739 - DNA, 25 bp, Rattus norvegicus
ggcctggagttattacacttgtcat

SEQ ID NO: 441740 - DNA, 25 bp, Rattus norvegicus
ggcctggatcaccttgtctcaaaaa

SEQ ID NO: 441741 - DNA, 25 bp, Rattus norvegicus
ggcctggatcacgttgtctcaaaaa

SEQ ID NO: 441742 - DNA, 25 bp, Rattus norvegicus
ggcctggatccacactgtattttaa

SEQ ID NO: 441743 - DNA, 25 bp, Rattus norvegicus
ggcctggatccagactgtattttaa

SEQ ID NO: 441744 - DNA, 25 bp, Rattus norvegicus
ggcctggcaggtcatgtactttttt

SEQ ID NO: 441745 - DNA, 25 bp, Rattus norvegicus
ggcctggcaggtgatgtactttttt

SEQ ID NO: 441746 - DNA, 25 bp, Rattus norvegicus
ggcctggcatatcgtaggtacccaa

SEQ ID NO: 441747 - DNA, 25 bp, Rattus norvegicus
ggcctggcatatggtaggtacccaa

SEQ ID NO: 441748 - DNA, 25 bp, Rattus norvegicus
ggcctggccaaaactattcaccatg

SEQ ID NO: 441749 - DNA, 25 bp, Rattus norvegicus
ggcctggccaaatctattcaccatg

SEQ ID NO: 441750 - DNA, 25 bp, Rattus norvegicus
ggcctggccaatagagtcccttgaa

SEQ ID NO: 441751 - DNA, 25 bp, Rattus norvegicus
ggcctggccaattgagtcccttgaa

SEQ ID NO: 441752 - DNA, 25 bp, Rattus norvegicus
ggcctggccccaaagaagaagaaat

SEQ ID NO: 441753 - DNA, 25 bp, Rattus norvegicus
ggcctggccccatagaagaagaaat

SEQ ID NO: 441754 - DNA, 25 bp, Rattus norvegicus
ggcctggccgacatgtaggagactt

SEQ ID NO: 441755 - DNA, 25 bp, Rattus norvegicus
ggcctggccgacttgtaggagactt

SEQ ID NO: 441756 - DNA, 25 bp, Rattus norvegicus
ggcctggcctacaaagcaagatatt

SEQ ID NO: 441757 - DNA, 25 bp, Rattus norvegicus
ggcctggcctactaagcaagatatt

SEQ ID NO: 441758 - DNA, 25 bp, Rattus norvegicus
ggcctggcctccagccctgtggaaa

SEQ ID NO: 441759 - DNA, 25 bp, Rattus norvegicus
ggcctggcctcctgccctgtggaaa

SEQ ID NO: 441760 - DNA, 25 bp, Rattus norvegicus
ggcctggcgatgcacatgtgtaatt

SEQ ID NO: 441761 - DNA, 25 bp, Rattus norvegicus
ggcctggcgatggacatgtgtaatt

SEQ ID NO: 441762 - DNA, 25 bp, Rattus norvegicus
ggcctggcgcatcagctagtgacat

SEQ ID NO: 441763 - DNA, 25 bp, Rattus norvegicus
ggcctggcgcatgagctagtgacat

SEQ ID NO: 441764 - DNA, 25 bp, Rattus norvegicus
ggcctggctcagaacctatttattg

SEQ ID NO: 441765 - DNA, 25 bp, Rattus norvegicus
ggcctggctcagtacctatttattg

SEQ ID NO: 441766 - DNA, 25 bp, Rattus norvegicus
ggcctggctgagaactgcacgttga

SEQ ID NO: 441767 - DNA, 25 bp, Rattus norvegicus
ggcctggctgagtactgcacgttga

SEQ ID NO: 441768 - DNA, 25 bp, Rattus norvegicus
ggcctggctggcaaagttctccaac

SEQ ID NO: 441769 - DNA, 25 bp, Rattus norvegicus
ggcctggctggctaagttctccaac

SEQ ID NO: 441770 - DNA, 25 bp, Rattus norvegicus
ggcctggcttaacaaccacacactt

SEQ ID NO: 441771 - DNA, 25 bp, Rattus norvegicus
ggcctggcttaagaaccacacactt

SEQ ID NO: 441772 - DNA, 25 bp, Rattus norvegicus
ggcctgggaaatcacaagctgctgt

SEQ ID NO: 441773 - DNA, 25 bp, Rattus norvegicus
ggcctgggaaatgacaagctgctgt

SEQ ID NO: 441774 - DNA, 25 bp, Rattus norvegicus
ggcctgggacaacttcatgctccga

SEQ ID NO: 441775 - DNA, 25 bp, Rattus norvegicus
ggcctgggacaagttcatgctccga

SEQ ID NO: 441776 - DNA, 25 bp, Rattus norvegicus
ggcctgggactcacacgcaaaacat

SEQ ID NO: 441777 - DNA, 25 bp, Rattus norvegicus
ggcctgggactctcacgcaaaacat

SEQ ID NO: 441778 - DNA, 25 bp, Rattus norvegicus
ggcctgggactgcttctgtttgtat

SEQ ID NO: 441779 - DNA, 25 bp, Rattus norvegicus
ggcctgggactggttctgtttgtat

SEQ ID NO: 441780 - DNA, 25 bp, Rattus norvegicus
ggcctgggatccaggaaagaaaatc

SEQ ID NO: 441781 - DNA, 25 bp, Rattus norvegicus
ggcctgggatcctggaaagaaaatc

SEQ ID NO: 441782 - DNA, 25 bp, Rattus norvegicus
ggcctgggcagaccagtgaccttct

SEQ ID NO: 441783 - DNA, 25 bp, Rattus norvegicus
ggcctgggcagagcagtgaccttct

SEQ ID NO: 441784 - DNA, 25 bp, Rattus norvegicus
ggcctgggcccaaagaagtagtgaa

SEQ ID NO: 441785 - DNA, 25 bp, Rattus norvegicus
ggcctgggcccatagaagtagtgaa

SEQ ID NO: 441786 - DNA, 25 bp, Rattus norvegicus
ggcctgggcttcctttatattgaga

SEQ ID NO: 441787 - DNA, 25 bp, Rattus norvegicus
ggcctgggcttcgtttatattgaga

SEQ ID NO: 441788 - DNA, 25 bp, Rattus norvegicus
ggcctgggtattagcccaagcactt

SEQ ID NO: 441789 - DNA, 25 bp, Rattus norvegicus
ggcctgggtatttgcccaagcactt

SEQ ID NO: 441790 - DNA, 25 bp, Rattus norvegicus
ggcctgggtcagataagtgttacaa

SEQ ID NO: 441791 - DNA, 25 bp, Rattus norvegicus
ggcctgggtcagttaagtgttacaa

SEQ ID NO: 441792 - DNA, 25 bp, Rattus norvegicus
ggcctggtagacacttaaagactgg

SEQ ID NO: 441793 - DNA, 25 bp, Rattus norvegicus
ggcctggtagactcttaaagactgg

SEQ ID NO: 441794 - DNA, 25 bp, Rattus norvegicus
ggcctggtatgcagtatcttgttac

SEQ ID NO: 441795 - DNA, 25 bp, Rattus norvegicus
ggcctggtatgctgtatcttgttac

SEQ ID NO: 441796 - DNA, 25 bp, Rattus norvegicus
ggcctggtgcttcacctggttaaat

SEQ ID NO: 441797 - DNA, 25 bp, Rattus norvegicus
ggcctggtgcttgacctggttaaat

SEQ ID NO: 441798 - DNA, 25 bp, Rattus norvegicus
ggcctggtgggcatggaaccttcta

SEQ ID NO: 441799 - DNA, 25 bp, Rattus norvegicus
ggcctggtgggcttggaaccttcta

SEQ ID NO: 441800 - DNA, 25 bp, Rattus norvegicus
ggcctggtggtaaaaaactgcatct

SEQ ID NO: 441801 - DNA, 25 bp, Rattus norvegicus
ggcctggtggtataaaactgcatct

SEQ ID NO: 441802 - DNA, 25 bp, Rattus norvegicus
ggcctggtggtcatgcgcatgtcca

SEQ ID NO: 441803 - DNA, 25 bp, Rattus norvegicus
ggcctggtggtcttgcgcatgtcca

SEQ ID NO: 441804 - DNA, 25 bp, Rattus norvegicus
ggcctggtgtttacttctaagggct

SEQ ID NO: 441805 - DNA, 25 bp, Rattus norvegicus
ggcctggtgttttcttctaagggct

SEQ ID NO: 441806 - DNA, 25 bp, Rattus norvegicus
ggcctggtttccattatactaatcg

SEQ ID NO: 441807 - DNA, 25 bp, Rattus norvegicus
ggcctggtttcctttatactaatcg

SEQ ID NO: 441808 - DNA, 25 bp, Rattus norvegicus
ggcctgtaaattacattgtttcctt

SEQ ID NO: 441809 - DNA, 25 bp, Rattus norvegicus
ggcctgtaaatttcattgtttcctt

SEQ ID NO: 441810 - DNA, 25 bp, Rattus norvegicus
ggcctgtaacagacccacgggttca

SEQ ID NO: 441811 - DNA, 25 bp, Rattus norvegicus
ggcctgtaacagtcccacgggttca

SEQ ID NO: 441812 - DNA, 25 bp, Rattus norvegicus
ggcctgtaattacactacttcctaa

SEQ ID NO: 441813 - DNA, 25 bp, Rattus norvegicus
ggcctgtaattagactacttcctaa

SEQ ID NO: 441814 - DNA, 25 bp, Rattus norvegicus
ggcctgtcaaagctgacggacgact

SEQ ID NO: 441815 - DNA, 25 bp, Rattus norvegicus
ggcctgtcaaaggtgacggacgact

SEQ ID NO: 441816 - DNA, 25 bp, Rattus norvegicus
ggcctgtcacctacggtataattga

SEQ ID NO: 441817 - DNA, 25 bp, Rattus norvegicus
ggcctgtcaccttcggtataattga

SEQ ID NO: 441818 - DNA, 25 bp, Rattus norvegicus
ggcctgtcagctataattttatgca

SEQ ID NO: 441819 - DNA, 25 bp, Rattus norvegicus
ggcctgtcagctttaattttatgca

SEQ ID NO: 441820 - DNA, 25 bp, Rattus norvegicus
ggcctgtcaggtattttcttcttta

SEQ ID NO: 441821 - DNA, 25 bp, Rattus norvegicus
ggcctgtcaggttttttcttcttta

SEQ ID NO: 441822 - DNA, 25 bp, Rattus norvegicus
ggcctgtcatcaactatctgttctt

SEQ ID NO: 441823 - DNA, 25 bp, Rattus norvegicus
ggcctgtcatcatctatctgttctt

SEQ ID NO: 441824 - DNA, 25 bp, Rattus norvegicus
ggcctgtccataaaacatttctcgt

SEQ ID NO: 441825 - DNA, 25 bp, Rattus norvegicus
ggcctgtccatataacatttctcgt

SEQ ID NO: 441826 - DNA, 25 bp, Rattus norvegicus
ggcctgtcccatcagagtgtattac

SEQ ID NO: 441827 - DNA, 25 bp, Rattus norvegicus
ggcctgtcccatgagagtgtattac

SEQ ID NO: 441828 - DNA, 25 bp, Rattus norvegicus
ggcctgtcctcaatgttttttgatc

SEQ ID NO: 441829 - DNA, 25 bp, Rattus norvegicus
ggcctgtcctcattgttttttgatc

SEQ ID NO: 441830 - DNA, 25 bp, Rattus norvegicus
ggcctgtcgaccaggtgacatctaa

SEQ ID NO: 441831 - DNA, 25 bp, Rattus norvegicus
ggcctgtcgacctggtgacatctaa

SEQ ID NO: 441832 - DNA, 25 bp, Rattus norvegicus
ggcctgtctcagactggaggctcct

SEQ ID NO: 441833 - DNA, 25 bp, Rattus norvegicus
ggcctgtctcagtctggaggctcct

SEQ ID NO: 441834 - DNA, 25 bp, Rattus norvegicus
ggcctgtctccacggcctttgaaat

SEQ ID NO: 441835 - DNA, 25 bp, Rattus norvegicus
ggcctgtctccagggcctttgaaat

SEQ ID NO: 441836 - DNA, 25 bp, Rattus norvegicus
ggcctgtctgggatgctgccacgct

SEQ ID NO: 441837 - DNA, 25 bp, Rattus norvegicus
ggcctgtctgggttgctgccacgct

SEQ ID NO: 441838 - DNA, 25 bp, Rattus norvegicus
ggcctgtctgtccacaccgagactt

SEQ ID NO: 441839 - DNA, 25 bp, Rattus norvegicus
ggcctgtctgtcgacaccgagactt

SEQ ID NO: 441840 - DNA, 25 bp, Rattus norvegicus
ggcctgtctttcatgtttgtcagag

SEQ ID NO: 441841 - DNA, 25 bp, Rattus norvegicus
ggcctgtctttcttgtttgtcagag

SEQ ID NO: 441842 - DNA, 25 bp, Rattus norvegicus
ggcctgtgaacgagatgtccagtgt

SEQ ID NO: 441843 - DNA, 25 bp, Rattus norvegicus
ggcctgtgaacgtgatgtccagtgt

SEQ ID NO: 441844 - DNA, 25 bp, Rattus norvegicus
ggcctgtgaagaagttcctcaggtc

SEQ ID NO: 441845 - DNA, 25 bp, Rattus norvegicus
ggcctgtgaagatgttcctcaggtc

SEQ ID NO: 441846 - DNA, 25 bp, Rattus norvegicus
ggcctgtgacttatccattatttat

SEQ ID NO: 441847 - DNA, 25 bp, Rattus norvegicus
ggcctgtgacttcggaattgtgact

SEQ ID NO: 441848 - DNA, 25 bp, Rattus norvegicus
ggcctgtgacttgggaattgtgact

SEQ ID NO: 441849 - DNA, 25 bp, Rattus norvegicus
ggcctgtgacttttccattatttat

SEQ ID NO: 441850 - DNA, 25 bp, Rattus norvegicus
ggcctgtgagggatcatctctatat

SEQ ID NO: 441851 - DNA, 25 bp, Rattus norvegicus
ggcctgtgagggttcatctctatat

SEQ ID NO: 441852 - DNA, 25 bp, Rattus norvegicus
ggcctgtgatgactacaagctgtgt

SEQ ID NO: 441853 - DNA, 25 bp, Rattus norvegicus
ggcctgtgatgagtacaagctgtgt

SEQ ID NO: 441854 - DNA, 25 bp, Rattus norvegicus
ggcctgtgcacccagaaccttagag

SEQ ID NO: 441855 - DNA, 25 bp, Rattus norvegicus
ggcctgtgcaccgagaaccttagag

SEQ ID NO: 441856 - DNA, 25 bp, Rattus norvegicus
ggcctgtgcatgaaccagtttgaat

SEQ ID NO: 441857 - DNA, 25 bp, Rattus norvegicus
ggcctgtgcatgtaccagtttgaat

SEQ ID NO: 441858 - DNA, 25 bp, Rattus norvegicus
ggcctgtgccacagagaacctcgaa

SEQ ID NO: 441859 - DNA, 25 bp, Rattus norvegicus
ggcctgtgccactgagaacctcgaa

SEQ ID NO: 441860 - DNA, 25 bp, Rattus norvegicus
ggcctgtgccagcaatggtcatgca

SEQ ID NO: 441861 - DNA, 25 bp, Rattus norvegicus
ggcctgtgccaggaatggtcatgca

SEQ ID NO: 441862 - DNA, 25 bp, Rattus norvegicus
ggcctgtgccatcttggacatggaa

SEQ ID NO: 441863 - DNA, 25 bp, Rattus norvegicus
ggcctgtgccatgttggacatggaa

SEQ ID NO: 441864 - DNA, 25 bp, Rattus norvegicus
ggcctgtgctatctcgggaaccaaa

SEQ ID NO: 441865 - DNA, 25 bp, Rattus norvegicus
ggcctgtgctatgtcgggaaccaaa

SEQ ID NO: 441866 - DNA, 25 bp, Rattus norvegicus
ggcctgtgctttaacggcagtgcct

SEQ ID NO: 441867 - DNA, 25 bp, Rattus norvegicus
ggcctgtgcttttacggcagtgcct

SEQ ID NO: 441868 - DNA, 25 bp, Rattus norvegicus
ggcctgtggatccttctagcatgct

SEQ ID NO: 441869 - DNA, 25 bp, Rattus norvegicus
ggcctgtggatcgttctagcatgct

SEQ ID NO: 441870 - DNA, 25 bp, Rattus norvegicus
ggcctgtgggtgatacagactccat

SEQ ID NO: 441871 - DNA, 25 bp, Rattus norvegicus
ggcctgtgggtgttacagactccat

SEQ ID NO: 441872 - DNA, 25 bp, Rattus norvegicus
ggcctgtggttactgttatccatgt

SEQ ID NO: 441873 - DNA, 25 bp, Rattus norvegicus
ggcctgtggttagtgttatccatgt

SEQ ID NO: 441874 - DNA, 25 bp, Rattus norvegicus
ggcctgtgtaacatactccttagga

SEQ ID NO: 441875 - DNA, 25 bp, Rattus norvegicus
ggcctgtgtaacttactccttagga

SEQ ID NO: 441876 - DNA, 25 bp, Rattus norvegicus
ggcctgtgtaccaacctacaatgaa

SEQ ID NO: 441877 - DNA, 25 bp, Rattus norvegicus
ggcctgtgtacctacctacaatgaa

SEQ ID NO: 441878 - DNA, 25 bp, Rattus norvegicus
ggcctgtgtctccagactgaggacc

SEQ ID NO: 441879 - DNA, 25 bp, Rattus norvegicus
ggcctgtgtctcgagactgaggacc

SEQ ID NO: 441880 - DNA, 25 bp, Rattus norvegicus
ggcctgttaatgctgaatttccttt

SEQ ID NO: 441881 - DNA, 25 bp, Rattus norvegicus
ggcctgttaatggtgaatttccttt

SEQ ID NO: 441882 - DNA, 25 bp, Rattus norvegicus
ggcctgttcttgaagtcagtgctgt

SEQ ID NO: 441883 - DNA, 25 bp, Rattus norvegicus
ggcctgttcttgtagtcagtgctgt

SEQ ID NO: 441884 - DNA, 25 bp, Rattus norvegicus
ggcctgttgatgagctgttcttgag

SEQ ID NO: 441885 - DNA, 25 bp, Rattus norvegicus
ggcctgttgatgtgctgttcttgag

SEQ ID NO: 441886 - DNA, 25 bp, Rattus norvegicus
ggcctgttgccaagggtttaatcta

SEQ ID NO: 441887 - DNA, 25 bp, Rattus norvegicus
ggcctgttgccatgggtttaatcta

SEQ ID NO: 441888 - DNA, 25 bp, Rattus norvegicus
ggcctgttgcccaggttgtcgacat

SEQ ID NO: 441889 - DNA, 25 bp, Rattus norvegicus
ggcctgttgccctggttgtcgacat

SEQ ID NO: 441890 - DNA, 25 bp, Rattus norvegicus
ggcctgtttgatctctgtgttctag

SEQ ID NO: 441891 - DNA, 25 bp, Rattus norvegicus
ggcctgtttgatgtctgtgttctag

SEQ ID NO: 441892 - DNA, 25 bp, Rattus norvegicus
ggcctgtttgtcatcagactcagca

SEQ ID NO: 441893 - DNA, 25 bp, Rattus norvegicus
ggcctgtttgtcttcagactcagca

SEQ ID NO: 441894 - DNA, 25 bp, Rattus norvegicus
ggcctgttttacaggtggctgttat

SEQ ID NO: 441895 - DNA, 25 bp, Rattus norvegicus
ggcctgttttactggtggctgttat

SEQ ID NO: 441896 - DNA, 25 bp, Rattus norvegicus
ggccttaaatctcccattatgttct

SEQ ID NO: 441897 - DNA, 25 bp, Rattus norvegicus
ggccttaaatctgccattatgttct

SEQ ID NO: 441898 - DNA, 25 bp, Rattus norvegicus
ggccttaacaaaagctgaccctgag

SEQ ID NO: 441899 - DNA, 25 bp, Rattus norvegicus
ggccttaacaaatgctgaccctgag

SEQ ID NO: 441900 - DNA, 25 bp, Rattus norvegicus
ggccttaaccctctgaggaagtgta

SEQ ID NO: 441901 - DNA, 25 bp, Rattus norvegicus
ggccttaaccctgtgaggaagtgta

SEQ ID NO: 441902 - DNA, 25 bp, Rattus norvegicus
ggccttaatcgcacctggagatacg

SEQ ID NO: 441903 - DNA, 25 bp, Rattus norvegicus
ggccttaatcgctcctggagatacg

SEQ ID NO: 441904 - DNA, 25 bp, Rattus norvegicus
ggccttacagggagtattttccaag

SEQ ID NO: 441905 - DNA, 25 bp, Rattus norvegicus
ggccttacagggtgtattttccaag

SEQ ID NO: 441906 - DNA, 25 bp, Rattus norvegicus
ggccttacagtccaacttttttctg

SEQ ID NO: 441907 - DNA, 25 bp, Rattus norvegicus
ggccttacagtcgaacttttttctg

SEQ ID NO: 441908 - DNA, 25 bp, Rattus norvegicus
ggccttaccctgcactaaacataag

SEQ ID NO: 441909 - DNA, 25 bp, Rattus norvegicus
ggccttaccctggactaaacataag

SEQ ID NO: 441910 - DNA, 25 bp, Rattus norvegicus
ggccttacctgcagtttaaccaaag

SEQ ID NO: 441911 - DNA, 25 bp, Rattus norvegicus
ggccttacctgcctatttttggagg

SEQ ID NO: 441912 - DNA, 25 bp, Rattus norvegicus
ggccttacctgcgtatttttggagg

SEQ ID NO: 441913 - DNA, 25 bp, Rattus norvegicus
ggccttacctgctgtttaaccaaag

SEQ ID NO: 441914 - DNA, 25 bp, Rattus norvegicus
ggccttactcagaggatctcagtac

SEQ ID NO: 441915 - DNA, 25 bp, Rattus norvegicus
ggccttactcagtggatctcagtac

SEQ ID NO: 441916 - DNA, 25 bp, Rattus norvegicus
ggccttactctgatgttgtttggat

SEQ ID NO: 441917 - DNA, 25 bp, Rattus norvegicus
ggccttactctgttgttgtttggat

SEQ ID NO: 441918 - DNA, 25 bp, Rattus norvegicus
ggccttactttaccatggttaccat

SEQ ID NO: 441919 - DNA, 25 bp, Rattus norvegicus
ggccttactttagcatggttaccat

SEQ ID NO: 441920 - DNA, 25 bp, Rattus norvegicus
ggccttagatgactccctgtttaga

SEQ ID NO: 441921 - DNA, 25 bp, Rattus norvegicus
ggccttagatgagtccctgtttaga

SEQ ID NO: 441922 - DNA, 25 bp, Rattus norvegicus
ggccttagcatacttacttttccta

SEQ ID NO: 441923 - DNA, 25 bp, Rattus norvegicus
ggccttagcatagttacttttccta

SEQ ID NO: 441924 - DNA, 25 bp, Rattus norvegicus
ggccttagcgataattttcattctg

SEQ ID NO: 441925 - DNA, 25 bp, Rattus norvegicus
ggccttagcgattattttcattctg

SEQ ID NO: 441926 - DNA, 25 bp, Rattus norvegicus
ggccttaggcccagctcaagagaag

SEQ ID NO: 441927 - DNA, 25 bp, Rattus norvegicus
ggccttaggccctgctcaagagaag

SEQ ID NO: 441928 - DNA, 25 bp, Rattus norvegicus
ggccttaggctacctgtctgtagga

SEQ ID NO: 441929 - DNA, 25 bp, Rattus norvegicus
ggccttaggctagctgtctgtagga

SEQ ID NO: 441930 - DNA, 25 bp, Rattus norvegicus
ggccttagtataagctatgctcaga

SEQ ID NO: 441931 - DNA, 25 bp, Rattus norvegicus
ggccttagtatatgctatgctcaga

SEQ ID NO: 441932 - DNA, 25 bp, Rattus norvegicus
ggccttagtctcaatacatctgcaa

SEQ ID NO: 441933 - DNA, 25 bp, Rattus norvegicus
ggccttagtctctatacatctgcaa

SEQ ID NO: 441934 - DNA, 25 bp, Rattus norvegicus
ggccttatatacatgggtatttgtt

SEQ ID NO: 441935 - DNA, 25 bp, Rattus norvegicus
ggccttatatacttgggtatttgtt

SEQ ID NO: 441936 - DNA, 25 bp, Rattus norvegicus
ggccttatgtccagaagctatcaga

SEQ ID NO: 441937 - DNA, 25 bp, Rattus norvegicus
ggccttatgtcctgaagctatcaga

SEQ ID NO: 441938 - DNA, 25 bp, Rattus norvegicus
ggccttatgtgcatagtatccagaa

SEQ ID NO: 441939 - DNA, 25 bp, Rattus norvegicus
ggccttatgtgcttagtatccagaa

SEQ ID NO: 441940 - DNA, 25 bp, Rattus norvegicus
ggccttatgtggaggacctctccaa

SEQ ID NO: 441941 - DNA, 25 bp, Rattus norvegicus
ggccttatgtggtggacctctccaa

SEQ ID NO: 441942 - DNA, 25 bp, Rattus norvegicus
ggccttattaccaaggaatcgctcg

SEQ ID NO: 441943 - DNA, 25 bp, Rattus norvegicus
ggccttattacctaggaatcgctcg

SEQ ID NO: 441944 - DNA, 25 bp, Rattus norvegicus
ggccttattgtcacttctatcaaca

SEQ ID NO: 441945 - DNA, 25 bp, Rattus norvegicus
ggccttattgtctcttctatcaaca

SEQ ID NO: 441946 - DNA, 25 bp, Rattus norvegicus
ggccttatttctaacggactcgaca

SEQ ID NO: 441947 - DNA, 25 bp, Rattus norvegicus
ggccttatttcttacggactcgaca

SEQ ID NO: 441948 - DNA, 25 bp, Rattus norvegicus
ggccttcaaaaacctgctatattca

SEQ ID NO: 441949 - DNA, 25 bp, Rattus norvegicus
ggccttcaaaaagctgctatattca

SEQ ID NO: 441950 - DNA, 25 bp, Rattus norvegicus
ggccttcaaatgactttccttggga

SEQ ID NO: 441951 - DNA, 25 bp, Rattus norvegicus
ggccttcaaatgtctttccttggga

SEQ ID NO: 441952 - DNA, 25 bp, Rattus norvegicus
ggccttcaagagaccacttttttct

SEQ ID NO: 441953 - DNA, 25 bp, Rattus norvegicus
ggccttcaagagtccacttttttct

SEQ ID NO: 441954 - DNA, 25 bp, Rattus norvegicus
ggccttcaagcactgctactcataa

SEQ ID NO: 441955 - DNA, 25 bp, Rattus norvegicus
ggccttcaagcagtgctactcataa

SEQ ID NO: 441956 - DNA, 25 bp, Rattus norvegicus
ggccttcaagttaagcctctaagca

SEQ ID NO: 441957 - DNA, 25 bp, Rattus norvegicus
ggccttcaagtttagcctctaagca

SEQ ID NO: 441958 - DNA, 25 bp, Rattus norvegicus
ggccttcaccggcaaatacgaattt

SEQ ID NO: 441959 - DNA, 25 bp, Rattus norvegicus
ggccttcaccgggaaatacgaattt

SEQ ID NO: 441960 - DNA, 25 bp, Rattus norvegicus
ggccttcagtccaaaagatcgtctc

SEQ ID NO: 441961 - DNA, 25 bp, Rattus norvegicus
ggccttcagtccattttgtattagt

SEQ ID NO: 441962 - DNA, 25 bp, Rattus norvegicus
ggccttcagtcctaaagatcgtctc

SEQ ID NO: 441963 - DNA, 25 bp, Rattus norvegicus
ggccttcagtcctttttgtattagt

SEQ ID NO: 441964 - DNA, 25 bp, Rattus norvegicus
ggccttcatagtctccggcgaaaag

SEQ ID NO: 441965 - DNA, 25 bp, Rattus norvegicus
ggccttcatagtgtccggcgaaaag

SEQ ID NO: 441966 - DNA, 25 bp, Rattus norvegicus
ggccttccagttcactgacaaacat

SEQ ID NO: 441967 - DNA, 25 bp, Rattus norvegicus
ggccttccagttgactgacaaacat

SEQ ID NO: 441968 - DNA, 25 bp, Rattus norvegicus
ggccttcccaaactcagattgcaga

SEQ ID NO: 441969 - DNA, 25 bp, Rattus norvegicus
ggccttcccaaagtcagattgcaga

SEQ ID NO: 441970 - DNA, 25 bp, Rattus norvegicus
ggccttccctgccaagctggagagt

SEQ ID NO: 441971 - DNA, 25 bp, Rattus norvegicus
ggccttccctgcgaagctggagagt

SEQ ID NO: 441972 - DNA, 25 bp, Rattus norvegicus
ggccttccgcaaccactgactggga

SEQ ID NO: 441973 - DNA, 25 bp, Rattus norvegicus
ggccttccgcaagcactgactggga

SEQ ID NO: 441974 - DNA, 25 bp, Rattus norvegicus
ggccttcctctgattcagctatgga

SEQ ID NO: 441975 - DNA, 25 bp, Rattus norvegicus
ggccttcctctgtttcagctatgga

SEQ ID NO: 441976 - DNA, 25 bp, Rattus norvegicus
ggccttcctgaaactgtgctggtgc

SEQ ID NO: 441977 - DNA, 25 bp, Rattus norvegicus
ggccttcctgaatctgtgctggtgc

SEQ ID NO: 441978 - DNA, 25 bp, Rattus norvegicus
ggccttcctggaagcactgcaggga

SEQ ID NO: 441979 - DNA, 25 bp, Rattus norvegicus
ggccttcctggatgcactgcaggga

SEQ ID NO: 441980 - DNA, 25 bp, Rattus norvegicus
ggccttcgagaaaatcccagctaag

SEQ ID NO: 441981 - DNA, 25 bp, Rattus norvegicus
ggccttcgagaatatcccagctaag

SEQ ID NO: 441982 - DNA, 25 bp, Rattus norvegicus
ggccttcgctgaaaatattcccatc

SEQ ID NO: 441983 - DNA, 25 bp, Rattus norvegicus
ggccttcgctgataatattcccatc

SEQ ID NO: 441984 - DNA, 25 bp, Rattus norvegicus
ggccttcggaaactgtcctgtgtgt

SEQ ID NO: 441985 - DNA, 25 bp, Rattus norvegicus
ggccttcggaaagtgtcctgtgtgt

SEQ ID NO: 441986 - DNA, 25 bp, Rattus norvegicus
ggccttcggtttcgctctgagtgaa

SEQ ID NO: 441987 - DNA, 25 bp, Rattus norvegicus
ggccttcggtttggctctgagtgaa

SEQ ID NO: 441988 - DNA, 25 bp, Rattus norvegicus
ggccttctaaagcaaacttacccat

SEQ ID NO: 441989 - DNA, 25 bp, Rattus norvegicus
ggccttctaaaggaaacttacccat

SEQ ID NO: 441990 - DNA, 25 bp, Rattus norvegicus
ggccttctacatcatagtcccatag

SEQ ID NO: 441991 - DNA, 25 bp, Rattus norvegicus
ggccttctacatgatagtcccatag

SEQ ID NO: 441992 - DNA, 25 bp, Rattus norvegicus
ggccttctactgagctttgcatcag

SEQ ID NO: 441993 - DNA, 25 bp, Rattus norvegicus
ggccttctactgtgctttgcatcag

SEQ ID NO: 441994 - DNA, 25 bp, Rattus norvegicus
ggccttctagaactgcacgatgact

SEQ ID NO: 441995 - DNA, 25 bp, Rattus norvegicus
ggccttctagaagtgcacgatgact

SEQ ID NO: 441996 - DNA, 25 bp, Rattus norvegicus
ggccttctcagacagcaggtgcaca

SEQ ID NO: 441997 - DNA, 25 bp, Rattus norvegicus
ggccttctcagacccgtgagtgagt

SEQ ID NO: 441998 - DNA, 25 bp, Rattus norvegicus
ggccttctcagagagcaggtgcaca

SEQ ID NO: 441999 - DNA, 25 bp, Rattus norvegicus
ggccttctcagagccgtgagtgagt

SEQ ID NO: 442000 - DNA, 25 bp, Rattus norvegicus
ggccttctcagtcagatttctaata

SEQ ID NO: 442001 - DNA, 25 bp, Rattus norvegicus
ggccttctcagtgagatttctaata

SEQ ID NO: 442002 - DNA, 25 bp, Rattus norvegicus
ggccttctctaaactacatgacttc

SEQ ID NO: 442003 - DNA, 25 bp, Rattus norvegicus
ggccttctctaatctacatgacttc

SEQ ID NO: 442004 - DNA, 25 bp, Rattus norvegicus
ggccttctcttacctataatacatg

SEQ ID NO: 442005 - DNA, 25 bp, Rattus norvegicus
ggccttctcttagctataatacatg

SEQ ID NO: 442006 - DNA, 25 bp, Rattus norvegicus
ggccttctgcagctttttggagtaa

SEQ ID NO: 442007 - DNA, 25 bp, Rattus norvegicus
ggccttctgcaggtttttggagtaa

SEQ ID NO: 442008 - DNA, 25 bp, Rattus norvegicus
ggccttctgggcatcttcaacaaga

SEQ ID NO: 442009 - DNA, 25 bp, Rattus norvegicus
ggccttctgggcttcttcaacaaga

SEQ ID NO: 442010 - DNA, 25 bp, Rattus norvegicus
ggccttctgtttagaatatgcacga

SEQ ID NO: 442011 - DNA, 25 bp, Rattus norvegicus
ggccttctgttttgaatatgcacga

SEQ ID NO: 442012 - DNA, 25 bp, Rattus norvegicus
ggccttcttagtagcctgcaataag

SEQ ID NO: 442013 - DNA, 25 bp, Rattus norvegicus
ggccttcttagtctgatgtggtcaa

SEQ ID NO: 442014 - DNA, 25 bp, Rattus norvegicus
ggccttcttagtgtgatgtggtcaa

SEQ ID NO: 442015 - DNA, 25 bp, Rattus norvegicus
ggccttcttagttgcctgcaataag

SEQ ID NO: 442016 - DNA, 25 bp, Rattus norvegicus
ggccttcttattacctgtagacttt

SEQ ID NO: 442017 - DNA, 25 bp, Rattus norvegicus
ggccttcttatttcctgtagacttt

SEQ ID NO: 442018 - DNA, 25 bp, Rattus norvegicus
ggccttcttcaccaacaggtatgtg

SEQ ID NO: 442019 - DNA, 25 bp, Rattus norvegicus
ggccttcttcacgaacaggtatgtg

SEQ ID NO: 442020 - DNA, 25 bp, Rattus norvegicus
ggccttcttgcaaccttcaaaattg

SEQ ID NO: 442021 - DNA, 25 bp, Rattus norvegicus
ggccttcttgcatccttcaaaattg

SEQ ID NO: 442022 - DNA, 25 bp, Rattus norvegicus
ggccttctttttccgtgcagcaccg

SEQ ID NO: 442023 - DNA, 25 bp, Rattus norvegicus
ggccttctttttgcgtgcagcaccg

SEQ ID NO: 442024 - DNA, 25 bp, Rattus norvegicus
ggccttgaactacaggtcctcctga

SEQ ID NO: 442025 - DNA, 25 bp, Rattus norvegicus
ggccttgaactagaggtcctcctga

SEQ ID NO: 442026 - DNA, 25 bp, Rattus norvegicus
ggccttgaacttaatcctcttactt

SEQ ID NO: 442027 - DNA, 25 bp, Rattus norvegicus
ggccttgaacttcatctgtagcgca

SEQ ID NO: 442028 - DNA, 25 bp, Rattus norvegicus
ggccttgaacttgatctgtagcgca

SEQ ID NO: 442029 - DNA, 25 bp, Rattus norvegicus
ggccttgaactttatcctcttactt

SEQ ID NO: 442030 - DNA, 25 bp, Rattus norvegicus
ggccttgaatggattgtttttcctc

SEQ ID NO: 442031 - DNA, 25 bp, Rattus norvegicus
ggccttgaatggtttgtttttcctc

SEQ ID NO: 442032 - DNA, 25 bp, Rattus norvegicus
ggccttgacaaaccacatggctgtc

SEQ ID NO: 442033 - DNA, 25 bp, Rattus norvegicus
ggccttgacaaagcacatggctgtc

SEQ ID NO: 442034 - DNA, 25 bp, Rattus norvegicus
ggccttgacctccaaccaggagtat

SEQ ID NO: 442035 - DNA, 25 bp, Rattus norvegicus
ggccttgacctcgaaccaggagtat

SEQ ID NO: 442036 - DNA, 25 bp, Rattus norvegicus
ggccttgagaacatagtcacggctg

SEQ ID NO: 442037 - DNA, 25 bp, Rattus norvegicus
ggccttgagaacttagtcacggctg

SEQ ID NO: 442038 - DNA, 25 bp, Rattus norvegicus
ggccttgagctgacaagagatcctc

SEQ ID NO: 442039 - DNA, 25 bp, Rattus norvegicus
ggccttgagctgtcaagagatcctc

SEQ ID NO: 442040 - DNA, 25 bp, Rattus norvegicus
ggccttgagtccaggattcagagtt

SEQ ID NO: 442041 - DNA, 25 bp, Rattus norvegicus
ggccttgagtcctggattcagagtt

SEQ ID NO: 442042 - DNA, 25 bp, Rattus norvegicus
ggccttgataaccagcttagccctg

SEQ ID NO: 442043 - DNA, 25 bp, Rattus norvegicus
ggccttgataacgagcttagccctg

SEQ ID NO: 442044 - DNA, 25 bp, Rattus norvegicus
ggccttgatcttaggctactggaga

SEQ ID NO: 442045 - DNA, 25 bp, Rattus norvegicus
ggccttgatctttggctactggaga

SEQ ID NO: 442046 - DNA, 25 bp, Rattus norvegicus
ggccttgatggcaattttcagctga

SEQ ID NO: 442047 - DNA, 25 bp, Rattus norvegicus
ggccttgatggctattttcagctga

SEQ ID NO: 442048 - DNA, 25 bp, Rattus norvegicus
ggccttgattagcaaagcccttgca

SEQ ID NO: 442049 - DNA, 25 bp, Rattus norvegicus
ggccttgattaggaaagcccttgca

SEQ ID NO: 442050 - DNA, 25 bp, Rattus norvegicus
ggccttgattggcagttgtgcctca

SEQ ID NO: 442051 - DNA, 25 bp, Rattus norvegicus
ggccttgattgggagttgtgcctca

SEQ ID NO: 442052 - DNA, 25 bp, Rattus norvegicus
ggccttgcacaaactgtaaacaatg

SEQ ID NO: 442053 - DNA, 25 bp, Rattus norvegicus
ggccttgcacaatctgtaaacaatg

SEQ ID NO: 442054 - DNA, 25 bp, Rattus norvegicus
ggccttgcaggccaccagcaatgtc

SEQ ID NO: 442055 - DNA, 25 bp, Rattus norvegicus
ggccttgcaggcgaccagcaatgtc

SEQ ID NO: 442056 - DNA, 25 bp, Rattus norvegicus
ggccttgcagtaaggctttgccaat

SEQ ID NO: 442057 - DNA, 25 bp, Rattus norvegicus
ggccttgcagtatggctttgccaat

SEQ ID NO: 442058 - DNA, 25 bp, Rattus norvegicus
ggccttgcatggcatcactgccaat

SEQ ID NO: 442059 - DNA, 25 bp, Rattus norvegicus
ggccttgcatgggatcactgccaat

SEQ ID NO: 442060 - DNA, 25 bp, Rattus norvegicus
ggccttgccagtatggagctgtttt

SEQ ID NO: 442061 - DNA, 25 bp, Rattus norvegicus
ggccttgccagtttggagctgtttt

SEQ ID NO: 442062 - DNA, 25 bp, Rattus norvegicus
ggccttgccgatccctcagatgagg

SEQ ID NO: 442063 - DNA, 25 bp, Rattus norvegicus
ggccttgccgatgcctcagatgagg

SEQ ID NO: 442064 - DNA, 25 bp, Rattus norvegicus
ggccttgctcttctagcccttggct

SEQ ID NO: 442065 - DNA, 25 bp, Rattus norvegicus
ggccttgctcttgtagcccttggct

SEQ ID NO: 442066 - DNA, 25 bp, Rattus norvegicus
ggccttgctgagagttgctagtgac

SEQ ID NO: 442067 - DNA, 25 bp, Rattus norvegicus
ggccttgctgagtgttgctagtgac

SEQ ID NO: 442068 - DNA, 25 bp, Rattus norvegicus
ggccttgcttgaccactttatctag

SEQ ID NO: 442069 - DNA, 25 bp, Rattus norvegicus
ggccttgcttgagcactttatctag

SEQ ID NO: 442070 - DNA, 25 bp, Rattus norvegicus
ggccttggaagaaatgcctcaactt

SEQ ID NO: 442071 - DNA, 25 bp, Rattus norvegicus
ggccttggaagatatgcctcaactt

SEQ ID NO: 442072 - DNA, 25 bp, Rattus norvegicus
ggccttggacacactctattactga

SEQ ID NO: 442073 - DNA, 25 bp, Rattus norvegicus
ggccttggacactctctattactga

SEQ ID NO: 442074 - DNA, 25 bp, Rattus norvegicus
ggccttggactcaccgaagagttat

SEQ ID NO: 442075 - DNA, 25 bp, Rattus norvegicus
ggccttggactctccgaagagttat

SEQ ID NO: 442076 - DNA, 25 bp, Rattus norvegicus
ggccttggaggaaaacccagccagg

SEQ ID NO: 442077 - DNA, 25 bp, Rattus norvegicus
ggccttggaggataacccagccagg

SEQ ID NO: 442078 - DNA, 25 bp, Rattus norvegicus
ggccttggatatcccctttgttaat

SEQ ID NO: 442079 - DNA, 25 bp, Rattus norvegicus
ggccttggatatcgcgaagcgcaca

SEQ ID NO: 442080 - DNA, 25 bp, Rattus norvegicus
ggccttggatatgccctttgttaat

SEQ ID NO: 442081 - DNA, 25 bp, Rattus norvegicus
ggccttggatatggcgaagcgcaca

SEQ ID NO: 442082 - DNA, 25 bp, Rattus norvegicus
ggccttggatcgacacatcattcag

SEQ ID NO: 442083 - DNA, 25 bp, Rattus norvegicus
ggccttggatcgtcacatcattcag

SEQ ID NO: 442084 - DNA, 25 bp, Rattus norvegicus
ggccttggcccacatagactagagt

SEQ ID NO: 442085 - DNA, 25 bp, Rattus norvegicus
ggccttggcccagatagactagagt

SEQ ID NO: 442086 - DNA, 25 bp, Rattus norvegicus
ggccttgggaacaagagactgtgaa

SEQ ID NO: 442087 - DNA, 25 bp, Rattus norvegicus
ggccttgggaactagagactgtgaa

SEQ ID NO: 442088 - DNA, 25 bp, Rattus norvegicus
ggccttgggacaactgatcttgggt

SEQ ID NO: 442089 - DNA, 25 bp, Rattus norvegicus
ggccttgggacatctgatcttgggt

SEQ ID NO: 442090 - DNA, 25 bp, Rattus norvegicus
ggccttgggccactcagttaataga

SEQ ID NO: 442091 - DNA, 25 bp, Rattus norvegicus
ggccttgggccagtcagttaataga

SEQ ID NO: 442092 - DNA, 25 bp, Rattus norvegicus
ggccttggtaggagctaaccagact

SEQ ID NO: 442093 - DNA, 25 bp, Rattus norvegicus
ggccttggtaggtgctaaccagact

SEQ ID NO: 442094 - DNA, 25 bp, Rattus norvegicus
ggccttggtgtacagcgacttctca

SEQ ID NO: 442095 - DNA, 25 bp, Rattus norvegicus
ggccttggtgtagagcgacttctca

SEQ ID NO: 442096 - DNA, 25 bp, Rattus norvegicus
ggccttgtagtgcacttgagtcctg

SEQ ID NO: 442097 - DNA, 25 bp, Rattus norvegicus
ggccttgtagtggacttgagtcctg

SEQ ID NO: 442098 - DNA, 25 bp, Rattus norvegicus
ggccttgtatgtctctgctcacaga

SEQ ID NO: 442099 - DNA, 25 bp, Rattus norvegicus
ggccttgtatgtgtctgctcacaga

SEQ ID NO: 442100 - DNA, 25 bp, Rattus norvegicus
ggccttgtctttatgagttatgtca

SEQ ID NO: 442101 - DNA, 25 bp, Rattus norvegicus
ggccttgtctttttgagttatgtca

SEQ ID NO: 442102 - DNA, 25 bp, Rattus norvegicus
ggccttgtgcacacagatctggaac

SEQ ID NO: 442103 - DNA, 25 bp, Rattus norvegicus
ggccttgtgcactcagatctggaac

SEQ ID NO: 442104 - DNA, 25 bp, Rattus norvegicus
ggccttgtgcgaagctgagatgtac

SEQ ID NO: 442105 - DNA, 25 bp, Rattus norvegicus
ggccttgtgcgatgctgagatgtac

SEQ ID NO: 442106 - DNA, 25 bp, Rattus norvegicus
ggccttgtgtaactgtatttctccc

SEQ ID NO: 442107 - DNA, 25 bp, Rattus norvegicus
ggccttgtgtaagtgtatttctccc

SEQ ID NO: 442108 - DNA, 25 bp, Rattus norvegicus
ggccttgtgtggcaaagcattactc

SEQ ID NO: 442109 - DNA, 25 bp, Rattus norvegicus
ggccttgtgtgggaaagcattactc

SEQ ID NO: 442110 - DNA, 25 bp, Rattus norvegicus
ggccttgtgtttatctgcatgagca

SEQ ID NO: 442111 - DNA, 25 bp, Rattus norvegicus
ggccttgtgtttttctgcatgagca

SEQ ID NO: 442112 - DNA, 25 bp, Rattus norvegicus
ggccttgttgaacgcacatgctgag

SEQ ID NO: 442113 - DNA, 25 bp, Rattus norvegicus
ggccttgttgaaggcacatgctgag

SEQ ID NO: 442114 - DNA, 25 bp, Rattus norvegicus
ggcctttaatatccactgtatccac

SEQ ID NO: 442115 - DNA, 25 bp, Rattus norvegicus
ggcctttaatatgcactgtatccac

SEQ ID NO: 442116 - DNA, 25 bp, Rattus norvegicus
ggcctttacaccacgaactgattaa

SEQ ID NO: 442117 - DNA, 25 bp, Rattus norvegicus
ggcctttacacctcgaactgattaa

SEQ ID NO: 442118 - DNA, 25 bp, Rattus norvegicus
ggcctttactcgattgtaacaactg

SEQ ID NO: 442119 - DNA, 25 bp, Rattus norvegicus
ggcctttactcgtttgtaacaactg

SEQ ID NO: 442120 - DNA, 25 bp, Rattus norvegicus
ggcctttatattatactaccaggga

SEQ ID NO: 442121 - DNA, 25 bp, Rattus norvegicus
ggcctttatattttactaccaggga

SEQ ID NO: 442122 - DNA, 25 bp, Rattus norvegicus
ggcctttcaaagctgtagatcagga

SEQ ID NO: 442123 - DNA, 25 bp, Rattus norvegicus
ggcctttcaaaggtgtagatcagga

SEQ ID NO: 442124 - DNA, 25 bp, Rattus norvegicus
ggcctttcaacgctactgcagattt

SEQ ID NO: 442125 - DNA, 25 bp, Rattus norvegicus
ggcctttcaacggtactgcagattt

SEQ ID NO: 442126 - DNA, 25 bp, Rattus norvegicus
ggcctttcagtgattttggatttct

SEQ ID NO: 442127 - DNA, 25 bp, Rattus norvegicus
ggcctttcagtgtttttggatttct

SEQ ID NO: 442128 - DNA, 25 bp, Rattus norvegicus
ggcctttcatatccacatttgctaa

SEQ ID NO: 442129 - DNA, 25 bp, Rattus norvegicus
ggcctttcatatgcacatttgctaa

SEQ ID NO: 442130 - DNA, 25 bp, Rattus norvegicus
ggcctttccactagtctgatgcaat

SEQ ID NO: 442131 - DNA, 25 bp, Rattus norvegicus
ggcctttccacttgtctgatgcaat

SEQ ID NO: 442132 - DNA, 25 bp, Rattus norvegicus
ggcctttcctctctcttaattatta

SEQ ID NO: 442133 - DNA, 25 bp, Rattus norvegicus
ggcctttcctctgtcttaattatta

SEQ ID NO: 442134 - DNA, 25 bp, Rattus norvegicus
ggcctttcgatcacatgtctcaaat

SEQ ID NO: 442135 - DNA, 25 bp, Rattus norvegicus
ggcctttcgatctcatgtctcaaat

SEQ ID NO: 442136 - DNA, 25 bp, Rattus norvegicus
ggcctttctcaaccaaagttctttg

SEQ ID NO: 442137 - DNA, 25 bp, Rattus norvegicus
ggcctttctcaagcaaagttctttg

SEQ ID NO: 442138 - DNA, 25 bp, Rattus norvegicus
ggcctttctggcagagagccttgta

SEQ ID NO: 442139 - DNA, 25 bp, Rattus norvegicus
ggcctttctggctgagagccttgta

SEQ ID NO: 442140 - DNA, 25 bp, Rattus norvegicus
ggcctttctgttatattacggacat

SEQ ID NO: 442141 - DNA, 25 bp, Rattus norvegicus
ggcctttctgttttattacggacat

SEQ ID NO: 442142 - DNA, 25 bp, Rattus norvegicus
ggcctttgaaccagtgagcgtttta

SEQ ID NO: 442143 - DNA, 25 bp, Rattus norvegicus
ggcctttgaacctgtgagcgtttta

SEQ ID NO: 442144 - DNA, 25 bp, Rattus norvegicus
ggcctttgaggaccctgacaaccag

SEQ ID NO: 442145 - DNA, 25 bp, Rattus norvegicus
ggcctttgaggagcctgacaaccag

SEQ ID NO: 442146 - DNA, 25 bp, Rattus norvegicus
ggcctttgagtacatggacccacct

SEQ ID NO: 442147 - DNA, 25 bp, Rattus norvegicus
ggcctttgagtagatggacccacct

SEQ ID NO: 442148 - DNA, 25 bp, Rattus norvegicus
ggcctttgatctcaggactgctgta

SEQ ID NO: 442149 - DNA, 25 bp, Rattus norvegicus
ggcctttgatctgaggactgctgta

SEQ ID NO: 442150 - DNA, 25 bp, Rattus norvegicus
ggcctttgcagtcggatagttcaga

SEQ ID NO: 442151 - DNA, 25 bp, Rattus norvegicus
ggcctttgcagtgggatagttcaga

SEQ ID NO: 442152 - DNA, 25 bp, Rattus norvegicus
ggcctttgcatgacaaagtaatctt

SEQ ID NO: 442153 - DNA, 25 bp, Rattus norvegicus
ggcctttgcatgtcaaagtaatctt

SEQ ID NO: 442154 - DNA, 25 bp, Rattus norvegicus
ggcctttgccggaggtgtctcacaa

SEQ ID NO: 442155 - DNA, 25 bp, Rattus norvegicus
ggcctttgccggtggtgtctcacaa

SEQ ID NO: 442156 - DNA, 25 bp, Rattus norvegicus
ggcctttgcctacacggtcaaatac

SEQ ID NO: 442157 - DNA, 25 bp, Rattus norvegicus
ggcctttgcctagacggtcaaatac

SEQ ID NO: 442158 - DNA, 25 bp, Rattus norvegicus
ggcctttgcttgatgttatcaactc

SEQ ID NO: 442159 - DNA, 25 bp, Rattus norvegicus
ggcctttgcttgttgttatcaactc

SEQ ID NO: 442160 - DNA, 25 bp, Rattus norvegicus
ggcctttggcggaaatgatgacatc

SEQ ID NO: 442161 - DNA, 25 bp, Rattus norvegicus
ggcctttggcggtaatgatgacatc

SEQ ID NO: 442162 - DNA, 25 bp, Rattus norvegicus
ggcctttgggttaccggatgacctg

SEQ ID NO: 442163 - DNA, 25 bp, Rattus norvegicus
ggcctttgggtttccggatgacctg

SEQ ID NO: 442164 - DNA, 25 bp, Rattus norvegicus
ggcctttgtagcaacttggctgcaa

SEQ ID NO: 442165 - DNA, 25 bp, Rattus norvegicus
ggcctttgtagctacttggctgcaa

SEQ ID NO: 442166 - DNA, 25 bp, Rattus norvegicus
ggcctttgttctatctcagcaggaa

SEQ ID NO: 442167 - DNA, 25 bp, Rattus norvegicus
ggcctttgttctttctcagcaggaa

SEQ ID NO: 442168 - DNA, 25 bp, Rattus norvegicus
ggccttttagttaccttatgagatg

SEQ ID NO: 442169 - DNA, 25 bp, Rattus norvegicus
ggccttttagtttccttatgagatg

SEQ ID NO: 442170 - DNA, 25 bp, Rattus norvegicus
ggccttttcaggaaacatggttcac

SEQ ID NO: 442171 - DNA, 25 bp, Rattus norvegicus
ggccttttcaggtaacatggttcac

SEQ ID NO: 442172 - DNA, 25 bp, Rattus norvegicus
ggccttttctctacatttgtttcaa

SEQ ID NO: 442173 - DNA, 25 bp, Rattus norvegicus
ggccttttctcttcatttgtttcaa

SEQ ID NO: 442174 - DNA, 25 bp, Rattus norvegicus
ggccttttctgcatagaggacactg

SEQ ID NO: 442175 - DNA, 25 bp, Rattus norvegicus
ggccttttctgcattaagtgtagct

SEQ ID NO: 442176 - DNA, 25 bp, Rattus norvegicus
ggccttttctgcttagaggacactg

SEQ ID NO: 442177 - DNA, 25 bp, Rattus norvegicus
ggccttttctgctttaagtgtagct

SEQ ID NO: 442178 - DNA, 25 bp, Rattus norvegicus
ggccttttgcttcttatcacatgca

SEQ ID NO: 442179 - DNA, 25 bp, Rattus norvegicus
ggccttttgcttgttatcacatgca

SEQ ID NO: 442180 - DNA, 25 bp, Rattus norvegicus
ggcctttttggcatattcatttctc

SEQ ID NO: 442181 - DNA, 25 bp, Rattus norvegicus
ggcctttttggcttattcatttctc

SEQ ID NO: 442182 - DNA, 25 bp, Rattus norvegicus
ggcgaaaaccgacactgtatgcaat

SEQ ID NO: 442183 - DNA, 25 bp, Rattus norvegicus
ggcgaaaaccgagactgtatgcaat

SEQ ID NO: 442184 - DNA, 25 bp, Rattus norvegicus
ggcgaaaatttccatgtctcaaaga

SEQ ID NO: 442185 - DNA, 25 bp, Rattus norvegicus
ggcgaaaatttcgatgtctcaaaga

SEQ ID NO: 442186 - DNA, 25 bp, Rattus norvegicus
ggcgaaacagataccattgtggctt

SEQ ID NO: 442187 - DNA, 25 bp, Rattus norvegicus
ggcgaaacagattccattgtggctt

SEQ ID NO: 442188 - DNA, 25 bp, Rattus norvegicus
ggcgaaaccattactgcacagagat

SEQ ID NO: 442189 - DNA, 25 bp, Rattus norvegicus
ggcgaaaccatttctgcacagagat

SEQ ID NO: 442190 - DNA, 25 bp, Rattus norvegicus
ggcgaaaggtacactagacccactt

SEQ ID NO: 442191 - DNA, 25 bp, Rattus norvegicus
ggcgaaaggtactctagacccactt

SEQ ID NO: 442192 - DNA, 25 bp, Rattus norvegicus
ggcgaaagtggacgttcctgaccct

SEQ ID NO: 442193 - DNA, 25 bp, Rattus norvegicus
ggcgaaagtggaggttcctgaccct

SEQ ID NO: 442194 - DNA, 25 bp, Rattus norvegicus
ggcgaacataagcttcattcatcat

SEQ ID NO: 442195 - DNA, 25 bp, Rattus norvegicus
ggcgaacataaggttcattcatcat

SEQ ID NO: 442196 - DNA, 25 bp, Rattus norvegicus
ggcgaaccacagcagagcgtagtct

SEQ ID NO: 442197 - DNA, 25 bp, Rattus norvegicus
ggcgaaccacaggagagcgtagtct

SEQ ID NO: 442198 - DNA, 25 bp, Rattus norvegicus
ggcgaactatgccttcaagatctat

SEQ ID NO: 442199 - DNA, 25 bp, Rattus norvegicus
ggcgaactatgcgttcaagatctat

SEQ ID NO: 442200 - DNA, 25 bp, Rattus norvegicus
ggcgaactcaaccagtagcacatgc

SEQ ID NO: 442201 - DNA, 25 bp, Rattus norvegicus
ggcgaactcaacgagtagcacatgc

SEQ ID NO: 442202 - DNA, 25 bp, Rattus norvegicus
ggcgaactgagaatatgtgtcaaaa

SEQ ID NO: 442203 - DNA, 25 bp, Rattus norvegicus
ggcgaactgagattatgtgtcaaaa

SEQ ID NO: 442204 - DNA, 25 bp, Rattus norvegicus
ggcgaactttttcctcttaactcct

SEQ ID NO: 442205 - DNA, 25 bp, Rattus norvegicus
ggcgaactttttgctcttaactcct

SEQ ID NO: 442206 - DNA, 25 bp, Rattus norvegicus
ggcgaagatctccaagccttgatcg

SEQ ID NO: 442207 - DNA, 25 bp, Rattus norvegicus
ggcgaagatctcgaagccttgatcg

SEQ ID NO: 442208 - DNA, 25 bp, Rattus norvegicus
ggcgaagcagccactgacctaagct

SEQ ID NO: 442209 - DNA, 25 bp, Rattus norvegicus
ggcgaagcagcctctgacctaagct

SEQ ID NO: 442210 - DNA, 25 bp, Rattus norvegicus
ggcgaagccgctcccgcgagataaa

SEQ ID NO: 442211 - DNA, 25 bp, Rattus norvegicus
ggcgaagccgctgccgcgagataaa

SEQ ID NO: 442212 - DNA, 25 bp, Rattus norvegicus
ggcgaagcggcccagtatttataga

SEQ ID NO: 442213 - DNA, 25 bp, Rattus norvegicus
ggcgaagcggccgagtatttataga

SEQ ID NO: 442214 - DNA, 25 bp, Rattus norvegicus
ggcgaagctcgcagcacagaaacta

SEQ ID NO: 442215 - DNA, 25 bp, Rattus norvegicus
ggcgaagctcgctgcacagaaacta

SEQ ID NO: 442216 - DNA, 25 bp, Rattus norvegicus
ggcgaagctgagacacgaaacccaa

SEQ ID NO: 442217 - DNA, 25 bp, Rattus norvegicus
ggcgaagctgagtcacgaaacccaa

SEQ ID NO: 442218 - DNA, 25 bp, Rattus norvegicus
ggcgaaggagtccagtttgacccct

SEQ ID NO: 442219 - DNA, 25 bp, Rattus norvegicus
ggcgaaggagtcgagtttgacccct

SEQ ID NO: 442220 - DNA, 25 bp, Rattus norvegicus
ggcgaaggccatcttagaacctgac

SEQ ID NO: 442221 - DNA, 25 bp, Rattus norvegicus
ggcgaaggccatgttagaacctgac

SEQ ID NO: 442222 - DNA, 25 bp, Rattus norvegicus
ggcgaagtagctcttcaaggaccaa

SEQ ID NO: 442223 - DNA, 25 bp, Rattus norvegicus
ggcgaagtagctgttcaaggaccaa

SEQ ID NO: 442224 - DNA, 25 bp, Rattus norvegicus
ggcgaagtcaaacattgcgtcatca

SEQ ID NO: 442225 - DNA, 25 bp, Rattus norvegicus
ggcgaagtcaaagattgcgtcatca

SEQ ID NO: 442226 - DNA, 25 bp, Rattus norvegicus
ggcgaagtcatgagcactactggta

SEQ ID NO: 442227 - DNA, 25 bp, Rattus norvegicus
ggcgaagtcatgtgcactactggta

SEQ ID NO: 442228 - DNA, 25 bp, Rattus norvegicus
ggcgaagtctcacgagtacccagag

SEQ ID NO: 442229 - DNA, 25 bp, Rattus norvegicus
ggcgaagtctcaggagtacccagag

SEQ ID NO: 442230 - DNA, 25 bp, Rattus norvegicus
ggcgaatctactatagactctgaga

SEQ ID NO: 442231 - DNA, 25 bp, Rattus norvegicus
ggcgaatctactttagactctgaga

SEQ ID NO: 442232 - DNA, 25 bp, Rattus norvegicus
ggcgaatgcctcaccaatgaatgtc

SEQ ID NO: 442233 - DNA, 25 bp, Rattus norvegicus
ggcgaatgcctctccaatgaatgtc

SEQ ID NO: 442234 - DNA, 25 bp, Rattus norvegicus
ggcgaatgtatcatacctgtcttac

SEQ ID NO: 442235 - DNA, 25 bp, Rattus norvegicus
ggcgaatgtatcttacctgtcttac

SEQ ID NO: 442236 - DNA, 25 bp, Rattus norvegicus
ggcgaatgtctaaatccccagttga

SEQ ID NO: 442237 - DNA, 25 bp, Rattus norvegicus
ggcgaatgtctatatccccagttga

SEQ ID NO: 442238 - DNA, 25 bp, Rattus norvegicus
ggcgaatgtgccatgcagattacat

SEQ ID NO: 442239 - DNA, 25 bp, Rattus norvegicus
ggcgaatgtgccttgcagattacat

SEQ ID NO: 442240 - DNA, 25 bp, Rattus norvegicus
ggcgacaaccggacctataaaggct

SEQ ID NO: 442241 - DNA, 25 bp, Rattus norvegicus
ggcgacaaccggtcctataaaggct

SEQ ID NO: 442242 - DNA, 25 bp, Rattus norvegicus
ggcgacaagaacaaccatggcgagg

SEQ ID NO: 442243 - DNA, 25 bp, Rattus norvegicus
ggcgacaagaactaccatggcgagg

SEQ ID NO: 442244 - DNA, 25 bp, Rattus norvegicus
ggcgacaagggaccacagcactgat

SEQ ID NO: 442245 - DNA, 25 bp, Rattus norvegicus
ggcgacaagggagcacagcactgat

SEQ ID NO: 442246 - DNA, 25 bp, Rattus norvegicus
ggcgacaattggcactgtgagaacc

SEQ ID NO: 442247 - DNA, 25 bp, Rattus norvegicus
ggcgacaattgggactgtgagaacc

SEQ ID NO: 442248 - DNA, 25 bp, Rattus norvegicus
ggcgacagaggcagcccgacctcag

SEQ ID NO: 442249 - DNA, 25 bp, Rattus norvegicus
ggcgacagaggctgcccgacctcag

SEQ ID NO: 442250 - DNA, 25 bp, Rattus norvegicus
ggcgacagattcctgtggagactta

SEQ ID NO: 442251 - DNA, 25 bp, Rattus norvegicus
ggcgacagattcgtgtggagactta

SEQ ID NO: 442252 - DNA, 25 bp, Rattus norvegicus
ggcgacagcagaccccaatgtcaat

SEQ ID NO: 442253 - DNA, 25 bp, Rattus norvegicus
ggcgacagcagagcccaatgtcaat

SEQ ID NO: 442254 - DNA, 25 bp, Rattus norvegicus
ggcgacagcattctctgccgctgag

SEQ ID NO: 442255 - DNA, 25 bp, Rattus norvegicus
ggcgacagcattgtctgccgctgag

SEQ ID NO: 442256 - DNA, 25 bp, Rattus norvegicus
ggcgacagtaacacgaaaactcaag

SEQ ID NO: 442257 - DNA, 25 bp, Rattus norvegicus
ggcgacagtaactcgaaaactcaag

SEQ ID NO: 442258 - DNA, 25 bp, Rattus norvegicus
ggcgacatctccatcatcagcagtt

SEQ ID NO: 442259 - DNA, 25 bp, Rattus norvegicus
ggcgacatctccttcatcagcagtt

SEQ ID NO: 442260 - DNA, 25 bp, Rattus norvegicus
ggcgacatggtgatggccacagtta

SEQ ID NO: 442261 - DNA, 25 bp, Rattus norvegicus
ggcgacatggtgttggccacagtta

SEQ ID NO: 442262 - DNA, 25 bp, Rattus norvegicus
ggcgaccactctaaaaacgtaactg

SEQ ID NO: 442263 - DNA, 25 bp, Rattus norvegicus
ggcgaccactcttaaaacgtaactg

SEQ ID NO: 442264 - DNA, 25 bp, Rattus norvegicus
ggcgaccagatcaaattcctttcta

SEQ ID NO: 442265 - DNA, 25 bp, Rattus norvegicus
ggcgaccagatctaattcctttcta

SEQ ID NO: 442266 - DNA, 25 bp, Rattus norvegicus
ggcgaccagcaaagtcagtgtattt

SEQ ID NO: 442267 - DNA, 25 bp, Rattus norvegicus
ggcgaccagcaatgtcagtgtattt

SEQ ID NO: 442268 - DNA, 25 bp, Rattus norvegicus
ggcgaccatcccctcctgttttaag

SEQ ID NO: 442269 - DNA, 25 bp, Rattus norvegicus
ggcgaccatcccgtcctgttttaag

SEQ ID NO: 442270 - DNA, 25 bp, Rattus norvegicus
ggcgacccagctcttaagcagaaca

SEQ ID NO: 442271 - DNA, 25 bp, Rattus norvegicus
ggcgacccagctgttaagcagaaca

SEQ ID NO: 442272 - DNA, 25 bp, Rattus norvegicus
ggcgaccccaagcaacagcagtata

SEQ ID NO: 442273 - DNA, 25 bp, Rattus norvegicus
ggcgaccccaaggaacagcagtata

SEQ ID NO: 442274 - DNA, 25 bp, Rattus norvegicus
ggcgaccccgcaatttgcagggttt

SEQ ID NO: 442275 - DNA, 25 bp, Rattus norvegicus
ggcgaccccgcattttgcagggttt

SEQ ID NO: 442276 - DNA, 25 bp, Rattus norvegicus
ggcgaccccggaacaactgctgtgg

SEQ ID NO: 442277 - DNA, 25 bp, Rattus norvegicus
ggcgaccccggatcaactgctgtgg

SEQ ID NO: 442278 - DNA, 25 bp, Rattus norvegicus
ggcgacctacctcgagctggcaagc

SEQ ID NO: 442279 - DNA, 25 bp, Rattus norvegicus
ggcgacctacctggagctggcaagc

SEQ ID NO: 442280 - DNA, 25 bp, Rattus norvegicus
ggcgacctgaacatccattatggct

SEQ ID NO: 442281 - DNA, 25 bp, Rattus norvegicus
ggcgacctgaacttccattatggct

SEQ ID NO: 442282 - DNA, 25 bp, Rattus norvegicus
ggcgacctgaagattgccagcatgg

SEQ ID NO: 442283 - DNA, 25 bp, Rattus norvegicus
ggcgacctgaagtttgccagcatgg

SEQ ID NO: 442284 - DNA, 25 bp, Rattus norvegicus
ggcgacctgctgcatgatgacgata

SEQ ID NO: 442285 - DNA, 25 bp, Rattus norvegicus
ggcgacctgctggatgatgacgata

SEQ ID NO: 442286 - DNA, 25 bp, Rattus norvegicus
ggcgacctttacaatttcaactttg

SEQ ID NO: 442287 - DNA, 25 bp, Rattus norvegicus
ggcgacctttactatttcaactttg

SEQ ID NO: 442288 - DNA, 25 bp, Rattus norvegicus
ggcgacgaagagcatccgtttcaat

SEQ ID NO: 442289 - DNA, 25 bp, Rattus norvegicus
ggcgacgaagaggatccgtttcaat

SEQ ID NO: 442290 - DNA, 25 bp, Rattus norvegicus
ggcgacgtctcaagtttcagacact

SEQ ID NO: 442291 - DNA, 25 bp, Rattus norvegicus
ggcgacgtctcatgtttcagacact

SEQ ID NO: 442292 - DNA, 25 bp, Rattus norvegicus
ggcgactagcgacgcggagccgggt

SEQ ID NO: 442293 - DNA, 25 bp, Rattus norvegicus
ggcgactagcgaggcggagccgggt

SEQ ID NO: 442294 - DNA, 25 bp, Rattus norvegicus
ggcgactcagacactcgggaactgg

SEQ ID NO: 442295 - DNA, 25 bp, Rattus norvegicus
ggcgactcagactctcgggaactgg

SEQ ID NO: 442296 - DNA, 25 bp, Rattus norvegicus
ggcgactcagccagccaggacgtga

SEQ ID NO: 442297 - DNA, 25 bp, Rattus norvegicus
ggcgactcagcctgccaggacgtga

SEQ ID NO: 442298 - DNA, 25 bp, Rattus norvegicus
ggcgactccaagaatagccagggct

SEQ ID NO: 442299 - DNA, 25 bp, Rattus norvegicus
ggcgactccaagtatagccagggct

SEQ ID NO: 442300 - DNA, 25 bp, Rattus norvegicus
ggcgactccatcagtgagctgtgat

SEQ ID NO: 442301 - DNA, 25 bp, Rattus norvegicus
ggcgactccatctgtgagctgtgat

SEQ ID NO: 442302 - DNA, 25 bp, Rattus norvegicus
ggcgactgacgcaaaagtgtataca

SEQ ID NO: 442303 - DNA, 25 bp, Rattus norvegicus
ggcgactgacgctaaagtgtataca

SEQ ID NO: 442304 - DNA, 25 bp, Rattus norvegicus
ggcgactgagtgacctccgtggtaa

SEQ ID NO: 442305 - DNA, 25 bp, Rattus norvegicus
ggcgactgagtgtcctccgtggtaa

SEQ ID NO: 442306 - DNA, 25 bp, Rattus norvegicus
ggcgactggcagctcagaaccaaga

SEQ ID NO: 442307 - DNA, 25 bp, Rattus norvegicus
ggcgactggcaggtcagaaccaaga

SEQ ID NO: 442308 - DNA, 25 bp, Rattus norvegicus
ggcgactggcgtctgggcgcgggaa

SEQ ID NO: 442309 - DNA, 25 bp, Rattus norvegicus
ggcgactggcgtgtgggcgcgggaa

SEQ ID NO: 442310 - DNA, 25 bp, Rattus norvegicus
ggcgactgtactaaggccacacaag

SEQ ID NO: 442311 - DNA, 25 bp, Rattus norvegicus
ggcgactgtacttaggccacacaag

SEQ ID NO: 442312 - DNA, 25 bp, Rattus norvegicus
ggcgactgtgtccgtctatacgcat

SEQ ID NO: 442313 - DNA, 25 bp, Rattus norvegicus
ggcgactgtgtcggtctatacgcat

SEQ ID NO: 442314 - DNA, 25 bp, Rattus norvegicus
ggcgacttccccagaaattgtatta

SEQ ID NO: 442315 - DNA, 25 bp, Rattus norvegicus
ggcgacttcccctgaaattgtatta

SEQ ID NO: 442316 - DNA, 25 bp, Rattus norvegicus
ggcgagaaacacagtcatcccaaag

SEQ ID NO: 442317 - DNA, 25 bp, Rattus norvegicus
ggcgagaaacactgtcatcccaaag

SEQ ID NO: 442318 - DNA, 25 bp, Rattus norvegicus
ggcgagaactccattgaccatgtcg

SEQ ID NO: 442319 - DNA, 25 bp, Rattus norvegicus
ggcgagaactcctttgaccatgtcg

SEQ ID NO: 442320 - DNA, 25 bp, Rattus norvegicus
ggcgagaagattaagaagtcaccct

SEQ ID NO: 442321 - DNA, 25 bp, Rattus norvegicus
ggcgagaagatttagaagtcaccct

SEQ ID NO: 442322 - DNA, 25 bp, Rattus norvegicus
ggcgagagaaatcgctcagccgtta

SEQ ID NO: 442323 - DNA, 25 bp, Rattus norvegicus
ggcgagagaaatggctcagccgtta

SEQ ID NO: 442324 - DNA, 25 bp, Rattus norvegicus
ggcgagagaactagcaccataggtt

SEQ ID NO: 442325 - DNA, 25 bp, Rattus norvegicus
ggcgagagaacttgcaccataggtt

SEQ ID NO: 442326 - DNA, 25 bp, Rattus norvegicus
ggcgagagagagacacatgctgttt

SEQ ID NO: 442327 - DNA, 25 bp, Rattus norvegicus
ggcgagagagagtcacatgctgttt

SEQ ID NO: 442328 - DNA, 25 bp, Rattus norvegicus
ggcgagaggaggacaaccgctacct

SEQ ID NO: 442329 - DNA, 25 bp, Rattus norvegicus
ggcgagaggaggtcaaccgctacct

SEQ ID NO: 442330 - DNA, 25 bp, Rattus norvegicus
ggcgagagttggacctctccctggt

SEQ ID NO: 442331 - DNA, 25 bp, Rattus norvegicus
ggcgagagttggtcctctccctggt

SEQ ID NO: 442332 - DNA, 25 bp, Rattus norvegicus
ggcgagattgtcctctttaatactt

SEQ ID NO: 442333 - DNA, 25 bp, Rattus norvegicus
ggcgagattgtcgtctttaatactt

SEQ ID NO: 442334 - DNA, 25 bp, Rattus norvegicus
ggcgagatttgaccagatccctgga

SEQ ID NO: 442335 - DNA, 25 bp, Rattus norvegicus
ggcgagatttgagcagatccctgga

SEQ ID NO: 442336 - DNA, 25 bp, Rattus norvegicus
ggcgagcacgggaacccaaagagct

SEQ ID NO: 442337 - DNA, 25 bp, Rattus norvegicus
ggcgagcacgggtacccaaagagct

SEQ ID NO: 442338 - DNA, 25 bp, Rattus norvegicus
ggcgagcatctcatatctcattgga

SEQ ID NO: 442339 - DNA, 25 bp, Rattus norvegicus
ggcgagcatctcttatctcattgga

SEQ ID NO: 442340 - DNA, 25 bp, Rattus norvegicus
ggcgagccctctcaaatgtaaaaga

SEQ ID NO: 442341 - DNA, 25 bp, Rattus norvegicus
ggcgagccctctgaaatgtaaaaga

SEQ ID NO: 442342 - DNA, 25 bp, Rattus norvegicus
ggcgagcctcttctccaacaggaag

SEQ ID NO: 442343 - DNA, 25 bp, Rattus norvegicus
ggcgagcctcttgtccaacaggaag

SEQ ID NO: 442344 - DNA, 25 bp, Rattus norvegicus
ggcgagcctgtcagtaaggacagta

SEQ ID NO: 442345 - DNA, 25 bp, Rattus norvegicus
ggcgagcctgtctgtaaggacagta

SEQ ID NO: 442346 - DNA, 25 bp, Rattus norvegicus
ggcgagccttataatcagttcccag

SEQ ID NO: 442347 - DNA, 25 bp, Rattus norvegicus
ggcgagccttattatcagttcccag

SEQ ID NO: 442348 - DNA, 25 bp, Rattus norvegicus
ggcgagcgggcgattagcacccatt

SEQ ID NO: 442349 - DNA, 25 bp, Rattus norvegicus
ggcgagcgggcgtttagcacccatt

SEQ ID NO: 442350 - DNA, 25 bp, Rattus norvegicus
ggcgagctgagtcacgactatccct

SEQ ID NO: 442351 - DNA, 25 bp, Rattus norvegicus
ggcgagctgagtgacgactatccct

SEQ ID NO: 442352 - DNA, 25 bp, Rattus norvegicus
ggcgagctgttaacttgcactggga

SEQ ID NO: 442353 - DNA, 25 bp, Rattus norvegicus
ggcgagctgttatcttgcactggga

SEQ ID NO: 442354 - DNA, 25 bp, Rattus norvegicus
ggcgagcttcttcgttggcctgcaa

SEQ ID NO: 442355 - DNA, 25 bp, Rattus norvegicus
ggcgagcttcttggttggcctgcaa

SEQ ID NO: 442356 - DNA, 25 bp, Rattus norvegicus
ggcgaggacaaaccactatccttta

SEQ ID NO: 442357 - DNA, 25 bp, Rattus norvegicus
ggcgaggacaaagcactatccttta

SEQ ID NO: 442358 - DNA, 25 bp, Rattus norvegicus
ggcgaggcagctagagttaaacgaa

SEQ ID NO: 442359 - DNA, 25 bp, Rattus norvegicus
ggcgaggcagcttgagttaaacgaa

SEQ ID NO: 442360 - DNA, 25 bp, Rattus norvegicus
ggcgaggcataaactcttttaagat

SEQ ID NO: 442361 - DNA, 25 bp, Rattus norvegicus
ggcgaggcataatctcttttaagat

SEQ ID NO: 442362 - DNA, 25 bp, Rattus norvegicus
ggcgagggaccccagtctttagcat

SEQ ID NO: 442363 - DNA, 25 bp, Rattus norvegicus
ggcgagggacccgagtctttagcat

SEQ ID NO: 442364 - DNA, 25 bp, Rattus norvegicus
ggcgagggagcacattccttttgtc

SEQ ID NO: 442365 - DNA, 25 bp, Rattus norvegicus
ggcgagggagcagattccttttgtc

SEQ ID NO: 442366 - DNA, 25 bp, Rattus norvegicus
ggcgagggcacacgtttctaatgat

SEQ ID NO: 442367 - DNA, 25 bp, Rattus norvegicus
ggcgagggcacaggtttctaatgat

SEQ ID NO: 442368 - DNA, 25 bp, Rattus norvegicus
ggcgagggcatgaacactgcagacc

SEQ ID NO: 442369 - DNA, 25 bp, Rattus norvegicus
ggcgagggcatgtacactgcagacc

SEQ ID NO: 442370 - DNA, 25 bp, Rattus norvegicus
ggcgagtacttcctcaagtgtgaca

SEQ ID NO: 442371 - DNA, 25 bp, Rattus norvegicus
ggcgagtacttcgtcaagtgtgaca

SEQ ID NO: 442372 - DNA, 25 bp, Rattus norvegicus
ggcgagtagctactgctaggccact

SEQ ID NO: 442373 - DNA, 25 bp, Rattus norvegicus
ggcgagtagctagtgctaggccact

SEQ ID NO: 442374 - DNA, 25 bp, Rattus norvegicus
ggcgagtcacagcatagcggaccct

SEQ ID NO: 442375 - DNA, 25 bp, Rattus norvegicus
ggcgagtcacaggatagcggaccct

SEQ ID NO: 442376 - DNA, 25 bp, Rattus norvegicus
ggcgagtcgcctacgtgcagtgttc

SEQ ID NO: 442377 - DNA, 25 bp, Rattus norvegicus
ggcgagtcgccttcgtgcagtgttc

SEQ ID NO: 442378 - DNA, 25 bp, Rattus norvegicus
ggcgagttactcactatgaagtcaa

SEQ ID NO: 442379 - DNA, 25 bp, Rattus norvegicus
ggcgagttactctctatgaagtcaa

SEQ ID NO: 442380 - DNA, 25 bp, Rattus norvegicus
ggcgagttcctcacataatcaatgt

SEQ ID NO: 442381 - DNA, 25 bp, Rattus norvegicus
ggcgagttcctctcataatcaatgt

SEQ ID NO: 442382 - DNA, 25 bp, Rattus norvegicus
ggcgataccgtcaacgctatggagt

SEQ ID NO: 442383 - DNA, 25 bp, Rattus norvegicus
ggcgataccgtctacgctatggagt

SEQ ID NO: 442384 - DNA, 25 bp, Rattus norvegicus
ggcgatagaaagctccctcccgtag

SEQ ID NO: 442385 - DNA, 25 bp, Rattus norvegicus
ggcgatagaaaggtccctcccgtag

SEQ ID NO: 442386 - DNA, 25 bp, Rattus norvegicus
ggcgatcatctgacactaagtttaa

SEQ ID NO: 442387 - DNA, 25 bp, Rattus norvegicus
ggcgatcatctgtcactaagtttaa

SEQ ID NO: 442388 - DNA, 25 bp, Rattus norvegicus
ggcgatcgcgtcaatactctaaaga

SEQ ID NO: 442389 - DNA, 25 bp, Rattus norvegicus
ggcgatcgcgtctatactctaaaga

SEQ ID NO: 442390 - DNA, 25 bp, Rattus norvegicus
ggcgatctggccaagcacaaattga

SEQ ID NO: 442391 - DNA, 25 bp, Rattus norvegicus
ggcgatctggcctagcacaaattga

SEQ ID NO: 442392 - DNA, 25 bp, Rattus norvegicus
ggcgatgacagccaccccagagcag

SEQ ID NO: 442393 - DNA, 25 bp, Rattus norvegicus
ggcgatgacagcgaccccagagcag

SEQ ID NO: 442394 - DNA, 25 bp, Rattus norvegicus
ggcgatgaggacactctaccgaacc

SEQ ID NO: 442395 - DNA, 25 bp, Rattus norvegicus
ggcgatgaggactctctaccgaacc

SEQ ID NO: 442396 - DNA, 25 bp, Rattus norvegicus
ggcgatgcagacacctaagagttgt

SEQ ID NO: 442397 - DNA, 25 bp, Rattus norvegicus
ggcgatgcagactcctaagagttgt

SEQ ID NO: 442398 - DNA, 25 bp, Rattus norvegicus
ggcgatgcttaaacatgctctttca

SEQ ID NO: 442399 - DNA, 25 bp, Rattus norvegicus
ggcgatgcttaatcatgctctttca

SEQ ID NO: 442400 - DNA, 25 bp, Rattus norvegicus
ggcgatgtagagacccagaaaaatg

SEQ ID NO: 442401 - DNA, 25 bp, Rattus norvegicus
ggcgatgtagagtcccagaaaaatg

SEQ ID NO: 442402 - DNA, 25 bp, Rattus norvegicus
ggcgatgttcgaagcgccgctgaac

SEQ ID NO: 442403 - DNA, 25 bp, Rattus norvegicus
ggcgatgttcgatgcgccgctgaac

SEQ ID NO: 442404 - DNA, 25 bp, Rattus norvegicus
ggcgatgttctgcaagtaacccttg

SEQ ID NO: 442405 - DNA, 25 bp, Rattus norvegicus
ggcgatgttctggaagtaacccttg

SEQ ID NO: 442406 - DNA, 25 bp, Rattus norvegicus
ggcgattctactcaaaacttctgtt

SEQ ID NO: 442407 - DNA, 25 bp, Rattus norvegicus
ggcgattctactgaaaacttctgtt

SEQ ID NO: 442408 - DNA, 25 bp, Rattus norvegicus
ggcgattgcataagcttcatctgat

SEQ ID NO: 442409 - DNA, 25 bp, Rattus norvegicus
ggcgattgcatatgcttcatctgat

SEQ ID NO: 442410 - DNA, 25 bp, Rattus norvegicus
ggcgattgctctcgtgagactgaat

SEQ ID NO: 442411 - DNA, 25 bp, Rattus norvegicus
ggcgattgctctggtgagactgaat

SEQ ID NO: 442412 - DNA, 25 bp, Rattus norvegicus
ggcgattgtgatacgggacattcta

SEQ ID NO: 442413 - DNA, 25 bp, Rattus norvegicus
ggcgattgtgattcgggacattcta

SEQ ID NO: 442414 - DNA, 25 bp, Rattus norvegicus
ggcgatttccaacagacggcgttaa

SEQ ID NO: 442415 - DNA, 25 bp, Rattus norvegicus
ggcgatttccaagagacggcgttaa

SEQ ID NO: 442416 - DNA, 25 bp, Rattus norvegicus
ggcgcaacgtgcaatcggacagcaa

SEQ ID NO: 442417 - DNA, 25 bp, Rattus norvegicus
ggcgcaacgtgctatcggacagcaa

SEQ ID NO: 442418 - DNA, 25 bp, Rattus norvegicus
ggcgcaagaggcagtccctgcagct

SEQ ID NO: 442419 - DNA, 25 bp, Rattus norvegicus
ggcgcaagaggctgtccctgcagct

SEQ ID NO: 442420 - DNA, 25 bp, Rattus norvegicus
ggcgcaagctgcacacccagaagag

SEQ ID NO: 442421 - DNA, 25 bp, Rattus norvegicus
ggcgcaagctgctcacccagaagag

SEQ ID NO: 442422 - DNA, 25 bp, Rattus norvegicus
ggcgcaatcggcacctagagaaaca

SEQ ID NO: 442423 - DNA, 25 bp, Rattus norvegicus
ggcgcaatcggctcctagagaaaca

SEQ ID NO: 442424 - DNA, 25 bp, Rattus norvegicus
ggcgcaattcagattctgcaggacc

SEQ ID NO: 442425 - DNA, 25 bp, Rattus norvegicus
ggcgcaattcagtttctgcaggacc

SEQ ID NO: 442426 - DNA, 25 bp, Rattus norvegicus
ggcgcacacgggacatctctggttt

SEQ ID NO: 442427 - DNA, 25 bp, Rattus norvegicus
ggcgcacacgggtcatctctggttt

SEQ ID NO: 442428 - DNA, 25 bp, Rattus norvegicus
ggcgcacactcaagaaccgaggcta

SEQ ID NO: 442429 - DNA, 25 bp, Rattus norvegicus
ggcgcacactcatgaaccgaggcta

SEQ ID NO: 442430 - DNA, 25 bp, Rattus norvegicus
ggcgcacagctccatggacttctga

SEQ ID NO: 442431 - DNA, 25 bp, Rattus norvegicus
ggcgcacagctcgatggacttctga

SEQ ID NO: 442432 - DNA, 25 bp, Rattus norvegicus
ggcgcacccttaacgtcaataggag

SEQ ID NO: 442433 - DNA, 25 bp, Rattus norvegicus
ggcgcacccttatcgtcaataggag

SEQ ID NO: 442434 - DNA, 25 bp, Rattus norvegicus
ggcgcacctacgcatcattgatggg

SEQ ID NO: 442435 - DNA, 25 bp, Rattus norvegicus
ggcgcacctacggatcattgatggg

SEQ ID NO: 442436 - DNA, 25 bp, Rattus norvegicus
ggcgcacgcggtcgtgggcagctca

SEQ ID NO: 442437 - DNA, 25 bp, Rattus norvegicus
ggcgcacgcggtggtgggcagctca

SEQ ID NO: 442438 - DNA, 25 bp, Rattus norvegicus
ggcgcactaccacaatctgatgaat

SEQ ID NO: 442439 - DNA, 25 bp, Rattus norvegicus
ggcgcactaccagaatctgatgaat

SEQ ID NO: 442440 - DNA, 25 bp, Rattus norvegicus
ggcgcactaggcacagcgggcactc

SEQ ID NO: 442441 - DNA, 25 bp, Rattus norvegicus
ggcgcactaggctcagcgggcactc

SEQ ID NO: 442442 - DNA, 25 bp, Rattus norvegicus
ggcgcactcctgctttaggaggaca

SEQ ID NO: 442443 - DNA, 25 bp, Rattus norvegicus
ggcgcactcctggtttaggaggaca

SEQ ID NO: 442444 - DNA, 25 bp, Rattus norvegicus
ggcgcactctgcaccagaatggtaa

SEQ ID NO: 442445 - DNA, 25 bp, Rattus norvegicus
ggcgcactctgctccagaatggtaa

SEQ ID NO: 442446 - DNA, 25 bp, Rattus norvegicus
ggcgcactgaagaggtttccttact

SEQ ID NO: 442447 - DNA, 25 bp, Rattus norvegicus
ggcgcactgaagtggtttccttact

SEQ ID NO: 442448 - DNA, 25 bp, Rattus norvegicus
ggcgcactggatactcattcctaat

SEQ ID NO: 442449 - DNA, 25 bp, Rattus norvegicus
ggcgcactggattctcattcctaat

SEQ ID NO: 442450 - DNA, 25 bp, Rattus norvegicus
ggcgcacttaaaagttccaagaaca

SEQ ID NO: 442451 - DNA, 25 bp, Rattus norvegicus
ggcgcacttaaatgttccaagaaca

SEQ ID NO: 442452 - DNA, 25 bp, Rattus norvegicus
ggcgcacttggtcactagtctatag

SEQ ID NO: 442453 - DNA, 25 bp, Rattus norvegicus
ggcgcacttggtgactagtctatag

SEQ ID NO: 442454 - DNA, 25 bp, Rattus norvegicus
ggcgcagaaaccacagtcatgtatg

SEQ ID NO: 442455 - DNA, 25 bp, Rattus norvegicus
ggcgcagaaacctcagtcatgtatg

SEQ ID NO: 442456 - DNA, 25 bp, Rattus norvegicus
ggcgcagaaattctaccagttcaga

SEQ ID NO: 442457 - DNA, 25 bp, Rattus norvegicus
ggcgcagaaattgtaccagttcaga

SEQ ID NO: 442458 - DNA, 25 bp, Rattus norvegicus
ggcgcagacttaactctgttctctt

SEQ ID NO: 442459 - DNA, 25 bp, Rattus norvegicus
ggcgcagacttatctctgttctctt

SEQ ID NO: 442460 - DNA, 25 bp, Rattus norvegicus
ggcgcagagatcatgaatagcacca

SEQ ID NO: 442461 - DNA, 25 bp, Rattus norvegicus
ggcgcagagatcttgaatagcacca

SEQ ID NO: 442462 - DNA, 25 bp, Rattus norvegicus
ggcgcagagtgacacttttgaccag

SEQ ID NO: 442463 - DNA, 25 bp, Rattus norvegicus
ggcgcagagtgagacttttgaccag

SEQ ID NO: 442464 - DNA, 25 bp, Rattus norvegicus
ggcgcagatccacgaagagcagctt

SEQ ID NO: 442465 - DNA, 25 bp, Rattus norvegicus
ggcgcagatccaggaagagcagctt

SEQ ID NO: 442466 - DNA, 25 bp, Rattus norvegicus
ggcgcagcacctactaaatccaagg

SEQ ID NO: 442467 - DNA, 25 bp, Rattus norvegicus
ggcgcagcaccttctaaatccaagg

SEQ ID NO: 442468 - DNA, 25 bp, Rattus norvegicus
ggcgcagcaggaagtacacccatgg

SEQ ID NO: 442469 - DNA, 25 bp, Rattus norvegicus
ggcgcagcaggatgtacacccatgg

SEQ ID NO: 442470 - DNA, 25 bp, Rattus norvegicus
ggcgcagcctgtatttagagggatt

SEQ ID NO: 442471 - DNA, 25 bp, Rattus norvegicus
ggcgcagcctgtttttagagggatt

SEQ ID NO: 442472 - DNA, 25 bp, Rattus norvegicus
ggcgcagtctgtcaaccatgggttc

SEQ ID NO: 442473 - DNA, 25 bp, Rattus norvegicus
ggcgcagtctgtgaaccatgggttc

SEQ ID NO: 442474 - DNA, 25 bp, Rattus norvegicus
ggcgcagtggcacccgctttgctat

SEQ ID NO: 442475 - DNA, 25 bp, Rattus norvegicus
ggcgcagtggcagccgctttgctat

SEQ ID NO: 442476 - DNA, 25 bp, Rattus norvegicus
ggcgcagtggccacgggctgtgcct

SEQ ID NO: 442477 - DNA, 25 bp, Rattus norvegicus
ggcgcagtggcctcgggctgtgcct

SEQ ID NO: 442478 - DNA, 25 bp, Rattus norvegicus
ggcgcagtggtgaacacagtcacat

SEQ ID NO: 442479 - DNA, 25 bp, Rattus norvegicus
ggcgcagtggtgtacacagtcacat

SEQ ID NO: 442480 - DNA, 25 bp, Rattus norvegicus
ggcgcagttacaacttcactgtcag

SEQ ID NO: 442481 - DNA, 25 bp, Rattus norvegicus
ggcgcagttacatcttcactgtcag

SEQ ID NO: 442482 - DNA, 25 bp, Rattus norvegicus
ggcgcagttcatcttgccttagaac

SEQ ID NO: 442483 - DNA, 25 bp, Rattus norvegicus
ggcgcagttcatgttgccttagaac

SEQ ID NO: 442484 - DNA, 25 bp, Rattus norvegicus
ggcgcagtttatatcctggactaag

SEQ ID NO: 442485 - DNA, 25 bp, Rattus norvegicus
ggcgcagtttatttcctggactaag

SEQ ID NO: 442486 - DNA, 25 bp, Rattus norvegicus
ggcgcatagcgcagagatgtatcat

SEQ ID NO: 442487 - DNA, 25 bp, Rattus norvegicus
ggcgcatagcgctgagatgtatcat

SEQ ID NO: 442488 - DNA, 25 bp, Rattus norvegicus
ggcgcatatggtcacatcctcttac

SEQ ID NO: 442489 - DNA, 25 bp, Rattus norvegicus
ggcgcatatggtgacatcctcttac

SEQ ID NO: 442490 - DNA, 25 bp, Rattus norvegicus
ggcgcatattttaacacttgcaaat

SEQ ID NO: 442491 - DNA, 25 bp, Rattus norvegicus
ggcgcatatttttacacttgcaaat

SEQ ID NO: 442492 - DNA, 25 bp, Rattus norvegicus
ggcgcatccctgagaggccaattaa

SEQ ID NO: 442493 - DNA, 25 bp, Rattus norvegicus
ggcgcatccctgtgaggccaattaa

SEQ ID NO: 442494 - DNA, 25 bp, Rattus norvegicus
ggcgcatctgagcacgcacacaggt

SEQ ID NO: 442495 - DNA, 25 bp, Rattus norvegicus
ggcgcatctgaggacgcacacaggt

SEQ ID NO: 442496 - DNA, 25 bp, Rattus norvegicus
ggcgcatctgctcaaaccaggcttt

SEQ ID NO: 442497 - DNA, 25 bp, Rattus norvegicus
ggcgcatctgctgaaaccaggcttt

SEQ ID NO: 442498 - DNA, 25 bp, Rattus norvegicus
ggcgcatgccccatatttatgggaa

SEQ ID NO: 442499 - DNA, 25 bp, Rattus norvegicus
ggcgcatgccccttatttatgggaa

SEQ ID NO: 442500 - DNA, 25 bp, Rattus norvegicus
ggcgcatgccggaaggtaatctcat

SEQ ID NO: 442501 - DNA, 25 bp, Rattus norvegicus
ggcgcatgccggtaggtaatctcat

SEQ ID NO: 442502 - DNA, 25 bp, Rattus norvegicus
ggcgcatgtattactgctgtgctaa

SEQ ID NO: 442503 - DNA, 25 bp, Rattus norvegicus
ggcgcatgtatttctgctgtgctaa

SEQ ID NO: 442504 - DNA, 25 bp, Rattus norvegicus
ggcgcatgtctcaggtttttgccat

SEQ ID NO: 442505 - DNA, 25 bp, Rattus norvegicus
ggcgcatgtctctggtttttgccat

SEQ ID NO: 442506 - DNA, 25 bp, Rattus norvegicus
ggcgcattatggagacacagcagaa

SEQ ID NO: 442507 - DNA, 25 bp, Rattus norvegicus
ggcgcattatggtgacacagcagaa

SEQ ID NO: 442508 - DNA, 25 bp, Rattus norvegicus
ggcgcatttactcccacctgagaaa

SEQ ID NO: 442509 - DNA, 25 bp, Rattus norvegicus
ggcgcatttactgccacctgagaaa

SEQ ID NO: 442510 - DNA, 25 bp, Rattus norvegicus
ggcgccaagcagaaaatgcacgatg

SEQ ID NO: 442511 - DNA, 25 bp, Rattus norvegicus
ggcgccaagcagtaaatgcacgatg

SEQ ID NO: 442512 - DNA, 25 bp, Rattus norvegicus
ggcgccaagcgcaacagttacttaa

SEQ ID NO: 442513 - DNA, 25 bp, Rattus norvegicus
ggcgccaagcgctacagttacttaa

SEQ ID NO: 442514 - DNA, 25 bp, Rattus norvegicus
ggcgccaaggaacgaacggccttat

SEQ ID NO: 442515 - DNA, 25 bp, Rattus norvegicus
ggcgccaaggaaggaacggccttat

SEQ ID NO: 442516 - DNA, 25 bp, Rattus norvegicus
ggcgccacagtccatcaagtaacag

SEQ ID NO: 442517 - DNA, 25 bp, Rattus norvegicus
ggcgccacagtcgatcaagtaacag

SEQ ID NO: 442518 - DNA, 25 bp, Rattus norvegicus
ggcgccagctgcatgaagtgttttg

SEQ ID NO: 442519 - DNA, 25 bp, Rattus norvegicus
ggcgccagctgcttgaagtgttttg

SEQ ID NO: 442520 - DNA, 25 bp, Rattus norvegicus
ggcgccatcaccatttatctgacaa

SEQ ID NO: 442521 - DNA, 25 bp, Rattus norvegicus
ggcgccatcaccttttatctgacaa

SEQ ID NO: 442522 - DNA, 25 bp, Rattus norvegicus
ggcgccatggatcccaaagtcggct

SEQ ID NO: 442523 - DNA, 25 bp, Rattus norvegicus
ggcgccatggatgccaaagtcggct

SEQ ID NO: 442524 - DNA, 25 bp, Rattus norvegicus
ggcgccattgcaacatccatgctgg

SEQ ID NO: 442525 - DNA, 25 bp, Rattus norvegicus
ggcgccattgcatcatccatgctgg

SEQ ID NO: 442526 - DNA, 25 bp, Rattus norvegicus
ggcgccatttggaattactgacttc

SEQ ID NO: 442527 - DNA, 25 bp, Rattus norvegicus
ggcgccatttggtattactgacttc

SEQ ID NO: 442528 - DNA, 25 bp, Rattus norvegicus
ggcgcccacggcagagggttaggga

SEQ ID NO: 442529 - DNA, 25 bp, Rattus norvegicus
ggcgcccacggctgagggttaggga

SEQ ID NO: 442530 - DNA, 25 bp, Rattus norvegicus
ggcgcccagctgactctgtaagaat

SEQ ID NO: 442531 - DNA, 25 bp, Rattus norvegicus
ggcgcccagctgtctctgtaagaat

SEQ ID NO: 442532 - DNA, 25 bp, Rattus norvegicus
ggcgcccaggtacaacactttggac

SEQ ID NO: 442533 - DNA, 25 bp, Rattus norvegicus
ggcgcccaggtagaacactttggac

SEQ ID NO: 442534 - DNA, 25 bp, Rattus norvegicus
ggcgcccgccagaagctactgggaa

SEQ ID NO: 442535 - DNA, 25 bp, Rattus norvegicus
ggcgcccgccagtagctactgggaa

SEQ ID NO: 442536 - DNA, 25 bp, Rattus norvegicus
ggcgcccgggcaccggcatgaagga

SEQ ID NO: 442537 - DNA, 25 bp, Rattus norvegicus
ggcgcccgggcagcggcatgaagga

SEQ ID NO: 442538 - DNA, 25 bp, Rattus norvegicus
ggcgccctacagaaatggacttcga

SEQ ID NO: 442539 - DNA, 25 bp, Rattus norvegicus
ggcgccctacagtaatggacttcga

SEQ ID NO: 442540 - DNA, 25 bp, Rattus norvegicus
ggcgccctacgtcaaccaagtgaat

SEQ ID NO: 442541 - DNA, 25 bp, Rattus norvegicus
ggcgccctacgtgaaccaagtgaat

SEQ ID NO: 442542 - DNA, 25 bp, Rattus norvegicus
ggcgccctcagtcatcaggagagca

SEQ ID NO: 442543 - DNA, 25 bp, Rattus norvegicus
ggcgccctcagtgatcaggagagca

SEQ ID NO: 442544 - DNA, 25 bp, Rattus norvegicus
ggcgccgagctgcacttatatttta

SEQ ID NO: 442545 - DNA, 25 bp, Rattus norvegicus
ggcgccgagctggacttatatttta

SEQ ID NO: 442546 - DNA, 25 bp, Rattus norvegicus
ggcgccgagggcatgcccatcttca

SEQ ID NO: 442547 - DNA, 25 bp, Rattus norvegicus
ggcgccgagggcttgcccatcttca

SEQ ID NO: 442548 - DNA, 25 bp, Rattus norvegicus
ggcgccggccagagactctaaggat

SEQ ID NO: 442549 - DNA, 25 bp, Rattus norvegicus
ggcgccggccagtgactctaaggat

SEQ ID NO: 442550 - DNA, 25 bp, Rattus norvegicus
ggcgccggcgcaagaagcatagatc

SEQ ID NO: 442551 - DNA, 25 bp, Rattus norvegicus
ggcgccggcgcatgaagcatagatc

SEQ ID NO: 442552 - DNA, 25 bp, Rattus norvegicus
ggcgccgtcagcatgagatagcgct

SEQ ID NO: 442553 - DNA, 25 bp, Rattus norvegicus
ggcgccgtcagcttgagatagcgct

SEQ ID NO: 442554 - DNA, 25 bp, Rattus norvegicus
ggcgccgtttctctatgatctgaaa

SEQ ID NO: 442555 - DNA, 25 bp, Rattus norvegicus
ggcgccgtttctgtatgatctgaaa

SEQ ID NO: 442556 - DNA, 25 bp, Rattus norvegicus
ggcgcctaaggactatgctgctgta

SEQ ID NO: 442557 - DNA, 25 bp, Rattus norvegicus
ggcgcctaaggagtatgctgctgta

SEQ ID NO: 442558 - DNA, 25 bp, Rattus norvegicus
ggcgcctagcggagctaccagtaag

SEQ ID NO: 442559 - DNA, 25 bp, Rattus norvegicus
ggcgcctagcggtgctaccagtaag

SEQ ID NO: 442560 - DNA, 25 bp, Rattus norvegicus
ggcgcctagttacatctgttaccat

SEQ ID NO: 442561 - DNA, 25 bp, Rattus norvegicus
ggcgcctagttagatctgttaccat

SEQ ID NO: 442562 - DNA, 25 bp, Rattus norvegicus
ggcgcctccaggatatgtaatgctc

SEQ ID NO: 442563 - DNA, 25 bp, Rattus norvegicus
ggcgcctccaggttatgtaatgctc

SEQ ID NO: 442564 - DNA, 25 bp, Rattus norvegicus
ggcgcctcgcgcagattcgtcatgg

SEQ ID NO: 442565 - DNA, 25 bp, Rattus norvegicus
ggcgcctcgcgctgattcgtcatgg

SEQ ID NO: 442566 - DNA, 25 bp, Rattus norvegicus
ggcgcctctggcacaagaacgtgtc

SEQ ID NO: 442567 - DNA, 25 bp, Rattus norvegicus
ggcgcctctggctcaagaacgtgtc

SEQ ID NO: 442568 - DNA, 25 bp, Rattus norvegicus
ggcgcctgggccaagacaaacggca

SEQ ID NO: 442569 - DNA, 25 bp, Rattus norvegicus
ggcgcctgggcctagacaaacggca

SEQ ID NO: 442570 - DNA, 25 bp, Rattus norvegicus
ggcgcctggtttccacacagtacag

SEQ ID NO: 442571 - DNA, 25 bp, Rattus norvegicus
ggcgcctggtttgcacacagtacag

SEQ ID NO: 442572 - DNA, 25 bp, Rattus norvegicus
ggcgcctgtcagagccaggttatta

SEQ ID NO: 442573 - DNA, 25 bp, Rattus norvegicus
ggcgcctgtcagtgccaggttatta

SEQ ID NO: 442574 - DNA, 25 bp, Rattus norvegicus
ggcgcctgttgcacaactagggcaa

SEQ ID NO: 442575 - DNA, 25 bp, Rattus norvegicus
ggcgcctgttgctcaactagggcaa

SEQ ID NO: 442576 - DNA, 25 bp, Rattus norvegicus
ggcgcctgttttagacgtgtacata

SEQ ID NO: 442577 - DNA, 25 bp, Rattus norvegicus
ggcgcctgtttttgacgtgtacata

SEQ ID NO: 442578 - DNA, 25 bp, Rattus norvegicus
ggcgccttgcgtagtccaaggagaa

SEQ ID NO: 442579 - DNA, 25 bp, Rattus norvegicus
ggcgccttgcgttgtccaaggagaa

SEQ ID NO: 442580 - DNA, 25 bp, Rattus norvegicus
ggcgcctttattaacttcgcagaag

SEQ ID NO: 442581 - DNA, 25 bp, Rattus norvegicus
ggcgcctttatttacttcgcagaag

SEQ ID NO: 442582 - DNA, 25 bp, Rattus norvegicus
ggcgcgaatgtaatttctgtctata

SEQ ID NO: 442583 - DNA, 25 bp, Rattus norvegicus
ggcgcgaatgtattttctgtctata

SEQ ID NO: 442584 - DNA, 25 bp, Rattus norvegicus
ggcgcgacagcgaaagccaatgtta

SEQ ID NO: 442585 - DNA, 25 bp, Rattus norvegicus
ggcgcgacagcgtaagccaatgtta

SEQ ID NO: 442586 - DNA, 25 bp, Rattus norvegicus
ggcgcgactggaaacctaggactaa

SEQ ID NO: 442587 - DNA, 25 bp, Rattus norvegicus
ggcgcgactggatacctaggactaa

SEQ ID NO: 442588 - DNA, 25 bp, Rattus norvegicus
ggcgcgagtataaagccaagtcact

SEQ ID NO: 442589 - DNA, 25 bp, Rattus norvegicus
ggcgcgagtatatagccaagtcact

SEQ ID NO: 442590 - DNA, 25 bp, Rattus norvegicus
ggcgcgatacaaagctttgggtcac

SEQ ID NO: 442591 - DNA, 25 bp, Rattus norvegicus
ggcgcgatacaatgctttgggtcac

SEQ ID NO: 442592 - DNA, 25 bp, Rattus norvegicus
ggcgcgcaggccatgtacgtattcg

SEQ ID NO: 442593 - DNA, 25 bp, Rattus norvegicus
ggcgcgcaggccttgtacgtattcg

SEQ ID NO: 442594 - DNA, 25 bp, Rattus norvegicus
ggcgcgcagggcatctccatgagat

SEQ ID NO: 442595 - DNA, 25 bp, Rattus norvegicus
ggcgcgcagggcttctccatgagat

SEQ ID NO: 442596 - DNA, 25 bp, Rattus norvegicus
ggcgcgcatttgagcggctctatca

SEQ ID NO: 442597 - DNA, 25 bp, Rattus norvegicus
ggcgcgcatttgtgcggctctatca

SEQ ID NO: 442598 - DNA, 25 bp, Rattus norvegicus
ggcgcgcctactcggacatgagaaa

SEQ ID NO: 442599 - DNA, 25 bp, Rattus norvegicus
ggcgcgcctactgggacatgagaaa

SEQ ID NO: 442600 - DNA, 25 bp, Rattus norvegicus
ggcgcgcgagtcatcttccagagtc

SEQ ID NO: 442601 - DNA, 25 bp, Rattus norvegicus
ggcgcgcgagtcttcttccagagtc

SEQ ID NO: 442602 - DNA, 25 bp, Rattus norvegicus
ggcgcgcggccgctggctgggactt

SEQ ID NO: 442603 - DNA, 25 bp, Rattus norvegicus
ggcgcgcggccggtggctgggactt

SEQ ID NO: 442604 - DNA, 25 bp, Rattus norvegicus
ggcgcgctaagtcgacaggaccctc

SEQ ID NO: 442605 - DNA, 25 bp, Rattus norvegicus
ggcgcgctaagtggacaggaccctc

SEQ ID NO: 442606 - DNA, 25 bp, Rattus norvegicus
ggcgcggaaaagatgcaccggcttt

SEQ ID NO: 442607 - DNA, 25 bp, Rattus norvegicus
ggcgcggaaaagttgcaccggcttt

SEQ ID NO: 442608 - DNA, 25 bp, Rattus norvegicus
ggcgcggacatccaagtcacaaggt

SEQ ID NO: 442609 - DNA, 25 bp, Rattus norvegicus
ggcgcggacatcgaagtcacaaggt

SEQ ID NO: 442610 - DNA, 25 bp, Rattus norvegicus
ggcgcgggaggtccatgcgagcctg

SEQ ID NO: 442611 - DNA, 25 bp, Rattus norvegicus
ggcgcgggaggtgcatgcgagcctg

SEQ ID NO: 442612 - DNA, 25 bp, Rattus norvegicus
ggcgcgggtggaacttgctaacata

SEQ ID NO: 442613 - DNA, 25 bp, Rattus norvegicus
ggcgcgggtggatcttgctaacata

SEQ ID NO: 442614 - DNA, 25 bp, Rattus norvegicus
ggcgcggtggtgaatacctgtaact

SEQ ID NO: 442615 - DNA, 25 bp, Rattus norvegicus
ggcgcggtggtgtatacctgtaact

SEQ ID NO: 442616 - DNA, 25 bp, Rattus norvegicus
ggcgcggttgcccttttgaatgcct

SEQ ID NO: 442617 - DNA, 25 bp, Rattus norvegicus
ggcgcggttgccgttttgaatgcct

SEQ ID NO: 442618 - DNA, 25 bp, Rattus norvegicus
ggcgcgtagacacacgtgagaacaa

SEQ ID NO: 442619 - DNA, 25 bp, Rattus norvegicus
ggcgcgtagacagacgtgagaacaa

SEQ ID NO: 442620 - DNA, 25 bp, Rattus norvegicus
ggcgcgtcctggaaggcatcagcaa

SEQ ID NO: 442621 - DNA, 25 bp, Rattus norvegicus
ggcgcgtcctggtaggcatcagcaa

SEQ ID NO: 442622 - DNA, 25 bp, Rattus norvegicus
ggcgcgtgacctatgtacttagaaa

SEQ ID NO: 442623 - DNA, 25 bp, Rattus norvegicus
ggcgcgtgacctttgtacttagaaa

SEQ ID NO: 442624 - DNA, 25 bp, Rattus norvegicus
ggcgcgtgactcctgacactaatga

SEQ ID NO: 442625 - DNA, 25 bp, Rattus norvegicus
ggcgcgtgactcgtgacactaatga

SEQ ID NO: 442626 - DNA, 25 bp, Rattus norvegicus
ggcgcgtgcgacctcagcgtggtgg

SEQ ID NO: 442627 - DNA, 25 bp, Rattus norvegicus
ggcgcgtgcgacgtcagcgtggtgg

SEQ ID NO: 442628 - DNA, 25 bp, Rattus norvegicus
ggcgcgttggccctctttccaaata

SEQ ID NO: 442629 - DNA, 25 bp, Rattus norvegicus
ggcgcgttggccgtctttccaaata

SEQ ID NO: 442630 - DNA, 25 bp, Rattus norvegicus
ggcgcgtttcacatttggataggtc

SEQ ID NO: 442631 - DNA, 25 bp, Rattus norvegicus
ggcgcgtttcacttttggataggtc

SEQ ID NO: 442632 - DNA, 25 bp, Rattus norvegicus
ggcgctaagcgtcatcgcaaagttc

SEQ ID NO: 442633 - DNA, 25 bp, Rattus norvegicus
ggcgctaagcgtgatcgcaaagttc

SEQ ID NO: 442634 - DNA, 25 bp, Rattus norvegicus
ggcgctaccagacacgaacacaaag

SEQ ID NO: 442635 - DNA, 25 bp, Rattus norvegicus
ggcgctaccagagacgaacacaaag

SEQ ID NO: 442636 - DNA, 25 bp, Rattus norvegicus
ggcgctacgagtacgaccactggga

SEQ ID NO: 442637 - DNA, 25 bp, Rattus norvegicus
ggcgctacgagttcgaccactggga

SEQ ID NO: 442638 - DNA, 25 bp, Rattus norvegicus
ggcgctagcagcatctgtcagaagt

SEQ ID NO: 442639 - DNA, 25 bp, Rattus norvegicus
ggcgctagcagcttctgtcagaagt

SEQ ID NO: 442640 - DNA, 25 bp, Rattus norvegicus
ggcgctatagacaaagggaactttt

SEQ ID NO: 442641 - DNA, 25 bp, Rattus norvegicus
ggcgctatagactaagggaactttt

SEQ ID NO: 442642 - DNA, 25 bp, Rattus norvegicus
ggcgctatcaggcactgcgattaga

SEQ ID NO: 442643 - DNA, 25 bp, Rattus norvegicus
ggcgctatcagggactgcgattaga

SEQ ID NO: 442644 - DNA, 25 bp, Rattus norvegicus
ggcgctatgcctaagaccagggaaa

SEQ ID NO: 442645 - DNA, 25 bp, Rattus norvegicus
ggcgctatgccttagaccagggaaa

SEQ ID NO: 442646 - DNA, 25 bp, Rattus norvegicus
ggcgctcagaagagatgaattgatc

SEQ ID NO: 442647 - DNA, 25 bp, Rattus norvegicus
ggcgctcagaagtgatgaattgatc

SEQ ID NO: 442648 - DNA, 25 bp, Rattus norvegicus
ggcgctcaggtactgcccagctcga

SEQ ID NO: 442649 - DNA, 25 bp, Rattus norvegicus
ggcgctcaggtagtgcccagctcga

SEQ ID NO: 442650 - DNA, 25 bp, Rattus norvegicus
ggcgctccagctaagaaccttttaa

SEQ ID NO: 442651 - DNA, 25 bp, Rattus norvegicus
ggcgctccagcttagaaccttttaa

SEQ ID NO: 442652 - DNA, 25 bp, Rattus norvegicus
ggcgctcgggccaatgaaatgcctt

SEQ ID NO: 442653 - DNA, 25 bp, Rattus norvegicus
ggcgctcgggcctatgaaatgcctt

SEQ ID NO: 442654 - DNA, 25 bp, Rattus norvegicus
ggcgctctaccaatcaacttgggaa

SEQ ID NO: 442655 - DNA, 25 bp, Rattus norvegicus
ggcgctctaccattcaacttgggaa

SEQ ID NO: 442656 - DNA, 25 bp, Rattus norvegicus
ggcgctctgctacaggtagctcgct

SEQ ID NO: 442657 - DNA, 25 bp, Rattus norvegicus
ggcgctctgctagaggtagctcgct

SEQ ID NO: 442658 - DNA, 25 bp, Rattus norvegicus
ggcgctctgggactcttcagcctca

SEQ ID NO: 442659 - DNA, 25 bp, Rattus norvegicus
ggcgctctgggagtcttcagcctca

SEQ ID NO: 442660 - DNA, 25 bp, Rattus norvegicus
ggcgctctgttaaggtagggccatc

SEQ ID NO: 442661 - DNA, 25 bp, Rattus norvegicus
ggcgctctgttatggtagggccatc

SEQ ID NO: 442662 - DNA, 25 bp, Rattus norvegicus
ggcgctgaaatcacctcaatagttg

SEQ ID NO: 442663 - DNA, 25 bp, Rattus norvegicus
ggcgctgaaatctcctcaatagttg

SEQ ID NO: 442664 - DNA, 25 bp, Rattus norvegicus
ggcgctgacataactaacatctgca

SEQ ID NO: 442665 - DNA, 25 bp, Rattus norvegicus
ggcgctgacatatctaacatctgca

SEQ ID NO: 442666 - DNA, 25 bp, Rattus norvegicus
ggcgctgatgtaaggcggtttcata

SEQ ID NO: 442667 - DNA, 25 bp, Rattus norvegicus
ggcgctgatgtatggcggtttcata

SEQ ID NO: 442668 - DNA, 25 bp, Rattus norvegicus
ggcgctgcaggaacctggctctgtt

SEQ ID NO: 442669 - DNA, 25 bp, Rattus norvegicus
ggcgctgcaggatcctggctctgtt

SEQ ID NO: 442670 - DNA, 25 bp, Rattus norvegicus
ggcgctgcatggccgctgagcgcag

SEQ ID NO: 442671 - DNA, 25 bp, Rattus norvegicus
ggcgctgcatgggcgctgagcgcag

SEQ ID NO: 442672 - DNA, 25 bp, Rattus norvegicus
ggcgctgccataattttgggagcat

SEQ ID NO: 442673 - DNA, 25 bp, Rattus norvegicus
ggcgctgccatatttttgggagcat

SEQ ID NO: 442674 - DNA, 25 bp, Rattus norvegicus
ggcgctgctctgataaactggacta

SEQ ID NO: 442675 - DNA, 25 bp, Rattus norvegicus
ggcgctgctctgttaaactggacta

SEQ ID NO: 442676 - DNA, 25 bp, Rattus norvegicus
ggcgctggctctccagctgttctta

SEQ ID NO: 442677 - DNA, 25 bp, Rattus norvegicus
ggcgctggctctgcagctgttctta

SEQ ID NO: 442678 - DNA, 25 bp, Rattus norvegicus
ggcgctgtacaactcaccttgtata

SEQ ID NO: 442679 - DNA, 25 bp, Rattus norvegicus
ggcgctgtacaagtcaccttgtata

SEQ ID NO: 442680 - DNA, 25 bp, Rattus norvegicus
ggcgctgtacctcatgacggagaca

SEQ ID NO: 442681 - DNA, 25 bp, Rattus norvegicus
ggcgctgtacctgatgacggagaca

SEQ ID NO: 442682 - DNA, 25 bp, Rattus norvegicus
ggcgcttaaaggcatttcattcaga

SEQ ID NO: 442683 - DNA, 25 bp, Rattus norvegicus
ggcgcttaaagggatttcattcaga

SEQ ID NO: 442684 - DNA, 25 bp, Rattus norvegicus
ggcgcttacgtcagtgctgaaggaa

SEQ ID NO: 442685 - DNA, 25 bp, Rattus norvegicus
ggcgcttacgtctgtgctgaaggaa

SEQ ID NO: 442686 - DNA, 25 bp, Rattus norvegicus
ggcgcttcatgaagacgtcgtcctg

SEQ ID NO: 442687 - DNA, 25 bp, Rattus norvegicus
ggcgcttcatgatgacgtcgtcctg

SEQ ID NO: 442688 - DNA, 25 bp, Rattus norvegicus
ggcgcttccactatcagttgtaaaa

SEQ ID NO: 442689 - DNA, 25 bp, Rattus norvegicus
ggcgcttccactttcagttgtaaaa

SEQ ID NO: 442690 - DNA, 25 bp, Rattus norvegicus
ggcgcttcccttctctttaagggag

SEQ ID NO: 442691 - DNA, 25 bp, Rattus norvegicus
ggcgcttcccttgtctttaagggag

SEQ ID NO: 442692 - DNA, 25 bp, Rattus norvegicus
ggcgcttcggtgacagcaggcaatc

SEQ ID NO: 442693 - DNA, 25 bp, Rattus norvegicus
ggcgcttcggtgtcagcaggcaatc

SEQ ID NO: 442694 - DNA, 25 bp, Rattus norvegicus
ggcgcttcttttacagaacaatgga

SEQ ID NO: 442695 - DNA, 25 bp, Rattus norvegicus
ggcgcttctttttcagaacaatgga

SEQ ID NO: 442696 - DNA, 25 bp, Rattus norvegicus
ggcgcttgcctactatgcccaagag

SEQ ID NO: 442697 - DNA, 25 bp, Rattus norvegicus
ggcgcttgcctagtatgcccaagag

SEQ ID NO: 442698 - DNA, 25 bp, Rattus norvegicus
ggcgcttggcctcatggttgcttct

SEQ ID NO: 442699 - DNA, 25 bp, Rattus norvegicus
ggcgcttggcctgatggttgcttct

SEQ ID NO: 442700 - DNA, 25 bp, Rattus norvegicus
ggcgctttatgaagtctacagttct

SEQ ID NO: 442701 - DNA, 25 bp, Rattus norvegicus
ggcgctttatgatgtctacagttct

SEQ ID NO: 442702 - DNA, 25 bp, Rattus norvegicus
ggcgctttcagaacccaaagatttg

SEQ ID NO: 442703 - DNA, 25 bp, Rattus norvegicus
ggcgctttcagatcccaaagatttg

SEQ ID NO: 442704 - DNA, 25 bp, Rattus norvegicus
ggcgctttcggtctcttcgacgacg

SEQ ID NO: 442705 - DNA, 25 bp, Rattus norvegicus
ggcgctttcggtgtcttcgacgacg

SEQ ID NO: 442706 - DNA, 25 bp, Rattus norvegicus
ggcgctttcttaatctttatccaat

SEQ ID NO: 442707 - DNA, 25 bp, Rattus norvegicus
ggcgctttcttattctttatccaat

SEQ ID NO: 442708 - DNA, 25 bp, Rattus norvegicus
ggcgctttgctacccagcatctaat

SEQ ID NO: 442709 - DNA, 25 bp, Rattus norvegicus
ggcgctttgctagccagcatctaat

SEQ ID NO: 442710 - DNA, 25 bp, Rattus norvegicus
ggcggaaaccctaagactcagagaa

SEQ ID NO: 442711 - DNA, 25 bp, Rattus norvegicus
ggcggaaacccttagactcagagaa

SEQ ID NO: 442712 - DNA, 25 bp, Rattus norvegicus
ggcggaaagccaccaggttgcacaa

SEQ ID NO: 442713 - DNA, 25 bp, Rattus norvegicus
ggcggaaagccagcaggttgcacaa

SEQ ID NO: 442714 - DNA, 25 bp, Rattus norvegicus
ggcggaaagcttcctttctctgtcc

SEQ ID NO: 442715 - DNA, 25 bp, Rattus norvegicus
ggcggaaagcttgctttctctgtcc

SEQ ID NO: 442716 - DNA, 25 bp, Rattus norvegicus
ggcggaaagttgagccgcgtcttcc

SEQ ID NO: 442717 - DNA, 25 bp, Rattus norvegicus
ggcggaaagttgtgccgcgtcttcc

SEQ ID NO: 442718 - DNA, 25 bp, Rattus norvegicus
ggcggaagcttccagagatgtctta

SEQ ID NO: 442719 - DNA, 25 bp, Rattus norvegicus
ggcggaagcttcgagagatgtctta

SEQ ID NO: 442720 - DNA, 25 bp, Rattus norvegicus
ggcggaaggtcaagctggccctacc

SEQ ID NO: 442721 - DNA, 25 bp, Rattus norvegicus
ggcggaaggtcatgctggccctacc

SEQ ID NO: 442722 - DNA, 25 bp, Rattus norvegicus
ggcggaagtacacctgctgccctca

SEQ ID NO: 442723 - DNA, 25 bp, Rattus norvegicus
ggcggaagtacagctgctgccctca

SEQ ID NO: 442724 - DNA, 25 bp, Rattus norvegicus
ggcggaatacctattagacttccag

SEQ ID NO: 442725 - DNA, 25 bp, Rattus norvegicus
ggcggaataccttttagacttccag

SEQ ID NO: 442726 - DNA, 25 bp, Rattus norvegicus
ggcggaatccaccaagactaccagt

SEQ ID NO: 442727 - DNA, 25 bp, Rattus norvegicus
ggcggaatccacgaagactaccagt

SEQ ID NO: 442728 - DNA, 25 bp, Rattus norvegicus
ggcggaattccactctaacttattt

SEQ ID NO: 442729 - DNA, 25 bp, Rattus norvegicus
ggcggaattccagtctaacttattt

SEQ ID NO: 442730 - DNA, 25 bp, Rattus norvegicus
ggcggacagggcaagggcaccgaac

SEQ ID NO: 442731 - DNA, 25 bp, Rattus norvegicus
ggcggacagggctagggcaccgaac

SEQ ID NO: 442732 - DNA, 25 bp, Rattus norvegicus
ggcggacagtgcagaccccatagaa

SEQ ID NO: 442733 - DNA, 25 bp, Rattus norvegicus
ggcggacagtgctgaccccatagaa

SEQ ID NO: 442734 - DNA, 25 bp, Rattus norvegicus
ggcggacatcccctaccaggagatc

SEQ ID NO: 442735 - DNA, 25 bp, Rattus norvegicus
ggcggacatcccgtaccaggagatc

SEQ ID NO: 442736 - DNA, 25 bp, Rattus norvegicus
ggcggacatctcaaaaacggtcatg

SEQ ID NO: 442737 - DNA, 25 bp, Rattus norvegicus
ggcggacatctctaaaacggtcatg

SEQ ID NO: 442738 - DNA, 25 bp, Rattus norvegicus
ggcggacatgccatggtgccagcca

SEQ ID NO: 442739 - DNA, 25 bp, Rattus norvegicus
ggcggacatgccttggtgccagcca

SEQ ID NO: 442740 - DNA, 25 bp, Rattus norvegicus
ggcggacccagaatctatctgtgtt

SEQ ID NO: 442741 - DNA, 25 bp, Rattus norvegicus
ggcggacccagattctatctgtgtt

SEQ ID NO: 442742 - DNA, 25 bp, Rattus norvegicus
ggcggacctgatcacagaggctaca

SEQ ID NO: 442743 - DNA, 25 bp, Rattus norvegicus
ggcggacctgatgacagaggctaca

SEQ ID NO: 442744 - DNA, 25 bp, Rattus norvegicus
ggcggactttgcaaacgccaagtgg

SEQ ID NO: 442745 - DNA, 25 bp, Rattus norvegicus
ggcggactttgctaacgccaagtgg

SEQ ID NO: 442746 - DNA, 25 bp, Rattus norvegicus
ggcggagaacaaaggcaacgtgctt

SEQ ID NO: 442747 - DNA, 25 bp, Rattus norvegicus
ggcggagaacaatggcaacgtgctt

SEQ ID NO: 442748 - DNA, 25 bp, Rattus norvegicus
ggcggagacgccatagctgcgatcc

SEQ ID NO: 442749 - DNA, 25 bp, Rattus norvegicus
ggcggagacgccttagctgcgatcc

SEQ ID NO: 442750 - DNA, 25 bp, Rattus norvegicus
ggcggagacgtcaacatcagcatta

SEQ ID NO: 442751 - DNA, 25 bp, Rattus norvegicus
ggcggagacgtctacatcagcatta

SEQ ID NO: 442752 - DNA, 25 bp, Rattus norvegicus
ggcggagaggccacatcttgaatat

SEQ ID NO: 442753 - DNA, 25 bp, Rattus norvegicus
ggcggagaggcctcatcttgaatat

SEQ ID NO: 442754 - DNA, 25 bp, Rattus norvegicus
ggcggagcactgacttcctgagaat

SEQ ID NO: 442755 - DNA, 25 bp, Rattus norvegicus
ggcggagcactgtcttcctgagaat

SEQ ID NO: 442756 - DNA, 25 bp, Rattus norvegicus
ggcggagcatagcttgtgctttcaa

SEQ ID NO: 442757 - DNA, 25 bp, Rattus norvegicus
ggcggagcataggttgtgctttcaa

SEQ ID NO: 442758 - DNA, 25 bp, Rattus norvegicus
ggcggagcctagaaccaaaacacaa

SEQ ID NO: 442759 - DNA, 25 bp, Rattus norvegicus
ggcggagcctagtaccaaaacacaa

SEQ ID NO: 442760 - DNA, 25 bp, Rattus norvegicus
ggcggaggaccaattctgccacgga

SEQ ID NO: 442761 - DNA, 25 bp, Rattus norvegicus
ggcggaggaccatttctgccacgga

SEQ ID NO: 442762 - DNA, 25 bp, Rattus norvegicus
ggcggaggatgcaccacacttgtcc

SEQ ID NO: 442763 - DNA, 25 bp, Rattus norvegicus
ggcggaggatgctccacacttgtcc

SEQ ID NO: 442764 - DNA, 25 bp, Rattus norvegicus
ggcggagtggccactgtgatggaac

SEQ ID NO: 442765 - DNA, 25 bp, Rattus norvegicus
ggcggagtggcctctgtgatggaac

SEQ ID NO: 442766 - DNA, 25 bp, Rattus norvegicus
ggcggagttgtgagaacccttccac

SEQ ID NO: 442767 - DNA, 25 bp, Rattus norvegicus
ggcggagttgtgtgaacccttccac

SEQ ID NO: 442768 - DNA, 25 bp, Rattus norvegicus
ggcggagtttgcaacaccaagctca

SEQ ID NO: 442769 - DNA, 25 bp, Rattus norvegicus
ggcggagtttgctacaccaagctca

SEQ ID NO: 442770 - DNA, 25 bp, Rattus norvegicus
ggcggatatctcagctaacatctac

SEQ ID NO: 442771 - DNA, 25 bp, Rattus norvegicus
ggcggatatctctgctaacatctac

SEQ ID NO: 442772 - DNA, 25 bp, Rattus norvegicus
ggcggatattctaactatgcaccag

SEQ ID NO: 442773 - DNA, 25 bp, Rattus norvegicus
ggcggatattcttactatgcaccag

SEQ ID NO: 442774 - DNA, 25 bp, Rattus norvegicus
ggcggatcacgcatgtgctatctta

SEQ ID NO: 442775 - DNA, 25 bp, Rattus norvegicus
ggcggatcacgcttgtgctatctta

SEQ ID NO: 442776 - DNA, 25 bp, Rattus norvegicus
ggcggatcactactatcaccaggga

SEQ ID NO: 442777 - DNA, 25 bp, Rattus norvegicus
ggcggatcactagtatcaccaggga

SEQ ID NO: 442778 - DNA, 25 bp, Rattus norvegicus
ggcggatcactcagagagcgtccaa

SEQ ID NO: 442779 - DNA, 25 bp, Rattus norvegicus
ggcggatcactctgagagcgtccaa

SEQ ID NO: 442780 - DNA, 25 bp, Rattus norvegicus
ggcggatcagatcattgagtatctc

SEQ ID NO: 442781 - DNA, 25 bp, Rattus norvegicus
ggcggatcagatgattgagtatctc

SEQ ID NO: 442782 - DNA, 25 bp, Rattus norvegicus
ggcggatctgagatttatattcgaa

SEQ ID NO: 442783 - DNA, 25 bp, Rattus norvegicus
ggcggatctgagttttatattcgaa

SEQ ID NO: 442784 - DNA, 25 bp, Rattus norvegicus
ggcggatctttcacatcgtggagga

SEQ ID NO: 442785 - DNA, 25 bp, Rattus norvegicus
ggcggatctttctcatcgtggagga

SEQ ID NO: 442786 - DNA, 25 bp, Rattus norvegicus
ggcggattagaaatcctggcatcac

SEQ ID NO: 442787 - DNA, 25 bp, Rattus norvegicus
ggcggattagaattcctggcatcac

SEQ ID NO: 442788 - DNA, 25 bp, Rattus norvegicus
ggcggattctgcacatgttcatgga

SEQ ID NO: 442789 - DNA, 25 bp, Rattus norvegicus
ggcggattctgctcatgttcatgga

SEQ ID NO: 442790 - DNA, 25 bp, Rattus norvegicus
ggcggatttaaaactctctcctgaa

SEQ ID NO: 442791 - DNA, 25 bp, Rattus norvegicus
ggcggatttaaatctctctcctgaa

SEQ ID NO: 442792 - DNA, 25 bp, Rattus norvegicus
ggcggcaaaactcagggtaccttca

SEQ ID NO: 442793 - DNA, 25 bp, Rattus norvegicus
ggcggcaaaactgagggtaccttca

SEQ ID NO: 442794 - DNA, 25 bp, Rattus norvegicus
ggcggcaacagtaggtgccctccta

SEQ ID NO: 442795 - DNA, 25 bp, Rattus norvegicus
ggcggcaacagttggtgccctccta

SEQ ID NO: 442796 - DNA, 25 bp, Rattus norvegicus
ggcggcaagaaacagagcaatctct

SEQ ID NO: 442797 - DNA, 25 bp, Rattus norvegicus
ggcggcaagaaagagagcaatctct

SEQ ID NO: 442798 - DNA, 25 bp, Rattus norvegicus
ggcggcagcacacctgggaaccaat

SEQ ID NO: 442799 - DNA, 25 bp, Rattus norvegicus
ggcggcagcacagctgggaaccaat

SEQ ID NO: 442800 - DNA, 25 bp, Rattus norvegicus
ggcggcagctttatatttaactcaa

SEQ ID NO: 442801 - DNA, 25 bp, Rattus norvegicus
ggcggcagctttttatttaactcaa

SEQ ID NO: 442802 - DNA, 25 bp, Rattus norvegicus
ggcggcaggcccacatctggtaaaa

SEQ ID NO: 442803 - DNA, 25 bp, Rattus norvegicus
ggcggcaggccctcatctggtaaaa

SEQ ID NO: 442804 - DNA, 25 bp, Rattus norvegicus
ggcggcagtattcaagcttgtgaca

SEQ ID NO: 442805 - DNA, 25 bp, Rattus norvegicus
ggcggcagtattgaagcttgtgaca

SEQ ID NO: 442806 - DNA, 25 bp, Rattus norvegicus
ggcggcatactgatttagcaataaa

SEQ ID NO: 442807 - DNA, 25 bp, Rattus norvegicus
ggcggcatactgttttagcaataaa

SEQ ID NO: 442808 - DNA, 25 bp, Rattus norvegicus
ggcggcatagcccatgttcttgagc

SEQ ID NO: 442809 - DNA, 25 bp, Rattus norvegicus
ggcggcatagccgatgttcttgagc

SEQ ID NO: 442810 - DNA, 25 bp, Rattus norvegicus
ggcggcatgtggatatggtggtaca

SEQ ID NO: 442811 - DNA, 25 bp, Rattus norvegicus
ggcggcatgtggttatggtggtaca

SEQ ID NO: 442812 - DNA, 25 bp, Rattus norvegicus
ggcggcattctgacatttacacatg

SEQ ID NO: 442813 - DNA, 25 bp, Rattus norvegicus
ggcggcattctgtcatttacacatg

SEQ ID NO: 442814 - DNA, 25 bp, Rattus norvegicus
ggcggccagagcctatcgccgggag

SEQ ID NO: 442815 - DNA, 25 bp, Rattus norvegicus
ggcggccagagcgtatcgccgggag

SEQ ID NO: 442816 - DNA, 25 bp, Rattus norvegicus
ggcggccagctgacccagtgtggat

SEQ ID NO: 442817 - DNA, 25 bp, Rattus norvegicus
ggcggccagctgtcccagtgtggat

SEQ ID NO: 442818 - DNA, 25 bp, Rattus norvegicus
ggcggccaggctaaagtctagtact

SEQ ID NO: 442819 - DNA, 25 bp, Rattus norvegicus
ggcggccaggcttaagtctagtact

SEQ ID NO: 442820 - DNA, 25 bp, Rattus norvegicus
ggcggccatgttcacaatgccttgt

SEQ ID NO: 442821 - DNA, 25 bp, Rattus norvegicus
ggcggccatgttgacaatgccttgt

SEQ ID NO: 442822 - DNA, 25 bp, Rattus norvegicus
ggcggccctaaacctctgttttttg

SEQ ID NO: 442823 - DNA, 25 bp, Rattus norvegicus
ggcggccctaaagctctgttttttg

SEQ ID NO: 442824 - DNA, 25 bp, Rattus norvegicus
ggcggccctggacgcgtcagtgctg

SEQ ID NO: 442825 - DNA, 25 bp, Rattus norvegicus
ggcggccctggaggcgtcagtgctg

SEQ ID NO: 442826 - DNA, 25 bp, Rattus norvegicus
ggcggccgaagaccagcaacccttt

SEQ ID NO: 442827 - DNA, 25 bp, Rattus norvegicus
ggcggccgaagagcagcaacccttt

SEQ ID NO: 442828 - DNA, 25 bp, Rattus norvegicus
ggcggcctcccaaagaaacacattg

SEQ ID NO: 442829 - DNA, 25 bp, Rattus norvegicus
ggcggcctcccatagaaacacattg

SEQ ID NO: 442830 - DNA, 25 bp, Rattus norvegicus
ggcggcctttgtagtgtatttggaa

SEQ ID NO: 442831 - DNA, 25 bp, Rattus norvegicus
ggcggcctttgttgtgtatttggaa

SEQ ID NO: 442832 - DNA, 25 bp, Rattus norvegicus
ggcggcgcggcgagtggtcacctgc

SEQ ID NO: 442833 - DNA, 25 bp, Rattus norvegicus
ggcggcgcggcgtgtggtcacctgc

SEQ ID NO: 442834 - DNA, 25 bp, Rattus norvegicus
ggcggcgctgacactgtggactcca

SEQ ID NO: 442835 - DNA, 25 bp, Rattus norvegicus
ggcggcgctgactctgtggactcca

SEQ ID NO: 442836 - DNA, 25 bp, Rattus norvegicus
ggcggcggaaaaaagccttcgctat

SEQ ID NO: 442837 - DNA, 25 bp, Rattus norvegicus
ggcggcggaaaatagccttcgctat

SEQ ID NO: 442838 - DNA, 25 bp, Rattus norvegicus
ggcggcggtggaaagctcaacttta

SEQ ID NO: 442839 - DNA, 25 bp, Rattus norvegicus
ggcggcggtggatagctcaacttta

SEQ ID NO: 442840 - DNA, 25 bp, Rattus norvegicus
ggcggctacggccagggctcagaaa

SEQ ID NO: 442841 - DNA, 25 bp, Rattus norvegicus
ggcggctacggcgagggctcagaaa

SEQ ID NO: 442842 - DNA, 25 bp, Rattus norvegicus
ggcggctattaacaatggactgtca

SEQ ID NO: 442843 - DNA, 25 bp, Rattus norvegicus
ggcggctattaagaatggactgtca

SEQ ID NO: 442844 - DNA, 25 bp, Rattus norvegicus
ggcggctccattcctgggcaagcat

SEQ ID NO: 442845 - DNA, 25 bp, Rattus norvegicus
ggcggctccattgctgggcaagcat

SEQ ID NO: 442846 - DNA, 25 bp, Rattus norvegicus
ggcggctctagcaaagtcttcaaca

SEQ ID NO: 442847 - DNA, 25 bp, Rattus norvegicus
ggcggctctagctaagtcttcaaca

SEQ ID NO: 442848 - DNA, 25 bp, Rattus norvegicus
ggcggctctctaaagtttgaggcca

SEQ ID NO: 442849 - DNA, 25 bp, Rattus norvegicus
ggcggctctctatagtttgaggcca

SEQ ID NO: 442850 - DNA, 25 bp, Rattus norvegicus
ggcggctcttttctgtttactaatt

SEQ ID NO: 442851 - DNA, 25 bp, Rattus norvegicus
ggcggctcttttgtgtttactaatt

SEQ ID NO: 442852 - DNA, 25 bp, Rattus norvegicus
ggcggctgccctcaaggcataccaa

SEQ ID NO: 442853 - DNA, 25 bp, Rattus norvegicus
ggcggctgccctgaaggcataccaa

SEQ ID NO: 442854 - DNA, 25 bp, Rattus norvegicus
ggcggctggaggacaccaaacttat

SEQ ID NO: 442855 - DNA, 25 bp, Rattus norvegicus
ggcggctggaggtcaccaaacttat

SEQ ID NO: 442856 - DNA, 25 bp, Rattus norvegicus
ggcggctttttcatactactgttaa

SEQ ID NO: 442857 - DNA, 25 bp, Rattus norvegicus
ggcggctttttcttactactgttaa

SEQ ID NO: 442858 - DNA, 25 bp, Rattus norvegicus
ggcgggaaacagcaatccacttgct

SEQ ID NO: 442859 - DNA, 25 bp, Rattus norvegicus
ggcgggaaacaggaatccacttgct

SEQ ID NO: 442860 - DNA, 25 bp, Rattus norvegicus
ggcgggaacgctcagggcgcggcgg

SEQ ID NO: 442861 - DNA, 25 bp, Rattus norvegicus
ggcgggaacgctgagggcgcggcgg

SEQ ID NO: 442862 - DNA, 25 bp, Rattus norvegicus
ggcgggaactgaacgtgtcatttct

SEQ ID NO: 442863 - DNA, 25 bp, Rattus norvegicus
ggcgggaactgatcgtgtcatttct

SEQ ID NO: 442864 - DNA, 25 bp, Rattus norvegicus
ggcgggaagcagctctacttacaat

SEQ ID NO: 442865 - DNA, 25 bp, Rattus norvegicus
ggcgggaagcaggtctacttacaat

SEQ ID NO: 442866 - DNA, 25 bp, Rattus norvegicus
ggcgggacacggctcttaacatttt

SEQ ID NO: 442867 - DNA, 25 bp, Rattus norvegicus
ggcgggacacgggtcttaacatttt

SEQ ID NO: 442868 - DNA, 25 bp, Rattus norvegicus
ggcgggacagcgacaccggcaatcc

SEQ ID NO: 442869 - DNA, 25 bp, Rattus norvegicus
ggcgggacagcgtcaccggcaatcc

SEQ ID NO: 442870 - DNA, 25 bp, Rattus norvegicus
ggcgggactgccagggctttccata

SEQ ID NO: 442871 - DNA, 25 bp, Rattus norvegicus
ggcgggactgcctgggctttccata

SEQ ID NO: 442872 - DNA, 25 bp, Rattus norvegicus
ggcgggcaaagaccacatgccgttt

SEQ ID NO: 442873 - DNA, 25 bp, Rattus norvegicus
ggcgggcaaagagcacatgccgttt

SEQ ID NO: 442874 - DNA, 25 bp, Rattus norvegicus
ggcgggcactacctatggagttatt

SEQ ID NO: 442875 - DNA, 25 bp, Rattus norvegicus
ggcgggcactacgtatggagttatt

SEQ ID NO: 442876 - DNA, 25 bp, Rattus norvegicus
ggcgggcactgaaggcattactctg

SEQ ID NO: 442877 - DNA, 25 bp, Rattus norvegicus
ggcgggcactgatggcattactctg

SEQ ID NO: 442878 - DNA, 25 bp, Rattus norvegicus
ggcgggcatccacgaaaccacctat

SEQ ID NO: 442879 - DNA, 25 bp, Rattus norvegicus
ggcgggcatccaggaaaccacctat

SEQ ID NO: 442880 - DNA, 25 bp, Rattus norvegicus
ggcgggccaggcaatccaggcactc

SEQ ID NO: 442881 - DNA, 25 bp, Rattus norvegicus
ggcgggccaggctatccaggcactc

SEQ ID NO: 442882 - DNA, 25 bp, Rattus norvegicus
ggcgggcctcacagtgtgtgaattc

SEQ ID NO: 442883 - DNA, 25 bp, Rattus norvegicus
ggcgggcctcactgtgtgtgaattc

SEQ ID NO: 442884 - DNA, 25 bp, Rattus norvegicus
ggcgggcgccatattaatactgctt

SEQ ID NO: 442885 - DNA, 25 bp, Rattus norvegicus
ggcgggcgccattttaatactgctt

SEQ ID NO: 442886 - DNA, 25 bp, Rattus norvegicus
ggcgggcgctctagccaatgaacct

SEQ ID NO: 442887 - DNA, 25 bp, Rattus norvegicus
ggcgggcgctcttgccaatgaacct

SEQ ID NO: 442888 - DNA, 25 bp, Rattus norvegicus
ggcgggcggctacaactgattccaa

SEQ ID NO: 442889 - DNA, 25 bp, Rattus norvegicus
ggcgggcggctagaactgattccaa

SEQ ID NO: 442890 - DNA, 25 bp, Rattus norvegicus
ggcgggcgtgaaaccatgtgtatat

SEQ ID NO: 442891 - DNA, 25 bp, Rattus norvegicus
ggcgggcgtgaatccatgtgtatat

SEQ ID NO: 442892 - DNA, 25 bp, Rattus norvegicus
ggcgggctcatgaactacttttaca

SEQ ID NO: 442893 - DNA, 25 bp, Rattus norvegicus
ggcgggctcatgtactacttttaca

SEQ ID NO: 442894 - DNA, 25 bp, Rattus norvegicus
ggcgggctgaagatgtgtttttctt

SEQ ID NO: 442895 - DNA, 25 bp, Rattus norvegicus
ggcgggctgaagttgtgtttttctt

SEQ ID NO: 442896 - DNA, 25 bp, Rattus norvegicus
ggcgggctgagcagagaactcacca

SEQ ID NO: 442897 - DNA, 25 bp, Rattus norvegicus
ggcgggctgagctgagaactcacca

SEQ ID NO: 442898 - DNA, 25 bp, Rattus norvegicus
ggcgggctgtgaacatctcggacaa

SEQ ID NO: 442899 - DNA, 25 bp, Rattus norvegicus
ggcgggctgtgatcatctcggacaa

SEQ ID NO: 442900 - DNA, 25 bp, Rattus norvegicus
ggcgggtcactgaccgtgttttaag

SEQ ID NO: 442901 - DNA, 25 bp, Rattus norvegicus
ggcgggtcactgtccgtgttttaag

SEQ ID NO: 442902 - DNA, 25 bp, Rattus norvegicus
ggcgggtggagcaagctcccataca

SEQ ID NO: 442903 - DNA, 25 bp, Rattus norvegicus
ggcgggtggagctagctcccataca

SEQ ID NO: 442904 - DNA, 25 bp, Rattus norvegicus
ggcggtacagctcaacggagtcctc

SEQ ID NO: 442905 - DNA, 25 bp, Rattus norvegicus
ggcggtacagctgaacggagtcctc

SEQ ID NO: 442906 - DNA, 25 bp, Rattus norvegicus
ggcggtaccattccacatgagaaca

SEQ ID NO: 442907 - DNA, 25 bp, Rattus norvegicus
ggcggtaccattgcacatgagaaca

SEQ ID NO: 442908 - DNA, 25 bp, Rattus norvegicus
ggcggtagctgaatctggaagcaac

SEQ ID NO: 442909 - DNA, 25 bp, Rattus norvegicus
ggcggtagctgattctggaagcaac

SEQ ID NO: 442910 - DNA, 25 bp, Rattus norvegicus
ggcggtagtgatacgctcttgatac

SEQ ID NO: 442911 - DNA, 25 bp, Rattus norvegicus
ggcggtagtgattcgctcttgatac

SEQ ID NO: 442912 - DNA, 25 bp, Rattus norvegicus
ggcggtatattgagcccatgattac

SEQ ID NO: 442913 - DNA, 25 bp, Rattus norvegicus
ggcggtatattgtgcccatgattac

SEQ ID NO: 442914 - DNA, 25 bp, Rattus norvegicus
ggcggtatgcctctcaaacgtatcc

SEQ ID NO: 442915 - DNA, 25 bp, Rattus norvegicus
ggcggtatgcctgtcaaacgtatcc

SEQ ID NO: 442916 - DNA, 25 bp, Rattus norvegicus
ggcggtcactgcagggaaatcaatt

SEQ ID NO: 442917 - DNA, 25 bp, Rattus norvegicus
ggcggtcactgctgggaaatcaatt

SEQ ID NO: 442918 - DNA, 25 bp, Rattus norvegicus
ggcggtcagctgcttgccttgccct

SEQ ID NO: 442919 - DNA, 25 bp, Rattus norvegicus
ggcggtcagctggttgccttgccct

SEQ ID NO: 442920 - DNA, 25 bp, Rattus norvegicus
ggcggtcatcacagaactgctgctg

SEQ ID NO: 442921 - DNA, 25 bp, Rattus norvegicus
ggcggtcatcactgaactgctgctg

SEQ ID NO: 442922 - DNA, 25 bp, Rattus norvegicus
ggcggtccacaactcaaggaggcaa

SEQ ID NO: 442923 - DNA, 25 bp, Rattus norvegicus
ggcggtccacaagtcaaggaggcaa

SEQ ID NO: 442924 - DNA, 25 bp, Rattus norvegicus
ggcggtccacagacgagatgagttt

SEQ ID NO: 442925 - DNA, 25 bp, Rattus norvegicus
ggcggtccacagtcgagatgagttt

SEQ ID NO: 442926 - DNA, 25 bp, Rattus norvegicus
ggcggtccgggcactcctggcggag

SEQ ID NO: 442927 - DNA, 25 bp, Rattus norvegicus
ggcggtccgggctctcctggcggag

SEQ ID NO: 442928 - DNA, 25 bp, Rattus norvegicus
ggcggtcgctcactcaaaaacaaga

SEQ ID NO: 442929 - DNA, 25 bp, Rattus norvegicus
ggcggtcgctcagtcaaaaacaaga

SEQ ID NO: 442930 - DNA, 25 bp, Rattus norvegicus
ggcggtctaccacccagaaatccaa

SEQ ID NO: 442931 - DNA, 25 bp, Rattus norvegicus
ggcggtctaccagccagaaatccaa

SEQ ID NO: 442932 - DNA, 25 bp, Rattus norvegicus
ggcggtgacaatatggctgccctca

SEQ ID NO: 442933 - DNA, 25 bp, Rattus norvegicus
ggcggtgacaatttggctgccctca

SEQ ID NO: 442934 - DNA, 25 bp, Rattus norvegicus
ggcggtgactttagtatgctatgaa

SEQ ID NO: 442935 - DNA, 25 bp, Rattus norvegicus
ggcggtgacttttgtatgctatgaa

SEQ ID NO: 442936 - DNA, 25 bp, Rattus norvegicus
ggcggtgctatgctaattgactcca

SEQ ID NO: 442937 - DNA, 25 bp, Rattus norvegicus
ggcggtgctatggtaattgactcca

SEQ ID NO: 442938 - DNA, 25 bp, Rattus norvegicus
ggcggtggaaagctcaactttattg

SEQ ID NO: 442939 - DNA, 25 bp, Rattus norvegicus
ggcggtggaaaggtcaactttattg

SEQ ID NO: 442940 - DNA, 25 bp, Rattus norvegicus
ggcggtggcaccacaaacacagtga

SEQ ID NO: 442941 - DNA, 25 bp, Rattus norvegicus
ggcggtggcacctcaaacacagtga

SEQ ID NO: 442942 - DNA, 25 bp, Rattus norvegicus
ggcggtgggcgcattatcatttctg

SEQ ID NO: 442943 - DNA, 25 bp, Rattus norvegicus
ggcggtgggcgctttatcatttctg

SEQ ID NO: 442944 - DNA, 25 bp, Rattus norvegicus
ggcggtggtggtaacatccacgtta

SEQ ID NO: 442945 - DNA, 25 bp, Rattus norvegicus
ggcggtggtggttacatccacgtta

SEQ ID NO: 442946 - DNA, 25 bp, Rattus norvegicus
ggcggtgtagccataactttctgat

SEQ ID NO: 442947 - DNA, 25 bp, Rattus norvegicus
ggcggtgtagccttaactttctgat

SEQ ID NO: 442948 - DNA, 25 bp, Rattus norvegicus
ggcggtgttcatctactggctgtcc

SEQ ID NO: 442949 - DNA, 25 bp, Rattus norvegicus
ggcggtgttcatgtactggctgtcc

SEQ ID NO: 442950 - DNA, 25 bp, Rattus norvegicus
ggcggttaagggactctcgtctgtc

SEQ ID NO: 442951 - DNA, 25 bp, Rattus norvegicus
ggcggttaagggtctctcgtctgtc

SEQ ID NO: 442952 - DNA, 25 bp, Rattus norvegicus
ggcggttaccggctacacagagcca

SEQ ID NO: 442953 - DNA, 25 bp, Rattus norvegicus
ggcggttaccgggtacacagagcca

SEQ ID NO: 442954 - DNA, 25 bp, Rattus norvegicus
ggcggttactgtctgtgtctttgat

SEQ ID NO: 442955 - DNA, 25 bp, Rattus norvegicus
ggcggttactgtgtgtgtctttgat

SEQ ID NO: 442956 - DNA, 25 bp, Rattus norvegicus
ggcggttatctgagactcttgtaaa

SEQ ID NO: 442957 - DNA, 25 bp, Rattus norvegicus
ggcggttatctgtgactcttgtaaa

SEQ ID NO: 442958 - DNA, 25 bp, Rattus norvegicus
ggcggttcaccactagagcacttgc

SEQ ID NO: 442959 - DNA, 25 bp, Rattus norvegicus
ggcggttcaccagtagagcacttgc

SEQ ID NO: 442960 - DNA, 25 bp, Rattus norvegicus
ggcggttccccaagttcaagatcag

SEQ ID NO: 442961 - DNA, 25 bp, Rattus norvegicus
ggcggttccccatgttcaagatcag

SEQ ID NO: 442962 - DNA, 25 bp, Rattus norvegicus
ggcggttctcgacttcagatttgga

SEQ ID NO: 442963 - DNA, 25 bp, Rattus norvegicus
ggcggttctcgagttcagatttgga

SEQ ID NO: 442964 - DNA, 25 bp, Rattus norvegicus
ggcggttttcgacagattggcactt

SEQ ID NO: 442965 - DNA, 25 bp, Rattus norvegicus
ggcggttttcgagagattggcactt

SEQ ID NO: 442966 - DNA, 25 bp, Rattus norvegicus
ggcgtaagccacagacaccctcggg

SEQ ID NO: 442967 - DNA, 25 bp, Rattus norvegicus
ggcgtaagccactgacaccctcggg

SEQ ID NO: 442968 - DNA, 25 bp, Rattus norvegicus
ggcgtacaataacaagaacagcaat

SEQ ID NO: 442969 - DNA, 25 bp, Rattus norvegicus
ggcgtacaataagaagaacagcaat

SEQ ID NO: 442970 - DNA, 25 bp, Rattus norvegicus
ggcgtacgccagatacaaaaactct

SEQ ID NO: 442971 - DNA, 25 bp, Rattus norvegicus
ggcgtacgccagttacaaaaactct

SEQ ID NO: 442972 - DNA, 25 bp, Rattus norvegicus
ggcgtagaccgtagcttgtgctttc

SEQ ID NO: 442973 - DNA, 25 bp, Rattus norvegicus
ggcgtagaccgttgcttgtgctttc

SEQ ID NO: 442974 - DNA, 25 bp, Rattus norvegicus
ggcgtagacgccaccttgcaggagc

SEQ ID NO: 442975 - DNA, 25 bp, Rattus norvegicus
ggcgtagacgcctccttgcaggagc

SEQ ID NO: 442976 - DNA, 25 bp, Rattus norvegicus
ggcgtagctcacatctggagctgtg

SEQ ID NO: 442977 - DNA, 25 bp, Rattus norvegicus
ggcgtagctcacttctggagctgtg

SEQ ID NO: 442978 - DNA, 25 bp, Rattus norvegicus
ggcgtagctcagagatacatcccag

SEQ ID NO: 442979 - DNA, 25 bp, Rattus norvegicus
ggcgtagctcagtgatacatcccag

SEQ ID NO: 442980 - DNA, 25 bp, Rattus norvegicus
ggcgtagggttgaccttccgtgtca

SEQ ID NO: 442981 - DNA, 25 bp, Rattus norvegicus
ggcgtagggttgtccttccgtgtca

SEQ ID NO: 442982 - DNA, 25 bp, Rattus norvegicus
ggcgtatatagcaccatcagcagtg

SEQ ID NO: 442983 - DNA, 25 bp, Rattus norvegicus
ggcgtatatagctccatcagcagtg

SEQ ID NO: 442984 - DNA, 25 bp, Rattus norvegicus
ggcgtatgaagtagctgccttactt

SEQ ID NO: 442985 - DNA, 25 bp, Rattus norvegicus
ggcgtatgaagtcaatggtccaaca

SEQ ID NO: 442986 - DNA, 25 bp, Rattus norvegicus
ggcgtatgaagtgaatggtccaaca

SEQ ID NO: 442987 - DNA, 25 bp, Rattus norvegicus
ggcgtatgaagttgctgccttactt

SEQ ID NO: 442988 - DNA, 25 bp, Rattus norvegicus
ggcgtatgtgctaaatccagagtct

SEQ ID NO: 442989 - DNA, 25 bp, Rattus norvegicus
ggcgtatgtgcttaatccagagtct

SEQ ID NO: 442990 - DNA, 25 bp, Rattus norvegicus
ggcgtattgtgtcgccatgctgaat

SEQ ID NO: 442991 - DNA, 25 bp, Rattus norvegicus
ggcgtattgtgtggccatgctgaat

SEQ ID NO: 442992 - DNA, 25 bp, Rattus norvegicus
ggcgtatttcctactgagtcagcaa

SEQ ID NO: 442993 - DNA, 25 bp, Rattus norvegicus
ggcgtatttccttctgagtcagcaa

SEQ ID NO: 442994 - DNA, 25 bp, Rattus norvegicus
ggcgtcaactccattgtgatgcaag

SEQ ID NO: 442995 - DNA, 25 bp, Rattus norvegicus
ggcgtcaactcctttgtgatgcaag

SEQ ID NO: 442996 - DNA, 25 bp, Rattus norvegicus
ggcgtcaagccacagagcagcatat

SEQ ID NO: 442997 - DNA, 25 bp, Rattus norvegicus
ggcgtcaagccagagagcagcatat

SEQ ID NO: 442998 - DNA, 25 bp, Rattus norvegicus
ggcgtcaagtttccgattaaagcca

SEQ ID NO: 442999 - DNA, 25 bp, Rattus norvegicus
ggcgtcaagtttgcgattaaagcca

SEQ ID NO: 443000 - DNA, 25 bp, Rattus norvegicus
ggcgtcaatctaaagcataccccag

SEQ ID NO: 443001 - DNA, 25 bp, Rattus norvegicus
ggcgtcaatctatagcataccccag

SEQ ID NO: 443002 - DNA, 25 bp, Rattus norvegicus
ggcgtcacggtcacggtcaccggac

SEQ ID NO: 443003 - DNA, 25 bp, Rattus norvegicus
ggcgtcacggtctcggtcaccggac

SEQ ID NO: 443004 - DNA, 25 bp, Rattus norvegicus
ggcgtcacttaccatactggaactt

SEQ ID NO: 443005 - DNA, 25 bp, Rattus norvegicus
ggcgtcacttacgatactggaactt

SEQ ID NO: 443006 - DNA, 25 bp, Rattus norvegicus
ggcgtcagaatgctgatgatccttt

SEQ ID NO: 443007 - DNA, 25 bp, Rattus norvegicus
ggcgtcagaatggtgatgatccttt

SEQ ID NO: 443008 - DNA, 25 bp, Rattus norvegicus
ggcgtcagagtaagcctctaattct

SEQ ID NO: 443009 - DNA, 25 bp, Rattus norvegicus
ggcgtcagagtatgcctctaattct

SEQ ID NO: 443010 - DNA, 25 bp, Rattus norvegicus
ggcgtcaggtgtctcaaaaagcctc

SEQ ID NO: 443011 - DNA, 25 bp, Rattus norvegicus
ggcgtcaggtgtgtcaaaaagcctc

SEQ ID NO: 443012 - DNA, 25 bp, Rattus norvegicus
ggcgtcattaggctgaagtgtcttt

SEQ ID NO: 443013 - DNA, 25 bp, Rattus norvegicus
ggcgtcattagggtgaagtgtcttt

SEQ ID NO: 443014 - DNA, 25 bp, Rattus norvegicus
ggcgtcattcctatcagtttacaga

SEQ ID NO: 443015 - DNA, 25 bp, Rattus norvegicus
ggcgtcattcctttcagtttacaga

SEQ ID NO: 443016 - DNA, 25 bp, Rattus norvegicus
ggcgtcattgatcccagttatttct

SEQ ID NO: 443017 - DNA, 25 bp, Rattus norvegicus
ggcgtcattgatgccagttatttct

SEQ ID NO: 443018 - DNA, 25 bp, Rattus norvegicus
ggcgtccaattccatcctgagtttt

SEQ ID NO: 443019 - DNA, 25 bp, Rattus norvegicus
ggcgtccaattcgatcctgagtttt

SEQ ID NO: 443020 - DNA, 25 bp, Rattus norvegicus
ggcgtccagtcacataaccattttg

SEQ ID NO: 443021 - DNA, 25 bp, Rattus norvegicus
ggcgtccagtcagataaccattttg

SEQ ID NO: 443022 - DNA, 25 bp, Rattus norvegicus
ggcgtcccagtgaccaaccaaagaa

SEQ ID NO: 443023 - DNA, 25 bp, Rattus norvegicus
ggcgtcccagtgtccaaccaaagaa

SEQ ID NO: 443024 - DNA, 25 bp, Rattus norvegicus
ggcgtccctgtactcatttagttac

SEQ ID NO: 443025 - DNA, 25 bp, Rattus norvegicus
ggcgtccctgtagtcatttagttac

SEQ ID NO: 443026 - DNA, 25 bp, Rattus norvegicus
ggcgtccgcttgaggcagttactaa

SEQ ID NO: 443027 - DNA, 25 bp, Rattus norvegicus
ggcgtccgcttgtggcagttactaa

SEQ ID NO: 443028 - DNA, 25 bp, Rattus norvegicus
ggcgtcctaattcttgcgtaactgg

SEQ ID NO: 443029 - DNA, 25 bp, Rattus norvegicus
ggcgtcctaattgttgcgtaactgg

SEQ ID NO: 443030 - DNA, 25 bp, Rattus norvegicus
ggcgtcctgagacaggtgactactt

SEQ ID NO: 443031 - DNA, 25 bp, Rattus norvegicus
ggcgtcctgagagaggtgactactt

SEQ ID NO: 443032 - DNA, 25 bp, Rattus norvegicus
ggcgtccttagtcacacactgaagt

SEQ ID NO: 443033 - DNA, 25 bp, Rattus norvegicus
ggcgtccttagtgacacactgaagt

SEQ ID NO: 443034 - DNA, 25 bp, Rattus norvegicus
ggcgtcgaacttatctgggtccagg

SEQ ID NO: 443035 - DNA, 25 bp, Rattus norvegicus
ggcgtcgaacttttctgggtccagg

SEQ ID NO: 443036 - DNA, 25 bp, Rattus norvegicus
ggcgtcgactttccctatagtctag

SEQ ID NO: 443037 - DNA, 25 bp, Rattus norvegicus
ggcgtcgactttgcctatagtctag

SEQ ID NO: 443038 - DNA, 25 bp, Rattus norvegicus
ggcgtcggaaaaactccgctgccgc

SEQ ID NO: 443039 - DNA, 25 bp, Rattus norvegicus
ggcgtcggaaaatctccgctgccgc

SEQ ID NO: 443040 - DNA, 25 bp, Rattus norvegicus
ggcgtcgggcctaacaaatgtaaat

SEQ ID NO: 443041 - DNA, 25 bp, Rattus norvegicus
ggcgtcgggccttacaaatgtaaat

SEQ ID NO: 443042 - DNA, 25 bp, Rattus norvegicus
ggcgtcgtgcccaagaacagcagaa

SEQ ID NO: 443043 - DNA, 25 bp, Rattus norvegicus
ggcgtcgtgccctagaacagcagaa

SEQ ID NO: 443044 - DNA, 25 bp, Rattus norvegicus
ggcgtctaaggacgattacactgct

SEQ ID NO: 443045 - DNA, 25 bp, Rattus norvegicus
ggcgtctaaggaggattacactgct

SEQ ID NO: 443046 - DNA, 25 bp, Rattus norvegicus
ggcgtctaaggtagaccatgctcaa

SEQ ID NO: 443047 - DNA, 25 bp, Rattus norvegicus
ggcgtctaaggttgaccatgctcaa

SEQ ID NO: 443048 - DNA, 25 bp, Rattus norvegicus
ggcgtctaggcactagcacagattt

SEQ ID NO: 443049 - DNA, 25 bp, Rattus norvegicus
ggcgtctaggcagtagcacagattt

SEQ ID NO: 443050 - DNA, 25 bp, Rattus norvegicus
ggcgtctatctgacttaatgaatag

SEQ ID NO: 443051 - DNA, 25 bp, Rattus norvegicus
ggcgtctatctgtcttaatgaatag

SEQ ID NO: 443052 - DNA, 25 bp, Rattus norvegicus
ggcgtctcacgtctgtgtgtttaac

SEQ ID NO: 443053 - DNA, 25 bp, Rattus norvegicus
ggcgtctcacgtgtgtgtgtttaac

SEQ ID NO: 443054 - DNA, 25 bp, Rattus norvegicus
ggcgtctcagatccggtaaggcttc

SEQ ID NO: 443055 - DNA, 25 bp, Rattus norvegicus
ggcgtctcagatgcggtaaggcttc

SEQ ID NO: 443056 - DNA, 25 bp, Rattus norvegicus
ggcgtctcaggcctcgattccacag

SEQ ID NO: 443057 - DNA, 25 bp, Rattus norvegicus
ggcgtctcaggcgtcgattccacag

SEQ ID NO: 443058 - DNA, 25 bp, Rattus norvegicus
ggcgtctccagaatacctgatggca

SEQ ID NO: 443059 - DNA, 25 bp, Rattus norvegicus
ggcgtctccagattacctgatggca

SEQ ID NO: 443060 - DNA, 25 bp, Rattus norvegicus
ggcgtctcgggtcttcggctccaac

SEQ ID NO: 443061 - DNA, 25 bp, Rattus norvegicus
ggcgtctcgggtgttcggctccaac

SEQ ID NO: 443062 - DNA, 25 bp, Rattus norvegicus
ggcgtctcgtttatggctaattgat

SEQ ID NO: 443063 - DNA, 25 bp, Rattus norvegicus
ggcgtctcgtttttggctaattgat

SEQ ID NO: 443064 - DNA, 25 bp, Rattus norvegicus
ggcgtctctaggaatgcagctttta

SEQ ID NO: 443065 - DNA, 25 bp, Rattus norvegicus
ggcgtctctaggtatgcagctttta

SEQ ID NO: 443066 - DNA, 25 bp, Rattus norvegicus
ggcgtctgactcacaccagatagtt

SEQ ID NO: 443067 - DNA, 25 bp, Rattus norvegicus
ggcgtctgactctcaccagatagtt

SEQ ID NO: 443068 - DNA, 25 bp, Rattus norvegicus
ggcgtctgcctcaccgaaagacaga

SEQ ID NO: 443069 - DNA, 25 bp, Rattus norvegicus
ggcgtctgcctctccgaaagacaga

SEQ ID NO: 443070 - DNA, 25 bp, Rattus norvegicus
ggcgtctggcagaaacactgagcat

SEQ ID NO: 443071 - DNA, 25 bp, Rattus norvegicus
ggcgtctggcagtaacactgagcat

SEQ ID NO: 443072 - DNA, 25 bp, Rattus norvegicus
ggcgtctgtaacctctttacaacat

SEQ ID NO: 443073 - DNA, 25 bp, Rattus norvegicus
ggcgtctgtaacgtctttacaacat

SEQ ID NO: 443074 - DNA, 25 bp, Rattus norvegicus
ggcgtcttccagagtggctaccaaa

SEQ ID NO: 443075 - DNA, 25 bp, Rattus norvegicus
ggcgtcttccagtgtggctaccaaa

SEQ ID NO: 443076 - DNA, 25 bp, Rattus norvegicus
ggcgtcttcttccaaacatggttca

SEQ ID NO: 443077 - DNA, 25 bp, Rattus norvegicus
ggcgtcttcttcgaaacatggttca

SEQ ID NO: 443078 - DNA, 25 bp, Rattus norvegicus
ggcgtcttggtgaattctgcttctc

SEQ ID NO: 443079 - DNA, 25 bp, Rattus norvegicus
ggcgtcttggtgtattctgcttctc

SEQ ID NO: 443080 - DNA, 25 bp, Rattus norvegicus
ggcgtgaacatcctcagtgctcgat

SEQ ID NO: 443081 - DNA, 25 bp, Rattus norvegicus
ggcgtgaacatcgtcagtgctcgat

SEQ ID NO: 443082 - DNA, 25 bp, Rattus norvegicus
ggcgtgaaccgcatactagataatg

SEQ ID NO: 443083 - DNA, 25 bp, Rattus norvegicus
ggcgtgaaccgcttactagataatg

SEQ ID NO: 443084 - DNA, 25 bp, Rattus norvegicus
ggcgtgaagccaacaagcatgacag

SEQ ID NO: 443085 - DNA, 25 bp, Rattus norvegicus
ggcgtgaagccatcaagcatgacag

SEQ ID NO: 443086 - DNA, 25 bp, Rattus norvegicus
ggcgtgaaggccacggcaagctctt

SEQ ID NO: 443087 - DNA, 25 bp, Rattus norvegicus
ggcgtgaaggcctcggcaagctctt

SEQ ID NO: 443088 - DNA, 25 bp, Rattus norvegicus
ggcgtgacagatcgcttcttttgct

SEQ ID NO: 443089 - DNA, 25 bp, Rattus norvegicus
ggcgtgacagatggcttcttttgct

SEQ ID NO: 443090 - DNA, 25 bp, Rattus norvegicus
ggcgtgagacgcactgattcagctg

SEQ ID NO: 443091 - DNA, 25 bp, Rattus norvegicus
ggcgtgagacgctctgattcagctg

SEQ ID NO: 443092 - DNA, 25 bp, Rattus norvegicus
ggcgtgagacttatgcaacctgcag

SEQ ID NO: 443093 - DNA, 25 bp, Rattus norvegicus
ggcgtgagacttttgcaacctgcag

SEQ ID NO: 443094 - DNA, 25 bp, Rattus norvegicus
ggcgtgagagttccctgtccttggg

SEQ ID NO: 443095 - DNA, 25 bp, Rattus norvegicus
ggcgtgagagttgcctgtccttggg

SEQ ID NO: 443096 - DNA, 25 bp, Rattus norvegicus
ggcgtgagctaaatgcagcagtcaa

SEQ ID NO: 443097 - DNA, 25 bp, Rattus norvegicus
ggcgtgagctaattgcagcagtcaa

SEQ ID NO: 443098 - DNA, 25 bp, Rattus norvegicus
ggcgtgatcatcattgttattccat

SEQ ID NO: 443099 - DNA, 25 bp, Rattus norvegicus
ggcgtgatcatctttgttattccat

SEQ ID NO: 443100 - DNA, 25 bp, Rattus norvegicus
ggcgtgatccggctgccagcgcaca

SEQ ID NO: 443101 - DNA, 25 bp, Rattus norvegicus
ggcgtgatccgggtgccagcgcaca

SEQ ID NO: 443102 - DNA, 25 bp, Rattus norvegicus
ggcgtgatgcctaccgatgaacagt

SEQ ID NO: 443103 - DNA, 25 bp, Rattus norvegicus
ggcgtgatgccttccgatgaacagt

SEQ ID NO: 443104 - DNA, 25 bp, Rattus norvegicus
ggcgtgcctcgtccctgataaaagg

SEQ ID NO: 443105 - DNA, 25 bp, Rattus norvegicus
ggcgtgcctcgtgcctgataaaagg

SEQ ID NO: 443106 - DNA, 25 bp, Rattus norvegicus
ggcgtgccttaaataaaaccagtca

SEQ ID NO: 443107 - DNA, 25 bp, Rattus norvegicus
ggcgtgccttaattaaaaccagtca

SEQ ID NO: 443108 - DNA, 25 bp, Rattus norvegicus
ggcgtgcgccatcagacgtaccgct

SEQ ID NO: 443109 - DNA, 25 bp, Rattus norvegicus
ggcgtgcgccatgagacgtaccgct

SEQ ID NO: 443110 - DNA, 25 bp, Rattus norvegicus
ggcgtgcgtccgcaaaacatcattc

SEQ ID NO: 443111 - DNA, 25 bp, Rattus norvegicus
ggcgtgcgtccggaaaacatcattc

SEQ ID NO: 443112 - DNA, 25 bp, Rattus norvegicus
ggcgtgcttcaacaggcactggaca

SEQ ID NO: 443113 - DNA, 25 bp, Rattus norvegicus
ggcgtgcttcaagaggcactggaca

SEQ ID NO: 443114 - DNA, 25 bp, Rattus norvegicus
ggcgtggacaaacttttataaggtg

SEQ ID NO: 443115 - DNA, 25 bp, Rattus norvegicus
ggcgtggacaaagttttataaggtg

SEQ ID NO: 443116 - DNA, 25 bp, Rattus norvegicus
ggcgtggagtatactgtccgacaaa

SEQ ID NO: 443117 - DNA, 25 bp, Rattus norvegicus
ggcgtggagtattctgtccgacaaa

SEQ ID NO: 443118 - DNA, 25 bp, Rattus norvegicus
ggcgtgggatgtactgacaacacca

SEQ ID NO: 443119 - DNA, 25 bp, Rattus norvegicus
ggcgtgggatgttctgacaacacca

SEQ ID NO: 443120 - DNA, 25 bp, Rattus norvegicus
ggcgtgggtcacaggtacagctcaa

SEQ ID NO: 443121 - DNA, 25 bp, Rattus norvegicus
ggcgtgggtcactggtacagctcaa

SEQ ID NO: 443122 - DNA, 25 bp, Rattus norvegicus
ggcgtgtagcatatagaccagtatt

SEQ ID NO: 443123 - DNA, 25 bp, Rattus norvegicus
ggcgtgtagcatttagaccagtatt

SEQ ID NO: 443124 - DNA, 25 bp, Rattus norvegicus
ggcgtgtatattataatctggctca

SEQ ID NO: 443125 - DNA, 25 bp, Rattus norvegicus
ggcgtgtatattttaatctggctca

SEQ ID NO: 443126 - DNA, 25 bp, Rattus norvegicus
ggcgtgtccacgatactcaggagga

SEQ ID NO: 443127 - DNA, 25 bp, Rattus norvegicus
ggcgtgtccacgttactcaggagga

SEQ ID NO: 443128 - DNA, 25 bp, Rattus norvegicus
ggcgtgttctttatgccagcaaatg

SEQ ID NO: 443129 - DNA, 25 bp, Rattus norvegicus
ggcgtgttctttttgccagcaaatg

SEQ ID NO: 443130 - DNA, 25 bp, Rattus norvegicus
ggcgtgtttgatccgcttttaactt

SEQ ID NO: 443131 - DNA, 25 bp, Rattus norvegicus
ggcgtgtttgatgcgcttttaactt

SEQ ID NO: 443132 - DNA, 25 bp, Rattus norvegicus
ggcgtgtttgcactacttcctcaga

SEQ ID NO: 443133 - DNA, 25 bp, Rattus norvegicus
ggcgtgtttgcagtacttcctcaga

SEQ ID NO: 443134 - DNA, 25 bp, Rattus norvegicus
ggcgtgttttccagggctgataaca

SEQ ID NO: 443135 - DNA, 25 bp, Rattus norvegicus
ggcgtgttttcctgggctgataaca

SEQ ID NO: 443136 - DNA, 25 bp, Rattus norvegicus
ggcgttacacgaccttcagcaagag

SEQ ID NO: 443137 - DNA, 25 bp, Rattus norvegicus
ggcgttacacgagcttcagcaagag

SEQ ID NO: 443138 - DNA, 25 bp, Rattus norvegicus
ggcgttacatacacttacccatgag

SEQ ID NO: 443139 - DNA, 25 bp, Rattus norvegicus
ggcgttacatactcttacccatgag

SEQ ID NO: 443140 - DNA, 25 bp, Rattus norvegicus
ggcgttactcagagatcacgggtaa

SEQ ID NO: 443141 - DNA, 25 bp, Rattus norvegicus
ggcgttactcagtgatcacgggtaa

SEQ ID NO: 443142 - DNA, 25 bp, Rattus norvegicus
ggcgttatgcaaatcgttgccctgt

SEQ ID NO: 443143 - DNA, 25 bp, Rattus norvegicus
ggcgttatgcaattcgttgccctgt

SEQ ID NO: 443144 - DNA, 25 bp, Rattus norvegicus
ggcgttcagttgacactgtggcaca

SEQ ID NO: 443145 - DNA, 25 bp, Rattus norvegicus
ggcgttcagttgtcactgtggcaca

SEQ ID NO: 443146 - DNA, 25 bp, Rattus norvegicus
ggcgttcgtctacttatgtatcaca

SEQ ID NO: 443147 - DNA, 25 bp, Rattus norvegicus
ggcgttcgtctagttatgtatcaca

SEQ ID NO: 443148 - DNA, 25 bp, Rattus norvegicus
ggcgttctccagaggattccacgga

SEQ ID NO: 443149 - DNA, 25 bp, Rattus norvegicus
ggcgttctccagtggattccacgga

SEQ ID NO: 443150 - DNA, 25 bp, Rattus norvegicus
ggcgttgagatgatttgcactattc

SEQ ID NO: 443151 - DNA, 25 bp, Rattus norvegicus
ggcgttgagatgttttgcactattc

SEQ ID NO: 443152 - DNA, 25 bp, Rattus norvegicus
ggcgttgatgctatgggtctgaata

SEQ ID NO: 443153 - DNA, 25 bp, Rattus norvegicus
ggcgttgatgctttgggtctgaata

SEQ ID NO: 443154 - DNA, 25 bp, Rattus norvegicus
ggcgttgcctctaagagaaatccat

SEQ ID NO: 443155 - DNA, 25 bp, Rattus norvegicus
ggcgttgcctcttagagaaatccat

SEQ ID NO: 443156 - DNA, 25 bp, Rattus norvegicus
ggcgttgctccacttggttatgtaa

SEQ ID NO: 443157 - DNA, 25 bp, Rattus norvegicus
ggcgttgctccagttggttatgtaa

SEQ ID NO: 443158 - DNA, 25 bp, Rattus norvegicus
ggcgttggaaacagcactttatatt

SEQ ID NO: 443159 - DNA, 25 bp, Rattus norvegicus
ggcgttggaaactgcactttatatt

SEQ ID NO: 443160 - DNA, 25 bp, Rattus norvegicus
ggcgttggcattacgatcactaagt

SEQ ID NO: 443161 - DNA, 25 bp, Rattus norvegicus
ggcgttggcatttcgatcactaagt

SEQ ID NO: 443162 - DNA, 25 bp, Rattus norvegicus
ggcgttgttataaggccctggaaca

SEQ ID NO: 443163 - DNA, 25 bp, Rattus norvegicus
ggcgttgttatatggccctggaaca

SEQ ID NO: 443164 - DNA, 25 bp, Rattus norvegicus
ggcgttgtttccattttcacagtat

SEQ ID NO: 443165 - DNA, 25 bp, Rattus norvegicus
ggcgttgtttcctttttcacagtat

SEQ ID NO: 443166 - DNA, 25 bp, Rattus norvegicus
ggcgtttagttcaggtaactctgta

SEQ ID NO: 443167 - DNA, 25 bp, Rattus norvegicus
ggcgtttagttctggtaactctgta

SEQ ID NO: 443168 - DNA, 25 bp, Rattus norvegicus
ggcgtttcctgcagctcaataagtg

SEQ ID NO: 443169 - DNA, 25 bp, Rattus norvegicus
ggcgtttcctgctgctcaataagtg

SEQ ID NO: 443170 - DNA, 25 bp, Rattus norvegicus
ggcgtttcggcgagtacctggacta

SEQ ID NO: 443171 - DNA, 25 bp, Rattus norvegicus
ggcgtttcggcgtgtacctggacta

SEQ ID NO: 443172 - DNA, 25 bp, Rattus norvegicus
ggcgtttctaaacctagtcgcagac

SEQ ID NO: 443173 - DNA, 25 bp, Rattus norvegicus
ggcgtttctaaagctagtcgcagac

SEQ ID NO: 443174 - DNA, 25 bp, Rattus norvegicus
ggcgtttctaacaattggaaatcct

SEQ ID NO: 443175 - DNA, 25 bp, Rattus norvegicus
ggcgtttctaactattggaaatcct

SEQ ID NO: 443176 - DNA, 25 bp, Rattus norvegicus
ggcgtttgaagaccccagcctttag

SEQ ID NO: 443177 - DNA, 25 bp, Rattus norvegicus
ggcgtttgaagagcccagcctttag

SEQ ID NO: 443178 - DNA, 25 bp, Rattus norvegicus
ggcgtttgtgccctctgcatccgca

SEQ ID NO: 443179 - DNA, 25 bp, Rattus norvegicus
ggcgtttgtgccgtctgcatccgca

SEQ ID NO: 443180 - DNA, 25 bp, Rattus norvegicus
ggcgtttgttccagaacgccgcctc

SEQ ID NO: 443181 - DNA, 25 bp, Rattus norvegicus
ggcgtttgttcctgaacgccgcctc

SEQ ID NO: 443182 - DNA, 25 bp, Rattus norvegicus
ggcgttttacatattacactctttg

SEQ ID NO: 443183 - DNA, 25 bp, Rattus norvegicus
ggcgttttacattttacactctttg

SEQ ID NO: 443184 - DNA, 25 bp, Rattus norvegicus
ggcgttttatttcacctctaactct

SEQ ID NO: 443185 - DNA, 25 bp, Rattus norvegicus
ggcgttttatttgacctctaactct

SEQ ID NO: 443186 - DNA, 25 bp, Rattus norvegicus
ggcgttttcacaataagtcacctcc

SEQ ID NO: 443187 - DNA, 25 bp, Rattus norvegicus
ggcgttttcacattaagtcacctcc

SEQ ID NO: 443188 - DNA, 25 bp, Rattus norvegicus
ggcgttttggaacaggccacagttt

SEQ ID NO: 443189 - DNA, 25 bp, Rattus norvegicus
ggcgttttggaagaggccacagttt

SEQ ID NO: 443190 - DNA, 25 bp, Rattus norvegicus
ggcgtttttacaaccctttgagcaa

SEQ ID NO: 443191 - DNA, 25 bp, Rattus norvegicus
ggcgtttttacatccctttgagcaa

SEQ ID NO: 443192 - DNA, 25 bp, Rattus norvegicus
ggcgtttttgctcggacaaaccctg

SEQ ID NO: 443193 - DNA, 25 bp, Rattus norvegicus
ggcgtttttgctgggacaaaccctg

SEQ ID NO: 443194 - DNA, 25 bp, Rattus norvegicus
ggctaaaacattctaggcttaggtt

SEQ ID NO: 443195 - DNA, 25 bp, Rattus norvegicus
ggctaaaacattgtaggcttaggtt

SEQ ID NO: 443196 - DNA, 25 bp, Rattus norvegicus
ggctaaaagcctcactaaccctgtt

SEQ ID NO: 443197 - DNA, 25 bp, Rattus norvegicus
ggctaaaagcctgactaaccctgtt

SEQ ID NO: 443198 - DNA, 25 bp, Rattus norvegicus
ggctaaaatcaccaactgttcctaa

SEQ ID NO: 443199 - DNA, 25 bp, Rattus norvegicus
ggctaaaatcacgaactgttcctaa

SEQ ID NO: 443200 - DNA, 25 bp, Rattus norvegicus
ggctaaacagcccatatccccgtta

SEQ ID NO: 443201 - DNA, 25 bp, Rattus norvegicus
ggctaaacagccgatatccccgtta

SEQ ID NO: 443202 - DNA, 25 bp, Rattus norvegicus
ggctaaaccgagacagtgtttccaa

SEQ ID NO: 443203 - DNA, 25 bp, Rattus norvegicus
ggctaaaccgagtcagtgtttccaa

SEQ ID NO: 443204 - DNA, 25 bp, Rattus norvegicus
ggctaaacctacacaccattcggga

SEQ ID NO: 443205 - DNA, 25 bp, Rattus norvegicus
ggctaaacctactcaccattcggga

SEQ ID NO: 443206 - DNA, 25 bp, Rattus norvegicus
ggctaaactattcgcatccctggga

SEQ ID NO: 443207 - DNA, 25 bp, Rattus norvegicus
ggctaaactattggcatccctggga

SEQ ID NO: 443208 - DNA, 25 bp, Rattus norvegicus
ggctaaactccaatgtcactttgac

SEQ ID NO: 443209 - DNA, 25 bp, Rattus norvegicus
ggctaaactccattgtcactttgac

SEQ ID NO: 443210 - DNA, 25 bp, Rattus norvegicus
ggctaaactcgacccaagtttcaat

SEQ ID NO: 443211 - DNA, 25 bp, Rattus norvegicus
ggctaaactcgagccaagtttcaat

SEQ ID NO: 443212 - DNA, 25 bp, Rattus norvegicus
ggctaaactcggcttcgttgtatga

SEQ ID NO: 443213 - DNA, 25 bp, Rattus norvegicus
ggctaaactcgggttcgttgtatga

SEQ ID NO: 443214 - DNA, 25 bp, Rattus norvegicus
ggctaaactggtctcagtccttttt

SEQ ID NO: 443215 - DNA, 25 bp, Rattus norvegicus
ggctaaactggtgtcagtccttttt

SEQ ID NO: 443216 - DNA, 25 bp, Rattus norvegicus
ggctaaacttttcgcgtgcaggcat

SEQ ID NO: 443217 - DNA, 25 bp, Rattus norvegicus
ggctaaacttttggcgtgcaggcat

SEQ ID NO: 443218 - DNA, 25 bp, Rattus norvegicus
ggctaaagaaatcatcccagggagg

SEQ ID NO: 443219 - DNA, 25 bp, Rattus norvegicus
ggctaaagaaatgatcccagggagg

SEQ ID NO: 443220 - DNA, 25 bp, Rattus norvegicus
ggctaaagatcaacgtgtatactgt

SEQ ID NO: 443221 - DNA, 25 bp, Rattus norvegicus
ggctaaagatcatcgtgtatactgt

SEQ ID NO: 443222 - DNA, 25 bp, Rattus norvegicus
ggctaaagatgacaccgacatctag

SEQ ID NO: 443223 - DNA, 25 bp, Rattus norvegicus
ggctaaagatgagaccgacatctag

SEQ ID NO: 443224 - DNA, 25 bp, Rattus norvegicus
ggctaaagcacaatgctatccctga

SEQ ID NO: 443225 - DNA, 25 bp, Rattus norvegicus
ggctaaagcacattgctatccctga

SEQ ID NO: 443226 - DNA, 25 bp, Rattus norvegicus
ggctaaagctgaactcatcctgagt

SEQ ID NO: 443227 - DNA, 25 bp, Rattus norvegicus
ggctaaagctgatctcatcctgagt

SEQ ID NO: 443228 - DNA, 25 bp, Rattus norvegicus
ggctaaagctggacaaggaccgcaa

SEQ ID NO: 443229 - DNA, 25 bp, Rattus norvegicus
ggctaaagctggtcaaggaccgcaa

SEQ ID NO: 443230 - DNA, 25 bp, Rattus norvegicus
ggctaaaggatcagccagcatccta

SEQ ID NO: 443231 - DNA, 25 bp, Rattus norvegicus
ggctaaaggatctgccagcatccta

SEQ ID NO: 443232 - DNA, 25 bp, Rattus norvegicus
ggctaaagggtcaggccagtcttcc

SEQ ID NO: 443233 - DNA, 25 bp, Rattus norvegicus
ggctaaagggtctggccagtcttcc

SEQ ID NO: 443234 - DNA, 25 bp, Rattus norvegicus
ggctaaataatgctccattgtatgg

SEQ ID NO: 443235 - DNA, 25 bp, Rattus norvegicus
ggctaaataatggtccattgtatgg

SEQ ID NO: 443236 - DNA, 25 bp, Rattus norvegicus
ggctaaatacagatcactccggtga

SEQ ID NO: 443237 - DNA, 25 bp, Rattus norvegicus
ggctaaatacagttcactccggtga

SEQ ID NO: 443238 - DNA, 25 bp, Rattus norvegicus
ggctaaatagtaatatcttggctta

SEQ ID NO: 443239 - DNA, 25 bp, Rattus norvegicus
ggctaaatagtattatcttggctta

SEQ ID NO: 443240 - DNA, 25 bp, Rattus norvegicus
ggctaaatccacagtagctctcatg

SEQ ID NO: 443241 - DNA, 25 bp, Rattus norvegicus
ggctaaatccactgtagctctcatg

SEQ ID NO: 443242 - DNA, 25 bp, Rattus norvegicus
ggctaaatcgaacctttcagactta

SEQ ID NO: 443243 - DNA, 25 bp, Rattus norvegicus
ggctaaatcgaagctttcagactta

SEQ ID NO: 443244 - DNA, 25 bp, Rattus norvegicus
ggctaaatcttaaccccagaaaagg

SEQ ID NO: 443245 - DNA, 25 bp, Rattus norvegicus
ggctaaatcttatccccagaaaagg

SEQ ID NO: 443246 - DNA, 25 bp, Rattus norvegicus
ggctaaatctttagccattcactgg

SEQ ID NO: 443247 - DNA, 25 bp, Rattus norvegicus
ggctaaatcttttgccattcactgg

SEQ ID NO: 443248 - DNA, 25 bp, Rattus norvegicus
ggctaaatgaatattatccctaaca

SEQ ID NO: 443249 - DNA, 25 bp, Rattus norvegicus
ggctaaatgaattttatccctaaca

SEQ ID NO: 443250 - DNA, 25 bp, Rattus norvegicus
ggctaaatgccactaaacccagcaa

SEQ ID NO: 443251 - DNA, 25 bp, Rattus norvegicus
ggctaaatgccagtaaacccagcaa

SEQ ID NO: 443252 - DNA, 25 bp, Rattus norvegicus
ggctaaatgcttcgccatgctgatg

SEQ ID NO: 443253 - DNA, 25 bp, Rattus norvegicus
ggctaaatgcttggccatgctgatg

SEQ ID NO: 443254 - DNA, 25 bp, Rattus norvegicus
ggctaaatgtttcctaccttcgttt

SEQ ID NO: 443255 - DNA, 25 bp, Rattus norvegicus
ggctaaatgtttgctaccttcgttt

SEQ ID NO: 443256 - DNA, 25 bp, Rattus norvegicus
ggctaaattctccttggttggcatt

SEQ ID NO: 443257 - DNA, 25 bp, Rattus norvegicus
ggctaaattctcgttggttggcatt

SEQ ID NO: 443258 - DNA, 25 bp, Rattus norvegicus
ggctaaattgggatccttgtgtcag

SEQ ID NO: 443259 - DNA, 25 bp, Rattus norvegicus
ggctaaattgggttccttgtgtcag

SEQ ID NO: 443260 - DNA, 25 bp, Rattus norvegicus
ggctaacacagcagcgggtgcgccc

SEQ ID NO: 443261 - DNA, 25 bp, Rattus norvegicus
ggctaacacagctgcgggtgcgccc

SEQ ID NO: 443262 - DNA, 25 bp, Rattus norvegicus
ggctaacacaggatgcagttgctaa

SEQ ID NO: 443263 - DNA, 25 bp, Rattus norvegicus
ggctaacacaggttgcagttgctaa

SEQ ID NO: 443264 - DNA, 25 bp, Rattus norvegicus
ggctaacacctgagctttgtgtgat

SEQ ID NO: 443265 - DNA, 25 bp, Rattus norvegicus
ggctaacacctgtgctttgtgtgat

SEQ ID NO: 443266 - DNA, 25 bp, Rattus norvegicus
ggctaacacgagatcttgccaacgt

SEQ ID NO: 443267 - DNA, 25 bp, Rattus norvegicus
ggctaacacgagttcttgccaacgt

SEQ ID NO: 443268 - DNA, 25 bp, Rattus norvegicus
ggctaacacgatcatctgactcagt

SEQ ID NO: 443269 - DNA, 25 bp, Rattus norvegicus
ggctaacacgatgatctgactcagt

SEQ ID NO: 443270 - DNA, 25 bp, Rattus norvegicus
ggctaacagcgtcttgctcttccag

SEQ ID NO: 443271 - DNA, 25 bp, Rattus norvegicus
ggctaacagcgtgttgctcttccag

SEQ ID NO: 443272 - DNA, 25 bp, Rattus norvegicus
ggctaacatccaagagaccctaagt

SEQ ID NO: 443273 - DNA, 25 bp, Rattus norvegicus
ggctaacatccatgagaccctaagt

SEQ ID NO: 443274 - DNA, 25 bp, Rattus norvegicus
ggctaacatttcattggcgcatggt

SEQ ID NO: 443275 - DNA, 25 bp, Rattus norvegicus
ggctaacatttctttggcgcatggt

SEQ ID NO: 443276 - DNA, 25 bp, Rattus norvegicus
ggctaacctgccaacttcagggata

SEQ ID NO: 443277 - DNA, 25 bp, Rattus norvegicus
ggctaacctgcctacttcagggata

SEQ ID NO: 443278 - DNA, 25 bp, Rattus norvegicus
ggctaaccttaccatctctgagaag

SEQ ID NO: 443279 - DNA, 25 bp, Rattus norvegicus
ggctaaccttacgatctctgagaag

SEQ ID NO: 443280 - DNA, 25 bp, Rattus norvegicus
ggctaacggttcatgtcagaggaat

SEQ ID NO: 443281 - DNA, 25 bp, Rattus norvegicus
ggctaacggttcttgtcagaggaat

SEQ ID NO: 443282 - DNA, 25 bp, Rattus norvegicus
ggctaacgttgactccagcattgga

SEQ ID NO: 443283 - DNA, 25 bp, Rattus norvegicus
ggctaacgttgagtccagcattgga

SEQ ID NO: 443284 - DNA, 25 bp, Rattus norvegicus
ggctaactaacaatggttatctgtg

SEQ ID NO: 443285 - DNA, 25 bp, Rattus norvegicus
ggctaactaacattggttatctgtg

SEQ ID NO: 443286 - DNA, 25 bp, Rattus norvegicus
ggctaactacagatgtttgtcagca

SEQ ID NO: 443287 - DNA, 25 bp, Rattus norvegicus
ggctaactacagttgtttgtcagca

SEQ ID NO: 443288 - DNA, 25 bp, Rattus norvegicus
ggctaactaccgaggctttgtcagg

SEQ ID NO: 443289 - DNA, 25 bp, Rattus norvegicus
ggctaactaccgtggctttgtcagg

SEQ ID NO: 443290 - DNA, 25 bp, Rattus norvegicus
ggctaactatagatactgtgctgta

SEQ ID NO: 443291 - DNA, 25 bp, Rattus norvegicus
ggctaactatagttactgtgctgta

SEQ ID NO: 443292 - DNA, 25 bp, Rattus norvegicus
ggctaactcgaaagccctttattta

SEQ ID NO: 443293 - DNA, 25 bp, Rattus norvegicus
ggctaactcgaatgccctttattta

SEQ ID NO: 443294 - DNA, 25 bp, Rattus norvegicus
ggctaactgttaaggacgcctcatc

SEQ ID NO: 443295 - DNA, 25 bp, Rattus norvegicus
ggctaactgttatggacgcctcatc

SEQ ID NO: 443296 - DNA, 25 bp, Rattus norvegicus
ggctaacttgtaaatcccatgtaaa

SEQ ID NO: 443297 - DNA, 25 bp, Rattus norvegicus
ggctaacttgtatatcccatgtaaa

SEQ ID NO: 443298 - DNA, 25 bp, Rattus norvegicus
ggctaactttccctagacagattct

SEQ ID NO: 443299 - DNA, 25 bp, Rattus norvegicus
ggctaactttccgtagacagattct

SEQ ID NO: 443300 - DNA, 25 bp, Rattus norvegicus
ggctaagaacaacgacttgccagaa

SEQ ID NO: 443301 - DNA, 25 bp, Rattus norvegicus
ggctaagaacaaggacttgccagaa

SEQ ID NO: 443302 - DNA, 25 bp, Rattus norvegicus
ggctaagaactcctccttcaagatt

SEQ ID NO: 443303 - DNA, 25 bp, Rattus norvegicus
ggctaagaactcgtccttcaagatt

SEQ ID NO: 443304 - DNA, 25 bp, Rattus norvegicus
ggctaagaatccacctcagacagaa

SEQ ID NO: 443305 - DNA, 25 bp, Rattus norvegicus
ggctaagaatcctcctcagacagaa

SEQ ID NO: 443306 - DNA, 25 bp, Rattus norvegicus
ggctaagatgcccaggaaacctgta

SEQ ID NO: 443307 - DNA, 25 bp, Rattus norvegicus
ggctaagatgccgaggaaacctgta

SEQ ID NO: 443308 - DNA, 25 bp, Rattus norvegicus
ggctaagcatacagttcataggcca

SEQ ID NO: 443309 - DNA, 25 bp, Rattus norvegicus
ggctaagcatactgttcataggcca

SEQ ID NO: 443310 - DNA, 25 bp, Rattus norvegicus
ggctaagccacacgcccgaagactg

SEQ ID NO: 443311 - DNA, 25 bp, Rattus norvegicus
ggctaagccacaggcccgaagactg

SEQ ID NO: 443312 - DNA, 25 bp, Rattus norvegicus
ggctaagcctccatggtgctgttga

SEQ ID NO: 443313 - DNA, 25 bp, Rattus norvegicus
ggctaagcctccttggtgctgttga

SEQ ID NO: 443314 - DNA, 25 bp, Rattus norvegicus
ggctaagcgttcatcagatgccctg

SEQ ID NO: 443315 - DNA, 25 bp, Rattus norvegicus
ggctaagcgttcttcagatgccctg

SEQ ID NO: 443316 - DNA, 25 bp, Rattus norvegicus
ggctaagctagcctggaaatcatta

SEQ ID NO: 443317 - DNA, 25 bp, Rattus norvegicus
ggctaagctagcgtggaaatcatta

SEQ ID NO: 443318 - DNA, 25 bp, Rattus norvegicus
ggctaagctcatcagatcccagtaa

SEQ ID NO: 443319 - DNA, 25 bp, Rattus norvegicus
ggctaagctcatgagatcccagtaa

SEQ ID NO: 443320 - DNA, 25 bp, Rattus norvegicus
ggctaaggaaacaccatttcatggt

SEQ ID NO: 443321 - DNA, 25 bp, Rattus norvegicus
ggctaaggaaactccatttcatggt

SEQ ID NO: 443322 - DNA, 25 bp, Rattus norvegicus
ggctaaggctgcatggacccttgag

SEQ ID NO: 443323 - DNA, 25 bp, Rattus norvegicus
ggctaaggctgcttggacccttgag

SEQ ID NO: 443324 - DNA, 25 bp, Rattus norvegicus
ggctaaggtcttcacttagggtgtc

SEQ ID NO: 443325 - DNA, 25 bp, Rattus norvegicus
ggctaaggtcttgacttagggtgtc

SEQ ID NO: 443326 - DNA, 25 bp, Rattus norvegicus
ggctaagtctgtattattactcttc

SEQ ID NO: 443327 - DNA, 25 bp, Rattus norvegicus
ggctaagtctgttttattactcttc

SEQ ID NO: 443328 - DNA, 25 bp, Rattus norvegicus
ggctaagtgcagattctgtggaaca

SEQ ID NO: 443329 - DNA, 25 bp, Rattus norvegicus
ggctaagtgcagtttctgtggaaca

SEQ ID NO: 443330 - DNA, 25 bp, Rattus norvegicus
ggctaagtggtcagctaaaaatgct

SEQ ID NO: 443331 - DNA, 25 bp, Rattus norvegicus
ggctaagtggtctgctaaaaatgct

SEQ ID NO: 443332 - DNA, 25 bp, Rattus norvegicus
ggctaagtgtgcagtgaactctctg

SEQ ID NO: 443333 - DNA, 25 bp, Rattus norvegicus
ggctaagtgtgctgtgaactctctg

SEQ ID NO: 443334 - DNA, 25 bp, Rattus norvegicus
ggctaataacacacccggcagagga

SEQ ID NO: 443335 - DNA, 25 bp, Rattus norvegicus
ggctaataacactcccggcagagga

SEQ ID NO: 443336 - DNA, 25 bp, Rattus norvegicus
ggctaataaggaaccaaactcttgt

SEQ ID NO: 443337 - DNA, 25 bp, Rattus norvegicus
ggctaataaggatccaaactcttgt

SEQ ID NO: 443338 - DNA, 25 bp, Rattus norvegicus
ggctaatagcagaggaggctgcccc

SEQ ID NO: 443339 - DNA, 25 bp, Rattus norvegicus
ggctaatagcagtggaggctgcccc

SEQ ID NO: 443340 - DNA, 25 bp, Rattus norvegicus
ggctaatagctcagctgcagggaat

SEQ ID NO: 443341 - DNA, 25 bp, Rattus norvegicus
ggctaatagctctgctgcagggaat

SEQ ID NO: 443342 - DNA, 25 bp, Rattus norvegicus
ggctaatagttactgctcacctgac

SEQ ID NO: 443343 - DNA, 25 bp, Rattus norvegicus
ggctaatagttagtgctcacctgac

SEQ ID NO: 443344 - DNA, 25 bp, Rattus norvegicus
ggctaatattccattgttctgctta

SEQ ID NO: 443345 - DNA, 25 bp, Rattus norvegicus
ggctaatattcctttgttctgctta

SEQ ID NO: 443346 - DNA, 25 bp, Rattus norvegicus
ggctaatcaagtaccctgagatcat

SEQ ID NO: 443347 - DNA, 25 bp, Rattus norvegicus
ggctaatcaagttccctgagatcat

SEQ ID NO: 443348 - DNA, 25 bp, Rattus norvegicus
ggctaatccaaacttcaagggcaga

SEQ ID NO: 443349 - DNA, 25 bp, Rattus norvegicus
ggctaatccaaagttcaagggcaga

SEQ ID NO: 443350 - DNA, 25 bp, Rattus norvegicus
ggctaatctagcatgttggtcggta

SEQ ID NO: 443351 - DNA, 25 bp, Rattus norvegicus
ggctaatctagcttgttggtcggta

SEQ ID NO: 443352 - DNA, 25 bp, Rattus norvegicus
ggctaatctgtgaatctcttgatag

SEQ ID NO: 443353 - DNA, 25 bp, Rattus norvegicus
ggctaatctgtgtatctcttgatag

SEQ ID NO: 443354 - DNA, 25 bp, Rattus norvegicus
ggctaatcttgtatcctttcatcta

SEQ ID NO: 443355 - DNA, 25 bp, Rattus norvegicus
ggctaatcttgtttcctttcatcta

SEQ ID NO: 443356 - DNA, 25 bp, Rattus norvegicus
ggctaatctttacgaccaaggtcgt

SEQ ID NO: 443357 - DNA, 25 bp, Rattus norvegicus
ggctaatctttaggaccaaggtcgt

SEQ ID NO: 443358 - DNA, 25 bp, Rattus norvegicus
ggctaatctttccatggctcaggat

SEQ ID NO: 443359 - DNA, 25 bp, Rattus norvegicus
ggctaatctttcgatggctcaggat

SEQ ID NO: 443360 - DNA, 25 bp, Rattus norvegicus
ggctaatgaccaaacacccaggcaa

SEQ ID NO: 443361 - DNA, 25 bp, Rattus norvegicus
ggctaatgaccatacacccaggcaa

SEQ ID NO: 443362 - DNA, 25 bp, Rattus norvegicus
ggctaatgatgtacgctgctgggaa

SEQ ID NO: 443363 - DNA, 25 bp, Rattus norvegicus
ggctaatgatgttcgctgctgggaa

SEQ ID NO: 443364 - DNA, 25 bp, Rattus norvegicus
ggctaatgtctaaccagcttgtatt

SEQ ID NO: 443365 - DNA, 25 bp, Rattus norvegicus
ggctaatgtctatccagcttgtatt

SEQ ID NO: 443366 - DNA, 25 bp, Rattus norvegicus
ggctaatgttttagctagcattgca

SEQ ID NO: 443367 - DNA, 25 bp, Rattus norvegicus
ggctaatgtttttgctagcattgca

SEQ ID NO: 443368 - DNA, 25 bp, Rattus norvegicus
ggctaattagggaccaccgctcggg

SEQ ID NO: 443369 - DNA, 25 bp, Rattus norvegicus
ggctaattagggtccaccgctcggg

SEQ ID NO: 443370 - DNA, 25 bp, Rattus norvegicus
ggctaattatgtcctgtgtttcaga

SEQ ID NO: 443371 - DNA, 25 bp, Rattus norvegicus
ggctaattatgtgctgtgtttcaga

SEQ ID NO: 443372 - DNA, 25 bp, Rattus norvegicus
ggctaattccaacatctcttttacc

SEQ ID NO: 443373 - DNA, 25 bp, Rattus norvegicus
ggctaattccaagatctcttttacc

SEQ ID NO: 443374 - DNA, 25 bp, Rattus norvegicus
ggctaattcctgacgctggacatga

SEQ ID NO: 443375 - DNA, 25 bp, Rattus norvegicus
ggctaattcctgtcgctggacatga

SEQ ID NO: 443376 - DNA, 25 bp, Rattus norvegicus
ggctaattgcccaaatacacttgtt

SEQ ID NO: 443377 - DNA, 25 bp, Rattus norvegicus
ggctaattgccctaatacacttgtt

SEQ ID NO: 443378 - DNA, 25 bp, Rattus norvegicus
ggctaattttacattcccatgataa

SEQ ID NO: 443379 - DNA, 25 bp, Rattus norvegicus
ggctaattttactttcccatgataa

SEQ ID NO: 443380 - DNA, 25 bp, Rattus norvegicus
ggctacaaacacatacacatgcaga

SEQ ID NO: 443381 - DNA, 25 bp, Rattus norvegicus
ggctacaaacacttacacatgcaga

SEQ ID NO: 443382 - DNA, 25 bp, Rattus norvegicus
ggctacaacgaaattttcctggact

SEQ ID NO: 443383 - DNA, 25 bp, Rattus norvegicus
ggctacaacgaatttttcctggact

SEQ ID NO: 443384 - DNA, 25 bp, Rattus norvegicus
ggctacaatcaaatactgcaggaat

SEQ ID NO: 443385 - DNA, 25 bp, Rattus norvegicus
ggctacaatcaattactgcaggaat

SEQ ID NO: 443386 - DNA, 25 bp, Rattus norvegicus
ggctacacatttaaatggggctggg

SEQ ID NO: 443387 - DNA, 25 bp, Rattus norvegicus
ggctacacattttaatggggctggg

SEQ ID NO: 443388 - DNA, 25 bp, Rattus norvegicus
ggctacacctccagaagaccgttga

SEQ ID NO: 443389 - DNA, 25 bp, Rattus norvegicus
ggctacacctcctgaagaccgttga

SEQ ID NO: 443390 - DNA, 25 bp, Rattus norvegicus
ggctacactgagcaccaggttgtct

SEQ ID NO: 443391 - DNA, 25 bp, Rattus norvegicus
ggctacactgaggaccaggttgtct

SEQ ID NO: 443392 - DNA, 25 bp, Rattus norvegicus
ggctacacttgaatgtctcttggac

SEQ ID NO: 443393 - DNA, 25 bp, Rattus norvegicus
ggctacacttgattgtctcttggac

SEQ ID NO: 443394 - DNA, 25 bp, Rattus norvegicus
ggctacagaagaaccgtctacccac

SEQ ID NO: 443395 - DNA, 25 bp, Rattus norvegicus
ggctacagaagatccgtctacccac

SEQ ID NO: 443396 - DNA, 25 bp, Rattus norvegicus
ggctacagagtcaccaggagtctat

SEQ ID NO: 443397 - DNA, 25 bp, Rattus norvegicus
ggctacagagtctccaggagtctat

SEQ ID NO: 443398 - DNA, 25 bp, Rattus norvegicus
ggctacagatttccggtaagtgttt

SEQ ID NO: 443399 - DNA, 25 bp, Rattus norvegicus
ggctacagatttgcggtaagtgttt

SEQ ID NO: 443400 - DNA, 25 bp, Rattus norvegicus
ggctacagcaatcgcctagtggttt

SEQ ID NO: 443401 - DNA, 25 bp, Rattus norvegicus
ggctacagcaatggcctagtggttt

SEQ ID NO: 443402 - DNA, 25 bp, Rattus norvegicus
ggctacagccagctttcagaaggca

SEQ ID NO: 443403 - DNA, 25 bp, Rattus norvegicus
ggctacagccaggtttcagaaggca

SEQ ID NO: 443404 - DNA, 25 bp, Rattus norvegicus
ggctacagcctcattgagttcgaca

SEQ ID NO: 443405 - DNA, 25 bp, Rattus norvegicus
ggctacagcctctttgagttcgaca

SEQ ID NO: 443406 - DNA, 25 bp, Rattus norvegicus
ggctacagcctgaactggatgggcc

SEQ ID NO: 443407 - DNA, 25 bp, Rattus norvegicus
ggctacagcctgtactggatgggcc

SEQ ID NO: 443408 - DNA, 25 bp, Rattus norvegicus
ggctacagctggctcaggatttttg

SEQ ID NO: 443409 - DNA, 25 bp, Rattus norvegicus
ggctacagctgggtcaggatttttg

SEQ ID NO: 443410 - DNA, 25 bp, Rattus norvegicus
ggctacaggcaaatccagtgttcat

SEQ ID NO: 443411 - DNA, 25 bp, Rattus norvegicus
ggctacaggcaattccagtgttcat

SEQ ID NO: 443412 - DNA, 25 bp, Rattus norvegicus
ggctacagggccatgggtcctgctc

SEQ ID NO: 443413 - DNA, 25 bp, Rattus norvegicus
ggctacagggccttgggtcctgctc

SEQ ID NO: 443414 - DNA, 25 bp, Rattus norvegicus
ggctacagtacactatcgtcggcaa

SEQ ID NO: 443415 - DNA, 25 bp, Rattus norvegicus
ggctacagtacagtatcgtcggcaa

SEQ ID NO: 443416 - DNA, 25 bp, Rattus norvegicus
ggctacagttttatcaacattgaac

SEQ ID NO: 443417 - DNA, 25 bp, Rattus norvegicus
ggctacagttttttcaacattgaac

SEQ ID NO: 443418 - DNA, 25 bp, Rattus norvegicus
ggctacataaacattcctggtccaa

SEQ ID NO: 443419 - DNA, 25 bp, Rattus norvegicus
ggctacataaactttcctggtccaa

SEQ ID NO: 443420 - DNA, 25 bp, Rattus norvegicus
ggctacataagtccctctcagaaag

SEQ ID NO: 443421 - DNA, 25 bp, Rattus norvegicus
ggctacataagtgcctctcagaaag

SEQ ID NO: 443422 - DNA, 25 bp, Rattus norvegicus
ggctacatagtgaaatcaggtctaa

SEQ ID NO: 443423 - DNA, 25 bp, Rattus norvegicus
ggctacatagtgtaatcaggtctaa

SEQ ID NO: 443424 - DNA, 25 bp, Rattus norvegicus
ggctacatcgcactgagtaagcatt

SEQ ID NO: 443425 - DNA, 25 bp, Rattus norvegicus
ggctacatcgcagtgagtaagcatt

SEQ ID NO: 443426 - DNA, 25 bp, Rattus norvegicus
ggctacatcgttcctaagaattctg

SEQ ID NO: 443427 - DNA, 25 bp, Rattus norvegicus
ggctacatcgttgctaagaattctg

SEQ ID NO: 443428 - DNA, 25 bp, Rattus norvegicus
ggctacatctggcacttgattcatg

SEQ ID NO: 443429 - DNA, 25 bp, Rattus norvegicus
ggctacatctgggacttgattcatg

SEQ ID NO: 443430 - DNA, 25 bp, Rattus norvegicus
ggctacatcttgatgctcagactat

SEQ ID NO: 443431 - DNA, 25 bp, Rattus norvegicus
ggctacatcttgttgctcagactat

SEQ ID NO: 443432 - DNA, 25 bp, Rattus norvegicus
ggctacatgaacatgcagcttgcaa

SEQ ID NO: 443433 - DNA, 25 bp, Rattus norvegicus
ggctacatgaacttgcagcttgcaa

SEQ ID NO: 443434 - DNA, 25 bp, Rattus norvegicus
ggctacatgaatcagacaccccagt

SEQ ID NO: 443435 - DNA, 25 bp, Rattus norvegicus
ggctacatgaatgagacaccccagt

SEQ ID NO: 443436 - DNA, 25 bp, Rattus norvegicus
ggctacatgccaagcccatgataat

SEQ ID NO: 443437 - DNA, 25 bp, Rattus norvegicus
ggctacatgccatgcccatgataat

SEQ ID NO: 443438 - DNA, 25 bp, Rattus norvegicus
ggctacatggcaccagcaagacaga

SEQ ID NO: 443439 - DNA, 25 bp, Rattus norvegicus
ggctacatggcagcagcaagacaga

SEQ ID NO: 443440 - DNA, 25 bp, Rattus norvegicus
ggctacattcttaattctgcggtga

SEQ ID NO: 443441 - DNA, 25 bp, Rattus norvegicus
ggctacattctttattctgcggtga

SEQ ID NO: 443442 - DNA, 25 bp, Rattus norvegicus
ggctaccacgggacgagagcgccaa

SEQ ID NO: 443443 - DNA, 25 bp, Rattus norvegicus
ggctaccacgggtcgagagcgccaa

SEQ ID NO: 443444 - DNA, 25 bp, Rattus norvegicus
ggctaccactgcctgttgggagatg

SEQ ID NO: 443445 - DNA, 25 bp, Rattus norvegicus
ggctaccactgcgtgttgggagatg

SEQ ID NO: 443446 - DNA, 25 bp, Rattus norvegicus
ggctaccacttgagtttttccttat

SEQ ID NO: 443447 - DNA, 25 bp, Rattus norvegicus
ggctaccacttgtgtttttccttat

SEQ ID NO: 443448 - DNA, 25 bp, Rattus norvegicus
ggctaccactttactgcacagagag

SEQ ID NO: 443449 - DNA, 25 bp, Rattus norvegicus
ggctaccacttttctgcacagagag

SEQ ID NO: 443450 - DNA, 25 bp, Rattus norvegicus
ggctaccataccagtgaccgatttg

SEQ ID NO: 443451 - DNA, 25 bp, Rattus norvegicus
ggctaccatacctgtgaccgatttg

SEQ ID NO: 443452 - DNA, 25 bp, Rattus norvegicus
ggctaccatagcaatttgttctttg

SEQ ID NO: 443453 - DNA, 25 bp, Rattus norvegicus
ggctaccatagctatttgttctttg

SEQ ID NO: 443454 - DNA, 25 bp, Rattus norvegicus
ggctaccatgcaaccatacataaat

SEQ ID NO: 443455 - DNA, 25 bp, Rattus norvegicus
ggctaccatgcatccatacataaat

SEQ ID NO: 443456 - DNA, 25 bp, Rattus norvegicus
ggctacccagccctattggagagga

SEQ ID NO: 443457 - DNA, 25 bp, Rattus norvegicus
ggctacccagccgtattggagagga

SEQ ID NO: 443458 - DNA, 25 bp, Rattus norvegicus
ggctacccaggaactagtcacatat

SEQ ID NO: 443459 - DNA, 25 bp, Rattus norvegicus
ggctacccaggatctagtcacatat

SEQ ID NO: 443460 - DNA, 25 bp, Rattus norvegicus
ggctacccaggcacctactccaggt

SEQ ID NO: 443461 - DNA, 25 bp, Rattus norvegicus
ggctacccaggctcctactccaggt

SEQ ID NO: 443462 - DNA, 25 bp, Rattus norvegicus
ggctaccccatgactctatgtgtgg

SEQ ID NO: 443463 - DNA, 25 bp, Rattus norvegicus
ggctaccccatgtctctatgtgtgg

SEQ ID NO: 443464 - DNA, 25 bp, Rattus norvegicus
ggctacccctgacctacagtataag

SEQ ID NO: 443465 - DNA, 25 bp, Rattus norvegicus
ggctacccctgagctacagtataag

SEQ ID NO: 443466 - DNA, 25 bp, Rattus norvegicus
ggctacccggaaactgcaggtgtta

SEQ ID NO: 443467 - DNA, 25 bp, Rattus norvegicus
ggctacccggaatctgcaggtgtta

SEQ ID NO: 443468 - DNA, 25 bp, Rattus norvegicus
ggctaccctggaactatctatatag

SEQ ID NO: 443469 - DNA, 25 bp, Rattus norvegicus
ggctaccctggatctatctatatag

SEQ ID NO: 443470 - DNA, 25 bp, Rattus norvegicus
ggctacctaaggcacaatccatgtt

SEQ ID NO: 443471 - DNA, 25 bp, Rattus norvegicus
ggctacctaagggacaatccatgtt

SEQ ID NO: 443472 - DNA, 25 bp, Rattus norvegicus
ggctacctaataagaccctgatgga

SEQ ID NO: 443473 - DNA, 25 bp, Rattus norvegicus
ggctacctaatatgaccctgatgga

SEQ ID NO: 443474 - DNA, 25 bp, Rattus norvegicus
ggctacctagagacctattttaaat

SEQ ID NO: 443475 - DNA, 25 bp, Rattus norvegicus
ggctacctagagtcctattttaaat

SEQ ID NO: 443476 - DNA, 25 bp, Rattus norvegicus
ggctacctatttagggtggcaccat

SEQ ID NO: 443477 - DNA, 25 bp, Rattus norvegicus
ggctacctattttgggtggcaccat

SEQ ID NO: 443478 - DNA, 25 bp, Rattus norvegicus
ggctacctcaccaaacttgtttaga

SEQ ID NO: 443479 - DNA, 25 bp, Rattus norvegicus
ggctacctcacctaacttgtttaga

SEQ ID NO: 443480 - DNA, 25 bp, Rattus norvegicus
ggctacctcttgctcaggtggaaat

SEQ ID NO: 443481 - DNA, 25 bp, Rattus norvegicus
ggctacctcttggtcaggtggaaat

SEQ ID NO: 443482 - DNA, 25 bp, Rattus norvegicus
ggctacctgcctctgaagcagttct

SEQ ID NO: 443483 - DNA, 25 bp, Rattus norvegicus
ggctacctgcctgtgaagcagttct

SEQ ID NO: 443484 - DNA, 25 bp, Rattus norvegicus
ggctacctggccagatagaattttg

SEQ ID NO: 443485 - DNA, 25 bp, Rattus norvegicus
ggctacctggcctgatagaattttg

SEQ ID NO: 443486 - DNA, 25 bp, Rattus norvegicus
ggctaccttagaccctatgtcaaaa

SEQ ID NO: 443487 - DNA, 25 bp, Rattus norvegicus
ggctaccttagagcctatgtcaaaa

SEQ ID NO: 443488 - DNA, 25 bp, Rattus norvegicus
ggctaccttattcaatgtccctgat

SEQ ID NO: 443489 - DNA, 25 bp, Rattus norvegicus
ggctaccttattgaatgtccctgat

SEQ ID NO: 443490 - DNA, 25 bp, Rattus norvegicus
ggctaccttcagaactgtcttgcaa

SEQ ID NO: 443491 - DNA, 25 bp, Rattus norvegicus
ggctaccttcagtactgtcttgcaa

SEQ ID NO: 443492 - DNA, 25 bp, Rattus norvegicus
ggctacgaagccagaaacagtctca

SEQ ID NO: 443493 - DNA, 25 bp, Rattus norvegicus
ggctacgaagcctgaaacagtctca

SEQ ID NO: 443494 - DNA, 25 bp, Rattus norvegicus
ggctacgagtagattgacatgtgct

SEQ ID NO: 443495 - DNA, 25 bp, Rattus norvegicus
ggctacgagtagtttgacatgtgct

SEQ ID NO: 443496 - DNA, 25 bp, Rattus norvegicus
ggctacgccgagattatcaatgcag

SEQ ID NO: 443497 - DNA, 25 bp, Rattus norvegicus
ggctacgccgagcttctgagaattc

SEQ ID NO: 443498 - DNA, 25 bp, Rattus norvegicus
ggctacgccgaggttctgagaattc

SEQ ID NO: 443499 - DNA, 25 bp, Rattus norvegicus
ggctacgccgagtttatcaatgcag

SEQ ID NO: 443500 - DNA, 25 bp, Rattus norvegicus
ggctacgcctctctgacaaaatatt

SEQ ID NO: 443501 - DNA, 25 bp, Rattus norvegicus
ggctacgcctctgtgacaaaatatt

SEQ ID NO: 443502 - DNA, 25 bp, Rattus norvegicus
ggctacgctgtcactgattatctca

SEQ ID NO: 443503 - DNA, 25 bp, Rattus norvegicus
ggctacgctgtctctgattatctca

SEQ ID NO: 443504 - DNA, 25 bp, Rattus norvegicus
ggctacgtaagaatctgttgtctca

SEQ ID NO: 443505 - DNA, 25 bp, Rattus norvegicus
ggctacgtaagattctgttgtctca

SEQ ID NO: 443506 - DNA, 25 bp, Rattus norvegicus
ggctacgtcctacgtacggtaggat

SEQ ID NO: 443507 - DNA, 25 bp, Rattus norvegicus
ggctacgtcctaggtacggtaggat

SEQ ID NO: 443508 - DNA, 25 bp, Rattus norvegicus
ggctactactatacggacacaggga

SEQ ID NO: 443509 - DNA, 25 bp, Rattus norvegicus
ggctactactattcggacacaggga

SEQ ID NO: 443510 - DNA, 25 bp, Rattus norvegicus
ggctactacttcattattgtgctcc

SEQ ID NO: 443511 - DNA, 25 bp, Rattus norvegicus
ggctactacttctttattgtgctcc

SEQ ID NO: 443512 - DNA, 25 bp, Rattus norvegicus
ggctactcctatcacctacaagtgg

SEQ ID NO: 443513 - DNA, 25 bp, Rattus norvegicus
ggctactcctatgacctacaagtgg

SEQ ID NO: 443514 - DNA, 25 bp, Rattus norvegicus
ggctactctagcaacagcaacggta

SEQ ID NO: 443515 - DNA, 25 bp, Rattus norvegicus
ggctactctagctacagcaacggta

SEQ ID NO: 443516 - DNA, 25 bp, Rattus norvegicus
ggctactctgggatcatgaaacacg

SEQ ID NO: 443517 - DNA, 25 bp, Rattus norvegicus
ggctactctgggttcatgaaacacg

SEQ ID NO: 443518 - DNA, 25 bp, Rattus norvegicus
ggctactcttcccaagaaccaggag

SEQ ID NO: 443519 - DNA, 25 bp, Rattus norvegicus
ggctactcttccgaagaaccaggag

SEQ ID NO: 443520 - DNA, 25 bp, Rattus norvegicus
ggctactctttgatatccatgcttt

SEQ ID NO: 443521 - DNA, 25 bp, Rattus norvegicus
ggctactctttgttatccatgcttt

SEQ ID NO: 443522 - DNA, 25 bp, Rattus norvegicus
ggctactgaaggctcgcacgcgttc

SEQ ID NO: 443523 - DNA, 25 bp, Rattus norvegicus
ggctactgaagggtcgcacgcgttc

SEQ ID NO: 443524 - DNA, 25 bp, Rattus norvegicus
ggctactgcagcaggtaccgaggat

SEQ ID NO: 443525 - DNA, 25 bp, Rattus norvegicus
ggctactgcagctggtaccgaggat

SEQ ID NO: 443526 - DNA, 25 bp, Rattus norvegicus
ggctactggcagacatgatcacggg

SEQ ID NO: 443527 - DNA, 25 bp, Rattus norvegicus
ggctactggcagtcatgatcacggg

SEQ ID NO: 443528 - DNA, 25 bp, Rattus norvegicus
ggctactggtacatcagcaaaaaga

SEQ ID NO: 443529 - DNA, 25 bp, Rattus norvegicus
ggctactggtacttcagcaaaaaga

SEQ ID NO: 443530 - DNA, 25 bp, Rattus norvegicus
ggctactggtggcattattggctat

SEQ ID NO: 443531 - DNA, 25 bp, Rattus norvegicus
ggctactggtgggattattggctat

SEQ ID NO: 443532 - DNA, 25 bp, Rattus norvegicus
ggctactgtgtaactgtgacttcaa

SEQ ID NO: 443533 - DNA, 25 bp, Rattus norvegicus
ggctactgtgtatctgtgacttcaa

SEQ ID NO: 443534 - DNA, 25 bp, Rattus norvegicus
ggctactgtgtcaacatgtctgcat

SEQ ID NO: 443535 - DNA, 25 bp, Rattus norvegicus
ggctactgtgtctacatgtctgcat

SEQ ID NO: 443536 - DNA, 25 bp, Rattus norvegicus
ggctacttaccaccttaatgctatt

SEQ ID NO: 443537 - DNA, 25 bp, Rattus norvegicus
ggctacttaccagcttaatgctatt

SEQ ID NO: 443538 - DNA, 25 bp, Rattus norvegicus
ggctacttagtaactgtgtttttgc

SEQ ID NO: 443539 - DNA, 25 bp, Rattus norvegicus
ggctacttagtatctgtgtttttgc

SEQ ID NO: 443540 - DNA, 25 bp, Rattus norvegicus
ggctacttcccaatggtgataaagt

SEQ ID NO: 443541 - DNA, 25 bp, Rattus norvegicus
ggctacttcccattggtgataaagt

SEQ ID NO: 443542 - DNA, 25 bp, Rattus norvegicus
ggctacttcctgactaaaatcttcc

SEQ ID NO: 443543 - DNA, 25 bp, Rattus norvegicus
ggctacttcctgtctaaaatcttcc

SEQ ID NO: 443544 - DNA, 25 bp, Rattus norvegicus
ggctacttctgacgtgaaaccaaaa

SEQ ID NO: 443545 - DNA, 25 bp, Rattus norvegicus
ggctacttctgaggtgaaaccaaaa

SEQ ID NO: 443546 - DNA, 25 bp, Rattus norvegicus
ggctactttcccaaatacagacaaa

SEQ ID NO: 443547 - DNA, 25 bp, Rattus norvegicus
ggctactttcccaggtgtggttatt

SEQ ID NO: 443548 - DNA, 25 bp, Rattus norvegicus
ggctactttccctaatacagacaaa

SEQ ID NO: 443549 - DNA, 25 bp, Rattus norvegicus
ggctactttccctggtgtggttatt

SEQ ID NO: 443550 - DNA, 25 bp, Rattus norvegicus
ggctactttctgacaccatctgatc

SEQ ID NO: 443551 - DNA, 25 bp, Rattus norvegicus
ggctactttctgtcaccatctgatc

SEQ ID NO: 443552 - DNA, 25 bp, Rattus norvegicus
ggctacttttagctacactggcttt

SEQ ID NO: 443553 - DNA, 25 bp, Rattus norvegicus
ggctacttttaggtacactggcttt

SEQ ID NO: 443554 - DNA, 25 bp, Rattus norvegicus
ggctagaaaaccactatctggtgga

SEQ ID NO: 443555 - DNA, 25 bp, Rattus norvegicus
ggctagaaaacctctatctggtgga

SEQ ID NO: 443556 - DNA, 25 bp, Rattus norvegicus
ggctagaaagccagtccacataaag

SEQ ID NO: 443557 - DNA, 25 bp, Rattus norvegicus
ggctagaaagcctgtccacataaag

SEQ ID NO: 443558 - DNA, 25 bp, Rattus norvegicus
ggctagaaatttcccaaaatacact

SEQ ID NO: 443559 - DNA, 25 bp, Rattus norvegicus
ggctagaaatttgccaaaatacact

SEQ ID NO: 443560 - DNA, 25 bp, Rattus norvegicus
ggctagaacacacctgtgtcctgaa

SEQ ID NO: 443561 - DNA, 25 bp, Rattus norvegicus
ggctagaacacagctgtgtcctgaa

SEQ ID NO: 443562 - DNA, 25 bp, Rattus norvegicus
ggctagaactctagaattcagaaat

SEQ ID NO: 443563 - DNA, 25 bp, Rattus norvegicus
ggctagaactcttgaattcagaaat

SEQ ID NO: 443564 - DNA, 25 bp, Rattus norvegicus
ggctagaacttgagggtacgtccca

SEQ ID NO: 443565 - DNA, 25 bp, Rattus norvegicus
ggctagaacttgatgccaacttcct

SEQ ID NO: 443566 - DNA, 25 bp, Rattus norvegicus
ggctagaacttgtgggtacgtccca

SEQ ID NO: 443567 - DNA, 25 bp, Rattus norvegicus
ggctagaacttgttgccaacttcct

SEQ ID NO: 443568 - DNA, 25 bp, Rattus norvegicus
ggctagaaggcccaaagcttgtaaa

SEQ ID NO: 443569 - DNA, 25 bp, Rattus norvegicus
ggctagaaggccgaaagcttgtaaa

SEQ ID NO: 443570 - DNA, 25 bp, Rattus norvegicus
ggctagaaggctaagcttccggtca

SEQ ID NO: 443571 - DNA, 25 bp, Rattus norvegicus
ggctagaaggcttagcttccggtca

SEQ ID NO: 443572 - DNA, 25 bp, Rattus norvegicus
ggctagaataatccccaaatacttt

SEQ ID NO: 443573 - DNA, 25 bp, Rattus norvegicus
ggctagaataatgcccaaatacttt

SEQ ID NO: 443574 - DNA, 25 bp, Rattus norvegicus
ggctagacacgtcaaacctcagtga

SEQ ID NO: 443575 - DNA, 25 bp, Rattus norvegicus
ggctagacacgtgaaacctcagtga

SEQ ID NO: 443576 - DNA, 25 bp, Rattus norvegicus
ggctagactcacaacatatctcatg

SEQ ID NO: 443577 - DNA, 25 bp, Rattus norvegicus
ggctagactcactacatatctcatg

SEQ ID NO: 443578 - DNA, 25 bp, Rattus norvegicus
ggctagagagaacgctcaacaccta

SEQ ID NO: 443579 - DNA, 25 bp, Rattus norvegicus
ggctagagagaaggctcaacaccta

SEQ ID NO: 443580 - DNA, 25 bp, Rattus norvegicus
ggctagagccaccattagactcaga

SEQ ID NO: 443581 - DNA, 25 bp, Rattus norvegicus
ggctagagccacgattagactcaga

SEQ ID NO: 443582 - DNA, 25 bp, Rattus norvegicus
ggctagagcggccttaatctactct

SEQ ID NO: 443583 - DNA, 25 bp, Rattus norvegicus
ggctagagcggcgttaatctactct

SEQ ID NO: 443584 - DNA, 25 bp, Rattus norvegicus
ggctagagctgtatttctgtcacat

SEQ ID NO: 443585 - DNA, 25 bp, Rattus norvegicus
ggctagagctgtttttctgtcacat

SEQ ID NO: 443586 - DNA, 25 bp, Rattus norvegicus
ggctagagtcttcttaagtattcat

SEQ ID NO: 443587 - DNA, 25 bp, Rattus norvegicus
ggctagagtcttgttaagtattcat

SEQ ID NO: 443588 - DNA, 25 bp, Rattus norvegicus
ggctagagtgtaactcgctcaacat

SEQ ID NO: 443589 - DNA, 25 bp, Rattus norvegicus
ggctagagtgtatctcgctcaacat

SEQ ID NO: 443590 - DNA, 25 bp, Rattus norvegicus
ggctagatacccaccatggctgtgt

SEQ ID NO: 443591 - DNA, 25 bp, Rattus norvegicus
ggctagataccctccatggctgtgt

SEQ ID NO: 443592 - DNA, 25 bp, Rattus norvegicus
ggctagatccccagcgtcaaattat

SEQ ID NO: 443593 - DNA, 25 bp, Rattus norvegicus
ggctagatcccctgcgtcaaattat

SEQ ID NO: 443594 - DNA, 25 bp, Rattus norvegicus
ggctagatcctgcataggcacatgt

SEQ ID NO: 443595 - DNA, 25 bp, Rattus norvegicus
ggctagatcctggataggcacatgt

SEQ ID NO: 443596 - DNA, 25 bp, Rattus norvegicus
ggctagatcgcacgacacacacatt

SEQ ID NO: 443597 - DNA, 25 bp, Rattus norvegicus
ggctagatcgcaggacacacacatt

SEQ ID NO: 443598 - DNA, 25 bp, Rattus norvegicus
ggctagcaagttataagtgccacgg

SEQ ID NO: 443599 - DNA, 25 bp, Rattus norvegicus
ggctagcaagttttaagtgccacgg

SEQ ID NO: 443600 - DNA, 25 bp, Rattus norvegicus
ggctagcagcaaatggtggacacct

SEQ ID NO: 443601 - DNA, 25 bp, Rattus norvegicus
ggctagcagcaattggtggacacct

SEQ ID NO: 443602 - DNA, 25 bp, Rattus norvegicus
ggctagcagtgaaatcctttatgaa

SEQ ID NO: 443603 - DNA, 25 bp, Rattus norvegicus
ggctagcagtgatatcctttatgaa

SEQ ID NO: 443604 - DNA, 25 bp, Rattus norvegicus
ggctagcatctgatacagcttccag

SEQ ID NO: 443605 - DNA, 25 bp, Rattus norvegicus
ggctagcatctgttacagcttccag

SEQ ID NO: 443606 - DNA, 25 bp, Rattus norvegicus
ggctagcatgctagttttaaagact

SEQ ID NO: 443607 - DNA, 25 bp, Rattus norvegicus
ggctagcatgcttgttttaaagact

SEQ ID NO: 443608 - DNA, 25 bp, Rattus norvegicus
ggctagcatttcatgccttttgacc

SEQ ID NO: 443609 - DNA, 25 bp, Rattus norvegicus
ggctagcatttcttgccttttgacc

SEQ ID NO: 443610 - DNA, 25 bp, Rattus norvegicus
ggctagccaagccatgttcctgagg

SEQ ID NO: 443611 - DNA, 25 bp, Rattus norvegicus
ggctagccaagcgatgttcctgagg

SEQ ID NO: 443612 - DNA, 25 bp, Rattus norvegicus
ggctagccaaggaaggtagtgaatt

SEQ ID NO: 443613 - DNA, 25 bp, Rattus norvegicus
ggctagccaaggtaggtagtgaatt

SEQ ID NO: 443614 - DNA, 25 bp, Rattus norvegicus
ggctagccaggtcacagttatctta

SEQ ID NO: 443615 - DNA, 25 bp, Rattus norvegicus
ggctagccaggtgacagttatctta

SEQ ID NO: 443616 - DNA, 25 bp, Rattus norvegicus
ggctagccattgcttaagctgacat

SEQ ID NO: 443617 - DNA, 25 bp, Rattus norvegicus
ggctagccattggttaagctgacat

SEQ ID NO: 443618 - DNA, 25 bp, Rattus norvegicus
ggctagcctaggatatgcagtgaga

SEQ ID NO: 443619 - DNA, 25 bp, Rattus norvegicus
ggctagcctaggttatgcagtgaga

SEQ ID NO: 443620 - DNA, 25 bp, Rattus norvegicus
ggctagcctcaaactcatagacctg

SEQ ID NO: 443621 - DNA, 25 bp, Rattus norvegicus
ggctagcctcaatctcatagacctg

SEQ ID NO: 443622 - DNA, 25 bp, Rattus norvegicus
ggctagcctcagactaacagtgatt

SEQ ID NO: 443623 - DNA, 25 bp, Rattus norvegicus
ggctagcctcagtctaacagtgatt

SEQ ID NO: 443624 - DNA, 25 bp, Rattus norvegicus
ggctagcctcataacacattactgt

SEQ ID NO: 443625 - DNA, 25 bp, Rattus norvegicus
ggctagcctcattacacattactgt

SEQ ID NO: 443626 - DNA, 25 bp, Rattus norvegicus
ggctagcctgccattctaaggaaac

SEQ ID NO: 443627 - DNA, 25 bp, Rattus norvegicus
ggctagcctgcctttctaaggaaac

SEQ ID NO: 443628 - DNA, 25 bp, Rattus norvegicus
ggctagcctggaactatgaagtcca

SEQ ID NO: 443629 - DNA, 25 bp, Rattus norvegicus
ggctagcctggatctatgaagtcca

SEQ ID NO: 443630 - DNA, 25 bp, Rattus norvegicus
ggctagccttgaatttgtggcagca

SEQ ID NO: 443631 - DNA, 25 bp, Rattus norvegicus
ggctagccttgattttgtggcagca

SEQ ID NO: 443632 - DNA, 25 bp, Rattus norvegicus
ggctagcgatttcccctctctgagc

SEQ ID NO: 443633 - DNA, 25 bp, Rattus norvegicus
ggctagcgatttgccctctctgagc

SEQ ID NO: 443634 - DNA, 25 bp, Rattus norvegicus
ggctagcgggacaggcagcacacaa

SEQ ID NO: 443635 - DNA, 25 bp, Rattus norvegicus
ggctagcgggactggcagcacacaa

SEQ ID NO: 443636 - DNA, 25 bp, Rattus norvegicus
ggctagctacatagtggaccagaca

SEQ ID NO: 443637 - DNA, 25 bp, Rattus norvegicus
ggctagctacattgtggaccagaca

SEQ ID NO: 443638 - DNA, 25 bp, Rattus norvegicus
ggctagctagcgagactgttcctgc

SEQ ID NO: 443639 - DNA, 25 bp, Rattus norvegicus
ggctagctagcgtgactgttcctgc

SEQ ID NO: 443640 - DNA, 25 bp, Rattus norvegicus
ggctagctcagtccttgcatcctgc

SEQ ID NO: 443641 - DNA, 25 bp, Rattus norvegicus
ggctagctcagtgcttgcatcctgc

SEQ ID NO: 443642 - DNA, 25 bp, Rattus norvegicus
ggctagctccgaatttgcatttctg

SEQ ID NO: 443643 - DNA, 25 bp, Rattus norvegicus
ggctagctccgattttgcatttctg

SEQ ID NO: 443644 - DNA, 25 bp, Rattus norvegicus
ggctagctcctcatgctggaactgc

SEQ ID NO: 443645 - DNA, 25 bp, Rattus norvegicus
ggctagctcctcttgctggaactgc

SEQ ID NO: 443646 - DNA, 25 bp, Rattus norvegicus
ggctagctcggtatcattgctgtga

SEQ ID NO: 443647 - DNA, 25 bp, Rattus norvegicus
ggctagctcggtttcattgctgtga

SEQ ID NO: 443648 - DNA, 25 bp, Rattus norvegicus
ggctagctgagcctatttggagctt

SEQ ID NO: 443649 - DNA, 25 bp, Rattus norvegicus
ggctagctgagcgtatttggagctt

SEQ ID NO: 443650 - DNA, 25 bp, Rattus norvegicus
ggctagctttctagtgtttttcaaa

SEQ ID NO: 443651 - DNA, 25 bp, Rattus norvegicus
ggctagctttcttgtgtttttcaaa

SEQ ID NO: 443652 - DNA, 25 bp, Rattus norvegicus
ggctaggatttcagaccgattctga

SEQ ID NO: 443653 - DNA, 25 bp, Rattus norvegicus
ggctaggatttctgaccgattctga

SEQ ID NO: 443654 - DNA, 25 bp, Rattus norvegicus
ggctaggatttgatagcatctccaa

SEQ ID NO: 443655 - DNA, 25 bp, Rattus norvegicus
ggctaggatttgttagcatctccaa

SEQ ID NO: 443656 - DNA, 25 bp, Rattus norvegicus
ggctaggcttgcaaacatgttctga

SEQ ID NO: 443657 - DNA, 25 bp, Rattus norvegicus
ggctaggcttgctaacatgttctga

SEQ ID NO: 443658 - DNA, 25 bp, Rattus norvegicus
ggctagggcccacacaagtctcaga

SEQ ID NO: 443659 - DNA, 25 bp, Rattus norvegicus
ggctagggcccagacaagtctcaga

SEQ ID NO: 443660 - DNA, 25 bp, Rattus norvegicus
ggctagggtatcagtttatctttca

SEQ ID NO: 443661 - DNA, 25 bp, Rattus norvegicus
ggctagggtatctgtttatctttca

SEQ ID NO: 443662 - DNA, 25 bp, Rattus norvegicus
ggctagggtctcagcttgacaggaa

SEQ ID NO: 443663 - DNA, 25 bp, Rattus norvegicus
ggctagggtctctgcttgacaggaa

SEQ ID NO: 443664 - DNA, 25 bp, Rattus norvegicus
ggctagggtgccagaacttgatatt

SEQ ID NO: 443665 - DNA, 25 bp, Rattus norvegicus
ggctagggtgcctgaacttgatatt

SEQ ID NO: 443666 - DNA, 25 bp, Rattus norvegicus
ggctaggtagacagtagcaccccta

SEQ ID NO: 443667 - DNA, 25 bp, Rattus norvegicus
ggctaggtagactgtagcaccccta

SEQ ID NO: 443668 - DNA, 25 bp, Rattus norvegicus
ggctaggtctagatgcagtaatgga

SEQ ID NO: 443669 - DNA, 25 bp, Rattus norvegicus
ggctaggtctagttgcagtaatgga

SEQ ID NO: 443670 - DNA, 25 bp, Rattus norvegicus
ggctaggtgaatcctgcctcaggct

SEQ ID NO: 443671 - DNA, 25 bp, Rattus norvegicus
ggctaggtgaatgctgcctcaggct

SEQ ID NO: 443672 - DNA, 25 bp, Rattus norvegicus
ggctaggtttctcaatgctgaattc

SEQ ID NO: 443673 - DNA, 25 bp, Rattus norvegicus
ggctaggtttctgaatgctgaattc

SEQ ID NO: 443674 - DNA, 25 bp, Rattus norvegicus
ggctagtaacctacttcattcggaa

SEQ ID NO: 443675 - DNA, 25 bp, Rattus norvegicus
ggctagtaaccttcttcattcggaa

SEQ ID NO: 443676 - DNA, 25 bp, Rattus norvegicus
ggctagtattctcctatatgaaagt

SEQ ID NO: 443677 - DNA, 25 bp, Rattus norvegicus
ggctagtattctgctatatgaaagt

SEQ ID NO: 443678 - DNA, 25 bp, Rattus norvegicus
ggctagtcatcactccattttatga

SEQ ID NO: 443679 - DNA, 25 bp, Rattus norvegicus
ggctagtcatcagtccattttatga

SEQ ID NO: 443680 - DNA, 25 bp, Rattus norvegicus
ggctagtctaggcattttgtttgat

SEQ ID NO: 443681 - DNA, 25 bp, Rattus norvegicus
ggctagtctagggattttgtttgat

SEQ ID NO: 443682 - DNA, 25 bp, Rattus norvegicus
ggctagtcttatagcatgttggtat

SEQ ID NO: 443683 - DNA, 25 bp, Rattus norvegicus
ggctagtcttattgcatgttggtat

SEQ ID NO: 443684 - DNA, 25 bp, Rattus norvegicus
ggctagtgacacaaacttcccagaa

SEQ ID NO: 443685 - DNA, 25 bp, Rattus norvegicus
ggctagtgacactaacttcccagaa

SEQ ID NO: 443686 - DNA, 25 bp, Rattus norvegicus
ggctagtgcacgacaatttatgtca

SEQ ID NO: 443687 - DNA, 25 bp, Rattus norvegicus
ggctagtgcacgtcaatttatgtca

SEQ ID NO: 443688 - DNA, 25 bp, Rattus norvegicus
ggctagtggtgtcctgatctttcaa

SEQ ID NO: 443689 - DNA, 25 bp, Rattus norvegicus
ggctagtggtgtgctgatctttcaa

SEQ ID NO: 443690 - DNA, 25 bp, Rattus norvegicus
ggctagttactgagatggacactga

SEQ ID NO: 443691 - DNA, 25 bp, Rattus norvegicus
ggctagttactgtgatggacactga

SEQ ID NO: 443692 - DNA, 25 bp, Rattus norvegicus
ggctagttctaaatgttgtttgctt

SEQ ID NO: 443693 - DNA, 25 bp, Rattus norvegicus
ggctagttctaattgttgtttgctt

SEQ ID NO: 443694 - DNA, 25 bp, Rattus norvegicus
ggctagttctccaaatctcttatat

SEQ ID NO: 443695 - DNA, 25 bp, Rattus norvegicus
ggctagttctcctaatctcttatat

SEQ ID NO: 443696 - DNA, 25 bp, Rattus norvegicus
ggctagttctttagctgacccagat

SEQ ID NO: 443697 - DNA, 25 bp, Rattus norvegicus
ggctagttcttttgctgacccagat

SEQ ID NO: 443698 - DNA, 25 bp, Rattus norvegicus
ggctagtttaggacaattctctcat

SEQ ID NO: 443699 - DNA, 25 bp, Rattus norvegicus
ggctagtttaggtcaattctctcat

SEQ ID NO: 443700 - DNA, 25 bp, Rattus norvegicus
ggctataacagcaaacatagcaggt

SEQ ID NO: 443701 - DNA, 25 bp, Rattus norvegicus
ggctataacagctaacatagcaggt

SEQ ID NO: 443702 - DNA, 25 bp, Rattus norvegicus
ggctataacttcacgggaacctcct

SEQ ID NO: 443703 - DNA, 25 bp, Rattus norvegicus
ggctataacttctcgggaacctcct

SEQ ID NO: 443704 - DNA, 25 bp, Rattus norvegicus
ggctataagtcaattctgcaaacga

SEQ ID NO: 443705 - DNA, 25 bp, Rattus norvegicus
ggctataagtcatttctgcaaacga

SEQ ID NO: 443706 - DNA, 25 bp, Rattus norvegicus
ggctatacacacacttatttccaga

SEQ ID NO: 443707 - DNA, 25 bp, Rattus norvegicus
ggctatacacactcttatttccaga

SEQ ID NO: 443708 - DNA, 25 bp, Rattus norvegicus
ggctatacagtaaaaattccaggac

SEQ ID NO: 443709 - DNA, 25 bp, Rattus norvegicus
ggctatacagtataaattccaggac

SEQ ID NO: 443710 - DNA, 25 bp, Rattus norvegicus
ggctatacccctaaccattattgtt

SEQ ID NO: 443711 - DNA, 25 bp, Rattus norvegicus
ggctataccccttaccattattgtt

SEQ ID NO: 443712 - DNA, 25 bp, Rattus norvegicus
ggctatacgttaactcagactcaca

SEQ ID NO: 443713 - DNA, 25 bp, Rattus norvegicus
ggctatacgttatctcagactcaca

SEQ ID NO: 443714 - DNA, 25 bp, Rattus norvegicus
ggctatacttttcactatgcctatg

SEQ ID NO: 443715 - DNA, 25 bp, Rattus norvegicus
ggctatacttttgactatgcctatg

SEQ ID NO: 443716 - DNA, 25 bp, Rattus norvegicus
ggctatatggatcaggatggctatt

SEQ ID NO: 443717 - DNA, 25 bp, Rattus norvegicus
ggctatatggatgaggatggctatt

SEQ ID NO: 443718 - DNA, 25 bp, Rattus norvegicus
ggctatatggcaatctaactaaaat

SEQ ID NO: 443719 - DNA, 25 bp, Rattus norvegicus
ggctatatggcattctaactaaaat

SEQ ID NO: 443720 - DNA, 25 bp, Rattus norvegicus
ggctatattttaacctacctcttgg

SEQ ID NO: 443721 - DNA, 25 bp, Rattus norvegicus
ggctatattttatcctacctcttgg

SEQ ID NO: 443722 - DNA, 25 bp, Rattus norvegicus
ggctatcaagcgagactttgggtct

SEQ ID NO: 443723 - DNA, 25 bp, Rattus norvegicus
ggctatcaagcgtgactttgggtct

SEQ ID NO: 443724 - DNA, 25 bp, Rattus norvegicus
ggctatcaggagattattttatttt

SEQ ID NO: 443725 - DNA, 25 bp, Rattus norvegicus
ggctatcaggagtttattttatttt

SEQ ID NO: 443726 - DNA, 25 bp, Rattus norvegicus
ggctatcataccatttgctaaactg

SEQ ID NO: 443727 - DNA, 25 bp, Rattus norvegicus
ggctatcataccttttgctaaactg

SEQ ID NO: 443728 - DNA, 25 bp, Rattus norvegicus
ggctatcatatcaccatttcttggc

SEQ ID NO: 443729 - DNA, 25 bp, Rattus norvegicus
ggctatcatatctccatttcttggc

SEQ ID NO: 443730 - DNA, 25 bp, Rattus norvegicus
ggctatcatgccaactattgtgagg

SEQ ID NO: 443731 - DNA, 25 bp, Rattus norvegicus
ggctatcatgcctactattgtgagg

SEQ ID NO: 443732 - DNA, 25 bp, Rattus norvegicus
ggctatcatttgcactactatgaga

SEQ ID NO: 443733 - DNA, 25 bp, Rattus norvegicus
ggctatcatttggactactatgaga

SEQ ID NO: 443734 - DNA, 25 bp, Rattus norvegicus
ggctatcctccacatcgagtctgaa

SEQ ID NO: 443735 - DNA, 25 bp, Rattus norvegicus
ggctatcctccagatcgagtctgaa

SEQ ID NO: 443736 - DNA, 25 bp, Rattus norvegicus
ggctatcctctaagcaatcgttctt

SEQ ID NO: 443737 - DNA, 25 bp, Rattus norvegicus
ggctatcctctatgcaatcgttctt

SEQ ID NO: 443738 - DNA, 25 bp, Rattus norvegicus
ggctatcgctatacacagaggcatg

SEQ ID NO: 443739 - DNA, 25 bp, Rattus norvegicus
ggctatcgctattcacagaggcatg

SEQ ID NO: 443740 - DNA, 25 bp, Rattus norvegicus
ggctatcgggttcctactcactaaa

SEQ ID NO: 443741 - DNA, 25 bp, Rattus norvegicus
ggctatcgggttgctactcactaaa

SEQ ID NO: 443742 - DNA, 25 bp, Rattus norvegicus
ggctatctcagcaagcttctttcaa

SEQ ID NO: 443743 - DNA, 25 bp, Rattus norvegicus
ggctatctcagctagcttctttcaa

SEQ ID NO: 443744 - DNA, 25 bp, Rattus norvegicus
ggctatctcttcaccttgatgtgta

SEQ ID NO: 443745 - DNA, 25 bp, Rattus norvegicus
ggctatctcttctccttgatgtgta

SEQ ID NO: 443746 - DNA, 25 bp, Rattus norvegicus
ggctatctcttgcaatttgcatcat

SEQ ID NO: 443747 - DNA, 25 bp, Rattus norvegicus
ggctatctcttggaatttgcatcat

SEQ ID NO: 443748 - DNA, 25 bp, Rattus norvegicus
ggctatctgtgtacctatcaagaac

SEQ ID NO: 443749 - DNA, 25 bp, Rattus norvegicus
ggctatctgtgttcctatcaagaac

SEQ ID NO: 443750 - DNA, 25 bp, Rattus norvegicus
ggctatctttggagggccaaggtta

SEQ ID NO: 443751 - DNA, 25 bp, Rattus norvegicus
ggctatctttggtgggccaaggtta

SEQ ID NO: 443752 - DNA, 25 bp, Rattus norvegicus
ggctatctttttccttgtatcttga

SEQ ID NO: 443753 - DNA, 25 bp, Rattus norvegicus
ggctatctttttgcttgtatcttga

SEQ ID NO: 443754 - DNA, 25 bp, Rattus norvegicus
ggctatgaaccaccagtccaagaat

SEQ ID NO: 443755 - DNA, 25 bp, Rattus norvegicus
ggctatgaaccagcagtccaagaat

SEQ ID NO: 443756 - DNA, 25 bp, Rattus norvegicus
ggctatgaactcacgtcacagggtt

SEQ ID NO: 443757 - DNA, 25 bp, Rattus norvegicus
ggctatgaactctcgtcacagggtt

SEQ ID NO: 443758 - DNA, 25 bp, Rattus norvegicus
ggctatgaagccactgcatgcagga

SEQ ID NO: 443759 - DNA, 25 bp, Rattus norvegicus
ggctatgaagcctctgcatgcagga

SEQ ID NO: 443760 - DNA, 25 bp, Rattus norvegicus
ggctatgaagctctgacctgcggtc

SEQ ID NO: 443761 - DNA, 25 bp, Rattus norvegicus
ggctatgaagctgtgacctgcggtc

SEQ ID NO: 443762 - DNA, 25 bp, Rattus norvegicus
ggctatgactctcaaggcaaccctc

SEQ ID NO: 443763 - DNA, 25 bp, Rattus norvegicus
ggctatgactctgaaggcaaccctc

SEQ ID NO: 443764 - DNA, 25 bp, Rattus norvegicus
ggctatgacttactggtgcggtcca

SEQ ID NO: 443765 - DNA, 25 bp, Rattus norvegicus
ggctatgacttagtggtgcggtcca

SEQ ID NO: 443766 - DNA, 25 bp, Rattus norvegicus
ggctatgagcaacgtcttccaggag

SEQ ID NO: 443767 - DNA, 25 bp, Rattus norvegicus
ggctatgagcaactctgggctgttt

SEQ ID NO: 443768 - DNA, 25 bp, Rattus norvegicus
ggctatgagcaaggtcttccaggag

SEQ ID NO: 443769 - DNA, 25 bp, Rattus norvegicus
ggctatgagcaagtctgggctgttt

SEQ ID NO: 443770 - DNA, 25 bp, Rattus norvegicus
ggctatgagcacagccccatcagaa

SEQ ID NO: 443771 - DNA, 25 bp, Rattus norvegicus
ggctatgagcactgccccatcagaa

SEQ ID NO: 443772 - DNA, 25 bp, Rattus norvegicus
ggctatgagtggacagatgctccca

SEQ ID NO: 443773 - DNA, 25 bp, Rattus norvegicus
ggctatgagtggtcagatgctccca

SEQ ID NO: 443774 - DNA, 25 bp, Rattus norvegicus
ggctatgatgaactatggtcctcca

SEQ ID NO: 443775 - DNA, 25 bp, Rattus norvegicus
ggctatgatgaagtatggtcctcca

SEQ ID NO: 443776 - DNA, 25 bp, Rattus norvegicus
ggctatgcatctaccagacacaaca

SEQ ID NO: 443777 - DNA, 25 bp, Rattus norvegicus
ggctatgcatcttccagacacaaca

SEQ ID NO: 443778 - DNA, 25 bp, Rattus norvegicus
ggctatgccacacgcaatgcaccag

SEQ ID NO: 443779 - DNA, 25 bp, Rattus norvegicus
ggctatgccacaggcaatgcaccag

SEQ ID NO: 443780 - DNA, 25 bp, Rattus norvegicus
ggctatgccgccaaggccatgaagg

SEQ ID NO: 443781 - DNA, 25 bp, Rattus norvegicus
ggctatgccgcctaggccatgaagg

SEQ ID NO: 443782 - DNA, 25 bp, Rattus norvegicus
ggctatgctctaagattaagaattg

SEQ ID NO: 443783 - DNA, 25 bp, Rattus norvegicus
ggctatgctctatgattaagaattg

SEQ ID NO: 443784 - DNA, 25 bp, Rattus norvegicus
ggctatgcttggatggtttttgtaa

SEQ ID NO: 443785 - DNA, 25 bp, Rattus norvegicus
ggctatgcttggttggtttttgtaa

SEQ ID NO: 443786 - DNA, 25 bp, Rattus norvegicus
ggctatggaagtaacacctctgtct

SEQ ID NO: 443787 - DNA, 25 bp, Rattus norvegicus
ggctatggaagttacacctctgtct

SEQ ID NO: 443788 - DNA, 25 bp, Rattus norvegicus
ggctatggagcactgcatgtgccct

SEQ ID NO: 443789 - DNA, 25 bp, Rattus norvegicus
ggctatggagcagtgcatgtgccct

SEQ ID NO: 443790 - DNA, 25 bp, Rattus norvegicus
ggctatggaggtaccagcagcagca

SEQ ID NO: 443791 - DNA, 25 bp, Rattus norvegicus
ggctatggaggttccagcagcagca

SEQ ID NO: 443792 - DNA, 25 bp, Rattus norvegicus
ggctatggccaaccagaaattgcca

SEQ ID NO: 443793 - DNA, 25 bp, Rattus norvegicus
ggctatggccaagcagaaattgcca

SEQ ID NO: 443794 - DNA, 25 bp, Rattus norvegicus
ggctatggcgcactgaggaaccctc

SEQ ID NO: 443795 - DNA, 25 bp, Rattus norvegicus
ggctatggcgcagtgaggaaccctc

SEQ ID NO: 443796 - DNA, 25 bp, Rattus norvegicus
ggctatgggaagagatccaaagagt

SEQ ID NO: 443797 - DNA, 25 bp, Rattus norvegicus
ggctatgggaagtgatccaaagagt

SEQ ID NO: 443798 - DNA, 25 bp, Rattus norvegicus
ggctatggtggtatgatcttgtctc

SEQ ID NO: 443799 - DNA, 25 bp, Rattus norvegicus
ggctatggtggtttgatcttgtctc

SEQ ID NO: 443800 - DNA, 25 bp, Rattus norvegicus
ggctatgtaagcatggactagtcac

SEQ ID NO: 443801 - DNA, 25 bp, Rattus norvegicus
ggctatgtaagcttggactagtcac

SEQ ID NO: 443802 - DNA, 25 bp, Rattus norvegicus
ggctatgtagcacaaccctttgtta

SEQ ID NO: 443803 - DNA, 25 bp, Rattus norvegicus
ggctatgtagcagaaccctttgtta

SEQ ID NO: 443804 - DNA, 25 bp, Rattus norvegicus
ggctatgtagccagttctatgaata

SEQ ID NO: 443805 - DNA, 25 bp, Rattus norvegicus
ggctatgtagcctgttctatgaata

SEQ ID NO: 443806 - DNA, 25 bp, Rattus norvegicus
ggctatgtatgtaagaccctgactc

SEQ ID NO: 443807 - DNA, 25 bp, Rattus norvegicus
ggctatgtatgttagaccctgactc

SEQ ID NO: 443808 - DNA, 25 bp, Rattus norvegicus
ggctatgtgactccattacttcaga

SEQ ID NO: 443809 - DNA, 25 bp, Rattus norvegicus
ggctatgtgactgcattacttcaga

SEQ ID NO: 443810 - DNA, 25 bp, Rattus norvegicus
ggctatgtgatcaacagggttgtct

SEQ ID NO: 443811 - DNA, 25 bp, Rattus norvegicus
ggctatgtgatctacagggttgtct

SEQ ID NO: 443812 - DNA, 25 bp, Rattus norvegicus
ggctatgtgcatatcagtttatctt

SEQ ID NO: 443813 - DNA, 25 bp, Rattus norvegicus
ggctatgtgcatttcagtttatctt

SEQ ID NO: 443814 - DNA, 25 bp, Rattus norvegicus
ggctatgtggccaaaatactatctg

SEQ ID NO: 443815 - DNA, 25 bp, Rattus norvegicus
ggctatgtggcctaaatactatctg

SEQ ID NO: 443816 - DNA, 25 bp, Rattus norvegicus
ggctatgttattactttaacacagt

SEQ ID NO: 443817 - DNA, 25 bp, Rattus norvegicus
ggctatgttatttctttaacacagt

SEQ ID NO: 443818 - DNA, 25 bp, Rattus norvegicus
ggctatgttctgaatggagtctata

SEQ ID NO: 443819 - DNA, 25 bp, Rattus norvegicus
ggctatgttctgtatggagtctata

SEQ ID NO: 443820 - DNA, 25 bp, Rattus norvegicus
ggctatgttgtaataccttgtctca

SEQ ID NO: 443821 - DNA, 25 bp, Rattus norvegicus
ggctatgttgtattaccttgtctca

SEQ ID NO: 443822 - DNA, 25 bp, Rattus norvegicus
ggctatgtttacacctaattgggtc

SEQ ID NO: 443823 - DNA, 25 bp, Rattus norvegicus
ggctatgtttaccatcattttccct

SEQ ID NO: 443824 - DNA, 25 bp, Rattus norvegicus
ggctatgtttacgatcattttccct

SEQ ID NO: 443825 - DNA, 25 bp, Rattus norvegicus
ggctatgtttactcctaattgggtc

SEQ ID NO: 443826 - DNA, 25 bp, Rattus norvegicus
ggctattaattcatcagtctgcatt

SEQ ID NO: 443827 - DNA, 25 bp, Rattus norvegicus
ggctattaattcttcagtctgcatt

SEQ ID NO: 443828 - DNA, 25 bp, Rattus norvegicus
ggctattacaggcaaaaccctgtct

SEQ ID NO: 443829 - DNA, 25 bp, Rattus norvegicus
ggctattacagggaaaaccctgtct

SEQ ID NO: 443830 - DNA, 25 bp, Rattus norvegicus
ggctattagaagaccccaacacaag

SEQ ID NO: 443831 - DNA, 25 bp, Rattus norvegicus
ggctattagaagtccccaacacaag

SEQ ID NO: 443832 - DNA, 25 bp, Rattus norvegicus
ggctattattttactgctgcaccaa

SEQ ID NO: 443833 - DNA, 25 bp, Rattus norvegicus
ggctattatttttctgctgcaccaa

SEQ ID NO: 443834 - DNA, 25 bp, Rattus norvegicus
ggctattcattgaacagctcggact

SEQ ID NO: 443835 - DNA, 25 bp, Rattus norvegicus
ggctattcattgtacagctcggact

SEQ ID NO: 443836 - DNA, 25 bp, Rattus norvegicus
ggctattcctaacattgacaaactg

SEQ ID NO: 443837 - DNA, 25 bp, Rattus norvegicus
ggctattcctaagattgacaaactg

SEQ ID NO: 443838 - DNA, 25 bp, Rattus norvegicus
ggctattctgtcactcatttctaca

SEQ ID NO: 443839 - DNA, 25 bp, Rattus norvegicus
ggctattctgtctctcatttctaca

SEQ ID NO: 443840 - DNA, 25 bp, Rattus norvegicus
ggctattgaggaatgtcttactact

SEQ ID NO: 443841 - DNA, 25 bp, Rattus norvegicus
ggctattgaggattgtcttactact

SEQ ID NO: 443842 - DNA, 25 bp, Rattus norvegicus
ggctattgattaatgctctctggag

SEQ ID NO: 443843 - DNA, 25 bp, Rattus norvegicus
ggctattgattattgctctctggag

SEQ ID NO: 443844 - DNA, 25 bp, Rattus norvegicus
ggctattgattgcttcagagtccca

SEQ ID NO: 443845 - DNA, 25 bp, Rattus norvegicus
ggctattgattggttcagagtccca

SEQ ID NO: 443846 - DNA, 25 bp, Rattus norvegicus
ggctattggctacaaatcctgagtt

SEQ ID NO: 443847 - DNA, 25 bp, Rattus norvegicus
ggctattggctagaaatcctgagtt

SEQ ID NO: 443848 - DNA, 25 bp, Rattus norvegicus
ggctattgtattacttaggtcctaa

SEQ ID NO: 443849 - DNA, 25 bp, Rattus norvegicus
ggctattgtatttcttaggtcctaa

SEQ ID NO: 443850 - DNA, 25 bp, Rattus norvegicus
ggctatttaatcatacccttccaag

SEQ ID NO: 443851 - DNA, 25 bp, Rattus norvegicus
ggctatttaatcttacccttccaag

SEQ ID NO: 443852 - DNA, 25 bp, Rattus norvegicus
ggctatttcatacaaggcagcatct

SEQ ID NO: 443853 - DNA, 25 bp, Rattus norvegicus
ggctatttcatagaaggcagcatct

SEQ ID NO: 443854 - DNA, 25 bp, Rattus norvegicus
ggctatttctatcgacgctgccaaa

SEQ ID NO: 443855 - DNA, 25 bp, Rattus norvegicus
ggctatttctatggacgctgccaaa

SEQ ID NO: 443856 - DNA, 25 bp, Rattus norvegicus
ggctatttctggattgttgcaagat

SEQ ID NO: 443857 - DNA, 25 bp, Rattus norvegicus
ggctatttctggtttgttgcaagat

SEQ ID NO: 443858 - DNA, 25 bp, Rattus norvegicus
ggctatttgtgtatacttccctggc

SEQ ID NO: 443859 - DNA, 25 bp, Rattus norvegicus
ggctatttgtgtttacttccctggc

SEQ ID NO: 443860 - DNA, 25 bp, Rattus norvegicus
ggctattttccaaagcacagtgctt

SEQ ID NO: 443861 - DNA, 25 bp, Rattus norvegicus
ggctattttccatagcacagtgctt

SEQ ID NO: 443862 - DNA, 25 bp, Rattus norvegicus
ggctattttcctatttagacctcag

SEQ ID NO: 443863 - DNA, 25 bp, Rattus norvegicus
ggctattttcctttttagacctcag

SEQ ID NO: 443864 - DNA, 25 bp, Rattus norvegicus
ggctcaaacagcctgaatccaactt

SEQ ID NO: 443865 - DNA, 25 bp, Rattus norvegicus
ggctcaaacagcgtgaatccaactt

SEQ ID NO: 443866 - DNA, 25 bp, Rattus norvegicus
ggctcaaactccagcctagaatctt

SEQ ID NO: 443867 - DNA, 25 bp, Rattus norvegicus
ggctcaaactcctgcctagaatctt

SEQ ID NO: 443868 - DNA, 25 bp, Rattus norvegicus
ggctcaaagtaccacagaacctcgc

SEQ ID NO: 443869 - DNA, 25 bp, Rattus norvegicus
ggctcaaagtacgacagaacctcgc

SEQ ID NO: 443870 - DNA, 25 bp, Rattus norvegicus
ggctcaaagtgactaggtgactctg

SEQ ID NO: 443871 - DNA, 25 bp, Rattus norvegicus
ggctcaaagtgagtaggtgactctg

SEQ ID NO: 443872 - DNA, 25 bp, Rattus norvegicus
ggctcaacacgaacctaaactctga

SEQ ID NO: 443873 - DNA, 25 bp, Rattus norvegicus
ggctcaacacgatcctaaactctga

SEQ ID NO: 443874 - DNA, 25 bp, Rattus norvegicus
ggctcaacactcaaatcactcaatg

SEQ ID NO: 443875 - DNA, 25 bp, Rattus norvegicus
ggctcaacactctaatcactcaatg

SEQ ID NO: 443876 - DNA, 25 bp, Rattus norvegicus
ggctcaacagaaaaccggtcctgct

SEQ ID NO: 443877 - DNA, 25 bp, Rattus norvegicus
ggctcaacagaataccggtcctgct

SEQ ID NO: 443878 - DNA, 25 bp, Rattus norvegicus
ggctcaacatgcctgggctcttgtc

SEQ ID NO: 443879 - DNA, 25 bp, Rattus norvegicus
ggctcaacatgcgtgggctcttgtc

SEQ ID NO: 443880 - DNA, 25 bp, Rattus norvegicus
ggctcaacgtgcctttccgctgctt

SEQ ID NO: 443881 - DNA, 25 bp, Rattus norvegicus
ggctcaacgtgcgtttccgctgctt

SEQ ID NO: 443882 - DNA, 25 bp, Rattus norvegicus
ggctcaactctcagggttcatgtta

SEQ ID NO: 443883 - DNA, 25 bp, Rattus norvegicus
ggctcaactctctgggttcatgtta

SEQ ID NO: 443884 - DNA, 25 bp, Rattus norvegicus
ggctcaagatttaggttcccaacca

SEQ ID NO: 443885 - DNA, 25 bp, Rattus norvegicus
ggctcaagattttggttcccaacca

SEQ ID NO: 443886 - DNA, 25 bp, Rattus norvegicus
ggctcaagccttagtacattttctc

SEQ ID NO: 443887 - DNA, 25 bp, Rattus norvegicus
ggctcaagcctttgtacattttctc

SEQ ID NO: 443888 - DNA, 25 bp, Rattus norvegicus
ggctcaagctaccttcactttaata

SEQ ID NO: 443889 - DNA, 25 bp, Rattus norvegicus
ggctcaagctacgttcactttaata

SEQ ID NO: 443890 - DNA, 25 bp, Rattus norvegicus
ggctcaaggccacgaactcatgact

SEQ ID NO: 443891 - DNA, 25 bp, Rattus norvegicus
ggctcaaggccaggaactcatgact

SEQ ID NO: 443892 - DNA, 25 bp, Rattus norvegicus
ggctcaaggcttctctagttttatg

SEQ ID NO: 443893 - DNA, 25 bp, Rattus norvegicus
ggctcaaggcttgtctagttttatg

SEQ ID NO: 443894 - DNA, 25 bp, Rattus norvegicus
ggctcaagtgatcctgtcgcagctc

SEQ ID NO: 443895 - DNA, 25 bp, Rattus norvegicus
ggctcaagtgatgctgtcgcagctc

SEQ ID NO: 443896 - DNA, 25 bp, Rattus norvegicus
ggctcaataccgaaggcattcacta

SEQ ID NO: 443897 - DNA, 25 bp, Rattus norvegicus
ggctcaataccgtaggcattcacta

SEQ ID NO: 443898 - DNA, 25 bp, Rattus norvegicus
ggctcaatagagaccatatgcataa

SEQ ID NO: 443899 - DNA, 25 bp, Rattus norvegicus
ggctcaatagagtccatatgcataa

SEQ ID NO: 443900 - DNA, 25 bp, Rattus norvegicus
ggctcaatattgcttcttttttctt

SEQ ID NO: 443901 - DNA, 25 bp, Rattus norvegicus
ggctcaatattggttcttttttctt

SEQ ID NO: 443902 - DNA, 25 bp, Rattus norvegicus
ggctcaatcgctatttatgatgctt

SEQ ID NO: 443903 - DNA, 25 bp, Rattus norvegicus
ggctcaatcgctttttatgatgctt

SEQ ID NO: 443904 - DNA, 25 bp, Rattus norvegicus
ggctcaatctccaggaggcgcgaga

SEQ ID NO: 443905 - DNA, 25 bp, Rattus norvegicus
ggctcaatctcctggaggcgcgaga

SEQ ID NO: 443906 - DNA, 25 bp, Rattus norvegicus
ggctcaatcttgaagtactggcgtg

SEQ ID NO: 443907 - DNA, 25 bp, Rattus norvegicus
ggctcaatcttgtagtactggcgtg

SEQ ID NO: 443908 - DNA, 25 bp, Rattus norvegicus
ggctcaatctttatatcctggatgt

SEQ ID NO: 443909 - DNA, 25 bp, Rattus norvegicus
ggctcaatctttttatcctggatgt

SEQ ID NO: 443910 - DNA, 25 bp, Rattus norvegicus
ggctcaatgcctcacataatttcac

SEQ ID NO: 443911 - DNA, 25 bp, Rattus norvegicus
ggctcaatgcctgacataatttcac

SEQ ID NO: 443912 - DNA, 25 bp, Rattus norvegicus
ggctcaatggcaccgagtgtccaaa

SEQ ID NO: 443913 - DNA, 25 bp, Rattus norvegicus
ggctcaatggcagcgagtgtccaaa

SEQ ID NO: 443914 - DNA, 25 bp, Rattus norvegicus
ggctcaattatactccttcggtttt

SEQ ID NO: 443915 - DNA, 25 bp, Rattus norvegicus
ggctcaattatagtccttcggtttt

SEQ ID NO: 443916 - DNA, 25 bp, Rattus norvegicus
ggctcaattcagaccccagggaaga

SEQ ID NO: 443917 - DNA, 25 bp, Rattus norvegicus
ggctcaattcagtccccagggaaga

SEQ ID NO: 443918 - DNA, 25 bp, Rattus norvegicus
ggctcacaaaatcttaaatccggct

SEQ ID NO: 443919 - DNA, 25 bp, Rattus norvegicus
ggctcacaaaatgttaaatccggct

SEQ ID NO: 443920 - DNA, 25 bp, Rattus norvegicus
ggctcacaagcaattattaaggaat

SEQ ID NO: 443921 - DNA, 25 bp, Rattus norvegicus
ggctcacaagcatttattaaggaat

SEQ ID NO: 443922 - DNA, 25 bp, Rattus norvegicus
ggctcacaaggccaagtccgtggtt

SEQ ID NO: 443923 - DNA, 25 bp, Rattus norvegicus
ggctcacaaggcgaagtccgtggtt

SEQ ID NO: 443924 - DNA, 25 bp, Rattus norvegicus
ggctcacactggaaactgtagcact

SEQ ID NO: 443925 - DNA, 25 bp, Rattus norvegicus
ggctcacactggtaactgtagcact

SEQ ID NO: 443926 - DNA, 25 bp, Rattus norvegicus
ggctcacacttgctctccaagaaag

SEQ ID NO: 443927 - DNA, 25 bp, Rattus norvegicus
ggctcacacttggtctccaagaaag

SEQ ID NO: 443928 - DNA, 25 bp, Rattus norvegicus
ggctcacagagcctgacatggcaat

SEQ ID NO: 443929 - DNA, 25 bp, Rattus norvegicus
ggctcacagagcgtgacatggcaat

SEQ ID NO: 443930 - DNA, 25 bp, Rattus norvegicus
ggctcacagaggcacgtcactgtta

SEQ ID NO: 443931 - DNA, 25 bp, Rattus norvegicus
ggctcacagagggacgtcactgtta

SEQ ID NO: 443932 - DNA, 25 bp, Rattus norvegicus
ggctcacagccgctactatgtagaa

SEQ ID NO: 443933 - DNA, 25 bp, Rattus norvegicus
ggctcacagccggtactatgtagaa

SEQ ID NO: 443934 - DNA, 25 bp, Rattus norvegicus
ggctcacaggtgaatgcctgccaga

SEQ ID NO: 443935 - DNA, 25 bp, Rattus norvegicus
ggctcacaggtgtatgcctgccaga

SEQ ID NO: 443936 - DNA, 25 bp, Rattus norvegicus
ggctcacagtgtctaccatcgtatt

SEQ ID NO: 443937 - DNA, 25 bp, Rattus norvegicus
ggctcacagtgtgtaccatcgtatt

SEQ ID NO: 443938 - DNA, 25 bp, Rattus norvegicus
ggctcacatcccatcagaaaaactc

SEQ ID NO: 443939 - DNA, 25 bp, Rattus norvegicus
ggctcacatcccttcagaaaaactc

SEQ ID NO: 443940 - DNA, 25 bp, Rattus norvegicus
ggctcacatgagatttatacgctgt

SEQ ID NO: 443941 - DNA, 25 bp, Rattus norvegicus
ggctcacatgagttttatacgctgt

SEQ ID NO: 443942 - DNA, 25 bp, Rattus norvegicus
ggctcacatgatccattacacataa

SEQ ID NO: 443943 - DNA, 25 bp, Rattus norvegicus
ggctcacatgatgcattacacataa

SEQ ID NO: 443944 - DNA, 25 bp, Rattus norvegicus
ggctcacccaaccaagctatagatt

SEQ ID NO: 443945 - DNA, 25 bp, Rattus norvegicus
ggctcacccaacgaagctatagatt

SEQ ID NO: 443946 - DNA, 25 bp, Rattus norvegicus
ggctcacccagtaatccaagatagg

SEQ ID NO: 443947 - DNA, 25 bp, Rattus norvegicus
ggctcacccagtacatcgatgggca

SEQ ID NO: 443948 - DNA, 25 bp, Rattus norvegicus
ggctcacccagttatccaagatagg

SEQ ID NO: 443949 - DNA, 25 bp, Rattus norvegicus
ggctcacccagttcatcgatgggca

SEQ ID NO: 443950 - DNA, 25 bp, Rattus norvegicus
ggctcaccgagaagttcttgcgcgc

SEQ ID NO: 443951 - DNA, 25 bp, Rattus norvegicus
ggctcaccgagatgttcttgcgcgc

SEQ ID NO: 443952 - DNA, 25 bp, Rattus norvegicus
ggctcacctatcaagaactcacaga

SEQ ID NO: 443953 - DNA, 25 bp, Rattus norvegicus
ggctcacctatctagaactcacaga

SEQ ID NO: 443954 - DNA, 25 bp, Rattus norvegicus
ggctcacctcttactgctgggaaaa

SEQ ID NO: 443955 - DNA, 25 bp, Rattus norvegicus
ggctcacctctttctgctgggaaaa

SEQ ID NO: 443956 - DNA, 25 bp, Rattus norvegicus
ggctcacctgatatgggacagattt

SEQ ID NO: 443957 - DNA, 25 bp, Rattus norvegicus
ggctcacctgatttgggacagattt

SEQ ID NO: 443958 - DNA, 25 bp, Rattus norvegicus
ggctcacctgtgatgctgatcttga

SEQ ID NO: 443959 - DNA, 25 bp, Rattus norvegicus
ggctcacctgtgttgctgatcttga

SEQ ID NO: 443960 - DNA, 25 bp, Rattus norvegicus
ggctcacctttaatgatttgcctaa

SEQ ID NO: 443961 - DNA, 25 bp, Rattus norvegicus
ggctcacctttattgatttgcctaa

SEQ ID NO: 443962 - DNA, 25 bp, Rattus norvegicus
ggctcacgcccaaagggtgcagtaa

SEQ ID NO: 443963 - DNA, 25 bp, Rattus norvegicus
ggctcacgcccatagggtgcagtaa

SEQ ID NO: 443964 - DNA, 25 bp, Rattus norvegicus
ggctcacgtccaagtttcaaactag

SEQ ID NO: 443965 - DNA, 25 bp, Rattus norvegicus
ggctcacgtccatgtttcaaactag

SEQ ID NO: 443966 - DNA, 25 bp, Rattus norvegicus
ggctcacgttgtaaactcctgttaa

SEQ ID NO: 443967 - DNA, 25 bp, Rattus norvegicus
ggctcacgttgttaactcctgttaa

SEQ ID NO: 443968 - DNA, 25 bp, Rattus norvegicus
ggctcactacctatgcatatactag

SEQ ID NO: 443969 - DNA, 25 bp, Rattus norvegicus
ggctcactacctttgcatatactag

SEQ ID NO: 443970 - DNA, 25 bp, Rattus norvegicus
ggctcactcattccccagagaacgg

SEQ ID NO: 443971 - DNA, 25 bp, Rattus norvegicus
ggctcactcattgcccagagaacgg

SEQ ID NO: 443972 - DNA, 25 bp, Rattus norvegicus
ggctcactgctgatctttattgtgc

SEQ ID NO: 443973 - DNA, 25 bp, Rattus norvegicus
ggctcactgctgcattcagtcaaag

SEQ ID NO: 443974 - DNA, 25 bp, Rattus norvegicus
ggctcactgctggattcagtcaaag

SEQ ID NO: 443975 - DNA, 25 bp, Rattus norvegicus
ggctcactgctgttctttattgtgc

SEQ ID NO: 443976 - DNA, 25 bp, Rattus norvegicus
ggctcactggagagcgacagtcttg

SEQ ID NO: 443977 - DNA, 25 bp, Rattus norvegicus
ggctcactggagtgcgacagtcttg

SEQ ID NO: 443978 - DNA, 25 bp, Rattus norvegicus
ggctcactggccatgaacctggtag

SEQ ID NO: 443979 - DNA, 25 bp, Rattus norvegicus
ggctcactggccttgaacctggtag

SEQ ID NO: 443980 - DNA, 25 bp, Rattus norvegicus
ggctcactgggaagttctagtgcta

SEQ ID NO: 443981 - DNA, 25 bp, Rattus norvegicus
ggctcactgggatgttctagtgcta

SEQ ID NO: 443982 - DNA, 25 bp, Rattus norvegicus
ggctcacttgtcaaagggtggcaag

SEQ ID NO: 443983 - DNA, 25 bp, Rattus norvegicus
ggctcacttgtctaagggtggcaag

SEQ ID NO: 443984 - DNA, 25 bp, Rattus norvegicus
ggctcacttttcagggttgttattt

SEQ ID NO: 443985 - DNA, 25 bp, Rattus norvegicus
ggctcacttttctgggttgttattt

SEQ ID NO: 443986 - DNA, 25 bp, Rattus norvegicus
ggctcagaagatcctgaaccccttg

SEQ ID NO: 443987 - DNA, 25 bp, Rattus norvegicus
ggctcagaagatgctgaaccccttg

SEQ ID NO: 443988 - DNA, 25 bp, Rattus norvegicus
ggctcagaaggcagtcacacatttt

SEQ ID NO: 443989 - DNA, 25 bp, Rattus norvegicus
ggctcagaaggctgtcacacatttt

SEQ ID NO: 443990 - DNA, 25 bp, Rattus norvegicus
ggctcagaagggaacaaggcagatt

SEQ ID NO: 443991 - DNA, 25 bp, Rattus norvegicus
ggctcagaagggtacaaggcagatt

SEQ ID NO: 443992 - DNA, 25 bp, Rattus norvegicus
ggctcagaatggaatatttaggcaa

SEQ ID NO: 443993 - DNA, 25 bp, Rattus norvegicus
ggctcagaatggtatatttaggcaa

SEQ ID NO: 443994 - DNA, 25 bp, Rattus norvegicus
ggctcagaccacatggcttcctatt

SEQ ID NO: 443995 - DNA, 25 bp, Rattus norvegicus
ggctcagaccacttggcttcctatt

SEQ ID NO: 443996 - DNA, 25 bp, Rattus norvegicus
ggctcagaccttcgagaatgcctgg

SEQ ID NO: 443997 - DNA, 25 bp, Rattus norvegicus
ggctcagaccttggagaatgcctgg

SEQ ID NO: 443998 - DNA, 25 bp, Rattus norvegicus
ggctcagacgggaatgcaactttaa

SEQ ID NO: 443999 - DNA, 25 bp, Rattus norvegicus
ggctcagacgggtatgcaactttaa

SEQ ID NO: 444000 - DNA, 25 bp, Rattus norvegicus
ggctcagactcccttttgtcttaaa

SEQ ID NO: 444001 - DNA, 25 bp, Rattus norvegicus
ggctcagactccgttttgtcttaaa

SEQ ID NO: 444002 - DNA, 25 bp, Rattus norvegicus
ggctcagactttcgattacgatcat

SEQ ID NO: 444003 - DNA, 25 bp, Rattus norvegicus
ggctcagactttggattacgatcat

SEQ ID NO: 444004 - DNA, 25 bp, Rattus norvegicus
ggctcagagctgacagtttggctaa

SEQ ID NO: 444005 - DNA, 25 bp, Rattus norvegicus
ggctcagagctgtcagtttggctaa

SEQ ID NO: 444006 - DNA, 25 bp, Rattus norvegicus
ggctcagaggagcaggccacccatt

SEQ ID NO: 444007 - DNA, 25 bp, Rattus norvegicus
ggctcagaggaggaggccacccatt

SEQ ID NO: 444008 - DNA, 25 bp, Rattus norvegicus
ggctcagaggcgagtcacatctaca

SEQ ID NO: 444009 - DNA, 25 bp, Rattus norvegicus
ggctcagaggcgtgtcacatctaca

SEQ ID NO: 444010 - DNA, 25 bp, Rattus norvegicus
ggctcagaggttagaagtgctgcct

SEQ ID NO: 444011 - DNA, 25 bp, Rattus norvegicus
ggctcagaggtttgaagtgctgcct

SEQ ID NO: 444012 - DNA, 25 bp, Rattus norvegicus
ggctcagagtacatctaactcaatg

SEQ ID NO: 444013 - DNA, 25 bp, Rattus norvegicus
ggctcagagtacttctaactcaatg

SEQ ID NO: 444014 - DNA, 25 bp, Rattus norvegicus
ggctcagagttgaacactgctgcat

SEQ ID NO: 444015 - DNA, 25 bp, Rattus norvegicus
ggctcagagttgtacactgctgcat

SEQ ID NO: 444016 - DNA, 25 bp, Rattus norvegicus
ggctcagataccctttccttggaac

SEQ ID NO: 444017 - DNA, 25 bp, Rattus norvegicus
ggctcagataccgtttccttggaac

SEQ ID NO: 444018 - DNA, 25 bp, Rattus norvegicus
ggctcagcaacgcaaatgtttctca

SEQ ID NO: 444019 - DNA, 25 bp, Rattus norvegicus
ggctcagcaacggaaatgtttctca

SEQ ID NO: 444020 - DNA, 25 bp, Rattus norvegicus
ggctcagcagccaggagcacttgtt

SEQ ID NO: 444021 - DNA, 25 bp, Rattus norvegicus
ggctcagcagcctggagcacttgtt

SEQ ID NO: 444022 - DNA, 25 bp, Rattus norvegicus
ggctcagcagctagagaactccaca

SEQ ID NO: 444023 - DNA, 25 bp, Rattus norvegicus
ggctcagcagcttgagaactccaca

SEQ ID NO: 444024 - DNA, 25 bp, Rattus norvegicus
ggctcagcattaagttccttatgga

SEQ ID NO: 444025 - DNA, 25 bp, Rattus norvegicus
ggctcagcattatgttccttatgga

SEQ ID NO: 444026 - DNA, 25 bp, Rattus norvegicus
ggctcagccagtcaaaagtaccaca

SEQ ID NO: 444027 - DNA, 25 bp, Rattus norvegicus
ggctcagccagtcaagtgttcacct

SEQ ID NO: 444028 - DNA, 25 bp, Rattus norvegicus
ggctcagccagtgaaaagtaccaca

SEQ ID NO: 444029 - DNA, 25 bp, Rattus norvegicus
ggctcagccagtgaagtgttcacct

SEQ ID NO: 444030 - DNA, 25 bp, Rattus norvegicus
ggctcagcctagctcacccataggg

SEQ ID NO: 444031 - DNA, 25 bp, Rattus norvegicus
ggctcagcctaggtcacccataggg

SEQ ID NO: 444032 - DNA, 25 bp, Rattus norvegicus
ggctcagcctccatgtgtgtactgt

SEQ ID NO: 444033 - DNA, 25 bp, Rattus norvegicus
ggctcagcctccttgtgtgtactgt

SEQ ID NO: 444034 - DNA, 25 bp, Rattus norvegicus
ggctcagccttaaagaggcctggct

SEQ ID NO: 444035 - DNA, 25 bp, Rattus norvegicus
ggctcagccttatagaggcctggct

SEQ ID NO: 444036 - DNA, 25 bp, Rattus norvegicus
ggctcagcggtgctgatgctcatcc

SEQ ID NO: 444037 - DNA, 25 bp, Rattus norvegicus
ggctcagcggtggtgatgctcatcc

SEQ ID NO: 444038 - DNA, 25 bp, Rattus norvegicus
ggctcagctatcagtttacaaactg

SEQ ID NO: 444039 - DNA, 25 bp, Rattus norvegicus
ggctcagctatctgtttacaaactg

SEQ ID NO: 444040 - DNA, 25 bp, Rattus norvegicus
ggctcagctcttatgcctgtcagga

SEQ ID NO: 444041 - DNA, 25 bp, Rattus norvegicus
ggctcagctcttttgcctgtcagga

SEQ ID NO: 444042 - DNA, 25 bp, Rattus norvegicus
ggctcagctgaacttatgtccatgt

SEQ ID NO: 444043 - DNA, 25 bp, Rattus norvegicus
ggctcagctgaagttatgtccatgt

SEQ ID NO: 444044 - DNA, 25 bp, Rattus norvegicus
ggctcagctgagacacacaaagggt

SEQ ID NO: 444045 - DNA, 25 bp, Rattus norvegicus
ggctcagctgagtcacacaaagggt

SEQ ID NO: 444046 - DNA, 25 bp, Rattus norvegicus
ggctcagcttagcaaaagtcccaag

SEQ ID NO: 444047 - DNA, 25 bp, Rattus norvegicus
ggctcagcttaggaaaagtcccaag

SEQ ID NO: 444048 - DNA, 25 bp, Rattus norvegicus
ggctcagcttcgagggcgccgccaa

SEQ ID NO: 444049 - DNA, 25 bp, Rattus norvegicus
ggctcagcttcgtgggcgccgccaa

SEQ ID NO: 444050 - DNA, 25 bp, Rattus norvegicus
ggctcaggaagcaaattgtgaccat

SEQ ID NO: 444051 - DNA, 25 bp, Rattus norvegicus
ggctcaggaagctaattgtgaccat

SEQ ID NO: 444052 - DNA, 25 bp, Rattus norvegicus
ggctcaggacatatcctccagagca

SEQ ID NO: 444053 - DNA, 25 bp, Rattus norvegicus
ggctcaggacatttcctccagagca

SEQ ID NO: 444054 - DNA, 25 bp, Rattus norvegicus
ggctcaggacctatgtagtttttat

SEQ ID NO: 444055 - DNA, 25 bp, Rattus norvegicus
ggctcaggacctttgtagtttttat

SEQ ID NO: 444056 - DNA, 25 bp, Rattus norvegicus
ggctcaggagaactcaggctaccct

SEQ ID NO: 444057 - DNA, 25 bp, Rattus norvegicus
ggctcaggagaagtcaggctaccct

SEQ ID NO: 444058 - DNA, 25 bp, Rattus norvegicus
ggctcaggcactaagatcaacaatt

SEQ ID NO: 444059 - DNA, 25 bp, Rattus norvegicus
ggctcaggcacttagatcaacaatt

SEQ ID NO: 444060 - DNA, 25 bp, Rattus norvegicus
ggctcaggcagaatgagtttcatct

SEQ ID NO: 444061 - DNA, 25 bp, Rattus norvegicus
ggctcaggcagattgagtttcatct

SEQ ID NO: 444062 - DNA, 25 bp, Rattus norvegicus
ggctcaggcattagcacgactggtc

SEQ ID NO: 444063 - DNA, 25 bp, Rattus norvegicus
ggctcaggcatttgcacgactggtc

SEQ ID NO: 444064 - DNA, 25 bp, Rattus norvegicus
ggctcaggccacagctaatcataaa

SEQ ID NO: 444065 - DNA, 25 bp, Rattus norvegicus
ggctcaggccactgctaatcataaa

SEQ ID NO: 444066 - DNA, 25 bp, Rattus norvegicus
ggctcaggccgaactgcagatggaa

SEQ ID NO: 444067 - DNA, 25 bp, Rattus norvegicus
ggctcaggccgatctgcagatggaa

SEQ ID NO: 444068 - DNA, 25 bp, Rattus norvegicus
ggctcaggcggccaatcagcctctg

SEQ ID NO: 444069 - DNA, 25 bp, Rattus norvegicus
ggctcaggcggcgaatcagcctctg

SEQ ID NO: 444070 - DNA, 25 bp, Rattus norvegicus
ggctcaggctctctcatgtgcgagt

SEQ ID NO: 444071 - DNA, 25 bp, Rattus norvegicus
ggctcaggctctgtcatgtgcgagt

SEQ ID NO: 444072 - DNA, 25 bp, Rattus norvegicus
ggctcaggctggacttaactgggat

SEQ ID NO: 444073 - DNA, 25 bp, Rattus norvegicus
ggctcaggctggtcttaactgggat

SEQ ID NO: 444074 - DNA, 25 bp, Rattus norvegicus
ggctcagggaaaaagttctctgaat

SEQ ID NO: 444075 - DNA, 25 bp, Rattus norvegicus
ggctcagggaaatagttctctgaat

SEQ ID NO: 444076 - DNA, 25 bp, Rattus norvegicus
ggctcagggcagctttaaaacctag

SEQ ID NO: 444077 - DNA, 25 bp, Rattus norvegicus
ggctcagggcaggtttaaaacctag

SEQ ID NO: 444078 - DNA, 25 bp, Rattus norvegicus
ggctcagggccaacgaagacggaaa

SEQ ID NO: 444079 - DNA, 25 bp, Rattus norvegicus
ggctcagggccatcgaagacggaaa

SEQ ID NO: 444080 - DNA, 25 bp, Rattus norvegicus
ggctcagggctcaagttcaagctgt

SEQ ID NO: 444081 - DNA, 25 bp, Rattus norvegicus
ggctcagggctctagttcaagctgt

SEQ ID NO: 444082 - DNA, 25 bp, Rattus norvegicus
ggctcaggtagtacaaaatgcttgc

SEQ ID NO: 444083 - DNA, 25 bp, Rattus norvegicus
ggctcaggtagttcaaaatgcttgc

SEQ ID NO: 444084 - DNA, 25 bp, Rattus norvegicus
ggctcaggtgcccatggtttgctta

SEQ ID NO: 444085 - DNA, 25 bp, Rattus norvegicus
ggctcaggtgccgatggtttgctta

SEQ ID NO: 444086 - DNA, 25 bp, Rattus norvegicus
ggctcagtaatgctcaagattccaa

SEQ ID NO: 444087 - DNA, 25 bp, Rattus norvegicus
ggctcagtaatggtcaagattccaa

SEQ ID NO: 444088 - DNA, 25 bp, Rattus norvegicus
ggctcagtagcacaatttgcaccac

SEQ ID NO: 444089 - DNA, 25 bp, Rattus norvegicus
ggctcagtagcagaatttgcaccac

SEQ ID NO: 444090 - DNA, 25 bp, Rattus norvegicus
ggctcagtcagtcaaccatgggttt

SEQ ID NO: 444091 - DNA, 25 bp, Rattus norvegicus
ggctcagtcagtgaaccatgggttt

SEQ ID NO: 444092 - DNA, 25 bp, Rattus norvegicus
ggctcagtcatcaggaacatcgtca

SEQ ID NO: 444093 - DNA, 25 bp, Rattus norvegicus
ggctcagtcatctggaacatcgtca

SEQ ID NO: 444094 - DNA, 25 bp, Rattus norvegicus
ggctcagtcccaacagcagactgta

SEQ ID NO: 444095 - DNA, 25 bp, Rattus norvegicus
ggctcagtcccatcagcagactgta

SEQ ID NO: 444096 - DNA, 25 bp, Rattus norvegicus
ggctcagtctctagtttaaatgtta

SEQ ID NO: 444097 - DNA, 25 bp, Rattus norvegicus
ggctcagtctcttgtttaaatgtta

SEQ ID NO: 444098 - DNA, 25 bp, Rattus norvegicus
ggctcagtgagcaaaggcacctgct

SEQ ID NO: 444099 - DNA, 25 bp, Rattus norvegicus
ggctcagtgagctaaggcacctgct

SEQ ID NO: 444100 - DNA, 25 bp, Rattus norvegicus
ggctcagtgcccatggaaagtactc

SEQ ID NO: 444101 - DNA, 25 bp, Rattus norvegicus
ggctcagtgcccttggaaagtactc

SEQ ID NO: 444102 - DNA, 25 bp, Rattus norvegicus
ggctcagtgggcatcttgcaactta

SEQ ID NO: 444103 - DNA, 25 bp, Rattus norvegicus
ggctcagtgggcttcttgcaactta

SEQ ID NO: 444104 - DNA, 25 bp, Rattus norvegicus
ggctcagtggtcaagctttctagta

SEQ ID NO: 444105 - DNA, 25 bp, Rattus norvegicus
ggctcagtggtctagctttctagta

SEQ ID NO: 444106 - DNA, 25 bp, Rattus norvegicus
ggctcagtggttacataaaataaat

SEQ ID NO: 444107 - DNA, 25 bp, Rattus norvegicus
ggctcagtggtttcataaaataaat

SEQ ID NO: 444108 - DNA, 25 bp, Rattus norvegicus
ggctcagttccaagaaaagatctac

SEQ ID NO: 444109 - DNA, 25 bp, Rattus norvegicus
ggctcagttccatgaaaagatctac

SEQ ID NO: 444110 - DNA, 25 bp, Rattus norvegicus
ggctcagttctacggtgcatgtgac

SEQ ID NO: 444111 - DNA, 25 bp, Rattus norvegicus
ggctcagttctagggtgcatgtgac

SEQ ID NO: 444112 - DNA, 25 bp, Rattus norvegicus
ggctcagttggaaaagcgcttactt

SEQ ID NO: 444113 - DNA, 25 bp, Rattus norvegicus
ggctcagttggataagcgcttactt

SEQ ID NO: 444114 - DNA, 25 bp, Rattus norvegicus
ggctcagttgtaatacagtgacagt

SEQ ID NO: 444115 - DNA, 25 bp, Rattus norvegicus
ggctcagttgtattacagtgacagt

SEQ ID NO: 444116 - DNA, 25 bp, Rattus norvegicus
ggctcagttgttaagacctccgact

SEQ ID NO: 444117 - DNA, 25 bp, Rattus norvegicus
ggctcagttgtttagacctccgact

SEQ ID NO: 444118 - DNA, 25 bp, Rattus norvegicus
ggctcataaaatagcgctctgtctt

SEQ ID NO: 444119 - DNA, 25 bp, Rattus norvegicus
ggctcataaaattgcgctctgtctt

SEQ ID NO: 444120 - DNA, 25 bp, Rattus norvegicus
ggctcataatgtctggttttatcat

SEQ ID NO: 444121 - DNA, 25 bp, Rattus norvegicus
ggctcataatgtgtggttttatcat

SEQ ID NO: 444122 - DNA, 25 bp, Rattus norvegicus
ggctcatagcccagtgatcagacat

SEQ ID NO: 444123 - DNA, 25 bp, Rattus norvegicus
ggctcatagccctgtgatcagacat

SEQ ID NO: 444124 - DNA, 25 bp, Rattus norvegicus
ggctcatatccaccgttcagtagaa

SEQ ID NO: 444125 - DNA, 25 bp, Rattus norvegicus
ggctcatatccagcgttcagtagaa

SEQ ID NO: 444126 - DNA, 25 bp, Rattus norvegicus
ggctcatatcgaaggttctggctta

SEQ ID NO: 444127 - DNA, 25 bp, Rattus norvegicus
ggctcatatcgatggttctggctta

SEQ ID NO: 444128 - DNA, 25 bp, Rattus norvegicus
ggctcatcaaggaagcatcactttt

SEQ ID NO: 444129 - DNA, 25 bp, Rattus norvegicus
ggctcatcaaggtagcatcactttt

SEQ ID NO: 444130 - DNA, 25 bp, Rattus norvegicus
ggctcatcagtaactgcacaccggg

SEQ ID NO: 444131 - DNA, 25 bp, Rattus norvegicus
ggctcatcagtaccagtgttcagct

SEQ ID NO: 444132 - DNA, 25 bp, Rattus norvegicus
ggctcatcagtagcagtgttcagct

SEQ ID NO: 444133 - DNA, 25 bp, Rattus norvegicus
ggctcatcagtatctgcacaccggg

SEQ ID NO: 444134 - DNA, 25 bp, Rattus norvegicus
ggctcatcattgacctacaggacag

SEQ ID NO: 444135 - DNA, 25 bp, Rattus norvegicus
ggctcatcattgtcctacaggacag

SEQ ID NO: 444136 - DNA, 25 bp, Rattus norvegicus
ggctcatcctgactttcagagctat

SEQ ID NO: 444137 - DNA, 25 bp, Rattus norvegicus
ggctcatcctgagtttcagagctat

SEQ ID NO: 444138 - DNA, 25 bp, Rattus norvegicus
ggctcatccttaaggattcaccaga

SEQ ID NO: 444139 - DNA, 25 bp, Rattus norvegicus
ggctcatccttatggattcaccaga

SEQ ID NO: 444140 - DNA, 25 bp, Rattus norvegicus
ggctcatcgcacagtaatgtcattc

SEQ ID NO: 444141 - DNA, 25 bp, Rattus norvegicus
ggctcatcgcactgtaatgtcattc

SEQ ID NO: 444142 - DNA, 25 bp, Rattus norvegicus
ggctcatctggtaggctcagtttaa

SEQ ID NO: 444143 - DNA, 25 bp, Rattus norvegicus
ggctcatctggttggctcagtttaa

SEQ ID NO: 444144 - DNA, 25 bp, Rattus norvegicus
ggctcatgaccacagtccatgccat

SEQ ID NO: 444145 - DNA, 25 bp, Rattus norvegicus
ggctcatgaccagagtccatgccat

SEQ ID NO: 444146 - DNA, 25 bp, Rattus norvegicus
ggctcatgatgaaatcatccccatg

SEQ ID NO: 444147 - DNA, 25 bp, Rattus norvegicus
ggctcatgatgatatcatccccatg

SEQ ID NO: 444148 - DNA, 25 bp, Rattus norvegicus
ggctcatgccacacatgcgtgagat

SEQ ID NO: 444149 - DNA, 25 bp, Rattus norvegicus
ggctcatgccactcatgcgtgagat

SEQ ID NO: 444150 - DNA, 25 bp, Rattus norvegicus
ggctcatgccagaaaccgagactta

SEQ ID NO: 444151 - DNA, 25 bp, Rattus norvegicus
ggctcatgccagtaaccgagactta

SEQ ID NO: 444152 - DNA, 25 bp, Rattus norvegicus
ggctcatgccttaaagtttagcatc

SEQ ID NO: 444153 - DNA, 25 bp, Rattus norvegicus
ggctcatgcctttaagtttagcatc

SEQ ID NO: 444154 - DNA, 25 bp, Rattus norvegicus
ggctcatgcgacaaaaatagctgat

SEQ ID NO: 444155 - DNA, 25 bp, Rattus norvegicus
ggctcatgcgactaaaatagctgat

SEQ ID NO: 444156 - DNA, 25 bp, Rattus norvegicus
ggctcatgctggatagcagtgcaca

SEQ ID NO: 444157 - DNA, 25 bp, Rattus norvegicus
ggctcatgctggttagcagtgcaca

SEQ ID NO: 444158 - DNA, 25 bp, Rattus norvegicus
ggctcatgtggcctgaaatgtgtct

SEQ ID NO: 444159 - DNA, 25 bp, Rattus norvegicus
ggctcatgtggcgtgaaatgtgtct

SEQ ID NO: 444160 - DNA, 25 bp, Rattus norvegicus
ggctcattccttaatagacaccaca

SEQ ID NO: 444161 - DNA, 25 bp, Rattus norvegicus
ggctcattcctttatagacaccaca

SEQ ID NO: 444162 - DNA, 25 bp, Rattus norvegicus
ggctcattctcaacgtgggacctaa

SEQ ID NO: 444163 - DNA, 25 bp, Rattus norvegicus
ggctcattctcatcgtgggacctaa

SEQ ID NO: 444164 - DNA, 25 bp, Rattus norvegicus
ggctcatttcatagtcatgcacaca

SEQ ID NO: 444165 - DNA, 25 bp, Rattus norvegicus
ggctcatttcattgtcatgcacaca

SEQ ID NO: 444166 - DNA, 25 bp, Rattus norvegicus
ggctcatttgccaacacatatctgt

SEQ ID NO: 444167 - DNA, 25 bp, Rattus norvegicus
ggctcatttgcctacacatatctgt

SEQ ID NO: 444168 - DNA, 25 bp, Rattus norvegicus
ggctcattttatatggatcacccaa

SEQ ID NO: 444169 - DNA, 25 bp, Rattus norvegicus
ggctcattttatttggatcacccaa

SEQ ID NO: 444170 - DNA, 25 bp, Rattus norvegicus
ggctcattttgaccttccattagca

SEQ ID NO: 444171 - DNA, 25 bp, Rattus norvegicus
ggctcattttgagcttccattagca

SEQ ID NO: 444172 - DNA, 25 bp, Rattus norvegicus
ggctcatttttgatcagattctact

SEQ ID NO: 444173 - DNA, 25 bp, Rattus norvegicus
ggctcatttttgttcagattctact

SEQ ID NO: 444174 - DNA, 25 bp, Rattus norvegicus
ggctccaaaaatatgcctgccttga

SEQ ID NO: 444175 - DNA, 25 bp, Rattus norvegicus
ggctccaaaaatttgcctgccttga

SEQ ID NO: 444176 - DNA, 25 bp, Rattus norvegicus
ggctccaaaagcatggggccaactt

SEQ ID NO: 444177 - DNA, 25 bp, Rattus norvegicus
ggctccaaaagcttggggccaactt

SEQ ID NO: 444178 - DNA, 25 bp, Rattus norvegicus
ggctccaaatgaattctgtactgca

SEQ ID NO: 444179 - DNA, 25 bp, Rattus norvegicus
ggctccaaatgatttctgtactgca

SEQ ID NO: 444180 - DNA, 25 bp, Rattus norvegicus
ggctccaacattccacttagcttga

SEQ ID NO: 444181 - DNA, 25 bp, Rattus norvegicus
ggctccaacattgcacttagcttga

SEQ ID NO: 444182 - DNA, 25 bp, Rattus norvegicus
ggctccaaccaactcaattctgaat

SEQ ID NO: 444183 - DNA, 25 bp, Rattus norvegicus
ggctccaaccaagtcaattctgaat

SEQ ID NO: 444184 - DNA, 25 bp, Rattus norvegicus
ggctccaacctgagcaagttgtcag

SEQ ID NO: 444185 - DNA, 25 bp, Rattus norvegicus
ggctccaacctgtgcaagttgtcag

SEQ ID NO: 444186 - DNA, 25 bp, Rattus norvegicus
ggctccaaggacagctccggcagca

SEQ ID NO: 444187 - DNA, 25 bp, Rattus norvegicus
ggctccaaggactgctccggcagca

SEQ ID NO: 444188 - DNA, 25 bp, Rattus norvegicus
ggctccacaataaatctgtgagtgt

SEQ ID NO: 444189 - DNA, 25 bp, Rattus norvegicus
ggctccacaatatatctgtgagtgt

SEQ ID NO: 444190 - DNA, 25 bp, Rattus norvegicus
ggctccacacccatgagtttctggg

SEQ ID NO: 444191 - DNA, 25 bp, Rattus norvegicus
ggctccacacccttgagtttctggg

SEQ ID NO: 444192 - DNA, 25 bp, Rattus norvegicus
ggctccacagatcggtgctgtctga

SEQ ID NO: 444193 - DNA, 25 bp, Rattus norvegicus
ggctccacagatgggtgctgtctga

SEQ ID NO: 444194 - DNA, 25 bp, Rattus norvegicus
ggctccaccaagcagtgattctgcc

SEQ ID NO: 444195 - DNA, 25 bp, Rattus norvegicus
ggctccaccaaggagtgattctgcc

SEQ ID NO: 444196 - DNA, 25 bp, Rattus norvegicus
ggctccaccatgctgacttggtaaa

SEQ ID NO: 444197 - DNA, 25 bp, Rattus norvegicus
ggctccaccatggtgacttggtaaa

SEQ ID NO: 444198 - DNA, 25 bp, Rattus norvegicus
ggctccaccctcacttataggagat

SEQ ID NO: 444199 - DNA, 25 bp, Rattus norvegicus
ggctccaccctctcttataggagat

SEQ ID NO: 444200 - DNA, 25 bp, Rattus norvegicus
ggctccaccgtgcaagcgctggttt

SEQ ID NO: 444201 - DNA, 25 bp, Rattus norvegicus
ggctccaccgtggaagcgctggttt

SEQ ID NO: 444202 - DNA, 25 bp, Rattus norvegicus
ggctccacgcatatgacttttaaga

SEQ ID NO: 444203 - DNA, 25 bp, Rattus norvegicus
ggctccacgcatttgacttttaaga

SEQ ID NO: 444204 - DNA, 25 bp, Rattus norvegicus
ggctccacgggaattttgggttcat

SEQ ID NO: 444205 - DNA, 25 bp, Rattus norvegicus
ggctccacgggatttttgggttcat

SEQ ID NO: 444206 - DNA, 25 bp, Rattus norvegicus
ggctccacggtaaccgatgtttaga

SEQ ID NO: 444207 - DNA, 25 bp, Rattus norvegicus
ggctccacggtatccgatgtttaga

SEQ ID NO: 444208 - DNA, 25 bp, Rattus norvegicus
ggctccactcgtaataaataagctt

SEQ ID NO: 444209 - DNA, 25 bp, Rattus norvegicus
ggctccactcgttataaataagctt

SEQ ID NO: 444210 - DNA, 25 bp, Rattus norvegicus
ggctccacttatacttttaccagat

SEQ ID NO: 444211 - DNA, 25 bp, Rattus norvegicus
ggctccacttattcttttaccagat

SEQ ID NO: 444212 - DNA, 25 bp, Rattus norvegicus
ggctccagaggaatccccggtccag

SEQ ID NO: 444213 - DNA, 25 bp, Rattus norvegicus
ggctccagaggattccccggtccag

SEQ ID NO: 444214 - DNA, 25 bp, Rattus norvegicus
ggctccagagttcaagggctttcag

SEQ ID NO: 444215 - DNA, 25 bp, Rattus norvegicus
ggctccagagttgaagggctttcag

SEQ ID NO: 444216 - DNA, 25 bp, Rattus norvegicus
ggctccagcaacctgtaccaaagga

SEQ ID NO: 444217 - DNA, 25 bp, Rattus norvegicus
ggctccagcaacgtgtaccaaagga

SEQ ID NO: 444218 - DNA, 25 bp, Rattus norvegicus
ggctccagcactcttaagttgtttt

SEQ ID NO: 444219 - DNA, 25 bp, Rattus norvegicus
ggctccagcactgttaagttgtttt

SEQ ID NO: 444220 - DNA, 25 bp, Rattus norvegicus
ggctccagcagccagaatgtcactg

SEQ ID NO: 444221 - DNA, 25 bp, Rattus norvegicus
ggctccagcagcgagaatgtcactg

SEQ ID NO: 444222 - DNA, 25 bp, Rattus norvegicus
ggctccagcataccatctaattctg

SEQ ID NO: 444223 - DNA, 25 bp, Rattus norvegicus
ggctccagcatagcatctaattctg

SEQ ID NO: 444224 - DNA, 25 bp, Rattus norvegicus
ggctccagccagaaggcttttgtat

SEQ ID NO: 444225 - DNA, 25 bp, Rattus norvegicus
ggctccagccagtaggcttttgtat

SEQ ID NO: 444226 - DNA, 25 bp, Rattus norvegicus
ggctccagccatccagttgatttag

SEQ ID NO: 444227 - DNA, 25 bp, Rattus norvegicus
ggctccagccatgcagttgatttag

SEQ ID NO: 444228 - DNA, 25 bp, Rattus norvegicus
ggctccagcctaattctttattcat

SEQ ID NO: 444229 - DNA, 25 bp, Rattus norvegicus
ggctccagcctatttctttattcat

SEQ ID NO: 444230 - DNA, 25 bp, Rattus norvegicus
ggctccagcttcaggaggatgccaa

SEQ ID NO: 444231 - DNA, 25 bp, Rattus norvegicus
ggctccagcttcattagcacaaatg

SEQ ID NO: 444232 - DNA, 25 bp, Rattus norvegicus
ggctccagcttctggaggatgccaa

SEQ ID NO: 444233 - DNA, 25 bp, Rattus norvegicus
ggctccagcttctttagcacaaatg

SEQ ID NO: 444234 - DNA, 25 bp, Rattus norvegicus
ggctccaggaacatgtagacacaca

SEQ ID NO: 444235 - DNA, 25 bp, Rattus norvegicus
ggctccaggaacttgtagacacaca

SEQ ID NO: 444236 - DNA, 25 bp, Rattus norvegicus
ggctccaggctccacaaatgacaaa

SEQ ID NO: 444237 - DNA, 25 bp, Rattus norvegicus
ggctccaggctcgacaaatgacaaa

SEQ ID NO: 444238 - DNA, 25 bp, Rattus norvegicus
ggctccagggctactgatgctgtga

SEQ ID NO: 444239 - DNA, 25 bp, Rattus norvegicus
ggctccagggcttctgatgctgtga

SEQ ID NO: 444240 - DNA, 25 bp, Rattus norvegicus
ggctccagggtcactggattcatgg

SEQ ID NO: 444241 - DNA, 25 bp, Rattus norvegicus
ggctccagggtctctggattcatgg

SEQ ID NO: 444242 - DNA, 25 bp, Rattus norvegicus
ggctccagtctcactgtttgatcaa

SEQ ID NO: 444243 - DNA, 25 bp, Rattus norvegicus
ggctccagtctctctgtttgatcaa

SEQ ID NO: 444244 - DNA, 25 bp, Rattus norvegicus
ggctccagttaacgcccagacttta

SEQ ID NO: 444245 - DNA, 25 bp, Rattus norvegicus
ggctccagttaaggcccagacttta

SEQ ID NO: 444246 - DNA, 25 bp, Rattus norvegicus
ggctccagttggagggactctagta

SEQ ID NO: 444247 - DNA, 25 bp, Rattus norvegicus
ggctccagttggtgggactctagta

SEQ ID NO: 444248 - DNA, 25 bp, Rattus norvegicus
ggctccataaccctttataagctgt

SEQ ID NO: 444249 - DNA, 25 bp, Rattus norvegicus
ggctccataaccgtttataagctgt

SEQ ID NO: 444250 - DNA, 25 bp, Rattus norvegicus
ggctccatacctcatactattactg

SEQ ID NO: 444251 - DNA, 25 bp, Rattus norvegicus
ggctccatacctgatactattactg

SEQ ID NO: 444252 - DNA, 25 bp, Rattus norvegicus
ggctccatagccactcagggactga

SEQ ID NO: 444253 - DNA, 25 bp, Rattus norvegicus
ggctccatagcctctcagggactga

SEQ ID NO: 444254 - DNA, 25 bp, Rattus norvegicus
ggctccatagtgacagtgctacaat

SEQ ID NO: 444255 - DNA, 25 bp, Rattus norvegicus
ggctccatagtgtcagtgctacaat

SEQ ID NO: 444256 - DNA, 25 bp, Rattus norvegicus
ggctccatcatcagtgacatcaagt

SEQ ID NO: 444257 - DNA, 25 bp, Rattus norvegicus
ggctccatcatctgtgacatcaagt

SEQ ID NO: 444258 - DNA, 25 bp, Rattus norvegicus
ggctccatcccactagaacagtttg

SEQ ID NO: 444259 - DNA, 25 bp, Rattus norvegicus
ggctccatcccagtagaacagtttg

SEQ ID NO: 444260 - DNA, 25 bp, Rattus norvegicus
ggctccatcctaccatctttgggta

SEQ ID NO: 444261 - DNA, 25 bp, Rattus norvegicus
ggctccatcctacgttatttggcag

SEQ ID NO: 444262 - DNA, 25 bp, Rattus norvegicus
ggctccatcctagcatctttgggta

SEQ ID NO: 444263 - DNA, 25 bp, Rattus norvegicus
ggctccatcctaggttatttggcag

SEQ ID NO: 444264 - DNA, 25 bp, Rattus norvegicus
ggctccatctacaaacctggtggta

SEQ ID NO: 444265 - DNA, 25 bp, Rattus norvegicus
ggctccatctactaacctggtggta

SEQ ID NO: 444266 - DNA, 25 bp, Rattus norvegicus
ggctccatctcaaatatcactattg

SEQ ID NO: 444267 - DNA, 25 bp, Rattus norvegicus
ggctccatctcatatatcactattg

SEQ ID NO: 444268 - DNA, 25 bp, Rattus norvegicus
ggctccatcttaaatatggccgacg

SEQ ID NO: 444269 - DNA, 25 bp, Rattus norvegicus
ggctccatcttatatatggccgacg

SEQ ID NO: 444270 - DNA, 25 bp, Rattus norvegicus
ggctccatgcggatcaagcacagcg

SEQ ID NO: 444271 - DNA, 25 bp, Rattus norvegicus
ggctccatgcggttcaagcacagcg

SEQ ID NO: 444272 - DNA, 25 bp, Rattus norvegicus
ggctccattcttagtctatgaaggg

SEQ ID NO: 444273 - DNA, 25 bp, Rattus norvegicus
ggctccattctttgtctatgaaggg

SEQ ID NO: 444274 - DNA, 25 bp, Rattus norvegicus
ggctccattgttaggttccaatcca

SEQ ID NO: 444275 - DNA, 25 bp, Rattus norvegicus
ggctccattgtttggttccaatcca

SEQ ID NO: 444276 - DNA, 25 bp, Rattus norvegicus
ggctcccaaaagaaaactgcgcatc

SEQ ID NO: 444277 - DNA, 25 bp, Rattus norvegicus
ggctcccaaaagaggaggccggctt

SEQ ID NO: 444278 - DNA, 25 bp, Rattus norvegicus
ggctcccaaaagtaaactgcgcatc

SEQ ID NO: 444279 - DNA, 25 bp, Rattus norvegicus
ggctcccaaaagtggaggccggctt

SEQ ID NO: 444280 - DNA, 25 bp, Rattus norvegicus
ggctcccaaaatcacccgtgtggtt

SEQ ID NO: 444281 - DNA, 25 bp, Rattus norvegicus
ggctcccaaaatgacccgtgtggtt

SEQ ID NO: 444282 - DNA, 25 bp, Rattus norvegicus
ggctcccaaatactatctaacatcc

SEQ ID NO: 444283 - DNA, 25 bp, Rattus norvegicus
ggctcccaaatagtatctaacatcc

SEQ ID NO: 444284 - DNA, 25 bp, Rattus norvegicus
ggctcccaagcacggaatctggcaa

SEQ ID NO: 444285 - DNA, 25 bp, Rattus norvegicus
ggctcccaagcagggaatctggcaa

SEQ ID NO: 444286 - DNA, 25 bp, Rattus norvegicus
ggctcccaagccacatgacatgagt

SEQ ID NO: 444287 - DNA, 25 bp, Rattus norvegicus
ggctcccaagccctagtcattcttg

SEQ ID NO: 444288 - DNA, 25 bp, Rattus norvegicus
ggctcccaagccgtagtcattcttg

SEQ ID NO: 444289 - DNA, 25 bp, Rattus norvegicus
ggctcccaagcctcatgacatgagt

SEQ ID NO: 444290 - DNA, 25 bp, Rattus norvegicus
ggctcccacctgattacagacgttt

SEQ ID NO: 444291 - DNA, 25 bp, Rattus norvegicus
ggctcccacctgtttacagacgttt

SEQ ID NO: 444292 - DNA, 25 bp, Rattus norvegicus
ggctcccacggtcacttgtttacag

SEQ ID NO: 444293 - DNA, 25 bp, Rattus norvegicus
ggctcccacggtgacttgtttacag

SEQ ID NO: 444294 - DNA, 25 bp, Rattus norvegicus
ggctcccacgtgcttccagaaaaat

SEQ ID NO: 444295 - DNA, 25 bp, Rattus norvegicus
ggctcccacgtggttccagaaaaat

SEQ ID NO: 444296 - DNA, 25 bp, Rattus norvegicus
ggctcccagacaagcaccactgaaa

SEQ ID NO: 444297 - DNA, 25 bp, Rattus norvegicus
ggctcccagacatgcaccactgaaa

SEQ ID NO: 444298 - DNA, 25 bp, Rattus norvegicus
ggctcccagccacctgtgtttggaa

SEQ ID NO: 444299 - DNA, 25 bp, Rattus norvegicus
ggctcccagccagctgtgtttggaa

SEQ ID NO: 444300 - DNA, 25 bp, Rattus norvegicus
ggctcccagctacatgtgttggact

SEQ ID NO: 444301 - DNA, 25 bp, Rattus norvegicus
ggctcccagctagatgtgttggact

SEQ ID NO: 444302 - DNA, 25 bp, Rattus norvegicus
ggctcccataacagtgtgacttcta

SEQ ID NO: 444303 - DNA, 25 bp, Rattus norvegicus
ggctcccataactgtgtgacttcta

SEQ ID NO: 444304 - DNA, 25 bp, Rattus norvegicus
ggctccccagctagaaaggtcagtg

SEQ ID NO: 444305 - DNA, 25 bp, Rattus norvegicus
ggctccccagcttgaaaggtcagtg

SEQ ID NO: 444306 - DNA, 25 bp, Rattus norvegicus
ggctccccgtttaagctctttcaat

SEQ ID NO: 444307 - DNA, 25 bp, Rattus norvegicus
ggctccccgttttagctctttcaat

SEQ ID NO: 444308 - DNA, 25 bp, Rattus norvegicus
ggctcccctgcaccaaaaagaatga

SEQ ID NO: 444309 - DNA, 25 bp, Rattus norvegicus
ggctcccctgcagcaaaaagaatga

SEQ ID NO: 444310 - DNA, 25 bp, Rattus norvegicus
ggctcccctgtaattatcacttaag

SEQ ID NO: 444311 - DNA, 25 bp, Rattus norvegicus
ggctcccctgtatttatcacttaag

SEQ ID NO: 444312 - DNA, 25 bp, Rattus norvegicus
ggctcccgaatgactccaaagtttg

SEQ ID NO: 444313 - DNA, 25 bp, Rattus norvegicus
ggctcccgaatgtctccaaagtttg

SEQ ID NO: 444314 - DNA, 25 bp, Rattus norvegicus
ggctcccgggacattgatgtagagt

SEQ ID NO: 444315 - DNA, 25 bp, Rattus norvegicus
ggctcccgggactttgatgtagagt

SEQ ID NO: 444316 - DNA, 25 bp, Rattus norvegicus
ggctcccgggtcagaactcctaaag

SEQ ID NO: 444317 - DNA, 25 bp, Rattus norvegicus
ggctcccgggtctgaactcctaaag

SEQ ID NO: 444318 - DNA, 25 bp, Rattus norvegicus
ggctcccggtacatcatggggtcag

SEQ ID NO: 444319 - DNA, 25 bp, Rattus norvegicus
ggctcccggtacttcatggggtcag

SEQ ID NO: 444320 - DNA, 25 bp, Rattus norvegicus
ggctccctaatcatccctggaaatg

SEQ ID NO: 444321 - DNA, 25 bp, Rattus norvegicus
ggctccctaatcttccctggaaatg

SEQ ID NO: 444322 - DNA, 25 bp, Rattus norvegicus
ggctccctagaacatttccagttga

SEQ ID NO: 444323 - DNA, 25 bp, Rattus norvegicus
ggctccctagaagatttccagttga

SEQ ID NO: 444324 - DNA, 25 bp, Rattus norvegicus
ggctccctcaggactgggcccatga

SEQ ID NO: 444325 - DNA, 25 bp, Rattus norvegicus
ggctccctcaggtctgggcccatga

SEQ ID NO: 444326 - DNA, 25 bp, Rattus norvegicus
ggctccctcagtcgacacttgtgga

SEQ ID NO: 444327 - DNA, 25 bp, Rattus norvegicus
ggctccctcagtggacacttgtgga

SEQ ID NO: 444328 - DNA, 25 bp, Rattus norvegicus
ggctccctgagcattgggtccagaa

SEQ ID NO: 444329 - DNA, 25 bp, Rattus norvegicus
ggctccctgagctttgggtccagaa

SEQ ID NO: 444330 - DNA, 25 bp, Rattus norvegicus
ggctccctggtcagttcacctgagg

SEQ ID NO: 444331 - DNA, 25 bp, Rattus norvegicus
ggctccctggtctgttcacctgagg

SEQ ID NO: 444332 - DNA, 25 bp, Rattus norvegicus
ggctccctgtatattgtgtatgaaa

SEQ ID NO: 444333 - DNA, 25 bp, Rattus norvegicus
ggctccctgtattttgtgtatgaaa

SEQ ID NO: 444334 - DNA, 25 bp, Rattus norvegicus
ggctccctgtccatattcaaaagaa

SEQ ID NO: 444335 - DNA, 25 bp, Rattus norvegicus
ggctccctgtccttattcaaaagaa

SEQ ID NO: 444336 - DNA, 25 bp, Rattus norvegicus
ggctcccttctaagggatccccaaa

SEQ ID NO: 444337 - DNA, 25 bp, Rattus norvegicus
ggctcccttctatgggatccccaaa

SEQ ID NO: 444338 - DNA, 25 bp, Rattus norvegicus
ggctcccttcttcgcttatgaacta

SEQ ID NO: 444339 - DNA, 25 bp, Rattus norvegicus
ggctcccttcttggcttatgaacta

SEQ ID NO: 444340 - DNA, 25 bp, Rattus norvegicus
ggctcccttgctcaagtattcttag

SEQ ID NO: 444341 - DNA, 25 bp, Rattus norvegicus
ggctcccttgctgaagtattcttag

SEQ ID NO: 444342 - DNA, 25 bp, Rattus norvegicus
ggctcccttttcaaagagtttctga

SEQ ID NO: 444343 - DNA, 25 bp, Rattus norvegicus
ggctcccttttctaagagtttctga

SEQ ID NO: 444344 - DNA, 25 bp, Rattus norvegicus
ggctccgaaggcaacgcgcaacgcg

SEQ ID NO: 444345 - DNA, 25 bp, Rattus norvegicus
ggctccgaaggctacgcgcaacgcg

SEQ ID NO: 444346 - DNA, 25 bp, Rattus norvegicus
ggctccgaatctctcatgcatttaa

SEQ ID NO: 444347 - DNA, 25 bp, Rattus norvegicus
ggctccgaatctgtcatgcatttaa

SEQ ID NO: 444348 - DNA, 25 bp, Rattus norvegicus
ggctccgactcaagtgcttacaaga

SEQ ID NO: 444349 - DNA, 25 bp, Rattus norvegicus
ggctccgactcatgtgcttacaaga

SEQ ID NO: 444350 - DNA, 25 bp, Rattus norvegicus
ggctccgaggagacgttcagttact

SEQ ID NO: 444351 - DNA, 25 bp, Rattus norvegicus
ggctccgaggagtcgttcagttact

SEQ ID NO: 444352 - DNA, 25 bp, Rattus norvegicus
ggctccgagggcagagcttccatcg

SEQ ID NO: 444353 - DNA, 25 bp, Rattus norvegicus
ggctccgagggctgagcttccatcg

SEQ ID NO: 444354 - DNA, 25 bp, Rattus norvegicus
ggctccgagggtctcgccggtggtg

SEQ ID NO: 444355 - DNA, 25 bp, Rattus norvegicus
ggctccgagggtgtcgccggtggtg

SEQ ID NO: 444356 - DNA, 25 bp, Rattus norvegicus
ggctccgatcggcttactggtgtta

SEQ ID NO: 444357 - DNA, 25 bp, Rattus norvegicus
ggctccgatcgggttactggtgtta

SEQ ID NO: 444358 - DNA, 25 bp, Rattus norvegicus
ggctccgattgtattggctttccgg

SEQ ID NO: 444359 - DNA, 25 bp, Rattus norvegicus
ggctccgattgttttggctttccgg

SEQ ID NO: 444360 - DNA, 25 bp, Rattus norvegicus
ggctccgcaatcctgtctgaagaga

SEQ ID NO: 444361 - DNA, 25 bp, Rattus norvegicus
ggctccgcaatcgtgtctgaagaga

SEQ ID NO: 444362 - DNA, 25 bp, Rattus norvegicus
ggctccgcaggtcatgatgtacgtc

SEQ ID NO: 444363 - DNA, 25 bp, Rattus norvegicus
ggctccgcaggtgatgatgtacgtc

SEQ ID NO: 444364 - DNA, 25 bp, Rattus norvegicus
ggctccgctactaccagggatacgc

SEQ ID NO: 444365 - DNA, 25 bp, Rattus norvegicus
ggctccgctacttccagggatacgc

SEQ ID NO: 444366 - DNA, 25 bp, Rattus norvegicus
ggctccgggagcacatatatctatg

SEQ ID NO: 444367 - DNA, 25 bp, Rattus norvegicus
ggctccgggagcagcagccatagac

SEQ ID NO: 444368 - DNA, 25 bp, Rattus norvegicus
ggctccgggagctcatatatctatg

SEQ ID NO: 444369 - DNA, 25 bp, Rattus norvegicus
ggctccgggagctgcagccatagac

SEQ ID NO: 444370 - DNA, 25 bp, Rattus norvegicus
ggctccgggtgtaggcagtattcca

SEQ ID NO: 444371 - DNA, 25 bp, Rattus norvegicus
ggctccgggtgttggcagtattcca

SEQ ID NO: 444372 - DNA, 25 bp, Rattus norvegicus
ggctccgtaaacaatttctgctact

SEQ ID NO: 444373 - DNA, 25 bp, Rattus norvegicus
ggctccgtaaactatttctgctact

SEQ ID NO: 444374 - DNA, 25 bp, Rattus norvegicus
ggctccgtaagtagggtcctgagaa

SEQ ID NO: 444375 - DNA, 25 bp, Rattus norvegicus
ggctccgtaagttgggtcctgagaa

SEQ ID NO: 444376 - DNA, 25 bp, Rattus norvegicus
ggctccgtcgtgagagtcttcagat

SEQ ID NO: 444377 - DNA, 25 bp, Rattus norvegicus
ggctccgtcgtgtgagtcttcagat

SEQ ID NO: 444378 - DNA, 25 bp, Rattus norvegicus
ggctccgtggccatctgttcagaaa

SEQ ID NO: 444379 - DNA, 25 bp, Rattus norvegicus
ggctccgtggccttctgttcagaaa

SEQ ID NO: 444380 - DNA, 25 bp, Rattus norvegicus
ggctccgtgggacacaagctcagaa

SEQ ID NO: 444381 - DNA, 25 bp, Rattus norvegicus
ggctccgtgggagacaagctcagaa

SEQ ID NO: 444382 - DNA, 25 bp, Rattus norvegicus
ggctccgttcacagctttctaaggg

SEQ ID NO: 444383 - DNA, 25 bp, Rattus norvegicus
ggctccgttcactgctttctaaggg

SEQ ID NO: 444384 - DNA, 25 bp, Rattus norvegicus
ggctcctaacacatccagaaagaaa

SEQ ID NO: 444385 - DNA, 25 bp, Rattus norvegicus
ggctcctaacacttccagaaagaaa

SEQ ID NO: 444386 - DNA, 25 bp, Rattus norvegicus
ggctcctaactcaacctaagtgaac

SEQ ID NO: 444387 - DNA, 25 bp, Rattus norvegicus
ggctcctaactctacctaagtgaac

SEQ ID NO: 444388 - DNA, 25 bp, Rattus norvegicus
ggctcctaactgcagtttgtgtcca

SEQ ID NO: 444389 - DNA, 25 bp, Rattus norvegicus
ggctcctaactggagtttgtgtcca

SEQ ID NO: 444390 - DNA, 25 bp, Rattus norvegicus
ggctcctacactctgagctgcacaa

SEQ ID NO: 444391 - DNA, 25 bp, Rattus norvegicus
ggctcctacactgtgagctgcacaa

SEQ ID NO: 444392 - DNA, 25 bp, Rattus norvegicus
ggctcctacagaatgatccagtttc

SEQ ID NO: 444393 - DNA, 25 bp, Rattus norvegicus
ggctcctacagattgatccagtttc

SEQ ID NO: 444394 - DNA, 25 bp, Rattus norvegicus
ggctcctaccagatctccatggcag

SEQ ID NO: 444395 - DNA, 25 bp, Rattus norvegicus
ggctcctaccagttctccatggcag

SEQ ID NO: 444396 - DNA, 25 bp, Rattus norvegicus
ggctcctagagtctcagaaccctga

SEQ ID NO: 444397 - DNA, 25 bp, Rattus norvegicus
ggctcctagagtgtcagaaccctga

SEQ ID NO: 444398 - DNA, 25 bp, Rattus norvegicus
ggctcctagcaccatgaagatcaag

SEQ ID NO: 444399 - DNA, 25 bp, Rattus norvegicus
ggctcctagcacgatgaagatcaag

SEQ ID NO: 444400 - DNA, 25 bp, Rattus norvegicus
ggctcctagcagcttccaggttgga

SEQ ID NO: 444401 - DNA, 25 bp, Rattus norvegicus
ggctcctagcaggttccaggttgga

SEQ ID NO: 444402 - DNA, 25 bp, Rattus norvegicus
ggctcctaggccattggttctcaat

SEQ ID NO: 444403 - DNA, 25 bp, Rattus norvegicus
ggctcctaggcctttggttctcaat

SEQ ID NO: 444404 - DNA, 25 bp, Rattus norvegicus
ggctcctagggacttggaattcgaa

SEQ ID NO: 444405 - DNA, 25 bp, Rattus norvegicus
ggctcctagggagttggaattcgaa

SEQ ID NO: 444406 - DNA, 25 bp, Rattus norvegicus
ggctcctagggcagaacacattctt

SEQ ID NO: 444407 - DNA, 25 bp, Rattus norvegicus
ggctcctagggctgaacacattctt

SEQ ID NO: 444408 - DNA, 25 bp, Rattus norvegicus
ggctcctatagcattgtttgggata

SEQ ID NO: 444409 - DNA, 25 bp, Rattus norvegicus
ggctcctatagctttgtttgggata

SEQ ID NO: 444410 - DNA, 25 bp, Rattus norvegicus
ggctcctatccaccaagaattacga

SEQ ID NO: 444411 - DNA, 25 bp, Rattus norvegicus
ggctcctatccagcaagaattacga

SEQ ID NO: 444412 - DNA, 25 bp, Rattus norvegicus
ggctcctattgtctctcaagtttga

SEQ ID NO: 444413 - DNA, 25 bp, Rattus norvegicus
ggctcctattgtgtctcaagtttga

SEQ ID NO: 444414 - DNA, 25 bp, Rattus norvegicus
ggctcctatttgaggtttgtacttc

SEQ ID NO: 444415 - DNA, 25 bp, Rattus norvegicus
ggctcctatttgtggtttgtacttc

SEQ ID NO: 444416 - DNA, 25 bp, Rattus norvegicus
ggctcctcaagacagaacctggttt

SEQ ID NO: 444417 - DNA, 25 bp, Rattus norvegicus
ggctcctcaagagagaacctggttt

SEQ ID NO: 444418 - DNA, 25 bp, Rattus norvegicus
ggctcctcaccccagaaatgattat

SEQ ID NO: 444419 - DNA, 25 bp, Rattus norvegicus
ggctcctcacccgagaaatgattat

SEQ ID NO: 444420 - DNA, 25 bp, Rattus norvegicus
ggctcctcagatcaccgacagatcg

SEQ ID NO: 444421 - DNA, 25 bp, Rattus norvegicus
ggctcctcagatgaccgacagatcg

SEQ ID NO: 444422 - DNA, 25 bp, Rattus norvegicus
ggctcctcaggtctcaaggtacaca

SEQ ID NO: 444423 - DNA, 25 bp, Rattus norvegicus
ggctcctcaggtgtcaaggtacaca

SEQ ID NO: 444424 - DNA, 25 bp, Rattus norvegicus
ggctcctccttcagcttgaaacaga

SEQ ID NO: 444425 - DNA, 25 bp, Rattus norvegicus
ggctcctccttctgcttgaaacaga

SEQ ID NO: 444426 - DNA, 25 bp, Rattus norvegicus
ggctcctcgacgaactgcgacgctt

SEQ ID NO: 444427 - DNA, 25 bp, Rattus norvegicus
ggctcctcgacgtactgcgacgctt

SEQ ID NO: 444428 - DNA, 25 bp, Rattus norvegicus
ggctcctcgatccatcctaagacag

SEQ ID NO: 444429 - DNA, 25 bp, Rattus norvegicus
ggctcctcgatcgatcctaagacag

SEQ ID NO: 444430 - DNA, 25 bp, Rattus norvegicus
ggctcctcgcgactttttcaaagga

SEQ ID NO: 444431 - DNA, 25 bp, Rattus norvegicus
ggctcctcgcgagtttttcaaagga

SEQ ID NO: 444432 - DNA, 25 bp, Rattus norvegicus
ggctcctcgtgacgtcctatcaata

SEQ ID NO: 444433 - DNA, 25 bp, Rattus norvegicus
ggctcctcgtgaggtcctatcaata

SEQ ID NO: 444434 - DNA, 25 bp, Rattus norvegicus
ggctcctctaaaatggttccagtgg

SEQ ID NO: 444435 - DNA, 25 bp, Rattus norvegicus
ggctcctctaaattggttccagtgg

SEQ ID NO: 444436 - DNA, 25 bp, Rattus norvegicus
ggctcctctgtgaggttctagagaa

SEQ ID NO: 444437 - DNA, 25 bp, Rattus norvegicus
ggctcctctgtgtggttctagagaa

SEQ ID NO: 444438 - DNA, 25 bp, Rattus norvegicus
ggctcctcttccagaatggctgtgg

SEQ ID NO: 444439 - DNA, 25 bp, Rattus norvegicus
ggctcctcttcctgaatggctgtgg

SEQ ID NO: 444440 - DNA, 25 bp, Rattus norvegicus
ggctcctcttgaactgtgttgtgaa

SEQ ID NO: 444441 - DNA, 25 bp, Rattus norvegicus
ggctcctcttgatctgtgttgtgaa

SEQ ID NO: 444442 - DNA, 25 bp, Rattus norvegicus
ggctcctcttggacttagagcttga

SEQ ID NO: 444443 - DNA, 25 bp, Rattus norvegicus
ggctcctcttggtcttagagcttga

SEQ ID NO: 444444 - DNA, 25 bp, Rattus norvegicus
ggctcctgaagcaattccatatgta

SEQ ID NO: 444445 - DNA, 25 bp, Rattus norvegicus
ggctcctgaagcactgtcacatgaa

SEQ ID NO: 444446 - DNA, 25 bp, Rattus norvegicus
ggctcctgaagctattccatatgta

SEQ ID NO: 444447 - DNA, 25 bp, Rattus norvegicus
ggctcctgaagctctgtcacatgaa

SEQ ID NO: 444448 - DNA, 25 bp, Rattus norvegicus
ggctcctgacagactgttcccagat

SEQ ID NO: 444449 - DNA, 25 bp, Rattus norvegicus
ggctcctgacagtctgttcccagat

SEQ ID NO: 444450 - DNA, 25 bp, Rattus norvegicus
ggctcctgatgtcaccgtatttatg

SEQ ID NO: 444451 - DNA, 25 bp, Rattus norvegicus
ggctcctgatgtgaccgtatttatg

SEQ ID NO: 444452 - DNA, 25 bp, Rattus norvegicus
ggctcctgcagacctgccgtgcgca

SEQ ID NO: 444453 - DNA, 25 bp, Rattus norvegicus
ggctcctgcagagctgccgtgcgca

SEQ ID NO: 444454 - DNA, 25 bp, Rattus norvegicus
ggctcctgccctagtacactaagaa

SEQ ID NO: 444455 - DNA, 25 bp, Rattus norvegicus
ggctcctgcccttgtacactaagaa

SEQ ID NO: 444456 - DNA, 25 bp, Rattus norvegicus
ggctcctgccttctgagtttttatt

SEQ ID NO: 444457 - DNA, 25 bp, Rattus norvegicus
ggctcctgccttgtgagtttttatt

SEQ ID NO: 444458 - DNA, 25 bp, Rattus norvegicus
ggctcctgcttcctagtctgcagaa

SEQ ID NO: 444459 - DNA, 25 bp, Rattus norvegicus
ggctcctgcttcgtagtctgcagaa

SEQ ID NO: 444460 - DNA, 25 bp, Rattus norvegicus
ggctcctggactctgcaaggcgaat

SEQ ID NO: 444461 - DNA, 25 bp, Rattus norvegicus
ggctcctggactgtgcaaggcgaat

SEQ ID NO: 444462 - DNA, 25 bp, Rattus norvegicus
ggctcctggagcaagtgtcaaagct

SEQ ID NO: 444463 - DNA, 25 bp, Rattus norvegicus
ggctcctggagctagtgtcaaagct

SEQ ID NO: 444464 - DNA, 25 bp, Rattus norvegicus
ggctcctggcaaatgtctgactgaa

SEQ ID NO: 444465 - DNA, 25 bp, Rattus norvegicus
ggctcctggcaattgtctgactgaa

SEQ ID NO: 444466 - DNA, 25 bp, Rattus norvegicus
ggctcctggtcaattgaggtggcat

SEQ ID NO: 444467 - DNA, 25 bp, Rattus norvegicus
ggctcctggtcatttgaggtggcat

SEQ ID NO: 444468 - DNA, 25 bp, Rattus norvegicus
ggctcctggttaattgccaaagtca

SEQ ID NO: 444469 - DNA, 25 bp, Rattus norvegicus
ggctcctggttatttgccaaagtca

SEQ ID NO: 444470 - DNA, 25 bp, Rattus norvegicus
ggctcctgttagacaacaacaacta

SEQ ID NO: 444471 - DNA, 25 bp, Rattus norvegicus
ggctcctgttagtcaacaacaacta

SEQ ID NO: 444472 - DNA, 25 bp, Rattus norvegicus
ggctcctgttctccagggagacaag

SEQ ID NO: 444473 - DNA, 25 bp, Rattus norvegicus
ggctcctgttctgcagggagacaag

SEQ ID NO: 444474 - DNA, 25 bp, Rattus norvegicus
ggctccttactcactttaggacaat

SEQ ID NO: 444475 - DNA, 25 bp, Rattus norvegicus
ggctccttactctctttaggacaat

SEQ ID NO: 444476 - DNA, 25 bp, Rattus norvegicus
ggctccttcctgagtgactggattt

SEQ ID NO: 444477 - DNA, 25 bp, Rattus norvegicus
ggctccttcctgtgtgactggattt

SEQ ID NO: 444478 - DNA, 25 bp, Rattus norvegicus
ggctccttcgcaattttgctgtagc

SEQ ID NO: 444479 - DNA, 25 bp, Rattus norvegicus
ggctccttcgcatttttgctgtagc

SEQ ID NO: 444480 - DNA, 25 bp, Rattus norvegicus
ggctccttcggacgacgacgacgat

SEQ ID NO: 444481 - DNA, 25 bp, Rattus norvegicus
ggctccttcggaggacgacgacgat

SEQ ID NO: 444482 - DNA, 25 bp, Rattus norvegicus
ggctccttctggaaaaccatacata

SEQ ID NO: 444483 - DNA, 25 bp, Rattus norvegicus
ggctccttctggtaaaccatacata

SEQ ID NO: 444484 - DNA, 25 bp, Rattus norvegicus
ggctccttgaaaaggaccccagact

SEQ ID NO: 444485 - DNA, 25 bp, Rattus norvegicus
ggctccttgaaatggaccccagact

SEQ ID NO: 444486 - DNA, 25 bp, Rattus norvegicus
ggctccttgagcatacgatgccggg

SEQ ID NO: 444487 - DNA, 25 bp, Rattus norvegicus
ggctccttgagcttacgatgccggg

SEQ ID NO: 444488 - DNA, 25 bp, Rattus norvegicus
ggctccttggacctataattgctta

SEQ ID NO: 444489 - DNA, 25 bp, Rattus norvegicus
ggctccttggacgtataattgctta

SEQ ID NO: 444490 - DNA, 25 bp, Rattus norvegicus
ggctccttggctaccggctctttgt

SEQ ID NO: 444491 - DNA, 25 bp, Rattus norvegicus
ggctccttggcttccggctctttgt

SEQ ID NO: 444492 - DNA, 25 bp, Rattus norvegicus
ggctccttggtccttgttaggatct

SEQ ID NO: 444493 - DNA, 25 bp, Rattus norvegicus
ggctccttggtcgttgttaggatct

SEQ ID NO: 444494 - DNA, 25 bp, Rattus norvegicus
ggctccttgtccagagctgagcttt

SEQ ID NO: 444495 - DNA, 25 bp, Rattus norvegicus
ggctccttgtcctgagctgagcttt

SEQ ID NO: 444496 - DNA, 25 bp, Rattus norvegicus
ggctccttgttcctacagtagatta

SEQ ID NO: 444497 - DNA, 25 bp, Rattus norvegicus
ggctccttgttcgtacagtagatta

SEQ ID NO: 444498 - DNA, 25 bp, Rattus norvegicus
ggctcctttaatagccactcataag

SEQ ID NO: 444499 - DNA, 25 bp, Rattus norvegicus
ggctcctttaatcccattgtttctt

SEQ ID NO: 444500 - DNA, 25 bp, Rattus norvegicus
ggctcctttaatgccattgtttctt

SEQ ID NO: 444501 - DNA, 25 bp, Rattus norvegicus
ggctcctttaattgccactcataag

SEQ ID NO: 444502 - DNA, 25 bp, Rattus norvegicus
ggctcctttataccagttgtcctga

SEQ ID NO: 444503 - DNA, 25 bp, Rattus norvegicus
ggctcctttatagcagttgtcctga

SEQ ID NO: 444504 - DNA, 25 bp, Rattus norvegicus
ggctcctttctcatttactgtgaga

SEQ ID NO: 444505 - DNA, 25 bp, Rattus norvegicus
ggctcctttctcttttactgtgaga

SEQ ID NO: 444506 - DNA, 25 bp, Rattus norvegicus
ggctcgaaatgtctctacgcgcaga

SEQ ID NO: 444507 - DNA, 25 bp, Rattus norvegicus
ggctcgaaatgtgtctacgcgcaga

SEQ ID NO: 444508 - DNA, 25 bp, Rattus norvegicus
ggctcgaatgtccaatcatcctgct

SEQ ID NO: 444509 - DNA, 25 bp, Rattus norvegicus
ggctcgaatgtcgaatcatcctgct

SEQ ID NO: 444510 - DNA, 25 bp, Rattus norvegicus
ggctcgaccaccacaacattggata

SEQ ID NO: 444511 - DNA, 25 bp, Rattus norvegicus
ggctcgaccacctcaacattggata

SEQ ID NO: 444512 - DNA, 25 bp, Rattus norvegicus
ggctcgagaataactgtgtcacgca

SEQ ID NO: 444513 - DNA, 25 bp, Rattus norvegicus
ggctcgagaatatctgtgtcacgca

SEQ ID NO: 444514 - DNA, 25 bp, Rattus norvegicus
ggctcgagatctagaacctactgga

SEQ ID NO: 444515 - DNA, 25 bp, Rattus norvegicus
ggctcgagatcttgaacctactgga

SEQ ID NO: 444516 - DNA, 25 bp, Rattus norvegicus
ggctcgagctcacagaatcttttaa

SEQ ID NO: 444517 - DNA, 25 bp, Rattus norvegicus
ggctcgagctcagagaatcttttaa

SEQ ID NO: 444518 - DNA, 25 bp, Rattus norvegicus
ggctcgagtcgaagaactcattgaa

SEQ ID NO: 444519 - DNA, 25 bp, Rattus norvegicus
ggctcgagtcgatgaactcattgaa

SEQ ID NO: 444520 - DNA, 25 bp, Rattus norvegicus
ggctcgagtgctcctcaggcagaaa

SEQ ID NO: 444521 - DNA, 25 bp, Rattus norvegicus
ggctcgagtgctgctcaggcagaaa

SEQ ID NO: 444522 - DNA, 25 bp, Rattus norvegicus
ggctcgagttctattgttttctcac

SEQ ID NO: 444523 - DNA, 25 bp, Rattus norvegicus
ggctcgagttcttttgttttctcac

SEQ ID NO: 444524 - DNA, 25 bp, Rattus norvegicus
ggctcgatgctcacggcatgcagaa

SEQ ID NO: 444525 - DNA, 25 bp, Rattus norvegicus
ggctcgatgctctcggcatgcagaa

SEQ ID NO: 444526 - DNA, 25 bp, Rattus norvegicus
ggctcgatgggcaaagacctggtaa

SEQ ID NO: 444527 - DNA, 25 bp, Rattus norvegicus
ggctcgatgggctaagacctggtaa

SEQ ID NO: 444528 - DNA, 25 bp, Rattus norvegicus
ggctcgcaactaaagtgtgaaagaa

SEQ ID NO: 444529 - DNA, 25 bp, Rattus norvegicus
ggctcgcaactatagtgtgaaagaa

SEQ ID NO: 444530 - DNA, 25 bp, Rattus norvegicus
ggctcgccaagcagatgaccaaaag

SEQ ID NO: 444531 - DNA, 25 bp, Rattus norvegicus
ggctcgccaagctgatgaccaaaag

SEQ ID NO: 444532 - DNA, 25 bp, Rattus norvegicus
ggctcgccgtgtatctaatcatgaa

SEQ ID NO: 444533 - DNA, 25 bp, Rattus norvegicus
ggctcgccgtgtttctaatcatgaa

SEQ ID NO: 444534 - DNA, 25 bp, Rattus norvegicus
ggctcgcctgagcatgacgtaaaat

SEQ ID NO: 444535 - DNA, 25 bp, Rattus norvegicus
ggctcgcctgaggatgacgtaaaat

SEQ ID NO: 444536 - DNA, 25 bp, Rattus norvegicus
ggctcgcctggaacacaagtttgat

SEQ ID NO: 444537 - DNA, 25 bp, Rattus norvegicus
ggctcgcctggatcacaagtttgat

SEQ ID NO: 444538 - DNA, 25 bp, Rattus norvegicus
ggctcgcggctcaggccgatctgca

SEQ ID NO: 444539 - DNA, 25 bp, Rattus norvegicus
ggctcgcggctctggccgatctgca

SEQ ID NO: 444540 - DNA, 25 bp, Rattus norvegicus
ggctcgctcggtcccgagttaccga

SEQ ID NO: 444541 - DNA, 25 bp, Rattus norvegicus
ggctcgctcggtgccgagttaccga

SEQ ID NO: 444542 - DNA, 25 bp, Rattus norvegicus
ggctcgctgctacattttagttcat

SEQ ID NO: 444543 - DNA, 25 bp, Rattus norvegicus
ggctcgctgctagattttagttcat

SEQ ID NO: 444544 - DNA, 25 bp, Rattus norvegicus
ggctcgctggccacgttgcctaggg

SEQ ID NO: 444545 - DNA, 25 bp, Rattus norvegicus
ggctcgctggcctcgttgcctaggg

SEQ ID NO: 444546 - DNA, 25 bp, Rattus norvegicus
ggctcgcttgagagctctggaagcc

SEQ ID NO: 444547 - DNA, 25 bp, Rattus norvegicus
ggctcgcttgagtgctctggaagcc

SEQ ID NO: 444548 - DNA, 25 bp, Rattus norvegicus
ggctcgcttgggaattgttccttta

SEQ ID NO: 444549 - DNA, 25 bp, Rattus norvegicus
ggctcgcttgggtattgttccttta

SEQ ID NO: 444550 - DNA, 25 bp, Rattus norvegicus
ggctcggacgctcgccaaagaagtt

SEQ ID NO: 444551 - DNA, 25 bp, Rattus norvegicus
ggctcggacgctggccaaagaagtt

SEQ ID NO: 444552 - DNA, 25 bp, Rattus norvegicus
ggctcggagcaaacaggttccccat

SEQ ID NO: 444553 - DNA, 25 bp, Rattus norvegicus
ggctcggagcaatcaggttccccat

SEQ ID NO: 444554 - DNA, 25 bp, Rattus norvegicus
ggctcggaggccactgctataaatt

SEQ ID NO: 444555 - DNA, 25 bp, Rattus norvegicus
ggctcggaggcctctgctataaatt

SEQ ID NO: 444556 - DNA, 25 bp, Rattus norvegicus
ggctcggcaacgcagttccagttta

SEQ ID NO: 444557 - DNA, 25 bp, Rattus norvegicus
ggctcggcaacggagttccagttta

SEQ ID NO: 444558 - DNA, 25 bp, Rattus norvegicus
ggctcggcaactcaatggaaccctg

SEQ ID NO: 444559 - DNA, 25 bp, Rattus norvegicus
ggctcggcaactgaatggaaccctg

SEQ ID NO: 444560 - DNA, 25 bp, Rattus norvegicus
ggctcggcaagtaaaggtatccaaa

SEQ ID NO: 444561 - DNA, 25 bp, Rattus norvegicus
ggctcggcaagttaaggtatccaaa

SEQ ID NO: 444562 - DNA, 25 bp, Rattus norvegicus
ggctcgggtaccacattgcgtcttt

SEQ ID NO: 444563 - DNA, 25 bp, Rattus norvegicus
ggctcgggtacctcattgcgtcttt

SEQ ID NO: 444564 - DNA, 25 bp, Rattus norvegicus
ggctcggtagctaatgtctttgagt

SEQ ID NO: 444565 - DNA, 25 bp, Rattus norvegicus
ggctcggtagcttatgtctttgagt

SEQ ID NO: 444566 - DNA, 25 bp, Rattus norvegicus
ggctcggtgtgtctgcttttttctt

SEQ ID NO: 444567 - DNA, 25 bp, Rattus norvegicus
ggctcggtgtgtgtgcttttttctt

SEQ ID NO: 444568 - DNA, 25 bp, Rattus norvegicus
ggctcgtagtgtcccgtggcacctc

SEQ ID NO: 444569 - DNA, 25 bp, Rattus norvegicus
ggctcgtagtgtgccgtggcacctc

SEQ ID NO: 444570 - DNA, 25 bp, Rattus norvegicus
ggctcgtcctgtcccttaaagtaca

SEQ ID NO: 444571 - DNA, 25 bp, Rattus norvegicus
ggctcgtcctgtgccttaaagtaca

SEQ ID NO: 444572 - DNA, 25 bp, Rattus norvegicus
ggctcgtctgtcactggacaatgca

SEQ ID NO: 444573 - DNA, 25 bp, Rattus norvegicus
ggctcgtctgtctctggacaatgca

SEQ ID NO: 444574 - DNA, 25 bp, Rattus norvegicus
ggctcgtctgtgaaccaagaatggt

SEQ ID NO: 444575 - DNA, 25 bp, Rattus norvegicus
ggctcgtctgtgtaccaagaatggt

SEQ ID NO: 444576 - DNA, 25 bp, Rattus norvegicus
ggctcgtgagtgagtggctcatctc

SEQ ID NO: 444577 - DNA, 25 bp, Rattus norvegicus
ggctcgtgagtgtgtggctcatctc

SEQ ID NO: 444578 - DNA, 25 bp, Rattus norvegicus
ggctcgtgctcaatctgtatttaac

SEQ ID NO: 444579 - DNA, 25 bp, Rattus norvegicus
ggctcgtgctcattctgtatttaac

SEQ ID NO: 444580 - DNA, 25 bp, Rattus norvegicus
ggctcgttgcaactcgtctgcaaga

SEQ ID NO: 444581 - DNA, 25 bp, Rattus norvegicus
ggctcgttgcaagtcgtctgcaaga

SEQ ID NO: 444582 - DNA, 25 bp, Rattus norvegicus
ggctctaaacggcagacactttcac

SEQ ID NO: 444583 - DNA, 25 bp, Rattus norvegicus
ggctctaaacgggagacactttcac

SEQ ID NO: 444584 - DNA, 25 bp, Rattus norvegicus
ggctctaacacacattgccatcctg

SEQ ID NO: 444585 - DNA, 25 bp, Rattus norvegicus
ggctctaacacagattgccatcctg

SEQ ID NO: 444586 - DNA, 25 bp, Rattus norvegicus
ggctctaacaccacaagcgttttta

SEQ ID NO: 444587 - DNA, 25 bp, Rattus norvegicus
ggctctaacacctcaagcgttttta

SEQ ID NO: 444588 - DNA, 25 bp, Rattus norvegicus
ggctctaacatgagtgaagcactct

SEQ ID NO: 444589 - DNA, 25 bp, Rattus norvegicus
ggctctaacatgtgtgaagcactct

SEQ ID NO: 444590 - DNA, 25 bp, Rattus norvegicus
ggctctaactggcatcctctggaag

SEQ ID NO: 444591 - DNA, 25 bp, Rattus norvegicus
ggctctaactgggatcctctggaag

SEQ ID NO: 444592 - DNA, 25 bp, Rattus norvegicus
ggctctaactttcatgatatcctat

SEQ ID NO: 444593 - DNA, 25 bp, Rattus norvegicus
ggctctaactttgatgatatcctat

SEQ ID NO: 444594 - DNA, 25 bp, Rattus norvegicus
ggctctaagactcttttctcacctt

SEQ ID NO: 444595 - DNA, 25 bp, Rattus norvegicus
ggctctaagactgttttctcacctt

SEQ ID NO: 444596 - DNA, 25 bp, Rattus norvegicus
ggctctaagccactatatgggtagt

SEQ ID NO: 444597 - DNA, 25 bp, Rattus norvegicus
ggctctaagccagtatatgggtagt

SEQ ID NO: 444598 - DNA, 25 bp, Rattus norvegicus
ggctctaatagacaagctggatagg

SEQ ID NO: 444599 - DNA, 25 bp, Rattus norvegicus
ggctctaatagagaagctggatagg

SEQ ID NO: 444600 - DNA, 25 bp, Rattus norvegicus
ggctctaattcacgccaaagatctg

SEQ ID NO: 444601 - DNA, 25 bp, Rattus norvegicus
ggctctaattcaggccaaagatctg

SEQ ID NO: 444602 - DNA, 25 bp, Rattus norvegicus
ggctctacaaatctttctgcttaca

SEQ ID NO: 444603 - DNA, 25 bp, Rattus norvegicus
ggctctacaaatgtttctgcttaca

SEQ ID NO: 444604 - DNA, 25 bp, Rattus norvegicus
ggctctacaactacccaaggcagtg

SEQ ID NO: 444605 - DNA, 25 bp, Rattus norvegicus
ggctctacaacttcccaaggcagtg

SEQ ID NO: 444606 - DNA, 25 bp, Rattus norvegicus
ggctctacagtgcatttgctttttc

SEQ ID NO: 444607 - DNA, 25 bp, Rattus norvegicus
ggctctacagtggatttgctttttc

SEQ ID NO: 444608 - DNA, 25 bp, Rattus norvegicus
ggctctacatcgaaggctcctgaag

SEQ ID NO: 444609 - DNA, 25 bp, Rattus norvegicus
ggctctacatcgtaggctcctgaag

SEQ ID NO: 444610 - DNA, 25 bp, Rattus norvegicus
ggctctaccctgactgcagtgacct

SEQ ID NO: 444611 - DNA, 25 bp, Rattus norvegicus
ggctctaccctgtctgcagtgacct

SEQ ID NO: 444612 - DNA, 25 bp, Rattus norvegicus
ggctctaccttcctgttacaataca

SEQ ID NO: 444613 - DNA, 25 bp, Rattus norvegicus
ggctctaccttcgtgttacaataca

SEQ ID NO: 444614 - DNA, 25 bp, Rattus norvegicus
ggctctacttgcagggtgactttgg

SEQ ID NO: 444615 - DNA, 25 bp, Rattus norvegicus
ggctctacttgctgggtgactttgg

SEQ ID NO: 444616 - DNA, 25 bp, Rattus norvegicus
ggctctagacttaaaattcagctat

SEQ ID NO: 444617 - DNA, 25 bp, Rattus norvegicus
ggctctagactttaaattcagctat

SEQ ID NO: 444618 - DNA, 25 bp, Rattus norvegicus
ggctctagagacagcttatcccaga

SEQ ID NO: 444619 - DNA, 25 bp, Rattus norvegicus
ggctctagagactgcttatcccaga

SEQ ID NO: 444620 - DNA, 25 bp, Rattus norvegicus
ggctctagctatagacccattacag

SEQ ID NO: 444621 - DNA, 25 bp, Rattus norvegicus
ggctctagctattgacccattacag

SEQ ID NO: 444622 - DNA, 25 bp, Rattus norvegicus
ggctctataaatcccctttaccttg

SEQ ID NO: 444623 - DNA, 25 bp, Rattus norvegicus
ggctctataaatgccctttaccttg

SEQ ID NO: 444624 - DNA, 25 bp, Rattus norvegicus
ggctctataattattcatgggtcta

SEQ ID NO: 444625 - DNA, 25 bp, Rattus norvegicus
ggctctataatttttcatgggtcta

SEQ ID NO: 444626 - DNA, 25 bp, Rattus norvegicus
ggctctatacctaccgagagaagtt

SEQ ID NO: 444627 - DNA, 25 bp, Rattus norvegicus
ggctctataccttccgagagaagtt

SEQ ID NO: 444628 - DNA, 25 bp, Rattus norvegicus
ggctctatgatgatccatgattgat

SEQ ID NO: 444629 - DNA, 25 bp, Rattus norvegicus
ggctctatgatgttccatgattgat

SEQ ID NO: 444630 - DNA, 25 bp, Rattus norvegicus
ggctctatggctatctctctgtgtc

SEQ ID NO: 444631 - DNA, 25 bp, Rattus norvegicus
ggctctatggctttctctctgtgtc

SEQ ID NO: 444632 - DNA, 25 bp, Rattus norvegicus
ggctctcaaagcaaattttttacta

SEQ ID NO: 444633 - DNA, 25 bp, Rattus norvegicus
ggctctcaaagctaattttttacta

SEQ ID NO: 444634 - DNA, 25 bp, Rattus norvegicus
ggctctcaaattcggcccatatcca

SEQ ID NO: 444635 - DNA, 25 bp, Rattus norvegicus
ggctctcaaattgggcccatatcca

SEQ ID NO: 444636 - DNA, 25 bp, Rattus norvegicus
ggctctcacaggcttaactgtacag

SEQ ID NO: 444637 - DNA, 25 bp, Rattus norvegicus
ggctctcacagggttaactgtacag

SEQ ID NO: 444638 - DNA, 25 bp, Rattus norvegicus
ggctctcagatgagctcctagtaga

SEQ ID NO: 444639 - DNA, 25 bp, Rattus norvegicus
ggctctcagatgtgctcctagtaga

SEQ ID NO: 444640 - DNA, 25 bp, Rattus norvegicus
ggctctcagcccagtcagagacaag

SEQ ID NO: 444641 - DNA, 25 bp, Rattus norvegicus
ggctctcagccctgtcagagacaag

SEQ ID NO: 444642 - DNA, 25 bp, Rattus norvegicus
ggctctcagggaaccaattcaggtt

SEQ ID NO: 444643 - DNA, 25 bp, Rattus norvegicus
ggctctcagggatccaattcaggtt

SEQ ID NO: 444644 - DNA, 25 bp, Rattus norvegicus
ggctctcaggtcagctggccacaga

SEQ ID NO: 444645 - DNA, 25 bp, Rattus norvegicus
ggctctcaggtctgctggccacaga

SEQ ID NO: 444646 - DNA, 25 bp, Rattus norvegicus
ggctctcagttcctcaccgggtgat

SEQ ID NO: 444647 - DNA, 25 bp, Rattus norvegicus
ggctctcagttcgtcaccgggtgat

SEQ ID NO: 444648 - DNA, 25 bp, Rattus norvegicus
ggctctcatacccactaagatacat

SEQ ID NO: 444649 - DNA, 25 bp, Rattus norvegicus
ggctctcataccgactaagatacat

SEQ ID NO: 444650 - DNA, 25 bp, Rattus norvegicus
ggctctcatcaacgccactggagaa

SEQ ID NO: 444651 - DNA, 25 bp, Rattus norvegicus
ggctctcatcaaggccactggagaa

SEQ ID NO: 444652 - DNA, 25 bp, Rattus norvegicus
ggctctcatgttaaccttttcagtt

SEQ ID NO: 444653 - DNA, 25 bp, Rattus norvegicus
ggctctcatgtttaccttttcagtt

SEQ ID NO: 444654 - DNA, 25 bp, Rattus norvegicus
ggctctcattctatttggtttaggg

SEQ ID NO: 444655 - DNA, 25 bp, Rattus norvegicus
ggctctcattctttttggtttaggg

SEQ ID NO: 444656 - DNA, 25 bp, Rattus norvegicus
ggctctcattttcctgacgagggca

SEQ ID NO: 444657 - DNA, 25 bp, Rattus norvegicus
ggctctcattttgctgacgagggca

SEQ ID NO: 444658 - DNA, 25 bp, Rattus norvegicus
ggctctccaagaagtaaaagattct

SEQ ID NO: 444659 - DNA, 25 bp, Rattus norvegicus
ggctctccaagacattccagaatgc

SEQ ID NO: 444660 - DNA, 25 bp, Rattus norvegicus
ggctctccaagagattccagaatgc

SEQ ID NO: 444661 - DNA, 25 bp, Rattus norvegicus
ggctctccaagatgtaaaagattct

SEQ ID NO: 444662 - DNA, 25 bp, Rattus norvegicus
ggctctccacatcatgcagtttttt

SEQ ID NO: 444663 - DNA, 25 bp, Rattus norvegicus
ggctctccacatgatgcagtttttt

SEQ ID NO: 444664 - DNA, 25 bp, Rattus norvegicus
ggctctccagagaagccattgagca

SEQ ID NO: 444665 - DNA, 25 bp, Rattus norvegicus
ggctctccagagagatcaccgtgtc

SEQ ID NO: 444666 - DNA, 25 bp, Rattus norvegicus
ggctctccagagtagccattgagca

SEQ ID NO: 444667 - DNA, 25 bp, Rattus norvegicus
ggctctccagagtgatcaccgtgtc

SEQ ID NO: 444668 - DNA, 25 bp, Rattus norvegicus
ggctctccagccaagagtcttatgt

SEQ ID NO: 444669 - DNA, 25 bp, Rattus norvegicus
ggctctccagcctagagtcttatgt

SEQ ID NO: 444670 - DNA, 25 bp, Rattus norvegicus
ggctctccaggcatgatgatgtcca

SEQ ID NO: 444671 - DNA, 25 bp, Rattus norvegicus
ggctctccaggcttgatgatgtcca

SEQ ID NO: 444672 - DNA, 25 bp, Rattus norvegicus
ggctctccattcagattttgggctg

SEQ ID NO: 444673 - DNA, 25 bp, Rattus norvegicus
ggctctccattctgattttgggctg

SEQ ID NO: 444674 - DNA, 25 bp, Rattus norvegicus
ggctctcccacaacaagcattaaga

SEQ ID NO: 444675 - DNA, 25 bp, Rattus norvegicus
ggctctcccacatcaagcattaaga

SEQ ID NO: 444676 - DNA, 25 bp, Rattus norvegicus
ggctctccctagagtgataggccgt

SEQ ID NO: 444677 - DNA, 25 bp, Rattus norvegicus
ggctctccctagtgtgataggccgt

SEQ ID NO: 444678 - DNA, 25 bp, Rattus norvegicus
ggctctccctttctgtgacagacat

SEQ ID NO: 444679 - DNA, 25 bp, Rattus norvegicus
ggctctccctttgtgtgacagacat

SEQ ID NO: 444680 - DNA, 25 bp, Rattus norvegicus
ggctctcctagcactgttctgtaag

SEQ ID NO: 444681 - DNA, 25 bp, Rattus norvegicus
ggctctcctagctctgttctgtaag

SEQ ID NO: 444682 - DNA, 25 bp, Rattus norvegicus
ggctctcctatcagttggttaccat

SEQ ID NO: 444683 - DNA, 25 bp, Rattus norvegicus
ggctctcctatctgttggttaccat

SEQ ID NO: 444684 - DNA, 25 bp, Rattus norvegicus
ggctctcctcccacaaggtcgggag

SEQ ID NO: 444685 - DNA, 25 bp, Rattus norvegicus
ggctctcctccctcaaggtcgggag

SEQ ID NO: 444686 - DNA, 25 bp, Rattus norvegicus
ggctctcctcgtctaagttggaaac

SEQ ID NO: 444687 - DNA, 25 bp, Rattus norvegicus
ggctctcctcgtgtaagttggaaac

SEQ ID NO: 444688 - DNA, 25 bp, Rattus norvegicus
ggctctcctctaccacaagaagtag

SEQ ID NO: 444689 - DNA, 25 bp, Rattus norvegicus
ggctctcctctagcacaagaagtag

SEQ ID NO: 444690 - DNA, 25 bp, Rattus norvegicus
ggctctcctgttactagtgtcttaa

SEQ ID NO: 444691 - DNA, 25 bp, Rattus norvegicus
ggctctcctgtttctagtgtcttaa

SEQ ID NO: 444692 - DNA, 25 bp, Rattus norvegicus
ggctctccttccctagataaaaaat

SEQ ID NO: 444693 - DNA, 25 bp, Rattus norvegicus
ggctctccttccgtagataaaaaat

SEQ ID NO: 444694 - DNA, 25 bp, Rattus norvegicus
ggctctcctttccacccagagagga

SEQ ID NO: 444695 - DNA, 25 bp, Rattus norvegicus
ggctctcctttcgacccagagagga

SEQ ID NO: 444696 - DNA, 25 bp, Rattus norvegicus
ggctctcgaactagacagtcatcaa

SEQ ID NO: 444697 - DNA, 25 bp, Rattus norvegicus
ggctctcgaactctcctgggaattg

SEQ ID NO: 444698 - DNA, 25 bp, Rattus norvegicus
ggctctcgaactgtcctgggaattg

SEQ ID NO: 444699 - DNA, 25 bp, Rattus norvegicus
ggctctcgaacttgacagtcatcaa

SEQ ID NO: 444700 - DNA, 25 bp, Rattus norvegicus
ggctctcgtcatcgaaaggtgcgat

SEQ ID NO: 444701 - DNA, 25 bp, Rattus norvegicus
ggctctcgtcatggaaaggtgcgat

SEQ ID NO: 444702 - DNA, 25 bp, Rattus norvegicus
ggctctctacctcggccaagtgttg

SEQ ID NO: 444703 - DNA, 25 bp, Rattus norvegicus
ggctctctacctgggccaagtgttg

SEQ ID NO: 444704 - DNA, 25 bp, Rattus norvegicus
ggctctctaggcacacatagtcaag

SEQ ID NO: 444705 - DNA, 25 bp, Rattus norvegicus
ggctctctaggctcacatagtcaag

SEQ ID NO: 444706 - DNA, 25 bp, Rattus norvegicus
ggctctctattcagacagcttgcaa

SEQ ID NO: 444707 - DNA, 25 bp, Rattus norvegicus
ggctctctattctgacagcttgcaa

SEQ ID NO: 444708 - DNA, 25 bp, Rattus norvegicus
ggctctctcccaacaaatgttagca

SEQ ID NO: 444709 - DNA, 25 bp, Rattus norvegicus
ggctctctcccatcaaatgttagca

SEQ ID NO: 444710 - DNA, 25 bp, Rattus norvegicus
ggctctctcgttcattgatactgat

SEQ ID NO: 444711 - DNA, 25 bp, Rattus norvegicus
ggctctctcgttgattgatactgat

SEQ ID NO: 444712 - DNA, 25 bp, Rattus norvegicus
ggctctctgagtccattttatccaa

SEQ ID NO: 444713 - DNA, 25 bp, Rattus norvegicus
ggctctctgagtgcattttatccaa

SEQ ID NO: 444714 - DNA, 25 bp, Rattus norvegicus
ggctctctgatgcatgactacttgg

SEQ ID NO: 444715 - DNA, 25 bp, Rattus norvegicus
ggctctctgatggatgactacttgg

SEQ ID NO: 444716 - DNA, 25 bp, Rattus norvegicus
ggctctctgcagacttgataggaaa

SEQ ID NO: 444717 - DNA, 25 bp, Rattus norvegicus
ggctctctgcagtcttgataggaaa

SEQ ID NO: 444718 - DNA, 25 bp, Rattus norvegicus
ggctctctgccaaattgatattcac

SEQ ID NO: 444719 - DNA, 25 bp, Rattus norvegicus
ggctctctgccatattgatattcac

SEQ ID NO: 444720 - DNA, 25 bp, Rattus norvegicus
ggctctctgtatagtcccttggaag

SEQ ID NO: 444721 - DNA, 25 bp, Rattus norvegicus
ggctctctgtattgtcccttggaag

SEQ ID NO: 444722 - DNA, 25 bp, Rattus norvegicus
ggctctcttatcactcgtgaaggaa

SEQ ID NO: 444723 - DNA, 25 bp, Rattus norvegicus
ggctctcttatctctcgtgaaggaa

SEQ ID NO: 444724 - DNA, 25 bp, Rattus norvegicus
ggctctcttcacagggctcaggtga

SEQ ID NO: 444725 - DNA, 25 bp, Rattus norvegicus
ggctctcttcactgggctcaggtga

SEQ ID NO: 444726 - DNA, 25 bp, Rattus norvegicus
ggctctcttggacatcaggacgata

SEQ ID NO: 444727 - DNA, 25 bp, Rattus norvegicus
ggctctcttggagatcaggacgata

SEQ ID NO: 444728 - DNA, 25 bp, Rattus norvegicus
ggctctgaacaaatctagtctgctg

SEQ ID NO: 444729 - DNA, 25 bp, Rattus norvegicus
ggctctgaacaattctagtctgctg

SEQ ID NO: 444730 - DNA, 25 bp, Rattus norvegicus
ggctctgaacctaacgacggtgcat

SEQ ID NO: 444731 - DNA, 25 bp, Rattus norvegicus
ggctctgaaccttacgacggtgcat

SEQ ID NO: 444732 - DNA, 25 bp, Rattus norvegicus
ggctctgaagacaaatcccacactc

SEQ ID NO: 444733 - DNA, 25 bp, Rattus norvegicus
ggctctgaagactaatcccacactc

SEQ ID NO: 444734 - DNA, 25 bp, Rattus norvegicus
ggctctgaagctcttggacatctac

SEQ ID NO: 444735 - DNA, 25 bp, Rattus norvegicus
ggctctgaagctgttggacatctac

SEQ ID NO: 444736 - DNA, 25 bp, Rattus norvegicus
ggctctgaattcacttcctggaatc

SEQ ID NO: 444737 - DNA, 25 bp, Rattus norvegicus
ggctctgaattctcttcctggaatc

SEQ ID NO: 444738 - DNA, 25 bp, Rattus norvegicus
ggctctgaccatagcaatacctaat

SEQ ID NO: 444739 - DNA, 25 bp, Rattus norvegicus
ggctctgaccattgcaatacctaat

SEQ ID NO: 444740 - DNA, 25 bp, Rattus norvegicus
ggctctgagggcatttacagtcatg

SEQ ID NO: 444741 - DNA, 25 bp, Rattus norvegicus
ggctctgagggcttttacagtcatg

SEQ ID NO: 444742 - DNA, 25 bp, Rattus norvegicus
ggctctgatcgaccgcatggtcagt

SEQ ID NO: 444743 - DNA, 25 bp, Rattus norvegicus
ggctctgatcgagcgcatggtcagt

SEQ ID NO: 444744 - DNA, 25 bp, Rattus norvegicus
ggctctgatcggcacactggataca

SEQ ID NO: 444745 - DNA, 25 bp, Rattus norvegicus
ggctctgatcgggacactggataca

SEQ ID NO: 444746 - DNA, 25 bp, Rattus norvegicus
ggctctgatgagattcaggctcaca

SEQ ID NO: 444747 - DNA, 25 bp, Rattus norvegicus
ggctctgatgagcaggtgatggtct

SEQ ID NO: 444748 - DNA, 25 bp, Rattus norvegicus
ggctctgatgaggaggtgatggtct

SEQ ID NO: 444749 - DNA, 25 bp, Rattus norvegicus
ggctctgatgagtttcaggctcaca

SEQ ID NO: 444750 - DNA, 25 bp, Rattus norvegicus
ggctctgatgttcaggttgtatttt

SEQ ID NO: 444751 - DNA, 25 bp, Rattus norvegicus
ggctctgatgttcctgtcgttctac

SEQ ID NO: 444752 - DNA, 25 bp, Rattus norvegicus
ggctctgatgttgaggttgtatttt

SEQ ID NO: 444753 - DNA, 25 bp, Rattus norvegicus
ggctctgatgttgctgtcgttctac

SEQ ID NO: 444754 - DNA, 25 bp, Rattus norvegicus
ggctctgcaacgacgaacactttaa

SEQ ID NO: 444755 - DNA, 25 bp, Rattus norvegicus
ggctctgcaacgtcgaacactttaa

SEQ ID NO: 444756 - DNA, 25 bp, Rattus norvegicus
ggctctgcaatcagggaagacgctg

SEQ ID NO: 444757 - DNA, 25 bp, Rattus norvegicus
ggctctgcaatctgggaagacgctg

SEQ ID NO: 444758 - DNA, 25 bp, Rattus norvegicus
ggctctgcatctctaacagcagctg

SEQ ID NO: 444759 - DNA, 25 bp, Rattus norvegicus
ggctctgcatctgtaacagcagctg

SEQ ID NO: 444760 - DNA, 25 bp, Rattus norvegicus
ggctctgcatgtattctgcctgtag

SEQ ID NO: 444761 - DNA, 25 bp, Rattus norvegicus
ggctctgcatgttttctgcctgtag

SEQ ID NO: 444762 - DNA, 25 bp, Rattus norvegicus
ggctctgccaggaatcgagcagctt

SEQ ID NO: 444763 - DNA, 25 bp, Rattus norvegicus
ggctctgccaggtatcgagcagctt

SEQ ID NO: 444764 - DNA, 25 bp, Rattus norvegicus
ggctctgccagtcagtaggaccagt

SEQ ID NO: 444765 - DNA, 25 bp, Rattus norvegicus
ggctctgccagtgagtaggaccagt

SEQ ID NO: 444766 - DNA, 25 bp, Rattus norvegicus
ggctctgcccatatgtgttaggcct

SEQ ID NO: 444767 - DNA, 25 bp, Rattus norvegicus
ggctctgcccatttgtgttaggcct

SEQ ID NO: 444768 - DNA, 25 bp, Rattus norvegicus
ggctctgcctctaaaggtcctcagt

SEQ ID NO: 444769 - DNA, 25 bp, Rattus norvegicus
ggctctgcctcttaaggtcctcagt

SEQ ID NO: 444770 - DNA, 25 bp, Rattus norvegicus
ggctctgcctggaattcccatctaa

SEQ ID NO: 444771 - DNA, 25 bp, Rattus norvegicus
ggctctgcctggtattcccatctaa

SEQ ID NO: 444772 - DNA, 25 bp, Rattus norvegicus
ggctctgccttacaccaaagactag

SEQ ID NO: 444773 - DNA, 25 bp, Rattus norvegicus
ggctctgccttagaccaaagactag

SEQ ID NO: 444774 - DNA, 25 bp, Rattus norvegicus
ggctctgcgataccctagaggcatt

SEQ ID NO: 444775 - DNA, 25 bp, Rattus norvegicus
ggctctgcgatagcctagaggcatt

SEQ ID NO: 444776 - DNA, 25 bp, Rattus norvegicus
ggctctgcgctgattagaacttcaa

SEQ ID NO: 444777 - DNA, 25 bp, Rattus norvegicus
ggctctgcgctgtttagaacttcaa

SEQ ID NO: 444778 - DNA, 25 bp, Rattus norvegicus
ggctctgctctgacagttggataac

SEQ ID NO: 444779 - DNA, 25 bp, Rattus norvegicus
ggctctgctctgaggcctgtagaca

SEQ ID NO: 444780 - DNA, 25 bp, Rattus norvegicus
ggctctgctctgtcagttggataac

SEQ ID NO: 444781 - DNA, 25 bp, Rattus norvegicus
ggctctgctctgtggcctgtagaca

SEQ ID NO: 444782 - DNA, 25 bp, Rattus norvegicus
ggctctgctggcactcagtaaggca

SEQ ID NO: 444783 - DNA, 25 bp, Rattus norvegicus
ggctctgctggctctcagtaaggca

SEQ ID NO: 444784 - DNA, 25 bp, Rattus norvegicus
ggctctgcttacaaaaaggctctga

SEQ ID NO: 444785 - DNA, 25 bp, Rattus norvegicus
ggctctgcttactaaaaggctctga

SEQ ID NO: 444786 - DNA, 25 bp, Rattus norvegicus
ggctctgcttccagctaaacagatg

SEQ ID NO: 444787 - DNA, 25 bp, Rattus norvegicus
ggctctgcttccaggactgaagaga

SEQ ID NO: 444788 - DNA, 25 bp, Rattus norvegicus
ggctctgcttcctgctaaacagatg

SEQ ID NO: 444789 - DNA, 25 bp, Rattus norvegicus
ggctctgcttcctggactgaagaga

SEQ ID NO: 444790 - DNA, 25 bp, Rattus norvegicus
ggctctgctttcatgccatctggtt

SEQ ID NO: 444791 - DNA, 25 bp, Rattus norvegicus
ggctctgctttcttgccatctggtt

SEQ ID NO: 444792 - DNA, 25 bp, Rattus norvegicus
ggctctggaagccaactgcacagtg

SEQ ID NO: 444793 - DNA, 25 bp, Rattus norvegicus
ggctctggaagcgaactgcacagtg

SEQ ID NO: 444794 - DNA, 25 bp, Rattus norvegicus
ggctctggaccaaagctgttctgtc

SEQ ID NO: 444795 - DNA, 25 bp, Rattus norvegicus
ggctctggaccatagctgttctgtc

SEQ ID NO: 444796 - DNA, 25 bp, Rattus norvegicus
ggctctggactacctagctgggcac

SEQ ID NO: 444797 - DNA, 25 bp, Rattus norvegicus
ggctctggactagctagctgggcac

SEQ ID NO: 444798 - DNA, 25 bp, Rattus norvegicus
ggctctggcaccatgggattgctgt

SEQ ID NO: 444799 - DNA, 25 bp, Rattus norvegicus
ggctctggcaccttgggattgctgt

SEQ ID NO: 444800 - DNA, 25 bp, Rattus norvegicus
ggctctggcagtaagctgggacata

SEQ ID NO: 444801 - DNA, 25 bp, Rattus norvegicus
ggctctggcagttagctgggacata

SEQ ID NO: 444802 - DNA, 25 bp, Rattus norvegicus
ggctctgggactatcctaactaggg

SEQ ID NO: 444803 - DNA, 25 bp, Rattus norvegicus
ggctctgggactttcctaactaggg

SEQ ID NO: 444804 - DNA, 25 bp, Rattus norvegicus
ggctctgggaggagctttgctcaaa

SEQ ID NO: 444805 - DNA, 25 bp, Rattus norvegicus
ggctctgggaggtgctttgctcaaa

SEQ ID NO: 444806 - DNA, 25 bp, Rattus norvegicus
ggctctgggatcagccaaggcctgc

SEQ ID NO: 444807 - DNA, 25 bp, Rattus norvegicus
ggctctgggatctgccaaggcctgc

SEQ ID NO: 444808 - DNA, 25 bp, Rattus norvegicus
ggctctggtcaaacctgaaatgtct

SEQ ID NO: 444809 - DNA, 25 bp, Rattus norvegicus
ggctctggtcaatcctgaaatgtct

SEQ ID NO: 444810 - DNA, 25 bp, Rattus norvegicus
ggctctggtgtcattttgttggtgt

SEQ ID NO: 444811 - DNA, 25 bp, Rattus norvegicus
ggctctggtgtctttttgttggtgt

SEQ ID NO: 444812 - DNA, 25 bp, Rattus norvegicus
ggctctgtaactcgcatggttccca

SEQ ID NO: 444813 - DNA, 25 bp, Rattus norvegicus
ggctctgtaactggcatggttccca

SEQ ID NO: 444814 - DNA, 25 bp, Rattus norvegicus
ggctctgtacctcttaatgtgtttt

SEQ ID NO: 444815 - DNA, 25 bp, Rattus norvegicus
ggctctgtacctgttaatgtgtttt

SEQ ID NO: 444816 - DNA, 25 bp, Rattus norvegicus
ggctctgtacgtctggctccagagt

SEQ ID NO: 444817 - DNA, 25 bp, Rattus norvegicus
ggctctgtacgtgtggctccagagt

SEQ ID NO: 444818 - DNA, 25 bp, Rattus norvegicus
ggctctgtagccatgctagctggaa

SEQ ID NO: 444819 - DNA, 25 bp, Rattus norvegicus
ggctctgtagccctagaaaactcac

SEQ ID NO: 444820 - DNA, 25 bp, Rattus norvegicus
ggctctgtagccgtagaaaactcac

SEQ ID NO: 444821 - DNA, 25 bp, Rattus norvegicus
ggctctgtagccttgctagctggaa

SEQ ID NO: 444822 - DNA, 25 bp, Rattus norvegicus
ggctctgtagtgaattatgctgcta

SEQ ID NO: 444823 - DNA, 25 bp, Rattus norvegicus
ggctctgtagtgtattatgctgcta

SEQ ID NO: 444824 - DNA, 25 bp, Rattus norvegicus
ggctctgtatagaactccagcacac

SEQ ID NO: 444825 - DNA, 25 bp, Rattus norvegicus
ggctctgtatagtactccagcacac

SEQ ID NO: 444826 - DNA, 25 bp, Rattus norvegicus
ggctctgtcaagctatggccacaaa

SEQ ID NO: 444827 - DNA, 25 bp, Rattus norvegicus
ggctctgtcaagctgcgtatttatt

SEQ ID NO: 444828 - DNA, 25 bp, Rattus norvegicus
ggctctgtcaaggtatggccacaaa

SEQ ID NO: 444829 - DNA, 25 bp, Rattus norvegicus
ggctctgtcaaggtgcgtatttatt

SEQ ID NO: 444830 - DNA, 25 bp, Rattus norvegicus
ggctctgtcacaccacagggtgtaa

SEQ ID NO: 444831 - DNA, 25 bp, Rattus norvegicus
ggctctgtcacagcacagggtgtaa

SEQ ID NO: 444832 - DNA, 25 bp, Rattus norvegicus
ggctctgtccagaggaccactcaga

SEQ ID NO: 444833 - DNA, 25 bp, Rattus norvegicus
ggctctgtccagtggaccactcaga

SEQ ID NO: 444834 - DNA, 25 bp, Rattus norvegicus
ggctctgtcctaagcagacactata

SEQ ID NO: 444835 - DNA, 25 bp, Rattus norvegicus
ggctctgtcctatgcagacactata

SEQ ID NO: 444836 - DNA, 25 bp, Rattus norvegicus
ggctctgtcgacacttgtcagggag

SEQ ID NO: 444837 - DNA, 25 bp, Rattus norvegicus
ggctctgtcgactcttgtcagggag

SEQ ID NO: 444838 - DNA, 25 bp, Rattus norvegicus
ggctctgtcgcgagtgctgtgaaac

SEQ ID NO: 444839 - DNA, 25 bp, Rattus norvegicus
ggctctgtcgcgtgtgctgtgaaac

SEQ ID NO: 444840 - DNA, 25 bp, Rattus norvegicus
ggctctgtctgtcttttagatctcc

SEQ ID NO: 444841 - DNA, 25 bp, Rattus norvegicus
ggctctgtctgtgttttagatctcc

SEQ ID NO: 444842 - DNA, 25 bp, Rattus norvegicus
ggctctgtcttcagaaagctgggat

SEQ ID NO: 444843 - DNA, 25 bp, Rattus norvegicus
ggctctgtcttctgaaagctgggat

SEQ ID NO: 444844 - DNA, 25 bp, Rattus norvegicus
ggctctgtgcgacatggtagctact

SEQ ID NO: 444845 - DNA, 25 bp, Rattus norvegicus
ggctctgtgcgagatggtagctact

SEQ ID NO: 444846 - DNA, 25 bp, Rattus norvegicus
ggctctgtgcggattcagaccaatg

SEQ ID NO: 444847 - DNA, 25 bp, Rattus norvegicus
ggctctgtgcggtttcagaccaatg

SEQ ID NO: 444848 - DNA, 25 bp, Rattus norvegicus
ggctctgtgctgacaagacaggtaa

SEQ ID NO: 444849 - DNA, 25 bp, Rattus norvegicus
ggctctgtgctgtcaagacaggtaa

SEQ ID NO: 444850 - DNA, 25 bp, Rattus norvegicus
ggctctgtggagaagcgccatcctt

SEQ ID NO: 444851 - DNA, 25 bp, Rattus norvegicus
ggctctgtggagtagcgccatcctt

SEQ ID NO: 444852 - DNA, 25 bp, Rattus norvegicus
ggctctgtggccagtgatgtcaaag

SEQ ID NO: 444853 - DNA, 25 bp, Rattus norvegicus
ggctctgtggcctgtgatgtcaaag

SEQ ID NO: 444854 - DNA, 25 bp, Rattus norvegicus
ggctctgtgggtagttcacatcgta

SEQ ID NO: 444855 - DNA, 25 bp, Rattus norvegicus
ggctctgtgggttgttcacatcgta

SEQ ID NO: 444856 - DNA, 25 bp, Rattus norvegicus
ggctctgtgtcactgttgagacaaa

SEQ ID NO: 444857 - DNA, 25 bp, Rattus norvegicus
ggctctgtgtcagtgttgagacaaa

SEQ ID NO: 444858 - DNA, 25 bp, Rattus norvegicus
ggctctgtgtgtcgcactgatttat

SEQ ID NO: 444859 - DNA, 25 bp, Rattus norvegicus
ggctctgtgtgtggcactgatttat

SEQ ID NO: 444860 - DNA, 25 bp, Rattus norvegicus
ggctctgttaacagcgccgcagagt

SEQ ID NO: 444861 - DNA, 25 bp, Rattus norvegicus
ggctctgttaactgcgccgcagagt

SEQ ID NO: 444862 - DNA, 25 bp, Rattus norvegicus
ggctctgttcaacctccaagagtac

SEQ ID NO: 444863 - DNA, 25 bp, Rattus norvegicus
ggctctgttcaagctccaagagtac

SEQ ID NO: 444864 - DNA, 25 bp, Rattus norvegicus
ggctctgttcacatgctgtgataga

SEQ ID NO: 444865 - DNA, 25 bp, Rattus norvegicus
ggctctgttcacttgctgtgataga

SEQ ID NO: 444866 - DNA, 25 bp, Rattus norvegicus
ggctctgttcctaatagtttactgt

SEQ ID NO: 444867 - DNA, 25 bp, Rattus norvegicus
ggctctgttccttatagtttactgt

SEQ ID NO: 444868 - DNA, 25 bp, Rattus norvegicus
ggctctgttgccacatcagaatgga

SEQ ID NO: 444869 - DNA, 25 bp, Rattus norvegicus
ggctctgttgcctcatcagaatgga

SEQ ID NO: 444870 - DNA, 25 bp, Rattus norvegicus
ggctctgttgttacctctgttttaa

SEQ ID NO: 444871 - DNA, 25 bp, Rattus norvegicus
ggctctgttgtttcctctgttttaa

SEQ ID NO: 444872 - DNA, 25 bp, Rattus norvegicus
ggctcttacaccacaggctttgcaa

SEQ ID NO: 444873 - DNA, 25 bp, Rattus norvegicus
ggctcttacaccagcatgacggaag

SEQ ID NO: 444874 - DNA, 25 bp, Rattus norvegicus
ggctcttacacctcaggctttgcaa

SEQ ID NO: 444875 - DNA, 25 bp, Rattus norvegicus
ggctcttacacctgcatgacggaag

SEQ ID NO: 444876 - DNA, 25 bp, Rattus norvegicus
ggctcttacagaatgaacttgtcta

SEQ ID NO: 444877 - DNA, 25 bp, Rattus norvegicus
ggctcttacagattgaacttgtcta

SEQ ID NO: 444878 - DNA, 25 bp, Rattus norvegicus
ggctcttacataacgtgacctttca

SEQ ID NO: 444879 - DNA, 25 bp, Rattus norvegicus
ggctcttacatatcgtgacctttca

SEQ ID NO: 444880 - DNA, 25 bp, Rattus norvegicus
ggctcttaccatccggagacagtga

SEQ ID NO: 444881 - DNA, 25 bp, Rattus norvegicus
ggctcttaccatgcggagacagtga

SEQ ID NO: 444882 - DNA, 25 bp, Rattus norvegicus
ggctcttagcagcatcaagctgtac

SEQ ID NO: 444883 - DNA, 25 bp, Rattus norvegicus
ggctcttagcaggatcaagctgtac

SEQ ID NO: 444884 - DNA, 25 bp, Rattus norvegicus
ggctcttagtggctcctggtagtta

SEQ ID NO: 444885 - DNA, 25 bp, Rattus norvegicus
ggctcttagtgggtcctggtagtta

SEQ ID NO: 444886 - DNA, 25 bp, Rattus norvegicus
ggctcttcaccccagggcatcctga

SEQ ID NO: 444887 - DNA, 25 bp, Rattus norvegicus
ggctcttcacccgagggcatcctga

SEQ ID NO: 444888 - DNA, 25 bp, Rattus norvegicus
ggctcttcagagattgggtacgtgt

SEQ ID NO: 444889 - DNA, 25 bp, Rattus norvegicus
ggctcttcagagtttgggtacgtgt

SEQ ID NO: 444890 - DNA, 25 bp, Rattus norvegicus
ggctcttcaggtcctccaatgagaa

SEQ ID NO: 444891 - DNA, 25 bp, Rattus norvegicus
ggctcttcaggtgctccaatgagaa

SEQ ID NO: 444892 - DNA, 25 bp, Rattus norvegicus
ggctcttcatgtactgacagcacag

SEQ ID NO: 444893 - DNA, 25 bp, Rattus norvegicus
ggctcttcatgttctgacagcacag

SEQ ID NO: 444894 - DNA, 25 bp, Rattus norvegicus
ggctcttccaaaaaatggctcagca

SEQ ID NO: 444895 - DNA, 25 bp, Rattus norvegicus
ggctcttccaaataatggctcagca

SEQ ID NO: 444896 - DNA, 25 bp, Rattus norvegicus
ggctcttcccgtccaattatgtgaa

SEQ ID NO: 444897 - DNA, 25 bp, Rattus norvegicus
ggctcttcccgtgcaattatgtgaa

SEQ ID NO: 444898 - DNA, 25 bp, Rattus norvegicus
ggctcttccctgcaggaatgtggtc

SEQ ID NO: 444899 - DNA, 25 bp, Rattus norvegicus
ggctcttccctggaggaatgtggtc

SEQ ID NO: 444900 - DNA, 25 bp, Rattus norvegicus
ggctcttccgctcgcttaaagatac

SEQ ID NO: 444901 - DNA, 25 bp, Rattus norvegicus
ggctcttccgctggcttaaagatac

SEQ ID NO: 444902 - DNA, 25 bp, Rattus norvegicus
ggctcttccttaaaactcaacttgt

SEQ ID NO: 444903 - DNA, 25 bp, Rattus norvegicus
ggctcttccttataactcaacttgt

SEQ ID NO: 444904 - DNA, 25 bp, Rattus norvegicus
ggctcttcggatctctctgtaataa

SEQ ID NO: 444905 - DNA, 25 bp, Rattus norvegicus
ggctcttcggatgtctctgtaataa

SEQ ID NO: 444906 - DNA, 25 bp, Rattus norvegicus
ggctcttcgtcgaccgatgatgagt

SEQ ID NO: 444907 - DNA, 25 bp, Rattus norvegicus
ggctcttcgtcgtccgatgatgagt

SEQ ID NO: 444908 - DNA, 25 bp, Rattus norvegicus
ggctcttcgtggagtttacgctcca

SEQ ID NO: 444909 - DNA, 25 bp, Rattus norvegicus
ggctcttcgtggtgtttacgctcca

SEQ ID NO: 444910 - DNA, 25 bp, Rattus norvegicus
ggctcttctccaagacacagattct

SEQ ID NO: 444911 - DNA, 25 bp, Rattus norvegicus
ggctcttctccatgacacagattct

SEQ ID NO: 444912 - DNA, 25 bp, Rattus norvegicus
ggctcttcttcccaaataactctag

SEQ ID NO: 444913 - DNA, 25 bp, Rattus norvegicus
ggctcttcttccgaaataactctag

SEQ ID NO: 444914 - DNA, 25 bp, Rattus norvegicus
ggctcttcttctacgcgacagaaaa

SEQ ID NO: 444915 - DNA, 25 bp, Rattus norvegicus
ggctcttcttcttcgcgacagaaaa

SEQ ID NO: 444916 - DNA, 25 bp, Rattus norvegicus
ggctcttgaaggaacatagtgacac

SEQ ID NO: 444917 - DNA, 25 bp, Rattus norvegicus
ggctcttgaaggtacatagtgacac

SEQ ID NO: 444918 - DNA, 25 bp, Rattus norvegicus
ggctcttgacttctgggacctatct

SEQ ID NO: 444919 - DNA, 25 bp, Rattus norvegicus
ggctcttgacttgtgggacctatct

SEQ ID NO: 444920 - DNA, 25 bp, Rattus norvegicus
ggctcttgagcccagtaacatgcat

SEQ ID NO: 444921 - DNA, 25 bp, Rattus norvegicus
ggctcttgagccgagtaacatgcat

SEQ ID NO: 444922 - DNA, 25 bp, Rattus norvegicus
ggctcttgatgaaatttactccaca

SEQ ID NO: 444923 - DNA, 25 bp, Rattus norvegicus
ggctcttgatgatatttactccaca

SEQ ID NO: 444924 - DNA, 25 bp, Rattus norvegicus
ggctcttgccagctctttcaaatac

SEQ ID NO: 444925 - DNA, 25 bp, Rattus norvegicus
ggctcttgccaggtctttcaaatac

SEQ ID NO: 444926 - DNA, 25 bp, Rattus norvegicus
ggctcttgcctgagaaggttaagca

SEQ ID NO: 444927 - DNA, 25 bp, Rattus norvegicus
ggctcttgcctgtgaaggttaagca

SEQ ID NO: 444928 - DNA, 25 bp, Rattus norvegicus
ggctcttgcgcacagcgatgttgtt

SEQ ID NO: 444929 - DNA, 25 bp, Rattus norvegicus
ggctcttgcgcagagcgatgttgtt

SEQ ID NO: 444930 - DNA, 25 bp, Rattus norvegicus
ggctcttggatactttcctgtggct

SEQ ID NO: 444931 - DNA, 25 bp, Rattus norvegicus
ggctcttggatagtttcctgtggct

SEQ ID NO: 444932 - DNA, 25 bp, Rattus norvegicus
ggctcttggccaagctgagtgtgca

SEQ ID NO: 444933 - DNA, 25 bp, Rattus norvegicus
ggctcttggccatgctgagtgtgca

SEQ ID NO: 444934 - DNA, 25 bp, Rattus norvegicus
ggctcttggcctcgacgagatctat

SEQ ID NO: 444935 - DNA, 25 bp, Rattus norvegicus
ggctcttggcctggacgagatctat

SEQ ID NO: 444936 - DNA, 25 bp, Rattus norvegicus
ggctcttgggttcaagggaaccact

SEQ ID NO: 444937 - DNA, 25 bp, Rattus norvegicus
ggctcttgggttgaagggaaccact

SEQ ID NO: 444938 - DNA, 25 bp, Rattus norvegicus
ggctcttggtggctaattgctgact

SEQ ID NO: 444939 - DNA, 25 bp, Rattus norvegicus
ggctcttggtgggtaattgctgact

SEQ ID NO: 444940 - DNA, 25 bp, Rattus norvegicus
ggctcttgtcgaaatccagttggat

SEQ ID NO: 444941 - DNA, 25 bp, Rattus norvegicus
ggctcttgtcgatatccagttggat

SEQ ID NO: 444942 - DNA, 25 bp, Rattus norvegicus
ggctcttgtgaaactctgcttggga

SEQ ID NO: 444943 - DNA, 25 bp, Rattus norvegicus
ggctcttgtgaatctctgcttggga

SEQ ID NO: 444944 - DNA, 25 bp, Rattus norvegicus
ggctcttgtggacccctagacaagg

SEQ ID NO: 444945 - DNA, 25 bp, Rattus norvegicus
ggctcttgtggagccctagacaagg

SEQ ID NO: 444946 - DNA, 25 bp, Rattus norvegicus
ggctcttgttagcttgcgtaaccaa

SEQ ID NO: 444947 - DNA, 25 bp, Rattus norvegicus
ggctcttgttaggttgcgtaaccaa

SEQ ID NO: 444948 - DNA, 25 bp, Rattus norvegicus
ggctctttagagataatgagttggt

SEQ ID NO: 444949 - DNA, 25 bp, Rattus norvegicus
ggctctttagagttaatgagttggt

SEQ ID NO: 444950 - DNA, 25 bp, Rattus norvegicus
ggctctttatatacctggctacgtt

SEQ ID NO: 444951 - DNA, 25 bp, Rattus norvegicus
ggctctttatattcctggctacgtt

SEQ ID NO: 444952 - DNA, 25 bp, Rattus norvegicus
ggctctttattcattactacagtga

SEQ ID NO: 444953 - DNA, 25 bp, Rattus norvegicus
ggctctttattctttactacagtga

SEQ ID NO: 444954 - DNA, 25 bp, Rattus norvegicus
ggctctttcctgcaagatcaattcg

SEQ ID NO: 444955 - DNA, 25 bp, Rattus norvegicus
ggctctttcctggaagatcaattcg

SEQ ID NO: 444956 - DNA, 25 bp, Rattus norvegicus
ggctctttctctatctaaggacctg

SEQ ID NO: 444957 - DNA, 25 bp, Rattus norvegicus
ggctctttctctttctaaggacctg

SEQ ID NO: 444958 - DNA, 25 bp, Rattus norvegicus
ggctctttgctcatttcctttagaa

SEQ ID NO: 444959 - DNA, 25 bp, Rattus norvegicus
ggctctttgctcttttcctttagaa

SEQ ID NO: 444960 - DNA, 25 bp, Rattus norvegicus
ggctctttggccagttttgggagac

SEQ ID NO: 444961 - DNA, 25 bp, Rattus norvegicus
ggctctttggcctgttttgggagac

SEQ ID NO: 444962 - DNA, 25 bp, Rattus norvegicus
ggctcttttaccagtgtgaatgaca

SEQ ID NO: 444963 - DNA, 25 bp, Rattus norvegicus
ggctcttttacctgtgtgaatgaca

SEQ ID NO: 444964 - DNA, 25 bp, Rattus norvegicus
ggctcttttgtgatcatctcacaca

SEQ ID NO: 444965 - DNA, 25 bp, Rattus norvegicus
ggctcttttgtgttcatctcacaca

SEQ ID NO: 444966 - DNA, 25 bp, Rattus norvegicus
ggctgaaaacccaagagtgtcccct

SEQ ID NO: 444967 - DNA, 25 bp, Rattus norvegicus
ggctgaaaaccctagagtgtcccct

SEQ ID NO: 444968 - DNA, 25 bp, Rattus norvegicus
ggctgaaaccacaaacccacatctg

SEQ ID NO: 444969 - DNA, 25 bp, Rattus norvegicus
ggctgaaaccactaacccacatctg

SEQ ID NO: 444970 - DNA, 25 bp, Rattus norvegicus
ggctgaaactctcggacaaagttct

SEQ ID NO: 444971 - DNA, 25 bp, Rattus norvegicus
ggctgaaactctgggacaaagttct

SEQ ID NO: 444972 - DNA, 25 bp, Rattus norvegicus
ggctgaaataccactttgtgaccat

SEQ ID NO: 444973 - DNA, 25 bp, Rattus norvegicus
ggctgaaatacctctttgtgaccat

SEQ ID NO: 444974 - DNA, 25 bp, Rattus norvegicus
ggctgaaatcagcagattggctcat

SEQ ID NO: 444975 - DNA, 25 bp, Rattus norvegicus
ggctgaaatcaggagattggctcat

SEQ ID NO: 444976 - DNA, 25 bp, Rattus norvegicus
ggctgaaatcccaagctctcgacaa

SEQ ID NO: 444977 - DNA, 25 bp, Rattus norvegicus
ggctgaaatccctagctctcgacaa

SEQ ID NO: 444978 - DNA, 25 bp, Rattus norvegicus
ggctgaacagatactgcggccactg

SEQ ID NO: 444979 - DNA, 25 bp, Rattus norvegicus
ggctgaacagattctgcggccactg

SEQ ID NO: 444980 - DNA, 25 bp, Rattus norvegicus
ggctgaacaggcatgtctctcgggt

SEQ ID NO: 444981 - DNA, 25 bp, Rattus norvegicus
ggctgaacaggcttgtctctcgggt

SEQ ID NO: 444982 - DNA, 25 bp, Rattus norvegicus
ggctgaacatgtcccgacagtgctt

SEQ ID NO: 444983 - DNA, 25 bp, Rattus norvegicus
ggctgaacatgtgccgacagtgctt

SEQ ID NO: 444984 - DNA, 25 bp, Rattus norvegicus
ggctgaacattcatatcctttaaaa

SEQ ID NO: 444985 - DNA, 25 bp, Rattus norvegicus
ggctgaacattcttatcctttaaaa

SEQ ID NO: 444986 - DNA, 25 bp, Rattus norvegicus
ggctgaaccaagcacatttcatgta

SEQ ID NO: 444987 - DNA, 25 bp, Rattus norvegicus
ggctgaaccaaggacatttcatgta

SEQ ID NO: 444988 - DNA, 25 bp, Rattus norvegicus
ggctgaacgccacacgtagacgtga

SEQ ID NO: 444989 - DNA, 25 bp, Rattus norvegicus
ggctgaacgccagacgtagacgtga

SEQ ID NO: 444990 - DNA, 25 bp, Rattus norvegicus
ggctgaactagcataccttgaacgg

SEQ ID NO: 444991 - DNA, 25 bp, Rattus norvegicus
ggctgaactagcttaccttgaacgg

SEQ ID NO: 444992 - DNA, 25 bp, Rattus norvegicus
ggctgaactttgaacatgctacttt

SEQ ID NO: 444993 - DNA, 25 bp, Rattus norvegicus
ggctgaactttgaacttttgacgca

SEQ ID NO: 444994 - DNA, 25 bp, Rattus norvegicus
ggctgaactttgtacatgctacttt

SEQ ID NO: 444995 - DNA, 25 bp, Rattus norvegicus
ggctgaactttgtacttttgacgca

SEQ ID NO: 444996 - DNA, 25 bp, Rattus norvegicus
ggctgaagaaatcccacaccatgtg

SEQ ID NO: 444997 - DNA, 25 bp, Rattus norvegicus
ggctgaagaaatgccacaccatgtg

SEQ ID NO: 444998 - DNA, 25 bp, Rattus norvegicus
ggctgaagacaaacttgcacgggtt

SEQ ID NO: 444999 - DNA, 25 bp, Rattus norvegicus
ggctgaagacaatcttgcacgggtt

SEQ ID NO: 445000 - DNA, 25 bp, Rattus norvegicus
ggctgaagacctcgctgtttattac

SEQ ID NO: 445001 - DNA, 25 bp, Rattus norvegicus
ggctgaagacctggctgtttattac

SEQ ID NO: 445002 - DNA, 25 bp, Rattus norvegicus
ggctgaagcagcagatcccagtcac

SEQ ID NO: 445003 - DNA, 25 bp, Rattus norvegicus
ggctgaagcagctgatcccagtcac

SEQ ID NO: 445004 - DNA, 25 bp, Rattus norvegicus
ggctgaagcatgagtgcatctactt

SEQ ID NO: 445005 - DNA, 25 bp, Rattus norvegicus
ggctgaagcatgtgtgcatctactt

SEQ ID NO: 445006 - DNA, 25 bp, Rattus norvegicus
ggctgaagccctctatatagtaaac

SEQ ID NO: 445007 - DNA, 25 bp, Rattus norvegicus
ggctgaagccctgtatatagtaaac

SEQ ID NO: 445008 - DNA, 25 bp, Rattus norvegicus
ggctgaagcctcagattccttcaaa

SEQ ID NO: 445009 - DNA, 25 bp, Rattus norvegicus
ggctgaagcctctgattccttcaaa

SEQ ID NO: 445010 - DNA, 25 bp, Rattus norvegicus
ggctgaagcctgaggaaatctgtat

SEQ ID NO: 445011 - DNA, 25 bp, Rattus norvegicus
ggctgaagcctgtggaaatctgtat

SEQ ID NO: 445012 - DNA, 25 bp, Rattus norvegicus
ggctgaagcggacgaagctcacctt

SEQ ID NO: 445013 - DNA, 25 bp, Rattus norvegicus
ggctgaagcggaggaagctcacctt

SEQ ID NO: 445014 - DNA, 25 bp, Rattus norvegicus
ggctgaaggaagagccaggcttact

SEQ ID NO: 445015 - DNA, 25 bp, Rattus norvegicus
ggctgaaggaagtgccaggcttact

SEQ ID NO: 445016 - DNA, 25 bp, Rattus norvegicus
ggctgaaggcacagacaaatccgat

SEQ ID NO: 445017 - DNA, 25 bp, Rattus norvegicus
ggctgaaggcactgacaaatccgat

SEQ ID NO: 445018 - DNA, 25 bp, Rattus norvegicus
ggctgaaggcctctggcaacagaca

SEQ ID NO: 445019 - DNA, 25 bp, Rattus norvegicus
ggctgaaggcctgtggcaacagaca

SEQ ID NO: 445020 - DNA, 25 bp, Rattus norvegicus
ggctgaagtataaagatctcgtttg

SEQ ID NO: 445021 - DNA, 25 bp, Rattus norvegicus
ggctgaagtatatagatctcgtttg

SEQ ID NO: 445022 - DNA, 25 bp, Rattus norvegicus
ggctgaagtatcatcaaccctttat

SEQ ID NO: 445023 - DNA, 25 bp, Rattus norvegicus
ggctgaagtatcttcaaccctttat

SEQ ID NO: 445024 - DNA, 25 bp, Rattus norvegicus
ggctgaagtatgcaaagtcccaatg

SEQ ID NO: 445025 - DNA, 25 bp, Rattus norvegicus
ggctgaagtatggaaagtcccaatg

SEQ ID NO: 445026 - DNA, 25 bp, Rattus norvegicus
ggctgaagtcccagacagactgtgt

SEQ ID NO: 445027 - DNA, 25 bp, Rattus norvegicus
ggctgaagtccctgacagactgtgt

SEQ ID NO: 445028 - DNA, 25 bp, Rattus norvegicus
ggctgaagtcgcagatccctgagat

SEQ ID NO: 445029 - DNA, 25 bp, Rattus norvegicus
ggctgaagtcgctgatccctgagat

SEQ ID NO: 445030 - DNA, 25 bp, Rattus norvegicus
ggctgaatacacaacttaagtccac

SEQ ID NO: 445031 - DNA, 25 bp, Rattus norvegicus
ggctgaatacactacttaagtccac

SEQ ID NO: 445032 - DNA, 25 bp, Rattus norvegicus
ggctgaatacccctgcggttataat

SEQ ID NO: 445033 - DNA, 25 bp, Rattus norvegicus
ggctgaatacccgtgcggttataat

SEQ ID NO: 445034 - DNA, 25 bp, Rattus norvegicus
ggctgaatatcacgtctggcatgca

SEQ ID NO: 445035 - DNA, 25 bp, Rattus norvegicus
ggctgaatatcaggtctggcatgca

SEQ ID NO: 445036 - DNA, 25 bp, Rattus norvegicus
ggctgaatccagcttgtccaagtca

SEQ ID NO: 445037 - DNA, 25 bp, Rattus norvegicus
ggctgaatccaggttgtccaagtca

SEQ ID NO: 445038 - DNA, 25 bp, Rattus norvegicus
ggctgaatcctcatgtgacctttta

SEQ ID NO: 445039 - DNA, 25 bp, Rattus norvegicus
ggctgaatcctcttgtgacctttta

SEQ ID NO: 445040 - DNA, 25 bp, Rattus norvegicus
ggctgaatctggactatatgctacg

SEQ ID NO: 445041 - DNA, 25 bp, Rattus norvegicus
ggctgaatctggtctatatgctacg

SEQ ID NO: 445042 - DNA, 25 bp, Rattus norvegicus
ggctgaatgaccatgactcactctt

SEQ ID NO: 445043 - DNA, 25 bp, Rattus norvegicus
ggctgaatgaccttgactcactctt

SEQ ID NO: 445044 - DNA, 25 bp, Rattus norvegicus
ggctgaatgtccatcgagagtatct

SEQ ID NO: 445045 - DNA, 25 bp, Rattus norvegicus
ggctgaatgtccttcgagagtatct

SEQ ID NO: 445046 - DNA, 25 bp, Rattus norvegicus
ggctgaatgttcacttaatcttggt

SEQ ID NO: 445047 - DNA, 25 bp, Rattus norvegicus
ggctgaatgttctcttaatcttggt

SEQ ID NO: 445048 - DNA, 25 bp, Rattus norvegicus
ggctgaattcagcaaggcgctaact

SEQ ID NO: 445049 - DNA, 25 bp, Rattus norvegicus
ggctgaattcaggaaggcgctaact

SEQ ID NO: 445050 - DNA, 25 bp, Rattus norvegicus
ggctgaatttccatatagtttttac

SEQ ID NO: 445051 - DNA, 25 bp, Rattus norvegicus
ggctgaatttccttatagtttttac

SEQ ID NO: 445052 - DNA, 25 bp, Rattus norvegicus
ggctgacaacctcagaaaccaacgt

SEQ ID NO: 445053 - DNA, 25 bp, Rattus norvegicus
ggctgacaacctgagaaaccaacgt

SEQ ID NO: 445054 - DNA, 25 bp, Rattus norvegicus
ggctgacaagttctttgtaccccaa

SEQ ID NO: 445055 - DNA, 25 bp, Rattus norvegicus
ggctgacaagttgtttgtaccccaa

SEQ ID NO: 445056 - DNA, 25 bp, Rattus norvegicus
ggctgacacaagactttgaccctga

SEQ ID NO: 445057 - DNA, 25 bp, Rattus norvegicus
ggctgacacaagtctttgaccctga

SEQ ID NO: 445058 - DNA, 25 bp, Rattus norvegicus
ggctgacacagacattgctcttaaa

SEQ ID NO: 445059 - DNA, 25 bp, Rattus norvegicus
ggctgacacagagattgctcttaaa

SEQ ID NO: 445060 - DNA, 25 bp, Rattus norvegicus
ggctgacactacacacaattcaaca

SEQ ID NO: 445061 - DNA, 25 bp, Rattus norvegicus
ggctgacactactcacaattcaaca

SEQ ID NO: 445062 - DNA, 25 bp, Rattus norvegicus
ggctgacagcagagattttacccat

SEQ ID NO: 445063 - DNA, 25 bp, Rattus norvegicus
ggctgacagcagagcctgtattttc

SEQ ID NO: 445064 - DNA, 25 bp, Rattus norvegicus
ggctgacagcagcaactactacaac

SEQ ID NO: 445065 - DNA, 25 bp, Rattus norvegicus
ggctgacagcaggaactactacaac

SEQ ID NO: 445066 - DNA, 25 bp, Rattus norvegicus
ggctgacagcagtgattttacccat

SEQ ID NO: 445067 - DNA, 25 bp, Rattus norvegicus
ggctgacagcagtgcctgtattttc

SEQ ID NO: 445068 - DNA, 25 bp, Rattus norvegicus
ggctgacagcccataaacaagataa

SEQ ID NO: 445069 - DNA, 25 bp, Rattus norvegicus
ggctgacagcccttaaacaagataa

SEQ ID NO: 445070 - DNA, 25 bp, Rattus norvegicus
ggctgacatcttagctgagcttgga

SEQ ID NO: 445071 - DNA, 25 bp, Rattus norvegicus
ggctgacatctttgctgagcttgga

SEQ ID NO: 445072 - DNA, 25 bp, Rattus norvegicus
ggctgacatggaacggcctctgcag

SEQ ID NO: 445073 - DNA, 25 bp, Rattus norvegicus
ggctgacatggatcggcctctgcag

SEQ ID NO: 445074 - DNA, 25 bp, Rattus norvegicus
ggctgacatgggatgtctgactttt

SEQ ID NO: 445075 - DNA, 25 bp, Rattus norvegicus
ggctgacatgggttgtctgactttt

SEQ ID NO: 445076 - DNA, 25 bp, Rattus norvegicus
ggctgaccaaggctctcgcacgttc

SEQ ID NO: 445077 - DNA, 25 bp, Rattus norvegicus
ggctgaccaagggtctcgcacgttc

SEQ ID NO: 445078 - DNA, 25 bp, Rattus norvegicus
ggctgaccacaacaccaaagttaac

SEQ ID NO: 445079 - DNA, 25 bp, Rattus norvegicus
ggctgaccacaagaccaaagttaac

SEQ ID NO: 445080 - DNA, 25 bp, Rattus norvegicus
ggctgaccagctcggcaaaatcttt

SEQ ID NO: 445081 - DNA, 25 bp, Rattus norvegicus
ggctgaccagctgggcaaaatcttt

SEQ ID NO: 445082 - DNA, 25 bp, Rattus norvegicus
ggctgaccataactcatccacacag

SEQ ID NO: 445083 - DNA, 25 bp, Rattus norvegicus
ggctgaccataagtcatccacacag

SEQ ID NO: 445084 - DNA, 25 bp, Rattus norvegicus
ggctgacccagaacttactgtgtag

SEQ ID NO: 445085 - DNA, 25 bp, Rattus norvegicus
ggctgacccagatcttactgtgtag

SEQ ID NO: 445086 - DNA, 25 bp, Rattus norvegicus
ggctgacccaggagtcgcaaacttg

SEQ ID NO: 445087 - DNA, 25 bp, Rattus norvegicus
ggctgacccaggtgtcgcaaacttg

SEQ ID NO: 445088 - DNA, 25 bp, Rattus norvegicus
ggctgaccgctacttacaacagaga

SEQ ID NO: 445089 - DNA, 25 bp, Rattus norvegicus
ggctgaccgctagttacaacagaga

SEQ ID NO: 445090 - DNA, 25 bp, Rattus norvegicus
ggctgaccggatactgaccatgaga

SEQ ID NO: 445091 - DNA, 25 bp, Rattus norvegicus
ggctgaccggattctgaccatgaga

SEQ ID NO: 445092 - DNA, 25 bp, Rattus norvegicus
ggctgacctaagcacaattcaacat

SEQ ID NO: 445093 - DNA, 25 bp, Rattus norvegicus
ggctgacctaaggacaattcaacat

SEQ ID NO: 445094 - DNA, 25 bp, Rattus norvegicus
ggctgacctccactttgccaaagga

SEQ ID NO: 445095 - DNA, 25 bp, Rattus norvegicus
ggctgacctccagtttgccaaagga

SEQ ID NO: 445096 - DNA, 25 bp, Rattus norvegicus
ggctgacctgacctgatattcaact

SEQ ID NO: 445097 - DNA, 25 bp, Rattus norvegicus
ggctgacctgacgtgatattcaact

SEQ ID NO: 445098 - DNA, 25 bp, Rattus norvegicus
ggctgacctggaatctctttgtagt

SEQ ID NO: 445099 - DNA, 25 bp, Rattus norvegicus
ggctgacctggacgactatcttaat

SEQ ID NO: 445100 - DNA, 25 bp, Rattus norvegicus
ggctgacctggaggactatcttaat

SEQ ID NO: 445101 - DNA, 25 bp, Rattus norvegicus
ggctgacctggattctctttgtagt

SEQ ID NO: 445102 - DNA, 25 bp, Rattus norvegicus
ggctgacctgtgactatgagggact

SEQ ID NO: 445103 - DNA, 25 bp, Rattus norvegicus
ggctgacctgtgtctatgagggact

SEQ ID NO: 445104 - DNA, 25 bp, Rattus norvegicus
ggctgacctttcacttaactgtaaa

SEQ ID NO: 445105 - DNA, 25 bp, Rattus norvegicus
ggctgacctttctcttaactgtaaa

SEQ ID NO: 445106 - DNA, 25 bp, Rattus norvegicus
ggctgacgagccacctgtggctctt

SEQ ID NO: 445107 - DNA, 25 bp, Rattus norvegicus
ggctgacgagcctcctgtggctctt

SEQ ID NO: 445108 - DNA, 25 bp, Rattus norvegicus
ggctgacgagctccgaattacttat

SEQ ID NO: 445109 - DNA, 25 bp, Rattus norvegicus
ggctgacgagctgcgaattacttat

SEQ ID NO: 445110 - DNA, 25 bp, Rattus norvegicus
ggctgacgctggaagtctgcagaca

SEQ ID NO: 445111 - DNA, 25 bp, Rattus norvegicus
ggctgacgctggtagtctgcagaca

SEQ ID NO: 445112 - DNA, 25 bp, Rattus norvegicus
ggctgacggctgaccaatagaatct

SEQ ID NO: 445113 - DNA, 25 bp, Rattus norvegicus
ggctgacggctgtccaatagaatct

SEQ ID NO: 445114 - DNA, 25 bp, Rattus norvegicus
ggctgacgtggtcgaaatagtaaac

SEQ ID NO: 445115 - DNA, 25 bp, Rattus norvegicus
ggctgacgtggtggaaatagtaaac

SEQ ID NO: 445116 - DNA, 25 bp, Rattus norvegicus
ggctgactcaaaagttttgctttgt

SEQ ID NO: 445117 - DNA, 25 bp, Rattus norvegicus
ggctgactcaaatgttttgctttgt

SEQ ID NO: 445118 - DNA, 25 bp, Rattus norvegicus
ggctgactcactcaaccaatgtaga

SEQ ID NO: 445119 - DNA, 25 bp, Rattus norvegicus
ggctgactcactgaaccaatgtaga

SEQ ID NO: 445120 - DNA, 25 bp, Rattus norvegicus
ggctgactcatcagctcatggtacg

SEQ ID NO: 445121 - DNA, 25 bp, Rattus norvegicus
ggctgactcatctgctcatggtacg

SEQ ID NO: 445122 - DNA, 25 bp, Rattus norvegicus
ggctgactgaggacccagatcttca

SEQ ID NO: 445123 - DNA, 25 bp, Rattus norvegicus
ggctgactgaggtcccagatcttca

SEQ ID NO: 445124 - DNA, 25 bp, Rattus norvegicus
ggctgactgattaacaagtttggca

SEQ ID NO: 445125 - DNA, 25 bp, Rattus norvegicus
ggctgactgatttacaagtttggca

SEQ ID NO: 445126 - DNA, 25 bp, Rattus norvegicus
ggctgactggagctcctggatcccc

SEQ ID NO: 445127 - DNA, 25 bp, Rattus norvegicus
ggctgactggaggtcctggatcccc

SEQ ID NO: 445128 - DNA, 25 bp, Rattus norvegicus
ggctgactgggtagtagctcctctt

SEQ ID NO: 445129 - DNA, 25 bp, Rattus norvegicus
ggctgactgggttgtagctcctctt

SEQ ID NO: 445130 - DNA, 25 bp, Rattus norvegicus
ggctgactggtcaacaaacctttga

SEQ ID NO: 445131 - DNA, 25 bp, Rattus norvegicus
ggctgactggtctacaaacctttga

SEQ ID NO: 445132 - DNA, 25 bp, Rattus norvegicus
ggctgactggttagtccctgagtgc

SEQ ID NO: 445133 - DNA, 25 bp, Rattus norvegicus
ggctgactggtttgtccctgagtgc

SEQ ID NO: 445134 - DNA, 25 bp, Rattus norvegicus
ggctgactgtagattgttgcccaaa

SEQ ID NO: 445135 - DNA, 25 bp, Rattus norvegicus
ggctgactgtagtttgttgcccaaa

SEQ ID NO: 445136 - DNA, 25 bp, Rattus norvegicus
ggctgacttcgcagggaactctgga

SEQ ID NO: 445137 - DNA, 25 bp, Rattus norvegicus
ggctgacttcgctgggaactctgga

SEQ ID NO: 445138 - DNA, 25 bp, Rattus norvegicus
ggctgacttcggctccgcttccatg

SEQ ID NO: 445139 - DNA, 25 bp, Rattus norvegicus
ggctgacttcgggtccgcttccatg

SEQ ID NO: 445140 - DNA, 25 bp, Rattus norvegicus
ggctgactttatagacctgcttgtt

SEQ ID NO: 445141 - DNA, 25 bp, Rattus norvegicus
ggctgactttattgacctgcttgtt

SEQ ID NO: 445142 - DNA, 25 bp, Rattus norvegicus
ggctgactttcgcacaaggctgaga

SEQ ID NO: 445143 - DNA, 25 bp, Rattus norvegicus
ggctgactttcggacaaggctgaga

SEQ ID NO: 445144 - DNA, 25 bp, Rattus norvegicus
ggctgactttgccattgaggcctta

SEQ ID NO: 445145 - DNA, 25 bp, Rattus norvegicus
ggctgactttgcgattgaggcctta

SEQ ID NO: 445146 - DNA, 25 bp, Rattus norvegicus
ggctgagaacgaacggatccgcccc

SEQ ID NO: 445147 - DNA, 25 bp, Rattus norvegicus
ggctgagaacgatcggatccgcccc

SEQ ID NO: 445148 - DNA, 25 bp, Rattus norvegicus
ggctgagaacttccagtcaccttag

SEQ ID NO: 445149 - DNA, 25 bp, Rattus norvegicus
ggctgagaacttgcagtcaccttag

SEQ ID NO: 445150 - DNA, 25 bp, Rattus norvegicus
ggctgagaagctcatcctctggata

SEQ ID NO: 445151 - DNA, 25 bp, Rattus norvegicus
ggctgagaagctgatcctctggata

SEQ ID NO: 445152 - DNA, 25 bp, Rattus norvegicus
ggctgagaatatagcgccggtcttg

SEQ ID NO: 445153 - DNA, 25 bp, Rattus norvegicus
ggctgagaatattgcgccggtcttg

SEQ ID NO: 445154 - DNA, 25 bp, Rattus norvegicus
ggctgagaccacaccagggagttat

SEQ ID NO: 445155 - DNA, 25 bp, Rattus norvegicus
ggctgagaccactccagggagttat

SEQ ID NO: 445156 - DNA, 25 bp, Rattus norvegicus
ggctgagatcagctctgtggcccta

SEQ ID NO: 445157 - DNA, 25 bp, Rattus norvegicus
ggctgagatcaggtctgtggcccta

SEQ ID NO: 445158 - DNA, 25 bp, Rattus norvegicus
ggctgagatctcagactgaccatca

SEQ ID NO: 445159 - DNA, 25 bp, Rattus norvegicus
ggctgagatctctgactgaccatca

SEQ ID NO: 445160 - DNA, 25 bp, Rattus norvegicus
ggctgagatgaaagctgctctatgt

SEQ ID NO: 445161 - DNA, 25 bp, Rattus norvegicus
ggctgagatgaatgctgctctatgt

SEQ ID NO: 445162 - DNA, 25 bp, Rattus norvegicus
ggctgagatggcaacagggctcatt

SEQ ID NO: 445163 - DNA, 25 bp, Rattus norvegicus
ggctgagatggctacagggctcatt

SEQ ID NO: 445164 - DNA, 25 bp, Rattus norvegicus
ggctgagattgtcgcctaaggcccc

SEQ ID NO: 445165 - DNA, 25 bp, Rattus norvegicus
ggctgagattgtggcctaaggcccc

SEQ ID NO: 445166 - DNA, 25 bp, Rattus norvegicus
ggctgagattttagcgggaattttg

SEQ ID NO: 445167 - DNA, 25 bp, Rattus norvegicus
ggctgagatttttgcgggaattttg

SEQ ID NO: 445168 - DNA, 25 bp, Rattus norvegicus
ggctgagcaaccaggtgacgtctta

SEQ ID NO: 445169 - DNA, 25 bp, Rattus norvegicus
ggctgagcaacctggtgacgtctta

SEQ ID NO: 445170 - DNA, 25 bp, Rattus norvegicus
ggctgagcactcagggttcctttaa

SEQ ID NO: 445171 - DNA, 25 bp, Rattus norvegicus
ggctgagcactctgggttcctttaa

SEQ ID NO: 445172 - DNA, 25 bp, Rattus norvegicus
ggctgagcagacaggacatgacatt

SEQ ID NO: 445173 - DNA, 25 bp, Rattus norvegicus
ggctgagcagactggacatgacatt

SEQ ID NO: 445174 - DNA, 25 bp, Rattus norvegicus
ggctgagcagccatctctagacaga

SEQ ID NO: 445175 - DNA, 25 bp, Rattus norvegicus
ggctgagcagccttctctagacaga

SEQ ID NO: 445176 - DNA, 25 bp, Rattus norvegicus
ggctgagccctgattatttatgaga

SEQ ID NO: 445177 - DNA, 25 bp, Rattus norvegicus
ggctgagccctgcaaagaacccgtg

SEQ ID NO: 445178 - DNA, 25 bp, Rattus norvegicus
ggctgagccctggaaagaacccgtg

SEQ ID NO: 445179 - DNA, 25 bp, Rattus norvegicus
ggctgagccctgtttatttatgaga

SEQ ID NO: 445180 - DNA, 25 bp, Rattus norvegicus
ggctgagctcatactgttgtatttt

SEQ ID NO: 445181 - DNA, 25 bp, Rattus norvegicus
ggctgagctcattctgttgtatttt

SEQ ID NO: 445182 - DNA, 25 bp, Rattus norvegicus
ggctgagctctcaatatggatgaaa

SEQ ID NO: 445183 - DNA, 25 bp, Rattus norvegicus
ggctgagctctccacaacaaaaggg

SEQ ID NO: 445184 - DNA, 25 bp, Rattus norvegicus
ggctgagctctcgacaacaaaaggg

SEQ ID NO: 445185 - DNA, 25 bp, Rattus norvegicus
ggctgagctctctatatggatgaaa

SEQ ID NO: 445186 - DNA, 25 bp, Rattus norvegicus
ggctgagctctgaattctggtgaat

SEQ ID NO: 445187 - DNA, 25 bp, Rattus norvegicus
ggctgagctctgtattctggtgaat

SEQ ID NO: 445188 - DNA, 25 bp, Rattus norvegicus
ggctgagctgcaatctaacatgtta

SEQ ID NO: 445189 - DNA, 25 bp, Rattus norvegicus
ggctgagctgcattctaacatgtta

SEQ ID NO: 445190 - DNA, 25 bp, Rattus norvegicus
ggctgagctgctcttagcgcagaca

SEQ ID NO: 445191 - DNA, 25 bp, Rattus norvegicus
ggctgagctgctgttagcgcagaca

SEQ ID NO: 445192 - DNA, 25 bp, Rattus norvegicus
ggctgagcttcaacggaaggcccat

SEQ ID NO: 445193 - DNA, 25 bp, Rattus norvegicus
ggctgagcttcaatacttcagtcta

SEQ ID NO: 445194 - DNA, 25 bp, Rattus norvegicus
ggctgagcttcatcggaaggcccat

SEQ ID NO: 445195 - DNA, 25 bp, Rattus norvegicus
ggctgagcttcattacttcagtcta

SEQ ID NO: 445196 - DNA, 25 bp, Rattus norvegicus
ggctgagcttcccaaatctattcaa

SEQ ID NO: 445197 - DNA, 25 bp, Rattus norvegicus
ggctgagcttccgaaatctattcaa

SEQ ID NO: 445198 - DNA, 25 bp, Rattus norvegicus
ggctgaggcacgaggtagccctctt

SEQ ID NO: 445199 - DNA, 25 bp, Rattus norvegicus
ggctgaggcacgtggtagccctctt

SEQ ID NO: 445200 - DNA, 25 bp, Rattus norvegicus
ggctgaggcactaaacttctgttca

SEQ ID NO: 445201 - DNA, 25 bp, Rattus norvegicus
ggctgaggcacttaacttctgttca

SEQ ID NO: 445202 - DNA, 25 bp, Rattus norvegicus
ggctgaggccagacttcattactgt

SEQ ID NO: 445203 - DNA, 25 bp, Rattus norvegicus
ggctgaggccagtcttcattactgt

SEQ ID NO: 445204 - DNA, 25 bp, Rattus norvegicus
ggctgaggccataccggtcaccgaa

SEQ ID NO: 445205 - DNA, 25 bp, Rattus norvegicus
ggctgaggccatacgaagaacccac

SEQ ID NO: 445206 - DNA, 25 bp, Rattus norvegicus
ggctgaggccattccggtcaccgaa

SEQ ID NO: 445207 - DNA, 25 bp, Rattus norvegicus
ggctgaggccattcgaagaacccac

SEQ ID NO: 445208 - DNA, 25 bp, Rattus norvegicus
ggctgaggctccagacaaaggcagt

SEQ ID NO: 445209 - DNA, 25 bp, Rattus norvegicus
ggctgaggctcctgacaaaggcagt

SEQ ID NO: 445210 - DNA, 25 bp, Rattus norvegicus
ggctgaggctcgacggccttgctct

SEQ ID NO: 445211 - DNA, 25 bp, Rattus norvegicus
ggctgaggctcgtcggccttgctct

SEQ ID NO: 445212 - DNA, 25 bp, Rattus norvegicus
ggctgaggctgtctccggtactatt

SEQ ID NO: 445213 - DNA, 25 bp, Rattus norvegicus
ggctgaggctgtgtccggtactatt

SEQ ID NO: 445214 - DNA, 25 bp, Rattus norvegicus
ggctgagggactcgctctattagaa

SEQ ID NO: 445215 - DNA, 25 bp, Rattus norvegicus
ggctgagggactggctctattagaa

SEQ ID NO: 445216 - DNA, 25 bp, Rattus norvegicus
ggctgagggtctatcctggttcttc

SEQ ID NO: 445217 - DNA, 25 bp, Rattus norvegicus
ggctgagggtctccagtttctgaaa

SEQ ID NO: 445218 - DNA, 25 bp, Rattus norvegicus
ggctgagggtctgcagtttctgaaa

SEQ ID NO: 445219 - DNA, 25 bp, Rattus norvegicus
ggctgagggtctttcctggttcttc

SEQ ID NO: 445220 - DNA, 25 bp, Rattus norvegicus
ggctgagtaggcacctgacacgctg

SEQ ID NO: 445221 - DNA, 25 bp, Rattus norvegicus
ggctgagtaggctcctgacacgctg

SEQ ID NO: 445222 - DNA, 25 bp, Rattus norvegicus
ggctgagtatggaggcacactttaa

SEQ ID NO: 445223 - DNA, 25 bp, Rattus norvegicus
ggctgagtatggtggcacactttaa

SEQ ID NO: 445224 - DNA, 25 bp, Rattus norvegicus
ggctgagtcagtatgctggagctta

SEQ ID NO: 445225 - DNA, 25 bp, Rattus norvegicus
ggctgagtcagtttgctggagctta

SEQ ID NO: 445226 - DNA, 25 bp, Rattus norvegicus
ggctgagtcctaaaccttggttcag

SEQ ID NO: 445227 - DNA, 25 bp, Rattus norvegicus
ggctgagtcctataccttggttcag

SEQ ID NO: 445228 - DNA, 25 bp, Rattus norvegicus
ggctgagtgcctagaggtatacaca

SEQ ID NO: 445229 - DNA, 25 bp, Rattus norvegicus
ggctgagtgccttgaggtatacaca

SEQ ID NO: 445230 - DNA, 25 bp, Rattus norvegicus
ggctgagtggcgctctgcacctact

SEQ ID NO: 445231 - DNA, 25 bp, Rattus norvegicus
ggctgagtggcggtctgcacctact

SEQ ID NO: 445232 - DNA, 25 bp, Rattus norvegicus
ggctgagtggtgctagcttaacctt

SEQ ID NO: 445233 - DNA, 25 bp, Rattus norvegicus
ggctgagtggtggtagcttaacctt

SEQ ID NO: 445234 - DNA, 25 bp, Rattus norvegicus
ggctgagttcagcaccaagttcagt

SEQ ID NO: 445235 - DNA, 25 bp, Rattus norvegicus
ggctgagttcaggaccaagttcagt

SEQ ID NO: 445236 - DNA, 25 bp, Rattus norvegicus
ggctgagtttataaccttgaaccac

SEQ ID NO: 445237 - DNA, 25 bp, Rattus norvegicus
ggctgagtttattaccttgaaccac

SEQ ID NO: 445238 - DNA, 25 bp, Rattus norvegicus
ggctgataagataatcctccccggg

SEQ ID NO: 445239 - DNA, 25 bp, Rattus norvegicus
ggctgataagattatcctccccggg

SEQ ID NO: 445240 - DNA, 25 bp, Rattus norvegicus
ggctgatagaagctagaccccaata

SEQ ID NO: 445241 - DNA, 25 bp, Rattus norvegicus
ggctgatagaaggtagaccccaata

SEQ ID NO: 445242 - DNA, 25 bp, Rattus norvegicus
ggctgatattagatctcacaggtat

SEQ ID NO: 445243 - DNA, 25 bp, Rattus norvegicus
ggctgatattagttctcacaggtat

SEQ ID NO: 445244 - DNA, 25 bp, Rattus norvegicus
ggctgatattttctcatcttggcac

SEQ ID NO: 445245 - DNA, 25 bp, Rattus norvegicus
ggctgatattttgtcatcttggcac

SEQ ID NO: 445246 - DNA, 25 bp, Rattus norvegicus
ggctgatcatcgcagtcatcaatcc

SEQ ID NO: 445247 - DNA, 25 bp, Rattus norvegicus
ggctgatcatcggagtcatcaatcc

SEQ ID NO: 445248 - DNA, 25 bp, Rattus norvegicus
ggctgatcatctcaactccactaat

SEQ ID NO: 445249 - DNA, 25 bp, Rattus norvegicus
ggctgatcatctgaactccactaat

SEQ ID NO: 445250 - DNA, 25 bp, Rattus norvegicus
ggctgatcgaatatcatcctacatg

SEQ ID NO: 445251 - DNA, 25 bp, Rattus norvegicus
ggctgatcgaatttcatcctacatg

SEQ ID NO: 445252 - DNA, 25 bp, Rattus norvegicus
ggctgatcgactataacccatttgg

SEQ ID NO: 445253 - DNA, 25 bp, Rattus norvegicus
ggctgatcgactttaacccatttgg

SEQ ID NO: 445254 - DNA, 25 bp, Rattus norvegicus
ggctgatctggcaaggtcctgagac

SEQ ID NO: 445255 - DNA, 25 bp, Rattus norvegicus
ggctgatctggctaggtcctgagac

SEQ ID NO: 445256 - DNA, 25 bp, Rattus norvegicus
ggctgatctgtcacactagtgttag

SEQ ID NO: 445257 - DNA, 25 bp, Rattus norvegicus
ggctgatctgtctcactagtgttag

SEQ ID NO: 445258 - DNA, 25 bp, Rattus norvegicus
ggctgatgaagtacaccccagcttc

SEQ ID NO: 445259 - DNA, 25 bp, Rattus norvegicus
ggctgatgaagttcaccccagcttc

SEQ ID NO: 445260 - DNA, 25 bp, Rattus norvegicus
ggctgatgacaaatacctctcggat

SEQ ID NO: 445261 - DNA, 25 bp, Rattus norvegicus
ggctgatgacaattacctctcggat

SEQ ID NO: 445262 - DNA, 25 bp, Rattus norvegicus
ggctgatgacctaagttccagatct

SEQ ID NO: 445263 - DNA, 25 bp, Rattus norvegicus
ggctgatgaccttagttccagatct

SEQ ID NO: 445264 - DNA, 25 bp, Rattus norvegicus
ggctgatgagaaccaaaccctgaag

SEQ ID NO: 445265 - DNA, 25 bp, Rattus norvegicus
ggctgatgagaagcaaaccctgaag

SEQ ID NO: 445266 - DNA, 25 bp, Rattus norvegicus
ggctgatgatttataacggctatac

SEQ ID NO: 445267 - DNA, 25 bp, Rattus norvegicus
ggctgatgatttttaacggctatac

SEQ ID NO: 445268 - DNA, 25 bp, Rattus norvegicus
ggctgatgctgaataaatcctggtt

SEQ ID NO: 445269 - DNA, 25 bp, Rattus norvegicus
ggctgatgctgattaaatcctggtt

SEQ ID NO: 445270 - DNA, 25 bp, Rattus norvegicus
ggctgatgctgcctacatttttgag

SEQ ID NO: 445271 - DNA, 25 bp, Rattus norvegicus
ggctgatgctgcgtacatttttgag

SEQ ID NO: 445272 - DNA, 25 bp, Rattus norvegicus
ggctgatggcatcacctgtaatccc

SEQ ID NO: 445273 - DNA, 25 bp, Rattus norvegicus
ggctgatggcatgacctgtaatccc

SEQ ID NO: 445274 - DNA, 25 bp, Rattus norvegicus
ggctgatggtgtattatctcctgta

SEQ ID NO: 445275 - DNA, 25 bp, Rattus norvegicus
ggctgatggtgtcgcatattcttga

SEQ ID NO: 445276 - DNA, 25 bp, Rattus norvegicus
ggctgatggtgtggcatattcttga

SEQ ID NO: 445277 - DNA, 25 bp, Rattus norvegicus
ggctgatggtgttttatctcctgta

SEQ ID NO: 445278 - DNA, 25 bp, Rattus norvegicus
ggctgatgtagcattaacccaaatt

SEQ ID NO: 445279 - DNA, 25 bp, Rattus norvegicus
ggctgatgtagctttaacccaaatt

SEQ ID NO: 445280 - DNA, 25 bp, Rattus norvegicus
ggctgatgtcaaagctcgagacagt

SEQ ID NO: 445281 - DNA, 25 bp, Rattus norvegicus
ggctgatgtcaatgctcgagacagt

SEQ ID NO: 445282 - DNA, 25 bp, Rattus norvegicus
ggctgatgtgctatcgacatctcaa

SEQ ID NO: 445283 - DNA, 25 bp, Rattus norvegicus
ggctgatgtgctttcgacatctcaa

SEQ ID NO: 445284 - DNA, 25 bp, Rattus norvegicus
ggctgattaaccatgtcgactggtc

SEQ ID NO: 445285 - DNA, 25 bp, Rattus norvegicus
ggctgattaaccttgtcgactggtc

SEQ ID NO: 445286 - DNA, 25 bp, Rattus norvegicus
ggctgattacaaagagttccttcta

SEQ ID NO: 445287 - DNA, 25 bp, Rattus norvegicus
ggctgattacaatgagttccttcta

SEQ ID NO: 445288 - DNA, 25 bp, Rattus norvegicus
ggctgattagcaattgtctccattc

SEQ ID NO: 445289 - DNA, 25 bp, Rattus norvegicus
ggctgattagcatttgtctccattc

SEQ ID NO: 445290 - DNA, 25 bp, Rattus norvegicus
ggctgattgaagctcgaccctgacg

SEQ ID NO: 445291 - DNA, 25 bp, Rattus norvegicus
ggctgattgaaggtcgaccctgacg

SEQ ID NO: 445292 - DNA, 25 bp, Rattus norvegicus
ggctgattggcaaagctatccctac

SEQ ID NO: 445293 - DNA, 25 bp, Rattus norvegicus
ggctgattggcatagctatccctac

SEQ ID NO: 445294 - DNA, 25 bp, Rattus norvegicus
ggctgattggctcctcatatgaaca

SEQ ID NO: 445295 - DNA, 25 bp, Rattus norvegicus
ggctgattggctgctcatatgaaca

SEQ ID NO: 445296 - DNA, 25 bp, Rattus norvegicus
ggctgattgtatcatgttacctttt

SEQ ID NO: 445297 - DNA, 25 bp, Rattus norvegicus
ggctgattgtatgatgttacctttt

SEQ ID NO: 445298 - DNA, 25 bp, Rattus norvegicus
ggctgatttctcagctcagtcataa

SEQ ID NO: 445299 - DNA, 25 bp, Rattus norvegicus
ggctgatttctctgctcagtcataa

SEQ ID NO: 445300 - DNA, 25 bp, Rattus norvegicus
ggctgcaaaccaactccttaaaatg

SEQ ID NO: 445301 - DNA, 25 bp, Rattus norvegicus
ggctgcaaaccatctccttaaaatg

SEQ ID NO: 445302 - DNA, 25 bp, Rattus norvegicus
ggctgcaaagcacatcaacatcctt

SEQ ID NO: 445303 - DNA, 25 bp, Rattus norvegicus
ggctgcaaagcagatcaacatcctt

SEQ ID NO: 445304 - DNA, 25 bp, Rattus norvegicus
ggctgcaacatcaacagctggcaat

SEQ ID NO: 445305 - DNA, 25 bp, Rattus norvegicus
ggctgcaacatctacagctggcaat

SEQ ID NO: 445306 - DNA, 25 bp, Rattus norvegicus
ggctgcaaccaaccaaaagacactt

SEQ ID NO: 445307 - DNA, 25 bp, Rattus norvegicus
ggctgcaaccaagcaaaagacactt

SEQ ID NO: 445308 - DNA, 25 bp, Rattus norvegicus
ggctgcaaccccattgtcactagaa

SEQ ID NO: 445309 - DNA, 25 bp, Rattus norvegicus
ggctgcaacccctttgtcactagaa

SEQ ID NO: 445310 - DNA, 25 bp, Rattus norvegicus
ggctgcaagcacctttaaccactga

SEQ ID NO: 445311 - DNA, 25 bp, Rattus norvegicus
ggctgcaagcacgtttaaccactga

SEQ ID NO: 445312 - DNA, 25 bp, Rattus norvegicus
ggctgcaagcccagaagctaaaaaa

SEQ ID NO: 445313 - DNA, 25 bp, Rattus norvegicus
ggctgcaagccctgaagctaaaaaa

SEQ ID NO: 445314 - DNA, 25 bp, Rattus norvegicus
ggctgcaagcttatgagtctgactt

SEQ ID NO: 445315 - DNA, 25 bp, Rattus norvegicus
ggctgcaagcttttgagtctgactt

SEQ ID NO: 445316 - DNA, 25 bp, Rattus norvegicus
ggctgcaatgaaatcaactgctgta

SEQ ID NO: 445317 - DNA, 25 bp, Rattus norvegicus
ggctgcaatgaattcaactgctgta

SEQ ID NO: 445318 - DNA, 25 bp, Rattus norvegicus
ggctgcaatgtgattgcccactggg

SEQ ID NO: 445319 - DNA, 25 bp, Rattus norvegicus
ggctgcaatgtgtttgcccactggg

SEQ ID NO: 445320 - DNA, 25 bp, Rattus norvegicus
ggctgcaattccagctcacattcaa

SEQ ID NO: 445321 - DNA, 25 bp, Rattus norvegicus
ggctgcaattcccttccaaaagaca

SEQ ID NO: 445322 - DNA, 25 bp, Rattus norvegicus
ggctgcaattccgttccaaaagaca

SEQ ID NO: 445323 - DNA, 25 bp, Rattus norvegicus
ggctgcaattcctgctcacattcaa

SEQ ID NO: 445324 - DNA, 25 bp, Rattus norvegicus
ggctgcacaacaaccaactgagtaa

SEQ ID NO: 445325 - DNA, 25 bp, Rattus norvegicus
ggctgcacaacaatatcatctccat

SEQ ID NO: 445326 - DNA, 25 bp, Rattus norvegicus
ggctgcacaacatccaactgagtaa

SEQ ID NO: 445327 - DNA, 25 bp, Rattus norvegicus
ggctgcacaacattatcatctccat

SEQ ID NO: 445328 - DNA, 25 bp, Rattus norvegicus
ggctgcacacagcttattctttggg

SEQ ID NO: 445329 - DNA, 25 bp, Rattus norvegicus
ggctgcacacaggttattctttggg

SEQ ID NO: 445330 - DNA, 25 bp, Rattus norvegicus
ggctgcacagaacacctcagggcag

SEQ ID NO: 445331 - DNA, 25 bp, Rattus norvegicus
ggctgcacagaagacctcagggcag

SEQ ID NO: 445332 - DNA, 25 bp, Rattus norvegicus
ggctgcacaggcctaacagaactga

SEQ ID NO: 445333 - DNA, 25 bp, Rattus norvegicus
ggctgcacaggcgtaacagaactga

SEQ ID NO: 445334 - DNA, 25 bp, Rattus norvegicus
ggctgcacattgagtggtcgtccaa

SEQ ID NO: 445335 - DNA, 25 bp, Rattus norvegicus
ggctgcacattgtgtggtcgtccaa

SEQ ID NO: 445336 - DNA, 25 bp, Rattus norvegicus
ggctgcaccctccagtcttattaat

SEQ ID NO: 445337 - DNA, 25 bp, Rattus norvegicus
ggctgcaccctcgagtcttattaat

SEQ ID NO: 445338 - DNA, 25 bp, Rattus norvegicus
ggctgcacctagatctgagttttca

SEQ ID NO: 445339 - DNA, 25 bp, Rattus norvegicus
ggctgcacctagttctgagttttca

SEQ ID NO: 445340 - DNA, 25 bp, Rattus norvegicus
ggctgcacctggacctcatcaagga

SEQ ID NO: 445341 - DNA, 25 bp, Rattus norvegicus
ggctgcacctggtcctcatcaagga

SEQ ID NO: 445342 - DNA, 25 bp, Rattus norvegicus
ggctgcactcagctcttggactgtg

SEQ ID NO: 445343 - DNA, 25 bp, Rattus norvegicus
ggctgcactcaggtcttggactgtg

SEQ ID NO: 445344 - DNA, 25 bp, Rattus norvegicus
ggctgcactgcactcttatgaggga

SEQ ID NO: 445345 - DNA, 25 bp, Rattus norvegicus
ggctgcactgcagtcttatgaggga

SEQ ID NO: 445346 - DNA, 25 bp, Rattus norvegicus
ggctgcactgcgctggtcacatgaa

SEQ ID NO: 445347 - DNA, 25 bp, Rattus norvegicus
ggctgcactgcggtggtcacatgaa

SEQ ID NO: 445348 - DNA, 25 bp, Rattus norvegicus
ggctgcactggaagggacatctcca

SEQ ID NO: 445349 - DNA, 25 bp, Rattus norvegicus
ggctgcactggatgggacatctcca

SEQ ID NO: 445350 - DNA, 25 bp, Rattus norvegicus
ggctgcactgtgacatcttggacat

SEQ ID NO: 445351 - DNA, 25 bp, Rattus norvegicus
ggctgcactgtgtcatcttggacat

SEQ ID NO: 445352 - DNA, 25 bp, Rattus norvegicus
ggctgcagaacaagaagttccttta

SEQ ID NO: 445353 - DNA, 25 bp, Rattus norvegicus
ggctgcagaacatgaagttccttta

SEQ ID NO: 445354 - DNA, 25 bp, Rattus norvegicus
ggctgcagaaccactgtgtctactg

SEQ ID NO: 445355 - DNA, 25 bp, Rattus norvegicus
ggctgcagaacctctgtgtctactg

SEQ ID NO: 445356 - DNA, 25 bp, Rattus norvegicus
ggctgcagaagtactaccacagtgt

SEQ ID NO: 445357 - DNA, 25 bp, Rattus norvegicus
ggctgcagaagttctaccacagtgt

SEQ ID NO: 445358 - DNA, 25 bp, Rattus norvegicus
ggctgcagaccaagtttggacacta

SEQ ID NO: 445359 - DNA, 25 bp, Rattus norvegicus
ggctgcagaccatgtttggacacta

SEQ ID NO: 445360 - DNA, 25 bp, Rattus norvegicus
ggctgcagactacactaaccagtgg

SEQ ID NO: 445361 - DNA, 25 bp, Rattus norvegicus
ggctgcagactagactaaccagtgg

SEQ ID NO: 445362 - DNA, 25 bp, Rattus norvegicus
ggctgcagagcccttgtccactgct

SEQ ID NO: 445363 - DNA, 25 bp, Rattus norvegicus
ggctgcagagccgttgtccactgct

SEQ ID NO: 445364 - DNA, 25 bp, Rattus norvegicus
ggctgcagatccagggacagacact

SEQ ID NO: 445365 - DNA, 25 bp, Rattus norvegicus
ggctgcagatcctgggacagacact

SEQ ID NO: 445366 - DNA, 25 bp, Rattus norvegicus
ggctgcagatgcatgggcaacacga

SEQ ID NO: 445367 - DNA, 25 bp, Rattus norvegicus
ggctgcagatgcttgggcaacacga

SEQ ID NO: 445368 - DNA, 25 bp, Rattus norvegicus
ggctgcagcagacagtgatcccaat

SEQ ID NO: 445369 - DNA, 25 bp, Rattus norvegicus
ggctgcagcagagagtgatcccaat

SEQ ID NO: 445370 - DNA, 25 bp, Rattus norvegicus
ggctgcagcctgaattcattgataa

SEQ ID NO: 445371 - DNA, 25 bp, Rattus norvegicus
ggctgcagcctgtattcattgataa

SEQ ID NO: 445372 - DNA, 25 bp, Rattus norvegicus
ggctgcagctcccagcatgacaaaa

SEQ ID NO: 445373 - DNA, 25 bp, Rattus norvegicus
ggctgcagctccgagcatgacaaaa

SEQ ID NO: 445374 - DNA, 25 bp, Rattus norvegicus
ggctgcagctttcagaacacttgga

SEQ ID NO: 445375 - DNA, 25 bp, Rattus norvegicus
ggctgcagctttcgaaggactctca

SEQ ID NO: 445376 - DNA, 25 bp, Rattus norvegicus
ggctgcagctttgagaacacttgga

SEQ ID NO: 445377 - DNA, 25 bp, Rattus norvegicus
ggctgcagctttggaaggactctca

SEQ ID NO: 445378 - DNA, 25 bp, Rattus norvegicus
ggctgcagggtcacttttggctcat

SEQ ID NO: 445379 - DNA, 25 bp, Rattus norvegicus
ggctgcagggtctcttttggctcat

SEQ ID NO: 445380 - DNA, 25 bp, Rattus norvegicus
ggctgcaggtacagtgctggcccaa

SEQ ID NO: 445381 - DNA, 25 bp, Rattus norvegicus
ggctgcaggtactgtgctggcccaa

SEQ ID NO: 445382 - DNA, 25 bp, Rattus norvegicus
ggctgcagtacccatgttttatgaa

SEQ ID NO: 445383 - DNA, 25 bp, Rattus norvegicus
ggctgcagtaccgatgttttatgaa

SEQ ID NO: 445384 - DNA, 25 bp, Rattus norvegicus
ggctgcagtattctagatgaagtta

SEQ ID NO: 445385 - DNA, 25 bp, Rattus norvegicus
ggctgcagtattgtagatgaagtta

SEQ ID NO: 445386 - DNA, 25 bp, Rattus norvegicus
ggctgcagtctgcacttctcatagc

SEQ ID NO: 445387 - DNA, 25 bp, Rattus norvegicus
ggctgcagtctggacttctcatagc

SEQ ID NO: 445388 - DNA, 25 bp, Rattus norvegicus
ggctgcagtgcacagacagtgccaa

SEQ ID NO: 445389 - DNA, 25 bp, Rattus norvegicus
ggctgcagtgcagagacagtgccaa

SEQ ID NO: 445390 - DNA, 25 bp, Rattus norvegicus
ggctgcagtgccataccaaatggag

SEQ ID NO: 445391 - DNA, 25 bp, Rattus norvegicus
ggctgcagtgccttaccaaatggag

SEQ ID NO: 445392 - DNA, 25 bp, Rattus norvegicus
ggctgcagtgttaagcttttaacta

SEQ ID NO: 445393 - DNA, 25 bp, Rattus norvegicus
ggctgcagtgtttagcttttaacta

SEQ ID NO: 445394 - DNA, 25 bp, Rattus norvegicus
ggctgcagttaccagtttttcctat

SEQ ID NO: 445395 - DNA, 25 bp, Rattus norvegicus
ggctgcagttacgagtttttcctat

SEQ ID NO: 445396 - DNA, 25 bp, Rattus norvegicus
ggctgcagttgtcagaagtgactca

SEQ ID NO: 445397 - DNA, 25 bp, Rattus norvegicus
ggctgcagttgtgagaagtgactca

SEQ ID NO: 445398 - DNA, 25 bp, Rattus norvegicus
ggctgcataagcaacagtccatgaa

SEQ ID NO: 445399 - DNA, 25 bp, Rattus norvegicus
ggctgcataagctacagtccatgaa

SEQ ID NO: 445400 - DNA, 25 bp, Rattus norvegicus
ggctgcataagtatgaggctacaca

SEQ ID NO: 445401 - DNA, 25 bp, Rattus norvegicus
ggctgcataagtttgaggctacaca

SEQ ID NO: 445402 - DNA, 25 bp, Rattus norvegicus
ggctgcatagcactggaactttcct

SEQ ID NO: 445403 - DNA, 25 bp, Rattus norvegicus
ggctgcatagcagtggaactttcct

SEQ ID NO: 445404 - DNA, 25 bp, Rattus norvegicus
ggctgcatctttataacaactcatt

SEQ ID NO: 445405 - DNA, 25 bp, Rattus norvegicus
ggctgcatctttttaacaactcatt

SEQ ID NO: 445406 - DNA, 25 bp, Rattus norvegicus
ggctgcatgaacaatgtgaccctgg

SEQ ID NO: 445407 - DNA, 25 bp, Rattus norvegicus
ggctgcatgaactatgtgaccctgg

SEQ ID NO: 445408 - DNA, 25 bp, Rattus norvegicus
ggctgcatgacacacattggcttaa

SEQ ID NO: 445409 - DNA, 25 bp, Rattus norvegicus
ggctgcatgacagacattggcttaa

SEQ ID NO: 445410 - DNA, 25 bp, Rattus norvegicus
ggctgcatgataacaggctgcccca

SEQ ID NO: 445411 - DNA, 25 bp, Rattus norvegicus
ggctgcatgatatcaggctgcccca

SEQ ID NO: 445412 - DNA, 25 bp, Rattus norvegicus
ggctgcatgcaacactatggccaat

SEQ ID NO: 445413 - DNA, 25 bp, Rattus norvegicus
ggctgcatgcaagactatggccaat

SEQ ID NO: 445414 - DNA, 25 bp, Rattus norvegicus
ggctgcatgggcaatatgctggtta

SEQ ID NO: 445415 - DNA, 25 bp, Rattus norvegicus
ggctgcatgggctatatgctggtta

SEQ ID NO: 445416 - DNA, 25 bp, Rattus norvegicus
ggctgcatgtacaaattcattagct

SEQ ID NO: 445417 - DNA, 25 bp, Rattus norvegicus
ggctgcatgtactaattcattagct

SEQ ID NO: 445418 - DNA, 25 bp, Rattus norvegicus
ggctgcattaacaatgaccttgtga

SEQ ID NO: 445419 - DNA, 25 bp, Rattus norvegicus
ggctgcattaactatgaccttgtga

SEQ ID NO: 445420 - DNA, 25 bp, Rattus norvegicus
ggctgcattcttcccttactgtata

SEQ ID NO: 445421 - DNA, 25 bp, Rattus norvegicus
ggctgcattcttgccttactgtata

SEQ ID NO: 445422 - DNA, 25 bp, Rattus norvegicus
ggctgcatttcaactctcagaagga

SEQ ID NO: 445423 - DNA, 25 bp, Rattus norvegicus
ggctgcatttcatctctcagaagga

SEQ ID NO: 445424 - DNA, 25 bp, Rattus norvegicus
ggctgcatttgcaactgaatctaca

SEQ ID NO: 445425 - DNA, 25 bp, Rattus norvegicus
ggctgcatttgctactgaatctaca

SEQ ID NO: 445426 - DNA, 25 bp, Rattus norvegicus
ggctgccaaagtcaagtgtatccca

SEQ ID NO: 445427 - DNA, 25 bp, Rattus norvegicus
ggctgccaaagtgaagtgtatccca

SEQ ID NO: 445428 - DNA, 25 bp, Rattus norvegicus
ggctgccaaataaagtgtcccttcc

SEQ ID NO: 445429 - DNA, 25 bp, Rattus norvegicus
ggctgccaaatatagtgtcccttcc

SEQ ID NO: 445430 - DNA, 25 bp, Rattus norvegicus
ggctgccaaggaatgtatgccttct

SEQ ID NO: 445431 - DNA, 25 bp, Rattus norvegicus
ggctgccaaggattgtatgccttct

SEQ ID NO: 445432 - DNA, 25 bp, Rattus norvegicus
ggctgccaaggcaagctaggtctga

SEQ ID NO: 445433 - DNA, 25 bp, Rattus norvegicus
ggctgccaaggctagctaggtctga

SEQ ID NO: 445434 - DNA, 25 bp, Rattus norvegicus
ggctgccacaagcttaactactgct

SEQ ID NO: 445435 - DNA, 25 bp, Rattus norvegicus
ggctgccacaaggttaactactgct

SEQ ID NO: 445436 - DNA, 25 bp, Rattus norvegicus
ggctgccacaggcttgttactgtat

SEQ ID NO: 445437 - DNA, 25 bp, Rattus norvegicus
ggctgccacagggttgttactgtat

SEQ ID NO: 445438 - DNA, 25 bp, Rattus norvegicus
ggctgccacagtacccaggtatttt

SEQ ID NO: 445439 - DNA, 25 bp, Rattus norvegicus
ggctgccacagttcccaggtatttt

SEQ ID NO: 445440 - DNA, 25 bp, Rattus norvegicus
ggctgccagattcggtattttacct

SEQ ID NO: 445441 - DNA, 25 bp, Rattus norvegicus
ggctgccagattgggtattttacct

SEQ ID NO: 445442 - DNA, 25 bp, Rattus norvegicus
ggctgccagctcaggctacgagtcg

SEQ ID NO: 445443 - DNA, 25 bp, Rattus norvegicus
ggctgccagctctggctacgagtcg

SEQ ID NO: 445444 - DNA, 25 bp, Rattus norvegicus
ggctgccaggcaaccaactagggaa

SEQ ID NO: 445445 - DNA, 25 bp, Rattus norvegicus
ggctgccaggcaccattaccaaggg

SEQ ID NO: 445446 - DNA, 25 bp, Rattus norvegicus
ggctgccaggcagcattaccaaggg

SEQ ID NO: 445447 - DNA, 25 bp, Rattus norvegicus
ggctgccaggcatccaactagggaa

SEQ ID NO: 445448 - DNA, 25 bp, Rattus norvegicus
ggctgccagttacactgcgattgta

SEQ ID NO: 445449 - DNA, 25 bp, Rattus norvegicus
ggctgccagttagactgcgattgta

SEQ ID NO: 445450 - DNA, 25 bp, Rattus norvegicus
ggctgccataccaggagagaacact

SEQ ID NO: 445451 - DNA, 25 bp, Rattus norvegicus
ggctgccatacctggagagaacact

SEQ ID NO: 445452 - DNA, 25 bp, Rattus norvegicus
ggctgccatcatccagttcagtttt

SEQ ID NO: 445453 - DNA, 25 bp, Rattus norvegicus
ggctgccatcatgcagttcagtttt

SEQ ID NO: 445454 - DNA, 25 bp, Rattus norvegicus
ggctgccatcgtcgtctatgatatc

SEQ ID NO: 445455 - DNA, 25 bp, Rattus norvegicus
ggctgccatcgtggtctatgatatc

SEQ ID NO: 445456 - DNA, 25 bp, Rattus norvegicus
ggctgccattttagaaatcaagttt

SEQ ID NO: 445457 - DNA, 25 bp, Rattus norvegicus
ggctgccatttttgaaatcaagttt

SEQ ID NO: 445458 - DNA, 25 bp, Rattus norvegicus
ggctgcccaagcagaaacacgtgtc

SEQ ID NO: 445459 - DNA, 25 bp, Rattus norvegicus
ggctgcccaagctgaaacacgtgtc

SEQ ID NO: 445460 - DNA, 25 bp, Rattus norvegicus
ggctgcccacgacaacatggacatt

SEQ ID NO: 445461 - DNA, 25 bp, Rattus norvegicus
ggctgcccacgagaacatggacatt

SEQ ID NO: 445462 - DNA, 25 bp, Rattus norvegicus
ggctgcccagggaatctctgaagac

SEQ ID NO: 445463 - DNA, 25 bp, Rattus norvegicus
ggctgcccagggtatctctgaagac

SEQ ID NO: 445464 - DNA, 25 bp, Rattus norvegicus
ggctgcccatgaacattattccatt

SEQ ID NO: 445465 - DNA, 25 bp, Rattus norvegicus
ggctgcccatgatcattattccatt

SEQ ID NO: 445466 - DNA, 25 bp, Rattus norvegicus
ggctgcccatgcatacagactaaat

SEQ ID NO: 445467 - DNA, 25 bp, Rattus norvegicus
ggctgcccatgcttacagactaaat

SEQ ID NO: 445468 - DNA, 25 bp, Rattus norvegicus
ggctgccccaagagtcctcaaacac

SEQ ID NO: 445469 - DNA, 25 bp, Rattus norvegicus
ggctgccccaagtgtcctcaaacac

SEQ ID NO: 445470 - DNA, 25 bp, Rattus norvegicus
ggctgccccgaacaggatgtatgtt

SEQ ID NO: 445471 - DNA, 25 bp, Rattus norvegicus
ggctgccccgaagaggatgtatgtt

SEQ ID NO: 445472 - DNA, 25 bp, Rattus norvegicus
ggctgcccgtgtacgctgggaatct

SEQ ID NO: 445473 - DNA, 25 bp, Rattus norvegicus
ggctgcccgtgttcgctgggaatct

SEQ ID NO: 445474 - DNA, 25 bp, Rattus norvegicus
ggctgccctgctaaaacatggactt

SEQ ID NO: 445475 - DNA, 25 bp, Rattus norvegicus
ggctgccctgcttaaacatggactt

SEQ ID NO: 445476 - DNA, 25 bp, Rattus norvegicus
ggctgccctggaactttgaattcat

SEQ ID NO: 445477 - DNA, 25 bp, Rattus norvegicus
ggctgccctggatctttgaattcat

SEQ ID NO: 445478 - DNA, 25 bp, Rattus norvegicus
ggctgccctgggaggactcaagtca

SEQ ID NO: 445479 - DNA, 25 bp, Rattus norvegicus
ggctgccctgggtggactcaagtca

SEQ ID NO: 445480 - DNA, 25 bp, Rattus norvegicus
ggctgccctggtctactgtgtaaag

SEQ ID NO: 445481 - DNA, 25 bp, Rattus norvegicus
ggctgccctggtgtactgtgtaaag

SEQ ID NO: 445482 - DNA, 25 bp, Rattus norvegicus
ggctgcccttccagaaaagttagtt

SEQ ID NO: 445483 - DNA, 25 bp, Rattus norvegicus
ggctgcccttcctgaaaagttagtt

SEQ ID NO: 445484 - DNA, 25 bp, Rattus norvegicus
ggctgccgaaaaagggctcgtcaat

SEQ ID NO: 445485 - DNA, 25 bp, Rattus norvegicus
ggctgccgaaaatgggctcgtcaat

SEQ ID NO: 445486 - DNA, 25 bp, Rattus norvegicus
ggctgccgacaacgataactgcttc

SEQ ID NO: 445487 - DNA, 25 bp, Rattus norvegicus
ggctgccgacaaggataactgcttc

SEQ ID NO: 445488 - DNA, 25 bp, Rattus norvegicus
ggctgccgttcacgatcataggatc

SEQ ID NO: 445489 - DNA, 25 bp, Rattus norvegicus
ggctgccgttcaggatcataggatc

SEQ ID NO: 445490 - DNA, 25 bp, Rattus norvegicus
ggctgcctaaccagtacatacctga

SEQ ID NO: 445491 - DNA, 25 bp, Rattus norvegicus
ggctgcctaacctgtacatacctga

SEQ ID NO: 445492 - DNA, 25 bp, Rattus norvegicus
ggctgcctacaactcctcatgggag

SEQ ID NO: 445493 - DNA, 25 bp, Rattus norvegicus
ggctgcctacaagtcctcatgggag

SEQ ID NO: 445494 - DNA, 25 bp, Rattus norvegicus
ggctgcctacttcctagtgctggca

SEQ ID NO: 445495 - DNA, 25 bp, Rattus norvegicus
ggctgcctacttgctagtgctggca

SEQ ID NO: 445496 - DNA, 25 bp, Rattus norvegicus
ggctgcctagagatcttacactgtg

SEQ ID NO: 445497 - DNA, 25 bp, Rattus norvegicus
ggctgcctagagttcttacactgtg

SEQ ID NO: 445498 - DNA, 25 bp, Rattus norvegicus
ggctgcctagcacgtgggccacact

SEQ ID NO: 445499 - DNA, 25 bp, Rattus norvegicus
ggctgcctagcaggtgggccacact

SEQ ID NO: 445500 - DNA, 25 bp, Rattus norvegicus
ggctgcctaggcagtactcagtttt

SEQ ID NO: 445501 - DNA, 25 bp, Rattus norvegicus
ggctgcctaggctgtactcagtttt

SEQ ID NO: 445502 - DNA, 25 bp, Rattus norvegicus
ggctgcctcagaaggcctgggataa

SEQ ID NO: 445503 - DNA, 25 bp, Rattus norvegicus
ggctgcctcagatggcctgggataa

SEQ ID NO: 445504 - DNA, 25 bp, Rattus norvegicus
ggctgcctctgacaataacctacta

SEQ ID NO: 445505 - DNA, 25 bp, Rattus norvegicus
ggctgcctctgagaataacctacta

SEQ ID NO: 445506 - DNA, 25 bp, Rattus norvegicus
ggctgcctgaccatggagtgctaca

SEQ ID NO: 445507 - DNA, 25 bp, Rattus norvegicus
ggctgcctgaccttggagtgctaca

SEQ ID NO: 445508 - DNA, 25 bp, Rattus norvegicus
ggctgcctgccaagtgtccgggcaa

SEQ ID NO: 445509 - DNA, 25 bp, Rattus norvegicus
ggctgcctgccatgtgtccgggcaa

SEQ ID NO: 445510 - DNA, 25 bp, Rattus norvegicus
ggctgcctgcctatttagtaatggt

SEQ ID NO: 445511 - DNA, 25 bp, Rattus norvegicus
ggctgcctgcctttttagtaatggt

SEQ ID NO: 445512 - DNA, 25 bp, Rattus norvegicus
ggctgcctggaacaggtgataccct

SEQ ID NO: 445513 - DNA, 25 bp, Rattus norvegicus
ggctgcctggaagaggtgataccct

SEQ ID NO: 445514 - DNA, 25 bp, Rattus norvegicus
ggctgcctggagattactttaatga

SEQ ID NO: 445515 - DNA, 25 bp, Rattus norvegicus
ggctgcctggagtttactttaatga

SEQ ID NO: 445516 - DNA, 25 bp, Rattus norvegicus
ggctgcctgtgaatttatccataac

SEQ ID NO: 445517 - DNA, 25 bp, Rattus norvegicus
ggctgcctgtgattttatccataac

SEQ ID NO: 445518 - DNA, 25 bp, Rattus norvegicus
ggctgcctgttaacaagtatctctg

SEQ ID NO: 445519 - DNA, 25 bp, Rattus norvegicus
ggctgcctgttatcaagtatctctg

SEQ ID NO: 445520 - DNA, 25 bp, Rattus norvegicus
ggctgccttagactctgtcaatgca

SEQ ID NO: 445521 - DNA, 25 bp, Rattus norvegicus
ggctgccttagagtctgtcaatgca

SEQ ID NO: 445522 - DNA, 25 bp, Rattus norvegicus
ggctgccttaggcaaacaccaagtg

SEQ ID NO: 445523 - DNA, 25 bp, Rattus norvegicus
ggctgccttagggaaacaccaagtg

SEQ ID NO: 445524 - DNA, 25 bp, Rattus norvegicus
ggctgccttcagcagatcgcaggaa

SEQ ID NO: 445525 - DNA, 25 bp, Rattus norvegicus
ggctgccttcaggagatcgcaggaa

SEQ ID NO: 445526 - DNA, 25 bp, Rattus norvegicus
ggctgccttctcatgtgacaaagtg

SEQ ID NO: 445527 - DNA, 25 bp, Rattus norvegicus
ggctgccttctcttgtgacaaagtg

SEQ ID NO: 445528 - DNA, 25 bp, Rattus norvegicus
ggctgccttgctcatgaaatcttgg

SEQ ID NO: 445529 - DNA, 25 bp, Rattus norvegicus
ggctgccttgctgatgaaatcttgg

SEQ ID NO: 445530 - DNA, 25 bp, Rattus norvegicus
ggctgccttttaatttgctgaatct

SEQ ID NO: 445531 - DNA, 25 bp, Rattus norvegicus
ggctgccttttattttgctgaatct

SEQ ID NO: 445532 - DNA, 25 bp, Rattus norvegicus
ggctgcctttttaatttcccatagt

SEQ ID NO: 445533 - DNA, 25 bp, Rattus norvegicus
ggctgccttttttatttcccatagt

SEQ ID NO: 445534 - DNA, 25 bp, Rattus norvegicus
ggctgcgacaaaactggtggctcta

SEQ ID NO: 445535 - DNA, 25 bp, Rattus norvegicus
ggctgcgacaaatctggtggctcta

SEQ ID NO: 445536 - DNA, 25 bp, Rattus norvegicus
ggctgcgacatgcactgaccttgat

SEQ ID NO: 445537 - DNA, 25 bp, Rattus norvegicus
ggctgcgacatggactgaccttgat

SEQ ID NO: 445538 - DNA, 25 bp, Rattus norvegicus
ggctgcgacgcactggcttacagaa

SEQ ID NO: 445539 - DNA, 25 bp, Rattus norvegicus
ggctgcgacgcagtggcttacagaa

SEQ ID NO: 445540 - DNA, 25 bp, Rattus norvegicus
ggctgcgactccagaatggctcttc

SEQ ID NO: 445541 - DNA, 25 bp, Rattus norvegicus
ggctgcgactcctgaatggctcttc

SEQ ID NO: 445542 - DNA, 25 bp, Rattus norvegicus
ggctgcgagctaccattttgtaaat

SEQ ID NO: 445543 - DNA, 25 bp, Rattus norvegicus
ggctgcgagctagcattttgtaaat

SEQ ID NO: 445544 - DNA, 25 bp, Rattus norvegicus
ggctgcgatttgatttatgcttact

SEQ ID NO: 445545 - DNA, 25 bp, Rattus norvegicus
ggctgcgatttgttttatgcttact

SEQ ID NO: 445546 - DNA, 25 bp, Rattus norvegicus
ggctgcgcaaccaggtgtgtccaga

SEQ ID NO: 445547 - DNA, 25 bp, Rattus norvegicus
ggctgcgcaacctggtgtgtccaga

SEQ ID NO: 445548 - DNA, 25 bp, Rattus norvegicus
ggctgcgcactgagaatctgtaggc

SEQ ID NO: 445549 - DNA, 25 bp, Rattus norvegicus
ggctgcgcactgtgaatctgtaggc

SEQ ID NO: 445550 - DNA, 25 bp, Rattus norvegicus
ggctgcgccgcccaatttattttac

SEQ ID NO: 445551 - DNA, 25 bp, Rattus norvegicus
ggctgcgccgccgaatttattttac

SEQ ID NO: 445552 - DNA, 25 bp, Rattus norvegicus
ggctgcgcgccgaggacgggttcga

SEQ ID NO: 445553 - DNA, 25 bp, Rattus norvegicus
ggctgcgcgccgtggacgggttcga

SEQ ID NO: 445554 - DNA, 25 bp, Rattus norvegicus
ggctgcgctatgattcccgaagtgg

SEQ ID NO: 445555 - DNA, 25 bp, Rattus norvegicus
ggctgcgctatgtttcccgaagtgg

SEQ ID NO: 445556 - DNA, 25 bp, Rattus norvegicus
ggctgcggaacacttctttgagtac

SEQ ID NO: 445557 - DNA, 25 bp, Rattus norvegicus
ggctgcggaacagttctttgagtac

SEQ ID NO: 445558 - DNA, 25 bp, Rattus norvegicus
ggctgcggactaaagtctgatgcaa

SEQ ID NO: 445559 - DNA, 25 bp, Rattus norvegicus
ggctgcggactatagtctgatgcaa

SEQ ID NO: 445560 - DNA, 25 bp, Rattus norvegicus
ggctgcggattcaccagccctggac

SEQ ID NO: 445561 - DNA, 25 bp, Rattus norvegicus
ggctgcggattctccagccctggac

SEQ ID NO: 445562 - DNA, 25 bp, Rattus norvegicus
ggctgcggatttccttctgaatgtc

SEQ ID NO: 445563 - DNA, 25 bp, Rattus norvegicus
ggctgcggatttgcttctgaatgtc

SEQ ID NO: 445564 - DNA, 25 bp, Rattus norvegicus
ggctgcggcctgaccagagactgat

SEQ ID NO: 445565 - DNA, 25 bp, Rattus norvegicus
ggctgcggcctgtccagagactgat

SEQ ID NO: 445566 - DNA, 25 bp, Rattus norvegicus
ggctgcggcgtcacaggaggttttg

SEQ ID NO: 445567 - DNA, 25 bp, Rattus norvegicus
ggctgcggcgtctcaggaggttttg

SEQ ID NO: 445568 - DNA, 25 bp, Rattus norvegicus
ggctgcggctgtactggagtctcct

SEQ ID NO: 445569 - DNA, 25 bp, Rattus norvegicus
ggctgcggctgttctggagtctcct

SEQ ID NO: 445570 - DNA, 25 bp, Rattus norvegicus
ggctgcgggacaccggcgcccagaa

SEQ ID NO: 445571 - DNA, 25 bp, Rattus norvegicus
ggctgcgggacagcggcgcccagaa

SEQ ID NO: 445572 - DNA, 25 bp, Rattus norvegicus
ggctgcggtaataaaatgtgctcac

SEQ ID NO: 445573 - DNA, 25 bp, Rattus norvegicus
ggctgcggtaattaaatgtgctcac

SEQ ID NO: 445574 - DNA, 25 bp, Rattus norvegicus
ggctgcggttctagctaaggacatg

SEQ ID NO: 445575 - DNA, 25 bp, Rattus norvegicus
ggctgcggttcttgctaaggacatg

SEQ ID NO: 445576 - DNA, 25 bp, Rattus norvegicus
ggctgcggtttaaactgagttatgt

SEQ ID NO: 445577 - DNA, 25 bp, Rattus norvegicus
ggctgcggtttaaagggctgtactt

SEQ ID NO: 445578 - DNA, 25 bp, Rattus norvegicus
ggctgcggtttatactgagttatgt

SEQ ID NO: 445579 - DNA, 25 bp, Rattus norvegicus
ggctgcggtttatagggctgtactt

SEQ ID NO: 445580 - DNA, 25 bp, Rattus norvegicus
ggctgcggttttataagcgaagtga

SEQ ID NO: 445581 - DNA, 25 bp, Rattus norvegicus
ggctgcggttttttaagcgaagtga

SEQ ID NO: 445582 - DNA, 25 bp, Rattus norvegicus
ggctgcgtaggtatcaagtgtctaa

SEQ ID NO: 445583 - DNA, 25 bp, Rattus norvegicus
ggctgcgtaggtttcaagtgtctaa

SEQ ID NO: 445584 - DNA, 25 bp, Rattus norvegicus
ggctgcgtccaaacttttctaaaat

SEQ ID NO: 445585 - DNA, 25 bp, Rattus norvegicus
ggctgcgtccaatcttttctaaaat

SEQ ID NO: 445586 - DNA, 25 bp, Rattus norvegicus
ggctgcgttctcatcagtgtgtgtg

SEQ ID NO: 445587 - DNA, 25 bp, Rattus norvegicus
ggctgcgttctcttcagtgtgtgtg

SEQ ID NO: 445588 - DNA, 25 bp, Rattus norvegicus
ggctgctaatgacgcccatcttggg

SEQ ID NO: 445589 - DNA, 25 bp, Rattus norvegicus
ggctgctaatgaggcccatcttggg

SEQ ID NO: 445590 - DNA, 25 bp, Rattus norvegicus
ggctgctagccactttgaagcttgt

SEQ ID NO: 445591 - DNA, 25 bp, Rattus norvegicus
ggctgctagccagtttgaagcttgt

SEQ ID NO: 445592 - DNA, 25 bp, Rattus norvegicus
ggctgctaggaactgcgtcatcgac

SEQ ID NO: 445593 - DNA, 25 bp, Rattus norvegicus
ggctgctaggaagtgcgtcatcgac

SEQ ID NO: 445594 - DNA, 25 bp, Rattus norvegicus
ggctgctagtacaggccctgctggt

SEQ ID NO: 445595 - DNA, 25 bp, Rattus norvegicus
ggctgctagtactggccctgctggt

SEQ ID NO: 445596 - DNA, 25 bp, Rattus norvegicus
ggctgctagtctacaagatcgtact

SEQ ID NO: 445597 - DNA, 25 bp, Rattus norvegicus
ggctgctagtcttcaagatcgtact

SEQ ID NO: 445598 - DNA, 25 bp, Rattus norvegicus
ggctgctagttaactatccccagat

SEQ ID NO: 445599 - DNA, 25 bp, Rattus norvegicus
ggctgctagttatctatccccagat

SEQ ID NO: 445600 - DNA, 25 bp, Rattus norvegicus
ggctgctataaaaatcttcctcgac

SEQ ID NO: 445601 - DNA, 25 bp, Rattus norvegicus
ggctgctataaatatcttcctcgac

SEQ ID NO: 445602 - DNA, 25 bp, Rattus norvegicus
ggctgctcaagacctgtgaactatc

SEQ ID NO: 445603 - DNA, 25 bp, Rattus norvegicus
ggctgctcaagagctgtgaactatc

SEQ ID NO: 445604 - DNA, 25 bp, Rattus norvegicus
ggctgctcacagctaacagacagga

SEQ ID NO: 445605 - DNA, 25 bp, Rattus norvegicus
ggctgctcacaggtaacagacagga

SEQ ID NO: 445606 - DNA, 25 bp, Rattus norvegicus
ggctgctcaccgctgttagtgtaaa

SEQ ID NO: 445607 - DNA, 25 bp, Rattus norvegicus
ggctgctcaccggtgttagtgtaaa

SEQ ID NO: 445608 - DNA, 25 bp, Rattus norvegicus
ggctgctcataaccatttaactctg

SEQ ID NO: 445609 - DNA, 25 bp, Rattus norvegicus
ggctgctcataagcatttaactctg

SEQ ID NO: 445610 - DNA, 25 bp, Rattus norvegicus
ggctgctccaatccccgggttttgt

SEQ ID NO: 445611 - DNA, 25 bp, Rattus norvegicus
ggctgctccaatgcccgggttttgt

SEQ ID NO: 445612 - DNA, 25 bp, Rattus norvegicus
ggctgctcctgtaaaggacccacat

SEQ ID NO: 445613 - DNA, 25 bp, Rattus norvegicus
ggctgctcctgttaaggacccacat

SEQ ID NO: 445614 - DNA, 25 bp, Rattus norvegicus
ggctgctcctttagagtttctgaga

SEQ ID NO: 445615 - DNA, 25 bp, Rattus norvegicus
ggctgctccttttgagtttctgaga

SEQ ID NO: 445616 - DNA, 25 bp, Rattus norvegicus
ggctgctcgaaacatcctggtctct

SEQ ID NO: 445617 - DNA, 25 bp, Rattus norvegicus
ggctgctcgaaagatcctggtctct

SEQ ID NO: 445618 - DNA, 25 bp, Rattus norvegicus
ggctgctcgaatcaggctggcacta

SEQ ID NO: 445619 - DNA, 25 bp, Rattus norvegicus
ggctgctcgaatgaggctggcacta

SEQ ID NO: 445620 - DNA, 25 bp, Rattus norvegicus
ggctgctcgagtcagtttccctcgc

SEQ ID NO: 445621 - DNA, 25 bp, Rattus norvegicus
ggctgctcgagtgagtttccctcgc

SEQ ID NO: 445622 - DNA, 25 bp, Rattus norvegicus
ggctgctctgcaagtggtcaagtag

SEQ ID NO: 445623 - DNA, 25 bp, Rattus norvegicus
ggctgctctgcatgtggtcaagtag

SEQ ID NO: 445624 - DNA, 25 bp, Rattus norvegicus
ggctgctctgctccggctgcgaatg

SEQ ID NO: 445625 - DNA, 25 bp, Rattus norvegicus
ggctgctctgctgcggctgcgaatg

SEQ ID NO: 445626 - DNA, 25 bp, Rattus norvegicus
ggctgctcttgtcccaacagtagga

SEQ ID NO: 445627 - DNA, 25 bp, Rattus norvegicus
ggctgctcttgtgccaacagtagga

SEQ ID NO: 445628 - DNA, 25 bp, Rattus norvegicus
ggctgctgacagcacctgaagactc

SEQ ID NO: 445629 - DNA, 25 bp, Rattus norvegicus
ggctgctgacaggacctgaagactc

SEQ ID NO: 445630 - DNA, 25 bp, Rattus norvegicus
ggctgctgcacaagcctttgaaagc

SEQ ID NO: 445631 - DNA, 25 bp, Rattus norvegicus
ggctgctgcacatgcctttgaaagc

SEQ ID NO: 445632 - DNA, 25 bp, Rattus norvegicus
ggctgctgctacaccgtaaagaaaa

SEQ ID NO: 445633 - DNA, 25 bp, Rattus norvegicus
ggctgctgctactccgtaaagaaaa

SEQ ID NO: 445634 - DNA, 25 bp, Rattus norvegicus
ggctgctgcttaacaggtcgcagga

SEQ ID NO: 445635 - DNA, 25 bp, Rattus norvegicus
ggctgctgcttatcaggtcgcagga

SEQ ID NO: 445636 - DNA, 25 bp, Rattus norvegicus
ggctgctgcttgagaccaggcagaa

SEQ ID NO: 445637 - DNA, 25 bp, Rattus norvegicus
ggctgctgcttgtgaccaggcagaa

SEQ ID NO: 445638 - DNA, 25 bp, Rattus norvegicus
ggctgctggcagcaaacgcttacat

SEQ ID NO: 445639 - DNA, 25 bp, Rattus norvegicus
ggctgctggcaggaaacgcttacat

SEQ ID NO: 445640 - DNA, 25 bp, Rattus norvegicus
ggctgctggcatatgtcattgaaca

SEQ ID NO: 445641 - DNA, 25 bp, Rattus norvegicus
ggctgctggcatttgtcattgaaca

SEQ ID NO: 445642 - DNA, 25 bp, Rattus norvegicus
ggctgctggcctagctggcagtaac

SEQ ID NO: 445643 - DNA, 25 bp, Rattus norvegicus
ggctgctggccttgctggcagtaac

SEQ ID NO: 445644 - DNA, 25 bp, Rattus norvegicus
ggctgctgggcaactagtgcatctt

SEQ ID NO: 445645 - DNA, 25 bp, Rattus norvegicus
ggctgctgggcatctagtgcatctt

SEQ ID NO: 445646 - DNA, 25 bp, Rattus norvegicus
ggctgctgggtcaatgtataccacc

SEQ ID NO: 445647 - DNA, 25 bp, Rattus norvegicus
ggctgctgggtctatgtataccacc

SEQ ID NO: 445648 - DNA, 25 bp, Rattus norvegicus
ggctgctgggttcaaaagtgtcact

SEQ ID NO: 445649 - DNA, 25 bp, Rattus norvegicus
ggctgctgggttgaaaagtgtcact

SEQ ID NO: 445650 - DNA, 25 bp, Rattus norvegicus
ggctgctgtagtcgtggtggtggat

SEQ ID NO: 445651 - DNA, 25 bp, Rattus norvegicus
ggctgctgtagtggtggtggtggat

SEQ ID NO: 445652 - DNA, 25 bp, Rattus norvegicus
ggctgctgtcagctgtcaataaaca

SEQ ID NO: 445653 - DNA, 25 bp, Rattus norvegicus
ggctgctgtcaggtgtcaataaaca

SEQ ID NO: 445654 - DNA, 25 bp, Rattus norvegicus
ggctgctgtgagaacccattctgga

SEQ ID NO: 445655 - DNA, 25 bp, Rattus norvegicus
ggctgctgtgagtacccattctgga

SEQ ID NO: 445656 - DNA, 25 bp, Rattus norvegicus
ggctgctgtgatattctgaaaggag

SEQ ID NO: 445657 - DNA, 25 bp, Rattus norvegicus
ggctgctgtgattttctgaaaggag

SEQ ID NO: 445658 - DNA, 25 bp, Rattus norvegicus
ggctgctgtgcactaattactcatc

SEQ ID NO: 445659 - DNA, 25 bp, Rattus norvegicus
ggctgctgtgcagtaattactcatc

SEQ ID NO: 445660 - DNA, 25 bp, Rattus norvegicus
ggctgctgtgccaacatagtgctaa

SEQ ID NO: 445661 - DNA, 25 bp, Rattus norvegicus
ggctgctgtgcctacatagtgctaa

SEQ ID NO: 445662 - DNA, 25 bp, Rattus norvegicus
ggctgcttaacacaagttctgatca

SEQ ID NO: 445663 - DNA, 25 bp, Rattus norvegicus
ggctgcttaacagaagttctgatca

SEQ ID NO: 445664 - DNA, 25 bp, Rattus norvegicus
ggctgcttaagccttagctgtgtag

SEQ ID NO: 445665 - DNA, 25 bp, Rattus norvegicus
ggctgcttaagcgttagctgtgtag

SEQ ID NO: 445666 - DNA, 25 bp, Rattus norvegicus
ggctgcttagcaattgaccttgacc

SEQ ID NO: 445667 - DNA, 25 bp, Rattus norvegicus
ggctgcttagcatttgaccttgacc

SEQ ID NO: 445668 - DNA, 25 bp, Rattus norvegicus
ggctgcttagccacgatcatgatgg

SEQ ID NO: 445669 - DNA, 25 bp, Rattus norvegicus
ggctgcttagcctcgatcatgatgg

SEQ ID NO: 445670 - DNA, 25 bp, Rattus norvegicus
ggctgcttaggactgactcattgta

SEQ ID NO: 445671 - DNA, 25 bp, Rattus norvegicus
ggctgcttaggagtgactcattgta

SEQ ID NO: 445672 - DNA, 25 bp, Rattus norvegicus
ggctgcttcacaactggttgttaga

SEQ ID NO: 445673 - DNA, 25 bp, Rattus norvegicus
ggctgcttcacaatctaaaacttca

SEQ ID NO: 445674 - DNA, 25 bp, Rattus norvegicus
ggctgcttcacatctggttgttaga

SEQ ID NO: 445675 - DNA, 25 bp, Rattus norvegicus
ggctgcttcacattctaaaacttca

SEQ ID NO: 445676 - DNA, 25 bp, Rattus norvegicus
ggctgcttccacacagaggagacag

SEQ ID NO: 445677 - DNA, 25 bp, Rattus norvegicus
ggctgcttccactcagaggagacag

SEQ ID NO: 445678 - DNA, 25 bp, Rattus norvegicus
ggctgcttccatagtggccgcttct

SEQ ID NO: 445679 - DNA, 25 bp, Rattus norvegicus
ggctgcttccattgtggccgcttct

SEQ ID NO: 445680 - DNA, 25 bp, Rattus norvegicus
ggctgcttcctaaaacgactattga

SEQ ID NO: 445681 - DNA, 25 bp, Rattus norvegicus
ggctgcttcctataacgactattga

SEQ ID NO: 445682 - DNA, 25 bp, Rattus norvegicus
ggctgcttcgtaaatcagcaactac

SEQ ID NO: 445683 - DNA, 25 bp, Rattus norvegicus
ggctgcttcgtatatcagcaactac

SEQ ID NO: 445684 - DNA, 25 bp, Rattus norvegicus
ggctgcttctaccaagtaatccatt

SEQ ID NO: 445685 - DNA, 25 bp, Rattus norvegicus
ggctgcttctacgaagtaatccatt

SEQ ID NO: 445686 - DNA, 25 bp, Rattus norvegicus
ggctgcttctcccaacaaagagata

SEQ ID NO: 445687 - DNA, 25 bp, Rattus norvegicus
ggctgcttctccgaacaaagagata

SEQ ID NO: 445688 - DNA, 25 bp, Rattus norvegicus
ggctgcttctgtacagtttgtggaa

SEQ ID NO: 445689 - DNA, 25 bp, Rattus norvegicus
ggctgcttctgttcagtttgtggaa

SEQ ID NO: 445690 - DNA, 25 bp, Rattus norvegicus
ggctgcttgcttccttgagcgctgt

SEQ ID NO: 445691 - DNA, 25 bp, Rattus norvegicus
ggctgcttgcttgcttgagcgctgt

SEQ ID NO: 445692 - DNA, 25 bp, Rattus norvegicus
ggctgcttggctactttaatgtcca

SEQ ID NO: 445693 - DNA, 25 bp, Rattus norvegicus
ggctgcttggcttctttaatgtcca

SEQ ID NO: 445694 - DNA, 25 bp, Rattus norvegicus
ggctgcttgtcacccagaacacaaa

SEQ ID NO: 445695 - DNA, 25 bp, Rattus norvegicus
ggctgcttgtcagccagaacacaaa

SEQ ID NO: 445696 - DNA, 25 bp, Rattus norvegicus
ggctgctttactatcttagttgatg

SEQ ID NO: 445697 - DNA, 25 bp, Rattus norvegicus
ggctgctttactttcttagttgatg

SEQ ID NO: 445698 - DNA, 25 bp, Rattus norvegicus
ggctgctttcagattggttttctga

SEQ ID NO: 445699 - DNA, 25 bp, Rattus norvegicus
ggctgctttcagtttggttttctga

SEQ ID NO: 445700 - DNA, 25 bp, Rattus norvegicus
ggctgctttcttcagagtctttaca

SEQ ID NO: 445701 - DNA, 25 bp, Rattus norvegicus
ggctgctttcttgagagtctttaca

SEQ ID NO: 445702 - DNA, 25 bp, Rattus norvegicus
ggctgctttgacaccttctgaataa

SEQ ID NO: 445703 - DNA, 25 bp, Rattus norvegicus
ggctgctttgactccttctgaataa

SEQ ID NO: 445704 - DNA, 25 bp, Rattus norvegicus
ggctgctttgagctttgtgaataaa

SEQ ID NO: 445705 - DNA, 25 bp, Rattus norvegicus
ggctgctttgaggtttgtgaataaa

SEQ ID NO: 445706 - DNA, 25 bp, Rattus norvegicus
ggctgctttgggaacagtccccata

SEQ ID NO: 445707 - DNA, 25 bp, Rattus norvegicus
ggctgctttgggtacagtccccata

SEQ ID NO: 445708 - DNA, 25 bp, Rattus norvegicus
ggctgctttgtgacatttgcaacat

SEQ ID NO: 445709 - DNA, 25 bp, Rattus norvegicus
ggctgctttgtgtcatttgcaacat

SEQ ID NO: 445710 - DNA, 25 bp, Rattus norvegicus
ggctgcttttgtatcaactgcaggc

SEQ ID NO: 445711 - DNA, 25 bp, Rattus norvegicus
ggctgcttttgtttcaactgcaggc

SEQ ID NO: 445712 - DNA, 25 bp, Rattus norvegicus
ggctggaacataaccgtacacatta

SEQ ID NO: 445713 - DNA, 25 bp, Rattus norvegicus
ggctggaacatatccgtacacatta

SEQ ID NO: 445714 - DNA, 25 bp, Rattus norvegicus
ggctggaacattatagatgctgcta

SEQ ID NO: 445715 - DNA, 25 bp, Rattus norvegicus
ggctggaacattttagatgctgcta

SEQ ID NO: 445716 - DNA, 25 bp, Rattus norvegicus
ggctggaactgacgcgccgcacaat

SEQ ID NO: 445717 - DNA, 25 bp, Rattus norvegicus
ggctggaactgaggcgccgcacaat

SEQ ID NO: 445718 - DNA, 25 bp, Rattus norvegicus
ggctggaacttcagacatgggaact

SEQ ID NO: 445719 - DNA, 25 bp, Rattus norvegicus
ggctggaacttctgacatgggaact

SEQ ID NO: 445720 - DNA, 25 bp, Rattus norvegicus
ggctggaagattctgtgtcatgcat

SEQ ID NO: 445721 - DNA, 25 bp, Rattus norvegicus
ggctggaagattgtgtgtcatgcat

SEQ ID NO: 445722 - DNA, 25 bp, Rattus norvegicus
ggctggaagctgcagaatctctgtt

SEQ ID NO: 445723 - DNA, 25 bp, Rattus norvegicus
ggctggaagctggagaatctctgtt

SEQ ID NO: 445724 - DNA, 25 bp, Rattus norvegicus
ggctggaagcttcgctgccccacaa

SEQ ID NO: 445725 - DNA, 25 bp, Rattus norvegicus
ggctggaagcttggctgccccacaa

SEQ ID NO: 445726 - DNA, 25 bp, Rattus norvegicus
ggctggaatatacacatgactttat

SEQ ID NO: 445727 - DNA, 25 bp, Rattus norvegicus
ggctggaatatagacatgactttat

SEQ ID NO: 445728 - DNA, 25 bp, Rattus norvegicus
ggctggaatcaaaatatttgcccaa

SEQ ID NO: 445729 - DNA, 25 bp, Rattus norvegicus
ggctggaatcaatatatttgcccaa

SEQ ID NO: 445730 - DNA, 25 bp, Rattus norvegicus
ggctggaatcagatttgactcattg

SEQ ID NO: 445731 - DNA, 25 bp, Rattus norvegicus
ggctggaatcagttttgactcattg

SEQ ID NO: 445732 - DNA, 25 bp, Rattus norvegicus
ggctggaattacaacctctgatcac

SEQ ID NO: 445733 - DNA, 25 bp, Rattus norvegicus
ggctggaattactacctctgatcac

SEQ ID NO: 445734 - DNA, 25 bp, Rattus norvegicus
ggctggacaatcacattggcatctt

SEQ ID NO: 445735 - DNA, 25 bp, Rattus norvegicus
ggctggacaatctcattggcatctt

SEQ ID NO: 445736 - DNA, 25 bp, Rattus norvegicus
ggctggacactaatactatacggca

SEQ ID NO: 445737 - DNA, 25 bp, Rattus norvegicus
ggctggacactattactatacggca

SEQ ID NO: 445738 - DNA, 25 bp, Rattus norvegicus
ggctggacagagctcctggaaacat

SEQ ID NO: 445739 - DNA, 25 bp, Rattus norvegicus
ggctggacagaggtcctggaaacat

SEQ ID NO: 445740 - DNA, 25 bp, Rattus norvegicus
ggctggacagccaagaaggaagaaa

SEQ ID NO: 445741 - DNA, 25 bp, Rattus norvegicus
ggctggacagcctagaaggaagaaa

SEQ ID NO: 445742 - DNA, 25 bp, Rattus norvegicus
ggctggacagcgactctttaatcat

SEQ ID NO: 445743 - DNA, 25 bp, Rattus norvegicus
ggctggacagcgtctctttaatcat

SEQ ID NO: 445744 - DNA, 25 bp, Rattus norvegicus
ggctggacaggaagcactacactct

SEQ ID NO: 445745 - DNA, 25 bp, Rattus norvegicus
ggctggacaggatgcactacactct

SEQ ID NO: 445746 - DNA, 25 bp, Rattus norvegicus
ggctggacaggcataaaacaagaat

SEQ ID NO: 445747 - DNA, 25 bp, Rattus norvegicus
ggctggacaggcttaaaacaagaat

SEQ ID NO: 445748 - DNA, 25 bp, Rattus norvegicus
ggctggacagtgatctattaactca

SEQ ID NO: 445749 - DNA, 25 bp, Rattus norvegicus
ggctggacagtgttctattaactca

SEQ ID NO: 445750 - DNA, 25 bp, Rattus norvegicus
ggctggacccagaaagtctcagggt

SEQ ID NO: 445751 - DNA, 25 bp, Rattus norvegicus
ggctggacccagtaagtctcagggt

SEQ ID NO: 445752 - DNA, 25 bp, Rattus norvegicus
ggctggacgaaccactttagcagtt

SEQ ID NO: 445753 - DNA, 25 bp, Rattus norvegicus
ggctggacgaacgactttagcagtt

SEQ ID NO: 445754 - DNA, 25 bp, Rattus norvegicus
ggctggacgaccactgggaagatat

SEQ ID NO: 445755 - DNA, 25 bp, Rattus norvegicus
ggctggacgacctctgggaagatat

SEQ ID NO: 445756 - DNA, 25 bp, Rattus norvegicus
ggctggagaaaccatcaccgacggt

SEQ ID NO: 445757 - DNA, 25 bp, Rattus norvegicus
ggctggagaaacgatcaccgacggt

SEQ ID NO: 445758 - DNA, 25 bp, Rattus norvegicus
ggctggagaatcatgactctttcta

SEQ ID NO: 445759 - DNA, 25 bp, Rattus norvegicus
ggctggagaatcttgactctttcta

SEQ ID NO: 445760 - DNA, 25 bp, Rattus norvegicus
ggctggagacagatgttcttcacca

SEQ ID NO: 445761 - DNA, 25 bp, Rattus norvegicus
ggctggagacagttgttcttcacca

SEQ ID NO: 445762 - DNA, 25 bp, Rattus norvegicus
ggctggagcccgaggcgagcaggct

SEQ ID NO: 445763 - DNA, 25 bp, Rattus norvegicus
ggctggagcccgtggcgagcaggct

SEQ ID NO: 445764 - DNA, 25 bp, Rattus norvegicus
ggctggagccctcgtccgggccggg

SEQ ID NO: 445765 - DNA, 25 bp, Rattus norvegicus
ggctggagccctggtccgggccggg

SEQ ID NO: 445766 - DNA, 25 bp, Rattus norvegicus
ggctggagctccagtgaagaccatt

SEQ ID NO: 445767 - DNA, 25 bp, Rattus norvegicus
ggctggagctcctgtgaagaccatt

SEQ ID NO: 445768 - DNA, 25 bp, Rattus norvegicus
ggctggaggaaaacagctccttttt

SEQ ID NO: 445769 - DNA, 25 bp, Rattus norvegicus
ggctggaggaaatcagctccttttt

SEQ ID NO: 445770 - DNA, 25 bp, Rattus norvegicus
ggctggaggactaccctgcatgccg

SEQ ID NO: 445771 - DNA, 25 bp, Rattus norvegicus
ggctggaggacttccctgcatgccg

SEQ ID NO: 445772 - DNA, 25 bp, Rattus norvegicus
ggctggaggctcatctgcgaagtaa

SEQ ID NO: 445773 - DNA, 25 bp, Rattus norvegicus
ggctggaggctcttctgcgaagtaa

SEQ ID NO: 445774 - DNA, 25 bp, Rattus norvegicus
ggctggaggtccctggacaacaagg

SEQ ID NO: 445775 - DNA, 25 bp, Rattus norvegicus
ggctggaggtccgtggacaacaagg

SEQ ID NO: 445776 - DNA, 25 bp, Rattus norvegicus
ggctggagtcctagtatgttgaacc

SEQ ID NO: 445777 - DNA, 25 bp, Rattus norvegicus
ggctggagtcctatacaagtttcta

SEQ ID NO: 445778 - DNA, 25 bp, Rattus norvegicus
ggctggagtccttgtatgttgaacc

SEQ ID NO: 445779 - DNA, 25 bp, Rattus norvegicus
ggctggagtcctttacaagtttcta

SEQ ID NO: 445780 - DNA, 25 bp, Rattus norvegicus
ggctggagtctccaaaacctgtgga

SEQ ID NO: 445781 - DNA, 25 bp, Rattus norvegicus
ggctggagtctcgaaaacctgtgga

SEQ ID NO: 445782 - DNA, 25 bp, Rattus norvegicus
ggctggagttaaactctctattgta

SEQ ID NO: 445783 - DNA, 25 bp, Rattus norvegicus
ggctggagttaatctctctattgta

SEQ ID NO: 445784 - DNA, 25 bp, Rattus norvegicus
ggctggagttttctgattgccccac

SEQ ID NO: 445785 - DNA, 25 bp, Rattus norvegicus
ggctggagttttgtgattgccccac

SEQ ID NO: 445786 - DNA, 25 bp, Rattus norvegicus
ggctggatacctagcatggcaacaa

SEQ ID NO: 445787 - DNA, 25 bp, Rattus norvegicus
ggctggataccttgcatggcaacaa

SEQ ID NO: 445788 - DNA, 25 bp, Rattus norvegicus
ggctggatatcccaagaatcagaga

SEQ ID NO: 445789 - DNA, 25 bp, Rattus norvegicus
ggctggatatccgaagaatcagaga

SEQ ID NO: 445790 - DNA, 25 bp, Rattus norvegicus
ggctggatatttcgtcctgcaatca

SEQ ID NO: 445791 - DNA, 25 bp, Rattus norvegicus
ggctggatatttggtcctgcaatca

SEQ ID NO: 445792 - DNA, 25 bp, Rattus norvegicus
ggctggatcactcgagcaggtctcc

SEQ ID NO: 445793 - DNA, 25 bp, Rattus norvegicus
ggctggatcactggagcaggtctcc

SEQ ID NO: 445794 - DNA, 25 bp, Rattus norvegicus
ggctggatcaggcacttcagatttg

SEQ ID NO: 445795 - DNA, 25 bp, Rattus norvegicus
ggctggatcagggacttcagatttg

SEQ ID NO: 445796 - DNA, 25 bp, Rattus norvegicus
ggctggatctatcagggcatccaat

SEQ ID NO: 445797 - DNA, 25 bp, Rattus norvegicus
ggctggatctatgagggcatccaat

SEQ ID NO: 445798 - DNA, 25 bp, Rattus norvegicus
ggctggatggttatcttactcccta

SEQ ID NO: 445799 - DNA, 25 bp, Rattus norvegicus
ggctggatggttttcttactcccta

SEQ ID NO: 445800 - DNA, 25 bp, Rattus norvegicus
ggctggattaaacccggcctaggca

SEQ ID NO: 445801 - DNA, 25 bp, Rattus norvegicus
ggctggattaaagccggcctaggca

SEQ ID NO: 445802 - DNA, 25 bp, Rattus norvegicus
ggctggattcacaggcaggctgcca

SEQ ID NO: 445803 - DNA, 25 bp, Rattus norvegicus
ggctggattcactggcaggctgcca

SEQ ID NO: 445804 - DNA, 25 bp, Rattus norvegicus
ggctggattgatatgtgtcgcccca

SEQ ID NO: 445805 - DNA, 25 bp, Rattus norvegicus
ggctggattgatttgtgtcgcccca

SEQ ID NO: 445806 - DNA, 25 bp, Rattus norvegicus
ggctggatttcactcgtttggagca

SEQ ID NO: 445807 - DNA, 25 bp, Rattus norvegicus
ggctggatttcagtcgtttggagca

SEQ ID NO: 445808 - DNA, 25 bp, Rattus norvegicus
ggctggatttggatatggcttgcca

SEQ ID NO: 445809 - DNA, 25 bp, Rattus norvegicus
ggctggatttggttatggcttgcca

SEQ ID NO: 445810 - DNA, 25 bp, Rattus norvegicus
ggctggcaatgaatgggcacttcac

SEQ ID NO: 445811 - DNA, 25 bp, Rattus norvegicus
ggctggcaatgattgggcacttcac

SEQ ID NO: 445812 - DNA, 25 bp, Rattus norvegicus
ggctggcaatgcagttattttcctc

SEQ ID NO: 445813 - DNA, 25 bp, Rattus norvegicus
ggctggcaatgctgttattttcctc

SEQ ID NO: 445814 - DNA, 25 bp, Rattus norvegicus
ggctggcacaccagtgtacttggcg

SEQ ID NO: 445815 - DNA, 25 bp, Rattus norvegicus
ggctggcacacctgtgtacttggcg

SEQ ID NO: 445816 - DNA, 25 bp, Rattus norvegicus
ggctggcacagcacggttgaacaac

SEQ ID NO: 445817 - DNA, 25 bp, Rattus norvegicus
ggctggcacagcagaacccggatct

SEQ ID NO: 445818 - DNA, 25 bp, Rattus norvegicus
ggctggcacagctcggttgaacaac

SEQ ID NO: 445819 - DNA, 25 bp, Rattus norvegicus
ggctggcacagctgaacccggatct

SEQ ID NO: 445820 - DNA, 25 bp, Rattus norvegicus
ggctggcaccatcctgtaatcacat

SEQ ID NO: 445821 - DNA, 25 bp, Rattus norvegicus
ggctggcaccatgctgtaatcacat

SEQ ID NO: 445822 - DNA, 25 bp, Rattus norvegicus
ggctggcacccactgaggaagacca

SEQ ID NO: 445823 - DNA, 25 bp, Rattus norvegicus
ggctggcacccagtgaggaagacca

SEQ ID NO: 445824 - DNA, 25 bp, Rattus norvegicus
ggctggcactagctgtggttttaat

SEQ ID NO: 445825 - DNA, 25 bp, Rattus norvegicus
ggctggcactaggtgtggttttaat

SEQ ID NO: 445826 - DNA, 25 bp, Rattus norvegicus
ggctggcactatacaattctcccga

SEQ ID NO: 445827 - DNA, 25 bp, Rattus norvegicus
ggctggcactattcaattctcccga

SEQ ID NO: 445828 - DNA, 25 bp, Rattus norvegicus
ggctggcagcagatcttcgagaagc

SEQ ID NO: 445829 - DNA, 25 bp, Rattus norvegicus
ggctggcagcagttcttcgagaagc

SEQ ID NO: 445830 - DNA, 25 bp, Rattus norvegicus
ggctggcagctgaaccagcttggta

SEQ ID NO: 445831 - DNA, 25 bp, Rattus norvegicus
ggctggcagctgtaccagcttggta

SEQ ID NO: 445832 - DNA, 25 bp, Rattus norvegicus
ggctggcatcaaattcacagatgtc

SEQ ID NO: 445833 - DNA, 25 bp, Rattus norvegicus
ggctggcatcaatttcacagatgtc

SEQ ID NO: 445834 - DNA, 25 bp, Rattus norvegicus
ggctggcatccaatggtggtcattt

SEQ ID NO: 445835 - DNA, 25 bp, Rattus norvegicus
ggctggcatccattggtggtcattt

SEQ ID NO: 445836 - DNA, 25 bp, Rattus norvegicus
ggctggcatgtcaatcacttgttta

SEQ ID NO: 445837 - DNA, 25 bp, Rattus norvegicus
ggctggcatgtctatcacttgttta

SEQ ID NO: 445838 - DNA, 25 bp, Rattus norvegicus
ggctggcatgttcaactgcataatg

SEQ ID NO: 445839 - DNA, 25 bp, Rattus norvegicus
ggctggcatgttgaactgcataatg

SEQ ID NO: 445840 - DNA, 25 bp, Rattus norvegicus
ggctggcattaaactttcaatcctc

SEQ ID NO: 445841 - DNA, 25 bp, Rattus norvegicus
ggctggcattaatctttcaatcctc

SEQ ID NO: 445842 - DNA, 25 bp, Rattus norvegicus
ggctggccaagcatagtactgactg

SEQ ID NO: 445843 - DNA, 25 bp, Rattus norvegicus
ggctggccaagcttagtactgactg

SEQ ID NO: 445844 - DNA, 25 bp, Rattus norvegicus
ggctggccaccaatgcaggagctgc

SEQ ID NO: 445845 - DNA, 25 bp, Rattus norvegicus
ggctggccaccattgcaggagctgc

SEQ ID NO: 445846 - DNA, 25 bp, Rattus norvegicus
ggctggccagttactcatgcatgca

SEQ ID NO: 445847 - DNA, 25 bp, Rattus norvegicus
ggctggccagtttctcatgcatgca

SEQ ID NO: 445848 - DNA, 25 bp, Rattus norvegicus
ggctggccccacagaagtcagaact

SEQ ID NO: 445849 - DNA, 25 bp, Rattus norvegicus
ggctggccccactgaagtcagaact

SEQ ID NO: 445850 - DNA, 25 bp, Rattus norvegicus
ggctggccctgcaaagaaggttcag

SEQ ID NO: 445851 - DNA, 25 bp, Rattus norvegicus
ggctggccctgctaagaaggttcag

SEQ ID NO: 445852 - DNA, 25 bp, Rattus norvegicus
ggctggcctacacgtccggaagaat

SEQ ID NO: 445853 - DNA, 25 bp, Rattus norvegicus
ggctggcctacaggtccggaagaat

SEQ ID NO: 445854 - DNA, 25 bp, Rattus norvegicus
ggctggcctatgatttcagggctca

SEQ ID NO: 445855 - DNA, 25 bp, Rattus norvegicus
ggctggcctatgttttcagggctca

SEQ ID NO: 445856 - DNA, 25 bp, Rattus norvegicus
ggctggcctcaaactaagtacaatg

SEQ ID NO: 445857 - DNA, 25 bp, Rattus norvegicus
ggctggcctcaacacgatgctggaa

SEQ ID NO: 445858 - DNA, 25 bp, Rattus norvegicus
ggctggcctcaagacgatgctggaa

SEQ ID NO: 445859 - DNA, 25 bp, Rattus norvegicus
ggctggcctcaatctaagtacaatg

SEQ ID NO: 445860 - DNA, 25 bp, Rattus norvegicus
ggctggcctcagaattggtgtcaat

SEQ ID NO: 445861 - DNA, 25 bp, Rattus norvegicus
ggctggcctcagtattggtgtcaat

SEQ ID NO: 445862 - DNA, 25 bp, Rattus norvegicus
ggctggcctggactaaataaaatct

SEQ ID NO: 445863 - DNA, 25 bp, Rattus norvegicus
ggctggcctggagtaaataaaatct

SEQ ID NO: 445864 - DNA, 25 bp, Rattus norvegicus
ggctggcctgtacccaatggatcaa

SEQ ID NO: 445865 - DNA, 25 bp, Rattus norvegicus
ggctggcctgtagccaatggatcaa

SEQ ID NO: 445866 - DNA, 25 bp, Rattus norvegicus
ggctggccttaaactatctgaacga

SEQ ID NO: 445867 - DNA, 25 bp, Rattus norvegicus
ggctggccttaatctatctgaacga

SEQ ID NO: 445868 - DNA, 25 bp, Rattus norvegicus
ggctggccttgaccttagtggctta

SEQ ID NO: 445869 - DNA, 25 bp, Rattus norvegicus
ggctggccttgagcttagtggctta

SEQ ID NO: 445870 - DNA, 25 bp, Rattus norvegicus
ggctggcctttaaactcagtggctg

SEQ ID NO: 445871 - DNA, 25 bp, Rattus norvegicus
ggctggcctttatactcagtggctg

SEQ ID NO: 445872 - DNA, 25 bp, Rattus norvegicus
ggctggcgagcaatgatgaactcat

SEQ ID NO: 445873 - DNA, 25 bp, Rattus norvegicus
ggctggcgagcattgatgaactcat

SEQ ID NO: 445874 - DNA, 25 bp, Rattus norvegicus
ggctggctaccaacatgtgttgttg

SEQ ID NO: 445875 - DNA, 25 bp, Rattus norvegicus
ggctggctaccatcatgtgttgttg

SEQ ID NO: 445876 - DNA, 25 bp, Rattus norvegicus
ggctggctactgaactggagtgttc

SEQ ID NO: 445877 - DNA, 25 bp, Rattus norvegicus
ggctggctactgtactggagtgttc

SEQ ID NO: 445878 - DNA, 25 bp, Rattus norvegicus
ggctggctagctcgcttgagattac

SEQ ID NO: 445879 - DNA, 25 bp, Rattus norvegicus
ggctggctagctggcttgagattac

SEQ ID NO: 445880 - DNA, 25 bp, Rattus norvegicus
ggctggctcaaacctgctatataca

SEQ ID NO: 445881 - DNA, 25 bp, Rattus norvegicus
ggctggctcaaagctgctatataca

SEQ ID NO: 445882 - DNA, 25 bp, Rattus norvegicus
ggctggctcactctactgggaactc

SEQ ID NO: 445883 - DNA, 25 bp, Rattus norvegicus
ggctggctcactgtactgggaactc

SEQ ID NO: 445884 - DNA, 25 bp, Rattus norvegicus
ggctggctcagaactcctgagttca

SEQ ID NO: 445885 - DNA, 25 bp, Rattus norvegicus
ggctggctcagatctcctgagttca

SEQ ID NO: 445886 - DNA, 25 bp, Rattus norvegicus
ggctggctctggcatcattctctaa

SEQ ID NO: 445887 - DNA, 25 bp, Rattus norvegicus
ggctggctctgggatcattctctaa

SEQ ID NO: 445888 - DNA, 25 bp, Rattus norvegicus
ggctggctcttgcttcatatttaat

SEQ ID NO: 445889 - DNA, 25 bp, Rattus norvegicus
ggctggctcttggttcatatttaat

SEQ ID NO: 445890 - DNA, 25 bp, Rattus norvegicus
ggctggctgaacacctggtgaagat

SEQ ID NO: 445891 - DNA, 25 bp, Rattus norvegicus
ggctggctgaactcctggtgaagat

SEQ ID NO: 445892 - DNA, 25 bp, Rattus norvegicus
ggctggctgaatattcctttgttca

SEQ ID NO: 445893 - DNA, 25 bp, Rattus norvegicus
ggctggctgaattttcctttgttca

SEQ ID NO: 445894 - DNA, 25 bp, Rattus norvegicus
ggctggctgactattctgcagatga

SEQ ID NO: 445895 - DNA, 25 bp, Rattus norvegicus
ggctggctgacttttctgcagatga

SEQ ID NO: 445896 - DNA, 25 bp, Rattus norvegicus
ggctggctgaggaggcaggagtaca

SEQ ID NO: 445897 - DNA, 25 bp, Rattus norvegicus
ggctggctgaggtggcaggagtaca

SEQ ID NO: 445898 - DNA, 25 bp, Rattus norvegicus
ggctggctgcatattaaaccttaaa

SEQ ID NO: 445899 - DNA, 25 bp, Rattus norvegicus
ggctggctgcattttaaaccttaaa

SEQ ID NO: 445900 - DNA, 25 bp, Rattus norvegicus
ggctggctgtgtaccaggcccttga

SEQ ID NO: 445901 - DNA, 25 bp, Rattus norvegicus
ggctggctgtgttccaggcccttga

SEQ ID NO: 445902 - DNA, 25 bp, Rattus norvegicus
ggctggctgtttcaatctgtcagtg

SEQ ID NO: 445903 - DNA, 25 bp, Rattus norvegicus
ggctggctgtttgaatctgtcagtg

SEQ ID NO: 445904 - DNA, 25 bp, Rattus norvegicus
ggctggcttaaaatgaccctcctct

SEQ ID NO: 445905 - DNA, 25 bp, Rattus norvegicus
ggctggcttaaattgaccctcctct

SEQ ID NO: 445906 - DNA, 25 bp, Rattus norvegicus
ggctggcttcaaacagacagtcttc

SEQ ID NO: 445907 - DNA, 25 bp, Rattus norvegicus
ggctggcttcaaactatgtggacta

SEQ ID NO: 445908 - DNA, 25 bp, Rattus norvegicus
ggctggcttcaaagtcagaggtcaa

SEQ ID NO: 445909 - DNA, 25 bp, Rattus norvegicus
ggctggcttcaatcagacagtcttc

SEQ ID NO: 445910 - DNA, 25 bp, Rattus norvegicus
ggctggcttcaatctatgtggacta

SEQ ID NO: 445911 - DNA, 25 bp, Rattus norvegicus
ggctggcttcaatgtcagaggtcaa

SEQ ID NO: 445912 - DNA, 25 bp, Rattus norvegicus
ggctggcttctgaagaatccctgat

SEQ ID NO: 445913 - DNA, 25 bp, Rattus norvegicus
ggctggcttctgtagaatccctgat

SEQ ID NO: 445914 - DNA, 25 bp, Rattus norvegicus
ggctggctttcaactcacaaggctg

SEQ ID NO: 445915 - DNA, 25 bp, Rattus norvegicus
ggctggctttcatctcacaaggctg

SEQ ID NO: 445916 - DNA, 25 bp, Rattus norvegicus
ggctggcttttcagcatggtatctg

SEQ ID NO: 445917 - DNA, 25 bp, Rattus norvegicus
ggctggcttttctgcatggtatctg

SEQ ID NO: 445918 - DNA, 25 bp, Rattus norvegicus
ggctgggaaaacattgtacagtgga

SEQ ID NO: 445919 - DNA, 25 bp, Rattus norvegicus
ggctgggaaaactttgtacagtgga

SEQ ID NO: 445920 - DNA, 25 bp, Rattus norvegicus
ggctgggaaacacgtctccttagga

SEQ ID NO: 445921 - DNA, 25 bp, Rattus norvegicus
ggctgggaaacaggtctccttagga

SEQ ID NO: 445922 - DNA, 25 bp, Rattus norvegicus
ggctgggaaatcaggctgcatattt

SEQ ID NO: 445923 - DNA, 25 bp, Rattus norvegicus
ggctgggaaatctggctgcatattt

SEQ ID NO: 445924 - DNA, 25 bp, Rattus norvegicus
ggctgggaaattaggcttctactgt

SEQ ID NO: 445925 - DNA, 25 bp, Rattus norvegicus
ggctgggaaatttggcttctactgt

SEQ ID NO: 445926 - DNA, 25 bp, Rattus norvegicus
ggctgggaagccagtttagtcaata

SEQ ID NO: 445927 - DNA, 25 bp, Rattus norvegicus
ggctgggaagcctgtttagtcaata

SEQ ID NO: 445928 - DNA, 25 bp, Rattus norvegicus
ggctgggaagttcttcctggaatct

SEQ ID NO: 445929 - DNA, 25 bp, Rattus norvegicus
ggctgggaagttgttcctggaatct

SEQ ID NO: 445930 - DNA, 25 bp, Rattus norvegicus
ggctgggacactcgtagatatacct

SEQ ID NO: 445931 - DNA, 25 bp, Rattus norvegicus
ggctgggacactggtagatatacct

SEQ ID NO: 445932 - DNA, 25 bp, Rattus norvegicus
ggctgggacagcaagctccactgcc

SEQ ID NO: 445933 - DNA, 25 bp, Rattus norvegicus
ggctgggacagctagctccactgcc

SEQ ID NO: 445934 - DNA, 25 bp, Rattus norvegicus
ggctgggacattcaagtatgctgta

SEQ ID NO: 445935 - DNA, 25 bp, Rattus norvegicus
ggctgggacattgaagtatgctgta

SEQ ID NO: 445936 - DNA, 25 bp, Rattus norvegicus
ggctgggacccaactataccaagga

SEQ ID NO: 445937 - DNA, 25 bp, Rattus norvegicus
ggctgggacccatctataccaagga

SEQ ID NO: 445938 - DNA, 25 bp, Rattus norvegicus
ggctgggaccgcaggatcgtacacc

SEQ ID NO: 445939 - DNA, 25 bp, Rattus norvegicus
ggctgggaccgctggatcgtacacc

SEQ ID NO: 445940 - DNA, 25 bp, Rattus norvegicus
ggctgggagcagatcgattttacct

SEQ ID NO: 445941 - DNA, 25 bp, Rattus norvegicus
ggctgggagcagttcgattttacct

SEQ ID NO: 445942 - DNA, 25 bp, Rattus norvegicus
ggctgggagcctctcgtgcttactc

SEQ ID NO: 445943 - DNA, 25 bp, Rattus norvegicus
ggctgggagcctgtcgtgcttactc

SEQ ID NO: 445944 - DNA, 25 bp, Rattus norvegicus
ggctgggatcccagtagactaattg

SEQ ID NO: 445945 - DNA, 25 bp, Rattus norvegicus
ggctgggatccctgtagactaattg

SEQ ID NO: 445946 - DNA, 25 bp, Rattus norvegicus
ggctgggatttccatatcactgagg

SEQ ID NO: 445947 - DNA, 25 bp, Rattus norvegicus
ggctgggatttcgatatcactgagg

SEQ ID NO: 445948 - DNA, 25 bp, Rattus norvegicus
ggctgggcagcaaatatacgtcggt

SEQ ID NO: 445949 - DNA, 25 bp, Rattus norvegicus
ggctgggcagcatatatacgtcggt

SEQ ID NO: 445950 - DNA, 25 bp, Rattus norvegicus
ggctgggcagctcaaggtcatcatt

SEQ ID NO: 445951 - DNA, 25 bp, Rattus norvegicus
ggctgggcagctgaaggtcatcatt

SEQ ID NO: 445952 - DNA, 25 bp, Rattus norvegicus
ggctgggcaggcaaaaagctttcct

SEQ ID NO: 445953 - DNA, 25 bp, Rattus norvegicus
ggctgggcaggctaaaagctttcct

SEQ ID NO: 445954 - DNA, 25 bp, Rattus norvegicus
ggctgggcatatcacttactgggta

SEQ ID NO: 445955 - DNA, 25 bp, Rattus norvegicus
ggctgggcatatgacttactgggta

SEQ ID NO: 445956 - DNA, 25 bp, Rattus norvegicus
ggctgggcatgcacacaggacctgt

SEQ ID NO: 445957 - DNA, 25 bp, Rattus norvegicus
ggctgggcatgctcacaggacctgt

SEQ ID NO: 445958 - DNA, 25 bp, Rattus norvegicus
ggctgggcccttcgctggactccta

SEQ ID NO: 445959 - DNA, 25 bp, Rattus norvegicus
ggctgggcccttggctggactccta

SEQ ID NO: 445960 - DNA, 25 bp, Rattus norvegicus
ggctgggtacacagtctggatgtaa

SEQ ID NO: 445961 - DNA, 25 bp, Rattus norvegicus
ggctgggtacactgtctggatgtaa

SEQ ID NO: 445962 - DNA, 25 bp, Rattus norvegicus
ggctgggtatctctggcagcactaa

SEQ ID NO: 445963 - DNA, 25 bp, Rattus norvegicus
ggctgggtatctgtggcagcactaa

SEQ ID NO: 445964 - DNA, 25 bp, Rattus norvegicus
ggctgggtatgacagctcttccacc

SEQ ID NO: 445965 - DNA, 25 bp, Rattus norvegicus
ggctgggtatgagagctcttccacc

SEQ ID NO: 445966 - DNA, 25 bp, Rattus norvegicus
ggctgggtatggcactctttgtcac

SEQ ID NO: 445967 - DNA, 25 bp, Rattus norvegicus
ggctgggtatgggactctttgtcac

SEQ ID NO: 445968 - DNA, 25 bp, Rattus norvegicus
ggctgggtcctcactgaaattgaca

SEQ ID NO: 445969 - DNA, 25 bp, Rattus norvegicus
ggctgggtcctctctgaaattgaca

SEQ ID NO: 445970 - DNA, 25 bp, Rattus norvegicus
ggctgggtcttgcaaattagactta

SEQ ID NO: 445971 - DNA, 25 bp, Rattus norvegicus
ggctgggtcttggaaattagactta

SEQ ID NO: 445972 - DNA, 25 bp, Rattus norvegicus
ggctgggtgcagatgaaccacgatt

SEQ ID NO: 445973 - DNA, 25 bp, Rattus norvegicus
ggctgggtgcagttgaaccacgatt

SEQ ID NO: 445974 - DNA, 25 bp, Rattus norvegicus
ggctgggtggccatttatgtcagta

SEQ ID NO: 445975 - DNA, 25 bp, Rattus norvegicus
ggctgggtggccttttatgtcagta

SEQ ID NO: 445976 - DNA, 25 bp, Rattus norvegicus
ggctgggtgttcagagttctcagta

SEQ ID NO: 445977 - DNA, 25 bp, Rattus norvegicus
ggctgggtgttctgagttctcagta

SEQ ID NO: 445978 - DNA, 25 bp, Rattus norvegicus
ggctggtaaccaagataaagtctgt

SEQ ID NO: 445979 - DNA, 25 bp, Rattus norvegicus
ggctggtaaccatgataaagtctgt

SEQ ID NO: 445980 - DNA, 25 bp, Rattus norvegicus
ggctggtagccacattgcatatggt

SEQ ID NO: 445981 - DNA, 25 bp, Rattus norvegicus
ggctggtagccagattgcatatggt

SEQ ID NO: 445982 - DNA, 25 bp, Rattus norvegicus
ggctggtagtcaaggcttctataac

SEQ ID NO: 445983 - DNA, 25 bp, Rattus norvegicus
ggctggtagtcatggcttctataac

SEQ ID NO: 445984 - DNA, 25 bp, Rattus norvegicus
ggctggtatgtgacagttcgtccta

SEQ ID NO: 445985 - DNA, 25 bp, Rattus norvegicus
ggctggtatgtgtcagttcgtccta

SEQ ID NO: 445986 - DNA, 25 bp, Rattus norvegicus
ggctggtcaagcattctttgtattt

SEQ ID NO: 445987 - DNA, 25 bp, Rattus norvegicus
ggctggtcaagctttctttgtattt

SEQ ID NO: 445988 - DNA, 25 bp, Rattus norvegicus
ggctggtcaagtcttatttaactgg

SEQ ID NO: 445989 - DNA, 25 bp, Rattus norvegicus
ggctggtcaagtgttatttaactgg

SEQ ID NO: 445990 - DNA, 25 bp, Rattus norvegicus
ggctggtcagccaatatgtgatctt

SEQ ID NO: 445991 - DNA, 25 bp, Rattus norvegicus
ggctggtcagcctatatgtgatctt

SEQ ID NO: 445992 - DNA, 25 bp, Rattus norvegicus
ggctggtcatataaactcagacctg

SEQ ID NO: 445993 - DNA, 25 bp, Rattus norvegicus
ggctggtcatattaactcagacctg

SEQ ID NO: 445994 - DNA, 25 bp, Rattus norvegicus
ggctggtcatccagggtcctaagaa

SEQ ID NO: 445995 - DNA, 25 bp, Rattus norvegicus
ggctggtcatcctgggtcctaagaa

SEQ ID NO: 445996 - DNA, 25 bp, Rattus norvegicus
ggctggtcccaaatagaatgctaac

SEQ ID NO: 445997 - DNA, 25 bp, Rattus norvegicus
ggctggtcccaattagaatgctaac

SEQ ID NO: 445998 - DNA, 25 bp, Rattus norvegicus
ggctggtccctgcaaaagactgctt

SEQ ID NO: 445999 - DNA, 25 bp, Rattus norvegicus
ggctggtccctggaaaagactgctt

SEQ ID NO: 446000 - DNA, 25 bp, Rattus norvegicus
ggctggtccggcatgcctgtatgta

SEQ ID NO: 446001 - DNA, 25 bp, Rattus norvegicus
ggctggtccggcttgcctgtatgta

SEQ ID NO: 446002 - DNA, 25 bp, Rattus norvegicus
ggctggtctcaacctcaggtacctg

SEQ ID NO: 446003 - DNA, 25 bp, Rattus norvegicus
ggctggtctcaagctcaggtacctg

SEQ ID NO: 446004 - DNA, 25 bp, Rattus norvegicus
ggctggtctgtccaagaaggcacat

SEQ ID NO: 446005 - DNA, 25 bp, Rattus norvegicus
ggctggtctgtcgaagaaggcacat

SEQ ID NO: 446006 - DNA, 25 bp, Rattus norvegicus
ggctggtctgtgaagagcttcatct

SEQ ID NO: 446007 - DNA, 25 bp, Rattus norvegicus
ggctggtctgtgtagagcttcatct

SEQ ID NO: 446008 - DNA, 25 bp, Rattus norvegicus
ggctggtgaaatcgctcggcactta

SEQ ID NO: 446009 - DNA, 25 bp, Rattus norvegicus
ggctggtgaaatggctcggcactta

SEQ ID NO: 446010 - DNA, 25 bp, Rattus norvegicus
ggctggtgcttactagaccgtctct

SEQ ID NO: 446011 - DNA, 25 bp, Rattus norvegicus
ggctggtgcttagtagaccgtctct

SEQ ID NO: 446012 - DNA, 25 bp, Rattus norvegicus
ggctggtggcacagctggcccaaaa

SEQ ID NO: 446013 - DNA, 25 bp, Rattus norvegicus
ggctggtggcactgctggcccaaaa

SEQ ID NO: 446014 - DNA, 25 bp, Rattus norvegicus
ggctggtggctgcatttgattttta

SEQ ID NO: 446015 - DNA, 25 bp, Rattus norvegicus
ggctggtggctggatttgattttta

SEQ ID NO: 446016 - DNA, 25 bp, Rattus norvegicus
ggctggtggtccagagttctaagat

SEQ ID NO: 446017 - DNA, 25 bp, Rattus norvegicus
ggctggtggtcctgagttctaagat

SEQ ID NO: 446018 - DNA, 25 bp, Rattus norvegicus
ggctggtggttcactgttgtctgaa

SEQ ID NO: 446019 - DNA, 25 bp, Rattus norvegicus
ggctggtggttctctgttgtctgaa

SEQ ID NO: 446020 - DNA, 25 bp, Rattus norvegicus
ggctggtgtacactttcctccctct

SEQ ID NO: 446021 - DNA, 25 bp, Rattus norvegicus
ggctggtgtacagtttcctccctct

SEQ ID NO: 446022 - DNA, 25 bp, Rattus norvegicus
ggctggtgtagtcttatcattgcat

SEQ ID NO: 446023 - DNA, 25 bp, Rattus norvegicus
ggctggtgtagtgttatcattgcat

SEQ ID NO: 446024 - DNA, 25 bp, Rattus norvegicus
ggctggtgtcccaaaggttgtacag

SEQ ID NO: 446025 - DNA, 25 bp, Rattus norvegicus
ggctggtgtccctaaggttgtacag

SEQ ID NO: 446026 - DNA, 25 bp, Rattus norvegicus
ggctggtgttccaagaccggacacc

SEQ ID NO: 446027 - DNA, 25 bp, Rattus norvegicus
ggctggtgttcctagaccggacacc

SEQ ID NO: 446028 - DNA, 25 bp, Rattus norvegicus
ggctggttaagcatcaccctagaaa

SEQ ID NO: 446029 - DNA, 25 bp, Rattus norvegicus
ggctggttaagcttcaccctagaaa

SEQ ID NO: 446030 - DNA, 25 bp, Rattus norvegicus
ggctggttaatcctggcctttaatc

SEQ ID NO: 446031 - DNA, 25 bp, Rattus norvegicus
ggctggttaatcgtggcctttaatc

SEQ ID NO: 446032 - DNA, 25 bp, Rattus norvegicus
ggctggttacacaatgagactgcaa

SEQ ID NO: 446033 - DNA, 25 bp, Rattus norvegicus
ggctggttacactatgagactgcaa

SEQ ID NO: 446034 - DNA, 25 bp, Rattus norvegicus
ggctggttctctagtatttgtgaat

SEQ ID NO: 446035 - DNA, 25 bp, Rattus norvegicus
ggctggttctctccgaagctagaag

SEQ ID NO: 446036 - DNA, 25 bp, Rattus norvegicus
ggctggttctctgcgaagctagaag

SEQ ID NO: 446037 - DNA, 25 bp, Rattus norvegicus
ggctggttctcttgtatttgtgaat

SEQ ID NO: 446038 - DNA, 25 bp, Rattus norvegicus
ggctggttctgtcctgagctttaac

SEQ ID NO: 446039 - DNA, 25 bp, Rattus norvegicus
ggctggttctgtgctgagctttaac

SEQ ID NO: 446040 - DNA, 25 bp, Rattus norvegicus
ggctggttttcccatcacactctga

SEQ ID NO: 446041 - DNA, 25 bp, Rattus norvegicus
ggctggttttccgatcacactctga

SEQ ID NO: 446042 - DNA, 25 bp, Rattus norvegicus
ggctgtaaatcaataaccctgggtt

SEQ ID NO: 446043 - DNA, 25 bp, Rattus norvegicus
ggctgtaaatcattaaccctgggtt

SEQ ID NO: 446044 - DNA, 25 bp, Rattus norvegicus
ggctgtaagcccaggacacttattt

SEQ ID NO: 446045 - DNA, 25 bp, Rattus norvegicus
ggctgtaagccctggacacttattt

SEQ ID NO: 446046 - DNA, 25 bp, Rattus norvegicus
ggctgtaatatcatttggttttgtc

SEQ ID NO: 446047 - DNA, 25 bp, Rattus norvegicus
ggctgtaatatcttttggttttgtc

SEQ ID NO: 446048 - DNA, 25 bp, Rattus norvegicus
ggctgtaatatgctgctcttcataa

SEQ ID NO: 446049 - DNA, 25 bp, Rattus norvegicus
ggctgtaatatggtgctcttcataa

SEQ ID NO: 446050 - DNA, 25 bp, Rattus norvegicus
ggctgtaatctaaaacccgtgaaga

SEQ ID NO: 446051 - DNA, 25 bp, Rattus norvegicus
ggctgtaatctataacccgtgaaga

SEQ ID NO: 446052 - DNA, 25 bp, Rattus norvegicus
ggctgtacaagcaccacggcctgaa

SEQ ID NO: 446053 - DNA, 25 bp, Rattus norvegicus
ggctgtacaagctccacggcctgaa

SEQ ID NO: 446054 - DNA, 25 bp, Rattus norvegicus
ggctgtacacatcgcccagtatggg

SEQ ID NO: 446055 - DNA, 25 bp, Rattus norvegicus
ggctgtacacatggcccagtatggg

SEQ ID NO: 446056 - DNA, 25 bp, Rattus norvegicus
ggctgtacatgcattgtgcaggcga

SEQ ID NO: 446057 - DNA, 25 bp, Rattus norvegicus
ggctgtacatgctttgtgcaggcga

SEQ ID NO: 446058 - DNA, 25 bp, Rattus norvegicus
ggctgtacatttccctttttcacaa

SEQ ID NO: 446059 - DNA, 25 bp, Rattus norvegicus
ggctgtacatttgcctttttcacaa

SEQ ID NO: 446060 - DNA, 25 bp, Rattus norvegicus
ggctgtaccagtcccttaaagagag

SEQ ID NO: 446061 - DNA, 25 bp, Rattus norvegicus
ggctgtaccagtgccttaaagagag

SEQ ID NO: 446062 - DNA, 25 bp, Rattus norvegicus
ggctgtacttaacatgactggttca

SEQ ID NO: 446063 - DNA, 25 bp, Rattus norvegicus
ggctgtacttaagatgactggttca

SEQ ID NO: 446064 - DNA, 25 bp, Rattus norvegicus
ggctgtagatgtaccattcccacgt

SEQ ID NO: 446065 - DNA, 25 bp, Rattus norvegicus
ggctgtagatgttccattcccacgt

SEQ ID NO: 446066 - DNA, 25 bp, Rattus norvegicus
ggctgtagattcagctcagtagtga

SEQ ID NO: 446067 - DNA, 25 bp, Rattus norvegicus
ggctgtagattctgctcagtagtga

SEQ ID NO: 446068 - DNA, 25 bp, Rattus norvegicus
ggctgtagcaacctctgtcaggtcc

SEQ ID NO: 446069 - DNA, 25 bp, Rattus norvegicus
ggctgtagcaacgtctgtcaggtcc

SEQ ID NO: 446070 - DNA, 25 bp, Rattus norvegicus
ggctgtagcatgattgtgactctgg

SEQ ID NO: 446071 - DNA, 25 bp, Rattus norvegicus
ggctgtagcatgtttgtgactctgg

SEQ ID NO: 446072 - DNA, 25 bp, Rattus norvegicus
ggctgtagccgaagccactgaagtt

SEQ ID NO: 446073 - DNA, 25 bp, Rattus norvegicus
ggctgtagccgatgccactgaagtt

SEQ ID NO: 446074 - DNA, 25 bp, Rattus norvegicus
ggctgtagcgatctatacggacact

SEQ ID NO: 446075 - DNA, 25 bp, Rattus norvegicus
ggctgtagcgatgtatacggacact

SEQ ID NO: 446076 - DNA, 25 bp, Rattus norvegicus
ggctgtaggcacctgctcatgaaga

SEQ ID NO: 446077 - DNA, 25 bp, Rattus norvegicus
ggctgtaggcacgtgctcatgaaga

SEQ ID NO: 446078 - DNA, 25 bp, Rattus norvegicus
ggctgtaggctgagtctaacgacca

SEQ ID NO: 446079 - DNA, 25 bp, Rattus norvegicus
ggctgtaggctgtgtctaacgacca

SEQ ID NO: 446080 - DNA, 25 bp, Rattus norvegicus
ggctgtagtaggctaccacacacat

SEQ ID NO: 446081 - DNA, 25 bp, Rattus norvegicus
ggctgtagtagggtaccacacacat

SEQ ID NO: 446082 - DNA, 25 bp, Rattus norvegicus
ggctgtagttacatcaccatcaacc

SEQ ID NO: 446083 - DNA, 25 bp, Rattus norvegicus
ggctgtagttacttcaccatcaacc

SEQ ID NO: 446084 - DNA, 25 bp, Rattus norvegicus
ggctgtagttagcttttcatcccta

SEQ ID NO: 446085 - DNA, 25 bp, Rattus norvegicus
ggctgtagttaggttttcatcccta

SEQ ID NO: 446086 - DNA, 25 bp, Rattus norvegicus
ggctgtatacatccctattaaattg

SEQ ID NO: 446087 - DNA, 25 bp, Rattus norvegicus
ggctgtatacatgcctattaaattg

SEQ ID NO: 446088 - DNA, 25 bp, Rattus norvegicus
ggctgtatatataccccatgcctgc

SEQ ID NO: 446089 - DNA, 25 bp, Rattus norvegicus
ggctgtatatattccccatgcctgc

SEQ ID NO: 446090 - DNA, 25 bp, Rattus norvegicus
ggctgtatatttctgcctattaata

SEQ ID NO: 446091 - DNA, 25 bp, Rattus norvegicus
ggctgtatatttgtgcctattaata

SEQ ID NO: 446092 - DNA, 25 bp, Rattus norvegicus
ggctgtatcagacaagcgcgctcaa

SEQ ID NO: 446093 - DNA, 25 bp, Rattus norvegicus
ggctgtatcagacgcacaacgtcta

SEQ ID NO: 446094 - DNA, 25 bp, Rattus norvegicus
ggctgtatcagagaagcgcgctcaa

SEQ ID NO: 446095 - DNA, 25 bp, Rattus norvegicus
ggctgtatcagaggcacaacgtcta

SEQ ID NO: 446096 - DNA, 25 bp, Rattus norvegicus
ggctgtatcatacaaatggcttcaa

SEQ ID NO: 446097 - DNA, 25 bp, Rattus norvegicus
ggctgtatcatagaaatggcttcaa

SEQ ID NO: 446098 - DNA, 25 bp, Rattus norvegicus
ggctgtatcggaacccttcgggaga

SEQ ID NO: 446099 - DNA, 25 bp, Rattus norvegicus
ggctgtatcggatcccttcgggaga

SEQ ID NO: 446100 - DNA, 25 bp, Rattus norvegicus
ggctgtatgaaaataccctcctcaa

SEQ ID NO: 446101 - DNA, 25 bp, Rattus norvegicus
ggctgtatgaaattaccctcctcaa

SEQ ID NO: 446102 - DNA, 25 bp, Rattus norvegicus
ggctgtatgaccctggctaagtccc

SEQ ID NO: 446103 - DNA, 25 bp, Rattus norvegicus
ggctgtatgaccgtggctaagtccc

SEQ ID NO: 446104 - DNA, 25 bp, Rattus norvegicus
ggctgtatgcccaagaaaggactct

SEQ ID NO: 446105 - DNA, 25 bp, Rattus norvegicus
ggctgtatgccctagaaaggactct

SEQ ID NO: 446106 - DNA, 25 bp, Rattus norvegicus
ggctgtatgcctacatgtggatgtc

SEQ ID NO: 446107 - DNA, 25 bp, Rattus norvegicus
ggctgtatgccttcatgtggatgtc

SEQ ID NO: 446108 - DNA, 25 bp, Rattus norvegicus
ggctgtatgtccataagatttgcta

SEQ ID NO: 446109 - DNA, 25 bp, Rattus norvegicus
ggctgtatgtccttaagatttgcta

SEQ ID NO: 446110 - DNA, 25 bp, Rattus norvegicus
ggctgtatgtcgagtgctctggaca

SEQ ID NO: 446111 - DNA, 25 bp, Rattus norvegicus
ggctgtatgtcgtgtgctctggaca

SEQ ID NO: 446112 - DNA, 25 bp, Rattus norvegicus
ggctgtatgtggaattgctgatcat

SEQ ID NO: 446113 - DNA, 25 bp, Rattus norvegicus
ggctgtatgtggtattgctgatcat

SEQ ID NO: 446114 - DNA, 25 bp, Rattus norvegicus
ggctgtattaacatagcaaacccct

SEQ ID NO: 446115 - DNA, 25 bp, Rattus norvegicus
ggctgtattaaccagcttccaggta

SEQ ID NO: 446116 - DNA, 25 bp, Rattus norvegicus
ggctgtattaacgagcttccaggta

SEQ ID NO: 446117 - DNA, 25 bp, Rattus norvegicus
ggctgtattaacttagcaaacccct

SEQ ID NO: 446118 - DNA, 25 bp, Rattus norvegicus
ggctgtattatcaatggccatctac

SEQ ID NO: 446119 - DNA, 25 bp, Rattus norvegicus
ggctgtattatctatggccatctac

SEQ ID NO: 446120 - DNA, 25 bp, Rattus norvegicus
ggctgtattgagatgtaacctgagt

SEQ ID NO: 446121 - DNA, 25 bp, Rattus norvegicus
ggctgtattgagttgtaacctgagt

SEQ ID NO: 446122 - DNA, 25 bp, Rattus norvegicus
ggctgtcaacttcttggtgtcctta

SEQ ID NO: 446123 - DNA, 25 bp, Rattus norvegicus
ggctgtcaacttgttggtgtcctta

SEQ ID NO: 446124 - DNA, 25 bp, Rattus norvegicus
ggctgtcacatgagtgctgctgctg

SEQ ID NO: 446125 - DNA, 25 bp, Rattus norvegicus
ggctgtcacatgtgtgctgctgctg

SEQ ID NO: 446126 - DNA, 25 bp, Rattus norvegicus
ggctgtcaccgtctagaacaaactg

SEQ ID NO: 446127 - DNA, 25 bp, Rattus norvegicus
ggctgtcaccgtgtagaacaaactg

SEQ ID NO: 446128 - DNA, 25 bp, Rattus norvegicus
ggctgtcactataatcttctgcttc

SEQ ID NO: 446129 - DNA, 25 bp, Rattus norvegicus
ggctgtcactattatcttctgcttc

SEQ ID NO: 446130 - DNA, 25 bp, Rattus norvegicus
ggctgtcactgcacagcacatgata

SEQ ID NO: 446131 - DNA, 25 bp, Rattus norvegicus
ggctgtcactgctcagcacatgata

SEQ ID NO: 446132 - DNA, 25 bp, Rattus norvegicus
ggctgtcactgtctgggcttatttc

SEQ ID NO: 446133 - DNA, 25 bp, Rattus norvegicus
ggctgtcactgtgtgggcttatttc

SEQ ID NO: 446134 - DNA, 25 bp, Rattus norvegicus
ggctgtcagagacactccacttggt

SEQ ID NO: 446135 - DNA, 25 bp, Rattus norvegicus
ggctgtcagagagactccacttggt

SEQ ID NO: 446136 - DNA, 25 bp, Rattus norvegicus
ggctgtcagatcatcattacatcca

SEQ ID NO: 446137 - DNA, 25 bp, Rattus norvegicus
ggctgtcagatcttcattacatcca

SEQ ID NO: 446138 - DNA, 25 bp, Rattus norvegicus
ggctgtcagccaaaaggaaggctct

SEQ ID NO: 446139 - DNA, 25 bp, Rattus norvegicus
ggctgtcagccacagtcatgtctca

SEQ ID NO: 446140 - DNA, 25 bp, Rattus norvegicus
ggctgtcagccagagtcatgtctca

SEQ ID NO: 446141 - DNA, 25 bp, Rattus norvegicus
ggctgtcagccataaggaaggctct

SEQ ID NO: 446142 - DNA, 25 bp, Rattus norvegicus
ggctgtcagcctcactgttgttgaa

SEQ ID NO: 446143 - DNA, 25 bp, Rattus norvegicus
ggctgtcagcctgactgttgttgaa

SEQ ID NO: 446144 - DNA, 25 bp, Rattus norvegicus
ggctgtcagtcaatcccgaaaagag

SEQ ID NO: 446145 - DNA, 25 bp, Rattus norvegicus
ggctgtcagtcattcccgaaaagag

SEQ ID NO: 446146 - DNA, 25 bp, Rattus norvegicus
ggctgtcatcataggcatcaccata

SEQ ID NO: 446147 - DNA, 25 bp, Rattus norvegicus
ggctgtcatcattggcatcaccata

SEQ ID NO: 446148 - DNA, 25 bp, Rattus norvegicus
ggctgtccacttcaactgcaatagt

SEQ ID NO: 446149 - DNA, 25 bp, Rattus norvegicus
ggctgtccacttgaactgcaatagt

SEQ ID NO: 446150 - DNA, 25 bp, Rattus norvegicus
ggctgtccagcacttcaaatgtact

SEQ ID NO: 446151 - DNA, 25 bp, Rattus norvegicus
ggctgtccagcagttcaaatgtact

SEQ ID NO: 446152 - DNA, 25 bp, Rattus norvegicus
ggctgtccagctaggctctgggcat

SEQ ID NO: 446153 - DNA, 25 bp, Rattus norvegicus
ggctgtccagcttggctctgggcat

SEQ ID NO: 446154 - DNA, 25 bp, Rattus norvegicus
ggctgtccaggaccgcaggcctctt

SEQ ID NO: 446155 - DNA, 25 bp, Rattus norvegicus
ggctgtccaggagcgcaggcctctt

SEQ ID NO: 446156 - DNA, 25 bp, Rattus norvegicus
ggctgtccagggagtagtaagtcct

SEQ ID NO: 446157 - DNA, 25 bp, Rattus norvegicus
ggctgtccagggtgtagtaagtcct

SEQ ID NO: 446158 - DNA, 25 bp, Rattus norvegicus
ggctgtccagttctatgatgcgttc

SEQ ID NO: 446159 - DNA, 25 bp, Rattus norvegicus
ggctgtccagttgtatgatgcgttc

SEQ ID NO: 446160 - DNA, 25 bp, Rattus norvegicus
ggctgtccatccaagcagaaccagt

SEQ ID NO: 446161 - DNA, 25 bp, Rattus norvegicus
ggctgtccatcctagcagaaccagt

SEQ ID NO: 446162 - DNA, 25 bp, Rattus norvegicus
ggctgtcccaagatgccagagtcag

SEQ ID NO: 446163 - DNA, 25 bp, Rattus norvegicus
ggctgtcccaagttgccagagtcag

SEQ ID NO: 446164 - DNA, 25 bp, Rattus norvegicus
ggctgtccgggaaagggctcactct

SEQ ID NO: 446165 - DNA, 25 bp, Rattus norvegicus
ggctgtccgggatagggctcactct

SEQ ID NO: 446166 - DNA, 25 bp, Rattus norvegicus
ggctgtccggttctcctacaaggaa

SEQ ID NO: 446167 - DNA, 25 bp, Rattus norvegicus
ggctgtccggttgtcctacaaggaa

SEQ ID NO: 446168 - DNA, 25 bp, Rattus norvegicus
ggctgtccgtctcctattaaagttt

SEQ ID NO: 446169 - DNA, 25 bp, Rattus norvegicus
ggctgtccgtctgctattaaagttt

SEQ ID NO: 446170 - DNA, 25 bp, Rattus norvegicus
ggctgtcctaagcagatctccaagt

SEQ ID NO: 446171 - DNA, 25 bp, Rattus norvegicus
ggctgtcctaaggagatctccaagt

SEQ ID NO: 446172 - DNA, 25 bp, Rattus norvegicus
ggctgtcctggaatatattgcacat

SEQ ID NO: 446173 - DNA, 25 bp, Rattus norvegicus
ggctgtcctggattatattgcacat

SEQ ID NO: 446174 - DNA, 25 bp, Rattus norvegicus
ggctgtcctgtaacttatcatgtag

SEQ ID NO: 446175 - DNA, 25 bp, Rattus norvegicus
ggctgtcctgtatcttatcatgtag

SEQ ID NO: 446176 - DNA, 25 bp, Rattus norvegicus
ggctgtcctgttatactatcactta

SEQ ID NO: 446177 - DNA, 25 bp, Rattus norvegicus
ggctgtcctgttttactatcactta

SEQ ID NO: 446178 - DNA, 25 bp, Rattus norvegicus
ggctgtccttagataattagaccct

SEQ ID NO: 446179 - DNA, 25 bp, Rattus norvegicus
ggctgtccttagttaattagaccct

SEQ ID NO: 446180 - DNA, 25 bp, Rattus norvegicus
ggctgtccttttaataatgcaaagt

SEQ ID NO: 446181 - DNA, 25 bp, Rattus norvegicus
ggctgtcctttttataatgcaaagt

SEQ ID NO: 446182 - DNA, 25 bp, Rattus norvegicus
ggctgtcgggacatactttctacat

SEQ ID NO: 446183 - DNA, 25 bp, Rattus norvegicus
ggctgtcgggacttactttctacat

SEQ ID NO: 446184 - DNA, 25 bp, Rattus norvegicus
ggctgtcgtgtgcttttgatgtata

SEQ ID NO: 446185 - DNA, 25 bp, Rattus norvegicus
ggctgtcgtgtggttttgatgtata

SEQ ID NO: 446186 - DNA, 25 bp, Rattus norvegicus
ggctgtctaaacattccttcagggt

SEQ ID NO: 446187 - DNA, 25 bp, Rattus norvegicus
ggctgtctaaactttccttcagggt

SEQ ID NO: 446188 - DNA, 25 bp, Rattus norvegicus
ggctgtctaatgaagtctctggtct

SEQ ID NO: 446189 - DNA, 25 bp, Rattus norvegicus
ggctgtctaatgtagtctctggtct

SEQ ID NO: 446190 - DNA, 25 bp, Rattus norvegicus
ggctgtctacgtattctgaatattc

SEQ ID NO: 446191 - DNA, 25 bp, Rattus norvegicus
ggctgtctacgttttctgaatattc

SEQ ID NO: 446192 - DNA, 25 bp, Rattus norvegicus
ggctgtctcacaccatactaatgct

SEQ ID NO: 446193 - DNA, 25 bp, Rattus norvegicus
ggctgtctcacagcatactaatgct

SEQ ID NO: 446194 - DNA, 25 bp, Rattus norvegicus
ggctgtctcgggactccaagtagta

SEQ ID NO: 446195 - DNA, 25 bp, Rattus norvegicus
ggctgtctcgggtctccaagtagta

SEQ ID NO: 446196 - DNA, 25 bp, Rattus norvegicus
ggctgtctctctctagtaatgtcac

SEQ ID NO: 446197 - DNA, 25 bp, Rattus norvegicus
ggctgtctctctgtagtaatgtcac

SEQ ID NO: 446198 - DNA, 25 bp, Rattus norvegicus
ggctgtctctgaagacgctgctcag

SEQ ID NO: 446199 - DNA, 25 bp, Rattus norvegicus
ggctgtctctgatgacgctgctcag

SEQ ID NO: 446200 - DNA, 25 bp, Rattus norvegicus
ggctgtctgcacacagtggtaacta

SEQ ID NO: 446201 - DNA, 25 bp, Rattus norvegicus
ggctgtctgcactcagtggtaacta

SEQ ID NO: 446202 - DNA, 25 bp, Rattus norvegicus
ggctgtctgcagaggagctatacat

SEQ ID NO: 446203 - DNA, 25 bp, Rattus norvegicus
ggctgtctgcagtggagctatacat

SEQ ID NO: 446204 - DNA, 25 bp, Rattus norvegicus
ggctgtctgcttactactgatggag

SEQ ID NO: 446205 - DNA, 25 bp, Rattus norvegicus
ggctgtctgctttctactgatggag

SEQ ID NO: 446206 - DNA, 25 bp, Rattus norvegicus
ggctgtctggcgagatgcatgacat

SEQ ID NO: 446207 - DNA, 25 bp, Rattus norvegicus
ggctgtctggcgtgatgcatgacat

SEQ ID NO: 446208 - DNA, 25 bp, Rattus norvegicus
ggctgtctggtgcaattcctccgaa

SEQ ID NO: 446209 - DNA, 25 bp, Rattus norvegicus
ggctgtctggtggaattcctccgaa

SEQ ID NO: 446210 - DNA, 25 bp, Rattus norvegicus
ggctgtcttcctcggtcatctaaaa

SEQ ID NO: 446211 - DNA, 25 bp, Rattus norvegicus
ggctgtcttcctgggtcatctaaaa

SEQ ID NO: 446212 - DNA, 25 bp, Rattus norvegicus
ggctgtcttttcactccaaattaac

SEQ ID NO: 446213 - DNA, 25 bp, Rattus norvegicus
ggctgtcttttctctccaaattaac

SEQ ID NO: 446214 - DNA, 25 bp, Rattus norvegicus
ggctgtgaacttcaatgaccattgc

SEQ ID NO: 446215 - DNA, 25 bp, Rattus norvegicus
ggctgtgaacttgaatgaccattgc

SEQ ID NO: 446216 - DNA, 25 bp, Rattus norvegicus
ggctgtgaagccctgtcctttaaga

SEQ ID NO: 446217 - DNA, 25 bp, Rattus norvegicus
ggctgtgaagccgtgtcctttaaga

SEQ ID NO: 446218 - DNA, 25 bp, Rattus norvegicus
ggctgtgaagctatctatcgcttta

SEQ ID NO: 446219 - DNA, 25 bp, Rattus norvegicus
ggctgtgaagctttctatcgcttta

SEQ ID NO: 446220 - DNA, 25 bp, Rattus norvegicus
ggctgtgaataaaagccaccttcag

SEQ ID NO: 446221 - DNA, 25 bp, Rattus norvegicus
ggctgtgaataatagccaccttcag

SEQ ID NO: 446222 - DNA, 25 bp, Rattus norvegicus
ggctgtgacaatcaacagtgtccca

SEQ ID NO: 446223 - DNA, 25 bp, Rattus norvegicus
ggctgtgacaatgaacagtgtccca

SEQ ID NO: 446224 - DNA, 25 bp, Rattus norvegicus
ggctgtgaccatataggtttcccac

SEQ ID NO: 446225 - DNA, 25 bp, Rattus norvegicus
ggctgtgaccatttaggtttcccac

SEQ ID NO: 446226 - DNA, 25 bp, Rattus norvegicus
ggctgtgaccttagatctttatgtt

SEQ ID NO: 446227 - DNA, 25 bp, Rattus norvegicus
ggctgtgacctttgatctttatgtt

SEQ ID NO: 446228 - DNA, 25 bp, Rattus norvegicus
ggctgtgagctgaaccatggtccaa

SEQ ID NO: 446229 - DNA, 25 bp, Rattus norvegicus
ggctgtgagctgatctcattggcag

SEQ ID NO: 446230 - DNA, 25 bp, Rattus norvegicus
ggctgtgagctgtaccatggtccaa

SEQ ID NO: 446231 - DNA, 25 bp, Rattus norvegicus
ggctgtgagctgttctcattggcag

SEQ ID NO: 446232 - DNA, 25 bp, Rattus norvegicus
ggctgtgagtgtaataatccccaaa

SEQ ID NO: 446233 - DNA, 25 bp, Rattus norvegicus
ggctgtgagtgttataatccccaaa

SEQ ID NO: 446234 - DNA, 25 bp, Rattus norvegicus
ggctgtgatcaccacattaccagat

SEQ ID NO: 446235 - DNA, 25 bp, Rattus norvegicus
ggctgtgatcacgacattaccagat

SEQ ID NO: 446236 - DNA, 25 bp, Rattus norvegicus
ggctgtgatctgctggcttcagaaa

SEQ ID NO: 446237 - DNA, 25 bp, Rattus norvegicus
ggctgtgatctggtggcttcagaaa

SEQ ID NO: 446238 - DNA, 25 bp, Rattus norvegicus
ggctgtgatgagattcccattattc

SEQ ID NO: 446239 - DNA, 25 bp, Rattus norvegicus
ggctgtgatgagtttcccattattc

SEQ ID NO: 446240 - DNA, 25 bp, Rattus norvegicus
ggctgtgcaagaagttctacgccat

SEQ ID NO: 446241 - DNA, 25 bp, Rattus norvegicus
ggctgtgcaagatgttctacgccat

SEQ ID NO: 446242 - DNA, 25 bp, Rattus norvegicus
ggctgtgcaatgagtttcgggttac

SEQ ID NO: 446243 - DNA, 25 bp, Rattus norvegicus
ggctgtgcaatgtgtttcgggttac

SEQ ID NO: 446244 - DNA, 25 bp, Rattus norvegicus
ggctgtgcacagatggcttgcttga

SEQ ID NO: 446245 - DNA, 25 bp, Rattus norvegicus
ggctgtgcacagttggcttgcttga

SEQ ID NO: 446246 - DNA, 25 bp, Rattus norvegicus
ggctgtgcactcaactgtgtcttaa

SEQ ID NO: 446247 - DNA, 25 bp, Rattus norvegicus
ggctgtgcactctactgtgtcttaa

SEQ ID NO: 446248 - DNA, 25 bp, Rattus norvegicus
ggctgtgcagccattgtgttactgt

SEQ ID NO: 446249 - DNA, 25 bp, Rattus norvegicus
ggctgtgcagcctttgtgttactgt

SEQ ID NO: 446250 - DNA, 25 bp, Rattus norvegicus
ggctgtgcagtcaccgacctatgta

SEQ ID NO: 446251 - DNA, 25 bp, Rattus norvegicus
ggctgtgcagtctccgacctatgta

SEQ ID NO: 446252 - DNA, 25 bp, Rattus norvegicus
ggctgtgcatcactgctgcaggaaa

SEQ ID NO: 446253 - DNA, 25 bp, Rattus norvegicus
ggctgtgcatcagtgctgcaggaaa

SEQ ID NO: 446254 - DNA, 25 bp, Rattus norvegicus
ggctgtgccactccaaaacgggaaa

SEQ ID NO: 446255 - DNA, 25 bp, Rattus norvegicus
ggctgtgccactgcaaaacgggaaa

SEQ ID NO: 446256 - DNA, 25 bp, Rattus norvegicus
ggctgtgccaggacgtttccagaag

SEQ ID NO: 446257 - DNA, 25 bp, Rattus norvegicus
ggctgtgccaggtcgtttccagaag

SEQ ID NO: 446258 - DNA, 25 bp, Rattus norvegicus
ggctgtgcctagctgccatgtcagt

SEQ ID NO: 446259 - DNA, 25 bp, Rattus norvegicus
ggctgtgcctaggtgccatgtcagt

SEQ ID NO: 446260 - DNA, 25 bp, Rattus norvegicus
ggctgtgcctgcagagatcatccag

SEQ ID NO: 446261 - DNA, 25 bp, Rattus norvegicus
ggctgtgcctgctgagatcatccag

SEQ ID NO: 446262 - DNA, 25 bp, Rattus norvegicus
ggctgtgccttcatgtggactggtc

SEQ ID NO: 446263 - DNA, 25 bp, Rattus norvegicus
ggctgtgccttcttgtggactggtc

SEQ ID NO: 446264 - DNA, 25 bp, Rattus norvegicus
ggctgtgcgtgtccaattttttcac

SEQ ID NO: 446265 - DNA, 25 bp, Rattus norvegicus
ggctgtgcgtgtgcaattttttcac

SEQ ID NO: 446266 - DNA, 25 bp, Rattus norvegicus
ggctgtgctactccatggactgtat

SEQ ID NO: 446267 - DNA, 25 bp, Rattus norvegicus
ggctgtgctactgcatggactgtat

SEQ ID NO: 446268 - DNA, 25 bp, Rattus norvegicus
ggctgtgctcacaacggactttaat

SEQ ID NO: 446269 - DNA, 25 bp, Rattus norvegicus
ggctgtgctcactacggactttaat

SEQ ID NO: 446270 - DNA, 25 bp, Rattus norvegicus
ggctgtgctcctcgaatctaagtcc

SEQ ID NO: 446271 - DNA, 25 bp, Rattus norvegicus
ggctgtgctcctggaatctaagtcc

SEQ ID NO: 446272 - DNA, 25 bp, Rattus norvegicus
ggctgtgctcgaaagctttgttctt

SEQ ID NO: 446273 - DNA, 25 bp, Rattus norvegicus
ggctgtgctcgatagctttgttctt

SEQ ID NO: 446274 - DNA, 25 bp, Rattus norvegicus
ggctgtgctctcagtattgtacatt

SEQ ID NO: 446275 - DNA, 25 bp, Rattus norvegicus
ggctgtgctctctgtattgtacatt

SEQ ID NO: 446276 - DNA, 25 bp, Rattus norvegicus
ggctgtgctcttacaagcagctgaa

SEQ ID NO: 446277 - DNA, 25 bp, Rattus norvegicus
ggctgtgctctttcaagcagctgaa

SEQ ID NO: 446278 - DNA, 25 bp, Rattus norvegicus
ggctgtgctgcgctattactaaacg

SEQ ID NO: 446279 - DNA, 25 bp, Rattus norvegicus
ggctgtgctgcggtattactaaacg

SEQ ID NO: 446280 - DNA, 25 bp, Rattus norvegicus
ggctgtgctggacagttcattacca

SEQ ID NO: 446281 - DNA, 25 bp, Rattus norvegicus
ggctgtgctggagagttcattacca

SEQ ID NO: 446282 - DNA, 25 bp, Rattus norvegicus
ggctgtgctgtgacattatgtcatt

SEQ ID NO: 446283 - DNA, 25 bp, Rattus norvegicus
ggctgtgctgtgctaataagactga

SEQ ID NO: 446284 - DNA, 25 bp, Rattus norvegicus
ggctgtgctgtggtaataagactga

SEQ ID NO: 446285 - DNA, 25 bp, Rattus norvegicus
ggctgtgctgtgtcattatgtcatt

SEQ ID NO: 446286 - DNA, 25 bp, Rattus norvegicus
ggctgtgcttctctgcactgagaat

SEQ ID NO: 446287 - DNA, 25 bp, Rattus norvegicus
ggctgtgcttctgtgcactgagaat

SEQ ID NO: 446288 - DNA, 25 bp, Rattus norvegicus
ggctgtgctttaatgatgaaaccga

SEQ ID NO: 446289 - DNA, 25 bp, Rattus norvegicus
ggctgtgctttattgatgaaaccga

SEQ ID NO: 446290 - DNA, 25 bp, Rattus norvegicus
ggctgtggaacccagactgactctt

SEQ ID NO: 446291 - DNA, 25 bp, Rattus norvegicus
ggctgtggaaccgagactgactctt

SEQ ID NO: 446292 - DNA, 25 bp, Rattus norvegicus
ggctgtggacagaactctactcaaa

SEQ ID NO: 446293 - DNA, 25 bp, Rattus norvegicus
ggctgtggacagtactctactcaaa

SEQ ID NO: 446294 - DNA, 25 bp, Rattus norvegicus
ggctgtggacgcaccaaggagacat

SEQ ID NO: 446295 - DNA, 25 bp, Rattus norvegicus
ggctgtggacgctccaaggagacat

SEQ ID NO: 446296 - DNA, 25 bp, Rattus norvegicus
ggctgtggacttagcggaatgtttc

SEQ ID NO: 446297 - DNA, 25 bp, Rattus norvegicus
ggctgtggactttgcggaatgtttc

SEQ ID NO: 446298 - DNA, 25 bp, Rattus norvegicus
ggctgtggcacactagcgctgatca

SEQ ID NO: 446299 - DNA, 25 bp, Rattus norvegicus
ggctgtggcacagtagcgctgatca

SEQ ID NO: 446300 - DNA, 25 bp, Rattus norvegicus
ggctgtggcctgatccaagtacgag

SEQ ID NO: 446301 - DNA, 25 bp, Rattus norvegicus
ggctgtggcctgttccaagtacgag

SEQ ID NO: 446302 - DNA, 25 bp, Rattus norvegicus
ggctgtggctcaaggtcgccaagca

SEQ ID NO: 446303 - DNA, 25 bp, Rattus norvegicus
ggctgtggctcatggtcgccaagca

SEQ ID NO: 446304 - DNA, 25 bp, Rattus norvegicus
ggctgtggcttcaagttttggaaac

SEQ ID NO: 446305 - DNA, 25 bp, Rattus norvegicus
ggctgtggcttctagttttggaaac

SEQ ID NO: 446306 - DNA, 25 bp, Rattus norvegicus
ggctgtgggaatatcacctgtcaaa

SEQ ID NO: 446307 - DNA, 25 bp, Rattus norvegicus
ggctgtgggaatttcacctgtcaaa

SEQ ID NO: 446308 - DNA, 25 bp, Rattus norvegicus
ggctgtgggcttcctcgtagcctaa

SEQ ID NO: 446309 - DNA, 25 bp, Rattus norvegicus
ggctgtgggcttgctcgtagcctaa

SEQ ID NO: 446310 - DNA, 25 bp, Rattus norvegicus
ggctgtggtactacatatgctgggt

SEQ ID NO: 446311 - DNA, 25 bp, Rattus norvegicus
ggctgtggtacttcatatgctgggt

SEQ ID NO: 446312 - DNA, 25 bp, Rattus norvegicus
ggctgtggtataaaagtctccctcc

SEQ ID NO: 446313 - DNA, 25 bp, Rattus norvegicus
ggctgtggtatataagtctccctcc

SEQ ID NO: 446314 - DNA, 25 bp, Rattus norvegicus
ggctgtggtcacaaagacgggccca

SEQ ID NO: 446315 - DNA, 25 bp, Rattus norvegicus
ggctgtggtcactaagacgggccca

SEQ ID NO: 446316 - DNA, 25 bp, Rattus norvegicus
ggctgtggtcagaatcacacaatgc

SEQ ID NO: 446317 - DNA, 25 bp, Rattus norvegicus
ggctgtggtcagtatcacacaatgc

SEQ ID NO: 446318 - DNA, 25 bp, Rattus norvegicus
ggctgtggtgctcaggtccctaccc

SEQ ID NO: 446319 - DNA, 25 bp, Rattus norvegicus
ggctgtggtgctgaggtccctaccc

SEQ ID NO: 446320 - DNA, 25 bp, Rattus norvegicus
ggctgtggttacacattttccaaca

SEQ ID NO: 446321 - DNA, 25 bp, Rattus norvegicus
ggctgtggttactcattttccaaca

SEQ ID NO: 446322 - DNA, 25 bp, Rattus norvegicus
ggctgtgtacagaaaatttccttta

SEQ ID NO: 446323 - DNA, 25 bp, Rattus norvegicus
ggctgtgtacagtaaatttccttta

SEQ ID NO: 446324 - DNA, 25 bp, Rattus norvegicus
ggctgtgtagacaccagcgttatcc

SEQ ID NO: 446325 - DNA, 25 bp, Rattus norvegicus
ggctgtgtagactccagcgttatcc

SEQ ID NO: 446326 - DNA, 25 bp, Rattus norvegicus
ggctgtgtagatcccagatacctgt

SEQ ID NO: 446327 - DNA, 25 bp, Rattus norvegicus
ggctgtgtagatgccagatacctgt

SEQ ID NO: 446328 - DNA, 25 bp, Rattus norvegicus
ggctgtgtatttctactcctaggaa

SEQ ID NO: 446329 - DNA, 25 bp, Rattus norvegicus
ggctgtgtatttgtactcctaggaa

SEQ ID NO: 446330 - DNA, 25 bp, Rattus norvegicus
ggctgtgtcagtctaggtctcccta

SEQ ID NO: 446331 - DNA, 25 bp, Rattus norvegicus
ggctgtgtcagtgtaggtctcccta

SEQ ID NO: 446332 - DNA, 25 bp, Rattus norvegicus
ggctgtgtcccgcttactaattata

SEQ ID NO: 446333 - DNA, 25 bp, Rattus norvegicus
ggctgtgtcccggttactaattata

SEQ ID NO: 446334 - DNA, 25 bp, Rattus norvegicus
ggctgtgtccctcatgagaaaaggt

SEQ ID NO: 446335 - DNA, 25 bp, Rattus norvegicus
ggctgtgtccctgatgagaaaaggt

SEQ ID NO: 446336 - DNA, 25 bp, Rattus norvegicus
ggctgtgtcctcatccacaataaaa

SEQ ID NO: 446337 - DNA, 25 bp, Rattus norvegicus
ggctgtgtcctcttccacaataaaa

SEQ ID NO: 446338 - DNA, 25 bp, Rattus norvegicus
ggctgtgtcctgcaccacgaatgat

SEQ ID NO: 446339 - DNA, 25 bp, Rattus norvegicus
ggctgtgtcctggaccacgaatgat

SEQ ID NO: 446340 - DNA, 25 bp, Rattus norvegicus
ggctgtgtcgagatcagtcttttct

SEQ ID NO: 446341 - DNA, 25 bp, Rattus norvegicus
ggctgtgtcgagttcagtcttttct

SEQ ID NO: 446342 - DNA, 25 bp, Rattus norvegicus
ggctgtgtctaaatccaatctggga

SEQ ID NO: 446343 - DNA, 25 bp, Rattus norvegicus
ggctgtgtctaattccaatctggga

SEQ ID NO: 446344 - DNA, 25 bp, Rattus norvegicus
ggctgtgtctacacagtgcctccaa

SEQ ID NO: 446345 - DNA, 25 bp, Rattus norvegicus
ggctgtgtctactcagtgcctccaa

SEQ ID NO: 446346 - DNA, 25 bp, Rattus norvegicus
ggctgtgtgaatagtgcgactgatt

SEQ ID NO: 446347 - DNA, 25 bp, Rattus norvegicus
ggctgtgtgaattgtgcgactgatt

SEQ ID NO: 446348 - DNA, 25 bp, Rattus norvegicus
ggctgtgtgaccaaacaggacagaa

SEQ ID NO: 446349 - DNA, 25 bp, Rattus norvegicus
ggctgtgtgacctaacaggacagaa

SEQ ID NO: 446350 - DNA, 25 bp, Rattus norvegicus
ggctgtgtgctcatattttcaacct

SEQ ID NO: 446351 - DNA, 25 bp, Rattus norvegicus
ggctgtgtgctcttattttcaacct

SEQ ID NO: 446352 - DNA, 25 bp, Rattus norvegicus
ggctgtgtgcttctgtcctaataaa

SEQ ID NO: 446353 - DNA, 25 bp, Rattus norvegicus
ggctgtgtgcttgtgtcctaataaa

SEQ ID NO: 446354 - DNA, 25 bp, Rattus norvegicus
ggctgtgtggatactctccctgtac

SEQ ID NO: 446355 - DNA, 25 bp, Rattus norvegicus
ggctgtgtggattctctccctgtac

SEQ ID NO: 446356 - DNA, 25 bp, Rattus norvegicus
ggctgtgttacaatttaggtttcct

SEQ ID NO: 446357 - DNA, 25 bp, Rattus norvegicus
ggctgtgttacattttaggtttcct

SEQ ID NO: 446358 - DNA, 25 bp, Rattus norvegicus
ggctgtgttagcatctctgggaatc

SEQ ID NO: 446359 - DNA, 25 bp, Rattus norvegicus
ggctgtgttagcttctctgggaatc

SEQ ID NO: 446360 - DNA, 25 bp, Rattus norvegicus
ggctgtgttcatactcacgacgcag

SEQ ID NO: 446361 - DNA, 25 bp, Rattus norvegicus
ggctgtgttcattctcacgacgcag

SEQ ID NO: 446362 - DNA, 25 bp, Rattus norvegicus
ggctgtgttgtaatagattccttga

SEQ ID NO: 446363 - DNA, 25 bp, Rattus norvegicus
ggctgtgttgtattagattccttga

SEQ ID NO: 446364 - DNA, 25 bp, Rattus norvegicus
ggctgtgttgtgaagtacctctcac

SEQ ID NO: 446365 - DNA, 25 bp, Rattus norvegicus
ggctgtgttgtgtagtacctctcac

SEQ ID NO: 446366 - DNA, 25 bp, Rattus norvegicus
ggctgtgtttggatattatccctgg

SEQ ID NO: 446367 - DNA, 25 bp, Rattus norvegicus
ggctgtgtttggttattatccctgg

SEQ ID NO: 446368 - DNA, 25 bp, Rattus norvegicus
ggctgtgttttaacgcagtgctaaa

SEQ ID NO: 446369 - DNA, 25 bp, Rattus norvegicus
ggctgtgttttatcgcagtgctaaa

SEQ ID NO: 446370 - DNA, 25 bp, Rattus norvegicus
ggctgttaacacaatttctttagcg

SEQ ID NO: 446371 - DNA, 25 bp, Rattus norvegicus
ggctgttaacactatttctttagcg

SEQ ID NO: 446372 - DNA, 25 bp, Rattus norvegicus
ggctgttaacagacccatgcagtat

SEQ ID NO: 446373 - DNA, 25 bp, Rattus norvegicus
ggctgttaacagtcccatgcagtat

SEQ ID NO: 446374 - DNA, 25 bp, Rattus norvegicus
ggctgttacttgcagaagtcccggc

SEQ ID NO: 446375 - DNA, 25 bp, Rattus norvegicus
ggctgttacttggagaagtcccggc

SEQ ID NO: 446376 - DNA, 25 bp, Rattus norvegicus
ggctgttatgttaactggaccatca

SEQ ID NO: 446377 - DNA, 25 bp, Rattus norvegicus
ggctgttatgtttactggaccatca

SEQ ID NO: 446378 - DNA, 25 bp, Rattus norvegicus
ggctgttcaaacaacacctgctaaa

SEQ ID NO: 446379 - DNA, 25 bp, Rattus norvegicus
ggctgttcaaactacacctgctaaa

SEQ ID NO: 446380 - DNA, 25 bp, Rattus norvegicus
ggctgttcaactatactttctccag

SEQ ID NO: 446381 - DNA, 25 bp, Rattus norvegicus
ggctgttcaactttactttctccag

SEQ ID NO: 446382 - DNA, 25 bp, Rattus norvegicus
ggctgttcacagagatggcatctta

SEQ ID NO: 446383 - DNA, 25 bp, Rattus norvegicus
ggctgttcacagtgatggcatctta

SEQ ID NO: 446384 - DNA, 25 bp, Rattus norvegicus
ggctgttcatctattttatttcaaa

SEQ ID NO: 446385 - DNA, 25 bp, Rattus norvegicus
ggctgttcatcttttttatttcaaa

SEQ ID NO: 446386 - DNA, 25 bp, Rattus norvegicus
ggctgttcattaaagttctccaggg

SEQ ID NO: 446387 - DNA, 25 bp, Rattus norvegicus
ggctgttcattatagttctccaggg

SEQ ID NO: 446388 - DNA, 25 bp, Rattus norvegicus
ggctgttcatttcatgctcagtaac

SEQ ID NO: 446389 - DNA, 25 bp, Rattus norvegicus
ggctgttcatttgatgctcagtaac

SEQ ID NO: 446390 - DNA, 25 bp, Rattus norvegicus
ggctgttccaaacgcccgaagtcac

SEQ ID NO: 446391 - DNA, 25 bp, Rattus norvegicus
ggctgttccaaaggcccgaagtcac

SEQ ID NO: 446392 - DNA, 25 bp, Rattus norvegicus
ggctgttccctgaataaacctcatt

SEQ ID NO: 446393 - DNA, 25 bp, Rattus norvegicus
ggctgttccctgagactggagctta

SEQ ID NO: 446394 - DNA, 25 bp, Rattus norvegicus
ggctgttccctgtataaacctcatt

SEQ ID NO: 446395 - DNA, 25 bp, Rattus norvegicus
ggctgttccctgtgactggagctta

SEQ ID NO: 446396 - DNA, 25 bp, Rattus norvegicus
ggctgttcctccagatttcctaaac

SEQ ID NO: 446397 - DNA, 25 bp, Rattus norvegicus
ggctgttcctcctgatttcctaaac

SEQ ID NO: 446398 - DNA, 25 bp, Rattus norvegicus
ggctgttctaacctgaagatgctga

SEQ ID NO: 446399 - DNA, 25 bp, Rattus norvegicus
ggctgttctaacgtgaagatgctga

SEQ ID NO: 446400 - DNA, 25 bp, Rattus norvegicus
ggctgttctacacttgtgtgtcaca

SEQ ID NO: 446401 - DNA, 25 bp, Rattus norvegicus
ggctgttctacagttgtgtgtcaca

SEQ ID NO: 446402 - DNA, 25 bp, Rattus norvegicus
ggctgttctatacaaaattggtagt

SEQ ID NO: 446403 - DNA, 25 bp, Rattus norvegicus
ggctgttctatagaaaattggtagt

SEQ ID NO: 446404 - DNA, 25 bp, Rattus norvegicus
ggctgttctcctataaatagacttt

SEQ ID NO: 446405 - DNA, 25 bp, Rattus norvegicus
ggctgttctcctttaaatagacttt

SEQ ID NO: 446406 - DNA, 25 bp, Rattus norvegicus
ggctgttctgaaattccctatgcac

SEQ ID NO: 446407 - DNA, 25 bp, Rattus norvegicus
ggctgttctgaatttccctatgcac

SEQ ID NO: 446408 - DNA, 25 bp, Rattus norvegicus
ggctgttctggccacagcttgctag

SEQ ID NO: 446409 - DNA, 25 bp, Rattus norvegicus
ggctgttctggcgacagcttgctag

SEQ ID NO: 446410 - DNA, 25 bp, Rattus norvegicus
ggctgttctgttaactgcaaaccat

SEQ ID NO: 446411 - DNA, 25 bp, Rattus norvegicus
ggctgttctgtttactgcaaaccat

SEQ ID NO: 446412 - DNA, 25 bp, Rattus norvegicus
ggctgttgaaagcacctcagaggat

SEQ ID NO: 446413 - DNA, 25 bp, Rattus norvegicus
ggctgttgaaaggacctcagaggat

SEQ ID NO: 446414 - DNA, 25 bp, Rattus norvegicus
ggctgttgaatgagtgcggaaccta

SEQ ID NO: 446415 - DNA, 25 bp, Rattus norvegicus
ggctgttgaatgtgtgcggaaccta

SEQ ID NO: 446416 - DNA, 25 bp, Rattus norvegicus
ggctgttgagacaccgagtgagcat

SEQ ID NO: 446417 - DNA, 25 bp, Rattus norvegicus
ggctgttgagactccgagtgagcat

SEQ ID NO: 446418 - DNA, 25 bp, Rattus norvegicus
ggctgttgagctccccggccctcga

SEQ ID NO: 446419 - DNA, 25 bp, Rattus norvegicus
ggctgttgagctgcccggccctcga

SEQ ID NO: 446420 - DNA, 25 bp, Rattus norvegicus
ggctgttgatgcatattctctgtaa

SEQ ID NO: 446421 - DNA, 25 bp, Rattus norvegicus
ggctgttgatgcttattctctgtaa

SEQ ID NO: 446422 - DNA, 25 bp, Rattus norvegicus
ggctgttgccagagagagcagtctt

SEQ ID NO: 446423 - DNA, 25 bp, Rattus norvegicus
ggctgttgccagtgagagcagtctt

SEQ ID NO: 446424 - DNA, 25 bp, Rattus norvegicus
ggctgttgcccactgatatactaaa

SEQ ID NO: 446425 - DNA, 25 bp, Rattus norvegicus
ggctgttgcccagtgatatactaaa

SEQ ID NO: 446426 - DNA, 25 bp, Rattus norvegicus
ggctgttgccctagggacactgttt

SEQ ID NO: 446427 - DNA, 25 bp, Rattus norvegicus
ggctgttgcccttgggacactgttt

SEQ ID NO: 446428 - DNA, 25 bp, Rattus norvegicus
ggctgttggaccacaagggcaaagc

SEQ ID NO: 446429 - DNA, 25 bp, Rattus norvegicus
ggctgttggacctcaagggcaaagc

SEQ ID NO: 446430 - DNA, 25 bp, Rattus norvegicus
ggctgttggcccaaaccgtggacta

SEQ ID NO: 446431 - DNA, 25 bp, Rattus norvegicus
ggctgttggccctaaccgtggacta

SEQ ID NO: 446432 - DNA, 25 bp, Rattus norvegicus
ggctgttggtcacttggtaactaac

SEQ ID NO: 446433 - DNA, 25 bp, Rattus norvegicus
ggctgttggtcagttggtaactaac

SEQ ID NO: 446434 - DNA, 25 bp, Rattus norvegicus
ggctgttggttgaactggtctgttt

SEQ ID NO: 446435 - DNA, 25 bp, Rattus norvegicus
ggctgttggttgtactggtctgttt

SEQ ID NO: 446436 - DNA, 25 bp, Rattus norvegicus
ggctgttgtgtgcttatgtgcttat

SEQ ID NO: 446437 - DNA, 25 bp, Rattus norvegicus
ggctgttgtgtggttatgtgcttat

SEQ ID NO: 446438 - DNA, 25 bp, Rattus norvegicus
ggctgtttacaactgccagtccatg

SEQ ID NO: 446439 - DNA, 25 bp, Rattus norvegicus
ggctgtttacaagtgccagtccatg

SEQ ID NO: 446440 - DNA, 25 bp, Rattus norvegicus
ggctgtttacagagcatttagttac

SEQ ID NO: 446441 - DNA, 25 bp, Rattus norvegicus
ggctgtttacagtgcatttagttac

SEQ ID NO: 446442 - DNA, 25 bp, Rattus norvegicus
ggctgtttagacattgggagtccca

SEQ ID NO: 446443 - DNA, 25 bp, Rattus norvegicus
ggctgtttagactttgggagtccca

SEQ ID NO: 446444 - DNA, 25 bp, Rattus norvegicus
ggctgtttatctactcagttcccaa

SEQ ID NO: 446445 - DNA, 25 bp, Rattus norvegicus
ggctgtttatcttctcagttcccaa

SEQ ID NO: 446446 - DNA, 25 bp, Rattus norvegicus
ggctgtttatgcaggctgagtctta

SEQ ID NO: 446447 - DNA, 25 bp, Rattus norvegicus
ggctgtttatgctggctgagtctta

SEQ ID NO: 446448 - DNA, 25 bp, Rattus norvegicus
ggctgtttcagcagttaatccatgc

SEQ ID NO: 446449 - DNA, 25 bp, Rattus norvegicus
ggctgtttcagctgttaatccatgc

SEQ ID NO: 446450 - DNA, 25 bp, Rattus norvegicus
ggctgtttccaaaactcttggttga

SEQ ID NO: 446451 - DNA, 25 bp, Rattus norvegicus
ggctgtttccaatactcttggttga

SEQ ID NO: 446452 - DNA, 25 bp, Rattus norvegicus
ggctgtttccagaagtaggtacatt

SEQ ID NO: 446453 - DNA, 25 bp, Rattus norvegicus
ggctgtttccagtagtaggtacatt

SEQ ID NO: 446454 - DNA, 25 bp, Rattus norvegicus
ggctgtttccctctagtcttaagag

SEQ ID NO: 446455 - DNA, 25 bp, Rattus norvegicus
ggctgtttccctgtagtcttaagag

SEQ ID NO: 446456 - DNA, 25 bp, Rattus norvegicus
ggctgtttcttgacttccagacata

SEQ ID NO: 446457 - DNA, 25 bp, Rattus norvegicus
ggctgtttcttgtcttccagacata

SEQ ID NO: 446458 - DNA, 25 bp, Rattus norvegicus
ggctgtttgaagcatcagatccgta

SEQ ID NO: 446459 - DNA, 25 bp, Rattus norvegicus
ggctgtttgaaggatcagatccgta

SEQ ID NO: 446460 - DNA, 25 bp, Rattus norvegicus
ggctgtttgcaaccgccatattcta

SEQ ID NO: 446461 - DNA, 25 bp, Rattus norvegicus
ggctgtttgcaagcgccatattcta

SEQ ID NO: 446462 - DNA, 25 bp, Rattus norvegicus
ggctgtttggttaaacatccccaag

SEQ ID NO: 446463 - DNA, 25 bp, Rattus norvegicus
ggctgtttggtttaacatccccaag

SEQ ID NO: 446464 - DNA, 25 bp, Rattus norvegicus
ggctgtttgtgccagagcttcctag

SEQ ID NO: 446465 - DNA, 25 bp, Rattus norvegicus
ggctgtttgtgcgagagcttcctag

SEQ ID NO: 446466 - DNA, 25 bp, Rattus norvegicus
ggctgttttcccattgctgatggaa

SEQ ID NO: 446467 - DNA, 25 bp, Rattus norvegicus
ggctgttttccctttgctgatggaa

SEQ ID NO: 446468 - DNA, 25 bp, Rattus norvegicus
ggctgttttcttctctgtggctgaa

SEQ ID NO: 446469 - DNA, 25 bp, Rattus norvegicus
ggctgttttcttgtctgtggctgaa

SEQ ID NO: 446470 - DNA, 25 bp, Rattus norvegicus
ggctgttttgcaatactctggtaga

SEQ ID NO: 446471 - DNA, 25 bp, Rattus norvegicus
ggctgttttgcattactctggtaga

SEQ ID NO: 446472 - DNA, 25 bp, Rattus norvegicus
ggctgtttttgaaaaattcccatgt

SEQ ID NO: 446473 - DNA, 25 bp, Rattus norvegicus
ggctgtttttgataaattcccatgt

SEQ ID NO: 446474 - DNA, 25 bp, Rattus norvegicus
ggcttaaaaattccccagctgaggt

SEQ ID NO: 446475 - DNA, 25 bp, Rattus norvegicus
ggcttaaaaattgcccagctgaggt

SEQ ID NO: 446476 - DNA, 25 bp, Rattus norvegicus
ggcttaaaacatactggttccctat

SEQ ID NO: 446477 - DNA, 25 bp, Rattus norvegicus
ggcttaaaacattctggttccctat

SEQ ID NO: 446478 - DNA, 25 bp, Rattus norvegicus
ggcttaaaagacctgatcctggaac

SEQ ID NO: 446479 - DNA, 25 bp, Rattus norvegicus
ggcttaaaagacgtgatcctggaac

SEQ ID NO: 446480 - DNA, 25 bp, Rattus norvegicus
ggcttaaacaggcatctctaccagc

SEQ ID NO: 446481 - DNA, 25 bp, Rattus norvegicus
ggcttaaacagggatctctaccagc

SEQ ID NO: 446482 - DNA, 25 bp, Rattus norvegicus
ggcttaaacatcacatggttttgta

SEQ ID NO: 446483 - DNA, 25 bp, Rattus norvegicus
ggcttaaacatctcatggttttgta

SEQ ID NO: 446484 - DNA, 25 bp, Rattus norvegicus
ggcttaacatgcatgattcttctat

SEQ ID NO: 446485 - DNA, 25 bp, Rattus norvegicus
ggcttaacatgcttgattcttctat

SEQ ID NO: 446486 - DNA, 25 bp, Rattus norvegicus
ggcttaacgtctcctggagctaagc

SEQ ID NO: 446487 - DNA, 25 bp, Rattus norvegicus
ggcttaacgtctgctggagctaagc

SEQ ID NO: 446488 - DNA, 25 bp, Rattus norvegicus
ggcttaactaaccagagaacacact

SEQ ID NO: 446489 - DNA, 25 bp, Rattus norvegicus
ggcttaactaacgagagaacacact

SEQ ID NO: 446490 - DNA, 25 bp, Rattus norvegicus
ggcttaacttacaggcctcaaaagt

SEQ ID NO: 446491 - DNA, 25 bp, Rattus norvegicus
ggcttaacttactggcctcaaaagt

SEQ ID NO: 446492 - DNA, 25 bp, Rattus norvegicus
ggcttaagcactacgatgaccacag

SEQ ID NO: 446493 - DNA, 25 bp, Rattus norvegicus
ggcttaagcacttcgatgaccacag

SEQ ID NO: 446494 - DNA, 25 bp, Rattus norvegicus
ggcttaagcctcatgatgatcctga

SEQ ID NO: 446495 - DNA, 25 bp, Rattus norvegicus
ggcttaagcctcttgatgatcctga

SEQ ID NO: 446496 - DNA, 25 bp, Rattus norvegicus
ggcttaagctggatccgagacataa

SEQ ID NO: 446497 - DNA, 25 bp, Rattus norvegicus
ggcttaagctggttccgagacataa

SEQ ID NO: 446498 - DNA, 25 bp, Rattus norvegicus
ggcttaatcttgagccttacttgta

SEQ ID NO: 446499 - DNA, 25 bp, Rattus norvegicus
ggcttaatcttgtgccttacttgta

SEQ ID NO: 446500 - DNA, 25 bp, Rattus norvegicus
ggcttaattttcaccttgaagggct

SEQ ID NO: 446501 - DNA, 25 bp, Rattus norvegicus
ggcttaattttctccttgaagggct

SEQ ID NO: 446502 - DNA, 25 bp, Rattus norvegicus
ggcttacacattagcaatgagcata

SEQ ID NO: 446503 - DNA, 25 bp, Rattus norvegicus
ggcttacacatttgcaatgagcata

SEQ ID NO: 446504 - DNA, 25 bp, Rattus norvegicus
ggcttacactgcagaatcctttggg

SEQ ID NO: 446505 - DNA, 25 bp, Rattus norvegicus
ggcttacactgctgaatcctttggg

SEQ ID NO: 446506 - DNA, 25 bp, Rattus norvegicus
ggcttacagcttaagtcctatagca

SEQ ID NO: 446507 - DNA, 25 bp, Rattus norvegicus
ggcttacagctttagtcctatagca

SEQ ID NO: 446508 - DNA, 25 bp, Rattus norvegicus
ggcttacaggagacaacacggatct

SEQ ID NO: 446509 - DNA, 25 bp, Rattus norvegicus
ggcttacaggagtcaacacggatct

SEQ ID NO: 446510 - DNA, 25 bp, Rattus norvegicus
ggcttaccacatattgagtccctag

SEQ ID NO: 446511 - DNA, 25 bp, Rattus norvegicus
ggcttaccacattttgagtccctag

SEQ ID NO: 446512 - DNA, 25 bp, Rattus norvegicus
ggcttacctaccatgcttgttaaag

SEQ ID NO: 446513 - DNA, 25 bp, Rattus norvegicus
ggcttacctaccttgcttgttaaag

SEQ ID NO: 446514 - DNA, 25 bp, Rattus norvegicus
ggcttacctggcactgactgaggct

SEQ ID NO: 446515 - DNA, 25 bp, Rattus norvegicus
ggcttacctggctctgactgaggct

SEQ ID NO: 446516 - DNA, 25 bp, Rattus norvegicus
ggcttacgaccaaaggaccattcac

SEQ ID NO: 446517 - DNA, 25 bp, Rattus norvegicus
ggcttacgaccataggaccattcac

SEQ ID NO: 446518 - DNA, 25 bp, Rattus norvegicus
ggcttacgcaatcaaccctttgtac

SEQ ID NO: 446519 - DNA, 25 bp, Rattus norvegicus
ggcttacgcaatgaaccctttgtac

SEQ ID NO: 446520 - DNA, 25 bp, Rattus norvegicus
ggcttacgcagaattgcagacttgc

SEQ ID NO: 446521 - DNA, 25 bp, Rattus norvegicus
ggcttacgcagatttgcagacttgc

SEQ ID NO: 446522 - DNA, 25 bp, Rattus norvegicus
ggcttacggctaagtgtctaggaca

SEQ ID NO: 446523 - DNA, 25 bp, Rattus norvegicus
ggcttacggctatgtgtctaggaca

SEQ ID NO: 446524 - DNA, 25 bp, Rattus norvegicus
ggcttactacaacatggccagtggt

SEQ ID NO: 446525 - DNA, 25 bp, Rattus norvegicus
ggcttactacaagatggccagtggt

SEQ ID NO: 446526 - DNA, 25 bp, Rattus norvegicus
ggcttactcaacaggttttcttaca

SEQ ID NO: 446527 - DNA, 25 bp, Rattus norvegicus
ggcttactcaactggttttcttaca

SEQ ID NO: 446528 - DNA, 25 bp, Rattus norvegicus
ggcttactcagcaggcattcttacg

SEQ ID NO: 446529 - DNA, 25 bp, Rattus norvegicus
ggcttactcagctggcattcttacg

SEQ ID NO: 446530 - DNA, 25 bp, Rattus norvegicus
ggcttactcagtaaccattcttatg

SEQ ID NO: 446531 - DNA, 25 bp, Rattus norvegicus
ggcttactcagttaccattcttatg

SEQ ID NO: 446532 - DNA, 25 bp, Rattus norvegicus
ggcttactctgcaactcgagaacta

SEQ ID NO: 446533 - DNA, 25 bp, Rattus norvegicus
ggcttactctgctactcgagaacta

SEQ ID NO: 446534 - DNA, 25 bp, Rattus norvegicus
ggcttactggccaatttgtagtttt

SEQ ID NO: 446535 - DNA, 25 bp, Rattus norvegicus
ggcttactggcctatttgtagtttt

SEQ ID NO: 446536 - DNA, 25 bp, Rattus norvegicus
ggcttactgtatactcttggtggat

SEQ ID NO: 446537 - DNA, 25 bp, Rattus norvegicus
ggcttactgtattctcttggtggat

SEQ ID NO: 446538 - DNA, 25 bp, Rattus norvegicus
ggcttactgtcacattttcttagga

SEQ ID NO: 446539 - DNA, 25 bp, Rattus norvegicus
ggcttactgtcagattttcttagga

SEQ ID NO: 446540 - DNA, 25 bp, Rattus norvegicus
ggcttacttctcatccattgattaa

SEQ ID NO: 446541 - DNA, 25 bp, Rattus norvegicus
ggcttacttctcttccattgattaa

SEQ ID NO: 446542 - DNA, 25 bp, Rattus norvegicus
ggcttacttgggatggtatgataac

SEQ ID NO: 446543 - DNA, 25 bp, Rattus norvegicus
ggcttacttgggttggtatgataac

SEQ ID NO: 446544 - DNA, 25 bp, Rattus norvegicus
ggcttagaagtgactgctccatcgc

SEQ ID NO: 446545 - DNA, 25 bp, Rattus norvegicus
ggcttagaagtgtctgctccatcgc

SEQ ID NO: 446546 - DNA, 25 bp, Rattus norvegicus
ggcttagagcctcacgttacaaaag

SEQ ID NO: 446547 - DNA, 25 bp, Rattus norvegicus
ggcttagagcctgacgttacaaaag

SEQ ID NO: 446548 - DNA, 25 bp, Rattus norvegicus
ggcttagagctcaacccagatacct

SEQ ID NO: 446549 - DNA, 25 bp, Rattus norvegicus
ggcttagagctctacccagatacct

SEQ ID NO: 446550 - DNA, 25 bp, Rattus norvegicus
ggcttagagctgacttagtcactac

SEQ ID NO: 446551 - DNA, 25 bp, Rattus norvegicus
ggcttagagctgtcttagtcactac

SEQ ID NO: 446552 - DNA, 25 bp, Rattus norvegicus
ggcttagcaattccactatgtgtac

SEQ ID NO: 446553 - DNA, 25 bp, Rattus norvegicus
ggcttagcaattgcactatgtgtac

SEQ ID NO: 446554 - DNA, 25 bp, Rattus norvegicus
ggcttagcactgaactgccacataa

SEQ ID NO: 446555 - DNA, 25 bp, Rattus norvegicus
ggcttagcactgtactgccacataa

SEQ ID NO: 446556 - DNA, 25 bp, Rattus norvegicus
ggcttagcattcacagtcagtgttt

SEQ ID NO: 446557 - DNA, 25 bp, Rattus norvegicus
ggcttagcattctcagtcagtgttt

SEQ ID NO: 446558 - DNA, 25 bp, Rattus norvegicus
ggcttagccactacatgtggacatt

SEQ ID NO: 446559 - DNA, 25 bp, Rattus norvegicus
ggcttagccacttcatgtggacatt

SEQ ID NO: 446560 - DNA, 25 bp, Rattus norvegicus
ggcttagctgtgaatatctgaccat

SEQ ID NO: 446561 - DNA, 25 bp, Rattus norvegicus
ggcttagctgtgtatatctgaccat

SEQ ID NO: 446562 - DNA, 25 bp, Rattus norvegicus
ggcttaggattacagctcagtggta

SEQ ID NO: 446563 - DNA, 25 bp, Rattus norvegicus
ggcttaggattagagctcagtggta

SEQ ID NO: 446564 - DNA, 25 bp, Rattus norvegicus
ggcttaggttgcattgttcaactct

SEQ ID NO: 446565 - DNA, 25 bp, Rattus norvegicus
ggcttaggttgctttgttcaactct

SEQ ID NO: 446566 - DNA, 25 bp, Rattus norvegicus
ggcttagtaagtacccaggctgcac

SEQ ID NO: 446567 - DNA, 25 bp, Rattus norvegicus
ggcttagtaagtctgtgctctcctg

SEQ ID NO: 446568 - DNA, 25 bp, Rattus norvegicus
ggcttagtaagtgtgtgctctcctg

SEQ ID NO: 446569 - DNA, 25 bp, Rattus norvegicus
ggcttagtaagttcccaggctgcac

SEQ ID NO: 446570 - DNA, 25 bp, Rattus norvegicus
ggcttagtaatgaacacgaacctga

SEQ ID NO: 446571 - DNA, 25 bp, Rattus norvegicus
ggcttagtaatgtacacgaacctga

SEQ ID NO: 446572 - DNA, 25 bp, Rattus norvegicus
ggcttagtccttagctttttcaaca

SEQ ID NO: 446573 - DNA, 25 bp, Rattus norvegicus
ggcttagtcctttgctttttcaaca

SEQ ID NO: 446574 - DNA, 25 bp, Rattus norvegicus
ggcttagtctctatccgtctgtatt

SEQ ID NO: 446575 - DNA, 25 bp, Rattus norvegicus
ggcttagtctctttccgtctgtatt

SEQ ID NO: 446576 - DNA, 25 bp, Rattus norvegicus
ggcttagtgaagaccatgtactgct

SEQ ID NO: 446577 - DNA, 25 bp, Rattus norvegicus
ggcttagtgaagtccatgtactgct

SEQ ID NO: 446578 - DNA, 25 bp, Rattus norvegicus
ggcttagttagaaatctctgtgtat

SEQ ID NO: 446579 - DNA, 25 bp, Rattus norvegicus
ggcttagttagatatctctgtgtat

SEQ ID NO: 446580 - DNA, 25 bp, Rattus norvegicus
ggcttagtttgtctgttgtctctga

SEQ ID NO: 446581 - DNA, 25 bp, Rattus norvegicus
ggcttagtttgtgtgttgtctctga

SEQ ID NO: 446582 - DNA, 25 bp, Rattus norvegicus
ggcttatacagtctgagcgtatgga

SEQ ID NO: 446583 - DNA, 25 bp, Rattus norvegicus
ggcttatacagtgtgagcgtatgga

SEQ ID NO: 446584 - DNA, 25 bp, Rattus norvegicus
ggcttatagcttagcttggtgtcta

SEQ ID NO: 446585 - DNA, 25 bp, Rattus norvegicus
ggcttatagctttgcttggtgtcta

SEQ ID NO: 446586 - DNA, 25 bp, Rattus norvegicus
ggcttatagttcaatggctgagaat

SEQ ID NO: 446587 - DNA, 25 bp, Rattus norvegicus
ggcttatagttctatggctgagaat

SEQ ID NO: 446588 - DNA, 25 bp, Rattus norvegicus
ggcttatatctgcttggcttgttca

SEQ ID NO: 446589 - DNA, 25 bp, Rattus norvegicus
ggcttatatctggttggcttgttca

SEQ ID NO: 446590 - DNA, 25 bp, Rattus norvegicus
ggcttatattccatacgttggcatg

SEQ ID NO: 446591 - DNA, 25 bp, Rattus norvegicus
ggcttatattccttacgttggcatg

SEQ ID NO: 446592 - DNA, 25 bp, Rattus norvegicus
ggcttatcagccagaccatcagaca

SEQ ID NO: 446593 - DNA, 25 bp, Rattus norvegicus
ggcttatcagcctgaccatcagaca

SEQ ID NO: 446594 - DNA, 25 bp, Rattus norvegicus
ggcttatcggagaggaggctacaaa

SEQ ID NO: 446595 - DNA, 25 bp, Rattus norvegicus
ggcttatcggagtggaggctacaaa

SEQ ID NO: 446596 - DNA, 25 bp, Rattus norvegicus
ggcttatctacacgaggttcactct

SEQ ID NO: 446597 - DNA, 25 bp, Rattus norvegicus
ggcttatctacaggaggttcactct

SEQ ID NO: 446598 - DNA, 25 bp, Rattus norvegicus
ggcttatctcctcccaatgaagtgt

SEQ ID NO: 446599 - DNA, 25 bp, Rattus norvegicus
ggcttatctcctgccaatgaagtgt

SEQ ID NO: 446600 - DNA, 25 bp, Rattus norvegicus
ggcttatgtactcttctgaatcttg

SEQ ID NO: 446601 - DNA, 25 bp, Rattus norvegicus
ggcttatgtactgttctgaatcttg

SEQ ID NO: 446602 - DNA, 25 bp, Rattus norvegicus
ggcttattcccaatgcttcattgat

SEQ ID NO: 446603 - DNA, 25 bp, Rattus norvegicus
ggcttattcccattgcttcattgat

SEQ ID NO: 446604 - DNA, 25 bp, Rattus norvegicus
ggcttatttaccaagactgtgtgtg

SEQ ID NO: 446605 - DNA, 25 bp, Rattus norvegicus
ggcttatttacctagactgtgtgtg

SEQ ID NO: 446606 - DNA, 25 bp, Rattus norvegicus
ggcttatttgtgaactgtgtgagtc

SEQ ID NO: 446607 - DNA, 25 bp, Rattus norvegicus
ggcttatttgtgtactgtgtgagtc

SEQ ID NO: 446608 - DNA, 25 bp, Rattus norvegicus
ggcttattttagacctcatggctgc

SEQ ID NO: 446609 - DNA, 25 bp, Rattus norvegicus
ggcttattttagtcctcatggctgc

SEQ ID NO: 446610 - DNA, 25 bp, Rattus norvegicus
ggcttcaaacaacatgctctctcaa

SEQ ID NO: 446611 - DNA, 25 bp, Rattus norvegicus
ggcttcaaacaagatgctctctcaa

SEQ ID NO: 446612 - DNA, 25 bp, Rattus norvegicus
ggcttcaaacccacggtgagggatt

SEQ ID NO: 446613 - DNA, 25 bp, Rattus norvegicus
ggcttcaaaccctcggtgagggatt

SEQ ID NO: 446614 - DNA, 25 bp, Rattus norvegicus
ggcttcaaactcactgcagctaaag

SEQ ID NO: 446615 - DNA, 25 bp, Rattus norvegicus
ggcttcaaactctctgcagctaaag

SEQ ID NO: 446616 - DNA, 25 bp, Rattus norvegicus
ggcttcaaacttcagacccttctga

SEQ ID NO: 446617 - DNA, 25 bp, Rattus norvegicus
ggcttcaaacttgagacccttctga

SEQ ID NO: 446618 - DNA, 25 bp, Rattus norvegicus
ggcttcaaagcgcttcagtatctga

SEQ ID NO: 446619 - DNA, 25 bp, Rattus norvegicus
ggcttcaaagcggttcagtatctga

SEQ ID NO: 446620 - DNA, 25 bp, Rattus norvegicus
ggcttcaaccacaacgggaacatat

SEQ ID NO: 446621 - DNA, 25 bp, Rattus norvegicus
ggcttcaaccactacgggaacatat

SEQ ID NO: 446622 - DNA, 25 bp, Rattus norvegicus
ggcttcaaccatcttccttggtaaa

SEQ ID NO: 446623 - DNA, 25 bp, Rattus norvegicus
ggcttcaaccatgttccttggtaaa

SEQ ID NO: 446624 - DNA, 25 bp, Rattus norvegicus
ggcttcaagagaactgtgctgggca

SEQ ID NO: 446625 - DNA, 25 bp, Rattus norvegicus
ggcttcaagagatctgtgctgggca

SEQ ID NO: 446626 - DNA, 25 bp, Rattus norvegicus
ggcttcaaggtgatgactaatgtct

SEQ ID NO: 446627 - DNA, 25 bp, Rattus norvegicus
ggcttcaaggtgttgactaatgtct

SEQ ID NO: 446628 - DNA, 25 bp, Rattus norvegicus
ggcttcaattttaatactcctctct

SEQ ID NO: 446629 - DNA, 25 bp, Rattus norvegicus
ggcttcaatttttatactcctctct

SEQ ID NO: 446630 - DNA, 25 bp, Rattus norvegicus
ggcttcacagttagctaaggctgca

SEQ ID NO: 446631 - DNA, 25 bp, Rattus norvegicus
ggcttcacagtttgctaaggctgca

SEQ ID NO: 446632 - DNA, 25 bp, Rattus norvegicus
ggcttcacatggcttcacatggcat

SEQ ID NO: 446633 - DNA, 25 bp, Rattus norvegicus
ggcttcacatgggttcacatggcat

SEQ ID NO: 446634 - DNA, 25 bp, Rattus norvegicus
ggcttcaccagaccaggcttttgct

SEQ ID NO: 446635 - DNA, 25 bp, Rattus norvegicus
ggcttcaccagagcaggcttttgct

SEQ ID NO: 446636 - DNA, 25 bp, Rattus norvegicus
ggcttcacccagcacttcaaggaga

SEQ ID NO: 446637 - DNA, 25 bp, Rattus norvegicus
ggcttcacccaggacttcaaggaga

SEQ ID NO: 446638 - DNA, 25 bp, Rattus norvegicus
ggcttcacccttattacttggacaa

SEQ ID NO: 446639 - DNA, 25 bp, Rattus norvegicus
ggcttcaccctttttacttggacaa

SEQ ID NO: 446640 - DNA, 25 bp, Rattus norvegicus
ggcttcacctctaatgttctgtatt

SEQ ID NO: 446641 - DNA, 25 bp, Rattus norvegicus
ggcttcacctcttatgttctgtatt

SEQ ID NO: 446642 - DNA, 25 bp, Rattus norvegicus
ggcttcacgaagctggtttaccaaa

SEQ ID NO: 446643 - DNA, 25 bp, Rattus norvegicus
ggcttcacgaaggtggtttaccaaa

SEQ ID NO: 446644 - DNA, 25 bp, Rattus norvegicus
ggcttcactacactatgtcccttaa

SEQ ID NO: 446645 - DNA, 25 bp, Rattus norvegicus
ggcttcactacagtatgtcccttaa

SEQ ID NO: 446646 - DNA, 25 bp, Rattus norvegicus
ggcttcactgtgcttcaagtccaga

SEQ ID NO: 446647 - DNA, 25 bp, Rattus norvegicus
ggcttcactgtggttcaagtccaga

SEQ ID NO: 446648 - DNA, 25 bp, Rattus norvegicus
ggcttcacttggacacctcagagag

SEQ ID NO: 446649 - DNA, 25 bp, Rattus norvegicus
ggcttcacttggtcacctcagagag

SEQ ID NO: 446650 - DNA, 25 bp, Rattus norvegicus
ggcttcagaaaaacatccagaagtt

SEQ ID NO: 446651 - DNA, 25 bp, Rattus norvegicus
ggcttcagaaaatcatccagaagtt

SEQ ID NO: 446652 - DNA, 25 bp, Rattus norvegicus
ggcttcagaagcatcctttttgatt

SEQ ID NO: 446653 - DNA, 25 bp, Rattus norvegicus
ggcttcagaagcttcctttttgatt

SEQ ID NO: 446654 - DNA, 25 bp, Rattus norvegicus
ggcttcagaaggcattcctgctgtt

SEQ ID NO: 446655 - DNA, 25 bp, Rattus norvegicus
ggcttcagaagggattcctgctgtt

SEQ ID NO: 446656 - DNA, 25 bp, Rattus norvegicus
ggcttcagactcatggaaatccacc

SEQ ID NO: 446657 - DNA, 25 bp, Rattus norvegicus
ggcttcagactcttggaaatccacc

SEQ ID NO: 446658 - DNA, 25 bp, Rattus norvegicus
ggcttcagagacacacaaggccatc

SEQ ID NO: 446659 - DNA, 25 bp, Rattus norvegicus
ggcttcagagactcacaaggccatc

SEQ ID NO: 446660 - DNA, 25 bp, Rattus norvegicus
ggcttcagagagaaaaccctgtcta

SEQ ID NO: 446661 - DNA, 25 bp, Rattus norvegicus
ggcttcagagagtaaaccctgtcta

SEQ ID NO: 446662 - DNA, 25 bp, Rattus norvegicus
ggcttcagagcgataatacactatt

SEQ ID NO: 446663 - DNA, 25 bp, Rattus norvegicus
ggcttcagagcgttaatacactatt

SEQ ID NO: 446664 - DNA, 25 bp, Rattus norvegicus
ggcttcagcacaagtggagacccac

SEQ ID NO: 446665 - DNA, 25 bp, Rattus norvegicus
ggcttcagcacatgtggagacccac

SEQ ID NO: 446666 - DNA, 25 bp, Rattus norvegicus
ggcttcagcaccaagaactcttcag

SEQ ID NO: 446667 - DNA, 25 bp, Rattus norvegicus
ggcttcagcacctagaactcttcag

SEQ ID NO: 446668 - DNA, 25 bp, Rattus norvegicus
ggcttcagcactcatcactgggatg

SEQ ID NO: 446669 - DNA, 25 bp, Rattus norvegicus
ggcttcagcactgatcactgggatg

SEQ ID NO: 446670 - DNA, 25 bp, Rattus norvegicus
ggcttcagcgtcattagctctcctc

SEQ ID NO: 446671 - DNA, 25 bp, Rattus norvegicus
ggcttcagcgtctttagctctcctc

SEQ ID NO: 446672 - DNA, 25 bp, Rattus norvegicus
ggcttcagcgtgcagaccatcatga

SEQ ID NO: 446673 - DNA, 25 bp, Rattus norvegicus
ggcttcagcgtggagaccatcatga

SEQ ID NO: 446674 - DNA, 25 bp, Rattus norvegicus
ggcttcaggaatagacagtctgtca

SEQ ID NO: 446675 - DNA, 25 bp, Rattus norvegicus
ggcttcaggaattgacagtctgtca

SEQ ID NO: 446676 - DNA, 25 bp, Rattus norvegicus
ggcttcagtggccttgtcacataat

SEQ ID NO: 446677 - DNA, 25 bp, Rattus norvegicus
ggcttcagtggcgttgtcacataat

SEQ ID NO: 446678 - DNA, 25 bp, Rattus norvegicus
ggcttcagtgtgactgcctttctga

SEQ ID NO: 446679 - DNA, 25 bp, Rattus norvegicus
ggcttcagtgtgtctgcctttctga

SEQ ID NO: 446680 - DNA, 25 bp, Rattus norvegicus
ggcttcatagttctttctcatgtac

SEQ ID NO: 446681 - DNA, 25 bp, Rattus norvegicus
ggcttcatagttgtttctcatgtac

SEQ ID NO: 446682 - DNA, 25 bp, Rattus norvegicus
ggcttcatcaatattcctcgattac

SEQ ID NO: 446683 - DNA, 25 bp, Rattus norvegicus
ggcttcatcaattttcctcgattac

SEQ ID NO: 446684 - DNA, 25 bp, Rattus norvegicus
ggcttcatcaccataagggctgttc

SEQ ID NO: 446685 - DNA, 25 bp, Rattus norvegicus
ggcttcatcaccttaagggctgttc

SEQ ID NO: 446686 - DNA, 25 bp, Rattus norvegicus
ggcttcatccagcagcgggaactgc

SEQ ID NO: 446687 - DNA, 25 bp, Rattus norvegicus
ggcttcatccaggagcgggaactgc

SEQ ID NO: 446688 - DNA, 25 bp, Rattus norvegicus
ggcttcatgaggaaactcacccaga

SEQ ID NO: 446689 - DNA, 25 bp, Rattus norvegicus
ggcttcatgaggtaactcacccaga

SEQ ID NO: 446690 - DNA, 25 bp, Rattus norvegicus
ggcttcatgccgcaactctatggag

SEQ ID NO: 446691 - DNA, 25 bp, Rattus norvegicus
ggcttcatgccggaactctatggag

SEQ ID NO: 446692 - DNA, 25 bp, Rattus norvegicus
ggcttcatggtgagcactggttccc

SEQ ID NO: 446693 - DNA, 25 bp, Rattus norvegicus
ggcttcatggtgtgcactggttccc

SEQ ID NO: 446694 - DNA, 25 bp, Rattus norvegicus
ggcttcatgtctcagggattctgca

SEQ ID NO: 446695 - DNA, 25 bp, Rattus norvegicus
ggcttcatgtctgagggattctgca

SEQ ID NO: 446696 - DNA, 25 bp, Rattus norvegicus
ggcttcattcttactgtcatttcaa

SEQ ID NO: 446697 - DNA, 25 bp, Rattus norvegicus
ggcttcattctttctgtcatttcaa

SEQ ID NO: 446698 - DNA, 25 bp, Rattus norvegicus
ggcttcattgacatcatcggccaag

SEQ ID NO: 446699 - DNA, 25 bp, Rattus norvegicus
ggcttcattgacttcatcggccaag

SEQ ID NO: 446700 - DNA, 25 bp, Rattus norvegicus
ggcttcatttcaatttcaccagtgg

SEQ ID NO: 446701 - DNA, 25 bp, Rattus norvegicus
ggcttcatttcattttcaccagtgg

SEQ ID NO: 446702 - DNA, 25 bp, Rattus norvegicus
ggcttccaaattccctccgatttta

SEQ ID NO: 446703 - DNA, 25 bp, Rattus norvegicus
ggcttccaaattgcctccgatttta

SEQ ID NO: 446704 - DNA, 25 bp, Rattus norvegicus
ggcttccaacgccttatacacagag

SEQ ID NO: 446705 - DNA, 25 bp, Rattus norvegicus
ggcttccaacgcgttatacacagag

SEQ ID NO: 446706 - DNA, 25 bp, Rattus norvegicus
ggcttccaactgcacacggtttttt

SEQ ID NO: 446707 - DNA, 25 bp, Rattus norvegicus
ggcttccaactggacacggtttttt

SEQ ID NO: 446708 - DNA, 25 bp, Rattus norvegicus
ggcttccaagcaaaaatcttccctg

SEQ ID NO: 446709 - DNA, 25 bp, Rattus norvegicus
ggcttccaagcataaatcttccctg

SEQ ID NO: 446710 - DNA, 25 bp, Rattus norvegicus
ggcttccaatgcacttcaaatttta

SEQ ID NO: 446711 - DNA, 25 bp, Rattus norvegicus
ggcttccaatgccaatctacttaag

SEQ ID NO: 446712 - DNA, 25 bp, Rattus norvegicus
ggcttccaatgcgaatctacttaag

SEQ ID NO: 446713 - DNA, 25 bp, Rattus norvegicus
ggcttccaatgctcttcaaatttta

SEQ ID NO: 446714 - DNA, 25 bp, Rattus norvegicus
ggcttccacacacacctttctagaa

SEQ ID NO: 446715 - DNA, 25 bp, Rattus norvegicus
ggcttccacacagacctttctagaa

SEQ ID NO: 446716 - DNA, 25 bp, Rattus norvegicus
ggcttccaccaaccagccatataaa

SEQ ID NO: 446717 - DNA, 25 bp, Rattus norvegicus
ggcttccaccaagcagccatataaa

SEQ ID NO: 446718 - DNA, 25 bp, Rattus norvegicus
ggcttccaccacatacagagagttt

SEQ ID NO: 446719 - DNA, 25 bp, Rattus norvegicus
ggcttccaccacttacagagagttt

SEQ ID NO: 446720 - DNA, 25 bp, Rattus norvegicus
ggcttccactgtacagccaagggaa

SEQ ID NO: 446721 - DNA, 25 bp, Rattus norvegicus
ggcttccactgttcagccaagggaa

SEQ ID NO: 446722 - DNA, 25 bp, Rattus norvegicus
ggcttccagaagcatgctcaccaaa

SEQ ID NO: 446723 - DNA, 25 bp, Rattus norvegicus
ggcttccagaaggatgctcaccaaa

SEQ ID NO: 446724 - DNA, 25 bp, Rattus norvegicus
ggcttccagagcattctatcactag

SEQ ID NO: 446725 - DNA, 25 bp, Rattus norvegicus
ggcttccagagctttctatcactag

SEQ ID NO: 446726 - DNA, 25 bp, Rattus norvegicus
ggcttccagatcagtaagattgtat

SEQ ID NO: 446727 - DNA, 25 bp, Rattus norvegicus
ggcttccagatctgtaagattgtat

SEQ ID NO: 446728 - DNA, 25 bp, Rattus norvegicus
ggcttccagattaaatacgtcacag

SEQ ID NO: 446729 - DNA, 25 bp, Rattus norvegicus
ggcttccagatttaatacgtcacag

SEQ ID NO: 446730 - DNA, 25 bp, Rattus norvegicus
ggcttccagccaccaggattacatt

SEQ ID NO: 446731 - DNA, 25 bp, Rattus norvegicus
ggcttccagccagcaggattacatt

SEQ ID NO: 446732 - DNA, 25 bp, Rattus norvegicus
ggcttccaggctaagaggcggccat

SEQ ID NO: 446733 - DNA, 25 bp, Rattus norvegicus
ggcttccaggcttagaggcggccat

SEQ ID NO: 446734 - DNA, 25 bp, Rattus norvegicus
ggcttccagtagaaaaccacccaga

SEQ ID NO: 446735 - DNA, 25 bp, Rattus norvegicus
ggcttccagtagtaaaccacccaga

SEQ ID NO: 446736 - DNA, 25 bp, Rattus norvegicus
ggcttccagtctagtccattagtga

SEQ ID NO: 446737 - DNA, 25 bp, Rattus norvegicus
ggcttccagtcttgtccattagtga

SEQ ID NO: 446738 - DNA, 25 bp, Rattus norvegicus
ggcttccagtggacttcagtctgtc

SEQ ID NO: 446739 - DNA, 25 bp, Rattus norvegicus
ggcttccagtggtcttcagtctgtc

SEQ ID NO: 446740 - DNA, 25 bp, Rattus norvegicus
ggcttccatcatacagaggttccga

SEQ ID NO: 446741 - DNA, 25 bp, Rattus norvegicus
ggcttccatcattcagaggttccga

SEQ ID NO: 446742 - DNA, 25 bp, Rattus norvegicus
ggcttccatcttatagagcaggcct

SEQ ID NO: 446743 - DNA, 25 bp, Rattus norvegicus
ggcttccatcttttagagcaggcct

SEQ ID NO: 446744 - DNA, 25 bp, Rattus norvegicus
ggcttccatgagctgcgcagcctca

SEQ ID NO: 446745 - DNA, 25 bp, Rattus norvegicus
ggcttccatgaggtgcgcagcctca

SEQ ID NO: 446746 - DNA, 25 bp, Rattus norvegicus
ggcttcccaaatcccttggcagaaa

SEQ ID NO: 446747 - DNA, 25 bp, Rattus norvegicus
ggcttcccaaatgccttggcagaaa

SEQ ID NO: 446748 - DNA, 25 bp, Rattus norvegicus
ggcttcccaatgactcctgagagga

SEQ ID NO: 446749 - DNA, 25 bp, Rattus norvegicus
ggcttcccaatgtctcctgagagga

SEQ ID NO: 446750 - DNA, 25 bp, Rattus norvegicus
ggcttcccagcaaagtgcatctgag

SEQ ID NO: 446751 - DNA, 25 bp, Rattus norvegicus
ggcttcccagcatagtgcatctgag

SEQ ID NO: 446752 - DNA, 25 bp, Rattus norvegicus
ggcttcccaggtagataaaaggcat

SEQ ID NO: 446753 - DNA, 25 bp, Rattus norvegicus
ggcttcccaggtcgtgtacattgat

SEQ ID NO: 446754 - DNA, 25 bp, Rattus norvegicus
ggcttcccaggtggtgtacattgat

SEQ ID NO: 446755 - DNA, 25 bp, Rattus norvegicus
ggcttcccaggttgataaaaggcat

SEQ ID NO: 446756 - DNA, 25 bp, Rattus norvegicus
ggcttcccatgtattcctgtgataa

SEQ ID NO: 446757 - DNA, 25 bp, Rattus norvegicus
ggcttcccatgttttcctgtgataa

SEQ ID NO: 446758 - DNA, 25 bp, Rattus norvegicus
ggcttccccgaaattacaactgcat

SEQ ID NO: 446759 - DNA, 25 bp, Rattus norvegicus
ggcttccccgaatttacaactgcat

SEQ ID NO: 446760 - DNA, 25 bp, Rattus norvegicus
ggcttcccggaactgcgaacgaact

SEQ ID NO: 446761 - DNA, 25 bp, Rattus norvegicus
ggcttcccggaagtgcgaacgaact

SEQ ID NO: 446762 - DNA, 25 bp, Rattus norvegicus
ggcttcccgtgacgtttggagtaat

SEQ ID NO: 446763 - DNA, 25 bp, Rattus norvegicus
ggcttcccgtgaggtttggagtaat

SEQ ID NO: 446764 - DNA, 25 bp, Rattus norvegicus
ggcttccctaagcacacacatggaa

SEQ ID NO: 446765 - DNA, 25 bp, Rattus norvegicus
ggcttccctaaggacacacatggaa

SEQ ID NO: 446766 - DNA, 25 bp, Rattus norvegicus
ggcttccctcagagctggcgggacc

SEQ ID NO: 446767 - DNA, 25 bp, Rattus norvegicus
ggcttccctcagtgctggcgggacc

SEQ ID NO: 446768 - DNA, 25 bp, Rattus norvegicus
ggcttccctggcctgaaagaagtca

SEQ ID NO: 446769 - DNA, 25 bp, Rattus norvegicus
ggcttccctggcgtgaaagaagtca

SEQ ID NO: 446770 - DNA, 25 bp, Rattus norvegicus
ggcttccctggtcacactgagcgaa

SEQ ID NO: 446771 - DNA, 25 bp, Rattus norvegicus
ggcttccctggtgacactgagcgaa

SEQ ID NO: 446772 - DNA, 25 bp, Rattus norvegicus
ggcttcccttagatcatgtgtagat

SEQ ID NO: 446773 - DNA, 25 bp, Rattus norvegicus
ggcttcccttagttcatgtgtagat

SEQ ID NO: 446774 - DNA, 25 bp, Rattus norvegicus
ggcttcccttccactacaagacggg

SEQ ID NO: 446775 - DNA, 25 bp, Rattus norvegicus
ggcttcccttcctctacaagacggg

SEQ ID NO: 446776 - DNA, 25 bp, Rattus norvegicus
ggcttccgaccaaccagtgattgaa

SEQ ID NO: 446777 - DNA, 25 bp, Rattus norvegicus
ggcttccgaccatccagtgattgaa

SEQ ID NO: 446778 - DNA, 25 bp, Rattus norvegicus
ggcttccgtgatcagtgcgctccga

SEQ ID NO: 446779 - DNA, 25 bp, Rattus norvegicus
ggcttccgtgatgagtgcgctccga

SEQ ID NO: 446780 - DNA, 25 bp, Rattus norvegicus
ggcttcctatatagaccaggacatg

SEQ ID NO: 446781 - DNA, 25 bp, Rattus norvegicus
ggcttcctatattgaccaggacatg

SEQ ID NO: 446782 - DNA, 25 bp, Rattus norvegicus
ggcttcctattcatgtcttggtgac

SEQ ID NO: 446783 - DNA, 25 bp, Rattus norvegicus
ggcttcctattcttgtcttggtgac

SEQ ID NO: 446784 - DNA, 25 bp, Rattus norvegicus
ggcttcctcagcagggttgtcccat

SEQ ID NO: 446785 - DNA, 25 bp, Rattus norvegicus
ggcttcctcagctgggttgtcccat

SEQ ID NO: 446786 - DNA, 25 bp, Rattus norvegicus
ggcttcctcatgaaactggattcaa

SEQ ID NO: 446787 - DNA, 25 bp, Rattus norvegicus
ggcttcctcatgtaactggattcaa

SEQ ID NO: 446788 - DNA, 25 bp, Rattus norvegicus
ggcttcctccacaagtcaggactaa

SEQ ID NO: 446789 - DNA, 25 bp, Rattus norvegicus
ggcttcctccactagtcaggactaa

SEQ ID NO: 446790 - DNA, 25 bp, Rattus norvegicus
ggcttcctccgactaccacaaaaga

SEQ ID NO: 446791 - DNA, 25 bp, Rattus norvegicus
ggcttcctccgagtaccacaaaaga

SEQ ID NO: 446792 - DNA, 25 bp, Rattus norvegicus
ggcttcctcctaattggtcattaaa

SEQ ID NO: 446793 - DNA, 25 bp, Rattus norvegicus
ggcttcctcctatttggtcattaaa

SEQ ID NO: 446794 - DNA, 25 bp, Rattus norvegicus
ggcttcctcgcgacagctttgggca

SEQ ID NO: 446795 - DNA, 25 bp, Rattus norvegicus
ggcttcctcgcgtcagctttgggca

SEQ ID NO: 446796 - DNA, 25 bp, Rattus norvegicus
ggcttcctctgcagatgaccaggta

SEQ ID NO: 446797 - DNA, 25 bp, Rattus norvegicus
ggcttcctctgctgatgaccaggta

SEQ ID NO: 446798 - DNA, 25 bp, Rattus norvegicus
ggcttcctcttcagggtgattgttc

SEQ ID NO: 446799 - DNA, 25 bp, Rattus norvegicus
ggcttcctcttctgggtgattgttc

SEQ ID NO: 446800 - DNA, 25 bp, Rattus norvegicus
ggcttcctgcacaaggaacagggtg

SEQ ID NO: 446801 - DNA, 25 bp, Rattus norvegicus
ggcttcctgcactaggaacagggtg

SEQ ID NO: 446802 - DNA, 25 bp, Rattus norvegicus
ggcttcctgtgaacactaaacagtg

SEQ ID NO: 446803 - DNA, 25 bp, Rattus norvegicus
ggcttcctgtgatcactaaacagtg

SEQ ID NO: 446804 - DNA, 25 bp, Rattus norvegicus
ggcttcctgttcctactcataaaaa

SEQ ID NO: 446805 - DNA, 25 bp, Rattus norvegicus
ggcttcctgttcgtactcataaaaa

SEQ ID NO: 446806 - DNA, 25 bp, Rattus norvegicus
ggcttcctgttgctcttgtgtttcc

SEQ ID NO: 446807 - DNA, 25 bp, Rattus norvegicus
ggcttcctgttggtcttgtgtttcc

SEQ ID NO: 446808 - DNA, 25 bp, Rattus norvegicus
ggcttccttagcctttgagaccaaa

SEQ ID NO: 446809 - DNA, 25 bp, Rattus norvegicus
ggcttccttagcgtttgagaccaaa

SEQ ID NO: 446810 - DNA, 25 bp, Rattus norvegicus
ggcttccttccactacagtaaaaat

SEQ ID NO: 446811 - DNA, 25 bp, Rattus norvegicus
ggcttccttccagtacagtaaaaat

SEQ ID NO: 446812 - DNA, 25 bp, Rattus norvegicus
ggcttcctttatcttttgcactgat

SEQ ID NO: 446813 - DNA, 25 bp, Rattus norvegicus
ggcttcctttatgttttgcactgat

SEQ ID NO: 446814 - DNA, 25 bp, Rattus norvegicus
ggcttcctttgaactattactgtaa

SEQ ID NO: 446815 - DNA, 25 bp, Rattus norvegicus
ggcttcctttgatctattactgtaa

SEQ ID NO: 446816 - DNA, 25 bp, Rattus norvegicus
ggcttcgaagaaaacatccagggtg

SEQ ID NO: 446817 - DNA, 25 bp, Rattus norvegicus
ggcttcgaagaatacatccagggtg

SEQ ID NO: 446818 - DNA, 25 bp, Rattus norvegicus
ggcttcgagaacctctatatcggtc

SEQ ID NO: 446819 - DNA, 25 bp, Rattus norvegicus
ggcttcgagaacgtctatatcggtc

SEQ ID NO: 446820 - DNA, 25 bp, Rattus norvegicus
ggcttcgagactcgctgacttcaga

SEQ ID NO: 446821 - DNA, 25 bp, Rattus norvegicus
ggcttcgagactggctgacttcaga

SEQ ID NO: 446822 - DNA, 25 bp, Rattus norvegicus
ggcttcgagcccacacaggagggaa

SEQ ID NO: 446823 - DNA, 25 bp, Rattus norvegicus
ggcttcgagccctcacaggagggaa

SEQ ID NO: 446824 - DNA, 25 bp, Rattus norvegicus
ggcttcgccggactttattttgaga

SEQ ID NO: 446825 - DNA, 25 bp, Rattus norvegicus
ggcttcgccggagtttattttgaga

SEQ ID NO: 446826 - DNA, 25 bp, Rattus norvegicus
ggcttcgctataaaccatgctatcg

SEQ ID NO: 446827 - DNA, 25 bp, Rattus norvegicus
ggcttcgctatataccatgctatcg

SEQ ID NO: 446828 - DNA, 25 bp, Rattus norvegicus
ggcttcgcttcgatagatactggat

SEQ ID NO: 446829 - DNA, 25 bp, Rattus norvegicus
ggcttcgcttcgttagatactggat

SEQ ID NO: 446830 - DNA, 25 bp, Rattus norvegicus
ggcttcgcttgaatgcaggaccgga

SEQ ID NO: 446831 - DNA, 25 bp, Rattus norvegicus
ggcttcgcttgattgcaggaccgga

SEQ ID NO: 446832 - DNA, 25 bp, Rattus norvegicus
ggcttcgcttttaacagtgtccaag

SEQ ID NO: 446833 - DNA, 25 bp, Rattus norvegicus
ggcttcgctttttacagtgtccaag

SEQ ID NO: 446834 - DNA, 25 bp, Rattus norvegicus
ggcttcggacgtcggcagaaccaca

SEQ ID NO: 446835 - DNA, 25 bp, Rattus norvegicus
ggcttcggacgtgggcagaaccaca

SEQ ID NO: 446836 - DNA, 25 bp, Rattus norvegicus
ggcttcggatttcgcaatggcatga

SEQ ID NO: 446837 - DNA, 25 bp, Rattus norvegicus
ggcttcggatttggcaatggcatga

SEQ ID NO: 446838 - DNA, 25 bp, Rattus norvegicus
ggcttcggcttcctgagctatgaga

SEQ ID NO: 446839 - DNA, 25 bp, Rattus norvegicus
ggcttcggcttcgtgagctatgaga

SEQ ID NO: 446840 - DNA, 25 bp, Rattus norvegicus
ggcttcgtgtggacgcatctgacaa

SEQ ID NO: 446841 - DNA, 25 bp, Rattus norvegicus
ggcttcgtgtggtcgcatctgacaa

SEQ ID NO: 446842 - DNA, 25 bp, Rattus norvegicus
ggcttcgtgttcatgagatttattc

SEQ ID NO: 446843 - DNA, 25 bp, Rattus norvegicus
ggcttcgtgttcttgagatttattc

SEQ ID NO: 446844 - DNA, 25 bp, Rattus norvegicus
ggcttctaatctctcttttcatatt

SEQ ID NO: 446845 - DNA, 25 bp, Rattus norvegicus
ggcttctaatctgtcttttcatatt

SEQ ID NO: 446846 - DNA, 25 bp, Rattus norvegicus
ggcttctacgaacggcttgctgacc

SEQ ID NO: 446847 - DNA, 25 bp, Rattus norvegicus
ggcttctacgaagggcttgctgacc

SEQ ID NO: 446848 - DNA, 25 bp, Rattus norvegicus
ggcttctagagacacccaggtctga

SEQ ID NO: 446849 - DNA, 25 bp, Rattus norvegicus
ggcttctagagagacccaggtctga

SEQ ID NO: 446850 - DNA, 25 bp, Rattus norvegicus
ggcttctagagtctagcccgttgac

SEQ ID NO: 446851 - DNA, 25 bp, Rattus norvegicus
ggcttctagagtgtagcccgttgac

SEQ ID NO: 446852 - DNA, 25 bp, Rattus norvegicus
ggcttctagctaatctaagtcactt

SEQ ID NO: 446853 - DNA, 25 bp, Rattus norvegicus
ggcttctagctattctaagtcactt

SEQ ID NO: 446854 - DNA, 25 bp, Rattus norvegicus
ggcttctaggaaattgtcgccttca

SEQ ID NO: 446855 - DNA, 25 bp, Rattus norvegicus
ggcttctaggaatttgtcgccttca

SEQ ID NO: 446856 - DNA, 25 bp, Rattus norvegicus
ggcttctattaccaacagatgtcag

SEQ ID NO: 446857 - DNA, 25 bp, Rattus norvegicus
ggcttctattacgaacagatgtcag

SEQ ID NO: 446858 - DNA, 25 bp, Rattus norvegicus
ggcttctattttctgcatgtactaa

SEQ ID NO: 446859 - DNA, 25 bp, Rattus norvegicus
ggcttctattttgtgcatgtactaa

SEQ ID NO: 446860 - DNA, 25 bp, Rattus norvegicus
ggcttctcaaatcgatacccttgca

SEQ ID NO: 446861 - DNA, 25 bp, Rattus norvegicus
ggcttctcaaatggatacccttgca

SEQ ID NO: 446862 - DNA, 25 bp, Rattus norvegicus
ggcttctcaacacagtcccagagga

SEQ ID NO: 446863 - DNA, 25 bp, Rattus norvegicus
ggcttctcaacagagtcccagagga

SEQ ID NO: 446864 - DNA, 25 bp, Rattus norvegicus
ggcttctcaagtcccaagggacatg

SEQ ID NO: 446865 - DNA, 25 bp, Rattus norvegicus
ggcttctcaagtgccaagggacatg

SEQ ID NO: 446866 - DNA, 25 bp, Rattus norvegicus
ggcttctccaacagaggtgtggatt

SEQ ID NO: 446867 - DNA, 25 bp, Rattus norvegicus
ggcttctccaactgaggtgtggatt

SEQ ID NO: 446868 - DNA, 25 bp, Rattus norvegicus
ggcttctccagacttccagggcgga

SEQ ID NO: 446869 - DNA, 25 bp, Rattus norvegicus
ggcttctccagagttccagggcgga

SEQ ID NO: 446870 - DNA, 25 bp, Rattus norvegicus
ggcttctccaggaacagcgacagga

SEQ ID NO: 446871 - DNA, 25 bp, Rattus norvegicus
ggcttctccaggtacagcgacagga

SEQ ID NO: 446872 - DNA, 25 bp, Rattus norvegicus
ggcttctcctgaattgttcttctgt

SEQ ID NO: 446873 - DNA, 25 bp, Rattus norvegicus
ggcttctcctgatttgttcttctgt

SEQ ID NO: 446874 - DNA, 25 bp, Rattus norvegicus
ggcttctcctggagggacttggaaa

SEQ ID NO: 446875 - DNA, 25 bp, Rattus norvegicus
ggcttctcctggtgggacttggaaa

SEQ ID NO: 446876 - DNA, 25 bp, Rattus norvegicus
ggcttctcctgtattccatgtcaga

SEQ ID NO: 446877 - DNA, 25 bp, Rattus norvegicus
ggcttctcctgttttccatgtcaga

SEQ ID NO: 446878 - DNA, 25 bp, Rattus norvegicus
ggcttctcgagtaatttcttcacct

SEQ ID NO: 446879 - DNA, 25 bp, Rattus norvegicus
ggcttctcgagttatttcttcacct

SEQ ID NO: 446880 - DNA, 25 bp, Rattus norvegicus
ggcttctcgctaacctgtaagctga

SEQ ID NO: 446881 - DNA, 25 bp, Rattus norvegicus
ggcttctcgctatcctgtaagctga

SEQ ID NO: 446882 - DNA, 25 bp, Rattus norvegicus
ggcttctctagacggattctgcacc

SEQ ID NO: 446883 - DNA, 25 bp, Rattus norvegicus
ggcttctctagagggattctgcacc

SEQ ID NO: 446884 - DNA, 25 bp, Rattus norvegicus
ggcttctctcttctttaggtcaaag

SEQ ID NO: 446885 - DNA, 25 bp, Rattus norvegicus
ggcttctctcttgtttaggtcaaag

SEQ ID NO: 446886 - DNA, 25 bp, Rattus norvegicus
ggcttctctgtcagttagtctggaa

SEQ ID NO: 446887 - DNA, 25 bp, Rattus norvegicus
ggcttctctgtctgttagtctggaa

SEQ ID NO: 446888 - DNA, 25 bp, Rattus norvegicus
ggcttctctgtgaaagcagtcctga

SEQ ID NO: 446889 - DNA, 25 bp, Rattus norvegicus
ggcttctctgtgtaagcagtcctga

SEQ ID NO: 446890 - DNA, 25 bp, Rattus norvegicus
ggcttctcttatacttactgtttta

SEQ ID NO: 446891 - DNA, 25 bp, Rattus norvegicus
ggcttctcttattcttactgtttta

SEQ ID NO: 446892 - DNA, 25 bp, Rattus norvegicus
ggcttctctttcatatcttcttaaa

SEQ ID NO: 446893 - DNA, 25 bp, Rattus norvegicus
ggcttctctttcttatcttcttaaa

SEQ ID NO: 446894 - DNA, 25 bp, Rattus norvegicus
ggcttctgaagcatgctggctgcat

SEQ ID NO: 446895 - DNA, 25 bp, Rattus norvegicus
ggcttctgaagcttgctggctgcat

SEQ ID NO: 446896 - DNA, 25 bp, Rattus norvegicus
ggcttctgacccagagggcctgaga

SEQ ID NO: 446897 - DNA, 25 bp, Rattus norvegicus
ggcttctgaccctgagggcctgaga

SEQ ID NO: 446898 - DNA, 25 bp, Rattus norvegicus
ggcttctgactccagagtctgatgt

SEQ ID NO: 446899 - DNA, 25 bp, Rattus norvegicus
ggcttctgactcgagagtctgatgt

SEQ ID NO: 446900 - DNA, 25 bp, Rattus norvegicus
ggcttctgattcattgttcatatct

SEQ ID NO: 446901 - DNA, 25 bp, Rattus norvegicus
ggcttctgattctttgttcatatct

SEQ ID NO: 446902 - DNA, 25 bp, Rattus norvegicus
ggcttctgatttataggctctcaca

SEQ ID NO: 446903 - DNA, 25 bp, Rattus norvegicus
ggcttctgatttttaggctctcaca

SEQ ID NO: 446904 - DNA, 25 bp, Rattus norvegicus
ggcttctgcaacatcatgcatctga

SEQ ID NO: 446905 - DNA, 25 bp, Rattus norvegicus
ggcttctgcaacttcatgcatctga

SEQ ID NO: 446906 - DNA, 25 bp, Rattus norvegicus
ggcttctgcactaaacggactggag

SEQ ID NO: 446907 - DNA, 25 bp, Rattus norvegicus
ggcttctgcacttaacggactggag

SEQ ID NO: 446908 - DNA, 25 bp, Rattus norvegicus
ggcttctgcatcaatcgcaaactgg

SEQ ID NO: 446909 - DNA, 25 bp, Rattus norvegicus
ggcttctgcatctatcgcaaactgg

SEQ ID NO: 446910 - DNA, 25 bp, Rattus norvegicus
ggcttctgcattcagacctgctggg

SEQ ID NO: 446911 - DNA, 25 bp, Rattus norvegicus
ggcttctgcattgagacctgctggg

SEQ ID NO: 446912 - DNA, 25 bp, Rattus norvegicus
ggcttctgcctaaggctgtgcctaa

SEQ ID NO: 446913 - DNA, 25 bp, Rattus norvegicus
ggcttctgcctacagtttgacctat

SEQ ID NO: 446914 - DNA, 25 bp, Rattus norvegicus
ggcttctgcctagagtttgacctat

SEQ ID NO: 446915 - DNA, 25 bp, Rattus norvegicus
ggcttctgcctatggctgtgcctaa

SEQ ID NO: 446916 - DNA, 25 bp, Rattus norvegicus
ggcttctgcctccaggtctaataca

SEQ ID NO: 446917 - DNA, 25 bp, Rattus norvegicus
ggcttctgcctcgaggtctaataca

SEQ ID NO: 446918 - DNA, 25 bp, Rattus norvegicus
ggcttctgccttaagttttcactta

SEQ ID NO: 446919 - DNA, 25 bp, Rattus norvegicus
ggcttctgcctttagttttcactta

SEQ ID NO: 446920 - DNA, 25 bp, Rattus norvegicus
ggcttctgcgtgacaggctttcaga

SEQ ID NO: 446921 - DNA, 25 bp, Rattus norvegicus
ggcttctgcgtgtcaggctttcaga

SEQ ID NO: 446922 - DNA, 25 bp, Rattus norvegicus
ggcttctggcttctctaagtactga

SEQ ID NO: 446923 - DNA, 25 bp, Rattus norvegicus
ggcttctggcttgtctaagtactga

SEQ ID NO: 446924 - DNA, 25 bp, Rattus norvegicus
ggcttctgggagacacgtctgtcac

SEQ ID NO: 446925 - DNA, 25 bp, Rattus norvegicus
ggcttctgggagtcacgtctgtcac

SEQ ID NO: 446926 - DNA, 25 bp, Rattus norvegicus
ggcttctgtacccagacttttgtac

SEQ ID NO: 446927 - DNA, 25 bp, Rattus norvegicus
ggcttctgtaccgagacttttgtac

SEQ ID NO: 446928 - DNA, 25 bp, Rattus norvegicus
ggcttctgtagtactcctagctaac

SEQ ID NO: 446929 - DNA, 25 bp, Rattus norvegicus
ggcttctgtagttctcctagctaac

SEQ ID NO: 446930 - DNA, 25 bp, Rattus norvegicus
ggcttctgtcccatcttacagagga

SEQ ID NO: 446931 - DNA, 25 bp, Rattus norvegicus
ggcttctgtcccttcttacagagga

SEQ ID NO: 446932 - DNA, 25 bp, Rattus norvegicus
ggcttctgtgatcagcttctctcat

SEQ ID NO: 446933 - DNA, 25 bp, Rattus norvegicus
ggcttctgtgatgagcttctctcat

SEQ ID NO: 446934 - DNA, 25 bp, Rattus norvegicus
ggcttctgtgtgcagaacggcatta

SEQ ID NO: 446935 - DNA, 25 bp, Rattus norvegicus
ggcttctgtgtggagaacggcatta

SEQ ID NO: 446936 - DNA, 25 bp, Rattus norvegicus
ggcttctgttaaactgcttgcttgc

SEQ ID NO: 446937 - DNA, 25 bp, Rattus norvegicus
ggcttctgttaatctgcttgcttgc

SEQ ID NO: 446938 - DNA, 25 bp, Rattus norvegicus
ggcttcttagaaactgggtcactga

SEQ ID NO: 446939 - DNA, 25 bp, Rattus norvegicus
ggcttcttagaatctgggtcactga

SEQ ID NO: 446940 - DNA, 25 bp, Rattus norvegicus
ggcttcttagacctgtccaggtgta

SEQ ID NO: 446941 - DNA, 25 bp, Rattus norvegicus
ggcttcttagacgtgtccaggtgta

SEQ ID NO: 446942 - DNA, 25 bp, Rattus norvegicus
ggcttcttagagacttttctgcacg

SEQ ID NO: 446943 - DNA, 25 bp, Rattus norvegicus
ggcttcttagagtcttttctgcacg

SEQ ID NO: 446944 - DNA, 25 bp, Rattus norvegicus
ggcttcttagttctccatgtatcca

SEQ ID NO: 446945 - DNA, 25 bp, Rattus norvegicus
ggcttcttagttgtccatgtatcca

SEQ ID NO: 446946 - DNA, 25 bp, Rattus norvegicus
ggcttcttccatcctggtgaagaca

SEQ ID NO: 446947 - DNA, 25 bp, Rattus norvegicus
ggcttcttccatgctggtgaagaca

SEQ ID NO: 446948 - DNA, 25 bp, Rattus norvegicus
ggcttcttcccgcaatgtgttacaa

SEQ ID NO: 446949 - DNA, 25 bp, Rattus norvegicus
ggcttcttcccggaatgtgttacaa

SEQ ID NO: 446950 - DNA, 25 bp, Rattus norvegicus
ggcttcttcctcatggatgttcact

SEQ ID NO: 446951 - DNA, 25 bp, Rattus norvegicus
ggcttcttcctcttggatgttcact

SEQ ID NO: 446952 - DNA, 25 bp, Rattus norvegicus
ggcttcttctcccagttaaaggtgg

SEQ ID NO: 446953 - DNA, 25 bp, Rattus norvegicus
ggcttcttctccgagttaaaggtgg

SEQ ID NO: 446954 - DNA, 25 bp, Rattus norvegicus
ggcttcttctttcctcagatctcat

SEQ ID NO: 446955 - DNA, 25 bp, Rattus norvegicus
ggcttcttctttgctcagatctcat

SEQ ID NO: 446956 - DNA, 25 bp, Rattus norvegicus
ggcttcttgaggaatgtggtctctg

SEQ ID NO: 446957 - DNA, 25 bp, Rattus norvegicus
ggcttcttgaggctgtgcaccacta

SEQ ID NO: 446958 - DNA, 25 bp, Rattus norvegicus
ggcttcttgagggtgtgcaccacta

SEQ ID NO: 446959 - DNA, 25 bp, Rattus norvegicus
ggcttcttgaggtatgtggtctctg

SEQ ID NO: 446960 - DNA, 25 bp, Rattus norvegicus
ggcttcttgatacctgactgcatga

SEQ ID NO: 446961 - DNA, 25 bp, Rattus norvegicus
ggcttcttgatagctgactgcatga

SEQ ID NO: 446962 - DNA, 25 bp, Rattus norvegicus
ggcttcttggatcgctgtcatacct

SEQ ID NO: 446963 - DNA, 25 bp, Rattus norvegicus
ggcttcttggatggctgtcatacct

SEQ ID NO: 446964 - DNA, 25 bp, Rattus norvegicus
ggcttctttaggaaacaggtatgca

SEQ ID NO: 446965 - DNA, 25 bp, Rattus norvegicus
ggcttctttaggtaacaggtatgca

SEQ ID NO: 446966 - DNA, 25 bp, Rattus norvegicus
ggcttctttcctacctggatttata

SEQ ID NO: 446967 - DNA, 25 bp, Rattus norvegicus
ggcttctttccttcctggatttata

SEQ ID NO: 446968 - DNA, 25 bp, Rattus norvegicus
ggcttctttgaaatcctgcattaat

SEQ ID NO: 446969 - DNA, 25 bp, Rattus norvegicus
ggcttctttgaattcctgcattaat

SEQ ID NO: 446970 - DNA, 25 bp, Rattus norvegicus
ggcttctttggaaatttctattcta

SEQ ID NO: 446971 - DNA, 25 bp, Rattus norvegicus
ggcttctttggacacccttagaata

SEQ ID NO: 446972 - DNA, 25 bp, Rattus norvegicus
ggcttctttggagacccttagaata

SEQ ID NO: 446973 - DNA, 25 bp, Rattus norvegicus
ggcttctttggatatttctattcta

SEQ ID NO: 446974 - DNA, 25 bp, Rattus norvegicus
ggcttctttgttaaaaccctctgtg

SEQ ID NO: 446975 - DNA, 25 bp, Rattus norvegicus
ggcttctttgtttaaaccctctgtg

SEQ ID NO: 446976 - DNA, 25 bp, Rattus norvegicus
ggcttgaaaggtcggctcagcttct

SEQ ID NO: 446977 - DNA, 25 bp, Rattus norvegicus
ggcttgaaaggtgggctcagcttct

SEQ ID NO: 446978 - DNA, 25 bp, Rattus norvegicus
ggcttgaacaccacctaacgaagtt

SEQ ID NO: 446979 - DNA, 25 bp, Rattus norvegicus
ggcttgaacacctcctaacgaagtt

SEQ ID NO: 446980 - DNA, 25 bp, Rattus norvegicus
ggcttgaaccccagatggctcacag

SEQ ID NO: 446981 - DNA, 25 bp, Rattus norvegicus
ggcttgaacccctgatggctcacag

SEQ ID NO: 446982 - DNA, 25 bp, Rattus norvegicus
ggcttgaagtctcaaaagtccacat

SEQ ID NO: 446983 - DNA, 25 bp, Rattus norvegicus
ggcttgaagtctgaaaagtccacat

SEQ ID NO: 446984 - DNA, 25 bp, Rattus norvegicus
ggcttgaatgtactcttgcttctgt

SEQ ID NO: 446985 - DNA, 25 bp, Rattus norvegicus
ggcttgaatgtagtcttgcttctgt

SEQ ID NO: 446986 - DNA, 25 bp, Rattus norvegicus
ggcttgagaagaacctttctttctt

SEQ ID NO: 446987 - DNA, 25 bp, Rattus norvegicus
ggcttgagaagatcctttctttctt

SEQ ID NO: 446988 - DNA, 25 bp, Rattus norvegicus
ggcttgagaagcacctttgtgttat

SEQ ID NO: 446989 - DNA, 25 bp, Rattus norvegicus
ggcttgagaagctcctttgtgttat

SEQ ID NO: 446990 - DNA, 25 bp, Rattus norvegicus
ggcttgagactcaggacatttgcag

SEQ ID NO: 446991 - DNA, 25 bp, Rattus norvegicus
ggcttgagactctggacatttgcag

SEQ ID NO: 446992 - DNA, 25 bp, Rattus norvegicus
ggcttgagactgctatctgcttcac

SEQ ID NO: 446993 - DNA, 25 bp, Rattus norvegicus
ggcttgagactggtatctgcttcac

SEQ ID NO: 446994 - DNA, 25 bp, Rattus norvegicus
ggcttgagagaaacctgtcaggcct

SEQ ID NO: 446995 - DNA, 25 bp, Rattus norvegicus
ggcttgagagaatcctgtcaggcct

SEQ ID NO: 446996 - DNA, 25 bp, Rattus norvegicus
ggcttgagatgccttttctgagaag

SEQ ID NO: 446997 - DNA, 25 bp, Rattus norvegicus
ggcttgagatgcgttttctgagaag

SEQ ID NO: 446998 - DNA, 25 bp, Rattus norvegicus
ggcttgagccccagcccgtgggctt

SEQ ID NO: 446999 - DNA, 25 bp, Rattus norvegicus
ggcttgagcccctgcccgtgggctt

SEQ ID NO: 447000 - DNA, 25 bp, Rattus norvegicus
ggcttgagctaccactgtataccat

SEQ ID NO: 447001 - DNA, 25 bp, Rattus norvegicus
ggcttgagctacgactgtataccat

SEQ ID NO: 447002 - DNA, 25 bp, Rattus norvegicus
ggcttgataaaacactccaggaggt

SEQ ID NO: 447003 - DNA, 25 bp, Rattus norvegicus
ggcttgataaaagactccaggaggt

SEQ ID NO: 447004 - DNA, 25 bp, Rattus norvegicus
ggcttgatgatgactgcctgcgatc

SEQ ID NO: 447005 - DNA, 25 bp, Rattus norvegicus
ggcttgatgatgtctgcctgcgatc

SEQ ID NO: 447006 - DNA, 25 bp, Rattus norvegicus
ggcttgcaactaactgtgactccag

SEQ ID NO: 447007 - DNA, 25 bp, Rattus norvegicus
ggcttgcaactatctgtgactccag

SEQ ID NO: 447008 - DNA, 25 bp, Rattus norvegicus
ggcttgcaactgaccataaactgaa

SEQ ID NO: 447009 - DNA, 25 bp, Rattus norvegicus
ggcttgcaactgtccataaactgaa

SEQ ID NO: 447010 - DNA, 25 bp, Rattus norvegicus
ggcttgcaagcgcacattggccaac

SEQ ID NO: 447011 - DNA, 25 bp, Rattus norvegicus
ggcttgcaagcggacattggccaac

SEQ ID NO: 447012 - DNA, 25 bp, Rattus norvegicus
ggcttgcaatcccagccagtggtgt

SEQ ID NO: 447013 - DNA, 25 bp, Rattus norvegicus
ggcttgcaatccgagccagtggtgt

SEQ ID NO: 447014 - DNA, 25 bp, Rattus norvegicus
ggcttgcacaccaacgtgtggtaga

SEQ ID NO: 447015 - DNA, 25 bp, Rattus norvegicus
ggcttgcacacctacgtgtggtaga

SEQ ID NO: 447016 - DNA, 25 bp, Rattus norvegicus
ggcttgcaccacctttttagagatg

SEQ ID NO: 447017 - DNA, 25 bp, Rattus norvegicus
ggcttgcaccacgtttttagagatg

SEQ ID NO: 447018 - DNA, 25 bp, Rattus norvegicus
ggcttgcactttcttattttcttat

SEQ ID NO: 447019 - DNA, 25 bp, Rattus norvegicus
ggcttgcactttgttattttcttat

SEQ ID NO: 447020 - DNA, 25 bp, Rattus norvegicus
ggcttgcagaagactaacgtgctca

SEQ ID NO: 447021 - DNA, 25 bp, Rattus norvegicus
ggcttgcagaagtctaacgtgctca

SEQ ID NO: 447022 - DNA, 25 bp, Rattus norvegicus
ggcttgcagccacaagcaggagtgc

SEQ ID NO: 447023 - DNA, 25 bp, Rattus norvegicus
ggcttgcagccagaagcaggagtgc

SEQ ID NO: 447024 - DNA, 25 bp, Rattus norvegicus
ggcttgcagggaaattttgtgttca

SEQ ID NO: 447025 - DNA, 25 bp, Rattus norvegicus
ggcttgcagggatattttgtgttca

SEQ ID NO: 447026 - DNA, 25 bp, Rattus norvegicus
ggcttgcatagaagtttcccacttc

SEQ ID NO: 447027 - DNA, 25 bp, Rattus norvegicus
ggcttgcatagatgtttcccacttc

SEQ ID NO: 447028 - DNA, 25 bp, Rattus norvegicus
ggcttgcatctcaatccttgaaagt

SEQ ID NO: 447029 - DNA, 25 bp, Rattus norvegicus
ggcttgcatctctatccttgaaagt

SEQ ID NO: 447030 - DNA, 25 bp, Rattus norvegicus
ggcttgcatgggaactttcttatta

SEQ ID NO: 447031 - DNA, 25 bp, Rattus norvegicus
ggcttgcatgggtactttcttatta

SEQ ID NO: 447032 - DNA, 25 bp, Rattus norvegicus
ggcttgcattcccatttctagatac

SEQ ID NO: 447033 - DNA, 25 bp, Rattus norvegicus
ggcttgcattccgatttctagatac

SEQ ID NO: 447034 - DNA, 25 bp, Rattus norvegicus
ggcttgccattaagctctagctttc

SEQ ID NO: 447035 - DNA, 25 bp, Rattus norvegicus
ggcttgccattatgctctagctttc

SEQ ID NO: 447036 - DNA, 25 bp, Rattus norvegicus
ggcttgcccaagcagcattttgtaa

SEQ ID NO: 447037 - DNA, 25 bp, Rattus norvegicus
ggcttgcccaaggagcattttgtaa

SEQ ID NO: 447038 - DNA, 25 bp, Rattus norvegicus
ggcttgcccaggatgcttggtttgc

SEQ ID NO: 447039 - DNA, 25 bp, Rattus norvegicus
ggcttgcccaggttgcttggtttgc

SEQ ID NO: 447040 - DNA, 25 bp, Rattus norvegicus
ggcttgccctttagtacttcaatta

SEQ ID NO: 447041 - DNA, 25 bp, Rattus norvegicus
ggcttgcccttttgtacttcaatta

SEQ ID NO: 447042 - DNA, 25 bp, Rattus norvegicus
ggcttgccgtacaaacatctgttat

SEQ ID NO: 447043 - DNA, 25 bp, Rattus norvegicus
ggcttgccgtactaacatctgttat

SEQ ID NO: 447044 - DNA, 25 bp, Rattus norvegicus
ggcttgcgacaacgactctcagtgt

SEQ ID NO: 447045 - DNA, 25 bp, Rattus norvegicus
ggcttgcgacaaggactctcagtgt

SEQ ID NO: 447046 - DNA, 25 bp, Rattus norvegicus
ggcttgcgagggattttatacctag

SEQ ID NO: 447047 - DNA, 25 bp, Rattus norvegicus
ggcttgcgagggtttttatacctag

SEQ ID NO: 447048 - DNA, 25 bp, Rattus norvegicus
ggcttgcgggacatcagaaagaaca

SEQ ID NO: 447049 - DNA, 25 bp, Rattus norvegicus
ggcttgcgggacttcagaaagaaca

SEQ ID NO: 447050 - DNA, 25 bp, Rattus norvegicus
ggcttgcgttcaaagactgtcctca

SEQ ID NO: 447051 - DNA, 25 bp, Rattus norvegicus
ggcttgcgttcatagactgtcctca

SEQ ID NO: 447052 - DNA, 25 bp, Rattus norvegicus
ggcttgctaccaccaattgaactgt

SEQ ID NO: 447053 - DNA, 25 bp, Rattus norvegicus
ggcttgctaccagcaattgaactgt

SEQ ID NO: 447054 - DNA, 25 bp, Rattus norvegicus
ggcttgctcctacttggagtggcaa

SEQ ID NO: 447055 - DNA, 25 bp, Rattus norvegicus
ggcttgctcctagttggagtggcaa

SEQ ID NO: 447056 - DNA, 25 bp, Rattus norvegicus
ggcttgctctgaatggtgcgctatt

SEQ ID NO: 447057 - DNA, 25 bp, Rattus norvegicus
ggcttgctctgattggtgcgctatt

SEQ ID NO: 447058 - DNA, 25 bp, Rattus norvegicus
ggcttgctctgtatctctaatgtac

SEQ ID NO: 447059 - DNA, 25 bp, Rattus norvegicus
ggcttgctctgtttctctaatgtac

SEQ ID NO: 447060 - DNA, 25 bp, Rattus norvegicus
ggcttgctgcaaatcctgactaaag

SEQ ID NO: 447061 - DNA, 25 bp, Rattus norvegicus
ggcttgctgcaattcctgactaaag

SEQ ID NO: 447062 - DNA, 25 bp, Rattus norvegicus
ggcttgctgcccatgatcagtgtaa

SEQ ID NO: 447063 - DNA, 25 bp, Rattus norvegicus
ggcttgctgcccttgatcagtgtaa

SEQ ID NO: 447064 - DNA, 25 bp, Rattus norvegicus
ggcttgctgtcactaggatgttttt

SEQ ID NO: 447065 - DNA, 25 bp, Rattus norvegicus
ggcttgctgtcagtaggatgttttt

SEQ ID NO: 447066 - DNA, 25 bp, Rattus norvegicus
ggcttgcttgttagcagtgtaagaa

SEQ ID NO: 447067 - DNA, 25 bp, Rattus norvegicus
ggcttgcttgtttgcagtgtaagaa

SEQ ID NO: 447068 - DNA, 25 bp, Rattus norvegicus
ggcttgctttctaccatgtagaaac

SEQ ID NO: 447069 - DNA, 25 bp, Rattus norvegicus
ggcttgctttctctgctttgaggca

SEQ ID NO: 447070 - DNA, 25 bp, Rattus norvegicus
ggcttgctttctgtgctttgaggca

SEQ ID NO: 447071 - DNA, 25 bp, Rattus norvegicus
ggcttgctttcttccatgtagaaac

SEQ ID NO: 447072 - DNA, 25 bp, Rattus norvegicus
ggcttgctttggctatttccatgta

SEQ ID NO: 447073 - DNA, 25 bp, Rattus norvegicus
ggcttgctttgggtatttccatgta

SEQ ID NO: 447074 - DNA, 25 bp, Rattus norvegicus
ggcttggaaagcaaaggccctgccc

SEQ ID NO: 447075 - DNA, 25 bp, Rattus norvegicus
ggcttggaaagctaaggccctgccc

SEQ ID NO: 447076 - DNA, 25 bp, Rattus norvegicus
ggcttggaaagtctgctctgaactc

SEQ ID NO: 447077 - DNA, 25 bp, Rattus norvegicus
ggcttggaaagtgtgctctgaactc

SEQ ID NO: 447078 - DNA, 25 bp, Rattus norvegicus
ggcttggaacttcctgcgtagaaca

SEQ ID NO: 447079 - DNA, 25 bp, Rattus norvegicus
ggcttggaacttgctgcgtagaaca

SEQ ID NO: 447080 - DNA, 25 bp, Rattus norvegicus
ggcttggagcccactgtatagacca

SEQ ID NO: 447081 - DNA, 25 bp, Rattus norvegicus
ggcttggagccctctgtatagacca

SEQ ID NO: 447082 - DNA, 25 bp, Rattus norvegicus
ggcttggaggcaaaccttgacccta

SEQ ID NO: 447083 - DNA, 25 bp, Rattus norvegicus
ggcttggaggcataccttgacccta

SEQ ID NO: 447084 - DNA, 25 bp, Rattus norvegicus
ggcttggatcaaagaatctctgcag

SEQ ID NO: 447085 - DNA, 25 bp, Rattus norvegicus
ggcttggatcaatgaatctctgcag

SEQ ID NO: 447086 - DNA, 25 bp, Rattus norvegicus
ggcttggatccacagtttgtgcgtt

SEQ ID NO: 447087 - DNA, 25 bp, Rattus norvegicus
ggcttggatccagagtttgtgcgtt

SEQ ID NO: 447088 - DNA, 25 bp, Rattus norvegicus
ggcttggcatttattgttggctacg

SEQ ID NO: 447089 - DNA, 25 bp, Rattus norvegicus
ggcttggcattttttgttggctacg

SEQ ID NO: 447090 - DNA, 25 bp, Rattus norvegicus
ggcttggccacaaaccatgctgaaa

SEQ ID NO: 447091 - DNA, 25 bp, Rattus norvegicus
ggcttggccacataccatgctgaaa

SEQ ID NO: 447092 - DNA, 25 bp, Rattus norvegicus
ggcttggccaggcattaactatgat

SEQ ID NO: 447093 - DNA, 25 bp, Rattus norvegicus
ggcttggccagggattaactatgat

SEQ ID NO: 447094 - DNA, 25 bp, Rattus norvegicus
ggcttggccctgcttggaactattt

SEQ ID NO: 447095 - DNA, 25 bp, Rattus norvegicus
ggcttggccctggttggaactattt

SEQ ID NO: 447096 - DNA, 25 bp, Rattus norvegicus
ggcttggcctcacctgggaatgatt

SEQ ID NO: 447097 - DNA, 25 bp, Rattus norvegicus
ggcttggcctcagctgggaatgatt

SEQ ID NO: 447098 - DNA, 25 bp, Rattus norvegicus
ggcttggcgcatagaagtccctgaa

SEQ ID NO: 447099 - DNA, 25 bp, Rattus norvegicus
ggcttggcgcattgaagtccctgaa

SEQ ID NO: 447100 - DNA, 25 bp, Rattus norvegicus
ggcttggcggcgagacaagaaatat

SEQ ID NO: 447101 - DNA, 25 bp, Rattus norvegicus
ggcttggcggcgtgacaagaaatat

SEQ ID NO: 447102 - DNA, 25 bp, Rattus norvegicus
ggcttggctcctacagagttagtga

SEQ ID NO: 447103 - DNA, 25 bp, Rattus norvegicus
ggcttggctccttcagagttagtga

SEQ ID NO: 447104 - DNA, 25 bp, Rattus norvegicus
ggcttggctggtcttagatcttgta

SEQ ID NO: 447105 - DNA, 25 bp, Rattus norvegicus
ggcttggctggtgttagatcttgta

SEQ ID NO: 447106 - DNA, 25 bp, Rattus norvegicus
ggcttggcttaactacctgtatggg

SEQ ID NO: 447107 - DNA, 25 bp, Rattus norvegicus
ggcttggcttaagtacctgtatggg

SEQ ID NO: 447108 - DNA, 25 bp, Rattus norvegicus
ggcttggcttttcttagcccacaaa

SEQ ID NO: 447109 - DNA, 25 bp, Rattus norvegicus
ggcttggcttttgttagcccacaaa

SEQ ID NO: 447110 - DNA, 25 bp, Rattus norvegicus
ggcttgggactactttcctgggact

SEQ ID NO: 447111 - DNA, 25 bp, Rattus norvegicus
ggcttgggactagtttcctgggact

SEQ ID NO: 447112 - DNA, 25 bp, Rattus norvegicus
ggcttgggatgcatgctgatctaac

SEQ ID NO: 447113 - DNA, 25 bp, Rattus norvegicus
ggcttgggatgcttgctgatctaac

SEQ ID NO: 447114 - DNA, 25 bp, Rattus norvegicus
ggcttgggcagaacgaatcggacac

SEQ ID NO: 447115 - DNA, 25 bp, Rattus norvegicus
ggcttgggcagatcgaatcggacac

SEQ ID NO: 447116 - DNA, 25 bp, Rattus norvegicus
ggcttgggccttctggattccatca

SEQ ID NO: 447117 - DNA, 25 bp, Rattus norvegicus
ggcttgggccttgtggattccatca

SEQ ID NO: 447118 - DNA, 25 bp, Rattus norvegicus
ggcttgggctttaccatttctttgc

SEQ ID NO: 447119 - DNA, 25 bp, Rattus norvegicus
ggcttgggcttttccatttctttgc

SEQ ID NO: 447120 - DNA, 25 bp, Rattus norvegicus
ggcttgggtatcatgacctttaggg

SEQ ID NO: 447121 - DNA, 25 bp, Rattus norvegicus
ggcttgggtatcttgacctttaggg

SEQ ID NO: 447122 - DNA, 25 bp, Rattus norvegicus
ggcttggtacatctctgtaacccca

SEQ ID NO: 447123 - DNA, 25 bp, Rattus norvegicus
ggcttggtacatgtctgtaacccca

SEQ ID NO: 447124 - DNA, 25 bp, Rattus norvegicus
ggcttggtgggtagacttcgtccat

SEQ ID NO: 447125 - DNA, 25 bp, Rattus norvegicus
ggcttggtgggttgacttcgtccat

SEQ ID NO: 447126 - DNA, 25 bp, Rattus norvegicus
ggcttggttaccagaattctcttat

SEQ ID NO: 447127 - DNA, 25 bp, Rattus norvegicus
ggcttggttacctgaattctcttat

SEQ ID NO: 447128 - DNA, 25 bp, Rattus norvegicus
ggcttggttcgtatacatttttgca

SEQ ID NO: 447129 - DNA, 25 bp, Rattus norvegicus
ggcttggttcgtttacatttttgca

SEQ ID NO: 447130 - DNA, 25 bp, Rattus norvegicus
ggcttggtttccagcacctacatga

SEQ ID NO: 447131 - DNA, 25 bp, Rattus norvegicus
ggcttggtttcctgcacctacatga

SEQ ID NO: 447132 - DNA, 25 bp, Rattus norvegicus
ggcttgtattttcaacagagttcta

SEQ ID NO: 447133 - DNA, 25 bp, Rattus norvegicus
ggcttgtattttgaacagagttcta

SEQ ID NO: 447134 - DNA, 25 bp, Rattus norvegicus
ggcttgtcacacagatttcaatgca

SEQ ID NO: 447135 - DNA, 25 bp, Rattus norvegicus
ggcttgtcacactgatttcaatgca

SEQ ID NO: 447136 - DNA, 25 bp, Rattus norvegicus
ggcttgtcacatccttgtatttcag

SEQ ID NO: 447137 - DNA, 25 bp, Rattus norvegicus
ggcttgtcacatgcttgtatttcag

SEQ ID NO: 447138 - DNA, 25 bp, Rattus norvegicus
ggcttgtcacgaccccgcgctggaa

SEQ ID NO: 447139 - DNA, 25 bp, Rattus norvegicus
ggcttgtcacgagcccgcgctggaa

SEQ ID NO: 447140 - DNA, 25 bp, Rattus norvegicus
ggcttgtcagacacatggcccatgc

SEQ ID NO: 447141 - DNA, 25 bp, Rattus norvegicus
ggcttgtcagactcatggcccatgc

SEQ ID NO: 447142 - DNA, 25 bp, Rattus norvegicus
ggcttgtcaggtcagtacggtttac

SEQ ID NO: 447143 - DNA, 25 bp, Rattus norvegicus
ggcttgtcaggtgagtacggtttac

SEQ ID NO: 447144 - DNA, 25 bp, Rattus norvegicus
ggcttgtcattcacagtcacagttt

SEQ ID NO: 447145 - DNA, 25 bp, Rattus norvegicus
ggcttgtcattctcagtcacagttt

SEQ ID NO: 447146 - DNA, 25 bp, Rattus norvegicus
ggcttgtccaacaccgtgatgaggc

SEQ ID NO: 447147 - DNA, 25 bp, Rattus norvegicus
ggcttgtccaactccgtgatgaggc

SEQ ID NO: 447148 - DNA, 25 bp, Rattus norvegicus
ggcttgtccagaacactgttctttt

SEQ ID NO: 447149 - DNA, 25 bp, Rattus norvegicus
ggcttgtccagatcactgttctttt

SEQ ID NO: 447150 - DNA, 25 bp, Rattus norvegicus
ggcttgtccctcagtatgaacttgg

SEQ ID NO: 447151 - DNA, 25 bp, Rattus norvegicus
ggcttgtccctctgtatgaacttgg

SEQ ID NO: 447152 - DNA, 25 bp, Rattus norvegicus
ggcttgtcctcgaggccggctgccg

SEQ ID NO: 447153 - DNA, 25 bp, Rattus norvegicus
ggcttgtcctcgtggccggctgccg

SEQ ID NO: 447154 - DNA, 25 bp, Rattus norvegicus
ggcttgtctcacatatgaaacacat

SEQ ID NO: 447155 - DNA, 25 bp, Rattus norvegicus
ggcttgtctcacttatgaaacacat

SEQ ID NO: 447156 - DNA, 25 bp, Rattus norvegicus
ggcttgtgacttcccacctttgtga

SEQ ID NO: 447157 - DNA, 25 bp, Rattus norvegicus
ggcttgtgacttgccacctttgtga

SEQ ID NO: 447158 - DNA, 25 bp, Rattus norvegicus
ggcttgtgctgccactcacaatatt

SEQ ID NO: 447159 - DNA, 25 bp, Rattus norvegicus
ggcttgtgctgcgactcacaatatt

SEQ ID NO: 447160 - DNA, 25 bp, Rattus norvegicus
ggcttgtgctttctgcttcaatcaa

SEQ ID NO: 447161 - DNA, 25 bp, Rattus norvegicus
ggcttgtgctttgtgcttcaatcaa

SEQ ID NO: 447162 - DNA, 25 bp, Rattus norvegicus
ggcttgtggatgattctctaattca

SEQ ID NO: 447163 - DNA, 25 bp, Rattus norvegicus
ggcttgtggatgtttctctaattca

SEQ ID NO: 447164 - DNA, 25 bp, Rattus norvegicus
ggcttgtggctcaagcattaggttc

SEQ ID NO: 447165 - DNA, 25 bp, Rattus norvegicus
ggcttgtggctctagcattaggttc

SEQ ID NO: 447166 - DNA, 25 bp, Rattus norvegicus
ggcttgtggtcccttcagtaagaat

SEQ ID NO: 447167 - DNA, 25 bp, Rattus norvegicus
ggcttgtggtccgttcagtaagaat

SEQ ID NO: 447168 - DNA, 25 bp, Rattus norvegicus
ggcttgtgtcatcacttcaggaaat

SEQ ID NO: 447169 - DNA, 25 bp, Rattus norvegicus
ggcttgtgtcatgacttcaggaaat

SEQ ID NO: 447170 - DNA, 25 bp, Rattus norvegicus
ggcttgtgtccaatgccttcaaaag

SEQ ID NO: 447171 - DNA, 25 bp, Rattus norvegicus
ggcttgtgtccattgccttcaaaag

SEQ ID NO: 447172 - DNA, 25 bp, Rattus norvegicus
ggcttgttaaagatttgcactgtgg

SEQ ID NO: 447173 - DNA, 25 bp, Rattus norvegicus
ggcttgttaaagttttgcactgtgg

SEQ ID NO: 447174 - DNA, 25 bp, Rattus norvegicus
ggcttgttacgtcctttgagtatcc

SEQ ID NO: 447175 - DNA, 25 bp, Rattus norvegicus
ggcttgttacgtgctttgagtatcc

SEQ ID NO: 447176 - DNA, 25 bp, Rattus norvegicus
ggcttgttcggtagtgactgtccca

SEQ ID NO: 447177 - DNA, 25 bp, Rattus norvegicus
ggcttgttcggttgtgactgtccca

SEQ ID NO: 447178 - DNA, 25 bp, Rattus norvegicus
ggcttgttctggctttcgtttctgt

SEQ ID NO: 447179 - DNA, 25 bp, Rattus norvegicus
ggcttgttctgggtttcgtttctgt

SEQ ID NO: 447180 - DNA, 25 bp, Rattus norvegicus
ggcttgttcttaatcaacccatgta

SEQ ID NO: 447181 - DNA, 25 bp, Rattus norvegicus
ggcttgttcttattcaacccatgta

SEQ ID NO: 447182 - DNA, 25 bp, Rattus norvegicus
ggcttgttggaaacgatgccttcaa

SEQ ID NO: 447183 - DNA, 25 bp, Rattus norvegicus
ggcttgttggaatcgatgccttcaa

SEQ ID NO: 447184 - DNA, 25 bp, Rattus norvegicus
ggcttgttgtttcttttaactccat

SEQ ID NO: 447185 - DNA, 25 bp, Rattus norvegicus
ggcttgttgtttgttttaactccat

SEQ ID NO: 447186 - DNA, 25 bp, Rattus norvegicus
ggcttgtttcttattgctatttggc

SEQ ID NO: 447187 - DNA, 25 bp, Rattus norvegicus
ggcttgtttctttttgctatttggc

SEQ ID NO: 447188 - DNA, 25 bp, Rattus norvegicus
ggcttgttttggagaccttgattca

SEQ ID NO: 447189 - DNA, 25 bp, Rattus norvegicus
ggcttgttttggtgaccttgattca

SEQ ID NO: 447190 - DNA, 25 bp, Rattus norvegicus
ggctttaaattccttatactgacga

SEQ ID NO: 447191 - DNA, 25 bp, Rattus norvegicus
ggctttaaattccttctgtgcatgt

SEQ ID NO: 447192 - DNA, 25 bp, Rattus norvegicus
ggctttaaattcgttatactgacga

SEQ ID NO: 447193 - DNA, 25 bp, Rattus norvegicus
ggctttaaattcgttctgtgcatgt

SEQ ID NO: 447194 - DNA, 25 bp, Rattus norvegicus
ggctttaacctgcacatcataaaga

SEQ ID NO: 447195 - DNA, 25 bp, Rattus norvegicus
ggctttaacctggacatcataaaga

SEQ ID NO: 447196 - DNA, 25 bp, Rattus norvegicus
ggctttaacttgaaatctgctcttg

SEQ ID NO: 447197 - DNA, 25 bp, Rattus norvegicus
ggctttaacttgcttgccttgcttt

SEQ ID NO: 447198 - DNA, 25 bp, Rattus norvegicus
ggctttaacttggttgccttgcttt

SEQ ID NO: 447199 - DNA, 25 bp, Rattus norvegicus
ggctttaacttgtaatctgctcttg

SEQ ID NO: 447200 - DNA, 25 bp, Rattus norvegicus
ggctttaaggcgacgtctggagaaa

SEQ ID NO: 447201 - DNA, 25 bp, Rattus norvegicus
ggctttaaggcgtcgtctggagaaa

SEQ ID NO: 447202 - DNA, 25 bp, Rattus norvegicus
ggctttaatacgagagcgtgctaaa

SEQ ID NO: 447203 - DNA, 25 bp, Rattus norvegicus
ggctttaatacgtgagcgtgctaaa

SEQ ID NO: 447204 - DNA, 25 bp, Rattus norvegicus
ggctttaatatactgcgggcattcc

SEQ ID NO: 447205 - DNA, 25 bp, Rattus norvegicus
ggctttaatatagtgcgggcattcc

SEQ ID NO: 447206 - DNA, 25 bp, Rattus norvegicus
ggctttaatttcagtacacccatcc

SEQ ID NO: 447207 - DNA, 25 bp, Rattus norvegicus
ggctttaatttcatttgtggcttgc

SEQ ID NO: 447208 - DNA, 25 bp, Rattus norvegicus
ggctttaatttctgtacacccatcc

SEQ ID NO: 447209 - DNA, 25 bp, Rattus norvegicus
ggctttaatttcttttgtggcttgc

SEQ ID NO: 447210 - DNA, 25 bp, Rattus norvegicus
ggctttacacatcctaaccactgac

SEQ ID NO: 447211 - DNA, 25 bp, Rattus norvegicus
ggctttacacatgctaaccactgac

SEQ ID NO: 447212 - DNA, 25 bp, Rattus norvegicus
ggctttaccagtatcttccttagat

SEQ ID NO: 447213 - DNA, 25 bp, Rattus norvegicus
ggctttaccagtttcttccttagat

SEQ ID NO: 447214 - DNA, 25 bp, Rattus norvegicus
ggctttaccatactgcgagacttct

SEQ ID NO: 447215 - DNA, 25 bp, Rattus norvegicus
ggctttaccatagtgcgagacttct

SEQ ID NO: 447216 - DNA, 25 bp, Rattus norvegicus
ggctttaccctgaagatccgtggga

SEQ ID NO: 447217 - DNA, 25 bp, Rattus norvegicus
ggctttaccctgtagatccgtggga

SEQ ID NO: 447218 - DNA, 25 bp, Rattus norvegicus
ggctttactcagatatggccctgaa

SEQ ID NO: 447219 - DNA, 25 bp, Rattus norvegicus
ggctttactcagttatggccctgaa

SEQ ID NO: 447220 - DNA, 25 bp, Rattus norvegicus
ggctttactgccattccagaaatgt

SEQ ID NO: 447221 - DNA, 25 bp, Rattus norvegicus
ggctttactgcctttccagaaatgt

SEQ ID NO: 447222 - DNA, 25 bp, Rattus norvegicus
ggctttactgcgactaccagaacat

SEQ ID NO: 447223 - DNA, 25 bp, Rattus norvegicus
ggctttactgcgtctaccagaacat

SEQ ID NO: 447224 - DNA, 25 bp, Rattus norvegicus
ggctttagaaccagctatgatcccg

SEQ ID NO: 447225 - DNA, 25 bp, Rattus norvegicus
ggctttagaacctgctatgatcccg

SEQ ID NO: 447226 - DNA, 25 bp, Rattus norvegicus
ggctttagacaccaagaccttgcgg

SEQ ID NO: 447227 - DNA, 25 bp, Rattus norvegicus
ggctttagacacgaagaccttgcgg

SEQ ID NO: 447228 - DNA, 25 bp, Rattus norvegicus
ggctttagcagtctcaatgttgaaa

SEQ ID NO: 447229 - DNA, 25 bp, Rattus norvegicus
ggctttagcagtgtcaatgttgaaa

SEQ ID NO: 447230 - DNA, 25 bp, Rattus norvegicus
ggctttagccgtatagataacttca

SEQ ID NO: 447231 - DNA, 25 bp, Rattus norvegicus
ggctttagccgtttagataacttca

SEQ ID NO: 447232 - DNA, 25 bp, Rattus norvegicus
ggctttaggctacgtttgtcccaag

SEQ ID NO: 447233 - DNA, 25 bp, Rattus norvegicus
ggctttaggctaggtttgtcccaag

SEQ ID NO: 447234 - DNA, 25 bp, Rattus norvegicus
ggctttagtggaaggaccctgcacc

SEQ ID NO: 447235 - DNA, 25 bp, Rattus norvegicus
ggctttagtggatggaccctgcacc

SEQ ID NO: 447236 - DNA, 25 bp, Rattus norvegicus
ggctttagtgtcaaggtccacttca

SEQ ID NO: 447237 - DNA, 25 bp, Rattus norvegicus
ggctttagtgtctaggtccacttca

SEQ ID NO: 447238 - DNA, 25 bp, Rattus norvegicus
ggctttagttttaatcaccgaggat

SEQ ID NO: 447239 - DNA, 25 bp, Rattus norvegicus
ggctttagtttttatcaccgaggat

SEQ ID NO: 447240 - DNA, 25 bp, Rattus norvegicus
ggctttataaaaataccagctttgg

SEQ ID NO: 447241 - DNA, 25 bp, Rattus norvegicus
ggctttataaaattaccagctttgg

SEQ ID NO: 447242 - DNA, 25 bp, Rattus norvegicus
ggctttataccaccccagagtagaa

SEQ ID NO: 447243 - DNA, 25 bp, Rattus norvegicus
ggctttataccagcccagagtagaa

SEQ ID NO: 447244 - DNA, 25 bp, Rattus norvegicus
ggctttatagccattgcaaaacata

SEQ ID NO: 447245 - DNA, 25 bp, Rattus norvegicus
ggctttatagcctttgcaaaacata

SEQ ID NO: 447246 - DNA, 25 bp, Rattus norvegicus
ggctttatggatctccgtgtgctca

SEQ ID NO: 447247 - DNA, 25 bp, Rattus norvegicus
ggctttatggatgtccgtgtgctca

SEQ ID NO: 447248 - DNA, 25 bp, Rattus norvegicus
ggctttattaatctcatcatggtgt

SEQ ID NO: 447249 - DNA, 25 bp, Rattus norvegicus
ggctttattaatgtcatcatggtgt

SEQ ID NO: 447250 - DNA, 25 bp, Rattus norvegicus
ggctttattagcacagaacttcatg

SEQ ID NO: 447251 - DNA, 25 bp, Rattus norvegicus
ggctttattagcatcatcttctgtt

SEQ ID NO: 447252 - DNA, 25 bp, Rattus norvegicus
ggctttattagctcagaacttcatg

SEQ ID NO: 447253 - DNA, 25 bp, Rattus norvegicus
ggctttattagcttcatcttctgtt

SEQ ID NO: 447254 - DNA, 25 bp, Rattus norvegicus
ggctttattgagctagcgtttccat

SEQ ID NO: 447255 - DNA, 25 bp, Rattus norvegicus
ggctttattgaggtagcgtttccat

SEQ ID NO: 447256 - DNA, 25 bp, Rattus norvegicus
ggctttattttaagccatttccaaa

SEQ ID NO: 447257 - DNA, 25 bp, Rattus norvegicus
ggctttattttacttccggtggcat

SEQ ID NO: 447258 - DNA, 25 bp, Rattus norvegicus
ggctttattttagttccggtggcat

SEQ ID NO: 447259 - DNA, 25 bp, Rattus norvegicus
ggctttattttatgccatttccaaa

SEQ ID NO: 447260 - DNA, 25 bp, Rattus norvegicus
ggctttcaagacacataccttaggg

SEQ ID NO: 447261 - DNA, 25 bp, Rattus norvegicus
ggctttcaagactcataccttaggg

SEQ ID NO: 447262 - DNA, 25 bp, Rattus norvegicus
ggctttcaagatccacgtagctttg

SEQ ID NO: 447263 - DNA, 25 bp, Rattus norvegicus
ggctttcaagatgcacgtagctttg

SEQ ID NO: 447264 - DNA, 25 bp, Rattus norvegicus
ggctttcaatccatgtttgcctgga

SEQ ID NO: 447265 - DNA, 25 bp, Rattus norvegicus
ggctttcaatccttgtttgcctgga

SEQ ID NO: 447266 - DNA, 25 bp, Rattus norvegicus
ggctttcacacactttgtacaggca

SEQ ID NO: 447267 - DNA, 25 bp, Rattus norvegicus
ggctttcacacagtttgtacaggca

SEQ ID NO: 447268 - DNA, 25 bp, Rattus norvegicus
ggctttcaccataaacagatgcata

SEQ ID NO: 447269 - DNA, 25 bp, Rattus norvegicus
ggctttcaccattaacagatgcata

SEQ ID NO: 447270 - DNA, 25 bp, Rattus norvegicus
ggctttcaccccagattttagacag

SEQ ID NO: 447271 - DNA, 25 bp, Rattus norvegicus
ggctttcacccctgattttagacag

SEQ ID NO: 447272 - DNA, 25 bp, Rattus norvegicus
ggctttcactaaacctcagcagatg

SEQ ID NO: 447273 - DNA, 25 bp, Rattus norvegicus
ggctttcactaatcctcagcagatg

SEQ ID NO: 447274 - DNA, 25 bp, Rattus norvegicus
ggctttcactagcagggcagctcag

SEQ ID NO: 447275 - DNA, 25 bp, Rattus norvegicus
ggctttcactaggagggcagctcag

SEQ ID NO: 447276 - DNA, 25 bp, Rattus norvegicus
ggctttcagaatctgcttgaccctt

SEQ ID NO: 447277 - DNA, 25 bp, Rattus norvegicus
ggctttcagaatgtgcttgaccctt

SEQ ID NO: 447278 - DNA, 25 bp, Rattus norvegicus
ggctttcagatgacttactttttga

SEQ ID NO: 447279 - DNA, 25 bp, Rattus norvegicus
ggctttcagatgtcttactttttga

SEQ ID NO: 447280 - DNA, 25 bp, Rattus norvegicus
ggctttcagccaaccataactaggt

SEQ ID NO: 447281 - DNA, 25 bp, Rattus norvegicus
ggctttcagccatccataactaggt

SEQ ID NO: 447282 - DNA, 25 bp, Rattus norvegicus
ggctttcaggtcacacttggattct

SEQ ID NO: 447283 - DNA, 25 bp, Rattus norvegicus
ggctttcaggtctcacttggattct

SEQ ID NO: 447284 - DNA, 25 bp, Rattus norvegicus
ggctttcataatactgtcccatgtt

SEQ ID NO: 447285 - DNA, 25 bp, Rattus norvegicus
ggctttcataattctgtcccatgtt

SEQ ID NO: 447286 - DNA, 25 bp, Rattus norvegicus
ggctttcatcacaggacagcgctaa

SEQ ID NO: 447287 - DNA, 25 bp, Rattus norvegicus
ggctttcatcactggacagcgctaa

SEQ ID NO: 447288 - DNA, 25 bp, Rattus norvegicus
ggctttcattttcatctagactcgt

SEQ ID NO: 447289 - DNA, 25 bp, Rattus norvegicus
ggctttcattttgatctagactcgt

SEQ ID NO: 447290 - DNA, 25 bp, Rattus norvegicus
ggctttccaaagattacattttcat

SEQ ID NO: 447291 - DNA, 25 bp, Rattus norvegicus
ggctttccaaagtttacattttcat

SEQ ID NO: 447292 - DNA, 25 bp, Rattus norvegicus
ggctttccagaacgttctcttctca

SEQ ID NO: 447293 - DNA, 25 bp, Rattus norvegicus
ggctttccagaactcagaggtccat

SEQ ID NO: 447294 - DNA, 25 bp, Rattus norvegicus
ggctttccagaaggttctcttctca

SEQ ID NO: 447295 - DNA, 25 bp, Rattus norvegicus
ggctttccagaagtcagaggtccat

SEQ ID NO: 447296 - DNA, 25 bp, Rattus norvegicus
ggctttccagagcatgcagctaaaa

SEQ ID NO: 447297 - DNA, 25 bp, Rattus norvegicus
ggctttccagaggatgcagctaaaa

SEQ ID NO: 447298 - DNA, 25 bp, Rattus norvegicus
ggctttccagatcggcctaaggact

SEQ ID NO: 447299 - DNA, 25 bp, Rattus norvegicus
ggctttccagatctctgactggcct

SEQ ID NO: 447300 - DNA, 25 bp, Rattus norvegicus
ggctttccagatgggcctaaggact

SEQ ID NO: 447301 - DNA, 25 bp, Rattus norvegicus
ggctttccagatgtctgactggcct

SEQ ID NO: 447302 - DNA, 25 bp, Rattus norvegicus
ggctttccagctcgtgacacactga

SEQ ID NO: 447303 - DNA, 25 bp, Rattus norvegicus
ggctttccagctggtgacacactga

SEQ ID NO: 447304 - DNA, 25 bp, Rattus norvegicus
ggctttcccaccacgacattaagtg

SEQ ID NO: 447305 - DNA, 25 bp, Rattus norvegicus
ggctttcccaccagtgactaagaaa

SEQ ID NO: 447306 - DNA, 25 bp, Rattus norvegicus
ggctttcccacctcgacattaagtg

SEQ ID NO: 447307 - DNA, 25 bp, Rattus norvegicus
ggctttcccacctgtgactaagaaa

SEQ ID NO: 447308 - DNA, 25 bp, Rattus norvegicus
ggctttcccactctggcagtggagt

SEQ ID NO: 447309 - DNA, 25 bp, Rattus norvegicus
ggctttcccactgtggcagtggagt

SEQ ID NO: 447310 - DNA, 25 bp, Rattus norvegicus
ggctttccctccaattgatgctgga

SEQ ID NO: 447311 - DNA, 25 bp, Rattus norvegicus
ggctttccctcctattgatgctgga

SEQ ID NO: 447312 - DNA, 25 bp, Rattus norvegicus
ggctttccgattacttgatgtttct

SEQ ID NO: 447313 - DNA, 25 bp, Rattus norvegicus
ggctttccgatttcttgatgtttct

SEQ ID NO: 447314 - DNA, 25 bp, Rattus norvegicus
ggctttccgcgacattcagttgtag

SEQ ID NO: 447315 - DNA, 25 bp, Rattus norvegicus
ggctttccgcgagattcagttgtag

SEQ ID NO: 447316 - DNA, 25 bp, Rattus norvegicus
ggctttcctacaatacagcctctaa

SEQ ID NO: 447317 - DNA, 25 bp, Rattus norvegicus
ggctttcctacattacagcctctaa

SEQ ID NO: 447318 - DNA, 25 bp, Rattus norvegicus
ggctttcctagcagatgttgtccta

SEQ ID NO: 447319 - DNA, 25 bp, Rattus norvegicus
ggctttcctagctgatgttgtccta

SEQ ID NO: 447320 - DNA, 25 bp, Rattus norvegicus
ggctttccttggcttatgacaatta

SEQ ID NO: 447321 - DNA, 25 bp, Rattus norvegicus
ggctttccttgggttatgacaatta

SEQ ID NO: 447322 - DNA, 25 bp, Rattus norvegicus
ggctttcctttcatgggtcttccat

SEQ ID NO: 447323 - DNA, 25 bp, Rattus norvegicus
ggctttcctttcttgggtcttccat

SEQ ID NO: 447324 - DNA, 25 bp, Rattus norvegicus
ggctttcgacttaatccctggaaag

SEQ ID NO: 447325 - DNA, 25 bp, Rattus norvegicus
ggctttcgactttatccctggaaag

SEQ ID NO: 447326 - DNA, 25 bp, Rattus norvegicus
ggctttcgcagcctattacattaaa

SEQ ID NO: 447327 - DNA, 25 bp, Rattus norvegicus
ggctttcgcagcgtattacattaaa

SEQ ID NO: 447328 - DNA, 25 bp, Rattus norvegicus
ggctttcgcctcaggagtggtcctt

SEQ ID NO: 447329 - DNA, 25 bp, Rattus norvegicus
ggctttcgcctctggagtggtcctt

SEQ ID NO: 447330 - DNA, 25 bp, Rattus norvegicus
ggctttcggagcagacttcacacaa

SEQ ID NO: 447331 - DNA, 25 bp, Rattus norvegicus
ggctttcggagctgacttcacacaa

SEQ ID NO: 447332 - DNA, 25 bp, Rattus norvegicus
ggctttctaatgcacttctgttcaa

SEQ ID NO: 447333 - DNA, 25 bp, Rattus norvegicus
ggctttctaatggacttctgttcaa

SEQ ID NO: 447334 - DNA, 25 bp, Rattus norvegicus
ggctttctacacaaggtctcagact

SEQ ID NO: 447335 - DNA, 25 bp, Rattus norvegicus
ggctttctacactaggtctcagact

SEQ ID NO: 447336 - DNA, 25 bp, Rattus norvegicus
ggctttctacctactgtttgcaaaa

SEQ ID NO: 447337 - DNA, 25 bp, Rattus norvegicus
ggctttctaccttctgtttgcaaaa

SEQ ID NO: 447338 - DNA, 25 bp, Rattus norvegicus
ggctttctagctaaggaaggcaata

SEQ ID NO: 447339 - DNA, 25 bp, Rattus norvegicus
ggctttctagcttaggaaggcaata

SEQ ID NO: 447340 - DNA, 25 bp, Rattus norvegicus
ggctttctcatacagaagcagacta

SEQ ID NO: 447341 - DNA, 25 bp, Rattus norvegicus
ggctttctcatagagaagcagacta

SEQ ID NO: 447342 - DNA, 25 bp, Rattus norvegicus
ggctttctcatgaatatccttacaa

SEQ ID NO: 447343 - DNA, 25 bp, Rattus norvegicus
ggctttctcatgtatatccttacaa

SEQ ID NO: 447344 - DNA, 25 bp, Rattus norvegicus
ggctttctcattcaccttagactta

SEQ ID NO: 447345 - DNA, 25 bp, Rattus norvegicus
ggctttctcattgaccttagactta

SEQ ID NO: 447346 - DNA, 25 bp, Rattus norvegicus
ggctttctccgtcgagttgtaccaa

SEQ ID NO: 447347 - DNA, 25 bp, Rattus norvegicus
ggctttctccgtggagttgtaccaa

SEQ ID NO: 447348 - DNA, 25 bp, Rattus norvegicus
ggctttctcttccacaaagaccagt

SEQ ID NO: 447349 - DNA, 25 bp, Rattus norvegicus
ggctttctcttcgacaaagaccagt

SEQ ID NO: 447350 - DNA, 25 bp, Rattus norvegicus
ggctttctgacaatagttccgacac

SEQ ID NO: 447351 - DNA, 25 bp, Rattus norvegicus
ggctttctgacattagttccgacac

SEQ ID NO: 447352 - DNA, 25 bp, Rattus norvegicus
ggctttctgagaagctttcctataa

SEQ ID NO: 447353 - DNA, 25 bp, Rattus norvegicus
ggctttctgagatgctttcctataa

SEQ ID NO: 447354 - DNA, 25 bp, Rattus norvegicus
ggctttctgcatcggctatagttat

SEQ ID NO: 447355 - DNA, 25 bp, Rattus norvegicus
ggctttctgcatgggctatagttat

SEQ ID NO: 447356 - DNA, 25 bp, Rattus norvegicus
ggctttctgccaagtgatacactag

SEQ ID NO: 447357 - DNA, 25 bp, Rattus norvegicus
ggctttctgccatgtgatacactag

SEQ ID NO: 447358 - DNA, 25 bp, Rattus norvegicus
ggctttctggatattacctgcactt

SEQ ID NO: 447359 - DNA, 25 bp, Rattus norvegicus
ggctttctggattttacctgcactt

SEQ ID NO: 447360 - DNA, 25 bp, Rattus norvegicus
ggctttctggtcacttctgaggaga

SEQ ID NO: 447361 - DNA, 25 bp, Rattus norvegicus
ggctttctggtctcttctgaggaga

SEQ ID NO: 447362 - DNA, 25 bp, Rattus norvegicus
ggctttctggtgcttatggtcatcc

SEQ ID NO: 447363 - DNA, 25 bp, Rattus norvegicus
ggctttctggtggttatggtcatcc

SEQ ID NO: 447364 - DNA, 25 bp, Rattus norvegicus
ggctttctgtttcatatcccttttg

SEQ ID NO: 447365 - DNA, 25 bp, Rattus norvegicus
ggctttctgtttgatatcccttttg

SEQ ID NO: 447366 - DNA, 25 bp, Rattus norvegicus
ggctttcttactacacagatccaat

SEQ ID NO: 447367 - DNA, 25 bp, Rattus norvegicus
ggctttcttacttcacagatccaat

SEQ ID NO: 447368 - DNA, 25 bp, Rattus norvegicus
ggctttcttcaccttgtacagtaga

SEQ ID NO: 447369 - DNA, 25 bp, Rattus norvegicus
ggctttcttcacgttgtacagtaga

SEQ ID NO: 447370 - DNA, 25 bp, Rattus norvegicus
ggctttcttctcatatttcggttat

SEQ ID NO: 447371 - DNA, 25 bp, Rattus norvegicus
ggctttcttctcatcatgagatgta

SEQ ID NO: 447372 - DNA, 25 bp, Rattus norvegicus
ggctttcttctcttatttcggttat

SEQ ID NO: 447373 - DNA, 25 bp, Rattus norvegicus
ggctttcttctcttcatgagatgta

SEQ ID NO: 447374 - DNA, 25 bp, Rattus norvegicus
ggctttctttgtccatttggtaaat

SEQ ID NO: 447375 - DNA, 25 bp, Rattus norvegicus
ggctttctttgtgcatttggtaaat

SEQ ID NO: 447376 - DNA, 25 bp, Rattus norvegicus
ggctttgaaaacctgcacacatgac

SEQ ID NO: 447377 - DNA, 25 bp, Rattus norvegicus
ggctttgaaaacgtgcacacatgac

SEQ ID NO: 447378 - DNA, 25 bp, Rattus norvegicus
ggctttgaaaagctgctgctctcat

SEQ ID NO: 447379 - DNA, 25 bp, Rattus norvegicus
ggctttgaaaaggtgctgctctcat

SEQ ID NO: 447380 - DNA, 25 bp, Rattus norvegicus
ggctttgaagcccaatcattgtgaa

SEQ ID NO: 447381 - DNA, 25 bp, Rattus norvegicus
ggctttgaagccgaatcattgtgaa

SEQ ID NO: 447382 - DNA, 25 bp, Rattus norvegicus
ggctttgaatccagtgtgttctagt

SEQ ID NO: 447383 - DNA, 25 bp, Rattus norvegicus
ggctttgaatcctgtgtgttctagt

SEQ ID NO: 447384 - DNA, 25 bp, Rattus norvegicus
ggctttgacacgctgacagctatgg

SEQ ID NO: 447385 - DNA, 25 bp, Rattus norvegicus
ggctttgacacggtgacagctatgg

SEQ ID NO: 447386 - DNA, 25 bp, Rattus norvegicus
ggctttgacagtagctgaccctagc

SEQ ID NO: 447387 - DNA, 25 bp, Rattus norvegicus
ggctttgacagttgctgaccctagc

SEQ ID NO: 447388 - DNA, 25 bp, Rattus norvegicus
ggctttgacccaattctgatgtggt

SEQ ID NO: 447389 - DNA, 25 bp, Rattus norvegicus
ggctttgacccatttctgatgtggt

SEQ ID NO: 447390 - DNA, 25 bp, Rattus norvegicus
ggctttgagattctgcgtccaggtc

SEQ ID NO: 447391 - DNA, 25 bp, Rattus norvegicus
ggctttgagattgtgcgtccaggtc

SEQ ID NO: 447392 - DNA, 25 bp, Rattus norvegicus
ggctttgagctcaatggcactgtaa

SEQ ID NO: 447393 - DNA, 25 bp, Rattus norvegicus
ggctttgagctctatggcactgtaa

SEQ ID NO: 447394 - DNA, 25 bp, Rattus norvegicus
ggctttgaggagagcccacgccaaa

SEQ ID NO: 447395 - DNA, 25 bp, Rattus norvegicus
ggctttgaggagtgcccacgccaaa

SEQ ID NO: 447396 - DNA, 25 bp, Rattus norvegicus
ggctttgagttgaagatccccggat

SEQ ID NO: 447397 - DNA, 25 bp, Rattus norvegicus
ggctttgagttgtagatccccggat

SEQ ID NO: 447398 - DNA, 25 bp, Rattus norvegicus
ggctttgatcttagctgaatccagc

SEQ ID NO: 447399 - DNA, 25 bp, Rattus norvegicus
ggctttgatctttgctgaatccagc

SEQ ID NO: 447400 - DNA, 25 bp, Rattus norvegicus
ggctttgatgatcatgttctcctgc

SEQ ID NO: 447401 - DNA, 25 bp, Rattus norvegicus
ggctttgatgatgatgttctcctgc

SEQ ID NO: 447402 - DNA, 25 bp, Rattus norvegicus
ggctttgcaaagactcgtgctttct

SEQ ID NO: 447403 - DNA, 25 bp, Rattus norvegicus
ggctttgcaaagtctcgtgctttct

SEQ ID NO: 447404 - DNA, 25 bp, Rattus norvegicus
ggctttgcacggcttttcaggtaac

SEQ ID NO: 447405 - DNA, 25 bp, Rattus norvegicus
ggctttgcacgggttttcaggtaac

SEQ ID NO: 447406 - DNA, 25 bp, Rattus norvegicus
ggctttgcactacacgttgatacca

SEQ ID NO: 447407 - DNA, 25 bp, Rattus norvegicus
ggctttgcactagacgttgatacca

SEQ ID NO: 447408 - DNA, 25 bp, Rattus norvegicus
ggctttgccaagagtgccagttact

SEQ ID NO: 447409 - DNA, 25 bp, Rattus norvegicus
ggctttgccaagtgtgccagttact

SEQ ID NO: 447410 - DNA, 25 bp, Rattus norvegicus
ggctttgccaatcagttctagaaat

SEQ ID NO: 447411 - DNA, 25 bp, Rattus norvegicus
ggctttgccaatgagttctagaaat

SEQ ID NO: 447412 - DNA, 25 bp, Rattus norvegicus
ggctttgcccagaaccagctggtta

SEQ ID NO: 447413 - DNA, 25 bp, Rattus norvegicus
ggctttgcccagtaccagctggtta

SEQ ID NO: 447414 - DNA, 25 bp, Rattus norvegicus
ggctttgcctgtcgatcttgggaaa

SEQ ID NO: 447415 - DNA, 25 bp, Rattus norvegicus
ggctttgcctgtggatcttgggaaa

SEQ ID NO: 447416 - DNA, 25 bp, Rattus norvegicus
ggctttgcctttaatgatctcttac

SEQ ID NO: 447417 - DNA, 25 bp, Rattus norvegicus
ggctttgccttttatgatctcttac

SEQ ID NO: 447418 - DNA, 25 bp, Rattus norvegicus
ggctttgcgtttatccacatgatct

SEQ ID NO: 447419 - DNA, 25 bp, Rattus norvegicus
ggctttgcgtttttccacatgatct

SEQ ID NO: 447420 - DNA, 25 bp, Rattus norvegicus
ggctttgctcacatgcagacacaga

SEQ ID NO: 447421 - DNA, 25 bp, Rattus norvegicus
ggctttgctcacttgcagacacaga

SEQ ID NO: 447422 - DNA, 25 bp, Rattus norvegicus
ggctttgctccacacctgttatgaa

SEQ ID NO: 447423 - DNA, 25 bp, Rattus norvegicus
ggctttgctccagacctgttatgaa

SEQ ID NO: 447424 - DNA, 25 bp, Rattus norvegicus
ggctttgctcgtatccagtggtagg

SEQ ID NO: 447425 - DNA, 25 bp, Rattus norvegicus
ggctttgctcgtttccagtggtagg

SEQ ID NO: 447426 - DNA, 25 bp, Rattus norvegicus
ggctttgctgagcacattcccagga

SEQ ID NO: 447427 - DNA, 25 bp, Rattus norvegicus
ggctttgctgaggacattcccagga

SEQ ID NO: 447428 - DNA, 25 bp, Rattus norvegicus
ggctttggaagcacattcatcacaa

SEQ ID NO: 447429 - DNA, 25 bp, Rattus norvegicus
ggctttggaagctcattcatcacaa

SEQ ID NO: 447430 - DNA, 25 bp, Rattus norvegicus
ggctttggaagtatcaaccttcaca

SEQ ID NO: 447431 - DNA, 25 bp, Rattus norvegicus
ggctttggaagtttcaaccttcaca

SEQ ID NO: 447432 - DNA, 25 bp, Rattus norvegicus
ggctttggagtgacacctctgcttc

SEQ ID NO: 447433 - DNA, 25 bp, Rattus norvegicus
ggctttggagtgtcacctctgcttc

SEQ ID NO: 447434 - DNA, 25 bp, Rattus norvegicus
ggctttggagttaccttcattcaga

SEQ ID NO: 447435 - DNA, 25 bp, Rattus norvegicus
ggctttggagtttccttcattcaga

SEQ ID NO: 447436 - DNA, 25 bp, Rattus norvegicus
ggctttggcacgctggtcttcacaa

SEQ ID NO: 447437 - DNA, 25 bp, Rattus norvegicus
ggctttggcacggtggtcttcacaa

SEQ ID NO: 447438 - DNA, 25 bp, Rattus norvegicus
ggctttggcattaagtttcccagaa

SEQ ID NO: 447439 - DNA, 25 bp, Rattus norvegicus
ggctttggcatttagtttcccagaa

SEQ ID NO: 447440 - DNA, 25 bp, Rattus norvegicus
ggctttggccagaacaacattcgtg

SEQ ID NO: 447441 - DNA, 25 bp, Rattus norvegicus
ggctttggccagtacaacattcgtg

SEQ ID NO: 447442 - DNA, 25 bp, Rattus norvegicus
ggctttggcctccaaggactgtttc

SEQ ID NO: 447443 - DNA, 25 bp, Rattus norvegicus
ggctttggcctcgaaggactgtttc

SEQ ID NO: 447444 - DNA, 25 bp, Rattus norvegicus
ggctttggccttccaagtgaactca

SEQ ID NO: 447445 - DNA, 25 bp, Rattus norvegicus
ggctttggccttgcaagtgaactca

SEQ ID NO: 447446 - DNA, 25 bp, Rattus norvegicus
ggctttggctacaggctgcacagta

SEQ ID NO: 447447 - DNA, 25 bp, Rattus norvegicus
ggctttggctacctattgttttctc

SEQ ID NO: 447448 - DNA, 25 bp, Rattus norvegicus
ggctttggctacgtattgttttctc

SEQ ID NO: 447449 - DNA, 25 bp, Rattus norvegicus
ggctttggctactggctgcacagta

SEQ ID NO: 447450 - DNA, 25 bp, Rattus norvegicus
ggctttggctcaagcatggattcta

SEQ ID NO: 447451 - DNA, 25 bp, Rattus norvegicus
ggctttggctcatgcatggattcta

SEQ ID NO: 447452 - DNA, 25 bp, Rattus norvegicus
ggctttggctgaaacccattttgct

SEQ ID NO: 447453 - DNA, 25 bp, Rattus norvegicus
ggctttggctgatacccattttgct

SEQ ID NO: 447454 - DNA, 25 bp, Rattus norvegicus
ggctttggctttcaggatggcaccc

SEQ ID NO: 447455 - DNA, 25 bp, Rattus norvegicus
ggctttggctttgaggatggcaccc

SEQ ID NO: 447456 - DNA, 25 bp, Rattus norvegicus
ggctttgggactcagttagcttcga

SEQ ID NO: 447457 - DNA, 25 bp, Rattus norvegicus
ggctttgggactgagttagcttcga

SEQ ID NO: 447458 - DNA, 25 bp, Rattus norvegicus
ggctttgggcttatgcagtgctaac

SEQ ID NO: 447459 - DNA, 25 bp, Rattus norvegicus
ggctttgggcttttgcagtgctaac

SEQ ID NO: 447460 - DNA, 25 bp, Rattus norvegicus
ggctttgggttacgccctggtcaca

SEQ ID NO: 447461 - DNA, 25 bp, Rattus norvegicus
ggctttgggttaggccctggtcaca

SEQ ID NO: 447462 - DNA, 25 bp, Rattus norvegicus
ggctttgtaagcattcctttctagg

SEQ ID NO: 447463 - DNA, 25 bp, Rattus norvegicus
ggctttgtaagctttcctttctagg

SEQ ID NO: 447464 - DNA, 25 bp, Rattus norvegicus
ggctttgtacaaactctggtttcct

SEQ ID NO: 447465 - DNA, 25 bp, Rattus norvegicus
ggctttgtacaatctctggtttcct

SEQ ID NO: 447466 - DNA, 25 bp, Rattus norvegicus
ggctttgtagtcactactgtggcaa

SEQ ID NO: 447467 - DNA, 25 bp, Rattus norvegicus
ggctttgtagtctctactgtggcaa

SEQ ID NO: 447468 - DNA, 25 bp, Rattus norvegicus
ggctttgtcatgctaggttcccaaa

SEQ ID NO: 447469 - DNA, 25 bp, Rattus norvegicus
ggctttgtcatggtaggttcccaaa

SEQ ID NO: 447470 - DNA, 25 bp, Rattus norvegicus
ggctttgtcattctgttccatgtgc

SEQ ID NO: 447471 - DNA, 25 bp, Rattus norvegicus
ggctttgtcattgtgttccatgtgc

SEQ ID NO: 447472 - DNA, 25 bp, Rattus norvegicus
ggctttgtcccacctgaagtgacat

SEQ ID NO: 447473 - DNA, 25 bp, Rattus norvegicus
ggctttgtcccagctgaagtgacat

SEQ ID NO: 447474 - DNA, 25 bp, Rattus norvegicus
ggctttgtcttcacagtgagttcca

SEQ ID NO: 447475 - DNA, 25 bp, Rattus norvegicus
ggctttgtcttctcagtgagttcca

SEQ ID NO: 447476 - DNA, 25 bp, Rattus norvegicus
ggctttgtgcacctgtgtccagaga

SEQ ID NO: 447477 - DNA, 25 bp, Rattus norvegicus
ggctttgtgcacgtgtgtccagaga

SEQ ID NO: 447478 - DNA, 25 bp, Rattus norvegicus
ggctttgtgctactttctaaagttg

SEQ ID NO: 447479 - DNA, 25 bp, Rattus norvegicus
ggctttgtgctagtttctaaagttg

SEQ ID NO: 447480 - DNA, 25 bp, Rattus norvegicus
ggctttgtgttcatttgcaggacct

SEQ ID NO: 447481 - DNA, 25 bp, Rattus norvegicus
ggctttgtgttcttttgcaggacct

SEQ ID NO: 447482 - DNA, 25 bp, Rattus norvegicus
ggctttgttcccaatgacatgcaag

SEQ ID NO: 447483 - DNA, 25 bp, Rattus norvegicus
ggctttgttccctatgacatgcaag

SEQ ID NO: 447484 - DNA, 25 bp, Rattus norvegicus
ggctttgttcttacctgagctgcag

SEQ ID NO: 447485 - DNA, 25 bp, Rattus norvegicus
ggctttgttctttcctgagctgcag

SEQ ID NO: 447486 - DNA, 25 bp, Rattus norvegicus
ggcttttaactgaacgtgtacgaca

SEQ ID NO: 447487 - DNA, 25 bp, Rattus norvegicus
ggcttttaactgtacgtgtacgaca

SEQ ID NO: 447488 - DNA, 25 bp, Rattus norvegicus
ggcttttacactaaactgtgttttg

SEQ ID NO: 447489 - DNA, 25 bp, Rattus norvegicus
ggcttttacacttaactgtgttttg

SEQ ID NO: 447490 - DNA, 25 bp, Rattus norvegicus
ggcttttaccctagtattacaacat

SEQ ID NO: 447491 - DNA, 25 bp, Rattus norvegicus
ggcttttacccttgtattacaacat

SEQ ID NO: 447492 - DNA, 25 bp, Rattus norvegicus
ggcttttactcaagccttgtatatc

SEQ ID NO: 447493 - DNA, 25 bp, Rattus norvegicus
ggcttttactcatgccttgtatatc

SEQ ID NO: 447494 - DNA, 25 bp, Rattus norvegicus
ggcttttactggcacgccttgtctg

SEQ ID NO: 447495 - DNA, 25 bp, Rattus norvegicus
ggcttttactgggacgccttgtctg

SEQ ID NO: 447496 - DNA, 25 bp, Rattus norvegicus
ggcttttatctaccaatattcatgg

SEQ ID NO: 447497 - DNA, 25 bp, Rattus norvegicus
ggcttttatctagcaatattcatgg

SEQ ID NO: 447498 - DNA, 25 bp, Rattus norvegicus
ggcttttatgcccttcattagctga

SEQ ID NO: 447499 - DNA, 25 bp, Rattus norvegicus
ggcttttatgccgttcattagctga

SEQ ID NO: 447500 - DNA, 25 bp, Rattus norvegicus
ggcttttattctattattccatggg

SEQ ID NO: 447501 - DNA, 25 bp, Rattus norvegicus
ggcttttattcttttattccatggg

SEQ ID NO: 447502 - DNA, 25 bp, Rattus norvegicus
ggcttttattgtaccttttcagttg

SEQ ID NO: 447503 - DNA, 25 bp, Rattus norvegicus
ggcttttattgttccttttcagttg

SEQ ID NO: 447504 - DNA, 25 bp, Rattus norvegicus
ggcttttatttcacaggactccatc

SEQ ID NO: 447505 - DNA, 25 bp, Rattus norvegicus
ggcttttatttctcaggactccatc

SEQ ID NO: 447506 - DNA, 25 bp, Rattus norvegicus
ggcttttcaaagactgttcccatag

SEQ ID NO: 447507 - DNA, 25 bp, Rattus norvegicus
ggcttttcaaagtctgttcccatag

SEQ ID NO: 447508 - DNA, 25 bp, Rattus norvegicus
ggcttttcaaatagcttttccctgc

SEQ ID NO: 447509 - DNA, 25 bp, Rattus norvegicus
ggcttttcaaattgcttttccctgc

SEQ ID NO: 447510 - DNA, 25 bp, Rattus norvegicus
ggcttttcaagcagtcttagggcgc

SEQ ID NO: 447511 - DNA, 25 bp, Rattus norvegicus
ggcttttcaagctgtcttagggcgc

SEQ ID NO: 447512 - DNA, 25 bp, Rattus norvegicus
ggcttttcagaaacggacctataca

SEQ ID NO: 447513 - DNA, 25 bp, Rattus norvegicus
ggcttttcagaatcggacctataca

SEQ ID NO: 447514 - DNA, 25 bp, Rattus norvegicus
ggcttttccaaactcatgaccacag

SEQ ID NO: 447515 - DNA, 25 bp, Rattus norvegicus
ggcttttccaaagtcatgaccacag

SEQ ID NO: 447516 - DNA, 25 bp, Rattus norvegicus
ggcttttccagaatttgtgtcctca

SEQ ID NO: 447517 - DNA, 25 bp, Rattus norvegicus
ggcttttccagattttgtgtcctca

SEQ ID NO: 447518 - DNA, 25 bp, Rattus norvegicus
ggcttttccataagtggcctttaag

SEQ ID NO: 447519 - DNA, 25 bp, Rattus norvegicus
ggcttttccatatgtggcctttaag

SEQ ID NO: 447520 - DNA, 25 bp, Rattus norvegicus
ggcttttcccatcttgatagtcttt

SEQ ID NO: 447521 - DNA, 25 bp, Rattus norvegicus
ggcttttcccatgttgatagtcttt

SEQ ID NO: 447522 - DNA, 25 bp, Rattus norvegicus
ggcttttcgtgtcttaacatatctt

SEQ ID NO: 447523 - DNA, 25 bp, Rattus norvegicus
ggcttttcgtgtgttaacatatctt

SEQ ID NO: 447524 - DNA, 25 bp, Rattus norvegicus
ggcttttctgctaacttctattcga

SEQ ID NO: 447525 - DNA, 25 bp, Rattus norvegicus
ggcttttctgctactttgtgaatgc

SEQ ID NO: 447526 - DNA, 25 bp, Rattus norvegicus
ggcttttctgcttacttctattcga

SEQ ID NO: 447527 - DNA, 25 bp, Rattus norvegicus
ggcttttctgcttctttgtgaatgc

SEQ ID NO: 447528 - DNA, 25 bp, Rattus norvegicus
ggcttttcttatattctgtttccaa

SEQ ID NO: 447529 - DNA, 25 bp, Rattus norvegicus
ggcttttcttattttctgtttccaa

SEQ ID NO: 447530 - DNA, 25 bp, Rattus norvegicus
ggcttttcttccaccttaatcagga

SEQ ID NO: 447531 - DNA, 25 bp, Rattus norvegicus
ggcttttcttcctccttaatcagga

SEQ ID NO: 447532 - DNA, 25 bp, Rattus norvegicus
ggcttttcttgaaacagcttctcct

SEQ ID NO: 447533 - DNA, 25 bp, Rattus norvegicus
ggcttttcttgatacagcttctcct

SEQ ID NO: 447534 - DNA, 25 bp, Rattus norvegicus
ggcttttcttgtcattatcctcgat

SEQ ID NO: 447535 - DNA, 25 bp, Rattus norvegicus
ggcttttcttgtgattatcctcgat

SEQ ID NO: 447536 - DNA, 25 bp, Rattus norvegicus
ggcttttgacaccatgttgtctcac

SEQ ID NO: 447537 - DNA, 25 bp, Rattus norvegicus
ggcttttgacacgatgttgtctcac

SEQ ID NO: 447538 - DNA, 25 bp, Rattus norvegicus
ggcttttgcaacaatgttgcttctg

SEQ ID NO: 447539 - DNA, 25 bp, Rattus norvegicus
ggcttttgcaactatgttgcttctg

SEQ ID NO: 447540 - DNA, 25 bp, Rattus norvegicus
ggcttttgcactattgacgttctca

SEQ ID NO: 447541 - DNA, 25 bp, Rattus norvegicus
ggcttttgcacttttgacgttctca

SEQ ID NO: 447542 - DNA, 25 bp, Rattus norvegicus
ggcttttgccagaagctaaccgaaa

SEQ ID NO: 447543 - DNA, 25 bp, Rattus norvegicus
ggcttttgccagtagctaaccgaaa

SEQ ID NO: 447544 - DNA, 25 bp, Rattus norvegicus
ggcttttgcttaagtcccagttgag

SEQ ID NO: 447545 - DNA, 25 bp, Rattus norvegicus
ggcttttgcttatgtcccagttgag

SEQ ID NO: 447546 - DNA, 25 bp, Rattus norvegicus
ggcttttgctttaatgtccactatc

SEQ ID NO: 447547 - DNA, 25 bp, Rattus norvegicus
ggcttttgcttttatgtccactatc

SEQ ID NO: 447548 - DNA, 25 bp, Rattus norvegicus
ggcttttggaacctggtccttcttg

SEQ ID NO: 447549 - DNA, 25 bp, Rattus norvegicus
ggcttttggaacgtggtccttcttg

SEQ ID NO: 447550 - DNA, 25 bp, Rattus norvegicus
ggcttttggagaactcacatgaaaa

SEQ ID NO: 447551 - DNA, 25 bp, Rattus norvegicus
ggcttttggagatctcacatgaaaa

SEQ ID NO: 447552 - DNA, 25 bp, Rattus norvegicus
ggcttttggtcacggggtttcatca

SEQ ID NO: 447553 - DNA, 25 bp, Rattus norvegicus
ggcttttggtcagggggtttcatca

SEQ ID NO: 447554 - DNA, 25 bp, Rattus norvegicus
ggcttttgtaaccttgacacacagt

SEQ ID NO: 447555 - DNA, 25 bp, Rattus norvegicus
ggcttttgtaacgttgacacacagt

SEQ ID NO: 447556 - DNA, 25 bp, Rattus norvegicus
ggcttttgtacaattcagtcttgat

SEQ ID NO: 447557 - DNA, 25 bp, Rattus norvegicus
ggcttttgtacatttcagtcttgat

SEQ ID NO: 447558 - DNA, 25 bp, Rattus norvegicus
ggcttttgtcttatgggatggccaa

SEQ ID NO: 447559 - DNA, 25 bp, Rattus norvegicus
ggcttttgtcttttgggatggccaa

SEQ ID NO: 447560 - DNA, 25 bp, Rattus norvegicus
ggcttttgttgaagtgaatatgttc

SEQ ID NO: 447561 - DNA, 25 bp, Rattus norvegicus
ggcttttgttgaagttctctggctt

SEQ ID NO: 447562 - DNA, 25 bp, Rattus norvegicus
ggcttttgttgatgtgaatatgttc

SEQ ID NO: 447563 - DNA, 25 bp, Rattus norvegicus
ggcttttgttgatgttctctggctt

SEQ ID NO: 447564 - DNA, 25 bp, Rattus norvegicus
ggcttttgttttaccagtggccaga

SEQ ID NO: 447565 - DNA, 25 bp, Rattus norvegicus
ggcttttgtttttccagtggccaga

SEQ ID NO: 447566 - DNA, 25 bp, Rattus norvegicus
ggctttttaacacgagatctcggga

SEQ ID NO: 447567 - DNA, 25 bp, Rattus norvegicus
ggctttttaacaggagatctcggga

SEQ ID NO: 447568 - DNA, 25 bp, Rattus norvegicus
ggctttttacataggagcacgctgt

SEQ ID NO: 447569 - DNA, 25 bp, Rattus norvegicus
ggctttttacattggagcacgctgt

SEQ ID NO: 447570 - DNA, 25 bp, Rattus norvegicus
ggctttttatttctctccactgagt

SEQ ID NO: 447571 - DNA, 25 bp, Rattus norvegicus
ggctttttatttgtctccactgagt

SEQ ID NO: 447572 - DNA, 25 bp, Rattus norvegicus
ggctttttcaccactcagaaacacc

SEQ ID NO: 447573 - DNA, 25 bp, Rattus norvegicus
ggctttttcacctctcagaaacacc

SEQ ID NO: 447574 - DNA, 25 bp, Rattus norvegicus
ggctttttcagaatgacccaacctc

SEQ ID NO: 447575 - DNA, 25 bp, Rattus norvegicus
ggctttttcagattgacccaacctc

SEQ ID NO: 447576 - DNA, 25 bp, Rattus norvegicus
ggctttttccagacgtaaaggctct

SEQ ID NO: 447577 - DNA, 25 bp, Rattus norvegicus
ggctttttccagtcgtaaaggctct

SEQ ID NO: 447578 - DNA, 25 bp, Rattus norvegicus
ggctttttctagagctggactccta

SEQ ID NO: 447579 - DNA, 25 bp, Rattus norvegicus
ggctttttctagtgctggactccta

SEQ ID NO: 447580 - DNA, 25 bp, Rattus norvegicus
ggctttttgcctatgtgtctcaata

SEQ ID NO: 447581 - DNA, 25 bp, Rattus norvegicus
ggctttttgcctttgtgtctcaata

SEQ ID NO: 447582 - DNA, 25 bp, Rattus norvegicus
ggctttttgcgcaaataccccaaga

SEQ ID NO: 447583 - DNA, 25 bp, Rattus norvegicus
ggctttttgcgctaataccccaaga

SEQ ID NO: 447584 - DNA, 25 bp, Rattus norvegicus
ggctttttgctaatgtgactgtgaa

SEQ ID NO: 447585 - DNA, 25 bp, Rattus norvegicus
ggctttttgctattgtgactgtgaa

SEQ ID NO: 447586 - DNA, 25 bp, Rattus norvegicus
ggctttttgcttagccctgaaaatt

SEQ ID NO: 447587 - DNA, 25 bp, Rattus norvegicus
ggctttttgctttgccctgaaaatt

SEQ ID NO: 447588 - DNA, 25 bp, Rattus norvegicus
ggctttttggaaaactcgctcttat

SEQ ID NO: 447589 - DNA, 25 bp, Rattus norvegicus
ggctttttggaatactcgctcttat

SEQ ID NO: 447590 - DNA, 25 bp, Rattus norvegicus
ggctttttgtcgatttctaatcact

SEQ ID NO: 447591 - DNA, 25 bp, Rattus norvegicus
ggctttttgtcgttttctaatcact

SEQ ID NO: 447592 - DNA, 25 bp, Rattus norvegicus
ggctttttgttgaagttcctgacgc

SEQ ID NO: 447593 - DNA, 25 bp, Rattus norvegicus
ggctttttgttgtagttcctgacgc

SEQ ID NO: 447594 - DNA, 25 bp, Rattus norvegicus
ggcttttttatcactaacactgtca

SEQ ID NO: 447595 - DNA, 25 bp, Rattus norvegicus
ggcttttttatctctaacactgtca

SEQ ID NO: 447596 - DNA, 25 bp, Rattus norvegicus
ggcttttttgctagaattttcagtt

SEQ ID NO: 447597 - DNA, 25 bp, Rattus norvegicus
ggcttttttgcttgaattttcagtt

SEQ ID NO: 447598 - DNA, 25 bp, Rattus norvegicus
gggaaaaaacccatacattctaatg

SEQ ID NO: 447599 - DNA, 25 bp, Rattus norvegicus
gggaaaaaacccttacattctaatg

SEQ ID NO: 447600 - DNA, 25 bp, Rattus norvegicus
gggaaaaacagtagcttcagccaaa

SEQ ID NO: 447601 - DNA, 25 bp, Rattus norvegicus
gggaaaaacagttgcttcagccaaa

SEQ ID NO: 447602 - DNA, 25 bp, Rattus norvegicus
gggaaaaagtcacgcccgagccagg

SEQ ID NO: 447603 - DNA, 25 bp, Rattus norvegicus
gggaaaaagtcaggcccgagccagg

SEQ ID NO: 447604 - DNA, 25 bp, Rattus norvegicus
gggaaaaattaaaacatgctacaag

SEQ ID NO: 447605 - DNA, 25 bp, Rattus norvegicus
gggaaaaattaatacatgctacaag

SEQ ID NO: 447606 - DNA, 25 bp, Rattus norvegicus
gggaaaacacagcaccgattacaaa

SEQ ID NO: 447607 - DNA, 25 bp, Rattus norvegicus
gggaaaacacaggaccgattacaaa

SEQ ID NO: 447608 - DNA, 25 bp, Rattus norvegicus
gggaaaacataaccagcccactgta

SEQ ID NO: 447609 - DNA, 25 bp, Rattus norvegicus
gggaaaacataagcagcccactgta

SEQ ID NO: 447610 - DNA, 25 bp, Rattus norvegicus
gggaaaacatccacagtcactaaga

SEQ ID NO: 447611 - DNA, 25 bp, Rattus norvegicus
gggaaaacatcctcagtcactaaga

SEQ ID NO: 447612 - DNA, 25 bp, Rattus norvegicus
gggaaaacctcaagctgccagtgtt

SEQ ID NO: 447613 - DNA, 25 bp, Rattus norvegicus
gggaaaacctcatgctgccagtgtt

SEQ ID NO: 447614 - DNA, 25 bp, Rattus norvegicus
gggaaaactcctatgtcgaatcatt

SEQ ID NO: 447615 - DNA, 25 bp, Rattus norvegicus
gggaaaactcctttgtcgaatcatt

SEQ ID NO: 447616 - DNA, 25 bp, Rattus norvegicus
gggaaaactgagaccctctctgcag

SEQ ID NO: 447617 - DNA, 25 bp, Rattus norvegicus
gggaaaactgagtccctctctgcag

SEQ ID NO: 447618 - DNA, 25 bp, Rattus norvegicus
gggaaaactgccaggaacttccact

SEQ ID NO: 447619 - DNA, 25 bp, Rattus norvegicus
gggaaaactgcctggaacttccact

SEQ ID NO: 447620 - DNA, 25 bp, Rattus norvegicus
gggaaaactgtccccagttgtgcac

SEQ ID NO: 447621 - DNA, 25 bp, Rattus norvegicus
gggaaaactgtcgccagttgtgcac

SEQ ID NO: 447622 - DNA, 25 bp, Rattus norvegicus
gggaaaactgttcactccaactcaa

SEQ ID NO: 447623 - DNA, 25 bp, Rattus norvegicus
gggaaaactgttgactccaactcaa

SEQ ID NO: 447624 - DNA, 25 bp, Rattus norvegicus
gggaaaacttagagaaactgaatca

SEQ ID NO: 447625 - DNA, 25 bp, Rattus norvegicus
gggaaaacttagtgaaactgaatca

SEQ ID NO: 447626 - DNA, 25 bp, Rattus norvegicus
gggaaaagacctcccggaatgccat

SEQ ID NO: 447627 - DNA, 25 bp, Rattus norvegicus
gggaaaagacctgccggaatgccat

SEQ ID NO: 447628 - DNA, 25 bp, Rattus norvegicus
gggaaaagccagaactgaggcctaa

SEQ ID NO: 447629 - DNA, 25 bp, Rattus norvegicus
gggaaaagccagctctttgtataga

SEQ ID NO: 447630 - DNA, 25 bp, Rattus norvegicus
gggaaaagccaggtctttgtataga

SEQ ID NO: 447631 - DNA, 25 bp, Rattus norvegicus
gggaaaagccagtactgaggcctaa

SEQ ID NO: 447632 - DNA, 25 bp, Rattus norvegicus
gggaaaagcccaatacatcttgtat

SEQ ID NO: 447633 - DNA, 25 bp, Rattus norvegicus
gggaaaagcccattacatcttgtat

SEQ ID NO: 447634 - DNA, 25 bp, Rattus norvegicus
gggaaaagcgaacttcacccacttg

SEQ ID NO: 447635 - DNA, 25 bp, Rattus norvegicus
gggaaaagcgaagttcacccacttg

SEQ ID NO: 447636 - DNA, 25 bp, Rattus norvegicus
gggaaaagtaccatctcctggccat

SEQ ID NO: 447637 - DNA, 25 bp, Rattus norvegicus
gggaaaagtaccttctcctggccat

SEQ ID NO: 447638 - DNA, 25 bp, Rattus norvegicus
gggaaaagtactatgctgcctcttt

SEQ ID NO: 447639 - DNA, 25 bp, Rattus norvegicus
gggaaaagtactttgctgcctcttt

SEQ ID NO: 447640 - DNA, 25 bp, Rattus norvegicus
gggaaaagtatgacctggagctaca

SEQ ID NO: 447641 - DNA, 25 bp, Rattus norvegicus
gggaaaagtatgtcctggagctaca

SEQ ID NO: 447642 - DNA, 25 bp, Rattus norvegicus
gggaaaagtgtgcttccttgtcaca

SEQ ID NO: 447643 - DNA, 25 bp, Rattus norvegicus
gggaaaagtgtggttccttgtcaca

SEQ ID NO: 447644 - DNA, 25 bp, Rattus norvegicus
gggaaaatcccaatcttgctgagta

SEQ ID NO: 447645 - DNA, 25 bp, Rattus norvegicus
gggaaaatcccactgaagccgccac

SEQ ID NO: 447646 - DNA, 25 bp, Rattus norvegicus
gggaaaatcccagtgaagccgccac

SEQ ID NO: 447647 - DNA, 25 bp, Rattus norvegicus
gggaaaatcccattcttgctgagta

SEQ ID NO: 447648 - DNA, 25 bp, Rattus norvegicus
gggaaaatcctcaccagtggtccca

SEQ ID NO: 447649 - DNA, 25 bp, Rattus norvegicus
gggaaaatcctctccagtggtccca

SEQ ID NO: 447650 - DNA, 25 bp, Rattus norvegicus
gggaaaatctgacccctgatctctc

SEQ ID NO: 447651 - DNA, 25 bp, Rattus norvegicus
gggaaaatctgagccctgatctctc

SEQ ID NO: 447652 - DNA, 25 bp, Rattus norvegicus
gggaaaatgcaaacacctatgggtg

SEQ ID NO: 447653 - DNA, 25 bp, Rattus norvegicus
gggaaaatgcaatcacctatgggtg

SEQ ID NO: 447654 - DNA, 25 bp, Rattus norvegicus
gggaaaatgcacaacctatcagagg

SEQ ID NO: 447655 - DNA, 25 bp, Rattus norvegicus
gggaaaatgcactacctatcagagg

SEQ ID NO: 447656 - DNA, 25 bp, Rattus norvegicus
gggaaaatgcctagccacagtctac

SEQ ID NO: 447657 - DNA, 25 bp, Rattus norvegicus
gggaaaatgcctccccgtgcagctc

SEQ ID NO: 447658 - DNA, 25 bp, Rattus norvegicus
gggaaaatgcctgcccgtgcagctc

SEQ ID NO: 447659 - DNA, 25 bp, Rattus norvegicus
gggaaaatgccttgccacagtctac

SEQ ID NO: 447660 - DNA, 25 bp, Rattus norvegicus
gggaaaatggtgaccctcttttatg

SEQ ID NO: 447661 - DNA, 25 bp, Rattus norvegicus
gggaaaatggtgtccctcttttatg

SEQ ID NO: 447662 - DNA, 25 bp, Rattus norvegicus
gggaaaatgtcaacaccagctgaga

SEQ ID NO: 447663 - DNA, 25 bp, Rattus norvegicus
gggaaaatgtcatcaccagctgaga

SEQ ID NO: 447664 - DNA, 25 bp, Rattus norvegicus
gggaaaatgtctacatgttctgtca

SEQ ID NO: 447665 - DNA, 25 bp, Rattus norvegicus
gggaaaatgtcttcatgttctgtca

SEQ ID NO: 447666 - DNA, 25 bp, Rattus norvegicus
gggaaaatgtgcctcttattattag

SEQ ID NO: 447667 - DNA, 25 bp, Rattus norvegicus
gggaaaatgtgcgtcttattattag

SEQ ID NO: 447668 - DNA, 25 bp, Rattus norvegicus
gggaaaattcacactcaagcctcac

SEQ ID NO: 447669 - DNA, 25 bp, Rattus norvegicus
gggaaaattcactctcaagcctcac

SEQ ID NO: 447670 - DNA, 25 bp, Rattus norvegicus
gggaaaattctactgcagatctctt

SEQ ID NO: 447671 - DNA, 25 bp, Rattus norvegicus
gggaaaattctagtgcagatctctt

SEQ ID NO: 447672 - DNA, 25 bp, Rattus norvegicus
gggaaacaaacaccgaacagctcaa

SEQ ID NO: 447673 - DNA, 25 bp, Rattus norvegicus
gggaaacaaacagcgaacagctcaa

SEQ ID NO: 447674 - DNA, 25 bp, Rattus norvegicus
gggaaacaacagcaagcaccggccg

SEQ ID NO: 447675 - DNA, 25 bp, Rattus norvegicus
gggaaacaacaggaagcaccggccg

SEQ ID NO: 447676 - DNA, 25 bp, Rattus norvegicus
gggaaacaacctcgaggccaagtgt

SEQ ID NO: 447677 - DNA, 25 bp, Rattus norvegicus
gggaaacaacctggaggccaagtgt

SEQ ID NO: 447678 - DNA, 25 bp, Rattus norvegicus
gggaaacaactgaagacatcatcag

SEQ ID NO: 447679 - DNA, 25 bp, Rattus norvegicus
gggaaacaactgtagacatcatcag

SEQ ID NO: 447680 - DNA, 25 bp, Rattus norvegicus
gggaaacaagccacagctgtacaag

SEQ ID NO: 447681 - DNA, 25 bp, Rattus norvegicus
gggaaacaagcctcagctgtacaag

SEQ ID NO: 447682 - DNA, 25 bp, Rattus norvegicus
gggaaacaaggaccagccatcctat

SEQ ID NO: 447683 - DNA, 25 bp, Rattus norvegicus
gggaaacaaggactctgaatcagaa

SEQ ID NO: 447684 - DNA, 25 bp, Rattus norvegicus
gggaaacaaggagcagccatcctat

SEQ ID NO: 447685 - DNA, 25 bp, Rattus norvegicus
gggaaacaaggagtctgaatcagaa

SEQ ID NO: 447686 - DNA, 25 bp, Rattus norvegicus
gggaaacaatgtcgctacctggcta

SEQ ID NO: 447687 - DNA, 25 bp, Rattus norvegicus
gggaaacaatgtggctacctggcta

SEQ ID NO: 447688 - DNA, 25 bp, Rattus norvegicus
gggaaacacccaagctcagagtact

SEQ ID NO: 447689 - DNA, 25 bp, Rattus norvegicus
gggaaacacccatgctcagagtact

SEQ ID NO: 447690 - DNA, 25 bp, Rattus norvegicus
gggaaacacgtaaggagcacacaca

SEQ ID NO: 447691 - DNA, 25 bp, Rattus norvegicus
gggaaacacgtatggagcacacaca

SEQ ID NO: 447692 - DNA, 25 bp, Rattus norvegicus
gggaaacacgtcatggctccagcag

SEQ ID NO: 447693 - DNA, 25 bp, Rattus norvegicus
gggaaacacgtcttggctccagcag

SEQ ID NO: 447694 - DNA, 25 bp, Rattus norvegicus
gggaaacactctcatgaagctgcat

SEQ ID NO: 447695 - DNA, 25 bp, Rattus norvegicus
gggaaacactctgatgaagctgcat

SEQ ID NO: 447696 - DNA, 25 bp, Rattus norvegicus
gggaaacactttctccaatccccat

SEQ ID NO: 447697 - DNA, 25 bp, Rattus norvegicus
gggaaacactttgtccaatccccat

SEQ ID NO: 447698 - DNA, 25 bp, Rattus norvegicus
gggaaacagcttacttcactgactt

SEQ ID NO: 447699 - DNA, 25 bp, Rattus norvegicus
gggaaacagcttcaggacccctatc

SEQ ID NO: 447700 - DNA, 25 bp, Rattus norvegicus
gggaaacagcttgaggacccctatc

SEQ ID NO: 447701 - DNA, 25 bp, Rattus norvegicus
gggaaacagctttcttcactgactt

SEQ ID NO: 447702 - DNA, 25 bp, Rattus norvegicus
gggaaacatcctctttaatgtcata

SEQ ID NO: 447703 - DNA, 25 bp, Rattus norvegicus
gggaaacatcctgtttaatgtcata

SEQ ID NO: 447704 - DNA, 25 bp, Rattus norvegicus
gggaaacatcttacatttcttgagc

SEQ ID NO: 447705 - DNA, 25 bp, Rattus norvegicus
gggaaacatctttcatttcttgagc

SEQ ID NO: 447706 - DNA, 25 bp, Rattus norvegicus
gggaaacatgcaccagttcttcagc

SEQ ID NO: 447707 - DNA, 25 bp, Rattus norvegicus
gggaaacatgcagcagttcttcagc

SEQ ID NO: 447708 - DNA, 25 bp, Rattus norvegicus
gggaaacatgctaatgggccttact

SEQ ID NO: 447709 - DNA, 25 bp, Rattus norvegicus
gggaaacatgcttatgggccttact

SEQ ID NO: 447710 - DNA, 25 bp, Rattus norvegicus
gggaaacattcactatggcactata

SEQ ID NO: 447711 - DNA, 25 bp, Rattus norvegicus
gggaaacattcagtatggcactata

SEQ ID NO: 447712 - DNA, 25 bp, Rattus norvegicus
gggaaacattggacgtcagctagca

SEQ ID NO: 447713 - DNA, 25 bp, Rattus norvegicus
gggaaacattggtcgtcagctagca

SEQ ID NO: 447714 - DNA, 25 bp, Rattus norvegicus
gggaaaccacatcaaagcatcgtag

SEQ ID NO: 447715 - DNA, 25 bp, Rattus norvegicus
gggaaaccacatgaaagcatcgtag

SEQ ID NO: 447716 - DNA, 25 bp, Rattus norvegicus
gggaaaccattcacacagggaatac

SEQ ID NO: 447717 - DNA, 25 bp, Rattus norvegicus
gggaaaccattcatgagcctgtaat

SEQ ID NO: 447718 - DNA, 25 bp, Rattus norvegicus
gggaaaccattctcacagggaatac

SEQ ID NO: 447719 - DNA, 25 bp, Rattus norvegicus
gggaaaccattcttgagcctgtaat

SEQ ID NO: 447720 - DNA, 25 bp, Rattus norvegicus
gggaaaccccaaagagaggaaggct

SEQ ID NO: 447721 - DNA, 25 bp, Rattus norvegicus
gggaaaccccaatgagaggaaggct

SEQ ID NO: 447722 - DNA, 25 bp, Rattus norvegicus
gggaaaccccgaatgctgaatactg

SEQ ID NO: 447723 - DNA, 25 bp, Rattus norvegicus
gggaaaccccgattgctgaatactg

SEQ ID NO: 447724 - DNA, 25 bp, Rattus norvegicus
gggaaaccctgaattgttctccata

SEQ ID NO: 447725 - DNA, 25 bp, Rattus norvegicus
gggaaaccctgatttgttctccata

SEQ ID NO: 447726 - DNA, 25 bp, Rattus norvegicus
gggaaacccttgaggcacctttgag

SEQ ID NO: 447727 - DNA, 25 bp, Rattus norvegicus
gggaaacccttgtggcacctttgag

SEQ ID NO: 447728 - DNA, 25 bp, Rattus norvegicus
gggaaaccgctaacagacattacag

SEQ ID NO: 447729 - DNA, 25 bp, Rattus norvegicus
gggaaaccgctatcagacattacag

SEQ ID NO: 447730 - DNA, 25 bp, Rattus norvegicus
gggaaacctgagatcaccatcagca

SEQ ID NO: 447731 - DNA, 25 bp, Rattus norvegicus
gggaaacctgagttcaccatcagca

SEQ ID NO: 447732 - DNA, 25 bp, Rattus norvegicus
gggaaacctgctaccgaatctttct

SEQ ID NO: 447733 - DNA, 25 bp, Rattus norvegicus
gggaaacctgctcaaagctgtggac

SEQ ID NO: 447734 - DNA, 25 bp, Rattus norvegicus
gggaaacctgctgaaagctgtggac

SEQ ID NO: 447735 - DNA, 25 bp, Rattus norvegicus
gggaaacctgcttccgaatctttct

SEQ ID NO: 447736 - DNA, 25 bp, Rattus norvegicus
gggaaaccttccagctgatgaatct

SEQ ID NO: 447737 - DNA, 25 bp, Rattus norvegicus
gggaaaccttcctgctgatgaatct

SEQ ID NO: 447738 - DNA, 25 bp, Rattus norvegicus
gggaaaccttgaaaacgcaactgaa

SEQ ID NO: 447739 - DNA, 25 bp, Rattus norvegicus
gggaaaccttgataacgcaactgaa

SEQ ID NO: 447740 - DNA, 25 bp, Rattus norvegicus
gggaaacgactcacagactgcgata

SEQ ID NO: 447741 - DNA, 25 bp, Rattus norvegicus
gggaaacgactctcagactgcgata

SEQ ID NO: 447742 - DNA, 25 bp, Rattus norvegicus
gggaaacgactgcaacgccgctaag

SEQ ID NO: 447743 - DNA, 25 bp, Rattus norvegicus
gggaaacgactggaacgccgctaag

SEQ ID NO: 447744 - DNA, 25 bp, Rattus norvegicus
gggaaacgcatcctatggacaacta

SEQ ID NO: 447745 - DNA, 25 bp, Rattus norvegicus
gggaaacgcatcgtatggacaacta

SEQ ID NO: 447746 - DNA, 25 bp, Rattus norvegicus
gggaaacgggttccaccgctgacat

SEQ ID NO: 447747 - DNA, 25 bp, Rattus norvegicus
gggaaacgggttgcaccgctgacat

SEQ ID NO: 447748 - DNA, 25 bp, Rattus norvegicus
gggaaacgtacaatttatgacctat

SEQ ID NO: 447749 - DNA, 25 bp, Rattus norvegicus
gggaaacgtacattttatgacctat

SEQ ID NO: 447750 - DNA, 25 bp, Rattus norvegicus
gggaaactaagtaacagctcttctt

SEQ ID NO: 447751 - DNA, 25 bp, Rattus norvegicus
gggaaactaagttacagctcttctt

SEQ ID NO: 447752 - DNA, 25 bp, Rattus norvegicus
gggaaactcagacaccagtgctcta

SEQ ID NO: 447753 - DNA, 25 bp, Rattus norvegicus
gggaaactcagacagtagccccaat

SEQ ID NO: 447754 - DNA, 25 bp, Rattus norvegicus
gggaaactcagagaccagtgctcta

SEQ ID NO: 447755 - DNA, 25 bp, Rattus norvegicus
gggaaactcagagagtagccccaat

SEQ ID NO: 447756 - DNA, 25 bp, Rattus norvegicus
gggaaactccatcctgttacataat

SEQ ID NO: 447757 - DNA, 25 bp, Rattus norvegicus
gggaaactccatcttcgtttatcat

SEQ ID NO: 447758 - DNA, 25 bp, Rattus norvegicus
gggaaactccatgctgttacataat

SEQ ID NO: 447759 - DNA, 25 bp, Rattus norvegicus
gggaaactccatgttcgtttatcat

SEQ ID NO: 447760 - DNA, 25 bp, Rattus norvegicus
gggaaactcccactacagtcagcag

SEQ ID NO: 447761 - DNA, 25 bp, Rattus norvegicus
gggaaactcccagtacagtcagcag

SEQ ID NO: 447762 - DNA, 25 bp, Rattus norvegicus
gggaaactccttatatagccatttt

SEQ ID NO: 447763 - DNA, 25 bp, Rattus norvegicus
gggaaactccttttatagccatttt

SEQ ID NO: 447764 - DNA, 25 bp, Rattus norvegicus
gggaaactcgatcctctgaggccca

SEQ ID NO: 447765 - DNA, 25 bp, Rattus norvegicus
gggaaactcgatgctctgaggccca

SEQ ID NO: 447766 - DNA, 25 bp, Rattus norvegicus
gggaaactgagcctgctttgtagta

SEQ ID NO: 447767 - DNA, 25 bp, Rattus norvegicus
gggaaactgagcgtgctttgtagta

SEQ ID NO: 447768 - DNA, 25 bp, Rattus norvegicus
gggaaactgaggatcaagactgaat

SEQ ID NO: 447769 - DNA, 25 bp, Rattus norvegicus
gggaaactgaggttcaagactgaat

SEQ ID NO: 447770 - DNA, 25 bp, Rattus norvegicus
gggaaactgagtaacctcgcctgcc

SEQ ID NO: 447771 - DNA, 25 bp, Rattus norvegicus
gggaaactgagttacctcgcctgcc

SEQ ID NO: 447772 - DNA, 25 bp, Rattus norvegicus
gggaaactgcagcacttaatggaaa

SEQ ID NO: 447773 - DNA, 25 bp, Rattus norvegicus
gggaaactgcaggacttaatggaaa

SEQ ID NO: 447774 - DNA, 25 bp, Rattus norvegicus
gggaaactggatagtaccacatggg

SEQ ID NO: 447775 - DNA, 25 bp, Rattus norvegicus
gggaaactggattgtaccacatggg

SEQ ID NO: 447776 - DNA, 25 bp, Rattus norvegicus
gggaaactgtcaacactggtaacaa

SEQ ID NO: 447777 - DNA, 25 bp, Rattus norvegicus
gggaaactgtcatcactggtaacaa

SEQ ID NO: 447778 - DNA, 25 bp, Rattus norvegicus
gggaaactgtgtatcactgtgaact

SEQ ID NO: 447779 - DNA, 25 bp, Rattus norvegicus
gggaaactgtgtttcactgtgaact

SEQ ID NO: 447780 - DNA, 25 bp, Rattus norvegicus
gggaaacttactctctctagtgtga

SEQ ID NO: 447781 - DNA, 25 bp, Rattus norvegicus
gggaaacttactgtctctagtgtga

SEQ ID NO: 447782 - DNA, 25 bp, Rattus norvegicus
gggaaacttccaaacttcaccagaa

SEQ ID NO: 447783 - DNA, 25 bp, Rattus norvegicus
gggaaacttccatacttcaccagaa

SEQ ID NO: 447784 - DNA, 25 bp, Rattus norvegicus
gggaaacttgaaccttctctgctcc

SEQ ID NO: 447785 - DNA, 25 bp, Rattus norvegicus
gggaaacttgaagcttctctgctcc

SEQ ID NO: 447786 - DNA, 25 bp, Rattus norvegicus
gggaaacttgctacctgttctgaga

SEQ ID NO: 447787 - DNA, 25 bp, Rattus norvegicus
gggaaacttgcttcctgttctgaga

SEQ ID NO: 447788 - DNA, 25 bp, Rattus norvegicus
gggaaagaaatactccacaaagtag

SEQ ID NO: 447789 - DNA, 25 bp, Rattus norvegicus
gggaaagaaatagtccacaaagtag

SEQ ID NO: 447790 - DNA, 25 bp, Rattus norvegicus
gggaaagaatccatttaccccaatg

SEQ ID NO: 447791 - DNA, 25 bp, Rattus norvegicus
gggaaagaatccttttaccccaatg

SEQ ID NO: 447792 - DNA, 25 bp, Rattus norvegicus
gggaaagacactaccgcggccacgg

SEQ ID NO: 447793 - DNA, 25 bp, Rattus norvegicus
gggaaagacacttccgcggccacgg

SEQ ID NO: 447794 - DNA, 25 bp, Rattus norvegicus
gggaaagaccaccattggccttgat

SEQ ID NO: 447795 - DNA, 25 bp, Rattus norvegicus
gggaaagaccacgattggccttgat

SEQ ID NO: 447796 - DNA, 25 bp, Rattus norvegicus
gggaaagagaccaccagcccagcgt

SEQ ID NO: 447797 - DNA, 25 bp, Rattus norvegicus
gggaaagagacctccagcccagcgt

SEQ ID NO: 447798 - DNA, 25 bp, Rattus norvegicus
gggaaagagcccacaggcttcctgt

SEQ ID NO: 447799 - DNA, 25 bp, Rattus norvegicus
gggaaagagccctcaggcttcctgt

SEQ ID NO: 447800 - DNA, 25 bp, Rattus norvegicus
gggaaagatcagaataggcctcaat

SEQ ID NO: 447801 - DNA, 25 bp, Rattus norvegicus
gggaaagatcagtataggcctcaat

SEQ ID NO: 447802 - DNA, 25 bp, Rattus norvegicus
gggaaagatcctaggtgctcaaatt

SEQ ID NO: 447803 - DNA, 25 bp, Rattus norvegicus
gggaaagatccttggtgctcaaatt

SEQ ID NO: 447804 - DNA, 25 bp, Rattus norvegicus
gggaaagatcttcctttgaactact

SEQ ID NO: 447805 - DNA, 25 bp, Rattus norvegicus
gggaaagatcttgctttgaactact

SEQ ID NO: 447806 - DNA, 25 bp, Rattus norvegicus
gggaaagatttcacacaacgctcat

SEQ ID NO: 447807 - DNA, 25 bp, Rattus norvegicus
gggaaagatttcagtgtcacatgag

SEQ ID NO: 447808 - DNA, 25 bp, Rattus norvegicus
gggaaagatttctcacaacgctcat

SEQ ID NO: 447809 - DNA, 25 bp, Rattus norvegicus
gggaaagatttctgtgtcacatgag

SEQ ID NO: 447810 - DNA, 25 bp, Rattus norvegicus
gggaaagcacatagattgcctctca

SEQ ID NO: 447811 - DNA, 25 bp, Rattus norvegicus
gggaaagcacattgattgcctctca

SEQ ID NO: 447812 - DNA, 25 bp, Rattus norvegicus
gggaaagcagacaccagtccatgcc

SEQ ID NO: 447813 - DNA, 25 bp, Rattus norvegicus
gggaaagcagactccagtccatgcc

SEQ ID NO: 447814 - DNA, 25 bp, Rattus norvegicus
gggaaagcagcaacctgatccacca

SEQ ID NO: 447815 - DNA, 25 bp, Rattus norvegicus
gggaaagcagcatcctgatccacca

SEQ ID NO: 447816 - DNA, 25 bp, Rattus norvegicus
gggaaagccactctgtcattgaagt

SEQ ID NO: 447817 - DNA, 25 bp, Rattus norvegicus
gggaaagccactgtgtcattgaagt

SEQ ID NO: 447818 - DNA, 25 bp, Rattus norvegicus
gggaaagccatcacatgttcgagaa

SEQ ID NO: 447819 - DNA, 25 bp, Rattus norvegicus
gggaaagccatctcatgttcgagaa

SEQ ID NO: 447820 - DNA, 25 bp, Rattus norvegicus
gggaaagcctggattagcctgtcat

SEQ ID NO: 447821 - DNA, 25 bp, Rattus norvegicus
gggaaagcctggtttagcctgtcat

SEQ ID NO: 447822 - DNA, 25 bp, Rattus norvegicus
gggaaagcctgtcagcctttaactt

SEQ ID NO: 447823 - DNA, 25 bp, Rattus norvegicus
gggaaagcctgtgagcctttaactt

SEQ ID NO: 447824 - DNA, 25 bp, Rattus norvegicus
gggaaagccttgagtgtaaatcagt

SEQ ID NO: 447825 - DNA, 25 bp, Rattus norvegicus
gggaaagccttgtgtgtaaatcagt

SEQ ID NO: 447826 - DNA, 25 bp, Rattus norvegicus
gggaaagcctttcccgaaatgatgc

SEQ ID NO: 447827 - DNA, 25 bp, Rattus norvegicus
gggaaagcctttctaccagtgaact

SEQ ID NO: 447828 - DNA, 25 bp, Rattus norvegicus
gggaaagcctttgccgaaatgatgc

SEQ ID NO: 447829 - DNA, 25 bp, Rattus norvegicus
gggaaagcctttgtaccagtgaact

SEQ ID NO: 447830 - DNA, 25 bp, Rattus norvegicus
gggaaagcgcctcagcggccaggaa

SEQ ID NO: 447831 - DNA, 25 bp, Rattus norvegicus
gggaaagcgcctgagcggccaggaa

SEQ ID NO: 447832 - DNA, 25 bp, Rattus norvegicus
gggaaagctaatcgccttccatgaa

SEQ ID NO: 447833 - DNA, 25 bp, Rattus norvegicus
gggaaagctaatggccttccatgaa

SEQ ID NO: 447834 - DNA, 25 bp, Rattus norvegicus
gggaaagctccaccccaaatgtgag

SEQ ID NO: 447835 - DNA, 25 bp, Rattus norvegicus
gggaaagctccagcccaaatgtgag

SEQ ID NO: 447836 - DNA, 25 bp, Rattus norvegicus
gggaaaggagacaacacccctgctc

SEQ ID NO: 447837 - DNA, 25 bp, Rattus norvegicus
gggaaaggagactacacccctgctc

SEQ ID NO: 447838 - DNA, 25 bp, Rattus norvegicus
gggaaaggcacaactacctcatggc

SEQ ID NO: 447839 - DNA, 25 bp, Rattus norvegicus
gggaaaggcacatctacctcatggc

SEQ ID NO: 447840 - DNA, 25 bp, Rattus norvegicus
gggaaaggcctcacgggctgcttca

SEQ ID NO: 447841 - DNA, 25 bp, Rattus norvegicus
gggaaaggcctctcgggctgcttca

SEQ ID NO: 447842 - DNA, 25 bp, Rattus norvegicus
gggaaaggcgataagctatcatatt

SEQ ID NO: 447843 - DNA, 25 bp, Rattus norvegicus
gggaaaggcgattagctatcatatt

SEQ ID NO: 447844 - DNA, 25 bp, Rattus norvegicus
gggaaaggcgctactccattggcat

SEQ ID NO: 447845 - DNA, 25 bp, Rattus norvegicus
gggaaaggcgcttctccattggcat

SEQ ID NO: 447846 - DNA, 25 bp, Rattus norvegicus
gggaaaggcgtgagcttcataaata

SEQ ID NO: 447847 - DNA, 25 bp, Rattus norvegicus
gggaaaggcgtgtgcttcataaata

SEQ ID NO: 447848 - DNA, 25 bp, Rattus norvegicus
gggaaaggctcccatttgaggccat

SEQ ID NO: 447849 - DNA, 25 bp, Rattus norvegicus
gggaaaggctccgatttgaggccat

SEQ ID NO: 447850 - DNA, 25 bp, Rattus norvegicus
gggaaaggtcagacccctacactag

SEQ ID NO: 447851 - DNA, 25 bp, Rattus norvegicus
gggaaaggtcagtcccctacactag

SEQ ID NO: 447852 - DNA, 25 bp, Rattus norvegicus
gggaaaggtcccagaggcatttagc

SEQ ID NO: 447853 - DNA, 25 bp, Rattus norvegicus
gggaaaggtccctgaggcatttagc

SEQ ID NO: 447854 - DNA, 25 bp, Rattus norvegicus
gggaaaggtgatatcaactgattaa

SEQ ID NO: 447855 - DNA, 25 bp, Rattus norvegicus
gggaaaggtgatttcaactgattaa

SEQ ID NO: 447856 - DNA, 25 bp, Rattus norvegicus
gggaaaggtgccagtgttcactgtc

SEQ ID NO: 447857 - DNA, 25 bp, Rattus norvegicus
gggaaaggtgcctgtgttcactgtc

SEQ ID NO: 447858 - DNA, 25 bp, Rattus norvegicus
gggaaaggttctctcagttacgcct

SEQ ID NO: 447859 - DNA, 25 bp, Rattus norvegicus
gggaaaggttctgtcagttacgcct

SEQ ID NO: 447860 - DNA, 25 bp, Rattus norvegicus
gggaaagtaactctctccaacacca

SEQ ID NO: 447861 - DNA, 25 bp, Rattus norvegicus
gggaaagtaactgtctccaacacca

SEQ ID NO: 447862 - DNA, 25 bp, Rattus norvegicus
gggaaagtatgcaagcacatttatt

SEQ ID NO: 447863 - DNA, 25 bp, Rattus norvegicus
gggaaagtatgctagcacatttatt

SEQ ID NO: 447864 - DNA, 25 bp, Rattus norvegicus
gggaaagtcaccactgtcacgtaga

SEQ ID NO: 447865 - DNA, 25 bp, Rattus norvegicus
gggaaagtcacctctgtcacgtaga

SEQ ID NO: 447866 - DNA, 25 bp, Rattus norvegicus
gggaaagtcactcaaatcacactat

SEQ ID NO: 447867 - DNA, 25 bp, Rattus norvegicus
gggaaagtcactgaaatcacactat

SEQ ID NO: 447868 - DNA, 25 bp, Rattus norvegicus
gggaaagtcccgctatgctgtaaac

SEQ ID NO: 447869 - DNA, 25 bp, Rattus norvegicus
gggaaagtcccggtatgctgtaaac

SEQ ID NO: 447870 - DNA, 25 bp, Rattus norvegicus
gggaaagtgctcaagccagcagccc

SEQ ID NO: 447871 - DNA, 25 bp, Rattus norvegicus
gggaaagtgctctagccagcagccc

SEQ ID NO: 447872 - DNA, 25 bp, Rattus norvegicus
gggaaagtgcttcatgcagccctgc

SEQ ID NO: 447873 - DNA, 25 bp, Rattus norvegicus
gggaaagtgcttgatgcagccctgc

SEQ ID NO: 447874 - DNA, 25 bp, Rattus norvegicus
gggaaagtggctaggttctgaacat

SEQ ID NO: 447875 - DNA, 25 bp, Rattus norvegicus
gggaaagtggcttggttctgaacat

SEQ ID NO: 447876 - DNA, 25 bp, Rattus norvegicus
gggaaagtggtcccaatggaggcca

SEQ ID NO: 447877 - DNA, 25 bp, Rattus norvegicus
gggaaagtggtcgcaatggaggcca

SEQ ID NO: 447878 - DNA, 25 bp, Rattus norvegicus
gggaaagttcacagctcatgacaca

SEQ ID NO: 447879 - DNA, 25 bp, Rattus norvegicus
gggaaagttcactgctcatgacaca

SEQ ID NO: 447880 - DNA, 25 bp, Rattus norvegicus
gggaaatacaacacctcagcctgta

SEQ ID NO: 447881 - DNA, 25 bp, Rattus norvegicus
gggaaatacaactcctcagcctgta

SEQ ID NO: 447882 - DNA, 25 bp, Rattus norvegicus
gggaaatactacctcattaacctag

SEQ ID NO: 447883 - DNA, 25 bp, Rattus norvegicus
gggaaatactacgtcattaacctag

SEQ ID NO: 447884 - DNA, 25 bp, Rattus norvegicus
gggaaatactccagatgccttcact

SEQ ID NO: 447885 - DNA, 25 bp, Rattus norvegicus
gggaaatactcctgatgccttcact

SEQ ID NO: 447886 - DNA, 25 bp, Rattus norvegicus
gggaaatagatcagccacttttaag

SEQ ID NO: 447887 - DNA, 25 bp, Rattus norvegicus
gggaaatagatctgccacttttaag

SEQ ID NO: 447888 - DNA, 25 bp, Rattus norvegicus
gggaaatatcctaatgttacaaact

SEQ ID NO: 447889 - DNA, 25 bp, Rattus norvegicus
gggaaatatcctcgcattgctatcg

SEQ ID NO: 447890 - DNA, 25 bp, Rattus norvegicus
gggaaatatcctggcattgctatcg

SEQ ID NO: 447891 - DNA, 25 bp, Rattus norvegicus
gggaaatatccttatgttacaaact

SEQ ID NO: 447892 - DNA, 25 bp, Rattus norvegicus
gggaaatatcgcacttatctaccct

SEQ ID NO: 447893 - DNA, 25 bp, Rattus norvegicus
gggaaatatcgctcttatctaccct

SEQ ID NO: 447894 - DNA, 25 bp, Rattus norvegicus
gggaaatcaagaagactaccagctt

SEQ ID NO: 447895 - DNA, 25 bp, Rattus norvegicus
gggaaatcaagatgactaccagctt

SEQ ID NO: 447896 - DNA, 25 bp, Rattus norvegicus
gggaaatcacaccttatcctagtct

SEQ ID NO: 447897 - DNA, 25 bp, Rattus norvegicus
gggaaatcacacgttatcctagtct

SEQ ID NO: 447898 - DNA, 25 bp, Rattus norvegicus
gggaaatcagcaccagtgacccaaa

SEQ ID NO: 447899 - DNA, 25 bp, Rattus norvegicus
gggaaatcagcacctccgaggagat

SEQ ID NO: 447900 - DNA, 25 bp, Rattus norvegicus
gggaaatcagcagcagtgacccaaa

SEQ ID NO: 447901 - DNA, 25 bp, Rattus norvegicus
gggaaatcagcagctccgaggagat

SEQ ID NO: 447902 - DNA, 25 bp, Rattus norvegicus
gggaaatcagttctgatcatacttt

SEQ ID NO: 447903 - DNA, 25 bp, Rattus norvegicus
gggaaatcagttgtgatcatacttt

SEQ ID NO: 447904 - DNA, 25 bp, Rattus norvegicus
gggaaatccattacgggcaggcgac

SEQ ID NO: 447905 - DNA, 25 bp, Rattus norvegicus
gggaaatccatttcgggcaggcgac

SEQ ID NO: 447906 - DNA, 25 bp, Rattus norvegicus
gggaaatcccatcgccgacgctgac

SEQ ID NO: 447907 - DNA, 25 bp, Rattus norvegicus
gggaaatcccatggccgacgctgac

SEQ ID NO: 447908 - DNA, 25 bp, Rattus norvegicus
gggaaatcctgcaacaatacccttt

SEQ ID NO: 447909 - DNA, 25 bp, Rattus norvegicus
gggaaatcctgctacaatacccttt

SEQ ID NO: 447910 - DNA, 25 bp, Rattus norvegicus
gggaaatcgcccactggccaaagga

SEQ ID NO: 447911 - DNA, 25 bp, Rattus norvegicus
gggaaatcgccctctggccaaagga

SEQ ID NO: 447912 - DNA, 25 bp, Rattus norvegicus
gggaaatcgctaacaactgctccga

SEQ ID NO: 447913 - DNA, 25 bp, Rattus norvegicus
gggaaatcgctatcaactgctccga

SEQ ID NO: 447914 - DNA, 25 bp, Rattus norvegicus
gggaaatcgtacatgcccaatttgc

SEQ ID NO: 447915 - DNA, 25 bp, Rattus norvegicus
gggaaatcgtacttgcccaatttgc

SEQ ID NO: 447916 - DNA, 25 bp, Rattus norvegicus
gggaaatctagcagcccatgagctt

SEQ ID NO: 447917 - DNA, 25 bp, Rattus norvegicus
gggaaatctagctgcccatgagctt

SEQ ID NO: 447918 - DNA, 25 bp, Rattus norvegicus
gggaaatctaggaaacttgtgttga

SEQ ID NO: 447919 - DNA, 25 bp, Rattus norvegicus
gggaaatctaggtaacttgtgttga

SEQ ID NO: 447920 - DNA, 25 bp, Rattus norvegicus
gggaaatctagtactctggagactg

SEQ ID NO: 447921 - DNA, 25 bp, Rattus norvegicus
gggaaatctagttctctggagactg

SEQ ID NO: 447922 - DNA, 25 bp, Rattus norvegicus
gggaaatctcacacaaactcaggag

SEQ ID NO: 447923 - DNA, 25 bp, Rattus norvegicus
gggaaatctcactcaaactcaggag

SEQ ID NO: 447924 - DNA, 25 bp, Rattus norvegicus
gggaaatctcagatccacagctcta

SEQ ID NO: 447925 - DNA, 25 bp, Rattus norvegicus
gggaaatctcagttccacagctcta

SEQ ID NO: 447926 - DNA, 25 bp, Rattus norvegicus
gggaaatctccacgctgctagttac

SEQ ID NO: 447927 - DNA, 25 bp, Rattus norvegicus
gggaaatctccaggctgctagttac

SEQ ID NO: 447928 - DNA, 25 bp, Rattus norvegicus
gggaaatctgctctttattgtgaaa

SEQ ID NO: 447929 - DNA, 25 bp, Rattus norvegicus
gggaaatctgctgtttattgtgaaa

SEQ ID NO: 447930 - DNA, 25 bp, Rattus norvegicus
gggaaatctgttactcttgtcttga

SEQ ID NO: 447931 - DNA, 25 bp, Rattus norvegicus
gggaaatctgtttctcttgtcttga

SEQ ID NO: 447932 - DNA, 25 bp, Rattus norvegicus
gggaaatgactcacccaaccccatg

SEQ ID NO: 447933 - DNA, 25 bp, Rattus norvegicus
gggaaatgactctcccaaccccatg

SEQ ID NO: 447934 - DNA, 25 bp, Rattus norvegicus
gggaaatgagttctacacataccaa

SEQ ID NO: 447935 - DNA, 25 bp, Rattus norvegicus
gggaaatgagttgtacacataccaa

SEQ ID NO: 447936 - DNA, 25 bp, Rattus norvegicus
gggaaatgattacttacattgcaat

SEQ ID NO: 447937 - DNA, 25 bp, Rattus norvegicus
gggaaatgattagttacattgcaat

SEQ ID NO: 447938 - DNA, 25 bp, Rattus norvegicus
gggaaatgcatcatcttcggaacta

SEQ ID NO: 447939 - DNA, 25 bp, Rattus norvegicus
gggaaatgcatcttcttcggaacta

SEQ ID NO: 447940 - DNA, 25 bp, Rattus norvegicus
gggaaatgccatatatgtagctaaa

SEQ ID NO: 447941 - DNA, 25 bp, Rattus norvegicus
gggaaatgccatttatgtagctaaa

SEQ ID NO: 447942 - DNA, 25 bp, Rattus norvegicus
gggaaatgctgacaaataggtcaca

SEQ ID NO: 447943 - DNA, 25 bp, Rattus norvegicus
gggaaatgctgagaaataggtcaca

SEQ ID NO: 447944 - DNA, 25 bp, Rattus norvegicus
gggaaatgtaatcagcatctttgat

SEQ ID NO: 447945 - DNA, 25 bp, Rattus norvegicus
gggaaatgtaatgagcatctttgat

SEQ ID NO: 447946 - DNA, 25 bp, Rattus norvegicus
gggaaatgtattcacctggaacaca

SEQ ID NO: 447947 - DNA, 25 bp, Rattus norvegicus
gggaaatgtattgacctggaacaca

SEQ ID NO: 447948 - DNA, 25 bp, Rattus norvegicus
gggaaatgtcacatccatcccctca

SEQ ID NO: 447949 - DNA, 25 bp, Rattus norvegicus
gggaaatgtcacttccatcccctca

SEQ ID NO: 447950 - DNA, 25 bp, Rattus norvegicus
gggaaatgtgccattcatcctataa

SEQ ID NO: 447951 - DNA, 25 bp, Rattus norvegicus
gggaaatgtgcctttcatcctataa

SEQ ID NO: 447952 - DNA, 25 bp, Rattus norvegicus
gggaaattacatcattatactataa

SEQ ID NO: 447953 - DNA, 25 bp, Rattus norvegicus
gggaaattacatgattatactataa

SEQ ID NO: 447954 - DNA, 25 bp, Rattus norvegicus
gggaaattcattatctttcactgga

SEQ ID NO: 447955 - DNA, 25 bp, Rattus norvegicus
gggaaattcattttctttcactgga

SEQ ID NO: 447956 - DNA, 25 bp, Rattus norvegicus
gggaaattcctcatccgtgagttct

SEQ ID NO: 447957 - DNA, 25 bp, Rattus norvegicus
gggaaattcctcttccgtgagttct

SEQ ID NO: 447958 - DNA, 25 bp, Rattus norvegicus
gggaaattgcctatggttatgactt

SEQ ID NO: 447959 - DNA, 25 bp, Rattus norvegicus
gggaaattgcctttggttatgactt

SEQ ID NO: 447960 - DNA, 25 bp, Rattus norvegicus
gggaaatttcacaacgctgcagtta

SEQ ID NO: 447961 - DNA, 25 bp, Rattus norvegicus
gggaaatttcactacgctgcagtta

SEQ ID NO: 447962 - DNA, 25 bp, Rattus norvegicus
gggaaatttttcatgcatcttttgt

SEQ ID NO: 447963 - DNA, 25 bp, Rattus norvegicus
gggaaatttttcttgcatcttttgt

SEQ ID NO: 447964 - DNA, 25 bp, Rattus norvegicus
gggaacaaaactactccaatgtcac

SEQ ID NO: 447965 - DNA, 25 bp, Rattus norvegicus
gggaacaaaacttctccaatgtcac

SEQ ID NO: 447966 - DNA, 25 bp, Rattus norvegicus
gggaacaaacacctcacaacaaatt

SEQ ID NO: 447967 - DNA, 25 bp, Rattus norvegicus
gggaacaaacacgtcacaacaaatt

SEQ ID NO: 447968 - DNA, 25 bp, Rattus norvegicus
gggaacaaagcaccattggcctcta

SEQ ID NO: 447969 - DNA, 25 bp, Rattus norvegicus
gggaacaaagcagcattggcctcta

SEQ ID NO: 447970 - DNA, 25 bp, Rattus norvegicus
gggaacaaagctagctctccgctac

SEQ ID NO: 447971 - DNA, 25 bp, Rattus norvegicus
gggaacaaagcttgctctccgctac

SEQ ID NO: 447972 - DNA, 25 bp, Rattus norvegicus
gggaacaacctaaaacatctcggat

SEQ ID NO: 447973 - DNA, 25 bp, Rattus norvegicus
gggaacaacctataacatctcggat

SEQ ID NO: 447974 - DNA, 25 bp, Rattus norvegicus
gggaacaactttagggcgcacaact

SEQ ID NO: 447975 - DNA, 25 bp, Rattus norvegicus
gggaacaacttttgggcgcacaact

SEQ ID NO: 447976 - DNA, 25 bp, Rattus norvegicus
gggaacaagactcagctgctgcaga

SEQ ID NO: 447977 - DNA, 25 bp, Rattus norvegicus
gggaacaagactgagctgctgcaga

SEQ ID NO: 447978 - DNA, 25 bp, Rattus norvegicus
gggaacaagcatatgctgaaacttg

SEQ ID NO: 447979 - DNA, 25 bp, Rattus norvegicus
gggaacaagcatttgctgaaacttg

SEQ ID NO: 447980 - DNA, 25 bp, Rattus norvegicus
gggaacaagcttaactgatctgaga

SEQ ID NO: 447981 - DNA, 25 bp, Rattus norvegicus
gggaacaagctttactgatctgaga

SEQ ID NO: 447982 - DNA, 25 bp, Rattus norvegicus
gggaacaatgtgacagtactggatg

SEQ ID NO: 447983 - DNA, 25 bp, Rattus norvegicus
gggaacaatgtgtcagtactggatg

SEQ ID NO: 447984 - DNA, 25 bp, Rattus norvegicus
gggaacaattacatctgaggcacag

SEQ ID NO: 447985 - DNA, 25 bp, Rattus norvegicus
gggaacaattacttctgaggcacag

SEQ ID NO: 447986 - DNA, 25 bp, Rattus norvegicus
gggaacacaacaccctcgtaattca

SEQ ID NO: 447987 - DNA, 25 bp, Rattus norvegicus
gggaacacaacagcctcgtaattca

SEQ ID NO: 447988 - DNA, 25 bp, Rattus norvegicus
gggaacacaatcactttatgatgtc

SEQ ID NO: 447989 - DNA, 25 bp, Rattus norvegicus
gggaacacaatctctttatgatgtc

SEQ ID NO: 447990 - DNA, 25 bp, Rattus norvegicus
gggaacacagatccagtgccctgct

SEQ ID NO: 447991 - DNA, 25 bp, Rattus norvegicus
gggaacacagatgcagtgccctgct

SEQ ID NO: 447992 - DNA, 25 bp, Rattus norvegicus
gggaacacagtccaaagccttctat

SEQ ID NO: 447993 - DNA, 25 bp, Rattus norvegicus
gggaacacagtcgaaagccttctat

SEQ ID NO: 447994 - DNA, 25 bp, Rattus norvegicus
gggaacacatgaaactctccctctt

SEQ ID NO: 447995 - DNA, 25 bp, Rattus norvegicus
gggaacacatgatactctccctctt

SEQ ID NO: 447996 - DNA, 25 bp, Rattus norvegicus
gggaacaccaccatcgcttgagtag

SEQ ID NO: 447997 - DNA, 25 bp, Rattus norvegicus
gggaacaccaccttcgcttgagtag

SEQ ID NO: 447998 - DNA, 25 bp, Rattus norvegicus
gggaacacccagcttaaaggagtca

SEQ ID NO: 447999 - DNA, 25 bp, Rattus norvegicus
gggaacacccaggttaaaggagtca

SEQ ID NO: 448000 - DNA, 25 bp, Rattus norvegicus
gggaacaccccaagtaaatggacat

SEQ ID NO: 448001 - DNA, 25 bp, Rattus norvegicus
gggaacaccccatgtaaatggacat

SEQ ID NO: 448002 - DNA, 25 bp, Rattus norvegicus
gggaacacgaccctttgtgatctcc

SEQ ID NO: 448003 - DNA, 25 bp, Rattus norvegicus
gggaacacgaccgtttgtgatctcc

SEQ ID NO: 448004 - DNA, 25 bp, Rattus norvegicus
gggaacacggaaccccagaagttgt

SEQ ID NO: 448005 - DNA, 25 bp, Rattus norvegicus
gggaacacggaagcccagaagttgt

SEQ ID NO: 448006 - DNA, 25 bp, Rattus norvegicus
gggaacacggccaccctggcaatag

SEQ ID NO: 448007 - DNA, 25 bp, Rattus norvegicus
gggaacacggcctccctggcaatag

SEQ ID NO: 448008 - DNA, 25 bp, Rattus norvegicus
gggaacactcagactttcaagggaa

SEQ ID NO: 448009 - DNA, 25 bp, Rattus norvegicus
gggaacactcagtctttcaagggaa

SEQ ID NO: 448010 - DNA, 25 bp, Rattus norvegicus
gggaacactccgatatggctagcag

SEQ ID NO: 448011 - DNA, 25 bp, Rattus norvegicus
gggaacactccgttatggctagcag

SEQ ID NO: 448012 - DNA, 25 bp, Rattus norvegicus
gggaacactgaactcatggtcctcc

SEQ ID NO: 448013 - DNA, 25 bp, Rattus norvegicus
gggaacactgaagtcatggtcctcc

SEQ ID NO: 448014 - DNA, 25 bp, Rattus norvegicus
gggaacactggcagcctctctaaac

SEQ ID NO: 448015 - DNA, 25 bp, Rattus norvegicus
gggaacactggctgcctctctaaac

SEQ ID NO: 448016 - DNA, 25 bp, Rattus norvegicus
gggaacacttacacttcagacttaa

SEQ ID NO: 448017 - DNA, 25 bp, Rattus norvegicus
gggaacacttactcttcagacttaa

SEQ ID NO: 448018 - DNA, 25 bp, Rattus norvegicus
gggaacacttcacttgttttgcaag

SEQ ID NO: 448019 - DNA, 25 bp, Rattus norvegicus
gggaacacttcagttgttttgcaag

SEQ ID NO: 448020 - DNA, 25 bp, Rattus norvegicus
gggaacagacacactatacaccacc

SEQ ID NO: 448021 - DNA, 25 bp, Rattus norvegicus
gggaacagacactctatacaccacc

SEQ ID NO: 448022 - DNA, 25 bp, Rattus norvegicus
gggaacagagttcaggcactcctta

SEQ ID NO: 448023 - DNA, 25 bp, Rattus norvegicus
gggaacagagttgaggcactcctta

SEQ ID NO: 448024 - DNA, 25 bp, Rattus norvegicus
gggaacagatccaggtaccctccaa

SEQ ID NO: 448025 - DNA, 25 bp, Rattus norvegicus
gggaacagatcctggtaccctccaa

SEQ ID NO: 448026 - DNA, 25 bp, Rattus norvegicus
gggaacagcaacctgagtcctgaat

SEQ ID NO: 448027 - DNA, 25 bp, Rattus norvegicus
gggaacagcaacgtgagtcctgaat

SEQ ID NO: 448028 - DNA, 25 bp, Rattus norvegicus
gggaacagccccatatcctgaggca

SEQ ID NO: 448029 - DNA, 25 bp, Rattus norvegicus
gggaacagccccttatcctgaggca

SEQ ID NO: 448030 - DNA, 25 bp, Rattus norvegicus
gggaacagcctgcaagcgatttctg

SEQ ID NO: 448031 - DNA, 25 bp, Rattus norvegicus
gggaacagcctggaagcgatttctg

SEQ ID NO: 448032 - DNA, 25 bp, Rattus norvegicus
gggaacagcgcacggccttggactg

SEQ ID NO: 448033 - DNA, 25 bp, Rattus norvegicus
gggaacagcgcagggccttggactg

SEQ ID NO: 448034 - DNA, 25 bp, Rattus norvegicus
gggaacagcggtatcagccgctcca

SEQ ID NO: 448035 - DNA, 25 bp, Rattus norvegicus
gggaacagcggtttcagccgctcca

SEQ ID NO: 448036 - DNA, 25 bp, Rattus norvegicus
gggaacagctccaagcctagtgaca

SEQ ID NO: 448037 - DNA, 25 bp, Rattus norvegicus
gggaacagctcctagcctagtgaca

SEQ ID NO: 448038 - DNA, 25 bp, Rattus norvegicus
gggaacagcttacatgagctttagt

SEQ ID NO: 448039 - DNA, 25 bp, Rattus norvegicus
gggaacagcttagatgagctttagt

SEQ ID NO: 448040 - DNA, 25 bp, Rattus norvegicus
gggaacagcttcactgccttagggc

SEQ ID NO: 448041 - DNA, 25 bp, Rattus norvegicus
gggaacagcttctctgccttagggc

SEQ ID NO: 448042 - DNA, 25 bp, Rattus norvegicus
gggaacagggcacagcatttttaaa

SEQ ID NO: 448043 - DNA, 25 bp, Rattus norvegicus
gggaacagggcagagcatttttaaa

SEQ ID NO: 448044 - DNA, 25 bp, Rattus norvegicus
gggaacagggtaacatcacaacgaa

SEQ ID NO: 448045 - DNA, 25 bp, Rattus norvegicus
gggaacagggtatcatcacaacgaa

SEQ ID NO: 448046 - DNA, 25 bp, Rattus norvegicus
gggaacagtctaattccattcatct

SEQ ID NO: 448047 - DNA, 25 bp, Rattus norvegicus
gggaacagtctatttccattcatct

SEQ ID NO: 448048 - DNA, 25 bp, Rattus norvegicus
gggaacagtgccagctcattttgtt

SEQ ID NO: 448049 - DNA, 25 bp, Rattus norvegicus
gggaacagtgcctgctcattttgtt

SEQ ID NO: 448050 - DNA, 25 bp, Rattus norvegicus
gggaacatagcaattagccactgac

SEQ ID NO: 448051 - DNA, 25 bp, Rattus norvegicus
gggaacatagcatttagccactgac

SEQ ID NO: 448052 - DNA, 25 bp, Rattus norvegicus
gggaacatagctctctgactaaaat

SEQ ID NO: 448053 - DNA, 25 bp, Rattus norvegicus
gggaacatagctgtctgactaaaat

SEQ ID NO: 448054 - DNA, 25 bp, Rattus norvegicus
gggaacatagggacagggtcatcat

SEQ ID NO: 448055 - DNA, 25 bp, Rattus norvegicus
gggaacatagggtcagggtcatcat

SEQ ID NO: 448056 - DNA, 25 bp, Rattus norvegicus
gggaacatatttcatctgttctcca

SEQ ID NO: 448057 - DNA, 25 bp, Rattus norvegicus
gggaacatatttccctatgcctcca

SEQ ID NO: 448058 - DNA, 25 bp, Rattus norvegicus
gggaacatatttgatctgttctcca

SEQ ID NO: 448059 - DNA, 25 bp, Rattus norvegicus
gggaacatatttgcctatgcctcca

SEQ ID NO: 448060 - DNA, 25 bp, Rattus norvegicus
gggaacatcaatcactatcaaccaa

SEQ ID NO: 448061 - DNA, 25 bp, Rattus norvegicus
gggaacatcaatgactatcaaccaa

SEQ ID NO: 448062 - DNA, 25 bp, Rattus norvegicus
gggaacatcagcatctgaactgcaa

SEQ ID NO: 448063 - DNA, 25 bp, Rattus norvegicus
gggaacatcagcttctgaactgcaa

SEQ ID NO: 448064 - DNA, 25 bp, Rattus norvegicus
gggaacatcattatctccttttgtg

SEQ ID NO: 448065 - DNA, 25 bp, Rattus norvegicus
gggaacatcattttctccttttgtg

SEQ ID NO: 448066 - DNA, 25 bp, Rattus norvegicus
gggaacatccgaccagaacctctga

SEQ ID NO: 448067 - DNA, 25 bp, Rattus norvegicus
gggaacatccgagcagaacctctga

SEQ ID NO: 448068 - DNA, 25 bp, Rattus norvegicus
gggaacatctaaaagcctcacagtg

SEQ ID NO: 448069 - DNA, 25 bp, Rattus norvegicus
gggaacatctaatagcctcacagtg

SEQ ID NO: 448070 - DNA, 25 bp, Rattus norvegicus
gggaacatctcaatttaatagtttg

SEQ ID NO: 448071 - DNA, 25 bp, Rattus norvegicus
gggaacatctcattttaatagtttg

SEQ ID NO: 448072 - DNA, 25 bp, Rattus norvegicus
gggaacatctgcacttccgccttat

SEQ ID NO: 448073 - DNA, 25 bp, Rattus norvegicus
gggaacatctgctcttccgccttat

SEQ ID NO: 448074 - DNA, 25 bp, Rattus norvegicus
gggaacatcttgatccaagcctaac

SEQ ID NO: 448075 - DNA, 25 bp, Rattus norvegicus
gggaacatcttgttccaagcctaac

SEQ ID NO: 448076 - DNA, 25 bp, Rattus norvegicus
gggaacatggcaacaactttgctaa

SEQ ID NO: 448077 - DNA, 25 bp, Rattus norvegicus
gggaacatggcatcaactttgctaa

SEQ ID NO: 448078 - DNA, 25 bp, Rattus norvegicus
gggaacatgtttaacacctatgcga

SEQ ID NO: 448079 - DNA, 25 bp, Rattus norvegicus
gggaacatgttttacacctatgcga

SEQ ID NO: 448080 - DNA, 25 bp, Rattus norvegicus
gggaacattttgcatgcctgcacat

SEQ ID NO: 448081 - DNA, 25 bp, Rattus norvegicus
gggaacattttggatgcctgcacat

SEQ ID NO: 448082 - DNA, 25 bp, Rattus norvegicus
gggaaccaaactcagcaagagcaat

SEQ ID NO: 448083 - DNA, 25 bp, Rattus norvegicus
gggaaccaaactgagcaagagcaat

SEQ ID NO: 448084 - DNA, 25 bp, Rattus norvegicus
gggaaccaacctacgtcctattgag

SEQ ID NO: 448085 - DNA, 25 bp, Rattus norvegicus
gggaaccaaccttcgtcctattgag

SEQ ID NO: 448086 - DNA, 25 bp, Rattus norvegicus
gggaaccaaggcatcagccgtcagt

SEQ ID NO: 448087 - DNA, 25 bp, Rattus norvegicus
gggaaccaaggcttcagccgtcagt

SEQ ID NO: 448088 - DNA, 25 bp, Rattus norvegicus
gggaaccaagttacaccagtctatt

SEQ ID NO: 448089 - DNA, 25 bp, Rattus norvegicus
gggaaccaagttagcctggactccg

SEQ ID NO: 448090 - DNA, 25 bp, Rattus norvegicus
gggaaccaagtttcaccagtctatt

SEQ ID NO: 448091 - DNA, 25 bp, Rattus norvegicus
gggaaccaagtttgcctggactccg

SEQ ID NO: 448092 - DNA, 25 bp, Rattus norvegicus
gggaaccacacacatagttttcatg

SEQ ID NO: 448093 - DNA, 25 bp, Rattus norvegicus
gggaaccacacagatagttttcatg

SEQ ID NO: 448094 - DNA, 25 bp, Rattus norvegicus
gggaaccagcaaaatcctcaaggga

SEQ ID NO: 448095 - DNA, 25 bp, Rattus norvegicus
gggaaccagcaatatcctcaaggga

SEQ ID NO: 448096 - DNA, 25 bp, Rattus norvegicus
gggaaccagggccagatgtgcatca

SEQ ID NO: 448097 - DNA, 25 bp, Rattus norvegicus
gggaaccagggcgagatgtgcatca

SEQ ID NO: 448098 - DNA, 25 bp, Rattus norvegicus
gggaaccagttcatgagtttgttaa

SEQ ID NO: 448099 - DNA, 25 bp, Rattus norvegicus
gggaaccagttcttgagtttgttaa

SEQ ID NO: 448100 - DNA, 25 bp, Rattus norvegicus
gggaaccatactcccgggatattaa

SEQ ID NO: 448101 - DNA, 25 bp, Rattus norvegicus
gggaaccatactgccgggatattaa

SEQ ID NO: 448102 - DNA, 25 bp, Rattus norvegicus
gggaaccatgggaagcaacgctctg

SEQ ID NO: 448103 - DNA, 25 bp, Rattus norvegicus
gggaaccatgggtagcaacgctctg

SEQ ID NO: 448104 - DNA, 25 bp, Rattus norvegicus
gggaacccaactctgaactctcctg

SEQ ID NO: 448105 - DNA, 25 bp, Rattus norvegicus
gggaacccaactgtgaactctcctg

SEQ ID NO: 448106 - DNA, 25 bp, Rattus norvegicus
gggaacccaagtcgcacgcctgtcg

SEQ ID NO: 448107 - DNA, 25 bp, Rattus norvegicus
gggaacccaagtggcacgcctgtcg

SEQ ID NO: 448108 - DNA, 25 bp, Rattus norvegicus
gggaacccacaaatccagatgttga

SEQ ID NO: 448109 - DNA, 25 bp, Rattus norvegicus
gggaacccacaattccagatgttga

SEQ ID NO: 448110 - DNA, 25 bp, Rattus norvegicus
gggaacccagaacctcctgaatcat

SEQ ID NO: 448111 - DNA, 25 bp, Rattus norvegicus
gggaacccagaagctcctgaatcat

SEQ ID NO: 448112 - DNA, 25 bp, Rattus norvegicus
gggaacccagatactcatagtttat

SEQ ID NO: 448113 - DNA, 25 bp, Rattus norvegicus
gggaacccagattctcatagtttat

SEQ ID NO: 448114 - DNA, 25 bp, Rattus norvegicus
gggaacccaggtactcactgccttc

SEQ ID NO: 448115 - DNA, 25 bp, Rattus norvegicus
gggaacccaggttctcactgccttc

SEQ ID NO: 448116 - DNA, 25 bp, Rattus norvegicus
gggaacccatggatctcttacaggt

SEQ ID NO: 448117 - DNA, 25 bp, Rattus norvegicus
gggaacccatggttctcttacaggt

SEQ ID NO: 448118 - DNA, 25 bp, Rattus norvegicus
gggaaccccaagagcgatgagatga

SEQ ID NO: 448119 - DNA, 25 bp, Rattus norvegicus
gggaaccccaagtgcgatgagatga

SEQ ID NO: 448120 - DNA, 25 bp, Rattus norvegicus
gggaaccccggaatgcctggcactc

SEQ ID NO: 448121 - DNA, 25 bp, Rattus norvegicus
gggaaccccggattgcctggcactc

SEQ ID NO: 448122 - DNA, 25 bp, Rattus norvegicus
gggaacccctctcgcgtggacaatt

SEQ ID NO: 448123 - DNA, 25 bp, Rattus norvegicus
gggaacccctctggcgtggacaatt

SEQ ID NO: 448124 - DNA, 25 bp, Rattus norvegicus
gggaacccgagtaactatcccagca

SEQ ID NO: 448125 - DNA, 25 bp, Rattus norvegicus
gggaacccgagttactatcccagca

SEQ ID NO: 448126 - DNA, 25 bp, Rattus norvegicus
gggaaccctatgctttagaagccaa

SEQ ID NO: 448127 - DNA, 25 bp, Rattus norvegicus
gggaaccctatggtttagaagccaa

SEQ ID NO: 448128 - DNA, 25 bp, Rattus norvegicus
gggaaccctggccaaacacacagct

SEQ ID NO: 448129 - DNA, 25 bp, Rattus norvegicus
gggaaccctggcgaaacacacagct

SEQ ID NO: 448130 - DNA, 25 bp, Rattus norvegicus
gggaacccttgaaattgtgtgcagt

SEQ ID NO: 448131 - DNA, 25 bp, Rattus norvegicus
gggaacccttgatattgtgtgcagt

SEQ ID NO: 448132 - DNA, 25 bp, Rattus norvegicus
gggaaccctttgcagatgcagccgc

SEQ ID NO: 448133 - DNA, 25 bp, Rattus norvegicus
gggaaccctttggagatgcagccgc

SEQ ID NO: 448134 - DNA, 25 bp, Rattus norvegicus
gggaaccgaactacagtggatctgc

SEQ ID NO: 448135 - DNA, 25 bp, Rattus norvegicus
gggaaccgaacttcagtggatctgc

SEQ ID NO: 448136 - DNA, 25 bp, Rattus norvegicus
gggaaccgagaacatctttccgctc

SEQ ID NO: 448137 - DNA, 25 bp, Rattus norvegicus
gggaaccgagaagatctttccgctc

SEQ ID NO: 448138 - DNA, 25 bp, Rattus norvegicus
gggaaccgatatattcttcttcagc

SEQ ID NO: 448139 - DNA, 25 bp, Rattus norvegicus
gggaaccgatattttcttcttcagc

SEQ ID NO: 448140 - DNA, 25 bp, Rattus norvegicus
gggaaccgattcactatttctacca

SEQ ID NO: 448141 - DNA, 25 bp, Rattus norvegicus
gggaaccgattctctatttctacca

SEQ ID NO: 448142 - DNA, 25 bp, Rattus norvegicus
gggaaccgtgtaaattctctcttca

SEQ ID NO: 448143 - DNA, 25 bp, Rattus norvegicus
gggaaccgtgtatattctctcttca

SEQ ID NO: 448144 - DNA, 25 bp, Rattus norvegicus
gggaacctagtccttcacacgtgtt

SEQ ID NO: 448145 - DNA, 25 bp, Rattus norvegicus
gggaacctagtcgttcacacgtgtt

SEQ ID NO: 448146 - DNA, 25 bp, Rattus norvegicus
gggaacctatggagcaaatggtagt

SEQ ID NO: 448147 - DNA, 25 bp, Rattus norvegicus
gggaacctatggtgcaaatggtagt

SEQ ID NO: 448148 - DNA, 25 bp, Rattus norvegicus
gggaacctcaacaacaatttgacta

SEQ ID NO: 448149 - DNA, 25 bp, Rattus norvegicus
gggaacctcaactacaatttgacta

SEQ ID NO: 448150 - DNA, 25 bp, Rattus norvegicus
gggaacctcagcaggctttccacca

SEQ ID NO: 448151 - DNA, 25 bp, Rattus norvegicus
gggaacctcagctggctttccacca

SEQ ID NO: 448152 - DNA, 25 bp, Rattus norvegicus
gggaacctcataacatgcaccctga

SEQ ID NO: 448153 - DNA, 25 bp, Rattus norvegicus
gggaacctcatatcatgcaccctga

SEQ ID NO: 448154 - DNA, 25 bp, Rattus norvegicus
gggaacctcctcatacctgaccaga

SEQ ID NO: 448155 - DNA, 25 bp, Rattus norvegicus
gggaacctcctcttacctgaccaga

SEQ ID NO: 448156 - DNA, 25 bp, Rattus norvegicus
gggaacctgtaacaattctgttgta

SEQ ID NO: 448157 - DNA, 25 bp, Rattus norvegicus
gggaacctgtaagaattctgttgta

SEQ ID NO: 448158 - DNA, 25 bp, Rattus norvegicus
gggaaccttaggacagcccttgagc

SEQ ID NO: 448159 - DNA, 25 bp, Rattus norvegicus
gggaaccttaggtcagcccttgagc

SEQ ID NO: 448160 - DNA, 25 bp, Rattus norvegicus
gggaaccttagtctatacctcctca

SEQ ID NO: 448161 - DNA, 25 bp, Rattus norvegicus
gggaaccttagtgtatacctcctca

SEQ ID NO: 448162 - DNA, 25 bp, Rattus norvegicus
gggaaccttcgaccagttgccatca

SEQ ID NO: 448163 - DNA, 25 bp, Rattus norvegicus
gggaaccttcgagcagttgccatca

SEQ ID NO: 448164 - DNA, 25 bp, Rattus norvegicus
gggaaccttggcactaggagtcaga

SEQ ID NO: 448165 - DNA, 25 bp, Rattus norvegicus
gggaaccttggctctaggagtcaga

SEQ ID NO: 448166 - DNA, 25 bp, Rattus norvegicus
gggaaccttggtactgtacactctt

SEQ ID NO: 448167 - DNA, 25 bp, Rattus norvegicus
gggaaccttggttctgtacactctt

SEQ ID NO: 448168 - DNA, 25 bp, Rattus norvegicus
gggaacctttcaagtctttcaagag

SEQ ID NO: 448169 - DNA, 25 bp, Rattus norvegicus
gggaacctttcatgtctttcaagag

SEQ ID NO: 448170 - DNA, 25 bp, Rattus norvegicus
gggaacgcaaagcacttctctaaca

SEQ ID NO: 448171 - DNA, 25 bp, Rattus norvegicus
gggaacgcaaaggacttctctaaca

SEQ ID NO: 448172 - DNA, 25 bp, Rattus norvegicus
gggaacgcagacctcatcaacgact

SEQ ID NO: 448173 - DNA, 25 bp, Rattus norvegicus
gggaacgcagacgtcatcaacgact

SEQ ID NO: 448174 - DNA, 25 bp, Rattus norvegicus
gggaacgctcttaactcaggttcaa

SEQ ID NO: 448175 - DNA, 25 bp, Rattus norvegicus
gggaacgctctttactcaggttcaa

SEQ ID NO: 448176 - DNA, 25 bp, Rattus norvegicus
gggaacggaggcagcccctcctgat

SEQ ID NO: 448177 - DNA, 25 bp, Rattus norvegicus
gggaacggaggctgcccctcctgat

SEQ ID NO: 448178 - DNA, 25 bp, Rattus norvegicus
gggaacggccctacagctgtccaac

SEQ ID NO: 448179 - DNA, 25 bp, Rattus norvegicus
gggaacggcccttcagctgtccaac

SEQ ID NO: 448180 - DNA, 25 bp, Rattus norvegicus
gggaacggtctcagctttgtgagcc

SEQ ID NO: 448181 - DNA, 25 bp, Rattus norvegicus
gggaacggtctctgctttgtgagcc

SEQ ID NO: 448182 - DNA, 25 bp, Rattus norvegicus
gggaacgtctctctgactggcaaaa

SEQ ID NO: 448183 - DNA, 25 bp, Rattus norvegicus
gggaacgtctctgtgactggcaaaa

SEQ ID NO: 448184 - DNA, 25 bp, Rattus norvegicus
gggaacgttgccatgatgacgatac

SEQ ID NO: 448185 - DNA, 25 bp, Rattus norvegicus
gggaacgttgccttgatgacgatac

SEQ ID NO: 448186 - DNA, 25 bp, Rattus norvegicus
gggaactaaatcacctgccactcaa

SEQ ID NO: 448187 - DNA, 25 bp, Rattus norvegicus
gggaactaaatctcctgccactcaa

SEQ ID NO: 448188 - DNA, 25 bp, Rattus norvegicus
gggaactaacttcggccctgttatg

SEQ ID NO: 448189 - DNA, 25 bp, Rattus norvegicus
gggaactaacttgggccctgttatg

SEQ ID NO: 448190 - DNA, 25 bp, Rattus norvegicus
gggaactaagccattaccaccacgg

SEQ ID NO: 448191 - DNA, 25 bp, Rattus norvegicus
gggaactaagcctttaccaccacgg

SEQ ID NO: 448192 - DNA, 25 bp, Rattus norvegicus
gggaactacaagaaccacaagctca

SEQ ID NO: 448193 - DNA, 25 bp, Rattus norvegicus
gggaactacaagtaccacaagctca

SEQ ID NO: 448194 - DNA, 25 bp, Rattus norvegicus
gggaactacaggattgtgccctcca

SEQ ID NO: 448195 - DNA, 25 bp, Rattus norvegicus
gggaactacaggtttgtgccctcca

SEQ ID NO: 448196 - DNA, 25 bp, Rattus norvegicus
gggaactacattcacatcggtttgt

SEQ ID NO: 448197 - DNA, 25 bp, Rattus norvegicus
gggaactacattgacatcggtttgt

SEQ ID NO: 448198 - DNA, 25 bp, Rattus norvegicus
gggaactaccagagtggctgtctct

SEQ ID NO: 448199 - DNA, 25 bp, Rattus norvegicus
gggaactaccagtgtggctgtctct

SEQ ID NO: 448200 - DNA, 25 bp, Rattus norvegicus
gggaactaggccagtgttagctttc

SEQ ID NO: 448201 - DNA, 25 bp, Rattus norvegicus
gggaactaggcctgtgttagctttc

SEQ ID NO: 448202 - DNA, 25 bp, Rattus norvegicus
gggaactagtaacatctttctgaaa

SEQ ID NO: 448203 - DNA, 25 bp, Rattus norvegicus
gggaactagtaagatctttctgaaa

SEQ ID NO: 448204 - DNA, 25 bp, Rattus norvegicus
gggaactagtccagactgcctgaga

SEQ ID NO: 448205 - DNA, 25 bp, Rattus norvegicus
gggaactagtcctgactgcctgaga

SEQ ID NO: 448206 - DNA, 25 bp, Rattus norvegicus
gggaactatgtgcagcccagctgct

SEQ ID NO: 448207 - DNA, 25 bp, Rattus norvegicus
gggaactatgtggagcccagctgct

SEQ ID NO: 448208 - DNA, 25 bp, Rattus norvegicus
gggaactattctctactgtcagaac

SEQ ID NO: 448209 - DNA, 25 bp, Rattus norvegicus
gggaactattctgtactgtcagaac

SEQ ID NO: 448210 - DNA, 25 bp, Rattus norvegicus
gggaactcaaccctatgtatgaagg

SEQ ID NO: 448211 - DNA, 25 bp, Rattus norvegicus
gggaactcaaccgtatgtatgaagg

SEQ ID NO: 448212 - DNA, 25 bp, Rattus norvegicus
gggaactcaggtaacacacagtacg

SEQ ID NO: 448213 - DNA, 25 bp, Rattus norvegicus
gggaactcaggttacacacagtacg

SEQ ID NO: 448214 - DNA, 25 bp, Rattus norvegicus
gggaactcatcaacagcttcttcat

SEQ ID NO: 448215 - DNA, 25 bp, Rattus norvegicus
gggaactcatcatcagcttcttcat

SEQ ID NO: 448216 - DNA, 25 bp, Rattus norvegicus
gggaactcatctctatcccagctgg

SEQ ID NO: 448217 - DNA, 25 bp, Rattus norvegicus
gggaactcatctgtatcccagctgg

SEQ ID NO: 448218 - DNA, 25 bp, Rattus norvegicus
gggaactcatggagccttttcttcc

SEQ ID NO: 448219 - DNA, 25 bp, Rattus norvegicus
gggaactcatggtgccttttcttcc

SEQ ID NO: 448220 - DNA, 25 bp, Rattus norvegicus
gggaactccacacgcattgactatg

SEQ ID NO: 448221 - DNA, 25 bp, Rattus norvegicus
gggaactccacaggcattgactatg

SEQ ID NO: 448222 - DNA, 25 bp, Rattus norvegicus
gggaactcctgcacgtgtaaaatca

SEQ ID NO: 448223 - DNA, 25 bp, Rattus norvegicus
gggaactcctgctcgtgtaaaatca

SEQ ID NO: 448224 - DNA, 25 bp, Rattus norvegicus
gggaactctattaggttgcctacaa

SEQ ID NO: 448225 - DNA, 25 bp, Rattus norvegicus
gggaactctatttggttgcctacaa

SEQ ID NO: 448226 - DNA, 25 bp, Rattus norvegicus
gggaactctcagcagatagcaggca

SEQ ID NO: 448227 - DNA, 25 bp, Rattus norvegicus
gggaactctcaggagatagcaggca

SEQ ID NO: 448228 - DNA, 25 bp, Rattus norvegicus
gggaactctgctaaggtctacctca

SEQ ID NO: 448229 - DNA, 25 bp, Rattus norvegicus
gggaactctgcttaggtctacctca

SEQ ID NO: 448230 - DNA, 25 bp, Rattus norvegicus
gggaactcttctaactgtaactctt

SEQ ID NO: 448231 - DNA, 25 bp, Rattus norvegicus
gggaactcttcttactgtaactctt

SEQ ID NO: 448232 - DNA, 25 bp, Rattus norvegicus
gggaactgaacaagcctgagggcct

SEQ ID NO: 448233 - DNA, 25 bp, Rattus norvegicus
gggaactgaacatgcctgagggcct

SEQ ID NO: 448234 - DNA, 25 bp, Rattus norvegicus
gggaactgaattctcatcttctaca

SEQ ID NO: 448235 - DNA, 25 bp, Rattus norvegicus
gggaactgaattgtcatcttctaca

SEQ ID NO: 448236 - DNA, 25 bp, Rattus norvegicus
gggaactgacacatctgcctagact

SEQ ID NO: 448237 - DNA, 25 bp, Rattus norvegicus
gggaactgacacttctgcctagact

SEQ ID NO: 448238 - DNA, 25 bp, Rattus norvegicus
gggaactgatgcatcttctggcccc

SEQ ID NO: 448239 - DNA, 25 bp, Rattus norvegicus
gggaactgatgcttcttctggcccc

SEQ ID NO: 448240 - DNA, 25 bp, Rattus norvegicus
gggaactgcactctttttaaatact

SEQ ID NO: 448241 - DNA, 25 bp, Rattus norvegicus
gggaactgcactgtttttaaatact

SEQ ID NO: 448242 - DNA, 25 bp, Rattus norvegicus
gggaactgcaggaccaccattgtca

SEQ ID NO: 448243 - DNA, 25 bp, Rattus norvegicus
gggaactgcaggtccaccattgtca

SEQ ID NO: 448244 - DNA, 25 bp, Rattus norvegicus
gggaactgcctgaaccaactgggta

SEQ ID NO: 448245 - DNA, 25 bp, Rattus norvegicus
gggaactgcctgtaccaactgggta

SEQ ID NO: 448246 - DNA, 25 bp, Rattus norvegicus
gggaactgccttccaaatgttcatg

SEQ ID NO: 448247 - DNA, 25 bp, Rattus norvegicus
gggaactgccttgcaaatgttcatg

SEQ ID NO: 448248 - DNA, 25 bp, Rattus norvegicus
gggaactgcttaaattacatgctaa

SEQ ID NO: 448249 - DNA, 25 bp, Rattus norvegicus
gggaactgcttatattacatgctaa

SEQ ID NO: 448250 - DNA, 25 bp, Rattus norvegicus
gggaactggaatacattagcttttt

SEQ ID NO: 448251 - DNA, 25 bp, Rattus norvegicus
gggaactggaattcattagcttttt

SEQ ID NO: 448252 - DNA, 25 bp, Rattus norvegicus
gggaactggagaactactccccgac

SEQ ID NO: 448253 - DNA, 25 bp, Rattus norvegicus
gggaactggagatctactccccgac

SEQ ID NO: 448254 - DNA, 25 bp, Rattus norvegicus
gggaactgtagcaatggcccagcca

SEQ ID NO: 448255 - DNA, 25 bp, Rattus norvegicus
gggaactgtagctatggcccagcca

SEQ ID NO: 448256 - DNA, 25 bp, Rattus norvegicus
gggaactgtatcacagcacctgaat

SEQ ID NO: 448257 - DNA, 25 bp, Rattus norvegicus
gggaactgtatctcagcacctgaat

SEQ ID NO: 448258 - DNA, 25 bp, Rattus norvegicus
gggaactgtcatattgaggtaaaat

SEQ ID NO: 448259 - DNA, 25 bp, Rattus norvegicus
gggaactgtcattttgaggtaaaat

SEQ ID NO: 448260 - DNA, 25 bp, Rattus norvegicus
gggaactgtggcatctcaataaaca

SEQ ID NO: 448261 - DNA, 25 bp, Rattus norvegicus
gggaactgtggcttctcaataaaca

SEQ ID NO: 448262 - DNA, 25 bp, Rattus norvegicus
gggaactgtgtgcacttcctcatac

SEQ ID NO: 448263 - DNA, 25 bp, Rattus norvegicus
gggaactgtgtggacttcctcatac

SEQ ID NO: 448264 - DNA, 25 bp, Rattus norvegicus
gggaactgttctattgcaaccagaa

SEQ ID NO: 448265 - DNA, 25 bp, Rattus norvegicus
gggaactgttcttttgcaaccagaa

SEQ ID NO: 448266 - DNA, 25 bp, Rattus norvegicus
gggaacttaacaattctgtcagatt

SEQ ID NO: 448267 - DNA, 25 bp, Rattus norvegicus
gggaacttaacatttctgtcagatt

SEQ ID NO: 448268 - DNA, 25 bp, Rattus norvegicus
gggaacttagttctgtaaactgtct

SEQ ID NO: 448269 - DNA, 25 bp, Rattus norvegicus
gggaacttagttgtgtaaactgtct

SEQ ID NO: 448270 - DNA, 25 bp, Rattus norvegicus
gggaacttatgaaggaccccgtcat

SEQ ID NO: 448271 - DNA, 25 bp, Rattus norvegicus
gggaacttatgatggaccccgtcat

SEQ ID NO: 448272 - DNA, 25 bp, Rattus norvegicus
gggaacttcaacacttagtcttgtg

SEQ ID NO: 448273 - DNA, 25 bp, Rattus norvegicus
gggaacttcaactcttagtcttgtg

SEQ ID NO: 448274 - DNA, 25 bp, Rattus norvegicus
gggaacttcaagactaagtccaggt

SEQ ID NO: 448275 - DNA, 25 bp, Rattus norvegicus
gggaacttcaagtctaagtccaggt

SEQ ID NO: 448276 - DNA, 25 bp, Rattus norvegicus
gggaacttcacaagcaaatccagtg

SEQ ID NO: 448277 - DNA, 25 bp, Rattus norvegicus
gggaacttcacatgcaaatccagtg

SEQ ID NO: 448278 - DNA, 25 bp, Rattus norvegicus
gggaacttcatcaaaatccaaggat

SEQ ID NO: 448279 - DNA, 25 bp, Rattus norvegicus
gggaacttcatctaaatccaaggat

SEQ ID NO: 448280 - DNA, 25 bp, Rattus norvegicus
gggaacttcatgatgaccctgaccc

SEQ ID NO: 448281 - DNA, 25 bp, Rattus norvegicus
gggaacttcatgttgaccctgaccc

SEQ ID NO: 448282 - DNA, 25 bp, Rattus norvegicus
gggaacttcattcgtattcattatg

SEQ ID NO: 448283 - DNA, 25 bp, Rattus norvegicus
gggaacttcattggtattcattatg

SEQ ID NO: 448284 - DNA, 25 bp, Rattus norvegicus
gggaacttccatagcattatgtata

SEQ ID NO: 448285 - DNA, 25 bp, Rattus norvegicus
gggaacttccattgcattatgtata

SEQ ID NO: 448286 - DNA, 25 bp, Rattus norvegicus
gggaacttcgtaaccgcaagctctg

SEQ ID NO: 448287 - DNA, 25 bp, Rattus norvegicus
gggaacttcgtatccgcaagctctg

SEQ ID NO: 448288 - DNA, 25 bp, Rattus norvegicus
gggaacttctatcatgcttacgatt

SEQ ID NO: 448289 - DNA, 25 bp, Rattus norvegicus
gggaacttctatgatgcttacgatt

SEQ ID NO: 448290 - DNA, 25 bp, Rattus norvegicus
gggaacttgaaacctacatcaggat

SEQ ID NO: 448291 - DNA, 25 bp, Rattus norvegicus
gggaacttgaaagctacatcaggat

SEQ ID NO: 448292 - DNA, 25 bp, Rattus norvegicus
gggaacttgaccatcacattgggtg

SEQ ID NO: 448293 - DNA, 25 bp, Rattus norvegicus
gggaacttgaccttcacattgggtg

SEQ ID NO: 448294 - DNA, 25 bp, Rattus norvegicus
gggaacttgactactgaagctgcag

SEQ ID NO: 448295 - DNA, 25 bp, Rattus norvegicus
gggaacttgacttctgaagctgcag

SEQ ID NO: 448296 - DNA, 25 bp, Rattus norvegicus
gggaacttgagacagcccacaaaac

SEQ ID NO: 448297 - DNA, 25 bp, Rattus norvegicus
gggaacttgagagagcccacaaaac

SEQ ID NO: 448298 - DNA, 25 bp, Rattus norvegicus
gggaacttgctcacgtcgaaatcaa

SEQ ID NO: 448299 - DNA, 25 bp, Rattus norvegicus
gggaacttgctctcgtcgaaatcaa

SEQ ID NO: 448300 - DNA, 25 bp, Rattus norvegicus
gggaacttggctaatgcaacctcta

SEQ ID NO: 448301 - DNA, 25 bp, Rattus norvegicus
gggaacttggcttatgcaacctcta

SEQ ID NO: 448302 - DNA, 25 bp, Rattus norvegicus
gggaactttacaccataccaattat

SEQ ID NO: 448303 - DNA, 25 bp, Rattus norvegicus
gggaactttacagcataccaattat

SEQ ID NO: 448304 - DNA, 25 bp, Rattus norvegicus
gggaactttccaaaaaacactagct

SEQ ID NO: 448305 - DNA, 25 bp, Rattus norvegicus
gggaactttccataaaacactagct

SEQ ID NO: 448306 - DNA, 25 bp, Rattus norvegicus
gggaactttgcccaggtcactgtga

SEQ ID NO: 448307 - DNA, 25 bp, Rattus norvegicus
gggaactttgccgaggtcactgtga

SEQ ID NO: 448308 - DNA, 25 bp, Rattus norvegicus
gggaacttttacatgctctaattat

SEQ ID NO: 448309 - DNA, 25 bp, Rattus norvegicus
gggaacttttacttgctctaattat

SEQ ID NO: 448310 - DNA, 25 bp, Rattus norvegicus
gggaacttttgaaacaatcttgtga

SEQ ID NO: 448311 - DNA, 25 bp, Rattus norvegicus
gggaacttttgatacaatcttgtga

SEQ ID NO: 448312 - DNA, 25 bp, Rattus norvegicus
gggaagaacactcgcctttcccatg

SEQ ID NO: 448313 - DNA, 25 bp, Rattus norvegicus
gggaagaacactggcctttcccatg

SEQ ID NO: 448314 - DNA, 25 bp, Rattus norvegicus
gggaagaacagtcctgtccatcctc

SEQ ID NO: 448315 - DNA, 25 bp, Rattus norvegicus
gggaagaacagtgctgtccatcctc

SEQ ID NO: 448316 - DNA, 25 bp, Rattus norvegicus
gggaagaaccatcctgttgtcgtag

SEQ ID NO: 448317 - DNA, 25 bp, Rattus norvegicus
gggaagaaccatgctgttgtcgtag

SEQ ID NO: 448318 - DNA, 25 bp, Rattus norvegicus
gggaagaagacactggcgcctccac

SEQ ID NO: 448319 - DNA, 25 bp, Rattus norvegicus
gggaagaagacagtggcgcctccac

SEQ ID NO: 448320 - DNA, 25 bp, Rattus norvegicus
gggaagaagcctcagactacaatgt

SEQ ID NO: 448321 - DNA, 25 bp, Rattus norvegicus
gggaagaagcctgagactacaatgt

SEQ ID NO: 448322 - DNA, 25 bp, Rattus norvegicus
gggaagaaggaaaccattcagctgt

SEQ ID NO: 448323 - DNA, 25 bp, Rattus norvegicus
gggaagaaggaatccattcagctgt

SEQ ID NO: 448324 - DNA, 25 bp, Rattus norvegicus
gggaagaaggccacctttgaacata

SEQ ID NO: 448325 - DNA, 25 bp, Rattus norvegicus
gggaagaaggcctcctttgaacata

SEQ ID NO: 448326 - DNA, 25 bp, Rattus norvegicus
gggaagaatcttcacctcacccatt

SEQ ID NO: 448327 - DNA, 25 bp, Rattus norvegicus
gggaagaatcttgacctcacccatt

SEQ ID NO: 448328 - DNA, 25 bp, Rattus norvegicus
gggaagaattctatcctgctgcttc

SEQ ID NO: 448329 - DNA, 25 bp, Rattus norvegicus
gggaagaattctttcctgctgcttc

SEQ ID NO: 448330 - DNA, 25 bp, Rattus norvegicus
gggaagacaaccagtttgctggctc

SEQ ID NO: 448331 - DNA, 25 bp, Rattus norvegicus
gggaagacaacctgtttgctggctc

SEQ ID NO: 448332 - DNA, 25 bp, Rattus norvegicus
gggaagacatacattgatctctggc

SEQ ID NO: 448333 - DNA, 25 bp, Rattus norvegicus
gggaagacatactttgatctctggc

SEQ ID NO: 448334 - DNA, 25 bp, Rattus norvegicus
gggaagacatcactcagcctgtata

SEQ ID NO: 448335 - DNA, 25 bp, Rattus norvegicus
gggaagacatcagtcagcctgtata

SEQ ID NO: 448336 - DNA, 25 bp, Rattus norvegicus
gggaagacatctctgctgcagctct

SEQ ID NO: 448337 - DNA, 25 bp, Rattus norvegicus
gggaagacatctgtgctgcagctct

SEQ ID NO: 448338 - DNA, 25 bp, Rattus norvegicus
gggaagacattcaccacctattaag

SEQ ID NO: 448339 - DNA, 25 bp, Rattus norvegicus
gggaagacattcagcctagcttgag

SEQ ID NO: 448340 - DNA, 25 bp, Rattus norvegicus
gggaagacattctccacctattaag

SEQ ID NO: 448341 - DNA, 25 bp, Rattus norvegicus
gggaagacattctgcctagcttgag

SEQ ID NO: 448342 - DNA, 25 bp, Rattus norvegicus
gggaagaccacgaggccgacaaaca

SEQ ID NO: 448343 - DNA, 25 bp, Rattus norvegicus
gggaagaccacgtggccgacaaaca

SEQ ID NO: 448344 - DNA, 25 bp, Rattus norvegicus
gggaagacccacattcaatctggat

SEQ ID NO: 448345 - DNA, 25 bp, Rattus norvegicus
gggaagacccactttcaatctggat

SEQ ID NO: 448346 - DNA, 25 bp, Rattus norvegicus
gggaagaccgcaaacttagactctg

SEQ ID NO: 448347 - DNA, 25 bp, Rattus norvegicus
gggaagaccgcatacttagactctg

SEQ ID NO: 448348 - DNA, 25 bp, Rattus norvegicus
gggaagacctaaactcagagtgtaa

SEQ ID NO: 448349 - DNA, 25 bp, Rattus norvegicus
gggaagacctaatctcagagtgtaa

SEQ ID NO: 448350 - DNA, 25 bp, Rattus norvegicus
gggaagacctgcacaacaacgtggc

SEQ ID NO: 448351 - DNA, 25 bp, Rattus norvegicus
gggaagacctgctcaacaacgtggc

SEQ ID NO: 448352 - DNA, 25 bp, Rattus norvegicus
gggaagacctttctgctgagcacat

SEQ ID NO: 448353 - DNA, 25 bp, Rattus norvegicus
gggaagacctttgtgctgagcacat

SEQ ID NO: 448354 - DNA, 25 bp, Rattus norvegicus
gggaagacgagccatctgactacat

SEQ ID NO: 448355 - DNA, 25 bp, Rattus norvegicus
gggaagacgagcgatctgactacat

SEQ ID NO: 448356 - DNA, 25 bp, Rattus norvegicus
gggaagacttacacaacatccactt

SEQ ID NO: 448357 - DNA, 25 bp, Rattus norvegicus
gggaagacttactcaacatccactt

SEQ ID NO: 448358 - DNA, 25 bp, Rattus norvegicus
gggaagacttctcagcacataaaag

SEQ ID NO: 448359 - DNA, 25 bp, Rattus norvegicus
gggaagacttctgagcacataaaag

SEQ ID NO: 448360 - DNA, 25 bp, Rattus norvegicus
gggaagagacttacatgactatcac

SEQ ID NO: 448361 - DNA, 25 bp, Rattus norvegicus
gggaagagactttcatgactatcac

SEQ ID NO: 448362 - DNA, 25 bp, Rattus norvegicus
gggaagagagaactgcccctcctaa

SEQ ID NO: 448363 - DNA, 25 bp, Rattus norvegicus
gggaagagagaagtgcccctcctaa

SEQ ID NO: 448364 - DNA, 25 bp, Rattus norvegicus
gggaagagagtgctacctctcaccc

SEQ ID NO: 448365 - DNA, 25 bp, Rattus norvegicus
gggaagagagtggtacctctcaccc

SEQ ID NO: 448366 - DNA, 25 bp, Rattus norvegicus
gggaagagcacgagaacccttgctt

SEQ ID NO: 448367 - DNA, 25 bp, Rattus norvegicus
gggaagagcacgtgaacccttgctt

SEQ ID NO: 448368 - DNA, 25 bp, Rattus norvegicus
gggaagagcactaacccagcatgct

SEQ ID NO: 448369 - DNA, 25 bp, Rattus norvegicus
gggaagagcacttacccagcatgct

SEQ ID NO: 448370 - DNA, 25 bp, Rattus norvegicus
gggaagagcagactggcccactcct

SEQ ID NO: 448371 - DNA, 25 bp, Rattus norvegicus
gggaagagcagagtggcccactcct

SEQ ID NO: 448372 - DNA, 25 bp, Rattus norvegicus
gggaagagccccaaagccagacaga

SEQ ID NO: 448373 - DNA, 25 bp, Rattus norvegicus
gggaagagcccctaagccagacaga

SEQ ID NO: 448374 - DNA, 25 bp, Rattus norvegicus
gggaagagcctccaatcacttgcac

SEQ ID NO: 448375 - DNA, 25 bp, Rattus norvegicus
gggaagagcctcgaatcacttgcac

SEQ ID NO: 448376 - DNA, 25 bp, Rattus norvegicus
gggaagagccttagcaggtctagaa

SEQ ID NO: 448377 - DNA, 25 bp, Rattus norvegicus
gggaagagcctttgcaggtctagaa

SEQ ID NO: 448378 - DNA, 25 bp, Rattus norvegicus
gggaagagcgtcacacattaagaga

SEQ ID NO: 448379 - DNA, 25 bp, Rattus norvegicus
gggaagagcgtctcacattaagaga

SEQ ID NO: 448380 - DNA, 25 bp, Rattus norvegicus
gggaagagctagagcctttcctctc

SEQ ID NO: 448381 - DNA, 25 bp, Rattus norvegicus
gggaagagctagtgcctttcctctc

SEQ ID NO: 448382 - DNA, 25 bp, Rattus norvegicus
gggaagagtcggctatgccctctca

SEQ ID NO: 448383 - DNA, 25 bp, Rattus norvegicus
gggaagagtcgggtatgccctctca

SEQ ID NO: 448384 - DNA, 25 bp, Rattus norvegicus
gggaagagtctcacaaacaagcctg

SEQ ID NO: 448385 - DNA, 25 bp, Rattus norvegicus
gggaagagtctctcaaacaagcctg

SEQ ID NO: 448386 - DNA, 25 bp, Rattus norvegicus
gggaagagttccacgtagctcctac

SEQ ID NO: 448387 - DNA, 25 bp, Rattus norvegicus
gggaagagttcctcgtagctcctac

SEQ ID NO: 448388 - DNA, 25 bp, Rattus norvegicus
gggaagagttctccccaaggtgccc

SEQ ID NO: 448389 - DNA, 25 bp, Rattus norvegicus
gggaagagttctgcccaaggtgccc

SEQ ID NO: 448390 - DNA, 25 bp, Rattus norvegicus
gggaagatcatcaacctacttataa

SEQ ID NO: 448391 - DNA, 25 bp, Rattus norvegicus
gggaagatcatctacctacttataa

SEQ ID NO: 448392 - DNA, 25 bp, Rattus norvegicus
gggaagatcggcatcgccagccacg

SEQ ID NO: 448393 - DNA, 25 bp, Rattus norvegicus
gggaagatcggcttcgccagccacg

SEQ ID NO: 448394 - DNA, 25 bp, Rattus norvegicus
gggaagatctccctctatttaacta

SEQ ID NO: 448395 - DNA, 25 bp, Rattus norvegicus
gggaagatctccgtctatttaacta

SEQ ID NO: 448396 - DNA, 25 bp, Rattus norvegicus
gggaagatgctcaaattactttgct

SEQ ID NO: 448397 - DNA, 25 bp, Rattus norvegicus
gggaagatgctcacaagctcataga

SEQ ID NO: 448398 - DNA, 25 bp, Rattus norvegicus
gggaagatgctctaattactttgct

SEQ ID NO: 448399 - DNA, 25 bp, Rattus norvegicus
gggaagatgctctcaagctcataga

SEQ ID NO: 448400 - DNA, 25 bp, Rattus norvegicus
gggaagatgcttctcaccaagggat

SEQ ID NO: 448401 - DNA, 25 bp, Rattus norvegicus
gggaagatgcttgtcaccaagggat

SEQ ID NO: 448402 - DNA, 25 bp, Rattus norvegicus
gggaagatggctatactggcctcaa

SEQ ID NO: 448403 - DNA, 25 bp, Rattus norvegicus
gggaagatggctttactggcctcaa

SEQ ID NO: 448404 - DNA, 25 bp, Rattus norvegicus
gggaagattactacctgccctagga

SEQ ID NO: 448405 - DNA, 25 bp, Rattus norvegicus
gggaagattacttcctgccctagga

SEQ ID NO: 448406 - DNA, 25 bp, Rattus norvegicus
gggaagattccaacagatcacattt

SEQ ID NO: 448407 - DNA, 25 bp, Rattus norvegicus
gggaagattccatcagatcacattt

SEQ ID NO: 448408 - DNA, 25 bp, Rattus norvegicus
gggaagattcccactttaatataga

SEQ ID NO: 448409 - DNA, 25 bp, Rattus norvegicus
gggaagattccctctttaatataga

SEQ ID NO: 448410 - DNA, 25 bp, Rattus norvegicus
gggaagattctcaggagcctcataa

SEQ ID NO: 448411 - DNA, 25 bp, Rattus norvegicus
gggaagattctctggagcctcataa

SEQ ID NO: 448412 - DNA, 25 bp, Rattus norvegicus
gggaagcaaaccacgtctggccaca

SEQ ID NO: 448413 - DNA, 25 bp, Rattus norvegicus
gggaagcaaaccatcaacccatgag

SEQ ID NO: 448414 - DNA, 25 bp, Rattus norvegicus
gggaagcaaacctcgtctggccaca

SEQ ID NO: 448415 - DNA, 25 bp, Rattus norvegicus
gggaagcaaaccttcaacccatgag

SEQ ID NO: 448416 - DNA, 25 bp, Rattus norvegicus
gggaagcaaccaaggttccagctct

SEQ ID NO: 448417 - DNA, 25 bp, Rattus norvegicus
gggaagcaaccatggttccagctct

SEQ ID NO: 448418 - DNA, 25 bp, Rattus norvegicus
gggaagcaagcgcacccaaagactt

SEQ ID NO: 448419 - DNA, 25 bp, Rattus norvegicus
gggaagcaagcggacccaaagactt

SEQ ID NO: 448420 - DNA, 25 bp, Rattus norvegicus
gggaagcacaacacacatcagaggt

SEQ ID NO: 448421 - DNA, 25 bp, Rattus norvegicus
gggaagcacaactcacatcagaggt

SEQ ID NO: 448422 - DNA, 25 bp, Rattus norvegicus
gggaagcaccttcatcaagtatgta

SEQ ID NO: 448423 - DNA, 25 bp, Rattus norvegicus
gggaagcaccttgatcaagtatgta

SEQ ID NO: 448424 - DNA, 25 bp, Rattus norvegicus
gggaagcacgtcattggccttcaaa

SEQ ID NO: 448425 - DNA, 25 bp, Rattus norvegicus
gggaagcacgtctttggccttcaaa

SEQ ID NO: 448426 - DNA, 25 bp, Rattus norvegicus
gggaagcactctattgactcaaagt

SEQ ID NO: 448427 - DNA, 25 bp, Rattus norvegicus
gggaagcactcttttgactcaaagt

SEQ ID NO: 448428 - DNA, 25 bp, Rattus norvegicus
gggaagcagacccttcacattctaa

SEQ ID NO: 448429 - DNA, 25 bp, Rattus norvegicus
gggaagcagaccgttcacattctaa

SEQ ID NO: 448430 - DNA, 25 bp, Rattus norvegicus
gggaagcagccacaagccatcaaat

SEQ ID NO: 448431 - DNA, 25 bp, Rattus norvegicus
gggaagcagccagaagccatcaaat

SEQ ID NO: 448432 - DNA, 25 bp, Rattus norvegicus
gggaagcagcctattcaccacaaac

SEQ ID NO: 448433 - DNA, 25 bp, Rattus norvegicus
gggaagcagccttttcaccacaaac

SEQ ID NO: 448434 - DNA, 25 bp, Rattus norvegicus
gggaagcagcgcacttcctaagcag

SEQ ID NO: 448435 - DNA, 25 bp, Rattus norvegicus
gggaagcagcgctcttcctaagcag

SEQ ID NO: 448436 - DNA, 25 bp, Rattus norvegicus
gggaagcagcttaacaaatgtgact

SEQ ID NO: 448437 - DNA, 25 bp, Rattus norvegicus
gggaagcagcttagcatcctagata

SEQ ID NO: 448438 - DNA, 25 bp, Rattus norvegicus
gggaagcagctttacaaatgtgact

SEQ ID NO: 448439 - DNA, 25 bp, Rattus norvegicus
gggaagcagctttgcatcctagata

SEQ ID NO: 448440 - DNA, 25 bp, Rattus norvegicus
gggaagcaggcacctgcacttgttt

SEQ ID NO: 448441 - DNA, 25 bp, Rattus norvegicus
gggaagcaggcagctgcacttgttt

SEQ ID NO: 448442 - DNA, 25 bp, Rattus norvegicus
gggaagcaggccatctctttagaaa

SEQ ID NO: 448443 - DNA, 25 bp, Rattus norvegicus
gggaagcaggccttctctttagaaa

SEQ ID NO: 448444 - DNA, 25 bp, Rattus norvegicus
gggaagcatctccaacccatgggca

SEQ ID NO: 448445 - DNA, 25 bp, Rattus norvegicus
gggaagcatctcgaacccatgggca

SEQ ID NO: 448446 - DNA, 25 bp, Rattus norvegicus
gggaagcatctgagactagcacaga

SEQ ID NO: 448447 - DNA, 25 bp, Rattus norvegicus
gggaagcatctgtgactagcacaga

SEQ ID NO: 448448 - DNA, 25 bp, Rattus norvegicus
gggaagcatgcactttagaaatgaa

SEQ ID NO: 448449 - DNA, 25 bp, Rattus norvegicus
gggaagcatgcagtttagaaatgaa

SEQ ID NO: 448450 - DNA, 25 bp, Rattus norvegicus
gggaagcattccaaaagacgatact

SEQ ID NO: 448451 - DNA, 25 bp, Rattus norvegicus
gggaagcattccaaagcagtatatt

SEQ ID NO: 448452 - DNA, 25 bp, Rattus norvegicus
gggaagcattcctaaagacgatact

SEQ ID NO: 448453 - DNA, 25 bp, Rattus norvegicus
gggaagcattcctaagcagtatatt

SEQ ID NO: 448454 - DNA, 25 bp, Rattus norvegicus
gggaagcatttacaagccacatgac

SEQ ID NO: 448455 - DNA, 25 bp, Rattus norvegicus
gggaagcatttagaagccacatgac

SEQ ID NO: 448456 - DNA, 25 bp, Rattus norvegicus
gggaagcatttcactcaaagcagat

SEQ ID NO: 448457 - DNA, 25 bp, Rattus norvegicus
gggaagcatttctctcaaagcagat

SEQ ID NO: 448458 - DNA, 25 bp, Rattus norvegicus
gggaagccactaaggagaccagcat

SEQ ID NO: 448459 - DNA, 25 bp, Rattus norvegicus
gggaagccactatggagaccagcat

SEQ ID NO: 448460 - DNA, 25 bp, Rattus norvegicus
gggaagccacttcctgcatgctctt

SEQ ID NO: 448461 - DNA, 25 bp, Rattus norvegicus
gggaagccacttgctgcatgctctt

SEQ ID NO: 448462 - DNA, 25 bp, Rattus norvegicus
gggaagccagaccacatgcagagac

SEQ ID NO: 448463 - DNA, 25 bp, Rattus norvegicus
gggaagccagacgacatgcagagac

SEQ ID NO: 448464 - DNA, 25 bp, Rattus norvegicus
gggaagccatgtattaaggcctctt

SEQ ID NO: 448465 - DNA, 25 bp, Rattus norvegicus
gggaagccatgttttaaggcctctt

SEQ ID NO: 448466 - DNA, 25 bp, Rattus norvegicus
gggaagccatttagctccttggctg

SEQ ID NO: 448467 - DNA, 25 bp, Rattus norvegicus
gggaagccattttgctccttggctg

SEQ ID NO: 448468 - DNA, 25 bp, Rattus norvegicus
gggaagcccaatcccgatcagagat

SEQ ID NO: 448469 - DNA, 25 bp, Rattus norvegicus
gggaagcccaatgccgatcagagat

SEQ ID NO: 448470 - DNA, 25 bp, Rattus norvegicus
gggaagcccactatactgcttctgt

SEQ ID NO: 448471 - DNA, 25 bp, Rattus norvegicus
gggaagcccactttactgcttctgt

SEQ ID NO: 448472 - DNA, 25 bp, Rattus norvegicus
gggaagcccatcattaatcttgatt

SEQ ID NO: 448473 - DNA, 25 bp, Rattus norvegicus
gggaagcccatctttaatcttgatt

SEQ ID NO: 448474 - DNA, 25 bp, Rattus norvegicus
gggaagcccattcaaactccgaaag

SEQ ID NO: 448475 - DNA, 25 bp, Rattus norvegicus
gggaagcccattgaaactccgaaag

SEQ ID NO: 448476 - DNA, 25 bp, Rattus norvegicus
gggaagccccaacatgaccttgcaa

SEQ ID NO: 448477 - DNA, 25 bp, Rattus norvegicus
gggaagccccaagatgaccttgcaa

SEQ ID NO: 448478 - DNA, 25 bp, Rattus norvegicus
gggaagccccagagacttaagacta

SEQ ID NO: 448479 - DNA, 25 bp, Rattus norvegicus
gggaagccccagtgacttaagacta

SEQ ID NO: 448480 - DNA, 25 bp, Rattus norvegicus
gggaagcccctaaatcatcaacgaa

SEQ ID NO: 448481 - DNA, 25 bp, Rattus norvegicus
gggaagcccctatatcatcaacgaa

SEQ ID NO: 448482 - DNA, 25 bp, Rattus norvegicus
gggaagccccttagatatatgcaaa

SEQ ID NO: 448483 - DNA, 25 bp, Rattus norvegicus
gggaagcccctttgatatatgcaaa

SEQ ID NO: 448484 - DNA, 25 bp, Rattus norvegicus
gggaagcccgtcaagcccatgcatg

SEQ ID NO: 448485 - DNA, 25 bp, Rattus norvegicus
gggaagcccgtctagcccatgcatg

SEQ ID NO: 448486 - DNA, 25 bp, Rattus norvegicus
gggaagcccttcatactgtgtataa

SEQ ID NO: 448487 - DNA, 25 bp, Rattus norvegicus
gggaagcccttcttactgtgtataa

SEQ ID NO: 448488 - DNA, 25 bp, Rattus norvegicus
gggaagccgtacaatgctcagatca

SEQ ID NO: 448489 - DNA, 25 bp, Rattus norvegicus
gggaagccgtactatgctcagatca

SEQ ID NO: 448490 - DNA, 25 bp, Rattus norvegicus
gggaagcctacaccctaaccagtaa

SEQ ID NO: 448491 - DNA, 25 bp, Rattus norvegicus
gggaagcctacagcctaaccagtaa

SEQ ID NO: 448492 - DNA, 25 bp, Rattus norvegicus
gggaagcctactatctcaggtgaga

SEQ ID NO: 448493 - DNA, 25 bp, Rattus norvegicus
gggaagcctactttctcaggtgaga

SEQ ID NO: 448494 - DNA, 25 bp, Rattus norvegicus
gggaagcctcacagtatggcccatg

SEQ ID NO: 448495 - DNA, 25 bp, Rattus norvegicus
gggaagcctcactgtatggcccatg

SEQ ID NO: 448496 - DNA, 25 bp, Rattus norvegicus
gggaagcctgttagcagtgtcactc

SEQ ID NO: 448497 - DNA, 25 bp, Rattus norvegicus
gggaagcctgttccttaccttttct

SEQ ID NO: 448498 - DNA, 25 bp, Rattus norvegicus
gggaagcctgttgcttaccttttct

SEQ ID NO: 448499 - DNA, 25 bp, Rattus norvegicus
gggaagcctgtttgcagtgtcactc

SEQ ID NO: 448500 - DNA, 25 bp, Rattus norvegicus
gggaagccttgcacggctccagaga

SEQ ID NO: 448501 - DNA, 25 bp, Rattus norvegicus
gggaagccttgctcggctccagaga

SEQ ID NO: 448502 - DNA, 25 bp, Rattus norvegicus
gggaagcctttgaagctgtctatga

SEQ ID NO: 448503 - DNA, 25 bp, Rattus norvegicus
gggaagcctttgtagctgtctatga

SEQ ID NO: 448504 - DNA, 25 bp, Rattus norvegicus
gggaagccttttatatcggtctcat

SEQ ID NO: 448505 - DNA, 25 bp, Rattus norvegicus
gggaagccttttttatcggtctcat

SEQ ID NO: 448506 - DNA, 25 bp, Rattus norvegicus
gggaagcgctctcgtaagcaacaaa

SEQ ID NO: 448507 - DNA, 25 bp, Rattus norvegicus
gggaagcgctctggtaagcaacaaa

SEQ ID NO: 448508 - DNA, 25 bp, Rattus norvegicus
gggaagcgtcttaacgtcactacat

SEQ ID NO: 448509 - DNA, 25 bp, Rattus norvegicus
gggaagcgtctttacgtcactacat

SEQ ID NO: 448510 - DNA, 25 bp, Rattus norvegicus
gggaagcgttgaacttccggtccag

SEQ ID NO: 448511 - DNA, 25 bp, Rattus norvegicus
gggaagcgttgatcttccggtccag

SEQ ID NO: 448512 - DNA, 25 bp, Rattus norvegicus
gggaagctaatgcttttcttcacag

SEQ ID NO: 448513 - DNA, 25 bp, Rattus norvegicus
gggaagctaatggttttcttcacag

SEQ ID NO: 448514 - DNA, 25 bp, Rattus norvegicus
gggaagctacttaggcaccatgaaa

SEQ ID NO: 448515 - DNA, 25 bp, Rattus norvegicus
gggaagctacttctccttaccattc

SEQ ID NO: 448516 - DNA, 25 bp, Rattus norvegicus
gggaagctacttgtccttaccattc

SEQ ID NO: 448517 - DNA, 25 bp, Rattus norvegicus
gggaagctactttggcaccatgaaa

SEQ ID NO: 448518 - DNA, 25 bp, Rattus norvegicus
gggaagctagacaactgccactacc

SEQ ID NO: 448519 - DNA, 25 bp, Rattus norvegicus
gggaagctagactactgccactacc

SEQ ID NO: 448520 - DNA, 25 bp, Rattus norvegicus
gggaagctcaagaggtgtcttttgt

SEQ ID NO: 448521 - DNA, 25 bp, Rattus norvegicus
gggaagctcaagtggtgtcttttgt

SEQ ID NO: 448522 - DNA, 25 bp, Rattus norvegicus
gggaagctcagacatgctacgatct

SEQ ID NO: 448523 - DNA, 25 bp, Rattus norvegicus
gggaagctcagagatgctacgatct

SEQ ID NO: 448524 - DNA, 25 bp, Rattus norvegicus
gggaagctcatgaggatgtatctta

SEQ ID NO: 448525 - DNA, 25 bp, Rattus norvegicus
gggaagctcatgtggatgtatctta

SEQ ID NO: 448526 - DNA, 25 bp, Rattus norvegicus
gggaagctccgtcaagaccaacatg

SEQ ID NO: 448527 - DNA, 25 bp, Rattus norvegicus
gggaagctccgtgaagaccaacatg

SEQ ID NO: 448528 - DNA, 25 bp, Rattus norvegicus
gggaagctccttctgcttctgatgt

SEQ ID NO: 448529 - DNA, 25 bp, Rattus norvegicus
gggaagctccttgtgcttctgatgt

SEQ ID NO: 448530 - DNA, 25 bp, Rattus norvegicus
gggaagctgactcaccactatagaa

SEQ ID NO: 448531 - DNA, 25 bp, Rattus norvegicus
gggaagctgactgaccactatagaa

SEQ ID NO: 448532 - DNA, 25 bp, Rattus norvegicus
gggaagctgccgcttcaatcctcat

SEQ ID NO: 448533 - DNA, 25 bp, Rattus norvegicus
gggaagctgccggttcaatcctcat

SEQ ID NO: 448534 - DNA, 25 bp, Rattus norvegicus
gggaagctggtcatcaacgggaaac

SEQ ID NO: 448535 - DNA, 25 bp, Rattus norvegicus
gggaagctggtcttcaacgggaaac

SEQ ID NO: 448536 - DNA, 25 bp, Rattus norvegicus
gggaagctgtatctaacttgacttt

SEQ ID NO: 448537 - DNA, 25 bp, Rattus norvegicus
gggaagctgtatgtaacttgacttt

SEQ ID NO: 448538 - DNA, 25 bp, Rattus norvegicus
gggaagctgtgcactgctgagccca

SEQ ID NO: 448539 - DNA, 25 bp, Rattus norvegicus
gggaagctgtgctctgctgagccca

SEQ ID NO: 448540 - DNA, 25 bp, Rattus norvegicus
gggaagcttctacgcgtcctgttga

SEQ ID NO: 448541 - DNA, 25 bp, Rattus norvegicus
gggaagcttctaggcgtcctgttga

SEQ ID NO: 448542 - DNA, 25 bp, Rattus norvegicus
gggaagctttccaccaatggaaagt

SEQ ID NO: 448543 - DNA, 25 bp, Rattus norvegicus
gggaagctttcctccaatggaaagt

SEQ ID NO: 448544 - DNA, 25 bp, Rattus norvegicus
gggaagcttttccttgagaatctca

SEQ ID NO: 448545 - DNA, 25 bp, Rattus norvegicus
gggaagcttttcgttgagaatctca

SEQ ID NO: 448546 - DNA, 25 bp, Rattus norvegicus
gggaaggaaacacatccatcatgta

SEQ ID NO: 448547 - DNA, 25 bp, Rattus norvegicus
gggaaggaaacagatccatcatgta

SEQ ID NO: 448548 - DNA, 25 bp, Rattus norvegicus
gggaaggaagccactttctccatgg

SEQ ID NO: 448549 - DNA, 25 bp, Rattus norvegicus
gggaaggaagcctctttctccatgg

SEQ ID NO: 448550 - DNA, 25 bp, Rattus norvegicus
gggaaggaatccagctgctctccgc

SEQ ID NO: 448551 - DNA, 25 bp, Rattus norvegicus
gggaaggaatcctgctgctctccgc

SEQ ID NO: 448552 - DNA, 25 bp, Rattus norvegicus
gggaaggaattcatctggagctcag

SEQ ID NO: 448553 - DNA, 25 bp, Rattus norvegicus
gggaaggaattcttctggagctcag

SEQ ID NO: 448554 - DNA, 25 bp, Rattus norvegicus
gggaaggacaggaaactcaacctga

SEQ ID NO: 448555 - DNA, 25 bp, Rattus norvegicus
gggaaggacaggtaactcaacctga

SEQ ID NO: 448556 - DNA, 25 bp, Rattus norvegicus
gggaaggacatgactgcccaggcca

SEQ ID NO: 448557 - DNA, 25 bp, Rattus norvegicus
gggaaggacatgtctgcccaggcca

SEQ ID NO: 448558 - DNA, 25 bp, Rattus norvegicus
gggaaggacctcagctataccgggt

SEQ ID NO: 448559 - DNA, 25 bp, Rattus norvegicus
gggaaggacctctgctataccgggt

SEQ ID NO: 448560 - DNA, 25 bp, Rattus norvegicus
gggaaggacgccatatttgccagta

SEQ ID NO: 448561 - DNA, 25 bp, Rattus norvegicus
gggaaggacgccttatttgccagta

SEQ ID NO: 448562 - DNA, 25 bp, Rattus norvegicus
gggaaggacgctctacaacgccatt

SEQ ID NO: 448563 - DNA, 25 bp, Rattus norvegicus
gggaaggacgctgtacaacgccatt

SEQ ID NO: 448564 - DNA, 25 bp, Rattus norvegicus
gggaaggactttaacactcatctga

SEQ ID NO: 448565 - DNA, 25 bp, Rattus norvegicus
gggaaggacttttacactcatctga

SEQ ID NO: 448566 - DNA, 25 bp, Rattus norvegicus
gggaaggagatgacccctattccac

SEQ ID NO: 448567 - DNA, 25 bp, Rattus norvegicus
gggaaggagatgtcccctattccac

SEQ ID NO: 448568 - DNA, 25 bp, Rattus norvegicus
gggaaggaggctcggcgcactcacc

SEQ ID NO: 448569 - DNA, 25 bp, Rattus norvegicus
gggaaggaggctgggcgcactcacc

SEQ ID NO: 448570 - DNA, 25 bp, Rattus norvegicus
gggaaggattccactgtgtcttctc

SEQ ID NO: 448571 - DNA, 25 bp, Rattus norvegicus
gggaaggattcctctgtgtcttctc

SEQ ID NO: 448572 - DNA, 25 bp, Rattus norvegicus
gggaaggcaagaccgccaagcacct

SEQ ID NO: 448573 - DNA, 25 bp, Rattus norvegicus
gggaaggcaagagcgccaagcacct

SEQ ID NO: 448574 - DNA, 25 bp, Rattus norvegicus
gggaaggcacccaagagccatgtgt

SEQ ID NO: 448575 - DNA, 25 bp, Rattus norvegicus
gggaaggcaccctagagccatgtgt

SEQ ID NO: 448576 - DNA, 25 bp, Rattus norvegicus
gggaaggcatggaccataccctgca

SEQ ID NO: 448577 - DNA, 25 bp, Rattus norvegicus
gggaaggcatggtccataccctgca

SEQ ID NO: 448578 - DNA, 25 bp, Rattus norvegicus
gggaaggcattacctcttggttgaa

SEQ ID NO: 448579 - DNA, 25 bp, Rattus norvegicus
gggaaggcattagctcttggttgaa

SEQ ID NO: 448580 - DNA, 25 bp, Rattus norvegicus
gggaaggcattcacacagagctcac

SEQ ID NO: 448581 - DNA, 25 bp, Rattus norvegicus
gggaaggcattctcacagagctcac

SEQ ID NO: 448582 - DNA, 25 bp, Rattus norvegicus
gggaaggccagcaggactcttgcac

SEQ ID NO: 448583 - DNA, 25 bp, Rattus norvegicus
gggaaggccagctggactcttgcac

SEQ ID NO: 448584 - DNA, 25 bp, Rattus norvegicus
gggaaggcccttagagtatcattgt

SEQ ID NO: 448585 - DNA, 25 bp, Rattus norvegicus
gggaaggccctttgagtatcattgt

SEQ ID NO: 448586 - DNA, 25 bp, Rattus norvegicus
gggaaggcctgtatcactgaagact

SEQ ID NO: 448587 - DNA, 25 bp, Rattus norvegicus
gggaaggcctgtttcactgaagact

SEQ ID NO: 448588 - DNA, 25 bp, Rattus norvegicus
gggaaggccttacctgctactcaaa

SEQ ID NO: 448589 - DNA, 25 bp, Rattus norvegicus
gggaaggccttagctgctactcaaa

SEQ ID NO: 448590 - DNA, 25 bp, Rattus norvegicus
gggaaggcgctcacttctttacccg

SEQ ID NO: 448591 - DNA, 25 bp, Rattus norvegicus
gggaaggcgctctcttctttacccg

SEQ ID NO: 448592 - DNA, 25 bp, Rattus norvegicus
gggaaggctatgcacgtctgtaata

SEQ ID NO: 448593 - DNA, 25 bp, Rattus norvegicus
gggaaggctatggacgtctgtaata

SEQ ID NO: 448594 - DNA, 25 bp, Rattus norvegicus
gggaaggctcccaggttatactcct

SEQ ID NO: 448595 - DNA, 25 bp, Rattus norvegicus
gggaaggctccctggttatactcct

SEQ ID NO: 448596 - DNA, 25 bp, Rattus norvegicus
gggaaggcttgacggctttactcct

SEQ ID NO: 448597 - DNA, 25 bp, Rattus norvegicus
gggaaggcttgagggctttactcct

SEQ ID NO: 448598 - DNA, 25 bp, Rattus norvegicus
gggaaggcttttactcagttctcca

SEQ ID NO: 448599 - DNA, 25 bp, Rattus norvegicus
gggaaggctttttctcagttctcca

SEQ ID NO: 448600 - DNA, 25 bp, Rattus norvegicus
gggaagggcgatagccccattcatc

SEQ ID NO: 448601 - DNA, 25 bp, Rattus norvegicus
gggaagggcgattgccccattcatc

SEQ ID NO: 448602 - DNA, 25 bp, Rattus norvegicus
gggaagggcttccatcattctgaca

SEQ ID NO: 448603 - DNA, 25 bp, Rattus norvegicus
gggaagggcttcgatcattctgaca

SEQ ID NO: 448604 - DNA, 25 bp, Rattus norvegicus
gggaagggtttcatcgacggacatt

SEQ ID NO: 448605 - DNA, 25 bp, Rattus norvegicus
gggaagggtttcttcgacggacatt

SEQ ID NO: 448606 - DNA, 25 bp, Rattus norvegicus
gggaagggtttgactccactcacag

SEQ ID NO: 448607 - DNA, 25 bp, Rattus norvegicus
gggaagggtttgtctccactcacag

SEQ ID NO: 448608 - DNA, 25 bp, Rattus norvegicus
gggaaggtatccactggttgccatg

SEQ ID NO: 448609 - DNA, 25 bp, Rattus norvegicus
gggaaggtatcctctggttgccatg

SEQ ID NO: 448610 - DNA, 25 bp, Rattus norvegicus
gggaaggtccacacactgtggatta

SEQ ID NO: 448611 - DNA, 25 bp, Rattus norvegicus
gggaaggtccactcactgtggatta

SEQ ID NO: 448612 - DNA, 25 bp, Rattus norvegicus
gggaaggtcccgacatgttaagatg

SEQ ID NO: 448613 - DNA, 25 bp, Rattus norvegicus
gggaaggtcccgtcatgttaagatg

SEQ ID NO: 448614 - DNA, 25 bp, Rattus norvegicus
gggaaggtctagattcctaagtact

SEQ ID NO: 448615 - DNA, 25 bp, Rattus norvegicus
gggaaggtctagtttcctaagtact

SEQ ID NO: 448616 - DNA, 25 bp, Rattus norvegicus
gggaaggttcaaagctcggccagaa

SEQ ID NO: 448617 - DNA, 25 bp, Rattus norvegicus
gggaaggttcaatgctcggccagaa

SEQ ID NO: 448618 - DNA, 25 bp, Rattus norvegicus
gggaaggttcgactgttcctgcctc

SEQ ID NO: 448619 - DNA, 25 bp, Rattus norvegicus
gggaaggttcgagtgttcctgcctc

SEQ ID NO: 448620 - DNA, 25 bp, Rattus norvegicus
gggaagtaactaccatctctccgac

SEQ ID NO: 448621 - DNA, 25 bp, Rattus norvegicus
gggaagtaactagcatctctccgac

SEQ ID NO: 448622 - DNA, 25 bp, Rattus norvegicus
gggaagtacctgctggattatttaa

SEQ ID NO: 448623 - DNA, 25 bp, Rattus norvegicus
gggaagtacctggtggattatttaa

SEQ ID NO: 448624 - DNA, 25 bp, Rattus norvegicus
gggaagtactgtatcctgtgctgtt

SEQ ID NO: 448625 - DNA, 25 bp, Rattus norvegicus
gggaagtactgtttcctgtgctgtt

SEQ ID NO: 448626 - DNA, 25 bp, Rattus norvegicus
gggaagtatcccactctataaacta

SEQ ID NO: 448627 - DNA, 25 bp, Rattus norvegicus
gggaagtatccctctctataaacta

SEQ ID NO: 448628 - DNA, 25 bp, Rattus norvegicus
gggaagtcaccaaaaaactgatggg

SEQ ID NO: 448629 - DNA, 25 bp, Rattus norvegicus
gggaagtcaccataaaactgatggg

SEQ ID NO: 448630 - DNA, 25 bp, Rattus norvegicus
gggaagtcactgaccttaggtgtgt

SEQ ID NO: 448631 - DNA, 25 bp, Rattus norvegicus
gggaagtcactgtccttaggtgtgt

SEQ ID NO: 448632 - DNA, 25 bp, Rattus norvegicus
gggaagtcacttatgattcaacaaa

SEQ ID NO: 448633 - DNA, 25 bp, Rattus norvegicus
gggaagtcacttttgattcaacaaa

SEQ ID NO: 448634 - DNA, 25 bp, Rattus norvegicus
gggaagtcagccatgcctctgaagg

SEQ ID NO: 448635 - DNA, 25 bp, Rattus norvegicus
gggaagtcagccttgcctctgaagg

SEQ ID NO: 448636 - DNA, 25 bp, Rattus norvegicus
gggaagtcaggaacaccagctggtt

SEQ ID NO: 448637 - DNA, 25 bp, Rattus norvegicus
gggaagtcaggatcaccagctggtt

SEQ ID NO: 448638 - DNA, 25 bp, Rattus norvegicus
gggaagtcatcaccatctattcttg

SEQ ID NO: 448639 - DNA, 25 bp, Rattus norvegicus
gggaagtcatcagcatctattcttg

SEQ ID NO: 448640 - DNA, 25 bp, Rattus norvegicus
gggaagtccaagacagtcctgtaca

SEQ ID NO: 448641 - DNA, 25 bp, Rattus norvegicus
gggaagtccaagtcagtcctgtaca

SEQ ID NO: 448642 - DNA, 25 bp, Rattus norvegicus
gggaagtcccaacccatgtgttcaa

SEQ ID NO: 448643 - DNA, 25 bp, Rattus norvegicus
gggaagtcccaagccatgtgttcaa

SEQ ID NO: 448644 - DNA, 25 bp, Rattus norvegicus
gggaagtctcccctgatcttatgga

SEQ ID NO: 448645 - DNA, 25 bp, Rattus norvegicus
gggaagtctcccgtgatcttatgga

SEQ ID NO: 448646 - DNA, 25 bp, Rattus norvegicus
gggaagtctgccactgatgctttca

SEQ ID NO: 448647 - DNA, 25 bp, Rattus norvegicus
gggaagtctgcctctgatgctttca

SEQ ID NO: 448648 - DNA, 25 bp, Rattus norvegicus
gggaagtcttcaagggcaataatgt

SEQ ID NO: 448649 - DNA, 25 bp, Rattus norvegicus
gggaagtcttcatgggcaataatgt

SEQ ID NO: 448650 - DNA, 25 bp, Rattus norvegicus
gggaagtcttgtacacctacaaatg

SEQ ID NO: 448651 - DNA, 25 bp, Rattus norvegicus
gggaagtcttgttcacctacaaatg

SEQ ID NO: 448652 - DNA, 25 bp, Rattus norvegicus
gggaagtctttgaactcttttatca

SEQ ID NO: 448653 - DNA, 25 bp, Rattus norvegicus
gggaagtctttgtactcttttatca

SEQ ID NO: 448654 - DNA, 25 bp, Rattus norvegicus
gggaagtgaccaccaatcagcgcat

SEQ ID NO: 448655 - DNA, 25 bp, Rattus norvegicus
gggaagtgaccagcaatcagcgcat

SEQ ID NO: 448656 - DNA, 25 bp, Rattus norvegicus
gggaagtgcatcatgtcccgaaacc

SEQ ID NO: 448657 - DNA, 25 bp, Rattus norvegicus
gggaagtgcatccaattcatctatg

SEQ ID NO: 448658 - DNA, 25 bp, Rattus norvegicus
gggaagtgcatcgaattcatctatg

SEQ ID NO: 448659 - DNA, 25 bp, Rattus norvegicus
gggaagtgcatcttgtcccgaaacc

SEQ ID NO: 448660 - DNA, 25 bp, Rattus norvegicus
gggaagtgccccacctcttagccaa

SEQ ID NO: 448661 - DNA, 25 bp, Rattus norvegicus
gggaagtgcccctcctcttagccaa

SEQ ID NO: 448662 - DNA, 25 bp, Rattus norvegicus
gggaagtgcctgagcgacccagact

SEQ ID NO: 448663 - DNA, 25 bp, Rattus norvegicus
gggaagtgcctgtgcgacccagact

SEQ ID NO: 448664 - DNA, 25 bp, Rattus norvegicus
gggaagtggattacagtccgctctc

SEQ ID NO: 448665 - DNA, 25 bp, Rattus norvegicus
gggaagtggatttcagtccgctctc

SEQ ID NO: 448666 - DNA, 25 bp, Rattus norvegicus
gggaagtgggacagtacaaagctca

SEQ ID NO: 448667 - DNA, 25 bp, Rattus norvegicus
gggaagtgggactgtacaaagctca

SEQ ID NO: 448668 - DNA, 25 bp, Rattus norvegicus
gggaagttcagtacttcagttgtca

SEQ ID NO: 448669 - DNA, 25 bp, Rattus norvegicus
gggaagttcagtctactctcattta

SEQ ID NO: 448670 - DNA, 25 bp, Rattus norvegicus
gggaagttcagtgtactctcattta

SEQ ID NO: 448671 - DNA, 25 bp, Rattus norvegicus
gggaagttcagttcttcagttgtca

SEQ ID NO: 448672 - DNA, 25 bp, Rattus norvegicus
gggaagttcatcacgacaaccagtc

SEQ ID NO: 448673 - DNA, 25 bp, Rattus norvegicus
gggaagttcatctcgacaaccagtc

SEQ ID NO: 448674 - DNA, 25 bp, Rattus norvegicus
gggaagttcgtccattctacaaaca

SEQ ID NO: 448675 - DNA, 25 bp, Rattus norvegicus
gggaagttcgtcgattctacaaaca

SEQ ID NO: 448676 - DNA, 25 bp, Rattus norvegicus
gggaagttctccagtgaccgaacaa

SEQ ID NO: 448677 - DNA, 25 bp, Rattus norvegicus
gggaagttctcctgtgaccgaacaa

SEQ ID NO: 448678 - DNA, 25 bp, Rattus norvegicus
gggaagttgaaaatggtatcatacc

SEQ ID NO: 448679 - DNA, 25 bp, Rattus norvegicus
gggaagttgaaattggtatcatacc

SEQ ID NO: 448680 - DNA, 25 bp, Rattus norvegicus
gggaagttgctcagcagtatctaaa

SEQ ID NO: 448681 - DNA, 25 bp, Rattus norvegicus
gggaagttgctccttttggccgact

SEQ ID NO: 448682 - DNA, 25 bp, Rattus norvegicus
gggaagttgctcgttttggccgact

SEQ ID NO: 448683 - DNA, 25 bp, Rattus norvegicus
gggaagttgctctgcagtatctaaa

SEQ ID NO: 448684 - DNA, 25 bp, Rattus norvegicus
gggaagttgtccatcgactccctga

SEQ ID NO: 448685 - DNA, 25 bp, Rattus norvegicus
gggaagttgtccttcgactccctga

SEQ ID NO: 448686 - DNA, 25 bp, Rattus norvegicus
gggaagttgtgcctccctcaatcat

SEQ ID NO: 448687 - DNA, 25 bp, Rattus norvegicus
gggaagttgtgcgtccctcaatcat

SEQ ID NO: 448688 - DNA, 25 bp, Rattus norvegicus
gggaagtttagcacattcacatttg

SEQ ID NO: 448689 - DNA, 25 bp, Rattus norvegicus
gggaagtttagctcattcacatttg

SEQ ID NO: 448690 - DNA, 25 bp, Rattus norvegicus
gggaagtttcacaggcacaaccatt

SEQ ID NO: 448691 - DNA, 25 bp, Rattus norvegicus
gggaagtttcactggcacaaccatt

SEQ ID NO: 448692 - DNA, 25 bp, Rattus norvegicus
gggaagtttctcatatagttgcaaa

SEQ ID NO: 448693 - DNA, 25 bp, Rattus norvegicus
gggaagtttctcttatagttgcaaa

SEQ ID NO: 448694 - DNA, 25 bp, Rattus norvegicus
gggaataaccaaagccagggcagca

SEQ ID NO: 448695 - DNA, 25 bp, Rattus norvegicus
gggaataaccaatgccagggcagca

SEQ ID NO: 448696 - DNA, 25 bp, Rattus norvegicus
gggaataacccaatgtttacagtat

SEQ ID NO: 448697 - DNA, 25 bp, Rattus norvegicus
gggaataacccattgtttacagtat

SEQ ID NO: 448698 - DNA, 25 bp, Rattus norvegicus
gggaataactcaacttctttaacga

SEQ ID NO: 448699 - DNA, 25 bp, Rattus norvegicus
gggaataactcatcttctttaacga

SEQ ID NO: 448700 - DNA, 25 bp, Rattus norvegicus
gggaataactgccatgccaaagcca

SEQ ID NO: 448701 - DNA, 25 bp, Rattus norvegicus
gggaataactgcgatgccaaagcca

SEQ ID NO: 448702 - DNA, 25 bp, Rattus norvegicus
gggaatacacagatcatcttctcag

SEQ ID NO: 448703 - DNA, 25 bp, Rattus norvegicus
gggaatacacagttcatcttctcag

SEQ ID NO: 448704 - DNA, 25 bp, Rattus norvegicus
gggaataccacgattctaaagcatg

SEQ ID NO: 448705 - DNA, 25 bp, Rattus norvegicus
gggaataccacgtttctaaagcatg

SEQ ID NO: 448706 - DNA, 25 bp, Rattus norvegicus
gggaataccgggagctgtaggcttt

SEQ ID NO: 448707 - DNA, 25 bp, Rattus norvegicus
gggaataccgggtgctgtaggcttt

SEQ ID NO: 448708 - DNA, 25 bp, Rattus norvegicus
gggaatacctgaacgtacacatgaa

SEQ ID NO: 448709 - DNA, 25 bp, Rattus norvegicus
gggaatacctgatcgtacacatgaa

SEQ ID NO: 448710 - DNA, 25 bp, Rattus norvegicus
gggaatacctgtctggctaccttta

SEQ ID NO: 448711 - DNA, 25 bp, Rattus norvegicus
gggaatacctgtgtggctaccttta

SEQ ID NO: 448712 - DNA, 25 bp, Rattus norvegicus
gggaatacggtgacccacacagtcc

SEQ ID NO: 448713 - DNA, 25 bp, Rattus norvegicus
gggaatacggtgtcccacacagtcc

SEQ ID NO: 448714 - DNA, 25 bp, Rattus norvegicus
gggaatactcagatcgcatgaaatt

SEQ ID NO: 448715 - DNA, 25 bp, Rattus norvegicus
gggaatactcagttcgcatgaaatt

SEQ ID NO: 448716 - DNA, 25 bp, Rattus norvegicus
gggaatactcctcagatcacatgac

SEQ ID NO: 448717 - DNA, 25 bp, Rattus norvegicus
gggaatactcctgagatcacatgac

SEQ ID NO: 448718 - DNA, 25 bp, Rattus norvegicus
gggaatacttccacagaatcactgt

SEQ ID NO: 448719 - DNA, 25 bp, Rattus norvegicus
gggaatacttcctcagaatcactgt

SEQ ID NO: 448720 - DNA, 25 bp, Rattus norvegicus
gggaatacttgcactgtgagcacaa

SEQ ID NO: 448721 - DNA, 25 bp, Rattus norvegicus
gggaatacttgctctgtgagcacaa

SEQ ID NO: 448722 - DNA, 25 bp, Rattus norvegicus
gggaatagcatcaacctaccagtac

SEQ ID NO: 448723 - DNA, 25 bp, Rattus norvegicus
gggaatagcatctacctaccagtac

SEQ ID NO: 448724 - DNA, 25 bp, Rattus norvegicus
gggaatagccgcactgctcattggg

SEQ ID NO: 448725 - DNA, 25 bp, Rattus norvegicus
gggaatagccgctctgctcattggg

SEQ ID NO: 448726 - DNA, 25 bp, Rattus norvegicus
gggaatagcctaagggcccagtgct

SEQ ID NO: 448727 - DNA, 25 bp, Rattus norvegicus
gggaatagcctatgggcccagtgct

SEQ ID NO: 448728 - DNA, 25 bp, Rattus norvegicus
gggaatagggacagctgccacctcc

SEQ ID NO: 448729 - DNA, 25 bp, Rattus norvegicus
gggaatagggactgctgccacctcc

SEQ ID NO: 448730 - DNA, 25 bp, Rattus norvegicus
gggaatagggctacctcagaaggct

SEQ ID NO: 448731 - DNA, 25 bp, Rattus norvegicus
gggaatagggcttcctcagaaggct

SEQ ID NO: 448732 - DNA, 25 bp, Rattus norvegicus
gggaatagtctgcatcctgcttgct

SEQ ID NO: 448733 - DNA, 25 bp, Rattus norvegicus
gggaatagtctggatcctgcttgct

SEQ ID NO: 448734 - DNA, 25 bp, Rattus norvegicus
gggaatagttcccataggttgatat

SEQ ID NO: 448735 - DNA, 25 bp, Rattus norvegicus
gggaatagttccgataggttgatat

SEQ ID NO: 448736 - DNA, 25 bp, Rattus norvegicus
gggaatataacaccagggcctacag

SEQ ID NO: 448737 - DNA, 25 bp, Rattus norvegicus
gggaatataacagcagggcctacag

SEQ ID NO: 448738 - DNA, 25 bp, Rattus norvegicus
gggaatatactgacaatcgtgcggc

SEQ ID NO: 448739 - DNA, 25 bp, Rattus norvegicus
gggaatatactgtcaatcgtgcggc

SEQ ID NO: 448740 - DNA, 25 bp, Rattus norvegicus
gggaatatcactactggagcaagtg

SEQ ID NO: 448741 - DNA, 25 bp, Rattus norvegicus
gggaatatcacttctggagcaagtg

SEQ ID NO: 448742 - DNA, 25 bp, Rattus norvegicus
gggaatatcatgcatccttgctttt

SEQ ID NO: 448743 - DNA, 25 bp, Rattus norvegicus
gggaatatcatggatccttgctttt

SEQ ID NO: 448744 - DNA, 25 bp, Rattus norvegicus
gggaatatccttcattcaagctgat

SEQ ID NO: 448745 - DNA, 25 bp, Rattus norvegicus
gggaatatccttgattcaagctgat

SEQ ID NO: 448746 - DNA, 25 bp, Rattus norvegicus
gggaatatctacacctttatttgta

SEQ ID NO: 448747 - DNA, 25 bp, Rattus norvegicus
gggaatatctactcctttatttgta

SEQ ID NO: 448748 - DNA, 25 bp, Rattus norvegicus
gggaatatctcacggacatctctga

SEQ ID NO: 448749 - DNA, 25 bp, Rattus norvegicus
gggaatatctcagggacatctctga

SEQ ID NO: 448750 - DNA, 25 bp, Rattus norvegicus
gggaatattgcaatgaaagttttaa

SEQ ID NO: 448751 - DNA, 25 bp, Rattus norvegicus
gggaatattgcattgaaagttttaa

SEQ ID NO: 448752 - DNA, 25 bp, Rattus norvegicus
gggaatatttcgcttctggaggctc

SEQ ID NO: 448753 - DNA, 25 bp, Rattus norvegicus
gggaatatttcggttctggaggctc

SEQ ID NO: 448754 - DNA, 25 bp, Rattus norvegicus
gggaatcaaactccagtactcaagt

SEQ ID NO: 448755 - DNA, 25 bp, Rattus norvegicus
gggaatcaaactgcagtactcaagt

SEQ ID NO: 448756 - DNA, 25 bp, Rattus norvegicus
gggaatcaaatccaggtcctctata

SEQ ID NO: 448757 - DNA, 25 bp, Rattus norvegicus
gggaatcaaatcgaggtcctctata

SEQ ID NO: 448758 - DNA, 25 bp, Rattus norvegicus
gggaatcacatcctaatgtcaggct

SEQ ID NO: 448759 - DNA, 25 bp, Rattus norvegicus
gggaatcacatcgtaatgtcaggct

SEQ ID NO: 448760 - DNA, 25 bp, Rattus norvegicus
gggaatcactgcatgtgtcataaat

SEQ ID NO: 448761 - DNA, 25 bp, Rattus norvegicus
gggaatcactgcttgtgtcataaat

SEQ ID NO: 448762 - DNA, 25 bp, Rattus norvegicus
gggaatcagactccaactggttaaa

SEQ ID NO: 448763 - DNA, 25 bp, Rattus norvegicus
gggaatcagactgcaactggttaaa

SEQ ID NO: 448764 - DNA, 25 bp, Rattus norvegicus
gggaatcagctaccaccaatcttaa

SEQ ID NO: 448765 - DNA, 25 bp, Rattus norvegicus
gggaatcagctagcaccaatcttaa

SEQ ID NO: 448766 - DNA, 25 bp, Rattus norvegicus
gggaatcaggctcagtgtacatctt

SEQ ID NO: 448767 - DNA, 25 bp, Rattus norvegicus
gggaatcaggctgagtgtacatctt

SEQ ID NO: 448768 - DNA, 25 bp, Rattus norvegicus
gggaatcagggaccagctttatgaa

SEQ ID NO: 448769 - DNA, 25 bp, Rattus norvegicus
gggaatcagggagcagctttatgaa

SEQ ID NO: 448770 - DNA, 25 bp, Rattus norvegicus
gggaatcatagtcttgtacatacat

SEQ ID NO: 448771 - DNA, 25 bp, Rattus norvegicus
gggaatcatagtgttgtacatacat

SEQ ID NO: 448772 - DNA, 25 bp, Rattus norvegicus
gggaatcatcagactcagggctaaa

SEQ ID NO: 448773 - DNA, 25 bp, Rattus norvegicus
gggaatcatcagtctcagggctaaa

SEQ ID NO: 448774 - DNA, 25 bp, Rattus norvegicus
gggaatcatctgcaaaccaggctga

SEQ ID NO: 448775 - DNA, 25 bp, Rattus norvegicus
gggaatcatctggaaaccaggctga

SEQ ID NO: 448776 - DNA, 25 bp, Rattus norvegicus
gggaatccacctaccgaacatgtat

SEQ ID NO: 448777 - DNA, 25 bp, Rattus norvegicus
gggaatccacctctgagaccttaga

SEQ ID NO: 448778 - DNA, 25 bp, Rattus norvegicus
gggaatccacctgtgagaccttaga

SEQ ID NO: 448779 - DNA, 25 bp, Rattus norvegicus
gggaatccaccttccgaacatgtat

SEQ ID NO: 448780 - DNA, 25 bp, Rattus norvegicus
gggaatccacggactgcagcggcca

SEQ ID NO: 448781 - DNA, 25 bp, Rattus norvegicus
gggaatccacggtctgcagcggcca

SEQ ID NO: 448782 - DNA, 25 bp, Rattus norvegicus
gggaatccactgaaccttcgaactc

SEQ ID NO: 448783 - DNA, 25 bp, Rattus norvegicus
gggaatccactgtaccttcgaactc

SEQ ID NO: 448784 - DNA, 25 bp, Rattus norvegicus
gggaatccacttattctggaaccta

SEQ ID NO: 448785 - DNA, 25 bp, Rattus norvegicus
gggaatccactttttctggaaccta

SEQ ID NO: 448786 - DNA, 25 bp, Rattus norvegicus
gggaatccaggtaatttctgtctat

SEQ ID NO: 448787 - DNA, 25 bp, Rattus norvegicus
gggaatccaggttatttctgtctat

SEQ ID NO: 448788 - DNA, 25 bp, Rattus norvegicus
gggaatccatttactcaactgtaca

SEQ ID NO: 448789 - DNA, 25 bp, Rattus norvegicus
gggaatccatttctagtattttaag

SEQ ID NO: 448790 - DNA, 25 bp, Rattus norvegicus
gggaatccatttgtagtattttaag

SEQ ID NO: 448791 - DNA, 25 bp, Rattus norvegicus
gggaatccattttctcaactgtaca

SEQ ID NO: 448792 - DNA, 25 bp, Rattus norvegicus
gggaatcccaatcgacagggcctgc

SEQ ID NO: 448793 - DNA, 25 bp, Rattus norvegicus
gggaatcccaatggacagggcctgc

SEQ ID NO: 448794 - DNA, 25 bp, Rattus norvegicus
gggaatccccaactccatttagaat

SEQ ID NO: 448795 - DNA, 25 bp, Rattus norvegicus
gggaatccccaagtccatttagaat

SEQ ID NO: 448796 - DNA, 25 bp, Rattus norvegicus
gggaatccctgaagccttttgtgac

SEQ ID NO: 448797 - DNA, 25 bp, Rattus norvegicus
gggaatccctgatgccttttgtgac

SEQ ID NO: 448798 - DNA, 25 bp, Rattus norvegicus
gggaatccctgtcatgaccacttga

SEQ ID NO: 448799 - DNA, 25 bp, Rattus norvegicus
gggaatccctgtctggagtttcttt

SEQ ID NO: 448800 - DNA, 25 bp, Rattus norvegicus
gggaatccctgtgatgaccacttga

SEQ ID NO: 448801 - DNA, 25 bp, Rattus norvegicus
gggaatccctgtgtggagtttcttt

SEQ ID NO: 448802 - DNA, 25 bp, Rattus norvegicus
gggaatccgcctagtgacttcatta

SEQ ID NO: 448803 - DNA, 25 bp, Rattus norvegicus
gggaatccgccttgtgacttcatta

SEQ ID NO: 448804 - DNA, 25 bp, Rattus norvegicus
gggaatccgtgtcctatctgttcag

SEQ ID NO: 448805 - DNA, 25 bp, Rattus norvegicus
gggaatccgtgtgctatctgttcag

SEQ ID NO: 448806 - DNA, 25 bp, Rattus norvegicus
gggaatcctaggacaagccagcaca

SEQ ID NO: 448807 - DNA, 25 bp, Rattus norvegicus
gggaatcctaggtcaagccagcaca

SEQ ID NO: 448808 - DNA, 25 bp, Rattus norvegicus
gggaatcctgaacgtcaacttgcca

SEQ ID NO: 448809 - DNA, 25 bp, Rattus norvegicus
gggaatcctgaaggtcaacttgcca

SEQ ID NO: 448810 - DNA, 25 bp, Rattus norvegicus
gggaatcctggcaacgtgcctgaat

SEQ ID NO: 448811 - DNA, 25 bp, Rattus norvegicus
gggaatcctggctacgtgcctgaat

SEQ ID NO: 448812 - DNA, 25 bp, Rattus norvegicus
gggaatccttaccatcacactaaac

SEQ ID NO: 448813 - DNA, 25 bp, Rattus norvegicus
gggaatccttacgatcacactaaac

SEQ ID NO: 448814 - DNA, 25 bp, Rattus norvegicus
gggaatcctttaatcacactgtctg

SEQ ID NO: 448815 - DNA, 25 bp, Rattus norvegicus
gggaatcctttattcacactgtctg

SEQ ID NO: 448816 - DNA, 25 bp, Rattus norvegicus
gggaatcctttcaaatcatcatgtc

SEQ ID NO: 448817 - DNA, 25 bp, Rattus norvegicus
gggaatcctttctaatcatcatgtc

SEQ ID NO: 448818 - DNA, 25 bp, Rattus norvegicus
gggaatcgagatcaacgcctttgat

SEQ ID NO: 448819 - DNA, 25 bp, Rattus norvegicus
gggaatcgagatgaacgcctttgat

SEQ ID NO: 448820 - DNA, 25 bp, Rattus norvegicus
gggaatcgagtgctaaggcctactt

SEQ ID NO: 448821 - DNA, 25 bp, Rattus norvegicus
gggaatcgagtggtaaggcctactt

SEQ ID NO: 448822 - DNA, 25 bp, Rattus norvegicus
gggaatcgatgaagtttcacttttg

SEQ ID NO: 448823 - DNA, 25 bp, Rattus norvegicus
gggaatcgatgatgtttcacttttg

SEQ ID NO: 448824 - DNA, 25 bp, Rattus norvegicus
gggaatcgcatgcttgtcttcagac

SEQ ID NO: 448825 - DNA, 25 bp, Rattus norvegicus
gggaatcgcatggttgtcttcagac

SEQ ID NO: 448826 - DNA, 25 bp, Rattus norvegicus
gggaatcgcgacatgtgcaccaagt

SEQ ID NO: 448827 - DNA, 25 bp, Rattus norvegicus
gggaatcgcgacttgtgcaccaagt

SEQ ID NO: 448828 - DNA, 25 bp, Rattus norvegicus
gggaatcgctttctgacctgaagga

SEQ ID NO: 448829 - DNA, 25 bp, Rattus norvegicus
gggaatcgctttgtgacctgaagga

SEQ ID NO: 448830 - DNA, 25 bp, Rattus norvegicus
gggaatctaatgagacctgagggac

SEQ ID NO: 448831 - DNA, 25 bp, Rattus norvegicus
gggaatctaatgtgacctgagggac

SEQ ID NO: 448832 - DNA, 25 bp, Rattus norvegicus
gggaatctcaacaacacttctgtga

SEQ ID NO: 448833 - DNA, 25 bp, Rattus norvegicus
gggaatctcaactacacttctgtga

SEQ ID NO: 448834 - DNA, 25 bp, Rattus norvegicus
gggaatctcagaacacttgccaatt

SEQ ID NO: 448835 - DNA, 25 bp, Rattus norvegicus
gggaatctcagatcacttgccaatt

SEQ ID NO: 448836 - DNA, 25 bp, Rattus norvegicus
gggaatctcagtattggcattgtca

SEQ ID NO: 448837 - DNA, 25 bp, Rattus norvegicus
gggaatctcagtcctgcctcaaggg

SEQ ID NO: 448838 - DNA, 25 bp, Rattus norvegicus
gggaatctcagtgctgcctcaaggg

SEQ ID NO: 448839 - DNA, 25 bp, Rattus norvegicus
gggaatctcagttttggcattgtca

SEQ ID NO: 448840 - DNA, 25 bp, Rattus norvegicus
gggaatctcatgcaatcagcagcga

SEQ ID NO: 448841 - DNA, 25 bp, Rattus norvegicus
gggaatctcatggaatcagcagcga

SEQ ID NO: 448842 - DNA, 25 bp, Rattus norvegicus
gggaatctcctcattgacacagaag

SEQ ID NO: 448843 - DNA, 25 bp, Rattus norvegicus
gggaatctcctctttgacacagaag

SEQ ID NO: 448844 - DNA, 25 bp, Rattus norvegicus
gggaatctcgtgagcctaacacttg

SEQ ID NO: 448845 - DNA, 25 bp, Rattus norvegicus
gggaatctcgtgtgcctaacacttg

SEQ ID NO: 448846 - DNA, 25 bp, Rattus norvegicus
gggaatctctgacccatccagaaag

SEQ ID NO: 448847 - DNA, 25 bp, Rattus norvegicus
gggaatctctgagccatccagaaag

SEQ ID NO: 448848 - DNA, 25 bp, Rattus norvegicus
gggaatctctgtcctggataccctt

SEQ ID NO: 448849 - DNA, 25 bp, Rattus norvegicus
gggaatctctgtgctggataccctt

SEQ ID NO: 448850 - DNA, 25 bp, Rattus norvegicus
gggaatctgataccttgccatgttt

SEQ ID NO: 448851 - DNA, 25 bp, Rattus norvegicus
gggaatctgatactctctactgacg

SEQ ID NO: 448852 - DNA, 25 bp, Rattus norvegicus
gggaatctgatagcttgccatgttt

SEQ ID NO: 448853 - DNA, 25 bp, Rattus norvegicus
gggaatctgatagtctctactgacg

SEQ ID NO: 448854 - DNA, 25 bp, Rattus norvegicus
gggaatctgccaacctcatctggcc

SEQ ID NO: 448855 - DNA, 25 bp, Rattus norvegicus
gggaatctgccatcctcatctggcc

SEQ ID NO: 448856 - DNA, 25 bp, Rattus norvegicus
gggaatctgcctacccgaggaagga

SEQ ID NO: 448857 - DNA, 25 bp, Rattus norvegicus
gggaatctgccttcccgaggaagga

SEQ ID NO: 448858 - DNA, 25 bp, Rattus norvegicus
gggaatctgggtcatgactcttcaa

SEQ ID NO: 448859 - DNA, 25 bp, Rattus norvegicus
gggaatctgggtgatgactcttcaa

SEQ ID NO: 448860 - DNA, 25 bp, Rattus norvegicus
gggaatctggttctccaaatccttt

SEQ ID NO: 448861 - DNA, 25 bp, Rattus norvegicus
gggaatctggttgtccaaatccttt

SEQ ID NO: 448862 - DNA, 25 bp, Rattus norvegicus
gggaatctgtctcgtcaacctgtgg

SEQ ID NO: 448863 - DNA, 25 bp, Rattus norvegicus
gggaatctgtctggtcaacctgtgg

SEQ ID NO: 448864 - DNA, 25 bp, Rattus norvegicus
gggaatcttataagcattgctgtga

SEQ ID NO: 448865 - DNA, 25 bp, Rattus norvegicus
gggaatcttatatgcattgctgtga

SEQ ID NO: 448866 - DNA, 25 bp, Rattus norvegicus
gggaatcttccaactggttcatcaa

SEQ ID NO: 448867 - DNA, 25 bp, Rattus norvegicus
gggaatcttccaattctaaaacctg

SEQ ID NO: 448868 - DNA, 25 bp, Rattus norvegicus
gggaatcttccacggctgtaatcgc

SEQ ID NO: 448869 - DNA, 25 bp, Rattus norvegicus
gggaatcttccagggctgtaatcgc

SEQ ID NO: 448870 - DNA, 25 bp, Rattus norvegicus
gggaatcttccatctggttcatcaa

SEQ ID NO: 448871 - DNA, 25 bp, Rattus norvegicus
gggaatcttccatttctaaaacctg

SEQ ID NO: 448872 - DNA, 25 bp, Rattus norvegicus
gggaatcttctaatgttaacatgat

SEQ ID NO: 448873 - DNA, 25 bp, Rattus norvegicus
gggaatcttctattgttaacatgat

SEQ ID NO: 448874 - DNA, 25 bp, Rattus norvegicus
gggaatcttcttatgacctattaca

SEQ ID NO: 448875 - DNA, 25 bp, Rattus norvegicus
gggaatcttcttttgacctattaca

SEQ ID NO: 448876 - DNA, 25 bp, Rattus norvegicus
gggaatcttgaacgacgagttctta

SEQ ID NO: 448877 - DNA, 25 bp, Rattus norvegicus
gggaatcttgaaggacgagttctta

SEQ ID NO: 448878 - DNA, 25 bp, Rattus norvegicus
gggaatcttgatatggtccacttta

SEQ ID NO: 448879 - DNA, 25 bp, Rattus norvegicus
gggaatcttgatttggtccacttta

SEQ ID NO: 448880 - DNA, 25 bp, Rattus norvegicus
gggaatcttgtaattacctctgagt

SEQ ID NO: 448881 - DNA, 25 bp, Rattus norvegicus
gggaatcttgtatttacctctgagt

SEQ ID NO: 448882 - DNA, 25 bp, Rattus norvegicus
gggaatcttgtcatttactcggctt

SEQ ID NO: 448883 - DNA, 25 bp, Rattus norvegicus
gggaatcttgtcttttactcggctt

SEQ ID NO: 448884 - DNA, 25 bp, Rattus norvegicus
gggaatgaagctctgctcacggacc

SEQ ID NO: 448885 - DNA, 25 bp, Rattus norvegicus
gggaatgaagctgtgctcacggacc

SEQ ID NO: 448886 - DNA, 25 bp, Rattus norvegicus
gggaatgaatgcctttctcaaacat

SEQ ID NO: 448887 - DNA, 25 bp, Rattus norvegicus
gggaatgaatgcgtttctcaaacat

SEQ ID NO: 448888 - DNA, 25 bp, Rattus norvegicus
gggaatgaatgtcaactggtttata

SEQ ID NO: 448889 - DNA, 25 bp, Rattus norvegicus
gggaatgaatgtgaactggtttata

SEQ ID NO: 448890 - DNA, 25 bp, Rattus norvegicus
gggaatgaccaaccgcatgtacata

SEQ ID NO: 448891 - DNA, 25 bp, Rattus norvegicus
gggaatgaccaagcgcatgtacata

SEQ ID NO: 448892 - DNA, 25 bp, Rattus norvegicus
gggaatgactttctggcatggccca

SEQ ID NO: 448893 - DNA, 25 bp, Rattus norvegicus
gggaatgactttgtggcatggccca

SEQ ID NO: 448894 - DNA, 25 bp, Rattus norvegicus
gggaatgagagcagactcccttcca

SEQ ID NO: 448895 - DNA, 25 bp, Rattus norvegicus
gggaatgagagctgactcccttcca

SEQ ID NO: 448896 - DNA, 25 bp, Rattus norvegicus
gggaatgagcctcatgacactatta

SEQ ID NO: 448897 - DNA, 25 bp, Rattus norvegicus
gggaatgagcctgatgacactatta

SEQ ID NO: 448898 - DNA, 25 bp, Rattus norvegicus
gggaatgaggtacccatccaccagc

SEQ ID NO: 448899 - DNA, 25 bp, Rattus norvegicus
gggaatgaggtagccatccaccagc

SEQ ID NO: 448900 - DNA, 25 bp, Rattus norvegicus
gggaatgatactcccactatgtgag

SEQ ID NO: 448901 - DNA, 25 bp, Rattus norvegicus
gggaatgatactgccactatgtgag

SEQ ID NO: 448902 - DNA, 25 bp, Rattus norvegicus
gggaatgatcagagaaaaaccgtta

SEQ ID NO: 448903 - DNA, 25 bp, Rattus norvegicus
gggaatgatcagtgaaaaaccgtta

SEQ ID NO: 448904 - DNA, 25 bp, Rattus norvegicus
gggaatgatgcgaacttggtcataa

SEQ ID NO: 448905 - DNA, 25 bp, Rattus norvegicus
gggaatgatgcgtacttggtcataa

SEQ ID NO: 448906 - DNA, 25 bp, Rattus norvegicus
gggaatgattacctacatcctttgt

SEQ ID NO: 448907 - DNA, 25 bp, Rattus norvegicus
gggaatgattacgtacatcctttgt

SEQ ID NO: 448908 - DNA, 25 bp, Rattus norvegicus
gggaatgatttccttcctcacttgc

SEQ ID NO: 448909 - DNA, 25 bp, Rattus norvegicus
gggaatgatttcgttcctcacttgc

SEQ ID NO: 448910 - DNA, 25 bp, Rattus norvegicus
gggaatgcaataaatgtagcatcgt

SEQ ID NO: 448911 - DNA, 25 bp, Rattus norvegicus
gggaatgcaatatatgtagcatcgt

SEQ ID NO: 448912 - DNA, 25 bp, Rattus norvegicus
gggaatgcacacacggtacatttaa

SEQ ID NO: 448913 - DNA, 25 bp, Rattus norvegicus
gggaatgcacactcggtacatttaa

SEQ ID NO: 448914 - DNA, 25 bp, Rattus norvegicus
gggaatgcacctatatttcctaatc

SEQ ID NO: 448915 - DNA, 25 bp, Rattus norvegicus
gggaatgcacctttatttcctaatc

SEQ ID NO: 448916 - DNA, 25 bp, Rattus norvegicus
gggaatgcacggagccatattggat

SEQ ID NO: 448917 - DNA, 25 bp, Rattus norvegicus
gggaatgcacggtgccatattggat

SEQ ID NO: 448918 - DNA, 25 bp, Rattus norvegicus
gggaatgccaagcaagaactccagt

SEQ ID NO: 448919 - DNA, 25 bp, Rattus norvegicus
gggaatgccaaggaagaactccagt

SEQ ID NO: 448920 - DNA, 25 bp, Rattus norvegicus
gggaatgccacaaccatttagcaaa

SEQ ID NO: 448921 - DNA, 25 bp, Rattus norvegicus
gggaatgccacatccatttagcaaa

SEQ ID NO: 448922 - DNA, 25 bp, Rattus norvegicus
gggaatgccccactaaatagctctt

SEQ ID NO: 448923 - DNA, 25 bp, Rattus norvegicus
gggaatgccccagtaaatagctctt

SEQ ID NO: 448924 - DNA, 25 bp, Rattus norvegicus
gggaatgcctttaagacacaccatg

SEQ ID NO: 448925 - DNA, 25 bp, Rattus norvegicus
gggaatgccttttagacacaccatg

SEQ ID NO: 448926 - DNA, 25 bp, Rattus norvegicus
gggaatgcgttcatcgtgtctgcca

SEQ ID NO: 448927 - DNA, 25 bp, Rattus norvegicus
gggaatgcgttcttcgtgtctgcca

SEQ ID NO: 448928 - DNA, 25 bp, Rattus norvegicus
gggaatgcttgcagatcttgaagaa

SEQ ID NO: 448929 - DNA, 25 bp, Rattus norvegicus
gggaatgcttgctgatcttgaagaa

SEQ ID NO: 448930 - DNA, 25 bp, Rattus norvegicus
gggaatggaaaaccaaaccgactct

SEQ ID NO: 448931 - DNA, 25 bp, Rattus norvegicus
gggaatggaaaagcaaaccgactct

SEQ ID NO: 448932 - DNA, 25 bp, Rattus norvegicus
gggaatggagccagcttcactcaga

SEQ ID NO: 448933 - DNA, 25 bp, Rattus norvegicus
gggaatggagcctgcttcactcaga

SEQ ID NO: 448934 - DNA, 25 bp, Rattus norvegicus
gggaatggccagagcgctcagccca

SEQ ID NO: 448935 - DNA, 25 bp, Rattus norvegicus
gggaatggccagtgcgctcagccca

SEQ ID NO: 448936 - DNA, 25 bp, Rattus norvegicus
gggaatgggcctcaggccttctccc

SEQ ID NO: 448937 - DNA, 25 bp, Rattus norvegicus
gggaatgggcctgaggccttctccc

SEQ ID NO: 448938 - DNA, 25 bp, Rattus norvegicus
gggaatgtacttagtgtcctctgta

SEQ ID NO: 448939 - DNA, 25 bp, Rattus norvegicus
gggaatgtactttgtgtcctctgta

SEQ ID NO: 448940 - DNA, 25 bp, Rattus norvegicus
gggaatgtatttacagggctacctg

SEQ ID NO: 448941 - DNA, 25 bp, Rattus norvegicus
gggaatgtattttcagggctacctg

SEQ ID NO: 448942 - DNA, 25 bp, Rattus norvegicus
gggaatgtcagcaaacctgcaggta

SEQ ID NO: 448943 - DNA, 25 bp, Rattus norvegicus
gggaatgtcagctaacctgcaggta

SEQ ID NO: 448944 - DNA, 25 bp, Rattus norvegicus
gggaatgtccatatcttcaaattct

SEQ ID NO: 448945 - DNA, 25 bp, Rattus norvegicus
gggaatgtccatttcttcaaattct

SEQ ID NO: 448946 - DNA, 25 bp, Rattus norvegicus
gggaatgtctctatcgtttgtaagg

SEQ ID NO: 448947 - DNA, 25 bp, Rattus norvegicus
gggaatgtctctttcgtttgtaagg

SEQ ID NO: 448948 - DNA, 25 bp, Rattus norvegicus
gggaatgtgctaagacttgtttgtt

SEQ ID NO: 448949 - DNA, 25 bp, Rattus norvegicus
gggaatgtgctatgacttgtttgtt

SEQ ID NO: 448950 - DNA, 25 bp, Rattus norvegicus
gggaatgtggataccccttgtccag

SEQ ID NO: 448951 - DNA, 25 bp, Rattus norvegicus
gggaatgtggattccccttgtccag

SEQ ID NO: 448952 - DNA, 25 bp, Rattus norvegicus
gggaatgtggccacatcactttaat

SEQ ID NO: 448953 - DNA, 25 bp, Rattus norvegicus
gggaatgtggcctcatcactttaat

SEQ ID NO: 448954 - DNA, 25 bp, Rattus norvegicus
gggaatgtgttccttcattgtattt

SEQ ID NO: 448955 - DNA, 25 bp, Rattus norvegicus
gggaatgtgttcgttcattgtattt

SEQ ID NO: 448956 - DNA, 25 bp, Rattus norvegicus
gggaatgttcaaaactgtcaatttc

SEQ ID NO: 448957 - DNA, 25 bp, Rattus norvegicus
gggaatgttcaatactgtcaatttc

SEQ ID NO: 448958 - DNA, 25 bp, Rattus norvegicus
gggaatgtttaaccactcacagcct

SEQ ID NO: 448959 - DNA, 25 bp, Rattus norvegicus
gggaatgtttaagcactcacagcct

SEQ ID NO: 448960 - DNA, 25 bp, Rattus norvegicus
gggaattaagatactgtcccagaaa

SEQ ID NO: 448961 - DNA, 25 bp, Rattus norvegicus
gggaattaagattctgtcccagaaa

SEQ ID NO: 448962 - DNA, 25 bp, Rattus norvegicus
gggaattaatcactcaccttccagt

SEQ ID NO: 448963 - DNA, 25 bp, Rattus norvegicus
gggaattaatcagtcaccttccagt

SEQ ID NO: 448964 - DNA, 25 bp, Rattus norvegicus
gggaattacagcatttcttgcctat

SEQ ID NO: 448965 - DNA, 25 bp, Rattus norvegicus
gggaattacagcttttcttgcctat

SEQ ID NO: 448966 - DNA, 25 bp, Rattus norvegicus
gggaattaccaccatgccagcagta

SEQ ID NO: 448967 - DNA, 25 bp, Rattus norvegicus
gggaattaccacgatgccagcagta

SEQ ID NO: 448968 - DNA, 25 bp, Rattus norvegicus
gggaattacccacagccttcctgac

SEQ ID NO: 448969 - DNA, 25 bp, Rattus norvegicus
gggaattacccagagccttcctgac

SEQ ID NO: 448970 - DNA, 25 bp, Rattus norvegicus
gggaattacttacgtctggccagag

SEQ ID NO: 448971 - DNA, 25 bp, Rattus norvegicus
gggaattacttaggtctggccagag

SEQ ID NO: 448972 - DNA, 25 bp, Rattus norvegicus
gggaattagctacacactgatttct

SEQ ID NO: 448973 - DNA, 25 bp, Rattus norvegicus
gggaattagctagacactgatttct

SEQ ID NO: 448974 - DNA, 25 bp, Rattus norvegicus
gggaattatcatacatacatcctat

SEQ ID NO: 448975 - DNA, 25 bp, Rattus norvegicus
gggaattatcattcatacatcctat

SEQ ID NO: 448976 - DNA, 25 bp, Rattus norvegicus
gggaattatccccatcgtacctttg

SEQ ID NO: 448977 - DNA, 25 bp, Rattus norvegicus
gggaattatcccgatcgtacctttg

SEQ ID NO: 448978 - DNA, 25 bp, Rattus norvegicus
gggaattatgctcgtctatgacatc

SEQ ID NO: 448979 - DNA, 25 bp, Rattus norvegicus
gggaattatgctggtctatgacatc

SEQ ID NO: 448980 - DNA, 25 bp, Rattus norvegicus
gggaattcaagacgccctgagaagc

SEQ ID NO: 448981 - DNA, 25 bp, Rattus norvegicus
gggaattcaagaggccctgagaagc

SEQ ID NO: 448982 - DNA, 25 bp, Rattus norvegicus
gggaattcacacaggcagctagtga

SEQ ID NO: 448983 - DNA, 25 bp, Rattus norvegicus
gggaattcacactggcagctagtga

SEQ ID NO: 448984 - DNA, 25 bp, Rattus norvegicus
gggaattcacccaaggccactatgg

SEQ ID NO: 448985 - DNA, 25 bp, Rattus norvegicus
gggaattcacccattagatcaggct

SEQ ID NO: 448986 - DNA, 25 bp, Rattus norvegicus
gggaattcaccctaggccactatgg

SEQ ID NO: 448987 - DNA, 25 bp, Rattus norvegicus
gggaattcaccctttagatcaggct

SEQ ID NO: 448988 - DNA, 25 bp, Rattus norvegicus
gggaattcagtgatgctggccttcg

SEQ ID NO: 448989 - DNA, 25 bp, Rattus norvegicus
gggaattcagtgttgctggccttcg

SEQ ID NO: 448990 - DNA, 25 bp, Rattus norvegicus
gggaattcataactgcctagaggcc

SEQ ID NO: 448991 - DNA, 25 bp, Rattus norvegicus
gggaattcataagtgcctagaggcc

SEQ ID NO: 448992 - DNA, 25 bp, Rattus norvegicus
gggaattcatagatctgatgtcttt

SEQ ID NO: 448993 - DNA, 25 bp, Rattus norvegicus
gggaattcatagttctgatgtcttt

SEQ ID NO: 448994 - DNA, 25 bp, Rattus norvegicus
gggaattcatccaggcatttccttc

SEQ ID NO: 448995 - DNA, 25 bp, Rattus norvegicus
gggaattcatcctggcatttccttc

SEQ ID NO: 448996 - DNA, 25 bp, Rattus norvegicus
gggaattcatttcttcactttcaga

SEQ ID NO: 448997 - DNA, 25 bp, Rattus norvegicus
gggaattcatttgttcactttcaga

SEQ ID NO: 448998 - DNA, 25 bp, Rattus norvegicus
gggaattccagtccaaagtctgcat

SEQ ID NO: 448999 - DNA, 25 bp, Rattus norvegicus
gggaattccagtgcaaagtctgcat

SEQ ID NO: 449000 - DNA, 25 bp, Rattus norvegicus
gggaattcctaacacgtgggcttgt

SEQ ID NO: 449001 - DNA, 25 bp, Rattus norvegicus
gggaattcctaagacgtgggcttgt

SEQ ID NO: 449002 - DNA, 25 bp, Rattus norvegicus
gggaattcctacaggtagcagccct

SEQ ID NO: 449003 - DNA, 25 bp, Rattus norvegicus
gggaattcctactggtagcagccct

SEQ ID NO: 449004 - DNA, 25 bp, Rattus norvegicus
gggaattctaccagcggagctcggc

SEQ ID NO: 449005 - DNA, 25 bp, Rattus norvegicus
gggaattctacctgcggagctcggc

SEQ ID NO: 449006 - DNA, 25 bp, Rattus norvegicus
gggaattctcccaaagtgtggacat

SEQ ID NO: 449007 - DNA, 25 bp, Rattus norvegicus
gggaattctccctaagtgtggacat

SEQ ID NO: 449008 - DNA, 25 bp, Rattus norvegicus
gggaattctcggagctatagacttt

SEQ ID NO: 449009 - DNA, 25 bp, Rattus norvegicus
gggaattctcggtgctatagacttt

SEQ ID NO: 449010 - DNA, 25 bp, Rattus norvegicus
gggaattctctgaactccatatcaa

SEQ ID NO: 449011 - DNA, 25 bp, Rattus norvegicus
gggaattctctgcatttgtctgtac

SEQ ID NO: 449012 - DNA, 25 bp, Rattus norvegicus
gggaattctctggatttgtctgtac

SEQ ID NO: 449013 - DNA, 25 bp, Rattus norvegicus
gggaattctctgtactccatatcaa

SEQ ID NO: 449014 - DNA, 25 bp, Rattus norvegicus
gggaattcttctaccgtgtggcagc

SEQ ID NO: 449015 - DNA, 25 bp, Rattus norvegicus
gggaattcttctctcacagtgacag

SEQ ID NO: 449016 - DNA, 25 bp, Rattus norvegicus
gggaattcttctgtcacagtgacag

SEQ ID NO: 449017 - DNA, 25 bp, Rattus norvegicus
gggaattcttcttccgtgtggcagc

SEQ ID NO: 449018 - DNA, 25 bp, Rattus norvegicus
gggaattgaaatacacctgtttgac

SEQ ID NO: 449019 - DNA, 25 bp, Rattus norvegicus
gggaattgaaattcacctgtttgac

SEQ ID NO: 449020 - DNA, 25 bp, Rattus norvegicus
gggaattgaaccaacatcgtctgaa

SEQ ID NO: 449021 - DNA, 25 bp, Rattus norvegicus
gggaattgaacctacatcgtctgaa

SEQ ID NO: 449022 - DNA, 25 bp, Rattus norvegicus
gggaattgaattagtgtctggaaaa

SEQ ID NO: 449023 - DNA, 25 bp, Rattus norvegicus
gggaattgaatttgtgtctggaaaa

SEQ ID NO: 449024 - DNA, 25 bp, Rattus norvegicus
gggaattgcaccatacagacaatgg

SEQ ID NO: 449025 - DNA, 25 bp, Rattus norvegicus
gggaattgcaccttacagacaatgg

SEQ ID NO: 449026 - DNA, 25 bp, Rattus norvegicus
gggaattgctccatttaaatgaaca

SEQ ID NO: 449027 - DNA, 25 bp, Rattus norvegicus
gggaattgctccttttaaatgaaca

SEQ ID NO: 449028 - DNA, 25 bp, Rattus norvegicus
gggaattgcttacatcactattgga

SEQ ID NO: 449029 - DNA, 25 bp, Rattus norvegicus
gggaattgcttagatcactattgga

SEQ ID NO: 449030 - DNA, 25 bp, Rattus norvegicus
gggaattggcttcgaatcccatact

SEQ ID NO: 449031 - DNA, 25 bp, Rattus norvegicus
gggaattggcttggaatcccatact

SEQ ID NO: 449032 - DNA, 25 bp, Rattus norvegicus
gggaattgggtcactccccagccct

SEQ ID NO: 449033 - DNA, 25 bp, Rattus norvegicus
gggaattgggtctctccccagccct

SEQ ID NO: 449034 - DNA, 25 bp, Rattus norvegicus
gggaattgttcacccacaactcagc

SEQ ID NO: 449035 - DNA, 25 bp, Rattus norvegicus
gggaattgttcagccacaactcagc

SEQ ID NO: 449036 - DNA, 25 bp, Rattus norvegicus
gggaatttacaacaagctatcggga

SEQ ID NO: 449037 - DNA, 25 bp, Rattus norvegicus
gggaatttacaagaagctatcggga

SEQ ID NO: 449038 - DNA, 25 bp, Rattus norvegicus
gggaatttactgaactgtttcaatg

SEQ ID NO: 449039 - DNA, 25 bp, Rattus norvegicus
gggaatttactgtactgtttcaatg

SEQ ID NO: 449040 - DNA, 25 bp, Rattus norvegicus
gggaatttatgacttctggacagtt

SEQ ID NO: 449041 - DNA, 25 bp, Rattus norvegicus
gggaatttatgagttctggacagtt

SEQ ID NO: 449042 - DNA, 25 bp, Rattus norvegicus
gggaatttcacaatttacctttcag

SEQ ID NO: 449043 - DNA, 25 bp, Rattus norvegicus
gggaatttcacattttacctttcag

SEQ ID NO: 449044 - DNA, 25 bp, Rattus norvegicus
gggaatttcactcccatggtacaat

SEQ ID NO: 449045 - DNA, 25 bp, Rattus norvegicus
gggaatttcactgccatggtacaat

SEQ ID NO: 449046 - DNA, 25 bp, Rattus norvegicus
gggaatttcccaatggagctctctt

SEQ ID NO: 449047 - DNA, 25 bp, Rattus norvegicus
gggaatttcccattggagctctctt

SEQ ID NO: 449048 - DNA, 25 bp, Rattus norvegicus
gggaatttctgaatctcctgctagg

SEQ ID NO: 449049 - DNA, 25 bp, Rattus norvegicus
gggaatttctgattctcctgctagg

SEQ ID NO: 449050 - DNA, 25 bp, Rattus norvegicus
gggaatttgcacaatttacacttga

SEQ ID NO: 449051 - DNA, 25 bp, Rattus norvegicus
gggaatttgcactatttacacttga

SEQ ID NO: 449052 - DNA, 25 bp, Rattus norvegicus
gggaatttgcttcgtgcttacacct

SEQ ID NO: 449053 - DNA, 25 bp, Rattus norvegicus
gggaatttgcttggtgcttacacct

SEQ ID NO: 449054 - DNA, 25 bp, Rattus norvegicus
gggaatttggttctaactgcaggat

SEQ ID NO: 449055 - DNA, 25 bp, Rattus norvegicus
gggaatttggttgtaactgcaggat

SEQ ID NO: 449056 - DNA, 25 bp, Rattus norvegicus
gggaatttgtataagtactactctt

SEQ ID NO: 449057 - DNA, 25 bp, Rattus norvegicus
gggaatttgtattagtactactctt

SEQ ID NO: 449058 - DNA, 25 bp, Rattus norvegicus
gggaatttgtctagtcatcttttag

SEQ ID NO: 449059 - DNA, 25 bp, Rattus norvegicus
gggaatttgtcttgtcatcttttag

SEQ ID NO: 449060 - DNA, 25 bp, Rattus norvegicus
gggaattttcagaaatctctcttgt

SEQ ID NO: 449061 - DNA, 25 bp, Rattus norvegicus
gggaattttcagtaatctctcttgt

SEQ ID NO: 449062 - DNA, 25 bp, Rattus norvegicus
gggaattttgccagcattgatgctc

SEQ ID NO: 449063 - DNA, 25 bp, Rattus norvegicus
gggaattttgcctgcattgatgctc

SEQ ID NO: 449064 - DNA, 25 bp, Rattus norvegicus
gggaattttgtcctagtccacactg

SEQ ID NO: 449065 - DNA, 25 bp, Rattus norvegicus
gggaattttgtcgtagtccacactg

SEQ ID NO: 449066 - DNA, 25 bp, Rattus norvegicus
gggaatttttctcttgacctatgca

SEQ ID NO: 449067 - DNA, 25 bp, Rattus norvegicus
gggaatttttctgttgacctatgca

SEQ ID NO: 449068 - DNA, 25 bp, Rattus norvegicus
gggacaaaacacatgatacaactga

SEQ ID NO: 449069 - DNA, 25 bp, Rattus norvegicus
gggacaaaacacttgatacaactga

SEQ ID NO: 449070 - DNA, 25 bp, Rattus norvegicus
gggacaaaaggaccccttcctgcag

SEQ ID NO: 449071 - DNA, 25 bp, Rattus norvegicus
gggacaaaaggagcccttcctgcag

SEQ ID NO: 449072 - DNA, 25 bp, Rattus norvegicus
gggacaaaataactgcctacctctc

SEQ ID NO: 449073 - DNA, 25 bp, Rattus norvegicus
gggacaaaataagtgcctacctctc

SEQ ID NO: 449074 - DNA, 25 bp, Rattus norvegicus
gggacaaacaaacacagaacgctca

SEQ ID NO: 449075 - DNA, 25 bp, Rattus norvegicus
gggacaaacaaagacagaacgctca

SEQ ID NO: 449076 - DNA, 25 bp, Rattus norvegicus
gggacaaacataccatagcacaagt

SEQ ID NO: 449077 - DNA, 25 bp, Rattus norvegicus
gggacaaacatagcatagcacaagt

SEQ ID NO: 449078 - DNA, 25 bp, Rattus norvegicus
gggacaaaccagacagcccacaact

SEQ ID NO: 449079 - DNA, 25 bp, Rattus norvegicus
gggacaaaccagtcagcccacaact

SEQ ID NO: 449080 - DNA, 25 bp, Rattus norvegicus
gggacaaaccctaggcccctgtctg

SEQ ID NO: 449081 - DNA, 25 bp, Rattus norvegicus
gggacaaaccctctctgtctgagga

SEQ ID NO: 449082 - DNA, 25 bp, Rattus norvegicus
gggacaaaccctgtctgtctgagga

SEQ ID NO: 449083 - DNA, 25 bp, Rattus norvegicus
gggacaaacccttggcccctgtctg

SEQ ID NO: 449084 - DNA, 25 bp, Rattus norvegicus
gggacaaaccgcagacacagacagc

SEQ ID NO: 449085 - DNA, 25 bp, Rattus norvegicus
gggacaaaccgctgacacagacagc

SEQ ID NO: 449086 - DNA, 25 bp, Rattus norvegicus
gggacaaagaacaccttctacctga

SEQ ID NO: 449087 - DNA, 25 bp, Rattus norvegicus
gggacaaagaactccttctacctga

SEQ ID NO: 449088 - DNA, 25 bp, Rattus norvegicus
gggacaaagacaccgttcaaaccag

SEQ ID NO: 449089 - DNA, 25 bp, Rattus norvegicus
gggacaaagacagcgttcaaaccag

SEQ ID NO: 449090 - DNA, 25 bp, Rattus norvegicus
gggacaaagcagagctcagctcagc

SEQ ID NO: 449091 - DNA, 25 bp, Rattus norvegicus
gggacaaagcagtgctcagctcagc

SEQ ID NO: 449092 - DNA, 25 bp, Rattus norvegicus
gggacaaagccacccgagccttact

SEQ ID NO: 449093 - DNA, 25 bp, Rattus norvegicus
gggacaaagccagccgagccttact

SEQ ID NO: 449094 - DNA, 25 bp, Rattus norvegicus
gggacaaagctcacagctcctggac

SEQ ID NO: 449095 - DNA, 25 bp, Rattus norvegicus
gggacaaagctctcagctcctggac

SEQ ID NO: 449096 - DNA, 25 bp, Rattus norvegicus
gggacaaagcttacatcacaaacat

SEQ ID NO: 449097 - DNA, 25 bp, Rattus norvegicus
gggacaaagctttcatcacaaacat

SEQ ID NO: 449098 - DNA, 25 bp, Rattus norvegicus
gggacaaagtacactcacaacctca

SEQ ID NO: 449099 - DNA, 25 bp, Rattus norvegicus
gggacaaagtactctcacaacctca

SEQ ID NO: 449100 - DNA, 25 bp, Rattus norvegicus
gggacaaatcaaccagcctcaaaca

SEQ ID NO: 449101 - DNA, 25 bp, Rattus norvegicus
gggacaaatcaagcagcctcaaaca

SEQ ID NO: 449102 - DNA, 25 bp, Rattus norvegicus
gggacaaatgtgcttttctctatga

SEQ ID NO: 449103 - DNA, 25 bp, Rattus norvegicus
gggacaaatgtggttttctctatga

SEQ ID NO: 449104 - DNA, 25 bp, Rattus norvegicus
gggacaacaaatacagcagcctttt

SEQ ID NO: 449105 - DNA, 25 bp, Rattus norvegicus
gggacaacaaattcagcagcctttt

SEQ ID NO: 449106 - DNA, 25 bp, Rattus norvegicus
gggacaacacacataatggctggtt

SEQ ID NO: 449107 - DNA, 25 bp, Rattus norvegicus
gggacaacacacttaatggctggtt

SEQ ID NO: 449108 - DNA, 25 bp, Rattus norvegicus
gggacaaccaccaagaacatcggaa

SEQ ID NO: 449109 - DNA, 25 bp, Rattus norvegicus
gggacaaccacctagaacatcggaa

SEQ ID NO: 449110 - DNA, 25 bp, Rattus norvegicus
gggacaaccatgcacagagcccttg

SEQ ID NO: 449111 - DNA, 25 bp, Rattus norvegicus
gggacaaccatggacagagcccttg

SEQ ID NO: 449112 - DNA, 25 bp, Rattus norvegicus
gggacaacccacaacagtagtctag

SEQ ID NO: 449113 - DNA, 25 bp, Rattus norvegicus
gggacaacccactacagtagtctag

SEQ ID NO: 449114 - DNA, 25 bp, Rattus norvegicus
gggacaacccctctgatagctaagt

SEQ ID NO: 449115 - DNA, 25 bp, Rattus norvegicus
gggacaacccctgtgatagctaagt

SEQ ID NO: 449116 - DNA, 25 bp, Rattus norvegicus
gggacaaccgggagtcttctgcaca

SEQ ID NO: 449117 - DNA, 25 bp, Rattus norvegicus
gggacaaccgggtgtcttctgcaca

SEQ ID NO: 449118 - DNA, 25 bp, Rattus norvegicus
gggacaaccgtacactgcgctcaca

SEQ ID NO: 449119 - DNA, 25 bp, Rattus norvegicus
gggacaaccgtagactgcgctcaca

SEQ ID NO: 449120 - DNA, 25 bp, Rattus norvegicus
gggacaaccgtgattctcttgtaat

SEQ ID NO: 449121 - DNA, 25 bp, Rattus norvegicus
gggacaaccgtgtttctcttgtaat

SEQ ID NO: 449122 - DNA, 25 bp, Rattus norvegicus
gggacaacctccctcatttatttat

SEQ ID NO: 449123 - DNA, 25 bp, Rattus norvegicus
gggacaacctccgtcatttatttat

SEQ ID NO: 449124 - DNA, 25 bp, Rattus norvegicus
gggacaaccttaccctgtgtatctt

SEQ ID NO: 449125 - DNA, 25 bp, Rattus norvegicus
gggacaaccttagcctgtgtatctt

SEQ ID NO: 449126 - DNA, 25 bp, Rattus norvegicus
gggacaacgtcacacaaatctcttt

SEQ ID NO: 449127 - DNA, 25 bp, Rattus norvegicus
gggacaacgtcagacaaatctcttt

SEQ ID NO: 449128 - DNA, 25 bp, Rattus norvegicus
gggacaacgtctatcaccttgactg

SEQ ID NO: 449129 - DNA, 25 bp, Rattus norvegicus
gggacaacgtctttcaccttgactg

SEQ ID NO: 449130 - DNA, 25 bp, Rattus norvegicus
gggacaactcaaagacagctacatc

SEQ ID NO: 449131 - DNA, 25 bp, Rattus norvegicus
gggacaactcaatgacagctacatc

SEQ ID NO: 449132 - DNA, 25 bp, Rattus norvegicus
gggacaactcgacaatgggctacat

SEQ ID NO: 449133 - DNA, 25 bp, Rattus norvegicus
gggacaactcgagaatgggctacat

SEQ ID NO: 449134 - DNA, 25 bp, Rattus norvegicus
gggacaagaacacccctgctgggca

SEQ ID NO: 449135 - DNA, 25 bp, Rattus norvegicus
gggacaagaacagccctgctgggca

SEQ ID NO: 449136 - DNA, 25 bp, Rattus norvegicus
gggacaagaaccacatgctggccac

SEQ ID NO: 449137 - DNA, 25 bp, Rattus norvegicus
gggacaagaacctcatgctggccac

SEQ ID NO: 449138 - DNA, 25 bp, Rattus norvegicus
gggacaagataaccaccttccgact

SEQ ID NO: 449139 - DNA, 25 bp, Rattus norvegicus
gggacaagataagcaccttccgact

SEQ ID NO: 449140 - DNA, 25 bp, Rattus norvegicus
gggacaagatcccacaggctcagaa

SEQ ID NO: 449141 - DNA, 25 bp, Rattus norvegicus
gggacaagatccgacaggctcagaa

SEQ ID NO: 449142 - DNA, 25 bp, Rattus norvegicus
gggacaagcactcaaggtttagtaa

SEQ ID NO: 449143 - DNA, 25 bp, Rattus norvegicus
gggacaagcactgaaggtttagtaa

SEQ ID NO: 449144 - DNA, 25 bp, Rattus norvegicus
gggacaagcatcctcagtgctaagg

SEQ ID NO: 449145 - DNA, 25 bp, Rattus norvegicus
gggacaagcatcgtcagtgctaagg

SEQ ID NO: 449146 - DNA, 25 bp, Rattus norvegicus
gggacaagcatgagtcacactttac

SEQ ID NO: 449147 - DNA, 25 bp, Rattus norvegicus
gggacaagcatgtgtcacactttac

SEQ ID NO: 449148 - DNA, 25 bp, Rattus norvegicus
gggacaagcccactgtaggctcctg

SEQ ID NO: 449149 - DNA, 25 bp, Rattus norvegicus
gggacaagcccagtgtaggctcctg

SEQ ID NO: 449150 - DNA, 25 bp, Rattus norvegicus
gggacaagctgcacctccggaagaa

SEQ ID NO: 449151 - DNA, 25 bp, Rattus norvegicus
gggacaagctgccttctctctctgc

SEQ ID NO: 449152 - DNA, 25 bp, Rattus norvegicus
gggacaagctgcgttctctctctgc

SEQ ID NO: 449153 - DNA, 25 bp, Rattus norvegicus
gggacaagctgctcctccggaagaa

SEQ ID NO: 449154 - DNA, 25 bp, Rattus norvegicus
gggacaaggctcaccacacgctggc

SEQ ID NO: 449155 - DNA, 25 bp, Rattus norvegicus
gggacaaggctctccacacgctggc

SEQ ID NO: 449156 - DNA, 25 bp, Rattus norvegicus
gggacaaggctgacgacatccaaaa

SEQ ID NO: 449157 - DNA, 25 bp, Rattus norvegicus
gggacaaggctgtcgacatccaaaa

SEQ ID NO: 449158 - DNA, 25 bp, Rattus norvegicus
gggacaagggctatggcacctgcat

SEQ ID NO: 449159 - DNA, 25 bp, Rattus norvegicus
gggacaagggctttggcacctgcat

SEQ ID NO: 449160 - DNA, 25 bp, Rattus norvegicus
gggacaaggtttacgtcatgtgcta

SEQ ID NO: 449161 - DNA, 25 bp, Rattus norvegicus
gggacaaggttttcgtcatgtgcta

SEQ ID NO: 449162 - DNA, 25 bp, Rattus norvegicus
gggacaagtattaacaaccccatgt

SEQ ID NO: 449163 - DNA, 25 bp, Rattus norvegicus
gggacaagtatttacaaccccatgt

SEQ ID NO: 449164 - DNA, 25 bp, Rattus norvegicus
gggacaagtgttctactacgccgaa

SEQ ID NO: 449165 - DNA, 25 bp, Rattus norvegicus
gggacaagtgttgtactacgccgaa

SEQ ID NO: 449166 - DNA, 25 bp, Rattus norvegicus
gggacaagttacaggctacttctag

SEQ ID NO: 449167 - DNA, 25 bp, Rattus norvegicus
gggacaagttactggctacttctag

SEQ ID NO: 449168 - DNA, 25 bp, Rattus norvegicus
gggacaatagtcagggcctggacaa

SEQ ID NO: 449169 - DNA, 25 bp, Rattus norvegicus
gggacaatagtctgggcctggacaa

SEQ ID NO: 449170 - DNA, 25 bp, Rattus norvegicus
gggacaatatggcagctaacgttaa

SEQ ID NO: 449171 - DNA, 25 bp, Rattus norvegicus
gggacaatatgggagctaacgttaa

SEQ ID NO: 449172 - DNA, 25 bp, Rattus norvegicus
gggacaatcgccaatgaagcaattt

SEQ ID NO: 449173 - DNA, 25 bp, Rattus norvegicus
gggacaatcgcctatgaagcaattt

SEQ ID NO: 449174 - DNA, 25 bp, Rattus norvegicus
gggacaatctccaactcagcagaat

SEQ ID NO: 449175 - DNA, 25 bp, Rattus norvegicus
gggacaatctcctactcagcagaat

SEQ ID NO: 449176 - DNA, 25 bp, Rattus norvegicus
gggacaatgatgacactgcctgcca

SEQ ID NO: 449177 - DNA, 25 bp, Rattus norvegicus
gggacaatgatgtcactgcctgcca

SEQ ID NO: 449178 - DNA, 25 bp, Rattus norvegicus
gggacaatgtctattctagtagctg

SEQ ID NO: 449179 - DNA, 25 bp, Rattus norvegicus
gggacaatgtcttttctagtagctg

SEQ ID NO: 449180 - DNA, 25 bp, Rattus norvegicus
gggacaattactaccaggcccagct

SEQ ID NO: 449181 - DNA, 25 bp, Rattus norvegicus
gggacaattacttccaggcccagct

SEQ ID NO: 449182 - DNA, 25 bp, Rattus norvegicus
gggacaattctcattctgtaggttc

SEQ ID NO: 449183 - DNA, 25 bp, Rattus norvegicus
gggacaattctctttctgtaggttc

SEQ ID NO: 449184 - DNA, 25 bp, Rattus norvegicus
gggacaattgaacccatcttttcca

SEQ ID NO: 449185 - DNA, 25 bp, Rattus norvegicus
gggacaattgaagccatcttttcca

SEQ ID NO: 449186 - DNA, 25 bp, Rattus norvegicus
gggacaattgcgaaccatcctcaga

SEQ ID NO: 449187 - DNA, 25 bp, Rattus norvegicus
gggacaattgcgtaccatcctcaga

SEQ ID NO: 449188 - DNA, 25 bp, Rattus norvegicus
gggacaatttatcttatactgaact

SEQ ID NO: 449189 - DNA, 25 bp, Rattus norvegicus
gggacaatttatgttatactgaact

SEQ ID NO: 449190 - DNA, 25 bp, Rattus norvegicus
gggacaattttcattctcttatctc

SEQ ID NO: 449191 - DNA, 25 bp, Rattus norvegicus
gggacaattttctttctcttatctc

SEQ ID NO: 449192 - DNA, 25 bp, Rattus norvegicus
gggacacaaaggacttcaaaggttg

SEQ ID NO: 449193 - DNA, 25 bp, Rattus norvegicus
gggacacaaaggtcttcaaaggttg

SEQ ID NO: 449194 - DNA, 25 bp, Rattus norvegicus
gggacacaaagtatcatgctagatg

SEQ ID NO: 449195 - DNA, 25 bp, Rattus norvegicus
gggacacaaagtttcatgctagatg

SEQ ID NO: 449196 - DNA, 25 bp, Rattus norvegicus
gggacacaaccaatcgccagtttat

SEQ ID NO: 449197 - DNA, 25 bp, Rattus norvegicus
gggacacaaccattcgccagtttat

SEQ ID NO: 449198 - DNA, 25 bp, Rattus norvegicus
gggacacaacccaggacttcttgca

SEQ ID NO: 449199 - DNA, 25 bp, Rattus norvegicus
gggacacaaccctggacttcttgca

SEQ ID NO: 449200 - DNA, 25 bp, Rattus norvegicus
gggacacaactgattctgctttgag

SEQ ID NO: 449201 - DNA, 25 bp, Rattus norvegicus
gggacacaactgtttctgctttgag

SEQ ID NO: 449202 - DNA, 25 bp, Rattus norvegicus
gggacacaagagaattagccttaga

SEQ ID NO: 449203 - DNA, 25 bp, Rattus norvegicus
gggacacaagagtattagccttaga

SEQ ID NO: 449204 - DNA, 25 bp, Rattus norvegicus
gggacacaagggatggccttccatc

SEQ ID NO: 449205 - DNA, 25 bp, Rattus norvegicus
gggacacaagggttggccttccatc

SEQ ID NO: 449206 - DNA, 25 bp, Rattus norvegicus
gggacacaatctcttgttatggctt

SEQ ID NO: 449207 - DNA, 25 bp, Rattus norvegicus
gggacacaatctgttgttatggctt

SEQ ID NO: 449208 - DNA, 25 bp, Rattus norvegicus
gggacacacaatacagttatcttct

SEQ ID NO: 449209 - DNA, 25 bp, Rattus norvegicus
gggacacacaattcagttatcttct

SEQ ID NO: 449210 - DNA, 25 bp, Rattus norvegicus
gggacacaccacaagaatctcgcag

SEQ ID NO: 449211 - DNA, 25 bp, Rattus norvegicus
gggacacaccactagaatctcgcag

SEQ ID NO: 449212 - DNA, 25 bp, Rattus norvegicus
gggacacaccctcatagcacaatct

SEQ ID NO: 449213 - DNA, 25 bp, Rattus norvegicus
gggacacaccctgatagcacaatct

SEQ ID NO: 449214 - DNA, 25 bp, Rattus norvegicus
gggacacactgacatactacagctt

SEQ ID NO: 449215 - DNA, 25 bp, Rattus norvegicus
gggacacactgagatactacagctt

SEQ ID NO: 449216 - DNA, 25 bp, Rattus norvegicus
gggacacactgccagatttggccag

SEQ ID NO: 449217 - DNA, 25 bp, Rattus norvegicus
gggacacactgcgagatttggccag

SEQ ID NO: 449218 - DNA, 25 bp, Rattus norvegicus
gggacacacttcatcagcgtttgaa

SEQ ID NO: 449219 - DNA, 25 bp, Rattus norvegicus
gggacacacttcttcagcgtttgaa

SEQ ID NO: 449220 - DNA, 25 bp, Rattus norvegicus
gggacacagacaatatcacctcctt

SEQ ID NO: 449221 - DNA, 25 bp, Rattus norvegicus
gggacacagacattatcacctcctt

SEQ ID NO: 449222 - DNA, 25 bp, Rattus norvegicus
gggacacagcctagctccagggatg

SEQ ID NO: 449223 - DNA, 25 bp, Rattus norvegicus
gggacacagccttgctccagggatg

SEQ ID NO: 449224 - DNA, 25 bp, Rattus norvegicus
gggacacagcgaactgcctgttggt

SEQ ID NO: 449225 - DNA, 25 bp, Rattus norvegicus
gggacacagcgatctgcctgttggt

SEQ ID NO: 449226 - DNA, 25 bp, Rattus norvegicus
gggacacagctcactggaggccaga

SEQ ID NO: 449227 - DNA, 25 bp, Rattus norvegicus
gggacacagctctctggaggccaga

SEQ ID NO: 449228 - DNA, 25 bp, Rattus norvegicus
gggacacagggcaggatcctttgat

SEQ ID NO: 449229 - DNA, 25 bp, Rattus norvegicus
gggacacagggctggatcctttgat

SEQ ID NO: 449230 - DNA, 25 bp, Rattus norvegicus
gggacacagtctagctattgtactc

SEQ ID NO: 449231 - DNA, 25 bp, Rattus norvegicus
gggacacagtcttgctattgtactc

SEQ ID NO: 449232 - DNA, 25 bp, Rattus norvegicus
gggacacagtgtattcttttattga

SEQ ID NO: 449233 - DNA, 25 bp, Rattus norvegicus
gggacacagtgttttcttttattga

SEQ ID NO: 449234 - DNA, 25 bp, Rattus norvegicus
gggacacatagcagctccatatcct

SEQ ID NO: 449235 - DNA, 25 bp, Rattus norvegicus
gggacacatagctgctccatatcct

SEQ ID NO: 449236 - DNA, 25 bp, Rattus norvegicus
gggacacatcccaatgggatttcca

SEQ ID NO: 449237 - DNA, 25 bp, Rattus norvegicus
gggacacatccctatgggatttcca

SEQ ID NO: 449238 - DNA, 25 bp, Rattus norvegicus
gggacacatgacatatgtagggctt

SEQ ID NO: 449239 - DNA, 25 bp, Rattus norvegicus
gggacacatgacttatgtagggctt

SEQ ID NO: 449240 - DNA, 25 bp, Rattus norvegicus
gggacacattagcacatcagctggc

SEQ ID NO: 449241 - DNA, 25 bp, Rattus norvegicus
gggacacattaggacatcagctggc

SEQ ID NO: 449242 - DNA, 25 bp, Rattus norvegicus
gggacacattatctttttacttcca

SEQ ID NO: 449243 - DNA, 25 bp, Rattus norvegicus
gggacacattatgtttttacttcca

SEQ ID NO: 449244 - DNA, 25 bp, Rattus norvegicus
gggacacattcaagccactaactgt

SEQ ID NO: 449245 - DNA, 25 bp, Rattus norvegicus
gggacacattcatgccactaactgt

SEQ ID NO: 449246 - DNA, 25 bp, Rattus norvegicus
gggacaccaagaactctaacagctc

SEQ ID NO: 449247 - DNA, 25 bp, Rattus norvegicus
gggacaccaagatctctaacagctc

SEQ ID NO: 449248 - DNA, 25 bp, Rattus norvegicus
gggacaccaagtcaatgcctgcttg

SEQ ID NO: 449249 - DNA, 25 bp, Rattus norvegicus
gggacaccaagtgaatgcctgcttg

SEQ ID NO: 449250 - DNA, 25 bp, Rattus norvegicus
gggacaccaggaccagtctctgaga

SEQ ID NO: 449251 - DNA, 25 bp, Rattus norvegicus
gggacaccaggagcagtctctgaga

SEQ ID NO: 449252 - DNA, 25 bp, Rattus norvegicus
gggacaccagtcagactgtgacata

SEQ ID NO: 449253 - DNA, 25 bp, Rattus norvegicus
gggacaccagtctgactgtgacata

SEQ ID NO: 449254 - DNA, 25 bp, Rattus norvegicus
gggacaccatcgacaatgtgcagca

SEQ ID NO: 449255 - DNA, 25 bp, Rattus norvegicus
gggacaccatcgtcaatgtgcagca

SEQ ID NO: 449256 - DNA, 25 bp, Rattus norvegicus
gggacaccatgacagagcaacgctt

SEQ ID NO: 449257 - DNA, 25 bp, Rattus norvegicus
gggacaccatgagagagcaacgctt

SEQ ID NO: 449258 - DNA, 25 bp, Rattus norvegicus
gggacacccatgcttggactttgtt

SEQ ID NO: 449259 - DNA, 25 bp, Rattus norvegicus
gggacacccatggttggactttgtt

SEQ ID NO: 449260 - DNA, 25 bp, Rattus norvegicus
gggacacccggcagggtcaaatatc

SEQ ID NO: 449261 - DNA, 25 bp, Rattus norvegicus
gggacacccggctgggtcaaatatc

SEQ ID NO: 449262 - DNA, 25 bp, Rattus norvegicus
gggacaccgggtacggagcctgccg

SEQ ID NO: 449263 - DNA, 25 bp, Rattus norvegicus
gggacaccgggttcggagcctgccg

SEQ ID NO: 449264 - DNA, 25 bp, Rattus norvegicus
gggacacctaaactcacactttgtg

SEQ ID NO: 449265 - DNA, 25 bp, Rattus norvegicus
gggacacctaaagtcacactttgtg

SEQ ID NO: 449266 - DNA, 25 bp, Rattus norvegicus
gggacaccttaactctcaggctgcc

SEQ ID NO: 449267 - DNA, 25 bp, Rattus norvegicus
gggacaccttaagtctcaggctgcc

SEQ ID NO: 449268 - DNA, 25 bp, Rattus norvegicus
gggacacgatgacactgacagtgtc

SEQ ID NO: 449269 - DNA, 25 bp, Rattus norvegicus
gggacacgatgagactgacagtgtc

SEQ ID NO: 449270 - DNA, 25 bp, Rattus norvegicus
gggacacgctcaaatctcattgaga

SEQ ID NO: 449271 - DNA, 25 bp, Rattus norvegicus
gggacacgctcatatctcattgaga

SEQ ID NO: 449272 - DNA, 25 bp, Rattus norvegicus
gggacacgctctacatttatagagc

SEQ ID NO: 449273 - DNA, 25 bp, Rattus norvegicus
gggacacgctcttcatttatagagc

SEQ ID NO: 449274 - DNA, 25 bp, Rattus norvegicus
gggacacggacgacgccgtgtatca

SEQ ID NO: 449275 - DNA, 25 bp, Rattus norvegicus
gggacacggacgtcgccgtgtatca

SEQ ID NO: 449276 - DNA, 25 bp, Rattus norvegicus
gggacacggctcataacattttcag

SEQ ID NO: 449277 - DNA, 25 bp, Rattus norvegicus
gggacacggctcttaacattttcag

SEQ ID NO: 449278 - DNA, 25 bp, Rattus norvegicus
gggacacgtgcaactcgagcctcgc

SEQ ID NO: 449279 - DNA, 25 bp, Rattus norvegicus
gggacacgtgcatctcgagcctcgc

SEQ ID NO: 449280 - DNA, 25 bp, Rattus norvegicus
gggacactaagtccgttgactctga

SEQ ID NO: 449281 - DNA, 25 bp, Rattus norvegicus
gggacactaagtgcgttgactctga

SEQ ID NO: 449282 - DNA, 25 bp, Rattus norvegicus
gggacactacctcacaggatgactg

SEQ ID NO: 449283 - DNA, 25 bp, Rattus norvegicus
gggacactacctgacaggatgactg

SEQ ID NO: 449284 - DNA, 25 bp, Rattus norvegicus
gggacactagaaattcaatggactc

SEQ ID NO: 449285 - DNA, 25 bp, Rattus norvegicus
gggacactagaaccaccgtggcctg

SEQ ID NO: 449286 - DNA, 25 bp, Rattus norvegicus
gggacactagaagcaccgtggcctg

SEQ ID NO: 449287 - DNA, 25 bp, Rattus norvegicus
gggacactagaatttcaatggactc

SEQ ID NO: 449288 - DNA, 25 bp, Rattus norvegicus
gggacactatacacagaaaatacat

SEQ ID NO: 449289 - DNA, 25 bp, Rattus norvegicus
gggacactatactcagaaaatacat

SEQ ID NO: 449290 - DNA, 25 bp, Rattus norvegicus
gggacactattacccgaatctccta

SEQ ID NO: 449291 - DNA, 25 bp, Rattus norvegicus
gggacactattagccgaatctccta

SEQ ID NO: 449292 - DNA, 25 bp, Rattus norvegicus
gggacactcactcggaacacttgga

SEQ ID NO: 449293 - DNA, 25 bp, Rattus norvegicus
gggacactcactgggaacacttgga

SEQ ID NO: 449294 - DNA, 25 bp, Rattus norvegicus
gggacactcataccctggagttttc

SEQ ID NO: 449295 - DNA, 25 bp, Rattus norvegicus
gggacactcatagcctggagttttc

SEQ ID NO: 449296 - DNA, 25 bp, Rattus norvegicus
gggacactccacatataaactgtat

SEQ ID NO: 449297 - DNA, 25 bp, Rattus norvegicus
gggacactccacttataaactgtat

SEQ ID NO: 449298 - DNA, 25 bp, Rattus norvegicus
gggacactcccaccacaatttggag

SEQ ID NO: 449299 - DNA, 25 bp, Rattus norvegicus
gggacactcccagcacaatttggag

SEQ ID NO: 449300 - DNA, 25 bp, Rattus norvegicus
gggacactcctcaagaggtcattgc

SEQ ID NO: 449301 - DNA, 25 bp, Rattus norvegicus
gggacactcctctagaggtcattgc

SEQ ID NO: 449302 - DNA, 25 bp, Rattus norvegicus
gggacactctaccactttaatatat

SEQ ID NO: 449303 - DNA, 25 bp, Rattus norvegicus
gggacactctacgactttaatatat

SEQ ID NO: 449304 - DNA, 25 bp, Rattus norvegicus
gggacactctgcacagattgcaaaa

SEQ ID NO: 449305 - DNA, 25 bp, Rattus norvegicus
gggacactctgctcagattgcaaaa

SEQ ID NO: 449306 - DNA, 25 bp, Rattus norvegicus
gggacactgaatacagggatagcct

SEQ ID NO: 449307 - DNA, 25 bp, Rattus norvegicus
gggacactgaatagggcatcctggc

SEQ ID NO: 449308 - DNA, 25 bp, Rattus norvegicus
gggacactgaattcagggatagcct

SEQ ID NO: 449309 - DNA, 25 bp, Rattus norvegicus
gggacactgaattgggcatcctggc

SEQ ID NO: 449310 - DNA, 25 bp, Rattus norvegicus
gggacactgaccaacttaattccgg

SEQ ID NO: 449311 - DNA, 25 bp, Rattus norvegicus
gggacactgacctacttaattccgg

SEQ ID NO: 449312 - DNA, 25 bp, Rattus norvegicus
gggacactgggtaaaaggcacaact

SEQ ID NO: 449313 - DNA, 25 bp, Rattus norvegicus
gggacactgggttaaaggcacaact

SEQ ID NO: 449314 - DNA, 25 bp, Rattus norvegicus
gggacactggtcaggatgctcctcg

SEQ ID NO: 449315 - DNA, 25 bp, Rattus norvegicus
gggacactggtctggatgctcctcg

SEQ ID NO: 449316 - DNA, 25 bp, Rattus norvegicus
gggacactgtgaccagcccaagaat

SEQ ID NO: 449317 - DNA, 25 bp, Rattus norvegicus
gggacactgtgagcagcccaagaat

SEQ ID NO: 449318 - DNA, 25 bp, Rattus norvegicus
gggacacttaagaaatctgtgcttt

SEQ ID NO: 449319 - DNA, 25 bp, Rattus norvegicus
gggacacttaagtaatctgtgcttt

SEQ ID NO: 449320 - DNA, 25 bp, Rattus norvegicus
gggacacttcacaactagacgggaa

SEQ ID NO: 449321 - DNA, 25 bp, Rattus norvegicus
gggacacttcactactagacgggaa

SEQ ID NO: 449322 - DNA, 25 bp, Rattus norvegicus
gggacacttcatagtcatccagatc

SEQ ID NO: 449323 - DNA, 25 bp, Rattus norvegicus
gggacacttcattgtcatccagatc

SEQ ID NO: 449324 - DNA, 25 bp, Rattus norvegicus
gggacacttcttcctgccaagaatg

SEQ ID NO: 449325 - DNA, 25 bp, Rattus norvegicus
gggacacttcttgctgccaagaatg

SEQ ID NO: 449326 - DNA, 25 bp, Rattus norvegicus
gggacacttgctaacgtgaacaaag

SEQ ID NO: 449327 - DNA, 25 bp, Rattus norvegicus
gggacacttgcttacgtgaacaaag

SEQ ID NO: 449328 - DNA, 25 bp, Rattus norvegicus
gggacacttgtcaatagggtgacca

SEQ ID NO: 449329 - DNA, 25 bp, Rattus norvegicus
gggacacttgtctatagggtgacca

SEQ ID NO: 449330 - DNA, 25 bp, Rattus norvegicus
gggacacttgtgaaaaatctccaaa

SEQ ID NO: 449331 - DNA, 25 bp, Rattus norvegicus
gggacacttgtgtaaaatctccaaa

SEQ ID NO: 449332 - DNA, 25 bp, Rattus norvegicus
gggacactttccagagttggcttat

SEQ ID NO: 449333 - DNA, 25 bp, Rattus norvegicus
gggacactttcctgagttggcttat

SEQ ID NO: 449334 - DNA, 25 bp, Rattus norvegicus
gggacactttttctaatacattgcc

SEQ ID NO: 449335 - DNA, 25 bp, Rattus norvegicus
gggacactttttgtaatacattgcc

SEQ ID NO: 449336 - DNA, 25 bp, Rattus norvegicus
gggacagaaccccaagaccctggag

SEQ ID NO: 449337 - DNA, 25 bp, Rattus norvegicus
gggacagaaccccacacctgaggag

SEQ ID NO: 449338 - DNA, 25 bp, Rattus norvegicus
gggacagaacccgaagaccctggag

SEQ ID NO: 449339 - DNA, 25 bp, Rattus norvegicus
gggacagaacccgacacctgaggag

SEQ ID NO: 449340 - DNA, 25 bp, Rattus norvegicus
gggacagaaggcaccatccagttca

SEQ ID NO: 449341 - DNA, 25 bp, Rattus norvegicus
gggacagaaggctccatccagttca

SEQ ID NO: 449342 - DNA, 25 bp, Rattus norvegicus
gggacagaagttcccgtcatttccg

SEQ ID NO: 449343 - DNA, 25 bp, Rattus norvegicus
gggacagaagttgccgtcatttccg

SEQ ID NO: 449344 - DNA, 25 bp, Rattus norvegicus
gggacagaatctaccaaaccacaga

SEQ ID NO: 449345 - DNA, 25 bp, Rattus norvegicus
gggacagaatcttccaaaccacaga

SEQ ID NO: 449346 - DNA, 25 bp, Rattus norvegicus
gggacagaatgtcctggccccaaca

SEQ ID NO: 449347 - DNA, 25 bp, Rattus norvegicus
gggacagaatgtgctggccccaaca

SEQ ID NO: 449348 - DNA, 25 bp, Rattus norvegicus
gggacagacactcttccagtgtgtt

SEQ ID NO: 449349 - DNA, 25 bp, Rattus norvegicus
gggacagacactgttccagtgtgtt

SEQ ID NO: 449350 - DNA, 25 bp, Rattus norvegicus
gggacagacagaagagcctcctaca

SEQ ID NO: 449351 - DNA, 25 bp, Rattus norvegicus
gggacagacagatgagcctcctaca

SEQ ID NO: 449352 - DNA, 25 bp, Rattus norvegicus
gggacagacccactttcactattga

SEQ ID NO: 449353 - DNA, 25 bp, Rattus norvegicus
gggacagacccagtttcactattga

SEQ ID NO: 449354 - DNA, 25 bp, Rattus norvegicus
gggacagagagtacttccttgtgat

SEQ ID NO: 449355 - DNA, 25 bp, Rattus norvegicus
gggacagagagttcttccttgtgat

SEQ ID NO: 449356 - DNA, 25 bp, Rattus norvegicus
gggacagagatcacagcaaccttct

SEQ ID NO: 449357 - DNA, 25 bp, Rattus norvegicus
gggacagagatctcagcaaccttct

SEQ ID NO: 449358 - DNA, 25 bp, Rattus norvegicus
gggacagagcacagagtcacgctat

SEQ ID NO: 449359 - DNA, 25 bp, Rattus norvegicus
gggacagagcactgagtcacgctat

SEQ ID NO: 449360 - DNA, 25 bp, Rattus norvegicus
gggacagagccactttgaagaatca

SEQ ID NO: 449361 - DNA, 25 bp, Rattus norvegicus
gggacagagccagtttgaagaatca

SEQ ID NO: 449362 - DNA, 25 bp, Rattus norvegicus
gggacagaggataccctgcaacaga

SEQ ID NO: 449363 - DNA, 25 bp, Rattus norvegicus
gggacagaggattccctgcaacaga

SEQ ID NO: 449364 - DNA, 25 bp, Rattus norvegicus
gggacagaggctacggctcatgata

SEQ ID NO: 449365 - DNA, 25 bp, Rattus norvegicus
gggacagaggcttcggctcatgata

SEQ ID NO: 449366 - DNA, 25 bp, Rattus norvegicus
gggacagagtagactccacccaaat

SEQ ID NO: 449367 - DNA, 25 bp, Rattus norvegicus
gggacagagtagtctccacccaaat

SEQ ID NO: 449368 - DNA, 25 bp, Rattus norvegicus
gggacagagttcatatttgttttga

SEQ ID NO: 449369 - DNA, 25 bp, Rattus norvegicus
gggacagagttcttatttgttttga

SEQ ID NO: 449370 - DNA, 25 bp, Rattus norvegicus
gggacagataatctgtatatcaact

SEQ ID NO: 449371 - DNA, 25 bp, Rattus norvegicus
gggacagataatgtgtatatcaact

SEQ ID NO: 449372 - DNA, 25 bp, Rattus norvegicus
gggacagatcttacatgtcagttga

SEQ ID NO: 449373 - DNA, 25 bp, Rattus norvegicus
gggacagatctttcatgtcagttga

SEQ ID NO: 449374 - DNA, 25 bp, Rattus norvegicus
gggacagatggcctctttctctttt

SEQ ID NO: 449375 - DNA, 25 bp, Rattus norvegicus
gggacagatggcgtctttctctttt

SEQ ID NO: 449376 - DNA, 25 bp, Rattus norvegicus
gggacagattacaccaaggcctttg

SEQ ID NO: 449377 - DNA, 25 bp, Rattus norvegicus
gggacagattactccaaggcctttg

SEQ ID NO: 449378 - DNA, 25 bp, Rattus norvegicus
gggacagattccacccgctgtccat

SEQ ID NO: 449379 - DNA, 25 bp, Rattus norvegicus
gggacagattccagctttcaatact

SEQ ID NO: 449380 - DNA, 25 bp, Rattus norvegicus
gggacagattcctcccgctgtccat

SEQ ID NO: 449381 - DNA, 25 bp, Rattus norvegicus
gggacagattcctgctttcaatact

SEQ ID NO: 449382 - DNA, 25 bp, Rattus norvegicus
gggacagattgcaccctggagagct

SEQ ID NO: 449383 - DNA, 25 bp, Rattus norvegicus
gggacagattgctccctggagagct

SEQ ID NO: 449384 - DNA, 25 bp, Rattus norvegicus
gggacagcaaatatctgcccacgtt

SEQ ID NO: 449385 - DNA, 25 bp, Rattus norvegicus
gggacagcaaatttctgcccacgtt

SEQ ID NO: 449386 - DNA, 25 bp, Rattus norvegicus
gggacagcaagtactccccatttgc

SEQ ID NO: 449387 - DNA, 25 bp, Rattus norvegicus
gggacagcaagttctccccatttgc

SEQ ID NO: 449388 - DNA, 25 bp, Rattus norvegicus
gggacagcacagatgtgtagtttct

SEQ ID NO: 449389 - DNA, 25 bp, Rattus norvegicus
gggacagcacagttgtgtagtttct

SEQ ID NO: 449390 - DNA, 25 bp, Rattus norvegicus
gggacagcacctacagaattgtcag

SEQ ID NO: 449391 - DNA, 25 bp, Rattus norvegicus
gggacagcaccttcagaattgtcag

SEQ ID NO: 449392 - DNA, 25 bp, Rattus norvegicus
gggacagcagcgctgccgagcgcac

SEQ ID NO: 449393 - DNA, 25 bp, Rattus norvegicus
gggacagcagcggtgccgagcgcac

SEQ ID NO: 449394 - DNA, 25 bp, Rattus norvegicus
gggacagcagctactctcaagcaga

SEQ ID NO: 449395 - DNA, 25 bp, Rattus norvegicus
gggacagcagcttctctcaagcaga

SEQ ID NO: 449396 - DNA, 25 bp, Rattus norvegicus
gggacagcagtactctttgagttta

SEQ ID NO: 449397 - DNA, 25 bp, Rattus norvegicus
gggacagcagtagtctttgagttta

SEQ ID NO: 449398 - DNA, 25 bp, Rattus norvegicus
gggacagcatcacaactgtttgtca

SEQ ID NO: 449399 - DNA, 25 bp, Rattus norvegicus
gggacagcatcagaactgtttgtca

SEQ ID NO: 449400 - DNA, 25 bp, Rattus norvegicus
gggacagcatctcgtatggcctgca

SEQ ID NO: 449401 - DNA, 25 bp, Rattus norvegicus
gggacagcatctggtatggcctgca

SEQ ID NO: 449402 - DNA, 25 bp, Rattus norvegicus
gggacagccaagaccagctaccact

SEQ ID NO: 449403 - DNA, 25 bp, Rattus norvegicus
gggacagccaagtccagctaccact

SEQ ID NO: 449404 - DNA, 25 bp, Rattus norvegicus
gggacagccacacgtcgaccagatt

SEQ ID NO: 449405 - DNA, 25 bp, Rattus norvegicus
gggacagccacaggtcgaccagatt

SEQ ID NO: 449406 - DNA, 25 bp, Rattus norvegicus
gggacagccactagcctggtaggaa

SEQ ID NO: 449407 - DNA, 25 bp, Rattus norvegicus
gggacagccactctggcccttgaga

SEQ ID NO: 449408 - DNA, 25 bp, Rattus norvegicus
gggacagccactgtggcccttgaga

SEQ ID NO: 449409 - DNA, 25 bp, Rattus norvegicus
gggacagccacttgcctggtaggaa

SEQ ID NO: 449410 - DNA, 25 bp, Rattus norvegicus
gggacagcccagagttttggtacgc

SEQ ID NO: 449411 - DNA, 25 bp, Rattus norvegicus
gggacagcccagtgttttggtacgc

SEQ ID NO: 449412 - DNA, 25 bp, Rattus norvegicus
gggacagcccctagacagaaagacc

SEQ ID NO: 449413 - DNA, 25 bp, Rattus norvegicus
gggacagccccttgacagaaagacc

SEQ ID NO: 449414 - DNA, 25 bp, Rattus norvegicus
gggacagccctgaagatgccactaa

SEQ ID NO: 449415 - DNA, 25 bp, Rattus norvegicus
gggacagccctgtagatgccactaa

SEQ ID NO: 449416 - DNA, 25 bp, Rattus norvegicus
gggacagccgagctctccattgttg

SEQ ID NO: 449417 - DNA, 25 bp, Rattus norvegicus
gggacagccgaggtctccattgttg

SEQ ID NO: 449418 - DNA, 25 bp, Rattus norvegicus
gggacagccgctacagacaaccgct

SEQ ID NO: 449419 - DNA, 25 bp, Rattus norvegicus
gggacagccgcttcagacaaccgct

SEQ ID NO: 449420 - DNA, 25 bp, Rattus norvegicus
gggacagcctccaagttgtctttaa

SEQ ID NO: 449421 - DNA, 25 bp, Rattus norvegicus
gggacagcctcctagttgtctttaa

SEQ ID NO: 449422 - DNA, 25 bp, Rattus norvegicus
gggacagcctgacaaaggacatcca

SEQ ID NO: 449423 - DNA, 25 bp, Rattus norvegicus
gggacagcctgacgtgtcttcagaa

SEQ ID NO: 449424 - DNA, 25 bp, Rattus norvegicus
gggacagcctgagaaaggacatcca

SEQ ID NO: 449425 - DNA, 25 bp, Rattus norvegicus
gggacagcctgaggtgtcttcagaa

SEQ ID NO: 449426 - DNA, 25 bp, Rattus norvegicus
gggacagcctgcaggacacagaact

SEQ ID NO: 449427 - DNA, 25 bp, Rattus norvegicus
gggacagcctgctggacacagaact

SEQ ID NO: 449428 - DNA, 25 bp, Rattus norvegicus
gggacagcgctaatccattcagaat

SEQ ID NO: 449429 - DNA, 25 bp, Rattus norvegicus
gggacagcgctattccattcagaat

SEQ ID NO: 449430 - DNA, 25 bp, Rattus norvegicus
gggacagcgtctacacagtctacaa

SEQ ID NO: 449431 - DNA, 25 bp, Rattus norvegicus
gggacagcgtcttcacagtctacaa

SEQ ID NO: 449432 - DNA, 25 bp, Rattus norvegicus
gggacagctaggattagttcagcta

SEQ ID NO: 449433 - DNA, 25 bp, Rattus norvegicus
gggacagctaggtttagttcagcta

SEQ ID NO: 449434 - DNA, 25 bp, Rattus norvegicus
gggacagctcatcaaagcctgcaaa

SEQ ID NO: 449435 - DNA, 25 bp, Rattus norvegicus
gggacagctcatgaaagcctgcaaa

SEQ ID NO: 449436 - DNA, 25 bp, Rattus norvegicus
gggacagctccacatctgagacagt

SEQ ID NO: 449437 - DNA, 25 bp, Rattus norvegicus
gggacagctccagatctgagacagt

SEQ ID NO: 449438 - DNA, 25 bp, Rattus norvegicus
gggacagctcccacgaggacgacct

SEQ ID NO: 449439 - DNA, 25 bp, Rattus norvegicus
gggacagctccctcgaggacgacct

SEQ ID NO: 449440 - DNA, 25 bp, Rattus norvegicus
gggacagctgctctcttaatagtga

SEQ ID NO: 449441 - DNA, 25 bp, Rattus norvegicus
gggacagctgctgtcttaatagtga

SEQ ID NO: 449442 - DNA, 25 bp, Rattus norvegicus
gggacagctggaataggcttcccct

SEQ ID NO: 449443 - DNA, 25 bp, Rattus norvegicus
gggacagctggattaggcttcccct

SEQ ID NO: 449444 - DNA, 25 bp, Rattus norvegicus
gggacagctgtcctttccaaagtac

SEQ ID NO: 449445 - DNA, 25 bp, Rattus norvegicus
gggacagctgtcgtttccaaagtac

SEQ ID NO: 449446 - DNA, 25 bp, Rattus norvegicus
gggacagctgttagcaaatgattct

SEQ ID NO: 449447 - DNA, 25 bp, Rattus norvegicus
gggacagctgttatcaagttatcta

SEQ ID NO: 449448 - DNA, 25 bp, Rattus norvegicus
gggacagctgtttgcaaatgattct

SEQ ID NO: 449449 - DNA, 25 bp, Rattus norvegicus
gggacagctgttttcaagttatcta

SEQ ID NO: 449450 - DNA, 25 bp, Rattus norvegicus
gggacagcttcaccttcagtgatga

SEQ ID NO: 449451 - DNA, 25 bp, Rattus norvegicus
gggacagcttcagcttcagtgatga

SEQ ID NO: 449452 - DNA, 25 bp, Rattus norvegicus
gggacaggaaagaccctccgcaaag

SEQ ID NO: 449453 - DNA, 25 bp, Rattus norvegicus
gggacaggaaagtccctccgcaaag

SEQ ID NO: 449454 - DNA, 25 bp, Rattus norvegicus
gggacaggacatccgattgtacccg

SEQ ID NO: 449455 - DNA, 25 bp, Rattus norvegicus
gggacaggacatgcgattgtacccg

SEQ ID NO: 449456 - DNA, 25 bp, Rattus norvegicus
gggacaggactcaaacatactcata

SEQ ID NO: 449457 - DNA, 25 bp, Rattus norvegicus
gggacaggactctaacatactcata

SEQ ID NO: 449458 - DNA, 25 bp, Rattus norvegicus
gggacaggagccagagcgccacaaa

SEQ ID NO: 449459 - DNA, 25 bp, Rattus norvegicus
gggacaggagcctgagcgccacaaa

SEQ ID NO: 449460 - DNA, 25 bp, Rattus norvegicus
gggacaggcataaacaatctttctt

SEQ ID NO: 449461 - DNA, 25 bp, Rattus norvegicus
gggacaggcatatacaatctttctt

SEQ ID NO: 449462 - DNA, 25 bp, Rattus norvegicus
gggacaggccgaacaacacccgagc

SEQ ID NO: 449463 - DNA, 25 bp, Rattus norvegicus
gggacaggccgatcaacacccgagc

SEQ ID NO: 449464 - DNA, 25 bp, Rattus norvegicus
gggacaggccttcagatcccaactc

SEQ ID NO: 449465 - DNA, 25 bp, Rattus norvegicus
gggacaggccttgagatcccaactc

SEQ ID NO: 449466 - DNA, 25 bp, Rattus norvegicus
gggacaggctctccagcttggtttc

SEQ ID NO: 449467 - DNA, 25 bp, Rattus norvegicus
gggacaggctctgcagcttggtttc

SEQ ID NO: 449468 - DNA, 25 bp, Rattus norvegicus
gggacaggcttcagaaccgcattgc

SEQ ID NO: 449469 - DNA, 25 bp, Rattus norvegicus
gggacaggcttctgaaccgcattgc

SEQ ID NO: 449470 - DNA, 25 bp, Rattus norvegicus
gggacagggacacacagctagccac

SEQ ID NO: 449471 - DNA, 25 bp, Rattus norvegicus
gggacagggacagacagctagccac

SEQ ID NO: 449472 - DNA, 25 bp, Rattus norvegicus
gggacagggaccacatcaatctcat

SEQ ID NO: 449473 - DNA, 25 bp, Rattus norvegicus
gggacagggacctcatcaatctcat

SEQ ID NO: 449474 - DNA, 25 bp, Rattus norvegicus
gggacagggcctagctcttgtagcc

SEQ ID NO: 449475 - DNA, 25 bp, Rattus norvegicus
gggacagggccttgctcttgtagcc

SEQ ID NO: 449476 - DNA, 25 bp, Rattus norvegicus
gggacagggtacacccacaccagag

SEQ ID NO: 449477 - DNA, 25 bp, Rattus norvegicus
gggacagggtactcccacaccagag

SEQ ID NO: 449478 - DNA, 25 bp, Rattus norvegicus
gggacaggtcatagccactatcccc

SEQ ID NO: 449479 - DNA, 25 bp, Rattus norvegicus
gggacaggtcattgccactatcccc

SEQ ID NO: 449480 - DNA, 25 bp, Rattus norvegicus
gggacagtaaatccaagccttcctc

SEQ ID NO: 449481 - DNA, 25 bp, Rattus norvegicus
gggacagtaaatgcaagccttcctc

SEQ ID NO: 449482 - DNA, 25 bp, Rattus norvegicus
gggacagtacaaagctcactggaaa

SEQ ID NO: 449483 - DNA, 25 bp, Rattus norvegicus
gggacagtacaatgctcactggaaa

SEQ ID NO: 449484 - DNA, 25 bp, Rattus norvegicus
gggacagtactcattgcagaaatct

SEQ ID NO: 449485 - DNA, 25 bp, Rattus norvegicus
gggacagtactctttgcagaaatct

SEQ ID NO: 449486 - DNA, 25 bp, Rattus norvegicus
gggacagtaggcacccactacctag

SEQ ID NO: 449487 - DNA, 25 bp, Rattus norvegicus
gggacagtaggcatacctccaacag

SEQ ID NO: 449488 - DNA, 25 bp, Rattus norvegicus
gggacagtaggctcccactacctag

SEQ ID NO: 449489 - DNA, 25 bp, Rattus norvegicus
gggacagtaggcttacctccaacag

SEQ ID NO: 449490 - DNA, 25 bp, Rattus norvegicus
gggacagtagtgagctttcccgcat

SEQ ID NO: 449491 - DNA, 25 bp, Rattus norvegicus
gggacagtagtgtgctttcccgcat

SEQ ID NO: 449492 - DNA, 25 bp, Rattus norvegicus
gggacagtatccatttcccttccgg

SEQ ID NO: 449493 - DNA, 25 bp, Rattus norvegicus
gggacagtatccttttcccttccgg

SEQ ID NO: 449494 - DNA, 25 bp, Rattus norvegicus
gggacagtcaccacctaaacagtgg

SEQ ID NO: 449495 - DNA, 25 bp, Rattus norvegicus
gggacagtcacctcctaaacagtgg

SEQ ID NO: 449496 - DNA, 25 bp, Rattus norvegicus
gggacagtcataatgctgtttgcaa

SEQ ID NO: 449497 - DNA, 25 bp, Rattus norvegicus
gggacagtcatattgctgtttgcaa

SEQ ID NO: 449498 - DNA, 25 bp, Rattus norvegicus
gggacagtccatcccaagatactct

SEQ ID NO: 449499 - DNA, 25 bp, Rattus norvegicus
gggacagtccatgccaagatactct

SEQ ID NO: 449500 - DNA, 25 bp, Rattus norvegicus
gggacagtccctcaaaacagccaca

SEQ ID NO: 449501 - DNA, 25 bp, Rattus norvegicus
gggacagtccctgaaaacagccaca

SEQ ID NO: 449502 - DNA, 25 bp, Rattus norvegicus
gggacagtccttattcacacatcta

SEQ ID NO: 449503 - DNA, 25 bp, Rattus norvegicus
gggacagtcctttttcacacatcta

SEQ ID NO: 449504 - DNA, 25 bp, Rattus norvegicus
gggacagtctgacggtatgcttttt

SEQ ID NO: 449505 - DNA, 25 bp, Rattus norvegicus
gggacagtctgagggtatgcttttt

SEQ ID NO: 449506 - DNA, 25 bp, Rattus norvegicus
gggacagtcttacaacaaacacctt

SEQ ID NO: 449507 - DNA, 25 bp, Rattus norvegicus
gggacagtcttagaacaaacacctt

SEQ ID NO: 449508 - DNA, 25 bp, Rattus norvegicus
gggacagtgacacctatcatacctt

SEQ ID NO: 449509 - DNA, 25 bp, Rattus norvegicus
gggacagtgacagctatcatacctt

SEQ ID NO: 449510 - DNA, 25 bp, Rattus norvegicus
gggacagtgatcaaaaccccacact

SEQ ID NO: 449511 - DNA, 25 bp, Rattus norvegicus
gggacagtgatctaaaccccacact

SEQ ID NO: 449512 - DNA, 25 bp, Rattus norvegicus
gggacagtgcagctcagttccaaaa

SEQ ID NO: 449513 - DNA, 25 bp, Rattus norvegicus
gggacagtgcaggtcagttccaaaa

SEQ ID NO: 449514 - DNA, 25 bp, Rattus norvegicus
gggacagtgccaagcatgatgccgt

SEQ ID NO: 449515 - DNA, 25 bp, Rattus norvegicus
gggacagtgccatgcatgatgccgt

SEQ ID NO: 449516 - DNA, 25 bp, Rattus norvegicus
gggacagtgctgagttttaatttgt

SEQ ID NO: 449517 - DNA, 25 bp, Rattus norvegicus
gggacagtgctgtgttttaatttgt

SEQ ID NO: 449518 - DNA, 25 bp, Rattus norvegicus
gggacagtgtgactgctcagccctt

SEQ ID NO: 449519 - DNA, 25 bp, Rattus norvegicus
gggacagtgtgagtgctcagccctt

SEQ ID NO: 449520 - DNA, 25 bp, Rattus norvegicus
gggacagttacccagttgttcaatg

SEQ ID NO: 449521 - DNA, 25 bp, Rattus norvegicus
gggacagttaccgagttgttcaatg

SEQ ID NO: 449522 - DNA, 25 bp, Rattus norvegicus
gggacagttcctatgcctctttaca

SEQ ID NO: 449523 - DNA, 25 bp, Rattus norvegicus
gggacagttcctttgcctctttaca

SEQ ID NO: 449524 - DNA, 25 bp, Rattus norvegicus
gggacagttggcaagaacccagctt

SEQ ID NO: 449525 - DNA, 25 bp, Rattus norvegicus
gggacagttggctagaacccagctt

SEQ ID NO: 449526 - DNA, 25 bp, Rattus norvegicus
gggacagttgtgactctgctgtgcc

SEQ ID NO: 449527 - DNA, 25 bp, Rattus norvegicus
gggacagttgtgtctctgctgtgcc

SEQ ID NO: 449528 - DNA, 25 bp, Rattus norvegicus
gggacagtttatatctctacgtgct

SEQ ID NO: 449529 - DNA, 25 bp, Rattus norvegicus
gggacagtttatttctctacgtgct

SEQ ID NO: 449530 - DNA, 25 bp, Rattus norvegicus
gggacataattcctaatttctctag

SEQ ID NO: 449531 - DNA, 25 bp, Rattus norvegicus
gggacataattcgtaatttctctag

SEQ ID NO: 449532 - DNA, 25 bp, Rattus norvegicus
gggacataccacctggaatcagaaa

SEQ ID NO: 449533 - DNA, 25 bp, Rattus norvegicus
gggacataccacgtggaatcagaaa

SEQ ID NO: 449534 - DNA, 25 bp, Rattus norvegicus
gggacatagcaccagcagataacat

SEQ ID NO: 449535 - DNA, 25 bp, Rattus norvegicus
gggacatagcacgagcagataacat

SEQ ID NO: 449536 - DNA, 25 bp, Rattus norvegicus
gggacatatatgaaactcaccagac

SEQ ID NO: 449537 - DNA, 25 bp, Rattus norvegicus
gggacatatatgtaactcaccagac

SEQ ID NO: 449538 - DNA, 25 bp, Rattus norvegicus
gggacatatcaaacaacctccaaca

SEQ ID NO: 449539 - DNA, 25 bp, Rattus norvegicus
gggacatatcaatcaacctccaaca

SEQ ID NO: 449540 - DNA, 25 bp, Rattus norvegicus
gggacatatgcgagttttagcacaa

SEQ ID NO: 449541 - DNA, 25 bp, Rattus norvegicus
gggacatatgcgtgttttagcacaa

SEQ ID NO: 449542 - DNA, 25 bp, Rattus norvegicus
gggacatattctactctcaatccta

SEQ ID NO: 449543 - DNA, 25 bp, Rattus norvegicus
gggacatattctctgtatagttaat

SEQ ID NO: 449544 - DNA, 25 bp, Rattus norvegicus
gggacatattctgtgtatagttaat

SEQ ID NO: 449545 - DNA, 25 bp, Rattus norvegicus
gggacatattcttctctcaatccta

SEQ ID NO: 449546 - DNA, 25 bp, Rattus norvegicus
gggacatatttcctgctaccaatat

SEQ ID NO: 449547 - DNA, 25 bp, Rattus norvegicus
gggacatatttcgtgctaccaatat

SEQ ID NO: 449548 - DNA, 25 bp, Rattus norvegicus
gggacatcaaatcgtcttaatcact

SEQ ID NO: 449549 - DNA, 25 bp, Rattus norvegicus
gggacatcaaatggtcttaatcact

SEQ ID NO: 449550 - DNA, 25 bp, Rattus norvegicus
gggacatcaactctcttatttctga

SEQ ID NO: 449551 - DNA, 25 bp, Rattus norvegicus
gggacatcaactgtcttatttctga

SEQ ID NO: 449552 - DNA, 25 bp, Rattus norvegicus
gggacatcaatactgctgtgtgtag

SEQ ID NO: 449553 - DNA, 25 bp, Rattus norvegicus
gggacatcaatagtgctgtgtgtag

SEQ ID NO: 449554 - DNA, 25 bp, Rattus norvegicus
gggacatcacataagcaccttcatc

SEQ ID NO: 449555 - DNA, 25 bp, Rattus norvegicus
gggacatcacattagcaccttcatc

SEQ ID NO: 449556 - DNA, 25 bp, Rattus norvegicus
gggacatcatcactttagcttgcta

SEQ ID NO: 449557 - DNA, 25 bp, Rattus norvegicus
gggacatcatcagtttagcttgcta

SEQ ID NO: 449558 - DNA, 25 bp, Rattus norvegicus
gggacatcatgtatacgcagcgttt

SEQ ID NO: 449559 - DNA, 25 bp, Rattus norvegicus
gggacatcatgtttacgcagcgttt

SEQ ID NO: 449560 - DNA, 25 bp, Rattus norvegicus
gggacatcattgcaacctgagcagg

SEQ ID NO: 449561 - DNA, 25 bp, Rattus norvegicus
gggacatcattggaacctgagcagg

SEQ ID NO: 449562 - DNA, 25 bp, Rattus norvegicus
gggacatccacccagaaatcctatg

SEQ ID NO: 449563 - DNA, 25 bp, Rattus norvegicus
gggacatccaccgagaaatcctatg

SEQ ID NO: 449564 - DNA, 25 bp, Rattus norvegicus
gggacatccatcatctcaacaaaga

SEQ ID NO: 449565 - DNA, 25 bp, Rattus norvegicus
gggacatccatcttctcaacaaaga

SEQ ID NO: 449566 - DNA, 25 bp, Rattus norvegicus
gggacatcccataagtagtttcaag

SEQ ID NO: 449567 - DNA, 25 bp, Rattus norvegicus
gggacatcccattagtagtttcaag

SEQ ID NO: 449568 - DNA, 25 bp, Rattus norvegicus
gggacatcccctcaagggacgtcag

SEQ ID NO: 449569 - DNA, 25 bp, Rattus norvegicus
gggacatcccctgaagggacgtcag

SEQ ID NO: 449570 - DNA, 25 bp, Rattus norvegicus
gggacatcctagcttctgtcagtga

SEQ ID NO: 449571 - DNA, 25 bp, Rattus norvegicus
gggacatcctaggttctgtcagtga

SEQ ID NO: 449572 - DNA, 25 bp, Rattus norvegicus
gggacatcctatatttacattattg

SEQ ID NO: 449573 - DNA, 25 bp, Rattus norvegicus
gggacatcctatttttacattattg

SEQ ID NO: 449574 - DNA, 25 bp, Rattus norvegicus
gggacatcctcacataacattcact

SEQ ID NO: 449575 - DNA, 25 bp, Rattus norvegicus
gggacatcctcagataacattcact

SEQ ID NO: 449576 - DNA, 25 bp, Rattus norvegicus
gggacatcctctagtctggcgcatg

SEQ ID NO: 449577 - DNA, 25 bp, Rattus norvegicus
gggacatcctcttgtctggcgcatg

SEQ ID NO: 449578 - DNA, 25 bp, Rattus norvegicus
gggacatcctttacagattatcctg

SEQ ID NO: 449579 - DNA, 25 bp, Rattus norvegicus
gggacatccttttcagattatcctg

SEQ ID NO: 449580 - DNA, 25 bp, Rattus norvegicus
gggacatcggttatactggagcact

SEQ ID NO: 449581 - DNA, 25 bp, Rattus norvegicus
gggacatcggttttactggagcact

SEQ ID NO: 449582 - DNA, 25 bp, Rattus norvegicus
gggacatctaacaagctgtcacctc

SEQ ID NO: 449583 - DNA, 25 bp, Rattus norvegicus
gggacatctaactagctgtcacctc

SEQ ID NO: 449584 - DNA, 25 bp, Rattus norvegicus
gggacatctacaccacagactacta

SEQ ID NO: 449585 - DNA, 25 bp, Rattus norvegicus
gggacatctacagcacagactacta

SEQ ID NO: 449586 - DNA, 25 bp, Rattus norvegicus
gggacatctactatggcttccaaaa

SEQ ID NO: 449587 - DNA, 25 bp, Rattus norvegicus
gggacatctactttggcttccaaaa

SEQ ID NO: 449588 - DNA, 25 bp, Rattus norvegicus
gggacatctcaaactcgaaaggctg

SEQ ID NO: 449589 - DNA, 25 bp, Rattus norvegicus
gggacatctcaatctcgaaaggctg

SEQ ID NO: 449590 - DNA, 25 bp, Rattus norvegicus
gggacatctcggaggcttcctttct

SEQ ID NO: 449591 - DNA, 25 bp, Rattus norvegicus
gggacatctcggtggcttcctttct

SEQ ID NO: 449592 - DNA, 25 bp, Rattus norvegicus
gggacatctgagctggtgaacctca

SEQ ID NO: 449593 - DNA, 25 bp, Rattus norvegicus
gggacatctgaggtggtgaacctca

SEQ ID NO: 449594 - DNA, 25 bp, Rattus norvegicus
gggacatctggcctgaagttgcctt

SEQ ID NO: 449595 - DNA, 25 bp, Rattus norvegicus
gggacatctggcgtgaagttgcctt

SEQ ID NO: 449596 - DNA, 25 bp, Rattus norvegicus
gggacatctggtctgagacgcttca

SEQ ID NO: 449597 - DNA, 25 bp, Rattus norvegicus
gggacatctggtgtgagacgcttca

SEQ ID NO: 449598 - DNA, 25 bp, Rattus norvegicus
gggacatctgtcagtttaccataca

SEQ ID NO: 449599 - DNA, 25 bp, Rattus norvegicus
gggacatctgtctgtttaccataca

SEQ ID NO: 449600 - DNA, 25 bp, Rattus norvegicus
gggacatcttacaactgttctttct

SEQ ID NO: 449601 - DNA, 25 bp, Rattus norvegicus
gggacatcttactactgttctttct

SEQ ID NO: 449602 - DNA, 25 bp, Rattus norvegicus
gggacatcttgccttggatctattc

SEQ ID NO: 449603 - DNA, 25 bp, Rattus norvegicus
gggacatcttgcgttggatctattc

SEQ ID NO: 449604 - DNA, 25 bp, Rattus norvegicus
gggacatgaccaacattaccttttt

SEQ ID NO: 449605 - DNA, 25 bp, Rattus norvegicus
gggacatgaccatcattaccttttt

SEQ ID NO: 449606 - DNA, 25 bp, Rattus norvegicus
gggacatgacccagccaaggaattt

SEQ ID NO: 449607 - DNA, 25 bp, Rattus norvegicus
gggacatgaccctgccaaggaattt

SEQ ID NO: 449608 - DNA, 25 bp, Rattus norvegicus
gggacatgagccatctagtctctgc

SEQ ID NO: 449609 - DNA, 25 bp, Rattus norvegicus
gggacatgagccttctagtctctgc

SEQ ID NO: 449610 - DNA, 25 bp, Rattus norvegicus
gggacatgagtgagtgcgcctctat

SEQ ID NO: 449611 - DNA, 25 bp, Rattus norvegicus
gggacatgagtgtgtgcgcctctat

SEQ ID NO: 449612 - DNA, 25 bp, Rattus norvegicus
gggacatgcaatattacttttgtaa

SEQ ID NO: 449613 - DNA, 25 bp, Rattus norvegicus
gggacatgcaattttacttttgtaa

SEQ ID NO: 449614 - DNA, 25 bp, Rattus norvegicus
gggacatgcagacagcctagcttca

SEQ ID NO: 449615 - DNA, 25 bp, Rattus norvegicus
gggacatgcagagagcctagcttca

SEQ ID NO: 449616 - DNA, 25 bp, Rattus norvegicus
gggacatgcatgctatatacccact

SEQ ID NO: 449617 - DNA, 25 bp, Rattus norvegicus
gggacatgcatggtatatacccact

SEQ ID NO: 449618 - DNA, 25 bp, Rattus norvegicus
gggacatgccatatgttgtgacccg

SEQ ID NO: 449619 - DNA, 25 bp, Rattus norvegicus
gggacatgccatttgttgtgacccg

SEQ ID NO: 449620 - DNA, 25 bp, Rattus norvegicus
gggacatgcccgacagacaagccat

SEQ ID NO: 449621 - DNA, 25 bp, Rattus norvegicus
gggacatgcccgtcagacaagccat

SEQ ID NO: 449622 - DNA, 25 bp, Rattus norvegicus
gggacatggagcctgtcttatatca

SEQ ID NO: 449623 - DNA, 25 bp, Rattus norvegicus
gggacatggagcgtgtcttatatca

SEQ ID NO: 449624 - DNA, 25 bp, Rattus norvegicus
gggacatggatcatgcccaatcaga

SEQ ID NO: 449625 - DNA, 25 bp, Rattus norvegicus
gggacatggatcttgcccaatcaga

SEQ ID NO: 449626 - DNA, 25 bp, Rattus norvegicus
gggacatggattcagctgcctttga

SEQ ID NO: 449627 - DNA, 25 bp, Rattus norvegicus
gggacatggattgagctgcctttga

SEQ ID NO: 449628 - DNA, 25 bp, Rattus norvegicus
gggacatggctgaactggaccttta

SEQ ID NO: 449629 - DNA, 25 bp, Rattus norvegicus
gggacatggctgtactggaccttta

SEQ ID NO: 449630 - DNA, 25 bp, Rattus norvegicus
gggacatgggccaggaaccccagca

SEQ ID NO: 449631 - DNA, 25 bp, Rattus norvegicus
gggacatgggcctggaaccccagca

SEQ ID NO: 449632 - DNA, 25 bp, Rattus norvegicus
gggacatgggttaaacagcattcac

SEQ ID NO: 449633 - DNA, 25 bp, Rattus norvegicus
gggacatgggtttaacagcattcac

SEQ ID NO: 449634 - DNA, 25 bp, Rattus norvegicus
gggacatggtacactccacaaaggc

SEQ ID NO: 449635 - DNA, 25 bp, Rattus norvegicus
gggacatggtactctccacaaaggc

SEQ ID NO: 449636 - DNA, 25 bp, Rattus norvegicus
gggacatggttcaggccagccctat

SEQ ID NO: 449637 - DNA, 25 bp, Rattus norvegicus
gggacatggttctggccagccctat

SEQ ID NO: 449638 - DNA, 25 bp, Rattus norvegicus
gggacatgtaccacacttaagcagg

SEQ ID NO: 449639 - DNA, 25 bp, Rattus norvegicus
gggacatgtacctcacttaagcagg

SEQ ID NO: 449640 - DNA, 25 bp, Rattus norvegicus
gggacatgtcataatgacaactttt

SEQ ID NO: 449641 - DNA, 25 bp, Rattus norvegicus
gggacatgtcattatgacaactttt

SEQ ID NO: 449642 - DNA, 25 bp, Rattus norvegicus
gggacatgtcctacagattggcaat

SEQ ID NO: 449643 - DNA, 25 bp, Rattus norvegicus
gggacatgtccttcagattggcaat

SEQ ID NO: 449644 - DNA, 25 bp, Rattus norvegicus
gggacatgtctaacagttgtgtcct

SEQ ID NO: 449645 - DNA, 25 bp, Rattus norvegicus
gggacatgtctacttggtgttgtat

SEQ ID NO: 449646 - DNA, 25 bp, Rattus norvegicus
gggacatgtctagttggtgttgtat

SEQ ID NO: 449647 - DNA, 25 bp, Rattus norvegicus
gggacatgtctatcagttgtgtcct

SEQ ID NO: 449648 - DNA, 25 bp, Rattus norvegicus
gggacatgtctgaaatctcagcttg

SEQ ID NO: 449649 - DNA, 25 bp, Rattus norvegicus
gggacatgtctgtaatctcagcttg

SEQ ID NO: 449650 - DNA, 25 bp, Rattus norvegicus
gggacatgtgaaccttgatctcatt

SEQ ID NO: 449651 - DNA, 25 bp, Rattus norvegicus
gggacatgtgaagcttgatctcatt

SEQ ID NO: 449652 - DNA, 25 bp, Rattus norvegicus
gggacatgtgccagcagtacacgct

SEQ ID NO: 449653 - DNA, 25 bp, Rattus norvegicus
gggacatgtgcctgcagtacacgct

SEQ ID NO: 449654 - DNA, 25 bp, Rattus norvegicus
gggacatgtgtacacaatgggctta

SEQ ID NO: 449655 - DNA, 25 bp, Rattus norvegicus
gggacatgtgtagacaatgggctta

SEQ ID NO: 449656 - DNA, 25 bp, Rattus norvegicus
gggacatgtttcattcttcattgga

SEQ ID NO: 449657 - DNA, 25 bp, Rattus norvegicus
gggacatgtttctttcttcattgga

SEQ ID NO: 449658 - DNA, 25 bp, Rattus norvegicus
gggacattatcactgctcagcatgg

SEQ ID NO: 449659 - DNA, 25 bp, Rattus norvegicus
gggacattatcagtgctcagcatgg

SEQ ID NO: 449660 - DNA, 25 bp, Rattus norvegicus
gggacattattaacacttctggctt

SEQ ID NO: 449661 - DNA, 25 bp, Rattus norvegicus
gggacattattatcacttctggctt

SEQ ID NO: 449662 - DNA, 25 bp, Rattus norvegicus
gggacattcacacttacctacaaag

SEQ ID NO: 449663 - DNA, 25 bp, Rattus norvegicus
gggacattcacagttacctacaaag

SEQ ID NO: 449664 - DNA, 25 bp, Rattus norvegicus
gggacattcagaccacctcaggaag

SEQ ID NO: 449665 - DNA, 25 bp, Rattus norvegicus
gggacattcagagcacctcaggaag

SEQ ID NO: 449666 - DNA, 25 bp, Rattus norvegicus
gggacattcataatctaaccactaa

SEQ ID NO: 449667 - DNA, 25 bp, Rattus norvegicus
gggacattcatattctaaccactaa

SEQ ID NO: 449668 - DNA, 25 bp, Rattus norvegicus
gggacattcgtcacttcagtaaact

SEQ ID NO: 449669 - DNA, 25 bp, Rattus norvegicus
gggacattcgtctcttcagtaaact

SEQ ID NO: 449670 - DNA, 25 bp, Rattus norvegicus
gggacattctccagactgggactcc

SEQ ID NO: 449671 - DNA, 25 bp, Rattus norvegicus
gggacattctcctgactgggactcc

SEQ ID NO: 449672 - DNA, 25 bp, Rattus norvegicus
gggacattctggaactgctggtcag

SEQ ID NO: 449673 - DNA, 25 bp, Rattus norvegicus
gggacattctggtactgctggtcag

SEQ ID NO: 449674 - DNA, 25 bp, Rattus norvegicus
gggacattcttgctcaaaccgcaga

SEQ ID NO: 449675 - DNA, 25 bp, Rattus norvegicus
gggacattcttggtcaaaccgcaga

SEQ ID NO: 449676 - DNA, 25 bp, Rattus norvegicus
gggacattgagcacctcactggtct

SEQ ID NO: 449677 - DNA, 25 bp, Rattus norvegicus
gggacattgagctcctcactggtct

SEQ ID NO: 449678 - DNA, 25 bp, Rattus norvegicus
gggacattgctcaagcttaggcctt

SEQ ID NO: 449679 - DNA, 25 bp, Rattus norvegicus
gggacattgctccattgaatttgcc

SEQ ID NO: 449680 - DNA, 25 bp, Rattus norvegicus
gggacattgctcgattgaatttgcc

SEQ ID NO: 449681 - DNA, 25 bp, Rattus norvegicus
gggacattgctctagcttaggcctt

SEQ ID NO: 449682 - DNA, 25 bp, Rattus norvegicus
gggacattgtagaaccccaaatatc

SEQ ID NO: 449683 - DNA, 25 bp, Rattus norvegicus
gggacattgtagtaccccaaatatc

SEQ ID NO: 449684 - DNA, 25 bp, Rattus norvegicus
gggacattgttcaagttgcctactg

SEQ ID NO: 449685 - DNA, 25 bp, Rattus norvegicus
gggacattgttctagttgcctactg

SEQ ID NO: 449686 - DNA, 25 bp, Rattus norvegicus
gggacattgtttctttcttccacat

SEQ ID NO: 449687 - DNA, 25 bp, Rattus norvegicus
gggacattgtttgtttcttccacat

SEQ ID NO: 449688 - DNA, 25 bp, Rattus norvegicus
gggacatttaacatagtaacatttt

SEQ ID NO: 449689 - DNA, 25 bp, Rattus norvegicus
gggacatttaacttagtaacatttt

SEQ ID NO: 449690 - DNA, 25 bp, Rattus norvegicus
gggacatttcacattcaaacagacc

SEQ ID NO: 449691 - DNA, 25 bp, Rattus norvegicus
gggacatttcactttcaaacagacc

SEQ ID NO: 449692 - DNA, 25 bp, Rattus norvegicus
gggacatttcgtcttgtgtaacaaa

SEQ ID NO: 449693 - DNA, 25 bp, Rattus norvegicus
gggacatttcgtgttgtgtaacaaa

SEQ ID NO: 449694 - DNA, 25 bp, Rattus norvegicus
gggacatttcttcaagcatcactta

SEQ ID NO: 449695 - DNA, 25 bp, Rattus norvegicus
gggacatttcttgaagcatcactta

SEQ ID NO: 449696 - DNA, 25 bp, Rattus norvegicus
gggacatttgaacttaggacttagg

SEQ ID NO: 449697 - DNA, 25 bp, Rattus norvegicus
gggacatttgaagttaggacttagg

SEQ ID NO: 449698 - DNA, 25 bp, Rattus norvegicus
gggacatttgggacgtcactgttgt

SEQ ID NO: 449699 - DNA, 25 bp, Rattus norvegicus
gggacatttgggtcgtcactgttgt

SEQ ID NO: 449700 - DNA, 25 bp, Rattus norvegicus
gggacatttgtaatccggccgacag

SEQ ID NO: 449701 - DNA, 25 bp, Rattus norvegicus
gggacatttgtactgagactccaat

SEQ ID NO: 449702 - DNA, 25 bp, Rattus norvegicus
gggacatttgtagtgagactccaat

SEQ ID NO: 449703 - DNA, 25 bp, Rattus norvegicus
gggacatttgtattccggccgacag

SEQ ID NO: 449704 - DNA, 25 bp, Rattus norvegicus
gggacatttgttcccctggaccgga

SEQ ID NO: 449705 - DNA, 25 bp, Rattus norvegicus
gggacatttgttgccctggaccgga

SEQ ID NO: 449706 - DNA, 25 bp, Rattus norvegicus
gggacattttctcgccaggaggaca

SEQ ID NO: 449707 - DNA, 25 bp, Rattus norvegicus
gggacattttctggccaggaggaca

SEQ ID NO: 449708 - DNA, 25 bp, Rattus norvegicus
gggacattttgcatcctgctttatt

SEQ ID NO: 449709 - DNA, 25 bp, Rattus norvegicus
gggacattttgcttcctgctttatt

SEQ ID NO: 449710 - DNA, 25 bp, Rattus norvegicus
gggacattttgtctgaatctaagga

SEQ ID NO: 449711 - DNA, 25 bp, Rattus norvegicus
gggacattttgtgtgaatctaagga

SEQ ID NO: 449712 - DNA, 25 bp, Rattus norvegicus
gggaccaaaaatccacttgtttctt

SEQ ID NO: 449713 - DNA, 25 bp, Rattus norvegicus
gggaccaaaaatgcacttgtttctt

SEQ ID NO: 449714 - DNA, 25 bp, Rattus norvegicus
gggaccaaaccaatgatgcgcatgg

SEQ ID NO: 449715 - DNA, 25 bp, Rattus norvegicus
gggaccaaaccattgatgcgcatgg

SEQ ID NO: 449716 - DNA, 25 bp, Rattus norvegicus
gggaccaaacccaggcctaggcaag

SEQ ID NO: 449717 - DNA, 25 bp, Rattus norvegicus
gggaccaaaccctggcctaggcaag

SEQ ID NO: 449718 - DNA, 25 bp, Rattus norvegicus
gggaccaaagatcttgacctgggat

SEQ ID NO: 449719 - DNA, 25 bp, Rattus norvegicus
gggaccaaagatgttgacctgggat

SEQ ID NO: 449720 - DNA, 25 bp, Rattus norvegicus
gggaccaaagctctagaccatcacc

SEQ ID NO: 449721 - DNA, 25 bp, Rattus norvegicus
gggaccaaagctgtagaccatcacc

SEQ ID NO: 449722 - DNA, 25 bp, Rattus norvegicus
gggaccaaaggcatcattctctgtg

SEQ ID NO: 449723 - DNA, 25 bp, Rattus norvegicus
gggaccaaaggcttcattctctgtg

SEQ ID NO: 449724 - DNA, 25 bp, Rattus norvegicus
gggaccaaatctcggtcttctgcaa

SEQ ID NO: 449725 - DNA, 25 bp, Rattus norvegicus
gggaccaaatctgggtcttctgcaa

SEQ ID NO: 449726 - DNA, 25 bp, Rattus norvegicus
gggaccaaatgtaggcacctttcct

SEQ ID NO: 449727 - DNA, 25 bp, Rattus norvegicus
gggaccaaatgttggcacctttcct

SEQ ID NO: 449728 - DNA, 25 bp, Rattus norvegicus
gggaccaaattcaaaacttgctaat

SEQ ID NO: 449729 - DNA, 25 bp, Rattus norvegicus
gggaccaaattctaaacttgctaat

SEQ ID NO: 449730 - DNA, 25 bp, Rattus norvegicus
gggaccaacagacagcttcaccctt

SEQ ID NO: 449731 - DNA, 25 bp, Rattus norvegicus
gggaccaacagagagcttcaccctt

SEQ ID NO: 449732 - DNA, 25 bp, Rattus norvegicus
gggaccaacatcagtgatctaactt

SEQ ID NO: 449733 - DNA, 25 bp, Rattus norvegicus
gggaccaacatctgtgatctaactt

SEQ ID NO: 449734 - DNA, 25 bp, Rattus norvegicus
gggaccaacattcttagatacttag

SEQ ID NO: 449735 - DNA, 25 bp, Rattus norvegicus
gggaccaacattgttagatacttag

SEQ ID NO: 449736 - DNA, 25 bp, Rattus norvegicus
gggaccaaccagagtggcttctcca

SEQ ID NO: 449737 - DNA, 25 bp, Rattus norvegicus
gggaccaaccagtgtggcttctcca

SEQ ID NO: 449738 - DNA, 25 bp, Rattus norvegicus
gggaccaactcaccaagaacctttt

SEQ ID NO: 449739 - DNA, 25 bp, Rattus norvegicus
gggaccaactcagcaagaacctttt

SEQ ID NO: 449740 - DNA, 25 bp, Rattus norvegicus
gggaccaagacaaacttagatgcac

SEQ ID NO: 449741 - DNA, 25 bp, Rattus norvegicus
gggaccaagacatacttagatgcac

SEQ ID NO: 449742 - DNA, 25 bp, Rattus norvegicus
gggaccaagcaaagatactgttctg

SEQ ID NO: 449743 - DNA, 25 bp, Rattus norvegicus
gggaccaagcaatgatactgttctg

SEQ ID NO: 449744 - DNA, 25 bp, Rattus norvegicus
gggaccaagggtcacagcctacaag

SEQ ID NO: 449745 - DNA, 25 bp, Rattus norvegicus
gggaccaagggtgacagcctacaag

SEQ ID NO: 449746 - DNA, 25 bp, Rattus norvegicus
gggaccaatccaaatcatagcatat

SEQ ID NO: 449747 - DNA, 25 bp, Rattus norvegicus
gggaccaatccatatcatagcatat

SEQ ID NO: 449748 - DNA, 25 bp, Rattus norvegicus
gggaccaatcctctgactttacaag

SEQ ID NO: 449749 - DNA, 25 bp, Rattus norvegicus
gggaccaatcctgtgactttacaag

SEQ ID NO: 449750 - DNA, 25 bp, Rattus norvegicus
gggaccaatcgtcgcagttcagaca

SEQ ID NO: 449751 - DNA, 25 bp, Rattus norvegicus
gggaccaatcgtggcagttcagaca

SEQ ID NO: 449752 - DNA, 25 bp, Rattus norvegicus
gggaccaatgctattaactttgcat

SEQ ID NO: 449753 - DNA, 25 bp, Rattus norvegicus
gggaccaatgcttttaactttgcat

SEQ ID NO: 449754 - DNA, 25 bp, Rattus norvegicus
gggaccaatgggatatctggctata

SEQ ID NO: 449755 - DNA, 25 bp, Rattus norvegicus
gggaccaatgggttatctggctata

SEQ ID NO: 449756 - DNA, 25 bp, Rattus norvegicus
gggaccaatgttcttcactgggaca

SEQ ID NO: 449757 - DNA, 25 bp, Rattus norvegicus
gggaccaatgttgttcactgggaca

SEQ ID NO: 449758 - DNA, 25 bp, Rattus norvegicus
gggaccaattacctcggttatgcag

SEQ ID NO: 449759 - DNA, 25 bp, Rattus norvegicus
gggaccaattacgtcggttatgcag

SEQ ID NO: 449760 - DNA, 25 bp, Rattus norvegicus
gggaccacaagaatgcggcaactac

SEQ ID NO: 449761 - DNA, 25 bp, Rattus norvegicus
gggaccacaagattgcggcaactac

SEQ ID NO: 449762 - DNA, 25 bp, Rattus norvegicus
gggaccacaatcatcggtcaaatgt

SEQ ID NO: 449763 - DNA, 25 bp, Rattus norvegicus
gggaccacaatcttcggtcaaatgt

SEQ ID NO: 449764 - DNA, 25 bp, Rattus norvegicus
gggaccacacagctgcaactgacaa

SEQ ID NO: 449765 - DNA, 25 bp, Rattus norvegicus
gggaccacacaggtgcaactgacaa

SEQ ID NO: 449766 - DNA, 25 bp, Rattus norvegicus
gggaccacacccatggaagaaacac

SEQ ID NO: 449767 - DNA, 25 bp, Rattus norvegicus
gggaccacacccttggaagaaacac

SEQ ID NO: 449768 - DNA, 25 bp, Rattus norvegicus
gggaccacacctactatgacattgt

SEQ ID NO: 449769 - DNA, 25 bp, Rattus norvegicus
gggaccacaccttctatgacattgt

SEQ ID NO: 449770 - DNA, 25 bp, Rattus norvegicus
gggaccacactcatgatcaagtttg

SEQ ID NO: 449771 - DNA, 25 bp, Rattus norvegicus
gggaccacactcttgatcaagtttg

SEQ ID NO: 449772 - DNA, 25 bp, Rattus norvegicus
gggaccacaggtctgtgtcgccaca

SEQ ID NO: 449773 - DNA, 25 bp, Rattus norvegicus
gggaccacaggtgtgtgtcgccaca

SEQ ID NO: 449774 - DNA, 25 bp, Rattus norvegicus
gggaccacagtaattgaatgtgtga

SEQ ID NO: 449775 - DNA, 25 bp, Rattus norvegicus
gggaccacagtatttgaatgtgtga

SEQ ID NO: 449776 - DNA, 25 bp, Rattus norvegicus
gggaccacatccagactgaacctca

SEQ ID NO: 449777 - DNA, 25 bp, Rattus norvegicus
gggaccacatcctgactgaacctca

SEQ ID NO: 449778 - DNA, 25 bp, Rattus norvegicus
gggaccacatggatcttcttcatga

SEQ ID NO: 449779 - DNA, 25 bp, Rattus norvegicus
gggaccacatggttcttcttcatga

SEQ ID NO: 449780 - DNA, 25 bp, Rattus norvegicus
gggaccaccagaagtatttccataa

SEQ ID NO: 449781 - DNA, 25 bp, Rattus norvegicus
gggaccaccagatgtatttccataa

SEQ ID NO: 449782 - DNA, 25 bp, Rattus norvegicus
gggaccacccctctgatgagcacta

SEQ ID NO: 449783 - DNA, 25 bp, Rattus norvegicus
gggaccacccctgtgatgagcacta

SEQ ID NO: 449784 - DNA, 25 bp, Rattus norvegicus
gggaccaccgctaccatgacgactg

SEQ ID NO: 449785 - DNA, 25 bp, Rattus norvegicus
gggaccaccgcttccatgacgactg

SEQ ID NO: 449786 - DNA, 25 bp, Rattus norvegicus
gggaccacgctgattaaaccaaatg

SEQ ID NO: 449787 - DNA, 25 bp, Rattus norvegicus
gggaccacgctgtttaaaccaaatg

SEQ ID NO: 449788 - DNA, 25 bp, Rattus norvegicus
gggaccacgggcaacgagatttcct

SEQ ID NO: 449789 - DNA, 25 bp, Rattus norvegicus
gggaccacgggctacgagatttcct

SEQ ID NO: 449790 - DNA, 25 bp, Rattus norvegicus
gggaccacgttacgactccaggtga

SEQ ID NO: 449791 - DNA, 25 bp, Rattus norvegicus
gggaccacgttaggactccaggtga

SEQ ID NO: 449792 - DNA, 25 bp, Rattus norvegicus
gggaccactattaagtctttctctg

SEQ ID NO: 449793 - DNA, 25 bp, Rattus norvegicus
gggaccactatttagtctttctctg

SEQ ID NO: 449794 - DNA, 25 bp, Rattus norvegicus
gggaccactgcaaccatgacggcga

SEQ ID NO: 449795 - DNA, 25 bp, Rattus norvegicus
gggaccactgcatccatgacggcga

SEQ ID NO: 449796 - DNA, 25 bp, Rattus norvegicus
gggaccactggcacctgagtgacct

SEQ ID NO: 449797 - DNA, 25 bp, Rattus norvegicus
gggaccactggctcctgagtgacct

SEQ ID NO: 449798 - DNA, 25 bp, Rattus norvegicus
gggaccactgtcacttccagctaga

SEQ ID NO: 449799 - DNA, 25 bp, Rattus norvegicus
gggaccactgtctcttccagctaga

SEQ ID NO: 449800 - DNA, 25 bp, Rattus norvegicus
gggaccagaacaccaccacaaagta

SEQ ID NO: 449801 - DNA, 25 bp, Rattus norvegicus
gggaccagaacagcaccacaaagta

SEQ ID NO: 449802 - DNA, 25 bp, Rattus norvegicus
gggaccagacaaaatcagctttcat

SEQ ID NO: 449803 - DNA, 25 bp, Rattus norvegicus
gggaccagacaatatcagctttcat

SEQ ID NO: 449804 - DNA, 25 bp, Rattus norvegicus
gggaccagacctcagggttatcagt

SEQ ID NO: 449805 - DNA, 25 bp, Rattus norvegicus
gggaccagacctgagggttatcagt

SEQ ID NO: 449806 - DNA, 25 bp, Rattus norvegicus
gggaccagagcaacccagtggataa

SEQ ID NO: 449807 - DNA, 25 bp, Rattus norvegicus
gggaccagagcatcccagtggataa

SEQ ID NO: 449808 - DNA, 25 bp, Rattus norvegicus
gggaccagaggcacccttcgtctca

SEQ ID NO: 449809 - DNA, 25 bp, Rattus norvegicus
gggaccagaggcctgtaaacttctt

SEQ ID NO: 449810 - DNA, 25 bp, Rattus norvegicus
gggaccagaggcgtgtaaacttctt

SEQ ID NO: 449811 - DNA, 25 bp, Rattus norvegicus
gggaccagaggctcccttcgtctca

SEQ ID NO: 449812 - DNA, 25 bp, Rattus norvegicus
gggaccagatcacccattctaggga

SEQ ID NO: 449813 - DNA, 25 bp, Rattus norvegicus
gggaccagatcagccattctaggga

SEQ ID NO: 449814 - DNA, 25 bp, Rattus norvegicus
gggaccagatggcagcacaccacaa

SEQ ID NO: 449815 - DNA, 25 bp, Rattus norvegicus
gggaccagatgggagcacaccacaa

SEQ ID NO: 449816 - DNA, 25 bp, Rattus norvegicus
gggaccagatgtcactctgcagcag

SEQ ID NO: 449817 - DNA, 25 bp, Rattus norvegicus
gggaccagatgtgactctgcagcag

SEQ ID NO: 449818 - DNA, 25 bp, Rattus norvegicus
gggaccagattgaccggttcagcaa

SEQ ID NO: 449819 - DNA, 25 bp, Rattus norvegicus
gggaccagattgtccggttcagcaa

SEQ ID NO: 449820 - DNA, 25 bp, Rattus norvegicus
gggaccagccacacaacggtatagt

SEQ ID NO: 449821 - DNA, 25 bp, Rattus norvegicus
gggaccagccactcaacggtatagt

SEQ ID NO: 449822 - DNA, 25 bp, Rattus norvegicus
gggaccagcctgaaatttgcctaaa

SEQ ID NO: 449823 - DNA, 25 bp, Rattus norvegicus
gggaccagcctgtaatttgcctaaa

SEQ ID NO: 449824 - DNA, 25 bp, Rattus norvegicus
gggaccagctccacctggaaatgtt

SEQ ID NO: 449825 - DNA, 25 bp, Rattus norvegicus
gggaccagctcctcctggaaatgtt

SEQ ID NO: 449826 - DNA, 25 bp, Rattus norvegicus
gggaccaggactaaacggcaccaga

SEQ ID NO: 449827 - DNA, 25 bp, Rattus norvegicus
gggaccaggacttaacggcaccaga

SEQ ID NO: 449828 - DNA, 25 bp, Rattus norvegicus
gggaccaggtaacaactaggccttg

SEQ ID NO: 449829 - DNA, 25 bp, Rattus norvegicus
gggaccaggtaagaactaggccttg

SEQ ID NO: 449830 - DNA, 25 bp, Rattus norvegicus
gggaccaggtctagctccaccttga

SEQ ID NO: 449831 - DNA, 25 bp, Rattus norvegicus
gggaccaggtcttgctccaccttga

SEQ ID NO: 449832 - DNA, 25 bp, Rattus norvegicus
gggaccagtaaaacaccagcttcat

SEQ ID NO: 449833 - DNA, 25 bp, Rattus norvegicus
gggaccagtaaatcaccagcttcat

SEQ ID NO: 449834 - DNA, 25 bp, Rattus norvegicus
gggaccagtcatcagactccttgaa

SEQ ID NO: 449835 - DNA, 25 bp, Rattus norvegicus
gggaccagtcatgagactccttgaa

SEQ ID NO: 449836 - DNA, 25 bp, Rattus norvegicus
gggaccagtcccagtatctatttaa

SEQ ID NO: 449837 - DNA, 25 bp, Rattus norvegicus
gggaccagtccctgtatctatttaa

SEQ ID NO: 449838 - DNA, 25 bp, Rattus norvegicus
gggaccagtctactacagattcaat

SEQ ID NO: 449839 - DNA, 25 bp, Rattus norvegicus
gggaccagtctagtacagattcaat

SEQ ID NO: 449840 - DNA, 25 bp, Rattus norvegicus
gggaccagtctgagaggccagaaca

SEQ ID NO: 449841 - DNA, 25 bp, Rattus norvegicus
gggaccagtctgtgaggccagaaca

SEQ ID NO: 449842 - DNA, 25 bp, Rattus norvegicus
gggaccagtgccaatgactctgatg

SEQ ID NO: 449843 - DNA, 25 bp, Rattus norvegicus
gggaccagtgcctatgactctgatg

SEQ ID NO: 449844 - DNA, 25 bp, Rattus norvegicus
gggaccagtgtcaaacctctgcttc

SEQ ID NO: 449845 - DNA, 25 bp, Rattus norvegicus
gggaccagtgtctaacctctgcttc

SEQ ID NO: 449846 - DNA, 25 bp, Rattus norvegicus
gggaccagttccactttgaacagta

SEQ ID NO: 449847 - DNA, 25 bp, Rattus norvegicus
gggaccagttcctctttgaacagta

SEQ ID NO: 449848 - DNA, 25 bp, Rattus norvegicus
gggaccataactcctgtttacattc

SEQ ID NO: 449849 - DNA, 25 bp, Rattus norvegicus
gggaccataactgctgtttacattc

SEQ ID NO: 449850 - DNA, 25 bp, Rattus norvegicus
gggaccatacatctctacatttact

SEQ ID NO: 449851 - DNA, 25 bp, Rattus norvegicus
gggaccatacatgtctacatttact

SEQ ID NO: 449852 - DNA, 25 bp, Rattus norvegicus
gggaccatactaattataccttctg

SEQ ID NO: 449853 - DNA, 25 bp, Rattus norvegicus
gggaccatactatttataccttctg

SEQ ID NO: 449854 - DNA, 25 bp, Rattus norvegicus
gggaccataggacgcgcagccccaa

SEQ ID NO: 449855 - DNA, 25 bp, Rattus norvegicus
gggaccataggaggcgcagccccaa

SEQ ID NO: 449856 - DNA, 25 bp, Rattus norvegicus
gggaccatattgagtctgaacctca

SEQ ID NO: 449857 - DNA, 25 bp, Rattus norvegicus
gggaccatattgtgtctgaacctca

SEQ ID NO: 449858 - DNA, 25 bp, Rattus norvegicus
gggaccatcaatagtgatctcacta

SEQ ID NO: 449859 - DNA, 25 bp, Rattus norvegicus
gggaccatcaattgtgatctcacta

SEQ ID NO: 449860 - DNA, 25 bp, Rattus norvegicus
gggaccatctcaacaaacattgagt

SEQ ID NO: 449861 - DNA, 25 bp, Rattus norvegicus
gggaccatctcatcaaacattgagt

SEQ ID NO: 449862 - DNA, 25 bp, Rattus norvegicus
gggaccatctggaccaagatttgga

SEQ ID NO: 449863 - DNA, 25 bp, Rattus norvegicus
gggaccatctggtccaagatttgga

SEQ ID NO: 449864 - DNA, 25 bp, Rattus norvegicus
gggaccatgcacaggtgtatactta

SEQ ID NO: 449865 - DNA, 25 bp, Rattus norvegicus
gggaccatgcactggtgtatactta

SEQ ID NO: 449866 - DNA, 25 bp, Rattus norvegicus
gggaccatgcttaaagtacttgtaa

SEQ ID NO: 449867 - DNA, 25 bp, Rattus norvegicus
gggaccatgcttatctacagttcca

SEQ ID NO: 449868 - DNA, 25 bp, Rattus norvegicus
gggaccatgctttaagtacttgtaa

SEQ ID NO: 449869 - DNA, 25 bp, Rattus norvegicus
gggaccatgcttttctacagttcca

SEQ ID NO: 449870 - DNA, 25 bp, Rattus norvegicus
gggaccatggcgaacaagtcttttt

SEQ ID NO: 449871 - DNA, 25 bp, Rattus norvegicus
gggaccatggcgtacaagtcttttt

SEQ ID NO: 449872 - DNA, 25 bp, Rattus norvegicus
gggaccatgtcaccaaatatcttag

SEQ ID NO: 449873 - DNA, 25 bp, Rattus norvegicus
gggaccatgtcagcaaatatcttag

SEQ ID NO: 449874 - DNA, 25 bp, Rattus norvegicus
gggaccatgtttcttttactaccag

SEQ ID NO: 449875 - DNA, 25 bp, Rattus norvegicus
gggaccatgtttgttttactaccag

SEQ ID NO: 449876 - DNA, 25 bp, Rattus norvegicus
gggaccattcagcaagcttaataag

SEQ ID NO: 449877 - DNA, 25 bp, Rattus norvegicus
gggaccattcaggaagcttaataag

SEQ ID NO: 449878 - DNA, 25 bp, Rattus norvegicus
gggaccattctcaaacaccgggcac

SEQ ID NO: 449879 - DNA, 25 bp, Rattus norvegicus
gggaccattctctaacaccgggcac

SEQ ID NO: 449880 - DNA, 25 bp, Rattus norvegicus
gggaccattggcatgtgaagtccat

SEQ ID NO: 449881 - DNA, 25 bp, Rattus norvegicus
gggaccattggcttgtgaagtccat

SEQ ID NO: 449882 - DNA, 25 bp, Rattus norvegicus
gggaccattgggacaccacagaggc

SEQ ID NO: 449883 - DNA, 25 bp, Rattus norvegicus
gggaccattgggtcaccacagaggc

SEQ ID NO: 449884 - DNA, 25 bp, Rattus norvegicus
gggaccattgtgaacctagaccaaa

SEQ ID NO: 449885 - DNA, 25 bp, Rattus norvegicus
gggaccattgtgtacctagaccaaa

SEQ ID NO: 449886 - DNA, 25 bp, Rattus norvegicus
gggaccatttccatcacttgggaat

SEQ ID NO: 449887 - DNA, 25 bp, Rattus norvegicus
gggaccatttccttcacttgggaat

SEQ ID NO: 449888 - DNA, 25 bp, Rattus norvegicus
gggaccatttgcaccatgtaaagca

SEQ ID NO: 449889 - DNA, 25 bp, Rattus norvegicus
gggaccatttgctccatgtaaagca

SEQ ID NO: 449890 - DNA, 25 bp, Rattus norvegicus
gggaccattttcattcggaccatca

SEQ ID NO: 449891 - DNA, 25 bp, Rattus norvegicus
gggaccattttctttcggaccatca

SEQ ID NO: 449892 - DNA, 25 bp, Rattus norvegicus
gggaccatttttctcatcggaataa

SEQ ID NO: 449893 - DNA, 25 bp, Rattus norvegicus
gggaccatttttgtcatcggaataa

SEQ ID NO: 449894 - DNA, 25 bp, Rattus norvegicus
gggacccaacaacttcttctgacct

SEQ ID NO: 449895 - DNA, 25 bp, Rattus norvegicus
gggacccaacaagttcttctgacct

SEQ ID NO: 449896 - DNA, 25 bp, Rattus norvegicus
gggacccaactcacaagcatgacgc

SEQ ID NO: 449897 - DNA, 25 bp, Rattus norvegicus
gggacccaactctcaagcatgacgc

SEQ ID NO: 449898 - DNA, 25 bp, Rattus norvegicus
gggacccacgtcagacagttttgta

SEQ ID NO: 449899 - DNA, 25 bp, Rattus norvegicus
gggacccacgtcctggaaaatcata

SEQ ID NO: 449900 - DNA, 25 bp, Rattus norvegicus
gggacccacgtcgtggaaaatcata

SEQ ID NO: 449901 - DNA, 25 bp, Rattus norvegicus
gggacccacgtctgacagttttgta

SEQ ID NO: 449902 - DNA, 25 bp, Rattus norvegicus
gggacccacgttatggatgcactga

SEQ ID NO: 449903 - DNA, 25 bp, Rattus norvegicus
gggacccacgttttggatgcactga

SEQ ID NO: 449904 - DNA, 25 bp, Rattus norvegicus
gggacccactgaacttgtagagcat

SEQ ID NO: 449905 - DNA, 25 bp, Rattus norvegicus
gggacccactgatcttgtagagcat

SEQ ID NO: 449906 - DNA, 25 bp, Rattus norvegicus
gggacccagaacaatcagcttacaa

SEQ ID NO: 449907 - DNA, 25 bp, Rattus norvegicus
gggacccagaactatcagcttacaa

SEQ ID NO: 449908 - DNA, 25 bp, Rattus norvegicus
gggacccagacaaagcacatcagca

SEQ ID NO: 449909 - DNA, 25 bp, Rattus norvegicus
gggacccagacatagcacatcagca

SEQ ID NO: 449910 - DNA, 25 bp, Rattus norvegicus
gggacccagatgactgccctaagac

SEQ ID NO: 449911 - DNA, 25 bp, Rattus norvegicus
gggacccagatgtctgccctaagac

SEQ ID NO: 449912 - DNA, 25 bp, Rattus norvegicus
gggacccaggatcgtgcaccgggac

SEQ ID NO: 449913 - DNA, 25 bp, Rattus norvegicus
gggacccaggatggtgcaccgggac

SEQ ID NO: 449914 - DNA, 25 bp, Rattus norvegicus
gggacccaggccagaacaagcatta

SEQ ID NO: 449915 - DNA, 25 bp, Rattus norvegicus
gggacccaggcctgaacaagcatta

SEQ ID NO: 449916 - DNA, 25 bp, Rattus norvegicus
gggacccagttcagtcacagctcct

SEQ ID NO: 449917 - DNA, 25 bp, Rattus norvegicus
gggacccagttctgtcacagctcct

SEQ ID NO: 449918 - DNA, 25 bp, Rattus norvegicus
gggacccatcatactcagaccaaaa

SEQ ID NO: 449919 - DNA, 25 bp, Rattus norvegicus
gggacccatcattctcagaccaaaa

SEQ ID NO: 449920 - DNA, 25 bp, Rattus norvegicus
gggacccatctgagaatgacctggt

SEQ ID NO: 449921 - DNA, 25 bp, Rattus norvegicus
gggacccatctgtgaatgacctggt

SEQ ID NO: 449922 - DNA, 25 bp, Rattus norvegicus
gggacccatgacagatcacagcaac

SEQ ID NO: 449923 - DNA, 25 bp, Rattus norvegicus
gggacccatgactgatcacagcaac

SEQ ID NO: 449924 - DNA, 25 bp, Rattus norvegicus
gggacccattctctgaagcaggaag

SEQ ID NO: 449925 - DNA, 25 bp, Rattus norvegicus
gggacccattctgtgaagcaggaag

SEQ ID NO: 449926 - DNA, 25 bp, Rattus norvegicus
gggaccccaaagagccagctgatga

SEQ ID NO: 449927 - DNA, 25 bp, Rattus norvegicus
gggaccccaaagtgccagctgatga

SEQ ID NO: 449928 - DNA, 25 bp, Rattus norvegicus
gggaccccaagacatgacaccttta

SEQ ID NO: 449929 - DNA, 25 bp, Rattus norvegicus
gggaccccaagagatgacaccttta

SEQ ID NO: 449930 - DNA, 25 bp, Rattus norvegicus
gggaccccaagtcgctcaatggttt

SEQ ID NO: 449931 - DNA, 25 bp, Rattus norvegicus
gggaccccaagtggctcaatggttt

SEQ ID NO: 449932 - DNA, 25 bp, Rattus norvegicus
gggaccccaataagttactacctat

SEQ ID NO: 449933 - DNA, 25 bp, Rattus norvegicus
gggaccccaatatgttactacctat

SEQ ID NO: 449934 - DNA, 25 bp, Rattus norvegicus
gggaccccacaacgagagcctgtgg

SEQ ID NO: 449935 - DNA, 25 bp, Rattus norvegicus
gggaccccacaaggagagcctgtgg

SEQ ID NO: 449936 - DNA, 25 bp, Rattus norvegicus
gggaccccagaaccttgctgaccag

SEQ ID NO: 449937 - DNA, 25 bp, Rattus norvegicus
gggaccccagaagcttgctgaccag

SEQ ID NO: 449938 - DNA, 25 bp, Rattus norvegicus
gggaccccatgaaacagccacggac

SEQ ID NO: 449939 - DNA, 25 bp, Rattus norvegicus
gggaccccatgatacagccacggac

SEQ ID NO: 449940 - DNA, 25 bp, Rattus norvegicus
gggacccctatgagtgcgctatact

SEQ ID NO: 449941 - DNA, 25 bp, Rattus norvegicus
gggacccctatgtgtgcgctatact

SEQ ID NO: 449942 - DNA, 25 bp, Rattus norvegicus
gggacccctctaagatgaagtacga

SEQ ID NO: 449943 - DNA, 25 bp, Rattus norvegicus
gggacccctctatgatgaagtacga

SEQ ID NO: 449944 - DNA, 25 bp, Rattus norvegicus
gggacccctggactgtttgtctgct

SEQ ID NO: 449945 - DNA, 25 bp, Rattus norvegicus
gggacccctggagtgtttgtctgct

SEQ ID NO: 449946 - DNA, 25 bp, Rattus norvegicus
gggacccctgtaagtaggctgctta

SEQ ID NO: 449947 - DNA, 25 bp, Rattus norvegicus
gggacccctgtacagaaagctggaa

SEQ ID NO: 449948 - DNA, 25 bp, Rattus norvegicus
gggacccctgtagagaaagctggaa

SEQ ID NO: 449949 - DNA, 25 bp, Rattus norvegicus
gggacccctgtatgtaggctgctta

SEQ ID NO: 449950 - DNA, 25 bp, Rattus norvegicus
gggaccccttagacctcgtggcgct

SEQ ID NO: 449951 - DNA, 25 bp, Rattus norvegicus
gggaccccttagtcctcgtggcgct

SEQ ID NO: 449952 - DNA, 25 bp, Rattus norvegicus
gggacccgaatgacatggatgctaa

SEQ ID NO: 449953 - DNA, 25 bp, Rattus norvegicus
gggacccgaatgtcatggatgctaa

SEQ ID NO: 449954 - DNA, 25 bp, Rattus norvegicus
gggacccgatagaccaagagcctgg

SEQ ID NO: 449955 - DNA, 25 bp, Rattus norvegicus
gggacccgatagtccaagagcctgg

SEQ ID NO: 449956 - DNA, 25 bp, Rattus norvegicus
gggacccgcaagcagcattctcagc

SEQ ID NO: 449957 - DNA, 25 bp, Rattus norvegicus
gggacccgcaaggagcattctcagc

SEQ ID NO: 449958 - DNA, 25 bp, Rattus norvegicus
gggacccgcatcagcgcgaatgcgc

SEQ ID NO: 449959 - DNA, 25 bp, Rattus norvegicus
gggacccgcatctgcgcgaatgcgc

SEQ ID NO: 449960 - DNA, 25 bp, Rattus norvegicus
gggacccggtcgacaccagcgatag

SEQ ID NO: 449961 - DNA, 25 bp, Rattus norvegicus
gggacccggtcgtcaccagcgatag

SEQ ID NO: 449962 - DNA, 25 bp, Rattus norvegicus
gggaccctaaaactaactcatgaga

SEQ ID NO: 449963 - DNA, 25 bp, Rattus norvegicus
gggaccctaaaagtaactcatgaga

SEQ ID NO: 449964 - DNA, 25 bp, Rattus norvegicus
gggaccctaagactctggatcacag

SEQ ID NO: 449965 - DNA, 25 bp, Rattus norvegicus
gggaccctaagagtctggatcacag

SEQ ID NO: 449966 - DNA, 25 bp, Rattus norvegicus
gggaccctactcactatggttacag

SEQ ID NO: 449967 - DNA, 25 bp, Rattus norvegicus
gggaccctactctctatggttacag

SEQ ID NO: 449968 - DNA, 25 bp, Rattus norvegicus
gggaccctactgatatcccaagtgc

SEQ ID NO: 449969 - DNA, 25 bp, Rattus norvegicus
gggaccctactgttatcccaagtgc

SEQ ID NO: 449970 - DNA, 25 bp, Rattus norvegicus
gggaccctagataaagcctttgata

SEQ ID NO: 449971 - DNA, 25 bp, Rattus norvegicus
gggaccctagattaagcctttgata

SEQ ID NO: 449972 - DNA, 25 bp, Rattus norvegicus
gggaccctattgaaatggctcagga

SEQ ID NO: 449973 - DNA, 25 bp, Rattus norvegicus
gggaccctattgtaatggctcagga

SEQ ID NO: 449974 - DNA, 25 bp, Rattus norvegicus
gggaccctcctcaggtgccggcttg

SEQ ID NO: 449975 - DNA, 25 bp, Rattus norvegicus
gggaccctcctctggtgccggcttg

SEQ ID NO: 449976 - DNA, 25 bp, Rattus norvegicus
gggaccctcgcaatgctaatgcagg

SEQ ID NO: 449977 - DNA, 25 bp, Rattus norvegicus
gggaccctcgcattgctaatgcagg

SEQ ID NO: 449978 - DNA, 25 bp, Rattus norvegicus
gggaccctgaaaatccattccagaa

SEQ ID NO: 449979 - DNA, 25 bp, Rattus norvegicus
gggaccctgaaattccattccagaa

SEQ ID NO: 449980 - DNA, 25 bp, Rattus norvegicus
gggaccctgatcatgcctataggaa

SEQ ID NO: 449981 - DNA, 25 bp, Rattus norvegicus
gggaccctgatcttgcctataggaa

SEQ ID NO: 449982 - DNA, 25 bp, Rattus norvegicus
gggaccctgcctacgagtgatgctg

SEQ ID NO: 449983 - DNA, 25 bp, Rattus norvegicus
gggaccctgccttcgagtgatgctg

SEQ ID NO: 449984 - DNA, 25 bp, Rattus norvegicus
gggaccctgctgaagctacgcagca

SEQ ID NO: 449985 - DNA, 25 bp, Rattus norvegicus
gggaccctgctgatatgtgactatg

SEQ ID NO: 449986 - DNA, 25 bp, Rattus norvegicus
gggaccctgctgtagctacgcagca

SEQ ID NO: 449987 - DNA, 25 bp, Rattus norvegicus
gggaccctgctgttatgtgactatg

SEQ ID NO: 449988 - DNA, 25 bp, Rattus norvegicus
gggaccctgcttatctttacttgct

SEQ ID NO: 449989 - DNA, 25 bp, Rattus norvegicus
gggaccctgcttttctttacttgct

SEQ ID NO: 449990 - DNA, 25 bp, Rattus norvegicus
gggaccctgggcacacagtattaag

SEQ ID NO: 449991 - DNA, 25 bp, Rattus norvegicus
gggaccctgggctcacagtattaag

SEQ ID NO: 449992 - DNA, 25 bp, Rattus norvegicus
gggaccctgggtcgtattctcccag

SEQ ID NO: 449993 - DNA, 25 bp, Rattus norvegicus
gggaccctgggtggtattctcccag

SEQ ID NO: 449994 - DNA, 25 bp, Rattus norvegicus
gggaccctgtttataggtgcatgac

SEQ ID NO: 449995 - DNA, 25 bp, Rattus norvegicus
gggaccctgtttttaggtgcatgac

SEQ ID NO: 449996 - DNA, 25 bp, Rattus norvegicus
gggacccttaccagaaccagcctgg

SEQ ID NO: 449997 - DNA, 25 bp, Rattus norvegicus
gggacccttacctgaaccagcctgg

SEQ ID NO: 449998 - DNA, 25 bp, Rattus norvegicus
gggacccttactcggcttagagcag

SEQ ID NO: 449999 - DNA, 25 bp, Rattus norvegicus
gggacccttactgggcttagagcag

SEQ ID NO: 450000 - DNA, 25 bp, Rattus norvegicus
gggacccttattattgcacactcat

SEQ ID NO: 450001 - DNA, 25 bp, Rattus norvegicus
gggacccttatttttgcacactcat

SEQ ID NO: 450002 - DNA, 25 bp, Rattus norvegicus
gggacccttcatccctttaagaaca

SEQ ID NO: 450003 - DNA, 25 bp, Rattus norvegicus
gggacccttcatgcctttaagaaca

SEQ ID NO: 450004 - DNA, 25 bp, Rattus norvegicus
gggacccttctcagtggaggctgac

SEQ ID NO: 450005 - DNA, 25 bp, Rattus norvegicus
gggacccttctctgtggaggctgac

SEQ ID NO: 450006 - DNA, 25 bp, Rattus norvegicus
gggacccttgtacagagtcttggca

SEQ ID NO: 450007 - DNA, 25 bp, Rattus norvegicus
gggacccttgtagagagtcttggca

SEQ ID NO: 450008 - DNA, 25 bp, Rattus norvegicus
gggaccctttcactctagcttggaa

SEQ ID NO: 450009 - DNA, 25 bp, Rattus norvegicus
gggaccctttcagtctagcttggaa

SEQ ID NO: 450010 - DNA, 25 bp, Rattus norvegicus
gggaccgaaaacacaacccatgcgt

SEQ ID NO: 450011 - DNA, 25 bp, Rattus norvegicus
gggaccgaaaactcaacccatgcgt

SEQ ID NO: 450012 - DNA, 25 bp, Rattus norvegicus
gggaccgaagtccatgtaaccactt

SEQ ID NO: 450013 - DNA, 25 bp, Rattus norvegicus
gggaccgaagtcgatgtaaccactt

SEQ ID NO: 450014 - DNA, 25 bp, Rattus norvegicus
gggaccgaccagataacagttctct

SEQ ID NO: 450015 - DNA, 25 bp, Rattus norvegicus
gggaccgaccagttaacagttctct

SEQ ID NO: 450016 - DNA, 25 bp, Rattus norvegicus
gggaccgagcccaaaatcaagtatt

SEQ ID NO: 450017 - DNA, 25 bp, Rattus norvegicus
gggaccgagccctaaatcaagtatt

SEQ ID NO: 450018 - DNA, 25 bp, Rattus norvegicus
gggaccgagcctacattatttgttg

SEQ ID NO: 450019 - DNA, 25 bp, Rattus norvegicus
gggaccgagccttcattatttgttg

SEQ ID NO: 450020 - DNA, 25 bp, Rattus norvegicus
gggaccgatcatcagaccacagacc

SEQ ID NO: 450021 - DNA, 25 bp, Rattus norvegicus
gggaccgatcatgagaccacagacc

SEQ ID NO: 450022 - DNA, 25 bp, Rattus norvegicus
gggaccgatccaacaacgtctttta

SEQ ID NO: 450023 - DNA, 25 bp, Rattus norvegicus
gggaccgatccatcaacgtctttta

SEQ ID NO: 450024 - DNA, 25 bp, Rattus norvegicus
gggaccgcatcaacagcagcattga

SEQ ID NO: 450025 - DNA, 25 bp, Rattus norvegicus
gggaccgcatcatcagcagcattga

SEQ ID NO: 450026 - DNA, 25 bp, Rattus norvegicus
gggaccgcatgaacctgcaacggga

SEQ ID NO: 450027 - DNA, 25 bp, Rattus norvegicus
gggaccgcatgatcctgcaacggga

SEQ ID NO: 450028 - DNA, 25 bp, Rattus norvegicus
gggaccgcccgtctcaaagccaagt

SEQ ID NO: 450029 - DNA, 25 bp, Rattus norvegicus
gggaccgcccgtgtcaaagccaagt

SEQ ID NO: 450030 - DNA, 25 bp, Rattus norvegicus
gggaccggacacctgaattcattga

SEQ ID NO: 450031 - DNA, 25 bp, Rattus norvegicus
gggaccggacacgtgaattcattga

SEQ ID NO: 450032 - DNA, 25 bp, Rattus norvegicus
gggaccggatcaacaatgccttctt

SEQ ID NO: 450033 - DNA, 25 bp, Rattus norvegicus
gggaccggatcatcaatgccttctt

SEQ ID NO: 450034 - DNA, 25 bp, Rattus norvegicus
gggaccggatgccatatatcctctg

SEQ ID NO: 450035 - DNA, 25 bp, Rattus norvegicus
gggaccggatgcgatatatcctctg

SEQ ID NO: 450036 - DNA, 25 bp, Rattus norvegicus
gggaccggcaatcttacaccaaggg

SEQ ID NO: 450037 - DNA, 25 bp, Rattus norvegicus
gggaccggcaatgttacaccaaggg

SEQ ID NO: 450038 - DNA, 25 bp, Rattus norvegicus
gggaccgggaacaggagatctactc

SEQ ID NO: 450039 - DNA, 25 bp, Rattus norvegicus
gggaccgggaactggagatctactc

SEQ ID NO: 450040 - DNA, 25 bp, Rattus norvegicus
gggaccggtcacagaagcctatgaa

SEQ ID NO: 450041 - DNA, 25 bp, Rattus norvegicus
gggaccggtcactgaagcctatgaa

SEQ ID NO: 450042 - DNA, 25 bp, Rattus norvegicus
gggaccggtgccagttagatgaact

SEQ ID NO: 450043 - DNA, 25 bp, Rattus norvegicus
gggaccggtgcctgttagatgaact

SEQ ID NO: 450044 - DNA, 25 bp, Rattus norvegicus
gggaccgtcggcatgttcctgcagc

SEQ ID NO: 450045 - DNA, 25 bp, Rattus norvegicus
gggaccgtcggcttgttcctgcagc

SEQ ID NO: 450046 - DNA, 25 bp, Rattus norvegicus
gggaccgtctgcaggtcactaagtg

SEQ ID NO: 450047 - DNA, 25 bp, Rattus norvegicus
gggaccgtctgctggtcactaagtg

SEQ ID NO: 450048 - DNA, 25 bp, Rattus norvegicus
gggacctaactacggccttggctgt

SEQ ID NO: 450049 - DNA, 25 bp, Rattus norvegicus
gggacctaactagggccttggctgt

SEQ ID NO: 450050 - DNA, 25 bp, Rattus norvegicus
gggacctaatcaagtacattgagaa

SEQ ID NO: 450051 - DNA, 25 bp, Rattus norvegicus
gggacctaatcatgtacattgagaa

SEQ ID NO: 450052 - DNA, 25 bp, Rattus norvegicus
gggacctaatgtaattgccaaagcc

SEQ ID NO: 450053 - DNA, 25 bp, Rattus norvegicus
gggacctaatgttattgccaaagcc

SEQ ID NO: 450054 - DNA, 25 bp, Rattus norvegicus
gggacctaattccagcagtctgtat

SEQ ID NO: 450055 - DNA, 25 bp, Rattus norvegicus
gggacctaattcgagcagtctgtat

SEQ ID NO: 450056 - DNA, 25 bp, Rattus norvegicus
gggacctaatttatcttttatgtat

SEQ ID NO: 450057 - DNA, 25 bp, Rattus norvegicus
gggacctaatttttcttttatgtat

SEQ ID NO: 450058 - DNA, 25 bp, Rattus norvegicus
gggacctacactaaatctctatgct

SEQ ID NO: 450059 - DNA, 25 bp, Rattus norvegicus
gggacctacacttaatctctatgct

SEQ ID NO: 450060 - DNA, 25 bp, Rattus norvegicus
gggacctacattccactgagcaaat

SEQ ID NO: 450061 - DNA, 25 bp, Rattus norvegicus
gggacctacattgcactgagcaaat

SEQ ID NO: 450062 - DNA, 25 bp, Rattus norvegicus
gggacctagatgactcaccggtaaa

SEQ ID NO: 450063 - DNA, 25 bp, Rattus norvegicus
gggacctagatgtctcaccggtaaa

SEQ ID NO: 450064 - DNA, 25 bp, Rattus norvegicus
gggacctatctgattatagtacttg

SEQ ID NO: 450065 - DNA, 25 bp, Rattus norvegicus
gggacctatctgtttatagtacttg

SEQ ID NO: 450066 - DNA, 25 bp, Rattus norvegicus
gggacctcactgactaccttatgaa

SEQ ID NO: 450067 - DNA, 25 bp, Rattus norvegicus
gggacctcactgtctaccttatgaa

SEQ ID NO: 450068 - DNA, 25 bp, Rattus norvegicus
gggacctcacttctcacagtgggaa

SEQ ID NO: 450069 - DNA, 25 bp, Rattus norvegicus
gggacctcacttgtcacagtgggaa

SEQ ID NO: 450070 - DNA, 25 bp, Rattus norvegicus
gggacctcataaaattgaaaagctg

SEQ ID NO: 450071 - DNA, 25 bp, Rattus norvegicus
gggacctcataatattgaaaagctg

SEQ ID NO: 450072 - DNA, 25 bp, Rattus norvegicus
gggacctcatacacttctctggctt

SEQ ID NO: 450073 - DNA, 25 bp, Rattus norvegicus
gggacctcatactcttctctggctt

SEQ ID NO: 450074 - DNA, 25 bp, Rattus norvegicus
gggacctcattgaacatggctccaa

SEQ ID NO: 450075 - DNA, 25 bp, Rattus norvegicus
gggacctcattgtacatggctccaa

SEQ ID NO: 450076 - DNA, 25 bp, Rattus norvegicus
gggacctccaaactcaattacctgg

SEQ ID NO: 450077 - DNA, 25 bp, Rattus norvegicus
gggacctccaaagtcaattacctgg

SEQ ID NO: 450078 - DNA, 25 bp, Rattus norvegicus
gggacctccaagaggggccgcccat

SEQ ID NO: 450079 - DNA, 25 bp, Rattus norvegicus
gggacctccaagtggggccgcccat

SEQ ID NO: 450080 - DNA, 25 bp, Rattus norvegicus
gggacctcctcacagccgaaaacaa

SEQ ID NO: 450081 - DNA, 25 bp, Rattus norvegicus
gggacctcctcagagccgaaaacaa

SEQ ID NO: 450082 - DNA, 25 bp, Rattus norvegicus
gggacctcgtggaagccacagcagc

SEQ ID NO: 450083 - DNA, 25 bp, Rattus norvegicus
gggacctcgtggtagccacagcagc

SEQ ID NO: 450084 - DNA, 25 bp, Rattus norvegicus
gggacctctagaagcttttgcaatg

SEQ ID NO: 450085 - DNA, 25 bp, Rattus norvegicus
gggacctctagatgcttttgcaatg

SEQ ID NO: 450086 - DNA, 25 bp, Rattus norvegicus
gggacctctgggatggatgccatcc

SEQ ID NO: 450087 - DNA, 25 bp, Rattus norvegicus
gggacctctgggttggatgccatcc

SEQ ID NO: 450088 - DNA, 25 bp, Rattus norvegicus
gggacctcttacacacaacagagtc

SEQ ID NO: 450089 - DNA, 25 bp, Rattus norvegicus
gggacctcttactcacaacagagtc

SEQ ID NO: 450090 - DNA, 25 bp, Rattus norvegicus
gggacctgagacatgtagaacctgg

SEQ ID NO: 450091 - DNA, 25 bp, Rattus norvegicus
gggacctgagacttgtagaacctgg

SEQ ID NO: 450092 - DNA, 25 bp, Rattus norvegicus
gggacctgaggaccacctatcgtag

SEQ ID NO: 450093 - DNA, 25 bp, Rattus norvegicus
gggacctgaggagcacctatcgtag

SEQ ID NO: 450094 - DNA, 25 bp, Rattus norvegicus
gggacctgaggtcacaagttgccat

SEQ ID NO: 450095 - DNA, 25 bp, Rattus norvegicus
gggacctgaggtgacaagttgccat

SEQ ID NO: 450096 - DNA, 25 bp, Rattus norvegicus
gggacctgattccataatgcttgaa

SEQ ID NO: 450097 - DNA, 25 bp, Rattus norvegicus
gggacctgattcgataatgcttgaa

SEQ ID NO: 450098 - DNA, 25 bp, Rattus norvegicus
gggacctgcagaaattttcacttga

SEQ ID NO: 450099 - DNA, 25 bp, Rattus norvegicus
gggacctgcagatattttcacttga

SEQ ID NO: 450100 - DNA, 25 bp, Rattus norvegicus
gggacctgcccacctttgagactct

SEQ ID NO: 450101 - DNA, 25 bp, Rattus norvegicus
gggacctgcccagctttgagactct

SEQ ID NO: 450102 - DNA, 25 bp, Rattus norvegicus
gggacctgccttcttagtgttagga

SEQ ID NO: 450103 - DNA, 25 bp, Rattus norvegicus
gggacctgccttgttagtgttagga

SEQ ID NO: 450104 - DNA, 25 bp, Rattus norvegicus
gggacctgctgaagcactccaggag

SEQ ID NO: 450105 - DNA, 25 bp, Rattus norvegicus
gggacctgctgatgcactccaggag

SEQ ID NO: 450106 - DNA, 25 bp, Rattus norvegicus
gggacctggaacacacatgtccgag

SEQ ID NO: 450107 - DNA, 25 bp, Rattus norvegicus
gggacctggaactcacatgtccgag

SEQ ID NO: 450108 - DNA, 25 bp, Rattus norvegicus
gggacctggagaagaccatcaagat

SEQ ID NO: 450109 - DNA, 25 bp, Rattus norvegicus
gggacctggagatgaccatcaagat

SEQ ID NO: 450110 - DNA, 25 bp, Rattus norvegicus
gggacctggctgaacatatgtgaat

SEQ ID NO: 450111 - DNA, 25 bp, Rattus norvegicus
gggacctggctgtacatatgtgaat

SEQ ID NO: 450112 - DNA, 25 bp, Rattus norvegicus
gggacctgggaactcacacatgcat

SEQ ID NO: 450113 - DNA, 25 bp, Rattus norvegicus
gggacctgggaagtcacacatgcat

SEQ ID NO: 450114 - DNA, 25 bp, Rattus norvegicus
gggacctgggtgatatcctctaggc

SEQ ID NO: 450115 - DNA, 25 bp, Rattus norvegicus
gggacctgggtgttatcctctaggc

SEQ ID NO: 450116 - DNA, 25 bp, Rattus norvegicus
gggacctggtggacacagtctgaat

SEQ ID NO: 450117 - DNA, 25 bp, Rattus norvegicus
gggacctggtggtcacagtctgaat

SEQ ID NO: 450118 - DNA, 25 bp, Rattus norvegicus
gggacctggtttatctgtcctcatc

SEQ ID NO: 450119 - DNA, 25 bp, Rattus norvegicus
gggacctggtttttctgtcctcatc

SEQ ID NO: 450120 - DNA, 25 bp, Rattus norvegicus
gggacctgtctcaggtaaccgactg

SEQ ID NO: 450121 - DNA, 25 bp, Rattus norvegicus
gggacctgtctctggtaaccgactg

SEQ ID NO: 450122 - DNA, 25 bp, Rattus norvegicus
gggaccttaagaccgcccaggcaaa

SEQ ID NO: 450123 - DNA, 25 bp, Rattus norvegicus
gggaccttaagagcgcccaggcaaa

SEQ ID NO: 450124 - DNA, 25 bp, Rattus norvegicus
gggaccttacccaagactggcaagc

SEQ ID NO: 450125 - DNA, 25 bp, Rattus norvegicus
gggaccttaccctagactggcaagc

SEQ ID NO: 450126 - DNA, 25 bp, Rattus norvegicus
gggaccttagttaccagcaggacca

SEQ ID NO: 450127 - DNA, 25 bp, Rattus norvegicus
gggaccttagtttccagcaggacca

SEQ ID NO: 450128 - DNA, 25 bp, Rattus norvegicus
gggaccttcacaagctctttaggaa

SEQ ID NO: 450129 - DNA, 25 bp, Rattus norvegicus
gggaccttcacatgctctttaggaa

SEQ ID NO: 450130 - DNA, 25 bp, Rattus norvegicus
gggaccttcacgatctagccatgaa

SEQ ID NO: 450131 - DNA, 25 bp, Rattus norvegicus
gggaccttcacgttctagccatgaa

SEQ ID NO: 450132 - DNA, 25 bp, Rattus norvegicus
gggaccttccatctgatttgcctgg

SEQ ID NO: 450133 - DNA, 25 bp, Rattus norvegicus
gggaccttccatgtgatttgcctgg

SEQ ID NO: 450134 - DNA, 25 bp, Rattus norvegicus
gggaccttcctgctagagtacagac

SEQ ID NO: 450135 - DNA, 25 bp, Rattus norvegicus
gggaccttcctggtagagtacagac

SEQ ID NO: 450136 - DNA, 25 bp, Rattus norvegicus
gggaccttcgtaacaacaagctgaa

SEQ ID NO: 450137 - DNA, 25 bp, Rattus norvegicus
gggaccttcgtacagtgtgatgctc

SEQ ID NO: 450138 - DNA, 25 bp, Rattus norvegicus
gggaccttcgtagagtgtgatgctc

SEQ ID NO: 450139 - DNA, 25 bp, Rattus norvegicus
gggaccttcgtatcaacaagctgaa

SEQ ID NO: 450140 - DNA, 25 bp, Rattus norvegicus
gggaccttcgtgcagatgtactacc

SEQ ID NO: 450141 - DNA, 25 bp, Rattus norvegicus
gggaccttcgtggagatgtactacc

SEQ ID NO: 450142 - DNA, 25 bp, Rattus norvegicus
gggaccttcttgaatatggccaaag

SEQ ID NO: 450143 - DNA, 25 bp, Rattus norvegicus
gggaccttcttgtatatggccaaag

SEQ ID NO: 450144 - DNA, 25 bp, Rattus norvegicus
gggaccttgaacagatccaatcctg

SEQ ID NO: 450145 - DNA, 25 bp, Rattus norvegicus
gggaccttgaactgatccaatcctg

SEQ ID NO: 450146 - DNA, 25 bp, Rattus norvegicus
gggaccttgaatactgagtcattct

SEQ ID NO: 450147 - DNA, 25 bp, Rattus norvegicus
gggaccttgaattctgagtcattct

SEQ ID NO: 450148 - DNA, 25 bp, Rattus norvegicus
gggaccttgcccagagtgaatctgt

SEQ ID NO: 450149 - DNA, 25 bp, Rattus norvegicus
gggaccttgccctgagtgaatctgt

SEQ ID NO: 450150 - DNA, 25 bp, Rattus norvegicus
gggaccttgctgacttctcgactct

SEQ ID NO: 450151 - DNA, 25 bp, Rattus norvegicus
gggaccttgctgtcttctcgactct

SEQ ID NO: 450152 - DNA, 25 bp, Rattus norvegicus
gggaccttgttcagaatggccatct

SEQ ID NO: 450153 - DNA, 25 bp, Rattus norvegicus
gggaccttgttctgaatggccatct

SEQ ID NO: 450154 - DNA, 25 bp, Rattus norvegicus
gggacctttcagagctaaagctgat

SEQ ID NO: 450155 - DNA, 25 bp, Rattus norvegicus
gggacctttcagtgctaaagctgat

SEQ ID NO: 450156 - DNA, 25 bp, Rattus norvegicus
gggacctttctgacaggcaagcttt

SEQ ID NO: 450157 - DNA, 25 bp, Rattus norvegicus
gggacctttctgaggcatttgaagc

SEQ ID NO: 450158 - DNA, 25 bp, Rattus norvegicus
gggacctttctgtcaggcaagcttt

SEQ ID NO: 450159 - DNA, 25 bp, Rattus norvegicus
gggacctttctgtggcatttgaagc

SEQ ID NO: 450160 - DNA, 25 bp, Rattus norvegicus
gggacctttgcactttattcctgcc

SEQ ID NO: 450161 - DNA, 25 bp, Rattus norvegicus
gggacctttgcagtttattcctgcc

SEQ ID NO: 450162 - DNA, 25 bp, Rattus norvegicus
gggaccttttctatgactgtgtgga

SEQ ID NO: 450163 - DNA, 25 bp, Rattus norvegicus
gggaccttttctttgactgtgtgga

SEQ ID NO: 450164 - DNA, 25 bp, Rattus norvegicus
gggacctttttacctgggcctctca

SEQ ID NO: 450165 - DNA, 25 bp, Rattus norvegicus
gggacctttttagctgggcctctca

SEQ ID NO: 450166 - DNA, 25 bp, Rattus norvegicus
gggacgaacagtacagctgttttct

SEQ ID NO: 450167 - DNA, 25 bp, Rattus norvegicus
gggacgaacagttcagctgttttct

SEQ ID NO: 450168 - DNA, 25 bp, Rattus norvegicus
gggacgacaatcactctgttgtgta

SEQ ID NO: 450169 - DNA, 25 bp, Rattus norvegicus
gggacgacaatctctctgttgtgta

SEQ ID NO: 450170 - DNA, 25 bp, Rattus norvegicus
gggacgacactgaagccacacgtag

SEQ ID NO: 450171 - DNA, 25 bp, Rattus norvegicus
gggacgacactgtagccacacgtag

SEQ ID NO: 450172 - DNA, 25 bp, Rattus norvegicus
gggacgacatgtatctcacacaaga

SEQ ID NO: 450173 - DNA, 25 bp, Rattus norvegicus
gggacgacatgtttctcacacaaga

SEQ ID NO: 450174 - DNA, 25 bp, Rattus norvegicus
gggacgaccgtgagcagttctacaa

SEQ ID NO: 450175 - DNA, 25 bp, Rattus norvegicus
gggacgaccgtgtgcagttctacaa

SEQ ID NO: 450176 - DNA, 25 bp, Rattus norvegicus
gggacgacgagtacattctgatgac

SEQ ID NO: 450177 - DNA, 25 bp, Rattus norvegicus
gggacgacgagttcattctgatgac

SEQ ID NO: 450178 - DNA, 25 bp, Rattus norvegicus
gggacgactgccctaccgaggatac

SEQ ID NO: 450179 - DNA, 25 bp, Rattus norvegicus
gggacgactgccgtaccgaggatac

SEQ ID NO: 450180 - DNA, 25 bp, Rattus norvegicus
gggacgactgttacttgggcacttt

SEQ ID NO: 450181 - DNA, 25 bp, Rattus norvegicus
gggacgactgtttcttgggcacttt

SEQ ID NO: 450182 - DNA, 25 bp, Rattus norvegicus
gggacgagacccagctcaggaacta

SEQ ID NO: 450183 - DNA, 25 bp, Rattus norvegicus
gggacgagaccctgctcaggaacta

SEQ ID NO: 450184 - DNA, 25 bp, Rattus norvegicus
gggacgaggactcctgttgatttct

SEQ ID NO: 450185 - DNA, 25 bp, Rattus norvegicus
gggacgaggactgctgttgatttct

SEQ ID NO: 450186 - DNA, 25 bp, Rattus norvegicus
gggacgaggatcaagaactcctatt

SEQ ID NO: 450187 - DNA, 25 bp, Rattus norvegicus
gggacgaggatctagaactcctatt

SEQ ID NO: 450188 - DNA, 25 bp, Rattus norvegicus
gggacgagttctaccttatggagga

SEQ ID NO: 450189 - DNA, 25 bp, Rattus norvegicus
gggacgagttcttccttatggagga

SEQ ID NO: 450190 - DNA, 25 bp, Rattus norvegicus
gggacgatccttccaggagcctcag

SEQ ID NO: 450191 - DNA, 25 bp, Rattus norvegicus
gggacgatccttgcaggagcctcag

SEQ ID NO: 450192 - DNA, 25 bp, Rattus norvegicus
gggacgatcttaactttcttctgac

SEQ ID NO: 450193 - DNA, 25 bp, Rattus norvegicus
gggacgatcttatctttcttctgac

SEQ ID NO: 450194 - DNA, 25 bp, Rattus norvegicus
gggacgattctgctttacacctgta

SEQ ID NO: 450195 - DNA, 25 bp, Rattus norvegicus
gggacgattctggtttacacctgta

SEQ ID NO: 450196 - DNA, 25 bp, Rattus norvegicus
gggacgcaaaacacagcctggctct

SEQ ID NO: 450197 - DNA, 25 bp, Rattus norvegicus
gggacgcaaaactcagcctggctct

SEQ ID NO: 450198 - DNA, 25 bp, Rattus norvegicus
gggacgcaacaaatttcaatcggaa

SEQ ID NO: 450199 - DNA, 25 bp, Rattus norvegicus
gggacgcaacaattttcaatcggaa

SEQ ID NO: 450200 - DNA, 25 bp, Rattus norvegicus
gggacgcaatgtaaccagcagcaca

SEQ ID NO: 450201 - DNA, 25 bp, Rattus norvegicus
gggacgcaatgttaccagcagcaca

SEQ ID NO: 450202 - DNA, 25 bp, Rattus norvegicus
gggacgcaccccagaagagcactgg

SEQ ID NO: 450203 - DNA, 25 bp, Rattus norvegicus
gggacgcacccctgaagagcactgg

SEQ ID NO: 450204 - DNA, 25 bp, Rattus norvegicus
gggacgcactgcagaaggctaccaa

SEQ ID NO: 450205 - DNA, 25 bp, Rattus norvegicus
gggacgcactgctgaaggctaccaa

SEQ ID NO: 450206 - DNA, 25 bp, Rattus norvegicus
gggacgcagcacagcgttcctattt

SEQ ID NO: 450207 - DNA, 25 bp, Rattus norvegicus
gggacgcagcactgcgttcctattt

SEQ ID NO: 450208 - DNA, 25 bp, Rattus norvegicus
gggacgcagtcaacttgggcatgtc

SEQ ID NO: 450209 - DNA, 25 bp, Rattus norvegicus
gggacgcagtcatcttgggcatgtc

SEQ ID NO: 450210 - DNA, 25 bp, Rattus norvegicus
gggacgcatgaaaccaagagttcct

SEQ ID NO: 450211 - DNA, 25 bp, Rattus norvegicus
gggacgcatgaatccaagagttcct

SEQ ID NO: 450212 - DNA, 25 bp, Rattus norvegicus
gggacgcctgacaacatattttctg

SEQ ID NO: 450213 - DNA, 25 bp, Rattus norvegicus
gggacgcctgactacatattttctg

SEQ ID NO: 450214 - DNA, 25 bp, Rattus norvegicus
gggacgcgttgccaataaactctga

SEQ ID NO: 450215 - DNA, 25 bp, Rattus norvegicus
gggacgcgttgcgaataaactctga

SEQ ID NO: 450216 - DNA, 25 bp, Rattus norvegicus
gggacgctacttagctctaatgtta

SEQ ID NO: 450217 - DNA, 25 bp, Rattus norvegicus
gggacgctactttgctctaatgtta

SEQ ID NO: 450218 - DNA, 25 bp, Rattus norvegicus
gggacgctctcaaaatatttcttca

SEQ ID NO: 450219 - DNA, 25 bp, Rattus norvegicus
gggacgctctcataatatttcttca

SEQ ID NO: 450220 - DNA, 25 bp, Rattus norvegicus
gggacgctctctagctagattcata

SEQ ID NO: 450221 - DNA, 25 bp, Rattus norvegicus
gggacgctctcttgctagattcata

SEQ ID NO: 450222 - DNA, 25 bp, Rattus norvegicus
gggacgctgcttccgacggaggcga

SEQ ID NO: 450223 - DNA, 25 bp, Rattus norvegicus
gggacgctgcttgcgacggaggcga

SEQ ID NO: 450224 - DNA, 25 bp, Rattus norvegicus
gggacgctgtatatgctcgcatatg

SEQ ID NO: 450225 - DNA, 25 bp, Rattus norvegicus
gggacgctgtatttgctcgcatatg

SEQ ID NO: 450226 - DNA, 25 bp, Rattus norvegicus
gggacggaccatctgcactgttgct

SEQ ID NO: 450227 - DNA, 25 bp, Rattus norvegicus
gggacggaccatgtgcactgttgct

SEQ ID NO: 450228 - DNA, 25 bp, Rattus norvegicus
gggacggacgagccccgatgccggg

SEQ ID NO: 450229 - DNA, 25 bp, Rattus norvegicus
gggacggacgaggcccgatgccggg

SEQ ID NO: 450230 - DNA, 25 bp, Rattus norvegicus
gggacggcaccaacacaacaaagga

SEQ ID NO: 450231 - DNA, 25 bp, Rattus norvegicus
gggacggcaccatcacaacaaagga

SEQ ID NO: 450232 - DNA, 25 bp, Rattus norvegicus
gggacggcgtagctgcagactgaag

SEQ ID NO: 450233 - DNA, 25 bp, Rattus norvegicus
gggacggcgtaggtgcagactgaag

SEQ ID NO: 450234 - DNA, 25 bp, Rattus norvegicus
gggacggtcatcagcctgagaaatg

SEQ ID NO: 450235 - DNA, 25 bp, Rattus norvegicus
gggacggtcatctgcctgagaaatg

SEQ ID NO: 450236 - DNA, 25 bp, Rattus norvegicus
gggacggtgctaaactcgtctccac

SEQ ID NO: 450237 - DNA, 25 bp, Rattus norvegicus
gggacggtgctatactcgtctccac

SEQ ID NO: 450238 - DNA, 25 bp, Rattus norvegicus
gggacggtggccacaatgtgcaata

SEQ ID NO: 450239 - DNA, 25 bp, Rattus norvegicus
gggacggtggcctcaatgtgcaata

SEQ ID NO: 450240 - DNA, 25 bp, Rattus norvegicus
gggacggttcacattcaaaccacag

SEQ ID NO: 450241 - DNA, 25 bp, Rattus norvegicus
gggacggttcactttcaaaccacag

SEQ ID NO: 450242 - DNA, 25 bp, Rattus norvegicus
gggacggtttcaactggccgaaaga

SEQ ID NO: 450243 - DNA, 25 bp, Rattus norvegicus
gggacggtttcatctggccgaaaga

SEQ ID NO: 450244 - DNA, 25 bp, Rattus norvegicus
gggacgtaacttcaagatcatcaca

SEQ ID NO: 450245 - DNA, 25 bp, Rattus norvegicus
gggacgtaacttgaagatcatcaca

SEQ ID NO: 450246 - DNA, 25 bp, Rattus norvegicus
gggacgtatattccttgttgctgtt

SEQ ID NO: 450247 - DNA, 25 bp, Rattus norvegicus
gggacgtatattgcttgttgctgtt

SEQ ID NO: 450248 - DNA, 25 bp, Rattus norvegicus
gggacgtcctcaattgtaaaagtag

SEQ ID NO: 450249 - DNA, 25 bp, Rattus norvegicus
gggacgtcctcatttgtaaaagtag

SEQ ID NO: 450250 - DNA, 25 bp, Rattus norvegicus
gggacgtcttcaaaggatgtgcctg

SEQ ID NO: 450251 - DNA, 25 bp, Rattus norvegicus
gggacgtcttcataggatgtgcctg

SEQ ID NO: 450252 - DNA, 25 bp, Rattus norvegicus
gggacgtgatgactgatccttcctg

SEQ ID NO: 450253 - DNA, 25 bp, Rattus norvegicus
gggacgtgatgagtgatccttcctg

SEQ ID NO: 450254 - DNA, 25 bp, Rattus norvegicus
gggacgtgcatccaatacattacct

SEQ ID NO: 450255 - DNA, 25 bp, Rattus norvegicus
gggacgtgcatcgaatacattacct

SEQ ID NO: 450256 - DNA, 25 bp, Rattus norvegicus
gggacgtgcgggactatcttcctta

SEQ ID NO: 450257 - DNA, 25 bp, Rattus norvegicus
gggacgtgcgggtctatcttcctta

SEQ ID NO: 450258 - DNA, 25 bp, Rattus norvegicus
gggacgttacaccaggacaatagaa

SEQ ID NO: 450259 - DNA, 25 bp, Rattus norvegicus
gggacgttacacgaggacaatagaa

SEQ ID NO: 450260 - DNA, 25 bp, Rattus norvegicus
gggacgttcagactcgactggatct

SEQ ID NO: 450261 - DNA, 25 bp, Rattus norvegicus
gggacgttcagagtcgactggatct

SEQ ID NO: 450262 - DNA, 25 bp, Rattus norvegicus
gggacgttgcctatgcgctgttgta

SEQ ID NO: 450263 - DNA, 25 bp, Rattus norvegicus
gggacgttgcctttgcgctgttgta

SEQ ID NO: 450264 - DNA, 25 bp, Rattus norvegicus
gggacgttgctaactcaagactaat

SEQ ID NO: 450265 - DNA, 25 bp, Rattus norvegicus
gggacgttgctatctcaagactaat

SEQ ID NO: 450266 - DNA, 25 bp, Rattus norvegicus
gggacgtttgtactgcctctaggaa

SEQ ID NO: 450267 - DNA, 25 bp, Rattus norvegicus
gggacgtttgtagtgcctctaggaa

SEQ ID NO: 450268 - DNA, 25 bp, Rattus norvegicus
gggacgttttagctggaccaagatt

SEQ ID NO: 450269 - DNA, 25 bp, Rattus norvegicus
gggacgttttaggtggaccaagatt

SEQ ID NO: 450270 - DNA, 25 bp, Rattus norvegicus
gggacgttttatacacattgcttct

SEQ ID NO: 450271 - DNA, 25 bp, Rattus norvegicus
gggacgttttatctgagtcgtgttt

SEQ ID NO: 450272 - DNA, 25 bp, Rattus norvegicus
gggacgttttatgtgagtcgtgttt

SEQ ID NO: 450273 - DNA, 25 bp, Rattus norvegicus
gggacgttttattcacattgcttct

SEQ ID NO: 450274 - DNA, 25 bp, Rattus norvegicus
gggacgttttcccactaacatgaca

SEQ ID NO: 450275 - DNA, 25 bp, Rattus norvegicus
gggacgttttccgactaacatgaca

SEQ ID NO: 450276 - DNA, 25 bp, Rattus norvegicus
gggactaaagccacactgccctgtt

SEQ ID NO: 450277 - DNA, 25 bp, Rattus norvegicus
gggactaaagccactgtgagtcaga

SEQ ID NO: 450278 - DNA, 25 bp, Rattus norvegicus
gggactaaagcctcactgccctgtt

SEQ ID NO: 450279 - DNA, 25 bp, Rattus norvegicus
gggactaaagcctctgtgagtcaga

SEQ ID NO: 450280 - DNA, 25 bp, Rattus norvegicus
gggactaaccctctttcagagccag

SEQ ID NO: 450281 - DNA, 25 bp, Rattus norvegicus
gggactaaccctgtttcagagccag

SEQ ID NO: 450282 - DNA, 25 bp, Rattus norvegicus
gggactaaccgacctgagtgccatc

SEQ ID NO: 450283 - DNA, 25 bp, Rattus norvegicus
gggactaaccgagctgagtgccatc

SEQ ID NO: 450284 - DNA, 25 bp, Rattus norvegicus
gggactacaagtactgaggttcact

SEQ ID NO: 450285 - DNA, 25 bp, Rattus norvegicus
gggactacaagttctgaggttcact

SEQ ID NO: 450286 - DNA, 25 bp, Rattus norvegicus
gggactacacctatgatgctggctg

SEQ ID NO: 450287 - DNA, 25 bp, Rattus norvegicus
gggactacacctttgatgctggctg

SEQ ID NO: 450288 - DNA, 25 bp, Rattus norvegicus
gggactacactcaacattctcagtg

SEQ ID NO: 450289 - DNA, 25 bp, Rattus norvegicus
gggactacactctacattctcagtg

SEQ ID NO: 450290 - DNA, 25 bp, Rattus norvegicus
gggactacatccatttaagtgcaga

SEQ ID NO: 450291 - DNA, 25 bp, Rattus norvegicus
gggactacatccttttaagtgcaga

SEQ ID NO: 450292 - DNA, 25 bp, Rattus norvegicus
gggactacccgcaattttatatgtg

SEQ ID NO: 450293 - DNA, 25 bp, Rattus norvegicus
gggactacccgctattttatatgtg

SEQ ID NO: 450294 - DNA, 25 bp, Rattus norvegicus
gggactacctttaccaacaagactg

SEQ ID NO: 450295 - DNA, 25 bp, Rattus norvegicus
gggactaccttttccaacaagactg

SEQ ID NO: 450296 - DNA, 25 bp, Rattus norvegicus
gggactacgggcatcctgtctacat

SEQ ID NO: 450297 - DNA, 25 bp, Rattus norvegicus
gggactacgggcttcctgtctacat

SEQ ID NO: 450298 - DNA, 25 bp, Rattus norvegicus
gggactactgggaaatgactccaca

SEQ ID NO: 450299 - DNA, 25 bp, Rattus norvegicus
gggactactgggtaatgactccaca

SEQ ID NO: 450300 - DNA, 25 bp, Rattus norvegicus
gggactactggtctatgccaccatg

SEQ ID NO: 450301 - DNA, 25 bp, Rattus norvegicus
gggactactggtgtatgccaccatg

SEQ ID NO: 450302 - DNA, 25 bp, Rattus norvegicus
gggactactgtgaccatgacaggca

SEQ ID NO: 450303 - DNA, 25 bp, Rattus norvegicus
gggactactgtgtccatgacaggca

SEQ ID NO: 450304 - DNA, 25 bp, Rattus norvegicus
gggactacttcaccctcatgaactg

SEQ ID NO: 450305 - DNA, 25 bp, Rattus norvegicus
gggactacttcagcctcatgaactg

SEQ ID NO: 450306 - DNA, 25 bp, Rattus norvegicus
gggactacttccataaagttctcct

SEQ ID NO: 450307 - DNA, 25 bp, Rattus norvegicus
gggactacttccttaaagttctcct

SEQ ID NO: 450308 - DNA, 25 bp, Rattus norvegicus
gggactacttctagatgctgggaaa

SEQ ID NO: 450309 - DNA, 25 bp, Rattus norvegicus
gggactacttcttgatgctgggaaa

SEQ ID NO: 450310 - DNA, 25 bp, Rattus norvegicus
gggactagatggcacccagcctgtc

SEQ ID NO: 450311 - DNA, 25 bp, Rattus norvegicus
gggactagatgggacccagcctgtc

SEQ ID NO: 450312 - DNA, 25 bp, Rattus norvegicus
gggactagcaatatttgtatcttta

SEQ ID NO: 450313 - DNA, 25 bp, Rattus norvegicus
gggactagcaatttttgtatcttta

SEQ ID NO: 450314 - DNA, 25 bp, Rattus norvegicus
gggactaggcatatttcatttcact

SEQ ID NO: 450315 - DNA, 25 bp, Rattus norvegicus
gggactaggcatttttcatttcact

SEQ ID NO: 450316 - DNA, 25 bp, Rattus norvegicus
gggactagtcccacagtaagcacag

SEQ ID NO: 450317 - DNA, 25 bp, Rattus norvegicus
gggactagtccctcagtaagcacag

SEQ ID NO: 450318 - DNA, 25 bp, Rattus norvegicus
gggactagtcttctactcatatcat

SEQ ID NO: 450319 - DNA, 25 bp, Rattus norvegicus
gggactagtcttgtactcatatcat

SEQ ID NO: 450320 - DNA, 25 bp, Rattus norvegicus
gggactatctgcaccggcccagcta

SEQ ID NO: 450321 - DNA, 25 bp, Rattus norvegicus
gggactatctgctccggcccagcta

SEQ ID NO: 450322 - DNA, 25 bp, Rattus norvegicus
gggactatcttcaactcctgatcct

SEQ ID NO: 450323 - DNA, 25 bp, Rattus norvegicus
gggactatcttctactcctgatcct

SEQ ID NO: 450324 - DNA, 25 bp, Rattus norvegicus
gggactatgacgacgaccaagttaa

SEQ ID NO: 450325 - DNA, 25 bp, Rattus norvegicus
gggactatgacgtcgaccaagttaa

SEQ ID NO: 450326 - DNA, 25 bp, Rattus norvegicus
gggactatgctccagctcaaagcag

SEQ ID NO: 450327 - DNA, 25 bp, Rattus norvegicus
gggactatgctcgagctcaaagcag

SEQ ID NO: 450328 - DNA, 25 bp, Rattus norvegicus
gggactattgatatccagggtctaa

SEQ ID NO: 450329 - DNA, 25 bp, Rattus norvegicus
gggactattgatttccagggtctaa

SEQ ID NO: 450330 - DNA, 25 bp, Rattus norvegicus
gggactatttccatgtcggccaggt

SEQ ID NO: 450331 - DNA, 25 bp, Rattus norvegicus
gggactatttccttgtcggccaggt

SEQ ID NO: 450332 - DNA, 25 bp, Rattus norvegicus
gggactcaaaacctccctgacatac

SEQ ID NO: 450333 - DNA, 25 bp, Rattus norvegicus
gggactcaaaacgtccctgacatac

SEQ ID NO: 450334 - DNA, 25 bp, Rattus norvegicus
gggactcaaacccagagacttatgt

SEQ ID NO: 450335 - DNA, 25 bp, Rattus norvegicus
gggactcaaaccgagagacttatgt

SEQ ID NO: 450336 - DNA, 25 bp, Rattus norvegicus
gggactcaaagacaattgctattct

SEQ ID NO: 450337 - DNA, 25 bp, Rattus norvegicus
gggactcaaagagaattgctattct

SEQ ID NO: 450338 - DNA, 25 bp, Rattus norvegicus
gggactcaattgcagcagctgtcat

SEQ ID NO: 450339 - DNA, 25 bp, Rattus norvegicus
gggactcaattggagcagctgtcat

SEQ ID NO: 450340 - DNA, 25 bp, Rattus norvegicus
gggactcacatacagccccatttca

SEQ ID NO: 450341 - DNA, 25 bp, Rattus norvegicus
gggactcacatagagccccatttca

SEQ ID NO: 450342 - DNA, 25 bp, Rattus norvegicus
gggactcaccaccttctgataagtt

SEQ ID NO: 450343 - DNA, 25 bp, Rattus norvegicus
gggactcaccacgttctgataagtt

SEQ ID NO: 450344 - DNA, 25 bp, Rattus norvegicus
gggactcaccccagggtcagaggct

SEQ ID NO: 450345 - DNA, 25 bp, Rattus norvegicus
gggactcacccctgggtcagaggct

SEQ ID NO: 450346 - DNA, 25 bp, Rattus norvegicus
gggactcacgcgcatgaacatcagt

SEQ ID NO: 450347 - DNA, 25 bp, Rattus norvegicus
gggactcacgcggatgaacatcagt

SEQ ID NO: 450348 - DNA, 25 bp, Rattus norvegicus
gggactcacggcaaaatctgcgaaa

SEQ ID NO: 450349 - DNA, 25 bp, Rattus norvegicus
gggactcacggctaaatctgcgaaa

SEQ ID NO: 450350 - DNA, 25 bp, Rattus norvegicus
gggactcacgggacagaccttctgg

SEQ ID NO: 450351 - DNA, 25 bp, Rattus norvegicus
gggactcacgggtcagaccttctgg

SEQ ID NO: 450352 - DNA, 25 bp, Rattus norvegicus
gggactcagaagagaatccaagtgg

SEQ ID NO: 450353 - DNA, 25 bp, Rattus norvegicus
gggactcagaagtgaatccaagtgg

SEQ ID NO: 450354 - DNA, 25 bp, Rattus norvegicus
gggactcagactcctgcgccagcag

SEQ ID NO: 450355 - DNA, 25 bp, Rattus norvegicus
gggactcagactgctgcgccagcag

SEQ ID NO: 450356 - DNA, 25 bp, Rattus norvegicus
gggactcagatgaccacggcttagc

SEQ ID NO: 450357 - DNA, 25 bp, Rattus norvegicus
gggactcagatgtccacggcttagc

SEQ ID NO: 450358 - DNA, 25 bp, Rattus norvegicus
gggactcagcgcactgagaagactc

SEQ ID NO: 450359 - DNA, 25 bp, Rattus norvegicus
gggactcagcgctctgagaagactc

SEQ ID NO: 450360 - DNA, 25 bp, Rattus norvegicus
gggactcaggaaaatcaaaagcatt

SEQ ID NO: 450361 - DNA, 25 bp, Rattus norvegicus
gggactcaggaatatcaaaagcatt

SEQ ID NO: 450362 - DNA, 25 bp, Rattus norvegicus
gggactcagggaacgccacaaacag

SEQ ID NO: 450363 - DNA, 25 bp, Rattus norvegicus
gggactcagggacccctaggatcac

SEQ ID NO: 450364 - DNA, 25 bp, Rattus norvegicus
gggactcagggagccctaggatcac

SEQ ID NO: 450365 - DNA, 25 bp, Rattus norvegicus
gggactcagggatcgccacaaacag

SEQ ID NO: 450366 - DNA, 25 bp, Rattus norvegicus
gggactcaggtcagtaactgcccag

SEQ ID NO: 450367 - DNA, 25 bp, Rattus norvegicus
gggactcaggtctgtaactgcccag

SEQ ID NO: 450368 - DNA, 25 bp, Rattus norvegicus
gggactcatccaaggcatggtttat

SEQ ID NO: 450369 - DNA, 25 bp, Rattus norvegicus
gggactcatccatggcatggtttat

SEQ ID NO: 450370 - DNA, 25 bp, Rattus norvegicus
gggactcatcggctgttcagaactt

SEQ ID NO: 450371 - DNA, 25 bp, Rattus norvegicus
gggactcatcgggtgttcagaactt

SEQ ID NO: 450372 - DNA, 25 bp, Rattus norvegicus
gggactcatgagctgagcgcccgcc

SEQ ID NO: 450373 - DNA, 25 bp, Rattus norvegicus
gggactcatgaggtgagcgcccgcc

SEQ ID NO: 450374 - DNA, 25 bp, Rattus norvegicus
gggactcattaaaccttctgaacag

SEQ ID NO: 450375 - DNA, 25 bp, Rattus norvegicus
gggactcattaatccttctgaacag

SEQ ID NO: 450376 - DNA, 25 bp, Rattus norvegicus
gggactccacataattctgctgcta

SEQ ID NO: 450377 - DNA, 25 bp, Rattus norvegicus
gggactccacattattctgctgcta

SEQ ID NO: 450378 - DNA, 25 bp, Rattus norvegicus
gggactccagcacctattactacat

SEQ ID NO: 450379 - DNA, 25 bp, Rattus norvegicus
gggactccagcagctattactacat

SEQ ID NO: 450380 - DNA, 25 bp, Rattus norvegicus
gggactccaggaacacgctgcagga

SEQ ID NO: 450381 - DNA, 25 bp, Rattus norvegicus
gggactccaggatcacgctgcagga

SEQ ID NO: 450382 - DNA, 25 bp, Rattus norvegicus
gggactccagtgcttttatggcata

SEQ ID NO: 450383 - DNA, 25 bp, Rattus norvegicus
gggactccagtggttttatggcata

SEQ ID NO: 450384 - DNA, 25 bp, Rattus norvegicus
gggactccatggcagctggtctcca

SEQ ID NO: 450385 - DNA, 25 bp, Rattus norvegicus
gggactccatgggagctggtctcca

SEQ ID NO: 450386 - DNA, 25 bp, Rattus norvegicus
gggactccatgtacagctctgcgct

SEQ ID NO: 450387 - DNA, 25 bp, Rattus norvegicus
gggactccatgtagacagtgccaaa

SEQ ID NO: 450388 - DNA, 25 bp, Rattus norvegicus
gggactccatgttcagctctgcgct

SEQ ID NO: 450389 - DNA, 25 bp, Rattus norvegicus
gggactccatgttgacagtgccaaa

SEQ ID NO: 450390 - DNA, 25 bp, Rattus norvegicus
gggactccccacagtgttaatattt

SEQ ID NO: 450391 - DNA, 25 bp, Rattus norvegicus
gggactccccactgtgttaatattt

SEQ ID NO: 450392 - DNA, 25 bp, Rattus norvegicus
gggactccctgaagtttgatttcat

SEQ ID NO: 450393 - DNA, 25 bp, Rattus norvegicus
gggactccctgatgtttgatttcat

SEQ ID NO: 450394 - DNA, 25 bp, Rattus norvegicus
gggactccctttaacagatctagag

SEQ ID NO: 450395 - DNA, 25 bp, Rattus norvegicus
gggactcccttttacagatctagag

SEQ ID NO: 450396 - DNA, 25 bp, Rattus norvegicus
gggactccgcctaccagggctgaga

SEQ ID NO: 450397 - DNA, 25 bp, Rattus norvegicus
gggactccgccttccagggctgaga

SEQ ID NO: 450398 - DNA, 25 bp, Rattus norvegicus
gggactcctgctacgtgttaacgtg

SEQ ID NO: 450399 - DNA, 25 bp, Rattus norvegicus
gggactcctgcttcgtgttaacgtg

SEQ ID NO: 450400 - DNA, 25 bp, Rattus norvegicus
gggactcctggaagtctctggaaca

SEQ ID NO: 450401 - DNA, 25 bp, Rattus norvegicus
gggactcctggatgtctctggaaca

SEQ ID NO: 450402 - DNA, 25 bp, Rattus norvegicus
gggactccttcgcagacattggcag

SEQ ID NO: 450403 - DNA, 25 bp, Rattus norvegicus
gggactccttcggagacattggcag

SEQ ID NO: 450404 - DNA, 25 bp, Rattus norvegicus
gggactccttctccaacaggatgaa

SEQ ID NO: 450405 - DNA, 25 bp, Rattus norvegicus
gggactccttctgcaacaggatgaa

SEQ ID NO: 450406 - DNA, 25 bp, Rattus norvegicus
gggactccttggaccaatggactat

SEQ ID NO: 450407 - DNA, 25 bp, Rattus norvegicus
gggactccttggtccaatggactat

SEQ ID NO: 450408 - DNA, 25 bp, Rattus norvegicus
gggactcgaactcagctcttctgaa

SEQ ID NO: 450409 - DNA, 25 bp, Rattus norvegicus
gggactcgaactgagctcttctgaa

SEQ ID NO: 450410 - DNA, 25 bp, Rattus norvegicus
gggactcgatgtctcctctacagga

SEQ ID NO: 450411 - DNA, 25 bp, Rattus norvegicus
gggactcgatgtgtcctctacagga

SEQ ID NO: 450412 - DNA, 25 bp, Rattus norvegicus
gggactcggagaacatgcagcagaa

SEQ ID NO: 450413 - DNA, 25 bp, Rattus norvegicus
gggactcggagatcatgcagcagaa

SEQ ID NO: 450414 - DNA, 25 bp, Rattus norvegicus
gggactcgtagcaggcaacaaggcc

SEQ ID NO: 450415 - DNA, 25 bp, Rattus norvegicus
gggactcgtagctggcaacaaggcc

SEQ ID NO: 450416 - DNA, 25 bp, Rattus norvegicus
gggactcgttcacagaatcagggca

SEQ ID NO: 450417 - DNA, 25 bp, Rattus norvegicus
gggactcgttcagagaatcagggca

SEQ ID NO: 450418 - DNA, 25 bp, Rattus norvegicus
gggactctagtaattgacactgctg

SEQ ID NO: 450419 - DNA, 25 bp, Rattus norvegicus
gggactctagtatttgacactgctg

SEQ ID NO: 450420 - DNA, 25 bp, Rattus norvegicus
gggactctatatcttccagaacacc

SEQ ID NO: 450421 - DNA, 25 bp, Rattus norvegicus
gggactctatatgttccagaacacc

SEQ ID NO: 450422 - DNA, 25 bp, Rattus norvegicus
gggactctatcccaagctcaggttg

SEQ ID NO: 450423 - DNA, 25 bp, Rattus norvegicus
gggactctatccgaagctcaggttg

SEQ ID NO: 450424 - DNA, 25 bp, Rattus norvegicus
gggactctccctcttgaggatcaca

SEQ ID NO: 450425 - DNA, 25 bp, Rattus norvegicus
gggactctccctgttgaggatcaca

SEQ ID NO: 450426 - DNA, 25 bp, Rattus norvegicus
gggactctcgacaagggcagacatc

SEQ ID NO: 450427 - DNA, 25 bp, Rattus norvegicus
gggactctcgactagggcagacatc

SEQ ID NO: 450428 - DNA, 25 bp, Rattus norvegicus
gggactctcgagaattatgcagact

SEQ ID NO: 450429 - DNA, 25 bp, Rattus norvegicus
gggactctcgagtattatgcagact

SEQ ID NO: 450430 - DNA, 25 bp, Rattus norvegicus
gggactctctccacaggtggatcta

SEQ ID NO: 450431 - DNA, 25 bp, Rattus norvegicus
gggactctctcctcaggtggatcta

SEQ ID NO: 450432 - DNA, 25 bp, Rattus norvegicus
gggactctcttcacgccagagggaa

SEQ ID NO: 450433 - DNA, 25 bp, Rattus norvegicus
gggactctcttctcgccagagggaa

SEQ ID NO: 450434 - DNA, 25 bp, Rattus norvegicus
gggactctgagaactaaagcttaga

SEQ ID NO: 450435 - DNA, 25 bp, Rattus norvegicus
gggactctgagatctaaagcttaga

SEQ ID NO: 450436 - DNA, 25 bp, Rattus norvegicus
gggactctgagcagcaggatcagca

SEQ ID NO: 450437 - DNA, 25 bp, Rattus norvegicus
gggactctgagctgcaggatcagca

SEQ ID NO: 450438 - DNA, 25 bp, Rattus norvegicus
gggactctgccacatacttctgtgc

SEQ ID NO: 450439 - DNA, 25 bp, Rattus norvegicus
gggactctgccagatacttctgtgc

SEQ ID NO: 450440 - DNA, 25 bp, Rattus norvegicus
gggactctggatcaatttctggcac

SEQ ID NO: 450441 - DNA, 25 bp, Rattus norvegicus
gggactctggatgaatttctggcac

SEQ ID NO: 450442 - DNA, 25 bp, Rattus norvegicus
gggactctgtatattgtaacattca

SEQ ID NO: 450443 - DNA, 25 bp, Rattus norvegicus
gggactctgtattttgtaacattca

SEQ ID NO: 450444 - DNA, 25 bp, Rattus norvegicus
gggactctgtctattctatcattat

SEQ ID NO: 450445 - DNA, 25 bp, Rattus norvegicus
gggactctgtcttttctatcattat

SEQ ID NO: 450446 - DNA, 25 bp, Rattus norvegicus
gggactctgttgcttacccaagagc

SEQ ID NO: 450447 - DNA, 25 bp, Rattus norvegicus
gggactctgttggttacccaagagc

SEQ ID NO: 450448 - DNA, 25 bp, Rattus norvegicus
gggactcttcgtcatcgtgaacaga

SEQ ID NO: 450449 - DNA, 25 bp, Rattus norvegicus
gggactcttcgtgatcgtgaacaga

SEQ ID NO: 450450 - DNA, 25 bp, Rattus norvegicus
gggactcttggacgcttgcctgaat

SEQ ID NO: 450451 - DNA, 25 bp, Rattus norvegicus
gggactcttggaggcttgcctgaat

SEQ ID NO: 450452 - DNA, 25 bp, Rattus norvegicus
gggactcttggtagatcgcccatct

SEQ ID NO: 450453 - DNA, 25 bp, Rattus norvegicus
gggactcttggttgatcgcccatct

SEQ ID NO: 450454 - DNA, 25 bp, Rattus norvegicus
gggactcttgtcatacacacatact

SEQ ID NO: 450455 - DNA, 25 bp, Rattus norvegicus
gggactcttgtcttacacacatact

SEQ ID NO: 450456 - DNA, 25 bp, Rattus norvegicus
gggactcttgttctcagcaacaaca

SEQ ID NO: 450457 - DNA, 25 bp, Rattus norvegicus
gggactcttgttgtcagcaacaaca

SEQ ID NO: 450458 - DNA, 25 bp, Rattus norvegicus
gggactctttacaaactgctatctt

SEQ ID NO: 450459 - DNA, 25 bp, Rattus norvegicus
gggactctttactaactgctatctt

SEQ ID NO: 450460 - DNA, 25 bp, Rattus norvegicus
gggactgaaaacacgagccgccacg

SEQ ID NO: 450461 - DNA, 25 bp, Rattus norvegicus
gggactgaaaactcgagccgccacg

SEQ ID NO: 450462 - DNA, 25 bp, Rattus norvegicus
gggactgaaattactattgcctttg

SEQ ID NO: 450463 - DNA, 25 bp, Rattus norvegicus
gggactgaaatttctattgcctttg

SEQ ID NO: 450464 - DNA, 25 bp, Rattus norvegicus
gggactgaacagacttttgaaactc

SEQ ID NO: 450465 - DNA, 25 bp, Rattus norvegicus
gggactgaacagtcttttgaaactc

SEQ ID NO: 450466 - DNA, 25 bp, Rattus norvegicus
gggactgaagatcttcctgacttac

SEQ ID NO: 450467 - DNA, 25 bp, Rattus norvegicus
gggactgaagatgttcctgacttac

SEQ ID NO: 450468 - DNA, 25 bp, Rattus norvegicus
gggactgaagttcaaccacttgttt

SEQ ID NO: 450469 - DNA, 25 bp, Rattus norvegicus
gggactgaagttgaaccacttgttt

SEQ ID NO: 450470 - DNA, 25 bp, Rattus norvegicus
gggactgaatccaggacccacacac

SEQ ID NO: 450471 - DNA, 25 bp, Rattus norvegicus
gggactgaatcctggacccacacac

SEQ ID NO: 450472 - DNA, 25 bp, Rattus norvegicus
gggactgacaccagaacgatctgtc

SEQ ID NO: 450473 - DNA, 25 bp, Rattus norvegicus
gggactgacacctgaacgatctgtc

SEQ ID NO: 450474 - DNA, 25 bp, Rattus norvegicus
gggactgacattactcagtgggact

SEQ ID NO: 450475 - DNA, 25 bp, Rattus norvegicus
gggactgacatttctcagtgggact

SEQ ID NO: 450476 - DNA, 25 bp, Rattus norvegicus
gggactgaccagaggcagcgacacc

SEQ ID NO: 450477 - DNA, 25 bp, Rattus norvegicus
gggactgaccagtggcagcgacacc

SEQ ID NO: 450478 - DNA, 25 bp, Rattus norvegicus
gggactgaccgtaagccgtgcagat

SEQ ID NO: 450479 - DNA, 25 bp, Rattus norvegicus
gggactgaccgttagccgtgcagat

SEQ ID NO: 450480 - DNA, 25 bp, Rattus norvegicus
gggactgactgcatcttgggatcga

SEQ ID NO: 450481 - DNA, 25 bp, Rattus norvegicus
gggactgactgcttcttgggatcga

SEQ ID NO: 450482 - DNA, 25 bp, Rattus norvegicus
gggactgagaccctgccacatctat

SEQ ID NO: 450483 - DNA, 25 bp, Rattus norvegicus
gggactgagaccgtgccacatctat

SEQ ID NO: 450484 - DNA, 25 bp, Rattus norvegicus
gggactgagatcatgtgctttcaat

SEQ ID NO: 450485 - DNA, 25 bp, Rattus norvegicus
gggactgagatcttgtgctttcaat

SEQ ID NO: 450486 - DNA, 25 bp, Rattus norvegicus
gggactgagcccaggtctctgtgaa

SEQ ID NO: 450487 - DNA, 25 bp, Rattus norvegicus
gggactgagccctggtctctgtgaa

SEQ ID NO: 450488 - DNA, 25 bp, Rattus norvegicus
gggactgaggacattgactctcttc

SEQ ID NO: 450489 - DNA, 25 bp, Rattus norvegicus
gggactgaggactttgactctcttc

SEQ ID NO: 450490 - DNA, 25 bp, Rattus norvegicus
gggactgaggttaaagcacacacac

SEQ ID NO: 450491 - DNA, 25 bp, Rattus norvegicus
gggactgaggtttaagcacacacac

SEQ ID NO: 450492 - DNA, 25 bp, Rattus norvegicus
gggactgatacaatgacttttcttc

SEQ ID NO: 450493 - DNA, 25 bp, Rattus norvegicus
gggactgatacaccctgaaccctgg

SEQ ID NO: 450494 - DNA, 25 bp, Rattus norvegicus
gggactgatacagcctgaaccctgg

SEQ ID NO: 450495 - DNA, 25 bp, Rattus norvegicus
gggactgatacattgacttttcttc

SEQ ID NO: 450496 - DNA, 25 bp, Rattus norvegicus
gggactgatatcatcttgagctttt

SEQ ID NO: 450497 - DNA, 25 bp, Rattus norvegicus
gggactgatatcttcttgagctttt

SEQ ID NO: 450498 - DNA, 25 bp, Rattus norvegicus
gggactgattcgattgaagaagaaa

SEQ ID NO: 450499 - DNA, 25 bp, Rattus norvegicus
gggactgattcgtttgaagaagaaa

SEQ ID NO: 450500 - DNA, 25 bp, Rattus norvegicus
gggactgcaaagcacaccgaccata

SEQ ID NO: 450501 - DNA, 25 bp, Rattus norvegicus
gggactgcaaaggacaccgaccata

SEQ ID NO: 450502 - DNA, 25 bp, Rattus norvegicus
gggactgcacatccctttaaaataa

SEQ ID NO: 450503 - DNA, 25 bp, Rattus norvegicus
gggactgcacatgcctttaaaataa

SEQ ID NO: 450504 - DNA, 25 bp, Rattus norvegicus
gggactgcaccaccatatttcaact

SEQ ID NO: 450505 - DNA, 25 bp, Rattus norvegicus
gggactgcaccagcatatttcaact

SEQ ID NO: 450506 - DNA, 25 bp, Rattus norvegicus
gggactgcacgtatgcgctgcacag

SEQ ID NO: 450507 - DNA, 25 bp, Rattus norvegicus
gggactgcacgtttgcgctgcacag

SEQ ID NO: 450508 - DNA, 25 bp, Rattus norvegicus
gggactgcagtaactcatgtcacca

SEQ ID NO: 450509 - DNA, 25 bp, Rattus norvegicus
gggactgcagtatctcatgtcacca

SEQ ID NO: 450510 - DNA, 25 bp, Rattus norvegicus
gggactgcagtccttttcatttgtc

SEQ ID NO: 450511 - DNA, 25 bp, Rattus norvegicus
gggactgcagtcgttttcatttgtc

SEQ ID NO: 450512 - DNA, 25 bp, Rattus norvegicus
gggactgcatttctattcactattt

SEQ ID NO: 450513 - DNA, 25 bp, Rattus norvegicus
gggactgcatttctttctgtcaact

SEQ ID NO: 450514 - DNA, 25 bp, Rattus norvegicus
gggactgcatttgtattcactattt

SEQ ID NO: 450515 - DNA, 25 bp, Rattus norvegicus
gggactgcatttgtttctgtcaact

SEQ ID NO: 450516 - DNA, 25 bp, Rattus norvegicus
gggactgcctggattccatacacaa

SEQ ID NO: 450517 - DNA, 25 bp, Rattus norvegicus
gggactgcctggtttccatacacaa

SEQ ID NO: 450518 - DNA, 25 bp, Rattus norvegicus
gggactgcctttacctcggaatgag

SEQ ID NO: 450519 - DNA, 25 bp, Rattus norvegicus
gggactgccttttcctcggaatgag

SEQ ID NO: 450520 - DNA, 25 bp, Rattus norvegicus
gggactgcggcgacctgagcaactc

SEQ ID NO: 450521 - DNA, 25 bp, Rattus norvegicus
gggactgcggcgtcctgagcaactc

SEQ ID NO: 450522 - DNA, 25 bp, Rattus norvegicus
gggactgctaacacattcagggtca

SEQ ID NO: 450523 - DNA, 25 bp, Rattus norvegicus
gggactgctaactcattcagggtca

SEQ ID NO: 450524 - DNA, 25 bp, Rattus norvegicus
gggactgctagtcagaccttacata

SEQ ID NO: 450525 - DNA, 25 bp, Rattus norvegicus
gggactgctagtgagaccttacata

SEQ ID NO: 450526 - DNA, 25 bp, Rattus norvegicus
gggactgctcagactccaggatgca

SEQ ID NO: 450527 - DNA, 25 bp, Rattus norvegicus
gggactgctcagtctccaggatgca

SEQ ID NO: 450528 - DNA, 25 bp, Rattus norvegicus
gggactgctgataccattgggcctg

SEQ ID NO: 450529 - DNA, 25 bp, Rattus norvegicus
gggactgctgattccattgggcctg

SEQ ID NO: 450530 - DNA, 25 bp, Rattus norvegicus
gggactggaggcaacaccctttggc

SEQ ID NO: 450531 - DNA, 25 bp, Rattus norvegicus
gggactggaggctacaccctttggc

SEQ ID NO: 450532 - DNA, 25 bp, Rattus norvegicus
gggactggatccatacaatatgcta

SEQ ID NO: 450533 - DNA, 25 bp, Rattus norvegicus
gggactggatccttacaatatgcta

SEQ ID NO: 450534 - DNA, 25 bp, Rattus norvegicus
gggactggatgtcagtgccatcttt

SEQ ID NO: 450535 - DNA, 25 bp, Rattus norvegicus
gggactggatgtgagtgccatcttt

SEQ ID NO: 450536 - DNA, 25 bp, Rattus norvegicus
gggactggcagcaactgcagttcta

SEQ ID NO: 450537 - DNA, 25 bp, Rattus norvegicus
gggactggcagctactgcagttcta

SEQ ID NO: 450538 - DNA, 25 bp, Rattus norvegicus
gggactggcttcagcagactgtgat

SEQ ID NO: 450539 - DNA, 25 bp, Rattus norvegicus
gggactggcttctgcagactgtgat

SEQ ID NO: 450540 - DNA, 25 bp, Rattus norvegicus
gggactgggcataacatcgagccac

SEQ ID NO: 450541 - DNA, 25 bp, Rattus norvegicus
gggactgggcattacatcgagccac

SEQ ID NO: 450542 - DNA, 25 bp, Rattus norvegicus
gggactgggctcaaagtagctcttt

SEQ ID NO: 450543 - DNA, 25 bp, Rattus norvegicus
gggactgggctctaagtagctcttt

SEQ ID NO: 450544 - DNA, 25 bp, Rattus norvegicus
gggactgggtgtacgattttcaaat

SEQ ID NO: 450545 - DNA, 25 bp, Rattus norvegicus
gggactgggtgttcgattttcaaat

SEQ ID NO: 450546 - DNA, 25 bp, Rattus norvegicus
gggactggtgaccacctacaggcct

SEQ ID NO: 450547 - DNA, 25 bp, Rattus norvegicus
gggactggtgacgacctacaggcct

SEQ ID NO: 450548 - DNA, 25 bp, Rattus norvegicus
gggactggtttcagagaagcccctt

SEQ ID NO: 450549 - DNA, 25 bp, Rattus norvegicus
gggactggtttctgagaagcccctt

SEQ ID NO: 450550 - DNA, 25 bp, Rattus norvegicus
gggactgtacacaccttatttactt

SEQ ID NO: 450551 - DNA, 25 bp, Rattus norvegicus
gggactgtacactccttatttactt

SEQ ID NO: 450552 - DNA, 25 bp, Rattus norvegicus
gggactgtactgctgttctgcacct

SEQ ID NO: 450553 - DNA, 25 bp, Rattus norvegicus
gggactgtactggtgttctgcacct

SEQ ID NO: 450554 - DNA, 25 bp, Rattus norvegicus
gggactgtagatccctttcttcata

SEQ ID NO: 450555 - DNA, 25 bp, Rattus norvegicus
gggactgtagatgcctttcttcata

SEQ ID NO: 450556 - DNA, 25 bp, Rattus norvegicus
gggactgtagccaatgctctagaac

SEQ ID NO: 450557 - DNA, 25 bp, Rattus norvegicus
gggactgtagcctatgctctagaac

SEQ ID NO: 450558 - DNA, 25 bp, Rattus norvegicus
gggactgtatccattgctatcgctc

SEQ ID NO: 450559 - DNA, 25 bp, Rattus norvegicus
gggactgtatcctttgctatcgctc

SEQ ID NO: 450560 - DNA, 25 bp, Rattus norvegicus
gggactgtatctccgattttcaaat

SEQ ID NO: 450561 - DNA, 25 bp, Rattus norvegicus
gggactgtatctgcgattttcaaat

SEQ ID NO: 450562 - DNA, 25 bp, Rattus norvegicus
gggactgtcaatcacaggctttcat

SEQ ID NO: 450563 - DNA, 25 bp, Rattus norvegicus
gggactgtcaatgacaggctttcat

SEQ ID NO: 450564 - DNA, 25 bp, Rattus norvegicus
gggactgtcatacctatgtctgtgg

SEQ ID NO: 450565 - DNA, 25 bp, Rattus norvegicus
gggactgtcatagctatgtctgtgg

SEQ ID NO: 450566 - DNA, 25 bp, Rattus norvegicus
gggactgtccaacgcaccaatactt

SEQ ID NO: 450567 - DNA, 25 bp, Rattus norvegicus
gggactgtccaaggcaccaatactt

SEQ ID NO: 450568 - DNA, 25 bp, Rattus norvegicus
gggactgtccaccatacagactttt

SEQ ID NO: 450569 - DNA, 25 bp, Rattus norvegicus
gggactgtccacgatacagactttt

SEQ ID NO: 450570 - DNA, 25 bp, Rattus norvegicus
gggactgtcgggatacagcatgttt

SEQ ID NO: 450571 - DNA, 25 bp, Rattus norvegicus
gggactgtcgggttacagcatgttt

SEQ ID NO: 450572 - DNA, 25 bp, Rattus norvegicus
gggactgtcttaacccaggtatgta

SEQ ID NO: 450573 - DNA, 25 bp, Rattus norvegicus
gggactgtcttatcccaggtatgta

SEQ ID NO: 450574 - DNA, 25 bp, Rattus norvegicus
gggactgtcttgaagcacagtttct

SEQ ID NO: 450575 - DNA, 25 bp, Rattus norvegicus
gggactgtcttgtagcacagtttct

SEQ ID NO: 450576 - DNA, 25 bp, Rattus norvegicus
gggactgtgcctccatatatcacat

SEQ ID NO: 450577 - DNA, 25 bp, Rattus norvegicus
gggactgtgcctgcatatatcacat

SEQ ID NO: 450578 - DNA, 25 bp, Rattus norvegicus
gggactgtgctgacttttgttgata

SEQ ID NO: 450579 - DNA, 25 bp, Rattus norvegicus
gggactgtgctgatgctgctacacc

SEQ ID NO: 450580 - DNA, 25 bp, Rattus norvegicus
gggactgtgctgtcttttgttgata

SEQ ID NO: 450581 - DNA, 25 bp, Rattus norvegicus
gggactgtgctgttgctgctacacc

SEQ ID NO: 450582 - DNA, 25 bp, Rattus norvegicus
gggactgtgcttagtgcatctcatt

SEQ ID NO: 450583 - DNA, 25 bp, Rattus norvegicus
gggactgtgctttgtgcatctcatt

SEQ ID NO: 450584 - DNA, 25 bp, Rattus norvegicus
gggactgtgtagctttttgttaatt

SEQ ID NO: 450585 - DNA, 25 bp, Rattus norvegicus
gggactgtgtaggtttttgttaatt

SEQ ID NO: 450586 - DNA, 25 bp, Rattus norvegicus
gggactgtgtatatctccaaatgga

SEQ ID NO: 450587 - DNA, 25 bp, Rattus norvegicus
gggactgtgtatttctccaaatgga

SEQ ID NO: 450588 - DNA, 25 bp, Rattus norvegicus
gggactgtgtgaaacactgcattta

SEQ ID NO: 450589 - DNA, 25 bp, Rattus norvegicus
gggactgtgtgaatctagcatatac

SEQ ID NO: 450590 - DNA, 25 bp, Rattus norvegicus
gggactgtgtgatacactgcattta

SEQ ID NO: 450591 - DNA, 25 bp, Rattus norvegicus
gggactgtgtgattctagcatatac

SEQ ID NO: 450592 - DNA, 25 bp, Rattus norvegicus
gggactgtgtggatcaactgctacg

SEQ ID NO: 450593 - DNA, 25 bp, Rattus norvegicus
gggactgtgtggttcaactgctacg

SEQ ID NO: 450594 - DNA, 25 bp, Rattus norvegicus
gggactgttaagagccttgacccaa

SEQ ID NO: 450595 - DNA, 25 bp, Rattus norvegicus
gggactgttaagtgccttgacccaa

SEQ ID NO: 450596 - DNA, 25 bp, Rattus norvegicus
gggactgttaggacttttctacatt

SEQ ID NO: 450597 - DNA, 25 bp, Rattus norvegicus
gggactgttaggtcttttctacatt

SEQ ID NO: 450598 - DNA, 25 bp, Rattus norvegicus
gggactgttagtagccccagggata

SEQ ID NO: 450599 - DNA, 25 bp, Rattus norvegicus
gggactgttagttgccccagggata

SEQ ID NO: 450600 - DNA, 25 bp, Rattus norvegicus
gggactgttcctctatctagacaac

SEQ ID NO: 450601 - DNA, 25 bp, Rattus norvegicus
gggactgttcctgtatctagacaac

SEQ ID NO: 450602 - DNA, 25 bp, Rattus norvegicus
gggactgttttaaaagtagcttctg

SEQ ID NO: 450603 - DNA, 25 bp, Rattus norvegicus
gggactgttttaatcagtgtttcat

SEQ ID NO: 450604 - DNA, 25 bp, Rattus norvegicus
gggactgttttataagtagcttctg

SEQ ID NO: 450605 - DNA, 25 bp, Rattus norvegicus
gggactgttttattcagtgtttcat

SEQ ID NO: 450606 - DNA, 25 bp, Rattus norvegicus
gggacttaaactagcatgttatcag

SEQ ID NO: 450607 - DNA, 25 bp, Rattus norvegicus
gggacttaaacttgcatgttatcag

SEQ ID NO: 450608 - DNA, 25 bp, Rattus norvegicus
gggacttaacttacattttcctatg

SEQ ID NO: 450609 - DNA, 25 bp, Rattus norvegicus
gggacttaactttcattttcctatg

SEQ ID NO: 450610 - DNA, 25 bp, Rattus norvegicus
gggacttaagataactggagtttat

SEQ ID NO: 450611 - DNA, 25 bp, Rattus norvegicus
gggacttaagattactggagtttat

SEQ ID NO: 450612 - DNA, 25 bp, Rattus norvegicus
gggacttaagtcactctctcttctc

SEQ ID NO: 450613 - DNA, 25 bp, Rattus norvegicus
gggacttaagtccttgtcagaggaa

SEQ ID NO: 450614 - DNA, 25 bp, Rattus norvegicus
gggacttaagtcgttgtcagaggaa

SEQ ID NO: 450615 - DNA, 25 bp, Rattus norvegicus
gggacttaagtctctctctcttctc

SEQ ID NO: 450616 - DNA, 25 bp, Rattus norvegicus
gggacttacaaaccaagcaccttct

SEQ ID NO: 450617 - DNA, 25 bp, Rattus norvegicus
gggacttacaaagcaagcaccttct

SEQ ID NO: 450618 - DNA, 25 bp, Rattus norvegicus
gggacttacacaactggaaactctt

SEQ ID NO: 450619 - DNA, 25 bp, Rattus norvegicus
gggacttacacatctggaaactctt

SEQ ID NO: 450620 - DNA, 25 bp, Rattus norvegicus
gggacttacaccagtatgaacacct

SEQ ID NO: 450621 - DNA, 25 bp, Rattus norvegicus
gggacttacacctgtatgaacacct

SEQ ID NO: 450622 - DNA, 25 bp, Rattus norvegicus
gggacttactgcacaaaccaaaaat

SEQ ID NO: 450623 - DNA, 25 bp, Rattus norvegicus
gggacttactgctcaaaccaaaaat

SEQ ID NO: 450624 - DNA, 25 bp, Rattus norvegicus
gggacttagatgcacagtgtcatga

SEQ ID NO: 450625 - DNA, 25 bp, Rattus norvegicus
gggacttagatggacagtgtcatga

SEQ ID NO: 450626 - DNA, 25 bp, Rattus norvegicus
gggacttagctaccaggaactgcct

SEQ ID NO: 450627 - DNA, 25 bp, Rattus norvegicus
gggacttagctagcaggaactgcct

SEQ ID NO: 450628 - DNA, 25 bp, Rattus norvegicus
gggacttcaaagcatctgggcctca

SEQ ID NO: 450629 - DNA, 25 bp, Rattus norvegicus
gggacttcaaaggatctgggcctca

SEQ ID NO: 450630 - DNA, 25 bp, Rattus norvegicus
gggacttcacctctagccggatggt

SEQ ID NO: 450631 - DNA, 25 bp, Rattus norvegicus
gggacttcacctgtagccggatggt

SEQ ID NO: 450632 - DNA, 25 bp, Rattus norvegicus
gggacttcactgaaactgactgcat

SEQ ID NO: 450633 - DNA, 25 bp, Rattus norvegicus
gggacttcactgtaactgactgcat

SEQ ID NO: 450634 - DNA, 25 bp, Rattus norvegicus
gggacttcagggactgatatcttat

SEQ ID NO: 450635 - DNA, 25 bp, Rattus norvegicus
gggacttcagggtctgatatcttat

SEQ ID NO: 450636 - DNA, 25 bp, Rattus norvegicus
gggacttcagttacagctttgagga

SEQ ID NO: 450637 - DNA, 25 bp, Rattus norvegicus
gggacttcagtttcagctttgagga

SEQ ID NO: 450638 - DNA, 25 bp, Rattus norvegicus
gggacttcatacaattgcagagctt

SEQ ID NO: 450639 - DNA, 25 bp, Rattus norvegicus
gggacttcatactattgcagagctt

SEQ ID NO: 450640 - DNA, 25 bp, Rattus norvegicus
gggacttcatcaacgtcatcttaca

SEQ ID NO: 450641 - DNA, 25 bp, Rattus norvegicus
gggacttcatcatcgtcatcttaca

SEQ ID NO: 450642 - DNA, 25 bp, Rattus norvegicus
gggacttcatctactatcattagag

SEQ ID NO: 450643 - DNA, 25 bp, Rattus norvegicus
gggacttcatctctcaagccctgaa

SEQ ID NO: 450644 - DNA, 25 bp, Rattus norvegicus
gggacttcatctgtcaagccctgaa

SEQ ID NO: 450645 - DNA, 25 bp, Rattus norvegicus
gggacttcatcttctatcattagag

SEQ ID NO: 450646 - DNA, 25 bp, Rattus norvegicus
gggacttcatgcaaagtttctccag

SEQ ID NO: 450647 - DNA, 25 bp, Rattus norvegicus
gggacttcatgctaagtttctccag

SEQ ID NO: 450648 - DNA, 25 bp, Rattus norvegicus
gggacttccagactgtgttgcctcc

SEQ ID NO: 450649 - DNA, 25 bp, Rattus norvegicus
gggacttccagagtgtgttgcctcc

SEQ ID NO: 450650 - DNA, 25 bp, Rattus norvegicus
gggacttcccataataggcaactga

SEQ ID NO: 450651 - DNA, 25 bp, Rattus norvegicus
gggacttcccattataggcaactga

SEQ ID NO: 450652 - DNA, 25 bp, Rattus norvegicus
gggacttccccaacctgaagaggat

SEQ ID NO: 450653 - DNA, 25 bp, Rattus norvegicus
gggacttccccatcctgaagaggat

SEQ ID NO: 450654 - DNA, 25 bp, Rattus norvegicus
gggacttccgctcgtctgatggaca

SEQ ID NO: 450655 - DNA, 25 bp, Rattus norvegicus
gggacttccgctggtctgatggaca

SEQ ID NO: 450656 - DNA, 25 bp, Rattus norvegicus
gggacttcctaaatgatccagccac

SEQ ID NO: 450657 - DNA, 25 bp, Rattus norvegicus
gggacttcctaattgatccagccac

SEQ ID NO: 450658 - DNA, 25 bp, Rattus norvegicus
gggacttcctgtattggctctgcct

SEQ ID NO: 450659 - DNA, 25 bp, Rattus norvegicus
gggacttcctgtccgaactgtcaga

SEQ ID NO: 450660 - DNA, 25 bp, Rattus norvegicus
gggacttcctgtgcgaactgtcaga

SEQ ID NO: 450661 - DNA, 25 bp, Rattus norvegicus
gggacttcctgttttggctctgcct

SEQ ID NO: 450662 - DNA, 25 bp, Rattus norvegicus
gggacttcgaggcttacacgaaaat

SEQ ID NO: 450663 - DNA, 25 bp, Rattus norvegicus
gggacttcgagggttacacgaaaat

SEQ ID NO: 450664 - DNA, 25 bp, Rattus norvegicus
gggacttcgattcctgtctggccgt

SEQ ID NO: 450665 - DNA, 25 bp, Rattus norvegicus
gggacttcgattgctgtctggccgt

SEQ ID NO: 450666 - DNA, 25 bp, Rattus norvegicus
gggacttcgcatacatgtactacga

SEQ ID NO: 450667 - DNA, 25 bp, Rattus norvegicus
gggacttcgcattcatgtactacga

SEQ ID NO: 450668 - DNA, 25 bp, Rattus norvegicus
gggacttcgtgacgcaatggcttca

SEQ ID NO: 450669 - DNA, 25 bp, Rattus norvegicus
gggacttcgtgaggcaatggcttca

SEQ ID NO: 450670 - DNA, 25 bp, Rattus norvegicus
gggacttctacaataggcaaatcaa

SEQ ID NO: 450671 - DNA, 25 bp, Rattus norvegicus
gggacttctacattaggcaaatcaa

SEQ ID NO: 450672 - DNA, 25 bp, Rattus norvegicus
gggacttctagtacttatacaacca

SEQ ID NO: 450673 - DNA, 25 bp, Rattus norvegicus
gggacttctagttcttatacaacca

SEQ ID NO: 450674 - DNA, 25 bp, Rattus norvegicus
gggacttctcataatcagatgcttc

SEQ ID NO: 450675 - DNA, 25 bp, Rattus norvegicus
gggacttctcattatcagatgcttc

SEQ ID NO: 450676 - DNA, 25 bp, Rattus norvegicus
gggacttctcctagaatgagcacag

SEQ ID NO: 450677 - DNA, 25 bp, Rattus norvegicus
gggacttctccttgaatgagcacag

SEQ ID NO: 450678 - DNA, 25 bp, Rattus norvegicus
gggacttctctgaaactctggagga

SEQ ID NO: 450679 - DNA, 25 bp, Rattus norvegicus
gggacttctctgtaactctggagga

SEQ ID NO: 450680 - DNA, 25 bp, Rattus norvegicus
gggacttctggccatcagcatgtga

SEQ ID NO: 450681 - DNA, 25 bp, Rattus norvegicus
gggacttctggcgatcagcatgtga

SEQ ID NO: 450682 - DNA, 25 bp, Rattus norvegicus
gggacttcttcaacatccataggaa

SEQ ID NO: 450683 - DNA, 25 bp, Rattus norvegicus
gggacttcttcatcatccataggaa

SEQ ID NO: 450684 - DNA, 25 bp, Rattus norvegicus
gggacttgaaagactgacccaagtt

SEQ ID NO: 450685 - DNA, 25 bp, Rattus norvegicus
gggacttgaaagtctgacccaagtt

SEQ ID NO: 450686 - DNA, 25 bp, Rattus norvegicus
gggacttgaagcagagccccggtac

SEQ ID NO: 450687 - DNA, 25 bp, Rattus norvegicus
gggacttgaagctgagccccggtac

SEQ ID NO: 450688 - DNA, 25 bp, Rattus norvegicus
gggacttgagatccagccacagcct

SEQ ID NO: 450689 - DNA, 25 bp, Rattus norvegicus
gggacttgagatgcagccacagcct

SEQ ID NO: 450690 - DNA, 25 bp, Rattus norvegicus
gggacttgatacagcctttggctaa

SEQ ID NO: 450691 - DNA, 25 bp, Rattus norvegicus
gggacttgatactgcctttggctaa

SEQ ID NO: 450692 - DNA, 25 bp, Rattus norvegicus
gggacttgatcacttcccactactt

SEQ ID NO: 450693 - DNA, 25 bp, Rattus norvegicus
gggacttgatcagttcccactactt

SEQ ID NO: 450694 - DNA, 25 bp, Rattus norvegicus
gggacttgcaaaccttctaccgaag

SEQ ID NO: 450695 - DNA, 25 bp, Rattus norvegicus
gggacttgcaaagcttctaccgaag

SEQ ID NO: 450696 - DNA, 25 bp, Rattus norvegicus
gggacttgcatacagccatgattct

SEQ ID NO: 450697 - DNA, 25 bp, Rattus norvegicus
gggacttgcatagagccatgattct

SEQ ID NO: 450698 - DNA, 25 bp, Rattus norvegicus
gggacttgcatgacccggtctgtta

SEQ ID NO: 450699 - DNA, 25 bp, Rattus norvegicus
gggacttgcatgtcccggtctgtta

SEQ ID NO: 450700 - DNA, 25 bp, Rattus norvegicus
gggacttggtttaggactctgatga

SEQ ID NO: 450701 - DNA, 25 bp, Rattus norvegicus
gggacttggtttccccatgtcaaga

SEQ ID NO: 450702 - DNA, 25 bp, Rattus norvegicus
gggacttggtttgcccatgtcaaga

SEQ ID NO: 450703 - DNA, 25 bp, Rattus norvegicus
gggacttggttttggactctgatga

SEQ ID NO: 450704 - DNA, 25 bp, Rattus norvegicus
gggacttgtaaactgctgtagcctg

SEQ ID NO: 450705 - DNA, 25 bp, Rattus norvegicus
gggacttgtaaagtgctgtagcctg

SEQ ID NO: 450706 - DNA, 25 bp, Rattus norvegicus
gggacttgtcaacaactctacagac

SEQ ID NO: 450707 - DNA, 25 bp, Rattus norvegicus
gggacttgtcaagaactctacagac

SEQ ID NO: 450708 - DNA, 25 bp, Rattus norvegicus
gggacttgtcacctatacaatggta

SEQ ID NO: 450709 - DNA, 25 bp, Rattus norvegicus
gggacttgtcacgtatacaatggta

SEQ ID NO: 450710 - DNA, 25 bp, Rattus norvegicus
gggacttgtcatagtttcatcagct

SEQ ID NO: 450711 - DNA, 25 bp, Rattus norvegicus
gggacttgtcattgtttcatcagct

SEQ ID NO: 450712 - DNA, 25 bp, Rattus norvegicus
gggacttgtccaattgtcaggcatc

SEQ ID NO: 450713 - DNA, 25 bp, Rattus norvegicus
gggacttgtccatttgtcaggcatc

SEQ ID NO: 450714 - DNA, 25 bp, Rattus norvegicus
gggacttgtctaagcaatttcagtt

SEQ ID NO: 450715 - DNA, 25 bp, Rattus norvegicus
gggacttgtctatgcaatttcagtt

SEQ ID NO: 450716 - DNA, 25 bp, Rattus norvegicus
gggacttgtgtacagcatttggaaa

SEQ ID NO: 450717 - DNA, 25 bp, Rattus norvegicus
gggacttgtgtagagcatttggaaa

SEQ ID NO: 450718 - DNA, 25 bp, Rattus norvegicus
gggacttgttaacactctgaggaaa

SEQ ID NO: 450719 - DNA, 25 bp, Rattus norvegicus
gggacttgttaagactctgaggaaa

SEQ ID NO: 450720 - DNA, 25 bp, Rattus norvegicus
gggacttgttatcgcatcagctgct

SEQ ID NO: 450721 - DNA, 25 bp, Rattus norvegicus
gggacttgttatggcatcagctgct

SEQ ID NO: 450722 - DNA, 25 bp, Rattus norvegicus
gggacttgtttcacgatgagctgga

SEQ ID NO: 450723 - DNA, 25 bp, Rattus norvegicus
gggacttgtttccattcaatgacaa

SEQ ID NO: 450724 - DNA, 25 bp, Rattus norvegicus
gggacttgtttcgattcaatgacaa

SEQ ID NO: 450725 - DNA, 25 bp, Rattus norvegicus
gggacttgtttctcgatgagctgga

SEQ ID NO: 450726 - DNA, 25 bp, Rattus norvegicus
gggactttaagccaccacacctgga

SEQ ID NO: 450727 - DNA, 25 bp, Rattus norvegicus
gggactttaagcgaccacacctgga

SEQ ID NO: 450728 - DNA, 25 bp, Rattus norvegicus
gggactttatatatcaccactacta

SEQ ID NO: 450729 - DNA, 25 bp, Rattus norvegicus
gggactttatatttcaccactacta

SEQ ID NO: 450730 - DNA, 25 bp, Rattus norvegicus
gggactttatgaagcccaaactggc

SEQ ID NO: 450731 - DNA, 25 bp, Rattus norvegicus
gggactttatgatgcccaaactggc

SEQ ID NO: 450732 - DNA, 25 bp, Rattus norvegicus
gggactttcagaaccaagctgggct

SEQ ID NO: 450733 - DNA, 25 bp, Rattus norvegicus
gggactttcagaaccgtggtcgcta

SEQ ID NO: 450734 - DNA, 25 bp, Rattus norvegicus
gggactttcagacctgtatgccaag

SEQ ID NO: 450735 - DNA, 25 bp, Rattus norvegicus
gggactttcagagctgtatgccaag

SEQ ID NO: 450736 - DNA, 25 bp, Rattus norvegicus
gggactttcagatccaagctgggct

SEQ ID NO: 450737 - DNA, 25 bp, Rattus norvegicus
gggactttcagatccgtggtcgcta

SEQ ID NO: 450738 - DNA, 25 bp, Rattus norvegicus
gggactttcagtcccacgccttcga

SEQ ID NO: 450739 - DNA, 25 bp, Rattus norvegicus
gggactttcagtgccacgccttcga

SEQ ID NO: 450740 - DNA, 25 bp, Rattus norvegicus
gggactttcatcaggaatcgcctca

SEQ ID NO: 450741 - DNA, 25 bp, Rattus norvegicus
gggactttcatctggaatcgcctca

SEQ ID NO: 450742 - DNA, 25 bp, Rattus norvegicus
gggactttcctaccgtccacaatga

SEQ ID NO: 450743 - DNA, 25 bp, Rattus norvegicus
gggactttcctagcgtccacaatga

SEQ ID NO: 450744 - DNA, 25 bp, Rattus norvegicus
gggactttcctcacagattacatct

SEQ ID NO: 450745 - DNA, 25 bp, Rattus norvegicus
gggactttcctctcagattacatct

SEQ ID NO: 450746 - DNA, 25 bp, Rattus norvegicus
gggactttcgttccactgtggtctt

SEQ ID NO: 450747 - DNA, 25 bp, Rattus norvegicus
gggactttcgttgcactgtggtctt

SEQ ID NO: 450748 - DNA, 25 bp, Rattus norvegicus
gggactttcttccttctatatgtaa

SEQ ID NO: 450749 - DNA, 25 bp, Rattus norvegicus
gggactttcttcgttctatatgtaa

SEQ ID NO: 450750 - DNA, 25 bp, Rattus norvegicus
gggactttctttagtatctgtcttg

SEQ ID NO: 450751 - DNA, 25 bp, Rattus norvegicus
gggactttcttttgtatctgtcttg

SEQ ID NO: 450752 - DNA, 25 bp, Rattus norvegicus
gggactttgaaaccatccgattggc

SEQ ID NO: 450753 - DNA, 25 bp, Rattus norvegicus
gggactttgaaagcatccgattggc

SEQ ID NO: 450754 - DNA, 25 bp, Rattus norvegicus
gggactttgcccatccaaggagagc

SEQ ID NO: 450755 - DNA, 25 bp, Rattus norvegicus
gggactttgcccttccaaggagagc

SEQ ID NO: 450756 - DNA, 25 bp, Rattus norvegicus
gggactttgggaaggagtttcatca

SEQ ID NO: 450757 - DNA, 25 bp, Rattus norvegicus
gggactttgggatggagtttcatca

SEQ ID NO: 450758 - DNA, 25 bp, Rattus norvegicus
gggactttggtacagcatctgatct

SEQ ID NO: 450759 - DNA, 25 bp, Rattus norvegicus
gggactttggtagagcatctgatct

SEQ ID NO: 450760 - DNA, 25 bp, Rattus norvegicus
gggactttgtgtaaattgttctcgt

SEQ ID NO: 450761 - DNA, 25 bp, Rattus norvegicus
gggactttgtgttaattgttctcgt

SEQ ID NO: 450762 - DNA, 25 bp, Rattus norvegicus
gggacttttattagaggaggtgact

SEQ ID NO: 450763 - DNA, 25 bp, Rattus norvegicus
gggacttttatttgaggaggtgact

SEQ ID NO: 450764 - DNA, 25 bp, Rattus norvegicus
gggacttttctcctataactctctc

SEQ ID NO: 450765 - DNA, 25 bp, Rattus norvegicus
gggacttttctcgtataactctctc

SEQ ID NO: 450766 - DNA, 25 bp, Rattus norvegicus
gggacttttcttcaatggaggactt

SEQ ID NO: 450767 - DNA, 25 bp, Rattus norvegicus
gggacttttcttcatggctttattg

SEQ ID NO: 450768 - DNA, 25 bp, Rattus norvegicus
gggacttttcttctgctaatggttc

SEQ ID NO: 450769 - DNA, 25 bp, Rattus norvegicus
gggacttttcttgaatggaggactt

SEQ ID NO: 450770 - DNA, 25 bp, Rattus norvegicus
gggacttttcttgatggctttattg

SEQ ID NO: 450771 - DNA, 25 bp, Rattus norvegicus
gggacttttcttgtgctaatggttc

SEQ ID NO: 450772 - DNA, 25 bp, Rattus norvegicus
gggacttttgtcactgtatattcac

SEQ ID NO: 450773 - DNA, 25 bp, Rattus norvegicus
gggacttttgtctctgtatattcac

SEQ ID NO: 450774 - DNA, 25 bp, Rattus norvegicus
gggactttttcaagccttagcagat

SEQ ID NO: 450775 - DNA, 25 bp, Rattus norvegicus
gggactttttcatgccttagcagat

SEQ ID NO: 450776 - DNA, 25 bp, Rattus norvegicus
gggagaaaagtccagccagcattca

SEQ ID NO: 450777 - DNA, 25 bp, Rattus norvegicus
gggagaaaagtcgagccagcattca

SEQ ID NO: 450778 - DNA, 25 bp, Rattus norvegicus
gggagaaacagacacccagcatttg

SEQ ID NO: 450779 - DNA, 25 bp, Rattus norvegicus
gggagaaacagagacccagcatttg

SEQ ID NO: 450780 - DNA, 25 bp, Rattus norvegicus
gggagaaacctaaacctttgcccag

SEQ ID NO: 450781 - DNA, 25 bp, Rattus norvegicus
gggagaaacctatacctttgcccag

SEQ ID NO: 450782 - DNA, 25 bp, Rattus norvegicus
gggagaaactgcctctgacatcaac

SEQ ID NO: 450783 - DNA, 25 bp, Rattus norvegicus
gggagaaactgcgtctgacatcaac

SEQ ID NO: 450784 - DNA, 25 bp, Rattus norvegicus
gggagaaatcccaggtcaggccaca

SEQ ID NO: 450785 - DNA, 25 bp, Rattus norvegicus
gggagaaatccctggtcaggccaca

SEQ ID NO: 450786 - DNA, 25 bp, Rattus norvegicus
gggagaacaacacccagacgcatca

SEQ ID NO: 450787 - DNA, 25 bp, Rattus norvegicus
gggagaacaacaccttttgctcttt

SEQ ID NO: 450788 - DNA, 25 bp, Rattus norvegicus
gggagaacaacagccagacgcatca

SEQ ID NO: 450789 - DNA, 25 bp, Rattus norvegicus
gggagaacaacagcttttgctcttt

SEQ ID NO: 450790 - DNA, 25 bp, Rattus norvegicus
gggagaacattcacatggcctagga

SEQ ID NO: 450791 - DNA, 25 bp, Rattus norvegicus
gggagaacattctcatggcctagga

SEQ ID NO: 450792 - DNA, 25 bp, Rattus norvegicus
gggagaaccgagaccttcattcgct

SEQ ID NO: 450793 - DNA, 25 bp, Rattus norvegicus
gggagaaccgagtccttcattcgct

SEQ ID NO: 450794 - DNA, 25 bp, Rattus norvegicus
gggagaaccgatagccatcggcctt

SEQ ID NO: 450795 - DNA, 25 bp, Rattus norvegicus
gggagaaccgattgccatcggcctt

SEQ ID NO: 450796 - DNA, 25 bp, Rattus norvegicus
gggagaaccgctcaccattagaaat

SEQ ID NO: 450797 - DNA, 25 bp, Rattus norvegicus
gggagaaccgctgaccattagaaat

SEQ ID NO: 450798 - DNA, 25 bp, Rattus norvegicus
gggagaaccggcaccactcatcttt

SEQ ID NO: 450799 - DNA, 25 bp, Rattus norvegicus
gggagaaccggctccactcatcttt

SEQ ID NO: 450800 - DNA, 25 bp, Rattus norvegicus
gggagaacctggaccatctccgaaa

SEQ ID NO: 450801 - DNA, 25 bp, Rattus norvegicus
gggagaacctggtccatctccgaaa

SEQ ID NO: 450802 - DNA, 25 bp, Rattus norvegicus
gggagaacgacaaactcacttgtgt

SEQ ID NO: 450803 - DNA, 25 bp, Rattus norvegicus
gggagaacgacatactcacttgtgt

SEQ ID NO: 450804 - DNA, 25 bp, Rattus norvegicus
gggagaactcaccacgttgctggtt

SEQ ID NO: 450805 - DNA, 25 bp, Rattus norvegicus
gggagaactcacgacgttgctggtt

SEQ ID NO: 450806 - DNA, 25 bp, Rattus norvegicus
gggagaactggaccggctttattca

SEQ ID NO: 450807 - DNA, 25 bp, Rattus norvegicus
gggagaactggagcggctttattca

SEQ ID NO: 450808 - DNA, 25 bp, Rattus norvegicus
gggagaacttccaggcataatgact

SEQ ID NO: 450809 - DNA, 25 bp, Rattus norvegicus
gggagaacttcctggcataatgact

SEQ ID NO: 450810 - DNA, 25 bp, Rattus norvegicus
gggagaagaagcacgcctggcccat

SEQ ID NO: 450811 - DNA, 25 bp, Rattus norvegicus
gggagaagaagctcgcctggcccat

SEQ ID NO: 450812 - DNA, 25 bp, Rattus norvegicus
gggagaagacctcccttcacacaag

SEQ ID NO: 450813 - DNA, 25 bp, Rattus norvegicus
gggagaagacctgccttcacacaag

SEQ ID NO: 450814 - DNA, 25 bp, Rattus norvegicus
gggagaagagcacccagcacacttg

SEQ ID NO: 450815 - DNA, 25 bp, Rattus norvegicus
gggagaagagcagccagcacacttg

SEQ ID NO: 450816 - DNA, 25 bp, Rattus norvegicus
gggagaagagttcccacaactccag

SEQ ID NO: 450817 - DNA, 25 bp, Rattus norvegicus
gggagaagagttgccacaactccag

SEQ ID NO: 450818 - DNA, 25 bp, Rattus norvegicus
gggagaagatccaatctgcctttaa

SEQ ID NO: 450819 - DNA, 25 bp, Rattus norvegicus
gggagaagatcctatctgcctttaa

SEQ ID NO: 450820 - DNA, 25 bp, Rattus norvegicus
gggagaagccccacgcctgtgacac

SEQ ID NO: 450821 - DNA, 25 bp, Rattus norvegicus
gggagaagcccctcgcctgtgacac

SEQ ID NO: 450822 - DNA, 25 bp, Rattus norvegicus
gggagaagccctcccgatgcaacga

SEQ ID NO: 450823 - DNA, 25 bp, Rattus norvegicus
gggagaagccctgccgatgcaacga

SEQ ID NO: 450824 - DNA, 25 bp, Rattus norvegicus
gggagaagccgcatcaagaggacct

SEQ ID NO: 450825 - DNA, 25 bp, Rattus norvegicus
gggagaagccgcttcaagaggacct

SEQ ID NO: 450826 - DNA, 25 bp, Rattus norvegicus
gggagaagctagcagcaccccactt

SEQ ID NO: 450827 - DNA, 25 bp, Rattus norvegicus
gggagaagctaggagcaccccactt

SEQ ID NO: 450828 - DNA, 25 bp, Rattus norvegicus
gggagaagttgcattttctcctcct

SEQ ID NO: 450829 - DNA, 25 bp, Rattus norvegicus
gggagaagttgctttttctcctcct

SEQ ID NO: 450830 - DNA, 25 bp, Rattus norvegicus
gggagaataaatcctggcctacttt

SEQ ID NO: 450831 - DNA, 25 bp, Rattus norvegicus
gggagaataaatgctggcctacttt

SEQ ID NO: 450832 - DNA, 25 bp, Rattus norvegicus
gggagaatattcatcttctcagtta

SEQ ID NO: 450833 - DNA, 25 bp, Rattus norvegicus
gggagaatattcttcttctcagtta

SEQ ID NO: 450834 - DNA, 25 bp, Rattus norvegicus
gggagaatcactaattcaaccctat

SEQ ID NO: 450835 - DNA, 25 bp, Rattus norvegicus
gggagaatcacttattcaaccctat

SEQ ID NO: 450836 - DNA, 25 bp, Rattus norvegicus
gggagaatcagtcttttttaagcca

SEQ ID NO: 450837 - DNA, 25 bp, Rattus norvegicus
gggagaatcagtgttttttaagcca

SEQ ID NO: 450838 - DNA, 25 bp, Rattus norvegicus
gggagaatccaactacatttcatta

SEQ ID NO: 450839 - DNA, 25 bp, Rattus norvegicus
gggagaatccaagtacatttcatta

SEQ ID NO: 450840 - DNA, 25 bp, Rattus norvegicus
gggagaatccgaccataccactaca

SEQ ID NO: 450841 - DNA, 25 bp, Rattus norvegicus
gggagaatccgagcataccactaca

SEQ ID NO: 450842 - DNA, 25 bp, Rattus norvegicus
gggagaatctgcacttatcggaaga

SEQ ID NO: 450843 - DNA, 25 bp, Rattus norvegicus
gggagaatctgctcttatcggaaga

SEQ ID NO: 450844 - DNA, 25 bp, Rattus norvegicus
gggagaatgcccatcaatcgtggcc

SEQ ID NO: 450845 - DNA, 25 bp, Rattus norvegicus
gggagaatgcccttcaatcgtggcc

SEQ ID NO: 450846 - DNA, 25 bp, Rattus norvegicus
gggagaatgcttatggacagttatt

SEQ ID NO: 450847 - DNA, 25 bp, Rattus norvegicus
gggagaatgcttttggacagttatt

SEQ ID NO: 450848 - DNA, 25 bp, Rattus norvegicus
gggagaatggttacgcctcttgtct

SEQ ID NO: 450849 - DNA, 25 bp, Rattus norvegicus
gggagaatggtttcgcctcttgtct

SEQ ID NO: 450850 - DNA, 25 bp, Rattus norvegicus
gggagaatgtaaccactccttccac

SEQ ID NO: 450851 - DNA, 25 bp, Rattus norvegicus
gggagaatgtaagcactccttccac

SEQ ID NO: 450852 - DNA, 25 bp, Rattus norvegicus
gggagaatgtttcgacagtacctga

SEQ ID NO: 450853 - DNA, 25 bp, Rattus norvegicus
gggagaatgtttggacagtacctga

SEQ ID NO: 450854 - DNA, 25 bp, Rattus norvegicus
gggagaattccacagccattcagag

SEQ ID NO: 450855 - DNA, 25 bp, Rattus norvegicus
gggagaattccagagccattcagag

SEQ ID NO: 450856 - DNA, 25 bp, Rattus norvegicus
gggagacaacctaggatatacaaaa

SEQ ID NO: 450857 - DNA, 25 bp, Rattus norvegicus
gggagacaaccttggatatacaaaa

SEQ ID NO: 450858 - DNA, 25 bp, Rattus norvegicus
gggagacaagccaagtcggccctct

SEQ ID NO: 450859 - DNA, 25 bp, Rattus norvegicus
gggagacaagcctagtcggccctct

SEQ ID NO: 450860 - DNA, 25 bp, Rattus norvegicus
gggagacaagttccgcttcttcagc

SEQ ID NO: 450861 - DNA, 25 bp, Rattus norvegicus
gggagacaagttgcgcttcttcagc

SEQ ID NO: 450862 - DNA, 25 bp, Rattus norvegicus
gggagacacagccacttgtttgtct

SEQ ID NO: 450863 - DNA, 25 bp, Rattus norvegicus
gggagacacagcgacttgtttgtct

SEQ ID NO: 450864 - DNA, 25 bp, Rattus norvegicus
gggagacaccaaattctatggcaaa

SEQ ID NO: 450865 - DNA, 25 bp, Rattus norvegicus
gggagacaccaatttctatggcaaa

SEQ ID NO: 450866 - DNA, 25 bp, Rattus norvegicus
gggagacagagtatccacctactga

SEQ ID NO: 450867 - DNA, 25 bp, Rattus norvegicus
gggagacagagtttccacctactga

SEQ ID NO: 450868 - DNA, 25 bp, Rattus norvegicus
gggagacagcacagcacttcttctg

SEQ ID NO: 450869 - DNA, 25 bp, Rattus norvegicus
gggagacagcactgcacttcttctg

SEQ ID NO: 450870 - DNA, 25 bp, Rattus norvegicus
gggagacagcctcctcaggagcaaa

SEQ ID NO: 450871 - DNA, 25 bp, Rattus norvegicus
gggagacagcctgctcaggagcaaa

SEQ ID NO: 450872 - DNA, 25 bp, Rattus norvegicus
gggagacagctacgattctcgccta

SEQ ID NO: 450873 - DNA, 25 bp, Rattus norvegicus
gggagacagctaggattctcgccta

SEQ ID NO: 450874 - DNA, 25 bp, Rattus norvegicus
gggagacagtggatcccaccttaca

SEQ ID NO: 450875 - DNA, 25 bp, Rattus norvegicus
gggagacagtggttcccaccttaca

SEQ ID NO: 450876 - DNA, 25 bp, Rattus norvegicus
gggagacagtttatggctgctttca

SEQ ID NO: 450877 - DNA, 25 bp, Rattus norvegicus
gggagacagtttttggctgctttca

SEQ ID NO: 450878 - DNA, 25 bp, Rattus norvegicus
gggagacatcgccttccatgtcaaa

SEQ ID NO: 450879 - DNA, 25 bp, Rattus norvegicus
gggagacatcgcgttccatgtcaaa

SEQ ID NO: 450880 - DNA, 25 bp, Rattus norvegicus
gggagacatgataccatgagtcctt

SEQ ID NO: 450881 - DNA, 25 bp, Rattus norvegicus
gggagacatgattccatgagtcctt

SEQ ID NO: 450882 - DNA, 25 bp, Rattus norvegicus
gggagacattacctgccatatttga

SEQ ID NO: 450883 - DNA, 25 bp, Rattus norvegicus
gggagacattacgtgccatatttga

SEQ ID NO: 450884 - DNA, 25 bp, Rattus norvegicus
gggagacattcacatcaaacttttt

SEQ ID NO: 450885 - DNA, 25 bp, Rattus norvegicus
gggagacattcagatcaaacttttt

SEQ ID NO: 450886 - DNA, 25 bp, Rattus norvegicus
gggagacattctacctgacacttct

SEQ ID NO: 450887 - DNA, 25 bp, Rattus norvegicus
gggagacattcttcctgacacttct

SEQ ID NO: 450888 - DNA, 25 bp, Rattus norvegicus
gggagaccaaaccaggagcatcctt

SEQ ID NO: 450889 - DNA, 25 bp, Rattus norvegicus
gggagaccaaacgaggagcatcctt

SEQ ID NO: 450890 - DNA, 25 bp, Rattus norvegicus
gggagaccaatccagctgattcgaa

SEQ ID NO: 450891 - DNA, 25 bp, Rattus norvegicus
gggagaccaatcgagctgattcgaa

SEQ ID NO: 450892 - DNA, 25 bp, Rattus norvegicus
gggagaccacagatgacattttcac

SEQ ID NO: 450893 - DNA, 25 bp, Rattus norvegicus
gggagaccacagttgacattttcac

SEQ ID NO: 450894 - DNA, 25 bp, Rattus norvegicus
gggagaccaggtctcctcttagatt

SEQ ID NO: 450895 - DNA, 25 bp, Rattus norvegicus
gggagaccaggtgtcctcttagatt

SEQ ID NO: 450896 - DNA, 25 bp, Rattus norvegicus
gggagacccaatctgcaattgcaaa

SEQ ID NO: 450897 - DNA, 25 bp, Rattus norvegicus
gggagacccaatgtgcaattgcaaa

SEQ ID NO: 450898 - DNA, 25 bp, Rattus norvegicus
gggagaccccagaccccagagagag

SEQ ID NO: 450899 - DNA, 25 bp, Rattus norvegicus
gggagaccccagtccccagagagag

SEQ ID NO: 450900 - DNA, 25 bp, Rattus norvegicus
gggagacccgtaaaggtgctcatgt

SEQ ID NO: 450901 - DNA, 25 bp, Rattus norvegicus
gggagacccgtataggtgctcatgt

SEQ ID NO: 450902 - DNA, 25 bp, Rattus norvegicus
gggagaccctgacccggccaatgaa

SEQ ID NO: 450903 - DNA, 25 bp, Rattus norvegicus
gggagaccctgagccggccaatgaa

SEQ ID NO: 450904 - DNA, 25 bp, Rattus norvegicus
gggagacccttgacactgcctagaa

SEQ ID NO: 450905 - DNA, 25 bp, Rattus norvegicus
gggagacccttgtcactgcctagaa

SEQ ID NO: 450906 - DNA, 25 bp, Rattus norvegicus
gggagaccgatgctatttattcagt

SEQ ID NO: 450907 - DNA, 25 bp, Rattus norvegicus
gggagaccgatggtatttattcagt

SEQ ID NO: 450908 - DNA, 25 bp, Rattus norvegicus
gggagacctcaacgcagagtccgct

SEQ ID NO: 450909 - DNA, 25 bp, Rattus norvegicus
gggagacctcaaggcagagtccgct

SEQ ID NO: 450910 - DNA, 25 bp, Rattus norvegicus
gggagacctcccagatgaggactct

SEQ ID NO: 450911 - DNA, 25 bp, Rattus norvegicus
gggagacctccctgatgaggactct

SEQ ID NO: 450912 - DNA, 25 bp, Rattus norvegicus
gggagacctctcaacatcagaagaa

SEQ ID NO: 450913 - DNA, 25 bp, Rattus norvegicus
gggagacctctctacatcagaagaa

SEQ ID NO: 450914 - DNA, 25 bp, Rattus norvegicus
gggagacctgctccaaaagcacaca

SEQ ID NO: 450915 - DNA, 25 bp, Rattus norvegicus
gggagacctgctgcaaaagcacaca

SEQ ID NO: 450916 - DNA, 25 bp, Rattus norvegicus
gggagacctgttctcttggtcaacc

SEQ ID NO: 450917 - DNA, 25 bp, Rattus norvegicus
gggagacctgttgtcttggtcaacc

SEQ ID NO: 450918 - DNA, 25 bp, Rattus norvegicus
gggagacgacgcatctgcaagtcct

SEQ ID NO: 450919 - DNA, 25 bp, Rattus norvegicus
gggagacgacgcttctgcaagtcct

SEQ ID NO: 450920 - DNA, 25 bp, Rattus norvegicus
gggagacgactgctcaattctcagt

SEQ ID NO: 450921 - DNA, 25 bp, Rattus norvegicus
gggagacgactggtcaattctcagt

SEQ ID NO: 450922 - DNA, 25 bp, Rattus norvegicus
gggagacgagatattattggcacaa

SEQ ID NO: 450923 - DNA, 25 bp, Rattus norvegicus
gggagacgagattttattggcacaa

SEQ ID NO: 450924 - DNA, 25 bp, Rattus norvegicus
gggagacgctcacatcaaatcatgt

SEQ ID NO: 450925 - DNA, 25 bp, Rattus norvegicus
gggagacgctcagatcaaatcatgt

SEQ ID NO: 450926 - DNA, 25 bp, Rattus norvegicus
gggagacgctgcatccatgctctga

SEQ ID NO: 450927 - DNA, 25 bp, Rattus norvegicus
gggagacgctgcctatgacactgtt

SEQ ID NO: 450928 - DNA, 25 bp, Rattus norvegicus
gggagacgctgcgtatgacactgtt

SEQ ID NO: 450929 - DNA, 25 bp, Rattus norvegicus
gggagacgctgcttccatgctctga

SEQ ID NO: 450930 - DNA, 25 bp, Rattus norvegicus
gggagactatacaaaaagtgacttt

SEQ ID NO: 450931 - DNA, 25 bp, Rattus norvegicus
gggagactatactaaaagtgacttt

SEQ ID NO: 450932 - DNA, 25 bp, Rattus norvegicus
gggagactatatcaccattagaact

SEQ ID NO: 450933 - DNA, 25 bp, Rattus norvegicus
gggagactatatgaccattagaact

SEQ ID NO: 450934 - DNA, 25 bp, Rattus norvegicus
gggagactcagtattccattggctg

SEQ ID NO: 450935 - DNA, 25 bp, Rattus norvegicus
gggagactcagttttccattggctg

SEQ ID NO: 450936 - DNA, 25 bp, Rattus norvegicus
gggagactccccagactatttatgg

SEQ ID NO: 450937 - DNA, 25 bp, Rattus norvegicus
gggagactcccctgactatttatgg

SEQ ID NO: 450938 - DNA, 25 bp, Rattus norvegicus
gggagactcctgagttcaaataaag

SEQ ID NO: 450939 - DNA, 25 bp, Rattus norvegicus
gggagactcctgtgttcaaataaag

SEQ ID NO: 450940 - DNA, 25 bp, Rattus norvegicus
gggagactctataaactcatgctca

SEQ ID NO: 450941 - DNA, 25 bp, Rattus norvegicus
gggagactctattaactcatgctca

SEQ ID NO: 450942 - DNA, 25 bp, Rattus norvegicus
gggagactctggatcaacatagcac

SEQ ID NO: 450943 - DNA, 25 bp, Rattus norvegicus
gggagactctggttcaacatagcac

SEQ ID NO: 450944 - DNA, 25 bp, Rattus norvegicus
gggagactgaaaacagtgtaacacc

SEQ ID NO: 450945 - DNA, 25 bp, Rattus norvegicus
gggagactgaaatcagtgtaacacc

SEQ ID NO: 450946 - DNA, 25 bp, Rattus norvegicus
gggagactgagcataacaccggttt

SEQ ID NO: 450947 - DNA, 25 bp, Rattus norvegicus
gggagactgagcttaacaccggttt

SEQ ID NO: 450948 - DNA, 25 bp, Rattus norvegicus
gggagactgagtcaccagacagaca

SEQ ID NO: 450949 - DNA, 25 bp, Rattus norvegicus
gggagactgagtgaccagacagaca

SEQ ID NO: 450950 - DNA, 25 bp, Rattus norvegicus
gggagactgatgcaccaaacatttc

SEQ ID NO: 450951 - DNA, 25 bp, Rattus norvegicus
gggagactgatggaccaaacatttc

SEQ ID NO: 450952 - DNA, 25 bp, Rattus norvegicus
gggagactgtctccagccaagtcca

SEQ ID NO: 450953 - DNA, 25 bp, Rattus norvegicus
gggagactgtctgcagccaagtcca

SEQ ID NO: 450954 - DNA, 25 bp, Rattus norvegicus
gggagacttcatcacaggtcctgtc

SEQ ID NO: 450955 - DNA, 25 bp, Rattus norvegicus
gggagacttcatgacaggtcctgtc

SEQ ID NO: 450956 - DNA, 25 bp, Rattus norvegicus
gggagacttgacagaacacctctat

SEQ ID NO: 450957 - DNA, 25 bp, Rattus norvegicus
gggagacttgactgaacacctctat

SEQ ID NO: 450958 - DNA, 25 bp, Rattus norvegicus
gggagacttgcaacattgaagccat

SEQ ID NO: 450959 - DNA, 25 bp, Rattus norvegicus
gggagacttgcatcattgaagccat

SEQ ID NO: 450960 - DNA, 25 bp, Rattus norvegicus
gggagactttatataggaacactgc

SEQ ID NO: 450961 - DNA, 25 bp, Rattus norvegicus
gggagactttatttaggaacactgc

SEQ ID NO: 450962 - DNA, 25 bp, Rattus norvegicus
gggagactttggctcattttcacaa

SEQ ID NO: 450963 - DNA, 25 bp, Rattus norvegicus
gggagactttgggtcattttcacaa

SEQ ID NO: 450964 - DNA, 25 bp, Rattus norvegicus
gggagacttttcaaccatataacag

SEQ ID NO: 450965 - DNA, 25 bp, Rattus norvegicus
gggagacttttctaccatataacag

SEQ ID NO: 450966 - DNA, 25 bp, Rattus norvegicus
gggagagaatctatacctggttaat

SEQ ID NO: 450967 - DNA, 25 bp, Rattus norvegicus
gggagagaatctttacctggttaat

SEQ ID NO: 450968 - DNA, 25 bp, Rattus norvegicus
gggagagaccagcactctgctacat

SEQ ID NO: 450969 - DNA, 25 bp, Rattus norvegicus
gggagagaccaggactctgctacat

SEQ ID NO: 450970 - DNA, 25 bp, Rattus norvegicus
gggagagaccatattgctcacctct

SEQ ID NO: 450971 - DNA, 25 bp, Rattus norvegicus
gggagagaccattttgctcacctct

SEQ ID NO: 450972 - DNA, 25 bp, Rattus norvegicus
gggagagaccgtaacagagcacagt

SEQ ID NO: 450973 - DNA, 25 bp, Rattus norvegicus
gggagagaccgttacagagcacagt

SEQ ID NO: 450974 - DNA, 25 bp, Rattus norvegicus
gggagagactcacgaagcttatgct

SEQ ID NO: 450975 - DNA, 25 bp, Rattus norvegicus
gggagagactcaggaagcttatgct

SEQ ID NO: 450976 - DNA, 25 bp, Rattus norvegicus
gggagagactccaataatttctaat

SEQ ID NO: 450977 - DNA, 25 bp, Rattus norvegicus
gggagagactcctataatttctaat

SEQ ID NO: 450978 - DNA, 25 bp, Rattus norvegicus
gggagagacttaccccacaacagcc

SEQ ID NO: 450979 - DNA, 25 bp, Rattus norvegicus
gggagagacttagcccacaacagcc

SEQ ID NO: 450980 - DNA, 25 bp, Rattus norvegicus
gggagagactttccaattgaacgag

SEQ ID NO: 450981 - DNA, 25 bp, Rattus norvegicus
gggagagactttgcaattgaacgag

SEQ ID NO: 450982 - DNA, 25 bp, Rattus norvegicus
gggagagagcctacctatgaacatt

SEQ ID NO: 450983 - DNA, 25 bp, Rattus norvegicus
gggagagagccttcctatgaacatt

SEQ ID NO: 450984 - DNA, 25 bp, Rattus norvegicus
gggagagagctaccttctatgtatt

SEQ ID NO: 450985 - DNA, 25 bp, Rattus norvegicus
gggagagagctagcttctatgtatt

SEQ ID NO: 450986 - DNA, 25 bp, Rattus norvegicus
gggagagagtcacccttacatctcc

SEQ ID NO: 450987 - DNA, 25 bp, Rattus norvegicus
gggagagagtcagccttacatctcc

SEQ ID NO: 450988 - DNA, 25 bp, Rattus norvegicus
gggagagagtccaacagcataataa

SEQ ID NO: 450989 - DNA, 25 bp, Rattus norvegicus
gggagagagtcctacagcataataa

SEQ ID NO: 450990 - DNA, 25 bp, Rattus norvegicus
gggagagagttcatcagagaccttg

SEQ ID NO: 450991 - DNA, 25 bp, Rattus norvegicus
gggagagagttcttcagagaccttg

SEQ ID NO: 450992 - DNA, 25 bp, Rattus norvegicus
gggagagatctcagtgtggtacaaa

SEQ ID NO: 450993 - DNA, 25 bp, Rattus norvegicus
gggagagatctctgtgtggtacaaa

SEQ ID NO: 450994 - DNA, 25 bp, Rattus norvegicus
gggagagatggcaaccaccctccaa

SEQ ID NO: 450995 - DNA, 25 bp, Rattus norvegicus
gggagagatggctaccaccctccaa

SEQ ID NO: 450996 - DNA, 25 bp, Rattus norvegicus
gggagagcaaccaggaccacatagt

SEQ ID NO: 450997 - DNA, 25 bp, Rattus norvegicus
gggagagcaacctggaccacatagt

SEQ ID NO: 450998 - DNA, 25 bp, Rattus norvegicus
gggagagcaagcactgtcctggctt

SEQ ID NO: 450999 - DNA, 25 bp, Rattus norvegicus
gggagagcaagctctgtcctggctt

SEQ ID NO: 451000 - DNA, 25 bp, Rattus norvegicus
gggagagcaaggctccccatagcca

SEQ ID NO: 451001 - DNA, 25 bp, Rattus norvegicus
gggagagcaagggtccccatagcca

SEQ ID NO: 451002 - DNA, 25 bp, Rattus norvegicus
gggagagcaccaaattgacatttgt

SEQ ID NO: 451003 - DNA, 25 bp, Rattus norvegicus
gggagagcaccacacagcttgtcca

SEQ ID NO: 451004 - DNA, 25 bp, Rattus norvegicus
gggagagcaccagacagcttgtcca

SEQ ID NO: 451005 - DNA, 25 bp, Rattus norvegicus
gggagagcaccatattgacatttgt

SEQ ID NO: 451006 - DNA, 25 bp, Rattus norvegicus
gggagagcagctacatccagcccag

SEQ ID NO: 451007 - DNA, 25 bp, Rattus norvegicus
gggagagcagcttcatccagcccag

SEQ ID NO: 451008 - DNA, 25 bp, Rattus norvegicus
gggagagcagttctccaacccagca

SEQ ID NO: 451009 - DNA, 25 bp, Rattus norvegicus
gggagagcagttgtccaacccagca

SEQ ID NO: 451010 - DNA, 25 bp, Rattus norvegicus
gggagagcccagacctaagccaggt

SEQ ID NO: 451011 - DNA, 25 bp, Rattus norvegicus
gggagagcccagtcctaagccaggt

SEQ ID NO: 451012 - DNA, 25 bp, Rattus norvegicus
gggagagcctaaagaataccttgaa

SEQ ID NO: 451013 - DNA, 25 bp, Rattus norvegicus
gggagagcctaatgaataccttgaa

SEQ ID NO: 451014 - DNA, 25 bp, Rattus norvegicus
gggagagcctctcgagcttcataaa

SEQ ID NO: 451015 - DNA, 25 bp, Rattus norvegicus
gggagagcctctggagcttcataaa

SEQ ID NO: 451016 - DNA, 25 bp, Rattus norvegicus
gggagagccttgaccacgtgaccgt

SEQ ID NO: 451017 - DNA, 25 bp, Rattus norvegicus
gggagagccttgtccacgtgaccgt

SEQ ID NO: 451018 - DNA, 25 bp, Rattus norvegicus
gggagagcgctcagagatcccctca

SEQ ID NO: 451019 - DNA, 25 bp, Rattus norvegicus
gggagagcgctctgagatcccctca

SEQ ID NO: 451020 - DNA, 25 bp, Rattus norvegicus
gggagagctcatctcaatgcgcgac

SEQ ID NO: 451021 - DNA, 25 bp, Rattus norvegicus
gggagagctcatgtcaatgcgcgac

SEQ ID NO: 451022 - DNA, 25 bp, Rattus norvegicus
gggagagctccacagcaatagagta

SEQ ID NO: 451023 - DNA, 25 bp, Rattus norvegicus
gggagagctccagagcaatagagta

SEQ ID NO: 451024 - DNA, 25 bp, Rattus norvegicus
gggagaggacctagctgtttcccct

SEQ ID NO: 451025 - DNA, 25 bp, Rattus norvegicus
gggagaggaccttgctgtttcccct

SEQ ID NO: 451026 - DNA, 25 bp, Rattus norvegicus
gggagaggcacacaacccaccacaa

SEQ ID NO: 451027 - DNA, 25 bp, Rattus norvegicus
gggagaggcacagaacccaccacaa

SEQ ID NO: 451028 - DNA, 25 bp, Rattus norvegicus
gggagaggctctcttgaaccttcag

SEQ ID NO: 451029 - DNA, 25 bp, Rattus norvegicus
gggagaggctctgttgaaccttcag

SEQ ID NO: 451030 - DNA, 25 bp, Rattus norvegicus
gggagagggctcagagctcccaccc

SEQ ID NO: 451031 - DNA, 25 bp, Rattus norvegicus
gggagagggctctgagctcccaccc

SEQ ID NO: 451032 - DNA, 25 bp, Rattus norvegicus
gggagaggtcctaagcatacatgaa

SEQ ID NO: 451033 - DNA, 25 bp, Rattus norvegicus
gggagaggtccttagcatacatgaa

SEQ ID NO: 451034 - DNA, 25 bp, Rattus norvegicus
gggagagtcaagatcattctactgt

SEQ ID NO: 451035 - DNA, 25 bp, Rattus norvegicus
gggagagtcaagttcattctactgt

SEQ ID NO: 451036 - DNA, 25 bp, Rattus norvegicus
gggagagtcagccttgctttacgat

SEQ ID NO: 451037 - DNA, 25 bp, Rattus norvegicus
gggagagtcagcgttgctttacgat

SEQ ID NO: 451038 - DNA, 25 bp, Rattus norvegicus
gggagagtcagtacttctcatttaa

SEQ ID NO: 451039 - DNA, 25 bp, Rattus norvegicus
gggagagtcagttcttctcatttaa

SEQ ID NO: 451040 - DNA, 25 bp, Rattus norvegicus
gggagagtcctcacttcagtatctc

SEQ ID NO: 451041 - DNA, 25 bp, Rattus norvegicus
gggagagtcctctcttcagtatctc

SEQ ID NO: 451042 - DNA, 25 bp, Rattus norvegicus
gggagagtctctactggaaaactgt

SEQ ID NO: 451043 - DNA, 25 bp, Rattus norvegicus
gggagagtctcttctggaaaactgt

SEQ ID NO: 451044 - DNA, 25 bp, Rattus norvegicus
gggagagtcttaactgcatagttct

SEQ ID NO: 451045 - DNA, 25 bp, Rattus norvegicus
gggagagtcttatctgcatagttct

SEQ ID NO: 451046 - DNA, 25 bp, Rattus norvegicus
gggagagttcagcaccacaatgaac

SEQ ID NO: 451047 - DNA, 25 bp, Rattus norvegicus
gggagagttcaggaccacaatgaac

SEQ ID NO: 451048 - DNA, 25 bp, Rattus norvegicus
gggagagttcctcacacataactta

SEQ ID NO: 451049 - DNA, 25 bp, Rattus norvegicus
gggagagttcctgacacataactta

SEQ ID NO: 451050 - DNA, 25 bp, Rattus norvegicus
gggagagttggacactttccttgaa

SEQ ID NO: 451051 - DNA, 25 bp, Rattus norvegicus
gggagagttggagactttccttgaa

SEQ ID NO: 451052 - DNA, 25 bp, Rattus norvegicus
gggagagttgtcctcactttgttgc

SEQ ID NO: 451053 - DNA, 25 bp, Rattus norvegicus
gggagagttgtcgtcactttgttgc

SEQ ID NO: 451054 - DNA, 25 bp, Rattus norvegicus
gggagataccatcatcacgaaagaa

SEQ ID NO: 451055 - DNA, 25 bp, Rattus norvegicus
gggagataccatgatcacgaaagaa

SEQ ID NO: 451056 - DNA, 25 bp, Rattus norvegicus
gggagatcaagaaggactctatggt

SEQ ID NO: 451057 - DNA, 25 bp, Rattus norvegicus
gggagatcaagatggactctatggt

SEQ ID NO: 451058 - DNA, 25 bp, Rattus norvegicus
gggagatcacccacaagcatcgcgt

SEQ ID NO: 451059 - DNA, 25 bp, Rattus norvegicus
gggagatcaccctcaagcatcgcgt

SEQ ID NO: 451060 - DNA, 25 bp, Rattus norvegicus
gggagatcacctcggttcctgtcac

SEQ ID NO: 451061 - DNA, 25 bp, Rattus norvegicus
gggagatcacctgggttcctgtcac

SEQ ID NO: 451062 - DNA, 25 bp, Rattus norvegicus
gggagatcagccacagctctgcgct

SEQ ID NO: 451063 - DNA, 25 bp, Rattus norvegicus
gggagatcagcctcagctctgcgct

SEQ ID NO: 451064 - DNA, 25 bp, Rattus norvegicus
gggagatcagggatacaggcaacct

SEQ ID NO: 451065 - DNA, 25 bp, Rattus norvegicus
gggagatcagggttacaggcaacct

SEQ ID NO: 451066 - DNA, 25 bp, Rattus norvegicus
gggagatcatttcacattgttagta

SEQ ID NO: 451067 - DNA, 25 bp, Rattus norvegicus
gggagatcatttgacattgttagta

SEQ ID NO: 451068 - DNA, 25 bp, Rattus norvegicus
gggagatccaaccaccagcaggaga

SEQ ID NO: 451069 - DNA, 25 bp, Rattus norvegicus
gggagatccaacgaccagcaggaga

SEQ ID NO: 451070 - DNA, 25 bp, Rattus norvegicus
gggagatccagcatctgcttgcata

SEQ ID NO: 451071 - DNA, 25 bp, Rattus norvegicus
gggagatccagcttctgcttgcata

SEQ ID NO: 451072 - DNA, 25 bp, Rattus norvegicus
gggagatcctaaattcttcagttct

SEQ ID NO: 451073 - DNA, 25 bp, Rattus norvegicus
gggagatcctaatttcttcagttct

SEQ ID NO: 451074 - DNA, 25 bp, Rattus norvegicus
gggagatcgtttcagctgtaccttc

SEQ ID NO: 451075 - DNA, 25 bp, Rattus norvegicus
gggagatcgtttgagctgtaccttc

SEQ ID NO: 451076 - DNA, 25 bp, Rattus norvegicus
gggagatctccacttatcatagaca

SEQ ID NO: 451077 - DNA, 25 bp, Rattus norvegicus
gggagatctccagttatcatagaca

SEQ ID NO: 451078 - DNA, 25 bp, Rattus norvegicus
gggagatctcccagcgcctggtagc

SEQ ID NO: 451079 - DNA, 25 bp, Rattus norvegicus
gggagatctccctgcgcctggtagc

SEQ ID NO: 451080 - DNA, 25 bp, Rattus norvegicus
gggagatgcacgcacccatattgga

SEQ ID NO: 451081 - DNA, 25 bp, Rattus norvegicus
gggagatgcacggacccatattgga

SEQ ID NO: 451082 - DNA, 25 bp, Rattus norvegicus
gggagatggacaacaccggacacca

SEQ ID NO: 451083 - DNA, 25 bp, Rattus norvegicus
gggagatggacatcaccggacacca

SEQ ID NO: 451084 - DNA, 25 bp, Rattus norvegicus
gggagatggcacactatggaaacat

SEQ ID NO: 451085 - DNA, 25 bp, Rattus norvegicus
gggagatggcacattaacaccatta

SEQ ID NO: 451086 - DNA, 25 bp, Rattus norvegicus
gggagatggcactctatggaaacat

SEQ ID NO: 451087 - DNA, 25 bp, Rattus norvegicus
gggagatggcactttaacaccatta

SEQ ID NO: 451088 - DNA, 25 bp, Rattus norvegicus
gggagatgggcacacaccactgtca

SEQ ID NO: 451089 - DNA, 25 bp, Rattus norvegicus
gggagatgggcagacaccactgtca

SEQ ID NO: 451090 - DNA, 25 bp, Rattus norvegicus
gggagatgtaagcttccttcttctt

SEQ ID NO: 451091 - DNA, 25 bp, Rattus norvegicus
gggagatgtaaggttccttcttctt

SEQ ID NO: 451092 - DNA, 25 bp, Rattus norvegicus
gggagatgtctaactaggcataaaa

SEQ ID NO: 451093 - DNA, 25 bp, Rattus norvegicus
gggagatgtctatctaggcataaaa

SEQ ID NO: 451094 - DNA, 25 bp, Rattus norvegicus
gggagatgttacctgcggtttattc

SEQ ID NO: 451095 - DNA, 25 bp, Rattus norvegicus
gggagatgttacgtgcggtttattc

SEQ ID NO: 451096 - DNA, 25 bp, Rattus norvegicus
gggagattagctagctcacagagcc

SEQ ID NO: 451097 - DNA, 25 bp, Rattus norvegicus
gggagattagcttgctcacagagcc

SEQ ID NO: 451098 - DNA, 25 bp, Rattus norvegicus
gggagattcaatcggctaattttat

SEQ ID NO: 451099 - DNA, 25 bp, Rattus norvegicus
gggagattcaatgggctaattttat

SEQ ID NO: 451100 - DNA, 25 bp, Rattus norvegicus
gggagattccagatcaatgccttta

SEQ ID NO: 451101 - DNA, 25 bp, Rattus norvegicus
gggagattccagttcaatgccttta

SEQ ID NO: 451102 - DNA, 25 bp, Rattus norvegicus
gggagattccttcgctacacagaga

SEQ ID NO: 451103 - DNA, 25 bp, Rattus norvegicus
gggagattccttggctacacagaga

SEQ ID NO: 451104 - DNA, 25 bp, Rattus norvegicus
gggagattctccaaaatgtggccaa

SEQ ID NO: 451105 - DNA, 25 bp, Rattus norvegicus
gggagattctcctaaatgtggccaa

SEQ ID NO: 451106 - DNA, 25 bp, Rattus norvegicus
gggagattgacaactacccagccag

SEQ ID NO: 451107 - DNA, 25 bp, Rattus norvegicus
gggagattgacatctacccagccag

SEQ ID NO: 451108 - DNA, 25 bp, Rattus norvegicus
gggagattgaccagaagctcctcac

SEQ ID NO: 451109 - DNA, 25 bp, Rattus norvegicus
gggagattgacctgaagctcctcac

SEQ ID NO: 451110 - DNA, 25 bp, Rattus norvegicus
gggagattgagacctacaaccaaat

SEQ ID NO: 451111 - DNA, 25 bp, Rattus norvegicus
gggagattgagagctacaaccaaat

SEQ ID NO: 451112 - DNA, 25 bp, Rattus norvegicus
gggagattgctcacatcacatgcag

SEQ ID NO: 451113 - DNA, 25 bp, Rattus norvegicus
gggagattgctctcatcacatgcag

SEQ ID NO: 451114 - DNA, 25 bp, Rattus norvegicus
gggagattggcaccaagaccacgct

SEQ ID NO: 451115 - DNA, 25 bp, Rattus norvegicus
gggagattggcagcaagaccacgct

SEQ ID NO: 451116 - DNA, 25 bp, Rattus norvegicus
gggagattgtctctgatggtcacca

SEQ ID NO: 451117 - DNA, 25 bp, Rattus norvegicus
gggagattgtctgtgatggtcacca

SEQ ID NO: 451118 - DNA, 25 bp, Rattus norvegicus
gggagatttatgcacctccttactt

SEQ ID NO: 451119 - DNA, 25 bp, Rattus norvegicus
gggagatttatggacctccttactt

SEQ ID NO: 451120 - DNA, 25 bp, Rattus norvegicus
gggagattttcccaattcttctcac

SEQ ID NO: 451121 - DNA, 25 bp, Rattus norvegicus
gggagattttccgaattcttctcac

SEQ ID NO: 451122 - DNA, 25 bp, Rattus norvegicus
gggagcaaaggtctaaccctcctca

SEQ ID NO: 451123 - DNA, 25 bp, Rattus norvegicus
gggagcaaaggtgtaaccctcctca

SEQ ID NO: 451124 - DNA, 25 bp, Rattus norvegicus
gggagcaaccaactttcctggttct

SEQ ID NO: 451125 - DNA, 25 bp, Rattus norvegicus
gggagcaaccaagtttcctggttct

SEQ ID NO: 451126 - DNA, 25 bp, Rattus norvegicus
gggagcaaccagaacttcacaaagc

SEQ ID NO: 451127 - DNA, 25 bp, Rattus norvegicus
gggagcaaccagtacttcacaaagc

SEQ ID NO: 451128 - DNA, 25 bp, Rattus norvegicus
gggagcaaccatccgtaattctact

SEQ ID NO: 451129 - DNA, 25 bp, Rattus norvegicus
gggagcaaccatgcgtaattctact

SEQ ID NO: 451130 - DNA, 25 bp, Rattus norvegicus
gggagcaactcacttctggaaacag

SEQ ID NO: 451131 - DNA, 25 bp, Rattus norvegicus
gggagcaactcagttctggaaacag

SEQ ID NO: 451132 - DNA, 25 bp, Rattus norvegicus
gggagcaactcgctgtgacttcaca

SEQ ID NO: 451133 - DNA, 25 bp, Rattus norvegicus
gggagcaactcggtgtgacttcaca

SEQ ID NO: 451134 - DNA, 25 bp, Rattus norvegicus
gggagcaactgactttattattttc

SEQ ID NO: 451135 - DNA, 25 bp, Rattus norvegicus
gggagcaactgagtttattattttc

SEQ ID NO: 451136 - DNA, 25 bp, Rattus norvegicus
gggagcaagagccaggccacaactt

SEQ ID NO: 451137 - DNA, 25 bp, Rattus norvegicus
gggagcaagagcgaggccacaactt

SEQ ID NO: 451138 - DNA, 25 bp, Rattus norvegicus
gggagcaagcccaggatggatcttc

SEQ ID NO: 451139 - DNA, 25 bp, Rattus norvegicus
gggagcaagccctggatggatcttc

SEQ ID NO: 451140 - DNA, 25 bp, Rattus norvegicus
gggagcaatcaaataccaccaccat

SEQ ID NO: 451141 - DNA, 25 bp, Rattus norvegicus
gggagcaatcaattaccaccaccat

SEQ ID NO: 451142 - DNA, 25 bp, Rattus norvegicus
gggagcaatcgcattattcagtgta

SEQ ID NO: 451143 - DNA, 25 bp, Rattus norvegicus
gggagcaatcgctttattcagtgta

SEQ ID NO: 451144 - DNA, 25 bp, Rattus norvegicus
gggagcaatctccttaatagtcatt

SEQ ID NO: 451145 - DNA, 25 bp, Rattus norvegicus
gggagcaatctcgttaatagtcatt

SEQ ID NO: 451146 - DNA, 25 bp, Rattus norvegicus
gggagcaatgctaccacagaacttg

SEQ ID NO: 451147 - DNA, 25 bp, Rattus norvegicus
gggagcaatgcttccacagaacttg

SEQ ID NO: 451148 - DNA, 25 bp, Rattus norvegicus
gggagcaattatcgttgatcaagat

SEQ ID NO: 451149 - DNA, 25 bp, Rattus norvegicus
gggagcaattatggttgatcaagat

SEQ ID NO: 451150 - DNA, 25 bp, Rattus norvegicus
gggagcacactccataaatctcagc

SEQ ID NO: 451151 - DNA, 25 bp, Rattus norvegicus
gggagcacactcgataaatctcagc

SEQ ID NO: 451152 - DNA, 25 bp, Rattus norvegicus
gggagcacacttacatagcaaggtg

SEQ ID NO: 451153 - DNA, 25 bp, Rattus norvegicus
gggagcacactttcatagcaaggtg

SEQ ID NO: 451154 - DNA, 25 bp, Rattus norvegicus
gggagcacagcaagctcatctttcc

SEQ ID NO: 451155 - DNA, 25 bp, Rattus norvegicus
gggagcacagcatgctcatctttcc

SEQ ID NO: 451156 - DNA, 25 bp, Rattus norvegicus
gggagcacatcaatgacacctttgt

SEQ ID NO: 451157 - DNA, 25 bp, Rattus norvegicus
gggagcacatcattgacacctttgt

SEQ ID NO: 451158 - DNA, 25 bp, Rattus norvegicus
gggagcaccagcaaccaaacagaca

SEQ ID NO: 451159 - DNA, 25 bp, Rattus norvegicus
gggagcaccagctaccaaacagaca

SEQ ID NO: 451160 - DNA, 25 bp, Rattus norvegicus
gggagcaccagtccggccacttgta

SEQ ID NO: 451161 - DNA, 25 bp, Rattus norvegicus
gggagcaccagtgcggccacttgta

SEQ ID NO: 451162 - DNA, 25 bp, Rattus norvegicus
gggagcacccagcatcagagatgtc

SEQ ID NO: 451163 - DNA, 25 bp, Rattus norvegicus
gggagcacccaggatcagagatgtc

SEQ ID NO: 451164 - DNA, 25 bp, Rattus norvegicus
gggagcacccatacaaagcgtttca

SEQ ID NO: 451165 - DNA, 25 bp, Rattus norvegicus
gggagcacccattcaaagcgtttca

SEQ ID NO: 451166 - DNA, 25 bp, Rattus norvegicus
gggagcacgctgcgcttccacgttc

SEQ ID NO: 451167 - DNA, 25 bp, Rattus norvegicus
gggagcacgctgggcttccacgttc

SEQ ID NO: 451168 - DNA, 25 bp, Rattus norvegicus
gggagcactataacctttactgcaa

SEQ ID NO: 451169 - DNA, 25 bp, Rattus norvegicus
gggagcactatatcctttactgcaa

SEQ ID NO: 451170 - DNA, 25 bp, Rattus norvegicus
gggagcactatccattggacctaca

SEQ ID NO: 451171 - DNA, 25 bp, Rattus norvegicus
gggagcactatcgattggacctaca

SEQ ID NO: 451172 - DNA, 25 bp, Rattus norvegicus
gggagcactctgcacctgtcagcac

SEQ ID NO: 451173 - DNA, 25 bp, Rattus norvegicus
gggagcactctggacctgtcagcac

SEQ ID NO: 451174 - DNA, 25 bp, Rattus norvegicus
gggagcactgacaacctgggaaaga

SEQ ID NO: 451175 - DNA, 25 bp, Rattus norvegicus
gggagcactgactacctgggaaaga

SEQ ID NO: 451176 - DNA, 25 bp, Rattus norvegicus
gggagcacttccaaatagatcgtct

SEQ ID NO: 451177 - DNA, 25 bp, Rattus norvegicus
gggagcacttcctaatagatcgtct

SEQ ID NO: 451178 - DNA, 25 bp, Rattus norvegicus
gggagcagaagacccattgcttcaa

SEQ ID NO: 451179 - DNA, 25 bp, Rattus norvegicus
gggagcagaagagccattgcttcaa

SEQ ID NO: 451180 - DNA, 25 bp, Rattus norvegicus
gggagcagagcaacgccacgcagct

SEQ ID NO: 451181 - DNA, 25 bp, Rattus norvegicus
gggagcagagcatcgccacgcagct

SEQ ID NO: 451182 - DNA, 25 bp, Rattus norvegicus
gggagcagaggaatctttcttaaac

SEQ ID NO: 451183 - DNA, 25 bp, Rattus norvegicus
gggagcagaggattctttcttaaac

SEQ ID NO: 451184 - DNA, 25 bp, Rattus norvegicus
gggagcagatagaccagtccaccta

SEQ ID NO: 451185 - DNA, 25 bp, Rattus norvegicus
gggagcagatagtccagtccaccta

SEQ ID NO: 451186 - DNA, 25 bp, Rattus norvegicus
gggagcagccacactccgcggcaag

SEQ ID NO: 451187 - DNA, 25 bp, Rattus norvegicus
gggagcagccactctccgcggcaag

SEQ ID NO: 451188 - DNA, 25 bp, Rattus norvegicus
gggagcagcgctccagcagggcgga

SEQ ID NO: 451189 - DNA, 25 bp, Rattus norvegicus
gggagcagcgctgcagcagggcgga

SEQ ID NO: 451190 - DNA, 25 bp, Rattus norvegicus
gggagcagctaaacacagttacatg

SEQ ID NO: 451191 - DNA, 25 bp, Rattus norvegicus
gggagcagctaatcacagttacatg

SEQ ID NO: 451192 - DNA, 25 bp, Rattus norvegicus
gggagcagctccataggttatttaa

SEQ ID NO: 451193 - DNA, 25 bp, Rattus norvegicus
gggagcagctccttaggttatttaa

SEQ ID NO: 451194 - DNA, 25 bp, Rattus norvegicus
gggagcagctttagctatgccccta

SEQ ID NO: 451195 - DNA, 25 bp, Rattus norvegicus
gggagcagcttttgctatgccccta

SEQ ID NO: 451196 - DNA, 25 bp, Rattus norvegicus
gggagcaggctgcatttctttagca

SEQ ID NO: 451197 - DNA, 25 bp, Rattus norvegicus
gggagcaggctggatttctttagca

SEQ ID NO: 451198 - DNA, 25 bp, Rattus norvegicus
gggagcagggcgatgaccctttttc

SEQ ID NO: 451199 - DNA, 25 bp, Rattus norvegicus
gggagcagggcgttgaccctttttc

SEQ ID NO: 451200 - DNA, 25 bp, Rattus norvegicus
gggagcagtcatccattcacttgag

SEQ ID NO: 451201 - DNA, 25 bp, Rattus norvegicus
gggagcagtcatgcattcacttgag

SEQ ID NO: 451202 - DNA, 25 bp, Rattus norvegicus
gggagcagtcttatcctaaggctat

SEQ ID NO: 451203 - DNA, 25 bp, Rattus norvegicus
gggagcagtcttttcctaaggctat

SEQ ID NO: 451204 - DNA, 25 bp, Rattus norvegicus
gggagcagtttacatcattgtccaa

SEQ ID NO: 451205 - DNA, 25 bp, Rattus norvegicus
gggagcagtttagatcattgtccaa

SEQ ID NO: 451206 - DNA, 25 bp, Rattus norvegicus
gggagcagtttgatctaaccacaca

SEQ ID NO: 451207 - DNA, 25 bp, Rattus norvegicus
gggagcagtttgttctaaccacaca

SEQ ID NO: 451208 - DNA, 25 bp, Rattus norvegicus
gggagcagttttcttttgcctacat

SEQ ID NO: 451209 - DNA, 25 bp, Rattus norvegicus
gggagcagttttgttttgcctacat

SEQ ID NO: 451210 - DNA, 25 bp, Rattus norvegicus
gggagcatacagagagcacccatat

SEQ ID NO: 451211 - DNA, 25 bp, Rattus norvegicus
gggagcatacagtgagcacccatat

SEQ ID NO: 451212 - DNA, 25 bp, Rattus norvegicus
gggagcatacttataaccaacatgg

SEQ ID NO: 451213 - DNA, 25 bp, Rattus norvegicus
gggagcatacttttaaccaacatgg

SEQ ID NO: 451214 - DNA, 25 bp, Rattus norvegicus
gggagcatagtgaggcatctaccca

SEQ ID NO: 451215 - DNA, 25 bp, Rattus norvegicus
gggagcatagtgtggcatctaccca

SEQ ID NO: 451216 - DNA, 25 bp, Rattus norvegicus
gggagcatcagcaatttccatatta

SEQ ID NO: 451217 - DNA, 25 bp, Rattus norvegicus
gggagcatcagctatttccatatta

SEQ ID NO: 451218 - DNA, 25 bp, Rattus norvegicus
gggagcatccagctcatctgtaaca

SEQ ID NO: 451219 - DNA, 25 bp, Rattus norvegicus
gggagcatccaggtcatctgtaaca

SEQ ID NO: 451220 - DNA, 25 bp, Rattus norvegicus
gggagcatccatctgtagaggtttt

SEQ ID NO: 451221 - DNA, 25 bp, Rattus norvegicus
gggagcatccatgtgtagaggtttt

SEQ ID NO: 451222 - DNA, 25 bp, Rattus norvegicus
gggagcatcctcctggagaccggag

SEQ ID NO: 451223 - DNA, 25 bp, Rattus norvegicus
gggagcatcctcgtggagaccggag

SEQ ID NO: 451224 - DNA, 25 bp, Rattus norvegicus
gggagcatcggtccacactgtatca

SEQ ID NO: 451225 - DNA, 25 bp, Rattus norvegicus
gggagcatcggtgcacactgtatca

SEQ ID NO: 451226 - DNA, 25 bp, Rattus norvegicus
gggagcatctacctatagactgcct

SEQ ID NO: 451227 - DNA, 25 bp, Rattus norvegicus
gggagcatctacgtatagactgcct

SEQ ID NO: 451228 - DNA, 25 bp, Rattus norvegicus
gggagcatctccagaaccttcttat

SEQ ID NO: 451229 - DNA, 25 bp, Rattus norvegicus
gggagcatctcctgaaccttcttat

SEQ ID NO: 451230 - DNA, 25 bp, Rattus norvegicus
gggagcatgtgtccgccatacagca

SEQ ID NO: 451231 - DNA, 25 bp, Rattus norvegicus
gggagcatgtgtgcgccatacagca

SEQ ID NO: 451232 - DNA, 25 bp, Rattus norvegicus
gggagcattcccaggtcacatccaa

SEQ ID NO: 451233 - DNA, 25 bp, Rattus norvegicus
gggagcattccctggtcacatccaa

SEQ ID NO: 451234 - DNA, 25 bp, Rattus norvegicus
gggagcattctgctaatctgctgtt

SEQ ID NO: 451235 - DNA, 25 bp, Rattus norvegicus
gggagcattctggtaatctgctgtt

SEQ ID NO: 451236 - DNA, 25 bp, Rattus norvegicus
gggagcatttggctcatcccacaag

SEQ ID NO: 451237 - DNA, 25 bp, Rattus norvegicus
gggagcatttgggtcatcccacaag

SEQ ID NO: 451238 - DNA, 25 bp, Rattus norvegicus
gggagcatttttactagtctgtatc

SEQ ID NO: 451239 - DNA, 25 bp, Rattus norvegicus
gggagcattttttctagtctgtatc

SEQ ID NO: 451240 - DNA, 25 bp, Rattus norvegicus
gggagccaaacaagacccacattga

SEQ ID NO: 451241 - DNA, 25 bp, Rattus norvegicus
gggagccaaacatgacccacattga

SEQ ID NO: 451242 - DNA, 25 bp, Rattus norvegicus
gggagccaacatacaacgttgctgt

SEQ ID NO: 451243 - DNA, 25 bp, Rattus norvegicus
gggagccaacattcaacgttgctgt

SEQ ID NO: 451244 - DNA, 25 bp, Rattus norvegicus
gggagccaaccaagtcaatactctt

SEQ ID NO: 451245 - DNA, 25 bp, Rattus norvegicus
gggagccaaccatgtcaatactctt

SEQ ID NO: 451246 - DNA, 25 bp, Rattus norvegicus
gggagccaagagaccaacctgcttc

SEQ ID NO: 451247 - DNA, 25 bp, Rattus norvegicus
gggagccaagagtccaacctgcttc

SEQ ID NO: 451248 - DNA, 25 bp, Rattus norvegicus
gggagccacaagagccatgtagaca

SEQ ID NO: 451249 - DNA, 25 bp, Rattus norvegicus
gggagccacaagtgccatgtagaca

SEQ ID NO: 451250 - DNA, 25 bp, Rattus norvegicus
gggagccacacaatcgaatacagtt

SEQ ID NO: 451251 - DNA, 25 bp, Rattus norvegicus
gggagccacacattcgaatacagtt

SEQ ID NO: 451252 - DNA, 25 bp, Rattus norvegicus
gggagccaccagcaaagcgcaaaaa

SEQ ID NO: 451253 - DNA, 25 bp, Rattus norvegicus
gggagccaccaggaaagcgcaaaaa

SEQ ID NO: 451254 - DNA, 25 bp, Rattus norvegicus
gggagccacgaaccctgaagacaaa

SEQ ID NO: 451255 - DNA, 25 bp, Rattus norvegicus
gggagccacgaagcctgaagacaaa

SEQ ID NO: 451256 - DNA, 25 bp, Rattus norvegicus
gggagccactcgcattcacctgatg

SEQ ID NO: 451257 - DNA, 25 bp, Rattus norvegicus
gggagccactcggattcacctgatg

SEQ ID NO: 451258 - DNA, 25 bp, Rattus norvegicus
gggagccactgcctctgtttcagag

SEQ ID NO: 451259 - DNA, 25 bp, Rattus norvegicus
gggagccactgcgtctgtttcagag

SEQ ID NO: 451260 - DNA, 25 bp, Rattus norvegicus
gggagccagaaactgataagcctag

SEQ ID NO: 451261 - DNA, 25 bp, Rattus norvegicus
gggagccagaaagtgataagcctag

SEQ ID NO: 451262 - DNA, 25 bp, Rattus norvegicus
gggagccagcagagtttgcatgcac

SEQ ID NO: 451263 - DNA, 25 bp, Rattus norvegicus
gggagccagcagtgtttgcatgcac

SEQ ID NO: 451264 - DNA, 25 bp, Rattus norvegicus
gggagccagccaaggtgcgcatcaa

SEQ ID NO: 451265 - DNA, 25 bp, Rattus norvegicus
gggagccagccatggtgcgcatcaa

SEQ ID NO: 451266 - DNA, 25 bp, Rattus norvegicus
gggagccagtcaatgccaaacctaa

SEQ ID NO: 451267 - DNA, 25 bp, Rattus norvegicus
gggagccagtcattgccaaacctaa

SEQ ID NO: 451268 - DNA, 25 bp, Rattus norvegicus
gggagccagtgcatagcctcgcatc

SEQ ID NO: 451269 - DNA, 25 bp, Rattus norvegicus
gggagccagtgcttagcctcgcatc

SEQ ID NO: 451270 - DNA, 25 bp, Rattus norvegicus
gggagccataccaagacagacctac

SEQ ID NO: 451271 - DNA, 25 bp, Rattus norvegicus
gggagccatacctagacagacctac

SEQ ID NO: 451272 - DNA, 25 bp, Rattus norvegicus
gggagccatactcgacacagcgttc

SEQ ID NO: 451273 - DNA, 25 bp, Rattus norvegicus
gggagccatactggacacagcgttc

SEQ ID NO: 451274 - DNA, 25 bp, Rattus norvegicus
gggagccatattcatttacaaacct

SEQ ID NO: 451275 - DNA, 25 bp, Rattus norvegicus
gggagccatattgatttacaaacct

SEQ ID NO: 451276 - DNA, 25 bp, Rattus norvegicus
gggagccatcttagtggacacgcat

SEQ ID NO: 451277 - DNA, 25 bp, Rattus norvegicus
gggagccatctttgtggacacgcat

SEQ ID NO: 451278 - DNA, 25 bp, Rattus norvegicus
gggagccatgataccatttcagatg

SEQ ID NO: 451279 - DNA, 25 bp, Rattus norvegicus
gggagccatgattccatttcagatg

SEQ ID NO: 451280 - DNA, 25 bp, Rattus norvegicus
gggagcccaacaacatcggtgaaga

SEQ ID NO: 451281 - DNA, 25 bp, Rattus norvegicus
gggagcccaacatcatcggtgaaga

SEQ ID NO: 451282 - DNA, 25 bp, Rattus norvegicus
gggagcccaactagccagcccattt

SEQ ID NO: 451283 - DNA, 25 bp, Rattus norvegicus
gggagcccaacttgccagcccattt

SEQ ID NO: 451284 - DNA, 25 bp, Rattus norvegicus
gggagcccaagcagaaccgcaaact

SEQ ID NO: 451285 - DNA, 25 bp, Rattus norvegicus
gggagcccaagctgaaccgcaaact

SEQ ID NO: 451286 - DNA, 25 bp, Rattus norvegicus
gggagcccacagaaccgccagacgg

SEQ ID NO: 451287 - DNA, 25 bp, Rattus norvegicus
gggagcccacagtaccgccagacgg

SEQ ID NO: 451288 - DNA, 25 bp, Rattus norvegicus
gggagcccaccaagaaatcgatgct

SEQ ID NO: 451289 - DNA, 25 bp, Rattus norvegicus
gggagcccaccatgaaatcgatgct

SEQ ID NO: 451290 - DNA, 25 bp, Rattus norvegicus
gggagcccagacactgcccatggag

SEQ ID NO: 451291 - DNA, 25 bp, Rattus norvegicus
gggagcccagactctgcccatggag

SEQ ID NO: 451292 - DNA, 25 bp, Rattus norvegicus
gggagcccagctcttgattctagaa

SEQ ID NO: 451293 - DNA, 25 bp, Rattus norvegicus
gggagcccagctgttgattctagaa

SEQ ID NO: 451294 - DNA, 25 bp, Rattus norvegicus
gggagcccaggcatttaagtgcctt

SEQ ID NO: 451295 - DNA, 25 bp, Rattus norvegicus
gggagcccaggcttttaagtgcctt

SEQ ID NO: 451296 - DNA, 25 bp, Rattus norvegicus
gggagcccatcaatgactacttcag

SEQ ID NO: 451297 - DNA, 25 bp, Rattus norvegicus
gggagcccatcattgactacttcag

SEQ ID NO: 451298 - DNA, 25 bp, Rattus norvegicus
gggagcccattgataggaagacctt

SEQ ID NO: 451299 - DNA, 25 bp, Rattus norvegicus
gggagcccattgttaggaagacctt

SEQ ID NO: 451300 - DNA, 25 bp, Rattus norvegicus
gggagccccactcgagccaatgtac

SEQ ID NO: 451301 - DNA, 25 bp, Rattus norvegicus
gggagccccactcgcagcacaggaa

SEQ ID NO: 451302 - DNA, 25 bp, Rattus norvegicus
gggagccccactggagccaatgtac

SEQ ID NO: 451303 - DNA, 25 bp, Rattus norvegicus
gggagccccactggcagcacaggaa

SEQ ID NO: 451304 - DNA, 25 bp, Rattus norvegicus
gggagccccagaactagcctgattc

SEQ ID NO: 451305 - DNA, 25 bp, Rattus norvegicus
gggagccccagatctagcctgattc

SEQ ID NO: 451306 - DNA, 25 bp, Rattus norvegicus
gggagcccctttctagacttcacgg

SEQ ID NO: 451307 - DNA, 25 bp, Rattus norvegicus
gggagcccctttgtagacttcacgg

SEQ ID NO: 451308 - DNA, 25 bp, Rattus norvegicus
gggagcccgattagtgccaatgaat

SEQ ID NO: 451309 - DNA, 25 bp, Rattus norvegicus
gggagcccgatttgtgccaatgaat

SEQ ID NO: 451310 - DNA, 25 bp, Rattus norvegicus
gggagcccgcgcactttttgttgtc

SEQ ID NO: 451311 - DNA, 25 bp, Rattus norvegicus
gggagcccgcgctctttttgttgtc

SEQ ID NO: 451312 - DNA, 25 bp, Rattus norvegicus
gggagccctcttaggaatatggtat

SEQ ID NO: 451313 - DNA, 25 bp, Rattus norvegicus
gggagccctctttggaatatggtat

SEQ ID NO: 451314 - DNA, 25 bp, Rattus norvegicus
gggagccctggccatttgatgtccc

SEQ ID NO: 451315 - DNA, 25 bp, Rattus norvegicus
gggagccctggcgatttgatgtccc

SEQ ID NO: 451316 - DNA, 25 bp, Rattus norvegicus
gggagccctgttcaaattcatcaaa

SEQ ID NO: 451317 - DNA, 25 bp, Rattus norvegicus
gggagccctgttgaaattcatcaaa

SEQ ID NO: 451318 - DNA, 25 bp, Rattus norvegicus
gggagcccttctaaagagctttaag

SEQ ID NO: 451319 - DNA, 25 bp, Rattus norvegicus
gggagcccttcttaagagctttaag

SEQ ID NO: 451320 - DNA, 25 bp, Rattus norvegicus
gggagccctttactctgaagtgtaa

SEQ ID NO: 451321 - DNA, 25 bp, Rattus norvegicus
gggagccctttagtctgaagtgtaa

SEQ ID NO: 451322 - DNA, 25 bp, Rattus norvegicus
gggagccctttcagtgcatgggtac

SEQ ID NO: 451323 - DNA, 25 bp, Rattus norvegicus
gggagccctttctgtgcatgggtac

SEQ ID NO: 451324 - DNA, 25 bp, Rattus norvegicus
gggagccgagtaacatcgccaggat

SEQ ID NO: 451325 - DNA, 25 bp, Rattus norvegicus
gggagccgagtatcatcgccaggat

SEQ ID NO: 451326 - DNA, 25 bp, Rattus norvegicus
gggagccggccacaggaggaccctt

SEQ ID NO: 451327 - DNA, 25 bp, Rattus norvegicus
gggagccggccagaggaggaccctt

SEQ ID NO: 451328 - DNA, 25 bp, Rattus norvegicus
gggagccgggctctgctctcacact

SEQ ID NO: 451329 - DNA, 25 bp, Rattus norvegicus
gggagccgggctgtgctctcacact

SEQ ID NO: 451330 - DNA, 25 bp, Rattus norvegicus
gggagccgggtcagacatgatcata

SEQ ID NO: 451331 - DNA, 25 bp, Rattus norvegicus
gggagccgggtctgacatgatcata

SEQ ID NO: 451332 - DNA, 25 bp, Rattus norvegicus
gggagccggtgaaatgtccacacca

SEQ ID NO: 451333 - DNA, 25 bp, Rattus norvegicus
gggagccggtgatatgtccacacca

SEQ ID NO: 451334 - DNA, 25 bp, Rattus norvegicus
gggagccgtgacagtaatcgcccta

SEQ ID NO: 451335 - DNA, 25 bp, Rattus norvegicus
gggagccgtgactgtaatcgcccta

SEQ ID NO: 451336 - DNA, 25 bp, Rattus norvegicus
gggagcctaagcctcactctgtggc

SEQ ID NO: 451337 - DNA, 25 bp, Rattus norvegicus
gggagcctaagcgtcactctgtggc

SEQ ID NO: 451338 - DNA, 25 bp, Rattus norvegicus
gggagcctaattagcaagccacaat

SEQ ID NO: 451339 - DNA, 25 bp, Rattus norvegicus
gggagcctaatttgcaagccacaat

SEQ ID NO: 451340 - DNA, 25 bp, Rattus norvegicus
gggagcctacgtatttatcatcttc

SEQ ID NO: 451341 - DNA, 25 bp, Rattus norvegicus
gggagcctacgtttttatcatcttc

SEQ ID NO: 451342 - DNA, 25 bp, Rattus norvegicus
gggagcctagacagaatatttttat

SEQ ID NO: 451343 - DNA, 25 bp, Rattus norvegicus
gggagcctagactgaatatttttat

SEQ ID NO: 451344 - DNA, 25 bp, Rattus norvegicus
gggagcctagtgctctacttgatcc

SEQ ID NO: 451345 - DNA, 25 bp, Rattus norvegicus
gggagcctagtggtctacttgatcc

SEQ ID NO: 451346 - DNA, 25 bp, Rattus norvegicus
gggagcctatttcttctccttcacg

SEQ ID NO: 451347 - DNA, 25 bp, Rattus norvegicus
gggagcctatttgttctccttcacg

SEQ ID NO: 451348 - DNA, 25 bp, Rattus norvegicus
gggagcctcaaaatagatgaccttt

SEQ ID NO: 451349 - DNA, 25 bp, Rattus norvegicus
gggagcctcaaattagatgaccttt

SEQ ID NO: 451350 - DNA, 25 bp, Rattus norvegicus
gggagcctcagtctttttggcctcg

SEQ ID NO: 451351 - DNA, 25 bp, Rattus norvegicus
gggagcctcagtgtttttggcctcg

SEQ ID NO: 451352 - DNA, 25 bp, Rattus norvegicus
gggagcctcatcactgaaaaccgtg

SEQ ID NO: 451353 - DNA, 25 bp, Rattus norvegicus
gggagcctcatctctgaaaaccgtg

SEQ ID NO: 451354 - DNA, 25 bp, Rattus norvegicus
gggagcctcttaagtcagtatcgat

SEQ ID NO: 451355 - DNA, 25 bp, Rattus norvegicus
gggagcctcttatgtcagtatcgat

SEQ ID NO: 451356 - DNA, 25 bp, Rattus norvegicus
gggagcctgactagtggcccctacc

SEQ ID NO: 451357 - DNA, 25 bp, Rattus norvegicus
gggagcctgacttgtggcccctacc

SEQ ID NO: 451358 - DNA, 25 bp, Rattus norvegicus
gggagcctgcagagctaacttagtt

SEQ ID NO: 451359 - DNA, 25 bp, Rattus norvegicus
gggagcctgcagtgctaacttagtt

SEQ ID NO: 451360 - DNA, 25 bp, Rattus norvegicus
gggagcctgcccataggaacacttg

SEQ ID NO: 451361 - DNA, 25 bp, Rattus norvegicus
gggagcctgcccttaggaacacttg

SEQ ID NO: 451362 - DNA, 25 bp, Rattus norvegicus
gggagcctgcgcacagccttttaat

SEQ ID NO: 451363 - DNA, 25 bp, Rattus norvegicus
gggagcctgcgctcagccttttaat

SEQ ID NO: 451364 - DNA, 25 bp, Rattus norvegicus
gggagcctgcttaggtactacagaa

SEQ ID NO: 451365 - DNA, 25 bp, Rattus norvegicus
gggagcctgctttggtactacagaa

SEQ ID NO: 451366 - DNA, 25 bp, Rattus norvegicus
gggagcctgggcagctaaagtcatc

SEQ ID NO: 451367 - DNA, 25 bp, Rattus norvegicus
gggagcctgggctgctaaagtcatc

SEQ ID NO: 451368 - DNA, 25 bp, Rattus norvegicus
gggagcctgtaaccaaagctagaaa

SEQ ID NO: 451369 - DNA, 25 bp, Rattus norvegicus
gggagcctgtaagcaaagctagaaa

SEQ ID NO: 451370 - DNA, 25 bp, Rattus norvegicus
gggagcctgtcgagtgtttcctgca

SEQ ID NO: 451371 - DNA, 25 bp, Rattus norvegicus
gggagcctgtcgtgtgtttcctgca

SEQ ID NO: 451372 - DNA, 25 bp, Rattus norvegicus
gggagcctgtctagttggatttttt

SEQ ID NO: 451373 - DNA, 25 bp, Rattus norvegicus
gggagcctgtcttgttggatttttt

SEQ ID NO: 451374 - DNA, 25 bp, Rattus norvegicus
gggagcctgtgtcccaagacaagat

SEQ ID NO: 451375 - DNA, 25 bp, Rattus norvegicus
gggagcctgtgtgccaagacaagat

SEQ ID NO: 451376 - DNA, 25 bp, Rattus norvegicus
gggagccttccacatctgtatgtgg

SEQ ID NO: 451377 - DNA, 25 bp, Rattus norvegicus
gggagccttccagatctgtatgtgg

SEQ ID NO: 451378 - DNA, 25 bp, Rattus norvegicus
gggagccttctaagacaagttccaa

SEQ ID NO: 451379 - DNA, 25 bp, Rattus norvegicus
gggagccttctatgacaagttccaa

SEQ ID NO: 451380 - DNA, 25 bp, Rattus norvegicus
gggagccttgaaaagccaaaatctt

SEQ ID NO: 451381 - DNA, 25 bp, Rattus norvegicus
gggagccttgaatagccaaaatctt

SEQ ID NO: 451382 - DNA, 25 bp, Rattus norvegicus
gggagccttggaagcttatgttcaa

SEQ ID NO: 451383 - DNA, 25 bp, Rattus norvegicus
gggagccttggatgcttatgttcaa

SEQ ID NO: 451384 - DNA, 25 bp, Rattus norvegicus
gggagcctttaccttgtgtattcac

SEQ ID NO: 451385 - DNA, 25 bp, Rattus norvegicus
gggagcctttacgttgtgtattcac

SEQ ID NO: 451386 - DNA, 25 bp, Rattus norvegicus
gggagcgatcctactttgggaacat

SEQ ID NO: 451387 - DNA, 25 bp, Rattus norvegicus
gggagcgatccttctttgggaacat

SEQ ID NO: 451388 - DNA, 25 bp, Rattus norvegicus
gggagcgcacatccttgcaattcta

SEQ ID NO: 451389 - DNA, 25 bp, Rattus norvegicus
gggagcgcacatgcttgcaattcta

SEQ ID NO: 451390 - DNA, 25 bp, Rattus norvegicus
gggagcggcttgatcaatggattaa

SEQ ID NO: 451391 - DNA, 25 bp, Rattus norvegicus
gggagcggcttgttcaatggattaa

SEQ ID NO: 451392 - DNA, 25 bp, Rattus norvegicus
gggagcgtcagaaccgtacgtgaaa

SEQ ID NO: 451393 - DNA, 25 bp, Rattus norvegicus
gggagcgtcagatccgtacgtgaaa

SEQ ID NO: 451394 - DNA, 25 bp, Rattus norvegicus
gggagcgtcttgacatttctgaggc

SEQ ID NO: 451395 - DNA, 25 bp, Rattus norvegicus
gggagcgtcttgtcatttctgaggc

SEQ ID NO: 451396 - DNA, 25 bp, Rattus norvegicus
gggagcgtggatacttctacacacc

SEQ ID NO: 451397 - DNA, 25 bp, Rattus norvegicus
gggagcgtggattcttctacacacc

SEQ ID NO: 451398 - DNA, 25 bp, Rattus norvegicus
gggagcgtgtgtctaagcaaaataa

SEQ ID NO: 451399 - DNA, 25 bp, Rattus norvegicus
gggagcgtgtgtgtaagcaaaataa

SEQ ID NO: 451400 - DNA, 25 bp, Rattus norvegicus
gggagctaaattatctctgttttgt

SEQ ID NO: 451401 - DNA, 25 bp, Rattus norvegicus
gggagctaaattttctctgttttgt

SEQ ID NO: 451402 - DNA, 25 bp, Rattus norvegicus
gggagctaacagaagcgtttataaa

SEQ ID NO: 451403 - DNA, 25 bp, Rattus norvegicus
gggagctaacagtagcgtttataaa

SEQ ID NO: 451404 - DNA, 25 bp, Rattus norvegicus
gggagctaactgcatccacctggat

SEQ ID NO: 451405 - DNA, 25 bp, Rattus norvegicus
gggagctaactggatccacctggat

SEQ ID NO: 451406 - DNA, 25 bp, Rattus norvegicus
gggagctacagtccctgcagagaca

SEQ ID NO: 451407 - DNA, 25 bp, Rattus norvegicus
gggagctacagtgcctgcagagaca

SEQ ID NO: 451408 - DNA, 25 bp, Rattus norvegicus
gggagctaccaaaactttatacaca

SEQ ID NO: 451409 - DNA, 25 bp, Rattus norvegicus
gggagctaccaatactttatacaca

SEQ ID NO: 451410 - DNA, 25 bp, Rattus norvegicus
gggagctaccgcagtcgcctcaagt

SEQ ID NO: 451411 - DNA, 25 bp, Rattus norvegicus
gggagctaccgctgtcgcctcaagt

SEQ ID NO: 451412 - DNA, 25 bp, Rattus norvegicus
gggagctacgcgcagagggagtgaa

SEQ ID NO: 451413 - DNA, 25 bp, Rattus norvegicus
gggagctacgcggagagggagtgaa

SEQ ID NO: 451414 - DNA, 25 bp, Rattus norvegicus
gggagctactacaactacagcactg

SEQ ID NO: 451415 - DNA, 25 bp, Rattus norvegicus
gggagctactactactacagcactg

SEQ ID NO: 451416 - DNA, 25 bp, Rattus norvegicus
gggagctagctaccctgggaactta

SEQ ID NO: 451417 - DNA, 25 bp, Rattus norvegicus
gggagctagctagcctgggaactta

SEQ ID NO: 451418 - DNA, 25 bp, Rattus norvegicus
gggagctagggcaacaatcttctgg

SEQ ID NO: 451419 - DNA, 25 bp, Rattus norvegicus
gggagctagggctacaatcttctgg

SEQ ID NO: 451420 - DNA, 25 bp, Rattus norvegicus
gggagctatccaaccatggcagatt

SEQ ID NO: 451421 - DNA, 25 bp, Rattus norvegicus
gggagctatccatccatggcagatt

SEQ ID NO: 451422 - DNA, 25 bp, Rattus norvegicus
gggagctattatatcactatgcatc

SEQ ID NO: 451423 - DNA, 25 bp, Rattus norvegicus
gggagctattatttcactatgcatc

SEQ ID NO: 451424 - DNA, 25 bp, Rattus norvegicus
gggagctcaaagcatccgagagaat

SEQ ID NO: 451425 - DNA, 25 bp, Rattus norvegicus
gggagctcaaaggatccgagagaat

SEQ ID NO: 451426 - DNA, 25 bp, Rattus norvegicus
gggagctcacacaattattcctgct

SEQ ID NO: 451427 - DNA, 25 bp, Rattus norvegicus
gggagctcacactattattcctgct

SEQ ID NO: 451428 - DNA, 25 bp, Rattus norvegicus
gggagctcactgcaaacatcggttt

SEQ ID NO: 451429 - DNA, 25 bp, Rattus norvegicus
gggagctcactggaaacatcggttt

SEQ ID NO: 451430 - DNA, 25 bp, Rattus norvegicus
gggagctcagcaacttttagcatta

SEQ ID NO: 451431 - DNA, 25 bp, Rattus norvegicus
gggagctcagcatcttttagcatta

SEQ ID NO: 451432 - DNA, 25 bp, Rattus norvegicus
gggagctcagccagcaaaggacaca

SEQ ID NO: 451433 - DNA, 25 bp, Rattus norvegicus
gggagctcagcctgcaaaggacaca

SEQ ID NO: 451434 - DNA, 25 bp, Rattus norvegicus
gggagctcattaagtctggcaagaa

SEQ ID NO: 451435 - DNA, 25 bp, Rattus norvegicus
gggagctcattatgtctggcaagaa

SEQ ID NO: 451436 - DNA, 25 bp, Rattus norvegicus
gggagctccaaaaacccttaagcat

SEQ ID NO: 451437 - DNA, 25 bp, Rattus norvegicus
gggagctccaaatacccttaagcat

SEQ ID NO: 451438 - DNA, 25 bp, Rattus norvegicus
gggagctccagaaattcttatccag

SEQ ID NO: 451439 - DNA, 25 bp, Rattus norvegicus
gggagctccagatattcttatccag

SEQ ID NO: 451440 - DNA, 25 bp, Rattus norvegicus
gggagctccatcagtgttggataac

SEQ ID NO: 451441 - DNA, 25 bp, Rattus norvegicus
gggagctccatctgtgttggataac

SEQ ID NO: 451442 - DNA, 25 bp, Rattus norvegicus
gggagctccctgctttattcctctt

SEQ ID NO: 451443 - DNA, 25 bp, Rattus norvegicus
gggagctccctggtttattcctctt

SEQ ID NO: 451444 - DNA, 25 bp, Rattus norvegicus
gggagctccttgactagtaactcat

SEQ ID NO: 451445 - DNA, 25 bp, Rattus norvegicus
gggagctccttgtctagtaactcat

SEQ ID NO: 451446 - DNA, 25 bp, Rattus norvegicus
gggagctcgagaacttcacggctag

SEQ ID NO: 451447 - DNA, 25 bp, Rattus norvegicus
gggagctcgagatcttcacggctag

SEQ ID NO: 451448 - DNA, 25 bp, Rattus norvegicus
gggagctctagcaccatgaattcag

SEQ ID NO: 451449 - DNA, 25 bp, Rattus norvegicus
gggagctctagctccatgaattcag

SEQ ID NO: 451450 - DNA, 25 bp, Rattus norvegicus
gggagctctgtactcattgtctcta

SEQ ID NO: 451451 - DNA, 25 bp, Rattus norvegicus
gggagctctgtagtcattgtctcta

SEQ ID NO: 451452 - DNA, 25 bp, Rattus norvegicus
gggagctctgtcatgtttggccagc

SEQ ID NO: 451453 - DNA, 25 bp, Rattus norvegicus
gggagctctgtcttgtttggccagc

SEQ ID NO: 451454 - DNA, 25 bp, Rattus norvegicus
gggagctcttaacttgggatctgaa

SEQ ID NO: 451455 - DNA, 25 bp, Rattus norvegicus
gggagctcttaagttgggatctgaa

SEQ ID NO: 451456 - DNA, 25 bp, Rattus norvegicus
gggagctcttccaggtgcttaagat

SEQ ID NO: 451457 - DNA, 25 bp, Rattus norvegicus
gggagctcttccatccctaaagttt

SEQ ID NO: 451458 - DNA, 25 bp, Rattus norvegicus
gggagctcttcctggtgcttaagat

SEQ ID NO: 451459 - DNA, 25 bp, Rattus norvegicus
gggagctcttccttccctaaagttt

SEQ ID NO: 451460 - DNA, 25 bp, Rattus norvegicus
gggagctcttgacactatcctgggt

SEQ ID NO: 451461 - DNA, 25 bp, Rattus norvegicus
gggagctcttgagactatcctgggt

SEQ ID NO: 451462 - DNA, 25 bp, Rattus norvegicus
gggagctgaatgactggctactcat

SEQ ID NO: 451463 - DNA, 25 bp, Rattus norvegicus
gggagctgaatgtctggctactcat

SEQ ID NO: 451464 - DNA, 25 bp, Rattus norvegicus
gggagctgaccaacattgacaacct

SEQ ID NO: 451465 - DNA, 25 bp, Rattus norvegicus
gggagctgaccatcattgacaacct

SEQ ID NO: 451466 - DNA, 25 bp, Rattus norvegicus
gggagctgacccaggtatgctaacc

SEQ ID NO: 451467 - DNA, 25 bp, Rattus norvegicus
gggagctgaccctggtatgctaacc

SEQ ID NO: 451468 - DNA, 25 bp, Rattus norvegicus
gggagctgagatccaaacccaggcc

SEQ ID NO: 451469 - DNA, 25 bp, Rattus norvegicus
gggagctgagatgcaaacccaggcc

SEQ ID NO: 451470 - DNA, 25 bp, Rattus norvegicus
gggagctgagctagcacctacggcc

SEQ ID NO: 451471 - DNA, 25 bp, Rattus norvegicus
gggagctgagcttgcacctacggcc

SEQ ID NO: 451472 - DNA, 25 bp, Rattus norvegicus
gggagctgatcgagttgttgccaac

SEQ ID NO: 451473 - DNA, 25 bp, Rattus norvegicus
gggagctgatcgtgttgttgccaac

SEQ ID NO: 451474 - DNA, 25 bp, Rattus norvegicus
gggagctgatctagcctgaaaatga

SEQ ID NO: 451475 - DNA, 25 bp, Rattus norvegicus
gggagctgatctcacaagaccctca

SEQ ID NO: 451476 - DNA, 25 bp, Rattus norvegicus
gggagctgatctctaaaacttaaag

SEQ ID NO: 451477 - DNA, 25 bp, Rattus norvegicus
gggagctgatctgacaagaccctca

SEQ ID NO: 451478 - DNA, 25 bp, Rattus norvegicus
gggagctgatctgtaaaacttaaag

SEQ ID NO: 451479 - DNA, 25 bp, Rattus norvegicus
gggagctgatcttgcctgaaaatga

SEQ ID NO: 451480 - DNA, 25 bp, Rattus norvegicus
gggagctgcctgagaaacctgtgaa

SEQ ID NO: 451481 - DNA, 25 bp, Rattus norvegicus
gggagctgcctgtgaaacctgtgaa

SEQ ID NO: 451482 - DNA, 25 bp, Rattus norvegicus
gggagctgctctcctgcagtagaca

SEQ ID NO: 451483 - DNA, 25 bp, Rattus norvegicus
gggagctgctctgctgcagtagaca

SEQ ID NO: 451484 - DNA, 25 bp, Rattus norvegicus
gggagctgcttaaactgcagccggt

SEQ ID NO: 451485 - DNA, 25 bp, Rattus norvegicus
gggagctgcttatactgcagccggt

SEQ ID NO: 451486 - DNA, 25 bp, Rattus norvegicus
gggagctgtgaccatgtttacatgt

SEQ ID NO: 451487 - DNA, 25 bp, Rattus norvegicus
gggagctgtgacgatgtttacatgt

SEQ ID NO: 451488 - DNA, 25 bp, Rattus norvegicus
gggagctgtggcacggacctttcac

SEQ ID NO: 451489 - DNA, 25 bp, Rattus norvegicus
gggagctgtggcattgtgcctcttt

SEQ ID NO: 451490 - DNA, 25 bp, Rattus norvegicus
gggagctgtggctcggacctttcac

SEQ ID NO: 451491 - DNA, 25 bp, Rattus norvegicus
gggagctgtggctttgtgcctcttt

SEQ ID NO: 451492 - DNA, 25 bp, Rattus norvegicus
gggagctgttctcccaacctgctgg

SEQ ID NO: 451493 - DNA, 25 bp, Rattus norvegicus
gggagctgttctgccaacctgctgg

SEQ ID NO: 451494 - DNA, 25 bp, Rattus norvegicus
gggagcttatcaactctgctgtgac

SEQ ID NO: 451495 - DNA, 25 bp, Rattus norvegicus
gggagcttatcatctctgctgtgac

SEQ ID NO: 451496 - DNA, 25 bp, Rattus norvegicus
gggagcttattacctcatagggaat

SEQ ID NO: 451497 - DNA, 25 bp, Rattus norvegicus
gggagcttattagctcatagggaat

SEQ ID NO: 451498 - DNA, 25 bp, Rattus norvegicus
gggagcttcactagctcattcagaa

SEQ ID NO: 451499 - DNA, 25 bp, Rattus norvegicus
gggagcttcacttgctcattcagaa

SEQ ID NO: 451500 - DNA, 25 bp, Rattus norvegicus
gggagcttccctaagtggctctgaa

SEQ ID NO: 451501 - DNA, 25 bp, Rattus norvegicus
gggagcttcccttagtggctctgaa

SEQ ID NO: 451502 - DNA, 25 bp, Rattus norvegicus
gggagcttccgaatagccaaggcta

SEQ ID NO: 451503 - DNA, 25 bp, Rattus norvegicus
gggagcttccgattagccaaggcta

SEQ ID NO: 451504 - DNA, 25 bp, Rattus norvegicus
gggagcttcgcacatcacagtgcaa

SEQ ID NO: 451505 - DNA, 25 bp, Rattus norvegicus
gggagcttcgcagatcacagtgcaa

SEQ ID NO: 451506 - DNA, 25 bp, Rattus norvegicus
gggagcttcgctcttttcttcctcc

SEQ ID NO: 451507 - DNA, 25 bp, Rattus norvegicus
gggagcttcgctgttttcttcctcc

SEQ ID NO: 451508 - DNA, 25 bp, Rattus norvegicus
gggagcttcgtcactcagggacacg

SEQ ID NO: 451509 - DNA, 25 bp, Rattus norvegicus
gggagcttcgtctctcagggacacg

SEQ ID NO: 451510 - DNA, 25 bp, Rattus norvegicus
gggagcttctacaggatgaaatctg

SEQ ID NO: 451511 - DNA, 25 bp, Rattus norvegicus
gggagcttctactggatgaaatctg

SEQ ID NO: 451512 - DNA, 25 bp, Rattus norvegicus
gggagcttgcagaacaagccctcaa

SEQ ID NO: 451513 - DNA, 25 bp, Rattus norvegicus
gggagcttgcagtacaagccctcaa

SEQ ID NO: 451514 - DNA, 25 bp, Rattus norvegicus
gggagcttggacaggagctacctca

SEQ ID NO: 451515 - DNA, 25 bp, Rattus norvegicus
gggagcttggactggagctacctca

SEQ ID NO: 451516 - DNA, 25 bp, Rattus norvegicus
gggagcttggtaagacactttatag

SEQ ID NO: 451517 - DNA, 25 bp, Rattus norvegicus
gggagcttggtatgacactttatag

SEQ ID NO: 451518 - DNA, 25 bp, Rattus norvegicus
gggagctttatcaccgaaccctgga

SEQ ID NO: 451519 - DNA, 25 bp, Rattus norvegicus
gggagctttatctccgaaccctgga

SEQ ID NO: 451520 - DNA, 25 bp, Rattus norvegicus
gggagctttgctactttgcaacaga

SEQ ID NO: 451521 - DNA, 25 bp, Rattus norvegicus
gggagctttgcttctttgcaacaga

SEQ ID NO: 451522 - DNA, 25 bp, Rattus norvegicus
gggagcttttatacccaggcaagcc

SEQ ID NO: 451523 - DNA, 25 bp, Rattus norvegicus
gggagcttttattcccaggcaagcc

SEQ ID NO: 451524 - DNA, 25 bp, Rattus norvegicus
gggagcttttccagatgtcccacca

SEQ ID NO: 451525 - DNA, 25 bp, Rattus norvegicus
gggagcttttcctgatgtcccacca

SEQ ID NO: 451526 - DNA, 25 bp, Rattus norvegicus
gggaggaaactcaggcacaggatct

SEQ ID NO: 451527 - DNA, 25 bp, Rattus norvegicus
gggaggaaactctggcacaggatct

SEQ ID NO: 451528 - DNA, 25 bp, Rattus norvegicus
gggaggaaccacctctcttagaggg

SEQ ID NO: 451529 - DNA, 25 bp, Rattus norvegicus
gggaggaaccacgtctcttagaggg

SEQ ID NO: 451530 - DNA, 25 bp, Rattus norvegicus
gggaggaacctacgcatacagttgc

SEQ ID NO: 451531 - DNA, 25 bp, Rattus norvegicus
gggaggaacctaggcatacagttgc

SEQ ID NO: 451532 - DNA, 25 bp, Rattus norvegicus
gggaggaagccccaagcagtattct

SEQ ID NO: 451533 - DNA, 25 bp, Rattus norvegicus
gggaggaagcccgaagcagtattct

SEQ ID NO: 451534 - DNA, 25 bp, Rattus norvegicus
gggaggaattctatcacatcatgtt

SEQ ID NO: 451535 - DNA, 25 bp, Rattus norvegicus
gggaggaattctttcacatcatgtt

SEQ ID NO: 451536 - DNA, 25 bp, Rattus norvegicus
gggaggacaaccctttgcacagtag

SEQ ID NO: 451537 - DNA, 25 bp, Rattus norvegicus
gggaggacaaccgtttgcacagtag

SEQ ID NO: 451538 - DNA, 25 bp, Rattus norvegicus
gggaggacacagaggccagtcttaa

SEQ ID NO: 451539 - DNA, 25 bp, Rattus norvegicus
gggaggacacagtggccagtcttaa

SEQ ID NO: 451540 - DNA, 25 bp, Rattus norvegicus
gggaggacaccacatggaaccttta

SEQ ID NO: 451541 - DNA, 25 bp, Rattus norvegicus
gggaggacaccagatggaaccttta

SEQ ID NO: 451542 - DNA, 25 bp, Rattus norvegicus
gggaggacagaacagcccgtcacct

SEQ ID NO: 451543 - DNA, 25 bp, Rattus norvegicus
gggaggacagaagagcccgtcacct

SEQ ID NO: 451544 - DNA, 25 bp, Rattus norvegicus
gggaggacattcagttcgccatgtc

SEQ ID NO: 451545 - DNA, 25 bp, Rattus norvegicus
gggaggacattctgttcgccatgtc

SEQ ID NO: 451546 - DNA, 25 bp, Rattus norvegicus
gggaggacgcctcctccgaattcgc

SEQ ID NO: 451547 - DNA, 25 bp, Rattus norvegicus
gggaggacgcctgctccgaattcgc

SEQ ID NO: 451548 - DNA, 25 bp, Rattus norvegicus
gggaggactcacactcctgcaggta

SEQ ID NO: 451549 - DNA, 25 bp, Rattus norvegicus
gggaggactcactctcctgcaggta

SEQ ID NO: 451550 - DNA, 25 bp, Rattus norvegicus
gggaggactctaaacagccttagta

SEQ ID NO: 451551 - DNA, 25 bp, Rattus norvegicus
gggaggactctatacagccttagta

SEQ ID NO: 451552 - DNA, 25 bp, Rattus norvegicus
gggaggactcttattctgaagccag

SEQ ID NO: 451553 - DNA, 25 bp, Rattus norvegicus
gggaggactctttttctgaagccag

SEQ ID NO: 451554 - DNA, 25 bp, Rattus norvegicus
gggaggactttgagctctactgctt

SEQ ID NO: 451555 - DNA, 25 bp, Rattus norvegicus
gggaggactttgtgctctactgctt

SEQ ID NO: 451556 - DNA, 25 bp, Rattus norvegicus
gggaggacttttctcactcttcggc

SEQ ID NO: 451557 - DNA, 25 bp, Rattus norvegicus
gggaggacttttgtcactcttcggc

SEQ ID NO: 451558 - DNA, 25 bp, Rattus norvegicus
gggaggagaaccaatcctgttttat

SEQ ID NO: 451559 - DNA, 25 bp, Rattus norvegicus
gggaggagaacctatcctgttttat

SEQ ID NO: 451560 - DNA, 25 bp, Rattus norvegicus
gggaggagaactagcccttcacaca

SEQ ID NO: 451561 - DNA, 25 bp, Rattus norvegicus
gggaggagaacttgcccttcacaca

SEQ ID NO: 451562 - DNA, 25 bp, Rattus norvegicus
gggaggagattccaccagaaaatgt

SEQ ID NO: 451563 - DNA, 25 bp, Rattus norvegicus
gggaggagattcgaccagaaaatgt

SEQ ID NO: 451564 - DNA, 25 bp, Rattus norvegicus
gggaggagccacaatatttcaacaa

SEQ ID NO: 451565 - DNA, 25 bp, Rattus norvegicus
gggaggagccactatatttcaacaa

SEQ ID NO: 451566 - DNA, 25 bp, Rattus norvegicus
gggaggagccgcagccctcatctct

SEQ ID NO: 451567 - DNA, 25 bp, Rattus norvegicus
gggaggagccgctgccctcatctct

SEQ ID NO: 451568 - DNA, 25 bp, Rattus norvegicus
gggaggaggaacagaccctaacaga

SEQ ID NO: 451569 - DNA, 25 bp, Rattus norvegicus
gggaggaggaactgaccctaacaga

SEQ ID NO: 451570 - DNA, 25 bp, Rattus norvegicus
gggaggagggacacaattctgcttt

SEQ ID NO: 451571 - DNA, 25 bp, Rattus norvegicus
gggaggagggactcaattctgcttt

SEQ ID NO: 451572 - DNA, 25 bp, Rattus norvegicus
gggaggagtctcagatcagccattc

SEQ ID NO: 451573 - DNA, 25 bp, Rattus norvegicus
gggaggagtctctgatcagccattc

SEQ ID NO: 451574 - DNA, 25 bp, Rattus norvegicus
gggaggatcgtcacagtcctttgtc

SEQ ID NO: 451575 - DNA, 25 bp, Rattus norvegicus
gggaggatcgtctcagtcctttgtc

SEQ ID NO: 451576 - DNA, 25 bp, Rattus norvegicus
gggaggatctttcctagcctcagct

SEQ ID NO: 451577 - DNA, 25 bp, Rattus norvegicus
gggaggatctttgctagcctcagct

SEQ ID NO: 451578 - DNA, 25 bp, Rattus norvegicus
gggaggattccaacctcatcttaga

SEQ ID NO: 451579 - DNA, 25 bp, Rattus norvegicus
gggaggattccatcctcatcttaga

SEQ ID NO: 451580 - DNA, 25 bp, Rattus norvegicus
gggaggattctgatcaagtttcact

SEQ ID NO: 451581 - DNA, 25 bp, Rattus norvegicus
gggaggattctgttcaagtttcact

SEQ ID NO: 451582 - DNA, 25 bp, Rattus norvegicus
gggaggcaaagcctgccagaacctt

SEQ ID NO: 451583 - DNA, 25 bp, Rattus norvegicus
gggaggcaaagcgtgccagaacctt

SEQ ID NO: 451584 - DNA, 25 bp, Rattus norvegicus
gggaggcacagcatctcactcactg

SEQ ID NO: 451585 - DNA, 25 bp, Rattus norvegicus
gggaggcacagcttctcactcactg

SEQ ID NO: 451586 - DNA, 25 bp, Rattus norvegicus
gggaggcaccctaagcatcatactt

SEQ ID NO: 451587 - DNA, 25 bp, Rattus norvegicus
gggaggcacccttagcatcatactt

SEQ ID NO: 451588 - DNA, 25 bp, Rattus norvegicus
gggaggcagctgctaacatcacaaa

SEQ ID NO: 451589 - DNA, 25 bp, Rattus norvegicus
gggaggcagctggtaacatcacaaa

SEQ ID NO: 451590 - DNA, 25 bp, Rattus norvegicus
gggaggcagcttagtttcttcagtc

SEQ ID NO: 451591 - DNA, 25 bp, Rattus norvegicus
gggaggcagctttgtttcttcagtc

SEQ ID NO: 451592 - DNA, 25 bp, Rattus norvegicus
gggaggcaggcaatttcttgtttaa

SEQ ID NO: 451593 - DNA, 25 bp, Rattus norvegicus
gggaggcaggcattttcttgtttaa

SEQ ID NO: 451594 - DNA, 25 bp, Rattus norvegicus
gggaggcaggctctcagaccacttt

SEQ ID NO: 451595 - DNA, 25 bp, Rattus norvegicus
gggaggcaggctgtcagaccacttt

SEQ ID NO: 451596 - DNA, 25 bp, Rattus norvegicus
gggaggcagggaattatgccaacca

SEQ ID NO: 451597 - DNA, 25 bp, Rattus norvegicus
gggaggcagggatttatgccaacca

SEQ ID NO: 451598 - DNA, 25 bp, Rattus norvegicus
gggaggcatacactttctacgtaga

SEQ ID NO: 451599 - DNA, 25 bp, Rattus norvegicus
gggaggcatacagtttctacgtaga

SEQ ID NO: 451600 - DNA, 25 bp, Rattus norvegicus
gggaggcatatgacacatgaccaca

SEQ ID NO: 451601 - DNA, 25 bp, Rattus norvegicus
gggaggcatatgtcacatgaccaca

SEQ ID NO: 451602 - DNA, 25 bp, Rattus norvegicus
gggaggcatgctccacaattcccaa

SEQ ID NO: 451603 - DNA, 25 bp, Rattus norvegicus
gggaggcatgctgcacaattcccaa

SEQ ID NO: 451604 - DNA, 25 bp, Rattus norvegicus
gggaggccagcaacagtcaagtttc

SEQ ID NO: 451605 - DNA, 25 bp, Rattus norvegicus
gggaggccagcatcagtcaagtttc

SEQ ID NO: 451606 - DNA, 25 bp, Rattus norvegicus
gggaggccaggcaccagtccagact

SEQ ID NO: 451607 - DNA, 25 bp, Rattus norvegicus
gggaggccaggctccagtccagact

SEQ ID NO: 451608 - DNA, 25 bp, Rattus norvegicus
gggaggcccagcagacagtcttgct

SEQ ID NO: 451609 - DNA, 25 bp, Rattus norvegicus
gggaggcccagctgacagtcttgct

SEQ ID NO: 451610 - DNA, 25 bp, Rattus norvegicus
gggaggcccaggacaacatccactg

SEQ ID NO: 451611 - DNA, 25 bp, Rattus norvegicus
gggaggcccaggtcaacatccactg

SEQ ID NO: 451612 - DNA, 25 bp, Rattus norvegicus
gggaggcccagtaatcctgaatagc

SEQ ID NO: 451613 - DNA, 25 bp, Rattus norvegicus
gggaggcccagttatcctgaatagc

SEQ ID NO: 451614 - DNA, 25 bp, Rattus norvegicus
gggaggcccattaatagcagattat

SEQ ID NO: 451615 - DNA, 25 bp, Rattus norvegicus
gggaggcccatttatagcagattat

SEQ ID NO: 451616 - DNA, 25 bp, Rattus norvegicus
gggaggccccatatttaagaatctt

SEQ ID NO: 451617 - DNA, 25 bp, Rattus norvegicus
gggaggccccatttttaagaatctt

SEQ ID NO: 451618 - DNA, 25 bp, Rattus norvegicus
gggaggccctgcagagcttagaaaa

SEQ ID NO: 451619 - DNA, 25 bp, Rattus norvegicus
gggaggccctgctgagcttagaaaa

SEQ ID NO: 451620 - DNA, 25 bp, Rattus norvegicus
gggaggccgccaaatgcagagtact

SEQ ID NO: 451621 - DNA, 25 bp, Rattus norvegicus
gggaggccgccatatgcagagtact

SEQ ID NO: 451622 - DNA, 25 bp, Rattus norvegicus
gggaggccgtcaacatgatttctta

SEQ ID NO: 451623 - DNA, 25 bp, Rattus norvegicus
gggaggccgtcatcatgatttctta

SEQ ID NO: 451624 - DNA, 25 bp, Rattus norvegicus
gggaggcctatcaaaattcagttta

SEQ ID NO: 451625 - DNA, 25 bp, Rattus norvegicus
gggaggcctatctaaattcagttta

SEQ ID NO: 451626 - DNA, 25 bp, Rattus norvegicus
gggaggcctccaaccgaaatgtaac

SEQ ID NO: 451627 - DNA, 25 bp, Rattus norvegicus
gggaggcctccatccgaaatgtaac

SEQ ID NO: 451628 - DNA, 25 bp, Rattus norvegicus
gggaggcctgaacacagttctatat

SEQ ID NO: 451629 - DNA, 25 bp, Rattus norvegicus
gggaggcctgaagacagttctatat

SEQ ID NO: 451630 - DNA, 25 bp, Rattus norvegicus
gggaggcctgtcattagttagcaac

SEQ ID NO: 451631 - DNA, 25 bp, Rattus norvegicus
gggaggcctgtctttagttagcaac

SEQ ID NO: 451632 - DNA, 25 bp, Rattus norvegicus
gggaggcgccacaatttttaaaatg

SEQ ID NO: 451633 - DNA, 25 bp, Rattus norvegicus
gggaggcgccactatttttaaaatg

SEQ ID NO: 451634 - DNA, 25 bp, Rattus norvegicus
gggaggcggcttagatacaacctta

SEQ ID NO: 451635 - DNA, 25 bp, Rattus norvegicus
gggaggcggctttgatacaacctta

SEQ ID NO: 451636 - DNA, 25 bp, Rattus norvegicus
gggaggcgtcacacatccaggcctc

SEQ ID NO: 451637 - DNA, 25 bp, Rattus norvegicus
gggaggcgtcactcatccaggcctc

SEQ ID NO: 451638 - DNA, 25 bp, Rattus norvegicus
gggaggctacagacacaccgatcgt

SEQ ID NO: 451639 - DNA, 25 bp, Rattus norvegicus
gggaggctacagtcacaccgatcgt

SEQ ID NO: 451640 - DNA, 25 bp, Rattus norvegicus
gggaggctagcaagacctgtcagac

SEQ ID NO: 451641 - DNA, 25 bp, Rattus norvegicus
gggaggctagcatgacctgtcagac

SEQ ID NO: 451642 - DNA, 25 bp, Rattus norvegicus
gggaggctcaagacactaagcttca

SEQ ID NO: 451643 - DNA, 25 bp, Rattus norvegicus
gggaggctcaagtcactaagcttca

SEQ ID NO: 451644 - DNA, 25 bp, Rattus norvegicus
gggaggctcaataaataatgtgctt

SEQ ID NO: 451645 - DNA, 25 bp, Rattus norvegicus
gggaggctcaattaataatgtgctt

SEQ ID NO: 451646 - DNA, 25 bp, Rattus norvegicus
gggaggctcacgctatctatgcaag

SEQ ID NO: 451647 - DNA, 25 bp, Rattus norvegicus
gggaggctcacggtatctatgcaag

SEQ ID NO: 451648 - DNA, 25 bp, Rattus norvegicus
gggaggctccaaatattctcaaaag

SEQ ID NO: 451649 - DNA, 25 bp, Rattus norvegicus
gggaggctccaattattctcaaaag

SEQ ID NO: 451650 - DNA, 25 bp, Rattus norvegicus
gggaggctccagcaaggattatctt

SEQ ID NO: 451651 - DNA, 25 bp, Rattus norvegicus
gggaggctccaggaaggattatctt

SEQ ID NO: 451652 - DNA, 25 bp, Rattus norvegicus
gggaggctcgaaacggactccagtc

SEQ ID NO: 451653 - DNA, 25 bp, Rattus norvegicus
gggaggctcgaatcggactccagtc

SEQ ID NO: 451654 - DNA, 25 bp, Rattus norvegicus
gggaggctctggaaattgctcagtt

SEQ ID NO: 451655 - DNA, 25 bp, Rattus norvegicus
gggaggctctggtaattgctcagtt

SEQ ID NO: 451656 - DNA, 25 bp, Rattus norvegicus
gggaggctgactccatgagtcacta

SEQ ID NO: 451657 - DNA, 25 bp, Rattus norvegicus
gggaggctgactgcatgagtcacta

SEQ ID NO: 451658 - DNA, 25 bp, Rattus norvegicus
gggaggctgagtactttgcacttca

SEQ ID NO: 451659 - DNA, 25 bp, Rattus norvegicus
gggaggctgagttctttgcacttca

SEQ ID NO: 451660 - DNA, 25 bp, Rattus norvegicus
gggaggctggccatttataaatatt

SEQ ID NO: 451661 - DNA, 25 bp, Rattus norvegicus
gggaggctggccttttataaatatt

SEQ ID NO: 451662 - DNA, 25 bp, Rattus norvegicus
gggaggctgttcaatatgcttgctg

SEQ ID NO: 451663 - DNA, 25 bp, Rattus norvegicus
gggaggctgttctatatgcttgctg

SEQ ID NO: 451664 - DNA, 25 bp, Rattus norvegicus
gggaggcttcagcacttctatgatt

SEQ ID NO: 451665 - DNA, 25 bp, Rattus norvegicus
gggaggcttcaggacttctatgatt

SEQ ID NO: 451666 - DNA, 25 bp, Rattus norvegicus
gggaggctttccatttgaacagaat

SEQ ID NO: 451667 - DNA, 25 bp, Rattus norvegicus
gggaggctttccttttgaacagaat

SEQ ID NO: 451668 - DNA, 25 bp, Rattus norvegicus
gggaggctttctatcctaatgctgt

SEQ ID NO: 451669 - DNA, 25 bp, Rattus norvegicus
gggaggctttctctggaatagctat

SEQ ID NO: 451670 - DNA, 25 bp, Rattus norvegicus
gggaggctttctgtggaatagctat

SEQ ID NO: 451671 - DNA, 25 bp, Rattus norvegicus
gggaggctttctttcctaatgctgt

SEQ ID NO: 451672 - DNA, 25 bp, Rattus norvegicus
gggaggctttggctattgctacctt

SEQ ID NO: 451673 - DNA, 25 bp, Rattus norvegicus
gggaggctttgggtattgctacctt

SEQ ID NO: 451674 - DNA, 25 bp, Rattus norvegicus
gggagggaactactgtcctattgcc

SEQ ID NO: 451675 - DNA, 25 bp, Rattus norvegicus
gggagggaactagtgtcctattgcc

SEQ ID NO: 451676 - DNA, 25 bp, Rattus norvegicus
gggagggacaagagcaccccacgtc

SEQ ID NO: 451677 - DNA, 25 bp, Rattus norvegicus
gggagggacaagtgcaccccacgtc

SEQ ID NO: 451678 - DNA, 25 bp, Rattus norvegicus
gggagggacaggatccagctacaac

SEQ ID NO: 451679 - DNA, 25 bp, Rattus norvegicus
gggagggacaggttccagctacaac

SEQ ID NO: 451680 - DNA, 25 bp, Rattus norvegicus
gggagggagcagaaccatcacacca

SEQ ID NO: 451681 - DNA, 25 bp, Rattus norvegicus
gggagggagcagtaccatcacacca

SEQ ID NO: 451682 - DNA, 25 bp, Rattus norvegicus
gggagggagcccagactcagctaca

SEQ ID NO: 451683 - DNA, 25 bp, Rattus norvegicus
gggagggagccctgactcagctaca

SEQ ID NO: 451684 - DNA, 25 bp, Rattus norvegicus
gggagggagctgacaatcatttatt

SEQ ID NO: 451685 - DNA, 25 bp, Rattus norvegicus
gggagggagctgtcaatcatttatt

SEQ ID NO: 451686 - DNA, 25 bp, Rattus norvegicus
gggagggatcctcacgaaatcatat

SEQ ID NO: 451687 - DNA, 25 bp, Rattus norvegicus
gggagggatcctgacgaaatcatat

SEQ ID NO: 451688 - DNA, 25 bp, Rattus norvegicus
gggagggcaaatctgtcaactaaag

SEQ ID NO: 451689 - DNA, 25 bp, Rattus norvegicus
gggagggcaaatgtgtcaactaaag

SEQ ID NO: 451690 - DNA, 25 bp, Rattus norvegicus
gggagggcaattacttttctaagtg

SEQ ID NO: 451691 - DNA, 25 bp, Rattus norvegicus
gggagggcaatttcttttctaagtg

SEQ ID NO: 451692 - DNA, 25 bp, Rattus norvegicus
gggagggcactgatgttcaaagttc

SEQ ID NO: 451693 - DNA, 25 bp, Rattus norvegicus
gggagggcactgttgttcaaagttc

SEQ ID NO: 451694 - DNA, 25 bp, Rattus norvegicus
gggagggcacttagttatagttcaa

SEQ ID NO: 451695 - DNA, 25 bp, Rattus norvegicus
gggagggcactttgttatagttcaa

SEQ ID NO: 451696 - DNA, 25 bp, Rattus norvegicus
gggagggccttgacttttcatagag

SEQ ID NO: 451697 - DNA, 25 bp, Rattus norvegicus
gggagggccttgtcttttcatagag

SEQ ID NO: 451698 - DNA, 25 bp, Rattus norvegicus
gggagggctactcaacttgctcaat

SEQ ID NO: 451699 - DNA, 25 bp, Rattus norvegicus
gggagggctactgaacttgctcaat

SEQ ID NO: 451700 - DNA, 25 bp, Rattus norvegicus
gggagggctcccaagacactgagac

SEQ ID NO: 451701 - DNA, 25 bp, Rattus norvegicus
gggagggctccctagacactgagac

SEQ ID NO: 451702 - DNA, 25 bp, Rattus norvegicus
gggagggctgagcttgcacaggtgt

SEQ ID NO: 451703 - DNA, 25 bp, Rattus norvegicus
gggagggctgaggttgcacaggtgt

SEQ ID NO: 451704 - DNA, 25 bp, Rattus norvegicus
gggagggctgtgatcactgcatctt

SEQ ID NO: 451705 - DNA, 25 bp, Rattus norvegicus
gggagggctgtgttcactgcatctt

SEQ ID NO: 451706 - DNA, 25 bp, Rattus norvegicus
gggagggtgaccagattccgccacc

SEQ ID NO: 451707 - DNA, 25 bp, Rattus norvegicus
gggagggtgacctgattccgccacc

SEQ ID NO: 451708 - DNA, 25 bp, Rattus norvegicus
gggagggtttcaatcacagcgtgcc

SEQ ID NO: 451709 - DNA, 25 bp, Rattus norvegicus
gggagggtttcattcacagcgtgcc

SEQ ID NO: 451710 - DNA, 25 bp, Rattus norvegicus
gggaggtaacatctctgccccattt

SEQ ID NO: 451711 - DNA, 25 bp, Rattus norvegicus
gggaggtaacatgtctgccccattt

SEQ ID NO: 451712 - DNA, 25 bp, Rattus norvegicus
gggaggtcacaaatgcaaggctaac

SEQ ID NO: 451713 - DNA, 25 bp, Rattus norvegicus
gggaggtcacaattgcaaggctaac

SEQ ID NO: 451714 - DNA, 25 bp, Rattus norvegicus
gggaggtcacctcacgccagacaag

SEQ ID NO: 451715 - DNA, 25 bp, Rattus norvegicus
gggaggtcacctgacgccagacaag

SEQ ID NO: 451716 - DNA, 25 bp, Rattus norvegicus
gggaggtcactaaacagcctactgc

SEQ ID NO: 451717 - DNA, 25 bp, Rattus norvegicus
gggaggtcactatacagcctactgc

SEQ ID NO: 451718 - DNA, 25 bp, Rattus norvegicus
gggaggtcacttacctgtagcatct

SEQ ID NO: 451719 - DNA, 25 bp, Rattus norvegicus
gggaggtcactttcctgtagcatct

SEQ ID NO: 451720 - DNA, 25 bp, Rattus norvegicus
gggaggtcagaaaacgccactattg

SEQ ID NO: 451721 - DNA, 25 bp, Rattus norvegicus
gggaggtcagaatacgccactattg

SEQ ID NO: 451722 - DNA, 25 bp, Rattus norvegicus
gggaggtcattaagctttctgccct

SEQ ID NO: 451723 - DNA, 25 bp, Rattus norvegicus
gggaggtcattatgctttctgccct

SEQ ID NO: 451724 - DNA, 25 bp, Rattus norvegicus
gggaggtcatttcaaaggccacata

SEQ ID NO: 451725 - DNA, 25 bp, Rattus norvegicus
gggaggtcatttgaaaggccacata

SEQ ID NO: 451726 - DNA, 25 bp, Rattus norvegicus
gggaggtcccatctttcagtgcagt

SEQ ID NO: 451727 - DNA, 25 bp, Rattus norvegicus
gggaggtcccatgtttcagtgcagt

SEQ ID NO: 451728 - DNA, 25 bp, Rattus norvegicus
gggaggtccttcagtcaatcagcta

SEQ ID NO: 451729 - DNA, 25 bp, Rattus norvegicus
gggaggtccttctgtcaatcagcta

SEQ ID NO: 451730 - DNA, 25 bp, Rattus norvegicus
gggaggtcgcctatattgatggaca

SEQ ID NO: 451731 - DNA, 25 bp, Rattus norvegicus
gggaggtcgcctttattgatggaca

SEQ ID NO: 451732 - DNA, 25 bp, Rattus norvegicus
gggaggtctgcaactctggtgctaa

SEQ ID NO: 451733 - DNA, 25 bp, Rattus norvegicus
gggaggtctgcatctctggtgctaa

SEQ ID NO: 451734 - DNA, 25 bp, Rattus norvegicus
gggaggtgactccttcaaactgtcc

SEQ ID NO: 451735 - DNA, 25 bp, Rattus norvegicus
gggaggtgactcgttcaaactgtcc

SEQ ID NO: 451736 - DNA, 25 bp, Rattus norvegicus
gggaggtgtcatacagtttaatagc

SEQ ID NO: 451737 - DNA, 25 bp, Rattus norvegicus
gggaggtgtcattcagtttaatagc

SEQ ID NO: 451738 - DNA, 25 bp, Rattus norvegicus
gggaggtgtccacttccttcaacta

SEQ ID NO: 451739 - DNA, 25 bp, Rattus norvegicus
gggaggtgtccagttccttcaacta

SEQ ID NO: 451740 - DNA, 25 bp, Rattus norvegicus
gggaggttcctaacagtctgaaatc

SEQ ID NO: 451741 - DNA, 25 bp, Rattus norvegicus
gggaggttcctatcagtctgaaatc

SEQ ID NO: 451742 - DNA, 25 bp, Rattus norvegicus
gggaggttctttacccgatgtgaag

SEQ ID NO: 451743 - DNA, 25 bp, Rattus norvegicus
gggaggttcttttcccgatgtgaag

SEQ ID NO: 451744 - DNA, 25 bp, Rattus norvegicus
gggaggttgatgatattgaaccaat

SEQ ID NO: 451745 - DNA, 25 bp, Rattus norvegicus
gggaggttgatgttattgaaccaat

SEQ ID NO: 451746 - DNA, 25 bp, Rattus norvegicus
gggaggttgccaagtctgaagaact

SEQ ID NO: 451747 - DNA, 25 bp, Rattus norvegicus
gggaggttgccatgtctgaagaact

SEQ ID NO: 451748 - DNA, 25 bp, Rattus norvegicus
gggaggttgttcattgtcttcccct

SEQ ID NO: 451749 - DNA, 25 bp, Rattus norvegicus
gggaggttgttctttgtcttcccct

SEQ ID NO: 451750 - DNA, 25 bp, Rattus norvegicus
gggaggtttcaacagtgcacatgta

SEQ ID NO: 451751 - DNA, 25 bp, Rattus norvegicus
gggaggtttcaagagtgcacatgta

SEQ ID NO: 451752 - DNA, 25 bp, Rattus norvegicus
gggaggtttcccaagtcacttctgg

SEQ ID NO: 451753 - DNA, 25 bp, Rattus norvegicus
gggaggtttccctagtcacttctgg

SEQ ID NO: 451754 - DNA, 25 bp, Rattus norvegicus
gggaggttttctatcactgtattgt

SEQ ID NO: 451755 - DNA, 25 bp, Rattus norvegicus
gggaggttttctttcactgtattgt

SEQ ID NO: 451756 - DNA, 25 bp, Rattus norvegicus
gggagtaaaaatacagtgactgact

SEQ ID NO: 451757 - DNA, 25 bp, Rattus norvegicus
gggagtaaaaattcagtgactgact

SEQ ID NO: 451758 - DNA, 25 bp, Rattus norvegicus
gggagtaaatttagatttcgaagag

SEQ ID NO: 451759 - DNA, 25 bp, Rattus norvegicus
gggagtaaattttgatttcgaagag

SEQ ID NO: 451760 - DNA, 25 bp, Rattus norvegicus
gggagtaaccctccgcagaggaatt

SEQ ID NO: 451761 - DNA, 25 bp, Rattus norvegicus
gggagtaaccctgcgcagaggaatt

SEQ ID NO: 451762 - DNA, 25 bp, Rattus norvegicus
gggagtaagaggcacttcttctaga

SEQ ID NO: 451763 - DNA, 25 bp, Rattus norvegicus
gggagtaagagggacttcttctaga

SEQ ID NO: 451764 - DNA, 25 bp, Rattus norvegicus
gggagtaatacaaacctacaaggtg

SEQ ID NO: 451765 - DNA, 25 bp, Rattus norvegicus
gggagtaatacatacctacaaggtg

SEQ ID NO: 451766 - DNA, 25 bp, Rattus norvegicus
gggagtaattacagttcctgatttt

SEQ ID NO: 451767 - DNA, 25 bp, Rattus norvegicus
gggagtaattactgttcctgatttt

SEQ ID NO: 451768 - DNA, 25 bp, Rattus norvegicus
gggagtacaacaactacggctgcta

SEQ ID NO: 451769 - DNA, 25 bp, Rattus norvegicus
gggagtacaacatctacggctgcta

SEQ ID NO: 451770 - DNA, 25 bp, Rattus norvegicus
gggagtacacatcgttttagtcaaa

SEQ ID NO: 451771 - DNA, 25 bp, Rattus norvegicus
gggagtacacatggttttagtcaaa

SEQ ID NO: 451772 - DNA, 25 bp, Rattus norvegicus
gggagtaccataatgttacctgtcc

SEQ ID NO: 451773 - DNA, 25 bp, Rattus norvegicus
gggagtaccatattgttacctgtcc

SEQ ID NO: 451774 - DNA, 25 bp, Rattus norvegicus
gggagtacgaacacctagccaagga

SEQ ID NO: 451775 - DNA, 25 bp, Rattus norvegicus
gggagtacgaactcctagccaagga

SEQ ID NO: 451776 - DNA, 25 bp, Rattus norvegicus
gggagtacttacaaatctcagactt

SEQ ID NO: 451777 - DNA, 25 bp, Rattus norvegicus
gggagtacttactaatctcagactt

SEQ ID NO: 451778 - DNA, 25 bp, Rattus norvegicus
gggagtacttgtacctccaaagctt

SEQ ID NO: 451779 - DNA, 25 bp, Rattus norvegicus
gggagtacttgttcctccaaagctt

SEQ ID NO: 451780 - DNA, 25 bp, Rattus norvegicus
gggagtagactcaggcctataccta

SEQ ID NO: 451781 - DNA, 25 bp, Rattus norvegicus
gggagtagactccaaccctaggagt

SEQ ID NO: 451782 - DNA, 25 bp, Rattus norvegicus
gggagtagactcgaaccctaggagt

SEQ ID NO: 451783 - DNA, 25 bp, Rattus norvegicus
gggagtagactctggcctataccta

SEQ ID NO: 451784 - DNA, 25 bp, Rattus norvegicus
gggagtagatcccaaactgcttttt

SEQ ID NO: 451785 - DNA, 25 bp, Rattus norvegicus
gggagtagatccgaaactgcttttt

SEQ ID NO: 451786 - DNA, 25 bp, Rattus norvegicus
gggagtagttcacagacatgagctt

SEQ ID NO: 451787 - DNA, 25 bp, Rattus norvegicus
gggagtagttcagagacatgagctt

SEQ ID NO: 451788 - DNA, 25 bp, Rattus norvegicus
gggagtatagaaccccatccctggg

SEQ ID NO: 451789 - DNA, 25 bp, Rattus norvegicus
gggagtatagaagcccatccctggg

SEQ ID NO: 451790 - DNA, 25 bp, Rattus norvegicus
gggagtatatctacatgcacttcgg

SEQ ID NO: 451791 - DNA, 25 bp, Rattus norvegicus
gggagtatatcttcatgcacttcgg

SEQ ID NO: 451792 - DNA, 25 bp, Rattus norvegicus
gggagtatcatcaatctaccacgca

SEQ ID NO: 451793 - DNA, 25 bp, Rattus norvegicus
gggagtatcatctatctaccacgca

SEQ ID NO: 451794 - DNA, 25 bp, Rattus norvegicus
gggagtatcatgacctactagctca

SEQ ID NO: 451795 - DNA, 25 bp, Rattus norvegicus
gggagtatcatgtcctactagctca

SEQ ID NO: 451796 - DNA, 25 bp, Rattus norvegicus
gggagtatggccaaacaccccactg

SEQ ID NO: 451797 - DNA, 25 bp, Rattus norvegicus
gggagtatggcctaacaccccactg

SEQ ID NO: 451798 - DNA, 25 bp, Rattus norvegicus
gggagtatgttcacactcagtgact

SEQ ID NO: 451799 - DNA, 25 bp, Rattus norvegicus
gggagtatgttctcactcagtgact

SEQ ID NO: 451800 - DNA, 25 bp, Rattus norvegicus
gggagtattaccacttctgtatcta

SEQ ID NO: 451801 - DNA, 25 bp, Rattus norvegicus
gggagtattacctcttctgtatcta

SEQ ID NO: 451802 - DNA, 25 bp, Rattus norvegicus
gggagtcaaccaagcttaaaacagt

SEQ ID NO: 451803 - DNA, 25 bp, Rattus norvegicus
gggagtcaaccatgcttaaaacagt

SEQ ID NO: 451804 - DNA, 25 bp, Rattus norvegicus
gggagtcaaccgcatttcagtatgg

SEQ ID NO: 451805 - DNA, 25 bp, Rattus norvegicus
gggagtcaaccggatttcagtatgg

SEQ ID NO: 451806 - DNA, 25 bp, Rattus norvegicus
gggagtcacgttatgcagcatcttg

SEQ ID NO: 451807 - DNA, 25 bp, Rattus norvegicus
gggagtcacgttttgcagcatcttg

SEQ ID NO: 451808 - DNA, 25 bp, Rattus norvegicus
gggagtcactccaggacctctgtac

SEQ ID NO: 451809 - DNA, 25 bp, Rattus norvegicus
gggagtcactcctggacctctgtac

SEQ ID NO: 451810 - DNA, 25 bp, Rattus norvegicus
gggagtcactgtaataccatcaatg

SEQ ID NO: 451811 - DNA, 25 bp, Rattus norvegicus
gggagtcactgttataccatcaatg

SEQ ID NO: 451812 - DNA, 25 bp, Rattus norvegicus
gggagtcagaaaatacctagggcaa

SEQ ID NO: 451813 - DNA, 25 bp, Rattus norvegicus
gggagtcagaaattacctagggcaa

SEQ ID NO: 451814 - DNA, 25 bp, Rattus norvegicus
gggagtcagagcatcttagtcacct

SEQ ID NO: 451815 - DNA, 25 bp, Rattus norvegicus
gggagtcagagcttcttagtcacct

SEQ ID NO: 451816 - DNA, 25 bp, Rattus norvegicus
gggagtcagcaaaccgtctacctcg

SEQ ID NO: 451817 - DNA, 25 bp, Rattus norvegicus
gggagtcagcaatccgtctacctcg

SEQ ID NO: 451818 - DNA, 25 bp, Rattus norvegicus
gggagtcagccacatagctcaaggc

SEQ ID NO: 451819 - DNA, 25 bp, Rattus norvegicus
gggagtcagccagatagctcaaggc

SEQ ID NO: 451820 - DNA, 25 bp, Rattus norvegicus
gggagtcagtgtaagcactcaccaa

SEQ ID NO: 451821 - DNA, 25 bp, Rattus norvegicus
gggagtcagtgttagcactcaccaa

SEQ ID NO: 451822 - DNA, 25 bp, Rattus norvegicus
gggagtcatgacaaacttctgagaa

SEQ ID NO: 451823 - DNA, 25 bp, Rattus norvegicus
gggagtcatgactaacttctgagaa

SEQ ID NO: 451824 - DNA, 25 bp, Rattus norvegicus
gggagtcattttcctgagcagtcta

SEQ ID NO: 451825 - DNA, 25 bp, Rattus norvegicus
gggagtcattttgctgagcagtcta

SEQ ID NO: 451826 - DNA, 25 bp, Rattus norvegicus
gggagtccaacaatgacattgcaaa

SEQ ID NO: 451827 - DNA, 25 bp, Rattus norvegicus
gggagtccaacacagcaggcaatga

SEQ ID NO: 451828 - DNA, 25 bp, Rattus norvegicus
gggagtccaacagagcaggcaatga

SEQ ID NO: 451829 - DNA, 25 bp, Rattus norvegicus
gggagtccaacattgacattgcaaa

SEQ ID NO: 451830 - DNA, 25 bp, Rattus norvegicus
gggagtccacccaggatcagagaca

SEQ ID NO: 451831 - DNA, 25 bp, Rattus norvegicus
gggagtccaccctggatcagagaca

SEQ ID NO: 451832 - DNA, 25 bp, Rattus norvegicus
gggagtccatacacatgagtggcaa

SEQ ID NO: 451833 - DNA, 25 bp, Rattus norvegicus
gggagtccatactcatgagtggcaa

SEQ ID NO: 451834 - DNA, 25 bp, Rattus norvegicus
gggagtccatccagagtcagcagca

SEQ ID NO: 451835 - DNA, 25 bp, Rattus norvegicus
gggagtccatccaggattgctaaca

SEQ ID NO: 451836 - DNA, 25 bp, Rattus norvegicus
gggagtccatcctgagtcagcagca

SEQ ID NO: 451837 - DNA, 25 bp, Rattus norvegicus
gggagtccatcctggattgctaaca

SEQ ID NO: 451838 - DNA, 25 bp, Rattus norvegicus
gggagtccatttatactcaagaaca

SEQ ID NO: 451839 - DNA, 25 bp, Rattus norvegicus
gggagtccatttttactcaagaaca

SEQ ID NO: 451840 - DNA, 25 bp, Rattus norvegicus
gggagtcccatgaagactgacattt

SEQ ID NO: 451841 - DNA, 25 bp, Rattus norvegicus
gggagtcccatgtagactgacattt

SEQ ID NO: 451842 - DNA, 25 bp, Rattus norvegicus
gggagtcccattaggtttcggtcat

SEQ ID NO: 451843 - DNA, 25 bp, Rattus norvegicus
gggagtcccatttggtttcggtcat

SEQ ID NO: 451844 - DNA, 25 bp, Rattus norvegicus
gggagtccccacacactaagcatta

SEQ ID NO: 451845 - DNA, 25 bp, Rattus norvegicus
gggagtccccactcactaagcatta

SEQ ID NO: 451846 - DNA, 25 bp, Rattus norvegicus
gggagtccccagagtaatttactgt

SEQ ID NO: 451847 - DNA, 25 bp, Rattus norvegicus
gggagtccccagtgtaatttactgt

SEQ ID NO: 451848 - DNA, 25 bp, Rattus norvegicus
gggagtccccatcagcttaaaggag

SEQ ID NO: 451849 - DNA, 25 bp, Rattus norvegicus
gggagtccccatgagcttaaaggag

SEQ ID NO: 451850 - DNA, 25 bp, Rattus norvegicus
gggagtcctaccatgccctgttgct

SEQ ID NO: 451851 - DNA, 25 bp, Rattus norvegicus
gggagtcctaccttgccctgttgct

SEQ ID NO: 451852 - DNA, 25 bp, Rattus norvegicus
gggagtcctctaacaagggcacaca

SEQ ID NO: 451853 - DNA, 25 bp, Rattus norvegicus
gggagtcctctatcaagggcacaca

SEQ ID NO: 451854 - DNA, 25 bp, Rattus norvegicus
gggagtcctctgagacatccatgat

SEQ ID NO: 451855 - DNA, 25 bp, Rattus norvegicus
gggagtcctctgtgacatccatgat

SEQ ID NO: 451856 - DNA, 25 bp, Rattus norvegicus
gggagtcctttgacacatttttcat

SEQ ID NO: 451857 - DNA, 25 bp, Rattus norvegicus
gggagtcctttgtcacatttttcat

SEQ ID NO: 451858 - DNA, 25 bp, Rattus norvegicus
gggagtcgatggctgccttctcact

SEQ ID NO: 451859 - DNA, 25 bp, Rattus norvegicus
gggagtcgatgggtgccttctcact

SEQ ID NO: 451860 - DNA, 25 bp, Rattus norvegicus
gggagtcgatgtaactggacctcat

SEQ ID NO: 451861 - DNA, 25 bp, Rattus norvegicus
gggagtcgatgttactggacctcat

SEQ ID NO: 451862 - DNA, 25 bp, Rattus norvegicus
gggagtcgctggacacttagcattg

SEQ ID NO: 451863 - DNA, 25 bp, Rattus norvegicus
gggagtcgctggtcacttagcattg

SEQ ID NO: 451864 - DNA, 25 bp, Rattus norvegicus
gggagtcgtcttagtcgtcttcaac

SEQ ID NO: 451865 - DNA, 25 bp, Rattus norvegicus
gggagtcgtctttgtcgtcttcaac

SEQ ID NO: 451866 - DNA, 25 bp, Rattus norvegicus
gggagtcgttgcaggaatttctttt

SEQ ID NO: 451867 - DNA, 25 bp, Rattus norvegicus
gggagtcgttgctggaatttctttt

SEQ ID NO: 451868 - DNA, 25 bp, Rattus norvegicus
gggagtctaagcctcaactttatgt

SEQ ID NO: 451869 - DNA, 25 bp, Rattus norvegicus
gggagtctaagcgtcaactttatgt

SEQ ID NO: 451870 - DNA, 25 bp, Rattus norvegicus
gggagtctacaaaacgggtacgtca

SEQ ID NO: 451871 - DNA, 25 bp, Rattus norvegicus
gggagtctacaatacgggtacgtca

SEQ ID NO: 451872 - DNA, 25 bp, Rattus norvegicus
gggagtctatgcagccaaaccgcag

SEQ ID NO: 451873 - DNA, 25 bp, Rattus norvegicus
gggagtctatgctgccaaaccgcag

SEQ ID NO: 451874 - DNA, 25 bp, Rattus norvegicus
gggagtctccacaagaaacggctgt

SEQ ID NO: 451875 - DNA, 25 bp, Rattus norvegicus
gggagtctccactagaaacggctgt

SEQ ID NO: 451876 - DNA, 25 bp, Rattus norvegicus
gggagtctcctacaaattccagtta

SEQ ID NO: 451877 - DNA, 25 bp, Rattus norvegicus
gggagtctcctagaaattccagtta

SEQ ID NO: 451878 - DNA, 25 bp, Rattus norvegicus
gggagtctcgaaaccttcctgtcct

SEQ ID NO: 451879 - DNA, 25 bp, Rattus norvegicus
gggagtctcgaatccttcctgtcct

SEQ ID NO: 451880 - DNA, 25 bp, Rattus norvegicus
gggagtctctaaaaccgcttcacta

SEQ ID NO: 451881 - DNA, 25 bp, Rattus norvegicus
gggagtctctaataccgcttcacta

SEQ ID NO: 451882 - DNA, 25 bp, Rattus norvegicus
gggagtctctgcacaggtctagctg

SEQ ID NO: 451883 - DNA, 25 bp, Rattus norvegicus
gggagtctctgctcaggtctagctg

SEQ ID NO: 451884 - DNA, 25 bp, Rattus norvegicus
gggagtctcttgactcagcctcctg

SEQ ID NO: 451885 - DNA, 25 bp, Rattus norvegicus
gggagtctcttgtctcagcctcctg

SEQ ID NO: 451886 - DNA, 25 bp, Rattus norvegicus
gggagtctctttaaatcagcaccaa

SEQ ID NO: 451887 - DNA, 25 bp, Rattus norvegicus
gggagtctcttttaatcagcaccaa

SEQ ID NO: 451888 - DNA, 25 bp, Rattus norvegicus
gggagtctgagtattagccattcta

SEQ ID NO: 451889 - DNA, 25 bp, Rattus norvegicus
gggagtctgagttttagccattcta

SEQ ID NO: 451890 - DNA, 25 bp, Rattus norvegicus
gggagtctgccgatgagtgcttcat

SEQ ID NO: 451891 - DNA, 25 bp, Rattus norvegicus
gggagtctgccgttgagtgcttcat

SEQ ID NO: 451892 - DNA, 25 bp, Rattus norvegicus
gggagtctgggcattgtccatcact

SEQ ID NO: 451893 - DNA, 25 bp, Rattus norvegicus
gggagtctgggctttgtccatcact

SEQ ID NO: 451894 - DNA, 25 bp, Rattus norvegicus
gggagtctgtggaacatcagccctg

SEQ ID NO: 451895 - DNA, 25 bp, Rattus norvegicus
gggagtctgtggcttctttaaacct

SEQ ID NO: 451896 - DNA, 25 bp, Rattus norvegicus
gggagtctgtgggttctttaaacct

SEQ ID NO: 451897 - DNA, 25 bp, Rattus norvegicus
gggagtctgtggtacatcagccctg

SEQ ID NO: 451898 - DNA, 25 bp, Rattus norvegicus
gggagtcttaaccttaatcgacatt

SEQ ID NO: 451899 - DNA, 25 bp, Rattus norvegicus
gggagtcttaacgttaatcgacatt

SEQ ID NO: 451900 - DNA, 25 bp, Rattus norvegicus
gggagtcttccacgccagtagcatt

SEQ ID NO: 451901 - DNA, 25 bp, Rattus norvegicus
gggagtcttccaggccagtagcatt

SEQ ID NO: 451902 - DNA, 25 bp, Rattus norvegicus
gggagtctttacatcttctcaatca

SEQ ID NO: 451903 - DNA, 25 bp, Rattus norvegicus
gggagtctttacttcttctcaatca

SEQ ID NO: 451904 - DNA, 25 bp, Rattus norvegicus
gggagtctttatcctcatcctgaaa

SEQ ID NO: 451905 - DNA, 25 bp, Rattus norvegicus
gggagtctttatgctcatcctgaaa

SEQ ID NO: 451906 - DNA, 25 bp, Rattus norvegicus
gggagtctttcccagtaactgatag

SEQ ID NO: 451907 - DNA, 25 bp, Rattus norvegicus
gggagtctttccgagtaactgatag

SEQ ID NO: 451908 - DNA, 25 bp, Rattus norvegicus
gggagtgaaattctgccttccaact

SEQ ID NO: 451909 - DNA, 25 bp, Rattus norvegicus
gggagtgaaattgtgccttccaact

SEQ ID NO: 451910 - DNA, 25 bp, Rattus norvegicus
gggagtgaacagagactcacggttt

SEQ ID NO: 451911 - DNA, 25 bp, Rattus norvegicus
gggagtgaacagtgactcacggttt

SEQ ID NO: 451912 - DNA, 25 bp, Rattus norvegicus
gggagtgacacacaactttgtaaac

SEQ ID NO: 451913 - DNA, 25 bp, Rattus norvegicus
gggagtgacacagaactttgtaaac

SEQ ID NO: 451914 - DNA, 25 bp, Rattus norvegicus
gggagtgaccacatagcctcactgg

SEQ ID NO: 451915 - DNA, 25 bp, Rattus norvegicus
gggagtgaccacttagcctcactgg

SEQ ID NO: 451916 - DNA, 25 bp, Rattus norvegicus
gggagtgacccgagttggcctctca

SEQ ID NO: 451917 - DNA, 25 bp, Rattus norvegicus
gggagtgacccgtgttggcctctca

SEQ ID NO: 451918 - DNA, 25 bp, Rattus norvegicus
gggagtgactaaccattgctgttac

SEQ ID NO: 451919 - DNA, 25 bp, Rattus norvegicus
gggagtgactaagcattgctgttac

SEQ ID NO: 451920 - DNA, 25 bp, Rattus norvegicus
gggagtgactgacgccttccctgtt

SEQ ID NO: 451921 - DNA, 25 bp, Rattus norvegicus
gggagtgactgaggccttccctgtt

SEQ ID NO: 451922 - DNA, 25 bp, Rattus norvegicus
gggagtgagccaatcttttcttagc

SEQ ID NO: 451923 - DNA, 25 bp, Rattus norvegicus
gggagtgagccattcttttcttagc

SEQ ID NO: 451924 - DNA, 25 bp, Rattus norvegicus
gggagtgcaaacctgtacacccact

SEQ ID NO: 451925 - DNA, 25 bp, Rattus norvegicus
gggagtgcaaacgtgtacacccact

SEQ ID NO: 451926 - DNA, 25 bp, Rattus norvegicus
gggagtgcatttatccacttccctc

SEQ ID NO: 451927 - DNA, 25 bp, Rattus norvegicus
gggagtgcatttttccacttccctc

SEQ ID NO: 451928 - DNA, 25 bp, Rattus norvegicus
gggagtgccagtattaaaggacttg

SEQ ID NO: 451929 - DNA, 25 bp, Rattus norvegicus
gggagtgccagttttaaaggacttg

SEQ ID NO: 451930 - DNA, 25 bp, Rattus norvegicus
gggagtgccccacatgattgtacag

SEQ ID NO: 451931 - DNA, 25 bp, Rattus norvegicus
gggagtgccccagatgattgtacag

SEQ ID NO: 451932 - DNA, 25 bp, Rattus norvegicus
gggagtgcgcagaacattttgtctg

SEQ ID NO: 451933 - DNA, 25 bp, Rattus norvegicus
gggagtgcgcagtacattttgtctg

SEQ ID NO: 451934 - DNA, 25 bp, Rattus norvegicus
gggagtgctcaacatcttcgcggcc

SEQ ID NO: 451935 - DNA, 25 bp, Rattus norvegicus
gggagtgctcaagatcttcgcggcc

SEQ ID NO: 451936 - DNA, 25 bp, Rattus norvegicus
gggagtgctcccagtgtgattatgc

SEQ ID NO: 451937 - DNA, 25 bp, Rattus norvegicus
gggagtgctccctgtgtgattatgc

SEQ ID NO: 451938 - DNA, 25 bp, Rattus norvegicus
gggagtgctgttctgcgccatacct

SEQ ID NO: 451939 - DNA, 25 bp, Rattus norvegicus
gggagtgctgttgtgcgccatacct

SEQ ID NO: 451940 - DNA, 25 bp, Rattus norvegicus
gggagtggatctaccaggccataaa

SEQ ID NO: 451941 - DNA, 25 bp, Rattus norvegicus
gggagtggatcttccaggccataaa

SEQ ID NO: 451942 - DNA, 25 bp, Rattus norvegicus
gggagtggattcacccagagataga

SEQ ID NO: 451943 - DNA, 25 bp, Rattus norvegicus
gggagtggattctcccagagataga

SEQ ID NO: 451944 - DNA, 25 bp, Rattus norvegicus
gggagtggctccaggctggacaggg

SEQ ID NO: 451945 - DNA, 25 bp, Rattus norvegicus
gggagtggctcctggctggacaggg

SEQ ID NO: 451946 - DNA, 25 bp, Rattus norvegicus
gggagtggtctcaagtcaccctgac

SEQ ID NO: 451947 - DNA, 25 bp, Rattus norvegicus
gggagtggtctctagtcaccctgac

SEQ ID NO: 451948 - DNA, 25 bp, Rattus norvegicus
gggagtgtcaccaccgctgaaggcc

SEQ ID NO: 451949 - DNA, 25 bp, Rattus norvegicus
gggagtgtcacctccgctgaaggcc

SEQ ID NO: 451950 - DNA, 25 bp, Rattus norvegicus
gggagtgtcgctagtatgttaccat

SEQ ID NO: 451951 - DNA, 25 bp, Rattus norvegicus
gggagtgtcgcttgtatgttaccat

SEQ ID NO: 451952 - DNA, 25 bp, Rattus norvegicus
gggagtgtctgcaaccatcgaaaag

SEQ ID NO: 451953 - DNA, 25 bp, Rattus norvegicus
gggagtgtctgctaccatcgaaaag

SEQ ID NO: 451954 - DNA, 25 bp, Rattus norvegicus
gggagtgtgttcagtggttccttct

SEQ ID NO: 451955 - DNA, 25 bp, Rattus norvegicus
gggagtgtgttctgtggttccttct

SEQ ID NO: 451956 - DNA, 25 bp, Rattus norvegicus
gggagttacagtacctagggatcac

SEQ ID NO: 451957 - DNA, 25 bp, Rattus norvegicus
gggagttacagttcctagggatcac

SEQ ID NO: 451958 - DNA, 25 bp, Rattus norvegicus
gggagttacatgcaggcctgactta

SEQ ID NO: 451959 - DNA, 25 bp, Rattus norvegicus
gggagttacatggaggcctgactta

SEQ ID NO: 451960 - DNA, 25 bp, Rattus norvegicus
gggagttaccatcgttaagccaata

SEQ ID NO: 451961 - DNA, 25 bp, Rattus norvegicus
gggagttaccatggttaagccaata

SEQ ID NO: 451962 - DNA, 25 bp, Rattus norvegicus
gggagttactgcaaaactaagacaa

SEQ ID NO: 451963 - DNA, 25 bp, Rattus norvegicus
gggagttactgctaaactaagacaa

SEQ ID NO: 451964 - DNA, 25 bp, Rattus norvegicus
gggagttagccaacagtcagagcaa

SEQ ID NO: 451965 - DNA, 25 bp, Rattus norvegicus
gggagttagccatcagtcagagcaa

SEQ ID NO: 451966 - DNA, 25 bp, Rattus norvegicus
gggagttagcttctttgttccatag

SEQ ID NO: 451967 - DNA, 25 bp, Rattus norvegicus
gggagttagcttgtttgttccatag

SEQ ID NO: 451968 - DNA, 25 bp, Rattus norvegicus
gggagttatgagataccacgtggtt

SEQ ID NO: 451969 - DNA, 25 bp, Rattus norvegicus
gggagttatgagttaccacgtggtt

SEQ ID NO: 451970 - DNA, 25 bp, Rattus norvegicus
gggagttatttgaccagcatgaaga

SEQ ID NO: 451971 - DNA, 25 bp, Rattus norvegicus
gggagttatttgtccagcatgaaga

SEQ ID NO: 451972 - DNA, 25 bp, Rattus norvegicus
gggagttcacagacagcttaggcta

SEQ ID NO: 451973 - DNA, 25 bp, Rattus norvegicus
gggagttcacagacagtcaactgca

SEQ ID NO: 451974 - DNA, 25 bp, Rattus norvegicus
gggagttcacagtcagcttaggcta

SEQ ID NO: 451975 - DNA, 25 bp, Rattus norvegicus
gggagttcacagtcagtcaactgca

SEQ ID NO: 451976 - DNA, 25 bp, Rattus norvegicus
gggagttcacctcatagccctagag

SEQ ID NO: 451977 - DNA, 25 bp, Rattus norvegicus
gggagttcacctgatagccctagag

SEQ ID NO: 451978 - DNA, 25 bp, Rattus norvegicus
gggagttcagtgctgattgcaataa

SEQ ID NO: 451979 - DNA, 25 bp, Rattus norvegicus
gggagttcagtggtgattgcaataa

SEQ ID NO: 451980 - DNA, 25 bp, Rattus norvegicus
gggagttcccgtctgtcaccttgga

SEQ ID NO: 451981 - DNA, 25 bp, Rattus norvegicus
gggagttcccgtgtgtcaccttgga

SEQ ID NO: 451982 - DNA, 25 bp, Rattus norvegicus
gggagttctctgctgctaacaagga

SEQ ID NO: 451983 - DNA, 25 bp, Rattus norvegicus
gggagttctctggtgctaacaagga

SEQ ID NO: 451984 - DNA, 25 bp, Rattus norvegicus
gggagttctgaaaaaggccacacaa

SEQ ID NO: 451985 - DNA, 25 bp, Rattus norvegicus
gggagttctgaataaggccacacaa

SEQ ID NO: 451986 - DNA, 25 bp, Rattus norvegicus
gggagttctgctaatactttcttat

SEQ ID NO: 451987 - DNA, 25 bp, Rattus norvegicus
gggagttctgcttatactttcttat

SEQ ID NO: 451988 - DNA, 25 bp, Rattus norvegicus
gggagttctggcacaacgtacacgt

SEQ ID NO: 451989 - DNA, 25 bp, Rattus norvegicus
gggagttctggctcaacgtacacgt

SEQ ID NO: 451990 - DNA, 25 bp, Rattus norvegicus
gggagttcttgccaaatacgctaaa

SEQ ID NO: 451991 - DNA, 25 bp, Rattus norvegicus
gggagttcttgcgaaatacgctaaa

SEQ ID NO: 451992 - DNA, 25 bp, Rattus norvegicus
gggagttgagggagccccatcttca

SEQ ID NO: 451993 - DNA, 25 bp, Rattus norvegicus
gggagttgagggtgccccatcttca

SEQ ID NO: 451994 - DNA, 25 bp, Rattus norvegicus
gggagttgcattaccctattagtgc

SEQ ID NO: 451995 - DNA, 25 bp, Rattus norvegicus
gggagttgcatttccctattagtgc

SEQ ID NO: 451996 - DNA, 25 bp, Rattus norvegicus
gggagttgccagatcctccgaacgc

SEQ ID NO: 451997 - DNA, 25 bp, Rattus norvegicus
gggagttgccagttcctccgaacgc

SEQ ID NO: 451998 - DNA, 25 bp, Rattus norvegicus
gggagttgccccagatgactgcaaa

SEQ ID NO: 451999 - DNA, 25 bp, Rattus norvegicus
gggagttgcccctgatgactgcaaa

SEQ ID NO: 452000 - DNA, 25 bp, Rattus norvegicus
gggagttgccttctttcataaacat

SEQ ID NO: 452001 - DNA, 25 bp, Rattus norvegicus
gggagttgccttgtttcataaacat

SEQ ID NO: 452002 - DNA, 25 bp, Rattus norvegicus
gggagttgcttgacacacgaatcag

SEQ ID NO: 452003 - DNA, 25 bp, Rattus norvegicus
gggagttgcttgtcacacgaatcag

SEQ ID NO: 452004 - DNA, 25 bp, Rattus norvegicus
gggagttgtatgacactctatcatt

SEQ ID NO: 452005 - DNA, 25 bp, Rattus norvegicus
gggagttgtatgtcactctatcatt

SEQ ID NO: 452006 - DNA, 25 bp, Rattus norvegicus
gggagttgttccctagtcttaacat

SEQ ID NO: 452007 - DNA, 25 bp, Rattus norvegicus
gggagttgttccgtagtcttaacat

SEQ ID NO: 452008 - DNA, 25 bp, Rattus norvegicus
gggagtttacttcttgtgcaatttt

SEQ ID NO: 452009 - DNA, 25 bp, Rattus norvegicus
gggagtttacttgttgtgcaatttt

SEQ ID NO: 452010 - DNA, 25 bp, Rattus norvegicus
gggagtttatgcctgtccagtgcaa

SEQ ID NO: 452011 - DNA, 25 bp, Rattus norvegicus
gggagtttatgcgtgtccagtgcaa

SEQ ID NO: 452012 - DNA, 25 bp, Rattus norvegicus
gggagtttccaaatagatacttgga

SEQ ID NO: 452013 - DNA, 25 bp, Rattus norvegicus
gggagtttccaattagatacttgga

SEQ ID NO: 452014 - DNA, 25 bp, Rattus norvegicus
gggagtttccatccagtggccatgc

SEQ ID NO: 452015 - DNA, 25 bp, Rattus norvegicus
gggagtttccatgcagtggccatgc

SEQ ID NO: 452016 - DNA, 25 bp, Rattus norvegicus
gggagtttctccatgctgagagccg

SEQ ID NO: 452017 - DNA, 25 bp, Rattus norvegicus
gggagtttctccttgctgagagccg

SEQ ID NO: 452018 - DNA, 25 bp, Rattus norvegicus
gggagtttgcagagttccagcttca

SEQ ID NO: 452019 - DNA, 25 bp, Rattus norvegicus
gggagtttgcagtgttccagcttca

SEQ ID NO: 452020 - DNA, 25 bp, Rattus norvegicus
gggagtttgcttaggaaatattgaa

SEQ ID NO: 452021 - DNA, 25 bp, Rattus norvegicus
gggagtttgctttggaaatattgaa

SEQ ID NO: 452022 - DNA, 25 bp, Rattus norvegicus
gggagtttgtgaagctctgaaccat

SEQ ID NO: 452023 - DNA, 25 bp, Rattus norvegicus
gggagtttgtgatgctctgaaccat

SEQ ID NO: 452024 - DNA, 25 bp, Rattus norvegicus
gggagttttacaatctcagtttctc

SEQ ID NO: 452025 - DNA, 25 bp, Rattus norvegicus
gggagttttacattctcagtttctc

SEQ ID NO: 452026 - DNA, 25 bp, Rattus norvegicus
gggagttttcacacagaggcagcca

SEQ ID NO: 452027 - DNA, 25 bp, Rattus norvegicus
gggagttttcactcagaggcagcca

SEQ ID NO: 452028 - DNA, 25 bp, Rattus norvegicus
gggagttttctgattctctcattat

SEQ ID NO: 452029 - DNA, 25 bp, Rattus norvegicus
gggagttttctgtttctctcattat

SEQ ID NO: 452030 - DNA, 25 bp, Rattus norvegicus
gggagtttttccaacacgcaactgt

SEQ ID NO: 452031 - DNA, 25 bp, Rattus norvegicus
gggagtttttccaacagtgcaatct

SEQ ID NO: 452032 - DNA, 25 bp, Rattus norvegicus
gggagtttttcctacacgcaactgt

SEQ ID NO: 452033 - DNA, 25 bp, Rattus norvegicus
gggagtttttcctacagtgcaatct

SEQ ID NO: 452034 - DNA, 25 bp, Rattus norvegicus
gggataaacaagatctcctccactg

SEQ ID NO: 452035 - DNA, 25 bp, Rattus norvegicus
gggataaacaagttctcctccactg

SEQ ID NO: 452036 - DNA, 25 bp, Rattus norvegicus
gggataaacagcataatagtgacat

SEQ ID NO: 452037 - DNA, 25 bp, Rattus norvegicus
gggataaacagcttaatagtgacat

SEQ ID NO: 452038 - DNA, 25 bp, Rattus norvegicus
gggataaactccatgtacctcttgc

SEQ ID NO: 452039 - DNA, 25 bp, Rattus norvegicus
gggataaactccttgtacctcttgc

SEQ ID NO: 452040 - DNA, 25 bp, Rattus norvegicus
gggataaccaccagacgaggacttt

SEQ ID NO: 452041 - DNA, 25 bp, Rattus norvegicus
gggataaccacctgacgaggacttt

SEQ ID NO: 452042 - DNA, 25 bp, Rattus norvegicus
gggataacgaacaacagcaacgtct

SEQ ID NO: 452043 - DNA, 25 bp, Rattus norvegicus
gggataacgaactacagcaacgtct

SEQ ID NO: 452044 - DNA, 25 bp, Rattus norvegicus
gggataactcatccgatcagctctg

SEQ ID NO: 452045 - DNA, 25 bp, Rattus norvegicus
gggataactcatgcgatcagctctg

SEQ ID NO: 452046 - DNA, 25 bp, Rattus norvegicus
gggataactcttcgactcagccgcc

SEQ ID NO: 452047 - DNA, 25 bp, Rattus norvegicus
gggataactcttggactcagccgcc

SEQ ID NO: 452048 - DNA, 25 bp, Rattus norvegicus
gggataacttgtatgaggttagcct

SEQ ID NO: 452049 - DNA, 25 bp, Rattus norvegicus
gggataacttgtttgaggttagcct

SEQ ID NO: 452050 - DNA, 25 bp, Rattus norvegicus
gggataactttacccatgaccttga

SEQ ID NO: 452051 - DNA, 25 bp, Rattus norvegicus
gggataactttagccatgaccttga

SEQ ID NO: 452052 - DNA, 25 bp, Rattus norvegicus
gggataagacctctgacccgtgcct

SEQ ID NO: 452053 - DNA, 25 bp, Rattus norvegicus
gggataagacctgtgacccgtgcct

SEQ ID NO: 452054 - DNA, 25 bp, Rattus norvegicus
gggataagccagcactcactgatgg

SEQ ID NO: 452055 - DNA, 25 bp, Rattus norvegicus
gggataagccagcatgtgagaacct

SEQ ID NO: 452056 - DNA, 25 bp, Rattus norvegicus
gggataagccaggactcactgatgg

SEQ ID NO: 452057 - DNA, 25 bp, Rattus norvegicus
gggataagccaggatgtgagaacct

SEQ ID NO: 452058 - DNA, 25 bp, Rattus norvegicus
gggataagctatccttcctcttaaa

SEQ ID NO: 452059 - DNA, 25 bp, Rattus norvegicus
gggataagctatgcttcctcttaaa

SEQ ID NO: 452060 - DNA, 25 bp, Rattus norvegicus
gggataagctccagtgaatacactt

SEQ ID NO: 452061 - DNA, 25 bp, Rattus norvegicus
gggataagctcctgtgaatacactt

SEQ ID NO: 452062 - DNA, 25 bp, Rattus norvegicus
gggataagtgttccctgcatgcctc

SEQ ID NO: 452063 - DNA, 25 bp, Rattus norvegicus
gggataagtgttgcctgcatgcctc

SEQ ID NO: 452064 - DNA, 25 bp, Rattus norvegicus
gggataatcgtccttattttattca

SEQ ID NO: 452065 - DNA, 25 bp, Rattus norvegicus
gggataatcgtcgttattttattca

SEQ ID NO: 452066 - DNA, 25 bp, Rattus norvegicus
gggataatgcatcccagtcccattg

SEQ ID NO: 452067 - DNA, 25 bp, Rattus norvegicus
gggataatgcatgccagtcccattg

SEQ ID NO: 452068 - DNA, 25 bp, Rattus norvegicus
gggataatggacacaccctagccta

SEQ ID NO: 452069 - DNA, 25 bp, Rattus norvegicus
gggataatggactcaccctagccta

SEQ ID NO: 452070 - DNA, 25 bp, Rattus norvegicus
gggatacaaatgctgccactctttt

SEQ ID NO: 452071 - DNA, 25 bp, Rattus norvegicus
gggatacaaatggtgccactctttt

SEQ ID NO: 452072 - DNA, 25 bp, Rattus norvegicus
gggatacaactcagggccttgcagg

SEQ ID NO: 452073 - DNA, 25 bp, Rattus norvegicus
gggatacaactctgggccttgcagg

SEQ ID NO: 452074 - DNA, 25 bp, Rattus norvegicus
gggatacaccacagtaggcggttaa

SEQ ID NO: 452075 - DNA, 25 bp, Rattus norvegicus
gggatacaccactgtaggcggttaa

SEQ ID NO: 452076 - DNA, 25 bp, Rattus norvegicus
gggatacacctaagtcttgtcgatg

SEQ ID NO: 452077 - DNA, 25 bp, Rattus norvegicus
gggatacacctatgtcttgtcgatg

SEQ ID NO: 452078 - DNA, 25 bp, Rattus norvegicus
gggatacagctaccagactcttctg

SEQ ID NO: 452079 - DNA, 25 bp, Rattus norvegicus
gggatacagctagcagactcttctg

SEQ ID NO: 452080 - DNA, 25 bp, Rattus norvegicus
gggatacagctcagtctaatacatg

SEQ ID NO: 452081 - DNA, 25 bp, Rattus norvegicus
gggatacagctctgtctaatacatg

SEQ ID NO: 452082 - DNA, 25 bp, Rattus norvegicus
gggatacagtttagcaatattccta

SEQ ID NO: 452083 - DNA, 25 bp, Rattus norvegicus
gggatacagttttgcaatattccta

SEQ ID NO: 452084 - DNA, 25 bp, Rattus norvegicus
gggatacatccaattctcacagaac

SEQ ID NO: 452085 - DNA, 25 bp, Rattus norvegicus
gggatacatccatttctcacagaac

SEQ ID NO: 452086 - DNA, 25 bp, Rattus norvegicus
gggataccaccaccatgacattctt

SEQ ID NO: 452087 - DNA, 25 bp, Rattus norvegicus
gggataccaccagcatgacattctt

SEQ ID NO: 452088 - DNA, 25 bp, Rattus norvegicus
gggataccacctcagtttacattca

SEQ ID NO: 452089 - DNA, 25 bp, Rattus norvegicus
gggataccacctgagtttacattca

SEQ ID NO: 452090 - DNA, 25 bp, Rattus norvegicus
gggataccagctatgggtgtgcctc

SEQ ID NO: 452091 - DNA, 25 bp, Rattus norvegicus
gggataccagctttgggtgtgcctc

SEQ ID NO: 452092 - DNA, 25 bp, Rattus norvegicus
gggatacccatgaccatagcccagt

SEQ ID NO: 452093 - DNA, 25 bp, Rattus norvegicus
gggatacccatgtccatagcccagt

SEQ ID NO: 452094 - DNA, 25 bp, Rattus norvegicus
gggataccctaaatctgattcatgt

SEQ ID NO: 452095 - DNA, 25 bp, Rattus norvegicus
gggataccctaattctgattcatgt

SEQ ID NO: 452096 - DNA, 25 bp, Rattus norvegicus
gggataccctctactttagaactag

SEQ ID NO: 452097 - DNA, 25 bp, Rattus norvegicus
gggataccctcttctttagaactag

SEQ ID NO: 452098 - DNA, 25 bp, Rattus norvegicus
gggataccctgcattgcatcaacaa

SEQ ID NO: 452099 - DNA, 25 bp, Rattus norvegicus
gggataccctgctttgcatcaacaa

SEQ ID NO: 452100 - DNA, 25 bp, Rattus norvegicus
gggatacgcataaatgccttcatca

SEQ ID NO: 452101 - DNA, 25 bp, Rattus norvegicus
gggatacgcatatatgccttcatca

SEQ ID NO: 452102 - DNA, 25 bp, Rattus norvegicus
gggatacggacccatcatttctagt

SEQ ID NO: 452103 - DNA, 25 bp, Rattus norvegicus
gggatacggaccgatcatttctagt

SEQ ID NO: 452104 - DNA, 25 bp, Rattus norvegicus
gggatactacaccttcactgacagc

SEQ ID NO: 452105 - DNA, 25 bp, Rattus norvegicus
gggatactacacgttcactgacagc

SEQ ID NO: 452106 - DNA, 25 bp, Rattus norvegicus
gggatactacttactaacaaggtgt

SEQ ID NO: 452107 - DNA, 25 bp, Rattus norvegicus
gggatactactttctaacaaggtgt

SEQ ID NO: 452108 - DNA, 25 bp, Rattus norvegicus
gggatactatctatctttctatttc

SEQ ID NO: 452109 - DNA, 25 bp, Rattus norvegicus
gggatactatctttctttctatttc

SEQ ID NO: 452110 - DNA, 25 bp, Rattus norvegicus
gggatactccatctgggcccaagag

SEQ ID NO: 452111 - DNA, 25 bp, Rattus norvegicus
gggatactccatgtgggcccaagag

SEQ ID NO: 452112 - DNA, 25 bp, Rattus norvegicus
gggatactggacatttttctctgtt

SEQ ID NO: 452113 - DNA, 25 bp, Rattus norvegicus
gggatactggacttttttctctgtt

SEQ ID NO: 452114 - DNA, 25 bp, Rattus norvegicus
gggatactgtggacctctccaagaa

SEQ ID NO: 452115 - DNA, 25 bp, Rattus norvegicus
gggatactgtggtcctctccaagaa

SEQ ID NO: 452116 - DNA, 25 bp, Rattus norvegicus
gggatactgtttacctggctaactt

SEQ ID NO: 452117 - DNA, 25 bp, Rattus norvegicus
gggatactgttttcctggctaactt

SEQ ID NO: 452118 - DNA, 25 bp, Rattus norvegicus
gggatacttctgacctggagataca

SEQ ID NO: 452119 - DNA, 25 bp, Rattus norvegicus
gggatacttctgtcctggagataca

SEQ ID NO: 452120 - DNA, 25 bp, Rattus norvegicus
gggatacttgctattgtaaaccaaa

SEQ ID NO: 452121 - DNA, 25 bp, Rattus norvegicus
gggatacttgcttttgtaaaccaaa

SEQ ID NO: 452122 - DNA, 25 bp, Rattus norvegicus
gggatacttgtaaattaccacttag

SEQ ID NO: 452123 - DNA, 25 bp, Rattus norvegicus
gggatacttgtatattaccacttag

SEQ ID NO: 452124 - DNA, 25 bp, Rattus norvegicus
gggatactttgcctaactcagggtg

SEQ ID NO: 452125 - DNA, 25 bp, Rattus norvegicus
gggatactttgcgtaactcagggtg

SEQ ID NO: 452126 - DNA, 25 bp, Rattus norvegicus
gggatagacctaaggcttcagtcaa

SEQ ID NO: 452127 - DNA, 25 bp, Rattus norvegicus
gggatagacctatggcttcagtcaa

SEQ ID NO: 452128 - DNA, 25 bp, Rattus norvegicus
gggatagacgccatagatacctcat

SEQ ID NO: 452129 - DNA, 25 bp, Rattus norvegicus
gggatagacgccttagatacctcat

SEQ ID NO: 452130 - DNA, 25 bp, Rattus norvegicus
gggatagacttgcattcttacagta

SEQ ID NO: 452131 - DNA, 25 bp, Rattus norvegicus
gggatagacttggattcttacagta

SEQ ID NO: 452132 - DNA, 25 bp, Rattus norvegicus
gggatagatttcaaggtcctcttca

SEQ ID NO: 452133 - DNA, 25 bp, Rattus norvegicus
gggatagatttctaggtcctcttca

SEQ ID NO: 452134 - DNA, 25 bp, Rattus norvegicus
gggatagcacctctttgaacaagga

SEQ ID NO: 452135 - DNA, 25 bp, Rattus norvegicus
gggatagcacctgtttgaacaagga

SEQ ID NO: 452136 - DNA, 25 bp, Rattus norvegicus
gggatagcactgaacatcaatacct

SEQ ID NO: 452137 - DNA, 25 bp, Rattus norvegicus
gggatagcactgtacatcaatacct

SEQ ID NO: 452138 - DNA, 25 bp, Rattus norvegicus
gggatagcagcaacctcatagctgt

SEQ ID NO: 452139 - DNA, 25 bp, Rattus norvegicus
gggatagcagcatcctcatagctgt

SEQ ID NO: 452140 - DNA, 25 bp, Rattus norvegicus
gggatagcagttatccatttttcta

SEQ ID NO: 452141 - DNA, 25 bp, Rattus norvegicus
gggatagcagttttccatttttcta

SEQ ID NO: 452142 - DNA, 25 bp, Rattus norvegicus
gggatagccagtacaccattgtgtt

SEQ ID NO: 452143 - DNA, 25 bp, Rattus norvegicus
gggatagccagttcaccattgtgtt

SEQ ID NO: 452144 - DNA, 25 bp, Rattus norvegicus
gggatagcctggcagacatcatcaa

SEQ ID NO: 452145 - DNA, 25 bp, Rattus norvegicus
gggatagcctgggagacatcatcaa

SEQ ID NO: 452146 - DNA, 25 bp, Rattus norvegicus
gggataggatcaaacctctccactt

SEQ ID NO: 452147 - DNA, 25 bp, Rattus norvegicus
gggataggatcatacctctccactt

SEQ ID NO: 452148 - DNA, 25 bp, Rattus norvegicus
gggatagtaacacccaagccacatc

SEQ ID NO: 452149 - DNA, 25 bp, Rattus norvegicus
gggatagtaacagccaagccacatc

SEQ ID NO: 452150 - DNA, 25 bp, Rattus norvegicus
gggatagtccatcatctggggctaa

SEQ ID NO: 452151 - DNA, 25 bp, Rattus norvegicus
gggatagtccatgatctggggctaa

SEQ ID NO: 452152 - DNA, 25 bp, Rattus norvegicus
gggatagtcctaccactgtatttta

SEQ ID NO: 452153 - DNA, 25 bp, Rattus norvegicus
gggatagtcctagcactgtatttta

SEQ ID NO: 452154 - DNA, 25 bp, Rattus norvegicus
gggatagtctgtctccagacccatg

SEQ ID NO: 452155 - DNA, 25 bp, Rattus norvegicus
gggatagtctgtgtccagacccatg

SEQ ID NO: 452156 - DNA, 25 bp, Rattus norvegicus
gggatagtgtctcctccacttatgg

SEQ ID NO: 452157 - DNA, 25 bp, Rattus norvegicus
gggatagtgtctgctccacttatgg

SEQ ID NO: 452158 - DNA, 25 bp, Rattus norvegicus
gggatatacccgatcacgcaaagtg

SEQ ID NO: 452159 - DNA, 25 bp, Rattus norvegicus
gggatatacccgttcacgcaaagtg

SEQ ID NO: 452160 - DNA, 25 bp, Rattus norvegicus
gggatatactgtatctttgtaatca

SEQ ID NO: 452161 - DNA, 25 bp, Rattus norvegicus
gggatatactgtttctttgtaatca

SEQ ID NO: 452162 - DNA, 25 bp, Rattus norvegicus
gggatatagtcaactactttgtaat

SEQ ID NO: 452163 - DNA, 25 bp, Rattus norvegicus
gggatatagtcatctactttgtaat

SEQ ID NO: 452164 - DNA, 25 bp, Rattus norvegicus
gggatatcaatgaggcctgccaaat

SEQ ID NO: 452165 - DNA, 25 bp, Rattus norvegicus
gggatatcaatgtggcctgccaaat

SEQ ID NO: 452166 - DNA, 25 bp, Rattus norvegicus
gggatatcacagctacactttgaac

SEQ ID NO: 452167 - DNA, 25 bp, Rattus norvegicus
gggatatcacaggtacactttgaac

SEQ ID NO: 452168 - DNA, 25 bp, Rattus norvegicus
gggatatcacccaaatgcagcacaa

SEQ ID NO: 452169 - DNA, 25 bp, Rattus norvegicus
gggatatcaccctaatgcagcacaa

SEQ ID NO: 452170 - DNA, 25 bp, Rattus norvegicus
gggatatcaggccacccgtgcttga

SEQ ID NO: 452171 - DNA, 25 bp, Rattus norvegicus
gggatatcaggcgacccgtgcttga

SEQ ID NO: 452172 - DNA, 25 bp, Rattus norvegicus
gggatatcccatcagtggagactgc

SEQ ID NO: 452173 - DNA, 25 bp, Rattus norvegicus
gggatatcccatgagtggagactgc

SEQ ID NO: 452174 - DNA, 25 bp, Rattus norvegicus
gggatatcctttaaggttcgaatat

SEQ ID NO: 452175 - DNA, 25 bp, Rattus norvegicus
gggatatccttttaggttcgaatat

SEQ ID NO: 452176 - DNA, 25 bp, Rattus norvegicus
gggatatcggatatgtgcctgtctc

SEQ ID NO: 452177 - DNA, 25 bp, Rattus norvegicus
gggatatcggatttgtgcctgtctc

SEQ ID NO: 452178 - DNA, 25 bp, Rattus norvegicus
gggatatcgtatcgaaacctatttc

SEQ ID NO: 452179 - DNA, 25 bp, Rattus norvegicus
gggatatcgtatggaaacctatttc

SEQ ID NO: 452180 - DNA, 25 bp, Rattus norvegicus
gggatatctccacagctgagacaat

SEQ ID NO: 452181 - DNA, 25 bp, Rattus norvegicus
gggatatctccagagctgagacaat

SEQ ID NO: 452182 - DNA, 25 bp, Rattus norvegicus
gggatatctctcagaagctgggtac

SEQ ID NO: 452183 - DNA, 25 bp, Rattus norvegicus
gggatatctctctgaagctgggtac

SEQ ID NO: 452184 - DNA, 25 bp, Rattus norvegicus
gggatatctgccatccccgtgtgtg

SEQ ID NO: 452185 - DNA, 25 bp, Rattus norvegicus
gggatatctgccttccccgtgtgtg

SEQ ID NO: 452186 - DNA, 25 bp, Rattus norvegicus
gggatatctttactcagcacgtgtt

SEQ ID NO: 452187 - DNA, 25 bp, Rattus norvegicus
gggatatctttagtcagcacgtgtt

SEQ ID NO: 452188 - DNA, 25 bp, Rattus norvegicus
gggatatgacatactggcgtcctga

SEQ ID NO: 452189 - DNA, 25 bp, Rattus norvegicus
gggatatgacattctggcgtcctga

SEQ ID NO: 452190 - DNA, 25 bp, Rattus norvegicus
gggatatgggcaactccccaacaat

SEQ ID NO: 452191 - DNA, 25 bp, Rattus norvegicus
gggatatgggcatctccccaacaat

SEQ ID NO: 452192 - DNA, 25 bp, Rattus norvegicus
gggatatgggccacaaagctgtaca

SEQ ID NO: 452193 - DNA, 25 bp, Rattus norvegicus
gggatatgggcctcaaagctgtaca

SEQ ID NO: 452194 - DNA, 25 bp, Rattus norvegicus
gggatatgtactacctacagccaag

SEQ ID NO: 452195 - DNA, 25 bp, Rattus norvegicus
gggatatgtacttcctacagccaag

SEQ ID NO: 452196 - DNA, 25 bp, Rattus norvegicus
gggatatgtcacaaccgtatggttc

SEQ ID NO: 452197 - DNA, 25 bp, Rattus norvegicus
gggatatgtcactaccgtatggttc

SEQ ID NO: 452198 - DNA, 25 bp, Rattus norvegicus
gggatatgttgtcacttaaaacttg

SEQ ID NO: 452199 - DNA, 25 bp, Rattus norvegicus
gggatatgttgtgacttaaaacttg

SEQ ID NO: 452200 - DNA, 25 bp, Rattus norvegicus
gggatattacagattgctgccacaa

SEQ ID NO: 452201 - DNA, 25 bp, Rattus norvegicus
gggatattacagtttgctgccacaa

SEQ ID NO: 452202 - DNA, 25 bp, Rattus norvegicus
gggatattctacctcctaatgggtg

SEQ ID NO: 452203 - DNA, 25 bp, Rattus norvegicus
gggatattctacgtcctaatgggtg

SEQ ID NO: 452204 - DNA, 25 bp, Rattus norvegicus
gggatatttactagtctgatttcat

SEQ ID NO: 452205 - DNA, 25 bp, Rattus norvegicus
gggatatttacttgtctgatttcat

SEQ ID NO: 452206 - DNA, 25 bp, Rattus norvegicus
gggatatttccaccttgattcatta

SEQ ID NO: 452207 - DNA, 25 bp, Rattus norvegicus
gggatatttccagcttgattcatta

SEQ ID NO: 452208 - DNA, 25 bp, Rattus norvegicus
gggatatttgccagagtgttttatt

SEQ ID NO: 452209 - DNA, 25 bp, Rattus norvegicus
gggatatttgcccacttttaaaatg

SEQ ID NO: 452210 - DNA, 25 bp, Rattus norvegicus
gggatatttgccgacttttaaaatg

SEQ ID NO: 452211 - DNA, 25 bp, Rattus norvegicus
gggatatttgcctgagtgttttatt

SEQ ID NO: 452212 - DNA, 25 bp, Rattus norvegicus
gggatatttgctctgacccctggaa

SEQ ID NO: 452213 - DNA, 25 bp, Rattus norvegicus
gggatatttgctgtgacccctggaa

SEQ ID NO: 452214 - DNA, 25 bp, Rattus norvegicus
gggatcaaaacaaggtcaaagtcct

SEQ ID NO: 452215 - DNA, 25 bp, Rattus norvegicus
gggatcaaaacatggtcaaagtcct

SEQ ID NO: 452216 - DNA, 25 bp, Rattus norvegicus
gggatcaaaataccaagaggccatt

SEQ ID NO: 452217 - DNA, 25 bp, Rattus norvegicus
gggatcaaaatagcaagaggccatt

SEQ ID NO: 452218 - DNA, 25 bp, Rattus norvegicus
gggatcaaagtcaagttgtcggctt

SEQ ID NO: 452219 - DNA, 25 bp, Rattus norvegicus
gggatcaaagtctagttgtcggctt

SEQ ID NO: 452220 - DNA, 25 bp, Rattus norvegicus
gggatcaaatccatgagacactggg

SEQ ID NO: 452221 - DNA, 25 bp, Rattus norvegicus
gggatcaaatccttgagacactggg

SEQ ID NO: 452222 - DNA, 25 bp, Rattus norvegicus
gggatcaaatgcatggtgtcagttt

SEQ ID NO: 452223 - DNA, 25 bp, Rattus norvegicus
gggatcaaatgcttggtgtcagttt

SEQ ID NO: 452224 - DNA, 25 bp, Rattus norvegicus
gggatcaaattgcacctgtccctaa

SEQ ID NO: 452225 - DNA, 25 bp, Rattus norvegicus
gggatcaaattggacctgtccctaa

SEQ ID NO: 452226 - DNA, 25 bp, Rattus norvegicus
gggatcaaatttagggtctctcaca

SEQ ID NO: 452227 - DNA, 25 bp, Rattus norvegicus
gggatcaaattttgggtctctcaca

SEQ ID NO: 452228 - DNA, 25 bp, Rattus norvegicus
gggatcaacctcataaaattctttt

SEQ ID NO: 452229 - DNA, 25 bp, Rattus norvegicus
gggatcaacctcttaaaattctttt

SEQ ID NO: 452230 - DNA, 25 bp, Rattus norvegicus
gggatcaactacatcatgagcaacg

SEQ ID NO: 452231 - DNA, 25 bp, Rattus norvegicus
gggatcaactacttcatgagcaacg

SEQ ID NO: 452232 - DNA, 25 bp, Rattus norvegicus
gggatcaactctcaaatgtaaggca

SEQ ID NO: 452233 - DNA, 25 bp, Rattus norvegicus
gggatcaactctgaaatgtaaggca

SEQ ID NO: 452234 - DNA, 25 bp, Rattus norvegicus
gggatcaagcctctagcttttcaag

SEQ ID NO: 452235 - DNA, 25 bp, Rattus norvegicus
gggatcaagcctgtagcttttcaag

SEQ ID NO: 452236 - DNA, 25 bp, Rattus norvegicus
gggatcaagctcataatacaggacc

SEQ ID NO: 452237 - DNA, 25 bp, Rattus norvegicus
gggatcaagctcttaatacaggacc

SEQ ID NO: 452238 - DNA, 25 bp, Rattus norvegicus
gggatcaagcttcgtggctttttat

SEQ ID NO: 452239 - DNA, 25 bp, Rattus norvegicus
gggatcaagcttggtggctttttat

SEQ ID NO: 452240 - DNA, 25 bp, Rattus norvegicus
gggatcaatacacagtaccacaaag

SEQ ID NO: 452241 - DNA, 25 bp, Rattus norvegicus
gggatcaatacagagtaccacaaag

SEQ ID NO: 452242 - DNA, 25 bp, Rattus norvegicus
gggatcaataccacacacagactag

SEQ ID NO: 452243 - DNA, 25 bp, Rattus norvegicus
gggatcaatacctcacacagactag

SEQ ID NO: 452244 - DNA, 25 bp, Rattus norvegicus
gggatcaatcccatctgtttgttac

SEQ ID NO: 452245 - DNA, 25 bp, Rattus norvegicus
gggatcaatcccttctgtttgttac

SEQ ID NO: 452246 - DNA, 25 bp, Rattus norvegicus
gggatcaatctcaagttcatgcata

SEQ ID NO: 452247 - DNA, 25 bp, Rattus norvegicus
gggatcaatctctagttcatgcata

SEQ ID NO: 452248 - DNA, 25 bp, Rattus norvegicus
gggatcacaaaaaggtcctgctgtt

SEQ ID NO: 452249 - DNA, 25 bp, Rattus norvegicus
gggatcacaaaatggtcctgctgtt

SEQ ID NO: 452250 - DNA, 25 bp, Rattus norvegicus
gggatcacaactccagctcatgaat

SEQ ID NO: 452251 - DNA, 25 bp, Rattus norvegicus
gggatcacaactgcagctcatgaat

SEQ ID NO: 452252 - DNA, 25 bp, Rattus norvegicus
gggatcacaccacgaactcgaataa

SEQ ID NO: 452253 - DNA, 25 bp, Rattus norvegicus
gggatcacaccaggaactcgaataa

SEQ ID NO: 452254 - DNA, 25 bp, Rattus norvegicus
gggatcacagtcattcagctagcat

SEQ ID NO: 452255 - DNA, 25 bp, Rattus norvegicus
gggatcacagtccatgcttctgatg

SEQ ID NO: 452256 - DNA, 25 bp, Rattus norvegicus
gggatcacagtcgatgcttctgatg

SEQ ID NO: 452257 - DNA, 25 bp, Rattus norvegicus
gggatcacagtctttcagctagcat

SEQ ID NO: 452258 - DNA, 25 bp, Rattus norvegicus
gggatcaccgatctttgccgagaaa

SEQ ID NO: 452259 - DNA, 25 bp, Rattus norvegicus
gggatcaccgatgtttgccgagaaa

SEQ ID NO: 452260 - DNA, 25 bp, Rattus norvegicus
gggatcacctaaagcgagaagtcag

SEQ ID NO: 452261 - DNA, 25 bp, Rattus norvegicus
gggatcacctaatgcgagaagtcag

SEQ ID NO: 452262 - DNA, 25 bp, Rattus norvegicus
gggatcacctatcgcttatttatac

SEQ ID NO: 452263 - DNA, 25 bp, Rattus norvegicus
gggatcacctatggcttatttatac

SEQ ID NO: 452264 - DNA, 25 bp, Rattus norvegicus
gggatcacggctctactgaatgtct

SEQ ID NO: 452265 - DNA, 25 bp, Rattus norvegicus
gggatcacggctgtactgaatgtct

SEQ ID NO: 452266 - DNA, 25 bp, Rattus norvegicus
gggatcacgtacaatgaagattcaa

SEQ ID NO: 452267 - DNA, 25 bp, Rattus norvegicus
gggatcacgtactatgaagattcaa

SEQ ID NO: 452268 - DNA, 25 bp, Rattus norvegicus
gggatcacgttgactccgagccagg

SEQ ID NO: 452269 - DNA, 25 bp, Rattus norvegicus
gggatcacgttgtctccgagccagg

SEQ ID NO: 452270 - DNA, 25 bp, Rattus norvegicus
gggatcactcctcaaaagtgttctc

SEQ ID NO: 452271 - DNA, 25 bp, Rattus norvegicus
gggatcactcctgaaaagtgttctc

SEQ ID NO: 452272 - DNA, 25 bp, Rattus norvegicus
gggatcactgtcacaaaaaggtgac

SEQ ID NO: 452273 - DNA, 25 bp, Rattus norvegicus
gggatcactgtctcaaaaaggtgac

SEQ ID NO: 452274 - DNA, 25 bp, Rattus norvegicus
gggatcactgtgcatgcatctctga

SEQ ID NO: 452275 - DNA, 25 bp, Rattus norvegicus
gggatcactgtggatgcatctctga

SEQ ID NO: 452276 - DNA, 25 bp, Rattus norvegicus
gggatcagacaacagcttgcttttt

SEQ ID NO: 452277 - DNA, 25 bp, Rattus norvegicus
gggatcagacaagagcttgcttttt

SEQ ID NO: 452278 - DNA, 25 bp, Rattus norvegicus
gggatcagcacaagtcagtgtccat

SEQ ID NO: 452279 - DNA, 25 bp, Rattus norvegicus
gggatcagcacatgtcagtgtccat

SEQ ID NO: 452280 - DNA, 25 bp, Rattus norvegicus
gggatcagcaggcactaccacactc

SEQ ID NO: 452281 - DNA, 25 bp, Rattus norvegicus
gggatcagcagggactaccacactc

SEQ ID NO: 452282 - DNA, 20 bp, Rattus norvegicus
gggatcagccacaaacgtcg

SEQ ID NO: 452283 - DNA, 20 bp, Rattus norvegicus
gggatcagccccaaacgtcg

SEQ ID NO: 452284 - DNA, 20 bp, Rattus norvegicus
gggatcagccgcaaacgtcg

SEQ ID NO: 452285 - DNA, 20 bp, Rattus norvegicus
gggatcagcctcaaacgtcg

SEQ ID NO: 452286 - DNA, 25 bp, Rattus norvegicus
gggatcaggaagatctcagtttttt

SEQ ID NO: 452287 - DNA, 25 bp, Rattus norvegicus
gggatcaggaagttctcagtttttt

SEQ ID NO: 452288 - DNA, 25 bp, Rattus norvegicus
gggatcaggccaattatggtaactt

SEQ ID NO: 452289 - DNA, 25 bp, Rattus norvegicus
gggatcaggccacccaccccttcga

SEQ ID NO: 452290 - DNA, 25 bp, Rattus norvegicus
gggatcaggccagccaccccttcga

SEQ ID NO: 452291 - DNA, 25 bp, Rattus norvegicus
gggatcaggccatttatggtaactt

SEQ ID NO: 452292 - DNA, 25 bp, Rattus norvegicus
gggatcagtgaaaggactacgctaa

SEQ ID NO: 452293 - DNA, 25 bp, Rattus norvegicus
gggatcagtgaatggactacgctaa

SEQ ID NO: 452294 - DNA, 25 bp, Rattus norvegicus
gggatcataagcacacaccactaac

SEQ ID NO: 452295 - DNA, 25 bp, Rattus norvegicus
gggatcataagctcacaccactaac

SEQ ID NO: 452296 - DNA, 25 bp, Rattus norvegicus
gggatcatcctaaagctggtttctc

SEQ ID NO: 452297 - DNA, 25 bp, Rattus norvegicus
gggatcatcctatagctggtttctc

SEQ ID NO: 452298 - DNA, 25 bp, Rattus norvegicus
gggatcatctgaccagtgcacccat

SEQ ID NO: 452299 - DNA, 25 bp, Rattus norvegicus
gggatcatctgagcagtgcacccat

SEQ ID NO: 452300 - DNA, 25 bp, Rattus norvegicus
gggatcatgggtatatctagactga

SEQ ID NO: 452301 - DNA, 25 bp, Rattus norvegicus
gggatcatgggtttatctagactga

SEQ ID NO: 452302 - DNA, 25 bp, Rattus norvegicus
gggatcattcatagcagccacagct

SEQ ID NO: 452303 - DNA, 25 bp, Rattus norvegicus
gggatcattcattgcagccacagct

SEQ ID NO: 452304 - DNA, 25 bp, Rattus norvegicus
gggatcattgatcccctaactggga

SEQ ID NO: 452305 - DNA, 25 bp, Rattus norvegicus
gggatcattgatgccctaactggga

SEQ ID NO: 452306 - DNA, 25 bp, Rattus norvegicus
gggatcatttaaagatcgcggaatg

SEQ ID NO: 452307 - DNA, 25 bp, Rattus norvegicus
gggatcatttaatgatcgcggaatg

SEQ ID NO: 452308 - DNA, 25 bp, Rattus norvegicus
gggatccaaatcctttttctgacct

SEQ ID NO: 452309 - DNA, 25 bp, Rattus norvegicus
gggatccaaatcgtttttctgacct

SEQ ID NO: 452310 - DNA, 25 bp, Rattus norvegicus
gggatccaacacaaagtctactcat

SEQ ID NO: 452311 - DNA, 25 bp, Rattus norvegicus
gggatccaacactaagtctactcat

SEQ ID NO: 452312 - DNA, 25 bp, Rattus norvegicus
gggatccaacatcctctactggtct

SEQ ID NO: 452313 - DNA, 25 bp, Rattus norvegicus
gggatccaacatgctctactggtct

SEQ ID NO: 452314 - DNA, 25 bp, Rattus norvegicus
gggatccaagtacgtttcatagaaa

SEQ ID NO: 452315 - DNA, 25 bp, Rattus norvegicus
gggatccaagtaggtttcatagaaa

SEQ ID NO: 452316 - DNA, 25 bp, Rattus norvegicus
gggatccaagtgctggttcccacca

SEQ ID NO: 452317 - DNA, 25 bp, Rattus norvegicus
gggatccaagtggtggttcccacca

SEQ ID NO: 452318 - DNA, 25 bp, Rattus norvegicus
gggatccaattcaacgagcggttgc

SEQ ID NO: 452319 - DNA, 25 bp, Rattus norvegicus
gggatccaattctacgagcggttgc

SEQ ID NO: 452320 - DNA, 25 bp, Rattus norvegicus
gggatccaccgacttgtttcaagct

SEQ ID NO: 452321 - DNA, 25 bp, Rattus norvegicus
gggatccaccgagttgtttcaagct

SEQ ID NO: 452322 - DNA, 25 bp, Rattus norvegicus
gggatccactctagatacaaccgta

SEQ ID NO: 452323 - DNA, 25 bp, Rattus norvegicus
gggatccactcttgatacaaccgta

SEQ ID NO: 452324 - DNA, 25 bp, Rattus norvegicus
gggatccacttcaaagcactacggg

SEQ ID NO: 452325 - DNA, 25 bp, Rattus norvegicus
gggatccacttctaagcactacggg

SEQ ID NO: 452326 - DNA, 25 bp, Rattus norvegicus
gggatccagaagcaacttcgattct

SEQ ID NO: 452327 - DNA, 25 bp, Rattus norvegicus
gggatccagaaggaacttcgattct

SEQ ID NO: 452328 - DNA, 25 bp, Rattus norvegicus
gggatccagagtaacaccatttaat

SEQ ID NO: 452329 - DNA, 25 bp, Rattus norvegicus
gggatccagagtccgtcaccctcta

SEQ ID NO: 452330 - DNA, 25 bp, Rattus norvegicus
gggatccagagtgcgtcaccctcta

SEQ ID NO: 452331 - DNA, 25 bp, Rattus norvegicus
gggatccagagttacaccatttaat

SEQ ID NO: 452332 - DNA, 25 bp, Rattus norvegicus
gggatccagcaactcaaaacctagg

SEQ ID NO: 452333 - DNA, 25 bp, Rattus norvegicus
gggatccagcaagtcaaaacctagg

SEQ ID NO: 452334 - DNA, 25 bp, Rattus norvegicus
gggatccagccaacacttcttcatt

SEQ ID NO: 452335 - DNA, 25 bp, Rattus norvegicus
gggatccagccatcacttcttcatt

SEQ ID NO: 452336 - DNA, 25 bp, Rattus norvegicus
gggatccagcctctgtgtatgcaaa

SEQ ID NO: 452337 - DNA, 25 bp, Rattus norvegicus
gggatccagcctgtgtgtatgcaaa

SEQ ID NO: 452338 - DNA, 25 bp, Rattus norvegicus
gggatccagcgcaacctgagtacat

SEQ ID NO: 452339 - DNA, 25 bp, Rattus norvegicus
gggatccagcgctacctgagtacat

SEQ ID NO: 452340 - DNA, 25 bp, Rattus norvegicus
gggatccagcttatcagagagtcaa

SEQ ID NO: 452341 - DNA, 25 bp, Rattus norvegicus
gggatccagcttttcagagagtcaa

SEQ ID NO: 452342 - DNA, 25 bp, Rattus norvegicus
gggatccaggatattaaatgtgcat

SEQ ID NO: 452343 - DNA, 25 bp, Rattus norvegicus
gggatccaggattttaaatgtgcat

SEQ ID NO: 452344 - DNA, 25 bp, Rattus norvegicus
gggatccagtgaccaagcagttaag

SEQ ID NO: 452345 - DNA, 25 bp, Rattus norvegicus
gggatccagtgagcaagcagttaag

SEQ ID NO: 452346 - DNA, 25 bp, Rattus norvegicus
gggatccatctcaaaggtgacttgc

SEQ ID NO: 452347 - DNA, 25 bp, Rattus norvegicus
gggatccatctctaaggtgacttgc

SEQ ID NO: 452348 - DNA, 25 bp, Rattus norvegicus
gggatccatgaccatcttcctcttg

SEQ ID NO: 452349 - DNA, 25 bp, Rattus norvegicus
gggatccatgacgatcttcctcttg

SEQ ID NO: 452350 - DNA, 25 bp, Rattus norvegicus
gggatccatgatccaaactccatta

SEQ ID NO: 452351 - DNA, 25 bp, Rattus norvegicus
gggatccatgatgcaaactccatta

SEQ ID NO: 452352 - DNA, 25 bp, Rattus norvegicus
gggatccatgcgcactgagtcaatc

SEQ ID NO: 452353 - DNA, 25 bp, Rattus norvegicus
gggatccatgcggactgagtcaatc

SEQ ID NO: 452354 - DNA, 25 bp, Rattus norvegicus
gggatccattttctaaagttcatgt

SEQ ID NO: 452355 - DNA, 25 bp, Rattus norvegicus
gggatccattttgtaaagttcatgt

SEQ ID NO: 452356 - DNA, 25 bp, Rattus norvegicus
gggatcccaaatcagacccttgtct

SEQ ID NO: 452357 - DNA, 25 bp, Rattus norvegicus
gggatcccaaatgagacccttgtct

SEQ ID NO: 452358 - DNA, 25 bp, Rattus norvegicus
gggatcccacagcaggtccagagaa

SEQ ID NO: 452359 - DNA, 25 bp, Rattus norvegicus
gggatcccacaggaggtccagagaa

SEQ ID NO: 452360 - DNA, 25 bp, Rattus norvegicus
gggatccccacaccctagagatggt

SEQ ID NO: 452361 - DNA, 25 bp, Rattus norvegicus
gggatccccacagcctagagatggt

SEQ ID NO: 452362 - DNA, 25 bp, Rattus norvegicus
gggatccccattcgagcaaagccta

SEQ ID NO: 452363 - DNA, 25 bp, Rattus norvegicus
gggatccccattggagcaaagccta

SEQ ID NO: 452364 - DNA, 25 bp, Rattus norvegicus
gggatccccgacataacaggatgag

SEQ ID NO: 452365 - DNA, 25 bp, Rattus norvegicus
gggatccccgacttaacaggatgag

SEQ ID NO: 452366 - DNA, 25 bp, Rattus norvegicus
gggatccccgagagcaaatacacaa

SEQ ID NO: 452367 - DNA, 25 bp, Rattus norvegicus
gggatccccgagtgcaaatacacaa

SEQ ID NO: 452368 - DNA, 25 bp, Rattus norvegicus
gggatccccgggaacaatcttgcct

SEQ ID NO: 452369 - DNA, 25 bp, Rattus norvegicus
gggatccccgggtacaatcttgcct

SEQ ID NO: 452370 - DNA, 25 bp, Rattus norvegicus
gggatcccctaccataaaggcaatg

SEQ ID NO: 452371 - DNA, 25 bp, Rattus norvegicus
gggatcccctacgataaaggcaatg

SEQ ID NO: 452372 - DNA, 25 bp, Rattus norvegicus
gggatccctacaaattcgagaccag

SEQ ID NO: 452373 - DNA, 25 bp, Rattus norvegicus
gggatccctacatattcgagaccag

SEQ ID NO: 452374 - DNA, 25 bp, Rattus norvegicus
gggatccctcctattaagcagctgt

SEQ ID NO: 452375 - DNA, 25 bp, Rattus norvegicus
gggatccctccttttaagcagctgt

SEQ ID NO: 452376 - DNA, 25 bp, Rattus norvegicus
gggatccctgatacatcatatctat

SEQ ID NO: 452377 - DNA, 25 bp, Rattus norvegicus
gggatccctgattcatcatatctat

SEQ ID NO: 452378 - DNA, 25 bp, Rattus norvegicus
gggatcccttccaattgtataagtt

SEQ ID NO: 452379 - DNA, 25 bp, Rattus norvegicus
gggatcccttcctattgtataagtt

SEQ ID NO: 452380 - DNA, 25 bp, Rattus norvegicus
gggatccgacatctgccagatgaaa

SEQ ID NO: 452381 - DNA, 25 bp, Rattus norvegicus
gggatccgacatgtgccagatgaaa

SEQ ID NO: 452382 - DNA, 25 bp, Rattus norvegicus
gggatccgagtcaaccatcctgcat

SEQ ID NO: 452383 - DNA, 25 bp, Rattus norvegicus
gggatccgagtctaccatcctgcat

SEQ ID NO: 452384 - DNA, 25 bp, Rattus norvegicus
gggatcctaaagcattgggttgcaa

SEQ ID NO: 452385 - DNA, 25 bp, Rattus norvegicus
gggatcctaaaggattgggttgcaa

SEQ ID NO: 452386 - DNA, 25 bp, Rattus norvegicus
gggatcctaaccatcatgagaaata

SEQ ID NO: 452387 - DNA, 25 bp, Rattus norvegicus
gggatcctaaccttcatgagaaata

SEQ ID NO: 452388 - DNA, 25 bp, Rattus norvegicus
gggatcctatttcttctttagctat

SEQ ID NO: 452389 - DNA, 25 bp, Rattus norvegicus
gggatcctatttgttctttagctat

SEQ ID NO: 452390 - DNA, 25 bp, Rattus norvegicus
gggatcctcagcaatgtcaataaac

SEQ ID NO: 452391 - DNA, 25 bp, Rattus norvegicus
gggatcctcagccacagaccgtgga

SEQ ID NO: 452392 - DNA, 25 bp, Rattus norvegicus
gggatcctcagcgacagaccgtgga

SEQ ID NO: 452393 - DNA, 25 bp, Rattus norvegicus
gggatcctcagctatgtcaataaac

SEQ ID NO: 452394 - DNA, 25 bp, Rattus norvegicus
gggatcctccaactctgaggttgtt

SEQ ID NO: 452395 - DNA, 25 bp, Rattus norvegicus
gggatcctccaagtctgaggttgtt

SEQ ID NO: 452396 - DNA, 25 bp, Rattus norvegicus
gggatcctcctcagcccaaatgtgt

SEQ ID NO: 452397 - DNA, 25 bp, Rattus norvegicus
gggatcctcctctgcccaaatgtgt

SEQ ID NO: 452398 - DNA, 25 bp, Rattus norvegicus
gggatcctgactccttgaagccaag

SEQ ID NO: 452399 - DNA, 25 bp, Rattus norvegicus
gggatcctgactgcttgaagccaag

SEQ ID NO: 452400 - DNA, 25 bp, Rattus norvegicus
gggatcctgagaacacacacaattt

SEQ ID NO: 452401 - DNA, 25 bp, Rattus norvegicus
gggatcctgagatcacacacaattt

SEQ ID NO: 452402 - DNA, 25 bp, Rattus norvegicus
gggatcctgagtaaaatacccagca

SEQ ID NO: 452403 - DNA, 25 bp, Rattus norvegicus
gggatcctgagttaaatacccagca

SEQ ID NO: 452404 - DNA, 25 bp, Rattus norvegicus
gggatcctgcaactctcaagagtag

SEQ ID NO: 452405 - DNA, 25 bp, Rattus norvegicus
gggatcctgcaagtctcaagagtag

SEQ ID NO: 452406 - DNA, 25 bp, Rattus norvegicus
gggatcctggaaagtctggtgctta

SEQ ID NO: 452407 - DNA, 25 bp, Rattus norvegicus
gggatcctggaatgtctggtgctta

SEQ ID NO: 452408 - DNA, 25 bp, Rattus norvegicus
gggatcctggagaattctctgcctt

SEQ ID NO: 452409 - DNA, 25 bp, Rattus norvegicus
gggatcctggagtattctctgcctt

SEQ ID NO: 452410 - DNA, 25 bp, Rattus norvegicus
gggatcctggccagtaacttataaa

SEQ ID NO: 452411 - DNA, 25 bp, Rattus norvegicus
gggatcctggcctgtaacttataaa

SEQ ID NO: 452412 - DNA, 25 bp, Rattus norvegicus
gggatcctgtccacacaactgaggt

SEQ ID NO: 452413 - DNA, 25 bp, Rattus norvegicus
gggatcctgtcctcacaactgaggt

SEQ ID NO: 452414 - DNA, 25 bp, Rattus norvegicus
gggatcctgttcacttcaaactgtg

SEQ ID NO: 452415 - DNA, 25 bp, Rattus norvegicus
gggatcctgttctcttcaaactgtg

SEQ ID NO: 452416 - DNA, 25 bp, Rattus norvegicus
gggatccttttcaatagtatcttca

SEQ ID NO: 452417 - DNA, 25 bp, Rattus norvegicus
gggatccttttctatagtatcttca

SEQ ID NO: 452418 - DNA, 25 bp, Rattus norvegicus
gggatcgaagcaatgaacctcatat

SEQ ID NO: 452419 - DNA, 25 bp, Rattus norvegicus
gggatcgaagcattgaacctcatat

SEQ ID NO: 452420 - DNA, 25 bp, Rattus norvegicus
gggatcgacaagcacttccaggact

SEQ ID NO: 452421 - DNA, 25 bp, Rattus norvegicus
gggatcgacaaggacttccaggact

SEQ ID NO: 452422 - DNA, 25 bp, Rattus norvegicus
gggatcgagatgagctgtaaaaact

SEQ ID NO: 452423 - DNA, 25 bp, Rattus norvegicus
gggatcgagatgtgctgtaaaaact

SEQ ID NO: 452424 - DNA, 25 bp, Rattus norvegicus
gggatcgccagtcgaagttcataat

SEQ ID NO: 452425 - DNA, 25 bp, Rattus norvegicus
gggatcgccagtggaagttcataat

SEQ ID NO: 452426 - DNA, 25 bp, Rattus norvegicus
gggatcgcccatattccagagaggt

SEQ ID NO: 452427 - DNA, 25 bp, Rattus norvegicus
gggatcgcccattttccagagaggt

SEQ ID NO: 452428 - DNA, 25 bp, Rattus norvegicus
gggatcggcattcagaatatccatt

SEQ ID NO: 452429 - DNA, 25 bp, Rattus norvegicus
gggatcggcattgagaatatccatt

SEQ ID NO: 452430 - DNA, 25 bp, Rattus norvegicus
gggatcgggtttacagcattcctgt

SEQ ID NO: 452431 - DNA, 25 bp, Rattus norvegicus
gggatcgggttttcagcattcctgt

SEQ ID NO: 452432 - DNA, 25 bp, Rattus norvegicus
gggatcgtcacaacgagcgtgccgc

SEQ ID NO: 452433 - DNA, 25 bp, Rattus norvegicus
gggatcgtcacatcgagcgtgccgc

SEQ ID NO: 452434 - DNA, 25 bp, Rattus norvegicus
gggatcgttgtgcacaaaccgcctt

SEQ ID NO: 452435 - DNA, 25 bp, Rattus norvegicus
gggatcgttgtggacaaaccgcctt

SEQ ID NO: 452436 - DNA, 25 bp, Rattus norvegicus
gggatcgtttccattctaagggaca

SEQ ID NO: 452437 - DNA, 25 bp, Rattus norvegicus
gggatcgtttcctttctaagggaca

SEQ ID NO: 452438 - DNA, 25 bp, Rattus norvegicus
gggatcgttttgagaggtctctcta

SEQ ID NO: 452439 - DNA, 25 bp, Rattus norvegicus
gggatcgttttgtgaggtctctcta

SEQ ID NO: 452440 - DNA, 25 bp, Rattus norvegicus
gggatctaatgcctctggactatga

SEQ ID NO: 452441 - DNA, 25 bp, Rattus norvegicus
gggatctaatgcgtctggactatga

SEQ ID NO: 452442 - DNA, 25 bp, Rattus norvegicus
gggatctacagtcgccactcagcaa

SEQ ID NO: 452443 - DNA, 25 bp, Rattus norvegicus
gggatctacagtggccactcagcaa

SEQ ID NO: 452444 - DNA, 25 bp, Rattus norvegicus
gggatctaccaactctttcatcaaa

SEQ ID NO: 452445 - DNA, 25 bp, Rattus norvegicus
gggatctaccaagtctttcatcaaa

SEQ ID NO: 452446 - DNA, 25 bp, Rattus norvegicus
gggatctacccacatttatgacatg

SEQ ID NO: 452447 - DNA, 25 bp, Rattus norvegicus
gggatctacccagatttatgacatg

SEQ ID NO: 452448 - DNA, 25 bp, Rattus norvegicus
gggatctaccctagacatctgaaat

SEQ ID NO: 452449 - DNA, 25 bp, Rattus norvegicus
gggatctacccttgacatctgaaat

SEQ ID NO: 452450 - DNA, 25 bp, Rattus norvegicus
gggatctaccttataatttcctttg

SEQ ID NO: 452451 - DNA, 25 bp, Rattus norvegicus
gggatctaccttttaatttcctttg

SEQ ID NO: 452452 - DNA, 25 bp, Rattus norvegicus
gggatctactgtccaaagtgtttta

SEQ ID NO: 452453 - DNA, 25 bp, Rattus norvegicus
gggatctactgtgcaaagtgtttta

SEQ ID NO: 452454 - DNA, 25 bp, Rattus norvegicus
gggatctaggctactatggcctcac

SEQ ID NO: 452455 - DNA, 25 bp, Rattus norvegicus
gggatctaggcttctatggcctcac

SEQ ID NO: 452456 - DNA, 25 bp, Rattus norvegicus
gggatctatccaatactcgactatg

SEQ ID NO: 452457 - DNA, 25 bp, Rattus norvegicus
gggatctatccattactcgactatg

SEQ ID NO: 452458 - DNA, 25 bp, Rattus norvegicus
gggatctatcccagagttctgtctc

SEQ ID NO: 452459 - DNA, 25 bp, Rattus norvegicus
gggatctatccctgagttctgtctc

SEQ ID NO: 452460 - DNA, 25 bp, Rattus norvegicus
gggatctatgaactgtgacacttgt

SEQ ID NO: 452461 - DNA, 25 bp, Rattus norvegicus
gggatctatgaagtgtgacacttgt

SEQ ID NO: 452462 - DNA, 25 bp, Rattus norvegicus
gggatctatttaatttctctgacca

SEQ ID NO: 452463 - DNA, 25 bp, Rattus norvegicus
gggatctatttattttctctgacca

SEQ ID NO: 452464 - DNA, 25 bp, Rattus norvegicus
gggatctatttgaagcttcctcaga

SEQ ID NO: 452465 - DNA, 25 bp, Rattus norvegicus
gggatctatttgtagcttcctcaga

SEQ ID NO: 452466 - DNA, 25 bp, Rattus norvegicus
gggatctcaatgaaggcaagcacct

SEQ ID NO: 452467 - DNA, 25 bp, Rattus norvegicus
gggatctcaatgtaggcaagcacct

SEQ ID NO: 452468 - DNA, 25 bp, Rattus norvegicus
gggatctcacacacaataatcactg

SEQ ID NO: 452469 - DNA, 25 bp, Rattus norvegicus
gggatctcacactcaataatcactg

SEQ ID NO: 452470 - DNA, 25 bp, Rattus norvegicus
gggatctcatgccttctggacccca

SEQ ID NO: 452471 - DNA, 25 bp, Rattus norvegicus
gggatctcatgcgttctggacccca

SEQ ID NO: 452472 - DNA, 25 bp, Rattus norvegicus
gggatctcatttctttaaagctgtt

SEQ ID NO: 452473 - DNA, 25 bp, Rattus norvegicus
gggatctcatttgtttaaagctgtt

SEQ ID NO: 452474 - DNA, 25 bp, Rattus norvegicus
gggatctccatgacttcttagtctg

SEQ ID NO: 452475 - DNA, 25 bp, Rattus norvegicus
gggatctccatgtcttcttagtctg

SEQ ID NO: 452476 - DNA, 25 bp, Rattus norvegicus
gggatctcccaaatttcaggtttca

SEQ ID NO: 452477 - DNA, 25 bp, Rattus norvegicus
gggatctcccaattttcaggtttca

SEQ ID NO: 452478 - DNA, 25 bp, Rattus norvegicus
gggatctcctgcacttcagttgtgc

SEQ ID NO: 452479 - DNA, 25 bp, Rattus norvegicus
gggatctcctgctcttcagttgtgc

SEQ ID NO: 452480 - DNA, 25 bp, Rattus norvegicus
gggatctcgaccaaactttagctta

SEQ ID NO: 452481 - DNA, 25 bp, Rattus norvegicus
gggatctcgacctaactttagctta

SEQ ID NO: 452482 - DNA, 25 bp, Rattus norvegicus
gggatctctactcctgttaggtgaa

SEQ ID NO: 452483 - DNA, 25 bp, Rattus norvegicus
gggatctctactgctgttaggtgaa

SEQ ID NO: 452484 - DNA, 25 bp, Rattus norvegicus
gggatctctcacatatggaggcaac

SEQ ID NO: 452485 - DNA, 25 bp, Rattus norvegicus
gggatctctcacttatggaggcaac

SEQ ID NO: 452486 - DNA, 25 bp, Rattus norvegicus
gggatctctcgtcttctttacaaaa

SEQ ID NO: 452487 - DNA, 25 bp, Rattus norvegicus
gggatctctcgtgttctttacaaaa

SEQ ID NO: 452488 - DNA, 25 bp, Rattus norvegicus
gggatctctgagatcattctagcca

SEQ ID NO: 452489 - DNA, 25 bp, Rattus norvegicus
gggatctctgagttcattctagcca

SEQ ID NO: 452490 - DNA, 25 bp, Rattus norvegicus
gggatctgaaacacccttttgcctt

SEQ ID NO: 452491 - DNA, 25 bp, Rattus norvegicus
gggatctgaaactcccttttgcctt

SEQ ID NO: 452492 - DNA, 25 bp, Rattus norvegicus
gggatctgacaaacctctcttggtg

SEQ ID NO: 452493 - DNA, 25 bp, Rattus norvegicus
gggatctgacaatcctctcttggtg

SEQ ID NO: 452494 - DNA, 25 bp, Rattus norvegicus
gggatctgaccacccttttgagtca

SEQ ID NO: 452495 - DNA, 25 bp, Rattus norvegicus
gggatctgaccagccttttgagtca

SEQ ID NO: 452496 - DNA, 25 bp, Rattus norvegicus
gggatctgagctcgttcctaaatct

SEQ ID NO: 452497 - DNA, 25 bp, Rattus norvegicus
gggatctgagctggttcctaaatct

SEQ ID NO: 452498 - DNA, 25 bp, Rattus norvegicus
gggatctgaggaactcgctcgctgt

SEQ ID NO: 452499 - DNA, 25 bp, Rattus norvegicus
gggatctgaggatctcgctcgctgt

SEQ ID NO: 452500 - DNA, 25 bp, Rattus norvegicus
gggatctgagttcgcctgtacaata

SEQ ID NO: 452501 - DNA, 25 bp, Rattus norvegicus
gggatctgagttggcctgtacaata

SEQ ID NO: 452502 - DNA, 25 bp, Rattus norvegicus
gggatctgcaatcaagctggcttta

SEQ ID NO: 452503 - DNA, 25 bp, Rattus norvegicus
gggatctgcaatgaagctggcttta

SEQ ID NO: 452504 - DNA, 25 bp, Rattus norvegicus
gggatctgcagaatcactgcgtctc

SEQ ID NO: 452505 - DNA, 25 bp, Rattus norvegicus
gggatctgcagattcactgcgtctc

SEQ ID NO: 452506 - DNA, 25 bp, Rattus norvegicus
gggatctgctctagctaataaccat

SEQ ID NO: 452507 - DNA, 25 bp, Rattus norvegicus
gggatctgctcttgctaataaccat

SEQ ID NO: 452508 - DNA, 25 bp, Rattus norvegicus
gggatctgctgacttggcactgcac

SEQ ID NO: 452509 - DNA, 25 bp, Rattus norvegicus
gggatctgctgagttggcactgcac

SEQ ID NO: 452510 - DNA, 25 bp, Rattus norvegicus
gggatctgctgtatggaccctccag

SEQ ID NO: 452511 - DNA, 25 bp, Rattus norvegicus
gggatctgctgtttggaccctccag

SEQ ID NO: 452512 - DNA, 25 bp, Rattus norvegicus
gggatctgctttacttattctgagc

SEQ ID NO: 452513 - DNA, 25 bp, Rattus norvegicus
gggatctgcttttcttattctgagc

SEQ ID NO: 452514 - DNA, 25 bp, Rattus norvegicus
gggatctggaaccatcctctaatac

SEQ ID NO: 452515 - DNA, 25 bp, Rattus norvegicus
gggatctggaacgatcctctaatac

SEQ ID NO: 452516 - DNA, 25 bp, Rattus norvegicus
gggatctggcataactgtggttcca

SEQ ID NO: 452517 - DNA, 25 bp, Rattus norvegicus
gggatctggcattactgtggttcca

SEQ ID NO: 452518 - DNA, 25 bp, Rattus norvegicus
gggatctggcctcggacactccttg

SEQ ID NO: 452519 - DNA, 25 bp, Rattus norvegicus
gggatctggcctctgcagacatcac

SEQ ID NO: 452520 - DNA, 25 bp, Rattus norvegicus
gggatctggcctgggacactccttg

SEQ ID NO: 452521 - DNA, 25 bp, Rattus norvegicus
gggatctggcctgtgcagacatcac

SEQ ID NO: 452522 - DNA, 25 bp, Rattus norvegicus
gggatctgtctccaaatgtgcagtc

SEQ ID NO: 452523 - DNA, 25 bp, Rattus norvegicus
gggatctgtctcgaaatgtgcagtc

SEQ ID NO: 452524 - DNA, 25 bp, Rattus norvegicus
gggatctgttcgaacacatcaaagg

SEQ ID NO: 452525 - DNA, 25 bp, Rattus norvegicus
gggatctgttcgtacacatcaaagg

SEQ ID NO: 452526 - DNA, 25 bp, Rattus norvegicus
gggatcttaacccaccacagtggga

SEQ ID NO: 452527 - DNA, 25 bp, Rattus norvegicus
gggatcttaaccgaccacagtggga

SEQ ID NO: 452528 - DNA, 25 bp, Rattus norvegicus
gggatcttacttaactgcacccagc

SEQ ID NO: 452529 - DNA, 25 bp, Rattus norvegicus
gggatcttactttactgcacccagc

SEQ ID NO: 452530 - DNA, 25 bp, Rattus norvegicus
gggatcttagttaaccgtgtacact

SEQ ID NO: 452531 - DNA, 25 bp, Rattus norvegicus
gggatcttagtttaccgtgtacact

SEQ ID NO: 452532 - DNA, 25 bp, Rattus norvegicus
gggatcttatacctatgtagcagca

SEQ ID NO: 452533 - DNA, 25 bp, Rattus norvegicus
gggatcttatacgtatgtagcagca

SEQ ID NO: 452534 - DNA, 25 bp, Rattus norvegicus
gggatcttcaagcaatgcactgtac

SEQ ID NO: 452535 - DNA, 25 bp, Rattus norvegicus
gggatcttcaaggaatgcactgtac

SEQ ID NO: 452536 - DNA, 25 bp, Rattus norvegicus
gggatcttcacaaaggcagtgtcta

SEQ ID NO: 452537 - DNA, 25 bp, Rattus norvegicus
gggatcttcacataggcagtgtcta

SEQ ID NO: 452538 - DNA, 25 bp, Rattus norvegicus
gggatcttcagaagacgggaaaact

SEQ ID NO: 452539 - DNA, 25 bp, Rattus norvegicus
gggatcttcagatgacgggaaaact

SEQ ID NO: 452540 - DNA, 25 bp, Rattus norvegicus
gggatcttccctaaaggactgtctt

SEQ ID NO: 452541 - DNA, 25 bp, Rattus norvegicus
gggatcttcccttaaggactgtctt

SEQ ID NO: 452542 - DNA, 25 bp, Rattus norvegicus
gggatcttcctgagctaactcaggg

SEQ ID NO: 452543 - DNA, 25 bp, Rattus norvegicus
gggatcttcctgattagaacgttag

SEQ ID NO: 452544 - DNA, 25 bp, Rattus norvegicus
gggatcttcctgtgctaactcaggg

SEQ ID NO: 452545 - DNA, 25 bp, Rattus norvegicus
gggatcttcctgtttagaacgttag

SEQ ID NO: 452546 - DNA, 25 bp, Rattus norvegicus
gggatcttctaacttgcctgttaat

SEQ ID NO: 452547 - DNA, 25 bp, Rattus norvegicus
gggatcttctaagttgcctgttaat

SEQ ID NO: 452548 - DNA, 25 bp, Rattus norvegicus
gggatcttcttaacccagatggtca

SEQ ID NO: 452549 - DNA, 25 bp, Rattus norvegicus
gggatcttcttatcccagatggtca

SEQ ID NO: 452550 - DNA, 25 bp, Rattus norvegicus
gggatcttctttcggtctatcacct

SEQ ID NO: 452551 - DNA, 25 bp, Rattus norvegicus
gggatcttctttgggtctatcacct

SEQ ID NO: 452552 - DNA, 25 bp, Rattus norvegicus
gggatcttggcacaacgctgctaaa

SEQ ID NO: 452553 - DNA, 25 bp, Rattus norvegicus
gggatcttggcagaacgctgctaaa

SEQ ID NO: 452554 - DNA, 25 bp, Rattus norvegicus
gggatcttgttcattatgtgggatg

SEQ ID NO: 452555 - DNA, 25 bp, Rattus norvegicus
gggatcttgttctttatgtgggatg

SEQ ID NO: 452556 - DNA, 25 bp, Rattus norvegicus
gggatctttagaccatgtgccaatc

SEQ ID NO: 452557 - DNA, 25 bp, Rattus norvegicus
gggatctttagagcatgtgccaatc

SEQ ID NO: 452558 - DNA, 25 bp, Rattus norvegicus
gggatctttatcagttgttattttt

SEQ ID NO: 452559 - DNA, 25 bp, Rattus norvegicus
gggatctttatctgttgttattttt

SEQ ID NO: 452560 - DNA, 25 bp, Rattus norvegicus
gggatctttgaactcacccatcagt

SEQ ID NO: 452561 - DNA, 25 bp, Rattus norvegicus
gggatctttgaagtcacccatcagt

SEQ ID NO: 452562 - DNA, 25 bp, Rattus norvegicus
gggatctttttccactaaagctaag

SEQ ID NO: 452563 - DNA, 25 bp, Rattus norvegicus
gggatctttttcgactaaagctaag

SEQ ID NO: 452564 - DNA, 25 bp, Rattus norvegicus
gggatgaaccatcccctcatgcttt

SEQ ID NO: 452565 - DNA, 25 bp, Rattus norvegicus
gggatgaaccatgccctcatgcttt

SEQ ID NO: 452566 - DNA, 25 bp, Rattus norvegicus
gggatgaacctgcagctttattacc

SEQ ID NO: 452567 - DNA, 25 bp, Rattus norvegicus
gggatgaacctggagctttattacc

SEQ ID NO: 452568 - DNA, 25 bp, Rattus norvegicus
gggatgaactccagaaacctcgctg

SEQ ID NO: 452569 - DNA, 25 bp, Rattus norvegicus
gggatgaactcctgaaacctcgctg

SEQ ID NO: 452570 - DNA, 25 bp, Rattus norvegicus
gggatgaagagtcctttgctcaccc

SEQ ID NO: 452571 - DNA, 25 bp, Rattus norvegicus
gggatgaagagtgctttgctcaccc

SEQ ID NO: 452572 - DNA, 25 bp, Rattus norvegicus
gggatgaagatcacacgcccggatg

SEQ ID NO: 452573 - DNA, 25 bp, Rattus norvegicus
gggatgaagatctcacgcccggatg

SEQ ID NO: 452574 - DNA, 25 bp, Rattus norvegicus
gggatgaatcataccgttcagtaca

SEQ ID NO: 452575 - DNA, 25 bp, Rattus norvegicus
gggatgaatcattccgttcagtaca

SEQ ID NO: 452576 - DNA, 25 bp, Rattus norvegicus
gggatgaatccacagttttcctact

SEQ ID NO: 452577 - DNA, 25 bp, Rattus norvegicus
gggatgaatccagagttttcctact

SEQ ID NO: 452578 - DNA, 25 bp, Rattus norvegicus
gggatgaatcccctgggacactctt

SEQ ID NO: 452579 - DNA, 25 bp, Rattus norvegicus
gggatgaatcccgtgggacactctt

SEQ ID NO: 452580 - DNA, 25 bp, Rattus norvegicus
gggatgaatgtaaacagacctgcca

SEQ ID NO: 452581 - DNA, 25 bp, Rattus norvegicus
gggatgaatgtatacagacctgcca

SEQ ID NO: 452582 - DNA, 25 bp, Rattus norvegicus
gggatgacaaccaacgggacagcta

SEQ ID NO: 452583 - DNA, 25 bp, Rattus norvegicus
gggatgacaacctacgggacagcta

SEQ ID NO: 452584 - DNA, 25 bp, Rattus norvegicus
gggatgacaagtactgcagccctca

SEQ ID NO: 452585 - DNA, 25 bp, Rattus norvegicus
gggatgacaagttctgcagccctca

SEQ ID NO: 452586 - DNA, 25 bp, Rattus norvegicus
gggatgacaatcctttctcttctga

SEQ ID NO: 452587 - DNA, 25 bp, Rattus norvegicus
gggatgacaatcgtttctcttctga

SEQ ID NO: 452588 - DNA, 25 bp, Rattus norvegicus
gggatgacaggtccacctcaccgag

SEQ ID NO: 452589 - DNA, 25 bp, Rattus norvegicus
gggatgacaggtgcacctcaccgag

SEQ ID NO: 452590 - DNA, 25 bp, Rattus norvegicus
gggatgacatcaccgtgctctgcac

SEQ ID NO: 452591 - DNA, 25 bp, Rattus norvegicus
gggatgacatcagcgtgctctgcac

SEQ ID NO: 452592 - DNA, 25 bp, Rattus norvegicus
gggatgacatctcggtcttcgttat

SEQ ID NO: 452593 - DNA, 25 bp, Rattus norvegicus
gggatgacatctgggtcttcgttat

SEQ ID NO: 452594 - DNA, 25 bp, Rattus norvegicus
gggatgaccaaaagttcttctactt

SEQ ID NO: 452595 - DNA, 25 bp, Rattus norvegicus
gggatgaccaaatgttcttctactt

SEQ ID NO: 452596 - DNA, 25 bp, Rattus norvegicus
gggatgaccgacacggtgcgctttc

SEQ ID NO: 452597 - DNA, 25 bp, Rattus norvegicus
gggatgaccgactcggtgcgctttc

SEQ ID NO: 452598 - DNA, 25 bp, Rattus norvegicus
gggatgacgagtatctccacttcca

SEQ ID NO: 452599 - DNA, 25 bp, Rattus norvegicus
gggatgacgagtttctccacttcca

SEQ ID NO: 452600 - DNA, 25 bp, Rattus norvegicus
gggatgacgcatagttctggattat

SEQ ID NO: 452601 - DNA, 25 bp, Rattus norvegicus
gggatgacgcattgttctggattat

SEQ ID NO: 452602 - DNA, 25 bp, Rattus norvegicus
gggatgactactcagataccgtgaa

SEQ ID NO: 452603 - DNA, 25 bp, Rattus norvegicus
gggatgactactgagataccgtgaa

SEQ ID NO: 452604 - DNA, 25 bp, Rattus norvegicus
gggatgactcacacggtgctaaaca

SEQ ID NO: 452605 - DNA, 25 bp, Rattus norvegicus
gggatgactcactcggtgctaaaca

SEQ ID NO: 452606 - DNA, 25 bp, Rattus norvegicus
gggatgactcataagagaccagctc

SEQ ID NO: 452607 - DNA, 25 bp, Rattus norvegicus
gggatgactcattagagaccagctc

SEQ ID NO: 452608 - DNA, 25 bp, Rattus norvegicus
gggatgactcccacatgagttctct

SEQ ID NO: 452609 - DNA, 25 bp, Rattus norvegicus
gggatgactccctcatgagttctct

SEQ ID NO: 452610 - DNA, 25 bp, Rattus norvegicus
gggatgactgctagcccactcaggt

SEQ ID NO: 452611 - DNA, 25 bp, Rattus norvegicus
gggatgactgcttgcccactcaggt

SEQ ID NO: 452612 - DNA, 25 bp, Rattus norvegicus
gggatgactgttaactttcctgaaa

SEQ ID NO: 452613 - DNA, 25 bp, Rattus norvegicus
gggatgactgtttactttcctgaaa

SEQ ID NO: 452614 - DNA, 25 bp, Rattus norvegicus
gggatgacttctaccgtgccaaacc

SEQ ID NO: 452615 - DNA, 25 bp, Rattus norvegicus
gggatgacttcttccgtgccaaacc

SEQ ID NO: 452616 - DNA, 25 bp, Rattus norvegicus
gggatgagaaccagctggtctgtcc

SEQ ID NO: 452617 - DNA, 25 bp, Rattus norvegicus
gggatgagaacctgctggtctgtcc

SEQ ID NO: 452618 - DNA, 25 bp, Rattus norvegicus
gggatgagaagcactgctggcccca

SEQ ID NO: 452619 - DNA, 25 bp, Rattus norvegicus
gggatgagaagctctgctggcccca

SEQ ID NO: 452620 - DNA, 25 bp, Rattus norvegicus
gggatgagactgcacatttgcacat

SEQ ID NO: 452621 - DNA, 25 bp, Rattus norvegicus
gggatgagactggacatttgcacat

SEQ ID NO: 452622 - DNA, 25 bp, Rattus norvegicus
gggatgagccacaaatgaacaactt

SEQ ID NO: 452623 - DNA, 25 bp, Rattus norvegicus
gggatgagccactaatgaacaactt

SEQ ID NO: 452624 - DNA, 25 bp, Rattus norvegicus
gggatgagccatacacttctgtgaa

SEQ ID NO: 452625 - DNA, 25 bp, Rattus norvegicus
gggatgagccattcacttctgtgaa

SEQ ID NO: 452626 - DNA, 25 bp, Rattus norvegicus
gggatgagccttcctcacgaacttc

SEQ ID NO: 452627 - DNA, 25 bp, Rattus norvegicus
gggatgagccttgctcacgaacttc

SEQ ID NO: 452628 - DNA, 25 bp, Rattus norvegicus
gggatgagggaacgccctttctcta

SEQ ID NO: 452629 - DNA, 25 bp, Rattus norvegicus
gggatgagggaaggccctttctcta

SEQ ID NO: 452630 - DNA, 25 bp, Rattus norvegicus
gggatgaggtccaacagctccgtgt

SEQ ID NO: 452631 - DNA, 25 bp, Rattus norvegicus
gggatgaggtcctacagctccgtgt

SEQ ID NO: 452632 - DNA, 25 bp, Rattus norvegicus
gggatgaggtttacactctagttgt

SEQ ID NO: 452633 - DNA, 25 bp, Rattus norvegicus
gggatgaggttttcactctagttgt

SEQ ID NO: 452634 - DNA, 25 bp, Rattus norvegicus
gggatgagtcctccaatgccacact

SEQ ID NO: 452635 - DNA, 25 bp, Rattus norvegicus
gggatgagtcctgcaatgccacact

SEQ ID NO: 452636 - DNA, 25 bp, Rattus norvegicus
gggatgagtttccatactgcctgac

SEQ ID NO: 452637 - DNA, 25 bp, Rattus norvegicus
gggatgagtttcgatactgcctgac

SEQ ID NO: 452638 - DNA, 25 bp, Rattus norvegicus
gggatgatacacatggaccactctt

SEQ ID NO: 452639 - DNA, 25 bp, Rattus norvegicus
gggatgatacacttggaccactctt

SEQ ID NO: 452640 - DNA, 25 bp, Rattus norvegicus
gggatgatccaaagctggcaccttt

SEQ ID NO: 452641 - DNA, 25 bp, Rattus norvegicus
gggatgatccaatgctggcaccttt

SEQ ID NO: 452642 - DNA, 25 bp, Rattus norvegicus
gggatgatctccctagtcagatttc

SEQ ID NO: 452643 - DNA, 25 bp, Rattus norvegicus
gggatgatctccgtagtcagatttc

SEQ ID NO: 452644 - DNA, 25 bp, Rattus norvegicus
gggatgatgaccactcagcaggccg

SEQ ID NO: 452645 - DNA, 25 bp, Rattus norvegicus
gggatgatgacctctcagcaggccg

SEQ ID NO: 452646 - DNA, 25 bp, Rattus norvegicus
gggatgattgccaccaagcttgatg

SEQ ID NO: 452647 - DNA, 25 bp, Rattus norvegicus
gggatgattgcctccaagcttgatg

SEQ ID NO: 452648 - DNA, 25 bp, Rattus norvegicus
gggatgatttccaatgtttactgta

SEQ ID NO: 452649 - DNA, 25 bp, Rattus norvegicus
gggatgatttcctatgtttactgta

SEQ ID NO: 452650 - DNA, 25 bp, Rattus norvegicus
gggatgcaagaacgacccattttta

SEQ ID NO: 452651 - DNA, 25 bp, Rattus norvegicus
gggatgcaagaaggacccattttta

SEQ ID NO: 452652 - DNA, 25 bp, Rattus norvegicus
gggatgcaagcactcgagatagaca

SEQ ID NO: 452653 - DNA, 25 bp, Rattus norvegicus
gggatgcaagcagtcgagatagaca

SEQ ID NO: 452654 - DNA, 25 bp, Rattus norvegicus
gggatgcaagctatcaacatgagtt

SEQ ID NO: 452655 - DNA, 25 bp, Rattus norvegicus
gggatgcaagctttcaacatgagtt

SEQ ID NO: 452656 - DNA, 25 bp, Rattus norvegicus
gggatgcaatgtctgtataacgtca

SEQ ID NO: 452657 - DNA, 25 bp, Rattus norvegicus
gggatgcaatgtgtgtataacgtca

SEQ ID NO: 452658 - DNA, 25 bp, Rattus norvegicus
gggatgcacaccacagagtaaacag

SEQ ID NO: 452659 - DNA, 25 bp, Rattus norvegicus
gggatgcacacctcagagtaaacag

SEQ ID NO: 452660 - DNA, 25 bp, Rattus norvegicus
gggatgcacataaacattcttcagg

SEQ ID NO: 452661 - DNA, 25 bp, Rattus norvegicus
gggatgcacatatacattcttcagg

SEQ ID NO: 452662 - DNA, 25 bp, Rattus norvegicus
gggatgcacatcaagtcaagcagtg

SEQ ID NO: 452663 - DNA, 25 bp, Rattus norvegicus
gggatgcacatctagtcaagcagtg

SEQ ID NO: 452664 - DNA, 25 bp, Rattus norvegicus
gggatgcagaatatgccctggcaaa

SEQ ID NO: 452665 - DNA, 25 bp, Rattus norvegicus
gggatgcagaatttgccctggcaaa

SEQ ID NO: 452666 - DNA, 25 bp, Rattus norvegicus
gggatgcagagcaaaacagaaaatt

SEQ ID NO: 452667 - DNA, 25 bp, Rattus norvegicus
gggatgcagagctaaacagaaaatt

SEQ ID NO: 452668 - DNA, 25 bp, Rattus norvegicus
gggatgcagcggacacagaccgaat

SEQ ID NO: 452669 - DNA, 25 bp, Rattus norvegicus
gggatgcagcggtcacagaccgaat

SEQ ID NO: 452670 - DNA, 25 bp, Rattus norvegicus
gggatgcagctcagctccaagggac

SEQ ID NO: 452671 - DNA, 25 bp, Rattus norvegicus
gggatgcagctctgctccaagggac

SEQ ID NO: 452672 - DNA, 25 bp, Rattus norvegicus
gggatgcatatgacttactcagggt

SEQ ID NO: 452673 - DNA, 25 bp, Rattus norvegicus
gggatgcatatgtcttactcagggt

SEQ ID NO: 452674 - DNA, 25 bp, Rattus norvegicus
gggatgccaacaaaagaacactgat

SEQ ID NO: 452675 - DNA, 25 bp, Rattus norvegicus
gggatgccaacataagaacactgat

SEQ ID NO: 452676 - DNA, 25 bp, Rattus norvegicus
gggatgccacatatcataactgttt

SEQ ID NO: 452677 - DNA, 25 bp, Rattus norvegicus
gggatgccacatctagaagactatc

SEQ ID NO: 452678 - DNA, 25 bp, Rattus norvegicus
gggatgccacatgtagaagactatc

SEQ ID NO: 452679 - DNA, 25 bp, Rattus norvegicus
gggatgccacatttcataactgttt

SEQ ID NO: 452680 - DNA, 25 bp, Rattus norvegicus
gggatgcccagtagctcacctgcaa

SEQ ID NO: 452681 - DNA, 25 bp, Rattus norvegicus
gggatgcccagtcgctttcattctc

SEQ ID NO: 452682 - DNA, 25 bp, Rattus norvegicus
gggatgcccagtggctttcattctc

SEQ ID NO: 452683 - DNA, 25 bp, Rattus norvegicus
gggatgcccagttgctcacctgcaa

SEQ ID NO: 452684 - DNA, 25 bp, Rattus norvegicus
gggatgccctcactggaatgcagca

SEQ ID NO: 452685 - DNA, 25 bp, Rattus norvegicus
gggatgccctcagtggaatgcagca

SEQ ID NO: 452686 - DNA, 25 bp, Rattus norvegicus
gggatgccgcgcaggtcgaccttaa

SEQ ID NO: 452687 - DNA, 25 bp, Rattus norvegicus
gggatgccgcgctggtcgaccttaa

SEQ ID NO: 452688 - DNA, 25 bp, Rattus norvegicus
gggatgcctaacagctgctgctcct

SEQ ID NO: 452689 - DNA, 25 bp, Rattus norvegicus
gggatgcctaactgctgctgctcct

SEQ ID NO: 452690 - DNA, 25 bp, Rattus norvegicus
gggatgcctacaaaacccattctag

SEQ ID NO: 452691 - DNA, 25 bp, Rattus norvegicus
gggatgcctacataacccattctag

SEQ ID NO: 452692 - DNA, 25 bp, Rattus norvegicus
gggatgcctcagctcgaacagatac

SEQ ID NO: 452693 - DNA, 25 bp, Rattus norvegicus
gggatgcctcaggtcgaacagatac

SEQ ID NO: 452694 - DNA, 25 bp, Rattus norvegicus
gggatgcctccgataaaaatgaaca

SEQ ID NO: 452695 - DNA, 25 bp, Rattus norvegicus
gggatgcctccgttaaaaatgaaca

SEQ ID NO: 452696 - DNA, 25 bp, Rattus norvegicus
gggatgcgctgtcagtccatcatca

SEQ ID NO: 452697 - DNA, 25 bp, Rattus norvegicus
gggatgcgctgtgagtccatcatca

SEQ ID NO: 452698 - DNA, 25 bp, Rattus norvegicus
gggatgctaattcgacagccctttg

SEQ ID NO: 452699 - DNA, 25 bp, Rattus norvegicus
gggatgctaattggacagccctttg

SEQ ID NO: 452700 - DNA, 25 bp, Rattus norvegicus
gggatgctacttaccacaatctgta

SEQ ID NO: 452701 - DNA, 25 bp, Rattus norvegicus
gggatgctactttccacaatctgta

SEQ ID NO: 452702 - DNA, 25 bp, Rattus norvegicus
gggatgctatatatcattcttgtaa

SEQ ID NO: 452703 - DNA, 25 bp, Rattus norvegicus
gggatgctatatttcattcttgtaa

SEQ ID NO: 452704 - DNA, 25 bp, Rattus norvegicus
gggatgctcagaactatttatctca

SEQ ID NO: 452705 - DNA, 25 bp, Rattus norvegicus
gggatgctcagatctatttatctca

SEQ ID NO: 452706 - DNA, 25 bp, Rattus norvegicus
gggatgctcagcaggtactgctccg

SEQ ID NO: 452707 - DNA, 25 bp, Rattus norvegicus
gggatgctcagctggtactgctccg

SEQ ID NO: 452708 - DNA, 25 bp, Rattus norvegicus
gggatgctcatccacggattatgct

SEQ ID NO: 452709 - DNA, 25 bp, Rattus norvegicus
gggatgctcatcgacggattatgct

SEQ ID NO: 452710 - DNA, 25 bp, Rattus norvegicus
gggatgctcattagactgaagggta

SEQ ID NO: 452711 - DNA, 25 bp, Rattus norvegicus
gggatgctcatttgactgaagggta

SEQ ID NO: 452712 - DNA, 25 bp, Rattus norvegicus
gggatgctccaaacaccagaggtgg

SEQ ID NO: 452713 - DNA, 25 bp, Rattus norvegicus
gggatgctccaatcaccagaggtgg

SEQ ID NO: 452714 - DNA, 25 bp, Rattus norvegicus
gggatgctctgaaccaattccagga

SEQ ID NO: 452715 - DNA, 25 bp, Rattus norvegicus
gggatgctctgatccaattccagga

SEQ ID NO: 452716 - DNA, 25 bp, Rattus norvegicus
gggatgctcttaattcttgagtttt

SEQ ID NO: 452717 - DNA, 25 bp, Rattus norvegicus
gggatgctcttatttcttgagtttt

SEQ ID NO: 452718 - DNA, 25 bp, Rattus norvegicus
gggatgctgaccaaccaggaaatct

SEQ ID NO: 452719 - DNA, 25 bp, Rattus norvegicus
gggatgctgacctaccaggaaatct

SEQ ID NO: 452720 - DNA, 25 bp, Rattus norvegicus
gggatgctgctaattccaagatgca

SEQ ID NO: 452721 - DNA, 25 bp, Rattus norvegicus
gggatgctgctatttccaagatgca

SEQ ID NO: 452722 - DNA, 25 bp, Rattus norvegicus
gggatgctgggaagacacctgcttc

SEQ ID NO: 452723 - DNA, 25 bp, Rattus norvegicus
gggatgctgggatgacacctgcttc

SEQ ID NO: 452724 - DNA, 25 bp, Rattus norvegicus
gggatgcttaatcgccccagctccg

SEQ ID NO: 452725 - DNA, 25 bp, Rattus norvegicus
gggatgcttaatggccccagctccg

SEQ ID NO: 452726 - DNA, 25 bp, Rattus norvegicus
gggatgcttcatctggaagttcaaa

SEQ ID NO: 452727 - DNA, 25 bp, Rattus norvegicus
gggatgcttcatgtggaagttcaaa

SEQ ID NO: 452728 - DNA, 25 bp, Rattus norvegicus
gggatgcttctcagaccaaacactc

SEQ ID NO: 452729 - DNA, 25 bp, Rattus norvegicus
gggatgcttctcagtatagccagag

SEQ ID NO: 452730 - DNA, 25 bp, Rattus norvegicus
gggatgcttctctgaccaaacactc

SEQ ID NO: 452731 - DNA, 25 bp, Rattus norvegicus
gggatgcttctctgtatagccagag

SEQ ID NO: 452732 - DNA, 25 bp, Rattus norvegicus
gggatgcttggacagcactttctcg

SEQ ID NO: 452733 - DNA, 25 bp, Rattus norvegicus
gggatgcttggagagcactttctcg

SEQ ID NO: 452734 - DNA, 25 bp, Rattus norvegicus
gggatgcttggtaaaaccatgtgat

SEQ ID NO: 452735 - DNA, 25 bp, Rattus norvegicus
gggatgcttggttaaaccatgtgat

SEQ ID NO: 452736 - DNA, 25 bp, Rattus norvegicus
gggatgcttttaacgtctctggaca

SEQ ID NO: 452737 - DNA, 25 bp, Rattus norvegicus
gggatgcttttatcgtctctggaca

SEQ ID NO: 452738 - DNA, 25 bp, Rattus norvegicus
gggatggaaccaactttttctgtat

SEQ ID NO: 452739 - DNA, 25 bp, Rattus norvegicus
gggatggaaccatctttttctgtat

SEQ ID NO: 452740 - DNA, 25 bp, Rattus norvegicus
gggatggaacccaggcaagacctct

SEQ ID NO: 452741 - DNA, 25 bp, Rattus norvegicus
gggatggaaccctggcaagacctct

SEQ ID NO: 452742 - DNA, 25 bp, Rattus norvegicus
gggatggaactcactgcctccaatg

SEQ ID NO: 452743 - DNA, 25 bp, Rattus norvegicus
gggatggaactctctgcctccaatg

SEQ ID NO: 452744 - DNA, 25 bp, Rattus norvegicus
gggatggaacttaacccacacgctg

SEQ ID NO: 452745 - DNA, 25 bp, Rattus norvegicus
gggatggaactttacccacacgctg

SEQ ID NO: 452746 - DNA, 25 bp, Rattus norvegicus
gggatggacatcattgccaagttct

SEQ ID NO: 452747 - DNA, 25 bp, Rattus norvegicus
gggatggacatctttgccaagttct

SEQ ID NO: 452748 - DNA, 25 bp, Rattus norvegicus
gggatggaccttaccaaatcagtta

SEQ ID NO: 452749 - DNA, 25 bp, Rattus norvegicus
gggatggacctttccaaatcagtta

SEQ ID NO: 452750 - DNA, 25 bp, Rattus norvegicus
gggatggatcaacgccattctccta

SEQ ID NO: 452751 - DNA, 25 bp, Rattus norvegicus
gggatggatcaaggccattctccta

SEQ ID NO: 452752 - DNA, 25 bp, Rattus norvegicus
gggatggatctgaccttgttagaaa

SEQ ID NO: 452753 - DNA, 25 bp, Rattus norvegicus
gggatggatctgtccttgttagaaa

SEQ ID NO: 452754 - DNA, 25 bp, Rattus norvegicus
gggatggatggcagctcaacacact

SEQ ID NO: 452755 - DNA, 25 bp, Rattus norvegicus
gggatggatggctgctcaacacact

SEQ ID NO: 452756 - DNA, 25 bp, Rattus norvegicus
gggatggatggtcctttccatctgt

SEQ ID NO: 452757 - DNA, 25 bp, Rattus norvegicus
gggatggatggtgctttccatctgt

SEQ ID NO: 452758 - DNA, 25 bp, Rattus norvegicus
gggatggattcactcactccaactt

SEQ ID NO: 452759 - DNA, 25 bp, Rattus norvegicus
gggatggattcagtcactccaactt

SEQ ID NO: 452760 - DNA, 25 bp, Rattus norvegicus
gggatggcaagtcgctcaatgtcca

SEQ ID NO: 452761 - DNA, 25 bp, Rattus norvegicus
gggatggcaagtggctcaatgtcca

SEQ ID NO: 452762 - DNA, 25 bp, Rattus norvegicus
gggatggcagtgacctcctcattcc

SEQ ID NO: 452763 - DNA, 25 bp, Rattus norvegicus
gggatggcagtgtcctcctcattcc

SEQ ID NO: 452764 - DNA, 25 bp, Rattus norvegicus
gggatggcatcactcataattatct

SEQ ID NO: 452765 - DNA, 25 bp, Rattus norvegicus
gggatggcatcagtcataattatct

SEQ ID NO: 452766 - DNA, 25 bp, Rattus norvegicus
gggatggccaacatgtgtgaccttt

SEQ ID NO: 452767 - DNA, 25 bp, Rattus norvegicus
gggatggccaacttgtgtgaccttt

SEQ ID NO: 452768 - DNA, 25 bp, Rattus norvegicus
gggatggcctttagctcacccagat

SEQ ID NO: 452769 - DNA, 25 bp, Rattus norvegicus
gggatggcctttatccgtcagggat

SEQ ID NO: 452770 - DNA, 25 bp, Rattus norvegicus
gggatggccttttgctcacccagat

SEQ ID NO: 452771 - DNA, 25 bp, Rattus norvegicus
gggatggcctttttccgtcagggat

SEQ ID NO: 452772 - DNA, 25 bp, Rattus norvegicus
gggatggcgccgaagccgtgcgggc

SEQ ID NO: 452773 - DNA, 25 bp, Rattus norvegicus
gggatggcgccgtagccgtgcgggc

SEQ ID NO: 452774 - DNA, 25 bp, Rattus norvegicus
gggatggctggaattgacctcactg

SEQ ID NO: 452775 - DNA, 25 bp, Rattus norvegicus
gggatggctggatttgacctcactg

SEQ ID NO: 452776 - DNA, 25 bp, Rattus norvegicus
gggatgggctccacggattttatga

SEQ ID NO: 452777 - DNA, 25 bp, Rattus norvegicus
gggatgggctcctcggattttatga

SEQ ID NO: 452778 - DNA, 25 bp, Rattus norvegicus
gggatgggctgcattccagacccag

SEQ ID NO: 452779 - DNA, 25 bp, Rattus norvegicus
gggatgggctgctttccagacccag

SEQ ID NO: 452780 - DNA, 25 bp, Rattus norvegicus
gggatggtaactacctacactgttt

SEQ ID NO: 452781 - DNA, 25 bp, Rattus norvegicus
gggatggtaacttcctacactgttt

SEQ ID NO: 452782 - DNA, 25 bp, Rattus norvegicus
gggatggtagcaaactcacatgcaa

SEQ ID NO: 452783 - DNA, 25 bp, Rattus norvegicus
gggatggtagcatactcacatgcaa

SEQ ID NO: 452784 - DNA, 25 bp, Rattus norvegicus
gggatggtagccctaatcagcccca

SEQ ID NO: 452785 - DNA, 25 bp, Rattus norvegicus
gggatggtagccgtaatcagcccca

SEQ ID NO: 452786 - DNA, 25 bp, Rattus norvegicus
gggatggtcccacagctgcatccca

SEQ ID NO: 452787 - DNA, 25 bp, Rattus norvegicus
gggatggtcccagagctgcatccca

SEQ ID NO: 452788 - DNA, 25 bp, Rattus norvegicus
gggatggttacacacatggttatag

SEQ ID NO: 452789 - DNA, 25 bp, Rattus norvegicus
gggatggttacagacatggttatag

SEQ ID NO: 452790 - DNA, 25 bp, Rattus norvegicus
gggatggttataccaacgtcatcaa

SEQ ID NO: 452791 - DNA, 25 bp, Rattus norvegicus
gggatggttatagcaacgtcatcaa

SEQ ID NO: 452792 - DNA, 25 bp, Rattus norvegicus
gggatggttctcattaacacagcag

SEQ ID NO: 452793 - DNA, 25 bp, Rattus norvegicus
gggatggttctctttaacacagcag

SEQ ID NO: 452794 - DNA, 25 bp, Rattus norvegicus
gggatgtaacacagctcttttcatg

SEQ ID NO: 452795 - DNA, 25 bp, Rattus norvegicus
gggatgtaacactgctcttttcatg

SEQ ID NO: 452796 - DNA, 25 bp, Rattus norvegicus
gggatgtacagcagacaagatggca

SEQ ID NO: 452797 - DNA, 25 bp, Rattus norvegicus
gggatgtacagctgacaagatggca

SEQ ID NO: 452798 - DNA, 25 bp, Rattus norvegicus
gggatgtaccccaggctgagaacag

SEQ ID NO: 452799 - DNA, 25 bp, Rattus norvegicus
gggatgtacccctggctgagaacag

SEQ ID NO: 452800 - DNA, 25 bp, Rattus norvegicus
gggatgtaccgacccggtctctcaa

SEQ ID NO: 452801 - DNA, 25 bp, Rattus norvegicus
gggatgtaccgagccggtctctcaa

SEQ ID NO: 452802 - DNA, 25 bp, Rattus norvegicus
gggatgtacctacttctgctgggtc

SEQ ID NO: 452803 - DNA, 25 bp, Rattus norvegicus
gggatgtacctagttctgctgggtc

SEQ ID NO: 452804 - DNA, 25 bp, Rattus norvegicus
gggatgtatcatcgagcacctctct

SEQ ID NO: 452805 - DNA, 25 bp, Rattus norvegicus
gggatgtatcatggagcacctctct

SEQ ID NO: 452806 - DNA, 25 bp, Rattus norvegicus
gggatgtattttcttaggcatcaca

SEQ ID NO: 452807 - DNA, 25 bp, Rattus norvegicus
gggatgtattttgttaggcatcaca

SEQ ID NO: 452808 - DNA, 25 bp, Rattus norvegicus
gggatgtcacacctaagacttggat

SEQ ID NO: 452809 - DNA, 25 bp, Rattus norvegicus
gggatgtcacacgtaagacttggat

SEQ ID NO: 452810 - DNA, 25 bp, Rattus norvegicus
gggatgtcacatcgcctttgtcaac

SEQ ID NO: 452811 - DNA, 25 bp, Rattus norvegicus
gggatgtcacatggcctttgtcaac

SEQ ID NO: 452812 - DNA, 25 bp, Rattus norvegicus
gggatgtcactgcacttggccaact

SEQ ID NO: 452813 - DNA, 25 bp, Rattus norvegicus
gggatgtcactggacttggccaact

SEQ ID NO: 452814 - DNA, 25 bp, Rattus norvegicus
gggatgtcaggacctatttctcatt

SEQ ID NO: 452815 - DNA, 25 bp, Rattus norvegicus
gggatgtcaggactgcctaaccctg

SEQ ID NO: 452816 - DNA, 25 bp, Rattus norvegicus
gggatgtcaggagctatttctcatt

SEQ ID NO: 452817 - DNA, 25 bp, Rattus norvegicus
gggatgtcaggagtgcctaaccctg

SEQ ID NO: 452818 - DNA, 25 bp, Rattus norvegicus
gggatgtccaatactggcacttttt

SEQ ID NO: 452819 - DNA, 25 bp, Rattus norvegicus
gggatgtccaattctggcacttttt

SEQ ID NO: 452820 - DNA, 25 bp, Rattus norvegicus
gggatgtccagaacccaagccatca

SEQ ID NO: 452821 - DNA, 25 bp, Rattus norvegicus
gggatgtccagatcccaagccatca

SEQ ID NO: 452822 - DNA, 25 bp, Rattus norvegicus
gggatgtcccacatgtatcatagtt

SEQ ID NO: 452823 - DNA, 25 bp, Rattus norvegicus
gggatgtcccacttgtatcatagtt

SEQ ID NO: 452824 - DNA, 25 bp, Rattus norvegicus
gggatgtccctgaagattagttcca

SEQ ID NO: 452825 - DNA, 25 bp, Rattus norvegicus
gggatgtccctgtagattagttcca

SEQ ID NO: 452826 - DNA, 25 bp, Rattus norvegicus
gggatgtcctccaggctttgctggc

SEQ ID NO: 452827 - DNA, 25 bp, Rattus norvegicus
gggatgtcctcctggctttgctggc

SEQ ID NO: 452828 - DNA, 25 bp, Rattus norvegicus
gggatgtccttacccaattggtcat

SEQ ID NO: 452829 - DNA, 25 bp, Rattus norvegicus
gggatgtccttagccaattggtcat

SEQ ID NO: 452830 - DNA, 25 bp, Rattus norvegicus
gggatgtctacacatgtgtcttctt

SEQ ID NO: 452831 - DNA, 25 bp, Rattus norvegicus
gggatgtctacagatgtgtcttctt

SEQ ID NO: 452832 - DNA, 25 bp, Rattus norvegicus
gggatgtctcacacaaccactttac

SEQ ID NO: 452833 - DNA, 25 bp, Rattus norvegicus
gggatgtctcactcaaccactttac

SEQ ID NO: 452834 - DNA, 25 bp, Rattus norvegicus
gggatgtctcctagcaaatgtctct

SEQ ID NO: 452835 - DNA, 25 bp, Rattus norvegicus
gggatgtctccttgcaaatgtctct

SEQ ID NO: 452836 - DNA, 25 bp, Rattus norvegicus
gggatgtgacctacgaccctgagct

SEQ ID NO: 452837 - DNA, 25 bp, Rattus norvegicus
gggatgtgaccttcgaccctgagct

SEQ ID NO: 452838 - DNA, 25 bp, Rattus norvegicus
gggatgtgccctacaataaccttct

SEQ ID NO: 452839 - DNA, 25 bp, Rattus norvegicus
gggatgtgcccttcaataaccttct

SEQ ID NO: 452840 - DNA, 25 bp, Rattus norvegicus
gggatgtgctctcattagatgcttt

SEQ ID NO: 452841 - DNA, 25 bp, Rattus norvegicus
gggatgtgctctgattagatgcttt

SEQ ID NO: 452842 - DNA, 25 bp, Rattus norvegicus
gggatgtggcgaatctacacagaag

SEQ ID NO: 452843 - DNA, 25 bp, Rattus norvegicus
gggatgtggcgattctacacagaag

SEQ ID NO: 452844 - DNA, 25 bp, Rattus norvegicus
gggatgtgggtgactttatatttta

SEQ ID NO: 452845 - DNA, 25 bp, Rattus norvegicus
gggatgtgggtgtctttatatttta

SEQ ID NO: 452846 - DNA, 25 bp, Rattus norvegicus
gggatgtggtgaattatgcccatga

SEQ ID NO: 452847 - DNA, 25 bp, Rattus norvegicus
gggatgtggtgatttatgcccatga

SEQ ID NO: 452848 - DNA, 25 bp, Rattus norvegicus
gggatgtgtagcactcatctaacct

SEQ ID NO: 452849 - DNA, 25 bp, Rattus norvegicus
gggatgtgtagctctcatctaacct

SEQ ID NO: 452850 - DNA, 25 bp, Rattus norvegicus
gggatgtgtcacagttcaggctcgt

SEQ ID NO: 452851 - DNA, 25 bp, Rattus norvegicus
gggatgtgtcactgttcaggctcgt

SEQ ID NO: 452852 - DNA, 25 bp, Rattus norvegicus
gggatgtgtcagatgtgctaccatt

SEQ ID NO: 452853 - DNA, 25 bp, Rattus norvegicus
gggatgtgtcagttgtgctaccatt

SEQ ID NO: 452854 - DNA, 25 bp, Rattus norvegicus
gggatgttacacaggaagcctcaag

SEQ ID NO: 452855 - DNA, 25 bp, Rattus norvegicus
gggatgttacactggaagcctcaag

SEQ ID NO: 452856 - DNA, 25 bp, Rattus norvegicus
gggatgttcatcctggtcaactcca

SEQ ID NO: 452857 - DNA, 25 bp, Rattus norvegicus
gggatgttcatcgtggtcaactcca

SEQ ID NO: 452858 - DNA, 25 bp, Rattus norvegicus
gggatgttctatatttgctgcctcc

SEQ ID NO: 452859 - DNA, 25 bp, Rattus norvegicus
gggatgttctatttttgctgcctcc

SEQ ID NO: 452860 - DNA, 25 bp, Rattus norvegicus
gggatgttctcgacaatctttttga

SEQ ID NO: 452861 - DNA, 25 bp, Rattus norvegicus
gggatgttctcgtcaatctttttga

SEQ ID NO: 452862 - DNA, 25 bp, Rattus norvegicus
gggatgttctttaggcatgctataa

SEQ ID NO: 452863 - DNA, 25 bp, Rattus norvegicus
gggatgttcttttggcatgctataa

SEQ ID NO: 452864 - DNA, 25 bp, Rattus norvegicus
gggatgttgcccacctagatagaat

SEQ ID NO: 452865 - DNA, 25 bp, Rattus norvegicus
gggatgttgccctcctagatagaat

SEQ ID NO: 452866 - DNA, 25 bp, Rattus norvegicus
gggatgttgctaatgaacactctgt

SEQ ID NO: 452867 - DNA, 25 bp, Rattus norvegicus
gggatgttgctattgaacactctgt

SEQ ID NO: 452868 - DNA, 25 bp, Rattus norvegicus
gggatgtttccaacagccagtagtt

SEQ ID NO: 452869 - DNA, 25 bp, Rattus norvegicus
gggatgtttccatcagccagtagtt

SEQ ID NO: 452870 - DNA, 25 bp, Rattus norvegicus
gggatgtttcccagaagagcccgaa

SEQ ID NO: 452871 - DNA, 25 bp, Rattus norvegicus
gggatgtttccctgaagagcccgaa

SEQ ID NO: 452872 - DNA, 25 bp, Rattus norvegicus
gggatgttttatcggtttcttctgc

SEQ ID NO: 452873 - DNA, 25 bp, Rattus norvegicus
gggatgttttatgggtttcttctgc

SEQ ID NO: 452874 - DNA, 25 bp, Rattus norvegicus
gggatgttttccacactttagtatt

SEQ ID NO: 452875 - DNA, 25 bp, Rattus norvegicus
gggatgttttcctcactttagtatt

SEQ ID NO: 452876 - DNA, 25 bp, Rattus norvegicus
gggatgttttctcgtcttgaatcta

SEQ ID NO: 452877 - DNA, 25 bp, Rattus norvegicus
gggatgttttctggtcttgaatcta

SEQ ID NO: 452878 - DNA, 25 bp, Rattus norvegicus
gggattaaaccaaaaagatgtgcct

SEQ ID NO: 452879 - DNA, 25 bp, Rattus norvegicus
gggattaaaccataaagatgtgcct

SEQ ID NO: 452880 - DNA, 25 bp, Rattus norvegicus
gggattaaagccaccatgataaaga

SEQ ID NO: 452881 - DNA, 25 bp, Rattus norvegicus
gggattaaagcctccatgataaaga

SEQ ID NO: 452882 - DNA, 25 bp, Rattus norvegicus
gggattaacatgctgctggcagcct

SEQ ID NO: 452883 - DNA, 25 bp, Rattus norvegicus
gggattaacatggtgctggcagcct

SEQ ID NO: 452884 - DNA, 25 bp, Rattus norvegicus
gggattaacattactctcttctgat

SEQ ID NO: 452885 - DNA, 25 bp, Rattus norvegicus
gggattaacatttctctcttctgat

SEQ ID NO: 452886 - DNA, 25 bp, Rattus norvegicus
gggattaacctgctagctgctaata

SEQ ID NO: 452887 - DNA, 25 bp, Rattus norvegicus
gggattaacctggtagctgctaata

SEQ ID NO: 452888 - DNA, 25 bp, Rattus norvegicus
gggattaacgggacaaagctcattg

SEQ ID NO: 452889 - DNA, 25 bp, Rattus norvegicus
gggattaacgggtcaaagctcattg

SEQ ID NO: 452890 - DNA, 25 bp, Rattus norvegicus
gggattaactcccaattctcttcat

SEQ ID NO: 452891 - DNA, 25 bp, Rattus norvegicus
gggattaactccgaattctcttcat

SEQ ID NO: 452892 - DNA, 25 bp, Rattus norvegicus
gggattaagggcacggcacaccaca

SEQ ID NO: 452893 - DNA, 25 bp, Rattus norvegicus
gggattaagggcatgccccaccata

SEQ ID NO: 452894 - DNA, 25 bp, Rattus norvegicus
gggattaagggctcggcacaccaca

SEQ ID NO: 452895 - DNA, 25 bp, Rattus norvegicus
gggattaagggcttgccccaccata

SEQ ID NO: 452896 - DNA, 25 bp, Rattus norvegicus
gggattaatcccatggccatttttc

SEQ ID NO: 452897 - DNA, 25 bp, Rattus norvegicus
gggattaatcccttggccatttttc

SEQ ID NO: 452898 - DNA, 25 bp, Rattus norvegicus
gggattacaaacacactcgctatgg

SEQ ID NO: 452899 - DNA, 25 bp, Rattus norvegicus
gggattacaaactcactcgctatgg

SEQ ID NO: 452900 - DNA, 25 bp, Rattus norvegicus
gggattacaacaaggcaaaagcaaa

SEQ ID NO: 452901 - DNA, 25 bp, Rattus norvegicus
gggattacaacatggcaaaagcaaa

SEQ ID NO: 452902 - DNA, 25 bp, Rattus norvegicus
gggattacaacgcaccagctactgt

SEQ ID NO: 452903 - DNA, 25 bp, Rattus norvegicus
gggattacaacggaccagctactgt

SEQ ID NO: 452904 - DNA, 25 bp, Rattus norvegicus
gggattacagacatgtatcactaca

SEQ ID NO: 452905 - DNA, 25 bp, Rattus norvegicus
gggattacagacttgtatcactaca

SEQ ID NO: 452906 - DNA, 25 bp, Rattus norvegicus
gggattacaggcacgagcgccctac

SEQ ID NO: 452907 - DNA, 25 bp, Rattus norvegicus
gggattacaggctcgagcgccctac

SEQ ID NO: 452908 - DNA, 25 bp, Rattus norvegicus
gggattacagtaagcatcaccatgt

SEQ ID NO: 452909 - DNA, 25 bp, Rattus norvegicus
gggattacagtatgcatcaccatgt

SEQ ID NO: 452910 - DNA, 25 bp, Rattus norvegicus
gggattacatatattaccatgcatg

SEQ ID NO: 452911 - DNA, 25 bp, Rattus norvegicus
gggattacatattttaccatgcatg

SEQ ID NO: 452912 - DNA, 25 bp, Rattus norvegicus
gggattacatgtcctcacctttaat

SEQ ID NO: 452913 - DNA, 25 bp, Rattus norvegicus
gggattacatgtgctcacctttaat

SEQ ID NO: 452914 - DNA, 25 bp, Rattus norvegicus
gggattaccagcatgttttatactt

SEQ ID NO: 452915 - DNA, 25 bp, Rattus norvegicus
gggattaccagcttgttttatactt

SEQ ID NO: 452916 - DNA, 25 bp, Rattus norvegicus
gggattaccatgagttcgaagccag

SEQ ID NO: 452917 - DNA, 25 bp, Rattus norvegicus
gggattaccatgtgttcgaagccag

SEQ ID NO: 452918 - DNA, 25 bp, Rattus norvegicus
gggattacccacaatgatgtcctgt

SEQ ID NO: 452919 - DNA, 25 bp, Rattus norvegicus
gggattacccactatgatgtcctgt

SEQ ID NO: 452920 - DNA, 25 bp, Rattus norvegicus
gggattacctcactgtcaaggtctg

SEQ ID NO: 452921 - DNA, 25 bp, Rattus norvegicus
gggattacctcagtgtcaaggtctg

SEQ ID NO: 452922 - DNA, 25 bp, Rattus norvegicus
gggattacgggcatgcgtcatcatg

SEQ ID NO: 452923 - DNA, 25 bp, Rattus norvegicus
gggattacgggcttgcgtcatcatg

SEQ ID NO: 452924 - DNA, 25 bp, Rattus norvegicus
gggattactcaaatgcacctacctg

SEQ ID NO: 452925 - DNA, 25 bp, Rattus norvegicus
gggattactcaacgacacccagtcc

SEQ ID NO: 452926 - DNA, 25 bp, Rattus norvegicus
gggattactcaaggacacccagtcc

SEQ ID NO: 452927 - DNA, 25 bp, Rattus norvegicus
gggattactcaattgcacctacctg

SEQ ID NO: 452928 - DNA, 25 bp, Rattus norvegicus
gggattagagtcatcttgtagccaa

SEQ ID NO: 452929 - DNA, 25 bp, Rattus norvegicus
gggattagagtcttcttgtagccaa

SEQ ID NO: 452930 - DNA, 25 bp, Rattus norvegicus
gggattagctagatgccgcaagttc

SEQ ID NO: 452931 - DNA, 25 bp, Rattus norvegicus
gggattagctagttgccgcaagttc

SEQ ID NO: 452932 - DNA, 25 bp, Rattus norvegicus
gggattagctcaactcgccgcgagg

SEQ ID NO: 452933 - DNA, 25 bp, Rattus norvegicus
gggattagctcatctcgccgcgagg

SEQ ID NO: 452934 - DNA, 25 bp, Rattus norvegicus
gggattagctctatctgacaccttc

SEQ ID NO: 452935 - DNA, 25 bp, Rattus norvegicus
gggattagctctttctgacaccttc

SEQ ID NO: 452936 - DNA, 25 bp, Rattus norvegicus
gggattagcttcagtaactattgag

SEQ ID NO: 452937 - DNA, 25 bp, Rattus norvegicus
gggattagcttctgtaactattgag

SEQ ID NO: 452938 - DNA, 25 bp, Rattus norvegicus
gggattagctttctgatcgtcctac

SEQ ID NO: 452939 - DNA, 25 bp, Rattus norvegicus
gggattagctttgtgatcgtcctac

SEQ ID NO: 452940 - DNA, 25 bp, Rattus norvegicus
gggattataggcctgtacctcattt

SEQ ID NO: 452941 - DNA, 25 bp, Rattus norvegicus
gggattataggcgtgtacctcattt

SEQ ID NO: 452942 - DNA, 25 bp, Rattus norvegicus
gggattatattcatgtttgcttagc

SEQ ID NO: 452943 - DNA, 25 bp, Rattus norvegicus
gggattatattcttgtttgcttagc

SEQ ID NO: 452944 - DNA, 25 bp, Rattus norvegicus
gggattatcatgatgactgccaaat

SEQ ID NO: 452945 - DNA, 25 bp, Rattus norvegicus
gggattatcatgttgactgccaaat

SEQ ID NO: 452946 - DNA, 25 bp, Rattus norvegicus
gggattatgcctatatctagaacca

SEQ ID NO: 452947 - DNA, 25 bp, Rattus norvegicus
gggattatgcctttatctagaacca

SEQ ID NO: 452948 - DNA, 25 bp, Rattus norvegicus
gggattatgcgcatccaagttgata

SEQ ID NO: 452949 - DNA, 25 bp, Rattus norvegicus
gggattatgcgcttccaagttgata

SEQ ID NO: 452950 - DNA, 25 bp, Rattus norvegicus
gggattatgtgtcagatttctcttt

SEQ ID NO: 452951 - DNA, 25 bp, Rattus norvegicus
gggattatgtgtgagatttctcttt

SEQ ID NO: 452952 - DNA, 25 bp, Rattus norvegicus
gggattattattccaattattatga

SEQ ID NO: 452953 - DNA, 25 bp, Rattus norvegicus
gggattattattgcaattattatga

SEQ ID NO: 452954 - DNA, 25 bp, Rattus norvegicus
gggattattcagaacagtggctagt

SEQ ID NO: 452955 - DNA, 25 bp, Rattus norvegicus
gggattattcagtacagtggctagt

SEQ ID NO: 452956 - DNA, 25 bp, Rattus norvegicus
gggattattggcatatgccaccaca

SEQ ID NO: 452957 - DNA, 25 bp, Rattus norvegicus
gggattattggcttatgccaccaca

SEQ ID NO: 452958 - DNA, 25 bp, Rattus norvegicus
gggattcaacaaagctggactttta

SEQ ID NO: 452959 - DNA, 25 bp, Rattus norvegicus
gggattcaacaatgctggactttta

SEQ ID NO: 452960 - DNA, 25 bp, Rattus norvegicus
gggattcaagccaaggtcttctaac

SEQ ID NO: 452961 - DNA, 25 bp, Rattus norvegicus
gggattcaagcctaggtcttctaac

SEQ ID NO: 452962 - DNA, 25 bp, Rattus norvegicus
gggattcaaggcatgtacggcaact

SEQ ID NO: 452963 - DNA, 25 bp, Rattus norvegicus
gggattcaaggcttgtacggcaact

SEQ ID NO: 452964 - DNA, 25 bp, Rattus norvegicus
gggattcaaggtcagcatcgtctac

SEQ ID NO: 452965 - DNA, 25 bp, Rattus norvegicus
gggattcaaggtgagcatcgtctac

SEQ ID NO: 452966 - DNA, 25 bp, Rattus norvegicus
gggattcacaatccagggaccctca

SEQ ID NO: 452967 - DNA, 25 bp, Rattus norvegicus
gggattcacaatgcagggaccctca

SEQ ID NO: 452968 - DNA, 25 bp, Rattus norvegicus
gggattcacatcaagacctccacgg

SEQ ID NO: 452969 - DNA, 25 bp, Rattus norvegicus
gggattcacatctagacctccacgg

SEQ ID NO: 452970 - DNA, 25 bp, Rattus norvegicus
gggattcactccaaagaaccactta

SEQ ID NO: 452971 - DNA, 25 bp, Rattus norvegicus
gggattcactcctaagaaccactta

SEQ ID NO: 452972 - DNA, 25 bp, Rattus norvegicus
gggattcagactcaggtaaccatgc

SEQ ID NO: 452973 - DNA, 25 bp, Rattus norvegicus
gggattcagactgaggtaaccatgc

SEQ ID NO: 452974 - DNA, 25 bp, Rattus norvegicus
gggattcagcacacaggcgcagcag

SEQ ID NO: 452975 - DNA, 25 bp, Rattus norvegicus
gggattcagcactcaggcgcagcag

SEQ ID NO: 452976 - DNA, 25 bp, Rattus norvegicus
gggattcaggatacccacagaacat

SEQ ID NO: 452977 - DNA, 25 bp, Rattus norvegicus
gggattcaggattcccacagaacat

SEQ ID NO: 452978 - DNA, 25 bp, Rattus norvegicus
gggattcagggacccgtcaccactt

SEQ ID NO: 452979 - DNA, 25 bp, Rattus norvegicus
gggattcagggagccgtcaccactt

SEQ ID NO: 452980 - DNA, 25 bp, Rattus norvegicus
gggattcaggtgcatgtcaccgttc

SEQ ID NO: 452981 - DNA, 25 bp, Rattus norvegicus
gggattcaggtggatgtcaccgttc

SEQ ID NO: 452982 - DNA, 25 bp, Rattus norvegicus
gggattcagtatccacacattaaat

SEQ ID NO: 452983 - DNA, 25 bp, Rattus norvegicus
gggattcagtatgcacacattaaat

SEQ ID NO: 452984 - DNA, 25 bp, Rattus norvegicus
gggattcattcaaatcttcctgcac

SEQ ID NO: 452985 - DNA, 25 bp, Rattus norvegicus
gggattcattcatatcttcctgcac

SEQ ID NO: 452986 - DNA, 25 bp, Rattus norvegicus
gggattccacacagcatcgatccag

SEQ ID NO: 452987 - DNA, 25 bp, Rattus norvegicus
gggattccacaccagcaagacaaaa

SEQ ID NO: 452988 - DNA, 25 bp, Rattus norvegicus
gggattccacacgagcaagacaaaa

SEQ ID NO: 452989 - DNA, 25 bp, Rattus norvegicus
gggattccacactgcatcgatccag

SEQ ID NO: 452990 - DNA, 25 bp, Rattus norvegicus
gggattccagaacggagcccagatg

SEQ ID NO: 452991 - DNA, 25 bp, Rattus norvegicus
gggattccagaagggagcccagatg

SEQ ID NO: 452992 - DNA, 25 bp, Rattus norvegicus
gggattccagcaatcacgagccttt

SEQ ID NO: 452993 - DNA, 25 bp, Rattus norvegicus
gggattccagcattcacgagccttt

SEQ ID NO: 452994 - DNA, 25 bp, Rattus norvegicus
gggattccaggcacattcacatagg

SEQ ID NO: 452995 - DNA, 25 bp, Rattus norvegicus
gggattccaggctcattcacatagg

SEQ ID NO: 452996 - DNA, 25 bp, Rattus norvegicus
gggattccaggtcccttactataaa

SEQ ID NO: 452997 - DNA, 25 bp, Rattus norvegicus
gggattccaggtgccttactataaa

SEQ ID NO: 452998 - DNA, 25 bp, Rattus norvegicus
gggattccatggagatcaccaaaaa

SEQ ID NO: 452999 - DNA, 25 bp, Rattus norvegicus
gggattccatggtgatcaccaaaaa

SEQ ID NO: 453000 - DNA, 25 bp, Rattus norvegicus
gggattccatgtcccgacagacatt

SEQ ID NO: 453001 - DNA, 25 bp, Rattus norvegicus
gggattccatgtgccgacagacatt

SEQ ID NO: 453002 - DNA, 25 bp, Rattus norvegicus
gggattccattgcagaccagatcaa

SEQ ID NO: 453003 - DNA, 25 bp, Rattus norvegicus
gggattccattggagaccagatcaa

SEQ ID NO: 453004 - DNA, 25 bp, Rattus norvegicus
gggattcccacaacaaagaaaagct

SEQ ID NO: 453005 - DNA, 25 bp, Rattus norvegicus
gggattcccacatcaaagaaaagct

SEQ ID NO: 453006 - DNA, 25 bp, Rattus norvegicus
gggattcccaggacttaaatctgtc

SEQ ID NO: 453007 - DNA, 25 bp, Rattus norvegicus
gggattcccaggtcttaaatctgtc

SEQ ID NO: 453008 - DNA, 25 bp, Rattus norvegicus
gggattcccagtcttgtagggtcaa

SEQ ID NO: 453009 - DNA, 25 bp, Rattus norvegicus
gggattcccagtgttgtagggtcaa

SEQ ID NO: 453010 - DNA, 25 bp, Rattus norvegicus
gggattcccatcactattagtttgc

SEQ ID NO: 453011 - DNA, 25 bp, Rattus norvegicus
gggattcccatctctattagtttgc

SEQ ID NO: 453012 - DNA, 25 bp, Rattus norvegicus
gggattcccgatcaactgtctgagg

SEQ ID NO: 453013 - DNA, 25 bp, Rattus norvegicus
gggattcccgatgaactgtctgagg

SEQ ID NO: 453014 - DNA, 25 bp, Rattus norvegicus
gggattccctcaacagcgatgaagg

SEQ ID NO: 453015 - DNA, 25 bp, Rattus norvegicus
gggattccctcatcagcgatgaagg

SEQ ID NO: 453016 - DNA, 25 bp, Rattus norvegicus
gggattccgaatcactacatagttt

SEQ ID NO: 453017 - DNA, 25 bp, Rattus norvegicus
gggattccgaatgactacatagttt

SEQ ID NO: 453018 - DNA, 25 bp, Rattus norvegicus
gggattccgataccgatgccagcag

SEQ ID NO: 453019 - DNA, 25 bp, Rattus norvegicus
gggattccgatagcgatgccagcag

SEQ ID NO: 453020 - DNA, 25 bp, Rattus norvegicus
gggattcctaggacaccagtagttc

SEQ ID NO: 453021 - DNA, 25 bp, Rattus norvegicus
gggattcctaggtcaccagtagttc

SEQ ID NO: 453022 - DNA, 25 bp, Rattus norvegicus
gggattcctcttagttgtcacccag

SEQ ID NO: 453023 - DNA, 25 bp, Rattus norvegicus
gggattcctctttgttgtcacccag

SEQ ID NO: 453024 - DNA, 25 bp, Rattus norvegicus
gggattcctggtatgtgtaagcaga

SEQ ID NO: 453025 - DNA, 25 bp, Rattus norvegicus
gggattcctggtttgtgtaagcaga

SEQ ID NO: 453026 - DNA, 25 bp, Rattus norvegicus
gggattcctgttagcctgtatctcc

SEQ ID NO: 453027 - DNA, 25 bp, Rattus norvegicus
gggattcctgtttgcctgtatctcc

SEQ ID NO: 453028 - DNA, 25 bp, Rattus norvegicus
gggattccttgaatctttcaaccag

SEQ ID NO: 453029 - DNA, 25 bp, Rattus norvegicus
gggattccttgattctttcaaccag

SEQ ID NO: 453030 - DNA, 25 bp, Rattus norvegicus
gggattcctttgagctcattatgta

SEQ ID NO: 453031 - DNA, 25 bp, Rattus norvegicus
gggattcctttgtgctcattatgta

SEQ ID NO: 453032 - DNA, 25 bp, Rattus norvegicus
gggattcgatgcactttactgtcct

SEQ ID NO: 453033 - DNA, 25 bp, Rattus norvegicus
gggattcgatgctctttactgtcct

SEQ ID NO: 453034 - DNA, 25 bp, Rattus norvegicus
gggattcgccttaggatattatcta

SEQ ID NO: 453035 - DNA, 25 bp, Rattus norvegicus
gggattcgcctttggatattatcta

SEQ ID NO: 453036 - DNA, 25 bp, Rattus norvegicus
gggattcggctaccagaaaacaaag

SEQ ID NO: 453037 - DNA, 25 bp, Rattus norvegicus
gggattcggctagcagaaaacaaag

SEQ ID NO: 453038 - DNA, 25 bp, Rattus norvegicus
gggattcggtccagtttgaacaaca

SEQ ID NO: 453039 - DNA, 25 bp, Rattus norvegicus
gggattcggtcctgtttgaacaaca

SEQ ID NO: 453040 - DNA, 25 bp, Rattus norvegicus
gggattcgtcatctatgcatcaact

SEQ ID NO: 453041 - DNA, 25 bp, Rattus norvegicus
gggattcgtcatgtatgcatcaact

SEQ ID NO: 453042 - DNA, 25 bp, Rattus norvegicus
gggattctactgcacattttctttt

SEQ ID NO: 453043 - DNA, 25 bp, Rattus norvegicus
gggattctactggacattttctttt

SEQ ID NO: 453044 - DNA, 25 bp, Rattus norvegicus
gggattctagttactaagtcaatca

SEQ ID NO: 453045 - DNA, 25 bp, Rattus norvegicus
gggattctagtttctaagtcaatca

SEQ ID NO: 453046 - DNA, 25 bp, Rattus norvegicus
gggattctatctatatttctcttca

SEQ ID NO: 453047 - DNA, 25 bp, Rattus norvegicus
gggattctatctttatttctcttca

SEQ ID NO: 453048 - DNA, 25 bp, Rattus norvegicus
gggattctcagactcctgtggacac

SEQ ID NO: 453049 - DNA, 25 bp, Rattus norvegicus
gggattctcagagtcctgtggacac

SEQ ID NO: 453050 - DNA, 25 bp, Rattus norvegicus
gggattctccctccgcagtcacaaa

SEQ ID NO: 453051 - DNA, 25 bp, Rattus norvegicus
gggattctccctgcgcagtcacaaa

SEQ ID NO: 453052 - DNA, 25 bp, Rattus norvegicus
gggattctccttcttagctgtggtc

SEQ ID NO: 453053 - DNA, 25 bp, Rattus norvegicus
gggattctccttgttagctgtggtc

SEQ ID NO: 453054 - DNA, 25 bp, Rattus norvegicus
gggattctctaaattcatggcctgg

SEQ ID NO: 453055 - DNA, 25 bp, Rattus norvegicus
gggattctctaatttcatggcctgg

SEQ ID NO: 453056 - DNA, 25 bp, Rattus norvegicus
gggattctcttcatgaaatgctcat

SEQ ID NO: 453057 - DNA, 25 bp, Rattus norvegicus
gggattctcttcttgaaatgctcat

SEQ ID NO: 453058 - DNA, 25 bp, Rattus norvegicus
gggattctgaaacccagcaatgcta

SEQ ID NO: 453059 - DNA, 25 bp, Rattus norvegicus
gggattctgaaagccagcaatgcta

SEQ ID NO: 453060 - DNA, 25 bp, Rattus norvegicus
gggattctgaccatttatacctcat

SEQ ID NO: 453061 - DNA, 25 bp, Rattus norvegicus
gggattctgaccttttatacctcat

SEQ ID NO: 453062 - DNA, 25 bp, Rattus norvegicus
gggattctggctaaatacctcggat

SEQ ID NO: 453063 - DNA, 25 bp, Rattus norvegicus
gggattctggctctcgtctaaagag

SEQ ID NO: 453064 - DNA, 25 bp, Rattus norvegicus
gggattctggctgtcgtctaaagag

SEQ ID NO: 453065 - DNA, 25 bp, Rattus norvegicus
gggattctggcttaatacctcggat

SEQ ID NO: 453066 - DNA, 25 bp, Rattus norvegicus
gggattctgtatctcctgcattgtt

SEQ ID NO: 453067 - DNA, 25 bp, Rattus norvegicus
gggattctgtatgtcctgcattgtt

SEQ ID NO: 453068 - DNA, 25 bp, Rattus norvegicus
gggattcttctgagtcgagcagtga

SEQ ID NO: 453069 - DNA, 25 bp, Rattus norvegicus
gggattcttctgtgtcgagcagtga

SEQ ID NO: 453070 - DNA, 25 bp, Rattus norvegicus
gggattcttcttattcttgtttctt

SEQ ID NO: 453071 - DNA, 25 bp, Rattus norvegicus
gggattcttctttttcttgtttctt

SEQ ID NO: 453072 - DNA, 25 bp, Rattus norvegicus
gggattcttgcaatcgcccaataga

SEQ ID NO: 453073 - DNA, 25 bp, Rattus norvegicus
gggattcttgcattcgcccaataga

SEQ ID NO: 453074 - DNA, 25 bp, Rattus norvegicus
gggattgaaccgacccaactacctg

SEQ ID NO: 453075 - DNA, 25 bp, Rattus norvegicus
gggattgaaccgtcccaactacctg

SEQ ID NO: 453076 - DNA, 25 bp, Rattus norvegicus
gggattgaactcagagcctcatgca

SEQ ID NO: 453077 - DNA, 25 bp, Rattus norvegicus
gggattgaactctgagcctcatgca

SEQ ID NO: 453078 - DNA, 25 bp, Rattus norvegicus
gggattgaactgaaccactgataat

SEQ ID NO: 453079 - DNA, 25 bp, Rattus norvegicus
gggattgaactgtaccactgataat

SEQ ID NO: 453080 - DNA, 25 bp, Rattus norvegicus
gggattgaacttatgctgtgaggct

SEQ ID NO: 453081 - DNA, 25 bp, Rattus norvegicus
gggattgaacttttgctgtgaggct

SEQ ID NO: 453082 - DNA, 25 bp, Rattus norvegicus
gggattgaaggcctccaccccatgc

SEQ ID NO: 453083 - DNA, 25 bp, Rattus norvegicus
gggattgaaggcgtccaccccatgc

SEQ ID NO: 453084 - DNA, 25 bp, Rattus norvegicus
gggattgacgatctcttctggcctt

SEQ ID NO: 453085 - DNA, 25 bp, Rattus norvegicus
gggattgacgatgtcttctggcctt

SEQ ID NO: 453086 - DNA, 25 bp, Rattus norvegicus
gggattgactcactagcttgactca

SEQ ID NO: 453087 - DNA, 25 bp, Rattus norvegicus
gggattgactcagtagcttgactca

SEQ ID NO: 453088 - DNA, 25 bp, Rattus norvegicus
gggattgactgacttgagacctcac

SEQ ID NO: 453089 - DNA, 25 bp, Rattus norvegicus
gggattgactgagttgagacctcac

SEQ ID NO: 453090 - DNA, 25 bp, Rattus norvegicus
gggattgactttatgccaggcttgt

SEQ ID NO: 453091 - DNA, 25 bp, Rattus norvegicus
gggattgactttttgccaggcttgt

SEQ ID NO: 453092 - DNA, 25 bp, Rattus norvegicus
gggattgatagcaaccaggtttcta

SEQ ID NO: 453093 - DNA, 25 bp, Rattus norvegicus
gggattgatagctaccaggtttcta

SEQ ID NO: 453094 - DNA, 25 bp, Rattus norvegicus
gggattgatctgagtgccctgccca

SEQ ID NO: 453095 - DNA, 25 bp, Rattus norvegicus
gggattgatctgtgtgccctgccca

SEQ ID NO: 453096 - DNA, 25 bp, Rattus norvegicus
gggattgatggcacaggcagctttc

SEQ ID NO: 453097 - DNA, 25 bp, Rattus norvegicus
gggattgatggctcaggcagctttc

SEQ ID NO: 453098 - DNA, 25 bp, Rattus norvegicus
gggattgcaattactactttcatag

SEQ ID NO: 453099 - DNA, 25 bp, Rattus norvegicus
gggattgcaatttctactttcatag

SEQ ID NO: 453100 - DNA, 25 bp, Rattus norvegicus
gggattgcaccacgcctaggataaa

SEQ ID NO: 453101 - DNA, 25 bp, Rattus norvegicus
gggattgcaccaggcctaggataaa

SEQ ID NO: 453102 - DNA, 25 bp, Rattus norvegicus
gggattgcaccccatttggtattca

SEQ ID NO: 453103 - DNA, 25 bp, Rattus norvegicus
gggattgcacccgatttggtattca

SEQ ID NO: 453104 - DNA, 25 bp, Rattus norvegicus
gggattgcaggcagatgacacacct

SEQ ID NO: 453105 - DNA, 25 bp, Rattus norvegicus
gggattgcaggctgatgacacacct

SEQ ID NO: 453106 - DNA, 25 bp, Rattus norvegicus
gggattgcataactcgctcaccgat

SEQ ID NO: 453107 - DNA, 25 bp, Rattus norvegicus
gggattgcataagtcgctcaccgat

SEQ ID NO: 453108 - DNA, 25 bp, Rattus norvegicus
gggattgcatatctgccctaactaa

SEQ ID NO: 453109 - DNA, 25 bp, Rattus norvegicus
gggattgcatatgtgccctaactaa

SEQ ID NO: 453110 - DNA, 25 bp, Rattus norvegicus
gggattgcatccaccattaaggttc

SEQ ID NO: 453111 - DNA, 25 bp, Rattus norvegicus
gggattgcatcctccattaaggttc

SEQ ID NO: 453112 - DNA, 25 bp, Rattus norvegicus
gggattgcatgacaccacgtaacct

SEQ ID NO: 453113 - DNA, 25 bp, Rattus norvegicus
gggattgcatgagaccacgtaacct

SEQ ID NO: 453114 - DNA, 25 bp, Rattus norvegicus
gggattgcattgatatccaccacta

SEQ ID NO: 453115 - DNA, 25 bp, Rattus norvegicus
gggattgcattgttatccaccacta

SEQ ID NO: 453116 - DNA, 25 bp, Rattus norvegicus
gggattgccagtagactactctgac

SEQ ID NO: 453117 - DNA, 25 bp, Rattus norvegicus
gggattgccagttgactactctgac

SEQ ID NO: 453118 - DNA, 25 bp, Rattus norvegicus
gggattgccccaaccaaagaaatct

SEQ ID NO: 453119 - DNA, 25 bp, Rattus norvegicus
gggattgccccatccaaagaaatct

SEQ ID NO: 453120 - DNA, 25 bp, Rattus norvegicus
gggattgccgatatatacttgctga

SEQ ID NO: 453121 - DNA, 25 bp, Rattus norvegicus
gggattgccgatttatacttgctga

SEQ ID NO: 453122 - DNA, 25 bp, Rattus norvegicus
gggattgcctgcagtatgacacatc

SEQ ID NO: 453123 - DNA, 25 bp, Rattus norvegicus
gggattgcctgctgtatgacacatc

SEQ ID NO: 453124 - DNA, 25 bp, Rattus norvegicus
gggattgctatcaacataactgagt

SEQ ID NO: 453125 - DNA, 25 bp, Rattus norvegicus
gggattgctatctacataactgagt

SEQ ID NO: 453126 - DNA, 25 bp, Rattus norvegicus
gggattgctggaccccattaacacg

SEQ ID NO: 453127 - DNA, 25 bp, Rattus norvegicus
gggattgctggagcccattaacacg

SEQ ID NO: 453128 - DNA, 25 bp, Rattus norvegicus
gggattgcttataacaccctgttac

SEQ ID NO: 453129 - DNA, 25 bp, Rattus norvegicus
gggattgcttattacaccctgttac

SEQ ID NO: 453130 - DNA, 25 bp, Rattus norvegicus
gggattggaccaatcaggctttctt

SEQ ID NO: 453131 - DNA, 25 bp, Rattus norvegicus
gggattggaccacagggcccactca

SEQ ID NO: 453132 - DNA, 25 bp, Rattus norvegicus
gggattggaccagagggcccactca

SEQ ID NO: 453133 - DNA, 25 bp, Rattus norvegicus
gggattggaccattcaggctttctt

SEQ ID NO: 453134 - DNA, 25 bp, Rattus norvegicus
gggattggactcagtgactcccagt

SEQ ID NO: 453135 - DNA, 25 bp, Rattus norvegicus
gggattggactctgtgactcccagt

SEQ ID NO: 453136 - DNA, 25 bp, Rattus norvegicus
gggattggcacacttaggtccttaa

SEQ ID NO: 453137 - DNA, 25 bp, Rattus norvegicus
gggattggcacagttaggtccttaa

SEQ ID NO: 453138 - DNA, 25 bp, Rattus norvegicus
gggattgggttcctgaatgcaccat

SEQ ID NO: 453139 - DNA, 25 bp, Rattus norvegicus
gggattgggttcgtgaatgcaccat

SEQ ID NO: 453140 - DNA, 25 bp, Rattus norvegicus
gggattgggtttacagcaccttgaa

SEQ ID NO: 453141 - DNA, 25 bp, Rattus norvegicus
gggattgggttttcagcaccttgaa

SEQ ID NO: 453142 - DNA, 25 bp, Rattus norvegicus
gggattggtataccgcgctaacaaa

SEQ ID NO: 453143 - DNA, 25 bp, Rattus norvegicus
gggattggtatagcgcgctaacaaa

SEQ ID NO: 453144 - DNA, 25 bp, Rattus norvegicus
gggattggtcgcaatgcgttgtcat

SEQ ID NO: 453145 - DNA, 25 bp, Rattus norvegicus
gggattggtcgctatgcgttgtcat

SEQ ID NO: 453146 - DNA, 25 bp, Rattus norvegicus
gggattggttgtccttggcatcaat

SEQ ID NO: 453147 - DNA, 25 bp, Rattus norvegicus
gggattggttgtgcttggcatcaat

SEQ ID NO: 453148 - DNA, 25 bp, Rattus norvegicus
gggattgtcaccattatgaaactaa

SEQ ID NO: 453149 - DNA, 25 bp, Rattus norvegicus
gggattgtcacctttatgaaactaa

SEQ ID NO: 453150 - DNA, 25 bp, Rattus norvegicus
gggattgtcagcagtaccaagcact

SEQ ID NO: 453151 - DNA, 25 bp, Rattus norvegicus
gggattgtcagctgtaccaagcact

SEQ ID NO: 453152 - DNA, 25 bp, Rattus norvegicus
gggattgtcgcaccagcagctctgt

SEQ ID NO: 453153 - DNA, 25 bp, Rattus norvegicus
gggattgtcgcagcagcagctctgt

SEQ ID NO: 453154 - DNA, 25 bp, Rattus norvegicus
gggattgtctccaagaacttcacca

SEQ ID NO: 453155 - DNA, 25 bp, Rattus norvegicus
gggattgtctcctagaacttcacca

SEQ ID NO: 453156 - DNA, 25 bp, Rattus norvegicus
gggattgtgctaaggaacgtcttta

SEQ ID NO: 453157 - DNA, 25 bp, Rattus norvegicus
gggattgtgctatggaacgtcttta

SEQ ID NO: 453158 - DNA, 25 bp, Rattus norvegicus
gggattgtgtctacatctggcactc

SEQ ID NO: 453159 - DNA, 25 bp, Rattus norvegicus
gggattgtgtcttcatctggcactc

SEQ ID NO: 453160 - DNA, 25 bp, Rattus norvegicus
gggattgtgttaatgttctctcagt

SEQ ID NO: 453161 - DNA, 25 bp, Rattus norvegicus
gggattgtgttattgttctctcagt

SEQ ID NO: 453162 - DNA, 25 bp, Rattus norvegicus
gggattgtgttcagcaactccatat

SEQ ID NO: 453163 - DNA, 25 bp, Rattus norvegicus
gggattgtgttctgcaactccatat

SEQ ID NO: 453164 - DNA, 25 bp, Rattus norvegicus
gggattgttacaactgcacaagagt

SEQ ID NO: 453165 - DNA, 25 bp, Rattus norvegicus
gggattgttacatctgcacaagagt

SEQ ID NO: 453166 - DNA, 25 bp, Rattus norvegicus
gggattgttctacctgcaactacct

SEQ ID NO: 453167 - DNA, 25 bp, Rattus norvegicus
gggattgttctagctgcaactacct

SEQ ID NO: 453168 - DNA, 25 bp, Rattus norvegicus
gggattgtttaccagcacctgcagt

SEQ ID NO: 453169 - DNA, 25 bp, Rattus norvegicus
gggattgtttacgagcacctgcagt

SEQ ID NO: 453170 - DNA, 25 bp, Rattus norvegicus
gggattgtttcaattctcatgttaa

SEQ ID NO: 453171 - DNA, 25 bp, Rattus norvegicus
gggattgtttcatttctcatgttaa

SEQ ID NO: 453172 - DNA, 25 bp, Rattus norvegicus
gggatttaaattatctgcacgaatg

SEQ ID NO: 453173 - DNA, 25 bp, Rattus norvegicus
gggatttaaattttctgcacgaatg

SEQ ID NO: 453174 - DNA, 25 bp, Rattus norvegicus
gggatttaacttcggtcatgtgaaa

SEQ ID NO: 453175 - DNA, 25 bp, Rattus norvegicus
gggatttaacttgggtcatgtgaaa

SEQ ID NO: 453176 - DNA, 25 bp, Rattus norvegicus
gggatttacaccaactcattgaaag

SEQ ID NO: 453177 - DNA, 25 bp, Rattus norvegicus
gggatttacacctactcattgaaag

SEQ ID NO: 453178 - DNA, 25 bp, Rattus norvegicus
gggatttacagaacttttgcacttt

SEQ ID NO: 453179 - DNA, 25 bp, Rattus norvegicus
gggatttacagatcttttgcacttt

SEQ ID NO: 453180 - DNA, 25 bp, Rattus norvegicus
gggatttacagtccaatgtactcag

SEQ ID NO: 453181 - DNA, 25 bp, Rattus norvegicus
gggatttacagtgcaatgtactcag

SEQ ID NO: 453182 - DNA, 25 bp, Rattus norvegicus
gggatttagatcaccaagctcagtt

SEQ ID NO: 453183 - DNA, 25 bp, Rattus norvegicus
gggatttagatctccaagctcagtt

SEQ ID NO: 453184 - DNA, 25 bp, Rattus norvegicus
gggatttaggctacagaggcaaact

SEQ ID NO: 453185 - DNA, 25 bp, Rattus norvegicus
gggatttaggcttcagaggcaaact

SEQ ID NO: 453186 - DNA, 25 bp, Rattus norvegicus
gggatttagggcctcacaaacacac

SEQ ID NO: 453187 - DNA, 25 bp, Rattus norvegicus
gggatttagggcgtcacaaacacac

SEQ ID NO: 453188 - DNA, 25 bp, Rattus norvegicus
gggatttatcagagaccggtgtcat

SEQ ID NO: 453189 - DNA, 25 bp, Rattus norvegicus
gggatttatcagtgaccggtgtcat

SEQ ID NO: 453190 - DNA, 25 bp, Rattus norvegicus
gggatttatcctattcacttggaca

SEQ ID NO: 453191 - DNA, 25 bp, Rattus norvegicus
gggatttatccttttcacttggaca

SEQ ID NO: 453192 - DNA, 25 bp, Rattus norvegicus
gggatttatgatcccctttttgata

SEQ ID NO: 453193 - DNA, 25 bp, Rattus norvegicus
gggatttatgatgccctttttgata

SEQ ID NO: 453194 - DNA, 25 bp, Rattus norvegicus
gggatttattccacatacaacttat

SEQ ID NO: 453195 - DNA, 25 bp, Rattus norvegicus
gggatttattcctcatacaacttat

SEQ ID NO: 453196 - DNA, 25 bp, Rattus norvegicus
gggatttcacaaagctgctaacgat

SEQ ID NO: 453197 - DNA, 25 bp, Rattus norvegicus
gggatttcacaatgctgctaacgat

SEQ ID NO: 453198 - DNA, 25 bp, Rattus norvegicus
gggatttcaccacaaaaggccgagg

SEQ ID NO: 453199 - DNA, 25 bp, Rattus norvegicus
gggatttcaccagaaaaggccgagg

SEQ ID NO: 453200 - DNA, 25 bp, Rattus norvegicus
gggatttcaggtcggctctaccatc

SEQ ID NO: 453201 - DNA, 25 bp, Rattus norvegicus
gggatttcaggtgggctctaccatc

SEQ ID NO: 453202 - DNA, 25 bp, Rattus norvegicus
gggatttccaatattttcatgtgta

SEQ ID NO: 453203 - DNA, 25 bp, Rattus norvegicus
gggatttccaattttttcatgtgta

SEQ ID NO: 453204 - DNA, 25 bp, Rattus norvegicus
gggatttccactatacagcaatgta

SEQ ID NO: 453205 - DNA, 25 bp, Rattus norvegicus
gggatttccactttacagcaatgta

SEQ ID NO: 453206 - DNA, 25 bp, Rattus norvegicus
gggatttccattaacctcactttgg

SEQ ID NO: 453207 - DNA, 25 bp, Rattus norvegicus
gggatttccatttacctcactttgg

SEQ ID NO: 453208 - DNA, 25 bp, Rattus norvegicus
gggatttcccatattgagtattttg

SEQ ID NO: 453209 - DNA, 25 bp, Rattus norvegicus
gggatttcccattttgagtattttg

SEQ ID NO: 453210 - DNA, 25 bp, Rattus norvegicus
gggatttcccttcttgcccaatctt

SEQ ID NO: 453211 - DNA, 25 bp, Rattus norvegicus
gggatttcccttgttgcccaatctt

SEQ ID NO: 453212 - DNA, 25 bp, Rattus norvegicus
gggatttcgcaaatcctgaaacctt

SEQ ID NO: 453213 - DNA, 25 bp, Rattus norvegicus
gggatttcgcaattcctgaaacctt

SEQ ID NO: 453214 - DNA, 25 bp, Rattus norvegicus
gggatttcgcctcttttgaatttca

SEQ ID NO: 453215 - DNA, 25 bp, Rattus norvegicus
gggatttcgcctgttttgaatttca

SEQ ID NO: 453216 - DNA, 25 bp, Rattus norvegicus
gggatttctaatcccatcatctctg

SEQ ID NO: 453217 - DNA, 25 bp, Rattus norvegicus
gggatttctaatgccatcatctctg

SEQ ID NO: 453218 - DNA, 25 bp, Rattus norvegicus
gggatttctattcagaggtacctgt

SEQ ID NO: 453219 - DNA, 25 bp, Rattus norvegicus
gggatttctattgagaggtacctgt

SEQ ID NO: 453220 - DNA, 25 bp, Rattus norvegicus
gggatttctcacacaaaggcttcac

SEQ ID NO: 453221 - DNA, 25 bp, Rattus norvegicus
gggatttctcactcaaaggcttcac

SEQ ID NO: 453222 - DNA, 25 bp, Rattus norvegicus
gggatttctctcaatcatcaggaac

SEQ ID NO: 453223 - DNA, 25 bp, Rattus norvegicus
gggatttctctctatcatcaggaac

SEQ ID NO: 453224 - DNA, 25 bp, Rattus norvegicus
gggatttctctgatgtaatatacta

SEQ ID NO: 453225 - DNA, 25 bp, Rattus norvegicus
gggatttctctgttgtaatatacta

SEQ ID NO: 453226 - DNA, 25 bp, Rattus norvegicus
gggatttcttaaagtctccattctg

SEQ ID NO: 453227 - DNA, 25 bp, Rattus norvegicus
gggatttcttaatgtctccattctg

SEQ ID NO: 453228 - DNA, 25 bp, Rattus norvegicus
gggatttcttatactgtcccaaatg

SEQ ID NO: 453229 - DNA, 25 bp, Rattus norvegicus
gggatttcttattctgtcccaaatg

SEQ ID NO: 453230 - DNA, 25 bp, Rattus norvegicus
gggatttcttcaaccggcagatcca

SEQ ID NO: 453231 - DNA, 25 bp, Rattus norvegicus
gggatttcttcatccggcagatcca

SEQ ID NO: 453232 - DNA, 25 bp, Rattus norvegicus
gggatttgaaccatctgccttctac

SEQ ID NO: 453233 - DNA, 25 bp, Rattus norvegicus
gggatttgaaccttctgccttctac

SEQ ID NO: 453234 - DNA, 25 bp, Rattus norvegicus
gggatttgaatccaatacatttcca

SEQ ID NO: 453235 - DNA, 25 bp, Rattus norvegicus
gggatttgaatcgaatacatttcca

SEQ ID NO: 453236 - DNA, 25 bp, Rattus norvegicus
gggatttgaatgacttgctgcttta

SEQ ID NO: 453237 - DNA, 25 bp, Rattus norvegicus
gggatttgaatgtcttgctgcttta

SEQ ID NO: 453238 - DNA, 25 bp, Rattus norvegicus
gggatttgagtcaaccctgccagcc

SEQ ID NO: 453239 - DNA, 25 bp, Rattus norvegicus
gggatttgagtctaccctgccagcc

SEQ ID NO: 453240 - DNA, 25 bp, Rattus norvegicus
gggatttgatcaacttagtgtcagt

SEQ ID NO: 453241 - DNA, 25 bp, Rattus norvegicus
gggatttgatcatcttagtgtcagt

SEQ ID NO: 453242 - DNA, 25 bp, Rattus norvegicus
gggatttgcaccacatagcaggtca

SEQ ID NO: 453243 - DNA, 25 bp, Rattus norvegicus
gggatttgcaccagttgggcatcat

SEQ ID NO: 453244 - DNA, 25 bp, Rattus norvegicus
gggatttgcacctcatagcaggtca

SEQ ID NO: 453245 - DNA, 25 bp, Rattus norvegicus
gggatttgcacctgttgggcatcat

SEQ ID NO: 453246 - DNA, 25 bp, Rattus norvegicus
gggatttgcatcatttctataccgt

SEQ ID NO: 453247 - DNA, 25 bp, Rattus norvegicus
gggatttgcatcttttctataccgt

SEQ ID NO: 453248 - DNA, 25 bp, Rattus norvegicus
gggatttgcttcattgtttgacatc

SEQ ID NO: 453249 - DNA, 25 bp, Rattus norvegicus
gggatttgcttctttgtttgacatc

SEQ ID NO: 453250 - DNA, 25 bp, Rattus norvegicus
gggatttggcgtcttctcagacaca

SEQ ID NO: 453251 - DNA, 25 bp, Rattus norvegicus
gggatttggcgtgttctcagacaca

SEQ ID NO: 453252 - DNA, 25 bp, Rattus norvegicus
gggatttggcttaagtcttcgagga

SEQ ID NO: 453253 - DNA, 25 bp, Rattus norvegicus
gggatttggctttagtcttcgagga

SEQ ID NO: 453254 - DNA, 25 bp, Rattus norvegicus
gggatttgtactcctagctgaccca

SEQ ID NO: 453255 - DNA, 25 bp, Rattus norvegicus
gggatttgtactgctagctgaccca

SEQ ID NO: 453256 - DNA, 25 bp, Rattus norvegicus
gggatttgtcaaccctggtaacata

SEQ ID NO: 453257 - DNA, 25 bp, Rattus norvegicus
gggatttgtcaagcctggtaacata

SEQ ID NO: 453258 - DNA, 25 bp, Rattus norvegicus
gggatttgtcccaacttgattaaag

SEQ ID NO: 453259 - DNA, 25 bp, Rattus norvegicus
gggatttgtccctacttgattaaag

SEQ ID NO: 453260 - DNA, 25 bp, Rattus norvegicus
gggatttgttttatagactcttgtt

SEQ ID NO: 453261 - DNA, 25 bp, Rattus norvegicus
gggatttgttttttagactcttgtt

SEQ ID NO: 453262 - DNA, 25 bp, Rattus norvegicus
gggattttaatcctcttccttgctg

SEQ ID NO: 453263 - DNA, 25 bp, Rattus norvegicus
gggattttaatcgtcttccttgctg

SEQ ID NO: 453264 - DNA, 25 bp, Rattus norvegicus
gggattttacctctatatcactgtc

SEQ ID NO: 453265 - DNA, 25 bp, Rattus norvegicus
gggattttacctgtatatcactgtc

SEQ ID NO: 453266 - DNA, 25 bp, Rattus norvegicus
gggattttactgatgctgggatttt

SEQ ID NO: 453267 - DNA, 25 bp, Rattus norvegicus
gggattttactgttgctgggatttt

SEQ ID NO: 453268 - DNA, 25 bp, Rattus norvegicus
gggattttagcccataaattcttat

SEQ ID NO: 453269 - DNA, 25 bp, Rattus norvegicus
gggattttagccgataaattcttat

SEQ ID NO: 453270 - DNA, 25 bp, Rattus norvegicus
gggattttcatgagttccagcccgg

SEQ ID NO: 453271 - DNA, 25 bp, Rattus norvegicus
gggattttcatgtgttccagcccgg

SEQ ID NO: 453272 - DNA, 25 bp, Rattus norvegicus
gggattttccatctgacttccctgg

SEQ ID NO: 453273 - DNA, 25 bp, Rattus norvegicus
gggattttccatgtgacttccctgg

SEQ ID NO: 453274 - DNA, 25 bp, Rattus norvegicus
gggattttccccagcatcgcggaat

SEQ ID NO: 453275 - DNA, 25 bp, Rattus norvegicus
gggattttcccctgcatcgcggaat

SEQ ID NO: 453276 - DNA, 25 bp, Rattus norvegicus
gggattttcctcattgagtcaacat

SEQ ID NO: 453277 - DNA, 25 bp, Rattus norvegicus
gggattttcctctttgagtcaacat

SEQ ID NO: 453278 - DNA, 25 bp, Rattus norvegicus
gggattttcttgcttaggttcactg

SEQ ID NO: 453279 - DNA, 25 bp, Rattus norvegicus
gggattttcttggttaggttcactg

SEQ ID NO: 453280 - DNA, 25 bp, Rattus norvegicus
gggattttctttaagggctctagag

SEQ ID NO: 453281 - DNA, 25 bp, Rattus norvegicus
gggattttcttttagggctctagag

SEQ ID NO: 453282 - DNA, 25 bp, Rattus norvegicus
gggattttgaaaatattagaagcat

SEQ ID NO: 453283 - DNA, 25 bp, Rattus norvegicus
gggattttgaaattattagaagcat

SEQ ID NO: 453284 - DNA, 25 bp, Rattus norvegicus
gggattttgccaagtctctgaccat

SEQ ID NO: 453285 - DNA, 25 bp, Rattus norvegicus
gggattttgccatgtctctgaccat

SEQ ID NO: 453286 - DNA, 25 bp, Rattus norvegicus
gggattttgccgaaccaagtaccag

SEQ ID NO: 453287 - DNA, 25 bp, Rattus norvegicus
gggattttgccgtaccaagtaccag

SEQ ID NO: 453288 - DNA, 25 bp, Rattus norvegicus
gggatttttagcagtgcctgtgatc

SEQ ID NO: 453289 - DNA, 25 bp, Rattus norvegicus
gggatttttagctgtgcctgtgatc

SEQ ID NO: 453290 - DNA, 25 bp, Rattus norvegicus
gggatttttcttcctagcagcaatt

SEQ ID NO: 453291 - DNA, 25 bp, Rattus norvegicus
gggatttttcttctatttatgactt

SEQ ID NO: 453292 - DNA, 25 bp, Rattus norvegicus
gggatttttcttgctagcagcaatt

SEQ ID NO: 453293 - DNA, 25 bp, Rattus norvegicus
gggatttttcttgtatttatgactt

SEQ ID NO: 453294 - DNA, 25 bp, Rattus norvegicus
gggatttttgtaacttcacgcctac

SEQ ID NO: 453295 - DNA, 25 bp, Rattus norvegicus
gggatttttgtatcttcacgcctac

SEQ ID NO: 453296 - DNA, 25 bp, Rattus norvegicus
gggattttttcacctaatgtgcagt

SEQ ID NO: 453297 - DNA, 25 bp, Rattus norvegicus
gggattttttcagctaatgtgcagt

SEQ ID NO: 453298 - DNA, 25 bp, Rattus norvegicus
gggcaaaaacagagacccacttgaa

SEQ ID NO: 453299 - DNA, 25 bp, Rattus norvegicus
gggcaaaaacagtgacccacttgaa

SEQ ID NO: 453300 - DNA, 25 bp, Rattus norvegicus
gggcaaaaactccacgctcggacgt

SEQ ID NO: 453301 - DNA, 25 bp, Rattus norvegicus
gggcaaaaactcgacgctcggacgt

SEQ ID NO: 453302 - DNA, 25 bp, Rattus norvegicus
gggcaaaacattccttctctggtca

SEQ ID NO: 453303 - DNA, 25 bp, Rattus norvegicus
gggcaaaacattgcttctctggtca

SEQ ID NO: 453304 - DNA, 25 bp, Rattus norvegicus
gggcaaaacctcaacagctggcaat

SEQ ID NO: 453305 - DNA, 25 bp, Rattus norvegicus
gggcaaaacctctacagctggcaat

SEQ ID NO: 453306 - DNA, 25 bp, Rattus norvegicus
gggcaaaactgaccatggctcctca

SEQ ID NO: 453307 - DNA, 25 bp, Rattus norvegicus
gggcaaaactgagcatggctcctca

SEQ ID NO: 453308 - DNA, 25 bp, Rattus norvegicus
gggcaaaactgcagaactaggctta

SEQ ID NO: 453309 - DNA, 25 bp, Rattus norvegicus
gggcaaaactgctgaactaggctta

SEQ ID NO: 453310 - DNA, 25 bp, Rattus norvegicus
gggcaaaactgtcacttcttacttc

SEQ ID NO: 453311 - DNA, 25 bp, Rattus norvegicus
gggcaaaactgtgacttcttacttc

SEQ ID NO: 453312 - DNA, 25 bp, Rattus norvegicus
gggcaaaagcctccatgacaaactg

SEQ ID NO: 453313 - DNA, 25 bp, Rattus norvegicus
gggcaaaagcctgcatgacaaactg

SEQ ID NO: 453314 - DNA, 25 bp, Rattus norvegicus
gggcaaaatctcactgtcctaaact

SEQ ID NO: 453315 - DNA, 25 bp, Rattus norvegicus
gggcaaaatctctctgtcctaaact

SEQ ID NO: 453316 - DNA, 25 bp, Rattus norvegicus
gggcaaaattttactactcatcttt

SEQ ID NO: 453317 - DNA, 25 bp, Rattus norvegicus
gggcaaaatttttctactcatcttt

SEQ ID NO: 453318 - DNA, 25 bp, Rattus norvegicus
gggcaaacaatgcatcctttttctt

SEQ ID NO: 453319 - DNA, 25 bp, Rattus norvegicus
gggcaaacaatggatcctttttctt

SEQ ID NO: 453320 - DNA, 25 bp, Rattus norvegicus
gggcaaacactaatattatcagtct

SEQ ID NO: 453321 - DNA, 25 bp, Rattus norvegicus
gggcaaacactattattatcagtct

SEQ ID NO: 453322 - DNA, 25 bp, Rattus norvegicus
gggcaaacactgaatacttgatgta

SEQ ID NO: 453323 - DNA, 25 bp, Rattus norvegicus
gggcaaacactgtatacttgatgta

SEQ ID NO: 453324 - DNA, 25 bp, Rattus norvegicus
gggcaaacaggcattcaatagtcag

SEQ ID NO: 453325 - DNA, 25 bp, Rattus norvegicus
gggcaaacaggctttcaatagtcag

SEQ ID NO: 453326 - DNA, 25 bp, Rattus norvegicus
gggcaaacatcaagttgctttccta

SEQ ID NO: 453327 - DNA, 25 bp, Rattus norvegicus
gggcaaacatcatgttgctttccta

SEQ ID NO: 453328 - DNA, 25 bp, Rattus norvegicus
gggcaaacattaattccagaactct

SEQ ID NO: 453329 - DNA, 25 bp, Rattus norvegicus
gggcaaacattatttccagaactct

SEQ ID NO: 453330 - DNA, 25 bp, Rattus norvegicus
gggcaaaccaagaacttcagcgttg

SEQ ID NO: 453331 - DNA, 25 bp, Rattus norvegicus
gggcaaaccaagtacttcagcgttg

SEQ ID NO: 453332 - DNA, 25 bp, Rattus norvegicus
gggcaaacccagatcctaacacttg

SEQ ID NO: 453333 - DNA, 25 bp, Rattus norvegicus
gggcaaacccagttcctaacacttg

SEQ ID NO: 453334 - DNA, 25 bp, Rattus norvegicus
gggcaaacctcaatccttggaagaa

SEQ ID NO: 453335 - DNA, 25 bp, Rattus norvegicus
gggcaaacctcattccttggaagaa

SEQ ID NO: 453336 - DNA, 25 bp, Rattus norvegicus
gggcaaacctgactttctgggtcta

SEQ ID NO: 453337 - DNA, 25 bp, Rattus norvegicus
gggcaaacctgagtttctgggtcta

SEQ ID NO: 453338 - DNA, 25 bp, Rattus norvegicus
gggcaaacgccacgtcctcatcagg

SEQ ID NO: 453339 - DNA, 25 bp, Rattus norvegicus
gggcaaacgccaggtcctcatcagg

SEQ ID NO: 453340 - DNA, 25 bp, Rattus norvegicus
gggcaaacgctacaagaactccttg

SEQ ID NO: 453341 - DNA, 25 bp, Rattus norvegicus
gggcaaacgctagaagaactccttg

SEQ ID NO: 453342 - DNA, 25 bp, Rattus norvegicus
gggcaaacgttcaagattgtactaa

SEQ ID NO: 453343 - DNA, 25 bp, Rattus norvegicus
gggcaaacgttctagattgtactaa

SEQ ID NO: 453344 - DNA, 25 bp, Rattus norvegicus
gggcaaactgccaaacgaataatca

SEQ ID NO: 453345 - DNA, 25 bp, Rattus norvegicus
gggcaaactgcctaacgaataatca

SEQ ID NO: 453346 - DNA, 25 bp, Rattus norvegicus
gggcaaactgctagggaacacttct

SEQ ID NO: 453347 - DNA, 25 bp, Rattus norvegicus
gggcaaactgcttgggaacacttct

SEQ ID NO: 453348 - DNA, 25 bp, Rattus norvegicus
gggcaaacttcacccctgatgagga

SEQ ID NO: 453349 - DNA, 25 bp, Rattus norvegicus
gggcaaacttcagccctgatgagga

SEQ ID NO: 453350 - DNA, 25 bp, Rattus norvegicus
gggcaaacttccctgtattcacagc

SEQ ID NO: 453351 - DNA, 25 bp, Rattus norvegicus
gggcaaacttccgtgtattcacagc

SEQ ID NO: 453352 - DNA, 25 bp, Rattus norvegicus
gggcaaagagtactggcgccttaac

SEQ ID NO: 453353 - DNA, 25 bp, Rattus norvegicus
gggcaaagagtagtggcgccttaac

SEQ ID NO: 453354 - DNA, 25 bp, Rattus norvegicus
gggcaaagagtcagagaccctgcct

SEQ ID NO: 453355 - DNA, 25 bp, Rattus norvegicus
gggcaaagagtctgagaccctgcct

SEQ ID NO: 453356 - DNA, 25 bp, Rattus norvegicus
gggcaaagcaatcgcgacatggtca

SEQ ID NO: 453357 - DNA, 25 bp, Rattus norvegicus
gggcaaagcaatggcgacatggtca

SEQ ID NO: 453358 - DNA, 25 bp, Rattus norvegicus
gggcaaagcactacatcactgcaaa

SEQ ID NO: 453359 - DNA, 25 bp, Rattus norvegicus
gggcaaagcactcatgttctgacaa

SEQ ID NO: 453360 - DNA, 25 bp, Rattus norvegicus
gggcaaagcactgatgttctgacaa

SEQ ID NO: 453361 - DNA, 25 bp, Rattus norvegicus
gggcaaagcacttcatcactgcaaa

SEQ ID NO: 453362 - DNA, 25 bp, Rattus norvegicus
gggcaaagcaggactccgggcccct

SEQ ID NO: 453363 - DNA, 25 bp, Rattus norvegicus
gggcaaagcaggtctccgggcccct

SEQ ID NO: 453364 - DNA, 25 bp, Rattus norvegicus
gggcaaagccatcccgtccacgttg

SEQ ID NO: 453365 - DNA, 25 bp, Rattus norvegicus
gggcaaagccatgccgtccacgttg

SEQ ID NO: 453366 - DNA, 25 bp, Rattus norvegicus
gggcaaaggccactgcattagtttt

SEQ ID NO: 453367 - DNA, 25 bp, Rattus norvegicus
gggcaaaggccagtgcattagtttt

SEQ ID NO: 453368 - DNA, 25 bp, Rattus norvegicus
gggcaaagtgccaccacctgaatat

SEQ ID NO: 453369 - DNA, 25 bp, Rattus norvegicus
gggcaaagtgcctccacctgaatat

SEQ ID NO: 453370 - DNA, 25 bp, Rattus norvegicus
gggcaaagtttaagcttgttaccaa

SEQ ID NO: 453371 - DNA, 25 bp, Rattus norvegicus
gggcaaagtttatgcttgttaccaa

SEQ ID NO: 453372 - DNA, 25 bp, Rattus norvegicus
gggcaaatacctcgccagacctgga

SEQ ID NO: 453373 - DNA, 25 bp, Rattus norvegicus
gggcaaatacctggccagacctgga

SEQ ID NO: 453374 - DNA, 25 bp, Rattus norvegicus
gggcaaatactcagacacactacaa

SEQ ID NO: 453375 - DNA, 25 bp, Rattus norvegicus
gggcaaatactctgacacactacaa

SEQ ID NO: 453376 - DNA, 25 bp, Rattus norvegicus
gggcaaatcggaccccagctttcca

SEQ ID NO: 453377 - DNA, 25 bp, Rattus norvegicus
gggcaaatcggagcccagctttcca

SEQ ID NO: 453378 - DNA, 25 bp, Rattus norvegicus
gggcaaatctaacagcatccattaa

SEQ ID NO: 453379 - DNA, 25 bp, Rattus norvegicus
gggcaaatctaagagcatccattaa

SEQ ID NO: 453380 - DNA, 25 bp, Rattus norvegicus
gggcaaatcttaacatgctctgtac

SEQ ID NO: 453381 - DNA, 25 bp, Rattus norvegicus
gggcaaatcttatcatgctctgtac

SEQ ID NO: 453382 - DNA, 25 bp, Rattus norvegicus
gggcaaatgcccaatgaatgtacaa

SEQ ID NO: 453383 - DNA, 25 bp, Rattus norvegicus
gggcaaatgccctatgaatgtacaa

SEQ ID NO: 453384 - DNA, 25 bp, Rattus norvegicus
gggcaaatgttgcatcctttccttg

SEQ ID NO: 453385 - DNA, 25 bp, Rattus norvegicus
gggcaaatgttggatcctttccttg

SEQ ID NO: 453386 - DNA, 25 bp, Rattus norvegicus
gggcaaattaatctgtagctcagtt

SEQ ID NO: 453387 - DNA, 25 bp, Rattus norvegicus
gggcaaattaatgtgtagctcagtt

SEQ ID NO: 453388 - DNA, 25 bp, Rattus norvegicus
gggcaaattccaccttcaactttta

SEQ ID NO: 453389 - DNA, 25 bp, Rattus norvegicus
gggcaaattccagcttcaactttta

SEQ ID NO: 453390 - DNA, 25 bp, Rattus norvegicus
gggcaaattcccagacaaactgcaa

SEQ ID NO: 453391 - DNA, 25 bp, Rattus norvegicus
gggcaaattccctgacaaactgcaa

SEQ ID NO: 453392 - DNA, 25 bp, Rattus norvegicus
gggcaacaacctcctcactgagaag

SEQ ID NO: 453393 - DNA, 25 bp, Rattus norvegicus
gggcaacaacctgctcactgagaag

SEQ ID NO: 453394 - DNA, 25 bp, Rattus norvegicus
gggcaacaattaacctaagtcctca

SEQ ID NO: 453395 - DNA, 25 bp, Rattus norvegicus
gggcaacaattatcctaagtcctca

SEQ ID NO: 453396 - DNA, 25 bp, Rattus norvegicus
gggcaacacagactgaattccatgg

SEQ ID NO: 453397 - DNA, 25 bp, Rattus norvegicus
gggcaacacagagtgaattccatgg

SEQ ID NO: 453398 - DNA, 25 bp, Rattus norvegicus
gggcaacaccaacgacagcatctat

SEQ ID NO: 453399 - DNA, 25 bp, Rattus norvegicus
gggcaacaccaaggacagcatctat

SEQ ID NO: 453400 - DNA, 25 bp, Rattus norvegicus
gggcaacaccctcagcaatggtgtg

SEQ ID NO: 453401 - DNA, 25 bp, Rattus norvegicus
gggcaacaccctcagtcttggtgtg

SEQ ID NO: 453402 - DNA, 25 bp, Rattus norvegicus
gggcaacaccctgagcaatggtgtg

SEQ ID NO: 453403 - DNA, 25 bp, Rattus norvegicus
gggcaacaccctgagtcttggtgtg

SEQ ID NO: 453404 - DNA, 25 bp, Rattus norvegicus
gggcaacacgttccatgtgtacact

SEQ ID NO: 453405 - DNA, 25 bp, Rattus norvegicus
gggcaacacgttgcatgtgtacact

SEQ ID NO: 453406 - DNA, 25 bp, Rattus norvegicus
gggcaacacttcaacaccatggaaa

SEQ ID NO: 453407 - DNA, 25 bp, Rattus norvegicus
gggcaacacttctacaccatggaaa

SEQ ID NO: 453408 - DNA, 25 bp, Rattus norvegicus
gggcaacagcatcggcacgtctcat

SEQ ID NO: 453409 - DNA, 25 bp, Rattus norvegicus
gggcaacagcatgggcacgtctcat

SEQ ID NO: 453410 - DNA, 25 bp, Rattus norvegicus
gggcaacaggttactcttctgtaga

SEQ ID NO: 453411 - DNA, 25 bp, Rattus norvegicus
gggcaacaggtttctcttctgtaga

SEQ ID NO: 453412 - DNA, 25 bp, Rattus norvegicus
gggcaacagtgaccttgttactttt

SEQ ID NO: 453413 - DNA, 25 bp, Rattus norvegicus
gggcaacagtgagcttgttactttt

SEQ ID NO: 453414 - DNA, 25 bp, Rattus norvegicus
gggcaacagtgcctaaactgcaacc

SEQ ID NO: 453415 - DNA, 25 bp, Rattus norvegicus
gggcaacagtgcgtaaactgcaacc

SEQ ID NO: 453416 - DNA, 25 bp, Rattus norvegicus
gggcaacataataccatcttttatc

SEQ ID NO: 453417 - DNA, 25 bp, Rattus norvegicus
gggcaacataattccatcttttatc

SEQ ID NO: 453418 - DNA, 25 bp, Rattus norvegicus
gggcaacatcaacgtcattttagtg

SEQ ID NO: 453419 - DNA, 25 bp, Rattus norvegicus
gggcaacatcaaggtcattttagtg

SEQ ID NO: 453420 - DNA, 25 bp, Rattus norvegicus
gggcaaccacatcctgaagatgtat

SEQ ID NO: 453421 - DNA, 25 bp, Rattus norvegicus
gggcaaccacatgctgaagatgtat

SEQ ID NO: 453422 - DNA, 25 bp, Rattus norvegicus
gggcaacccacacaatgtctacatg

SEQ ID NO: 453423 - DNA, 25 bp, Rattus norvegicus
gggcaacccacagaatgtctacatg

SEQ ID NO: 453424 - DNA, 25 bp, Rattus norvegicus
gggcaacccacgactaccgttatca

SEQ ID NO: 453425 - DNA, 25 bp, Rattus norvegicus
gggcaacccacgtctaccgttatca

SEQ ID NO: 453426 - DNA, 25 bp, Rattus norvegicus
gggcaaccctgaatgacagttgtta

SEQ ID NO: 453427 - DNA, 25 bp, Rattus norvegicus
gggcaaccctgattgacagttgtta

SEQ ID NO: 453428 - DNA, 25 bp, Rattus norvegicus
gggcaaccggccacaatagcattaa

SEQ ID NO: 453429 - DNA, 25 bp, Rattus norvegicus
gggcaaccggcctcaatagcattaa

SEQ ID NO: 453430 - DNA, 25 bp, Rattus norvegicus
gggcaacctaggctacttcaaaagt

SEQ ID NO: 453431 - DNA, 25 bp, Rattus norvegicus
gggcaacctagggtacttcaaaagt

SEQ ID NO: 453432 - DNA, 25 bp, Rattus norvegicus
gggcaacctgagactgtgacctaca

SEQ ID NO: 453433 - DNA, 25 bp, Rattus norvegicus
gggcaacctgagtctgtgacctaca

SEQ ID NO: 453434 - DNA, 25 bp, Rattus norvegicus
gggcaacctgcaagtgaagttcact

SEQ ID NO: 453435 - DNA, 25 bp, Rattus norvegicus
gggcaacctgcatgtgaagttcact

SEQ ID NO: 453436 - DNA, 25 bp, Rattus norvegicus
gggcaacctgttaacctggcttagc

SEQ ID NO: 453437 - DNA, 25 bp, Rattus norvegicus
gggcaacctgtttacctggcttagc

SEQ ID NO: 453438 - DNA, 25 bp, Rattus norvegicus
gggcaacctttgatactctgttatt

SEQ ID NO: 453439 - DNA, 25 bp, Rattus norvegicus
gggcaacctttgttactctgttatt

SEQ ID NO: 453440 - DNA, 25 bp, Rattus norvegicus
gggcaacggtgccaaagaccctcga

SEQ ID NO: 453441 - DNA, 25 bp, Rattus norvegicus
gggcaacggtgcgaaagaccctcga

SEQ ID NO: 453442 - DNA, 25 bp, Rattus norvegicus
gggcaacgtcaaagtggcagctctc

SEQ ID NO: 453443 - DNA, 25 bp, Rattus norvegicus
gggcaacgtcaatgtggcagctctc

SEQ ID NO: 453444 - DNA, 25 bp, Rattus norvegicus
gggcaacgttgaacctacatattgg

SEQ ID NO: 453445 - DNA, 25 bp, Rattus norvegicus
gggcaacgttgatcctacatattgg

SEQ ID NO: 453446 - DNA, 25 bp, Rattus norvegicus
gggcaactacgacacactggtttcc

SEQ ID NO: 453447 - DNA, 25 bp, Rattus norvegicus
gggcaactacgagacactggtttcc

SEQ ID NO: 453448 - DNA, 25 bp, Rattus norvegicus
gggcaactcatgaagtacacttaca

SEQ ID NO: 453449 - DNA, 25 bp, Rattus norvegicus
gggcaactcatgtagtacacttaca

SEQ ID NO: 453450 - DNA, 25 bp, Rattus norvegicus
gggcaactccaaactctaattgaca

SEQ ID NO: 453451 - DNA, 25 bp, Rattus norvegicus
gggcaactccaatctctaattgaca

SEQ ID NO: 453452 - DNA, 25 bp, Rattus norvegicus
gggcaactccatctctattaagcac

SEQ ID NO: 453453 - DNA, 25 bp, Rattus norvegicus
gggcaactccatgtctattaagcac

SEQ ID NO: 453454 - DNA, 25 bp, Rattus norvegicus
gggcaactcttcaatgaccgcctct

SEQ ID NO: 453455 - DNA, 25 bp, Rattus norvegicus
gggcaactcttctatgaccgcctct

SEQ ID NO: 453456 - DNA, 25 bp, Rattus norvegicus
gggcaactcttgaaggaccccaagg

SEQ ID NO: 453457 - DNA, 25 bp, Rattus norvegicus
gggcaactcttgtaggaccccaagg

SEQ ID NO: 453458 - DNA, 25 bp, Rattus norvegicus
gggcaactgctgctgcataagttac

SEQ ID NO: 453459 - DNA, 25 bp, Rattus norvegicus
gggcaactgctggtgcataagttac

SEQ ID NO: 453460 - DNA, 25 bp, Rattus norvegicus
gggcaactgtaacctttctactcaa

SEQ ID NO: 453461 - DNA, 25 bp, Rattus norvegicus
gggcaactgtaagctttctactcaa

SEQ ID NO: 453462 - DNA, 25 bp, Rattus norvegicus
gggcaactgtctctgggcccatcac

SEQ ID NO: 453463 - DNA, 25 bp, Rattus norvegicus
gggcaactgtctgtgggcccatcac

SEQ ID NO: 453464 - DNA, 25 bp, Rattus norvegicus
gggcaacttccacataatagctttt

SEQ ID NO: 453465 - DNA, 25 bp, Rattus norvegicus
gggcaacttccagataatagctttt

SEQ ID NO: 453466 - DNA, 25 bp, Rattus norvegicus
gggcaacttcgtcgacctgggtcta

SEQ ID NO: 453467 - DNA, 25 bp, Rattus norvegicus
gggcaacttcgtggacctgggtcta

SEQ ID NO: 453468 - DNA, 25 bp, Rattus norvegicus
gggcaactttacaatctgctcatat

SEQ ID NO: 453469 - DNA, 25 bp, Rattus norvegicus
gggcaactttactatctgctcatat

SEQ ID NO: 453470 - DNA, 25 bp, Rattus norvegicus
gggcaactttggaggaagcttcgca

SEQ ID NO: 453471 - DNA, 25 bp, Rattus norvegicus
gggcaactttggtggaagcttcgca

SEQ ID NO: 453472 - DNA, 25 bp, Rattus norvegicus
gggcaagaattccagagccacgcct

SEQ ID NO: 453473 - DNA, 25 bp, Rattus norvegicus
gggcaagaattcgagagccacgcct

SEQ ID NO: 453474 - DNA, 25 bp, Rattus norvegicus
gggcaagacagcctcctcagaaata

SEQ ID NO: 453475 - DNA, 25 bp, Rattus norvegicus
gggcaagacagcgtcctcagaaata

SEQ ID NO: 453476 - DNA, 25 bp, Rattus norvegicus
gggcaagacctaccaacagtgagat

SEQ ID NO: 453477 - DNA, 25 bp, Rattus norvegicus
gggcaagacctagcaacagtgagat

SEQ ID NO: 453478 - DNA, 25 bp, Rattus norvegicus
gggcaagactgacctccagataaat

SEQ ID NO: 453479 - DNA, 25 bp, Rattus norvegicus
gggcaagactgacctgcagccaaga

SEQ ID NO: 453480 - DNA, 25 bp, Rattus norvegicus
gggcaagactgagctccagataaat

SEQ ID NO: 453481 - DNA, 25 bp, Rattus norvegicus
gggcaagactgagctgcagccaaga

SEQ ID NO: 453482 - DNA, 25 bp, Rattus norvegicus
gggcaagactgcaaacttttttata

SEQ ID NO: 453483 - DNA, 25 bp, Rattus norvegicus
gggcaagactgctaacttttttata

SEQ ID NO: 453484 - DNA, 25 bp, Rattus norvegicus
gggcaagagcccaggacgctcagac

SEQ ID NO: 453485 - DNA, 25 bp, Rattus norvegicus
gggcaagagccctggacgctcagac

SEQ ID NO: 453486 - DNA, 25 bp, Rattus norvegicus
gggcaagagctcatgctgaggtcct

SEQ ID NO: 453487 - DNA, 25 bp, Rattus norvegicus
gggcaagagctcttgctgaggtcct

SEQ ID NO: 453488 - DNA, 25 bp, Rattus norvegicus
gggcaagagctgcagacattcgatc

SEQ ID NO: 453489 - DNA, 25 bp, Rattus norvegicus
gggcaagagctggagacattcgatc

SEQ ID NO: 453490 - DNA, 25 bp, Rattus norvegicus
gggcaagatctaattcttcatcctt

SEQ ID NO: 453491 - DNA, 25 bp, Rattus norvegicus
gggcaagatctatttcttcatcctt

SEQ ID NO: 453492 - DNA, 25 bp, Rattus norvegicus
gggcaagatctgatattctggtcca

SEQ ID NO: 453493 - DNA, 25 bp, Rattus norvegicus
gggcaagatctgttattctggtcca

SEQ ID NO: 453494 - DNA, 25 bp, Rattus norvegicus
gggcaagatgcaatcactgtatcca

SEQ ID NO: 453495 - DNA, 25 bp, Rattus norvegicus
gggcaagatgcattcactgtatcca

SEQ ID NO: 453496 - DNA, 25 bp, Rattus norvegicus
gggcaagcaagtattgttgttgttt

SEQ ID NO: 453497 - DNA, 25 bp, Rattus norvegicus
gggcaagcaagttttgttgttgttt

SEQ ID NO: 453498 - DNA, 25 bp, Rattus norvegicus
gggcaagcacacacttgtttcacca

SEQ ID NO: 453499 - DNA, 25 bp, Rattus norvegicus
gggcaagcacactcttgtttcacca

SEQ ID NO: 453500 - DNA, 25 bp, Rattus norvegicus
gggcaagcactacactcgacacaaa

SEQ ID NO: 453501 - DNA, 25 bp, Rattus norvegicus
gggcaagcactagactcgacacaaa

SEQ ID NO: 453502 - DNA, 25 bp, Rattus norvegicus
gggcaagcacttcatcggagacttc

SEQ ID NO: 453503 - DNA, 25 bp, Rattus norvegicus
gggcaagcacttgatcggagacttc

SEQ ID NO: 453504 - DNA, 25 bp, Rattus norvegicus
gggcaagcagaacctgattctctgg

SEQ ID NO: 453505 - DNA, 25 bp, Rattus norvegicus
gggcaagcagaagctgattctctgg

SEQ ID NO: 453506 - DNA, 25 bp, Rattus norvegicus
gggcaagcagctcagtgcaataatt

SEQ ID NO: 453507 - DNA, 25 bp, Rattus norvegicus
gggcaagcagctgagtgcaataatt

SEQ ID NO: 453508 - DNA, 25 bp, Rattus norvegicus
gggcaagcatacatcctgactgtac

SEQ ID NO: 453509 - DNA, 25 bp, Rattus norvegicus
gggcaagcatacttcctgactgtac

SEQ ID NO: 453510 - DNA, 25 bp, Rattus norvegicus
gggcaagcatatacaaagcaccaca

SEQ ID NO: 453511 - DNA, 25 bp, Rattus norvegicus
gggcaagcatattcaaagcaccaca

SEQ ID NO: 453512 - DNA, 25 bp, Rattus norvegicus
gggcaagcatcaagcttttccccaa

SEQ ID NO: 453513 - DNA, 25 bp, Rattus norvegicus
gggcaagcatcatgcttttccccaa

SEQ ID NO: 453514 - DNA, 25 bp, Rattus norvegicus
gggcaagcatctatacctattgaat

SEQ ID NO: 453515 - DNA, 25 bp, Rattus norvegicus
gggcaagcatctttacctattgaat

SEQ ID NO: 453516 - DNA, 25 bp, Rattus norvegicus
gggcaagcattcagtacacatgcat

SEQ ID NO: 453517 - DNA, 25 bp, Rattus norvegicus
gggcaagcattctgtacacatgcat

SEQ ID NO: 453518 - DNA, 25 bp, Rattus norvegicus
gggcaagccacgatgtgttctgaac

SEQ ID NO: 453519 - DNA, 25 bp, Rattus norvegicus
gggcaagccacgttgtgttctgaac

SEQ ID NO: 453520 - DNA, 25 bp, Rattus norvegicus
gggcaagccaggagctctcaacaga

SEQ ID NO: 453521 - DNA, 25 bp, Rattus norvegicus
gggcaagccaggtgctctcaacaga

SEQ ID NO: 453522 - DNA, 25 bp, Rattus norvegicus
gggcaagccatgctcagattttcat

SEQ ID NO: 453523 - DNA, 25 bp, Rattus norvegicus
gggcaagccatggtcagattttcat

SEQ ID NO: 453524 - DNA, 25 bp, Rattus norvegicus
gggcaagcctaaccaggtctgcaaa

SEQ ID NO: 453525 - DNA, 25 bp, Rattus norvegicus
gggcaagcctaagcaggtctgcaaa

SEQ ID NO: 453526 - DNA, 25 bp, Rattus norvegicus
gggcaagcctagatgtttatttaac

SEQ ID NO: 453527 - DNA, 25 bp, Rattus norvegicus
gggcaagcctagttgtttatttaac

SEQ ID NO: 453528 - DNA, 25 bp, Rattus norvegicus
gggcaagcctcgaagttttactctg

SEQ ID NO: 453529 - DNA, 25 bp, Rattus norvegicus
gggcaagcctcgtagttttactctg

SEQ ID NO: 453530 - DNA, 25 bp, Rattus norvegicus
gggcaagcctgaaccatgggacaga

SEQ ID NO: 453531 - DNA, 25 bp, Rattus norvegicus
gggcaagcctgatccatgggacaga

SEQ ID NO: 453532 - DNA, 25 bp, Rattus norvegicus
gggcaagccttaaaccttgtttcac

SEQ ID NO: 453533 - DNA, 25 bp, Rattus norvegicus
gggcaagccttataccttgtttcac

SEQ ID NO: 453534 - DNA, 25 bp, Rattus norvegicus
gggcaagcgttgcactgtgtcatac

SEQ ID NO: 453535 - DNA, 25 bp, Rattus norvegicus
gggcaagcgttggactgtgtcatac

SEQ ID NO: 453536 - DNA, 25 bp, Rattus norvegicus
gggcaagctactccaagcagcaagt

SEQ ID NO: 453537 - DNA, 25 bp, Rattus norvegicus
gggcaagctactgcaagcagcaagt

SEQ ID NO: 453538 - DNA, 25 bp, Rattus norvegicus
gggcaagctctaatccttgggcaaa

SEQ ID NO: 453539 - DNA, 25 bp, Rattus norvegicus
gggcaagctctattccttgggcaaa

SEQ ID NO: 453540 - DNA, 25 bp, Rattus norvegicus
gggcaagctgttaattagagttttg

SEQ ID NO: 453541 - DNA, 25 bp, Rattus norvegicus
gggcaagctgttcctcatggctccg

SEQ ID NO: 453542 - DNA, 25 bp, Rattus norvegicus
gggcaagctgttgctcatggctccg

SEQ ID NO: 453543 - DNA, 25 bp, Rattus norvegicus
gggcaagctgtttattagagttttg

SEQ ID NO: 453544 - DNA, 25 bp, Rattus norvegicus
gggcaagctttactgtactttagct

SEQ ID NO: 453545 - DNA, 25 bp, Rattus norvegicus
gggcaagctttagtgtactttagct

SEQ ID NO: 453546 - DNA, 25 bp, Rattus norvegicus
gggcaaggcccaaatctcagcctat

SEQ ID NO: 453547 - DNA, 25 bp, Rattus norvegicus
gggcaaggcccatatctcagcctat

SEQ ID NO: 453548 - DNA, 25 bp, Rattus norvegicus
gggcaaggcttgctcttacaactca

SEQ ID NO: 453549 - DNA, 25 bp, Rattus norvegicus
gggcaaggcttggtcttacaactca

SEQ ID NO: 453550 - DNA, 25 bp, Rattus norvegicus
gggcaagggaaactcttcagctcct

SEQ ID NO: 453551 - DNA, 25 bp, Rattus norvegicus
gggcaagggaaagtcttcagctcct

SEQ ID NO: 453552 - DNA, 25 bp, Rattus norvegicus
gggcaaggtgccaattacctactta

SEQ ID NO: 453553 - DNA, 25 bp, Rattus norvegicus
gggcaaggtgcctattacctactta

SEQ ID NO: 453554 - DNA, 25 bp, Rattus norvegicus
gggcaaggttccacacaactaaagt

SEQ ID NO: 453555 - DNA, 25 bp, Rattus norvegicus
gggcaaggttcctcacaactaaagt

SEQ ID NO: 453556 - DNA, 25 bp, Rattus norvegicus
gggcaagtatttctaccagtctgtc

SEQ ID NO: 453557 - DNA, 25 bp, Rattus norvegicus
gggcaagtatttgtaccagtctgtc

SEQ ID NO: 453558 - DNA, 25 bp, Rattus norvegicus
gggcaagtcacgattccttgtgcag

SEQ ID NO: 453559 - DNA, 25 bp, Rattus norvegicus
gggcaagtcacgtttccttgtgcag

SEQ ID NO: 453560 - DNA, 25 bp, Rattus norvegicus
gggcaagtcagtcctgcagttgtca

SEQ ID NO: 453561 - DNA, 25 bp, Rattus norvegicus
gggcaagtcagtgctgcagttgtca

SEQ ID NO: 453562 - DNA, 25 bp, Rattus norvegicus
gggcaagtcttgcagaaccttctag

SEQ ID NO: 453563 - DNA, 25 bp, Rattus norvegicus
gggcaagtcttggagaaccttctag

SEQ ID NO: 453564 - DNA, 25 bp, Rattus norvegicus
gggcaagtgccaatctccaatatcc

SEQ ID NO: 453565 - DNA, 25 bp, Rattus norvegicus
gggcaagtgccattctccaatatcc

SEQ ID NO: 453566 - DNA, 25 bp, Rattus norvegicus
gggcaagtgctcaactccaaatgtg

SEQ ID NO: 453567 - DNA, 25 bp, Rattus norvegicus
gggcaagtgctctactccaaatgtg

SEQ ID NO: 453568 - DNA, 25 bp, Rattus norvegicus
gggcaagttcatctacataacccca

SEQ ID NO: 453569 - DNA, 25 bp, Rattus norvegicus
gggcaagttcatgtacataacccca

SEQ ID NO: 453570 - DNA, 25 bp, Rattus norvegicus
gggcaagttcgacctaactgggatc

SEQ ID NO: 453571 - DNA, 25 bp, Rattus norvegicus
gggcaagttcgagctaactgggatc

SEQ ID NO: 453572 - DNA, 25 bp, Rattus norvegicus
gggcaagttctaaccactggacttt

SEQ ID NO: 453573 - DNA, 25 bp, Rattus norvegicus
gggcaagttctatccactggacttt

SEQ ID NO: 453574 - DNA, 25 bp, Rattus norvegicus
gggcaagtttggatgcatctactca

SEQ ID NO: 453575 - DNA, 25 bp, Rattus norvegicus
gggcaagtttggttgcatctactca

SEQ ID NO: 453576 - DNA, 25 bp, Rattus norvegicus
gggcaataaaccacaacctcaggga

SEQ ID NO: 453577 - DNA, 25 bp, Rattus norvegicus
gggcaataaacctcaacctcaggga

SEQ ID NO: 453578 - DNA, 25 bp, Rattus norvegicus
gggcaatacagaccagtcacatctt
